United States Patent 7,709,616 (MICRORNAS AND USES THEREOF) - sequence listing, part 4

SEQ ID NO: 82626 - RNA, 64 nt, hsa
ggugguuuagagauaauccaaaaucaggguuugguuuggggaagaaaauccucccccuuccucc

SEQ ID NO: 82627 - RNA, 64 nt, hsa
aaaaaaaaaaaaaaaguuuuuaugugcacuuaaauuuggggacaauuuuauguaucuguguuaa

SEQ ID NO: 82628 - RNA, 64 nt, hsa
uucucccuaccccacaaaucuuuugguacuaccauuuggggaagccaagcaaggauaguaaauu

SEQ ID NO: 82629 - RNA, 64 nt, hsa
uaugcaucguucuacacagguuuaaaacaacuuuuuuggggauuuagggcuauuauaggaauag

SEQ ID NO: 82630 - RNA, 64 nt, hsa
uuuuaaagaugacauaaauaaguuuaaauaucaauuuggggaguaagguuuaauauugccaucg

SEQ ID NO: 82631 - RNA, 64 nt, hsa
aauaacuuggguguuuaggagucuuuucacauuuuuuggggauaugaacuagauguucaagaac

SEQ ID NO: 82632 - RNA, 64 nt, hsa
uuaccucccuucucaaauucgguaagacaguaguuuuggggaacuuuuuugcccaugugucuuu

SEQ ID NO: 82633 - RNA, 64 nt, hsa
guaguacuggcuccaccccuuggugcuggcaguguuuggggacauuaugcuggaaagagcuccu

SEQ ID NO: 82634 - RNA, 64 nt, hsa
gaaaauugaaacacagaguuguucugcugauaguuuuggggauacguccaucuuuuuaagggau

SEQ ID NO: 82635 - RNA, 64 nt, hsa
cuuugaaaagagaauauuuacaauauaugacuaauuuggggaaaaugaaguuuugauuuauuug

SEQ ID NO: 82636 - RNA, 64 nt, hsa
gggggguccagacuaccugaugccccuuccccaauuuggggacuuuuugauaauauaaauauau

SEQ ID NO: 82637 - RNA, 64 nt, hsa
cuuggcugagcuucuacagggcugagagcugcgcuuuggggacuucagccuuccuuccagucug

SEQ ID NO: 82638 - RNA, 64 nt, hsa
uauauaguuuuuaccuuuuauguagcacauaaacuuuggggaagggagggcaggguggggcuga

SEQ ID NO: 82639 - RNA, 64 nt, hsa
agauaaauauuugacuugcaugaagagaagcaauuuuggggaaggguuugaauuguuuucuuua

SEQ ID NO: 82640 - RNA, 64 nt, hsa
auaagguugaguauuuauuagaugggaagggaaauuuggggauuauuuauccuccuggggacag

SEQ ID NO: 82641 - RNA, 64 nt, hsa
gaaauuuggggauuauuuauccuccuggggacaguuuggggaggauuauuuauuguauuuauau

SEQ ID NO: 82642 - RNA, 64 nt, hsa
gagcaaaccccaaaccaguauauuuuaguauuuguuuggggaggggaacaagccaauaaagaug

SEQ ID NO: 82643 - RNA, 64 nt, hsa
uacuggauuuuguaaucuaggauaaaucacuuuuuuuggggacuuugauuuugcuccauuacgu

SEQ ID NO: 82644 - RNA, 64 nt, hsa
uuuuuauuucaaaaaaaauguauagaaacuuguauuuggggauucaaaggggauugcuacacca

SEQ ID NO: 82645 - RNA, 64 nt, hsa
gauuaggcuacauaaaaugggcugaggguaccuuuuuggggagaugggguggccugcagugaca

SEQ ID NO: 82646 - RNA, 64 nt, hsa
uaugccaccuuuuaaaccaauggaaauugcuauauuuggggaugucauacauuugauauugcuu

SEQ ID NO: 82647 - RNA, 64 nt, hsa
auaaguuugguaaacuuuagucccauuauauacuuuuggggacaguguuauaaaucagaauuuu

SEQ ID NO: 82648 - RNA, 64 nt, hsa
aagauuaaaaaaacaacaacaacaacuuauuuaguuuggggaggggaagcauuuuuaagugugu

SEQ ID NO: 82649 - RNA, 64 nt, hsa
gcagagacucuauagcugucucuuagggcaguauuuuggggaaguggggcuugaagaagcagcc

SEQ ID NO: 82650 - RNA, 64 nt, hsa
caagcagaaaacaagagaaagaaagaacguucccuuuggggauagucuggaaaguugggauuug

SEQ ID NO: 82651 - RNA, 64 nt, hsa
cccugccucuuccgguuggaggcucucaugucucuuuggggagagcuggcagugugcggagcug

SEQ ID NO: 82652 - RNA, 64 nt, hsa
ggcaucaguuguagcccacaaacauggcuagggcuuuggggauuuggcauuuuucuggugguuu

SEQ ID NO: 82653 - RNA, 64 nt, hsa
acaucaacuucuuucucuccguuccugaaggaacuuuggggaaucaucuucauccguaguuacg

SEQ ID NO: 82654 - RNA, 64 nt, hsa
cagggacucucgucugugggacgggauccaagaguuuggggauuagggguauuagggcuuuuca

SEQ ID NO: 82655 - RNA, 64 nt, hsa
ggacacgaugaagcaccggcuccauaagacaccuuuuggggaagugguugugcauauuuuauuu

SEQ ID NO: 82656 - RNA, 64 nt, hsa
ucauggguguuuuugucaacugcuuguuaauugauuuggggauguuugccccgaaugagagguu

SEQ ID NO: 82657 - RNA, 64 nt, hsa
ucuguuuccucuugaucucaaagcacaauguggauuuggggaccaaaggucagggacacauccc

SEQ ID NO: 82658 - RNA, 64 nt, hsa
uuauauuuuccauaucugugggcuuuguucuacauuuggggagcuuuuuauauuguuuauuuca

SEQ ID NO: 82659 - RNA, 64 nt, hsa
gaagauacaaaggcacaagaaugauacaauggauuuuggggacuuaggggaaaggaugcagggg

SEQ ID NO: 82660 - RNA, 64 nt, hsa
aucuccaggccaccagaacccugaugaccuugaauuuggggaguggggagaguggauggacuag

SEQ ID NO: 82661 - RNA, 64 nt, hsa
ccccaggugugaagaccccugccccacugguaccuuuggggaagacuguggcucuaccugcccc

SEQ ID NO: 82662 - RNA, 64 nt, hsa
aacuuccaucuggucugaccgcaaacaguguuuauuuggggacagggguugggaugggggugug

SEQ ID NO: 82663 - RNA, 64 nt, hsa
uggagugguccccagaagcauccaagaaaagauauuuggggacguagccuaacauuuuaccaac

SEQ ID NO: 82664 - RNA, 64 nt, hsa
gggcaucucccugccacagguggagcugaccggcuuuggggaggcagguaccccagggcagcag

SEQ ID NO: 82665 - RNA, 64 nt, hsa
auggugaaaugacaggcaagaaguggggaugauguuuggggaacaagauacuugacccagcaca

SEQ ID NO: 82666 - RNA, 64 nt, hsa
aaaguggaugauggagaaauaaaaugugguuuucuuuggggacuggaauuuuguaucauauuuu

SEQ ID NO: 82667 - RNA, 64 nt, hsa
uccagagacaacuuaggaugagggcagaaaagucuuuggggaugauucagucuguaccagacau

SEQ ID NO: 82668 - RNA, 64 nt, hsa
acuacccccucccugccaucuuuucuucugcuacuuuggggaguugauggccaggaaagaagcc

SEQ ID NO: 82669 - RNA, 64 nt, hsa
cauguccaguccucuucuucccucugcuggaaccuuuggggacacucaaggguacaguuugaca

SEQ ID NO: 82670 - RNA, 64 nt, hsa
ccaguuauccccgaaauuucuauguauuauauuuuuuggggaagugaggugugcccaguuuuuu

SEQ ID NO: 82671 - RNA, 64 nt, hsa
gaggugugcccaguuuuuuaaucuaacaacuacuuuuggggacuugcccacaucucugggauuu

SEQ ID NO: 82672 - RNA, 64 nt, hsa
cagugcucgggaucccgggcccagcuuuugccuuuuuggggaugcuuggugagacagauuugcc

SEQ ID NO: 82673 - RNA, 64 nt, hsa
agcucugaaggggucuccuaguuccagauuuuaauuuggggaacagaucuggguucuuuuuaac

SEQ ID NO: 82674 - RNA, 64 nt, hsa
ggaaagguacccuaaucguucaacagcaaucaucuuuggggaaugggcauuuugguagguaaag

SEQ ID NO: 82675 - RNA, 64 nt, hsa
uguggaaaaaaaucuccaaauuguaguuuuuaaauuuggggaaugcaaauauauauauauauac

SEQ ID NO: 82676 - RNA, 64 nt, hsa
ucuagugugaagccaaauagugaucuuuuagugcuuuggggauggggugggcugggguggaugg

SEQ ID NO: 82677 - RNA, 64 nt, hsa
cagagagauaaggaacaaaaguguuuucuguuguuuuggggaagugaaauaugugguugguagg

SEQ ID NO: 82678 - RNA, 63 nt, hsa
cgucagcccgaguucugaauuaaaacaugccucccacagaaucuauuucugaugaauaugaaa

SEQ ID NO: 82679 - RNA, 63 nt, hsa
ugaggccuccccagaagcagaagcauguaaagcccacagaaccgugaguugauuaaaucucuu

SEQ ID NO: 82680 - RNA, 63 nt, hsa
caagugacgacaaagauucuguuucaaauauagccacagaaauaaaggagggaccaauaucug

SEQ ID NO: 82681 - RNA, 63 nt, hsa
caagugacgagaaagauucuguuucaaauauagccacagaaauaaagaagggacaacaaucug

SEQ ID NO: 82682 - RNA, 63 nt, hsa
caacugacgaggaagacucuguuucgaauauagccacagaaauaaaggauggagaaaaaucug

SEQ ID NO: 82683 - RNA, 63 nt, hsa
caacugaugagaaagauucuguuucgaacauagccacagaaauaaaggauggagaaaaaucug

SEQ ID NO: 82684 - RNA, 63 nt, hsa
ucuaguaacuuaagugagagagaaagggcagcgccacagaagccccuaaacgccgccucguca

SEQ ID NO: 82685 - RNA, 63 nt, hsa
ggauccuuuuggggcuggagacugagucuugaaccacagaagggaauaaauuauacaccacug

SEQ ID NO: 82686 - RNA, 63 nt, hsa
aaaaaaaaaaaaaucagaaaacccccaccuaauccacagaaaguaaugucuuuccccuccccu

SEQ ID NO: 82687 - RNA, 63 nt, hsa
uucaggucacgcagcccuguacuguauccagcaccacagaaaccucaguguuuuuccucugcu

SEQ ID NO: 82688 - RNA, 63 nt, hsa
aauucaguguauccguuauuuuaaugcacuacaccacagaaauguuaaguuggucaagggcuu

SEQ ID NO: 82689 - RNA, 63 nt, hsa
aaacccuucccuccaggaggcccccgcugacucccacagaaacccaccuaccauaagaugucu

SEQ ID NO: 82690 - RNA, 63 nt, hsa
uggcagugagaccagcccacccaccaccacccaccacagaaaagcacaaaccucugggaaaga

SEQ ID NO: 82691 - RNA, 63 nt, hsa
aaacacacccaccagugcagccugaaguaacucccacagaaaccaucaucgucuuuguacauc

SEQ ID NO: 82692 - RNA, 63 nt, hsa
caagacagcugaaggagaaugaaacacacacauccacagaaacagagaggcguagguggcccu

SEQ ID NO: 82693 - RNA, 63 nt, hsa
cccacccacccugcaccccucgcccuccccccaccacagaaucuaagaccuuucagcuucgag

SEQ ID NO: 82694 - RNA, 63 nt, hsa
aaaaaaaugccaugaaacauuugaacugaugagccacagaacuucaguugaaauuuuuuucac

SEQ ID NO: 82695 - RNA, 63 nt, hsa
caaauuuuccaauuugaaccaguggggaaaaucccacagaaaucaguaaguuuacauuucaau

SEQ ID NO: 82696 - RNA, 63 nt, hsa
uaaucggguacuaccagucuugaaauuuugccaccacagaaagaaagauguuuuuaaaagcuu

SEQ ID NO: 82697 - RNA, 63 nt, hsa
uagucuccauuucauagaugaaaauagugaagcccacagaaaauaaguagcuccuccacaggu

SEQ ID NO: 82698 - RNA, 63 nt, hsa
agggaccacccuccccacaguaugcacucagccccacagaacccaccagucuuucugggaacu

SEQ ID NO: 82699 - RNA, 63 nt, hsa
ccauucccucccagccuccgcucugccucccuuccacagaagcccucuucgggcagccccccu

SEQ ID NO: 82700 - RNA, 63 nt, hsa
cuuucaccauuuuauauacaaaggggaccagugccacagaaggguacccgaagaaaugagaag

SEQ ID NO: 82701 - RNA, 63 nt, hsa
uauacauccagauggccugaaguuacugaagauccacagaagugaaaauagccuuaacugaug

SEQ ID NO: 82702 - RNA, 63 nt, hsa
uacuucaaagugucaggagagugaagaaauuggccacagaagagcaagaagcucucuuaagaa

SEQ ID NO: 82703 - RNA, 63 nt, hsa
agaggcacugcccaucucuucuccaccuucucuccacagaauguuugcagagcugggcaguug

SEQ ID NO: 82704 - RNA, 64 nt, hsa
gaaaagccauagcccggcagccccuaccaugagggagacagagaaacagaacugguggugcugg

SEQ ID NO: 82705 - RNA, 64 nt, hsa
caaaguugucccaacagaggaggccagugaggcagagacagagcucucccacucucagacccuc

SEQ ID NO: 82706 - RNA, 64 nt, hsa
agaccagcggagugggagggagacgcaguagacagagacagaccgagagaggaauggagagaca

SEQ ID NO: 82707 - RNA, 64 nt, hsa
gcaguagacagagacagaccgagagaggaauggagagacagagggggcgcgcgcacaggagccu

SEQ ID NO: 82708 - RNA, 64 nt, hsa
ccacgcccggcuaauuuuuguuuuguuuuguuuggagacagagucucgcuauugucaccagggc

SEQ ID NO: 82709 - RNA, 64 nt, hsa
uuuuuuuuucuuucuuucuuucuuuuuuuuuuuugagacagaaucucgcucugucgcccaggcu

SEQ ID NO: 82710 - RNA, 64 nt, hsa
uagccucacucagcccagggauagccaguguugggagacagaguugccucagguucccaggggc

SEQ ID NO: 82711 - RNA, 64 nt, hsa
ggacccggaagaaucaucuaccucccagcuuugugagacagaaccaaguaaaaggaaacaugcu

SEQ ID NO: 82712 - RNA, 64 nt, hsa
caggucuagagaaaugauaccuuuuuuuuuuuuugagacagagucucacucuguugcccaggcu

SEQ ID NO: 82713 - RNA, 64 nt, hsa
guagugggguuuuuugguuuuguuuguuuguuuugagacagagucuugcucugucgccgaggcu

SEQ ID NO: 82714 - RNA, 64 nt, hsa
ugguauucucaacagcaaaggggugaaaaaucuagagacagaggaggccuggcaggggugauaa

SEQ ID NO: 82715 - RNA, 64 nt, hsa
cuuggaguggcacaaguugggggaaagcgcacuugagacagagguaaugauggggacgaaguga

SEQ ID NO: 82716 - RNA, 64 nt, hsa
uugaaucccuaaaugcaccugucuuucacuuuuugagacagacugaauauaucuaaaauuucca

SEQ ID NO: 82717 - RNA, 64 nt, hsa
uuuguauaauuuugaacacuauaauagcaauucagagacagacauuguuaaagguuugauguau

SEQ ID NO: 82718 - RNA, 64 nt, hsa
ugauacaggguugguucucauuucgugccgaaaugagacagaaauucagugacgaaggugcguu

SEQ ID NO: 82719 - RNA, 64 nt, hsa
auguaaguaaucuuuuauuuuuuauuuuuuuuuugagacagagucucacucugucacccaggcu

SEQ ID NO: 82720 - RNA, 64 nt, hsa
uuacagcaguuucaaaaaugacaaagucaguuuggagacagaaaaagacaaaagguccagucuc

SEQ ID NO: 82721 - RNA, 64 nt, hsa
acuccuuguuauccuuguuuccuuagcuugguaugagacagaucggauccaguuucccaugcac

SEQ ID NO: 82722 - RNA, 64 nt, hsa
aaaaaugcaucuggcuacuuuuucauguauguaugagacagaaacuaauccuuacuauccuauu

SEQ ID NO: 82723 - RNA, 64 nt, hsa
uugaccaccuugggcuggcacucuuagcacaccugagacagauuuaagccucccuaagagacug

SEQ ID NO: 82724 - RNA, 64 nt, hsa
cgagagagauuggcuuuuuauuccagucuaggcagagacagaagaauguugaauaagagcacga

SEQ ID NO: 82725 - RNA, 64 nt, hsa
agguugacuuaauuuauuuauuuuuugaaaagaagagacagaaaauaccuuauuaucugcaggg

SEQ ID NO: 82726 - RNA, 64 nt, hsa
agaagccuuccccugcaaggugcccaccugcccggagacagagggagcagcugaggccucucuc

SEQ ID NO: 82727 - RNA, 64 nt, hsa
uuuaaauggcacuauguaguaauuaagagcuaaggagacagaaagacaguagaugagaauagaa

SEQ ID NO: 82728 - RNA, 64 nt, hsa
uaggcguuguggugaauaugcaggaaucauucaugagacagaauguauuuuguuguaugacaga

SEQ ID NO: 82729 - RNA, 64 nt, hsa
ucgggaaaggaucaucgccguugaaaugaaaagagagacagagagaaaaaaaaaaagagaaccc

SEQ ID NO: 82730 - RNA, 64 nt, hsa
ugaaaccaaacagcauccugccaugagcuucccagagacagaagagacuggagcaaagucggaa

SEQ ID NO: 82731 - RNA, 64 nt, hsa
gguucaagcgauuccuuuuuuuuuuuuuuuuuuugagacagagucucacucugucccccaggcu

SEQ ID NO: 82732 - RNA, 64 nt, hsa
cuacccuuuuuuuuuuuuaaucuuuuauuuuuuugagacagagucucacucugucacccagacu

SEQ ID NO: 82733 - RNA, 64 nt, hsa
aaaagacaaacagaaauagacacacacaccagcagagacagaaacagcaauagccaggacuccu

SEQ ID NO: 82734 - RNA, 64 nt, hsa
gagacugcucuaccaauagaucuuuguuuguuuugagacagaaucuugaucuguuacccaggcu

SEQ ID NO: 82735 - RNA, 64 nt, hsa
gacaaaaagacagagagauguagagacagugauagagacagaggaacaaaaagagcagcaguga

SEQ ID NO: 82736 - RNA, 64 nt, hsa
gagcagcagugagaaggcaaagagagaggcagaagagacagacgaggcagagacaaaacacuga

SEQ ID NO: 82737 - RNA, 64 nt, hsa
uguguguguaugagagagagagagagagacaacagagacagagagaggcagagaggcauagaga

SEQ ID NO: 82738 - RNA, 64 nt, hsa
acaacagagacagagagaggcagagaggcauagagagacagagagagagacaagaaacagagau

SEQ ID NO: 82739 - RNA, 64 nt, hsa
aggcacugugcuaggugcugggaauaccacugaugagacagacaaggucccuacucuuguggag

SEQ ID NO: 82740 - RNA, 64 nt, hsa
gucccuacucuuguggaguuuacuucugguggaggagacagaugauaaguaaacaaauaaauaa

SEQ ID NO: 82741 - RNA, 64 nt, hsa
aggagggcaugggagggagggagagguggggagggagacagagacagaaacagagagagacaga

SEQ ID NO: 82742 - RNA, 64 nt, hsa
gcaugggagggagggagagguggggagggagacagagacagaaacagagagagacagagacaga

SEQ ID NO: 82743 - RNA, 64 nt, hsa
gagguggggagggagacagagacagaaacagagagagacagagacagagagagacugagggaga

SEQ ID NO: 82744 - RNA, 64 nt, hsa
gggagggagacagagacagaaacagagagagacagagacagagagagacugagggagagacucu

SEQ ID NO: 82745 - RNA, 64 nt, hsa
ggaauaguuaaaugcauuuguuuguuuguuuuuugagacagaguuucacucuuguugcccaggc

SEQ ID NO: 82746 - RNA, 64 nt, hsa
ccagccaucaaugcauuuuuuuuauuuuuuuuuugagacagaguuucgcacuucuugcccaggc

SEQ ID NO: 82747 - RNA, 64 nt, hsa
ccauauaauucaccuucuuuuuuuuuuuuugucugagacagaaucucagucugucacccagguu

SEQ ID NO: 82748 - RNA, 64 nt, hsa
caccagaauuaauuuuauuauucuuauuauuuuugagacagagucuuacucuguugccaggcug

SEQ ID NO: 82749 - RNA, 64 nt, hsa
caccgcgcccagccuuuuuguuuuuuuuuuuuuugagacagagucuuccucugucuccuaagcu

SEQ ID NO: 82750 - RNA, 64 nt, hsa
uccccugccuggaacuggcugugaagacccaggagagacagagaugcgaaccacccaaaacacg

SEQ ID NO: 82751 - RNA, 64 nt, hsa
acccaaaacacgcacacccugccccuggugcccugagacagacacacagccucacgcccccagg

SEQ ID NO: 82752 - RNA, 64 nt, hsa
cuguggcaggaggacgcaucccaaucgggagggagagacagagacagagccgauggggccagag

SEQ ID NO: 82753 - RNA, 64 nt, hsa
caggaggacgcaucccaaucgggagggagagacagagacagagccgauggggccagagcaggca

SEQ ID NO: 82754 - RNA, 64 nt, hsa
cgcugguagacuuuuguuaaaagagagagagacagagacagagaaauaagcauuagagaccugc

SEQ ID NO: 82755 - RNA, 64 nt, hsa
ugaggccgcugguagacuuuuguuaaaagagagagagacagagacagagaaauaagcauuagag

SEQ ID NO: 82756 - RNA, 64 nt, hsa
agcucagcagugacuggggagcuggucugccucagagacagaguagggggugggagcagagccu

SEQ ID NO: 82757 - RNA, 64 nt, hsa
aacacuaccuuucucauugguuucuaagucaguagagacagaucuguuuuaagcaguugggggu

SEQ ID NO: 82758 - RNA, 64 nt, hsa
gaacgaaucgauguaagauuccuccuuuagggcagagacagaccacugacaaauacacagauag

SEQ ID NO: 82759 - RNA, 64 nt, hsa
aauauuuaaagccaaacaaauccaucuuuucugagagacagaaacuaaaaaauucagaguuaau

SEQ ID NO: 82760 - RNA, 64 nt, hsa
uccggagugagaagcuuugcccuccuaagagagagagacagagagacagagagagagaaagaga

SEQ ID NO: 82761 - RNA, 64 nt, hsa
gagaagcuuugcccuccuaagagagagagacagagagacagagagagagaaagagagagugugu

SEQ ID NO: 82762 - RNA, 64 nt, hsa
gguagaugcaugacuugugugugaugagagaauggagacagagucccuggcuccucuacuguuu

SEQ ID NO: 82763 - RNA, 64 nt, hsa
auuggggaaacggggugaacuucagguggaugaggagacagaauagagugauaggaagcgucug

SEQ ID NO: 82764 - RNA, 64 nt, hsa
uuucuuugauuuuauucuuuuuuuuuuuuucugugagacagaguuucacucuuguugcccaggc

SEQ ID NO: 82765 - RNA, 64 nt, hsa
ggcccuuguuuucuuugauuuuauucuuuuuuuugagacagaauuucacucuucucacccaggc

SEQ ID NO: 82766 - RNA, 64 nt, hsa
gagagggagagaggcagagagggagagaggcagagagacagagagggagagagggacagagaga

SEQ ID NO: 82767 - RNA, 64 nt, hsa
gagacagagagggagagagagacagagggagagagagacagaggggaagagaggcagagaggga

SEQ ID NO: 82768 - RNA, 64 nt, hsa
agggagagaaacagaggagacagagagggagagagagacagagggagagagagacagaggggaa

SEQ ID NO: 82769 - RNA, 64 nt, hsa
gagacagaggaggcagagagggagagaaacagaggagacagagagggagagagagacagaggga

SEQ ID NO: 82770 - RNA, 64 nt, hsa
agguggggagaggggagagagauaugaggagagagagacagaggaggcagagagggagagaaac

SEQ ID NO: 82771 - RNA, 64 nt, hsa
ccaccaugcccagcuaauuuuuguauuuuuaguagagacagaguuucaccauauuagccuggcu

SEQ ID NO: 82772 - RNA, 64 nt, hsa
gcagacagcugcugggggaaauccugggguccuugagacagaggcaggacccucguguucccag

SEQ ID NO: 82773 - RNA, 64 nt, hsa
acuaagaagcuugaaucuacuuuuuuuuuuuuuugagacagagucuggcucugucacccaggcu

SEQ ID NO: 82774 - RNA, 64 nt, hsa
uuuauuuuauuuauuuuuauuuuuauuuuuauuugagacagagucucacucuguugcccaggcu

SEQ ID NO: 82775 - RNA, 64 nt, hsa
cgggcgggccgccagagcagcuuuuuacaauccagagacagaaaacaaaaucuagaugcaacag

SEQ ID NO: 82776 - RNA, 64 nt, hsa
gagggaacccugggcagggcucuggugggagagggagacagauggaggcaguggcuggugggcc

SEQ ID NO: 82777 - RNA, 64 nt, hsa
accacagcccagcuaauuuuuuguauuuuuaguagagacagaguuuugcuauguuggccaggcu

SEQ ID NO: 82778 - RNA, 64 nt, hsa
ccaaaaagaaaaugaggguaauucagcuuauucugagacagacauuccuggcaauguaccauac

SEQ ID NO: 82779 - RNA, 64 nt, hsa
agacccagagggcagcgucagacacccagaguuggagacagaacaacagagucucagggaaaga

SEQ ID NO: 82780 - RNA, 64 nt, hsa
gacgcagaagagaggaacagaaauccagaguggggagacagagaccaagagcaggggauagaag

SEQ ID NO: 82781 - RNA, 64 nt, hsa
gagacccagaaaaaggaagagguggaaacccagagagacagagacccaaagggagagaaacaga

SEQ ID NO: 82782 - RNA, 64 nt, hsa
gagagagguuucuuucuuucuuuuuuuuuuuuuugagacagagucugguucuguuucccaggcu

SEQ ID NO: 82783 - RNA, 64 nt, hsa
ugggcaucagugcagcugauaucguuugaggagggagacagaugcuuggaccugggugccuggc

SEQ ID NO: 82784 - RNA, 64 nt, hsa
cugccuccaucucugccuccauggcuaccuuuaggagacagagaagauccuguguguuucucug

SEQ ID NO: 82785 - RNA, 64 nt, hsa
aagucuuuuggggagagaaugacauuuuuuuuuugagacagaguuuugcucuuguugcccaggc

SEQ ID NO: 82786 - RNA, 64 nt, hsa
ucugccccuugugaaggcccauuccuggcacuuagagacagaaagaacucagcaaucuuucguu

SEQ ID NO: 82787 - RNA, 64 nt, hsa
uccuagguuuugagauuuagagcaaugcauucuggagacagaaccagcagaacagccauuuuuc

SEQ ID NO: 82788 - RNA, 64 nt, hsa
aacugcuguauucaugaaucuugagaguguuccugagacagaauuaauggucauuugggaaaac

SEQ ID NO: 82789 - RNA, 64 nt, hsa
gaggagacacagacacagagcaggaggacacguggagacagaggcagacuggagugaugcggcc

SEQ ID NO: 82790 - RNA, 64 nt, hsa
agcacccuaaaugccaugacagguguccuuccaagagacagaagaggagacacagacacagagc

SEQ ID NO: 82791 - RNA, 64 nt, hsa
ugguggcggguagacaagggaugccugggcugacugggcagaggaaccucuagcucugacuguc

SEQ ID NO: 82792 - RNA, 64 nt, hsa
ucagucucaacaggagccagucuucuggagccucugggcagaacccuccaucagaguggaaauc

SEQ ID NO: 82793 - RNA, 64 nt, hsa
gagcucauggugagggauacccaucccauaugccugggcagaaggaagacuucaucccucuggg

SEQ ID NO: 82794 - RNA, 64 nt, hsa
gcacagcugggguggggaccucaggccugggggcugggcagaggaaagcaaaggagauuggaag

SEQ ID NO: 82795 - RNA, 64 nt, hsa
uuuuuucuugguaaagccaugcaccacagacuucugggcagagcugagagacaaugguccugac

SEQ ID NO: 82796 - RNA, 64 nt, hsa
gccauggguaaccucauuguaacuaucaucagaaugggcagagaugaucuugaagugucacaua

SEQ ID NO: 82797 - RNA, 64 nt, hsa
aagauggcgugcacaggacacagcgugggcggccugggcagaagggcggcuggcuguccuggag

SEQ ID NO: 82798 - RNA, 64 nt, hsa
aaggggaaaaccacuugagucuugugguguguggugggcagacaccacaggguggcaucaccug

SEQ ID NO: 82799 - RNA, 64 nt, hsa
caguauaugauaguucugcugauguuuuguuuauugggcagacauaucuucauuaagaguuuuu

SEQ ID NO: 82800 - RNA, 64 nt, hsa
uaucuugguuauuaaacaguaucugggacugguuugggcagaauauuaaacuuauuuuguugcc

SEQ ID NO: 82801 - RNA, 64 nt, hsa
acaccuauaaucccagcaauuugggaggccaaggugggcagaucacuugaggucaggaguucgc

SEQ ID NO: 82802 - RNA, 64 nt, hsa
auauuuugauuaagauuucuauuaacuuuuuggcugggcagaguggcuuacaccuauaauccca

SEQ ID NO: 82803 - RNA, 64 nt, hsa
gagcacaaacuuucugggccuccauccuaggaccugggcagacccacauggccugggcucugaa

SEQ ID NO: 82804 - RNA, 64 nt, hsa
gacgguggguucugcaucagcaaacgcugaggagugggcagauuuucuuugucuuuugcuugca

SEQ ID NO: 82805 - RNA, 64 nt, hsa
uuugucucuuguuaaaccagacccugggcuugucugggcagagacagaagcugauuuaacagca

SEQ ID NO: 82806 - RNA, 64 nt, hsa
acaaauuacaguaaaaaugugcucuuuuuuaaggugggcagauuaguuugucaaagucucagcc

SEQ ID NO: 82807 - RNA, 64 nt, hsa
uuuuucuacugaaaacaauuuagaaagaagcuauugggcagaaacagauauagaucaauaccug

SEQ ID NO: 82808 - RNA, 64 nt, hsa
uugagagcaagguagaggaaggagucccagccucugggcagaccagaggcccagagggagagag

SEQ ID NO: 82809 - RNA, 64 nt, hsa
aggcuccaggaaguugagggacccacaggagaggugggcagagcuggaguucucauccagggcu

SEQ ID NO: 82810 - RNA, 64 nt, hsa
cuguggcgcggggcauccuaugaggcaggcacccugggcagagagaugcagugggugcgggggg

SEQ ID NO: 82811 - RNA, 61 nt, hsa
uggacgaggaccagcugugaggcgggcgcccugggcagagagacucuguggcgcggggcau

SEQ ID NO: 82812 - RNA, 64 nt, hsa
gugggaggaggccugcacaggcuggaggaggguuugggcagagcgaagacccggccaggaccuu

SEQ ID NO: 82813 - RNA, 64 nt, hsa
agaugaguuuuaggaccagcauuacuaaggcaggugggcagacagugaccucucuagguguguc

SEQ ID NO: 82814 - RNA, 64 nt, hsa
aucuuagcagaugggaggaacugcugagagaagaugggcagaaagcuggagccccuggaguugg

SEQ ID NO: 82815 - RNA, 64 nt, hsa
uguguuugugacugauuacuggcugugucuugggugggcagaaacucgaacuugcuauguaauu

SEQ ID NO: 82816 - RNA, 64 nt, hsa
aauaagugaauggaagcaguggugguagcuacacugggcagaguuggcagggugcugguucacu

SEQ ID NO: 82817 - RNA, 64 nt, hsa
agggacugaggggaacccugggacaggcacaggcugggcagaggcacagggcagugcaggggac

SEQ ID NO: 82818 - RNA, 64 nt, hsa
uggaugggcucugcauguaaggggugaugcaugaugggcagaugcuggacauuugaggagccgu

SEQ ID NO: 82819 - RNA, 64 nt, hsa
gugauguugggagugggaucuccugaguccuuguugggcagaauuggugaggccagggauggca

SEQ ID NO: 82820 - RNA, 64 nt, hsa
uagggugguguggaggggcugguccccugacaccugggcagauggggucuccuucagucucccu

SEQ ID NO: 82821 - RNA, 64 nt, hsa
ugggggcagcuccucuucuucugacucagagcccugggcagaucagcagauacaugucagugca

SEQ ID NO: 82822 - RNA, 64 nt, hsa
auuucauucuaggcucacacuguccuugucaaggugggcagaagagcagaggucuucucugcac

SEQ ID NO: 82823 - RNA, 64 nt, hsa
cugggguccuguccugcaggaugcugcauaggaaugggcagagauguccuggaugggaacaugg

SEQ ID NO: 82824 - RNA, 64 nt, hsa
cucagaccagugaggggugauucagagguggggaugggcagagagggcuggccacucugccuca

SEQ ID NO: 82825 - RNA, 64 nt, hsa
gaaacaguuuguuaaucugauugggagaguuccaugggcagauuucccuuccugaaggccaaaa

SEQ ID NO: 82826 - RNA, 64 nt, hsa
ucugugagccuuuucauuucggugacagaagagaugggcagagcaacuuauuuuccacauuaaa

SEQ ID NO: 82827 - RNA, 64 nt, hsa
cucagggucagggaaugagccaggcacgggggcaugggcagagagggccacggggcagggccca

SEQ ID NO: 82828 - RNA, 64 nt, hsa
aagggaggggaaacuccaucaggaagugcuccccugggcagaggcgcccacugggugcuguggg

SEQ ID NO: 82829 - RNA, 64 nt, hsa
ugaaggaagcaggggcugaggaacacuuagagggugggcagaagcggggguucccagucugcuu

SEQ ID NO: 82830 - RNA, 64 nt, hsa
gaaagcugcgaauucucuuguccaaauaguggauugggcagacuggccuggaggaaaugcuaga

SEQ ID NO: 82831 - RNA, 64 nt, hsa
cugguguggaguccagggcugcuaggaaaaggaaugggcagacacagguguaugccaauguuuc

SEQ ID NO: 82832 - RNA, 64 nt, hsa
gcauggcccaaggccccaaguauaucaaggcacuugggcagaacaugccaaggaaucaaauguc

SEQ ID NO: 82833 - RNA, 64 nt, hsa
augccuguaaucccagcacuuugggaggccaaggugggcagaucaccugagaucaaguauuuga

SEQ ID NO: 82834 - RNA, 64 nt, hsa
ugggucacgugggccccgguacucaagaccagccugggcagaauggugaaaccaccuucucuac

SEQ ID NO: 82835 - RNA, 64 nt, hsa
gugccaucccaaauacuugggcagcagcucagcaugggcagacaugggggcuguggauucuucc

SEQ ID NO: 82836 - RNA, 64 nt, hsa
cuugguguggccguguccugagccucagugaggcugggcagauggucucggagccuccaugggg

SEQ ID NO: 82837 - RNA, 64 nt, hsa
cccuaagacagauuggcuuucuaaugaguuuaagugggcagaaguguaggguucaguguguccu

SEQ ID NO: 82838 - RNA, 64 nt, hsa
cagguacuugggacauggaaacucguuggauggcugggcagauguaagccuguccaugcaguca

SEQ ID NO: 82839 - RNA, 64 nt, hsa
caggggccuuugggugcuguuuugccagcccauuugggcagagaggcugugguuugggggagaa

SEQ ID NO: 82840 - RNA, 64 nt, hsa
ccccuuccugggcacacgcugcucugccccagcuugggcagaucucccacaugccaggggccuu

SEQ ID NO: 82841 - RNA, 64 nt, hsa
acaucccacugagagcggggguccugccccaucuuagagucaaaggcagaggggcuuccaggcc

SEQ ID NO: 82842 - RNA, 64 nt, hsa
aaugaaaauuguuuuucuacuucauuuuuccuuuuagagucaaaggauauuuauuuauaggccu

SEQ ID NO: 82843 - RNA, 64 nt, hsa
uagggcucagaguggugguuucugacuacauuucuagagucagagcuugaucaccacaacucaa

SEQ ID NO: 82844 - RNA, 64 nt, hsa
gauagcuugucccaugagcacagaagagccucaguagagucaaguccugcugcagcugccccac

SEQ ID NO: 82845 - RNA, 64 nt, hsa
ccuuacaauguaauguuagagauaaaggagcaaauagagucacgcaucacuuaaugacagagau

SEQ ID NO: 82846 - RNA, 64 nt, hsa
cuuauuuauuuccucuauuuguagcuuuuuguucuagagucagaacagguggacuuugcuuuga

SEQ ID NO: 82847 - RNA, 64 nt, hsa
augguuuuaaugcaaagcgccuuuuuugagcagguagagucacgcauccggcaggcggggcgag

SEQ ID NO: 82848 - RNA, 64 nt, hsa
uuagcugacacagauggucaccuccauuaccaaguagagucaggaugaacuaugugugacuguu

SEQ ID NO: 82849 - RNA, 64 nt, hsa
ggcaaaaucgugccacugcccucagccugggcaguagagucagucuccaucucaaagaaaccag

SEQ ID NO: 82850 - RNA, 64 nt, hsa
ugaguauagcaaaccaucaagcauuaauugacacuagagucaguccagcauugacuugaguuug

SEQ ID NO: 82851 - RNA, 64 nt, hsa
aagagcauggaugcauuucaaauguuagauauugcuacuauaaucaaaugauuucauauugauc

SEQ ID NO: 82852 - RNA, 64 nt, hsa
gaccucgcacuuucuguucuaaauauauuuauuccuacuauacaguaaaauacaucagacaaca

SEQ ID NO: 82853 - RNA, 64 nt, hsa
auauuuaaguuggauguacuuguuuuagguacaucuacuauacuuauucucucaaaccugggua

SEQ ID NO: 82854 - RNA, 64 nt, hsa
aaaaggaauucaaaucugaguaaauaacagccuccuacuauaggaauuagauucuucuauaaaa

SEQ ID NO: 82855 - RNA, 64 nt, hsa
uccuauagaaaaugccauuaauaaauuauaugaacuacuauacauuauguauauuaauuaaaac

SEQ ID NO: 82856 - RNA, 64 nt, hsa
uggcauccaagucuuggaaaaccgugugaagcaacuacuauaaacuugagucaucccgacguug

SEQ ID NO: 82857 - RNA, 64 nt, hsa
uuuuaauguguuugauagcuuugacgaggguucucuuuguuacuuucaggggagggcauccuau

SEQ ID NO: 82858 - RNA, 64 nt, hsa
agcccccuucuuggucccaugugaugucauccugcuuuguuaucuucuuauaacuuuauccugc

SEQ ID NO: 82859 - RNA, 64 nt, hsa
ggccccuuacuggugguuuuacagggggauccuacuuuguuacacauguuggguuuccugauaa

SEQ ID NO: 82860 - RNA, 64 nt, hsa
uccccauuuaaauuccuacaacuaagucucccugcuuuguuaauaguccaacaguuggguugug

SEQ ID NO: 82861 - RNA, 64 nt, hsa
augaauauugauaacuaaacuucauuucaguuuacuuuguuaugccuuaauauucugugucuuu

SEQ ID NO: 82862 - RNA, 64 nt, hsa
acauauaagaaaaaagucucuccccaagggcagccuuuguuacuuuuaaauauuuucuguuauu

SEQ ID NO: 82863 - RNA, 64 nt, hsa
uccuaauuacuugguggcuaauaaauguuacauucuuuguuacuuaaaugcauuauauaaacuc

SEQ ID NO: 82864 - RNA, 64 nt, hsa
aaaauaaaaguuagauaauggguuuuauggauuucuuuguuauaauauauuuucuaccauucca

SEQ ID NO: 82865 - RNA, 64 nt, hsa
auuaaugcguuggaaagaaagcugcuuguguuugcuuuguuaauugccucaggauauuucuuuu

SEQ ID NO: 82866 - RNA, 64 nt, hsa
ggauuuacugauaaugaucagucuuuagucuucccuuuguuauaugacuuuauagguuaugauu

SEQ ID NO: 82867 - RNA, 64 nt, hsa
aacaucuucagggcgggaaaggggccacuucuggcuuuguuagcaauaacugaccuucaguuua

SEQ ID NO: 82868 - RNA, 64 nt, hsa
uuuccuuuuuucaauguacauaguucaacucuuucuuuguuacauuuaaacuauauccauggau

SEQ ID NO: 82869 - RNA, 64 nt, hsa
uuugaaaaccaacaccaucacagcuuguuuuggacuuuguuacacuguuauuuucagcaugaaa

SEQ ID NO: 82870 - RNA, 64 nt, hsa
ucauagaauagcauguuguagauacaaucagcugcuuuguuaccuuaaaacuaggcauuuguaa

SEQ ID NO: 82871 - RNA, 64 nt, hsa
cugcacacuucaggcacuguaguugcugaagaugcuuuguuaaaugugaccuugacuggcuuua

SEQ ID NO: 82872 - RNA, 64 nt, hsa
cuuuuggugcaggcagccguuaaccuccugcuuccuuuguuaccucuggauuacuuugcaguaa

SEQ ID NO: 82873 - RNA, 64 nt, hsa
uaaauauuauuaauagcuuauuaaaggaaauggucuuuguuaauuccagucagauaauggcauu

SEQ ID NO: 82874 - RNA, 64 nt, hsa
agucuuuguuaugaugauugguguggcuuuaugucuuuguuauaaacuccuauuuuucaggggc

SEQ ID NO: 82875 - RNA, 64 nt, hsa
aagaaauguuacauguguacuccacaggcauagucuuuguuaugaugauugguguggcuuuaug

SEQ ID NO: 82876 - RNA, 64 nt, hsa
uugacucuuucaaaugcaaaaaaccuauuuuaugcuuuguuaaaauuauggugucacuuagauu

SEQ ID NO: 82877 - RNA, 64 nt, hsa
uuguuagaugagggaggaaaacucaacuguuucucuuuguuaucuaaauguuucagaauucaau

SEQ ID NO: 82878 - RNA, 64 nt, hsa
auuuuguaauuguuaaaaauagaguuaauuuugacuuuguuagaugagggaggaaaacucaacu

SEQ ID NO: 82879 - RNA, 64 nt, hsa
gacauguugacaggcagcaugguauguuuuuagccuuuguuacaguuuuagcaacauugauguc

SEQ ID NO: 82880 - RNA, 64 nt, hsa
gaaggauccagcuaggcccgugugguuagaucagcuuuguuacugaauuaccuaaaaccagacc

SEQ ID NO: 82881 - RNA, 64 nt, hsa
ccagauagugucagcuuauuugaagauuaauuuucuuuguuaacuuaaaauaacuauuuuaacc

SEQ ID NO: 82882 - RNA, 64 nt, hsa
guuggccauuauuugauuuuuguacgaaaaaaagcuuuguuauagaaaucagcauacuauuuuu

SEQ ID NO: 82883 - RNA, 64 nt, hsa
cuuauuaaauauuucauacacuuuauugcaacuacuuuguuauuucuacaucuuagauaaaugc

SEQ ID NO: 82884 - RNA, 64 nt, hsa
auaucuagguuuuuaaaacugaaguugaaauuaucuuuguuagcaguaguaguauagaauaaaa

SEQ ID NO: 82885 - RNA, 64 nt, hsa
cucucagaauuugguuuaaagcuggacagauuugcuuuguuauaggguaaagcuuugucuaaag

SEQ ID NO: 82886 - RNA, 64 nt, hsa
cacaaugcaucauuccuuuguuguugauaaugggcuuuguuagcacuuuuuaaaacaaacaaac

SEQ ID NO: 82887 - RNA, 64 nt, hsa
agucauuacaccaaguccauuuagagauaaugggcuuuguuagcacuuucaaaaaaaaaaaaag

SEQ ID NO: 82888 - RNA, 64 nt, hsa
accauuuccguaauucuuauuccauauuagaaaacuuuguuaggccaaagacaaauaguaggca

SEQ ID NO: 82889 - RNA, 64 nt, hsa
aguuuuauuuucuaaaguacugagcagugauauucuuuguuaauuuggaccauuuuccugcauu

SEQ ID NO: 82890 - RNA, 64 nt, hsa
cagcagaagaagcagccaugcccaguauucccacucuccaaaaggaacugaccagcuuauauuu

SEQ ID NO: 82891 - RNA, 64 nt, hsa
gucagaguuguggcucucagccauguagacacacucuccaaauggaguguuggaaaauguucuu

SEQ ID NO: 82892 - RNA, 64 nt, hsa
uaacuuggguuaggaagaaaauaauuagguauuuucuccaaauguucacugguacucugccacu

SEQ ID NO: 82893 - RNA, 64 nt, hsa
gcagauaaguagcaguucaacuggaugucucucuucuccaaaugcuacaguacaaagcccuaag

SEQ ID NO: 82894 - RNA, 64 nt, hsa
ugcacuccagccugggcaacagagugagacccugucuccaaagagaaagagaaacuugagaagg

SEQ ID NO: 82895 - RNA, 64 nt, hsa
auaagaaagaaucaaauaucuugcuuuugggucuucuccaaaguaaauugcauggacuucuuaa

SEQ ID NO: 82896 - RNA, 64 nt, hsa
cuuauuaauauuaagagacaguuuuucuauggcaucuccaaaacugcaugacaucacuagucuu

SEQ ID NO: 82897 - RNA, 64 nt, hsa
gugguucaagccaaacuggcagcauuuggcccaaucuccaaauuagagcaaguuaaauaauaua

SEQ ID NO: 82898 - RNA, 64 nt, hsa
ccaggcuguugauaccucagagccuucucuuuacucuccaaagugaaagggaagcccccgucuc

SEQ ID NO: 82899 - RNA, 64 nt, hsa
gagugcagaaauguggcuuuugccccacuuugcaucuccaaaauuacaacgguuggccgauccc

SEQ ID NO: 82900 - RNA, 64 nt, hsa
gaagcugagcuuucuuuauucaaccucauucccuucuccaaauaagccacuuguguaguugggc

SEQ ID NO: 82901 - RNA, 64 nt, hsa
uguccccaggaccuaugcucccugcucacccccuucuccaaagcccaagcgucccgcugcucau

SEQ ID NO: 82902 - RNA, 64 nt, hsa
uuggugccuuggaaaguagagagcaacagacacaucuccaaaugggcaaggagucucuagcaug

SEQ ID NO: 82903 - RNA, 64 nt, hsa
ccacugcauuccaaccugggugaugaagugagacucuccaaaaaaaaaaaagaaauuauuaauc

SEQ ID NO: 82904 - RNA, 64 nt, hsa
ccaacuuaggcucuuuauuaauugguuaagguuuucuccaaaaagggcauuucaacaaugggaa

SEQ ID NO: 82905 - RNA, 64 nt, hsa
aucuuuuuccauguugugcagaucaguuucacuaucuccaaagcauuugcaucaugaccuuaua

SEQ ID NO: 82906 - RNA, 64 nt, hsa
uuuguagucauguaaaacuuaagugcuucaugccucuccaaaugugguuauucuaauaaaugga

SEQ ID NO: 82907 - RNA, 64 nt, hsa
ugcacuccagccugggugacagagugagacucugucuccaaaaaaaaacuuugcuuguauauua

SEQ ID NO: 82908 - RNA, 64 nt, hsa
ucuacauauuauucaugaagcauaauguugcauuucuccaaauuuuaugccugaaaggguagug

SEQ ID NO: 82909 - RNA, 64 nt, hsa
aaccacgggcuguuuaggaggaugccugcuugggucuccaaauggcugggguaggaaugguugu

SEQ ID NO: 82910 - RNA, 64 nt, hsa
cugacacaggcugacacauucuuucuccuuuccuucuccaaaggcuuggaguuuucuucugagg

SEQ ID NO: 82911 - RNA, 64 nt, hsa
aaugaggaugcuguuacuuggccauuucuucccaucuccaaaaauccagagacauuacgagagc

SEQ ID NO: 82912 - RNA, 64 nt, hsa
ucugaaaugggauaauggccagaguagcugaaaaucuccaaaugggcauuugcaugccuaucuc

SEQ ID NO: 82913 - RNA, 64 nt, hsa
aauccucacuaugcuauuugguaccuaaaaauauucuccaaacccuugcugccaguuccucuuu

SEQ ID NO: 82914 - RNA, 64 nt, hsa
uguguucuaaccagaaagaaaggauuuguauuacucuccaaaucuacuguacugucagcuucac

SEQ ID NO: 82915 - RNA, 64 nt, hsa
gaccuagggauccugagagggagagacugcaauuucuccaaagcuugccacuuuccagccuguu

SEQ ID NO: 82916 - RNA, 64 nt, hsa
cuacuuccuccuagcaaccaacuuuaccucuucuucuccaaaggaucuuuguuccucugagcca

SEQ ID NO: 82917 - RNA, 64 nt, hsa
ugcacuccagccugggcaacagagcaagacuccgucuccaaaaaaaaaaaaaaaaaaaaagaau

SEQ ID NO: 82918 - RNA, 64 nt, hsa
ugcacuggcccccaaggucagcucccugggucugucuccaaaaaugguugcugaugacaucacc

SEQ ID NO: 82919 - RNA, 64 nt, hsa
auuucaugucuuacugaaacauuuugccagacuuucuccaaaugaaaccugaaucaauuuuucu

SEQ ID NO: 82920 - RNA, 64 nt, hsa
auacuuggcuuggaaauuuaacacaguccuuuugucuccaaagcccuucuucuuuccaccacaa

SEQ ID NO: 82921 - RNA, 64 nt, hsa
uugauaggauccauaucuaauaauggauucgaacucuccaaacuacaccaauuaauuuaaugua

SEQ ID NO: 82922 - RNA, 64 nt, hsa
cugcauacuuaccuauguggacuauaauaaccugucuccaaaaccaugccauaauaauauaagu

SEQ ID NO: 82923 - RNA, 64 nt, hsa
aauuauugauuuuuaaauuaugggagcaaauccaucuccaaacaugauacucuugggccaauga

SEQ ID NO: 82924 - RNA, 64 nt, hsa
ugcacuccagccugggcgacagugcaagacucugucuccaaaaaaaaaaaaagaaaaaagaaaa

SEQ ID NO: 82925 - RNA, 64 nt, hsa
cgcuaugcuacuggauuuguauaaauacugauauucuccaaaccuagugguguagggagcaaga

SEQ ID NO: 82926 - RNA, 64 nt, hsa
gauccuggucuagcugaaucuucagagugggaggucuccaaaaagauauuaccuuauugggcuu

SEQ ID NO: 82927 - RNA, 64 nt, hsa
gccaagucugaagaaucagaggcaacuucaugguucuccaaagaagagcccguuacuaucaguc

SEQ ID NO: 82928 - RNA, 64 nt, hsa
agcucggagucaaucccaggaaaauaugcgaaguucuccaaacccauuuauuacuggcuugacc

SEQ ID NO: 82929 - RNA, 64 nt, hsa
caucuucccugaagcccccaaucuggccccccccuccccagacuuccuccccaaaacaccccag

SEQ ID NO: 82930 - RNA, 64 nt, hsa
uggccuggcuggagccaggaacaggagggacacuuccccagaauccgcauguuuccccagugau

SEQ ID NO: 82931 - RNA, 64 nt, hsa
uaacauuaccuaaaaggcacuaacaugcucagguuccccagaaagaggcguaagaagggccucu

SEQ ID NO: 82932 - RNA, 64 nt, hsa
gagcuucaaggcucacaauggaagcacugucauuuccccagaaaagcuguguucccuaugcuga

SEQ ID NO: 82933 - RNA, 64 nt, hsa
aauuuuccaaaacagccuguucucuccucucuccuccccagagcacccccugccaucagggggg

SEQ ID NO: 82934 - RNA, 64 nt, hsa
cucugagcacgggcucuucccgccggguccucccuccccagaccccagagggagaggcccaccc

SEQ ID NO: 82935 - RNA, 64 nt, hsa
gucagaggauguggccaccugacccuaaauagguuccccagaguccugccccucuaaugaauga

SEQ ID NO: 82936 - RNA, 64 nt, hsa
caccaccugccuugugaccacaucucccaccacguccccagaucucaagaacgcagcucagcuu

SEQ ID NO: 82937 - RNA, 64 nt, hsa
aagucucuaucgcucuuccccucuccucggccacuccccagauaccagaccugaggcaauucac

SEQ ID NO: 82938 - RNA, 64 nt, hsa
ucagaaggcuaacuugagagguuuggggccuuguuccccagaggguccccagggacucugcagu

SEQ ID NO: 82939 - RNA, 64 nt, hsa
ccucuaagcacuuuacacauauuagcucauucaguccccagacagacgggaugaaguagguauu

SEQ ID NO: 82940 - RNA, 64 nt, hsa
ugcuuuuuaccuuuugcuguuugcuguggcagauuccccagauaaccaaggaaaaggggccacc

SEQ ID NO: 82941 - RNA, 64 nt, hsa
agaaaucagugccaagcaugcgauauucagagucuccccagaccggcagucaucauggcaguuu

SEQ ID NO: 82942 - RNA, 64 nt, hsa
gacugguucagcuagcucuccugagcagggacgcuccccagaaccaacagaaaucagugccaag

SEQ ID NO: 82943 - RNA, 64 nt, hsa
uacauucuccucuggggcucuaccucuccacacuuccccagaagggaaaagggcacccuggauu

SEQ ID NO: 82944 - RNA, 64 nt, hsa
gaaaucacuccuuggugggcagcauccugaggcuuccccagaaccaggccucugcucuggcccu

SEQ ID NO: 82945 - RNA, 64 nt, hsa
gggagcauccagaacugcuaccuuccuagauguuuccccagaccgcuggcugagauucccucac

SEQ ID NO: 82946 - RNA, 64 nt, hsa
gcacgggguucgcgcaccaggugucuuuuuccaguccccagaagcagagagcacagccccugcu

SEQ ID NO: 82947 - RNA, 64 nt, hsa
cccuguggagcagaacgggaaccaccugcagagguccccagacccaaagcaggacgggagacaa

SEQ ID NO: 82948 - RNA, 64 nt, hsa
cugugggugagccaggccaacauuggugucccuguccccagagggaggagcaggcaggagagag

SEQ ID NO: 82949 - RNA, 64 nt, hsa
acagacgcuggaugcccuccuaccgccagacaccuccccagaggccuuggaccuccuuaggcga

SEQ ID NO: 82950 - RNA, 64 nt, hsa
cuucaccuggcccucuguuccugccccagccccuuccccagaccccucuccagucuccugcacc

SEQ ID NO: 82951 - RNA, 64 nt, hsa
agcucacaugggacugggauaugggggcaucucuuccccagagaggcacucagugagccuccug

SEQ ID NO: 82952 - RNA, 64 nt, hsa
cguuggccggcggcuacucuggaauguuuuucccuccccagaaucaagcuuuugcuugauccag

SEQ ID NO: 82953 - RNA, 64 nt, hsa
ugggaagcaguuagggagauagcgacccggaguuuccccagaagcggggugggagggugugcau

SEQ ID NO: 82954 - RNA, 64 nt, hsa
cagccccguucggcucagaccgacccccacuccauccccagaccugcagcacaagugcgcgggc

SEQ ID NO: 82955 - RNA, 64 nt, hsa
cacagacccucaugcacucucuuacgugccauucuccccagacuuuuuuuguacuuaauguaug

SEQ ID NO: 82956 - RNA, 64 nt, hsa
ggagaggagggcccuguccggcauguguggguauuccccagaagcauuugccuccugcugagcc

SEQ ID NO: 82957 - RNA, 64 nt, hsa
ggaaggagggagccgggagccuggugggaagccuuccccagagagauggcuuuaggggcuuuau

SEQ ID NO: 82958 - RNA, 64 nt, hsa
acaacugggcccuggaccagcaccacuuccgagguccccagacccccugagcccucccagggac

SEQ ID NO: 82959 - RNA, 64 nt, hsa
cgaacaggagccccccuccacagauguccccccauccccagaggcuggaggaacaacugggccc

SEQ ID NO: 82960 - RNA, 64 nt, hsa
gagauauucuuucuucugccuuggaguucggcccuccccagacuucacuuaugcuagucuaaga

SEQ ID NO: 82961 - RNA, 64 nt, hsa
gguaugacauucaaagcuaccagaagcaucaugguccccagacccuguaccugccuguaacucu

SEQ ID NO: 82962 - RNA, 64 nt, hsa
aucucccaggaggaaguggaggggacaucgcuguuccccagaaacccacucuauccucacccug

SEQ ID NO: 82963 - RNA, 64 nt, hsa
accgggaacagggauuugcccuucacaauucuacuccccagauccucuccccuggacacaggag

SEQ ID NO: 82964 - RNA, 64 nt, hsa
gcgccacuuuguauauuucaggacugggaccuacuccccagaugccaccugagaggagcuucug

SEQ ID NO: 82965 - RNA, 64 nt, hsa
guggagcugugcucccuugagugcacuugagcacuccccagaccagaucacuuuuuggacacac

SEQ ID NO: 82966 - RNA, 64 nt, hsa
agccagucucuggcuguggcuccccagaacaggauccccagaagcaggcugaagaggaaaggca

SEQ ID NO: 82967 - RNA, 64 nt, hsa
aaggagagcccaggagccagucucuggcuguggcuccccagaacaggauccccagaagcaggcu

SEQ ID NO: 82968 - RNA, 64 nt, hsa
ccccagccccacuaucaguguccagcgugcugguuccccagagcacagcucagcaucacacuga

SEQ ID NO: 82969 - RNA, 64 nt, hsa
agacaugugccccuuugcugcuggcuaccacucuuccccagagcagcaggccccgagccccuuc

SEQ ID NO: 82970 - RNA, 64 nt, hsa
accaaagaagguguguaagugaagugguucucaguccccagacaugugccccuuugcugcuggc

SEQ ID NO: 82971 - RNA, 64 nt, hsa
caagagaccagggaugcaggguuaggcagacagguccccagaguccucacccugcuccccagac

SEQ ID NO: 82972 - RNA, 64 nt, hsa
uuaggcagacagguccccagaguccucacccugcuccccagacaguagacacagugcccguccu

SEQ ID NO: 82973 - RNA, 64 nt, hsa
cuguggaauagggggaguucaugcaccccuuuuuuccccagaggggcuggacucagguuaguuu

SEQ ID NO: 82974 - RNA, 64 nt, hsa
ucuaagaaggugauucccccugcccuugcccccuuccccagaacaaaacauguugaucaugugc

SEQ ID NO: 82975 - RNA, 64 nt, hsa
aagccauaaggggcaggggccaccccacggcaucuccccagaaguacaggccucaggaggaggu

SEQ ID NO: 82976 - RNA, 64 nt, hsa
caggaggagguggaacugauguaggggguggcacuccccagagacugcccucacgaggggacug

SEQ ID NO: 82977 - RNA, 64 nt, hsa
ccaccccacccuccaccucaauccccucccaucuuccccagaccuaccucaccuacuaggaccu

SEQ ID NO: 82978 - RNA, 64 nt, hsa
aagugugaaauugagcaauaggcaggcaccaccguccccagagcaggucagcgucucgagaggc

SEQ ID NO: 82979 - RNA, 64 nt, hsa
gccaggccaucagcccaccuccaccucuggaggguccccagagacccacgcccgacgcagaccc

SEQ ID NO: 82980 - RNA, 64 nt, hsa
ccuucuuaaaaauauuacauguuuuauuauccuguccccagagggugguuuauccagaaaccaa

SEQ ID NO: 82981 - RNA, 64 nt, hsa
cacauacacgugucugcaggccacaccgugcauguccccagaccugccgccuggcuucuggagu

SEQ ID NO: 82982 - RNA, 64 nt, hsa
gagcauccugaaggagccacugcagccgucacuguccccagagccuguggagauagagccuguu

SEQ ID NO: 82983 - RNA, 64 nt, hsa
acccgacuaaaguuuccguggguucugucauguaacacgacaugcuccaccgucaggggggagu

SEQ ID NO: 82984 - RNA, 64 nt, hsa
auucccacauccugagaaaggucauuucucccacacacgacaaagucacagacauccugcaccu

SEQ ID NO: 82985 - RNA, 64 nt, hsa
caggccuggacccagagacgucccccaucgugggacacgacacacccagaccgcgugccccacc

SEQ ID NO: 82986 - RNA, 64 nt, hsa
acccugucccucgguggccuccccaggccccuggacacgacaguucuccucaggcaggugggcu

SEQ ID NO: 82987 - RNA, 64 nt, hsa
gagggaucgugcacgguagcgucagcccgaauugacacgacaacucugaauguguggcccucua

SEQ ID NO: 82988 - RNA, 64 nt, hsa
ccacccacccacacacaacacugggacaauucagacacgacagcucaccucacuugcucagcuu

SEQ ID NO: 82989 - RNA, 64 nt, hsa
auuccacugccagugacccacugccuccggccguacacgacagugccuugacccaacagccauc

SEQ ID NO: 82990 - RNA, 64 nt, hsa
cagggugacaucaggaauggugcuagccucugcaacacgacacccagucugaagagcucuauac

SEQ ID NO: 82991 - RNA, 64 nt, hsa
gugcaccacccuaagcggcuaggcugacagggccacacgacauagcugaaauuuguucuguagg

SEQ ID NO: 82992 - RNA, 64 nt, hsa
aaaucacuuuucucgcagaagccaugcgacucccacacgacacgggcagcuucacaagccaucu

SEQ ID NO: 82993 - RNA, 64 nt, hsa
agguggaaguuacagaagaggagguaccugggccacacgacaugagcuggaaaaucucucuuag

SEQ ID NO: 82994 - RNA, 64 nt, hsa
uuuagcuaagaaauaaauacaucucaucuaacacacacgacaaagagaagcugugcgugccccg

SEQ ID NO: 82995 - RNA, 64 nt, hsa
ucuaaggaggaccccuagacugcucgcuaguggaacacgacagaggcgaaauccugccccgucu

SEQ ID NO: 82996 - RNA, 64 nt, hsa
gagagcagcugccgccucccgacaccuucagaaaacacgacaccuuuuguugccuucuuuggcc

SEQ ID NO: 82997 - RNA, 64 nt, hsa
accaaaccccacagaacagagggcaccaggcaucacacgacaucuuucccucccaucucugcca

SEQ ID NO: 82998 - RNA, 64 nt, hsa
gggguuuuagcugcagccuuggaaggaggcaccgacacgacaccaggcaggagugagccucagg

SEQ ID NO: 82999 - RNA, 64 nt, hsa
cagauaacccugguuggccacagaagcuauuaauacacgacagcauguggggaaggacuuaugg

SEQ ID NO: 83000 - RNA, 64 nt, hsa
augcaaugugagaggauggcaugccagaauuaggacacgacaugaaaccagaguggugccucug

SEQ ID NO: 83001 - RNA, 64 nt, hsa
uaaucauuuuaagugcaugaaauguaugcuuuguacacgacacuucaauaaagcuauccagaaa

SEQ ID NO: 83002 - RNA, 64 nt, hsa
uacaaacugcucucaaguuaccaaggaagaaaauacacgacaaccacuuauggcucuuuuucaa

SEQ ID NO: 83003 - RNA, 64 nt, hsa
uugguuuugcugagaucgaagaggccaguaggagacacgacagcacacacaguggauuccagug

SEQ ID NO: 83004 - RNA, 64 nt, hsa
accugcuggugcugaguccuguguggggcaccccacacgacaccccucuucccucaggaggccc

SEQ ID NO: 83005 - RNA, 64 nt, hsa
ccacauugacacacacacacacacacacacacacacacgacaugcuccuuucuguggcacaugc

SEQ ID NO: 83006 - RNA, 64 nt, hsa
uggagagaggacccagugacuuguccaaguuuacacacgacacuaaucuccccuggggaggaag

SEQ ID NO: 83007 - RNA, 64 nt, hsa
ccacaagcucccucaugcuuccugucccccgcuuacacgacaacgggccagaccacaggaagga

SEQ ID NO: 83008 - RNA, 64 nt, hsa
uccuguugccccaccugugguugcuguggacugcacacgacagcagauucgcuguccccucguu

SEQ ID NO: 83009 - RNA, 64 nt, hsa
gaagacgaugggcagaggagugacagccgcagacacacgacagccggcagcaacuggaauggca

SEQ ID NO: 83010 - RNA, 64 nt, hsa
auugaaccccgaaacucaggaagagugaaaugcuacacgacaaccucaggcaagcccggccucu

SEQ ID NO: 83011 - RNA, 64 nt, hsa
gacaguucagacacccuuggggauggcacuccacacacgacagagaugcaggggccagggaagc

SEQ ID NO: 83012 - RNA, 64 nt, hsa
uuuucuccuguguaccaagguauugcuuuuauuuacacgacagcgacucaaaaggcacucgauu

SEQ ID NO: 83013 - RNA, 64 nt, hsa
auacacuacgaguugaucucggccagccaaagacacacgacaaaagagacaaucgauauaaugu

SEQ ID NO: 83014 - RNA, 64 nt, hsa
ggguuuucugcuuuguuuuuauuuaagaaaauaaacacgacauauuuaaagaagguucuuucac

SEQ ID NO: 83015 - RNA, 64 nt, hsa
accagacccuguaugacaaguggggucuuucagaacacgacagaaacaggggggcccuuguaau

SEQ ID NO: 83016 - RNA, 64 nt, hsa
caugggaaugauaguugggaagaaaacuauuugcacacgacagauuucuagauacuuuuugcug

SEQ ID NO: 83017 - RNA, 64 nt, hsa
cucucaugccucagcugggacccaccguguagacacacgacaugcaagaguugcagcggcugcu

SEQ ID NO: 83018 - RNA, 64 nt, hsa
aaaucacuugagguaugaaguuuauccuguuuuccagagauaaacauaaguugaucuucccaaa

SEQ ID NO: 83019 - RNA, 64 nt, hsa
ucaagccagcuucauucacucacuuuacuuagaacagagauauaagggccugggaugcauuuau

SEQ ID NO: 83020 - RNA, 64 nt, hsa
cuuuugaggcauucacugcccuagacaaugccaccagagauagugggggaaaugccagaugaaa

SEQ ID NO: 83021 - RNA, 64 nt, hsa
gugauaacuacuuagcacugcccuggugauuacccagagauaucuaugaaaaccaguggcuucc

SEQ ID NO: 83022 - RNA, 64 nt, hsa
uucuacuuguaagauccuaucauaugaaaauaaccagagauacaaagacauucugcaaagauau

SEQ ID NO: 83023 - RNA, 64 nt, hsa
acaagcuucuauugcuaaaacauuucaaaaaacucagagauauuacucuuugaugaaugcauaa

SEQ ID NO: 83024 - RNA, 64 nt, hsa
aaguuucguuggauguucaaaaugcuaauuuuugcagagauauaaggauaaauuaguuuuaguu

SEQ ID NO: 83025 - RNA, 64 nt, hsa
auuuggcuauuuuuauaacugaaauccugagcaacagagauaauuugggugguaaugaucaucu

SEQ ID NO: 83026 - RNA, 64 nt, hsa
cuucauggaaguggccacuacguggggaucccuucagagauaucugagaccucucuggggauca

SEQ ID NO: 83027 - RNA, 64 nt, hsa
ccaccagagaggagagggaaccagauaugcagaucagagauagaggaaguggaaccagagagcu

SEQ ID NO: 83028 - RNA, 64 nt, hsa
ugcacugugcucucccacaaguccagcugcaacccagagauaguggaaacugaaauuaggaagg

SEQ ID NO: 83029 - RNA, 64 nt, hsa
gaagcauggggaaaauauuugcacucuaaacauacagagauagagguggggcuugugguacuua

SEQ ID NO: 83030 - RNA, 64 nt, hsa
gcaacuguuuugauccauuucuuacacacacugccagagauacucuaggcauguaaagcacaaa

SEQ ID NO: 83031 - RNA, 64 nt, hsa
guguguuuauuguuccuaagaauuuggcacaagucagagauaauugccuauacuaagaaucuau

SEQ ID NO: 83032 - RNA, 64 nt, hsa
gaaacagacuuaucauuauugauuugagguuucccagagauauaguucacaguuaauuguugcg

SEQ ID NO: 83033 - RNA, 64 nt, hsa
uggaugcacacacacacacgccaaugcacacacacagagauaugcacacacacggaugcacaca

SEQ ID NO: 83034 - RNA, 64 nt, hsa
ugcacacacacggaugcacacacagauggucacacagagauacgcaaacacaccgaugcacacg

SEQ ID NO: 83035 - RNA, 64 nt, hsa
ccaaugcacgcacacaucagugcacacggaugcacagagauaugcacacaccgaugugcgcaca

SEQ ID NO: 83036 - RNA, 64 nt, hsa
uuagaaacuuagugggaaaaguaggaugguauuuuuauguaaagccuugacccaauguuuaaaa

SEQ ID NO: 83037 - RNA, 64 nt, hsa
ucugauuuauugagauugaauuaugccaccacguuuauguaaaaaugaagguggcaccguggug

SEQ ID NO: 83038 - RNA, 64 nt, hsa
guguuuuguuuaucaugauuauagaauaaggaauuuauguaaauauacuuaguccuauuucuag

SEQ ID NO: 83039 - RNA, 64 nt, hsa
auuauuuuauugucuagcuccaguuaucuguauuuuauguaauguaauugacaggauggcugcu

SEQ ID NO: 83040 - RNA, 64 nt, hsa
ggaagcacgcuggugcuaaguauuuuuuaaaugguuauguaagcaaagcugaacuguaaaucuu

SEQ ID NO: 83041 - RNA, 64 nt, hsa
aauauuuguaaauggucuguuugggcagguaaaauuauguaaugcaguguuuggaacaggagaa

SEQ ID NO: 83042 - RNA, 64 nt, hsa
ucugucauuaauaagguauuucuaaauaaacacauuauguaaggaagugccaaaauaguuauca

SEQ ID NO: 83043 - RNA, 64 nt, hsa
uuccguagucuaagauaacuaacugaauuaaaaauuauguaauacuuguggaacuuugauaaau

SEQ ID NO: 83044 - RNA, 64 nt, hsa
auguuucagugccucagacaaauguguauuuaacuuauguaaaagauaagucuggaaauaaaug

SEQ ID NO: 83045 - RNA, 64 nt, hsa
caguauaucuucuuugggguuaccucucugaauauuauguaaacaauccaaagaaaugauugua

SEQ ID NO: 83046 - RNA, 64 nt, hsa
gauaacauuucaaacccugaaggacagugacuuauuauguaaguucaauuuuguaaguucauua

SEQ ID NO: 83047 - RNA, 64 nt, hsa
ugacuuauuauguaaguucaauuuuguaaguucauuauguaagauccuuuuuuuuuucauaaua

SEQ ID NO: 83048 - RNA, 64 nt, hsa
augaaauuaaugagauauauauugaaauaaagaauuauguaaaagccauucuuuaaaauauuua

SEQ ID NO: 83049 - RNA, 64 nt, hsa
ccauucuuuaaaauauuuauagcauaaauauauguuauguaaaguguguauauagaauuaguuu

SEQ ID NO: 83050 - RNA, 64 nt, hsa
gcagaagccuuuuuuuuaagaugaaggaaauauuuuauguaaagagcaacucagcaggacacag

SEQ ID NO: 83051 - RNA, 64 nt, hsa
cagcauuugacuuuuauuuaaaaggcggcacuacuuauguaaaucugagcugugggauauuucu

SEQ ID NO: 83052 - RNA, 64 nt, hsa
gaugacuaauuggcaauuugauaguaguuacauuuuauguaacacuugauauaauaacccaaau

SEQ ID NO: 83053 - RNA, 64 nt, hsa
uucugugguuuauugauccaaaaguacauauuuguuauguaaacuuauacuauguaaacuugaa

SEQ ID NO: 83054 - RNA, 64 nt, hsa
ugggcagcugcagguuucucccaaucaugucucuuuauguaaagacaguaacaugcaaacacuu

SEQ ID NO: 83055 - RNA, 64 nt, hsa
aaaauaacucuauguuguuuauuuucagugacacuuauguaaggcccugugaguuguauuuauc

SEQ ID NO: 83056 - RNA, 64 nt, hsa
uauauugcagaaaccaauaucuguuucuuggugguuauguaaaagaccugaagaauuacuaucu

SEQ ID NO: 83057 - RNA, 64 nt, hsa
augcugauguucaacaguugcagaaauugugcuauuauguaacugugggccuugccccugucug

SEQ ID NO: 83058 - RNA, 64 nt, hsa
uuuuguuuaauaggaaauauauaauaauagcauuuuauguaauaaaauaugggcaacgauuauc

SEQ ID NO: 83059 - RNA, 64 nt, hsa
auuuuaauugagcauuuauauggauaaucauacauuauguaagcccauauguauuuacauccag

SEQ ID NO: 83060 - RNA, 64 nt, hsa
cuguaacuguuuaagccaauaaacuuuucaaaauuuauguaauguggggcuuuuauguagcacu

SEQ ID NO: 83061 - RNA, 64 nt, hsa
aauaacuuguuuuuucucauguuucaucuucuuuuuauguaaauuuguaauacuuuccuauauu

SEQ ID NO: 83062 - RNA, 64 nt, hsa
uauauugucuuaaaaguauguggacucuguuccuuuauguaaacauguaaagaaaauaagucag

SEQ ID NO: 83063 - RNA, 64 nt, hsa
auaguaucuuaauaaaaaugagaacacugucccuuuauguaaauuuuuguacauaguagcauua

SEQ ID NO: 83064 - RNA, 64 nt, hsa
uugcaaauuugugacuguccuuauuaacuuucuuuuauguaaguaauuuguaaaaguuucuuaa

SEQ ID NO: 83065 - RNA, 64 nt, hsa
ugucuugaccauugacuaugacacaguuucuuauuuauguaaauacuugcaucacaguggccga

SEQ ID NO: 83066 - RNA, 64 nt, hsa
aagaauaugaaacauagauaaaacaucuuugaaauuauguaaauuauguaaauuaucaggcaaa

SEQ ID NO: 83067 - RNA, 64 nt, hsa
aaacauagauaaaacaucuuugaaauuauguaaauuauguaaauuaucaggcaaauuugcauua

SEQ ID NO: 83068 - RNA, 64 nt, hsa
uuuacaauagugugacaacgaugaaaaugcuugguuauguaaagugauuggaaauguaauggau

SEQ ID NO: 83069 - RNA, 64 nt, hsa
guuuugccgaggauuuugguuagaucuuuuaguauuauguaaauuuaugcugcaauagcuuuug

SEQ ID NO: 83070 - RNA, 64 nt, hsa
gagaaaauauuuuagaauuuaauguuucuuauauuuauguaaacuuaugacucuucauuuauau

SEQ ID NO: 83071 - RNA, 64 nt, hsa
gugcagugcagcucuaauaaaggccuuauuuuucuuauguaaaucaucuuuuuacauuuguuug

SEQ ID NO: 83072 - RNA, 64 nt, hsa
cuguuuuucuauuaaucuuuugucaacuuccugauuauguaacaaaguauguacagucuacuuu

SEQ ID NO: 83073 - RNA, 64 nt, hsa
uacgauuccacugaaacucuucgaucaagcuacuuuauguaaaucacuucauuguuuuaaagga

SEQ ID NO: 83074 - RNA, 64 nt, hsa
aagaagaaaaagaagucaaagacaaaguguguaauuauguaaauacaauuuguacuuuuuucuu

SEQ ID NO: 83075 - RNA, 64 nt, hsa
uaaaaauuuagaaaauguuaucuuuuugcauuuauuauguaaaacuguuuuacaguaucaaaau

SEQ ID NO: 83076 - RNA, 64 nt, hsa
uggaaagagauucuuuaaaauguauaaccugccauuauguaauuugguuucauuuuauucuacc

SEQ ID NO: 83077 - RNA, 64 nt, hsa
cugauguauaugguuaucuggguuauaucuauuuuuauguaaacucuauuuuguuuuuggcaag

SEQ ID NO: 83078 - RNA, 64 nt, hsa
uucuuuaaaguuuacaaaaaaaaaccuuauguuuuuauguaaucagucauuacacuagggagaa

SEQ ID NO: 83079 - RNA, 64 nt, hsa
aacaauguuugauacucuaguauguaagcuguauuuauguaauauuuagaacgacauguuaaua

SEQ ID NO: 83080 - RNA, 64 nt, hsa
aguuuaacguauauuaaaccuguugaaaugauaauuauguaaagauaaauauucuagguuaguc

SEQ ID NO: 83081 - RNA, 64 nt, hsa
cggaugugcguugguuauauacaaauaugucauuuuauguaagggacuugaguauacuuggauu

SEQ ID NO: 83082 - RNA, 64 nt, hsa
ugaaauuauugauuuuggcauuuuucuaagcaauuuauguaauuuuauuugaagaaaauguuuu

SEQ ID NO: 83083 - RNA, 64 nt, hsa
cagaaacagaaccagagagaaguuaaacaaaagguuauguaacuguuccuuuaauguuguaauu

SEQ ID NO: 83084 - RNA, 64 nt, hsa
aaaagaaaaauaauugaaauguugagagagaugguuauguaaguuaguccucugcuguuuacuu

SEQ ID NO: 83085 - RNA, 64 nt, hsa
uuuucuuuuuaauuuaagaugagcuauuuggagcuuauguaauaauggcauaaagccaacuaga

SEQ ID NO: 83086 - RNA, 64 nt, hsa
aguagguuaccauuuugaggcaguuggauauaaauuauguaaauauguaugauuaugauuuuua

SEQ ID NO: 83087 - RNA, 64 nt, hsa
uuuagauguauaaugaaaaaggauaaugcaaaaauuauguaauagauaccaaauuagggaaguu

SEQ ID NO: 83088 - RNA, 64 nt, hsa
aacuauuuaagaguuuaaaagaguugcauucuuauuauguaaggaugauuuuaacaacuuuuua

SEQ ID NO: 83089 - RNA, 64 nt, hsa
uauuuuauguaauauuguguuaaauuauauuguuuuauguaauauauuauuuuaaauguuauuu

SEQ ID NO: 83090 - RNA, 64 nt, hsa
cuuguauuauaaucuuuuaauauaauauuauauuuuauguaauauuguguuaaauuauauuguu

SEQ ID NO: 83091 - RNA, 64 nt, hsa
uagaguaguagcucuauuucuaacuaaauucuauuuauguaacaacacagcuaauuuacucuug

SEQ ID NO: 83092 - RNA, 64 nt, hsa
agccauuuucucaucugauauauugagcuauguuuuauguaaguauugcuuauucaaguaguuu

SEQ ID NO: 83093 - RNA, 64 nt, hsa
cugcagcaaugauauuucagucugugaacuucuauuauguaaagaaucucuaguguacaaaggg

SEQ ID NO: 83094 - RNA, 64 nt, hsa
gauuaaguuguugaguaguuuuguaaucaagauuuuauguaacauuuguaaagggaaaauuagc

SEQ ID NO: 83095 - RNA, 64 nt, hsa
uauauuuauggggccauugcuuaaagauuauaaauuauguaaauacauuaauaaauucuaaguu

SEQ ID NO: 83096 - RNA, 64 nt, hsa
cagcuguuaaauccuaaaaaucaauauaauuuauuuauguaagaaaaauaacucaaucaauaua

SEQ ID NO: 83097 - RNA, 64 nt, hsa
uuuucauugucuuuuauacauuugggauuauaaauuauguaaauguuaaaaugagcaucucaaa

SEQ ID NO: 83098 - RNA, 64 nt, hsa
uaacuacaauucacuguugugagaauauuccucgucacagcaaaaacacuuuccuuucuacuga

SEQ ID NO: 83099 - RNA, 64 nt, hsa
cacuuuccuuucuacugacaaccaguccuccacaucacagcauuuagacauauggguaaaaugu

SEQ ID NO: 83100 - RNA, 64 nt, hsa
cacaacagaugcugggacccagucucugcccaggucacagcacaagugcacaucagcacuaugg

SEQ ID NO: 83101 - RNA, 64 nt, hsa
ucaagggaccucccucaugccaggccccugccucucacagcagcacccuuuccucucauugucc

SEQ ID NO: 83102 - RNA, 64 nt, hsa
gaaacugaggcccagggaggagaguaacugaaggucacagcacggucacagcagagguggccga

SEQ ID NO: 83103 - RNA, 64 nt, hsa
ccagggaggagaguaacugaaggucacagcacggucacagcagagguggccgaacccagcccuc

SEQ ID NO: 83104 - RNA, 64 nt, hsa
caacagugaacaauaaagauaaaaguccuuguccucacagcaguacauucuauuguucaucaua

SEQ ID NO: 83105 - RNA, 64 nt, hsa
cuaugcauuagaguugauguguuuuguacuagugucacagcauaaaaucauauuacaaguacgu

SEQ ID NO: 83106 - RNA, 64 nt, hsa
agugaguuucauaggauggguggcuuuaacaguuucacagcaggacacugagggaauauuuccc

SEQ ID NO: 83107 - RNA, 64 nt, hsa
aacagccacaguguggggcucugccaugaggaagucacagcagacacgcuagacagcauagucc

SEQ ID NO: 83108 - RNA, 64 nt, hsa
auccaaaucucuguggcuucaugcuuguauaugcucacagcagggcacaaaauccaagagaagg

SEQ ID NO: 83109 - RNA, 64 nt, hsa
gucugauauucuugacaaucaucagcaacaaagaucacagcacuuuccagaagcauggagcuuc

SEQ ID NO: 83110 - RNA, 64 nt, hsa
ggaaccgauuccaucaccccaauaaaggagcucuucacagcaccugugagucugggcgccuuag

SEQ ID NO: 83111 - RNA, 64 nt, hsa
gaaccagagcuugaaauucaaagcugcgaucccuucacagcaguaaaccagcucuuuggaaccg

SEQ ID NO: 83112 - RNA, 64 nt, hsa
cacaacccccuauauuauuuugguugucuauuucucacagcauauuuucaguuuuuuguccauu

SEQ ID NO: 83113 - RNA, 64 nt, hsa
uguggguauaccuaccccaaaauuguuuucucauucacagcauuagcauauucagcaaauccau

SEQ ID NO: 83114 - RNA, 64 nt, hsa
agagggauggggucccugagccaggccccacccaucacagcauucccagguccugguacccagc

SEQ ID NO: 83115 - RNA, 64 nt, hsa
gcuuugcucuuugguccucaggccaccagaccccucacagcauggcccuuggcucuuccugcac

SEQ ID NO: 83116 - RNA, 64 nt, hsa
agccuucacagaggacgucccgugccagauucucucacagcagaucgggagacaggauguugac

SEQ ID NO: 83117 - RNA, 64 nt, hsa
gaaggguccugcuguggucaucuuggugacucggucacagcagcuacuggccaagaucagacgu

SEQ ID NO: 83118 - RNA, 64 nt, hsa
gcugucugccaaaagaaacugccuacagacaucaucacagcagccuccucacuuggguacuaca

SEQ ID NO: 83119 - RNA, 64 nt, hsa
uuuuuaucccauaucccaaauucuuaugagccacucacagcaggcagcauauguugaaauaagu

SEQ ID NO: 83120 - RNA, 64 nt, hsa
cugggacagcuguuaccuuugcaguguugccgaaucacagcaguuaccuuugcaguguugccga

SEQ ID NO: 83121 - RNA, 64 nt, hsa
gaaucacagcaguuaccuuugcaguguugccgaaucacagcaguucuguuggagaaacgcuugg

SEQ ID NO: 83122 - RNA, 62 nt, hsa
gucccagguccaggaaauccaauguuggugaaggcagccacucucuugcuuguccccaaauc

SEQ ID NO: 83123 - RNA, 62 nt, hsa
gguggggugggcucucccuuaggcuugggcaaggcagccaccugcccuugcucucccuuagu

SEQ ID NO: 83124 - RNA, 62 nt, hsa
ugccaguaccugccuggggguggggggugccuggcagccaugaagcaggcugaaaggcagag

SEQ ID NO: 83125 - RNA, 62 nt, hsa
ugccaacuguggaaacuucagucccucaggcuggcagccaugccaguaccugccugggggug

SEQ ID NO: 83126 - RNA, 62 nt, hsa
gggcuccccaaccugaguuggguuacuucaagggcagccagcaggccuggauggaggccuag

SEQ ID NO: 83127 - RNA, 57 nt, hsa
gcaugcucaaggacuccuagggcugguggcagccaggauucuggcccagggcgccuc

SEQ ID NO: 83128 - RNA, 62 nt, hsa
aaaggaggaucagaaugcuuugggauuaauugggcagccaucgcagaauuguuugugggcaa

SEQ ID NO: 83129 - RNA, 62 nt, hsa
gugccugaauucuuucuuuucgccgacacgauggcagccaaacugcagcuucaaacgcucac

SEQ ID NO: 83130 - RNA, 62 nt, hsa
cuauggccccagugccuugaggcccaggccagggcagccaguggcucuagcucagggaaagc

SEQ ID NO: 83131 - RNA, 62 nt, hsa
agccaugaggaccuggccuucugcccgacccaggcagccauucaaguugagcaauggccacu

SEQ ID NO: 83132 - RNA, 62 nt, hsa
gcccccucuccccuucccuggcuguggacacuggcagccaauggggaggcggccucuccccu

SEQ ID NO: 83133 - RNA, 62 nt, hsa
acuagagccccaaccacagcagaugcuuccugggcagccacuggccaggccguuguauccau

SEQ ID NO: 83134 - RNA, 62 nt, hsa
ggccuaggcgaggguuccagguuucagacacuggcagccaaugaagacugugcucgcugggu

SEQ ID NO: 83135 - RNA, 62 nt, hsa
uguccucccaucuccugugggcagccccucccggcagccagggcuuccuggaggcgaugcag

SEQ ID NO: 83136 - RNA, 59 nt, hsa
acuccagcggcagccacuagaccgcgcccggcagccacccaccccacgugccaacuucc

SEQ ID NO: 83137 - RNA, 62 nt, hsa
ccucgaggcucgaugccugugccaaggccaggggcagccagagggcagcuggauggccacgu

SEQ ID NO: 83138 - RNA, 62 nt, hsa
cgugggugucacgugucccagaugcaguauucggcagccagccggggagggcuaccuccucc

SEQ ID NO: 83139 - RNA, 62 nt, hsa
agugugcgucuguacgggaagaggcagagggaggcagccagcggggcgugaugcagugugca

SEQ ID NO: 83140 - RNA, 62 nt, hsa
uucuucaucauggaaagccacaagccucagaaggcagccagaggacaggaagagucugugau

SEQ ID NO: 83141 - RNA, 62 nt, hsa
uguucguaggaugaugugcagccugucacaguggcagccacaggcauucaguuugugggcau

SEQ ID NO: 83142 - RNA, 62 nt, hsa
gaggcagcccaggaagucucaucuggggagcaggcagccagcaucugggccuuggccuggag

SEQ ID NO: 83143 - RNA, 62 nt, hsa
gugggccugggcuccuggaccccccuuucacaggcagccagugcccugagccagggucucca

SEQ ID NO: 83144 - RNA, 62 nt, hsa
cuuccuucuuaauaaaggcugacaguucuguuggcagccaagaacccacaccaugaagacag

SEQ ID NO: 83145 - RNA, 62 nt, hsa
acucuuuccacugugacuuauuuucucucucaggcagccagccaccuggucccuugugcuga

SEQ ID NO: 83146 - RNA, 62 nt, hsa
cuuuccacaccagacuggcagcacuucccccaggcagccaguggugggcccugagcccucag

SEQ ID NO: 83147 - RNA, 62 nt, hsa
acugaugaagucaccuggccuggaguguguugggcagccaguguccccagagcugcuugugg

SEQ ID NO: 83148 - RNA, 62 nt, hsa
uacagacuggcacugggcagggccucucauguggcagccacauguggcguugugaggccacc

SEQ ID NO: 83149 - RNA, 62 nt, hsa
gggaaaaaccccugcucacuuguuugcccucaggcagccaaagcacuuuaaccccugcauag

SEQ ID NO: 83150 - RNA, 62 nt, hsa
cuggcucaggaggguugggucccugggaggccggcagccaggccacagaauccacacgugga

SEQ ID NO: 83151 - RNA, 62 nt, hsa
acacguggaccauugugggucccugggaggccggcagccaggccacggaauccacacgugga

SEQ ID NO: 83152 - RNA, 62 nt, hsa
uggccgccuggggagccuguguggcugugccgggcagccauccugcauucccacccagcgcg

SEQ ID NO: 83153 - RNA, 62 nt, hsa
gggucucgugcugcccuucccucccacagccuggcagccauccagaggaggggcucuaccag

SEQ ID NO: 83154 - RNA, 62 nt, hsa
cuguagcagccaccccccugcccccacuccagggcagccaugaugugcuugggcccaccagg

SEQ ID NO: 83155 - RNA, 62 nt, hsa
cggggugggaccagaggucauaggugcccaacggcagccaaaccaaagacacuggugugcau

SEQ ID NO: 83156 - RNA, 64 nt, hsa
cuggccugcaucucucuaagacuuagucugacgccacgcgcaucucuuguucuguguucaauca

SEQ ID NO: 83157 - RNA, 64 nt, hsa
gguggcucccuguggagccagggcugagccuugucacgcgcacucgccaauuaagagauggacc

SEQ ID NO: 83158 - RNA, 64 nt, hsa
ucguucuuccacacccuguccugguggggcuguccgggaagacaccuacccugugggcacucag

SEQ ID NO: 83159 - RNA, 64 nt, hsa
cgucggcauccaggccugugccggcuucacguggcgggaagacccucugcaagggggacaggca

SEQ ID NO: 83160 - RNA, 64 nt, hsa
ucuucucauuucagagcaugggcauguguuucaucgggaagaggaauuuugaacauuuccuucu

SEQ ID NO: 83161 - RNA, 64 nt, hsa
cuguguucuacaagggggacgagugccugggcagcgggaagauccugcggcuggggccgucugc

SEQ ID NO: 83162 - RNA, 64 nt, hsa; identical to SEQ ID NO: 58312

SEQ ID NO: 83163 - RNA, 64 nt, hsa; identical to SEQ ID NO: 58313

SEQ ID NO: 83164 - RNA, 64 nt, hsa; identical to SEQ ID NO: 58314

SEQ ID NO: 83165 - RNA, 64 nt, hsa; identical to SEQ ID NO: 58315

SEQ ID NO: 83166 - RNA, 64 nt, hsa; identical to SEQ ID NO: 58316

SEQ ID NO: 83167 - RNA, 64 nt, hsa; identical to SEQ ID NO: 58317

SEQ ID NO: 83168 - RNA, 64 nt, hsa; identical to SEQ ID NO: 58318

SEQ ID NO: 83169 - RNA, 64 nt, hsa; identical to SEQ ID NO: 58319

SEQ ID NO: 83170 - RNA, 64 nt, hsa; identical to SEQ ID NO: 58320

SEQ ID NO: 83171 - RNA, 64 nt, hsa; identical to SEQ ID NO: 58321

SEQ ID NO: 83172 - RNA, 64 nt, hsa; identical to SEQ ID NO: 58322

SEQ ID NO: 83173 - RNA, 64 nt, hsa; identical to SEQ ID NO: 58323

SEQ ID NO: 83174 - RNA, 64 nt, hsa; identical to SEQ ID NO: 58324

SEQ ID NO: 83175 - RNA, 64 nt, hsa; identical to SEQ ID NO: 58325

SEQ ID NO: 83176 - RNA, 64 nt, hsa; identical to SEQ ID NO: 58326

SEQ ID NO: 83177 - RNA, 64 nt, hsa; identical to SEQ ID NO: 58327

SEQ ID NO: 83178 - RNA, 64 nt, hsa; identical to SEQ ID NO: 58328

SEQ ID NO: 83179 - RNA, 64 nt, hsa; identical to SEQ ID NO: 58329

SEQ ID NO: 83180 - RNA, 64 nt, hsa; identical to SEQ ID NO: 58330

SEQ ID NO: 83181 - RNA, 64 nt, hsa; identical to SEQ ID NO: 58331

SEQ ID NO: 83182 - RNA, 64 nt, hsa; identical to SEQ ID NO: 58332

SEQ ID NO: 83183 - RNA, 64 nt, hsa; identical to SEQ ID NO: 58333

SEQ ID NO: 83184 - RNA, 64 nt, hsa; identical to SEQ ID NO: 58334

SEQ ID NO: 83185 - RNA, 64 nt, hsa; identical to SEQ ID NO: 58335

SEQ ID NO: 83186 - RNA, 64 nt, hsa; identical to SEQ ID NO: 58336

SEQ ID NO: 83187 - RNA, 64 nt, hsa; identical to SEQ ID NO: 58337

SEQ ID NO: 83188 - RNA, 64 nt, hsa; identical to SEQ ID NO: 58338

SEQ ID NO: 83189 - RNA, 64 nt, hsa; identical to SEQ ID NO: 58339

SEQ ID NO: 83190 - RNA, 64 nt, hsa; identical to SEQ ID NO: 58340

SEQ ID NO: 83191 - RNA, 64 nt, hsa; identical to SEQ ID NO: 58341

SEQ ID NO: 83192 - RNA, 64 nt, hsa; identical to SEQ ID NO: 58342

SEQ ID NO: 83193 - RNA, 64 nt, hsa; identical to SEQ ID NO: 58343

SEQ ID NO: 83194 - RNA, 64 nt, hsa; identical to SEQ ID NO: 58344

SEQ ID NO: 83195 - RNA, 64 nt, hsa; identical to SEQ ID NO: 58345

SEQ ID NO: 83196 - RNA, 64 nt, hsa; identical to SEQ ID NO: 58346

SEQ ID NO: 83197 - RNA, 64 nt, hsa; identical to SEQ ID NO: 58347

SEQ ID NO: 83198 - RNA, 64 nt, hsa; identical to SEQ ID NO: 58348

SEQ ID NO: 83199 - RNA, 64 nt, hsa; identical to SEQ ID NO: 58349

SEQ ID NO: 83200 - RNA, 64 nt, hsa; identical to SEQ ID NO: 58350

SEQ ID NO: 83201 - RNA, 64 nt, hsa; identical to SEQ ID NO: 58351

SEQ ID NO: 83202 - RNA, 64 nt, hsa; identical to SEQ ID NO: 58352

SEQ ID NO: 83203 - RNA, 64 nt, hsa; identical to SEQ ID NO: 58353

SEQ ID NO: 83204 - RNA, 64 nt, hsa; identical to SEQ ID NO: 58354

SEQ ID NO: 83205 - RNA, 64 nt, hsa; identical to SEQ ID NO: 58355

SEQ ID NO: 83206 - RNA, 64 nt, hsa; identical to SEQ ID NO: 58356

SEQ ID NO: 83207 - RNA, 64 nt, hsa; identical to SEQ ID NO: 58357

SEQ ID NO: 83208 - RNA, 64 nt, hsa; identical to SEQ ID NO: 58358

SEQ ID NO: 83209 - RNA, 64 nt, hsa; identical to SEQ ID NO: 58359

SEQ ID NO: 83210 - RNA, 64 nt, hsa; identical to SEQ ID NO: 58360

SEQ ID NO: 83211 - RNA, 64 nt, hsa; identical to SEQ ID NO: 58361

SEQ ID NO: 83212 - RNA, 64 nt, hsa; identical to SEQ ID NO: 58362

SEQ ID NO: 83213 - RNA, 64 nt, hsa; identical to SEQ ID NO: 58363

SEQ ID NO: 83214 - RNA, 64 nt, hsa; identical to SEQ ID NO: 58364

SEQ ID NO: 83215 - RNA, 64 nt, hsa; identical to SEQ ID NO: 58365

SEQ ID NO: 83216 - RNA, 64 nt, hsa; identical to SEQ ID NO: 58366

SEQ ID NO: 83217 - RNA, 64 nt, hsa; identical to SEQ ID NO: 58367

SEQ ID NO: 83218 - RNA, 64 nt, hsa; identical to SEQ ID NO: 58368

SEQ ID NO: 83219 - RNA, 64 nt, hsa; identical to SEQ ID NO: 58369

SEQ ID NO: 83220 - RNA, 64 nt, hsa; identical to SEQ ID NO: 58370

SEQ ID NO: 83221 - RNA, 64 nt, hsa; identical to SEQ ID NO: 58371

SEQ ID NO: 83222 - RNA, 64 nt, hsa; identical to SEQ ID NO: 58372

SEQ ID NO: 83223 - RNA, 64 nt, hsa; identical to SEQ ID NO: 58373

SEQ ID NO: 83224 - RNA, 64 nt, hsa; identical to SEQ ID NO: 58374

SEQ ID NO: 83225 - RNA, 64 nt, hsa; identical to SEQ ID NO: 58375

SEQ ID NO: 83226 - RNA, 64 nt, hsa; identical to SEQ ID NO: 58376

SEQ ID NO: 83227 - RNA, 64 nt, hsa; identical to SEQ ID NO: 58377

SEQ ID NO: 83228 - RNA, 64 nt, hsa; identical to SEQ ID NO: 58378

SEQ ID NO: 83229 - RNA, 64 nt, hsa; identical to SEQ ID NO: 58379

SEQ ID NO: 83230 - RNA, 64 nt, hsa; identical to SEQ ID NO: 58380

SEQ ID NO: 83231 - RNA, 64 nt, hsa; identical to SEQ ID NO: 58381

SEQ ID NO: 83232 - RNA, 64 nt, hsa; identical to SEQ ID NO: 58382

SEQ ID NO: 83233 - RNA, 64 nt, hsa; identical to SEQ ID NO: 58383

SEQ ID NO: 83234 - RNA, 64 nt, hsa; identical to SEQ ID NO: 58384

SEQ ID NO: 83235 - RNA, 64 nt, hsa; identical to SEQ ID NO: 58385

SEQ ID NO: 83236 - RNA, 64 nt, hsa; identical to SEQ ID NO: 58386

SEQ ID NO: 83237 - RNA, 64 nt, hsa; identical to SEQ ID NO: 58387

SEQ ID NO: 83238 - RNA, 64 nt, hsa; identical to SEQ ID NO: 58388

SEQ ID NO: 83239 - RNA, 64 nt, hsa; identical to SEQ ID NO: 58389

SEQ ID NO: 83240 - RNA, 64 nt, hsa; identical to SEQ ID NO: 58390

SEQ ID NO: 83241 - RNA, 64 nt, hsa; identical to SEQ ID NO: 58391

SEQ ID NO: 83242 - RNA, 64 nt, hsa; identical to SEQ ID NO: 58392

SEQ ID NO: 83243 - RNA, 64 nt, hsa; identical to SEQ ID NO: 58393

SEQ ID NO: 83244 - RNA, 64 nt, hsa; identical to SEQ ID NO: 58394

SEQ ID NO: 83245 - RNA, 64 nt, hsa; identical to SEQ ID NO: 58395

SEQ ID NO: 83246 - RNA, 64 nt, hsa; identical to SEQ ID NO: 58396

SEQ ID NO: 83247 - RNA, 64 nt, hsa; identical to SEQ ID NO: 58397

SEQ ID NO: 83248 - RNA, 64 nt, hsa; identical to SEQ ID NO: 58398

SEQ ID NO: 83249 - RNA, 64 nt, hsa; identical to SEQ ID NO: 58399

SEQ ID NO: 83250 - RNA, 64 nt, hsa; identical to SEQ ID NO: 58400

SEQ ID NO: 83251 - RNA, 64 nt, hsa; identical to SEQ ID NO: 58401

SEQ ID NO: 83252 - RNA, 64 nt, hsa; identical to SEQ ID NO: 58402

SEQ ID NO: 83253 - RNA, 64 nt, hsa; identical to SEQ ID NO: 58403

SEQ ID NO: 83254 - RNA, 64 nt, hsa; identical to SEQ ID NO: 58404

SEQ ID NO: 83255 - RNA, 64 nt, hsa; identical to SEQ ID NO: 58405

SEQ ID NO: 83256 - RNA, 64 nt, hsa; identical to SEQ ID NO: 58406

SEQ ID NO: 83257 - RNA, 64 nt, hsa; identical to SEQ ID NO: 58407

SEQ ID NO: 83258 - RNA, 64 nt, hsa; identical to SEQ ID NO: 58408

SEQ ID NO: 83259 - RNA, 64 nt, hsa; identical to SEQ ID NO: 58409

SEQ ID NO: 83260 - RNA, 64 nt, hsa; identical to SEQ ID NO: 58410

SEQ ID NO: 83261 - RNA, 64 nt, hsa; identical to SEQ ID NO: 58411

SEQ ID NO: 83262 - RNA, 64 nt, hsa; identical to SEQ ID NO: 58412

SEQ ID NO: 83263 - RNA, 64 nt, hsa; identical to SEQ ID NO: 58413

SEQ ID NO: 83264 - RNA, 64 nt, hsa; identical to SEQ ID NO: 58414

SEQ ID NO: 83265 - RNA, 64 nt, hsa; identical to SEQ ID NO: 58415

SEQ ID NO: 83266 - RNA, 64 nt, hsa; identical to SEQ ID NO: 58416

SEQ ID NO: 83267 - RNA, 64 nt, hsa; identical to SEQ ID NO: 58417

SEQ ID NO: 83268 - RNA, 64 nt, hsa; identical to SEQ ID NO: 58418

SEQ ID NO: 83269 - RNA, 64 nt, hsa; identical to SEQ ID NO: 58419

SEQ ID NO: 83270 - RNA, 64 nt, hsa; identical to SEQ ID NO: 58420

SEQ ID NO: 83271 - RNA, 64 nt, hsa; identical to SEQ ID NO: 58421

SEQ ID NO: 83272 - RNA, 64 nt, hsa; identical to SEQ ID NO: 58422

SEQ ID NO: 83273 - RNA, 64 nt, hsa; identical to SEQ ID NO: 58423

SEQ ID NO: 83274 - RNA, 64 nt, hsa; identical to SEQ ID NO: 58424

SEQ ID NO: 83275 - RNA, 64 nt, hsa; identical to SEQ ID NO: 58425

SEQ ID NO: 83276 - RNA, 64 nt, hsa; identical to SEQ ID NO: 58426

SEQ ID NO: 83277 - RNA, 64 nt, hsa; identical to SEQ ID NO: 58427

SEQ ID NO: 83278 - RNA, 64 nt, hsa; identical to SEQ ID NO: 58428

SEQ ID NO: 83279 - RNA, 64 nt, hsa; identical to SEQ ID NO: 58429

SEQ ID NO: 83280 - RNA, 64 nt, hsa; identical to SEQ ID NO: 58430

SEQ ID NO: 83281 - RNA, 64 nt, hsa; identical to SEQ ID NO: 58431

SEQ ID NO: 83282 - RNA, 64 nt, hsa; identical to SEQ ID NO: 58432

SEQ ID NO: 83283 - RNA, 64 nt, hsa; identical to SEQ ID NO: 58433

SEQ ID NO: 83284 - RNA, 64 nt, hsa; identical to SEQ ID NO: 58434

SEQ ID NO: 83285 - RNA, 64 nt, hsa; identical to SEQ ID NO: 58435

SEQ ID NO: 83286 - RNA, 50 nt, hsa; identical to SEQ ID NO: 58436

SEQ ID NO: 83287 - RNA, 64 nt, hsa; identical to SEQ ID NO: 58437

SEQ ID NO: 83288 - RNA, 64 nt, hsa; identical to SEQ ID NO: 58438

SEQ ID NO: 83289 - RNA, 64 nt, hsa; identical to SEQ ID NO: 58439

SEQ ID NO: 83290 - RNA, 64 nt, hsa; identical to SEQ ID NO: 58440

SEQ ID NO: 83291 - RNA, 64 nt, hsa; identical to SEQ ID NO: 58441

SEQ ID NO: 83292 - RNA, 64 nt, hsa; identical to SEQ ID NO: 58442

SEQ ID NO: 83293 - RNA, 64 nt, hsa; identical to SEQ ID NO: 58443

SEQ ID NO: 83294 - RNA, 64 nt, hsa; identical to SEQ ID NO: 58444

SEQ ID NO: 83295 - RNA, 64 nt, hsa; identical to SEQ ID NO: 58445

SEQ ID NO: 83296 - RNA, 64 nt, hsa; identical to SEQ ID NO: 58446

SEQ ID NO: 83297 - RNA, 64 nt, hsa; identical to SEQ ID NO: 58447

SEQ ID NO: 83298 - RNA, 64 nt, hsa; identical to SEQ ID NO: 58448

SEQ ID NO: 83299 - RNA, 64 nt, hsa; identical to SEQ ID NO: 58449

SEQ ID NO: 83300 - RNA, 64 nt, hsa; identical to SEQ ID NO: 58450

SEQ ID NO: 83301 - RNA, 64 nt, hsa; identical to SEQ ID NO: 58451

SEQ ID NO: 83302 - RNA, 64 nt, hsa; identical to SEQ ID NO: 58452

SEQ ID NO: 83303 - RNA, 64 nt, hsa; identical to SEQ ID NO: 58453

SEQ ID NO: 83304 - RNA, 64 nt, hsa; identical to SEQ ID NO: 58454

SEQ ID NO: 83305 - RNA, 64 nt, hsa; identical to SEQ ID NO: 58455

SEQ ID NO: 83306 - RNA, 64 nt, hsa; identical to SEQ ID NO: 58456

SEQ ID NO: 83307 - RNA, 64 nt, hsa; identical to SEQ ID NO: 58457

SEQ ID NO: 83308 - RNA, 64 nt, hsa; identical to SEQ ID NO: 58458

SEQ ID NO: 83309 - RNA, 64 nt, hsa; identical to SEQ ID NO: 58459

SEQ ID NO: 83310 - RNA, 64 nt, hsa; identical to SEQ ID NO: 58460

SEQ ID NO: 83311 - RNA, 64 nt, hsa; identical to SEQ ID NO: 58461

SEQ ID NO: 83312 - RNA, 64 nt, hsa; identical to SEQ ID NO: 58462

SEQ ID NO: 83313 - RNA, 64 nt, hsa; identical to SEQ ID NO: 58463

SEQ ID NO: 83314 - RNA, 64 nt, hsa; identical to SEQ ID NO: 58464

SEQ ID NO: 83315 - RNA, 64 nt, hsa; identical to SEQ ID NO: 58465

SEQ ID NO: 83316 - RNA, 64 nt, hsa; identical to SEQ ID NO: 58466

SEQ ID NO: 83317 - RNA, 64 nt, hsa; identical to SEQ ID NO: 58467

SEQ ID NO: 83318 - RNA, 64 nt, hsa
gacauuaacugcgugccuggcccuaugagggcggcggcgggacagggugagcggagagacagaa

SEQ ID NO: 83319 - RNA, 64 nt, hsa
uuguaugaaaggggccacugugugucuuccuccccggcgggagccccacaugugugcacuguag

SEQ ID NO: 83320 - RNA, 52 nt, hsa
gccucuggcggcccuggugacccggcgggaccugcgggcgcgcggcccgacg

SEQ ID NO: 83321 - RNA, 64 nt, hsa
gugaggcccugucacagccuguggguaggggaugcggcgggauccucauugccaugguacucaa

SEQ ID NO: 83322 - RNA, 64 nt, hsa
gaggacggugcggggccgcagggggcgcggggcgcggcgggacccaggcuacgagcgggaggga

SEQ ID NO: 83323 - RNA, 64 nt, hsa
ccgcccugcgcuggacugguucaagcuuccgccucggcgggaacgcuguacauagucagguccg

SEQ ID NO: 83324 - RNA, 64 nt, hsa
ggcccugcccucacuuuuaccaaagguucucccucggcgggagggcaucuguguuggaggugau

SEQ ID NO: 83325 - RNA, 64 nt, hsa
ggagucaucaguaugaggggaacccccaccgcgucggcgggaagcgugggagguguagcuccua

SEQ ID NO: 83326 - RNA, 64 nt, hsa
ccagcaaggacacgcucuccccaacagggugcuucggcgggaggugggggaacaaggggucuuc

SEQ ID NO: 83327 - RNA, 54 nt, hsa
gcgucuaccgagcccagugaggcgcggcgggagggcgcggggcggggagcgagc

SEQ ID NO: 83328 - RNA, 64 nt, hsa
ggguggggcuggacggggacgaggcgcggagaggcggcgggaaagagcuucggcugggccacgg

SEQ ID NO: 83329 - RNA, 64 nt, hsa
agauggugaggcugucaguguauggggcagcuuccggcgggauguugaacuggucauuaaugug

SEQ ID NO: 83330 - RNA, 64 nt, hsa
ccggcguuucuguuaccccggccgcggcucuuggcggcgggagaggcgcaguggcugcaggcug

SEQ ID NO: 83331 - RNA, 64 nt, hsa
gcgggcgggcccggcugccaaggaggagggagagcggcgggaggggccgcggugccgggccggg

SEQ ID NO: 83332 - RNA, 64 nt, hsa
cgccacauccucacgcucgguggagggacgcgugcggcgggacggugccuacggguacuugcag

SEQ ID NO: 83333 - RNA, 64 nt, hsa
cagcaagcaggaucgcugcucagaccugugaccccggcgggacccccauguccuccgcuccgcc

SEQ ID NO: 83334 - RNA, 64 nt, hsa
ucggucaucuagccccaccccugccugucggacgcggcgggaggcccacgguucggggcuucug

SEQ ID NO: 83335 - RNA, 64 nt, hsa
agagcuguguggccuggcaagcaagccugggagccggcgggaggucugccaggcugucccgugc

SEQ ID NO: 83336 - RNA, 64 nt, hsa
gaucaaccagguggcauuggaggcguggcgcagccggcgggaccgcgaggagauccuccugcag

SEQ ID NO: 83337 - RNA, 64 nt, hsa
ugcugugcagucagaggcccaggguccagcagcccggcgggaacgggugcugccucuuccucca

SEQ ID NO: 83338 - RNA, 64 nt, hsa
gcuggcagacaaggugaagaggcugaugcggccccggcgggaggggggccccccuggggggcug

SEQ ID NO: 83339 - RNA, 64 nt, hsa
ggcgagguggcuggacagcaccagcagcgcaucccggcgggaacccagaaaaggcuucuuacac

SEQ ID NO: 83340 - RNA, 64 nt, hsa
aagggcucagggcaccagcaaccaagccagcccccggcgggaucgauacccucaccccuccacu

SEQ ID NO: 83341 - RNA, 64 nt, hsa
acacccucuguaauuuuaagauguaugugguggccggcgggaagaccagccccgacagcaccuc

SEQ ID NO: 83342 - RNA, 64 nt, hsa
gagacggaggaagcggcagaaggcggacgcgugccggcgggaggagccacgcgugagcacaccu

SEQ ID NO: 83343 - RNA, 59 nt, hsa
uccucaacaaccccagauaguggcggccccggcgggaggggcgggugggaggccgcggc

SEQ ID NO: 83344 - RNA, 64 nt, hsa
ccagagcaagcucagcgaggaccucauggaguuccggcgggacgcauccauguuaaaugugagc

SEQ ID NO: 83345 - RNA, 64 nt, hsa
auccauucuagagccagucucugccucccagacgcggcgggagccaagcuccuccaaccacaag

SEQ ID NO: 83346 - RNA, 64 nt, hsa
gccgcaccgagugcacuuuaggggccccuacggccggcgggaucggccucccucccccacgacu

SEQ ID NO: 83347 - RNA, 64 nt, hsa
ggcgggggcaaagcccccagagccucacuggccccggcgggaugaggagaccaugccgggcgcg

SEQ ID NO: 83348 - RNA, 64 nt, hsa
ccaggguuagacacaaggaccugaagugacaugacggcgggacaggggaaaugugacuuucuaa

SEQ ID NO: 83349 - RNA, 59 nt, hsa
uggucacgaagaacuuguaaggccaacugcggcgggaggcccugaagaugcaguccccc

SEQ ID NO: 83350 - RNA, 64 nt, hsa
cggcaacguagccugggcucacugugcuggggcacggcgggauccuccacagagaggaggggac

SEQ ID NO: 83351 - RNA, 64 nt, hsa
gaccuggccuugccaagggccuggggcaaggugucggcgggacggugaggaagggggaggcagc

SEQ ID NO: 83352 - RNA, 64 nt, hsa
aggcgucuacauucgcugagaggcaggggccacacggcgggaggaagggcucugagcccagggg

SEQ ID NO: 83353 - RNA, 64 nt, hsa
agccccgggggauccgggcugcugggcagcaggucggcgggaccacaugccugggucucacccu

SEQ ID NO: 83354 - RNA, 64 nt, hsa
caagucgcugagccauugaggaucgcgacgcagucggcgggacccucauggaagcaucgcccuc

SEQ ID NO: 83355 - RNA, 64 nt, hsa
ccgccccugggcccgucugcgccggaggcugcggcggcgggagccacggaccagaccagccaca

SEQ ID NO: 83356 - RNA, 64 nt, hsa
gaagcggcgaagcagccggagucgggagcgggcccggcgggagcgggagcgcaaggaggagcug

SEQ ID NO: 83357 - RNA, 64 nt, hsa
gagccgcuacgaggccuuccugaguccggaguaccggcgggaggagguagggccauagugaccc

SEQ ID NO: 83358 - RNA, 64 nt, hsa
ugcuccugccgccuuccuucacggcacuuacaaccggcgggacccccagggaccaccccucagg

SEQ ID NO: 83359 - RNA, 64 nt, hsa
ccuugggcugggggagggggcccacccuuaaaggcggcgggaggggagggagggagaguggagg

SEQ ID NO: 83360 - RNA, 64 nt, hsa
cccgcugcucggcggaucccagcugcgguggcgacggcgggaaggcgcuuuccgcuguuccuca

SEQ ID NO: 83361 - RNA, 64 nt, hsa
ugcuucuccccugggcugcugugggcuggguccccggcgggacugucaauggaggcagggguuc

SEQ ID NO: 83362 - RNA, 64 nt, hsa
gacccgaggccaccccagccugguguggacccaucggcgggagagagugccacgccuccacagc

SEQ ID NO: 83363 - RNA, 64 nt, hsa
aaugauuuuauucauuuuuauguuuucuuuugggcggcgggauggagucucugucacccaggcu

SEQ ID NO: 83364 - RNA, 64 nt, hsa
augcuuuaaugauaacugcuuuggcaauuccccagacagguauacuucuucauccaaaauugca

SEQ ID NO: 83365 - RNA, 64 nt, hsa
agaguaagcaguacaaaguguauauuuuggaaaagacagguaacagguaacagcaucgcuaauc

SEQ ID NO: 83366 - RNA, 64 nt, hsa
uuauaaacaaggcugguggcugucuacccacccucccuucuagcagauuuugauuuuguuucaa

SEQ ID NO: 83367 - RNA, 64 nt, hsa
gccugugacggggcggguggcgucuacccacccucccuucuagcagauucuuauuuuguuugaa

SEQ ID NO: 83368 - RNA, 64 nt, hsa
uuucagcgaaggucaguguauuuaguguaauuaccccuucuaaacaguguccuagucccucccu

SEQ ID NO: 83369 - RNA, 64 nt, hsa
aaagggguaagagcuggcuucuguagccaccugucccuucuauuuuucagcgaaggucagugua

SEQ ID NO: 83370 - RNA, 64 nt, hsa
uuccauugcuuuggccuucaguaaaaagcagccucccuucuaggucagggaaccaugccauuga

SEQ ID NO: 83371 - RNA, 64 nt, hsa
guugcagcuaaaaaucagucucugaagucucucucccuucuagagguuaggacuuggugaacau

SEQ ID NO: 83372 - RNA, 64 nt, hsa
aucucuagcaaccuccugggccccaugcccccaccccuucuagaaccugcauucccagggccuu

SEQ ID NO: 83373 - RNA, 64 nt, hsa
ccaaaccauaaaugugauuauaguuaacacaugacccuucuagcgucccagccaguguuuuucc

SEQ ID NO: 83374 - RNA, 64 nt, hsa
aagcaacugaacggaugcgugcgagcugaggacagggcgggaggagggggcacacaugccccag

SEQ ID NO: 83375 - RNA, 64 nt, hsa
caaacaauaccugcucauuuacacugaggauucagggcgggagacaggagccuugggguccugu

SEQ ID NO: 83376 - RNA, 64 nt, hsa
ggcauccuugucccccucacccacccagagcuaggggcgggaacagcccaccuuuugguuggca

SEQ ID NO: 83377 - RNA, 64 nt, hsa
gggagguggaugguucuuauucuguggagaagaagggcgggaagaacuuccuuucaggaggaag

SEQ ID NO: 83378 - RNA, 64 nt, hsa
cucucgggagccacagacgcccgagacccacgccgggcgggaccggccagggaucacccccgcc

SEQ ID NO: 83379 - RNA, 64 nt, hsa
gcugcgccgcguccgaacgucgagaccccaccgagggcgggagggggacucucgggagccacag

SEQ ID NO: 83380 - RNA, 64 nt, hsa
caguugcccagcagagcucuuggccccgcugcugcgcccacacucucgccagaguccccagccg

SEQ ID NO: 83381 - RNA, 64 nt, hsa
gcuuccaggccacccaucugucacccuuggacagcgcccacacccuucuagcaccuccugacag

SEQ ID NO: 83382 - RNA, 64 nt, hsa
acaccaacgccgcauaggacugcccacaugggaccgcccacauaggaccgcccacauaggaccg

SEQ ID NO: 83383 - RNA, 64 nt, hsa
uaggacugcccacaugggaccgcccacauaggaccgcccacauaggaccgcccacaugggaccg

SEQ ID NO: 83384 - RNA, 64 nt, hsa
ugggaccgcccacauaggaccgcccacauaggaccgcccacaugggaccgcccacaugggaccg

SEQ ID NO: 83385 - RNA, 64 nt, hsa
uaggaccgcccacauaggaccgcccacaugggaccgcccacaugggaccgcccacaugggaccg

SEQ ID NO: 83386 - RNA, 64 nt, hsa
uaggaccgcccacaugggaccgcccacaugggaccgcccacaugggaccgcccacauagaaccg

SEQ ID NO: 83387 - RNA, 64 nt, hsa
ugggaccgcccacaugggaccgcccacaugggaccgcccacauagaaccguccuccagugguga

SEQ ID NO: 83388 - RNA, 64 nt, hsa
uuuguagcuucuaaugugagguuugaguccagugcgcccacagcagcaugcccuucucaccccu

SEQ ID NO: 83389 - RNA, 64 nt, hsa
uccccagggaagagaaugaggaccacguggacuccgcccacacagagcuggcugcugugcccac

SEQ ID NO: 83390 - RNA, 64 nt, hsa; identical to SEQ ID NO: 52852

SEQ ID NO: 83391 - RNA, 64 nt, hsa; identical to SEQ ID NO: 52853

SEQ ID NO: 83392 - RNA, 64 nt, hsa; identical to SEQ ID NO: 52854

SEQ ID NO: 83393 - RNA, 64 nt, hsa; identical to SEQ ID NO: 52855

SEQ ID NO: 83394 - RNA, 64 nt, hsa; identical to SEQ ID NO: 52856

SEQ ID NO: 83395 - RNA, 64 nt, hsa; identical to SEQ ID NO: 52857

SEQ ID NO: 83396 - RNA, 64 nt, hsa; identical to SEQ ID NO: 52858

SEQ ID NO: 83397 - RNA, 64 nt, hsa; identical to SEQ ID NO: 52859

SEQ ID NO: 83398 - RNA, 60 nt, hsa; identical to SEQ ID NO: 52860

SEQ ID NO: 83399 - RNA, 64 nt, hsa; identical to SEQ ID NO: 52861

SEQ ID NO: 83400 - RNA, 64 nt, hsa; identical to SEQ ID NO: 52862

SEQ ID NO: 83401 - RNA, 64 nt, hsa; identical to SEQ ID NO: 52863

SEQ ID NO: 83402 - RNA, 62 nt, hsa
auuucagaguggggaagugauaaacuauuugccuucuggagcucuuugugaaaaauuaaaaa

SEQ ID NO: 83403 - RNA, 62 nt, hsa
gucuggauuucucuugggaucuaacgugggaucuucuggacagacaaccgugacaucagcag

SEQ ID NO: 83404 - RNA, 62 nt, hsa
uauuauacacccccagaaagagagaaagcugccuucuggaggacugauuccacaugcuauau

SEQ ID NO: 83405 - RNA, 62 nt, hsa
auaccuugccagaucccucucucaguuccagccuucuggacaaggccugggcuaagaggagc

SEQ ID NO: 83406 - RNA, 62 nt, hsa
acccagcugggacuccaaaacucaaccaucaccuucuggaauaucacccuggaggaugaagg

SEQ ID NO: 83407 - RNA, 62 nt, hsa
ugcucugccacugcccgcccagcccccauggucuucuggaaggucccucggucagggauuga

SEQ ID NO: 83408 - RNA, 62 nt, hsa
auugccaaugcuacaguaauaaaugaaugucacuucuggauauagcuaggugacauauacau

SEQ ID NO: 83409 - RNA, 62 nt, hsa
cccaucuuaaaaacaacgaaagaaggcauggacuucuggaugcccauccacuggguguaaac

SEQ ID NO: 83410 - RNA, 62 nt, hsa
cuggaguuuuagugaaaggauuuauugagcagcuucuggaauauaaugugcauguccaaaau

SEQ ID NO: 83411 - RNA, 62 nt, hsa
uggcagaugaauaauuuucacucauuuauugucuucuggaaaccauuuaacuuuuacuguuu

SEQ ID NO: 83412 - RNA, 62 nt, hsa
ucuacuuguucuccagcuucuggguagcugggcuucuggaaggguggcagugggcuacuccc

SEQ ID NO: 83413 - RNA, 62 nt, hsa
gagccgcuguacccgaacuuuuuuuguuuuugcuucuggaacuuugaaacacaaaacacaag

SEQ ID NO: 83414 - RNA, 62 nt, hsa
guacaaacgcugcuuggauaaggagagcaaagcuucuggaacuuuauuuacucuuucuuuuu

SEQ ID NO: 83415 - RNA, 62 nt, hsa
gggccaaccacguuuguuaucauggcugcugccuucuggacagcugccagcucugccuugag

SEQ ID NO: 83416 - RNA, 62 nt, hsa
gcgugguuuuuugcuaagagccagaggcaggucuucuggaguucucaggggggcccugugac

SEQ ID NO: 83417 - RNA, 62 nt, hsa
cccguguuucucagacuuuaaagccaccagggcuucuggaacaccugucauagaagcaauaa

SEQ ID NO: 83418 - RNA, 62 nt, hsa
gucuaaaaucaaagugucagcagaguugguuccuucuggaggcucuaaggaagaauccauaa

SEQ ID NO: 83419 - RNA, 62 nt, hsa
uguggcugugugcaauucuuggaguucuuuggcuucuggacaaaucuuguccaaguauugca

SEQ ID NO: 83420 - RNA, 62 nt, hsa
agccugcaggguccugggccauguggguggugcuucuggaugugagucucuuauuuaucugc

SEQ ID NO: 83421 - RNA, 62 nt, hsa
cugggaaaccgggccagcguggggcucccugccuucuggacuccugaaggucguggauggau

SEQ ID NO: 83422 - RNA, 62 nt, hsa
agacugaucauaaaccaaugcugguauugcaccuucuggaacuaugggcuugagaaaacccc

SEQ ID NO: 83423 - RNA, 62 nt, hsa
aaauagaagcaggaaagggagacaaagacuggcuucuggacuuccucccugauccccacccu

SEQ ID NO: 83424 - RNA, 62 nt, hsa
uccaucucgacccuggggcugaggccugaguccuucuggacucuugguacccacauugccuc

SEQ ID NO: 83425 - RNA, 62 nt, hsa
gaagcuggggcaucgaugacccaagacuuuaucuucuggaaaauauuuuucagacuccucaa

SEQ ID NO: 83426 - RNA, 62 nt, hsa
cauagagguugggcuggaggccuguccacuggcuucuggagcugaaggucugcgucacggug

SEQ ID NO: 83427 - RNA, 62 nt, hsa
ucagaggcucugacacugucugguuuccaaugcuucuggagacuuccugccuaggccucauc

SEQ ID NO: 83428 - RNA, 62 nt, hsa
ugauggcugccccuuccccagacagggcuggacuucuggagcugcuaagccacccuccguuu

SEQ ID NO: 83429 - RNA, 62 nt, hsa
ggaguucccuggagccuggccagcccucaccucuucuggauagaggauucccccaacucccc

SEQ ID NO: 83430 - RNA, 62 nt, hsa
uggggugagggaucacugccaaaaugguacagcuucuggagcagaacuuuccagggauccag

SEQ ID NO: 83431 - RNA, 62 nt, hsa
gccagcaguacguggcuucagaggccuggcaucuucuggagaagcuugugguguuccugaag

SEQ ID NO: 83432 - RNA, 62 nt, hsa
aaauaaacuguauuugcaaauccaacauugagcuucuggacuacgcugacuccacugcugaa

SEQ ID NO: 83433 - RNA, 62 nt, hsa
uggcccacuccucacccccuugcuccccuggucuucuggaguuugugacauugauuugaaau

SEQ ID NO: 83434 - RNA, 62 nt, hsa
acuguuagcucugcuaacagucaggacuauuccuucuggacucugugccuuugccugcacag

SEQ ID NO: 83435 - RNA, 62 nt, hsa
ggcuuguuuguuguuuucaccagagugagcuccuucuggacauacugccuggcagccugccu

SEQ ID NO: 83436 - RNA, 62 nt, hsa
uuauguauuauacuuagucaaauguaauguggcuucuggaaucauuguccagagcugcuucc

SEQ ID NO: 83437 - RNA, 62 nt, hsa
aucaguagcuuaagaaaaaaccguguuugucucuucuggaaugguuagaagugagggaguuu

SEQ ID NO: 83438 - RNA, 64 nt, hsa
ggauccaugauucugcuuugguccaauugcuuccucucugcagaggaacaacccuaaaaccaga

SEQ ID NO: 83439 - RNA, 64 nt, hsa
cuggagaagguugcuucauuggcccugggacuucucucugcaggaggagagaacgcugccucuc

SEQ ID NO: 83440 - RNA, 64 nt, hsa
ucuuucauccuucaguuguauuuagcuuugaguuucucugcaucuguccaccccauguguauau

SEQ ID NO: 83441 - RNA, 64 nt, hsa
ugccagggcgugcuccaggcaccucuuccugaagucucugcauuuggagauucguggagaaccu

SEQ ID NO: 83442 - RNA, 64 nt, hsa
ggaugcuauagauugacacccuccugccuguuuuucucugcaucccaaccuggccaaggccccu

SEQ ID NO: 83443 - RNA, 64 nt, hsa
uccuugacuguggcauugcacucugcacuguuucucucugcagaccuaggggaaaacugcaggu

SEQ ID NO: 83444 - RNA, 64 nt, hsa
aggggaccuuugauugucuuuccagagaugcugcucucugcagggcaccaccuucaaggcacag

SEQ ID NO: 83445 - RNA, 64 nt, hsa
aauagcaaaucuuacagaagguccugugugacccucucugcaucuguccccaggaccuaugcuc

SEQ ID NO: 83446 - RNA, 64 nt, hsa
uuuuuguggaaccauuguuuguuaauguugggauucucugcacuuuugaaugugaaagcuuaua

SEQ ID NO: 83447 - RNA, 64 nt, hsa
uuuucuaauagguauuuagaagcacuugaaauaaucucugcauguguuacaauucaguuauuuc

SEQ ID NO: 83448 - RNA, 64 nt, hsa
cucccagggguccugaggguuucagcaccaggguucucugcagccacacaaucagcccggcucg

SEQ ID NO: 83449 - RNA, 64 nt, hsa
uccucacaacccgagauagguacuguuaccauccucucugcagacgaggaaaccgaggaccagg

SEQ ID NO: 83450 - RNA, 64 nt, hsa
uauuaauuucuucccccaaagccggauucuuaauucucugcaacacuuugaggacauuuaugau

SEQ ID NO: 83451 - RNA, 64 nt, hsa
ccccauccagcgagagaguuucaaaagcaaaacaucucugcaguuuuucccaaguacccugaga

SEQ ID NO: 83452 - RNA, 51 nt, hsa
accuuaugucauuugaguaagucucugcaggacguggcaugacuucagagg

SEQ ID NO: 83453 - RNA, 64 nt, hsa
aaaacaaacuccuaguccuuuagaaauaacagauucucugcacaaaaccacccauucauucauu

SEQ ID NO: 83454 - RNA, 64 nt, hsa
ggcuuccuccugcgccugguugauucagcccaccucucugcaucccgcuucccgcgucucuucu

SEQ ID NO: 83455 - RNA, 64 nt, hsa
gcccaccucucugcaucccgcuucccgcgucucuucucugcacuccugccgaccuucccaccug

SEQ ID NO: 83456 - RNA, 64 nt, hsa
aggagaggaggccgcacucucccugucucucccgucucugcacccagcuccucucugcaugcug

SEQ ID NO: 83457 - RNA, 64 nt, hsa
ucucccugucucucccgucucugcacccagcuccucucugcaugcugagggcuaaauugggauc

SEQ ID NO: 83458 - RNA, 64 nt, hsa
agugagggguuuuuuuaaccucagagcuagcugcucucugcagccuccuccacuggcuucucug

SEQ ID NO: 83459 - RNA, 64 nt, hsa
ucaagagucaccccagcugcugggcuccucugccucucugcagcagaauguccguccucuguug

SEQ ID NO: 83460 - RNA, 64 nt, hsa
uaauuuuucucuuaaaaaagaagacuuguguaagucucugcaucaacgccaauaaacauguugc

SEQ ID NO: 83461 - RNA, 64 nt, hsa
gggauagcaaaauauacuguguauucagagggccucucugcagcugcuagcucagacaccaaag

SEQ ID NO: 83462 - RNA, 64 nt, hsa
gcagaagagcagaggucuucucugcaccaaccacucucugcagauggcuggagaaagggugugc

SEQ ID NO: 83463 - RNA, 64 nt, hsa
guccuugucaaggugggcagaagagcagaggucuucucugcaccaaccacucucugcagauggc

SEQ ID NO: 83464 - RNA, 64 nt, hsa
aagcugcacugcaaagggaguaacggacucugcuucucugcagugcaaaggguguaagggacuc

SEQ ID NO: 83465 - RNA, 64 nt, hsa
gagaggcaguuccuaccuugggaauggaagauuuucucugcaguuugcugaggcccaggagggg

SEQ ID NO: 83466 - RNA, 64 nt, hsa
aggucuuuucuuggcguuccugccaggcucucccucucugcaccugucucauagccucgaauau

SEQ ID NO: 83467 - RNA, 64 nt, hsa
ugcucauucauauuccugccuuucuuccaucagcucucugcaaagaugauuuugcuuuucccua

SEQ ID NO: 83468 - RNA, 64 nt, hsa
uagcccaccccaagcuccgacauugagguuuucaucucugcagggagagguuccaauguccacc

SEQ ID NO: 83469 - RNA, 64 nt, hsa
cacuccagcccaaaaccgugaggaaggugauauaucucugcauuuucccuuguuguugcuugaa

SEQ ID NO: 83470 - RNA, 64 nt, hsa
cugcaacuuccuaagcugccccugccccagcuccucucugcaacccagcccucuccugagcucu

SEQ ID NO: 83471 - RNA, 64 nt, hsa
ccucccaccgcggccccugccuggccaccuggccucucugcaccagggugacaagggguccucg

SEQ ID NO: 83472 - RNA, 64 nt, hsa
uccccuagccgccaccccacguuucuguaccgggucucugcaguguuaaacggacguguaaaua

SEQ ID NO: 83473 - RNA, 64 nt, hsa
ucgucccagccugggacaggcccccuuuccccucucucugcaggccaggagggccuccuuccug

SEQ ID NO: 83474 - RNA, 64 nt, hsa
cuggucucccccucuucucugcccuccacccccgucucugcacugagauacauaagaaacaagg

SEQ ID NO: 83475 - RNA, 64 nt, hsa
augaccaugggaccaccaagcucuaggucauccaucucugcauccaaauaguagggaaacgugg

SEQ ID NO: 83476 - RNA, 64 nt, hsa
gauggcuuuugcugcucuguucucccucuacauuucucugcagaacucgcguuagaaacacaga

SEQ ID NO: 83477 - RNA, 64 nt, hsa
ugugcacuugcugucugcggagccagugugccauucucugcacaugggcagccagccugagcug

SEQ ID NO: 83478 - RNA, 64 nt, hsa
cacaaguccacaccuggccuuggcugcugcccgcucucugcagcguggauuuccuuugcccauu

SEQ ID NO: 83479 - RNA, 64 nt, hsa
accaugcugcucaaaucuucacagaguggaucuuucucugcaguacuguauccacacgagccaa

SEQ ID NO: 83480 - RNA, 64 nt, hsa
uaguuuggagauuacagguccuaucaugccucauucucugcauucacugaccaugcugcucaaa

SEQ ID NO: 83481 - RNA, 64 nt, hsa
ugccugagcgccgccucugugcccaggucccauuucucugcagcacuggccccuuggugcacac

SEQ ID NO: 83482 - RNA, 64 nt, hsa
guggugggagggccucccuggcuugggagaccgcucucugcaagggagggggagagaagcagag

SEQ ID NO: 83483 - RNA, 64 nt, hsa
ucccucagucuccagccugggcugccgagggcuaucucugcagaaugaguugugaucauuguca

SEQ ID NO: 83484 - RNA, 64 nt, hsa
gugucugcauggguagcaggcugcaggaguggggucucugcacagccugggauggggcuugggg

SEQ ID NO: 83485 - RNA, 64 nt, hsa
cccuuuucccuuauggcucugaggccaucggcugucucugcauuucauuggcuguggaggagag

SEQ ID NO: 83486 - RNA, 64 nt, hsa
ucuuuacacuacuuuuucuuccccuuccucuugcucucugcacaccccauucuuaaacuccucc

SEQ ID NO: 83487 - RNA, 64 nt, hsa
uuuauuagggugcuguuuguuauugagagcccaaucucugcaugaauaacagaaagguggacau

SEQ ID NO: 83488 - RNA, 64 nt, hsa; identical to SEQ ID NO: 80183

SEQ ID NO: 83489 - RNA, 64 nt, hsa; identical to SEQ ID NO: 80184

SEQ ID NO: 83490 - RNA, 64 nt, hsa; identical to SEQ ID NO: 80185

SEQ ID NO: 83491 - RNA, 64 nt, hsa; identical to SEQ ID NO: 80186

SEQ ID NO: 83492 - RNA, 64 nt, hsa; identical to SEQ ID NO: 80187

SEQ ID NO: 83493 - RNA, 64 nt, hsa; identical to SEQ ID NO: 80188

SEQ ID NO: 83494 - RNA, 64 nt, hsa; identical to SEQ ID NO: 80189

SEQ ID NO: 83495 - RNA, 64 nt, hsa; identical to SEQ ID NO: 80190

SEQ ID NO: 83496 - RNA, 64 nt, hsa; identical to SEQ ID NO: 80191

SEQ ID NO: 83497 - RNA, 64 nt, hsa; identical to SEQ ID NO: 80192

SEQ ID NO: 83498 - RNA, 64 nt, hsa; identical to SEQ ID NO: 80193

SEQ ID NO: 83499 - RNA, 64 nt, hsa; identical to SEQ ID NO: 80194

SEQ ID NO: 83500 - RNA, 64 nt, hsa; identical to SEQ ID NO: 80195

SEQ ID NO: 83501 - RNA, 64 nt, hsa; identical to SEQ ID NO: 80196

SEQ ID NO: 83502 - RNA, 64 nt, hsa; identical to SEQ ID NO: 80197

SEQ ID NO: 83503 - RNA, 64 nt, hsa; identical to SEQ ID NO: 80198

SEQ ID NO: 83504 - RNA, 64 nt, hsa
augacauugucacacagaaauuacacauuuuaugugccagaagccuuaaacaucuuucugugaa

SEQ ID NO: 83505 - RNA, 64 nt, hsa
auuaaaauauuagaauuuguguuguggcuuuuaaugccagaagaaaaguuaccagaauuuauaa

SEQ ID NO: 83506 - RNA, 64 nt, hsa
auauauugauaaaaagugacucucagauugguaaugccagaaaaaauuuuaagaggacucacca

SEQ ID NO: 83507 - RNA, 64 nt, hsa
cagaaguaauggauaacagaauggaaauaagagaugccagaacuacuuccauaacuaacucacc

SEQ ID NO: 83508 - RNA, 64 nt, hsa
cugcuucuaacaugaaggccuuuagaugccagucugccagaaaucuggaaacagaggaaccggu

SEQ ID NO: 83509 - RNA, 64 nt, hsa
cagaguuugggcacacacugcccucccuccgagaugccagaaguuuuuccacagccuuggagag

SEQ ID NO: 83510 - RNA, 64 nt, hsa
uucuagcugacuucugcacaagcuagugaggaccugccagaauuguugccugagcgugccaggc

SEQ ID NO: 83511 - RNA, 64 nt, hsa
ccaugguguguguguccagaggugugugugaggcugccagaacaagugcugggucugucacaga

SEQ ID NO: 83512 - RNA, 64 nt, hsa
uaagaugauaagaaagugcuccugagaaggcucuugccagaagccugaugugaguguguggcac

SEQ ID NO: 83513 - RNA, 64 nt, hsa
accugacccccguaagcugcugaacaaguagggcugccagaaaugucccacuagggaauuuggu

SEQ ID NO: 83514 - RNA, 64 nt, hsa
guugggugaauuuaauggaaucaaguuaaguaggugccagaaccauugcuguuuucccuccaua

SEQ ID NO: 83515 - RNA, 64 nt, hsa
agagaagcacgcuguccccgucucuccuggcuucugccagaaaaucgaacaagugcaauuaaca

SEQ ID NO: 83516 - RNA, 64 nt, hsa
gacgccucuccccuggucuggaaucuuccaguucugccagaauuggccuuucccagaugcugca

SEQ ID NO: 83517 - RNA, 64 nt, hsa
cccaccaucucccggaccccagggagguggccauugccagaagccuguggguuucuuucuagcu

SEQ ID NO: 83518 - RNA, 64 nt, hsa
uuagccauggguccuuucugcaggguccccucugugccagaaauggguuuucgggacuugcccc

SEQ ID NO: 83519 - RNA, 64 nt, hsa
uggaaaguagcuuacccuagaaaacagcugcaaaugccagaaagaugaucccuaaaaauguuga

SEQ ID NO: 83520 - RNA, 64 nt, hsa
cugagaguguguacaaguuuuaguauacaugccaugccagaagauaguguaugcaagaagucuu

SEQ ID NO: 83521 - RNA, 64 nt, hsa
aacacagaccugcugaaucagcuucuuucugagcugccagaaguacagaaguuggagccuccac

SEQ ID NO: 83522 - RNA, 64 nt, hsa
ucaugagucucagguccagguggagucuguagguugccagaacucaaaagucugaaaaacaucc

SEQ ID NO: 83523 - RNA, 64 nt, hsa; identical to SEQ ID NO: 21333

SEQ ID NO: 83524 - RNA, 64 nt, hsa; identical to SEQ ID NO: 21334

SEQ ID NO: 83525 - RNA, 64 nt, hsa
aucaaugaaacucuugagucuugcuuaggcucgcaaacaagaaguggggaggcuugggaaauua

SEQ ID NO: 83526 - RNA, 64 nt, hsa
aguaaaccccaccauuaccuucuaguuggcauaaaaacaagaaccacaaaaacuugaaaaaucu

SEQ ID NO: 83527 - RNA, 64 nt, hsa
aagacgacgacaaaggccuuuggccugugcuacuaaacaagaagccuaugaaaaauuucuucuu

SEQ ID NO: 83528 - RNA, 64 nt, hsa
gaauauuggaagcagcauaguguugauguacgcaaaacaagacagcuuggucagcuacaaucuu

SEQ ID NO: 83529 - RNA, 64 nt, hsa
guuacucaaaaacauugacucugcaucaagaaagaaacaagaaagcaauaaaacaagaaauaau

SEQ ID NO: 83530 - RNA, 64 nt, hsa
gacucugcaucaagaaagaaacaagaaagcaauaaaacaagaaauaauucaugcucacauuuuu

SEQ ID NO: 83531 - RNA, 64 nt, hsa
ugcaacaugcauucuugauuaccuacugugugccaaacaagauuuuguagaauauugcaaaaau

SEQ ID NO: 83532 - RNA, 64 nt, hsa
cugcuuugccuuuucucugggccaagucauggugaaacaagaaagcuacaagcucuaaauggua

SEQ ID NO: 83533 - RNA, 64 nt, hsa
auuuguuaaaaaaaaacaaaaaaaaaaaaaaaaaaaacaagaugacgacgacaaccacaaaaaa

SEQ ID NO: 83534 - RNA, 64 nt, hsa
cucguucccuccccuggugccugugucugcagaaaaacaagaccagaugugauuuguuaaaaaa

SEQ ID NO: 83535 - RNA, 64 nt, hsa
uuaggccugaaccaaaaaacaacaaacaaacaaaaaacaagaaugaaaaacagaaauaaaagaa

SEQ ID NO: 83536 - RNA, 64 nt, hsa
aucuggaacauuacuuauuugaggucagagaacaaaacaagaaccuggccagguguugauuacc

SEQ ID NO: 83537 - RNA, 64 nt, hsa
aguuuggugcuuuaaauuaagucuguuuacuaugaaacaagagucauuuuuagaggauuuuaac

SEQ ID NO: 83538 - RNA, 64 nt, hsa
acuaucaucacaugccuccccaaccccaagucaaaaacaagaggaaugguacuacaaacauggc

SEQ ID NO: 83539 - RNA, 64 nt, hsa
cuauaaauaccauuuugagugagaaaguacuuuuaaacaagaaagaaauuguacauuaugacua

SEQ ID NO: 83540 - RNA, 64 nt, hsa
ugaagagauauuuguauuuuucaaauguuaaguaaaacaagaugugccaauaucauagguaaau

SEQ ID NO: 83541 - RNA, 64 nt, hsa
gccuuauucaccuuuuuaauaaaaauacacaugaaaacaagaaagaaauggcuuuucuuaccca

SEQ ID NO: 83542 - RNA, 64 nt, hsa
cuccuguccucccccgcacccccucccuucugggaaacaagaagaguaaacaggaaaccuacuu

SEQ ID NO: 83543 - RNA, 64 nt, hsa
gagcuucuucccuaagccauaaacugucucaccuaaacaagauagaccucaauaaaagacauaa

SEQ ID NO: 83544 - RNA, 64 nt, hsa
aacaugaaaaugcuggugagcugagguagaaaaaaaacaagaaaaaaauuuuaaaaauagcguu

SEQ ID NO: 83545 - RNA, 64 nt, hsa
uccuuacacauuugucauacuaucaaagagaaagaaacaagauuuccauucccacaaauuuuag

SEQ ID NO: 83546 - RNA, 64 nt, hsa
uauuuuuuauuaccagagcauaucuauuauagcaaaacaagaaaaguggacuuuguuguuauuu

SEQ ID NO: 83547 - RNA, 64 nt, hsa
uuuguaauaaucgagaaugccugggcauuuuacaaaacaagaaaaaaaauacccuuuucuuuuc

SEQ ID NO: 83548 - RNA, 64 nt, hsa
uuuuuuugaaaugaaaagacuuuuuaaaaaaguaaaacaagaaaaguacauucuuuagaaacua

SEQ ID NO: 83549 - RNA, 64 nt, hsa
aagcuuuuguuugcauuuaaauuaaauggcuucuaaacaagaaauugcagcauauucuucucuu

SEQ ID NO: 83550 - RNA, 64 nt, hsa
ucauggaauuggaaaaaaagauguacauuuaguuaaacaagauaacacuauuuuuguagcauga

SEQ ID NO: 83551 - RNA, 64 nt, hsa
cuuuucauaacugccugaaaagagagauggugugaaacaagauucugauaaugguuugugugag

SEQ ID NO: 83552 - RNA, 64 nt, hsa
gugcagugucaguuucaaaucaaauuaucuaagaaaacaagaaaacaaaggcagcagacuauug

SEQ ID NO: 83553 - RNA, 64 nt, hsa
aacaaguuagaauaggaaauaguaaaauaaauccaaacaagaguguaauauugguuagggaaac

SEQ ID NO: 83554 - RNA, 64 nt, hsa
uacauuuagacaaaaccccaaacuaagccauuugaaacaagauucucuccauugcaguuuguag

SEQ ID NO: 83555 - RNA, 64 nt, hsa
cuuguagggaugagguuaggaauauucaguuccaaaacaagauaucuucuguccgccuuacaua

SEQ ID NO: 83556 - RNA, 64 nt, hsa
ucuuuuucuccacccaaaccccuucccacgacaaaaacaagacugccucccucucuuccgggag

SEQ ID NO: 83557 - RNA, 64 nt, hsa
gccacguauaguccuagcugacgccaauaauaaaaaacaagaaaccaagugggcugguauucuc

SEQ ID NO: 83558 - RNA, 64 nt, hsa
auuucucuuacuguagaagaaaaaguuuauuaccaaacaagaguauuuuuaugaaagaaaagga

SEQ ID NO: 83559 - RNA, 64 nt, hsa
uaauacaugccucucucagguaagccauuuuauaaaacaagaagauaaaaagcacuguugaggc

SEQ ID NO: 83560 - RNA, 64 nt, hsa
ugcgucagacaaaccugccuuccauuuuauuccuaaacaagauaguuacaaagauuuuuuaaaa

SEQ ID NO: 83561 - RNA, 64 nt, hsa
cucaaucaaggcaauguaaauucugcuaaaacugaaacaagaagaaacaucaaauuugcgauga

SEQ ID NO: 83562 - RNA, 64 nt, hsa
auaccaucauccuaauaacagaagaucuugcaaagaaucacagagcuuaaugggucaagaaguu

SEQ ID NO: 83563 - RNA, 64 nt, hsa
aaguuaguaguauugaguggauacaaugaauggggaaucacauguguagagccccaacuuagau

SEQ ID NO: 83564 - RNA, 64 nt, hsa
agcuaucaccgggaacccucccuguccccuucccgaaucacacacauacccuacccucaccuga

SEQ ID NO: 83565 - RNA, 64 nt, hsa
uuggccucccaggacaucuggccugaggggauuugaaucacagccccgaagguccugccuucac

SEQ ID NO: 83566 - RNA, 64 nt, hsa
cagacaccaagguuuaugccaccagguaacacgggaaucacagguacaugucgcuccggucaga

SEQ ID NO: 83567 - RNA, 64 nt, hsa
gagcuauuuaaugacacaccuuggauuaaaacgggaaucacaucuuaaagcuaaaaaugaaccu

SEQ ID NO: 83568 - RNA, 64 nt, hsa
cagauaaaucaugcccguuccccucugccuggcagaaucacagucucacauacugucuuguacu

SEQ ID NO: 83569 - RNA, 64 nt, hsa
aaauaccaaauaaugaauugguauaccauauccggaaucacacauguuaucuuaaacccagcca

SEQ ID NO: 83570 - RNA, 64 nt, hsa
ggaugcuaaaggagauaaagccaaggugaaggaugaaucacagagaagaucugcgagguugucu

SEQ ID NO: 83571 - RNA, 64 nt, hsa
ugauaugguacagucauuuugacaaucgauauuugaaucacaauauuugaugacaauauccuua

SEQ ID NO: 83572 - RNA, 64 nt, hsa
uggaaugcuacuaagauacuccauauucuuccccgaaucacacagacaguuucugacaggcgca

SEQ ID NO: 83573 - RNA, 64 nt, hsa
gaucugggagagucucacuuuggaaucagaauuggaaucacauucuguuuaucaagccauaaug

SEQ ID NO: 83574 - RNA, 64 nt, hsa
aacugugugagauugugaaguggucugaauucuggaaucacaaaccaagccaugcuggugggcc

SEQ ID NO: 83575 - RNA, 64 nt, hsa
ucaguuaccacuguacugcucaaaaacaugagaggaaucacacugcacagaaacacuaugaaug

SEQ ID NO: 83576 - RNA, 64 nt, hsa
ucauuuaccgccauucugcucgagcacaugaaaggaaucacacuguacagaaacgcuaugaaug

SEQ ID NO: 83577 - RNA, 64 nt, hsa
ccccugggacagcuguuaccuuugcaguguugccgaaucacagcaguuaccuuugcaguguugc

SEQ ID NO: 83578 - RNA, 64 nt, hsa
gccgaaucacagcaguuaccuuugcaguguugccgaaucacagcaguucuguuggagaaacgcu

SEQ ID NO: 83579 - RNA, 65 nt, hsa
auccuugucaaaaugagauuccagguccugagagcugcuuugaggcaguuccaggaguacuuacu

SEQ ID NO: 83580 - RNA, 65 nt, hsa
caaugauggcaccuacuuuugggaaucuguagcugugcuuugagaauugccaucggucauguguu

SEQ ID NO: 83581 - RNA, 65 nt, hsa
guuugggcuuugucuggauuugcuuuucucaguugugcuuugaagugaauaagcuuuguuacaaa

SEQ ID NO: 83582 - RNA, 65 nt, hsa
cugaaccagucuuaccugagacuggaaggcugauuugcuuugaggcugauauguguguuucagag

SEQ ID NO: 83583 - RNA, 65 nt, hsa
ucugcaggucgucagcuuguucuggaaacucuuuaugcuuugacaucgaguacaaaaauaaucaa

SEQ ID NO: 83584 - RNA, 65 nt, hsa
aguacaaaaauaaucaaagaagcaauggcaaagggugcuuugaucuauuuacuggauauguucug

SEQ ID NO: 83585 - RNA, 65 nt, hsa
cguuugugugaagaaaugaacuguggaguacaaaaugcuuugagucuuuccgauugcucauuaau

SEQ ID NO: 83586 - RNA, 56 nt, hsa
uggaggugcgaguuuuauagcuaaggugcuuugaagaggaagccauuauggaugga

SEQ ID NO: 83587 - RNA, 65 nt, hsa
auuuauguccauuucucaauuuuuucauugaucuaugcuuugaguuugcuuucucaacauuauug

SEQ ID NO: 83588 - RNA, 65 nt, hsa
aaauccaucagaaucucagacuacagcacuaaauaugcuuugaugcuacaucaaacggaauggaa

SEQ ID NO: 83589 - RNA, 65 nt, hsa
caaugucaugaaagugguaaaagugggaaccagugugcuuugaaaccaaauuagaaacacauucc

SEQ ID NO: 83590 - RNA, 65 nt, hsa
aucucuacaauacccggcggggcgagaaggaggagugcuuugagcggguccauggcgaguguauc

SEQ ID NO: 83591 - RNA, 65 nt, hsa
aguuuaacaaaugacuguaucuaggcauuucauuaugcuuugaacuuuaguuugccugcaguuuc

SEQ ID NO: 83592 - RNA, 65 nt, hsa
agggcccaaagaauuggaauccuccuuaauuuaauugcuuugaagcauagcuacaauuuguuuuu

SEQ ID NO: 83593 - RNA, 65 nt, hsa
gccugcuuggcagugggacaucaggggaccgguccugcuuugagauggcagggucccuguucuga

SEQ ID NO: 83594 - RNA, 65 nt, hsa
guuugccucugaaauucauggccccugacguuaugugcuuugagguuuugugccugcuuuuugcu

SEQ ID NO: 83595 - RNA, 65 nt, hsa
guaaguucccacacugcuggaccuguggcaaagagugcuuugaauaagucagcuagggauucuug

SEQ ID NO: 83596 - RNA, 65 nt, hsa
gguuuuggaaggagaggucuuuaauagcuuugaaaugcuuugagaucauuggucaaauugcauuu

SEQ ID NO: 83597 - RNA, 65 nt, hsa
gcaaaugaaaaaaauguuaacauuugguagacaugugcuuugacauagcgugagcagcacauuac

SEQ ID NO: 83598 - RNA, 65 nt, hsa
uucuaaaaguuaugguuagaugcuauucuguggguugcuuugauaauucuuacuaacacagauua

SEQ ID NO: 83599 - RNA, 65 nt, hsa
aacaagaucuaugccuuaguguuguuuuuguugucugcuuugauguaaaagcaagaguauuugga

SEQ ID NO: 83600 - RNA, 65 nt, hsa
gaugcuagcugcuuggacauuaacuguguuauuucugcuuugagaugaaaauauauauuuaucuu

SEQ ID NO: 83601 - RNA, 65 nt, hsa
uaaauaugaguaauuucucuaagauauaacccaggugcuuugagaagcugcauuaagguguucag

SEQ ID NO: 83602 - RNA, 65 nt, hsa
uuuauaucuaacuuuccuucccuccauugaguacgugcuuugagaaaacauuucuuaaaacagug

SEQ ID NO: 83603 - RNA, 65 nt, hsa
aaaacuugaaaaguuuauugcuuguagaguuguacugcuuugauuuuugaaguugggguaguagu

SEQ ID NO: 83604 - RNA, 65 nt, hsa
uccucauagacuuauauuuuauaaucagaauauguugcuuugaaaaagccucuaauggacugacc

SEQ ID NO: 83605 - RNA, 65 nt, hsa
gaaauguuaaugguuaauguucccaaaccagagaaugcuuugaaaauguaucauucaguguaaau

SEQ ID NO: 83606 - RNA, 65 nt, hsa
uuuggaauuacaggugugagccaccaugccuggccugcuuugacauauuuuauaguguguuaauu

SEQ ID NO: 83607 - RNA, 65 nt, hsa
uuuagaugggaauugcagaagcugcaucaaaaguaugcuuugagguauauauagugaaacagagc

SEQ ID NO: 83608 - RNA, 65 nt, hsa
aggcuaagggggacagccuuccccuugucagggcuugcuuugacccugcuucguuccaccccggg

SEQ ID NO: 83609 - RNA, 65 nt, hsa
cgcgggccaccccacccuguucauuuccauaaacgugcuuugagaggcgggguccgcauguacgu

SEQ ID NO: 83610 - RNA, 65 nt, hsa
gugagagcaaaaugcauguaaucaacauggcuacuugcuuugaggcucaccagaauuauuuuuaa

SEQ ID NO: 83611 - RNA, 65 nt, hsa
ggucacuuuucacauccuugacuuuuuagaugugcugcuuugauauauaggacauugauuugauu

SEQ ID NO: 83612 - RNA, 64 nt, hsa
uggauaccaauauucuauuuugcagauagaauuuggcccagagagguuaacuaauauauccaug

SEQ ID NO: 83613 - RNA, 64 nt, hsa
uugccugucaccccagucaccuaagcaaucacugggcccagaggagaggagacagacacacacu

SEQ ID NO: 83614 - RNA, 64 nt, hsa
agccaaucauguuaacucuuccuuaucagccuguggcccagagacacaaugggguccuucugua

SEQ ID NO: 83615 - RNA, 64 nt, hsa
cuaguaccaacacagggaaaacggaugggaccugggcccagacagucccccuugaccccagggc

SEQ ID NO: 83616 - RNA, 64 nt, hsa
aagucagggucaacucccaggccucagaugcaggggcccagaacaccugcucucaccugagccc

SEQ ID NO: 83617 - RNA, 64 nt, hsa
gaacaccugcucucaccugaaccccaggugaaggggcccagaacaccugcucucaccugagccc

SEQ ID NO: 83618 - RNA, 64 nt, hsa
cucuuggacuuuuggaugccuggccuuaggcuguggcccagaagcuggaaguuugggaaaggcc

SEQ ID NO: 83619 - RNA, 64 nt, hsa
agagggggugaugaccccuccccaagccccucagggcccagaccuuccugcucuccagcagggg

SEQ ID NO: 83620 - RNA, 64 nt, hsa
ggcagggcccagcccugcuuccuggaguggauguggcccagagaaggaggcugggggaucacca

SEQ ID NO: 83621 - RNA, 64 nt, hsa
caaaacuuggcagcugugccagaaaccaaagccaggcccagauguagggggagggcacgagagc

SEQ ID NO: 83622 - RNA, 64 nt, hsa
cgccgauuccgggagcuugggagcccugcgucagggcccagagccucgcacuugcugugugcga

SEQ ID NO: 83623 - RNA, 64 nt, hsa
aagugacuguaggggggaccgucuagaaacaccaggcccagacacacggucccucaggucagga

SEQ ID NO: 83624 - RNA, 64 nt, hsa
gaaagcaggagccccucuggugcuccuagaggguggcccagaggagcugugccagggcguggag

SEQ ID NO: 83625 - RNA, 64 nt, hsa
ccagggggccgcaggggucucuccacccugcaggggcccagacugccugcaggucaggcacagg

SEQ ID NO: 83626 - RNA, 64 nt, hsa
ucaggacacuuggcuuuggggggaaggaaacugaggcccagagaggggcaaccacuggccaagg

SEQ ID NO: 83627 - RNA, 64 nt, hsa
uggcuaagagccuggccuccagccccagcaguguggcccagagcaggggccgacugccaaagua

SEQ ID NO: 83628 - RNA, 64 nt, hsa
cuugcaagcaacaucugcucuguuccucagguggggcccagagcccuuccccgagacugcugau

SEQ ID NO: 83629 - RNA, 64 nt, hsa
aaugaggaugaagucacuauccuagaggcugcuuggcccagaagagccaggcacagagcugcag

SEQ ID NO: 83630 - RNA, 64 nt, hsa
gcugcccuuuggguaggugcugggcuccugggagggcccagaugauggggugaggcaugucuuu

SEQ ID NO: 83631 - RNA, 64 nt, hsa
ggcccugcuucucugcuccccugggugaugggugggcccagaagguggcagucccacaccuugu

SEQ ID NO: 83632 - RNA, 64 nt, hsa
gccugccaggccaggagugggcuggagcugcugaggcccagaaggcccgcauaguuccucacca

SEQ ID NO: 83633 - RNA, 60 nt, hsa
ggggcuccugccucuucugacuucacugggggcccagaggcagauggguggguggguggg

SEQ ID NO: 83634 - RNA, 64 nt, hsa
accucaaccauggcaagaaccagagguccaaagaggcccagacccagguccuugugcucagucc

SEQ ID NO: 83635 - RNA, 64 nt, hsa
acccagguccuugugcucaguccugcgcaaaccaggcccagacccugcaagcauuuguugaugc

SEQ ID NO: 83636 - RNA, 64 nt, hsa
aguggacgacccagccuccccauaccgggccucuggcccagaccuaagcccugcccacaaagac

SEQ ID NO: 83637 - RNA, 64 nt, hsa
ccugaaggcucuaagccuggaacacccugggguuggcccagaaggaggcacaucagucccaaaa

SEQ ID NO: 83638 - RNA, 64 nt, hsa
caacagaugauauugagugucggguggggaaggaggcccagacucugcuucggccaugauuugu

SEQ ID NO: 83639 - RNA, 64 nt, hsa
acuguucacucugugucuuuugaagugccuugaaggcccagaugaaauuuuaaagggagggggu

SEQ ID NO: 83640 - RNA, 64 nt, hsa
ugcacugccagcgccugucuuacccgguggccuuggcccagaaggagccagaggcagcagccuc

SEQ ID NO: 83641 - RNA, 64 nt, hsa
uuaggagcgccuggaagcagaaccaguagcuacaggcccagagauggacuggagagugaggagg

SEQ ID NO: 83642 - RNA, 64 nt, hsa
uggcagggccguccaucagcgcugaccuuccgggggcccagagcuucccagcccugagucaagc

SEQ ID NO: 83643 - RNA, 64 nt, hsa
gcgggccugccccaacccccagcauucccgggugggcccagaccccaucaccaagacuggccac

SEQ ID NO: 83644 - RNA, 64 nt, hsa
cggcgccuggguggcuugccgcccacacuucaggggcccagacuuacacccugacugucccacc

SEQ ID NO: 83645 - RNA, 64 nt, hsa
cucacccagagguuucacccuccuucaucucacgggcccagagcccugucucacucaccccacc

SEQ ID NO: 83646 - RNA, 64 nt, hsa
ggagcgagaagccaaggccagguucuggguguagggcccagagaagcagaacagcccagagccc

SEQ ID NO: 83647 - RNA, 64 nt, hsa
cguggagacaguauuucuuucugucugucccuuuggcccagacccagccugaccaacgaugagc

SEQ ID NO: 83648 - RNA, 64 nt, hsa
ucccccacuggauucccuacaaggagaggccuugggcccagaugagccaguacagacuccagac

SEQ ID NO: 83649 - RNA, 64 nt, hsa
cccauccucagugcccaaugcuguggccccaccaggcccagagccugguuggccauucucaugc

SEQ ID NO: 83650 - RNA, 64 nt, hsa
gacccgggccaggaggcccggggcgcugagcucaggcccagaacuggcugauuucagggauacc

SEQ ID NO: 83651 - RNA, 54 nt, hsa
uccaaaaggauguucuauaaaaauggcccagaguauuuucaacaaagcgugcuu

SEQ ID NO: 83652 - RNA, 64 nt, hsa
auggcugcaggguggaccagcugccuggcauucaggcccagaugccugcagggcuggggcucuc

SEQ ID NO: 83653 - RNA, 64 nt, hsa
agguguauucccguuuuacagauaaggaaacugaggcccagagagcugaaguacugcacccagc

SEQ ID NO: 83654 - RNA, 64 nt, hsa
gaauuaaacuaaaauacaaguaaagcuagacaaaggcccagaaaucauacuguaaggaaauguu

SEQ ID NO: 83655 - RNA, 64 nt, hsa
uugccaaggcucugaccucacagaagaugcccagggcccagaagccaucagaauuaucagugga

SEQ ID NO: 83656 - RNA, 64 nt, hsa
auccuggaaagguggcagagccuccacugagccaggcccagagcuccuugcagugccuucuucc

SEQ ID NO: 83657 - RNA, 64 nt, hsa
uaaaauggugauaaaaaccgacagguuguucaaaggcccagaucagcuaaagcauguauauaag

SEQ ID NO: 83658 - RNA, 59 nt, hsa
agcccggggagaaccucuaggcacaggcgggcccagaccggcuucucggcuuggauccu

SEQ ID NO: 83659 - RNA, 64 nt, hsa
gcucugggccgggccuggggcuccgaaauuccaaggcccagacuugcgggggguggggggguau

SEQ ID NO: 83660 - RNA, 64 nt, hsa
gcccaaaaaggacaaaaaugggcuggccuggaauggcccagaccccagccuccccuccucccuc

SEQ ID NO: 83661 - RNA, 64 nt, hsa
ugcuuguggcugugcaggcugaggucuggagccaggcccagagcuggcuucaggguggggccuu

SEQ ID NO: 83662 - RNA, 64 nt, hsa
aagcuguagcccaucugagagguugggaaacugaggcccagaaacaggaagugacucacacaag

SEQ ID NO: 83663 - RNA, 64 nt, hsa
gcagcuuugcaaggauccggagccagcucccaggggcccagagccccccacuugaagaggagcu

SEQ ID NO: 83664 - RNA, 64 nt, hsa
ggucugaggagacagcugaccuguuggcugaaaaggcccagaucaccgaggaggaggcaaaacu

SEQ ID NO: 83665 - RNA, 64 nt, hsa
aggcccagaucaccgaggaggaggcaaaacuucuggcccagaaggccgcagaggcugagcagga

SEQ ID NO: 83666 - RNA, 64 nt, hsa
aagcccuguggcuccacaggugcugcuucucacuggcccagacucugagcuccaccggcccagu

SEQ ID NO: 83667 - RNA, 64 nt, hsa
gucaaagccagaacugagaggggaccccagacugggcccagaggcuggccagaguucaggaacg

SEQ ID NO: 83668 - RNA, 64 nt, hsa
gagcccaaggggccacugcccuugaaguggagugggcccagaguguggcgguccccaugguggc

SEQ ID NO: 83669 - RNA, 64 nt, hsa; identical to SEQ ID NO: 58132

SEQ ID NO: 83670 - RNA, 64 nt, hsa; identical to SEQ ID NO: 58133

SEQ ID NO: 83671 - RNA, 64 nt, hsa; identical to SEQ ID NO: 58134

SEQ ID NO: 83672 - RNA, 64 nt, hsa; identical to SEQ ID NO: 58135

SEQ ID NO: 83673 - RNA, 64 nt, hsa; identical to SEQ ID NO: 58136

SEQ ID NO: 83674 - RNA, 64 nt, hsa; identical to SEQ ID NO: 58137

SEQ ID NO: 83675 - RNA, 64 nt, hsa; identical to SEQ ID NO: 58138

SEQ ID NO: 83676 - RNA, 64 nt, hsa; identical to SEQ ID NO: 58139

SEQ ID NO: 83677 - RNA, 64 nt, hsa; identical to SEQ ID NO: 58140

SEQ ID NO: 83678 - RNA, 64 nt, hsa
ugucuuuuacuaggacuguaaacuuuugugauaaaauucaaauaagauuuuauuucuugguaau

SEQ ID NO: 83679 - RNA, 64 nt, hsa
ccaauuucuugcauuaauuugaauuuaagcauuuaauucaaagagaggggagcauccauuauug

SEQ ID NO: 83680 - RNA, 64 nt, hsa
gaauguaggaccucugaguggcuguauaauuguuaauucaaaugaaauucauuuaaacaguuga

SEQ ID NO: 83681 - RNA, 64 nt, hsa
aauuuaaaaaaucacguuagccuccaaaccauuuaauucaaaugaacccaucaacuggaugcca

SEQ ID NO: 83682 - RNA, 64 nt, hsa
ggccaacuguauuuaggauaauuucaucacuuuuaauucaaaccagaauaugugaauaagcaga

SEQ ID NO: 83683 - RNA, 64 nt, hsa
aauaaaauauaaaaaugaaaaugaagauacgugaaauucaaaugucacaacuugccuauuauuu

SEQ ID NO: 83684 - RNA, 64 nt, hsa
auucuguuauuuacauaucucuaauuuacuuugaaauucaaaggugaaaauaaaaaaugauggc

SEQ ID NO: 83685 - RNA, 64 nt, hsa
uuaagcucuucuuugcacaaagcuuuauaaagggaauucaaaggaagcccuuuagaauuagagu

SEQ ID NO: 83686 - RNA, 64 nt, hsa
ugaaauaucaauucaaauucuguuuuuagauaucaauucaaauucuuuuuuuuacaauguguuu

SEQ ID NO: 83687 - RNA, 64 nt, hsa
gccucuagggcuuuaaaagucaagaugaaauaucaauucaaauucuguuuuuagauaucaauuc

SEQ ID NO: 83688 - RNA, 64 nt, hsa
uaauuguggauauaaaagaacaccagagaucagaaauucaaaaacucagaauaaaaaugaaaaa

SEQ ID NO: 83689 - RNA, 64 nt, hsa
aaagauaagacaguggcauagaguuaauauuuaaaauucaaauauuaaaacucaaauaaacccc

SEQ ID NO: 83690 - RNA, 64 nt, hsa
aguuacauuuuuuucuuuuuaacacuaaaaauacaauucaaauuuauuagcucuacuacuugaa

SEQ ID NO: 83691 - RNA, 64 nt, hsa
uggacaucaugacgaaaccccaucuccacaaaaaaauucaaaaaauuagccaggugugguggca

SEQ ID NO: 83692 - RNA, 64 nt, hsa
gaauaagaaaggauuaaacaguuacaagccuccaaauucaaauaaaauuaaaucacaguucaga

SEQ ID NO: 83693 - RNA, 64 nt, hsa
cggucucaccgaugcaguuuucauggacauagaaaauucaaauagaauauauaauauugaauuu

SEQ ID NO: 83694 - RNA, 64 nt, hsa
acuccuaggaauguauuuugcuucaggauuuuuaaauucaaauaaggauggcagugcccauuuu

SEQ ID NO: 83695 - RNA, 64 nt, hsa
cuuuaguaauuuguauguaaugucaaauaaaaggaauucaaaucugaguaaauaacagccuccu

SEQ ID NO: 83696 - RNA, 64 nt, hsa
aaucaauaucuccuacauuaguagauauaaacauaauucaaauauuuaaauauuuaagaggaga

SEQ ID NO: 83697 - RNA, 64 nt, hsa
uacaaacauaugcccauuccugugauagcauacaaauucaaacauacagaaacacacacagaua

SEQ ID NO: 83698 - RNA, 64 nt, hsa
uggcuuaaucucuuagacuuagauaagggaguucaauucaaaaccauauaugucaagaccacaa

SEQ ID NO: 83699 - RNA, 64 nt, hsa
ggauucuguggauucuuuaaaccugugugcuaauaauucaaacaauguugcauuaauuguauaa

SEQ ID NO: 83700 - RNA, 64 nt, hsa
acuagccuuaaugaguuucccauuccugaaccaaaauucaaagugagugagauguaaauccugu

SEQ ID NO: 83701 - RNA, 64 nt, hsa
accuuaauuccaggaaagcacagaggacaaaguuaauucaaaaagaggcgcuagaucaagguca

SEQ ID NO: 83702 - RNA, 64 nt, hsa
uaauuguucucuaggaaaagagaacuuuuuucaaaauucaaaauacuuuuuaaggauggcacag

SEQ ID NO: 83703 - RNA, 64 nt, hsa
agguuuuagguggcauaguggcuuaacuggacugaauucaaauauucuuucaacuucaucucaa

SEQ ID NO: 83704 - RNA, 64 nt, hsa
acuguuaucuaucugcuguauauggaauucuuuuaauucaaacgcugaaaagaaucagcauuua

SEQ ID NO: 83705 - RNA, 64 nt, hsa
acaaaucccauuaaauaaauuauaaacaagggucaauucaaauuugaaguaauguuuuaguaag

SEQ ID NO: 83706 - RNA, 64 nt, hsa
uuaacuaguucucgaacuuuacuaugcauaagaaaauucaaacuggagagaaacucuacaaaug

SEQ ID NO: 83707 - RNA, 64 nt, hsa
cauaagauaauuuauacuggagcaaaaccuuggaaauucaaagaaugugguaaaacuuacaauc

SEQ ID NO: 83708 - RNA, 64 nt, hsa
cacacuauguuaaaauuacuuuuuucccuuagauaauucaaauuucuccacuugcuugagauua

SEQ ID NO: 83709 - RNA, 64 nt, hsa
cauuuggaggauuuucuucuuuguaauguaaagaaauucaaaguuaucaaaguuccuuaaaugu

SEQ ID NO: 83710 - RNA, 64 nt, hsa
agauauuuuaaauauuuggaagguguucaauaaaaauucaaauaauuuguacugagggaaacag

SEQ ID NO: 83711 - RNA, 64 nt, hsa
aucucuuuacacaauuggagcucauguacuagagaauucaaagggauaacugcaaagacacugg

SEQ ID NO: 83712 - RNA, 64 nt, hsa
uaacguauuguccuuccguuaacagaaacaucacaauucaaaagugaguuuucuuauuauagug

SEQ ID NO: 83713 - RNA, 64 nt, hsa
auggucuagagggaaaugauucaaauuuuuucauaauucaaacaaaaguuauuacacuaaaagu

SEQ ID NO: 83714 - RNA, 64 nt, hsa
uaaauaaucuuuucuagcuuaauauuuuaauucuaauucaaacaacucugagguuuugguuuca

SEQ ID NO: 83715 - RNA, 64 nt, hsa
aacuauucuugaaaugguauugaaaaauaccguuaauucaaauugacagagauugauaaaaaga

SEQ ID NO: 83716 - RNA, 64 nt, hsa
gccuuugaaauucaguguguauuaaacacaucucaauucaaaccaucaccauauuucaagucuu

SEQ ID NO: 83717 - RNA, 64 nt, hsa
uguuuacuuucugucaagauauuuacccgugucaaauucaaacuacaguacuguguaauuaugu

SEQ ID NO: 83718 - RNA, 64 nt, hsa
uggacaccucugcugugaauguuuuagagaaggaaauucaaaaaauguuguaacugaaagcacu

SEQ ID NO: 83719 - RNA, 64 nt, hsa
uuuaugauguucaucacagugugguaagguugcaaauucaaaacaugucacccaagcucuguuc

SEQ ID NO: 83720 - RNA, 64 nt, hsa
aauaaaguuaccauguuacacuguuauguccuaaaauucaaaucacuauuugagaaacccucaa

SEQ ID NO: 83721 - RNA, 64 nt, hsa
aggguuuugucaaauguuuucugaaaaucugaguaauucaaagcaugccucugccccuuuaaua

SEQ ID NO: 83722 - RNA, 64 nt, hsa
uccauauguuacugaaucugaaaaacaucuuuaaaauucaaacaguuccauuuucucucuugua

SEQ ID NO: 83723 - RNA, 64 nt, hsa
uuaaauaaagaaagugugaggucuacuuuaaaaaaauucaaaugaagagaaaaagaaaaacagc

SEQ ID NO: 83724 - RNA, 64 nt, hsa
cuuuacuccuuaaaaaagaaaggaaagaucucuaaauucaaagcuagauuguaaauaggcauuc

SEQ ID NO: 83725 - RNA, 64 nt, hsa
cuccuuuuuucggaauugaaacauuuuaauuucaaauucaaauagaacauuuaaaaugauuuca

SEQ ID NO: 83726 - RNA, 64 nt, hsa
guggcaacaccuuuggucaaaauucauaccuuguaauucaaaaggcaauucguauuggagagaa

SEQ ID NO: 83727 - RNA, 64 nt, hsa
uugaauauaauucauaccuggcaaaacauauuagaauucaaacuggagagaaaccuuacaaaug

SEQ ID NO: 83728 - RNA, 64 nt, hsa
cugcagguggagcuggagcaagaauaccaagacaaauucaaaagacugccccucgagauuuugg

SEQ ID NO: 83729 - RNA, 64 nt, hsa
uguaugugagauuuuuguuuucuuuccaauagcaaauucaaagcaagcaacuugcaggcuccau

SEQ ID NO: 83730 - RNA, 64 nt, hsa
uuggcuuaauuccaaucauuguuaaaguaaaaacaauucaaagaaucaccuaauuaauuucagu

SEQ ID NO: 83731 - RNA, 64 nt, hsa
aacccaaguuuauuauaucauuaaccuuaucauaaauucaaaccuaaguugcuggacccuggug

SEQ ID NO: 83732 - RNA, 64 nt, hsa
uauaaucuuauucuguagucaucagaauguuaauguaagguacauuugauuuuuauuuuuuaca

SEQ ID NO: 83733 - RNA, 64 nt, hsa
caaaaggcaugucuuaggaacuguuucuguuucuguaagguacaugaauggucaaacaccaguc

SEQ ID NO: 83734 - RNA, 64 nt, hsa
agugauguuggguugugggcagggacagugauggaugacucagagcgucugucuuuguauuucu

SEQ ID NO: 83735 - RNA, 64 nt, hsa
guugaaaagaaacccaaaggaguguuguguggacaugacucacccugaggagucuccagggaug

SEQ ID NO: 83736 - RNA, 64 nt, hsa
uccaacauaaaaauuauaauaggaauaauuugagaugacucaauauuacaaccucuucuucucu

SEQ ID NO: 83737 - RNA, 64 nt, hsa
cccuuuuccauuuuggauuuaucucuuuacuguaaugacucaaaagguauuuaagaauugacga

SEQ ID NO: 83738 - RNA, 64 nt, hsa
cuggcagugcucaccccaggcuucccugacggggaugacucagcacuaccccucaacagagaug

SEQ ID NO: 83739 - RNA, 64 nt, hsa
aacagggaugacuccgcacugccccucaacagggaugacucagcagagaugacucagcacuguc

SEQ ID NO: 83740 - RNA, 64 nt, hsa
cgcacugccccucaacagggaugacucagcagagaugacucagcacugucccuuagcagggaug

SEQ ID NO: 83741 - RNA, 64 nt, hsa
agcacugucccuuagcagggaugacacagcaaggaugacucagcacugccccucagcaaggaug

SEQ ID NO: 83742 - RNA, 64 nt, hsa
agcaaggaugacucagcacugccccucagcaaggaugacucagcacugccgcucaacagacaug

SEQ ID NO: 83743 - RNA, 64 nt, hsa
agcaaggaugacucagcacugccgcucaacagacaugacucagggauggcuuaguacugccccu

SEQ ID NO: 83744 - RNA, 64 nt, hsa
cucagggauggcuuaguacugccccucagcagggaugacucagcaccgccucucaacagggaug

SEQ ID NO: 83745 - RNA, 64 nt, hsa
agcagggaugacucagcaccgccucucaacagggaugacucagcagggaugacucagcaccgcc

SEQ ID NO: 83746 - RNA, 64 nt, hsa
agcaccgccucucaacagggaugacucagcagggaugacucagcaccgccccucaacaggcaug

SEQ ID NO: 83747 - RNA, 64 nt, hsa
agcaccgccccucaacaggcaugacucugcagagaugacucagcacugucccuuagcagggaug

SEQ ID NO: 83748 - RNA, 64 nt, hsa; identical to SEQ ID NO: 83741

SEQ ID NO: 83749 - RNA, 64 nt, hsa
agcaaggaugacucagcacugccccucagcaaggaugacucagcacugccgcucaacagggaug

SEQ ID NO: 83750 - RNA, 64 nt, hsa
agcaaggaugacucagcacugccgcucaacagggaugacucagggauggcuuaguacugccccu

SEQ ID NO: 83751 - RNA, 64 nt, hsa
cucagggauggcuuaguacugccccucaacagggaugacucagcagggaugacucagcaccgcc

SEQ ID NO: 83752 - RNA, 64 nt, hsa
aguacugccccucaacagggaugacucagcagggaugacucagcaccgccccucaacaggcaug

SEQ ID NO: 83753 - RNA, 64 nt, hsa
ugcagagaugacuuaguacugccccucagcagggaugacucaguacugccccucagcagggaug

SEQ ID NO: 83754 - RNA, 64 nt, hsa
agcagggaugacucaguacugccccucagcagggaugacucagcacugccccucaacagggaug

SEQ ID NO: 83755 - RNA, 64 nt, hsa
agcagggaugacucagcacugccccucaacagggaugacucagcagggaugacucagcacuguc

SEQ ID NO: 83756 - RNA, 64 nt, hsa
agcacugccccucaacagggaugacucagcagggaugacucagcacugucccuuagcagugaug

SEQ ID NO: 83757 - RNA, 64 nt, hsa
agcacugucccuuagcagugaugacacagcaaggaugacucagcacugccccucagcaaggaug

SEQ ID NO: 83758 - RNA, 64 nt, hsa; identical to SEQ ID NO: 83742

SEQ ID NO: 83759 - RNA, 64 nt, hsa; identical to SEQ ID NO: 83743

SEQ ID NO: 83760 - RNA, 64 nt, hsa
cucagggauggcuuaguacugccccucagcagggaugacucagcaccgccccucaacagggaug

SEQ ID NO: 83761 - RNA, 64 nt, hsa
agcagggaugacucagcaccgccccucaacagggaugacucagcacugccccucaacagggaug

SEQ ID NO: 83762 - RNA, 64 nt, hsa
aacagggaugacucagcacugccccucaacagggaugacucagcagggaugacucagcaguguc

SEQ ID NO: 83763 - RNA, 64 nt, hsa
agcacugccccucaacagggaugacucagcagggaugacucagcagugucccuuagcagcgaug

SEQ ID NO: 83764 - RNA, 64 nt, hsa
agcagugucccuuagcagcgaugacacagcaaggaugacucagcacugccccucaccaaggaug

SEQ ID NO: 83765 - RNA, 64 nt, hsa
agcaaggaugacucagcacugccccucaccaaggaugacucagcacugccgcucaacagacaug

SEQ ID NO: 83766 - RNA, 64 nt, hsa
accaaggaugacucagcacugccgcucaacagacaugacucagggauggcuuaguacugccccu

SEQ ID NO: 83767 - RNA, 64 nt, hsa
cucagggauggcuuaguacugccccucagcagggaugacucagcagggaugacucagcaccacc

SEQ ID NO: 83768 - RNA, 64 nt, hsa
aguacugccccucagcagggaugacucagcagggaugacucagcaccaccccucaacagggaug

SEQ ID NO: 83769 - RNA, 64 nt, hsa
agcagggaugacucagcaccaccccucaacagggaugacucagcagggaugacucagcacugcc

SEQ ID NO: 83770 - RNA, 64 nt, hsa
agcaccaccccucaacagggaugacucagcagggaugacucagcacugccccucaacagggaug

SEQ ID NO: 83771 - RNA, 64 nt, hsa
ucagcacugccccucaacagggaugacugcagggaugacucagcacugccccucagcagggaug

SEQ ID NO: 83772 - RNA, 64 nt, hsa
ugcagggaugacucagcacugccccucagcagggaugacucagcacugccccucagcagggaug

SEQ ID NO: 83773 - RNA, 64 nt, hsa
agcagggaugacucagcacugccccucagcagggaugacucagcagggaugacucagcaccgcc

SEQ ID NO: 83774 - RNA, 64 nt, hsa
agcacugccccucagcagggaugacucagcagggaugacucagcaccgccccucaacaggcaug

SEQ ID NO: 83775 - RNA, 64 nt, hsa
agcaccgccccucaacaggcaugacucugcagagaugacucagcacugccccucagcagggaug

SEQ ID NO: 83776 - RNA, 64 nt, hsa
agcacugccccucagcagggauggcucagcagggaugacucagcauugccccucaacagggaug

SEQ ID NO: 83777 - RNA, 64 nt, hsa
agcagggaugacucagcauugccccucaacagggaugacucagcagacucagcagggaugacuc

SEQ ID NO: 83778 - RNA, 64 nt, hsa
ccucaacagggaugacucagcagacucagcagggaugacucagcacugccccucaacagacaug

SEQ ID NO: 83779 - RNA, 64 nt, hsa
agcagggaugacucagcacugccccucaacagacaugacucagcagggaugacucagcaccgcc

SEQ ID NO: 83780 - RNA, 64 nt, hsa
agcacugccccucaacagacaugacucagcagggaugacucagcaccgccccucagcaaggaug

SEQ ID NO: 83781 - RNA, 64 nt, hsa
agcagggaugacucagcaccgccccucagcaaggaugacucagcagggaugauucagcagagau

SEQ ID NO: 83782 - RNA, 64 nt, hsa
ggugggauggggaagaccaggagcagagucgagccucacagaagccagcgcgggucucugcuca

SEQ ID NO: 83783 - RNA, 64 nt, hsa
acagaucccagcuuauggccuugacccagccguccucacagaugccgggugacccucuagcucu

SEQ ID NO: 83784 - RNA, 64 nt, hsa
cuaccccuuuccauuuuggauucucggcugaguucucacagaagcauuuuccccauguggcucu

SEQ ID NO: 83785 - RNA, 64 nt, hsa
ggagaaguuuuguggugccgcuggugacaaggaacucacagaaagguuucuuagcuggugaaga

SEQ ID NO: 83786 - RNA, 64 nt, hsa
agaucugggggaggcaggaagcuccucagauuuucucacagacccuucccaauuccaucaccac

SEQ ID NO: 83787 - RNA, 64 nt, hsa
agaguaggaagagagaaaugguagccugcugcuucucacagacaccucacauccucacuuggga

SEQ ID NO: 83788 - RNA, 64 nt, hsa
guaacucccacuccuaaucaagagucucuccagccucacagaugcuggccucuuggcaccugcc

SEQ ID NO: 83789 - RNA, 64 nt, hsa
aguaacaccagggccagcaggcagcgccuguccccucacagacucuuccaccagagcaggggcu

SEQ ID NO: 83790 - RNA, 64 nt, hsa
uucauuuuuaaguuuggaauuuuuaucuauauuucucacagaugugcagugcacaugcaggccu

SEQ ID NO: 83791 - RNA, 64 nt, hsa
aagaggaaucaaguucugaguggcugccaaggcacucacagaaucauaaucauggcuaaauauu

SEQ ID NO: 83792 - RNA, 64 nt, hsa
uuuaucacaaugcccacugugacagaacaagacacucacagauuagugauacguuuuauuuuua

SEQ ID NO: 83793 - RNA, 64 nt, hsa
gugaugcuuucauauugaccucaccccauacuaccucacagauguguugugaggauuaauaaaa

SEQ ID NO: 83794 - RNA, 64 nt, hsa
cggaugcacccgucuuuagaaccaaaaauauucucucacagauuucauuccuguuuuuauauau

SEQ ID NO: 83795 - RNA, 64 nt, hsa
auccauccacgcgugcagagcugccagcagggagcucacagaaggggagggagcaccaggccag

SEQ ID NO: 83796 - RNA, 64 nt, hsa
aaacaagcaacauccucaaaacccaaccccaugccucacagagcuuccuguggcuucuccagcc

SEQ ID NO: 83797 - RNA, 64 nt, hsa
uuguucucucucuggucacugcccuuaccugacccucacagaaagagagcucugagcaggugag

SEQ ID NO: 83798 - RNA, 64 nt, hsa
cuaugaguacuacuuuuguuaaaugugaaaaacccucacagaaagucaucgaggcaaaaagagg

SEQ ID NO: 83799 - RNA, 64 nt, hsa
ugaacagcuaauaaagauuuauuuauuguaauaccucacagacguuguaccauauccaugcaca

SEQ ID NO: 83800 - RNA, 64 nt, hsa
ucccagcaucugugccuccauaccaauccucuuucucacagagaaccacuucccauauaagaug

SEQ ID NO: 83801 - RNA, 64 nt, hsa
ucccuaggaugccaaaguggcauuaugucuguugcucacagaugcagagacugacaauuguguc

SEQ ID NO: 83802 - RNA, 64 nt, hsa
cucuccaugcccugggucacuuccuuuuuugggucucacagaccccuccaggggcugacaccua

SEQ ID NO: 83803 - RNA, 64 nt, hsa
cugaugagagcucaaaccucuagucugggaugagcucacagagcccucaugaguuaagauccau

SEQ ID NO: 83804 - RNA, 64 nt, hsa
auagaaaagacuuaaauggagaaccagcccaugccucacagacaguaggaucccaguaaauaug

SEQ ID NO: 83805 - RNA, 64 nt, hsa
cucagugucugggccagucucacuggaugggaaacucacagaugagcugaucuguaagucacuc

SEQ ID NO: 83806 - RNA, 64 nt, hsa
cuugggcugaauuuagacucucucacagagguggcucacagagaaggauggcagauggugcagc

SEQ ID NO: 83807 - RNA, 64 nt, hsa
uugauccugauuucuugggcugaauuuagacucucucacagagguggcucacagagaaggaugg

SEQ ID NO: 83808 - RNA, 64 nt, hsa
cugcaccccaaguccaggucgggcucagcucuggcucacagacuggagacaaugcagaugccag

SEQ ID NO: 83809 - RNA, 64 nt, hsa
ggucuucggcauugguucccuuugcuccaccccacucacagagacacagggcauccaacugaga

SEQ ID NO: 83810 - RNA, 64 nt, hsa
cuaaggcucucucuccucuaguuccuggaacagacucacagauuggcaugaagcacugaucagg

SEQ ID NO: 83811 - RNA, 64 nt, hsa
auuugauaauuuaaacccccugccccuaaaacuucucacagagcuggggaguugguggcaacuu

SEQ ID NO: 83812 - RNA, 64 nt, hsa
aguaaguuaaagucugguggguuuuuuuucccuccucacagauaaaugaaaaguaaguauucua

SEQ ID NO: 83813 - RNA, 64 nt, hsa
acugauucaaaugcuaaucucuuccagaaacagccucacagacacacccagacaucugguagau

SEQ ID NO: 83814 - RNA, 64 nt, hsa
ugggugcccaagcucagaaggcucuucugacuacugggcaaagaguguagaucagagcagcagu

SEQ ID NO: 83815 - RNA, 64 nt, hsa
uuaauccagaauaacuagcaccagggacuaugaaugggcaaaacugaauuauaagaggcugaua

SEQ ID NO: 83816 - RNA, 64 nt, hsa
cggaucacuugaggccaggaauuugaaaccagccugggcaaaacccugucucuacuaaaaauau

SEQ ID NO: 83817 - RNA, 64 nt, hsa
ggcagaugggcacaggugcuggugaugccucuccugggcaaaacgccccauuuguggcacuuuc

SEQ ID NO: 83818 - RNA, 64 nt, hsa
augccuguaaucccaguacuuugggaggcugaggugggcaaaucaccugaggucaggaguucca

SEQ ID NO: 83819 - RNA, 64 nt, hsa
gaaaacaucggggaaucucuccaggacauuggagugggcaaagauuucuuguguaauaccugac

SEQ ID NO: 83820 - RNA, 64 nt, hsa
uauaguuagauauacuuucucuuaggaaaaauaaugggcaaaaauuuuuguugcaacuuuucau

SEQ ID NO: 83821 - RNA, 64 nt, hsa
gaaaguugcagauccacaaaacuaacaggauaauugggcaaauaaauuacauauaaacacacac

SEQ ID NO: 83822 - RNA, 64 nt, hsa
agucucucggcuccuuuaauguaggauugagagcugggcaaacaggucccacuggggacuguga

SEQ ID NO: 83823 - RNA, 64 nt, hsa
uccucugcccuagagcuguuuguucaaucacugaugggcaaaggggagauguagcuaacuggug

SEQ ID NO: 83824 - RNA, 64 nt, hsa
gugauugugaugcuauuuaucuucagggucacucugggcaaagagaagguccucagccaugccc

SEQ ID NO: 83825 - RNA, 64 nt, hsa
uuaggaugaauggucccuacacaaagaggccuugugggcaaaccuggagaacccuccuaaaucc

SEQ ID NO: 83826 - RNA, 64 nt, hsa
ccaccucugcucgagagguccgugggggaggccgugggcaaaggugucccgagcugccauguuu

SEQ ID NO: 83827 - RNA, 64 nt, hsa
caaauugcuugaccucaggaauuugaggccugccugggcaaaauggugaaaccaugucucuaca

SEQ ID NO: 83828 - RNA, 64 nt, hsa
caguggcucacgccuguaaucccagcacuuagggugggcaaauugcuugaccucaggaauuuga

SEQ ID NO: 83829 - RNA, 64 nt, hsa
cugucuaguggcagcuuuuccccuggaacaggggucccuggaguucacaggcuuauccccagga

SEQ ID NO: 83830 - RNA, 64 nt, hsa
uaaacugguuagaaugaaccuggcucccugagcaucccuggauccuucaaauaggcccugagau

SEQ ID NO: 83831 - RNA, 64 nt, hsa
aaugucucuguuuucuuuuccuuuugaaaaagagucccuggaaaagaaagaauaaguggauucu

SEQ ID NO: 83832 - RNA, 64 nt, hsa
augcucuuuguaugccuuaugcagcgcugaucugucccuggaguucccagguucccagcucccc

SEQ ID NO: 83833 - RNA, 64 nt, hsa
aagacauccucaagaaaacaggggcauccagggcucccuggaugaauagaaugcaauucauuca

SEQ ID NO: 83834 - RNA, 64 nt, hsa
cuccuugccucucccuauggccugcuggcccaccucccuggaccccguuccacccucacccuuu

SEQ ID NO: 83835 - RNA, 64 nt, hsa
uuauaauuugaccacagcaucugaacucccucucucccuggaauaaguauuuuucccacauuuu

SEQ ID NO: 83836 - RNA, 64 nt, hsa
cacuaaaagcaguauuuuaagguuggugucuuacucccuggaagccugaaauggguggaauagc

SEQ ID NO: 83837 - RNA, 64 nt, hsa
ccaagagccugauaacugagcaggguggauccugucccuggagcugcugcacccauuaauucuc

SEQ ID NO: 83838 - RNA, 64 nt, hsa
cagggucacagccuacuaauuccucaaacuucucucccuggacuaggagaaaggcuaaagaaug

SEQ ID NO: 83839 - RNA, 64 nt, hsa
gccaaguuaggauggcaucacucuguggcagcucucccuggacuugcccugccuggaacagggu

SEQ ID NO: 83840 - RNA, 64 nt, hsa
ucaguucucuuugagucugacugacuguggccagucccuggacugguagcugcuggaggccuuc

SEQ ID NO: 83841 - RNA, 64 nt, hsa
cugguagcugcuggaggccuucuuguuucuccagucccuggaagcugagcucuauguguauuug

SEQ ID NO: 83842 - RNA, 64 nt, hsa
accaagaaguaacacuuuuuaaacuuguuagaaaucccuggaggcauuucaaauucaucuucua

SEQ ID NO: 83843 - RNA, 64 nt, hsa
caaauucuagguacacuggcugcugccuauccugucccuggaucugaggccuuucccuugccau

SEQ ID NO: 83844 - RNA, 64 nt, hsa
ggccuuaaaaagauacacaaagaugggcugugggucccuggaaagggggagaguugcccuuuac

SEQ ID NO: 83845 - RNA, 64 nt, hsa
ugcaccucuuugacuaggucccaggauccccuugucccuggaguagggacuaacuauagcacaa

SEQ ID NO: 83846 - RNA, 64 nt, hsa
gugggugagcuuagccacucuuacccaugcucuuucccuggaaucccuggagaccuguccaaga

SEQ ID NO: 83847 - RNA, 64 nt, hsa
cuuagccacucuuacccaugcucuuucccuggaaucccuggagaccuguccaagaugauuucca

SEQ ID NO: 83848 - RNA, 64 nt, hsa
augccaaaugguuguggagaaaguggccggagccucccuggaguggagcagcccugaagccugu

SEQ ID NO: 83849 - RNA, 64 nt, hsa
gguggggugggaaccucaguuucccccaaagucuucccuggaugcuggcuucagguugaagucc

SEQ ID NO: 83850 - RNA, 64 nt, hsa
ccaccgcuccaccuggcuucacuccagcacccugucccuggagcaccucuguccugucugggcc

SEQ ID NO: 83851 - RNA, 64 nt, hsa
aggcccuggcgguccuuggccuggcccauuuuauucccuggacccuuaacugccucacccugag

SEQ ID NO: 83852 - RNA, 64 nt, hsa
ggggaggacacccgacugugcacacuuccaggccucccuggagagguguccacuccauccuucc

SEQ ID NO: 83853 - RNA, 64 nt, hsa
ucagaauaggagcagagagaagcccagacuuccuucccuggaguguagaccugugugugggacc

SEQ ID NO: 83854 - RNA, 64 nt, hsa
uuaagcauuuuaaaaucuauucucucccccuuucucccuggaugauucaggaagcugacauugu

SEQ ID NO: 83855 - RNA, 64 nt, hsa
ugggcccccuucuccauaugccuccaaaaacaugucccuggagaguagccugcucccacacugu

SEQ ID NO: 83856 - RNA, 64 nt, hsa
gugggucagaggugccaguaguauaauauucgucucccuggaguuauguugaaggcagaguuuu

SEQ ID NO: 83857 - RNA, 64 nt, hsa
gcaggaaaacaggauuuuuuuuuuuuuaucuuguucccuggaggauccagggaugaggauagag

SEQ ID NO: 83858 - RNA, 64 nt, hsa
ucucgcugggcuggguccuggauuccagggcuauucccuggaggacagucucaguuaugggaua

SEQ ID NO: 83859 - RNA, 64 nt, hsa
cuuagccaugagcuggcucaggcaucccuucccuucccuggagcugcccugccuuucucaagua

SEQ ID NO: 83860 - RNA, 64 nt, hsa
gaauugggggugggggucuucuaccuaggacucuucccuggagucaugggcugccugggaccca

SEQ ID NO: 83861 - RNA, 64 nt, hsa
ccagaucuuucucuucccugaacguuuucuucuuucccuggacaggcagccuccuuugugugua

SEQ ID NO: 83862 - RNA, 64 nt, hsa
aacccaagugccucaccucgaaaggaggcccuguucccuggagucagggugaacugcaaagcuu

SEQ ID NO: 83863 - RNA, 64 nt, hsa
ggcccucugcagggcccagucuucaguccuguggucccuggacuggugggaaccugaacuagga

SEQ ID NO: 83864 - RNA, 64 nt, hsa
uugaaaaaaacaggacccuuucccuccuuugggcucccuggagguuuuuaagcaguacgugccu

SEQ ID NO: 83865 - RNA, 64 nt, hsa
ggaccugaagcuccagugugugccuuuggccucuucccuggacuugggugaccagucuccgucu

SEQ ID NO: 83866 - RNA, 64 nt, hsa
cugggccaccacucugaggaggguaggaggggccucccuggauugaaccgggacagaaacacgg

SEQ ID NO: 83867 - RNA, 64 nt, hsa
gucugugaaaaacugaaaauccccuggugggcacucccuggagcccaagcagcuccccuagggg

SEQ ID NO: 83868 - RNA, 64 nt, hsa
aaaugucagcgaccugggcuuggaacacagugacucccuggaguagucgggcagcccagauggc

SEQ ID NO: 83869 - RNA, 64 nt, hsa
accaccgagcuucaaugaggaccccagccccacuucccuggaacugccgaggacucuguuuggc

SEQ ID NO: 83870 - RNA, 64 nt, hsa
ugugguggcaguacuguggcccaccaguguaaucucccuggauuaaggcauucuuaaaaacuua

SEQ ID NO: 83871 - RNA, 64 nt, hsa
uuucacaaauuaggccacggcccuaaauaggaauucccuggauugugggcaagugggcggaagu

SEQ ID NO: 83872 - RNA, 64 nt, hsa
ccugcucugggagcauugcuagccuucuaccccaucccuggauccacaggggcuaucgaggaga

SEQ ID NO: 83873 - RNA, 64 nt, hsa
uaacagugaaguaaggcccaaaggaaagacggcuucccuggacaaagaagaccucagggcuacc

SEQ ID NO: 83874 - RNA, 64 nt, hsa
cccuaaccucggcagggcuucuguccuguggaguucccuggacaccuuggucuggcucuugugc

SEQ ID NO: 83875 - RNA, 64 nt, hsa
acccccaccucaugcaucccaaggcucuacugggucccuggaccuaacccugcuuucauccugg

SEQ ID NO: 83876 - RNA, 64 nt, hsa
aacaggcuccgaggaaaaucacuccuacacgcuaucccuggagccugagacugggugccagcuu

SEQ ID NO: 83877 - RNA, 64 nt, hsa
cgccaaugaggaucugcugcaccugcucacgcucucccuggaccucuucuacacggaagacgag

SEQ ID NO: 83878 - RNA, 64 nt, hsa
gugugcaugcaggggugagguauuuucacugcccucccuggagagucccuuguaaguuuggcuc

SEQ ID NO: 83879 - RNA, 64 nt, hsa
uggugccuggcaccccugaaccaugaucugagccucccuggagaagguauuuuauaugucugcu

SEQ ID NO: 83880 - RNA, 64 nt, hsa
agggaauacccaagccccugaugccuaugagaagucccuggacuucaacccuccuguuguuugg

SEQ ID NO: 83881 - RNA, 64 nt, hsa
uagggaagaaagagcugcagcuggagccugacccucccuggaacagggagaggcuggcccgugu

SEQ ID NO: 83882 - RNA, 64 nt, hsa
ggcucaguacuugccaccugcuggccugucugacccuccgcacucaccugccgggacccucccu

SEQ ID NO: 83883 - RNA, 64 nt, hsa
cggcggccgcgagcggggcgggggcugccggugcccuccgcaggccgggccuccugggcgcccc

SEQ ID NO: 83884 - RNA, 64 nt, hsa
uggaguguaguggcacaaucucagcucacugcaaccuccgcaucccggguucaagagauucugc

SEQ ID NO: 83885 - RNA, 64 nt, hsa
cugguggggcacccagcacucugcugggcaucacccuccgcaccccugacauuucucuccaccu

SEQ ID NO: 83886 - RNA, 64 nt, hsa
ggaugcuaggggggcuugcccacugccugccuccccuccgcagcagggaagcucuuuucuccug

SEQ ID NO: 83887 - RNA, 64 nt, hsa
uugcuaugccccagauccuuaauguaguucucauccuccgcaugcccucagccacaagcgggug

SEQ ID NO: 83888 - RNA, 64 nt, hsa
gucagcugaaucccgauaguacuagguccccuucccuccgcaucccgucagcuggaaaaggccu

SEQ ID NO: 83889 - RNA, 64 nt, hsa
caaucauuuauucguucauuuagcaaauaugcagccuccgcaagaugagcucuccugcagacaa

SEQ ID NO: 83890 - RNA, 64 nt, hsa
cagggagggguuggcuuggggugaaaaguucugcccuccgcagggagcagcuccagcugccugg

SEQ ID NO: 83891 - RNA, 64 nt, hsa
uauugcugugcuccccaccacccccauggcagucccuccgcagccccagucccuggccacgccc

SEQ ID NO: 83892 - RNA, 64 nt, hsa
accagccucagcuggcgcagcggggcccuucuucccuccgcauccccuucagggagcaggagcc

SEQ ID NO: 83893 - RNA, 64 nt, hsa
cacucuaacccucggagacccccuaagccccguuccuccgcagacccaggcccuccggaagggg

SEQ ID NO: 83894 - RNA, 64 nt, hsa
caugcuuggcccccucguccccauccaccugugcccuccgcaucuuacccucccuuucucuuuc

SEQ ID NO: 83895 - RNA, 64 nt, hsa
uggacugcaaugacgcgaucuugguucacugcaaccuccgcauccgggguucaagccauucucc

SEQ ID NO: 83896 - RNA, 64 nt, hsa
gggucuucuccccucacccaugcuuucaucauccccuccgcacagccuccccguccaggccuuc

SEQ ID NO: 83897 - RNA, 64 nt, hsa
guuacugugaauguuccccaccgcugagaggcugccuccgcaccugaccgcugcccaggugggg

SEQ ID NO: 83898 - RNA, 64 nt, hsa
ccucucuucaccgccugcgccugaguucgcggguccuccgcaggccgccugggaaccggagccu

SEQ ID NO: 83899 - RNA, 64 nt, hsa
agucacuuaugacgaaauaagucaccccugaacgccuccgcaggcagauucauggagaccaguc

SEQ ID NO: 83900 - RNA, 64 nt, hsa
cgagaugacauauauagaguuuaauuuuacggucccuccgcaggggagcggccuccagccuuau

SEQ ID NO: 83901 - RNA, 64 nt, hsa
ugggagggguccccaacauggauguguugccccuccuccgcaugccaacgcaguucauguacaa

SEQ ID NO: 83902 - RNA, 64 nt, hsa
uuucucucaaccacaucugccuccacacacagcuccuccgcagggaaggagaagcugcucugua

SEQ ID NO: 83903 - RNA, 64 nt, hsa
uuccguuuccuaccuguuugcuuccccccccaguccuccgcaugagcuguugcccuccaggggc

SEQ ID NO: 83904 - RNA, 64 nt, hsa
ucuggccaccuggagagcucgagugccaccaguaccuccgcaccccgggccucuggacuucuug

SEQ ID NO: 83905 - RNA, 64 nt, hsa
guugacugccaaaauagcauccccaacgugcagcccuccgcaucuaucagcagguugccccgga

SEQ ID NO: 83906 - RNA, 64 nt, hsa
uuauaaccuauuaccuauuuuguaugcgacuccaccuccgcauguuuauuuuaauaaaaggcaa

SEQ ID NO: 83907 - RNA, 63 nt, hsa
agaaacugagcaaggccugagcgcugcccugcaccuccgcagaccugcugugaugacuugcca

SEQ ID NO: 83908 - RNA, 64 nt, hsa
cauccuuugugaagcuggaacacuggcuggagacccuccgcaugcaccuggccggccaccugcc

SEQ ID NO: 83909 - RNA, 64 nt, hsa
auguggccccgcucgaggcacagcacgcggugcaccuccgcagccagcuccguccucaggaugu

SEQ ID NO: 83910 - RNA, 64 nt, hsa
uccccucacuucugaaggucccauccccugcugcccuccgcaggcccagggcugggcacucccu

SEQ ID NO: 83911 - RNA, 64 nt, hsa
ccauugccccugagcucccagagucaccccuccaccuccgcagccagugaaguguguugugccu

SEQ ID NO: 83912 - RNA, 64 nt, hsa
cagugggccaagcaguccugguaccugagcgccuccuccgcagagcugcagcagcaguggcugg

SEQ ID NO: 83913 - RNA, 64 nt, hsa
caaauugcugcugaccuuacgccuguauauuaagccuccgcaggaugccggacaauggugaaga

SEQ ID NO: 83914 - RNA, 64 nt, hsa
cugccggcgguggccugggauuggcugugaggucccuccgcaucacccagcucacgucccccaa

SEQ ID NO: 83915 - RNA, 64 nt, hsa
accuuccacccuggggccugugucagccgccggcccuccgcacccuggaagcacacggccucug

SEQ ID NO: 83916 - RNA, 64 nt, hsa
cggccggggcacugugguccaaaagguccugccgccuccgcaucugacugucccaacggcaugc

SEQ ID NO: 83917 - RNA, 64 nt, hsa
cccuaaacaagucugcugcugcccucucaucagaccuccgcacccucaccccaccaucacuuac

SEQ ID NO: 83918 - RNA, 64 nt, hsa
uccaguguccaagcugcggccaggaguccacccaccuccgcauccacccccguccgccauccug

SEQ ID NO: 83919 - RNA, 64 nt, hsa
ggccuccagcgcccugcccuguggacagcccaccccuccgcagccccaucccugcggggcgguc

SEQ ID NO: 83920 - RNA, 64 nt, hsa
cucuccacaccucaaaacuccugccccauaacguccuccgcauccacuuuccagcucagcagcc

SEQ ID NO: 83921 - RNA, 64 nt, hsa
auagcacagucgauuucguuucgcagcugucuccccuccgcagcagauaccucgguccagaucu

SEQ ID NO: 83922 - RNA, 64 nt, hsa
uuugaaaguagagcuagcugccacuuucacguggccuccgcagugucuccaccuacaccccugu

SEQ ID NO: 83923 - RNA, 64 nt, hsa
gaggggaccccuccacccccaguacccuggacccccuccgcagagucucggcagagcccuuugu

SEQ ID NO: 83924 - RNA, 58 nt, hsa
ucaaugaguacuucugcugagggauaugccuccgcaacucacacaccugccugcccac

SEQ ID NO: 83925 - RNA, 64 nt, hsa
cagguaaugaaucguaaccaaaacuacaguugauccuccgcaaaggaaagcucuuuacccagaa

SEQ ID NO: 83926 - RNA, 64 nt, hsa
gagagcaaggaagagaaauuccaugggugacuuuccuccgcagaaagcaaaguuuggggagggc

SEQ ID NO: 83927 - RNA, 64 nt, hsa
gcccaccucuucccgcacccagcaugcagcucugccuccgcagccucagugcgcuuuccugcgc

SEQ ID NO: 83928 - RNA, 64 nt, hsa
agaugcuguaacuagcauuuuuugaaugccucucccuccgcaucucaucuuucucuuuucaauc

SEQ ID NO: 83929 - RNA, 64 nt, hsa
cugggacugaggggcucaggcagggugugcccuuccuccgcaugccccucccuccccacggccc

SEQ ID NO: 83930 - RNA, 64 nt, hsa
ccuggccuggcuuccugguaaggaguuucagccgccuccgcaggaacccccaaagugcagauuc

SEQ ID NO: 83931 - RNA, 64 nt, hsa
caagaagccugcaggagaaagccaagggcaguucccuccgcagaacaccccaugcgugcugaga

SEQ ID NO: 83932 - RNA, 64 nt, hsa
cccagagccaagagggugcugcucaguugcagggccuccgcagcuggacagagagugggggagg

SEQ ID NO: 83933 - RNA, 64 nt, hsa
cucuacgaaauucaguaggagagaagauccugucccuccgcaguugcucccugggcucccuggg

SEQ ID NO: 83934 - RNA, 64 nt, hsa
gagaaagcuuauuauggaaagucacugguccuccccuccgcacaggaaagguacccaguagaua

SEQ ID NO: 83935 - RNA, 64 nt, hsa
caccccggggaggcgcccaccccggacccccaccccuccgcacugugaaagacuaacuccugca

SEQ ID NO: 83936 - RNA, 64 nt, hsa
ccucugcuguagcuuuaaugcauacaaacaugucccuccgcacaacuaaccugcccugccucuc

SEQ ID NO: 83937 - RNA, 64 nt, hsa
ccgccuugggcccucccugcgacagccggacccgccuccgcaucggguugcgaugcccucugca

SEQ ID NO: 83938 - RNA, 64 nt, hsa
cugcuucccagcuucacaauaaacggcugcgucuccuccgcacaccuguggugccugccaccca

SEQ ID NO: 83939 - RNA, 64 nt, hsa
gcuuugaugaacagaugacaaacaucugaaacccccuccgcacuguuacccaguguguauauaa

SEQ ID NO: 83940 - RNA, 64 nt, hsa
cccucucccagaaccgcugccaccaccgccacgcccuccgcagaaagcccaccuggcccugugg

SEQ ID NO: 83941 - RNA, 64 nt, hsa
uggcucuguuccuucugggagcuguucccgggagccuccgcaagcaucuuuagaaaucugaucu

SEQ ID NO: 83942 - RNA, 64 nt, hsa
ccucaggaagcuguggaggcuggauuccaggcucccuccgcagacugacuuuccucugugucug

SEQ ID NO: 83943 - RNA, 64 nt, hsa
ggcugcugcuggcugugaagacuucgcacagucuccuccgcacagggugagguggcaguggcag

SEQ ID NO: 83944 - RNA, 64 nt, hsa
uccccugacuguguccgaugccaaggaguccuggccuccgcagaugcuucauuuugacccuugg

SEQ ID NO: 83945 - RNA, 64 nt, hsa
ugacucaggaccagcucuggagucuccagcccacccuccgcaccguccccuccugagcagcacu

SEQ ID NO: 83946 - RNA, 64 nt, hsa
caggaaaugcugucggagagcgcgcauucuauuuccuccgcagggaaugccagauagaaaguug

SEQ ID NO: 83947 - RNA, 50 nt, hsa
aggcccagggcaugcgguagccuccgcagaggcugggggccuccacccag

SEQ ID NO: 83948 - RNA, 64 nt, hsa
ggacaugccuuacacuggcguccucuccugagucccuccgcacucuccaucagcaaccucacac

SEQ ID NO: 83949 - RNA, 64 nt, hsa
uagagugcaguggcgccaucuaggcucacugcaaccuccgcaucccagauuccagcgauucucc

SEQ ID NO: 83950 - RNA, 64 nt, hsa
guccagccccgggacccauggccucucuccaggcccuccgcaccccgccccaugccccaguccu

SEQ ID NO: 83951 - RNA, 64 nt, hsa
ccgcugcgaggggccccccaugggggcuguggccccuccgcaggcaggacaucccaaccccugg

SEQ ID NO: 83952 - RNA, 64 nt, hsa
accucucagugccucaccucccccugccucccagccuccgcagaugagguuccugccccuuccu

SEQ ID NO: 83953 - RNA, 64 nt, hsa
gucucuucugggcgucugagcuggggugggagcuccuccgcagaagguuggugggggguccagu

SEQ ID NO: 83954 - RNA, 64 nt, hsa
ggugccugggcccagccccgugccccuccgucugccuccgcacggcuggcagagggcaggcugc

SEQ ID NO: 83955 - RNA, 64 nt, hsa
ccugucugugcauccugaaccacucuuugcugggccuccgcaagggccucucuugggucugugu

SEQ ID NO: 83956 - RNA, 64 nt, hsa
uggggccacgaccucccuggccguggccacccguccuccgcagcaggccccugcugucccccca

SEQ ID NO: 83957 - RNA, 64 nt, hsa
ccgacauucccaguccugugagcucaggugaccuccuccgcagaagagagaugcugcucuggcc

SEQ ID NO: 83958 - RNA, 64 nt, hsa
cugcuuccucaguuuccaaaauggaaccaccucaccuccgcagcacccgacuuaccaggacgca

SEQ ID NO: 83959 - RNA, 64 nt, hsa
acacauuauucaagagaccaccugacaugcaucuccuccgcaggaauacauucguccucucuua

SEQ ID NO: 83960 - RNA, 64 nt, hsa
gcucccaccacgcggcgcuucaguacggcuggauccuccgcaggcgagcggaaggcccccagga

SEQ ID NO: 83961 - RNA, 64 nt, hsa
cccgcacugaacacacccgcccucaaccccgcacccuccgcacucaccucccccucgccgcucg

SEQ ID NO: 83962 - RNA, 64 nt, hsa
acaggaggggaaggcaacauacacaccccggacuccuccgcauccuccuccugcuuccuccgcu

SEQ ID NO: 83963 - RNA, 64 nt, hsa
caugucuccagauuccaggugcagguucuuagcaccuccgcagccgcucucucuugaguccauc

SEQ ID NO: 83964 - RNA, 64 nt, hsa
ggggagacacaccuacugcuuccucagaugggccccuccgcagccccuucccuugcucggggaa

SEQ ID NO: 83965 - RNA, 64 nt, hsa
uucucagauuucccuccuuucugacguuuuucucccuccgcaggggccccggcccucccuggcu

SEQ ID NO: 83966 - RNA, 64 nt, hsa
ccugagaggagcccccucccuguggagccuguuaccuccgcauuugacacgagucugcugugaa

SEQ ID NO: 83967 - RNA, 64 nt, hsa
aucaucccugcuccagcugcccccgggaagccagccuccgcagccaccgugaagaggaagcgga

SEQ ID NO: 83968 - RNA, 64 nt, hsa
uggagggucucuaguuccacgccucucccaccucccuccgcacacaccccaccccagccugcua

SEQ ID NO: 83969 - RNA, 64 nt, hsa
auccagccccaggccccucuguaccauccccuccccuccgcaccacugaccucuugucuccugu

SEQ ID NO: 83970 - RNA, 64 nt, hsa
acacagacagaagacugugucaugggucauggccccuccgcacaccuacagguuugccaaagga

SEQ ID NO: 83971 - RNA, 64 nt, hsa
cugcacacccaggaaaagucugcagacccccagcccuccgcaauaauucaccagaccagaagcc

SEQ ID NO: 83972 - RNA, 64 nt, hsa
acuuacaacgacgagggacuuugaugggcugggcccuccgcacggcccgccagcuggcuucgag

SEQ ID NO: 83973 - RNA, 64 nt, hsa
ugggccccagacaagccuuugguggggaacagaaccuccgcaucguguaguuuugugacauaag

SEQ ID NO: 83974 - RNA, 64 nt, hsa
caccguggccuggcggcgagcccccggucaccuuccuccgcacggaagaggggccggacgccac

SEQ ID NO: 83975 - RNA, 64 nt, hsa
ggggggaguguuucugaccugcuuugcagacgugccuccgcaccucagcaguuugggguguggc

SEQ ID NO: 83976 - RNA, 64 nt, hsa
uuugacgcccuccaucccucccgccaggcacuguccuccgcaaggccuggugcagcccuggcag

SEQ ID NO: 83977 - RNA, 64 nt, hsa
ucuaagaauagaaagaaagaaagagaaacgguguccuccgcacagccggucagaacugugugac

SEQ ID NO: 83978 - RNA, 64 nt, hsa
cuuaggcaccagacuggaggcccccgggcgcuggccuccgcacauucgucugccuucucacagc

SEQ ID NO: 83979 - RNA, 64 nt, hsa
ccacccagcccucccgcucaggccacagccggagccuccgcauugcccccacccccauuuucca

SEQ ID NO: 83980 - RNA, 64 nt, hsa
agaggugcuaaaguuucccaucuuugugcagcuaccuccgcauugcuguguagugaccccugcc

SEQ ID NO: 83981 - RNA, 64 nt, hsa
gcgacagcccagcagugcccacacaggacugggcccuccgcaggggacuucagagcagcaaggc

SEQ ID NO: 83982 - RNA, 64 nt, hsa
gagccccuggugguccugaaccggccccucuaucccuccgcaggccucuugccuggggccacuc

SEQ ID NO: 83983 - RNA, 64 nt, hsa
ugucuacuaacaaggacaugggggugggcggugaccuccgcaucccucagagcucagagggucc

SEQ ID NO: 83984 - RNA, 64 nt, hsa
ucugaagggucuuggcuugauugcagaaggacaaccuccgcacccaccuaaagacauguauaug

SEQ ID NO: 83985 - RNA, 64 nt, hsa
uggaacucaagcgugaguucgccuucgacgaugcccuccgcaugcuugaggucacuuggaguuc

SEQ ID NO: 83986 - RNA, 64 nt, hsa
cuuuuaaacaaccagaucucgugagaagcuacucccuccgcagcaccaagcgggggauggugcu

SEQ ID NO: 83987 - RNA, 64 nt, hsa
ccucacugaggcaccccacuuccagugaagaaguccuccgcaacucccaaacaagccucgcuug

SEQ ID NO: 83988 - RNA, 64 nt, hsa
gaggugcauuucugcuggugacuggaggagggaccagaaugaggauacgugagaaauagacccg

SEQ ID NO: 83989 - RNA, 64 nt, hsa
gaggcuggaaggccacaaggugcuugcuaaggaacagaaugacccagagucaaggccaagucug

SEQ ID NO: 83990 - RNA, 64 nt, hsa
aaauaguugcuucccacugccccccgcccgcccccagaaugauauuaauuuugccuuuuuuuuu

SEQ ID NO: 83991 - RNA, 64 nt, hsa
aacagugagguggaucuuuaccucugauagaggucagaaugagguccuggggagaaucuaagcc

SEQ ID NO: 83992 - RNA, 64 nt, hsa
aaaaucucaaucuucaguuuuggccuucugucagcagaaugauaagugcaauaguuguaaaucu

SEQ ID NO: 83993 - RNA, 64 nt, hsa
caaaccuccacagcucauuucuuuguaauauaaucagaaugaaaaauaauuuaagaggacagaa

SEQ ID NO: 83994 - RNA, 64 nt, hsa
auugguucuuuaaaauauaucugaaaguaguagucagaaugaauuaugguuggaaaacugagga

SEQ ID NO: 83995 - RNA, 64 nt, hsa
caccuuuucugugaggaggaggggaucgugauuucagaaugaauuauguaucccuucucuuuug

SEQ ID NO: 83996 - RNA, 64 nt, hsa
ugagaaaagaauaauucuaacugguacuccaauucagaaugaucugcaagaauuuuuugcauua

SEQ ID NO: 83997 - RNA, 64 nt, hsa
aaguguuuguaaaccaaguucaaaggaaaauagacagaaugauuuccaaaauugcaaaccacgc

SEQ ID NO: 83998 - RNA, 64 nt, hsa
agcagccugccccaugcuuccagccugcagaacacagaaugaaacaugcugguagacuccacga

SEQ ID NO: 83999 - RNA, 64 nt, hsa
caggaugugcuucugcagccuacagaugcagaaccagaaugagggggacaauuccacccacucg

SEQ ID NO: 84000 - RNA, 64 nt, hsa
cugagauugugccacugcacuccagucugugugacagaaugagaccuugucuugaaaaaaaaaa

SEQ ID NO: 84001 - RNA, 64 nt, hsa
uuuuaggacuacucuucaaaaaaaguguauugcucagaaugaugaccuguaaauguaagagugg

SEQ ID NO: 84002 - RNA, 64 nt, hsa
uggaaauguaauggauaauuggguaauaaaaugacagaaugagcagaacaugugagauuuugag

SEQ ID NO: 84003 - RNA, 64 nt, hsa
uaaauggaaugcucugaaugggaagagcccauaacagaaugaccuauauuacaaccgauauaaa

SEQ ID NO: 84004 - RNA, 64 nt, hsa
gauggccacuaaguguguauccagaagaagagaucagaaugaugaguccagaaccccugucaca

SEQ ID NO: 84005 - RNA, 64 nt, hsa
uauaauagaugacaguggcaacugaaaacagucccagaaugaccccaucgagaugaaauuaaac

SEQ ID NO: 84006 - RNA, 64 nt, hsa
acauuucccagaaaauguuucccagaaaacuagacagaaugaucauucaauggaucacagugaa

SEQ ID NO: 84007 - RNA, 64 nt, hsa
uuagccaaauagucugaauuuccagaaaacaaggcagaaugaucauucccagaaacauuuccca

SEQ ID NO: 84008 - RNA, 64 nt, hsa
gucuuuauugcagaagacaguguguugccuuacccagaaugagauugaauuguuuugcuucguu

SEQ ID NO: 84009 - RNA, 64 nt, hsa
agucuuuauugcagaagacaguguguugccuuaccagaaugagugcuuggauuacaggcgugag

SEQ ID NO: 84010 - RNA, 64 nt, hsa
cacacuauuucagaagacaguguguugccuuacccagaaugagugcuaggauuacaggcgugag

SEQ ID NO: 84011 - RNA, 64 nt, hsa
uggucaugagaauaaaacaaaaggugauucuauucagaaugagaaaaauccuaacccaauagaa

SEQ ID NO: 84012 - RNA, 64 nt, hsa
agcaugagaacagcaguuuauuacucacuaaagacagaaugaauguagaaaaggcugaauucug

SEQ ID NO: 84013 - RNA, 64 nt, hsa
gucccucgcugcacaaauacuccgcaagagaggccagaaugacagcugacagggucuauggcca

SEQ ID NO: 84014 - RNA, 64 nt, hsa
augaagccagaccuccccggcgggccucagggaacagaaugaucagaccuuugaaugauucuaa

SEQ ID NO: 84015 - RNA, 64 nt, hsa
ucaaggcaagagaaguggcuuuaaccaugccagccagaaugaagcaucauggguccugaugguu

SEQ ID NO: 84016 - RNA, 64 nt, hsa
uuaggaagugguucuccuacuggaaaauaugcuacagaaugaaaguuuguaauugaaagaaaaa

SEQ ID NO: 84017 - RNA, 64 nt, hsa
uucauguucaucucagguggcauuugcaggugaccagaaugaggcacaugacagugguuauauu

SEQ ID NO: 84018 - RNA, 64 nt, hsa
cuguugaagugcauguuaaaauaauuauaugaagcagaaugagaugauuuaauucuuaccgaaa

SEQ ID NO: 84019 - RNA, 64 nt, hsa
aauaucauuuguuaugcauuuuuaagauacaguucagaaugacacauuguaguggcaaagauaa

SEQ ID NO: 84020 - RNA, 64 nt, hsa
uguauaguuccagauaauuugucaugaacauugacagaaugacaauuuuuuguauuugcuuuuu

SEQ ID NO: 84021 - RNA, 64 nt, hsa
aaauacagugugacguguacugucaucaagggguaugcuccaugcuuugagucaccaaugaagc

SEQ ID NO: 84022 - RNA, 64 nt, hsa
gcagaaguggggagcacuuuaaugcaacccagguaugcuccaugcauauccagcugggccagcc

SEQ ID NO: 84023 - RNA, 64 nt, hsa
agcuacccuccagacaagggcaagaguuagccagaugcuccaggcagugggaagccaauggagg

SEQ ID NO: 84024 - RNA, 64 nt, hsa
ccaucggcacuggcgcccugcuccaucggcacuaaugcuccacucggcgccccacuccaucggc

SEQ ID NO: 84025 - RNA, 64 nt, hsa
augccccacucggcgccccacuccaucagcacuaaugcuccacuccauuggcacuaacgcccca

SEQ ID NO: 84026 - RNA, 64 nt, hsa
gaggcugagacugcgggaugguccuggggcucugugcagggaggagguggcagcccuguaggga

SEQ ID NO: 84027 - RNA, 64 nt, hsa
gcugggaaaucguuugaacccgggaagcggagguugcagggagccgagaucacgccacugcacu

SEQ ID NO: 84028 - RNA, 64 nt, hsa
gggaugcuaaacauugaaagcuggguguaggcacugcagggagaguguggaggucugacagggu

SEQ ID NO: 84029 - RNA, 64 nt, hsa
gaagagcagauugcuuaugccaugcagaugucccugcagggagcaggugagccagagccugggu

SEQ ID NO: 84030 - RNA, 64 nt, hsa
gugucugcuccuuguugggcagacaccagcggugugcagggagagaccaaguaccaucuuuauc

SEQ ID NO: 84031 - RNA, 64 nt, hsa
acaugugcuuccauacagugguuucugaagcuuuugcagggagagaagauggcuuaguguuuag

SEQ ID NO: 84032 - RNA, 64 nt, hsa
augacccagccucuugcaguauucccauacuugaugcagggaaggaaccagaagcagaggggcc

SEQ ID NO: 84033 - RNA, 64 nt, hsa
aguugacgccagcccuguaaagcuggccacagugugcagggagaauggggagagggucuucagu

SEQ ID NO: 84034 - RNA, 64 nt, hsa
accaccaaagccuguucgcacagaagggcgaccuugcagggacucgccgccgcgaccucagugu

SEQ ID NO: 84035 - RNA, 64 nt, hsa
gugccuuuagaggaaggagaggauugcugaggaaugcagggacgccuguuucuguccucacacc

SEQ ID NO: 84036 - RNA, 64 nt, hsa
ucuuuuaccauuuuugggaagagggauagguaagugcagggaguuugugcugaaacagcgccug

SEQ ID NO: 84037 - RNA, 64 nt, hsa
aagaaggucauggccccuggccuggcccccgcccugcagggacacagaagccacaccauuugca

SEQ ID NO: 84038 - RNA, 64 nt, hsa
gcccuucuuccauucccagacagcagugugagggugcagggaccaagaugucaagcuggccgug

SEQ ID NO: 84039 - RNA, 64 nt, hsa
cugaggggcagggccguagacucacggcugcaccugcagggagcagcacgccaaccccagcagu

SEQ ID NO: 84040 - RNA, 64 nt, hsa
agggcauuccagccaagggcacagcaggggacagugcagggaggugugggguaagggagggaag

SEQ ID NO: 84041 - RNA, 64 nt, hsa
aagccuuauccaccaaauacacagggaagggugaugcagggaagggugacaucaggagucaggg

SEQ ID NO: 84042 - RNA, 64 nt, hsa
guccucucccccgccccaccccgugcuucagccuugcagggagagugaugcuccaggcaacacg

SEQ ID NO: 84043 - RNA, 64 nt, hsa
cuuggccgcuuacuggaagggcguuuuucagagcugcagggacagggugagcagcugaagggcu

SEQ ID NO: 84044 - RNA, 64 nt, hsa
ucaggggcagcugcagggccagauggaguuggccugcagggagucagccuuaccccaucagaga

SEQ ID NO: 84045 - RNA, 64 nt, hsa
cggaggagaaauaaggccagaggcucacauugcuugcagggaaccgacugaguaaugaagaaga

SEQ ID NO: 84046 - RNA, 64 nt, hsa
gccugucuguuugcuuaaagucaguggguucuggugcagggagugagaagugggggaagugaaa

SEQ ID NO: 84047 - RNA, 64 nt, hsa
cagcucccguggccacacagcuaucuggaggcuuugcagggagucguggguucucgcaccugcu

SEQ ID NO: 84048 - RNA, 64 nt, hsa
ccccccagggccccccagcaccuacagcuggggcugcagggagacaacggguggcugcauccag

SEQ ID NO: 84049 - RNA, 64 nt, hsa
ugagccaagccacuggggccaugcguaugacuggugcagggaggcaaggcccacauucuccuuc

SEQ ID NO: 84050 - RNA, 64 nt, hsa
ggugaucuguuugaggagagcacccuaggcagccugcagggaauaacauacuggccguucugac

SEQ ID NO: 84051 - RNA, 64 nt, hsa
cuuacaauuaaggucaagcccagaaagugauaagugcagggaggaaaagugcaaguccauuaug

SEQ ID NO: 84052 - RNA, 64 nt, hsa
guauuucuucuguccaguuauacuuauaaaugccugcagggauuucaccaccucaggguggaga

SEQ ID NO: 84053 - RNA, 64 nt, hsa
gagugcccguagcgggaugaucucgguuggugagugcagggaaggaggauguaauuccaucaua

SEQ ID NO: 84054 - RNA, 64 nt, hsa
uuuacagcuuugaggcuucaaauaaguuuccauaugcagggaguaacuuuaaacaauguuugaa

SEQ ID NO: 84055 - RNA, 64 nt, hsa
uuucuauauugccaaguugaaucaugugggcugaugcagggaagcucugaagcagugaauaaag

SEQ ID NO: 84056 - RNA, 64 nt, hsa
gagauuuccaggccuaucccugugcagguacagcugcagggaagcccaguuuucuaagccuagg

SEQ ID NO: 84057 - RNA, 64 nt, hsa
ggucccaggugagagaaggaagugaggccauagaugcagggaguagaagcuuuguggugucagg

SEQ ID NO: 84058 - RNA, 64 nt, hsa
uugccugcuggggugaugcagggaggaggggaggugcagggaagaggggccggccucagcuguc

SEQ ID NO: 84059 - RNA, 64 nt, hsa
agagccugucucagggaauugccugcuggggugaugcagggaggaggggaggugcagggaagag

SEQ ID NO: 84060 - RNA, 64 nt, hsa
aauaugggagggagugugguguggaugggggugaugcagggacugaggggaacccugggacagg

SEQ ID NO: 84061 - RNA, 64 nt, hsa
uuagaugcccagaugaagagggaaagcugacaucugcagggaacccacuuugaggcugaggcca

SEQ ID NO: 84062 - RNA, 64 nt, hsa
gcuuggaaagggaucugggaagccagguauuaauugcagggauaguuccaagucuguccugucu

SEQ ID NO: 84063 - RNA, 64 nt, hsa
ucaaaagugugagcccugcuucgggcugagcagcugcagggagcccccuuucugaugaugaaac

SEQ ID NO: 84064 - RNA, 64 nt, hsa
acuguccagguuauaaccugguaccagcagacuuugcagggaagaaagaguuguuccaaucaug

SEQ ID NO: 84065 - RNA, 64 nt, hsa
cagccaguauagagacuugguuggcaucuucugcugcagggacuaaaaguauuugacuggggca

SEQ ID NO: 84066 - RNA, 64 nt, hsa
cagguaucacaaagcauuugugaauugcuuuaggugcagggacaccacccacucaggacucuuc

SEQ ID NO: 84067 - RNA, 64 nt, hsa
cugggccuguaaugaaugucggcggcgcugggguugcagggaaaagacaaauccucaaagcgug

SEQ ID NO: 84068 - RNA, 64 nt, hsa
gggcuagcguucuuguccaaagcacucauccugcugcagggaagggagcuguacggaggcugga

SEQ ID NO: 84069 - RNA, 64 nt, hsa
acccuggcaucucaagagggagugaggagaggauugcagggacuuuucccugcgaaacaaauga

SEQ ID NO: 84070 - RNA, 64 nt, hsa
guugcugugcacuaggagcugugaucucccucucugcagggaggccccagccccugcugcuugc

SEQ ID NO: 84071 - RNA, 64 nt, hsa
ugugacuguuuggcacuugagacaaaccugccuuugcagggaaagugucucucacgggcauugg

SEQ ID NO: 84072 - RNA, 64 nt, hsa
gggcacagaugcugagacagccucuccuucucagugcagggacgucaccccugccaggcaagcc

SEQ ID NO: 84073 - RNA, 64 nt, hsa
gggcauagaugcugagacagccucucccucucagugcagggacgucaccccugccaggcaagcc

SEQ ID NO: 84074 - RNA, 64 nt, hsa
cggcaccggcgggcgggugggaggugggaguggcugcagggaccccuagugucccuggucuauc

SEQ ID NO: 84075 - RNA, 64 nt, hsa
aaggaacgccuuccaggaaccuguggacuaggggugcagggacuucccuuugcaagggguaaca

SEQ ID NO: 84076 - RNA, 64 nt, hsa
uuggcacauuuccggguuaggguggaaugggcuuugcagggaagagggcccccugugcacgcau

SEQ ID NO: 84077 - RNA, 64 nt, hsa
cagaugccugcagggcuggggcucucgggacagaugcagggaugugugcugcagggcugcuggg

SEQ ID NO: 84078 - RNA, 57 nt, hsa
ccugccucucagccgccuagccaagacugcagggauggcccgcagccucaucggggc

SEQ ID NO: 84079 - RNA, 64 nt, hsa
ccagagacagcgggccuggcagcgggccgggccaugcagggagcgccucccuauguugccugcc

SEQ ID NO: 84080 - RNA, 64 nt, hsa
aagcgccagggaaaugacccacagggaucgcagcugcagggagggccagggagguugggggugg

SEQ ID NO: 84081 - RNA, 64 nt, hsa
agcagucccaucucugugggaggcaugcaacgcgugcagggaguucaggugccggucggcguag

SEQ ID NO: 84082 - RNA, 64 nt, hsa
cagugcgcucuugcugggagguccggaucguuccugcagggaagcggcagcacacggagaccac

SEQ ID NO: 84083 - RNA, 64 nt, hsa
aucuuccuucuccaaagcugggagucauguugccugcagggacucuuuccuuacugggcccagg

SEQ ID NO: 84084 - RNA, 64 nt, hsa
agaaaagaagauauuaagugcuuuuuaacaacuccuagaguacaaaaugaguacaucauaaugc

SEQ ID NO: 84085 - RNA, 64 nt, hsa
uuaauucugugcucuguuuaaaguacuauuauaacuagaguagaucugaaugaggauaacccua

SEQ ID NO: 84086 - RNA, 64 nt, hsa
cuuauugauauuuuuguaacagaauauagcucuuaacugaaaauccagaaccagaaacauaaau

SEQ ID NO: 84087 - RNA, 64 nt, hsa
uaauuccuuugaucuuauaaguuaaagcuguaacaacugaaauugcauggaucaaguaagcaua

SEQ ID NO: 84088 - RNA, 64 nt, hsa
cuguuagaagguacaauuuucuucucuucccuguaacugaaaguuuuaagaauuguuccuuggg

SEQ ID NO: 84089 - RNA, 64 nt, hsa
auuuaaagggaaaaguccuaaauuuaccuuaaauaacugaaaugaauuaagccuucauagcgua

SEQ ID NO: 84090 - RNA, 64 nt, hsa
cccaaaaagauaacauuuuucuucugcuuuuaaaaacugaaauucccuguucuaguuccuaaca

SEQ ID NO: 84091 - RNA, 64 nt, hsa
uaguauggugcauuucauuccuuauuuauaaauuaacugaaauuacaguuugcuauaauauaaa

SEQ ID NO: 84092 - RNA, 64 nt, hsa
aaaaugagacuuuuuauauguuaauguauaauaaaacugaaacaagauuauuuuccauuugaaa

SEQ ID NO: 84093 - RNA, 64 nt, hsa
auguuacauauguuuauauucacaaauauuuuuaaacugaaauaucugaacauaauauaauuuc

SEQ ID NO: 84094 - RNA, 64 nt, hsa
uucugaauauucuguggugccaaguagaaaguuuaacugaaauuaauaagccaauggaaagaaa

SEQ ID NO: 84095 - RNA, 64 nt, hsa
uaaacuuuauccuaaaguuuaaaucuaacagaacaacugaaauacuugaaauagaccuauaaaa

SEQ ID NO: 84096 - RNA, 64 nt, hsa
augcaacuucaaccuuccagaugcucaggucaaaaacugaaaguugcuuuugacuccucuauuu

SEQ ID NO: 84097 - RNA, 64 nt, hsa
cauauauauucucuaaauauuucuugaauuaaugaacugaaaaauguguguuaaaguugcuaag

SEQ ID NO: 84098 - RNA, 64 nt, hsa
cgcuucacaauaaaacacagcuuaaaaauaaaauaacugaaagaaauagaauucagcaaauagu

SEQ ID NO: 84099 - RNA, 64 nt, hsa
auagaauucagcaaauaguuauuuuuugcacuugaacugaaacguacuguacuguaaauuauga

SEQ ID NO: 84100 - RNA, 64 nt, hsa
aaccacaguuucauuauucucauaauccuucugcaacugaaauuacauauugcaggagacauuu

SEQ ID NO: 84101 - RNA, 64 nt, hsa
uaguuuuuuuucuaguuuuuaauuuuaacaucagaacugaaauaaaaaauuauggauacguguu

SEQ ID NO: 84102 - RNA, 64 nt, hsa
augauuaagcuuaaacccuguuagcaaaacugaaaacugaaauguucucaauaucaacauauuu

SEQ ID NO: 84103 - RNA, 64 nt, hsa
aauuguuaugauuaagcuuaaacccuguuagcaaaacugaaaacugaaauguucucaauaucaa

SEQ ID NO: 84104 - RNA, 64 nt, hsa
gagauuugcccauagguuaaacaugguuagaaacaacugaaagcauaaaagaaaaaucuaggcc

SEQ ID NO: 84105 - RNA, 64 nt, hsa
uguauuuuuuauuauuuuaauauacuguaagccaaacugaaauaacauuugcuguuuuauaggu

SEQ ID NO: 84106 - RNA, 64 nt, hsa
auuuuauuuugguauauuuaaacagugaaaaacuaacugaaagcacaugaagaguuguaacuug

SEQ ID NO: 84107 - RNA, 64 nt, hsa
acuauaaagacaaaguaauucuauuaaaugaacuaacugaaaauaauaauuauaggaagugauu

SEQ ID NO: 84108 - RNA, 64 nt, hsa
aguuuaaacuucauuuagcuuggacucucaagagaacugaaacauaaucaauggauucagaaau

SEQ ID NO: 84109 - RNA, 64 nt, hsa
aguuggacaaaaugaguuugaguuuaguuucaguaacugaaauaagcuugaauacugcauaugc

SEQ ID NO: 84110 - RNA, 64 nt, hsa
guaauugucuuugucuugauuuggcuauuuuuauaacugaaauccugagcaacagagauaauuu

SEQ ID NO: 84111 - RNA, 64 nt, hsa
acuuugauaaagaagcauacuguaauguuuuaugaacugaaauuuuaaucaaaagaggucauuu

SEQ ID NO: 84112 - RNA, 64 nt, hsa
aauccacuggaggucauuacugccauuaaauaauaacugaaaagacuauguagugaaauguauu

SEQ ID NO: 84113 - RNA, 64 nt, hsa
cauggauacaucaaguucauuugcagaaacaaauaacugaaauaaaaaacauguuaauccuugu

SEQ ID NO: 84114 - RNA, 64 nt, hsa
augaugugccagcuaaaauugugugccauuuaaaaacugaaaauauuuuaaaauuauuugucua

SEQ ID NO: 84115 - RNA, 64 nt, hsa
aucucaccugucgcguagcucuaauauucacauaaacugaaauaaagaaguggaaugaggagcu

SEQ ID NO: 84116 - RNA, 64 nt, hsa
uaugucuuaguuauaauuagauugugaaucagccaacugaaaauccuuuuugcauauuucaaug

SEQ ID NO: 84117 - RNA, 64 nt, hsa
agcuuucugagaaaagcuagguguuuaauaguuuaacugaaaguuuaacuauuuaaaagacuaa

SEQ ID NO: 84118 - RNA, 64 nt, hsa
uuaacugccaagcccagguugccucucaugaggcaacugaaaaaauccugugucuugauagcau

SEQ ID NO: 84119 - RNA, 64 nt, hsa
gacaagaauguguaucuguuggauauaaucagagaacugaaaaguaauuuaucaguaauuuuua

SEQ ID NO: 84120 - RNA, 64 nt, hsa
uaaaaaaaguuugucuuugagauucaauguaaagaacugaaaacaauguauauguuguaaauau

SEQ ID NO: 84121 - RNA, 64 nt, hsa
uaaagaaauaaaaaauuccagucaauuauuccucaacugaaaguuuaguggcagcacuucuauu

SEQ ID NO: 84122 - RNA, 64 nt, hsa
aacugaaaauaaaaauaaaaauauguauucuccuaacugaaauauuuacuuaaucuggaaaaca

SEQ ID NO: 84123 - RNA, 64 nt, hsa
cagccugggugacagagugagacuccaucucaaaaacugaaaauaaaaauaaaaauauguauuc

SEQ ID NO: 84124 - RNA, 64 nt, hsa
uaucuccccucccuucaggaauaacuuauuggaaaacugaaaagaaucacugaauggaauguuc

SEQ ID NO: 84125 - RNA, 64 nt, hsa
agaacuugagaaaauuacuucauaaacauauggaaacugaaaauggacucucuuugugacaaag

SEQ ID NO: 84126 - RNA, 64 nt, hsa
gucauuaccaaaauacuaaaacccaacaaaaugcaacugaaaaauaccuuccaaauuugccaag

SEQ ID NO: 84127 - RNA, 64 nt, hsa
auauaucaucaggucuuaaaaaaaaauaaagguaaacugaaaagacaacuggcuacaaagaagg

SEQ ID NO: 84128 - RNA, 64 nt, hsa
aagaucucauguuaaguggagaaaggguuuugcaaacugaaagaucuguagagaguagcaguau

SEQ ID NO: 84129 - RNA, 64 nt, hsa
ggaagaaggcaagccuccccaacuuaagccauguaacugaaaaucuaauuauaggagcauuugu

SEQ ID NO: 84130 - RNA, 64 nt, hsa
agcuuggauauuuuucugaaaaguuauuugccaaaacugaaauccuucagauguuuuccauggu

SEQ ID NO: 84131 - RNA, 64 nt, hsa
augacagaauuaccucugcuuaguaucucauuauaacugaaagaagguuuaucauuacaaauac

SEQ ID NO: 84132 - RNA, 64 nt, hsa
auaauaaauguaggcucagcucuuucccaggauuuucaucaaaaagcuuuaagugccuaacccu

SEQ ID NO: 84133 - RNA, 64 nt, hsa
agacauguggacuggaauuuuuuucauuaauguguucaucaaguuucacaucuaaguugaaaca

SEQ ID NO: 84134 - RNA, 64 nt, hsa
acuuucuguuuuuagggaugagacuauucucugcuucaucaaggaaagagaaauguucaggguu

SEQ ID NO: 84135 - RNA, 64 nt, hsa
cauuuuguggcuaaagaccagaccuuugcacuauuucaucaagauuauuuuauugagguuuggc

SEQ ID NO: 84136 - RNA, 64 nt, hsa
uuuaaagguuacuugaaugucacaaaauuaugccuucaucaaaacuuuaaaggaaaaaucaauu

SEQ ID NO: 84137 - RNA, 64 nt, hsa
gcaucuugcccaggaucacucagucaagcaugucuucaucaaguggaagccaacuguccugccu

SEQ ID NO: 84138 - RNA, 64 nt, hsa
aaaauauugaaguucaucugaaaugcaaggugcuuucaucaaugaaccuuuucaaacuuuucua

SEQ ID NO: 84139 - RNA, 64 nt, hsa
gauggugcacuacucugaggccuguauggccccuuucaucaauaucuauucaaauauacaggug

SEQ ID NO: 84140 - RNA, 64 nt, hsa
ucuuucagaucauuuaggauacucuuaaucucacuucaucaaucaaauauuuuuugaguguaug

SEQ ID NO: 84141 - RNA, 64 nt, hsa
uuccuguguauucucauugggguugcaacaauaauucaucaaguaaucauggccagcgauuauu

SEQ ID NO: 84142 - RNA, 64 nt, hsa
agacccacucugaccccacuaaaaugaccccugauucaucaaaagugaggccuagaauuacccu

SEQ ID NO: 84143 - RNA, 64 nt, hsa
gagguaucauuaucaguuacaaauugaguuauucuucaucaaaugacuuuuggaguagagauuu

SEQ ID NO: 84144 - RNA, 64 nt, hsa
cacaaaacacagcaaacauaaaaaguuguuacacuucaucaaaaguacaaaguucuguucauca

SEQ ID NO: 84145 - RNA, 64 nt, hsa
aguuguuacacuucaucaaaaguacaaaguucuguucaucaaaugaugcuguuaagauagggaa

SEQ ID NO: 84146 - RNA, 64 nt, hsa
ucccaugugaaccaaauuucagggucaccagaaguucaucaaauucaaaugaauuuggccuggc

SEQ ID NO: 84147 - RNA, 64 nt, hsa
uggccacaauagccucaucaacauggcugcuugcuucaucaaggcaugcaagccaaaagggagg

SEQ ID NO: 84148 - RNA, 64 nt, hsa
cacagccuggucaggagggaaggaccucacuuguuucaucaaauggagugguuuaaaacugauc

SEQ ID NO: 84149 - RNA, 64 nt, hsa
aaaaaaacaaaaagacauauucagguacugauuuuucaucaagagauugacauaccaaugauca

SEQ ID NO: 84150 - RNA, 64 nt, hsa; identical to SEQ ID NO: 56583

SEQ ID NO: 84151 - RNA, 64 nt, hsa; identical to SEQ ID NO: 56584

SEQ ID NO: 84152 - RNA, 64 nt, hsa; identical to SEQ ID NO: 56585

SEQ ID NO: 84153 - RNA, 64 nt, hsa; identical to SEQ ID NO: 56586

SEQ ID NO: 84154 - RNA, 64 nt, hsa; identical to SEQ ID NO: 56587

SEQ ID NO: 84155 - RNA, 64 nt, hsa; identical to SEQ ID NO: 56588

SEQ ID NO: 84156 - RNA, 64 nt, hsa; identical to SEQ ID NO: 56589

SEQ ID NO: 84157 - RNA, 64 nt, hsa; identical to SEQ ID NO: 56590

SEQ ID NO: 84158 - RNA, 64 nt, hsa; identical to SEQ ID NO: 56591

SEQ ID NO: 84159 - RNA, 64 nt, hsa; identical to SEQ ID NO: 56592

SEQ ID NO: 84160 - RNA, 64 nt, hsa; identical to SEQ ID NO: 56593

SEQ ID NO: 84161 - RNA, 64 nt, hsa; identical to SEQ ID NO: 56594

SEQ ID NO: 84162 - RNA, 64 nt, hsa; identical to SEQ ID NO: 56595

SEQ ID NO: 84163 - RNA, 64 nt, hsa; identical to SEQ ID NO: 56596

SEQ ID NO: 84164 - RNA, 64 nt, hsa; identical to SEQ ID NO: 56597

SEQ ID NO: 84165 - RNA, 64 nt, hsa; identical to SEQ ID NO: 56598

SEQ ID NO: 84166 - RNA, 64 nt, hsa
gagcagcaaguuuccauuuggcauuagcccagcacagagccaccggaacaucaagauccuagag

SEQ ID NO: 84167 - RNA, 64 nt, hsa
ccuagaggacagccuugccgccacacaguuccagcagagccaggccagccuccuccacaugcag

SEQ ID NO: 84168 - RNA, 64 nt, hsa
agagcaucgugacccuucagggccagaaggagggcagagccaugggccugggccugcuuuucca

SEQ ID NO: 84169 - RNA, 64 nt, hsa
guugccaacuaagcccucgaaccaaggcagccuccagagccagccugggacucccagugaacuu

SEQ ID NO: 84170 - RNA, 64 nt, hsa
ggcucugaaggggagggaaggcaacggcucugcccagagccaucccuggagcaugugagcagcg

SEQ ID NO: 84171 - RNA, 64 nt, hsa
ggauccuccugugagagugacgucaccuccuuuccagagccauuagugagccuggcuugggaac

SEQ ID NO: 84172 - RNA, 64 nt, hsa
cugggcucuggacaagcacugggggacgugcccccagagccacccacuucucaucccaaaccca

SEQ ID NO: 84173 - RNA, 64 nt, hsa
auggccacaccccaccccacuucucccccaaaaccagagccaccugccagccucgcugggcagg

SEQ ID NO: 84174 - RNA, 64 nt, hsa
guugaaaaguuuucacauaauccaguauuggcaucagagccagaaaugcccucccuagguccag

SEQ ID NO: 84175 - RNA, 64 nt, hsa
uugugucaaucaguuuaucccauccccuuggccacagagccauugugauaugaggagauacugg

SEQ ID NO: 84176 - RNA, 64 nt, hsa
ggcaaaauagaggguaugaccugggguugcuggccagagccagggaggagccuuaagaagugaa

SEQ ID NO: 84177 - RNA, 64 nt, hsa
ucaucucugcaagggacccugacgccugggagaucagagccacugacccuuuauggcacugcua

SEQ ID NO: 84178 - RNA, 64 nt, hsa
aaaacauggaaaaguugccuuuauggaaacuuggcagagccagaguguacacauuccuaaacca

SEQ ID NO: 84179 - RNA, 64 nt, hsa
ccuugcucuccccagccugccaagcccagcccuccagagccagcccuccuggguaccggcaacu

SEQ ID NO: 84180 - RNA, 64 nt, hsa
cccugccacccucccuggcacguuuauuucacagcagagccaagucuguggcagguugacacag

SEQ ID NO: 84181 - RNA, 64 nt, hsa
auauaccugccugagauaggcugguccucaccuccagagccagccagccccgucaggggccaaa

SEQ ID NO: 84182 - RNA, 64 nt, hsa
aagugacuugcccaaggucagagccacuuggugacagagccaggaugagaacaaagauuccauu

SEQ ID NO: 84183 - RNA, 64 nt, hsa
gagaccugaagaggguaagugacuugcccaaggucagagccacuuggugacagagccaggauga

SEQ ID NO: 84184 - RNA, 64 nt, hsa
gacaaggauaaaggaauaugauuuuccagagccccagagccagcucaucuuccaggugcugaaa

SEQ ID NO: 84185 - RNA, 64 nt, hsa
uauucucauuuuccuuuuaccuuucuccaccauccagagccacaaaagcaaaccuucuaccucc

SEQ ID NO: 84186 - RNA, 64 nt, hsa
aagcccgccccgcuggccgccagcugcccguccccagagccacugcagcaggagucgggcccug

SEQ ID NO: 84187 - RNA, 64 nt, hsa
ccucaaauccggcugaggcagcagcuggcaccaucagagccaggagagugacaacagguaacgg

SEQ ID NO: 84188 - RNA, 64 nt, hsa
gacuuccggcgccgccgcccucucccggcauccgcagagccagcugacgcccucccugccuccc

SEQ ID NO: 84189 - RNA, 64 nt, hsa
caagcucaugggacacccagagcagaagcuagggcagagccaaugcugagggagccucgacuuc

SEQ ID NO: 84190 - RNA, 64 nt, hsa
uggguaagaagggugggaguggggccuuugccagcagagccagggcagggcgagcugcaggaau

SEQ ID NO: 84191 - RNA, 64 nt, hsa
ccaccugaaggguggaugugcuggagggguggcccagagccauacugcguccacccugagcucg

SEQ ID NO: 84192 - RNA, 64 nt, hsa
cccugcacccgcuaccacaccagcucagccacagcagagccaaucacagacccaccacacagcc

SEQ ID NO: 84193 - RNA, 64 nt, hsa
aguucuuagccaguugagccagcgacaacagcaccagagccaggcagucacuguuccuccuccu

SEQ ID NO: 84194 - RNA, 64 nt, hsa
cagccuagguucccauuuggggacuucaggaccccagagccacuaggacuuccuugggaagccc

SEQ ID NO: 84195 - RNA, 64 nt, hsa
cugcccauuggccaugcugggagccacagcuauccagagccagcaugaccuggggcuugguuuc

SEQ ID NO: 84196 - RNA, 64 nt, hsa
ccaaccacacccggugggggcacagcacagaccccagagccaggaaccucucagccgaugcccc

SEQ ID NO: 84197 - RNA, 64 nt, hsa
ccagccacacccagugggggcacagcacagaccccagagccaggaaccucucagccgaugcccc

SEQ ID NO: 84198 - RNA, 64 nt, hsa
aaggcccagaggaaguuaagggagagucaaugggcagagccagggcuaggcccugguggugugu

SEQ ID NO: 84199 - RNA, 64 nt, hsa
caagaaucucccagucugguaggagagagugcugcagagccacguggccgccacgcagugugcu

SEQ ID NO: 84200 - RNA, 64 nt, hsa
cccugacucuccagcuuccaggaagguuccuucucagagccaaauacucuuugugcaagugccu

SEQ ID NO: 84201 - RNA, 64 nt, hsa
cuuccugagcagaagaacuggagaaagggaaccacagagccaggaggaaugucugagcagaguc

SEQ ID NO: 84202 - RNA, 64 nt, hsa
gaugaguugcacaagauuauacacuguuaaguagcagagccagaauggacuucagaaucccaac

SEQ ID NO: 84203 - RNA, 64 nt, hsa
uauuguacaaauaucacucuucagguuuagcuuacagagccauggcuauggauucuuagcucug

SEQ ID NO: 84204 - RNA, 64 nt, hsa
accuuugaggcuggucauaccuccaggaacaauacagagccagucaacuuccuggaauccaaga

SEQ ID NO: 84205 - RNA, 64 nt, hsa
cuucucuggcccuuaggaucuccccauuuggagacagagccauuuggauauuuuccccuugaac

SEQ ID NO: 84206 - RNA, 64 nt, hsa
gggagggaagggcugguguugauuuuccucccugcagagccaauggugcacauugguuuaagcc

SEQ ID NO: 84207 - RNA, 64 nt, hsa
caccccaggaggaaaagcccagggucuggggcagcagagccaucgcaucauguuucccagggca

SEQ ID NO: 84208 - RNA, 64 nt, hsa
guuucucuuucugagaacguaacuugaaacacuacagagccaauaaucauauaaaaaguguauc

SEQ ID NO: 84209 - RNA, 64 nt, hsa
cuucagaccuggugcggagccaggcggagggacacagagccaggacucccagccguauugaaau

SEQ ID NO: 84210 - RNA, 64 nt, hsa
ugucugggccgaagcacgucccaccacacagugccagagccagagaaggggccccaccaccaag

SEQ ID NO: 84211 - RNA, 64 nt, hsa
ucuugcccuggagugccgaugaugauucucccuccagagccacgcuugggaacaugaagcaagu

SEQ ID NO: 84212 - RNA, 64 nt, hsa
cucuguccacuuguggguccuggggucgucuuagcagagccaccgccaagguuugcacucaggg

SEQ ID NO: 84213 - RNA, 64 nt, hsa
ugagaacuccagcuggugcccccagacagcugcucagagccaagggggcagagggcuuucagcg

SEQ ID NO: 84214 - RNA, 64 nt, hsa
gaaaacuguacucuguccagacaugauagagggacagagccaaaaggauagagaaagagaccca

SEQ ID NO: 84215 - RNA, 64 nt, hsa
ucuccccuacaguuuuaugcucagacauggaggucagagccacaagggaaaggggagaggggga

SEQ ID NO: 84216 - RNA, 64 nt, hsa
ggucuuggaugagaacaugacuuuuggcaucauucagagccagguuugaauccuggcuauaaaa

SEQ ID NO: 84217 - RNA, 64 nt, hsa
agaaauuugcuaggaucacaccacuaauaagcaacagagccaggauucaaacccagguguggcu

SEQ ID NO: 84218 - RNA, 64 nt, hsa
auguggcccucaagagccauccccacugccuggccagagccauuguuguccccuacuuccuagg

SEQ ID NO: 84219 - RNA, 64 nt, hsa
ccagcuggugguguuaagccagaauuugaccucccagagccaguuuccauuagcugccaugcuc

SEQ ID NO: 84220 - RNA, 64 nt, hsa
aaagugguguaaucuccuucucuacaucuguugucagagccacugagugcugugcugcucgacg

SEQ ID NO: 84221 - RNA, 64 nt, hsa
cuguugggucaccggcuggaccugcugcagccugcagagccacagucagccugcccacaugcca

SEQ ID NO: 84222 - RNA, 64 nt, hsa
uccagccaggccccaagcccacugggguguguggcagagccaggacccaggaggugugauuccu

SEQ ID NO: 84223 - RNA, 64 nt, hsa
ccguguaccucaguucccucuugcucagugggggcagagccaccugacucuugcagggguagcc

SEQ ID NO: 84224 - RNA, 64 nt, hsa
cgaguggagcuucgacccacccacuccaggaacccagagccacauuagaaguuccugagggcug

SEQ ID NO: 84225 - RNA, 64 nt, hsa
cugacagccacuccaggaacuugaacugcaggggcagagccagugaaucaccggaccuccagca

SEQ ID NO: 84226 - RNA, 64 nt, hsa
uagcuacugaggcauagggagaggaaguuaauuucagagccauacaaaaauaagccacaaccag

SEQ ID NO: 84227 - RNA, 64 nt, hsa
agggggagccugggugcagcagagacagaggaagcagagccaggugccgagcgcgacccugcag

SEQ ID NO: 84228 - RNA, 64 nt, hsa
cggccacaccagugucccaaagaggagagcgcagcagagccaggggucuguucuguagcagcca

SEQ ID NO: 84229 - RNA, 64 nt, hsa
gggugcccgccccacagugcuuuccccagcaccccagagccagucgggacaccccccgcagccc

SEQ ID NO: 84230 - RNA, 64 nt, hsa
acacgugaccugcacaggaucacagagcauggggcagagccaggacuagagcucagggcaucug

SEQ ID NO: 84231 - RNA, 64 nt, hsa
agaggccucauggcccaggagaccccaccucuggcagagccacauuaccuacccugugcauggu

SEQ ID NO: 84232 - RNA, 64 nt, hsa
aaggguacuugcgaugccggauuuaaaacuugcucagagccacuuagccacuugagaaccagac

SEQ ID NO: 84233 - RNA, 64 nt, hsa
uuucauguuccuaaacccaugucuuagggcagcacagagccaggucaugucaugccccaaagug

SEQ ID NO: 84234 - RNA, 64 nt, hsa
agaaucacuuacucauccuaaaagaaaacauuaucccaguuaccuacaucgcaauuaccuuaug

SEQ ID NO: 84235 - RNA, 64 nt, hsa
ucaguguaauauuaaguuagaaaagaaguugcugcccaguuaaaggggcucccucucaaauaaa

SEQ ID NO: 84236 - RNA, 64 nt, hsa
uucauguuugagaauuuuuuuauugcuuucauuucccaguuaaaugauauuuaacaccugggaa

SEQ ID NO: 84237 - RNA, 64 nt, hsa
uggguaacaaaaauggcaaaagaaaugcagauuucccaguuaucuugcucugaagacauuucuu

SEQ ID NO: 84238 - RNA, 64 nt, hsa
gagccuguuuggaugauggaugccauuccuuuugcccaguuaaauguucaccaaucauuuuaac

SEQ ID NO: 84239 - RNA, 64 nt, hsa
uggagaucuuccuuuaccccucaacuuuaauuugcccaguuauaccucaguguuguagcaguac

SEQ ID NO: 84240 - RNA, 64 nt, hsa
aaacugacaccaucuuaauuagaugcagggacagggaucagaugggacaauaucaaauuuacuu

SEQ ID NO: 84241 - RNA, 64 nt, hsa
auaaauaauauggauuguuuuaaaaaauauccaaggaucagagucucuuucuaagcuuuguaag

SEQ ID NO: 84242 - RNA, 64 nt, hsa
guguccuagucuugccuuuuuucucuaaguggcaggaucagaaaaccugcgagcuuuaguuugu

SEQ ID NO: 84243 - RNA, 64 nt, hsa
ucccaugagggaagcacgacagggcugauggugaggaucagagcaguucuaaggugacucguug

SEQ ID NO: 84244 - RNA, 64 nt, hsa
aggacccagugccgcaggccuggaucagaccccaggaucagaccuuggggucuucuggccagag

SEQ ID NO: 84245 - RNA, 64 nt, hsa
agacagucugccuaggacccagugccgcaggccuggaucagaccccaggaucagaccuuggggu

SEQ ID NO: 84246 - RNA, 64 nt, hsa
auagggaggaugaauuaccaggauucauggagcgggaucagauuaccaggaacauaggagugga

SEQ ID NO: 84247 - RNA, 64 nt, hsa
aucauuuuaggauugucaaaaggaggauugaggaggaucagaucaauaauggaggcaaugguau

SEQ ID NO: 84248 - RNA, 64 nt, hsa
uccagccugagcccccaccaggggucucugcccagcacaggaagcugacccuggcccagcucua

SEQ ID NO: 84249 - RNA, 64 nt, hsa
accuugccugcagaaccagcugcaacagcugcgugcacaggagcccccaggcagucagcagccc

SEQ ID NO: 84250 - RNA, 64 nt, hsa
uacuccuuuuccuuuuggaucauagcuuaacaaggcacaggaagggaagggaucuugacuaaga

SEQ ID NO: 84251 - RNA, 64 nt, hsa
aucugaacauuguuaauggccugugacaugaugagcacaggaacaggcaugaagauauugccau

SEQ ID NO: 84252 - RNA, 64 nt, hsa
uguggcagcagcaggagcuacuagaauauucucagcacaggaaugaggcuuccuugguuuccau

SEQ ID NO: 84253 - RNA, 64 nt, hsa
ucauccgcagccugggaaccuucucccucguacagcacaggaaccugacacauaguaggcacac

SEQ ID NO: 84254 - RNA, 64 nt, hsa
uuuugguuuucucuuuucaggcuguuuaacuuaggcacaggagauccacuuuuaaacuugggaa

SEQ ID NO: 84255 - RNA, 64 nt, hsa
aucagaucuugugagacuuacuaucacgagaauagcacaggaaagacuggcccccaugauucaa

SEQ ID NO: 84256 - RNA, 64 nt, hsa
aucagaucucaugagacuuacuaucaugagaauagcacaggaaagacuggccccccugauucga

SEQ ID NO: 84257 - RNA, 64 nt, hsa
gaggacggcguggcgaaagucagcguccacugcagcacaggaucagauggccgugugcugugca

SEQ ID NO: 84258 - RNA, 64 nt, hsa
ccagaggauggacaaguuugucaagaaucgaggggcacaggagauucaggugagacccaaguuc

SEQ ID NO: 84259 - RNA, 64 nt, hsa
gaaaccaacacccaaagcauggacuaaccccaacgcacaggaaaagguagcuuaccugacacaa

SEQ ID NO: 84260 - RNA, 64 nt, hsa
auggcacugauuguuuuagagacuauggagccuggcacaggacugauucugggaugcuccuagu

SEQ ID NO: 84261 - RNA, 55 nt, hsa
gguauguccuggugaauuagucucagcacaggaauugaggugggucaggugaagg

SEQ ID NO: 84262 - RNA, 64 nt, hsa
caaggcaaaucaagaagacaucaggaaaucagaugcacaggaaauaaaggaaagcugugcuuug

SEQ ID NO: 84263 - RNA, 64 nt, hsa
ugaggcgccccaacccguggaggcugcucggggugcacaggagggggucguggagagcuaggag

SEQ ID NO: 84264 - RNA, 64 nt, hsa
gaggugcccaggagaagaaagaggugaccccagggcacaggagcuaccuguguggacaggacua

SEQ ID NO: 84265 - RNA, 64 nt, hsa
aggaggggggagcagguuuuaugaauguaacugugcacaggaaaugacugguaauggaaaaaau

SEQ ID NO: 84266 - RNA, 64 nt, hsa
ccacagagauuagggggacuuaaaauuaauauaggcacaggaaagagaaaagugugcgcuccau

SEQ ID NO: 84267 - RNA, 64 nt, hsa
gccaugauguacccuccgagaaagaagaacguaagcacaggaaagagaaaaagaaaucuguuga

SEQ ID NO: 84268 - RNA, 64 nt, hsa
ucuucaugucccucauccagcucagaucuuauuagcacaggaauggcuaccauaacgauaugga

SEQ ID NO: 84269 - RNA, 64 nt, hsa
aggaggggcgauguggcuggggagcuagggagagacucuggagguggugggucucucgggagac

SEQ ID NO: 84270 - RNA, 64 nt, hsa
acuggaaugcaaguccuucuucccuuuggaauguacucuggaucccuuccccugcuuugacccc

SEQ ID NO: 84271 - RNA, 64 nt, hsa
gucuccgcuggcuuugaaucuuccucugggcucuacucuggagaacauaagggcugcugugguu

SEQ ID NO: 84272 - RNA, 64 nt, hsa
uggcccagggaagccccugguucugucccuggagacucuggaaauccuuuugcauuaaaaggac

SEQ ID NO: 84273 - RNA, 64 nt, hsa
ucggaugugguggcaggugccuguagucccagcuacucuggaggcugaggcaggagaauggcgu

SEQ ID NO: 84274 - RNA, 64 nt, hsa
aaagaauacaaaugcuccaacauuauuuuuuauaacucuggauuaccgaugcugagaugugugc

SEQ ID NO: 84275 - RNA, 64 nt, hsa
uauuaucuccacuuucaaucucccuccaagcucuacucuggaggagucugucccacucugucaa

SEQ ID NO: 84276 - RNA, 64 nt, hsa
uuuucuuacucccaaaaaagaaugaacaccccugacucuggagugguguauacugccacaucag

SEQ ID NO: 84277 - RNA, 64 nt, hsa
ucuuuccacucuggauucagccuucuuuuucuggacucuggacuuucucuaauaauaaauaguu

SEQ ID NO: 84278 - RNA, 64 nt, hsa
cugcacccuccuagggcauuguaucugucuuuccacucuggauucagccuucuuuuucuggacu

SEQ ID NO: 84279 - RNA, 64 nt, hsa
ucuugcccucuccucaccuccuuuucucucagugacucuggaaccugaaugcagcuuacaagac

SEQ ID NO: 84280 - RNA, 64 nt, hsa
ucaggagcuagcagaaaauaacucaaaguugaagacucuggaagauuuugcuuuaaccuaacuc

SEQ ID NO: 84281 - RNA, 64 nt, hsa
auguccuguuaaauuuacaacacuaacgauguagacucuggaaaugccuaauaagucaaagaag

SEQ ID NO: 84282 - RNA, 64 nt, hsa
cugagguucucuuuuucuuggugcuuuauuagcaacucuggauauuuuuauaaaacuaguuaca

SEQ ID NO: 84283 - RNA, 64 nt, hsa
gaugggccugugacaccccaaagagaagaaggggacucuggauaggguccccacauccagggcg

SEQ ID NO: 84284 - RNA, 64 nt, hsa
acagucuguggccguggucuuagcccccaguuccacucuggaugggccugugacaccccaaaga

SEQ ID NO: 84285 - RNA, 64 nt, hsa
ccaggcaugguggugcgcaccuguagucccagcuacucuggaggcugaggcaggggaauggcuc

SEQ ID NO: 84286 - RNA, 64 nt, hsa
uggcccaguuuauuucguaugcaugaaagaacucacucuggagagaaacuauaugaauguaagc

SEQ ID NO: 84287 - RNA, 64 nt, hsa
gacucuggaaccucugugacgccaguucucccugacucuggaaccucugugauccuuugcaggu

SEQ ID NO: 84288 - RNA, 64 nt, hsa
cauuucacucagcugcuccucucaguucucccugacucuggaaccucugugacgccaguucucc

SEQ ID NO: 84289 - RNA, 64 nt, hsa
uauuucuuauccaggugguuaaagcauucauaaaggauuauaaaauuuuuuuuuuuuuuuuuuu

SEQ ID NO: 84290 - RNA, 64 nt, hsa
ccuagaccuccauucacucuguuucucuucugcuggauuauauaauuuaaaaauaauguguucc

SEQ ID NO: 84291 - RNA, 64 nt, hsa
agugauccaccuaccuaggccuuccagagugcugggauuauaggcgugagccaccgugccuggc

SEQ ID NO: 84292 - RNA, 64 nt, hsa
agcaauucuccugccucagccuccugaguagcugggauuauaggcgugcaccaccaugcccagc

SEQ ID NO: 84293 - RNA, 64 nt, hsa
agcgauucuccugccccagccucccauauagcugggauuauaggugccugccaccaugcccagc

SEQ ID NO: 84294 - RNA, 64 nt, hsa
agcgauucuccuguaucagccucccaaguagcugggauuauaggcaugugccaccaugcccagc

SEQ ID NO: 84295 - RNA, 64 nt, hsa
gccuuucuauaagcaaauuaaggaagaaaagguaggauuauaagauuucucaauggggaugauu

SEQ ID NO: 84296 - RNA, 64 nt, hsa
aagugaucucccacuucagccucccgaguaucugggauuauaagcaagagccacugcucccagc

SEQ ID NO: 84297 - RNA, 64 nt, hsa
cgugauccgcccgccucagccuuccaaaguguugggauuauaggcgugagccaccgcgcccagc

SEQ ID NO: 84298 - RNA, 64 nt, hsa
agccaucccccaaccuuggccucucgaguagaugggauuauaggcaugugccacggugccugac

SEQ ID NO: 84299 - RNA, 64 nt, hsa
uuaaguuccacagauuuuucuguugggcagccaaggauuauaaaccacuucccuaaaggcaaca

SEQ ID NO: 84300 - RNA, 64 nt, hsa
ugaauauguaaaggguuuguuuuguauacaaaugggauuauacuaaaauaaguaaugccuauuu

SEQ ID NO: 84301 - RNA, 64 nt, hsa
uacuuagaugccagucuacuuuauaaagacaaauggauuauagacuuaaaaauagucauuuuuc

SEQ ID NO: 84302 - RNA, 64 nt, hsa
ccuuugucagaaaguauucucacaauuaugagauggauuauaauaaaauacuuaaauuuguguu

SEQ ID NO: 84303 - RNA, 64 nt, hsa
gggacuuuggcacccaaggaguucugacuuucugggauuauaauaguaauucccagccauacuc

SEQ ID NO: 84304 - RNA, 64 nt, hsa
aaauuuucucuggauuguuuuaguaauauuuuugggauuauacuuccuuucuguaccaauuucu

SEQ ID NO: 84305 - RNA, 64 nt, hsa
agugauccacucgcuucggccucccaaagugcugggauuauaggcgugagccacugugcccagc

SEQ ID NO: 84306 - RNA, 64 nt, hsa
aaagauccacccaccucggccucccaaagugcugggauuauaggcaugaaccaccguguccggc

SEQ ID NO: 84307 - RNA, 64 nt, hsa
agguuaagugagguccccuugauugaggacuucaccccuugauuaaagcaacuucugcuucagu

SEQ ID NO: 84308 - RNA, 64 nt, hsa
ggcugagaccccaccaccaaagguuaagugagguccccuugauugaggacuucaccccuugauu

SEQ ID NO: 84309 - RNA, 64 nt, hsa
gaucacucuuuuuuuuuuuuuuuaaaaggggcagccccuugauggcucaucucucugaauaaca

SEQ ID NO: 84310 - RNA, 64 nt, hsa
ugcucagcccacaccagaccuccaggagacauccccccuugaggcagagagauccuguucccua

SEQ ID NO: 84311 - RNA, 64 nt, hsa
ccuaaauauuaugagaugcuggcuugggcagcauccccuugaacucuucacucuucaaaugccu

SEQ ID NO: 84312 - RNA, 64 nt, hsa
ccaggcuguguuuggcuuucagggaggcccugugccccuugacaacuggcaggcaggcucccag

SEQ ID NO: 84313 - RNA, 64 nt, hsa
gguguagucaacaaagcugugcuaauaucucuguccccuugauccuggcauucuggaagacacg

SEQ ID NO: 84314 - RNA, 64 nt, hsa
cugaagaagcagagccuguaucaugggacacacaccccuugaccacacagcauccacucuccug

SEQ ID NO: 84315 - RNA, 64 nt, hsa; identical to SEQ ID NO: 45658

SEQ ID NO: 84316 - RNA, 64 nt, hsa; identical to SEQ ID NO: 45659

SEQ ID NO: 84317 - RNA, 64 nt, hsa; identical to SEQ ID NO: 45660

SEQ ID NO: 84318 - RNA, 64 nt, hsa; identical to SEQ ID NO: 45661

SEQ ID NO: 84319 - RNA, 64 nt, hsa; identical to SEQ ID NO: 45662

SEQ ID NO: 84320 - RNA, 64 nt, hsa; identical to SEQ ID NO: 45663

SEQ ID NO: 84321 - RNA, 64 nt, hsa
uucaaagucccuauccaggucacuccagaaaaggguauugaaacguugaaaucuaaagcaaauu

SEQ ID NO: 84322 - RNA, 64 nt, hsa
auuaaacagagaacuugccauguugagugccauuguauugaacuuauucuaaaggcuuaugcua

SEQ ID NO: 84323 - RNA, 64 nt, hsa
auucucauauacccagauuuacagagaugacacaguauugaaauggcaggugggcucuguaagu

SEQ ID NO: 84324 - RNA, 64 nt, hsa
aaaucuugaacauuuaugaugucaauuagugaaaguauugaaaauacuaaauuauaacuaaaag

SEQ ID NO: 84325 - RNA, 64 nt, hsa
acacaaagcaauuauucuuccuaucugauuauuuguauugaagaaaacaaauuuaccaaaagca

SEQ ID NO: 84326 - RNA, 64 nt, hsa
aaaccuuucuuuuguuuuuuacacauaagaaacaguauugaaaaaucccacgcuaugguucaua

SEQ ID NO: 84327 - RNA, 64 nt, hsa
cuaccaaguuucauaccaaauauuugaaaggaugguauugaaucuaaaaccaaauauuaguuuu

SEQ ID NO: 84328 - RNA, 64 nt, hsa
cuuuaggaugaccguuucuuaacaaucaaaucugguauugaacugcaggugacuuuggcagaga

SEQ ID NO: 84329 - RNA, 64 nt, hsa
gucuaguucuaguaugguaacuauucuugaaaugguauugaaaaauaccguuaauucaaauuga

SEQ ID NO: 84330 - RNA, 64 nt, hsa
cauuuauuacuaacauagcuuuaaaucuuuaaauguauugaagcauugugcugucugaaaauaa

SEQ ID NO: 84331 - RNA, 64 nt, hsa
ugaaauuauuuugcaugcugcugcagccuuuaaaguauugaaguaacuggagaauugccaauac

SEQ ID NO: 84332 - RNA, 64 nt, hsa
auuggccaguagcuaagaagugggcuuuuaaagaguauugaagauugaaaggguuuuucuuucu

SEQ ID NO: 84333 - RNA, 64 nt, hsa
auagaaugaagaaacagucuuuaacagaaaaaagguauugaaauauuaaauggccaccaaguuu

SEQ ID NO: 84334 - RNA, 64 nt, hsa
uguauguaugcuuaauacgugucggucauauacaguauugaauuuuuacuguauaguaauucug

SEQ ID NO: 84335 - RNA, 64 nt, hsa
gacuaaggguagggguauaagucuguuccaugcagucacucagggacccagucuccuuuugucu

SEQ ID NO: 84336 - RNA, 64 nt, hsa
gcugugagcaggucagcaggaacccuuuucugcagucacucagggacccagacuuacagagugg

SEQ ID NO: 84337 - RNA, 64 nt, hsa
uauuauaauagagagauuaaguaacuugccugaggucacucagcucauaaauugcacuuuaggg

SEQ ID NO: 84338 - RNA, 64 nt, hsa
gcucauaaauugcacuuuagggauugugcacucagucacucagcuauucugacucuccagcacc

SEQ ID NO: 84339 - RNA, 64 nt, hsa
ucugaaugcugcuccacugucuuuugucuuggaggucacucagcagguuccuugcauuugcugc

SEQ ID NO: 84340 - RNA, 64 nt, hsa
acagucuuccuugccuuuagagugacccugcagagucacucagccaaaucugucugcugcuccc

SEQ ID NO: 84341 - RNA, 64 nt, hsa
uauggucauguauguaggcuguuaccucaagugagucacucagggaacaaugagcacuugaaga

SEQ ID NO: 84342 - RNA, 64 nt, hsa
acauuuuuguguuuuuaggagauggucuugcucugucacucaggcuggaguacaguggcacaau

SEQ ID NO: 84343 - RNA, 64 nt, hsa
caucugaccacugggcaccuuagugccaaccugaaccaaagagaccuccuuguuucagcugggc

SEQ ID NO: 84344 - RNA, 64 nt, hsa
ugugggaacaagagaugacuuugaggauaaaaggaccaaagaaaaagcuuuacuuagaugauug

SEQ ID NO: 84345 - RNA, 64 nt, hsa
aguuccugauuccaagucaccugugcuuucugggaccaaagaaugggcaccugcuggaguccgg

SEQ ID NO: 84346 - RNA, 64 nt, hsa
guaauuuuaaggggccaaagcuuucccugaagcaaccaaagauauauccaagugcuuccuccaa

SEQ ID NO: 84347 - RNA, 64 nt, hsa
aaguccuauaauguggaagaaacaaacaguugcuaccaaagauucuucaaauaaacauacaaau

SEQ ID NO: 84348 - RNA, 64 nt, hsa
aauuggccugaauauucucuuggggaaagagggcaccaaagaaaaggguaagugcaucugaggg

SEQ ID NO: 84349 - RNA, 64 nt, hsa
caucagagccagaaaugcccucccuagguccaggaccaaagauaaaacaaacacgaggaacaug

SEQ ID NO: 84350 - RNA, 64 nt, hsa
gugcuaccauauggagccuaaggauaaagccaauaccaaagaaaacagugacuaaacagagaga

SEQ ID NO: 84351 - RNA, 64 nt, hsa
aguuuugccuuaauuuuuuaaguacugcaccaaaaccaaagagcugaccugacuucuguggaac

SEQ ID NO: 84352 - RNA, 64 nt, hsa
cucaacauaacuaugaaaucauagcucuguuuucaccaaagaacagaccaauuaacauacuuau

SEQ ID NO: 84353 - RNA, 64 nt, hsa
uuuuuguaugcuuaaauaaaaauaaaaauucauaaccaaagagaaucccacauuagcuuguuag

SEQ ID NO: 84354 - RNA, 64 nt, hsa
ggugcaguccagacagcuugacugcuuuuaaaugaccaaagaugaccugugguaagcaaccugg

SEQ ID NO: 84355 - RNA, 64 nt, hsa
auccagauauuugagaagcaggaaauuuauagcaaccaaagaaauagggcaagagaggcaggug

SEQ ID NO: 84356 - RNA, 64 nt, hsa
cagagagaccugcuaaaaccagacagauauaaacaccaaagacggaagccaaauagguagccaa

SEQ ID NO: 84357 - RNA, 64 nt, hsa
uaauagacaacuccagauugacauugacugcuuaaccaaagaaauugaucuuuuucaagcccga

SEQ ID NO: 84358 - RNA, 64 nt, hsa
ucuuucuuacagaucaaagguccaucaucaaaacaccaaagacucaagacacagaagaugauga

SEQ ID NO: 84359 - RNA, 64 nt, hsa
ggcugccucccuuccucagcccauuagguuaaacaccaaagaaagacugguguguacugaauag

SEQ ID NO: 84360 - RNA, 64 nt, hsa
uuauuuggaaccuucuaagaggaaaucaaccaggaccaaagagccuuaaaggacacacagcaau

SEQ ID NO: 84361 - RNA, 64 nt, hsa
aucagcucaggacugccauuggacuauggagugcaccaaagagaaugcccuucuccuuauugua

SEQ ID NO: 84362 - RNA, 64 nt, hsa
cugccccagcuggggaaaucaaaagggccaaagaaccaaagaagaaaguccacccuugguuccu

SEQ ID NO: 84363 - RNA, 64 nt, hsa
caagaaauauuaauaccacauggggagaaccccaaccaaagaaaucugaaauauauaguaaaug

SEQ ID NO: 84364 - RNA, 64 nt, hsa
auaaagcaaaaagcaggccacaaccuuaaccaacaccaaagaaacauccaagcaauaaagugga

SEQ ID NO: 84365 - RNA, 64 nt, hsa
caccuuuccagaaaaaagucaauuguucagguacaccaaagaggaagaagagcuguggaggcca

SEQ ID NO: 84366 - RNA, 64 nt, hsa
ccuggcacacuggggucugcacaaggcuuugucaaccaaagacagcuucccccuuuugauugcc

SEQ ID NO: 84367 - RNA, 64 nt, hsa
ucucaaauuuuaaguuaaacuaccuaaaauaaauaccaaagauaaugcauauuuuugcacagug

SEQ ID NO: 84368 - RNA, 64 nt, hsa
gcuauuaugauguuuugcaaaggaaaauaaucaaaccaaagaguauucagugauauguaaauua

SEQ ID NO: 84369 - RNA, 64 nt, hsa
aauguucauuuaucaaaaaucugguuugggaaauaccaaagaggcuuugauugaauucccuuuu

SEQ ID NO: 84370 - RNA, 64 nt, hsa
cguguuucguaagcccaggcaccaaugggaauggaccaaagaguuucagggaaacuccaguaua

SEQ ID NO: 84371 - RNA, 64 nt, hsa
ggaccagaggucauaggugcccaacggcagccaaaccaaagacacuggugugcauggggcagca

SEQ ID NO: 84372 - RNA, 64 nt, hsa
cgggcagaugguggaaggcagcuuaggagaccucaccaaagagaagauggaccggcucuugcuc

SEQ ID NO: 84373 - RNA, 64 nt, hsa
gaaauggagaguagugagcaaaacaucagauuucaccaaagaaccaaagugacuccacaauugg

SEQ ID NO: 84374 - RNA, 64 nt, hsa
aggggaaacugcacuuagacugacagaauugaacaccaaagaauuugcuggcuuccaaauuggg

SEQ ID NO: 84375 - RNA, 64 nt, hsa
agcgcuuuaugcccaugaugucauuucaggcucaaccaaagaggaucaaacaggaauuccaucu

SEQ ID NO: 84376 - RNA, 64 nt, hsa
uuucagcugagaacagauuugacucacagacauuaccaaagaggagcuugugaauccaggaaaa

SEQ ID NO: 84377 - RNA, 64 nt, hsa
augccuauaauuccagcacuuugggaggccaaggcagaaggaucacuugagaccaggaguucaa

SEQ ID NO: 84378 - RNA, 64 nt, hsa
ggugugguggcaugcgcauguagucccagcuacucagaaggaugaggugggaggaucucuugag

SEQ ID NO: 84379 - RNA, 64 nt, hsa
cuggcugaagggaauuaacagauaguaucaagcgcagaaggaaugugccaguauggcucccugg

SEQ ID NO: 84380 - RNA, 64 nt, hsa
aagaagcauaagcaagacaaaaacagagagaccgcagaaggaggaagauacugugguacuguca

SEQ ID NO: 84381 - RNA, 64 nt, hsa
gcagcuuugacugcuuuccaaguuuucauuaauccagaaggaugaacauggucaccaucuaacu

SEQ ID NO: 84382 - RNA, 64 nt, hsa
gaugugaaaagccuccaagcuguacaggcaauggcagaaggagaugcucagggcuccugggggg

SEQ ID NO: 84383 - RNA, 64 nt, hsa
cugccauauugugaaaaacuuuaguggacaagggcagaaggaagagggaagaccuguuaggaag

SEQ ID NO: 84384 - RNA, 64 nt, hsa
cugaaugcacuugguuuauuguugggggugcucucagaaggaaccugugaaagccuuuaucagu

SEQ ID NO: 84385 - RNA, 64 nt, hsa
gaggcaugucugagccacuugaggggcagcugaacagaaggaugucugugugcaucaaccgagc

SEQ ID NO: 84386 - RNA, 64 nt, hsa
ugugcccucagggacuggcagagcaagaggccaucagaaggacgaggugcuguuggcaauugca

SEQ ID NO: 84387 - RNA, 64 nt, hsa
aaacaacaacaacaacaacaacaacaacaacaaacagaaggauaaacuggcuugccuguggacc

SEQ ID NO: 84388 - RNA, 64 nt, hsa
guugugacggauguauggauguucuugaacauuucagaaggagugguagaaaaaaacacacauu

SEQ ID NO: 84389 - RNA, 64 nt, hsa
aaauaugucugccaaguuguuagaaucuuugaaucagaaggaaaaaaagcagcgcugguugaca

SEQ ID NO: 84390 - RNA, 64 nt, hsa
ucccaaccugagauuuguaguccaggauuacaaccagaaggaaaguaugacagauuucuacuua

SEQ ID NO: 84391 - RNA, 64 nt, hsa
agcacugaacgauuucaagcccuacgcaccagaacagaaggaggguggaggaagugaucagagg

SEQ ID NO: 84392 - RNA, 64 nt, hsa
ccggugggggcugggcucccgugagguccuagggcagaaggaggugcuugcagggccucucgcu

SEQ ID NO: 84393 - RNA, 64 nt, hsa
agucagcaaggaagccgggugucgcucacacaaccagaaggagcugaguuuggcaacaacccaa

SEQ ID NO: 84394 - RNA, 64 nt, hsa
ugcuuucugcuuaguauuuuuuugauucaaggcucagaaggaauggugcguggcuucccugucc

SEQ ID NO: 84395 - RNA, 64 nt, hsa
gcggagcugcugagugacagcuuuccucaaaaagcagaaggagagugagugccuuucccuccua

SEQ ID NO: 84396 - RNA, 64 nt, hsa
ccaaaccaggacacuacccugagaucugcacagucagaaggacggcaggaguguccuggcugug

SEQ ID NO: 84397 - RNA, 64 nt, hsa
gcgggcuggcggcagucccaggggagagacaccacagaaggagacccagacaucccgaggaagu

SEQ ID NO: 84398 - RNA, 64 nt, hsa
caggcaacuucgagaacggauccagaaaugcagucagaaggacccugcuccaccuggggggacu

SEQ ID NO: 84399 - RNA, 64 nt, hsa
cgccugugucagguguggaugaggucgucacacucagaaggacaggcuugucugccagcucaca

SEQ ID NO: 84400 - RNA, 64 nt, hsa
agaaugcccacaagugggucuucuguggaagaugcagaaggaggaaguuagugcuuacauuuua

SEQ ID NO: 84401 - RNA, 64 nt, hsa
uuuccagaaggaacgagccaucuuccuggcugcucagaaggaggcagauuuggcugcccaagaa

SEQ ID NO: 84402 - RNA, 64 nt, hsa
uugcagccucaguucagaagagcuugcagcuuuccagaaggaacgagccaucuuccuggcugcu

SEQ ID NO: 84403 - RNA, 64 nt, hsa
cauuucauuauuucugcuuccugggggaaggaugcagaaggagucugaugcucaacaucccuua

SEQ ID NO: 84404 - RNA, 64 nt, hsa
caaaggagaguccugggagcccacaagauccaggcagaaggagauggguuuggggcuggcccca

SEQ ID NO: 84405 - RNA, 64 nt, hsa
augccuguaaucucagcacuuugggaggcugaggcagaaggauuaccugaggcaaggaguuuga

SEQ ID NO: 84406 - RNA, 64 nt, hsa
acaucucaucucaggaaguggugguggggguagucagaaggaaaaauaacuggacaucuuugug

SEQ ID NO: 84407 - RNA, 64 nt, hsa
caccucaacacaucccuucagugacucagagucucagaaggaaacccugacuccuggggccauu

SEQ ID NO: 84408 - RNA, 64 nt, hsa
auggcaacauggaauauuguccuccaugccccuccagaaggaccuaggagaguaggugagcuuu

SEQ ID NO: 84409 - RNA, 64 nt, hsa
ccagauauaggcugaacagaaacauuuacuuugccagaaggagccuuuaggaguauaugugggc

SEQ ID NO: 84410 - RNA, 64 nt, hsa
aaugagagucuguaugauucuggaacagagacaucagaaggaaagacuggugaaaagauguauc

SEQ ID NO: 84411 - RNA, 64 nt, hsa
cguggacuugaucauggacuggugccuuugcauucagaaggagagcugucagcguagcaccgaa

SEQ ID NO: 84412 - RNA, 64 nt, hsa
ccgaucugggacugaaacgcuuacaccucugccucagaaggagucccccaugcccugccugaaa

SEQ ID NO: 84413 - RNA, 64 nt, hsa
acaccagcucucagggcagagauuggcuuggggccagaaggacccuccccaacccuggagacac

SEQ ID NO: 84414 - RNA, 64 nt, hsa
ucauaacaugaauugauggucaauuucccuucagcagaaggaaaaggugauuuagaucaguagc

SEQ ID NO: 84415 - RNA, 64 nt, hsa
cgaagcaggguuugaggguuggguggauggagcucagaaggaaaccccagccccaccacggaug

SEQ ID NO: 84416 - RNA, 64 nt, hsa
ccauccccagcaugggcaaggccagccuuucuggcagaaggagcuguccucaacucagggccgc

SEQ ID NO: 84417 - RNA, 64 nt, hsa
cccacugugcacagguuugagaggacaaguucaucagaaggaaggcaguccuuagaagucacau

SEQ ID NO: 84418 - RNA, 64 nt, hsa
ggugaacauguuugugggccuuuugacugaguggcagaaggaaacugcucaggaagagaaacag

SEQ ID NO: 84419 - RNA, 64 nt, hsa
agaaggaaggagggaagaaaagaaagcaaaggaacagaaggaaggaaagaaagaugggaggaag

SEQ ID NO: 84420 - RNA, 64 nt, hsa
ggaggcggagaggggagaagaaggaagggaagggcagaaggaaggagggaagaaaagaaagcaa

SEQ ID NO: 84421 - RNA, 64 nt, hsa
uuuaauuuuuaaaagauauucuuacucauuugcuagguuguaaauuugauuucaccauuaagaa

SEQ ID NO: 84422 - RNA, 64 nt, hsa
uucuacuacaguuuuuuccuuauggacccauacuagguuguacaaaccuuaaggacucguuacc

SEQ ID NO: 84423 - RNA, 64 nt, hsa
uuuuagggaacggggaguggauccaggacaggggagguuguaaccccugagaaaugaacauugg

SEQ ID NO: 84424 - RNA, 64 nt, hsa
agugaagcccacagaaaauaaguagcuccuccacagguuguaagcuaggucuagcugacugcaa

SEQ ID NO: 84425 - RNA, 64 nt, hsa
uaugccucugaaaauuuuauuaguuuauucuuguggagaauaccaagaaaauguguauuugccc

SEQ ID NO: 84426 - RNA, 64 nt, hsa
uguauuuauuugucccaagugucuuuuuguaagaggagaauaaacaauaaggaauuacugauca

SEQ ID NO: 84427 - RNA, 64 nt, hsa
uuugcugcuauucugggagaauaaacuuguauauggagaauaaacuaauaaacuuguaucgagg

SEQ ID NO: 84428 - RNA, 64 nt, hsa
acauccaauucaaguuuuauuugcugcuauucugggagaauaaacuuguauauggagaauaaac

SEQ ID NO: 84429 - RNA, 64 nt, hsa
caaguuuuccagaucauuccuacaaaguaaacugggagaauaauaagucugaaagaguguggag

SEQ ID NO: 84430 - RNA, 64 nt, hsa
ucacauuaugaucuugacaggugcacuuuacuggggagaauaaaaaggaccauacgguaaagcu

SEQ ID NO: 84431 - RNA, 64 nt, hsa
caacauuuuccuaucaugaaaucucuuucagagaggagaauacaacaucuuaguccagacauuu

SEQ ID NO: 84432 - RNA, 64 nt, hsa
acuacuaaaaauaaauauuuuuggagauuaaaauggagaauagaaguaauuacauuauuuaggu

SEQ ID NO: 84433 - RNA, 64 nt, hsa
ugggaguaggaaacgauggacuccaaaguacaagggagaauacccauuuucauucagcuaucug

SEQ ID NO: 84434 - RNA, 64 nt, hsa
uuuuacuugcggugacuauucuugccacaauauuggagaauaaugauagaugauauacuagauu

SEQ ID NO: 84435 - RNA, 64 nt, hsa
auucccugacaaacauugcuuaggaaagagggccggagaauaagaagccagcaccucaucaguc

SEQ ID NO: 84436 - RNA, 64 nt, hsa
gccuguaaucccagcuacucaagaggcugaggcaggagaauagcuugaacccgggaggcagagg

SEQ ID NO: 84437 - RNA, 64 nt, hsa
aauuuuucuuccucuccacuucuuagaggcauucaguuagcaaagagguuggagcaacaacuuu

SEQ ID NO: 84438 - RNA, 64 nt, hsa
gggaaguguguuuagaaggguucaggacuuugugaguuagcaugacccuaaaauucuaggggau

SEQ ID NO: 84439 - RNA, 64 nt, hsa
uuuuaaagguaauuuucuaagcauaccuuuggaauuuuuccaucuuuuuugaggcuuuuggucc

SEQ ID NO: 84440 - RNA, 64 nt, hsa
caacccucaguuaugauacuuaugugcguguuuuuuuuuccaaaguuuuucccaaggagaagau

SEQ ID NO: 84441 - RNA, 64 nt, hsa
agcuauuuuuuguuuuuguucuuuucguuuuuuuuuuuuccaaaaauagugacuuccuucucca

SEQ ID NO: 84442 - RNA, 64 nt, hsa
cuuaguagaugagagaguucuaggcuacuguggcuuuuuccaguagauuuagaugagauuaugu

SEQ ID NO: 84443 - RNA, 64 nt, hsa
uccuguuauugguaguucugaacguuagauauuuuuuuuccauggggucaaaagguaccuaagu

SEQ ID NO: 84444 - RNA, 64 nt, hsa
ggaaaaauaggggacagaaaucagguauuggcaguuuuuccauuuucauuugugugugaauuuu

SEQ ID NO: 84445 - RNA, 64 nt, hsa
guuaaaccuucuuuaucuccuccuuuggcauccauuuuuccaaagaagagucgaguccucugag

SEQ ID NO: 84446 - RNA, 64 nt, hsa
uuuuuuucuuccauaaacuacuauugugaucuauuuuuuccagccaugucacuaauugugaauu

SEQ ID NO: 84447 - RNA, 64 nt, hsa
acuccuaacaacauuuucgggggaucugaccuuuuuuuuccaguugaaauguauuaacacaccu

SEQ ID NO: 84448 - RNA, 64 nt, hsa
uuucaguacaacuggaauuuaaauauuuccauuguuuuuccaaagcaguuaacccaacuccuaa

SEQ ID NO: 84449 - RNA, 64 nt, hsa
acaaagcugugcuccuauucaugagcauggaauguuuuuccauuuguuugugacaucucuuauu

SEQ ID NO: 84450 - RNA, 64 nt, hsa
caguuaauuuuuuguauuuguuuguagagauguguuuuuccauguugcccaagcuggucuugaa

SEQ ID NO: 84451 - RNA, 64 nt, hsa
uaagggcugaaaggugcucuacuucuuaacuuguuuuuuccauguuguagacaaaugaaauuug

SEQ ID NO: 84452 - RNA, 64 nt, hsa
uauacacuaugauuagaaaauaugcaagaaauuguuuuuccauguuaagaacaaaugccauuag

SEQ ID NO: 84453 - RNA, 64 nt, hsa
guuuucauuuagugcuuugauaaugauuuacuuauuuuuccaaauuucguuugaauuuucuuuc

SEQ ID NO: 84454 - RNA, 64 nt, hsa
agaauguuucaaaugcuuaaauauauaauacauuuuuuuccauggaagugagggaauauuucag

SEQ ID NO: 84455 - RNA, 64 nt, hsa
gaauauuuuuaguuuucuguaaauuaucaguuauuuuuuccagucuccuuagaaaaauggcaac

SEQ ID NO: 84456 - RNA, 64 nt, hsa
gacgcauucccuguggacaguugacagcuuuuuuuuuuuccauauaccugauagucuguguaca

SEQ ID NO: 84457 - RNA, 64 nt, hsa
caauuauuucagcgcagguaucacccacgagaaauuuuuccagaguuucacaggcauuuuugga

SEQ ID NO: 84458 - RNA, 64 nt, hsa
cucuuuuuugguuccauaugaacuuuaaaguaguuuuuuccaauucugugaagaaagucaucgg

SEQ ID NO: 84459 - RNA, 64 nt, hsa
uuuaaugugaucccuucauuugaauauuaauggcuuuuuccauuaaagaauaaaauauuuugga

SEQ ID NO: 84460 - RNA, 64 nt, hsa
uucagaccauuuucuuuucuugggagccaguggauuuuuccagcagugaagggacauucucuac

SEQ ID NO: 84461 - RNA, 64 nt, hsa
uaugucaaagcuuugacucuauaagcaaauugcuuuuuuccaaaacaaaaagaugucucagguu

SEQ ID NO: 84462 - RNA, 64 nt, hsa
ucacaucuucggagaugaggaguaaaauucaguuuuuuuccaguuccucuuuugugcugcuucu

SEQ ID NO: 84463 - RNA, 64 nt, hsa
gcacacaggacaccagucuucaaggaaagggacuuuuuuccagucugccaaucauauugggaaa

SEQ ID NO: 84464 - RNA, 64 nt, hsa
ggaacugcugauuuucgguggguuuuguaguugauuuuuccaagagcgucgaagacucucuuuc

SEQ ID NO: 84465 - RNA, 64 nt, hsa
ugggauuuuucaauuuuauuauuuuauuuuuguuuuuuuccaauuacuggaaauuccaaauuug

SEQ ID NO: 84466 - RNA, 64 nt, hsa
guaauaaacuacugcauuuuaagcuuccuauuuuuuuuuccaguaguauuguuaccugcuugaa

SEQ ID NO: 84467 - RNA, 64 nt, hsa
uuuuacauacugcugucuauguggcuguaucuuguuuuuccacuacugcuaccacaacuauauu

SEQ ID NO: 84468 - RNA, 64 nt, hsa
acauuugcgaaugguuccauucucucuccuguacuuuuuccagacacuuuuuugaguggaugau

SEQ ID NO: 84469 - RNA, 64 nt, hsa
guccuuccugauucaugccugauauugggauuuuuuuuuccagccuucuugaugccaaggggcu

SEQ ID NO: 84470 - RNA, 64 nt, hsa
uaacaaugcuuucuauguucauauacuguuuaccuuuuuccauggagucuccuggcaaagaaua

SEQ ID NO: 84471 - RNA, 64 nt, hsa
caguacauuccauucaugcaguagauaugaaggcuuuuuccaaguuugucauauaaaguaauca

SEQ ID NO: 84472 - RNA, 64 nt, hsa
uuugauauucauauccuggaaguauacauauuuguuuuuccaaaguuuuauaugcagguuuuug

SEQ ID NO: 84473 - RNA, 64 nt, hsa
uuuguguauuuccuuuucugcuauuucuuuucaguuuuuccaaagucaagagucuuaaccuugu

SEQ ID NO: 84474 - RNA, 64 nt, hsa
guccugccaccuucuaguucaucccauaggaauguuuuuccaaguccuuccagucuuuuuagaa

SEQ ID NO: 84475 - RNA, 64 nt, hsa
cucaggugcugcuggugugagccaaagacuggaguuuuuccagcuggggugggaguggagagac

SEQ ID NO: 84476 - RNA, 64 nt, hsa
acuguuugacacccuccuuagagggcugcucuuuuuuuuccagagauaauccuagccauccucu

SEQ ID NO: 84477 - RNA, 64 nt, hsa
cuuauauguguauugcuaaucauuaagguauuauuuuuuccacauauaaagcuuugucuuuuug

SEQ ID NO: 84478 - RNA, 64 nt, hsa
aacuuucuuuugauuaguguuuuugugguauaucuuuuuccaucauguuacuuuaaauauaucu

SEQ ID NO: 84479 - RNA, 64 nt, hsa
aaccguuaacaucacugcuguggccucauacucuuuuuuccauuuucuacaagaagccuuuuag

SEQ ID NO: 84480 - RNA, 64 nt, hsa
aaccagugaauuuucaggaauuuaaaaauuagcuuuuuuccacuuaaaggagaaaaauauuugg

SEQ ID NO: 84481 - RNA, 64 nt, hsa
uguggugacuccuuuauauucguacugcacuuuguuuuuccaaggaaaucagugucuuuuacgu

SEQ ID NO: 84482 - RNA, 64 nt, hsa
agugagaauuuauuauagauuauuuuuuagcuauuuuuuccaugugugaaccuugagugauacu

SEQ ID NO: 84483 - RNA, 64 nt, hsa
cagugcuuccacauggaaacaaaaugcaauaaaauuuuuccaaaaccuguucugauuuagcucu

SEQ ID NO: 84484 - RNA, 64 nt, hsa
cugugauuauuuggaagaguguguaggaaagacguuuuuccaguucaaaaugccuuauacaauc

SEQ ID NO: 84485 - RNA, 64 nt, hsa
uuauagguccaguuugaagcauucugacuucugguuuuuccacccugaaaggaaauguuuuucu

SEQ ID NO: 84486 - RNA, 64 nt, hsa
auuucagaaacuuaguuuuuagaauaaauauuaauuuuuccacuucaguuuuauucuagaaaau

SEQ ID NO: 84487 - RNA, 64 nt, hsa
auuuauuaugcccaaaucaaccucugaaaaaagguuuuuccaggaagauuuacauuuagguuua

SEQ ID NO: 84488 - RNA, 64 nt, hsa
acacaugcuaugagcacuccaggaaacacuauauuuuuuccaaaaaauaugugauuauauaugu

SEQ ID NO: 84489 - RNA, 64 nt, hsa
aaagugagcgauuaguugagcccuugccgggccuuuuuuccaccugccaauucuacauguauug

SEQ ID NO: 84490 - RNA, 64 nt, hsa
uaguccccuaaagguauuaaccacuucugcgauauuuuuccacauuuucuugucgcuuguuuuu

SEQ ID NO: 84491 - RNA, 64 nt, hsa
aaaacucggaucuuuuaaaaagcaucauagaucauuuuuccauaugacacugguuccgauuuua

SEQ ID NO: 84492 - RNA, 64 nt, hsa
cuucacuauuuucagaaguuuuuguucuuuuuuuuuuuuccaucacucaguggagaaaagcuuu

SEQ ID NO: 84493 - RNA, 64 nt, hsa
gauauggaggcaaggggaacaaagagcaugagucuuuuuccaagaaaacuggugaguuaaguaa

SEQ ID NO: 84494 - RNA, 64 nt, hsa
cugagaagaaaugauuacuucugaaaaacauccuuuuuuccagccucugggaaucagccccccc

SEQ ID NO: 84495 - RNA, 64 nt, hsa
uuuuuuuuuuuuuucaucuuuuuugucucucucuuuuuuccaucccuuuuuaauuuuuuuaaca

SEQ ID NO: 84496 - RNA, 64 nt, hsa
guauauuuguuaugcacuacuuuuguauaucuuguuuuuccaacagugaacauuuuuaggcaca

SEQ ID NO: 84497 - RNA, 64 nt, hsa
aagugggugucuaguuuuuacuaaucccuaauuuuuuuuccaguguauugcucauauuaucaga

SEQ ID NO: 84498 - RNA, 64 nt, hsa
gugaaaccuuccugcugacaaccaugcagaggaauuuuuccacuuaagucagagccuuccuccc

SEQ ID NO: 84499 - RNA, 64 nt, hsa
cuguccacaccucuuuggggaaguuacgauuuuuuuuuuccaucauaauucagucucuucuuau

SEQ ID NO: 84500 - RNA, 64 nt, hsa
gcuggcuuucucccacugaguuugcuguuugcaauuuuuccaugaaguuugaacuucauaaggu

SEQ ID NO: 84501 - RNA, 64 nt, hsa
auagggagaaaccaagagaaguuuuguuuuuguuuuuuuccaacuguguucauuagaacagcgu

SEQ ID NO: 84502 - RNA, 64 nt, hsa
guguaauucucuuugccagcugcacaaagcugauuuuuuccaaagucuaaagacugagcucacc

SEQ ID NO: 84503 - RNA, 64 nt, hsa
aauaagucuuaaaaguuccuucaugcauaagauuuuuuuccaguuacuggguuuaacuggugua

SEQ ID NO: 84504 - RNA, 64 nt, hsa
gaaaagcuuaccaaaaauauauuuugacauuuaguuuuuccaagagcuauaaucuugcccauag

SEQ ID NO: 84505 - RNA, 64 nt, hsa
cauucugauuggauauuuaaagaagggugccacauuuuuccagcuuuaagugccuauauaugau

SEQ ID NO: 84506 - RNA, 64 nt, hsa
uaacacagcccaaaaaccuacuucuccuuguguuuuuuuccaacucaaugaaugacaucacugc

SEQ ID NO: 84507 - RNA, 64 nt, hsa
auuuccucggauucuuucaccacuuuuuaaguuuuuuuuccacagguauuuuuccugagcucua

SEQ ID NO: 84508 - RNA, 64 nt, hsa
auuuacugcccucuuacauaauguauuuauaaaguuuuuccagauaaacuaaucaaauaaauua

SEQ ID NO: 84509 - RNA, 64 nt, hsa
aaauacgucucauucuucaauacuuuaaaauggcuuuuuccagugugcuccuucuuagcaauca

SEQ ID NO: 84510 - RNA, 64 nt, hsa
uuucuguauucugaaagcuaaauauuaaguacuauuuuuccauucaaauauucauuuagaauuu

SEQ ID NO: 84511 - RNA, 64 nt, hsa
agucugaaacuuuagacaucaaaaguuugagcaguuuuuccaaggcaacauugauaguuagauu

SEQ ID NO: 84512 - RNA, 64 nt, hsa
uugcguuucuuauuuugcuuuaaaucucugguaguuuuuccaccccugugacacaauccuaaua

SEQ ID NO: 84513 - RNA, 64 nt, hsa
acacugccauauuuuaaaucaacuacuccacguguuuuuccauccaaucacacugcugugauuc

SEQ ID NO: 84514 - RNA, 64 nt, hsa
caauaacccacugaccacagugagaaccacugauuuuuuccacugaccuacugaauaucuagca

SEQ ID NO: 84515 - RNA, 64 nt, hsa
aucccaaagaggcccugugucuaccaggagcuucuuuuuccaaauguaauggauuauguggaau

SEQ ID NO: 84516 - RNA, 64 nt, hsa
aaaugguaaagaagaaauguaguuuacauuuguauuuuuccagaauucuuuuguccuaugcagu

SEQ ID NO: 84517 - RNA, 64 nt, hsa
uucagaccggucuucaaaggaaaagccuguccgauuuuuccauggguuccaguuucagaguucu

SEQ ID NO: 84518 - RNA, 64 nt, hsa
aaguuagcugguguuuuacuauuauuguguuacauuuuuccagugucgucauuaaucgguggca

SEQ ID NO: 84519 - RNA, 64 nt, hsa
ucccagaccacacaacuaguggaaugauuccuccuuuuuccauuacuuacuuaaucacaguuua

SEQ ID NO: 84520 - RNA, 64 nt, hsa
ugcucaauuugaagcagaauucagugaaaaauuauuuuuccacauugaaacacuuugcagacac

SEQ ID NO: 84521 - RNA, 64 nt, hsa
ccucaguacaugcuuugcacucuccuuugcucccuuuuuccaauuucuuauugcauaucauuuu

SEQ ID NO: 84522 - RNA, 64 nt, hsa
cucucuguuauuaauacauaaaugaaaauacauuuuuuuccauauuggcauguagcuacaaaua

SEQ ID NO: 84523 - RNA, 64 nt, hsa
agggagcuuuuaagaaauauuaauuuccuauacauuuuuccaauccccaugcaaacuguuccug

SEQ ID NO: 84524 - RNA, 64 nt, hsa
caugaacagauuuguguauaacugcaauggccuuuuuuuccagauuuccuuauugacuuuuugu

SEQ ID NO: 84525 - RNA, 64 nt, hsa
gacagaaguguugccuucauaaucaaacagcuuguuuuuccaucuccucugcaacccuaauuaa

SEQ ID NO: 84526 - RNA, 64 nt, hsa
aauaccuacaucaaauggaaaauaucugaaauuuuuuuuccauagcagguauuuucuacuagaa

SEQ ID NO: 84527 - RNA, 64 nt, hsa
uaauuauucaacaaaaagcauauccguucaaaaauuuuuccacuaugucuuuuuucuaguggcu

SEQ ID NO: 84528 - RNA, 64 nt, hsa
acaaccaaacagucugccuuaaaagugacccacauuuuuccauagcuccucacuuuuuagcccu

SEQ ID NO: 84529 - RNA, 64 nt, hsa
acaacucaacauggucaucauguuuucuauaugguuuuuccagcuagcaguacucccuuccaua

SEQ ID NO: 84530 - RNA, 64 nt, hsa
cagugguaguagggagugggagggcuuauauugguuuuuccagcuauuaaggggacauauugug

SEQ ID NO: 84531 - RNA, 64 nt, hsa
uuaacucguugcagucuguauuuuccaccuuuuguuuuuccaguuccaggacacagauuaucaa

SEQ ID NO: 84532 - RNA, 64 nt, hsa
accuuacucguauaccgugccacuuuccaccaacuuuuuccaaguccuuuaacucguugcaguc

SEQ ID NO: 84533 - RNA, 64 nt, hsa
ccuuuuugaauugugaugggaaaguagaguuggguuuuuccaguuuugcucuguggugugugag

SEQ ID NO: 84534 - RNA, 64 nt, hsa
gcuagcuaugucccuagcugcaggaagccccuauuuuuuccaagcacgaagccaccagucuccc

SEQ ID NO: 84535 - RNA, 64 nt, hsa
ccacuuuuaaacuugggaaauaagcaccuguauuuuuuuccaaaacuguuuuuaaagcuguaua

SEQ ID NO: 84536 - RNA, 64 nt, hsa
ccguuagugcaucaguaaauguguuauuuugucauuuuuccaaagagaguguuguagguuuucc

SEQ ID NO: 84537 - RNA, 64 nt, hsa
agagauuuuucaugauuuugaaaucaugaagauauuuuuccauuuuuuucuaauaguuuuauua

SEQ ID NO: 84538 - RNA, 64 nt, hsa
uaacuugcugcaguaugaaaauaagacggauuuauuuuuccauuuacaacaaacaccugugcuc

SEQ ID NO: 84539 - RNA, 64 nt, hsa
cuucgaaauaaaacacagcuccuucaaacagcacuuuuuccacauaaaucuaguugccucuccc

SEQ ID NO: 84540 - RNA, 64 nt, hsa
uuuguaaaagaaaaagggauaucuuuuuuauauuuuuuuccaugaaucugcagaaaauuacuga

SEQ ID NO: 84541 - RNA, 64 nt, hsa
caguguugugggucuacaacacuaaccagacgacuuuuuccaucaguguuuuacuugaaucuuc

SEQ ID NO: 84542 - RNA, 64 nt, hsa
uuuacagccuuuauacaaauguauuuaguucucuuuuuuccaacauaaaauucuuguuuuaaga

SEQ ID NO: 84543 - RNA, 64 nt, hsa
aaauaaguuuuuuaacuuguaaaacaugucaagauuuuuccaccaagcuagaaaauaaaaaacu

SEQ ID NO: 84544 - RNA, 51 nt, hsa
uuagcccuugucuacuaugauuuuuuccagauguuuccuaaagaaguuucc

SEQ ID NO: 84545 - RNA, 64 nt, hsa
cuggcuaauuuuuguauuuuuuauaaagacaggguuuuuccauguugcccaggcugguuucgaa

SEQ ID NO: 84546 - RNA, 64 nt, hsa
uauauauauuuucaguuuuuuugccuuauugauuuuuuuccaaaaaaaaaaaacuacuaaauua

SEQ ID NO: 84547 - RNA, 64 nt, hsa
gcuuuccucaaguuugucucucuugaccaaucauuuuuuccaaaucaaucaccagaaggagaca

SEQ ID NO: 84548 - RNA, 64 nt, hsa
gauaaauaauugcuguaaauuccuuuugauuuucuuuuuccagguucaugguccuugguaauuu

SEQ ID NO: 84549 - RNA, 55 nt, hsa
guaacagugaacaguuauaagacuuuuuuuccauuuuugugcuaauuuauuccac

SEQ ID NO: 84550 - RNA, 64 nt, hsa
accugaugauuuuccuucagcucucugaaggugcuuuuuccacaauccaagugauucugauaca

SEQ ID NO: 84551 - RNA, 50 nt, hsa
aagaaggacacuugcagugauuuuuccaggcuuccauuuagcaaauguuu

SEQ ID NO: 84552 - RNA, 64 nt, hsa
guccagaaagguuuggggcagaaaggacuccuccuuuuuccaugcccuaaacagaccugacagg

SEQ ID NO: 84553 - RNA, 64 nt, hsa
acauuuauuuccucccucuaccccaauuucggauuuuuuccaaaaucucccauuuuggaauuug

SEQ ID NO: 84554 - RNA, 64 nt, hsa
augcuuaagaaacucuugaaggcuauuuguguuguuuuuccacaaugugcgaaacucagccauc

SEQ ID NO: 84555 - RNA, 64 nt, hsa
auugaagauacuaaaugaugcaaaccaaauggauuuuuuccaugucaugauguaauuuuucuuu

SEQ ID NO: 84556 - RNA, 64 nt, hsa
uucuuaagaacaugacacuaaaaaaaaaguguuuuuuuuccaccguugcugauuauuagacagu

SEQ ID NO: 84557 - RNA, 64 nt, hsa
agaaaaugguucugugaaaagugaaugauauguauuuuuccaaaugcuucaugguuaggagucu

SEQ ID NO: 84558 - RNA, 64 nt, hsa
augugaacuagugccuuuggguaucacguaaaauuuuuuccaaaggguuacuuuaaaaaucugu

SEQ ID NO: 84559 - RNA, 64 nt, hsa
cugaaagaugcacugccauauuaucuuucuuaacuuuuuccaacacauaauccucuccaacugg

SEQ ID NO: 84560 - RNA, 64 nt, hsa
ugugcaaccuaauuaguaacuuuccucuuuuuauuuuuuccauauagagcacuauguaaauuua

SEQ ID NO: 84561 - RNA, 64 nt, hsa
guuggaugcauuuuauuuuagacacaaagcuuuauuuuuccacaucaugcuuacaaaaaagaau

SEQ ID NO: 84562 - RNA, 64 nt, hsa
agcaccaucaggugaaugauguuccugcuuuuguuuuuuccacuuguauaugcacuaauuuuaa

SEQ ID NO: 84563 - RNA, 64 nt, hsa
uaugaaaugcuuaauuuauaagcgggcuggagauuuuuuccaauauuguuuucuuugaaaauga

SEQ ID NO: 84564 - RNA, 64 nt, hsa
cauaauuaacauaagugguuccuaacgagagcaauuuuuccacccaaaagucauuuggcaacau

SEQ ID NO: 84565 - RNA, 64 nt, hsa
aaacaugcauauucacauuaauuaaucgaucagauuuuuccagaauuccguaucagucaccauu

SEQ ID NO: 84566 - RNA, 64 nt, hsa
uguuuguaauggguuggugcaaaaguaauugugguuuuuccauuacuuucaauggcaaaaaccg

SEQ ID NO: 84567 - RNA, 64 nt, hsa
uuuagaaauaccccuauuucucauuugcaguuuuuuuuuccaauucugugcucugucaacauga

SEQ ID NO: 84568 - RNA, 64 nt, hsa
acuucaagaaauuauuuuaucauaucugcuucuguuuuuccaaaagguuaaaacuuguaaaaaa

SEQ ID NO: 84569 - RNA, 64 nt, hsa
cuuagaaaugugaaguuauauucucaaguuuauuuuuuuccaaguguagcuaaaauauuuuugc

SEQ ID NO: 84570 - RNA, 64 nt, hsa
uucccuacuguaaaauacuuaagacgguuucugauuuuuccacuauuuaaauaaugcugugaug

SEQ ID NO: 84571 - RNA, 64 nt, hsa
aggaugucacuacugcaauccaucuguggccgauuuuuuccaagagccaauuuccuuguuuugg

SEQ ID NO: 84572 - RNA, 64 nt, hsa
auccuuaaaagaccauugcaaaucaguguaaggguuuuuccaguaauuacucacagcacuuugu

SEQ ID NO: 84573 - RNA, 64 nt, hsa
auuaaacuuuuagaaaacuuuagcauuuguuacuuuuuuccauugcguuuacuuucaaaugcac

SEQ ID NO: 84574 - RNA, 64 nt, hsa
uuaacagggcggcagucuaguguugaaaguuuuauuuuuccauuuuucuuuuaaguaaauuuuu

SEQ ID NO: 84575 - RNA, 64 nt, hsa
uaucuccgugacuccaacuuguggguuuguucuguuuuuccaugagaauaaaauacuggcgguu

SEQ ID NO: 84576 - RNA, 64 nt, hsa
augcuucugaaaacuaggucugacucuggggauuuuuuuccagccgaaggaaaaucacuuccgu

SEQ ID NO: 84577 - RNA, 64 nt, hsa
auguaaaaaacugguggaaaaagguuuuggauuuuuuuuccagugggguggggggagggcaagc

SEQ ID NO: 84578 - RNA, 64 nt, hsa
ccccucaacagcaugcgagcccauaccuucugcauuuuuccaggccugugagggauauaggccu

SEQ ID NO: 84579 - RNA, 64 nt, hsa
gucugcccacugaggauagggaaaggauuaaggauuuuuccaccuccucuuaguaacuccugaa

SEQ ID NO: 84580 - RNA, 64 nt, hsa
cuaaggacaaauuagcaugcaagcuuggucaaacuuuuuccagcaaaauggaagcaaagacaaa

SEQ ID NO: 84581 - RNA, 64 nt, hsa
auggucuuaacuaauuugaauccuucaagaaggauuuuuccauacuauuuuuuaagauagaaga

SEQ ID NO: 84582 - RNA, 64 nt, hsa
aauuaucaaugggauaugauugguucaguuuuuuuuuuuccagaguuguuguuugccaagcuaa

SEQ ID NO: 84583 - RNA, 64 nt, hsa
aauguaggguuauauuugggagugacugcaagcauuuuuccaucugugugcaacuaacugacuc

SEQ ID NO: 84584 - RNA, 64 nt, hsa
uauacauauuuuuagauaaaauuaaaugcucuuauuuuuccaacagcuaaacuacucuuaguug

SEQ ID NO: 84585 - RNA, 64 nt, hsa
uuaauuaaaacaaaaaaaaauucuuuuuuuuuuuuuuuuccaauuuuaccuucuuuaaaauagg

SEQ ID NO: 84586 - RNA, 64 nt, hsa
guucuuguuccgggacugcaggaaugucucgcaguuuuuccagaaaggaggagucaaggaagcc

SEQ ID NO: 84587 - RNA, 64 nt, hsa
uuuuguugauauaucaugaaaaugaacagaauucuuuuuccauacuuauaucuaagaaaaggca

SEQ ID NO: 84588 - RNA, 64 nt, hsa
augcuuucuaucacauuucuaagaugaguaauauuuuuuccaguagguuccacagagacaccuu

SEQ ID NO: 84589 - RNA, 64 nt, hsa
aucccuuuuuaaaaaagcuaaucuauaaauaccguuuuuccaaagguauuuuacaauauuucaa

SEQ ID NO: 84590 - RNA, 64 nt, hsa
aaggaaaccauacugaaaaccuuuccaagccucuuuuuuccauucccauuuuuguccucauaau

SEQ ID NO: 84591 - RNA, 64 nt, hsa
gccaggauuucuauuuuuaauauuuuugggaaaauuuuuccauaguaccugugccauuuuacau

SEQ ID NO: 84592 - RNA, 64 nt, hsa
gcauuuguguaucuggaaaaauauucaagucuuuuuuuuccauuuuuaaugggacuauuugcuu

SEQ ID NO: 84593 - RNA, 64 nt, hsa
ccugauauucuacuuauuuagaacaucuuuucauuuuuuccauuauucugauuggguaauuuua

SEQ ID NO: 84594 - RNA, 64 nt, hsa
uuuaaaaaacucaugagaagaguaaucuguuauguuuuuccagauauuuaccauuucuguugcu

SEQ ID NO: 84595 - RNA, 64 nt, hsa
augucugaagaagguaguaauauuccuuuuaaauuuuuuccaaccauugcuugauauaucacua

SEQ ID NO: 84596 - RNA, 64 nt, hsa
cguccggcugcugcccuucaacaacaagcccugauuuuuccagcaaugccagaaaccuggauuu

SEQ ID NO: 84597 - RNA, 64 nt, hsa
cagucaucacagacuuacgcacuuguuuggacaguuuuuccagaggggaugggaaagggccuug

SEQ ID NO: 84598 - RNA, 64 nt, hsa
auuuauuuuugacugggcagauaggggauuuuuuuuuuuccauguccgauucacacgcuacaca

SEQ ID NO: 84599 - RNA, 64 nt, hsa
aguuguucugacaacagcgcuguauacgcuucaguuuuuccacauuguccacggccagcacaug

SEQ ID NO: 84600 - RNA, 64 nt, hsa
uugaaaauccugagagcuaaaaaacugaaaggaauuuuuccacaccuugaagucacaguguuuu

SEQ ID NO: 84601 - RNA, 64 nt, hsa
uacacuguuaaaacccaaucuuggaaucaaauauuuuuuccaggggugagaauaaguauaaaca

SEQ ID NO: 84602 - RNA, 64 nt, hsa
auuugauuguuuuacucccaaugacugcacuauauguaugcauaagaccacuuuugagcgcugu

SEQ ID NO: 84603 - RNA, 64 nt, hsa
uaguguucugccauguaauguuuauagcugcugauguaugcacauuuggggguauaucuauuuc

SEQ ID NO: 84604 - RNA, 64 nt, hsa
aaggaauuucccuaagcaguugggaagaacaaauuguaugcauguaggcaaagauuuugaagau

SEQ ID NO: 84605 - RNA, 64 nt, hsa
aagaaaaaaaaacacaaaacagaauguuaaaaaauguaugcagauuuauggauauuaucaauga

SEQ ID NO: 84606 - RNA, 64 nt, hsa
caggaccuggccuggaugcugauugcacugucauuguaugcaagcauuuugucuuuuuucagaa

SEQ ID NO: 84607 - RNA, 64 nt, hsa
aaaugaauugcuccccagauuauuuuuuuaauauuguaugcaaucuuuauguguaacuccaaaa

SEQ ID NO: 84608 - RNA, 64 nt, hsa
cuaaagcacauuaaaaacaaauccugguuuuuaauguaugcauaguuucauauuuaaugaauau

SEQ ID NO: 84609 - RNA, 64 nt, hsa
aucuacaaagaugcgaaucagucaaggggaaauguguaugcaauguguguguauaugauguaug

SEQ ID NO: 84610 - RNA, 64 nt, hsa
uggcaacuuacugacccuuguuuuugccugugcuuguaugcaugcauuuucaagcaaguaauaa

SEQ ID NO: 84611 - RNA, 64 nt, hsa
agacugcuuaaauugauaagcuuugcuaaagaguuguaugcacaaaggaugauuaauucuggga

SEQ ID NO: 84612 - RNA, 64 nt, hsa
uauauauuuaaaagugucaagcugaguauuaaaauguaugcauguugucuaagaaauugaauac

SEQ ID NO: 84613 - RNA, 64 nt, hsa
uugaaauaagcuauuugauguaauacuucuuguguguaugcacaugaacuuagauuuuacauga

SEQ ID NO: 84614 - RNA, 64 nt, hsa
aaaugcaguggcaugcuaaguacccaaauaggaguguaugcagaggaugaaagauuaagauuau

SEQ ID NO: 84615 - RNA, 64 nt, hsa
aacauuaaauuauaauguuugacuauuauauauguguaugcauuuuacuggcucaaaacuaccu

SEQ ID NO: 84616 - RNA, 64 nt, hsa
uuaaauuaguccgguaggaugucaggugagacuguguaugcaaaaugaauggcacaggugaugc

SEQ ID NO: 84617 - RNA, 64 nt, hsa
uauaucuguagcauagaugacuuggaauaaaagcuguaugcaugggcauuaccccucagguccu

SEQ ID NO: 84618 - RNA, 64 nt, hsa
cugaaugucauguuuucuccucuggaacuucuuauguaugcaagcucccauguuaaccuaucau

SEQ ID NO: 84619 - RNA, 64 nt, hsa
uuuuguacgagaguuuguugcucuguaugacuccuguaugcauuguauauugcaauuuauuacu

SEQ ID NO: 84620 - RNA, 64 nt, hsa
uguguaugcagggcuaugcaccugcaggcacguguguaugcacuccccgcuuguguuuacacaa

SEQ ID NO: 84621 - RNA, 64 nt, hsa
ccuucauugaaaaccaccacggugccaucucuuguguaugcagggcuaugcaccugcaggcacg

SEQ ID NO: 84622 - RNA, 64 nt, hsa
caaguuuuaguauacaugccaugccagaagauaguguaugcaagaagucuugggaccagaaaau

SEQ ID NO: 84623 - RNA, 64 nt, hsa
aaaagucuaggaguuuuuuuguacuuagugaauuuguaugcaacagagaugcugcagcugaugc

SEQ ID NO: 84624 - RNA, 64 nt, hsa
aguguauauauguguguauaggcauauauacguguguaugcaucaacacaguauauguaaaacu

SEQ ID NO: 84625 - RNA, 64 nt, hsa
agaaaacaagacaguuguucauaaaguuucauuuuguaugcacugauggcaaauucauuagguc

SEQ ID NO: 84626 - RNA, 64 nt, hsa
agcuuauuuuggagagauaggaaggucauuuccauguaugcauaauaauccugcaaaguacagg

SEQ ID NO: 84627 - RNA, 64 nt, hsa
guugacauuuguuugguuauagugcaauauauuuuguaugcaagcaguuucaauaaaguuugau

SEQ ID NO: 84628 - RNA, 64 nt, hsa
uguaaacuguguaugcauauaaguauaugcuuuauguaugcauauguauguagauauguuuaua

SEQ ID NO: 84629 - RNA, 64 nt, hsa
guuuuucugaacacuggcugggaaauguaaacuguguaugcauauaaguauaugcuuuauguau

SEQ ID NO: 84630 - RNA, 64 nt, hsa
aaucaccgacacacuacuaguacuuuguuccuguuguaugcauucuccuagguagagccuccau

SEQ ID NO: 84631 - RNA, 64 nt, hsa
ucauucaauauuuucuguugaggaaagauaaaaauguaugcaauuccugaguguagaaacuucu

SEQ ID NO: 84632 - RNA, 64 nt, hsa
caaaauucugcuuucuucaacaucaaaaauuguguagaaauauuuucagugaaagggaauaacu

SEQ ID NO: 84633 - RNA, 64 nt, hsa
aaagcuauugugugaguauauugugcuaaaaucauagaaauaaagauuagauuucuucaucaaa

SEQ ID NO: 84634 - RNA, 64 nt, hsa
gaaaaauccugagcaaacaaaaccaccuggcccuuagaaauagcuuuaacuuugcuuaaacuac

SEQ ID NO: 84635 - RNA, 64 nt, hsa
cuuaacuuggaucauuucugguaaaugcuuauguuagaaauaagacaaccccagccaaucacaa

SEQ ID NO: 84636 - RNA, 64 nt, hsa
aaagccugugagucaagcaucaagugguguuuguuagaaauaaacuagagauuuuuaaacucug

SEQ ID NO: 84637 - RNA, 64 nt, hsa
agcugaucuaaaaaugaaagcaagauaucuuauguagaaauauuuugauaauauuuuuacagug

SEQ ID NO: 84638 - RNA, 64 nt, hsa
uuaaaauggugcauuauguauauauauuauaauuuagaaauaccauuuuauaauuuuacuauuc

SEQ ID NO: 84639 - RNA, 64 nt, hsa
uugccaauacuucuacauuugagaaggguuuuuuuagaaauacauuuaguaaaguccccaagac

SEQ ID NO: 84640 - RNA, 64 nt, hsa
aaauggcaucagauuuaaggauaauacuccaucauagaaauaagccuuaauaaccaguguugcc

SEQ ID NO: 84641 - RNA, 64 nt, hsa
gguugauuauugugguuguauuguucacuguguguagaaauaguaugaguacgauuucaauaga

SEQ ID NO: 84642 - RNA, 64 nt, hsa
ugugagcaguagaagagaccacauuuacagucaauagaaauaaugaaaaaaaauuagguguuua

SEQ ID NO: 84643 - RNA, 64 nt, hsa
aaaaccuuuauuuuaaagucaaguugugagcaaauagaaauaaaagacaaaaggacaucacucu

SEQ ID NO: 84644 - RNA, 64 nt, hsa
auuaaaauugcuaguuuaccguucagaaguauaauagaaauaaucuuuaguugcucuuuucuaa

SEQ ID NO: 84645 - RNA, 64 nt, hsa
uacucacuuuuuccaaaugauccuaguaauugccuagaaauaucuuucucuuaccuguuauuua

SEQ ID NO: 84646 - RNA, 64 nt, hsa
uuuaaucuaguggguuuuuuauuuuauuuuuucuuagaaauauguagguaagguuuaucuugaa

SEQ ID NO: 84647 - RNA, 64 nt, hsa
aaaguuauuaagguugguuuaaaaacaacugcauuagaaauaaugcguguuuggggggcagaau

SEQ ID NO: 84648 - RNA, 64 nt, hsa
gaguuaucuguacuuuguuuaacugaaaaaaauguagaaauauauguaaagaauuuaagacaag

SEQ ID NO: 84649 - RNA, 64 nt, hsa
uacuuugaguuuuguuucguaucauguccuaugcuagaaauauuuaaaugaugugaaacaaagc

SEQ ID NO: 84650 - RNA, 64 nt, hsa
aguggaaucuucugagcauuccuaaauaucugcuuagaaauaucaugugauaaagagggaccuu

SEQ ID NO: 84651 - RNA, 64 nt, hsa
aauugucaaaugaaguauaaacacaugaacuuucuagaaauauuuccucuuuuggauaggucuu

SEQ ID NO: 84652 - RNA, 64 nt, hsa
ugugauuuaaaacguuuguugagauuuucaaacauagaaauaaagcuguagcauauucacuaaa

SEQ ID NO: 84653 - RNA, 64 nt, hsa
ugccuguuuuguaauucagggccuauuaugauuuuagaaauaagauaaucaacguacaacucuu

SEQ ID NO: 84654 - RNA, 64 nt, hsa
cccccaucuacuauaaagaaaugucuucgagauguagaaauaaggaauauucugaaaauaaaaa

SEQ ID NO: 84655 - RNA, 64 nt, hsa
gcugcaggagugcccugcauuguuuucuuuuaauuagaaauaaaaaguauuagucuaaaugugg

SEQ ID NO: 84656 - RNA, 64 nt, hsa
uauuugaugaaagaaaauccaaauaaagcccaccuagaaauagauauuuuauuauauaugugcu

SEQ ID NO: 84657 - RNA, 64 nt, hsa
uuccaguucuuugauauuccccuuguuauucaaauagaaauauggaaaugcuuuauauauuacu

SEQ ID NO: 84658 - RNA, 64 nt, hsa
uuuuagcuguauuuguagcaauuaucagguuugcuagaaauauaacuuuuaauacaguagccug

SEQ ID NO: 84659 - RNA, 64 nt, hsa
uucaacauuuuacaacugcaguauucaccuaaaguagaaauaaucuguuacuuauuguaaauac

SEQ ID NO: 84660 - RNA, 64 nt, hsa
uguuucagcauguaauuuuaacuuuuguggaaaauagaaauaccuucauuuugaaagaaguuuu

SEQ ID NO: 84661 - RNA, 64 nt, hsa
uucagagguaauaugcuccaccuacacacaauuuuagaaauaaauuaaaaauuaaauaaaacua

SEQ ID NO: 84662 - RNA, 64 nt, hsa
gggcauuucugccuuuuuuuuucuaaacgacaaauagaaauacaucuucuuuauuauccuccaa

SEQ ID NO: 84663 - RNA, 64 nt, hsa
uuaaagaaaauagucacaauacagaaaagcauuuuagaaauagcuucaaaagcacuuguguauc

SEQ ID NO: 84664 - RNA, 64 nt, hsa
ccuggugaucacaaagauaauguucuacuucugauagaaauaauuucucaacaaauguuguuac

SEQ ID NO: 84665 - RNA, 64 nt, hsa
gaaugugguauucauucacuuaaagguaccucuguagaaauaaccuaaaacugcagaaggaucu

SEQ ID NO: 84666 - RNA, 64 nt, hsa
auucaaauaccaaauaguuuacauagggccagcuuagaaauagauacuaaauccagagcuacug

SEQ ID NO: 84667 - RNA, 64 nt, hsa
uggagggauuuugugaugcagaauaucuaagucauagaaauagaagacagguggaauaaguaua

SEQ ID NO: 84668 - RNA, 64 nt, hsa
accauguaccaggaauagcuuuacuuuccauacauagaaauauaaauuuagugguauccuauau

SEQ ID NO: 84669 - RNA, 64 nt, hsa
uacuucauucuuuucugaaguuguguguugcugcuagaaauagucauuugugaauuauccaaau

SEQ ID NO: 84670 - RNA, 64 nt, hsa
uuuaaacaucaaauaauugaagagacaauagcauuagaaauaagugauuaaaggccucugccuc

SEQ ID NO: 84671 - RNA, 64 nt, hsa
agagugaggauggauuuagaaaaaaacaugaauuuagaaauauucaaaaugguuuuuguggcag

SEQ ID NO: 84672 - RNA, 64 nt, hsa
cagaggaguggaucuguagaagucugucuuucuauagaaauauugugcuuacucaaguguuaaa

SEQ ID NO: 84673 - RNA, 64 nt, hsa
gugucugcucuuacauuauuguggagcccugugauagaaauauguaaaaucucauauuauuuuu

SEQ ID NO: 84674 - RNA, 64 nt, hsa
uugugggagaugguugauuuagguuuucaaaagcuagaaauaaaauuuacaugccuuagauuuc

SEQ ID NO: 84675 - RNA, 64 nt, hsa
accucacugucucgucugucuaugugacauuaaguagaaauauugguuuuuuuuuuuuuuuuuu

SEQ ID NO: 84676 - RNA, 64 nt, hsa
auccuacguuacaacaauaauaucaugggagaaauagaaauagccuaguuugcuuccaauagaa

SEQ ID NO: 84677 - RNA, 64 nt, hsa
uauuuuuucuuucuguacagaaauagaaaagcauuagaaauaacuucuaaccauccucugaaaa

SEQ ID NO: 84678 - RNA, 64 nt, hsa
gcugggauggcucucucaucauacucuuguuucuuagaaauaagcaagacagagcaggaaaugg

SEQ ID NO: 84679 - RNA, 64 nt, hsa
cuagaggcaugaaaguuaaauguauauauuaugguagaaauaauauugaaggauauuguacuuc

SEQ ID NO: 84680 - RNA, 64 nt, hsa
auauagagcacaguaaauaaguuuuuucauuguguagaaauacuuagaugucaaaaccagauuu

SEQ ID NO: 84681 - RNA, 64 nt, hsa
augccacccaucugauuccucaagaaucuagaccuagaaauaccauuugacccagccaucccau

SEQ ID NO: 84682 - RNA, 64 nt, hsa
aggcgccaacagcacacagggucagggucacuucuagaaauagcccaccaaggcuauucagauu

SEQ ID NO: 84683 - RNA, 64 nt, hsa
uuacacuauaauauaaaaccugauauauacacauuagaaauauuccaguucuccguaacagugu

SEQ ID NO: 84684 - RNA, 64 nt, hsa
gucuuuuuuuuucuucauuguaaucugcaaaauguagaaauaaauuacuuaaggcaguauccuu

SEQ ID NO: 84685 - RNA, 64 nt, hsa
uguuuuuguuagguacagucuggaucauggcauguagaaauagaaauuuagaauuuuacugcag

SEQ ID NO: 84686 - RNA, 64 nt, hsa
gaccuuaauuuaaaacuuucaauggagauagggcuagaaauacuuuugccaaauagcauucuua

SEQ ID NO: 84687 - RNA, 64 nt, hsa
ugguguagguguuacgcgaagggcgcacagugucuagaaauacuugaucguggcucaaaccuga

SEQ ID NO: 84688 - RNA, 64 nt, hsa
uuccagaaguaaaagucccagugauguauucccauagaaauauuuuucaguuguuuaugucguu

SEQ ID NO: 84689 - RNA, 64 nt, hsa
aaaaggguaaaacaugacuauacagaaauuuaaauagaaauaguguauauacauauaaaauaca

SEQ ID NO: 84690 - RNA, 64 nt, hsa
uuccugguaguauaagucaccuaaaaaagacuucuagaaauauguacuuuaauuauuuguuuuu

SEQ ID NO: 84691 - RNA, 64 nt, hsa
aauaaauauggagcugggguuuaacacuaaaaacuagaaauaaacaucucaaacaguaagaguu

SEQ ID NO: 84692 - RNA, 64 nt, hsa
cuuguguccuuugaauucucgcccugccagcuccuagaaauaguuucaaucuuggaaucagaug

SEQ ID NO: 84693 - RNA, 64 nt, hsa
acaugauugaagccuuuggcugaaacuuuauacauagaaauaaugauuugcucauaacagguau

SEQ ID NO: 84694 - RNA, 64 nt, hsa
auuuuaugaaaauuaaguacagaggcugcgaucuuagaaauaaugaaggugccauuuggcugcu

SEQ ID NO: 84695 - RNA, 64 nt, hsa
ugcacagaaaaucauuuauauuugagaaaaauuguagaaauauagacugugaaaaagacgucaa

SEQ ID NO: 84696 - RNA, 64 nt, hsa
ccaaauuugucuauguaaauaccagaauuuauaguagaaauauaugaggaagcgacacuucgaa

SEQ ID NO: 84697 - RNA, 64 nt, hsa
uuucugcuucugaaugauucaauguugggagcaauagaaauaacauucccuuugccuucucuga

SEQ ID NO: 84698 - RNA, 64 nt, hsa
uaagagagacagagaccaagaacuugcccaauuuuagaaauacacuaaugugcaguuguugccu

SEQ ID NO: 84699 - RNA, 64 nt, hsa
uuaaaauaaagaaaaugcagcaaaaagaaugcuauagaaauauuuggugguuuuuuuuuuuuuu

SEQ ID NO: 84700 - RNA, 64 nt, hsa
ucaaaaaaguuaaauaccuaaguagaaaaaaauauagaaauaaagccaagaaucucuuucaguu

SEQ ID NO: 84701 - RNA, 64 nt, hsa
ccaaguaaagcauaaggucauauauacuauacaauauguuuauugcacuucccauggggauaaa

SEQ ID NO: 84702 - RNA, 64 nt, hsa
guuucuagguguugauauacuuuaauaaaaaugauauguuuaauauuuucccauuaauauauuu

SEQ ID NO: 84703 - RNA, 64 nt, hsa
aucauuauuauuuuauuuagacuugacuaucucuuauguuuauuaaagaacauguuuuccuauu

SEQ ID NO: 84704 - RNA, 64 nt, hsa
gguuuuggggggccaguaguucagugagaauguuuauguuuacaacuagccuucccaguaaaaa

SEQ ID NO: 84705 - RNA, 64 nt, hsa
uuguaagaacugauugcucuccugugaguuaagcuauguuuacuacugggacccucaagaggaa

SEQ ID NO: 84706 - RNA, 64 nt, hsa
cacagugaguucuguuuauuuuuuguagguucauuauguuuauguucuuuaagauguauauaag

SEQ ID NO: 84707 - RNA, 64 nt, hsa
guuuucuuacuuagugcuuuaaaauguuuuuuuuuauguuuaagaggggcaguuauaaauggac

SEQ ID NO: 84708 - RNA, 64 nt, hsa
agucaguagauguuuuauuuuuuagcuauucaguuauguuuauaaguuugcauagcuacuucuc

SEQ ID NO: 84709 - RNA, 64 nt, hsa
acuuuuuauauuaccuauuaguuuuggaguucuuuauguuuaaaaauucagguguaaauuuuau

SEQ ID NO: 84710 - RNA, 64 nt, hsa
cauaaacuuagaauucuguaucucaugucagaaauauguuuauggccuugcuuuuaaguggugc

SEQ ID NO: 84711 - RNA, 64 nt, hsa
uuguuaauguaaauaguuggugcuuacuuucauuuauguuuauuaucuuaaagcaauugauaga

SEQ ID NO: 84712 - RNA, 64 nt, hsa
aauagaaacuuuaauaaugauaguuuuuaacuuuuauguuuaaauuuuuuuuaaaucuuaaaac

SEQ ID NO: 84713 - RNA, 64 nt, hsa
caauucguaaaaaccuuaagugauacuuuguuuauauguuuauaauuuuuagguguuuccugaa

SEQ ID NO: 84714 - RNA, 64 nt, hsa
uuggaccagcuaagcgacagggaaccugguacauuauguuuaguuacuguuuucuucucaaagu

SEQ ID NO: 84715 - RNA, 64 nt, hsa
aaaagagguuuguuuaagaaagcaguagguacauuauguuuacuagacaggcccuuggaccagc

SEQ ID NO: 84716 - RNA, 64 nt, hsa
uauuuuuauuauucaugaauuaaauuacuaaaaguauguuuauacugugaauuaauauaaugua

SEQ ID NO: 84717 - RNA, 64 nt, hsa
uauucuuacaguacuuguuuuuaguugucaugccuauguuuagaccauaucuuaauguauucac

SEQ ID NO: 84718 - RNA, 64 nt, hsa
auauauuuuugacacaauuaaauauuacauagaguauguuuacaacaaauauccugucagccaa

SEQ ID NO: 84719 - RNA, 64 nt, hsa
uaauugauacuguguuuuuaugcccaaaucccaguauguuuauguaccaauaaugacucuuacc

SEQ ID NO: 84720 - RNA, 64 nt, hsa
uuauuguuuuuauuucuagccauaccucagauaauauguuuaguuuuacauuuuaaaauguuua

SEQ ID NO: 84721 - RNA, 64 nt, hsa
cuccagacuaacaugucaguuuuaucaauuauauuauguuuaauuauuuaagauuucuuuaugu

SEQ ID NO: 84722 - RNA, 64 nt, hsa
gaagugaaauuuaaccuuuuuuucucuuuaguauuauguuuauaaugccauauuuuuagaaagc

SEQ ID NO: 84723 - RNA, 64 nt, hsa
ggguuccuuuuuuuuuaauguuuacauuuaucucuauguuuaccuuuuuagucacauugaccug

SEQ ID NO: 84724 - RNA, 64 nt, hsa
uaacagaugugaucuauuuaguaugugucuacucuauguuuaugcauaagaaaacauccauagc

SEQ ID NO: 84725 - RNA, 64 nt, hsa
auugcccugaucacaaacaaaagccugaauguacuauguuuaaaagacaaaccaaaaauuaacc

SEQ ID NO: 84726 - RNA, 64 nt, hsa
cuaaggauaacccagaaacaugggguguccuagguauguuuaucucgacacugaacccccuagg

SEQ ID NO: 84727 - RNA, 64 nt, hsa
ggcacuauuauauaauaccuuugagaucuuuguuuauguuuauuagaagaggguaauggaaacu

SEQ ID NO: 84728 - RNA, 64 nt, hsa
cuuuccgaaaugaccacauugugcuuuuaguuuguauguuuaaguggucaagcaaggcucuagg

SEQ ID NO: 84729 - RNA, 64 nt, hsa
auuuggggacaauuuuauguaucuguguuaaggauauguuuaagaacauaauucuuuuguugcu

SEQ ID NO: 84730 - RNA, 64 nt, hsa
gucuuugauuugauuucccuaguaaccuugcagauauguuuaaccaagccauagcccaugccuu

SEQ ID NO: 84731 - RNA, 64 nt, hsa
aagugaagugccuacugauauuacuaaaguacauuauguuuacucaaguaaauaauuuucuccc

SEQ ID NO: 84732 - RNA, 64 nt, hsa
agaaagcauuucauuuuauuugccuauguucaaauauguuuaauaaugaccaaagugcauucug

SEQ ID NO: 84733 - RNA, 64 nt, hsa
ggaauaacauuagcaggcugauguccugcaccauuauguuuacuaaucacauguucugugugcu

SEQ ID NO: 84734 - RNA, 64 nt, hsa
auuuguugacacucgugcuguuaagagauuuguuuauguuuauauuauacucaaaaacaauuuc

SEQ ID NO: 84735 - RNA, 64 nt, hsa
uaaauuauaauauugcugcuuuguauaacucuucuauguuuauucuauucauuuguuccuuucc

SEQ ID NO: 84736 - RNA, 64 nt, hsa
acgaauuauuaauuggccauguucauuauuuaucuauguuuauuaaugggccaaugcaaaaaau

SEQ ID NO: 84737 - RNA, 64 nt, hsa
ccuuaaaauaucccccuaccuggguccucagugcuauguuuaaagugcugcagggauggagugg

SEQ ID NO: 84738 - RNA, 64 nt, hsa
gaugcugaaggcaaggggagggagcagaagcacuuauguuuacggauauuuuaaacucuguuag

SEQ ID NO: 84739 - RNA, 64 nt, hsa
gguguaaaaacauuuuugagauaagguuuuuauuuauguuuauuauuguuagagugaguugcaa

SEQ ID NO: 84740 - RNA, 64 nt, hsa
ggucugacaguauuuuguuaaggauauuuguuuguauguuuauucaguauacuuacauaaaaau

SEQ ID NO: 84741 - RNA, 64 nt, hsa
aguaucuugcacugauaaauauauuuaaaaauuauauguuuauaaaguuauuaauuuguaaagg

SEQ ID NO: 84742 - RNA, 64 nt, hsa
ccugcugggaauggcaaacgauuuuacuagacuuuauguuuaaaaauaaauaaauaagggaaau

SEQ ID NO: 84743 - RNA, 64 nt, hsa
cacucagcaagugaauuaaucugauucacaggauuauguuuaaucgccaaaaacacacuggcca

SEQ ID NO: 84744 - RNA, 64 nt, hsa
augcagauaagugccgaauucaaacccuucauuuuauguuuaagcuccugaaucugcauuccac

SEQ ID NO: 84745 - RNA, 64 nt, hsa
caucaggacaacuuugagaaaaucaguccuuuuuuauguuuaaauuauguaucuauuguaaccu

SEQ ID NO: 84746 - RNA, 64 nt, hsa
uagcuacaguuaguuauuaaaucuucugauaauauauguuuacuuagcuaucagaagccaagua

SEQ ID NO: 84747 - RNA, 64 nt, hsa
aaagcccuucuucuuuccaccacaaauuaaucacuauguuuauaagguaguaucagaauuuuuu

SEQ ID NO: 84748 - RNA, 64 nt, hsa
uauaguccacugcauucuuauaaguucuaaauuuuauguuuauuauaaugcauuucuuguggaa

SEQ ID NO: 84749 - RNA, 64 nt, hsa
uacauucuuauacaauaaaaaggacacauuuguguauguuuaaaauuacuuaugcagauaccgu

SEQ ID NO: 84750 - RNA, 64 nt, hsa
uaugguaaauuuuuuguuaaauaaaauagacccuuauguuuagcauuuuguuuuuagagaacua

SEQ ID NO: 84751 - RNA, 64 nt, hsa
gccaauuugguccuuuaauaaguaaagaaaauaauauguuuaaaaauguaaauguuuuacaaau

SEQ ID NO: 84752 - RNA, 64 nt, hsa
uucacuuuuaccuuuaaaguuuacuuguagcaaauauguuuacauugauaaagccagauauguu

SEQ ID NO: 84753 - RNA, 64 nt, hsa
ugguucuagaaauuugaagucuuuauaacuuaauuauguuuaauaaaaaauagagucugccucg

SEQ ID NO: 84754 - RNA, 64 nt, hsa
uuuauuuuauauuguacaugaaaaguuuuaaagauauguuuaagaccaagacuauuaaaaugau

SEQ ID NO: 84755 - RNA, 64 nt, hsa
uuucuuuugcaugcauuuuuccccuguuuggugcuauguuuauguauuaugcuugaaauuuuaa

SEQ ID NO: 84756 - RNA, 64 nt, hsa
gauuuuguguuuuacuugaccaaaaccaaguguauauguuuacauguuuuuauccuguuuagcu

SEQ ID NO: 84757 - RNA, 64 nt, hsa
auauauaaaagaauauacaucacaauauaauauuuauguuuauguaauaaaguaaauacagagc

SEQ ID NO: 84758 - RNA, 64 nt, hsa
cuuccccuuuaaacuaauauucauaauugguucauauguuuaaaagacuuuaauuuacaaauua

SEQ ID NO: 84759 - RNA, 64 nt, hsa
ggguguuugugguuaucuuaccuggggaaguucuuauguuuaucuugcuuuucaugugucuuuc

SEQ ID NO: 84760 - RNA, 64 nt, hsa
cccauuaaaagaaaacgugccuucuguauaaguuuauguuuauuccuacauuuuauucauuuuu

SEQ ID NO: 84761 - RNA, 64 nt, hsa
uuauuauuuaaaucacuucaguuagcuuucaguguauguuuaauaauauacauuuaaugaugaa

SEQ ID NO: 84762 - RNA, 64 nt, hsa
gaauaguucuauacaaaugaaguauggagguguguauguuuauauguauauaacaaaauauuuu

SEQ ID NO: 84763 - RNA, 64 nt, hsa
ggagaaaguguauuuguguauauguguguauacauauguuuaucucacacacauuaugagcuug

SEQ ID NO: 84764 - RNA, 64 nt, hsa
uguacacuuuuuacagcagcaauauuuuguauauuauguuuauuucauguggugaauaugcaag

SEQ ID NO: 84765 - RNA, 64 nt, hsa
gacuguuacagacugaaaggugugaacagcuuuguauguuuaugaaggguaagggaauuuaaua

SEQ ID NO: 84766 - RNA, 64 nt, hsa
uggugcuauuauucuauucugcaaauacacugaauauguuuauuaguuccaguuguauuuuggu

SEQ ID NO: 84767 - RNA, 64 nt, hsa
uuguagauuucaagguacaaacuucucaccuuuauauguuuauuccuaaauauuucuuacuuua

SEQ ID NO: 84768 - RNA, 64 nt, hsa
uuauacacuuuuuaaaaucucaaacuucuauuuuuauguuuaacguuuucauuaaaauuuuuuu

SEQ ID NO: 84769 - RNA, 64 nt, hsa
aggcugaaagaugacggaugccuagaguuuaccuuauguuuaauuaaaaucaguauuugucuau

SEQ ID NO: 84770 - RNA, 64 nt, hsa
aaaguaaaaacuacaugauuuauuuucgggcaauuauguuuagcuuucaucauuauacuccaac

SEQ ID NO: 84771 - RNA, 64 nt, hsa
ucauuccucauauuucauugguauuuguggagccuauguuuaauguugccacguguuuuuaugu

SEQ ID NO: 84772 - RNA, 64 nt, hsa
uaaauguuccuugaaguauuuauuuauguuuauauauguuuauauauguucuucauaaaucuau

SEQ ID NO: 84773 - RNA, 64 nt, hsa
aaaucuauccuaaauguuccuugaaguauuuauuuauguuuauauauguuuauauauguucuuc

SEQ ID NO: 84774 - RNA, 64 nt, hsa
aaauguuauuuguguuagcauguaauggguuuacuauguuuaaauaaguuaauacuuuaaaaau

SEQ ID NO: 84775 - RNA, 64 nt, hsa
ugguuuacauuaaauuaugguauuuaacuauuuuuauguuuauacuagguagggucuuucuuau

SEQ ID NO: 84776 - RNA, 64 nt, hsa
caugaaacacaaauguccucaacugucaucauucuauguuuacuuucucccaaucacaucaccu

SEQ ID NO: 84777 - RNA, 64 nt, hsa
aucucaccacagugaauuauggguaaggugauaauauguuuaauuagcuugauuuaaucauccc

SEQ ID NO: 84778 - RNA, 64 nt, hsa
gucuacacagacgccuacagaaaguuucaggaagaggcaagaugcauucaauuugaaagauauu

SEQ ID NO: 84779 - RNA, 64 nt, hsa
uggggguggagggugccacagggaaagcuguagaaggcaagaagacucgagaaucccccagagu

SEQ ID NO: 84780 - RNA, 64 nt, hsa
aaauaaaaauuaaaaaaaaauuauuaggcugcagaggcaagaggauccccugagcccagaaguu

SEQ ID NO: 84781 - RNA, 64 nt, hsa
ugaagccacaaguuugagaccagccugguuagcaaggcaagauccccaacucuacaaaaaaaua

SEQ ID NO: 84782 - RNA, 64 nt, hsa
caucauuuuucaaccaucacaguaaauauggcucaggcaagaauuaucaaucaaugcuaaagcu

SEQ ID NO: 84783 - RNA, 64 nt, hsa
uggaaaaacaaauauacaaauaugaaaugagggaaggcaagaaagaaccauguggaaauggaau

SEQ ID NO: 84784 - RNA, 64 nt, hsa
cauacuuuccuucgcugucccucccgcacuccuuaggcaagauuucccaguaaagauuuucugu

SEQ ID NO: 84785 - RNA, 64 nt, hsa
auuuccagaggaaagcuagaggaucuaguucaagaggcaagaagaucuggcccucaauuagcua

SEQ ID NO: 84786 - RNA, 64 nt, hsa
ucuuucccccucccugcugaagcaugugguacagaggcaagagcagagccugagaagcgucagg

SEQ ID NO: 84787 - RNA, 64 nt, hsa
uuuucccagguagugggagagaggaaaggagggaaggcaagauucuuucccccucccugcugaa

SEQ ID NO: 84788 - RNA, 64 nt, hsa
uucccccgccccucaguuaccuggggaagaguaaaggcaagaauucuuaccagcauuagucaua

SEQ ID NO: 84789 - RNA, 64 nt, hsa
cuuauauuaacacguuuuacauauaaagaaauggaggcaagaaagcauuuccuuugggguuuag

SEQ ID NO: 84790 - RNA, 64 nt, hsa
gggcccagucagcccugcugcucagagugcaggcauugcacauggugugagaaggucuacaccu

SEQ ID NO: 84791 - RNA, 64 nt, hsa
gggcccagucagcccugcugcacauggcacaggcauugcacacggugugaggaguguacaccug

SEQ ID NO: 84792 - RNA, 64 nt, hsa
ccugggcucaguccuagcugcauggggugcaggcauugcacagagcaugaaugggccuacaccu

SEQ ID NO: 84793 - RNA, 64 nt, hsa
gggcucgaccagcccagcugcgugggguacaggcauugcacacagugugaaugggucuacaccu

SEQ ID NO: 84794 - RNA, 64 nt, hsa
aggcccugccagcccugcugcacagggugcaggcauugcacacggugugaagggucuacaccug

SEQ ID NO: 84795 - RNA, 64 nt, hsa
uugcuacccaagagaaaaugcuacaguuuuauagauugcacaucauucuuuaaggcauacuuuu

SEQ ID NO: 84796 - RNA, 64 nt, hsa
auuaaauacuagauugggaaccucauucagccguauugcacagaugagcaauuacagcagagaa

SEQ ID NO: 84797 - RNA, 64 nt, hsa
uuggauucuuguuacaguguauccaaucugaaguauugcacaucugaacugggacuguuaacac

SEQ ID NO: 84798 - RNA, 64 nt, hsa
uuuaaguuuuucuuccuuuuuucccucuguuuauauugcacaucaagucaaaaacauguuuggg

SEQ ID NO: 84799 - RNA, 64 nt, hsa
ucugacauuguuuuccaaagacacacuaaacugcauugcacaguucaaaauuugauuacuuaag

SEQ ID NO: 84800 - RNA, 64 nt, hsa
aaacuaguccaguuuaauuuuuuguacuuagaauauugcacauuuucuauauaugaguuauuca

SEQ ID NO: 84801 - RNA, 64 nt, hsa
acauuuuuacaguguuuucuuaucaauuugcuauauugcacagaaucagugugugucuuuucau

SEQ ID NO: 84802 - RNA, 64 nt, hsa
uucuauuaaagaugaggcagacucgcuuauuugaauugcacaauguucuaacaaggauguaaca

SEQ ID NO: 84803 - RNA, 64 nt, hsa
cccauuuuauagcuggggaaacaggcuccgagaaauugcacaaccgaccucagguggccggcag

SEQ ID NO: 84804 - RNA, 64 nt, hsa
cgagcccccaccccucccugggcccccaagugagauugcacauuuaacuacuguaaggagagga

SEQ ID NO: 84805 - RNA, 64 nt, hsa
cuaguagaucuauauuagaucaaauaguugcauagcaguauauguuaauuuguguguuuuuagc

SEQ ID NO: 84806 - RNA, 64 nt, hsa
aauagugugaaauauauuacuuaacuguccguaagcaguauauuaguauuaucuuguucaggaa

SEQ ID NO: 84807 - RNA, 64 nt, hsa
cagugcccuuugcaauuaccuuuuugaugauuaaggugacuauuuuuauuucuuguuaagcauc

SEQ ID NO: 84808 - RNA, 64 nt, hsa
uuaagaagucuugccucaguuauuucaguuuucaggugacuagagaauuucaggcaacagugcc

SEQ ID NO: 84809 - RNA, 64 nt, hsa
uuuuuuuuuucuuacuccaaaauaaaucaaggcugcaaugcagcuggugcuguucagauucuac

SEQ ID NO: 84810 - RNA, 64 nt, hsa
cuugggggugggggaguuucccuuuucuaaaaaugcaaugcacuaaaacuauuuuaagaaugua

SEQ ID NO: 84811 - RNA, 64 nt, hsa
gauuaacaacagcaagaaaacaccugcugcugaugcaaugcaaugcaucccaaugguugugggg

SEQ ID NO: 84812 - RNA, 64 nt, hsa
acaacagcaagaaaacaccugcugcugaugcaaugcaaugcaucccaaugguuguggggauugu

SEQ ID NO: 84813 - RNA, 64 nt, hsa
uaguacagucaaauuggggucuucgaccucaaaaaauacauaaugacauaauuuaguuucaugu

SEQ ID NO: 84814 - RNA, 64 nt, hsa
aauuuaguuucauguaaugaaacuuuguaaacagaauacauacauguguauauguaaagaauuu

SEQ ID NO: 84815 - RNA, 64 nt, hsa
uacuagugacuuucuggaacaauuuccuuucaggaauacauauucacugcuuagaggugaccuu

SEQ ID NO: 84816 - RNA, 64 nt, hsa
ugcugauuuucccaaaacaugacccauaguauuaaauacauaucauuuuuaaaaauaaaaaaaa

SEQ ID NO: 84817 - RNA, 64 nt, hsa
auuugacauugaguuuaauucagcaacaacaaaaaauacauauaaaacuagaaagggacuuuuu

SEQ ID NO: 84818 - RNA, 64 nt, hsa
aaauguuccuguaaaagaaacauugguaaauuuaaauacauacuguucuaauuuuguauuuuuu

SEQ ID NO: 84819 - RNA, 64 nt, hsa
uccaguuuggaauuacuuauuaaggagaauuggaaauacauaugcccaugcuuaaauuuuauag

SEQ ID NO: 84820 - RNA, 64 nt, hsa
uuuuauaaacucaaauuggcaccuacugaauuaaaauacauaaaaucauuuaaauauaauucag

SEQ ID NO: 84821 - RNA, 64 nt, hsa
ggggccugccugugagaaacagugggucccuucaaauacauaguggauagcucaucccuaggaa

SEQ ID NO: 84822 - RNA, 64 nt, hsa
aggaagagugugugugucuacacaggauaaacccaauacauauuguacugcucagugauuaaau

SEQ ID NO: 84823 - RNA, 64 nt, hsa
ugauaaacauuuaacuuguuuccaauguuuagcaaauacauauuuuauagaacuuccaucugug

SEQ ID NO: 84824 - RNA, 64 nt, hsa
ggaagcuuccaguccaaucucauggagaagcagaaauacauauuuccaagaaguuggaugggug

SEQ ID NO: 84825 - RNA, 64 nt, hsa
ggcacugggaaaaguggaaacaaacauguauugaaauacauauuggaaauaaaaaugguuugag

SEQ ID NO: 84826 - RNA, 64 nt, hsa
aacuuugaggcgugauuucauucauugaagaaucaauacauauuuuguuucaaaauguuugaaa

SEQ ID NO: 84827 - RNA, 64 nt, hsa
ucaagacgacaugagcagcucaccauaugauaaaaauacauaaauuugacauucccucuuccau

SEQ ID NO: 84828 - RNA, 64 nt, hsa
caugaggaaaagaaugcagagagggugcaagcagaauacauacccuaaguccauaauuguguuu

SEQ ID NO: 84829 - RNA, 64 nt, hsa
aacuucuuuuaaaacaauauccacacacugcaucaauacauaacuuuaggucuaagucuugcua

SEQ ID NO: 84830 - RNA, 64 nt, hsa
ggaacuagccagauggccauuauuuuguauuuuaaauacauaaauaggauugaaucaacuagaa

SEQ ID NO: 84831 - RNA, 64 nt, hsa
uucaaaauuaauuuuuuauuaauucaugaugauaaauacauaguauuccucaguaucuauucca

SEQ ID NO: 84832 - RNA, 64 nt, hsa
uguaaacccaaguaaguucuaaaaaaaaguaaaaaauacauagaauacuugagaauuuagcagg

SEQ ID NO: 84833 - RNA, 64 nt, hsa
ucuaugauucauguuuuaaagauggaauaauuuuaauacauauuuuguuuaaauauaaucuaua

SEQ ID NO: 84834 - RNA, 64 nt, hsa
ucccagauauuuauguuugaacauaauggcucagaauacauauuugaacaucauaguuguauau

SEQ ID NO: 84835 - RNA, 64 nt, hsa
uauacucaacuggauauguguauguaaauuagaaaauacauaccuauccagacauaaaugcuaa

SEQ ID NO: 84836 - RNA, 64 nt, hsa
cacacauucuauucaucgugggaaccauggugucaauacauaucauguagcuucugaaaaacuc

SEQ ID NO: 84837 - RNA, 64 nt, hsa
agaacuuaaaagugagaaaaauuuaaaacacgagaauacauaggcacacauucuauucaucgug

SEQ ID NO: 84838 - RNA, 64 nt, hsa
cugaaauuauauuuaaaauauauuugagacaugaaauacauacugauaauacauaccucaugaa

SEQ ID NO: 84839 - RNA, 64 nt, hsa
uaaaauauauuugagacaugaaauacauacugauaauacauaccucaugaaagauuuuauucuu

SEQ ID NO: 84840 - RNA, 64 nt, hsa
uaugcgauacagacagcuaacuuuucuuaugaaaaauacauauuugcauguaaacaaugauuuc

SEQ ID NO: 84841 - RNA, 64 nt, hsa
cuguucugguuauaaaccuugcuaaugaaaauacaauacauauaaaaauguauagccauguuau

SEQ ID NO: 84842 - RNA, 64 nt, hsa
aguuuucugcuuuuuaaauacaaaaauacauaaaaauacauaaaaucugaugaugaauauaaaa

SEQ ID NO: 84843 - RNA, 64 nt, hsa
cucauaggaaaguuuucugcuuuuuaaauacaaaaauacauaaaaauacauaaaaucugaugau

SEQ ID NO: 84844 - RNA, 64 nt, hsa
aacucaaaacuugucucucaagcuuguucuuuaaaauacauagacaaagcuguaaauuuaaaga

SEQ ID NO: 84845 - RNA, 64 nt, hsa
uuuuuuaacuuugaacaucaauacauuuuacuugaauacauauaguccuuaguugcauaaggca

SEQ ID NO: 84846 - RNA, 64 nt, hsa
gacuucuugugaaauuucuguacuuuguauauaaaauacauaaaacaauagauuagaaaucaaa

SEQ ID NO: 84847 - RNA, 64 nt, hsa
ccuuaaaucuuaauguuccucaaagcuuggauuaaauacauauggauguuacucucuugcacca

SEQ ID NO: 84848 - RNA, 64 nt, hsa
ccaaccaacauggugaaacccugucuccacugaaaauacauaaaauuagccgggugcaguggug

SEQ ID NO: 84849 - RNA, 64 nt, hsa
gccugcaugacgggagugagacaccaucucaaaaaauacauauaauaauauaaauaaaaauauc

SEQ ID NO: 84850 - RNA, 64 nt, hsa
caguauuauuuagugugguuuccaugacaacaaaaauacauacgaagaaaacuucucagguuac

SEQ ID NO: 84851 - RNA, 64 nt, hsa
gaggauucugauauuuggcauacuuguaaaaacaaauacauaaguaaccauugaacauuaauuu

SEQ ID NO: 84852 - RNA, 64 nt, hsa
gaggacaaaaauuacaucuuaagcuaauuccuuaaauacauacaguaggugaauuuucaggaca

SEQ ID NO: 84853 - RNA, 64 nt, hsa
ugcugcuauuuucuguccuauuuugagaaauauaaauacauagaaauggugcaucuuaacauuu

SEQ ID NO: 84854 - RNA, 64 nt, hsa
ggcugaagaacaacagaagagagucaggauaaaaaauacauacuguggucggcaaggugaggga

SEQ ID NO: 84855 - RNA, 64 nt, hsa
aaaaagcauuaauugcacagcuaccauccacacaaauacauaguuuuucugacuucacauuuau

SEQ ID NO: 84856 - RNA, 64 nt, hsa
ugggcagaauggugaaaccaccuucucuacaaaaaauacauaaauuagcugggcauuguggcac

SEQ ID NO: 84857 - RNA, 64 nt, hsa
cuaguacaaggggucuucaggaaguucauggaaaaauacauauuaugagaaaauugugcaugau

SEQ ID NO: 84858 - RNA, 64 nt, hsa
acuaguugaaaaaagucucugaacaauucucucuaauacauauuuucugcaaaugggagcaugg

SEQ ID NO: 84859 - RNA, 64 nt, hsa
aggcaagcacuuuguucugagucuuuuaucuccaaauacauaguugucucaaaccaagcaagcu

SEQ ID NO: 84860 - RNA, 64 nt, hsa
uuggcuaaauaugacaauuaucugaguaugguuaaauacauacaauuaaaugucugaagccaau

SEQ ID NO: 84861 - RNA, 64 nt, hsa
guccaguuuugugaugcugcuuuuacgugucccucgauaacagucagcuagacacacucaggag

SEQ ID NO: 84862 - RNA, 64 nt, hsa
acccgaucacagacgaguggccaccggaaucacccgauaacagcccaucacaacuccaaagccc

SEQ ID NO: 84863 - RNA, 64 nt, hsa
ccuuuucccuuuccccuuaaaacaccagacaaaucgauaacaacuuauauauauauauauauau

SEQ ID NO: 84864 - RNA, 64 nt, hsa
cauagugcugugaugauggacaauuacauaguaccgauaacagccaugcacugugcaaagcaug

SEQ ID NO: 84865 - RNA, 64 nt, hsa
uuuuuuguuuaagucgagauauaaaaacugaacacgauaacacuuacucuuaaaucaagcauca

SEQ ID NO: 84866 - RNA, 64 nt, hsa
aagacaagugaaaaaauauuggcaucgaugaaaccgauaacauuggccucauuggauuucuuua

SEQ ID NO: 84867 - RNA, 64 nt, hsa
cauauauacacauauauauuuugcacuacacaaacgauaacauuuuaaggacuaauauugcuga

SEQ ID NO: 84868 - RNA, 64 nt, hsa
uuguaguuacuucuaccaaauagccuuuccuuuucgauaacauuccucaguauuuuuauagcca

SEQ ID NO: 84869 - RNA, 64 nt, hsa
uauuuggaguuuauuuagaaguaaagugugaugacgauaacacuuaagugugaauuuuuaaaua

SEQ ID NO: 84870 - RNA, 64 nt, hsa
uuguagacuaaaccaaguauuguaaaauaaacagcgauaacagugauaguuuuuaacucuaugg

SEQ ID NO: 84871 - RNA, 64 nt, hsa
gcuaccuaggggaaacaagauguagugcuauugccgauaacaaguaagauuuuccacacuacag

SEQ ID NO: 84872 - RNA, 64 nt, hsa
guguaucugguagaaggcgaacaggcguugaugccgauaacaagaaucgccuuuaagguucagc

SEQ ID NO: 84873 - RNA, 64 nt, hsa
acaacccagguuauuuucaaucagaccaggcauucgauaacacacuaaggggguaggaauggaa

SEQ ID NO: 84874 - RNA, 64 nt, hsa
augugggaaagccuuuauuucuuucacuucuuuucgauaacaugaaaggacucacacuggagag

SEQ ID NO: 84875 - RNA, 64 nt, hsa
aucuccuuaaccacacuuaaucuccaaauaaguacgauaacauagucauagucccacccaacau

SEQ ID NO: 84876 - RNA, 64 nt, hsa
gugagccacugugcccggccaagaauuuuuuuaucgauaacauagugagcucucugccucuucg

SEQ ID NO: 84877 - RNA, 64 nt, hsa
ucgacacaucaguaccacuaauggaugauggagacgauaacacucuuuaccaucggguacguga

SEQ ID NO: 84878 - RNA, 64 nt, hsa
aaguauagauuccaguagccuaguuuccacagcacgauaacaccaugacgccuacugcuguucc

SEQ ID NO: 84879 - RNA, 64 nt, hsa
gcuggagugcagugguaugaucucagcucacugcaagcuccaccucccggguucacgccauucu

SEQ ID NO: 84880 - RNA, 56 nt, hsa
acaaaaucaaaaugaaaugaauaaauaagcuccagccagagauguaugcaugauaa

SEQ ID NO: 84881 - RNA, 64 nt, hsa
gcuggagggcaguggcacgaucucagcucacugcaagcuccaacucccggguucacgccauucu

SEQ ID NO: 84882 - RNA, 64 nt, hsa
ccccuugaaccucauuaaauggugauuucuugcuaagcuccagcccgaguggucuccucucagc

SEQ ID NO: 84883 - RNA, 64 nt, hsa
auucccacuccucugagcccggaggggacaccccaagcuccaagcuccaagcuccaggccaaag

SEQ ID NO: 84884 - RNA, 64 nt, hsa
cuccucugagcccggaggggacaccccaagcuccaagcuccaagcuccaggccaaaggcugaaa

SEQ ID NO: 84885 - RNA, 64 nt, hsa
gagcccggaggggacaccccaagcuccaagcuccaagcuccaggccaaaggcugaaaggcacgu

SEQ ID NO: 84886 - RNA, 64 nt, hsa
cccuuuugaaccucauuggacccaaccaggucccaagcuccauuggagaugaccaguccuuucu

SEQ ID NO: 84887 - RNA, 64 nt, hsa
ggacagggaagucuccgcccugauuggaugaggaaagcuccaacccagucuccuaagcgacugg

SEQ ID NO: 84888 - RNA, 64 nt, hsa
acguggagguuagaauagagggcagaguaaaaggaagcuccaucugagcaaguacaccaaauga

SEQ ID NO: 84889 - RNA, 64 nt, hsa
gguagggccaccacuacgccuucacuugucacccaagcuccaaccacagagaguuugacaaguu

SEQ ID NO: 84890 - RNA, 64 nt, hsa
uuuagaaacuuagugggaaaaguaggaugguauuuuuauguaaagccuugacccaauguuuaaa

SEQ ID NO: 84891 - RNA, 64 nt, hsa
uucugauuuauugagauugaauuaugccaccacguuuauguaaaaaugaagguggcaccguggu

SEQ ID NO: 84892 - RNA, 64 nt, hsa
agaaauguuucugcuguaguuggauuugcccauauuuauguaggugguuuuaauuuuuuaaaug

SEQ ID NO: 84893 - RNA, 64 nt, hsa
acaaaacaaggaaaaugcuguaaauauugcauauuuuauguauuuggaccaaaagguuacaagu

SEQ ID NO: 84894 - RNA, 64 nt, hsa
uguguuuuguuuaucaugauuauagaauaaggaauuuauguaaauauacuuaguccuauuucua

SEQ ID NO: 84895 - RNA, 64 nt, hsa
cauuauuuuauugucuagcuccaguuaucuguauuuuauguaauguaauugacaggauggcugc

SEQ ID NO: 84896 - RNA, 64 nt, hsa
uucuaacuguaguuuuauagaaaguauuaaugcuuuuauguauuucaaaacuuucauauguuaa

SEQ ID NO: 84897 - RNA, 64 nt, hsa
auguuaaauggaaauuguuuuaaauguguuugaguuuauguaagcauguauacacugugcuaaa

SEQ ID NO: 84898 - RNA, 64 nt, hsa
uaaguuuccauaagucuccuacauagcaguguuauuuauguacagauaagaaaaccauauguca

SEQ ID NO: 84899 - RNA, 64 nt, hsa
caggucaauaaaugauauaaaaacauguguucuauuuauguauauauauguauguuucuccaaa

SEQ ID NO: 84900 - RNA, 64 nt, hsa
gggaucuuuggggcuaacuucgggaucccugcacuuuauguaagaauguaaaccuggagucuca

SEQ ID NO: 84901 - RNA, 64 nt, hsa
auaugaacugaaugaaauggacauuuuuucuuaauuuauguauaaauccauaugauuauacaua

SEQ ID NO: 84902 - RNA, 64 nt, hsa
acaaacauguuacuauucauuggacagauaucauuuuauguauaaauacuguucacaucacugg

SEQ ID NO: 84903 - RNA, 64 nt, hsa
auagaauuuguauuuuuauuguacuuuaaaaagauuuauguaauagguauauauuuaguggcca

SEQ ID NO: 84904 - RNA, 64 nt, hsa
cuaggucccuugucacagcuugguuuuuagacuuuuuauguauauguuuauguacaguauauua

SEQ ID NO: 84905 - RNA, 64 nt, hsa
ucacagcuugguuuuuagacuuuuuauguauauguuuauguacaguauauuacucuugacaguu

SEQ ID NO: 84906 - RNA, 52 nt, hsa
auggccauuuuucccuauaaguuuuauguaguuaaaugcuuccuagaaaccu

SEQ ID NO: 84907 - RNA, 64 nt, hsa
acuuuaucuucauuugggguagaaaaauuauuucuuuauguaguagagacaaauuauucucauu

SEQ ID NO: 84908 - RNA, 64 nt, hsa
auuuuuuucugccauuuucuuuugcaauuguaguuuuauguacuguuaaagaauuguauugaau

SEQ ID NO: 84909 - RNA, 64 nt, hsa
auuuaaaaguuucauuuucuuuugcaauuuuaguuuuauguacuguuaaagaauuguacugaau

SEQ ID NO: 84910 - RNA, 64 nt, hsa
ccuuucuaaccugaaggauacccagauuucuuucuuuauguacaagauggaaaauccccuaccc

SEQ ID NO: 84911 - RNA, 64 nt, hsa
acucaugcuuuggcuuaaacuguaauuaauuuauuuuauguacaauaaaucgcauuugaaaaag

SEQ ID NO: 84912 - RNA, 64 nt, hsa
agaugacuaauuggcaauuugauaguaguuacauuuuauguaacacuugauauaauaacccaaa

SEQ ID NO: 84913 - RNA, 64 nt, hsa
ugcgucaaguuaagggcauuguaaauacuguaguuuuauguagcuugcaacuucuacugaaaug

SEQ ID NO: 84914 - RNA, 64 nt, hsa
caguacagugcucuguucauugcaagcuggcaaauuuauguagcuauguggaaugauaugucau

SEQ ID NO: 84915 - RNA, 64 nt, hsa
ggaacacaaaacucuuuguaauucuguuaaaucuuuuauguagauuuauuuaugaucagccuac

SEQ ID NO: 84916 - RNA, 64 nt, hsa
uuuacaucugugaacuauggcuuaagggacaggauuuauguagcuaaacuaauuuugcaaauca

SEQ ID NO: 84917 - RNA, 64 nt, hsa
ugcacuggaauguaaucaagaaaguuagucauguuuuauguaccauguuuucacacgugucucu

SEQ ID NO: 84918 - RNA, 64 nt, hsa
gacauuguuaaauugagcuauuaaacuaaugaguuuuauguaaguuauauggucuuaauuuggu

SEQ ID NO: 84919 - RNA, 64 nt, hsa
uuauuuuugccuuacuuucuuaagaaacauuaauuuuauguauagugaguauauuuugcauguu

SEQ ID NO: 84920 - RNA, 64 nt, hsa
ucucaucuaaaauuuuucuagaagauaucaugauuuuauguaaagucucucaauggguaaccau

SEQ ID NO: 84921 - RNA, 64 nt, hsa
aaguauuuacagauguuaaauggaguauuuuuauuuuauguauauacuauacaacaauguucuu

SEQ ID NO: 84922 - RNA, 64 nt, hsa
uuaaaaauugcauuguguuacagagcuagaaaauuuuauguaugaaaaacgauaauagccuuac

SEQ ID NO: 84923 - RNA, 64 nt, hsa
agauagaggguccuccacuuucagcucaugcuuuuuuauguaggacuagcuuaccugauuuuaa

SEQ ID NO: 84924 - RNA, 64 nt, hsa
uagaccgagucuuguuguuuagccuaagagaagauuuauguaguaauuucuucucagguaugga

SEQ ID NO: 84925 - RNA, 64 nt, hsa
cuaaaguuuaauuuuaagauguuugaauguucaguuuauguauuugaacuacaauaaaccaacc

SEQ ID NO: 84926 - RNA, 64 nt, hsa
ggaugcauuauaaacugaaaagccuuuuuaaaauuuuauguauuaauauaugcauucacuugaa

SEQ ID NO: 84927 - RNA, 64 nt, hsa
cuugagccaccacacccggcacaucuucauucuuuuuauguaguaaaaaguauaaggccacaca

SEQ ID NO: 84928 - RNA, 64 nt, hsa
caugggccuucaugcuauuuaaauauuuaaguaauuuauguauuuauuaguauauuacuguuau

SEQ ID NO: 84929 - RNA, 64 nt, hsa
uagaugcuaaaugcucauugaaacaaucagcuaauuuauguauagauuuuccagcucucaaguu

SEQ ID NO: 84930 - RNA, 64 nt, hsa
cgaaugcaaauuccacucagcagaggcaauguuauuuauguacauagggauaguggaaugaguu

SEQ ID NO: 84931 - RNA, 64 nt, hsa
auuauugagcuuccucuuaaaaagauuuuuuuauuuuauguagccaacauugcaguacuguaug

SEQ ID NO: 84932 - RNA, 64 nt, hsa
aauaaacuuuucaaaauuuauguaauguggggcuuuuauguagcacuuuacguuuucaugcugc

SEQ ID NO: 84933 - RNA, 64 nt, hsa
ccuguaacuguuuaagccaauaaacuuuucaaaauuuauguaauguggggcuuuuauguagcac

SEQ ID NO: 84934 - RNA, 64 nt, hsa
aaauaacuuguuuuuucucauguuucaucuucuuuuuauguaaauuuguaauacuuuccuauau

SEQ ID NO: 84935 - RNA, 64 nt, hsa
auguaaauauguacaagugcaucacugguacaauuuuauguaacucaguuggacacuagguugc

SEQ ID NO: 84936 - RNA, 64 nt, hsa
aaacauauuuuuauaugauuaaaacugaacagcuuuuauguacagcucugauucuguaauacua

SEQ ID NO: 84937 - RNA, 64 nt, hsa
uuuauuaauauuuaaauaugugaagcugaguuaauuuauguaagucauauuuauauuuuuaaga

SEQ ID NO: 84938 - RNA, 64 nt, hsa
uauuuauauuuuuaagaaguaccacuugaaacauuuuauguauuaguuuugaaauaauaaugga

SEQ ID NO: 84939 - RNA, 64 nt, hsa
uugaaccagauccccaauuaaaacaacaguauuuuuuauguagccauaauuuuuuuuuuuuuuu

SEQ ID NO: 84940 - RNA, 64 nt, hsa
uacucacaaaaccauugcagaaaagcaagaaauauuuauguagaaguucuuaugaaaacuuauu

SEQ ID NO: 84941 - RNA, 64 nt, hsa
cuauauugucuuaaaaguauguggacucuguuccuuuauguaaacauguaaagaaaauaaguca

SEQ ID NO: 84942 - RNA, 64 nt, hsa
uauaguaucuuaauaaaaaugagaacacugucccuuuauguaaauuuuuguacauaguagcauu

SEQ ID NO: 84943 - RNA, 64 nt, hsa
guugcaaauuugugacuguccuuauuaacuuucuuuuauguaaguaauuuguaaaaguuucuua

SEQ ID NO: 84944 - RNA, 64 nt, hsa
cugucuugaccauugacuaugacacaguuucuuauuuauguaaauacuugcaucacaguggccg

SEQ ID NO: 84945 - RNA, 64 nt, hsa
uagcuacuaaaugcaaaauguauaaaaguauuguuuuauguaguuaccuaccaauacuaucugc

SEQ ID NO: 84946 - RNA, 64 nt, hsa
caagguaaccaucucauauacuagugucaaaagguuuauguaaacuugaauuuuaucugaacua

SEQ ID NO: 84947 - RNA, 64 nt, hsa
auuagaagagaaacaaauuccaugcuuuauggaauuuauguagacuggagucuucgugaacugg

SEQ ID NO: 84948 - RNA, 64 nt, hsa
gggugacucuuuaauauuaccuuauaguagaaacuuuauguaauauagcuaacuccguauuuac

SEQ ID NO: 84949 - RNA, 64 nt, hsa
gaauacugcaaaacccauauaucuuuuuaaaaaauuuauguacucacagucuuucccuugaaga

SEQ ID NO: 84950 - RNA, 64 nt, hsa
ugugcuuuugaaaagaguauacuuuuuacuuuuauuuauguacuaguagauguaaaauuucaca

SEQ ID NO: 84951 - RNA, 64 nt, hsa
guauaguaugcuauuucuguguauguucaaauuguuuauguauauaauaaaguuuuaaaaauuu

SEQ ID NO: 84952 - RNA, 64 nt, hsa
gcaccgugccuggccaagauucuuuacaauaggauuuauguaaaacuuuacuaagcuaaacugc

SEQ ID NO: 84953 - RNA, 64 nt, hsa
aguuagaccugcagauguguacagauaguucauauuuauguauugcacauaaucaugcuauuca

SEQ ID NO: 84954 - RNA, 64 nt, hsa
uuuuauucuuaaagcauucaguuuugcuuucaauuuuauguaccuuaguucugaguuagaccug

SEQ ID NO: 84955 - RNA, 64 nt, hsa
ugguaagcaugcacaguuugcagucuacaguuuuuuuauguagcacaaaauagguguaccuuua

SEQ ID NO: 84956 - RNA, 64 nt, hsa
uguucauguuauauuaaaacuugagauuuguguauuuauguagagucuguauugacaagacugu

SEQ ID NO: 84957 - RNA, 64 nt, hsa
ugccauuaauguuucuuaucuauaucuguaucuauuuauguagauauugguauauggcagauuu

SEQ ID NO: 84958 - RNA, 64 nt, hsa
uucuuuaacuuauuuugagauuugagauuuaaauuuuauguauuguuuacagucagaguaaauc

SEQ ID NO: 84959 - RNA, 64 nt, hsa
cugcugucagugcuggacgaagugcuauaacuacuuuauguaacauuacagaacagcuagaggu

SEQ ID NO: 84960 - RNA, 64 nt, hsa
guuuggccacaugucaagccaauuguuuguacuauuuauguaccuuuuucauaacuggaauugc

SEQ ID NO: 84961 - RNA, 64 nt, hsa
uucucuuaauuuguauauaaccuguugucuaaauuuuauguacagucuuuuauaauaaaccauu

SEQ ID NO: 84962 - RNA, 64 nt, hsa
aaaaaauacuguuuguuuaaagcaugcauaaaaauuuauguauugaaauauacuuaaaaauuca

SEQ ID NO: 84963 - RNA, 64 nt, hsa
aaugucuaccuguaagcauaaaucuuugaggcaguuuauguauugcugaauagcaauuuauaca

SEQ ID NO: 84964 - RNA, 64 nt, hsa
ugaucuagcuguuuuauuuuuauguacucuuaguuuuauguaagaaaccuuaggaugagcuccc

SEQ ID NO: 84965 - RNA, 64 nt, hsa
aggccaucucuaaaauugaucuagcuguuuuauuuuuauguacucuuaguuuuauguaagaaac

SEQ ID NO: 84966 - RNA, 64 nt, hsa
cuuagaucggagugugaaguaaauuaugguauauuuuauguaacauuuuaauguuuaugcucau

SEQ ID NO: 84967 - RNA, 64 nt, hsa
caggcaggaugacacuuuguguuaaaguguuauuuuuauguauuaccuggaaugaggcagguuu

SEQ ID NO: 84968 - RNA, 64 nt, hsa
ggcaugcaccaccaugccuggcuaauuuuuguauuuuauguagagacaggggucuugccauguc

SEQ ID NO: 84969 - RNA, 64 nt, hsa
ggagaagaacaugagguagacuuaaagaacuuccuuuauguaaagaucugugacucugaaauau

SEQ ID NO: 84970 - RNA, 64 nt, hsa
uguaucauuauaggcagaagguauuuggcaaauuuuuauguauuguuuuauguacuguacaagu

SEQ ID NO: 84971 - RNA, 64 nt, hsa
ggcagaagguauuuggcaaauuuuuauguauuguuuuauguacuguacaaguaacuuauucuug

SEQ ID NO: 84972 - RNA, 64 nt, hsa
cucccuucauauuaauauuugauaaagauuuuaauuuauguaaaacuucuaaagcagaaucaaa

SEQ ID NO: 84973 - RNA, 58 nt, hsa
ucuccacucaggaguggugacugagguuuuuauguagaaggggaacaaaaaaaaaaau

SEQ ID NO: 84974 - RNA, 64 nt, hsa
agaauauuaauuuguaaauucugcaaguuuaauuuuuauguagaugguauaacauuugaaaaua

SEQ ID NO: 84975 - RNA, 64 nt, hsa
accauuaacucauucauguaguuuauucaagugauuuauguauuuaaacuaaauauugaaaaug

SEQ ID NO: 84976 - RNA, 64 nt, hsa
cgaaagcaaugcuucuaucaaauacuaguauuaauuuauguaucugguuaaugacauacuugga

SEQ ID NO: 84977 - RNA, 64 nt, hsa
uuauuaaaauuggaugcuagagaaucaaguuuauuuuauguauauauuuuucugauuauaagag

SEQ ID NO: 84978 - RNA, 64 nt, hsa
acugauguauaugguuaucuggguuauaucuauuuuuauguaaacucuauuuuguuuuuggcaa

SEQ ID NO: 84979 - RNA, 64 nt, hsa
auucuuuaaaguuuacaaaaaaaaaccuuauguuuuuauguaaucagucauuacacuagggaga

SEQ ID NO: 84980 - RNA, 64 nt, hsa
gaauaaguuucuguuaaaauacuuauucucaauauuuauguauaaaccaugcuucucagcuuuc

SEQ ID NO: 84981 - RNA, 64 nt, hsa
auucugaauauacuuguaguuuuacuucuuucuguuuauguacccaauuccuuaugauuauuuu

SEQ ID NO: 84982 - RNA, 64 nt, hsa
cuaaaucauuuauuaguuguuuuuugaaagcaguuuuauguauaaauaacaaauguuuauauuu

SEQ ID NO: 84983 - RNA, 64 nt, hsa
gaagcucauuuucuaugcagguuuuuaaacgucauuuauguaucauucuuuuuauauaucacac

SEQ ID NO: 84984 - RNA, 64 nt, hsa
gcggaugugcguugguuauauacaaauaugucauuuuauguaagggacuugaguauacuuggau

SEQ ID NO: 84985 - RNA, 64 nt, hsa
uugaaauuauugauuuuggcauuuuucuaagcaauuuauguaauuuuauuugaagaaaauguuu

SEQ ID NO: 84986 - RNA, 64 nt, hsa
aacuuggcccuagaccuagggauaagcaauguucuuuauguagccaaugcuacgaaacaaaaga

SEQ ID NO: 84987 - RNA, 64 nt, hsa
auuuuugcaauucagacaaggguaaacauuuuacuuuauguaauugccacaucccaagauguaa

SEQ ID NO: 84988 - RNA, 64 nt, hsa
uuuccuugcauuugaaugguucaauucuguuguguuuauguagaaaauucacaaaucuguucau

SEQ ID NO: 84989 - RNA, 64 nt, hsa
uucuaagcauauucaaaagggugacaaaauuacguuuauguacuaaaucuaaucaggaaaguaa

SEQ ID NO: 84990 - RNA, 64 nt, hsa
uauggcuucacauucauugcagugggauaugguuuuuauguaaaacauuuuuagaacuccaguu

SEQ ID NO: 84991 - RNA, 64 nt, hsa
auauuuuauguaauauuguguuaaauuauauuguuuuauguaauauauuauuuuaaauguuauu

SEQ ID NO: 84992 - RNA, 64 nt, hsa
ucuuguauuauaaucuuuuaauauaauauuauauuuuauguaauauuguguuaaauuauauugu

SEQ ID NO: 84993 - RNA, 64 nt, hsa
auagaguaguagcucuauuucuaacuaaauucuauuuauguaacaacacagcuaauuuacucuu

SEQ ID NO: 84994 - RNA, 64 nt, hsa
aagccauuuucucaucugauauauugagcuauguuuuauguaaguauugcuuauucaaguaguu

SEQ ID NO: 84995 - RNA, 64 nt, hsa
auuuuaauuuuugaaacugaugucuuucccagaauuuauguacucuauaacggugugaaugauu

SEQ ID NO: 84996 - RNA, 64 nt, hsa
uuccagaagaguugcaucaacaaaguuaauuguauuuauguauguaaauagauuuuaagcuuca

SEQ ID NO: 84997 - RNA, 64 nt, hsa
uaacuacuguauucccacaaggaauccccagauauuuauguaucuugauguucagacauuuaug

SEQ ID NO: 84998 - RNA, 64 nt, hsa
aaaacgcuuugguagauuuggccaggagcuuucuuuuauguaaauuggauaaauacacacacca

SEQ ID NO: 84999 - RNA, 64 nt, hsa
uucacccguucacuuacuguauaauuuaaaaucauuuauguagcugagacacuucuguauuuca

SEQ ID NO: 85000 - RNA, 64 nt, hsa
uuucacuuugguggucugaagaagaaaaagaaauuuuauguauguauguguaaauauguguaua

SEQ ID NO: 85001 - RNA, 64 nt, hsa
uguuuuuuaacaacaacaaaaguuuagguucuaauuuauguaaauaccuaguauguguauuuuu

SEQ ID NO: 85002 - RNA, 64 nt, hsa
uaccuuuuuuauucugucggguuacugaccucacuuuauguaaauacuucgcaugacaaauuca

SEQ ID NO: 85003 - RNA, 64 nt, hsa
ggcaaugugcuguuaaaguaauagacuuuuaaucuuuauguauuuuuuguuuucucuggaguac

SEQ ID NO: 85004 - RNA, 64 nt, hsa
uauguagcagaccaaucucuaaaauagcuaauucuucaauaaaaucuuucuauauagccauuuc

SEQ ID NO: 85005 - RNA, 64 nt, hsa
uuuaaggcugcaauacaagcauucaguucccuguuucaauaagagucaauccacauuuacaaag

SEQ ID NO: 85006 - RNA, 64 nt, hsa
uuauguggaacaucuauagagauaaauagaaauuuucaauaagauguaguaacacugugauuua

SEQ ID NO: 85007 - RNA, 64 nt, hsa
agaagggagggaauaaaucaugacuuaucccauuuucaauaacaaaacgaaacuauggcacuaa

SEQ ID NO: 85008 - RNA, 64 nt, hsa
ucucaggcacaaauauauauggggacaucaaaacuucaauaaucaagauaccuaauauuuaagu

SEQ ID NO: 85009 - RNA, 64 nt, hsa
ucacaggguuggaaagaacuuugaaaggucauuuuucaauaaucucaccuuaaaagugaccccu

SEQ ID NO: 85010 - RNA, 64 nt, hsa
uuucuuaaugugccuaaguuaauuucuguaucaauucaauaaauggaauugacugaacuuccca

SEQ ID NO: 85011 - RNA, 64 nt, hsa
cacuuuccaacuauuauauaauacauuucgaucuuucaauaaagauacgcauucacgcuguaag

SEQ ID NO: 85012 - RNA, 64 nt, hsa
gaauccuaggaaagggcucagccugugauaggcauucaauaaauacuccaaugcugucauuccu

SEQ ID NO: 85013 - RNA, 64 nt, hsa
gcugugauuuggggccguuuguacucugcauguauucaauaaauucaauucagcaauaguuauc

SEQ ID NO: 85014 - RNA, 64 nt, hsa
uuuggcuacuuguauucuuuaugcuguuguuuauuucaauaaaaaauucacaccuaaauguaua

SEQ ID NO: 85015 - RNA, 64 nt, hsa
ugcuucuggcgaacugauuuuauuuuuaauuuuuuucaauaaagauauucuuagauacugaaag

SEQ ID NO: 85016 - RNA, 64 nt, hsa
gggguuaguuaugaaauguucuuaauaugacguguucaauaacuucacauaaacuuccuguucu

SEQ ID NO: 85017 - RNA, 64 nt, hsa
caagcccaugcuguuguugguuuuuaagguuucuuucaauaauaggcuaaggaaagacauguuu

SEQ ID NO: 85018 - RNA, 64 nt, hsa
uccugaauauguacuuuuaacacaagagagacuauucaauaaaaacucacugggucuuucaugu

SEQ ID NO: 85019 - RNA, 64 nt, hsa
guucuuuuuuauauuguccuccaccuccaucauuuucaauaaaagauagggcuuuugcucccuu

SEQ ID NO: 85020 - RNA, 64 nt, hsa
agaugguaaaacacuguugucauuuuuuccaguauucaauaaguagccuuuguacaaauuuaaa

SEQ ID NO: 85021 - RNA, 64 nt, hsa
gagugguucagccaucaccaccaguggccaccuguucaauaaaauugccuagcaccacagugga

SEQ ID NO: 85022 - RNA, 64 nt, hsa
aauaccuuagauuucuagguaagucuuuccacauuucaauaauggguaagaguagaaccagggc

SEQ ID NO: 85023 - RNA, 64 nt, hsa
ugaguuuuagaagugauggaaauuaagagagcauuucaauaaaaugugacuuggcugucuuugg

SEQ ID NO: 85024 - RNA, 64 nt, hsa
uaaaaaaguuacgaacuuucucuguaacuuggguuucaauaauuauggauuuuuaugaaaacuu

SEQ ID NO: 85025 - RNA, 64 nt, hsa
aagccgacgaaccgacacgcggcagagucaauaauucaauaaaaaaguuacgaacuuucucugu

SEQ ID NO: 85026 - RNA, 64 nt, hsa
guuugugcaauaaguggaagggaugucauccuucuucaauaaaugcugaaugacauucaagcug

SEQ ID NO: 85027 - RNA, 64 nt, hsa
uagaccacugagaaaaucuuuauuuacaauaaauuucaauaaaauuugcauaaauauauuccca

SEQ ID NO: 85028 - RNA, 64 nt, hsa
uuuuagucaaguaauggcuuuugaaaaaguaaaguucaauaauaacuaaggcugugauuuuuuu

SEQ ID NO: 85029 - RNA, 64 nt, hsa
uauacaagggcugugcuaugcuaccauauucuuguucaauaauaauagguuuguuguuuuuuuu

SEQ ID NO: 85030 - RNA, 64 nt, hsa
cacuacagaauuuagucaacauuuuauauaauguuucaauaaauguuucuuucaauaaagauac

SEQ ID NO: 85031 - RNA, 64 nt, hsa
caacauuuuauauaauguuucaauaaauguuucuuucaauaaagauacuaugugcccuucauag

SEQ ID NO: 85032 - RNA, 64 nt, hsa
uauuaagcucuucuauauuaaacacuaauagauauucaauaacggaguaaacuguuccagauaa

SEQ ID NO: 85033 - RNA, 64 nt, hsa
uaucuuuuaugucuaaagccauuuuauauuacuuuucaauaaaaagaauaucauggucaacaua

SEQ ID NO: 85034 - RNA, 64 nt, hsa
uuguuagacagucaggguguauuauuucaagagcuucaauaaaaaaaguguuugcagguauuug

SEQ ID NO: 85035 - RNA, 64 nt, hsa
ugauucuccuuuuaagcuaaaaucucaucaaggcuucaauaagaagauggauauggauauauag

SEQ ID NO: 85036 - RNA, 64 nt, hsa
aacccucaacaaauuacacauugagggaacauacuucaauaagaaccaucuaugcuggacucac

SEQ ID NO: 85037 - RNA, 64 nt, hsa
aacaaaacugacaagcaaugaaguaagaacuucauucaauaaguggugcuggcauaacuggcua

SEQ ID NO: 85038 - RNA, 64 nt, hsa
uagguuugauuacuaggagauaccaccgacauuuuucaauaaaguacugcaaaaugcuuuugug

SEQ ID NO: 85039 - RNA, 64 nt, hsa
auuuaguaaaaauaaaucaaggcuaucggagcaguucaauaacaaagguuacuguugagaaaaa

SEQ ID NO: 85040 - RNA, 64 nt, hsa
aaaacaguccaggccaaagaggaagcauuucauguucaauaagaaacccagccauuccgcaugg

SEQ ID NO: 85041 - RNA, 64 nt, hsa
cacauuaucagagagcacugugcaagccaaaugguucaauaaugaaugaaaauucuggguguaa

SEQ ID NO: 85042 - RNA, 64 nt, hsa
cuagcuuaauaggacaguaaaucuguguggggcuagaacaaaauuaagacauguuuggcaauau

SEQ ID NO: 85043 - RNA, 64 nt, hsa
aaggugcuuuaccuugagccauuauuugugucagagaacaaaagaaacagaaucaauauauaaa

SEQ ID NO: 85044 - RNA, 64 nt, hsa
uccauuuuaauaauggaaugaacuaaaauaaacaagaacaaaagaauaguauaauuauaucagu

SEQ ID NO: 85045 - RNA, 64 nt, hsa
agcuaaauaaauuacuuuuauaacuuacuaaagcagaacaaacagugaaacuuucuaaaauauu

SEQ ID NO: 85046 - RNA, 64 nt, hsa
aucccuacugcugguuucugccuucuccaugcugagaacaaaaucaccuauucacugcuuaugc

SEQ ID NO: 85047 - RNA, 64 nt, hsa
ccuauucacugcuuaugcagucggaagcuccagaagaacaaagagcccaauuaccagaaccaca

SEQ ID NO: 85048 - RNA, 64 nt, hsa
cucaguacuauuucuuuucacuuugaaaauauaaagaacaaaauaaagacaaacauugcaaguu

SEQ ID NO: 85049 - RNA, 64 nt, hsa
aucuuuagagcaacuuuaaggcuuguaaauacauagaacaaauauuuaaaaaaacaaaaagaaa

SEQ ID NO: 85050 - RNA, 64 nt, hsa
aguaaugaauguaaugagagaaaauguuuugaaaagaacaaaacaucaaaaugaauagaaagaa

SEQ ID NO: 85051 - RNA, 64 nt, hsa
auucaaauuguuaaaacauuggcauuugaagaggagaacaaaauguagcaugauguauuuaaag

SEQ ID NO: 85052 - RNA, 64 nt, hsa
uacugcuacugauuuuggaggaaauuuuucuagaagaacaaaggucauauuugaggcaagcuaa

SEQ ID NO: 85053 - RNA, 64 nt, hsa
caaguuaaggaaacaaaaauacuuauauauacacagaacaaaaauaauguucuuuuuaugcaaa

SEQ ID NO: 85054 - RNA, 64 nt, hsa
gauaugaacaaaaauuacaggggaccuguuuaagagaacaaaauguuccaagcacuuuaggcag

SEQ ID NO: 85055 - RNA, 64 nt, hsa
auggaagggaauguaaaauuugccugacuucuuaagaacaaaacccccagcucugugccccaug

SEQ ID NO: 85056 - RNA, 64 nt, hsa
cuuuauuuucacauaagucaauagauguuucucuagaacaaaauauuuaguaaagcuuuauaaa

SEQ ID NO: 85057 - RNA, 64 nt, hsa
acucagugacaaucaucauauuggagcaaaacauagaacaaaaucacuaucucagaaauaccuu

SEQ ID NO: 85058 - RNA, 64 nt, hsa
aggaaucacgcaaagugcuuacuguguaagcccaagaacaaaggcuuucugaaucuucucaggc

SEQ ID NO: 85059 - RNA, 64 nt, hsa
uugggguucagaaagauaaaucccaaaaguauggagaacaaaggaacucauuuuaaaggacuag

SEQ ID NO: 85060 - RNA, 64 nt, hsa
cccugucuugacccugaaaugaaccuuaagccuuagaacaaagucaugcagaugccccauuuga

SEQ ID NO: 85061 - RNA, 64 nt, hsa
cucucccuaagaacauuagauauuuuaguuuuccagaacaaaagcuuuaaacuucugcaguaag

SEQ ID NO: 85062 - RNA, 64 nt, hsa
ccaaauauaaccauuuaaagaaagaaugcauuccagaacaaauuguuuacauaaguuccuauac

SEQ ID NO: 85063 - RNA, 64 nt, hsa
uaaccacuugccucuuucuccagcagcugauuccagaacaaaucauuauguuuccuaacuguga

SEQ ID NO: 85064 - RNA, 64 nt, hsa
cagucuuuggaccacuauuuuacuggccuuugaaagaacaaaguuuacuucaacuaaaauguuu

SEQ ID NO: 85065 - RNA, 64 nt, hsa
auguuggacagcauuugguuuguuugguaagagaagaacaaauauggcuaauuguuaauaaggu

SEQ ID NO: 85066 - RNA, 64 nt, hsa
uuauagaaaugaauaccuuugugaaccuagacuuagaacaaauccugcuuuugaaaaaaaaugu

SEQ ID NO: 85067 - RNA, 64 nt, hsa
acauuauucuccuauuuuagacauuuugugaaagagaacaaauuguccaguggccuccugucag

SEQ ID NO: 85068 - RNA, 64 nt, hsa
acagcagcaaguuuuucagugcauaugcugcacaagaacaaaauauaaaucuguauggcaccaa

SEQ ID NO: 85069 - RNA, 64 nt, hsa
cuacguguuuugagugucuauuucuuugcugcggagaacaaauuccuaaauaguuuuaguaaag

SEQ ID NO: 85070 - RNA, 64 nt, hsa
aacagcuaaggaauaauuuuaauaaaagugaaccagaacaaaucacucauuuaaaaaguaauuc

SEQ ID NO: 85071 - RNA, 64 nt, hsa
aaagggcaaaaaauucauuugaaccaguuuuccaagaacaaaucuugcacaagcaaaguauaag

SEQ ID NO: 85072 - RNA, 64 nt, hsa
agaaucacauucguuucccagugaaaagcaaaccagaacaaaacaaaaagccaccgcaauaauu

SEQ ID NO: 85073 - RNA, 64 nt, hsa
guguagaucauuuaugggauuggugcugauugaaagaacaaaacaaaacaaaacaaacacaaac

SEQ ID NO: 85074 - RNA, 64 nt, hsa
aguauauuuuuaugagggagcaaaaguuagacugagaacaaacguuagaaaaucacuucagauu

SEQ ID NO: 85075 - RNA, 64 nt, hsa
aaacuuuauguaauauagcuaacuccguauuuacagaacaaaaaaacacaguucccccuccugu

SEQ ID NO: 85076 - RNA, 64 nt, hsa
uguuuguaauauuuaagaaaugcucauucuuuguagaacaaaaauguauuaaauauuuuaaaaa

SEQ ID NO: 85077 - RNA, 64 nt, hsa
ugccuuugagaacugcuugacuccaugaucuccuagaacaaaaccgcccugacuuuacaggggg

SEQ ID NO: 85078 - RNA, 53 nt, hsa
augugggcaagaccuccugaacuagaacaaauaggaauauuuucauggaauuu

SEQ ID NO: 85079 - RNA, 64 nt, hsa
caucaacuaacuuggacuaauugugaggaagagcagaacaaauuaguagaaagagguuauaaga

SEQ ID NO: 85080 - RNA, 64 nt, hsa
uugauuauauguugauugauaacauauuaaauagagaacaaauaagagagguccuuuacaugac

SEQ ID NO: 85081 - RNA, 64 nt, hsa
agaaacugcagugguaauuaaauuaauagaaaagagaacaaacugcagguuuagaaaaaugguu

SEQ ID NO: 85082 - RNA, 64 nt, hsa
aaauuaauuucagcuugauuaucaaccuguaucaagaacaaaaaugggaggagguguccacauu

SEQ ID NO: 85083 - RNA, 64 nt, hsa
auuuaucauggcauuucuuaaaagggugagcaacagaacaaaaggcagaaaaggcauaccuaag

SEQ ID NO: 85084 - RNA, 64 nt, hsa
cuuuugcacuaccaaccacuuuaaaccaaccacgagaacaaagaggagcgguugcucucuguca

SEQ ID NO: 85085 - RNA, 64 nt, hsa
ccuuugcuucucauggcauacuucaacaacugaaagaacaaaugaaccccccugaccuuuccug

SEQ ID NO: 85086 - RNA, 64 nt, hsa
accauccuuuaaucauaacuaaaacauugaaaacagaacaaaugagaaaagaaaaaaaaccugc

SEQ ID NO: 85087 - RNA, 64 nt, hsa
aaacuagacaaauaaagacaaacuaaaacaaaacagaacaaaagcaaaggaaaaugcuuuagaa

SEQ ID NO: 85088 - RNA, 64 nt, hsa
aguacacaaguauaguggcccaggauguagugaaagaacaaauccuagagucuuugaaauuucu

SEQ ID NO: 85089 - RNA, 64 nt, hsa
augucaagucuacaucgacugguaaaacauucaaagaacaaacugacaaugauguucuaccuac

SEQ ID NO: 85090 - RNA, 64 nt, hsa
auugaaagaaauuugacucauaaacuuccaaguuagaacaaauauuucuucauuauuguugcuu

SEQ ID NO: 85091 - RNA, 64 nt, hsa
gaaugucucaguaauuagaaaucccuuaauaaguagaacaaauguggcaaguaggacuccuauc

SEQ ID NO: 85092 - RNA, 64 nt, hsa
ccugugaucuaugcaggaccucuguacuuucuaaagaacaaaauguuauguagacauuauacau

SEQ ID NO: 85093 - RNA, 64 nt, hsa
acuucuuucagagagcuuuauacugccugaccaaagaacaaaucugaaaaucaccauuuuaaag

SEQ ID NO: 85094 - RNA, 64 nt, hsa
gaugccagcauacauuaaagcgguucacgugcagagaacaaagcagugacaaccauuggcccuu

SEQ ID NO: 85095 - RNA, 64 nt, hsa
cacuauguagcuuaaagauuucuguuaauuugaaagaacaaaaacaagacagaacuucugguac

SEQ ID NO: 85096 - RNA, 64 nt, hsa
uaccacccaaugcugauguccucaccacaugcggagaacaaaugugaagggaguaggauauugg

SEQ ID NO: 85097 - RNA, 64 nt, hsa
ccauuaccuucucccucauuucaggagcagccucagaacaaagugagacaguccagccuggaga

SEQ ID NO: 85098 - RNA, 62 nt, hsa
ucuuacagagugcaguaugaaacucaccagcgagaacaaacaccuccccagcccccagcccu

SEQ ID NO: 85099 - RNA, 64 nt, hsa
ugcccagcacacugccugagggacaacagacaucagaacaaacccccagagagaaacagucaaa

SEQ ID NO: 85100 - RNA, 64 nt, hsa
aacaaacaaaaaaaaaaacacacaaaacaaaaacagaacaaaagaagagagaaggaaauuuuau

SEQ ID NO: 85101 - RNA, 64 nt, hsa
uacuucggagacaccugucugcaucugacugagcagaacaaaucgucaggugccuggagcaaaa

SEQ ID NO: 85102 - RNA, 64 nt, hsa
aggcauuugcaggaugagccugaacugguugugcagaacaaacaaggcauucaugggaauuguu

SEQ ID NO: 85103 - RNA, 64 nt, hsa
uauuauuaaucaaugcaauauuuaaaaugaaaugagaacaaagaggaaaaugguaaaaacuuga

SEQ ID NO: 85104 - RNA, 64 nt, hsa
cugacuugcagaaaugcagacauacagucaggaaagaacaaacuucaauuaaauguauaaugag

SEQ ID NO: 85105 - RNA, 64 nt, hsa
uucuuuguagguggaguuugugauugcagugaauagaacaaauucugacuugcagaaaugcaga

SEQ ID NO: 85106 - RNA, 64 nt, hsa
aggcuaacaccugacuuuagaaaaugcugauuugagaacaaaaggaaaggucuuuuuucacugc

SEQ ID NO: 85107 - RNA, 64 nt, hsa
uuggcgagggaguggauauagggcaugucacaaaagaacaaaauaacccgaccuuuauugcugg

SEQ ID NO: 85108 - RNA, 64 nt, hsa
aucauaaauagacuaguuaguagaagacuuuugaagaacaaaguaaaacuuuuuuuuuucauua

SEQ ID NO: 85109 - RNA, 64 nt, hsa
auuauuuaaaacaugagugacagguagucagaagagaacaaaaggacgcaagauacucuauagc

SEQ ID NO: 85110 - RNA, 64 nt, hsa
uauuuaaguaaaaacaaaaugaugcauuuugagaagaacaaagugugcacucagcggcuggaaa

SEQ ID NO: 85111 - RNA, 64 nt, hsa
cucauucaaagcacauuguagauauucagagagaagaacaaauggcuggcuuggcaaaucccca

SEQ ID NO: 85112 - RNA, 64 nt, hsa
aucauuuguuugcuuugaagaaaaagcaaaaacaagaacaaaaacaccaaaucauuugaaauca

SEQ ID NO: 85113 - RNA, 64 nt, hsa
cuuuacagacgucgugaucagccuccagccauacagaacaaaugagaaauuagaagcgauucca

SEQ ID NO: 85114 - RNA, 64 nt, hsa
ucugucugcggaacacugacucugcucucuaaugagaacaaaguuagaaaucugccgauaaccu

SEQ ID NO: 85115 - RNA, 64 nt, hsa
cagugagcaauuuuugugucagaaauucuuugucagaacaaauauauguaacaggcucaacuua

SEQ ID NO: 85116 - RNA, 64 nt, hsa
guuuaggcgaccuucugaaacucacagaagucacgugauggagagaggauucaaagccagggcc

SEQ ID NO: 85117 - RNA, 64 nt, hsa
cugaaccaaucacuuuguaugcuaugcuccuacugugauggaaaacaaaaugaguauaacuuau

SEQ ID NO: 85118 - RNA, 64 nt, hsa
gagaaaaaucaguagaaacccagaaaagacagaggugauggaauuaguagacaaggauauuaaa

SEQ ID NO: 85119 - RNA, 64 nt, hsa
guuuacuuagaugugaagaguucuccuuacugcugugauggaauaacaagggucagauuuccuc

SEQ ID NO: 85120 - RNA, 64 nt, hsa
gaugggcagcagguggcgcugccuuccacccauggugauggaugguuuggaaagggaauguugg

SEQ ID NO: 85121 - RNA, 64 nt, hsa
agcuguuccuggacagccuucuacugccugggaagugauggaacaggaacucagggugcccuua

SEQ ID NO: 85122 - RNA, 64 nt, hsa
auucacaguaccaugcgaguagcccacaguuaauucccggcagauucuuuggcuguguuuuauc

SEQ ID NO: 85123 - RNA, 64 nt, hsa
agggcugugagcugggcuucuguccuccucugugucccggcauggaagccaguauaagcauuuc

SEQ ID NO: 85124 - RNA, 64 nt, hsa
acccggugaccagugguggccccucagcccacccucccggcagcucagccuguggcucuugagg

SEQ ID NO: 85125 - RNA, 64 nt, hsa
uagugcuguccucccaucuccugugggcagccccucccggcagccagggcuuccuggaggcgau

SEQ ID NO: 85126 - RNA, 64 nt, hsa
aaacuagccaagggcaagcuauuauucagcagugucccggcacuacuaaccccugcaacaagcc

SEQ ID NO: 85127 - RNA, 64 nt, hsa
gaucucagcugggugcgauggcucacgccuguaaucccggcacuuugggaggccaaggugggug

SEQ ID NO: 85128 - RNA, 64 nt, hsa
cguaucaacgcuaugaacgcaaggcugugauauggaaccagaaggcugucugaacuuuugaaac

SEQ ID NO: 85129 - RNA, 64 nt, hsa
ucaaucuaaaugcauucauucuaaaaaauuuuuugaaccagauaaauaaaauuuuuuuuugaca

SEQ ID NO: 85130 - RNA, 64 nt, hsa
ggugcuggggguaggacugaggcagccccacugggaaccagacugcagccuggcccauggcugu

SEQ ID NO: 85131 - RNA, 58 nt, hsa
ggaucgauacagauggauaaacugccaagaaccagauuuuuaaaaggccgcaaaaaau

SEQ ID NO: 85132 - RNA, 64 nt, hsa
caggccuggaaaagaaccagaaggaggcugggcagaaccagaacaaccugcacuucugccaagg

SEQ ID NO: 85133 - RNA, 64 nt, hsa
gaagagagccuggaaaagaaccaggccuggaaaagaaccagaaggaggcugggcagaaccagaa

SEQ ID NO: 85134 - RNA, 64 nt, hsa
uuaaacacgagacaaaacaauccauauguuuagggaaccagaaaaguccccuggucugucccuu

SEQ ID NO: 85135 - RNA, 64 nt, hsa
gcagggugcuucagaugagcaagagaacccagucgaaccagauaccccaggugggccggaggga

SEQ ID NO: 85136 - RNA, 64 nt, hsa
cuuaucuuaguagacaaaaagagucaauaccagagaaccagaggcauccucuguauuuuaauga

SEQ ID NO: 85137 - RNA, 64 nt, hsa
aaagccuccugcuccuacccaugcuacaggccaggaaccagagcccaucaucucagaggccccu

SEQ ID NO: 85138 - RNA, 64 nt, hsa
gcauacaguucuugacuuuggacaauccaagagugaaccagaaugcaguuuuccuugagauacc

SEQ ID NO: 85139 - RNA, 64 nt, hsa
aaaacaauuccccuguggccugcuggacugguuggaaccagaacaggcuaaggcauacaguucu

SEQ ID NO: 85140 - RNA, 64 nt, hsa
gagaggaauccacaggaccaccagaagggagagggaaccagauaugcagaucagagauagagga

SEQ ID NO: 85141 - RNA, 64 nt, hsa
gaaccagauaugcagaucagagauagaggaaguggaaccagagagcugggagggaccaagguug

SEQ ID NO: 85142 - RNA, 64 nt, hsa
gagaggaauccacaggaccaccagagaggagagggaaccagauaugcagaucagagauagagga

SEQ ID NO: 85143 - RNA, 64 nt, hsa; identical to SEQ ID NO: 85141

SEQ ID NO: 85144 - RNA, 64 nt, hsa
cucucaacccagucucccuucccagggccacucagaaccagaggucuuuagggccaguguacug

SEQ ID NO: 85145 - RNA, 64 nt, hsa
gggaggcaucaggccuucuucugguugcaggagagaaccagagggugggaacggggagggaaga

SEQ ID NO: 85146 - RNA, 64 nt, hsa
uuugcagauauucuucgguuugaauaauuaaaaugaaccagauaucagggugguuaauuaaaau

SEQ ID NO: 85147 - RNA, 64 nt, hsa
aaaugaaccagauaucagggugguuaauuaaaaugaaccagauaucagggugguuuauaaagcc

SEQ ID NO: 85148 - RNA, 64 nt, hsa
ccaaagaugaaagcccagacuucaguaaucuuuugaaccagacguggauggugcugaauuguug

SEQ ID NO: 85149 - RNA, 64 nt, hsa
cuugcuaaaguucucuuucuuugagaaaacugaggaaccagaaugcuuagaguucauaaaauaa

SEQ ID NO: 85150 - RNA, 64 nt, hsa
gguucuagaugaaccaauuaucuggaaaaugaaagaaccagaguuggaaggcacuugacuggcc

SEQ ID NO: 85151 - RNA, 64 nt, hsa
aacaaugggaaagaggacugggagaggaaucuaagaaccagauggcuucagcucucuagaggag

SEQ ID NO: 85152 - RNA, 64 nt, hsa
agccuggcgccuaggaaccagaccugaaaccaaggaaccagacccgaaaccaggccugggccgg

SEQ ID NO: 85153 - RNA, 64 nt, hsa
aagcaaaacuaaaggcagguagccuggcgccuaggaaccagaccugaaaccaaggaaccagacc

SEQ ID NO: 85154 - RNA, 64 nt, hsa
uucuugguggcuauuagcagaagugcagaguagggaaccagagcugguuaagggccuagugaag

SEQ ID NO: 85155 - RNA, 64 nt, hsa
auuuuacaaggaagaaccucuuaagaaguccucagaaccagaagcaaugugaacucucagcgcu

SEQ ID NO: 85156 - RNA, 64 nt, hsa
gggauccacaggaacgacauucauacagggacauuugugaaagcaaagcaagaaugaaugcuuu

SEQ ID NO: 85157 - RNA, 64 nt, hsa
uuucaugcuaaucuucaaagguucaugcucaauauugugaaaagcuuuuaaaaguuguuuugaa

SEQ ID NO: 85158 - RNA, 64 nt, hsa
aggacugacaagugugcaaaauguuuacaaucuuuugugaaauuguaguuuaucauuaguuugu

SEQ ID NO: 85159 - RNA, 64 nt, hsa
ccaccauucugaguuuauuaaacauuuuccauucuugugaaaauuucaaccaguuuguccuuuu

SEQ ID NO: 85160 - RNA, 64 nt, hsa
agguauuuuaagauucugcugcuguuuagagaaauugugaaacaagcaaaacaaaacuuuccag

SEQ ID NO: 85161 - RNA, 64 nt, hsa
gucauuaaaauaauuuuaaagagugaagaaaauauugugaaaagcucuugguugcacauguuau

SEQ ID NO: 85162 - RNA, 64 nt, hsa
aaauaucucaguuacauuuaccauacaguuuccuuugugaaagaacaguaggggaggaaauaau

SEQ ID NO: 85163 - RNA, 64 nt, hsa
uaagauaauaucaagagucuagaugugaggcuuuuugugaaagagaagccuaaauucagcaucu

SEQ ID NO: 85164 - RNA, 64 nt, hsa
ccucuaauuuccaaaaauguaagaaauuuuacaauugugaaaaccucauggauuugggcaaacu

SEQ ID NO: 85165 - RNA, 64 nt, hsa
uuguguguguaaacuguaaagucuagcccagcccuugugaaaaaaaaaaucacaaauaaaacag

SEQ ID NO: 85166 - RNA, 64 nt, hsa
uguaccuccuuaauccugcuucaacuugauuaucuugugaaacgaugagaguaaguugcaaccu

SEQ ID NO: 85167 - RNA, 64 nt, hsa
uguaaaucuggaaauuugauagacuugacuguguuugugaaaacugagcauuaaagguuuugau

SEQ ID NO: 85168 - RNA, 64 nt, hsa
cguucuguuguguguggcuguaaaaccccaugcuuugugaaaugagaaucuugacauuuuucuu

SEQ ID NO: 85169 - RNA, 64 nt, hsa
caugcuuugugaaaugagaaucuugacauuuuucuugugaaauuuggaaaaugugaucaauuga

SEQ ID NO: 85170 - RNA, 64 nt, hsa
auaauccuacuaauuucuuugcagcuuauuaauuuugugaaauuuguauauaugaagaauuugc

SEQ ID NO: 85171 - RNA, 64 nt, hsa
aaugccucauucaucuagagguaaucuggcagucuugugaaaaccgaacacaacucagaaacuu

SEQ ID NO: 85172 - RNA, 64 nt, hsa
cccauuuuuugaaauagagaauauuuuauuauuuuugugaaaauagaguuuugguaaucacuuu

SEQ ID NO: 85173 - RNA, 64 nt, hsa
uugacaaagcacaauuucccgccuuuuuuuuuuuuugugaaaugaaaaaaacaaauuguguuuu

SEQ ID NO: 85174 - RNA, 64 nt, hsa
gacauauggaauucauaguaugagccacauuuuguugugaaauuuauuuaccugcuuguggcuu

SEQ ID NO: 85175 - RNA, 64 nt, hsa
ugcugcugguaagcaugugcaugcucugccuuucuugugaaaguuuucaaucagcgauaucagc

SEQ ID NO: 85176 - RNA, 64 nt, hsa
uuuuuaaucaaaaacuuauaaaacaugaugaucauugugaaaauucugaguugaagguuaguuu

SEQ ID NO: 85177 - RNA, 64 nt, hsa
uuuaaauaagaaaaacauuccuagaagaugauaauugugaaaaccuccuuuggcuuauuugcuu

SEQ ID NO: 85178 - RNA, 64 nt, hsa
uuuauauuuugcaagggucauucuagcugccauauugugaaaaacuuuaguggacaagggcaga

SEQ ID NO: 85179 - RNA, 64 nt, hsa
ugguuaauuaaguaaccuaaaguaugcauuaggauugugaaaugucucgugaguaugccaaucc

SEQ ID NO: 85180 - RNA, 64 nt, hsa
uaaauuacaacucuuguuauaacuuuuuaaaagauugugaaaauaucaaaauauaaaugaauca

SEQ ID NO: 85181 - RNA, 64 nt, hsa
gauuaaauucauaagacuuaauuuguacaauaguuugugaaauaucuuguuacugcuuuuauuu

SEQ ID NO: 85182 - RNA, 64 nt, hsa
uuagcagacuguggacuguaauaaaguauauaaauugugaaauauaaaaacuuggaacuuauuc

SEQ ID NO: 85183 - RNA, 64 nt, hsa
agugacauguucgaaaccuguccauaaaguaauuuugugaaagaaggagcaagagaacauuccu

SEQ ID NO: 85184 - RNA, 64 nt, hsa
augcuaagcaguagucgucaaguugcagaucuuuuugugaaauucaaccugugucuuauagguu

SEQ ID NO: 85185 - RNA, 64 nt, hsa
augugcagaaagauuccaaaggagaauauauaucuugugaaaauauggagauuugaaaauuuga

SEQ ID NO: 85186 - RNA, 64 nt, hsa
aaaaaaaaaaaaagaaaagaaaaagauaaagggauugugaaaagagcauuuauauuggacuaau

SEQ ID NO: 85187 - RNA, 64 nt, hsa
uauuuguguacagaauucucaauggauuuauauauugugaaauuuuuaucugagauugggaugu

SEQ ID NO: 85188 - RNA, 64 nt, hsa
gaccuaggggaugugugaccuguuuguugagugauugugaaagaggaaugugggagauugggac

SEQ ID NO: 85189 - RNA, 64 nt, hsa
uaaaucaguuauagguuaauguagauaggauguuuugugaaaaagcaaucuauuguguccaaau

SEQ ID NO: 85190 - RNA, 64 nt, hsa
gagaugaaaaacgauuaauguuucauuauuauuauugugaaaauauuauuaacacuggggacuc

SEQ ID NO: 85191 - RNA, 64 nt, hsa
ugugacauucccuacccccaauguugucagcugcuugugaaacucagccagguugucuaaccug

SEQ ID NO: 85192 - RNA, 64 nt, hsa
cccaccgcuauggucuaucuaugaucaccgugcuuugugaaacugugcauccccuuguagccuu

SEQ ID NO: 85193 - RNA, 64 nt, hsa
auauauuccaaaacauuuuugugaauaucuaaguuugugaaacuacuagggcaugauacaguaa

SEQ ID NO: 85194 - RNA, 64 nt, hsa
uacccccuuuuuuaacaaaaagaaacuaguacauuugugaaaauuguguuguguuguccauugu

SEQ ID NO: 85195 - RNA, 64 nt, hsa
cuucaaggaauuuggggaucucucuggcaacaaauugugaaacaugaaauuucugcugacuuua

SEQ ID NO: 85196 - RNA, 64 nt, hsa
uaugccaccauaccauuuuguuaaaauguuuucuuugugaaacauuuguucaaguucuaauaaa

SEQ ID NO: 85197 - RNA, 64 nt, hsa
guagucugaaauggugacagauuacuuguuaaaauugugaaaacucuguuguguccucucuucc

SEQ ID NO: 85198 - RNA, 64 nt, hsa
auaaauggggccuuuaaaaauaugaaaaacaaacuugugaaaauguauaaaagaugcaucuguu

SEQ ID NO: 85199 - RNA, 64 nt, hsa
uaguauaacacaccucacaguguuaagauuuauauugugaaaugagacacccuaccuucaauug

SEQ ID NO: 85200 - RNA, 64 nt, hsa
aaucaucgaacuuggauuucaaaugcaauagacauugugaaagcuggcauuucagaaguauagc

SEQ ID NO: 85201 - RNA, 64 nt, hsa
aucaauugcgaugcucccacaacucuuuacagacuugugaaaucuucaagaacaccuuuacucu

SEQ ID NO: 85202 - RNA, 64 nt, hsa
ugugaacaucccgcaguauaggcuuaagucacuuuugugaaauuugacaaaggcauagaaucuu

SEQ ID NO: 85203 - RNA, 64 nt, hsa
uggaaagguagaagaaacagaguuuuuguugccguugugaaauuguugaaauuuccuucaugcc

SEQ ID NO: 85204 - RNA, 64 nt, hsa
guguauugguaauuuaaauuauuucaguuuuaacuugugaaagcuuauauuaugauuucuggua

SEQ ID NO: 85205 - RNA, 64 nt, hsa
uguuauaugagggagcaucuguaaaucuuuagccuugugaaaacuaaccuucucugcugagcaa

SEQ ID NO: 85206 - RNA, 64 nt, hsa
aauuaaaagaauaguuauuuuacaguuccagggauugugaaauaaauguugcaguuuuuuaaaa

SEQ ID NO: 85207 - RNA, 64 nt, hsa
uucuaaaagcauacacaauguguaacugaaugguuugugaaaaauauauugauauauauacuag

SEQ ID NO: 85208 - RNA, 64 nt, hsa
agauuuaauaaaauuccuucacgaccugguacccuugugaaacuguaaaauauaucauaugggg

SEQ ID NO: 85209 - RNA, 64 nt, hsa
caacuuuuuucagguaauagaagugaauaauuuauugugaaauaauucauuuuauaaauguaua

SEQ ID NO: 85210 - RNA, 64 nt, hsa
uuauaaaaagauuuucauggugagagggauuuuauugugaaauucuagaaaaaaauauuaccac

SEQ ID NO: 85211 - RNA, 64 nt, hsa
caaacauuagggugcacuguaaccauuacagagcuugugaaaagugcagaaaccugagccucac

SEQ ID NO: 85212 - RNA, 64 nt, hsa
agucucuguuucauggcaacacuggauaauggcuuugugaaauuuaaaaaauuuuuguagcgac

SEQ ID NO: 85213 - RNA, 64 nt, hsa
acaaccauugcauguuugcuuuugauguaucccuuugugaaauuagcacuuuuggggccaaugg

SEQ ID NO: 85214 - RNA, 64 nt, hsa
uguuuuauaccauauaagacucuguacaguauguuugugaaagauugaacuagaauaaugaaag

SEQ ID NO: 85215 - RNA, 64 nt, hsa
auaagcaucauuaguuggggauucaguauuuuuguugugaaaauuucagaaacaauagauucuu

SEQ ID NO: 85216 - RNA, 64 nt, hsa
aacucuaaaauuuugcaugaaaauuacauccaaauugugaaaaucagaucuauuuuguuugcca

SEQ ID NO: 85217 - RNA, 64 nt, hsa
guuuuuauaaaugaauguaaaauaauuaaaugaauugugaaauggauguuuaagaaaauauagg

SEQ ID NO: 85218 - RNA, 64 nt, hsa
aauggccuugcaguuggcucaguuguuuguuguguugugaaauguuuuaggauuuuuuguauug

SEQ ID NO: 85219 - RNA, 64 nt, hsa
uguuguguugugaaauguuuuaggauuuuuuguauugugaaaauaugaauaugauuggauucag

SEQ ID NO: 85220 - RNA, 64 nt, hsa
aaauuaacuuucugaauuugaucugucuucagucuugugaaaaaguugaacaaauuuccuaauc

SEQ ID NO: 85221 - RNA, 64 nt, hsa
ugauagcuggagaacuuuaguuucaaguacuacauugugaaagcaauuauuuuguuucuaguuu

SEQ ID NO: 85222 - RNA, 64 nt, hsa
gaggaagcugggggacccauuuugcaccaugaguuugugaaaaaucuggauuaaaaaauuaccu

SEQ ID NO: 85223 - RNA, 64 nt, hsa
cuagaaaucuguggguuauacauagggcagcucuuugugaaagugguuuauuccacuggagaaa

SEQ ID NO: 85224 - RNA, 64 nt, hsa
uuacagauuuuagccagucuuugcuuuuauacuuuugugaaauuuaauuucucucuauagcacc

SEQ ID NO: 85225 - RNA, 64 nt, hsa
uaaucaaguguugauugugcgcgacugaccaggauugugaaagaguucuucuguuuguauuuuu

SEQ ID NO: 85226 - RNA, 64 nt, hsa
guagaugaaguacuuugcggugcucuguuauauauugugaaauuuauuuuauauaguaaaguga

SEQ ID NO: 85227 - RNA, 64 nt, hsa
gagauuaacauuucacaaauguuuagugaaacauuugugaaaaaagaagacuaaauuaagaccu

SEQ ID NO: 85228 - RNA, 64 nt, hsa
ccuagaagauacaauaauuagucauaaacaugcauugugaaacuguagagagcagguagcccaa

SEQ ID NO: 85229 - RNA, 64 nt, hsa
uaaaaggugacagguagauguuaauuucccuagauugugaaagugaucacgacaaucacacaac

SEQ ID NO: 85230 - RNA, 64 nt, hsa
ucauguacuucccuaggacuagaugcauaccguuuugugaaaaccagccauaggaaaacaugug

SEQ ID NO: 85231 - RNA, 64 nt, hsa
cuaugucuguguuucuuaggaauguugaagcuuuuugugaaaacuguacuguauacauauauaa

SEQ ID NO: 85232 - RNA, 64 nt, hsa
augucauuucuuccugaggaaggaagauuugauguugugaaauaacauucguuacuguugugaa

SEQ ID NO: 85233 - RNA, 64 nt, hsa
aagauuugauguugugaaauaacauucguuacuguugugaaaaucugucaugagcauuuguuua

SEQ ID NO: 85234 - RNA, 64 nt, hsa
auaacaucauacauaagucauuuaguaacagccuuugugaaaugaacuuguuuacuauuggaga

SEQ ID NO: 85235 - RNA, 64 nt, hsa
uuuuugacuuuauauuuccugagcucuccugacuuugugaaaaaggguggaugaaaaugcauuc

SEQ ID NO: 85236 - RNA, 64 nt, hsa
uauagcauugugauucuuucugggcacuggcauuuugugaaacucucaagggaaggugaugcag

SEQ ID NO: 85237 - RNA, 64 nt, hsa
uagguagccuauuuuaauauuuaaauauauauauuugugaaagaacuuuuagaacagaccuuuu

SEQ ID NO: 85238 - RNA, 64 nt, hsa
uauauacaacuaugugacuuagugcacaacacauuugugaaauaaccuacuccuauauacugac

SEQ ID NO: 85239 - RNA, 64 nt, hsa
cguugccacacaaggugcacaggcuggaagucuuuugugaaauucccaguuaaauauauacaac

SEQ ID NO: 85240 - RNA, 64 nt, hsa
gcacagugguacugucuuuuuuguaagaugcuaguugugaaauacaauuaauugcauacaguaa

SEQ ID NO: 85241 - RNA, 64 nt, hsa
agugcaagcugccuaaauauguauuauuugagaauugugaaacagauaguuauauguauacaag

SEQ ID NO: 85242 - RNA, 64 nt, hsa
uagccauacacaugguaacauugacuauggagucuugugaaaguguaaugugcgauggcuaugu

SEQ ID NO: 85243 - RNA, 64 nt, hsa
aaggaugccucugauaggaggacaaccaugcaaauugugaaauaguccugaaguucuuggauua

SEQ ID NO: 85244 - RNA, 64 nt, hsa
cacaucagcuguuaaccauuugcaccucuaaguguugugaaacuguaaauuucauacauuugac

SEQ ID NO: 85245 - RNA, 64 nt, hsa
ugugauauugggcucuucaggaagcauaaagcaauugugaaauacaguauaccgcaguggcucu

SEQ ID NO: 85246 - RNA, 64 nt, hsa
guauuucucauuucauuuuagggaugacaaacauuugugaaaccagugagagaaggcuugaugu

SEQ ID NO: 85247 - RNA, 64 nt, hsa
cagaucuggagaggagcuggcccggaaggcgugguugugaaagcgcccuucuuauguuaggagg

SEQ ID NO: 85248 - RNA, 64 nt, hsa
cagcuugaagacuggcucugggacacacugaccauugugaaauucagccuucccugugggucuc

SEQ ID NO: 85249 - RNA, 64 nt, hsa
caggaaggacaucgggcaggacugacacugugucuugugaaauuguuuuuuuguuguuauuuug

SEQ ID NO: 85250 - RNA, 64 nt, hsa
auuuacauauaagucuguuuaauuucaaaggaguuugugaaaaaaaauccauggugaaaaugaa

SEQ ID NO: 85251 - RNA, 64 nt, hsa
acuuuguuucuuacauguguacuuuuuuguuuacuugugaaaauggccaucuuuaagcauauuu

SEQ ID NO: 85252 - RNA, 64 nt, hsa
aaaguaguucuaguguggucguuauaaaccaauauugugaaaaauagcaacuauucauuuguuc

SEQ ID NO: 85253 - RNA, 64 nt, hsa
cucuugguucuauaaacuagauaaaagcagugcuuugugaaaugcaguguucucucuuaacgcc

SEQ ID NO: 85254 - RNA, 64 nt, hsa
gaauucaccaaccagggguuucuuucccuacccuuugugaaaaccaaucaauuacuagaugagu

SEQ ID NO: 85255 - RNA, 64 nt, hsa
gccuccacccaggagacugaugcacaagaucuguuugugaaagccugauuuaaaaagaaaaaaa

SEQ ID NO: 85256 - RNA, 64 nt, hsa
gccucaguguggccugagaaaucccuauguaccuuugugaaauuguugaauuaguuagugaaua

SEQ ID NO: 85257 - RNA, 64 nt, hsa
gauuaagauuuaaaaacgaaaaguaugccuugccuugugaaaauuuauccauuuaucuucaggu

SEQ ID NO: 85258 - RNA, 64 nt, hsa
cuauuacuguauguugcuuuucuaaauaaauguauugugaaaccaaaacagcugcuguuaauau

SEQ ID NO: 85259 - RNA, 64 nt, hsa
gacagcagccuaguuuucgagugugagcuugugcuugugaaagcuaaccaugcuaaccaccaag

SEQ ID NO: 85260 - RNA, 64 nt, hsa
aucagugugucaaagcauuauggcugucacaagcuugugaaaggaaaauaaaaauuacuaagcc

SEQ ID NO: 85261 - RNA, 64 nt, hsa
guuuaggauuuccaugaugacuggauguugaauuuugugaaaugcuuuuucuccauguauugag

SEQ ID NO: 85262 - RNA, 64 nt, hsa
ugucagcuacugggaauauuuuuguagagcugcauugugaaaaaaagauggucuuaccugaauc

SEQ ID NO: 85263 - RNA, 64 nt, hsa
agauaaaaaauguaucugcagcaacucugcagguuugugaaauaggaugaaacucaaucuuuuu

SEQ ID NO: 85264 - RNA, 64 nt, hsa
ucuuucaugaguguccggcaucugcuggucuucauugugaaacgugccagucgugcuuugugaa

SEQ ID NO: 85265 - RNA, 64 nt, hsa
gcuggucuucauugugaaacgugccagucgugcuuugugaaaaauaacaaaguggucacagaaa

SEQ ID NO: 85266 - RNA, 64 nt, hsa
uccauuucuggacaugacgucugugguuuaagcuuugugaaagaaugugcuuugauucgaaggg

SEQ ID NO: 85267 - RNA, 64 nt, hsa
uagauaucuagacaauuucuucuaauaaagucauuugugaaaggguacuacagcuuauugacau

SEQ ID NO: 85268 - RNA, 64 nt, hsa
aauuuacgaugucucagugauguuucugcaauaauugugaaaugcauuauugauuuaaauaaug

SEQ ID NO: 85269 - RNA, 64 nt, hsa
ccuaugggaggcaguccccagauuucaaccugaauugugaaaugugucauaagaaacaaaauau

SEQ ID NO: 85270 - RNA, 64 nt, hsa
gagcguagggugcugagcuggcgcuagggcucgguugugaaauacagcguagucagcccuugcg

SEQ ID NO: 85271 - RNA, 64 nt, hsa
uuugggguuugggcuuuuuuauacucuucucaguuugugaaacgcuaacugcacacgaagccgc

SEQ ID NO: 85272 - RNA, 64 nt, hsa
auuauacaacuaagaugaaauauugaaaaacccuuugugaaaguaacuuuucaaguaaaugcac

SEQ ID NO: 85273 - RNA, 64 nt, hsa
aauaaguucuuuuaaacagucuuuuuauuguggauugugaaaucaaaaucuggagaaaugcuua

SEQ ID NO: 85274 - RNA, 64 nt, hsa
gguaauuuacuacacuuauaaaauagugugacuuuugugaaaauuuugaauuagcuuucauaug

SEQ ID NO: 85275 - RNA, 64 nt, hsa
aaaugccacuauuguggaaauaggauaauuguaauugugaaaaaauaauuuuaaggaaaucuua

SEQ ID NO: 85276 - RNA, 64 nt, hsa
agugaauuaauuucaaauaggaaucauauugcuuuugugaaacaaagaaaauuuaccaccuugu

SEQ ID NO: 85277 - RNA, 64 nt, hsa
ggccuugauguuggggaaacagagacaaauucaguugugaaaaguauuauguauuaaguguuug

SEQ ID NO: 85278 - RNA, 64 nt, hsa
gaugcauuuauuuuaucaauaccaauuuuuguggccauggcagacauugcuaaucaaucacagc

SEQ ID NO: 85279 - RNA, 64 nt, hsa
uugacugcuggcagucuaaaacaguccacccaccccauggcacugccgcgugauucccgcggcc

SEQ ID NO: 85280 - RNA, 64 nt, hsa
aggcccaguucucgugcccuuagaggggaaugaaccauggcaccuuugagagagggggcacugu

SEQ ID NO: 85281 - RNA, 64 nt, hsa
cuggccaggacacacugaaaagcagccuuuuucaccauggcaaaccuaaaugcagucagucaca

SEQ ID NO: 85282 - RNA, 64 nt, hsa
ggaaaacaaacuuaguaucagggguccaugaagcccauggcaucauuuuugaaaauauuucuag

SEQ ID NO: 85283 - RNA, 64 nt, hsa
ucaaauuugaaugucauaguacauugugugcuaaccauggcaagcaaacauuuacauuuguuuu

SEQ ID NO: 85284 - RNA, 64 nt, hsa
gccaauguguggcucagugccuggacaaaugaugccauggcagacaguagacagaacaacacuu

SEQ ID NO: 85285 - RNA, 64 nt, hsa
ccaacaggguucuuggugaugcuggcagccauggccauggcagcggguggcauccaggcugccc

SEQ ID NO: 85286 - RNA, 64 nt, hsa
uuuggggccaaaaugaauaagcuggacuuucuccccauggcacuggggaaccauggaaguucag

SEQ ID NO: 85287 - RNA, 64 nt, hsa
gggccugggcuuucuuccaagggcacugggggagccauggcaagguuguagguaggguagagau

SEQ ID NO: 85288 - RNA, 64 nt, hsa
cugcugagucucccaggacccccuuuggagaugcccauggcaugggcacugcccacaggcucag

SEQ ID NO: 85289 - RNA, 64 nt, hsa
gcaucaaagccuuuccuugggaaucugccucccuccauggcagggguggauucgggagcuggga

SEQ ID NO: 85290 - RNA, 64 nt, hsa
ucauguuugaaaccaugcuuggcuggaccgggacccauggcaagagcaccugggcaccaguguu

SEQ ID NO: 85291 - RNA, 64 nt, hsa
uccccugcuuuuugagguuggguuaaaaugccgaccauggcagaggggucacagcucagguucc

SEQ ID NO: 85292 - RNA, 64 nt, hsa
ccugucuuugcugagagcuuuccuuuuucccaauaaauucuacucugcccuacucacucuccau

SEQ ID NO: 85293 - RNA, 64 nt, hsa
ucacaaaggaaagauuugccaauugaauaggaucaaauucuacaacuuuuccuaaggcacccac

SEQ ID NO: 85294 - RNA, 64 nt, hsa
ucugaaucuugccuagguguuucauuuaucucuaaaauucuaaaaagcauaaaucauucaaauc

SEQ ID NO: 85295 - RNA, 64 nt, hsa
auuaacacaguggaaggacaaaucuuugaagccaaaauucuaguuuuccaauauaagguuuaac

SEQ ID NO: 85296 - RNA, 64 nt, hsa
aauggaaaagaacucggcuguuaggccauucucuaaauucuaguuuagccaaaaguuuaugugu

SEQ ID NO: 85297 - RNA, 64 nt, hsa
ucuuuaacuuuauaagacuuuaaaaaaaaaacccaaauucuaagcacugacaugaaaguugccu

SEQ ID NO: 85298 - RNA, 64 nt, hsa
aaacuucaguaaguacguguuauuuuuuucaauaaaauucuauuacaguaugucauguuugcug

SEQ ID NO: 85299 - RNA, 64 nt, hsa
ucuaugcaaucugaguagagcagccacaaccaaaaaauucuacaacacacacuguucugaaagu

SEQ ID NO: 85300 - RNA, 64 nt, hsa
uuuuguuaaaauaaauaacauuuaauuugacggaaaauucuaaaaaucaacauuugguaacuua

SEQ ID NO: 85301 - RNA, 64 nt, hsa
auaacucacuuuucaguuaaguuaggcugaguugaaauucuacuaaguuuucccauauucuuga

SEQ ID NO: 85302 - RNA, 64 nt, hsa
aagguugcauaggguuuccucauuggagaccgggaaauucuauucuugggauaaauaauaguaa

SEQ ID NO: 85303 - RNA, 64 nt, hsa
accgggaaauucuauucuugggauaaauaauaguaaauucuauaggauucaauacuuaguuugc

SEQ ID NO: 85304 - RNA, 64 nt, hsa
aaacaacaacaaggacaacaacaaaaaaccagugaaauucuacaagugucccuuuuaaaaauag

SEQ ID NO: 85305 - RNA, 64 nt, hsa
gaagcgauaaacuuuaaauauacuuauuaaaaugaaauucuauuaaguuuuucagaucuuauuu

SEQ ID NO: 85306 - RNA, 64 nt, hsa
gaugcuaauggaauuacugccuuacuguacauacaaauucuacuuuaauauaaacccauaaguu

SEQ ID NO: 85307 - RNA, 64 nt, hsa
uaguuuagauauguuaagcauggauuuucccccuaaauucuacucuaaagcuucuauaaaauau

SEQ ID NO: 85308 - RNA, 64 nt, hsa
agagagaaaguaaaagcacuucacaaaaaaaugaaaauucuaaggacauacaagagccauuguu

SEQ ID NO: 85309 - RNA, 64 nt, hsa
aaucaaaagaagaacaauauuucaugacaccugaaaauucuaugaaauucagauuucagugucc

SEQ ID NO: 85310 - RNA, 64 nt, hsa
ugauuuguuccuuauuaaagcuucccagcguaugaaauucuaagcugggugggguggcucacac

SEQ ID NO: 85311 - RNA, 64 nt, hsa
agcaagacucucucucaaaaaaaaaaaaaaaaaaaaauucuagaccgaaguguacggcagugcc

SEQ ID NO: 85312 - RNA, 64 nt, hsa
uaccauucuguaucuuauauaacagaucuuugccaaauucuagauauuauaguguugccugucu

SEQ ID NO: 85313 - RNA, 64 nt, hsa
uugauguauauauauauuaagguguggcuguuuaaaauucuaaugacauauaucaacacauuca

SEQ ID NO: 85314 - RNA, 64 nt, hsa
cuuuggaaguuuucuuugccuuaguuuuggaaguaaauucuaguuuguaguucucauuuguaau

SEQ ID NO: 85315 - RNA, 64 nt, hsa
uggccacugcagauggaguuuuagaguaguaaugaaauucuaccuagaaugcaaaauuggguau

SEQ ID NO: 85316 - RNA, 64 nt, hsa
cauuuuagaauugaucagacauuagaacacagaaaaauucuaguacauuuaaauucuaaacaau

SEQ ID NO: 85317 - RNA, 64 nt, hsa
agacauuagaacacagaaaaauucuaguacauuuaaauucuaaacaauacaguggaugacccuu

SEQ ID NO: 85318 - RNA, 64 nt, hsa
gugaggucacauguuggugcugccuugcugcauaaaauucuagagggcagguuagagacaguau

SEQ ID NO: 85319 - RNA, 64 nt, hsa
auuuuucauggcaacaucagcuuucuaauguucuaaauucuauaaaaaccacccacaaagaaac

SEQ ID NO: 85320 - RNA, 64 nt, hsa
aggaaagccagccagaggaagugucagcacuuuaaaauucuagaccccaaaaaacuacaaaauc

SEQ ID NO: 85321 - RNA, 64 nt, hsa
ggaaaggaagagaacugauuccuacugaaaauucaaauucuauuaccauucuaacuuucauaaa

SEQ ID NO: 85322 - RNA, 64 nt, hsa
gcuuaaagauuauaaauuauguaaauacauuaauaaauucuaaguuucauuugacauuccauug

SEQ ID NO: 85323 - RNA, 64 nt, hsa
uucugaaaucauauaaaaagaaugucauuaguaaaaauucuaacuucguuuuguuuaaaagaca

SEQ ID NO: 85324 - RNA, 64 nt, hsa
aacucccuuuggcuacuuuugaaaaucaagaugagauauauagauauauauccauacauuuuau

SEQ ID NO: 85325 - RNA, 64 nt, hsa
uuggcuacuuuugaaaaucaagaugagauauauagauauauauccauacauuuuauugucagaa

SEQ ID NO: 85326 - RNA, 64 nt, hsa
cugacaugaauuugaagauauaucuaucuguauggauauauaucuauauguauauagauauaua

SEQ ID NO: 85327 - RNA, 64 nt, hsa
ucuaucuguauggauauauaucuauauguauauagauauauaaauacagagagauaucuggcuu

SEQ ID NO: 85328 - RNA, 64 nt, hsa
auauaucuguauagacacacauauaauauauauagauauauaaucccuauauaucuugaaucua

SEQ ID NO: 85329 - RNA, 64 nt, hsa
cacuaagcaacaauagauuuuauauguguguguggauauauauacacacacacacagaaagaug

SEQ ID NO: 85330 - RNA, 64 nt, hsa
uuuuaaugauuucuaacauuucuuaacagucauagauauauacauuuucauuuuuuguacuuga

SEQ ID NO: 85331 - RNA, 64 nt, hsa
ugaaacaaaauaucuuuaaaaguuaaaacauccagauauauaagcuauuuuuuccuaaggauaa

SEQ ID NO: 85332 - RNA, 64 nt, hsa
aaugauuugcuuuucagugagaauauauauaugagauauauauagauauauauucuagguuggg

SEQ ID NO: 85333 - RNA, 64 nt, hsa
uuuucagugagaauauauauaugagauauauauagauauauauucuagguuggguggugguaga

SEQ ID NO: 85334 - RNA, 64 nt, hsa
guuuguacacagguaacaaaaaguuacuuuaaaagauauauaaagggcuguaagcuaauugugg

SEQ ID NO: 85335 - RNA, 64 nt, hsa
cauguguacuauauuuguuuauagacuguagguggauauauaauuuaaaagcuugauuuaauaa

SEQ ID NO: 85336 - RNA, 64 nt, hsa
cucucucaauacagauaaacucacacauacuggagauauauauauaauagauauauauaaaauu

SEQ ID NO: 85337 - RNA, 64 nt, hsa
uaaacucacacauacuggagauauauauauaauagauauauauaaaauuauuuuaaugcauugu

SEQ ID NO: 85338 - RNA, 64 nt, hsa
uagauuauacauauauauacacacguguauaugagauauauaucuuauaucuccacaaacacaa

SEQ ID NO: 85339 - RNA, 64 nt, hsa
gggacguuccaugcccagguuaacaaagaacugugauauauagagugucuaauuacaaaaucau

SEQ ID NO: 85340 - RNA, 64 nt, hsa
gauauauauauauauauauaaauauauauacauggauauauaaaguuucuuugccggcauguug

SEQ ID NO: 85341 - RNA, 64 nt, hsa
uuuccgagacuguauacguccauauagauagguagauauauauauauauauauaaauauauaua

SEQ ID NO: 85342 - RNA, 64 nt, hsa
aaagaggaacuucaauuaugaaaaauuuuuaaaagauauauauaucuauauaucuauauauaug

SEQ ID NO: 85343 - RNA, 64 nt, hsa
uuauggucuuuugauaggaauagauucugcuugggauauauauccaggcacucucuaaggucua

SEQ ID NO: 85344 - RNA, 64 nt, hsa
aagaauguggccauuauuuugauuuuuugaaugagauauauaaucaaaguacugcugaacugug

SEQ ID NO: 85345 - RNA, 64 nt, hsa
uuuuuuuaaaaaucaaaagccaauugaacaacaggauauauagacugauaaauauuuaggcuga

SEQ ID NO: 85346 - RNA, 64 nt, hsa
acuuagagacugauuagacugaaaaugccuaaucgauauauauauucuugugccuaguacuuua

SEQ ID NO: 85347 - RNA, 64 nt, hsa
ugauauauaugugauauauauauaucauauauaugauauauauuuuuuuuaaugcaggaaagua

SEQ ID NO: 85348 - RNA, 64 nt, hsa
ugcugucuaaaugauauauauaugauauauaugugauauauauauaucauauauaugauauaua

SEQ ID NO: 85349 - RNA, 64 nt, hsa
cuucuuggaucugcugucuaaaugauauauauaugauauauaugugauauauauauaucauaua

SEQ ID NO: 85350 - RNA, 64 nt, hsa
ugccuggucaccuucuuggaucugcugucuaaaugauauauauaugauauauaugugauauaua

SEQ ID NO: 85351 - RNA, 64 nt, hsa
auggaagauucaagaaaacuauaaaauacuuaaagauauauaaauuuaaaaaaacauagcugca

SEQ ID NO: 85352 - RNA, 64 nt, hsa
agucaucaguucguguugucugaagcaagugggagauauauaaauacccaguagcuaaaauggu

SEQ ID NO: 85353 - RNA, 64 nt, hsa
auauauauuucccccuauggggccugacugcacugauauauauuuuuuuuaaagagcaacugcc

SEQ ID NO: 85354 - RNA, 64 nt, hsa
auauuuuacaauaaaagcaacuuuuaauuguauagauauauauuucccccuauggggccugacu

SEQ ID NO: 85355 - RNA, 64 nt, hsa
aaaaacuaugaggaaaacuuauauuagaacuuuugauauauacuaaaauacugauuaucuuaau

SEQ ID NO: 85356 - RNA, 64 nt, hsa
ugagagaacgaaagccaaagugucauuuaagagagauauauaugaaaaaguaacauuaauauau

SEQ ID NO: 85357 - RNA, 64 nt, hsa
caagugccauuagaugauauauauguaggccuuugauauauaaugcuuuguguacaaaaauggu

SEQ ID NO: 85358 - RNA, 64 nt, hsa
uuuaagacuuauuauaauucaagugccauuagaugauauauauguaggccuuugauauauaaug

SEQ ID NO: 85359 - RNA, 64 nt, hsa
aguaauaguguauggcauuggggucuucagagucgauauauagguagaucucuuuagucuuuuc

SEQ ID NO: 85360 - RNA, 64 nt, hsa
uguauauauagauguauauauauacacacacagagauauauacauauggcuguacuuuugcaua

SEQ ID NO: 85361 - RNA, 64 nt, hsa
uaaucuacaauuggcuuuuuaaaaauaaccuguugauauauaauugucaguccaaaugaauaug

SEQ ID NO: 85362 - RNA, 64 nt, hsa
cuaagcuuguauaugauuauggugggugauuucagauauauaagcagauaagcacagauuauug

SEQ ID NO: 85363 - RNA, 64 nt, hsa
uuguucacucguacaugccuagccuacagaaggggauauauauuaugaaauggucauuuuucug

SEQ ID NO: 85364 - RNA, 64 nt, hsa
aacaguagcuauagccauuaaccaaaggacagaugauauauauauauaugauauauauauauau

SEQ ID NO: 85365 - RNA, 64 nt, hsa
cauuaaccaaaggacagaugauauauauauauaugauauauauauauauauaaguucuuuuuua

SEQ ID NO: 85366 - RNA, 64 nt, hsa
ucucuuuccuccuuaaaaacaaaauuuauauauagauauauauauauauauaaauaauauacuu

SEQ ID NO: 85367 - RNA, 64 nt, hsa
uauacagauaucuauaucuauauauauauauacagauauauauauaugacgcgucacagaaucu

SEQ ID NO: 85368 - RNA, 64 nt, hsa
ugagagacugggaagggaaaagcauauauauauagauauauagagauauagauauauauacagg

SEQ ID NO: 85369 - RNA, 64 nt, hsa
gaaaagcauauauauauagauauauagagauauagauauauauacaggaaacaccgcauccuug

SEQ ID NO: 85370 - RNA, 64 nt, hsa
aggcuccuucaucccaguuuugagaugaagcuguacuccccauuucccacugcccuugacuuug

SEQ ID NO: 85371 - RNA, 64 nt, hsa
ucccugcccugccauccugaccuccagagcccucacuccccacuccccguguuuggugucuuag

SEQ ID NO: 85372 - RNA, 64 nt, hsa
aaaggugggcaaaguucccucugacucuucccccacuccccaucuuacugauuuaauuuaauuu

SEQ ID NO: 85373 - RNA, 64 nt, hsa
cacuccccaucuuacugauuuaauuuaauuuuucacuccccagagucuaauauggauucugacu

SEQ ID NO: 85374 - RNA, 64 nt, hsa
ccagcagagagaguugaccccuccugaacuggccacuccccagugcuccugugcagggauagga

SEQ ID NO: 85375 - RNA, 64 nt, hsa
accccucuguccagccagcuccugcacaaauggaacuccccagggccuccaggacuggggcuug

SEQ ID NO: 85376 - RNA, 64 nt, hsa
ggaagauagcacaaggccuaaugaggucacccugacuccccaccccagcauuucauucauacca

SEQ ID NO: 85377 - RNA, 64 nt, hsa
gcugcucagugcuuuucucuuccacuuuccugccacuccccacuacccucggagagagguggug

SEQ ID NO: 85378 - RNA, 64 nt, hsa
acgccaggcaccacagccuccaaaaauggcagugacuccccagcccagcaccccuuccucgugg

SEQ ID NO: 85379 - RNA, 64 nt, hsa
cuccaacuccauacuccacuccaagugccccaccacuccccaaccccucuccaggccugucaag

SEQ ID NO: 85380 - RNA, 64 nt, hsa
aggcgccacuuuguauauuucaggacugggaccuacuccccagaugccaccugagaggagcuuc

SEQ ID NO: 85381 - RNA, 64 nt, hsa
ugguggagcugugcucccuugagugcacuugagcacuccccagaccagaucacuuuuuggacac

SEQ ID NO: 85382 - RNA, 64 nt, hsa
cccacccaccacccugcugugcuugggaacccccacuccccacuccccacaucccaacauccug

SEQ ID NO: 85383 - RNA, 64 nt, hsa
accacccugcugugcuugggaacccccacuccccacuccccacaucccaacauccuggugucug

SEQ ID NO: 85384 - RNA, 64 nt, hsa
cuaccaagcugaagguauccaaauuugccaucucacuccccaaggcucgggugggggcugaggc

SEQ ID NO: 85385 - RNA, 64 nt, hsa
ugaaagucccugacaugaagcucccagagauaaaacuccccaaggugccugagauggcugugcc

SEQ ID NO: 85386 - RNA, 64 nt, hsa
ccgaggugcagcugccaaaagucucagagaugaaacuccccaaggugccugaaauggccgugcc

SEQ ID NO: 85387 - RNA, 64 nt, hsa; identical to SEQ ID NO: 73636

SEQ ID NO: 85388 - RNA, 64 nt, hsa; identical to SEQ ID NO: 73637

SEQ ID NO: 85389 - RNA, 64 nt, hsa; identical to SEQ ID NO: 73638

SEQ ID NO: 85390 - RNA, 64 nt, hsa; identical to SEQ ID NO: 73639

SEQ ID NO: 85391 - RNA, 64 nt, hsa; identical to SEQ ID NO: 73640

SEQ ID NO: 85392 - RNA, 64 nt, hsa; identical to SEQ ID NO: 73641

SEQ ID NO: 85393 - RNA, 64 nt, hsa; identical to SEQ ID NO: 73642

SEQ ID NO: 85394 - RNA, 64 nt, hsa; identical to SEQ ID NO: 73643

SEQ ID NO: 85395 - RNA, 64 nt, hsa; identical to SEQ ID NO: 73644

SEQ ID NO: 85396 - RNA, 64 nt, hsa; identical to SEQ ID NO: 73645

SEQ ID NO: 85397 - RNA, 64 nt, hsa; identical to SEQ ID NO: 73646

SEQ ID NO: 85398 - RNA, 64 nt, hsa; identical to SEQ ID NO: 73647

SEQ ID NO: 85399 - RNA, 64 nt, hsa; identical to SEQ ID NO: 73648

SEQ ID NO: 85400 - RNA, 64 nt, hsa; identical to SEQ ID NO: 73649

SEQ ID NO: 85401 - RNA, 64 nt, hsa; identical to SEQ ID NO: 73650

SEQ ID NO: 85402 - RNA, 64 nt, hsa; identical to SEQ ID NO: 73651

SEQ ID NO: 85403 - RNA, 64 nt, hsa; identical to SEQ ID NO: 73652

SEQ ID NO: 85404 - RNA, 64 nt, hsa; identical to SEQ ID NO: 73653

SEQ ID NO: 85405 - RNA, 64 nt, hsa; identical to SEQ ID NO: 73654

SEQ ID NO: 85406 - RNA, 64 nt, hsa; identical to SEQ ID NO: 73655

SEQ ID NO: 85407 - RNA, 64 nt, hsa; identical to SEQ ID NO: 73656

SEQ ID NO: 85408 - RNA, 64 nt, hsa; identical to SEQ ID NO: 73657

SEQ ID NO: 85409 - RNA, 64 nt, hsa; identical to SEQ ID NO: 73658

SEQ ID NO: 85410 - RNA, 64 nt, hsa; identical to SEQ ID NO: 73659

SEQ ID NO: 85411 - RNA, 64 nt, hsa; identical to SEQ ID NO: 73660

SEQ ID NO: 85412 - RNA, 64 nt, hsa; identical to SEQ ID NO: 73661

SEQ ID NO: 85413 - RNA, 64 nt, hsa; identical to SEQ ID NO: 73662

SEQ ID NO: 85414 - RNA, 64 nt, hsa; identical to SEQ ID NO: 73663

SEQ ID NO: 85415 - RNA, 63 nt, hsa; identical to SEQ ID NO: 73664

SEQ ID NO: 85416 - RNA, 64 nt, hsa; identical to SEQ ID NO: 73665

SEQ ID NO: 85417 - RNA, 64 nt, hsa; identical to SEQ ID NO: 73666

SEQ ID NO: 85418 - RNA, 64 nt, hsa; identical to SEQ ID NO: 73667

SEQ ID NO: 85419 - RNA, 64 nt, hsa; identical to SEQ ID NO: 73668

SEQ ID NO: 85420 - RNA, 64 nt, hsa; identical to SEQ ID NO: 73669

SEQ ID NO: 85421 - RNA, 64 nt, hsa; identical to SEQ ID NO: 73670

SEQ ID NO: 85422 - RNA, 64 nt, hsa; identical to SEQ ID NO: 73671

SEQ ID NO: 85423 - RNA, 64 nt, hsa; identical to SEQ ID NO: 73672

SEQ ID NO: 85424 - RNA, 64 nt, hsa; identical to SEQ ID NO: 73673

SEQ ID NO: 85425 - RNA, 64 nt, hsa; identical to SEQ ID NO: 73674

SEQ ID NO: 85426 - RNA, 64 nt, hsa; identical to SEQ ID NO: 73675

SEQ ID NO: 85427 - RNA, 64 nt, hsa; identical to SEQ ID NO: 73676

SEQ ID NO: 85428 - RNA, 64 nt, hsa; identical to SEQ ID NO: 73677

SEQ ID NO: 85429 - RNA, 64 nt, hsa; identical to SEQ ID NO: 73678

SEQ ID NO: 85430 - RNA, 64 nt, hsa; identical to SEQ ID NO: 73679

SEQ ID NO: 85431 - RNA, 64 nt, hsa; identical to SEQ ID NO: 73680

SEQ ID NO: 85432 - RNA, 64 nt, hsa; identical to SEQ ID NO: 73681

SEQ ID NO: 85433 - RNA, 64 nt, hsa; identical to SEQ ID NO: 73682

SEQ ID NO: 85434 - RNA, 64 nt, hsa; identical to SEQ ID NO: 73683

SEQ ID NO: 85435 - RNA, 64 nt, hsa; identical to SEQ ID NO: 73684

SEQ ID NO: 85436 - RNA, 64 nt, hsa; identical to SEQ ID NO: 73685

SEQ ID NO: 85437 - RNA, 64 nt, hsa; identical to SEQ ID NO: 73686

SEQ ID NO: 85438 - RNA, 64 nt, hsa; identical to SEQ ID NO: 73687

SEQ ID NO: 85439 - RNA, 64 nt, hsa; identical to SEQ ID NO: 73688

SEQ ID NO: 85440 - RNA, 64 nt, hsa; identical to SEQ ID NO: 73689

SEQ ID NO: 85441 - RNA, 64 nt, hsa; identical to SEQ ID NO: 73690

SEQ ID NO: 85442 - RNA, 64 nt, hsa; identical to SEQ ID NO: 73691

SEQ ID NO: 85443 - RNA, 64 nt, hsa; identical to SEQ ID NO: 73692

SEQ ID NO: 85444 - RNA, 64 nt, hsa; identical to SEQ ID NO: 73693

SEQ ID NO: 85445 - RNA, 64 nt, hsa; identical to SEQ ID NO: 73694

SEQ ID NO: 85446 - RNA, 64 nt, hsa; identical to SEQ ID NO: 73695

SEQ ID NO: 85447 - RNA, 64 nt, hsa; identical to SEQ ID NO: 73696

SEQ ID NO: 85448 - RNA, 64 nt, hsa; identical to SEQ ID NO: 73697

SEQ ID NO: 85449 - RNA, 64 nt, hsa; identical to SEQ ID NO: 73698

SEQ ID NO: 85450 - RNA, 64 nt, hsa; identical to SEQ ID NO: 73699

SEQ ID NO: 85451 - RNA, 64 nt, hsa; identical to SEQ ID NO: 73700

SEQ ID NO: 85452 - RNA, 64 nt, hsa; identical to SEQ ID NO: 73701

SEQ ID NO: 85453 - RNA, 64 nt, hsa; identical to SEQ ID NO: 73702

SEQ ID NO: 85454 - RNA, 64 nt, hsa; identical to SEQ ID NO: 73703

SEQ ID NO: 85455 - RNA, 64 nt, hsa; identical to SEQ ID NO: 73704

SEQ ID NO: 85456 - RNA, 64 nt, hsa; identical to SEQ ID NO: 73705

SEQ ID NO: 85457 - RNA, 64 nt, hsa; identical to SEQ ID NO: 73706

SEQ ID NO: 85458 - RNA, 64 nt, hsa; identical to SEQ ID NO: 73707

SEQ ID NO: 85459 - RNA, 64 nt, hsa; identical to SEQ ID NO: 79919

SEQ ID NO: 85460 - RNA, 64 nt, hsa; identical to SEQ ID NO: 79920

SEQ ID NO: 85461 - RNA, 64 nt, hsa; identical to SEQ ID NO: 79921

SEQ ID NO: 85462 - RNA, 64 nt, hsa; identical to SEQ ID NO: 79922

SEQ ID NO: 85463 - RNA, 64 nt, hsa; identical to SEQ ID NO: 79923

SEQ ID NO: 85464 - RNA, 64 nt, hsa; identical to SEQ ID NO: 79924

SEQ ID NO: 85465 - RNA, 64 nt, hsa; identical to SEQ ID NO: 79925

SEQ ID NO: 85466 - RNA, 64 nt, hsa; identical to SEQ ID NO: 79926

SEQ ID NO: 85467 - RNA, 64 nt, hsa; identical to SEQ ID NO: 79927

SEQ ID NO: 85468 - RNA, 64 nt, hsa; identical to SEQ ID NO: 79928

SEQ ID NO: 85469 - RNA, 64 nt, hsa; identical to SEQ ID NO: 79929

SEQ ID NO: 85470 - RNA, 64 nt, hsa; identical to SEQ ID NO: 79930

SEQ ID NO: 85471 - RNA, 64 nt, hsa; identical to SEQ ID NO: 79931

SEQ ID NO: 85472 - RNA, 64 nt, hsa; identical to SEQ ID NO: 79932

SEQ ID NO: 85473 - RNA, 64 nt, hsa; identical to SEQ ID NO: 79933

SEQ ID NO: 85474 - RNA, 64 nt, hsa; identical to SEQ ID NO: 79934

SEQ ID NO: 85475 - RNA, 64 nt, hsa; identical to SEQ ID NO: 79935

SEQ ID NO: 85476 - RNA, 64 nt, hsa; identical to SEQ ID NO: 79936

SEQ ID NO: 85477 - RNA, 64 nt, hsa; identical to SEQ ID NO: 79937

SEQ ID NO: 85478 - RNA, 64 nt, hsa; identical to SEQ ID NO: 79938

SEQ ID NO: 85479 - RNA, 64 nt, hsa; identical to SEQ ID NO: 79939

SEQ ID NO: 85480 - RNA, 64 nt, hsa
ugccucagccuccugaguagcugggacuacaggugccugccaccacacccagcuaauuuuuuuu

SEQ ID NO: 85481 - RNA, 64 nt, hsa
aacccuuuuguuuguuuccaauugagucauuacugccugccacuaagaaacgugcuugaaucua

SEQ ID NO: 85482 - RNA, 64 nt, hsa
ugccucagccucccaaguagcugggauuacaggugccugccaccaugccuggcuaauuuuuuug

SEQ ID NO: 85483 - RNA, 64 nt, hsa
ugccucagccuccugaguagcugggacuacaggcgccugccaccacgcccagcuaauuuuugua

SEQ ID NO: 85484 - RNA, 64 nt, hsa
cucagggcugguucccagcuggccugagcagggggccugccaccagacccacccacgcucugac

SEQ ID NO: 85485 - RNA, 64 nt, hsa
agcucuaccacauucaggaggccucaggaggccagccugccaugagagcacauguccucuggcc

SEQ ID NO: 85486 - RNA, 64 nt, hsa
cagaagcacaaaugcuguccauggccgugaggcugccugccaggugaauggacauagcgugaga

SEQ ID NO: 85487 - RNA, 64 nt, hsa
gguucaaaccccaccucaguagguggaggggagcgccugccauugguuguauuuuuguucugag

SEQ ID NO: 85488 - RNA, 64 nt, hsa
agagcaaacuagggucucaguauugagaaacgcagccugccagggaaucacagagacaucgggg

SEQ ID NO: 85489 - RNA, 64 nt, hsa
ccauugcuauacuguaccagugucaaaugcugcagccugccaagcugugauuuugugaggcuug

SEQ ID NO: 85490 - RNA, 64 nt, hsa
caguguacuggugugggguggaggcccuggcucugccugccauccuagggcccuguucuggcug

SEQ ID NO: 85491 - RNA, 64 nt, hsa
accaucaucauuaacugagcaccagcugugcuaagccugccacgggcguauccuugcagccuca

SEQ ID NO: 85492 - RNA, 64 nt, hsa
uagaggagccacgugccgcccagccaccuucaaugccugccacccugcccgaggauguacagag

SEQ ID NO: 85493 - RNA, 64 nt, hsa
cuccagccucaaucuguuccguagcucagagccugccugccagggccaagugcccuagagucca

SEQ ID NO: 85494 - RNA, 64 nt, hsa
cagcuacugcccagggcccgcaguguuggcugcugccugccacagccucugugacugcagugga

SEQ ID NO: 85495 - RNA, 64 nt, hsa
ucugugacugcaguggagcggcgaauucccuguggccugccaugccuucggcaucagaggaugg

SEQ ID NO: 85496 - RNA, 64 nt, hsa
cuucugcagagaaguucccuucaccgcauccgucgccugccaaacugaaggcuacugcagguca

SEQ ID NO: 85497 - RNA, 64 nt, hsa
ugccaaacugaaggcuacugcaggucacugaguugccugccauccaaaggggaugggcgggauu

SEQ ID NO: 85498 - RNA, 64 nt, hsa
aagcuguggcagcucuuuucccuguucaccucccgccugccagggaaggcaggacccgcucugc

SEQ ID NO: 85499 - RNA, 64 nt, hsa
ugccucagccuccccaguagcugggacuacaggcgccugccaacaugccuggcuaauuuuuuuu

SEQ ID NO: 85500 - RNA, 64 nt, hsa
gcaccaccuaccuggcuuccugcaaggccuucacgccugccagggucagcugcagcccccacuc

SEQ ID NO: 85501 - RNA, 64 nt, hsa
ugaaauucaaagaaaacuuuuucuauugcuaggagccugccagaacaaaggccaauauauaaug

SEQ ID NO: 85502 - RNA, 64 nt, hsa
gaaggaguuuuuacaugccacagcucagcugucugccugccacuuuguuguaaacauugcaaaa

SEQ ID NO: 85503 - RNA, 64 nt, hsa
aggcccugggucccacgcccugggugcccacauggccugccaacuagggccugcaaauggagug

SEQ ID NO: 85504 - RNA, 64 nt, hsa
ggaguccuggccccugaaucaccagagccaccaagccugccagaggggucucauucauggcuug

SEQ ID NO: 85505 - RNA, 64 nt, hsa
ggagcagggggaaaaggugcacuuggccaguggcgccugccaggagugaguccaugcguugucu

SEQ ID NO: 85506 - RNA, 64 nt, hsa
ugcaaagcuagugaguagcugucagguucccugggccugccaucagggaucacuaaauuuaagg

SEQ ID NO: 85507 - RNA, 64 nt, hsa
agauugcagauguucugucuuccaucccaaacaagccugccaugagguaggauccuagggguuu

SEQ ID NO: 85508 - RNA, 64 nt, hsa
uuaaaauauugucaguuuuucaucgucgucccuagccugccaacagccaucugcccagacagcc

SEQ ID NO: 85509 - RNA, 64 nt, hsa
ggcagggcugagcuggagccgccccucucagcccgccugccacggccuuuccuuaaaggccauc

SEQ ID NO: 85510 - RNA, 64 nt, hsa
ggggcgaggcugggggagggcggcgccgcggcgggccugccagcugggggccuuugcggcgcgc

SEQ ID NO: 85511 - RNA, 64 nt, hsa
cggggaaaaugcaggcugaguggggcgaccuccugccugccaggagcccccuuucaggacacag

SEQ ID NO: 85512 - RNA, 64 nt, hsa
ugggcuugucaucugcuggaacaggcgccauggggccugccagcccugccugccaggucccuua

SEQ ID NO: 85513 - RNA, 64 nt, hsa
ugcuggaacaggcgccauggggccugccagcccugccugccaggucccuuagcaccuguccccc

SEQ ID NO: 85514 - RNA, 64 nt, hsa
guuccagcacuguucaggcugccugucaucccgggccugccagcuccccugagugaugagcacu

SEQ ID NO: 85515 - RNA, 64 nt, hsa
ggccucgccagcccucuggggcauugugggagaugccugccaggaaugagcaagcucuguugcu

SEQ ID NO: 85516 - RNA, 64 nt, hsa
ggaucucacagaguucuuaagauggaauuuuccagccugccagucaugaaucucagacagccug

SEQ ID NO: 85517 - RNA, 64 nt, hsa
aauuuuccagccugccagucaugaaucucagacagccugccaccuauugcccugauuuguguua

SEQ ID NO: 85518 - RNA, 64 nt, hsa
guuucccuguguggaccauggggaucagagucuggccugccaggcuccucuccccguuuucucu

SEQ ID NO: 85519 - RNA, 64 nt, hsa
aaagcaggcugaucgggcaaugggagguggccaggccugccagccccucggcucugccgcggug

SEQ ID NO: 85520 - RNA, 64 nt, hsa
ggacuuugagcgacucucgggcaauuuucccuucgccugccaugggcuucacccacccccacgc

SEQ ID NO: 85521 - RNA, 64 nt, hsa
cuuucuuaugcccgggagccgcguugucccaagagccugccacccucccccuucaaugcaccuc

SEQ ID NO: 85522 - RNA, 64 nt, hsa
aagggacuacucucuucaccccuuuauuccagcugccugccaccccagacccccaccucccacc

SEQ ID NO: 85523 - RNA, 64 nt, hsa
caugaggggccaccucauccagggccccucccuugccugccacuuuggggacuugagggggguc

SEQ ID NO: 85524 - RNA, 64 nt, hsa
ggcauccagcgcugccuggaggcaggaaggagaggcagggcaggacacgcuggucugagaugag

SEQ ID NO: 85525 - RNA, 64 nt, hsa
ugggccccugaaguuccaucuccgagaguggugugcagggcaggccagggcccaugcuggcugc

SEQ ID NO: 85526 - RNA, 64 nt, hsa
ucccacaugugucucccaagccugcuagggacaggcagggcagggacagccaccuuggaaggcc

SEQ ID NO: 85527 - RNA, 64 nt, hsa
accuuugauugucuuuccagagaugcugcucucugcagggcaccaccuucaaggcacagcccuu

SEQ ID NO: 85528 - RNA, 64 nt, hsa
accugccagaauuguugccugagcgugccaggcugcagggcaggcaguaaaaggcccccacaua

SEQ ID NO: 85529 - RNA, 64 nt, hsa
ucuggcugguuccacuaaaugugccagcccaaaugcagggcaugggcucugguucugccaggag

SEQ ID NO: 85530 - RNA, 64 nt, hsa
agccuggccuuuccuggacagacugaagagcugagcagggcacugccagccugucccucauuac

SEQ ID NO: 85531 - RNA, 64 nt, hsa
cuaggaucuguccaagacacucucaggccuggaggcagggcauagaaucaguucuucacucucc

SEQ ID NO: 85532 - RNA, 64 nt, hsa
gacaugcugggaacucgcauggaacaggagggcagcagggcacuaaccuccgaagccagacucu

SEQ ID NO: 85533 - RNA, 64 nt, hsa
uugacaucacuggcauggugguugggacccaguggcagggcacagggccuggcccauguauggc

SEQ ID NO: 85534 - RNA, 64 nt, hsa
cccagccucaaauccaggacccugccaggcacaggcagggcaggaccagcccacgcugacuaca

SEQ ID NO: 85535 - RNA, 64 nt, hsa
auguggaugagugaagggagccagguacacggcagcagggcagaggagacuauggggagcccac

SEQ ID NO: 85536 - RNA, 55 nt, hsa
ccaaagagaacaacaacugacaagggcagggcaccgccuccucuguuuucuaggc

SEQ ID NO: 85537 - RNA, 64 nt, hsa
auguugcgugagaggcccauccuguguaauuggagcagggcacacuugcuuccuguugaguuaa

SEQ ID NO: 85538 - RNA, 64 nt, hsa
gaacauuuauuugaaccucuuagccacauuuccagcagggcaaaccaacugaugcccuggaaga

SEQ ID NO: 85539 - RNA, 64 nt, hsa
cgcugggcgcucccgggccgcgcgucugcguuaggcagggcaggguagugcagggcacaccuuc

SEQ ID NO: 85540 - RNA, 64 nt, hsa
ggccgcgcgucugcguuaggcagggcaggguagugcagggcacaccuuccccgggguucggggu

SEQ ID NO: 85541 - RNA, 64 nt, hsa
gcaggcucaccuguuccugggacugucugagauggcagggcacuugcccugguggcucccaccu

SEQ ID NO: 85542 - RNA, 64 nt, hsa
aguccaggcgccuccacgcugcaccgugaggacugcagggcauguccccgugaggggcuauggg

SEQ ID NO: 85543 - RNA, 64 nt, hsa
gggcaggcuguuacuggcuaaauuaaaacccuuggcagggcaucgacugugugcgaggcaaugc

SEQ ID NO: 85544 - RNA, 64 nt, hsa
aaaugaacccaucuuuugccugccaugaaucauugcagggcaggcuguuacuggcuaaauuaaa

SEQ ID NO: 85545 - RNA, 64 nt, hsa
caccugacuuggcuggggaggaccagggcccugggcagggcagggcagccugucacccguguga

SEQ ID NO: 85546 - RNA, 64 nt, hsa
gacuuggcuggggaggaccagggcccugggcagggcagggcagccugucacccgugugaagaug

SEQ ID NO: 85547 - RNA, 64 nt, hsa
ggauuucuguucugagagcagcgugggcagcaaggcagggcagcccagagguggcagcggcagg

SEQ ID NO: 85548 - RNA, 64 nt, hsa
guuguguguuuuuccuggugcuucaagagcgugugcagggcaagugccgucacugggaacugca

SEQ ID NO: 85549 - RNA, 64 nt, hsa
aagcacuuucauggcugcccucuggcagggcagggcagggcagugacacuguaggagcauagca

SEQ ID NO: 85550 - RNA, 64 nt, hsa
ccucaaagcacuuucauggcugcccucuggcagggcagggcagggcagugacacuguaggagca

SEQ ID NO: 85551 - RNA, 64 nt, hsa
gaugaccucaaagcacuuucauggcugcccucuggcagggcagggcagggcagugacacuguag

SEQ ID NO: 85552 - RNA, 64 nt, hsa
gccuccucccgacuugacucaccgucaccuggaagcagggcaccagcugcuggggugggacuug

SEQ ID NO: 85553 - RNA, 64 nt, hsa
agcagcaggauggugaaguaguaaacugggggaggcagggcacagggagaugcucaggggccag

SEQ ID NO: 85554 - RNA, 64 nt, hsa
ugugcccacugcugcuccauguguaccaagagcagcagggcagaagggcccucccuccagccua

SEQ ID NO: 85555 - RNA, 64 nt, hsa
cccccacccaaggccgggcccagccagaggaggggcagggcagggcaggagguuucuggauguu

SEQ ID NO: 85556 - RNA, 64 nt, hsa
acccaaggccgggcccagccagaggaggggcagggcagggcaggagguuucuggauguuuguug

SEQ ID NO: 85557 - RNA, 64 nt, hsa
cuuuccccaccgagagcugggccgggagaggaccgcagggcagguggcgugagguccguguugc

SEQ ID NO: 85558 - RNA, 64 nt, hsa
ggcugguuggcugggcccagcuccugggggcugggcagggcagggcagggccggguccacuucc

SEQ ID NO: 85559 - RNA, 64 nt, hsa
guuggcugggcccagcuccugggggcugggcagggcagggcagggccggguccacuuccauugu

SEQ ID NO: 85560 - RNA, 64 nt, hsa
uggcagccggaggugcguaagcccacugaacgcugcagggcagggaagaaauaaauggucucau

SEQ ID NO: 85561 - RNA, 64 nt, hsa
ggccugaaaggucugccucacacaggccuucccugcagggcagcccaugguggcagccggaggu

SEQ ID NO: 85562 - RNA, 64 nt, hsa
cggacaggacagacacguugagaagcugcagggagcagggcaccaagggagugugcacugugcu

SEQ ID NO: 85563 - RNA, 64 nt, hsa
gggugucuuuccagccuuugccagucuagccccagcagggcaccguguaugaaugcaguuuggu

SEQ ID NO: 85564 - RNA, 62 nt, hsa
acuccaucccagaugccugaagccacugcagggcagggcaggcagggggggcuucccgcccu

SEQ ID NO: 85565 - RNA, 57 nt, hsa
acuccaucccagaugccugaagccacugcagggcagggcaggcagggggggcuuccc

SEQ ID NO: 85566 - RNA, 64 nt, hsa
agagagaaccgagaggucccaguacaagggcagggcagggcagggaagcugccaagcuccgcac

SEQ ID NO: 85567 - RNA, 64 nt, hsa
cugagagagagaaccgagaggucccaguacaagggcagggcagggcagggaagcugccaagcuc

SEQ ID NO: 85568 - RNA, 64 nt, hsa
ccagaaggagcaggcccugggccuccaccucugugcagggcacagaaggcugggguggggggag

SEQ ID NO: 85569 - RNA, 64 nt, hsa
cucucuugccaaaaagcacaagauguugaggcgagcagggcaggcccccggggaggggccagag

SEQ ID NO: 85570 - RNA, 64 nt, hsa
ccccugggcaccaagggagcgagggggaauaagagcagggcagcccccugggugccgcugucag

SEQ ID NO: 85571 - RNA, 64 nt, hsa
auuggacuggagugaaugggcacagggguggagcgcagggcagccccagucaccacgagcuguu

SEQ ID NO: 85572 - RNA, 64 nt, hsa; identical to SEQ ID NO: 81841

SEQ ID NO: 85573 - RNA, 64 nt, hsa; identical to SEQ ID NO: 81842

SEQ ID NO: 85574 - RNA, 64 nt, hsa; identical to SEQ ID NO: 81843

SEQ ID NO: 85575 - RNA, 64 nt, hsa; identical to SEQ ID NO: 81844

SEQ ID NO: 85576 - RNA, 64 nt, hsa; identical to SEQ ID NO: 81845

SEQ ID NO: 85577 - RNA, 64 nt, hsa; identical to SEQ ID NO: 81846

SEQ ID NO: 85578 - RNA, 64 nt, hsa; identical to SEQ ID NO: 81847

SEQ ID NO: 85579 - RNA, 64 nt, hsa; identical to SEQ ID NO: 81848

SEQ ID NO: 85580 - RNA, 64 nt, hsa; identical to SEQ ID NO: 81849

SEQ ID NO: 85581 - RNA, 64 nt, hsa; identical to SEQ ID NO: 81850

SEQ ID NO: 85582 - RNA, 64 nt, hsa; identical to SEQ ID NO: 81851

SEQ ID NO: 85583 - RNA, 61 nt, hsa; identical to SEQ ID NO: 81852

SEQ ID NO: 85584 - RNA, 64 nt, hsa; identical to SEQ ID NO: 81853

SEQ ID NO: 85585 - RNA, 51 nt, hsa; identical to SEQ ID NO: 81854

SEQ ID NO: 85586 - RNA, 64 nt, hsa; identical to SEQ ID NO: 81855

SEQ ID NO: 85587 - RNA, 64 nt, hsa; identical to SEQ ID NO: 81856

SEQ ID NO: 85588 - RNA, 64 nt, hsa; identical to SEQ ID NO: 81857

SEQ ID NO: 85589 - RNA, 64 nt, hsa; identical to SEQ ID NO: 81858

SEQ ID NO: 85590 - RNA, 64 nt, hsa; identical to SEQ ID NO: 81859

SEQ ID NO: 85591 - RNA, 64 nt, hsa; identical to SEQ ID NO: 81860

SEQ ID NO: 85592 - RNA, 64 nt, hsa; identical to SEQ ID NO: 81861

SEQ ID NO: 85593 - RNA, 64 nt, hsa; identical to SEQ ID NO: 81862

SEQ ID NO: 85594 - RNA, 64 nt, hsa; identical to SEQ ID NO: 81863

SEQ ID NO: 85595 - RNA, 64 nt, hsa; identical to SEQ ID NO: 81864

SEQ ID NO: 85596 - RNA, 64 nt, hsa; identical to SEQ ID NO: 81865

SEQ ID NO: 85597 - RNA, 64 nt, hsa; identical to SEQ ID NO: 81866

SEQ ID NO: 85598 - RNA, 64 nt, hsa; identical to SEQ ID NO: 81867

SEQ ID NO: 85599 - RNA, 64 nt, hsa; identical to SEQ ID NO: 81868

SEQ ID NO: 85600 - RNA, 64 nt, hsa; identical to SEQ ID NO: 81869

SEQ ID NO: 85601 - RNA, 64 nt, hsa; identical to SEQ ID NO: 81870

SEQ ID NO: 85602 - RNA, 64 nt, hsa; identical to SEQ ID NO: 81871

SEQ ID NO: 85603 - RNA, 64 nt, hsa; identical to SEQ ID NO: 81872

SEQ ID NO: 85604 - RNA, 64 nt, hsa; identical to SEQ ID NO: 81873

SEQ ID NO: 85605 - RNA, 64 nt, hsa; identical to SEQ ID NO: 81874

SEQ ID NO: 85606 - RNA, 64 nt, hsa; identical to SEQ ID NO: 81875

SEQ ID NO: 85607 - RNA, 64 nt, hsa; identical to SEQ ID NO: 81876

SEQ ID NO: 85608 - RNA, 64 nt, hsa; identical to SEQ ID NO: 81877

SEQ ID NO: 85609 - RNA, 64 nt, hsa; identical to SEQ ID NO: 81878

SEQ ID NO: 85610 - RNA, 64 nt, hsa; identical to SEQ ID NO: 81879

SEQ ID NO: 85611 - RNA, 64 nt, hsa; identical to SEQ ID NO: 81880

SEQ ID NO: 85612 - RNA, 64 nt, hsa; identical to SEQ ID NO: 81881

SEQ ID NO: 85613 - RNA, 64 nt, hsa; identical to SEQ ID NO: 81882

SEQ ID NO: 85614 - RNA, 64 nt, hsa; identical to SEQ ID NO: 81883

SEQ ID NO: 85615 - RNA, 64 nt, hsa; identical to SEQ ID NO: 81884

SEQ ID NO: 85616 - RNA, 64 nt, hsa; identical to SEQ ID NO: 81885

SEQ ID NO: 85617 - RNA, 64 nt, hsa; identical to SEQ ID NO: 81886

SEQ ID NO: 85618 - RNA, 64 nt, hsa; identical to SEQ ID NO: 81887

SEQ ID NO: 85619 - RNA, 64 nt, hsa; identical to SEQ ID NO: 81888

SEQ ID NO: 85620 - RNA, 64 nt, hsa; identical to SEQ ID NO: 81889

SEQ ID NO: 85621 - RNA, 64 nt, hsa; identical to SEQ ID NO: 81890

SEQ ID NO: 85622 - RNA, 64 nt, hsa; identical to SEQ ID NO: 81891

SEQ ID NO: 85623 - RNA, 64 nt, hsa; identical to SEQ ID NO: 81892

SEQ ID NO: 85624 - RNA, 64 nt, hsa; identical to SEQ ID NO: 81893

SEQ ID NO: 85625 - RNA, 64 nt, hsa; identical to SEQ ID NO: 81894

SEQ ID NO: 85626 - RNA, 64 nt, hsa; identical to SEQ ID NO: 81895

SEQ ID NO: 85627 - RNA, 64 nt, hsa; identical to SEQ ID NO: 81896

SEQ ID NO: 85628 - RNA, 64 nt, hsa; identical to SEQ ID NO: 81897

SEQ ID NO: 85629 - RNA, 64 nt, hsa; identical to SEQ ID NO: 81898

SEQ ID NO: 85630 - RNA, 64 nt, hsa; identical to SEQ ID NO: 81899

SEQ ID NO: 85631 - RNA, 64 nt, hsa; identical to SEQ ID NO: 81900

SEQ ID NO: 85632 - RNA, 64 nt, hsa; identical to SEQ ID NO: 81901

SEQ ID NO: 85633 - RNA, 64 nt, hsa; identical to SEQ ID NO: 81902

SEQ ID NO: 85634 - RNA, 64 nt, hsa; identical to SEQ ID NO: 81903

SEQ ID NO: 85635 - RNA, 64 nt, hsa; identical to SEQ ID NO: 81904

SEQ ID NO: 85636 - RNA, 64 nt, hsa; identical to SEQ ID NO: 81905

SEQ ID NO: 85637 - RNA, 64 nt, hsa; identical to SEQ ID NO: 81906

SEQ ID NO: 85638 - RNA, 64 nt, hsa; identical to SEQ ID NO: 81907

SEQ ID NO: 85639 - RNA, 64 nt, hsa; identical to SEQ ID NO: 81908

SEQ ID NO: 85640 - RNA, 64 nt, hsa; identical to SEQ ID NO: 81909

SEQ ID NO: 85641 - RNA, 64 nt, hsa; identical to SEQ ID NO: 81910

SEQ ID NO: 85642 - RNA, 64 nt, hsa; identical to SEQ ID NO: 81911

SEQ ID NO: 85643 - RNA, 64 nt, hsa; identical to SEQ ID NO: 81912

SEQ ID NO: 85644 - RNA, 64 nt, hsa; identical to SEQ ID NO: 81913

SEQ ID NO: 85645 - RNA, 64 nt, hsa; identical to SEQ ID NO: 81914

SEQ ID NO: 85646 - RNA, 64 nt, hsa; identical to SEQ ID NO: 81915

SEQ ID NO: 85647 - RNA, 64 nt, hsa; identical to SEQ ID NO: 81916

SEQ ID NO: 85648 - RNA, 64 nt, hsa; identical to SEQ ID NO: 81917

SEQ ID NO: 85649 - RNA, 64 nt, hsa; identical to SEQ ID NO: 81918

SEQ ID NO: 85650 - RNA, 64 nt, hsa; identical to SEQ ID NO: 81919

SEQ ID NO: 85651 - RNA, 64 nt, hsa; identical to SEQ ID NO: 81920

SEQ ID NO: 85652 - RNA, 64 nt, hsa; identical to SEQ ID NO: 81921

SEQ ID NO: 85653 - RNA, 64 nt, hsa; identical to SEQ ID NO: 81922

SEQ ID NO: 85654 - RNA, 64 nt, hsa; identical to SEQ ID NO: 81923

SEQ ID NO: 85655 - RNA, 64 nt, hsa; identical to SEQ ID NO: 81924

SEQ ID NO: 85656 - RNA, 64 nt, hsa; identical to SEQ ID NO: 81925

SEQ ID NO: 85657 - RNA, 64 nt, hsa; identical to SEQ ID NO: 81926

SEQ ID NO: 85658 - RNA, 64 nt, hsa; identical to SEQ ID NO: 81927

SEQ ID NO: 85659 - RNA, 64 nt, hsa; identical to SEQ ID NO: 81928

SEQ ID NO: 85660 - RNA, 64 nt, hsa; identical to SEQ ID NO: 81929

SEQ ID NO: 85661 - RNA, 64 nt, hsa; identical to SEQ ID NO: 81930

SEQ ID NO: 85662 - RNA, 64 nt, hsa; identical to SEQ ID NO: 81931

SEQ ID NO: 85663 - RNA, 64 nt, hsa; identical to SEQ ID NO: 81932

SEQ ID NO: 85664 - RNA, 64 nt, hsa; identical to SEQ ID NO: 81933

SEQ ID NO: 85665 - RNA, 64 nt, hsa; identical to SEQ ID NO: 81934

SEQ ID NO: 85666 - RNA, 64 nt, hsa; identical to SEQ ID NO: 81935

SEQ ID NO: 85667 - RNA, 64 nt, hsa; identical to SEQ ID NO: 81936

SEQ ID NO: 85668 - RNA, 64 nt, hsa; identical to SEQ ID NO: 81937

SEQ ID NO: 85669 - RNA, 64 nt, hsa; identical to SEQ ID NO: 81938

SEQ ID NO: 85670 - RNA, 64 nt, hsa; identical to SEQ ID NO: 81939

SEQ ID NO: 85671 - RNA, 64 nt, hsa; identical to SEQ ID NO: 81940

SEQ ID NO: 85672 - RNA, 64 nt, hsa; identical to SEQ ID NO: 81941

SEQ ID NO: 85673 - RNA, 64 nt, hsa; identical to SEQ ID NO: 81942

SEQ ID NO: 85674 - RNA, 64 nt, hsa; identical to SEQ ID NO: 81943

SEQ ID NO: 85675 - RNA, 64 nt, hsa; identical to SEQ ID NO: 81944

SEQ ID NO: 85676 - RNA, 64 nt, hsa
uauugauuuuugauuaugaaaaucaaaaauuuucacauuugauuaugaaaaucuccaaacauau

SEQ ID NO: 85677 - RNA, 64 nt, hsa
gucuguaagucucuuuccaucuacagaguuuagcacauuugaacguugcugguugaaaucccga

SEQ ID NO: 85678 - RNA, 64 nt, hsa
ccuuauaguccuaagccaagacauuugaccuuugacauuugaccuuugcagugucaugugaggg

SEQ ID NO: 85679 - RNA, 64 nt, hsa
uuguccuaucucucccuuauaguccuaagccaagacauuugaccuuugacauuugaccuuugca

SEQ ID NO: 85680 - RNA, 64 nt, hsa
uguggaaaaagaaacaggguuuugaacucuguuaacauuugaaaaauauauuuucaaauucacu

SEQ ID NO: 85681 - RNA, 64 nt, hsa
gcaaaguggcacuaaugaagcuuuugccuuuuguacauuugagauuuuuguauauaguguuugc

SEQ ID NO: 85682 - RNA, 64 nt, hsa
cggggaaacaaaauuauucucugagagggaaaggacauuugagggaaacaucaaauuuccccau

SEQ ID NO: 85683 - RNA, 64 nt, hsa
auucuggucucaggcaugaccacguccagugaagacauuugaggcagcacaucucaggacccag

SEQ ID NO: 85684 - RNA, 64 nt, hsa
aauaaguccuaaagugaagaagccaucaauuuuaacauuugaugucuagauaacauucaugaga

SEQ ID NO: 85685 - RNA, 64 nt, hsa
agaaauucauuaaagaaaaaccacagauacugaaacauuugacacauaaaaguaauuaauugcu

SEQ ID NO: 85686 - RNA, 64 nt, hsa
ucgaugauaaauaaagcaaaugcaucauauguucacauuugauaaguauaugccaaaaaaugaa

SEQ ID NO: 85687 - RNA, 64 nt, hsa
aaguguggucaggaaaggccccacugauaagguaacauuugagcaagucugaaaaaggcaaggg

SEQ ID NO: 85688 - RNA, 64 nt, hsa
aaaaauugcccuaugaaaacuuuaaaucucuaaaacauuugaaauacuaccauauuugugauuu

SEQ ID NO: 85689 - RNA, 64 nt, hsa
uaagaaaacaugaaugaacuagaagauauuaaaaacauuugacauugguaagaaauauugauac

SEQ ID NO: 85690 - RNA, 64 nt, hsa
uuuuacaguacuccagaugucuacacucaauaaaacauuugacaaaaccagccuugguguguuu

SEQ ID NO: 85691 - RNA, 64 nt, hsa
uucauuaaucuccaucauguaugccaagccugacacauuugacagugaggacaauguggcuugc

SEQ ID NO: 85692 - RNA, 64 nt, hsa
aaucccagcacuuugggaggccauggcggguggaacauuugagggcaugaguucgagaccagcc

SEQ ID NO: 85693 - RNA, 64 nt, hsa
ccugucagccaacuuuagacagaugguaaagaccacauuugaauaaguacacaucuuucauauc

SEQ ID NO: 85694 - RNA, 64 nt, hsa
uucugucuacagcuagaagcugugccccaguuccacauuugauuacacaugugagauuugcugc

SEQ ID NO: 85695 - RNA, 64 nt, hsa
aaauugaaaaugagaaauuaaaccugcaagugaaacauuugaaacgauuauacuuucuacauaa

SEQ ID NO: 85696 - RNA, 64 nt, hsa
uucugaaguuauaccuagugauguuuuuugcaguacauuugaauggauuguagacacugccuca

SEQ ID NO: 85697 - RNA, 64 nt, hsa
uccuuguucucauuuacacccugcaguuuggaccacauuugaccucauaaguuuuuccuuuuaa

SEQ ID NO: 85698 - RNA, 64 nt, hsa
ucgugguuccacuagauguaacuuaaaggaguuaacauuugaggacuuuguucuacaucagauu

SEQ ID NO: 85699 - RNA, 64 nt, hsa
ucgugguuccgcuagauguaacuuauaggaguuaacauuugaggacuuuguucugcaucagauc

SEQ ID NO: 85700 - RNA, 64 nt, hsa
gcccugauacuauaagcucagcaaguaaccugguacauuugaaauaaaaaccaaauuuuuagau

SEQ ID NO: 85701 - RNA, 64 nt, hsa
aaggguuguaaaaaucugugaaaaaguuuuuccuacauuugacuagaaaaugugauccauagua

SEQ ID NO: 85702 - RNA, 64 nt, hsa
gaaucaguggugucugaaaucauauuaaauacccacauuugacauaaaugcgguacccuuuacu

SEQ ID NO: 85703 - RNA, 64 nt, hsa
ucauucuaugcugauuuuacaaaagaucauuuuuacauuugaacugagaaccccuuuuaauuga

SEQ ID NO: 85704 - RNA, 64 nt, hsa
uaguacuauauuaagugcacuugaguggaauucaacauuugacuaauaaaaugaguucaucaug

SEQ ID NO: 85705 - RNA, 64 nt, hsa
ucaguguguguuuugaggucuuauguaauugaugacauuugagagaaaugguggcuuuuuuuag

SEQ ID NO: 85706 - RNA, 64 nt, hsa
cuucucaaagagagaccaacaucaugcuuuuaacacauuugaugagguuuuuuauuuguguuuu

SEQ ID NO: 85707 - RNA, 64 nt, hsa
cugggauuccaggugugagccgcugcggccgaccacauuugauguuugaaguuguaaucugucc

SEQ ID NO: 85708 - RNA, 64 nt, hsa
uuauauauauauacauuuuuuuuccuucugcaauacauuugaaaacuuguuugggagacucugc

SEQ ID NO: 85709 - RNA, 64 nt, hsa
aaacugugguugauagccagucacugccuuaagaacauuugaugcaagauggccagcacugaac

SEQ ID NO: 85710 - RNA, 64 nt, hsa
uaaaucuguuguguacauuucaacaaauacuuuuacauuugacauuacugaggucauucugagu

SEQ ID NO: 85711 - RNA, 64 nt, hsa
cuuaacguguuucuuaaacuuuuguaguaaaugaacauuugaaauccauuuugauaaaccugcu

SEQ ID NO: 85712 - RNA, 64 nt, hsa
cuuuguagcugccuccuagaagcacauucugagcacauuugagaccucuguguuagaggggaga

SEQ ID NO: 85713 - RNA, 64 nt, hsa
aaguuuuguuuuuaucuugccuguuggcuucaauacauuugagaauacgcugaagagggaaaau

SEQ ID NO: 85714 - RNA, 64 nt, hsa
ugccaguagagcugugaagaaacagcugcagagaacauuugaccuuccuggcauucuugucugc

SEQ ID NO: 85715 - RNA, 64 nt, hsa
uauuuuaacucuuacuagaaaaucuaaucuuaaaacauuugaauucuaaacauguaaaauguga

SEQ ID NO: 85716 - RNA, 64 nt, hsa
caguuuuuuauuacuaaaaauagcacauuugaguacauuugaaaaguagaaaaauuagaaauua

SEQ ID NO: 85717 - RNA, 64 nt, hsa
uuuaauuacucaguuuuuuauuacuaaaaauagcacauuugaguacauuugaaaaguagaaaaa

SEQ ID NO: 85718 - RNA, 64 nt, hsa
gugugugugguuauaucaaacuuuuacgacuuuuacauuugaguaaccaucaacacgauuaguu

SEQ ID NO: 85719 - RNA, 64 nt, hsa
aauauuagcaaaucaggaaugcaaggcuuguucaacauuugauauucaguguaauccauugcau

SEQ ID NO: 85720 - RNA, 64 nt, hsa
aauguuagcaaaucaggaaugcaagccuuguucaacauuugauauucagugcaauccauugcau

SEQ ID NO: 85721 - RNA, 64 nt, hsa
ugugugugugugguuauaacaaacugguacuuuuacauuugaguaaccaucaacacaauuaguu

SEQ ID NO: 85722 - RNA, 64 nt, hsa
ucccuggugccgauguaaagggcuacauuugggaacauuugacuuccuugggacucuuaagugc

SEQ ID NO: 85723 - RNA, 64 nt, hsa
gaauuuaagcucuguuuuaaagccgaagaagaaaacauuugaauuuaccuucauaugccacuaa

SEQ ID NO: 85724 - RNA, 64 nt, hsa
auguaaggggugaugcaugaugggcagaugcuggacauuugaggagccgucuuucuuggccuga

SEQ ID NO: 85725 - RNA, 64 nt, hsa
ugcaaaacuguuuucuucuuccuucucaauggugacauuugaagaggcagagcaccuuggggcu

SEQ ID NO: 85726 - RNA, 64 nt, hsa
auucaaggauccaggaugccaaaaauaugugugaacauuugaaacauuuuuauuugcugcuuuu

SEQ ID NO: 85727 - RNA, 64 nt, hsa
aaaauuuugucugcacuugaguucacuugaguuuacauuugaaaugugcauguuuauuuauaua

SEQ ID NO: 85728 - RNA, 64 nt, hsa
aaaacaaacaagcaagcagacacacacagugaacacauuugauuaauuguguuguuucaacguu

SEQ ID NO: 85729 - RNA, 64 nt, hsa
uuguuuuuaaaggauguguuuguaugcauucuggacauuugaauuaaaaaaaaaguauugugau

SEQ ID NO: 85730 - RNA, 64 nt, hsa
gcuuagaauauugauuucuugaauacguauaagcacauuugacugucuuuuauauauggauuac

SEQ ID NO: 85731 - RNA, 64 nt, hsa
gaagguuuauucugaucauaauuuguuuagugcuacauuugauaauuuauuauuuacagcuuag

SEQ ID NO: 85732 - RNA, 64 nt, hsa
gauccuuuuuccuuaauuuauacaugauccaggcacauuugaaauuugguaggcauugcaaaca

SEQ ID NO: 85733 - RNA, 64 nt, hsa
caggcacauuugaaauuugguaggcauugcaaacacauuugaauauuguguauuucauacuauu

SEQ ID NO: 85734 - RNA, 64 nt, hsa
ugucauguuuauuaccuauaugguuguuuuaauuacauuugaauaauuauauuuuuccaaccac

SEQ ID NO: 85735 - RNA, 64 nt, hsa
augcuucguggaaugcugcauuuauauguaagugacauuugaauacuguccuuccugcuuuauc

SEQ ID NO: 85736 - RNA, 64 nt, hsa
aaccaauggaaauugcuauauuuggggaugucauacauuugauauugcuucagcauuucaaaua

SEQ ID NO: 85737 - RNA, 64 nt, hsa
uuuagacuacugccucuaccauuaacuagcccagacauuugaauggccuuguaaacagcucacu

SEQ ID NO: 85738 - RNA, 64 nt, hsa
uuuacccauacauuuagcaaauugaauggccaaaacauuugacuccagugagggcucaaguuag

SEQ ID NO: 85739 - RNA, 64 nt, hsa
ccagggauuguucuugacauaccugacuuuucucacauuugaacuuccacuaucauuguaucca

SEQ ID NO: 85740 - RNA, 64 nt, hsa
cuacucuugcugcacuuauguaaacaaucagaccacauuugaagaaacuccaccuauuuugcaa

SEQ ID NO: 85741 - RNA, 64 nt, hsa
guacaguaacaaucugcuuucuuuguaacaugacacauuugaaaucauugguuauauuaccaau

SEQ ID NO: 85742 - RNA, 64 nt, hsa
uuuuagcuaaauauauacucuucucuaguuuaaaacauuugaacuugccuaguuagugugguug

SEQ ID NO: 85743 - RNA, 64 nt, hsa
uuagaaaaaguccugcuuuaaguaauauguagccacauuugaauccucuaccacaagucuuuuu

SEQ ID NO: 85744 - RNA, 64 nt, hsa
uuuucuuggaaagauauaauuugagcaguggcuuuaugcagacuccaagaacaaaaccaccagg

SEQ ID NO: 85745 - RNA, 64 nt, hsa
uucuggaccccuauuuaucucaaaacucuuaauauaugcagaccaacaggucuuugcauuccuu

SEQ ID NO: 85746 - RNA, 64 nt, hsa
uacaucaacuccuaagggguccucugggauuaguuaugcagauauuaaaucacccgaagacacu

SEQ ID NO: 85747 - RNA, 64 nt, hsa
gcccuuaauucuuuuccagcuuuucauauuaauguaugcagagucucaccaagcucaaagacac

SEQ ID NO: 85748 - RNA, 64 nt, hsa
uuuuccauccaacagcaguguguagagagaauauuaugcagaugccguuaauuuuuuacccuau

SEQ ID NO: 85749 - RNA, 64 nt, hsa
cauuuccauucauuuccauacuggcuuuugauuauaugcagauuccuaguagcaugccuuaccu

SEQ ID NO: 85750 - RNA, 64 nt, hsa
aacaacagugugaucauugguuggacacugugguuaugcagaagcagagaugaggaggcuggcc

SEQ ID NO: 85751 - RNA, 64 nt, hsa
aauugugaaggguuguguucuuuauggcagguucuaugcagauugugccagagcaugugcgugu

SEQ ID NO: 85752 - RNA, 64 nt, hsa
ugcaugcugaggacgaccagcugaggguguauuauaugcagaauuacauaaacgaagcucucaa

SEQ ID NO: 85753 - RNA, 64 nt, hsa
ugaacauuuuucuauucauucauuuugaaauaauuaugcagacacaucagcuguuaaccauuug

SEQ ID NO: 85754 - RNA, 64 nt, hsa
auccaagagagggaagaagaguaugucaguauauuaugcagaagauagauacagccuuuucaga

SEQ ID NO: 85755 - RNA, 64 nt, hsa
cagaggccuugauggagaguugcauggggugcuauaugcagacuuccaugguuuguguguagcc

SEQ ID NO: 85756 - RNA, 64 nt, hsa
uaagauauccuaaauauuuaaaauauuuagauauccuaaauauaggauauagaguuuguaccaa

SEQ ID NO: 85757 - RNA, 64 nt, hsa
agcuucugugaggaccuuuuggcucuuaagauauccuaaauauuuaaaauauuuagauauccua

SEQ ID NO: 85758 - RNA, 64 nt, hsa
aguggaucuaggguuacuuucuuuauuaacauuuccuaaauaacugaauugagagacauacucu

SEQ ID NO: 85759 - RNA, 64 nt, hsa
gaaaaauuccaagaguuacaaucuggacuugguaccuaaauaucauuuuuuaaauucuugaugc

SEQ ID NO: 85760 - RNA, 64 nt, hsa
uaguaucccuucacuacaaauucucugaagaccaccuaaauaucacuugcucugccacugcccg

SEQ ID NO: 85761 - RNA, 64 nt, hsa
uacuggaaacgucaccggaaucaggaccgagagcccuaaauaagucacacagcacccugaaagu

SEQ ID NO: 85762 - RNA, 64 nt, hsa
ggucuguguuaacuuuugaacauguguaacuuaaccuaaauacucccaaacuuuaccucuaaau

SEQ ID NO: 85763 - RNA, 64 nt, hsa
ccugguuaugaucaguugacacuuugaguaccccccuaaauagcuggacuuuccuuuucauuuc

SEQ ID NO: 85764 - RNA, 64 nt, hsa
caggacagucucuugagggguuuuguuucuguuuccuaaauacuccuaaauaauauuucuaauc

SEQ ID NO: 85765 - RNA, 64 nt, hsa
ucuugagggguuuuguuucuguuuccuaaauacuccuaaauaauauuucuaaucagccauuaug

SEQ ID NO: 85766 - RNA, 64 nt, hsa
guuuaacuuugcacucucuaugcauaugagguuuccuaaauaaaugaggaguagcauaguuuaa

SEQ ID NO: 85767 - RNA, 64 nt, hsa
ggaauguauauguauaucaaaacauguaguacacccuaaauauauauaauuuuuauuugucaaa

SEQ ID NO: 85768 - RNA, 64 nt, hsa
agccaccaugcccagcugcuccuuuauuuuaaucccuaaauauaaucccuaaauauaguuauau

SEQ ID NO: 85769 - RNA, 64 nt, hsa
agcugcuccuuuauuuuaaucccuaaauauaaucccuaaauauaguuauauuucauacuuaguu

SEQ ID NO: 85770 - RNA, 64 nt, hsa
agcuuuaacuuugcuuaaacuacaaacacaagcaaaacuucacggggucauacuacauacaagc

SEQ ID NO: 85771 - RNA, 64 nt, hsa
auacuugccugugacauuuugccacuggaacacuaaacuucaugaauugcgccucagauuuuuc

SEQ ID NO: 85772 - RNA, 64 nt, hsa
uuuaaagcauccaaaugguaauuaacaggcagcaaaacuucagaacuaguucugcaucuacugu

SEQ ID NO: 85773 - RNA, 64 nt, hsa
caucuuaaaaaaaaaaaauccuuccauugaauagaaacuucaaaguccuucaucagaucauggc

SEQ ID NO: 85774 - RNA, 64 nt, hsa
guuuuuuuaaugauugaggaaaaagucauuuagaaaacuucaguuuucggccagcgcgucgagg

SEQ ID NO: 85775 - RNA, 64 nt, hsa
uuacccuaaaacuuaaaguauaauaaaaaaaaaaaaacuucaguuuucuaaaaauuauauuuaa

SEQ ID NO: 85776 - RNA, 64 nt, hsa
uuaucugaacauaccuguuuuucgaaacuucaagaaacuucaauaagggaugcauugagcaguc

SEQ ID NO: 85777 - RNA, 64 nt, hsa
cugcugaaaauuaucugaacauaccuguuuuucgaaacuucaagaaacuucaauaagggaugca

SEQ ID NO: 85778 - RNA, 64 nt, hsa
gcuggaaugcaauggcgugaucuuggcucacugcaaacuucaccuccugaguucaagccauucu

SEQ ID NO: 85779 - RNA, 64 nt, hsa
gaaauucacaaaaaaauuaauaccucuguggagaaaacuucaaaacuuaaaaaaggacauagaa

SEQ ID NO: 85780 - RNA, 64 nt, hsa
gaaguggcauaguuuuaucaauaucugucaaauuaaacuucaaggcaaaacuuuuuuauugaga

SEQ ID NO: 85781 - RNA, 64 nt, hsa
aggcaaauuuuagcaaaaauuaaaauucuuaagaaaacuucacuaauauauagucauaaugugg

SEQ ID NO: 85782 - RNA, 64 nt, hsa
cacauuuauauuuaaacuucaauuuuuuauauuuaaacuucaauuuuuuagcaacagcugaaua

SEQ ID NO: 85783 - RNA, 64 nt, hsa
gggaaaaaagguccgaauuuucacauuuauauuuaaacuucaauuuuuuauauuuaaacuucaa

SEQ ID NO: 85784 - RNA, 64 nt, hsa
uggccucucucccauuucccgcuguggcugagccaaacuucauuacuuuccuuaggcccucugc

SEQ ID NO: 85785 - RNA, 64 nt, hsa
ccugagaaaagagaacuuucucuuaagaaguuggaaacuucauuuuaccuucgugacccuggua

SEQ ID NO: 85786 - RNA, 64 nt, hsa
gaagcugcaauguaacauagguaucuuuuucuaaaaacuucaaguguuugauuaaaauagagaa

SEQ ID NO: 85787 - RNA, 64 nt, hsa
agcuuauagacuaugagagaaaagugagcaccaaaaacuucauuaaucaccuuaucaggaagga

SEQ ID NO: 85788 - RNA, 64 nt, hsa
cuuuuuguguaauucacuuuauuuauuuuauuacaaacuucaagauuauuuaagugaagauauu

SEQ ID NO: 85789 - RNA, 64 nt, hsa
gaaucuuuauaauuucuuuccaaagauaccaaauaaacuucaguguuuucaucuaauucucuua

SEQ ID NO: 85790 - RNA, 64 nt, hsa
auagcaaaaauaguuaaaaugcugacauaacaccaaacuucauuuuuuaaaaaaucuguuguuc

SEQ ID NO: 85791 - RNA, 64 nt, hsa
aguagauuauggccuuuuuaaguauugcagucuaaaacuucaaaaacuaaaaucauugucaaaa

SEQ ID NO: 85792 - RNA, 64 nt, hsa
ccuggacugugaugggaacagcccagugcagucuaaacuucaauuguguugaaacuacuuuaau

SEQ ID NO: 85793 - RNA, 64 nt, hsa
gacaaaguaauaaaucauguuuaucuauugauuuaaacuucaucaguuuugcauccuacugaga

SEQ ID NO: 85794 - RNA, 64 nt, hsa
aguacuaaaaggaauaucauaagggcuguagcucaaacuucauaauacauaaaucacugggguc

SEQ ID NO: 85795 - RNA, 64 nt, hsa
acuuucuaccauauauuacguuuuuguuauuaaaaaacuucauuggccacuagugaaguuaguc

SEQ ID NO: 85796 - RNA, 64 nt, hsa
uccucaaggacauuacuagugacucagaaaauucaaacuucagaaaugaaauccaaagcuuggu

SEQ ID NO: 85797 - RNA, 64 nt, hsa
ccuccaaggauguuuaaaaucuaguugggaaaacaaacuucaucaagaguaaaugcaguggcau

SEQ ID NO: 85798 - RNA, 64 nt, hsa
cuccgcuccuuaaugugaaacuucaugaaguuuuaaacuucaugcaauuugaaauuccauauaa

SEQ ID NO: 85799 - RNA, 64 nt, hsa
agacgagagagagaagccuccgcuccuuaaugugaaacuucaugaaguuuuaaacuucaugcaa

SEQ ID NO: 85800 - RNA, 64 nt, hsa
aauuuuaaauuaguauauacuacaacaaauuuccaaacuucauaauuugcuaguagugcuaacu

SEQ ID NO: 85801 - RNA, 64 nt, hsa
aauguccucaucuccuacucuccauuuaaaaaacaaacuucauuguaguaaauucaaauaggaa

SEQ ID NO: 85802 - RNA, 64 nt, hsa
uauugucuaagcuuuaauccacuguguuaggucaaaacuucaaauacaugcauuuuucaauaua

SEQ ID NO: 85803 - RNA, 64 nt, hsa
aaccuaucagcuuaguuuuuuaacaugguagucuaaacuucaaggcuugcucuaucuccuagag

SEQ ID NO: 85804 - RNA, 64 nt, hsa
ugcacaucguugaaugaagagagucuuuuugcacaaacuucacuugaaauugugccacugauga

SEQ ID NO: 85805 - RNA, 64 nt, hsa
uuggggaauuaccuuauuuuauauuguuguaaacaaacuucaaauucuacaugugcgacuuuuc

SEQ ID NO: 85806 - RNA, 64 nt, hsa
agcagguagauggaugacaguugcucauucugagaaacuucacucuuuucacuuaugcaucacg

SEQ ID NO: 85807 - RNA, 64 nt, hsa
uugccaucggaucaucaacaagucuucuauuuacaaacuucaaaaaacacaaaacaacauucau

SEQ ID NO: 85808 - RNA, 64 nt, hsa
gugagacaugcuuauuuugcuaaaggaugcacccaaacuucaaacuucaagcaaaugaaaugga

SEQ ID NO: 85809 - RNA, 64 nt, hsa
augcuuauuuugcuaaaggaugcacccaaacuucaaacuucaagcaaaugaaauggacaaugca

SEQ ID NO: 85810 - RNA, 64 nt, hsa
aauucaguuguaccccaguguuccauguauagaaaaacuucauuagaacaaacuuuacuugaua

SEQ ID NO: 85811 - RNA, 64 nt, hsa
aaaaaacacucaaauaguagaagcagcaaguagcaaacuucaggagagcuacuuucuauccaaa

SEQ ID NO: 85812 - RNA, 64 nt, hsa
agcccuggaucucccaauggccuuccaauccuuaaacugccaaucgccccacccguuccuaccu

SEQ ID NO: 85813 - RNA, 64 nt, hsa
auuguaauccagucccuucuuggaaccuaaauugaacugccaaguacugcgcaugcaagagacc

SEQ ID NO: 85814 - RNA, 64 nt, hsa
ccauuuuuuuucuuaaagcauauucuuugcaucuaacugccagugccauugucaaaacuuauuu

SEQ ID NO: 85815 - RNA, 64 nt, hsa
gauguagcauaaaaauugucccgguuugaguuauaacugccaguagaugaccagucacaaguga

SEQ ID NO: 85816 - RNA, 64 nt, hsa
cccugguccccccacaaggccucagcccagucacaacugccauuuccagucucugcugaguguc

SEQ ID NO: 85817 - RNA, 64 nt, hsa
cauuggcagcggcugaacuuggcauuuccuugcuaacugccagauguggccaaccuuuguccau

SEQ ID NO: 85818 - RNA, 64 nt, hsa
acaaaugccaaacaaaguauuaguguuaacacaaaacugccaacuuugcacaaguuuccagaaa

SEQ ID NO: 85819 - RNA, 64 nt, hsa
aaugccagcucucaccagauggccuacguguuugaacugccauagucagugugcgcuuauguac

SEQ ID NO: 85820 - RNA, 64 nt, hsa
uagugcucuuaagccuaaaugccuuagaaauguaaacugccauauauaacagauacauuucccu

SEQ ID NO: 85821 - RNA, 64 nt, hsa
auacauacggucagguuuaacauuugccuugcagaacugccauuauuuucugucagaugagaac

SEQ ID NO: 85822 - RNA, 64 nt, hsa
uguaguagacucggguccuguccacagcccuagcugccagcaaugcuguccucacagaggcaua

SEQ ID NO: 85823 - RNA, 64 nt, hsa
ugugcuccacugugacgguggcccggggggaggaugccagcagccugccuauggcuccagcugu

SEQ ID NO: 85824 - RNA, 64 nt, hsa
caggccaaugcaagaggccaaggcuggagaggcgugccagcaaggccagggauggccggagggc

SEQ ID NO: 85825 - RNA, 64 nt, hsa
ccacggaaggacaugcuguccagacugugaugacugccagcacagggcaucucgggcuuggcug

SEQ ID NO: 85826 - RNA, 64 nt, hsa
cgcccucccugcaguugaggaagagccacuuuccugccagcacauguuucugggucuuggaggu

SEQ ID NO: 85827 - RNA, 64 nt, hsa
gugcaggguggacaucaccuuggaggcccugcacugccagcaucuggagaccguccuggagcug

SEQ ID NO: 85828 - RNA, 64 nt, hsa
ugauuccuuggugacagguugagggcagcuccagugccagcaauaggguggcacagaagcucau

SEQ ID NO: 85829 - RNA, 64 nt, hsa
gaccccagggacuugccuuccccacccacucugcugccagcaggcccagggaucccugaccugc

SEQ ID NO: 85830 - RNA, 64 nt, hsa
cacccugguuguucucugggcuuggaggguacagugccagcagcuuccuugcccaauugauguu

SEQ ID NO: 85831 - RNA, 64 nt, hsa
ccaugugcauuaaauacuuugccagcacugccuuugccagcauccuaaaucuggaguuuuacaa

SEQ ID NO: 85832 - RNA, 64 nt, hsa
aauagaauagcauuuccaugugcauuaaauacuuugccagcacugccuuugccagcauccuaaa

SEQ ID NO: 85833 - RNA, 64 nt, hsa
gauguuccagugucccuggucucugcccaccagaugccagcacucccaccauucguggcaacca

SEQ ID NO: 85834 - RNA, 64 nt, hsa
gugcuuucauccgucacaaacuggcaccuguaccugccagcaggagcaugauggggacuuccau

SEQ ID NO: 85835 - RNA, 64 nt, hsa
augaauaagucggacuuauuaacucugagugccuugccagcacuaacauucuagaguauuccag

SEQ ID NO: 85836 - RNA, 64 nt, hsa
ggccccuacccugcccugccugaagcucccccccugccagcacccagcaucuccuggccuggcc

SEQ ID NO: 85837 - RNA, 64 nt, hsa
ucucugugcuuuuggccucuguguggccguguuuugccagcaugagauacuguccccucuggag

SEQ ID NO: 85838 - RNA, 64 nt, hsa
caggcguuccuuuugggacuguggaagcaucagaugccagcacugacucaggaacagcaaguca

SEQ ID NO: 85839 - RNA, 64 nt, hsa
gugaaugggugaggcugauguggaugucugugugugccagcaggugggugggggaugugggugu

SEQ ID NO: 85840 - RNA, 64 nt, hsa
agagauauauuaaagcacaaguuucuaucugaccugccagcaccuucuuuacugcaaagacagg

SEQ ID NO: 85841 - RNA, 64 nt, hsa
ggauggcagagacuuccuugucaucauggagaagugccagcaggggacugggaaaagcacucua

SEQ ID NO: 85842 - RNA, 64 nt, hsa
agccuugaguccauugccaaauuuucagcacaccugccagcaacuugggggaauaagcgaaggu

SEQ ID NO: 85843 - RNA, 64 nt, hsa
aggaccacaaccccugccagcagcccugggacccugccagcagcccugggaaaaggcuguggcc

SEQ ID NO: 85844 - RNA, 64 nt, hsa
gcgucgcuccucugcucaacaggaccacaaccccugccagcagcccugggacccugccagcagc

SEQ ID NO: 85845 - RNA, 64 nt, hsa
gagugcuuuuuugguaccacgagacccggcccucugccagcauaaaccacucacaccccagggg

SEQ ID NO: 85846 - RNA, 64 nt, hsa
aaaauaagccgucaaguaguaagaagaacuuggaugccagcaaagagaauggggcugggcagau

SEQ ID NO: 85847 - RNA, 64 nt, hsa
aacuugaagaagguugucagcugcagccacuuucugccagcaucugcagccacuuucugccagc

SEQ ID NO: 85848 - RNA, 64 nt, hsa
cagccacuuucugccagcaucugcagccacuuucugccagcaucugcagccagcaagcugggac

SEQ ID NO: 85849 - RNA, 64 nt, hsa
uuccauuucagccaguggguagcugauaagccagugccagcauccagcaugagcagaugucggg

SEQ ID NO: 85850 - RNA, 64 nt, hsa
cguuacugcucuccuucccuucaugauaagccagugccagcauccagcgugagcagacgucggg

SEQ ID NO: 85851 - RNA, 64 nt, hsa
acuccacccgaccccagcaguggugcaggacagcugccagcacccaccuggcccuccuccuuuu

SEQ ID NO: 85852 - RNA, 64 nt, hsa
gggaggugucccacugaagccccgcgccuccuccugccagcacccccagcaccugcuagcagga

SEQ ID NO: 85853 - RNA, 64 nt, hsa
uuuucaggcagcgucugugaacccacagcucgguugccagcagugcccgcguggugacccagaa

SEQ ID NO: 85854 - RNA, 64 nt, hsa
agggcgccgaugucgagggcaccugagcgaggggugccagcaagggggcggccggcuggugggu

SEQ ID NO: 85855 - RNA, 64 nt, hsa
aauuaagugggcuggagaagaauggagcuccacaugccagcaccguauauggaauacaaaagcu

SEQ ID NO: 85856 - RNA, 64 nt, hsa
gggagaugcugccagcacacaggggcccuccugcugccagcagguuggggugguuaagucuuau

SEQ ID NO: 85857 - RNA, 64 nt, hsa
ggugcaggugagccggcguguccuggggagaugcugccagcacacaggggcccuccugcugcca

SEQ ID NO: 85858 - RNA, 64 nt, hsa
ggauggccaugccccgugccuggcagaggucuggugccagcacugggagcugcuccgcccuugc

SEQ ID NO: 85859 - RNA, 64 nt, hsa
ucuuucaagaguaacaaaaaaaugcaaacuguaaugaaacuacauuguauuucuaagugugaaa

SEQ ID NO: 85860 - RNA, 64 nt, hsa
caaguauguccauguguuucuuauaagguacacuugaaacuagugaguguuugucacauuucac

SEQ ID NO: 85861 - RNA, 54 nt, hsa
aagcugaagaaggugacugaauuuugaaacuacacccucaguaaagcaaacagg

SEQ ID NO: 85862 - RNA, 64 nt, hsa
guuaaaagugaacauuuugaagguuuuuaacuggugaaacuagccuggaauaaugccaccagag

SEQ ID NO: 85863 - RNA, 64 nt, hsa
cagugguuuuggggguuauccacuuuuauuuuuuugaaacuagcucucauucugucacccaggc

SEQ ID NO: 85864 - RNA, 64 nt, hsa
acuugggaggcugaggcaggagaaucacaaggauugaaacuaugcaguguguucuccaaacaug

SEQ ID NO: 85865 - RNA, 64 nt, hsa
aauugccugugugcacauauuuuuagaugaaaaaugaaacuaccuuacaauauuauuuuuuuaa

SEQ ID NO: 85866 - RNA, 64 nt, hsa
guugauguguucauuccaguuauucacuuacagaugaaacuaaaacaaauaaaggcaagcuauu

SEQ ID NO: 85867 - RNA, 63 nt, hsa
accuugugacaucuguuuaaaagagaggaagaaugaaacuaagaaaauucuauguuaauuaca

SEQ ID NO: 85868 - RNA, 64 nt, hsa
aaaacaaaaaucuguguaacuguaaaacauugaaugaaacuauuuuaccugaacuagauuuuau

SEQ ID NO: 85869 - RNA, 64 nt, hsa
uuuauucaaauaagauuauuuacaaacuuauucuugaaacuaaauauaguaaagaggguuuuua

SEQ ID NO: 85870 - RNA, 64 nt, hsa
uuuaaaugcaauuuauuauuucagaaauuucccaugaaacuaaaaauagaaaauaagauauaca

SEQ ID NO: 85871 - RNA, 64 nt, hsa
auauguauauguauauuuaaucaaccagcaguuuugaaacuagucauccugguacaaaaguuuu

SEQ ID NO: 85872 - RNA, 64 nt, hsa
cuuuccugaaccuucucagugguuuacaugccucugaaacuaugugcaauauuuuugguugaca

SEQ ID NO: 85873 - RNA, 64 nt, hsa
guaaucccugcuggucauaggaaaacacacgguucuaauuaagugugaagguauagcuauugca

SEQ ID NO: 85874 - RNA, 64 nt, hsa
auacuguuauguauaugcuaaauguugguaaauacuaauuaauuuccaucauuuguagacuugu

SEQ ID NO: 85875 - RNA, 64 nt, hsa
aucucaccccauauuguucuuaaauaaguauagacuaauuaaccuaagcuaccuuuaacaacgu

SEQ ID NO: 85876 - RNA, 64 nt, hsa
uuauaggcaugagccaccgugcccagccuacuuucuaauuaauuaaaaaaaaaaaaaaaaaaaa

SEQ ID NO: 85877 - RNA, 64 nt, hsa
cuaauuaaaagcauaguguauaagugaguacacucuaauuaacuugcuucuguugcacuuuagu

SEQ ID NO: 85878 - RNA, 64 nt, hsa
auaauaaauuaucaauuacacauuuuuguguuaacuaauuaaaagcauaguguauaagugagua

SEQ ID NO: 85879 - RNA, 64 nt, hsa
aaagcaccacuguucuguucauuuccuagcuguucuaauuaagaaaacuauuaagaugagcaac

SEQ ID NO: 85880 - RNA, 64 nt, hsa
uguuuauugacaggucuuuucaaauaaugcuuuucuaauuaauagccaaagauuucauaucuaa

SEQ ID NO: 85881 - RNA, 64 nt, hsa
cauagcauguuuauaucugcaaaaaaccuaauagcuaauuaaucuggaauaugcaacauugucc

SEQ ID NO: 85882 - RNA, 64 nt, hsa
cucacccuguuaugucuugcuaauuuaaauuuugcuaauuaacugaaacaugcuuaccagauuc

SEQ ID NO: 85883 - RNA, 64 nt, hsa
uuucuuuuaucuugauaacuccuagugagggaaucuaauuaagauuucaugcuguucuuuguaa

SEQ ID NO: 85884 - RNA, 64 nt, hsa
auuguuuauuuccaaggcauguauuauucaauuucuaauuaaaauauaucagggcuuauauuuu

SEQ ID NO: 85885 - RNA, 64 nt, hsa
uuccagccuaauuaaggacauagaaaauugaccucuaauuaaguggaucauuauuauggcauuu

SEQ ID NO: 85886 - RNA, 64 nt, hsa
aaauacuuuuuauguaucauugcuagguuccagccuaauuaaggacauagaaaauugaccucua

SEQ ID NO: 85887 - RNA, 64 nt, hsa
gaggcagaugagcuuacaaguauugaaauaauuacuaauuaaucacaaaugugaaguuaugcau

SEQ ID NO: 85888 - RNA, 64 nt, hsa
ugaaguuaugcaugauguaaaaaauacaaacauucuaauuaaaggcuuugcaacacaugccuug

SEQ ID NO: 85889 - RNA, 64 nt, hsa
gauccccuccauuuuuuguguuuugccuccuguucuaauuaauuuugucuccauacauaucuga

SEQ ID NO: 85890 - RNA, 64 nt, hsa
acauuccccgagaguguaaagagaucggaaauaacuaauuaaacaaauccgccacuuucaugac

SEQ ID NO: 85891 - RNA, 64 nt, hsa
gaacagaccaauaaugaguuccaaaauuuaaucacuaauuaaaaaucuaucaaacaaaacucug

SEQ ID NO: 85892 - RNA, 64 nt, hsa
aauugcaacaaaaacaaaaauugacaagugggaccuaauuaaacuaaauaacuucugcacagca

SEQ ID NO: 85893 - RNA, 64 nt, hsa
uugcuguaauauaaaacuuagaaguaaaccacugcuaauuaaucauuuuaaacuuucaaaaacu

SEQ ID NO: 85894 - RNA, 64 nt, hsa
ccaaauuaauuacaaucugguuguuuagccuaugcuaauuaagcccucuuaguaguaguauuca

SEQ ID NO: 85895 - RNA, 64 nt, hsa
gcuaccauguuaauacaucauuuuuuguuucuuccuaauuaacaaaagggcucuauaaugauua

SEQ ID NO: 85896 - RNA, 64 nt, hsa
auaauuucaauuuuuaaauuucuuggugcuuugucuaauuaauuacaucccauaacuugucagg

SEQ ID NO: 85897 - RNA, 64 nt, hsa
auagccaaggccaaaggaagcacaugccucucucaggccaaacucaccugccccucaacucucc

SEQ ID NO: 85898 - RNA, 64 nt, hsa
uguggguuucuaaagcugccagccgagauagccaaggccaaaggaagcacaugccucucucagg

SEQ ID NO: 85899 - RNA, 64 nt, hsa
accaacugaucaccacuaacucagagccuccuccaggccaaacagccccaaagucaauuaaagg

SEQ ID NO: 85900 - RNA, 64 nt, hsa
uuuguggaaccagaggcacagagagagucaacugaggccaaaagaggccugagagaaacugagg

SEQ ID NO: 85901 - RNA, 64 nt, hsa
uauaguaucuacuucugguacuaauauacacaaaaggccaaaaccaugccuauucugcaggugu

SEQ ID NO: 85902 - RNA, 64 nt, hsa
gcuccaccagugggccuuggaaaaugcaucaagaaggccaaaccagcuugacccuggcucacag

SEQ ID NO: 85903 - RNA, 64 nt, hsa
gccuugcucuugccaccaggacaccuaugucaacaggccaaacagccaugcaucuauaaagguc

SEQ ID NO: 85904 - RNA, 64 nt, hsa
auaguuguuuucuaacccagcccuccacugccaaaggccaaaagcucagacaguuggcagacgu

SEQ ID NO: 85905 - RNA, 64 nt, hsa
uaaagcauucaacauuguguaaaugaaucuuggaaggccaaagcuacugaauuuagcgaauuug

SEQ ID NO: 85906 - RNA, 64 nt, hsa
gcacuucggcucuggaguuacagaucuggguucaaggccaaauuccaccacuuacuagguuugu

SEQ ID NO: 85907 - RNA, 64 nt, hsa
uguauuggcuguucauguauguaggaguuaaaauaggccaaacuggagaaauaaacgcauucug

SEQ ID NO: 85908 - RNA, 64 nt, hsa
gucuucaggacaccauuagaugggcuuucccaauaggccaaaaaaaugcugcgcauacccagag

SEQ ID NO: 85909 - RNA, 64 nt, hsa
gggagcguggucguggaagaaacaacccaccugaaggccaaaugccagagauuugggguugggg

SEQ ID NO: 85910 - RNA, 64 nt, hsa
caggcuccuccuugcccccaccuugccccaggaaaggccaaaguccaggugacugcccuccuuc

SEQ ID NO: 85911 - RNA, 64 nt, hsa
cuaccagcaaauagcccuaacuugccucuagaguaggccaaaugccaacucuguaaaacacacu

SEQ ID NO: 85912 - RNA, 64 nt, hsa
ggacuucuggguacugagaagcagcagcagaaugaggccaaaugcagagaugaggcuaaggcaa

SEQ ID NO: 85913 - RNA, 64 nt, hsa
agugucuggggcuccugguacgacagaggggccgaggccaaaagugucuuccaucacuguaagu

SEQ ID NO: 85914 - RNA, 64 nt, hsa
acuggccccuuaauucccacaggcccccccagcaaggccaaagggaggccccuggguauugucc

SEQ ID NO: 85915 - RNA, 64 nt, hsa
auccucuuuguuuguucaaaggaccaguuuuccuaggccaaagaagucucuuccccauguuagu

SEQ ID NO: 85916 - RNA, 64 nt, hsa
gaccacagauuuggacaggaagggcucugagaagaggccaaagcccucauuuuacagaugagga

SEQ ID NO: 85917 - RNA, 64 nt, hsa
uccagccuggagggaaggggacaaagaccccaggaggccaaagggcugcagucaccccuugugc

SEQ ID NO: 85918 - RNA, 64 nt, hsa
gcuaaaaaucaggcuaaaaaucaggccaaaaaucaggccaaaugacuuggcaaauaauugacaa

SEQ ID NO: 85919 - RNA, 64 nt, hsa
gggaagaguccugcuaaaaaucaggcuaaaaaucaggccaaaaaucaggccaaaugacuuggca

SEQ ID NO: 85920 - RNA, 64 nt, hsa
uguuuaaaauaaaguauuaauacuuuaaagucaaauaagauauaguguuuacauucuuuagguc

SEQ ID NO: 85921 - RNA, 64 nt, hsa
augcuaauuuauuguuucuugguuucaccuuuguauaagauauagccaagacugaagaaaccaa

SEQ ID NO: 85922 - RNA, 64 nt, hsa
uuagggucauucuccuuaauaggcuuuuauguuaauaagauauauuuuuagaagagcuuguuug

SEQ ID NO: 85923 - RNA, 64 nt, hsa
uauuuuuagaagagcuuguuugggagauuagagaauaagauaaaagaaccaaaaccuuaggaua

SEQ ID NO: 85924 - RNA, 64 nt, hsa
ucuguucagaaucuuacagugaucaagcauuuuuauaagauauuugcaauuuuuguaaauauuu

SEQ ID NO: 85925 - RNA, 64 nt, hsa
ccaagucugaauuuacauuugacuaaagcagcacauaagauaauuugcuaaaaugcuaaucuuu

SEQ ID NO: 85926 - RNA, 64 nt, hsa
aaugccuuuaaucaguccucacaccuuucuacacauaagauaauuuauacuggagaggaacucu

SEQ ID NO: 85927 - RNA, 64 nt, hsa
aauacuuuaaaccaauccucaaaccucacuaaacauaagauaauacugaaaacuuuacaaaccu

SEQ ID NO: 85928 - RNA, 64 nt, hsa
aaagccuuuaaccaguuuucaacccuuauuacacauaagauaauucauagcggagagaaacccc

SEQ ID NO: 85929 - RNA, 64 nt, hsa
aaagccuuuaacugguccucaacucuuauuacacauaagauaauucacaguggagaaaaacccu

SEQ ID NO: 85930 - RNA, 64 nt, hsa
aaagcuuuuaaccaagucucaacacuuacuauacauaagauaauuuauacuggagcaaaaccuu

SEQ ID NO: 85931 - RNA, 64 nt, hsa
caguuucugcucuuaagggcuuaccguuuugucuauaagauacacaaguauaaaugacaaguac

SEQ ID NO: 85932 - RNA, 64 nt, hsa
auuucagauuacuuuuuaaugauuggaaugggcuauaagauauugugcugaagagaaaacaguu

SEQ ID NO: 85933 - RNA, 64 nt, hsa
uuauaaugauuuuuaaaaaacauaucuauuuggaauaagauacagcaacaaucauugcuacuga

SEQ ID NO: 85934 - RNA, 64 nt, hsa
aacauacuuauccucugaacacauaaauaagugaauaagauaaaaauaucuuuaccuuauuaau

SEQ ID NO: 85935 - RNA, 64 nt, hsa
aacucacuggaaauccaauuaacaauuuuacaacauaagauagaauggagaccugaauaauucu

SEQ ID NO: 85936 - RNA, 64 nt, hsa
uguuuuuuguuuguuuguuuuguuuuacccagaaauaagauaacuccaucucgccccuucccuu

SEQ ID NO: 85937 - RNA, 64 nt, hsa
aaagcuuuucaccaguacuuuacccuuaauacacauaagauaauuaaugcuggagagaaacccu

SEQ ID NO: 85938 - RNA, 64 nt, hsa
aaagauuucuauugauucucauaccuuacuaaauauaagauaauucauauuggagagaaauucu

SEQ ID NO: 85939 - RNA, 64 nt, hsa
aaagcuuuuaacaaauccucauccauuaguaaacauaagauaauucauacuggagagaaaaccu

SEQ ID NO: 85940 - RNA, 64 nt, hsa
aaagccuuuagccugucccuccaauuuacugcacauaagauaauuuauacuggagagaagcccu

SEQ ID NO: 85941 - RNA, 64 nt, hsa
aaagcuuuuaaccaauuuucaaaccuuacuaaacauaagauaacucauacuggagaaaaaucuu

SEQ ID NO: 85942 - RNA, 64 nt, hsa
aauuacacagcuaaaaaggaaaaaaaacaccaaaauaagauaaaauaaaacaaauuuaaacacc

SEQ ID NO: 85943 - RNA, 64 nt, hsa
aauaagauaaaauaaaacaaauuuaaacaccaaaauaagauauaauaaaacauuuguuuuugca

SEQ ID NO: 85944 - RNA, 64 nt, hsa
ggcuuuagggcucccccggcugggggcugugcaguccggucagggcgggaggggaaaugcaccg

SEQ ID NO: 85945 - RNA, 64 nt, hsa
guuuuguguugugcgcaggccucagagaugcucuuccggucagaguucccuuggcagggccuug

SEQ ID NO: 85946 - RNA, 64 nt, hsa
ucuguaugacugacgcuuggcagcagcuuuuguguccggucaccaguucugccgugcgaugggg

SEQ ID NO: 85947 - RNA, 64 nt, hsa
caaaguucugggauuacaggugugagcgaccacauccggucaaguucugacuuuucagggcagu

SEQ ID NO: 85948 - RNA, 64 nt, hsa
uggcuaguaguuucuucauuugaaauuguaagcauccggucaguaagaaugcccauccaguuuu

SEQ ID NO: 85949 - RNA, 64 nt, hsa
cagcugccaagucauuugaggaucucacggaccauccggucaccagaagugaaaaggcugccuc

SEQ ID NO: 85950 - RNA, 54 nt, hsa
agaaaagaagugaaucuugaggauuccggucagcuaccuaggcaucaccuuguu

SEQ ID NO: 85951 - RNA, 64 nt, hsa
auguggcccacaucugaccuggcagcccauguauuccggucauuagggaugggaagccaugagg

SEQ ID NO: 85952 - RNA, 64 nt, hsa
gauccugcuacagauucaacauaugacuggacaauccggucaccucucugggccucaguuaaug

SEQ ID NO: 85953 - RNA, 64 nt, hsa
cuucuguucucugucacaaccccaggugauuugguccggucaaaggccauacuuggggcccuaa

SEQ ID NO: 85954 - RNA, 64 nt, hsa
gauucagaugugcugaaagcucugccucuggcuuuccggucauggguuccaguuaauucaugcc

SEQ ID NO: 85955 - RNA, 64 nt, hsa
gaaagucacuucauucuaacuagaugcgcccacuuccggucauuauuucguuugcaugauguau

SEQ ID NO: 85956 - RNA, 64 nt, hsa
caaccucccccuccuguccccucuguucccgucuuccggucauucuuuucuccuccucucuccu

SEQ ID NO: 85957 - RNA, 64 nt, hsa
agcuacagugugucauagagcuggaggcgccccguccggucagcccucgcgcccucuccuucuu

SEQ ID NO: 85958 - RNA, 64 nt, hsa
ggcccuggaggggggguccccgcggcagcugaccuccggucaccugcuuccccuucugugcaaa

SEQ ID NO: 85959 - RNA, 64 nt, hsa
uccagaagcuaggagggagggauaccuggaagacuccggucaccuccuucuugcucagggccua

SEQ ID NO: 85960 - RNA, 64 nt, hsa
ggugucagaucccauccugcuccucuccagaguuuccggucaccuccguguucucagggagugc

SEQ ID NO: 85961 - RNA, 64 nt, hsa
cuugggagagauauaaaguggagggagggagccguccggucaguagggcaccaaucccaccucc

SEQ ID NO: 85962 - RNA, 64 nt, hsa
ccugaugcagggaaggaagaagagaaaacauauuuccggucaucucugguggugagaggcuggu

SEQ ID NO: 85963 - RNA, 64 nt, hsa
gacagugggagcuguguuacuagcacuauauaauuccggucagugcugacaaauaacauuuaac

SEQ ID NO: 85964 - RNA, 64 nt, hsa
acccagaggaugcagggaaagcacacugugucuuuccggucauuggauccucucccuuucccca

SEQ ID NO: 85965 - RNA, 64 nt, hsa
aguuaaacuauuuugagcauuagaauggaggaaauccggucagccaagugcagaguucagacuu

SEQ ID NO: 85966 - RNA, 64 nt, hsa
uauuagaaagcugacccaacaagagcucucugccuccggucacucuugcuguggugcuacgugg

SEQ ID NO: 85967 - RNA, 64 nt, hsa
ugaucccaucucuuuucccuucuuuccuccugguuccggucaguucagaggauuuaacaaucac

SEQ ID NO: 85968 - RNA, 64 nt, hsa
cuggagcggagcugaggcuccuucccagcaacacuccggucagccccuggcaaucccaccaaau

SEQ ID NO: 85969 - RNA, 64 nt, hsa
ugaggaaucccagggugacucugucggggaagaauccggucacagccuccccucagagacaggc

SEQ ID NO: 85970 - RNA, 64 nt, hsa
gucuucauguggagcccucaccacaaucccugacuccggucauuugugccuuucucuugucauc

SEQ ID NO: 85971 - RNA, 64 nt, hsa
ggcauggccagucguggcaggccggccuucagcguccggucagggaagcgugcagcccaaaugg

SEQ ID NO: 85972 - RNA, 64 nt, hsa
aaaacaguugucuggcaucagcuucaggagcggguccggucauucugaaacugucccuccagag

SEQ ID NO: 85973 - RNA, 64 nt, hsa
auccccauccuauaguucauaguccucuccugguuccggucaaagccuuuccucagccuucacc

SEQ ID NO: 85974 - RNA, 64 nt, hsa
ugucugaaaacaucacuuuuuguggauuuguguauccggucaccaaacggugaauauuauagaa

SEQ ID NO: 85975 - RNA, 64 nt, hsa; identical to SEQ ID NO: 70731

SEQ ID NO: 85976 - RNA, 64 nt, hsa; identical to SEQ ID NO: 70732

SEQ ID NO: 85977 - RNA, 64 nt, hsa; identical to SEQ ID NO: 70733

SEQ ID NO: 85978 - RNA, 64 nt, hsa; identical to SEQ ID NO: 70734

SEQ ID NO: 85979 - RNA, 64 nt, hsa; identical to SEQ ID NO: 70735

SEQ ID NO: 85980 - RNA, 64 nt, hsa; identical to SEQ ID NO: 70736

SEQ ID NO: 85981 - RNA, 64 nt, hsa; identical to SEQ ID NO: 70737

SEQ ID NO: 85982 - RNA, 64 nt, hsa; identical to SEQ ID NO: 70738

SEQ ID NO: 85983 - RNA, 64 nt, hsa; identical to SEQ ID NO: 70739

SEQ ID NO: 85984 - RNA, 64 nt, hsa; identical to SEQ ID NO: 70740

SEQ ID NO: 85985 - RNA, 64 nt, hsa
cuuacuaacaccuaugauguuaccugaaaucaaucucccauauguaugcuguaugcuaugcuaa

SEQ ID NO: 85986 - RNA, 64 nt, hsa
aaaaaaaacugucuugucuacuuuuagcuucauucucccauauuuugaaggguguguaacuuca

SEQ ID NO: 85987 - RNA, 64 nt, hsa
acaaaggggagaagggccagcccuacaucuucagcucccauagcgcuggcucaggaagaaaccc

SEQ ID NO: 85988 - RNA, 64 nt, hsa
ucccaagcuuugaauacccccagagaccuuuucucucccauaccaucacugaguggcuugugau

SEQ ID NO: 85989 - RNA, 64 nt, hsa
cucacucugucugguauaggcuaauuuugaagaacucccauaaguuucugcugcuucucccaua

SEQ ID NO: 85990 - RNA, 64 nt, hsa
aauuuugaagaacucccauaaguuucugcugcuucucccauaacugcugccaccaccaucagaa

SEQ ID NO: 85991 - RNA, 64 nt, hsa
ugucacuguacuaucuacauguggaagaauguucaaguugaauccuaaugccgugaaugaaaca

SEQ ID NO: 85992 - RNA, 64 nt, hsa
aaugaaacacagucuguguagggaaugagcaaaaaaguugaauuccaauugcuuuuuggccuuu

SEQ ID NO: 85993 - RNA, 64 nt, hsa
ugaacaugcucuucaaaaagaugcacuuaguauuaaguugaaacuugaacaaauagauggucac

SEQ ID NO: 85994 - RNA, 64 nt, hsa
aggacaguguuucaacaagccuaggcuaucucguaaguugaaaaauaucccacuauaguugcuu

SEQ ID NO: 85995 - RNA, 64 nt, hsa
caugucaaaggaacuuuugagugaugacucugagaaguugaauugcuugaagaguucaucacgg

SEQ ID NO: 85996 - RNA, 64 nt, hsa
uuaauaaaugaaggcaugagaggaaguaaguagcaaguugaaggacagguaguugagaugaaac

SEQ ID NO: 85997 - RNA, 64 nt, hsa
acuucuuauuugaaguuaaaauuucuuauuugaaaaguugaaauuuaugagcuuugaagauugc

SEQ ID NO: 85998 - RNA, 64 nt, hsa
ucuagacucaccaagaacuacauguuaugauguuaaguugaaguugaaacaugauguuuugcau

SEQ ID NO: 85999 - RNA, 64 nt, hsa
cucaccaagaacuacauguuaugauguuaaguugaaguugaaacaugauguuuugcauuaaauu

SEQ ID NO: 86000 - RNA, 64 nt, hsa
cuaaaaaguaaaaaugaaaaagacgacauggcagaaguugaaacaaacuuguauguaucuguau

SEQ ID NO: 86001 - RNA, 64 nt, hsa
gacuuuaugaagggaagauugucuagguugcaguaaguugaaauaugguuuuguuauuucuuga

SEQ ID NO: 86002 - RNA, 64 nt, hsa
cauacauacuuuacaagcaaguuaaauggagauaaaguugaaaucauagaagaugcaaaugacc

SEQ ID NO: 86003 - RNA, 64 nt, hsa
cccugcccgcaagagcuaaguaggaucuuacuguaaguugaagggaguuuugcccuaacucaug

SEQ ID NO: 86004 - RNA, 64 nt, hsa
gcagugugaacgcaucccaacauagguuaagagcaaguugaaaacaaaggccauggcauucugc

SEQ ID NO: 86005 - RNA, 64 nt, hsa
uggugucuguuuauguaacucugacuugcuggaaaaguugaaacuccaaauaaucugaaacuag

SEQ ID NO: 86006 - RNA, 64 nt, hsa
cguuggacaaauuuugaguuuuaacaaggacaaaaaguugaaagaaaaggcacaguuaacaaaa

SEQ ID NO: 86007 - RNA, 64 nt, hsa
cugaaacaugucuguuaccccucuccaucuuaccaaguugaaaaggggaauauuuggccacaua

SEQ ID NO: 86008 - RNA, 64 nt, hsa
uuuaauuuugggaaauuuuaaaguaaaaguuucaaaguugaaagauuauagugaguacccuuau

SEQ ID NO: 86009 - RNA, 64 nt, hsa
gcaucauggaacgccacaggauuuuuacauuaaaaaguugaauauguuccugcauuucagcagu

SEQ ID NO: 86010 - RNA, 64 nt, hsa
ugauaaacccaucauaaguugaaaauaugaucauaaguugaaaauaugaucauaagucaaaaau

SEQ ID NO: 86011 - RNA, 64 nt, hsa
augugauggguuugcauccugauaaacccaucauaaguugaaaauaugaucauaaguugaaaau

SEQ ID NO: 86012 - RNA, 64 nt, hsa
gcuuucccaucaucauaaaauuuuuaaaaauccuaaguugaaucauuguuaguccgggaccuuc

SEQ ID NO: 86013 - RNA, 64 nt, hsa
ucucaauaaacccaucguaaguccaaaauauuggaaguugaaaaugcauugaauacacccaacc

SEQ ID NO: 86014 - RNA, 64 nt, hsa
gacacuuuguugcaacccuuuuucaaguacuugaaaguugaaaauuugaaaucuugguauugau

SEQ ID NO: 86015 - RNA, 64 nt, hsa
guuaacuccuguauauaucauuaaaauaaaucugaaguugaaguaguguuuuuaguuaaauuau

SEQ ID NO: 86016 - RNA, 64 nt, hsa
cuuccuuuagaaggaacuguuauaauuuauuuaaaaguugaaaaaccacccaagaugacuacca

SEQ ID NO: 86017 - RNA, 64 nt, hsa
uacuacgaucacagacacagacauacuuuuccuaaaguugaagcauuuguucccaggauuuauu

SEQ ID NO: 86018 - RNA, 64 nt, hsa
acugaagacauugucauguuuuauuaauuuaacaaaguugaaagugacugcucuguacaucaug

SEQ ID NO: 86019 - RNA, 64 nt, hsa
ugagcagugucaguaaauacugugcauucaguagaaguugaagaaucauuguuagaagcauuuc

SEQ ID NO: 86020 - RNA, 64 nt, hsa
aaaagcacauuucauguguauucaacccuaaguaaaguugaaugaaacuuaacagaauggaaau

SEQ ID NO: 86021 - RNA, 64 nt, hsa
uuucuaagguugugcuaauucuuuugguugugaaaaguugaauuuuucuguugccuucguuuuc

SEQ ID NO: 86022 - RNA, 64 nt, hsa
gcaacuccaagacacauaauugucagauucaccaaaguugaaaugaaggaaaaaauguuaaggg

SEQ ID NO: 86023 - RNA, 64 nt, hsa
aacacguacacccucccaagacuaaaccaggaagaaguugaaucucugaauagaccaauaacag

SEQ ID NO: 86024 - RNA, 64 nt, hsa
gcacuucgcaacugacuucuuguccugggguuaaaaguugaagauauuuucugaugauauuaaa

SEQ ID NO: 86025 - RNA, 64 nt, hsa
guuaaaaguugaagauauuuucugaugauauuaaaaguugaagauauuucugcacuugggcccu

SEQ ID NO: 86026 - RNA, 64 nt, hsa
aaucaauaaauaaacucaaccgaaauggguaugaaaguugaaauggguauguaaguugaaaacc

SEQ ID NO: 86027 - RNA, 64 nt, hsa
accgaaauggguaugaaaguugaaauggguauguaaguugaaaaccagaaguuuugagaaacau

SEQ ID NO: 86028 - RNA, 64 nt, hsa
cacagguaccccaaggaguagaugccaggguccuaaguugaaaaugaugucgauugggggcggg

SEQ ID NO: 86029 - RNA, 64 nt, hsa
uguacagcacuuauagaaauaagcuguucuuuugaaguugaaauacccaguaaaauguugaaga

SEQ ID NO: 86030 - RNA, 64 nt, hsa
cccuguuugauuucuucaugcuuuugcccuucucaaguugaaguugcauacauccaauaucgua

SEQ ID NO: 86031 - RNA, 64 nt, hsa
uguguccugacucccuugaggcuuauaaugggccaaguugaagacuguugaugaucccuggugg

SEQ ID NO: 86032 - RNA, 64 nt, hsa
aaacaacgaaaugaaaagguaucaggaaaaaaagaucaggaaguuguauucagguacaaaucuu

SEQ ID NO: 86033 - RNA, 64 nt, hsa
uuuaaaugcuaaagaaacaacgaaaugaaaagguaucaggaaaaaaagaucaggaaguuguauu

SEQ ID NO: 86034 - RNA, 64 nt, hsa
guuaucugucauuuuuuuuuuucacaucaguuugaucaggaaaguguauaacacaucuuagagc

SEQ ID NO: 86035 - RNA, 64 nt, hsa
agaauuuauuaugucagauguuuuuucauucauuaucaggaaguuuuaguuaucugucauuuuu

SEQ ID NO: 86036 - RNA, 64 nt, hsa
cacuucuuuaagcuuuuuuuuuuuaaugucaugaaucaggaaggauacauagugauucguauac

SEQ ID NO: 86037 - RNA, 64 nt, hsa
uuuacuaagguuuagcaccuuugaucuuuucuaaaucaggaaaaaaaucuaugcauauugaggu

SEQ ID NO: 86038 - RNA, 64 nt, hsa
aaaagugagcaccaaaaacuucauuaaucaccuuaucaggaaggaauauccugccauaguaaaa

SEQ ID NO: 86039 - RNA, 64 nt, hsa
cacugcaugugugaugguuguuugccaucuguugaucaggaacuacuucagcuacuugcauuug

SEQ ID NO: 86040 - RNA, 64 nt, hsa
guuuuaaugauuucaccaugggauuaagaacuauaucaggaacaucccugagaaacgguuuuaa

SEQ ID NO: 86041 - RNA, 64 nt, hsa
guccagacuuugaacuugccugccagccuucagcaucaggaaaggccaaguccugggugugagu

SEQ ID NO: 86042 - RNA, 64 nt, hsa
guuacuggagaguucuugaagccagggauaccauaucaggaacuauucaggaucuaugauauuu

SEQ ID NO: 86043 - RNA, 64 nt, hsa
aaggcuuaaacuaaaccuugacauccacaguagcaucaggaauagaaauguguauuuuggcuac

SEQ ID NO: 86044 - RNA, 64 nt, hsa
aacaaacuaaguuacuuuuuuacuaacaaggaagaucaggaauaauauuucuuugaaagcugaa

SEQ ID NO: 86045 - RNA, 64 nt, hsa
uucuuuagaaaugggugggagaaugaaaaugcaaaucaggaaaccacauuaaagucaaggaaau

SEQ ID NO: 86046 - RNA, 64 nt, hsa
uagacaacuugcagauaauuucuuuauugaaacuaucaggaaguuuuacuaugaaauuuuacau

SEQ ID NO: 86047 - RNA, 64 nt, hsa
agcuuauaugcaaacauaauaaauauuauuaaauaucaggaaagcuaacauuucauacaagaua

SEQ ID NO: 86048 - RNA, 64 nt, hsa
ucucucagugugaacaugccuucugugggcggaaaucaggaagccaccagcuguuaauggagag

SEQ ID NO: 86049 - RNA, 64 nt, hsa
aaaggaauggauaaaguaguguaauggauugacaaucaggaagaacagaauaacucaguuuuuu

SEQ ID NO: 86050 - RNA, 64 nt, hsa
aauaaaaccagagggagaggacccucagugucauaucaggaagcccagugccagaggacagaca

SEQ ID NO: 86051 - RNA, 64 nt, hsa
aacacagaugcagaaauccucaaaauauuagcaaaucaggaaugcaaggcuuguucaacauuug

SEQ ID NO: 86052 - RNA, 64 nt, hsa
cuugauguuuccaacuagacacuuuccuacuaagaucaggaacauggcaaggaacaccacacca

SEQ ID NO: 86053 - RNA, 64 nt, hsa
cuugauguuuccaacuaaaugcuuuccuacuaagaucaggaacauggcaaggaacaccacugcu

SEQ ID NO: 86054 - RNA, 64 nt, hsa
aacacagaugcagaaauccuuaaaauguuagcaaaucaggaaugcaagccuuguucaacauuug

SEQ ID NO: 86055 - RNA, 64 nt, hsa
gaucguuugagccugggaggcagagguugcagugaucaggaauugugccacugcacuccaaccu

SEQ ID NO: 86056 - RNA, 64 nt, hsa
gaaaaauuuagacggucuucauuuuaaaauuggcaucaggaaggauuaccaugaacuuauuuua

SEQ ID NO: 86057 - RNA, 64 nt, hsa
uacauauauaaaauauauauauuaaaauaaaauuaucaggaauacugccucaguuauugaacuu

SEQ ID NO: 86058 - RNA, 64 nt, hsa
auuuacucccagauccucuugcagacccagaauuaucaggaacauagcucugugauucaugagu

SEQ ID NO: 86059 - RNA, 64 nt, hsa
uucuuuccuuucucuucuuuuaucuccaagguuaaucaggaaaaauagcuuuugacaggggaaa

SEQ ID NO: 86060 - RNA, 64 nt, hsa
aaaaacucaauaacuagcuauuuuugaccuccugaucaggaacuuuaguugaagcguaaaucua

SEQ ID NO: 86061 - RNA, 64 nt, hsa
cguuguuuaccaaauuuucuuagauuuggucaucaucaggaagcauuuguaaaaauaaaaaucu

SEQ ID NO: 86062 - RNA, 64 nt, hsa
aagcuguguuuacagggcauuccaagugauucuuaucaggaaaugugaaaaacacuccuguaca

SEQ ID NO: 86063 - RNA, 64 nt, hsa
gugaauguggaaauggccaccuggguuuucccauaucaggaagggcuuugggauggcaccuaua

SEQ ID NO: 86064 - RNA, 64 nt, hsa
cgcccagagugcucaaggcugguaugaucaguggaucaggaaugcaauugugaauuccugccca

SEQ ID NO: 86065 - RNA, 64 nt, hsa
cuuccuaaccguccugucuucucuuggcgcucuuuccuuccaccuuucccaagaguccugguug

SEQ ID NO: 86066 - RNA, 64 nt, hsa
cauccuugcauucuuccuagaagaguuccucugcuccuuccauuccauuuuuguguuuguuuug

SEQ ID NO: 86067 - RNA, 64 nt, hsa
cguuuggagagaaugacuagcauuuaucuucuuuuccuuccaugccaaagguuggagucugcug

SEQ ID NO: 86068 - RNA, 64 nt, hsa
uggaucccacacuggcagagauggggccaccccuuccuuccaggcacaucucacauugccaugu

SEQ ID NO: 86069 - RNA, 64 nt, hsa
cacuucagcugggucacauccaucccuccauucauccuuccauccaucuuuccauccauuaccu

SEQ ID NO: 86070 - RNA, 64 nt, hsa
uuccauccaucuuuccauccauuaccuccauccauccuuccaacauauauuuauugaguaccua

SEQ ID NO: 86071 - RNA, 64 nt, hsa
guauaagucugggcacuggaugcaugaauuccacuccuuccagaaccaacugcauugguuuucc

SEQ ID NO: 86072 - RNA, 64 nt, hsa
guaccucucauuugggcaccuuaaaacuuaacuauccuuccagggcucuuccagaugaggccca

SEQ ID NO: 86073 - RNA, 64 nt, hsa
auugccacugagagaucugcugucagucugcuuauccuuccacgguaaguaaauuguguuuucu

SEQ ID NO: 86074 - RNA, 64 nt, hsa
gacuuggggaaaaauggggaagaguugaaauacguccuuccacccaaaccuuuguuuaguaaua

SEQ ID NO: 86075 - RNA, 64 nt, hsa
uacuuuuauuugcaacauuuacaguccuucaaaauccuuccaaagaauucuuauacacauuggg

SEQ ID NO: 86076 - RNA, 64 nt, hsa
uuacuugagccuuuaauggacuuauuucuucaaauccuuccaaaaauuauuauaagcauugaaa

SEQ ID NO: 86077 - RNA, 64 nt, hsa
uugcaucucauccuggccuggagaacauucaguuuccuuccaacccuucccaccuuucccccac

SEQ ID NO: 86078 - RNA, 64 nt, hsa
cugcaccauagccugcggcuccccuauucaggucuccuuccacaacucugaagagagagaccac

SEQ ID NO: 86079 - RNA, 64 nt, hsa
cuugugcacacccuugugccuuugcucgcauuaauccuuccaagagacuucccuccuguucucc

SEQ ID NO: 86080 - RNA, 64 nt, hsa
cagaaguguuaacuauuguauucccauuuuuuucuccuuccaucucuucugcgguaauucauca

SEQ ID NO: 86081 - RNA, 64 nt, hsa
aggugagggggccgaccccugcggggcucagggcuccuuccauucuaaccuugagccacagugu

SEQ ID NO: 86082 - RNA, 64 nt, hsa
aaaaugggugcccuggaggggccugacaguggguuccuuccauggcggauacucccuugaaauu

SEQ ID NO: 86083 - RNA, 64 nt, hsa
gucuuuccucugugcuggccuaggacauuaggauuccuuccacggcuccggccgcuaggacccu

SEQ ID NO: 86084 - RNA, 64 nt, hsa
ugagcuucuuccgugguuuccuuuuggaaacuccuccuuccaacaagcagugggaucccggggc

SEQ ID NO: 86085 - RNA, 64 nt, hsa
acgacugggauuucuucugagacuguggugaaacuccuuccaaggcugagggggucaguaggug

SEQ ID NO: 86086 - RNA, 64 nt, hsa
ugcuuugacugcgaaaggaaaccucacuguuuccuccuuccagggacugaggucuccaagcuag

SEQ ID NO: 86087 - RNA, 64 nt, hsa
uaaaguuguaaaaauauugugaugucaccaauuuuccuuccaucuccacauccccuaacaucug

SEQ ID NO: 86088 - RNA, 64 nt, hsa
uauaaacaugcaaaaaaacuaauucauguuaaaguccuuccagauccuaauuucuaaagcaauc

SEQ ID NO: 86089 - RNA, 64 nt, hsa
ccuuuccccgccccucaaaucguccuuuaagucuuccuuccaagugcuguggggcauaacgaug

SEQ ID NO: 86090 - RNA, 64 nt, hsa
cgcacuccucuguagaugugugcccagugggaguuccuuccagccccaggaccacagcagcagc

SEQ ID NO: 86091 - RNA, 64 nt, hsa
gucgcccaccucagcgcccaggagccuugggacuuccuuccauaugauaaaucauucuucuuca

SEQ ID NO: 86092 - RNA, 64 nt, hsa
cuagacuagaaauccaucaucucuaucguugauauccuuccauccaggaauagauuuuucuuac

SEQ ID NO: 86093 - RNA, 64 nt, hsa
caggauguggacuacugagcccugaagaaauaaguccuuccacuuugaccccauggaggauugc

SEQ ID NO: 86094 - RNA, 64 nt, hsa
cuguccacaucccucugccccucccagaccucuguccuuccaccaaucgccucccgcagccccg

SEQ ID NO: 86095 - RNA, 64 nt, hsa
uucagacugaaaacauguuucacagguguuugcuuccuuccagagcagaguucccuauuccccu

SEQ ID NO: 86096 - RNA, 64 nt, hsa
gaguugacuaacucaaccuguaaaacaccacuccuccuuccaaaguuguauauauaauauugca

SEQ ID NO: 86097 - RNA, 64 nt, hsa
auccuccgcaaaggaaagcucuuuacccagaauguccuuccagagucauucaggaaggacaagg

SEQ ID NO: 86098 - RNA, 64 nt, hsa
uuuuaacaaaucuuaauuauuaaacucuuuuccuuccuuccauuucucccucccuuguccaucu

SEQ ID NO: 86099 - RNA, 64 nt, hsa
gggccucagccugggaagucaccaagcagaucccuccuuccagcuuccugcucuuucuccuuuu

SEQ ID NO: 86100 - RNA, 64 nt, hsa
cucguucccccugucucccuccuccauuacuucuuccuuccaggucucucucucucuuuugguu

SEQ ID NO: 86101 - RNA, 64 nt, hsa
aaaguccaaguagagauuacacccagaacaccauuccuuccaggagcaguaggugggagguuug

SEQ ID NO: 86102 - RNA, 64 nt, hsa
caaaaggacgacgguggccaacuaaagcaagucuuccuuccacccuguggccugcacuugagcc

SEQ ID NO: 86103 - RNA, 64 nt, hsa
ucucuuugccaaguuguuuuccuuucagggccuguccuuccaguuuagaacaguaccaugaauc

SEQ ID NO: 86104 - RNA, 64 nt, hsa
ucgauauguacauauuacucacguauaccccauuuccuuccagucagcccaacauuuuccacca

SEQ ID NO: 86105 - RNA, 64 nt, hsa
uccagcccccuauucugguaacuaccaggaggcuuccuuccagcccccuauucugguaacuacc

SEQ ID NO: 86106 - RNA, 64 nt, hsa
acugagguguucaaaucgaaucucccaggaggcuuccuuccagcccccuauucugguaacuacc

SEQ ID NO: 86107 - RNA, 64 nt, hsa
aagugugaacuugugaauguaauugaucuuuccuuccuuccagagaaagauuuaagggacacug

SEQ ID NO: 86108 - RNA, 64 nt, hsa
uagcccaccauaggcacagcacaucccaccacucuccuuccaguccugaccaggccccagccgg

SEQ ID NO: 86109 - RNA, 64 nt, hsa
agaguugucuguccaggcccuuagggaaguugucuccuuccauucagauguuaauggggacccu

SEQ ID NO: 86110 - RNA, 64 nt, hsa
gagaggggcgccuuuucagcccuuugcucugauuuccuuccaaggucacucuuggucccuggaa

SEQ ID NO: 86111 - RNA, 64 nt, hsa
aaaguuauauuuaugacuugcaaugauagaaaacuccuuccaauuaaauggcauuuuauaauau

SEQ ID NO: 86112 - RNA, 64 nt, hsa
aaugguguugaaggacuucucauuuuuggagcuuuccuuccagaguccuggcugauugguguuc

SEQ ID NO: 86113 - RNA, 64 nt, hsa
gcuggucuggccuggugacucucaggguaucuucuccuuccagcuacuuucgcucacugaucuc

SEQ ID NO: 86114 - RNA, 64 nt, hsa
cauguaugggcucccaaggacccagcagccuggauccuuccagagcaucccuccuggaggccug

SEQ ID NO: 86115 - RNA, 64 nt, hsa
uccuguggcuggucugggguggggucuguugugguccuuccacggugucaguggccugaagucc

SEQ ID NO: 86116 - RNA, 64 nt, hsa
ggcuggguacucagcagccacucugagccggggcuccuuccaggagcugaaauccaccugucuc

SEQ ID NO: 86117 - RNA, 64 nt, hsa
gagcauuagcaagugucacugcucaucaguuacuuccuuccauuuauaucacaaauacccaagu

SEQ ID NO: 86118 - RNA, 64 nt, hsa
agcagacaagacuccuuagaacuguccucagauuuccuuccacccauuaaggaaacagauuugu

SEQ ID NO: 86119 - RNA, 64 nt, hsa
auuguuucuauauauuuugccccugcuauaaaauuccuuccaugaagaaaacugcugcuuucag

SEQ ID NO: 86120 - RNA, 64 nt, hsa
uauuuaauucuccuuuacauugccaccuuaacaauccuuccagcuacguaucuuaaaggaugug

SEQ ID NO: 86121 - RNA, 64 nt, hsa
uaugaggucaccuacggcuguggccgugcaggccuccuuccagcccagaguggcccaguagagc

SEQ ID NO: 86122 - RNA, 64 nt, hsa
ucucagggcagcccuugacuccuaagccccuuccuccuuccauucugcauccccuccccaucca

SEQ ID NO: 86123 - RNA, 64 nt, hsa
cuccacccccauaagauugugaaggguuuacugcuccuuccaucugccugaccccuucacuaug

SEQ ID NO: 86124 - RNA, 64 nt, hsa
accuauuuucugcagcugcucccagauuacuccuuccuuccaauauaacuaggcaaaaagaagu

SEQ ID NO: 86125 - RNA, 64 nt, hsa
cugggcccguggccugaacccuccugcacuccuccagcuggagucucaccgcggaucccaggaa

SEQ ID NO: 86126 - RNA, 64 nt, hsa
ugggcacacggccccugccguggggcucacucugcagcuggagagacagcauaccugaaaccug

SEQ ID NO: 86127 - RNA, 64 nt, hsa
ugugcugggggugguagaaaggaugcugcugaggcagcuggaggagugggaguagcucagaggg

SEQ ID NO: 86128 - RNA, 64 nt, hsa
guggcuggcugaggugcaugggccccacacaggacagcuggagaaugggccguccacuuggccu

SEQ ID NO: 86129 - RNA, 58 nt, hsa
gagaaaccaccagcaacuaagcugcauucagcuggaguuccucggaacgggaggacuc

SEQ ID NO: 86130 - RNA, 64 nt, hsa
ggacaguggcugaggggcuuccuguugcagccuucagcuggacucaggguuggggucacuggag

SEQ ID NO: 86131 - RNA, 64 nt, hsa
cccucaucagcuccccacaccagucaaggcuucucagcuggagaaccggggagcagcuggacac

SEQ ID NO: 86132 - RNA, 64 nt, hsa
ccagucaaggcuucucagcuggagaaccggggagcagcuggacacccagccaaggcccugccaa

SEQ ID NO: 86133 - RNA, 64 nt, hsa
gguggugagcacaucugggaggcuggucucccuccagcuggaauugcugcucucugagggagag

SEQ ID NO: 86134 - RNA, 64 nt, hsa
gggugaugaugaccaagaauuacaaguagaauggcagcuggaauuuaaggagggacaagaauca

SEQ ID NO: 86135 - RNA, 64 nt, hsa
cccgagguggucuuuuguuuuaaacagggggcaacagcuggaucuccaaguacauauggauuuu

SEQ ID NO: 86136 - RNA, 64 nt, hsa
uuuaaucuacuucuuugacuaccaguggagauuucagcuggacuauguugaugggguuuguugu

SEQ ID NO: 86137 - RNA, 64 nt, hsa
agugcggaugcaagagcaccuggccaagcgagagcagcuggauuuuauggagagcaugcuaucc

SEQ ID NO: 86138 - RNA, 64 nt, hsa
cugaggcuccgccccagcccucagccccaggccccagcuggagaaaaaacauugcccagggauu

SEQ ID NO: 86139 - RNA, 64 nt, hsa
ucaccucuauugccuucuugcacugaggauuuuucagcuggauuucugcaauccaagcuacuca

SEQ ID NO: 86140 - RNA, 64 nt, hsa
cucaugauuuuuccuuugugaaaucccugguuuucagcuggaagcgguggguaaaugaggucug

SEQ ID NO: 86141 - RNA, 64 nt, hsa
aggccccaccuccuccuccauacguucagaggugcagcuggaggcugcuguggggaccacacug

SEQ ID NO: 86142 - RNA, 64 nt, hsa
cccagaggacuuuauucggaccaagcagagcucacagcuggacagguguuguauauagagugga

SEQ ID NO: 86143 - RNA, 64 nt, hsa
caugcaccuggccggccaccugccacugggcccacagcuggagcagcuggacagagguuucugg

SEQ ID NO: 86144 - RNA, 64 nt, hsa
ggccggccaccugccacugggcccacagcuggagcagcuggacagagguuucugggagaccuac

SEQ ID NO: 86145 - RNA, 64 nt, hsa
ccccaggucccggaggggaagugaagcaacagcccagcuggaagggcgucuucugcggagaaau

SEQ ID NO: 86146 - RNA, 64 nt, hsa
ccucccugucucuccgccagcucugagucccaggcagcuggacaucuccaggaaaccaggccau

SEQ ID NO: 86147 - RNA, 64 nt, hsa
gcugcggggcucuuguuggccgcacguggcagugcagcuggagaggaagccuggggcacguccu

SEQ ID NO: 86148 - RNA, 64 nt, hsa
ggaaaagauccaggcccuccacuucuccuugaggcagcuggagagcuaucccccgccccucaag

SEQ ID NO: 86149 - RNA, 64 nt, hsa
uauuaagaucugguagagguaccagcuuccuuuccagcuggagaggccccaacacuggaugguu

SEQ ID NO: 86150 - RNA, 64 nt, hsa
ccaggcccgggguuguuggggagagaggcagaggcagcuggagcgccguucucuccugcuggga

SEQ ID NO: 86151 - RNA, 64 nt, hsa
acuuguagugagccaagaucacgccacugcacuccagcuggagugacagagccaaacuccguca

SEQ ID NO: 86152 - RNA, 64 nt, hsa
caggcuccccggggccuuccuauuauguaaaucccagcuggacagacagcccuggagccaggug

SEQ ID NO: 86153 - RNA, 64 nt, hsa
gucaagagugaauucccucacucgucucccccaacagcuggacccugaccagcucccccucccu

SEQ ID NO: 86154 - RNA, 64 nt, hsa
ccucucauuuagccuguccugucaucaucauggccagcuggaggcaggggcuuccuggugcugg

SEQ ID NO: 86155 - RNA, 64 nt, hsa
gggccggcuggcgcggcuggagcuggagcgggcacagcuggagaugcagagccagcagcugcgc

SEQ ID NO: 86156 - RNA, 64 nt, hsa
gaugcagagccagcagcugcgcgaguccaaccagcagcuggaccugagcgccugccggcugacc

SEQ ID NO: 86157 - RNA, 64 nt, hsa
agcuggaggcuacgcauggccucugcagcacacgcagcuggagagggcuucugucccugucagc

SEQ ID NO: 86158 - RNA, 64 nt, hsa
cuaacuggcccaggcacuggaguggaauagaaugcagcuggaggcuacgcauggccucugcagc

SEQ ID NO: 86159 - RNA, 64 nt, hsa
ugaagaccagcaggggcuuccuaaaaagcagcagcagcuggaauuccaaggccaaguccugcag

SEQ ID NO: 86160 - RNA, 64 nt, hsa
acuguugcuaugacaacagggagaaccccaucuccagcuggaacgugaagguaauggcuccucu

SEQ ID NO: 86161 - RNA, 64 nt, hsa
agguucaucccucaguuggggggaacguaggacccagcuggagccucuugagggagaugagagg

SEQ ID NO: 86162 - RNA, 64 nt, hsa
ucuaggggcacauccagucuccaucgugcugcagcagcuggacugagggcagagccuguaggug

SEQ ID NO: 86163 - RNA, 64 nt, hsa
ucaguucccuccugugucaaguagcuaacugcagcagcuggacugagggcagagucugugggug

SEQ ID NO: 86164 - RNA, 60 nt, hsa
uugggguggggcuguccugaugcacgcagacagcuggaagggucuugguuuucugaaacu

SEQ ID NO: 86165 - RNA, 64 nt, hsa
acugcagccuugacccccucccugaccuccccgccagcuggacuccagccauccuccugccuca

SEQ ID NO: 86166 - RNA, 64 nt, hsa
gugaccccucgggacugccuggugcaggugguggcagcuggagggacccaugcagcacccaggu

SEQ ID NO: 86167 - RNA, 64 nt, hsa
aggucagagcagacccuccccugccggccugcgccagcuggaccugauggcccccuguggcgcc

SEQ ID NO: 86168 - RNA, 64 nt, hsa
cagaggaaaacgcuucuuucuccuccagcugaaucagcuggaucccaguguccuggcuguuugg

SEQ ID NO: 86169 - RNA, 64 nt, hsa
aucgcucaaacaccuguuugcagaccccaugcaccagcuggaggggccguaacugcaggacugc

SEQ ID NO: 86170 - RNA, 64 nt, hsa
auagcaauuccccuacaucaaaugcucaagcccccagcuggaaguuaagagaaagucaccugcc

SEQ ID NO: 86171 - RNA, 64 nt, hsa
cagaaggcacuaagcuuccugggccccucacccccagcuggaaauuaagaaaaagucgcccgaa

SEQ ID NO: 86172 - RNA, 64 nt, hsa
ccgcauuagcucuagcaaugagguucacuggauacagcuggauacuggggugagucucuugccu

SEQ ID NO: 86173 - RNA, 64 nt, hsa
agcuuggggcuggaugaaggggucuccgccagcucagcuggagccggagccggggagacucuga

SEQ ID NO: 86174 - RNA, 64 nt, hsa
cuuggcccggcagcaccacgcugacuauagcaaccagcuggacccggccucuggcacccgaaac

SEQ ID NO: 86175 - RNA, 64 nt, hsa
ccgcucuggauaagacacccaaccccaacuccagcagcuggacucugggcccacaaggggaggg

SEQ ID NO: 86176 - RNA, 64 nt, hsa
gcccagaauaaccgccacccuugccauccugcaacagcuggacucaaguuuccaggaaguggag

SEQ ID NO: 86177 - RNA, 64 nt, hsa
agcagggaagggggacccaaggcaggagguacaccagcuggacaaauugcagggaggggaggga

SEQ ID NO: 86178 - RNA, 64 nt, hsa
cugggguaggagggccugccugagucccagcucccagcuggagaauccaccagcacaagaagag

SEQ ID NO: 86179 - RNA, 64 nt, hsa
caggugguggccuggccgguuggcgaucucccgacagcuggauccggcaaugugaagcuuuugu

SEQ ID NO: 86180 - RNA, 64 nt, hsa
uuccauuguccuccccuggccaggccuccuggcucagcuggaagugcauggcuucuuucucccu

SEQ ID NO: 86181 - RNA, 64 nt, hsa
cccuccccagacugccugcugucaaaccacggagcagcuggagccugcccuguccacggcccgu

SEQ ID NO: 86182 - RNA, 64 nt, hsa
acuaugcaaagagaggagguugagaguguucuggcagcuggagcucuuuuccuuguccuuccug

SEQ ID NO: 86183 - RNA, 64 nt, hsa
ccccacccucccaucgguccuacauggggcugugcagcuggagccaaaaaggcaagguagaaag

SEQ ID NO: 86184 - RNA, 64 nt, hsa
ccaccgagaucucccucaggcuggccagguuuugcagcuggaauucuccucuuggucccagggc

SEQ ID NO: 86185 - RNA, 64 nt, hsa
cucacccucucuggaccucaucuguaagaggagccagcuggauaagaugauuucugaagacgcu

SEQ ID NO: 86186 - RNA, 64 nt, hsa
ucaguuuaucuuuccaggauauaugaaaagggaccagcuggaagacuagccucacucuguccuc

SEQ ID NO: 86187 - RNA, 64 nt, hsa
accuugccacccauucuucccguucuuaacuuugaaccauaaagggugccaggucugggugaaa

SEQ ID NO: 86188 - RNA, 64 nt, hsa
gugccaggucugggugaaagggauacuuuuaugcaaccauaagacaaacuccugaaaugccaag

SEQ ID NO: 86189 - RNA, 64 nt, hsa
auucccccugcccuagcucuucucuaacuugguuaaccauaaccauaaccagauucccuugcaa

SEQ ID NO: 86190 - RNA, 64 nt, hsa
ccugcccuagcucuucucuaacuugguuaaccauaaccauaaccagauucccuugcaaucgauu

SEQ ID NO: 86191 - RNA, 64 nt, hsa
cucaaaaaugcugugacagcuuuuuggcugcuuuaaccauaagaaaaaugauugguggaugauu

SEQ ID NO: 86192 - RNA, 64 nt, hsa
uuacuguuucuagucaaaaaugagacuucgaucaaaccauaagauuuuauacugcagauaguca

SEQ ID NO: 86193 - RNA, 64 nt, hsa
gugcagcgcccguggugaucugggguagggggcaccccuacagugggaccccucccccauuauu

SEQ ID NO: 86194 - RNA, 64 nt, hsa
ugaaagggaccgugaguaguggaaaccaggacguccccuacaccuacccauggguggaagcuaa

SEQ ID NO: 86195 - RNA, 64 nt, hsa
ugcccaagaaacaccgagugaggccauagcaacuccccuacaucaaaugcucaagcccugaguu

SEQ ID NO: 86196 - RNA, 64 nt, hsa
gucgcccgaaacaccaagugaggccauagcaauuccccuacaucaaaugcucaagcccccagcu

SEQ ID NO: 86197 - RNA, 64 nt, hsa
gugugucauacacagggccuaguacauagugggcccccuacauacgcauggauucugggucucc

SEQ ID NO: 86198 - RNA, 64 nt, hsa
uauuaaaaccagggauccgugacccccugccaugccccuacaguagagauuccuccccugcuaa

SEQ ID NO: 86199 - RNA, 64 nt, hsa
uuuuccauuaauuucucaacaucaauuauucaggccccuacaguugugguauugaggccccuaa

SEQ ID NO: 86200 - RNA, 64 nt, hsa
aaaaagugauuuaacuuaccucaucaagaaugugccccuacaggccgggcgcaguggcucacgc

SEQ ID NO: 86201 - RNA, 64 nt, hsa
cccuucagaaauuugugcugauuuggucccugugccagggcacagggggucaggcacuguggaa

SEQ ID NO: 86202 - RNA, 64 nt, hsa
ggggcagcagcuggacagccauuagaccucagugccagggcacucuuccuccagcugggaucuc

SEQ ID NO: 86203 - RNA, 64 nt, hsa
augaauaugaagaaaaauacacagccaccucuguccagggcaguaagaagggcugcaaggaagg

SEQ ID NO: 86204 - RNA, 64 nt, hsa
ucaccugagggcuggcaggaaggggcgagaaaucccagggcauuguaccaaggaccuaguuccu

SEQ ID NO: 86205 - RNA, 64 nt, hsa
accagcucuuacgccucagccagcaccacugccaccagggcaacugcagcagcaucucaugcau

SEQ ID NO: 86206 - RNA, 64 nt, hsa
agcaucucaugcauaacccuguggcuugcuucccccagggcagcacaggcuaagucaggaacau

SEQ ID NO: 86207 - RNA, 64 nt, hsa
uuccaacacugcucuucugcaccaugagaccaacccagggcaagaucccaucccaucacaucag

SEQ ID NO: 86208 - RNA, 64 nt, hsa
uagccaacaggagaggaggccuccugggguuuccccagggcaguaggucaaacgaccucaucac

SEQ ID NO: 86209 - RNA, 64 nt, hsa
gaggggaagggugggucucaguuagcagggguccccagggcaagucagccuccucccuccaugc

SEQ ID NO: 86210 - RNA, 64 nt, hsa
ccaugcagacaggaucaccuaacagagauggaagccagggcauggauggggcuuuggguccucg

SEQ ID NO: 86211 - RNA, 64 nt, hsa
cugcccaccccgugcccccagccagcuggcugugccagggcagagccaugccacaucuguauau

SEQ ID NO: 86212 - RNA, 64 nt, hsa
gaccauccucccaaacuagggcccuccacucuauccagggcaggccagggacucccuggccuga

SEQ ID NO: 86213 - RNA, 64 nt, hsa
gggccuggugcuccucucugcuugguaggaaugaccagggcaggaugccaccugcuacacucuu

SEQ ID NO: 86214 - RNA, 64 nt, hsa
agaaauugguacaaagugcagugccagcugcuccccagggcauggucuggcucucugggcugcu

SEQ ID NO: 86215 - RNA, 64 nt, hsa
gaaccuggguggggagggcgaagggggugcacaaccagggcaaggcuccccacuuccuuagucc

SEQ ID NO: 86216 - RNA, 64 nt, hsa
uccucacuauggccccagugccuugaggcccaggccagggcagccaguggcucuagcucaggga

SEQ ID NO: 86217 - RNA, 64 nt, hsa
ugaugacaggcagugugauguguucugaaaguguccagggcaaagcguagggagaggguggauu

SEQ ID NO: 86218 - RNA, 64 nt, hsa
ugcugcuucaugagcgggaggacagcuucuacagccagggcauugccaacuugagccucuuucc

SEQ ID NO: 86219 - RNA, 64 nt, hsa
acucaccccuaagugggcugggagccaggcagggccagggcagcugggugggggccggggcugg

SEQ ID NO: 86220 - RNA, 64 nt, hsa
accccacucaccaguucugcugccucaggucaggccagggcagugcugcugcagagcuagaagg

SEQ ID NO: 86221 - RNA, 64 nt, hsa
gacagcuggguaugaggugcuuacggcacaguguccagggcagcugggugugcagggacugggg

SEQ ID NO: 86222 - RNA, 64 nt, hsa
gugauucugccuccauccugguuuccccaaagccccagggcaccauccuuaggggagaaggucu

SEQ ID NO: 86223 - RNA, 64 nt, hsa
cacauauugggcuuacccagaguggagcacaccuccagggcauguggcugacacugggucaaug

SEQ ID NO: 86224 - RNA, 64 nt, hsa
gcagggcucagcccagggcauccaggaacaggcuccagggcaggaaccugggcccaggaguugc

SEQ ID NO: 86225 - RNA, 64 nt, hsa
gggugaugggcucugcugacgugcagggcucagcccagggcauccaggaacaggcuccagggca

SEQ ID NO: 86226 - RNA, 64 nt, hsa
gaugcucaucauuuguugaugucaucaaagaucaccagggcauaauuauaaucaaaauuaguuu

SEQ ID NO: 86227 - RNA, 64 nt, hsa
gauaauuccacacuuacauccucagaucucccauccagggcaaggacagacuaaaagagcauau

SEQ ID NO: 86228 - RNA, 64 nt, hsa
ucccagcagaggcuucaggugcuuuguguagaguccagggcagcuggagcuuuguuggggagac

SEQ ID NO: 86229 - RNA, 64 nt, hsa
aagccaguaggcaacacagccagcacggugcucuccagggcagccccucucagacgaggaggca

SEQ ID NO: 86230 - RNA, 64 nt, hsa
acccuccuuauuucuguuacuacuugucuguggcccagggcaguggcuuuccugaggcagcagc

SEQ ID NO: 86231 - RNA, 64 nt, hsa
ggcccccacuucccaguggcugcuuccuggggacccagggcaccccggcaccuucaggcacgcu

SEQ ID NO: 86232 - RNA, 64 nt, hsa
caggugccagccuccacuggcaucagugacaagcccagggcacagcccacccggggguccucgc

SEQ ID NO: 86233 - RNA, 64 nt, hsa
ccccucaccuugucccuccucagccagcagaggcccagggcaagggacaggaggacagggguuc

SEQ ID NO: 86234 - RNA, 64 nt, hsa
ugcucucaugggcucaccugggcccaaggcacagccagggcacaguuaggccuggauguuugcc

SEQ ID NO: 86235 - RNA, 64 nt, hsa
gagcccuggaccuuuuguccuauguguguggauuccagggcaacucuagcaucagagcaaaagc

SEQ ID NO: 86236 - RNA, 64 nt, hsa
acugcugcuagcggccugccgccacgucagcagcccagggcacagcgcucgaggugugcuguua

SEQ ID NO: 86237 - RNA, 64 nt, hsa
gugagguggccuggggagggcagaggcaagguuaccagggcaccaugcaagcggaugucggcac

SEQ ID NO: 86238 - RNA, 64 nt, hsa
uugauguuuauacccucugaauuggagggcagugccagggcauuugcagaagcugggaaggacc

SEQ ID NO: 86239 - RNA, 64 nt, hsa
uccccacccccugccaaaaaaaaaaaaaaaaaagccagggcaaaggaccuggcguggccacuuc

SEQ ID NO: 86240 - RNA, 64 nt, hsa
ugggcaccacagggaacauccuggacuuaaaaagccagggcaggccgggcacaguggcucacgc

SEQ ID NO: 86241 - RNA, 64 nt, hsa
cagggcuacccugagcugaggcagcagugugaggccagggcagagugagacccagcccucaucc

SEQ ID NO: 86242 - RNA, 64 nt, hsa
aguguuagggaagggccugccacagccuccccugccagggcagggccccaggcauugccaaggg

SEQ ID NO: 86243 - RNA, 64 nt, hsa
agaccaugucuucuuagagcaaauguggaggcggccagggcaguuguugggugaauguggagag

SEQ ID NO: 86244 - RNA, 64 nt, hsa
ccucccguuuguccuugaggacugcuggcuguaaccagggcacaucacccaccucaagacaagc

SEQ ID NO: 86245 - RNA, 64 nt, hsa
gguugguuccggugaguguagggauggcacgauaccagggcagccucuugaaaacggccucggg

SEQ ID NO: 86246 - RNA, 64 nt, hsa
gcuucacagggcugcaaaggguacagggauugcaccagggcagaacaggggaggguguucaagg

SEQ ID NO: 86247 - RNA, 64 nt, hsa
ccacacugugucgucguuuguuugccuauguccuccagggcacgguggcaggaacaacuauccu

SEQ ID NO: 86248 - RNA, 64 nt, hsa
agggcgucccccucaacccugcccugaacaugccccagggcacugaggggcgaagccagugcuu

SEQ ID NO: 86249 - RNA, 64 nt, hsa
uuggcaggacucaaccaagcacugcucucuagcuccagggcacuaagccacaggaggcagcgcc

SEQ ID NO: 86250 - RNA, 64 nt, hsa
gcagcguugagaagggggugaguggugccaguugccagggcaagucacugcgcugggagguggg

SEQ ID NO: 86251 - RNA, 64 nt, hsa
gggggcugggccuugcagguggagggaccucacuccagggcacggcgugggagggguagucgaa

SEQ ID NO: 86252 - RNA, 64 nt, hsa
cuccuggccagcuuccagcccagaguccucaaguccagggcaccuugggcccagcgcaggcaga

SEQ ID NO: 86253 - RNA, 64 nt, hsa
cccagaagcccccagggugggauuucucaggcugccagggcaggcccaggccucaggaagaagg

SEQ ID NO: 86254 - RNA, 64 nt, hsa
ggucuggggcagcagagccaucgcaucauguuucccagggcaacuugaggucugacuuuuggcu

SEQ ID NO: 86255 - RNA, 64 nt, hsa
ucaguaugguucucggaguccaaaggguuuuaagccagggcacaaccagaaaaguggcucucuu

SEQ ID NO: 86256 - RNA, 64 nt, hsa
aaaaacauggggagcccggaggacaggcugcuguccagggcagaggccaugaagaagugcuucc

SEQ ID NO: 86257 - RNA, 55 nt, hsa
gugacuuacaugggaagugaugccaccagggcagccucaccuccuccccaucauc

SEQ ID NO: 86258 - RNA, 64 nt, hsa
uccucccugcagaagccauuagcagaccuuugggccagggcagccucccuauaauuuucuucau

SEQ ID NO: 86259 - RNA, 64 nt, hsa
uggugggagacaucaguagugucaccuucuaccaccagggcaaggagcuggacugcaggugcug

SEQ ID NO: 86260 - RNA, 64 nt, hsa
uuaaucgaugaauguaaacucgggggugcuggggccagggcagauguggggauguuuugacauu

SEQ ID NO: 86261 - RNA, 64 nt, hsa
ccuucccagagggucuuacuguuccaggguggccccagggcaggcaggggccacacuaugccug

SEQ ID NO: 86262 - RNA, 64 nt, hsa
cauacucccuuucagggccagggcuccagcaagcccagggcaaggauccugugcugcugucugg

SEQ ID NO: 86263 - RNA, 64 nt, hsa
gcaccacaagaaagggaggguacgccaggcgagcccagggcacagaugcugagacagccucucc

SEQ ID NO: 86264 - RNA, 64 nt, hsa
cucagugcagggacgucaccccugccaggcaagcccagggcacagaugccaggauggcuucucc

SEQ ID NO: 86265 - RNA, 64 nt, hsa
ucucagugcgaggcuucaccccugccaggcaagcccagggcauagaugcugagacagccucucc

SEQ ID NO: 86266 - RNA, 64 nt, hsa
cucagugcagggacgucaccccugccaggcaagcccagggcacagaggccgggacggccucucc

SEQ ID NO: 86267 - RNA, 64 nt, hsa
ucucagugugaggcuucacccaugcuaggcaagcccagggcacagaugccgggauggccccucc

SEQ ID NO: 86268 - RNA, 64 nt, hsa
cucagugcgggaacgucaccccugccaggcaagcccagggcacagaugcugcgauggccucuuc

SEQ ID NO: 86269 - RNA, 64 nt, hsa
ggcgcagagaugagcacacagcuuugggcacgguccagggcaaacugaaauguacgccugaauu

SEQ ID NO: 86270 - RNA, 64 nt, hsa
ccccgccucacacacgcacuccuucuccucaaggccagggcagagggccucaccgccucccggg

SEQ ID NO: 86271 - RNA, 64 nt, hsa
aauucccacagauaaucugaggaaugcagaaaaaccagggcaggacaguuaucgacaaugcauu

SEQ ID NO: 86272 - RNA, 64 nt, hsa
aaggaaacaaauucaaggacaaccugucuuugagccagggcaggccucagacacccugccugug

SEQ ID NO: 86273 - RNA, 64 nt, hsa
gucacugagagcuucguuaccccugcugccuugcccagggcacacccuauaccuccuuaucugc

SEQ ID NO: 86274 - RNA, 64 nt, hsa
ggcagguauggcacccugggagcccggcauauacccagggcaccccuacggcugccgccagucu

SEQ ID NO: 86275 - RNA, 64 nt, hsa
guacuugagggggacuggaggccgucucugguccccagggcaagggaacagcagaacuuagggu

SEQ ID NO: 86276 - RNA, 64 nt, hsa
cagaugugggggccuguccaaggguggcuggggcccagggcaucgcuaaacccaaaugggggcu

SEQ ID NO: 86277 - RNA, 64 nt, hsa
agagcaguuggaggaagcauccaaagauugcaacccagggcaaauggaaaacaggagauccuaa

SEQ ID NO: 86278 - RNA, 64 nt, hsa
accugccacugccgucaccucucccuccucagcuccagggcagugucccucccuggcuugccuu

SEQ ID NO: 86279 - RNA, 56 nt, hsa
gcuucaaacagcgcagauaaaugcaggcaagaaaagaugccgccguugcugccguc

SEQ ID NO: 86280 - RNA, 64 nt, hsa
ccuauuuuuguuuguuuauacaaauaucugauuugcaagaaaaagugcaugggagggguuuuag

SEQ ID NO: 86281 - RNA, 64 nt, hsa
auguggguguggccgaggugauggcaagaaaggugcaagaaagugagcagucugccugugagug

SEQ ID NO: 86282 - RNA, 64 nt, hsa
cuauuggaggaauguggguguggccgaggugauggcaagaaaggugcaagaaagugagcagucu

SEQ ID NO: 86283 - RNA, 64 nt, hsa
aguuuucuagauugucacaugcuuugugacuaaugcaagaaagcaaguccuguguuguauuugu

SEQ ID NO: 86284 - RNA, 64 nt, hsa
uucucuaauuccaauaugucuuuugcuuccagaagcaagaaaaguuucuucucuccccuccuuc

SEQ ID NO: 86285 - RNA, 64 nt, hsa
aaaaaaucauugccauaagaaaaaguauaaauuagcaagaaaggagagugacuugauuugcuuu

SEQ ID NO: 86286 - RNA, 64 nt, hsa
ccgaugaaguaaacgccuuagugcuucagacccagcaagaaauuauugguaauauuuaugucua

SEQ ID NO: 86287 - RNA, 64 nt, hsa
gguauacaggauaaacuacauacacugaucccuugcaagaaauuugaucucaguuauaaucuaa

SEQ ID NO: 86288 - RNA, 64 nt, hsa
uccuaaaauucuagccauuugucacacaaccacagcaagaaacguguucuauaucuagagugug

SEQ ID NO: 86289 - RNA, 64 nt, hsa
auuacuucacuauaauuacaaggacaaauuauuagcaagaaauaagaauaguauuagaagaauu

SEQ ID NO: 86290 - RNA, 64 nt, hsa
aguacugcauugcaccaugagcaagaacugcucugcaagaaaaauaucugucccuguggucuga

SEQ ID NO: 86291 - RNA, 64 nt, hsa
aaaucucaaaucacacugaacccuaaaugucauugcaagaaauaaaaauuuaagaauuaaauug

SEQ ID NO: 86292 - RNA, 64 nt, hsa
uacuuuuauuauauuguuuacaaauauauuucaugcaagaaacagaaaaaaaaaaaaacccuuu

SEQ ID NO: 86293 - RNA, 64 nt, hsa
auaaacuauaggauagauagaaugguuauuuuaugcaagaaauauuguaccgcaagggugguuu

SEQ ID NO: 86294 - RNA, 64 nt, hsa
gaagcaugaagauuccugggguggggggaaagcagcaagaaaagguagagaggaaccagauugg

SEQ ID NO: 86295 - RNA, 64 nt, hsa
agauauuggaaacaguaugcaugaagacaugaaggcaagaaacagcaaaacaaauacugaagca

SEQ ID NO: 86296 - RNA, 63 nt, hsa
cuuccucucucuaccagucuauuuccacugaacaaaaccuacgcacauaccuucauguggcuc

SEQ ID NO: 86297 - RNA, 63 nt, hsa
cuuccucucucuaccagucuauuuccacugaacaaaaccuacacacauaccuucaugugguuc

SEQ ID NO: 86298 - RNA, 63 nt, hsa
cagcuggcugagacacugaagaagucacugaacaaaaccuacacacguaccuucaugugauuc

SEQ ID NO: 86299 - RNA, 63 nt, hsa
uuuaaaaucaaacucaguuuuuauuucuucacuaaaaccuauuuucauaugauauacauguua

SEQ ID NO: 86300 - RNA, 63 nt, hsa
gggcuguguuauauuaaguucucccuuacuguuaaaaccuaauuaaauaugcuuuagaauuuu

SEQ ID NO: 86301 - RNA, 63 nt, hsa
uacauuuggauaaacaacauugagauuaugaugaaaaccuacauauuccauguuuggaagacc

SEQ ID NO: 86302 - RNA, 63 nt, hsa
ccagcguacuauaaugaaaacauccuuguuuugaaaaccuaaaagacaggcucuguauauaua

SEQ ID NO: 86303 - RNA, 63 nt, hsa
ucucugaaauggguaaaggacaaauuguguaaaaaaaccuaugcacuauagaagggaauagua

SEQ ID NO: 86304 - RNA, 63 nt, hsa
agcuuauauaaggucauuacauuuuuuaacugaaaaaccuaguuaccugauuauugcacauua

SEQ ID NO: 86305 - RNA, 63 nt, hsa
auuguauauaguaagaaaagaucaaaagacuuuaaaaccuaaaugacuuuugacauacaaacu

SEQ ID NO: 86306 - RNA, 63 nt, hsa
aguaauuaugaauuuaagaccauauuauuaucaaaaaccuagagaccaaucauauaucugaaa

SEQ ID NO: 86307 - RNA, 63 nt, hsa
aucucaagucuagugaagacagccaacagaaacaaaaccuagcauagggauagaaaauaccau

SEQ ID NO: 86308 - RNA, 63 nt, hsa
aaauaaaaaugcaugauuaaaaacuaagaauaaaaaaccuauuuuuauguuuccuaaaggaaa

SEQ ID NO: 86309 - RNA, 63 nt, hsa
cagagcaucuugaccuaaucagcuuacaguuugaaaaccuagcucuccagaacaugagaugag

SEQ ID NO: 86310 - RNA, 63 nt, hsa
gguuuuuaccccacccucaacccucuccagcauaaaaccuagugagcuaaaggcuuugucugc

SEQ ID NO: 86311 - RNA, 63 nt, hsa
cauguuaaaaaaaaaaauguauuucauaucuauaaaaccuauauagccauuuagcugaagccc

SEQ ID NO: 86312 - RNA, 63 nt, hsa
gcacaugccuguauuacugaaagcuaaauccucaaaaccuaguaaggggacuaaugauucauu

SEQ ID NO: 86313 - RNA, 63 nt, hsa
auuacuauaaacaccuguaugcacacaaacuagaaaaccuagaaaaaauuaauaaauuccuug

SEQ ID NO: 86314 - RNA, 63 nt, hsa
aaucaacucaagauggauuaaagacuuaaauauaaaaccuaaaaguauuaaauuccuagaaga

SEQ ID NO: 86315 - RNA, 63 nt, hsa
aaccaaaauuauaggauuuuuucuuuuuuaguaaaaaccuauaugaaaaccaaaauuauagga

SEQ ID NO: 86316 - RNA, 63 nt, hsa
accaaaauuauaggauuuuuuucuuuuuuaguaaaaaccuauauaaaaaccaaaauuauagga

SEQ ID NO: 86317 - RNA, 63 nt, hsa
auauuucggggguaauagagccacuggugaguaaaaaccuauauaaaaaccaaaauuauagga

SEQ ID NO: 86318 - RNA, 64 nt, hsa
ucaauccacuuuugggguucagagauaaaacauuuuuucccaaguagcuggggcucuuccauuu

SEQ ID NO: 86319 - RNA, 64 nt, hsa
caaggcucaggcuguauuggcaaauucccgaaaguuuucccacuuugccuggcccugcuucugu

SEQ ID NO: 86320 - RNA, 64 nt, hsa
ggucaucuuuuuugcccuuucauggagucauaaauuuucccaacugaagucuuguauauucugu

SEQ ID NO: 86321 - RNA, 64 nt, hsa
uuguaaauaggagagaacugacguucuugugauguuuucccaugcauaaacaugccacauccau

SEQ ID NO: 86322 - RNA, 64 nt, hsa
cucuuggcguucaggaaacacagauucuuuguccuuuucccaacagcccaggcuguugauaccu

SEQ ID NO: 86323 - RNA, 64 nt, hsa
uugaagggcagucuucucuggcuuguuuuuuuguuuuucccagaaaaucaguauuauuuuuuaa

SEQ ID NO: 86324 - RNA, 64 nt, hsa
uguaguuaagaaacuggaaaaugguuucuucauguuuucccaacucuuucauccaguguccaaa

SEQ ID NO: 86325 - RNA, 64 nt, hsa
gaacccugcccucuccccuccugcugcuguagaguuuucccaaagcaguguccaggagagaauu

SEQ ID NO: 86326 - RNA, 64 nt, hsa
aaauuauuuauucuauuuuaagccuucuaucauauuuucccauccaauuguuugguuucagugg

SEQ ID NO: 86327 - RNA, 64 nt, hsa
uccacucccauggcuuaauugccuaucagacgcauuuucccagacgaaagcaauguuggguugg

SEQ ID NO: 86328 - RNA, 64 nt, hsa
gauuauugauuggauugacuuuuuugcauuaaauuuuucccagcaaaauaaaucauauggcgag

SEQ ID NO: 86329 - RNA, 64 nt, hsa
cauugaugagaauuuauuggcaguucagauuguguuuucccaacuuaggcucuuuauuaauugg

SEQ ID NO: 86330 - RNA, 64 nt, hsa
auuuauauuagguuggugcaaaacuaguugcgguuuuucccauuaaaaguaauaaacuuacucu

SEQ ID NO: 86331 - RNA, 64 nt, hsa
agaugcuuccccuuggcuaugacauggagaaagauuuucccauaauaauaacuaacauuuauau

SEQ ID NO: 86332 - RNA, 64 nt, hsa
auacacacauccauccuaaacuauacuaaagcccuuuucccaugcauggauggaaauggaagau

SEQ ID NO: 86333 - RNA, 64 nt, hsa
ucuguaacucccuagagccacagguucucauuccuuuucccauuauacuucucacaauucaguu

SEQ ID NO: 86334 - RNA, 64 nt, hsa
caauccagccauaaaaauuaacuugugauuuuuuuuuucccaaagucaugcuuuuccuuaauua

SEQ ID NO: 86335 - RNA, 64 nt, hsa
gaaaguuucuauuugguugauaaaaggaacaauuuuuucccacuuuugaugccugugaugcaau

SEQ ID NO: 86336 - RNA, 64 nt, hsa
caccacuugacggcuacaagugccgacuccugaauuuucccaugguguucugacuucaagggcu

SEQ ID NO: 86337 - RNA, 64 nt, hsa
ccuaaauuaaugaaccauauuuuuaaaauccuauuuuucccaaacagggcccucugcagcccau

SEQ ID NO: 86338 - RNA, 64 nt, hsa
cuguucuuuaugcauugucucaacacuuucccuuuuuucccaaaaugaguagagaauuaaagcc

SEQ ID NO: 86339 - RNA, 64 nt, hsa
ccccauuuuuucuuuucaccacccuguugagcaauuuucccaaaaaaagggcagcaauuauuaa

SEQ ID NO: 86340 - RNA, 64 nt, hsa
uaccuacuugaaacagugucugucugcuacuuuauuuucccaauuugauacauacccugauuug

SEQ ID NO: 86341 - RNA, 64 nt, hsa
uguuuucuacacccagcuagaggagcacacuccauuuucccaugucugacuucguggugugagc

SEQ ID NO: 86342 - RNA, 64 nt, hsa
aaaaagauuggcacaaagcaugaagaaaccccauuuuucccaggguaaucaugaaagaaggcuc

SEQ ID NO: 86343 - RNA, 64 nt, hsa
ccucuagaaccugccuuuuucaaauaucccugccuuuucccaccuggaaacauauacuguaugc

SEQ ID NO: 86344 - RNA, 64 nt, hsa
aaacauggcuuaucaauuuuuucaaagaauucuuuuuucccaaaaagaggaguaacaaaauguc

SEQ ID NO: 86345 - RNA, 64 nt, hsa
uuguuugaaauaccauuuuuuucuccuuuuguguuuuucccacuuuccaauguacucaagaaaa

SEQ ID NO: 86346 - RNA, 64 nt, hsa
caugacuuucuggaagccucccaacuauucuugcuuuucccagacagcucccacucccaugucu

SEQ ID NO: 86347 - RNA, 64 nt, hsa
aacaagguaggcuucaaagagccuauauuccucuuuuucccacaccgaucaagucaacucagua

SEQ ID NO: 86348 - RNA, 64 nt, hsa
ugucagaaucaaggcuucggccaccugugcaauauuuucccauggaaugcagcaguaaauccaa

SEQ ID NO: 86349 - RNA, 64 nt, hsa
ccuuuucucccaagaugcagaaauguggaugcucuuuucccaggggacaugaguaaagcagugu

SEQ ID NO: 86350 - RNA, 64 nt, hsa
caaacuacuuucuuaauaucacuuuggucuccauuuuucccaggacaggaaauauguccccccc

SEQ ID NO: 86351 - RNA, 64 nt, hsa
uuauaauuucuacccauguugggaaaaacuggcuuuuucccagcccuuuccagggcauaaaacu

SEQ ID NO: 86352 - RNA, 64 nt, hsa
uucaguuuccccaaguaccuguuuucauucccauuuuucccauuguuuaaaaccaucacuuuuu

SEQ ID NO: 86353 - RNA, 64 nt, hsa
uguucagucccuucccugcuucucgcugucuuucuuuucccaccucccaccccccaguuuucag

SEQ ID NO: 86354 - RNA, 64 nt, hsa
ucaauuuaaucaucaccaccgguguuuccauauuuuuucccaaguauuuaauauagcucucuua

SEQ ID NO: 86355 - RNA, 64 nt, hsa
uaguguacugagccugcggugcauggcucaggccuuuucccaucgacgucuagggggacucugg

SEQ ID NO: 86356 - RNA, 64 nt, hsa
ugcuauauucaccaaaaggacuuaauucuuguuuuuuucccaguuuuauauagaggaaacacua

SEQ ID NO: 86357 - RNA, 64 nt, hsa
uugcuauauucaccaaaaggacuuacuucuuguuuuuucccaguuuuauauagaggaaacacug

SEQ ID NO: 86358 - RNA, 64 nt, hsa
uccccaugauucucuacaaagcucuugcacacccuuuucccauucaauuugugagccaggcagg

SEQ ID NO: 86359 - RNA, 64 nt, hsa
aggaucuacuagaugcauuauacuccauaccugcuuuucccauggccgcccuacggaaaauccc

SEQ ID NO: 86360 - RNA, 64 nt, hsa
ugaaagggaaaaaccauauugccuuguguguugcuuuucccagucaaaagggucugaccuuaga

SEQ ID NO: 86361 - RNA, 64 nt, hsa
cagaagugcccugcgcuuucaggcagugucucuguuuucccaaggugaaacuuagauaucaugg

SEQ ID NO: 86362 - RNA, 64 nt, hsa
uggguuuuucuacuaauuauuuuuugaagcauuauuuucccaacacaaaagagcuuuuuucucg

SEQ ID NO: 86363 - RNA, 64 nt, hsa
ccucucuuggugaauguggaaauggccaccuggguuuucccauaucaggaagggcuuugggaug

SEQ ID NO: 86364 - RNA, 64 nt, hsa
aauaaaucagaggaaaaauugucauuuaguuuccuuuucccaugugaaccaaauuucaggguca

SEQ ID NO: 86365 - RNA, 64 nt, hsa
agcuguugaagaauuagagggaaauaggaaaugauuuucccauaauuccagaaagcaaaaggcu

SEQ ID NO: 86366 - RNA, 64 nt, hsa
agagacaauauuuuuccaccauuguaucucacauuuuucccaggagguuacccauaacagaaga

SEQ ID NO: 86367 - RNA, 64 nt, hsa
ggccagugaugauuucccccagcucauccccuuauuuucccacaacccaaccauucucuaaagc

SEQ ID NO: 86368 - RNA, 64 nt, hsa
uaucaaaauuuucaacauaugcauaaccuuaguauuuucccaaccaauagaaacuauuuauugu

SEQ ID NO: 86369 - RNA, 64 nt, hsa
gagcagaauuuaaaaaagaaagaaaauaaauuguuuuucccaaaguaugucacuguuggaaaua

SEQ ID NO: 86370 - RNA, 64 nt, hsa
cgcauuucuuaaacuaaacaggaaagucgcauuauuuucccauucuacucuagaaagcauggaa

SEQ ID NO: 86371 - RNA, 64 nt, hsa
ccucuucaagguugcaaacugcucacuucuugcauuuucccaugucuacagcuagagaacucuu

SEQ ID NO: 86372 - RNA, 64 nt, hsa
gagguaggcacugguuugcccagagaauuuuuauuuuucccagaccacacuugccuuuaggccu

SEQ ID NO: 86373 - RNA, 64 nt, hsa
guucuaaguauuuauuuaaaacaaaagaaucacguuuucccauuuguacuucagcgcuagcccc

SEQ ID NO: 86374 - RNA, 64 nt, hsa
cggaccaucaaccuucgagaaauuccaguugucuuuuucccagccgcauccugccuguagaugg

SEQ ID NO: 86375 - RNA, 64 nt, hsa
auugaaggcugacauggagaauguuuacuuuucuauuuggcauagcuaacuacacuuugauacu

SEQ ID NO: 86376 - RNA, 64 nt, hsa
guaggucauccacuuuuucagguaaacauuuuucauuuggcaaauggcauaauuauuugaaagu

SEQ ID NO: 86377 - RNA, 64 nt, hsa
gcagcccaggauggacagcaguggggagggaaccauuuggcauaaggccguugggcuucaggau

SEQ ID NO: 86378 - RNA, 64 nt, hsa
caggcaaaacaugcuccacaaauucaacuuguauauuuggcagauuaaacuugacauuaucgua

SEQ ID NO: 86379 - RNA, 64 nt, hsa
aaaugugugacaguguuugucauauuaagagugaauuuggcaggaauucccaagauggacauug

SEQ ID NO: 86380 - RNA, 64 nt, hsa
guacaguguagaaagcagugggaacugugauuggauuuggcaacaugucagcuuuauaguugcc

SEQ ID NO: 86381 - RNA, 64 nt, hsa
aaagaaagcaguuacucuuggagcuuaugccuucauuuggcaagggaagucuuuuuaacuaguu

SEQ ID NO: 86382 - RNA, 64 nt, hsa
uuuugacauuuuugaagagauaauaaauguuuuaauuuggcaguuugagugauugggaaaagga

SEQ ID NO: 86383 - RNA, 64 nt, hsa
agccucgcagcuccguggggcccuccgccccagccccagccagccaggcccugguggaaaggcu

SEQ ID NO: 86384 - RNA, 64 nt, hsa
ucuggccccaccucccucaagucugcgccccguccccagccagacccacucgcugccgggaccc

SEQ ID NO: 86385 - RNA, 64 nt, hsa
accccuagaacugccauucccaagaccucugucucccagccaaccacccuuggaacuugccucu

SEQ ID NO: 86386 - RNA, 64 nt, hsa
gcagccguccaguacugcuggcuuccucuggaggcccagccacaggcugggguuggggugugug

SEQ ID NO: 86387 - RNA, 64 nt, hsa
gccaccgcgcccagcgauuguuucuugaggcuuccccagccauauggaacuauaagucaauuaa

SEQ ID NO: 86388 - RNA, 64 nt, hsa
ccaugcugacuuggagaaccccagaucucuggggcccagccaggcagggugugggggcagcugu

SEQ ID NO: 86389 - RNA, 64 nt, hsa
gcucugggggucggagacaccgcugcuuagcacccccagccagaacacccugagggucucgggg

SEQ ID NO: 86390 - RNA, 64 nt, hsa
ccucggaacgggaggacucgcagcucucccuuuccccagccaggaugagggaauuagacaaugg

SEQ ID NO: 86391 - RNA, 64 nt, hsa
uacugaagugucuaaaaagaacagaaggacccaccccagccauaaugcagacuuucccauuccu

SEQ ID NO: 86392 - RNA, 64 nt, hsa
cuuucagcccuucccacaggaaacaucaagaagccccagccaggaggggccaggcugccaaggc

SEQ ID NO: 86393 - RNA, 64 nt, hsa
uugccccucagaccuugcauccacagaagcacaacccagccaaacaccacagccuucuccagag

SEQ ID NO: 86394 - RNA, 64 nt, hsa
ccccacuugccuugggcguguccacugagccuuccccagccagucuuguucucaauuuuguuuu

SEQ ID NO: 86395 - RNA, 61 nt, hsa
agcuccuuccugaugaaugaagacccagguacccagccauaaagccacauugaguagucua

SEQ ID NO: 86396 - RNA, 64 nt, hsa
cagcaguuucuuauaagcauaacuuaucauauggcccagccauuucacuacuagaaauugacgc

SEQ ID NO: 86397 - RNA, 64 nt, hsa
caaagugcugggauuacaggcgugagccaccgcgcccagccaaaccuuacuauuuuuuuaaaga

SEQ ID NO: 86398 - RNA, 64 nt, hsa
ccagaggggucaggccgacgccucgagucagggccccagccacccaacagacaagauggaagaa

SEQ ID NO: 86399 - RNA, 64 nt, hsa
ccuguacuuuggggaaacagauggagcucuugggcccagccagcugggccugggacuucugccu

SEQ ID NO: 86400 - RNA, 64 nt, hsa
ggagauccuccauccuaaaaguaccugccuccuucccagccaucccugacacauuccagccagu

SEQ ID NO: 86401 - RNA, 64 nt, hsa
aaaccaucccuucccuuucucccuuggcuguucacccagccauucccugaaggccuuaccaaca

SEQ ID NO: 86402 - RNA, 64 nt, hsa
ucacccucccuccuccaaggaagagcucaaaguucccagccaauagacagcaugaaucaaggaa

SEQ ID NO: 86403 - RNA, 64 nt, hsa
aagagucucuggcccagucaugcacaucuguagccccagccauccuugugccuucaccucugau

SEQ ID NO: 86404 - RNA, 64 nt, hsa
accucucagucuggcucugcuguguaguccauagcccagccagaugagcuugcagccucauagg

SEQ ID NO: 86405 - RNA, 64 nt, hsa
gcccaacacuucccagggugcugcugccacccgccccagccagccaccugcuccugacagccag

SEQ ID NO: 86406 - RNA, 64 nt, hsa
ccccagcacugaaucccagcgcugcccugaggcccccagccacucccuccagcagccugguuca

SEQ ID NO: 86407 - RNA, 64 nt, hsa
guucugggcgccugauuuugcugugacucccagacccagccacuguuucugccacccuguaaca

SEQ ID NO: 86408 - RNA, 64 nt, hsa
aagggugaagaagagccaugggacacagaguugacccagccagggggaaagcccagcucucuuu

SEQ ID NO: 86409 - RNA, 64 nt, hsa
gagcacgccugccucccucuccccuccgcccucacccagccaauccgaggcugcuucgcacuuu

SEQ ID NO: 86410 - RNA, 64 nt, hsa
ugccccagggcagcuaccuaugggucuuugcuuccccagccagccucuccucacugugacccac

SEQ ID NO: 86411 - RNA, 64 nt, hsa
gguggaucaccagaggucaggaguucgagaccagcccagccaacauggcaaaaccccaucucua

SEQ ID NO: 86412 - RNA, 64 nt, hsa
aacuuuccaucugcuuguauuuuccauacacauccccagccagaaguuaguguccgaagaccga

SEQ ID NO: 86413 - RNA, 64 nt, hsa
ucagagauacaguccacagguggacaaagggauccccagccagagagagagagaccagccaaca

SEQ ID NO: 86414 - RNA, 64 nt, hsa
acaggcagacaucagccacauggaauccugacaucccagccagccggccagacucucaucuuga

SEQ ID NO: 86415 - RNA, 64 nt, hsa
gacccccagcaaaucaggaccuaucuaggcagaccccagccagacccccgccagacagacuccc

SEQ ID NO: 86416 - RNA, 64 nt, hsa
uuucucauugccauuaguaaugacugauggaaaacccagccaccacugugaugcgaaaugauca

SEQ ID NO: 86417 - RNA, 64 nt, hsa
cacuuagcauuggcuugcuucaguuguuucucuucccagccaguaugccacaggugaacuuucg

SEQ ID NO: 86418 - RNA, 64 nt, hsa
agccgggucggggucugccuguuucccagccaggcccagccacccaggacuccugggacauccc

SEQ ID NO: 86419 - RNA, 64 nt, hsa
gccuugcuggagccgggucggggucugccuguuucccagccaggcccagccacccaggacuccu

SEQ ID NO: 86420 - RNA, 64 nt, hsa
augaauaauccaggcuucagcaacacuccucuuucccagccagcaaaggcugugaauuugaauu

SEQ ID NO: 86421 - RNA, 64 nt, hsa
cgggugggagacuucagaugggcucaguaccugucccagccacaggcuucuuguccaccucuuc

SEQ ID NO: 86422 - RNA, 64 nt, hsa
auggccagucuucauaauagcaacguaccuucaccccagccacaugccccagccaauacaaauu

SEQ ID NO: 86423 - RNA, 64 nt, hsa
auaauagcaacguaccuucaccccagccacaugccccagccaauacaaauuggaaaaucuggcc

SEQ ID NO: 86424 - RNA, 64 nt, hsa
cuggggcacugagacaguuguuuggcagccccagcccagccaggggcucauccuucucagcucu

SEQ ID NO: 86425 - RNA, 64 nt, hsa
uccuccaguccugggccccauccuugagggccuucccagccagccagcaggagaggcaagaacu

SEQ ID NO: 86426 - RNA, 64 nt, hsa
agucccucuccuggagcuggggguccacacaucucccagccaaguccaagagggcagggccagu

SEQ ID NO: 86427 - RNA, 64 nt, hsa
caagagggcagggccaguuccucccaucuucaggcccagccaggcagggggcagucggcuccuc

SEQ ID NO: 86428 - RNA, 64 nt, hsa
gcuccgucuuugaagaaagaagagauggucucuccccagccaugggccacccuugccagugacu

SEQ ID NO: 86429 - RNA, 64 nt, hsa
uucucaacugcucggccucuugggccaggcugugcccagccagcccugggagaacuggguagca

SEQ ID NO: 86430 - RNA, 64 nt, hsa
gcucugcagcgagcccugggaccacucaucccugcccagccagcuucagugcccggggccgcuu

SEQ ID NO: 86431 - RNA, 64 nt, hsa
gaccuuggacaccaccaccugcugagcuucccgucccagccaugcaguggggccccuggggugc

SEQ ID NO: 86432 - RNA, 64 nt, hsa
cccuguucccugagaccuggccucaaagggcugacccagccauacguagauccuggggucuuuc

SEQ ID NO: 86433 - RNA, 64 nt, hsa
gugccugcagccuagucccugcccaagcuucucccccagccacccucugccccugugguagagc

SEQ ID NO: 86434 - RNA, 64 nt, hsa
cagcaucucaguccuuccuccaugcagucucucgcccagccaggugagagcaugagcacuuccc

SEQ ID NO: 86435 - RNA, 64 nt, hsa
caaagugcugggauuacaggcgugagccaccgugcccagccagaauggguaguuuuuauucucu

SEQ ID NO: 86436 - RNA, 64 nt, hsa
aggcagcagccuucguggcaagaacuagcgugagcccagccaggcgccuccccaccgggcucuc

SEQ ID NO: 86437 - RNA, 64 nt, hsa
ggagugacaucuucaucugcucugaauacuggugcccagccagcccgugacagcuucccccuaa

SEQ ID NO: 86438 - RNA, 64 nt, hsa
gaagaaaguguccauucuuugccuuccuggagcucccagccagagcugagcuuaggcacccgag

SEQ ID NO: 86439 - RNA, 64 nt, hsa
ucagugucccuccugcggugauguccuuacuguccccagccagggccggggaccgguguuucac

SEQ ID NO: 86440 - RNA, 64 nt, hsa
aggggcgguggcugguccucaggcacgcugcacucccagccagacauggucuuuccguuucuua

SEQ ID NO: 86441 - RNA, 64 nt, hsa
gggucagaccacccccuagaggagccacgugccgcccagccaccuucaaugccugccacccugc

SEQ ID NO: 86442 - RNA, 64 nt, hsa
gugcccucgggucuguccuccccgucuggacccucccagccacuaucccuugcuggaaggcuca

SEQ ID NO: 86443 - RNA, 64 nt, hsa
aucuucuggccaaucaaggcuugcuggagugucucccagccaaucagggccuugaggaggaugu

SEQ ID NO: 86444 - RNA, 64 nt, hsa
aaacauaccccaucccacccaccccugccucugccccagccagccacacagagaagcaaauucu

SEQ ID NO: 86445 - RNA, 64 nt, hsa
ugcuggugcugucagugauuuuuaccgucacuagcccagccaggcuucagucuguccgacagga

SEQ ID NO: 86446 - RNA, 60 nt, hsa
guggcagcaaggccaccugaggcccugucucccagccacuuucccuccuggcacugccac

SEQ ID NO: 86447 - RNA, 64 nt, hsa
uccuuaggccccagccugggcccagacccauccucccagccagguuucccuccagcaggcuccu

SEQ ID NO: 86448 - RNA, 64 nt, hsa
agccuguacccagaggccuuggacuagacgaagccccagccaguggcagaacugggucucucag

SEQ ID NO: 86449 - RNA, 64 nt, hsa
gcggucgggccugggccguuaucuccccacaacccccagccaaucaggacuuuccagacuuggc

SEQ ID NO: 86450 - RNA, 64 nt, hsa
guccuggacuucaagagugagggccccugcugggcccagccaccaggacagcaggaaccagggc

SEQ ID NO: 86451 - RNA, 64 nt, hsa
agaggcuaagaggaagacuggccaggcccaaggacccagccaucaaaaccagccucaaaucugg

SEQ ID NO: 86452 - RNA, 64 nt, hsa
augugagcaaacacacacacgugcgccuucauagcccagccaagggcaugcaggcagggugugc

SEQ ID NO: 86453 - RNA, 64 nt, hsa
ggcugugaccaccccccauccuucucccuacacucccagccaaccuagugcccaagcagcuaaa

SEQ ID NO: 86454 - RNA, 64 nt, hsa
gggcuuguuuaggauuggagggccaggucaccuccccagccacccucccuucucuccucugggg

SEQ ID NO: 86455 - RNA, 64 nt, hsa
ccccucccuagucccacccacgcucaaccuuuggcccagccaucgccgagauucgagggucaac

SEQ ID NO: 86456 - RNA, 64 nt, hsa
cugugagcuccccaauccaacccaugcauggccucccagccacccggaucuccaggcccagccu

SEQ ID NO: 86457 - RNA, 64 nt, hsa
ugccugccuccggcccugccccacacaggccuggcccagccagcagguucucuccugugagcuc

SEQ ID NO: 86458 - RNA, 64 nt, hsa
agaugggccacagacuggggaggagaaucaguggcccagccagaaguuaaagggcugaggguug

SEQ ID NO: 86459 - RNA, 64 nt, hsa
agccaucuugguuuuaggaaauggggccgccuggcccagccacucacugguguccugucucuug

SEQ ID NO: 86460 - RNA, 64 nt, hsa
cuuguuuuccagacagaaaaucuacuccccuguccccagccauaucccuggauaggaagggaua

SEQ ID NO: 86461 - RNA, 64 nt, hsa
gcauccccagcacugguccugggcacuuccccaccccagccaggugucccuccuaugcacagag

SEQ ID NO: 86462 - RNA, 55 nt, hsa
augggggccccagcaguuaacagggcccagccacaaauucagcugaagggaccaa

SEQ ID NO: 86463 - RNA, 64 nt, hsa
guuuguagcuuaugacuuauuuaaugaauggaugcccagccaagcucagaguaggcgcccaaag

SEQ ID NO: 86464 - RNA, 64 nt, hsa
uccucacaugugcugcgaccucucucagggcucccccagccauuccuucuuuccuuccugccuu

SEQ ID NO: 86465 - RNA, 64 nt, hsa
aggcuauggaguuugcugugggcccugcaaccuucccagccacuccugcugcacuaaggacuua

SEQ ID NO: 86466 - RNA, 64 nt, hsa
cuuuccugccccuccccaucauaccugcacccaccccagccagggcucccuguccagaauucgg

SEQ ID NO: 86467 - RNA, 64 nt, hsa
ugaaaccuuuagggcagcuugccccggccccggccccagccagaguuccugcggagugaagagg

SEQ ID NO: 86468 - RNA, 64 nt, hsa
ccccuuuucuuuucuacccuagccauuccugguacccagccaucugcccaggggugcccccucc

SEQ ID NO: 86469 - RNA, 64 nt, hsa
guucgccucuaguuucucagggauggagcgagagcccagccagagaacaguaagaggagcugcu

SEQ ID NO: 86470 - RNA, 64 nt, hsa
uucaucacagcuaaaccugguucccuccaaaccucccagccacucgggcuuguaacugucugag

SEQ ID NO: 86471 - RNA, 64 nt, hsa
aucacagugacagugucauggggagcugggcgggcccagccaaacccuccuucuuccuagagcc

SEQ ID NO: 86472 - RNA, 64 nt, hsa
ggcgggcccagccaaacccuccuucuuccuagagcccagccagcaggcaggaguuccuggaccc

SEQ ID NO: 86473 - RNA, 64 nt, hsa
aucuccugagcuuaguguccguggcuguccaccucccagccauacuugacuguccccaaacucu

SEQ ID NO: 86474 - RNA, 64 nt, hsa
acagcugaggaguggccgggcaggcagcaggcuccccagccagggcuugacacgcccacaguca

SEQ ID NO: 86475 - RNA, 64 nt, hsa
uggcgcaggugccaugccugcucccugucugugucccagccacgcagggccauccacugugacg

SEQ ID NO: 86476 - RNA, 64 nt, hsa
gcucugccuucucaggccccgggcuucccuucuccccagccagagguggagccaagugguccag

SEQ ID NO: 86477 - RNA, 64 nt, hsa
guuugcaugcuucgugccacacgcccgcggugaucccagccagggccccgagcgcagaggcgga

SEQ ID NO: 86478 - RNA, 64 nt, hsa
cacagccagagucaaugccuucaugggaagggcucccagccacacccagaguggcccaaagcug

SEQ ID NO: 86479 - RNA, 64 nt, hsa
gguagaaaacuccaggguccccugccaccgacugcccagccacuccaagcccccuggcagcugc

SEQ ID NO: 86480 - RNA, 64 nt, hsa
uuuggcccaagacugggcuguaguuacauuaaugcccagccagccaccccugccacucacccuu

SEQ ID NO: 86481 - RNA, 64 nt, hsa
uccuuacucagcuaccucggguuggggugggagccccagccaaauccugggcucccugccugug

SEQ ID NO: 86482 - RNA, 64 nt, hsa
cuucucuccaagugugccaggccaggacagcccucccagccaugaauccuuacucagcuaccuc

SEQ ID NO: 86483 - RNA, 64 nt, hsa
cagcgugaggcuucagccuggagcccuggugggucccagccagggcagaggggccuccccagga

SEQ ID NO: 86484 - RNA, 64 nt, hsa
ccucagaucaucucugucacucuggaagggacaccccagccagggacggaaugccuggucuuga

SEQ ID NO: 86485 - RNA, 64 nt, hsa
aaaaugacccaacgauguccacacaccaccaaaacccagccaaugggccaccucuuccuccaag

SEQ ID NO: 86486 - RNA, 64 nt, hsa
cccugggccugcaggagaggcugagaccagcccacccagccaguggucgagcacugccccgccg

SEQ ID NO: 86487 - RNA, 64 nt, hsa
cuuuucccacuuucuggguggcuuuuuggguccacccagccaggaugcugcaggccaagcuggg

SEQ ID NO: 86488 - RNA, 64 nt, hsa
cccagcaucucuuccuccuuuguagaugcuggagcccagccaaggucugggagcuauaugggaa

SEQ ID NO: 86489 - RNA, 64 nt, hsa
aagagggaaagagggcugccauuccugacagccucccagccagggcuggcgauaaaggaccgag

SEQ ID NO: 86490 - RNA, 64 nt, hsa
cgcucuuggccccaagguugccccgggccagcagcccagccagcagcacagucucuauggugcu

SEQ ID NO: 86491 - RNA, 64 nt, hsa
guggcuuaauccagaggcccugucauggcccgcccccagccaugggaaagcaaacuucauccua

SEQ ID NO: 86492 - RNA, 64 nt, hsa
cucagugccaccacccccggcaggccuucccugacccagccaggaacaaacaagggaccaagug

SEQ ID NO: 86493 - RNA, 64 nt, hsa
cccucgauggacagccucacccaccccaccugggcccagccaggagccccgccuggccaucagu

SEQ ID NO: 86494 - RNA, 51 nt, hsa
agaaggacuggaaggacugagcccagccagaggcgggcagggcagacugac

SEQ ID NO: 86495 - RNA, 64 nt, hsa
ccugccucugucucucuucuggccugagccugggcccagccaccuccugacggguccccugggu

SEQ ID NO: 86496 - RNA, 64 nt, hsa
cauaggucucccauggcgcaaugagucaguggcccccagccaggcagugugggcauugccacug

SEQ ID NO: 86497 - RNA, 64 nt, hsa
gccaccugauccccagcugugucuccuccagggccccagccauguguucgucgccccgugugcc

SEQ ID NO: 86498 - RNA, 64 nt, hsa
cuugccccugccccuaccccugccagcgcccacccccagccagggccccucgccuuccuccccu

SEQ ID NO: 86499 - RNA, 64 nt, hsa
uaaugaaccaggcauuguggcaugcgccuauagucccagccacucaagaggcacaggcgggagg

SEQ ID NO: 86500 - RNA, 64 nt, hsa
uggcucggcccugcccccaguauacugaccauuccccagccacuucccuuccgcacuuaccacu

SEQ ID NO: 86501 - RNA, 64 nt, hsa
uccccagccacuucccuuccgcacuuaccacucccccagccacgccccuccccgcugaccgcuc

SEQ ID NO: 86502 - RNA, 64 nt, hsa
gaggccucuacacagaagaaagcagcccccaugucccagccacuucugggucccagccagcagc

SEQ ID NO: 86503 - RNA, 64 nt, hsa
gaaagcagcccccaugucccagccacuucugggucccagccagcagcacggauguuacuguccu

SEQ ID NO: 86504 - RNA, 64 nt, hsa
acugcccccuccagcccauuuucugccgugaaaccccagccagccacaccagacucuggaaccc

SEQ ID NO: 86505 - RNA, 64 nt, hsa
ucaggcucccucuauuaaagccgaucugacuccgcccagccagaugucccgagugcgccaagga

SEQ ID NO: 86506 - RNA, 64 nt, hsa
acccuuccacacguuugauuucuuccugcagaggcccagccacgugucuggaaucccagcuccg

SEQ ID NO: 86507 - RNA, 64 nt, hsa
augaccaggacaucaugcuguugcgccuggcacgcccagccaaacucucugaacucauccagcc

SEQ ID NO: 86508 - RNA, 64 nt, hsa
gccccaacucuuuucccgggaccauacugagucccccagccacgcugcugacauuaccauuauu

SEQ ID NO: 86509 - RNA, 64 nt, hsa
ucagaccagccaaccuuuguggaauaagccccagcccagccaaaccaaacccagaugccugagg

SEQ ID NO: 86510 - RNA, 64 nt, hsa
gccuagaggagcaccaucuacaguugugccauuccccagccacugccuucaugcugcccccgcc

SEQ ID NO: 86511 - RNA, 64 nt, hsa
uuccgucugcccccucgucaccaggugugauagccccagccaggucacaccuggccucacacuu

SEQ ID NO: 86512 - RNA, 64 nt, hsa
ccuggcaaucugggaaggguucagaaggugggcacccagccaacagcaugaacucagagcauug

SEQ ID NO: 86513 - RNA, 64 nt, hsa
aagaguggguugaccaauuugguauugaauguugcccagccaccccuaggaacaccuguccauc

SEQ ID NO: 86514 - RNA, 64 nt, hsa
cgaguggccuucuuugaagagcucuagcaggugacccagccaccccaggaccugccacuucucc

SEQ ID NO: 86515 - RNA, 64 nt, hsa
ccagucugcacggcccaucugcuucaccuucccucccagccacgugccaguggccacagcccac

SEQ ID NO: 86516 - RNA, 64 nt, hsa
caccuugccccaaggaaaccagcccugggugccacccagccacuuagggucuacagggugggac

SEQ ID NO: 86517 - RNA, 64 nt, hsa
auggauguuguggcccugugucuuccuagugugacccagccaggagcggaagcuucaggcguuu

SEQ ID NO: 86518 - RNA, 64 nt, hsa
ggcugagguggggccgggccacaccccugcccaucccagccagggugcugugcccccguccaga

SEQ ID NO: 86519 - RNA, 64 nt, hsa
cucgggggucaggagcucagcguccgcuacucagcccagccaaaacccucccagacgucuccuc

SEQ ID NO: 86520 - RNA, 64 nt, hsa
uacauuguugauuguuaugacugguacacucuggcccagccagagcuauaauuguuuuuuaaau

SEQ ID NO: 86521 - RNA, 64 nt, hsa
uacagaaaccucagugaaaucaagaaauaaugaucccagccagacugagaaaauguaagcagac

SEQ ID NO: 86522 - RNA, 64 nt, hsa
caggguuggcaccuucccccucccccagccacuccccagccagccuggcugggacugggaacag

SEQ ID NO: 86523 - RNA, 64 nt, hsa
cuccucaggaccaggguuggcaccuucccccucccccagccacuccccagccagccuggcuggg

SEQ ID NO: 86524 - RNA, 64 nt, hsa
ccagcacuggccucccuguggaagaugaacauaucccagccaccuguguacaggggcucacuuu

SEQ ID NO: 86525 - RNA, 64 nt, hsa
ugugacuuugggcgagucucagugccacuugguccccagccauggacucuauacagugagggcc

SEQ ID NO: 86526 - RNA, 63 nt, hsa
ccacagcccuagcugccagcaaugcuguccucacagaggcauagucgcccccagcuggguugu

SEQ ID NO: 86527 - RNA, 63 nt, hsa
caggaucaugccuucugugucuggaagaggcggcagaggcaacaguguuuaggauuuggguua

SEQ ID NO: 86528 - RNA, 63 nt, hsa
gcgugagugugguggugugaccuucaggcugcacagaggcaaggacccagauguggcagcaug

SEQ ID NO: 86529 - RNA, 63 nt, hsa
ccauccgugcggccuuggccacaucccuauuaacagaggcagcuccacuucagacagggacaa

SEQ ID NO: 86530 - RNA, 63 nt, hsa
cugucauuuucccuuccuaccccaacccugagccagaggcaucugacagcccuuucccagagg

SEQ ID NO: 86531 - RNA, 63 nt, hsa
ggcagagcugggcggcauccacagccagagaggcagaggcaagagcagagccaggcugugccc

SEQ ID NO: 86532 - RNA, 63 nt, hsa
cacuuaaaggagaaaaauauuugggacuagcagcagaggcaguaagagaugugaaccuuggug

SEQ ID NO: 86533 - RNA, 63 nt, hsa
aacgagaugagaagacugugauccucauguacucagaggcacuucccuccuaagucaaagacc

SEQ ID NO: 86534 - RNA, 63 nt, hsa
uuucccauucacuucucuagaaagcugccaagacagaggcagaaagaaauggaugauaguucu

SEQ ID NO: 86535 - RNA, 63 nt, hsa
aauuuugaaguaacgaaugcaaauuccacucagcagaggcaauguuauuuauguacauaggga

SEQ ID NO: 86536 - RNA, 63 nt, hsa
ugcuaauaaaugucauccaagaggaacuaaaaccagaggcauuauuacugcauuguuugucac

SEQ ID NO: 86537 - RNA, 63 nt, hsa
uacaaaccauuagaaaauaacucaaaaagauggcagaggcaaauccacagaaggggggcugcc

SEQ ID NO: 86538 - RNA, 63 nt, hsa
acccaggagccccccaggcugccugccugcgugcagaggcaggagaggaccguggagcguuuc

SEQ ID NO: 86539 - RNA, 63 nt, hsa
gcuggcuuucaagcgugguuuuuugcuaagagccagaggcaggucuucuggaguucucagggg

SEQ ID NO: 86540 - RNA, 63 nt, hsa
gcacaggugggugauguccuuggcugcugccgucagaggcagcccccugcacagggaggggcu

SEQ ID NO: 86541 - RNA, 63 nt, hsa
agcacccacccugguucuccaggccccucuguccagaggcagggccugaaccucgggcuccug

SEQ ID NO: 86542 - RNA, 63 nt, hsa
uugcucaggguggggggcugggaccauggcccgcagaggcacugccacagcugugagggccaa

SEQ ID NO: 86543 - RNA, 63 nt, hsa
accuuugcggguggggcguuacugccaaaacuccagaggcaaaguggaccuggcaaccacaag

SEQ ID NO: 86544 - RNA, 63 nt, hsa
ccuggaacauugggccugaguggagaugggagacagaggcaggccagaagguucucucugcac

SEQ ID NO: 86545 - RNA, 63 nt, hsa
gccuguggcagcgccgcuggacccuaggaggcucagaggcaguggugugggagcccugucugc

SEQ ID NO: 86546 - RNA, 63 nt, hsa
uugaagaggcugacuuggcccacugcuaagcggcagaggcagggccagccauccugucgcaag

SEQ ID NO: 86547 - RNA, 63 nt, hsa
cccccccugucgucugcucuucacccagcaccacagaggcaccugcugcacacacaagcaucu

SEQ ID NO: 86548 - RNA, 63 nt, hsa
ggggguuggaaggaugggggcucauuuaacccucagaggcagcgccuuugucugucuaucugg

SEQ ID NO: 86549 - RNA, 53 nt, hsa
ccuucuuuucauggugguagcuccagaggcaggcagaggaaauauugucagag

SEQ ID NO: 86550 - RNA, 63 nt, hsa
cucugcuggccuacagcuugucuguuucucaagcagaggcaggaagagcuagucuuagcauuu

SEQ ID NO: 86551 - RNA, 63 nt, hsa
caaagggggagucccucgucucuugugacucagcagaggcaguggccacguucagggaggggc

SEQ ID NO: 86552 - RNA, 63 nt, hsa
ugccccccagcuacuguaugcccccgacccccgcagaggcagaaugaacccauagggagcuga

SEQ ID NO: 86553 - RNA, 63 nt, hsa
gagggcagaggaaguacuuagggagguuggugucagaggcaggagugggggaucagggaaggu

SEQ ID NO: 86554 - RNA, 63 nt, hsa
cugaggggaacccugggacaggcacaggcugggcagaggcacagggcagugcaggggacucug

SEQ ID NO: 86555 - RNA, 63 nt, hsa
cugaggccauggcaggacagcugcuguggggugcagaggcagaagaugaaggacaaaaggaag

SEQ ID NO: 86556 - RNA, 63 nt, hsa
ucaggaccagagaagggaaaugacuucuccaggcagaggcagaucugagucuagaacccaggc

SEQ ID NO: 86557 - RNA, 63 nt, hsa
ucagagaacagagaucacacacaccaaaccagacagaggcagggcagcauggagacagguaga

SEQ ID NO: 86558 - RNA, 63 nt, hsa
ggcuccggggggaguggggcccugcgcuagaggcagaggcaguucuuuguucaagcguuccuc

SEQ ID NO: 86559 - RNA, 63 nt, hsa
ucuuuguucaagcguuccucuggggaccggcagcagaggcaccguguucucucagcccuggau

SEQ ID NO: 86560 - RNA, 63 nt, hsa
aagacaaaaaaaaaaaaaaaaaacaaacagaggcagaggcaggcaguagcaagaaagcagagc

SEQ ID NO: 86561 - RNA, 63 nt, hsa
aaauguaagacaaaaaaaaaaaaaaaaaacaaacagaggcagaggcaggcaguagcaagaaag

SEQ ID NO: 86562 - RNA, 63 nt, hsa
uccacagcggcgacccaggccuccaagcuugcacagaggcaaggccagacuuuuccgucguuu

SEQ ID NO: 86563 - RNA, 63 nt, hsa
cacagcggagccaugggggcugggaguccccaucagaggcagugaggugggccccggcccugg

SEQ ID NO: 86564 - RNA, 63 nt, hsa
cuggcuccgcuguguggauggggagaucggggccagaggcagaacccuggugaggaagcucca

SEQ ID NO: 86565 - RNA, 63 nt, hsa
cucgcuucucugugacugauguuaggcugggcccagaggcacagccggggccugccuagcacu

SEQ ID NO: 86566 - RNA, 63 nt, hsa
augugucaaaggcuuuuggagugaccaaaagcacagaggcagcggguggggcgccuggguggu

SEQ ID NO: 86567 - RNA, 63 nt, hsa
gguccccaaggucgcugccacccuugcccggggcagaggcagaagcccacauaugcugugacg

SEQ ID NO: 86568 - RNA, 63 nt, hsa
ggcucacaccugucauccuagcacuuugggaggcagaggcaggaggaucgcuugagcucagga

SEQ ID NO: 86569 - RNA, 63 nt, hsa
ucaggcaaggucuggagacauuuuugguuggggcagaggcaugcuccuggcaucgagugggug

SEQ ID NO: 86570 - RNA, 63 nt, hsa
uggcacugagaugcauccacucagcaggagugacagaggcagaaguuccuuuaaagcacaucu

SEQ ID NO: 86571 - RNA, 63 nt, hsa
acccuuaaaguacaguguuauuuaagaaucuuccagaggcagucaacagacuuauacacuaag

SEQ ID NO: 86572 - RNA, 63 nt, hsa
ccugcagggguggagggcagucccucagaaucccagaggcagucccagccucagaacccagga

SEQ ID NO: 86573 - RNA, 63 nt, hsa
gaaagacucuuaauuaagaggcucaggcaagcacagaggcagcccgugggucucugucucagu

SEQ ID NO: 86574 - RNA, 63 nt, hsa
cugcuucuaagaggcuaaccuggaaacuaagcucagaggcaagguaauaaagcacuucagggc

SEQ ID NO: 86575 - RNA, 63 nt, hsa
gagaaggaucugcuccgccuuuggccacaggagcagaggcagaccugggaugccccaguuucu

SEQ ID NO: 86576 - RNA, 63 nt, hsa
ggucugggggacagacaaggaugauggaccccucagaggcaagacuaggaucagggacagauc

SEQ ID NO: 86577 - RNA, 63 nt, hsa
cagcuaugcaaaucccuaccuacccagcugggccagaggcacgaggcagccaggcaggguggg

SEQ ID NO: 86578 - RNA, 63 nt, hsa
gacacagacacagagcaggaggacacguggagacagaggcagacuggagugaugcggccacaa

SEQ ID NO: 86579 - RNA, 63 nt, hsa
gacacagacacaaagcaggaggccacauaaagacagaggcagagacugaagugaugcugcccc

SEQ ID NO: 86580 - RNA, 63 nt, hsa
agggucuccaggcuuuauuccucccaggcacugcagaggcaccggugaggaagggucuccagg

SEQ ID NO: 86581 - RNA, 64 nt, hsa
auauauugugauuauuuucguugauaaagaacuagauacaaagaccucugaaauugaugauaaa

SEQ ID NO: 86582 - RNA, 64 nt, hsa
guguuuuuuuuuccaaaguuuuucccaaggagaagauacaaauauaugguagcuauuguuuaaa

SEQ ID NO: 86583 - RNA, 64 nt, hsa
caacccaggauacaaacuuccauccagaugcauggauacaaauuuccauagcuccggggcugcu

SEQ ID NO: 86584 - RNA, 64 nt, hsa
uuuugguucaacuggaaucucugugccaacccaggauacaaacuuccauccagaugcauggaua

SEQ ID NO: 86585 - RNA, 64 nt, hsa
uaaugucuaagaaauccagcuucauaauuuccaugauacaaagaucuuuuuucagguggauuuu

SEQ ID NO: 86586 - RNA, 64 nt, hsa
cuauugucacaugaugaauaaauagaugaagugagauacaaagcuggguuugauucaaagcccu

SEQ ID NO: 86587 - RNA, 64 nt, hsa
agaauuaaauaauuuuuaaaaggugguaaagaaggauacaaaggagaacucagcagagauuuau

SEQ ID NO: 86588 - RNA, 64 nt, hsa
uauagauuuaaaauaaucucaagcugcauccacagauacaaaaaaauauaggagccaugaaaug

SEQ ID NO: 86589 - RNA, 64 nt, hsa
uaacaggaaaaugagagaaaauaaagcagcugaggauacaaaugugcugguagggagcgauauu

SEQ ID NO: 86590 - RNA, 64 nt, hsa
uagaaucaguggauggaaacaaggguuuaaacuugauacaaaaccuuuuauaaaaaauauuguu

SEQ ID NO: 86591 - RNA, 64 nt, hsa
guggggauggagaauggguaguuagugcauaauggauacaaaguuucugauuggggugaugaga

SEQ ID NO: 86592 - RNA, 64 nt, hsa
uacauauucuagauauucucccaagagaccucuugauacaaacaauagaaaauuguggcuuuca

SEQ ID NO: 86593 - RNA, 64 nt, hsa
aaugaaaauaagccagguauucuaaaagauccuggauacaaauuaagaauuuugcuuuauuuua

SEQ ID NO: 86594 - RNA, 64 nt, hsa
uuaguguguuuucaguaugcuaaaaagucagagugauacaaaagugauauuuaaaaauauacac

SEQ ID NO: 86595 - RNA, 64 nt, hsa
cuuacaggauguuagagacaaaacaagcagacaccugaaacaaucaacgcccaauaaaacaaag

SEQ ID NO: 86596 - RNA, 64 nt, hsa
gaaacauuauuaauugguaggguaagcagacacucugaaacaaugagaaaaauacuaaaaauug

SEQ ID NO: 86597 - RNA, 64 nt, hsa
agaguagucuuucaaucugaagauguaagacuuccugaaacaaguucucaagaagucuuuacau

SEQ ID NO: 86598 - RNA, 64 nt, hsa
auuucauaaagucugaggauuuucgucaaccuuacugaaacacacuggugcuuucaucaucaga

SEQ ID NO: 86599 - RNA, 64 nt, hsa
cagucuguugccugaaacagcccaguccucuuaacugaaacagcauucuacuucuuguuccaag

SEQ ID NO: 86600 - RNA, 64 nt, hsa
ccaccacugugaugcgaaaugaucagucuguugccugaaacagcccaguccucuuaacugaaac

SEQ ID NO: 86601 - RNA, 64 nt, hsa
agugaggaccuguaauccagcauucuuguuaaagcugaaacacugaaacagccauugccuugac

SEQ ID NO: 86602 - RNA, 64 nt, hsa
ccuguaauccagcauucuuguuaaagcugaaacacugaaacagccauugccuugaccaacauau

SEQ ID NO: 86603 - RNA, 64 nt, hsa
auaaaccccacaugccccaggagcgaugugcucccugaaacagacaaccacacgcuguugggga

SEQ ID NO: 86604 - RNA, 64 nt, hsa
accguccuugugcuguggcuggcggugucucagccugaaacauaaaccccacaugccccaggag

SEQ ID NO: 86605 - RNA, 64 nt, hsa
cuuccccuccuauaaucauaauaaucaugauaaccugaaacauguuacugggacucgacauuuu

SEQ ID NO: 86606 - RNA, 64 nt, hsa
cuuggagcugucacauagcaggggcaaccucacacugaaacaaaggaagugaugucccauuauu

SEQ ID NO: 86607 - RNA, 64 nt, hsa
gaaaagauggcccugucagccacccucucucagucugaaacauccaacauccccagaaggcuua

SEQ ID NO: 86608 - RNA, 64 nt, hsa
ccuguggaaaagaagagagacagagagacagugucugaaacaggauggcagaauaggcucacau

SEQ ID NO: 86609 - RNA, 64 nt, hsa
ugcacaugacagaaagcuggaagaaauagucaaccugaaacacaugauggaauuauaauucaga

SEQ ID NO: 86610 - RNA, 64 nt, hsa
gaaacuuucauaucaauaauugauuauguauuaacugaaacaaaagacuagagaaagacacagu

SEQ ID NO: 86611 - RNA, 64 nt, hsa
aggagcagaagcaaagagcagacacacauacagccugaaacagaccuggacagacagacacagc

SEQ ID NO: 86612 - RNA, 64 nt, hsa
cagccugaaacagaccuggacagacagacacagccugaaacagacccggacagacagacacagc

SEQ ID NO: 86613 - RNA, 64 nt, hsa
cagccugaaacagacccggacagacagacacagccugaaacagacccagacaaacagacagaca

SEQ ID NO: 86614 - RNA, 64 nt, hsa
aacagacccagacaaacagacagacagacacagccugaaacagacccagacagacagacagaca

SEQ ID NO: 86615 - RNA, 64 nt, hsa
gccugaaacagacccagacagacagacagacagccugaaacagacccagacacagccugaaaca

SEQ ID NO: 86616 - RNA, 64 nt, hsa
cagacagacagccugaaacagacccagacacagccugaaacagauccggacagacagacagaaa

SEQ ID NO: 86617 - RNA, 64 nt, hsa
cugaaacagauccggacagacagacagaaacagccugaaacagacccagacagacagacagaca

SEQ ID NO: 86618 - RNA, 64 nt, hsa
cugaaacagacccagacagacagacagacacagccugaaacagacccggacagacagacagaca

SEQ ID NO: 86619 - RNA, 64 nt, hsa
cugaaacagacccggacagacagacagacacagccugaaacagacccggacagacagacagaca

SEQ ID NO: 86620 - RNA, 64 nt, hsa; identical to SEQ ID NO: 86619

SEQ ID NO: 86621 - RNA, 64 nt, hsa
cugaaacagacccggacagacagacagacacagccugaaacagaccuagacagacagacacaga

SEQ ID NO: 86622 - RNA, 64 nt, hsa
uugaaacagacccagacaaacagacagacacagccugaaacagacccagacacagccugaaaca

SEQ ID NO: 86623 - RNA, 64 nt, hsa
gacagacacagccugaaacagacccagacacagccugaaacagacccggacagacagacagaca

SEQ ID NO: 86624 - RNA, 64 nt, hsa
cugaaacagacccggacagacagacagacacagccugaaacagacccagacagacagacagaca

SEQ ID NO: 86625 - RNA, 64 nt, hsa
cugaaacagacccagacagacagacagacacagccugaaacagacccagacagacagaccgacg

SEQ ID NO: 86626 - RNA, 64 nt, hsa
cuaaaacagaccuggacagacaggcagacguagucugaaacagaccugaacagacagacagacg

SEQ ID NO: 86627 - RNA, 64 nt, hsa
ggcauguggcacuuugucagggcagcccaggaaucugaaacaggaucaaacucugcuuccuggg

SEQ ID NO: 86628 - RNA, 64 nt, hsa
uuccaucccacugggaaaacgucucagguggccucugaaacaccacuccuuuuugugugugugc

SEQ ID NO: 86629 - RNA, 64 nt, hsa
aauuuuauguggaaaaguaaagaaacacaaauagcugaaacaaacuugacaaagcaaguagaga

SEQ ID NO: 86630 - RNA, 64 nt, hsa
auugauaauauuuaaucagcauucucauugaaaucugaaacaagguaucuuccaucagcauaac

SEQ ID NO: 86631 - RNA, 64 nt, hsa
gugacagagcgagacuccauuucaaaaaaaaagacugaaacaagcuugugcuaagauggaaagg

SEQ ID NO: 86632 - RNA, 64 nt, hsa
cugugaaugaacaaugaagucguuccucuuaagacugaaacaagcaggccagaugugguggcuc

SEQ ID NO: 86633 - RNA, 64 nt, hsa
uauccauuuuauacaaucacugauacagucuaugucaaaaaaccaacagaccauuauuccucuu

SEQ ID NO: 86634 - RNA, 64 nt, hsa
agcuacaaaguaauucaccagcaugacaaaauggucaaaaaauaagucaucagcacuuaagaaa

SEQ ID NO: 86635 - RNA, 64 nt, hsa
cugaaguuuuaguuaagauuuucacacauuaauaucaaaaaaguaaguuuaguauuuguuucuc

SEQ ID NO: 86636 - RNA, 64 nt, hsa
aguaauuacaguggaaugaguacuggacaaggagucaaaaaacuugauuucagguccuagcucu

SEQ ID NO: 86637 - RNA, 64 nt, hsa
ggcuuuuacuaucuuucuuaaaaaaaaaaaaaagucaaaaaaauucaaaaaaggggaugauacu

SEQ ID NO: 86638 - RNA, 64 nt, hsa
aucuuucuuaaaaaaaaaaaaaagucaaaaaaauucaaaaaaggggaugauacuagccuuaaca

SEQ ID NO: 86639 - RNA, 64 nt, hsa
cacuccagccugggcaacagagcgagacuccgucucaaaaaaaaaaaaaaaaaaaguaauuggc

SEQ ID NO: 86640 - RNA, 64 nt, hsa
cacuccagccugggugacagagcgagacuccgucucaaaaaacaaaaagcccguggcaauuaau

SEQ ID NO: 86641 - RNA, 64 nt, hsa
cacuccagccugggcaacagagcgagacucuaucucaaaaaaaaacaaaaaaaaaaacaaaaaa

SEQ ID NO: 86642 - RNA, 64 nt, hsa
cacuccagccugggcgacagagugagacucugucucaaaaaaaaaaaaaaaauagaauguguau

SEQ ID NO: 86643 - RNA, 64 nt, hsa
uaauuguauauuauucaagcaccuuuguugaagcucaaaaaaaaugaugccucuuuaaacuuua

SEQ ID NO: 86644 - RNA, 64 nt, hsa
aauuauaggaguauuuauguaacuaucuuaugcuucaaaaaacaaaaguauuugugugcaugug

SEQ ID NO: 86645 - RNA, 64 nt, hsa
guaauuaauccauuccuggcauaaaaagucuuuaucaaaaaaaauuguagaugcuugcuuuuug

SEQ ID NO: 86646 - RNA, 64 nt, hsa
ugcaucauaguucuacaguuuguuuuuguuuucuucaaaaaagcuguaagagaauuaucugcaa

SEQ ID NO: 86647 - RNA, 64 nt, hsa
aaauauaguuuuguauaauagcauagauuuuccuucaaaaaaugaacauuuauauaucuacaaa

SEQ ID NO: 86648 - RNA, 64 nt, hsa
aaauggugggauuuuuuuuuaucaugauuaaauaucaaaaaauugcccuaugaaaacuuuaaau

SEQ ID NO: 86649 - RNA, 64 nt, hsa
aaaaacaccuaaaauuugaaaaaugauuguaggaucaaaaaaggcagaugaaauuacuuaauac

SEQ ID NO: 86650 - RNA, 64 nt, hsa
auagguaucagagcagucuagagacaauugcaugucaaaaaauguacauucauuuuuaggugga

SEQ ID NO: 86651 - RNA, 64 nt, hsa
caauuuuauaucacaguuuuauuuucuuaugaaaucaaaaaaugcauugauacucauuaaugca

SEQ ID NO: 86652 - RNA, 64 nt, hsa
auggugacucugaugcucucaacuuuugagugccucaaaaaaugcuaaaacuuuggcugggcau

SEQ ID NO: 86653 - RNA, 64 nt, hsa
cacuccagccuaggcaacagagcaagacuccgucucaaaaaaaaaaaaaaaaaaaaaagacauu

SEQ ID NO: 86654 - RNA, 62 nt, hsa
acauuuuuauuaguggauagcguuguuggaauucaaaaaacagacaauauugccauagaaau

SEQ ID NO: 86655 - RNA, 64 nt, hsa
gucuugacuaaugguucccgguuuagcugaagauucaaaaaaaaaaaaaaaagcuuuaugcuaa

SEQ ID NO: 86656 - RNA, 64 nt, hsa
caagaauccucuugagccaguaaucaauccugucucaaaaaauguucuuugccauuuccuagau

SEQ ID NO: 86657 - RNA, 64 nt, hsa
ggauucaaucuucuuaucagaagguucuuuuaugucaaaaaaccugcugucaaggcuugaagag

SEQ ID NO: 86658 - RNA, 64 nt, hsa
cucuauacuuugucucugugucuuauuucuuuucucaaaaaaauuuuucuuuuuuuaacugcaa

SEQ ID NO: 86659 - RNA, 64 nt, hsa
cacuccagucugggcgacagagcaagacucugacucaaaaaaaaaaaaaaaaaaaaguggcucu

SEQ ID NO: 86660 - RNA, 64 nt, hsa
cacuccagccugggcaacagagugagacuccaucucaaaaaaaaaaaaaaaaaaaaaaaaagag

SEQ ID NO: 86661 - RNA, 64 nt, hsa
acaucaugacgaaaccccaucuccacaaaaaaauucaaaaaauuagccaggugugguggcaugu

SEQ ID NO: 86662 - RNA, 64 nt, hsa
cacuccagccugggugacagagccagacucugucucaaaaaaaaaaaaaaagaaaagaaaaaga

SEQ ID NO: 86663 - RNA, 64 nt, hsa
cacuccagucuggaugacagagagagacccugucucaaaaaauauauauuuaaaaaauaaaaau

SEQ ID NO: 86664 - RNA, 64 nt, hsa
uuucaagcucaucuguuaugcauagcuuugcacuucaaaaaagcuuaauuaaguacaaccaacc

SEQ ID NO: 86665 - RNA, 64 nt, hsa
acacuccagccuggcgacagagcgagacuugguuucaaaaaaaaaaaaaaaaaaaacuucagua

SEQ ID NO: 86666 - RNA, 64 nt, hsa
uucaguuuucaggaugauacacuaugaagauguuucaaaaaaucugaccaaaacaaacaaacag

SEQ ID NO: 86667 - RNA, 64 nt, hsa
ucuuuauucaaaugaaaacauguuugaugacuggucaaaaaauaagcucauaaucuauuuuuuu

SEQ ID NO: 86668 - RNA, 64 nt, hsa
cacuccagccugggcaacaaagugagacuccaucucaaaaaaaaaaaaaaaaaaaaaaaaaaaa

SEQ ID NO: 86669 - RNA, 64 nt, hsa
cacuccagccugggcaacagagugagacccugucucaaaaaaaaaaaaaaaaaaaggagagaag

SEQ ID NO: 86670 - RNA, 64 nt, hsa
gagggcagccugggaaacauggcuaaauccguguucaaaaaauacaaaaauuagcuaggcaugg

SEQ ID NO: 86671 - RNA, 64 nt, hsa
uuuaaguuaauugaacuuuuucuuuauuuauuuuucaaaaaaauguuuauaucacauagacaua

SEQ ID NO: 86672 - RNA, 64 nt, hsa
cauauaugagacuugaaucguagaaaauugaaugucaaaaaaagcucauuucuuuuugaaguga

SEQ ID NO: 86673 - RNA, 64 nt, hsa
guuuagcaguacaagcuucuauugcuaaaacauuucaaaaaacucagagauauuacucuuugau

SEQ ID NO: 86674 - RNA, 64 nt, hsa
acuccagccucggugacaagagcgagacuccaucucaaaaaaaaauaaaaagaaucuuaaaaua

SEQ ID NO: 86675 - RNA, 64 nt, hsa
agcucauaaauaauuggcuuauuacauauaaacuucaaaaaaguggguuauaagacauugcuuu

SEQ ID NO: 86676 - RNA, 64 nt, hsa
ugcacuccagucuggguaacagggagacugcaucucaaaaaaaaaaaaaaaaaaaaaaaagggc

SEQ ID NO: 86677 - RNA, 64 nt, hsa
aaaaaaaagggcuguccauguauucacacaccccucaaaaaaagccuuuaguuccuacuuuagc

SEQ ID NO: 86678 - RNA, 64 nt, hsa
uauuguuugccacugaggguucagaugauagaccucaaaaaaucgaaaauacugguugaaauuu

SEQ ID NO: 86679 - RNA, 64 nt, hsa
gcauuccugcugagcaacagagugagaccccaucucaaaaaagaaaaaaaaaggcauucuagua

SEQ ID NO: 86680 - RNA, 64 nt, hsa
guaugccgguccuacucacgcgacacccgugugcucaaaaaaguuauuuguuuuuguuacgugu

SEQ ID NO: 86681 - RNA, 64 nt, hsa
uccucuuuaucaugcuuuuucccccuguuguuugucaaaaaaaauugccuuuaaauuccugggu

SEQ ID NO: 86682 - RNA, 64 nt, hsa
cacuccagccugggugauagagcaagaccccaacucaaaaaaaaaaaaaaggaucccacgguuc

SEQ ID NO: 86683 - RNA, 64 nt, hsa
cacuccagccugggcgacagagcaagacuccaucucaaaaaaaaaguuaauuaauuaauuagau

SEQ ID NO: 86684 - RNA, 64 nt, hsa
caagcccuacuuuggccaacauccugcuuauuucucaaaaaagagggacagugaaaacaaaaac

SEQ ID NO: 86685 - RNA, 64 nt, hsa
gcacuccagccugggugacuagcaaaacuccaucucaaaaaaaaaaaaaagaaagaaagaaacu

SEQ ID NO: 86686 - RNA, 64 nt, hsa
uuugauaugauaauaaucaugaucacaacugagaucaaaaaaauauaugacagauuauuuuguu

SEQ ID NO: 86687 - RNA, 64 nt, hsa
cacuccagccugggcgacagagcaagacuccgucucaaaaaaaaaaaaaaaaaaaaaaaaagag

SEQ ID NO: 86688 - RNA, 64 nt, hsa
cacuccagccugggucacagagugagacuccaucucaaaaaaaaaaaagagagagagagagaaa

SEQ ID NO: 86689 - RNA, 64 nt, hsa
cacuccggccugggugacagagugagacccugucucaaaaaaaaaaagauucugugucagagcc

SEQ ID NO: 86690 - RNA, 64 nt, hsa
acuccagccugggcaacaagagcaaaacuccgucucaaaaaaaaaaaaaaauuacaaauggggc

SEQ ID NO: 86691 - RNA, 64 nt, hsa
aacucccucucugugcauuuucuaagugggacauucaaaaaacucucucccaggaccucggaug

SEQ ID NO: 86692 - RNA, 64 nt, hsa
ucaaaagauguucugauaacauugugauuguaacucaaaaaaauuuauaguagaaacguaauug

SEQ ID NO: 86693 - RNA, 64 nt, hsa
aaaugcucuguaugucacuacauaugaaaaaacaucaaaaaacaauuagcauuggacaucuuaa

SEQ ID NO: 86694 - RNA, 64 nt, hsa
acacuccagccugaugacagaccgagacacugucucaaaaaaauaaaaaaauucagauugcuga

SEQ ID NO: 86695 - RNA, 64 nt, hsa
cauuccagccuggaugacagagcaaaacccugucucaaaaaaaugcagacuggccaggcacagu

SEQ ID NO: 86696 - RNA, 64 nt, hsa
ucaguauuaagguuuucauguggaaaggugucauucaaaaaaaaaguaauuggcauacauauuc

SEQ ID NO: 86697 - RNA, 64 nt, hsa
ucuuaauguuucugguuaugacagauaaguuugcucaaaaaauguggaugaagccauuauuguu

SEQ ID NO: 86698 - RNA, 64 nt, hsa
uacuaccaacccugaacgucucaggacaaauaauucaaaaaagagaucuacauuuucuggaaaa

SEQ ID NO: 86699 - RNA, 64 nt, hsa
cacucuagccugggcaaccaagagugaaacugucucaaaaaacaacuuuuaucaaugucugcaa

SEQ ID NO: 86700 - RNA, 64 nt, hsa
cacuccagccugggugacagagcgacccucugucucaaaaaauaauaauaauaauaaauaaaac

SEQ ID NO: 86701 - RNA, 64 nt, hsa
acaagacuuuugagcaaucugaauuaaaaauacaucaaaaaaguaauagcgcucauuugcuaaa

SEQ ID NO: 86702 - RNA, 64 nt, hsa
acuccagccugggugacaagagugaaacuccaucucaaaaaaaaagaaaagaagguccagcuuu

SEQ ID NO: 86703 - RNA, 64 nt, hsa
ccacuuaacacuuugauuagcaugaacuugccaaucaaaaaaugacaaucaauuugagaaaaua

SEQ ID NO: 86704 - RNA, 64 nt, hsa
acuccagccugggcgacaagagcaaaacuccgucucaaaaaaaaaaaaaagauacaaagucugc

SEQ ID NO: 86705 - RNA, 64 nt, hsa
guucaucguuugccuagcaugucccuguggcgucucaaaaaaaaguuucaucgucccgucauug

SEQ ID NO: 86706 - RNA, 64 nt, hsa
ugguuuacuuaauacaaaaaaaaaaaaaagaauuucaaaaaaaaaaguuguuugcuuaaaaaaa

SEQ ID NO: 86707 - RNA, 64 nt, hsa
cuguccagccugggugacagagcaagacugcguuucaaaaaaaaaaaaaaaaaaacccauuaaa

SEQ ID NO: 86708 - RNA, 64 nt, hsa
cacuccagucugggugacagagcaagacuccaucucaaaaaauaaauaaauagaaagagagaga

SEQ ID NO: 86709 - RNA, 64 nt, hsa
cacucuagucugggugacagagcgagacucugucucaaaaaaaaaaaaauaaagccgggcgugg

SEQ ID NO: 86710 - RNA, 64 nt, hsa
gugcuccagccugagcaacaagagcgaaacugucucaaaaaaaagaagaaaauaaauaaauaaa

SEQ ID NO: 86711 - RNA, 64 nt, hsa
cacuccagccugggugacagagugagacucugucucaaaaaaaaauuaaauaaauuauuauaac

SEQ ID NO: 86712 - RNA, 64 nt, hsa
cacuccagccugggcaacagagcaagacucugccucaaaaaaaaauuaaaauaaauuuaaauac

SEQ ID NO: 86713 - RNA, 64 nt, hsa
agcugaaccagugucuuuacauuucauuuguacuucaaaaaauaugcuauuguuuagacuuucc

SEQ ID NO: 86714 - RNA, 64 nt, hsa
aguauauuaagacaugcugauggaaacaguaucuucaaaaaaaucagcagcaauugaaaugcua

SEQ ID NO: 86715 - RNA, 64 nt, hsa
aaaugacacaaaugacugggcuaaaucuacuguuucaaaaaagugucuuuacaaaaaaacaaaa

SEQ ID NO: 86716 - RNA, 64 nt, hsa
cuaaaacauuuacagaguuacaaaaaacaaacaaucaaaaaaaaagacaguuuauuaaaaauga

SEQ ID NO: 86717 - RNA, 64 nt, hsa
acuccagccuggggugauagaacaagacccugucucaaaaaaaaaaaaaacaacaaaaacuuag

SEQ ID NO: 86718 - RNA, 64 nt, hsa
uacuccagccugggcgacagagcaagacuccauuucaaaaaaaaaaaaaaaauccacucauaua

SEQ ID NO: 86719 - RNA, 64 nt, hsa
cacugaagccuggaugacagagugagaccuuaucucaaaaaaaaaaaaaaaaagagagagagag

SEQ ID NO: 86720 - RNA, 64 nt, hsa
cacuccagccugggcaacagagggagacuccaucucaaaaaaaaaaaaagucacuuuuggcuaa

SEQ ID NO: 86721 - RNA, 64 nt, hsa
gcugcugcuguuuucuucauuuuauguuaaugacucaaaaaagguauuuuuauagaauuuuugu

SEQ ID NO: 86722 - RNA, 64 nt, hsa
cgucaacccacugccucccaccccgaccccagcaucaaaaaaccaaugauuuugcugcagacuu

SEQ ID NO: 86723 - RNA, 64 nt, hsa
cacuccagccuggguaacagagugagacuccaucucaaaaaaaaaaaaaauagauauuuuucca

SEQ ID NO: 86724 - RNA, 64 nt, hsa
guacagcuauuguggaaaacaguguagagguuucucaaaaaauuaaaacuaucauacaacccag

SEQ ID NO: 86725 - RNA, 64 nt, hsa
guugaauauuugucugaacauuuuauuucaaaguucaaaaaaacagaggcugcaaaauucauuu

SEQ ID NO: 86726 - RNA, 64 nt, hsa
ggauuuuauuuuaaugugacuagaugucaccacuucaaaaaaucaauuuguucuuagaaccugg

SEQ ID NO: 86727 - RNA, 64 nt, hsa
uuccuuguaauuauacuuaagaucuucaauuucuucaaaaaaugaaggaucaaaauuuuccagu

SEQ ID NO: 86728 - RNA, 64 nt, hsa
gggaacuauaaccuuaggauuccugaaaagaauuucaaaaaaaaaauaaagacacuguugccaa

SEQ ID NO: 86729 - RNA, 64 nt, hsa
cacuccagccggggugacagagcgaaccucugucucaaaaaaaaaaaaagaaaaaagaaagaaa

SEQ ID NO: 86730 - RNA, 64 nt, hsa
uacuccagcuugggcaacagaguaagacucugucucaaaaaaaaaaaaacaaaaacaaacaaac

SEQ ID NO: 86731 - RNA, 64 nt, hsa
guuucuguaaauuauuuagcagccuuaaaguuuaucaaaaaauuguccagauuccacgugcagc

SEQ ID NO: 86732 - RNA, 64 nt, hsa
ucugaauuuaaggaaauucuuuaggauaaccauuucaaaaaauaaaauugcuaugcaaucuuga

SEQ ID NO: 86733 - RNA, 64 nt, hsa
cacuccagccugggcgacagagcaagacucugucucaaaaaaaaaaaauaauaauaaaauaagu

SEQ ID NO: 86734 - RNA, 64 nt, hsa
auuccagccugggcaacaaaagcgaaacucugucucaaaaaagaaaaaaaagaaaaaaaagcac

SEQ ID NO: 86735 - RNA, 64 nt, hsa
acuccagccugggcaacaagagcgaaacucugucucaaaaaaaaaaaaaagagguggguggauu

SEQ ID NO: 86736 - RNA, 64 nt, hsa
ccaggcuacacacagaaaauguuuacucaaucauucaaaaaagagaaaaggagagaaaguaacu

SEQ ID NO: 86737 - RNA, 64 nt, hsa
guuaaaaaaaaaaaaagauacaaagaaauaugucucaaaaaacuauuggaccuaaauaauuaga

SEQ ID NO: 86738 - RNA, 64 nt, hsa
caugccgcugcacuccagccugggagacugcaucucaaaaaagaaaaauaaacgaaguaaaaga

SEQ ID NO: 86739 - RNA, 64 nt, hsa
ucuccagccugcaugacgggagugagacaccaucucaaaaaauacauauaauaauauaaauaaa

SEQ ID NO: 86740 - RNA, 64 nt, hsa
uaaaagguuauauucuaguugugucaccaaaucaucaaaaaaccuuaaaaaagaaguaacuugc

SEQ ID NO: 86741 - RNA, 64 nt, hsa
cacuccagccuggaugacagagugagacuccgucucaaaaaaaaaaaaaaaaaaaaaaggaaaa

SEQ ID NO: 86742 - RNA, 64 nt, hsa
aaguuuacuguuucuucuguucuucuagcaucucucaaaaaauucacaguacuccauuuugggg

SEQ ID NO: 86743 - RNA, 64 nt, hsa
auaauuucauuuucuuggccaaagccaaaaggaaucaaaaaauccuuggagugcuugccuuucc

SEQ ID NO: 86744 - RNA, 64 nt, hsa
ugcacuccagccugggugacagaacaagacugucucaaaaaaaaaaaaagagaagaaaaacugc

SEQ ID NO: 86745 - RNA, 64 nt, hsa
augggucagugacacugaaacaguagaguaggagucaaaaaaccuuuucugugaagugcuagaa

SEQ ID NO: 86746 - RNA, 64 nt, hsa
cuggguuaagcuaccaaaaaugacaaccagggauucaaaaaaaauuuuuggucauuaaaucgaa

SEQ ID NO: 86747 - RNA, 64 nt, hsa
cugcagccugagagagagagagccagaccuugucucaaaaaauaaaaaauaaaaaaauaaaaac

SEQ ID NO: 86748 - RNA, 64 nt, hsa
uauguaugcauucaccuugccucuugcacaaaugucaaaaaaaagaugguaauaucucaaagaa

SEQ ID NO: 86749 - RNA, 64 nt, hsa
aauguuuuucaaccagcaccuaaaaagacucuuuucaaaaaaucacagaaacaaccuaggacaa

SEQ ID NO: 86750 - RNA, 64 nt, hsa
acuccagccugggcgacaagagugaaacuccaccucaaaaaaaaaaaaaaaagaguuaaucuag

SEQ ID NO: 86751 - RNA, 64 nt, hsa
gcacuccagccuggugacagagugagacuccgucucaaaaaaaaaaaaaaaaacucagcuucuu

SEQ ID NO: 86752 - RNA, 64 nt, hsa
agaucuguucaauuauuuuucagaaacuaaauuuucaaaaaauuaauauguguacaauuaaaau

SEQ ID NO: 86753 - RNA, 64 nt, hsa
aaaguacauuaugcuuuuuaauggaacuaaaugaucaaaaaaagaauggacuguaaccaguugc

SEQ ID NO: 86754 - RNA, 64 nt, hsa
cacuccagucggguuaacagagcaagacacugucucaaaaaaaaaaaaaaaaaaaaguaucaac

SEQ ID NO: 86755 - RNA, 64 nt, hsa
uauugaaugagugaaccagaaaauuagaagauggucaaaaaaaguccaaguuaccaauuuuuua

SEQ ID NO: 86756 - RNA, 64 nt, hsa
ugcacuccagccuggcgacagagcaaggcuccacucaaaaaaaagauuuaaaggggaaaaaauu

SEQ ID NO: 86757 - RNA, 64 nt, hsa
ugcacaucagccugagugacagagagacuuugucucaaaaaaaaaagaaaauuuuaauuuuaau

SEQ ID NO: 86758 - RNA, 64 nt, hsa
agcguuuuucccaggcagauaacauugcacagcuucaaaaaaacauugugacccuugccagaaa

SEQ ID NO: 86759 - RNA, 64 nt, hsa
acuccauccuggacaacaggagugaaacuccgucucaaaaaaaaaaaagaaaaaaaagaaguac

SEQ ID NO: 86760 - RNA, 64 nt, hsa
cacuccagccugggcgacagagugagacuccgucucaaaaaaaaaaagaagguuguacccacag

SEQ ID NO: 86761 - RNA, 64 nt, hsa
cacuccagccugggcaacacagggagacuccaucucaaaaaaaaaaaaaaaaaaaaaaagacau

SEQ ID NO: 86762 - RNA, 64 nt, hsa
cacuccagccugggcgauagagcuagacucugucucaaaaaaaaaacaaaaaacaaguaacucu

SEQ ID NO: 86763 - RNA, 64 nt, hsa
cacuccagccugggugacagagcgagacuccgucucaaaaaaaaaaaaaaauucggccaggugc

SEQ ID NO: 86764 - RNA, 64 nt, hsa
cacuccagccugggcgacugaauaaaacucugucucaaaaaaaaacaaaaacgguaagcuuuua

SEQ ID NO: 86765 - RNA, 64 nt, hsa
uuuacuaaaaugauauaggguuuauuuuauauuuucaaaaaaauuguuaaacaucauucuuauc

SEQ ID NO: 86766 - RNA, 64 nt, hsa
cacuccagccugggcgacagggcaagacucugucucaaaaaaaauaaaaaacugaccaucuagu

SEQ ID NO: 86767 - RNA, 64 nt, hsa
aauacucauuuuuuaaguguaauuaaguugaagaucaaaaaauggaaauguauaauuaaaucau

SEQ ID NO: 86768 - RNA, 64 nt, hsa
acuucacaauuauaauaaauguguggaaaagucuucaaaaaaauuucacaccuugcaaaaggag

SEQ ID NO: 86769 - RNA, 64 nt, hsa
ucugcccaaaggcuccuagaucugauaaacaacuucaaaaaaguuucaggauacaaaaucugug

SEQ ID NO: 86770 - RNA, 64 nt, hsa
cacuucagccugggugacagaaugagacucugugucaaaaaaauaaaaaauaaaaaaucuaagg

SEQ ID NO: 86771 - RNA, 64 nt, hsa
uacgccaaccugggucacauagcaagacucuguuucaaaaaaaaagggggggcgggggacgggu

SEQ ID NO: 86772 - RNA, 64 nt, hsa
aguagauuuuucaauguuuuacagaauuacauuuucaaaaaaagguuuuuauaaugaaguuguu

SEQ ID NO: 86773 - RNA, 64 nt, hsa
ccccaugaaggcagcugagcuuucagagcuggguucaaaaaaaaaaauuccagugucuguauac

SEQ ID NO: 86774 - RNA, 64 nt, hsa
acuccagccugggcaacaagagcaaaauucugccucaaaaaaaaaaauaguaauaauacaaaaa

SEQ ID NO: 86775 - RNA, 64 nt, hsa
cacucaagcuuggaugacagagcaagacuccguuucaaaaaaaaaaaaccuccucucuuccuuc

SEQ ID NO: 86776 - RNA, 64 nt, hsa
uuuaaaaaaacaaaaaacaaaaaaaaucaaaaaaucaaaaaaauaauaaacuucauuuuaaccu

SEQ ID NO: 86777 - RNA, 64 nt, hsa
caguuuuauuuaaaaaaacaaaaaacaaaaaaaaucaaaaaaucaaaaaaauaauaaacuucau

SEQ ID NO: 86778 - RNA, 64 nt, hsa
auaauugguucuggcaaguuuggccagacugacuucaaaaaauuaauguguauccagggacauu

SEQ ID NO: 86779 - RNA, 64 nt, hsa
uguacuccagccugggcaacagcgagacuccaucucaaaaaaaaaggaaauguguaucaagaac

SEQ ID NO: 86780 - RNA, 64 nt, hsa
agugcuuccaguagauuuuagaacauucuuugccucaaaaaaccugcaaagaugaugugagauu

SEQ ID NO: 86781 - RNA, 64 nt, hsa
ccuacaacugcaaaacgucuuacugaaccaacaaucaaaaaaugguucuguuuuaaaaaggauu

SEQ ID NO: 86782 - RNA, 64 nt, hsa
ugcacuccagccugggcaacagugaaacuccaucucaaaaaauaaauaaauaaaauaaauucuu

SEQ ID NO: 86783 - RNA, 64 nt, hsa
uaaaaaaaaaacaaaaacaaaaaaaccuuaaaugucaaaaaaaaauaauauuuucaccauccag

SEQ ID NO: 86784 - RNA, 64 nt, hsa
gcacuccagccuggcaacagagcgagacuccaucucaaaaaaaaaaaaaaaaguaagaaagaaa

SEQ ID NO: 86785 - RNA, 64 nt, hsa
cgcuccagccugagugauagagugagacucugucucaaaaaaaaguaucucuaaauacaggauu

SEQ ID NO: 86786 - RNA, 64 nt, hsa
auuaauguaauuccucuggauaaagauaauauauucaaaaaauauugggaccaaaaaaugcacu

SEQ ID NO: 86787 - RNA, 64 nt, hsa
cauauuuuucaaaugaagaagcaacacauaaguuucaaaaaauauccaggguacuccuggacag

SEQ ID NO: 86788 - RNA, 64 nt, hsa
aagcaccaucugaaaggggcaccauuuucuucuucccuuugaucucacauaugcucccuaaaaa

SEQ ID NO: 86789 - RNA, 64 nt, hsa
uuuuuauguaaauuuguaauacuuuccuauauugcccuuugaaauuuuuggauaaaagaugaug

SEQ ID NO: 86790 - RNA, 64 nt, hsa
uuuuguuuuucauucagucuuacgaauacuuuugcccuuugauuaaagacuccaguuaaaaaaa

SEQ ID NO: 86791 - RNA, 64 nt, hsa
ugugcagccgcugagcgaggagaugcuccuugggcccuuugagugcaguccugaucagagccgu

SEQ ID NO: 86792 - RNA, 64 nt, hsa
aaauugacagcagugacuugaaaaugauucugcucccuuugaaagcauucauuuugcuagaacu

SEQ ID NO: 86793 - RNA, 64 nt, hsa
ugcuguauugaaaguaggaauauaguuuuaaaaacccuuugaacaaagugugugcauaaccagu

SEQ ID NO: 86794 - RNA, 64 nt, hsa
ucaccauuaggcaggguguuugacugaagaaagacccuuugaagguaacaaguuaagaaaauuu

SEQ ID NO: 86795 - RNA, 64 nt, hsa
uaaaagaugcaaacauuacaaaaaggcaaauguacccuuugaccauaucccaaaggauagucuu

SEQ ID NO: 86796 - RNA, 64 nt, hsa
uauuuaaaaacgagaaauacaacauuuaaaaaauuaagaguauuuugcauuagugauuaugauu

SEQ ID NO: 86797 - RNA, 64 nt, hsa
uucuaaaaguuaaccuugugggcuguugccaaaauaagaguauuuagaggacacugauuaguug

SEQ ID NO: 86798 - RNA, 64 nt, hsa
acuguaauggccucaagauagagagauacccuuauaagaguaaagaauuaagaugauagucaac

SEQ ID NO: 86799 - RNA, 64 nt, hsa
caacacuggaaaugaguucuggguaagugaguuauaagaguacaugcucuaguaacucugguag

SEQ ID NO: 86800 - RNA, 64 nt, hsa
aaagggcccugguaaaauaguggaucucaguuuuuaagaguacaagcucuuguuucuguuuagu

SEQ ID NO: 86801 - RNA, 64 nt, hsa
aaguuuccuuuuaauucuaccaaccccagauaaguaagaguacuauuaauagaacacagagugu

SEQ ID NO: 86802 - RNA, 64 nt, hsa
caucccccccucaggcuugaaaguccucaaagagacccacuaucccauaucacugcccagaggg

SEQ ID NO: 86803 - RNA, 64 nt, hsa
aaugacuucuuugcuauuuugguuuugcaaaaagacccacuaucaaggaaugcugcaugugcua

SEQ ID NO: 86804 - RNA, 64 nt, hsa
ggaggcccuuuacauagaaaacagcauucuuuuugccaaauaugaccaaauuacuuuuauuuau

SEQ ID NO: 86805 - RNA, 64 nt, hsa
ccuuggucuugaauuuccuagccucuacaacuaagccaaauaaauuucuguuuauuauaaauaa

SEQ ID NO: 86806 - RNA, 64 nt, hsa
uggacuucauagacacaaaggcuucgaagcacaagccaaauaugucaauauuuguauguaagaa

SEQ ID NO: 86807 - RNA, 64 nt, hsa
auacaggcucauuuucaugcaaauucuuccuagagccaaauaaauaaagacuuaggugaauuag

SEQ ID NO: 86808 - RNA, 64 nt, hsa
cuaaucucagauuggcaguuaaagucaaaauguugccaaauauuuauuccuuuugccuaaguuu

SEQ ID NO: 86809 - RNA, 64 nt, hsa
gaagcuaucuuaaaucugugaugugucaggugcagccaaauaucacaccuucugaucuuagcca

SEQ ID NO: 86810 - RNA, 64 nt, hsa
caugcuuccuauacaguucuaugcagaacagugagccaaauaaaccucuuuucuuucuaaaaau

SEQ ID NO: 86811 - RNA, 64 nt, hsa
aaugguuuuuaaguacuuggaaaaggagguaaucgccaaauaguuccauuuuuuuuuuuuuuuu

SEQ ID NO: 86812 - RNA, 64 nt, hsa
gggaaaacaagaggccaaauauaguaauggaggugccaaauaauuaugugcacuuugcacuaga

SEQ ID NO: 86813 - RNA, 64 nt, hsa
uuuaggcacagcuauuuauaggggaaaacaagaggccaaauauaguaauggaggugccaaauaa

SEQ ID NO: 86814 - RNA, 64 nt, hsa
ggucucugccccaggcauggugcucuauaucuuggccaaauaaauuacuuuccuugaauaucca

SEQ ID NO: 86815 - RNA, 64 nt, hsa
aagcaagaguauuuggagcaagaagcugcaaugcgccaaauacacaauaggccuuuucuuuauc

SEQ ID NO: 86816 - RNA, 64 nt, hsa
gguaucuucugaauguucaagagcauccuauagugccaaauaauaaagcaccauuuuuuucuuc

SEQ ID NO: 86817 - RNA, 64 nt, hsa
guacuuuugagcuacuauuauuugaaaaaaaucugccaaauagcaucuuuaggauauauuuaca

SEQ ID NO: 86818 - RNA, 64 nt, hsa
uugucuuugauacauuuauuuuaauucuuaaguggccaaauaacagauuagguaaaaugagauu

SEQ ID NO: 86819 - RNA, 64 nt, hsa
guuaaauauuguagauaaauugcuaauacuaauagccaaauagauaacacuaaugcuuuguuua

SEQ ID NO: 86820 - RNA, 64 nt, hsa
auacggaacgacucacuuaauaaccagggaaccagccaaauacugugcagccgcagaauaugca

SEQ ID NO: 86821 - RNA, 64 nt, hsa
ucauuaaucuaaagacagaguucaaaggaauugggccaaauauauucucaguauuuggaacuaa

SEQ ID NO: 86822 - RNA, 64 nt, hsa
ggccuuccuuacuuaaugucuucuuuucccuacucuaaugcauuucuaacucacuuuggagcuu

SEQ ID NO: 86823 - RNA, 64 nt, hsa
ucgaaacugccaagggugcuggugcggauggacacuaaugcagccacgauuggagaauacuuug

SEQ ID NO: 86824 - RNA, 64 nt, hsa
cugaagaucaugcuauauuuuauauaugaagccccuaaugcaaagcucuuuaccucuugcuauu

SEQ ID NO: 86825 - RNA, 64 nt, hsa
uuguuuucuccuugcuuuaagcagugaaguuauccuaaugcaaaagagcuuaguagaaaaugag

SEQ ID NO: 86826 - RNA, 64 nt, hsa
uguguggacaucaguaggcaaguaaccaguuuuacuaaugcauucaucgcucaucuucauugcu

SEQ ID NO: 86827 - RNA, 64 nt, hsa
cucagaccgaaggugcugccuucauccuccccaccuaaugcauuuuugaaaccaaagguaccua

SEQ ID NO: 86828 - RNA, 64 nt, hsa
uguuuuuuuuuuucuuuuucuuuuuuccuguuuucuaaugcaggcccaaugugacaaauuuguu

SEQ ID NO: 86829 - RNA, 64 nt, hsa
gagucccucuaguggccauuuuguaugguaguugcuaaugcagaacaaguucugucuugggcuu

SEQ ID NO: 86830 - RNA, 64 nt, hsa
gacgguagcuuuuggaggaagauuccugcagccacuaaugcauuguguaugauaacaaaaacuc

SEQ ID NO: 86831 - RNA, 64 nt, hsa
ugaaaccuauuaccguacucacagcucaauggaacuaaugcagauguugcauaauagccugcau

SEQ ID NO: 86832 - RNA, 64 nt, hsa
guuuucaguguugcugagagaaacaaaaaauuuccuaaugcaucugagagauaagcuucggcag

SEQ ID NO: 86833 - RNA, 64 nt, hsa
uaauuguuuuuacaaagaauccaccugacuuccccuaaugcauuaaaaauauuuuuauuuaaau

SEQ ID NO: 86834 - RNA, 64 nt, hsa
aguggggagagguugggcagugagugagggaccccuaaugcagggacuagaagccucaguuucc

SEQ ID NO: 86835 - RNA, 64 nt, hsa
cuuuccaaacacugaaggauuuauuucaaacucucuaaugcaccugccucagagauuccccuac

SEQ ID NO: 86836 - RNA, 64 nt, hsa
guuuaccuuaccccacacccccucaacauguagacuaaugcagccauuggugguacauuuauuu

SEQ ID NO: 86837 - RNA, 64 nt, hsa
ggggaaaauaaacuuaacucuacaaaagcaaacucuaaugcaugcaagaaucauuagguuggca

SEQ ID NO: 86838 - RNA, 64 nt, hsa
ggaaauuggacaguuuugauacaaacuuuguuugcuaaugcacugaugagucuaguuucauuau

SEQ ID NO: 86839 - RNA, 64 nt, hsa
ggguucagucucaugccauauuuacuccuaguaccuaaugcagugccuggcacacagcaagugc

SEQ ID NO: 86840 - RNA, 64 nt, hsa
acugucaugcagauaguauaauuugguauaugugcuaaugcauugaguagaggauuauuuuaac

SEQ ID NO: 86841 - RNA, 64 nt, hsa
aaauauuguacaguauugucauguacaagcguaccuaaugcacacuuuaucuuuuauuguacaa

SEQ ID NO: 86842 - RNA, 64 nt, hsa
cucaauccguugcaugaaauaauuacuaugugcccuaaugcacacaaauagcuaaggagaaucc

SEQ ID NO: 86843 - RNA, 64 nt, hsa
gaggcaaauucgauuugaacauauacuuguaauucuaaugcaaaauuauacaauuuuuccugua

SEQ ID NO: 86844 - RNA, 64 nt, hsa
uuugaaguuuucuagauugucacaugcuuugugacuaaugcaagaaagcaaguccuguguugua

SEQ ID NO: 86845 - RNA, 64 nt, hsa
cuugcuugcuguucuuuugggucaaaggagcaggcuaaugcaaagcuuuuggagacugcuaagu

SEQ ID NO: 86846 - RNA, 64 nt, hsa
cgucgggcuagguuauccaugaguuucuuuauuccuaaugcaguuagaaagaccuuucuccuug

SEQ ID NO: 86847 - RNA, 64 nt, hsa
guaucauucauuaaacauaguuuaaaggcuaucacuaaugcauguuaauauugccuaugcugcu

SEQ ID NO: 86848 - RNA, 64 nt, hsa
cauuuguaaugaugcuacauaauuuuguggcucccuaaugcaauaauguacagaagauaaaaaa

SEQ ID NO: 86849 - RNA, 64 nt, hsa
ggaaauuucauuucaaauauguuuuaauguaucucuaaugcauuugaagacuuauuacauggcu

SEQ ID NO: 86850 - RNA, 64 nt, hsa
uaccugccugagccaccucagggaaucuuccagccuaaugcaggcauuucugcaccuuuggggu

SEQ ID NO: 86851 - RNA, 64 nt, hsa
uucuuccccagaaauaguaaacuugcagcugccccuaaugcagcauauuuuucuuaccaaagga

SEQ ID NO: 86852 - RNA, 64 nt, hsa
gagguauuacaaguugcuaguuuauaaugucuuacuaaugcagaaacaaggaaaaaagcaaaau

SEQ ID NO: 86853 - RNA, 64 nt, hsa
uggcaauuggaaaucuuauaaaaacuagucaagccuaaugcaacuggcuaaaggauaguaccac

SEQ ID NO: 86854 - RNA, 64 nt, hsa
augguuucaacuaguagguaaucugcuuauauuucuaaugcaaacuuaacaauuguguacuuuu

SEQ ID NO: 86855 - RNA, 64 nt, hsa
cuguaaagaugucuaggacgaaauauuuuaugugcuaaugcauguauuuguaaaccagauuugu

SEQ ID NO: 86856 - RNA, 64 nt, hsa
auuggccacacacugaguugcacauauugagaaccuaaugcacucugggucuggccagggcuuc

SEQ ID NO: 86857 - RNA, 64 nt, hsa
caguauccugcugguucacucuaauuggucauuccuaaugcauuagauuaucaaaaaguauaaa

SEQ ID NO: 86858 - RNA, 64 nt, hsa
ggcucucaaaguauaaucuuucuauagccaacugcuaaugcaaauuaaaacauauuucauuuua

SEQ ID NO: 86859 - RNA, 64 nt, hsa
augcuuugaagguucugauuuucaacugaucaaacuaaugcaaaaaaaaaaaaguauguauucu

SEQ ID NO: 86860 - RNA, 64 nt, hsa
cucagcuucuucaccaucaacaggaggauuacaucuaaugcaggcaaucaucuauuacagaugc

SEQ ID NO: 86861 - RNA, 64 nt, hsa
aacucuuuuugucacaguuagagaaugagguugacuaaugcauauuaugaauugaguccacaaa

SEQ ID NO: 86862 - RNA, 64 nt, hsa
ucugauaaggcucagcugcuuuauaguucucuggcuaaugcagcagauacucuuccugccagug

SEQ ID NO: 86863 - RNA, 64 nt, hsa
gaaaauaaguccagaagcacuggacuaaagagugcuaaugcaggaaauaauacacauaauuuuu

SEQ ID NO: 86864 - RNA, 64 nt, hsa
acacuauaauaaacugugaacauauuuuuguuaccuaaugcauccacugaugaacaugcaaacu

SEQ ID NO: 86865 - RNA, 64 nt, hsa
aaaacagaaaagguucugaauaaugaagauuaaccuaaugcagaauugcuagguaaagagguca

SEQ ID NO: 86866 - RNA, 64 nt, hsa
guuuuguucaaucggguuucuuuucuuuuugccucuaaugcagaaaucaacagaaucacucaca

SEQ ID NO: 86867 - RNA, 64 nt, hsa
guagacccugguguuuucuuugaagugcccucuccuaaugcagaggccuugaagcuuacaguau

SEQ ID NO: 86868 - RNA, 64 nt, hsa
gaacugcagaaguuuuuuuaaugccacuuuaacacuaaugcacugacagauucuaaauauuuug

SEQ ID NO: 86869 - RNA, 64 nt, hsa
auguuuauguugugagcauguagaaacaguaaugcuaaugcauggcuaguugccuuuuuaagau

SEQ ID NO: 86870 - RNA, 64 nt, hsa
augguuuugcaacuguaauaguagcuguaucguucuaaugcagacauuggauuuggugacuguc

SEQ ID NO: 86871 - RNA, 64 nt, hsa
aacuacuuggcauguaagaaauagcgucaguguccuaaugcauauugugacuguuugcauauac

SEQ ID NO: 86872 - RNA, 64 nt, hsa
uacuaguaccauuaucuucuuuugccuaaaauuacuaaugcaccacgucagucugcuuccuuca

SEQ ID NO: 86873 - RNA, 64 nt, hsa
aacgacuuggcauguaagaaauagcgucaguguccuaaugcauauugugacuguuugcauauac

SEQ ID NO: 86874 - RNA, 64 nt, hsa
auccccauucuuucucuuugaaaaaaaaaaaggccuaaugcauuauuuugucauaaaaugcuau

SEQ ID NO: 86875 - RNA, 64 nt, hsa
ccacuucacaaaguuuguguggggauuaaaugagcuaaugcagauucauucauucagaaaaauu

SEQ ID NO: 86876 - RNA, 64 nt, hsa
uugcagaaaaggcucaauauccaagagacagggacuaaugcacuguacaaucugcuuauccuug

SEQ ID NO: 86877 - RNA, 64 nt, hsa
aaauuacaugucagugcaucacauauaucaugaucuaaugcagaugacuaggcuuuuuccaaaa

SEQ ID NO: 86878 - RNA, 64 nt, hsa
ucuuaaaccacaccgaggugucuaauuucaaccccuaaugcauuuaagaagcugauaaaaucug

SEQ ID NO: 86879 - RNA, 64 nt, hsa
uuuacauugaauuugacccuacaucacuucaagacuaaugcauaauauuaaacaucauguugaa

SEQ ID NO: 86880 - RNA, 64 nt, hsa
ucucaguucccaccaguaaaauuauccugaguagcuaaugcaccuugagaaaaaucuggcauac

SEQ ID NO: 86881 - RNA, 64 nt, hsa
auguccacuugccuuccucuccgaggcaacuacucuaaugcauuugguauguaacuuuaaauuu

SEQ ID NO: 86882 - RNA, 64 nt, hsa
aagcaccccugguacucagcacacacaugcuuaccuaaugcaucacugugacaaaagccacacg

SEQ ID NO: 86883 - RNA, 64 nt, hsa
aucucaaggugaagaucuaaaugugaacaguuuacuaaugcacuacugaaguuuaaaucugugg

SEQ ID NO: 86884 - RNA, 64 nt, hsa
auggaugcaacuagaggcuauuauccuaagcaaccuaaugcaagaacagaaaaccacauacugc

SEQ ID NO: 86885 - RNA, 64 nt, hsa
aguaacuagaucggggaucuaguaugcuccuggucuaaugcauuuacauuguuuagguaacugg

SEQ ID NO: 86886 - RNA, 64 nt, hsa
cagaauuguggaguguuuuuacauugaucuuuugcuaaugcaauuagcauuauguuuugcaugu

SEQ ID NO: 86887 - RNA, 64 nt, hsa
ucuaugauuugaguucaguguuuaaggauucuaccuaaugcagauauauguauauaucuauaua

SEQ ID NO: 86888 - RNA, 64 nt, hsa
augguuucuauucuguguuuugaauuuuuauuuucuaaugcaguggaaaagaaacagaucaucc

SEQ ID NO: 86889 - RNA, 64 nt, hsa
gggagcagggcauaggaagaaaaugucaguagugcuaaugcauuuugcacuagaacgcuucggg

SEQ ID NO: 86890 - RNA, 64 nt, hsa
gguucuuaguguucacaacuuccauaagauacugcuaaugcaccaguauuaaaacacaucgacg

SEQ ID NO: 86891 - RNA, 64 nt, hsa
ucugggguagagaagccgagagacccuguccucccuaaugcacuguggcccaguccccuugccu

SEQ ID NO: 86892 - RNA, 64 nt, hsa
aggaucuggcaucauacaaaaugaagccagaccacuaaugcauuacaguaguucuugaauacaa

SEQ ID NO: 86893 - RNA, 64 nt, hsa
cuuagaacguggguauuuuuuuucuugagaaaagcuaaugcaccuacagauggcccccaacauu

SEQ ID NO: 86894 - RNA, 64 nt, hsa
acguagcuuuuccgucuucaccccaaauaaaguccuaaugcaucagccucagcuguuucucuua

SEQ ID NO: 86895 - RNA, 64 nt, hsa
uuuucugcuuauaaaugcuaucauuaugaaaaggcuaaugcagcucuuucuguucuuacuuuuu

SEQ ID NO: 86896 - RNA, 64 nt, hsa
agggcugucuucagugcuuuaaugguuuuguuuucuaaugcaauaaaucgccaggauuuccaaa

SEQ ID NO: 86897 - RNA, 64 nt, hsa
gauucugcaaaccuaacagggucacauauguucucuaaugcaguccuucuaccugguguuuacu

SEQ ID NO: 86898 - RNA, 64 nt, hsa
uucuuuugcuuugaugauuuuugcaacuugauagcuaaugcaccuuuucugugaggaggagggg

SEQ ID NO: 86899 - RNA, 64 nt, hsa
aauuggucuuaauuuauauaaucaauauaaaauacuaaugcaauucuacagcauucaaaugaag

SEQ ID NO: 86900 - RNA, 64 nt, hsa
uaaacauaaaaugucauucaggguuuccugacugcuaaugcagaaaggaaaaucguaaaggaaa

SEQ ID NO: 86901 - RNA, 64 nt, hsa
gauuuugauacuaaacugugcguuguacauaguucuaaugcauuguauugaccaccaguacuuc

SEQ ID NO: 86902 - RNA, 64 nt, hsa
ugucucccauaagaaaugugcuuuuuagagcuuccuaaugcauguguugcauuauugcagcauu

SEQ ID NO: 86903 - RNA, 64 nt, hsa
cauagcagccuuccucucacuacuuuccuggcaucuaaugcaacaaacuuaucacacacacaca

SEQ ID NO: 86904 - RNA, 64 nt, hsa
gaaacagagguaaaaaaaagaagugugcgcccggcuaaugcagcgguguggaccgaggaacaac

SEQ ID NO: 86905 - RNA, 64 nt, hsa
aucuguuuuucuccuacuuugguaggugaagaaacuaaugcaaauaauucuuaugugcacuaaa

SEQ ID NO: 86906 - RNA, 64 nt, hsa
cugucugcucaaugccauugugcagagaagcacccuaaugcauaagcuuuuuaaugcuguaaaa

SEQ ID NO: 86907 - RNA, 64 nt, hsa
uuuggagaggggagagguggaaauuccuaaauggcuaaugcacuguucccuccagcccgaaugc

SEQ ID NO: 86908 - RNA, 64 nt, hsa
guccuuucuuauggacucgcaggauuuuagaacccuaaugcacccuggaggguagcugggccag

SEQ ID NO: 86909 - RNA, 64 nt, hsa
aaaacugguucaucauggaaaugauucucauugacuaaugcaucaucucacacuuucaugaguu

SEQ ID NO: 86910 - RNA, 64 nt, hsa
ugaccauugggagcaaagccauguucacacugaccuaaugcagaguauggaagcauugggcugg

SEQ ID NO: 86911 - RNA, 64 nt, hsa
uguacuuuuugaacauaagcugcacuuuuauuuucuaaugcagaggaugaauaaguuaaauaca

SEQ ID NO: 86912 - RNA, 64 nt, hsa
gcgggacggcggugcuaggucaaucuuaacgugacuaaugcacagaggguaggagucuagccga

SEQ ID NO: 86913 - RNA, 64 nt, hsa
acccaguuuugaaaccaaaaaagaaaccuagaaucuaaugcagaagagaucuuuuaaaaaauaa

SEQ ID NO: 86914 - RNA, 64 nt, hsa
agagggaauaaucugagcaaagguaugaaacagccuaaugcauuagagaaaaaaguucuuuuag

SEQ ID NO: 86915 - RNA, 64 nt, hsa
acaaaggcuugcaaagauaggagaggcuccaucucuaaugcauguagaagcuccuuacgggugc

SEQ ID NO: 86916 - RNA, 64 nt, hsa
gcuaagagagguuuccgaaggguuuugcuacauucuaaugcauguauucggguuaggggaaugg

SEQ ID NO: 86917 - RNA, 64 nt, hsa
ucuccauuuuugccuuggugcucaucuuaauggccuaaugcacccccaaacauggaaauaucac

SEQ ID NO: 86918 - RNA, 64 nt, hsa
uuucuggaagguuaugacacuuuacuguuuacagcuaaugcauaguuacuugcaugccaugguu

SEQ ID NO: 86919 - RNA, 64 nt, hsa
cuccuccuuuaacugagucaucaucuuaguccaacuaaugcagucgauacaaugcguagauaga

SEQ ID NO: 86920 - RNA, 64 nt, hsa
ccacugcuuuucagcauuguacuggaagugcuaucuaaugcagugauaccaaaaaaaaaggaaa

SEQ ID NO: 86921 - RNA, 64 nt, hsa
ugauuuuuguaauuggagguuuauauugucuugccuaaugcauauucucuuuuuuuuuuuuuuu

SEQ ID NO: 86922 - RNA, 64 nt, hsa
ggggcuggaggggcccccacaucucucagccccacuaaugcagaaucccacuacccgugagcua

SEQ ID NO: 86923 - RNA, 64 nt, hsa
uaccaagacaagcaggcuguucccuggaaaaaaucuaaugcaaggagggcuaguucacagcaaa

SEQ ID NO: 86924 - RNA, 64 nt, hsa
cccucuccaguccccucacaaucccagauggguucuaaugcagcugcuggggccugaugcccug

SEQ ID NO: 86925 - RNA, 64 nt, hsa
ccuucuucaugaaaccagggcccucuuccuucaucuaaugcagccacuccuaggugaagaagug

SEQ ID NO: 86926 - RNA, 64 nt, hsa
aacagcuugaggucccugaggggaguggcaagcccuaaugcaacucacccucauccuggugcuu

SEQ ID NO: 86927 - RNA, 64 nt, hsa
gaaggucuccacucuccucugggcuccuccuugccuaaugcagggggucaccgcuggagaagaa

SEQ ID NO: 86928 - RNA, 64 nt, hsa
gucauuaugacuuauacuaauuccuagugaaggccuaaugcacuuguaaaacaggauuuucuag

SEQ ID NO: 86929 - RNA, 64 nt, hsa
guugagccugucugaauuugggcccccuuucugacuaaugcaguuuugcacaagguagaaguua

SEQ ID NO: 86930 - RNA, 64 nt, hsa
ccaucauacgcaugguccuggaggaugaccaggacuaaugcaugugguaugaguagguuuggcc

SEQ ID NO: 86931 - RNA, 64 nt, hsa
ggcaugcuugacuauuucuuauuucaaaugucugcuaaugcagaguaggcuacuccaugauagu

SEQ ID NO: 86932 - RNA, 64 nt, hsa
gaaaggaaauggcauugcugcuuucaaccagcgacuaaugcaauccauuccucucuuguuuaua

SEQ ID NO: 86933 - RNA, 64 nt, hsa; identical to SEQ ID NO: 86932

SEQ ID NO: 86934 - RNA, 64 nt, hsa
aagccagaguugcuucucuuacaaccuuacggcgcuaaugcauuaaguugaagucgacugccaa

SEQ ID NO: 86935 - RNA, 64 nt, hsa
auggguauaaaaacaaauuuguggcauuuuuagucuaaugcauguuuucauccacuauccagua

SEQ ID NO: 86936 - RNA, 64 nt, hsa
agccaccgcccccagccugagccuuuuuuuuuuucuaaugcauccaagguuaaggggaagacgc

SEQ ID NO: 86937 - RNA, 64 nt, hsa
augaacugccccccccacauuaauauaaaaacuacuaaugcacugauaugaaacacggcuuaca

SEQ ID NO: 86938 - RNA, 64 nt, hsa
agcaaaaucauuuugaguuaagccaguucuuagccuaaugcaaacugcagcgccuuuaagcaua

SEQ ID NO: 86939 - RNA, 64 nt, hsa
agggcuuaaccuauaugaacucuauuuaucaugucuaaugcaugugauuuaauguauguuuaau

SEQ ID NO: 86940 - RNA, 64 nt, hsa
ggguacuauuauuuccauuugacagaugaaaaaccuaaugcauagaaagauaaguagaccaguc

SEQ ID NO: 86941 - RNA, 64 nt, hsa
guuguccaagagcacacugaaaguugaauguuaucuaaugcauuccucuaccuuucagaagauc

SEQ ID NO: 86942 - RNA, 64 nt, hsa
augguggcuuguuucaugguuuuuguauuugugucuaaugcacguuuuaacaugauagacgcaa

SEQ ID NO: 86943 - RNA, 64 nt, hsa
uucuuguccacgguuuuguugaguuuucacucuucuaaugcaagggucucacacugugaaccac

SEQ ID NO: 86944 - RNA, 64 nt, hsa
auagaacccagggcucugaaacagcucuagccgccuaaugcacuucacagguaacuccccaagg

SEQ ID NO: 86945 - RNA, 64 nt, hsa
aauuuuaagguuuauaguucccucaacacaauugcuaaugcagaauaguguaaaaugcgcuuca

SEQ ID NO: 86946 - RNA, 64 nt, hsa
gucuuuuaagggcaucacaaauuaacauuuacuccuaaugcacgccuagaauguauuuuaaaua

SEQ ID NO: 86947 - RNA, 64 nt, hsa
cgguggccucaucaccagagcaucgccaggauuucuaaugcacucaguuucccuacauagcagg

SEQ ID NO: 86948 - RNA, 64 nt, hsa
auuuuacagcccuuggcuuguguuaucggacauucuaaugcauauuuauaagagaaguuuaaca

SEQ ID NO: 86949 - RNA, 64 nt, hsa
guguacguggaauuuuguguuucaguguuugaaccuaaugcaacagcaacaaagccacugauac

SEQ ID NO: 86950 - RNA, 64 nt, hsa
auguuucuaguuuuuugcuuuauugccuugcauucuaaugcaguuuguucuguaacucgagagc

SEQ ID NO: 86951 - RNA, 64 nt, hsa
guauaugcuuuaacaucaaauggaagucaaauuccuaaugcauagauagagagagcuaaacugu

SEQ ID NO: 86952 - RNA, 64 nt, hsa
cccucagacugucaggcaagcccggguucuaccccuaaugcaaauacccaccagggagaugucu

SEQ ID NO: 86953 - RNA, 64 nt, hsa
uuaauguguauuaaagggcuuacauggguauuagcuaaugcaguaguaugauuguuuuauuagc

SEQ ID NO: 86954 - RNA, 64 nt, hsa
ggaauacagcgauauaauuuugguugucaaauuccuaaugcaaccauuuagucuaaacuuaguc

SEQ ID NO: 86955 - RNA, 64 nt, hsa
aauguuccaaucuaaauaaaaaacuaauucauaacuaaugcauagaaaagauacauaaagcaau

SEQ ID NO: 86956 - RNA, 56 nt, hsa
uuuuuuuuuuuuuaagguaagaagaucuaaugcauccuauauccaguaaguagaau

SEQ ID NO: 86957 - RNA, 64 nt, hsa
augcagcagauaauuguucauaguggacugaaaacuaaugcaaggacuauggucucagugauaa

SEQ ID NO: 86958 - RNA, 64 nt, hsa
ccuuauacuaucuuuuuauuaucugagccuuuuccuaaugcagcucauaggugcuagcuagagc

SEQ ID NO: 86959 - RNA, 64 nt, hsa
acuaaaauauuccucuacuauuuuucaaugucaucuaaugcaaacgcucaaccuuuuuaaaugg

SEQ ID NO: 86960 - RNA, 64 nt, hsa
gaguuuuguuuagagcaguuaacaucugaagugucuaaugcauuaacuuuuguaagguacugaa

SEQ ID NO: 86961 - RNA, 64 nt, hsa
caugaagcuuaccgacuaguagggaagauagacucuaaugcaauaaucacauaaauauagcgag

SEQ ID NO: 86962 - RNA, 64 nt, hsa
cugcuuguucaaauacuguguguauuccuuuucucuaaugcagcucaucacuuggagcaguuuc

SEQ ID NO: 86963 - RNA, 64 nt, hsa
uaauaauguaacuuuguuaauaggugcauaaacacuaaugcagucaauuugaacaaaagaagug

SEQ ID NO: 86964 - RNA, 64 nt, hsa
uuugaaggaagcacaugugcaccuuuccuuuacacuaaugcacuuaggauguuucugcaucaug

SEQ ID NO: 86965 - RNA, 64 nt, hsa
uuuccuuaaugaaaaauacauauuuuguauuguucuaaugcaacagaaaagccuuuuaaucucu

SEQ ID NO: 86966 - RNA, 64 nt, hsa
gcaacugauguuucuuaguuuuacugugccugaucuaaugcaagcugcuucucucgcauguuuu

SEQ ID NO: 86967 - RNA, 64 nt, hsa
auguauaaacuuuagaguagaguuuggaaucccacuaaugcaaacugggaugaaacuaaagcaa

SEQ ID NO: 86968 - RNA, 64 nt, hsa
aaagaaaaauaauuauuuaaauauaaucaauauccuaaugcauucugguuugauauaaugcugc

SEQ ID NO: 86969 - RNA, 64 nt, hsa
cagggucuuuuaguugaagcacucaggaaauauacuaaugcaggcccagacaccccagaagggc

SEQ ID NO: 86970 - RNA, 64 nt, hsa
ugggcccggggaccucacaggcaggacggcgacacuaaugcagggagagggagucuggccccag

SEQ ID NO: 86971 - RNA, 64 nt, hsa
uggcucuggccucuuuagggaggcccaugaucgacuaaugcaguuggccgacugggacuuuuca

SEQ ID NO: 86972 - RNA, 64 nt, hsa
uucucucuccuccguccccuuccuccacugcugccuaaugcaaggcaguggcucagcagcaaga

SEQ ID NO: 86973 - RNA, 64 nt, hsa
ggaagucugccuggugaggcuggcaggugggagucuaaugcagucaggagcauuugcaugcagu

SEQ ID NO: 86974 - RNA, 64 nt, hsa
gaacacaccugccuuuuguguaaugcggggaagacuaaugcauggugacaccuaguuuuccuca

SEQ ID NO: 86975 - RNA, 64 nt, hsa
acugauaucuaaauauugauuucugccuuccuugcuaaugcaccauuagaagauauuagucuug

SEQ ID NO: 86976 - RNA, 64 nt, hsa
ucagcuuuuucugguuuauagaggugucuuauuucuaaugcaacagacccccaacuuuaacaga

SEQ ID NO: 86977 - RNA, 64 nt, hsa
augugaacaauuuucaugagacagucauuuuuaacuaaugcagugauucuuucucacuacuauc

SEQ ID NO: 86978 - RNA, 64 nt, hsa
auggugauuuguuucaugguuuuuguauuugagucuaaugcacguucuaacaugauagaggcaa

SEQ ID NO: 86979 - RNA, 64 nt, hsa
auuaauuuuuaggggagagcaguaggaaaaagagcuaaugcaugcgggguuuaauaccuaggug

SEQ ID NO: 86980 - RNA, 64 nt, hsa; identical to SEQ ID NO: 24913

SEQ ID NO: 86981 - RNA, 64 nt, hsa; identical to SEQ ID NO: 24914

SEQ ID NO: 86982 - RNA, 64 nt, hsa; identical to SEQ ID NO: 24915

SEQ ID NO: 86983 - RNA, 64 nt, hsa; identical to SEQ ID NO: 24916

SEQ ID NO: 86984 - RNA, 64 nt, hsa; identical to SEQ ID NO: 24917

SEQ ID NO: 86985 - RNA, 64 nt, hsa; identical to SEQ ID NO: 24918

SEQ ID NO: 86986 - RNA, 64 nt, hsa; identical to SEQ ID NO: 24919

SEQ ID NO: 86987 - RNA, 64 nt, hsa; identical to SEQ ID NO: 24920

SEQ ID NO: 86988 - RNA, 64 nt, hsa; identical to SEQ ID NO: 24921

SEQ ID NO: 86989 - RNA, 64 nt, hsa; identical to SEQ ID NO: 24922

SEQ ID NO: 86990 - RNA, 64 nt, hsa; identical to SEQ ID NO: 24923

SEQ ID NO: 86991 - RNA, 64 nt, hsa; identical to SEQ ID NO: 24924

SEQ ID NO: 86992 - RNA, 64 nt, hsa; identical to SEQ ID NO: 24925

SEQ ID NO: 86993 - RNA, 64 nt, hsa; identical to SEQ ID NO: 24926

SEQ ID NO: 86994 - RNA, 64 nt, hsa; identical to SEQ ID NO: 24927

SEQ ID NO: 86995 - RNA, 64 nt, hsa; identical to SEQ ID NO: 24928

SEQ ID NO: 86996 - RNA, 64 nt, hsa; identical to SEQ ID NO: 24929

SEQ ID NO: 86997 - RNA, 64 nt, hsa; identical to SEQ ID NO: 24930

SEQ ID NO: 86998 - RNA, 64 nt, hsa; identical to SEQ ID NO: 24931

SEQ ID NO: 86999 - RNA, 64 nt, hsa; identical to SEQ ID NO: 24932

SEQ ID NO: 87000 - RNA, 64 nt, hsa; identical to SEQ ID NO: 24933

SEQ ID NO: 87001 - RNA, 64 nt, hsa; identical to SEQ ID NO: 24934

SEQ ID NO: 87002 - RNA, 64 nt, hsa; identical to SEQ ID NO: 24935

SEQ ID NO: 87003 - RNA, 64 nt, hsa; identical to SEQ ID NO: 24936

SEQ ID NO: 87004 - RNA, 64 nt, hsa
uaaggccaucuagugccaacuccccccccaccauuccccucacugcacuuuggaccccuggggc

SEQ ID NO: 87005 - RNA, 64 nt, hsa
cuggcuuuucugccguggauucucccccgucuucuccccucagcaauuccugcaaaggguuaaa

SEQ ID NO: 87006 - RNA, 64 nt, hsa
acccuacucuguguggcugcuuucuuuggugcccuccccucaccccacuguagcugugacgugu

SEQ ID NO: 87007 - RNA, 64 nt, hsa
aauagcacagcugcccucccaugcucccuaccuguccccucacagggaggggagcaggggaggg

SEQ ID NO: 87008 - RNA, 64 nt, hsa
cuggugacccuccaagaugccccugcccucaguuuccccucaugaucuggccucugcccccuuc

SEQ ID NO: 87009 - RNA, 64 nt, hsa
ugccuugucugccuggcaaguucaucucucacgauccccucaaaggcccccuccuccaggaagg

SEQ ID NO: 87010 - RNA, 64 nt, hsa
uccgacuggggcucccugaggacagggcugugucuccccucagccuggggcucccugagucagg

SEQ ID NO: 87011 - RNA, 64 nt, hsa
cucagccuggggcucccugagucagggcugugucuccccucagacuggggcucccugaggacgg

SEQ ID NO: 87012 - RNA, 64 nt, hsa
ucaaaguggggcucccucaggacagcguugugucuccccucagacugcggcucccugaggacgg

SEQ ID NO: 87013 - RNA, 64 nt, hsa
ggcugcuccgacaggggagacuugucucccuuguuccccucaggauccauagaguggacaguaa

SEQ ID NO: 87014 - RNA, 64 nt, hsa
uagagcugggauugguggagggagcaggugccaguccccucacucucugggagcugugaaaggg

SEQ ID NO: 87015 - RNA, 64 nt, hsa
accuucugaaccuucuucaaacaguaguacaagcuccccucagccagccugccugcccagcgag

SEQ ID NO: 87016 - RNA, 64 nt, hsa
aacugcgcucccccaaccccucgcccugccaucuuccccucaagccugcuaaguuaucccaggc

SEQ ID NO: 87017 - RNA, 64 nt, hsa
aucgaugccuccuuucugggacucccggcacaacuccccucauccagggagggaggcagcugcu

SEQ ID NO: 87018 - RNA, 64 nt, hsa
gcuuggcuagguaguucuguguggcgguggucauuccccucauuaaacaccaguucuuggugac

SEQ ID NO: 87019 - RNA, 64 nt, hsa
cuguugagcagcauaauaaucccgggagaaugauuccccucauagaaagacaaaagcauccauc

SEQ ID NO: 87020 - RNA, 64 nt, hsa
aaugauuccccucauagaaagacaaaagcauccauccccucauaguuaaguagccacugguguc

SEQ ID NO: 87021 - RNA, 64 nt, hsa
gcccccacacugccuuucgcccuacugagacugguccccucaaaagguagacaaaacagcagcu

SEQ ID NO: 87022 - RNA, 64 nt, hsa
ggugcaacuccugccuccaucccccuugcugggguccccucauccacuugagggcgccugaggg

SEQ ID NO: 87023 - RNA, 64 nt, hsa
ugggcccugggaucuggaaccaacacaccccuguuccccucagcuuucccuccucgcuggccug

SEQ ID NO: 87024 - RNA, 64 nt, hsa
agccccugcccacccugacagagggagcugggccuccccucauccucuguaacucccgccuuca

SEQ ID NO: 87025 - RNA, 64 nt, hsa
aauuaagacugcauuaugaaagucaacagcucuuuccccucagcucuucuccuggaaugacugg

SEQ ID NO: 87026 - RNA, 64 nt, hsa
uuuccccucagcucuucuccuggaaugacuggcuuccccucaaauuggcacugagauuugcuac

SEQ ID NO: 87027 - RNA, 64 nt, hsa
uggggcagguggagggagcagucuucguucuuccuccccucaguggcaguuuggucuucaccug

SEQ ID NO: 87028 - RNA, 64 nt, hsa
ccugccguacgugccauuccacucucuucagcucuccccucaacagcaugcgagcccauaccuu

SEQ ID NO: 87029 - RNA, 64 nt, hsa
ggggcaguuagagcagccucguggagcucgccccuccccucagccugcccaccucucccugcau

SEQ ID NO: 87030 - RNA, 64 nt, hsa
cuucugcuccagccccuuugccucuguccucccauccccucaacacccugcuucucccggggac

SEQ ID NO: 87031 - RNA, 64 nt, hsa
uggcagcugccacgccgcccuaaaagcacacucauccccucacuugccgcgucgcccucccagg

SEQ ID NO: 87032 - RNA, 64 nt, hsa
cccccgccaaaagcugcucagggaaaagcagcucuccccucagagugcaagccccugcuccaga

SEQ ID NO: 87033 - RNA, 64 nt, hsa
aauaggagaagguggaaaugggugaagagagaaguccccucacuagcugcaugagaaaucuauc

SEQ ID NO: 87034 - RNA, 64 nt, hsa
auuccacgguuaggccccccugggggggcugccuuccccucagccucuccccacaccacccacc

SEQ ID NO: 87035 - RNA, 64 nt, hsa
uccccagaccucugucccuguuccccuccacuccuccccucacuccccugcucccccgaccacc

SEQ ID NO: 87036 - RNA, 64 nt, hsa
uguuccugguucccgcuuuccacuuccaaaucccuccccucaccuucccccacugccccccaag

SEQ ID NO: 87037 - RNA, 64 nt, hsa
ggugcuggggagggaggacugugaauggcuguucuccccucacugcugagucucccaggacccc

SEQ ID NO: 87038 - RNA, 64 nt, hsa
guuucuugcucaugguggcucauuuauuacauaguccccucaccccacuaauggauaaugggag

SEQ ID NO: 87039 - RNA, 51 nt, hsa
cugaggaagaugacaaguaacuccccucagggauacgacacaugcccauga

SEQ ID NO: 87040 - RNA, 64 nt, hsa
gccccccucacucuguuuccuguucagcauguacuccccucauccgauuccccucuaucaguca

SEQ ID NO: 87041 - RNA, 64 nt, hsa
gagaucagcgacccugaggaagaugacgaguaacuccccucagggauacgacacaugcccauga

SEQ ID NO: 87042 - RNA, 64 nt, hsa
cugcuuuucccauugccaugcguccuggucaagcuccccucacucuguuuccuggucagcaugu

SEQ ID NO: 87043 - RNA, 64 nt, hsa
gcuccccucacucuguuuccuggucagcauguacuccccucauccgauuccccuguagcaguca

SEQ ID NO: 87044 - RNA, 64 nt, hsa
gaacccaggagguggagguugcagugagccgucaucgcgccacuaagccaagaucgcgccacug

SEQ ID NO: 87045 - RNA, 64 nt, hsa
ugcagugagccgucaucgcgccacuaagccaagaucgcgccacugcacuccagccugggcgaca

SEQ ID NO: 87046 - RNA, 64 nt, hsa
gcugcugagcccacccagagguuguuggaguucagcggggcagcuugucucccuugucagcagg

SEQ ID NO: 87047 - RNA, 64 nt, hsa
ggcacgggccucggugcagguaacuggcaccucugcggggcagugccccacuccuuugugcaca

SEQ ID NO: 87048 - RNA, 64 nt, hsa
ugcccgagcaggcuccuugcaaagacagcagcgugcggggcagagccccgggagggcgcgucug

SEQ ID NO: 87049 - RNA, 64 nt, hsa
uguuguugguuuuagcuuccaguggcuucuuucugcggggcaucaggcugcugggguagccgcc

SEQ ID NO: 87050 - RNA, 64 nt, hsa
accgugaccgugaccgcgagcacaaacggggggagcggggcagugagcggggcagggaugaggc

SEQ ID NO: 87051 - RNA, 64 nt, hsa
accgcgagcacaaacggggggagcggggcagugagcggggcagggaugaggcccgagguggggg

SEQ ID NO: 87052 - RNA, 64 nt, hsa
ucuuuuugccauggcuaaucccugcauuuccauucagggaaaaggugguagugagcauagaacu

SEQ ID NO: 87053 - RNA, 64 nt, hsa
agauggcugccuggacuggaaucaaaucuaauuucagggaaaugaagauggaauuugaagguca

SEQ ID NO: 87054 - RNA, 64 nt, hsa
uccccuggauucgcuggacugcaaaaaggagcaccagggaaagcucagcaaaggcucaggaggc

SEQ ID NO: 87055 - RNA, 64 nt, hsa
cacuccugagucacugaauucgaggaggguggggcagggaaagggcuggccccccugcugaaau

SEQ ID NO: 87056 - RNA, 64 nt, hsa
gaccagucacuaaucucugagacuccauuuucuccagggaaacgaggcuugcccagauagacua

SEQ ID NO: 87057 - RNA, 64 nt, hsa
gcacaauggccugggaaguugaggucacuuuuuacagggaaauagaagaaacugagaaccuagu

SEQ ID NO: 87058 - RNA, 64 nt, hsa
gcauaaauagccaugugaauuccacaagaagcaccagggaaaguuuagagauuugcggcaaugg

SEQ ID NO: 87059 - RNA, 64 nt, hsa
cuguucuuucugccuguacuggaucuguuauuuucagggaaacaggccccagggccccccugag

SEQ ID NO: 87060 - RNA, 64 nt, hsa
auuucuuggaaaaggagagaggaauccccuagagcagggaaagcagugccugccagcuguugug

SEQ ID NO: 87061 - RNA, 64 nt, hsa
ggcccagacagucccccuugaccccagggcccaucagggaaaugccucccuuugguaaaucugc

SEQ ID NO: 87062 - RNA, 64 nt, hsa
agacucagaggggaagagggugcuaguaccaacacagggaaaacggaugggaccugggcccaga

SEQ ID NO: 87063 - RNA, 64 nt, hsa
agguggucccauaggucuugugaaaaggcuuuuucagggaaaaauauuuuacuaguccaaucac

SEQ ID NO: 87064 - RNA, 64 nt, hsa
gaguggggagcggagcuuggcccugcgcccugugcagggaaagggauggucaggcccaguucuc

SEQ ID NO: 87065 - RNA, 64 nt, hsa
gacacuuuagugcaaagagcugagcacauuccagcagggaaacgaacuccgaugugcgcccauu

SEQ ID NO: 87066 - RNA, 64 nt, hsa
uugggaaaagaauuauguagauaccacauggagacagggaaacaauugugguaaaacuguggau

SEQ ID NO: 87067 - RNA, 64 nt, hsa
aucuugaagaaaaaucuuuugguggaggugccuucagggaaaguuuucuucacccucacucuuc

SEQ ID NO: 87068 - RNA, 64 nt, hsa
gcagagccccucuuaucuugagaacuccauucuucagggaaaggaucucccuagcucagagaau

SEQ ID NO: 87069 - RNA, 64 nt, hsa
cagcgaggcccucugcaagaagcucaaggaagcucagggaaaauggacguauucagagaguguu

SEQ ID NO: 87070 - RNA, 64 nt, hsa
agggaaggagcagggaugagacuggcaauggucacagggaaagauguggccuuuugugaugguu

SEQ ID NO: 87071 - RNA, 64 nt, hsa
aagcaccgugcugacagauaucaaaguacucuagcagggaaaauaauuuguuugcuguguaagg

SEQ ID NO: 87072 - RNA, 64 nt, hsa
gacaagacagauaaaucugaaggucauguggcaucagggaaagggcauggcugugucuuuugca

SEQ ID NO: 87073 - RNA, 64 nt, hsa
ucgaagcaugucuuugccaugggcuguguccuuccagggaaauuguggucucgggccuggguga

SEQ ID NO: 87074 - RNA, 64 nt, hsa
uucuguuuguaagguaagagcuucuguucgugugcagggaaagcagcucacagacgccguuaaa

SEQ ID NO: 87075 - RNA, 64 nt, hsa
uccuaacccccaacagagguguucacaguguagacagggaaaaaauguauaaacaaauguguaa

SEQ ID NO: 87076 - RNA, 64 nt, hsa
gggccagaagaaugagagagaggaagacugcuggcagggaaaucgaggaggcgagacuagaacu

SEQ ID NO: 87077 - RNA, 64 nt, hsa
gccuguuccacacccccacaccaucaggauagcacagggaaacuguaguuuaaguggcaaauaa

SEQ ID NO: 87078 - RNA, 52 nt, hsa
uccaccagaucagacacugauccagggaaagagccaggaauggcagugucuu

SEQ ID NO: 87079 - RNA, 64 nt, hsa
cugcccgacucacucacagugcagggaaaggaggcagggaaaagaccaggauucugugaguucu

SEQ ID NO: 87080 - RNA, 64 nt, hsa
ggagcagcuccuucugcccgacucacucacagugcagggaaaggaggcagggaaaagaccagga

SEQ ID NO: 87081 - RNA, 64 nt, hsa
ugcacagagcucugcuugaaacagguacacgggccagggaaaugccagcaagccagagcgggcg

SEQ ID NO: 87082 - RNA, 64 nt, hsa
agagggagugggaggggucugucuccaccugaggcagggaaagagagccuauucucacacauga

SEQ ID NO: 87083 - RNA, 64 nt, hsa
caaauauugggaggggagaagaucuaaccagcaacagggaaaagagaaauauuaucuuucaaug

SEQ ID NO: 87084 - RNA, 64 nt, hsa
aaguauucaugaugacucuauuuggaaugauauucagggaaaucacaauaauauagcaguaguu

SEQ ID NO: 87085 - RNA, 64 nt, hsa
ucacuguuccuuuuuuuagguuagaaauuaacagcagggaaaugccaucuuauuaccugagacg

SEQ ID NO: 87086 - RNA, 64 nt, hsa
ccuuucccuagaaauuggcucaccuugggaaacccagggaaagaaucagcagguucucugcccu

SEQ ID NO: 87087 - RNA, 64 nt, hsa
cucucucagauccauaauccauacucagugaaagcagggaaaaaauauuuucacuuauuuuauu

SEQ ID NO: 87088 - RNA, 64 nt, hsa
aaccuguguaaguauugugaaaacccuuuucuuccagggaaaaauuauuggaaauuccuuaacu

SEQ ID NO: 87089 - RNA, 64 nt, hsa
aagggauuucccugucucagagcagccuuugccccagggaaaugggcucugggcuggcugccug

SEQ ID NO: 87090 - RNA, 64 nt, hsa
ggcagcccucccagugcccaagggccaccaaccccagggaaacagggccagcacagaggggccu

SEQ ID NO: 87091 - RNA, 64 nt, hsa
gggguggcggggggcauguaccacaggguggcagcagggaaaaaaauuagaaaagggugaaaga

SEQ ID NO: 87092 - RNA, 64 nt, hsa
uacccacccgcuguucuccaugcaaacaaagcgccagggaaaugacccacagggaucgcagcug

SEQ ID NO: 87093 - RNA, 64 nt, hsa
aaauguuuggaagguuuauuucucaugcacauuccagggaaaagcagagaguaaauuagagacg

SEQ ID NO: 87094 - RNA, 64 nt, hsa
ucaucggcuuucagaaggagaccacgggaauguucagggaaacaaugucagcuucucugaggac

SEQ ID NO: 87095 - RNA, 64 nt, hsa
cucucugaauaaccuagccaauaucaaacgagaacagggaaacauugaagaggcaguucgcuug

SEQ ID NO: 87096 - RNA, 64 nt, hsa
ugcccauucaaauuuagcaaguguacugcagcagcagggaaaacugcaggaagcucugaugcau

SEQ ID NO: 87097 - RNA, 64 nt, hsa
uaugauucuagaugagaaguuauaucaagaaagauguggccaaucagauugagucauccaggca

SEQ ID NO: 87098 - RNA, 64 nt, hsa
acauuuuccagauggcgaggucacagcagagagauguggccaccuagccuuuccuuauccccuu

SEQ ID NO: 87099 - RNA, 64 nt, hsa
cucaguaaugcuccauugcucuaaccuccugcuguguggccaaacggauauccuaauagaaauu

SEQ ID NO: 87100 - RNA, 64 nt, hsa
gaaauguacaaacuagaauuuuaauauaaagaaauguggccaugcuuuaaaccuguggucccca

SEQ ID NO: 87101 - RNA, 64 nt, hsa
gcucagagcagaaaguaaggggcagagucauacguguggccaggaaguagccagggugaagaga

SEQ ID NO: 87102 - RNA, 64 nt, hsa
uggcuugugacgcuauaagacagagcaggccacauguggccaucugcuccccauucuugaaagc

SEQ ID NO: 87103 - RNA, 64 nt, hsa
ucugcagcagaaagaaaggggccugggcagcagguguggccagucccucugccaaggccugugc

SEQ ID NO: 87104 - RNA, 64 nt, hsa
ggcgauggguggcuagagugaugaacucaagcccuguggccacaguucugggagccuucaaccc

SEQ ID NO: 87105 - RNA, 64 nt, hsa
aggggagcagaguccgagcuuaucuaaauaugaauguggccacaaagcuguggaaggugacaaa

SEQ ID NO: 87106 - RNA, 64 nt, hsa
ugcaauuauagaaauacaucggagacacaacaaauguggccauuacagguuucauaaaauuaca

SEQ ID NO: 87107 - RNA, 64 nt, hsa
gggagguucagugaauuguguaggagagguugucuguggccagaauuuaaaccuauacucacuu

SEQ ID NO: 87108 - RNA, 64 nt, hsa
caguuugaaauugagcuggaccucaccaagcugcuguggccaucaaccucuguauuugaaucag

SEQ ID NO: 87109 - RNA, 64 nt, hsa
ggcugaacuuggcauuuccuugcuaacugccagauguggccaaccuuuguccauaugcaaacca

SEQ ID NO: 87110 - RNA, 64 nt, hsa
ccuuaacgagcaauagaauguauggucaccuggguguggccagugcccgcugugcccugcauga

SEQ ID NO: 87111 - RNA, 64 nt, hsa
gaacccugaggaguggagucauacgcgaaggguguguggccaggcugcagagcugcgugccguu

SEQ ID NO: 87112 - RNA, 64 nt, hsa
gaacccugaggaguggagucauacacgaagggcguguggccaucgugucagcagagagagucuc

SEQ ID NO: 87113 - RNA, 64 nt, hsa
gcacgcccuacuccacugcccuggcagcagcagguguggccaauggaggggggugcuggccccc

SEQ ID NO: 87114 - RNA, 64 nt, hsa
ggcaggaggggugaguccccuacucccucuucacuguggccacagcccccuugcccuccgccug

SEQ ID NO: 87115 - RNA, 64 nt, hsa
uccuuguaauuugaguauaaauguauuuuugucuuguggccauucuuuguagauaauuucugca

SEQ ID NO: 87116 - RNA, 64 nt, hsa
auccucccaccgcccugcccuccccaccgaguccuguggccauucagagcggccacaugacuuu

SEQ ID NO: 87117 - RNA, 64 nt, hsa
ccugcacagggaggggcugauccugccucagcuguguggccaugugggggcagcaggggccugg

SEQ ID NO: 87118 - RNA, 64 nt, hsa
accccaaagguguccaugccccaguucuaagcccuguggccaggugcugucacacagcaaaggg

SEQ ID NO: 87119 - RNA, 64 nt, hsa
ggucacacauguacauccuggaagcugcccaagguguggccacuuguagggcagugagaggaag

SEQ ID NO: 87120 - RNA, 64 nt, hsa
ggccgggcuggaggcccagggaaucgguuacugauguggccacccuauucccacauggggagca

SEQ ID NO: 87121 - RNA, 64 nt, hsa
agagcuaucccccgccccucaagcaccugugccguguggccauccggcucuaccuucagccgug

SEQ ID NO: 87122 - RNA, 64 nt, hsa
cugucagggucccuaagggaggacacucagggccuguggccaggcagggcggaggccugcugug

SEQ ID NO: 87123 - RNA, 64 nt, hsa
ugcccuggcugcagucagugcccagggcgaggaauguggccaggggauccaggaccugggaucc

SEQ ID NO: 87124 - RNA, 64 nt, hsa
gucaucaggcacccagguuccuacugucuugccauguggccacaguuagcaacaaaggaggcug

SEQ ID NO: 87125 - RNA, 64 nt, hsa
uguugugaguuccauguccucuuggaucagucacuguggccaugcauguuuggccacaugauua

SEQ ID NO: 87126 - RNA, 64 nt, hsa
cagacgaggaagguauccagccucaagucaucauuguggccaggaagauggaauacaccaaaug

SEQ ID NO: 87127 - RNA, 64 nt, hsa
cccagcgcugcccucugccguccagaugcugcaguguggccagauuuaccuuccaguaacauac

SEQ ID NO: 87128 - RNA, 64 nt, hsa
gguuaugaggaaguuuaaugaagagcccggucacuguggccaucuuguguccccaacugcagga

SEQ ID NO: 87129 - RNA, 64 nt, hsa
auuuaaaaaaaaaaaaacaacaaaagaguuuguguguggccaggacuaaacagcugcuucuuaa

SEQ ID NO: 87130 - RNA, 64 nt, hsa
auaaaauaucacuacccacauaaccuauaauuuguguggccagcaauuuauugaacacuaaaau

SEQ ID NO: 87131 - RNA, 64 nt, hsa
gaaggcgcaugguucuggacggcccagcagcuccuguggccacagcagcuuuguacacgaagac

SEQ ID NO: 87132 - RNA, 64 nt, hsa
ccagggcugcaaugcagcauguugcccuggcaccuguggccaguacucgggacagacuaagggc

SEQ ID NO: 87133 - RNA, 64 nt, hsa
guguggccccagggcgguucuuggauguaaaagauguggccaucuagccucguaacuucacugu

SEQ ID NO: 87134 - RNA, 64 nt, hsa
acgaaugguagcagccagcuuugcggggcguauguguggccagcucuuaaccauuccagucuau

SEQ ID NO: 87135 - RNA, 64 nt, hsa
auggagggaaaaagccuugagccaggcagaaguuuguggccaggguuugugcagcagcuuugug

SEQ ID NO: 87136 - RNA, 64 nt, hsa
ugaccccaagucccccggcccugccuggugucacuguggccaaacagugcccagcuuaagcauc

SEQ ID NO: 87137 - RNA, 64 nt, hsa
cagaccaagucccuauaaacaaggaccuuccaguccaggggaaugacugugcaagguaguaucu

SEQ ID NO: 87138 - RNA, 64 nt, hsa
cuugagcccaggaguucaagaccagccugagcaaccaggggagaccuuguuucuacaaaagaau

SEQ ID NO: 87139 - RNA, 64 nt, hsa
uaaguaggauguuguugccuuuaacuuuucuuauccaggggaaaauugccauuuuagggucagc

SEQ ID NO: 87140 - RNA, 64 nt, hsa
agaaagaaagacgcugggcccaauuuugacuuggccaggggacaccuugguguguuuguuaucu

SEQ ID NO: 87141 - RNA, 64 nt, hsa
ggugaagcaucugcuggacaagucggaccacuggccaggggaccuuugauugucuuuccagaga

SEQ ID NO: 87142 - RNA, 64 nt, hsa
uggagaccaaggcaauaguccuuuccacuacaggccaggggaugggacaagaaguagggaacag

SEQ ID NO: 87143 - RNA, 64 nt, hsa
gccaugggaacgccaacuggaaagguccccuuccccaggggagccugcgaaggagagguucugu

SEQ ID NO: 87144 - RNA, 64 nt, hsa
cccagccuuuuuuuuuuuuuuuuuuuuuuugucuccaggggaggggcuguuugcuggcucaggc

SEQ ID NO: 87145 - RNA, 64 nt, hsa
auauacgugauuuaaucugcaauagguggaauaaccaggggaacugguuaugaauaugugaaug

SEQ ID NO: 87146 - RNA, 64 nt, hsa
augaugcuuuuucucugaaguggugugggaaguaccaggggacuggcagaagcccaggcccucu

SEQ ID NO: 87147 - RNA, 64 nt, hsa
ggggucgucgagaggcugcgggcuggcggcagucccaggggagagacaccacagaaggagaccc

SEQ ID NO: 87148 - RNA, 64 nt, hsa
cuuuccgcacucugagaccaugaucuuccuccugccaggggagagccacccacaggccaugucc

SEQ ID NO: 87149 - RNA, 64 nt, hsa
uccucccgugccccuccccgcuguccucuuggccccaggggagaagaugaggccaucagagaug

SEQ ID NO: 87150 - RNA, 64 nt, hsa
aagaugaggccaucagagauggccaggagaagggccaggggaauagagcuauuuuuuuaacaaa

SEQ ID NO: 87151 - RNA, 64 nt, hsa
ugcccaccugucaaacaaagccagaagcugagcaccaggggaugaguggagguuaaggcugagg

SEQ ID NO: 87152 - RNA, 64 nt, hsa
ggggugggguggagaacuccuaggguggcuggguccaggggaugggagguugugggcauugaug

SEQ ID NO: 87153 - RNA, 64 nt, hsa
acugggcugacaguaaaagcacagaauacaaaacccaggggauggggcugggaggggcugugag

SEQ ID NO: 87154 - RNA, 64 nt, hsa
cuccccuaaagguagaagauacucgagcaugcugccaggggagcuggauggugaaacaccugaa

SEQ ID NO: 87155 - RNA, 64 nt, hsa
ugggcaccaggggacgcucuggcgagggcagaccccaggggaaagcaaagggcgucucagggaa

SEQ ID NO: 87156 - RNA, 64 nt, hsa
ccccuucccccucgacccccgcaaugagugggcaccaggggacgcucuggcgagggcagacccc

SEQ ID NO: 87157 - RNA, 64 nt, hsa
cccucugacccuggcccagggaccccucacggggccaggggaggcauagcagaaagacuggccc

SEQ ID NO: 87158 - RNA, 64 nt, hsa
cugggggugcagagcccaccuggguaccugacccccaggggaugaaaaugcaaggaugagucug

SEQ ID NO: 87159 - RNA, 64 nt, hsa
ggcagagaccugggaugggagaaguccuggggcgccaggggauccagccuagagcagaccuuag

SEQ ID NO: 87160 - RNA, 64 nt, hsa
uccaagagcacccaccaagacacagcaggacaggccaggggagggcaucuggaccagggcaucc

SEQ ID NO: 87161 - RNA, 64 nt, hsa
acagcgccaauaacaauacagugucugaguaucuccaggggaugauuucuggcucuuugucucc

SEQ ID NO: 87162 - RNA, 64 nt, hsa
cugaagcugauuuguaaugauuggcacucuucagccaggggaguggguaggccauagccaagga

SEQ ID NO: 87163 - RNA, 64 nt, hsa
caaaaaacugcuccuucacccucacccugaggccccaggggagaggacccgugggauggugccc

SEQ ID NO: 87164 - RNA, 64 nt, hsa
caggggccacacggcgggaggaagggcucugagcccaggggaggggagggagcgaggggcucac

SEQ ID NO: 87165 - RNA, 64 nt, hsa
uuauccuaugggggccugagcaggauugagggagccaggggaggggcaggagucccagcaccau

SEQ ID NO: 87166 - RNA, 64 nt, hsa
gagcccugccaggggcugugggccuacaaggcuuccaggggaugccauccagccuguaggaaac

SEQ ID NO: 87167 - RNA, 64 nt, hsa
ccaccucccuucuucuaacuaaauauaaaaagauccaggggacauaaauguggagauuaaauaa

SEQ ID NO: 87168 - RNA, 64 nt, hsa
ccaguucuguuccuucugacuagccccucuuccuccaggggagaacuuccaaauguuaauuuuu

SEQ ID NO: 87169 - RNA, 64 nt, hsa
ucagggagcagggccaggcgggcucgggggccggccaggggagcaccccacucaacuacucaga

SEQ ID NO: 87170 - RNA, 64 nt, hsa
ccaggcucucugguggccgccccugugcaccuggccaggggaagcccgggggucuggggccucc

SEQ ID NO: 87171 - RNA, 64 nt, hsa
ccccuagccgucaucuccacacucaccaggcccaccaggggagggggcuggccugggggucuug

SEQ ID NO: 87172 - RNA, 64 nt, hsa
aagauacaagaggcaguaggaccuggguuggaacccaggggagcagacuggggggcuguugccc

SEQ ID NO: 87173 - RNA, 64 nt, hsa
caacaccccggccucggggcuccugguggcagcaccaggggacacaccugccaaacccaccaga

SEQ ID NO: 87174 - RNA, 64 nt, hsa
gaugcugucacucagccagaucaguauugacccaccaggggaggugggguuuggugagagacgc

SEQ ID NO: 87175 - RNA, 64 nt, hsa
gcugcuaaaaggccuugugagguggccccacccuccaggggagcuggugaagaugggccacaga

SEQ ID NO: 87176 - RNA, 64 nt, hsa
ggacagccuuuguuuucugagauaccaaagagagccaggggagggccccggguucggcggccag

SEQ ID NO: 87177 - RNA, 64 nt, hsa
ccuucuguaguaauaaaguuuuugccacuguaaauaaaaacaguauccguagcuaucaggauca

SEQ ID NO: 87178 - RNA, 64 nt, hsa
cauuaguaauauuucaguuggguaucuuuuuaaguaaaaacaacaaauaaacucuguacaugua

SEQ ID NO: 87179 - RNA, 64 nt, hsa
acauuuaaaaagaugacauauaccaccacuuacuuaaaaacaauaaaagcaauagauuugauua

SEQ ID NO: 87180 - RNA, 64 nt, hsa
ucuguuagcuuccaguaaaaauauuuguuuuuaguaaaaacaaauuuaaauauauuuacauguu

SEQ ID NO: 87181 - RNA, 64 nt, hsa
uuugucucucugacuugauuucuauaaaugcuuuuaaaaacaagugaagccccucuuuauuuca

SEQ ID NO: 87182 - RNA, 64 nt, hsa
cauuguucucaguuucccugccaacauugaaaaauaaaaacagcagcuuuucuccuuuaccacc

SEQ ID NO: 87183 - RNA, 64 nt, hsa
gggaaacaaagcgagacccugucuccacuaaacauaaaaacaaaauuacuggggccccauggca

SEQ ID NO: 87184 - RNA, 64 nt, hsa
uuucacauuaucauugcucauaauagccaauaaguaaaaacaacccaaauguccaagaaugaau

SEQ ID NO: 87185 - RNA, 64 nt, hsa
uuuauccacaacuuuucaaguauugaaaguagaauaaaaacauggguucuuagucuuuagcuau

SEQ ID NO: 87186 - RNA, 64 nt, hsa
aaagcacauuuuaaggaacaagaauugcuaaauauaaaaacauaaauaauaccauaauacaugg

SEQ ID NO: 87187 - RNA, 64 nt, hsa
cauugguugcuuuucaauauaauugcaaacaaauuaaaaacacaguuaaacuaauauguuuaua

SEQ ID NO: 87188 - RNA, 64 nt, hsa
ucucauuugaaccucauaaccagcccugaaauaguaaaaacaagcuauauucccacuuuauaaa

SEQ ID NO: 87189 - RNA, 64 nt, hsa
agaggugaauuugcauuuacacuuagacacuuucuaaaaacagggugaacuuaauugaaauuuu

SEQ ID NO: 87190 - RNA, 64 nt, hsa
aucugaguuuucagagugcuucugaaguacaguuuaaaaacacuuuuuaaaaaguggaguaaaa

SEQ ID NO: 87191 - RNA, 64 nt, hsa
cuucauuuguauacauuuggaaucuaaaccagcuuaaaaacaguuuccucaaugacuuagauac

SEQ ID NO: 87192 - RNA, 64 nt, hsa
acuucauaauggugcuuucaaacagcgagaugaguaaaaacaucagcuuccacguugccuucug

SEQ ID NO: 87193 - RNA, 64 nt, hsa
uccugauuuuucaauguuauucuucaguccuauuuaaaaacaaaaccaagcucccuucccuucc

SEQ ID NO: 87194 - RNA, 64 nt, hsa
agugcaccaucgcacccggcuggguuaucuaguuuaaaaacacuuuuuuucaaggaaaccgaag

SEQ ID NO: 87195 - RNA, 64 nt, hsa
uaauaagagguguaaaaacuaucacaggaagaaauaaaaacagauuuuugaaggugagaugaua

SEQ ID NO: 87196 - RNA, 64 nt, hsa
uuuugaagcuugacauuuuaguuugccauuauguuaaaaacaucuaaauagguguuaguuucuc

SEQ ID NO: 87197 - RNA, 64 nt, hsa
aauccuuguucaguucuuaaguuucgguuuuuuuuaaaaacaggaugcaacuuaaacuuuucuu

SEQ ID NO: 87198 - RNA, 64 nt, hsa
gugcauucaagcugugugacaagauauaucaauauaaaaacaagguauauacuuuauuauuuuu

SEQ ID NO: 87199 - RNA, 64 nt, hsa
ccuugauuuacagugcaggguaaagugcagaccuuaaaaacagcuaaguaccuagaagagcucc

SEQ ID NO: 87200 - RNA, 64 nt, hsa
uaggaagaaaugcuugcucugaaauaguauagauuaaaaacacucaguagaaaagaaucuaaaa

SEQ ID NO: 87201 - RNA, 64 nt, hsa
gaaauuaucacuuggauguggagguuuuacuuuuuaaaaacauucagcuuaauuaccuuaccuu

SEQ ID NO: 87202 - RNA, 64 nt, hsa
auagacacaaucaagacaauagugcaccguuccuuaaaaacagcaucugaggaaucccccuuuu

SEQ ID NO: 87203 - RNA, 64 nt, hsa
aaucucuaggguaagccagaaggcaagaucagauuaaaaacaccauguuucuaagcauccauuu

SEQ ID NO: 87204 - RNA, 64 nt, hsa
aguacuugaaauguauugacugcugacuauauuuuaaaaacaaaaugaaauaauuugaguugua

SEQ ID NO: 87205 - RNA, 64 nt, hsa
cauuuggugcucugcuaaccauuuauauaaaacuuaaaaacaagagaaaagaaaaaucaauuag

SEQ ID NO: 87206 - RNA, 64 nt, hsa
ugguuugucaguuuaucuuaagcaugucaauucauaaaaacaagucauuuuuguauuuuucauc

SEQ ID NO: 87207 - RNA, 64 nt, hsa
uuuacugucuguuggauaauggcuguaaaauguuuaaaaacaaaacaaaacaaaaaagaggcac

SEQ ID NO: 87208 - RNA, 64 nt, hsa
cacagggcuuucaguuuggcaaaggaaaagcagauaaaaacagaacauuccauauguuucuuuc

SEQ ID NO: 87209 - RNA, 64 nt, hsa
aauaguuauucucuaagaggaaacuaguguuuguuaaaaacaaaaauaaaaacaaaaccacaca

SEQ ID NO: 87210 - RNA, 64 nt, hsa
cuaagaggaaacuaguguuuguuaaaaacaaaaauaaaaacaaaaccacacaaggagaacccaa

SEQ ID NO: 87211 - RNA, 64 nt, hsa
uccaagaguguaccauuaacuugauuguugauaauaaaaacaaaaagcaagucuagcaauugaa

SEQ ID NO: 87212 - RNA, 64 nt, hsa
acuuguuuagaaaaaaaagacaaaaaaguaaaaauaaaaacaaaaaaguuggaaggcagaaacc

SEQ ID NO: 87213 - RNA, 64 nt, hsa
aaugcuuuugcauggacuauccucuuguuuuuauuaaaaacaaaugauuuuuuuaaaagucaca

SEQ ID NO: 87214 - RNA, 64 nt, hsa
gcuuuauuucacauuuuuucaguccugauaauauuaaaaacauugguuuggcacuagcagcagu

SEQ ID NO: 87215 - RNA, 64 nt, hsa
uuaauuacauuguggaagauuauuuuuuaucuuguaaaaacacuuuuuugguuuaauauauauu

SEQ ID NO: 87216 - RNA, 64 nt, hsa
agacacaaaagcauacacaggaaaaaaugaugcauaaaaacauggcuucuguagaacaauagag

SEQ ID NO: 87217 - RNA, 64 nt, hsa
auagaaaaguuaaggucugagugcaugugugcauuaaaaacauuucacuaccuauucucucaug

SEQ ID NO: 87218 - RNA, 64 nt, hsa
uuuacauaccugucuguagguaagcaaguguuaguaaaaacaauuuugucaaacaguacuccug

SEQ ID NO: 87219 - RNA, 64 nt, hsa
cagccuggccaacauggcaaaacccugucucuacuaaaaacauaaaaauuagcuggggguggua

SEQ ID NO: 87220 - RNA, 64 nt, hsa
ggggaccuagugaauggucuuuacuguugcuauguaaaaacaaacgaaacaacugacuucauac

SEQ ID NO: 87221 - RNA, 64 nt, hsa
aaugauaaaaaaaacugcucccugcacaugaguguaaaaacauguuuguaauuuuaaguaaaau

SEQ ID NO: 87222 - RNA, 64 nt, hsa
agaaaauaauuuuuaaaauaauagauaaaaauuuuaaaaacagccagaaaaaguauaauuuaua

SEQ ID NO: 87223 - RNA, 64 nt, hsa
uuaggaaauaguuaugagauuaagggaaaaucuauaaaaacaagguuagcauauucucaacaca

SEQ ID NO: 87224 - RNA, 64 nt, hsa
auuuuguuauauggaaugguuaauuuuuaccuaauaaaaacauagaugaaauacauuguauuuu

SEQ ID NO: 87225 - RNA, 64 nt, hsa
aaaagcuaaagcugccaaauuucuguugaacucuuaaaaacagcucauguuuguuuguccucuc

SEQ ID NO: 87226 - RNA, 64 nt, hsa
auuuaaauaacuuauuuuucuccauugcuguucuuaaaaacauuguaaguagcuguaauauacc

SEQ ID NO: 87227 - RNA, 64 nt, hsa
cauaggucacuuuaaauguucuaguagcaacuuuuaaaaacauaaaaagaagcaggugaaaaug

SEQ ID NO: 87228 - RNA, 64 nt, hsa
gaguaauagagaauucuucagguuugagagaagauaaaaacauuuugguugcauauuugcuaag

SEQ ID NO: 87229 - RNA, 64 nt, hsa
uucagccauuagaagcuaucaaauaaaguagguguaaaaacaacugucuguggcauuuguauac

SEQ ID NO: 87230 - RNA, 64 nt, hsa
agggacuuguaagcauuucuggaaauauuugauuuaaaaacauauauuaauagauguuuucccu

SEQ ID NO: 87231 - RNA, 64 nt, hsa
aggggaaauggauugggguuuaagguagggggaguaaaaacaagaaaccauccacucuguauau

SEQ ID NO: 87232 - RNA, 64 nt, hsa
aauauagugagaccaugucucuacagaaaaaauuuaaaaacagaucagcuggguguggugccac

SEQ ID NO: 87233 - RNA, 64 nt, hsa
ucuaaguugccaacuggcaaagaaagucuaauguuaaaaacaacuuugccuuugaaacguuaau

SEQ ID NO: 87234 - RNA, 64 nt, hsa
agccugaccagcaugguggaacccccaucucuacuaaaaacacaaaaaauuagccgggcguggu

SEQ ID NO: 87235 - RNA, 64 nt, hsa
caugugccagaugcuccgcuaggcaccagagggauaaaaacaauacuuauaguauaccacuaau

SEQ ID NO: 87236 - RNA, 64 nt, hsa
uuacaagauauuuguuuuauuaauauuugcuggcuaaaaacaaaugugguuuuuauauauuuuu

SEQ ID NO: 87237 - RNA, 64 nt, hsa
uuuccacuuuugcugaagcuuuuaaucagauguguaaaaacaauugaccagcuaggcuauuuag

SEQ ID NO: 87238 - RNA, 64 nt, hsa
cuggcugcaaagaagaaucaacagggacacuuuuuaaaaacacucuuaucagccugggcaacac

SEQ ID NO: 87239 - RNA, 62 nt, hsa
gcgagacccugucucaaaaaaauaaaauaaaaaauaaaaacacccuugccugcgcuccauuc

SEQ ID NO: 87240 - RNA, 64 nt, hsa
gcauguauagguaugaucuguguaaaaucugacauaaaaacagugcuauucugagugaaaauuu

SEQ ID NO: 87241 - RNA, 64 nt, hsa
uuuuaaagacaaagcauucuaaaugaacucaauauaaaaacauucauuuggaauguacauacug

SEQ ID NO: 87242 - RNA, 64 nt, hsa
acaaaaaaaaaaacaaaaaaaaacaaaaguaaauuaaaaacaaaaccugaugaaacagaugaag

SEQ ID NO: 87243 - RNA, 64 nt, hsa
uuaagguuucugaguuaaccagaaaaauagaaauuaaaaacaaaacaaaaaaaaaaacaaaaaa

SEQ ID NO: 87244 - RNA, 64 nt, hsa
uauuuaccuuuuaagacauuuucaugcuuccagguaaaaacagauauuguaccauguaccuaau

SEQ ID NO: 87245 - RNA, 64 nt, hsa
gugaaaaaaauuauucaugcucucauauauauuuuaaaaacacuacuuuugcuuuuuuauuuac

SEQ ID NO: 87246 - RNA, 64 nt, hsa
gaaauagaaaaggaagacagcauuuaaaguuguauaaaaacaugaguuauucauaaagagaaaa

SEQ ID NO: 87247 - RNA, 64 nt, hsa
cacaguuuuagaaucuacugcugcuaaagcacauuaaaaacaaauccugguuuuuaauguaugc

SEQ ID NO: 87248 - RNA, 64 nt, hsa
gccaaauauuaaauaugguuuauuuagguaagcauaaaaacauaggggcuaucauuuuuaaaga

SEQ ID NO: 87249 - RNA, 64 nt, hsa
agaagaauuuauguuaaacuuuaagguaaggguguaaaaacauuuuugagauaagguuuuuauu

SEQ ID NO: 87250 - RNA, 64 nt, hsa
aauaauuaucaggacuuuuuucaggaguggguuauaaaaacauucaaguuggucugacaguauu

SEQ ID NO: 87251 - RNA, 64 nt, hsa
guuuggaagaagaacaagaauuccacaugagaaguaaaaacaguuuacaguacucagcaaaaga

SEQ ID NO: 87252 - RNA, 64 nt, hsa
aaugaagaacaacuuuaucaaggaagcuaguauuuaaaaacaaauucaugagcaagcugcaaau

SEQ ID NO: 87253 - RNA, 64 nt, hsa
aauaauuggaauauauugcaggcauuaagcucauuaaaaacaaacuggcuugcagaaggguccg

SEQ ID NO: 87254 - RNA, 64 nt, hsa
gcuuuaauuucuuccguuugacaguguaugucuauaaaaacaauaaacauuuuuuaaaaaauga

SEQ ID NO: 87255 - RNA, 64 nt, hsa
uuauccuccuuuccgacccucuuauacauauuucuaaaaacaggcacauuggugagaugcaccc

SEQ ID NO: 87256 - RNA, 64 nt, hsa
acuuccaaaaacaagggaacaaggugguuuauuguaaaaacaggaaauggugcaugucauugag

SEQ ID NO: 87257 - RNA, 64 nt, hsa
gguagagaguguugaaauucaauaccaaauacaguaaaaacaaauguaaauaaaagaaaacaca

SEQ ID NO: 87258 - RNA, 64 nt, hsa
ugaaaauaaaaaguauucccaagugauuuuaauuuaaaaacaaauuggcuuugucucauugauc

SEQ ID NO: 87259 - RNA, 64 nt, hsa
aauaaauccagauacauauuaauguugauaugaguaaaaacaaauaggaagaaauugaaauuuc

SEQ ID NO: 87260 - RNA, 64 nt, hsa
auagaaaggacauuacuaaugacauuuugcagauuaaaaacauucauuugaacacaguaguccc

SEQ ID NO: 87261 - RNA, 64 nt, hsa
uaaaaacaaaaaaacacaaaaaaauaguaaaauauaaaaacaaauuaauguuuuauagacccug

SEQ ID NO: 87262 - RNA, 64 nt, hsa
aaacauaaugcuaguccuagauuacuuauugauuuaaaaacaaaaaaacacaaaaaaauaguaa

SEQ ID NO: 87263 - RNA, 64 nt, hsa
uuucuggggaauccaauuauaguugcuuuguauuuaaaaacaagaacagccaaggguuguucgc

SEQ ID NO: 87264 - RNA, 64 nt, hsa
uuugucgugucuauaaaggaagaacaaaacaaaauaaaaacagagcccuagagaaaugcuguua

SEQ ID NO: 87265 - RNA, 64 nt, hsa
ucgcaugcauaggauuuguucuacagguagauuuuaaaaacacguuaaagggccuuaaggcauu

SEQ ID NO: 87266 - RNA, 64 nt, hsa
aacgggugaaagaggguuucaauaaaauuuuaaauaaaaacagcauuagaauuguccuuuucau

SEQ ID NO: 87267 - RNA, 64 nt, hsa
aagaagucuugaaguuggguguuuccagaauugguaaaaacagcagcucauagaauuuugagua

SEQ ID NO: 87268 - RNA, 64 nt, hsa
gucaucagaugccugcuugauaauauauaaacaauaaaaacaacuuucacuucuuccuauugua

SEQ ID NO: 87269 - RNA, 64 nt, hsa
ugaucucuuucuucuguuuuggagaguuuauuauuaaaaacauuucuuugauaaaauggccauc

SEQ ID NO: 87270 - RNA, 64 nt, hsa
gcauuuccagcuaaucucuucugcucuaaauauuuaaaaacaguucuucucaaacauuuucauu

SEQ ID NO: 87271 - RNA, 64 nt, hsa
uugugggaaagcagaacugaaguuagcuuaagcauaaaaacaaagaaaaaucuucgcuuuucau

SEQ ID NO: 87272 - RNA, 64 nt, hsa
aaucaguucuaugcugccaaagauuaaaaauaaauaaaaacauaaaaaauuaagaggggccaag

SEQ ID NO: 87273 - RNA, 64 nt, hsa
uuuaaguggcuugauuaaauggcugaucaaaacuuaaaaacacacuaggucaauguuuuucaag

SEQ ID NO: 87274 - RNA, 64 nt, hsa
ucuucugcauagaaaaagaauugcaauuuuaauuuaaaaacauuuauagaaaauucauuuaauu

SEQ ID NO: 87275 - RNA, 64 nt, hsa
cacagcacuguucaucuggccaaacaacugugguuaaaaacacauguaaaaugcuuuuuaacag

SEQ ID NO: 87276 - RNA, 64 nt, hsa
gcccaggaauucuuccaguaggugcucagcuauuuaaaaacaaaacuauucucaaacauucauc

SEQ ID NO: 87277 - RNA, 64 nt, hsa
uagguuccauccuuuacguguuuaaaaaaaagcauaaaaacauuuuaaaaacauagaaaaauuc

SEQ ID NO: 87278 - RNA, 64 nt, hsa
cuuuacguguuuaaaaaaaagcauaaaaacauuuuaaaaacauagaaaaauucagcaaaccauu

SEQ ID NO: 87279 - RNA, 64 nt, hsa
cugauuucauauuguauuuuaaacugugugaaauuaaaaacaaagaauuucauucauaaugcug

SEQ ID NO: 87280 - RNA, 64 nt, hsa
guuuauacacuggaaauguugcguuuaugcuuuuuaaaaacacacguuaacuucagaggaagga

SEQ ID NO: 87281 - RNA, 64 nt, hsa
gucugucuugugacaguuucaucugaacuuaacuuaaaaacaacuguuaauguucuaguugugc

SEQ ID NO: 87282 - RNA, 64 nt, hsa
cugaaagcaggaaugccuacauuaauuccuacauuaaaaacagccaucuacccuugauuaucua

SEQ ID NO: 87283 - RNA, 64 nt, hsa
cacuccugaauuuacuuggauuuaaagagguuaauaaaaacaaacuauaaacucucuagacugg

SEQ ID NO: 87284 - RNA, 64 nt, hsa
cccaaagcagcagaaggcagggguuaaaucaggauaaaaacagacaucaguggaaucgaaaacc

SEQ ID NO: 87285 - RNA, 64 nt, hsa
gaaaugaaggauuucacacuucagaauauuuuacuaaaaacauuccagucuuggccgggugcgg

SEQ ID NO: 87286 - RNA, 64 nt, hsa
agaccagccugggaacacagcgagacccucucauuaaaaacaacaaaacaaaacaauuccaguc

SEQ ID NO: 87287 - RNA, 64 nt, hsa
aacagcaagaaaaaugcuuauaauguaguacaauuaaaaacaacacaucuccacuaccagugcu

SEQ ID NO: 87288 - RNA, 64 nt, hsa
acucuuauuagcacugcaaaagcuccugagaauuuaaaaacacaguaauucucuggauguuagg

SEQ ID NO: 87289 - RNA, 64 nt, hsa
cugcugggccuuuuuucaucaagucagggugauauaaaaacauuggaagucuuuucaccaaacc

SEQ ID NO: 87290 - RNA, 64 nt, hsa
uuuucuuaaaagucuaagauagcagaaaauacaguaaaaacacaggagaagaagcugagcuauu

SEQ ID NO: 87291 - RNA, 64 nt, hsa
guggagcacaaaaggagauuuucauauaacuuguuaaaaacauguucuaagucauguauaggcu

SEQ ID NO: 87292 - RNA, 64 nt, hsa
ggaggggagugaacagugccuauuguugaaaaguuaaaaacaaccaagugccaagauguugagu

SEQ ID NO: 87293 - RNA, 64 nt, hsa
gcacacaguaggcacucaauaaauauguauugauuaaaaacaaagacgucuucaauaugccaga

SEQ ID NO: 87294 - RNA, 64 nt, hsa
ugugacagaaguaaauauagugcgucauaauugcuaaaaacagggugaauuucuuucacuuaag

SEQ ID NO: 87295 - RNA, 64 nt, hsa
uuuaaaaauuaggcuuauugcuagacuguaaguuuaaaaacaauucauguucaaaggagcuuuu

SEQ ID NO: 87296 - RNA, 64 nt, hsa
aaauauaaugcuaguccuagauuacuuauugauuuaaaaacaaaaaaaagauuacuuaauuuug

SEQ ID NO: 87297 - RNA, 64 nt, hsa
uuaaaaacaaaaaaaagauuacuuaauuuugauuuaaaaacaaaaaaucguaaaauacaaaaac

SEQ ID NO: 87298 - RNA, 64 nt, hsa
cucauggcuuugaucuucaaaaggaagagccuuuuaaaaacauuugccaaccucaagaauaaau

SEQ ID NO: 87299 - RNA, 64 nt, hsa
uugaaaaccgugaauuaagauauucuuaucaguauaaaaacacugagauugcuuaccucccaaa

SEQ ID NO: 87300 - RNA, 64 nt, hsa
cuuuauacagaagcacaaccuuaucauuuuuaaauaaaaacagggaaaugguuuaacaaacuag

SEQ ID NO: 87301 - RNA, 64 nt, hsa
auuuugagucuugcauuacuuuuuguuccuuuuuuaaaaacacaagagcacugaaucaaaagaa

SEQ ID NO: 87302 - RNA, 64 nt, hsa
ugagguaauacugauuuugaaaauauauauaagcuaaaaacaguauuucguugauaucaguagu

SEQ ID NO: 87303 - RNA, 64 nt, hsa
auaauacagagaauagcuauaagcucauugacaguaaaaacaacaaaccaggauucuacuguuu

SEQ ID NO: 87304 - RNA, 64 nt, hsa
agaaaauacaagagaaaauuauaauguaaaaugguaaaaacauaaguaguuuuuuuuucaauua

SEQ ID NO: 87305 - RNA, 64 nt, hsa
caauagaugacacugaugguuuuacuccuuuuuuuaaaaacacaugcgcgcgcacacacacaug

SEQ ID NO: 87306 - RNA, 64 nt, hsa
ugugaaauauuauuuuauuauuuuaccaagauuauaaaaacacuuuuacaaaaaaacaaaaacc

SEQ ID NO: 87307 - RNA, 64 nt, hsa
uccuccacugacuacugacucaaaaauaaaauaauaaaaacaaauuuuuuuaagcacuggggau

SEQ ID NO: 87308 - RNA, 64 nt, hsa
gauuuaaagcacuuuuaaaucuuauccugcccccuaaaaacaaaagguuuugaucacaagggga

SEQ ID NO: 87309 - RNA, 64 nt, hsa
aaccaugcaauuaccugccuuaguucuuuugucauaaaaacaaucacuugguugguuguauugu

SEQ ID NO: 87310 - RNA, 64 nt, hsa
uucugguuagcuaauugaacuuuugugaccuguuuaaaaacaaaucaaauuuauugaacaaaug

SEQ ID NO: 87311 - RNA, 64 nt, hsa
cuccagcccguaugacagagugagacccuguuucuaaaaacaaaacaaacaaacaaacaaacaa

SEQ ID NO: 87312 - RNA, 64 nt, hsa
auauuuaauuaugguuuucuugaaacguguaaauuaaaaacacaaucaguguucaggcuucagu

SEQ ID NO: 87313 - RNA, 64 nt, hsa
gaugugaccacacucuucuuaauuuuguucacaguaaaaacacuuuuuugaguuauuaggcuua

SEQ ID NO: 87314 - RNA, 64 nt, hsa
ucccaagcccuaaagagaaccuucucacaagaauuaaaaacaaaaagggcaaaccuaggaagcu

SEQ ID NO: 87315 - RNA, 64 nt, hsa
auauauauauauauuuaucugaaacgugauauuuuaaaaacauguagguuuaacaaaccuuccu

SEQ ID NO: 87316 - RNA, 64 nt, hsa
auaaaucaagacuucugugugcucuuaaauauauuaaaaacaauuuacauuucaggaauucugu

SEQ ID NO: 87317 - RNA, 64 nt, hsa
guaucagguacauuccagccuguuggcaacuccauaaaaacauuucagauuuuaauccgaauuu

SEQ ID NO: 87318 - RNA, 64 nt, hsa
gcuucaacaguauugccagguuccuaaaauugucuaaaaacaugauuuggcuuccauuuuugca

SEQ ID NO: 87319 - RNA, 64 nt, hsa
aaaucauggaagauugcauaccugugugguauuuuaaaaacaaguugacuuuuucaguuucuug

SEQ ID NO: 87320 - RNA, 64 nt, hsa
ggaguagugauaaacaccuuaaucauaaaaugaauaaaaacaaaaaaaccauggggcuugucug

SEQ ID NO: 87321 - RNA, 64 nt, hsa
uuucuuccacuuuaauuuaaaaguucaugucauuuaaaaacaagucaagaaauuaaaauuguau

SEQ ID NO: 87322 - RNA, 64 nt, hsa
ugcuuuuauguguauuuuauauugcaugcuuuuguaaaaacaugcugggugaugaaagauuagu

SEQ ID NO: 87323 - RNA, 64 nt, hsa
ucguugggcuuuaaaagaaaagguuuggcagaacuaaaaacaaaacucacguaucaucucaaua

SEQ ID NO: 87324 - RNA, 64 nt, hsa
uacacccacagaacccggcuuuguccccaaagaauaaaaacaccucucuaaaagcugcucuucc

SEQ ID NO: 87325 - RNA, 64 nt, hsa
uugcucacugcaggcaggcaauccaggcagucguuaaaaacacagagagagguguccuccugac

SEQ ID NO: 87326 - RNA, 64 nt, hsa
uccuucauuacucaucacauccccgaugcuaaauuaaaaacagaaaacaaagaaaagcuuguau

SEQ ID NO: 87327 - RNA, 64 nt, hsa
gaacggguacuacacuuuaucuuaauucuuaauuuaaaaacauguuuacaaguuacaaccaacu

SEQ ID NO: 87328 - RNA, 64 nt, hsa
agcacuuuuuagauuuuuuuuucucuuuccuccuuaaaaacaaaauuuauauauagauauauau

SEQ ID NO: 87329 - RNA, 64 nt, hsa
cuaauguucuuccuuuuacauccuggaacaacaauaaaaacauuuuuuuaaacuugucuacugu

SEQ ID NO: 87330 - RNA, 64 nt, hsa
uuuuuuuuuuuuuuuacugcauguuacauugaaauaaaaacaaaguaaaaugagcaauugccuu

SEQ ID NO: 87331 - RNA, 64 nt, hsa
gugcagggcaauguuucaaaguuuagucacagcuuaaaaacauucagugugacuuuaauauuau

SEQ ID NO: 87332 - RNA, 64 nt, hsa
ccucccaugaaauugcguucuuccugcauugaaauaaaaacauuauugggaaacuagagaacac

SEQ ID NO: 87333 - RNA, 64 nt, hsa
cgugugugucuaauuuuuuuuccuguugaauggguaaaaacaaaacaaaacuuuuuuuagaaga

SEQ ID NO: 87334 - RNA, 64 nt, hsa
aucagacugaucuaaugugaaauguaaguauccuuaaaaacaaagcaucuauuuuggcagaaau

SEQ ID NO: 87335 - RNA, 64 nt, hsa
uauuaugcugauggagcaugcuuuuuaaauccuuuaaaaacacucaccauauaaacuugcauuu

SEQ ID NO: 87336 - RNA, 64 nt, hsa
uucuaccaguguuucaauuuaaagugcuaguguuuaaaaacauuuucaagggauaaggccuucu

SEQ ID NO: 87337 - RNA, 64 nt, hsa
uuuaagaaaagauaaacaccauuuuauuuauuuauaaaaacaaaauuaguuucaaauauuuuug

SEQ ID NO: 87338 - RNA, 64 nt, hsa
uacauugaccagcgcugggugauacagauucugauaaaaacauaaauguauuaguucaucucca

SEQ ID NO: 87339 - RNA, 64 nt, hsa
cugugugucugagcccacucagcagcaggcaugaucagggcagggcccagcgcuaagggcugcu

SEQ ID NO: 87340 - RNA, 64 nt, hsa
ugugagcgaccacauccggucaaguucugacuuuucagggcagugggauggugacuucugagcu

SEQ ID NO: 87341 - RNA, 64 nt, hsa
auuaacucucccugaugugugcuggguugagaggucagggcacuuucaaucccucaccuagucc

SEQ ID NO: 87342 - RNA, 64 nt, hsa
gggugugaggcaugagcugggggggcccccuuuuucagggcagagaaugaggcgugugcacugu

SEQ ID NO: 87343 - RNA, 64 nt, hsa
acugaucacaggugucaccguaguggcuaccaccucagggcagccccucccuccagcuggcggg

SEQ ID NO: 87344 - RNA, 64 nt, hsa
uaauaauuugaaauucaucuucuuaagauaaaaaucagggcagggugugguggcuuaugccugu

SEQ ID NO: 87345 - RNA, 64 nt, hsa
cucaggguguucugcugguugucugaugauggugucagggcagcuaaggacaggauaaaggccu

SEQ ID NO: 87346 - RNA, 64 nt, hsa
ucagagaacuugcuuaaucuuccauauauucugcucagggcacuugcaauuauuagguuuuguu

SEQ ID NO: 87347 - RNA, 64 nt, hsa
ucccacgugcaaaaucaacaucaggaacccagcuucagggcaucgcggagacgcgucagauggc

SEQ ID NO: 87348 - RNA, 64 nt, hsa
acuuuuccucauucuuaauaggugucuaagaaugucagggcaaaaguaugggcauuuuucuugc

SEQ ID NO: 87349 - RNA, 64 nt, hsa
ggaugcuccuggagccucuucucuggcugcuaccucagggcaugguuguggccccaccaacacc

SEQ ID NO: 87350 - RNA, 64 nt, hsa
gcccaggcagcucauucacuaccugugauccaccucagggcacgggcaaacacauaggcuugcg

SEQ ID NO: 87351 - RNA, 64 nt, hsa
accccguuguaaugugccacaacacccucaauagucagggcaacugguggagcauggaagucga

SEQ ID NO: 87352 - RNA, 64 nt, hsa
agauuccuuucuccugcuucauauaggccaaaccucagggcaagggaacauggggguagagugg

SEQ ID NO: 87353 - RNA, 64 nt, hsa
uuugacaugccuuuuccacaaaucucuugccuuuucagggcaaaguguauuugaucagaagugg

SEQ ID NO: 87354 - RNA, 64 nt, hsa
cagugaugaaauggaccccuccacacaggcauccucagggcacagggcccugggggcaccuucc

SEQ ID NO: 87355 - RNA, 64 nt, hsa
aaaugacaggaauuccagagccaggugcauccacucagggcagccaguguugguggagcugccu

SEQ ID NO: 87356 - RNA, 64 nt, hsa
agcuuccuccaggguuccccagccaccucccagcucagggcacaguguaucgacaaucugucag

SEQ ID NO: 87357 - RNA, 64 nt, hsa
agaggacaccuccccaucacucagcauucccagcucagggcacaggcaggcugggguccucgcu

SEQ ID NO: 87358 - RNA, 64 nt, hsa
cuuugcaaccgacagcaaacagcuuucuccggccucagggcagaaaaagggaauggcagggagu

SEQ ID NO: 87359 - RNA, 64 nt, hsa
aggacacagccaggacggcagaggccuccuggccucagggcaugcccugccuaccuucugaaau

SEQ ID NO: 87360 - RNA, 64 nt, hsa
gugaccugggacgggugggccugaggugcccagcucagggcagccagguggcucaugggcugua

SEQ ID NO: 87361 - RNA, 64 nt, hsa
cagucagggagggagggagugucccaccacguucucagggcagcccuugacuccuaagccccuu

SEQ ID NO: 87362 - RNA, 64 nt, hsa
uuaucuaaaauuagccagcucuuccugucagggaucagggcagcacuaacaggcgcaaaaguag

SEQ ID NO: 87363 - RNA, 64 nt, hsa
guuucuauagccccuaugauuagacacuucagugucagggcacagauuaucuaaaauuagccag

SEQ ID NO: 87364 - RNA, 64 nt, hsa
aacauuaccuaaaaggcacuaacaugcucagguuccccagaaagaggcguaagaagggccucuc

SEQ ID NO: 87365 - RNA, 64 nt, hsa
agcuucaaggcucacaauggaagcacugucauuuccccagaaaagcuguguucccuaugcugaa

SEQ ID NO: 87366 - RNA, 64 nt, hsa
ugccuucucuaugcagccugcccuccaucauccaccccagaauugcucucuuuccucucuuagc

SEQ ID NO: 87367 - RNA, 64 nt, hsa
guccuggaggcagguugugcagcuuaggggaggaccccagaaucuggaccccagagucuggaag

SEQ ID NO: 87368 - RNA, 64 nt, hsa
cugaugugaaagagauucuggaaauccaaauguuccccagaaauucugauaucaaaacauucca

SEQ ID NO: 87369 - RNA, 64 nt, hsa
ugcagggccccuccacgcccacucuucccuuguuccccagaaguagagggcucugggugcccau

SEQ ID NO: 87370 - RNA, 64 nt, hsa
ugcgggacgagaaccaguaggcccuguucugggcccccagaaccccuuccucuccacugcaggc

SEQ ID NO: 87371 - RNA, 64 nt, hsa
uucccccgccgccacugugccccccgucccuccaccccagaagcccugaccucauuugggcacc

SEQ ID NO: 87372 - RNA, 64 nt, hsa
cagcucugccucgcagcccccucagcaugggugcccccagaaguaagcagcucuuggacccacg

SEQ ID NO: 87373 - RNA, 64 nt, hsa
gggcccagcuugcucagucaaggggcugccaggcccccagaaaacacuuggagccaucggguag

SEQ ID NO: 87374 - RNA, 64 nt, hsa
cagugugcaugcaacacacuuaggggaggaguggccccagaauucagcacgcacacaacacaca

SEQ ID NO: 87375 - RNA, 64 nt, hsa
acauucuccucuggggcucuaccucuccacacuuccccagaagggaaaagggcacccuggauua

SEQ ID NO: 87376 - RNA, 64 nt, hsa
aaaucacuccuuggugggcagcauccugaggcuuccccagaaccaggccucugcucuggcccuc

SEQ ID NO: 87377 - RNA, 64 nt, hsa
aaggaaagggaagaagagaucacgaaacugggacccccagaagggaggagugggcuuugaacuu

SEQ ID NO: 87378 - RNA, 64 nt, hsa
gugggggaggggggagagucaggaauaaggggauccccagaagugcagagcugagcaggcuugg

SEQ ID NO: 87379 - RNA, 64 nt, hsa
uggcuuggaaaggggucagcagggugaaaccgaaccccagaaaacuugaugaagaaaugucuuu

SEQ ID NO: 87380 - RNA, 64 nt, hsa
aagaggacugagaauacuuuggcuuaaauuuugcccccagaaucuuguuguuugccuacugaag

SEQ ID NO: 87381 - RNA, 64 nt, hsa
uggcgcuguuggggagacuccuccagaccaggaaccccagaaggagacagagccugccacaucc

SEQ ID NO: 87382 - RNA, 64 nt, hsa
ggaagcugaccgcacaguguccagacgaauuggcccccagaagauggggaguucuguccugccc

SEQ ID NO: 87383 - RNA, 64 nt, hsa
aaguaaaaggcucaucaguuuuagcaucucugcuccccagaaaauuguaagcauccucaccagc

SEQ ID NO: 87384 - RNA, 64 nt, hsa
auaaaacaaggacuuauucacacauguucuagaaccccagaauggcccaaguuaccugagacca

SEQ ID NO: 87385 - RNA, 64 nt, hsa
ggggccagcacaguagugaaggcggucuccuggaccccagaagcgugcugugguguggacuggg

SEQ ID NO: 87386 - RNA, 64 nt, hsa
aaggagcugcuucucucuucucccaguucuaccuccccagaagccuuccuccccagguggggcu

SEQ ID NO: 87387 - RNA, 64 nt, hsa
ggacaccugaggcagccagcgcccccuccccaguccccagaacugccugcaggugccuuguugc

SEQ ID NO: 87388 - RNA, 64 nt, hsa
cugaaggggagcucugagacagagcaaacacccaccccagaacaagccgacacacagggagacg

SEQ ID NO: 87389 - RNA, 64 nt, hsa
gcacuccugcuuuugugggaaaaauuuucuucuuccccagaagaguuaacaguugaguguucag

SEQ ID NO: 87390 - RNA, 64 nt, hsa
gguuuauggauaggcuucaagagggucugugagcccccagaaauugugugugagacugaguaug

SEQ ID NO: 87391 - RNA, 64 nt, hsa
ccaggagcucggacugcugguccuggagagcugcccccagaagaagcuggagugcauaggucag

SEQ ID NO: 87392 - RNA, 64 nt, hsa
ccccaccgccauuggcauccccaccaagcuccucccccagaacccugaggccaagggggccacu

SEQ ID NO: 87393 - RNA, 64 nt, hsa
ugucuccucuccugauuuccuccaaucucuguagccccagaagugaacgccagacaggaacacg

SEQ ID NO: 87394 - RNA, 64 nt, hsa
caaacguucaguucaagucuccacaggaauucaaccccagaaagacauaaacuuggaguccauc

SEQ ID NO: 87395 - RNA, 64 nt, hsa
uggcccccucaaagaauuucuguggggauuuguaccccagaauccuguucccccaucccuucuc

SEQ ID NO: 87396 - RNA, 64 nt, hsa
cugacacccaaauccagaaucccuggucuugaguccccagaacuuugccucuugacugucccuu

SEQ ID NO: 87397 - RNA, 64 nt, hsa
gagccgccugcccuuucucuccgcuccagccucuccccagaacggcucuuuuugucacacagga

SEQ ID NO: 87398 - RNA, 64 nt, hsa
aguuccucuccauccgccaccuccccucccgcugccccagaaguuucuaucauuccauggagaa

SEQ ID NO: 87399 - RNA, 64 nt, hsa
aguuucgcucagagcuugucuccuuggcuuccaaccccagaaaugccugcugggccuuaagcuu

SEQ ID NO: 87400 - RNA, 64 nt, hsa
acaggccaacccuggcacaggucaugucugcagcccccagaauguucuggacaugcaccaccag

SEQ ID NO: 87401 - RNA, 64 nt, hsa
gccagucucuggcuguggcuccccagaacaggauccccagaagcaggcugaagaggaaaggcag

SEQ ID NO: 87402 - RNA, 64 nt, hsa
aggagagcccaggagccagucucuggcuguggcuccccagaacaggauccccagaagcaggcug

SEQ ID NO: 87403 - RNA, 64 nt, hsa
cuucaccaggggaugggcaggaaagaggcaggggccccagaagcuucugucccucaugccugag

SEQ ID NO: 87404 - RNA, 64 nt, hsa
gacucccagacugcaggggagcacuuggggcagcccccagaaggaccacugcuggaucccaggg

SEQ ID NO: 87405 - RNA, 64 nt, hsa
gaaggggugaggagagcagccagaggaaaaccagccccagaaugcugcaacuucucuucucucu

SEQ ID NO: 87406 - RNA, 64 nt, hsa
ugccagccugagugggcaaggaagcagguggaucccccagaaggaaccgcagcucgcgaggcac

SEQ ID NO: 87407 - RNA, 64 nt, hsa
gguaccuggagcgagagcuucuccgcccuuccaccaaccccacaggccgcuucgcggguggagc

SEQ ID NO: 87408 - RNA, 64 nt, hsa
auagagaaauaacuuuuucuugcucauucccuuacaaccccaaucuauacauggauuuuuagaa

SEQ ID NO: 87409 - RNA, 64 nt, hsa
ugcguggcuguuccccuuggcuggagcauucagccaaccccagcguccccccugaggcguucau

SEQ ID NO: 87410 - RNA, 64 nt, hsa
gguggugguaagccgccaacgcaccugggggcugcaaccccaccggacgggugguccggaggga

SEQ ID NO: 87411 - RNA, 64 nt, hsa
gcccagucccgcaguacauccccuguccccuccccaaccccaagugccuucaugcccuagggcc

SEQ ID NO: 87412 - RNA, 64 nt, hsa
caaagccuucugggcugucggggcccaaccugcccaaccccagcacuccccaaagugccugcca

SEQ ID NO: 87413 - RNA, 64 nt, hsa
uucguccccuauucauuaacagugugugcaaaugcaaccccaggacacauuauuguucugauag

SEQ ID NO: 87414 - RNA, 64 nt, hsa
gcccugcucauguuuuuuuccuguccccuuagaccaaccccagguguccacugcagggguucug

SEQ ID NO: 87415 - RNA, 64 nt, hsa
aaauucuaguuguuauuugguggaagcaguagcccaaccccaguuuaggggaagguagcacagg

SEQ ID NO: 87416 - RNA, 64 nt, hsa
gaauaugcugaccuuucacccugccaucccaucccaaccccagcucacuagccuucauauaugc

SEQ ID NO: 87417 - RNA, 64 nt, hsa
gucugaggaucugacuugggucuuggaaggguuccaaccccaagucagucaggaagcugcccau

SEQ ID NO: 87418 - RNA, 64 nt, hsa
caucgacaaggcgcauaauggagaguugguaucucaaccccaagcucccuuugcuguaccuggg

SEQ ID NO: 87419 - RNA, 64 nt, hsa
cuucuuggugccccaucucuugucuguguccuuccaaccccaagcugcuuauguggcccaaccc

SEQ ID NO: 87420 - RNA, 64 nt, hsa
uguguccuuccaaccccaagcugcuuauguggcccaaccccacugcugucaacuaggcuugaac

SEQ ID NO: 87421 - RNA, 64 nt, hsa
acacaaucagaaaugacaaaggggacauuaccaccaaccccacagaaauacgaaaaacccucaa

SEQ ID NO: 87422 - RNA, 64 nt, hsa
auaaagaacucaaacaaaucaacaaugagaaaaacaaccccauuaaaaacugggcaaaggccau

SEQ ID NO: 87423 - RNA, 64 nt, hsa
ugccaagcuuggaucauggcccuaaucccaaccccaaccccaugggaggaggaggaggaggaag

SEQ ID NO: 87424 - RNA, 64 nt, hsa
cagggaugccaagcuuggaucauggcccuaaucccaaccccaaccccaugggaggaggaggagg

SEQ ID NO: 87425 - RNA, 64 nt, hsa
auagugacauagcuagagcgcagaguuccugauuccaagucaccugugcuuucugggaccaaag

SEQ ID NO: 87426 - RNA, 64 nt, hsa
cugaagcaaccaaagauauauccaagugcuuccuccaagucaacauguauuuccucuccccauu

SEQ ID NO: 87427 - RNA, 64 nt, hsa
ccuugguacagugguuuuuaaauacugagaagaaccaagucagguuuuuuaaagcagacuaaaa

SEQ ID NO: 87428 - RNA, 64 nt, hsa
gauggucuccacaggucuuuccaccucugugaguccaagucaggucaaucagcaaggacccauc

SEQ ID NO: 87429 - RNA, 64 nt, hsa
aaauguuagauaugugggaaaggccuuuauucugccaagucauuucgaagacaugaaaaaacuc

SEQ ID NO: 87430 - RNA, 64 nt, hsa
aaauguaagauaugugggaaaggcuuuuauucugccaagucauuucaaauaccugaaaaaucuu

SEQ ID NO: 87431 - RNA, 64 nt, hsa
uccccuagggccuggaagggugggagguaugucuagggggcagugucucuuccagggggaauuc

SEQ ID NO: 87432 - RNA, 64 nt, hsa
caggggaggggaaaccuuuuucauucaacauuguagggggcaagcuuuggugcgcccccugcug

SEQ ID NO: 87433 - RNA, 64 nt, hsa
gcccggccgucugucucuugguauuggguaaaggagggggcaccugcaugucuccugcaaugag

SEQ ID NO: 87434 - RNA, 64 nt, hsa
uccaauuuuauauuuaagggggguggugggugggagggggcaaguaaagacggaacaaguuuag

SEQ ID NO: 87435 - RNA, 64 nt, hsa
ggcaaaggaaccacccuacccauuuggccucuggagggggcagaagaaagaaauaaaccucauc

SEQ ID NO: 87436 - RNA, 64 nt, hsa
cugacagcccaacaccaccuuccuccuggcuuccagggggcagcccaguggaauggaaagaaug

SEQ ID NO: 87437 - RNA, 64 nt, hsa
cugagaccucaggcaggauuggagaucaaaccagagggggcaggcccccagccugcucucuagg

SEQ ID NO: 87438 - RNA, 64 nt, hsa
gaggagagggcugaggagggcagaagggcuaggcagggggcaaauugagccccucccuucccca

SEQ ID NO: 87439 - RNA, 64 nt, hsa
cucaggggccuucccuggggguggccagccugguagggggcagagaaggaaaagcugagggggg

SEQ ID NO: 87440 - RNA, 64 nt, hsa
gacaagcccacugggucugguccaggugaggggcagggggcauggggcugggaggucucagggg

SEQ ID NO: 87441 - RNA, 64 nt, hsa
cugucggagggcuggacauuuguggcagugcugaagggggcauugccggcgaguaaaguauuau

SEQ ID NO: 87442 - RNA, 64 nt, hsa
cuuagaggggaaugaaccauggcaccuuugagagagggggcacuguggucaggcccagccucuc

SEQ ID NO: 87443 - RNA, 64 nt, hsa
gaacuggcugggcuugucagggggcaccccaaagagggggcacugccagguagcugggggagug

SEQ ID NO: 87444 - RNA, 64 nt, hsa
cccuuuugacuggaaugaacuggcugggcuugucagggggcaccccaaagagggggcacugcca

SEQ ID NO: 87445 - RNA, 64 nt, hsa
ggggacccagggaacaucggucuacucaggugugagggggcaggucugaccugccccaaaguug

SEQ ID NO: 87446 - RNA, 64 nt, hsa
acaugccuucccuccccagccacaccgugcacgaagggggcacaggagaggagaggggcugugc

SEQ ID NO: 87447 - RNA, 64 nt, hsa
ccaaauagaaggggucuggcccgggcauccacguagggggcaggggcaggggcgggcggaggga

SEQ ID NO: 87448 - RNA, 64 nt, hsa
uuggagggggaagagaucccaggaggugcaguggagggggcaagcuuugcuccuucaguucugc

SEQ ID NO: 87449 - RNA, 64 nt, hsa
gcaaaccuaccccggaucucuggcuucagccgccagggggcaguggcagcccuggggcccuuuc

SEQ ID NO: 87450 - RNA, 64 nt, hsa
cccuuccaccuuuccccgagaccgucgucgcuggagggggcaggguccagcccgccuggaucgg

SEQ ID NO: 87451 - RNA, 64 nt, hsa
cuucagggugaggcugcuggcgagggcaggggagagggggcauucugguuaaaagcaagaaauu

SEQ ID NO: 87452 - RNA, 64 nt, hsa
aaggggcccccugugaccgaggagcaggguccccagggggcagcucccacggagcgggcuugaa

SEQ ID NO: 87453 - RNA, 64 nt, hsa
cuaccccuagugcuagucccagaggaugcugcggagggggcagccucagcucucuuuucagaga

SEQ ID NO: 87454 - RNA, 64 nt, hsa
uggcucuaggcuugggacugcggcugccacaggaagggggcaucccccuacuuuggguguuggg

SEQ ID NO: 87455 - RNA, 64 nt, hsa
gcuacagccaggccggcugccucaucucagcucuagggggcacgagccauauggggucugcaca

SEQ ID NO: 87456 - RNA, 64 nt, hsa
cuacugcuccuucuccccuugcacagggaaaugcagggggcaggacuugggagguuccagcagg

SEQ ID NO: 87457 - RNA, 64 nt, hsa
ggucucugugggugggaaugcaagugaacuugggagggggcacgggccuguagaucagggauag

SEQ ID NO: 87458 - RNA, 64 nt, hsa
cccuagcccuucuaccccaccugaccucugcaagagggggcauugauacaucaucgggaaaaaa

SEQ ID NO: 87459 - RNA, 64 nt, hsa
cccggcucuacgggggccgcguggugccauccccagggggcaugaccagaugcgucccaagaug

SEQ ID NO: 87460 - RNA, 64 nt, hsa
cugcguccuuugguccuguccccgcagcccuggcagggggcaugcggucgggcaggggcuggag

SEQ ID NO: 87461 - RNA, 64 nt, hsa
cuguugcuaggaggggcacauggagugggacaggagggggcaccuucuccagaugaugucccug

SEQ ID NO: 87462 - RNA, 64 nt, hsa
aggagggggcaccuucuccagaugaugucccuggagggggcaggagguaccucccucucccucu

SEQ ID NO: 87463 - RNA, 64 nt, hsa
cuccuuccccuacaaucccauccugagccauugcagggggcagggaaguucacccccccccacc

SEQ ID NO: 87464 - RNA, 64 nt, hsa
cccgacuuuccucugggauauaaaaaaggggguaagggggcaaagagagcccucugggccucuc

SEQ ID NO: 87465 - RNA, 64 nt, hsa
cucugccccagugcucucuugcugucugcugacaagggggcauggagcaucucuuccucuucug

SEQ ID NO: 87466 - RNA, 64 nt, hsa
aguggacucugugcucacuggguggagcuguggcagggggcacugagccuccagacccugcuaa

SEQ ID NO: 87467 - RNA, 64 nt, hsa
agguugccuuggugcugccccagaucuguccagcagggggcaguaagugaucuugguaguaucc

SEQ ID NO: 87468 - RNA, 64 nt, hsa
ucagaagcuguugcuacugcgucucucugucugcagggggcacuuguuccugagguccucgccu

SEQ ID NO: 87469 - RNA, 64 nt, hsa
cugugacugugcagcgcccguggugaucugggguagggggcaccccuacagugggaccccuccc

SEQ ID NO: 87470 - RNA, 64 nt, hsa
cuaccccuuccaugcucaucucacugcccagugaagggggcaagggcagcgaggggcaggaccc

SEQ ID NO: 87471 - RNA, 64 nt, hsa
cuggggcuacccaugggcaaguggggcucgggguagggggcacugcuugaagcacagcacuugg

SEQ ID NO: 87472 - RNA, 64 nt, hsa
gagggaagaugggugcugggagaggguugggggcagggggcaaggaaaauugcuaccugauuug

SEQ ID NO: 87473 - RNA, 64 nt, hsa
cuguggcugccaggucugggccacauggcagcccagggggcaggagaagcccgggagaggccca

SEQ ID NO: 87474 - RNA, 64 nt, hsa
uuauaaacugaaccaugaccuuuauggcgcaugcagggggcaaccugcauaauuaucaauggcg

SEQ ID NO: 87475 - RNA, 64 nt, hsa
cucccauuucuguccuuggccuugggaguagcugagggggcagacuagggaguagggcuggcag

SEQ ID NO: 87476 - RNA, 64 nt, hsa
gagggggcagacuagggaguagggcuggcaggggagggggcagacagccucgccucgcacccuu

SEQ ID NO: 87477 - RNA, 64 nt, hsa
gggcacugcccggcccggcugugaggagggcggcagggggcacggccuccagcuuccaaagagc

SEQ ID NO: 87478 - RNA, 64 nt, hsa
agcgcugggcccucccuugcccccaagcucaagaagggggcacugcccggcccggcugugagga

SEQ ID NO: 87479 - RNA, 64 nt, hsa
cgucuucuccccagccccguccucccaccaccccagggggcaggcaggcaggcccccucccgug

SEQ ID NO: 87480 - RNA, 64 nt, hsa
caagauaucacugacuucaacccagaggaucgagccccugcacccugccuggggcccuggggug

SEQ ID NO: 87481 - RNA, 64 nt, hsa
ugugcuguccuagggggagggagagcagagcucgccccugcacugcagccuugugggggagggc

SEQ ID NO: 87482 - RNA, 64 nt, hsa
ugccuaggcuggagugcaguggcgcgaucuuggcccccugcaaccuccgccucccggguucgag

SEQ ID NO: 87483 - RNA, 64 nt, hsa
guggcggugcgcacgggccuccagccgugccuucccccugcaggccccgucugcugggccugcu

SEQ ID NO: 87484 - RNA, 64 nt, hsa
gggaaaccucccgaccccugcaccuucguuggagccccugcauccccuggguccagcccccucu

SEQ ID NO: 87485 - RNA, 64 nt, hsa
caggauaagccucaggcccugggaaaccucccgaccccugcaccuucguuggagccccugcauc

SEQ ID NO: 87486 - RNA, 64 nt, hsa
uuggccaccauuaaacacggggugggggugagggccccugcaauucacggugcaauauucacca

SEQ ID NO: 87487 - RNA, 64 nt, hsa
auggagcagaauacuuaagccuggcccccaaaugccccugcacacacacgugccacaccugcgc

SEQ ID NO: 87488 - RNA, 64 nt, hsa
uucacaguucaagcaccccaaaccugcccuuucuccccugcagacuggcaggugggauuggcuc

SEQ ID NO: 87489 - RNA, 64 nt, hsa
accugagguccuggcuccccacccuggcccccugccccugcacucccaugggaaugccgcaggg

SEQ ID NO: 87490 - RNA, 64 nt, hsa
gugacuagacguccuaacugggcagcccaacccuccccugcaaguuuguagcucaaguuguaau

SEQ ID NO: 87491 - RNA, 64 nt, hsa
accauuaggaaaauauggccauacugcuuuuuuaccccugcacuauuucagugcaccacagaau

SEQ ID NO: 87492 - RNA, 64 nt, hsa
cccugaaccccuggguggguggcacagcagugccccccugcagccuuccccucuacacaggaca

SEQ ID NO: 87493 - RNA, 64 nt, hsa
uuuuuggucuuggcucguauacuaggcuuaggguccccugcaugcccugaaccccugggugggu

SEQ ID NO: 87494 - RNA, 64 nt, hsa
cuguggaguggggagguugggccuggacccucaaccccugcaaccuucccuagcccccucaaua

SEQ ID NO: 87495 - RNA, 64 nt, hsa
cagcccagccccaguacugccaccuuuacaccuaccccugcaaguccccagagggcugcccacg

SEQ ID NO: 87496 - RNA, 64 nt, hsa
aaugaggcugaguguuuguuucuacugaucaaugccccugcagguugcauuuauuguaaugaaa

SEQ ID NO: 87497 - RNA, 64 nt, hsa
ucuaaaaauguuuaaauauauaccaaacaguggcccccugcauuaguuuucuguugccacugca

SEQ ID NO: 87498 - RNA, 64 nt, hsa
augugguggggacagcgcauugcgaccuccaccaccccugcagugggcugccagcugagccacc

SEQ ID NO: 87499 - RNA, 64 nt, hsa
cacagagagacaguucucagucagcacuuccuguccccugcagaggcucauaggggacagcccc

SEQ ID NO: 87500 - RNA, 64 nt, hsa
cauuugaacgccagguaucuccccuccucucucuccccugcagaggcauguagggaacagcagg

SEQ ID NO: 87501 - RNA, 64 nt, hsa
cauuggucccagaguagcugaagggaagccaaccccccugcagcacaaauaggccccccagucc

SEQ ID NO: 87502 - RNA, 64 nt, hsa
gugggcaggugauucugugggcaggggaugugcuccccugcaccucuggggugcagaaaccucu

SEQ ID NO: 87503 - RNA, 64 nt, hsa
agaugggacagccagcccugccuaucuggacaggccccugcagccucuguccccuggccuagcc

SEQ ID NO: 87504 - RNA, 64 nt, hsa
uuggacuuggaaggugugcggggacuggccgaggccccugcacccugcgcaucaggacugcuuc

SEQ ID NO: 87505 - RNA, 64 nt, hsa
cuguuaacacuguguccugggggggcugggaaguccccugcaucccaugguacccugguauugg

SEQ ID NO: 87506 - RNA, 64 nt, hsa
gagcccucccugaaccccugcaacccucccugaaccccugcaaaugaaaccaaacguccaccug

SEQ ID NO: 87507 - RNA, 64 nt, hsa
cuuccccgguugugggacaagagcccucccugaaccccugcaacccucccugaaccccugcaaa

SEQ ID NO: 87508 - RNA, 64 nt, hsa
gcuugggucucucucggccccugucuguucccagccccugcagauucugagcaaaggcccuggg

SEQ ID NO: 87509 - RNA, 64 nt, hsa
cagggcagggcgagcugcaggaaucaccccucugccccugcagcuggaaugugccacagaggcc

SEQ ID NO: 87510 - RNA, 64 nt, hsa
ggaguccgaugguuuucagcaggagacgggguguccccugcagggggcuaaacugcaggggccu

SEQ ID NO: 87511 - RNA, 64 nt, hsa
gguuccagccccuggcagggcuuccuuccaagggccccugcagccuacaaacugggccucgggc

SEQ ID NO: 87512 - RNA, 64 nt, hsa
agaaagcguagacccggggcccagggucugcccgccccugcagccuggccuccccgcacaggcu

SEQ ID NO: 87513 - RNA, 64 nt, hsa
gggugaagggcguccgcuggccacucugcaggggccccugcaggauuccaggcaccucccguuu

SEQ ID NO: 87514 - RNA, 64 nt, hsa
cuuugugucaccugccugcgcucuccagauaugaccccugcacccaccccccacagccugcccu

SEQ ID NO: 87515 - RNA, 64 nt, hsa
agaggcggguggagcgugaagcaggcuggaggugccccugcacgggagguggcguuugcuaacc

SEQ ID NO: 87516 - RNA, 64 nt, hsa
gggugguggaagcaggugucacggugcaagucucccccugcaccccucccccagcuugagccgu

SEQ ID NO: 87517 - RNA, 64 nt, hsa
gaagcagccccaacucaucacugggaaagaacucccccugcaaaccagcuaaauuugauaauuu

SEQ ID NO: 87518 - RNA, 64 nt, hsa
uagccagaugcccugcuccuggccaccuuuaaagccccugcauaugacacagguuaacuaaagu

SEQ ID NO: 87519 - RNA, 64 nt, hsa
aaacaggcacugcccugguggcccucuccccugcccccugcaggaaggagcugccuggacccgu

SEQ ID NO: 87520 - RNA, 64 nt, hsa
acccauuccuucccagaggggccugccaccuggaccccugcauuggaacuggaggcagggaaca

SEQ ID NO: 87521 - RNA, 64 nt, hsa
aggggcagagcacaccccagugcuuacgccuccaccccugcagccuccuggcccgcucaccuuc

SEQ ID NO: 87522 - RNA, 64 nt, hsa
cucccuuuuccccaggaaugaaccgaggccgucgccccugcacacgcacacgcacacagccugg

SEQ ID NO: 87523 - RNA, 64 nt, hsa
gauuggaugacugggaagcgcuggcccggaacagccccugcaacuguggggccugcacacagcc

SEQ ID NO: 87524 - RNA, 64 nt, hsa
cugcuccagugggccaaguugggcaggacccccgccccugcagggcccaugcaccagagccacu

SEQ ID NO: 87525 - RNA, 64 nt, hsa
uucucucuugccugcuccugucccuccagcacguccccugcaccacggcauagcuuaggugcgc

SEQ ID NO: 87526 - RNA, 64 nt, hsa
gggccuugcggcacaggacugugcccugugcuguccccugcaccccggcucagcugagcugggg

SEQ ID NO: 87527 - RNA, 64 nt, hsa
ucugucugggaggggggagugaaggggcccuagcccccugcacuccgccgccucagagccaugc

SEQ ID NO: 87528 - RNA, 64 nt, hsa
ccacuucaugaggggaggggcgaggggaagcccaccccugcaugcuucuggcuggagcaccucc

SEQ ID NO: 87529 - RNA, 64 nt, hsa
ccagagcagggaggugucguggaacuggguagacccccugcagcguuaggggcccauuuguggg

SEQ ID NO: 87530 - RNA, 64 nt, hsa
ccccugggcugcugcucugagcccaucuguucucccccugcaagaaggggcaaugcucuugugu

SEQ ID NO: 87531 - RNA, 64 nt, hsa
agagucacacccagggaccacgggaggauccugaccccugcagggcucaggggucagcagggac

SEQ ID NO: 87532 - RNA, 64 nt, hsa
cccuguccucguggugagucgcugaccacggcuuccccugcaggagccgccgggcgugagacgc

SEQ ID NO: 87533 - RNA, 64 nt, hsa
ugccugucccuggccugccuugauuucagccacaccccugcagcccugcaucccagcucugggg

SEQ ID NO: 87534 - RNA, 64 nt, hsa
ugagaacgcagugucaggugugggacuccuucugccccugcaguggguguuacgggcggugugc

SEQ ID NO: 87535 - RNA, 64 nt, hsa
gcagguggggggcucagccugcacccacuuggagccccugcaaggagcgaaccggucagcacca

SEQ ID NO: 87536 - RNA, 64 nt, hsa
uaggggacaagaguuugaacucaagggacugugaccccugcacacuggaguggcucauuguggc

SEQ ID NO: 87537 - RNA, 64 nt, hsa
acaccaucuucuaaaggcuuuugcccuacucagcccaaccuagaccuguagauuucccucuccu

SEQ ID NO: 87538 - RNA, 64 nt, hsa
uuguuaaauaauguaguuuuauauagcugauagaccaaccuauauccaaacuuuuauaaaauau

SEQ ID NO: 87539 - RNA, 64 nt, hsa
guugaggacuauuagaacugguuccccucaccacccaaccuacccaccuaugucauacugucuc

SEQ ID NO: 87540 - RNA, 64 nt, hsa
accuuaaagauacuguugguuuuacagaugcucuccaaccuauuuucuauaagaugagguagug

SEQ ID NO: 87541 - RNA, 64 nt, hsa
gaagaccuugucccaacucgaugggcacagccagccaaccuaagacuauguugguacuuggacu

SEQ ID NO: 87542 - RNA, 64 nt, hsa
uaaagaaaauaaagcugugauaaauacuguaauuccaaccuacauuagaaggucuaaguguagg

SEQ ID NO: 87543 - RNA, 64 nt, hsa
agagcaaagaaaggugacuggaaggguuccuaacccaaccuacuccccuuaggguguguaucca

SEQ ID NO: 87544 - RNA, 64 nt, hsa
cccaauagguuuuuuucugaucuucucccuccucccaaccuacacccucaaguagaccccagug

SEQ ID NO: 87545 - RNA, 64 nt, hsa
cuuaauuuuagugacguauuuuuguauauauaggccaaccuauaccacauccaaaauuauguau

SEQ ID NO: 87546 - RNA, 64 nt, hsa
uuuaagucaaguugagguuauuuuuguaagaaacccaaccuauuuuuuuugcagccuaaaaucc

SEQ ID NO: 87547 - RNA, 64 nt, hsa
gcagugcaagguggccuugggcacaguuuugcaaccaaccuacuccccuggaaagauggcuucc

SEQ ID NO: 87548 - RNA, 64 nt, hsa
gaagaaaauggagacaaacagaaggagggaaaaaccaaccuacucugaaagccuucagacauua

SEQ ID NO: 87549 - RNA, 64 nt, hsa
uggccgugaccucuauuuguuugcuuuuaauuugccaaccuaucgcugcuggcagcacuuuuug

SEQ ID NO: 87550 - RNA, 64 nt, hsa
uaacuuguauaaauuuuaggucaaauccuucaagccaaccuauacuaaaaauuaguuccauaau

SEQ ID NO: 87551 - RNA, 64 nt, hsa
aaaccagagaccaaaugucacguuuuguuuugugccaaccuauuuugaaguaccaccaaaaaag

SEQ ID NO: 87552 - RNA, 64 nt, hsa
accagcgauagugauugauacugcucaacacagcccaaccuauagugcccugugacuucucucc

SEQ ID NO: 87553 - RNA, 64 nt, hsa
ugggauuacaggagugagccacugugcccagccuccaaccuaauuugaguuucauuuguauuuu

SEQ ID NO: 87554 - RNA, 64 nt, hsa
ugcuucugauuuuucuugcauuuuaaauucucagccaaccuacagccaugaucuuuagcacagu

SEQ ID NO: 87555 - RNA, 64 nt, hsa
acgguggccuaggguacaggcaacaaugagcagaccaaccuaaauuuggggaaauuaggagagg

SEQ ID NO: 87556 - RNA, 64 nt, hsa
cauuccucccugcccaaucccagugcagucaaggccaaccuaggcagcagccaccuucucagga

SEQ ID NO: 87557 - RNA, 64 nt, hsa
aaaggcucaccuuuguggagaggauaaaaccugcccaaccuaccucaccaugguuuuucacauu

SEQ ID NO: 87558 - RNA, 64 nt, hsa
guuggagauuacgucuauguggaaccugcagaggccaaccuacaaccacauaucgucuguauug

SEQ ID NO: 87559 - RNA, 64 nt, hsa
acagaucuauuagguuggugcaauugcuuuugcaccaaccuaauauuugauggcagugguuuau

SEQ ID NO: 87560 - RNA, 64 nt, hsa
gcacuuuuaagguuuuuuuauauguguauaguuaccaaccuaaaaauaaaaaauccgaacagca

SEQ ID NO: 87561 - RNA, 64 nt, hsa
aggguggcauuggguuggacguucuggguacaagccaaccuagucccacguuguacgugaaugu

SEQ ID NO: 87562 - RNA, 64 nt, hsa
gucgguguguucaguaucacgcucaagacaagggccaaccuauuacuucacacaccucaaauac

SEQ ID NO: 87563 - RNA, 64 nt, hsa
aguaccauacuacaaauauuuaaaugcaaaauuaccaaccuauauagcaguuuuauuugcccua

SEQ ID NO: 87564 - RNA, 64 nt, hsa
uaugucuaccuccuccauuaugucuucgucucuuccaaccuaucuguucugucucccaauguac

SEQ ID NO: 87565 - RNA, 64 nt, hsa
uauauuuuggcacaauuauacacauuggaaagggccaaccuauuagggcucaaguauguauaug

SEQ ID NO: 87566 - RNA, 64 nt, hsa
aauaaaaagaaagucgcguuguuauauuucuaaaccaaccuaacaagaauuaagcagaguuggg

SEQ ID NO: 87567 - RNA, 64 nt, hsa
aucuuuguuuuguaugaucuauuuagaguuuuaaccaaccuagaucugucagcuaagcuaauuu

SEQ ID NO: 87568 - RNA, 64 nt, hsa
ucaaguuugcuggaaacauuguaucgaaaccgauccaaccuagagaccauuuuuaggaucauag

SEQ ID NO: 87569 - RNA, 64 nt, hsa
acuagcuuuagauuaccccuauacacaagaauggccaaccuaaaauuaugugugucuuguacag

SEQ ID NO: 87570 - RNA, 64 nt, hsa
uggcacacaaggaggcgaggcuaugcguucgaggccaaccuaggcaaaauuggaaaaaaaaaaa

SEQ ID NO: 87571 - RNA, 64 nt, hsa
ugaucucguuuacuccauguuaaucacauuccuaccaaccuaaauuucugccaagucaguucuc

SEQ ID NO: 87572 - RNA, 64 nt, hsa
gggcugccauccaucgccuaguaaccacggcaacccaaccuacucuaaaaccaaaccaaaaaaa

SEQ ID NO: 87573 - RNA, 64 nt, hsa
ggaugggaaaaguggacucucauuguagugacucccaaccuaccuaauaauuuguuaacuuagg

SEQ ID NO: 87574 - RNA, 64 nt, hsa
aaaauuguuugaaaaacauuuuccaggccuggcuccaaccuaaagccugacugucacgugccuu

SEQ ID NO: 87575 - RNA, 64 nt, hsa
aaaaaagccaccggaggaaaggaaaaaacaucggccaaccuagaaacguuuucauucgucauuc

SEQ ID NO: 87576 - RNA, 64 nt, hsa
ccacagacggcuucggcugugccuagggcaacagccaaccuaggagccagcgggcuuucgggga

SEQ ID NO: 87577 - RNA, 64 nt, hsa
uggcccuucugcccuucccuguguuucucacuuuccaaccuaaucccuggcucaggguuauugc

SEQ ID NO: 87578 - RNA, 64 nt, hsa
agcaggaggagcuucaucuguucccuucccaccuccaaccuagcccuacugcccaccccacccc

SEQ ID NO: 87579 - RNA, 64 nt, hsa
agcuagagccauuuaacauuuccucuuuccaagaccaaccuacaauuuucccuugauaaccaua

SEQ ID NO: 87580 - RNA, 64 nt, hsa
gcaccuccuuaggcccugccucugggcucagaccccaaccuagucaaggggauucuccugcucu

SEQ ID NO: 87581 - RNA, 62 nt, hsa
cuucuucguugcucaacuaagaacaggauaauccaaccuacgugaccucccggggacagugg

SEQ ID NO: 87582 - RNA, 64 nt, hsa
cacccaccccugccuugcuuuucuuccucuucccccaaccuaacuucugccaugggaacugguu

SEQ ID NO: 87583 - RNA, 64 nt, hsa
aucuccaacacuuaaguucagacuuaaaaauuugccaaccuaguggauguuaagugguaucuac

SEQ ID NO: 87584 - RNA, 64 nt, hsa
caucccuucuaugguauucccaacaaauuaucauccaaccuauacuuaaaaacauaugguggcc

SEQ ID NO: 87585 - RNA, 64 nt, hsa
uucauuuaguaauuaaauuuuagucagauuuugcccaaccuaaugcucucagggaaagccucug

SEQ ID NO: 87586 - RNA, 64 nt, hsa
aaccccaucauaugacaugccacccucuccaugcccaaccuaagauuguguggguuuuuuaauu

SEQ ID NO: 87587 - RNA, 64 nt, hsa
auuuuuaauggcaaaagccacuauuacuuuugcaccaaccuaauaggccgauucagaaacuuga

SEQ ID NO: 87588 - RNA, 64 nt, hsa
ucacagaacuggagaaccaggccaaguccccuccccaaccuaauuaggucauucaggacagcua

SEQ ID NO: 87589 - RNA, 64 nt, hsa
uuugcagcucgcccaaagagauacaaccuaauccccaaccuacuuuuaguuuuuuuguuuuuuu

SEQ ID NO: 87590 - RNA, 64 nt, hsa
ggcaguuuuuggucuuuuaccucugaucuuguccccaaccuaagccagcuagcugcgugcuccc

SEQ ID NO: 87591 - RNA, 64 nt, hsa
gcuuauuugaacuugagaccauuguaagcaugacccaaccuaccacccuguuuuuacauaucca

SEQ ID NO: 87592 - RNA, 64 nt, hsa
uuacuccuuuuaaacaccagcacccgucuuuuccccaaccuaaaaccaaccaccagcauuucac

SEQ ID NO: 87593 - RNA, 64 nt, hsa
uuuuuagccuauauaugcaaacagauuugcaguaccaaccuaugcagccaagcaaccucagcag

SEQ ID NO: 87594 - RNA, 64 nt, hsa
uguugaaaagaguuacuguuauuaucagaauuugccaaccuaaagaaugaauuuuuaaauucau

SEQ ID NO: 87595 - RNA, 64 nt, hsa
gaguagcugggauuacaggcgugugccaccaugcccaaccuauuuuuguauuuuuuaguagaga

SEQ ID NO: 87596 - RNA, 64 nt, hsa
uauauauuuuauuuaauuuaaaagaaaucucuuaccaaccuacauauuuauuacuauaauuugc

SEQ ID NO: 87597 - RNA, 64 nt, hsa
gaaaguacucgacaccuuuagauaagaauuaaaaccaaccuauguaacugacauaaucuugauc

SEQ ID NO: 87598 - RNA, 64 nt, hsa
aggugaggucacguggccucccaggccugacuucccaaccuacagcauugacgccaacuuggcu

SEQ ID NO: 87599 - RNA, 50 nt, hsa
ugcaucgggauucagaaugaccaaccuaagaagcacaaauuuaguuuggg

SEQ ID NO: 87600 - RNA, 64 nt, hsa
ggagaauuuuuaaaacaaaaucucucauuccagcccaaccuauuuaacuuuuuguggaggaauu

SEQ ID NO: 87601 - RNA, 64 nt, hsa
aggucucuugugcccuguucucuuguccccaccaccaaccuauagcaggcaccaaagcaagugc

SEQ ID NO: 87602 - RNA, 64 nt, hsa
gggagaaugagaccuggagucauguugaaggugcccaaccuaaaaauguaggcuuucauguugc

SEQ ID NO: 87603 - RNA, 64 nt, hsa
cgugacccacucagccuuauccacggagcuggagccaaccuacgugccaggccccaugcugggu

SEQ ID NO: 87604 - RNA, 64 nt, hsa
agagugcugggauuacaggcgugagccacuguggccaaccuaauuuuuguauuauuuaguagag

SEQ ID NO: 87605 - RNA, 64 nt, hsa
ccgguggugugacuucguugguugaggugugucuccaaccuacaucagaccaugaaguucaacc

SEQ ID NO: 87606 - RNA, 56 nt, hsa
acauugaucaagauuuguaggaccaaccaaccuaagagcaauaaauguuuuuguuu

SEQ ID NO: 87607 - RNA, 64 nt, hsa
caauguauguuuggaguuccaaaucugcaaguggccaaccuagagauucacuccuuaucuauga

SEQ ID NO: 87608 - RNA, 64 nt, hsa
uggagucugucaauguccuacugagacagcacagccaaccuagcuagcaacauuuguuuuaguc

SEQ ID NO: 87609 - RNA, 64 nt, hsa
cugccugucauugcugcaaagagcugcugcuuugccaaccuaagcaaagaaaauacggcuucuc

SEQ ID NO: 87610 - RNA, 64 nt, hsa
agugggcugacccaucccucccaggcgcuggggaccaaccuagcaaugaagguugggaagguug

SEQ ID NO: 87611 - RNA, 64 nt, hsa
cggggaggagaggguuugcuaaucugcucccagcccaaccuauuaccaccccaccucgcuggga

SEQ ID NO: 87612 - RNA, 64 nt, hsa
agugugcugggauuacaggcaugagcuacuaugcccaaccuauccuguucuuuuaauugaaagu

SEQ ID NO: 87613 - RNA, 55 nt, hsa
agccgcacuacuucaccugagccacccaaccuaaauguacuuaucuguccccaug

SEQ ID NO: 87614 - RNA, 64 nt, hsa
ugaccaccccccauccuucucccuacacucccagccaaccuagugcccaagcagcuaaacuugg

SEQ ID NO: 87615 - RNA, 64 nt, hsa
cuucaccuggccccaccauggcugcuugccuggcccaaccuagcguucugugccaugcuagagc

SEQ ID NO: 87616 - RNA, 64 nt, hsa
acaaaggggaugcccagugguuucccuuugcuucccaaccuaaaauuucaaguuuaauaaaaua

SEQ ID NO: 87617 - RNA, 64 nt, hsa
auuccagggccagagccaugcagucccagaaaccccaaccuagcuggggcagguccagagucca

SEQ ID NO: 87618 - RNA, 64 nt, hsa
aagaugaaggacaaaaggaagggaaaacugauggccaaccuagagcagcaaggagcagggcuug

SEQ ID NO: 87619 - RNA, 64 nt, hsa
aaaauauuggaaguugaaaaugcauugaauacacccaaccuacugaacaucguagcuuagccaa

SEQ ID NO: 87620 - RNA, 64 nt, hsa
gaggaauuuucccucggccuuacugacaaggacaccaaccuagggugcaaacagauggacuaug

SEQ ID NO: 87621 - RNA, 64 nt, hsa
ugaaaguaauggcaaaaccacaauuacuuuuuuaccaaccuaauaacaauguauuagcaaauau

SEQ ID NO: 87622 - RNA, 64 nt, hsa
ucuauccaacagggagccacaguauuuaaauugaccaaccuaauguuacaacuacuuugaggug

SEQ ID NO: 87623 - RNA, 64 nt, hsa
gagucacuguaacucuagaagauuaaccuuccagccaaccuauuuuccuuucccuugucucucu

SEQ ID NO: 87624 - RNA, 64 nt, hsa
ucauuaucucccacaacuagaccgccaugccucaccaaccuaugucccuggaccuccugguguc

SEQ ID NO: 87625 - RNA, 64 nt, hsa
cuccccuauccacccagcccauucucucuccuguccaaccuaaccccuuuccugcgggcuuuuc

SEQ ID NO: 87626 - RNA, 64 nt, hsa
auacaacagagcacuuuuugaggcaauugaaaaaccaaccuacacucuucggugcuuagagaga

SEQ ID NO: 87627 - RNA, 64 nt, hsa
uuacaaggcuuuaucucaggggccaacuaggcagccaaccuaagcaagaucccauggguugugu

SEQ ID NO: 87628 - RNA, 64 nt, hsa
uucugcagaauuauuuccuucagggacagauuuuccaaccuaagaaacuaccuaccguguguau

SEQ ID NO: 87629 - RNA, 64 nt, hsa
uuagaguacgaaauuccuggcaacugguacagaaccaaccuagaggcuuugcaguuggcaagcu

SEQ ID NO: 87630 - RNA, 64 nt, hsa
uauugagacgggaaaaacucgcuguaaaauaaugccaaccuagauaaugcuauaauaaauuauu

SEQ ID NO: 87631 - RNA, 64 nt, hsa
auaugaguauuaaauaugguaugcuuaguauauuccaaccuaagauaguuaacuaccugagacc

SEQ ID NO: 87632 - RNA, 64 nt, hsa
gcgggguuucacgcucaccugaaaacaccuguucccaaccuacuucuuggugcaaguugaccaa

SEQ ID NO: 87633 - RNA, 64 nt, hsa
aggcugcagugagccaugauugagccaccacacuccaaccuaggugacagagcaagacccuguc

SEQ ID NO: 87634 - RNA, 64 nt, hsa
cguaucaugguucuugaccagcacauucaauccuccaaccuacccuacugccaugaccuuccgc

SEQ ID NO: 87635 - RNA, 64 nt, hsa
ccgcguguccccggggcccaggggaggcggcacuccaaccuaaccugugucugcgaaguccuau

SEQ ID NO: 87636 - RNA, 64 nt, hsa
agguugcagugagccgagaucgcgccauugcacuccaaccuaggugacaaagcuacacgccauc

SEQ ID NO: 87637 - RNA, 64 nt, hsa
aagagauccagugggacaaugcuauuuuuguaugccaaccuagauaggauuauaaagcaagacu

SEQ ID NO: 87638 - RNA, 64 nt, hsa
caaaaguuggaucugaguuuggagaaagauauuuccaaccuaaguggguauuauuuugaaacca

SEQ ID NO: 87639 - RNA, 64 nt, hsa
ugccuuuaauugucuaaaacaaaaacaaaaccagccaaccuauguuacacgugagauuaaaacc

SEQ ID NO: 87640 - RNA, 64 nt, hsa
gucucuggccuguggauccagugcuauucugucaccaaccuaagaaucccaauugcaccuucug

SEQ ID NO: 87641 - RNA, 64 nt, hsa
cuucccaaagcagcaggcgccuccaggcuggggcccaaccuagaaggcaggggucaaucuaaca

SEQ ID NO: 87642 - RNA, 64 nt, hsa
gagugcgaacgucuugcuguuguguuuuuaugucccaaccuagaaaccuuagcugucuuuucug

SEQ ID NO: 87643 - RNA, 64 nt, hsa
ugugaccaggguguggcugacaccugggcuaccuccaaccuacaugugcaacgcuguugacuac

SEQ ID NO: 87644 - RNA, 64 nt, hsa
ggaggcauuucuacuuccuugaguuuugcuguugccaaccuaaaacauuucccuuuggaacaug

SEQ ID NO: 87645 - RNA, 64 nt, hsa
cuucuaccuaguaggagucaugccccuguagugcccaaccuagccagguagccaccacugugcc

SEQ ID NO: 87646 - RNA, 64 nt, hsa
augggcugcuccugggccuggugagcuacugcccccaaccuacccucuagaggggcugggaagg

SEQ ID NO: 87647 - RNA, 64 nt, hsa
caguuucacagaaaauaaggcacccaucugucugccaaccuaaaacucuuucgguagguggaag

SEQ ID NO: 87648 - RNA, 64 nt, hsa
ccaguaaauauggguugaauaaaaugugucuuguccaaccuacaaaaguuuggcccuaaaaaaa

SEQ ID NO: 87649 - RNA, 64 nt, hsa
cacagcauuucagaugcuguuggacuucauguccccaaccuagcuuggugagggcuguaacugu

SEQ ID NO: 87650 - RNA, 64 nt, hsa
uauaagaggggcagagaggacaacuccgcuuuggccaaccuagccaaggcugcagcauauagac

SEQ ID NO: 87651 - RNA, 64 nt, hsa
cugaauucuuuccccaaagacgaccagcauuuaaccaaccuaagggcccaaaggccuuggacaa

SEQ ID NO: 87652 - RNA, 64 nt, hsa
gacaccuggcuugccacccacagugcaccacaggccaaccuacgcccuucaucacuugguucug

SEQ ID NO: 87653 - RNA, 64 nt, hsa
uuuuuuucuuuuuuagaaaacagggaguugaaguccaaccuauuuaaaaaccccaccauuugga

SEQ ID NO: 87654 - RNA, 64 nt, hsa
gcaggagucaggucccuacacuuggccuguuuuuccaaccuauuuaauagacauuaaagcuaaa

SEQ ID NO: 87655 - RNA, 64 nt, hsa
aaggugggcggaucacaaggucaggaguucgagaccaaccuagccaacauggugaaaccccguc

SEQ ID NO: 87656 - RNA, 64 nt, hsa
aacaaaagaggacagaagcagaccacucugugcaccaaccuaaaaaauuacagagaagagaaaa

SEQ ID NO: 87657 - RNA, 64 nt, hsa
acacacacucgugcagugggggaguucuggcuccccaaccuaaccccuagccgucaucuccaca

SEQ ID NO: 87658 - RNA, 64 nt, hsa
aaacauucugaaauuuauuuggaaccagaaaagcccaaccuaaauagcaaaagcaauccuaagc

SEQ ID NO: 87659 - RNA, 64 nt, hsa
aauucuccauuucacuugaccccugcccaccucuccaaccuaacuggcuuacuuccuagucuac

SEQ ID NO: 87660 - RNA, 64 nt, hsa; identical to SEQ ID NO: 87659

SEQ ID NO: 87661 - RNA, 64 nt, hsa
aguucuccauuucacuugaccccugcccaccucuccaaccuaacuggcuuacuuccuagucuac

SEQ ID NO: 87662 - RNA, 64 nt, hsa
aauucucuauuucacuugaccccugcccaccucuccaaccuaacuggcuuacuuccuagucuac

SEQ ID NO: 87663 - RNA, 64 nt, hsa; identical to SEQ ID NO: 87661

SEQ ID NO: 87664 - RNA, 64 nt, hsa; identical to SEQ ID NO: 87659

SEQ ID NO: 87665 - RNA, 64 nt, hsa
aaguaucuauuucacuugaccccugcccaccucuccaaccuaacuggcuuacuuccuaguccua

SEQ ID NO: 87666 - RNA, 64 nt, hsa
augccgaccucauccuaacuccacucacgcagacccaaccuaaccuccacuagcuccaaaaucc

SEQ ID NO: 87667 - RNA, 64 nt, hsa
agugcaaagccgcccccagagcccagguguccccccaaccuaaccagaccuggugccuugacgc

SEQ ID NO: 87668 - RNA, 64 nt, hsa
ggcuggcccaucugagagcaucuccccacucucgccaaccuaucggggcauagcccagggaugc

SEQ ID NO: 87669 - RNA, 64 nt, hsa
caucaaagcugagucacuggaccuagcugugcccccaaccuagauuggcagcaccaccccaggg

SEQ ID NO: 87670 - RNA, 63 nt, hsa
aaaaugccuuacacauuccuuacaaauaaaccaaccaaccuacacagcguuauccaggcccaa

SEQ ID NO: 87671 - RNA, 64 nt, hsa
uuaaccucaaggucucgcaugguggggccccugaccaaccuacacaaguucccucccacaagug

SEQ ID NO: 87672 - RNA, 64 nt, hsa
agaaaggggggcggugaucaggucaccagugaccccaaccuaugcucucggucuuuccuggagg

SEQ ID NO: 87673 - RNA, 64 nt, hsa
cccuuccuccuuccauucugcauccccuccccauccaaccuaaaugccacagcuggggcugagc

SEQ ID NO: 87674 - RNA, 64 nt, hsa
gcucuaugccucaguuuccccauaauacccuuuuccaaccuaccucacaagguuaucagaaaga

SEQ ID NO: 87675 - RNA, 64 nt, hsa
ggggcgggggaaaugggggaaugacacaucccccccaaccuacccccaccccaaaagcagcucc

SEQ ID NO: 87676 - RNA, 64 nt, hsa
uuagagcuaaaaaggcccuuagagggaaucuagcccaaccuacauuccacccuguuacuuaugu

SEQ ID NO: 87677 - RNA, 64 nt, hsa
uacauccuguccacacugcuggagauacuaagucccaaccuaaaugauggaaggagcaucuccc

SEQ ID NO: 87678 - RNA, 64 nt, hsa
uggcaagguccuucccugggaaucaccacucgguccaaccuagacaaccaagaccgcuauaccu

SEQ ID NO: 87679 - RNA, 64 nt, hsa
aggcugcagugagcugugaugacaccacugcacuccaaccuagguaacagagagacaccucugu

SEQ ID NO: 87680 - RNA, 64 nt, hsa
gcgggaggacugauugaguccggguguucaagggccaaccuaggcaacacagugagaacucauc

SEQ ID NO: 87681 - RNA, 63 nt, hsa
ccguauuuucuaggacaagaguucucagucacugugcaauaugcccccugggucccaggaggg

SEQ ID NO: 87682 - RNA, 63 nt, hsa
ugucucaguacaauccaaauuugucguagacuugugcaauauauacuguuguggguuggagaa

SEQ ID NO: 87683 - RNA, 63 nt, hsa
acucaguaagacagugcagugcucaguaaggcagugcaauacucaguaacaguguaguacuca

SEQ ID NO: 87684 - RNA, 63 nt, hsa
caguacucaggaaugcagcacaguacucaggcagugcaauacucagugcgguacucaguaaca

SEQ ID NO: 87685 - RNA, 63 nt, hsa
acggggugggggugagggccccugcaauucacggugcaauauucaccaguuuugcccucugcc

SEQ ID NO: 87686 - RNA, 63 nt, hsa
ccucccuuccccaguuuuucucuaagauauacagugcaauagcuccccaccccucaguugacg

SEQ ID NO: 87687 - RNA, 63 nt, hsa
gauggugucuaacgagcagugcaauauuaggcggugcaauagaggcccuguuggcaagaugag

SEQ ID NO: 87688 - RNA, 63 nt, hsa
gacauggauaagugagauggugucuaacgagcagugcaauauuaggcggugcaauagaggccc

SEQ ID NO: 87689 - RNA, 63 nt, hsa
acuaugagauuuuuaaaaaauggggccgcugaugugcaauaucaaagugaacuugugaguauu

SEQ ID NO: 87690 - RNA, 63 nt, hsa
uaccucucuuuugugacucuuguacagcuuaaugugcaauaaaggaaaaguuauaucugucuu

SEQ ID NO: 87691 - RNA, 63 nt, hsa
gcuguaagagucuggcuuagaacagaccucucugugcaauaacuuguggccacuggaaauccc

SEQ ID NO: 87692 - RNA, 63 nt, hsa
uauauuauacauacacaaguuugugugaaagaugugcaauaacaaagguguauguauguuuug

SEQ ID NO: 87693 - RNA, 63 nt, hsa
auuauaauaaccucccaguucuaggggauauuugugcaauaaauacacaugucaacuugaugg

SEQ ID NO: 87694 - RNA, 63 nt, hsa
aauaugucuuaauuuugaguuugaaaauguuaagugcaauaaaaacauacuaguacagauuuu

SEQ ID NO: 87695 - RNA, 63 nt, hsa
aauacuucaauacuucauuuaaaauauuuuuaugugcaauaaaauguauuuguuuguauuuug

SEQ ID NO: 87696 - RNA, 63 nt, hsa
agguuugugacuuuccuaaaucaauucuauuacgugcaauacuucaauacuucauuuaaaaua

SEQ ID NO: 87697 - RNA, 63 nt, hsa
auauuugcaagacauagaauaguguuggaaaaugugcaauaugugauguggcaaaucucuauu

SEQ ID NO: 87698 - RNA, 63 nt, hsa
ucacaguguuuuuauugcucgcccagacaccaugugcaauaagauugguguucguuuccauca

SEQ ID NO: 87699 - RNA, 63 nt, hsa
ggagacaaaggaggaauuuacuuucuucaccaagugcaauagauuacugaugugauauucugu

SEQ ID NO: 87700 - RNA, 63 nt, hsa
ccacaacaaaaacccaaguuuucugugcuacaugugcaauauuuguuaugaauguuaucacaa

SEQ ID NO: 87701 - RNA, 63 nt, hsa
guuucauguccauucaagugacuuuuauucugagugcaauauuucaauagccuuguagugaua

SEQ ID NO: 87702 - RNA, 63 nt, hsa
auguacaguauuuuuuguuguuuuuaucaucaugugcaauauuacugauuuguuuccaugcug

SEQ ID NO: 87703 - RNA, 63 nt, hsa
ucucuacucuuuaguagaguucgagacacagaagugcaauaacugcccuaauuaagcaacuau

SEQ ID NO: 87704 - RNA, 63 nt, hsa; identical to SEQ ID NO: 87702

SEQ ID NO: 87705 - RNA, 63 nt, hsa; identical to SEQ ID NO: 87703

SEQ ID NO: 87706 - RNA, 64 nt, hsa
cuccaggcauuauccccaggugcugaaauggcuguggccccagcaccugaggcagggguacgcu

SEQ ID NO: 87707 - RNA, 64 nt, hsa
aggccaggauggugguguggggaggggugccugcuggccccauguccuccccuguacauagucu

SEQ ID NO: 87708 - RNA, 64 nt, hsa
aagccccaucuucuaaauggcaaaggaagguggauggccccagcacagcuugaccugaggcugu

SEQ ID NO: 87709 - RNA, 64 nt, hsa
cuccauccaaggccagguucuccguuagcuccuguggccccacccugggcccugggcuggaauc

SEQ ID NO: 87710 - RNA, 64 nt, hsa
gugcagggacccgagggccagguuagcacagcgcuggccccagcauggagggaagcccuguggg

SEQ ID NO: 87711 - RNA, 64 nt, hsa
gggauuuugaguugaacuuuacugggggugucccuggccccacaagccaggaccugcuguguga

SEQ ID NO: 87712 - RNA, 64 nt, hsa
gcgacuugccugccccugaagcccuuguucccauuggccccaguuugcauucugcagguuuucc

SEQ ID NO: 87713 - RNA, 64 nt, hsa
gggcagugugcaugcaacacacuuaggggaggaguggccccagaauucagcacgcacacaacac

SEQ ID NO: 87714 - RNA, 64 nt, hsa
uacacccucggacuccugcccuccucggccucccuggccccagcgcggcuccacccugggcugc

SEQ ID NO: 87715 - RNA, 64 nt, hsa
gcuaaccccaaccagcaggcaacuaacacggaauuggccccacaccggacgugggaggugucug

SEQ ID NO: 87716 - RNA, 64 nt, hsa
agguccuccauuacagaggcccagcgcacaucgcuggccccacaaacguucagggguacagcca

SEQ ID NO: 87717 - RNA, 64 nt, hsa
cuccuaaacagacaguuuaauuauaguugcggccuggccccauccucacuuccucuuuuuauuu

SEQ ID NO: 87718 - RNA, 64 nt, hsa
uccccagagaggcacucagugagccuccugugccuggccccagccugggccaucucuuagguga

SEQ ID NO: 87719 - RNA, 64 nt, hsa
gcucuggacagcagaagccuccaagcacagagccuggccccaggccccagacagggugggcuuc

SEQ ID NO: 87720 - RNA, 64 nt, hsa
gcccugccuccccauugugugcccagaacaucccuggccccaccccgccacuucccucgggccc

SEQ ID NO: 87721 - RNA, 64 nt, hsa
ccuuauguugcucuuucuaucauuuccauucugguggccccacuaaugucuuaaccuaaaccau

SEQ ID NO: 87722 - RNA, 64 nt, hsa
uggggucucugagcaguggggagcgggggcuaacuggccccaggcggaggggcuuggagcagag

SEQ ID NO: 87723 - RNA, 64 nt, hsa
cccgcagcaccagccugagccacaguggggcccauggccccagcuggcugggucgccccuccuc

SEQ ID NO: 87724 - RNA, 64 nt, hsa
caggcuggccgcgcaccggggcucgggcacccucuggccccacacuggcaaugaugccacaccu

SEQ ID NO: 87725 - RNA, 64 nt, hsa
gcagcaggcagacagcucacccccaccagcaugauggccccagcugggggcaguggcaggagcc

SEQ ID NO: 87726 - RNA, 64 nt, hsa
gcccggagcagccuguuccugcacuccacccugcuggccccaggacuucugaucucaguccucu

SEQ ID NO: 87727 - RNA, 64 nt, hsa
gccagucuccucucaagcaagccuccugaaccacuggccccaaccaacccacuggugggguggg

SEQ ID NO: 87728 - RNA, 64 nt, hsa
gugagaggaaagaggcgggggcgggugaggagacuggccccaggccccagccacggcugcagag

SEQ ID NO: 87729 - RNA, 64 nt, hsa
guucccaagcaguucaugauacagccucaccuuuuggccccaucucugguuuuugaaaauuugg

SEQ ID NO: 87730 - RNA, 64 nt, hsa
ucccucugugcagccacagccagagggcccagaauggccccacucuguucccaagcaguucaug

SEQ ID NO: 87731 - RNA, 64 nt, hsa
guuccaggggcccugauuuccucggaugugcuauuggccccaggacugaagcugccucccuuca

SEQ ID NO: 87732 - RNA, 64 nt, hsa
acaugccuggcaucugucuccccuuguuccugaguggccccacauggggcucugagcaggcugu

SEQ ID NO: 87733 - RNA, 64 nt, hsa
ggccccacucccaccauccugugagccccacuccuggccccacucacaccauccuaugagccca

SEQ ID NO: 87734 - RNA, 64 nt, hsa
cggccccacucacucuauccugugagaccacgccuggccccacucccaccauccugugagcccc

SEQ ID NO: 87735 - RNA, 64 nt, hsa
ccucacccuuauccaggacccacacagaagccuguggccccacuuaccucggggagucaugugc

SEQ ID NO: 87736 - RNA, 64 nt, hsa
uccuucccuccacuccacccucuucugggauggcuggccccacaagccacucaguuccaaggga

SEQ ID NO: 87737 - RNA, 64 nt, hsa
ugacugagucucccagcccagacccagggacccuuggccccaagcucagcucuaagaaccgccc

SEQ ID NO: 87738 - RNA, 64 nt, hsa
aucugagccuccaccacauagacugaaacuccccuggccccagcccucuccugccuggccuggc

SEQ ID NO: 87739 - RNA, 64 nt, hsa
gcuccuggcccugccccuaggucugggugggcaguggccccauagccucuggaacugugcguuc

SEQ ID NO: 87740 - RNA, 64 nt, hsa
gugggacgagccacccgcuuucagcccugugcucuggccccagaacggccacucgagaccccgg

SEQ ID NO: 87741 - RNA, 64 nt, hsa
cauuauuuuauuuuugguuuguauuauuuuuauuuggccccauuauuuuaaauaggaaaaacag

SEQ ID NO: 87742 - RNA, 64 nt, hsa
aagugcugggauuacaaaugugagccaccacaucuggccccauuauuuuauuuuugguuuguau

SEQ ID NO: 87743 - RNA, 64 nt, hsa
ugugaccccaccugcucuuuccucccucccaguauggccccaccugcucuuuccucccccgagg

SEQ ID NO: 87744 - RNA, 64 nt, hsa
ggccccaccugcucuuuccuccccccccaagguguggccccaccuguucuuuccuccccugccg

SEQ ID NO: 87745 - RNA, 64 nt, hsa
guggccccgccugcucuuuccucccccaccaguauggccccaccugcucuuuccucccccccca

SEQ ID NO: 87746 - RNA, 64 nt, hsa
aagaaugucccccaccccuuggccucugccuccuuggccccacauuucugcaaacauaaauauu

SEQ ID NO: 87747 - RNA, 64 nt, hsa
gcccaaccugccccuucacuuugccuuccugaguuggccccacuccacuugggggucugcauug

SEQ ID NO: 87748 - RNA, 64 nt, hsa
gaguggcaaagcuggcccugacgccuggguuucuuggccccagcugcccagcaggugccucgau

SEQ ID NO: 87749 - RNA, 64 nt, hsa
gagauaccaagggcauggguggucccugcuucgauggccccaaagcugggccagaguuaaggga

SEQ ID NO: 87750 - RNA, 64 nt, hsa
ugccccaccccagcucauccaugugcuuguacccuggccccacggggaggcuugcccuucccug

SEQ ID NO: 87751 - RNA, 64 nt, hsa
gucaccuccucagugcaguuagccugagcuccccuggccccaggugccuccaucagagcauuua

SEQ ID NO: 87752 - RNA, 64 nt, hsa
caaggcuuuguaaaccggcuggaccacgucucccuggccccagugaccgggggaagcugagccc

SEQ ID NO: 87753 - RNA, 64 nt, hsa
ccggcucggccucuugagagccccaccccugaacuggccccagcuccucuuccugccucucuca

SEQ ID NO: 87754 - RNA, 64 nt, hsa
cccagacgcggaaaccggguggcagcgcccagccuggccccaagcauggaaacgcacaaccccu

SEQ ID NO: 87755 - RNA, 64 nt, hsa
gucccucccugauaccaaguaugucgagaaccgauggccccacccucuggcuggugcugggccg

SEQ ID NO: 87756 - RNA, 64 nt, hsa
uuacaaaacucacgggccucuuuggucugcaugauggccccaugcguuucauaggcuguccacu

SEQ ID NO: 87757 - RNA, 63 nt, hsa
ggcccaccuucuagaugaccccuuaauaaagugauggccccacagaagaaaugccuucagaug

SEQ ID NO: 87758 - RNA, 64 nt, hsa
ggcucacaccccacacccgggcaggagcgcucccuggccccaacacaucggggcuccgaggcag

SEQ ID NO: 87759 - RNA, 64 nt, hsa
cagcaugaaaccuaauauguauauguuugaaauacuucauaaugugcauguuguagcaaacauu

SEQ ID NO: 87760 - RNA, 64 nt, hsa
uacagguaucuuggauuucagacacauucuguuucuucauaaaaauuuuacuuaaaaucuguaa

SEQ ID NO: 87761 - RNA, 64 nt, hsa
uuauuuccacugugagauucuuaaaacuuuuuugcuucauaauaauaaaacaacucauguuaga

SEQ ID NO: 87762 - RNA, 64 nt, hsa
uauugcguaccaagaguugauuacaaccuccaugcuucauaagcggacgccacguuaggguugg

SEQ ID NO: 87763 - RNA, 64 nt, hsa
caaguuacuguucagaauacuuaauaucuccucucuucauaauuaucaauagccccaagcucau

SEQ ID NO: 87764 - RNA, 64 nt, hsa
auuaaguacucuugauacaaaauauacuuuuaaacuucauaaccuuuuuauaaaaguuguugca

SEQ ID NO: 87765 - RNA, 64 nt, hsa
ucccugucucuaggucgcugagagaggugcuuuucuucauaaaaccuuugggguuuggauuucc

SEQ ID NO: 87766 - RNA, 64 nt, hsa
guguaaaagaugcauggagucaggagaaaaccaccuucauaaacugcucugugcaaagaggaau

SEQ ID NO: 87767 - RNA, 64 nt, hsa
cuuauuuuaucccagauguguucugaauauccuucuucauaaaucauggaaaacucacugcuga

SEQ ID NO: 87768 - RNA, 64 nt, hsa
ccuuccuuucuaggcugguaacaguucauguuugcuucauaaaugaagcagcuuuaaacaaauu

SEQ ID NO: 87769 - RNA, 64 nt, hsa
gagacuuuaaagucguuuugggaacugugaugugauguggaaauacugauguuuccaguaaggg

SEQ ID NO: 87770 - RNA, 64 nt, hsa
guuucuaucuagauuuaaauauauuugucaaugaauguggaauagaaaaucuaaacaugacaau

SEQ ID NO: 87771 - RNA, 64 nt, hsa
gaaauugaugaccggaaacuagaaagccccuauaauguggaauaugcauauguggggugaaacc

SEQ ID NO: 87772 - RNA, 64 nt, hsa
gaugcacuguaaauccggcauugauguuuccaccauguggaaaagcaaggauuucccuggcccc

SEQ ID NO: 87773 - RNA, 64 nt, hsa
agugguugaaaugagagcuagugaugacagaaggauguggaaugucuucuugacaucauugugu

SEQ ID NO: 87774 - RNA, 64 nt, hsa
cauggaaugggaaggggaaggggagucuuacuauauguggaauaaacuugcucaguguugccac

SEQ ID NO: 87775 - RNA, 64 nt, hsa
uguugguacuauguggaaaauauuagaaacuucuauguggaaaauauuagaaacuacagaguuu

SEQ ID NO: 87776 - RNA, 64 nt, hsa
ucuuucauaucuuggauuugcagcuguugguacuauguggaaaauauuagaaacuucuaugugg

SEQ ID NO: 87777 - RNA, 64 nt, hsa
auuuguguguauguguaugucaauucaugacauuauguggaauccuaaaccuuugguggcuggg

SEQ ID NO: 87778 - RNA, 64 nt, hsa
aauuauauuauguuuaauuauuuaagauuucuuuauguggaacaucuauagagauaaauagaaa

SEQ ID NO: 87779 - RNA, 64 nt, hsa
guccccugaggcccagcaguaccugcuucccuguauguggaagcagcaccucauucccgccauc

SEQ ID NO: 87780 - RNA, 64 nt, hsa
agucuuucaggaaggaagcccuuccuuauguuacauguggaaagccugccuuccaagacaugug

SEQ ID NO: 87781 - RNA, 64 nt, hsa
uuauguuacauguggaaagccugccuuccaagacauguggaaguaauugauccaccugccagag

SEQ ID NO: 87782 - RNA, 50 nt, hsa
accuuaacccaccuaaguaaauguggaaacauccgauauaaaucucauag

SEQ ID NO: 87783 - RNA, 64 nt, hsa
acucuacaaauucccucuugguguaaaauucaagauguggaaauucuaacuuuuuugaaauuua

SEQ ID NO: 87784 - RNA, 64 nt, hsa
ugggacucuuggaaucaggagacaaagcuaccacauguggaaagguacuauguguccaugucau

SEQ ID NO: 87785 - RNA, 64 nt, hsa
ggcacuauccagaaauaguggacagaggucuggcauguggaaaccuuggaucucggucacaggg

SEQ ID NO: 87786 - RNA, 64 nt, hsa
gcugcuacugggacauccacaggaccuaauguuuauguggaaucuccaggcugccaucgagggc

SEQ ID NO: 87787 - RNA, 64 nt, hsa
uucauuucagagaaaagcccuauacguguagugaauguggaaaagacuucagauugaauucaca

SEQ ID NO: 87788 - RNA, 64 nt, hsa
uucacacaggagagaaagcacaugaauguaaugaauguggaaaagcuuucagucaaaccucaug

SEQ ID NO: 87789 - RNA, 64 nt, hsa
uaagacuuaagcaaagccuuuuucauauuugaaaauguggaaagaaaagauguuccuaaaaggu

SEQ ID NO: 87790 - RNA, 64 nt, hsa
aguuacuuuguggaucuuguccaaauuuagugaaauguggaagucaaccagaccaaugauggaa

SEQ ID NO: 87791 - RNA, 64 nt, hsa
cuguauuuuucuggagcaguucacauagaguagaauguggaauuucccgugaacgucuccuucc

SEQ ID NO: 87792 - RNA, 64 nt, hsa
ccacccuuguauuuuaucacgugcucuucagggcauguggaauucguugaguuugcuuuuagag

SEQ ID NO: 87793 - RNA, 64 nt, hsa
cucauauaagacagaaacccuauggguguaaugaauguggaaaaucauucugugugaagucaag

SEQ ID NO: 87794 - RNA, 64 nt, hsa
uguugaguugcaggauaucuagcaauuuaagaaaauguggaaaaaauauuuuuauugagaaaua

SEQ ID NO: 87795 - RNA, 64 nt, hsa
gcuuaaggucagaggaguguguagggagggauguauguggaagguaagauucagggcaagcuaa

SEQ ID NO: 87796 - RNA, 64 nt, hsa
auugauccucuucaguuggagucucccaaauuuaauguggaagacaaaguguuggaaaaucaaa

SEQ ID NO: 87797 - RNA, 64 nt, hsa
acacacacacacacaaacaauccaguguuuugucauguggaaaaucaaaacaaguuagaaagca

SEQ ID NO: 87798 - RNA, 64 nt, hsa
ggagguucuguuauuaaagaaacaaugugaaauaauguggaaauuaauacugauaaagacuauc

SEQ ID NO: 87799 - RNA, 64 nt, hsa
uaggaagucaaucugugugcugguuuuguugguuauguggaaaucacaaacuccagaggagcaa

SEQ ID NO: 87800 - RNA, 64 nt, hsa
caaaguauaaauauuuuguuucuuuauggaggacauguggaaggaguuugaggguuugggaugg

SEQ ID NO: 87801 - RNA, 64 nt, hsa
cugcugcagcccugggaaugucuguggaauuacuauguggaaauggaacuuuguguuaugcucu

SEQ ID NO: 87802 - RNA, 64 nt, hsa
ucuccaugcccugacaacagugcuuguagcuuugauguggaacaggggcccugggcauuucugc

SEQ ID NO: 87803 - RNA, 64 nt, hsa
aucauacagcugagaaacccuaugaauguaaggaauguggaaaagccuucagcaggaaagaaaa

SEQ ID NO: 87804 - RNA, 64 nt, hsa
uucauacgggugagaaacccuaugcauguacaguauguggaaaagccuuuagucagaaaucaaa

SEQ ID NO: 87805 - RNA, 64 nt, hsa
ugaauucacaguggagaagacccugcaucagggaauguggaaaugacuuugcugaauucucaag

SEQ ID NO: 87806 - RNA, 64 nt, hsa
aaacucacuggggagaaacccuaugaauguaaaaauguggaagcaacuuuguaucucaggucuu

SEQ ID NO: 87807 - RNA, 64 nt, hsa
uucauacuggagagaaacccuaugaauguaaagaauguggaaaacccuucaguuuccuuacagg

SEQ ID NO: 87808 - RNA, 64 nt, hsa
cucacacuggagauaaacccuuugaguguaaaaaauguggaaaagcauuuagauacuacuacuc

SEQ ID NO: 87809 - RNA, 64 nt, hsa
aucacacuguacagaaacgcuaugaauguaaacaauguggaaaaaccuacauaucuucuguagg

SEQ ID NO: 87810 - RNA, 64 nt, hsa
cucacacuggagauaaacccuuuaaguguaaagaauguggaaaagcauuccgauaccaccaauc

SEQ ID NO: 87811 - RNA, 64 nt, hsa
cuccuucuggaggaaagcuuugggaaagcaguguauguggaaaagucuugagccaucauucauc

SEQ ID NO: 87812 - RNA, 64 nt, hsa
auguggaauauauacauauauuccacauguguguauguggaauauauuccacauguguauauau

SEQ ID NO: 87813 - RNA, 64 nt, hsa
guuccauauauauacauauauuccacauguguguauguggaauauauacauauauuccacaugu

SEQ ID NO: 87814 - RNA, 64 nt, hsa
ucagcccugccucccuuuccacagaggugguuuuauguggaacgagguaccuugucuggggaag

SEQ ID NO: 87815 - RNA, 64 nt, hsa
gcccagaagaggggcuguguggccugggaauaccauguggaagguugggcuucaaguuaacagg

SEQ ID NO: 87816 - RNA, 64 nt, hsa
cugaugauguguuaggauugcuacugaugcugucauguggaaacuauuuaaaggcacuauuaua

SEQ ID NO: 87817 - RNA, 64 nt, hsa
caaugcaaguaagacuuucugaaaacacuugaugauguggaaaugcugcaggauuaaauaacuu

SEQ ID NO: 87818 - RNA, 64 nt, hsa
ccucccuguuuggaacccuccccaaagaggcagucaggcugaugcucagugcuuugugcucccu

SEQ ID NO: 87819 - RNA, 64 nt, hsa
aaaaccaacaccaacucaacaacaaagugcaauacaggcugaaccuggcccaacagaaaaaccc

SEQ ID NO: 87820 - RNA, 64 nt, hsa
cacagcgcugugagccagacccuccuugggcagacaggcugacuggcagcaccagcuuuggggg

SEQ ID NO: 87821 - RNA, 64 nt, hsa
cacuacagccugaguaggccugaguggccguggccaggcugagaccugucaggccauacugaca

SEQ ID NO: 87822 - RNA, 64 nt, hsa
ugggcccaaagguugggaguaggagacaguaucccaggcugacaagggcuugcccuuuaccuug

SEQ ID NO: 87823 - RNA, 64 nt, hsa
uauaacauuaauauuauugagaguaucugcuuuccaggcugaagugauucauucauuauucuag

SEQ ID NO: 87824 - RNA, 64 nt, hsa
aggcugccuuggauggccucaggccagguaaccccaggcugaaggggcccugcuccccaucccc

SEQ ID NO: 87825 - RNA, 64 nt, hsa
ggugaggccucuaaagguccucucccaaacugaccaggcugaugucaaccuaacccccucaggg

SEQ ID NO: 87826 - RNA, 64 nt, hsa
uggcuccagacccgcccccaaccugagacagaaccaggcugagccaggccuccacccccacccc

SEQ ID NO: 87827 - RNA, 64 nt, hsa
auuuuuaguagagacgggguuucucuauguuggucaggcugaucucgaacucccgaccucaggu

SEQ ID NO: 87828 - RNA, 64 nt, hsa
uaaagacaaggaaacgcugcaggggccacaggcacaggcugauauuuaaagaucuuugcuugca

SEQ ID NO: 87829 - RNA, 64 nt, hsa
uauuccuuuggaaaauucacuguuccacaaacagcaggcugaauggccucgccucuagauugac

SEQ ID NO: 87830 - RNA, 64 nt, hsa
cagccugagagacagugggcacggggacagugaucaggcugacagugaccaagacacuaacaaa

SEQ ID NO: 87831 - RNA, 64 nt, hsa
caggugcuggaugccacaguucccugcagccaaucaggcugaaaaugcagauuaccgcacaaau

SEQ ID NO: 87832 - RNA, 64 nt, hsa
cugugaccucccagaaccauggaagccaggacgucaggcugaccaacaccucagaccuucugaa

SEQ ID NO: 87833 - RNA, 64 nt, hsa
cggggugaaggucagacuaaggcagccuucuucacaggcugaggggguucagaaccagccuggc

SEQ ID NO: 87834 - RNA, 64 nt, hsa
caaaaugcaacuggacaaccccagcaagguucagcaggcugaacuucacacagguagucugcca

SEQ ID NO: 87835 - RNA, 64 nt, hsa
uggcuggcuggacagacugauagcagaaaaaguacaggcugagcgaccugacaccauguugggg

SEQ ID NO: 87836 - RNA, 64 nt, hsa
cgugguucaucccugguuaaaaagcaaacaaacacaggcugaaaacccaugcugcuguuauaca

SEQ ID NO: 87837 - RNA, 64 nt, hsa
uccagagaacucaccugacaaaugucucugagcacaggcugacaccaaaguggcacaacugcac

SEQ ID NO: 87838 - RNA, 64 nt, hsa
uccagcaggcgcugccuucacccacggaucugcccaggcugaaggcacacgcucaaugccccac

SEQ ID NO: 87839 - RNA, 64 nt, hsa
gucauggauggcugagcagagagcggggaaaaugcaggcugaguggggcgaccuccugccugcc

SEQ ID NO: 87840 - RNA, 64 nt, hsa
cugcucagcucugggccauucuccacagcaaccccaggcugaagcagguucccaagcucagagg

SEQ ID NO: 87841 - RNA, 64 nt, hsa
uucuguggagggacaaguggacucagggcagcgccaggcugaccacagcacagccaacacgcac

SEQ ID NO: 87842 - RNA, 64 nt, hsa
ggcuggggagagacuuuaggcagaagcugugaugcaggcugacugccagccgaggggcugggua

SEQ ID NO: 87843 - RNA, 64 nt, hsa
acagagcacagagauccugccuucuuccuacuaucaggcugaccuaaugggguugggcugcucg

SEQ ID NO: 87844 - RNA, 64 nt, hsa
ccuguuggagggguggagggauguuccccugagccaggcugagacuagaaccccaucuucccug

SEQ ID NO: 87845 - RNA, 64 nt, hsa
ccaggcugagacuagaaccccaucuucccugagccaggcugagacuagaaccccaucuucccca

SEQ ID NO: 87846 - RNA, 64 nt, hsa
gggguggcacacaucaguagucccagcuacucugcaggcugaggugggaggauugcuugaaccc

SEQ ID NO: 87847 - RNA, 64 nt, hsa
ucuggugaagccagaauggagacacccgugaccucaggcugaaagucacucgacauuggucucu

SEQ ID NO: 87848 - RNA, 64 nt, hsa
uacucuucucagcucucugggucuggaaggagaacaggcugaggggagcugagaggagcugagg

SEQ ID NO: 87849 - RNA, 64 nt, hsa
accagccuacagauguuccugccaguggugccuucaggcugaugccaaucuagccucuccuguc

SEQ ID NO: 87850 - RNA, 64 nt, hsa
agugugcuuucugauugaccugcugcagcccaaucaggcugaauucccacucuucagcgucuuu

SEQ ID NO: 87851 - RNA, 64 nt, hsa
cgugucauuucugccuuuguuugggacaggcagacaggcugaggaagucaccagugauugugga

SEQ ID NO: 87852 - RNA, 64 nt, hsa
auuauuuguguucuaacaggaggaugaacuugcugaaaauaaaacuuugcuauguauuuacucu

SEQ ID NO: 87853 - RNA, 64 nt, hsa
auagcauuuauuucugugcccuuaaacccauuuagaaaauaacuacaaaguaaaaauguagagg

SEQ ID NO: 87854 - RNA, 64 nt, hsa
gaaaaaucaugucaucuucuauuuguacagaaaugaaaauaaaauaugaaaauaaugaaagaaa

SEQ ID NO: 87855 - RNA, 64 nt, hsa
aucuucuauuuguacagaaaugaaaauaaaauaugaaaauaaugaaagaaaugaaaagauagcu

SEQ ID NO: 87856 - RNA, 64 nt, hsa
gugggcaaaugucauuguuaccucuguguguuaagaaaauaaaaauauuuucuaaaggucugua

SEQ ID NO: 87857 - RNA, 64 nt, hsa
auuuugaaucccucuuccucacuuuuuuuucuaagaaaauaaacauuuuacuguuuuuauggau

SEQ ID NO: 87858 - RNA, 64 nt, hsa
aaauauugucacaaguaaauagcaaucaaaaggagaaaauaacuuuuguauuuuuuuaaugugu

SEQ ID NO: 87859 - RNA, 64 nt, hsa
ugaaagauuggauuuucuauaacaccuuguguaagaaaauaaaaaacuugaucuaacugaaaaa

SEQ ID NO: 87860 - RNA, 64 nt, hsa
uccagaguuuauaauuacguaguuuuuaguagaugaaaauaauggauucuuguaccuaacauuu

SEQ ID NO: 87861 - RNA, 64 nt, hsa
gcaaguuguacuguaugcaguuuuguaaauaagugaaaauaauuuguuguacuuuuuauucaau

SEQ ID NO: 87862 - RNA, 64 nt, hsa
auucauaugcuucccagagaagcucauuuaguuagaaaauaaggcaaguuuugaagccugcuaa

SEQ ID NO: 87863 - RNA, 64 nt, hsa
agaugacuauucaguggcuaacuuggguuaggaagaaaauaauuagguauuuucuccaaauguu

SEQ ID NO: 87864 - RNA, 64 nt, hsa
uuuuuuuuccaguaaugagcuuaagaaauuuguggaaaauaacucaccuggcaucuuacaucug

SEQ ID NO: 87865 - RNA, 64 nt, hsa
gaauugucugaacacaguagaacgauacaauccugaaaauaauaccuggacuuuaauugcaccc

SEQ ID NO: 87866 - RNA, 64 nt, hsa
ugccccucaggggaauucggagcuagaggacauggaaaauaaagccaggaaagucaaaaaaacg

SEQ ID NO: 87867 - RNA, 64 nt, hsa
aaaagcgcaaagaggagaaugaagauccagaaaggaaaauaaagaagaagggcuucggcgccau

SEQ ID NO: 87868 - RNA, 64 nt, hsa
acuccagccggggugacagagugagacuccgacugaaaauaaauaaauaaauaaauaaauaaau

SEQ ID NO: 87869 - RNA, 64 nt, hsa
aaaaaguuuauuuuccuuuugucugggcaguagugaaaauaacuacucacaacauucacuaugu

SEQ ID NO: 87870 - RNA, 64 nt, hsa
aguuaaagaaaggaaaagaaaacaaaaaacgaaugaaaauaacugaauuuggaggcuggaguaa

SEQ ID NO: 87871 - RNA, 64 nt, hsa
uugaaauucuauuuauaauacagaaucuuguuuugaaaauaaccuaauuaauauauuaaaauuc

SEQ ID NO: 87872 - RNA, 64 nt, hsa
auaaagaccagaaauucccuuuucaccuuuucaggaaaauaacuuagacucuaguauuuauggg

SEQ ID NO: 87873 - RNA, 64 nt, hsa
gccuuaucggggcgaaccuuuuaggauuccaugugaaaauaaaauaugaggaaaaguuuaaccu

SEQ ID NO: 87874 - RNA, 64 nt, hsa
caaaaacagagucgcuuuugccuuuucaaaucaagaaaauaagugcucugucaaaagcacaaaa

SEQ ID NO: 87875 - RNA, 64 nt, hsa
ucuauaauaaauuaacaagauucaccuaaccuuugaaaauaaaguaguauugaagacuuacaug

SEQ ID NO: 87876 - RNA, 64 nt, hsa
gucacauuuuucuacuauuugaccaaaaggaaaagaaaauaaagaagaacucuggaguggucua

SEQ ID NO: 87877 - RNA, 64 nt, hsa
ucucuguaaucugcuaugaaagaaaauaacaaaugaaaauaaauguguacuacacuuugaaaua

SEQ ID NO: 87878 - RNA, 64 nt, hsa
agguuucuuucuuucucuguaaucugcuaugaaagaaaauaacaaaugaaaauaaauguguacu

SEQ ID NO: 87879 - RNA, 64 nt, hsa
caucuaaaguccuggcccuggcccuuacuauuaggaaaauaaacagacaaaaacaaguaaauau

SEQ ID NO: 87880 - RNA, 64 nt, hsa
uaauaaaguaugacccacauuacuuuuuaugggugaaaauaagacaaaaauaauaguuuuagug

SEQ ID NO: 87881 - RNA, 64 nt, hsa
aguauauuuuagaaauuuguuaaugagaguaaaagaaaauaaauguguauagcucaguuuggau

SEQ ID NO: 87882 - RNA, 64 nt, hsa
cuuguuuaaauguccauuuuuauucuuuauguuugaaaauaaauuauggggauccuauuuagcu

SEQ ID NO: 87883 - RNA, 64 nt, hsa
uaaagacaaaguaauucuauuaaaugaacuaacugaaaauaauaauuauaggaagugauuauuc

SEQ ID NO: 87884 - RNA, 64 nt, hsa
ucuguagaauuuauuuuaacuaugaccuuuaauugaaaauaaauaauuaaaauaucagacaugu

SEQ ID NO: 87885 - RNA, 64 nt, hsa
ggccaggcauggccuaguaaguacaccaugccucgaaaauaaguccagaagcacuggacuaaag

SEQ ID NO: 87886 - RNA, 64 nt, hsa
caaacaaaacagauaugcuuacucuaguuaaaaagaaaauaaaucucaugucagacccagaaag

SEQ ID NO: 87887 - RNA, 64 nt, hsa
agaauugaccuuaauuuguuuuccagaaucaaaagaaaauaaaauauaaauuuugaaacuauga

SEQ ID NO: 87888 - RNA, 64 nt, hsa
cugucucaaaaaaaaaaaaaaaaaaaggagagaagaaaauaaagaaggcuaauauauaauuuuu

SEQ ID NO: 87889 - RNA, 64 nt, hsa
aauuaucauaucuuccauuccuguuauuggagaugaaaauaaaaagcaacuuaugaaaguagac

SEQ ID NO: 87890 - RNA, 64 nt, hsa
uuggaauagaauugguaaguugcaaagacuuuuugaaaauaauuaaauuaucauaucuuccauu

SEQ ID NO: 87891 - RNA, 64 nt, hsa
uagaugacuuuguggccaucuuguuauugaguaagaaaauaaagcauggacaucaugaaaauaa

SEQ ID NO: 87892 - RNA, 64 nt, hsa
guuauugaguaagaaaauaaagcauggacaucaugaaaauaacagauguuacccaaacucaucu

SEQ ID NO: 87893 - RNA, 64 nt, hsa
uguguugaugagagaauaaucuugggcagucugggaaaauaaggaaggcaucuccuucuuacuc

SEQ ID NO: 87894 - RNA, 64 nt, hsa
uaucauuaauaaauauaccuuugcucuuuucagggaaaauaacaaccacccuuacugauaguug

SEQ ID NO: 87895 - RNA, 64 nt, hsa
ccguaggcagagugcucacuuugaauugcuaauagaaaauaaugcacaguguccucaggauaug

SEQ ID NO: 87896 - RNA, 64 nt, hsa
gguaagguacaaguguguuaaaauugaaaacucugaaaauaacucuuuaaaaagcccucuuaau

SEQ ID NO: 87897 - RNA, 64 nt, hsa
uauugaaggucauaaucagugauuuuuguuauaugaaaauaauaguguuucacaguauuucuau

SEQ ID NO: 87898 - RNA, 64 nt, hsa
aaugauuuaauuuuuccuauugcucuuccuuguggaaaauaaaguguuuuguuuuuuucuguuu

SEQ ID NO: 87899 - RNA, 64 nt, hsa
ccugccauuuaaccccacaguuaauaaaguggcugaaaauaauaguagcucuggcuuggugcuu

SEQ ID NO: 87900 - RNA, 64 nt, hsa
agucuguuuuauguguuuugauuacuagugagcagaaaauaacauacccuguauucaaaauuac

SEQ ID NO: 87901 - RNA, 64 nt, hsa
acaaaucuuaaaguaucggaacuguuuagcuuaugaaaauaaucgacucugaauauuuguuaca

SEQ ID NO: 87902 - RNA, 64 nt, hsa
aucaagcuauuugggguguuuguuaguaaauagggaaaauaaucucaaaggaguuaaauguauu

SEQ ID NO: 87903 - RNA, 64 nt, hsa
cagcauaccacgccacaggguuagaaccaacgaagaaaauaaaaugagggugcccagcuuauaa

SEQ ID NO: 87904 - RNA, 64 nt, hsa
uacaagugugcaaauuaugacugcgugagccuuagaaaauaaaauguauaaagggcaacacaug

SEQ ID NO: 87905 - RNA, 64 nt, hsa
uugcaguauuuaaagcuuaagcuuucaggaaaaagaaaauaagaauucagugugugcaugacaa

SEQ ID NO: 87906 - RNA, 64 nt, hsa
ggaaaguguaggugaaaaaacuuguaacuguauugaaaauaaauaccauuaaacugugaucagu

SEQ ID NO: 87907 - RNA, 64 nt, hsa
acuuuguuuugguacauuugguugugcuuguggggaaaauaaaaacgcagagauccuuauauau

SEQ ID NO: 87908 - RNA, 64 nt, hsa
accgugcugacagauaucaaaguacucuagcagggaaaauaauuuguuugcuguguaaggaaga

SEQ ID NO: 87909 - RNA, 64 nt, hsa
ugauaaguuuacacacugugcaaucucacaaucugaaaauaaaguugaguuggcuguguuuucu

SEQ ID NO: 87910 - RNA, 64 nt, hsa
aucuuugccuuaccugaucacaaauuauguuggggaaaauaaagauuuaauauuucuuuaaaua

SEQ ID NO: 87911 - RNA, 64 nt, hsa
uaaaaugugaaaaaacauuauuuuuucaaagcaagaaaauaauuuacugcccucuuacauaaug

SEQ ID NO: 87912 - RNA, 64 nt, hsa
uaugggcaaaaacauucuauuauagugaacuaaugaaaauaacagcguauuuucaauauuuucu

SEQ ID NO: 87913 - RNA, 64 nt, hsa
aaaaaaaaaaaucaaguaauuguuuuccuaugaggaaaauaaccaugagcuguaucaugcuacu

SEQ ID NO: 87914 - RNA, 64 nt, hsa
aacagucuucauuuuuaaguaacugauuuaaaaggaaaauaauaaaauauguucguuuaucauu

SEQ ID NO: 87915 - RNA, 64 nt, hsa
uggacauaaagaaaauccuacuuauagaaaaggagaaaauaauuaaacagucuucauuuuuaag

SEQ ID NO: 87916 - RNA, 64 nt, hsa
uuuacaugaagcucaaguguuaggauugacuuaugaaaauaaauuuuauuucuauccaaauuug

SEQ ID NO: 87917 - RNA, 64 nt, hsa
uuagucacuuccucacauggaaggcagcuuuucagaaaauaacagacauugcucguuucucaug

SEQ ID NO: 87918 - RNA, 64 nt, hsa
cuuguagaauauguauuaaucauucuacauuaaagaaaauaaugguucuuacuggaaugucuag

SEQ ID NO: 87919 - RNA, 64 nt, hsa
auuuuuaugagcacagacuuucaagaaaauacuugaaaauaaauuacauugccuuuuguccauu

SEQ ID NO: 87920 - RNA, 64 nt, hsa
aauuuauuauuucaaaagaauaugucuuaaaagggaaaauaaaaacuuucuguugaaucacaac

SEQ ID NO: 87921 - RNA, 64 nt, hsa
uuacuuauaucaauuuaaaauuugcuagugguuugaaaauaauaauguacugacuacauguaug

SEQ ID NO: 87922 - RNA, 64 nt, hsa
aauaauuucgguacaucuuaugguuuaaagaguagaaaauaagaugaaauauccuaaaauauag

SEQ ID NO: 87923 - RNA, 64 nt, hsa
uuggcagagagguacaguauguuaucccuauggugaaaauaaauuaauuuguuguauauaguuc

SEQ ID NO: 87924 - RNA, 64 nt, hsa
aagauaugcacagucuauuuuuuguauaguauuggaaaauaaaaaugcuauaauuuggguaugg

SEQ ID NO: 87925 - RNA, 64 nt, hsa
uggaugaagguggguauuggggguggcugugaaagaaaauaauggagaaucacuuuucuagaca

SEQ ID NO: 87926 - RNA, 64 nt, hsa
gugggaggggagaaagggaaccuuuucuuaaaaugaaaauaauuacugcuauuuuaaaauuucu

SEQ ID NO: 87927 - RNA, 64 nt, hsa
uaagcauuuacaucacguacucauaaccuauuaugaaaauaaaugaaacuggcuggguauggug

SEQ ID NO: 87928 - RNA, 64 nt, hsa
ucccauccuggccaaugcuuaaauacuauuuguugaaaauaauucuuugagacagauuucagcu

SEQ ID NO: 87929 - RNA, 64 nt, hsa
guuuuguguuuuuuucuggaacuacuucaagugagaaaauaaaaaaaaauggugacaaagcugu

SEQ ID NO: 87930 - RNA, 64 nt, hsa
agucuuuagucaaaucucugcauuguuucaugcagaaaauaaagauacaauuaaggcugacauu

SEQ ID NO: 87931 - RNA, 64 nt, hsa
aucacauugugcuacuacgacuuuauuuuuucuugaaaauaaagccuugaggaugugaacauaa

SEQ ID NO: 87932 - RNA, 64 nt, hsa
acuuuguguuucagccauguauuugcagcugagagaaaauaaucauucuuauuucaugaaaauu

SEQ ID NO: 87933 - RNA, 64 nt, hsa
uaaugcuuucgauaguguuaacuugcugcaguaugaaaauaagacggauuuauuuuuccauuua

SEQ ID NO: 87934 - RNA, 64 nt, hsa
caccuguguuugcauauuuauauaugcuguggaugaaaauaacuuacuagagaauguauauuuu

SEQ ID NO: 87935 - RNA, 64 nt, hsa
auggccagaaaauauuguauugcuuggcagaaaagaaaauaaggucuaaaggaaaguagcacau

SEQ ID NO: 87936 - RNA, 64 nt, hsa
auaaaggaaaucaaauguuauuuuuaagaaaauggaaaauaaaaacuuuauaaacaccaucugc

SEQ ID NO: 87937 - RNA, 64 nt, hsa
gagguggaugucagaucugguagguugcagcagagaaaauaaaugugccuugagagaccacuca

SEQ ID NO: 87938 - RNA, 64 nt, hsa
gaaacacauuugccuaucuucuuacccugaaacagaaaauaaauauugugcuuuaugugguagu

SEQ ID NO: 87939 - RNA, 64 nt, hsa
auuacuuggguauucucugauuucuagcuaauaugaaaauaauuuucuuucuagaaacacauuu

SEQ ID NO: 87940 - RNA, 64 nt, hsa
gcauauaugcacagauacacacacacacacacacgaaaauaaauaaauguucauauucuucugu

SEQ ID NO: 87941 - RNA, 64 nt, hsa
aacagacauuuauuuucuccucucccuugaauaagaaaauaaguuuuccauuccuaugaacugu

SEQ ID NO: 87942 - RNA, 64 nt, hsa
uaacauuuauaggaggaaaaaaaucacuuugggagaaaauaaaauucaacucaagcauaaagcu

SEQ ID NO: 87943 - RNA, 64 nt, hsa
agggucagcaacaacaaagaaaaagacaauuacagaaaauaagcaagauuuggaaaggaaguau

SEQ ID NO: 87944 - RNA, 64 nt, hsa
aaacccauuaggcaugccuaauauuuaggcaagagaaaauaaaccaagauagauccauuuggac

SEQ ID NO: 87945 - RNA, 64 nt, hsa
cucaagaacaccuuuguuuugcacugacaagauggaaaauaaauuauauuaauuuuugaaaccc

SEQ ID NO: 87946 - RNA, 64 nt, hsa
agagcagaaauaaaaaggaagaaaauguagauuagaaaauaagacuucugagaaaaaguucaag

SEQ ID NO: 87947 - RNA, 64 nt, hsa
auugcaugacuauuauuuaucuucuuuuaguguagaaaauaauuuuuuacaaaaagucacuuuu

SEQ ID NO: 87948 - RNA, 64 nt, hsa
aaaucuuuaaauguauugaagcauugugcugucugaaaauaaggaauugcuuauaaaccagcca

SEQ ID NO: 87949 - RNA, 64 nt, hsa
uauguagcugauuuaauaagcuaguuagugaauggaaaauaaguguggaguauuaaaaauguuc

SEQ ID NO: 87950 - RNA, 64 nt, hsa
uuuugguggugaggaggaagaacaaauaauagaagaaaauaaaaaugagauagaagaaaaguaa

SEQ ID NO: 87951 - RNA, 64 nt, hsa
auuaguaguuaccuguaaauggcagaucuuuuaggaaaauaagagaaagguaagggcucuuuug

SEQ ID NO: 87952 - RNA, 64 nt, hsa
gauuccuggagggaagaccauuccuguuacaaaugaaaauaagcaacagaauuagcuacaucca

SEQ ID NO: 87953 - RNA, 64 nt, hsa
caucuccaggugaugcccaaggcacagggcugcagaaaauaaaccuccagauuccaccaacacg

SEQ ID NO: 87954 - RNA, 64 nt, hsa
ggcuauaauagcaauaaaaguuagacgaaguguagaaaauaaaauaaauuucauaauguuaguc

SEQ ID NO: 87955 - RNA, 64 nt, hsa
gcauuaaggaaguauaugaucugacuuuucagaagaaaauaaacaaaugcauuauguaagguca

SEQ ID NO: 87956 - RNA, 64 nt, hsa
guuaggagggccugugguagacagcgugaaucaugaaaauaagccuggagaguucuguuauuaa

SEQ ID NO: 87957 - RNA, 64 nt, hsa
acuuugauacgccucaucuuauccuacauuauuggaaaauaaaugagauguccacacaaaugga

SEQ ID NO: 87958 - RNA, 64 nt, hsa
aaaugaaaaagauccuuuucaaaaaggugauccugaaaauaaaacuaacacuccaguauuuugu

SEQ ID NO: 87959 - RNA, 64 nt, hsa
ggaaaugggaaauggauggaaaugggaaaggagggaaaauaauagcccagugagagcugaauga

SEQ ID NO: 87960 - RNA, 64 nt, hsa
aaaugguaucuaauuaauaacuagucugacaucagaaaauaaaauugaggcugauuuuuaaaaa

SEQ ID NO: 87961 - RNA, 64 nt, hsa
gugugaaaacaagugucaaaauuccucauauagagaaaauaauuuugaguuuagaguauuaucu

SEQ ID NO: 87962 - RNA, 64 nt, hsa
uccuugaaagcccauuaaguggaauagacuuucugaaaauaagaguucuuuaccucaguccucc

SEQ ID NO: 87963 - RNA, 64 nt, hsa
aaaaacugagacuauggacauucaaaucaugggagaaaauaauuuuguagauuauguuccauug

SEQ ID NO: 87964 - RNA, 64 nt, hsa
uaggauucuuuuggggaagagucauaauucuuuugaaaauaaccaugaauacacuuacaguuag

SEQ ID NO: 87965 - RNA, 64 nt, hsa
agauguuuauauauuaacgacaauuuuuuuuuuggaaaauaaaaagugccuaaaagauguaugu

SEQ ID NO: 87966 - RNA, 64 nt, hsa
uaucaaaggcaagauaucauuuauuggacuucuugaaaauaaaaguuacaaaauccaacaacaa

SEQ ID NO: 87967 - RNA, 64 nt, hsa
ggaaagugugacacaguuuuuaaauuuagauguagaaaauaaugaauuaaugagauuggugaaa

SEQ ID NO: 87968 - RNA, 64 nt, hsa
ggagauuuuuuuuuucacaguugaguuaguuugugaaaauaaagaacucuguagcucaccaagg

SEQ ID NO: 87969 - RNA, 64 nt, hsa
uugcccucaugaagaaucccuagaggaagauaaggaaaauaaguauuuuccaguuuugcuugac

SEQ ID NO: 87970 - RNA, 64 nt, hsa
uugcucucuagucucugaaaagcaaaaaaagugagaaaauaauuucuucagagauaacuucaag

SEQ ID NO: 87971 - RNA, 64 nt, hsa
acaacuaauuauuguugauacuuuucauuacaaggaaaauaaguuauaaauaccaugucaaauu

SEQ ID NO: 87972 - RNA, 64 nt, hsa
uuauguuuggaugcagcagcugaauauauccagagaaaauaaacuuaagauuacuggccuuugg

SEQ ID NO: 87973 - RNA, 64 nt, hsa
auuggauaaauaugaauaaauauuuucucucagggaaaauaauuuuugaaaguagggugauuga

SEQ ID NO: 87974 - RNA, 64 nt, hsa
gaaacuuguuuuuuuaacgucagccagauauuuagaaaauaaccucaaaaguguuuauaugguc

SEQ ID NO: 87975 - RNA, 64 nt, hsa
uagagagaucccaucucuaaaaaauaaaauauaagaaaauaaaacuuaggggauauacagauuu

SEQ ID NO: 87976 - RNA, 64 nt, hsa
uacuggugcugaaaggaaggauggauaacgaggagaaaauaaaacugugaggcucaaggcuggu

SEQ ID NO: 87977 - RNA, 64 nt, hsa
cagcauaaacgggggugggggggauccugauuuugaaaauaaucuauuuguagcuucucuucua

SEQ ID NO: 87978 - RNA, 64 nt, hsa
uuuaagaauuaaaaaaauacaaaaaagaaaaaaugaaaauaaaggaauaagaaguuaccuacuc

SEQ ID NO: 87979 - RNA, 64 nt, hsa
agccaacagaguaaaguggaaggaaguuuauucagaaaauaaaggaguaucacagcucuuuuag

SEQ ID NO: 87980 - RNA, 62 nt, hsa
uucagaugaugaagaaagaggaacgggcuuggaagaaaauaaucaagaagagcaaagcaugg

SEQ ID NO: 87981 - RNA, 64 nt, hsa
uacagaugcaaacagcuauaauuuugcaaaaaaggaaaauaacucuccugaacaucuaaaagau

SEQ ID NO: 87982 - RNA, 64 nt, hsa
guaguaaccccugcccagguauuuuuucacuugugaaaauaauuugagaaagaccuuuguuccu

SEQ ID NO: 87983 - RNA, 64 nt, hsa
acuaugauuuauuggguuucuuaaaaaucuugaagaaaauaauaaaauuuaucucacaauaagu

SEQ ID NO: 87984 - RNA, 64 nt, hsa
gagcuucuaagggcaucuuaacaggaugcuacaugaaaauaaggaaagaaauuaauacauauca

SEQ ID NO: 87985 - RNA, 64 nt, hsa
augugcuuaauuccuacagugaguuuauauuuuugaaaauaaaagcuaguaaauauucuuucug

SEQ ID NO: 87986 - RNA, 64 nt, hsa
uuuguuuauuuuaaagcaagaauggaagacccuugaaaauaaagaaguaauuauugacacauuu

SEQ ID NO: 87987 - RNA, 64 nt, hsa
ccuguugggcguuacuagaaacuauggaaaacuggaaaauaacuuugaaaaaauuggauaaagu

SEQ ID NO: 87988 - RNA, 64 nt, hsa
cauccucucuauaauuuggagucaucuuacuaaugaaaauaauguuuucccauauauuauuaaa

SEQ ID NO: 87989 - RNA, 64 nt, hsa
uauuuccuuuuaccuaauuugaauaugcauuugagaaaauaagaggauaaaggauggcuaagag

SEQ ID NO: 87990 - RNA, 64 nt, hsa
gccucaagaugguuuucaaaaaaauuuuuuuaaagaaaauaauuguauacgugucaacacagcu

SEQ ID NO: 87991 - RNA, 64 nt, hsa
gcaaauugugccuaagcgaaauauuuuuuuuaaggaaaauaaaaacauuaguuacaagauuuuu

SEQ ID NO: 87992 - RNA, 64 nt, hsa
uugcuuguagaaacaauuuugaaagccccuugaggaaaauaaaaaucaagaagaacacuuuucu

SEQ ID NO: 87993 - RNA, 64 nt, hsa
uaauacauuguaauacuguaugauaaucaugugugaaaauaauuuuugaaauauccuuuggcug

SEQ ID NO: 87994 - RNA, 64 nt, hsa
auagccuuuggcucacccagagucagggagagaugaaaauaauaggucagaaugcaagugacuu

SEQ ID NO: 87995 - RNA, 64 nt, hsa
gcuacuucguaauguuguuacuaaauuuuaucuugaaaauaaauaacaguguuugaggacagaa

SEQ ID NO: 87996 - RNA, 64 nt, hsa
uguccaguuauauuguuuuuuagaacaacacuuggaaaauaauuugcagugauuauauuucuga

SEQ ID NO: 87997 - RNA, 64 nt, hsa
uguauuuaugcccuuauaucccaaaaaugucuuagaaaauaaaaauucugggccuuacuuguuu

SEQ ID NO: 87998 - RNA, 64 nt, hsa
auuaaucaauggauauccuucaguagugaaugcagaaaauaaaaauacacagguaauuuaguau

SEQ ID NO: 87999 - RNA, 64 nt, hsa
cucaaguuaugaaauaaaacugagagauaauggagaaaauaauuuuuauggguuuuuuugguua

SEQ ID NO: 88000 - RNA, 64 nt, hsa
uaguccaaauauaagaaacugucauguuuugugggaaaauaauuuuauaauccauuuaaaguga

SEQ ID NO: 88001 - RNA, 64 nt, hsa
acuuccuauucuuucuuaaauuugauggagaagggaaaauaaauugcaguuauugauucuugcc

SEQ ID NO: 88002 - RNA, 64 nt, hsa
cauuaagaaauaauuuuagauuugugcucuagcagaaaauaacucuguacccaucaaucuuauu

SEQ ID NO: 88003 - RNA, 64 nt, hsa
uaauggugggguuuucugcuuuguuuuuauuuaagaaaauaaacacgacauauuuaaagaaggu

SEQ ID NO: 88004 - RNA, 64 nt, hsa
ggauuggaugaaagucaaagguugucuacuuuaagaaaauaaaauacccugaauggagcccagc

SEQ ID NO: 88005 - RNA, 64 nt, hsa
cugaauagaauuugaagcagucugaauguucuuugaaaauaacuggaguuauuagcauacccua

SEQ ID NO: 88006 - RNA, 64 nt, hsa
ccacuuuuaaaaaugacacauauuuaaacacuuagaaaauaaaguuaacacuuacugaagugcu

SEQ ID NO: 88007 - RNA, 64 nt, hsa
gacgagaaaacaauaacgauaaaagacagugaaagaaaauaacgauaaaagacagugaaagaaa

SEQ ID NO: 88008 - RNA, 64 nt, hsa
cagugaaagaaaauaacgauaaaagacagugaaagaaaauaacaauaaaagacaaggaaaaaau

SEQ ID NO: 88009 - RNA, 64 nt, hsa
aaggauauuuaagugagcauuuucuaguucauaugaaaauaaccauaguacaggaugauuucug

SEQ ID NO: 88010 - RNA, 64 nt, hsa
uaggugaagcauacuccaguguuuuagggguuuugaaaauaaauauuuaaauuucacaguccuc

SEQ ID NO: 88011 - RNA, 64 nt, hsa
auguaaagaaaucagauacaaacuacugcaauuagaaaauaaaauaugaacaacuuucaacaau

SEQ ID NO: 88012 - RNA, 64 nt, hsa
gauuccuauaauacagugcuauaagcuaugcacagaaaauaaaauguuugaaauccaagaauaa

SEQ ID NO: 88013 - RNA, 64 nt, hsa
uuuccaaucacuuaguagccccucaaaguaguuagaaaauaaacagauuuuuccaguguugauu

SEQ ID NO: 88014 - RNA, 64 nt, hsa
aaaccccacuuauggguguaagccuacuagacuugaaaauaaaguauaaaacauuuccaaucac

SEQ ID NO: 88015 - RNA, 60 nt, hsa
guaguuuucuaaacgcugcaaauuugcagccuuuaccacuacaaagaaguuuggaugagg

SEQ ID NO: 88016 - RNA, 60 nt, hsa
auuuagaugccuuccuaaauuguuacaaugcuuuaccaaaucuaugacuucuacauaaca

SEQ ID NO: 88017 - RNA, 60 nt, hsa
uauagauucaguaucuacuacccauauuuacuuuaccaaauauauuucuccucacugcau

SEQ ID NO: 88018 - RNA, 60 nt, hsa
agaugguauuugcacauuuaagauauguuacuuuaccaauuuuuaaugguaaucaacucu

SEQ ID NO: 88019 - RNA, 60 nt, hsa
ccacuugguuggcucccuuugucucuguaccuuuaccaacauuaggaucucaccucuuuc

SEQ ID NO: 88020 - RNA, 60 nt, hsa
aucucauauuuucucccucuuucucuuacucuuuaccaaguuuuccugguggcuuggcuu

SEQ ID NO: 88021 - RNA, 60 nt, hsa
augucgauggggcaagaacucagacuucuacuuuaccaaguaccacacacucuggaaugc

SEQ ID NO: 88022 - RNA, 60 nt, hsa
ucucuaagcucaagaugcaucccauugccacuuuaccauucuauuucccaagggaaccau

SEQ ID NO: 88023 - RNA, 60 nt, hsa
ccugaggcuucuguucaauuucauagacuccuuuaccauguaaaauuugucugauauuug

SEQ ID NO: 88024 - RNA, 60 nt, hsa
guuagucaauuguaucagguuuuccaagaccuuuaccaguaaauuauguuucuguaugua

SEQ ID NO: 88025 - RNA, 60 nt, hsa
aaauaucauguuaaauuagaaugaauuuaucuuuaccaaaaaccauguugcguucaaaga

SEQ ID NO: 88026 - RNA, 60 nt, hsa
uagagacaggacagaauguguucuuuucuccuuuaccaguccuauuuuucaaugggaaga

SEQ ID NO: 88027 - RNA, 64 nt, hsa; identical to SEQ ID NO: 24975

SEQ ID NO: 88028 - RNA, 64 nt, hsa; identical to SEQ ID NO: 24976

SEQ ID NO: 88029 - RNA, 64 nt, hsa; identical to SEQ ID NO: 24977

SEQ ID NO: 88030 - RNA, 64 nt, hsa; identical to SEQ ID NO: 24978

SEQ ID NO: 88031 - RNA, 64 nt, hsa; identical to SEQ ID NO: 24979

SEQ ID NO: 88032 - RNA, 64 nt, hsa; identical to SEQ ID NO: 24980

SEQ ID NO: 88033 - RNA, 64 nt, hsa; identical to SEQ ID NO: 24981

SEQ ID NO: 88034 - RNA, 64 nt, hsa; identical to SEQ ID NO: 24982

SEQ ID NO: 88035 - RNA, 64 nt, hsa
cuaaacguuggugaaaguuauaaccuccugccugggagaaaauauacaucaccuaaaaugaacu

SEQ ID NO: 88036 - RNA, 64 nt, hsa
ugccaacuaaacuacucuuuaggcagccuucugaggagaaaagcaacccuguuucaaauccacu

SEQ ID NO: 88037 - RNA, 64 nt, hsa
accuguaaauaugaaagaacaaagguuauuuccuggagaaaagacaauuuauucaacaccaacg

SEQ ID NO: 88038 - RNA, 64 nt, hsa
ucaucauaugggcacaacucugguguccuucuauggagaaaaccucaaguaaaguuuuauucug

SEQ ID NO: 88039 - RNA, 64 nt, hsa
cauagguagaugguaaagagaaugaggagaaaaaggagaaaagggaaaagcagaaaggaaaaaa

SEQ ID NO: 88040 - RNA, 64 nt, hsa
ggagggucacauagguagaugguaaagagaaugaggagaaaaaggagaaaagggaaaagcagaa

SEQ ID NO: 88041 - RNA, 64 nt, hsa
cucuguuucgaauauagccacagaaauaaaggauggagaaaaaucugggacagguaauuuugca

SEQ ID NO: 88042 - RNA, 64 nt, hsa
uucuguuucgaacauagccacagaaauaaaggauggagaaaaaucugggacagguaauuuugca

SEQ ID NO: 88043 - RNA, 64 nt, hsa
uucuguuuugaguauagccagagaaaacaaggauggagaaaaaucuaggacagguaauuuugaa

SEQ ID NO: 88044 - RNA, 64 nt, hsa
uucuguuuuggguauagccagagaaaacaaggauggagaaaaaucuaggacagguaauuuugaa

SEQ ID NO: 88045 - RNA, 64 nt, hsa
agaagaaaaaggaaaagggcaaauugaaagucaaggagaaaaagcgcaaagaggagaaugaaga

SEQ ID NO: 88046 - RNA, 64 nt, hsa
cucugaaacaugguggccugagagaagaagagcuggagaaaaugaaagaagagcgugaaaggug

SEQ ID NO: 88047 - RNA, 64 nt, hsa
gcagaauggcccuagaguucuuuucccugagaaaggagaaaaagaugggauugccacucaccca

SEQ ID NO: 88048 - RNA, 64 nt, hsa
gccacaaagccgguaaaugccucaauacguucugggagaaaacuuagcaaauccaucagcaggg

SEQ ID NO: 88049 - RNA, 64 nt, hsa
gcggaguuguuaaggacugaagaaaaacuucucuggagaaaaauaaaauugcaauucuacuuaa

SEQ ID NO: 88050 - RNA, 64 nt, hsa
agaaauucuguugaagacaguugagaauuccuuuggagaaaacagcccagcuuggcgugggguu

SEQ ID NO: 88051 - RNA, 64 nt, hsa
aaguauuaaugaaaaaagagccauaagcauuccaggagaaaaucucaagggagcuacauagagc

SEQ ID NO: 88052 - RNA, 64 nt, hsa
cuaagaauuucaggagugauguaugucuuaagagggagaaaaaaauauuucuuauuacuuuuuc

SEQ ID NO: 88053 - RNA, 64 nt, hsa
gaauauauaaauaacucuuauaacacaacaauaaggagaaaaauaaaucaauuuaaaaaauggg

SEQ ID NO: 88054 - RNA, 64 nt, hsa
cuaucaagaaggugaaaagauaaccugcagaaugggagaaaauauuugcgagucauauauauga

SEQ ID NO: 88055 - RNA, 64 nt, hsa
ugaaucaucaaauaaaagaauguggcuauuuuggggagaaaauuaugugugugugugcucaaga

SEQ ID NO: 88056 - RNA, 64 nt, hsa
gcaacagcucuuuugagaggaggccuaaaggacaggagaaaaggucuucaaucguggaaagaaa

SEQ ID NO: 88057 - RNA, 64 nt, hsa
agcaggacuucaggucuuccuggggguggauauaggagaaaauuucugccuggcacacaccugg

SEQ ID NO: 88058 - RNA, 64 nt, hsa
agucccacuccugucaccccacgcucugcacuggggagaaaacgggaggugcucgugcuggccc

SEQ ID NO: 88059 - RNA, 64 nt, hsa
uauaaacauaauucaaauauuuaaauauuuaagaggagaaaaguaacuagaaaaccaaugaaaa

SEQ ID NO: 88060 - RNA, 64 nt, hsa
cacaguauuucuauuuaaggcagcuauaaauauaggagaaaaauguuuuuggagagcugugaau

SEQ ID NO: 88061 - RNA, 64 nt, hsa
ugaaaaaggagaauugcaaauuuuaccaaaagauggagaaaagcacauuaaaaagauaccaaca

SEQ ID NO: 88062 - RNA, 64 nt, hsa
aguaaauuauagaauguauaagaaaaaauauaaaggagaaaaucaauuaucaggaaagcuaaag

SEQ ID NO: 88063 - RNA, 64 nt, hsa
uuauuaaacuagucaaaaaugcuaaaauaauuugggagaaaauauuuuuuaaguaguguuauag

SEQ ID NO: 88064 - RNA, 64 nt, hsa
uucuacacaucugccuaacuugggaaugaaugugggagaaaaucgcugcugcugagauggacuc

SEQ ID NO: 88065 - RNA, 64 nt, hsa
cucaacuuuuacuaaacauaagguaauucauacuggagaaaagccauacaaaugagaagaaugu

SEQ ID NO: 88066 - RNA, 64 nt, hsa
cucaaauguuguucaacaccagaaaauuuauauuggagaaaagcacuguaaauguaaugcauuu

SEQ ID NO: 88067 - RNA, 64 nt, hsa
cgcaaagcucacugaacauaaguuaauucauacuggagaaaaacccuacaaauguaaagaaugu

SEQ ID NO: 88068 - RNA, 64 nt, hsa
cucaacucuuauuacacauaagauaauucacaguggagaaaaacccuacaaaugugaagaaugu

SEQ ID NO: 88069 - RNA, 64 nt, hsa
gucacacuugauuguauauaagauaauucauacuggagaaaacucccagaaguggaguuuuccu

SEQ ID NO: 88070 - RNA, 64 nt, hsa
uucaaacuuuguucaauaccaggaaauuuauauuggagaaaaacccuaugaguguaaugaauuu

SEQ ID NO: 88071 - RNA, 64 nt, hsa
gucacgcuugauuguagguaagauaauuuauauuggagaaaaauccuccaaguaugaagaaugu

SEQ ID NO: 88072 - RNA, 64 nt, hsa
cucaaacuuuguucgacaucagggaauuuguauuggagaaaaacccugcaaauguaauaaauau

SEQ ID NO: 88073 - RNA, 64 nt, hsa
ccauccauucuguuacacuuuguauuuucuaacuggagaaaagagugaggaacagaauguuuua

SEQ ID NO: 88074 - RNA, 64 nt, hsa
ggaccuuggaggaugaaggcgaguaugugacacuggagaaaaguggaccaggcaugucuuuugc

SEQ ID NO: 88075 - RNA, 64 nt, hsa
auacuuaaauuaggauuucuuaaagaaaacauagggagaaaacuuuacaugcaauuaaaaaugg

SEQ ID NO: 88076 - RNA, 64 nt, hsa
auuuggacauaaagaaaauccuacuuauagaaaaggagaaaauaauuaaacagucuucauuuuu

SEQ ID NO: 88077 - RNA, 64 nt, hsa
ccauugcccucauggaacagagcauaucauagagggagaaaagucaaacuuguaauugugucuu

SEQ ID NO: 88078 - RNA, 64 nt, hsa
aguuucuggacguuugugcaguauugaaaagacaggagaaaagaaaacagaaaccugguuauaa

SEQ ID NO: 88079 - RNA, 64 nt, hsa
aguucauaaggaggugagaaguaauuuuuuuaaaggagaaaaauuuuuuggcuuuagauuuaaa

SEQ ID NO: 88080 - RNA, 64 nt, hsa
gauacuaugcaagaaaauguacaguugucgaaguggagaaaaugaggauauauucuugcagacg

SEQ ID NO: 88081 - RNA, 64 nt, hsa
uuacagccuuagaagaaagauugugaaaagcuggggagaaaaugcuuaaggacaugcuagggga

SEQ ID NO: 88082 - RNA, 64 nt, hsa
aaugucagaaaauaacagaugcuggugagguuguggagaaaaagauaugcuuauacacuguugg

SEQ ID NO: 88083 - RNA, 64 nt, hsa
cuaucaagagaguaaacagacagcuuacagaaugggagaaaauuguugcaaacuaugcaucuga

SEQ ID NO: 88084 - RNA, 64 nt, hsa
auuccagaaguuaaucauuugaauucugaacacuggagaaaaaccgaaaaauggacggggcaug

SEQ ID NO: 88085 - RNA, 64 nt, hsa
uaagauugcuauauuuuggguuauuuucuugacaggagaaaaagaucuaaagaucuuuuauuuu

SEQ ID NO: 88086 - RNA, 64 nt, hsa
cugggaguucucuggcuucacgaagcauguuuacggagaaaacuacaaccuaucaguacccaag

SEQ ID NO: 88087 - RNA, 64 nt, hsa
agcgaaaagaccaagaucaaauaauagcugggguggagaaaaaaauagcucaagacacaguuaa

SEQ ID NO: 88088 - RNA, 64 nt, hsa
auuuuccuucugaagucugagcccauuucuggggggagaaaaaaaaagcaaaucagaaaaccca

SEQ ID NO: 88089 - RNA, 64 nt, hsa
ugcccaguaaaauuucaggauuaacuaaagaagaggagaaaaagaagaaaagauucuucuuaaa

SEQ ID NO: 88090 - RNA, 64 nt, hsa
gcaggguuuauauuuuguauagaaucacaguuguggagaaaaaguaauaauuucucaaugaauu

SEQ ID NO: 88091 - RNA, 64 nt, hsa
cugaauagaaagagcacaguaaguaugcauugccggagaaaacguccuugaagcugcuugucuc

SEQ ID NO: 88092 - RNA, 64 nt, hsa
ucauacuuuuguuuugcaacauagaagucacacaggagaaaaauccuguaaguaaaacgaaugu

SEQ ID NO: 88093 - RNA, 64 nt, hsa
gcaaauacauagagagauucuguacauuuauuugggagaaaauuuuaucauauuuuaggcuuuu

SEQ ID NO: 88094 - RNA, 64 nt, hsa
aucuguuaaauuucacaaagucaugaggguaaauggagaaaauauuucugggauuacaaugaau

SEQ ID NO: 88095 - RNA, 64 nt, hsa
guaauuaacuggugcuuugaaaaucuuuuuuaagggagaaaaaucucaaccaaaguuaugcuca

SEQ ID NO: 88096 - RNA, 64 nt, hsa
cgaucaccaaaaugaaaagguggacuguagauugggagaaaauauuugcaaaccguuaucuggu

SEQ ID NO: 88097 - RNA, 64 nt, hsa
aaagauaagagauagcaagugucagcaagggucuggagaaaagggaauuuuuguauacuguugg

SEQ ID NO: 88098 - RNA, 64 nt, hsa
gaaguaauauggcccacacuuuauucaccacccuggagaaaaaaaaacccaggaauauguggaa

SEQ ID NO: 88099 - RNA, 64 nt, hsa
uacaaugcaauacuuacauuuuaauacucuuguaggagaaaaagcaacuguauaaaugaaugua

SEQ ID NO: 88100 - RNA, 64 nt, hsa
agaggggaaaaugaguuuuuauggggcugaacggggagaaaaggucaucaucgauucuacuuua

SEQ ID NO: 88101 - RNA, 64 nt, hsa
ugcagaacguauugguccagcuugcucuucagugggagaaaacacuuguaaguugcuaaacgag

SEQ ID NO: 88102 - RNA, 64 nt, hsa
uagguuugaacagugggagauaccagaggugggaggagaaaaaguuauuuauuaccguucccuu

SEQ ID NO: 88103 - RNA, 64 nt, hsa
guaauauauguuuaacuggagucccagaaggagaggagaaaaugaagaggcaugaagaaguauu

SEQ ID NO: 88104 - RNA, 64 nt, hsa
augcaaagaagcaauaaaauaugacuuauaaccaggagaaaaaucaguagaaacccagaaaaga

SEQ ID NO: 88105 - RNA, 64 nt, hsa
ugcaucuuuuuaaaacaaggaaaagggaaaaaaaggagaaaaaacgaugcaucaagcuuguuug

SEQ ID NO: 88106 - RNA, 64 nt, hsa
uaauagagauugauaagauuuagcaacugguguuggagaaaaaaagaaaagcaaaugaguguuu

SEQ ID NO: 88107 - RNA, 64 nt, hsa
ccccacaaggggagaaaaaguaggggaagcggauggagaaaaacccaaagccacuaguauuaga

SEQ ID NO: 88108 - RNA, 64 nt, hsa
auauuuaaacaucaucucacccacccccacaaggggagaaaaaguaggggaagcggauggagaa

SEQ ID NO: 88109 - RNA, 64 nt, hsa
auggucucugcccuucggagcuuauauuccaguaggagaaaaagcaaaaauaaaauaauuauaa

SEQ ID NO: 88110 - RNA, 64 nt, hsa
agguuauuggugacuuacuggacuggcaccgccaggagaaaauucuccugcuaacuuuuuuucu

SEQ ID NO: 88111 - RNA, 64 nt, hsa
ucaacagcaaacuucagccguuucacuuuuuguuggagaaaaauaguagauuuuaauuugacuc

SEQ ID NO: 88112 - RNA, 64 nt, hsa
aaucagauuguuuucacaguuaugauucccagugggagaaaaaugccucaauauauuuguaacc

SEQ ID NO: 88113 - RNA, 64 nt, hsa
gggcaggcuuggggaaaauggccaugcaggagguggagaaaauuggaacucuacucaacccauu

SEQ ID NO: 88114 - RNA, 64 nt, hsa
uuguguaacaaguacugcucccagcagcaauuagggagaaaacuagucuaaauuauuucaacug

SEQ ID NO: 88115 - RNA, 64 nt, hsa
uucaaaccuuacuguacaucagagaauucauacuggagaaaagccauauaaauguagugagugu

SEQ ID NO: 88116 - RNA, 64 nt, hsa
uauaggcaauaggaaucuccugcaaacuccuacaggagaaaaguuguaugaauguggaaacuuu

SEQ ID NO: 88117 - RNA, 64 nt, hsa
auaaaauugcugggaauauuugacucuccguauuggagaaaauaaaauuacaacauuacgacau

SEQ ID NO: 88118 - RNA, 64 nt, hsa
cuggaauuugaaaagccaaacugugaaaccauugggagaaaauagaugauauugucuaugacgu

SEQ ID NO: 88119 - RNA, 64 nt, hsa
uagguuuccaggccucacagccaagcugaagcuuggagaaaacucugcauucccaugagggcaa

SEQ ID NO: 88120 - RNA, 64 nt, hsa
ucugauuguuagacuguaaugcuauuccucuaugggagaaaaaaauuaauauaaagaaaaacaa

SEQ ID NO: 88121 - RNA, 64 nt, hsa
ccauaugucagaagcucccagcaccuccuacuugggagaaaagugagccaucugcuggucagga

SEQ ID NO: 88122 - RNA, 64 nt, hsa
uuuaguuuuccugaaaucaccaggucaggcacaaggagaaaagguuccuggauacugacuaacu

SEQ ID NO: 88123 - RNA, 64 nt, hsa
aaauuaugcuagagcaauuagacacccauggcgaggagaaaaaagaaccucuacuuaaaccuca

SEQ ID NO: 88124 - RNA, 64 nt, hsa
uacauaaaacuagauaacuuugaaaaaagccacaggagaaaaaucuucaggaucuugggcuagg

SEQ ID NO: 88125 - RNA, 64 nt, hsa
guugaggacagugacugccauuuguauauaaaaaggagaaaaaugguaaguacauaauugugaa

SEQ ID NO: 88126 - RNA, 64 nt, hsa
uucuuuucaucucagucauaacccaaaagcuacgggagaaaaagcagaaguguaaucucuguau

SEQ ID NO: 88127 - RNA, 64 nt, hsa; identical to SEQ ID NO: 87431

SEQ ID NO: 88128 - RNA, 64 nt, hsa; identical to SEQ ID NO: 87432

SEQ ID NO: 88129 - RNA, 64 nt, hsa; identical to SEQ ID NO: 87433

SEQ ID NO: 88130 - RNA, 64 nt, hsa; identical to SEQ ID NO: 87434

SEQ ID NO: 88131 - RNA, 64 nt, hsa; identical to SEQ ID NO: 87435

SEQ ID NO: 88132 - RNA, 64 nt, hsa; identical to SEQ ID NO: 87436

SEQ ID NO: 88133 - RNA, 64 nt, hsa; identical to SEQ ID NO: 87437

SEQ ID NO: 88134 - RNA, 64 nt, hsa; identical to SEQ ID NO: 87438

SEQ ID NO: 88135 - RNA, 64 nt, hsa; identical to SEQ ID NO: 87439

SEQ ID NO: 88136 - RNA, 64 nt, hsa; identical to SEQ ID NO: 87440

SEQ ID NO: 88137 - RNA, 64 nt, hsa; identical to SEQ ID NO: 87441

SEQ ID NO: 88138 - RNA, 64 nt, hsa; identical to SEQ ID NO: 87442

SEQ ID NO: 88139 - RNA, 64 nt, hsa; identical to SEQ ID NO: 87443

SEQ ID NO: 88140 - RNA, 64 nt, hsa; identical to SEQ ID NO: 87444

SEQ ID NO: 88141 - RNA, 64 nt, hsa; identical to SEQ ID NO: 87445

SEQ ID NO: 88142 - RNA, 64 nt, hsa; identical to SEQ ID NO: 87446

SEQ ID NO: 88143 - RNA, 64 nt, hsa; identical to SEQ ID NO: 87447

SEQ ID NO: 88144 - RNA, 64 nt, hsa; identical to SEQ ID NO: 87448

SEQ ID NO: 88145 - RNA, 64 nt, hsa; identical to SEQ ID NO: 87449

SEQ ID NO: 88146 - RNA, 64 nt, hsa; identical to SEQ ID NO: 87450

SEQ ID NO: 88147 - RNA, 64 nt, hsa; identical to SEQ ID NO: 87451

SEQ ID NO: 88148 - RNA, 64 nt, hsa; identical to SEQ ID NO: 87452

SEQ ID NO: 88149 - RNA, 64 nt, hsa; identical to SEQ ID NO: 87453

SEQ ID NO: 88150 - RNA, 64 nt, hsa; identical to SEQ ID NO: 87454

SEQ ID NO: 88151 - RNA, 64 nt, hsa; identical to SEQ ID NO: 87455

SEQ ID NO: 88152 - RNA, 64 nt, hsa; identical to SEQ ID NO: 87456

SEQ ID NO: 88153 - RNA, 64 nt, hsa; identical to SEQ ID NO: 87457

SEQ ID NO: 88154 - RNA, 64 nt, hsa; identical to SEQ ID NO: 87458

SEQ ID NO: 88155 - RNA, 64 nt, hsa; identical to SEQ ID NO: 87459

SEQ ID NO: 88156 - RNA, 64 nt, hsa; identical to SEQ ID NO: 87460

SEQ ID NO: 88157 - RNA, 64 nt, hsa; identical to SEQ ID NO: 87461

SEQ ID NO: 88158 - RNA, 64 nt, hsa; identical to SEQ ID NO: 87462

SEQ ID NO: 88159 - RNA, 64 nt, hsa; identical to SEQ ID NO: 87463

SEQ ID NO: 88160 - RNA, 64 nt, hsa; identical to SEQ ID NO: 87464

SEQ ID NO: 88161 - RNA, 64 nt, hsa; identical to SEQ ID NO: 87465

SEQ ID NO: 88162 - RNA, 64 nt, hsa; identical to SEQ ID NO: 87466

SEQ ID NO: 88163 - RNA, 64 nt, hsa; identical to SEQ ID NO: 87467

SEQ ID NO: 88164 - RNA, 64 nt, hsa; identical to SEQ ID NO: 87468

SEQ ID NO: 88165 - RNA, 64 nt, hsa; identical to SEQ ID NO: 87469

SEQ ID NO: 88166 - RNA, 64 nt, hsa; identical to SEQ ID NO: 87470

SEQ ID NO: 88167 - RNA, 64 nt, hsa; identical to SEQ ID NO: 87471

SEQ ID NO: 88168 - RNA, 64 nt, hsa; identical to SEQ ID NO: 87472

SEQ ID NO: 88169 - RNA, 64 nt, hsa; identical to SEQ ID NO: 87473

SEQ ID NO: 88170 - RNA, 64 nt, hsa; identical to SEQ ID NO: 87474

SEQ ID NO: 88171 - RNA, 64 nt, hsa; identical to SEQ ID NO: 87475

SEQ ID NO: 88172 - RNA, 64 nt, hsa; identical to SEQ ID NO: 87476

SEQ ID NO: 88173 - RNA, 64 nt, hsa; identical to SEQ ID NO: 87477

SEQ ID NO: 88174 - RNA, 64 nt, hsa; identical to SEQ ID NO: 87478

SEQ ID NO: 88175 - RNA, 64 nt, hsa; identical to SEQ ID NO: 87479

SEQ ID NO: 88176 - RNA, 64 nt, hsa
cugcagauccacuuaggccccaggguccacggauggccccaaaggcugagggccccaaagccac

SEQ ID NO: 88177 - RNA, 64 nt, hsa
gccccaggguccacggauggccccaaaggcugagggccccaaagccacuugucuccuaggaucc

SEQ ID NO: 88178 - RNA, 64 nt, hsa
ccuugggcucacacucucacugagccuugcugguggccccaagacacgcaaugucaggccaugg

SEQ ID NO: 88179 - RNA, 64 nt, hsa
gcaggacuccagggcgugcacggugagcagaugaggccccaagcucaucacaccagggggccau

SEQ ID NO: 88180 - RNA, 64 nt, hsa
ucugggccucauguagcucaccccggucacgcaugaaggcaaaagcaggucagaagcgaauacu

SEQ ID NO: 88181 - RNA, 64 nt, hsa
uauuuuuuuaagucauuucauguuucugucuggggaaggcaaguuaguuaaguaucacugaugu

SEQ ID NO: 88182 - RNA, 64 nt, hsa
cugugagaaguucucugggaguguggguacauuugaaggcaagugacuucaguugagggcaagu

SEQ ID NO: 88183 - RNA, 64 nt, hsa
uaagccacuuguguaguugggccccuccaggguugaaggcaagaggagaaaggcacagcguuug

SEQ ID NO: 88184 - RNA, 64 nt, hsa
acacacacaaauacacaaucucuaggguaagccagaaggcaagaucagauuaaaaacaccaugu

SEQ ID NO: 88185 - RNA, 64 nt, hsa
ugugccauggcugguguauauaugugcaauguuagaaggcaaaagagugaugguaggcagaggg

SEQ ID NO: 88186 - RNA, 64 nt, hsa
gaggcuacaagggguguguaaccguguaacacgugaaggcaaugcucaccucuucuuuaccaga

SEQ ID NO: 88187 - RNA, 64 nt, hsa
uuuucuaaaugucuuuuucacaaucauguacugggaaggcaauuucauacuaaacugauuaaau

SEQ ID NO: 88188 - RNA, 64 nt, hsa
uuucaggaaaugugcauggucuacccgcuuuaucgaaggcaagaauccgguuuggaauauaaaa

SEQ ID NO: 88189 - RNA, 64 nt, hsa
acuuggacagcuuucugcccccucuuucacuaaggaaggcaaaugaagugaaaaaaaaaaaugc

SEQ ID NO: 88190 - RNA, 64 nt, hsa
caaaccaccaggacugaaagaagaaaacaguacagaaggcaaaguuuacagauguuuuuaauuc

SEQ ID NO: 88191 - RNA, 64 nt, hsa
aucugaccguucuauuguguggaugaccacauaagaaggcaauuuuaguguauuaaucauagau

SEQ ID NO: 88192 - RNA, 64 nt, hsa
aaaguaucucguuacuggaaguuagcacucuagggaaggcaaaaacagaaccaaauaaaugugu

SEQ ID NO: 88193 - RNA, 64 nt, hsa
uugaagacaaaauauuugggaaaaccuaucggaagaaggcaagccuccccaacuuaagccaugu

SEQ ID NO: 88194 - RNA, 64 nt, hsa
gggcuccaccagccagaagccucuggaaggcaacgaaggcaaugcugcucccugaguccagucc

SEQ ID NO: 88195 - RNA, 64 nt, hsa
gacuccguggggcuccaccagccagaagccucuggaaggcaacgaaggcaaugcugcucccuga

SEQ ID NO: 88196 - RNA, 64 nt, hsa
gcacaccagugcaagcagaugacaaaaaggugcagaaggcaaucuuaaaacagaaaggugcagg

SEQ ID NO: 88197 - RNA, 64 nt, hsa
uaauagaugaugguaaguuccacuuugguuauuggaaggcaagucauuauuacugguauuaguu

SEQ ID NO: 88198 - RNA, 64 nt, hsa
guuuugaaggcaaaauugcaaaucuugaaauuaagaaggcaaaaauguaaaggagucaaaacua

SEQ ID NO: 88199 - RNA, 64 nt, hsa
auacuuuuuacaauuaaaaaaaaagaucuguuuugaaggcaaaauugcaaaucuugaaauuaag

SEQ ID NO: 88200 - RNA, 64 nt, hsa
cuuucccugacuccuggugcccucucccuuuguccccccagagagacauaugcccccagagaga

SEQ ID NO: 88201 - RNA, 64 nt, hsa
gcccucucccuuuguccccccagagagacauaugcccccagagagagcaaaucgaagcguggga

SEQ ID NO: 88202 - RNA, 64 nt, hsa
augaagugauccuuaacccccaaguaaucauuaacccccagaccagccucagaacugaaggaga

SEQ ID NO: 88203 - RNA, 64 nt, hsa
ggucacagggggugucgggcggaggaaagugcaucccccagagcuuggguuccucucuccucuc

SEQ ID NO: 88204 - RNA, 64 nt, hsa
ccugcccuagacccugccagaaaagggggcucuucccccagagaaguggcuuggagggaacuuc

SEQ ID NO: 88205 - RNA, 64 nt, hsa
auuuggacaucuggggaaguggagauuaaccccucccccagacucgugccuugccucucaggac

SEQ ID NO: 88206 - RNA, 64 nt, hsa
uacuucgagaguagcccugucuuguccccuccuacccccagauuagcaccaccccucucacucu

SEQ ID NO: 88207 - RNA, 64 nt, hsa
acuaacauaacuuauuaaaggaggggucccuccucccccagagcaguccucaacacuaugucag

SEQ ID NO: 88208 - RNA, 64 nt, hsa
cagugcuggaaaugcagccacuggcagaucuggccccccagacgucaccgcagggccucugaag

SEQ ID NO: 88209 - RNA, 64 nt, hsa
uugcagggcagacagugccuggcacugaggggugcccccagaccccgcugggacuggaugugcc

SEQ ID NO: 88210 - RNA, 64 nt, hsa
ccagcucugccucgcagcccccucagcaugggugcccccagaaguaagcagcucuuggacccac

SEQ ID NO: 88211 - RNA, 64 nt, hsa
ugugguucagguggggucuccagaaggcugcuugcccccagagagccaucucuuccauuuuuga

SEQ ID NO: 88212 - RNA, 64 nt, hsa
caaggucugugggcucuaggcagcccggcagcagcccccagaggaacugcucccaccucuccuu

SEQ ID NO: 88213 - RNA, 64 nt, hsa
aggauccugaccugacuauccaugccauccauggcccccagacugacucugcaccuggcccuuu

SEQ ID NO: 88214 - RNA, 64 nt, hsa
gggggcugagucuucccuggccccuuggaagaggcccccagaugcccaggcucacuucaguguu

SEQ ID NO: 88215 - RNA, 64 nt, hsa
cuagcuuuuagcuauaaaccacucaaagauucagcccccagaucccacagucagaacugaaucu

SEQ ID NO: 88216 - RNA, 64 nt, hsa
gcucaauucucagggcuggaaugagccggcuggucccccagaaagcuggagugggguacagagu

SEQ ID NO: 88217 - RNA, 64 nt, hsa
augggacaccaggccugacucaggcagguucugccccccagaccccacacacggccgccccacg

SEQ ID NO: 88218 - RNA, 64 nt, hsa
cccaccgggucugggcucuggaaggagccagaugcccccagaaaggugggugguggagacggca

SEQ ID NO: 88219 - RNA, 64 nt, hsa
caggcguggagguguccccaccccuuccaccugucccccagacccaaagcucucuccccacccu

SEQ ID NO: 88220 - RNA, 64 nt, hsa
auggcgggaaaacacugacugacuccuuggguuucccccagacauacuuucagagcgcuagcug

SEQ ID NO: 88221 - RNA, 64 nt, hsa
ccagcccuggacugaggauggaugguuccaugagcccccagaugaaaaccuggauucgacaggg

SEQ ID NO: 88222 - RNA, 64 nt, hsa
ugggcccagcuugcucagucaaggggcugccaggcccccagaaaacacuuggagccaucgggua

SEQ ID NO: 88223 - RNA, 64 nt, hsa
aauucagcacgcacacaacacacaagggagagaacccccagaugagaaaauaggaaggagcaau

SEQ ID NO: 88224 - RNA, 64 nt, hsa
cuccauggcaggcaucccugccuugggcugcccucccccagaccccugaccacccccugggucc

SEQ ID NO: 88225 - RNA, 64 nt, hsa
acaaugagagaccaggaguagguccuaucagugccccccagaguagagagcaauaagagcccag

SEQ ID NO: 88226 - RNA, 64 nt, hsa
gucacccuccucccccauggagguuuccaggggucccccagacaugaaagaggggugagcugga

SEQ ID NO: 88227 - RNA, 64 nt, hsa
gauagucacauguuuuucuuccuuguccccacggcccccagaacaacauucucccugcuggcag

SEQ ID NO: 88228 - RNA, 64 nt, hsa
gggggagccuaggcccagcuccuccgcgguuggccccccagaccauaccucugacccacccagc

SEQ ID NO: 88229 - RNA, 64 nt, hsa
cccugccacagggcacuggaauggacagcaggcgcccccagaugcagguaccucccuugguccc

SEQ ID NO: 88230 - RNA, 64 nt, hsa
cacagacacugaccucagaggccccacucuggugcccccagacccugggcccccagccucuggc

SEQ ID NO: 88231 - RNA, 64 nt, hsa
gaaggaaagggaagaagagaucacgaaacugggacccccagaagggaggagugggcuuugaacu

SEQ ID NO: 88232 - RNA, 64 nt, hsa
uuuguggguuaugaggacacagaagucccugaggcccccagaccuggcucagccaaccuccuuc

SEQ ID NO: 88233 - RNA, 64 nt, hsa
ugaggucauaauaucccucuaggacuuaccuguucccccagaucuugccuugggaccacauuug

SEQ ID NO: 88234 - RNA, 64 nt, hsa
caaucuuaacuaccuacccaaaggauuugcauuacccccagauucugugccaacaaccuuuuaa

SEQ ID NO: 88235 - RNA, 64 nt, hsa
uggccucucaucaggaucugccccccagagaccccccccagacacugcagggccuggugaugcu

SEQ ID NO: 88236 - RNA, 64 nt, hsa
caguaaaggcuccuggccucucaucaggaucugccccccagagaccccccccagacacugcagg

SEQ ID NO: 88237 - RNA, 64 nt, hsa
ccugccaccugagaagauggaaaggaaggagcugcccccagagcaucaguccuugaagagcagc

SEQ ID NO: 88238 - RNA, 64 nt, hsa
ugccacuuuaggauggcgaugcaggugucuuuuccccccagaucuccucuuccuucagcaaagg

SEQ ID NO: 88239 - RNA, 64 nt, hsa
agcuggggguccgcaucccuaccucagcuuaggacccccagagccaagguggcugggaucuggc

SEQ ID NO: 88240 - RNA, 64 nt, hsa
caucugugguccaggccggcaucguccuggccaccccccagaucuggugccugcuggccggccc

SEQ ID NO: 88241 - RNA, 64 nt, hsa
cugauaaauugagggcacuuguacccucccugugcccccagaagguucuuggagagaagugcaa

SEQ ID NO: 88242 - RNA, 64 nt, hsa
cgccccccggagguggcagcagccccgagggacgcccccagaggaccgggaggcaccccacccu

SEQ ID NO: 88243 - RNA, 64 nt, hsa
cccaggagcucggacugcugguccuggagagcugcccccagaagaagcuggagugcauagguca

SEQ ID NO: 88244 - RNA, 64 nt, hsa
cccccaccgccauuggcauccccaccaagcuccucccccagaacccugaggccaagggggccac

SEQ ID NO: 88245 - RNA, 64 nt, hsa
aauggagcagcagcaggacagacccccacgaggccccccagagaggaggaagaucccacggagg

SEQ ID NO: 88246 - RNA, 64 nt, hsa
acacugccugagggacaacagacaucagaacaaacccccagagagaaacagucaaaaucagggc

SEQ ID NO: 88247 - RNA, 64 nt, hsa
ugcuucuccccccaucccagggucccacccccaacccccagagguggcccuuguuuacagugag

SEQ ID NO: 88248 - RNA, 64 nt, hsa
gggcagucaccacccagcccuuccuugggcgucucccccagagugcugucgggaccacaucugu

SEQ ID NO: 88249 - RNA, 61 nt, hsa
guccccaagauccuccuuagaaucccacagucccccagacccuccuuagaaugccacaguc

SEQ ID NO: 88250 - RNA, 64 nt, hsa
uuagaaugccacagucccccaacccuccacagagcccccagacccaccagaacuuccacagacg

SEQ ID NO: 88251 - RNA, 64 nt, hsa
gcugagcacagaccagcagcgaccucccuuccagcccccagaaagcucggucacuugaguguuu

SEQ ID NO: 88252 - RNA, 64 nt, hsa
ccuccuccacucccuuuuuguaacucccuuacagcccccagacccuucuugaaacgagagccag

SEQ ID NO: 88253 - RNA, 64 nt, hsa
acagaagucgcaggcagccucucagaaaguuucacccccagaggacgaagaggucaagaaccuu

SEQ ID NO: 88254 - RNA, 64 nt, hsa
gaaccccaguacugacagccuccuuaaaguuucacccccagagggagccgagacucggaaagug

SEQ ID NO: 88255 - RNA, 64 nt, hsa
ccucucaggcagaugccgaggccaaguggacugacccccagauuuccuucccuuggaugcuuuc

SEQ ID NO: 88256 - RNA, 64 nt, hsa
ccaaagacuucauccggcaccuucuggagcgagacccccagaagagguucaccugccaacaggc

SEQ ID NO: 88257 - RNA, 64 nt, hsa
gccauggagugggaauccccagccgaggcccuaggccccucagcagggaagggauccccgggga

SEQ ID NO: 88258 - RNA, 64 nt, hsa
ucugcaucuuggaggcagggaggugagggcaggugccccucagacacuucaggaagguaguuug

SEQ ID NO: 88259 - RNA, 64 nt, hsa
caugccgggaagccagagaccugcaggggccucggccccucacaucguguaugucucuccuuga

SEQ ID NO: 88260 - RNA, 64 nt, hsa
ucucugcucccuucuucaguaagcaaggagccccgccccucaggcccagccucuggcaagaggu

SEQ ID NO: 88261 - RNA, 64 nt, hsa
aucgguauauuaaguccaaaagaugguccgggcugccccucacaaaagcuucugcauccacgug

SEQ ID NO: 88262 - RNA, 64 nt, hsa
gagccugggacccuguuuacaguugcacaucugggccccucacuguggggauugaucauucuca

SEQ ID NO: 88263 - RNA, 64 nt, hsa
cccacagcccugagaugggccggcccccuuccuggccccucauggcgggacuggagaaaugguc

SEQ ID NO: 88264 - RNA, 64 nt, hsa
cccggcccauaucccugguugccucauggccagcgccccucagccucugccacugugaaccggc

SEQ ID NO: 88265 - RNA, 64 nt, hsa
ggaccccucccuugcucagugccuccuggccggggccccucaccccaaggggucuguauauaca

SEQ ID NO: 88266 - RNA, 64 nt, hsa
aacauuaaucaccaaaguauuaauguacagaguggccccucaccugggccuuuccugugccaac

SEQ ID NO: 88267 - RNA, 64 nt, hsa
ugcucgaguuccuggaugugcagaagcacuuguggccccucaaggaccucacgcugacgagcaa

SEQ ID NO: 88268 - RNA, 64 nt, hsa
ccaucagggaccuccaggugcauggauuggugcugccccucaugcugcccagcuucuacucaga

SEQ ID NO: 88269 - RNA, 64 nt, hsa
ggccuuucccaccuggagagaaacuuccagaccagccccucauaccacagccaagaggggccuu

SEQ ID NO: 88270 - RNA, 64 nt, hsa
ggccuuucccaccgguagagaaacuuccagaccagccccucacaccacagccaagagaagccuu

SEQ ID NO: 88271 - RNA, 64 nt, hsa
ggccuuuaccaccuggagagaagcuuccagaccagccccucacaccacagccaggagaggccuu

SEQ ID NO: 88272 - RNA, 64 nt, hsa; identical to SEQ ID NO: 88269

SEQ ID NO: 88273 - RNA, 64 nt, hsa
ggccuuucucaccuggagagaaacuuccagaccagccccucacaccaccgccaggagaggccuu

SEQ ID NO: 88274 - RNA, 64 nt, hsa
ggccuuucccaccgggagagaaacuuccagaccagccccucacaccacagccaggagaggccuu

SEQ ID NO: 88275 - RNA, 64 nt, hsa
ggccuuucccaccgggagaggaacuuccagaccagccccucacaccacagccaggagaggccuu

SEQ ID NO: 88276 - RNA, 64 nt, hsa
ucacucccuuuggcuacccuggccgugccuggcagccccucaggccccacagguggguccuggu

SEQ ID NO: 88277 - RNA, 64 nt, hsa
acggaaaucucugggacaauggcuccuccagagggccccucagagccaggugcuggccagaugc

SEQ ID NO: 88278 - RNA, 64 nt, hsa
uuguagcccucugagcccucauccugcaggcagagccccucagugcucugagaaaccugcccug

SEQ ID NO: 88279 - RNA, 64 nt, hsa
gagaaaagccgaaaaagcaugcaucuuagaaauagccccucaauuccaggagucaacaugccaa

SEQ ID NO: 88280 - RNA, 64 nt, hsa
gggagaguaagaacuaagggaaugaguuugggcggccccucauaaaggaccuuagaggcaggga

SEQ ID NO: 88281 - RNA, 64 nt, hsa
ccccaaagcaguuagacuauggagagccgacccagccccucaggaacccucauccuucaaagac

SEQ ID NO: 88282 - RNA, 64 nt, hsa
cuccccuagacucaggcuuccuuuggagauuaaggccccucagagaucaacagaccaacauuuu

SEQ ID NO: 88283 - RNA, 64 nt, hsa
cugaggcuggcaaguggggcaacguguggaggaagccccucauaauuuggagaaaacuugauac

SEQ ID NO: 88284 - RNA, 64 nt, hsa
uauugccauacaauuuuaauuuauacaaguauuggccccucaagugguuggaaauuuuuuuuuu

SEQ ID NO: 88285 - RNA, 64 nt, hsa
uccuggcccugccucuggcccuucccgggccgcugccccucagccauguggcacuucugagcuc

SEQ ID NO: 88286 - RNA, 64 nt, hsa
ggcagagaggaggggagguccugaggggacugcugccccucacucggcauccccugcagaguca

SEQ ID NO: 88287 - RNA, 64 nt, hsa
gcugagguuuggguggugugaucuguccuaauuggccccucaccaaugcaucuaucugucugcc

SEQ ID NO: 88288 - RNA, 64 nt, hsa
ugggaagccuggcaaagcugcccaaccggguagugccccucacccaucggaucacugccuucuu

SEQ ID NO: 88289 - RNA, 64 nt, hsa
gcacuggaugggauguacuucucagccccgcugagccccucauuugugcccagcauuuugugug

SEQ ID NO: 88290 - RNA, 64 nt, hsa
acuucuccuugaggcagcuggagagcuaucccccgccccucaagcaccugugccguguggccau

SEQ ID NO: 88291 - RNA, 64 nt, hsa
cccuuguuaaugaugcuccugccucugccucccagccccucacccagcacagcucugccuggac

SEQ ID NO: 88292 - RNA, 64 nt, hsa
aggcagacccccaccaccauacaugcugucuguggccccucagacauucuguuucaucucccau

SEQ ID NO: 88293 - RNA, 64 nt, hsa
ccugucaccucccucucaccaacccggggucugagccccucauuccugaccguccguguucuca

SEQ ID NO: 88294 - RNA, 64 nt, hsa
aucagggccugcauuuauggagugcuugcuaugugccccucauggcaggcccacagcacucuga

SEQ ID NO: 88295 - RNA, 64 nt, hsa
aagggcagccccagcagcuggauucucaggcugggccccucaccuggcagaguccauaguggag

SEQ ID NO: 88296 - RNA, 64 nt, hsa
acuaccccucaacagagaugacuuugaugacucugccccucagcagggcuuacuaagcacuacc

SEQ ID NO: 88297 - RNA, 64 nt, hsa
aagcacuaccccuuaacagggaugacuccgcacugccccucaacagggaugacucagcagagau

SEQ ID NO: 88298 - RNA, 64 nt, hsa
agcagggaugacacagcaaggaugacucagcacugccccucagcaaggaugacucagcacugcc

SEQ ID NO: 88299 - RNA, 64 nt, hsa
cucaacagacaugacucagggauggcuuaguacugccccucagcagggaugacucagcaccgcc

SEQ ID NO: 88300 - RNA, 64 nt, hsa
aacagggaugacucagcagggaugacucagcaccgccccucaacaggcaugacucugcagagau

SEQ ID NO: 88301 - RNA, 64 nt, hsa; identical to SEQ ID NO: 88298

SEQ ID NO: 88302 - RNA, 64 nt, hsa
cucaacagggaugacucagggauggcuuaguacugccccucaacagggaugacucagcagggau

SEQ ID NO: 88303 - RNA, 64 nt, hsa; identical to SEQ ID NO: 88300

SEQ ID NO: 88304 - RNA, 64 nt, hsa
aacaggcaugacucugcagagaugacuuaguacugccccucagcagggaugacucaguacugcc

SEQ ID NO: 88305 - RNA, 64 nt, hsa
uaguacugccccucagcagggaugacucaguacugccccucagcagggaugacucagcacugcc

SEQ ID NO: 88306 - RNA, 64 nt, hsa
caguacugccccucagcagggaugacucagcacugccccucaacagggaugacucagcagggau

SEQ ID NO: 88307 - RNA, 64 nt, hsa
agcagugaugacacagcaaggaugacucagcacugccccucagcaaggaugacucagcacugcc

SEQ ID NO: 88308 - RNA, 64 nt, hsa; identical to SEQ ID NO: 88299

SEQ ID NO: 88309 - RNA, 64 nt, hsa
uaguacugccccucagcagggaugacucagcaccgccccucaacagggaugacucagcacugcc

SEQ ID NO: 88310 - RNA, 64 nt, hsa
cagcaccgccccucaacagggaugacucagcacugccccucaacagggaugacucagcagggau

SEQ ID NO: 88311 - RNA, 64 nt, hsa
agcagcgaugacacagcaaggaugacucagcacugccccucaccaaggaugacucagcacugcc

SEQ ID NO: 88312 - RNA, 64 nt, hsa
cucaacagacaugacucagggauggcuuaguacugccccucagcagggaugacucagcagggau

SEQ ID NO: 88313 - RNA, 64 nt, hsa
aacagggaugacucagcagggaugacucagcacugccccucaacagggaugacugcagggauga

SEQ ID NO: 88314 - RNA, 64 nt, hsa
ucaacagggaugacugcagggaugacucagcacugccccucagcagggaugacucagcacugcc

SEQ ID NO: 88315 - RNA, 64 nt, hsa
cagcacugccccucagcagggaugacucagcacugccccucagcagggaugacucagcagggau

SEQ ID NO: 88316 - RNA, 64 nt, hsa
agcagggaugacucagcagggaugacucagcaccgccccucaacaggcaugacucugcagagau

SEQ ID NO: 88317 - RNA, 64 nt, hsa
aacaggcaugacucugcagagaugacucagcacugccccucagcagggauggcucagcagggau

SEQ ID NO: 88318 - RNA, 64 nt, hsa
agcagggauggcucagcagggaugacucagcauugccccucaacagggaugacucagcagacuc

SEQ ID NO: 88319 - RNA, 64 nt, hsa
gacucagcagacucagcagggaugacucagcacugccccucaacagacaugacucagcagggau

SEQ ID NO: 88320 - RNA, 64 nt, hsa
aacagacaugacucagcagggaugacucagcaccgccccucagcaaggaugacucagcagggau

SEQ ID NO: 88321 - RNA, 64 nt, hsa
aggugggauccugaaggcacuagcugacagacgggccccucaauccuguccucugaaggauugu

SEQ ID NO: 88322 - RNA, 64 nt, hsa
cuggcucugaggucacaucagcuagguuugggaggccccucagcuugguuugggagugcccgug

SEQ ID NO: 88323 - RNA, 64 nt, hsa
ggacagcaggccuggcacugggaggugggggugagccccucacagccuugccccuccccaaggc

SEQ ID NO: 88324 - RNA, 64 nt, hsa
uggccacuggggccaccacccugaccaccacugugccccucauuguuacugccuugugagauaa

SEQ ID NO: 88325 - RNA, 64 nt, hsa
ggcccugcacaugaugggguuugguggacccagugccccucacggcugccgcaagucugcugca

SEQ ID NO: 88326 - RNA, 64 nt, hsa
cggugagcuuccugcagccuguggauguccugcagccccucagcccuacccccaaguuucuccu

SEQ ID NO: 88327 - RNA, 64 nt, hsa
uggcccccggccacugucucggggcccaccucucgccccucaucuugguaauuagccagccuca

SEQ ID NO: 88328 - RNA, 64 nt, hsa
uuccuuugcagaacuucagggacugggagcagaggccccucacucaacgacguuugugcgacau

SEQ ID NO: 88329 - RNA, 64 nt, hsa
augcccguuggacuuugccccucacacuggcccagccccucacacugccccaccccgagaaccc

SEQ ID NO: 88330 - RNA, 64 nt, hsa
ccaggccgcaggagugggaugcccguuggacuuugccccucacacuggcccagccccucacacu

SEQ ID NO: 88331 - RNA, 64 nt, hsa
agaugccaccacugcacuccagccugggcaacagagcgagaaccugucucaaaaaaaacaaaaa

SEQ ID NO: 88332 - RNA, 64 nt, hsa
agguguguguauagguguguguuuggagagugugagcgagaacuaacaugguaaaauguuaggu

SEQ ID NO: 88333 - RNA, 64 nt, hsa
auauuucucuucaaggcgagaugauccuuacuggagcgagaauaaaaaguugucucuagauaca

SEQ ID NO: 88334 - RNA, 64 nt, hsa
agacgaagagagauugcagagagagagcgucgagagcgagaacgcauuagaauaauucgugaac

SEQ ID NO: 88335 - RNA, 64 nt, hsa
aggcgguugccggagcuuaagccccgcccccagcagcgagaacaucccaccccucccccccccc

SEQ ID NO: 88336 - RNA, 64 nt, hsa
ggcuaggaguuggacggaauggaggauggaggacagcgagaagaaaggaagagaaaugcaaagu

SEQ ID NO: 88337 - RNA, 64 nt, hsa
ugucaagaucagaugguuuuacuauuguggcagaagcgagaaaacuuuguuuauugaaaaaaaa

SEQ ID NO: 88338 - RNA, 64 nt, hsa
uuucuuccacguaaggaaaaguaguguaaacaguagcgagaaaauggaaaccacagaggaagau

SEQ ID NO: 88339 - RNA, 64 nt, hsa
ugcuuuuuauaagaguugucauuguuggaaauucuuaaauaaaacugauuuaaauaauaugugu

SEQ ID NO: 88340 - RNA, 64 nt, hsa
uugucauuguuggaaauucuuaaauaaaacugauuuaaauaauaugugucuuuguuuugcagcc

SEQ ID NO: 88341 - RNA, 64 nt, hsa
cuacccuucuuucccuuuagaaaacugugauuaauuaaauaaaaagucuuacuacuauaacaac

SEQ ID NO: 88342 - RNA, 64 nt, hsa
aauauaugcagaccaacaggucuuugcauuccuuuuaaauaacugguugugacaaagcuuguug

SEQ ID NO: 88343 - RNA, 64 nt, hsa
uuuuauaugcaucauaaaauuucccauuucugcauuaaauaaacagaggaggggggucaaguga

SEQ ID NO: 88344 - RNA, 64 nt, hsa
aaagugccauuuuauuuuuagugcuaaauucuuguuaaauaauguaguuuuauauagcugauag

SEQ ID NO: 88345 - RNA, 64 nt, hsa
uauuuauuauucacucaaguauuaacauucucuauuaaauaagaggagguguuguaaagagcug

SEQ ID NO: 88346 - RNA, 64 nt, hsa
ucaucaaagcaaucuuugugauauuacuucgcuauuaaauaaagaaaauuggaugcaagacaau

SEQ ID NO: 88347 - RNA, 64 nt, hsa
ugaauuuggguaugaacagauugccugcuuucccuuaaauaacacuuagauuuauuggaccagu

SEQ ID NO: 88348 - RNA, 64 nt, hsa
ugaauucugguuacauguguuuuucucucccuccuuaaauaaagagagggguuaaacaugcccu

SEQ ID NO: 88349 - RNA, 64 nt, hsa
cuauucuagcauuuaaauuuaaauuuuauuaaaauuaaauaauuuaaaucuagcauuuaaauuu

SEQ ID NO: 88350 - RNA, 64 nt, hsa
uuaaaauuaaauaauuuaaaucuagcauuuaaauuuaaauaauuuaagucuagcauuuacuuuu

SEQ ID NO: 88351 - RNA, 64 nt, hsa
uuaaauuuaaauaauuuaagucuagcauuuacuuuuaaauaauuauaaugaaguuuugaaauac

SEQ ID NO: 88352 - RNA, 64 nt, hsa
aucugcgaaacuauacuuguauuaaaugugcuuuuuaaauaaaagcucguaacacaacuaauua

SEQ ID NO: 88353 - RNA, 64 nt, hsa
ugugacuuuaguucaggaaguuuuguuuuguguuuuaaauaaaaggaaagagcaaguuugcuca

SEQ ID NO: 88354 - RNA, 64 nt, hsa
ugcucaaacugcuuuauacuuauaaacagccaucuuaaauaagcaacguauugugaguacugau

SEQ ID NO: 88355 - RNA, 64 nt, hsa
aacuuugaaaaauuuugcaaaugucuuaggugauuuaaauaaaugaguauugggccuaauugca

SEQ ID NO: 88356 - RNA, 64 nt, hsa
cuuauggagccccucgugucguguaaaacuuauauuaaauaaaugugcaugcuuuucucuugcu

SEQ ID NO: 88357 - RNA, 64 nt, hsa
uauauauuaauaugcaugcuucuuuauaaaugcauuaaauaagaguuaauagcuauccuaaauu

SEQ ID NO: 88358 - RNA, 64 nt, hsa
uuuuuuuaaaaauuaaaagauuaaauaaaaaauauuaaauaaaacauggcaauaagugucagac

SEQ ID NO: 88359 - RNA, 64 nt, hsa
uacuguuaauggguuuuuuuuaaaaauuaaaagauuaaauaaaaaauauuaaauaaaacauggc

SEQ ID NO: 88360 - RNA, 64 nt, hsa
uuuuauagaaaaugcauggagaaaaggaauuuguuuaaauaacauuaugggauugcaaccagca

SEQ ID NO: 88361 - RNA, 64 nt, hsa
aauuuguauggauauuucaugauacaccuacugguuaaauaauugacaaaaaccagcagccaaa

SEQ ID NO: 88362 - RNA, 64 nt, hsa
ugcuuaugaaacagauuuaugagaaaaguuuuuuuuaaauaaauuauuuaauccuagcucuuug

SEQ ID NO: 88363 - RNA, 64 nt, hsa
auuuaguuauuauauuuaggaauagaaaauagaauuaaauaauuuaacuugauuaaucaaccag

SEQ ID NO: 88364 - RNA, 64 nt, hsa
auuuaaugucuaggauaauuuuuaaaagaggaaauuaaauaauuuuacaugucucauauuuuca

SEQ ID NO: 88365 - RNA, 64 nt, hsa
guuugcccuguucaaaguacuaaaacuagauaacuuaaauaauuuaagccaauaaauaauauua

SEQ ID NO: 88366 - RNA, 64 nt, hsa
uagagcugaauuaccuacagaaacuguuucugguuuaaauaauuagcacaaauuggccuaagua

SEQ ID NO: 88367 - RNA, 64 nt, hsa
ucuuggagucuagguugccuugucucuccuauuuuuaaauaagugaaauuugggagauuguaaa

SEQ ID NO: 88368 - RNA, 64 nt, hsa
auuuuuaaaauuugauuuuaaauuucaaauaaauuuaaauaaauuuuaaauaaauuuuaaauaa

SEQ ID NO: 88369 - RNA, 64 nt, hsa
uugauuuuaaauuucaaauaaauuuaaauaaauuuuaaauaaauuuuaaauaaaauuuuacaga

SEQ ID NO: 88370 - RNA, 64 nt, hsa
uuucaaauaaauuuaaauaaauuuuaaauaaauuuuaaauaaaauuuuacagagacguggucuc

SEQ ID NO: 88371 - RNA, 64 nt, hsa
uuuugcuguugugccaguuaaucauaggaucccauuaaauaagugugcuaacaucgaauauaga

SEQ ID NO: 88372 - RNA, 64 nt, hsa
agcuuguuucauaacauguuauuuuccugugucauuaaauaauuacuucaauguuguauuucgu

SEQ ID NO: 88373 - RNA, 64 nt, hsa
guuugaaaaagaaaaucuccagcaagcaucucauuuaaauaaagguuugucaucuuuaaaaaua

SEQ ID NO: 88374 - RNA, 64 nt, hsa
augcguauauaagcaaauauguaaucuuuauuuuuuaaauaaaugggaucauauuauauauucu

SEQ ID NO: 88375 - RNA, 64 nt, hsa
ugcaguacuguguucuucagcuagaggcagcuuuuuaaauaaugcaaguguauuuauuagcauu

SEQ ID NO: 88376 - RNA, 64 nt, hsa
uaaguugcugaaaaguauuaacaugguauuaagcuuaaauaauacguaaugggacuagauggcc

SEQ ID NO: 88377 - RNA, 64 nt, hsa
uuaauaacauagggugacuuguguuuuuagguauuuaaauaauaaaauuucaagggauaguuuu

SEQ ID NO: 88378 - RNA, 64 nt, hsa
ugcuguccucauuagguaaugauaaauauuucccuuaaauaauugacuauuuugcuguguuuua

SEQ ID NO: 88379 - RNA, 64 nt, hsa
agcuguauauucaccaguguggcacucaugguuuuuaaauaagauuaguauuaucuguuuauaa

SEQ ID NO: 88380 - RNA, 64 nt, hsa
cuaaauacaaaugcaaaugaagcauuaguaauacuuaaauaauuuuacugugcuacauaaagua

SEQ ID NO: 88381 - RNA, 64 nt, hsa
ucucucucccccuaccuaccaaacuauccacaauuuaaauaaagaacugcugugucugacuuac

SEQ ID NO: 88382 - RNA, 64 nt, hsa
aaaauucagucugauaaccucaaaucaaaaagcuuuaaauaaauucuugggcauuuaucuuuua

SEQ ID NO: 88383 - RNA, 64 nt, hsa
aaguugaaauuuaugagcuuugaagauugcuaaauuaaauaauuuauagcuccaaaaacaaaaa

SEQ ID NO: 88384 - RNA, 64 nt, hsa
uuaaaaauugccccaaauacugacauugagugcauuaaauaacaaauuaucuuugauacauuaa

SEQ ID NO: 88385 - RNA, 64 nt, hsa
aaaacuacaaaauuggaaagaaauuaaagaaggcuuaaauaaauggaaagacauccuguguuca

SEQ ID NO: 88386 - RNA, 64 nt, hsa
cuuuauacuagcaacaaacaauaugaaaacgaaguuaaauaauuccauuuauaauaccaucaga

SEQ ID NO: 88387 - RNA, 64 nt, hsa
augggggagauugucuuccaauguuuaacuacguuuaaauaaauaaaaauugaauuuuauuguu

SEQ ID NO: 88388 - RNA, 64 nt, hsa
uuacuacauauauugauuuuuaaauaaaguugccuuaaauaaguguauguaagcaguaguaguu

SEQ ID NO: 88389 - RNA, 64 nt, hsa
agugacagauauaauuuacuacauauauugauuuuuaaauaaaguugccuuaaauaaguguaug

SEQ ID NO: 88390 - RNA, 64 nt, hsa
uuuaucucucuugaugucagauuuuauagucuuuuuaaauaaauccauuuaauuaaaacguucu

SEQ ID NO: 88391 - RNA, 64 nt, hsa
aaaguaggccagauaaguuaaaaaaaauuuuuuuuuaaauaauaauugaaacuuaucucaaaug

SEQ ID NO: 88392 - RNA, 64 nt, hsa
uuuuuucucuuuauguauuacauuuuaaccuauauuaaauaaauguuuaaaugauaauuugcuu

SEQ ID NO: 88393 - RNA, 64 nt, hsa
cauuaguauaaagagucuguauuuuuaauaaauguuaaauaagcuaacaauguuuguacuuaug

SEQ ID NO: 88394 - RNA, 64 nt, hsa
uuuggcccaauguugaagauguagaacuuuguuuuuaaauaauguuuuuauaauuucauucgua

SEQ ID NO: 88395 - RNA, 64 nt, hsa
guaguucugaguaauccuagaauauuuuuccaaauuaaauaauccuuuauuauuugcaaguugg

SEQ ID NO: 88396 - RNA, 64 nt, hsa
gugcguucaugcuuuuucguauucuuuauggcuuuuaaauaaauauacaaugguuaauaguaaa

SEQ ID NO: 88397 - RNA, 64 nt, hsa
uguagaaugggauguauucuucugcugcugcuuauuaaauaaagaaagccugaguguucuuaga

SEQ ID NO: 88398 - RNA, 64 nt, hsa
aauggauggccacaagaaaaauaaaguaaaugucuuaaauaauuuaaccauaaauuuucuguca

SEQ ID NO: 88399 - RNA, 64 nt, hsa
gcagaauuugcaguggcaucuaaagagaucuuuuuuaaauaaaaauuauguauuguggcauaau

SEQ ID NO: 88400 - RNA, 64 nt, hsa
cuggaccaacauucuuguuuuugcuuuuguuuuuuuaaauaauucuagucuggagcuaacugug

SEQ ID NO: 88401 - RNA, 64 nt, hsa
agucuaguuuguauguagguaugaagggaauuuuuuaaauaaauugaaaagcugugaacagcau

SEQ ID NO: 88402 - RNA, 64 nt, hsa
uguuaaagaaaaguauauucaaugaagaugaaauuuaaauaaaaaaggacagagucuauccucc

SEQ ID NO: 88403 - RNA, 64 nt, hsa
uacauagcugcaauguguacaauggcugauuuaauuaaauaaaauguacaaguguuaaaugugg

SEQ ID NO: 88404 - RNA, 64 nt, hsa
uagugauuuuaaauaaucacuaaaaucacuagauuuaaauaaucacuaaaaugauuugugagaa

SEQ ID NO: 88405 - RNA, 64 nt, hsa
cagccuaugcuuaaugcaagcuaggauagugauuuuaaauaaucacuaaaaucacuagauuuaa

SEQ ID NO: 88406 - RNA, 64 nt, hsa
uuccuuuguguacuugguuuuucaccacugagcuuuaaauaagaauggaaauacaagggaaaac

SEQ ID NO: 88407 - RNA, 64 nt, hsa
ccuaauacccacaaaacuuaaaauauaaaauguuuuaaauaaaaauaaagaaaagauuucccac

SEQ ID NO: 88408 - RNA, 64 nt, hsa
uuuguaccuguuauauauaugaauauucccuauguuaaauaauaauaauaacuaguguuuauga

SEQ ID NO: 88409 - RNA, 64 nt, hsa
uacuauguauauuaugcuuagcuuuuaaggcauuuuaaauaaccaugaauguugauuucauuac

SEQ ID NO: 88410 - RNA, 64 nt, hsa
ucuugcacugagguuuuuuugcuuggggauuauuuuaaauaauugguuuuuguguuuucugaau

SEQ ID NO: 88411 - RNA, 64 nt, hsa
cauaugacacugguuccgauuuuaaaaauuauuuuuaaauaaccgauuauugauuacuguauuu

SEQ ID NO: 88412 - RNA, 64 nt, hsa
aaacacaaaagcuuuauacaaaauauuguugaauuuaaauaagguaaaucuuuuuuaguuuaua

SEQ ID NO: 88413 - RNA, 64 nt, hsa
cuuaauauguuccaguaaggguauuaaguaaaaauuaaauaaacguauuaaguuuaacauauua

SEQ ID NO: 88414 - RNA, 64 nt, hsa
agcuggguuuugggguugagaagaguucauuuauuuaaauaaaguuucuauuuaaaaaccuuuu

SEQ ID NO: 88415 - RNA, 64 nt, hsa
gaaucacagaaaugauauucugcaagaauuucuuuuaaauaaaaaguuugggggugcaauauaa

SEQ ID NO: 88416 - RNA, 64 nt, hsa
uuggguucaaccuuugaaucaauuuuaccacugauuaaauaaaugacucaaagacaucuguaag

SEQ ID NO: 88417 - RNA, 64 nt, hsa
gacaucaguauaaaagugccaaaccugcccucuuuuaaauaaaaauguaaaaaggccacuccca

SEQ ID NO: 88418 - RNA, 64 nt, hsa
uugcaugaaaacauuaugacuuuuuucucuuaguuuaaauaaacuccaagguaacuggacuucu

SEQ ID NO: 88419 - RNA, 64 nt, hsa
guuaauuaaauuaaguuuaauuaaaugccauguguuaaauaaagucaguacaugaaaggcaauu

SEQ ID NO: 88420 - RNA, 64 nt, hsa
cucuguucagccuguuuuaaaaagaauuaaagaguuaaauaaaaaauaaacuguuugaaaugca

SEQ ID NO: 88421 - RNA, 64 nt, hsa
caauucuucuuuucaaaugaagacauugauaauauuaaauaauuuaauuuuaagacugaaaccc

SEQ ID NO: 88422 - RNA, 64 nt, hsa
aaagagauguauggcauuuuaauuuggcaaucucuuaaauaauauugcccugcaaguacccagu

SEQ ID NO: 88423 - RNA, 64 nt, hsa
uuagaccucugauucuaagucaaaugcaaauggguuaaauaaaaugagacuacuuccuuuauaa

SEQ ID NO: 88424 - RNA, 64 nt, hsa
uuuuaucucugugcuuucuuuuucaugguguuuauuaaauaauuguguauauacauccuagcua

SEQ ID NO: 88425 - RNA, 64 nt, hsa
aaauaaauaaauaaaucugggucugcaucucuuauuaaauaaaaauauaaaaauauguacauua

SEQ ID NO: 88426 - RNA, 64 nt, hsa
aaaaaauguggaguuggagggcuaacauauuuaauuaaauaaauaaauaaaucugggucugcau

SEQ ID NO: 88427 - RNA, 64 nt, hsa
uucagggcaacuacaaauaaucacuuacuaagccuuaaauaaagccauuauuuuuauaucaaua

SEQ ID NO: 88428 - RNA, 64 nt, hsa
uaaauuguuuucuuucuuccaagaaagaagccacuuaaauaagcuuauacuuugccaaagcugu

SEQ ID NO: 88429 - RNA, 64 nt, hsa
aauuaaaauuuuagauacuuaacauuuauuuaacuuaaauaaaagauaacugucagauaaaacu

SEQ ID NO: 88430 - RNA, 64 nt, hsa
aaacuugaaaggaauucuccucaaaggucggauauuaaauaagucccaggcagauuuacauauu

SEQ ID NO: 88431 - RNA, 64 nt, hsa
caaagauuuuguacugcuaaaauuaccaaauaauuuaaauaaaguggauuugaacacaauuuga

SEQ ID NO: 88432 - RNA, 64 nt, hsa
aaggcuaccuaccacgugcuauccaguaauauacuuaaauaagccaauacuuagaucuacugua

SEQ ID NO: 88433 - RNA, 64 nt, hsa
uaccuugacuucauuuauaugaauuuccacuuuauuaaauaauagaaaagaaaaucccggugcu

SEQ ID NO: 88434 - RNA, 64 nt, hsa
aggcuguucuggcuuuuuaucuucuuagcucaucuuaaauaagcaguacacuuggaugcagugc

SEQ ID NO: 88435 - RNA, 64 nt, hsa
uaucuacauauauagguacaugccauccauuauuuuaaauaaacuaauagguuuucagaauuau

SEQ ID NO: 88436 - RNA, 64 nt, hsa
agaauuauuuuuaacugaacguuuuuguuguuuuuuaaauaaaguagccauauguaacgggauu

SEQ ID NO: 88437 - RNA, 64 nt, hsa
uuuuaagcuugacaaaugcacugauuguuauacuuuaaauaacuaaaaaucugagaauccacag

SEQ ID NO: 88438 - RNA, 64 nt, hsa
gggaaauuuauuuucuacgcuauucaaagauauuuuaaauaauauuuuaaaaacaugaaauuuu

SEQ ID NO: 88439 - RNA, 62 nt, hsa
uuugaauauuuaaauuuuaugguuuauuaaaaaauuaaauaaauguuguguccgucuuuauu

SEQ ID NO: 88440 - RNA, 64 nt, hsa
uagaggaagaguaaaaccagaaauucaugcuggcuuaaauaaucuauuuuuguuucuuuucauu

SEQ ID NO: 88441 - RNA, 64 nt, hsa
ucuuguaacuuugauaaugaacagugagagauuuuuaaauaaagccucuaaauauguuuuguca

SEQ ID NO: 88442 - RNA, 64 nt, hsa
uugcuuuugaagucugucaguauuacugguauuuuuaaauaaagaagaauuuuucuccaauuuu

SEQ ID NO: 88443 - RNA, 64 nt, hsa
cuccugguccccacuuuaaaggcugugcagcuccuuaaauaauaaagcuggaaaauauuuuuag

SEQ ID NO: 88444 - RNA, 64 nt, hsa
aaauaguaacucuccaaauccuguugcuuuuauguuaaauaagauaacaagaauuggagcaugc

SEQ ID NO: 88445 - RNA, 64 nt, hsa
ccuuaacauggcucaauaacuuaaaaacguucauuuaaauaaaauuuuaauacuuguuugacaa

SEQ ID NO: 88446 - RNA, 64 nt, hsa
uuuagaaauaaauugcaaaggugggaauauauacuuaaauaauuugucuuaaguaaauuagcau

SEQ ID NO: 88447 - RNA, 64 nt, hsa
uuacccaagaauccacuggaggucauuacugccauuaaauaauaacugaaaagacuauguagug

SEQ ID NO: 88448 - RNA, 64 nt, hsa
acuggauaaacuuuacauaaaauuaacuaauuuuuuaaauaaaugcauugcuuaaugguuucuc

SEQ ID NO: 88449 - RNA, 64 nt, hsa
augaaagcuuuagaaggcaugagauguuccuaucuuaaauaaagcauguuucuuuucuauagag

SEQ ID NO: 88450 - RNA, 64 nt, hsa
auuauucaccuaagaauagaaucucagcauuguguuaaauaaaaaugaaagcuuuagaaggcau

SEQ ID NO: 88451 - RNA, 64 nt, hsa
aauuuauccauuuauaggcuucaaaaguaaauuuuuaaauaaaauauauuagucgacuguguua

SEQ ID NO: 88452 - RNA, 64 nt, hsa
ccccucauuucuuucugcccaaagaccucauucuuuaaauaaaacuuguuauuuuggcauauuu

SEQ ID NO: 88453 - RNA, 64 nt, hsa
caauccucuauugaacauauaaggauccucagauuuaaauaaguacuuuuuuuuuuuuuaauca

SEQ ID NO: 88454 - RNA, 64 nt, hsa
uuuagucuuugauucagucaguauuugguuuauguuaaauaaaaaaucaguaucauggaaaaga

SEQ ID NO: 88455 - RNA, 64 nt, hsa
ucugaagacaggugcuugaacuugucaguuuguuuuaaauaaauacaauaguugaaaauuuuuc

SEQ ID NO: 88456 - RNA, 64 nt, hsa
ccucucaaauucauaacaguucuauuuaacugaauuaaauaaccauaugaaaaaucuuuugggu

SEQ ID NO: 88457 - RNA, 64 nt, hsa
auuaugccuuggaaugguucacuuaaaugacauuuuaaauaaguuuauguauacaucugaauga

SEQ ID NO: 88458 - RNA, 64 nt, hsa
aauuuguaaauguuaagaauuuuuuuuauaucuguuaaauaaaaauuauuuccaacaaccuuaa

SEQ ID NO: 88459 - RNA, 64 nt, hsa
cagcaguuguugacaauuguuagagguuugacuuuuaaauaauuacuuauuuuuucugauugug

SEQ ID NO: 88460 - RNA, 64 nt, hsa
aaggaaucugaaacacuuguacuuccaauuuucuuuaaauaaucccaaauagaccagaauuggc

SEQ ID NO: 88461 - RNA, 64 nt, hsa
cagggauuuuugaguccuauucaaauuccuauuuuuaaauaauuuccuacacaaaugauagcau

SEQ ID NO: 88462 - RNA, 64 nt, hsa
gauuuaaguuacaauguuuuauggccuaaauuuauuaaauaaaaugcacaaaacuuugauucuu

SEQ ID NO: 88463 - RNA, 64 nt, hsa
uuuuguuuaauaaugaguguguaaacugcauacguuaaauaaauguaaauacuaauguacugcu

SEQ ID NO: 88464 - RNA, 64 nt, hsa
acugccuguacuguuaauuuccuguauaauucacuuaaauaaaagcagguuaaccucaaugaua

SEQ ID NO: 88465 - RNA, 64 nt, hsa
uaucauuuccuucaaaaugaagggcagugcuuaguuaaauaaaagauugaugauaucuuuuaag

SEQ ID NO: 88466 - RNA, 64 nt, hsa
guugcuuggagaacaccuccuucagagcccuuuguuaaauaagaggggcgacguugaucauaga

SEQ ID NO: 88467 - RNA, 64 nt, hsa
ucuucuggcuucugaacucuuccucugccucucuuuaaauaaauaacacagaauuucaaguggu

SEQ ID NO: 88468 - RNA, 64 nt, hsa
aaauccagugaaacagcaccauuucuuaguaucauuaaauaacuagaaaguaucaaguauugcu

SEQ ID NO: 88469 - RNA, 64 nt, hsa
cuaccugacauuuauuccaagaagaucuggaaaguuaaauaaauuuauaaauuuaauaacauuc

SEQ ID NO: 88470 - RNA, 64 nt, hsa
aaauagauaugaaacauguuacuucauuucugguuuaaauaacuuguggaaucuuuccuaauga

SEQ ID NO: 88471 - RNA, 64 nt, hsa
caguuauuuuaguuacagguuaggaagauggucuuuaaauaaccaaaaauauguuuauuuuuua

SEQ ID NO: 88472 - RNA, 64 nt, hsa
aaccuuuaaguuagcuuuccauaauucacugcacuuaaauaaguuuaaaucaaauacaguuauu

SEQ ID NO: 88473 - RNA, 64 nt, hsa
aucuguauuggaaauauguuccuggaaaaugcauuuaaauaauaguaaauucucuugcauguuc

SEQ ID NO: 88474 - RNA, 64 nt, hsa
agacguuuuuuuccuccaaggugguuuucuucucuuaaauaacucgaucuguacccagcugggu

SEQ ID NO: 88475 - RNA, 64 nt, hsa
aagaggaaugagccaggagaacaaacuaauuccuuuaaauaaauaaaaaaaaaaaaugcaaaug

SEQ ID NO: 88476 - RNA, 64 nt, hsa
uugucauucaaaauauauuuuaacccaaaauaaguuaaauaauuugugcauguuugugugugua

SEQ ID NO: 88477 - RNA, 64 nt, hsa
ucucuaagacauucuccaaauugauuuuaucucuuuaaauaaaaacuuuaaauaaaaguauuag

SEQ ID NO: 88478 - RNA, 62 nt, hsa
cuccaaauugauuuuaucucuuuaaauaaaaacuuuaaauaaaaguauuagaaauguuuucu

SEQ ID NO: 88479 - RNA, 64 nt, hsa
auuuauguaaaguauauguauuugagugcagaauuuaaauaaggcucuaccucaaagaccuuug

SEQ ID NO: 88480 - RNA, 64 nt, hsa
uuuggaauuauaaaauauagguaaaaguacguaauuaaauaauguuuuugguauuucugguuuu

SEQ ID NO: 88481 - RNA, 64 nt, hsa
aagaaacauguauaagaaaccagauuuaaguguuuuaaauaaaauguaaacaguuuuuauuugg

SEQ ID NO: 88482 - RNA, 64 nt, hsa
ugaugugcuuguauaucgauuagcugugucacuuuuaaauaagaaguccacacaagcaagccaa

SEQ ID NO: 88483 - RNA, 64 nt, hsa
cuaaugaaauguacuucagagaagcaguauuuuguuaaauaaauacauaaccucauucugaaua

SEQ ID NO: 88484 - RNA, 64 nt, hsa
gggugacagagugagacucugucucaaaaaaaaauuaaauaaauuauuauaaccuuucagaaau

SEQ ID NO: 88485 - RNA, 64 nt, hsa
augauguacuuuguaaaaaaauugauugaagauuuuaaauaaacaggaaauuagaaguguuagg

SEQ ID NO: 88486 - RNA, 64 nt, hsa
uuuagaauaucaucuugaaccauuauaaaacaccuuaaauaaaagugauugugacuaaggcacg

SEQ ID NO: 88487 - RNA, 64 nt, hsa
aaguuucauaucacucaugaauugcucagcugauuuaaauaauuuguaaaauccugcuaacuag

SEQ ID NO: 88488 - RNA, 64 nt, hsa
uagcuuuaaaagaguauuuauguuggaauaauuuuuaaauaauguuuacauaacuguaaguccu

SEQ ID NO: 88489 - RNA, 64 nt, hsa
uuaauagacaaaucacauuuugcaaggccuuuaauuaaauaagauucuucuuuccuucauuuua

SEQ ID NO: 88490 - RNA, 64 nt, hsa
agaaauuugagaagcuucucacaagugaugcacuuuaaauaaucugcaugccauugagacaccu

SEQ ID NO: 88491 - RNA, 64 nt, hsa
aaauuguauuagaaaauuagcgugacuucucauuuuaaauaaaauauuuuaggaauucuaaaca

SEQ ID NO: 88492 - RNA, 64 nt, hsa
aauauaacaaaauguguaauuugugacucuaauauuaaauaagauauuugaacaagcuaggaaa

SEQ ID NO: 88493 - RNA, 64 nt, hsa
uuuauaucuugggacuuauguauauauauaccuuuuaaauaaaauaaauuuucuaaauaaaaag

SEQ ID NO: 88494 - RNA, 64 nt, hsa
ccauccauugugcaaaaccacaagcacgcaaguauuaaauaagagcaagcuguccugagcccau

SEQ ID NO: 88495 - RNA, 64 nt, hsa
uuaaagauuaagcauaguaacugacucuuaaguguuaaauaauguagaaguaaaaaaauuuuuu

SEQ ID NO: 88496 - RNA, 64 nt, hsa
agcuugaauauuauuucacauuccuuuuucuuuuuuaaauaaacagguuugcuuuggaaaggcu

SEQ ID NO: 88497 - RNA, 64 nt, hsa
aucuugguacaaauucagaucucuuauuuaaaauuuaaauaaggaauacauuuucaaaaugcag

SEQ ID NO: 88498 - RNA, 64 nt, hsa
uuaucguacgucacaguguauggugaauauauuauuaaauaaugugguacuucgcucaucaggc

SEQ ID NO: 88499 - RNA, 64 nt, hsa
cucaauuccuuuuuguaaggugcuauuucuguauuuaaauaacuuucuuuuaacguaaagcugc

SEQ ID NO: 88500 - RNA, 64 nt, hsa
caagauuuuuuaaaacuugagguagguagcuacauuaaauaaauuugcuacuuauauaaaaauu

SEQ ID NO: 88501 - RNA, 64 nt, hsa
acaaagaauaggaugggauaaagaaaguggacacuuaaauaagcuauaaauuauaugguccuug

SEQ ID NO: 88502 - RNA, 64 nt, hsa
caaaaaugucaguauugacaacacagucuaacucuuaaauaaaauuaugcuaauuaguuacauu

SEQ ID NO: 88503 - RNA, 64 nt, hsa
acugugugcuuguuuuauaaaauuuugcuuuuaauuaaauaaaagcuggaagcaaaguauaacc

SEQ ID NO: 88504 - RNA, 64 nt, hsa
uuuaggaacuucagagaucguguauugagauuucuuaaauaaugcuucagauauuauugcuuua

SEQ ID NO: 88505 - RNA, 64 nt, hsa
aguuuacagcaugauaguccaaguggugauaacuuuaaauaaaacucaaauuuuuacuguuugu

SEQ ID NO: 88506 - RNA, 64 nt, hsa
acuucagaaucccaacuacaauacaaauguuuauuuaaauaaagaagaaagcuauuguacaaau

SEQ ID NO: 88507 - RNA, 64 nt, hsa
cuuuuagagccaaaaaaacucaggcacaaagaaguuaaauaacuugccgggugcgguggcucac

SEQ ID NO: 88508 - RNA, 64 nt, hsa
caaaaacaaaacaaaacaacaacaaaaaaagaaguuaaauaacuuguuuaagaucacacagcua

SEQ ID NO: 88509 - RNA, 64 nt, hsa
cauuuauuugagaaaacacuggauuuaaauaauuuuaaauaauuuguagcuuaauauuaaagau

SEQ ID NO: 88510 - RNA, 64 nt, hsa
ucuuccuguacauuuauuugagaaaacacuggauuuaaauaauuuuaaauaauuuguagcuuaa

SEQ ID NO: 88511 - RNA, 64 nt, hsa
ggaaaauguucuugaucauuugcaguuaaggacuuuaaauaaaucaaauguuaacaaaagagca

SEQ ID NO: 88512 - RNA, 64 nt, hsa
uuaucaaugugauuguaauuaaaaauauuuugauuuaaauaacaaaaauaauaccagauuuuaa

SEQ ID NO: 88513 - RNA, 64 nt, hsa
caccauauuuuacuuuuuuaggauuuuucccccuuuaaauaaaaauauuagaucaaauacuaua

SEQ ID NO: 88514 - RNA, 64 nt, hsa
acaaugggcagugucugcuauagggcuucaggcauuaaauaaaaccgaggguuguugauuuugc

SEQ ID NO: 88515 - RNA, 64 nt, hsa
uggcuauauaggaagaaauaucacucaccauaauuuaaauaaagaauaaaaauacuuguauuuu

SEQ ID NO: 88516 - RNA, 64 nt, hsa
gacauucuaaaauaccauuaaagccacuuaaauguuaaauaagaauauacaugcacaucagcuc

SEQ ID NO: 88517 - RNA, 64 nt, hsa
aaaaacaauguuagaagguuauuuaaaaugauacuuaaauaaagaaagugugaggucuacuuua

SEQ ID NO: 88518 - RNA, 64 nt, hsa
acauuuugugggguagugauuuggcaaguguuuuuuaaauaaaacaaaucucauuguaaagcua

SEQ ID NO: 88519 - RNA, 64 nt, hsa
auuuuuaaguuaucuuuaaguuuaugccaucuucuuaaauaaguacguaauguuccaaucuaaa

SEQ ID NO: 88520 - RNA, 64 nt, hsa
auugaaaugcugugguuguguguuuugcuuuucuuuaaauaaaacguauguauaauuaagugaa

SEQ ID NO: 88521 - RNA, 64 nt, hsa
ucugcugcuccuagggccaugcuuguauacauauuuaaauaaacauauucauuuacccgaguua

SEQ ID NO: 88522 - RNA, 64 nt, hsa
uuucuagaaaaagucuagugccaaauuugucuuauuaaauaaaaacaauguaggagcagcuuuu

SEQ ID NO: 88523 - RNA, 64 nt, hsa
aaacugucuucuucuguuccucauuuugcuuuacuuaaauaaucuuucauauuuuuuaaguguu

SEQ ID NO: 88524 - RNA, 64 nt, hsa
uugguuggaucacauacauuuaaggaucauauuauuaaauaauauaugcacagacauggagaga

SEQ ID NO: 88525 - RNA, 64 nt, hsa
acauaauggacgcaaaugacagauaaaaacagcuuuaaauaauuugaacuuguuaauuagaaug

SEQ ID NO: 88526 - RNA, 64 nt, hsa
auuaacauggaugcagaauaauuucagaaaccccuuaaauaauuccuuaacaucucuauaaacg

SEQ ID NO: 88527 - RNA, 64 nt, hsa
aaaccaaguaauguauaauguggcuuuuguugaguuaaauaagaugcuauauaauggagaagaa

SEQ ID NO: 88528 - RNA, 64 nt, hsa
cauuaucagaaccugcagugaaauuaaacuuauguuaaauaaaaccaguuugcaggugcacaaa

SEQ ID NO: 88529 - RNA, 64 nt, hsa
ugugugugccaccaaacacguuauuggcaccuuuuuaaauaagcucucaugaucaagaugguga

SEQ ID NO: 88530 - RNA, 64 nt, hsa
uggauagauuuuaaugggaaaauuauaauucagauuaaauaaaaaacaauucccuuuucccugu

SEQ ID NO: 88531 - RNA, 64 nt, hsa
uaacaguuugcuauagcuuacugcuuaacuaauuuuaaauaaggaaauaaguauguuagaugca

SEQ ID NO: 88532 - RNA, 64 nt, hsa
uaaaaaauguuagauguuggugauaaguugacaguuaaauaaaauucucuaaaauugcuucuaa

SEQ ID NO: 88533 - RNA, 64 nt, hsa
gcaggcagcucaucucauguccugaaguuggaauuuaaauaauuccuauuugcaaauuagaaug

SEQ ID NO: 88534 - RNA, 64 nt, hsa
auaaaagcuguguuauuguuuucuauuauuauuuuuaaauaaucacacuuggacucuuuucaaa

SEQ ID NO: 88535 - RNA, 64 nt, hsa
ggcaagacuuuucuuugaaggaugacuacagacauuaaauaaucgaaguaauuuugggugggga

SEQ ID NO: 88536 - RNA, 64 nt, hsa
augaucgcuuucuacacuguauuacauaaauaaauuaaauaaaauaaccccgggcaagacuuuu

SEQ ID NO: 88537 - RNA, 64 nt, hsa
ucacauacuauuuugccauauuugcuucugauuuuuaaauaaauaaaauguuacucuuuuguac

SEQ ID NO: 88538 - RNA, 64 nt, hsa
caugcuccaauguauguacauaagugucuguggcuuaaauaauauguuguuauuugauacauuu

SEQ ID NO: 88539 - RNA, 64 nt, hsa
uucuuggugaaacacuauaauuaaguaguuauaauuaaauaacuguucuucauacuuaggacuc

SEQ ID NO: 88540 - RNA, 64 nt, hsa
guauuaaggucauguaccaaggauuugauaaaguuuaaauaauuuacucucuacuuuuauccau

SEQ ID NO: 88541 - RNA, 64 nt, hsa
ucuaauaaaacucggacccuucuugugaaaucaguuaaauaagacuugucucggucaccugugc

SEQ ID NO: 88542 - RNA, 64 nt, hsa
uuauuuguguuagcauguaauggguuuacuauguuuaaauaaguuaauacuuuaaaaauuuuca

SEQ ID NO: 88543 - RNA, 64 nt, hsa
aaggaguaacugaauugaaucaaccaguuugcauuuaaauaaaagaacaggcucaguggucuuc

SEQ ID NO: 88544 - RNA, 64 nt, hsa
gcuuccuauaauguaaacggacuuguuaaccuaaccuaauuaugcucaguggacuucuauagau

SEQ ID NO: 88545 - RNA, 64 nt, hsa
uccuuguguuuccuuaauuuauuuuguuaacaccccuaauuacaaccaaagugaugauguggag

SEQ ID NO: 88546 - RNA, 64 nt, hsa
gcucuucuuggucuuggcuagacugccuagauucccacagcagacaagguugagaauccauugc

SEQ ID NO: 88547 - RNA, 64 nt, hsa
augugggaaagguaaagcaacaccaaauaaaagcccacagcagcuucaucuuuacgauaacuca

SEQ ID NO: 88548 - RNA, 51 nt, hsa
aacuggaggagaccagcuagcccacagcaaccaaagagacuuccucuuggc

SEQ ID NO: 88549 - RNA, 64 nt, hsa
gaagcuacugcaagguuccaggcuugggccugggccacagcaacagcaguggucaaauaucuag

SEQ ID NO: 88550 - RNA, 64 nt, hsa
ggagucaguguuauuacugguggaugcaccguguccacagcagcccccaaucccagcgaugcgu

SEQ ID NO: 88551 - RNA, 64 nt, hsa
cauucauuuggaugcagugaaaagggcagaaauaccacagcagagaauaaaauugauaauguug

SEQ ID NO: 88552 - RNA, 64 nt, hsa
uaaaaugacagaaguuagcuguagaugaccuaucccacagcaaucggaguucuugaagaagaaa

SEQ ID NO: 88553 - RNA, 64 nt, hsa
ccucaucuggcacuaugcaugucucacucacccuccacagcacucagucccaucgacguucacu

SEQ ID NO: 88554 - RNA, 64 nt, hsa
gaccagaggagugcuggagcuccagcagccccaaccacagcauucccuaacauggaggcaaaau

SEQ ID NO: 88555 - RNA, 64 nt, hsa
aaaaacacaguccugagagggauggaccagacugccacagcagcucauagcacaaaaaaagguu

SEQ ID NO: 88556 - RNA, 64 nt, hsa
aaaaaacacaaucuuaaggggauagacuagacugccacagcagcccauggcacaacuaacaccu

SEQ ID NO: 88557 - RNA, 64 nt, hsa
uauuuucaguaaauacauuuaaacaauguuaaggccacagcacacauaucucagccauucauug

SEQ ID NO: 88558 - RNA, 64 nt, hsa
aacaaagcaaauauguucaucacugucaggcugcccacagcaacaccaagcauauuagaagagg

SEQ ID NO: 88559 - RNA, 64 nt, hsa
ucuucauugccucucuccccuuggcgucugaugaccacagcaaagcacugggaauuucuacucu

SEQ ID NO: 88560 - RNA, 64 nt, hsa
ccugccaggcuggggcuuccucaggcauggguguccacagcacuggcccccucuccccagccuc

SEQ ID NO: 88561 - RNA, 64 nt, hsa
gcaggaguggagagcuggugcccucaggaggagaccacagcauguccaucagcucagcagagcu

SEQ ID NO: 88562 - RNA, 64 nt, hsa
uaucccagcaaauugggaucacaugcuuuugucuccacagcaaccagccacugcaggcagcaug

SEQ ID NO: 88563 - RNA, 64 nt, hsa
cagcagcaguuuccaagacgggccagaaacgcauccacagcaguggcacccgcggcucaggggc

SEQ ID NO: 88564 - RNA, 64 nt, hsa
gcacugagcuguuggggcacacugcccagcccggccacagcagcucagccagucacagcuccac

SEQ ID NO: 88565 - RNA, 64 nt, hsa
gagaccacaaaauacaaggccagaccuagaguguccacagcaggccugugcugcccgccucagg

SEQ ID NO: 88566 - RNA, 64 nt, hsa
cugccaagcaggacuuggcacaugagcacccaccccacagcaccaucaggcagcacccaugggc

SEQ ID NO: 88567 - RNA, 64 nt, hsa
caccccgccccuccauaguucaggauagaggcucccacagcagccgguaaggaaguggguggca

SEQ ID NO: 88568 - RNA, 64 nt, hsa
ccuugccccccacccaagaagcccugcccuccagccacagcaguccacagcagcaggguuaaga

SEQ ID NO: 88569 - RNA, 64 nt, hsa
cacccaagaagcccugcccuccagccacagcaguccacagcagcaggguuaagacucagcacag

SEQ ID NO: 88570 - RNA, 64 nt, hsa
gcacaccacaacacacaacacaccucaccucacaccacagcacaccucaccacaccacaccgca

SEQ ID NO: 88571 - RNA, 64 nt, hsa
cgcacugcaccauaccucaccacaucucaccacaccacagcacaccucaccacacaacacacca

SEQ ID NO: 88572 - RNA, 64 nt, hsa
ccauucucaguaaugggagaucuugaguugcaguccacagcauucacauucucaggauaaacau

SEQ ID NO: 88573 - RNA, 64 nt, hsa
gccagcugccuguucuuaccuccgccugcgagagccacagcaaggagcucagccagccguggug

SEQ ID NO: 88574 - RNA, 64 nt, hsa
agccuggucauuugcuguccgcuuuucucugugaccacagcagcccugaacaaccaguaugugu

SEQ ID NO: 88575 - RNA, 64 nt, hsa
gggguguccgucaguuauuaguggauggagauucccacagcaaggcugcauuugaaugauuucc

SEQ ID NO: 88576 - RNA, 64 nt, hsa
aggccucuccccuggcaccugcuucaguuguccuccacagcacugauuugcagcccacaagcug

SEQ ID NO: 88577 - RNA, 64 nt, hsa
aaaguugugcagagcgcuggggacuccagacuccccacagcagcagagacucgggacugaggca

SEQ ID NO: 88578 - RNA, 64 nt, hsa
uccagggugguagugcugggcuguucccagccucccacagcagagcuggacgcuguggaaaugg

SEQ ID NO: 88579 - RNA, 64 nt, hsa
cagccucccaaaguguugggauuacaggugugagccacagcaccuggccaaccaacacuucuca

SEQ ID NO: 88580 - RNA, 64 nt, hsa
guuugccacgugcugcccgugacagcacauugagccacagcauuuguagacaggacagaggggu

SEQ ID NO: 88581 - RNA, 64 nt, hsa
caggcccuugggcaggcuggggugacggcagaggccacagcaccagcucugacaaguccuauca

SEQ ID NO: 88582 - RNA, 64 nt, hsa
ggggagccccuucugcucagcucugggccauucuccacagcaaccccaggcugaagcagguucc

SEQ ID NO: 88583 - RNA, 64 nt, hsa
agggacaaguggacucagggcagcgccaggcugaccacagcacagccaacacgcaccugccuca

SEQ ID NO: 88584 - RNA, 64 nt, hsa
ugccacaacggccagcaggugccccauccucugcccacagcagacucugucccauggcucuccg

SEQ ID NO: 88585 - RNA, 64 nt, hsa
agggccugguguggaaccagggagcugugggaagccacagcagaaauggaagaaaaacaggucu

SEQ ID NO: 88586 - RNA, 64 nt, hsa
cacagcuggcuuguaaggcaggagcuggcccaggccacagcaccugcuggggugggaaagggcc

SEQ ID NO: 88587 - RNA, 64 nt, hsa
ccugaauaaacagaaugagcugcagucucuuggcccacagcacuggcuuccccaucucaccugg

SEQ ID NO: 88588 - RNA, 64 nt, hsa
uggugccucuauugaagacuuugcccugccacuuccacagcaguaagccgaaaggaugaagagu

SEQ ID NO: 88589 - RNA, 64 nt, hsa
cccaagcggaaugaggccaagacuggcgcugacaccacagcagcugggccccucuuccagcagc

SEQ ID NO: 88590 - RNA, 64 nt, hsa
uaacccagucuuucuucacucuggcuucaaaaagccacagcagagcauugucaccgcaggugcu

SEQ ID NO: 88591 - RNA, 64 nt, hsa
cagccaggucugacuccaaagcuguuccauuacaccacagcauuguguggaauuugaggucuag

SEQ ID NO: 88592 - RNA, 64 nt, hsa
uucaaaugggcucgugacccaaaaaagucaagaaccacagcacuugaguaaaauacucuuuuua

SEQ ID NO: 88593 - RNA, 64 nt, hsa
uccugcgaggcuaugagugggaugagugaugcccccacagcaccuccauguggacuuaggaagg

SEQ ID NO: 88594 - RNA, 64 nt, hsa
auuuuauaauauaccaauguuacauuuucugaaacguagcaaacaggauauucaaaagauucuu

SEQ ID NO: 88595 - RNA, 64 nt, hsa
cgcgugucucauuugccaggaagauggguucccacguagcaaaucguacauugugcccuguagc

SEQ ID NO: 88596 - RNA, 64 nt, hsa
auaccuugaaaaaucaaagaacauuauguuccuccguagcaagaaaaauuuuaugcccucgcau

SEQ ID NO: 88597 - RNA, 64 nt, hsa
guuuuaagugauucgguuaaagaguuugggcucccguagcaaacuaauacuagauaauaaggaa

SEQ ID NO: 88598 - RNA, 64 nt, hsa
agccacaccacccucucccgacagcccucaaagacguagcaacucuuucucucaaggugcuaaa

SEQ ID NO: 88599 - RNA, 64 nt, hsa
caaaggcauuaaaaacuccaguaaaagcuggggccguagcaaaaaucaugaaaaacacuucaac

SEQ ID NO: 88600 - RNA, 64 nt, hsa
uuuuuaaacaaguuaguauuaaugcguuggcccacguagcaaaaagauauuugauuaucuuaaa

SEQ ID NO: 88601 - RNA, 64 nt, hsa
ccucguugguaaggcguuuuuauaguuuaugugacguagcaaucuugguugcuggaauggcugu

SEQ ID NO: 88602 - RNA, 64 nt, hsa
cuugacuuacccuaggugggugugaaagagcacccguagcaaggaaaauuuucucuauuagugu

SEQ ID NO: 88603 - RNA, 64 nt, hsa
ucucaugcuccccccccuccuuauuuguagcaaucguagcaacuaauuccacuaaguacaaggg

SEQ ID NO: 88604 - RNA, 64 nt, hsa
uggcucccacaggacaaucgcugccccccaaccucguagcaacagcaauaccgggggacccugc

SEQ ID NO: 88605 - RNA, 64 nt, hsa
uccacacauuuaaaacauuugaaggaccuaaauucguagcaaauucuguggcaguuuuaaaaag

SEQ ID NO: 88606 - RNA, 64 nt, hsa
uccugcagguggcuuccagaacaucgccugucuccguagcaaugccaugaagcaccuuccuaac

SEQ ID NO: 88607 - RNA, 64 nt, hsa
gugcauuccagguuacugcacuugucugaugugacguagcaacacccaggucuucuuaaaacaa

SEQ ID NO: 88608 - RNA, 64 nt, hsa
ggcccugagggccuagcauuuuuucuacuguaaacguagcaagaucuguauaugaauauguaua

SEQ ID NO: 88609 - RNA, 64 nt, hsa
cuccaggucguucucggagcuggaagagaagauccguagcaaccgggucaucgaggugugucua

SEQ ID NO: 88610 - RNA, 64 nt, hsa
cagcugaggacuucggagcuugucaggaaguggccguagcaacuuggcggagacaggcuaugag

SEQ ID NO: 88611 - RNA, 64 nt, hsa
auaggggauuuuucugaacacugcaaaaauagaacguagcaaaauggcuucaguuaucacuuuu

SEQ ID NO: 88612 - RNA, 64 nt, hsa
ccaccucuuucccuuuugaagagacagcaacagccguagcaaaagcagcugcugcuccugcuau

SEQ ID NO: 88613 - RNA, 64 nt, hsa
gcgaguagccagucuuucuuuaacaucaaucaaccguagcaauguggucaucacgaagucuuca

SEQ ID NO: 88614 - RNA, 64 nt, hsa
uuuugaggcucaguuaauauuucaaaauuguaaccguagcaaaacugcauugguauuuagaaaa

SEQ ID NO: 88615 - RNA, 64 nt, hsa
augacugaucauacaaaacguauuauaacauuuucguagcaaaauuaaccuuuuuuuuuuccag

SEQ ID NO: 88616 - RNA, 64 nt, hsa
auugcccaggcuagagugcaauggugcgaucuaggcucaccacaaccucugccuuccagguuca

SEQ ID NO: 88617 - RNA, 64 nt, hsa
guuugucucauggucagcucgccucucaaagauggcucaccaaucaccugccuguuuuuacuua

SEQ ID NO: 88618 - RNA, 64 nt, hsa
ugaagcacuuagaacugauggccagcacaugagggcucaccaaguguaagccacaaauacacau

SEQ ID NO: 88619 - RNA, 64 nt, hsa
ggaugucaucauucaccauuuauccaggauggccgcucaccaggcaauuugcuaggcucggggg

SEQ ID NO: 88620 - RNA, 64 nt, hsa
auuuuccuuuucuagcuucauaggaauauugugagcucaccaugcuguggagguugggaaagag

SEQ ID NO: 88621 - RNA, 64 nt, hsa
aaucuauuucagggaauguucugucuagugauuugcucaccauuugauauauaaugaauuauag

SEQ ID NO: 88622 - RNA, 64 nt, hsa
agaauacucacguuuuuuaacucauguagugauugcucaccacuuugcaaaguauuuuuccugc

SEQ ID NO: 88623 - RNA, 64 nt, hsa
gcuagugaagaagcaggagcuucuuguuuuaauugcucaccaaugguugguucuugaguggcua

SEQ ID NO: 88624 - RNA, 64 nt, hsa; identical to SEQ ID NO: 75157

SEQ ID NO: 88625 - RNA, 64 nt, hsa; identical to SEQ ID NO: 75158

SEQ ID NO: 88626 - RNA, 64 nt, hsa; identical to SEQ ID NO: 75159

SEQ ID NO: 88627 - RNA, 64 nt, hsa; identical to SEQ ID NO: 75160

SEQ ID NO: 88628 - RNA, 64 nt, hsa; identical to SEQ ID NO: 75161

SEQ ID NO: 88629 - RNA, 64 nt, hsa; identical to SEQ ID NO: 75162

SEQ ID NO: 88630 - RNA, 64 nt, hsa; identical to SEQ ID NO: 75163

SEQ ID NO: 88631 - RNA, 64 nt, hsa; identical to SEQ ID NO: 75164

SEQ ID NO: 88632 - RNA, 64 nt, hsa; identical to SEQ ID NO: 75165

SEQ ID NO: 88633 - RNA, 64 nt, hsa; identical to SEQ ID NO: 75166

SEQ ID NO: 88634 - RNA, 64 nt, hsa; identical to SEQ ID NO: 75167

SEQ ID NO: 88635 - RNA, 64 nt, hsa; identical to SEQ ID NO: 75168

SEQ ID NO: 88636 - RNA, 64 nt, hsa; identical to SEQ ID NO: 75169

SEQ ID NO: 88637 - RNA, 64 nt, hsa; identical to SEQ ID NO: 75170

SEQ ID NO: 88638 - RNA, 64 nt, hsa; identical to SEQ ID NO: 75171

SEQ ID NO: 88639 - RNA, 64 nt, hsa; identical to SEQ ID NO: 75172

SEQ ID NO: 88640 - RNA, 64 nt, hsa; identical to SEQ ID NO: 75173

SEQ ID NO: 88641 - RNA, 64 nt, hsa; identical to SEQ ID NO: 75174

SEQ ID NO: 88642 - RNA, 64 nt, hsa; identical to SEQ ID NO: 75175

SEQ ID NO: 88643 - RNA, 64 nt, hsa; identical to SEQ ID NO: 75176

SEQ ID NO: 88644 - RNA, 64 nt, hsa; identical to SEQ ID NO: 75177

SEQ ID NO: 88645 - RNA, 64 nt, hsa; identical to SEQ ID NO: 75178

SEQ ID NO: 88646 - RNA, 64 nt, hsa; identical to SEQ ID NO: 75179

SEQ ID NO: 88647 - RNA, 64 nt, hsa; identical to SEQ ID NO: 75180

SEQ ID NO: 88648 - RNA, 64 nt, hsa; identical to SEQ ID NO: 75181

SEQ ID NO: 88649 - RNA, 64 nt, hsa; identical to SEQ ID NO: 75182

SEQ ID NO: 88650 - RNA, 64 nt, hsa; identical to SEQ ID NO: 75183

SEQ ID NO: 88651 - RNA, 64 nt, hsa; identical to SEQ ID NO: 75184

SEQ ID NO: 88652 - RNA, 64 nt, hsa; identical to SEQ ID NO: 75185

SEQ ID NO: 88653 - RNA, 64 nt, hsa; identical to SEQ ID NO: 75186

SEQ ID NO: 88654 - RNA, 64 nt, hsa; identical to SEQ ID NO: 75187

SEQ ID NO: 88655 - RNA, 64 nt, hsa; identical to SEQ ID NO: 75188

SEQ ID NO: 88656 - RNA, 64 nt, hsa; identical to SEQ ID NO: 75189

SEQ ID NO: 88657 - RNA, 64 nt, hsa; identical to SEQ ID NO: 75190

SEQ ID NO: 88658 - RNA, 64 nt, hsa; identical to SEQ ID NO: 75191

SEQ ID NO: 88659 - RNA, 64 nt, hsa; identical to SEQ ID NO: 75192

SEQ ID NO: 88660 - RNA, 64 nt, hsa; identical to SEQ ID NO: 75193

SEQ ID NO: 88661 - RNA, 64 nt, hsa; identical to SEQ ID NO: 75194

SEQ ID NO: 88662 - RNA, 64 nt, hsa; identical to SEQ ID NO: 75195

SEQ ID NO: 88663 - RNA, 64 nt, hsa; identical to SEQ ID NO: 75196

SEQ ID NO: 88664 - RNA, 64 nt, hsa; identical to SEQ ID NO: 75197

SEQ ID NO: 88665 - RNA, 64 nt, hsa
uauaugaacauuuuucuuuuauuguuuuaucuucacagaaaauaaaagguguuaauuugcuuuu

SEQ ID NO: 88666 - RNA, 64 nt, hsa
uguguuuucaaaacuuugcaaauucaucuguuacacagaaaauuuugacuuaaaacaucugcug

SEQ ID NO: 88667 - RNA, 64 nt, hsa
ccacaaggcuaaaauauuuacauucucacccauuacagaaaaaguuugauaauuccugcuuuau

SEQ ID NO: 88668 - RNA, 64 nt, hsa
cuaucaaaagcuaaauauggcacacuuguucuuuacagaaaaauaaagauauuuuaaacaaaau

SEQ ID NO: 88669 - RNA, 64 nt, hsa
cuauguacauagggaacuuaguucugggccauguacagaaaauaucacuguaauauaccaaaag

SEQ ID NO: 88670 - RNA, 64 nt, hsa
cauaagccauccagaucaacacccuuucuuccauacagaaaagggcuaaccauaccacagcugg

SEQ ID NO: 88671 - RNA, 64 nt, hsa
ggaggucucuaagaauauaagugggggaguggccacagaaaauucuucuccacuuucuagccag

SEQ ID NO: 88672 - RNA, 64 nt, hsa
agucagaaguuucugccgcagcccugcagagggcacagaaaauggaagacagcucuuauauugc

SEQ ID NO: 88673 - RNA, 64 nt, hsa
acauacuuggcaaauuuuugaguuuuacauucuuacagaaaaguccauuuaaaagugaucauuu

SEQ ID NO: 88674 - RNA, 64 nt, hsa
aacauucacaaagauuugcguuaaugaagacuacacagaaaaccuuucuagggauuugugugga

SEQ ID NO: 88675 - RNA, 64 nt, hsa
guucagaaauuggcacaucccuuuaaaaauaacaacagaaaauacaacuccugggaaaaaaggu

SEQ ID NO: 88676 - RNA, 64 nt, hsa
caaaugccagaauuaaaaaaaaaaaucaucaaagacagaaaaugccugaccaaauucuaaaacc

SEQ ID NO: 88677 - RNA, 64 nt, hsa
uuaaguacuaaggcacaaagacaugucaugcaucacagaaaagcaacuacuuauauuucagagc

SEQ ID NO: 88678 - RNA, 64 nt, hsa
aaagucuauuucuuuaaaguuuuguuuaauauuuacagaaaaauccacauacaguauugguaaa

SEQ ID NO: 88679 - RNA, 64 nt, hsa
ugugauaauagcauuuuuguaacuugccauccgcacagaaaauacgagaaaaucugcauguuug

SEQ ID NO: 88680 - RNA, 64 nt, hsa
aaaaaucuccccaguagagaaacauuuggaaaagacagaaaacuaaaaaggaagaaaaaagauc

SEQ ID NO: 88681 - RNA, 64 nt, hsa
auauacagaaaaauauauauuuuaaguuuaaaaaacagaaaaacagacaaaacaauccccauca

SEQ ID NO: 88682 - RNA, 64 nt, hsa
guagucaggugcucaauggagaauauaaacauauacagaaaaauauauauuuuaaguuuaaaaa

SEQ ID NO: 88683 - RNA, 64 nt, hsa
gaguauccaauaaaggagacaguuuagagucaggacagaaaagcuuccauaauugaacuagauu

SEQ ID NO: 88684 - RNA, 64 nt, hsa
cagacgugacguccugccagaaagagaaugaaugacagaaaaaaaaaagagagacaaacucuag

SEQ ID NO: 88685 - RNA, 64 nt, hsa
uucaaaaaaucugaccaaaacaaacaaacagaaaacagaaaacaaaaaaaccucuaugcaaucu

SEQ ID NO: 88686 - RNA, 64 nt, hsa
aagauguuucaaaaaaucugaccaaaacaaacaaacagaaaacagaaaacaaaaaaaccucuau

SEQ ID NO: 88687 - RNA, 64 nt, hsa
uuucaaccuaaauacugacugcuggacauaaaucacagaaaauuuaacuuaagaaaauuuacaa

SEQ ID NO: 88688 - RNA, 64 nt, hsa
guuaccuacaucaauuaauuaaaugaacuuauguacagaaaacauguauaaauauaagucuaua

SEQ ID NO: 88689 - RNA, 64 nt, hsa
caaaaaguacuaggcuacuaagugcauuuucaucacagaaaagaguugcauuuguauuaacaag

SEQ ID NO: 88690 - RNA, 64 nt, hsa
aaacugaauuaggcagucuuaaaaaaaaaaaaaaacagaaaaagaaaaaaaagaacguugcaaa

SEQ ID NO: 88691 - RNA, 64 nt, hsa
ucccccccaaauuuuauuaugaacauuuuuaaaaacagaaaaauugaaaaacuguuugguaagc

SEQ ID NO: 88692 - RNA, 50 nt, hsa
uuaaaauucuugcacaauaaacagaaaacuuugcuuauuucuuuugcagc

SEQ ID NO: 88693 - RNA, 64 nt, hsa
cagaauauuaauacaauuaauauuaauauuaacuacagaaaagacaaacaguagagaacagcaa

SEQ ID NO: 88694 - RNA, 64 nt, hsa
aguccugagcgaaaacaggagaguuagucgcccuacagaaaacccagcuagacuauuggguaug

SEQ ID NO: 88695 - RNA, 64 nt, hsa
aaaugcucugugaugguaaauaaaauuggagcagacagaaaagauauagcaaaugaagaaauau

SEQ ID NO: 88696 - RNA, 64 nt, hsa
ucauguuuguuguaaccugagguauccaaaugcuacagaaaaauuuaugacccaaauacaaauc

SEQ ID NO: 88697 - RNA, 64 nt, hsa
caaauggggccucauuaaacuaaagagcuucugcacagaaaaagaaacuagcaacacaguaaac

SEQ ID NO: 88698 - RNA, 64 nt, hsa
uagaggcuauuauccuaagcaaccuaaugcaagaacagaaaaccacauacugcaucuucccauu

SEQ ID NO: 88699 - RNA, 64 nt, hsa
aagcuugcuuguuuuaaacaaccaaaucauuggaacagaaaaggauuuaaaaaacaagaaugca

SEQ ID NO: 88700 - RNA, 64 nt, hsa
auguauacauagaaguaucugagacauaaacuguacagaaaacuuguccacgugcuuuuguaug

SEQ ID NO: 88701 - RNA, 64 nt, hsa
ugcaaucauagugacuucagaaaauuuggaaaauacagaaaauauagggaagaauaaaauuaac

SEQ ID NO: 88702 - RNA, 64 nt, hsa
accagcuaaggcaauauagugagaccaugucucuacagaaaaaauuuaaaaacagaucagcugg

SEQ ID NO: 88703 - RNA, 64 nt, hsa
uaaaaaauacaaaaagcagacugauguacuggaaacagaaaaguauuuccuccauacuauaagu

SEQ ID NO: 88704 - RNA, 64 nt, hsa
guaauaauuuacguguauucuuuuucucuauagcacagaaaacagauaguuaacugaugauagg

SEQ ID NO: 88705 - RNA, 64 nt, hsa
uuagccagauugcuuuuugcaaccaaagcuguggacagaaaagccuccuuaagugagcugaggg

SEQ ID NO: 88706 - RNA, 64 nt, hsa
aauaggcuuuauuuguaagagcaguuuuauguuuacagaaaaauuaggcacaaagggauuccca

SEQ ID NO: 88707 - RNA, 64 nt, hsa
uggaauugugguauuuuuuucuguauugauuuuaacagaaaauuucaauuuauagagguuagga

SEQ ID NO: 88708 - RNA, 64 nt, hsa
aauuucaauuuauagagguuaggaauuccaaacuacagaaaauguuuguuuuuagugucaaauu

SEQ ID NO: 88709 - RNA, 64 nt, hsa
agaauaagaaugaaaacugcugacguauuacaaaacagaaaaauaaaugauuuaaaaucaaauc

SEQ ID NO: 88710 - RNA, 64 nt, hsa
uagaaaucuaaaugaauuaucacuguguauacagacagaaaaaucacauaacucugguguguua

SEQ ID NO: 88711 - RNA, 64 nt, hsa
cuaauuccaaaauuauggcugaauauacuaaauaacagaaaaguuacagauaagaauuuauuuc

SEQ ID NO: 88712 - RNA, 64 nt, hsa
ggccgcuccgcuccccugcuccugucugucucggacagaaaacacgaggcuccuugugucaagc

SEQ ID NO: 88713 - RNA, 64 nt, hsa
gauuucagaugaacucugcuguuuagaaguaaccacagaaaagcaaagucaguguacacucuga

SEQ ID NO: 88714 - RNA, 64 nt, hsa
aguagugaguuaaagcuacaggucaguuuaugaaacagaaaaguaggaaugcauuuucugggug

SEQ ID NO: 88715 - RNA, 64 nt, hsa
ugaugugcacugcauuagaaaugagguagcugacacagaaaaaggauguuuugauaggaauaau

SEQ ID NO: 88716 - RNA, 64 nt, hsa
uucuugaacugaucauugaaaacuuauaaaccuaacagaaaagccacauaauauuuagugucau

SEQ ID NO: 88717 - RNA, 64 nt, hsa
uauccagcacaaaaacuauuucuggcugaauagcacagaaaaguauuuuaaccuaccuguagag

SEQ ID NO: 88718 - RNA, 64 nt, hsa
cuacauuugcuuaaauugcuauuuuggcaacagcacagaaaacuaauauuuuuaagcagagaau

SEQ ID NO: 88719 - RNA, 64 nt, hsa
uuuacagcuacaaaaaccuacuuugguauuuauuacagaaaagugcucaguuaaauguaagugu

SEQ ID NO: 88720 - RNA, 64 nt, hsa
uccaaguuaugauuuauuuugcaacuaccucaggacagaaaagauuuauggggauuuuaaaaau

SEQ ID NO: 88721 - RNA, 64 nt, hsa
uauuaguugugccugguucuuguaauuugauuuuacagaaaaggaaaugacacuugagauccuu

SEQ ID NO: 88722 - RNA, 64 nt, hsa
uucaugaguccugcuucuagcuccauuguggaauacagaaaauuaaauauaccuguuaaguucg

SEQ ID NO: 88723 - RNA, 64 nt, hsa
aauggaaccuccauuuucaaacugaagcacagggacagaaaauauauuucuaguuaucacuuaa

SEQ ID NO: 88724 - RNA, 64 nt, hsa
ucugggauggggucagaaaugcauccuccagcugacagaaaaauccaggaugagaucagaagga

SEQ ID NO: 88725 - RNA, 64 nt, hsa
accaacauggagaaacccagucucuacugaaaauacagaaaaguuagccaggcgugguggcaca

SEQ ID NO: 88726 - RNA, 64 nt, hsa
uugacuuaauuuauuuauuuuuugaaaagaagagacagaaaauaccuuauuaucugcagggacu

SEQ ID NO: 88727 - RNA, 64 nt, hsa
uuuguccuucugcaauacaugcacuugaaaauaaacagaaaagagauguuuaauaacaaguuua

SEQ ID NO: 88728 - RNA, 64 nt, hsa
aaaccuuuauuuaggccuucugugugacguauccacagaaaagagaagcucugauucagcuggg

SEQ ID NO: 88729 - RNA, 64 nt, hsa
ucagagaaaugcaugggaauauuuuuuccuuaaaacagaaaaaaauuaaaguauuauuaauaau

SEQ ID NO: 88730 - RNA, 64 nt, hsa
uggacaaggaaggaauaaagggagaagagggaaaacagaaaaccugaugcuggggacacagcau

SEQ ID NO: 88731 - RNA, 64 nt, hsa
cauggauauguuauacugaaccaggccagagcaaacagaaaaagaagguugagggcaauggaca

SEQ ID NO: 88732 - RNA, 64 nt, hsa
ugauuuuuaugcuuguuaguguauugcaagaaacacagaaaauguaguuuuguuuuaauaaacc

SEQ ID NO: 88733 - RNA, 64 nt, hsa
uagauguguauuuccuccccugcagaaaauaagcacagaaaauuauaauguaggugaucggagc

SEQ ID NO: 88734 - RNA, 64 nt, hsa
uacuauuaauuugcucagugcacuuuuuucaaauacagaaaaaagauucuccauuauaguuaca

SEQ ID NO: 88735 - RNA, 64 nt, hsa
uuuguuacagcaauccuaggaagcuaauacucugacagaaaaaaaucuuggauaauaugcauga

SEQ ID NO: 88736 - RNA, 64 nt, hsa
guuuuaucaauaugauuaucaaaucacagcauauacagaaaagacuuggacuuauuguauguuu

SEQ ID NO: 88737 - RNA, 64 nt, hsa
aagaaagcaugguauuaaacuaucauagaaguagacagaaaaagaaaaaaggacucauggcauu

SEQ ID NO: 88738 - RNA, 64 nt, hsa
guauaagcauggagaacagugauuuuuuuuuagaacagaaaacaacaaaaaauaaccccaaaau

SEQ ID NO: 88739 - RNA, 64 nt, hsa
ugugaauugauaauaaacuguccucuuucagaaaacagaaaaaaaacacacacacacacaacaa

SEQ ID NO: 88740 - RNA, 64 nt, hsa
uauuagaauugugucauuuaucaaaccuuuuauuacagaaaaaaaucugaacugagaaaggagc

SEQ ID NO: 88741 - RNA, 64 nt, hsa
aaauuucucagugccuucucagggucuggugugaacagaaaaaacaguguuccugcauuuacca

SEQ ID NO: 88742 - RNA, 64 nt, hsa
cauuuguuacucucuguucuuugacugcccacccacagaaaagcaaaauaaccaacuaccuacu

SEQ ID NO: 88743 - RNA, 64 nt, hsa
uuaaccauauuuuaaaaguaccaauuuuguuuuuacagaaaagauaaaacucaaaagagaacag

SEQ ID NO: 88744 - RNA, 64 nt, hsa
aauaugugagguaguaaggaggacagaaaacagaacagaaaagaguaacagcugaggucaagau

SEQ ID NO: 88745 - RNA, 64 nt, hsa
gaaggagagagaaauaugugagguaguaaggaggacagaaaacagaacagaaaagaguaacagc

SEQ ID NO: 88746 - RNA, 64 nt, hsa
uuauaaaaagucaaacauugugaucuauaaaugcacagaaaauacuuuguaaaaaguagcaucc

SEQ ID NO: 88747 - RNA, 64 nt, hsa
aaccaaaacuguaaauaugguuguugcaugagcaacagaaaaaauuguuuaaaugcuugaagca

SEQ ID NO: 88748 - RNA, 64 nt, hsa
gagguugucccugcaguacuccuugucacagaaaacagaaaaacaguuguuccuguuguguggu

SEQ ID NO: 88749 - RNA, 64 nt, hsa
ucugggugagguugucccugcaguacuccuugucacagaaaacagaaaaacaguuguuccuguu

SEQ ID NO: 88750 - RNA, 64 nt, hsa
acaguuugauuaaaacauuguccuguuuguugcaacagaaaacucggauaguuuuaacaacagg

SEQ ID NO: 88751 - RNA, 64 nt, hsa
gguaaaauagguaaaauaccuagaaacaaucacuacagaaaacagcugaagacaguggccaugc

SEQ ID NO: 88752 - RNA, 64 nt, hsa
cagaauccccaagugccugcuuuugaugaugucuacagaaaaugcuggcugagcugaacacauu

SEQ ID NO: 88753 - RNA, 64 nt, hsa
ugagcugaacacauuugcccaauuccaggugugcacagaaaaccgagaauauucaaaauuccaa

SEQ ID NO: 88754 - RNA, 64 nt, hsa
auguucugauauccuccuacaguaguuuaaauugacagaaaaauuugaauguuuucuucuuaac

SEQ ID NO: 88755 - RNA, 64 nt, hsa
uauaccugaacuguagugguuugaucggauggagacagaaaacccgauuuuuauucucauaaau

SEQ ID NO: 88756 - RNA, 64 nt, hsa
cuaaaaacaaaacucacguaucaucucaauagauacagaaaaggcuuuugauaaaauucaacuu

SEQ ID NO: 88757 - RNA, 64 nt, hsa
uggaagccauuauccuaaaugaacucacucagaaacagaaaaccaaauaccacauguucucacu

SEQ ID NO: 88758 - RNA, 64 nt, hsa
gaaggugccauuuggcugcuccuuaauagugcagacagaaaacugcagugaacacaugccaaaa

SEQ ID NO: 88759 - RNA, 64 nt, hsa
gggaaaaaaaucuaagcugucugccacauugaguacagaaaaguuguagauuucaaauuuuauu

SEQ ID NO: 88760 - RNA, 64 nt, hsa
gacuccugaauuggaagaggaagaacuucuguuuacagaaaacuguauuguuauauaugucagg

SEQ ID NO: 88761 - RNA, 64 nt, hsa
acaauucaagcaguagacaaaguugcucacaaauacagaaaacaucuuuuugucuacuucgcaa

SEQ ID NO: 88762 - RNA, 64 nt, hsa
uguggcaaaguuuuuaacuaauacaccuuauugcacagaaaaucauuuauauuugagaaaaauu

SEQ ID NO: 88763 - RNA, 64 nt, hsa
cuuguaucagaucuuauuguccacauuuuguacuacagaaaaacucugaagaggucacucaaac

SEQ ID NO: 88764 - RNA, 64 nt, hsa
gaaagaaaacugucagcaauucuaugcugacauaacagaaaauguagaugagauagaugaaaua

SEQ ID NO: 88765 - RNA, 64 nt, hsa
guguccuaugcccagcugcacagcuuacccucaaacagaaaauaaugaagccuucuuccuccca

SEQ ID NO: 88766 - RNA, 62 nt, hsa
uauuguggaaucuuugaaaggacaaggccucugugaaugaaucagucccagggaagcauuug

SEQ ID NO: 88767 - RNA, 62 nt, hsa
uuguaaaucuuugcuaaguaguguuuuccuuggugaaugaagucauuguugucuucaagugu

SEQ ID NO: 88768 - RNA, 62 nt, hsa
gcuguuuggaaguguaaugauuuuaucacauggugaaugacuacuaagaguaaugauuauau

SEQ ID NO: 88769 - RNA, 62 nt, hsa
augacuacuaagaguaaugauuauaucacauugugaaugacuacuugccacaguaaaaauac

SEQ ID NO: 88770 - RNA, 62 nt, hsa
uacagaguaauauucuguggcccuuugacuuugugaaugagcacaaugaaaugccgccuacu

SEQ ID NO: 88771 - RNA, 62 nt, hsa
uuuaggugauuuaaaaauauaccguguugguggugaaugacuauugaugacuguguuaagug

SEQ ID NO: 88772 - RNA, 62 nt, hsa
uauaguuacaaauuuuagguuggugaauccaagugaaugaaauaucagcauaacuauguggg

SEQ ID NO: 88773 - RNA, 62 nt, hsa
uauaaauuucucuuugcauauaauacauauuugugaaugagacauauucccaaaaaauucuu

SEQ ID NO: 88774 - RNA, 62 nt, hsa
auucugaaguugccacaaaaaauaagacacuggugaaugagaguauaauuguuuuucuucua

SEQ ID NO: 88775 - RNA, 62 nt, hsa
guauggaggauuugaggaacaguaaccaggaugugaaugauuuuguuacaucaguguucacu

SEQ ID NO: 88776 - RNA, 62 nt, hsa
uuguauauguaacucuaagagaccuuccuagagugaaugaagguagaaaacugaaaagggag

SEQ ID NO: 88777 - RNA, 62 nt, hsa
cuucucacaauccgagcugcucuuuguccucugugaaugaagguacuuuugcuuccauuuca

SEQ ID NO: 88778 - RNA, 64 nt, hsa; identical to SEQ ID NO: 45664

SEQ ID NO: 88779 - RNA, 64 nt, hsa; identical to SEQ ID NO: 45665

SEQ ID NO: 88780 - RNA, 64 nt, hsa; identical to SEQ ID NO: 45666

SEQ ID NO: 88781 - RNA, 64 nt, hsa; identical to SEQ ID NO: 45667

SEQ ID NO: 88782 - RNA, 64 nt, hsa
auuucaaagcuuuauucugucugccuaagagaaucaaccaaaggugauucuccuaaagagcagu

SEQ ID NO: 88783 - RNA, 64 nt, hsa
uuuccuuaauuuauuuuguuaacaccccuaauuacaaccaaagugaugauguggagucuucugu

SEQ ID NO: 88784 - RNA, 64 nt, hsa
auccaacgacacaaucuuuuaaucuuuggucacucaaccaaacaggaguuccguaggcagagug

SEQ ID NO: 88785 - RNA, 64 nt, hsa
guccugugaggcaaaaaaacaaaacaaaacaaaacaaccaaacaaauacaaucuaacuuuuacc

SEQ ID NO: 88786 - RNA, 64 nt, hsa
ugcuuugaaaaucuuuuuuaagggagaaaaaucucaaccaaaguuaugcucauccagacaagcu

SEQ ID NO: 88787 - RNA, 64 nt, hsa
cucucacagguacagcuguuucuuggaaauccuccaaccaaauagcaguuuuccuaacuugauu

SEQ ID NO: 88788 - RNA, 64 nt, hsa
uaaauaucuauaugacgcucuuaaaaaaacaucccaaccaaaaccaaccaaacaaaaacauccu

SEQ ID NO: 88789 - RNA, 64 nt, hsa
uaugacgcucuuaaaaaaacaucccaaccaaaaccaaccaaacaaaaacauccucacaacuccc

SEQ ID NO: 88790 - RNA, 64 nt, hsa
ugcagcacuguuuacaauagcaaagacuuggaaccaaccaaaauacccacaaaugauagaccgg

SEQ ID NO: 88791 - RNA, 64 nt, hsa
aagccuaagccauaccaugcagccuuugugccagcaaccaaaucccauguuuccuacuguguua

SEQ ID NO: 88792 - RNA, 64 nt, hsa
ccugagguggcaccguacucaguguugugaugcccccaccuagggaggacucaaugcucuuugu

SEQ ID NO: 88793 - RNA, 64 nt, hsa
caguucucagaccgaaggugcugccuucauccuccccaccuaaugcauuuuugaaaccaaaggu

SEQ ID NO: 88794 - RNA, 64 nt, hsa
guaacucuagaaguuccuuugacuaggcugcaaucccaccuauaugcucagcccuaagagcugu

SEQ ID NO: 88795 - RNA, 64 nt, hsa
cacuguuugcauaucgcucaggccaccuccaaaccccaccuagguuuuauaauguauauuauau

SEQ ID NO: 88796 - RNA, 64 nt, hsa
ugccaggccucaggcccaggacccaggaggccuccccaccuaccccagcacacacacucccugc

SEQ ID NO: 88797 - RNA, 64 nt, hsa
cauauuccuuacccucugucucuccucccuguaucccaccuaugguucaguguugcaagagucu

SEQ ID NO: 88798 - RNA, 64 nt, hsa
cugugacccuuucgcuuuugcauucacccuccuucccaccuaccuguccuggggcuguugagca

SEQ ID NO: 88799 - RNA, 64 nt, hsa
agaccccgacauuccucgguauuuauugucuguccccaccuaggacccccacccccgacccucg

SEQ ID NO: 88800 - RNA, 64 nt, hsa
agccgggccguccguguuccauccuccacgcacccccaccuaucguugguucgcaaagugcaaa

SEQ ID NO: 88801 - RNA, 64 nt, hsa
cccaccuaccucccugaugcugaauggaaaccuucccaccuaagcgcucuugaacaucccacua

SEQ ID NO: 88802 - RNA, 64 nt, hsa
gagccuuuauuccacgucgcguggucuccaagaccccaccuaccucccugaugcugaauggaaa

SEQ ID NO: 88803 - RNA, 64 nt, hsa
auucucaucauccaaacugaacauuuguaucccaagcagaaauaaagagaauauguucuuuuua

SEQ ID NO: 88804 - RNA, 64 nt, hsa
cuccaaggcagcaaagcagaaucgggagcaguggagcagaaaugugcaagcacccugaucucac

SEQ ID NO: 88805 - RNA, 64 nt, hsa
gucagcaaaauuagaagucauuucuaguccucaaagcagaaauaauuagaaauguuaacauuua

SEQ ID NO: 88806 - RNA, 64 nt, hsa
acuguugauguuuuguucaccggauauguuggguagcagaaaaggccuagaaccaguuuuaaga

SEQ ID NO: 88807 - RNA, 64 nt, hsa
gaaaaaaagguuaagcauaaaaagaaagggaaaaagcagaaacacugcagaagacacaaacaaa

SEQ ID NO: 88808 - RNA, 64 nt, hsa
cacaaaaugaaaauguaguaguacaaccaguuguagcagaaaauauuccuguaauaccacugag

SEQ ID NO: 88809 - RNA, 64 nt, hsa
uuuagauuugaauguuuuaagauaggagagacuuagcagaaaauacuuggcuugccagggccac

SEQ ID NO: 88810 - RNA, 64 nt, hsa
auuucucacaaggaaaaaaacauucuauauuuguagcagaaaucagugguuugaaaagucauac

SEQ ID NO: 88811 - RNA, 64 nt, hsa
cuguuacaguuuuauugcucugaguaacugacaaagcagaaacuauucaguuuuuguaguaaag

SEQ ID NO: 88812 - RNA, 52 nt, hsa
uugauguggacaugaagugaagagcagaaaagaugaauuuguccaauugugu

SEQ ID NO: 88813 - RNA, 64 nt, hsa
uauuaaauagccaugagcuucacugcuuagagggagcagaaaggucaacaucuaaaagcaccuu

SEQ ID NO: 88814 - RNA, 64 nt, hsa
agaggaggagaaacagggugagucaagguaaaggagcagaaauguaguuacaagccaggucguc

SEQ ID NO: 88815 - RNA, 64 nt, hsa
aacauaugaagcuuaggagugaagagacuuccugagcagaaaugggcgaacuucagucuuuuua

SEQ ID NO: 88816 - RNA, 54 nt, hsa
aaaaggaggaaaaacaguaauaauagcagaaauuuugaagccagaaggacaaca

SEQ ID NO: 88817 - RNA, 64 nt, hsa
ugccaggggucugcucuagcaucaguaaguauuuagcagaaacuaacuccguaaugaauggaau

SEQ ID NO: 88818 - RNA, 64 nt, hsa
uuuuuaaagagaaguugccuugguccacacacuaagcagaaaaccaaguuaucaggacagagau

SEQ ID NO: 88819 - RNA, 64 nt, hsa
acucacuaaguauggaaaacugauucugggaggaagcagaaaugucccuagauaacagcaugua

SEQ ID NO: 88820 - RNA, 64 nt, hsa
acuccagccugggaacaagagugaaacucucaaaagcagaaacaaaaacccaacauauaugggc

SEQ ID NO: 88821 - RNA, 64 nt, hsa
auacccaugccuuaaagaggggcaguuucucaaaagcagaaacaugccgccaguucucaaguuu

SEQ ID NO: 88822 - RNA, 64 nt, hsa
ccaaagguguugauuuacaaagaggccagcuaauagcagaaaucaugacccugaaagagagaug

SEQ ID NO: 88823 - RNA, 64 nt, hsa
agacaguuagagacucugucacccuagcuauaccagcagaaaaccuguucaggcaggcuuucug

SEQ ID NO: 88824 - RNA, 64 nt, hsa
ccucuuguucaugucagcuuauaugugacacugcagcagaaaggcucugaagguccaaagaguu

SEQ ID NO: 88825 - RNA, 64 nt, hsa
ugggugcugugggucaccaacaggcuguuuacaaagcagaaaauaucaucaccaucauaaccuu

SEQ ID NO: 88826 - RNA, 64 nt, hsa
cuucccugugucuccccuaacaaggcaaucuggaagcagaaaugcaaacuccagccccaccaca

SEQ ID NO: 88827 - RNA, 64 nt, hsa
ggagaaugucaaggaagacuuuugguagagaaggagcagaaagauguguuuuugggaagaagaa

SEQ ID NO: 88828 - RNA, 64 nt, hsa
uuuguugcuuucuuaccuacuauuggcccuaaauagcagaaagaagagaagugaccgagagaac

SEQ ID NO: 88829 - RNA, 64 nt, hsa
acauccguuuauuaucaagggcaaccuuggugaaagcagaaagggugugugcuauugcauauau

SEQ ID NO: 88830 - RNA, 64 nt, hsa
uguaagcuccuauuugcuuaucuuguuuauuucaagcagaaaucaauaaauuccauaacccucu

SEQ ID NO: 88831 - RNA, 64 nt, hsa
agagcugcaguuagacgggguuacgggggcuaaaagcagaaaaaaaauuccauuucaucgggau

SEQ ID NO: 88832 - RNA, 64 nt, hsa
ucugaaucucuccagcagccagaggcacgugagaagcagaaagagcugguaaauaaagccuugg

SEQ ID NO: 88833 - RNA, 64 nt, hsa
uagaauuagagacaucugauuuguuuaucaccuuagcagaaaaaccacaguccaaaagacaagc

SEQ ID NO: 88834 - RNA, 64 nt, hsa
gauacuacaaauaauuuucuuaaaagucuaagauagcagaaaauacaguaaaaacacaggagaa

SEQ ID NO: 88835 - RNA, 64 nt, hsa
uuauauguuuuaaucucccuugucccucagaauaagcagaaaauauaacugcagcuguaugucg

SEQ ID NO: 88836 - RNA, 64 nt, hsa
caugacuuaccauuccagcugcaugggaaagcaaagcagaaaacagugccccaaauggaaaaaa

SEQ ID NO: 88837 - RNA, 64 nt, hsa
gaaaaaaaaguacaaccaaaugccagucaggcacagcagaaaccuacaacucauggaagguaaa

SEQ ID NO: 88838 - RNA, 64 nt, hsa
gcugauccccugugugagagaaaagaauggaauaagcagaaacugccaugcucagagaauccua

SEQ ID NO: 88839 - RNA, 64 nt, hsa
gcauugaauuugcuacuguaggaguauuuuuaggagcagaaacugcaaacacauuucauuguga

SEQ ID NO: 88840 - RNA, 64 nt, hsa
acuugaauagcacaucaauagguuacuggacaaaagcagaaaaaccuguuacaggauagccugc

SEQ ID NO: 88841 - RNA, 64 nt, hsa
ggaauuacaauugcaugcagguagcaagcaagaaagcagaaacuacuguucccuuuauuuuaac

SEQ ID NO: 88842 - RNA, 62 nt, hsa
auccaaaguuuauggacuaaaugcugcaggucagcagaaauuugcacuaauaauacuuacca

SEQ ID NO: 88843 - RNA, 64 nt, hsa
aaggggucucgguggagcugugcaccagcagccaagcagaaagaaacacgcgacauggacucug

SEQ ID NO: 88844 - RNA, 64 nt, hsa
cagacugcccugcuggggccgggccggaggguggagcagaaaggggaccccggagccgagcgag

SEQ ID NO: 88845 - RNA, 64 nt, hsa
ccuuucucucuuugccuuuaguuugcccgacaccagcagaaaaguggaccuugggggcugguuc

SEQ ID NO: 88846 - RNA, 64 nt, hsa
ggagaaggagaggauccggucggcagcagcccugagcagaaagcuggaggggggacugucgcgg

SEQ ID NO: 88847 - RNA, 64 nt, hsa
agagagcacaaaaaugggagaaaaugcaaacaugagcagaaaauauuuucccacugguguguag

SEQ ID NO: 88848 - RNA, 64 nt, hsa
acuccguuugaaguaucaccuucucauaacuaaaagcagaaaagcuaacaaaagcuucucagcu

SEQ ID NO: 88849 - RNA, 64 nt, hsa
ggaacauuugaucuagcagcagggaugagaggaaagcagaaaugaaugaacugugaaagcuccu

SEQ ID NO: 88850 - RNA, 64 nt, hsa
agaggaaaggacucauucaugucacgcuuccuugagcagaaaagagcacugagagcacuuggga

SEQ ID NO: 88851 - RNA, 64 nt, hsa
auuaucuauccuugaugauguguuuaaacugaguagcagaaaacagaggccacacuuucuggga

SEQ ID NO: 88852 - RNA, 64 nt, hsa
guuugcuccuguuguuacuggguagguucugaacagcagaaacccaugugcagggugggcuggu

SEQ ID NO: 88853 - RNA, 64 nt, hsa
aaaagggacucagguaagcccagccugggaugagagcagaaaagcauucaagauuugcaggccu

SEQ ID NO: 88854 - RNA, 64 nt, hsa
uuauugucacuuuuaaaauguuaaugucauucugagcagaaauagauauauuuucagauuuuuu

SEQ ID NO: 88855 - RNA, 64 nt, hsa
cccuuaugacaucagcaauacagacuacuucuuccccagauagcuggcuggguggcaccagcag

SEQ ID NO: 88856 - RNA, 64 nt, hsa
aaauuagccaagugugguagagugugccugaagucccagauacuuggggggcugaggugggagg

SEQ ID NO: 88857 - RNA, 64 nt, hsa
gugagggaaugguaguuaaggcuucuuuuuugcccccagauacauggugaugguuagcauaugg

SEQ ID NO: 88858 - RNA, 64 nt, hsa
caugggaagagcguagacagguguuacuuacagucccagauacacuaaaguuacaaacagacca

SEQ ID NO: 88859 - RNA, 64 nt, hsa
guucauauuugaguuuaauuguacugacccuggacccagauaagcagcaacuuugugucuuugg

SEQ ID NO: 88860 - RNA, 64 nt, hsa
ggcccuggggugcagaggcccggcacguagagaacccagauagacgccggugguggaacugguc

SEQ ID NO: 88861 - RNA, 64 nt, hsa
gagcccucggggccuccuccugggccucagcuugcccagauacauaccuaaauauauauauaua

SEQ ID NO: 88862 - RNA, 64 nt, hsa
cuggaaggguucccuuguccuagacauugaggggcccagauaagaccaaaaccaagcauaagag

SEQ ID NO: 88863 - RNA, 64 nt, hsa
agagauggaagccaggacaagggagcccaccgggcccagauagagacuucagaacccacuccug

SEQ ID NO: 88864 - RNA, 64 nt, hsa
uuuugaaaaaucccuccaagugauucuuuuacaucccagauagaaaacccuaaauuaaagguga

SEQ ID NO: 88865 - RNA, 64 nt, hsa
uguccagccagccagccagcugcagggccucuugcugcuuaagagcugaugggccgggcauguu

SEQ ID NO: 88866 - RNA, 64 nt, hsa
augggcugccagcaacugcagaggaugcagccaccugcuuaacugugcuguccagccagccagc

SEQ ID NO: 88867 - RNA, 64 nt, hsa
aacuauuuuaccaagaaaaaucucagcuugcuuacugcuuaauuaaaaaccuacaauuuacaca

SEQ ID NO: 88868 - RNA, 64 nt, hsa
ucccugccuucaagacugugagcuuuggauagcccugcuuaaauguuugucaacaacaagaguc

SEQ ID NO: 88869 - RNA, 64 nt, hsa
gaauaucaagucccagccccugcaacccaggcugcugcuuaauuuucaugucaguaucaucaaa

SEQ ID NO: 88870 - RNA, 64 nt, hsa
aauuuucaugucaguaucaucaaaauccaauguucugcuuaaacucaagauggaaaguccaguc

SEQ ID NO: 88871 - RNA, 64 nt, hsa
acaaacuuuguauaauagcaaaucgggaaggggacugcuuaaaauguuaaugcaguguuuuucu

SEQ ID NO: 88872 - RNA, 64 nt, hsa
uauuuuauaaacauuuuuauaauauauuauuuuacugcuuaaauuccaaguccugaaguagaug

SEQ ID NO: 88873 - RNA, 64 nt, hsa
aaagucggggguuguuaggcuuuucugccugcuccugcuuaaacacaagaaggaauccuggauu

SEQ ID NO: 88874 - RNA, 64 nt, hsa
uaaagugauacgauaauauuacucuugauugcugcugcuuaauuugauguaauauguuuaaagu

SEQ ID NO: 88875 - RNA, 64 nt, hsa
agcucaguauuguguggacacuuacgagaguuuucugcuuaauugaaguguaauauagguugua

SEQ ID NO: 88876 - RNA, 64 nt, hsa
ggcucccaagagagaggccuuuucaguugagacucugcuuaagagaagauccaaaguuaaagcu

SEQ ID NO: 88877 - RNA, 64 nt, hsa
ugugggcgugcccggaagcagagcgccacacucgcugcuuaagcucccccagcucuuuccagaa

SEQ ID NO: 88878 - RNA, 64 nt, hsa
uaaaugcuggacacggaggcaggcuguuuaaacgcugcuuaaagucgcaacugggccccuuuca

SEQ ID NO: 88879 - RNA, 64 nt, hsa
aaccacccucggaugauggguugcagccggccugcugcuuaaggugggggcugccaugaggggg

SEQ ID NO: 88880 - RNA, 64 nt, hsa
agcucugcuuaauguacuacuuaggaaaaugucccugcuuaauaauguaagccaagcuaaauga

SEQ ID NO: 88881 - RNA, 64 nt, hsa
ugggaguaauacugacaauccauuuacuguagcucugcuuaauguacuacuuaggaaaaugucc

SEQ ID NO: 88882 - RNA, 64 nt, hsa; identical to SEQ ID NO: 86383

SEQ ID NO: 88883 - RNA, 64 nt, hsa; identical to SEQ ID NO: 86384

SEQ ID NO: 88884 - RNA, 64 nt, hsa; identical to SEQ ID NO: 86385

SEQ ID NO: 88885 - RNA, 64 nt, hsa; identical to SEQ ID NO: 86386

SEQ ID NO: 88886 - RNA, 64 nt, hsa; identical to SEQ ID NO: 86387

SEQ ID NO: 88887 - RNA, 64 nt, hsa; identical to SEQ ID NO: 86388

SEQ ID NO: 88888 - RNA, 64 nt, hsa; identical to SEQ ID NO: 86389

SEQ ID NO: 88889 - RNA, 64 nt, hsa; identical to SEQ ID NO: 86390

SEQ ID NO: 88890 - RNA, 64 nt, hsa; identical to SEQ ID NO: 86391

SEQ ID NO: 88891 - RNA, 64 nt, hsa; identical to SEQ ID NO: 86392

SEQ ID NO: 88892 - RNA, 64 nt, hsa; identical to SEQ ID NO: 86393

SEQ ID NO: 88893 - RNA, 64 nt, hsa; identical to SEQ ID NO: 86394

SEQ ID NO: 88894 - RNA, 61 nt, hsa; identical to SEQ ID NO: 86395

SEQ ID NO: 88895 - RNA, 64 nt, hsa; identical to SEQ ID NO: 86396

SEQ ID NO: 88896 - RNA, 64 nt, hsa; identical to SEQ ID NO: 86397

SEQ ID NO: 88897 - RNA, 64 nt, hsa; identical to SEQ ID NO: 86398

SEQ ID NO: 88898 - RNA, 64 nt, hsa; identical to SEQ ID NO: 86399

SEQ ID NO: 88899 - RNA, 64 nt, hsa; identical to SEQ ID NO: 86400

SEQ ID NO: 88900 - RNA, 64 nt, hsa; identical to SEQ ID NO: 86401

SEQ ID NO: 88901 - RNA, 64 nt, hsa; identical to SEQ ID NO: 86402

SEQ ID NO: 88902 - RNA, 64 nt, hsa; identical to SEQ ID NO: 86403

SEQ ID NO: 88903 - RNA, 64 nt, hsa; identical to SEQ ID NO: 86404

SEQ ID NO: 88904 - RNA, 64 nt, hsa; identical to SEQ ID NO: 86405

SEQ ID NO: 88905 - RNA, 64 nt, hsa; identical to SEQ ID NO: 86406

SEQ ID NO: 88906 - RNA, 64 nt, hsa; identical to SEQ ID NO: 86407

SEQ ID NO: 88907 - RNA, 64 nt, hsa; identical to SEQ ID NO: 86408

SEQ ID NO: 88908 - RNA, 64 nt, hsa; identical to SEQ ID NO: 86409

SEQ ID NO: 88909 - RNA, 64 nt, hsa; identical to SEQ ID NO: 86410

SEQ ID NO: 88910 - RNA, 64 nt, hsa; identical to SEQ ID NO: 86411

SEQ ID NO: 88911 - RNA, 64 nt, hsa; identical to SEQ ID NO: 86412

SEQ ID NO: 88912 - RNA, 64 nt, hsa; identical to SEQ ID NO: 86413

SEQ ID NO: 88913 - RNA, 64 nt, hsa; identical to SEQ ID NO: 86414

SEQ ID NO: 88914 - RNA, 64 nt, hsa; identical to SEQ ID NO: 86415

SEQ ID NO: 88915 - RNA, 64 nt, hsa; identical to SEQ ID NO: 86416

SEQ ID NO: 88916 - RNA, 64 nt, hsa; identical to SEQ ID NO: 86417

SEQ ID NO: 88917 - RNA, 64 nt, hsa; identical to SEQ ID NO: 86418

SEQ ID NO: 88918 - RNA, 64 nt, hsa; identical to SEQ ID NO: 86419

SEQ ID NO: 88919 - RNA, 64 nt, hsa; identical to SEQ ID NO: 86420

SEQ ID NO: 88920 - RNA, 64 nt, hsa; identical to SEQ ID NO: 86421

SEQ ID NO: 88921 - RNA, 64 nt, hsa; identical to SEQ ID NO: 86422

SEQ ID NO: 88922 - RNA, 64 nt, hsa; identical to SEQ ID NO: 86423

SEQ ID NO: 88923 - RNA, 64 nt, hsa; identical to SEQ ID NO: 86424

SEQ ID NO: 88924 - RNA, 64 nt, hsa; identical to SEQ ID NO: 86425

SEQ ID NO: 88925 - RNA, 64 nt, hsa; identical to SEQ ID NO: 86426

SEQ ID NO: 88926 - RNA, 64 nt, hsa; identical to SEQ ID NO: 86427

SEQ ID NO: 88927 - RNA, 64 nt, hsa; identical to SEQ ID NO: 86428

SEQ ID NO: 88928 - RNA, 64 nt, hsa; identical to SEQ ID NO: 86429

SEQ ID NO: 88929 - RNA, 64 nt, hsa; identical to SEQ ID NO: 86430

SEQ ID NO: 88930 - RNA, 64 nt, hsa; identical to SEQ ID NO: 86431

SEQ ID NO: 88931 - RNA, 64 nt, hsa; identical to SEQ ID NO: 86432

SEQ ID NO: 88932 - RNA, 64 nt, hsa; identical to SEQ ID NO: 86433

SEQ ID NO: 88933 - RNA, 64 nt, hsa; identical to SEQ ID NO: 86434

SEQ ID NO: 88934 - RNA, 64 nt, hsa; identical to SEQ ID NO: 86435

SEQ ID NO: 88935 - RNA, 64 nt, hsa; identical to SEQ ID NO: 86436

SEQ ID NO: 88936 - RNA, 64 nt, hsa; identical to SEQ ID NO: 86437

SEQ ID NO: 88937 - RNA, 64 nt, hsa; identical to SEQ ID NO: 86438

SEQ ID NO: 88938 - RNA, 64 nt, hsa; identical to SEQ ID NO: 86439

SEQ ID NO: 88939 - RNA, 64 nt, hsa; identical to SEQ ID NO: 86440

SEQ ID NO: 88940 - RNA, 64 nt, hsa; identical to SEQ ID NO: 86441

SEQ ID NO: 88941 - RNA, 64 nt, hsa; identical to SEQ ID NO: 86442

SEQ ID NO: 88942 - RNA, 64 nt, hsa; identical to SEQ ID NO: 86443

SEQ ID NO: 88943 - RNA, 64 nt, hsa; identical to SEQ ID NO: 86444

SEQ ID NO: 88944 - RNA, 64 nt, hsa; identical to SEQ ID NO: 86445

SEQ ID NO: 88945 - RNA, 60 nt, hsa; identical to SEQ ID NO: 86446

SEQ ID NO: 88946 - RNA, 64 nt, hsa; identical to SEQ ID NO: 86447

SEQ ID NO: 88947 - RNA, 64 nt, hsa; identical to SEQ ID NO: 86448

SEQ ID NO: 88948 - RNA, 64 nt, hsa; identical to SEQ ID NO: 86449

SEQ ID NO: 88949 - RNA, 64 nt, hsa; identical to SEQ ID NO: 86450

SEQ ID NO: 88950 - RNA, 64 nt, hsa; identical to SEQ ID NO: 86451

SEQ ID NO: 88951 - RNA, 64 nt, hsa; identical to SEQ ID NO: 86452

SEQ ID NO: 88952 - RNA, 64 nt, hsa; identical to SEQ ID NO: 86453

SEQ ID NO: 88953 - RNA, 64 nt, hsa; identical to SEQ ID NO: 86454

SEQ ID NO: 88954 - RNA, 64 nt, hsa; identical to SEQ ID NO: 86455

SEQ ID NO: 88955 - RNA, 64 nt, hsa; identical to SEQ ID NO: 86456

SEQ ID NO: 88956 - RNA, 64 nt, hsa; identical to SEQ ID NO: 86457

SEQ ID NO: 88957 - RNA, 64 nt, hsa; identical to SEQ ID NO: 86458

SEQ ID NO: 88958 - RNA, 64 nt, hsa; identical to SEQ ID NO: 86459

SEQ ID NO: 88959 - RNA, 64 nt, hsa; identical to SEQ ID NO: 86460

SEQ ID NO: 88960 - RNA, 64 nt, hsa; identical to SEQ ID NO: 86461

SEQ ID NO: 88961 - RNA, 55 nt, hsa; identical to SEQ ID NO: 86462

SEQ ID NO: 88962 - RNA, 64 nt, hsa; identical to SEQ ID NO: 86463

SEQ ID NO: 88963 - RNA, 64 nt, hsa; identical to SEQ ID NO: 86464

SEQ ID NO: 88964 - RNA, 64 nt, hsa; identical to SEQ ID NO: 86465

SEQ ID NO: 88965 - RNA, 64 nt, hsa; identical to SEQ ID NO: 86466

SEQ ID NO: 88966 - RNA, 64 nt, hsa; identical to SEQ ID NO: 86467

SEQ ID NO: 88967 - RNA, 64 nt, hsa; identical to SEQ ID NO: 86468

SEQ ID NO: 88968 - RNA, 64 nt, hsa; identical to SEQ ID NO: 86469

SEQ ID NO: 88969 - RNA, 64 nt, hsa; identical to SEQ ID NO: 86470

SEQ ID NO: 88970 - RNA, 64 nt, hsa; identical to SEQ ID NO: 86471

SEQ ID NO: 88971 - RNA, 64 nt, hsa; identical to SEQ ID NO: 86472

SEQ ID NO: 88972 - RNA, 64 nt, hsa; identical to SEQ ID NO: 86473

SEQ ID NO: 88973 - RNA, 64 nt, hsa; identical to SEQ ID NO: 86474

SEQ ID NO: 88974 - RNA, 64 nt, hsa; identical to SEQ ID NO: 86475

SEQ ID NO: 88975 - RNA, 64 nt, hsa; identical to SEQ ID NO: 86476

SEQ ID NO: 88976 - RNA, 64 nt, hsa; identical to SEQ ID NO: 86477

SEQ ID NO: 88977 - RNA, 64 nt, hsa; identical to SEQ ID NO: 86478

SEQ ID NO: 88978 - RNA, 64 nt, hsa; identical to SEQ ID NO: 86479

SEQ ID NO: 88979 - RNA, 64 nt, hsa; identical to SEQ ID NO: 86480

SEQ ID NO: 88980 - RNA, 64 nt, hsa; identical to SEQ ID NO: 86481

SEQ ID NO: 88981 - RNA, 64 nt, hsa; identical to SEQ ID NO: 86482

SEQ ID NO: 88982 - RNA, 64 nt, hsa; identical to SEQ ID NO: 86483

SEQ ID NO: 88983 - RNA, 64 nt, hsa; identical to SEQ ID NO: 86484

SEQ ID NO: 88984 - RNA, 64 nt, hsa; identical to SEQ ID NO: 86485

SEQ ID NO: 88985 - RNA, 64 nt, hsa; identical to SEQ ID NO: 86486

SEQ ID NO: 88986 - RNA, 64 nt, hsa; identical to SEQ ID NO: 86487

SEQ ID NO: 88987 - RNA, 64 nt, hsa; identical to SEQ ID NO: 86488

SEQ ID NO: 88988 - RNA, 64 nt, hsa; identical to SEQ ID NO: 86489

SEQ ID NO: 88989 - RNA, 64 nt, hsa; identical to SEQ ID NO: 86490

SEQ ID NO: 88990 - RNA, 64 nt, hsa; identical to SEQ ID NO: 86491

SEQ ID NO: 88991 - RNA, 64 nt, hsa; identical to SEQ ID NO: 86492

SEQ ID NO: 88992 - RNA, 64 nt, hsa; identical to SEQ ID NO: 86493

SEQ ID NO: 88993 - RNA, 51 nt, hsa; identical to SEQ ID NO: 86494

SEQ ID NO: 88994 - RNA, 64 nt, hsa; identical to SEQ ID NO: 86495

SEQ ID NO: 88995 - RNA, 64 nt, hsa; identical to SEQ ID NO: 86496

SEQ ID NO: 88996 - RNA, 64 nt, hsa; identical to SEQ ID NO: 86497

SEQ ID NO: 88997 - RNA, 64 nt, hsa; identical to SEQ ID NO: 86498

SEQ ID NO: 88998 - RNA, 64 nt, hsa; identical to SEQ ID NO: 86499

SEQ ID NO: 88999 - RNA, 64 nt, hsa; identical to SEQ ID NO: 86500

SEQ ID NO: 89000 - RNA, 64 nt, hsa; identical to SEQ ID NO: 86501

SEQ ID NO: 89001 - RNA, 64 nt, hsa; identical to SEQ ID NO: 86502

SEQ ID NO: 89002 - RNA, 64 nt, hsa; identical to SEQ ID NO: 86503

SEQ ID NO: 89003 - RNA, 64 nt, hsa; identical to SEQ ID NO: 86504

SEQ ID NO: 89004 - RNA, 64 nt, hsa; identical to SEQ ID NO: 86505

SEQ ID NO: 89005 - RNA, 64 nt, hsa; identical to SEQ ID NO: 86506

SEQ ID NO: 89006 - RNA, 64 nt, hsa; identical to SEQ ID NO: 86507

SEQ ID NO: 89007 - RNA, 64 nt, hsa; identical to SEQ ID NO: 86508

SEQ ID NO: 89008 - RNA, 64 nt, hsa; identical to SEQ ID NO: 86509

SEQ ID NO: 89009 - RNA, 64 nt, hsa; identical to SEQ ID NO: 86510

SEQ ID NO: 89010 - RNA, 64 nt, hsa; identical to SEQ ID NO: 86511

SEQ ID NO: 89011 - RNA, 64 nt, hsa; identical to SEQ ID NO: 86512

SEQ ID NO: 89012 - RNA, 64 nt, hsa; identical to SEQ ID NO: 86513

SEQ ID NO: 89013 - RNA, 64 nt, hsa; identical to SEQ ID NO: 86514

SEQ ID NO: 89014 - RNA, 64 nt, hsa; identical to SEQ ID NO: 86515

SEQ ID NO: 89015 - RNA, 64 nt, hsa; identical to SEQ ID NO: 86516

SEQ ID NO: 89016 - RNA, 64 nt, hsa; identical to SEQ ID NO: 86517

SEQ ID NO: 89017 - RNA, 64 nt, hsa; identical to SEQ ID NO: 86518

SEQ ID NO: 89018 - RNA, 64 nt, hsa; identical to SEQ ID NO: 86519

SEQ ID NO: 89019 - RNA, 64 nt, hsa; identical to SEQ ID NO: 86520

SEQ ID NO: 89020 - RNA, 64 nt, hsa; identical to SEQ ID NO: 86521

SEQ ID NO: 89021 - RNA, 64 nt, hsa; identical to SEQ ID NO: 86522

SEQ ID NO: 89022 - RNA, 64 nt, hsa; identical to SEQ ID NO: 86523

SEQ ID NO: 89023 - RNA, 64 nt, hsa; identical to SEQ ID NO: 86524

SEQ ID NO: 89024 - RNA, 64 nt, hsa; identical to SEQ ID NO: 86525

SEQ ID NO: 89025 - RNA, 64 nt, hsa
guuuaagccuacaaucauugauuuuuuuuuguuaugucacaaucaguauaucuucuuugggguu

SEQ ID NO: 89026 - RNA, 64 nt, hsa
gaacgaaaguaaagauguuugaauacuuaaacacugucacaagauggcaaaaugcugaaaguuu

SEQ ID NO: 89027 - RNA, 64 nt, hsa
uagcccaagccugucuuucccagcgucauguuugugucacaaaagcaguuauuuuaaaaucuga

SEQ ID NO: 89028 - RNA, 64 nt, hsa
acuaccccuaaccugccaggaugcucaaguccacugucacaaucccuuucagaaaacauuagug

SEQ ID NO: 89029 - RNA, 64 nt, hsa
uucuuaaacaugcugucccaacauuugugaguugugucacaagugagucauuaucaaugguaga

SEQ ID NO: 89030 - RNA, 64 nt, hsa
uauuuuuagaaggaggaaaaguagauacgcaaauugucacaacuaagagugauaauuugguagc

SEQ ID NO: 89031 - RNA, 64 nt, hsa
accuacuaaacagaaaaugccuccaaauaaacagugucacaaguacagaagagagaaauauugu

SEQ ID NO: 89032 - RNA, 64 nt, hsa
uagguaaugugagcaaagauguggaagccaaaauugucacaauuccucaaucugaaacaaugag

SEQ ID NO: 89033 - RNA, 64 nt, hsa
aaagacacugguguaucucagaaggggaugguguugucacaaacugugguuaauccaaucaauu

SEQ ID NO: 89034 - RNA, 64 nt, hsa
caaccaguaggauauuucuacaagguguucauuuugucacaagcuguagauaacagcaagagau

SEQ ID NO: 89035 - RNA, 64 nt, hsa
acauaagaaccauggccuuggauuauucacugccugucacaagccucaguguggccugagaaau

SEQ ID NO: 89036 - RNA, 64 nt, hsa
cccaaauuauaaaugugacaaucucauuggaacaugucacaaaaaguuaaugugauuaagauuu

SEQ ID NO: 89037 - RNA, 64 nt, hsa
ucaugguguagggaaacuugacuaauguaaugauugucacaaagucuucaguaacgcuacaacg

SEQ ID NO: 89038 - RNA, 64 nt, hsa
ugcaaaacauaggagaauucaugcaggagagaaaugucacaagugugaugaguguugcaaagcc

SEQ ID NO: 89039 - RNA, 64 nt, hsa
cacacacacccucaugugugaagggcagagacacugucacaaacaggcaugccccuuagaagac

SEQ ID NO: 89040 - RNA, 64 nt, hsa
cgcuuaagacaccucugcaugcagucaaagccacugucacaagccggcaggcacuggugaggag

SEQ ID NO: 89041 - RNA, 64 nt, hsa
uuuccuaauuuuauuuauuucauacuguaguguacaguauuauaguucuucaauauauagauau

SEQ ID NO: 89042 - RNA, 64 nt, hsa
uuauuuucuguacuuuuuuguucauuaauuuugucaguauuacaccaaacuguuuuugcaacaa

SEQ ID NO: 89043 - RNA, 64 nt, hsa
guuaagcucacccuguucuuugaagcacccaugucaguauuagaagaauaggcagcaguuccuu

SEQ ID NO: 89044 - RNA, 64 nt, hsa
cuuuuuaauuuaaugugcucgcacuacaaugcaucaguauuaugauuccucuguacuuuccuuu

SEQ ID NO: 89045 - RNA, 64 nt, hsa
gcuugaggcucagaagagccucuguccagccccucaguauuaccaugucucccucucaggggua

SEQ ID NO: 89046 - RNA, 64 nt, hsa
ccaggguccuucccugccccacuuccccuuuucccaguauuacugaauagucccagcuggagag

SEQ ID NO: 89047 - RNA, 64 nt, hsa
uuaucuuacugguucaacauuuuucugauauaugcaguauuacagauauucagcaaaaguauua

SEQ ID NO: 89048 - RNA, 64 nt, hsa
uaccuguaucaaaggaauuuuaacaaagagcaaucaguauuauuggaccaaauuugguguuugu

SEQ ID NO: 89049 - RNA, 64 nt, hsa
uuacccucuguaagauacugauucuuccuggggccaguauuaccuuguaugcaaauauuacaua

SEQ ID NO: 89050 - RNA, 64 nt, hsa
auacagauguacuagcuaaagucucuuuaugugucaguauuaagaguaauauguagccagauua

SEQ ID NO: 89051 - RNA, 64 nt, hsa
caauucuguaaguggugacuuuuugagcaccuuucaguauuauguauuuguaaaaaccauuguu

SEQ ID NO: 89052 - RNA, 64 nt, hsa
acuuguuaggaaguagcuuaauuaccccccauugcaguauuauuguuauauauauaguuaauau

SEQ ID NO: 89053 - RNA, 64 nt, hsa
aaaggaaaucgccuagcuccaggcuguguuaggacaguauuagcaugaaggcugugcgaccauc

SEQ ID NO: 89054 - RNA, 64 nt, hsa
ucauucguaccaugccaaacgcauucacucggggcaguauuaaccguucuagaaagccacuguu

SEQ ID NO: 89055 - RNA, 64 nt, hsa
gacuugccaaacagucuuuuaugaaggaaaguuacaguauuaauuuuugaaaagguuuuuuuua

SEQ ID NO: 89056 - RNA, 64 nt, hsa
gacccuacaacugcccugggacauuucacuguaccaguauuaacugcaaacagcaauaauuguc

SEQ ID NO: 89057 - RNA, 64 nt, hsa
acccuuaugagaagugaagguuuuguaaacuuuccaguauuaauuugggcggguauuccccgcu

SEQ ID NO: 89058 - RNA, 64 nt, hsa
ugauauuaagaucaaagggaggaagggaagacagcaguauuaauucacccuagauuacucaauu

SEQ ID NO: 89059 - RNA, 64 nt, hsa
cauaauuaaacuauuucugcuauuauuuuuaaagcaguauuauuuuauaaccaauucuaaaauu

SEQ ID NO: 89060 - RNA, 64 nt, hsa
cauacacuucuuaaaaugugaaaaucuauguuuucaguauuaugacaguaucugcagauacuau

SEQ ID NO: 89061 - RNA, 64 nt, hsa
gauucacuuuguguguguuagugcucuaaaguagcaguauuauuauuaaacuguccccagagua

SEQ ID NO: 89062 - RNA, 64 nt, hsa
ucaugaacuuugagaaugggcuuccuuuuugguucaguauuagugagagggagagggagaugga

SEQ ID NO: 89063 - RNA, 64 nt, hsa
ucauuuaaucuuuacuacacuccugcaacauagacaguauuauuacauucaguauuacaauggc

SEQ ID NO: 89064 - RNA, 64 nt, hsa
uacacuccugcaacauagacaguauuauuacauucaguauuacaauggcagaaacagacagaaa

SEQ ID NO: 89065 - RNA, 64 nt, hsa
uacaauauuuauaacuauaaacuuuauagaaguacaguauuaaagucagugguacacagacauu

SEQ ID NO: 89066 - RNA, 64 nt, hsa
guucuaaucauuucagcaguagcgucuuaaacagcaguauuacuauaagcaguugcuucaaaau

SEQ ID NO: 89067 - RNA, 64 nt, hsa
cuucucugucucaugugugcucuucuucuuucuacaguauuauguacucuacugauaucuaaau

SEQ ID NO: 89068 - RNA, 64 nt, hsa
acauuuugccaaaauuauuaauauaagaagcuuucaguauuagugaugucaucugucacuauag

SEQ ID NO: 89069 - RNA, 64 nt, hsa
acaguaucuuacaaaaaacguguugcucucuucacaguauuauguguaaagucauuguuuaaag

SEQ ID NO: 89070 - RNA, 64 nt, hsa
ccauguuagcucaugguguaagaugaugucuugucaguauuacuguuuugcuaagccgcuucau

SEQ ID NO: 89071 - RNA, 64 nt, hsa
agggccaggaguggcguuuccgcacaggauuuccuaagacgagagggauuuagccaagagcaca

SEQ ID NO: 89072 - RNA, 64 nt, hsa
cuugcaacucuuaguguuuauuuuuauaucucaguaagacgaggauaccuucaguuugaaucug

SEQ ID NO: 89073 - RNA, 64 nt, hsa
uuuuggaauaacuuggaaguaagguucauucccuuaagacgauggauucuguugaacuaugggg

SEQ ID NO: 89074 - RNA, 64 nt, hsa
cuugaacacuaccucuugugaagucuacuguagauaagacgauugucauuuccacuuggaaagu

SEQ ID NO: 89075 - RNA, 64 nt, hsa
auggacugggaaguucuuuuaaaucauuaaauauuaagacgaccaucucuucuauuaaauuaca

SEQ ID NO: 89076 - RNA, 64 nt, hsa
gcauuauuacauuuugugaaugguguucagccuauaagacgaagucucacaagaccuauaggaa

SEQ ID NO: 89077 - RNA, 64 nt, hsa
ggagaacuauccaaaacuaauuuccucugacauguaagacgaaugauuuagguacgucaaagca

SEQ ID NO: 89078 - RNA, 64 nt, hsa
aucauuccccccgugaagucugcuuaccaaaacauaagacgacuuauauauuugaaagaaguca

SEQ ID NO: 89079 - RNA, 64 nt, hsa
uuguuuugaacagaacuguuuuuuccccuuccuguaagacgaugugacugcacaagagcacugc

SEQ ID NO: 89080 - RNA, 64 nt, hsa
guuauguaaaguuucucgguguguucuguuaauguaagacgaugaacaguuguguauaguguuu

SEQ ID NO: 89081 - RNA, 64 nt, hsa
agcaugaagcauaucugggaauaucuuuugccuuuaagacgauucauucuugucuagagggaaa

SEQ ID NO: 89082 - RNA, 64 nt, hsa
auauccucauauuuuuaccauauuuuaagaacuuuaagacgauuaauuguaaauaauuuauuug

SEQ ID NO: 89083 - RNA, 64 nt, hsa
ugcaaagucuugccagagauauacaaaacugauguaagacgaacuuggaucacggcuugguuca

SEQ ID NO: 89084 - RNA, 64 nt, hsa
uaugaucuuuuaaguuucuauacauguauucuuauaagacgacccaggaucuacuauauuagaa

SEQ ID NO: 89085 - RNA, 64 nt, hsa
agacagguuguuuuugcaauuaaauuuauuuuaauaagacgaucaugaauaaaacuuuaaauug

SEQ ID NO: 89086 - RNA, 64 nt, hsa
uuaaucuuuaauuuuacauuuccuaaauauauuuuaagacgaaacauuuguucuauagcuuuuc

SEQ ID NO: 89087 - RNA, 64 nt, hsa
ucuguaacaaucucaaggcauuugugucaucaccuaagacgauuggcgaaaacuuuucugaaaa

SEQ ID NO: 89088 - RNA, 64 nt, hsa
gucuacugucuggcuucuuuugcauuuuuaaaaauaagacgauuuaauuuuaauuucauaggau

SEQ ID NO: 89089 - RNA, 64 nt, hsa
aacaguggggugauuucauuugccauaauucacauaagacgaauuuuaaucuaaaaguacuuuc

SEQ ID NO: 89090 - RNA, 64 nt, hsa
acauauauauaauauauaugaagacuguaaauguuaagacgacuaguguucuuauuaguauauu

SEQ ID NO: 89091 - RNA, 64 nt, hsa
ugucaaaaaguuugguucugugucuguguuuuaauaagacgagaggacgagcgauugaggugua

SEQ ID NO: 89092 - RNA, 64 nt, hsa
ccucuccuacucucuguggcaguuucauauuugcuaagacgaauuugcucauuaaacauuuugu

SEQ ID NO: 89093 - RNA, 64 nt, hsa
aggaguuuuauauuaagggagacauuuuagucaguaagacgauauaaccuacuuacuccguaag

SEQ ID NO: 89094 - RNA, 64 nt, hsa
aauuuuuccaauagauuucauucuugucauuuuguaagacgacccugcaguccaccuguuugua

SEQ ID NO: 89095 - RNA, 64 nt, hsa
gggccuggaagaccaucccagccucugaguucucuuugaguaugagugauuacuuggauuuuag

SEQ ID NO: 89096 - RNA, 64 nt, hsa
cccucuccccauugccccacaaccuuacucuaaauuugaguagagaaaagcuccuaaagugacc

SEQ ID NO: 89097 - RNA, 64 nt, hsa
guuuuguugaaggaucaaccccaaauucuggguauuugaguacaugugaaucauggauuuggua

SEQ ID NO: 89098 - RNA, 64 nt, hsa
guugucugaaaggugugguuuuauugaaugucuauuugaguaucauuuaaaaaguauuugccuu

SEQ ID NO: 89099 - RNA, 64 nt, hsa
ugucaggaaauaaggucacuuuaugucaaaauuauuugaguacuaugggaccuggcgcaguggc

SEQ ID NO: 89100 - RNA, 64 nt, hsa
acaacaacaacaacaacaacaaaccacaaaauuauuugaguacugugaaggauuauuugucuaa

SEQ ID NO: 89101 - RNA, 64 nt, hsa
gacugcgugaucgugcacuuugugugguaagagguuugaguaguccuauaugucaccuagggaa

SEQ ID NO: 89102 - RNA, 64 nt, hsa
uggugucuugccccauucuuguguuuauaaaauguuugaguauuucugaugagugaugcuugcc

SEQ ID NO: 89103 - RNA, 64 nt, hsa
uguuuguggggagagggaaggaggaagucaguuauuugaguaagccucuaguugacuuuucucu

SEQ ID NO: 89104 - RNA, 64 nt, hsa
aacuuaaaaggacaugcccacugaauucagguccuuugaguaaaaaaaaaaucuucugcugcac

SEQ ID NO: 89105 - RNA, 64 nt, hsa
ugcauaagaaagagaaaagagaugccuuuuguguuuugaguaagaauaauuaaaccauaaggaa

SEQ ID NO: 89106 - RNA, 64 nt, hsa
auuuagguaagcaggcuuccuuugcucugaagguuuugaguaccuggcuguauuuguugaguau

SEQ ID NO: 89107 - RNA, 64 nt, hsa
ggugugcgccaccaugcccgacuaauuuuuguauuuugaguagagaugggaguuucaccauguu

SEQ ID NO: 89108 - RNA, 64 nt, hsa
gacaaaguaaagguggaaacuaggugauguggccuuugaguaugcagauuccuuguaucacuug

SEQ ID NO: 89109 - RNA, 64 nt, hsa
uauaagcuguaauaguggagguauuguggguucauuugaguaagcccuccaaagauaccauuca

SEQ ID NO: 89110 - RNA, 64 nt, hsa
uuaugauuugaaaguuggaaguuuguaccaucuguuugaguauaugcacauuuaaaaaauauca

SEQ ID NO: 89111 - RNA, 64 nt, hsa
gggugcuggggggacggggugaguggaaacuuaguuugaguaaugaaggaaucuucacagaagc

SEQ ID NO: 89112 - RNA, 64 nt, hsa
cuccccuuguaagggaauucuggggcagcuaugguuugaguaugcaguuugcaucguguuucua

SEQ ID NO: 89113 - RNA, 64 nt, hsa
ggauuacaggcaugagccaccgugccuggccucauuugaguauuuuuauaaugucucuuuuaaa

SEQ ID NO: 89114 - RNA, 64 nt, hsa
agugcugggauuacaggccacuacaccuggcacauuugaguauuuuuuuuuuuuuuuuuuuuuu

SEQ ID NO: 89115 - RNA, 64 nt, hsa
acuguccuacccuuuuuuauucucaaauguuuguuuugaguaaccguagugccaaaauuucagu

SEQ ID NO: 89116 - RNA, 64 nt, hsa
uguccuuuuuaugaguguuuauauuuuaaaguacuuugaguauuuuugggggggguguaaauga

SEQ ID NO: 89117 - RNA, 63 nt, hsa
cccgccucuuccccuuucugucccgggauaccuggcggcaagagacuucuuggcuauugucca

SEQ ID NO: 89118 - RNA, 63 nt, hsa
guuaucuccucucauacaucaagccccagaggaggcggcaagaggaacagccacaaacaagua

SEQ ID NO: 89119 - RNA, 63 nt, hsa
aggauguaacauaaugaaacacaccugucuaggggcggcaaucaacagucuuacacagagagg

SEQ ID NO: 89120 - RNA, 63 nt, hsa
augcggaaggauugcaaugcccgccagcacaguggcggcaacauugaagacguggacggagga

SEQ ID NO: 89121 - RNA, 63 nt, hsa
ugauaugucugcaugcaaaguggaacagaguugggcggcaaugacagaagagcuuccuuggcc

SEQ ID NO: 89122 - RNA, 63 nt, hsa
uuccagaaacuuuauauggguagaggaagccagggcggcaaaugcgagaccaaauaucauuuu

SEQ ID NO: 89123 - RNA, 63 nt, hsa
uauccacccccagcccaaccgagggcggcccuuggcggcaacaugcaagaaggagggacuguc

SEQ ID NO: 89124 - RNA, 63 nt, hsa
augggguggagggggccaccggggcagggagggggcggcaaggggggaaugggaguugucucc

SEQ ID NO: 89125 - RNA, 63 nt, hsa
cucuagagggcuggugauugaggggcccgggcuggcggcaaagagggguuuggucucggggcu

SEQ ID NO: 89126 - RNA, 53 nt, hsa
agcuccaagacucaaaguagcccggcggcaagaggcccauguuccggagagaa

SEQ ID NO: 89127 - RNA, 63 nt, hsa
gaagcccugacaacaacuaucaccaaaagacgaggcggcaaagauccagcggggcuucugggc

SEQ ID NO: 89128 - RNA, 63 nt, hsa
gggggcuggagaaggccuggauaaagacagaagggcggcaacacaccaccccagcccccaccc

SEQ ID NO: 89129 - RNA, 63 nt, hsa
ccuccccgggagccucagaguuugcuucuggcuggcggcaagggaaagggacgauggagaagg

SEQ ID NO: 89130 - RNA, 63 nt, hsa
agcggggaugauguuaaguguggccaagcgcacggcggcaaguuuucaagcacugaguuucua

SEQ ID NO: 89131 - RNA, 63 nt, hsa
gccuggaugugggccaaguccacuguccuccuuggcggcaaaagcccauugaagaagaaccag

SEQ ID NO: 89132 - RNA, 63 nt, hsa
acagagccccucuaggagaagccacgggaucccggcggcaaggagaacagaacacugaagacu

SEQ ID NO: 89133 - RNA, 63 nt, hsa
acgugcagguggagcucugggaugcuauguuggggcggcaagcggugggccgagggccgggua

SEQ ID NO: 89134 - RNA, 63 nt, hsa
gggcguggaccacccgcccuggcaguugaauggggcggcaauugcggggcccaccuuagaccg

SEQ ID NO: 89135 - RNA, 63 nt, hsa
augaaggagagauacuuaggaaauccuaaaagaggcggcaagaagguaccucccuguguaacu

SEQ ID NO: 89136 - RNA, 63 nt, hsa
ccucgugcucacggauuuuauuacacagauaguggcggcaauggccucagcccagcccacccu

SEQ ID NO: 89137 - RNA, 63 nt, hsa
gcgauucuaguuaauaaaaaggggggagaugugggcggcaagccacccaggcaccgaggcaag

SEQ ID NO: 89138 - RNA, 63 nt, hsa
ucuccgagagacuuuccauuuccuuggaguuauggcggcaaguaaguaucauaguauuaagaa

SEQ ID NO: 89139 - RNA, 63 nt, hsa
uuccaugacccuuugccuguuccgcauccuggaggcggcaaagggugaaauccgcauugaugg

SEQ ID NO: 89140 - RNA, 63 nt, hsa
ucugucuggauugaguccuacagugucagauagggcggcaaaugccaaagcagggaaacaggg

SEQ ID NO: 89141 - RNA, 63 nt, hsa
gucccggccucacucagcucacagggcgugccaggcggcaacaccagaaucuuccagaagccc

SEQ ID NO: 89142 - RNA, 63 nt, hsa
cugaccaaugaugggcggugacccgguaaccgaggcggcaaggaggccagguagucccggcac

SEQ ID NO: 89143 - RNA, 63 nt, hsa
gccuggaggggcagggcuggggcaacccggcuuggcggcaaagcccagccccuucucagacca

SEQ ID NO: 89144 - RNA, 63 nt, hsa
ccaaacuugugaacucgugacaaucacaaacuuggcggcaaaguggcgacucaaccuuggggg

SEQ ID NO: 89145 - RNA, 63 nt, hsa
ggcuggacauggccaagacacaaggcauuccacggcggcaagcugaccgcacagcagucuggc

SEQ ID NO: 89146 - RNA, 63 nt, hsa
cauccacuauuaaugcacuaggugggaggagagggcggcaaugacacugcaccucuccuuucc

SEQ ID NO: 89147 - RNA, 63 nt, hsa
gagagcgcacccuacucuuuccgugacgaugagggcggcaaaaacagacauuucuuccuucau

SEQ ID NO: 89148 - RNA, 64 nt, hsa; identical to SEQ ID NO: 85128

SEQ ID NO: 89149 - RNA, 64 nt, hsa; identical to SEQ ID NO: 85129

SEQ ID NO: 89150 - RNA, 64 nt, hsa; identical to SEQ ID NO: 85130

SEQ ID NO: 89151 - RNA, 58 nt, hsa; identical to SEQ ID NO: 85131

SEQ ID NO: 89152 - RNA, 64 nt, hsa; identical to SEQ ID NO: 85132

SEQ ID NO: 89153 - RNA, 64 nt, hsa; identical to SEQ ID NO: 85133

SEQ ID NO: 89154 - RNA, 64 nt, hsa; identical to SEQ ID NO: 85134

SEQ ID NO: 89155 - RNA, 64 nt, hsa; identical to SEQ ID NO: 85135

SEQ ID NO: 89156 - RNA, 64 nt, hsa; identical to SEQ ID NO: 85136

SEQ ID NO: 89157 - RNA, 64 nt, hsa; identical to SEQ ID NO: 85137

SEQ ID NO: 89158 - RNA, 64 nt, hsa; identical to SEQ ID NO: 85138

SEQ ID NO: 89159 - RNA, 64 nt, hsa; identical to SEQ ID NO: 85139

SEQ ID NO: 89160 - RNA, 64 nt, hsa; identical to SEQ ID NO: 85140

SEQ ID NO: 89161 - RNA, 64 nt, hsa; identical to SEQ ID NO: 85141

SEQ ID NO: 89162 - RNA, 64 nt, hsa; identical to SEQ ID NO: 85142

SEQ ID NO: 89163 - RNA, 64 nt, hsa; identical to SEQ ID NO: 85141

SEQ ID NO: 89164 - RNA, 64 nt, hsa; identical to SEQ ID NO: 85144

SEQ ID NO: 89165 - RNA, 64 nt, hsa; identical to SEQ ID NO: 85145

SEQ ID NO: 89166 - RNA, 64 nt, hsa; identical to SEQ ID NO: 85146

SEQ ID NO: 89167 - RNA, 64 nt, hsa; identical to SEQ ID NO: 85147

SEQ ID NO: 89168 - RNA, 64 nt, hsa; identical to SEQ ID NO: 85148

SEQ ID NO: 89169 - RNA, 64 nt, hsa; identical to SEQ ID NO: 85149

SEQ ID NO: 89170 - RNA, 64 nt, hsa; identical to SEQ ID NO: 85150

SEQ ID NO: 89171 - RNA, 64 nt, hsa; identical to SEQ ID NO: 85151

SEQ ID NO: 89172 - RNA, 64 nt, hsa; identical to SEQ ID NO: 85152

SEQ ID NO: 89173 - RNA, 64 nt, hsa; identical to SEQ ID NO: 85153

SEQ ID NO: 89174 - RNA, 64 nt, hsa; identical to SEQ ID NO: 85154

SEQ ID NO: 89175 - RNA, 64 nt, hsa; identical to SEQ ID NO: 85155

SEQ ID NO: 89176 - RNA, 64 nt, hsa
agauaaauaccuuucaagugugagcuuagacgucaacccuaaaauacuuaaccguaaugcuaau

SEQ ID NO: 89177 - RNA, 64 nt, hsa
uuuucugcaguuauuucucuuguucuggccaaacaacccuaaaaauccuuaccauuccacaaag

SEQ ID NO: 89178 - RNA, 64 nt, hsa
agaauucucuguacuuuuugcucaauuuuucuguaacccuaaagcugcucuaaaaaaugaagug

SEQ ID NO: 89179 - RNA, 64 nt, hsa
gaauuagacaucaagucauuaaaagacauauaggaacccuaaaugcuuauuguuaagugaaaac

SEQ ID NO: 89180 - RNA, 64 nt, hsa
uaaaaaaaauugauuuccauauuuuauuuuucaaaacccuaaaauauuacaaaauaagucccgc

SEQ ID NO: 89181 - RNA, 64 nt, hsa
gacaaggaaggaaaagaaagaagagaaggggagaaacccuaaaaagagaagaaucuuaaugaac

SEQ ID NO: 89182 - RNA, 64 nt, hsa
agagaaguggacuccaaaccucauuuuaguuguagaagaaaauuucuuacaaaacaaauuccac

SEQ ID NO: 89183 - RNA, 64 nt, hsa
cucuggagaauuucucccacuccccaccucugcagaagaaaauuuugcucuuauaaaaccucau

SEQ ID NO: 89184 - RNA, 64 nt, hsa
uaccccaugaaauguaaauacuguaucauaaguagaagaaaauaauuuuuguuuucuaaaaaug

SEQ ID NO: 89185 - RNA, 64 nt, hsa
ccuuuuuacugaaaguaagugacuuaaaaggauggaagaaaaacuacaugguuggaguguuuuu

SEQ ID NO: 89186 - RNA, 64 nt, hsa
aaauuacagugugaacaagagaaaaacaggaauagaagaaaaaaguugcagguugaauuaucua

SEQ ID NO: 89187 - RNA, 61 nt, hsa
aaaggggcaucugcuuauaagaagugagagagaagaaaaaucaugucccaaguucugagaa

SEQ ID NO: 89188 - RNA, 64 nt, hsa
ggauuuguuuuuuacaucuccuuuuuccuuccuugaagaaaaauucuuggcugucccaaggauu

SEQ ID NO: 89189 - RNA, 64 nt, hsa
agauugggggaguggggagggggaagaagaacaggaagaaaaaaaguacucugaacugcuccaa

SEQ ID NO: 89190 - RNA, 64 nt, hsa
ggauugaacucacagauggauaccaacacggucagaagaaaaacggacagaacgguucuuguau

SEQ ID NO: 89191 - RNA, 64 nt, hsa
ggacuucaacgccagugacuguguaccuccagcagaagaaaaucaggugucuggucuugggggc

SEQ ID NO: 89192 - RNA, 64 nt, hsa
cuggucuugggggcacugugcucacuucuagagagaagaaaaaggcuggguuuggacuucaugc

SEQ ID NO: 89193 - RNA, 64 nt, hsa
uguccugccaggcucuguacuguccuuuguguaugaagaaaaugcuguuagcccucucucaggc

SEQ ID NO: 89194 - RNA, 64 nt, hsa
caugggcuugcugacuuagccaaagaagaguuaagaagaaaauacacacaaguauacagacugu

SEQ ID NO: 89195 - RNA, 64 nt, hsa
acauguaaaacaagaaaaguugaagaagauaugugaagaaaaauguauuuuuccuaaauagaaa

SEQ ID NO: 89196 - RNA, 64 nt, hsa
aaaguccauauggacuguggauaccuaucuaaaagaagaaaacugauggcuaaguuugcaugaa

SEQ ID NO: 89197 - RNA, 64 nt, hsa
auagaaaucaugaauguggucugcagacauugaugaagaaaaucuguugguaauugauacaugg

SEQ ID NO: 89198 - RNA, 64 nt, hsa
ggccuugcucuuguggagcuuagagguugguggggaagaaaauaggcaugcaccaaggaauugu

SEQ ID NO: 89199 - RNA, 64 nt, hsa
aauagccugcucaguagagggucaugcagacaaggaagaaaacuuaggggcugcucugacggug

SEQ ID NO: 89200 - RNA, 64 nt, hsa
ucaggauuauuuaacuuaccuguauaucaaaagugaagaaaaaguuaguucauaaguaaaggca

SEQ ID NO: 89201 - RNA, 64 nt, hsa
uguuccuucacugccacagaaucagaaagagcuagaagaaaaggcucaccuggccacuguuuag

SEQ ID NO: 89202 - RNA, 64 nt, hsa
ccuuuguuuuuacuagugucugcuguugcaaaaagaagaaaacauucuuugccugaguuuuaau

SEQ ID NO: 89203 - RNA, 64 nt, hsa
aggggaagaagaucaaagaagaaaagaagaaggggaagaaaagaaggggaagaagaucaaaacc

SEQ ID NO: 89204 - RNA, 64 nt, hsa
ggaaggggaagaaaagaaggggaagaagaucaaagaagaaaagaagaaggggaagaaaagaagg

SEQ ID NO: 89205 - RNA, 64 nt, hsa
aauuuauugcagaaauugaaaagaaggggaaggggaagaaaagaaggggaagaagaucaaagaa

SEQ ID NO: 89206 - RNA, 64 nt, hsa
auauuaccgugguuuaugaacuauguucagaauugaagaaaauccuaacuuucaguuagagguu

SEQ ID NO: 89207 - RNA, 64 nt, hsa
gguauucuggugaugggguuuagcaacuuugauggaagaaaauauuaggcuauaaauguccuaa

SEQ ID NO: 89208 - RNA, 64 nt, hsa
gagcaugcagugauggaagaagcaggaaaagcaagaagaaaagacagcagcaucaagaggagga

SEQ ID NO: 89209 - RNA, 64 nt, hsa
gcagagagcaaaccaaucagucccucaggaaagggaagaaaaagaagagguggcaccaugaaga

SEQ ID NO: 89210 - RNA, 64 nt, hsa
aacaugcugagcagaacaucagaaaaagcaagaagaagaaaaggcgacaucaagaaggaaaggu

SEQ ID NO: 89211 - RNA, 64 nt, hsa
ggaggaagaaagggagagagaagaaaagaaaaaugaagaaaaguaauuagaauauuuucaacau

SEQ ID NO: 89212 - RNA, 64 nt, hsa
auaaaaagaagagagggaggaagaaagggagagagaagaaaagaaaaaugaagaaaaguaauua

SEQ ID NO: 89213 - RNA, 64 nt, hsa
guucccaaguggugaggugagauuguggcuggaggaagaaaaaggauggcaugaaagaaugacc

SEQ ID NO: 89214 - RNA, 64 nt, hsa
uguuccuucuuuuuaccuuuuuaaaaaucuguuagaagaaaaaaagcagcagacgaaagagaaa

SEQ ID NO: 89215 - RNA, 64 nt, hsa
gauuggaggccauggccuauguacaaacauacuggaagaaaaccagcuuguuuuuaaaacuuaa

SEQ ID NO: 89216 - RNA, 64 nt, hsa
caggacuguaaagauuuguugacagcaaaauguugaagaaaaaagcuuauagaauaaaagcuau

SEQ ID NO: 89217 - RNA, 64 nt, hsa
caagcugacuuggcacuuaagugcacuuuuuuaugaagaaaaaguacaaugaacugcuuuuccu

SEQ ID NO: 89218 - RNA, 64 nt, hsa
gaaagcucuccuaauacuuacuuaaauagccauggaagaaaauuaugcuugucccuucugacug

SEQ ID NO: 89219 - RNA, 64 nt, hsa
guacagaaaagcuuuuuguguguuuaaaaaaauugaagaaaauucaggaagaaacguguuaaua

SEQ ID NO: 89220 - RNA, 64 nt, hsa
ucgauugccaaagagcaucuaccuuaccuccuaagaagaaaagccacuuucuuccaauccaagc

SEQ ID NO: 89221 - RNA, 64 nt, hsa
ucacuuuuucuuuuuuacggaauucaucaucagagaagaaaauaacaaaaauggaagcaaacaa

SEQ ID NO: 89222 - RNA, 64 nt, hsa
uucacgcugcugauaaagacauacccgagacugggaagaaaaagugguuuaauuggacuuaaag

SEQ ID NO: 89223 - RNA, 64 nt, hsa
uuaaugcugcugauaaagacguacccgagacugggaagaaaaagagguuuacuuggacuuacag

SEQ ID NO: 89224 - RNA, 64 nt, hsa
agaggcugacaauaagguuugacagaggggaacagaagaaaauaauaugauuuauuagcacaac

SEQ ID NO: 89225 - RNA, 64 nt, hsa
ugucucuaaaggguuaaauguaucaauuggaaaggaagaaaaaaggccuugaauugacaaauua

SEQ ID NO: 89226 - RNA, 64 nt, hsa
acucagcccuguugcaaugcuuagggcccuuaaagaagaaaaucuccccagaaggcauccauca

SEQ ID NO: 89227 - RNA, 64 nt, hsa
uauuuuuucuauaaguuuuauugcaagagguaaagaagaaaacuauauauauauaucuuauuua

SEQ ID NO: 89228 - RNA, 64 nt, hsa
aaaaggagcagagagcuguccaucuggauugauggaagaaaagagaaccucauccaugccugga

SEQ ID NO: 89229 - RNA, 64 nt, hsa
ugcaaggauuagccaaaucuucuuauugaagaaagaagaaaagugaagagugguuaccuauacc

SEQ ID NO: 89230 - RNA, 64 nt, hsa
caaaaaaaaaaaaaaaaaagaaagaaauagcauugaagaaaauaccgcacaucagaggaaagcu

SEQ ID NO: 89231 - RNA, 64 nt, hsa
cucccugcugauuuguuucuaaaucaaaagaaaugaagaaaaaaguacugugaccugagagaca

SEQ ID NO: 89232 - RNA, 64 nt, hsa
cuucaaugacaugaaaacugugcaagcaaaaaccgaagaaaaacacuuaaguacaacuguagug

SEQ ID NO: 89233 - RNA, 64 nt, hsa
uccucuagaauguguaucuuuuuaugauuuagaugaagaaaauuuuacaacuuuuaacacccca

SEQ ID NO: 89234 - RNA, 64 nt, hsa
gugagaguaacaauaaagaaaaaaaaauacaaaggaagaaaagaaagaaaaacaaguguucagg

SEQ ID NO: 89235 - RNA, 64 nt, hsa
uauuucccaauuacaggaaauuagaucgacuggagaagaaaaaaaagaaaaaagauagaaaaaa

SEQ ID NO: 89236 - RNA, 64 nt, hsa
gcauggauuuugguaguugaaauauaagaguggagaagaaaagucagaugguuuguggcaggug

SEQ ID NO: 89237 - RNA, 64 nt, hsa
cucaaucucagcgugugaccaauggcuucauuuugaagaaaagccacagaagauacacuuccgc

SEQ ID NO: 89238 - RNA, 64 nt, hsa
aaaauuauuuucucaauuuuacugaguaggcacagaagaaaaguacagauaggcugaugguuau

SEQ ID NO: 89239 - RNA, 64 nt, hsa
cucuuugcaaaauguauauuacuaacauaguuuggaagaaaaauugaguagugguaaguuuugu

SEQ ID NO: 89240 - RNA, 64 nt, hsa
agugcuuuguuuccgugcacuuaaaaauaauugagaagaaaaacucaauuaaaauuuuguuuau

SEQ ID NO: 89241 - RNA, 64 nt, hsa
aaaaccaugacgcaaagagagauuuuuuuuuaaagaagaaaaaaaaaaauucacacugccagcg

SEQ ID NO: 89242 - RNA, 64 nt, hsa
uaccuuaucuuugucacaggguguucuuuuuuaugaagaaaaauuugaaaaugauaaaagcuaa

SEQ ID NO: 89243 - RNA, 64 nt, hsa
augauuuguacaugccauugaaaauuauuaaucagaagaaaauuaagcagggucuuugcuauac

SEQ ID NO: 89244 - RNA, 64 nt, hsa
ggcacagaaguuuaagacuaugaguuuuuagggugaagaaaaaacuguacaguuuaaaugaaaa

SEQ ID NO: 89245 - RNA, 64 nt, hsa
uguacaguuuaaaugaaaauguuuuucuucauuugaagaaaauuuguugauaaaccauggcaac

SEQ ID NO: 89246 - RNA, 64 nt, hsa
uuuucuacacauuuguauacaaaaucggauacaggaagaaaagggagaggugagcuaacauuug

SEQ ID NO: 89247 - RNA, 64 nt, hsa
cauaguguggauaggacuagucucauuucucugagaagaaaacuaaggcgcggaaauuugucua

SEQ ID NO: 89248 - RNA, 64 nt, hsa
auaaaaaagaaagaaaacaaaacucgcccuacaggaagaaaaggauucuccucuguauauaauu

SEQ ID NO: 89249 - RNA, 64 nt, hsa
ggugauaagcacaaaucucuacuccucaugacaugaagaaaaagacugaaugugaagggaguuu

SEQ ID NO: 89250 - RNA, 64 nt, hsa
cuggauuuuuuuuuuuaaaaaaaagaaaaaaaaagaagaaaaguauaccagauaccaaaagcua

SEQ ID NO: 89251 - RNA, 64 nt, hsa
uuuacauguacccaaaaaccauaaucaucucuuggaagaaaaugcugagaucaaugaauuauuc

SEQ ID NO: 89252 - RNA, 64 nt, hsa
cgaugacauuucuaagcuacagcguacuccaggagaagaaaagauuaauaccuuaaaagaagaa

SEQ ID NO: 89253 - RNA, 64 nt, hsa
uacuccaggagaagaaaagauuaauaccuuaaaagaagaaaacacucaagaagcagcaguccug

SEQ ID NO: 89254 - RNA, 64 nt, hsa
aaucuuaaaaguguuguuaucaugacuggugagagaagaaaacauuuuguuuuuauuaaaugga

SEQ ID NO: 89255 - RNA, 64 nt, hsa
aaguaaacaaaacccacauuuccuauccugguuagaagaaaauuaauguucugacaguugugau

SEQ ID NO: 89256 - RNA, 64 nt, hsa
aaguuucacagacaucauagauccuuuucuuaaagaagaaaaacauguauaaaauaguuuuagu

SEQ ID NO: 89257 - RNA, 64 nt, hsa
augagaggaggcagagagagggaggcagauggaagaagaaaaacaguuaaauaagacauaccca

SEQ ID NO: 89258 - RNA, 64 nt, hsa
uuggucaaaaucugcaaacucuaaaagaagaaaagaagaaaaaaccaagcuuaggguauuuuuc

SEQ ID NO: 89259 - RNA, 64 nt, hsa
caugucuguuggucaaaaucugcaaacucuaaaagaagaaaagaagaaaaaaccaagcuuaggg

SEQ ID NO: 89260 - RNA, 64 nt, hsa
uuuuuuuuuuuuguagaaguagcugucauagagugaagaaaaggauaagacuuuaaacaguuga

SEQ ID NO: 89261 - RNA, 64 nt, hsa
ugaccaucaaugccuaugaauucuucuaauacgugaagaaaauaguuugaguagcagcagugcu

SEQ ID NO: 89262 - RNA, 64 nt, hsa
uugcuuguaaauccuaaucuuagaguuaucaaaagaagaaaaaacugaagguacuuuacucccu

SEQ ID NO: 89263 - RNA, 64 nt, hsa
gaaaguccuggcugugguugcagaaacacuguuggaagaaaagagaugacuaagucaagugucu

SEQ ID NO: 89264 - RNA, 64 nt, hsa
aaaagaagaaaaaagaaaggaaaagaucuucuuugaagaaaaguaugucucuggaucccuggaa

SEQ ID NO: 89265 - RNA, 64 nt, hsa
cuucuguuuuaaacuuuggguaccaaaccaaaaagaagaaaaaagaaaggaaaagaucuucuuu

SEQ ID NO: 89266 - RNA, 64 nt, hsa
ugauauggaccuguuggucuaugucaucuuuucagaagaaaagcauuuaauugccaaugggagg

SEQ ID NO: 89267 - RNA, 64 nt, hsa
ucuuuaaaaauaacuuagauucaaauuuauaguagaagaaaaaaaaucuuucagauaagaggug

SEQ ID NO: 89268 - RNA, 64 nt, hsa
ugauauggaccuguugguccauaucaucuuuucagaagaaaagcauuuaauugccaaugggagg

SEQ ID NO: 89269 - RNA, 64 nt, hsa; identical to SEQ ID NO: 89267

SEQ ID NO: 89270 - RNA, 64 nt, hsa
gcacagacugggagaacuaacaagugacauaacagaagaaaaauaucauucaagauugguucug

SEQ ID NO: 89271 - RNA, 64 nt, hsa
ugaauuuuacaugugcaauguuccugacugcaaugaagaaaaggccuucuggagauuucuguuu

SEQ ID NO: 89272 - RNA, 64 nt, hsa
guaggcucucacuagaguuaccauucauauuugagaagaaaagaacauuuaauaaauguaugug

SEQ ID NO: 89273 - RNA, 64 nt, hsa
aagaagugcauagguccauaauauuucauaaaaugaagaaaaagaauguggccaaacaauuauu

SEQ ID NO: 89274 - RNA, 64 nt, hsa
aacccauaauuuuaaugcuacacaaaucuuaugugaagaaaagacugguaugaaaucauuuuuu

SEQ ID NO: 89275 - RNA, 64 nt, hsa
aaagugagugagauguaaauccugugauuuuggugaagaaaaaaacggguaucuucauagcagc

SEQ ID NO: 89276 - RNA, 64 nt, hsa
cugugaaucacaaaguguacugucucaaaaaauagaagaaaaugugucuucgucuuuauguuga

SEQ ID NO: 89277 - RNA, 64 nt, hsa
ccacagugagucagcccuucacagaacuacuacggaagaaaauuauucaucacaguguacaguu

SEQ ID NO: 89278 - RNA, 64 nt, hsa
caaauauauuagucuagggccacuuaauuuagaggaagaaaaaaaaucaacccauccauagaaa

SEQ ID NO: 89279 - RNA, 64 nt, hsa
gaacucacugauggagaugugaaauggcaguaaggaagaaaacagaauaacugaacaaauauau

SEQ ID NO: 89280 - RNA, 64 nt, hsa
gcaagucaaugucaccgacagugaugaggaggaagaagaaaaagugcucagggauuuauaauuu

SEQ ID NO: 89281 - RNA, 64 nt, hsa
aacuucuuacuauaacagucauagccacaguggggaagaaaacuuaaacccugugccucagcug

SEQ ID NO: 89282 - RNA, 64 nt, hsa
caccagcacaucacuaugcaucuguuccaggaaagaagaaaagcgagcgaggaagacggaaaag

SEQ ID NO: 89283 - RNA, 64 nt, hsa
gugggggguggggaggggggugagaagacaagaugaagaaaagccuuacauuucaguuucuuca

SEQ ID NO: 89284 - RNA, 64 nt, hsa
auggagugccauccugcuaggugaguacagaccagaagaaaauuuaguugggaaaauacuuguu

SEQ ID NO: 89285 - RNA, 64 nt, hsa
ccuauuaccuuuguagcagccacaucagaaagcagaagaaaacaguauuucugaaggcauuguu

SEQ ID NO: 89286 - RNA, 64 nt, hsa
agaagagaaaaaauuaagaaaaaaaucaaaaaaggaagaaaacuaaaaaaaaaaaaaaucaaau

SEQ ID NO: 89287 - RNA, 64 nt, hsa
uggugucagauucaucaaacaaaaaauaaaucucgaagaaaaaaaaugcacuuacaugugcuua

SEQ ID NO: 89288 - RNA, 64 nt, hsa
auuuguaaagcuuucagugaaacacuacauacacgaagaaaaggaacaagguuuaacuauuuaa

SEQ ID NO: 89289 - RNA, 64 nt, hsa
uuauaaaacaaggcuagccauauuuaggacaacugaagaaaagcuggaaaaaaaaacaagcaaa

SEQ ID NO: 89290 - RNA, 64 nt, hsa
uguuuggaagaccagaaugugaagacaaguaguagaagaaaaugaaugcugcugcugagacuga

SEQ ID NO: 89291 - RNA, 64 nt, hsa
ugaggcaaaguagugaauauguuuuauauguuaugaagaaaagaauuguuguaaguuuuugauu

SEQ ID NO: 89292 - RNA, 64 nt, hsa
aucauaauuacauuaccaguguuggaaaacuaaugaagaaaacacuguaauugcuacucagcaa

SEQ ID NO: 89293 - RNA, 56 nt, hsa
uguauuuuucuuuccaguaaagaauugaagaaaaguuaagagcugccgaaaugcac

SEQ ID NO: 89294 - RNA, 64 nt, hsa
accacuuuuuuuaaccauuauuaugcaaaauuuagaagaaaaguuauuggcaugguuguugcau

SEQ ID NO: 89295 - RNA, 64 nt, hsa
aguguuaaguuuuuaaucugggagcagggcauaggaagaaaaugucaguagugcuaaugcauuu

SEQ ID NO: 89296 - RNA, 64 nt, hsa
ggaaugucagaaaugacuuuaucaucgucaucuugaagaaaaauaugaacacugaugaagguca

SEQ ID NO: 89297 - RNA, 64 nt, hsa
aaccagucacuaggauauuucuacccaugcaacggaagaaaaacccauuacuccagaagaguau

SEQ ID NO: 89298 - RNA, 64 nt, hsa
ccucuuuuuuauuuuaagauuaauuucauuagaggaagaaaaccagcgcaaggaauccucuagu

SEQ ID NO: 89299 - RNA, 64 nt, hsa
acccuaugaaaaaauuaguugagaaagaagagaagaagaaaaucaaccagcaggaaaguacaga

SEQ ID NO: 89300 - RNA, 64 nt, hsa
ugcuccagccugggcgacagaagucuugucucaagaagaaaacgaacugggaaaauuucuucga

SEQ ID NO: 89301 - RNA, 64 nt, hsa
uguaugucucuaggacauuuuauaguuuuaagaggaagaaaacagaaacguggcaucauuuggg

SEQ ID NO: 89302 - RNA, 64 nt, hsa
ugaacaacugcagagagaaaggcggcgggucuuagaagaaaaucauguggagcaccagccucgg

SEQ ID NO: 89303 - RNA, 64 nt, hsa
uuuuagauguuauuaugcuaauauaguagggguugaagaaaacaaaauagcuuauuauagaauu

SEQ ID NO: 89304 - RNA, 64 nt, hsa
agcggcuuucuaauagagagauuaguaaauaugugaagaaaaagaccugcauuuggcaggaaga

SEQ ID NO: 89305 - RNA, 64 nt, hsa
ucuuaaauaacuccauucauacaaauugggaugggaagaaaauccuuuccucuugggaaaguaa

SEQ ID NO: 89306 - RNA, 64 nt, hsa
aagaccacaagucugcaggaaacucuggaaucaggaagaaaagcuauguucauacucuaaaucu

SEQ ID NO: 89307 - RNA, 64 nt, hsa
gagacaaagaucacuacagaccaaaacagaagaagaagaaaaaaaagaaaaagaaaucuaagca

SEQ ID NO: 89308 - RNA, 64 nt, hsa
ggagaaaaaaauagcucaagacacaguuaaucgagaagaaaagaaauauguacagaaccauaaa

SEQ ID NO: 89309 - RNA, 64 nt, hsa
uuguaaauacacuuuacgugaauacagucuaagugaagaaaauaaauaaaaggaagagguuuau

SEQ ID NO: 89310 - RNA, 64 nt, hsa
aaugaaaaauaguaaucauaguaaaacgcaacaagaagaaaaccaacccaaaccagugaaguuu

SEQ ID NO: 89311 - RNA, 64 nt, hsa
gauucagugcuuaccgaugaugcaguacuugauagaagaaaacagucugggaggauagcgcuca

SEQ ID NO: 89312 - RNA, 64 nt, hsa
aucaaucagcauauacauuucagccaaagccauagaagaaaaagcaauaguugcuugaauuaug

SEQ ID NO: 89313 - RNA, 64 nt, hsa
aguaaaguuuugguuauuauauauuuaacauguggaagaaaacaagacaugaaaagagugguga

SEQ ID NO: 89314 - RNA, 64 nt, hsa
uugguauuucacugaauuucaaacauuugucagagaagaaaaacgugaggacucaggaaaaaua

SEQ ID NO: 89315 - RNA, 64 nt, hsa
acauauuuacagacuccuaacuacagguacaauagaagaaaagaucuaucaaaggcagaucagu

SEQ ID NO: 89316 - RNA, 64 nt, hsa
ggaaaaggaauguagcucaacuugugauaaaaaugaagaaaagagucuauacaaaggcuugcua

SEQ ID NO: 89317 - RNA, 64 nt, hsa
caucauuuuaucgagagaaccuucugcuucugaggaagaaaaggaguuaggagaaagaagagca

SEQ ID NO: 89318 - RNA, 64 nt, hsa
gacuccugaaugauuuagacaacuucaaaauacagaagaaaagcaaaugacuaguaaacaugug

SEQ ID NO: 89319 - RNA, 64 nt, hsa
uaggcaagaaggacagcaguaaaugaagaccauggaagaaaagaaggaaugccaaagaucgagg

SEQ ID NO: 89320 - RNA, 64 nt, hsa
uuucauggugauggugcaagggagagaugauuaggaagaaaaugucuuacacggcuguaauuga

SEQ ID NO: 89321 - RNA, 64 nt, hsa
auauuccuguucccacagaacuuuggcacauucugaagaaaaucucugcagucaauuuuuaucu

SEQ ID NO: 89322 - RNA, 64 nt, hsa
guuagugggaguggucaaauugguacucuuggaggaagaaaaacuguccuuccuucuccaaaaa

SEQ ID NO: 89323 - RNA, 64 nt, hsa
uauuauuauucuuaggaauaguucaauguaacaagaagaaaacuugaccuuugcucugguuaaa

SEQ ID NO: 89324 - RNA, 64 nt, hsa
uacgcagcugccgaacucugacucuaguucugcggaagaaaaggaugcgguauuugcuuuugcc

SEQ ID NO: 89325 - RNA, 64 nt, hsa
gggcacuugcauccauugccuuuuccaggaaagggaagaaaacacucaguugauaaaccuuagu

SEQ ID NO: 89326 - RNA, 64 nt, hsa
aaacuuauuaacaacugugaauaugagaaauacagaagaaaauaauaagcccucuauacauaaa

SEQ ID NO: 89327 - RNA, 64 nt, hsa
uuuuaaaaaaucaaaaggcacugugaacuauuuugaagaaaacacaacauuuuaauacagauug

SEQ ID NO: 89328 - RNA, 64 nt, hsa
aaaaaaugagugguucaguucauuccccuaaacagaagaaaagaccaaauaauuaccuuccauu

SEQ ID NO: 89329 - RNA, 64 nt, hsa
aacuaacaauacauucuguguauauuauuuuaaugaagaaaauaaauugauuacuggcauugga

SEQ ID NO: 89330 - RNA, 64 nt, hsa
ucugacauuacuuuagcaauucaacuugaugugagaagaaaaaacaaauguuucaacacaaaau

SEQ ID NO: 89331 - RNA, 64 nt, hsa
agagaccuauguugaaaaccccugaaaauucacugaagaaaaaucauuacucuuuuucucagua

SEQ ID NO: 89332 - RNA, 64 nt, hsa
uuaaacaccugcucauggucacauagcccaggcagaagaaaaucucggacuuggaauagauccc

SEQ ID NO: 89333 - RNA, 64 nt, hsa
cugagcaacaagagcgaaacugucucaaaaaaaagaagaaaauaaauaaauaaaaaucagagca

SEQ ID NO: 89334 - RNA, 64 nt, hsa
ugucuaccucacaugcaggucuagggugaggauugaagaaaauaguggugaugagggcuuuaac

SEQ ID NO: 89335 - RNA, 64 nt, hsa
gaaccagagcuccaagucuuuaauuugccaagaugaagaaaaugaguucucaaggagggaaugc

SEQ ID NO: 89336 - RNA, 64 nt, hsa
aacuggucuaaacuucaaauaucauuuuaccuuugaagaaaaccagaaaacauucaaaagaacu

SEQ ID NO: 89337 - RNA, 64 nt, hsa
aacaggaucuucagaaaaacuacccugugacuaugaagaaaauauauauugcuagcccaaaaau

SEQ ID NO: 89338 - RNA, 64 nt, hsa
aaaauaaggguauaauuuuguaggucauaugauugaagaaaauauuauuuuaacaauguaaagc

SEQ ID NO: 89339 - RNA, 64 nt, hsa
uucacgcugcugauaaagacauaccugagaccaggaagaaaaagagguuuaauuggacuuacag

SEQ ID NO: 89340 - RNA, 64 nt, hsa
ucacacugcugauaaagacauuccucaagauugugaagaaaaagagguuuaauuggacuuacag

SEQ ID NO: 89341 - RNA, 64 nt, hsa
ccugccugcugaccacuggacgcugcuccaugcugaagaaaagugacagucuccaggggacauu

SEQ ID NO: 89342 - RNA, 64 nt, hsa
uuggacacaugaauuaaaucccaagggaaagugagaagaaaauuaauguauuagcaaccagugu

SEQ ID NO: 89343 - RNA, 64 nt, hsa
auccaucuccaguggaauguuuucaauaaaagaugaagaaaaugugugugaucuuuaauaacac

SEQ ID NO: 89344 - RNA, 64 nt, hsa
uugauuaacuuaaugccaccauugauuucaaagugaagaaaauguaacagaagccagugaagca

SEQ ID NO: 89345 - RNA, 64 nt, hsa
guaucuuuuaaacucaguucugcauccaacuugagaagaaaaaaagcuucuuuccauaucaagu

SEQ ID NO: 89346 - RNA, 64 nt, hsa
ugcuuaagaauuuaagcucuguuuuaaagccgaagaagaaaacauuugaauuuaccuucauaug

SEQ ID NO: 89347 - RNA, 64 nt, hsa
cccagcagugccugguucugagcaaacucccagggaagaaaacggcccugucuccauggccagg

SEQ ID NO: 89348 - RNA, 64 nt, hsa
uccaagcaccggggcgaaaaaccacaaaggaaaggaagaaaauuuauauauauauaauauaaaa

SEQ ID NO: 89349 - RNA, 64 nt, hsa
aggugggguguuugggaggcugcgugccagucaagaagaaaaagguuugcauucucacauugcc

SEQ ID NO: 89350 - RNA, 64 nt, hsa
uagauccuuuuauaggugagaaaaaaacaaucuggaagaaaaaaaccacacaaagacauugauu

SEQ ID NO: 89351 - RNA, 64 nt, hsa
ucagccaagugucuuucuaguuacugcuaauggagaagaaaacagggggucugggagaaaauag

SEQ ID NO: 89352 - RNA, 64 nt, hsa
ucaggucuuuacugaauguuagaagaggccuuuggaagaaaauuauguaaaguuuaaucuauaa

SEQ ID NO: 89353 - RNA, 64 nt, hsa
aggauccugaacggaaaaggaagaagaaagagaagaagaaaaagaagguagaguagaggccuau

SEQ ID NO: 89354 - RNA, 64 nt, hsa
cuacagaaacaccaucugauucagaucacaagaagaagaaaaagaaaaaagaagaggauccuga

SEQ ID NO: 89355 - RNA, 64 nt, hsa
aaaauuuugcagcgaagagaaaugaagaaaaacugaagaaaaaaaaaaaacaggaaaaaaagaa

SEQ ID NO: 89356 - RNA, 64 nt, hsa
ucacaaaaaaaaaaauuuugcagcgaagagaaaugaagaaaaacugaagaaaaaaaaaaaacag

SEQ ID NO: 89357 - RNA, 64 nt, hsa
agaacucaggaagagguagagcagaaauaaaaaggaagaaaauguagauuagaaaauaagacuu

SEQ ID NO: 89358 - RNA, 64 nt, hsa
uacuaaagccaugucaugacugucauucuauuaugaagaaaacaguuuuauuugagugcuuuaa

SEQ ID NO: 89359 - RNA, 64 nt, hsa
gaaaaauauggaaaauauugcuguuauuuuuggugaagaaaaucaauuuuguauaguuuauuuc

SEQ ID NO: 89360 - RNA, 64 nt, hsa
uuuuaaaaauaggcuuucuuauauuugauauuuggaagaaaaagccguaagguguauguagacc

SEQ ID NO: 89361 - RNA, 64 nt, hsa
cagguaaaaaaucauucacccaauuugaagcauagaagaaaauaguugcugagguuuuuuaaua

SEQ ID NO: 89362 - RNA, 64 nt, hsa
gcaaggcuucaggaaacagaguugugaggagaaagaagaaaauggcugcccauuucaguacccu

SEQ ID NO: 89363 - RNA, 64 nt, hsa
caggaaucaauuuugaggguucagauuuagcuuggaagaaaaaaaagaaacauacauccuucag

SEQ ID NO: 89364 - RNA, 64 nt, hsa
augagauuuuuuaguaaagaugagaaagaugguugaagaaaauuagugcauaauuucucaguga

SEQ ID NO: 89365 - RNA, 64 nt, hsa
gacuuuugguggugaggaggaagaacaaauaauagaagaaaauaaaaaugagauagaagaaaag

SEQ ID NO: 89366 - RNA, 64 nt, hsa
agaacaaauaauagaagaaaauaaaaaugagauagaagaaaaguaagaaccaagauucauauga

SEQ ID NO: 89367 - RNA, 64 nt, hsa
caaagagcuaaacuuauucagaaaggaaugacuagaagaaaaaggagacaauaccauguuguuc

SEQ ID NO: 89368 - RNA, 64 nt, hsa
uucauugauuuuaaacauuuuauuccuacuuucagaagaaaaauauaauacggaaaaaauuaua

SEQ ID NO: 89369 - RNA, 64 nt, hsa
ggagaaaaggaaaagaaaaaaaaaagaagaagaagaagaaaagagaagaagaaaaaaacgaaaa

SEQ ID NO: 89370 - RNA, 64 nt, hsa
agaaaaaaaaaagaagaagaagaagaaaagagaagaagaaaaaaacgaaaacagucaaccaacc

SEQ ID NO: 89371 - RNA, 64 nt, hsa
auccuaggugaggguagcaguccacaauggaauagaagaaaaucccauuauaacaaaugacaaa

SEQ ID NO: 89372 - RNA, 64 nt, hsa
acccaauggucugugaucauugaaaaagaggaaagaagaaaaaauguaugggugagaggaagga

SEQ ID NO: 89373 - RNA, 64 nt, hsa
cuuaguuaauucuucaaaagauaaagaugaacaggaagaaaaagaaaauuauuuuggacuauga

SEQ ID NO: 89374 - RNA, 64 nt, hsa
uagacucuauuuucucugauucggugugcgccaagaagaaaaggugaaaauggaauguuuucuu

SEQ ID NO: 89375 - RNA, 64 nt, hsa
cuaauaagcaaguguaaaaaaaaaaaaaaaagaggaagaaaaucuuaagugauugaugcuguuu

SEQ ID NO: 89376 - RNA, 64 nt, hsa
auuaaggguuauacucaguuuuuaacacauuguugaagaaaagguaccagcuuuggaacgagau

SEQ ID NO: 89377 - RNA, 64 nt, hsa
aaaacaugucuuuucaaaaugagaggcuuucauugaagaaaagaaaaaaacaacaguuaaaagc

SEQ ID NO: 89378 - RNA, 64 nt, hsa
aguugaggaauuuccucuaccaccuuuguugcuugaagaaaaacaugucuuuucaaaaugagag

SEQ ID NO: 89379 - RNA, 64 nt, hsa
aaaaucccgaguggagagauuagauacagaaaaagaagaaaaaaucaaugaacuugaagaguaa

SEQ ID NO: 89380 - RNA, 64 nt, hsa
gucaguuuauuaaauguuuagaauaccuaaacaggaagaaaauucuauuguuuuuuauaacaaa

SEQ ID NO: 89381 - RNA, 64 nt, hsa
gcaguaagguuucaagguacaguuauggaggaaagaagaaaaugacacauugauaacacagguc

SEQ ID NO: 89382 - RNA, 64 nt, hsa
gacagaacaagacugucucaaaaaaaaaaaaagagaagaaaaacugccuacaggccauaguuaa

SEQ ID NO: 89383 - RNA, 64 nt, hsa
aaacuggaacuugacaauuauaaauaguaauagugaagaaaaaauagaaagguugcaauuauau

SEQ ID NO: 89384 - RNA, 64 nt, hsa
agcacagcaguaaacuauggggaaaaaaaaagaagaagaaaaagaaacucagggaucacuggga

SEQ ID NO: 89385 - RNA, 64 nt, hsa
gcgcaaugagagaagcagcaguggguacaaggaggaagaaaaagggcuugcagagaguggaaag

SEQ ID NO: 89386 - RNA, 64 nt, hsa
ggaauauucaugaaacuucauugcagggguaauagaagaaaaaguaaauugggaggacuuaaug

SEQ ID NO: 89387 - RNA, 64 nt, hsa
cagguuuguugaacaaugccuuuucagguuggaagaagaaaaauagccucaaucucccacccca

SEQ ID NO: 89388 - RNA, 64 nt, hsa
uagaucaucuugaaguauuauuucacauugaaaagaagaaaauauauugauaacuauagauguu

SEQ ID NO: 89389 - RNA, 64 nt, hsa
uuauaauucagguuugaucaaggugugaauaacugaagaaaauaacuugcuggcuauauaggaa

SEQ ID NO: 89390 - RNA, 64 nt, hsa
aaacugcuuucuucucgagguauaaccgucggcagaagaaaaggguuccaccucuccccaaccg

SEQ ID NO: 89391 - RNA, 64 nt, hsa
uccggccaauggcagaagugggggaaaauuuuuagaagaaaagcaaacaugugagaccaaucau

SEQ ID NO: 89392 - RNA, 64 nt, hsa
accguggauuguauuuaaaaaaauaaaaauagaagaagaaaaggccgggcaugguggcucaugc

SEQ ID NO: 89393 - RNA, 64 nt, hsa
aauccaugaugccggacagaguucgcuccugugagaagaaaacugacccgcaggcuccucccag

SEQ ID NO: 89394 - RNA, 64 nt, hsa
ccacacaccugaauuuucagucacuggaggaacagaagaaaaguccagucuucucaugagcugu

SEQ ID NO: 89395 - RNA, 64 nt, hsa
aacuuauuuuguauugaaacuuuuaaacaauacugaagaaaaaaaaacuuuuccgacaucuguu

SEQ ID NO: 89396 - RNA, 64 nt, hsa
gccuuauugaaaaacuaaagcaaauucuuuauaggaagaaaauaugggaauuugauuacacaua

SEQ ID NO: 89397 - RNA, 64 nt, hsa
agaccuaaaaauaauucucuuguauuuuggagaugaagaaaaaagucauucaccugggagggau

SEQ ID NO: 89398 - RNA, 64 nt, hsa
ccuggccaugccuucuugccuuuggaaaaaugaugaagaaaaccuuggcuccuuccuugucugg

SEQ ID NO: 89399 - RNA, 64 nt, hsa
caaaacuuggaaagauggaggagaaaaagaaaaggaagaaaaaaaugucacccauagucucacc

SEQ ID NO: 89400 - RNA, 64 nt, hsa
ggccccaccaagaggguggaucacaccucagugggaagaaaaauaaaauuuccuucagguuuua

SEQ ID NO: 89401 - RNA, 64 nt, hsa
gcaugcuuugauaucugguucagacuaucaucaggaagaaaaaaaaaucccacaguaccugaaa

SEQ ID NO: 89402 - RNA, 64 nt, hsa
ggcugugucuauaacuugacacagucaauagaaugaagaaaauuagaguaguuaugugauuauu

SEQ ID NO: 89403 - RNA, 64 nt, hsa
ucauguucuucaucuucucaaaucaucagaggccgaagaaaaacacuuuggcugugucuauaac

SEQ ID NO: 89404 - RNA, 64 nt, hsa
gguuucagaugaugaagaaagaggaacgggcuuggaagaaaauaaucaagaagagcaaagcaug

SEQ ID NO: 89405 - RNA, 64 nt, hsa
aaguccaaaagucacuuuugaaugugaacaaaaggaagaaaaucaaggaaagaaugagucuaau

SEQ ID NO: 89406 - RNA, 64 nt, hsa
acuuaaagaauuugucaauccuagccuuccaagagaagaaaaagaagagaaacuagaaacaguu

SEQ ID NO: 89407 - RNA, 64 nt, hsa
cacauacuaccuagaaguaagaagaggagccucagaagaaaacaaaguucuauuuuauuaauuu

SEQ ID NO: 89408 - RNA, 64 nt, hsa
gcucagcgcgucucagcucagugccgaggaggaggaagaaaaacaggccgagugaaggugcugg

SEQ ID NO: 89409 - RNA, 64 nt, hsa
caggccagaagaaaaguugcuuuucaaagaggaagaagaaaauagcagcaagaaauaucucuuu

SEQ ID NO: 89410 - RNA, 64 nt, hsa
uugccagcugucuacacaaagaauaugcaggccagaagaaaaguugcuuuucaaagaggaagaa

SEQ ID NO: 89411 - RNA, 64 nt, hsa
uucuccaccaagcauuugguuuauuuagaaaaaggaagaaaaacaaaaaacaaaaaacuaaagg

SEQ ID NO: 89412 - RNA, 64 nt, hsa
aggacuggaggccgccaggcaggcguggccgagggaagaaaaagcuucuggauguccagccagc

SEQ ID NO: 89413 - RNA, 64 nt, hsa
uuuaugagagaaaaggaaaaaggaaucaaagguggaagaaaaaaaaagccaaauucuguuuacg

SEQ ID NO: 89414 - RNA, 64 nt, hsa
uacgccuaaugaacaagcacaguuuuucaauggugaagaaaaaagcaccagacuuuuuuucuuu

SEQ ID NO: 89415 - RNA, 64 nt, hsa
ucaacaaaauugauagaccgcuagcaagacuaaugaagaaaagagagaagaaucaaauagaugc

SEQ ID NO: 89416 - RNA, 64 nt, hsa
cuuacauguuagaccuaaaaccauaaaaacccuagaagaaaaccuaggcaauaccauucaggac

SEQ ID NO: 89417 - RNA, 64 nt, hsa
uaucaaacuaccaauggcauuuuucacagaaucagaagaaaacauucugaaauuuauuuggaac

SEQ ID NO: 89418 - RNA, 64 nt, hsa
cuuaaauauaaaaccuaaaaguauuaaauuccuagaagaaaacccaggaaaugccauucuggac

SEQ ID NO: 89419 - RNA, 64 nt, hsa
aaaaacacagcaugagaacuucgugaagcauacagaagaaaaaccuucagccagauugaaugcu

SEQ ID NO: 89420 - RNA, 64 nt, hsa
uccaaccuuuugucuucccugggccacauuggaagaagaaaaauugucuugugccacacauaca

SEQ ID NO: 89421 - RNA, 64 nt, hsa
cauggaacuuuuaaugaaggacagugucuucuuugaagaaaaucaagcucguguuuuuauucga

SEQ ID NO: 89422 - RNA, 64 nt, hsa
gacuuaaaaccaaauucagggacaaauggauagagaagaaaagggucaaacaucgagauuacau

SEQ ID NO: 89423 - RNA, 64 nt, hsa
ugauggauuggacguugugacucuugccuuuuaagaagaaaaaaaagauaggacaaaguauuug

SEQ ID NO: 89424 - RNA, 64 nt, hsa
aucacauccauucucaagguaguuauaugcuggagaagaaaaauccucuagacacaugaaggcc

SEQ ID NO: 89425 - RNA, 64 nt, hsa
uaaaggcaacuugcaggagaggagagccagccaagaagaaaauuuuaaaaccaaaccucguuua

SEQ ID NO: 89426 - RNA, 64 nt, hsa
cagaguugagaguugggugagguuagucucuccugaagaaaaagccuauaaaaaguggcuaauc

SEQ ID NO: 89427 - RNA, 64 nt, hsa
aaaucauugaacugagggggaaaaauguaacuaggaagaaaaacccaauuuaagaaauuacaua

SEQ ID NO: 89428 - RNA, 64 nt, hsa
gucauuucugcugaaaaaacagaugauccugguggaagaaaagguugaaggcagcugcccucgg

SEQ ID NO: 89429 - RNA, 64 nt, hsa
auauauuuugccccugcuauaaaauuccuuccaugaagaaaacugcugcuuucagcaaaaguca

SEQ ID NO: 89430 - RNA, 64 nt, hsa
aaaguuuccauggaagcuguucagaaaaaucaaggaagaaaaaagcaaguuguucaauuuuaau

SEQ ID NO: 89431 - RNA, 64 nt, hsa
acuucuugguguuggaggccacuggguaacaacagaagaaaaccuucagguacuaucagaaacc

SEQ ID NO: 89432 - RNA, 64 nt, hsa
uuaaucucuucuauuuuguugucguugcuuguuugaagaaaaucaugacauuccaaguugacau

SEQ ID NO: 89433 - RNA, 64 nt, hsa
acuuuaggaaacagagcugccaauugaaacagaagaagaaaaaaaaaaaaagcagcagacaaca

SEQ ID NO: 89434 - RNA, 64 nt, hsa
cggccacaccgcugaaggccaaagaggccacaaagaagaaaaagaaacaguuugggaagaaaag

SEQ ID NO: 89435 - RNA, 64 nt, hsa
aagaggccacaaagaagaaaaagaaacaguuugggaagaaaaggaaaagaaucccgcccacuaa

SEQ ID NO: 89436 - RNA, 64 nt, hsa
aaauguguaagucacccccaccaaaaacaaaagagaagaaaaagaauagaaagaauuauccagu

SEQ ID NO: 89437 - RNA, 64 nt, hsa
cacucucuuuccaauuucacuuugguggucugaagaagaaaaagaaauuuuauguauguaugug

SEQ ID NO: 89438 - RNA, 64 nt, hsa
aagacugaaauaaaacucugcugcaggaaagauggaagaaaagacagucaaauggggugggggu

SEQ ID NO: 89439 - RNA, 64 nt, hsa
aguagugaauccccucauuuugugcauucacuuugaagaaaaagguuucucaaagaugcacacu

SEQ ID NO: 89440 - RNA, 64 nt, hsa
uuuuugauguugauuuugaccuguucaugauucagaagaaaaacaaacuuuuuuggauuuuuuu

SEQ ID NO: 89441 - RNA, 64 nt, hsa
ucuccucuaaucuguguacacaucuccaagcaaggaagaaaaaacaaacucugcucagacgccu

SEQ ID NO: 89442 - RNA, 64 nt, hsa
acuuaaacggaugggauucacuuaacaaaagcaagaagaaaagcacacgaacaggugucuuaau

SEQ ID NO: 89443 - RNA, 64 nt, hsa
uccauacuuaaagaccaaaucauuuguuugcuuugaagaaaaagcaaaaacaagaacaaaaaca

SEQ ID NO: 89444 - RNA, 64 nt, hsa
aaaaaucaucucacaugcauuuuauaguuuuggggaagaaaauaucauggggaggucuaccuuc

SEQ ID NO: 89445 - RNA, 64 nt, hsa
uaaauaaauaauuuaaauuuuauugguguuauuggaagaaaaaugcuauuaaugggcuaauaaa

SEQ ID NO: 89446 - RNA, 64 nt, hsa
uguccauaugucuuuaccuaccuaaguaaaacaggaagaaaaucaguaacauuauccuuagguu

SEQ ID NO: 89447 - RNA, 64 nt, hsa
aaauggacuuuagacaaaagcaagaggaucagaugaagaaaaggagagguagauacagucagug

SEQ ID NO: 89448 - RNA, 64 nt, hsa
agucaauauggauuuagaaaaaggaacaccugaugaagaaaaggagagguagauacagucagug

SEQ ID NO: 89449 - RNA, 64 nt, hsa
acaaaauacauucuuuuugcucuaaaauauuuaugaagaaaauacuuaaauguuauguauaugg

SEQ ID NO: 89450 - RNA, 64 nt, hsa
ugauuaacuuggaugaguuuugggaaguuaaagggaagaaaacacuguuaucauuuuuuccugu

SEQ ID NO: 89451 - RNA, 64 nt, hsa
cccccaauaagaagagaugagacucggccggagagaagaaaaggcccuuaacuuucuuuccaau

SEQ ID NO: 89452 - RNA, 64 nt, hsa
uuacaccaagcccuucccauaaaacacaacugcugaagaaaauagcagacguuuccccucucuc

SEQ ID NO: 89453 - RNA, 64 nt, hsa
agauaggccuggaagagacuguugaugccacuuugaagaaaagaacacugagaacuagaggagg

SEQ ID NO: 89454 - RNA, 64 nt, hsa
ccuuuaggaaagaagaccuguuuauacauugaaggaagaaaagaaggaagcaguugccuuccgg

SEQ ID NO: 89455 - RNA, 64 nt, hsa
ucuccugauaauucaagggagcucaaagucacaagaagaaaaaugaaaggaaaaaacagcagcc

SEQ ID NO: 89456 - RNA, 64 nt, hsa
uaaauuuuauuggggaccauggaaugguaguugagaagaaaacuauuugcacacaacagauuuu

SEQ ID NO: 89457 - RNA, 64 nt, hsa
guuggggagagguguucgguuuccccagccuguuaaugaacagccauacguguaagcuuuuucu

SEQ ID NO: 89458 - RNA, 64 nt, hsa
ggcugggagggagaggggcuccggcuuucucugaaaugaacacugcucuucagcaguucaagua

SEQ ID NO: 89459 - RNA, 64 nt, hsa
agcucugcuguauuuuaaauguuuauguuuuaagaaugaacacuuuucaaauauaaaacuauau

SEQ ID NO: 89460 - RNA, 64 nt, hsa
acaaaguagguguucaacaaaaaugugaugaccaaaugaacaaaauucuuaaauaaaacauuca

SEQ ID NO: 89461 - RNA, 64 nt, hsa
ucccuggugauguuucuuccacauacaucugugaaaugaacaaggaagugaggcuucccaagaa

SEQ ID NO: 89462 - RNA, 64 nt, hsa
aaagggacuuucugaaggaaaauggaaaaaccaaaaugaacacugaacuuggccacaggcccca

SEQ ID NO: 89463 - RNA, 64 nt, hsa
uggcagaacuggcacuagguccaaaucuugugauaaugaacaccguaagguuagcuagcuuccu

SEQ ID NO: 89464 - RNA, 64 nt, hsa
uaaguuuuuauuuuacuugaaccaagagcacaugaaugaacaggaaaagauguaaaaacauuuu

SEQ ID NO: 89465 - RNA, 64 nt, hsa
aaaauucucauuauuugcaaagaaugaacaaguuaaugaacaaacaaacuagauuugguauguu

SEQ ID NO: 89466 - RNA, 64 nt, hsa
uuaauggaaaaaaaaauucucauuauuugcaaagaaugaacaaguuaaugaacaaacaaacuag

SEQ ID NO: 89467 - RNA, 64 nt, hsa
ccugagucccaauuacauucacgacaguacuuucaaugaacauaauuguuaggaccacugagga

SEQ ID NO: 89468 - RNA, 64 nt, hsa
gcugcaaucgcuuuccuaaaacaguaguguauuaaaugaacaucuauaaaauguaucaacacac

SEQ ID NO: 89469 - RNA, 64 nt, hsa
agcauacuaaaaugaacaaguugcuaaagaugagaaugaacaaagcauauucagggcauguuua

SEQ ID NO: 89470 - RNA, 64 nt, hsa
ggauggagcgcagauauccaggcaagcauacuaaaaugaacaaguugcuaaagaugagaaugaa

SEQ ID NO: 89471 - RNA, 64 nt, hsa
uaaugaaggacuccacugugccccacuuucugccaaugaacaguggcuugauaauaccaaguau

SEQ ID NO: 89472 - RNA, 64 nt, hsa
cuuuuuaaacuacuaguuuuaaaaaccuguguuaaaugaacaguaauugccugguagguuuggu

SEQ ID NO: 89473 - RNA, 64 nt, hsa
uaaugcccaauauccaccgacacugcuuuucuugaaugaacagccaaacuaaacuuuggccauc

SEQ ID NO: 89474 - RNA, 64 nt, hsa
auguuaaagagggaguuuuguuagaggcaucuuuaaugaacaugaaugugagugcucucuaaau

SEQ ID NO: 89475 - RNA, 64 nt, hsa
cccaacuuccuuuaauuauugcuugucuuaaaauaaugaacacuacagauagaaaauaugauau

SEQ ID NO: 89476 - RNA, 64 nt, hsa
uaaugagacaugaauugugucucaacagaaacuaaaugaacauuucagaauaaauuauugcugu

SEQ ID NO: 89477 - RNA, 64 nt, hsa
uggcuugaaacuuguguaucauaugugauuuugaaaugaacaccuugaauagcacuaauuuuua

SEQ ID NO: 89478 - RNA, 64 nt, hsa
uuuugugacuguuaccaugugaaaguccuguugaaaugaacaauugucugccccacaaucaaga

SEQ ID NO: 89479 - RNA, 64 nt, hsa
uggaaguaaauucuaguuuguaguucucauuuguaaugaacacauuaacgacuagauuaaaaua

SEQ ID NO: 89480 - RNA, 64 nt, hsa
auaacuuuucuaaauguagugccuuuaaaggaaaaaugaacacagggaagugacuuugcuacaa

SEQ ID NO: 89481 - RNA, 64 nt, hsa
aaaauuuucuaagauuaacugguaguucauuguaaaugaacauaaugaacagaauuuaugacuc

SEQ ID NO: 89482 - RNA, 64 nt, hsa
uaagauuaacugguaguucauuguaaaugaacauaaugaacagaauuuaugacuccacugugga

SEQ ID NO: 89483 - RNA, 64 nt, hsa
uagaaauuauccuuucuuacuaaugccuugaaagaaugaacaaauaaaaauucccagaccacag

SEQ ID NO: 89484 - RNA, 64 nt, hsa
aauucauuuucauuuguugggcagaggcccaauaaaugaacaaauguacauacacucaggaagg

SEQ ID NO: 89485 - RNA, 64 nt, hsa
cucugcuacucuuaggcugcauaguuuaugagaaaaugaacacaugcauuuauggauccaguau

SEQ ID NO: 89486 - RNA, 64 nt, hsa
guggauugcauuguuaggaagaacauuuggugggaaugaacacuccugggcauaccgcugacuu

SEQ ID NO: 89487 - RNA, 64 nt, hsa
auagcacuguaacggaaaaugauucuguuaauguaaugaacaugggaaagaccagccuuggccu

SEQ ID NO: 89488 - RNA, 64 nt, hsa
acagccacuauccauuuggaaaacuuaaaagaauaaugaacaguuauguucuaucuagauucag

SEQ ID NO: 89489 - RNA, 64 nt, hsa
ucucugauaaaaagaaaaaaaaugaaaaaauaaaaaugaacagguauaaaaagagaauauggua

SEQ ID NO: 89490 - RNA, 64 nt, hsa
uagacauuucaaacugucacauuagggauacaaaaaugaacaggcugggagugguggcucagcc

SEQ ID NO: 89491 - RNA, 64 nt, hsa; identical to SEQ ID NO: 85770

SEQ ID NO: 89492 - RNA, 64 nt, hsa; identical to SEQ ID NO: 85771

SEQ ID NO: 89493 - RNA, 64 nt, hsa; identical to SEQ ID NO: 85772

SEQ ID NO: 89494 - RNA, 64 nt, hsa; identical to SEQ ID NO: 85773

SEQ ID NO: 89495 - RNA, 64 nt, hsa; identical to SEQ ID NO: 85774

SEQ ID NO: 89496 - RNA, 64 nt, hsa; identical to SEQ ID NO: 85775

SEQ ID NO: 89497 - RNA, 64 nt, hsa; identical to SEQ ID NO: 85776

SEQ ID NO: 89498 - RNA, 64 nt, hsa; identical to SEQ ID NO: 85777

SEQ ID NO: 89499 - RNA, 64 nt, hsa; identical to SEQ ID NO: 85778

SEQ ID NO: 89500 - RNA, 64 nt, hsa; identical to SEQ ID NO: 85779

SEQ ID NO: 89501 - RNA, 64 nt, hsa; identical to SEQ ID NO: 85780

SEQ ID NO: 89502 - RNA, 64 nt, hsa; identical to SEQ ID NO: 85781

SEQ ID NO: 89503 - RNA, 64 nt, hsa; identical to SEQ ID NO: 85782

SEQ ID NO: 89504 - RNA, 64 nt, hsa; identical to SEQ ID NO: 85783

SEQ ID NO: 89505 - RNA, 64 nt, hsa; identical to SEQ ID NO: 85784

SEQ ID NO: 89506 - RNA, 64 nt, hsa; identical to SEQ ID NO: 85785

SEQ ID NO: 89507 - RNA, 64 nt, hsa; identical to SEQ ID NO: 85786

SEQ ID NO: 89508 - RNA, 64 nt, hsa; identical to SEQ ID NO: 85787

SEQ ID NO: 89509 - RNA, 64 nt, hsa; identical to SEQ ID NO: 85788

SEQ ID NO: 89510 - RNA, 64 nt, hsa; identical to SEQ ID NO: 85789

SEQ ID NO: 89511 - RNA, 64 nt, hsa; identical to SEQ ID NO: 85790

SEQ ID NO: 89512 - RNA, 64 nt, hsa; identical to SEQ ID NO: 85791

SEQ ID NO: 89513 - RNA, 64 nt, hsa; identical to SEQ ID NO: 85792

SEQ ID NO: 89514 - RNA, 64 nt, hsa; identical to SEQ ID NO: 85793

SEQ ID NO: 89515 - RNA, 64 nt, hsa; identical to SEQ ID NO: 85794

SEQ ID NO: 89516 - RNA, 64 nt, hsa; identical to SEQ ID NO: 85795

SEQ ID NO: 89517 - RNA, 64 nt, hsa; identical to SEQ ID NO: 85796

SEQ ID NO: 89518 - RNA, 64 nt, hsa; identical to SEQ ID NO: 85797

SEQ ID NO: 89519 - RNA, 64 nt, hsa; identical to SEQ ID NO: 85798

SEQ ID NO: 89520 - RNA, 64 nt, hsa; identical to SEQ ID NO: 85799

SEQ ID NO: 89521 - RNA, 64 nt, hsa; identical to SEQ ID NO: 85800

SEQ ID NO: 89522 - RNA, 64 nt, hsa; identical to SEQ ID NO: 85801

SEQ ID NO: 89523 - RNA, 64 nt, hsa; identical to SEQ ID NO: 85802

SEQ ID NO: 89524 - RNA, 64 nt, hsa; identical to SEQ ID NO: 85803

SEQ ID NO: 89525 - RNA, 64 nt, hsa; identical to SEQ ID NO: 85804

SEQ ID NO: 89526 - RNA, 64 nt, hsa; identical to SEQ ID NO: 85805

SEQ ID NO: 89527 - RNA, 64 nt, hsa; identical to SEQ ID NO: 85806

SEQ ID NO: 89528 - RNA, 64 nt, hsa; identical to SEQ ID NO: 85807

SEQ ID NO: 89529 - RNA, 64 nt, hsa; identical to SEQ ID NO: 85808

SEQ ID NO: 89530 - RNA, 64 nt, hsa; identical to SEQ ID NO: 85809

SEQ ID NO: 89531 - RNA, 64 nt, hsa; identical to SEQ ID NO: 85810

SEQ ID NO: 89532 - RNA, 64 nt, hsa; identical to SEQ ID NO: 85811

SEQ ID NO: 89533 - RNA, 64 nt, hsa
uuaagauacacaacuuguuucuuaguucauauaaucucgggauacacacacacacacacauaua

SEQ ID NO: 89534 - RNA, 64 nt, hsa
caaauaaggaaagcacugaaauguugugauugggucucgggaaaugcucagauugaugucuuac

SEQ ID NO: 89535 - RNA, 64 nt, hsa
cgcccucccuucuccacaggcugcgucaucaccaucucgggacgcaugaccuucacgagcaaua

SEQ ID NO: 89536 - RNA, 64 nt, hsa
gauucuuuccuguaaagucuuaucugcgacucugucucgggaauguuuugucuguugccgucag

SEQ ID NO: 89537 - RNA, 64 nt, hsa
augcccuccaauccuuuccacccuauucccuaacucucgggaccucguuugggaguguucugug

SEQ ID NO: 89538 - RNA, 64 nt, hsa
acuucccacuucccagaaucccuuguaucuccuuucucgggaauuguauuuucuaauaaaugac

SEQ ID NO: 89539 - RNA, 64 nt, hsa
ugcagcugauacuuguuugggcacaccuccaaguucucgggauuagaaggacaagagcacuccc

SEQ ID NO: 89540 - RNA, 64 nt, hsa
gggagcuagggagagacucuggagguggugggucucucgggagaccccuaaugaggaaguugag

SEQ ID NO: 89541 - RNA, 64 nt, hsa
ggcugccucaucaacggcaagaggaaaggaggggucucgggacaucuccagacccuaccaacug

SEQ ID NO: 89542 - RNA, 64 nt, hsa
ugcggaucugggaaauggcucugccuuaggcacuucucgggaauuugaggccagccugaggaac

SEQ ID NO: 89543 - RNA, 64 nt, hsa
ccugggguccuuuuuuuuauuuucugaaaaucacucucgggacugccguccucgcugcuggggg

SEQ ID NO: 89544 - RNA, 64 nt, hsa
gccuucacuccaccuuuaguccuucugagcacucucucgggaguuggaacauuguuauccuugu

SEQ ID NO: 89545 - RNA, 64 nt, hsa
aggugugaacccagggcccgccaaccgcugccuuucucgggaguacuuagagccucgaacccgc

SEQ ID NO: 89546 - RNA, 64 nt, hsa
agaaauacgcuauguuguaggguacaacagaauaucucgggaauggacucagaaguaugccaug

SEQ ID NO: 89547 - RNA, 64 nt, hsa
uugcaacaagguuaccucuauuuugccacaagcgucucgggauuguguuugacuugugucuguc

SEQ ID NO: 89548 - RNA, 64 nt, hsa
gaaggcuucaaucauuuggaucaacaacugcuacucucgggaagacuccucuacucacagcuga

SEQ ID NO: 89549 - RNA, 64 nt, hsa
aagugccgcgaaaaaauggaugaguugcaauuucucucgggauggcgcgggugguguguguguu

SEQ ID NO: 89550 - RNA, 64 nt, hsa
uuugccugccaccucugcccaggacacucuucccucucgggaugugugaugaacucccaggaga

SEQ ID NO: 89551 - RNA, 64 nt, hsa
uuuauuuaggcugugacucucucucuaaugcugcucucgggaaggacgaaagugaccugcaagg

SEQ ID NO: 89552 - RNA, 64 nt, hsa
aggcggugaggccagggcuuccagccucgugcugucucgggacuccugaccguggugugcgugu

SEQ ID NO: 89553 - RNA, 64 nt, hsa
ucuccugggcugucucuggucuggucagccuggcucucgggaaauucagccaugagcagggaaa

SEQ ID NO: 89554 - RNA, 64 nt, hsa
aguugaacaaaaauuaugaaaagguauauuugcuucucgggaaagcaaagaagcugcuuuaaaa

SEQ ID NO: 89555 - RNA, 64 nt, hsa
uaagcagagcuguucuuggggagaaggagggaggucucgggaguguagcaccaugccaaccagc

SEQ ID NO: 89556 - RNA, 64 nt, hsa
acagugaccccgagccgcucuccuuggaguagccucucgggaggaucacaccucgacacccaac

SEQ ID NO: 89557 - RNA, 64 nt, hsa
cuugccucaacuucccucucauuugccuacagcaucucgggacgcuucuguguuucccaaguau

SEQ ID NO: 89558 - RNA, 64 nt, hsa
ucauagcaaccucaaguaaucuuuauucugagggucucgggauugcagguugaaaaacacaacc

SEQ ID NO: 89559 - RNA, 64 nt, hsa
cacacucggaagaucccgugugugcacgcuggcuucucgggaccagccagggccaaggcuuggg

SEQ ID NO: 89560 - RNA, 64 nt, hsa
auuccauguucagcagaguauuuuaauuauauuuucucgggauuauugcucuucugucuauaaa

SEQ ID NO: 89561 - RNA, 64 nt, hsa
acagaaguaccuugauuuaauuuuuuaaacguguucucgggaaguuagggcuaaagaaaauuuu

SEQ ID NO: 89562 - RNA, 64 nt, hsa
ugcaaaugaacuucagacggaccucaggguagguucucgggacugaaggaaggccaagccauua

SEQ ID NO: 89563 - RNA, 64 nt, hsa
cuggcucuggauggagccaggcaucggcaagggcucucgggagcugcugccgucagacuccugc

SEQ ID NO: 89564 - RNA, 64 nt, hsa
guugcugugaccucccuaagacacugaagauacuucucgggaaaggaucaucgccguugaaaug

SEQ ID NO: 89565 - RNA, 64 nt, hsa
ccucccaagggcucagaugcugcuggcagaguugucucgggagcggggugagcugcagggugaa

SEQ ID NO: 89566 - RNA, 64 nt, hsa
cauuccgugcggugguaucucccaggcucuacauucucgggagcggcgccucccaagggggucc

SEQ ID NO: 89567 - RNA, 64 nt, hsa
uguuguaagaauaggcauuaacacaaaggaggcgucucgggagaggauuagguuccauccuuua

SEQ ID NO: 89568 - RNA, 64 nt, hsa
gcggugugucuuuccagaaggucacguggaaaugucucgggacuugggucccggagugcccgug

SEQ ID NO: 89569 - RNA, 64 nt, hsa
aguuauuuacuuugggcauuuaaaagaaaauuucucucgggaauaauuuuauagaaaaauaaag

SEQ ID NO: 89570 - RNA, 64 nt, hsa
cugggcaagaaccuaaaguagcaggacucggaauucucgggaaauuauuaugacucaauaaaag

SEQ ID NO: 89571 - RNA, 64 nt, hsa
gggcuggcaguagggaguuccaggagcggggacuucucgggaaaauccuauaacuugcuuuacu

SEQ ID NO: 89572 - RNA, 64 nt, hsa
auguugagagaugauucuuucuuggcccuggccaucucgggaagcuugauggcaauccuggaag

SEQ ID NO: 89573 - RNA, 64 nt, hsa
gcaucgaggaagggccgaggaaugugaagccagaucucgggacucagauuggaauguuacaucu

SEQ ID NO: 89574 - RNA, 64 nt, hsa
acuccuuccacucugggggcggaggggaauggcuucucgggacccucagcuagcgugggugccc

SEQ ID NO: 89575 - RNA, 64 nt, hsa
ugggacauggauucuugaucuuccuuuacacauuucucgggaaaucugaaaugaugcuggaugg

SEQ ID NO: 89576 - RNA, 64 nt, hsa
cacaaaguaggaucccagugcauuaggcagccagucucgggagaaggggaacuugugccccaga

SEQ ID NO: 89577 - RNA, 64 nt, hsa
aauuuaagacggugaugaaacugagguucaguacucucgggacucgaggaaauuauuccugaga

SEQ ID NO: 89578 - RNA, 64 nt, hsa
uagccccagggaucacuggcuggccugagcaacaucucgggaguccucuagcaggccuaagaca

SEQ ID NO: 89579 - RNA, 64 nt, hsa
aggggaggggaacuuccacccgaggggaagaugcucucgggacaguuucccgggcagcuccugg

SEQ ID NO: 89580 - RNA, 64 nt, hsa
cccauucccaagggagacugaccaucaugcccucucucgggagcccuagcccugcuccaacucc

SEQ ID NO: 89581 - RNA, 64 nt, hsa
aacaagugccuucagggcuggccucggccucgagucucgggacagaggccgccaguggagauca

SEQ ID NO: 89582 - RNA, 64 nt, hsa
ugggguucccgcacccugggcuggcuggugguuuucucgggaagcaggacccuccugacuggug

SEQ ID NO: 89583 - RNA, 64 nt, hsa
ugggaauccgcccaucugggggccucuucugcuuucucgggaauuuucaucuaggauuuuaagg

SEQ ID NO: 89584 - RNA, 64 nt, hsa
agaagacaaaagguaaagacgcaacguuuccaacucucgggacgccaaggccgcaggacuggag

SEQ ID NO: 89585 - RNA, 64 nt, hsa
ggcauucaggcccagaugccugcagggcuggggcucucgggacagaugcagggaugugugcugc

SEQ ID NO: 89586 - RNA, 64 nt, hsa
caacacccucaaccggcuccaucacauccucaggucucgggaccauggggggcucagaggggag

SEQ ID NO: 89587 - RNA, 64 nt, hsa
ucccaccuggaccucuucaaagucaaaacucuucucucgggacaaacaaauauucgggacuuuc

SEQ ID NO: 89588 - RNA, 64 nt, hsa
ucuguguccccaguagcucagccuucccucuuccucucgggagccuccccgguuccuccccugc

SEQ ID NO: 89589 - RNA, 64 nt, hsa
uagcccaggcaagagagaagcaaccaccacaagcucucgggacuagcugccuucgcaccuugcu

SEQ ID NO: 89590 - RNA, 64 nt, hsa
cccacuggaaaaaaauaguuuuuucauuaguauuucucgggaggacccaaaaguuaaggucagc

SEQ ID NO: 89591 - RNA, 64 nt, hsa
agccccuuaggaggacaggccugcagcauccuggucucgggaggcuucugucauugcucacaca

SEQ ID NO: 89592 - RNA, 64 nt, hsa
cccaagaaucagcaacugcagugugaggacagcgucucgggaggcaggacccuagggagacccg

SEQ ID NO: 89593 - RNA, 64 nt, hsa
aagauuugagguuuuuccagaagcuuugucugccucucgggaggaaggccguggggcugggacc

SEQ ID NO: 89594 - RNA, 64 nt, hsa
acagagggcugcccccaccacacacacccccgcgucucgggagaaacccacccucuucagagcc

SEQ ID NO: 89595 - RNA, 64 nt, hsa
cugccugguccucugcguuguagugcuaccucaaucucgggagaaacagcccuauauucuaaca

SEQ ID NO: 89596 - RNA, 64 nt, hsa
aacgucgagaccccaccgagggcgggagggggacucucgggagccacagacgcccgagacccac

SEQ ID NO: 89597 - RNA, 64 nt, hsa
acuugggccucugccucuguaccugcagcucugcucucgggauggugcuuccuuuaucuugaag

SEQ ID NO: 89598 - RNA, 64 nt, hsa
gguggcacuuauggugguggcuugagagccuuggggaaauuagggcccuaacagcuagaaucaa

SEQ ID NO: 89599 - RNA, 64 nt, hsa
caauucagucucuuaagauuagcuucacaaugauggaaauuauuucaucagguggaaagucugg

SEQ ID NO: 89600 - RNA, 64 nt, hsa
ugcauaccugccagcucguaugccucuggcauggggaaauuaagggaacagugucuguuugcau

SEQ ID NO: 89601 - RNA, 64 nt, hsa
auauccgugauauuaugucgauuuuuaacugaggggaaauuaacuaguccagccuaaaaugcuu

SEQ ID NO: 89602 - RNA, 64 nt, hsa
ugugagauuugacacuaaguuuuuguuagagauuggaaauuauacuaguccuuuuaagggguaa

SEQ ID NO: 89603 - RNA, 64 nt, hsa
aaauaaacauauauucuugcuugcauccuagauuggaaauuaaaauuuuucaaagaacaaagcu

SEQ ID NO: 89604 - RNA, 64 nt, hsa
uauggaaggcuguuaaauuaauauuccuguuaaaggaaauuaaaguuugucuauuuuugacaau

SEQ ID NO: 89605 - RNA, 64 nt, hsa
uccauugagugaaugaugaauaccugugaggauaggaaauuaguucugagaucuagucccucuc

SEQ ID NO: 89606 - RNA, 64 nt, hsa
agaugugugaauacuuaauuuuuauccauuuuauggaaauuagcuuagcaauuuuuuuuucucu

SEQ ID NO: 89607 - RNA, 64 nt, hsa
cacuaggcaguucccacuuucuuuagcaaauggaggaaauuaagcaccgauguagcacuuccca

SEQ ID NO: 89608 - RNA, 64 nt, hsa
acugauucuuucugugauuagcagauaccagaagggaaauuauuuaggauuggcaauguaaaga

SEQ ID NO: 89609 - RNA, 64 nt, hsa
guuuaggaaagcagugcuuuaaccuuuugccccuggaaauuacugauucuuucugugauuagca

SEQ ID NO: 89610 - RNA, 64 nt, hsa
uaacuucacuagagcauacauaacaacuggaacuggaaauuauacaaaaguaaauugggaagga

SEQ ID NO: 89611 - RNA, 64 nt, hsa
uaugcugaaaguaugcucugaacuuuagaguauaggaaauuaacuauuagaauuuaaagaauuu

SEQ ID NO: 89612 - RNA, 64 nt, hsa
auuuggaaaaaugcagugucucagcuguccccagggaaauuaaguggaauucaacuaagaucug

SEQ ID NO: 89613 - RNA, 64 nt, hsa
auuaaccuuaugaaucagaagucugacccuuguaggaaauuauauucacauauaaaguacauca

SEQ ID NO: 89614 - RNA, 64 nt, hsa
agucauggaauaauguuuaaguuguuauuugcauggaaauuaaguaggcuguuuauuuaucuaa

SEQ ID NO: 89615 - RNA, 64 nt, hsa
caggagacuguucuaccuuuuaauuugaaaacaaggaaauuaaauuuuaacagaaaucuuuuaa

SEQ ID NO: 89616 - RNA, 64 nt, hsa
aaagacccuggcuuucauuuucucucaggugaaaggaaauuaaggcaacaaaagaagcccggcu

SEQ ID NO: 89617 - RNA, 64 nt, hsa
gccauggacucuguccugaaggccugagguuacuggaaauuaggggauuaacccacuagcucuu

SEQ ID NO: 89618 - RNA, 64 nt, hsa
uaugaguucaaaaugcaaugaggaaaucugacagggaaauuaucuguaugaacuaaaaguaagg

SEQ ID NO: 89619 - RNA, 64 nt, hsa
gacuccauuuaaaaauaucacagggugggggcaaggaaauuagcugagauucaucucaggauug

SEQ ID NO: 89620 - RNA, 64 nt, hsa
uuuuuuuaguuuaaauauacugucaguguagguaggaaauuauuucuguaaauccaguugcauu

SEQ ID NO: 89621 - RNA, 64 nt, hsa
auuuguacauagccauucuagaaauagaguugagggaaauuauccauauacauaucacuaauag

SEQ ID NO: 89622 - RNA, 64 nt, hsa
cagcggaaaugucauuaugaacagauguuaaauaggaaauuauuacuuguuaacuucuuacagc

SEQ ID NO: 89623 - RNA, 64 nt, hsa
aaguacucugguuaauaaaugcugcuuccuuuguggaaauuauaaaauucuaacuuuacaugua

SEQ ID NO: 89624 - RNA, 64 nt, hsa
guguuuacauguucuuuucuucuggugauugcuaggaaauuacucaauccaauuuccuaggguu

SEQ ID NO: 89625 - RNA, 64 nt, hsa
auacccaacauauguuuacuuuaugaacuuaaauggaaauuaauuuauuguagacuacaucucu

SEQ ID NO: 89626 - RNA, 64 nt, hsa
uuuaaguagguuguaaguuugaauaguuagacauggaaauuauuuuauaagcacacaccuaaag

SEQ ID NO: 89627 - RNA, 64 nt, hsa
uuccguuuccagaaagagcuguggauauuuuacuggaaauuaagaacuugcugcuguuuuaaua

SEQ ID NO: 89628 - RNA, 64 nt, hsa
ccaccagagggcacaagcauaucacuuuuaguaaggaaauuacuagcuuguguugcuauuuaca

SEQ ID NO: 89629 - RNA, 64 nt, hsa
ucuuuaaauuauuuaaucaaccuugucuuuucaaggaaauuaccacuuaaagagauaguuggua

SEQ ID NO: 89630 - RNA, 64 nt, hsa
uccuucccuuccuuguagccuuuugacuuucauuggaaauuaggauguaaaucugcucaggaga

SEQ ID NO: 89631 - RNA, 64 nt, hsa
ggugucuguaucaguggauuucccauccccugugggaaauuaguaggcucauuuacuguuuuag

SEQ ID NO: 89632 - RNA, 64 nt, hsa
aaauuaggauaacuucacugagaagacauugaauggaaauuauucacccauuuuaaauugguga

SEQ ID NO: 89633 - RNA, 64 nt, hsa
uagaauauuaaaacugcuuugcauggguuuucugggaaauuaggauaacuucacugagaagaca

SEQ ID NO: 89634 - RNA, 64 nt, hsa
uuaagauaggagucuaaacuccacagaaaaggauaauaccaagagcuuguauuguuaccuuagu

SEQ ID NO: 89635 - RNA, 64 nt, hsa
ccaggaggugauauuauuuucagugcucagcugaaauaccaaccccaggaauaagaacuccauu

SEQ ID NO: 89636 - RNA, 64 nt, hsa
uucccaaaucauuuugugaggccaggauuacccuaauaccaaagccaggcaaaaacauuacaag

SEQ ID NO: 89637 - RNA, 64 nt, hsa
cuagauuaagaaaaaacagaagacaaauacugcuaauaccaaaagugaaagaggccaucauagc

SEQ ID NO: 89638 - RNA, 64 nt, hsa
auuuguuuuaggacaaauuuuaagaaaaugugggaauaccaaauguccuuuauaagaaaaauaa

SEQ ID NO: 89639 - RNA, 64 nt, hsa
ucuguuuuuccuuucgguuauaucuuugguuuugaauaccaacauuuaaaaugaugguauuuua

SEQ ID NO: 89640 - RNA, 64 nt, hsa
aguuauucuacauuuucuugaaauuugggagguuaauaccaaguauucauuucaugauguaaag

SEQ ID NO: 89641 - RNA, 64 nt, hsa; identical to SEQ ID NO: 89640

SEQ ID NO: 89642 - RNA, 64 nt, hsa
uagauguuugcuucuguagaugucacuuuaguaaaauaccaauuuaguuuuacuuguggcuuau

SEQ ID NO: 89643 - RNA, 64 nt, hsa
auaauaagaguaguuuacaaucucgggcuuauagaauaccaaacugaaaucuuaguucaaucug

SEQ ID NO: 89644 - RNA, 64 nt, hsa; identical to SEQ ID NO: 81719

SEQ ID NO: 89645 - RNA, 64 nt, hsa; identical to SEQ ID NO: 81720

SEQ ID NO: 89646 - RNA, 64 nt, hsa; identical to SEQ ID NO: 81721

SEQ ID NO: 89647 - RNA, 64 nt, hsa; identical to SEQ ID NO: 81722

SEQ ID NO: 89648 - RNA, 64 nt, hsa; identical to SEQ ID NO: 81723

SEQ ID NO: 89649 - RNA, 64 nt, hsa; identical to SEQ ID NO: 81724

SEQ ID NO: 89650 - RNA, 64 nt, hsa; identical to SEQ ID NO: 81725

SEQ ID NO: 89651 - RNA, 64 nt, hsa; identical to SEQ ID NO: 81726

SEQ ID NO: 89652 - RNA, 64 nt, hsa; identical to SEQ ID NO: 81727

SEQ ID NO: 89653 - RNA, 64 nt, hsa; identical to SEQ ID NO: 81728

SEQ ID NO: 89654 - RNA, 64 nt, hsa; identical to SEQ ID NO: 81729

SEQ ID NO: 89655 - RNA, 64 nt, hsa; identical to SEQ ID NO: 81730

SEQ ID NO: 89656 - RNA, 64 nt, hsa; identical to SEQ ID NO: 81731

SEQ ID NO: 89657 - RNA, 64 nt, hsa; identical to SEQ ID NO: 81732

SEQ ID NO: 89658 - RNA, 64 nt, hsa; identical to SEQ ID NO: 81733

SEQ ID NO: 89659 - RNA, 64 nt, hsa; identical to SEQ ID NO: 81734

SEQ ID NO: 89660 - RNA, 63 nt, hsa
uuauuaauuaaucacauuugcaggaaauucagaugaggcaagaaaauuuuauuggccugggua

SEQ ID NO: 89661 - RNA, 63 nt, hsa
aaccagaggaaaugcauacagggcaugagcaacugaggcaaaccuuuguggacaugaauuguu

SEQ ID NO: 89662 - RNA, 63 nt, hsa
augcuuucucaugacaguuucucaacaauccugugaggcaaauucgcauguacccucuguauu

SEQ ID NO: 89663 - RNA, 63 nt, hsa
aguuuauaauacucacuugacccuuguaacugaugaggcaaugaugccaccacaguauucuaa

SEQ ID NO: 89664 - RNA, 63 nt, hsa
gaaaauccagcacaccaagcaccagucuucuucugaggcaaaagaaaaguguugucauuuuca

SEQ ID NO: 89665 - RNA, 63 nt, hsa
uaagaaggaugcuggucagagcugcagaaaauaugaggcaauuaaaagucuuuagcuguuagc

SEQ ID NO: 89666 - RNA, 63 nt, hsa
gcaucuauuuauuuagaugauuuaucugguaaaugaggcaaaaaaauuauuaaaaauacauua

SEQ ID NO: 89667 - RNA, 63 nt, hsa
ugcucuguguccucaggaagucacagagucuacugaggcaaggagagggugauucuuucccca

SEQ ID NO: 89668 - RNA, 63 nt, hsa
ugguccuuaaauuucuuuuuuuuaaauugccacugaggcaacccuaguucaagaacucauucu

SEQ ID NO: 89669 - RNA, 63 nt, hsa
ucugaguccauuaucuuucacauacaguuuucaugaggcaaguuuuacucugcaaugguccuu

SEQ ID NO: 89670 - RNA, 64 nt, hsa
cagcuggaaaaggccuguggcccagaggcuucuccaaagggagggugacaugcuggcuuuugug

SEQ ID NO: 89671 - RNA, 64 nt, hsa
aauggaggcuguaggaauauaaccucccacccugcaaagggaaucucuugccugcuccaucuca

SEQ ID NO: 89672 - RNA, 64 nt, hsa
auuuguccacccacccuccaauaagcuggagcgacaaagggacauuccaucccuguacccuuag

SEQ ID NO: 89673 - RNA, 64 nt, hsa
guuauaaagaaagaagaucuuugucugggacccccaaagggauccuuucucuaaggucucugac

SEQ ID NO: 89674 - RNA, 64 nt, hsa
auaaguccuuuucucccugugccguuuucuugcucaaagggaacagugaauuagccagcuagaa

SEQ ID NO: 89675 - RNA, 64 nt, hsa
auuuagcagucagauuagguaggugguuuuauuucaaagggaaacuuuaauccaaagaaagauu

SEQ ID NO: 89676 - RNA, 64 nt, hsa
aaugcaggaacucucuugguaguuuguaaauacacaaagggaugugucgagggaugggagcgau

SEQ ID NO: 89677 - RNA, 64 nt, hsa
uccucuacaauuaacaaaacuuaucucugauauacaaagggauauaaauauauacacuuaaaua

SEQ ID NO: 89678 - RNA, 64 nt, hsa
caggugugcugcgcgggaagccccaugcuccaaucaaagggauuuuuaguagugccucuaagca

SEQ ID NO: 89679 - RNA, 64 nt, hsa
gaaagacucacccugcagcucugaccuuuuuucccaaagggacuuaagcgauugugcaggagua

SEQ ID NO: 89680 - RNA, 64 nt, hsa
ucuuauugcacugaauucaacuccagacaccauacaaagggagaugauggccauuccguucaaa

SEQ ID NO: 89681 - RNA, 64 nt, hsa
aagaugaauaucauagccuuuacuucuucacagccaaagggagccccuguguugucucaaguuu

SEQ ID NO: 89682 - RNA, 64 nt, hsa; identical to SEQ ID NO: 89598

SEQ ID NO: 89683 - RNA, 64 nt, hsa; identical to SEQ ID NO: 89599

SEQ ID NO: 89684 - RNA, 64 nt, hsa; identical to SEQ ID NO: 89600

SEQ ID NO: 89685 - RNA, 64 nt, hsa; identical to SEQ ID NO: 89601

SEQ ID NO: 89686 - RNA, 64 nt, hsa; identical to SEQ ID NO: 89602

SEQ ID NO: 89687 - RNA, 64 nt, hsa; identical to SEQ ID NO: 89603

SEQ ID NO: 89688 - RNA, 64 nt, hsa; identical to SEQ ID NO: 89604

SEQ ID NO: 89689 - RNA, 64 nt, hsa; identical to SEQ ID NO: 89605

SEQ ID NO: 89690 - RNA, 64 nt, hsa; identical to SEQ ID NO: 89606

SEQ ID NO: 89691 - RNA, 64 nt, hsa; identical to SEQ ID NO: 89607

SEQ ID NO: 89692 - RNA, 64 nt, hsa; identical to SEQ ID NO: 89608

SEQ ID NO: 89693 - RNA, 64 nt, hsa; identical to SEQ ID NO: 89609

SEQ ID NO: 89694 - RNA, 64 nt, hsa; identical to SEQ ID NO: 89610

SEQ ID NO: 89695 - RNA, 64 nt, hsa; identical to SEQ ID NO: 89611

SEQ ID NO: 89696 - RNA, 64 nt, hsa; identical to SEQ ID NO: 89612

SEQ ID NO: 89697 - RNA, 64 nt, hsa; identical to SEQ ID NO: 89613

SEQ ID NO: 89698 - RNA, 64 nt, hsa; identical to SEQ ID NO: 89614

SEQ ID NO: 89699 - RNA, 64 nt, hsa; identical to SEQ ID NO: 89615

SEQ ID NO: 89700 - RNA, 64 nt, hsa; identical to SEQ ID NO: 89616

SEQ ID NO: 89701 - RNA, 64 nt, hsa; identical to SEQ ID NO: 89617

SEQ ID NO: 89702 - RNA, 64 nt, hsa; identical to SEQ ID NO: 89618

SEQ ID NO: 89703 - RNA, 64 nt, hsa; identical to SEQ ID NO: 89619

SEQ ID NO: 89704 - RNA, 64 nt, hsa; identical to SEQ ID NO: 89620

SEQ ID NO: 89705 - RNA, 64 nt, hsa; identical to SEQ ID NO: 89621

SEQ ID NO: 89706 - RNA, 64 nt, hsa; identical to SEQ ID NO: 89622

SEQ ID NO: 89707 - RNA, 64 nt, hsa; identical to SEQ ID NO: 89623

SEQ ID NO: 89708 - RNA, 64 nt, hsa; identical to SEQ ID NO: 89624

SEQ ID NO: 89709 - RNA, 64 nt, hsa; identical to SEQ ID NO: 89625

SEQ ID NO: 89710 - RNA, 64 nt, hsa; identical to SEQ ID NO: 89626

SEQ ID NO: 89711 - RNA, 64 nt, hsa; identical to SEQ ID NO: 89627

SEQ ID NO: 89712 - RNA, 64 nt, hsa; identical to SEQ ID NO: 89628

SEQ ID NO: 89713 - RNA, 64 nt, hsa; identical to SEQ ID NO: 89629

SEQ ID NO: 89714 - RNA, 64 nt, hsa; identical to SEQ ID NO: 89630

SEQ ID NO: 89715 - RNA, 64 nt, hsa; identical to SEQ ID NO: 89631

SEQ ID NO: 89716 - RNA, 64 nt, hsa; identical to SEQ ID NO: 89632

SEQ ID NO: 89717 - RNA, 64 nt, hsa; identical to SEQ ID NO: 89633

SEQ ID NO: 89718 - RNA, 64 nt, hsa
ccaggacaugcugcucccuugugugagugaccgcggccccgagccuggggcuggacgcaggucc

SEQ ID NO: 89719 - RNA, 64 nt, hsa
guuagucgcuccuugcuaaccggugagugaccgcggccccgagccuggggcuggacgcaggucc

SEQ ID NO: 89720 - RNA, 64 nt, hsa
cuguuacacacuguccgcucucagcccacucucccuguuacacacugcccacacucagagcaag

SEQ ID NO: 89721 - RNA, 64 nt, hsa
ccucauuguggccccacacccagucugcuucucccuguuacacacuguccgcucucagcccacu

SEQ ID NO: 89722 - RNA, 64 nt, hsa
gagaguauuaacguuuuuguucuccuccggcccccuguuacaaugaaggggcaaaaguauuugc

SEQ ID NO: 89723 - RNA, 64 nt, hsa
cucgacaucaaacugccuggauuuuucuaccacccuguuacaucauaacaacuucugaaacaca

SEQ ID NO: 89724 - RNA, 64 nt, hsa
ucucuuccuuuugcuucuagucaaccuuaaugggcuguuacagaaacuaguucguguuuauaua

SEQ ID NO: 89725 - RNA, 64 nt, hsa
cuguaacuaucagcugcaauaccauggugaccagcuguuacaaaagauuuuuuccuguuuuauc

SEQ ID NO: 89726 - RNA, 64 nt, hsa
uccugccuucuuacccccaacucuagggaugggacuguuacaauacuucaagaucacucuuuac

SEQ ID NO: 89727 - RNA, 64 nt, hsa
uaggacauccaugccaggugaggugccugggucccuguuacaagucaggagcccuguagggaga

SEQ ID NO: 89728 - RNA, 64 nt, hsa
cauaaccuuauuugaaaugaauugcaauaaagcucuguuacaacguaaguggauggaugacaca

SEQ ID NO: 89729 - RNA, 64 nt, hsa
acagugggaacaaguuucuauuaaaaggcaaaugcuguuacaaauuuuuggcaucugguaauau

SEQ ID NO: 89730 - RNA, 64 nt, hsa
ccuugacugugaggcaggacuucccucgcuugaacuguuacacauacgaugugugugucacauc

SEQ ID NO: 89731 - RNA, 64 nt, hsa
uuucucaucugggaauuugaaaucucggugcuuacuguuacaccaauuuguccaaagaguugaa

SEQ ID NO: 89732 - RNA, 64 nt, hsa
gcgccuuccacuccaucauuucauuucacacccccgaagggaggggaggccaggaggggagcug

SEQ ID NO: 89733 - RNA, 64 nt, hsa
acaagacccuccgcccgaguaaauucuucagccacgaagggauggaugugcaucugcccuaagu

SEQ ID NO: 89734 - RNA, 64 nt, hsa
ccugggcaggcugcagccucaugccaugucucucucccacuaccugaugggcacauggacaggc

SEQ ID NO: 89735 - RNA, 64 nt, hsa
cuggccuugcaguggguguguggggaagucacugucccacuaugggucuccacuacccagucac

SEQ ID NO: 89736 - RNA, 64 nt, hsa
aggcucagggguuggucugagaggccugccauccaccccucagggagcuagguuuucucagagg

SEQ ID NO: 89737 - RNA, 64 nt, hsa
auguuauugaaggggaugguucauuaaggacuccaccccucagagcucacucagaccccaagga

SEQ ID NO: 89738 - RNA, 64 nt, hsa
agcugcccaccucguuccccagcccucaccccucaccccucaccauccuuccucaggacuuggc

SEQ ID NO: 89739 - RNA, 64 nt, hsa
ccccaucagcugcccaccucguuccccagcccucaccccucaccccucaccauccuuccucagg

SEQ ID NO: 89740 - RNA, 64 nt, hsa
gcuugucuggcgucaacuggcuuucagagugcugaccccucaucacuguggggaucauucucuc

SEQ ID NO: 89741 - RNA, 64 nt, hsa
ccuuccugcugaggugggacugggcccuggacacaccccucagccccucuguccucauuguuug

SEQ ID NO: 89742 - RNA, 64 nt, hsa
cagcaucauggagacccgcaggcggggcuuagccaccccucaaacccagggcccccuggcaccu

SEQ ID NO: 89743 - RNA, 64 nt, hsa
cuccuuggauauuucccaagaaccccccacauacaccccucacaagccaccccuccugagaggc

SEQ ID NO: 89744 - RNA, 64 nt, hsa
agugacuuccgcaggaauugagagggaauagcucaccccucauucuguccuccggacuuaggaa

SEQ ID NO: 89745 - RNA, 64 nt, hsa
uaaguggggugcagcccuggcggucuucagcugcaccccucaccgcuuccguucuuacugccuu

SEQ ID NO: 89746 - RNA, 64 nt, hsa
gucauuuucucccugagcuguaggguggaccuggaccccucagagaugcucgacugcagggucc

SEQ ID NO: 89747 - RNA, 64 nt, hsa
cuccguccagugucacccacacauugguccggggaccccucagugcagagccugaaguuggggg

SEQ ID NO: 89748 - RNA, 64 nt, hsa
cuugguguuucucucuguaauuugugugggguuuaccccucacagguuuaagagaccaggucuu

SEQ ID NO: 89749 - RNA, 64 nt, hsa
cggggguucagcggggccucugucuuuuguggugaccccucagggguuucauuguuuccuucug

SEQ ID NO: 89750 - RNA, 64 nt, hsa
cucacugucuuaagugagccagggcaaaauuuacaccccucacguuucccucucccuucuuccc

SEQ ID NO: 89751 - RNA, 64 nt, hsa
agcagaccucagggaggguugaguuucucuaaggaccccucaaacaugucgcaaaaugaaccaa

SEQ ID NO: 89752 - RNA, 64 nt, hsa
uucuucugcccauagacggggaugacucagcacuaccccucaacagagaugacuuugaugacuc

SEQ ID NO: 89753 - RNA, 64 nt, hsa
agcagggaugacucagcagggaugacucagcaccaccccucaacagggaugacucagcagggau

SEQ ID NO: 89754 - RNA, 64 nt, hsa
ucuugucuauucagacgcugguaugggggcucggaccccucacuggggacagggccaguguugg

SEQ ID NO: 89755 - RNA, 64 nt, hsa
cggcagcacacucaucccgcgccuccagaggcccaccccucaugcaacagccgcccccgcaggc

SEQ ID NO: 89756 - RNA, 64 nt, hsa
gaccccauggucacccugaagcccuuagauuccaaccccucaaucagagacuuccuucauuaac

SEQ ID NO: 89757 - RNA, 64 nt, hsa
cugaguagcaccuucaggcuagucccuauccccaaccccucagagcagauucccagauuaacag

SEQ ID NO: 89758 - RNA, 64 nt, hsa; identical to SEQ ID NO: 84807

SEQ ID NO: 89759 - RNA, 64 nt, hsa; identical to SEQ ID NO: 84808

SEQ ID NO: 89760 - RNA, 64 nt, hsa
auagugcugcgauaaacagcacuauuaugaauagugcugcgauaaacagugcaggugauuuuaa

SEQ ID NO: 89761 - RNA, 64 nt, hsa
uagguugguuccauaacuuugcuauuacgaauagugcugcgauaaacagcacuauuaugaauag

SEQ ID NO: 89762 - RNA, 64 nt, hsa
ggaaguauacuggucuguuagcagagacaaacuuuuuuuagaauugaagucugaaacaaacaaa

SEQ ID NO: 89763 - RNA, 64 nt, hsa
cuaggaaaauauuauuaaauuuauaucccuaaaauuuuuagaaaucucucaaaaucuuuccaaa

SEQ ID NO: 89764 - RNA, 64 nt, hsa
ggugagaguuugcuucccccuuucagcagcauucuuuuuagauuuagguacugaagaaucccag

SEQ ID NO: 89765 - RNA, 64 nt, hsa
uuguccgucucuuuuuuuuuuuuuaaaguaauauuuuuuagaaauacauguaaaauaccaagaa

SEQ ID NO: 89766 - RNA, 64 nt, hsa
aggguaaagucaaguuucuauuucuagaaaacauuuuuuagaaauuuguugcgauguuuguaca

SEQ ID NO: 89767 - RNA, 64 nt, hsa
aaucucuuccaguugcuuuuucuuuuuucuuuuuuuuuuagacaggucuuacucugucacccag

SEQ ID NO: 89768 - RNA, 64 nt, hsa
aauguugaauucucaugcuuuuagguguacuuccuuuuuagaauuuucaguuuucugcuauuuu

SEQ ID NO: 89769 - RNA, 64 nt, hsa
ugucaaaauaguuccuguuucuguagaaauuucauuuuuagauuaaacugugauggaugagcua

SEQ ID NO: 89770 - RNA, 64 nt, hsa
acuauauuguagauuuacuguagguuuucaaccuuuuuuagauuuaugcauguggacauuuuua

SEQ ID NO: 89771 - RNA, 64 nt, hsa
uucauuaucuuuauuauaauaaaccugaugcuuuuuuuuagaacuccuuacucugaugucugua

SEQ ID NO: 89772 - RNA, 64 nt, hsa
gcauccugcuuagagaccaaucaacggacacugguuuuuagaccucuaucaaucaguaguuagc

SEQ ID NO: 89773 - RNA, 64 nt, hsa
uuagggagaaguuaaugaccauuguuaaagugcuuuuuuagaaaauguugugcuguauguucuu

SEQ ID NO: 89774 - RNA, 64 nt, hsa
aaugcagugguaaaaauuuguuaguuucuuauacuuuuuagaaucucucaauaaaauuuuucua

SEQ ID NO: 89775 - RNA, 64 nt, hsa
caaaaugugaguaaauugaaaccaagaaaacuuguuuuuagaauauuucgucugaauaaguaca

SEQ ID NO: 89776 - RNA, 64 nt, hsa
gaggguaauccaggucuuuuuuuuuuuuuuuuuuuuuuuagacagagucucacucuguugcucu

SEQ ID NO: 89777 - RNA, 64 nt, hsa
uucuacuugaaaucaggaguuuuauaaaacaacauuuuuagacguggucaucuuuuauugguuu

SEQ ID NO: 89778 - RNA, 64 nt, hsa
uaaaauaauuuaugcaaugaagcauguugagauauuuuuagauuugaucaucuuagaaaacuca

SEQ ID NO: 89779 - RNA, 64 nt, hsa
cuuauuuccacaaauauuuugcauuuuuaggagguuuuuagaauguuuccauugcuuuuauaua

SEQ ID NO: 89780 - RNA, 64 nt, hsa
ugucuuuuuugggggagggcagagggcgguucuuuuuuuagauauuguuccuaaaaaggaauaa

SEQ ID NO: 89781 - RNA, 64 nt, hsa
agauuacauaauaguauuucuagaaaaagagauauuuuuagauuguaugccacuuuuguuuaag

SEQ ID NO: 89782 - RNA, 64 nt, hsa
ucuaucuuuaauuguucguaucauauaugcgaacuuuuuagacaugaacaugacauguucagcu

SEQ ID NO: 89783 - RNA, 64 nt, hsa
uuuguuuaaaucuggcuuuacuugauuuaauuccuuuuuagaaagaaauuuagggcaaaauaaa

SEQ ID NO: 89784 - RNA, 64 nt, hsa
ccuugcccccuguuccuggguuuaugcaguuuucuuuuuagaguuuauauagggcaagugguuc

SEQ ID NO: 89785 - RNA, 64 nt, hsa
auugucuuguuuuuaaaaaauacaguuccuaguguuuuuagaagucacuuaauuugucucauuu

SEQ ID NO: 89786 - RNA, 64 nt, hsa
ucaccaauuuauuaacagguugaauauuuguuucuuuuuagaacauuuuauuuauacugugaag

SEQ ID NO: 89787 - RNA, 64 nt, hsa
uauuuuuuaacauagaacagaagugacuucauucuuuuuagacaucagaaauguuaaaguugau

SEQ ID NO: 89788 - RNA, 64 nt, hsa
guuuuauguacuguuaaagaauuguauugaauucuuuuuagaucaaaguaaaaauaggucagca

SEQ ID NO: 89789 - RNA, 64 nt, hsa
guuuuauguacuguuaaagaauuguacugaauucuuuuuagaucacaguaaaaauagguuggca

SEQ ID NO: 89790 - RNA, 64 nt, hsa
auuauuaccauaaauaacaauuucagaaacuuaguuuuuagaauaaauauuaauuuuuccacuu

SEQ ID NO: 89791 - RNA, 64 nt, hsa
uuuuuccacuucaguuuuauucuagaaaauacccuuuuuagaaauccaguuuuaguuuugucau

SEQ ID NO: 89792 - RNA, 64 nt, hsa
cacagugcauuguuuuuucuaccugcuugucuuauuuuuagaauaauuuagaaaaacaaaacaa

SEQ ID NO: 89793 - RNA, 64 nt, hsa
uuauucucccaugaacguucuugucuguguacaguuuuuagaacauuacaaaggaucuguuugc

SEQ ID NO: 89794 - RNA, 64 nt, hsa
uaauuauaauagaaaugcggcuaguucagagagauuuuuagagcugugguggacuucauagaug

SEQ ID NO: 89795 - RNA, 64 nt, hsa
caaaugcccaguuuuugcuuaauauguauugugcuuuuuagaacaaaucuggauaaaugugcaa

SEQ ID NO: 89796 - RNA, 64 nt, hsa
uuuucccuuguuuuaauuuguauguuuguacuacuuuuuagaugcuuaaacuauacauaagcua

SEQ ID NO: 89797 - RNA, 64 nt, hsa
gauugaaauaaaaaguaucgggugccaacugugauuuuuagaagaacuguuguaaagccuuuga

SEQ ID NO: 89798 - RNA, 64 nt, hsa
cuaaguauaaagauuuaaauuauuuuuaauacgguuuuuagaaccacagacuaucccucuuuuu

SEQ ID NO: 89799 - RNA, 64 nt, hsa
uuaauacgguuuuuagaaccacagacuaucccucuuuuuagagcauccugaucaauugcaagua

SEQ ID NO: 89800 - RNA, 64 nt, hsa
aucccuuuucuccccaccuccacacacuacauuuuuuuuagauuuaaauaguuuuacuauuuua

SEQ ID NO: 89801 - RNA, 64 nt, hsa
auuuagaggguaacuuaaaucaguuauuuuuagcuuuuuagaacuuugaucugcuagggauugu

SEQ ID NO: 89802 - RNA, 64 nt, hsa
uagugaaauaguuacuauuucaugaaaguagauauuuuuagaauuuuugaaauaccacaguugu

SEQ ID NO: 89803 - RNA, 64 nt, hsa
uccuuucgauauaaaacucuuugaagaaauaugauuuuuagaaaucagcuacccauuauagcac

SEQ ID NO: 89804 - RNA, 64 nt, hsa
cccaaauaaucaagggugaagguaaaauaauacauuuuuagacaagcaaagacucagggguuac

SEQ ID NO: 89805 - RNA, 64 nt, hsa
agcaauucgauguuuaaguauguaaguucuuuuuuuuuuagacagcguuucgcucuuguugccc

SEQ ID NO: 89806 - RNA, 64 nt, hsa
uauauguuguuguuguuguuuuaaacccauuuuuuuuuuagaauuuucauuaauacuguaguua

SEQ ID NO: 89807 - RNA, 64 nt, hsa
uguuuuucuuuagauuuauaaauuugagcuauuuuuuuuagaggugcuuuuuaaaaauccaaua

SEQ ID NO: 89808 - RNA, 64 nt, hsa
cagaagaaaaaccuguuaaauucaaguauuaaaauuuuuagaucaaaaaggcaaaugauuuuau

SEQ ID NO: 89809 - RNA, 64 nt, hsa
ugagagcuacuucgcccaaauuacaaaaugaguguuuuuagauucaagugacaguaaaaggauu

SEQ ID NO: 89810 - RNA, 64 nt, hsa
acauggaauucucugauuuugagccgaacaugaguuuuuagacuguaucuugacaugagguucc

SEQ ID NO: 89811 - RNA, 64 nt, hsa
ugccaccacccccaguuaauauuuuuuuuaauuuuuuuuagaggcaggaucuugcuguccaauu

SEQ ID NO: 89812 - RNA, 64 nt, hsa
aucuugaagugaaaccaccacaauggccauuuuuuuuuuagauggaguuuugcaguggugcaau

SEQ ID NO: 89813 - RNA, 64 nt, hsa
gacuacaguuucgugugccaccaugccuggcuaauuuuuagaauuuuuuguagggacagggccu

SEQ ID NO: 89814 - RNA, 64 nt, hsa
cagcuugucagagacuuccuauggaagaaagaauuuuuuagauacuaucauuagguuggauaug

SEQ ID NO: 89815 - RNA, 64 nt, hsa
uauuaaaguacguuucaauguugggugaauuuuguuuuuagaugccaauaaaacuuauuuguuu

SEQ ID NO: 89816 - RNA, 64 nt, hsa
ucuuguauguagaggcuauuuuuaaaucauuaaauuuuuagaucucuguuuucauagccacugg

SEQ ID NO: 89817 - RNA, 64 nt, hsa
ugagugguucagucaugagguuuuccaaaagauguuuuuagaguuguaaaaaccauauuugcag

SEQ ID NO: 89818 - RNA, 64 nt, hsa
gcucacuucaauaacuauuuucugagacugaaguuuuuuagacaagaauaagaaaacuuugcuu

SEQ ID NO: 89819 - RNA, 64 nt, hsa
cugagaauuagcuaaauggaggcuaguguauuuauuuuuagagguacauguuuuaaguaaaugu

SEQ ID NO: 89820 - RNA, 64 nt, hsa
acaaucuggaaacugugagcccauaaaacaguauuuuuuagaaguuguguuacaacuguagcaa

SEQ ID NO: 89821 - RNA, 64 nt, hsa
cucugugauugugaauugcaguucaguucuuguguuuuuagacuguuagacaaaagugcucacg

SEQ ID NO: 89822 - RNA, 64 nt, hsa
uggaaacagagcaaaagaacaacccuaguaccuuuuuuuagaaacaguacgauaaauuauuuuu

SEQ ID NO: 89823 - RNA, 64 nt, hsa
augcaugggauaugcacccagguuucuuuuacaguuuuuagaaucguuuuuagaggguggugug

SEQ ID NO: 89824 - RNA, 64 nt, hsa
ugcacccagguuucuuuuacaguuuuuagaaucguuuuuagaggguggugugucugacaccaug

SEQ ID NO: 89825 - RNA, 64 nt, hsa
caacaagaagaaaaccaacccaaaccagugaaguuuuuuagaaccuuuagaaggguggucuuua

SEQ ID NO: 89826 - RNA, 64 nt, hsa
gguuggcucuuacacccauuccaaaugcaguuuauuuuuagacccgauugcaaauagugaugua

SEQ ID NO: 89827 - RNA, 64 nt, hsa
ccuuuccguuggggaugggggcaagggugggagguuuuuagaagaguauauaucucuuuaaaaa

SEQ ID NO: 89828 - RNA, 64 nt, hsa
ucauggccccuguagccaggguuaaaaacuggacuuuuuagaaguaaaguaaaagcauaucgcu

SEQ ID NO: 89829 - RNA, 64 nt, hsa
uacagaauguucacagcaaaacacguuuggucuguuuuuagauucuugaagaauucaauagucu

SEQ ID NO: 89830 - RNA, 64 nt, hsa
auuauuugaugugacaugaacucaaaauccugcauuuuuagauuccuuuuaguucuaauugagg

SEQ ID NO: 89831 - RNA, 64 nt, hsa
gcccuuuuuuauuugcccucugcgauccaccugcuuuuuagaagucugccgagugagaaggcca

SEQ ID NO: 89832 - RNA, 64 nt, hsa
auuuugcuuuuuaugucucccauaagaaaugugcuuuuuagagcuuccuaaugcauguguugca

SEQ ID NO: 89833 - RNA, 64 nt, hsa
aggacgaggccuucaagccugccccucuucugcuuuuuuagacaguauuuuuagagcuggaaag

SEQ ID NO: 89834 - RNA, 64 nt, hsa
caagccugccccucuucugcuuuuuuagacaguauuuuuagagcuggaaagaaauuuucuagcc

SEQ ID NO: 89835 - RNA, 64 nt, hsa
ugaggaauuuuuaaauauucuuuuuuuuuuccuauuuuuagacaucaauucuauagauucugac

SEQ ID NO: 89836 - RNA, 64 nt, hsa
agggauuugggaugaagugaagaggucaaauuacuuuuuagaagaagggaaucuaaaaaccauc

SEQ ID NO: 89837 - RNA, 64 nt, hsa
uggauucugaauauaauaaauucaaaguacccuuuuuuuagaguuucuaauaaaguaguaugua

SEQ ID NO: 89838 - RNA, 64 nt, hsa
cuuuuaaauaagaaguccacacaagcaagccaaauuuuuagaugacgaaguccauaaauaacua

SEQ ID NO: 89839 - RNA, 64 nt, hsa
uguuaugcuauaccaaucugcaguaaaaaaaauuuuuuuagaugauucuauauaacuucgucuc

SEQ ID NO: 89840 - RNA, 64 nt, hsa
uuuuucuuuuuuucccuaagugaucaacaucaaauuuuuagaauuaaaauacauuuaacucagg

SEQ ID NO: 89841 - RNA, 64 nt, hsa
gaaccaaaauaagacuuacuaaaggaagagugaguuuuuagaagagaacuuuacgagcgugaca

SEQ ID NO: 89842 - RNA, 64 nt, hsa
uaaaauauaggcauauaccucauauauacauguguuuuuagaacauuuagaaacaauugauugc

SEQ ID NO: 89843 - RNA, 64 nt, hsa
gagguuuucacucauaaauuuaaaccaguguauuuuuuuagaacugguuuguguauauauauag

SEQ ID NO: 89844 - RNA, 64 nt, hsa
accaaaaggauauucugaaaaauggccaacaauuuuuuuagaaguagcaucccaagcagcgugc

SEQ ID NO: 89845 - RNA, 64 nt, hsa
ccagcuuuugguauuucauuguuaccaaguucuauuuuuagaauaaaauuguucuccuucuaaa

SEQ ID NO: 89846 - RNA, 64 nt, hsa
uuuagaauaaauucuuagaaaguuuugagaggaauuuuuagagaggacauuuccuccuuccuga

SEQ ID NO: 89847 - RNA, 64 nt, hsa
uuuugaaggcucaggagcauccauaggcauuugcuuuuuagaaauguccacugcaauggcaaaa

SEQ ID NO: 89848 - RNA, 64 nt, hsa
cccauauuauuuacaaugucuugauaauucuaccuuuuuagagcaagaauaguaucugcuaaug

SEQ ID NO: 89849 - RNA, 64 nt, hsa
aaguaaugauuucuugauaauuguguaguaauguuuuuuagaacccagcaguuaccuuaaagcu

SEQ ID NO: 89850 - RNA, 64 nt, hsa
uucaaacaguauauaacuuuuuuuaggggauuuuuuuuuagacagcaaaaacuaucugaagauu

SEQ ID NO: 89851 - RNA, 64 nt, hsa
auuuccugcucuuaauaaaauuacauugaauugauuuuuagagguaaugaaaacuuccuuucug

SEQ ID NO: 89852 - RNA, 64 nt, hsa
guaccucuguucuggaucugggcagucagcacucuuuuuagaucuuuguguggcuccuauuuuu

SEQ ID NO: 89853 - RNA, 64 nt, hsa
cagacaguauauguuuuaaacuuugauguaaaccuuuuuagacccaaacuuguggaaguaucau

SEQ ID NO: 89854 - RNA, 64 nt, hsa
cucaaaguuuugaagucagugggaaaaaaggagguuuuuagacuuucuuaaaagacguuaaaau

SEQ ID NO: 89855 - RNA, 64 nt, hsa
agaauggaaaaugacugaaauccaauuuagauuauuuuuagaguauuuuuccagcaaauucaau

SEQ ID NO: 89856 - RNA, 64 nt, hsa
acuauucaaaaauuaacauuuucaucucaguaaguuuuuagaacaucaaaauguuuucugagcu

SEQ ID NO: 89857 - RNA, 64 nt, hsa
ccaacuguuaacuggaagcuuuugauaauuuuuuuuuuuagaacaauuuggaacauuaaaauuu

SEQ ID NO: 89858 - RNA, 64 nt, hsa
ggugaacucuggaagcagggauugugucuggcucuuuuuagagcuggaaauguaguggcuuuca

SEQ ID NO: 89859 - RNA, 64 nt, hsa
ucgcuauagaauaaugcauuaauaaaaugaggcuuuuuuagaggaagaccaaaaaauucaaugu

SEQ ID NO: 89860 - RNA, 64 nt, hsa
uggagauguaaguuguugguuuuguuuuguuuuguuuuuagaaaaauauauauaaauauauaau

SEQ ID NO: 89861 - RNA, 64 nt, hsa
ucccuacauuugugcuugguggcccuauuuuuuuuuuuuagagaggccuugagacauacagguc

SEQ ID NO: 89862 - RNA, 64 nt, hsa
aaaguuggggguggguugcaaaauguucuuucaguuuuuagaaccuccauuuuauaaaagaauu

SEQ ID NO: 89863 - RNA, 64 nt, hsa
ggcucuaggggagaauucauuucuggccuuuucauuuuuagaggcugaccguaauucuugacuu

SEQ ID NO: 89864 - RNA, 64 nt, hsa
gcguguuugauauuguuaauauaauaauaauuauuuuuuagaguacugcuuuuguauguauguu

SEQ ID NO: 89865 - RNA, 64 nt, hsa
aaguacugaaauaaugagugaccaauuugaaggauuuuuagauuauuuaaucuuugcuuauguu

SEQ ID NO: 89866 - RNA, 64 nt, hsa
uacccauugaagggguuccuuuuccauugcucaguuuuuagaaaauaauucucaucuuuuuucu

SEQ ID NO: 89867 - RNA, 64 nt, hsa
ucauuuuuaauauccugaacugaaugauaguguuuuuuuagaugaagaacugaugucagccugc

SEQ ID NO: 89868 - RNA, 64 nt, hsa
cugagcauggcugaaguauuaaaauguuuaauauuuuuuagagcaaaauuguuggaaagcauuu

SEQ ID NO: 89869 - RNA, 64 nt, hsa
gagguuuaagaacaugaagauucuaaaaggucaguuuuuagagauagaucuauaguugcauugu

SEQ ID NO: 89870 - RNA, 64 nt, hsa
acucagguggggagcucauggugccgcuggggacuuuuuagagaaauguaaagagaauagcuau

SEQ ID NO: 89871 - RNA, 64 nt, hsa
ccuccuuccggccaauggcagaagugggggaaaauuuuuagaagaaaagcaaacaugugagacc

SEQ ID NO: 89872 - RNA, 64 nt, hsa
uaacuuuguuggcaauauuugccguguagaauuuuuuuuagauauccauuguaaauuugaaaca

SEQ ID NO: 89873 - RNA, 64 nt, hsa
ugcuguggcauauuuugcuuuauuuaaaaauuuuuuuuuagagaugaguucuugcucugucacc

SEQ ID NO: 89874 - RNA, 64 nt, hsa
cauaugccagaauauaagagcaaguguuaucuacuuuuuagaugggaauugcagaagcugcauc

SEQ ID NO: 89875 - RNA, 64 nt, hsa
uuaauuccucaggguuuuaauuuaaacuaguauuuuuuuagauuauuuguuuuaggugauuuaa

SEQ ID NO: 89876 - RNA, 64 nt, hsa
ggugaagagguccagaaugauaugcaaaaacuacuuuuuagagaaacaaaacaacuuuguagca

SEQ ID NO: 89877 - RNA, 64 nt, hsa
cacgagccacugguuauuggauuuuuuuucuuuuuuuuuagacagaguuuugcucuuguugccu

SEQ ID NO: 89878 - RNA, 64 nt, hsa
aaggcaauucaguaucucccucucuuaaagucuguuuuuagacuucauggucauucuguaugua

SEQ ID NO: 89879 - RNA, 64 nt, hsa
ucaucaccaugccuagcucauuuaaaaaaaaauuuuuuuagagauggggucucacuauguuucc

SEQ ID NO: 89880 - RNA, 64 nt, hsa
aaucuaacccauuucugauauacugaaugguaaauuuuuagagacccagaucucggaggcuaca

SEQ ID NO: 89881 - RNA, 64 nt, hsa
uaaaagagcuaacguucuuauuaaggcuuugugguuuuuagaguugcaucuaugaaccugggga

SEQ ID NO: 89882 - RNA, 64 nt, hsa
aaauuucaauacagauacuucuuuuagaaguaaauuuuuagauuuuauugucaguagaaaaaag

SEQ ID NO: 89883 - RNA, 64 nt, hsa
augacaaaucucuguccccugaguguuaauuugauuuuuagaaauggccaaaagucacgugauc

SEQ ID NO: 89884 - RNA, 64 nt, hsa
auuuuuaugauuucuaaaguaacaauaaaagcaguuuuuagaguugaguuccagagagggcagg

SEQ ID NO: 89885 - RNA, 64 nt, hsa
ucuagguauaugcuuucucucugcugugaaauuauuuuuagaauuauaaauucacgucuuguca

SEQ ID NO: 89886 - RNA, 64 nt, hsa
uguguauuugauaaauauuucuuccuacauuauauuuuuagaauauuucagaaauauacauuua

SEQ ID NO: 89887 - RNA, 64 nt, hsa
gauuauuugccaucauuaguaccucucaacuuacuuuuuagaggacaagaaacaaucuguagau

SEQ ID NO: 89888 - RNA, 64 nt, hsa
aaaauguucaccagaugcaagaauguaccuuuucuuuuuagaaagccaaauguacuuuagacau

SEQ ID NO: 89889 - RNA, 64 nt, hsa
cauuuuaaacugcugauauuggauauaaugcugcuuuuuagagacaccuaaauugcaguaucag

SEQ ID NO: 89890 - RNA, 64 nt, hsa
aagccaaaugcuuaaacugaucaaugacuguagcuuuuuagacuguuggucaaagaacauucua

SEQ ID NO: 89891 - RNA, 64 nt, hsa
ccauucucccugcauccuuguccuugcaggugcuuuuuuagaugcuccaauaugucuucuuuug

SEQ ID NO: 89892 - RNA, 64 nt, hsa
ugaaauaucaauggguuugcauaucuaggcccuuuuuuuagaccaaugccuaugccauccucca

SEQ ID NO: 89893 - RNA, 64 nt, hsa
auugaaaaaaauauaugauuguauaaugugauuuuuuuuagaauagggggaaccuuauuuauuu

SEQ ID NO: 89894 - RNA, 64 nt, hsa
cucuuaauucucagccaugugcuuauuauauuucuuuuuagauugucuaucuguauaacacaca

SEQ ID NO: 89895 - RNA, 64 nt, hsa
aaauuguuccaugcugguggaaagauagagauuguuuuuagagguugguuguuguguuuuagga

SEQ ID NO: 89896 - RNA, 64 nt, hsa
uuuuuauaaguauguauuacuuuuguaaucagaauuuuuagaaaguauuuugcugauuuaaagg

SEQ ID NO: 89897 - RNA, 64 nt, hsa
gucagaauuguuuuugaaagccuaagaacccagcuuuuuagaaaggauuuucacacuggcauuu

SEQ ID NO: 89898 - RNA, 64 nt, hsa
caaugcuugcuuuuauuuuaaccaucuuuuacuauuuuuagaaggaaacuagcuuuaguagugg

SEQ ID NO: 89899 - RNA, 64 nt, hsa
uucuuauguuguguuacuaauguaauuuauauuuuuuuuagauccucccuuuccuauagagaua

SEQ ID NO: 89900 - RNA, 64 nt, hsa
acaagcccaccgcuucuguacaugucuaaauauauuuuuagaaguggguaggauugugaauuuc

SEQ ID NO: 89901 - RNA, 64 nt, hsa
ugcugaaagugaggaugaggauacagaguugauauuuuuagaaacaguaauuuuacuuuuaagg

SEQ ID NO: 89902 - RNA, 64 nt, hsa
ugaaaaauguuggugguuuuugugauuauuuauuuuuuuagauuucuuuucuuuugcacuacaa

SEQ ID NO: 89903 - RNA, 64 nt, hsa
ccacauuuggaauacuuuuuguuaucagucaauauuuuuagauaguuagaaccugguccuaagc

SEQ ID NO: 89904 - RNA, 64 nt, hsa
cgacuaauuucaaaaugcuuuuuauuauuauuauuuuuuagacagucucacuuugucgcccagg

SEQ ID NO: 89905 - RNA, 64 nt, hsa
gccacacagggccggugcugcuuuauuucagacucugccccagguuccaggaauccgaaccccg

SEQ ID NO: 89906 - RNA, 64 nt, hsa
cgaacacugcgguccuugccaaaguaaaaugaagcugccccaggacaagggguuaccaugagcu

SEQ ID NO: 89907 - RNA, 64 nt, hsa
cucggcucaccucuuccuccaagccccgcccccucugccccacgugccggcccuccuggugcuc

SEQ ID NO: 89908 - RNA, 64 nt, hsa
cagggcuggaaguccuugcccacuucccacucuccugccccaaucuaucuaguacuucccaggc

SEQ ID NO: 89909 - RNA, 64 nt, hsa
auggcaaaugaauggcacaccauuucuccuucuccugccccagggcagguaccacugaucugca

SEQ ID NO: 89910 - RNA, 64 nt, hsa
agggccaaggccugcugagcugauucuccagcugcugccccagccuuuccgccuugcacagcac

SEQ ID NO: 89911 - RNA, 64 nt, hsa
ccaccuuacccuuauuccucucuguccacauuuucugccccaccuuacuucuccucccugacag

SEQ ID NO: 89912 - RNA, 64 nt, hsa
cccugcccuuuuuccuugacuguucauuuuuuuccugccccacugcuugggauggggaguugca

SEQ ID NO: 89913 - RNA, 64 nt, hsa
auaaauauauaaagcuauauuuucaggcuccugccugccccaggcccccugccccacucccauc

SEQ ID NO: 89914 - RNA, 64 nt, hsa
cuauauuuucaggcuccugccugccccaggcccccugccccacucccaucucuucuucccugcc

SEQ ID NO: 89915 - RNA, 64 nt, hsa
acaccugguggauaccugguugaguguguggucucugccccagccuguccuugucacgaucaca

SEQ ID NO: 89916 - RNA, 64 nt, hsa
gccccaccucccccuuccccuacccaacccugcccugccccaccccaccucacagcuacucagu

SEQ ID NO: 89917 - RNA, 64 nt, hsa
uacccagcuccuuuuguccccagggccccucccucugccccaagcagccagccagucuugccua

SEQ ID NO: 89918 - RNA, 64 nt, hsa
agaacaagucacagcugcagcugggccccaugcucugccccaagcccccaaccccgcggugcuc

SEQ ID NO: 89919 - RNA, 64 nt, hsa
ccauuguaagcaagugccuugggcgagcuggccucugccccacagucucaucuguacaccgaca

SEQ ID NO: 89920 - RNA, 64 nt, hsa
agcuguguuguaaaccaggucccccuccugaccucugccccacuccaggaauggagcucuuccc

SEQ ID NO: 89921 - RNA, 64 nt, hsa
gaaguguggagucagaaugcaaacccagaucagucugccccaaaguccacuacaccagcugcca

SEQ ID NO: 89922 - RNA, 64 nt, hsa
gcagcaggguccuugagagaacaggggagcaagccugccccaguacccaaaaaacaauggcuau

SEQ ID NO: 89923 - RNA, 64 nt, hsa
agauacaccagcucacaaaugaaaacgucagccucugccccacccucccuccugcccaaaguga

SEQ ID NO: 89924 - RNA, 64 nt, hsa
cacuaaccccacuucuguguguucugcauggcgccugccccagggcaucugccaacuccaguau

SEQ ID NO: 89925 - RNA, 64 nt, hsa
cagggccuugcccagauagacagggcuggcucugcugccccaaccuuucaaggaggaaaccaga

SEQ ID NO: 89926 - RNA, 64 nt, hsa
ggggagaagcagcauugaagugggaagauuuaggcugccccagaccauaucuacuggccuuugu

SEQ ID NO: 89927 - RNA, 64 nt, hsa
uaccauacugucucuggagugaugguguccuucccugccccaccacgcaugcucagugccuuuu

SEQ ID NO: 89928 - RNA, 64 nt, hsa
gaggccgucacuggaguggcgucugcagcagcugcugccccagcacccgcucagccuguccugg

SEQ ID NO: 89929 - RNA, 50 nt, hsa
ccaggccccgguggcgguaacugccccaaggccccagggacagaggccaa

SEQ ID NO: 89930 - RNA, 64 nt, hsa
ugaccuccugucacucacugaggccaucagggcccugccccaggccuggacgggcccuccuucc

SEQ ID NO: 89931 - RNA, 64 nt, hsa
gccuguggguuuccauggcuucccagagcucccucugccccagccagcgccuccaggcccagcu

SEQ ID NO: 89932 - RNA, 64 nt, hsa
ccugccuccugcuugcgggggccgccuguccucacugccccaggcugcggcuugcccagucccg

SEQ ID NO: 89933 - RNA, 64 nt, hsa
agccuggacccccagcuuugcccaacaccagccccugccccagcccaaguccaaauguuuacag

SEQ ID NO: 89934 - RNA, 64 nt, hsa
cuguuccagacaacugccaacgucacugagggcccugccccagcggcccuggccccaggcucua

SEQ ID NO: 89935 - RNA, 64 nt, hsa
gucagguggucaauguccuggugauuuuaugagacugccccacugagaaaacuuacuuacuuca

SEQ ID NO: 89936 - RNA, 64 nt, hsa
ugucacaaucccuuucagaaaacauuaguggccgcugccccagcuacagagacggccgaaaugc

SEQ ID NO: 89937 - RNA, 64 nt, hsa
gauggcccacuuuuguuuauauaaauaagagcuucugccccaccugcagacauguuuacuaaug

SEQ ID NO: 89938 - RNA, 64 nt, hsa
ugaccagcuccuccagucaugcucuugucccucacugccccaguaagcuggaggcugcuccaga

SEQ ID NO: 89939 - RNA, 64 nt, hsa
auuccaacuucugccuguggagagauuuucugcccugccccaccagggcccugcauguuggaga

SEQ ID NO: 89940 - RNA, 64 nt, hsa
ugggggggacccugccucagcugacccggccucucugccccacccaagcccaaacuugguuucu

SEQ ID NO: 89941 - RNA, 64 nt, hsa
caccucacccggccucuucgccuuucccacccuccugccccacacuccccgccuuagagccucg

SEQ ID NO: 89942 - RNA, 55 nt, hsa
acgccucucgccgccucugagcacccugccccaccccaccuccacucccaccuca

SEQ ID NO: 89943 - RNA, 64 nt, hsa
agacaaccacagauccuacaggacugucugucuccugccccaugaugacccucaggaauugcaa

SEQ ID NO: 89944 - RNA, 64 nt, hsa
gacuauuacccaagagagguauccucagccccuccugccccaggucgggagacagcagcuuugg

SEQ ID NO: 89945 - RNA, 64 nt, hsa
gucuucccaucacaugaagacaucagguuggguccugccccacugccccucccccuguuccugc

SEQ ID NO: 89946 - RNA, 64 nt, hsa
guuggguccugccccacugccccucccccuguuccugccccaagccgucaaucagauuguggag

SEQ ID NO: 89947 - RNA, 64 nt, hsa
ugggcgcuuuggagguuugccccucacccaccagcugccccaucccugaggcagcgcuccaugg

SEQ ID NO: 89948 - RNA, 64 nt, hsa
agugacagccgguguccuggaaagcccccagcagcugccccagggacaugggaagaccacggga

SEQ ID NO: 89949 - RNA, 64 nt, hsa
ggaagaaaaagcaucagggggaaauggaaugccccugccccaggaacauggcagaagcacaggu

SEQ ID NO: 89950 - RNA, 64 nt, hsa
cugucugcaggugaaacaggagggcuguuugccucugccccauccccccgacuguguucaggag

SEQ ID NO: 89951 - RNA, 64 nt, hsa
ucgcccugugccaccccaacugugccugauagaccugccccagcguuccugacuucuugcuggc

SEQ ID NO: 89952 - RNA, 64 nt, hsa
cccuccgucccacuccacuccaggcugccggcaccugccccauucccuggccugguuuccuaac

SEQ ID NO: 89953 - RNA, 64 nt, hsa
ccauucugcggccugguucugcaaggaaccagggcugccccaccgcccgccgucugccgcccua

SEQ ID NO: 89954 - RNA, 64 nt, hsa
ucggucuacucaggugugagggggcaggucugaccugccccaaaguuggcuccauccuggacaa

SEQ ID NO: 89955 - RNA, 64 nt, hsa
ccgaaccgugaauguagggcccccagccucaccucugccccaggaccaacaacacccugguuug

SEQ ID NO: 89956 - RNA, 64 nt, hsa
gccacccaccggacccucgcacgccgugccaggccugccccagacgcgucugcaggccgcuugc

SEQ ID NO: 89957 - RNA, 64 nt, hsa
cccaagggccuggacaccccuccccaggcaggugcugccccaggaggacuguccucgggaauga

SEQ ID NO: 89958 - RNA, 64 nt, hsa
ccaagcaacauuugcuccugcccuggggccagcucugccccagcccugagagggguggugaggc

SEQ ID NO: 89959 - RNA, 64 nt, hsa
acagcuuugcaccccggcaucagcacaggggucccugccccacccuccggcagcucagggagug

SEQ ID NO: 89960 - RNA, 64 nt, hsa
caaauacagcucuuucuagcaaaaucaggcagcucugccccaucgguaggggcaccgauuaguc

SEQ ID NO: 89961 - RNA, 64 nt, hsa
ucaggcuguugccauggaaguucagggccauagacugccccacuuaaacucuugucagucuggg

SEQ ID NO: 89962 - RNA, 64 nt, hsa
gccaggguccccugggaagaugcccccaagacaccugccccaaguggguggauaucugccuucc

SEQ ID NO: 89963 - RNA, 64 nt, hsa
agaugcacuagaagaccuucauccuccccuuccucugccccaagucacuacaguugguucuauu

SEQ ID NO: 89964 - RNA, 64 nt, hsa
cugaggggaucaggcuuuucuacuccaggcaaaccugccccaucuugucgcuuuuaggaccucc

SEQ ID NO: 89965 - RNA, 64 nt, hsa
ggucccaggucaggcccacccccugcaccuccaccugccccagccccugccucugccccaagug

SEQ ID NO: 89966 - RNA, 64 nt, hsa
cccccugcaccuccaccugccccagccccugccucugccccaaguggggccagcugcccucacu

SEQ ID NO: 89967 - RNA, 64 nt, hsa
ggguugggguuucugccacuuccgggucuaggcccugccccaaauccagccaguccugccccag

SEQ ID NO: 89968 - RNA, 64 nt, hsa
ccgggucuaggcccugccccaaauccagccaguccugccccagcccacccccacauuggagccc

SEQ ID NO: 89969 - RNA, 64 nt, hsa
acagcccagccugagcucugggugggaaagcagccugccccaugcuuccagccugcagaacaca

SEQ ID NO: 89970 - RNA, 64 nt, hsa
uuuggugcacucaggcauggcugggacaagccagcugccccaggguucuuccccuggugauucu

SEQ ID NO: 89971 - RNA, 64 nt, hsa
ggagaaggcucugcucagcccugagagucccuuccugccccaccgauacuggcacuuuaaaaag

SEQ ID NO: 89972 - RNA, 64 nt, hsa
ccuccucgcccuggugaggggaggugcugcuuuucugccccaccugccggcugguuccagcagc

SEQ ID NO: 89973 - RNA, 64 nt, hsa
ggauacucuuggagaguuguucccccagggggcucugccccaccuggagaaggaagcugccugg

SEQ ID NO: 89974 - RNA, 64 nt, hsa
ugcuggcaaaggcuggcuguguauacccacuaggcugccccacgugcucccgagagaugacacu

SEQ ID NO: 89975 - RNA, 64 nt, hsa
aguuagucaccgcuguguguguugcagugugccucugccccaugggcccgagagaagcugacaa

SEQ ID NO: 89976 - RNA, 64 nt, hsa
ccacaugccacucgcugccuugucccacagcuugcugccccauuucuuugcuccuggcaccucg

SEQ ID NO: 89977 - RNA, 64 nt, hsa
cauuagcaucugacacagccaaccugaauacuuccugccccaggcggucaggguuauggcacga

SEQ ID NO: 89978 - RNA, 64 nt, hsa
aacgccuccaagaccagcaggccaaggccaagcccugccccagauccucauaggcagagaagcc

SEQ ID NO: 89979 - RNA, 64 nt, hsa
ccugccaccucccaccuagaggagaccaugggcccugccccacccacuccaggauguuaggguc

SEQ ID NO: 89980 - RNA, 64 nt, hsa
cccacacugcaggaggauuugucucuaagaggugcugccccaaagcuccccaagcaucaauacu

SEQ ID NO: 89981 - RNA, 64 nt, hsa
cuguuuuugcuauggcuguaaagguauuuuuccucugccccacucccugccauaccuuuauccu

SEQ ID NO: 89982 - RNA, 64 nt, hsa
cagagaaggauguccguuccaggagcacacggcccugccccauccugggccuuaccuccccugc

SEQ ID NO: 89983 - RNA, 64 nt, hsa
aagccugugccaccugcaagugcccgcccugccccugccccaacccccaccgaagagcccugag

SEQ ID NO: 89984 - RNA, 64 nt, hsa
gggagcccagaacuugcaguaacccuuuaggguccugccccaggcccagccagggcugaggagc

SEQ ID NO: 89985 - RNA, 64 nt, hsa
caggcggcccgcuucccauuucucaaaccccgcucugccccauuguucuccuuucccuuauacu

SEQ ID NO: 89986 - RNA, 64 nt, hsa
ggaaggcaggaggguccccugcccugccccaguccugccccagggaggcaggggguggggggcc

SEQ ID NO: 89987 - RNA, 64 nt, hsa
cuuuggcuccuggaaggcaggaggguccccugcccugccccaguccugccccagggaggcaggg

SEQ ID NO: 89988 - RNA, 64 nt, hsa
uguggaccugucuguuacggagucacacuggccccugccccagccagaggugacucagugccuc

SEQ ID NO: 89989 - RNA, 59 nt, hsa
cggaccccagcgggcucugaaccuggccccugccccaccagccccuucucugguagccc

SEQ ID NO: 89990 - RNA, 64 nt, hsa
agccaggccucccgcaugcugccugccuccggcccugccccacacaggccuggcccagccagca

SEQ ID NO: 89991 - RNA, 64 nt, hsa
gugugccugcuauccagccgcaaauccauacccccugccccagagaagccucagucccucccuc

SEQ ID NO: 89992 - RNA, 64 nt, hsa
cuucagaauuccauaucuugcgaauccaagcucccugccccaaauaacuucaguccugcuccag

SEQ ID NO: 89993 - RNA, 64 nt, hsa
acccacgauuuucuccagcucagaacccagggcucugccccagucguuagaauauaggucucuu

SEQ ID NO: 89994 - RNA, 64 nt, hsa
ccuccccaacccaccucaugccaccgccaacccccugccccaggagcgggccugagccacgucc

SEQ ID NO: 89995 - RNA, 64 nt, hsa
gugccaggaggcaccugaguucucugcuguuauccugccccaagggccugggccgagccucuac

SEQ ID NO: 89996 - RNA, 64 nt, hsa
cgcucugcugguuuuagucggcugacuuucucaacugccccagccucuccugcucucucagaac

SEQ ID NO: 89997 - RNA, 64 nt, hsa
ccugccccagcacuucccagccuuuccaggagcucugccccaccccuacucaaggagucaggug

SEQ ID NO: 89998 - RNA, 64 nt, hsa
ugaagggcacagcugcuggcaaaugccccauucccugccccagcacuucccagccuuuccagga

SEQ ID NO: 89999 - RNA, 64 nt, hsa
ugcagauccagagguuucuggcagccaguaccuccugccccaugcugcccgcuucucacccuau

SEQ ID NO: 90000 - RNA, 64 nt, hsa
gggaccucaaaggugauugugccaggcucugcgccugccccacacccucccuuacccuccucca

SEQ ID NO: 90001 - RNA, 64 nt, hsa
cuggggcuggaaauguuaggagguugccuuggugcugccccagaucuguccagcagggggcagu

SEQ ID NO: 90002 - RNA, 64 nt, hsa
gggaagaaggugggagggcauuagucaagccggacugccccagucuuugacugguuacccuccu

SEQ ID NO: 90003 - RNA, 64 nt, hsa
caccccacccaccccugacauaccuacugucacccugccccaguccuaccccuuccucuccaug

SEQ ID NO: 90004 - RNA, 64 nt, hsa
uuugcuuugagucugauaugacagugauguggggcugccccagcugacuuggaggcccuggcuc

SEQ ID NO: 90005 - RNA, 64 nt, hsa
uagcaugauccgagacauccaggagacagagccccugccccauggcccuggaugucacacuccc

SEQ ID NO: 90006 - RNA, 64 nt, hsa
gcuugcccaggagugugccguguguggcugggcccugccccacaaccggguaagucccucccca

SEQ ID NO: 90007 - RNA, 64 nt, hsa
gccuagcaauguaucuucaggaaaacggcauugacugccccaaaugcaaguucucguacgcccu

SEQ ID NO: 90008 - RNA, 64 nt, hsa
ggccaggcucacagggacuccggcauagcagacccugccccagcaggcccccuuguccuuccug

SEQ ID NO: 90009 - RNA, 64 nt, hsa
ccccucucucugguucccagcaccugccugagaccugccccaggcacccauaaccuggaauucc

SEQ ID NO: 90010 - RNA, 64 nt, hsa
gucaaggucacaggcauccaugugugcaaaccaucugccccagcugccuccacagacugcuguc

SEQ ID NO: 90011 - RNA, 64 nt, hsa
uccacagacugcugucuccuuguccuccucggcccugccccacuucagggcugcugugagaugg

SEQ ID NO: 90012 - RNA, 64 nt, hsa
ggugaggugagugcucgagggaggggagugcuuucugccccaugccuccaacuacuguaugcag

SEQ ID NO: 90013 - RNA, 64 nt, hsa
cuccacaaccucgagccugggcucugguccacuacugccccagaccacccucaaagcuggucuu

SEQ ID NO: 90014 - RNA, 64 nt, hsa
gucaucuuggugcugugagagguaggagggcagccugccccaucuaggaaucugggaagggcug

SEQ ID NO: 90015 - RNA, 64 nt, hsa
guuugugagaauguggccgcccuuuuccugcccucugccccauguggguggggggccucguggc

SEQ ID NO: 90016 - RNA, 64 nt, hsa
gcugggaccuauguguuuguguggucguuccaaacugccccagggcuuugggggcggcacuugg

SEQ ID NO: 90017 - RNA, 64 nt, hsa
gggcccccaugccacagucuggcuuucccuccaucugccccaggacaagagcaagaaggacauc

SEQ ID NO: 90018 - RNA, 64 nt, hsa
gcucauggaugaauggcgagccaccuguugucagcugccccaagccucugggauauguggauuc

SEQ ID NO: 90019 - RNA, 64 nt, hsa
ccuucagacccggcugcaacuuccuaagcugccccugccccagcuccucucugcaacccagccc

SEQ ID NO: 90020 - RNA, 64 nt, hsa
ccugcggccgggcugcccuucgcugccaggacaccugccccagcgcggcuuggccgccauccgg

SEQ ID NO: 90021 - RNA, 64 nt, hsa
uuuuccuagcaucaguccgaaccaugcgcccgcccugccccaacugugugcugguccugcugug

SEQ ID NO: 90022 - RNA, 64 nt, hsa
ggagucagcuuucaagauugccugugccccugcucugccccauccuggcuggcagggcugcaug

SEQ ID NO: 90023 - RNA, 64 nt, hsa
uucagcauucuguucugcacugugggcuggcucucugccccaacccugggcacuggccccuggc

SEQ ID NO: 90024 - RNA, 64 nt, hsa
ggcgcccacccugggcuccacacagcaguguccccugccccagaggucgcagcuacccucagcc

SEQ ID NO: 90025 - RNA, 64 nt, hsa
aggagcugggggaaggcaggagccuuccuuucuccugccccaagggcccagacccugggcaaac

SEQ ID NO: 90026 - RNA, 64 nt, hsa
agugccguccacgacccugacagucccagcccugcugccccauggccacgugcccacagaugug

SEQ ID NO: 90027 - RNA, 64 nt, hsa
cagacggggcugcagagugacacuggcugggcaccugccccacgaccaaugacaaggauuucca

SEQ ID NO: 90028 - RNA, 64 nt, hsa
cuuucccaacacuucagacugcaagugagcaaaccugccccaucccgugcaaaacaugcuaccu

SEQ ID NO: 90029 - RNA, 64 nt, hsa
acuccuaggacauguucccuucuccuuccaacugcugccccaaaggaagcuuucucugcuucag

SEQ ID NO: 90030 - RNA, 64 nt, hsa
cuuguuuaauaucuuaagacuuccccucaacaugcugccccaguuaaucagcaaccugacucag

SEQ ID NO: 90031 - RNA, 64 nt, hsa
gacgcgagugcuggugacgcacggcauuagcuuccugccccagacagacuucaucauugugcua

SEQ ID NO: 90032 - RNA, 64 nt, hsa
uuccccuaagcagaaaacuggcccugcccugccccugccccauuuccuccucaucugauccccc

SEQ ID NO: 90033 - RNA, 64 nt, hsa
cagagaguggggaggcgucagcgccuggccagggcugccccaguccuuuggugcccggugagcg

SEQ ID NO: 90034 - RNA, 64 nt, hsa
uccugccaccccacccuuccucuguguguuaucucugccccacagcagccccugggcagcacca

SEQ ID NO: 90035 - RNA, 64 nt, hsa
ucuagacuugcaagggagaggaacagggaccaggcugccccacggucccugaaggguccaagga

SEQ ID NO: 90036 - RNA, 64 nt, hsa
ucuggaucuagcuguccuucuccgaguggcacgccugccccaggaugcccccuuucccuccccc

SEQ ID NO: 90037 - RNA, 64 nt, hsa
ccacugguaccuuuggggaagacuguggcucuaccugccccaccuguguucagggguccuguga

SEQ ID NO: 90038 - RNA, 64 nt, hsa
cccgagucuugccucaccccaggugugaagaccccugccccacugguaccuuuggggaagacug

SEQ ID NO: 90039 - RNA, 64 nt, hsa
gugccugcugcucagggcucgcccccggcgugggcugccccagugccuuggaaccugcugccuu

SEQ ID NO: 90040 - RNA, 64 nt, hsa
acagcuuugcugaaggccuggccagccuccuggccugccccaaguggcaggcccugcgcagggc

SEQ ID NO: 90041 - RNA, 64 nt, hsa
ugcugcaugucuggucuggggcuuggauguugcacugccccacugccugucccuucugguaaaa

SEQ ID NO: 90042 - RNA, 64 nt, hsa
gaauguccaguggucccagcuccccacccuggcccugccccagccuguguagcucuuccugcau

SEQ ID NO: 90043 - RNA, 64 nt, hsa
cucucuccuggacuggucuucccagcccuaaacccugccccaggaagcccacagccucaccugc

SEQ ID NO: 90044 - RNA, 64 nt, hsa
accccugccauuuaccagcagcccuggcauguuccugccccacaggaauagaauggagggagcu

SEQ ID NO: 90045 - RNA, 64 nt, hsa
aaguucaagcuggacugaagaccuuggagcgagucugccccaguggggauccugcccccgcccu

SEQ ID NO: 90046 - RNA, 64 nt, hsa
gagcagcaggccccgagccccuucaggcccagcacugccccagacucgcuggcacucaguuccc

SEQ ID NO: 90047 - RNA, 64 nt, hsa
agcagaaugccucccaggauuucacaccugagcccugccccacccugcugagaaaacacuccgc

SEQ ID NO: 90048 - RNA, 64 nt, hsa
gcuaguuacugauagccacaggaaguugagacuucugccccauucucuccaauggcugggugaa

SEQ ID NO: 90049 - RNA, 64 nt, hsa
agugggcccucguccccuccccccucccaauucucugccccaggcuaauauuagggacugggga

SEQ ID NO: 90050 - RNA, 64 nt, hsa
guggugucauuggcagagggucauuuuaggagagcugccccagccccucgaacgccuggcuugg

SEQ ID NO: 90051 - RNA, 64 nt, hsa
cgcggugaccccgcggcggccugagggacgcucccugccccaucccggcuguugggcugggccg

SEQ ID NO: 90052 - RNA, 64 nt, hsa
cugucccggugcugccccagccaggaucuggucgcugccccagggggacugaugggcagagucg

SEQ ID NO: 90053 - RNA, 64 nt, hsa
gaccuuaggcccauagagagggccugucccggugcugccccagccaggaucuggucgcugcccc

SEQ ID NO: 90054 - RNA, 64 nt, hsa
gcuuagaaaagcuaacaaggguguguccccuguccugccccaccgguuugcuggcuuuguaaua

SEQ ID NO: 90055 - RNA, 64 nt, hsa
acucuugcuauuuguaacuuggggauggucuccccugccccagggcacauaagagcaaaggcuc

SEQ ID NO: 90056 - RNA, 64 nt, hsa
uguagcucauaagacccucauuccagagagggugcugccccauacccggaaggaggaacgcugc

SEQ ID NO: 90057 - RNA, 64 nt, hsa
cucagaaaacggaaucucugucugugaccuucuccugccccauuucacuugcucaacaccagac

SEQ ID NO: 90058 - RNA, 64 nt, hsa
cugcagugucugaagcgccugccuccccacugcucugccccacccuccaaucugcacuuugauu

SEQ ID NO: 90059 - RNA, 64 nt, hsa
cuugagcaagggcaggggucccugagcuguucuucugccccauacugaaggaacugaggccugg

SEQ ID NO: 90060 - RNA, 64 nt, hsa
uccacgugcucgccucugcccagccugccccagccugccccagccucccagcuuucugugugca

SEQ ID NO: 90061 - RNA, 64 nt, hsa
agcagauggauccacgugcucgccucugcccagccugccccagccugccccagccucccagcuu

SEQ ID NO: 90062 - RNA, 64 nt, hsa
cccuucauuauggaccugggcccuaccggaaccccugccccaguuaccacaacucaggccggcu

SEQ ID NO: 90063 - RNA, 64 nt, hsa
gccaaggccccacagagcccaaaacagaagggggcugccccagcccagcagagcacagaguuuc

SEQ ID NO: 90064 - RNA, 64 nt, hsa
gcccuggccggggccgcgggauaucaauaucaggcugccccacuccacguuccccagcacaucc

SEQ ID NO: 90065 - RNA, 64 nt, hsa
cagcacaucccagguggugggagcagaggguacccugccccaccaggguccuuagggaugcucu

SEQ ID NO: 90066 - RNA, 64 nt, hsa
ugggcacuguccuuccaccugugccagccacccccugccccacugcugaaugaaggccauuuca

SEQ ID NO: 90067 - RNA, 64 nt, hsa
cagaugcaugaauguuugcgaauguugacugccacugccccacacacugugucuuuauagaauu

SEQ ID NO: 90068 - RNA, 64 nt, hsa
ccuucgagggccucugccccaugugcccuugaagcugccccacaaucauggagcccugcgaccu

SEQ ID NO: 90069 - RNA, 64 nt, hsa
cauccccuacugaggaggggaccuucgagggccucugccccaugugcccuugaagcugccccac

SEQ ID NO: 90070 - RNA, 64 nt, hsa
cauggugacugaggacagagacccagagugaccccugccccaccccugugcauuuccacggacu

SEQ ID NO: 90071 - RNA, 64 nt, hsa
gggucuggucuguucuggcaaugaugcagcccuccugccccagugucaggggaccugggaagcu

SEQ ID NO: 90072 - RNA, 64 nt, hsa
uuucugauucuucuugcaaucuccugaggauuaucugccccauuuuuaaaacgagguggaauac

SEQ ID NO: 90073 - RNA, 64 nt, hsa
uuuuauuugcaguccuuccauuuggaccuccuagcugccccaucaggucaucuccagggcucag

SEQ ID NO: 90074 - RNA, 64 nt, hsa
uugcccuuuuaaaacauugggauccuccaaaggccugccccauguauuuaacaguaauacagga

SEQ ID NO: 90075 - RNA, 64 nt, hsa
ucccugccauuuugccucuccugucucccacccccugccccagacccaggagccccccugaggc

SEQ ID NO: 90076 - RNA, 64 nt, hsa
gcagcuccacagggcagggccucauuauuuuucacugccccagacacagugcccaacaccccgu

SEQ ID NO: 90077 - RNA, 64 nt, hsa
agggcucccugcccugaccucuucccuggguuuucugccccagccuccuccuucccuccccucc

SEQ ID NO: 90078 - RNA, 64 nt, hsa
gacuuugccccucacacuggcccagccccucacacugccccaccccgagaacccucagcucuca

SEQ ID NO: 90079 - RNA, 64 nt, hsa
gccccagccucccugagggccugccgggcugccucugccccagcccccagcaagggcacuccca

SEQ ID NO: 90080 - RNA, 64 nt, hsa
cgagaaccugccguggaaacuuccaguugugcgucugccccacucgcuguguuuguccgugggu

SEQ ID NO: 90081 - RNA, 64 nt, hsa
auuuuggacgaggccuaaguagacccccuaugcccugccccagcccuggcucuuuccuaacccc

SEQ ID NO: 90082 - RNA, 64 nt, hsa
gcugagcagugauuguggccgcccccagccccugcugccccagccugugucuguucuccucgag

SEQ ID NO: 90083 - RNA, 64 nt, hsa
gccuucccguguggccugagggcugucgagugagcugccccagccccucccagcccuugcccag

SEQ ID NO: 90084 - RNA, 64 nt, hsa
gaggugggaaaacggacccaaaccccagugugcccugccccaugccuuuccuuuagugguggga

SEQ ID NO: 90085 - RNA, 62 nt, hsa
gugugaucuuugugucuccuuuuugccaagcacauucugauuuucuuguuggaacacagguc

SEQ ID NO: 90086 - RNA, 62 nt, hsa
ggaauaagaacuccauuucaaacaguucuggccauucugagccugcuuuugugauugcucau

SEQ ID NO: 90087 - RNA, 62 nt, hsa
cccccacccaccgcaagcuuugagugggacaccauucugaauuuuuuuucugaauuuuuuuu

SEQ ID NO: 90088 - RNA, 62 nt, hsa
ccuucuuccccaauaugccugcgccaucuucacauucugaaguugaaacccaugaucacccc

SEQ ID NO: 90089 - RNA, 62 nt, hsa
augcugaaaggcagcguuuuuuagacucuaaacauucugauuuugaagguggguguuggaac

SEQ ID NO: 90090 - RNA, 62 nt, hsa
cacagcaaggcuuuugugccuugcacuccaugcauucugauaacggcagcuuuccuaaaaag

SEQ ID NO: 90091 - RNA, 62 nt, hsa
aagaaggaaagaugguuaaacauuuucccacucauucugaauuaauuaauuuggagcacaaa

SEQ ID NO: 90092 - RNA, 62 nt, hsa
ggcaugcuuaaauuuuaacuaaauuuuaaagccauucugauuauugaguuccaguugaaguu

SEQ ID NO: 90093 - RNA, 62 nt, hsa
aaagguugugcucgcuacacugcuggugugugcauucugagaccucuuguauucaaucugug

SEQ ID NO: 90094 - RNA, 62 nt, hsa
aaguagagaaaaucaucaauaaauauuuauuacauucugacaggguguguggcauuguguuc

SEQ ID NO: 90095 - RNA, 62 nt, hsa
aaaaaugaucuguaguuuuuuuggugcuauaacauucugacacauaucauucugugauuaaa

SEQ ID NO: 90096 - RNA, 62 nt, hsa
gcccccuagggucuauaauuccuuaaaauuuucauucugaaucugaaggagagagucuuuua

SEQ ID NO: 90097 - RNA, 62 nt, hsa
aauaacaaagcaaaccaauauaauuauauggucauucugaccccagcucuuauacaaauuau

SEQ ID NO: 90098 - RNA, 62 nt, hsa
ugccuccuguuuauugagaacuaugcauugaacauucugaaucauucuaagccucuggagag

SEQ ID NO: 90099 - RNA, 62 nt, hsa
uaucggauuuaccuuaagcuucucuagugaggcauucugagcaguggugaucacaugccaga

SEQ ID NO: 90100 - RNA, 62 nt, hsa
ugauacaacuccccgaucuagauuuauuccuacauucugaauggggagcagguaagagcaga

SEQ ID NO: 90101 - RNA, 62 nt, hsa
guucaaaugccaaauagugauuagaagacgaccauucugaucugugugugaucuggucacua

SEQ ID NO: 90102 - RNA, 62 nt, hsa
cucuuuguauaugcaaauugcaagauuuaaaccauucugaugcaaggauaaaccuuuacuuu

SEQ ID NO: 90103 - RNA, 62 nt, hsa
ccuuugcauagcuggguugcagcugcgaaccucauucugacugugaacuaagcaagcuuuga

SEQ ID NO: 90104 - RNA, 62 nt, hsa
acacgucugugcccugaaggaacacuggccuccauucugacaucugggcuggggccucagga

SEQ ID NO: 90105 - RNA, 62 nt, hsa
agcagaccccugagaucugggcauaggcaccgcauucugaucuggacaaagucgggacagca

SEQ ID NO: 90106 - RNA, 62 nt, hsa
aaucaaaacaccgcaccagccagcagaauggacauucugacaucgccagccgacgcccugaa

SEQ ID NO: 90107 - RNA, 62 nt, hsa
ggaucauuuugauguugaauguucccccaaagcauucugacaaguuugguccacuuggcucu

SEQ ID NO: 90108 - RNA, 62 nt, hsa
gguuuuguaggcaggcuguaccugcaaauaggcauucugagcaaggauccuaaauuucccuu

SEQ ID NO: 90109 - RNA, 64 nt, hsa
cgaggcaagcagaagcagcggccgcagcgaagcugccguucauguguuggaggccaaauguggc

SEQ ID NO: 90110 - RNA, 64 nt, hsa
aacucccgagcacuaaguagacgggguagagucagccguucaugcuuuguggggaguucacagc

SEQ ID NO: 90111 - RNA, 64 nt, hsa
cauuuaaaaucugugaagcaaauccagacuccuugccguucagccacugugaaaccagaaucug

SEQ ID NO: 90112 - RNA, 64 nt, hsa
ccaacuuguuuccuccccucaaaguucugccuaagccguucaguucuaacauggucucaguuaa

SEQ ID NO: 90113 - RNA, 64 nt, hsa
aaggccccugccccacuuuuaguuccaacagaaugccguucacaagaucugggaggcacucucu

SEQ ID NO: 90114 - RNA, 64 nt, hsa
aucaauaagguccauucugcgcaguaucucaacugccguucaacaaucgcaagaggaaggugga

SEQ ID NO: 90115 - RNA, 64 nt, hsa
cuucccucaugguggcagccuaaccugcauugcagccguucaccggacaccgcaccagacccuc

SEQ ID NO: 90116 - RNA, 64 nt, hsa
acauuaacgaugacagggguagaaauucuucggugccguucagcuuacaaggaucagccaugug

SEQ ID NO: 90117 - RNA, 64 nt, hsa
gauaaagaguauggauaaucuuuggauuuggagagccguucaagauacuuccagcuucuuggcu

SEQ ID NO: 90118 - RNA, 64 nt, hsa
ccagugacuuuccuucccuuucacaugaggaucugccguucauguugcuuucuccuuuguccuc

SEQ ID NO: 90119 - RNA, 64 nt, hsa
ucuuugaccaaugcauaguuuggcagaaaaaucagccguucauuuagaagaaucuuagcagaga

SEQ ID NO: 90120 - RNA, 64 nt, hsa
acuacgugagcucagaagagcacugggcaccuaggccguucauggcuacucccuggggugggcu

SEQ ID NO: 90121 - RNA, 64 nt, hsa
ggcuccccgggucucucacuguugcaguggccuggccguucagccugucucccccaacaccccg

SEQ ID NO: 90122 - RNA, 64 nt, hsa
aggcacgcuccucagcuggucaccucccggcuuugccguucagauggggcuccugaggcucagg

SEQ ID NO: 90123 - RNA, 64 nt, hsa
ccaagaaaacguaugaguuucugauucuccgggagccguucaauggugagguugaugggaagac

SEQ ID NO: 90124 - RNA, 64 nt, hsa
ccuccaaacugcagcuggucuggcuuacuguuuugccguucaaaaaggucgcgaauccguggga

SEQ ID NO: 90125 - RNA, 64 nt, hsa
gacauuuaucgucaucaucugcucugaguggaaggccguucagagaggcuagagguucuuauuc

SEQ ID NO: 90126 - RNA, 64 nt, hsa
ucauuuauaauaagaaugaguuauucauuuguaagccguucaguaauuuaucuacuauuccuaa

SEQ ID NO: 90127 - RNA, 64 nt, hsa
gagggcggccaaguccucgcugagcagagagggagccguucaugucagagacucacugccagaa

SEQ ID NO: 90128 - RNA, 50 nt, hsa
ccucccaccucuuccucugagccguucagagcaccuugugguguaguggg

SEQ ID NO: 90129 - RNA, 64 nt, hsa
uaucugggauuacauaugucggcuaccgugucuggccguucacaucuuuggccacuauuugcuu

SEQ ID NO: 90130 - RNA, 64 nt, hsa
ucugcggagucaucacgcagccaugguugugccugccguucaugguggucuuucagguuaucuu

SEQ ID NO: 90131 - RNA, 64 nt, hsa
gaagucaacugcuguucagccucagaauaaaggugccguucacuggcucaguuaccuccugugu

SEQ ID NO: 90132 - RNA, 64 nt, hsa
cucugggcgcuuggacauagacacguggucccaggccguucagccugaccucaggcagcaggca

SEQ ID NO: 90133 - RNA, 64 nt, hsa
ggguggggccgggccccccuacgggaugcccacggccguucaucaucuugucccucgucccccu

SEQ ID NO: 90134 - RNA, 64 nt, hsa
cucccuccucuuuucucuccagccuugcagcguggccguucacaucacgcgcuucacuaagccu

SEQ ID NO: 90135 - RNA, 64 nt, hsa
ccagcauuggagaggacuacgaugagugugugcugccguucauuaccacggagauccucaaguc

SEQ ID NO: 90136 - RNA, 64 nt, hsa
cauugauuuggacagcucaccaaccccugaaggggccguucagccugguuaguuuucuaccuac

SEQ ID NO: 90137 - RNA, 65 nt, hsa
aagguacucugaaacaugguggccugagagaagaagagcuggagaaaaugaaagaagagcgugaa

SEQ ID NO: 90138 - RNA, 65 nt, hsa
aucagcaaaugucuuuagaucuccaucucccccucgagcuggaccauuugguuacccucgggaug

SEQ ID NO: 90139 - RNA, 65 nt, hsa
aggcccugcacugccagcaucuggagaccguccuggagcuggagguggaaaauggugccuggagg

SEQ ID NO: 90140 - RNA, 65 nt, hsa
ugcauagcuacgugaggccugcacagcuaaguguggagcuggacuacggcggcaguauggaauuc

SEQ ID NO: 90141 - RNA, 65 nt, hsa
acuauguauggagcuuuguaucuuuaugaaagacugagcuggaccacccaugccaaggagcgagc

SEQ ID NO: 90142 - RNA, 65 nt, hsa
uuuuaauuagaaauaaagcuguucaacuugaaaaugagcuggagaauuuuacuaagcaguuucua

SEQ ID NO: 90143 - RNA, 65 nt, hsa
aaaugcagcaaauccuucacccugcuuuauaaguggagcuggaauaguccuggggcucuggggcc

SEQ ID NO: 90144 - RNA, 65 nt, hsa
ugagcaguuugccaacugagaaggacaaccaaagugagcuggaucuuugaagcacaaaugcagca

SEQ ID NO: 90145 - RNA, 65 nt, hsa
uugggcuggggagaggaacaggccuugggaaucaggagcuggagccaggaugcgaagcagcugua

SEQ ID NO: 90146 - RNA, 65 nt, hsa
cuccaaggguggaaacuugccccuucccauuucuagagcuggaacccacuccuuuuuuucccauu

SEQ ID NO: 90147 - RNA, 65 nt, hsa
gguuuccaggggucccccagacaugaaagaggggugagcuggaggaagucauggugucacugggg

SEQ ID NO: 90148 - RNA, 65 nt, hsa
cagaccaggguuggacaaaaccccaugagggcggggagcuggaagaaaagucucuuggggaccuc

SEQ ID NO: 90149 - RNA, 65 nt, hsa
cugccuguaucaccgguugaauggacaacuaacccgagcuggaccaacacaauucucuccagaga

SEQ ID NO: 90150 - RNA, 65 nt, hsa
uaaaucaucaggucuuauaaaauauaauguacuuagagcuggauucauggcuguuuauuaugaaa

SEQ ID NO: 90151 - RNA, 65 nt, hsa
cagucaaggauaaaacaagcacgcgcacaaucaaggagcuggaacacacucuccaggccgucaaa

SEQ ID NO: 90152 - RNA, 65 nt, hsa
gaaugauuugacaguguccaaacugagacauucuggagcuggaaagccugucacacuagagugug

SEQ ID NO: 90153 - RNA, 65 nt, hsa
cagugugucgaugggaacugaagacuaguccauaggagcuggaagaacuuugucccuuuacuucu

SEQ ID NO: 90154 - RNA, 65 nt, hsa
cucccugcagugccaacaugcacugcccacagcaggagcuggauccagcgucagugugucgaugg

SEQ ID NO: 90155 - RNA, 65 nt, hsa
ggguggcccagcugguuauugacucugacuugggugagcuggaguugggggugucucgggcccag

SEQ ID NO: 90156 - RNA, 65 nt, hsa
cugugcucuggugugugggugauugggcagggccugagcuggacaggggagcuccuaguagggga

SEQ ID NO: 90157 - RNA, 65 nt, hsa
cccugguccuggccaucccacgccgccugcguguggagcuggagugugaggagggcgagcugucu

SEQ ID NO: 90158 - RNA, 65 nt, hsa
ucgcacgccugggagguggcccuuggggggcugcagagcuggagggugggcgugguacgugugcg

SEQ ID NO: 90159 - RNA, 65 nt, hsa
agccaggggcccuggccugauggggcccccauggggagcuggagccugcccugcagccuggagaa

SEQ ID NO: 90160 - RNA, 65 nt, hsa
cgguaacaggcacggcuggcccaaugccuggucuggagcuggagcuugccuuuggcuuuccaggu

SEQ ID NO: 90161 - RNA, 60 nt, hsa
ucuacgacgggcugguauagucccaggcuggagcuggaugccugggaaccacucaccucc

SEQ ID NO: 90162 - RNA, 65 nt, hsa
ugccgcagcauggaaaacagggcgccuaaggcugggagcuggaagaaggggcauuggguacccag

SEQ ID NO: 90163 - RNA, 65 nt, hsa
cagcccacucucuggacaccaauccugggaggugggagcuggaauggggagcaaugagaggaggg

SEQ ID NO: 90164 - RNA, 65 nt, hsa
uccuaugguaggacguguaccucuguguguucauggagcuggagaaaccaaaacugggucucucu

SEQ ID NO: 90165 - RNA, 65 nt, hsa
cuguccacagcucugucugccuuguucuugggcuugagcuggauagagguggggucucuucaccu

SEQ ID NO: 90166 - RNA, 65 nt, hsa
caugaggcuggccagcccucagcggggccgggcgggagcuggagccugccagccgcuuccugccu

SEQ ID NO: 90167 - RNA, 65 nt, hsa
ggggcuccguaagaagcugaaaccuucgaccguuugagcuggaggggcccugagaaaucagaguc

SEQ ID NO: 90168 - RNA, 65 nt, hsa
agcuccaauucgugacccacucagccuuauccacggagcuggagccaaccuacgugccaggcccc

SEQ ID NO: 90169 - RNA, 65 nt, hsa
gggagaaggaguaucaggagaccauugaccagauagagcuggaguuggccacggccaagaacgac

SEQ ID NO: 90170 - RNA, 65 nt, hsa
uggucuucaaggggcucaugaguaacaaccugucggagcuggacaccaagauccaggagaaagcc

SEQ ID NO: 90171 - RNA, 65 nt, hsa
guuuccugguccaucucauugcggccuguugggcagagcuggacaaggugucuuugaaggaaagc

SEQ ID NO: 90172 - RNA, 65 nt, hsa
ugacgguuuaugcugggcacugccagacugaaccagagcuggaacacaauaauguguccuucuac

SEQ ID NO: 90173 - RNA, 65 nt, hsa
acauugaugccugggggaccuuuugccucgaggcugagcuggaaaaucuugaaaauauuuuuuuu

SEQ ID NO: 90174 - RNA, 65 nt, hsa
cauugugucuuaacaaaggugugguagacacucuugagcuggacuuagauuuuauucuuccuugc

SEQ ID NO: 90175 - RNA, 65 nt, hsa
uccggaugcgugccagcaaugaguuggcacuggcagagcuggaggaggaggagggcaaacccgag

SEQ ID NO: 90176 - RNA, 65 nt, hsa
gucugacagagcuggugcugcaggcccauaggaaggagcuggaaggccuccggaugcgugccagc

SEQ ID NO: 90177 - RNA, 65 nt, hsa
gcauagcagaaagacuggccccuuccuaggguuaugagcuggaacuguuucuacuuucagucuuc

SEQ ID NO: 90178 - RNA, 65 nt, hsa
cauucuccuggugccgcugcugcucccuguuucuggagcuggauguuccccagcuggcaguugag

SEQ ID NO: 90179 - RNA, 65 nt, hsa
aggaugagaggcuguggcagcaggagacucugcaggagcuggagaggcugcgggagcuggagagg

SEQ ID NO: 90180 - RNA, 65 nt, hsa
agcaggagacucugcaggagcuggagaggcugcgggagcuggagaggaugcuggagcuggggugg

SEQ ID NO: 90181 - RNA, 65 nt, hsa
agcagcuacaagcagaggcugaacaccugcggaaggagcuggagaaucugacaggacagcuuuaa

SEQ ID NO: 90182 - RNA, 65 nt, hsa
agcagcuacaagcagaggcugaacaccugcggaaggagcuggagaaucuggcaggacagcuuuaa

SEQ ID NO: 90183 - RNA, 65 nt, hsa
uuuauacugaaggaauuugugcuguguauuggggggagcuggauccagagcuggagggggugggu

SEQ ID NO: 90184 - RNA, 65 nt, hsa
gaauuugugcuguguauuggggggagcuggauccagagcuggaggggguggguccgggggaggga

SEQ ID NO: 90185 - RNA, 65 nt, hsa
uaucccauggcuccucgccaaagacugaaauuguggagcuggagggcgcccccuccccggaguuu

SEQ ID NO: 90186 - RNA, 65 nt, hsa
gaccucaccaccucuuuuccuuugagcccaaggcagagcuggagcuggcgccacccagacagcgu

SEQ ID NO: 90187 - RNA, 65 nt, hsa
ugacccugagcggcgcccacgaccucagcgagagugagcuggauguggccgggcugcagagccgg

SEQ ID NO: 90188 - RNA, 65 nt, hsa
ccccaaauuggccucgguggcaggggagccccgcagagcuggacagcgacacgcagggggcucgg

SEQ ID NO: 90189 - RNA, 64 nt, hsa
cauuuuggauauaggucagugaggcccagggagaggccaugauucgcccaaagccagacagcaa

SEQ ID NO: 90190 - RNA, 64 nt, hsa
aaggacuguuuuuuccugagcuuggccagaagggggccaugaggccucaguggacuuuccaccc

SEQ ID NO: 90191 - RNA, 64 nt, hsa
gcugagauggaacccuuuuggcccccgagcugggggccaugagcuccagacccccagcaacccu

SEQ ID NO: 90192 - RNA, 64 nt, hsa
cuccuggaacucugaaccugcuguggaaggaauuggccaugaccuucaccucuggagaguaggg

SEQ ID NO: 90193 - RNA, 64 nt, hsa
ucaguacccgaacucacuucaguaugcuuacugaggccaugagaaccugaggggcaucugccca

SEQ ID NO: 90194 - RNA, 64 nt, hsa
uaugccaugugaaugcaggcaugcuggcucccagggccaugaacuuuguccgguggaaggccuu

SEQ ID NO: 90195 - RNA, 64 nt, hsa
aaaagcccugaguuucaaguauccuuguugacacggccaugaccacuuuccccgugggccaugg

SEQ ID NO: 90196 - RNA, 64 nt, hsa
aggcugcuaagaagcaccagaauauguaccgccuggccaugaccggggcagggaucgacaggca

SEQ ID NO: 90197 - RNA, 64 nt, hsa
guuccuguaccagcgaguccacagccuuugugcaggccaugauggaggggucccacacaguaag

SEQ ID NO: 90198 - RNA, 64 nt, hsa
uuccucugcuuugaaagccccagaaaucaguguuggccaugaugacaacuacagaaaaaccaga

SEQ ID NO: 90199 - RNA, 64 nt, hsa
ccccuagccauuuuuacuguuauccuauuuagauggccaugaagaggaugcugugaaauuccca

SEQ ID NO: 90200 - RNA, 64 nt, hsa
uaggaaaccccccaaugucuguugaacagcuaucacguugaaccacgugaaacugcuguuuucu

SEQ ID NO: 90201 - RNA, 64 nt, hsa
uaggggggcuugauucaacaaagccacagacuuaacguugaaauuuucuucaggaauuuucuag

SEQ ID NO: 90202 - RNA, 64 nt, hsa
aucagaugaugucuucuccuuuuccaaacaccacacguugaaagcauuuauaaauccaagucug

SEQ ID NO: 90203 - RNA, 64 nt, hsa
ugguggcucacaccuguaaucccaacacuuugggacguugaaaugggagaauugcuugagucca

SEQ ID NO: 90204 - RNA, 64 nt, hsa
cccuauccaggucacuccagaaaaggguauugaaacguugaaaucuaaagcaaauuugcaauuu

SEQ ID NO: 90205 - RNA, 64 nt, hsa
ggccaaaguccuacaaucggaauggauucaugccacguugaagauaaaauuauccucucucuga

SEQ ID NO: 90206 - RNA, 64 nt, hsa
caaagggccuccuuggcuggcaugguucuguguuacguugaagccagagucuuauaacaccucc

SEQ ID NO: 90207 - RNA, 64 nt, hsa
ccauggaggugcagagaugagauuacuccuauucacguugaagugauuugcuuuguuaacaaaa

SEQ ID NO: 90208 - RNA, 64 nt, hsa
acuguguguaucucuagauaagaagauaugcaccacguugaaaauacucaguguagaucucuau

SEQ ID NO: 90209 - RNA, 63 nt, hsa
auacauuagauguguguuuuaaaaugcauaaaacacguugaaauacauuaaugaaccauuagu

SEQ ID NO: 90210 - RNA, 64 nt, hsa
aagcuguaauguaauuuuauauuuucuuauagccacguugaaguaaaaacaaacagguacagug

SEQ ID NO: 90211 - RNA, 64 nt, hsa
gagagacagaaagagagccucagaauggacaaugacguugaaacgcagcauuuuugaaaaggga

SEQ ID NO: 90212 - RNA, 64 nt, hsa
uaaugcuaugucacuauuuuuguaaaugagguuuacguugaagaaacaguauacaagaacccug

SEQ ID NO: 90213 - RNA, 64 nt, hsa
aaguuuaggugccuuugcggaugaccucauuuugacguugaaaaaaugauuuuuuaauauguga

SEQ ID NO: 90214 - RNA, 64 nt, hsa
gauaugguuuggaucuguguccccaccaaaucucacguugaaguguaauccccaauguuagagg

SEQ ID NO: 90215 - RNA, 64 nt, hsa
gaggaaaauguggccuguuuacaaaacauucagcacguugaagaaaguguucccaauggagugg

SEQ ID NO: 90216 - RNA, 64 nt, hsa
aggccagugccaaguccacauuccuccagcugauacguugaagcaaacucuuacugccuuucuc

SEQ ID NO: 90217 - RNA, 64 nt, hsa
cagugcaucuguucauccauccugcacuuggcccacguugaacuccauggugccugagagagac

SEQ ID NO: 90218 - RNA, 64 nt, hsa
gaagagcaucucauacauaucauuaucguggaacacguugaauguuugugauucuguguggccu

SEQ ID NO: 90219 - RNA, 64 nt, hsa
cacagagaagcucugauagcacagaucagcaccaacguugaacagcuaaugaguaugugcucau

SEQ ID NO: 90220 - RNA, 64 nt, hsa
cgagaaauuugaugagagaggcgggccuccuuuuacguugaaucagaugcuuugaguuuaaacc

SEQ ID NO: 90221 - RNA, 64 nt, hsa
caggaagagggccugagguucuccuagugcaggaacguugaauauuggcaaugauuccugguuc

SEQ ID NO: 90222 - RNA, 64 nt, hsa
ucauaacaacaucucaaaaauuuggggaaacacaacguugaaaacuuccuaagaaaaggaaucu

SEQ ID NO: 90223 - RNA, 64 nt, hsa
ccucuaguugacuuuucucuuagccugaauguggacguugaaacauaucacuucagggcuugga

SEQ ID NO: 90224 - RNA, 64 nt, hsa
ggcaguggugggugucugaaaccucagaaacauaacguugaacuuuuaagggucucaguccccg

SEQ ID NO: 90225 - RNA, 64 nt, hsa
ccagauuauucucuagccaagccccaccuuuguuacguugaaaucccucauuuauuuucuucuc

SEQ ID NO: 90226 - RNA, 64 nt, hsa
ugaacaaaaagcauuaaacuggcuccaucagaagacguugaagggcagugaagagcacagacuc

SEQ ID NO: 90227 - RNA, 64 nt, hsa
uaauauuuaacuuaaauauuugacuuacauguugacguugaaggcucaaagcuauacuaagaag

SEQ ID NO: 90228 - RNA, 64 nt, hsa
uggauugcgacugguuuuauacggccugccuauaacguugaaaauccauguacuacauaauaau

SEQ ID NO: 90229 - RNA, 64 nt, hsa
ugagccacuucuccccacccuccagaagggguccacguugaauucugaaucaucuugaaaauaa

SEQ ID NO: 90230 - RNA, 64 nt, hsa
uaaacggacagagaaaugcacauggaggagaacuacguugaaaucaagauccuaugucuguugu

SEQ ID NO: 90231 - RNA, 64 nt, hsa
ugauagaaguuauuugcuaauagcuucuauucuuacguugaaaauaguuguaaaagcugaugaa

SEQ ID NO: 90232 - RNA, 64 nt, hsa
cuugauguagauuuuacucuauguacagaauuuaacguugaauauauuaaaauaacaaaucugg

SEQ ID NO: 90233 - RNA, 62 nt, hsa
ugucuaaaucagaugacugaaaucugccuaaaacguugaaggagaaucaauucuucaacuca

SEQ ID NO: 90234 - RNA, 64 nt, hsa
uucuccaaagaagauauacaaauggcaaauacauacguugaaagauccuuaauauuguuagcca

SEQ ID NO: 90235 - RNA, 64 nt, hsa
caggguggcaguuucccuugagcaaagcagccagacguugaacuguguuuccuuucccugggcg

SEQ ID NO: 90236 - RNA, 64 nt, hsa
uauaagcaccucucuaaagaaucuuuaguuuccgacguugaauuauagaccaguuugaguaagu

SEQ ID NO: 90237 - RNA, 64 nt, hsa
gcaauggauguagaaaauaaaauucaagaaaagaacguugaaccaaauauuagcuuugauggca

SEQ ID NO: 90238 - RNA, 64 nt, hsa
aaaacaaauuauucauucauaugaugcuuucuuaacguugaaauugcacauucacauuggacug

SEQ ID NO: 90239 - RNA, 64 nt, hsa
ugauaugcuucgcacugagcacaucacauuuaggacguugaagauuuuuuuuuuuuuuuuuuuu

SEQ ID NO: 90240 - RNA, 64 nt, hsa
aaaauuguacagugauagcaacuuuccacacaggacguugaaaacaguaauguggcuacacagu

SEQ ID NO: 90241 - RNA, 64 nt, hsa
agcuuugaagaccuaccuguucuuccagaagagaacguugaaagugccauguuuccuuuugcgu

SEQ ID NO: 90242 - RNA, 64 nt, hsa
ugcuuuguauuguaguaaccaauaugugcaguauacguugaauguauaugaacauacuuuccua

SEQ ID NO: 90243 - RNA, 64 nt, hsa
gaacacaccacuuuuuacuguugaaaccaacacaacguugaaauccaggcuuauacgcagacuc

SEQ ID NO: 90244 - RNA, 64 nt, hsa
aggccaggcagggagcagaugcagggacucugccacguugaauucuggugagggacauuguagu

SEQ ID NO: 90245 - RNA, 64 nt, hsa
aaaaacugaacaagguugaggagaaauagugcuuacguugaaaaaucuuuaagucuuugucccc

SEQ ID NO: 90246 - RNA, 64 nt, hsa
uccuguuuuaauaauuuuaaaaugagcacaaagaacguugaaguucagauuaaucucuucugaa

SEQ ID NO: 90247 - RNA, 64 nt, hsa
aaacuuuucuccauuuuaaaaagcccuguuauaaacguugaacuuucacaauguuaaaauguua

SEQ ID NO: 90248 - RNA, 64 nt, hsa
auguugcauuuaugaugcaguuucaaguaccaaaacguugaauugaugaugcaguuuucauaua

SEQ ID NO: 90249 - RNA, 64 nt, hsa
ugaaauuuugaucccaauagaauucauuucucuuacguugaauccccaaucauaauuaagccgu

SEQ ID NO: 90250 - RNA, 64 nt, hsa
ucaaagugugguguuugguuugccuggagaugccacguugaaucaugugauucuagauuaacau

SEQ ID NO: 90251 - RNA, 64 nt, hsa
agauaaucuuauucugaugaagcgagaacuaugaacguugaaacaaggacaauuuguguuggau

SEQ ID NO: 90252 - RNA, 64 nt, hsa
cacuuuuuaaauugauaauuuuguaaaauugauuacguugaaugcuuuuuaagagaagugugua

SEQ ID NO: 90253 - RNA, 64 nt, hsa
uuuaaaccaaacggaacucuucaucuuaaacuacacguugaaaaucaacccaauaauucuguau

SEQ ID NO: 90254 - RNA, 64 nt, hsa
uuauacugcagguagguauuuccagugaauggaaacguugaaauuuauagaugggacaaugcac

SEQ ID NO: 90255 - RNA, 64 nt, hsa
gcaccgcugugacugggcuccgggccuuuccacuacguugaagaagaaaaccuauuuuuaaaug

SEQ ID NO: 90256 - RNA, 64 nt, hsa
aaaagaauaugguuuugguucccauuucuaguucacguugaaugacaggccuggagcuguagaa

SEQ ID NO: 90257 - RNA, 50 nt, hsa
gcaaggagcagaagacauagacguugaaacagaaacagaaggaugaagga

SEQ ID NO: 90258 - RNA, 64 nt, hsa
gcaccuuaaaucuaaucagcaaacuauaauuuguacguugaaaccugcaacacauuagaaacuu

SEQ ID NO: 90259 - RNA, 64 nt, hsa
ggucuuuuaccucauauuuucugucaaugaaaauacguugaauaaacuauauuaauguggagau

SEQ ID NO: 90260 - RNA, 64 nt, hsa
accuaggguacaguccuugacagaauugacuauaacguugaacaguccuguaucaaaacugaag

SEQ ID NO: 90261 - RNA, 64 nt, hsa
uuugucuugaaacaaaaacuguuuuaagacgucuacguugaauuauucagagaauuaagcaaua

SEQ ID NO: 90262 - RNA, 64 nt, hsa
ucugugcgauuuuuagcacauccauaucuuuucuacguugaaugucuggaucuuuccuuuguau

SEQ ID NO: 90263 - RNA, 64 nt, hsa
aguucgaaucugguaaacauagaccaaaauggaaacguugaauacauguccagcuuccagaaua

SEQ ID NO: 90264 - RNA, 58 nt, hsa
aaaagcaaucacaguguuaaaagaagacacguugaaaugaugcaggcugcuccuaugu

SEQ ID NO: 90265 - RNA, 58 nt, hsa; identical to SEQ ID NO: 90264

SEQ ID NO: 90266 - RNA, 64 nt, hsa
ucuuuguguucuucaaugagaaaucaaauuugagacguugaaauuggagcugcgugcugcugca

SEQ ID NO: 90267 - RNA, 64 nt, hsa
ccaggacugaaacuuucuugcucucuuuuucucaaucucccagccccucucuaccauauuggga

SEQ ID NO: 90268 - RNA, 64 nt, hsa
agccaugcugagaauaaacacacgucccaggcucaucucccaggacugaaacuuucuugcucuc

SEQ ID NO: 90269 - RNA, 64 nt, hsa
uacugaggagcaagacuguccaguucuccuccacaucucccaucccagaaucaggaucugggac

SEQ ID NO: 90270 - RNA, 64 nt, hsa
gcccuguggggugcccccgaugggaggcugucccaucucccaguccccaucucuuuuuccccac

SEQ ID NO: 90271 - RNA, 64 nt, hsa
ggugacgucuuacuggugaucaucuccucaccccaucucccaccuuguggaauaaauacauguu

SEQ ID NO: 90272 - RNA, 64 nt, hsa
acgguuucuguucugcccccucagggaugugggaaucucccagacuuguuuccugugcccauca

SEQ ID NO: 90273 - RNA, 64 nt, hsa
gaagacauaucaugugugagauaacuuccuucacaucucccauggucccuagcaaaaugcuagg

SEQ ID NO: 90274 - RNA, 64 nt, hsa
agcuguuuccuugccaacaggucccuuccucuccaucucccaccaaacuagggcaccauugauu

SEQ ID NO: 90275 - RNA, 64 nt, hsa
gccccugauuuugccuuaaguucuugccugagugaucucccagccugucuucugucuccuuuug

SEQ ID NO: 90276 - RNA, 64 nt, hsa
auucuauauaaaagaagucaguugauacuuuaaaaucucccauuugguuuauaaaaucccuuaa

SEQ ID NO: 90277 - RNA, 64 nt, hsa
uggaccugguggcuacgaaucuuccgauggaugaaucucccacuccagcgcugagugggagaag

SEQ ID NO: 90278 - RNA, 64 nt, hsa
auuguucccauuccauguguucugaauucagcucaucucccagcauauagauauauccuccuuu

SEQ ID NO: 90279 - RNA, 64 nt, hsa
ccuguggcacuccccacccauagaccuucagaucaucucccacacccuggaucucacucuccuc

SEQ ID NO: 90280 - RNA, 64 nt, hsa
gccuuuucagguuggaagaagaaaaauagccucaaucucccaccccauguaggcacuaccuccc

SEQ ID NO: 90281 - RNA, 64 nt, hsa
caacccugaagauaaucaaggccaguuacucaucaucucccaaccacuguuuccucaacugccc

SEQ ID NO: 90282 - RNA, 64 nt, hsa
ccaaagccaaaugcaguuccaaauaguggacauaaucucccagggaaaucugggcucgaggccu

SEQ ID NO: 90283 - RNA, 64 nt, hsa
ucuuugucacuuggacuauuucagcaacagucucaucucccagauuaccucugugcacacugac

SEQ ID NO: 90284 - RNA, 64 nt, hsa
ggcauaggacuugcagguuccuaggagcaggagcaucucccaucgcacgugcuuucugcucuuc

SEQ ID NO: 90285 - RNA, 64 nt, hsa
ugcaguggcaugaucauggcuuacugcagccuugaucucccaggcucaagcgauccuucugccu

SEQ ID NO: 90286 - RNA, 64 nt, hsa
uucacccuucauucuuucaacaaacaugccaucuaucucccaggacauuuauucccuucuauuc

SEQ ID NO: 90287 - RNA, 64 nt, hsa
gcacugugcugcccaaggaguauuuucuggguggaucucccauacuccucaggguucugagguc

SEQ ID NO: 90288 - RNA, 64 nt, hsa
ucccaggaugugagugggucugaagauacauucccaaauaaacgaccuaggcuagaagauaaga

SEQ ID NO: 90289 - RNA, 64 nt, hsa
gacuguuuuugacaauuuuuuuaucaagaaagagcaaauaaaaagcagugguaaugauccaaag

SEQ ID NO: 90290 - RNA, 64 nt, hsa
gaggaaauaauucucugcuguguauuguauuuuucaaauaaaaauuuaaaaauucaauugaaaa

SEQ ID NO: 90291 - RNA, 64 nt, hsa
uuuuaauuuccucuguaauuucaacagagaucagcaaauaaauauaaccaaagauuguccauua

SEQ ID NO: 90292 - RNA, 64 nt, hsa
cauuuucauaucauuugcauugaguugaaaacugcaaauaaaaguuugucacuugagcuuaugu

SEQ ID NO: 90293 - RNA, 64 nt, hsa
agauuuauaauaauaugggcugcaaguacaccugcaaauaaaacuacuagaauacugcuaguua

SEQ ID NO: 90294 - RNA, 62 nt, hsa
aauggugcgcuguuuugcauauaaauaaagguaucaaauaaaguccucucuuuuauuuuaag

SEQ ID NO: 90295 - RNA, 64 nt, hsa
uuucuguugugaaaauaaagauuauauuagaauccaaauaaacccugaauauuuaguaaguuua

SEQ ID NO: 90296 - RNA, 53 nt, hsa
cugaaagagauugcuaauaaaaucaaauaaaacuguaugaacucuaauggaga

SEQ ID NO: 90297 - RNA, 64 nt, hsa
ucacaacauucacuauguuugcaaggaauuaacacaaauaaaagaugccuuuuuacuuaaacac

SEQ ID NO: 90298 - RNA, 64 nt, hsa
uuccagaggucauggaacagaaagccuuauaaaccaaauaaaaauucucaaaauacauugguuu

SEQ ID NO: 90299 - RNA, 64 nt, hsa
uuguuuuugguuacaugauaccauggaaauauuccaaauaaauuuuuuucucacagugucaagg

SEQ ID NO: 90300 - RNA, 64 nt, hsa
cgcaguauuuauuaaaacauacuuuuuuuuucuucaaauaaaaaaguaaccaugucuuugucua

SEQ ID NO: 90301 - RNA, 64 nt, hsa
ugauuuuuugccaucguugauaaaaaugcaaagucaaauaaaaggugucuugguuugaugucau

SEQ ID NO: 90302 - RNA, 64 nt, hsa
cuaaugaaggguuuuuuaaaagaacuaaauaaaacaaauaaaacuaggcuacagguauagcuga

SEQ ID NO: 90303 - RNA, 64 nt, hsa
uuuaaaaaauuaaaauuucugaaaaccaaugcgacaaauaaaguuggggagaugggaaucuuug

SEQ ID NO: 90304 - RNA, 64 nt, hsa
aagaaguugcugcccaguuaaaggggcucccucucaaauaaaucuccauccuucccucucccaa

SEQ ID NO: 90305 - RNA, 64 nt, hsa
gaaaacaaucagggcacauuaaaaugauacaagucaaauaaaucuuaaagacacaaugcacacu

SEQ ID NO: 90306 - RNA, 64 nt, hsa
aaaacaaaagccagacaaacccaaguuguccaggcaaauaaacucaaaucuuugucacgucuga

SEQ ID NO: 90307 - RNA, 64 nt, hsa
aauuuggucauucuuugccauagcuuacucuauucaaauaaacauauauucuugcuugcauccu

SEQ ID NO: 90308 - RNA, 64 nt, hsa
augauucauauauuuuaugaaucagaauaaccuucaaauaaaauaaaucuaagucgguuaaaau

SEQ ID NO: 90309 - RNA, 64 nt, hsa
aaaauauuuucauuauacaugaaauucaacuuuccaaauaaaaguucuacuucauguaauccaa

SEQ ID NO: 90310 - RNA, 64 nt, hsa
uggaagaaacaaacaguugcuaccaaagauucuucaaauaaacauacaaauaaauguguauauu

SEQ ID NO: 90311 - RNA, 64 nt, hsa
acaguugcuaccaaagauucuucaaauaaacauacaaauaaauguguauauuuaauguuuuauu

SEQ ID NO: 90312 - RNA, 64 nt, hsa
ggcguaacguaaaguguauucuguacauaauuuacaaauaaaacauuuuauuuuaauuguuacu

SEQ ID NO: 90313 - RNA, 64 nt, hsa
caaggcugcaaucacuuuaauaguuucuuuuuagcaaauaaauguucauugaugaagugccugg

SEQ ID NO: 90314 - RNA, 64 nt, hsa
cauuccaguuauucacuuacagaugaaacuaaaacaaauaaaggcaagcuauuaucaguuuggu

SEQ ID NO: 90315 - RNA, 64 nt, hsa
uucacuccccuccccuccccacccccaauagauucaaauaaauaaaauccugagcaaauuaaua

SEQ ID NO: 90316 - RNA, 64 nt, hsa
aaaauugcaauuucuacaaauaaaugucauagugcaaauaaaugucaggauuuagagaaggagc

SEQ ID NO: 90317 - RNA, 64 nt, hsa
cuuuuaaaaauguuuuugaaaauugcaauuucuacaaauaaaugucauagugcaaauaaauguc

SEQ ID NO: 90318 - RNA, 64 nt, hsa
uuucuuuuguaaaugaccucacauguaaauucaccaaauaaauauuacauucaagcucuucuau

SEQ ID NO: 90319 - RNA, 64 nt, hsa
aaaaucaaagugcagauugcuuguauguaaaacccaaauaaagguagaguaagugugauauaug

SEQ ID NO: 90320 - RNA, 64 nt, hsa
aaguugcaaagaguacaaaugauaauuggccaugcaaauaaaaacugauuuguugauuuuuuuu

SEQ ID NO: 90321 - RNA, 64 nt, hsa
ucuaguaaucucuaauuccagugucuuuacacagcaaauaaauuggagaauauugcucccauau

SEQ ID NO: 90322 - RNA, 64 nt, hsa
auauuuaucuuugaacauguagcaucucuuuccgcaaauaaaugcagacuuugguuuugauuua

SEQ ID NO: 90323 - RNA, 64 nt, hsa
ggugcaauugcuucuguuugcuaaugcugcuuugcaaauaaaacuugcugccgaccacccacgg

SEQ ID NO: 90324 - RNA, 64 nt, hsa
cauuuacauguaacuucugacauuucacucugugcaaauaaagaacaugaggauaccugugcug

SEQ ID NO: 90325 - RNA, 64 nt, hsa
guaguauguaaaacccaaacaaguagaacccaagcaaauaaaauuauuuaaaauaauuuuaaag

SEQ ID NO: 90326 - RNA, 64 nt, hsa
cuaagcuaauuuuauauuugguauacaugcaugucaaauaaaguuaauuuuacauacuauucuc

SEQ ID NO: 90327 - RNA, 64 nt, hsa
ggguccuugaggccugccaguguguaaagguguucaaauaaagggcuguuucuacagguaacau

SEQ ID NO: 90328 - RNA, 64 nt, hsa
accauuaauuuuauuuguuuuuguucuauguaaucaaauaaaauuugaguaacauguaauggua

SEQ ID NO: 90329 - RNA, 64 nt, hsa
cgagaagggaagggguaugcaguuuacccaaguccaaauaaagcauuucacuagguuacacguu

SEQ ID NO: 90330 - RNA, 64 nt, hsa
ccuuauuaaggcuuuaguaauuuguauguaaugucaaauaaaaggaauucaaaucugaguaaau

SEQ ID NO: 90331 - RNA, 64 nt, hsa
aauuccuuucuauccuacaacaagaguuuauuuccaaauaaaaugaggacauguuuuuguuuuc

SEQ ID NO: 90332 - RNA, 64 nt, hsa
cuguuuaagaugggcagcuaguucguagcuuucccaaauaaacucuaaacauuaaucaaucauc

SEQ ID NO: 90333 - RNA, 64 nt, hsa
caugagccuuccuuugaggaaggauguggaucuccaaauaaagauuuaguguuuauuuugagcu

SEQ ID NO: 90334 - RNA, 64 nt, hsa
gaaauuuagcaauaaggagaggaguccaaggggacaaauaaaggcagagagaagagacagaacu

SEQ ID NO: 90335 - RNA, 64 nt, hsa
gucagcucaccacccccucuggcuaaaacucaagcaaauaaagccgcuuccugucauuaagcau

SEQ ID NO: 90336 - RNA, 64 nt, hsa
ucaccuugugauucaguguaucuguuuacuaacucaaauaaagcaauuguucccucuggagggg

SEQ ID NO: 90337 - RNA, 64 nt, hsa
uuuaauuuguuuaaaucaacauagcaugaaacaccaaauaaaauguuugacauaguuuuacuuu

SEQ ID NO: 90338 - RNA, 64 nt, hsa
aauguauuuauaaaguuuuuccagauaaacuaaucaaauaaauuagaauaaugugacaacauua

SEQ ID NO: 90339 - RNA, 64 nt, hsa
acauucugccuugcuguagugaagagacccacuccaaauaaaaaaggggccacacggggcuucu

SEQ ID NO: 90340 - RNA, 64 nt, hsa
agaucagcaauaaugacuauguaaucucaaaaaacaaauaaaauauucuuaacauggacucuua

SEQ ID NO: 90341 - RNA, 64 nt, hsa
uaguuuaaucugaaaucuugacccaguuauuuaacaaauaaauaccucauugauuauauuuaaa

SEQ ID NO: 90342 - RNA, 64 nt, hsa
caaacgguggauaaaguauuaaguaacuaagugccaaauaaaugcuggaaaucuugaccucucc

SEQ ID NO: 90343 - RNA, 64 nt, hsa
uauuauuauaaauauagccauauuauuuugaauucaaauaaauuucuauacugguaauacuuuc

SEQ ID NO: 90344 - RNA, 64 nt, hsa
auacuucaaucaggauauuaucugcuuuacuuuacaaauaaaaccaaaucuuuugucaacagga

SEQ ID NO: 90345 - RNA, 64 nt, hsa
ucagucucacuguuggcugucauugugacaaagucaaauaaacccccaaggacgacacacagua

SEQ ID NO: 90346 - RNA, 64 nt, hsa
cuggcuucaggaaagucuagaagcaauauuucuucaaauaaaagguguuuaaacuuuuuucugu

SEQ ID NO: 90347 - RNA, 64 nt, hsa
aggaauguuuucauaaucgaaagaaacggguauccaaauaaaaccaaguucuugacauuggucu

SEQ ID NO: 90348 - RNA, 64 nt, hsa
aucuucaaacccaccaaaccaacaggauaauugacaaauaaacgccauaggcuaggcugaacug

SEQ ID NO: 90349 - RNA, 64 nt, hsa
guuuguagugaugggaaguguauuuuacucugaucaaauaaauaaugcuggaauacucaagaau

SEQ ID NO: 90350 - RNA, 64 nt, hsa
uuguucccugcuguccuccguauuacgugaccggcaaauaaaucucauagcaguuaauauaaaa

SEQ ID NO: 90351 - RNA, 64 nt, hsa
gccagcucaucuuccaggugcugaaaccacuuuccaaauaaacuaaagccuggauuugauauua

SEQ ID NO: 90352 - RNA, 64 nt, hsa
ugggcagcauuguugagagauugguaacacugagcaaauaaauauguugagaaugaugacagca

SEQ ID NO: 90353 - RNA, 64 nt, hsa
agaauagaacucauaucuuuuaaauauauaggaacaaauaaauaaauuguugugugugcacaua

SEQ ID NO: 90354 - RNA, 64 nt, hsa
uaacacaaaaugauauacacugaaguugaugaagcaaauaaauauucuggcuucuuuuucaagg

SEQ ID NO: 90355 - RNA, 64 nt, hsa
aauguuuuaucacucaaaaauccauuagaaguuucaaauaaauugcuuucuugcuagcuguauu

SEQ ID NO: 90356 - RNA, 64 nt, hsa
ucuaaaaacaaaacaaaacacaaaauccccuguucaaauaaacaaaaaauccaagauugauuca

SEQ ID NO: 90357 - RNA, 64 nt, hsa
uugugauacaguuaaaaggugcagcugccagugacaaauaaaaacuuuuguuacaucucauuau

SEQ ID NO: 90358 - RNA, 64 nt, hsa
uuguuuucucauuucuuaaaccagaaguuuaugacaaauaaauaugccauguaauaugaaagcu

SEQ ID NO: 90359 - RNA, 64 nt, hsa
agcagaacaguuuuaaaaaucuaauuagaauuuccaaauaaaacaguuuccauaaggugucagc

SEQ ID NO: 90360 - RNA, 64 nt, hsa
ugggguaaaagugguuaacguacuguuggaucaacaaauaaagguuacaguuuuguaagagaag

SEQ ID NO: 90361 - RNA, 64 nt, hsa
aguaacaucuaaagcauuauugcuuuagaauguucaaauaaaauuuccugaccaaauuguuuug

SEQ ID NO: 90362 - RNA, 64 nt, hsa
caauguauaauuuagacgucugucaaaaauccgacaaauaaaauuuagcuggaacgaaggcagc

SEQ ID NO: 90363 - RNA, 64 nt, hsa
auuuaacugaucucugagguucaguaucauuuuucaaauaaaggaauuauauuauuuccucugc

SEQ ID NO: 90364 - RNA, 64 nt, hsa
augucaacuuuuuagauguuucaccacucuuuugcaaauaaagcauccuuucugcucuguugca

SEQ ID NO: 90365 - RNA, 64 nt, hsa
caaaugaaaauuucuucaaauaagccuuuuguuucaaauaaaacuugucucaaaacaugcuucu

SEQ ID NO: 90366 - RNA, 64 nt, hsa
aucuacugugaauauaaaauguuauuagccuuaucaaauaaauaaaugagcacagcucuuuguu

SEQ ID NO: 90367 - RNA, 64 nt, hsa
agaauuucuggauaguaggauuuuaauaggcgagcaaauaaaauucaaaucaauuucaaggaaa

SEQ ID NO: 90368 - RNA, 64 nt, hsa
cuggcaagagacuuccuuugauuucuacuguuuacaaauaaaacucagccagucucauucuaua

SEQ ID NO: 90369 - RNA, 64 nt, hsa
uuucuccauagaauaaucauuuauuuuugcagaucaaauaaaucagaguuuacaaugcacaggg

SEQ ID NO: 90370 - RNA, 64 nt, hsa
ugggcagcuaaauuuuucaguuccaugugccucccaaauaaaaaacagaaaauaaguaguuuuu

SEQ ID NO: 90371 - RNA, 64 nt, hsa
guaagaauccugacuuuuuuauauuuggaaacaucaaauaaaaauggaaaaaaugaucauggcu

SEQ ID NO: 90372 - RNA, 64 nt, hsa
uguacaaggcugcuuguuuuuuuauugccaaagucaaauaaacgggagacugucaugcucaugc

SEQ ID NO: 90373 - RNA, 64 nt, hsa
agacugucaugcucaugcaugaauagaauuuagucaaauaaaaaauuuuggucauuugguacug

SEQ ID NO: 90374 - RNA, 64 nt, hsa
gcuuuguguuuaccuacuaaacagaaaaugccuccaaauaaacagugucacaaguacagaagag

SEQ ID NO: 90375 - RNA, 64 nt, hsa
acacuucaaaagugugcuuacauuuuuaaaaagacaaauaaaaacaguguuuuauagugaaauc

SEQ ID NO: 90376 - RNA, 64 nt, hsa
ucuuagaacaauuuugcccugauuacugaagcgucaaauaaagcuggagugaaaauuuuguuuu

SEQ ID NO: 90377 - RNA, 64 nt, hsa
uucaacaguuguauuuggaguuaaauuauuuuaacaaauaaauuuauuuaaugaaacucuggau

SEQ ID NO: 90378 - RNA, 64 nt, hsa
agggccuuaaugucacccaccagaaaacuaacuccaaauaaacgcuuacccuuuccuuuagguu

SEQ ID NO: 90379 - RNA, 64 nt, hsa
uguaguuugacagaaccaucaguaaagacauaagcaaauaaauggucuuggugcaccuggucug

SEQ ID NO: 90380 - RNA, 64 nt, hsa
uuuguaccucuauugugccuauauuaaagguauacaaauaaauaaggccaugucugacuucaag

SEQ ID NO: 90381 - RNA, 64 nt, hsa
uguuggaauuuuaagucuuuccuuugguucuaugcaaauaaaaaaauaacugauuuuuuaagac

SEQ ID NO: 90382 - RNA, 64 nt, hsa
aaauacaacagggggaugugucccaguacacuuacaaauaaaacauaacugaaagaagagcagu

SEQ ID NO: 90383 - RNA, 64 nt, hsa
acaaaaacaaaccuaccaaccaccaaaaacuagacaaauaaagacaaacuaaaacaaaacagaa

SEQ ID NO: 90384 - RNA, 64 nt, hsa
ggugggcuggaucugugacugauugaaaugcaugcaaauaaaaaagacaauauuaaagucuguu

SEQ ID NO: 90385 - RNA, 64 nt, hsa
gcucacuucucucuucacccaucuuuuuuaaaaacaaauaaaugaauaaagcugcugugacaca

SEQ ID NO: 90386 - RNA, 64 nt, hsa
aaaguaaccucuugcuuggugcaacuauuuguuucaaauaaaaacauuuagacaaaauucucag

SEQ ID NO: 90387 - RNA, 64 nt, hsa
ggaggaagauguucacauacuggaacuguccugccaaauaaauuuugccccuauugugcucugu

SEQ ID NO: 90388 - RNA, 64 nt, hsa
aaaaagagagcuuaaugauaauauuguggugccacaaauaaaauggauuuauuagaauuucaua

SEQ ID NO: 90389 - RNA, 64 nt, hsa
ccgacagaaggaaccagcguguauaugaggguaucaaauaaaauugcuacuacuuaccuaccac

SEQ ID NO: 90390 - RNA, 64 nt, hsa
cccaggcugaaaauauuuuuuaacuccucaaauacaaauaaauuaaugaacccaugagaaaugu

SEQ ID NO: 90391 - RNA, 64 nt, hsa
uacuggaagcccauaaagcauucuugcucaucuccaaauaaaacguguuuuauuccuuuagcgu

SEQ ID NO: 90392 - RNA, 64 nt, hsa
caguucagaggcaacgaaacuggacucauuacuccaaauaaacauggacuuuuacaaaacccau

SEQ ID NO: 90393 - RNA, 64 nt, hsa
gaaguuagcacucuagggaaggcaaaaacagaaccaaauaaaugugugagucagugugcagcau

SEQ ID NO: 90394 - RNA, 64 nt, hsa
acugagccacagauaauacaagagcguccccucacaaauaaauuaaagcguaaaaggagaccua

SEQ ID NO: 90395 - RNA, 64 nt, hsa
gguuuuaagauuuacuucagcuugucaccaguuucaaauaaaucccuaauagguaacaaguaaa

SEQ ID NO: 90396 - RNA, 64 nt, hsa
guuucucugacaggcaguuuuuaacuguuuuccacaaauaaaaauaauaugucaugggauuaaa

SEQ ID NO: 90397 - RNA, 64 nt, hsa
cagaguucuuaguaacaggggcaguuccugaauucaaauaaaccauuuuguauguuuggauuuu

SEQ ID NO: 90398 - RNA, 64 nt, hsa
uuauguacauauugacaaauauucauuuauucaacaaauaaaaaguauguacaaaacaugauac

SEQ ID NO: 90399 - RNA, 64 nt, hsa
uugcagaauggaaacugcccugacucaugaaucacaaauaaaagccaauuguaucuauaacuga

SEQ ID NO: 90400 - RNA, 64 nt, hsa
aaauauucucucuuuggcuggaaugacaaaaacucaaauaaauguaugauuaggaggacaucau

SEQ ID NO: 90401 - RNA, 64 nt, hsa
gauuuucuuuacagaaggucaugucaucuacaaacaaauaaaauuugacuucuuucuuucugau

SEQ ID NO: 90402 - RNA, 64 nt, hsa
uucaacuaauuuuuggugcuguuauucuauucugcaaauaaacugaauguguuuguuaguucca

SEQ ID NO: 90403 - RNA, 64 nt, hsa
uucucuauuuuauauuucauagauuuaaaaaacccaaauaaagauggauuuaaaauucacugug

SEQ ID NO: 90404 - RNA, 64 nt, hsa
aguuugauuaccuagaaaguguguauagaaacugcaaauaaacgugacugcaauuaaacaaccg

SEQ ID NO: 90405 - RNA, 64 nt, hsa
uauuccuuccaguaaugccacuguauuuugucuccaaauaaaagaagcuuauuguaguauguuu

SEQ ID NO: 90406 - RNA, 64 nt, hsa
agcuaagcuuuaaacuucauuuuauguccuuucacaaauaaauuaguuuaaaacagaaaguggc

SEQ ID NO: 90407 - RNA, 64 nt, hsa
uaggaguuguucaaaucacugcaguagggcucugcaaauaaaauaauguaaccuauuaucaugg

SEQ ID NO: 90408 - RNA, 64 nt, hsa
guggcaauuuuaaauuuauauugugugugauguucaaauaaagugguaucuacauucaugugau

SEQ ID NO: 90409 - RNA, 64 nt, hsa
aucuaguagacuucugcacauguaaaauugaauucaaauaaaaucauacacacuuucuaguucu

SEQ ID NO: 90410 - RNA, 64 nt, hsa
guuuucaauaggguguagaccuccaguaccuuuguaacuaaagucugucuagucauuguaaaua

SEQ ID NO: 90411 - RNA, 64 nt, hsa
uuguugaugacauuagauuaguaguugcauuaaauaacuaaauucccauugugauuaauugaaa

SEQ ID NO: 90412 - RNA, 64 nt, hsa
aagauguaucaguauauugucacaguugugcuguuaacuaaaaaugcugagaccccuuuuuaua

SEQ ID NO: 90413 - RNA, 64 nt, hsa
gaaaucuacaccaaagugguuuuuuaaaauuacauaacuaaaaauaaaccacacuguggauaca

SEQ ID NO: 90414 - RNA, 64 nt, hsa
aaauauucucuucaaaugccaccuucucaauuuauaacuaaaauaguguuaucugacuaauucc

SEQ ID NO: 90415 - RNA, 64 nt, hsa
auuuaccuucagcuuauuugguaaccacugcuaauaacuaaaauguucucagcuuggaauaaug

SEQ ID NO: 90416 - RNA, 64 nt, hsa
uuuaugauuuucaucauaaagacuggcaauauuauaacuaaaaaucuuacuauaaugaaagaaa

SEQ ID NO: 90417 - RNA, 64 nt, hsa
aagacaugcacuuuccauauuuucaagucaauuuuaacuaaaaacuaagauaauguuuccuagu

SEQ ID NO: 90418 - RNA, 64 nt, hsa
acaacgcugagacaauccccuaacaacaugguaguaacuaaagaaacuuuuauacuaggcuucu

SEQ ID NO: 90419 - RNA, 64 nt, hsa
ucuaggugguucauuuugaaaggggacagaaauauaacuaaaugcuuccaggagaaaaauucca

SEQ ID NO: 90420 - RNA, 64 nt, hsa
aaaacaaacagcaauaacaauauuauuauuguuauaacuaaaaaaaaaaaaacaaaaacaagca

SEQ ID NO: 90421 - RNA, 64 nt, hsa
aauauguuuuaaaaugucuuauuuuuaagaauuauaacuaaaagaccaaauacugaaguuaagu

SEQ ID NO: 90422 - RNA, 64 nt, hsa
auuuauagucauaauuauuuuauuguaaagauuuuaacuaaaguuuuuccuuuucucucaaacu

SEQ ID NO: 90423 - RNA, 64 nt, hsa
ucuuuauacaaauaccauguaauguguacauauuuaacuaaagagauuuauagucauaauuauu

SEQ ID NO: 90424 - RNA, 64 nt, hsa
uuuggcuuucaauuccaaaacaugauuuaauuucuaacuaaauuaguauggcacuaguuaugaa

SEQ ID NO: 90425 - RNA, 64 nt, hsa
ccugcuuaucaauauucaguuugaugagcacuauuaacuaaaauaugaaacuuaaaaacaaaag

SEQ ID NO: 90426 - RNA, 64 nt, hsa
ccuuacuacacucaacugauugggaucuagaauguaacuaaauugcuuauaaaugucagcauuu

SEQ ID NO: 90427 - RNA, 64 nt, hsa
caaagaaucuugcacucaaugcacagugugauguuaacuaaaacgaguuaaauauuuaggaggc

SEQ ID NO: 90428 - RNA, 64 nt, hsa
gguaaaaucaauguuacaaaauuuaaggguauguuaacuaaaggauagcauuucuaagauauuu

SEQ ID NO: 90429 - RNA, 64 nt, hsa
aaucauuuaagguccuuuuauaggcaggcacuaguaacuaaaacugaaaacuaaguaaguuuau

SEQ ID NO: 90430 - RNA, 64 nt, hsa
cagacaugguguacugaucagaaauguucaguuuuaacuaaaacuaaauuuauguuauuuggcu

SEQ ID NO: 90431 - RNA, 64 nt, hsa
gcugcaaaauaauuguagacaaaauaauggcauuuaacuaaagauggagcaugaucuaaguaca

SEQ ID NO: 90432 - RNA, 64 nt, hsa
aacggaauggaaugccaagaaucugcauugagaauaacuaaacauuguuacuguacauacuauc

SEQ ID NO: 90433 - RNA, 64 nt, hsa
accauccaguugccuguuacagaauaacucuucuuaacuaaaaaccuagucaaacaaggaagcu

SEQ ID NO: 90434 - RNA, 64 nt, hsa
cuaugagccuaaaaccucuuuaaaaacggucaguuaacuaaaaaauaaaaaucaagucuuuagg

SEQ ID NO: 90435 - RNA, 64 nt, hsa
aaaaucaagucuuuaggagaguagaaaacacaauuaacuaaaaagcagggacaucugaaagaga

SEQ ID NO: 90436 - RNA, 64 nt, hsa
ugcccaaaguguauggcucagaagagaugaucaauaacuaaaauguuuuucguuuugcacaugg

SEQ ID NO: 90437 - RNA, 64 nt, hsa
ccuuauuuuguauuucacuuaagguggaggaccuuaacuaaaggaccauauuuauucauuauuu

SEQ ID NO: 90438 - RNA, 64 nt, hsa
aaauggaauuaucuaugggaugugugguucugguuaacuaaaaauuaaccaguaaacacucugu

SEQ ID NO: 90439 - RNA, 64 nt, hsa
gucaguauuccuacagaauucuuauuaacucaaauaacuaaauuucagaaaauuaagaagcuga

SEQ ID NO: 90440 - RNA, 64 nt, hsa
auuacaacuguuaaggagguuuugcuucuucuuuagauaacaacuuguuugcccaaaagaaucc

SEQ ID NO: 90441 - RNA, 64 nt, hsa
uuucucuucagaaaaguucccuuuucuaaaauugagauaacauaguucuugaauauuuugcugu

SEQ ID NO: 90442 - RNA, 64 nt, hsa
aggagucugcugguucuccuugaggauagugcuuagauaacagacucauuaaacauuuacugag

SEQ ID NO: 90443 - RNA, 64 nt, hsa
uugcacuuauuaauggucuuuauuuuucuagcauagauaacaauugauucuuuagauucauaua

SEQ ID NO: 90444 - RNA, 64 nt, hsa
cuuggauuuccuccagaguucggauuuccugagaagauaacagugaaacagcguuaucgccuac

SEQ ID NO: 90445 - RNA, 64 nt, hsa
uacaaaucccuuaccaauuugucacaagaagaacagauaacaaagcuguuaauacuuaaacugc

SEQ ID NO: 90446 - RNA, 54 nt, hsa
ugaaagcugggaaguuaugaaugaagauaacauucacccauaaccaagagaacu

SEQ ID NO: 90447 - RNA, 64 nt, hsa
cucagguagcugcaucaccaggcuugcuuggcguagauaacaauacacugaaauacuccugaag

SEQ ID NO: 90448 - RNA, 64 nt, hsa
aacaucuccugccuaaaaugcauugaauauuuuaagauaacagauauacuggcuggagguuugu

SEQ ID NO: 90449 - RNA, 64 nt, hsa
ccaccucauuuucaguuaacaugugccauuaaauagauaacauccuguggauuuagggauauuu

SEQ ID NO: 90450 - RNA, 64 nt, hsa; identical to SEQ ID NO: 64767

SEQ ID NO: 90451 - RNA, 64 nt, hsa; identical to SEQ ID NO: 64768

SEQ ID NO: 90452 - RNA, 64 nt, hsa; identical to SEQ ID NO: 64769

SEQ ID NO: 90453 - RNA, 64 nt, hsa; identical to SEQ ID NO: 64770

SEQ ID NO: 90454 - RNA, 64 nt, hsa; identical to SEQ ID NO: 64771

SEQ ID NO: 90455 - RNA, 64 nt, hsa; identical to SEQ ID NO: 64772

SEQ ID NO: 90456 - RNA, 64 nt, hsa; identical to SEQ ID NO: 64773

SEQ ID NO: 90457 - RNA, 64 nt, hsa; identical to SEQ ID NO: 64774

SEQ ID NO: 90458 - RNA, 64 nt, hsa; identical to SEQ ID NO: 64775

SEQ ID NO: 90459 - RNA, 64 nt, hsa; identical to SEQ ID NO: 64776

SEQ ID NO: 90460 - RNA, 64 nt, hsa; identical to SEQ ID NO: 64777

SEQ ID NO: 90461 - RNA, 64 nt, hsa; identical to SEQ ID NO: 64778

SEQ ID NO: 90462 - RNA, 64 nt, hsa; identical to SEQ ID NO: 64779

SEQ ID NO: 90463 - RNA, 64 nt, hsa; identical to SEQ ID NO: 64780

SEQ ID NO: 90464 - RNA, 64 nt, hsa; identical to SEQ ID NO: 64781

SEQ ID NO: 90465 - RNA, 64 nt, hsa; identical to SEQ ID NO: 64782

SEQ ID NO: 90466 - RNA, 64 nt, hsa; identical to SEQ ID NO: 64783

SEQ ID NO: 90467 - RNA, 64 nt, hsa; identical to SEQ ID NO: 64784

SEQ ID NO: 90468 - RNA, 64 nt, hsa; identical to SEQ ID NO: 64785

SEQ ID NO: 90469 - RNA, 64 nt, hsa; identical to SEQ ID NO: 64786

SEQ ID NO: 90470 - RNA, 64 nt, hsa; identical to SEQ ID NO: 64787

SEQ ID NO: 90471 - RNA, 64 nt, hsa; identical to SEQ ID NO: 64788

SEQ ID NO: 90472 - RNA, 64 nt, hsa; identical to SEQ ID NO: 64789

SEQ ID NO: 90473 - RNA, 64 nt, hsa; identical to SEQ ID NO: 64790

SEQ ID NO: 90474 - RNA, 64 nt, hsa; identical to SEQ ID NO: 64791

SEQ ID NO: 90475 - RNA, 64 nt, hsa; identical to SEQ ID NO: 64792

SEQ ID NO: 90476 - RNA, 64 nt, hsa; identical to SEQ ID NO: 64793

SEQ ID NO: 90477 - RNA, 64 nt, hsa; identical to SEQ ID NO: 64794

SEQ ID NO: 90478 - RNA, 64 nt, hsa; identical to SEQ ID NO: 64795

SEQ ID NO: 90479 - RNA, 64 nt, hsa; identical to SEQ ID NO: 64796

SEQ ID NO: 90480 - RNA, 64 nt, hsa; identical to SEQ ID NO: 64797

SEQ ID NO: 90481 - RNA, 64 nt, hsa; identical to SEQ ID NO: 64798

SEQ ID NO: 90482 - RNA, 64 nt, hsa; identical to SEQ ID NO: 64799

SEQ ID NO: 90483 - RNA, 64 nt, hsa; identical to SEQ ID NO: 64800

SEQ ID NO: 90484 - RNA, 64 nt, hsa; identical to SEQ ID NO: 64801

SEQ ID NO: 90485 - RNA, 64 nt, hsa; identical to SEQ ID NO: 64802

SEQ ID NO: 90486 - RNA, 64 nt, hsa; identical to SEQ ID NO: 64803

SEQ ID NO: 90487 - RNA, 64 nt, hsa
cucagaucucaccauugcacuccagccugggcgacugagcgagacucuaucucaaaacaaucaa

SEQ ID NO: 90488 - RNA, 64 nt, hsa
uccaccauugugauuuguuccugccccaccuuaacugagcgauuaaccugugaacuuccuucuc

SEQ ID NO: 90489 - RNA, 64 nt, hsa
gcuccaccaacaccucugugagucucaucaucagcugagcgaugaugccuuacagguugcauag

SEQ ID NO: 90490 - RNA, 64 nt, hsa
gaguuccaggcuggaguacaccaacuacuccagccugagcgacagaguaagaccuuaucuuuua

SEQ ID NO: 90491 - RNA, 64 nt, hsa
gacaggcccucauggcaggcuuguucccguggcucugagcgaggccucuuccugcugggcuccc

SEQ ID NO: 90492 - RNA, 64 nt, hsa
cggcugaccacuccuuuuggagacggcaggaggccugagcgauccguacucagaacguccagga

SEQ ID NO: 90493 - RNA, 64 nt, hsa
ccacguccaaucaugggccacaaggcacagucuucugagcgagugcucucacuguauuagagcg

SEQ ID NO: 90494 - RNA, 64 nt, hsa
ugauuuaaauaacuuccugauuggaguguguaagcugagcgauuucuaauaaaauuuuaguugu

SEQ ID NO: 90495 - RNA, 64 nt, hsa
gcagugagccgagauugugccccugcacuccagccugagcgacagugagacucugucucagucc

SEQ ID NO: 90496 - RNA, 64 nt, hsa
uauuucugaggugguucuaauucgcuaggcaggccugagcgaauacaaguuuagcuugucccug

SEQ ID NO: 90497 - RNA, 64 nt, hsa
uggcuuggccaggauuggcacuagcuaugaagggcugagcgagucacauuaaggaacuucacgg

SEQ ID NO: 90498 - RNA, 64 nt, hsa
aacguccacgggauuaacagaacguccuugcagacugagcgaugacaccacacuuuguuuggac

SEQ ID NO: 90499 - RNA, 64 nt, hsa
ucccucagaugacgggcgccgggccaccaucucacugagcgacagugaccugcugcggcuggag

SEQ ID NO: 90500 - RNA, 64 nt, hsa
ccgagauugcaccacugcauuccagccugggugacugagcgagacucugucucaaaaaaaaaaa

SEQ ID NO: 90501 - RNA, 64 nt, hsa
agacaaguccaaagcucguuuguggauugugggacugagcgaaggaguacaaauauauccacgu

SEQ ID NO: 90502 - RNA, 64 nt, hsa
auguccggcugaaggcugaguguccggcugaggccugagcgaguguccagccaagggcugagug

SEQ ID NO: 90503 - RNA, 64 nt, hsa
ugggguuuggaagugucugcacuggggucaugcacugagcgacccccaagcccuuccuuaagcc

SEQ ID NO: 90504 - RNA, 64 nt, hsa
cauuuacaacugaaaccuaggaagccccugaguccugagcgaaaacaggagaguuagucgcccu

SEQ ID NO: 90505 - RNA, 64 nt, hsa
gaaccagcaggaguggccuggcacauggaccggccugagcgaugugcacuccacccaagccagg

SEQ ID NO: 90506 - RNA, 64 nt, hsa
cgaggugcuuccuggcaggagagcagaugugauucugagcgacauggcgcccaaugccacaggg

SEQ ID NO: 90507 - RNA, 64 nt, hsa
aacaucucucaaaauaaaaaucccucuucccgcucugagcgauucagcucugcccgcagcuugu

SEQ ID NO: 90508 - RNA, 64 nt, hsa
uuuucugaauuccugcgccuuccugacgugagcccugagcgaucuucuaugcaguucugccaug

SEQ ID NO: 90509 - RNA, 64 nt, hsa
gcagugagccgagaucacgucacugcauuucagccugagcgacagagugaaacugucucaaaaa

SEQ ID NO: 90510 - RNA, 64 nt, hsa
acacaacauuugugucacuguacaguuuuguggacugagcgaggaaaaacaacaaauaauuuaa

SEQ ID NO: 90511 - RNA, 64 nt, hsa
ccucugugccagcgucccaggaaggaagccaacccugagcgagccuguccucuguggcaggucc

SEQ ID NO: 90512 - RNA, 64 nt, hsa
uugauuagaaucucagguuucagcuccugcuguccugagcgaacuugccugaugcagggcugug

SEQ ID NO: 90513 - RNA, 64 nt, hsa
agggccuggcauguuuguccugcucugccugggacugagcgaguggacuuagggcugggcaggc

SEQ ID NO: 90514 - RNA, 64 nt, hsa
cucuccucuccccuuuguggauucuuuuuggaaacugagcgaaauccaagaugcuggcaccaag

SEQ ID NO: 90515 - RNA, 64 nt, hsa
ucuugaugcaugcacuguucccccugugcagccgcugagcgaggagaugcuccuugggcccuuu

SEQ ID NO: 90516 - RNA, 64 nt, hsa
cuguuaugcuucucauuuuauauuuccaaaccaccugagcgaguaaugucaacuucgggagggu

SEQ ID NO: 90517 - RNA, 64 nt, hsa
guguaacaucugugcacaccauccauuccgcucgcugagcgauggaaaagcuugccuggaagac

SEQ ID NO: 90518 - RNA, 64 nt, hsa
gcccuggccuccugggggcgggguugugggggggcugagcgacacucagggacaccucaguugu

SEQ ID NO: 90519 - RNA, 64 nt, hsa
auuuguaaccucagcucugggagaggauuuuuuucugagcgauuauuaucuaaaguguguuguu

SEQ ID NO: 90520 - RNA, 64 nt, hsa
cuccugugccggugggcggggggcaugcuggccucugagcgaucaggcgaggccagcgagggug

SEQ ID NO: 90521 - RNA, 64 nt, hsa
cugacacccuaaaagccauccacagcuauggaaccugagcgacaccuugauuuguguugucacc

SEQ ID NO: 90522 - RNA, 64 nt, hsa
gaugauggagaguuuggccucaaguuuuuauaaacugagcgagacuaguguucaggaucuccuc

SEQ ID NO: 90523 - RNA, 64 nt, hsa
gguacuguacagcuggcucuacuuccccauggcccugagcgaguggagucugccacccaggauc

SEQ ID NO: 90524 - RNA, 64 nt, hsa
cugaacacaaccagagguggcaggagaauuucuacugagcgagcugggccgguuaguguauguc

SEQ ID NO: 90525 - RNA, 64 nt, hsa
auggaggacccaacaggaggccguggcucugaugcugagcgaagcuauaggcucuuguuggaua

SEQ ID NO: 90526 - RNA, 64 nt, hsa
caggccuguucccuaaggggccccagccaaggagcugagcgaggcugucuggcuugggggagau

SEQ ID NO: 90527 - RNA, 64 nt, hsa
gcagugagccgagaucgcaccacugcguuccagccugagcgacagggcaagacucagucucaaa

SEQ ID NO: 90528 - RNA, 64 nt, hsa
uggcuggacagacugauagcagaaaaaguacaggcugagcgaccugacaccauguuggggguug

SEQ ID NO: 90529 - RNA, 64 nt, hsa
gcacugagccgagaucacaccaccguacuccagucugagcgacagagcaagaaucugucucaaa

SEQ ID NO: 90530 - RNA, 64 nt, hsa
gggcagucaccugcccagaucccagaaggaccuccugagcgaugacucaagugucucaguccac

SEQ ID NO: 90531 - RNA, 64 nt, hsa
agucccaggcguaaagggggauguucuaugccggcugagcgagaaaaagaggaauaugaaacaa

SEQ ID NO: 90532 - RNA, 64 nt, hsa
ggagcccccagcaugggaaugaggggcucugcaacugagcgaagcugcgggcuaggaggcugga

SEQ ID NO: 90533 - RNA, 64 nt, hsa
caguccaugucuucaccagggagccauuugagugcugagcgacaagaggcucagagggcaugac

SEQ ID NO: 90534 - RNA, 64 nt, hsa
uccuucccccauuucugcguccaccccugaacuccugagcgacagaagccccaggccuccacca

SEQ ID NO: 90535 - RNA, 64 nt, hsa
uguagccugggucucccacgggccuuccccgcugcugagcgagacaccaguagccaggugaagg

SEQ ID NO: 90536 - RNA, 64 nt, hsa
ggaucacucccacuagggacucugcgcuaauuaccugagcgaccaggacuacauuucccaagag

SEQ ID NO: 90537 - RNA, 64 nt, hsa
cuccuagauggaucucagcggcauuaagcugugccugagcgaguuuguagugacucacugcaca

SEQ ID NO: 90538 - RNA, 64 nt, hsa
gaccuggauucuggucccugcugucccugccuggcugagcgacccagggcaggucccgucccug

SEQ ID NO: 90539 - RNA, 64 nt, hsa
gggacucuggcgucccggcaggcgagaggcgaggcugagcgaaagaaggaaggacagacggacc

SEQ ID NO: 90540 - RNA, 64 nt, hsa
uaaauggguggugugauuuuugacgugccuggcccugagcgaagcacauuacauauaucaucaa

SEQ ID NO: 90541 - RNA, 64 nt, hsa
gcucgccacgcucagugcccguuuuaccaauaaacugagcgaccccagagccgugugcgccugc

SEQ ID NO: 90542 - RNA, 64 nt, hsa
uuugaauuguaaacuugucagugaauuuaucacucugagcgagucucuagagggugagaauuug

SEQ ID NO: 90543 - RNA, 64 nt, hsa
gcagagccccucagggcgccgaugucgagggcaccugagcgaggggugccagcaagggggcggc

SEQ ID NO: 90544 - RNA, 64 nt, hsa
gccuuugagagccuccagguuccucaaaacaggccugagcgaugggcaucacacccucugccua

SEQ ID NO: 90545 - RNA, 64 nt, hsa
gguccagucugccgcugaugagacugcugugcagcugagcgaguugcugacgcugcccgugcuc

SEQ ID NO: 90546 - RNA, 64 nt, hsa
cuguuucagauggaaaaauauaaacuauuuuuuucugagcgauacauuaaacuauuuuccccag

SEQ ID NO: 90547 - RNA, 64 nt, hsa
guauggggaagaugucaagcccuucaagccaccccugagcgaugcugaguuucacacguaccug

SEQ ID NO: 90548 - RNA, 64 nt, hsa
ugaaggaggugcugaguuuuguaucuuuuuaaucauaaucaacaucaguuuuugacccaacuaa

SEQ ID NO: 90549 - RNA, 64 nt, hsa
caaaggaaggacuaaaaagccuccacggacaucgauaaucaagagauuauuaagaucuuugcua

SEQ ID NO: 90550 - RNA, 64 nt, hsa
caggugaacugaaaaguuauuuuaacuauuauacauaaucaagauccugccucuacggaauuag

SEQ ID NO: 90551 - RNA, 64 nt, hsa
acacugucuugaaauugaaucuguccaucuguuuauaaucaagaacauaucagaaauauauagg

SEQ ID NO: 90552 - RNA, 64 nt, hsa
aaacucuuugcuucugcuaagaagcagucuaaauauaaucaacguacagugagcucuuugaagc

SEQ ID NO: 90553 - RNA, 64 nt, hsa
aguuguauauucuugcaaugcauaaaaugacauuauaaucaacaaacuuaugguuuguuucaau

SEQ ID NO: 90554 - RNA, 64 nt, hsa
uuuucugagaguugggugaggguaaagcuuuucuauaaucaagcucaauacaccaaggaaacug

SEQ ID NO: 90555 - RNA, 64 nt, hsa
guauccuuuccucaguguguauaugacagccaguauaaucaauacccuagguuaugcgucuaua

SEQ ID NO: 90556 - RNA, 64 nt, hsa
uucuaaaauauccuccaaugugugcauggaacaaauaaucaaaagaaccagacugugucuuauu

SEQ ID NO: 90557 - RNA, 64 nt, hsa
gaguccaucucaaaaaaaaacaacuauuuuucacauaaucaaacucaccuugucucaugacuuu

SEQ ID NO: 90558 - RNA, 64 nt, hsa
uuguaagccagucagguuauuuaaugaugagguaauaaucaaauuuaagaauuugugacaugua

SEQ ID NO: 90559 - RNA, 64 nt, hsa
ugcagccaucccccucauuuuaaauguugcccuaauaaucaaugcaguuaacaaguauauuggc

SEQ ID NO: 90560 - RNA, 64 nt, hsa
cucacagacaucugaaaagugaauggccaagcuggucuaguagaugaggcuggacugaggaggg

SEQ ID NO: 90561 - RNA, 64 nt, hsa
ucucuaagcuucugaaguguuagagguagagauggucuaguaaagauguaguaguaauguuuua

SEQ ID NO: 90562 - RNA, 64 nt, hsa
cccagucccuacacugacuacccugaucucucuugucuaguacgcacauaugcacacaggcaga

SEQ ID NO: 90563 - RNA, 64 nt, hsa
augggagaagagagacaggguucuuuucagcagagucuaguaguuucucuguaaggcaaaauaa

SEQ ID NO: 90564 - RNA, 64 nt, hsa
agaaagcugaugcuugaucuugcacaauuuuuaugucuaguauguaugcuugagugaaugugcg

SEQ ID NO: 90565 - RNA, 64 nt, hsa
agaauugugggcuguagcguuacucugauuuucugucuaguaucagagaaugcugguagcuuaa

SEQ ID NO: 90566 - RNA, 64 nt, hsa
caguugauuuccucuugaacugccggugaaaacagucuaguacacaggugcugucagcccaggg

SEQ ID NO: 90567 - RNA, 64 nt, hsa
uagauugaauuuaaaguaaguauggauuauggaagucuaguaaauauacuuuucccuauuuuug

SEQ ID NO: 90568 - RNA, 64 nt, hsa
agaaaauauuaccauguaaauauguacauauguagucuaguaaaagcaggcaaacacauaucuu

SEQ ID NO: 90569 - RNA, 64 nt, hsa
aaaccucagagaaggcauguggauuauaagauuugucuaguaaaaauuguaauugaauauguuu

SEQ ID NO: 90570 - RNA, 64 nt, hsa
auacagcgacaauccuguuuucuacaagaauccugucuaguaaauaggaucauuuauugggcag

SEQ ID NO: 90571 - RNA, 64 nt, hsa
uugauaucuguuucaguuagggcuaaugggaaaugucuaguaagauaaaugucaacuuuugcug

SEQ ID NO: 90572 - RNA, 64 nt, hsa
caugacuugaacaacuguguuuuaaaguacuguagucuaguagguaacuuuguggcaaaaauuu

SEQ ID NO: 90573 - RNA, 64 nt, hsa
uaagaggaaaguaauuuuuguugcauuauaaaaugucuaguagcaucauaaguuuuuuugagag

SEQ ID NO: 90574 - RNA, 64 nt, hsa
gugggucagugggagcugcaggugucagcuuuucgucuaguaacuuaagugagagagaaagggc

SEQ ID NO: 90575 - RNA, 64 nt, hsa
gaaaacauauuugcaaaucaucuaacugauaaaggucuaguauccaaaauauuuaaauuuauga

SEQ ID NO: 90576 - RNA, 64 nt, hsa
caauuagaacuuuuugaucagccuggcugguaccgucuaguacuaugcagcgguccucaaguug

SEQ ID NO: 90577 - RNA, 64 nt, hsa
aaagauauauaaagggcuguaagcuaauuguggugucuaguaaguagcauaaugagaugugagg

SEQ ID NO: 90578 - RNA, 64 nt, hsa
uucccuuuaacauagaaguguccagcugcguacagucuaguaaccagcaacuguaaacgaaccu

SEQ ID NO: 90579 - RNA, 64 nt, hsa
gggagaacuguccacucaugccauuuucucucuugucuaguauuucauuaggaucuaaaguugu

SEQ ID NO: 90580 - RNA, 64 nt, hsa
gugggcauguauuagccagucauuguaaccucgugucuaguagaacaauguacaagguauguac

SEQ ID NO: 90581 - RNA, 64 nt, hsa
aagaauguaauuuauuuuuacauaauuaucuuaugucuaguaauaauucugauaauuugcuucu

SEQ ID NO: 90582 - RNA, 64 nt, hsa
auuuuuuaauaagaacauuaauuauauguauauugucuaguaauugggaaaaaagcaacugguu

SEQ ID NO: 90583 - RNA, 64 nt, hsa
uuucaauggagucuuuaagcaugaucuuuuuucugucuaguacuuguuuucauucuggccagca

SEQ ID NO: 90584 - RNA, 64 nt, hsa
gaguucaaguacauaaaguacauaacaagcgaacgucuaguacaauucuuacuuauguguaugg

SEQ ID NO: 90585 - RNA, 64 nt, hsa
ugugguagagcugagauuagaauccagauuccuagucuaguauccuucccacuguaccacauua

SEQ ID NO: 90586 - RNA, 64 nt, hsa
uuugugcuuuugaaaugucuguuuugacaucauagucuaguaaaauuuugacagugcauaugua

SEQ ID NO: 90587 - RNA, 64 nt, hsa
uuauguagacaaaacuuauaauuuccaaacuguugucuaguauacagugaucaguugcucucug

SEQ ID NO: 90588 - RNA, 64 nt, hsa
uuuguaaagugcaugagucauguucacacuugaagucuaguagugcacuguaauaauucauuuu

SEQ ID NO: 90589 - RNA, 64 nt, hsa
ccauucagguaccaucaccuggucccaucaacaggucuaguauguagcucacugauaacagagg

SEQ ID NO: 90590 - RNA, 64 nt, hsa
aaaaaaaaaucugguaucaacccacauuuuggcugucuaguauucauuuacauuuaggguucac

SEQ ID NO: 90591 - RNA, 64 nt, hsa
cugccuaauuuuuaguguuuaauaacaaccgaaugucuaguaaaugacucuccucugagcugua

SEQ ID NO: 90592 - RNA, 64 nt, hsa
aaauguucauaaauguuuuauauauuauuugguagucuaguauggcuuuaacugaauauuugau

SEQ ID NO: 90593 - RNA, 64 nt, hsa
aacaaucaccaccaccauuauuaaacuguaacuugucuaguaaauugucacuagaacuauuugc

SEQ ID NO: 90594 - RNA, 64 nt, hsa
auaaccaaggugauucaggauuugaucaaaagaagucuaguaagaauuaauuacacagaagccu

SEQ ID NO: 90595 - RNA, 64 nt, hsa
ucaacauaucagguggucauugccuuucuccauugucuaguagacaugucuaaaguucaaacuu

SEQ ID NO: 90596 - RNA, 64 nt, hsa
cagauggagagcuucagaaugggcuauccuuagagucuaguacaucuugaggccucucagcagg

SEQ ID NO: 90597 - RNA, 64 nt, hsa
uuguccucauauucaguccaguuuaauacuguaugucuaguaagaugggcuauauauugccucu

SEQ ID NO: 90598 - RNA, 64 nt, hsa
ccuuucccuuuucuuucaguuuuuuuaaucgcaugucuaguauauuaagucuccauagcccucc

SEQ ID NO: 90599 - RNA, 64 nt, hsa
ccgugcugaggcuccacauagcuccuggaccugugucuaguacauacugaagcgauggucagag

SEQ ID NO: 90600 - RNA, 64 nt, hsa
cggcagauaugaaaugccuggcacagugcuuggggucuaguauguagcuuccagaacccacccu

SEQ ID NO: 90601 - RNA, 64 nt, hsa
agacgucucaagacugaaacggccccauugccuggucuaguagcggaucucacucagccgcaga

SEQ ID NO: 90602 - RNA, 64 nt, hsa
acaaauauaggugccuuuuugauuacucuuguuugucuaguaugcucuuggaaagaaaaccaag

SEQ ID NO: 90603 - RNA, 64 nt, hsa
acagaagaaauauuucuguguaacuugaucuucugucuaguacuugucuuauagguaaccaaca

SEQ ID NO: 90604 - RNA, 64 nt, hsa
aauaaagcauuaaaauuucuuuuggggagagacugucuaguaauuuaaaauguguuaaauauga

SEQ ID NO: 90605 - RNA, 64 nt, hsa
cagguugcugcaugcaauaaauuuuauauccaaugucuaguauaaaacguucccacaaugcaca

SEQ ID NO: 90606 - RNA, 64 nt, hsa
uuuuguauaaaguuuccgacuccgucuuggccaugucuaguaauugcuauguguugggagaaac

SEQ ID NO: 90607 - RNA, 64 nt, hsa
ucaggaggaaagacacuuaaagacacuuuuacaugucuaguaauucuugauguucaucuucagc

SEQ ID NO: 90608 - RNA, 64 nt, hsa
uauuauugcagcuugaucauuuauauaaauauuugucuaguacaaugcuugacauacagcauug

SEQ ID NO: 90609 - RNA, 64 nt, hsa
uagcacaaguuagggaggaagaggcaggcgaugagucuaguagcacccaggacggcuuguagcu

SEQ ID NO: 90610 - RNA, 64 nt, hsa
ucgcugaguccgugcccuuuuaguuaguucugcagucuaguaugguccccauuugcccuuccac

SEQ ID NO: 90611 - RNA, 64 nt, hsa
auuaaaagccucuagaaguaacuccccuuaaaaugucuaguaaagcuugcacauggauugauua

SEQ ID NO: 90612 - RNA, 64 nt, hsa
caauacuaccucugaauguuacaacgaauuuacagucuaguacuuauuacaugcugcuauacac

SEQ ID NO: 90613 - RNA, 64 nt, hsa
aaauuuauguuauuuggcuaaauguuaugaugcagucuaguacgaguauugcaucuaauuccag

SEQ ID NO: 90614 - RNA, 64 nt, hsa
cauagugaaaagacagugaccucucuuucauccagucuaguauaucacuaaaucaucauuacga

SEQ ID NO: 90615 - RNA, 64 nt, hsa
ucaugguuaacacgcauuuaaaauuauuucaugagucuaguaguucuuugauuuauagcaggau

SEQ ID NO: 90616 - RNA, 64 nt, hsa
gguaccuuugcuugaaccgugcaaccacaucugggucuaguagguggaucccauccaguugguu

SEQ ID NO: 90617 - RNA, 64 nt, hsa
aaucgaagcuuucuuuucaccaugacuuuauaaugucuaguaaacaauauuucuacuucccaca

SEQ ID NO: 90618 - RNA, 64 nt, hsa
auaggcuuccaaggcauaggaagagaucuugcaggucuaguauuuuaauaaugcacuauuaccc

SEQ ID NO: 90619 - RNA, 64 nt, hsa
uguuuuuuuuuuuuuuuuuguaguuuauuuuggagucuaguauuucaauaauuuaagaaucaga

SEQ ID NO: 90620 - RNA, 64 nt, hsa
uucuucacuaaaggagaccaaacuguuccuugcggucuaguauuuaagaacuggaacuugaaag

SEQ ID NO: 90621 - RNA, 64 nt, hsa
uguaucaaaaguggguucucugggcuguggcuuugucuaguaguaccacaguggcuaaaguaga

SEQ ID NO: 90622 - RNA, 64 nt, hsa
cucucccuuugcuaguacuuucucuaaaguacuagucuaguaaaauuuauucuuguuagaaggu

SEQ ID NO: 90623 - RNA, 64 nt, hsa
agcucuaaauccauuuuuguguagggagaauaaugucuaguaauguggaagaauagcuaucauu

SEQ ID NO: 90624 - RNA, 64 nt, hsa
ucucuugucuuuacugggaagcuggagagucacagucuaguagaagaaagguaagaaugugcuu

SEQ ID NO: 90625 - RNA, 64 nt, hsa
acagggauggaauguaaauauccagagaauuugggucuaguauaguacauuuucccuuccauuu

SEQ ID NO: 90626 - RNA, 64 nt, hsa
guucugaccaaaccguuucacugucuugucuggugucuaguauuaauguugcccaguaagcacc

SEQ ID NO: 90627 - RNA, 64 nt, hsa
ugaagaaugugguaaauccuucagcugauucucagucuaguaaacauaagaaaauucauacugg

SEQ ID NO: 90628 - RNA, 64 nt, hsa
auggugucuguuaccucuucccacuugugacaaugucuaguaagguccacucuccauucugugu

SEQ ID NO: 90629 - RNA, 64 nt, hsa
ugagccccuuauuuucuuuuuuuucccuccccaggucuaguagcucuaacuaaaaaguucuugg

SEQ ID NO: 90630 - RNA, 64 nt, hsa
agcauuggaaaugaugaaugaaucauaccagaacgucuaguauaauuacagucaugcauugcuu

SEQ ID NO: 90631 - RNA, 64 nt, hsa
agaauaccacacuuuaauauuaaauauucauaaggucuaguaucuugauaauaauguagauguu

SEQ ID NO: 90632 - RNA, 64 nt, hsa
cuaaucucauuaaacaaauauucuccaugggccugucuaguagauuaauggaucugguuggccg

SEQ ID NO: 90633 - RNA, 64 nt, hsa
ccacuugccuccccaaucuguuaaacagcuucgugucuaguaugagcucaguacuugcccugug

SEQ ID NO: 90634 - RNA, 64 nt, hsa
aacacaucuugaaagauguagaagucccucuauagucuaguauaguuuacaauagaguuguaag

SEQ ID NO: 90635 - RNA, 64 nt, hsa
guaagucauuuuuaguuugguugugaaaaaacccugggcugaaguuggcauuucaguuaaaaga

SEQ ID NO: 90636 - RNA, 64 nt, hsa
agccauuggggaggcagaugcggguguggaggugugggcugaagguagugacuguuugauuuua

SEQ ID NO: 90637 - RNA, 64 nt, hsa
cuagcuggaggaggggucugaugugcugguaacuugggcugaccuaccuacagucccuggcugc

SEQ ID NO: 90638 - RNA, 64 nt, hsa
accauugggugcauagagauggggaggaggccacugggcugaauuuucucuuuaggcggaaaug

SEQ ID NO: 90639 - RNA, 64 nt, hsa
auuugucuggguauagucacuccuggugaugauaugggcugaaaugucuccacgucucuuugug

SEQ ID NO: 90640 - RNA, 64 nt, hsa
gggaucgaagacauuucaaauugcuaucuccaucugggcugauccaaaauucugagauuguugg

SEQ ID NO: 90641 - RNA, 64 nt, hsa
guaagggaucgaaaacauuucaaauugcucuaucugggcugauagacauuucgucauuuaagua

SEQ ID NO: 90642 - RNA, 64 nt, hsa
ccccacuuccacuccccucuacucucucuaggacugggcugaugaaggcacugcccaaaauuuc

SEQ ID NO: 90643 - RNA, 64 nt, hsa
cccaacaaucagguccccugagauagcuggucauugggcugaucauugccagaaucuucuucuc

SEQ ID NO: 90644 - RNA, 64 nt, hsa
gguccuuugcccgguggugggaggauggagggauugggcugaagcugcuccaccucauccuugc

SEQ ID NO: 90645 - RNA, 64 nt, hsa
uaaagcuccccgggcgucagaguugagcccugccugggcugaaggacugucuucacgaagucag

SEQ ID NO: 90646 - RNA, 64 nt, hsa
aucucaaagccagcauaauuaacuacuuugauugugggcugaccuuuguuuuuuuaacaaucag

SEQ ID NO: 90647 - RNA, 64 nt, hsa
cagugccaaggugcaugacccucugagaagucacugggcugauuugaccuccgacucauugguu

SEQ ID NO: 90648 - RNA, 64 nt, hsa
agcucccguuagccaggacuuguccccuggcagcugggcugagucugcccugagggggcgccuu

SEQ ID NO: 90649 - RNA, 57 nt, hsa
cugccgcaggcacccagugaacccgcuugggcugaggcagcgagugauucccgcgcu

SEQ ID NO: 90650 - RNA, 64 nt, hsa
ugcuucccuaggaucccgucuuccagagaaccugugggcugacugcccuccgaagagaguucug

SEQ ID NO: 90651 - RNA, 64 nt, hsa
uaugucuggcagaugagggcuggcugccguuuucugggcugaugggugcccuuuccuggcaguc

SEQ ID NO: 90652 - RNA, 64 nt, hsa
uguuuacagugcagaaggcggcucagcagugcaaugggcugacagccuuggaccgggagucaga

SEQ ID NO: 90653 - RNA, 64 nt, hsa
guaagaauccaggagcaagcuuuggugaauccagugggcugaguggcucuauggaugugguugu

SEQ ID NO: 90654 - RNA, 64 nt, hsa
uuuaccauuuucuauauugccaaguugaaucaugugggcugaugcagggaagcucugaagcagu

SEQ ID NO: 90655 - RNA, 64 nt, hsa
gcugcccaggccuucccaggaaaaucauuuuuucugggcugauguuguauucugccauggcgca

SEQ ID NO: 90656 - RNA, 64 nt, hsa
ggcuuugcccggccgccccaggaacccaacccucugggcugaccuuucuccugcuucucuccag

SEQ ID NO: 90657 - RNA, 64 nt, hsa
uccacccaacgcccaggcaccccagucuacuugcugggcugaguccagcccuggggaagauucc

SEQ ID NO: 90658 - RNA, 64 nt, hsa
uuagccaugaucugcaggggucugggagucaggcccggccuauugcuugggucucucuccauuu

SEQ ID NO: 90659 - RNA, 64 nt, hsa
agguugcagugagcugagauggcaccacugcacuccggccuaggcaacgagagcaaaacuccaa

SEQ ID NO: 90660 - RNA, 64 nt, hsa
caggacucugcaggucaaggauaugugaugagcaccggccuaaguguuugcucuucagauuccu

SEQ ID NO: 90661 - RNA, 64 nt, hsa
cauagaaagucuccugcgggagcggaaaugcaguccggccuagggcucccagcccuugacuguc

SEQ ID NO: 90662 - RNA, 64 nt, hsa
aauccugcauaaccccauuaggaguagauggugcccggccuaucugucagggaggcaaaaaagg

SEQ ID NO: 90663 - RNA, 64 nt, hsa
aaagugcuggaauuacaggccugagccaccccacccggccuauuuucuuaaaggggaacaaaug

SEQ ID NO: 90664 - RNA, 64 nt, hsa
uguuaaaggaauccuuuuguaugacuuguccagaccggccuauugcccuacccguuugauucuc

SEQ ID NO: 90665 - RNA, 64 nt, hsa
acuggugacuuaaggagcugcgaagucugauuuaccggccuacucucgaccugccccccacccc

SEQ ID NO: 90666 - RNA, 64 nt, hsa
ccagccuuucuuuccccucugaugcacguuccucccggccuaguccguggaggcccaucacacc

SEQ ID NO: 90667 - RNA, 64 nt, hsa
agagugcugggauuacaggcgugagccaccgcgcccggccuauuccauauuuuuuuaaugggac

SEQ ID NO: 90668 - RNA, 64 nt, hsa
aaagugcugggauuacaggugugagcuaccgcgcccggccuauuaucuuguacuuucuaacuga

SEQ ID NO: 90669 - RNA, 64 nt, hsa
auacaguaaauauauuguguuugcugacaaucagccggccuauaaaucuccuuauuuuauuucu

SEQ ID NO: 90670 - RNA, 64 nt, hsa
ggaaaagcugcacucaccaaggaccacaaugcccccggccuaaaguacugccauucagaaaagc

SEQ ID NO: 90671 - RNA, 64 nt, hsa
uggagcauucgguagcguauucagacugcaugggccggccuaggagucuuugccuucauaaauu

SEQ ID NO: 90672 - RNA, 64 nt, hsa
aaaagccaagcccgggacccucgugugagccagcccggccuaaucugaccgccucaacgccauu

SEQ ID NO: 90673 - RNA, 64 nt, hsa
cccgggccggccucgggccacccacgagggccucccggccuagggcccgaccgcgccggacgcg

SEQ ID NO: 90674 - RNA, 64 nt, hsa
gcagugagcggagacugcaccacugcauuccagcccggccuacaagaacaaaacuccaucucaa

SEQ ID NO: 90675 - RNA, 64 nt, hsa
augggguuaaacauucucacucagguaugcugugccggccuacagguugugaauguguuuuuau

SEQ ID NO: 90676 - RNA, 64 nt, hsa
aaaguacugggauuacaggccugagccaccgcgcccggccuauuuuucacuuuaauuuggcagc

SEQ ID NO: 90677 - RNA, 64 nt, hsa
ggagggaccuugaccuucuggugccugccccuccccggccuaugugccauccgcgugacgcuag

SEQ ID NO: 90678 - RNA, 64 nt, hsa
aaagugcugggauuacaggcgugagccaccgugcccggccuacaaauguuaacaaagcaauuac

SEQ ID NO: 90679 - RNA, 64 nt, hsa
cuccugcagaguuuggaagaagucaccagcaaagccggccuaaccaagaaaagucaaggcccuu

SEQ ID NO: 90680 - RNA, 64 nt, hsa
cuguugaccagaaaggacacuccauauugugaaaccggccuaauuuuucugacugauauggaaa

SEQ ID NO: 90681 - RNA, 64 nt, hsa
ccuucccuccaaucaucacugugcuccuuuuuucccggccuacgaggcagcuccugccacuauc

SEQ ID NO: 90682 - RNA, 64 nt, hsa
cucggcacaaagcggagggaggcuguggucgcugccggccuaggugucccaggugccccgccuu

SEQ ID NO: 90683 - RNA, 64 nt, hsa
aaagugcugggauuacaggcaugagccacugugcccggccuaugauucuuuuuuuuuuuuuuuu

SEQ ID NO: 90684 - RNA, 64 nt, hsa
cuaccccagccaacaccaaggccacaaggggaccccggccuaggaggcaggaagccaaggugca

SEQ ID NO: 90685 - RNA, 64 nt, hsa
gcagccccuucuggccggugcuggguucccacucccggccuaggcaccuccccgcucucccugu

SEQ ID NO: 90686 - RNA, 64 nt, hsa
auucaaucacgacguuaaccggcucgagagagcgccggccuagaggcucauuaucuauuuauuu

SEQ ID NO: 90687 - RNA, 64 nt, hsa
cugaaauaacuggaacccagccucuccuccuacaccggccuacccaucugggcccaagagcugc

SEQ ID NO: 90688 - RNA, 64 nt, hsa
uugugccccuguaggagguagguccuuuucuccuccggccuaguaggggaccuuggguaacauc

SEQ ID NO: 90689 - RNA, 64 nt, hsa
gguguggcauggcucagucuggcccccuugauuaccggccuagccccugcucacaucacagcug

SEQ ID NO: 90690 - RNA, 64 nt, hsa
agguugcagugagcugagaucaugccacugcacuccggccuaggugacagagggaaacuccauc

SEQ ID NO: 90691 - RNA, 64 nt, hsa
aaagugcugggauuacaggcgugagccacugcgcccggccuauuuccccaccuuucguguaagg

SEQ ID NO: 90692 - RNA, 64 nt, hsa
ugaaugugggaaucagaaaaaccuguucccaucaccggccuagccuagaauccuagccuagaag

SEQ ID NO: 90693 - RNA, 64 nt, hsa
caggcccggcccucccgcccccgaccugaccacgccggccuaggguuccagacugguuggacuu

SEQ ID NO: 90694 - RNA, 64 nt, hsa
aaagugcugggauuacaggcaugagcuacugcacccggccuaaccaggcuggagugcaguggug

SEQ ID NO: 90695 - RNA, 64 nt, hsa
guccucgcccuacauugaguacacgccggccagcccggccuacgcccaguacccaccggccacc

SEQ ID NO: 90696 - RNA, 64 nt, hsa
aaagugcuaggauuacaggcaugagccaccaugcccggccuaaacuuuguuuuuaaaaugaacu

SEQ ID NO: 90697 - RNA, 64 nt, hsa
cccugcugccaggcccucuccccacugccccaaaccggccuagacacgaagaccaaagcagccu

SEQ ID NO: 90698 - RNA, 64 nt, hsa
gcuuccuucgccagaggccugcggucucccacuuccggccuagucugccagcuuuugcuggcac

SEQ ID NO: 90699 - RNA, 64 nt, hsa
uauugccaguccugcuuuuccuggcaggcauuugccggccuaugugcuuuaaccuuaagcugau

SEQ ID NO: 90700 - RNA, 64 nt, hsa
gcuucgaaguuacaggacuaaaagagcaaacugaccggccuaaaacuaaaaugacauuuauucc

SEQ ID NO: 90701 - RNA, 64 nt, hsa
aaagugcugggaugacaggcgugagccaccgcgcccggccuauaccucauuuucuacaugucgc

SEQ ID NO: 90702 - RNA, 64 nt, hsa
caacuuuuuccuuuaaaggacuccuaaacuaagcacagaagaguuggcgucaucuuaaaaauac

SEQ ID NO: 90703 - RNA, 64 nt, hsa
agaagaguuggcgucaucuuaaaaauaccaaauaacagaagaucgcauugcagaugauaucagg

SEQ ID NO: 90704 - RNA, 64 nt, hsa
gacaucuuuugauauucuuauaaauggaacuuacacagaagaaauagggauaugauaaccacua

SEQ ID NO: 90705 - RNA, 64 nt, hsa
gcagagaacaguuaaucccuaaggucuugacaaaacagaagaaaaacaagccuccucguccuag

SEQ ID NO: 90706 - RNA, 64 nt, hsa
gagaacauggauuaggauccuagacuguaaagacacagaagaugcugaccucaccccugccacc

SEQ ID NO: 90707 - RNA, 64 nt, hsa
aauaccacguaaaucaagccauucauuuuggggaacagaagauccauaacuuuagaaauacggg

SEQ ID NO: 90708 - RNA, 64 nt, hsa
agcaaagccaauacaaaaaucagcuaaagcugccacagaagaggcaucuucaagaucaccaaaa

SEQ ID NO: 90709 - RNA, 64 nt, hsa
uuuuucuuaaccugucuagcugucggaaaagguaacagaagauggaacucgaaaucccaaugaa

SEQ ID NO: 90710 - RNA, 64 nt, hsa
uauaugcaauauauuccagauguuuugagagauuacagaagaggaggccugcuucacuugcaga

SEQ ID NO: 90711 - RNA, 64 nt, hsa
uaauugccucuacucugagucacuaucuucccugacagaagacaaggaccaggucuggccugau

SEQ ID NO: 90712 - RNA, 64 nt, hsa
guugcagugaaaaauaguaggccacuuggcucacacagaagaaaggaguuaggaaaaguaagua

SEQ ID NO: 90713 - RNA, 64 nt, hsa
aauaaugaaaugacuaaguuaugugaggaaaaaaacagaagacauugcuaaaagaguuaaaagu

SEQ ID NO: 90714 - RNA, 64 nt, hsa
gucgugauugugccacugcacuccagccggggugacagaagagaccuugucucgaaaaggaauc

SEQ ID NO: 90715 - RNA, 64 nt, hsa
uugucuaccaguacacaggcugcagaagacagagacagaagaaagagaucaagggcagauaacu

SEQ ID NO: 90716 - RNA, 64 nt, hsa
uggcugagaugaccugguccuaggacacccuuggacagaagacuggccuaccuagcagaccugg

SEQ ID NO: 90717 - RNA, 64 nt, hsa
ucccucuucccagaaaaccagucuguguuuacagacagaagagaaggaagccauagugucacuu

SEQ ID NO: 90718 - RNA, 64 nt, hsa
uaauuacaugaaugcaccuggaaugacauuuguaacagaagacggucugacuugcuuucaguau

SEQ ID NO: 90719 - RNA, 64 nt, hsa
acagucaggguggacucaaucuuucugguucuccacagaagacgucucugcaagaagccuggag

SEQ ID NO: 90720 - RNA, 64 nt, hsa
uuuaaauguuauuuuggaaagggguuuuggggacacagaagaauaaguaaacacaucucggagg

SEQ ID NO: 90721 - RNA, 64 nt, hsa
gcugcuguaagaccaccaaaaaugagucagaaacacagaagacuauuucaggcaugugggccug

SEQ ID NO: 90722 - RNA, 64 nt, hsa
acccuucaggaacccuuuaguuuauuaaucuuauacagaagaaacuaacuuagaaacaaaggau

SEQ ID NO: 90723 - RNA, 64 nt, hsa
aaaaggaaaaugggugguugggagagaaacuagaacagaagaugugcaauagggcucagagcag

SEQ ID NO: 90724 - RNA, 64 nt, hsa
ugccugaagcucagcgugaagucugaaauaugcaacagaagaaauauaucucuaucucucuacu

SEQ ID NO: 90725 - RNA, 64 nt, hsa
uuucaagaauaaagccaucauaagaccucaugccacagaagagauaaaagugcuuuuuauacca

SEQ ID NO: 90726 - RNA, 64 nt, hsa
ggagugguuugaucuauauacacugugacgauggacagaagaaaauugugaaaguucaaauucg

SEQ ID NO: 90727 - RNA, 64 nt, hsa
aagaggaaaaaaaagcaacaaaaaaagaaaacacacagaagagauuuaaaaaaaaaaaaggaaa

SEQ ID NO: 90728 - RNA, 64 nt, hsa
agaaaaaaaucaaaaaagcgacaaaaaaacacaaacagaagaggaaaaaaaagcaacaaaaaaa

SEQ ID NO: 90729 - RNA, 64 nt, hsa
guuaucuuaugagacucuguuuuauuuguauccaacagaagauguuuauuauuuauuuggcuuu

SEQ ID NO: 90730 - RNA, 64 nt, hsa
aacagaaaugugaucauugauuucaguguucaagacagaagaagacuggguaacaucuaucaca

SEQ ID NO: 90731 - RNA, 64 nt, hsa
ugcauguucucucuuuggguucaagcauuuccuuacagaagagccaccguggaagucaugggua

SEQ ID NO: 90732 - RNA, 64 nt, hsa
auauucuuuaugcagaagucuuguuuuauuacauacagaagagcucccacugcagaagggccuc

SEQ ID NO: 90733 - RNA, 64 nt, hsa
aacuuaagagaaaaagaaaccuacucaagaaaagacagaagagacagugauuugggaugagucu

SEQ ID NO: 90734 - RNA, 64 nt, hsa
caggaaagagaaaaagaaaucuguugaagaaaggacagaagaggaaaugcuuugggaugagucu

SEQ ID NO: 90735 - RNA, 64 nt, hsa
uaaaauguuuuacaaguaauguaaaagcuaguaucauucuuacauacuucuguguuuaaauuuu

SEQ ID NO: 90736 - RNA, 64 nt, hsa
guaucauucuuacauacuucuguguuuaaauuuucauucuuaccaaaacaguuaacucuuucuu

SEQ ID NO: 90737 - RNA, 64 nt, hsa
gguacuguuaaguaaaccagauuuucuaaauaggcauucuuaaaauuucagacuuacaaagcua

SEQ ID NO: 90738 - RNA, 64 nt, hsa
gcuuaaguauaauuuauagaauuucagugcaguucauucuuaauggaaaaucugaaaccuaaau

SEQ ID NO: 90739 - RNA, 64 nt, hsa
augaguagcaggccuuagugcaucacuggcaucucauucuuaggaaacuugucuuugauacaaa

SEQ ID NO: 90740 - RNA, 64 nt, hsa
cucucuaacacagagaagcacuaacuuagauccucauucuuaauauuuauauguaucuauuuuu

SEQ ID NO: 90741 - RNA, 64 nt, hsa
ccaucccugggguuugcaaguuguucacuuaaaacauucuuaaaaugguuggcuucuugucugc

SEQ ID NO: 90742 - RNA, 64 nt, hsa
caguugugaugguuguuaaaugcucacaauugugcauucuuaggguuuuuccaucccugggguu

SEQ ID NO: 90743 - RNA, 64 nt, hsa
uuuuuguugaagguuguauguuaaaucaauguuacauucuuauaucacuucuugagaaggaagu

SEQ ID NO: 90744 - RNA, 64 nt, hsa
cuuaaaccuugguagaucuggguuuauaaucggccauucuuaagcacgugggguugggggaaag

SEQ ID NO: 90745 - RNA, 64 nt, hsa
ugguuaccuucucauucaugucaaguaugugguucauucuuagaaccaagggaaauacugcucc

SEQ ID NO: 90746 - RNA, 64 nt, hsa
guuguaauuuaacagaaaaacacaaaauuucaaccauucuuaauguuacguccuccccccaccc

SEQ ID NO: 90747 - RNA, 64 nt, hsa
uaauaccuuuaaccucacuagcuucaagaguagacauucuuacuagcucaauuuaaauaauuga

SEQ ID NO: 90748 - RNA, 64 nt, hsa
uaaaaugcuuuuuuaauauuaaaauguacuuuuacauucuuaaucuuuuuuuagaaaggaaaag

SEQ ID NO: 90749 - RNA, 64 nt, hsa
agucccauuggugaggauauuaugacuuggugaccauucuuaggaguagaaaaccaaggacaau

SEQ ID NO: 90750 - RNA, 64 nt, hsa
aggggggcgcugucuagcacuuaacuaggguaagcauucuuaacauguauuuccacuugcccug

SEQ ID NO: 90751 - RNA, 64 nt, hsa
ucuuguagcuguuguuuuuagauauaguccacugcauucuuauaaguucuaaauuuuauguuua

SEQ ID NO: 90752 - RNA, 64 nt, hsa
uuccauagcuuauuaacacuaaagaaaacaauuacauucuuauacaauaaaaaggacacauuug

SEQ ID NO: 90753 - RNA, 64 nt, hsa
ucuaggaugauuuucccccuugcaguuauguuaucauucuuauaacauuguauguuaauagaaa

SEQ ID NO: 90754 - RNA, 64 nt, hsa
uaaguuagauguuuuaguuuaaaaaucagaaagacauucuuaguuaaucuuugaaaacucauac

SEQ ID NO: 90755 - RNA, 64 nt, hsa
uggagauccuaacugagaauuuucuaccuguguucauucuuaccgagaaaaggagaaaggagcu

SEQ ID NO: 90756 - RNA, 64 nt, hsa
gacuccuuucucuaucccaagccaaccaagagcacauucuuaaaggaaaagucaacaucuucuc

SEQ ID NO: 90757 - RNA, 64 nt, hsa
uguacagcauggcugugcuccaucugauuuaccccauucuuaaguucugagaguauguucucaa

SEQ ID NO: 90758 - RNA, 64 nt, hsa
cuucguucuauaacuaauguaccuuaacuucccccauucuuauauuuacaagaagcuaagucau

SEQ ID NO: 90759 - RNA, 64 nt, hsa
uguggguuauuguaugucacuaguauuagcauagcauucuuaaaggaaugcagugcucaaaacc

SEQ ID NO: 90760 - RNA, 64 nt, hsa
guuaguuuuaauauuccugauauuuacaaauauucauucuuauauacaaugaaaaaaauaacuu

SEQ ID NO: 90761 - RNA, 64 nt, hsa
auuaugaggggcacauucuuaucuccaaaacuagcauucuuaaacugagaauuauagauggggu

SEQ ID NO: 90762 - RNA, 64 nt, hsa
auauaauuauguuauuuagucauuaugaggggcacauucuuaucuccaaaacuagcauucuuaa

SEQ ID NO: 90763 - RNA, 64 nt, hsa
cucggcguggauggcagccucaggacacacaccccugccucaaggugcugagcccccgccuugc

SEQ ID NO: 90764 - RNA, 64 nt, hsa
caucuuucccaucucgccugagagcggcugagggcugccucacugcaaauccuccccacagcgu

SEQ ID NO: 90765 - RNA, 64 nt, hsa
caggcccgaagccccagcuugcccuggccugugccugccucaggugccagcuagaugucucgcu

SEQ ID NO: 90766 - RNA, 64 nt, hsa
ccguuucuucaucccaugagaccaacaacacugucugccucagaacauagccgugaucaagaug

SEQ ID NO: 90767 - RNA, 64 nt, hsa
ugcaaccucuaccuccuggguucaagcaaaucuccugccucagccuccaaaguagcugggauua

SEQ ID NO: 90768 - RNA, 64 nt, hsa
ugcaaccuccgccucccagguucaagcaauucuccugccucagccucccgaguagcuggaauua

SEQ ID NO: 90769 - RNA, 64 nt, hsa
aucuccugcuuucaugucccuggagggcucuggccugccucaaaaccccuucugccucaggugg

SEQ ID NO: 90770 - RNA, 64 nt, hsa
cccuggagggcucuggccugccucaaaaccccuucugccucagguggggaggaacaagcugaac

SEQ ID NO: 90771 - RNA, 64 nt, hsa
ugcaaccucugccuccuugguucaagcaauucuccugccucagccucucgaguagcugggauua

SEQ ID NO: 90772 - RNA, 64 nt, hsa
ugcaaccucugccuccugggugcaagcaauuauccugccucagccucccgaguagcugggacug

SEQ ID NO: 90773 - RNA, 64 nt, hsa
gcugguugcaaacucuugagcucaggcagucugccugccucagccuccuagagugcugggauua

SEQ ID NO: 90774 - RNA, 64 nt, hsa
ugcaaccuccgccucccggguucaagcaauucuccugccucagccucccgaguagcugggagug

SEQ ID NO: 90775 - RNA, 64 nt, hsa
ugcaaccuccaccucccggguucaagcgauucuccugccucagcucccaaguagcugggacuac

SEQ ID NO: 90776 - RNA, 64 nt, hsa
gcuggucuugaacuccuggccucaagugguccuccugccucagccucccaaaguguggggauua

SEQ ID NO: 90777 - RNA, 64 nt, hsa
ugcaaccuccgccucccagguucaagcaauuuuccugccucagccucccgaguaccugggacua

SEQ ID NO: 90778 - RNA, 64 nt, hsa
ugcaaccuucgccaccuggguuccagcaauucuccugccucagccucccgaguagcugagauua

SEQ ID NO: 90779 - RNA, 64 nt, hsa
ggacuuagcugggagaaagagagagcuucuguugcugccucaugcuaagacucaguggggaggg

SEQ ID NO: 90780 - RNA, 64 nt, hsa
agagcuaccuccccggggacagcccacuaagguucugccucagccuccugaaacaucacugccc

SEQ ID NO: 90781 - RNA, 64 nt, hsa
aaacuugguuaggacucuggcuugccuuccccagcugccucaacucugucucuggcagcucugc

SEQ ID NO: 90782 - RNA, 64 nt, hsa
gccuguuggaggcugggaaccccgcagcgcgaggcugccucaucaacggcaagaggaaaggagg

SEQ ID NO: 90783 - RNA, 64 nt, hsa
acacugaagggcuggaaugcuggcuggccacucucugccucaguggccucccuacagccuggaa

SEQ ID NO: 90784 - RNA, 64 nt, hsa
aauuccacaccccuguacccccccagggggcccucugccucauggcaaaggcuugccccaaauc

SEQ ID NO: 90785 - RNA, 64 nt, hsa
cacugcacugcagccugggcgacagagcgagauucugccucaaaaauaaacaaauaaauuuuaa

SEQ ID NO: 90786 - RNA, 64 nt, hsa
ccgcuuuuaggccaaaaaaauguaagaucguucucugccucacauagcuuacaagccagcugga

SEQ ID NO: 90787 - RNA, 64 nt, hsa
ugcaacuucugccucuuggguucaagugauucuccugccucagccuccugaguagcuggauuac

SEQ ID NO: 90788 - RNA, 64 nt, hsa
ugcaaccuccaccucccggauucaagcgauucuccugccucagccuccugaguagcuggaacua

SEQ ID NO: 90789 - RNA, 64 nt, hsa
guuggacuggaaacccuuggcucaagcaauuugccugccucagccucccaaagugcugggauua

SEQ ID NO: 90790 - RNA, 64 nt, hsa
ucugggacuuggccucaccccacccauggaauaccugccucaucccaaagaucagguaugggcu

SEQ ID NO: 90791 - RNA, 64 nt, hsa
gugcgugcgugcguguguguguguguguguguuucugccucauucaguuucuggggucaaauca

SEQ ID NO: 90792 - RNA, 64 nt, hsa
ugcaaccuuugccucccagguucaagcgauucuucugccucagccucccgaguagcugggacca

SEQ ID NO: 90793 - RNA, 64 nt, hsa
uggcucacugcuaccucuaccaugagcaauucuccugccucagccucccaaguagcuggaacua

SEQ ID NO: 90794 - RNA, 64 nt, hsa
uacaaccucugccucccggguucaaguaauucuccugccucaggcuucugaguagcugggauua

SEQ ID NO: 90795 - RNA, 64 nt, hsa
ugcaaccucugccuccuggguuuaagcaauucuccugccucagccuccccaguagcugggauua

SEQ ID NO: 90796 - RNA, 64 nt, hsa
aggauggucuugaucuccugaccucaugaucugccugccucagccucccaaagugcugggauua

SEQ ID NO: 90797 - RNA, 64 nt, hsa
ugcaagcucugccucccagguucacaccauucuccugccucaaccucccgaauggcugggacua

SEQ ID NO: 90798 - RNA, 64 nt, hsa
gcuggucuugaacuccugaccucaggugauccaccugccucagccucccaaagugcugggauua

SEQ ID NO: 90799 - RNA, 64 nt, hsa
ugcaaccucugccucccgaguucaagcaauucuccugccucagccucccaaguagcugggacua

SEQ ID NO: 90800 - RNA, 64 nt, hsa
ugcagccuccuccucuuggguucaagcaauucuccugccucagccucccgaguagcugggacua

SEQ ID NO: 90801 - RNA, 64 nt, hsa
caugucuucaucaaguggaagccaacuguccugccugccucaagaauauguguuuucuuuagcu

SEQ ID NO: 90802 - RNA, 64 nt, hsa
gggcugggagcccacaccccacucaccaguucugcugccucaggucaggccagggcagugcugc

SEQ ID NO: 90803 - RNA, 64 nt, hsa
ugccaccuccgccucucuaguucaagcgauuuuccugccucagccucccgaguagcugggauuc

SEQ ID NO: 90804 - RNA, 64 nt, hsa
cucaaugcaaaucuccaggguucaaucgauucuccugccucacccucccauguagcugggauua

SEQ ID NO: 90805 - RNA, 64 nt, hsa
ugcaaccuccaccucccagguucaagcaauucuucugccucagccucccaaguagcugggauua

SEQ ID NO: 90806 - RNA, 64 nt, hsa
acuggucucaaacuccugaccucaagugauccaccugccucagccucccaaagugcugggauua

SEQ ID NO: 90807 - RNA, 64 nt, hsa
ugcaaccuccaccucccagguucaagugauucuccugccucagccuccugaguagcugggacua

SEQ ID NO: 90808 - RNA, 64 nt, hsa
gcuggucuugaaccccuggccucaagcaauccuccugccucagccucucaaguuguuuuuuuuc

SEQ ID NO: 90809 - RNA, 64 nt, hsa
uguaaccucaaacuccuggacucaugcaaucuuccugccucaggcuucugaguagcuaggacua

SEQ ID NO: 90810 - RNA, 64 nt, hsa
uguaaccuccgccucccagguucaggugauucuccugccucagccuccugaguagcugggauua

SEQ ID NO: 90811 - RNA, 64 nt, hsa
aggcuggucucgaacuccugaccucgugauccgccugccucagccucccaaagugcugggauua

SEQ ID NO: 90812 - RNA, 64 nt, hsa
cucccagcagccuccagaaccaugcccaggucuccugccucacaucacaauaaucugggaccca

SEQ ID NO: 90813 - RNA, 64 nt, hsa
gcaccacaaaagagcucucuguacuuuccccaugcugccucaaaaguucugugaguuucggggu

SEQ ID NO: 90814 - RNA, 64 nt, hsa
ugcaacgucugccuccuggguucaagcaauucuccugccucagccuccugaguagcugggauua

SEQ ID NO: 90815 - RNA, 64 nt, hsa
uccaagcucccccucccguguucacgccauucuccugccucagccucccgaguagcugggacua

SEQ ID NO: 90816 - RNA, 64 nt, hsa
ugcaaccuccgccuccuggguucaagcaauucuccugccucagccucccaaguagcuuggacua

SEQ ID NO: 90817 - RNA, 64 nt, hsa
ucucaccugugagcuguggggaucacaaggcugccugccucagucuuggaguccuguuggguga

SEQ ID NO: 90818 - RNA, 64 nt, hsa
auaccccugccucacgaaaacccaaaagacacagcugccucacgguugacguuguguccuccuc

SEQ ID NO: 90819 - RNA, 64 nt, hsa
uguaaaaacaaacgaaacaacugacuucauaccccugccucacgaaaacccaaaagacacagcu

SEQ ID NO: 90820 - RNA, 64 nt, hsa
ccaaccaaaccucuugcucugcuauaucuccacucugccucagacugaaaagcuaguccuaacg

SEQ ID NO: 90821 - RNA, 64 nt, hsa
auucuuuggucucuuuugacucucaugcugguggcugccucaucaacugauucuaucuuuguag

SEQ ID NO: 90822 - RNA, 64 nt, hsa
ugcaaccuccaccuccuggguucaagcgauucuucugccucagccucccaaguagcuaggauua

SEQ ID NO: 90823 - RNA, 64 nt, hsa
cacaacuucggccuccuggguucaagcgauucuccugccucagccucccgaguaguugggauua

SEQ ID NO: 90824 - RNA, 64 nt, hsa
agguaaaguguuagcacacagacuguuaaaaugucugccucacagauaggagggaaaauauaua

SEQ ID NO: 90825 - RNA, 64 nt, hsa
ugcaagcuccgccucccggguucacgccauucuccugccucagccuccugaguagcuggggcua

SEQ ID NO: 90826 - RNA, 64 nt, hsa
cuggaauaugagaggaugggaggcccuuuagaaccugccucaaugccaucucucacucuccuuc

SEQ ID NO: 90827 - RNA, 64 nt, hsa
uauugacccuuuuuugccuucucuuucuccuucacugccucaaguuacagccagaggaaaggag

SEQ ID NO: 90828 - RNA, 64 nt, hsa
accuccccccuaccccugaguucaagcgauucuccugccucagccugcugaguaguugggauua

SEQ ID NO: 90829 - RNA, 64 nt, hsa
ggcaaccucugccucccagguucaagcgauuguccugccucagucuccugaguagcugggacua

SEQ ID NO: 90830 - RNA, 64 nt, hsa
ugcaagcuccgccucccggguucacgccauucuccugccucagccucccgaguagcugggacua

SEQ ID NO: 90831 - RNA, 64 nt, hsa
cuuuccugacacugcgaauacauuccuuaacccgcugccucagugguaauaaauggugcuagau

SEQ ID NO: 90832 - RNA, 64 nt, hsa
ggcacgcuccgccucccggguucacgccauucuccugccucagcuucccgaguagcugggacua

SEQ ID NO: 90833 - RNA, 64 nt, hsa
ugcaagcuccgccucucggguucacgccauucuccugccucagccucccaaguagcucggacua

SEQ ID NO: 90834 - RNA, 64 nt, hsa
aagaauggaaagggaugacauuuaccuaugugugcugccucauuccuggugaagcaacugcuac

SEQ ID NO: 90835 - RNA, 64 nt, hsa
uccaaccuccaccuuccagguucaagugauucuccugccucagccucccgaguagcugggacua

SEQ ID NO: 90836 - RNA, 64 nt, hsa
gccaggcuggucuugaacugaccucaugauccaccugccucagccucccaaaaugcugggauua

SEQ ID NO: 90837 - RNA, 64 nt, hsa
ugcaaccuccgucucuuagguucaagcaauucuccugccucagccucccgaguagcugggauua

SEQ ID NO: 90838 - RNA, 64 nt, hsa
ugcaaccuccaccucccagguucaagcaauucuccugccucagucuccugaguagcuggaacua

SEQ ID NO: 90839 - RNA, 64 nt, hsa
ugcaagcucugcguccuggguugacgccauucuccugccucagccucccgaguagcugggacua

SEQ ID NO: 90840 - RNA, 64 nt, hsa
ugcaagcuccgccucccggguucacgccauucuccugccucagccucccguguagcugggacua

SEQ ID NO: 90841 - RNA, 64 nt, hsa
gauagaaauccuuguguccagugcccagcaacuccugccucagccucccgagcagcugggacua

SEQ ID NO: 90842 - RNA, 64 nt, hsa
aggauggucuugaucucuugaccuugugauccaccugccucaucaucccaaagugcugggauua

SEQ ID NO: 90843 - RNA, 64 nt, hsa
guuuguuuguuucccacuuuuuuccuaugcuggucugccucaaagucucaagaccaaggugacu

SEQ ID NO: 90844 - RNA, 64 nt, hsa
gcuggucucaaacuccugggcucaagcaauccuccugccucagcuuccugaguagcuggaacca

SEQ ID NO: 90845 - RNA, 64 nt, hsa
ugcccacgcgcucagacaugauaugcggcuaugccugccucaaagguacuuugaguuccaaaag

SEQ ID NO: 90846 - RNA, 64 nt, hsa
ugcaagcuccaacucccggguucacgccauucuccugccucagccuuccaaguagcugggacua

SEQ ID NO: 90847 - RNA, 64 nt, hsa
ugcaaccuccgccuuccaguugcaagugauucuccugccucagccuccugaguagcugggauua

SEQ ID NO: 90848 - RNA, 64 nt, hsa
cauggugcuagauuguuuacuugguuuucuaggacugccucaacuagaauaacacuucacuaau

SEQ ID NO: 90849 - RNA, 64 nt, hsa
ggcccaaucuuaccuguucuccagggacuggucacugccucaggacccccaagccuaugcccug

SEQ ID NO: 90850 - RNA, 64 nt, hsa
ucuucuugcucauccccuuauaaaugugcuuugccugccucagccucauggucagagcagugga

SEQ ID NO: 90851 - RNA, 64 nt, hsa
aggauggucuugaucuccugaccuugugauccgccugccucagccucccaaagugcugggauua

SEQ ID NO: 90852 - RNA, 64 nt, hsa
ugcaagcucugccucccagguucacgccauucuccugccucagccucccgaguagcugggacua

SEQ ID NO: 90853 - RNA, 64 nt, hsa
cccugucucaggauugucucuucacgcccaucuucugccucauaguggucacucaaggccucgc

SEQ ID NO: 90854 - RNA, 64 nt, hsa
gccggccucccggcagccuccaccagcccggcuccugccucacgcuggccccucugggcccagc

SEQ ID NO: 90855 - RNA, 64 nt, hsa
cagguguuccgugggacccucagcagcucuggcucugccucaggaggucaccugccgcccugug

SEQ ID NO: 90856 - RNA, 64 nt, hsa
ugcaagcuccgccucccggguucacgccauucuccugccucagccucccauagcugggacuaca

SEQ ID NO: 90857 - RNA, 64 nt, hsa
ugcaaccuccgccucccagguucaagugauucuccugccucauccuccugaguagcugggauua

SEQ ID NO: 90858 - RNA, 64 nt, hsa
gcuugucucaaacuccuaaccucaacugauccaccugccucagccucccaaagugccgccggga

SEQ ID NO: 90859 - RNA, 64 nt, hsa
caacuccaggaaagagcagucagaguccagugcucugccucagacguugccugagaagaagugg

SEQ ID NO: 90860 - RNA, 64 nt, hsa
ugcagccucauacuccugggcucaagcaauccuccugccucagccuuccaacuagcugggacua

SEQ ID NO: 90861 - RNA, 64 nt, hsa
ugcaaccucugcccccuggguucaagcgauucuccugccucagccucccuaguagcugggacua

SEQ ID NO: 90862 - RNA, 64 nt, hsa
gccagucucaaacuccugaccucaggugauccaccugccucagccucccagacuguugggauua

SEQ ID NO: 90863 - RNA, 64 nt, hsa
ccaucccucggggcccaggcccucacccgaagggcugccucacucuguggugucaggcacuggg

SEQ ID NO: 90864 - RNA, 64 nt, hsa
uugggggcugcacuaccugcguccguggaagccucugccucagcggggacggccuccugcugca

SEQ ID NO: 90865 - RNA, 64 nt, hsa
agacugcuacaugugugauguuguuuccuuacuacugccucaccucaggaagcacauaaugucu

SEQ ID NO: 90866 - RNA, 64 nt, hsa
ugaguagccaggacuauggcauguaccaccgcaccugccucacauuuucuuucucacuguaaau

SEQ ID NO: 90867 - RNA, 64 nt, hsa
agucgccagccagaaacguggugcccagggugcccugccucaggacauguccacacccacguca

SEQ ID NO: 90868 - RNA, 64 nt, hsa
ugcaaccuccuucucccagguucaagcgacucuccugccucagccuccugaguagcugggauua

SEQ ID NO: 90869 - RNA, 64 nt, hsa
uugaaagagaauuuuuggaaccaacauucaaauucugccucaucuggagggaaaccaaaauugg

SEQ ID NO: 90870 - RNA, 64 nt, hsa
agccugugaggaucugaagaguaaagggcugggucugccucagaaggcaccagcaccagggccc

SEQ ID NO: 90871 - RNA, 64 nt, hsa
aaucccaucucgcaggagagcagggucugggcuccugccucaccgcugguucagcagcacccuc

SEQ ID NO: 90872 - RNA, 64 nt, hsa
ugcaagcucugccucccgggcucaccccauucuccugccucagccuccugaguagcugggacua

SEQ ID NO: 90873 - RNA, 64 nt, hsa
ugcgaccucugccucccagguucaagcaguucuccugccucagccuccugaguagcuggcauua

SEQ ID NO: 90874 - RNA, 64 nt, hsa
ugcaacauccaccucccagguucaagcaauucuccugccucagccucccaaguagcugggauua

SEQ ID NO: 90875 - RNA, 64 nt, hsa
gcuagucucgaacuucugaccucaggugauccaccugccucagccucccaaauugcugggauua

SEQ ID NO: 90876 - RNA, 64 nt, hsa
gcugcugcuugguggaaguaacaggacguggauucugccucauaaguggcaguuucccuuuucu

SEQ ID NO: 90877 - RNA, 64 nt, hsa
cguaucuucuugcuuccaugugucuuuuccccugcugccucacuccccacccccacuugccagg

SEQ ID NO: 90878 - RNA, 64 nt, hsa
ucaagagagccugggggucuaacagggagcccggcugccucaccuggccacagccuccacacca

SEQ ID NO: 90879 - RNA, 64 nt, hsa
accugccaagucugucaucacugugggguguagccugccucagagggaccugcaaucaccucuc

SEQ ID NO: 90880 - RNA, 64 nt, hsa
uggcuguguccccugccugagggcucugugccuccugccucagaugcggccugugccagagagg

SEQ ID NO: 90881 - RNA, 64 nt, hsa
ugcagccucgacuucucggggccaagcgauccuccugccucagccuucugaguagcugggacca

SEQ ID NO: 90882 - RNA, 64 nt, hsa
ccuaauuuuuuauuucuuguagagaugaggucuccugccucagccucccaaagugcuggaauuu

SEQ ID NO: 90883 - RNA, 64 nt, hsa
ugcaaccuccaccuccuggguucaaacgauucugcugccucagccuccugaguagcugggauua

SEQ ID NO: 90884 - RNA, 64 nt, hsa
uggggugugaguccugauuaaaugcuaguaaaagcugccucauacauacugaguaaaauaaaua

SEQ ID NO: 90885 - RNA, 64 nt, hsa
agcuccgccucccggguuuacuuacaccacuguccugccucagccuccggaguagcugggacua

SEQ ID NO: 90886 - RNA, 64 nt, hsa
gcuggucucaaauuccuggccucaggugauccaccugccucagccucccaaagugcugggauua

SEQ ID NO: 90887 - RNA, 64 nt, hsa
ugcacccuccaccucccagguucaagcgauucuccugccucagccucccaaguagcugggauua

SEQ ID NO: 90888 - RNA, 64 nt, hsa
gcucguaucaaacccuugaccccaggugaucugccugccucagccucccaaaguucugggauua

SEQ ID NO: 90889 - RNA, 64 nt, hsa
ugcagccuccgccuccuggguucaagugguucuccugccucagccucccuaguagcugggauua

SEQ ID NO: 90890 - RNA, 64 nt, hsa
ccuggucucaaacuccugaccucaggugauccaccugccucagccucccaaagugcugggauua

SEQ ID NO: 90891 - RNA, 64 nt, hsa
ugcaaccucugccucccgaguucaagcaauucuccugccucagccucccgaguagcugggauua

SEQ ID NO: 90892 - RNA, 64 nt, hsa
aaggagaggcccugggggacccucugaagcauuucugccucacuuuaugucaucugcuucuccc

SEQ ID NO: 90893 - RNA, 64 nt, hsa
ggccuugggggucugggcugggcauccauggucacugccucagcccagccaggcugugccuuug

SEQ ID NO: 90894 - RNA, 64 nt, hsa
ugcaacagucucaugggucaccacguggggagggcugccucagcagguuucucagaccacggag

SEQ ID NO: 90895 - RNA, 64 nt, hsa
cggcucacugcaaccucugucucaagcgauucuccugccucagccuccugaguagcugggauua

SEQ ID NO: 90896 - RNA, 64 nt, hsa
gguguaauucagcauaaaaccucauaugauuguccugccucauggagcuguuguauagauccca

SEQ ID NO: 90897 - RNA, 64 nt, hsa
ugcaggcucugccuccuggguucacgccauucuccugccucagcuucccgaguagcugggacua

SEQ ID NO: 90898 - RNA, 64 nt, hsa
aggucccaaccgucucugcccucuucugcugccccugccucaugggcucccagccacagguucc

SEQ ID NO: 90899 - RNA, 64 nt, hsa
gcuggucucgaacuccugggcuuaaaugacucuucugccucagccucaccaaaguguugggauu

SEQ ID NO: 90900 - RNA, 54 nt, hsa
accagagaguggccagcuaagagccugccucaccccuuaccaaugagggcaggg

SEQ ID NO: 90901 - RNA, 64 nt, hsa
ugugagggaaauagggaccccccgacuugcccuccugccucagucuuucccccacccugucucu

SEQ ID NO: 90902 - RNA, 64 nt, hsa
acugcaccaauucuugauuugggcccugugcugccugccucauaguaucugccuuggucuugcu

SEQ ID NO: 90903 - RNA, 64 nt, hsa
agcgcugaguuggguuugugacucuucccucucccugccucacaggauugugacuccccagccc

SEQ ID NO: 90904 - RNA, 64 nt, hsa
ucagcagaaguaacugaaguagaucaggaaggggcugccucaggaaaauuccuagauccuagga

SEQ ID NO: 90905 - RNA, 64 nt, hsa
uaaucagugucagugaauccacagucuuuacuuccugccucauaaagggccaggucuccccagu

SEQ ID NO: 90906 - RNA, 64 nt, hsa
cacaaucgcugccuccuggguucaagcaauucuccugccucagccucccgaguagcugggacua

SEQ ID NO: 90907 - RNA, 64 nt, hsa
ugcagccucagacuccuggguucaagcaauccuccugccucagccucccaaguagcugagacua

SEQ ID NO: 90908 - RNA, 64 nt, hsa
gcuggucuugaacucuuggccucaaguaauccuccugccucagccucccaaaguguugggauug

SEQ ID NO: 90909 - RNA, 64 nt, hsa
ugcaaccucugccucccgaguucaagcaauucuccugccucagccuccugaguagcugggauua

SEQ ID NO: 90910 - RNA, 64 nt, hsa
ggcuggucucaaacuucugaccucaaaugauugccugccucagccucccaaagugcugggauua

SEQ ID NO: 90911 - RNA, 64 nt, hsa
uguggccggaugcuuccaacuuugucagucuuuucugccucaacuucuuccagacaucagucac

SEQ ID NO: 90912 - RNA, 64 nt, hsa
ucaagaaccuguauauguguuguguuagaggcaucugccucaagucuauguacaguguuugcug

SEQ ID NO: 90913 - RNA, 64 nt, hsa
cccaggcagugccuagcuccagagcaggcacagccugccucagcaugcuucgaaaggcagcuuc

SEQ ID NO: 90914 - RNA, 64 nt, hsa
guucaagggccugaggcagauccagaggacaagccugccucaccuccagcaccuguaggaacuc

SEQ ID NO: 90915 - RNA, 64 nt, hsa
uagcgaguggcgggccugggguucagacccacagcugccucaagcaaacaggguaucacgcuug

SEQ ID NO: 90916 - RNA, 64 nt, hsa
gccaggccagccccaucuggaaggagucccugcucugccucagcccuaacccgaggcugugugg

SEQ ID NO: 90917 - RNA, 64 nt, hsa
gcucaaccaauaacuauugcacaaccaucugucccugccucaguucccucuucuguaacaugaa

SEQ ID NO: 90918 - RNA, 64 nt, hsa
caacccacucuuuuuucccaccacccacucuccucugccucaguaaguaucuggaggaagaaaa

SEQ ID NO: 90919 - RNA, 64 nt, hsa
gaagcuucuacuccugcaguaagcacagaucgcacugccucaauaacuugguauugagcacgua

SEQ ID NO: 90920 - RNA, 64 nt, hsa
acuccuuuuuucccaguccugcaaccuggauuuucugccucagccccauuuugcugaaaauaau

SEQ ID NO: 90921 - RNA, 64 nt, hsa
agccggucucaaacuccugagcucaagugauccucugccucagccuccagaguaucugggauua

SEQ ID NO: 90922 - RNA, 64 nt, hsa
gcauccuccaguuccuggguucaagccaucccuccugccucagccuccccaguagcuggaacua

SEQ ID NO: 90923 - RNA, 64 nt, hsa
gcugcuuaugucuaaagggaucaccuauauuuaacugccucagugaccuaaccucuuucuucuc

SEQ ID NO: 90924 - RNA, 64 nt, hsa
ugcaaccuccgccucuuggguuaaaagaauucuccugccucagccuccugaguagcugggauua

SEQ ID NO: 90925 - RNA, 64 nt, hsa
guuggucucgaacuccugaccucaagugaucugccugccucagccucccaaagugcugggauua

SEQ ID NO: 90926 - RNA, 64 nt, hsa
ugcaaccuucaccuccuggguucaagcaauucuccugccucagccuccugaguagcugggaaua

SEQ ID NO: 90927 - RNA, 64 nt, hsa
uaguggagggggccuucagcccucugcacccugccugccucacaccccgccuucaggagcccuc

SEQ ID NO: 90928 - RNA, 64 nt, hsa
cagagguggggaugggcagagagggcuggccacucugccucaggacuugaccucaaguguucug

SEQ ID NO: 90929 - RNA, 64 nt, hsa
ugcaaccucagccuccuggauuuaagugauucuccugccucagccucccaaguagcugggauua

SEQ ID NO: 90930 - RNA, 64 nt, hsa; identical to SEQ ID NO: 90811

SEQ ID NO: 90931 - RNA, 64 nt, hsa
uggcuggcugcugugugccugguuuccucacauccugccucagcuucaccacccuggcuuaugu

SEQ ID NO: 90932 - RNA, 64 nt, hsa
uaacuuuuauacuuugugcaggucgcggcgcuuccugccucauccucggcugcauggggcgggg

SEQ ID NO: 90933 - RNA, 64 nt, hsa
ugcaaccucugccucccugguucaagugauucuccugccucauccucccaagaagcugagauua

SEQ ID NO: 90934 - RNA, 64 nt, hsa
gcuggucuugaacuccugaccucaggugauccaccugccucagccucccaaagugcugagauua

SEQ ID NO: 90935 - RNA, 64 nt, hsa
uacaaccuccgccucccauguucaagcgauucuccugccucagccucccgaguagcugggacua

SEQ ID NO: 90936 - RNA, 64 nt, hsa
cagucccuccacauuucccccuagccugccuccccugccucaccagcccuggcaacugcuaauc

SEQ ID NO: 90937 - RNA, 64 nt, hsa
ugcaaccucugccuccuggguucaagcaguucuccugccucagccucccaaguagcugggauua

SEQ ID NO: 90938 - RNA, 64 nt, hsa
uagagagguuuuagauuuuuguuuuuuuuuuguucugccucaaagcucaguuuauugaagacau

SEQ ID NO: 90939 - RNA, 64 nt, hsa
ugaccuccccgccagcuggacuccagccauccuccugccucagcuucccagauagcugggccac

SEQ ID NO: 90940 - RNA, 64 nt, hsa
ugcaagcuccgccucccagguucacaccauucuccugccucagccuccccaguagcugggacua

SEQ ID NO: 90941 - RNA, 64 nt, hsa
ugcagccuccauccucuggguucaagcaauucuccugccucaggcuccugaguagcugggauua

SEQ ID NO: 90942 - RNA, 64 nt, hsa
ugcaaccucugucuccuggguucaaacgauccuacugccucauccuucggaguagcugggauua

SEQ ID NO: 90943 - RNA, 64 nt, hsa
ugcaaccucugccuccuaaguucaggcgauucuccugccucagcuucccgaguaacugagauua

SEQ ID NO: 90944 - RNA, 64 nt, hsa
gcuggucucaaacuccugaccucaggugaucuaccugccucagccucccaaagugcugagauua

SEQ ID NO: 90945 - RNA, 64 nt, hsa
cgcaaccuccgccucccagguucaagagauucuccugccucagccuccgaaguagcugggauua

SEQ ID NO: 90946 - RNA, 64 nt, hsa
ugcaaccuccaccucccagguucaagcgauucuccugccucagccuccugagcagcugggauua

SEQ ID NO: 90947 - RNA, 64 nt, hsa
uaaaggaaacuucaugaaggauguagaagcuuagcugccucagagaagagagaaccugaagauc

SEQ ID NO: 90948 - RNA, 64 nt, hsa
ucauguuucugcaugucagcgagcgacacugucccugccucagguuggagguuuuaucagccaa

SEQ ID NO: 90949 - RNA, 64 nt, hsa
ccagcccugcccacccucccuccacuccucucaacugccucagcgauuucaagaaggaaauaaa

SEQ ID NO: 90950 - RNA, 64 nt, hsa
agacacagaaccaacaaaaccgcauucagugcaccugccucagcuaccuaaugauuccgcgcgg

SEQ ID NO: 90951 - RNA, 64 nt, hsa
uguacccuugaacuccugggcucaagugauccuccugccucagccuccuuaguagcugggacua

SEQ ID NO: 90952 - RNA, 64 nt, hsa
gcugaucuugaauucccgggcucaagugguccuccugccucagccucccacaggaucgggauua

SEQ ID NO: 90953 - RNA, 64 nt, hsa
cgggggcagagauaagggccaucucucugugauucugccucagcuccugucuugcugagcccuc

SEQ ID NO: 90954 - RNA, 64 nt, hsa
ugcaaccuccaccucccagguucaagcaauuauccugccucaggcucccaaguagcugggauua

SEQ ID NO: 90955 - RNA, 64 nt, hsa
ugcaacccccgccccccggguucaagugauucuccugccucagccucccgaguagcuggaauua

SEQ ID NO: 90956 - RNA, 64 nt, hsa
cacuacagccuccaacucuuggguucaagcaacccugccucagcuaaccaaguagcugggacua

SEQ ID NO: 90957 - RNA, 64 nt, hsa
ugugcccuucaccuucuggguucaagugauucuccugccucagccucccuaguagcugggauua

SEQ ID NO: 90958 - RNA, 64 nt, hsa
ugcaaccuccaccucccugauucaagcgacucuccugccucagccucccgaguagcugggauug

SEQ ID NO: 90959 - RNA, 64 nt, hsa
uuauaauagcccuucccaaaacuaaacgauucuccugccucagccucccgaguagcugucuuua

SEQ ID NO: 90960 - RNA, 64 nt, hsa
aacccauaugccccucugaaguugagaaucauggcugccucaccacacaucagagaaugacugu

SEQ ID NO: 90961 - RNA, 64 nt, hsa
cggccaggccugcagacccagacuccagccagaccugccucacccaccaaugcagccggggcug

SEQ ID NO: 90962 - RNA, 64 nt, hsa
gccucagccaggcagcccaccccacccuggggcccugccucaccaaggaaauaaagacucaagc

SEQ ID NO: 90963 - RNA, 64 nt, hsa
uaugaguguaaggaaugugggaaagccuucagaucugccucacaccuucaaauucaugaaagga

SEQ ID NO: 90964 - RNA, 64 nt, hsa
uaugaguguaagcaaugugggaaagccuucagaucugccucaauccuucaaaugcaugcuggga

SEQ ID NO: 90965 - RNA, 64 nt, hsa
ugcaaccuccaucuccggggcucaagcgcuucuccugccucagccuccugaguagcugggauua

SEQ ID NO: 90966 - RNA, 64 nt, hsa
ugcaaccuccaccucccggguucaagugauucuccugccucagccucuugaguagcugggacua

SEQ ID NO: 90967 - RNA, 64 nt, hsa
ugcaaccuccacccccggggaucaagcaacucuccugccucagccucccuaguagcugggauua

SEQ ID NO: 90968 - RNA, 64 nt, hsa
ugcaaccuccacauccuggguucaagugauucuccugccucagccucuggaggagcugguauca

SEQ ID NO: 90969 - RNA, 64 nt, hsa
ugcaagcuccgccucccggguucacgccauucuccugccucagccuccugaguagcugggacua

SEQ ID NO: 90970 - RNA, 64 nt, hsa
aggauggucucgaucuccugaccuccugaugcgccugccucagccucccagugcugggauuaua

SEQ ID NO: 90971 - RNA, 64 nt, hsa
ugcaaccuccgccuccuggguuccaacgauucuccugccucagccucccgaguagcugggccua

SEQ ID NO: 90972 - RNA, 64 nt, hsa
ugcaaccuccgccucccggguucaagcaauucuccugccucagccucccaaguagcugggauua

SEQ ID NO: 90973 - RNA, 64 nt, hsa
acuggucucaaacuccugaccucaggcgauccaucugccucagccugaaagugcuaggauuaca

SEQ ID NO: 90974 - RNA, 64 nt, hsa
ugcagccuccaccuccuggguucaagcgauucuccugccucagccucccgaguagcugggauua

SEQ ID NO: 90975 - RNA, 64 nt, hsa
gcugguuuggaacuccugacuucaaauuacccaccugccucagccucccaaagugcuggcauua

SEQ ID NO: 90976 - RNA, 64 nt, hsa
cugcaaccucugccucccggguucaagcaauuaacugccucagcuucccuaguaauggauuaca

SEQ ID NO: 90977 - RNA, 64 nt, hsa
ugcaaccuccgccuccuggguucaagcgauucuccugccucagccuccugaguagcugggauua

SEQ ID NO: 90978 - RNA, 64 nt, hsa
ugcaaccucugccucccaaguucaacugauucuucugccucagccucccgaguagcagggauua

SEQ ID NO: 90979 - RNA, 64 nt, hsa
caggcuuguuaugaacugaccucaagugaucugccugccucagcuucucaggugugaccuacug

SEQ ID NO: 90980 - RNA, 64 nt, hsa
agagaggucaccccuacccucccuccccgcuucccugccucacccucaauaaauaaauuaauug

SEQ ID NO: 90981 - RNA, 64 nt, hsa
ucucucugauucccacaggccccaugcauccucccugccucacuccccucagccccugccgacc

SEQ ID NO: 90982 - RNA, 64 nt, hsa
ugcaacuuccgccucccggguucaagcgauucuccugccucagccucccgaguagcugggacuc

SEQ ID NO: 90983 - RNA, 64 nt, hsa
ugcaaccucugccucccggguucaagugauucuccugccucagccucacgaguagcuggaauua

SEQ ID NO: 90984 - RNA, 64 nt, hsa
cgcaaccuccaccuccugaguuccagugauucuccugccucacccucaguagcugggauuauug

SEQ ID NO: 90985 - RNA, 64 nt, hsa
gaagggucauggauggugaggucaguacugcaggcugccucaccuuggugauuagauuccuaag

SEQ ID NO: 90986 - RNA, 64 nt, hsa
aagcuccgccuccucccggguucacgccauucuccugccucagccuccugaguagcugggacua

SEQ ID NO: 90987 - RNA, 64 nt, hsa
agcaaccucugccuccuggguucaagcgauucuccugccucagccuccaaaguagcugggauua

SEQ ID NO: 90988 - RNA, 64 nt, hsa
ugcaaccuccacuucucagguucaagcaauucuccugccucagccuccugaguagcugggacua

SEQ ID NO: 90989 - RNA, 64 nt, hsa
ugcaagcuccgccuccuggguucacgccauucuccugccucagccucccgaguagcugggacua

SEQ ID NO: 90990 - RNA, 64 nt, hsa
uggcgcaaccucugccucccaggucaaagcaauccugccucaggcccccuaguagcuggcauua

SEQ ID NO: 90991 - RNA, 64 nt, hsa
ggcucacuguaaccucuggguucaagcaauucuucugccucagccuuccaaguagcugggauua

SEQ ID NO: 90992 - RNA, 64 nt, hsa
gcugguuucaaacuccugaccucauaugauccaccugccucagccucccaaagugcuuggauua

SEQ ID NO: 90993 - RNA, 64 nt, hsa
ugcaaccucugccuuccagguucaagcaauuauccugccucagccucccaaguagcugggauua

SEQ ID NO: 90994 - RNA, 64 nt, hsa
uguaaccuccaccuccuggguucacgcaauucuccugccucagccuccuaaguagcugggauua

SEQ ID NO: 90995 - RNA, 64 nt, hsa
ugcaaccucugccucacagguucaagugguucuccugccucagccucuugaguagcugggauua

SEQ ID NO: 90996 - RNA, 64 nt, hsa
agugcaauggcacaaucuuggcucacugcaaccucugccucacagguucaagugguucuccugc

SEQ ID NO: 90997 - RNA, 64 nt, hsa
acuguggucucaaucuccugacuucaugguccgccugccucagccucccaaaguucugggauua

SEQ ID NO: 90998 - RNA, 64 nt, hsa
ugcaagcuccgccuccuggguucacaccauucuccugccucagccuccugaguagcugggacua

SEQ ID NO: 90999 - RNA, 64 nt, hsa
ccaaauuccccuaaagguucccucuccacccguucugccucagugguuucaaaucucuccuuuc

SEQ ID NO: 91000 - RNA, 64 nt, hsa
gugacagugucaaggaacccugcuccucucuguccugccucaggccuaagaagcacucucccuu

SEQ ID NO: 91001 - RNA, 64 nt, hsa
ggcuguggaggaggccccucggucagggagcggccugccucaccccugaauagcuccuucggcc

SEQ ID NO: 91002 - RNA, 64 nt, hsa
gguaaccucugccucccagguucaagcgagucuccugccucagccuucugaguagcugggauua

SEQ ID NO: 91003 - RNA, 64 nt, hsa
cgcaaccuccgccucccggguucaagcgauucuccugccucagccucccaaguagcugggauua

SEQ ID NO: 91004 - RNA, 64 nt, hsa
gcuggucucaaacucccgaccucaaguagucugccugccucaaccucccaaagugcugggauua

SEQ ID NO: 91005 - RNA, 64 nt, hsa
gcuggucucaaacuccugaccucaggugauccaccugccucagccucccaaagugcugggauua

SEQ ID NO: 91006 - RNA, 64 nt, hsa
ugcaaccucugcccccuggguucaagcgauucuccugccucagccucccgaguagcugagacua

SEQ ID NO: 91007 - RNA, 64 nt, hsa
cacaaccuccaccuccuggguuuaagcaaugcuucugccucagcuucccaaguagcugagauua

SEQ ID NO: 91008 - RNA, 64 nt, hsa
ugcaagcucugccucccguguucacaccauucuccugccucagccuccugaguagcugggacua

SEQ ID NO: 91009 - RNA, 64 nt, hsa
ggaggacagagccgguuuccguggcaacccucagcugccucaucguggcugggaagggaaggaa

SEQ ID NO: 91010 - RNA, 64 nt, hsa
uucauggggggucagcuggucucaaaacuggccacugccucagccaccaagcuuuuuccuacca

SEQ ID NO: 91011 - RNA, 64 nt, hsa
caacaaauucugcaugguccagcgcuccagcuagcugccucaucaaaaacacugaauaaccaag

SEQ ID NO: 91012 - RNA, 64 nt, hsa
uccccacaccacccagcaggcgcuggugcuccuucugccucaugggaccaguccagcuuccagc

SEQ ID NO: 91013 - RNA, 64 nt, hsa
cuuggaagcuugaauuauaaaugugguguuuggccugccucagcagcaccaguugacugcucgu

SEQ ID NO: 91014 - RNA, 64 nt, hsa
ugcagucuccgccuccugaguucaagcgauucuccugccucagccucccaaguagcugggacug

SEQ ID NO: 91015 - RNA, 64 nt, hsa
uguuuuucacacuaaacauaugaaugcagcacugcugccucagcucagcuucgugccuggguuc

SEQ ID NO: 91016 - RNA, 64 nt, hsa
uaagacuaaugcuuucuguggacaccacugagcucugccucaacuccacccucugcgaccggag

SEQ ID NO: 91017 - RNA, 64 nt, hsa
ugcaaccucugccucccagguugaagcgauucuccugccucagccucccaaguagcugggauua

SEQ ID NO: 91018 - RNA, 64 nt, hsa
ugcaagcuuccccuuccggguucaugccauucuccugccucagccucccgaguagcugggacua

SEQ ID NO: 91019 - RNA, 64 nt, hsa
uccagcuguuaccagcuucugagcuagagcuguacugccucacguacacccccaccucuguaaa

SEQ ID NO: 91020 - RNA, 64 nt, hsa
ugcaaccuccaccuccugaguucaagcaauucuccugccucagccucccaaguagcugggacua

SEQ ID NO: 91021 - RNA, 64 nt, hsa
ugcaaccuccgccucccagguacaagagauucuccugccucagccucccgaguagcugggacua

SEQ ID NO: 91022 - RNA, 64 nt, hsa
cucugcagcaggcaagaccaaucaaucacugaaccugccucauggcaccagagugaacagggca

SEQ ID NO: 91023 - RNA, 64 nt, hsa
agagggaggcccaugaggccauccagguaagggccugccucagcgugguugggagucugaccag

SEQ ID NO: 91024 - RNA, 64 nt, hsa
ucagguggcagcggacucugacuccacugaggaacugccucagaagcugcgaucacaacuuugg

SEQ ID NO: 91025 - RNA, 64 nt, hsa
ucagaagcugcgaucacaacuuuggcugaagccccugccucacucuagggcaccugaccuggcc

SEQ ID NO: 91026 - RNA, 64 nt, hsa
cguaaccucugccuccugacuucaagcaauucuccugccucagccucccaaagugcugggauua

SEQ ID NO: 91027 - RNA, 64 nt, hsa
ugcaaccuccgccucccagguucaggcgauucuccugccucagccuccaaguagcugggacuac

SEQ ID NO: 91028 - RNA, 64 nt, hsa
cugcagugugagcugcugccucuauccugggugccugccucaugugaugauuuguauacagugg

SEQ ID NO: 91029 - RNA, 64 nt, hsa
uacccucugcuacccacuagcccucacucaguuucugccucacaaagcuguaacagaauggguu

SEQ ID NO: 91030 - RNA, 63 nt, hsa
acgaaagcccuacauugagcuccaaucugcucggggugggacgggugcuucccacaccucugg

SEQ ID NO: 91031 - RNA, 63 nt, hsa
agugggucuccauuccccgagaagccgggggcagggugggauggggaagaccaggagcagagu

SEQ ID NO: 91032 - RNA, 63 nt, hsa
ccuugcugauuugauauuuuuggucauggagaagggugggauugggugggaaugggguggaag

SEQ ID NO: 91033 - RNA, 63 nt, hsa
uugauauuuuuggucauggagaagggugggauugggugggaaugggguggaagggugaugggg

SEQ ID NO: 91034 - RNA, 63 nt, hsa
cuuuagaugggaaagugaggggcuugagaaagugggugggaggagggaaggauuuuuuaggag

SEQ ID NO: 91035 - RNA, 63 nt, hsa
accuuuuguaccuuucuuuggggaauggggugggggugggagaggagguagauggggaagaaa

SEQ ID NO: 91036 - RNA, 63 nt, hsa
cuuuuguuaacacuauuaaugggguggggaauagggugggaguggggguuugggagacgggug

SEQ ID NO: 91037 - RNA, 63 nt, hsa
ggggaauagggugggaguggggguuugggagacgggugggaaagggugguuggggggaccgau

SEQ ID NO: 91038 - RNA, 63 nt, hsa
cagaaaugcucaaauggguacaaccaucaccaagggugggaugggagggcagaggggaaauaa

SEQ ID NO: 91039 - RNA, 63 nt, hsa
gaauguuccuaaagaacugcugccccacagugagggugggagcagcggaacagggaaugccag

SEQ ID NO: 91040 - RNA, 63 nt, hsa
ugccagacacaggcucgcugcugcuggaaggcggggugggacuuccuuccucuguccggagag

SEQ ID NO: 91041 - RNA, 63 nt, hsa
aggcggggcuacagauugggcggggcuucucuugggugggacagggcuucuccugcgggggcg

SEQ ID NO: 91042 - RNA, 63 nt, hsa
accaggcuccaauggggcggggcuucucuccgcgggugggacucuucccugggaaccgcccuc

SEQ ID NO: 91043 - RNA, 63 nt, hsa
ccccucuucugcgucuguuccgugacuucgccugggugggauguaccgcaggugcaucgcguc

SEQ ID NO: 91044 - RNA, 63 nt, hsa
uggcgcguuucucggagcucccggcuccucagcgggugggaaccucggggcccagggguggag

SEQ ID NO: 91045 - RNA, 63 nt, hsa
uuucuccaagccugcuuugugcuucucaccuuugggugggaugccuugccagugugucuuacu

SEQ ID NO: 91046 - RNA, 63 nt, hsa
gccagcgcagcguucugggcuccucagucgcaggggugggaugugagucaugcggauuaucca

SEQ ID NO: 91047 - RNA, 63 nt, hsa
ccccagcucuugaagggcugaguggccugcugggggugggagggugucuuuacuauguccuag

SEQ ID NO: 91048 - RNA, 63 nt, hsa
acugcccccugcuugaauugauuccgaaggguagggugggaaggugagcaaagggagcagaaa

SEQ ID NO: 91049 - RNA, 63 nt, hsa
caucucucucuccuuccugggguggacucagaugggugggacacaugccuuccucccccuauu

SEQ ID NO: 91050 - RNA, 63 nt, hsa
ccugggccaagcugacaccagccccugaggguggggugggacggguggugcuuaaaagaggaa

SEQ ID NO: 91051 - RNA, 63 nt, hsa
uggcccagacaguauuugcaguucuugugcuaugggugggagucuucuuccucaaguuucggc

SEQ ID NO: 91052 - RNA, 63 nt, hsa
ugagaggcccuggcucuggccaggcugggaucugggugggaggcuggggcucuucuucuucca

SEQ ID NO: 91053 - RNA, 63 nt, hsa
ggggagaaaacgggaggugcucgugcuggcccugggugggagcggggaguccuggugagaccc

SEQ ID NO: 91054 - RNA, 63 nt, hsa
ugggcuggggccuuccuccagggaaggaggcuggggugggaacacuggccucccccagaauaa

SEQ ID NO: 91055 - RNA, 63 nt, hsa
gagcugggcuggccaguacagccaguggggagugggugggaggcaccaaaacuuggcagcugu

SEQ ID NO: 91056 - RNA, 63 nt, hsa
guuguaauauaaaaacuguguuucuguacgugugggugggaauucucugacggugcucguuca

SEQ ID NO: 91057 - RNA, 63 nt, hsa
gguuuacagaccagggaccgaacacgcagccaggggugggaaagcugccucagccaagcugag

SEQ ID NO: 91058 - RNA, 63 nt, hsa
uuuugcaacuggguaucuuaauuuuuauguugugggugggaggaaaggaaagaagcaacaguc

SEQ ID NO: 91059 - RNA, 63 nt, hsa
acaugccuguagucccagcuucucaggaggcuggggugggaagaucacuugagcccaggaggu

SEQ ID NO: 91060 - RNA, 63 nt, hsa
caggcuuacugagcuguccaguggagggcucaugggugggacauggaaaagaaggcagccuag

SEQ ID NO: 91061 - RNA, 63 nt, hsa
ugcucagcacauauuugcaugggagggggagaugggugggaggagaugaaaauaucagcuuuu

SEQ ID NO: 91062 - RNA, 63 nt, hsa
uugccaaggcucaucuugagaagcaggcggguugggugggaggaggaagaaagggaagaauua

SEQ ID NO: 91063 - RNA, 63 nt, hsa
uugaguuuguugccacugagaagcaggcggguugggugggaggaggaagaaagggaagaauua

SEQ ID NO: 91064 - RNA, 63 nt, hsa
ccgguggugcuuucugggcagccagggguuccugggugggaggacugucccucuggggacgug

SEQ ID NO: 91065 - RNA, 63 nt, hsa
ccgucagcuugauaauuacuaaagcaaaggccugggugggagaacagguuucuaguuuuuacc

SEQ ID NO: 91066 - RNA, 63 nt, hsa
ugagggccccaauguauguguggcugugggugugggugggagugugucugcugaguaaggaac

SEQ ID NO: 91067 - RNA, 63 nt, hsa
cggaaacauacagaggaugccuuuucugugauugggugggauuuuuucccuuuuuauguggga

SEQ ID NO: 91068 - RNA, 63 nt, hsa
gaagaguuuagaaugaggcagcggugagaagaagggugggagggcgugggggccccugggugg

SEQ ID NO: 91069 - RNA, 63 nt, hsa
uuuuucaauccuccacucuaagugauuccuccagggugggaagcacggggagcaauggaauca

SEQ ID NO: 91070 - RNA, 63 nt, hsa
cauugucgucuuuucuauugaggguugggauuugggugggagaggaaagcaaauuuuauuuuc

SEQ ID NO: 91071 - RNA, 63 nt, hsa
ggauaguggcagggguggggguugcuaaggaaagggugggaugggaguggguaaagaguuugg

SEQ ID NO: 91072 - RNA, 63 nt, hsa
ugauggggaagcugcuggaggagcagggguggggggugggagggaggggaaaggcaaaugcag

SEQ ID NO: 91073 - RNA, 63 nt, hsa
uuuuuaaggggguaguuuuauuuuggugggguugggugggaaggaaggcuggggguuuuguaa

SEQ ID NO: 91074 - RNA, 63 nt, hsa
cuguuuuuaggucugggagggcaaaaaagaggugggugggaugaaacauguuuugggggggga

SEQ ID NO: 91075 - RNA, 63 nt, hsa
caguugggaaaggaaagccaggacuuguggggugggugggaccagaaauucuugagcaaauuu

SEQ ID NO: 91076 - RNA, 63 nt, hsa
uuuuauuuuccagaacucauuuuuuaccuucaggggugggagcuaagucaguugcagcuguaa

SEQ ID NO: 91077 - RNA, 63 nt, hsa
ugguuugacuuuuuuucccugagggugagggaugggugggaagagaggacaucuguccagucu

SEQ ID NO: 91078 - RNA, 63 nt, hsa
accguuggcauuaucaggauucguguuuugugggggugggaguggagaguaggguggucuugu

SEQ ID NO: 91079 - RNA, 63 nt, hsa
aaagaggcuuuugggccaaaaugugaggguggugggugggaugggcagggaaggaauccuggu

SEQ ID NO: 91080 - RNA, 63 nt, hsa
ggaagggcgggcaaggaguggggagggagucuggggugggagggaggcaucugcaugggucuu

SEQ ID NO: 91081 - RNA, 63 nt, hsa
aagucuuuuguauugggucaggaguugaauuuggggugggaggauggaugcaacugaagcaga

SEQ ID NO: 91082 - RNA, 63 nt, hsa
cugauuccucugcugucccugccaggagcugaagggugggaacaacaaaggcaauggugaaaa

SEQ ID NO: 91083 - RNA, 63 nt, hsa
cuuuugauguuccuauuguggggguucuggauagggugggacagggauggggguguguuuuau

SEQ ID NO: 91084 - RNA, 63 nt, hsa
uauuccccuaaaaugucuauaaauuaucagucugggugggaaagcccccaccuccauccauuu

SEQ ID NO: 91085 - RNA, 63 nt, hsa
uccucccucagagcuggggcagcugccucccaggggugggacucugggcucagagagaggccc

SEQ ID NO: 91086 - RNA, 63 nt, hsa
cugacaugcucgggaaagggcagaggucacugggggugggaaggucauccaguccagacucag

SEQ ID NO: 91087 - RNA, 63 nt, hsa
gaaaagagagguaguuuagaacucucugcauaggggugggaauuaaucaaaaaccucagaggc

SEQ ID NO: 91088 - RNA, 63 nt, hsa
auuaagcacacaaaugcuaaggcagaauuuugagggugggagagaagaaaagggaaagaagcu

SEQ ID NO: 91089 - RNA, 63 nt, hsa
ugggaaguaacaguacuuagcacucuugguggugggugggaggguggguacaggccagggaua

SEQ ID NO: 91090 - RNA, 63 nt, hsa
cacaauagccugaaugggauuucagguuaggcagggugggaggggaggcucucuggcuuuagu

SEQ ID NO: 91091 - RNA, 63 nt, hsa
gucugcugggcugccaggcggcaccacugcaaggggugggagccuggcuuggguguggcugag

SEQ ID NO: 91092 - RNA, 63 nt, hsa
gggcgcagguggaggggacaggucugccgaugggggugggagccugucugcugggcugccagg

SEQ ID NO: 91093 - RNA, 63 nt, hsa
ccauguuuucauuuccuuuugcccaaaugagcggggugggaagaggguuagucuuaugugagc

SEQ ID NO: 91094 - RNA, 63 nt, hsa
cuguccugccuucuuucccucugcgaggcaguggggugggauucagagugcuuagucugcuca

SEQ ID NO: 91095 - RNA, 63 nt, hsa
caggucuguagucuuugggucuuugggaggccagggugggaggaucacuugagcucaggaguu

SEQ ID NO: 91096 - RNA, 63 nt, hsa
ggcucagguggggucacucuggcagcucagagagggugggagugggcccaaugcacuuuguuc

SEQ ID NO: 91097 - RNA, 63 nt, hsa
uucuggcucuuccaggcugggagagccuuccaggggugggacacccugugauggggcccugcc

SEQ ID NO: 91098 - RNA, 63 nt, hsa
uugcauaagaccagggggaagagugucagcguggggugggaauucccgcggccuccaccugcu

SEQ ID NO: 91099 - RNA, 63 nt, hsa
aggggagggccagauggcauccuggcuuggggcgggugggaccuacccaggcucugagacuuu

SEQ ID NO: 91100 - RNA, 63 nt, hsa
uggggagcuggucugccucagagacagaguagggggugggagcagagccucggugagggucuu

SEQ ID NO: 91101 - RNA, 63 nt, hsa
cucuucccuuugagaagauauuuucccacaaaggggugggaagccaggagugagaaggaauuc

SEQ ID NO: 91102 - RNA, 63 nt, hsa
uugaccaucguccuuccucucaagcuagccagagggugggagccuaaggaagcgugggguagc

SEQ ID NO: 91103 - RNA, 63 nt, hsa
uagggaggugggguacauuucucugagcagucagggugggaagaaagaaugcaagaguggacu

SEQ ID NO: 91104 - RNA, 63 nt, hsa
cuauuguuaucugacaucucuugacaugcccgugggugggaugggaguggaggguucauauga

SEQ ID NO: 91105 - RNA, 63 nt, hsa
guucucucccauggggaaagauucucacugcuggggugggaagauucucgcugcuggggugug

SEQ ID NO: 91106 - RNA, 63 nt, hsa
uuuguuuguuuguuuuuuaagacguucggggcagggugggaguggguauggagaugcaauuug

SEQ ID NO: 91107 - RNA, 63 nt, hsa
ccggcucuguccugugugcgcugcagcguugcggggugggagaauguggggugaggguucuua

SEQ ID NO: 91108 - RNA, 63 nt, hsa
ugggagcuauaugggaagugggggcugggaucugggugggaauauguguuuguauacaaaggg

SEQ ID NO: 91109 - RNA, 63 nt, hsa
cacaguuucccucgccccugggcugggggguuggggugggacacccguaccgcggcuggcugg

SEQ ID NO: 91110 - RNA, 63 nt, hsa
acgugggccuggaacucuaacuccaucgcugaggggugggaaugagaacuaugaaccaggaag

SEQ ID NO: 91111 - RNA, 63 nt, hsa
caccgucaccuggaagcagggcaccagcugcuggggugggacuugggucuucagaucauaaac

SEQ ID NO: 91112 - RNA, 63 nt, hsa
gcccaagcgcuccggcggagcccaaaagggugggggugggaggggcagaggccaacggauccc

SEQ ID NO: 91113 - RNA, 63 nt, hsa
gcgggggaggcugggagcugggccuccugcguggggugggacucgcaggggccgggucuccgu

SEQ ID NO: 91114 - RNA, 63 nt, hsa
caagcccccaggggagcccucccuggcguccgagggugggagucgggguguggcaggccgcgg

SEQ ID NO: 91115 - RNA, 63 nt, hsa
uuugugugugugcacgcauggcugagcaugugugggugggagucagcacauucacgauacugu

SEQ ID NO: 91116 - RNA, 63 nt, hsa
ucucuggguugucauucacuuugagagcccgaggggugggagggagugaugcaggcagacgcu

SEQ ID NO: 91117 - RNA, 63 nt, hsa
guugaggugagucauggccucuugcuggcaauggggugggaggaguacccccaaguccucuca

SEQ ID NO: 91118 - RNA, 63 nt, hsa
cgaggccggagagcuggugacuuuggggacagggggugggaaggggauggacacccccagcug

SEQ ID NO: 91119 - RNA, 63 nt, hsa
uucgggcaguccugugugaggauuaagggacgggggugggagguaggcuguggggugggcugg

SEQ ID NO: 91120 - RNA, 63 nt, hsa
guuuuucucuguggcuguauguggguugcuugggggugggaugggaagaggcucuuugcaaac

SEQ ID NO: 91121 - RNA, 63 nt, hsa
gugugggguugggggaugaggucagggggucuugggugggaguugggggccccuucauuuccc

SEQ ID NO: 91122 - RNA, 63 nt, hsa
gcuggaagcagaaacaaaaugaaaaaaaaaggggggugggaggggaagaaaaacucuauuuuu

SEQ ID NO: 91123 - RNA, 63 nt, hsa
cgucccugcggaagccacagggugagcacucuggggugggagggucugcagggaauugggggg

SEQ ID NO: 91124 - RNA, 63 nt, hsa
acucugccaaauggaaaaugaccaaauuuaagagggugggacaguccccugcuccucucccag

SEQ ID NO: 91125 - RNA, 63 nt, hsa
uuccuggaaucaguuuauuauacugaaaacugggggugggaguagggagcuaguuuguugaua

SEQ ID NO: 91126 - RNA, 63 nt, hsa
ugcccgggaagugcagcaggcagcuuuucuuuggggugggacuugcccugagcuuggagcugc

SEQ ID NO: 91127 - RNA, 63 nt, hsa
ggccucguuuuccuggucuugacugcucuguuugggugggagaagauucucugggggucccca

SEQ ID NO: 91128 - RNA, 63 nt, hsa
ccagugcuccuacugguucccaagcuacagguggggugggaaaggcuuuaucagguaucauca

SEQ ID NO: 91129 - RNA, 63 nt, hsa
cuaagggaucagggagaggaagaaagagggauggggugggaggcacccccuccagugcuccua

SEQ ID NO: 91130 - RNA, 63 nt, hsa
ccccagaggcaaggcugugcacucagggagggagggugggacacagaggugcaucuagggucc

SEQ ID NO: 91131 - RNA, 63 nt, hsa
ccccuuuuuuuuuguuuuguucuguuuuguuuugggugggagggugggaaauuuggguuuuua

SEQ ID NO: 91132 - RNA, 63 nt, hsa
uuuuuguuuuguucuguuuuguuuugggugggagggugggaaauuuggguuuuuaaguccucu

SEQ ID NO: 91133 - RNA, 63 nt, hsa
uuccuccacccuaagcccuggggcccugaaauggggugggagggcaggggugggagcccuccu

SEQ ID NO: 91134 - RNA, 63 nt, hsa
gcccuggggcccugaaauggggugggagggcaggggugggagcccuccuaguggguuuggggg

SEQ ID NO: 91135 - RNA, 64 nt, hsa
cacugucuuuaaguugaaacuguuaagcugaauaaaaacuuaagcugcaaauugauaacuucgc

SEQ ID NO: 91136 - RNA, 64 nt, hsa
uccuuuucuuaguuucacauucuuccuuuguucuaaaacuuagacugacaucuagcuuugacaa

SEQ ID NO: 91137 - RNA, 64 nt, hsa
augggaacauggacaccauuucugaccuucaaauaaaacuuauuauguauugguuuucagacug

SEQ ID NO: 91138 - RNA, 64 nt, hsa
gaguuuaacagcagccugauauguaaguuucagcaaaacuuauaccuguauauguuuuuauuug

SEQ ID NO: 91139 - RNA, 64 nt, hsa
cacaauuagaguuugguuuuuuuuuaagcuuuucaaaacuuacuaaacuggcacaauuuuauau

SEQ ID NO: 91140 - RNA, 64 nt, hsa
gcauacagccuucagaagccaacauuuuuaaucaaaaacuuauaaaacaugaugaucauuguga

SEQ ID NO: 91141 - RNA, 64 nt, hsa
uaccucuucaccugacccugcccccacuugccauaaaacuuagcuaaguuuuguuuuguuuuuc

SEQ ID NO: 91142 - RNA, 64 nt, hsa
aacauggugaaaccuggucucuacauaaaauacaaaaacuuagaugggcaugguggugugugcc

SEQ ID NO: 91143 - RNA, 64 nt, hsa
gaaauguaauuauguucuaagugccuccaaguucaaaacuuauuggaauguugagagugugguu

SEQ ID NO: 91144 - RNA, 64 nt, hsa
aucauauaucagaauuuuauuguauaugaugaacaaaacuuaaaauuuuuuaaauuuaauuuuu

SEQ ID NO: 91145 - RNA, 64 nt, hsa
acuguuucagaguucuaaaaaggcaguuuuuuaaaaaacuuaaguugauaaaaacuguaagaau

SEQ ID NO: 91146 - RNA, 64 nt, hsa
uaagaauuugcacaugaauguuaauggaaaacacaaaacuuaagauggcccaaaacaaaagcca

SEQ ID NO: 91147 - RNA, 64 nt, hsa
auaguugcaggcaaaaaaaaaaccaccucacugcaaaacuuauuguuaauuuuagucaccaaug

SEQ ID NO: 91148 - RNA, 64 nt, hsa
ugaacucuuuauguuuaaaaucaugucauuauggaaaacuuacaaguguaacuagcuaguagcu

SEQ ID NO: 91149 - RNA, 64 nt, hsa
accaguauaacguucaacaacaguuauuuugacaaaaacuuauuuugugauuccuacagugaaa

SEQ ID NO: 91150 - RNA, 64 nt, hsa
auuuaaaguuguaucuugacacaggaaaugggaaaaaacuuaaaaauuaauaugguguauuuuu

SEQ ID NO: 91151 - RNA, 64 nt, hsa
ugcagucauuuggugcucugcuaaccauuuauauaaaacuuaaaaacaagagaaaagaaaaauc

SEQ ID NO: 91152 - RNA, 64 nt, hsa
auaguuuugauuuuugaguuuuuaacagaaguauaaaacuuaacauucucauagcuccuguccu

SEQ ID NO: 91153 - RNA, 64 nt, hsa
aaaaaauccuuacugacuaguuaugugagaugcuaaaacuuacaacauugcaguuacugauaca

SEQ ID NO: 91154 - RNA, 64 nt, hsa
gaugaccucaauauugacuuucagccauacugggaaaacuuacuuuucauggagugccaccuaa

SEQ ID NO: 91155 - RNA, 64 nt, hsa
ugugauauuugacaacucuaaaaaauaaaaaaaaaaaacuuagagcacaauaauccuugccuau

SEQ ID NO: 91156 - RNA, 64 nt, hsa
augcccaacauuuuguguauuacauuguugucuuaaaacuuacuaguuuugugggacuuguuau

SEQ ID NO: 91157 - RNA, 64 nt, hsa
aagaguguaucugugaaagagcuccuacacuuugaaaacuuaagaaucccuuaucaugaaguuu

SEQ ID NO: 91158 - RNA, 64 nt, hsa
caaagauuaaagcaugaaauguaaaacaucugauaaaacuuacagcccccuacaccaagagugu

SEQ ID NO: 91159 - RNA, 64 nt, hsa
ugccuguguggauuuuugugaaaaugucaaagagaaaacuuauauacuauuucccuugaaauuu

SEQ ID NO: 91160 - RNA, 64 nt, hsa
gagaaaugauauauaccacuuucccagaaaaaaaaaaacuuacacuugggacuuggcaaauucc

SEQ ID NO: 91161 - RNA, 64 nt, hsa
agccccucacuccccagagucaaaaggaaauguaaaaacuuagagcucccauuguaauguaagg

SEQ ID NO: 91162 - RNA, 64 nt, hsa
cauugcacugaaugauuucuuuugccccuaggagaaaacuuaauaauugugccuaaaaacuaug

SEQ ID NO: 91163 - RNA, 64 nt, hsa
auguaaugaugacauaguugaugcauccaauccuaaaacuuacauuccaaaggaauuauaucau

SEQ ID NO: 91164 - RNA, 64 nt, hsa
uauuguuuaaauuugacuuaugggagaucagucaaaaacuuagaagguuuaacacuucacugau

SEQ ID NO: 91165 - RNA, 64 nt, hsa
uuuuguuugguauauuuacuaagugcacucuuucaaaacuuauucuauaacuuuaucaauucau

SEQ ID NO: 91166 - RNA, 64 nt, hsa
aauuguucauccauauauaagaaauuaucgaauuaaaacuuaauguaugucaauuauuuucaaa

SEQ ID NO: 91167 - RNA, 64 nt, hsa
auacagaaaugaaugagugugguuauguucuaauaaaacuuauuuauaaaaacaaggggaggcu

SEQ ID NO: 91168 - RNA, 64 nt, hsa
auauaugaucugcauuuucuugaacugaucauugaaaacuuauaaaccuaacagaaaagccaca

SEQ ID NO: 91169 - RNA, 64 nt, hsa
guaauaaccuuuuuguauaucacaauuugggugaaaaacuuaaguacccuuucaaacuauuuau

SEQ ID NO: 91170 - RNA, 64 nt, hsa
gccaauucacaaguuacacugccauucugauuuuaaaacuuacaauuggcacuaaagaauacau

SEQ ID NO: 91171 - RNA, 64 nt, hsa
aauauguuuaaagauauuuauauauugccauacaaaaacuuaacauuuaaaacugauaauaucu

SEQ ID NO: 91172 - RNA, 64 nt, hsa
ccaacaaacuguacuuuauacaauucuggaugcuaaaacuuagagauuuucucuuugcauaaau

SEQ ID NO: 91173 - RNA, 64 nt, hsa
gaugucccuuuaaacagacugcugccuucagcuaaaaacuuaauguucuuuauaccuuuguaug

SEQ ID NO: 91174 - RNA, 64 nt, hsa
aacuuagguuauuuuugcuuccgaauuugaaugaaaaacuuaaugccauggauuuuuuucuuuu

SEQ ID NO: 91175 - RNA, 64 nt, hsa
ucccugaacauaggaaaauagaaacuugcuuaucaaaacuuagcauuaccuuggugcucugugu

SEQ ID NO: 91176 - RNA, 64 nt, hsa
ggaaguggggaaguguuccagauagcagggcaugaaaacuuagagagguacaaguggcugaaaa

SEQ ID NO: 91177 - RNA, 64 nt, hsa
uuaaaauugcugaauuuacccucauauucuuuaaaaaacuuaaagcauuaugaauguagagaaa

SEQ ID NO: 91178 - RNA, 64 nt, hsa
aaaaaaaauaaagacacuguugccaaugugacccaaaacuuaagaacauacuaauggcauauau

SEQ ID NO: 91179 - RNA, 64 nt, hsa
gccuauagcuucccuuccggaaagcuugcuuugaaaaacuuaaaaagcccccguuuacauguag

SEQ ID NO: 91180 - RNA, 64 nt, hsa
caauuuuaaaaaugugacuuucuuguuuugucucaaaacuuaaaaaaacaaacacaaaaagaug

SEQ ID NO: 91181 - RNA, 64 nt, hsa
caucuucauguuccuaauaggcuaaaugaaguuaaaaacuuauuucagauuuuucucaucugua

SEQ ID NO: 91182 - RNA, 64 nt, hsa
auuugaaauaauguuuuguacuucgguaagauggaaaacuuagugauucacugauuucuuagac

SEQ ID NO: 91183 - RNA, 64 nt, hsa
uuacauuucacaaaagauauuuuaaacucuuuguaaaacuuagauaauagagccuagcaguuac

SEQ ID NO: 91184 - RNA, 64 nt, hsa
ucuuuucucccuuaugaaaaagaaaagauagcacaaaacuuaagacuuaccuaggaaacccauu

SEQ ID NO: 91185 - RNA, 64 nt, hsa
ccugaguucaauauauuauuaacagcaguauuuuaaaacuuaggguugaacugggcaugguggc

SEQ ID NO: 91186 - RNA, 64 nt, hsa
gaucccaucucuaaaaaauaaaauauaagaaaauaaaacuuaggggauauacagauuuaaauau

SEQ ID NO: 91187 - RNA, 64 nt, hsa
uuauucuuaggcccucguggauuuuuuuuuucagaaaacuuaaacaaaaaaagacuuacuaaga

SEQ ID NO: 91188 - RNA, 64 nt, hsa
uagguuucuguauuuauauauuaaaauacaaaaaaaaacuuauaaaauguuuaaaaaaauguuc

SEQ ID NO: 91189 - RNA, 64 nt, hsa
uuguguugguacauuggcagagacauaugcuuuaaaaacuuaaauauuucggaggcacauguug

SEQ ID NO: 91190 - RNA, 64 nt, hsa
aagaagugcagagggguuuuuuguguauugcgugaaaacuuauaaaacaaauguuaacagaaug

SEQ ID NO: 91191 - RNA, 64 nt, hsa
uucagaacauguguuaauaguauauaugccacugaaaacuuagguccuguaucauacuuuuuuc

SEQ ID NO: 91192 - RNA, 64 nt, hsa
guggauuuuaaaaaaucaaucaauggugcaaaaaaaaacuuaaagcaaaauaguauugcugaac

SEQ ID NO: 91193 - RNA, 64 nt, hsa
gauggccuuuugaugaaugucuuccacaguaaagaaaacuuaguggcuuaauuuaggaaacaug

SEQ ID NO: 91194 - RNA, 64 nt, hsa
caaaaaaauauagcguaaauacuuauuuuuuuuaaaaacuuacuuaaauuuguguguaaaauau

SEQ ID NO: 91195 - RNA, 64 nt, hsa
cacuguacuucucaaaguugguuauuagaccaggaaaacuuaauguaauauuauuuuuaaaauc

SEQ ID NO: 91196 - RNA, 64 nt, hsa
gacagagugagacuccaucucaaaaaaaaaaaaaaaaacuuaagauggacacagcugacuggac

SEQ ID NO: 91197 - RNA, 64 nt, hsa
caccagccugggcagcagcaagaacuauuuauuaaaaacuuaagaugggccaggugcgguggcu

SEQ ID NO: 91198 - RNA, 64 nt, hsa
ucagagagcauuuuacuacugagcugcaaagggaaaaacuuaaaauggauaugaaaagugaaga

SEQ ID NO: 91199 - RNA, 64 nt, hsa
cagccauggccccagacuugucgcacggaugcagaaaacuuaauggaggaggcugaggucagaa

SEQ ID NO: 91200 - RNA, 64 nt, hsa
gcaaucuuuuacuaugcauuaagaccucugauucaaaacuuauuagaacaguagcuucugcugg

SEQ ID NO: 91201 - RNA, 64 nt, hsa
gccagaccccaucucuauuuauauauauauauauaaaacuuagaguuuuuaucuuccccuaaaa

SEQ ID NO: 91202 - RNA, 64 nt, hsa
auucucuuuuuuuuuuuuuuuuuuuuugguuaugaaaacuuagggacuaaaauuaauauaaaaa

SEQ ID NO: 91203 - RNA, 64 nt, hsa
aguaccuccaggcugaaagacuguuguaccaguaaaaacuuaaaggcacaaauucuccuugaag

SEQ ID NO: 91204 - RNA, 64 nt, hsa
uuauuauuauauuuuauuucuuuggucugugagcaacucaaagaggcagaagaggagaaugacu

SEQ ID NO: 91205 - RNA, 64 nt, hsa
agugucuuuucagccuuuccaucuuuacaaauaaaacucaaaaaagccguccagcuuaucccau

SEQ ID NO: 91206 - RNA, 64 nt, hsa
gugauuguucuggagugaauuaaguucaccugauaacucaaaagugaauguauaauacaauucu

SEQ ID NO: 91207 - RNA, 64 nt, hsa
agauggugucuuagaugccacaggagaagaggcaaacucaaaugcugagaaccccaagcugaua

SEQ ID NO: 91208 - RNA, 64 nt, hsa
auuaauauuuugacuauuuuuauauauaaagaagaacucaaaaaauuauguucaaauuuguaca

SEQ ID NO: 91209 - RNA, 64 nt, hsa
cagaguaaguaggcagcacuuuuaaaaauaugugaacucaaauauugcacuucuuucaagaugu

SEQ ID NO: 91210 - RNA, 64 nt, hsa
uaagacuagaaccuauaggaaacuacuuggagcaaacucaaaggacagauuagggaucgagauu

SEQ ID NO: 91211 - RNA, 64 nt, hsa
cagaaagcgugauagaggagagaauuuuugacaaaacucaaaaguuguuugcacagcuguucuu

SEQ ID NO: 91212 - RNA, 64 nt, hsa
uuuugauaaugacuggacaucagaagaggaaaaaaacucaaaacaaaagcgagagagacuauug

SEQ ID NO: 91213 - RNA, 64 nt, hsa
ucaaaacaaaagcgagagagacuauugccauaugaacucaaaagcuaucaugguguucacucua

SEQ ID NO: 91214 - RNA, 64 nt, hsa
gaacaugggaauucauacugagaugcaaucucucaacucaaaaauguauuaaaaauaggauccc

SEQ ID NO: 91215 - RNA, 64 nt, hsa
uggucucuccagauauuaacaagaauuguuguguaacucaaagauuugcuuuuauagacuugau

SEQ ID NO: 91216 - RNA, 64 nt, hsa
auauagucugaaucuuaggaagaagguaaaagaaaggaggcaagagaauaguuaugaugaauau

SEQ ID NO: 91217 - RNA, 64 nt, hsa
guuaugaugaauauguguuaagugccugcucugaaggaggcaauguucuucucauuugaauccu

SEQ ID NO: 91218 - RNA, 64 nt, hsa
cuuauucuaccagggcugaaaaucggagucacuuaggaggcagcaugagaacaguggcacacca

SEQ ID NO: 91219 - RNA, 64 nt, hsa
acaacacaccuuaggaacaugugcuaaggggcuaaggaggcaucagcugucuuccuuauucuac

SEQ ID NO: 91220 - RNA, 64 nt, hsa
gcaaaggaaacuggguggggaggaucaauuagagaggaggcaccugggauccaccuucuuccuu

SEQ ID NO: 91221 - RNA, 64 nt, hsa
acuauggggugcacucuacaguuuuugaaaugcuaggaggcagaaggggcagagaguaaaaaac

SEQ ID NO: 91222 - RNA, 64 nt, hsa
uuccaaacuaagcuagauucuugguuuuaaugagaggaggcagagagagggaggcagauggaag

SEQ ID NO: 91223 - RNA, 64 nt, hsa
auuguuguuuaaguuccaaggugugcuacaauauaggaggcacagucaucaguuugugacauac

SEQ ID NO: 91224 - RNA, 64 nt, hsa
gaaagccuuuuugagauuaagaaauuuucuuaccaggaggcaacuuuccgucuguccuaaaggg

SEQ ID NO: 91225 - RNA, 55 nt, hsa
aggacuuugugaccaaauagucuacaggaggcagccauuuggaagguuagucuug

SEQ ID NO: 91226 - RNA, 64 nt, hsa
uaagacaaaaaaauauauauauauugaaaaucaaaggaggcaaaauuuugacagggaaggaagu

SEQ ID NO: 91227 - RNA, 64 nt, hsa
ugaggaggcugaggugggaggauugcuugagcccaggaggcagagguugcagugagccaagguc

SEQ ID NO: 91228 - RNA, 64 nt, hsa
agggugagagggaguggggagggagagggcaggaaggaggcagagcuguccgugggagguggag

SEQ ID NO: 91229 - RNA, 64 nt, hsa
aaggugguggcgugaccuuaacucucagaagcagaggaggcagguggguggagggggaugcugg

SEQ ID NO: 91230 - RNA, 64 nt, hsa
uccuggggaguugaccgacauuugggaagauaauaggaggcauuggggaaacugcuccccaaua

SEQ ID NO: 91231 - RNA, 64 nt, hsa
uucccuagcaaaguauuuguggggguccaaugcaaggaggcagggaagaaagggggccugcaaa

SEQ ID NO: 91232 - RNA, 64 nt, hsa
ucauaggcagagaagcccuucugacauuucccccaggaggcaggggguggucugagucuccuca

SEQ ID NO: 91233 - RNA, 64 nt, hsa
agcacugcucucuagcuccagggcacuaagccacaggaggcagcgcccugcagccucccgucca

SEQ ID NO: 91234 - RNA, 64 nt, hsa
gcugggagagggaaagacauucagacccacagaaaggaggcagcacacagagaaagaugcacag

SEQ ID NO: 91235 - RNA, 64 nt, hsa
cauuguuagcaucagauuauaccucauuauuaaaaggaggcauggccacacaugaagaaauggu

SEQ ID NO: 91236 - RNA, 64 nt, hsa
cggaagcugcagcagguguacaagcugaacaggaaggaggcagcugccuacauguacuacgucu

SEQ ID NO: 91237 - RNA, 64 nt, hsa
augaagacuguccggagcuucgccaaugaggaggaggaggcagagguguaccugcggaagcugc

SEQ ID NO: 91238 - RNA, 64 nt, hsa
uucauuucuaauacucuuacgaaaacuauucuaaaggaggcaggagccaaggccaaaagugaac

SEQ ID NO: 91239 - RNA, 55 nt, hsa
auucacagaaacagaugugaaggucaggaggcaaguggaggauggacugggcccg

SEQ ID NO: 91240 - RNA, 64 nt, hsa
aggcucugagggagaugggcuugggggcuguaggaggaggcagggauuccagggugucaggaag

SEQ ID NO: 91241 - RNA, 64 nt, hsa
augcucugaggcagaugggcuugggggcucuaggaggaggcagggacuccagggugucaggaag

SEQ ID NO: 91242 - RNA, 64 nt, hsa
cggugauguaguauggccugacagcucuguuuagaggaggcaacacugaucccccagaugcagg

SEQ ID NO: 91243 - RNA, 64 nt, hsa
ggggcggagccccggcucuuauagaagcuucagcaggaggcaagcguguucucagcacauaugg

SEQ ID NO: 91244 - RNA, 64 nt, hsa
uaugcaaaugugaaauaaccgaucuauaacgugaaggaggcagacaugagcuguacuacucagu

SEQ ID NO: 91245 - RNA, 64 nt, hsa
uagaaguaaauuuuuacacuauuuuguuguuuaaaggaggcauuucuacuuccuugaguuuugc

SEQ ID NO: 91246 - RNA, 64 nt, hsa
ccuguaaggggccagagccuuggaggacacuaagaggaggcaggaggagcaacucaaaucccca

SEQ ID NO: 91247 - RNA, 64 nt, hsa
gaguugcuaaguggccggaaaacaagccugagggaggaggcaggaguuggaguuaccuuaggcc

SEQ ID NO: 91248 - RNA, 64 nt, hsa
gagguugggcagcugaacaguguuggcuuucaugaggaggcagaaagcagaggcuggccucaga

SEQ ID NO: 91249 - RNA, 64 nt, hsa
gccaccugucccaccucaaaugggucugggggucaggaggcaggguuuuaucucugucuaccau

SEQ ID NO: 91250 - RNA, 64 nt, hsa
acucuguguuguaauuucaggggagcaucaguggaggaggcagugggggcagcagcagccuccu

SEQ ID NO: 91251 - RNA, 64 nt, hsa
ucaggaggcugaggcaggagaaucacuugaacccaggaggcagagguugcagucagccaagauc

SEQ ID NO: 91252 - RNA, 64 nt, hsa
aucuucuuagcccagagagcaguggaguugagugaggaggcagauguccugucugugagccagu

SEQ ID NO: 91253 - RNA, 64 nt, hsa
gcuuugaagaaagagcugauggugcagaagcagcaggaggcacuugaggagcaggcggcucugg

SEQ ID NO: 91254 - RNA, 64 nt, hsa
ggacucagccaugcacaccuugagcagcgccggcaggaggcacggaaggaacugugcuccguuc

SEQ ID NO: 91255 - RNA, 64 nt, hsa
cgagaaaccuguggucuagaaccacagcaagaagaggaggcaugcuggccugcaccggaagacu

SEQ ID NO: 91256 - RNA, 64 nt, hsa
cuguggucuggcccccucccuguccaggccccgcaggaggcagaugcagucccaggcauccucc

SEQ ID NO: 91257 - RNA, 64 nt, hsa
ugccuggccuggccugggacaccuccucucugccaggaggcaauaaaagccagcgccgggaccu

SEQ ID NO: 91258 - RNA, 64 nt, hsa
ucuggcaucguuuuccgccaggacccaaagauccaggaggcacuugugacuagccugccaaugg

SEQ ID NO: 91259 - RNA, 64 nt, hsa
auuauaaaaaaacaaaauaaaugaaaaggacuguaggaggcagagacggguacaggggguacca

SEQ ID NO: 91260 - RNA, 64 nt, hsa
cggguguggauuugaauguggacuucggaaucccaggaggcaggggccgggcucuccuccaccg

SEQ ID NO: 91261 - RNA, 64 nt, hsa
aguucagcccauuguacgugcaggucccgugggaaggaggcaaaagccccugcuucuuacuuug

SEQ ID NO: 91262 - RNA, 64 nt, hsa
uuguuuguuacugccacuucuuuuuaggagcaaaucuccccagggguguacgguauuucuugac

SEQ ID NO: 91263 - RNA, 64 nt, hsa
ugaauguguguagcugcuuuuucacucgugguccucuccccaucccuugcucugaccccagagc

SEQ ID NO: 91264 - RNA, 64 nt, hsa
caauuuggcacaggcagcagucucccucccaggcucuccccaucuccccugcuuugguguugag

SEQ ID NO: 91265 - RNA, 64 nt, hsa
acuuguucugaggacauccacacaauaguaggaaucuccccaaccaaucugugaauuucauggg

SEQ ID NO: 91266 - RNA, 64 nt, hsa
gguuugaaguacuauuuucccaggguggcuucaaucuccccaccuaggaugucagcccugucca

SEQ ID NO: 91267 - RNA, 64 nt, hsa
uaggaugucagcccuguccaaggaccuucccucuucuccccaguuccugggcaaucacuucacc

SEQ ID NO: 91268 - RNA, 64 nt, hsa
ccagacuuccccaccuucagccaccaucagagccucuccccaggugccccccggggauucaggg

SEQ ID NO: 91269 - RNA, 64 nt, hsa
cgcuccugcuccauggacucugccuacggcacccucuccccaaccuccuuacaagacuuugugg

SEQ ID NO: 91270 - RNA, 64 nt, hsa
uucccggagcacagcccugggagggggcuauuucucuccccacugaaaacauuucaaagcugag

SEQ ID NO: 91271 - RNA, 64 nt, hsa
aaggugcugagcuuagccuugugcccugcccccaucuccccaggccuccagccucucccggcug

SEQ ID NO: 91272 - RNA, 64 nt, hsa
accuccucagggucaaagggcuacuuucuggaagucuccccaggcugacuccuucucccugacu

SEQ ID NO: 91273 - RNA, 64 nt, hsa
acuggggacccugcacagucuggccaugugacccucuccccaggcaagcucugaagucccugca

SEQ ID NO: 91274 - RNA, 64 nt, hsa
ucuccccugcagucuggguucccagacugaguccucuccccaaaucagggcucuagacccgagc

SEQ ID NO: 91275 - RNA, 64 nt, hsa
aaaaaaaugggucuccuucugggcuccaggauugucuccccacuccagcauccccaaacuggua

SEQ ID NO: 91276 - RNA, 64 nt, hsa
uuacuuuuguuccuuuucccuaaucauucccuuuucuccccacuccuccagaaggcauaacccu

SEQ ID NO: 91277 - RNA, 64 nt, hsa
uucaaccgcugagguuugauuucuuacccuuucuucuccccauuuucauacucuucccagggau

SEQ ID NO: 91278 - RNA, 64 nt, hsa
cucaugaugaagugccauuucuguuacgucucccucuccccaagcucagaggugcucagaggua

SEQ ID NO: 91279 - RNA, 64 nt, hsa
uccugcgaucagccccugggguaccccauguaugucuccccacuaaccacauccuaccuaggga

SEQ ID NO: 91280 - RNA, 64 nt, hsa
ugcccuucagccuucaaaguaagagucagcuuuuucuccccauuugggacaucaagccuagcau

SEQ ID NO: 91281 - RNA, 64 nt, hsa
uacaucaaaaucuggcagagucagcugcugacccucuccccaagaagaugaaagauucaguggu

SEQ ID NO: 91282 - RNA, 64 nt, hsa
uguuuugacacugagcuuggggcuuuuuccaucuucuccccacagccucuggcuccacaccucc

SEQ ID NO: 91283 - RNA, 64 nt, hsa
ccuuccccacccuugagaaggugcuuuguaauauucuccccacccaccccacgcccgcaccccc

SEQ ID NO: 91284 - RNA, 64 nt, hsa
gggauaagucuuuugucaucaaggaggcaaauugucuccccaagacagcucaaaauauccacac

SEQ ID NO: 91285 - RNA, 64 nt, hsa
ccggcaacaccaagaggguuuuuaguggcuugggucuccccagugggggauaagucuuuuguca

SEQ ID NO: 91286 - RNA, 64 nt, hsa
ccuuuucugaucaugccccuucucucccaccccaucuccccaccaccaccucuguggccuccau

SEQ ID NO: 91287 - RNA, 64 nt, hsa
acuuccucuccucuuaccugggcagaguguugucucuccccaaauuuauaaaaacuaaaaugca

SEQ ID NO: 91288 - RNA, 64 nt, hsa
gcccggugucggggaggggugcuuucuuuccucaucuccccacuccccacucucagccugggag

SEQ ID NO: 91289 - RNA, 64 nt, hsa
gcuaccugggcauuuguggucauuucaguuuccaucuccccagcgggggcucccugggugaaag

SEQ ID NO: 91290 - RNA, 64 nt, hsa
ccaggccccgccuggaaggaagucguuccucaacucuccccaaggcaccugucuccaaucagag

SEQ ID NO: 91291 - RNA, 64 nt, hsa
auuugcauaacaauccuauuaagguaggugcucuucuccccauuuuacaaaugagaaaucugag

SEQ ID NO: 91292 - RNA, 64 nt, hsa
aaguaaauuuccuugucauuccuaucucuugaguucuccccagaggcaaucacugcuacugguu

SEQ ID NO: 91293 - RNA, 64 nt, hsa
agcagauugugcgcacacucguuuccgaacugccucuccccaaagaaugugaggcauugucacc

SEQ ID NO: 91294 - RNA, 64 nt, hsa
ugaggaaauguucucaauugagcaauucagucccucuccccaaagacuagacgugaccuggcag

SEQ ID NO: 91295 - RNA, 64 nt, hsa
gcaugcacacaacauccucucuuugaguuuggguucuccccagccccuuggccucugaggcuga

SEQ ID NO: 91296 - RNA, 64 nt, hsa
uccucugcccagaggggcagcagcucucccugguucuccccagggcagacgggguagggcgggc

SEQ ID NO: 91297 - RNA, 64 nt, hsa
caccccuuccaccugucccccagacccaaagcucucuccccacccuaccugcccaccuggggcu

SEQ ID NO: 91298 - RNA, 64 nt, hsa
aaaaaaucucagaaucugaaauaagcccuaaauuucuccccaaaaucaagacucuugagagcau

SEQ ID NO: 91299 - RNA, 64 nt, hsa
uaauauguguauauuuuuugguuuuccuacagcuucuccccaucuuucaaaagaaucacgaaau

SEQ ID NO: 91300 - RNA, 64 nt, hsa
aucuaaaacugggguuugggggaagguuucagccucuccccacuccccuugccccacacccuuu

SEQ ID NO: 91301 - RNA, 64 nt, hsa
aaagaugccauucucucccuaaggucugguggagucuccccaucuugcauacccuucugcaagc

SEQ ID NO: 91302 - RNA, 64 nt, hsa
cuggugaggauguuugauccgagauuuucugagcucuccccaaucaccagcugucugcuggguu

SEQ ID NO: 91303 - RNA, 64 nt, hsa
uccucaggcauggguguccacagcacuggcccccucuccccagccucagcugcuguccgccuga

SEQ ID NO: 91304 - RNA, 64 nt, hsa
aaaagucaucgcaacuucagagcgaacggccacaucuccccaccucucacccccacccucuccc

SEQ ID NO: 91305 - RNA, 64 nt, hsa
uugcuaaaccgacaaggaaggcugugugcuuagcucuccccagagggagggcgagaagggugug

SEQ ID NO: 91306 - RNA, 64 nt, hsa
ccugcccccaccuacuagaugccaggggcacuguucuccccagccccccgccccaguugugaca

SEQ ID NO: 91307 - RNA, 64 nt, hsa
uucccccucucaugguaggccagggacugggcuuucuccccacuaagggcaaggccccaguuuu

SEQ ID NO: 91308 - RNA, 64 nt, hsa
agaugccguggauacgccagggucccagggggaaucuccccaagcucacacucucucccgcuua

SEQ ID NO: 91309 - RNA, 64 nt, hsa
agugucguugauuuaaaggagccagugcuuccccucuccccagguaguuggucagcuguggacu

SEQ ID NO: 91310 - RNA, 64 nt, hsa
accagcagcagcagggcccuccucccccaccagcucuccccacagggccccucagcaucaugga

SEQ ID NO: 91311 - RNA, 64 nt, hsa
gagaggggcuggggagcucagcuuggucucagagucuccccaccagauacuguuuaaaaaagua

SEQ ID NO: 91312 - RNA, 64 nt, hsa
aguuaccagaauuuucaauggaaaaugagggguuucuccccacugauauuuuacauagagucau

SEQ ID NO: 91313 - RNA, 64 nt, hsa
uaucacggguuuuuguuaauguuucauaaguaauucuccccacuugauuuuucuucuauaaaau

SEQ ID NO: 91314 - RNA, 64 nt, hsa
cucgcagcccaugccugggggugcugccaucuucucuccccaccacccuuucacacauuccuga

SEQ ID NO: 91315 - RNA, 64 nt, hsa
ccccugucaacacaugagaacggaccacacccucucuccccagcauggauggccacagcucagc

SEQ ID NO: 91316 - RNA, 64 nt, hsa
ccuggcaaaugaaucaaagacccauuccuguuccucuccccaccacuacuguuuucuacuguaa

SEQ ID NO: 91317 - RNA, 64 nt, hsa
caauacauuuugauucucuuguggguugauaaugucuccccaaaauuuacauguugaagcaccu

SEQ ID NO: 91318 - RNA, 64 nt, hsa
uaaaguacauuauguuuacucaaguaaauaauuuucuccccaugguacacucuaguguaggcua

SEQ ID NO: 91319 - RNA, 64 nt, hsa
ugcaaauucuauccucuaaacuuaucuggugcauucuccccaccccacccccauuauauaaggg

SEQ ID NO: 91320 - RNA, 64 nt, hsa
gagucaccuucccuugccacuuugcacgacgcccucuccccaccccuaccccuggcuguacugc

SEQ ID NO: 91321 - RNA, 64 nt, hsa
uugcuuuucccucuuuucuuacuccuccucuuucucuccccaacccccauucucaucugcaccc

SEQ ID NO: 91322 - RNA, 64 nt, hsa
cuuggcucuugguaccuguggguuagcaucaaguucuccccaggguagaauucaaucagagcuc

SEQ ID NO: 91323 - RNA, 64 nt, hsa
ugauccguccgaggcugcuucccagaggagcagcucuccccaggcauuugccaagggaggcgga

SEQ ID NO: 91324 - RNA, 64 nt, hsa
gccaaguccacugaggcccggaccccggacugcgucuccccagccccccucggcguccucucuc

SEQ ID NO: 91325 - RNA, 64 nt, hsa
cccagccucugccggcuccccuaggcaaccccuuucuccccaggagcgggugcggcugauuccc

SEQ ID NO: 91326 - RNA, 64 nt, hsa
ggcagcagcugcagcaagcgcacccucuccccacucuccccacgccagagcggcuuccagagca

SEQ ID NO: 91327 - RNA, 64 nt, hsa
gccuccuaaggcagcagcugcagcaagcgcacccucuccccacucuccccacgccagagcggcu

SEQ ID NO: 91328 - RNA, 64 nt, hsa
ccaggguuggcuggugggucacccagcagaggcuucuccccauagcacgaggauguguugccug

SEQ ID NO: 91329 - RNA, 64 nt, hsa
gaggcaaugugaccagucacagggacagaucacaucuccccagaguggcaacucuggugaaacc

SEQ ID NO: 91330 - RNA, 64 nt, hsa
uucuuccuccuccugaccuuauuuugcucuucacucuccccagccaauaaagcgucuguggcga

SEQ ID NO: 91331 - RNA, 64 nt, hsa
gcacacagaauacuauuaaugugcacccagcuggucuccccaggcaagaagguauccucuuccc

SEQ ID NO: 91332 - RNA, 64 nt, hsa
uagaucugcgguuuccccucuacccugccucccgucuccccagaaugggaauuucuuuuauguu

SEQ ID NO: 91333 - RNA, 64 nt, hsa
agcugauggugagcggcacagucccacuuccccaucuccccaaguaggugguguuagaaaaccu

SEQ ID NO: 91334 - RNA, 64 nt, hsa
aggaccagaauuuuuuaucuagagaccagcauguucuccccaaagaccaagauauucugccaaa

SEQ ID NO: 91335 - RNA, 64 nt, hsa
aggaccagaauuuuuugucuagagaccagcauguucuccccaaagaccagaauauucuaccuaa

SEQ ID NO: 91336 - RNA, 64 nt, hsa
aagaccaggacuuuuuaucuagagaccagcauguucuccccaaagacuggaauauucuacccaa

SEQ ID NO: 91337 - RNA, 64 nt, hsa
gcuccuuaaacccucuggggagcauacugugugcucuccccaucuccagccccucccucugggu

SEQ ID NO: 91338 - RNA, 64 nt, hsa
acugcuacagcugguccacagagaggagcacuugucuccccagggcugccauggcagcuaucag

SEQ ID NO: 91339 - RNA, 64 nt, hsa
gcaccaggcaauacccauccaucacccaucucacucuccccaguccucaggcagcagcuuuucc

SEQ ID NO: 91340 - RNA, 64 nt, hsa
uucucucuaugucuguuucacuuuuuggauugcaucuccccaaaaacuaaaugugaaaucccua

SEQ ID NO: 91341 - RNA, 64 nt, hsa
ccaugcuggcaucuguagcucgguggcuugacauucuccccagggacuucccgguuccuaguuc

SEQ ID NO: 91342 - RNA, 64 nt, hsa
ugggggaggugucagcugggccccuccugugcuaucuccccagaggacaucccugacuccaccc

SEQ ID NO: 91343 - RNA, 64 nt, hsa
aacaaaggcuggagaagggcccugaguuccagccucuccccaaggguccccgccccaguggcug

SEQ ID NO: 91344 - RNA, 64 nt, hsa
guagagguggggccccuuccaagagggacaggccucuccccagcgcgccuuccucccacguuuu

SEQ ID NO: 91345 - RNA, 64 nt, hsa
aaaaaugccuugcugauucacuaggaaauaaaaaucuccccaauuuuuugauagucaacuucga

SEQ ID NO: 91346 - RNA, 64 nt, hsa
agaagcagagcagaugauucgagcagcauuuguuucuccccacaucuagaaauuguaguucaua

SEQ ID NO: 91347 - RNA, 64 nt, hsa
cugcuccuccugguuucuguuuccccuuccucacucuccccaugcugacuuggcucuguaacag

SEQ ID NO: 91348 - RNA, 64 nt, hsa
cuccccuuggccucaccuucucuggcccuuaggaucuccccauuuggagacagagccauuugga

SEQ ID NO: 91349 - RNA, 64 nt, hsa
uucuggcaucuccccaguauggaagucccgguggucuccccaagaaguccccaagacaaucucg

SEQ ID NO: 91350 - RNA, 64 nt, hsa
uuggacgacuucugcucccuuuccaguucuggcaucuccccaguauggaagucccgguggucuc

SEQ ID NO: 91351 - RNA, 64 nt, hsa
acccucgggggcuuucggcucccacacugaugauucuccccagcauccacaccgggccuggcgc

SEQ ID NO: 91352 - RNA, 64 nt, hsa
gaaggcugcuggggugcgcaggugggcgcucgcgucuccccaccccagggcuccccccgugcug

SEQ ID NO: 91353 - RNA, 64 nt, hsa
ggcuggagaggcagacggugggacccaccagcucucuccccaucccgcuucuucccugggggcc

SEQ ID NO: 91354 - RNA, 54 nt, hsa
cccgagagaagaagcagugaccucucuccccacacccucaccugcacccuagga

SEQ ID NO: 91355 - RNA, 64 nt, hsa
uuaaaggggguuugucagaagcaagaacagccccucuccccagucacagccugaagggaggccc

SEQ ID NO: 91356 - RNA, 64 nt, hsa
aggccccccugggggggcugccuuccccucagccucuccccacaccacccacccagcugcuguc

SEQ ID NO: 91357 - RNA, 64 nt, hsa
ccagcaguguccuggggagaaggaaggcugagccucuccccagccuucaugccuuccccacccu

SEQ ID NO: 91358 - RNA, 64 nt, hsa
gagacuacugaccuucucaccuccacccauaccuucuccccacagccucugcugaugcacagag

SEQ ID NO: 91359 - RNA, 64 nt, hsa
cccacgcccgucucuuucucaccuuucccaccucucuccccaaagugauccuaagaauguacag

SEQ ID NO: 91360 - RNA, 64 nt, hsa
gagccucauccagccucagagaucucccuucucaucuccccacgcccgucucuuucucaccuuu

SEQ ID NO: 91361 - RNA, 64 nt, hsa
ccccccaucaccagagucuuaagggucacuggccucuccccaggaaguggcucagaccccucag

SEQ ID NO: 91362 - RNA, 64 nt, hsa
ccccccaccuccagggccuuagaaccaccgccccucuccccaccccaggcaccccucuuuuuac

SEQ ID NO: 91363 - RNA, 64 nt, hsa
agggcacuuacuaagggaggggucucccucuccaucuccccaguggccuccccgccuccaaccc

SEQ ID NO: 91364 - RNA, 64 nt, hsa
cugggauuacaggccugagccaccgcgcccagucucuccccacguucuugaacucgggcagcac

SEQ ID NO: 91365 - RNA, 64 nt, hsa
guuccaaguugcaacugaccuugaacugaaucacucuccccacguuauuuuuuaauuacuauuu

SEQ ID NO: 91366 - RNA, 64 nt, hsa
gggccgaccucaaguucaaggggcccagguuugcucuccccaaguuuggggucagaggccggga

SEQ ID NO: 91367 - RNA, 64 nt, hsa
ucccacugucccaccgccuccugccucucuccucucuccccagaacauccagagucuguccccu

SEQ ID NO: 91368 - RNA, 64 nt, hsa
aaucuccggagccaacaccaccacccccagggggucuccccaccccaccccauuuacaggguga

SEQ ID NO: 91369 - RNA, 64 nt, hsa
ccacgaugaacuugcucuuuuccuuugaugagccucuccccagguguauuucagcagaccccgg

SEQ ID NO: 91370 - RNA, 64 nt, hsa
ccagcccuuccuauuuccuuuccuauuuuuuuuuucuccccacacuuucuugggacucccaccu

SEQ ID NO: 91371 - RNA, 64 nt, hsa
ccacuggggcuccuacagagcuguggaauguaccucuccccaacacuguuuuguuagcgagcac

SEQ ID NO: 91372 - RNA, 64 nt, hsa
aacuucuacuuuuccucuuaaaggcacuuuacucucuccccacucuuuucuuccucuucaaagu

SEQ ID NO: 91373 - RNA, 64 nt, hsa
uuuuuccuugauuucuuuuuaaagguaccuuaucucuccccacuccuuucuucccuccucaauc

SEQ ID NO: 91374 - RNA, 64 nt, hsa
uaaucuguacuaugggugaaucuuuuucccuugcucuccccaggggcuguuucacaguauucug

SEQ ID NO: 91375 - RNA, 64 nt, hsa
uccccuagccuuccaaacccagguggccugcccuucuccccagagggaggcggccuccgcccau

SEQ ID NO: 91376 - RNA, 64 nt, hsa
guggcccccgaagaauggaacccacacccauagcucuccccacagcugauacggcauccugcga

SEQ ID NO: 91377 - RNA, 64 nt, hsa
aauaagccuugucguugacuuuagggacucaauuucuccccaggguggaugggggaaauggugc

SEQ ID NO: 91378 - RNA, 64 nt, hsa
acuuguuauuuguuuuuauuauuacuguuugucuucuccccaggguucaguccucaaggggcca

SEQ ID NO: 91379 - RNA, 64 nt, hsa
aaagcuccagguguuccaaacucauuaacuaaauucuccccagaaugcuuuuaaauuuuccagg

SEQ ID NO: 91380 - RNA, 64 nt, hsa
aaaauacuggagcaacaaugccccugcuuccauuucuccccaccucacucucaccaagucacca

SEQ ID NO: 91381 - RNA, 64 nt, hsa
uggacgggaaggagaacagaggagagggaaagagaagcccaaccucugugaucauaugagggcc

SEQ ID NO: 91382 - RNA, 64 nt, hsa
acagugguaguuagaggugaaaaguagagcugucaagcccaagggcuuagcuuuagggcuccuc

SEQ ID NO: 91383 - RNA, 64 nt, hsa
ggguuauaacccaaacuauauaauaaauauuuacaagcccaaacuaauauaaaugauugaaugg

SEQ ID NO: 91384 - RNA, 64 nt, hsa
uugaguuugcuaaugcuuccaacuuagucauuugaagcccaagagucuaauuuuauaugcccug

SEQ ID NO: 91385 - RNA, 64 nt, hsa
agguguuuuuaguacaagacaucaaagugaaguaaagcccaaguguucuuuagcuuuuuauaau

SEQ ID NO: 91386 - RNA, 64 nt, hsa
augugaggcgauuauuuuaaguaauuaucuuaccaagcccaagacugguuuuaaaguuaccuga

SEQ ID NO: 91387 - RNA, 64 nt, hsa
cuauaacauuuuuacaauaagauguacaauuuauuaccuauauggaaguggccaacagauauaa

SEQ ID NO: 91388 - RNA, 64 nt, hsa
uuauguagagaguuuauaugcacauaauaaccuguaccuauaaaucgugcaauaaccauaugcg

SEQ ID NO: 91389 - RNA, 64 nt, hsa
uauccaguauagcagugacuuugacugcuguuauuaccuauagcuaaguguguaugauaaugaa

SEQ ID NO: 91390 - RNA, 64 nt, hsa
aaauuuccacaagcauugcuucagaaugaauuuguaccuauaaagcauaaggcauuaaaugaca

SEQ ID NO: 91391 - RNA, 64 nt, hsa
uucuauauaggaccauuauguuuggaucauuaaauaccuauaugaauaugagaucugaagcacg

SEQ ID NO: 91392 - RNA, 64 nt, hsa
uucgaauuucaacacuagaaugacuaaaacuaucuaccuauagaacuaucuguagauaguauac

SEQ ID NO: 91393 - RNA, 64 nt, hsa
uaagaaauagaauuagggagaguuuacacuuacuuaccuauauaucagcagauuuuucuggaag

SEQ ID NO: 91394 - RNA, 64 nt, hsa
auaaauuguaaauaccuauaaaauaaauuauaaauaccuauaaaauauaaaguaacauagcucu

SEQ ID NO: 91395 - RNA, 64 nt, hsa
uuguagcuuuaucccaaucuggauaaauuguaaauaccuauaaaauaaauuauaaauaccuaua

SEQ ID NO: 91396 - RNA, 64 nt, hsa
aaauaccgcuguguuuguuucgccauggcuucagggaugcuacauggcucuugcaccuuuuacu

SEQ ID NO: 91397 - RNA, 64 nt, hsa
ugaaaagugagaguuacgcauugcagccaugaagggaugcuaggaucaauuauggcaguaccuu

SEQ ID NO: 91398 - RNA, 64 nt, hsa
uuguccacccugggacacuucugaguaugaagcgggaugcuauuaaaaacuacauggggaaaca

SEQ ID NO: 91399 - RNA, 64 nt, hsa
ugacaucccagaagcccagccccucaaccccucuggaugcuacauggggaugcuggacggcuca

SEQ ID NO: 91400 - RNA, 64 nt, hsa
acuaaccuugagaccugaggguuuccacagugggaaccccaauagggcuagggcucucagguag

SEQ ID NO: 91401 - RNA, 64 nt, hsa
ugcuucaguguuaagaguggggcaaugaagagugaaccccaaugaagagugaucccaacuuugg

SEQ ID NO: 91402 - RNA, 64 nt, hsa
cccucagcugagcagugaucacuuacucacucuuaaccccaauccgcugacuggguggggacag

SEQ ID NO: 91403 - RNA, 64 nt, hsa
cuaccaaacaacagaaacccacacucuagacugaaaccccaaagugggcuugauggguggguuu

SEQ ID NO: 91404 - RNA, 64 nt, hsa
cugggcuuuucugggaauugaaguaucucuccuuaaccccaauugucaaggguaguagcuguau

SEQ ID NO: 91405 - RNA, 64 nt, hsa
cauuuguaguuugccccaccugcccuaaauaagaaaccccaaauguagucucuuuucuuucugu

SEQ ID NO: 91406 - RNA, 64 nt, hsa
cuugguacccauucccauuucacaaacuccuccaaaccccaaaccccaaacggaaaucucuggg

SEQ ID NO: 91407 - RNA, 64 nt, hsa
cccauucccauuucacaaacuccuccaaaccccaaaccccaaacggaaaucucugggacaaugg

SEQ ID NO: 91408 - RNA, 64 nt, hsa
uaaguaaaaaaucauuuuuccuccucccuccccaaaccccaaggaacucucacucuugcucaag

SEQ ID NO: 91409 - RNA, 64 nt, hsa
gcgugauacucaacauuucaucguccaccuucccaaccccaaacaauuccaucucguuucuucu

SEQ ID NO: 91410 - RNA, 64 nt, hsa
aacuuuugguaagggaaaagggaacaggaaaagaaaccccaaacucaggccgaaugaucaaggg

SEQ ID NO: 91411 - RNA, 64 nt, hsa
ugauuuuuuuuuagaacagaaaacaacaaaaaauaaccccaaaaugaagauuauuuuuuaugag

SEQ ID NO: 91412 - RNA, 64 nt, hsa
cacgcugucucagaaaacgaaaacggaggaaaaaaaccccaaaccccaaacaaucuuaauaaac

SEQ ID NO: 91413 - RNA, 64 nt, hsa
ucucagaaaacgaaaacggaggaaaaaaaccccaaaccccaaacaaucuuaauaaacacgacug

SEQ ID NO: 91414 - RNA, 64 nt, hsa
ucugaggaucugacuugggucuuggaaggguuccaaccccaagucagucaggaagcugcccauu

SEQ ID NO: 91415 - RNA, 64 nt, hsa
aucgacaaggcgcauaauggagaguugguaucucaaccccaagcucccuuugcuguaccugggc

SEQ ID NO: 91416 - RNA, 64 nt, hsa
aaauugcaugagauuagcaaaauuauuaauuuaaaaccccaaaguaaauugcaaauuuuaaaau

SEQ ID NO: 91417 - RNA, 64 nt, hsa
uuuccaguauugguacaucuuggcuucuggcccaaaccccaagcagaaaagaaaauggaauaau

SEQ ID NO: 91418 - RNA, 64 nt, hsa
gcagaagagaugucagcaaagcaagugaugaagcagaguggauguccacugucaccaagcugga

SEQ ID NO: 91419 - RNA, 64 nt, hsa
ucugaccccacccugggccacugcccugcuccagagaguggaccuugacucuuccacaccugcc

SEQ ID NO: 91420 - RNA, 56 nt, hsa
uuuuauaggcagaaccuuagagaagaagaguggaagaugacggagaugcauuuuga

SEQ ID NO: 91421 - RNA, 64 nt, hsa
aacaaagcagcaguuuuagccaggguucaaugauagaguggagguaaauuaagagccuccaggc

SEQ ID NO: 91422 - RNA, 64 nt, hsa
cccuaccagcauccagguuccacuuuccuaggagagaguggagaugggaagacagggaaaggaa

SEQ ID NO: 91423 - RNA, 64 nt, hsa
cuggaguaccagcgcauaucaucucaugggguccagaguggaguccaggcuucucugaaaccag

SEQ ID NO: 91424 - RNA, 64 nt, hsa
aauaguuuauguucucagcagccagaguggaaacagaguggaaacacauggagcaucagguaga

SEQ ID NO: 91425 - RNA, 64 nt, hsa
gcagggcugggaauaguuuauguucucagcagccagaguggaaacagaguggaaacacauggag

SEQ ID NO: 91426 - RNA, 64 nt, hsa
cccacagcugauggucacuguuuuggcuggcuccagaguggacagguacgcucuguccacagca

SEQ ID NO: 91427 - RNA, 64 nt, hsa
ucugaccucccugcuugcauugggucugggagagagaguggaauauuugguagggaccuugaca

SEQ ID NO: 91428 - RNA, 64 nt, hsa
uacuccugugcucuggaggcugcagagcugacccagaguggagucugagucugaguccugucuc

SEQ ID NO: 91429 - RNA, 64 nt, hsa
ucucugagcagucagggugggaagaaagaaugcaagaguggacugaaugugccuaauggagaag

SEQ ID NO: 91430 - RNA, 64 nt, hsa
gagcuguccucgguguuaccgaggcugugccuagagaguggagauuuuugaugaaaggugugcu

SEQ ID NO: 91431 - RNA, 64 nt, hsa
agcuuacagugccaaugccguuuguguucuggccagaguggagugcgcagcccugacucccagg

SEQ ID NO: 91432 - RNA, 64 nt, hsa
cuguguuuuccaggaaauucauagagaagagaauagaguggaugaugugacuugaaguuuuugc

SEQ ID NO: 91433 - RNA, 64 nt, hsa
aguuggcgugcugugugcacuguggauuaggaacagaguggagcuguaaccagucucuucucug

SEQ ID NO: 91434 - RNA, 64 nt, hsa
guguuucaacucucuuuucauugcuguuuccagaagaguggagagugugguuucaggcaaggua

SEQ ID NO: 91435 - RNA, 64 nt, hsa
ugccuuugcugagugugugugugcugggagagucagaguggauguagagcgcgguuuuauuuuu

SEQ ID NO: 91436 - RNA, 64 nt, hsa
uccuuggcugucagagucaggguaacacacaccaagaguggagugcggccagcaaguuugagac

SEQ ID NO: 91437 - RNA, 62 nt, hsa
uccccgcccacccucugccuggucgcgcucuucagucccacgaggagcugacacguccucuc

SEQ ID NO: 91438 - RNA, 62 nt, hsa
gcuuucgaagacucugcugccauccguucucccagucccaaggguccacgauguacaaaguc

SEQ ID NO: 91439 - RNA, 62 nt, hsa
gaaauggauuguuggugcuuuggaauauguuacagucccacauuugauauuucuuauauacu

SEQ ID NO: 91440 - RNA, 62 nt, hsa
caugaauuugugaugucuuugcuguuuacaugcagucccaagaaauggauuguuggugcuuu

SEQ ID NO: 91441 - RNA, 62 nt, hsa
ggggcuggcgggcggcggcuuaccagcugggucagucccaucucgccccucugugccuaugc

SEQ ID NO: 91442 - RNA, 62 nt, hsa
cugaacgccuccgcaggcagauucauggagaccagucccaguagcaaccgccccuuccccaa

SEQ ID NO: 91443 - RNA, 62 nt, hsa
ccugugagcaccgagaagaacugggcgacucccagucccaccugugcugugacagucccacg

SEQ ID NO: 91444 - RNA, 62 nt, hsa
cugggcgacucccagucccaccugugcugugacagucccacguggcuaugacagacuguuua

SEQ ID NO: 91445 - RNA, 62 nt, hsa
gcagggcccaguccaggggccccaggccuccccagucccagugugcgagccccacuuggaca

SEQ ID NO: 91446 - RNA, 62 nt, hsa
aggacaugccucccaccaaauguccccugcuccagucccacuccugucaccccacgcucugc

SEQ ID NO: 91447 - RNA, 62 nt, hsa
ccucucucucccaggucccagccccuuuuccccagucccagacaauuccauucaaucuuugg

SEQ ID NO: 91448 - RNA, 62 nt, hsa
aggaaagguuuuccuuauuuugugugcuuucccagucccauuccucagcuucuucacaggca

SEQ ID NO: 91449 - RNA, 62 nt, hsa
cccagccgcuuggcgaugccagccaagcucugcagucccagcggugggaccuagggaggcau

SEQ ID NO: 91450 - RNA, 62 nt, hsa
aggcgagaagggcugcuucccugaagcucccacagucccaucugcuucaggcccccgccuug

SEQ ID NO: 91451 - RNA, 62 nt, hsa
acccuguccugcagucccacacugugcagacccagucccacacuguggccaggccuuacauc

SEQ ID NO: 91452 - RNA, 62 nt, hsa
ccuggcagggccaccugcaggacccuguccugcagucccacacugugcagacccagucccac

SEQ ID NO: 91453 - RNA, 62 nt, hsa
cccacucaugcuguuccugaggccgcccucuccagucccaggagccgugucuagaguuccug

SEQ ID NO: 91454 - RNA, 62 nt, hsa
accgugguggaggaagucacccagcuguuucucagucccagaggccgguggcugguuuugaa

SEQ ID NO: 91455 - RNA, 62 nt, hsa
acuucguaccugcucaggagcccccacugucccagucccacucaggcccaucucuggcuggc

SEQ ID NO: 91456 - RNA, 62 nt, hsa
cacggaagccaggaaucaaacugccuggguuccagucccagcucugccaguuaugcccagcu

SEQ ID NO: 91457 - RNA, 62 nt, hsa
gccauugagacuaguaacgggcguucugggcacagucccacugugcacagguuugagaggac

SEQ ID NO: 91458 - RNA, 62 nt, hsa
ggugguccccaacagugccuagggguacaguacagucccauuacacuagagcagggcucuau

SEQ ID NO: 91459 - RNA, 62 nt, hsa
gcacugcccuaggagcccggaccccacgagcucagucccagcucugccucugacucgcugug

SEQ ID NO: 91460 - RNA, 62 nt, hsa
ggccauggcuuuccugcaagaccacugacgagcagucccauggugauaaagggcagcccggc

SEQ ID NO: 91461 - RNA, 62 nt, hsa
ggguggagggcagucccucagaaucccagaggcagucccagccucagaacccaggauaggaa

SEQ ID NO: 91462 - RNA, 62 nt, hsa
ccaaccuccggggcgaccuucucuuccagccacagucccaugagggccccuagccagggaca

SEQ ID NO: 91463 - RNA, 62 nt, hsa
ccacccuccugcccugugcccagguguugggacagucccacccucccugcuauuuauauccc

SEQ ID NO: 91464 - RNA, 62 nt, hsa
cugccuccucugaggaaucuggcccugucugacagucccagaccccccguucucuccucuuu

SEQ ID NO: 91465 - RNA, 64 nt, hsa
auuaagggcugugaaaagaaaucuagucuaacuccaacagaaaucugucucuguuaaguguuuu

SEQ ID NO: 91466 - RNA, 64 nt, hsa
gaaauagaugucugcacuccuggcugcagcuggacaacagaagccccaugccgccuguccaguu

SEQ ID NO: 91467 - RNA, 64 nt, hsa
uguaagcccuaguaauggccaauuauuuguacagcaacagaaguaaauugaagauacuggcuaa

SEQ ID NO: 91468 - RNA, 64 nt, hsa
ggguuucuuuucuuuuugccucuaaugcagaaaucaacagaaucacucacacauacaaguacac

SEQ ID NO: 91469 - RNA, 64 nt, hsa
uagaacaaauuaccacaaacuggguggcuuuaaacaacagaaauuuauucucuuaacaguucca

SEQ ID NO: 91470 - RNA, 64 nt, hsa
uacuauauauguuacauacuaacauauauauacacaacagaaaguuuauuggauuuaguacuga

SEQ ID NO: 91471 - RNA, 64 nt, hsa
uuucacauacagcccucccccagcaguugaaugacaacagaagcuucagaaguuuggcaauagu

SEQ ID NO: 91472 - RNA, 64 nt, hsa
cacuacaugugguuuauagagggccaagacuuggcaacagaagcaguugagucgucaucacuuu

SEQ ID NO: 91473 - RNA, 64 nt, hsa
ggggcagggacuguguucagggaaaguaccugaccaacagaacuucaagucucuuccagagugc

SEQ ID NO: 91474 - RNA, 64 nt, hsa
uccucuuuguagaugauguauuuugcuugggcaccaacagaauuaaaaacgaaaaacaaaaaaa

SEQ ID NO: 91475 - RNA, 64 nt, hsa
guaucugagcagugauaccaaccacaucugaagucaacagaagauccaaguuuaaaauugccug

SEQ ID NO: 91476 - RNA, 64 nt, hsa
aaaaaaucacacuauauuaauauuuuauauuugccaacagaaacauggcagauagguaucaaua

SEQ ID NO: 91477 - RNA, 64 nt, hsa
gugguagccaucaagcacuucccaggaucugcuccaacagaauauugcuagguuuugcuacaug

SEQ ID NO: 91478 - RNA, 64 nt, hsa
ggaaagccucuguccgccuuuacaagggagaagacaacagaaagagggacaagaggguucacac

SEQ ID NO: 91479 - RNA, 64 nt, hsa
gaacucuagccaaaggcaagccccagaacucagacaacagaaaggaaauccuaauccuucuguu

SEQ ID NO: 91480 - RNA, 64 nt, hsa
ggaagaaaggcugagucuagguggagaaaaauaucaacagaacucuagccaaaggcaagcccca

SEQ ID NO: 91481 - RNA, 64 nt, hsa
uuucacuucgggacauuuaauaauggaccaaauucaacagaacaccaggaaggucaagacgcuc

SEQ ID NO: 91482 - RNA, 64 nt, hsa
uuccugauaaauaagaggugaugacauggauauacaacagaaaacacuuugaguugaaaguaaa

SEQ ID NO: 91483 - RNA, 64 nt, hsa
aauccaucagacagaggaaucaauaauaaaacugcaacagaacuaucaacuguauacuuauuug

SEQ ID NO: 91484 - RNA, 64 nt, hsa
guugaaauaagaaacaagaguauuacuuuuccuacaacagaaccuggugaaacuucagguauug

SEQ ID NO: 91485 - RNA, 64 nt, hsa
auugugauuuuuuuguaaaagaagcuguacgaaucaucauaaauaauuccaauagucugcacuu

SEQ ID NO: 91486 - RNA, 64 nt, hsa
uaacuacauuaggguuugcgggucugauggucgccaucauaacugcauacucaacucugccguu

SEQ ID NO: 91487 - RNA, 64 nt, hsa
aguaucuguugcauuaaggcacauagugggauuacaucauaaaccucccauaauuuuugucauu

SEQ ID NO: 91488 - RNA, 64 nt, hsa
uuuuuauuuuugucauguagaauacuacuguggucaucauaauguaaucuauuucuguaccuuu

SEQ ID NO: 91489 - RNA, 64 nt, hsa
gucauugaucccuggcucagaggauagcgguuuccaucauaaaccaagaugaugaguucagccu

SEQ ID NO: 91490 - RNA, 64 nt, hsa
ccuccuguucccugggucagaggauagcgguuuccaucauaaaccaagaugaugaguucagccu

SEQ ID NO: 91491 - RNA, 64 nt, hsa
cucagcuugaaauggggcugcaucccuauaaacccaucauaaagucaaaaaauccuaaaacaua

SEQ ID NO: 91492 - RNA, 64 nt, hsa
cucgauuuacauugugguuaauucccaauaaacccaucauaaguuaaaaaugcauauaacguua

SEQ ID NO: 91493 - RNA, 64 nt, hsa
ccaccaccuucaguaacaaggguacgauaugggggucugccaagcugugaggaccaguagccac

SEQ ID NO: 91494 - RNA, 64 nt, hsa
gcaggcccuuagggcaggaagggacgaugagcaagucugccacaccaccuggugacugggaagg

SEQ ID NO: 91495 - RNA, 64 nt, hsa
agugggagacggcagugcaauccugaugagugaugucugccaggcaccguaaguuugauuagug

SEQ ID NO: 91496 - RNA, 64 nt, hsa
augucugccaggcaccguaaguuugauuagugaugucugccacgggcagggauggaaggagcag

SEQ ID NO: 91497 - RNA, 64 nt, hsa
uuagcugagaagaauuaucuaaucaauuagugaugucugccauggaugcaguagaggaaagugg

SEQ ID NO: 91498 - RNA, 64 nt, hsa
cuagcaggagagcaugcccauauuggcuuacuuugucugccacagacacagacagagggaguug

SEQ ID NO: 91499 - RNA, 64 nt, hsa
ggcccugggccugccucaccacggaccaaagggagucugccagggccccucuccccagggaagc

SEQ ID NO: 91500 - RNA, 64 nt, hsa
uggcucuacuuccccauggcccugagcgaguggagucugccacccaggauccccaaggcacuug

SEQ ID NO: 91501 - RNA, 64 nt, hsa
aaugcaagcauaauaucuggaaaauuugcugccugccuucuacuucucaaaucuuucuuguaaa

SEQ ID NO: 91502 - RNA, 64 nt, hsa
uuaacuaacuagaucuauugaauuucagagaagagccuucuaacuuguuuacacaaaaacgagu

SEQ ID NO: 91503 - RNA, 64 nt, hsa
uuggaaaaugauuuuuuuuccaaaugauguuuuugccuucuaauauacuguaagguaaugagcu

SEQ ID NO: 91504 - RNA, 64 nt, hsa
ucuuguacauaacuauuucgauggcaaauguuaagccuucuaaaaggaaaguguagauuggaaa

SEQ ID NO: 91505 - RNA, 64 nt, hsa
uguauuguuccuuugugcucuaagcagcacacuugccuucuauuuauuuaaguguaaacauuuc

SEQ ID NO: 91506 - RNA, 64 nt, hsa
aguucauuuacaguucuaaauguaauguuuuuaagccuucuaucuuuuuaggacacaguuuguu

SEQ ID NO: 91507 - RNA, 64 nt, hsa
ggcccuguauucccccuggaaggaagggaaucaugccuucuauauacagacagauugccuucag

SEQ ID NO: 91508 - RNA, 64 nt, hsa
gcuuaccauuuucaccuuccuugccuaugcccuugccuucuaguuccaaauauuuuagccagcu

SEQ ID NO: 91509 - RNA, 64 nt, hsa; identical to SEQ ID NO: 88257

SEQ ID NO: 91510 - RNA, 64 nt, hsa; identical to SEQ ID NO: 88258

SEQ ID NO: 91511 - RNA, 64 nt, hsa; identical to SEQ ID NO: 88259

SEQ ID NO: 91512 - RNA, 64 nt, hsa; identical to SEQ ID NO: 88260

SEQ ID NO: 91513 - RNA, 64 nt, hsa; identical to SEQ ID NO: 88261

SEQ ID NO: 91514 - RNA, 64 nt, hsa; identical to SEQ ID NO: 88262

SEQ ID NO: 91515 - RNA, 64 nt, hsa; identical to SEQ ID NO: 88263

SEQ ID NO: 91516 - RNA, 64 nt, hsa; identical to SEQ ID NO: 88264

SEQ ID NO: 91517 - RNA, 64 nt, hsa; identical to SEQ ID NO: 88265

SEQ ID NO: 91518 - RNA, 64 nt, hsa; identical to SEQ ID NO: 88266

SEQ ID NO: 91519 - RNA, 64 nt, hsa; identical to SEQ ID NO: 88267

SEQ ID NO: 91520 - RNA, 64 nt, hsa; identical to SEQ ID NO: 88268

SEQ ID NO: 91521 - RNA, 64 nt, hsa; identical to SEQ ID NO: 88269

SEQ ID NO: 91522 - RNA, 64 nt, hsa; identical to SEQ ID NO: 88270

SEQ ID NO: 91523 - RNA, 64 nt, hsa; identical to SEQ ID NO: 88271

SEQ ID NO: 91524 - RNA, 64 nt, hsa; identical to SEQ ID NO: 88269

SEQ ID NO: 91525 - RNA, 64 nt, hsa; identical to SEQ ID NO: 88273

SEQ ID NO: 91526 - RNA, 64 nt, hsa; identical to SEQ ID NO: 88274

SEQ ID NO: 91527 - RNA, 64 nt, hsa; identical to SEQ ID NO: 88275

SEQ ID NO: 91528 - RNA, 64 nt, hsa; identical to SEQ ID NO: 88276

SEQ ID NO: 91529 - RNA, 64 nt, hsa; identical to SEQ ID NO: 88277

SEQ ID NO: 91530 - RNA, 64 nt, hsa; identical to SEQ ID NO: 88278

SEQ ID NO: 91531 - RNA, 64 nt, hsa; identical to SEQ ID NO: 88279

SEQ ID NO: 91532 - RNA, 64 nt, hsa; identical to SEQ ID NO: 88280

SEQ ID NO: 91533 - RNA, 64 nt, hsa; identical to SEQ ID NO: 88281

SEQ ID NO: 91534 - RNA, 64 nt, hsa; identical to SEQ ID NO: 88282

SEQ ID NO: 91535 - RNA, 64 nt, hsa; identical to SEQ ID NO: 88283

SEQ ID NO: 91536 - RNA, 64 nt, hsa; identical to SEQ ID NO: 88284

SEQ ID NO: 91537 - RNA, 64 nt, hsa; identical to SEQ ID NO: 88285

SEQ ID NO: 91538 - RNA, 64 nt, hsa; identical to SEQ ID NO: 88286

SEQ ID NO: 91539 - RNA, 64 nt, hsa; identical to SEQ ID NO: 88287

SEQ ID NO: 91540 - RNA, 64 nt, hsa; identical to SEQ ID NO: 88288

SEQ ID NO: 91541 - RNA, 64 nt, hsa; identical to SEQ ID NO: 88289

SEQ ID NO: 91542 - RNA, 64 nt, hsa; identical to SEQ ID NO: 88290

SEQ ID NO: 91543 - RNA, 64 nt, hsa; identical to SEQ ID NO: 88291

SEQ ID NO: 91544 - RNA, 64 nt, hsa; identical to SEQ ID NO: 88292

SEQ ID NO: 91545 - RNA, 64 nt, hsa; identical to SEQ ID NO: 88293

SEQ ID NO: 91546 - RNA, 64 nt, hsa; identical to SEQ ID NO: 88294

SEQ ID NO: 91547 - RNA, 64 nt, hsa; identical to SEQ ID NO: 88295

SEQ ID NO: 91548 - RNA, 64 nt, hsa; identical to SEQ ID NO: 88296

SEQ ID NO: 91549 - RNA, 64 nt, hsa; identical to SEQ ID NO: 88297

SEQ ID NO: 91550 - RNA, 64 nt, hsa; identical to SEQ ID NO: 88298

SEQ ID NO: 91551 - RNA, 64 nt, hsa; identical to SEQ ID NO: 88299

SEQ ID NO: 91552 - RNA, 64 nt, hsa; identical to SEQ ID NO: 88300

SEQ ID NO: 91553 - RNA, 64 nt, hsa; identical to SEQ ID NO: 88298

SEQ ID NO: 91554 - RNA, 64 nt, hsa; identical to SEQ ID NO: 88302

SEQ ID NO: 91555 - RNA, 64 nt, hsa; identical to SEQ ID NO: 88300

SEQ ID NO: 91556 - RNA, 64 nt, hsa; identical to SEQ ID NO: 88304

SEQ ID NO: 91557 - RNA, 64 nt, hsa; identical to SEQ ID NO: 88305

SEQ ID NO: 91558 - RNA, 64 nt, hsa; identical to SEQ ID NO: 88306

SEQ ID NO: 91559 - RNA, 64 nt, hsa; identical to SEQ ID NO: 88307

SEQ ID NO: 91560 - RNA, 64 nt, hsa; identical to SEQ ID NO: 88299

SEQ ID NO: 91561 - RNA, 64 nt, hsa; identical to SEQ ID NO: 88309

SEQ ID NO: 91562 - RNA, 64 nt, hsa; identical to SEQ ID NO: 88310

SEQ ID NO: 91563 - RNA, 64 nt, hsa; identical to SEQ ID NO: 88311

SEQ ID NO: 91564 - RNA, 64 nt, hsa; identical to SEQ ID NO: 88312

SEQ ID NO: 91565 - RNA, 64 nt, hsa; identical to SEQ ID NO: 88313

SEQ ID NO: 91566 - RNA, 64 nt, hsa; identical to SEQ ID NO: 88314

SEQ ID NO: 91567 - RNA, 64 nt, hsa; identical to SEQ ID NO: 88315

SEQ ID NO: 91568 - RNA, 64 nt, hsa; identical to SEQ ID NO: 88316

SEQ ID NO: 91569 - RNA, 64 nt, hsa; identical to SEQ ID NO: 88317

SEQ ID NO: 91570 - RNA, 64 nt, hsa; identical to SEQ ID NO: 88318

SEQ ID NO: 91571 - RNA, 64 nt, hsa; identical to SEQ ID NO: 88319

SEQ ID NO: 91572 - RNA, 64 nt, hsa; identical to SEQ ID NO: 88320

SEQ ID NO: 91573 - RNA, 64 nt, hsa; identical to SEQ ID NO: 88321

SEQ ID NO: 91574 - RNA, 64 nt, hsa; identical to SEQ ID NO: 88322

SEQ ID NO: 91575 - RNA, 64 nt, hsa; identical to SEQ ID NO: 88323

SEQ ID NO: 91576 - RNA, 64 nt, hsa; identical to SEQ ID NO: 88324

SEQ ID NO: 91577 - RNA, 64 nt, hsa; identical to SEQ ID NO: 88325

SEQ ID NO: 91578 - RNA, 64 nt, hsa; identical to SEQ ID NO: 88326

SEQ ID NO: 91579 - RNA, 64 nt, hsa; identical to SEQ ID NO: 88327

SEQ ID NO: 91580 - RNA, 64 nt, hsa; identical to SEQ ID NO: 88328

SEQ ID NO: 91581 - RNA, 64 nt, hsa; identical to SEQ ID NO: 88329

SEQ ID NO: 91582 - RNA, 64 nt, hsa; identical to SEQ ID NO: 88330

SEQ ID NO: 91583 - RNA, 64 nt, hsa
uucccggccucacgcacccugcccaccagccccucggaagcaugugacaacagcagaggguaca

SEQ ID NO: 91584 - RNA, 64 nt, hsa
caagcugauccugcugcaccacaagcacccagaacggaagcaggcaccacuaacuuaugaaaag

SEQ ID NO: 91585 - RNA, 64 nt, hsa; identical to SEQ ID NO: 58312

SEQ ID NO: 91586 - RNA, 64 nt, hsa; identical to SEQ ID NO: 58313

SEQ ID NO: 91587 - RNA, 64 nt, hsa; identical to SEQ ID NO: 58314

SEQ ID NO: 91588 - RNA, 64 nt, hsa; identical to SEQ ID NO: 58315

SEQ ID NO: 91589 - RNA, 64 nt, hsa; identical to SEQ ID NO: 58316

SEQ ID NO: 91590 - RNA, 64 nt, hsa; identical to SEQ ID NO: 58317

SEQ ID NO: 91591 - RNA, 64 nt, hsa; identical to SEQ ID NO: 58318

SEQ ID NO: 91592 - RNA, 64 nt, hsa; identical to SEQ ID NO: 58319

SEQ ID NO: 91593 - RNA, 64 nt, hsa; identical to SEQ ID NO: 58320

SEQ ID NO: 91594 - RNA, 64 nt, hsa; identical to SEQ ID NO: 58321

SEQ ID NO: 91595 - RNA, 64 nt, hsa; identical to SEQ ID NO: 58322

SEQ ID NO: 91596 - RNA, 64 nt, hsa; identical to SEQ ID NO: 58323

SEQ ID NO: 91597 - RNA, 64 nt, hsa; identical to SEQ ID NO: 58324

SEQ ID NO: 91598 - RNA, 64 nt, hsa; identical to SEQ ID NO: 58325

SEQ ID NO: 91599 - RNA, 64 nt, hsa; identical to SEQ ID NO: 58326

SEQ ID NO: 91600 - RNA, 64 nt, hsa; identical to SEQ ID NO: 58327

SEQ ID NO: 91601 - RNA, 64 nt, hsa; identical to SEQ ID NO: 58328

SEQ ID NO: 91602 - RNA, 64 nt, hsa; identical to SEQ ID NO: 58329

SEQ ID NO: 91603 - RNA, 64 nt, hsa; identical to SEQ ID NO: 58330

SEQ ID NO: 91604 - RNA, 64 nt, hsa; identical to SEQ ID NO: 58331

SEQ ID NO: 91605 - RNA, 64 nt, hsa; identical to SEQ ID NO: 58332

SEQ ID NO: 91606 - RNA, 64 nt, hsa; identical to SEQ ID NO: 58333

SEQ ID NO: 91607 - RNA, 64 nt, hsa; identical to SEQ ID NO: 58334

SEQ ID NO: 91608 - RNA, 64 nt, hsa; identical to SEQ ID NO: 58335

SEQ ID NO: 91609 - RNA, 64 nt, hsa; identical to SEQ ID NO: 58336

SEQ ID NO: 91610 - RNA, 64 nt, hsa; identical to SEQ ID NO: 58337

SEQ ID NO: 91611 - RNA, 64 nt, hsa; identical to SEQ ID NO: 58338

SEQ ID NO: 91612 - RNA, 64 nt, hsa; identical to SEQ ID NO: 58339

SEQ ID NO: 91613 - RNA, 64 nt, hsa; identical to SEQ ID NO: 58340

SEQ ID NO: 91614 - RNA, 64 nt, hsa; identical to SEQ ID NO: 58341

SEQ ID NO: 91615 - RNA, 64 nt, hsa; identical to SEQ ID NO: 58342

SEQ ID NO: 91616 - RNA, 64 nt, hsa; identical to SEQ ID NO: 58343

SEQ ID NO: 91617 - RNA, 64 nt, hsa; identical to SEQ ID NO: 58344

SEQ ID NO: 91618 - RNA, 64 nt, hsa; identical to SEQ ID NO: 58345

SEQ ID NO: 91619 - RNA, 64 nt, hsa; identical to SEQ ID NO: 58346

SEQ ID NO: 91620 - RNA, 64 nt, hsa; identical to SEQ ID NO: 58347

SEQ ID NO: 91621 - RNA, 64 nt, hsa; identical to SEQ ID NO: 58348

SEQ ID NO: 91622 - RNA, 64 nt, hsa; identical to SEQ ID NO: 58349

SEQ ID NO: 91623 - RNA, 64 nt, hsa; identical to SEQ ID NO: 58350

SEQ ID NO: 91624 - RNA, 64 nt, hsa; identical to SEQ ID NO: 58351

SEQ ID NO: 91625 - RNA, 64 nt, hsa; identical to SEQ ID NO: 58352

SEQ ID NO: 91626 - RNA, 64 nt, hsa; identical to SEQ ID NO: 58353

SEQ ID NO: 91627 - RNA, 64 nt, hsa; identical to SEQ ID NO: 58354

SEQ ID NO: 91628 - RNA, 64 nt, hsa; identical to SEQ ID NO: 58355

SEQ ID NO: 91629 - RNA, 64 nt, hsa; identical to SEQ ID NO: 58356

SEQ ID NO: 91630 - RNA, 64 nt, hsa; identical to SEQ ID NO: 58357

SEQ ID NO: 91631 - RNA, 64 nt, hsa; identical to SEQ ID NO: 58358

SEQ ID NO: 91632 - RNA, 64 nt, hsa; identical to SEQ ID NO: 58359

SEQ ID NO: 91633 - RNA, 64 nt, hsa; identical to SEQ ID NO: 58360

SEQ ID NO: 91634 - RNA, 64 nt, hsa; identical to SEQ ID NO: 58361

SEQ ID NO: 91635 - RNA, 64 nt, hsa; identical to SEQ ID NO: 58362

SEQ ID NO: 91636 - RNA, 64 nt, hsa; identical to SEQ ID NO: 58363

SEQ ID NO: 91637 - RNA, 64 nt, hsa; identical to SEQ ID NO: 58364

SEQ ID NO: 91638 - RNA, 64 nt, hsa; identical to SEQ ID NO: 58365

SEQ ID NO: 91639 - RNA, 64 nt, hsa; identical to SEQ ID NO: 58366

SEQ ID NO: 91640 - RNA, 64 nt, hsa; identical to SEQ ID NO: 58367

SEQ ID NO: 91641 - RNA, 64 nt, hsa; identical to SEQ ID NO: 58368

SEQ ID NO: 91642 - RNA, 64 nt, hsa; identical to SEQ ID NO: 58369

SEQ ID NO: 91643 - RNA, 64 nt, hsa; identical to SEQ ID NO: 58370

SEQ ID NO: 91644 - RNA, 64 nt, hsa; identical to SEQ ID NO: 58371

SEQ ID NO: 91645 - RNA, 64 nt, hsa; identical to SEQ ID NO: 58372

SEQ ID NO: 91646 - RNA, 64 nt, hsa; identical to SEQ ID NO: 58373

SEQ ID NO: 91647 - RNA, 64 nt, hsa; identical to SEQ ID NO: 58374

SEQ ID NO: 91648 - RNA, 64 nt, hsa; identical to SEQ ID NO: 58375

SEQ ID NO: 91649 - RNA, 64 nt, hsa; identical to SEQ ID NO: 58376

SEQ ID NO: 91650 - RNA, 64 nt, hsa; identical to SEQ ID NO: 58377

SEQ ID NO: 91651 - RNA, 64 nt, hsa; identical to SEQ ID NO: 58378

SEQ ID NO: 91652 - RNA, 64 nt, hsa; identical to SEQ ID NO: 58379

SEQ ID NO: 91653 - RNA, 64 nt, hsa; identical to SEQ ID NO: 58380

SEQ ID NO: 91654 - RNA, 64 nt, hsa; identical to SEQ ID NO: 58381

SEQ ID NO: 91655 - RNA, 64 nt, hsa; identical to SEQ ID NO: 58382

SEQ ID NO: 91656 - RNA, 64 nt, hsa; identical to SEQ ID NO: 58383

SEQ ID NO: 91657 - RNA, 64 nt, hsa; identical to SEQ ID NO: 58384

SEQ ID NO: 91658 - RNA, 64 nt, hsa; identical to SEQ ID NO: 58385

SEQ ID NO: 91659 - RNA, 64 nt, hsa; identical to SEQ ID NO: 58386

SEQ ID NO: 91660 - RNA, 64 nt, hsa; identical to SEQ ID NO: 58387

SEQ ID NO: 91661 - RNA, 64 nt, hsa; identical to SEQ ID NO: 58388

SEQ ID NO: 91662 - RNA, 64 nt, hsa; identical to SEQ ID NO: 58389

SEQ ID NO: 91663 - RNA, 64 nt, hsa; identical to SEQ ID NO: 58390

SEQ ID NO: 91664 - RNA, 64 nt, hsa; identical to SEQ ID NO: 58391

SEQ ID NO: 91665 - RNA, 64 nt, hsa; identical to SEQ ID NO: 58392

SEQ ID NO: 91666 - RNA, 64 nt, hsa; identical to SEQ ID NO: 58393

SEQ ID NO: 91667 - RNA, 64 nt, hsa; identical to SEQ ID NO: 58394

SEQ ID NO: 91668 - RNA, 64 nt, hsa; identical to SEQ ID NO: 58395

SEQ ID NO: 91669 - RNA, 64 nt, hsa; identical to SEQ ID NO: 58396

SEQ ID NO: 91670 - RNA, 64 nt, hsa; identical to SEQ ID NO: 58397

SEQ ID NO: 91671 - RNA, 64 nt, hsa; identical to SEQ ID NO: 58398

SEQ ID NO: 91672 - RNA, 64 nt, hsa; identical to SEQ ID NO: 58399

SEQ ID NO: 91673 - RNA, 64 nt, hsa; identical to SEQ ID NO: 58400

SEQ ID NO: 91674 - RNA, 64 nt, hsa; identical to SEQ ID NO: 58401

SEQ ID NO: 91675 - RNA, 64 nt, hsa; identical to SEQ ID NO: 58402

SEQ ID NO: 91676 - RNA, 64 nt, hsa; identical to SEQ ID NO: 58403

SEQ ID NO: 91677 - RNA, 64 nt, hsa; identical to SEQ ID NO: 58404

SEQ ID NO: 91678 - RNA, 64 nt, hsa; identical to SEQ ID NO: 58405

SEQ ID NO: 91679 - RNA, 64 nt, hsa; identical to SEQ ID NO: 58406

SEQ ID NO: 91680 - RNA, 64 nt, hsa; identical to SEQ ID NO: 58407

SEQ ID NO: 91681 - RNA, 64 nt, hsa; identical to SEQ ID NO: 58408

SEQ ID NO: 91682 - RNA, 64 nt, hsa; identical to SEQ ID NO: 58409

SEQ ID NO: 91683 - RNA, 64 nt, hsa; identical to SEQ ID NO: 58410

SEQ ID NO: 91684 - RNA, 64 nt, hsa; identical to SEQ ID NO: 58411

SEQ ID NO: 91685 - RNA, 64 nt, hsa; identical to SEQ ID NO: 58412

SEQ ID NO: 91686 - RNA, 64 nt, hsa; identical to SEQ ID NO: 58413

SEQ ID NO: 91687 - RNA, 64 nt, hsa; identical to SEQ ID NO: 58414

SEQ ID NO: 91688 - RNA, 64 nt, hsa; identical to SEQ ID NO: 58415

SEQ ID NO: 91689 - RNA, 64 nt, hsa; identical to SEQ ID NO: 58416

SEQ ID NO: 91690 - RNA, 64 nt, hsa; identical to SEQ ID NO: 58417

SEQ ID NO: 91691 - RNA, 64 nt, hsa; identical to SEQ ID NO: 58418

SEQ ID NO: 91692 - RNA, 64 nt, hsa; identical to SEQ ID NO: 58419

SEQ ID NO: 91693 - RNA, 64 nt, hsa; identical to SEQ ID NO: 58420

SEQ ID NO: 91694 - RNA, 64 nt, hsa; identical to SEQ ID NO: 58421

SEQ ID NO: 91695 - RNA, 64 nt, hsa; identical to SEQ ID NO: 58422

SEQ ID NO: 91696 - RNA, 64 nt, hsa; identical to SEQ ID NO: 58423

SEQ ID NO: 91697 - RNA, 64 nt, hsa; identical to SEQ ID NO: 58424

SEQ ID NO: 91698 - RNA, 64 nt, hsa; identical to SEQ ID NO: 58425

SEQ ID NO: 91699 - RNA, 64 nt, hsa; identical to SEQ ID NO: 58426

SEQ ID NO: 91700 - RNA, 64 nt, hsa; identical to SEQ ID NO: 58427

SEQ ID NO: 91701 - RNA, 64 nt, hsa; identical to SEQ ID NO: 58428

SEQ ID NO: 91702 - RNA, 64 nt, hsa; identical to SEQ ID NO: 58429

SEQ ID NO: 91703 - RNA, 64 nt, hsa; identical to SEQ ID NO: 58430

SEQ ID NO: 91704 - RNA, 64 nt, hsa; identical to SEQ ID NO: 58431

SEQ ID NO: 91705 - RNA, 64 nt, hsa; identical to SEQ ID NO: 58432

SEQ ID NO: 91706 - RNA, 64 nt, hsa; identical to SEQ ID NO: 58433

SEQ ID NO: 91707 - RNA, 64 nt, hsa; identical to SEQ ID NO: 58434

SEQ ID NO: 91708 - RNA, 64 nt, hsa; identical to SEQ ID NO: 58435

SEQ ID NO: 91709 - RNA, 50 nt, hsa; identical to SEQ ID NO: 58436

SEQ ID NO: 91710 - RNA, 64 nt, hsa; identical to SEQ ID NO: 58437

SEQ ID NO: 91711 - RNA, 64 nt, hsa; identical to SEQ ID NO: 58438

SEQ ID NO: 91712 - RNA, 64 nt, hsa; identical to SEQ ID NO: 58439

SEQ ID NO: 91713 - RNA, 64 nt, hsa; identical to SEQ ID NO: 58440

SEQ ID NO: 91714 - RNA, 64 nt, hsa; identical to SEQ ID NO: 58441

SEQ ID NO: 91715 - RNA, 64 nt, hsa; identical to SEQ ID NO: 58442

SEQ ID NO: 91716 - RNA, 64 nt, hsa; identical to SEQ ID NO: 58443

SEQ ID NO: 91717 - RNA, 64 nt, hsa; identical to SEQ ID NO: 58444

SEQ ID NO: 91718 - RNA, 64 nt, hsa; identical to SEQ ID NO: 58445

SEQ ID NO: 91719 - RNA, 64 nt, hsa; identical to SEQ ID NO: 58446

SEQ ID NO: 91720 - RNA, 64 nt, hsa; identical to SEQ ID NO: 58447

SEQ ID NO: 91721 - RNA, 64 nt, hsa; identical to SEQ ID NO: 58448

SEQ ID NO: 91722 - RNA, 64 nt, hsa; identical to SEQ ID NO: 58449

SEQ ID NO: 91723 - RNA, 64 nt, hsa; identical to SEQ ID NO: 58450

SEQ ID NO: 91724 - RNA, 64 nt, hsa; identical to SEQ ID NO: 58451

SEQ ID NO: 91725 - RNA, 64 nt, hsa; identical to SEQ ID NO: 58452

SEQ ID NO: 91726 - RNA, 64 nt, hsa; identical to SEQ ID NO: 58453

SEQ ID NO: 91727 - RNA, 64 nt, hsa; identical to SEQ ID NO: 58454

SEQ ID NO: 91728 - RNA, 64 nt, hsa; identical to SEQ ID NO: 58455

SEQ ID NO: 91729 - RNA, 64 nt, hsa; identical to SEQ ID NO: 58456

SEQ ID NO: 91730 - RNA, 64 nt, hsa; identical to SEQ ID NO: 58457

SEQ ID NO: 91731 - RNA, 64 nt, hsa; identical to SEQ ID NO: 58458

SEQ ID NO: 91732 - RNA, 64 nt, hsa; identical to SEQ ID NO: 58459

SEQ ID NO: 91733 - RNA, 64 nt, hsa; identical to SEQ ID NO: 58460

SEQ ID NO: 91734 - RNA, 64 nt, hsa; identical to SEQ ID NO: 58461

SEQ ID NO: 91735 - RNA, 64 nt, hsa; identical to SEQ ID NO: 58462

SEQ ID NO: 91736 - RNA, 64 nt, hsa; identical to SEQ ID NO: 58463

SEQ ID NO: 91737 - RNA, 64 nt, hsa; identical to SEQ ID NO: 58464

SEQ ID NO: 91738 - RNA, 64 nt, hsa; identical to SEQ ID NO: 58465

SEQ ID NO: 91739 - RNA, 64 nt, hsa; identical to SEQ ID NO: 58466

SEQ ID NO: 91740 - RNA, 64 nt, hsa; identical to SEQ ID NO: 58467

SEQ ID NO: 91741 - RNA, 64 nt, hsa
aagcgacaggaggccagcuccugggguuccugggagccgggaacagauuggcuacggaacgccc

SEQ ID NO: 91742 - RNA, 64 nt, hsa
ucccugcccuugccguggguccggcguuccucccagccgggaucacagugggcagccggcaccc

SEQ ID NO: 91743 - RNA, 64 nt, hsa
cuggggcccugcagugcgcucuaggcugugcgugagccgggacuguacccacagcuugcugagg

SEQ ID NO: 91744 - RNA, 64 nt, hsa
agggcugcucuucuugggccagggaaagcagggcagccgggaccugcggcugugccuggacuga

SEQ ID NO: 91745 - RNA, 64 nt, hsa
cagagguggccugggaccgccaguugcacgccugccaccucagccagcccccgcccagcucauc

SEQ ID NO: 91746 - RNA, 64 nt, hsa
agccucgccuuucuacccaggcccccugcccugcccaccucaggcccccacccuccacuccucc

SEQ ID NO: 91747 - RNA, 64 nt, hsa
ugcagccucgaccucccaggcucaagugauccucccaccucagccuccagaguagcuaggacua

SEQ ID NO: 91748 - RNA, 64 nt, hsa
gcuggucucaaacuccuggguucaagccauccucccaccucagccucccaaaaugcugggauua

SEQ ID NO: 91749 - RNA, 64 nt, hsa
uguagucucgaccucccaggcucaagcuguccucccaccucagccucccaaguagcugagacua

SEQ ID NO: 91750 - RNA, 64 nt, hsa
gcuggucucaaacuccugggcucaagcgauccucccaccucagcuucucaaaguucugggacua

SEQ ID NO: 91751 - RNA, 64 nt, hsa
aaaagccuugaccuccugggcucaggugauccucccaccucagccuccugaguagcuaggacua

SEQ ID NO: 91752 - RNA, 64 nt, hsa
ugcagccucugccuccugggcucaaacaguccucccaccucagccuucugaguagcugagacua

SEQ ID NO: 91753 - RNA, 64 nt, hsa
uucugccucccucaugcucgcagccacucugugcccaccucaucuucguagggaccuugauuuu

SEQ ID NO: 91754 - RNA, 64 nt, hsa
accaaacaugacuguucuuuccguguaagcuaucccaccucagcggcacccucacugcugguga

SEQ ID NO: 91755 - RNA, 64 nt, hsa
gagauuucaguuucccagggcuuaaccagaaccgccaccucaaugcauugucaguaggauacau

SEQ ID NO: 91756 - RNA, 64 nt, hsa
gagauuucaguuucccagggcuuaaccagaaccgccaccucaaugcauugucaguagaauacau

SEQ ID NO: 91757 - RNA, 64 nt, hsa
ugcagcuuugaccucccagacccaagugauccucccaccucagccucccucagagcugggacua

SEQ ID NO: 91758 - RNA, 64 nt, hsa
gcugaucucgagcuccugggcucaagugauccucccaccucagccucccaaagugcugggauua

SEQ ID NO: 91759 - RNA, 64 nt, hsa
cagggaacuucugagaaguuaucugcagagagccccaccucacucccuuuggcuacccuggccg

SEQ ID NO: 91760 - RNA, 64 nt, hsa
gugucacugaucacaggugucaccguaguggcuaccaccucagggcagccccucccuccagcug

SEQ ID NO: 91761 - RNA, 64 nt, hsa
uaaauaugugaaauuuuaucccugugcccuuuccccaccucaggcccuaccccuggacccuccc

SEQ ID NO: 91762 - RNA, 64 nt, hsa
uccccccccgccccucugcuucccuccccacccaccaccucaaggguagggaguugcucuuccu

SEQ ID NO: 91763 - RNA, 64 nt, hsa
ugcaaccuccaccucccagacucaagccauccucccaccucaaccucccaaguagcugggacua

SEQ ID NO: 91764 - RNA, 64 nt, hsa
cucuuuacagccucucucugugacuggaaucucuccaccucaucguaucuaaggauaacccaga

SEQ ID NO: 91765 - RNA, 64 nt, hsa
ccugcuugcugcugcuuuacuacauuccagaugcccaccucauccaauuuccagagccacuauc

SEQ ID NO: 91766 - RNA, 64 nt, hsa
ugcagccucgaccuccccagcucaagcaauccucccaccucagccuccuaaguaccugguacua

SEQ ID NO: 91767 - RNA, 64 nt, hsa
gcuggucuugaacuccugaacucaagugauccgcccaccucagccucccaaaguguugggauua

SEQ ID NO: 91768 - RNA, 64 nt, hsa
gguggucucgaauuccuggacucaagcagucugcccaccucagacucccaaagcgguggaauua

SEQ ID NO: 91769 - RNA, 64 nt, hsa
uauagccuugaccucucaggcucaagcgauucucccaccucagccauccaaauagcugggacca

SEQ ID NO: 91770 - RNA, 64 nt, hsa
cccggcacuccagccuggcgacaagagugagacuccaccucaaaaaaaaaaaaaagaauccaau

SEQ ID NO: 91771 - RNA, 64 nt, hsa
uuuuuuuuaacccuccugggcccaagugauccuuccaccucagucucccagcuaauugagacca

SEQ ID NO: 91772 - RNA, 64 nt, hsa
aggcccggcccggcgaguggucaagggacagggaccaccucaccgggcaaauggggucgggggg

SEQ ID NO: 91773 - RNA, 64 nt, hsa
ggcccugcuggucccugucgccccauccccgaccccaccucacucuuucgugaauguucuccac

SEQ ID NO: 91774 - RNA, 64 nt, hsa
gcaguggugugaucucggcucacuucagccuccgccaccucaaggcaguucaagcaauucuccu

SEQ ID NO: 91775 - RNA, 64 nt, hsa
ucauagcucacugcagccugaaacuccuuggcuuccaccucagccucccaaagcauuaggauua

SEQ ID NO: 91776 - RNA, 64 nt, hsa
gcagccucaacugccccagguuuaagcaauccucccaccucagcccccagguaacugggacuac

SEQ ID NO: 91777 - RNA, 64 nt, hsa
gcuagucuugaacuccugaccucaaaugacccacccaccucagccucccaaagugcugagauua

SEQ ID NO: 91778 - RNA, 64 nt, hsa
ccuggucucaaacuccuguccucaagugauccucccaccucagccuuucaaagugcuggaauua

SEQ ID NO: 91779 - RNA, 64 nt, hsa
ugcaagcuccgccuccuggguucacgccauucucccaccucagcuucccaagcagcugggacua

SEQ ID NO: 91780 - RNA, 64 nt, hsa
uuugggguucucugcuugaaugucuucuccuuuaccaccucaccuuguugguaccucccucccu

SEQ ID NO: 91781 - RNA, 64 nt, hsa
ugggucugucugaggaaggagggggucccgccuuccaccucaacacaucccuucagugacucag

SEQ ID NO: 91782 - RNA, 64 nt, hsa
cuggucucuuaacuccuaggcucaagugauccucccaccucagccucccaaagugcuuggauga

SEQ ID NO: 91783 - RNA, 64 nt, hsa
ugccgcuucaaucuccugggcucaaaugauccuuccaccucagccucccauguggcugggacua

SEQ ID NO: 91784 - RNA, 64 nt, hsa
gcuggucucaaacucuugaccucaggugauccacccaccucagccucccaaagugcugggauua

SEQ ID NO: 91785 - RNA, 64 nt, hsa
cugcagccucaaccuccugggcuaagugauccucccaccucagccucccgaauagcugggacua

SEQ ID NO: 91786 - RNA, 64 nt, hsa
uauucucaaccuccugggcucaaaugaucuccucccaccucagccucccaaguagcugagacua

SEQ ID NO: 91787 - RNA, 64 nt, hsa
gcuggucucaaacuccuggccucaagcaauccucccaccucagccuccuaaagcacugggauua

SEQ ID NO: 91788 - RNA, 64 nt, hsa
ucguggccuacgggcagagggaccccagcgccuaccaccucaacagacaccuccagcacagcuu

SEQ ID NO: 91789 - RNA, 64 nt, hsa
cucucaccgcugccauugagaagaugaaaaccacccaccucaaggaacagaaagcauuugcccu

SEQ ID NO: 91790 - RNA, 64 nt, hsa
uggcuucugucuguagagccgcauggcacucuucccaccucagugcccacagccaagguagggu

SEQ ID NO: 91791 - RNA, 64 nt, hsa
agaugcacgaugcuggggucaaagacuuguguccccaccucaggcugccaggauggcgugugug

SEQ ID NO: 91792 - RNA, 64 nt, hsa
ugcagccuugaacucccagacucaagugauccuuccaccucagccucuggaguagcugggacua

SEQ ID NO: 91793 - RNA, 64 nt, hsa
gcuggucucaaacuccugcccucaggugauccacccaccucagccucucaaagugcugggauua

SEQ ID NO: 91794 - RNA, 64 nt, hsa
uuucucaucucauuggcccccaccccagagaccuccaccucaacuucuggcugucccuacccug

SEQ ID NO: 91795 - RNA, 64 nt, hsa
ccccucuaguuucaugggcgagcacccccaucugccaccucagacugacacacagccagcuggc

SEQ ID NO: 91796 - RNA, 64 nt, hsa
gcuggucucgaauuccuggauucaagugauccucccaccucagccuccuaaaguccuaggauua

SEQ ID NO: 91797 - RNA, 64 nt, hsa
ugcaaccucugccuccugagcucaagugauccucccaccucagccucccaagggugugugugac

SEQ ID NO: 91798 - RNA, 64 nt, hsa
caaugccacagaccccugagcgccagacccugccccaccucacuucccucccuucccgcugagc

SEQ ID NO: 91799 - RNA, 64 nt, hsa
gaggauuguaauucccaccccucuugcuucuuccccaccucaccaucucccagacccucuuccc

SEQ ID NO: 91800 - RNA, 64 nt, hsa
cgguuugaauguugguuccaugccuggcccagccccaccucagucuccaggacauuccuuuccc

SEQ ID NO: 91801 - RNA, 54 nt, hsa
aggggagggccaaggcaugaggggccaccucauccagggccccucccuugccug

SEQ ID NO: 91802 - RNA, 64 nt, hsa
uuagauggaagcauuuccuauccagugugaauaaaaagaacaguuguaguaaauuauuauaaag

SEQ ID NO: 91803 - RNA, 64 nt, hsa
ccaaacacuaugucagauggggguaaaauccauuaaagaacaggaaaaaauaauuauaagauga

SEQ ID NO: 91804 - RNA, 64 nt, hsa
aagugugcuaacaucgaauauagagaaaacugguaaagaacauuccaguaggaaaagaaaagaa

SEQ ID NO: 91805 - RNA, 64 nt, hsa
gaaaacugguaaagaacauuccaguaggaaaagaaaagaacaaucuuccauuucugggcuuggc

SEQ ID NO: 91806 - RNA, 64 nt, hsa
gcauccaaauaggagucuucugccucuuaacuuaaaagaacauaggaauuuuguuuuugguuuc

SEQ ID NO: 91807 - RNA, 64 nt, hsa
auaacaccaucuggagucuuccuguaguggcaaaaaagaacaguguugaaauuggaaaggacuu

SEQ ID NO: 91808 - RNA, 64 nt, hsa
auugauauuugugcugaggugauauuccugucuaaaagaacaacauugucuuucuuuucuagca

SEQ ID NO: 91809 - RNA, 64 nt, hsa
ucagucauuguuaguucuugucuaguuuucauuaaaagaacaaagaucuuuuauauggauaucu

SEQ ID NO: 91810 - RNA, 64 nt, hsa
agguugucuaaguguuuuuauguaaaaccaacaaaaagaacaaaucagcuuauauuuuuuaucu

SEQ ID NO: 91811 - RNA, 64 nt, hsa
gcgcccggccuuaaauguuuuuuuuaaucaucaaaaagaacaacauaucucagguugucuaagu

SEQ ID NO: 91812 - RNA, 64 nt, hsa
ggaaaaaaaucucugcucauuaauauuucaagauaaagaacaaauguuuccuugaaugcuugcu

SEQ ID NO: 91813 - RNA, 64 nt, hsa
aucaaugagaaucuguucaccaaaccaaauguggaaagaacacaaagaagacauaagacuucag

SEQ ID NO: 91814 - RNA, 64 nt, hsa
cucucacuagaguuaccauucauauuugagaagaaaagaacauuuaauaaauguaugugugggg

SEQ ID NO: 91815 - RNA, 64 nt, hsa
aaccuauggcaguugguugaauaauuauugaaaaaaagaacacgacugaaaaaguucaucugau

SEQ ID NO: 91816 - RNA, 64 nt, hsa
uuuuuuuuuuuuuaaguaacacuaaagaagcuguaaagaacauugaagguggucauuccuucaa

SEQ ID NO: 91817 - RNA, 64 nt, hsa
gggauuacaggcgugagccacugcgcccggccaaaaagaacauuuugucaaucugaacagagca

SEQ ID NO: 91818 - RNA, 64 nt, hsa
auaaaagcuuucuguaguugcuuccuuuaucagaaaagaacauuugauaccaugguauaucauu

SEQ ID NO: 91819 - RNA, 64 nt, hsa
auuugauaccaugguauaucauuuccucuucauuaaagaacagcuuuucuaaauguugggggaa

SEQ ID NO: 91820 - RNA, 64 nt, hsa
uauuuuuacuuuuuuauuauaauuuugauauuaaaaagaacagagauggggucuugcuuuguug

SEQ ID NO: 91821 - RNA, 64 nt, hsa
cauuuuuguauuuuaauagucuacaggcuauauaaaagaacauggcuuuuugacugauaaaagu

SEQ ID NO: 91822 - RNA, 64 nt, hsa
cccgcugcuccugccccuuggagcccagugacagaaagaacagccucugucaccccgccgccac

SEQ ID NO: 91823 - RNA, 64 nt, hsa
aaaagaaaagcuagaauuuauuuauucagacuuuaaagaacaauuucucauugauguugugaaa

SEQ ID NO: 91824 - RNA, 64 nt, hsa
uauucaagccuguugucuuaacauuuuguauaaaaaagaacaacagaaauuaucugucauuuga

SEQ ID NO: 91825 - RNA, 64 nt, hsa
aagaaucuaaaagauaacagauuauuugcuuaugaaagaacaauauagucugggaaucccagaa

SEQ ID NO: 91826 - RNA, 64 nt, hsa
accugggucaacucuuuuaauuuauauacaaagcaaagaacaacauuaauggagaugcacaaug

SEQ ID NO: 91827 - RNA, 64 nt, hsa
gaagauuuuuuucuauuuaaaaccccauuuuccuaaagaacaaaguaguaaaauaaaaaaaaau

SEQ ID NO: 91828 - RNA, 64 nt, hsa
aaugaacauguuuauugcagauucuucuuuuuugaaagaacaacagcaaaacauccacaacucu

SEQ ID NO: 91829 - RNA, 64 nt, hsa
uuuaucuauugucaguauuuuauguugaauauguaaagaacauuaaaguccuaaaacaucuaag

SEQ ID NO: 91830 - RNA, 64 nt, hsa
agucccugaugcaguauguuuauuugugauguuuaaagaacauuucuuggcugggcgcugcggc

SEQ ID NO: 91831 - RNA, 64 nt, hsa
auaaauagaaagagagagagaggaaaaaaaaagaaaagaacacuucuuuauuugagggacuuuc

SEQ ID NO: 91832 - RNA, 64 nt, hsa
acgacuuuucauggauauugagagagaacaaguuaaagaacaacaaaggcaaaaagaacaaaag

SEQ ID NO: 91833 - RNA, 64 nt, hsa
ugagagagaacaaguuaaagaacaacaaaggcaaaaagaacaaaagaagaaaauugaaaaguaa

SEQ ID NO: 91834 - RNA, 64 nt, hsa
aaauuuauaccuauuuguguauuaagcacaagauaaagaacagcuguuaauauuuuuuaaaaau

SEQ ID NO: 91835 - RNA, 64 nt, hsa
agguggcaguuuauuucucaaaccagucauuuucaaagaacaggugccuaaauuauaaauuggu

SEQ ID NO: 91836 - RNA, 64 nt, hsa
auaauguuuuacuaugauuuagggcuuuuuuuucaaagaacaaaaauuauaagcauaaaaacuc

SEQ ID NO: 91837 - RNA, 64 nt, hsa
uaaagugcucauugcuucuucaauauccuuuuuuaaagaacagaauuuauguauuguaugacag

SEQ ID NO: 91838 - RNA, 64 nt, hsa
ucuuguaaaguuucuuaacuguuuuuuugaggagaaagaacagauuuauuuauagacuuaacuu

SEQ ID NO: 91839 - RNA, 64 nt, hsa
auaaaaacccaaaguuccuuauuuugaaauugucaaagaacaaagcgguguuuuucuuuuaaac

SEQ ID NO: 91840 - RNA, 64 nt, hsa
agaguacacaaguauaguggcccaggauguagugaaagaacaaauccuagagucuuugaaauuu

SEQ ID NO: 91841 - RNA, 64 nt, hsa
uaaugucaagucuacaucgacugguaaaacauucaaagaacaaacugacaaugauguucuaccu

SEQ ID NO: 91842 - RNA, 64 nt, hsa
cuccugugaucuaugcaggaccucuguacuuucuaaagaacaaaauguuauguagacauuauac

SEQ ID NO: 91843 - RNA, 64 nt, hsa
cuugagauauuccaaaguuuuauuuuacuuuuuuaaagaacagaaaaagaugaaugaaagaacc

SEQ ID NO: 91844 - RNA, 64 nt, hsa
ggacuucuuucagagagcuuuauacugccugaccaaagaacaaaucugaaaaucaccauuuuaa

SEQ ID NO: 91845 - RNA, 64 nt, hsa
guccagucaggguccugaaguuugcugguucaggaaagaacaggaaagagaaaagccuucugug

SEQ ID NO: 91846 - RNA, 64 nt, hsa
aguucuguguuuauuuuuuaauuauagaaauuccaaagaacagcacaucagaaugcuccucucu

SEQ ID NO: 91847 - RNA, 64 nt, hsa
aaaagcacagcucucacuggccaguagcugccaaaaagaacacccaucguauaaggaaauccag

SEQ ID NO: 91848 - RNA, 64 nt, hsa
cucucucauguggggauguuugugcugcagacaaaaagaacaaaaaaaaauuuuuaaauaccac

SEQ ID NO: 91849 - RNA, 64 nt, hsa
ggugugugugaaacagugaagucucaacagcagaaaagaacaaaauguaaauucaugaauaaug

SEQ ID NO: 91850 - RNA, 64 nt, hsa
ccaggaaacuguagcuucuuaacuggugacuaccaaagaacaagcagugauuugaaaaaggaaa

SEQ ID NO: 91851 - RNA, 64 nt, hsa
aauuaggaagcauuucgaaccugcgcaacagaccaaagaacaguacaaagaacauccguguacc

SEQ ID NO: 91852 - RNA, 64 nt, hsa
uuucgaaccugcgcaacagaccaaagaacaguacaaagaacauccguguacccaguacccugac

SEQ ID NO: 91853 - RNA, 64 nt, hsa
guggaaagcacugcagcgauuucucaaagacauaaaagaacauagcauucaacccagcauccca

SEQ ID NO: 91854 - RNA, 64 nt, hsa
acauauacaccauggaauacuaugcagccauaaaaaagaacaagacuguguccuuuacagcaac

SEQ ID NO: 91855 - RNA, 64 nt, hsa
ucaaaggguuaagucuauuugaaaagguuaaaaaaaagaacaaaaaaaaaaaaagaacuuguac

SEQ ID NO: 91856 - RNA, 64 nt, hsa
ugcacaugauuuuuaaagguauuuauuagaaaucaaagaacacucaaaauaaacucagugcuca

SEQ ID NO: 91857 - RNA, 64 nt, hsa
aguauaacauuuguauaauuuaauaagaucuugcaaagaacaguacuguguauuggucauggau

SEQ ID NO: 91858 - RNA, 64 nt, hsa
cuuuaucaaguuauaaaauauguugaaaggcacaaaagaacaccugaaaaaugauauuuugucu

SEQ ID NO: 91859 - RNA, 64 nt, hsa
acugugcaaagccccaguagucggauuccggggaaaagaacaaguaucuaguuuugaugacaau

SEQ ID NO: 91860 - RNA, 64 nt, hsa
cauuugagcuggucuggagcagaguuucucccucaaagaacacagagaaaucagagaguggcug

SEQ ID NO: 91861 - RNA, 64 nt, hsa
ugaucaaugacuguagcuuuuuagacuguuggucaaagaacauucuacuucacaguaauagcuc

SEQ ID NO: 91862 - RNA, 64 nt, hsa
aacugaauugaaucaaccaguuugcauuuaaauaaaagaacaggcucaguggucuuccuguaga

SEQ ID NO: 91863 - RNA, 64 nt, hsa
agaccugcaggugcugccccaugaccuccaccaaagcccauauaaggagcggaguuguuaagga

SEQ ID NO: 91864 - RNA, 64 nt, hsa
guuuacacuuggggacaagugcuaaguauuguggagcccauagccccuugagauagauggcuac

SEQ ID NO: 91865 - RNA, 64 nt, hsa
gugugauuuauuaaguuguagucaccauagugauagcccauaaauaauugcuggaaaauuguau

SEQ ID NO: 91866 - RNA, 64 nt, hsa
uugugguuccaaaauaauuuuuuuaaauauuaauagcccauauacaaagauaauggauugcaca

SEQ ID NO: 91867 - RNA, 64 nt, hsa
gacucuaaugaaagcugaugaauuuucuuuucuguccaaacaaguaaaauaaaaauaaaagucu

SEQ ID NO: 91868 - RNA, 64 nt, hsa
gccacggauugcaggccaaauuucagaucguguuuccaaacacccuugcugugcccuuuaaugg

SEQ ID NO: 91869 - RNA, 64 nt, hsa
uuacagacaagcuuauuuccaaagccaccucauuuccaaacaucucacucaggaagggaggcuc

SEQ ID NO: 91870 - RNA, 64 nt, hsa
cauauggugauaugccaaaauauuuaugucaauguccaaacaaaguccaaugccaugagacuga

SEQ ID NO: 91871 - RNA, 64 nt, hsa
acauauauuuuauauccucuucuguugaaugcaguccaaacaugaaaggaaauaauuguuuuau

SEQ ID NO: 91872 - RNA, 64 nt, hsa
cagugacaauaaacaaaguacuaccugaaaaacauccaaacaccuugagcucucuaaccuccuu

SEQ ID NO: 91873 - RNA, 64 nt, hsa
cuggaaauaaauauaguuauuaaaggauucucacuccaaacauggccucucucuuuacuuggac

SEQ ID NO: 91874 - RNA, 64 nt, hsa
uuccucuguuauauagcuuuucccaaugcuaauuuccaaacaacaacaacaaaauaacauguuu

SEQ ID NO: 91875 - RNA, 64 nt, hsa
augcagagguuugcuuugcuuuuuuuucagaaguuccaaacagcaacuuugagagcaguggggu

SEQ ID NO: 91876 - RNA, 64 nt, hsa
aacaaaacaaaacauaaaauauaaacaaucaaaauccaaacaaacaaacaaacacucacugcau

SEQ ID NO: 91877 - RNA, 64 nt, hsa
aucuuaccgagcuguagaaaauaaaaaauuccucuccaaacauggguaguuuuaugucaaaaua

SEQ ID NO: 91878 - RNA, 64 nt, hsa
cugaaaagauggcauagcuuaaaagaugaaaguguccaaacacauccugcuuccuucauugggg

SEQ ID NO: 91879 - RNA, 64 nt, hsa
ugggccuugaaggauggaugaaauuuggauagagaaugaggaagacagagggccuccaagugag

SEQ ID NO: 91880 - RNA, 64 nt, hsa
caccagccagcuuacacaggcauuaacucuccucaaugaggaagaaucauucacaacugagcaa

SEQ ID NO: 91881 - RNA, 64 nt, hsa
ggcaaaagacacuucuuacauuguggcaagaaaaaaugaggaagaagcaaaagcagaaaccccu

SEQ ID NO: 91882 - RNA, 64 nt, hsa
ggugaaaggcacuucuuacauggcagcaagagaaaaugaggaagaagcaaaaguggaaaccccu

SEQ ID NO: 91883 - RNA, 64 nt, hsa
cucucugugguuugacuuaccccagcuaccguuaaaugaggacaaaucaccuuaaaacauguuc

SEQ ID NO: 91884 - RNA, 64 nt, hsa
cccugaaaccaugauuggcauauguuagauaacaaaugaggaugucuaagaggcauaugcugcu

SEQ ID NO: 91885 - RNA, 64 nt, hsa
gaauuuugugaagcugcauuaaggauagaguuggaaugaggauguggcuggcauuuuuccccuu

SEQ ID NO: 91886 - RNA, 64 nt, hsa
cuucuuagcccacauuccuccgggccuuauggagaaugaggauucagccuugacuucuugccca

SEQ ID NO: 91887 - RNA, 64 nt, hsa
guuggccucucucuucacuuuaucauugcccaagaaugaggauaugcaguaaacagaauucagg

SEQ ID NO: 91888 - RNA, 64 nt, hsa
gcucaucugguccugaaguaguaacauucacccaaaugaggauauagucauuauuccuuuucag

SEQ ID NO: 91889 - RNA, 64 nt, hsa
gaaugccuucaacugaaaaaaacauauccaaaauaaugaggaaauguguuggcucacuacguag

SEQ ID NO: 91890 - RNA, 64 nt, hsa
cauuuauuuacacucuugauucuacaauguagaaaaugaggaaaugccacaaauuguaugguga

SEQ ID NO: 91891 - RNA, 64 nt, hsa
cagagacuaugugguccaucgccuucauuguguaaaugaggacacagacuggcuuggucgcagu

SEQ ID NO: 91892 - RNA, 64 nt, hsa
acugcccggccugccucccaccuggaagucugggaaugaggagauugagauaaacuuuugaaau

SEQ ID NO: 91893 - RNA, 64 nt, hsa
cucccagacguagaguaggaaacgugcucuucuaaaugaggagggagaagauaaaggaaacuuc

SEQ ID NO: 91894 - RNA, 64 nt, hsa
aaaaagauaagauuuacucaaguagcauuugggcaaugaggaaggaaagguuucaaauuuaggg

SEQ ID NO: 91895 - RNA, 64 nt, hsa
uuuaaacgagcuauuaugguacggaacuuuuuuuaaugaggaauuucaugaugauuuaggaauu

SEQ ID NO: 91896 - RNA, 64 nt, hsa
ucuaauauucacauaaacugaaauaaagaaguggaaugaggagcuuugacauucaaauuaugug

SEQ ID NO: 91897 - RNA, 64 nt, hsa; identical to SEQ ID NO: 45477

SEQ ID NO: 91898 - RNA, 64 nt, hsa; identical to SEQ ID NO: 45478

SEQ ID NO: 91899 - RNA, 64 nt, hsa; identical to SEQ ID NO: 45479

SEQ ID NO: 91900 - RNA, 64 nt, hsa; identical to SEQ ID NO: 45480

SEQ ID NO: 91901 - RNA, 64 nt, hsa; identical to SEQ ID NO: 45481

SEQ ID NO: 91902 - RNA, 64 nt, hsa; identical to SEQ ID NO: 45482

SEQ ID NO: 91903 - RNA, 64 nt, hsa; identical to SEQ ID NO: 45483

SEQ ID NO: 91904 - RNA, 64 nt, hsa; identical to SEQ ID NO: 45484

SEQ ID NO: 91905 - RNA, 64 nt, hsa; identical to SEQ ID NO: 45485

SEQ ID NO: 91906 - RNA, 64 nt, hsa; identical to SEQ ID NO: 45486

SEQ ID NO: 91907 - RNA, 64 nt, hsa; identical to SEQ ID NO: 45487

SEQ ID NO: 91908 - RNA, 56 nt, hsa; identical to SEQ ID NO: 45488

SEQ ID NO: 91909 - RNA, 64 nt, hsa; identical to SEQ ID NO: 45489

SEQ ID NO: 91910 - RNA, 64 nt, hsa; identical to SEQ ID NO: 45490

SEQ ID NO: 91911 - RNA, 64 nt, hsa; identical to SEQ ID NO: 45491

SEQ ID NO: 91912 - RNA, 64 nt, hsa; identical to SEQ ID NO: 45492

SEQ ID NO: 91913 - RNA, 64 nt, hsa; identical to SEQ ID NO: 45493

SEQ ID NO: 91914 - RNA, 64 nt, hsa; identical to SEQ ID NO: 45494

SEQ ID NO: 91915 - RNA, 64 nt, hsa; identical to SEQ ID NO: 45495

SEQ ID NO: 91916 - RNA, 64 nt, hsa; identical to SEQ ID NO: 45496

SEQ ID NO: 91917 - RNA, 64 nt, hsa; identical to SEQ ID NO: 45497

SEQ ID NO: 91918 - RNA, 64 nt, hsa; identical to SEQ ID NO: 45498

SEQ ID NO: 91919 - RNA, 64 nt, hsa; identical to SEQ ID NO: 45499

SEQ ID NO: 91920 - RNA, 64 nt, hsa; identical to SEQ ID NO: 45500

SEQ ID NO: 91921 - RNA, 64 nt, hsa; identical to SEQ ID NO: 45501

SEQ ID NO: 91922 - RNA, 64 nt, hsa; identical to SEQ ID NO: 45502

SEQ ID NO: 91923 - RNA, 64 nt, hsa; identical to SEQ ID NO: 45503

SEQ ID NO: 91924 - RNA, 64 nt, hsa; identical to SEQ ID NO: 45504

SEQ ID NO: 91925 - RNA, 64 nt, hsa; identical to SEQ ID NO: 45505

SEQ ID NO: 91926 - RNA, 64 nt, hsa; identical to SEQ ID NO: 45506

SEQ ID NO: 91927 - RNA, 64 nt, hsa; identical to SEQ ID NO: 45507

SEQ ID NO: 91928 - RNA, 64 nt, hsa; identical to SEQ ID NO: 45508

SEQ ID NO: 91929 - RNA, 64 nt, hsa; identical to SEQ ID NO: 45509

SEQ ID NO: 91930 - RNA, 64 nt, hsa; identical to SEQ ID NO: 45510

SEQ ID NO: 91931 - RNA, 64 nt, hsa; identical to SEQ ID NO: 45511

SEQ ID NO: 91932 - RNA, 64 nt, hsa; identical to SEQ ID NO: 45512

SEQ ID NO: 91933 - RNA, 64 nt, hsa; identical to SEQ ID NO: 45513

SEQ ID NO: 91934 - RNA, 64 nt, hsa; identical to SEQ ID NO: 45514

SEQ ID NO: 91935 - RNA, 64 nt, hsa; identical to SEQ ID NO: 45515

SEQ ID NO: 91936 - RNA, 64 nt, hsa; identical to SEQ ID NO: 45516

SEQ ID NO: 91937 - RNA, 64 nt, hsa; identical to SEQ ID NO: 45517

SEQ ID NO: 91938 - RNA, 64 nt, hsa; identical to SEQ ID NO: 45518

SEQ ID NO: 91939 - RNA, 64 nt, hsa; identical to SEQ ID NO: 45519

SEQ ID NO: 91940 - RNA, 64 nt, hsa; identical to SEQ ID NO: 45520

SEQ ID NO: 91941 - RNA, 64 nt, hsa; identical to SEQ ID NO: 45521

SEQ ID NO: 91942 - RNA, 64 nt, hsa; identical to SEQ ID NO: 45522

SEQ ID NO: 91943 - RNA, 64 nt, hsa; identical to SEQ ID NO: 45523

SEQ ID NO: 91944 - RNA, 64 nt, hsa; identical to SEQ ID NO: 45524

SEQ ID NO: 91945 - RNA, 64 nt, hsa; identical to SEQ ID NO: 45525

SEQ ID NO: 91946 - RNA, 64 nt, hsa; identical to SEQ ID NO: 45526

SEQ ID NO: 91947 - RNA, 64 nt, hsa; identical to SEQ ID NO: 45527

SEQ ID NO: 91948 - RNA, 64 nt, hsa; identical to SEQ ID NO: 45528

SEQ ID NO: 91949 - RNA, 64 nt, hsa; identical to SEQ ID NO: 45529

SEQ ID NO: 91950 - RNA, 64 nt, hsa; identical to SEQ ID NO: 45530

SEQ ID NO: 91951 - RNA, 64 nt, hsa; identical to SEQ ID NO: 45531

SEQ ID NO: 91952 - RNA, 64 nt, hsa; identical to SEQ ID NO: 45532

SEQ ID NO: 91953 - RNA, 64 nt, hsa; identical to SEQ ID NO: 45533

SEQ ID NO: 91954 - RNA, 64 nt, hsa; identical to SEQ ID NO: 45534

SEQ ID NO: 91955 - RNA, 64 nt, hsa; identical to SEQ ID NO: 45535

SEQ ID NO: 91956 - RNA, 64 nt, hsa; identical to SEQ ID NO: 45536

SEQ ID NO: 91957 - RNA, 64 nt, hsa; identical to SEQ ID NO: 45537

SEQ ID NO: 91958 - RNA, 64 nt, hsa; identical to SEQ ID NO: 45538

SEQ ID NO: 91959 - RNA, 64 nt, hsa; identical to SEQ ID NO: 45539

SEQ ID NO: 91960 - RNA, 64 nt, hsa; identical to SEQ ID NO: 45540

SEQ ID NO: 91961 - RNA, 64 nt, hsa; identical to SEQ ID NO: 45541

SEQ ID NO: 91962 - RNA, 64 nt, hsa; identical to SEQ ID NO: 45542

SEQ ID NO: 91963 - RNA, 64 nt, hsa; identical to SEQ ID NO: 45543

SEQ ID NO: 91964 - RNA, 64 nt, hsa; identical to SEQ ID NO: 45544

SEQ ID NO: 91965 - RNA, 64 nt, hsa; identical to SEQ ID NO: 45545

SEQ ID NO: 91966 - RNA, 64 nt, hsa; identical to SEQ ID NO: 45546

SEQ ID NO: 91967 - RNA, 64 nt, hsa; identical to SEQ ID NO: 45547

SEQ ID NO: 91968 - RNA, 64 nt, hsa; identical to SEQ ID NO: 45548

SEQ ID NO: 91969 - RNA, 64 nt, hsa; identical to SEQ ID NO: 45549

SEQ ID NO: 91970 - RNA, 64 nt, hsa; identical to SEQ ID NO: 45550

SEQ ID NO: 91971 - RNA, 64 nt, hsa; identical to SEQ ID NO: 45551

SEQ ID NO: 91972 - RNA, 64 nt, hsa; identical to SEQ ID NO: 45552

SEQ ID NO: 91973 - RNA, 64 nt, hsa; identical to SEQ ID NO: 45553

SEQ ID NO: 91974 - RNA, 64 nt, hsa; identical to SEQ ID NO: 45554

SEQ ID NO: 91975 - RNA, 64 nt, hsa; identical to SEQ ID NO: 45555

SEQ ID NO: 91976 - RNA, 64 nt, hsa; identical to SEQ ID NO: 45556

SEQ ID NO: 91977 - RNA, 64 nt, hsa; identical to SEQ ID NO: 45557

SEQ ID NO: 91978 - RNA, 64 nt, hsa; identical to SEQ ID NO: 45558

SEQ ID NO: 91979 - RNA, 64 nt, hsa; identical to SEQ ID NO: 45559

SEQ ID NO: 91980 - RNA, 64 nt, hsa; identical to SEQ ID NO: 45560

SEQ ID NO: 91981 - RNA, 64 nt, hsa; identical to SEQ ID NO: 45561

SEQ ID NO: 91982 - RNA, 64 nt, hsa; identical to SEQ ID NO: 45562

SEQ ID NO: 91983 - RNA, 64 nt, hsa; identical to SEQ ID NO: 45563

SEQ ID NO: 91984 - RNA, 64 nt, hsa; identical to SEQ ID NO: 45564

SEQ ID NO: 91985 - RNA, 64 nt, hsa; identical to SEQ ID NO: 45565

SEQ ID NO: 91986 - RNA, 64 nt, hsa; identical to SEQ ID NO: 45566

SEQ ID NO: 91987 - RNA, 64 nt, hsa; identical to SEQ ID NO: 45567

SEQ ID NO: 91988 - RNA, 64 nt, hsa; identical to SEQ ID NO: 45568

SEQ ID NO: 91989 - RNA, 64 nt, hsa; identical to SEQ ID NO: 45569

SEQ ID NO: 91990 - RNA, 64 nt, hsa; identical to SEQ ID NO: 45570

SEQ ID NO: 91991 - RNA, 64 nt, hsa; identical to SEQ ID NO: 45571

SEQ ID NO: 91992 - RNA, 64 nt, hsa; identical to SEQ ID NO: 45572

SEQ ID NO: 91993 - RNA, 64 nt, hsa; identical to SEQ ID NO: 45573

SEQ ID NO: 91994 - RNA, 64 nt, hsa; identical to SEQ ID NO: 45574

SEQ ID NO: 91995 - RNA, 64 nt, hsa; identical to SEQ ID NO: 45575

SEQ ID NO: 91996 - RNA, 64 nt, hsa; identical to SEQ ID NO: 45576

SEQ ID NO: 91997 - RNA, 64 nt, hsa; identical to SEQ ID NO: 45577

SEQ ID NO: 91998 - RNA, 64 nt, hsa; identical to SEQ ID NO: 45578

SEQ ID NO: 91999 - RNA, 64 nt, hsa; identical to SEQ ID NO: 45579

SEQ ID NO: 92000 - RNA, 64 nt, hsa; identical to SEQ ID NO: 45580

SEQ ID NO: 92001 - RNA, 64 nt, hsa; identical to SEQ ID NO: 45581

SEQ ID NO: 92002 - RNA, 64 nt, hsa; identical to SEQ ID NO: 45582

SEQ ID NO: 92003 - RNA, 64 nt, hsa; identical to SEQ ID NO: 45583

SEQ ID NO: 92004 - RNA, 64 nt, hsa; identical to SEQ ID NO: 45584

SEQ ID NO: 92005 - RNA, 64 nt, hsa; identical to SEQ ID NO: 45585

SEQ ID NO: 92006 - RNA, 64 nt, hsa; identical to SEQ ID NO: 45586

SEQ ID NO: 92007 - RNA, 64 nt, hsa; identical to SEQ ID NO: 45587

SEQ ID NO: 92008 - RNA, 64 nt, hsa; identical to SEQ ID NO: 45588

SEQ ID NO: 92009 - RNA, 64 nt, hsa; identical to SEQ ID NO: 45589

SEQ ID NO: 92010 - RNA, 64 nt, hsa; identical to SEQ ID NO: 45590

SEQ ID NO: 92011 - RNA, 64 nt, hsa; identical to SEQ ID NO: 45591

SEQ ID NO: 92012 - RNA, 64 nt, hsa; identical to SEQ ID NO: 45592

SEQ ID NO: 92013 - RNA, 64 nt, hsa; identical to SEQ ID NO: 45593

SEQ ID NO: 92014 - RNA, 64 nt, hsa; identical to SEQ ID NO: 45594

SEQ ID NO: 92015 - RNA, 64 nt, hsa; identical to SEQ ID NO: 45595

SEQ ID NO: 92016 - RNA, 64 nt, hsa; identical to SEQ ID NO: 45596

SEQ ID NO: 92017 - RNA, 64 nt, hsa; identical to SEQ ID NO: 45597

SEQ ID NO: 92018 - RNA, 64 nt, hsa; identical to SEQ ID NO: 45598

SEQ ID NO: 92019 - RNA, 64 nt, hsa; identical to SEQ ID NO: 45599

SEQ ID NO: 92020 - RNA, 64 nt, hsa; identical to SEQ ID NO: 45600

SEQ ID NO: 92021 - RNA, 64 nt, hsa; identical to SEQ ID NO: 45601

SEQ ID NO: 92022 - RNA, 64 nt, hsa; identical to SEQ ID NO: 45602

SEQ ID NO: 92023 - RNA, 64 nt, hsa; identical to SEQ ID NO: 45603

SEQ ID NO: 92024 - RNA, 64 nt, hsa; identical to SEQ ID NO: 45604

SEQ ID NO: 92025 - RNA, 64 nt, hsa; identical to SEQ ID NO: 45605

SEQ ID NO: 92026 - RNA, 64 nt, hsa; identical to SEQ ID NO: 45606

SEQ ID NO: 92027 - RNA, 64 nt, hsa; identical to SEQ ID NO: 45607

SEQ ID NO: 92028 - RNA, 64 nt, hsa; identical to SEQ ID NO: 45608

SEQ ID NO: 92029 - RNA, 64 nt, hsa; identical to SEQ ID NO: 45609

SEQ ID NO: 92030 - RNA, 64 nt, hsa; identical to SEQ ID NO: 45610

SEQ ID NO: 92031 - RNA, 64 nt, hsa; identical to SEQ ID NO: 45611

SEQ ID NO: 92032 - RNA, 64 nt, hsa; identical to SEQ ID NO: 45612

SEQ ID NO: 92033 - RNA, 64 nt, hsa; identical to SEQ ID NO: 45613

SEQ ID NO: 92034 - RNA, 64 nt, hsa; identical to SEQ ID NO: 45614

SEQ ID NO: 92035 - RNA, 64 nt, hsa; identical to SEQ ID NO: 45615

SEQ ID NO: 92036 - RNA, 64 nt, hsa; identical to SEQ ID NO: 45616

SEQ ID NO: 92037 - RNA, 64 nt, hsa; identical to SEQ ID NO: 45617

SEQ ID NO: 92038 - RNA, 64 nt, hsa; identical to SEQ ID NO: 45618

SEQ ID NO: 92039 - RNA, 64 nt, hsa; identical to SEQ ID NO: 45619

SEQ ID NO: 92040 - RNA, 64 nt, hsa; identical to SEQ ID NO: 45620

SEQ ID NO: 92041 - RNA, 64 nt, hsa; identical to SEQ ID NO: 45621

SEQ ID NO: 92042 - RNA, 64 nt, hsa; identical to SEQ ID NO: 45622

SEQ ID NO: 92043 - RNA, 64 nt, hsa; identical to SEQ ID NO: 45623

SEQ ID NO: 92044 - RNA, 64 nt, hsa; identical to SEQ ID NO: 45624

SEQ ID NO: 92045 - RNA, 64 nt, hsa; identical to SEQ ID NO: 45625

SEQ ID NO: 92046 - RNA, 64 nt, hsa; identical to SEQ ID NO: 45626

SEQ ID NO: 92047 - RNA, 64 nt, hsa; identical to SEQ ID NO: 45627

SEQ ID NO: 92048 - RNA, 64 nt, hsa; identical to SEQ ID NO: 45628

SEQ ID NO: 92049 - RNA, 64 nt, hsa; identical to SEQ ID NO: 45629

SEQ ID NO: 92050 - RNA, 64 nt, hsa; identical to SEQ ID NO: 45630

SEQ ID NO: 92051 - RNA, 64 nt, hsa; identical to SEQ ID NO: 45631

SEQ ID NO: 92052 - RNA, 64 nt, hsa; identical to SEQ ID NO: 45632

SEQ ID NO: 92053 - RNA, 64 nt, hsa; identical to SEQ ID NO: 45633

SEQ ID NO: 92054 - RNA, 64 nt, hsa; identical to SEQ ID NO: 45634

SEQ ID NO: 92055 - RNA, 64 nt, hsa; identical to SEQ ID NO: 45635

SEQ ID NO: 92056 - RNA, 64 nt, hsa; identical to SEQ ID NO: 45636

SEQ ID NO: 92057 - RNA, 64 nt, hsa; identical to SEQ ID NO: 45637

SEQ ID NO: 92058 - RNA, 64 nt, hsa; identical to SEQ ID NO: 45638

SEQ ID NO: 92059 - RNA, 64 nt, hsa; identical to SEQ ID NO: 45639

SEQ ID NO: 92060 - RNA, 64 nt, hsa; identical to SEQ ID NO: 45640

SEQ ID NO: 92061 - RNA, 64 nt, hsa; identical to SEQ ID NO: 45641

SEQ ID NO: 92062 - RNA, 64 nt, hsa; identical to SEQ ID NO: 45642

SEQ ID NO: 92063 - RNA, 64 nt, hsa; identical to SEQ ID NO: 45643

SEQ ID NO: 92064 - RNA, 64 nt, hsa; identical to SEQ ID NO: 45644

SEQ ID NO: 92065 - RNA, 64 nt, hsa; identical to SEQ ID NO: 45645

SEQ ID NO: 92066 - RNA, 64 nt, hsa; identical to SEQ ID NO: 45646

SEQ ID NO: 92067 - RNA, 64 nt, hsa; identical to SEQ ID NO: 45647

SEQ ID NO: 92068 - RNA, 64 nt, hsa; identical to SEQ ID NO: 45648

SEQ ID NO: 92069 - RNA, 64 nt, hsa; identical to SEQ ID NO: 45649

SEQ ID NO: 92070 - RNA, 64 nt, hsa; identical to SEQ ID NO: 45650

SEQ ID NO: 92071 - RNA, 64 nt, hsa; identical to SEQ ID NO: 45651

SEQ ID NO: 92072 - RNA, 64 nt, hsa; identical to SEQ ID NO: 45652

SEQ ID NO: 92073 - RNA, 64 nt, hsa; identical to SEQ ID NO: 45653

SEQ ID NO: 92074 - RNA, 64 nt, hsa; identical to SEQ ID NO: 45654

SEQ ID NO: 92075 - RNA, 64 nt, hsa; identical to SEQ ID NO: 45655

SEQ ID NO: 92076 - RNA, 64 nt, hsa
agauuuuucuuuuaagcccugcucuuucucugagaaccaaaagaugccuugaauauuuauucag

SEQ ID NO: 92077 - RNA, 64 nt, hsa
ccuccuuuucuucuagcuuuguuguccucccaggaaccaaaaaaccccagcuauuuucugacca

SEQ ID NO: 92078 - RNA, 64 nt, hsa
caaucuguggguuaauaguuaaaagaauguucccaaccaaaaaauucuuaccguaauauuauau

SEQ ID NO: 92079 - RNA, 64 nt, hsa
guauauauauguauguuucuccaaaaagugauaaaaccaaaauaucacugacucaucccuaccc

SEQ ID NO: 92080 - RNA, 64 nt, hsa
ucugccauggagcagcauuacccuaauggauugcaaccaaaacuuuaaacaaguagaaagauaa

SEQ ID NO: 92081 - RNA, 64 nt, hsa
acuugaugcgggagcaacaaacagcucagggccaaaccaaaagacaaaaauuggaguaacguag

SEQ ID NO: 92082 - RNA, 62 nt, hsa
ucaacuugauuauaaauacaccugucacuaccagaaccaaaaaaaaaaagaaaaaaauccca

SEQ ID NO: 92083 - RNA, 64 nt, hsa
auuuugaagauacauuugcaagagauauuuguuuaaccaaaauauuuggaaaguaacaaauaaa

SEQ ID NO: 92084 - RNA, 64 nt, hsa
cuuucuaacagaacuuccauaacuagaagguggaaaccaaaacccucaugguaguauuuccucu

SEQ ID NO: 92085 - RNA, 64 nt, hsa
uugcccacaguaucuccacuuaaacuaggcuaguaaccaaaauaauguggaccuucuuuaggaa

SEQ ID NO: 92086 - RNA, 64 nt, hsa
aaaccaaaacaaaauuuccaaaaacaaugaaggaaaccaaaauaaauauuucugcauuucaggu

SEQ ID NO: 92087 - RNA, 64 nt, hsa
uugcuuuaaguguuggcuauuucuauguuuuauaaaccaaaacaaaauuuccaaaaacaaugaa

SEQ ID NO: 92088 - RNA, 64 nt, hsa
acagaggauaaagaaguuaauggcaugguggaauaaccaaaauguguaucauucuacaaaaaaa

SEQ ID NO: 92089 - RNA, 64 nt, hsa
gcuuauagauccucuugcuguucugaggccuuaaaaccaaaaaaauaauggaaugauugcauca

SEQ ID NO: 92090 - RNA, 64 nt, hsa
uuaauaaaagaagacaaacccagauagauauguaaaccaaaauacuaugccccuuaauacuuua

SEQ ID NO: 92091 - RNA, 64 nt, hsa
uaaaaagacaagcggugggacagagggaaccuacaaccaaaaacugccuagaucuuugcaguua

SEQ ID NO: 92092 - RNA, 64 nt, hsa
gcacaggcuccagcaauaugucugcauugaaaagaaccaaaaaaaugcaaacuaugaugccauu

SEQ ID NO: 92093 - RNA, 64 nt, hsa
ccccaugucuacaaaaaugaaaaaccaaaaagcaaaccaaaagaaaaaucugaaauuuccaucu

SEQ ID NO: 92094 - RNA, 64 nt, hsa
cauagcaacaccccccaugucuacaaaaaugaaaaaccaaaaagcaaaccaaaagaaaaaucug

SEQ ID NO: 92095 - RNA, 64 nt, hsa
gagucucucucucucuuucucucucucucuuuuuaaccaaaaagagaugacaaaacuaaguuca

SEQ ID NO: 92096 - RNA, 64 nt, hsa
aucuguauggcaccaaaaaucaaagugaaaaccaaaccaaaaacccaaacacccuauguaacua

SEQ ID NO: 92097 - RNA, 64 nt, hsa
aauggauauacauccucacagaaaaguuggaaauaaccaaaacugaagucuuaauuuaccuuca

SEQ ID NO: 92098 - RNA, 64 nt, hsa
gaucauagagauggaaaacuguauaguaaccaaaaaccaaaacagugauauuuccagaacuuuu

SEQ ID NO: 92099 - RNA, 64 nt, hsa
aucacgagaucauagagauggaaaacuguauaguaaccaaaaaccaaaacagugauauuuccag

SEQ ID NO: 92100 - RNA, 64 nt, hsa
auaaauguuccaccaguagggauaggggaaaaguaaccaaaagagagaaagagaaaggaaugcu

SEQ ID NO: 92101 - RNA, 64 nt, hsa
gaugcugaauagccuagacaucaaaguuggugugaaccaaaauagagucagcugacccagcauc

SEQ ID NO: 92102 - RNA, 64 nt, hsa
caaauauuaagcccuuaaaaaaauaaaaccucugaaccaaaaucuucccaggaauaguacuuaa

SEQ ID NO: 92103 - RNA, 64 nt, hsa
acagaggagugaaagaauuaaguggguagacaccaaccaaaaugacuuugaaagcagugagcug

SEQ ID NO: 92104 - RNA, 64 nt, hsa
auagaguaucuccgaaugcagcuauguaaaagagaaccaaaacuugagugcucuggauaacuau

SEQ ID NO: 92105 - RNA, 64 nt, hsa
aguauuuaucccauuuuaugcaauuaaccaaaucaaccaaaaaaagugaccaugaaguccugua

SEQ ID NO: 92106 - RNA, 64 nt, hsa
ucaaggucuuguugauauuauauaguaaaaauaaaaccaaaaauaaauauuauucaaguggcuc

SEQ ID NO: 92107 - RNA, 64 nt, hsa
uaaagugucaggauaugcauuagauucucuccugaaccaaaaacacaacagucauuaucuguga

SEQ ID NO: 92108 - RNA, 64 nt, hsa
guuucuauaaggaaauaauacuuuuuuaaacaacaaccaaaaaaugccuugcugauucacuagg

SEQ ID NO: 92109 - RNA, 64 nt, hsa
ggcuucuugucuguaagccagcugaucuaguaguaaccaaaaauuccaguuuugagaauaggaa

SEQ ID NO: 92110 - RNA, 64 nt, hsa
aauauuuacauuuuuaauuuaguuuacagaauggaaccaaaauguauaaauguuauguuugcua

SEQ ID NO: 92111 - RNA, 64 nt, hsa
ucugcucuccugaaucuugggcaugccuuucuguaaccaaaaaucccuguaggcgugcuagcaa

SEQ ID NO: 92112 - RNA, 64 nt, hsa
caguaccccugguaaaccaagccucccacacugaaaccaaaacauaaaaaccaaacccagacaa

SEQ ID NO: 92113 - RNA, 64 nt, hsa
cacugaaaccaaaacauaaaaaccaaacccagacaaccaaaacauauucaaagcagcagccacc

SEQ ID NO: 92114 - RNA, 64 nt, hsa
uucuacaguuuugcaccacggcaagaaaaccaaaaaccaaaacaaacaaacaaaaaaaacccaa

SEQ ID NO: 92115 - RNA, 64 nt, hsa
agcaacuuucuacaguuuugcaccacggcaagaaaaccaaaaaccaaaacaaacaaacaaaaaa

SEQ ID NO: 92116 - RNA, 64 nt, hsa
cacagcaaucaggcaagagaaagaaauaaaaggcaaccaaaaagaaaggaagucgaaguaucuc

SEQ ID NO: 92117 - RNA, 64 nt, hsa
gaaucagaaaaaaaaagcauuaaaauuuauuugaaaccaaaaaagagcccaaaaagccaaagca

SEQ ID NO: 92118 - RNA, 64 nt, hsa
uacccaacuucaaacuauacuacagggcuacaguaaccaaaacugcaugauacugguacaaaag

SEQ ID NO: 92119 - RNA, 64 nt, hsa
ccucugggguugaggugauaaucaauagcuuaccaaccaaaaagaguccaggaccagauggauu

SEQ ID NO: 92120 - RNA, 64 nt, hsa
gcaucuuccuguuaccaaagcugggcagagacaaaaccaaaaaagagaauuuuagaccaauauc

SEQ ID NO: 92121 - RNA, 64 nt, hsa
agaauugaaaaacacuacuuuaaaguucauauggaaccaaaaaagagcccacauugccaaguca

SEQ ID NO: 92122 - RNA, 64 nt, hsa
cuaccugacuucaaacuaugcuacaaggcuacauaaccaaaauagcaugguacugguaccaaaa

SEQ ID NO: 92123 - RNA, 64 nt, hsa
uuugucuggccucacgugucucagauuuucuaagaaccaaaaaaaaaaaaggaaaaaaaacaca

SEQ ID NO: 92124 - RNA, 64 nt, hsa
aaaaaaaaaaggaaaaaaaacacaaaacaacaaaaaccaaaaaaaaaaaaaaucacaaaaacaa

SEQ ID NO: 92125 - RNA, 64 nt, hsa
gaggugaaaaacaaacaaaaaaaaaccaaaaacaaaccaaaaaaaaaaaaaacccacaaaauca

SEQ ID NO: 92126 - RNA, 64 nt, hsa
caaaggaaccagaggugaaaaacaaacaaaaaaaaaccaaaaacaaaccaaaaaaaaaaaaaac

SEQ ID NO: 92127 - RNA, 64 nt, hsa
aaaaaaaggaaagaaacuaaccaacaaaagagaaaaccaaaaauaaucacaacagaaaccagcu

SEQ ID NO: 92128 - RNA, 64 nt, hsa
gagugacaagggaggaaagaccaaaaaaacaaccaaccaaaaaaaaaaaaaaaaaggaaagaaa

SEQ ID NO: 92129 - RNA, 64 nt, hsa
gauuuuuuucuuuuuuaguaaaaaccuguauaaaaaccaaaauuauaggauuuuuuuuucuucu

SEQ ID NO: 92130 - RNA, 64 nt, hsa
ggauuuuuucuuuuuuaguaaaaaccuauaugaaaaccaaaauuauaggauuuuuuucuuuuuu

SEQ ID NO: 92131 - RNA, 64 nt, hsa
gauuuuuuucuuuuuuaguaaaaaccuauauaaaaaccaaaauuauaggauuuuuucuuuuuua

SEQ ID NO: 92132 - RNA, 64 nt, hsa
ggauuuuuucuuuuuuaguaaaaaccgguaucaaaaccaaaauuauaggauuuuuuucuuuuuu

SEQ ID NO: 92133 - RNA, 64 nt, hsa
aauagagccacuggugaguaaaaaccuauauaaaaaccaaaauuauaggauuuuuucuuuuuua

SEQ ID NO: 92134 - RNA, 64 nt, hsa
cuggcaugggcuggacaguugcuugaaaugaccuaaccaaaaacauucaaggguucugccccca

SEQ ID NO: 92135 - RNA, 64 nt, hsa
cgucucauuuguaucuucugauauucuuuauacaaaccaaaaguccccuucaacauuuuuuaug

SEQ ID NO: 92136 - RNA, 64 nt, hsa
guagaaaaaaaacaaacaaacaaacagaaaaaaaaaccaaaaaaaaccacccugaguuucucug

SEQ ID NO: 92137 - RNA, 64 nt, hsa
ugucccuuuuccacaguaaugggaucggcuggugugccuucagggaggaagagggaggugguca

SEQ ID NO: 92138 - RNA, 64 nt, hsa
cuagaggccucuccauauggcuggucaggggagcugccuucaggcuugugccccgugugcucag

SEQ ID NO: 92139 - RNA, 64 nt, hsa
ucugcuucucuuuccuguaaguucagcaugggugugccuucauacaauaauauuuuucucuuug

SEQ ID NO: 92140 - RNA, 64 nt, hsa
uuuuuuucuuuuuugauaaaaaagcaaauaauauugccuucagauuauuucuucaaaauauaac

SEQ ID NO: 92141 - RNA, 64 nt, hsa
gaauaaagaaacagacuuuugaguuuauaugcaaugccuucauuagguaccaccggcacuuaca

SEQ ID NO: 92142 - RNA, 64 nt, hsa
cccaauguuuguaaauucacaguauuuggaaaacugccuucauuuuccagugugggaaaaacuc

SEQ ID NO: 92143 - RNA, 64 nt, hsa
agagauuauucucaccaacccgcugccuucaugcugccuucaaagcuagaucauguuugccuug

SEQ ID NO: 92144 - RNA, 64 nt, hsa
uucucuuaaggagagauuauucucaccaacccgcugccuucaugcugccuucaaagcuagauca

SEQ ID NO: 92145 - RNA, 64 nt, hsa
gcagaccagggguuaccagccucacagcugcagcugccuucaagccuguaggauccacuggcgu

SEQ ID NO: 92146 - RNA, 64 nt, hsa
uuuggugugagcuuuuuguuuguuuguuuaguuuugccuucauagguuauaugccaagauagua

SEQ ID NO: 92147 - RNA, 64 nt, hsa
ccacugccacagggguauucugccuucaggacucugccuucaggaacacgggucuguagagggu

SEQ ID NO: 92148 - RNA, 64 nt, hsa
cacucugagcugugccacugccacagggguauucugccuucaggacucugccuucaggaacacg

SEQ ID NO: 92149 - RNA, 64 nt, hsa
gcucaaaagcuguugggaacgccuucugaacaguugccuucagaacuaguuugagcugcucaau

SEQ ID NO: 92150 - RNA, 64 nt, hsa
uggcuggugaaaccauauaaucacagaaaaacauugccuucagcauguucaguucgcagcacug

SEQ ID NO: 92151 - RNA, 64 nt, hsa
ggagccguggggggacagcgacugggggccuccaugccuucaccacgcgcucuacggaggcuuc

SEQ ID NO: 92152 - RNA, 64 nt, hsa
agccccacgaguccccaccucucagugcugacggugccuucauguccccgccggcccugccccu

SEQ ID NO: 92153 - RNA, 64 nt, hsa
auaaggucccugcuccacccgaccccaccugcggugccuucagccccaaccaaagacacuagug

SEQ ID NO: 92154 - RNA, 64 nt, hsa
uuccugagcuuucuccugucgguuuggucuguuuugccuucacccauaagccccucgcacucug

SEQ ID NO: 92155 - RNA, 64 nt, hsa
gccggcugccuaccaggggccuuccuguguggccugccuucaccccacucagcucaccucuccc

SEQ ID NO: 92156 - RNA, 64 nt, hsa
auauaauguguguuguaaauauccugugguuuucugccuucaccaguaugaggguagccucgga

SEQ ID NO: 92157 - RNA, 64 nt, hsa
cuuaagauuguccacauccuucaugcaagacugcugccuucauguaacccugggcacagugugu

SEQ ID NO: 92158 - RNA, 64 nt, hsa
ucuuuuuccaguaggagagaaguuugcugaggaaugccuucaagcacaaagugaugaaugacug

SEQ ID NO: 92159 - RNA, 64 nt, hsa
gaggaaugccuucaagcacaaagugaugaaugacugccuucaagucucaagaaaacacuuuucc

SEQ ID NO: 92160 - RNA, 64 nt, hsa
uuacacagacccaaacaaaaaaauaauaaucaaaugccuucaauuucugagaaaaugaggcaga

SEQ ID NO: 92161 - RNA, 64 nt, hsa
ucaacaccuuuuuguuaguaaucauugccaguagugccuucaucaguuaagggaggugucccag

SEQ ID NO: 92162 - RNA, 64 nt, hsa
cuucauauaacaugcuucgugccaucaugauccuugccuucauauaacaaacaugcuucgucag

SEQ ID NO: 92163 - RNA, 64 nt, hsa
gccuucauauaacaugcuucgugcucauggucauugccuucauauaacaugcuucgugccauca

SEQ ID NO: 92164 - RNA, 64 nt, hsa
aaaguauuuugguggcagcugccaucauggucauugccuucauauaacaugcuucgugcucaug

SEQ ID NO: 92165 - RNA, 64 nt, hsa
uuuuuuuucacugccuucauuauguaucuucucuugccuucauuauuuuauuuuauuauuucuu

SEQ ID NO: 92166 - RNA, 64 nt, hsa
ccauuguuccuacauuuuguagguuuuuuuucacugccuucauuauguaucuucucuugccuuc

SEQ ID NO: 92167 - RNA, 64 nt, hsa
gauaugagcuggagugcaaggaguccuuccacccugccuucagguucucucuggagaaagguua

SEQ ID NO: 92168 - RNA, 64 nt, hsa
gucccuccgcacucuccaucagcaaccucacaccugccuucagacccggcugcaacuuccuaag

SEQ ID NO: 92169 - RNA, 64 nt, hsa
aggugaagaaugucuggcuccagcccuuucucugugccuucagcagccccuguccucaccaugg

SEQ ID NO: 92170 - RNA, 64 nt, hsa
accaggcuggaacccaagccccuuccuccacagcugccuucaguggguagaauggggccagggc

SEQ ID NO: 92171 - RNA, 64 nt, hsa
gcccugggcagccccaccucacagccagagucaaugccuucaugggaagggcucccagccacac

SEQ ID NO: 92172 - RNA, 64 nt, hsa
ugucccacagggaguagcaagacccaccccacacugccuucaccaucuacaccagugacgccgc

SEQ ID NO: 92173 - RNA, 64 nt, hsa
gcugaggugucaggaggggacuucuggcccaccuugccuucagcccuggagugggcagagagua

SEQ ID NO: 92174 - RNA, 64 nt, hsa
cuggaguagagcgagcccagcagcccuaaaaggcugccuucauggccaucuagccccaguucag

SEQ ID NO: 92175 - RNA, 64 nt, hsa
aaguggggucuggccugggaggaggucugauaagugccuucaaggagcuuacguucuaguuagg

SEQ ID NO: 92176 - RNA, 64 nt, hsa
ucaaggagcuuacguucuaguuagggaaauuggaugccuucacaaggcucagugacaaaccuga

SEQ ID NO: 92177 - RNA, 64 nt, hsa
gauuuuuaucuucuguagagcuagccgcccugacugccuucagaccuggcccuguagcuuuucu

SEQ ID NO: 92178 - RNA, 64 nt, hsa
uugccuacccucuguccugccuuguuauuguaagugccuucaauacuuugcauuuugggauaau

SEQ ID NO: 92179 - RNA, 64 nt, hsa
gagaauccagaccaucuuggggcagccaggcccuugccuucauuuuuacagagguagcacaacu

SEQ ID NO: 92180 - RNA, 64 nt, hsa
ugaguccaguccccgcccccaaacccagcccaggugccuucagcuacuucggcuucuuaaaccc

SEQ ID NO: 92181 - RNA, 64 nt, hsa
gacccauuccauuaaacuacauuauaaaccuuguugccuucacccuucagccucccgcuccagg

SEQ ID NO: 92182 - RNA, 64 nt, hsa
gcauagauagcuagaacauaaugugagcaguguuugccuucagguggugggguuauggguaguu

SEQ ID NO: 92183 - RNA, 64 nt, hsa
ccagucugggaugaaacuagaguggucucagaagugccuucaggacaauaaguggaacuacauu

SEQ ID NO: 92184 - RNA, 64 nt, hsa
cugaaguggaaggauggucucaggguucugaucuugccuucauguggaccuucaucacuaccuc

SEQ ID NO: 92185 - RNA, 64 nt, hsa
gaaugcaggccaguuacuuaaaaggucuucagauugccuucaguucacagugccucugcaacag

SEQ ID NO: 92186 - RNA, 64 nt, hsa
uuccauaaccaucacugugccacuggguggagugugccuucagggcaucuugaaaugucccgcu

SEQ ID NO: 92187 - RNA, 64 nt, hsa
aagaugcuuucagugaugcucucuauacucauaaauaagcaaauguggcaggcuuugcuuucug

SEQ ID NO: 92188 - RNA, 64 nt, hsa
caccuuuauguauuuucuuaaagcacgccuuuaaauaagcaaaaacuuuaaaaggcaggaaaga

SEQ ID NO: 92189 - RNA, 64 nt, hsa
aaaaguugccuuucuuuuuuuaugaccuggauauauaagcaaaucagcuaggaaauauauaauu

SEQ ID NO: 92190 - RNA, 64 nt, hsa
ccucaagcaacaauugcuagaguaacaucuuuguauaagcaaguaaccccagauagaguugacg

SEQ ID NO: 92191 - RNA, 64 nt, hsa
uuggugacuuugcuucacuacagguuaaaagaccauaagcaaacugguuauuuaaaauguaaaa

SEQ ID NO: 92192 - RNA, 64 nt, hsa
gaaaaugauaaaagcuaagaugccuucuaacuucauaagcaaaccuuuaacuaauuauguaucu

SEQ ID NO: 92193 - RNA, 64 nt, hsa
uuuuccuccuuucggagucaaggaaagccuuucuauaagcaaauuaaggaagaaaagguaggau

SEQ ID NO: 92194 - RNA, 64 nt, hsa
aucucccacuucagccucccgaguaucugggauuauaagcaagagccacugcucccagcucaug

SEQ ID NO: 92195 - RNA, 64 nt, hsa
uucguuauuuuaucuugucauuuacaacauccauauaagcaacuagccauauaagcaaaauuca

SEQ ID NO: 92196 - RNA, 64 nt, hsa
gucauuuacaacauccauauaagcaacuagccauauaagcaaaauucauagaacuacuaaugac

SEQ ID NO: 92197 - RNA, 64 nt, hsa
aacuuguaaaccacaucuuuuuugcacuuuuuuuauaagcaaaaacgugccguuuaaaccacug

SEQ ID NO: 92198 - RNA, 64 nt, hsa
gaaaacaucuuuguacauuuaagucuguauuauaauaagcaaaaagauuguguguauguauguu

SEQ ID NO: 92199 - RNA, 64 nt, hsa
uagaagaagcuggugagagugcccuccuacauaaauaagcaauugcaguguuuugcaugcaaaa

SEQ ID NO: 92200 - RNA, 64 nt, hsa
aguggcugcugugauguaaacuuagggugcugagauaagcaauuagcucuagccuucugccuua

SEQ ID NO: 92201 - RNA, 64 nt, hsa
uuuuuucuuaaccuacuaauaguuuguugaucugauaagcaagagugggcgggugagaaaaacc

SEQ ID NO: 92202 - RNA, 64 nt, hsa
uuaaaacucaacauuacuguuaacugugcguuaaauaagcaaauaaacaguggcucauaaaaau

SEQ ID NO: 92203 - RNA, 64 nt, hsa
gaagaucauuuuguauacagagaaccggaugaauauaagcaaugaagaugaacauuuauugauc

SEQ ID NO: 92204 - RNA, 64 nt, hsa
ugaagaagagaaauggauguuuccaaauuccacaauaagcaauauguggugauaaugaaaagaa

SEQ ID NO: 92205 - RNA, 64 nt, hsa
uaucuccuagagcaauuuagagcuaaaaccaguaauaagcaaaguuauugguuauaagcaaggu

SEQ ID NO: 92206 - RNA, 64 nt, hsa
gagcuaaaaccaguaauaagcaaaguuauugguuauaagcaagguauaagcaguuaaagcaaag

SEQ ID NO: 92207 - RNA, 64 nt, hsa
aagagaaguuugauaugagcaguuagaaguuggaauaagcaauuucuacuauauauugcauuuc

SEQ ID NO: 92208 - RNA, 64 nt, hsa
uuggaggcuaucuggauuuuaaccugcacuugauauaagcaauaaauauugugguuuuaucuac

SEQ ID NO: 92209 - RNA, 64 nt, hsa
agccauccugcucugaugaggacaauuuccagguauaagcaaggggcuuugugacaaaaaugua

SEQ ID NO: 92210 - RNA, 64 nt, hsa
uggucaaucucuccacugaggcaauuuggaaucaauaagcaauugauaauaguuuggaguaagg

SEQ ID NO: 92211 - RNA, 64 nt, hsa; identical to SEQ ID NO: 58746

SEQ ID NO: 92212 - RNA, 64 nt, hsa; identical to SEQ ID NO: 58747

SEQ ID NO: 92213 - RNA, 64 nt, hsa; identical to SEQ ID NO: 58748

SEQ ID NO: 92214 - RNA, 64 nt, hsa; identical to SEQ ID NO: 58749

SEQ ID NO: 92215 - RNA, 64 nt, hsa; identical to SEQ ID NO: 58750

SEQ ID NO: 92216 - RNA, 64 nt, hsa; identical to SEQ ID NO: 58751

SEQ ID NO: 92217 - RNA, 64 nt, hsa; identical to SEQ ID NO: 58752

SEQ ID NO: 92218 - RNA, 64 nt, hsa; identical to SEQ ID NO: 58753

SEQ ID NO: 92219 - RNA, 64 nt, hsa; identical to SEQ ID NO: 58754

SEQ ID NO: 92220 - RNA, 64 nt, hsa; identical to SEQ ID NO: 58755

SEQ ID NO: 92221 - RNA, 64 nt, hsa; identical to SEQ ID NO: 58756

SEQ ID NO: 92222 - RNA, 64 nt, hsa; identical to SEQ ID NO: 58757

SEQ ID NO: 92223 - RNA, 64 nt, hsa; identical to SEQ ID NO: 58758

SEQ ID NO: 92224 - RNA, 64 nt, hsa; identical to SEQ ID NO: 58759

SEQ ID NO: 92225 - RNA, 64 nt, hsa; identical to SEQ ID NO: 58760

SEQ ID NO: 92226 - RNA, 64 nt, hsa; identical to SEQ ID NO: 58761

SEQ ID NO: 92227 - RNA, 64 nt, hsa; identical to SEQ ID NO: 58762

SEQ ID NO: 92228 - RNA, 64 nt, hsa; identical to SEQ ID NO: 58763

SEQ ID NO: 92229 - RNA, 64 nt, hsa
uuaguguggaagauauagguuaaaauaaacuaugcuguuuuauuuaucuucccaaccugauugg

SEQ ID NO: 92230 - RNA, 64 nt, hsa
ggggcagugggagggcuugggcuuuuagccacagcuguuuuaagacuucugaucuccugcccug

SEQ ID NO: 92231 - RNA, 64 nt, hsa
uuaugccuuuaggauaauuuuguaucuuucuaaucuguuuuaucauugcuacagguuuuuaaaa

SEQ ID NO: 92232 - RNA, 64 nt, hsa
guacaguauguaauagugggucugcugcuacuuucuguuuuaaggugugagguaacaauucaau

SEQ ID NO: 92233 - RNA, 64 nt, hsa
uaauacacaguacuuuauuguacagacuguuuuacuguuuuaauuguaguucuguguacuuuuu

SEQ ID NO: 92234 - RNA, 64 nt, hsa
ggcacuguuaauacacaguacuuuauuguacagacuguuuuacuguuuuaauuguaguucugug

SEQ ID NO: 92235 - RNA, 64 nt, hsa
uauguagcuucuguuaauauuaaguguuuuuugucuguuuuaccucaauuugaacagauaaguu

SEQ ID NO: 92236 - RNA, 64 nt, hsa
ucaaguaugagucccucaggaaaaaaaaaaaauucuguuuuaaaaagcaaucugauucuuagcu

SEQ ID NO: 92237 - RNA, 64 nt, hsa
acuugaugacccccaaccaaguggcucccacacccuguuuuacaaaaaagaaaagaccagucca

SEQ ID NO: 92238 - RNA, 64 nt, hsa
ggugcaaaguucccuacuuccugugacuucagcucuguuuuacaauaaaaucuugaaaaugccu

SEQ ID NO: 92239 - RNA, 64 nt, hsa
auuuaaaaaaccacuaaagugauacuuuauacuucuguuuuacucccuaguggguuuucuuuaa

SEQ ID NO: 92240 - RNA, 64 nt, hsa
uagugcuauaauucuggauaguuccuuuuuaguacuguuuuaugaagcuuuaucaacuuggcuu

SEQ ID NO: 92241 - RNA, 64 nt, hsa
uuuuuucuucuuaguucugcauuagaaauggcaucuguuuuaggucucaaaauauaacucagcu

SEQ ID NO: 92242 - RNA, 64 nt, hsa
augaacuauuccauuacugcagagauuuaaguaucuguuuuaauaagcucuuuuuguuauuuaa

SEQ ID NO: 92243 - RNA, 64 nt, hsa
cauugggauauuaaaauauuagccaaauuucucucuguuuuauauaugucuguuuauuucaguu

SEQ ID NO: 92244 - RNA, 64 nt, hsa
ucaguuugugguuucugcaaauuuguaacugccucuguuuuaggaguauaaguauuacuuccuu

SEQ ID NO: 92245 - RNA, 64 nt, hsa
uuuuuuuacuacuaagcuuuuacaaaagaaguaucuguuuuauuguauagaacaaguacagcau

SEQ ID NO: 92246 - RNA, 64 nt, hsa
guauguuaccuguacuuaggcuucaaauugaagccuguuuuauguguaaaaucagaugcuugca

SEQ ID NO: 92247 - RNA, 64 nt, hsa
uuguaaaagugaaauauguaauagccacacuucacuguuuuaaaauaaaagugcaauuucaagu

SEQ ID NO: 92248 - RNA, 64 nt, hsa
auuggauuacauuaaguuggaauugugauuaugucuguuuuaguuguuuaaaagaauuuuccua

SEQ ID NO: 92249 - RNA, 64 nt, hsa
cccuuuuugaaacaagugucuugguuaacuaauucuguuuuaugguugugcuaaauucauagca

SEQ ID NO: 92250 - RNA, 64 nt, hsa
guuaauugccucaggauauuucuuuuaaaauaagcuguuuuaagaggaacagaagggaaaucug

SEQ ID NO: 92251 - RNA, 64 nt, hsa
acuaugagguacuguugugaguuauuugcuuauccuguuuuauucugaaaaaugaaagugcuca

SEQ ID NO: 92252 - RNA, 64 nt, hsa
aauauagacaagaugucucuagagacucaaacuacuguuuuauuaaaaaaguaaacaccugagc

SEQ ID NO: 92253 - RNA, 64 nt, hsa
ugugugugugucuuuaguaggaaauggaagaacacuguuuuauuuuuuaaaguguuuaauguuu

SEQ ID NO: 92254 - RNA, 64 nt, hsa
cuuacacauuaauguuacuagcaucaggagcuuacuguuuuauuaugauucaucuucaguaauu

SEQ ID NO: 92255 - RNA, 64 nt, hsa
aaaaaaucuguguuuguaguguggaaguuggugacuguuuuaaucaucaucuagacuuguuaag

SEQ ID NO: 92256 - RNA, 64 nt, hsa
uaucuuaauuuuauuuauaaguuuugguguuuaccuguuuuaaaaugauaauguuggcaucugu

SEQ ID NO: 92257 - RNA, 64 nt, hsa
uaaaggaaauuugugcauuauaaaugcaauaucacuguuuuaaacuugacuguuuuauauuauu

SEQ ID NO: 92258 - RNA, 64 nt, hsa
cauuauaaaugcaauaucacuguuuuaaacuugacuguuuuauauuauuuuugugugaucaagu

SEQ ID NO: 92259 - RNA, 64 nt, hsa
gccuacagauuuuacauuuuaaaauuaucuauggcuguuuuaaauugucuagcaauuuauaugg

SEQ ID NO: 92260 - RNA, 64 nt, hsa
ccaucguuaugauggaaggcugcuuugaaaauggcuguuuuaccuuauaagguuaaaauuuuga

SEQ ID NO: 92261 - RNA, 64 nt, hsa
auauuacccaaguuucuucaugaguugacaugagcuguuuuaaauacugguguauuuucagaac

SEQ ID NO: 92262 - RNA, 64 nt, hsa
gucuuuagcuuuucuaugugauugugccgucauucuguuuuaagcucauggaucaauggauuug

SEQ ID NO: 92263 - RNA, 64 nt, hsa
ccuguguuuuugugaaagccucacuguggcuccucuguuuuacauacucauuaguaagugggag

SEQ ID NO: 92264 - RNA, 64 nt, hsa
cuguuuugugucuuacgugaaauuucacuguagacuguuuuaaauugccaagacugcacaaaau

SEQ ID NO: 92265 - RNA, 64 nt, hsa
caggacuuuuuuuucaaaaugaaauauuuauguacuguuuuaugguaugugguagaguaaguaa

SEQ ID NO: 92266 - RNA, 64 nt, hsa
uacaauuuaguuuucaaaaaaaaaaugcaggaaacuguuuuaucagggagcccaaacacccagc

SEQ ID NO: 92267 - RNA, 64 nt, hsa
uugauauuuggcuuauaaaguaauuuuuaugaaucuguuuuaugaguuagguaagauuuagccu

SEQ ID NO: 92268 - RNA, 64 nt, hsa
uuucuauuuaaaaauuacaaaaaugaacccaagucuguuuuaagauauuuguguaauacuuaaa

SEQ ID NO: 92269 - RNA, 64 nt, hsa
guuugauauuaaguuuguaaauuuaauuuuaaugcuguuuuaaugggguugaaaacaagcagcu

SEQ ID NO: 92270 - RNA, 61 nt, hsa
cugagcacccuucagauuaagcgucagcuuccuguuuuauagguaauuuuuuuuguaauua

SEQ ID NO: 92271 - RNA, 64 nt, hsa
gauuaccaauuucaagugcugccagcuaaaauaacuguuuuaacggguaucuuuuguuuguucu

SEQ ID NO: 92272 - RNA, 64 nt, hsa
aucuuucuuuacucauaauguauuuaagaauuugcuguuuuauuuaacgcugcuacucuuaauc

SEQ ID NO: 92273 - RNA, 64 nt, hsa
gacaaagagaaaugcaguguaguaugcagagcugcuguuuuaaugccuaugcauuuacucuuuc

SEQ ID NO: 92274 - RNA, 64 nt, hsa
uuuuugcaugguuuuuauucuuuccuaauggauccuguuuuauaauacuuccaagccuguccau

SEQ ID NO: 92275 - RNA, 64 nt, hsa
accauggugaccagcuguuacaaaagauuuuuuccuguuuuaucugaaacauacuggauuuaua

SEQ ID NO: 92276 - RNA, 64 nt, hsa
guaacauuuacaaaugacauauugaaagcaaaggcuguuuuauuuagccaagaugauuaccauu

SEQ ID NO: 92277 - RNA, 64 nt, hsa
auauguauagacaacaacaacgacaaaaaauagacuguuuuaaaguuucagggaaaguuggugg

SEQ ID NO: 92278 - RNA, 64 nt, hsa
aaauuaguuuauuaaacauuaccuguaacugugucuguuuuaccaagcuggaaccuugggacuu

SEQ ID NO: 92279 - RNA, 64 nt, hsa
uggagaaaggacacacugguuuuaaucuguagaacuguuuuagaguaauuagcaaucaaacauu

SEQ ID NO: 92280 - RNA, 64 nt, hsa
gaaaaagaaaugucuuucuuguuagugaacaggccuguuuuaaauaucuuaguaugauaucaaa

SEQ ID NO: 92281 - RNA, 64 nt, hsa
cuucagagucaaagggagucugcauguaugggaacuguuuuauagagaauggggcagaggcaca

SEQ ID NO: 92282 - RNA, 64 nt, hsa
aaagauuuuucucuguaagaaaguucugguuaugcuguuuuaaaggugacuugucaggaguuga

SEQ ID NO: 92283 - RNA, 64 nt, hsa
auauggaaaaauaacuuucagauucagcccaguucuguuuuagaguguguuuauucuucucuac

SEQ ID NO: 92284 - RNA, 64 nt, hsa
cuugcaaguuuuuuuuuuuuuuaaaucaugguaccuguuuuaaaaugagaaguuauuauucaua

SEQ ID NO: 92285 - RNA, 64 nt, hsa
ugccugaugaugagucccaagguacauuguucuacuguuuuauacccagguagaaguuacacag

SEQ ID NO: 92286 - RNA, 64 nt, hsa
uuaucugucuaaauagcaaaaucaugaaaaucagcuguuuuauuugcauaggacaacuaaccug

SEQ ID NO: 92287 - RNA, 64 nt, hsa
gaauuuuagcaauauauugauucaggaaaaggagcuguuuuauaaaugaucauucacuguuccu

SEQ ID NO: 92288 - RNA, 64 nt, hsa
auguuacacauguucauguucaccucucauucaccuguuuuauaugguuuaaaauucucuuuaa

SEQ ID NO: 92289 - RNA, 64 nt, hsa
gaauuuuggacagugcccccauauaaggaaguuacuguuuuaaaauaaagcaaacuaacuguuu

SEQ ID NO: 92290 - RNA, 62 nt, hsa
aaggaaguuacuguuuuaaaauaaagcaaacuaacuguuuuauuuuccuuggaccauagugc

SEQ ID NO: 92291 - RNA, 64 nt, hsa
aauuccacaaccaccuugacgaaugcuugccaagcuguuuuaaagccaagaacacccuuucuuu

SEQ ID NO: 92292 - RNA, 64 nt, hsa
aggugcuuuuccuugucugugugccaguugcuggcuguuuuaguugcuugcccuucauuuugcu

SEQ ID NO: 92293 - RNA, 64 nt, hsa
cagaugaacuaagaaagucaccaagugucuuaagcuguuuuauauuuguuacgaagaaggcuau

SEQ ID NO: 92294 - RNA, 64 nt, hsa
aaaugccaaaugcuaaaugcaguguucuuucacacuguuuuaauuuucuugggaaauugagucc

SEQ ID NO: 92295 - RNA, 64 nt, hsa
uucaaaucuucuugucauguaaaaugaagcuagucuguuuuaaaauuuuuaguuuuggauugua

SEQ ID NO: 92296 - RNA, 64 nt, hsa
aaugcagaccauucuaucauaccuggcggggcuucuguuuuauuuuguaggcuggaugcuaccc

SEQ ID NO: 92297 - RNA, 64 nt, hsa
auucccuuuuaaucauaauaguuaacucuacuuacuguuuuaacauacauuugauuuaacaaau

SEQ ID NO: 92298 - RNA, 64 nt, hsa
auuacaggaagcaguccuuacuuacacuucuugucuguuuuagguguacuuguuaauucuuaug

SEQ ID NO: 92299 - RNA, 64 nt, hsa
agaacacaacuaauccauacuuuauuguggaaggcuguuuuauaguuuauuuaauuuuuucucu

SEQ ID NO: 92300 - RNA, 64 nt, hsa
acagccccuugcaguguguuaguuuuagaucacucuguuuuaguugagagaaauguuuuauauc

SEQ ID NO: 92301 - RNA, 64 nt, hsa
auauugugcgcugggggcuugugauguuugugugcuguuuuaaaauucauuucaaauuggacuc

SEQ ID NO: 92302 - RNA, 64 nt, hsa
ccaugucuuccauuugugguacuaaaauuugcuacuguuuuagaccauauuuuccuauuauuua

SEQ ID NO: 92303 - RNA, 64 nt, hsa
uuagaguaauuuuuucucucugccuccuuugugucuguuuuaaaggagacuaacuccaggagua

SEQ ID NO: 92304 - RNA, 64 nt, hsa
guuuggcccugcuguccuacuguuuaauagaaaacuguuuuacauugguuaaugguauuuagag

SEQ ID NO: 92305 - RNA, 64 nt, hsa
ugaggguagugccacuucuuaguauuuuugaaagcuguuuuagauuuuuuuuuuuuuuccuuuu

SEQ ID NO: 92306 - RNA, 64 nt, hsa
cacauuugcuuucuuaugguucaauguacacaaacuguuuuauauagaaaaugauuucaaauau

SEQ ID NO: 92307 - RNA, 64 nt, hsa
uacauuucuauuuuuauaauccauaaggauaugccuguuuuaaauaacauacauauuaacaaua

SEQ ID NO: 92308 - RNA, 64 nt, hsa
uugacaguauuucucagcaucacuauguagcauucuguuuuagcaucuuugaauuaugaucauu

SEQ ID NO: 92309 - RNA, 64 nt, hsa
ucugugguuuugucauauguaaaagucauaacaccuguuuuaaggauugagauuguucauuuac

SEQ ID NO: 92310 - RNA, 64 nt, hsa
uugugauagcaaaccauaaaaacaauuuuaguggcuguuuuacuaauuaaaggacauccacaau

SEQ ID NO: 92311 - RNA, 64 nt, hsa
guaaguuaaauuguauguugcauuuuuuuccaugcuguuuuaacuuguaaauauauauguauac

SEQ ID NO: 92312 - RNA, 64 nt, hsa
uaagagaaagguaagggcucuuuugaauaaacugcuguuuuauuuguggcacaacugaucaauc

SEQ ID NO: 92313 - RNA, 64 nt, hsa
uuggagauuucuauuacugccuuuuuuuuucuuacuguuuuauuacaaacuuacaaaaauaugu

SEQ ID NO: 92314 - RNA, 64 nt, hsa
guuuuauuacaaacuuacaaaaauauguauaacccuguuuuauacaaacuaguuucguaauaaa

SEQ ID NO: 92315 - RNA, 64 nt, hsa
acaugggaaguuuaucgugggagauauccagaaccuguuuuacacugggcuccuacuguguuug

SEQ ID NO: 92316 - RNA, 64 nt, hsa
ugguagucuucacuucuaucuuuuaaguuacaaacuguuuuauauauuugaaucgcuagucacu

SEQ ID NO: 92317 - RNA, 64 nt, hsa
ugugcuuuuucccugggcuuauuugaaaauuuuacuguuuuauacaagcucguuuaguacauuu

SEQ ID NO: 92318 - RNA, 64 nt, hsa
ucccuauacaaaauccaucugcuuuuauacguagcuguuuuaucaucuguagcuucauccuauc

SEQ ID NO: 92319 - RNA, 64 nt, hsa
guuuaaacugcaagauuuuuacuugcuagagaaucuguuuuaauauagugguuuggccucugau

SEQ ID NO: 92320 - RNA, 64 nt, hsa
auggacuguaaaugcauaugcaugauuuccuaaacuguuuuagaacucuccuuaacaaucucaa

SEQ ID NO: 92321 - RNA, 64 nt, hsa
guucauggaagaggcuccucugagggcaagagaccuguuuuagugcugcauucgacauggaaaa

SEQ ID NO: 92322 - RNA, 64 nt, hsa
caguagucuaagaugagagaguuuagggacuacucuguuuuagcaagagauauuuugggggucu

SEQ ID NO: 92323 - RNA, 64 nt, hsa
gcucagaguggauguuaugggauucuuuuuuucucuguuuuaucuuuucaaguggaauuaguug

SEQ ID NO: 92324 - RNA, 64 nt, hsa
uuaaauugcaaagaaagccaugaggucuucaauacuguuuuaccccaucccuugugcauauuuc

SEQ ID NO: 92325 - RNA, 64 nt, hsa
auuguacuuuucgaaccauuuugucucauuauuccuguuuuagcugaagaauuguauuacauuu

SEQ ID NO: 92326 - RNA, 64 nt, hsa
cgcuuuuuccccuccuuaauuuuuauauuccuuacuguuuuacuaaauauuaaguguucuuuga

SEQ ID NO: 92327 - RNA, 64 nt, hsa
aguauuauuuauguguaucgggaguguguuuagucuguuuuauuugcaguaaaccgaucuccaa

SEQ ID NO: 92328 - RNA, 64 nt, hsa
uaauuggcaaugccaagucacugggaccaauuuucuguuuuauaauaucuaaguuuagaacaga

SEQ ID NO: 92329 - RNA, 64 nt, hsa
gauuaaaguaucauguuauuuagccaaugcaaaucuguuuuaaaacaaauaguuuaaaaaaaga

SEQ ID NO: 92330 - RNA, 64 nt, hsa
uucuaauauaggcagcagacuguuuuacggguugcuguuuuaacauggguuuuugucagaucca

SEQ ID NO: 92331 - RNA, 64 nt, hsa
caauuacuggguaauuucuaauauaggcagcagacuguuuuacggguugcuguuuuaacauggg

SEQ ID NO: 92332 - RNA, 64 nt, hsa
uuucucauugguuucuaagucaguagagacagaucuguuuuaagcaguuggggguucgaguaga

SEQ ID NO: 92333 - RNA, 64 nt, hsa
gguggggcuggcugggguauucuuuuaccaaacucuguuuuaccgccagccccuuguacacccc

SEQ ID NO: 92334 - RNA, 64 nt, hsa
ggguucaaggcuagagcugcuggggaggggcugccuguuuuacucacccaccagcuuccgccuc

SEQ ID NO: 92335 - RNA, 64 nt, hsa
ccccagccccucagcccucccagcccacuucugccuguuuuaaacgaguuucucaacuccaguc

SEQ ID NO: 92336 - RNA, 64 nt, hsa
agagacuuuuccuccaccuuccucugugcccgagcuguuuuaucugcauuuuacugucugcuuu

SEQ ID NO: 92337 - RNA, 64 nt, hsa
ccuggagggaaaggaaugugcuuauuaaggcccacuguuuuacuggggcccauuguaugagggu

SEQ ID NO: 92338 - RNA, 64 nt, hsa
aaaguuuaagaagaauaugaccucauuaaaugugcuguuuuauuuggaccagucacacaaaaug

SEQ ID NO: 92339 - RNA, 64 nt, hsa
cccauuuggguaaaauaacggaucugauuagaaacuguuuuaaggaggggcugggcucgguggc

SEQ ID NO: 92340 - RNA, 64 nt, hsa
aaugguacuuaggcgaguaccauuugcacaaucacuguuuuacuuaugagcagauacagauaua

SEQ ID NO: 92341 - RNA, 64 nt, hsa
uccaauaucccccaucuuugucuugaaacaaaaacuguuuuaagacgucuacguugaauuauuc

SEQ ID NO: 92342 - RNA, 64 nt, hsa
uggagugcauugugcacaugaaguauuuauccaccuguuuuauuuucaugaaguucuuagacua

SEQ ID NO: 92343 - RNA, 64 nt, hsa
ucaacuaucauguuaagaauguacaguuuuuaugcuguuuuauuugacuuaaaggcuggaagac

SEQ ID NO: 92344 - RNA, 64 nt, hsa
aguuuugccugcuaaauucuccacauuuuguaaccuguuuuauuucuuuggguguaaagcguuu

SEQ ID NO: 92345 - RNA, 64 nt, hsa
uuaacacugaaguugugguuguuagguucacacccuguuuuauaaacaacaucaaaauggcaga

SEQ ID NO: 92346 - RNA, 64 nt, hsa
ugagugugccuaauacucuccucgacaagucaugcuguuuuaugcagaauaauccaggcgugag

SEQ ID NO: 92347 - RNA, 64 nt, hsa
aacccaugaguccauauguguaauuuuauguugucuguuuuauuauccaggauuucauacucag

SEQ ID NO: 92348 - RNA, 64 nt, hsa
cuguguuggcccucacuugggauucucagcaguuacaugaaaguugugcugauaaucucuucuc

SEQ ID NO: 92349 - RNA, 64 nt, hsa
uuuuauguguguguguauguguguguguugaguaacaugaaacuuggcaguagcagagagcacu

SEQ ID NO: 92350 - RNA, 64 nt, hsa
ucuguugauuuaaauuauuuuuuuccagauuggcacaugaaauauuuaaacuuuuuugugugcc

SEQ ID NO: 92351 - RNA, 64 nt, hsa
uguaaauucuaauguuuaccuuguaccauggaaaacaugaaaagagucuuagaaguaaagaaca

SEQ ID NO: 92352 - RNA, 64 nt, hsa
ggaugcaagugccuacaguauuaucaggaggagaacaugaaaauauuaagacaaaaauccucag

SEQ ID NO: 92353 - RNA, 64 nt, hsa
uaaagaguuuaacuuucuggaacugaaggagaaaacaugaaaauguuuauauugcuucuuguua

SEQ ID NO: 92354 - RNA, 64 nt, hsa
uuuugaaauuggcuuuggaguuuacauauacugaacaugaaaguuuauaauaaugaugauacaa

SEQ ID NO: 92355 - RNA, 64 nt, hsa
uuuuuuuaacacaaguaagugucaccauuuuaugacaugaaauaaaagguuaugacuguuauug

SEQ ID NO: 92356 - RNA, 64 nt, hsa
ucuccucaagcauuuauaaauuuuuccuucaaugacaugaaaacugugcaagcaaaaaccgaag

SEQ ID NO: 92357 - RNA, 64 nt, hsa
guugacccacuuuaguuuauauguuuauuaguaaacaugaaauggggaauaagugauuuuaagu

SEQ ID NO: 92358 - RNA, 64 nt, hsa
agcugauuuuaauggccacaucuaaucucauuucacaugaaagaagaaguauauuuuagaaauu

SEQ ID NO: 92359 - RNA, 64 nt, hsa
guacagcugaaauucagaggacccauaagaguucacaugaaaaaaaucaauuuauuugaaaagg

SEQ ID NO: 92360 - RNA, 64 nt, hsa
gaaaaaucuguggaauguauuauuuguccucuuuacaugaaacuacucauacuuaagcaaaagu

SEQ ID NO: 92361 - RNA, 64 nt, hsa
agaauugagucaauuggaaagacuauccaacuuaacaugaaacuugucaccaugagauagcauu

SEQ ID NO: 92362 - RNA, 64 nt, hsa
acaaggaacaaaacaaagcuuugaaaaaacuuuaacaugaaaaaacgcacugacauuuuuuuuu

SEQ ID NO: 92363 - RNA, 64 nt, hsa
aguggaauuacuuuugcccagaaaaauggcgaauacaugaaacaaccagugaucaugcuuuaga

SEQ ID NO: 92364 - RNA, 64 nt, hsa
guauguacaaagguaaccaucacuccuuaaauccacaugaaaacuacuguaacugaucauguau

SEQ ID NO: 92365 - RNA, 64 nt, hsa
auuuuaaaugcucauaggucuuuccauaucuguaacaugaaaaugauuauucugcauuuuauuc

SEQ ID NO: 92366 - RNA, 64 nt, hsa
acuuuucaaaagaagaccuacaauuggccaacaaacaugaaaaaaugcucaguaucacuaauca

SEQ ID NO: 92367 - RNA, 64 nt, hsa
aaaauuuguaugaugauaauuguauaauaauuauacaugaaagugccaaaacccuacaauuaaa

SEQ ID NO: 92368 - RNA, 64 nt, hsa
gcuauucaaagauauuuuaaauaauauuuuaaaaacaugaaauuuuuuuuucauuuuugauuug

SEQ ID NO: 92369 - RNA, 64 nt, hsa
uccauagugguuaguacuguaauuucuguuuauuacaugaaauuacauuccauuuauccaaaua

SEQ ID NO: 92370 - RNA, 64 nt, hsa
uguuauauuuguacaaucgaguauuuuagaaauuacaugaaacaugaaacaguuuuugcaauuu

SEQ ID NO: 92371 - RNA, 64 nt, hsa
uuuguacaaucgaguauuuuagaaauuacaugaaacaugaaacaguuuuugcaauuuuuuuuaa

SEQ ID NO: 92372 - RNA, 64 nt, hsa
ucaaaaguaauuuauuuuuacagcuucugguuucacaugaaauuguuugcgcuacugagacugu

SEQ ID NO: 92373 - RNA, 64 nt, hsa
gcgcuacugagacuguuacuacaaacuuuuuaagacaugaaaaggcguaaugaaaaccaucccg

SEQ ID NO: 92374 - RNA, 64 nt, hsa
agguaacucuauacaguauuuuaaauaauuuuguacaugaaacaaaguauugauuguggucagg

SEQ ID NO: 92375 - RNA, 64 nt, hsa
cauaaugagguaucuugguaggucucaugucuaaacaugaaauucauucauguuuuauauauac

SEQ ID NO: 92376 - RNA, 64 nt, hsa
caguauaaauuaauuuuucaaaccagagcuguucacaugaaaauauuccuuaguagaauguaua

SEQ ID NO: 92377 - RNA, 64 nt, hsa
uaauuuuaauuccaugaaagucuuaauguuuccaacaugaaaauucucuuacuuaaauacguuu

SEQ ID NO: 92378 - RNA, 64 nt, hsa
ugugugugugugugcauuaaaguuguaaacgguaacaugaaacaaaugaaaguucuugcuauaa

SEQ ID NO: 92379 - RNA, 64 nt, hsa
uuaaaaaaauacuucauagagccugccuuauccaacaugaaauucccuucuuuuguuauucuuu

SEQ ID NO: 92380 - RNA, 64 nt, hsa; identical to SEQ ID NO: 92354

SEQ ID NO: 92381 - RNA, 64 nt, hsa; identical to SEQ ID NO: 92355

SEQ ID NO: 92382 - RNA, 64 nt, hsa; identical to SEQ ID NO: 92355

SEQ ID NO: 92383 - RNA, 64 nt, hsa; identical to SEQ ID NO: 92354

SEQ ID NO: 92384 - RNA, 64 nt, hsa
uggucaaguuaaaaaaaaaaaacaauauuaaacaacaugaaacugcagucuguuuuugaaaaug

SEQ ID NO: 92385 - RNA, 64 nt, hsa
aauuuauuacaguuuacucuaucgcauuucuguaacaugaaaugcaugcccuucuucaggggaa

SEQ ID NO: 92386 - RNA, 64 nt, hsa
guaaguacacgguuucaacgggaguaauaaauucacaugaaaaggagacaauaaucaagucaaa

SEQ ID NO: 92387 - RNA, 64 nt, hsa
uuaaacuccaaaguuugggacauucaaacaauguacaugaaauuauauguguguggugugugaa

SEQ ID NO: 92388 - RNA, 64 nt, hsa
aaacaugcccugaagagaguuguucuuagguuacacaugaaauccuaccgucacuagcccccau

SEQ ID NO: 92389 - RNA, 64 nt, hsa
aaacuacaacuugauaaccccuagaaagaagaggacaugaaaggaugcuggcuauauauguuaa

SEQ ID NO: 92390 - RNA, 64 nt, hsa
augugagaggauggcaugccagaauuaggacacgacaugaaaccagaguggugccucuguccga

SEQ ID NO: 92391 - RNA, 64 nt, hsa
caugaagcugugucuuaaguuacucugaguuuacacaugaaaaggugaacaucaucaaaaaccc

SEQ ID NO: 92392 - RNA, 64 nt, hsa
uuauuuccagauaaauuucuuuauuuuauauuguacaugaaaaguuuuaaagauauguuuaaga

SEQ ID NO: 92393 - RNA, 64 nt, hsa
gcccucagaaagauucugauacccugccuugacaacaugaaacuugaggcugcuuugguucaug

SEQ ID NO: 92394 - RNA, 64 nt, hsa
ugugagguaaacuaccugauuuuuuuuuguuguuacaugaaagaaugagugacaaaucuuuaaa

SEQ ID NO: 92395 - RNA, 64 nt, hsa
cauauauguuguguauaaauguacacuuuuuuagacaugaaagaauugccuuaguugaacaguu

SEQ ID NO: 92396 - RNA, 64 nt, hsa
gguacauuccuaaggguauuuauaguugaugauaacaugaaaacugaaauaagauaaaauacaa

SEQ ID NO: 92397 - RNA, 64 nt, hsa
cuuaccaaguacauccuuaaacaaaguaguauguacaugaaauugcacuuaaccaaaacuauug

SEQ ID NO: 92398 - RNA, 64 nt, hsa
ggaggggcuuuuauucugccaagucauuucaaauacaugaaaaaucuuacacuggagagaaacc

SEQ ID NO: 92399 - RNA, 64 nt, hsa
gaaaagcauuccauaauuucucuucuuugcaaauacaugaaaggaugcacagaggagagaagcu

SEQ ID NO: 92400 - RNA, 64 nt, hsa
gaaaagcauucagcuugccuacuuccuuucauagacaugaaaagacucacacuggaaggaaaca

SEQ ID NO: 92401 - RNA, 64 nt, hsa
ggaaacacuuuuauucugccaaguuauuucaaacacaugaaaaaauucacacuggagagaaacc

SEQ ID NO: 92402 - RNA, 64 nt, hsa
gaaaagcguuccauaauuucucuucuuuucaaauacaugaaaguugcacagaggagaggcgccc

SEQ ID NO: 92403 - RNA, 64 nt, hsa
aacaagcauucaauuauuuuucuuccuugcauauacaugaaaggacucauacgagagagaaucc

SEQ ID NO: 92404 - RNA, 64 nt, hsa
ggaaaggccuuuauucugccaagucauuucgaagacaugaaaaaacucacacuggagagaaacc

SEQ ID NO: 92405 - RNA, 64 nt, hsa
ggaaaggcuuuuauucucccacgucauuucaaagacaugaaaaaacucacacugcagagaaacc

SEQ ID NO: 92406 - RNA, 64 nt, hsa
ggaaagccuuuauuucuuucacuucuuuucgauaacaugaaaggacucacacuggagagaaacc

SEQ ID NO: 92407 - RNA, 64 nt, hsa
gaaagcaugaaauucugucagugccuuuuuuaauacaugaaagaauucuagagagaagccauau

SEQ ID NO: 92408 - RNA, 64 nt, hsa
ggaaagcuuucaaucauuuuaguuccuuucaaauacaugaaagaacucaucauggagaaaacca

SEQ ID NO: 92409 - RNA, 64 nt, hsa
ggaaaacauacauuacucuugcagguuuccagauacaugaaagaacccacacuggagagaaacc

SEQ ID NO: 92410 - RNA, 64 nt, hsa
ggaaagccuuuuauuguugcaguucugcccgaagacaugaaaggaugcacacugcaaagaaaca

SEQ ID NO: 92411 - RNA, 64 nt, hsa
gaaaagcauuuagauacuacuacucagcucaaagacaugaaaggacucauacuggagagaaacc

SEQ ID NO: 92412 - RNA, 64 nt, hsa
ggaaaacuuacuugucuccuuuagguuuucaagcacaugaaaguacucacacuggagauaaacc

SEQ ID NO: 92413 - RNA, 64 nt, hsa
ggaaaguguucguauaucacaacucugcucaaagacaugaaaagacucauacuggagagaaacc

SEQ ID NO: 92414 - RNA, 64 nt, hsa
gaaaaaccuacauaucuucuguagguuuucaagcacaugaaagaacucacacuggagaaaaacc

SEQ ID NO: 92415 - RNA, 64 nt, hsa
ggaaacccuucauuuaccgccauucugcucgagcacaugaaaggaaucacacuguacagaaacg

SEQ ID NO: 92416 - RNA, 64 nt, hsa
gaaaagcauuccgauaccaccaaucugcucaaaaacaugaaaaggcucauacuggagagaaacc

SEQ ID NO: 92417 - RNA, 64 nt, hsa
guaaagccuucacucauucccguuuccuucaaggacaugaaagaacucauaccgcaaagaagcu

SEQ ID NO: 92418 - RNA, 64 nt, hsa
ggaaagcauucucuuggcucacuugccuucuacaacaugaaagaauucacacucgagagaaacc

SEQ ID NO: 92419 - RNA, 64 nt, hsa
gaaaagccuucagucauuuuggucacuuaaagcaacaugaaaggauucacacuggagagaagcc

SEQ ID NO: 92420 - RNA, 64 nt, hsa
ggaaagccuuuguuuauuucauuggauuucaaagacaugaaaggacucacacuagggagaaaau

SEQ ID NO: 92421 - RNA, 64 nt, hsa
cuaaagccuucccugauuacaguucuugucuaagacaugaaaaaacucacacuggagagaaacu

SEQ ID NO: 92422 - RNA, 64 nt, hsa
cuaaagccuuucauuuuuacaguucuuaucuaagacaugaaagaacacguacuggggagaaacu

SEQ ID NO: 92423 - RNA, 64 nt, hsa
caugaguuaguacaugaaaaaauuaugggaaacuacaugaaauauacuguuacguucaauaaac

SEQ ID NO: 92424 - RNA, 64 nt, hsa
gaucucuaaaaaacaaagaauuacaugaguuaguacaugaaaaaauuaugggaaacuacaugaa

SEQ ID NO: 92425 - RNA, 64 nt, hsa
caaccauuccagacugcuuccaauuuucuggaauacaugaaauauagaucaguuauaaguagca

SEQ ID NO: 92426 - RNA, 64 nt, hsa
uuugcucuuagcugucugcucagacagaaccccuacaugaaacagaaacaaaaacacuaaaaau

SEQ ID NO: 92427 - RNA, 64 nt, hsa
cacaaaaguaacuuguuuaucucagucuguacaaaaacaguaaggaggcagaaagccaagcacu

SEQ ID NO: 92428 - RNA, 64 nt, hsa
agcuuaaccuggucugaggugagacuaaacacaaaaacaguagauaaaucucucccuaaaagau

SEQ ID NO: 92429 - RNA, 64 nt, hsa
auuuuaccagaccuugguaaaagaacuauuuuggaaacaguauuuguaaauggaacuaaugcua

SEQ ID NO: 92430 - RNA, 64 nt, hsa
ucuagacuaaaaauauccuugaaagaauaguagcaaacaguaugcaguacuccuguguucuaag

SEQ ID NO: 92431 - RNA, 64 nt, hsa
gcagggucaguuaaugcuacaguuacuguauagcaaacaguauccuuuuuucuccuuccccuag

SEQ ID NO: 92432 - RNA, 64 nt, hsa
uaaaauaaugucccaagccuuuccuuuuagugauaaacaguagcagccugcguuaauugagcac

SEQ ID NO: 92433 - RNA, 64 nt, hsa
aauuuuuauaaggaauacuguuauaucuaaauuuaaacaguauuuauuuuuucaaaaacagcua

SEQ ID NO: 92434 - RNA, 64 nt, hsa
cagagugaguuugucaaaaguaucucauacuuauaaacaguaugagauaggaggauuaaaauau

SEQ ID NO: 92435 - RNA, 64 nt, hsa
auaaaucuagauacucauuaaguagccuuaugacaaacaguaugagauacuuaugacaaacucg

SEQ ID NO: 92436 - RNA, 64 nt, hsa
aucucauacaucugugaaaaagauaaugugaaauaaacaguaaaaaaaaaaaguauguugaugg

SEQ ID NO: 92437 - RNA, 64 nt, hsa
agaacuugaauuaugcauuuauuggcauuaauguaaacaguaaguccuaagcuuugauggaagg

SEQ ID NO: 92438 - RNA, 64 nt, hsa
uaugcuauuguguucagauacuuacaccauaauuaaacaguaaguuauagacuugcugaguuug

SEQ ID NO: 92439 - RNA, 64 nt, hsa
cuauuuuuucauaaaggcauuuguaguacacagaaaacaguaguuucaguaguguaaaagaguu

SEQ ID NO: 92440 - RNA, 64 nt, hsa
aucccauguuugccuggauaaaguuccucauuucaaacaguauacauacuucuuugcaguucau

SEQ ID NO: 92441 - RNA, 64 nt, hsa
ucuuugcaguucauuauaguaaggcuuaaccuguaaacaguaucugauggcccaccuauaaaua

SEQ ID NO: 92442 - RNA, 64 nt, hsa
uuguuuucuuauaugugcaaugaaguggaaugauaaacaguaugccuuuaauuuauauguguuc

SEQ ID NO: 92443 - RNA, 64 nt, hsa
ucuguucacaguauaugaaaauauggaguaauuuaaacaguaaauaaacauucuguggaugcuu

SEQ ID NO: 92444 - RNA, 64 nt, hsa
acccuguuaauaacgcaauuauuucuguguucuuaaacaguauaaauaguuguaaguuugcaug

SEQ ID NO: 92445 - RNA, 64 nt, hsa
uugacugcugggcaugcaugaaguuaagggcaagaaacaguaugccauguguucuguaccauca

SEQ ID NO: 92446 - RNA, 64 nt, hsa
ucacuguuuaccuguuggucuaacagcaaaucauaaacaguaguuuucaacauacuucuaaggc

SEQ ID NO: 92447 - RNA, 64 nt, hsa
ugagauauaauaaaagguguuuaucauaaaaaagaaacaguauuagauuuuggucuccauaauc

SEQ ID NO: 92448 - RNA, 64 nt, hsa
guugauuuaaauccuuucugaauaaagaucagauaaacaguaacugaaggagcauguauagcuc

SEQ ID NO: 92449 - RNA, 64 nt, hsa
gacugccaaauacauaggaauuuucuuucuuaaaaaacaguaaugaagacuauaucuccuuucc

SEQ ID NO: 92450 - RNA, 64 nt, hsa
cucauuaguuuaacucuuaaaacauaguguuguuaaacaguauuuuuugggggcggguggauag

SEQ ID NO: 92451 - RNA, 64 nt, hsa
cggguggauagcuuuuuguucuaucuuguacagaaaacaguaauggaaucacucauguucagaa

SEQ ID NO: 92452 - RNA, 64 nt, hsa
auuauaauaaaaaguuacaggucacuuuaaaagcaaacaguaccacuugaugauuuugcauaaa

SEQ ID NO: 92453 - RNA, 64 nt, hsa
guuccuacugaucagacucuuccaccuaaaaugaaaacaguaaccuucuauauacuguaaauaa

SEQ ID NO: 92454 - RNA, 64 nt, hsa
uggaagggcuguuuuuuaagaaaaaauuuuugguaaacaguauuguguaaaauugcuuuuugua

SEQ ID NO: 92455 - RNA, 64 nt, hsa
auacuccuguugauguuaaauuacuauauaauauaaacaguauguguuuuuauauaucauugug

SEQ ID NO: 92456 - RNA, 64 nt, hsa
ucuucauaaagcaagacaacauuaugacacuuuaaaacaguagcaaagaagucuauuuauuaac

SEQ ID NO: 92457 - RNA, 64 nt, hsa
aauuuucuaaauuuuaguaagagagaagcuuuuaaaacaguacauuccugaauaaaacaacaau

SEQ ID NO: 92458 - RNA, 64 nt, hsa
acaguccacuuaauuagucaaauuagcaauggcuaaacaguaucaaguacugcagaauuuauca

SEQ ID NO: 92459 - RNA, 64 nt, hsa
auauagaccaaagaugguguacucuaauuuuuuaaaacaguaauggaacacaauuuuuuucauu

SEQ ID NO: 92460 - RNA, 64 nt, hsa
acagaccugaggaacuuuacacugaccagcuuuaaaacaguacuuuaaaaggaaaagccuguua

SEQ ID NO: 92461 - RNA, 64 nt, hsa
aagcaguauggcagucauaaaaauuuuggaaccaaaacaguaucuuuuuuuaagcuaaaaaaaa

SEQ ID NO: 92462 - RNA, 64 nt, hsa
aguggcugcaauuacaggcaaccagccugacuuaaaacaguaucuuaagguagauggugauuag

SEQ ID NO: 92463 - RNA, 64 nt, hsa
auauaugaaauaaaauauauucuucuaagcaaagaaacaguacuauucauagaaaacauuaguu

SEQ ID NO: 92464 - RNA, 64 nt, hsa
gauuuuuaaaagcaguucaaguugacaacagcagaaacaguaacaaaaaaaucugcucagaaaa

SEQ ID NO: 92465 - RNA, 64 nt, hsa
acugucaguagaagugagauaagauccucagaggaaacaguaagaagggauaaucauuaagaua

SEQ ID NO: 92466 - RNA, 64 nt, hsa
uacuaacugcccucucccaagauucauuuaguucaaacaguauccguaaacuaggaauaaugcc

SEQ ID NO: 92467 - RNA, 64 nt, hsa; identical to SEQ ID NO: 92463

SEQ ID NO: 92468 - RNA, 64 nt, hsa; identical to SEQ ID NO: 92464

SEQ ID NO: 92469 - RNA, 64 nt, hsa
ccaacaacuccucccccagagaucuggcuggagcccagaaaaagaagcaugugguuuaaaaaau

SEQ ID NO: 92470 - RNA, 64 nt, hsa
guuacuccgagcuuuaucauggaccagaggaaaaccagaaaacugaaaacauuccucugucuug

SEQ ID NO: 92471 - RNA, 64 nt, hsa
agcccugcugucugucugugcccaagcccuuccaccagaaaagcuagucuaggugugagagccc

SEQ ID NO: 92472 - RNA, 64 nt, hsa
acaaaacucucaaaaauguauuucaagucagugaccagaaaaaucccaccccuugcccuuuccc

SEQ ID NO: 92473 - RNA, 64 nt, hsa
uagcugucagugugacuuccuuucccacccacccccagaaaaacagaaagagcaucuggggagc

SEQ ID NO: 92474 - RNA, 64 nt, hsa
uguucucaugcccucaaucuguaaauuuuugucuccagaaaaacccucccaggcaucccauacc

SEQ ID NO: 92475 - RNA, 63 nt, hsa
caccagaaaaaaagaauugaaaauaaucgucacccagaaaauccagaaaacugaagauuucau

SEQ ID NO: 92476 - RNA, 64 nt, hsa
aaaaagaauugaaaauaaucgucacccagaaaauccagaaaacugaagauuucaucaguuggaa

SEQ ID NO: 92477 - RNA, 64 nt, hsa
cauugugacauggcagaaaaagaaagcuguaagcccagaaaacauggucaccuucagcgagaac

SEQ ID NO: 92478 - RNA, 64 nt, hsa
cacauagcucuaaaacuuaauuuaaaauguaauuccagaaaaaaaaagggaauaagcaaagggg

SEQ ID NO: 92479 - RNA, 64 nt, hsa
cugacacgucaaaguaaccuaauguggacaccauccagaaaacuccaguucaugcuggaucuua

SEQ ID NO: 92480 - RNA, 64 nt, hsa
agaagaagcccugcacacagggcaguguccacagccagaaaacuccugcugggcaccaaccacu

SEQ ID NO: 92481 - RNA, 64 nt, hsa
caaggacuuccucuccugcaggccaacugaaauaccagaaaaugacauucugcuuugugagagc

SEQ ID NO: 92482 - RNA, 64 nt, hsa
ccuccccaccccccaggaauacuuuaaguuaugcccagaaaacuuccgagaugaggauguuuuu

SEQ ID NO: 92483 - RNA, 64 nt, hsa
gaauaaguacuccuaaagugaccauuauuagggaccagaaaauuauaucuuggcuaaguaauag

SEQ ID NO: 92484 - RNA, 64 nt, hsa
uaccaugguaauauuugcaaaaggucuggccauaccagaaaaguacaguugagauaguuaagau

SEQ ID NO: 92485 - RNA, 64 nt, hsa
ugaauccaaacaauguguuaaguaauauuuagggccagaaaaaucuuguacagaauaaugauuu

SEQ ID NO: 92486 - RNA, 64 nt, hsa
ugaagcuggaaagugugcauuggacaucuggaagccagaaaagacaaagaaauauccagaaagg

SEQ ID NO: 92487 - RNA, 64 nt, hsa
gcccagcuugcucagucaaggggcugccaggcccccagaaaacacuuggagccaucggguagcg

SEQ ID NO: 92488 - RNA, 64 nt, hsa
aacacgagacaaaacaauccauauguuuagggaaccagaaaaguccccuggucugucccuucuu

SEQ ID NO: 92489 - RNA, 64 nt, hsa
uuuuuuggcuuugggaaaagucaaaauaaaacaaccagaaaaccccugaaggaaguaagauguu

SEQ ID NO: 92490 - RNA, 64 nt, hsa
aauuuuugaagaccaaaugugaugcaugguggauccagaaaacaaaaaguaggauacuuacaau

SEQ ID NO: 92491 - RNA, 64 nt, hsa
uagauccgagggcagcagugcuggguggagagagccagaaaacagaucuggaggcagcagugcu

SEQ ID NO: 92492 - RNA, 64 nt, hsa
gggcuaaauuaauuggaguggggcgaggagagagccagaaaacauagauccgagggcagcagug

SEQ ID NO: 92493 - RNA, 64 nt, hsa
cacucaacauaaccacaggccaauuuguuggccaccagaaaaccgcuuuuuaaaaaaacacuug

SEQ ID NO: 92494 - RNA, 64 nt, hsa
uguuaacacaaaacugccaacuuugcacaaguuuccagaaaagaaaauacaauuagucacucaa

SEQ ID NO: 92495 - RNA, 64 nt, hsa
augaggcucugauuuccuaucccaguuuagggcuccagaaaagccauucucccaaacuaaugau

SEQ ID NO: 92496 - RNA, 64 nt, hsa
auggccaaugauguauacauguauuuuaguaaauccagaaaagaagacuaaggggacaggugaa

SEQ ID NO: 92497 - RNA, 64 nt, hsa
ucacugguggaaacguuaggauaagcaagaauugccagaaaauaaaguagacagaucuuucucu

SEQ ID NO: 92498 - RNA, 64 nt, hsa
aucauucccagaaacauuucccagaaaauguuucccagaaaacuagacagaaugaucauucaau

SEQ ID NO: 92499 - RNA, 64 nt, hsa
aacaaggcagaaugaucauucccagaaacauuucccagaaaauguuucccagaaaacuagacag

SEQ ID NO: 92500 - RNA, 64 nt, hsa
accauuuacuagauuagccaaauagucugaauuuccagaaaacaaggcagaaugaucauuccca

SEQ ID NO: 92501 - RNA, 64 nt, hsa
cuagcuuauuccaaauuauuugucuuauuaaucaccagaaaauggucauaucaaauguucuuuc

SEQ ID NO: 92502 - RNA, 64 nt, hsa
uucugcacaguccugccucuuagauuacagucagccagaaaaacauacuuauaaaucaucccuu

SEQ ID NO: 92503 - RNA, 64 nt, hsa
aaagugucacaaugcuccuccugaugacuccuccccagaaaaccaccaaucggcuuucauuuug

SEQ ID NO: 92504 - RNA, 64 nt, hsa
uauucuuugucacuugggugccaaacaugagagcccagaaaacugucauuuagcuggcugcaga

SEQ ID NO: 92505 - RNA, 64 nt, hsa
auuuucaacuucaagucauugcaguuucuuuuucccagaaaacaagggguuagauguugcauuu

SEQ ID NO: 92506 - RNA, 64 nt, hsa
ucuccugacuuguauuguggcagucugaacgcccccagaaaauugugccaaagaguuuagaaaa

SEQ ID NO: 92507 - RNA, 64 nt, hsa
gcauaacaaaggacauggaagaagauuccagaugccagaaaaccucugucagacgcccacuggc

SEQ ID NO: 92508 - RNA, 64 nt, hsa
uuuuuuuuuuuuaacgaugcaguauuugugcguuccagaaaagggcccagcucugagccccuca

SEQ ID NO: 92509 - RNA, 64 nt, hsa
ugucucaaaaaaaaaaagaaaagaaaagaaaaagccagaaaaaguuggugccccugaacccaag

SEQ ID NO: 92510 - RNA, 64 nt, hsa
agagggacagagccaaaaggauagagaaagagacccagaaaaaggaagagguggaaacccagag

SEQ ID NO: 92511 - RNA, 64 nt, hsa
ggggaaauguugagcucaaauggguaaauugagaccagaaaauuauuuuuucaaccuagagaau

SEQ ID NO: 92512 - RNA, 64 nt, hsa
uggauauuauucaagcugcaagucaucaaaagacccagaaaaaaaaaagucuguagguuauuuu

SEQ ID NO: 92513 - RNA, 64 nt, hsa
guaucuaugucucgacuuuucugaugaaguuauaccagaaaaguuaauuauuugaugggccugc

SEQ ID NO: 92514 - RNA, 64 nt, hsa
aaguuaauuauuugaugggccugccaugugaaaaccagaaaauaaccucguacucacaagccag

SEQ ID NO: 92515 - RNA, 64 nt, hsa
gagcuucugacuaguucagacugccacgccaaccccagaaaauaccccacaugccagaaaagug

SEQ ID NO: 92516 - RNA, 64 nt, hsa
acugccacgccaaccccagaaaauaccccacaugccagaaaagugaaguccuagguguuuccau

SEQ ID NO: 92517 - RNA, 64 nt, hsa
uauuuuccaacugaagucagggacauugccagcuccagaaaacauccauaacauaguaaagacu

SEQ ID NO: 92518 - RNA, 64 nt, hsa
aaguaccagaguugguggaauuccugaggugcuuccagaaaaccuuauuauuuuaugugagccu

SEQ ID NO: 92519 - RNA, 64 nt, hsa
aacuagaaauuauauuagaacucaaauucaauguuauacauacuugguaaacauuuauuuaaaa

SEQ ID NO: 92520 - RNA, 64 nt, hsa
aaaauguauccaagccauuuaaaaaauauuuauauauacauaguagcaaauaguuuuauagauu

SEQ ID NO: 92521 - RNA, 64 nt, hsa
cagauguguguguauauauauauauacauacacauauacauaaauuuucagcuauuucuguucc

SEQ ID NO: 92522 - RNA, 64 nt, hsa
uguauguauauacagauguguguguauauauauauauacauacacauauacauaaauuuucagc

SEQ ID NO: 92523 - RNA, 64 nt, hsa
uuuucuuuucccuccuccauguucuucuaaaacauauacauauauacauacacacauacacaua

SEQ ID NO: 92524 - RNA, 64 nt, hsa
ucccuccuccauguucuucuaaaacauauacauauauacauacacacauacacauauucuucag

SEQ ID NO: 92525 - RNA, 64 nt, hsa
uaucagauauaguaaauuuauauauauacauauauauacauaaaaauuauguauaauggacaga

SEQ ID NO: 92526 - RNA, 64 nt, hsa
cuaaaggaacuaucagauauaguaaauuuauauauauacauauauauacauaaaaauuauguau

SEQ ID NO: 92527 - RNA, 64 nt, hsa
gucccucaguaacguuaagugcuaguugugauuuuauacauaaaggccagaagcugucugaggc

SEQ ID NO: 92528 - RNA, 64 nt, hsa
uuucuucaucuuuuauaacaagaaaguaucuauauauacauauguaaauauuuauauauagaua

SEQ ID NO: 92529 - RNA, 64 nt, hsa
uuuguuacuuaaaugcauuauauaaacuccuauguauacauaagguauuaaugauauaguuauu

SEQ ID NO: 92530 - RNA, 64 nt, hsa
uaauuaauaaaaccugugcuugaucugacauuuguauacauaaaaguuuacaugaauuuuacaa

SEQ ID NO: 92531 - RNA, 64 nt, hsa
auugauguuuccagaaaauauaaaugcaugauuuuauacauagucacaaaaauggugguuuguc

SEQ ID NO: 92532 - RNA, 64 nt, hsa
uaucaauucaacacauuacuugcacaagcuuguauauacauauuauaaauaaaugccaacauac

SEQ ID NO: 92533 - RNA, 64 nt, hsa
uccuauuuuaaaaccaugcagcuucaucaauuuuuauacauaucagaaaaguagaauuauaucu

SEQ ID NO: 92534 - RNA, 64 nt, hsa
uacagagugguaaauaucuauguuacauguagauuauacauauauauacacacguguauaugag

SEQ ID NO: 92535 - RNA, 64 nt, hsa
uauaucuuauaucuccacaaacacaaauuauauauauacauauccacacacauacauuacauau

SEQ ID NO: 92536 - RNA, 64 nt, hsa
agcaacaaucagaguagaaaaaucuguugccugauauacauaacaccaaucagaccguguggau

SEQ ID NO: 92537 - RNA, 64 nt, hsa
gguguguguauauauauauauauuuaugcaucuauauacauauacuagaucuggacacacgcau

SEQ ID NO: 92538 - RNA, 64 nt, hsa
ugcucccuuuaaccauauaauuaaauuacaaagguauacauaauuaaucuaauaaaggaucaug

SEQ ID NO: 92539 - RNA, 64 nt, hsa
agaauugaaccaagaggcauuauacauauagauauauacauauguaaugugugcguaucauguc

SEQ ID NO: 92540 - RNA, 64 nt, hsa
ugaaacuucauuauagaauugaaccaagaggcauuauacauauagauauauacauauguaaugu

SEQ ID NO: 92541 - RNA, 64 nt, hsa
uuugggaaauauauauguuucugugauauacauauauacauauauauguauauauauacacaca

SEQ ID NO: 92542 - RNA, 64 nt, hsa
aagaaaaauuugggaaauauauauguuucugugauauacauauauacauauauauguauauaua

SEQ ID NO: 92543 - RNA, 64 nt, hsa
ugcuuguguguguaaauguguguacauauacauauauacauaucuacacauacauauauacaca

SEQ ID NO: 92544 - RNA, 64 nt, hsa
gacuuguaugcuuguguguguaaauguguguacauauacauauauacauaucuacacauacaua

SEQ ID NO: 92545 - RNA, 64 nt, hsa
auuuccuuucuaguaucuucucaaguuggaaaaauauacauacaguccuccuucaccuuacucu

SEQ ID NO: 92546 - RNA, 64 nt, hsa
aaauacacagacuaucacuaaaauaauaguuauauauacauacagguguauacuuaugcaugca

SEQ ID NO: 92547 - RNA, 64 nt, hsa
aaauaacuccuuuuuacaugaucauuuauaucuauauacauauauauacuugcauacacuauca

SEQ ID NO: 92548 - RNA, 64 nt, hsa
ugcacauuguaaauacauuauucuuggauaauucuauacauaaaaguuccuacuuguuaaaaaa

SEQ ID NO: 92549 - RNA, 64 nt, hsa
aagauguauaagguuuuuugccagaaauguacuguauacauaguuuuaaguauaacagauuuua

SEQ ID NO: 92550 - RNA, 64 nt, hsa
agucacagccaaaugcuuccauuuguaaucaaguuauacauaauuauaaccgagggcuggcguu

SEQ ID NO: 92551 - RNA, 64 nt, hsa
guuuuauauauauauacguauacauaucuguauauauacauauauauauauauaaauauaaaua

SEQ ID NO: 92552 - RNA, 64 nt, hsa
cuguaauuaaacuucuguuuuauauauauauacguauacauaucuguauauauacauauauaua

SEQ ID NO: 92553 - RNA, 64 nt, hsa
uacauacauacauauauauauauauauacauauauauacauacacacauacauauaauuuuuuu

SEQ ID NO: 92554 - RNA, 64 nt, hsa
cacacacacauacauacauacauauauauauauauauacauauauauacauacacacauacaua

SEQ ID NO: 92555 - RNA, 64 nt, hsa
uacacguauguauagaugugugaauauuuguuuauauacauauaugcacguaucuauauguaua

SEQ ID NO: 92556 - RNA, 64 nt, hsa
ccagguuacauuuaaacuauacauauacauaauauauacauacguguguacuuauuauauguau

SEQ ID NO: 92557 - RNA, 64 nt, hsa
uuuauggaugcccagguuacauuuaaacuauacauauacauaauauauacauacguguguacuu

SEQ ID NO: 92558 - RNA, 64 nt, hsa
uaguaauuuauggaugcccagguuacauuuaaacuauacauauacauaauauauacauacgugu

SEQ ID NO: 92559 - RNA, 64 nt, hsa
guggcauaucuuuuaaccaguucucacaacuugcuauacauaagaugauucacacuugaaugaa

SEQ ID NO: 92560 - RNA, 64 nt, hsa
guggcaaagcuuuuaaccaagucucaacacuuacuauacauaagauaauuuauacuggagcaaa

SEQ ID NO: 92561 - RNA, 64 nt, hsa
uuaguuuuuuaaaaguguuuuugguuuguguauauauacauauacaaauacaacauuuacaaua

SEQ ID NO: 92562 - RNA, 64 nt, hsa
uuucugaagacagcauguuauuuuaacaaucaaguauacauauuaaaaauugugagcaaucuca

SEQ ID NO: 92563 - RNA, 64 nt, hsa
auauauauauauggagagagaauuuugcacauauuauacauauuuugugcuaaucuuguuuucc

SEQ ID NO: 92564 - RNA, 64 nt, hsa
guaaauauauauuugaccuguaaguguguguauguauacauauacauauguauguguauggauu

SEQ ID NO: 92565 - RNA, 64 nt, hsa
auauauuugaccuguaaguguguguauguauacauauacauauguauguguauggauuuauaua

SEQ ID NO: 92566 - RNA, 64 nt, hsa
agguggagcaaguaauaagccaugcugugcaauauauacauaaagcuucugcuucucaugggaa

SEQ ID NO: 92567 - RNA, 64 nt, hsa
acuucuggccaaguuuguuuuuuauauaaauauauauacauauauacauauuauguaugguugu

SEQ ID NO: 92568 - RNA, 64 nt, hsa
ccaaguuuguuuuuuauauaaauauauauacauauauacauauuauguaugguuguaaauucau

SEQ ID NO: 92569 - RNA, 64 nt, hsa
agaaguuucaaggaaccauaaauauauguauacauauacauauauaaaauauauauauuaaaau

SEQ ID NO: 92570 - RNA, 64 nt, hsa
uuccaaagaaguuucaaggaaccauaaauauauguauacauauacauauauaaaauauauauau

SEQ ID NO: 92571 - RNA, 64 nt, hsa
cauggggaaacacacacagagauaucuauacauauauacauacauacaaacauaggcuaucuug

SEQ ID NO: 92572 - RNA, 64 nt, hsa
accucugccauggggaaacacacacagagauaucuauacauauauacauacauacaaacauagg

SEQ ID NO: 92573 - RNA, 64 nt, hsa
cuuaagcguucauaugcucugcuuuuaguucauauauacauacauaauguuuuuccuuucuuaa

SEQ ID NO: 92574 - RNA, 64 nt, hsa
gcuguaaauuacuauggcugauuuauuucuacuauauacauauauauuuuuugcuuuuguauau

SEQ ID NO: 92575 - RNA, 64 nt, hsa
uguauguauauacacacguacauacauucauauauauacauauauacauaaugugcuuaaccac

SEQ ID NO: 92576 - RNA, 64 nt, hsa
uauacacacguacauacauucauauauauacauauauacauaaugugcuuaaccacugccuuuu

SEQ ID NO: 92577 - RNA, 64 nt, hsa
uauauacauguguguauguauacauguauauauauauacauacacauauauguauacauauaua

SEQ ID NO: 92578 - RNA, 64 nt, hsa
uauacauguauauauauauacauacacauauauguauacauauauacacauauauguauacaua

SEQ ID NO: 92579 - RNA, 64 nt, hsa
uacacauauauguauacauauauacacauauauguauacauauauacacauauguauacauaua

SEQ ID NO: 92580 - RNA, 64 nt, hsa
uauacacauauauguauacauauauacacauauguauacauauauauauauucuacaguaaaac

SEQ ID NO: 92581 - RNA, 64 nt, hsa
guguacauauaucuauguacagggguauuauauauauacauauaagaugaugauauauauaaug

SEQ ID NO: 92582 - RNA, 64 nt, hsa
ucgacaggaaacuacaaguuccacacuuuaauuuuauacauauaaauauauacauguguacaua

SEQ ID NO: 92583 - RNA, 64 nt, hsa
gccugugggguuggaugccgcgguucuauacauauauacauauauccacaucuauauagagaga

SEQ ID NO: 92584 - RNA, 64 nt, hsa
gccccggggccugugggguuggaugccgcgguucuauacauauauacauauauccacaucuaua

SEQ ID NO: 92585 - RNA, 64 nt, hsa
uguauauagacaugcacacgugugcauuuguuuguauacauauauuuguccuucguauagcaag

SEQ ID NO: 92586 - RNA, 64 nt, hsa
cauuguacuuuuuuuuacuuuggcaacaaauauuuauacauacaagaugcuaguucauuugaau

SEQ ID NO: 92587 - RNA, 64 nt, hsa
auucaauguaauuaaauuucauauauauauaauauauacauauauacauaguguaaaauaaaau

SEQ ID NO: 92588 - RNA, 64 nt, hsa
uaauuaaauuucauauauauauaauauauacauauauacauaguguaaaauaaaauguuucuug

SEQ ID NO: 92589 - RNA, 64 nt, hsa
aaaacaguauauacauauguguguauauacaguauauacauauauauauuuucacuugcuuuca

SEQ ID NO: 92590 - RNA, 64 nt, hsa
auacauauauauuuguuaauauauuaaaacaguauauacauauguguguauauacaguauauac

SEQ ID NO: 92591 - RNA, 64 nt, hsa
gaaucugacaaagaugaaauccacuuuuaauauauauacauauauauuuguuaauauauuaaaa

SEQ ID NO: 92592 - RNA, 64 nt, hsa
augacuauacagaaauuuaaauagaaauaguguauauacauauaaaauacaagcuauguuagga

SEQ ID NO: 92593 - RNA, 64 nt, hsa
ccuuuuguuuaugaauggaaagcuuugugcaaaauauacauauaagcagaguaagccuuuuaaa

SEQ ID NO: 92594 - RNA, 64 nt, hsa
uauaucuggccucguuauauaguguauauauauguauacauauacauauauauaauauauauga

SEQ ID NO: 92595 - RNA, 64 nt, hsa
uggccucguuauauaguguauauauauguauacauauacauauauauaauauauaugaagacug

SEQ ID NO: 92596 - RNA, 64 nt, hsa
gccaauuccacuugauguaaacaaaacuuuuuuuuauacauaauauauauauauauauauaaaa

SEQ ID NO: 92597 - RNA, 64 nt, hsa
uagaaucacaggauaauauauacaaauauauauauauacauauauauauauauaguuauuuaaa

SEQ ID NO: 92598 - RNA, 64 nt, hsa
uauuuccuucuuuaagguaaucauacaaaaggucuauacauacaggaagguauauauugucuca

SEQ ID NO: 92599 - RNA, 64 nt, hsa
auguuuuacaugaacuaauggauaaaaaacaaaguauacauauaugucuauauauauauauaga

SEQ ID NO: 92600 - RNA, 64 nt, hsa
aguuuagaaauuuauucaaagcuaaagauguauauauacauauacuuuuguguguauauauaca

SEQ ID NO: 92601 - RNA, 64 nt, hsa
gaaagagaaucucagaaguaguuugcugcuaauauauacauauauuguauaaaaagguauauuu

SEQ ID NO: 92602 - RNA, 64 nt, hsa
gugggaaagccuuuucucagugcucauuacuuauuauacauaugagaagucauacuggugagaa

SEQ ID NO: 92603 - RNA, 64 nt, hsa
gugggaaagcauucucucaaagagcaucccuuucuauacauaagagaggucauacaggugagag

SEQ ID NO: 92604 - RNA, 64 nt, hsa
gguguaagacuggaauaaauggaaagaaauaccauauacauagauggaaaaacccaguauuaua

SEQ ID NO: 92605 - RNA, 64 nt, hsa
cauauaguguauauaguguaugugugauguauacuauacauaucacauauacuauaugugugua

SEQ ID NO: 92606 - RNA, 64 nt, hsa
ccaccauaacacacacacacacacacacacacuauauacauauaguguauauacacauauagug

SEQ ID NO: 92607 - RNA, 64 nt, hsa
uaacaugaaggaauaaaaaggauacagaauuguauauacauacuuacuguaacacaucuaaaaa

SEQ ID NO: 92608 - RNA, 64 nt, hsa
ucacuauaaauuauaauuauggacacugcaucaguauacauaacaugaaggaauaaaaaggaua

SEQ ID NO: 92609 - RNA, 64 nt, hsa
ugugcauguguguauaagugcacacagaaauauauauacauauguagacuauauacaugugugu

SEQ ID NO: 92610 - RNA, 64 nt, hsa
guagacuauauacauguguguauauauguguauauauacauacacuuguauaaauguauauaca

SEQ ID NO: 92611 - RNA, 64 nt, hsa
uggccucuggcuguagguuuuaaauuuuuauaucuauacauacauauauacauauauauauaau

SEQ ID NO: 92612 - RNA, 64 nt, hsa
guagguuuuaaauuuuuauaucuauacauacauauauacauauauauauaauguacaauauaua

SEQ ID NO: 92613 - RNA, 64 nt, hsa
cauacauauauacauauauauauaauguacaauauauacauagacuguaacuacuuugcuuuua

SEQ ID NO: 92614 - RNA, 64 nt, hsa
caaaguuacuguuguuuacagugaguuuggggaaaaaaaauaaaauaaaaauggcuuucccagu

SEQ ID NO: 92615 - RNA, 64 nt, hsa
uuucauaacuguuuuuaaugguaaaaaaaaaaaaaaaaaauacaaaaaaaaauucugaaggaca

SEQ ID NO: 92616 - RNA, 64 nt, hsa
cuguccacauuuggggccuauccuuacuuguuugaaaaaauauguuugcuuuuuuugguuuuug

SEQ ID NO: 92617 - RNA, 64 nt, hsa
ugggauuacaggcaugagccaccacgccuggccaaaaaaauauguuuuaaaugucccauuucac

SEQ ID NO: 92618 - RNA, 64 nt, hsa
agccugggugagaagagcgaaacuccgucucaaaaaaaaauaaaaaugaagaggggaaaccaga

SEQ ID NO: 92619 - RNA, 64 nt, hsa
cagccgggccaacauggugaaaccccaucucuacaaaaaauacaaaaauuagccuggcauaugg

SEQ ID NO: 92620 - RNA, 64 nt, hsa
guuuuccauugauugugauaucuaucauaccugcaaaaaauauuuuguauauauccaauuuaau

SEQ ID NO: 92621 - RNA, 64 nt, hsa
ggaaggucaaaaaaaaggaaaaaagaaaaauaauaaaaaauaauaaaaauccuuaggauaacuu

SEQ ID NO: 92622 - RNA, 64 nt, hsa
caggaguuugagaccagugugaccuugucucuguaaaaaauaaaauuaaaagaaaaagaaggga

SEQ ID NO: 92623 - RNA, 64 nt, hsa
uucacugguccaucuauauuuaaaacgugcaagaaaaaaauaaaauacucugcucuagcaaguu

SEQ ID NO: 92624 - RNA, 64 nt, hsa
guuuucaguaaucaaaaagauuucuaugaauucuaaaaaauauuuuuuucuaugaaauuacuag

SEQ ID NO: 92625 - RNA, 64 nt, hsa
aaaagccagcaauaauucuucaagauccaaaagaaaaaaauauacuaccucagauuuucaagaa

SEQ ID NO: 92626 - RNA, 64 nt, hsa
gguguacuaacaucaaaauguauccaagccauuuaaaaaauauuuauauauacauaguagcaaa

SEQ ID NO: 92627 - RNA, 64 nt, hsa
cccaaaaccaagucaagugaaaaaggaggaagagaaaaaauauuuuccugccaggcaugguggc

SEQ ID NO: 92628 - RNA, 64 nt, hsa
ugagacccugucucaaaaaaagaaaaagaaaaagaaaaaauauuuucccuauuagagaagagau

SEQ ID NO: 92629 - RNA, 64 nt, hsa
cagaggaaccaggugccaacagucaacugaggaaaaaaaauaauuaaacaggccuaagaagaaa

SEQ ID NO: 92630 - RNA, 64 nt, hsa
guuggucaugguaagguuuuuccaucagccucugaaaaaauaguugugcacaacaucugcucac

SEQ ID NO: 92631 - RNA, 64 nt, hsa
aaaacuaguguauucacuuacccuaguucauuauaaaaaauaucuaggcauuguggauauaaaa

SEQ ID NO: 92632 - RNA, 64 nt, hsa
acauguaauuauuuaauaaaacuuuggaacauuaaaaaaauaaauuggaggcuuaaggauuaga

SEQ ID NO: 92633 - RNA, 64 nt, hsa
uccagccuaggagacaaaacgagacuucauuuaaaaaaaauaaaaauaaaaauaaaaauaaagu

SEQ ID NO: 92634 - RNA, 64 nt, hsa
uccucaguuccacgagacugcccacccacagacaaaaaaauauauauauuccuaaagucggacc

SEQ ID NO: 92635 - RNA, 64 nt, hsa
auucauaaucacaaauauagagaauuccuauuuaaaaaaauagaaaaauagugaagacuacaca

SEQ ID NO: 92636 - RNA, 64 nt, hsa
uacauauuaaauauguucuacuuaaauauauuauaaaaaauaaaggcaaaguggaaugauaacc

SEQ ID NO: 92637 - RNA, 64 nt, hsa
guucuaauaauccauguucaguuuguagggaaagaaaaaauaauuuuuccuucuacccacuuua

SEQ ID NO: 92638 - RNA, 64 nt, hsa
aaugcauuacguguuuuggaaaauagaguaauuuaaaaaauauauuugaaaugaaaaucuccaa

SEQ ID NO: 92639 - RNA, 64 nt, hsa
aagcugcaaaagggaucuucgaaacugggcagagaaaaaauaaaguggaauauuaaguaaaagu

SEQ ID NO: 92640 - RNA, 64 nt, hsa
uuuuuuucuaucgaaauuacuaaucaguuggggaaaaaaauacuauagcagacagcacuaaugu

SEQ ID NO: 92641 - RNA, 64 nt, hsa
cucuagccugggcagcagagcgagacccugucucaaaaaauacauuuauuuuuuucauuuucag

SEQ ID NO: 92642 - RNA, 64 nt, hsa
uagccugggcaauguggcaaaaccgcguguuuacaaaaaauacaaaaauuagccaggcauggug

SEQ ID NO: 92643 - RNA, 64 nt, hsa
guucuuuauacagccuaguuaauguuuaaaaagaaaaaaauagcuugguuuuauuugucaucua

SEQ ID NO: 92644 - RNA, 64 nt, hsa
aaaugaccccaaacuggcauuuaacacuguuuauaaaaaauauauauauauauauauauauaua

SEQ ID NO: 92645 - RNA, 64 nt, hsa
agccugggcaacgugaugagacuccgucucuaccaaaaaauauauaaaaauuagccgggcguug

SEQ ID NO: 92646 - RNA, 64 nt, hsa
ugggcaacagaaugagauccugucucuuaaagaaaaaaaauaaacucaagaaugauuuuucuaa

SEQ ID NO: 92647 - RNA, 64 nt, hsa
ggagaaggaagagucuaauaguaauuauggauauaaaaaauaagaaauuuuguauagaaaugaa

SEQ ID NO: 92648 - RNA, 64 nt, hsa
gucuacuuccuuuuaacuuuuuuggucuucagcuaaaaaauaggauaagaaauuaaggucuauu

SEQ ID NO: 92649 - RNA, 64 nt, hsa
cagaacucugauggcaauaaauauauguauuaugaaaaaauaaaguuguaauuucugaugacuc

SEQ ID NO: 92650 - RNA, 64 nt, hsa
uguagaaaacaaaaaaagaaaaauauauauucauaaaaaauauggugcucauucucauccaucc

SEQ ID NO: 92651 - RNA, 64 nt, hsa
ccgguuucuuuuacugauuuaaaaacaaaacaaaaaaaaauaaaaaaguugugccugaaaugaa

SEQ ID NO: 92652 - RNA, 64 nt, hsa
caccaguuuuaacaccuuccucguguuauguuuaaaaaaauaaauaaauuuaagaaaaccauuu

SEQ ID NO: 92653 - RNA, 64 nt, hsa
aaacuagcucuuuuacuacugaccuuucacagagaaaaaauauuucccuugaaaaaaacugggc

SEQ ID NO: 92654 - RNA, 64 nt, hsa
aagccugggaaacauagcaagaucucauccuuacaaaaaauaauaauggugugugccugcaguc

SEQ ID NO: 92655 - RNA, 64 nt, hsa
auucuaaaucuugggagaaaaaauaauguuaggaaaaaaauauuuaugcaggaagaguagcacu

SEQ ID NO: 92656 - RNA, 64 nt, hsa
ggaacaugagaugugacauucuaaaucuugggagaaaaaauaauguuaggaaaaaaauauuuau

SEQ ID NO: 92657 - RNA, 64 nt, hsa
uccagccugggcgacagagcgagacuccgucucaaaaaaauaaauaaauacauuuugucugaaa

SEQ ID NO: 92658 - RNA, 64 nt, hsa
auccuggcuaacacagugaaaccccgucuccacuaaaaaauacaaaaaaauuagccaagcaugg

SEQ ID NO: 92659 - RNA, 64 nt, hsa
gcuggaacauuugauauuuuuccauuuauuuaugaaaaaauaugaaccuauuuucauuuguaca

SEQ ID NO: 92660 - RNA, 64 nt, hsa
gggccacuuuuuuuuuauacugcacaguggcacaaaaaaauaucagacaagcacuauuuuauau

SEQ ID NO: 92661 - RNA, 64 nt, hsa
uuuguuucuuucuuuguaaaggccuuggauauugaaaaaauaccaaggcagaacaguuggacaa

SEQ ID NO: 92662 - RNA, 64 nt, hsa
agaggacgaaaugaguauauucacagaggaauccaaaaaauacaguuugggggaaaaugcaaua

SEQ ID NO: 92663 - RNA, 64 nt, hsa
uuaaaaaggaauuuuagagauugauuguuuuaaaaaaaaauacgcacauuguccaauccaguga

SEQ ID NO: 92664 - RNA, 64 nt, hsa
gaauccuuuuuuuuuuuuuuaaagacuaaaugugaaaaaauaaucacuacuuaagcuaauuaau

SEQ ID NO: 92665 - RNA, 64 nt, hsa
uuuaugaauccugucgguauuccuugguaucugaaaaaaauaccaaauaguaccauacaugagu

SEQ ID NO: 92666 - RNA, 64 nt, hsa
uugcaucacacuaauuacaaaauacaaguucuggaaaaaauauuuuucuucauuuuaaaacuuu

SEQ ID NO: 92667 - RNA, 64 nt, hsa
ugucagauggggguaaaauccauuaaagaacaggaaaaaauaauuauaagaugauaagcaaaug

SEQ ID NO: 92668 - RNA, 64 nt, hsa
uguacaaugacaacccuggaaguugcuuuuuuuaaaaaaauaauaaauuucuuaaaucaacucu

SEQ ID NO: 92669 - RNA, 64 nt, hsa
aaugaggcaaauccgaagaaaaggaaaaucgaauaaaaaauagucccacaaaauaccuuuugug

SEQ ID NO: 92670 - RNA, 64 nt, hsa
auauauuacuuauaugcuucaaauuuuauuuaugaaaaaauauguauaucuguaaucaguuguu

SEQ ID NO: 92671 - RNA, 64 nt, hsa
auugauuuugaugcuagauaguuuugcuagguauaaaaaauaaguaaaguuccacuuagagaac

SEQ ID NO: 92672 - RNA, 64 nt, hsa
aguacauagugaauuuuaaaauguagaagaaagcaaaaaauaaaauaaguccuaaagugaagaa

SEQ ID NO: 92673 - RNA, 64 nt, hsa
uggaaaaaucuaaacauuuuuaucuucauaauuuaaaaaauauauauguauauauugcauauuc

SEQ ID NO: 92674 - RNA, 64 nt, hsa
acguuuuuaccuuuuuuaaaaaacauuuuuguagaaaaaauaauuaaauccccuuuuuggaaac

SEQ ID NO: 92675 - RNA, 64 nt, hsa
gcggagaaaucaaguuuaaaauuccuucugauuaaaaaaauauaguggaauacaauugucugcc

SEQ ID NO: 92676 - RNA, 64 nt, hsa
cccagcacacauuaauguuagcuucuuucugagaaaaaaauaccucuuccaggcccugaaacaa

SEQ ID NO: 92677 - RNA, 64 nt, hsa
cugagaaaaaaauaccucuuccaggcccugaaacaaaaaauacauuugcugugaagauugaaaa

SEQ ID NO: 92678 - RNA, 64 nt, hsa
cuuuugcacuugaauuugcaacugaauggauuuuaaaaaauaauucuuuaaugggaucaugagc

SEQ ID NO: 92679 - RNA, 64 nt, hsa
ugaauguauauuucuauuuaugauaccaauuuauaaaaaauaauuacacagaaaaaauggaaua

SEQ ID NO: 92680 - RNA, 64 nt, hsa
acuuguucuugauaagugaaaacugcagggaaauaaaaaauacauaucaaaacauggacaugcu

SEQ ID NO: 92681 - RNA, 64 nt, hsa
uuucuauaaacaguuuuaaggauaugauuugguuaaaaaauaauuuguuauaaaaauucuguuu

SEQ ID NO: 92682 - RNA, 64 nt, hsa
uuguaauuuguaguucucaaaagacuuuuuuuuaaaaaaauaaaguccauacuuacacuuaggc

SEQ ID NO: 92683 - RNA, 64 nt, hsa
uggaauaauuauuaaugaaagauuuuugaaauauaaaaaauaaauuaggcccaauccaagaaau

SEQ ID NO: 92684 - RNA, 64 nt, hsa
aaucaaagacuauuaaaggagcuguacagagguaaaaaaauaaauguggaacauuauuaacuua

SEQ ID NO: 92685 - RNA, 64 nt, hsa
aaugugaagcuuuuugaugccaucaaaacuuauuaaaaaauaggauuuacuuuuuucuaauucu

SEQ ID NO: 92686 - RNA, 64 nt, hsa
gauauuucugucuucuccuugugcuuuccuauggaaaaaauacauauauaguuuaguuuguuag

SEQ ID NO: 92687 - RNA, 64 nt, hsa
auuaucaaaaggaauuuugguaucaucuucagagaaaaaauaaagcaagaaauacuaacaucaa

SEQ ID NO: 92688 - RNA, 64 nt, hsa
aaaguugaaacaaaugauuuuaaaagcuugcaguaaaaaauaaacucauagauucagcaaauau

SEQ ID NO: 92689 - RNA, 62 nt, hsa
acucccgacauaggcuuugagucuaaugaaacaaaaaauauucaucuguugacaauuugcca

SEQ ID NO: 92690 - RNA, 64 nt, hsa
ucuauuuaaaaaauaaaaaaauacaguaaaguuuaaaaaauacaccacgaauuugguguggcug

SEQ ID NO: 92691 - RNA, 64 nt, hsa
uauuauuuucuauagcucuucuauuuaaaaaauaaaaaaauacaguaaaguuuaaaaaauacac

SEQ ID NO: 92692 - RNA, 64 nt, hsa
accuuauguauuauuuucuauagcucuucuauuuaaaaaauaaaaaaauacaguaaaguuuaaa

SEQ ID NO: 92693 - RNA, 64 nt, hsa
aaaaggaaucagaauaaggaucacugagaauuuaaaaaaauaaaaaaggaaguaaaaauuuuac

SEQ ID NO: 92694 - RNA, 64 nt, hsa
gcagugauccuuuacagguuuauuucuuuguaaaaaaaaauaauaauaauuugaaucauguaau

SEQ ID NO: 92695 - RNA, 64 nt, hsa
uuggcaacccuuuugaaaaguagcaauuauggaaaaaaaauauucaauaagagauuaggagccu

SEQ ID NO: 92696 - RNA, 64 nt, hsa
auaauacagugggcuucuggauggauuuuauaggaaaaaauaaacaggucaaugaaugaaacua

SEQ ID NO: 92697 - RNA, 64 nt, hsa
aaugucucguuagaguauuugaugucaugcaccaaaaaaauaaaaccccaccuuguugcaaaag

SEQ ID NO: 92698 - RNA, 64 nt, hsa
ggucauuaucacacaaagagaccaauaaaaauaaaaaaaauaaaaaaaaaaaaagacgaacuau

SEQ ID NO: 92699 - RNA, 64 nt, hsa
cccucagaauauuaagcacauuauuguagagaaaaaaaaauauguguacacauaugaacgcaca

SEQ ID NO: 92700 - RNA, 64 nt, hsa
auucucagaacaccaaguaaaucuaucucuauauaaaaaauauauguaauauauacauauucaa

SEQ ID NO: 92701 - RNA, 64 nt, hsa
uauacauauucaaaguauauacagagccuguuuuaaaaaauacaguauuauuuaguaaaauuau

SEQ ID NO: 92702 - RNA, 64 nt, hsa
ucagaccuguuucuuguaacuggguucaaaaagaaaaaaauaauaaaaauaaaagagagagaga

SEQ ID NO: 92703 - RNA, 64 nt, hsa
gccugggcaacagagcaagacucugucucaaaaaaaaaaauacaauauuuuaacaaugugcccu

SEQ ID NO: 92704 - RNA, 64 nt, hsa
aacugugucugauguuucuucucauguaagaaauaaaaaauaaaaauaaaauaaaauauauugg

SEQ ID NO: 92705 - RNA, 64 nt, hsa
auaaaauaaaauauauugguauguaacuacaggaaaaaaauaaaaaauauauaguggacaguaa

SEQ ID NO: 92706 - RNA, 64 nt, hsa
aaaauauauugguauguaacuacaggaaaaaaauaaaaaauauauaguggacaguaaccuuuca

SEQ ID NO: 92707 - RNA, 64 nt, hsa
gaaauggaucacacgauuucuuuaagggaauuaaaaaaaauaaaagaauuacggcuuuuacagc

SEQ ID NO: 92708 - RNA, 64 nt, hsa
uauucuggacggacuuauuaaaauacaaacagacaaaaaauaaaacaaaacuugaguucuauuu

SEQ ID NO: 92709 - RNA, 64 nt, hsa
agucuucuuugaauaucagggacugagucaauaaaaaaaauaguagaaagguggcuuuuacuau

SEQ ID NO: 92710 - RNA, 64 nt, hsa
gaggauagagcugcaucacuuaaauucaugacuuaaaaaauaauacaguuuauauacaacuugu

SEQ ID NO: 92711 - RNA, 64 nt, hsa
uuacugucaccacuaguuuuaauauaguacaaugaaaaaauaauauauauauauauaguacaau

SEQ ID NO: 92712 - RNA, 64 nt, hsa
agccuggacaacagagcaagacucugucucaaaaaaaaaauaaaaaauaaaaaauaaaaaauaa

SEQ ID NO: 92713 - RNA, 64 nt, hsa
acaacagagcaagacucugucucaaaaaaaaaauaaaaaauaaaaaauaaaaaauaaaagaaac

SEQ ID NO: 92714 - RNA, 64 nt, hsa
agcaagacucugucucaaaaaaaaaauaaaaaauaaaaaauaaaaaauaaaagaaacauaagau

SEQ ID NO: 92715 - RNA, 64 nt, hsa
cucugucucaaaaaaaaaauaaaaaauaaaaaauaaaaaauaaaagaaacauaagauaaguacc

SEQ ID NO: 92716 - RNA, 64 nt, hsa
cagucugagcaacauggcaaaacccugugucuacaaaaaauaaaaaauuagcugggcaugacgg

SEQ ID NO: 92717 - RNA, 64 nt, hsa
aauuauuucauuucagauagaaauacaaaaaaaaaaaaaauacuuuucuuagaagccagauaug

SEQ ID NO: 92718 - RNA, 64 nt, hsa
cagccugggcaacauagugagacuccgucucuacaaaaaauaaauuuagcugggcaugguggug

SEQ ID NO: 92719 - RNA, 64 nt, hsa
uagccucaccccuacauguggauagaaggaaaugaaaaaauaauugcuuugacauugucuauau

SEQ ID NO: 92720 - RNA, 64 nt, hsa
acuccagccaggugacauagcgagauccugucuaaaaaaauaaaaaauaaauaauggaacacag

SEQ ID NO: 92721 - RNA, 64 nt, hsa
ccaggugacauagcgagauccugucuaaaaaaauaaaaaauaaauaauggaacacagcaagucc

SEQ ID NO: 92722 - RNA, 64 nt, hsa
gauguaacacuugguaugcucgguugaggauaugaaaaaauacuuccgaaaccaggaauucaau

SEQ ID NO: 92723 - RNA, 64 nt, hsa
cuugaucaaaggucauuuguguagaugaguaauuaaaaaauauuuaaaucacauuauaauucua

SEQ ID NO: 92724 - RNA, 64 nt, hsa
ugcuugccauccugcaguaguauaaaucaugaauaaaaaauaauuuugcuguuguaguauacau

SEQ ID NO: 92725 - RNA, 64 nt, hsa
uaaaaucaguuuuuugauaguguguguauauaagaaaaaauagauacacacauucuuuuuucuc

SEQ ID NO: 92726 - RNA, 64 nt, hsa
gauuuugagaauguacuaaaaaccaaugaacuuuaaaaaauaaaaauaaacaaaaaaaauucaa

SEQ ID NO: 92727 - RNA, 64 nt, hsa
caaagaagauaugcaaauggcuacuaagcacaugaaaaaauacucaacauuauuauucauuagg

SEQ ID NO: 92728 - RNA, 64 nt, hsa
acuugagaacuuuuuuccuuaauaucagaaagcaaaaaaauaaaaccacaauugagauuugccu

SEQ ID NO: 92729 - RNA, 64 nt, hsa
uuuuaaaggagagcauccuaaguuaauaggaaccaaaaaauaaugaugggcagaagggggggaa

SEQ ID NO: 92730 - RNA, 64 nt, hsa
uuuugugcaacugcuuuauauuaacgauacuaaaaaaaaauagcuuuggaaaaaaaacuacugu

SEQ ID NO: 92731 - RNA, 64 nt, hsa
gaaggccuuuguguguguauuggggggagggguuaaaaaauaauuaucccaaacuuuuuaaugu

SEQ ID NO: 92732 - RNA, 64 nt, hsa
aaagcucccucaguuuuuuggagggaauaacuuaaaaaaauacuuaaauggcuaaguuuacuug

SEQ ID NO: 92733 - RNA, 64 nt, hsa
cugccucaugacaaguacauguuauuuaaggaggaaaaaauauuaaauuuugaauugagugugu

SEQ ID NO: 92734 - RNA, 64 nt, hsa
aaaaguguggccacugagcauuugauuuuauaggaaaaaauaguauuuuugagaauaacauagc

SEQ ID NO: 92735 - RNA, 64 nt, hsa
aaaccugaagcagguguuuucucuuggacauacuaaaaaauaccuaaaaggaagcuuagauggg

SEQ ID NO: 92736 - RNA, 64 nt, hsa
uucucugagaguuuuaauacuuucaaggacuuuaaaaaaauaaucauguuugaauuguuuucuc

SEQ ID NO: 92737 - RNA, 64 nt, hsa
cagagagagacccugucucaaaaaauauauauuuaaaaaauaaaaauaaaagcugaccccaaag

SEQ ID NO: 92738 - RNA, 64 nt, hsa
cuccagucuggaugacagagagagacccugucucaaaaaauauauauuuaaaaaauaaaaauaa

SEQ ID NO: 92739 - RNA, 64 nt, hsa
uuuuaaaauaaauuauuauuugacaacaauccaaaaaaaauacggcuuuuccaaugaugaaaua

SEQ ID NO: 92740 - RNA, 64 nt, hsa
gcauuccacuggguauaacaguauuuuaauuaaaaaaaaauaauuaaaagugaugucuuugcac

SEQ ID NO: 92741 - RNA, 64 nt, hsa
uacaaagcaaaaagaaaaaagaggaaaaaaaggcaaaaaauauugugaaagaaaaaaaacaacu

SEQ ID NO: 92742 - RNA, 64 nt, hsa
uaaaugccuggaacugacuucuugauaaaaauauaaaaaauaauuuccauguaaguuaccagaa

SEQ ID NO: 92743 - RNA, 64 nt, hsa
uaaaaaaaaaaaaaacaaaaaaaaacucaguaugaaaaaauacaguuagcuagcaaauauggac

SEQ ID NO: 92744 - RNA, 64 nt, hsa
uuuuauguuauguauauuuuaccacaauaaaugcaaaaaauaaaaagucuguguucuaaacaau

SEQ ID NO: 92745 - RNA, 64 nt, hsa
gguaaauuuuguuauguauauuuuaucauaauuuaaaaaauauaucuagaaugggcaagaagga

SEQ ID NO: 92746 - RNA, 64 nt, hsa
ccaguuggcaauaauauugccuuauuaaaucuucaaaaaauauauuuuagucuguuauuuaaga

SEQ ID NO: 92747 - RNA, 64 nt, hsa
aggauaccagaaaggaaauggcaugcacacacacaaaaaauaccuaaauuuuggaugagaaaau

SEQ ID NO: 92748 - RNA, 64 nt, hsa
aauguguuagguuuaaacgucguuucuuucuucuaaaaaauauuugguuaguaccuucacugag

SEQ ID NO: 92749 - RNA, 64 nt, hsa
guuaguaccuucacugagcaauaguggaaaaauaaaaaaauaaguaaacagaaaaaacuaaagu

SEQ ID NO: 92750 - RNA, 64 nt, hsa
uguggauucaaccaaccaaggacggaaaaugcuuaaaaaauaauacaacaacaacaaaaaauac

SEQ ID NO: 92751 - RNA, 64 nt, hsa
acggaaaaugcuuaaaaaauaauacaacaacaacaaaaaauacauuauaacaacuauuuacuuu

SEQ ID NO: 92752 - RNA, 64 nt, hsa
uagguuuaauauuuuuuuaguuagguagaguuuuaaaaaauacuugagccuguccgugauaaag

SEQ ID NO: 92753 - RNA, 64 nt, hsa
cuaugagcacuccaggaaacacuauauuuuuuccaaaaaauaugugauuauauauguuaaagua

SEQ ID NO: 92754 - RNA, 64 nt, hsa
cagauuuuuauuaauguaaaaaaaaucaauuuuuaaaaaauaguuggacuuuggcagcuuuuaa

SEQ ID NO: 92755 - RNA, 64 nt, hsa
cauuuuagagccaggaauucccauguuacacaggaaaaaauagaagucuacugaauuaauuuuu

SEQ ID NO: 92756 - RNA, 64 nt, hsa
aguaccuauuuuuacucuuacaaaauuuccuguaaaaaaauacuacauuugaaauuauuucauu

SEQ ID NO: 92757 - RNA, 64 nt, hsa
uuuuuguaaacccaaguaaguucuaaaaaaaaguaaaaaauacauagaauacuugagaauuuag

SEQ ID NO: 92758 - RNA, 64 nt, hsa
cuuuuccuucugaaccacguucuauguaaaagaaaaaaaauagcuuugauuuucucacuggugu

SEQ ID NO: 92759 - RNA, 64 nt, hsa
uguuuugaaagugagcauucauuuaaggauaaauaaaaaauaaaguaguaauaaagaauaaaau

SEQ ID NO: 92760 - RNA, 64 nt, hsa
uauuuuuuuuuucacuugcucauaaacuucuggaaaaaaauaagcaugaaucaaaugguaaugc

SEQ ID NO: 92761 - RNA, 64 nt, hsa
cugcgcuucuauguuugggaaacauugcucugauaaaaaauagcugucauuaugcaguguguau

SEQ ID NO: 92762 - RNA, 64 nt, hsa
cauauauuauggauauauacuuugugauauuuuuaaaaaauaauuuuuucaaagaauguauaag

SEQ ID NO: 92763 - RNA, 64 nt, hsa
uaucucccaaauauguucaauucuuaugucgcucaaaaaauaaaauuuaauuuaaaaaguaucu

SEQ ID NO: 92764 - RNA, 64 nt, hsa
auguggaagcuaaaaaaauugauaucauagaaguaaaaaauaaaacagaggauacuacaggcug

SEQ ID NO: 92765 - RNA, 64 nt, hsa
ucauccuaauuaaggugacuauuuucaaaaagacaaaaaauaugacagccguggugguucauau

SEQ ID NO: 92766 - RNA, 64 nt, hsa
ccuauucaacagaaauauagaaauauaguagcuaaaaaaauacucuggggaagguaccacaaac

SEQ ID NO: 92767 - RNA, 64 nt, hsa
cuugacucagggguucuuaaccuacauuucaugcaaaaaauauauauauuucaauguauuuuuu

SEQ ID NO: 92768 - RNA, 64 nt, hsa
cuacugguaaaauuuugaagacauuguuaacauuaaaaaauauuuuaaaguugucuacaaaucu

SEQ ID NO: 92769 - RNA, 64 nt, hsa
gaagcauuaaacuuucuuuuuauuguauauacuuaaaaaauagaacucacugcccuaucauaca

SEQ ID NO: 92770 - RNA, 64 nt, hsa
aauucacuaaaaauaaauaugucauugugcuuuaaaaaaauaaccucuuguaguuauaaaauaa

SEQ ID NO: 92771 - RNA, 64 nt, hsa
gagccaccgugcccagccuuuuuuuuuuuaauagaaaaaauaauccgacucccacuacaucaag

SEQ ID NO: 92772 - RNA, 64 nt, hsa
aucaucagaacucuucacugaagcuaauguuuggaaaaaauauauacuugaagaaccaauccaa

SEQ ID NO: 92773 - RNA, 64 nt, hsa
guguuuucuuaguacugucuauuuacaaacacguaaaaaauaccccaaauauguuuaaguauua

SEQ ID NO: 92774 - RNA, 64 nt, hsa
gcagcuauacguggcauacauguauuuaaagaaaaaaaaauagauguagaguguuuuuuuuaca

SEQ ID NO: 92775 - RNA, 64 nt, hsa
auugagccauguuaaccugccaaugagaucugugaaaaaauaauggccucauuuuucucuuuuu

SEQ ID NO: 92776 - RNA, 64 nt, hsa
uuguuugguuuuuuuuuuuuuuuuuaagguaaaaaaaaaauacaccuucaguuuccugguguga

SEQ ID NO: 92777 - RNA, 64 nt, hsa
ucuuuuguuauuaaaaaaacacaaaaaaauaauaaaaaaauauauacagauuccuguuguguaa

SEQ ID NO: 92778 - RNA, 64 nt, hsa
ggcauuaauauucuuuuguuauuaaaaaaacacaaaaaaauaauaaaaaaauauauacagauuc

SEQ ID NO: 92779 - RNA, 64 nt, hsa
gguaaacaauaaagaagauucagacacugagggaaaaaaauaaagcuuuuuacuuaaauaaugc

SEQ ID NO: 92780 - RNA, 64 nt, hsa
gcaacagagcaagaccccauccuccaccccccccaaaaaauagaaagaaaaaaaaaguuugcac

SEQ ID NO: 92781 - RNA, 64 nt, hsa
aaggacguaacuuagcauggaucaccaaucaaucaaaaaauaaauaaaucacuaaggauuggag

SEQ ID NO: 92782 - RNA, 64 nt, hsa
augccuuuucccaaaauguugaaauaugauguuaaaaaaauaagaagaaugcuuaaucagauag

SEQ ID NO: 92783 - RNA, 64 nt, hsa
aaccuuucuucaccaaaucuugguugaugccaaaaaaaaauacaugcuaagagaaguagaaauc

SEQ ID NO: 92784 - RNA, 64 nt, hsa
uucacuucaguuuaaugucuccuuugcucuugccaaaaaauagcacacuuuuccacauuccagu

SEQ ID NO: 92785 - RNA, 64 nt, hsa
auuauaauaggaacaaucuuugcuguauacuuuuaaaaaauacucugcuauuucucuugcugga

SEQ ID NO: 92786 - RNA, 64 nt, hsa
cagccuggccaauauggugaaacccugucucuacaaaaaauacaaaaauuagcugggcauggug

SEQ ID NO: 92787 - RNA, 64 nt, hsa
aaauaauuuuucacauuguauuguugcuauauaaaaaaaauaauagaauugguuggguuucuga

SEQ ID NO: 92788 - RNA, 64 nt, hsa
gaugcagaacacagaggaauaaucaccugcuuuaaaaaaauaaaguacuguugaaaagaucauu

SEQ ID NO: 92789 - RNA, 64 nt, hsa
gauuuuuuucauuuucuauuuaagaaauaugaagaaaaaauacaccaagauggucaaauuacua

SEQ ID NO: 92790 - RNA, 64 nt, hsa
uuaaccuccuaaaaggaauucauauuuuaaaggaaaaaaauacaacuaaugaugcacauuucuu

SEQ ID NO: 92791 - RNA, 64 nt, hsa
uuuucagcauuccucaugcauuucagugguaaccaaaaaauaauuugucaauuaauaguugugu

SEQ ID NO: 92792 - RNA, 64 nt, hsa
cccugcuaggaaaaaauugcacugaaaugcugacaaaaaauaaugaaaugaaguggcuuccaaa

SEQ ID NO: 92793 - RNA, 64 nt, hsa
uucauuaucccucaaaaaguuaccaccacaucagaaaaaauaaaaaaaaaauaguaaaguaggc

SEQ ID NO: 92794 - RNA, 64 nt, hsa
ucaaaaaguuaccaccacaucagaaaaaauaaaaaaaaaauaguaaaguaggcagagcuagguu

SEQ ID NO: 92795 - RNA, 64 nt, hsa
gagaugucugcucuuuuaaauuauauauaaggaaaaaaaauagccugccuugggacaggugugu

SEQ ID NO: 92796 - RNA, 64 nt, hsa
ccgcacccggccugaaaauauuuucuaaaaagauaaaaaauauacauaacgaugaaaaauaaua

SEQ ID NO: 92797 - RNA, 64 nt, hsa
aguguagaucauuguauucagagauuguaaaugaaaaaaauauagaaacuauuuaguuuuggua

SEQ ID NO: 92798 - RNA, 64 nt, hsa
ucugacauucucccggggcucacaacaguaucucaaaaaauauguugcuuugcaacgagucaga

SEQ ID NO: 92799 - RNA, 64 nt, hsa
aaguucuaucacuccuuuaccuagggaaggaaaaaaaaaauauauauauauaugugugugugug

SEQ ID NO: 92800 - RNA, 64 nt, hsa
aaaauuaaaaaaauaaacauugucuuggaggguuaaaaaauagaaagguguauguguauagauu

SEQ ID NO: 92801 - RNA, 64 nt, hsa
aaugguagaauauuuagaaauuugcacaaaauuaaaaaaauaaacauugucuuggaggguuaaa

SEQ ID NO: 92802 - RNA, 64 nt, hsa
agcaucaucacauuaccuguuugauguaaaaaauaaaaaauagaaagguguaaguauauaagua

SEQ ID NO: 92803 - RNA, 64 nt, hsa
uuguuacagcaucaucacauuaccuguuugauguaaaaaauaaaaaauagaaagguguaaguau

SEQ ID NO: 92804 - RNA, 64 nt, hsa
ucccugagaaagggaauuaugaaauuuuuaauacaaaaaauaauccauuuaggugcugaguuac

SEQ ID NO: 92805 - RNA, 64 nt, hsa
cugggcaacagagcgagacuucaucucagaaaauaaaaaauaggggccaggcacaguggcucau

SEQ ID NO: 92806 - RNA, 64 nt, hsa
aacauaacaagaccccaucccuuauuaaaagaaaaaaaaauaauuccucauuucaucauugguc

SEQ ID NO: 92807 - RNA, 64 nt, hsa
uccagccugagcaacacagugagacccuaucucaaaaaaauaaugaugauaguacacguuaugu

SEQ ID NO: 92808 - RNA, 64 nt, hsa
gcaagaccucaucucuucuaaaaauuaaaaaaaaaaaaaauaggcauggugguacacaccugug

SEQ ID NO: 92809 - RNA, 64 nt, hsa
uauugcuuuaauuagagcagcacauugcuaaaauaaaaaauacaccuuaauuuuuaagaaauaa

SEQ ID NO: 92810 - RNA, 64 nt, hsa
aauucuuaaauauugaggccccauugugaguaauaaaaaauacgacauaaguagaagacuaaga

SEQ ID NO: 92811 - RNA, 64 nt, hsa
uuaauuauuauuuccccgucccuuaaaaagacaaaaaaaauaaggcaaaaggaaagcaacuaag

SEQ ID NO: 92812 - RNA, 64 nt, hsa
guuuauuuauuguggauucccaucaggaaagaggaaaaaauacacauguucuuucauauaggca

SEQ ID NO: 92813 - RNA, 64 nt, hsa
cuauaugggauguaauuuuuuuguucagucucuuaaaaaauacuuuguuuugguacauuugguu

SEQ ID NO: 92814 - RNA, 64 nt, hsa
aaguaaacaaaagaaaaccuuccagcaacaaauuaaaaaauaauaacaaaucaaccccagcacc

SEQ ID NO: 92815 - RNA, 64 nt, hsa
cuccucucccugacuggugucagauucaucaaacaaaaaauaaaucucgaagaaaaaaaaugca

SEQ ID NO: 92816 - RNA, 64 nt, hsa
acccauauaugcaguuaaaaaaaaguuaauuuucaaaaaauacuguaaaagacuuuaaggaaca

SEQ ID NO: 92817 - RNA, 64 nt, hsa
ucucaauuggggacaaaaauugguucuuggggugaaaaaauauuagauauggcuuguggacuuc

SEQ ID NO: 92818 - RNA, 64 nt, hsa
gauguauuuuuuucaugcauuaguaugcauuuuuaaaaaauaaugcauguuucuuuaauaauua

SEQ ID NO: 92819 - RNA, 64 nt, hsa
acugcugccauguguguacuguauuauuuucagaaaaaaauauaauagucugaguccaaguuau

SEQ ID NO: 92820 - RNA, 64 nt, hsa
augguggaauaaccaaaauguguaucauucuacaaaaaaauaggccuggacuauuuaaggagug

SEQ ID NO: 92821 - RNA, 64 nt, hsa
uagauccucuugcuguucugaggccuuaaaaccaaaaaaauaauggaaugauugcaucacugcg

SEQ ID NO: 92822 - RNA, 64 nt, hsa
cagccuggccaacauggcaaaacuccgucucugcaaaaaauacaaaaaugagcccgguauguug

SEQ ID NO: 92823 - RNA, 64 nt, hsa
ccacagugcuacagacaauaagugauaaaaugggaaaaaauagugaagaucuucuuuuaggaaa

SEQ ID NO: 92824 - RNA, 64 nt, hsa
uuuucauuagggccauaucuccaaaaaaagaaagaaaaaauacaaaaaacaaaaacaaaaaaaa

SEQ ID NO: 92825 - RNA, 64 nt, hsa
augguuaccaguacagucaaaaaagagaaaaugaaaaaaauacaacuaaaaggaagaaacacaa

SEQ ID NO: 92826 - RNA, 64 nt, hsa
cuaauuaaaaaaauaguuaugaaaucuuagccacaaaaaauaaaucagguaaacauuuuaaccu

SEQ ID NO: 92827 - RNA, 64 nt, hsa
cacuuauagccuuaaaccauucaagggcuaauuaaaaaaauaguuaugaaaucuuagccacaaa

SEQ ID NO: 92828 - RNA, 64 nt, hsa
ugcaugugugcuuuuuuuugguguguauuucauuaaaaaauauaaauauuuaugaaaauugcac

SEQ ID NO: 92829 - RNA, 64 nt, hsa
ccuuauauuuuaguuuguuccacauuuugaaagcaaaaaauauauauuugauauacccuucaau

SEQ ID NO: 92830 - RNA, 64 nt, hsa
ugucuucuuagcuaagaggaggaaaaaaaggcugaaaaaauagggaggaaauuccuucaucaga

SEQ ID NO: 92831 - RNA, 64 nt, hsa
uaauagacaucaccagcaaugaauuuugaaaagcaaaaaauacuauuaaccuauauaaccauuu

SEQ ID NO: 92832 - RNA, 64 nt, hsa
cagccuggacaacauagugaaacacugucucugcaaaaaauacaaaaauuagcuggguauggug

SEQ ID NO: 92833 - RNA, 64 nt, hsa
cacugcacucuagccugggcaacagaguaagacaaaaaaauauauauauauugaaaaucaaagg

SEQ ID NO: 92834 - RNA, 64 nt, hsa
cagccugggcaacauggugaaacccuguuucuauaaaaaauaaucugggcuuuguagcauaugc

SEQ ID NO: 92835 - RNA, 64 nt, hsa
ccaucgaggaagccgaaaauaugcaaagaccaagaaaaaauaaagaaaagaugauuuaccucca

SEQ ID NO: 92836 - RNA, 64 nt, hsa
ucuccauuuugcugugaacuuaaaacugcucuaaaaaaaauaucuuuuuuaaaaaagagagaau

SEQ ID NO: 92837 - RNA, 64 nt, hsa
aggaaagagaggaagagagaagcaaacauguaggaaaaaauauaaaucagccccauucucccau

SEQ ID NO: 92838 - RNA, 64 nt, hsa
guugaccaguauuacuauacaauguaaguguuuuaaaaaauacgaaaguaauacucugcacccc

SEQ ID NO: 92839 - RNA, 64 nt, hsa
cuacuuucuucagguaaagggcaaauaaugaucgaaaaaauaauuauuuauuacauaauuuagu

SEQ ID NO: 92840 - RNA, 64 nt, hsa
uggcaauagaccgagacuccgucuccaaaaaaaaaaaaaauacaauuuuuauuucuuuuacuuu

SEQ ID NO: 92841 - RNA, 64 nt, hsa
caaaguuugcuuaguuacaacaaagcaccuuuaaaaaaaauacauuuuaaaaaaacauuccaag

SEQ ID NO: 92842 - RNA, 64 nt, hsa
uaggaugugaaaaaaaauguuugcaguacucagcaaaaaauaggguacauaaagcaggguggcu

SEQ ID NO: 92843 - RNA, 64 nt, hsa
ccucugcuggucuuguuccaggguuaugaauaugaaaaaauagagaugagacuuuuugugucaa

SEQ ID NO: 92844 - RNA, 64 nt, hsa
uccagccuggauaacagagcgagacccugucucaaaaaaauaaaauaaaaaauaaaaacacccu

SEQ ID NO: 92845 - RNA, 64 nt, hsa
aacagagcgagacccugucucaaaaaaauaaaauaaaaaauaaaaacacccuugccugcgcucc

SEQ ID NO: 92846 - RNA, 64 nt, hsa
guugaacauaauguuccaguugaaugcaaaacaaaaaaaauauggaaaacauuuugauaaaauu

SEQ ID NO: 92847 - RNA, 64 nt, hsa
ucaaaggauagcauaauaucugcauuaugcuggaaaaaaauagaccuuuggagaauacuuaaau

SEQ ID NO: 92848 - RNA, 64 nt, hsa
uauuuauaaauaguaaauaaaguuuuuaccauuaaaaaaauaucuuucccuuuguuauugacca

SEQ ID NO: 92849 - RNA, 64 nt, hsa
uauuggagaaaauaagguggaguccuacuuguuuaaaaaauauguaucuaagaauguucuaggg

SEQ ID NO: 92850 - RNA, 64 nt, hsa
aaaauauacuauaacaaccguguuuuauuugugaaaaaaauauuaaagugauuugcucucaaau

SEQ ID NO: 92851 - RNA, 64 nt, hsa
uuugaagaauuuauauuuggaaaguaaaaaaguaaaaaaauaaaucauccaacuucuuugcauu

SEQ ID NO: 92852 - RNA, 64 nt, hsa
uuuccaagaacaacuugauaucauucagcuguccaaaaaauaauaagagcauucauuaaauacu

SEQ ID NO: 92853 - RNA, 64 nt, hsa
ccaaugauauuucaguauauauuuucucucuuuuaaaaaauauuuaucauacucuguauauuau

SEQ ID NO: 92854 - RNA, 64 nt, hsa
cauaggcuaauauagauuaaauugaauauugaauaaaaaauauauuuauuuauccacaucuuug

SEQ ID NO: 92855 - RNA, 64 nt, hsa
ucccagcucauugcuccaggagagagaagaguucaaaaaauaaaguaaucauaaacuugaacuc

SEQ ID NO: 92856 - RNA, 64 nt, hsa
aauugcaucagaucauggaugcauuuuuauuaugaaaaaauaaaaugacuuuucaaauuauaau

SEQ ID NO: 92857 - RNA, 64 nt, hsa
auucucaugcuaaaaauacaacaaaagacaaagcaaaaaauaaaccuuugcuuuuuuuuuuuuu

SEQ ID NO: 92858 - RNA, 64 nt, hsa
auagaaaauauuaguuucagaauuacccuccuuuaaaaaauaagagacuauuuguuuucuuuua

SEQ ID NO: 92859 - RNA, 64 nt, hsa
cucuagccugggcaacggugagacccugccucaaaaaaaauaaaaauaaaaauaaaacacuuua

SEQ ID NO: 92860 - RNA, 64 nt, hsa
aaaacaaaacaaaaaaaaaaggcaaggcacaacaaaaaaauauccugggcaauaaaaaaaauau

SEQ ID NO: 92861 - RNA, 64 nt, hsa
gcaaggcacaacaaaaaaauauccugggcaauaaaaaaaauauuuuaaaccagcuuuggagcca

SEQ ID NO: 92862 - RNA, 64 nt, hsa
cauccugggcaacauggcgaaacccuaucucuacaaaaaauacaaaaauuagccagacauggug

SEQ ID NO: 92863 - RNA, 64 nt, hsa
uaaaaaaaagagagaguaacuacagaagaacuuuaaaaaauaaaaaauaagcuuaccuuggauu

SEQ ID NO: 92864 - RNA, 64 nt, hsa
aagagagaguaacuacagaagaacuuuaaaaaauaaaaaauaagcuuaccuuggauucuuggcu

SEQ ID NO: 92865 - RNA, 64 nt, hsa
aguguguaggagugaagacaggaucccgugcuuaaaaaaauaaaaaauaaaaaaauaaaaaaaa

SEQ ID NO: 92866 - RNA, 64 nt, hsa
aggagugaagacaggaucccgugcuuaaaaaaauaaaaaauaaaaaaauaaaaaaaaaauaaga

SEQ ID NO: 92867 - RNA, 64 nt, hsa
agacaggaucccgugcuuaaaaaaauaaaaaauaaaaaaauaaaaaaaaaauaagacuuuaacu

SEQ ID NO: 92868 - RNA, 64 nt, hsa
cgugcuuaaaaaaauaaaaaauaaaaaaauaaaaaaaaaauaagacuuuaacugcaguuccaaa

SEQ ID NO: 92869 - RNA, 64 nt, hsa
uauuugcuucucgggaaagcaaagaagcugcuuuaaaaaauaaaaaggggacuaaaaauuuguu

SEQ ID NO: 92870 - RNA, 64 nt, hsa
auaauauugugaaaaugaaucuguuaugauaaagaaaaaauaaaguggaaacuuuuagaguauu

SEQ ID NO: 92871 - RNA, 64 nt, hsa
caaaguaguaaaauaaaaaaaaauuuaaaaaauuaaaaaauaaaaaaaagaggucacuaaaaga

SEQ ID NO: 92872 - RNA, 64 nt, hsa
auaagccccuaccuucuuacuuucugguuuguugaaaaaauacacuggugcucuuugaagugau

SEQ ID NO: 92873 - RNA, 64 nt, hsa
cauugucaaccuuuauugacuuuguuuuuacaauaaaaaauauuuuacaacuuacuuucuguuc

SEQ ID NO: 92874 - RNA, 64 nt, hsa
aaagaccaagaucaaauaauagcugggguggagaaaaaaauagcucaagacacaguuaaucgag

SEQ ID NO: 92875 - RNA, 64 nt, hsa
uccugaguaugcuugguguuugccuucagaaaaaaaaaaauacauuguaaauaaccucagcugg

SEQ ID NO: 92876 - RNA, 64 nt, hsa
aaaagcuucauuucugaagaugaauuuuauuuuuaaaaaauacaugcacacucaaaacuuuuag

SEQ ID NO: 92877 - RNA, 64 nt, hsa
cauguaaaauuuuguuauuuccagucuguauaugaaaaaauaggucaucaaaaggaaaaaaaau

SEQ ID NO: 92878 - RNA, 64 nt, hsa
gucuguauaugaaaaaauaggucaucaaaaggaaaaaaaauaacuuugauuaacuaguguuaaa

SEQ ID NO: 92879 - RNA, 64 nt, hsa
gaaaaaaaauaacuuugauuaacuaguguuaaacaaaaaauagguuuacuaaauauguuaaucu

SEQ ID NO: 92880 - RNA, 64 nt, hsa
acuaguguguuaugaaugacuaagauucugauaaaaaaaauaaauuauuuacacaggguuuaua

SEQ ID NO: 92881 - RNA, 64 nt, hsa
ccuuuuuaaacccccaugaacacgaauacucugaaaaaaauaaaaagcuuucuggaagaagaca

SEQ ID NO: 92882 - RNA, 64 nt, hsa
ccauaccauagaagaaagaauuggcagucaaaaaaaaaaauaccuuuuguaauguuugaaaaau

SEQ ID NO: 92883 - RNA, 64 nt, hsa
cgccaugccuggcccuugauuuuucuuuuuaagaaaaaaauaucuaggaguuucuuagacccua

SEQ ID NO: 92884 - RNA, 64 nt, hsa
ucucaaagcacacugucuucccaguacguaaguuaaaaaauaccaguucacccaaguugcuucu

SEQ ID NO: 92885 - RNA, 64 nt, hsa
gagcaauacacauauuauaggccaauauuuuuuuaaaaaauagagcuuggucaaccucuauacu

SEQ ID NO: 92886 - RNA, 64 nt, hsa
gaaaaaaauaaaauaaauucccaauuccauugggaaaaaauagaaauccaugaauccauacuga

SEQ ID NO: 92887 - RNA, 64 nt, hsa
uaauugagaaaaauaaauaacaagauaauugagaaaaaaauaaaauaaauucccaauuccauug

SEQ ID NO: 92888 - RNA, 64 nt, hsa
aauaucuuguuaugccagaaaguaauguuaaaaaaaaaaauagagguauauugccaaaacauag

SEQ ID NO: 92889 - RNA, 64 nt, hsa
uauuucuaucugcaaauaguuucaaaugaguuuaaaaaaauaacaucugaaaagaaaugcuaau

SEQ ID NO: 92890 - RNA, 64 nt, hsa
gucuaugcuuaggccagucaguacacccaauuuuaaaaaauaacauauucuugcuuucacaaau

SEQ ID NO: 92891 - RNA, 64 nt, hsa
ggccgcaaccacuugcuagugauacacuguaucuaaaaaauaacugugcacuauaagggaguag

SEQ ID NO: 92892 - RNA, 64 nt, hsa
uuccagucauuuugggaauuccugcuuaacuugaaaaaaauaugggaaagacaugcagcuuuca

SEQ ID NO: 92893 - RNA, 64 nt, hsa
cagaagaaaagcaaaugacuaguaaacaugugggaaaaaauauuacauuuuaagggggaaaaaa

SEQ ID NO: 92894 - RNA, 64 nt, hsa
uuuucuuucaucuuuagguugaauaaagaaacagaaaaaauagaacauacugaaaauaaucuaa

SEQ ID NO: 92895 - RNA, 64 nt, hsa
ccagccugggugacagagugagacucugucucaaaaaaaauaaaauaaaaagucaauuuagaau

SEQ ID NO: 92896 - RNA, 64 nt, hsa
cuccagccugggugacagagcgacccucugucucaaaaaauaauaauaauaauaaauaaaacaa

SEQ ID NO: 92897 - RNA, 64 nt, hsa
aucaaaaaaguaauagcgcucauuugcuaaaugcaaaaaauaaucaccuuugauaccaaugugc

SEQ ID NO: 92898 - RNA, 64 nt, hsa
aggagacaauuuuggagagcaagcaaaucuuuuuaaaaaauaguaugaaugugaauacuagaaa

SEQ ID NO: 92899 - RNA, 64 nt, hsa
aaaauaguaugaaugugaauacuagaaaagauuuaaaaaauaguaugagugugaguacuaggaa

SEQ ID NO: 92900 - RNA, 64 nt, hsa
uuuggucaguaaaacuuaaugaaaaaagcaaagaaaaaaauauucugaacaaagcuauaggguu

SEQ ID NO: 92901 - RNA, 64 nt, hsa
cucucuagagcgagcaagagagggagagaggaggaaaaaauacacauaauacaaacauacaugc

SEQ ID NO: 92902 - RNA, 64 nt, hsa
caucuuugguguuuuuuuaacccccagccccucaaaaaaauaaggccuccagguaucaagaucu

SEQ ID NO: 92903 - RNA, 64 nt, hsa
cuugcaguauaaaugaagauuugguuuuuguauaaaaaaauaaugcuguuaaacaggaguugac

SEQ ID NO: 92904 - RNA, 64 nt, hsa
guaagacccaauaguuacuguacaucccauaaauaaaaaauacuuuaguuugcuaaccaacuga

SEQ ID NO: 92905 - RNA, 64 nt, hsa
gaaaaucuguauuaaaaauaaaauuaauaaaaguaaaaaauaaaaauagaaacacaacucuacu

SEQ ID NO: 92906 - RNA, 64 nt, hsa
auauauacauguaucuguaugugaauagacuuugaaaaaauacagaauaaacuucauggugguu

SEQ ID NO: 92907 - RNA, 64 nt, hsa
aacaaggguuuaaacuugauacaaaaccuuuuauaaaaaauauuguuuuaacuacucaauuauu

SEQ ID NO: 92908 - RNA, 64 nt, hsa
gacaugagggggaaaguccuuuuugcccuucuccaaaaaauaaccuuccacagagacaaacugu

SEQ ID NO: 92909 - RNA, 64 nt, hsa
uguuuguuuuuauuaucuuaagugcuaauuaaaaaaaaaauaaaauuuuaaaaaaaccuguagu

SEQ ID NO: 92910 - RNA, 64 nt, hsa
uggauuuuguuguuugauggaauuugagccaaaaaaaaaauacgcaggcuuuccuauuucuaca

SEQ ID NO: 92911 - RNA, 64 nt, hsa
caacacggugaaaccccgccucuacuaaaaauacaaaaaauagccgggugugguggugggcacc

SEQ ID NO: 92912 - RNA, 64 nt, hsa
cuccagucugggugacagagcaagacuccaucucaaaaaauaaauaaauagaaagagagagaga

SEQ ID NO: 92913 - RNA, 64 nt, hsa
acgauuuaccaauguuguuuuuuuuuaacaagaaaaaaaauaaaagcacauugucauuuuuuuu

SEQ ID NO: 92914 - RNA, 64 nt, hsa
guugcaggauaucuagcaauuuaagaaaauguggaaaaaauauuuuuauugagaaauagcauuu

SEQ ID NO: 92915 - RNA, 64 nt, hsa
accagccugggcaacauggcacaauugucucuacaaaaaauacaaaaauuagccaggcauggug

SEQ ID NO: 92916 - RNA, 64 nt, hsa
guuggaacauuaagaaaaauguauauucccaaugaaaaaauaguuauaucaucuuauaguaaac

SEQ ID NO: 92917 - RNA, 64 nt, hsa
ggauaaaauaauguguuauuuuuauagagaaagaaaaaaauagcaacacaaucuaguuuauuuu

SEQ ID NO: 92918 - RNA, 64 nt, hsa
uguccuaaaugugaagacagagguugaauuuuuuaaaaaauaucuuuaaaagacugaucacaaa

SEQ ID NO: 92919 - RNA, 64 nt, hsa
ucaacuguguuuaauacucugaauuuuaauuagaaaaaaauacaauagcagcaaggcccugguu

SEQ ID NO: 92920 - RNA, 64 nt, hsa
uuaaaaaguuuucugaaaaaacuuuugcaauaaaaaaaaauaaauugcccaucaauaaguuuga

SEQ ID NO: 92921 - RNA, 64 nt, hsa
gguuuuuguccuuuccuucacugauuugcuuuaaaaaaaauaaaagauaaugauuuauugcaga

SEQ ID NO: 92922 - RNA, 64 nt, hsa
ggucagacuuuuuuuguuagauucucucauuuaaaaaaaauacuguuuguuuaaagcaugcaua

SEQ ID NO: 92923 - RNA, 64 nt, hsa
cucaaaaaaaaauuaaaauaaauuuaaauacaaaaaaaaauagccagguguggggugcaugccu

SEQ ID NO: 92924 - RNA, 64 nt, hsa
caacguggugaaacgcugucucuacuaaaauacaaaaaaauagggcugggcgcgguugcucacg

SEQ ID NO: 92925 - RNA, 64 nt, hsa
uugcaaauuagcaucccauggcaaauauauuuugaaaaaauaaagaacuaucaggauugaaaac

SEQ ID NO: 92926 - RNA, 64 nt, hsa
aggagaaggccaauuccuauacgcagcgugcuuuaaaaaauaaauaagaaacaacucuuugaga

SEQ ID NO: 92927 - RNA, 64 nt, hsa
aaauuaaaauccucaauccagcuauguuauauugaaaaaauagagccugagggaucuuuacuag

SEQ ID NO: 92928 - RNA, 64 nt, hsa
aaauaucauuugacuuuuuauagaaaaaaaaaggaaaaaauaauugagaaaguguucaucugag

SEQ ID NO: 92929 - RNA, 64 nt, hsa
cuuucaccuccccacccaaacuuuauaaaaguugaaaaaauaucauuugacuuuuuauagaaaa

SEQ ID NO: 92930 - RNA, 64 nt, hsa
uuguuaugugcaauacuguuuguacuguuuguauaaaaaauagaaaaaaaaaagaaaagaaaaa

SEQ ID NO: 92931 - RNA, 64 nt, hsa
aaggcaaaaaacauuguccugaagaauagguuacaaaaaauaaacuccauuuggugcugaaagu

SEQ ID NO: 92932 - RNA, 64 nt, hsa
uuuuuucuauauauugaauuagauguuaucccaaaaaaaauaucuuuucacuucaaaaugaaaa

SEQ ID NO: 92933 - RNA, 64 nt, hsa
caguaaaaauauuguuuugcuucaucuguacacaaaaaaauacccuuuuacaauaugaaugcau

SEQ ID NO: 92934 - RNA, 64 nt, hsa
cugccaaauguuauguaguuuaauagagaacuugaaaaaauaaaacauuaaaauggagcuugug

SEQ ID NO: 92935 - RNA, 64 nt, hsa
uagacauuuuuuauuuugacuaucuauggcuuuuaaaaaauauuuuguggcaauguaucuguga

SEQ ID NO: 92936 - RNA, 64 nt, hsa
ucucuacauuuaagaguagcaauagaacaauaaaaaaaaauacgucuuucaaauuaauugcagu

SEQ ID NO: 92937 - RNA, 64 nt, hsa
auaaaauauauaccagauuucaaauaccuacuucaaaaaauaauguaaaauaucucacuaauaa

SEQ ID NO: 92938 - RNA, 64 nt, hsa
acuuuucauguagcguaucacauaacuuuuuugcaaaaaauauaaaaagaaauaaacuucaaug

SEQ ID NO: 92939 - RNA, 64 nt, hsa
aaaaaaaugcaaaucauucuuuaccuuaagaaaaaaaaaauacccuuugcuuugugccucaaag

SEQ ID NO: 92940 - RNA, 64 nt, hsa
ggcucccacauuuuaagauuuuaaaaaugaaaccaaaaaauaaauugaagaaaacuguaaacuu

SEQ ID NO: 92941 - RNA, 64 nt, hsa
cugcagccuaggugacagucagacccugucucaaaaaaaauaaaaaaaauuuaaaauaaucuug

SEQ ID NO: 92942 - RNA, 64 nt, hsa
ugccccuguaaauaguuuuaaauaugaacaaagaaaaaaauauauuuuaugauuuaaaaaauaa

SEQ ID NO: 92943 - RNA, 64 nt, hsa
auaugaacaaagaaaaaaauauauuuuaugauuuaaaaaauaaauauaauugggauuuuaaaaa

SEQ ID NO: 92944 - RNA, 64 nt, hsa
agccugggcaacacaguaagacccuguuucuacaaaaaaauauaaaaaauagccugguguggug

SEQ ID NO: 92945 - RNA, 62 nt, hsa
aacacaguaagacccuguuucuacaaaaaaauauaaaaaauagccuggugugguggugucug

SEQ ID NO: 92946 - RNA, 64 nt, hsa
agcaguuugaaggcauacuuuugcauagaaauaaaaaaaauacugauuuggggcaaugaggaau

SEQ ID NO: 92947 - RNA, 64 nt, hsa
ucacugaacaccaagaccagaauggauuuuuuuaaaaaaauagauguuccuuuugugaagcacc

SEQ ID NO: 92948 - RNA, 64 nt, hsa
uuaaaguaaccuuauauuuaaaagaugauuuugcaaaaaauaaaaaauaaaaaauaugccuucu

SEQ ID NO: 92949 - RNA, 64 nt, hsa
aaccuuauauuuaaaagaugauuuugcaaaaaauaaaaaauaaaaaauaugccuucuggaguga

SEQ ID NO: 92950 - RNA, 64 nt, hsa
uauuuaaaagaugauuuugcaaaaaauaaaaaauaaaaaauaugccuucuggagugaugucugu

SEQ ID NO: 92951 - RNA, 64 nt, hsa
agauauuuuccucuuuuucugaagcuacuuucuuaaaaaauaaauaaaauguuuauagcauucc

SEQ ID NO: 92952 - RNA, 64 nt, hsa
cuuuaugcaugaagauaauguaaagguuuuuauuaaaaaauauauauauguauaaauaaaugau

SEQ ID NO: 92953 - RNA, 64 nt, hsa
agaacagugauuuuuuuuuagaacagaaaacaacaaaaaauaaccccaaaaugaagauuauuuu

SEQ ID NO: 92954 - RNA, 64 nt, hsa
gccguugccaagaacugaaaacauaaaaaguuaaaaaaaauaauaaauugcaugcugcuuuaau

SEQ ID NO: 92955 - RNA, 64 nt, hsa
uauauacauaacaggguaaauuauucaguuaagaaaaaaauaauuuuaugaacugcauguauaa

SEQ ID NO: 92956 - RNA, 64 nt, hsa
uggaaaaccuuuucaggcccucagucuaaaaaauaaaaaauaugagcaccauugaauucugugc

SEQ ID NO: 92957 - RNA, 64 nt, hsa
ccucaguuggaaaaccuuuucaggcccucagucuaaaaaauaaaaaauaugagcaccauugaau

SEQ ID NO: 92958 - RNA, 64 nt, hsa
ggucguguaaauauguacaauauuguaaauacauaaaaaauauacaaauuuuuggcugcuguga

SEQ ID NO: 92959 - RNA, 64 nt, hsa
uauauuucuuuaauucugcuuacuauuucauggaaaaaaauaaauuucucaauuuuaauguaaa

SEQ ID NO: 92960 - RNA, 64 nt, hsa
aucuugaaugauacgauuaugcccaauauuaaguaaaaaauauaagaaaagguuaucuuaaaua

SEQ ID NO: 92961 - RNA, 64 nt, hsa
uaauuaaucacaaaugugaaguuaugcaugauguaaaaaauacaaacauucuaauuaaaggcuu

SEQ ID NO: 92962 - RNA, 64 nt, hsa
uauaaccuuaggauuccugaaaagaauuucaaaaaaaaaauaaagacacuguugccaaugugac

SEQ ID NO: 92963 - RNA, 64 nt, hsa
aagaacauacuaauggcauauauuuguuacaauuaaaaaauaaauuuacuacuuaauccuaugu

SEQ ID NO: 92964 - RNA, 64 nt, hsa
uacaguguucuguuuaauacucauccuuguauaaaaaaaauaguugagccagcagacauuguca

SEQ ID NO: 92965 - RNA, 64 nt, hsa
auugccuauuucaguggcacgucaucuaguuuuaaaaaaauaaaacauuuuaaauggacagaga

SEQ ID NO: 92966 - RNA, 64 nt, hsa
cccccuauuuucaggggguuaaaaaucagcuuuaaaaaaauacauaaaaauuucaucuuaaagc

SEQ ID NO: 92967 - RNA, 64 nt, hsa
uagauaaagcaagucuaucaacauuaaaaauacuaaaaaauaaagacacacacagagcauuuua

SEQ ID NO: 92968 - RNA, 64 nt, hsa
gccaacauggugaaaccccgucucuacuaaaaaaaaaaaauagacaaaaauuagcgggggggug

SEQ ID NO: 92969 - RNA, 64 nt, hsa
cuccagccugggcaacagagcaagacuccaucucaaaaaauaaauagauaaaaauaaaaaccca

SEQ ID NO: 92970 - RNA, 64 nt, hsa
cuggccaacacggugaaaccccaucucuacuaaaaaaaaauacaaaaauuagccgggcguggug

SEQ ID NO: 92971 - RNA, 64 nt, hsa
aauuaagggguaaagcacuaaacagaaaagaaaaaaaaaauagcaacucuggugagcagauuuc

SEQ ID NO: 92972 - RNA, 64 nt, hsa
uuuuacacaucauaccuagcagguaauaaaauuuaaaaaauaaaaauuaaauauuagaauguga

SEQ ID NO: 92973 - RNA, 64 nt, hsa
ggaaaaccagauauuuagagucgaagcagcaugcaaaaaauaauaauguuuuuaacuaaugaag

SEQ ID NO: 92974 - RNA, 64 nt, hsa
uuuaggaaaauauuaagcuuuauaaaauagcaauaaaaaauaauucauuuaagaagagauggug

SEQ ID NO: 92975 - RNA, 64 nt, hsa
ucuugagucuauuauuguauaauuuaguaaaagaaaaaaauaaucguuggugguccuacuaaga

SEQ ID NO: 92976 - RNA, 64 nt, hsa
uucaguuuggagcuuuuaggcauuauguauauuuaaaaaauauauucuucaaaaaugcauuuug

SEQ ID NO: 92977 - RNA, 64 nt, hsa
auucucuuaaaaaguaugugaaaagaaaauuaugaaaaaauaugcauaccuaaugaaguauugg

SEQ ID NO: 92978 - RNA, 64 nt, hsa
ugaauuuaaggaaauucuuuaggauaaccauuucaaaaaauaaaauugcuaugcaaucuugaau

SEQ ID NO: 92979 - RNA, 64 nt, hsa
ccugggcgacagagcaagacucugucucaaaaaaaaaaaauaauaauaaaauaagugagcugaa

SEQ ID NO: 92980 - RNA, 64 nt, hsa
gcuauguaaaauuuuuacuaaugucauuauuuugaaaaaauaaauuuaaaaauacauucaaaau

SEQ ID NO: 92981 - RNA, 64 nt, hsa
uauuuaguaaagcuuuucuuuuuuaauuuccaggaaaaaauaaaaagaguaugagucuucugua

SEQ ID NO: 92982 - RNA, 64 nt, hsa
uauaaccuggcaaaaucuuguuaaugucauugcuaaaaaauaaauaaaagcuagauacuggaaa

SEQ ID NO: 92983 - RNA, 64 nt, hsa
caaauuauauaaacaguaccaauaucauuauagaaaaaaauaacauuuuaauguauauuguucu

SEQ ID NO: 92984 - RNA, 64 nt, hsa
aauaaaauucuauugcaaaaauuucuuuuucuagaaaaaauaaauacaaaaaaaaaaaagaaga

SEQ ID NO: 92985 - RNA, 64 nt, hsa
aucuuuuaucaauaauguucuauagaaaagaaaaaaaaaauauauauauauauauaucuuaguc

SEQ ID NO: 92986 - RNA, 64 nt, hsa
cacgaguuaccuguuaaacuuuggaacaccuaccaaaaaauaaguuugauaacauuuaaaagau

SEQ ID NO: 92987 - RNA, 64 nt, hsa
uugaaagaauacaaaaauaugugaaguucauuuaaaaaaauaacuacaguauagcgcugguaca

SEQ ID NO: 92988 - RNA, 64 nt, hsa
aacccaauucuaagcagaaaaagaaaaaaaacacaaaaaauaaaaaaccccuacaaaaaaacuu

SEQ ID NO: 92989 - RNA, 64 nt, hsa
caucgcagugaacuuaaagcaaagaccucuuaguaaaaaauaaaaaaaaauaaaaaauaaaaau

SEQ ID NO: 92990 - RNA, 64 nt, hsa
aacuuaaagcaaagaccucuuaguaaaaaauaaaaaaaaauaaaaaauaaaaauaaaaaaaguu

SEQ ID NO: 92991 - RNA, 64 nt, hsa
agcaaagaccucuuaguaaaaaauaaaaaaaaauaaaaaauaaaaauaaaaaaaguuaaauuua

SEQ ID NO: 92992 - RNA, 64 nt, hsa
ucucuaccaaaaaaaaaaaaaaaaaaaaaaaaaaaaaaaauauauauauauauauacacacaca

SEQ ID NO: 92993 - RNA, 64 nt, hsa
gcuuuuccccucccaguaauaaaaaaaaaaaaaaaaaaaauauauauauauauauauauauaua

SEQ ID NO: 92994 - RNA, 64 nt, hsa
uugauuagcaaagguuuuugacaaacaguuuaugaaaaaauaaaacuuaaauacauuacacggg

SEQ ID NO: 92995 - RNA, 64 nt, hsa
ugugugugaugccccaguauugaguaugcuagcuaaaaaauaucaagugccugauuaaagaauu

SEQ ID NO: 92996 - RNA, 64 nt, hsa
gagcuuuauuaagaagcauuucuuuucuucccuuaaaaaauagaugcuuauuuuuauugacaug

SEQ ID NO: 92997 - RNA, 64 nt, hsa
uuucaaugugaggaaugaaugauaaauuaagagaaaaaaauaucaggaaggucaauauaugccu

SEQ ID NO: 92998 - RNA, 64 nt, hsa
gauagaccuagcaaggagauaagaauagaucauuaaaaaauaaauauaaauggauuggauagaa

SEQ ID NO: 92999 - RNA, 64 nt, hsa
ccggagucuuugaagcugaaaauauaaaacaaauaaaaaauaaaaaaauaaaaacccacaaaaa

SEQ ID NO: 93000 - RNA, 64 nt, hsa
uuugaagcugaaaauauaaaacaaauaaaaaauaaaaaaauaaaaacccacaaaaauguugaac

SEQ ID NO: 93001 - RNA, 64 nt, hsa
cuuucacugaagguuuuuuuuucuuaaaaauaaaaaaaaauauauaaguguaacauguuuucau

SEQ ID NO: 93002 - RNA, 64 nt, hsa
uugcagucagacauucgucaugggaaaguucagaaaaaaauaaaguccuuuuaagggaacuucc

SEQ ID NO: 93003 - RNA, 64 nt, hsa
guuucuuacauccuuaucgaggaauuggguuaggaaaaaauacauaauuguaaaacugaguuug

SEQ ID NO: 93004 - RNA, 64 nt, hsa
aguuuguaccaucuguuugaguauaugcacauuuaaaaaauaucauauaguaaaugcaaacaug

SEQ ID NO: 93005 - RNA, 64 nt, hsa
guuuuacacacauuugcauuguaaaugauaauuaaaaaaauaaguccagguauuuuuuauuaag

SEQ ID NO: 93006 - RNA, 64 nt, hsa
cuuacaaaaauguuuacuaugaacacacagaaauaaaaaauaggcuaaauucauauauaucuug

SEQ ID NO: 93007 - RNA, 64 nt, hsa
ucuugcaggaaaaaaauacaaagaaauuuaacaaaaaaaauauauuaauaaaaaaguucaaaaa

SEQ ID NO: 93008 - RNA, 64 nt, hsa
uacaacagugccgccaacaccaagucuugcaggaaaaaaauacaaagaaauuuaacaaaaaaaa

SEQ ID NO: 93009 - RNA, 64 nt, hsa
auuuuacugcuagcuugcaaaguuaugagaguuuaaaaaauaaaauauaugaaaauauguaaag

SEQ ID NO: 93010 - RNA, 64 nt, hsa
ggaauuuuucauugaguuauuuccucauucuuuuaaaaaauaagggacuauaaaucaguuaugu

SEQ ID NO: 93011 - RNA, 64 nt, hsa
aggcuaggaguauauugguucgaaaucccagggaaaaaaauaaaaauaaaaaauuaaaggauug

SEQ ID NO: 93012 - RNA, 64 nt, hsa
uuggaaacaaauagaacacaauauaauuuacauuaaaaaauaauuucuaccaaaauggaaagga

SEQ ID NO: 93013 - RNA, 64 nt, hsa
gagagccagaccuugucucaaaaaauaaaaaauaaaaaaauaaaaacaaaauaaggaauccuuu

SEQ ID NO: 93014 - RNA, 64 nt, hsa
gagagagagagagccagaccuugucucaaaaaauaaaaaauaaaaaaauaaaaacaaaauaagg

SEQ ID NO: 93015 - RNA, 64 nt, hsa
gcagccugagagagagagagccagaccuugucucaaaaaauaaaaaauaaaaaaauaaaaacaa

SEQ ID NO: 93016 - RNA, 64 nt, hsa
cagccugggcaacauggugaagccccaucucuacaaaaaauacaaaaaaauuagccggguauga

SEQ ID NO: 93017 - RNA, 64 nt, hsa
auuaaauuggaauuuuuuaauccuuuauauacaaaaaaaauacgaucacucaguguguguuucu

SEQ ID NO: 93018 - RNA, 64 nt, hsa
gccauuggcuugugcuguguuaagaaaggggaaaaaaaaauaacccaagugacuccuuucuagu

SEQ ID NO: 93019 - RNA, 64 nt, hsa
caguugccaguggaaauguuggguugguucaaaaaaaaaauaaaagcuauacuauaucucucua

SEQ ID NO: 93020 - RNA, 64 nt, hsa
aaacaccuguuaauuuuaaacacauuuuuuaagaaaaaaauaauuaaaaaagaaacagugcuca

SEQ ID NO: 93021 - RNA, 64 nt, hsa
aaggaucuuuuguccauuccauuaauaacugaauaaaaaauaaauaaaauggauagaaaaaaac

SEQ ID NO: 93022 - RNA, 64 nt, hsa
aagucccuauaguauaugauuauaaugcuauuuuaaaaaauauauauauaaaauauuuuuuucu

SEQ ID NO: 93023 - RNA, 64 nt, hsa
cuccuagagaggagaaaggggugauugaaagaaaaaaaaauacuuaaauauuuguaauugugag

SEQ ID NO: 93024 - RNA, 64 nt, hsa
cuuucccccuaggauuauggugauuaucuguguuaaaaaauaaguccuuaaaguuacuguuuug

SEQ ID NO: 93025 - RNA, 64 nt, hsa
uaaaaauauauauguauaagaguuauguauuugaaaaaaauauauaaaagaauauacaucacaa

SEQ ID NO: 93026 - RNA, 64 nt, hsa
guuuaauugaaugauuuaugaugaaucuugggcaaaaaaauacaacuguaaaaaauuucacagg

SEQ ID NO: 93027 - RNA, 64 nt, hsa
ugggcauuauuaaauuuuuguggaagcuaauaguaaaaaauaaaagcuguuuucaccaccuccc

SEQ ID NO: 93028 - RNA, 64 nt, hsa
aaggaggaagagaguggaauggaaaaaguauucaaaaaaauaaucacuaaaggccaggugcagu

SEQ ID NO: 93029 - RNA, 64 nt, hsa
ggccugagcaacacagggagacucaguuucuccaaaaaaauaaaaaauuagccgaucauggugg

SEQ ID NO: 93030 - RNA, 64 nt, hsa
cuccccaaaagaaaccaugacaaaccuagcuuuuaaaaaauauuuuaagaaagagaaugaacug

SEQ ID NO: 93031 - RNA, 64 nt, hsa
cuuuguauuauaauuguugauauuuucccuuuuuaaaaaauaccauugaaaucagcaugacaaa

SEQ ID NO: 93032 - RNA, 64 nt, hsa
uuaguauuguugaaucaauuacuuugguuucaugaaaaaauaaacgauaaauaucuuuaaagag

SEQ ID NO: 93033 - RNA, 64 nt, hsa
guggauuaaaccaauugcagaucaaaaauauuagaaaaaauaaaaauaauacaaauaaaaauac

SEQ ID NO: 93034 - RNA, 64 nt, hsa
auccauuugccuauaaauaccuguaaacgacuuuaaaaaauaaaugauuauugcuuugugacaa

SEQ ID NO: 93035 - RNA, 64 nt, hsa
accauuugccaaaaaaaaaagcuuuucuugcuacaaaaaauaagcaauuuucuugagccuuauu

SEQ ID NO: 93036 - RNA, 64 nt, hsa
caguaguacaucauuuuagcaacucuaaaaaaaaaaaaaauacaaauaaaaaggaaaaaaaauu

SEQ ID NO: 93037 - RNA, 64 nt, hsa
ugauaucacugcugacuuuuauauuaugggagggaaaaaauaacauuaauaaaaaggugauaaa

SEQ ID NO: 93038 - RNA, 64 nt, hsa
caaggacuuuuacuuuuuauuacauaaaaauauuaaaaaauaaauaaaaaaaauaaaauuuuaa

SEQ ID NO: 93039 - RNA, 64 nt, hsa
uuuuuauuacauaaaaauauuaaaaaauaaauaaaaaaaauaaaauuuuaaacuaacuuaaccu

SEQ ID NO: 93040 - RNA, 64 nt, hsa
acaauccuggccaacggcgaaacucugucucuacaaaaaauauacaggcguguuagcaugugcc

SEQ ID NO: 93041 - RNA, 64 nt, hsa
cagccugggcaacauggcaaaaccccauuucuacaaaaaauacaaaaauuagcugggcauggug

SEQ ID NO: 93042 - RNA, 64 nt, hsa
cacagcacucuggugcgggaagaagcagaagcaaaaaaaauaaaaauaaaaaaauaaauaaaaa

SEQ ID NO: 93043 - RNA, 64 nt, hsa
gcgggaagaagcagaagcaaaaaaaauaaaaauaaaaaaauaaauaaaaauaaaaaaaauaaaa

SEQ ID NO: 93044 - RNA, 64 nt, hsa
aaaaaaauaaaaauaaaaaaauaaauaaaaauaaaaaaaauaaaaaaggaaaaaaaaaaaagaa

SEQ ID NO: 93045 - RNA, 64 nt, hsa
cacuguucuuuuuuuauuuuauugucauuucaauaaaaaauauuugaaagagaaugacucugug

SEQ ID NO: 93046 - RNA, 64 nt, hsa
aauacugauaaauucggaucaaauuugggggaauaaaaaauauuagagcaaaggaguuugcugg

SEQ ID NO: 93047 - RNA, 64 nt, hsa
cagguuaagagaaaaacgaaauuuuaaaaacuuuaaaaaauacugauaaauucggaucaaauuu

SEQ ID NO: 93048 - RNA, 64 nt, hsa
accuaggaggaugccuaacagagaguaagcacuuaaaaaauauuugucauaugaaugaaaaaau

SEQ ID NO: 93049 - RNA, 64 nt, hsa
aguaagcacuuaaaaaauauuugucauaugaaugaaaaaauaaacgagugaauguugauagaaa

SEQ ID NO: 93050 - RNA, 64 nt, hsa
gaauucuacaucuuauaaaaccuaacuggcauuuaaaaaauacuguggccgggcgugguggcuc

SEQ ID NO: 93051 - RNA, 64 nt, hsa
agccuggacaacacagugagaccucaucucuaucaaaaaauaaaaauuagcuagaugugguggc

SEQ ID NO: 93052 - RNA, 64 nt, hsa
ggcaacagagcaagacccugucuccgaaacaaauaaaaaauacuguaauaaaaguacuuauaaa

SEQ ID NO: 93053 - RNA, 64 nt, hsa
ucugcgagaaacacccaagaaugaucaauuaaaaaaaaaauaauauaauaauaauucuuguccu

SEQ ID NO: 93054 - RNA, 64 nt, hsa
uuuaaguaaccacucaaaacuuuucauuucacugaaaaaauaugaaaaaccaugacaauagggc

SEQ ID NO: 93055 - RNA, 64 nt, hsa
gaaguggucuucauaugucaacuacagaaaaggaaaaaaauagaaauugaaggauuuuuaugaa

SEQ ID NO: 93056 - RNA, 64 nt, hsa
guaauuuuacauuacauaaguuccuuuuacaauuaaaaaauagcacuucuucaucuuaugccug

SEQ ID NO: 93057 - RNA, 64 nt, hsa
auuaaguucuuagucauugauuuuuguguuuaaaaaaaaauaggaaagagggaaacugcagcuu

SEQ ID NO: 93058 - RNA, 64 nt, hsa
aauucuauugaaaaaggaaaaucagcaauucagcaaaaaauaaauaaaaaauaaaaauguaaau

SEQ ID NO: 93059 - RNA, 64 nt, hsa
aaaaggaaaaucagcaauucagcaaaaaauaaauaaaaaauaaaaauguaaauaugauaguaau

SEQ ID NO: 93060 - RNA, 64 nt, hsa
cuucuuucccuaccuuuuuuuucuuuuuuucuuaaaaaaauauuuuguguuauuaacagaaauu

SEQ ID NO: 93061 - RNA, 64 nt, hsa
ugcuuccuugaaacauuuuugugcuauuguuuuaaaaaaauaauuaaaaaacaguuggcguuaa

SEQ ID NO: 93062 - RNA, 64 nt, hsa
gagagacccuguaucugaaaguaauaauaaaaauaaaaaauauaaaugaggucucguugauguu

SEQ ID NO: 93063 - RNA, 64 nt, hsa
uccagccugggcaacaaagcaagacucugucucaaaaaaauaaaaauaaaaaaaaaaucuuagu

SEQ ID NO: 93064 - RNA, 64 nt, hsa
uugucagcuggaacucagaaacaacaacuugaaaaaaaaauaauaauuagaacauauuugcaua

SEQ ID NO: 93065 - RNA, 64 nt, hsa
cuccagccugggcgacagagcaagacuccgucucaaaaaauaaaaaaaaaaaaaaaauagguga

SEQ ID NO: 93066 - RNA, 64 nt, hsa
gagcaagacuccgucucaaaaaauaaaaaaaaaaaaaaaauaggugaaaauuccuuauaaaucc

SEQ ID NO: 93067 - RNA, 64 nt, hsa
agccugggugacagaguaagacccugucucaacaaaaaaauaacagguucuguugcugcugagc

SEQ ID NO: 93068 - RNA, 64 nt, hsa
ggugacagagccagacuccaucucaaagaaaaaaaaaaaauauuaagagguucugcugccagau

SEQ ID NO: 93069 - RNA, 64 nt, hsa
gcccaggugacagugugagacuccaucucaaaaaaaaaaauaagaggccgggugcgguggcuca

SEQ ID NO: 93070 - RNA, 64 nt, hsa
caaaucuuguuucuggcacuuuagaaaaacugcaaaaaaauacguaauaaagaauacauauaua

SEQ ID NO: 93071 - RNA, 64 nt, hsa
ggauaaauauuucccaucccacccaccuccccccaaaaaauagcucacaaggggagagccagua

SEQ ID NO: 93072 - RNA, 64 nt, hsa
uagugcuuaaaaaaaaaaaagaaggaaaaauugaaaaaaauaaaaaaaaaaguuacagaaugcu

SEQ ID NO: 93073 - RNA, 64 nt, hsa
ugcaaguuaaaggguuugucauuguuucuuuaaaaaaaaauacaauaaugcaccauaucccuau

SEQ ID NO: 93074 - RNA, 64 nt, hsa
acacacccagccugaaguucuaaaagaaaaagcuaaaaaauaugguuaaaaacuguauauacaa

SEQ ID NO: 93075 - RNA, 64 nt, hsa
uaaaauaguuaauauuauccccauuugacagacgaaaaaauagaggcacagugaaguaacuugc

SEQ ID NO: 93076 - RNA, 64 nt, hsa
ucucauauauuguguuuuuuuuuuuuuuuccuagaaaaaauauuuaaagcauuguuugacaggu

SEQ ID NO: 93077 - RNA, 64 nt, hsa
uuaaauagaaacuuuaguuuuuuguaaauuuuuaaaaaaauauuucauugauaugcaucucugc

SEQ ID NO: 93078 - RNA, 64 nt, hsa
uggggugagagcuaaacauugcacagggaaagaaaaaaaauaacugcacugacuuuauaucuuu

SEQ ID NO: 93079 - RNA, 64 nt, hsa
accacuaguauucaaaucucuuucagguuuuauuaaaaaauauauaucaauaaacuaaaagguu

SEQ ID NO: 93080 - RNA, 64 nt, hsa
uuuucaucucacaguaaagccuauuuccccaggaaaaaaauaaaugccuuugaaugaaaauucu

SEQ ID NO: 93081 - RNA, 64 nt, hsa
acuuggcaugcgcaauaaagcagcacauguaaaaaaaaaauacacagugcaaggacuuuauuau

SEQ ID NO: 93082 - RNA, 64 nt, hsa
uguauuuggguauuuuucuccucuaccuucuaaaaaaaaauaccauaagaagaaucagaaugua

SEQ ID NO: 93083 - RNA, 64 nt, hsa
uuuguuucccuuuaguauuuaauggucuuuggagaaaaaauaauaaaacagaguguuauauaua

SEQ ID NO: 93084 - RNA, 64 nt, hsa
uuuuauaauguauuaaauacaauaaacucuguuuaaaaaauaaggucugugugaaacacacaug

SEQ ID NO: 93085 - RNA, 64 nt, hsa
gggaacaauuggaauagugauauccucaagguguaaaaaauauauaaauauauauauauauguc

SEQ ID NO: 93086 - RNA, 64 nt, hsa
uaaugcugugguugauauuucgaaagcugcuuuaaaaaaauacaugcaucucagcguuuuuuug

SEQ ID NO: 93087 - RNA, 64 nt, hsa
auguaccaugaaacaaagcugcaggcuguuuaagaaaaaauaacacacauauaaacaucacaca

SEQ ID NO: 93088 - RNA, 64 nt, hsa
uuuuuucugaaugugucugaguccaagagugggcaaaaaauaauuuucuacuuuggacuaaucu

SEQ ID NO: 93089 - RNA, 64 nt, hsa
gaacauuuauuaaaaaauaauguaaugcauggucaaaaaauauguaauucauggucuggacacu

SEQ ID NO: 93090 - RNA, 64 nt, hsa
uuuccacuauaaagaauuuuauugaacauuuauuaaaaaauaauguaaugcauggucaaaaaau

SEQ ID NO: 93091 - RNA, 64 nt, hsa
ccagccugggcgacagagcaagacucugucucaaaaaaaauaaaaaauaaucagggcacagugg

SEQ ID NO: 93092 - RNA, 64 nt, hsa
gggcgacagagcaagacucugucucaaaaaaaauaaaaaauaaucagggcacaguggcucaugc

SEQ ID NO: 93093 - RNA, 64 nt, hsa
aagggggccgcugcgagaaguucacccacccccgaaaaaauaauuaaacucgcaggccaggcac

SEQ ID NO: 93094 - RNA, 64 nt, hsa
agccuggguaacagagggagacuccuccgucucaaaaaaauaaauaaauaaacuugugagcugg

SEQ ID NO: 93095 - RNA, 64 nt, hsa
accacaggcugcaccauaagacccacucacaauaaaaaaauaaaaggccgagccgggcaugguu

SEQ ID NO: 93096 - RNA, 64 nt, hsa
gccgagccgggcaugguugcucacucccguaauaaaaaaauaaaagaacaggcugagccgggca

SEQ ID NO: 93097 - RNA, 64 nt, hsa
ggccaacauggugaaaccccgccucuacuaaaaaaaaaaauacaaaaaauuaggcgugguggug

SEQ ID NO: 93098 - RNA, 64 nt, hsa
ggcgacagagcaagacucugucucaagaagaaaaaaaaaauacauauacacauaaauauauaua

SEQ ID NO: 93099 - RNA, 64 nt, hsa
ucagguaucacuucuaguuuuacuuuaaaaaauaaaaaaauagagacagagucucaccauguuu

SEQ ID NO: 93100 - RNA, 64 nt, hsa
cguagagcucagguaucacuucuaguuuuacuuuaaaaaauaaaaaaauagagacagagucuca

SEQ ID NO: 93101 - RNA, 64 nt, hsa
ugggugacagaaugagacucugugucaaaaaaauaaaaaauaaaaaaucuaagggcucaggaac

SEQ ID NO: 93102 - RNA, 64 nt, hsa
uucagccugggugacagaaugagacucugugucaaaaaaauaaaaaauaaaaaaucuaagggcu

SEQ ID NO: 93103 - RNA, 64 nt, hsa
caccaugaccaacguguuucuuaauuuaaaaaaaaaaaaauagaccaggugcucuggcucaugc

SEQ ID NO: 93104 - RNA, 64 nt, hsa
agccugggcagaauggugaaaccaccuucucuacaaaaaauacauaaauuagcugggcauugug

SEQ ID NO: 93105 - RNA, 64 nt, hsa
acuacaaaaauacaauuacucaccaaaaagcuuuaaaaaauaaagcugugucuuuagggagacc

SEQ ID NO: 93106 - RNA, 64 nt, hsa
auauccucuacgguuauuuccugcuuucuaauuaaaaaaauaauaaccauggcaagagagaaag

SEQ ID NO: 93107 - RNA, 64 nt, hsa
gccaacauggugaauuaucucuacuaaaaauacaaaaaaauaauaauaauagccaggcguggug

SEQ ID NO: 93108 - RNA, 64 nt, hsa
ucaugugcccccaauuuuucacuauuguuauuugaaaaaauauuuuuauuuguaagaguuuuuc

SEQ ID NO: 93109 - RNA, 64 nt, hsa
uuucuugacuuuaaaaaaauuauuaaaaacaaaaaaaaaauaaauuuuuuugcaauccuuuccu

SEQ ID NO: 93110 - RNA, 64 nt, hsa
gaaugauauaaaggagauacauguuucuuccuuuaaaaaauaaacggaaguuacauuguuaaug

SEQ ID NO: 93111 - RNA, 64 nt, hsa
uucaguuucaaucaaguuuacauuauguugcuuaaaaaaauagaaauuauucuuuaucuugcaa

SEQ ID NO: 93112 - RNA, 64 nt, hsa
cagagcuauccugaaacugaacagcugaaacuuuaaaaaauaauugguauuauuuugugccccc

SEQ ID NO: 93113 - RNA, 64 nt, hsa
ucagauccauaauccauacucagugaaagcagggaaaaaauauuuucacuuauuuuauuugcuu

SEQ ID NO: 93114 - RNA, 64 nt, hsa
ggagaagagaaggcauuaguaagaaaaaaauagaaaaaaauaugaacagacucagcuuugggac

SEQ ID NO: 93115 - RNA, 64 nt, hsa
acaggggcagggagaagagaaggcauuaguaagaaaaaaauagaaaaaaauaugaacagacuca

SEQ ID NO: 93116 - RNA, 64 nt, hsa
aaacugugcaauccccucaaaaaaauaaaaauaaaaaaaauaaaaauaaaaaaacauuuuuuuc

SEQ ID NO: 93117 - RNA, 64 nt, hsa
ugaguguuuggaaauaaacugugcaauccccucaaaaaaauaaaaauaaaaaaaauaaaaauaa

SEQ ID NO: 93118 - RNA, 64 nt, hsa
cgagacuccgucucaaaaaaauaaauacauaaauaaaaaauaaaccaaccauaauccccagugc

SEQ ID NO: 93119 - RNA, 64 nt, hsa
uccaggcugggcgacagagcgagacuccgucucaaaaaaauaaauacauaaauaaaaaauaaac

SEQ ID NO: 93120 - RNA, 64 nt, hsa
ggcuaacauggugaaaccccgucucuacuaaaaaaaaaaauacaaaaaauuagccgggcguugu

SEQ ID NO: 93121 - RNA, 64 nt, hsa
aaacuuaccuacacugaucuuaguucucuuaugaaaaaaauaagauguuaucccaucaaauaaa

SEQ ID NO: 93122 - RNA, 64 nt, hsa
uguugccuagcauuuuauagauauuuauuauuuaaaaaaauaaagauauguuuuuaaugaagag

SEQ ID NO: 93123 - RNA, 64 nt, hsa
cuauagaaauccaauuaagacucacuuggguaaaaaaaaauaaaaaaauaaacaaaauaaacug

SEQ ID NO: 93124 - RNA, 64 nt, hsa
auccaauuaagacucacuuggguaaaaaaaaauaaaaaaauaaacaaaauaaacugcucacuua

SEQ ID NO: 93125 - RNA, 64 nt, hsa
gguuuacuuucuaucagcugagcaaccucucaagaaaaaauaaauaaauaaauaaaccucucuu

SEQ ID NO: 93126 - RNA, 64 nt, hsa
uccagccugagugacagagugagacuuugcaaccaaaaaauaaaauaauaauaauaaugaaaua

SEQ ID NO: 93127 - RNA, 64 nt, hsa
uaagagaauugugugaaaucauguaguugcaaauaaaaaauaguuugaggcaugacaacgcgug

SEQ ID NO: 93128 - RNA, 64 nt, hsa
auuuuuauagaaguuauugagaauaaucuuucuuaaaaaauauaugcacuuuagauauugauau

SEQ ID NO: 93129 - RNA, 64 nt, hsa
uuuuauuuuuugugguuauauucccaacaacauuaaaaaauacucgaggcauaaauguaguugu

SEQ ID NO: 93130 - RNA, 64 nt, hsa
gggcagaaagcaaaccuaguuaaauaggugagaaaaaaaauaauaaucccagugccauuugucu

SEQ ID NO: 93131 - RNA, 64 nt, hsa
guucuuuaacacugacuacuaaacuuuaaguuuuaaaaaauagguuuucauuuauggcuuuuug

SEQ ID NO: 93132 - RNA, 64 nt, hsa
gcauuaggcugaaagaguuuauuuugguggucaaaaaaaauaugcuuccacucauguaacuauu

SEQ ID NO: 93133 - RNA, 64 nt, hsa
uuuuuuaaaaauaauauuguuaaucaguaaaaaaaaaaaauauuuuugaucuaaacauagguuc

SEQ ID NO: 93134 - RNA, 64 nt, hsa
cucucucuuuucauucuauuuuaaguuuagaccaaaaaaauacagagucauccccuacccccac

SEQ ID NO: 93135 - RNA, 64 nt, hsa
guaggaaagagaggauaaacaaagaaaaaagaaaaaaaaauaagcucauacccaaauucacaaa

SEQ ID NO: 93136 - RNA, 64 nt, hsa
cagccuggacaacauggugaaaccccaucucuacaaaaaauacaaaaauuagccaugcauggug

SEQ ID NO: 93137 - RNA, 64 nt, hsa
caacauagcaaaauccugucucaaaaaaaaaguuaaaaaauauugcccggcuccuagaauuuau

SEQ ID NO: 93138 - RNA, 64 nt, hsa
ggacucucacaaagcugaugagcuguacuucagaaaaaaauaauaauuuccauguuuuguauau

SEQ ID NO: 93139 - RNA, 64 nt, hsa
ucugucuuuucccccuucagaauuuuccuuggaaaaaaaauacuagccuagcuggucauuucuu

SEQ ID NO: 93140 - RNA, 64 nt, hsa
ugaaagcccucuuuuuggugaagagagucaacuuaaaaaauaaauugccauguuccaaaauaau

SEQ ID NO: 93141 - RNA, 64 nt, hsa
cuauuagugauaacaaaugggucacuaucuggugaaaaaauaugguauuucaugaucuaagacu

SEQ ID NO: 93142 - RNA, 64 nt, hsa
uauauauauaaauuuuaauuucauagcaacuuguaaaaaauaaaauacuuguugaaaagccuuu

SEQ ID NO: 93143 - RNA, 64 nt, hsa
aauuugagggaggcagaagucugcaguugaagaaaaaaaauaagucuguuugucauauuuaagu

SEQ ID NO: 93144 - RNA, 64 nt, hsa
cacuccagccugggcaacagugaaacuccaucucaaaaaauaaauaaauaaaauaaauucuuag

SEQ ID NO: 93145 - RNA, 64 nt, hsa
aaaaaacaaaaacaaaaaaaccuuaaaugucaaaaaaaaauaauauuuucaccauccagacguc

SEQ ID NO: 93146 - RNA, 64 nt, hsa
agugauccacugaucucuaaucagaaauauuuuuaaaaaauacaauuuagaucucugaaaauug

SEQ ID NO: 93147 - RNA, 64 nt, hsa
aaggcuuuuaaaaguugguguuuucuuuuucuuaaaaaaauaauaaaacuacagacaaaaacaa

SEQ ID NO: 93148 - RNA, 64 nt, hsa
uaauguaauuccucuggauaaagauaauauauucaaaaaauauugggaccaaaaaaugcacuug

SEQ ID NO: 93149 - RNA, 64 nt, hsa
uauuuuucaaaugaagaagcaacacauaaguuucaaaaaauauccaggguacuccuggacagug

SEQ ID NO: 93150 - RNA, 64 nt, hsa
aauguaaucacccuauuugugacagagaaagggaaaaaaauauaauaagaucaucuaccuauaa

SEQ ID NO: 93151 - RNA, 64 nt, hsa
gugcuacuaaugucuugguagaauauucuugccaaaaaaauaccuugaacgcuuauguggaaag

SEQ ID NO: 93152 - RNA, 64 nt, hsa
auuccauuuccauccacaguguacuuuaagauugucuuaagaaauguaucugcaugaacuccgu

SEQ ID NO: 93153 - RNA, 64 nt, hsa
gguaaaugaauuguuugcauuuaaaaaaaaaaacucuuaagaaaacuguacuaaaucugaauca

SEQ ID NO: 93154 - RNA, 64 nt, hsa
ggaccuaaaagcacuuuauguaguuuuuaauuaaucuuaagaucugguuacgguaacuaaaaaa

SEQ ID NO: 93155 - RNA, 64 nt, hsa
ucaguaauuaguuaugaauauggauauccucaauucuuaagacagcuuguaaauguauuuguaa

SEQ ID NO: 93156 - RNA, 64 nt, hsa
agguuaaagacugaacgguuagugaagacaaaugucuuaagaggcugcgaugucuagguugggc

SEQ ID NO: 93157 - RNA, 64 nt, hsa
auucuaguuacugaugcaacuaaaauucuguauuucuuaagauggagccacugacgagauguca

SEQ ID NO: 93158 - RNA, 64 nt, hsa
acuuuccccucuauuugcucuccuuuuucuuucuucuuaagaguauuuauauuauuuuguuaag

SEQ ID NO: 93159 - RNA, 64 nt, hsa
agagccucuaaacuuuugagaaaucaaugugucuucuuaagaaaguuaagcacccucucuuaac

SEQ ID NO: 93160 - RNA, 64 nt, hsa
aaaugauuuuauaaacaauggacaauauauacuuucuuaagaucuaagguacuuucuuaagauc

SEQ ID NO: 93161 - RNA, 64 nt, hsa
gacaauauauacuuucuuaagaucuaagguacuuucuuaagaucuaagaauuugcugaaagcau

SEQ ID NO: 93162 - RNA, 64 nt, hsa
ucucauaacuuuccaagcuccaccacuuccuaaaucuuaagaacuuuaauugacaguuucaauu

SEQ ID NO: 93163 - RNA, 64 nt, hsa
aagcccagccaucaugacaaauccuugaauguucucuuaagaaaaugaugcuggucaucccagc

SEQ ID NO: 93164 - RNA, 64 nt, hsa
auuuaaauugucauuuuuuaaaggaauauuuucuucuuaagauauauagaggauuuuggagaag

SEQ ID NO: 93165 - RNA, 64 nt, hsa
gaaagaagauaaacugugauuugacaagucaagcucuuaagaaauacaaggacuucagauccau

SEQ ID NO: 93166 - RNA, 64 nt, hsa
uuuggcaugagcuaauaauugagggugcuaauuuucuuaagauagugccuaaaacacuaaauuu

SEQ ID NO: 93167 - RNA, 64 nt, hsa
gaugcuugcugccugccauuuucaaccuauucucucuuaagagugcuagguaccaaauugugaa

SEQ ID NO: 93168 - RNA, 64 nt, hsa
aauaauuuagcauauuuccuuucacacuuaaaguucuuaagaugagacuguguaaaugagagaa

SEQ ID NO: 93169 - RNA, 64 nt, hsa
auaaaauguugggagggaauauucccaauaaaggucuuaagagaaaagucacauuacaaguaau

SEQ ID NO: 93170 - RNA, 64 nt, hsa
cuaauguaauaauggaagccaaaguauucauauuucuuaagauagcccuaaauguacucuugaa

SEQ ID NO: 93171 - RNA, 64 nt, hsa
guaaagauaaauauucuagguuagucaagauuucucuuaagauuuaagugcauaaagaauagua

SEQ ID NO: 93172 - RNA, 64 nt, hsa
agggcagaccccgccaaugauuucucuucaccugucuuaagauuaaauaaaaaagaguguccug

SEQ ID NO: 93173 - RNA, 64 nt, hsa
ugaaacuuacacuacuucuccaagccuuuugcugucuuaagaauaagaccugagauuaacacua

SEQ ID NO: 93174 - RNA, 64 nt, hsa
aagcccagccaucaugacaaauccuugaauguucucuuaagaaaaugaugcuggucaucgcagc

SEQ ID NO: 93175 - RNA, 64 nt, hsa; identical to SEQ ID NO: 93162

SEQ ID NO: 93176 - RNA, 64 nt, hsa
uguuaaaauggcuuacacuugcagacuuugcaaaucuuaagacuaacaaauccuugaaaucaca

SEQ ID NO: 93177 - RNA, 64 nt, hsa
gaaacuaaaacaugccaagguuuugauauacuugucuuaagauauuaaugaaacacuucugaac

SEQ ID NO: 93178 - RNA, 64 nt, hsa
ucacagguaauggaaaacauaaguagaauaggugaccucuuaguuuugaacuuauuuaagugug

SEQ ID NO: 93179 - RNA, 64 nt, hsa
aguuggcagccuguaguccuagcuagcauacacuaccucuuaccugagaggugucuuuuaaaaa

SEQ ID NO: 93180 - RNA, 64 nt, hsa
aagaggaguuagaaaagagguccuugucauucucaccucuuauggaaaauggaauaagaaauaa

SEQ ID NO: 93181 - RNA, 64 nt, hsa
agagauugggguauguccccuguaguacacucuuaccucuuacuuccuagacuuugauuucucc

SEQ ID NO: 93182 - RNA, 64 nt, hsa
gggagcagagacugcuuuaaucccugcugacaucacggaaaagcaacagagccuuuucaacuuu

SEQ ID NO: 93183 - RNA, 64 nt, hsa
uuuacagggcaguguuucagauggcccugagcccacggaaaaggccagguagaccuccaaacua

SEQ ID NO: 93184 - RNA, 64 nt, hsa
auguuuacaggcuuccuguuugaugaagauagcaacggaaaacucaaaaugguggcaguucuua

SEQ ID NO: 93185 - RNA, 64 nt, hsa
gagaauucuggaguuguuaugaacaugaauaccaacggaaaaccuuaacugaaucuaaaagaaa

SEQ ID NO: 93186 - RNA, 64 nt, hsa
aaaggaagagcagaacaccugaaaaucagcaauuuccugacaacgaaagugaagaguaucacag

SEQ ID NO: 93187 - RNA, 64 nt, hsa
caaggaagagcagaacaccugaaagccagcaauuuccugacacugagaaugaagaguaucacag

SEQ ID NO: 93188 - RNA, 64 nt, hsa
ggagcaggccagguacgguggcuaacgccuguaauccugacacuuugggagucugaggcgggug

SEQ ID NO: 93189 - RNA, 64 nt, hsa
aggauuucauguuuguaucuucauaaggccaugcuccugacaggucuaggcaaccugggggaug

SEQ ID NO: 93190 - RNA, 64 nt, hsa
auuuucaauccaggagccuugagucuguguuguguccugacaccuccaaguucuagggccguca

SEQ ID NO: 93191 - RNA, 64 nt, hsa
aagcgagcagaggcuccacaggcuuacgcugcucuccugacagccacacgcgacccucggugca

SEQ ID NO: 93192 - RNA, 64 nt, hsa
cucaccgaagagaggaaccaccacacccagcagcuccugacagacccccaccccuaaagaugug

SEQ ID NO: 93193 - RNA, 64 nt, hsa
caccaaguucguaguugguaggugcccagccaaguccugacaucuucaugcccccucugcagag

SEQ ID NO: 93194 - RNA, 64 nt, hsa
cggguucuggcccccaaggucagagcaagcaucuuccugacagcauuuugucaucuaaagucca

SEQ ID NO: 93195 - RNA, 64 nt, hsa
aaccagauucuagaaacugcggucauccaguucuuccugacaccggaugggugcuugggaaccg

SEQ ID NO: 93196 - RNA, 64 nt, hsa
ggcaaaacccugucucaaaaaagaaagaaugauguccugacaugaaacagcaggcuacaaaacc

SEQ ID NO: 93197 - RNA, 64 nt, hsa
aaggagagaggcuugcuugggauauagaaagauauccugacauuggccaggcaugguggcucac

SEQ ID NO: 93198 - RNA, 64 nt, hsa
cugcacccaggaggccuccugacaccagccaaaauccugacagcagggucugcccucuugagug

SEQ ID NO: 93199 - RNA, 64 nt, hsa
cuagccccagagggaucccugcacccaggaggccuccugacaccagccaaaauccugacagcag

SEQ ID NO: 93200 - RNA, 64 nt, hsa
ccuuauaugcacaggcucaaguuguuuuaaaaaucucauuuauuauaauauugaugcucaauua

SEQ ID NO: 93201 - RNA, 64 nt, hsa
aagaauucuuucauugcuauauaauauucaguggcucauuuauaccuaauaaaauaaugguauu

SEQ ID NO: 93202 - RNA, 64 nt, hsa
agaaaagagauguccugaaaaugaaagguugcaccucauuuaaugaagcuuaacccuauguaga

SEQ ID NO: 93203 - RNA, 64 nt, hsa
uagcacuccuugauuaagaagcuaaaauguuucucucauuuacuccuuaaacaaaagacuuaaa

SEQ ID NO: 93204 - RNA, 64 nt, hsa
guuagagacagguuucccuguaggaagaugauggcucauuuacacucagcugcucugcaagcag

SEQ ID NO: 93205 - RNA, 64 nt, hsa
gaggccuggggaugugaacaaccugcucacaguccucauuuacuggauuugacuucagccaggu

SEQ ID NO: 93206 - RNA, 64 nt, hsa
acuacaguacaugcugaagcgugccguuucagcccucauuuaauucaauuuguaaguagcgcag

SEQ ID NO: 93207 - RNA, 64 nt, hsa
gccucccuccaccccaggacgccacucauuucaucucauuuaagggaaaaauauauaucuaucu

SEQ ID NO: 93208 - RNA, 64 nt, hsa
gugucacugugcugggccuauuuuauuuauagaacucauuuaagcuguuuuuauuuuaauaugc

SEQ ID NO: 93209 - RNA, 64 nt, hsa
augcaccaguauuaaaacacaucgacguaaguagcucauuuagcuuuuucugcuguucuuggcc

SEQ ID NO: 93210 - RNA, 64 nt, hsa
ugcaaagacaggaucauacacaugacuuauaccucucauuuaaauauuuuauaguauaaaguau

SEQ ID NO: 93211 - RNA, 64 nt, hsa
aauaauuuuaauaaaagugaaccagaacaaaucacucauuuaaaaaguaauucagaagaacagu

SEQ ID NO: 93212 - RNA, 64 nt, hsa
cagggagacccguccauuuggcagggguggcugccucauuuagagaggaaaaguaaccaucacu

SEQ ID NO: 93213 - RNA, 64 nt, hsa
auugcaaugaauccccaauaauugcagaacuaaacucauuuauaaagcuaaaauaaccggauau

SEQ ID NO: 93214 - RNA, 64 nt, hsa
cgaugggagccuuuaucugucauuagaaaucuuucucauuuaagaacuuaugaauaugcugaag

SEQ ID NO: 93215 - RNA, 64 nt, hsa
agugucuuacuuguacuguaucacauuccauacccucauuuaauucuuaauaaaacuguucacu

SEQ ID NO: 93216 - RNA, 64 nt, hsa
uacaaaggaagaacaucuggauuucauccuugaccucauuuacaaagcaaaaagagaugcugga

SEQ ID NO: 93217 - RNA, 64 nt, hsa
gagaugaaauuaaacagauuagaaauguaacauacucauuuaaauuaaauaaguuguauaaguu

SEQ ID NO: 93218 - RNA, 64 nt, hsa
caagaagcccuuuuggagcaaagugguugggaaacucauuuacuggguccaccaaaggaaaccc

SEQ ID NO: 93219 - RNA, 64 nt, hsa
gacauaugucuauguccucuguuuuuauuuaagccucauuuauuucucccuugccaugcccauu

SEQ ID NO: 93220 - RNA, 64 nt, hsa
ucucuacuccuuacagucucuagaauuaaauguacucauuuagacaacauauuaaaugcauauu

SEQ ID NO: 93221 - RNA, 64 nt, hsa
uugucuagucgggaaguaagguuggaaacuaagucucauuuacugauucguuuauggguaguac

SEQ ID NO: 93222 - RNA, 64 nt, hsa
caaaaaccaagucaaagccuaauuaaccaaagcacucauuuaaaaaucaucauguuuggaccua

SEQ ID NO: 93223 - RNA, 64 nt, hsa
ucucuaagaauuugaaauguauaaaccaugugaccucauuuauuugucuuauauauuuacagcc

SEQ ID NO: 93224 - RNA, 64 nt, hsa
guuugcacuuuaauaccaaacuuaaaaccaaacacucauuuaaaaguagguuaagugaucaugg

SEQ ID NO: 93225 - RNA, 64 nt, hsa
cauucaguuccauuagguuuucacauguguuaaucucauuuacagcauugaauugcggcaguaa

SEQ ID NO: 93226 - RNA, 61 nt, hsa
acagacauuaaacaauuguuguguucuuuuuaccuuuuauuuuucuauuaccuugcuacca

SEQ ID NO: 93227 - RNA, 61 nt, hsa
guuuucugaauuaauaaugacuuagauugugaccuuuuagauucgguguugagcucugugu

SEQ ID NO: 93228 - RNA, 61 nt, hsa
ucugccauuuugggugcccaccccaauuuuuaccuuuuaguaaguuggcaugaaauuuugg

SEQ ID NO: 93229 - RNA, 61 nt, hsa
uuauaguccuuauuuuuuuccuuugcgugaaaccuuuuauaacagauuaacaaucaacugc

SEQ ID NO: 93230 - RNA, 61 nt, hsa
gagcacuaugauuaucaaggugacuuuggaaaccuuuuaaaaaugcauuuuugcaaaacaa

SEQ ID NO: 93231 - RNA, 61 nt, hsa
aaccucaaccagguauaaaagaugcauaacaaccuuuuagcaguaagugucaagugaguga

SEQ ID NO: 93232 - RNA, 61 nt, hsa
uucucuagguaaguauguuuuaggauuaaauaccuuuuacagauacugaaagugccuccuu

SEQ ID NO: 93233 - RNA, 61 nt, hsa
agugaaucaguuucuuguuuauauuuuuuucaccuuuuaaacaaaaaauucuuuaaaauau

SEQ ID NO: 93234 - RNA, 61 nt, hsa
uugcugugaaauugaagugcauguagaaaaaaccuuuuacuauaugaaacuuuacaacacu

SEQ ID NO: 93235 - RNA, 61 nt, hsa
ugacuaguaauauaggcuuucaagaguugguaccuuuuagcuauauuugcagauucucugg

SEQ ID NO: 93236 - RNA, 61 nt, hsa
uuuuggucauauuuuuacuuuagugucacucaccuuuuacaaagugacuuuguacucauuu

SEQ ID NO: 93237 - RNA, 61 nt, hsa
gaaugauacaggccauaauugaaaugggaauaccuuuuaaguuucauuagggguggggugg

SEQ ID NO: 93238 - RNA, 61 nt, hsa
gucacuaaaaaauuuuacugucuaaauaaguaccuuuuauuggagaaaaaucaaaacccca

SEQ ID NO: 93239 - RNA, 61 nt, hsa
cugauuuauuuucuuaagugccaaugggcccaccuuuuaaacaagaaaacguuaaauaacu

SEQ ID NO: 93240 - RNA, 61 nt, hsa
aguaauagagucauacuuuuuuauaacagcaaccuuuuaaaaggaaagcucuuauaaaguc

SEQ ID NO: 93241 - RNA, 61 nt, hsa
accuucacauguccuauuacugaugugugcaaccuuuuauguguugaugacucacucauaa

SEQ ID NO: 93242 - RNA, 61 nt, hsa
uguugucccauaauugagaaagcuuaaauacaccuuuuauuaagaguuuguaaauucuagc

SEQ ID NO: 93243 - RNA, 61 nt, hsa
ugaaaaauauauuggcaaaauaaauguuuaaaccuuuuacguuaaaauuacuuugaaagau

SEQ ID NO: 93244 - RNA, 61 nt, hsa
caaacaugccuuuuguuuucuauauacccugaccuuuuaauaaaguuucaguguauuuauc

SEQ ID NO: 93245 - RNA, 61 nt, hsa
aauuuauaauagaacuuauagcuuuuaaaagaccuuuuaaagacauuaaauguaaacuuaa

SEQ ID NO: 93246 - RNA, 61 nt, hsa
aaucaacaaaauaugcuuucuggagaacuguaccuuuuaugguuugcuugcacaucaguag

SEQ ID NO: 93247 - RNA, 61 nt, hsa
gugucaauugaaaguugucaauuaaaagguaaccuuuuaaucucguaggaggaaucucauu

SEQ ID NO: 93248 - RNA, 61 nt, hsa
auuuuuuucuggauucaaacaggcaacaaugaccuuuuauuuucuguuuguccccaccucc

SEQ ID NO: 93249 - RNA, 61 nt, hsa
guauuuggagagagugacuauugaacuugaaaccuuuuauuccgggcgucuugguaguuuc

SEQ ID NO: 93250 - RNA, 61 nt, hsa
gaaaacaaaaaaagguagugaacuuucagcuaccuuuuaaagaggcuaaguuaucuuugau

SEQ ID NO: 93251 - RNA, 61 nt, hsa
ugaugcuugacagugugaaauguccaauuuuaccuuuuacacaaugugagauguaugaaaa

SEQ ID NO: 93252 - RNA, 61 nt, hsa
uccugaggcuuuggauuugacauugcguuugaccuuuuauguaguaauugacaugugccag

SEQ ID NO: 93253 - RNA, 61 nt, hsa
aacaggucuucaucgaaucuacuaauuccacaccuuuuauugacacagaaaauguugagaa

SEQ ID NO: 93254 - RNA, 64 nt, hsa
guaaaaaucagaaaauacaagauuuacauaaaggucauuucaacuuuuaagguuaccagugauu

SEQ ID NO: 93255 - RNA, 64 nt, hsa
gauaguguaugagacuuaagccaugaguuuuguaucauuucaauuagaagacuacuagcuguga

SEQ ID NO: 93256 - RNA, 64 nt, hsa
auaaagguaaguuaccuuaauaaaauuguugauaucauuucauccuugcauugcuucacuugau

SEQ ID NO: 93257 - RNA, 64 nt, hsa
ucccugguuuugcuuaauuccacuuaugcaucagucauuucaacagcaugaaugugguucugua

SEQ ID NO: 93258 - RNA, 64 nt, hsa
caguugcuaaccugaguugcaguguuuaaggccaucauuucacugcugcugucugugacuccac

SEQ ID NO: 93259 - RNA, 64 nt, hsa
agaugcagaaucagaaggaucuauuucuacagaaucauuucaccaguuaagcacaugaguagag

SEQ ID NO: 93260 - RNA, 64 nt, hsa
uagggcacaugugggcuuucucuugaucuuugugucauuucagaauucaaagacugugcuacgg

SEQ ID NO: 93261 - RNA, 64 nt, hsa
uaaaacaguagagcuagcaaugacaccuugcauuucauuucaacacugcuucaagguuucuuuu

SEQ ID NO: 93262 - RNA, 64 nt, hsa
ucacuuaauaauaugcaauuaagguuccuccaugucauuucauggcuuaauagugcauuuauuu

SEQ ID NO: 93263 - RNA, 64 nt, hsa
cucaucugggacauucuuaagauacauuuauaaaucauuucagcaguaguacuuuguauguguu

SEQ ID NO: 93264 - RNA, 64 nt, hsa
cuuucuugguuuucuaauggaguauauaguuuagucauuucacagacucuggccuccucuccug

SEQ ID NO: 93265 - RNA, 64 nt, hsa
ccagccagcgccucccuccaccccaggacgccacucauuucaucucauuuaagggaaaaauaua

SEQ ID NO: 93266 - RNA, 64 nt, hsa
caugagaucuaggugaggauugauuaccuaguagucauuucauggguuguugggaggauucuau

SEQ ID NO: 93267 - RNA, 64 nt, hsa
ugaaaugaauauaccccuuaguguuuggguauauucauuucaaagggagagagagagguuuuuu

SEQ ID NO: 93268 - RNA, 64 nt, hsa
guagggagggauuuuccuucauccuugugacauuucauuucaguaaggaaaagauaacaaagug

SEQ ID NO: 93269 - RNA, 64 nt, hsa
uuaucagcauuuuuuuuuccuggcauaaaauuaaucauuucauuuuauaauuuugugauaaaua

SEQ ID NO: 93270 - RNA, 64 nt, hsa
uguuuuuguggguauuuugucagacuuagagguuucauuucagggcauagucaaaggcaucauc

SEQ ID NO: 93271 - RNA, 64 nt, hsa
gaaaaagguuguuacauaaaacacccuggccaguucauuucagcaugcucuuucaaccagaagu

SEQ ID NO: 93272 - RNA, 64 nt, hsa
accuuucaaagaacuccugaagcaacuuaacucaucauuucagccucugaguagagguaaaacc

SEQ ID NO: 93273 - RNA, 64 nt, hsa
uggccagagauuuagauauguccaauuuccuggcucauuucauugugcucuauggguacguaua

SEQ ID NO: 93274 - RNA, 64 nt, hsa
auauucuauauuuuuuuaacuuaugagaauguguucauuucauuuguaacauauaaugggaaac

SEQ ID NO: 93275 - RNA, 64 nt, hsa
aauacugagauagacauguuuaguugaaguuauuucauuucagguuauauuaucuugggucaga

SEQ ID NO: 93276 - RNA, 64 nt, hsa
ucuucaaauuauuuucagccuccuugucauauaaucauuucaggcaaacugaggcaacacuaac

SEQ ID NO: 93277 - RNA, 64 nt, hsa
gaucaggacaaaaguguuagguucccaugauuucucauuucauuuauuaauaguuaaugcugaa

SEQ ID NO: 93278 - RNA, 64 nt, hsa
gaaaagaaacagguaguuaaguuaggguuaacauucauuucaaccacgagguuguauaucauga

SEQ ID NO: 93279 - RNA, 64 nt, hsa
ucuccuaauaacguuuugcugugucacuagauguucauuucacaagugcaugucuuucuaauaa

SEQ ID NO: 93280 - RNA, 64 nt, hsa
aaagcacauuaaaaagauaccaacauucagaaauucauuucagcauguuauuauuggaaauuau

SEQ ID NO: 93281 - RNA, 64 nt, hsa
aauaauuucuguuuaaaaauauugaauauuugcuucauuucaaauacucccuuuugacaaaaaa

SEQ ID NO: 93282 - RNA, 64 nt, hsa
uguacaauguuuucacauauauaguuucauuuaaucauuucaaaguuaaucucugccaucucgc

SEQ ID NO: 93283 - RNA, 64 nt, hsa
acuaauacuuaccgagucagacuuuguguucauuucauuucagggucuuggcugccugugggcu

SEQ ID NO: 93284 - RNA, 64 nt, hsa
uugaaacuaauacuuaccgagucagacuuuguguucauuucauuucagggucuuggcugccugu

SEQ ID NO: 93285 - RNA, 64 nt, hsa
auacccaguucuaccuacuuguauauuucuuuacucauuucaauaaaguguuugaaaaaaaaaa

SEQ ID NO: 93286 - RNA, 64 nt, hsa
gaugcauguuuauauauauggaaggaauauaguuucauuucauugcaaaggcaguauaaaagau

SEQ ID NO: 93287 - RNA, 64 nt, hsa
uauuuuauaguaagaaaugacaaacugcuuuguuucauuucauaaacaaacucugcauuuagau

SEQ ID NO: 93288 - RNA, 64 nt, hsa
ccaaaugagaaucaauuagguggauuuuuggcugucauuucaaaaguggaauaaauuuauuaau

SEQ ID NO: 93289 - RNA, 64 nt, hsa
uauuauuuuuuuauuuauucauuagaaauuuuccucauuucaaaauaauuuaugacucauggaa

SEQ ID NO: 93290 - RNA, 64 nt, hsa
auacaugauaaacaguuuaugguacuucucagaaucauuucauaauaagcaauuuauuuagcuu

SEQ ID NO: 93291 - RNA, 64 nt, hsa
ccacaguuugaagauucucauuaaaugauucauuucauuucaccuugacgauucuguuguuuug

SEQ ID NO: 93292 - RNA, 64 nt, hsa
cagugccacaguuugaagauucucauuaaaugauucauuucauuucaccuugacgauucuguug

SEQ ID NO: 93293 - RNA, 64 nt, hsa
uuuuagauugaauaaaauuuguaaaucauuauuuucauuucauaaguaaacaccuguugacugc

SEQ ID NO: 93294 - RNA, 64 nt, hsa
gugguuuugggggaucagaaggauuccuaaacugucauuucauuuauugguaggucaugauugc

SEQ ID NO: 93295 - RNA, 64 nt, hsa
ucagacaucugcagaaauguucugguucccaaagucauuucacuucgaaauaaaacacagcucc

SEQ ID NO: 93296 - RNA, 64 nt, hsa
uaaaggaaaguagcacauuagcauugauggcuguucauuucacccaguauaagcaagugcagug

SEQ ID NO: 93297 - RNA, 64 nt, hsa
uuuaguucacauuccuuaaguugaaucgguaguuucauuucaacugauaauaguaaagcuauuu

SEQ ID NO: 93298 - RNA, 64 nt, hsa
aaaugguagaauaaauuacagaauuuauuacuacucauuucaguguuuaguacagaaauugccu

SEQ ID NO: 93299 - RNA, 64 nt, hsa
gcuuaagauugaugauuucgugaaauaaagaacaucauuucauuuaagagaucauuucauuaag

SEQ ID NO: 93300 - RNA, 64 nt, hsa
ucgugaaauaaagaacaucauuucauuuaagagaucauuucauuaagaucucuaaucuguuuug

SEQ ID NO: 93301 - RNA, 64 nt, hsa
auuaaaaugccugcagauugaaaaugggggccacucauuucagaacugcaggaaugguguaguu

SEQ ID NO: 93302 - RNA, 64 nt, hsa
uguuucucaaugccugcuacuucuuguagauauuucauuucaggagagcagcaguuaaacccgu

SEQ ID NO: 93303 - RNA, 64 nt, hsa
accaugcccacagccaccggcugagcaaagaagcucauuucaugugaguucuaaggaaugagaa

SEQ ID NO: 93304 - RNA, 64 nt, hsa
gacugagcaaauacuacaaaauucaacuuaaccuucauuucauugguuuaaaugcguuauuaac

SEQ ID NO: 93305 - RNA, 64 nt, hsa
cugaugugacuucccugacuacuaccuucauauuucauuucaaauucaaacuucugagguugca

SEQ ID NO: 93306 - RNA, 64 nt, hsa
uggauuuuaaaaauauuuuacugcagccaaguuuucauuucaaaauguaauuucaguuuggagc

SEQ ID NO: 93307 - RNA, 64 nt, hsa
aaagggcaugaaaaacuaacugcuagcuuuccuuucauuucaaaaguccaagaauuucuaguau

SEQ ID NO: 93308 - RNA, 64 nt, hsa
aaguaacuggcuccuuacuuuaaauguucugccaucauuucaccugaugagcauucuuggagcc

SEQ ID NO: 93309 - RNA, 64 nt, hsa
aagagcaggauuugaaacuuggagagcuguuuucucauuucauguacacuugccccaaauuguc

SEQ ID NO: 93310 - RNA, 64 nt, hsa
aguuacacuugccagccccacucacaaaaguuguucauuucauugggucacuggcuuuauuugc

SEQ ID NO: 93311 - RNA, 64 nt, hsa
cuuucccuuuuguucauugaacuauauggacucuucauuucauauugauuuacugugcaauuua

SEQ ID NO: 93312 - RNA, 64 nt, hsa
aguguuaucuaccuuugucaggcuuuuugacaggucauuucagaguaagccuuuguucccaaga

SEQ ID NO: 93313 - RNA, 64 nt, hsa
uuuucuugaaauuugggagguuaauaccaaguauucauuucaugauguaaagaaacugaacagu

SEQ ID NO: 93314 - RNA, 64 nt, hsa; identical to SEQ ID NO: 93313

SEQ ID NO: 93315 - RNA, 64 nt, hsa
ucuugacagggagcucacuaccucacaaggcaggucauuucauugugggaucuauagaagguua

SEQ ID NO: 93316 - RNA, 64 nt, hsa
caacgcccauuagaaggggaaggacugccuacguucauuucauuuuauggagggucccagaaaa

SEQ ID NO: 93317 - RNA, 64 nt, hsa
uuaaagugaucacuguucuuuuuuuauuuuauugucauuucaauaaaaaauauuugaaagagaa

SEQ ID NO: 93318 - RNA, 64 nt, hsa
uuauacaucacugauuauuuggguuaaacuggacucauuucaagcaguuugcuuuuguucaaau

SEQ ID NO: 93319 - RNA, 64 nt, hsa
uaggguacaaaucucccaaagaugguuugcaccgucauuucaaauguuugcacaauauaccacu

SEQ ID NO: 93320 - RNA, 64 nt, hsa
uuauaucacaaauacccaaguuucaauucuaacuucauuucaugguauuucuuccuccucaaug

SEQ ID NO: 93321 - RNA, 64 nt, hsa
uuugaugcaauuuuaucauaagaguaacucagauucauuucaaaaggacagugaacaagcugag

SEQ ID NO: 93322 - RNA, 64 nt, hsa
ugcaaaugguuguccugcauauaaaaguaucuggucauuucaguuugguuuguaauuauuugau

SEQ ID NO: 93323 - RNA, 64 nt, hsa
uaagacaugugggaaaggcuuuuauucucccacgucauuucaaagacaugaaaaaacucacacu

SEQ ID NO: 93324 - RNA, 64 nt, hsa
uaagauaugugggaaaggcuuuuauucugccaagucauuucaaauaccugaaaaaucuuacacu

SEQ ID NO: 93325 - RNA, 64 nt, hsa
ucagacaagaugcacaccuugcucauuagugaguucauuucaggcagccagcucuuccucaccc

SEQ ID NO: 93326 - RNA, 64 nt, hsa
uccacuucuuuugguuccccaguccaaaacacagucauuucaccuggacuauuucaaucauuac

SEQ ID NO: 93327 - RNA, 64 nt, hsa
cccgaccccagccagcgccuuccacuccaucauuucauuucacacccccgaagggaggggaggc

SEQ ID NO: 93328 - RNA, 64 nt, hsa
uggagcccgaccccagccagcgccuuccacuccaucauuucauuucacacccccgaagggaggg

SEQ ID NO: 93329 - RNA, 64 nt, hsa
guuugccuucuugguaaaauuacauuuaaggaugucauuucaugagucaaauuguaucugcuga

SEQ ID NO: 93330 - RNA, 64 nt, hsa
uaaggaugaauuaccauaacaucuucauuuuuccucauuucauugccucucauacaguuuucuc

SEQ ID NO: 93331 - RNA, 60 nt, hsa
caauaggacauugugagaaggaauuuuucagggauucaucuacuaguuuaaaaaccccac

SEQ ID NO: 93332 - RNA, 60 nt, hsa
ugguucugguuggacagcuaaucugauuuggggauucacuguuucagaggacacagacaa

SEQ ID NO: 93333 - RNA, 60 nt, hsa
uccuuugcucucugcagcuguaagccagaggggauucaagguaaauaggcuuuacaggcu

SEQ ID NO: 93334 - RNA, 60 nt, hsa
cucuucugagggaagguugguugcaaaagugggauucaugacccucccaggcuacaccau

SEQ ID NO: 93335 - RNA, 60 nt, hsa
ccaucagagccucuccccaggugccccccggggauucagggcugaaucugcccaguuccc

SEQ ID NO: 93336 - RNA, 60 nt, hsa
auccuacuucuacccucacuggccuccagugggauucacuccugcccugcccccaccuuc

SEQ ID NO: 93337 - RNA, 60 nt, hsa
auucauaaguucuaaaauccuucauuaugagggauucaaaguauuuauaaaaacacugcc

SEQ ID NO: 93338 - RNA, 60 nt, hsa
acacauugauugagugccugcuggguacaagggauucaauuuaugccuauugauaucugc

SEQ ID NO: 93339 - RNA, 60 nt, hsa
agauaccgguuacauuauuaaaugauucuagggauucacugggggauauuuuuguugcuu

SEQ ID NO: 93340 - RNA, 60 nt, hsa
uggcuggacuggugauuccagggugcagaagggauucauauucccagaacgcuuuaagug

SEQ ID NO: 93341 - RNA, 60 nt, hsa
cagagaaccaucccuauuuuguauugaagagggauucacaucugcaucuuaacugcucuu

SEQ ID NO: 93342 - RNA, 60 nt, hsa
gccuguuuugucuuuuguuguuguucaaacgggauucacagaguauuugaaaaauguaua

SEQ ID NO: 93343 - RNA, 64 nt, hsa
accagccuggccaauaugaugaaaccccgucucuacuaaaaauacaaaauuagucggguauggu

SEQ ID NO: 93344 - RNA, 64 nt, hsa
accagccuggccaacauggugaaaccccgucucuacuaaaaauacaaaaaguagccaggcgugg

SEQ ID NO: 93345 - RNA, 64 nt, hsa
aacauccuggcuaacacggugaaacuccaucucuacuaaaaauacaaaaaauuggccgggcgca

SEQ ID NO: 93346 - RNA, 64 nt, hsa
aucauccuggccaacauggugacaccccgucucuacuaaaaauacaaaaauuacccaggcauag

SEQ ID NO: 93347 - RNA, 64 nt, hsa
gauguaucaguauauugucacaguugugcuguuaacuaaaaaugcugagaccccuuuuuauaga

SEQ ID NO: 93348 - RNA, 64 nt, hsa
aaucuacaccaaagugguuuuuuaaaauuacauaacuaaaaauaaaccacacuguggauacauc

SEQ ID NO: 93349 - RNA, 64 nt, hsa
accauccuggcuaacauggugaaacccugucucuacuaaaaauacaaaaaaaauuagccagcca

SEQ ID NO: 93350 - RNA, 64 nt, hsa
accauccuggcgaacacggugaaaccccgucucuacuaaaaaaaauacaaaaaaauuagccagg

SEQ ID NO: 93351 - RNA, 64 nt, hsa
accagccugaccaacauggcgaaaccccaucucuacuaaaaauacaaaaauuagccuggcaugg

SEQ ID NO: 93352 - RNA, 64 nt, hsa
ucuuuugagcuuucgauuaucaguguaguaccugacuaaaaaugaaguaauacccuuaaaccau

SEQ ID NO: 93353 - RNA, 64 nt, hsa
accagccugaccaacacggugaaaccccgucucuacuaaaaauacaaaaauuauccgggcaugg

SEQ ID NO: 93354 - RNA, 64 nt, hsa
uguaaaaaacaaaaacaaagaaacuaagaaucuuacuaaaaaucgauaaugucaguuaucuguu

SEQ ID NO: 93355 - RNA, 64 nt, hsa
ucuuuauugguagagcacugguuaucuucuggauacuaaaaaguuguauuacaaagccaaacac

SEQ ID NO: 93356 - RNA, 64 nt, hsa
uaugauuuucaucauaaagacuggcaauauuauaacuaaaaaucuuacuauaaugaaagaaauc

SEQ ID NO: 93357 - RNA, 64 nt, hsa
gacaugcacuuuccauauuuucaagucaauuuuaacuaaaaacuaagauaauguuuccuaguag

SEQ ID NO: 93358 - RNA, 64 nt, hsa
uuccuuuuucugugggaaucacaagaguuuauccacuaaaaaaagauauguaaaaaagauacuu

SEQ ID NO: 93359 - RNA, 64 nt, hsa
accauacuggcuaacacggugaaaccccgucucuacuaaaaauacaaaaaaaaaaaaaaaaaaa

SEQ ID NO: 93360 - RNA, 64 nt, hsa
accagccuggccaacauggcaaaaccacaucucuacuaaaaauaaaaaaauuagcugggugugg

SEQ ID NO: 93361 - RNA, 64 nt, hsa
aaaagaucuaauuugaaaaacuacaaaagcauuaacuaaaaaaguuuauuuuccuuuugucugg

SEQ ID NO: 93362 - RNA, 64 nt, hsa
cuuucgacaucccugaagcuagucuccugucuagacuaaaaauauccuugaaagaauaguagca

SEQ ID NO: 93363 - RNA, 64 nt, hsa
ugaagaucagauauguaugaaugcagucaaauaaacuaaaaacuaggaaaguguuaacuaucgu

SEQ ID NO: 93364 - RNA, 64 nt, hsa
accagccuggccaacauggugaaacccugucucuacuaaaaauacaaaaauuagccaggugugg

SEQ ID NO: 93365 - RNA, 64 nt, hsa
accauccuggcuaacauggugaaaccccgucucuacuaaaaauacaaaaaauuagccaggcgug

SEQ ID NO: 93366 - RNA, 64 nt, hsa
accagccugacuaacauggugaaaucccgucucuacuaaaaauacaaaaaaaaaaaaaaaaaaa

SEQ ID NO: 93367 - RNA, 64 nt, hsa
accauccuggccaacauggugaaauccugccucuacuaaaaauacaaaaaaaaaaaaaaauuag

SEQ ID NO: 93368 - RNA, 64 nt, hsa
gaaucuuaaauaguuacauuuuuuucuuuuuaacacuaaaaauacaauucaaauuuauuagcuc

SEQ ID NO: 93369 - RNA, 64 nt, hsa
aacaaacagcaauaacaauauuauuauuguuauaacuaaaaaaaaaaaaacaaaaacaagcagc

SEQ ID NO: 93370 - RNA, 64 nt, hsa
gcugguuuggccagcauggcgaaaccccaucucuacuaaaaauacaaaaaauuagcugggcaug

SEQ ID NO: 93371 - RNA, 64 nt, hsa
uuugccuuaauauugaauauacuguuuaccucacacuaaaaagaaaaccagaagccuuauuugu

SEQ ID NO: 93372 - RNA, 64 nt, hsa
aaaaaggcauaagauuacacugaacauauuagcuacuaaaaaggcacugcuaagacauucaagc

SEQ ID NO: 93373 - RNA, 64 nt, hsa
aaacucagacaagauuauauuuaauauauuaauuacuaaaaaggcauaagauuacacugaacau

SEQ ID NO: 93374 - RNA, 64 nt, hsa
auuuaauggccaaaugguuuuugcaagauuuaacacuaaaaagguuucaccugaucauauagcg

SEQ ID NO: 93375 - RNA, 64 nt, hsa
ucuguauuuucauguggaauggauuauagaguauacuaaaaaaugucuauagagaaaaacuuuc

SEQ ID NO: 93376 - RNA, 64 nt, hsa
aucagccuggccaacauggugaaaccccaucucuacuaaaaauacaaaaauuagccggacgcag

SEQ ID NO: 93377 - RNA, 64 nt, hsa
aucauccuggccaacauggugaaacccugucucuacuaaaaauacaaaaaugagcugggcaugg

SEQ ID NO: 93378 - RNA, 64 nt, hsa
accagccuggccagcaugguaaaacccugucuccacuaaaaauacaaaaauuagccaggcaugg

SEQ ID NO: 93379 - RNA, 64 nt, hsa
accauccuggccaacauggugaaacccugucucuacuaaaaauacaaaaauuagcugggugugg

SEQ ID NO: 93380 - RNA, 64 nt, hsa
uuaggugaggaggauuauuaacuggcacauauguacuaaaaaccccucacuuaaaaauggcagu

SEQ ID NO: 93381 - RNA, 64 nt, hsa
accagccuggccaacauggugaaacccugccucuacuaaaaauacaaaaaaugagccgggugca

SEQ ID NO: 93382 - RNA, 64 nt, hsa
ucacagaucuguuuaacccacuugaaaaaaaaacacuaaaaaugaagaaaugcuauaaguauaa

SEQ ID NO: 93383 - RNA, 64 nt, hsa
uuuucuuucuuauaacugcagagaaaauauccugacuaaaaaaaauucauuuuuuuggauuccu

SEQ ID NO: 93384 - RNA, 64 nt, hsa
auuucuuacucuauuguacguuuacagucgcagcacuaaaaauggaugacaucaaacauuuuua

SEQ ID NO: 93385 - RNA, 64 nt, hsa
cucacuucaagcacuaauuuggcucuuucugcucacuaaaaaucauauauuuuacagauuuauu

SEQ ID NO: 93386 - RNA, 64 nt, hsa
caucaugguuugaaaaaaggauaaaaaagcuauaacuaaaaaaaucuuaaggauaacauuuggu

SEQ ID NO: 93387 - RNA, 64 nt, hsa
accaggcuggccaacguggugaaaccccgucucuacuaaaaauacaaaaauuagccgggcguga

SEQ ID NO: 93388 - RNA, 64 nt, hsa
accaucccggcuaaaacggugaaaccccgucucuacuaaaaauacaaaaaauuagccgggcgua

SEQ ID NO: 93389 - RNA, 64 nt, hsa
aaccagaggacauacuagucacauguuauuauacacuaaaaaauaggaagucaucuugaaaggc

SEQ ID NO: 93390 - RNA, 64 nt, hsa
ucccuuccuuaucuguuaaauuuaaugucuuuauacuaaaaauauaggcucuugggauuggaga

SEQ ID NO: 93391 - RNA, 64 nt, hsa
accagccuggccaacauggcaaaaccccaucuuuacuaaaaauauaaaguacaucucuacuaaa

SEQ ID NO: 93392 - RNA, 64 nt, hsa
ccccaucuuuacuaaaaauauaaaguacaucucuacuaaaaauacgaaaaaauuagcugggcau

SEQ ID NO: 93393 - RNA, 64 nt, hsa
accagccaggccaacauggugaaacuucaucucuacuaaaaauacaaaaacuagccaggugugg

SEQ ID NO: 93394 - RNA, 64 nt, hsa
accaaccuggucuacauggugaaaccccaucucaacuaaaaauacaaaaaauacaaaaaauuag

SEQ ID NO: 93395 - RNA, 64 nt, hsa
accagccugaccaacauggagaaaccccgucucuacuaaaaauacaaaaauauuagccgggcgu

SEQ ID NO: 93396 - RNA, 64 nt, hsa
aucacccuggcccacauggugagaccccaacucuacuaaaaauacaaaaauuagcugggugugg

SEQ ID NO: 93397 - RNA, 64 nt, hsa
cuucuccucacucugggacagacgauguauggaaacuaaaaagaacaugcggcaccuuauuuau

SEQ ID NO: 93398 - RNA, 64 nt, hsa
accauccuggcuaacacagugaaacccugucucuacuaaaaaaauacaaaaaauuagcuuggcg

SEQ ID NO: 93399 - RNA, 64 nt, hsa
ggcuggucccuaugucaugucuuccauuaagaacacuaaaaaguccuugcaagaauggagauau

SEQ ID NO: 93400 - RNA, 64 nt, hsa
accaggcuggccgacauggugaaaccccaucucuacuaaaaaauauaaaaauuagccgggcuuu

SEQ ID NO: 93401 - RNA, 64 nt, hsa
auaauugauuuauguugaauauauggacuuagcaacuaaaaauaccacagaugguuaaccugga

SEQ ID NO: 93402 - RNA, 64 nt, hsa
accagccuggccaacauggugaaacccugucucuacuaaaaauacaaaaauuagccgggcaugg

SEQ ID NO: 93403 - RNA, 64 nt, hsa
agccuaagaguuauaggcuuaaagaugucgaguaacuaaaaacuguauugcuggccgggcgcgg

SEQ ID NO: 93404 - RNA, 64 nt, hsa
accauccuggccaacauggugaaacccugucucuacuaaaaauacaaaaaugagcugggugugg

SEQ ID NO: 93405 - RNA, 64 nt, hsa
gaagacacuauuuuagcuaaugggguuucuugggacuaaaaaauggcuuuguuuaaauuauaau

SEQ ID NO: 93406 - RNA, 64 nt, hsa
accauucuggccaacauggugaaaccccgucucuacuaaaaauacaaaaauuagcugggcaugg

SEQ ID NO: 93407 - RNA, 64 nt, hsa
accagccuggcuaacauagugagacccuguuucuacuaaaaauacaaaaauaagccaggugugg

SEQ ID NO: 93408 - RNA, 64 nt, hsa
cuugacaaaugcacugauuguuauacuuuaaauaacuaaaaaucugagaauccacagugcuaca

SEQ ID NO: 93409 - RNA, 64 nt, hsa
uaucauuaauuuuauaucaggauucauguaagagacuaaaaaugauccauagugguuaguacug

SEQ ID NO: 93410 - RNA, 64 nt, hsa
uuggacuugggaauagaaaagcaaccccgucucuacuaaaaauacaaaaaaauuagccaggcgu

SEQ ID NO: 93411 - RNA, 64 nt, hsa
uuaaaauuguuuauaaaucauaugauagaucuuuacuaaaaauggcuuuuuaguaaagccauuu

SEQ ID NO: 93412 - RNA, 64 nt, hsa
aucagccuggccaacauggcgaaaccccgucuccacuaaaaaugcaaaaaaaaaauuaaccggg

SEQ ID NO: 93413 - RNA, 64 nt, hsa
uagaauucuauauugauaagcaaacuauuuccaaacuaaaaaugugauagauaaaagugugauu

SEQ ID NO: 93414 - RNA, 64 nt, hsa
agaccauccuggccaacauggugaaaccuugucuacuaaaaauacaaaaaauuagcugggcaug

SEQ ID NO: 93415 - RNA, 64 nt, hsa
uugguucuauugcauaguacaugaaucuauugucacuaaaaauuagguuacuaaucuuaauuuu

SEQ ID NO: 93416 - RNA, 64 nt, hsa
guugucaacuugggcuacugaacuacaugcauaaacuaaaaacuaacagcuacaaacuuuuaag

SEQ ID NO: 93417 - RNA, 64 nt, hsa
accauccuggccaacauggugauaccccgucucuacuaaaaauacaaaaaaauuaguugggcau

SEQ ID NO: 93418 - RNA, 64 nt, hsa
accagccuggccaacauggugaaaccuugucucuacuaaaaauacaaaaauuagccaggcgugg

SEQ ID NO: 93419 - RNA, 64 nt, hsa
accagccugaccaacacggagaaacccuaucucuacuaaaaauacaaaaguagccgggcguggu

SEQ ID NO: 93420 - RNA, 64 nt, hsa
acuagccuggccaacauggugaaaccccgucucuacuaaaaauacaaaaauuagccgggcaugg

SEQ ID NO: 93421 - RNA, 64 nt, hsa
ccagccuguccaacauggugaaacccccaucucuacuaaaaauaccaaaaauuagccgagcgua

SEQ ID NO: 93422 - RNA, 64 nt, hsa
accauccuggccaacauggugaaaccccgucucuacuaaaaauacaaaaauuagcugggcaugg

SEQ ID NO: 93423 - RNA, 64 nt, hsa
accagccuggccaacauggcaaaaucccaucucuacuaaaaauacaaaaauucacagggugugu

SEQ ID NO: 93424 - RNA, 64 nt, hsa
accauccugaccaacguggugaaaccccaucucuacuaaaaauagaaaaaucagcugggugugg

SEQ ID NO: 93425 - RNA, 64 nt, hsa
uccagccugaccaacaugaagaaacccugucuguacuaaaaauacaaaaauuagccggacaugg

SEQ ID NO: 93426 - RNA, 64 nt, hsa
agacugggcaacagagggagacuccgucucaaaaacuaaaaaaaaaaaauacauuuaguauagc

SEQ ID NO: 93427 - RNA, 64 nt, hsa
accagccuggccaacauggugaaaccucgucuguacuaaaaauacaaaauuuagcugagugugg

SEQ ID NO: 93428 - RNA, 64 nt, hsa
accauccuggcuaacacggugaaacccugucucuacuaaaaauacaaaaaaauuagccaggcgu

SEQ ID NO: 93429 - RNA, 64 nt, hsa
accagccuggccaacauggcaaaaccccgucucuacuaaaaaauacagaaauuagcugggugug

SEQ ID NO: 93430 - RNA, 64 nt, hsa
ugggcaauuuuuuuaagacucugucuuaaaaaaaacuaaaaagaaaaaaagaagccccuucacu

SEQ ID NO: 93431 - RNA, 64 nt, hsa
accagccugaccaacauggcgaaaccccaucucuacuaaaaauacaaaaauuagcuuggcaugg

SEQ ID NO: 93432 - RNA, 64 nt, hsa
accagucuggccaacauggggaaaccccgucucuacuaaaaauacaaaaauuagccgggcaugg

SEQ ID NO: 93433 - RNA, 64 nt, hsa
accagccuggccaauguggugaaaccccaucucuacuaaaaauacaaaaauuagcugggcgugg

SEQ ID NO: 93434 - RNA, 64 nt, hsa
uuucuauguuuuuuuaauuacucaguuuuuuauuacuaaaaauagcacauuugaguacauuuga

SEQ ID NO: 93435 - RNA, 64 nt, hsa
uugacuccaaaaugucagagggaggccgcucuaaacuaaaaauaacgaaagguugccaaguauu

SEQ ID NO: 93436 - RNA, 64 nt, hsa
accagccuggccaacacggugaaaccccgccucuacuaaaaauacaaaaaauagccgggugugg

SEQ ID NO: 93437 - RNA, 64 nt, hsa
accagccuggucaacguggugaaacgccguuucuacuaaaaauaugaaaauuaguugggugugg

SEQ ID NO: 93438 - RNA, 64 nt, hsa
ccagccugacaaaacauagugaaaccccgucucuacuaaaaauacaaaaauuagcugggcgugg

SEQ ID NO: 93439 - RNA, 64 nt, hsa
aauguuaaagguuuuuucauuuuuaauauuuuaaacuaaaaacuguacuucaaucucaguuucu

SEQ ID NO: 93440 - RNA, 64 nt, hsa
caguggaggaaacagccucccaaaaggacagagaacuaaaaaauugcugcuggagaaggugaaa

SEQ ID NO: 93441 - RNA, 64 nt, hsa
auugcauauuuucauaaucagucaaaauaauaaaacuaaaaacaaaaaguaaaaauuaguuccc

SEQ ID NO: 93442 - RNA, 64 nt, hsa
uuuagcuucaggaauacugcucguuauaaacacuacuaaaaaaacaguuuauauuuuauauaca

SEQ ID NO: 93443 - RNA, 64 nt, hsa
ugaaaucucugccauuuuagauacugugaaacaaacuaaaaaaaaaaaagcuuuuguuuuguau

SEQ ID NO: 93444 - RNA, 64 nt, hsa
accagccuggccaacaaggugaaacccugucucuacuaaaaauacaaaaaauuagccaggcaug

SEQ ID NO: 93445 - RNA, 64 nt, hsa
accaaguguccagggaaacccuuguauuuugaugacuaaaaagagcacuuugcccguacuuagg

SEQ ID NO: 93446 - RNA, 64 nt, hsa
ucuccccacuuucccucuuccuuuaagaaaacuuacuaaaaaauguuucauugcgaagcagagg

SEQ ID NO: 93447 - RNA, 64 nt, hsa
accauccuggccaacauggugaaacccugucucuacuaaaaauacaaaaauagcugggcauggu

SEQ ID NO: 93448 - RNA, 64 nt, hsa
accagccuggguaauauggcaagagcccaacucuacuaaaaauacaaaaagaaaagaaaacagc

SEQ ID NO: 93449 - RNA, 64 nt, hsa
acccgccuggcuaacaaggcgaaauccugucuguacuaaaaauacaaaaaucagccagacaugg

SEQ ID NO: 93450 - RNA, 64 nt, hsa
auuucauuaugaggucagacuaggauaauguccaacuaaaaacaaacccuuuucauccuggcug

SEQ ID NO: 93451 - RNA, 64 nt, hsa
cugugauucuuauaagagcuuugucuucagaaaaacuaaaaauaaaaggcauugacuuaaacag

SEQ ID NO: 93452 - RNA, 64 nt, hsa
aaauccuggcagcuuuucuccaggcaucugggucacuaaaaacugauuuucuaaaauuauugga

SEQ ID NO: 93453 - RNA, 64 nt, hsa
accagacuggccaacauggugaaaccccgucucuacuaaaaaaaaaaaauagacaaaaauuagc

SEQ ID NO: 93454 - RNA, 64 nt, hsa
acccuccuggcuaacaccgugaaaccccgucucuacuaaaaauacaaaaaauuagccgggcgug

SEQ ID NO: 93455 - RNA, 64 nt, hsa
ugaauauugaaaaauugacaaauuguguacaaacacuaaaaaaaacuuguuuaaauuguauuug

SEQ ID NO: 93456 - RNA, 64 nt, hsa
caauuggucaucuggcuguaagguuugcccuugaacuaaaaauguuguuuggggcaagggccag

SEQ ID NO: 93457 - RNA, 64 nt, hsa
accagccuggccaacacggugaaaccccaucucuacuaaaaaaaaauacaaaaauuagccgggc

SEQ ID NO: 93458 - RNA, 64 nt, hsa
accagccuggccaacauggugaaaccccaucucuacuaaaaaaaaaaaaaaaauuagucgggcg

SEQ ID NO: 93459 - RNA, 64 nt, hsa
aucagccugaccaacauggugaaacccuaucucuacuaaaaauauagaauuagccaggcauggu

SEQ ID NO: 93460 - RNA, 64 nt, hsa
accagccuggccaacauggugaaaccccaucgcuacuaaaaauauaaaaaauuagcugggcaug

SEQ ID NO: 93461 - RNA, 63 nt, hsa
accaucauugcuaacauggugaaaccccgucucuacuaaaaauacaaaaaaaaaaaaaaaaca

SEQ ID NO: 93462 - RNA, 64 nt, hsa
accagccugaccaacauggagaaacccugucucuacuaaaaauacaaaauuagccaggcguggu

SEQ ID NO: 93463 - RNA, 64 nt, hsa
accagccuggccaacauggcgaaaccccaucucuacuaaaaauacaaaaauuagccgggcgugg

SEQ ID NO: 93464 - RNA, 64 nt, hsa
accagccuggccaauauggugaaaccccaucucuacuaaaaauauaaaaaucagcaaaaaaaau

SEQ ID NO: 93465 - RNA, 64 nt, hsa
agcuaaaauggcuuaacaucaugcuacacuuuacacuaaaaaucuauuacugugaguggucugu

SEQ ID NO: 93466 - RNA, 64 nt, hsa
aucugagggaaaacauguucagggcuucuagaacacuaaaaaauuuggcuuaaaccaguguuca

SEQ ID NO: 93467 - RNA, 64 nt, hsa
augagccuaaaaccucuuuaaaaacggucaguuaacuaaaaaauaaaaaucaagucuuuaggag

SEQ ID NO: 93468 - RNA, 64 nt, hsa
aaucaagucuuuaggagaguagaaaacacaauuaacuaaaaagcagggacaucugaaagagacg

SEQ ID NO: 93469 - RNA, 64 nt, hsa
cccuaaauacuucaguguguaauacugaauaauuacuaaaaaugauuuucucagaaaaaaaaac

SEQ ID NO: 93470 - RNA, 64 nt, hsa
aauauuuuacauggaauauuuggaaaauacuuauacuaaaaaauuauuuguuugaaauucaaau

SEQ ID NO: 93471 - RNA, 64 nt, hsa
ggacuuuuaaagguuugaauuuauuaggacacgaacuaaaaauaaaagugcacuaggggacagu

SEQ ID NO: 93472 - RNA, 64 nt, hsa
gauguuaugaagaagaggguauuucuaguuuuguacuaaaaaucaauuggaugaacuaaaucca

SEQ ID NO: 93473 - RNA, 64 nt, hsa
auaaaagugaaccauauuuaucugguuauauaaaacuaaaaauggggguguuuauauaaaacua

SEQ ID NO: 93474 - RNA, 64 nt, hsa
uauauaaaacuaaaaauggggguguuuauauaaaacuaaaaacuaagaaugauguaaccuuuug

SEQ ID NO: 93475 - RNA, 64 nt, hsa
accauccugucuaacacggugaaaccccaucucuacuaaaaauacaaaaaaauuagucggacau

SEQ ID NO: 93476 - RNA, 64 nt, hsa
accagccuggccaacauggugaaaccccaucucuacuaaaaauacaaaaauuagcuaggcgggg

SEQ ID NO: 93477 - RNA, 64 nt, hsa
accauccuggcuaacacggugaaaccccgucucuacuaaaaauacaaaaaaauuagucgggcgu

SEQ ID NO: 93478 - RNA, 64 nt, hsa
accagccuggccaacauggugaaaccccaucuuuacuaaaaauacaaaaaacuagccaggcgug

SEQ ID NO: 93479 - RNA, 64 nt, hsa
accauccuggcuaacacggugaaaccccgucucuacuaaaaauacaaaaaaaaaaaacaaaaaa

SEQ ID NO: 93480 - RNA, 64 nt, hsa
accagccuggccaaccuggugaaaugcagugucaacuaaaaauaggaaaaucagccaggcgugg

SEQ ID NO: 93481 - RNA, 64 nt, hsa
accauccuggccaacaugaugaaacccuaucucuacuaaaaauacaaaaauuagccgggcaugg

SEQ ID NO: 93482 - RNA, 64 nt, hsa
accauccuggcuaacacggugaaaccccaucucuacuaaaaauacaaaaaccaaaaaaaauuag

SEQ ID NO: 93483 - RNA, 64 nt, hsa
agcacccuggcuaacauggugaaaccccaucucuacuaaaaauacaaaaguuagccggggggug

SEQ ID NO: 93484 - RNA, 64 nt, hsa
accguccuggcuaacacggugaaaccccaucucuacuaaaaauauaaaauauuagccaggcgug

SEQ ID NO: 93485 - RNA, 64 nt, hsa
accagccuggccagcauagugaaaccccaucucuacuaaaaauacaaacuuagcugggcuuagu

SEQ ID NO: 93486 - RNA, 64 nt, hsa
accagccugaccaacauggagaaaccccaauuguacuaaaaauacaaaauuagccgggcguggu

SEQ ID NO: 93487 - RNA, 64 nt, hsa
accagccuggccaacauggugaaaccccaucuguacuaaaaauacaaaaauuugccuggugugg

SEQ ID NO: 93488 - RNA, 64 nt, hsa
gaaaauggggcuguuaauauacucuaaaagccauacuaaaaaugcucugagggaacuggcuaag

SEQ ID NO: 93489 - RNA, 64 nt, hsa
accagccuggccaacguggugaaaccccaucucuacuaaaaauacaaaaauuagccgggugugg

SEQ ID NO: 93490 - RNA, 64 nt, hsa
uauggacuuaaaguacuuauucauauaccuuguaacuaaaaauuagaacagcucccuagaauug

SEQ ID NO: 93491 - RNA, 64 nt, hsa
accagccuggccaacguggugaaacacugucucuacuaaaaauacaaaaaugagcuggguguga

SEQ ID NO: 93492 - RNA, 64 nt, hsa
gaccuccuggcuaacacggugaaaccccgucuuuacuaaaaauacaaaaaaaauuagcugggcg

SEQ ID NO: 93493 - RNA, 64 nt, hsa
ugucagguggucugcaaagaugauaaccuugacuacuaaaaacgucuccauggcggggguaaca

SEQ ID NO: 93494 - RNA, 64 nt, hsa
accagucuggccaacauagcaaaacccugucucuacuaaaaauacaaaaauuaucugggcaugg

SEQ ID NO: 93495 - RNA, 64 nt, hsa
accauccuggccaacauggugaaaccccgucucuacuaaaaauauaaaaauuagcugggugugg

SEQ ID NO: 93496 - RNA, 64 nt, hsa
accagccuggccaacaaggcaaaaccccgucucuacuaaaaauaugaaaauuagcugggcuugg

SEQ ID NO: 93497 - RNA, 64 nt, hsa
gccuggccaaccaacauggugaaaccucgugucuacuaaaaauacaagaaacuagccagaugcg

SEQ ID NO: 93498 - RNA, 64 nt, hsa
accagccuggccaacauggcgaaaccccgucucuacuaaaaauacaaaaauuagccaggacuga

SEQ ID NO: 93499 - RNA, 64 nt, hsa
uggaaaagaagaccuggguggaaagcgguuuggaugaaaagauuucaggcaaagacuugcagga

SEQ ID NO: 93500 - RNA, 64 nt, hsa
cagaaagacggguguuuuauuuggucuaauacccugaaaagaagugaugacuuguugcuuuuca

SEQ ID NO: 93501 - RNA, 64 nt, hsa
acgaguaaguagacaagaauaaagugguuugagaugaaaagaaccuaacauuauuuacaguaga

SEQ ID NO: 93502 - RNA, 64 nt, hsa
acaggagcaagagaaagaagauaauuuaaccaugugaaaagaauuuuuuugugugugaauuauc

SEQ ID NO: 93503 - RNA, 64 nt, hsa
uaguuuucuuuuuaucuuauuuuuacucguccguugaaaagauaaucaaggccuacauuuuagc

SEQ ID NO: 93504 - RNA, 64 nt, hsa
cagaaagacucuuuuagggcauuuuucugacucaugaaaagagcacagaaaaggauguuuggca

SEQ ID NO: 93505 - RNA, 64 nt, hsa
agcuuuugugauugaaaagacccuaucaagaaggugaaaagauaaccugcagaaugggagaaaa

SEQ ID NO: 93506 - RNA, 64 nt, hsa
auuggacuuaaucaagauuugaagcuuuugugauugaaaagacccuaucaagaaggugaaaaga

SEQ ID NO: 93507 - RNA, 64 nt, hsa
gagacuccaucucaaaaaaaaaaagagagagagaugaaaagaguaggaaaaugagaaaucaccu

SEQ ID NO: 93508 - RNA, 64 nt, hsa
aaaaaaaaaagaaaagaaaaagauaaagggauugugaaaagagcauuuauauuggacuaaucag

SEQ ID NO: 93509 - RNA, 64 nt, hsa
gccccgugccuucaguuaauaaagauuuguauugugaaaagauuuuuucuuuuuuuuuugggac

SEQ ID NO: 93510 - RNA, 64 nt, hsa
ugggauuacaggcgcgagccacggcgcccagccuugaaaagauguuuuuagaaccagaagaaac

SEQ ID NO: 93511 - RNA, 64 nt, hsa
uaauuaagcuaugauaggagaauaauaauaaagaugaaaagagaagguacccuaaggcugaggg

SEQ ID NO: 93512 - RNA, 64 nt, hsa
gaaccaagucuuacauagaaaaaaaagguagauaugaaaagaaaaaucacagaagagagaaugc

SEQ ID NO: 93513 - RNA, 64 nt, hsa
caaguuagagaaaagauggauuuaaugagauaaaugaaaagauauuuaaccuaauauaucaagg

SEQ ID NO: 93514 - RNA, 64 nt, hsa
uaucaaaaacaagugcuuguuuagcggagaauuuugaaaagaggaauauauaacucaauuuuca

SEQ ID NO: 93515 - RNA, 64 nt, hsa
ggaugaguacccucugaaaaagggaauuugcuggugaaaagaggcuggaucuuguggaagacug

SEQ ID NO: 93516 - RNA, 64 nt, hsa
uguugaauuacuguaucuuuuacuuuuuuuuuuuugaaaagauaaacuuguaaauagagugauu

SEQ ID NO: 93517 - RNA, 64 nt, hsa
auuucauuagauucucugauucuauauaagaaugugaaaagauugauauauuguuguuagaaau

SEQ ID NO: 93518 - RNA, 64 nt, hsa
gcauauaccgccacacccagcuaauuuuauuuuuugaaaagacaagguucccuauguugcccag

SEQ ID NO: 93519 - RNA, 64 nt, hsa
auaugacaaaugaaaagaauaacaaguugucaaaugaaaagaaugacauugaaacauuuguauu

SEQ ID NO: 93520 - RNA, 64 nt, hsa
uuuaguuaugagaaaucuuugcuuauaugacaaaugaaaagaauaacaaguugucaaaugaaaa

SEQ ID NO: 93521 - RNA, 64 nt, hsa
guuugaguugguugauugggguuugauuugcuuuugaaaagauuuuuauuuuuagaggcagggc

SEQ ID NO: 93522 - RNA, 64 nt, hsa
aaaauauauuuccucauaaacauuugaguuuuguugaaaagauggaguuuacaaagauaccauu

SEQ ID NO: 93523 - RNA, 64 nt, hsa
guagccuuuguggauuuggguuugugcuuuggguugaaaagaaguuuuuaguccuaggccagua

SEQ ID NO: 93524 - RNA, 64 nt, hsa
gauuugaggcuuuucuauauacuucucagagcacugaaaagaaaggaaggguuugcagaggaga

SEQ ID NO: 93525 - RNA, 64 nt, hsa
agcaaagaacuguaaccgaaagaaguaagagauuugaaaagacgauagaguuaaaacaauauuu

SEQ ID NO: 93526 - RNA, 64 nt, hsa
aagcaaacuuuuuguguuaucuggcacaggccuuugaaaagacuauaauucuacuuuguuuaau

SEQ ID NO: 93527 - RNA, 64 nt, hsa
aaauaguuucaaaugaguuuaaaaaaauaacaucugaaaagaaaugcuaauguaaucauuuauc

SEQ ID NO: 93528 - RNA, 64 nt, hsa
uguuuguaauauacaguuuuuguaaccauaugauugaaaagaagaaagucuaugcuuaggccag

SEQ ID NO: 93529 - RNA, 64 nt, hsa
aggagacacagauguucgguuuuuuuccuguuucugaaaagaaauaauaauauccaggucaaca

SEQ ID NO: 93530 - RNA, 64 nt, hsa
uguggauaacaaagauaucuuuucuuuagagaacugaaaagagagcagagaauauaacaugaaa

SEQ ID NO: 93531 - RNA, 64 nt, hsa
cagaaauacagcagacgaacauauuuauugguacugaaaagagacguaguaaauuaaauagaag

SEQ ID NO: 93532 - RNA, 64 nt, hsa
gugauguucuuuugcaaggcauagaacauuuguaugaaaagacauuuaguaugcuuugaaaaaa

SEQ ID NO: 93533 - RNA, 64 nt, hsa
auaauguacaguauaaagaggaauauugugcuuuugaaaagaguauacuuuuuacuuuuauuua

SEQ ID NO: 93534 - RNA, 64 nt, hsa
aucuccacuuuacuuaagaaaacuagcaaauauaugaaaagacccuuaguaccaaauacacuca

SEQ ID NO: 93535 - RNA, 64 nt, hsa
aaggauggagcuccguggguugacacuuuuucugugaaaagaacacugacacaccagucugggu

SEQ ID NO: 93536 - RNA, 64 nt, hsa
ugugugcaccugauuuggccaauaggaucaacagugaaaagacagaagaggcaauaccagcagu

SEQ ID NO: 93537 - RNA, 64 nt, hsa
aagaaagaaaccuguuuguuuuucuuuugaacuaugaaaagacccuguuugugaauauauuuua

SEQ ID NO: 93538 - RNA, 64 nt, hsa
uuuuuaaaggcagagaaguaucugcaucuuuauuugaaaagacgucuuauuaacucuuagcucc

SEQ ID NO: 93539 - RNA, 64 nt, hsa
aagcaagaucugucacccacaacaccacauaucuugaaaagaugcuuuucauaauuuucacuau

SEQ ID NO: 93540 - RNA, 64 nt, hsa
gauacuucucgggaaaggaucaucgccguugaaaugaaaagagagacagagagaaaaaaaaaaa

SEQ ID NO: 93541 - RNA, 64 nt, hsa
acuucacauuggaugacaccauguucuuccucuuugaaaagaaaaggggaaugugucccacuag

SEQ ID NO: 93542 - RNA, 64 nt, hsa
uaaaacuagaaauagcacucuugguuucuuuugaugaaaagagugagcuggucaaugcaacauu

SEQ ID NO: 93543 - RNA, 64 nt, hsa
uuggugccgagcagggauauaaccugcaguuaagugaaaagaaaauccagccucccccuccaaa

SEQ ID NO: 93544 - RNA, 64 nt, hsa
aaggaaaauaacugaaaagauuaaaagugagagcugaaaagagaaaugauaaugcuuccaaacu

SEQ ID NO: 93545 - RNA, 64 nt, hsa
acuuugguggcuaaguuuuacuaaggaaaauaacugaaaagauuaaaagugagagcugaaaaga

SEQ ID NO: 93546 - RNA, 64 nt, hsa
caaagauucaaaugcuuuuaugacuaauguaaaaugaaaagaggcuuacauuuuaaauguuauu

SEQ ID NO: 93547 - RNA, 64 nt, hsa
gucaacacauaguguaaaauaauuacaugccuaaugaaaagaagaugucauuuccuaauuuuga

SEQ ID NO: 93548 - RNA, 64 nt, hsa
gauguuaccaguuaggggaagacuuuuauuuucaugaaaagacaauaaaacaaaauggaaugug

SEQ ID NO: 93549 - RNA, 64 nt, hsa
cacacacauucacccuaaggauccaauggaauacugaaaagaaaucacuuccuugaaaauuuua

SEQ ID NO: 93550 - RNA, 64 nt, hsa
auucugcauuugguuuuaugaauacaaagauaagugaaaagagagaaaggaaaagaaaaaggag

SEQ ID NO: 93551 - RNA, 64 nt, hsa
augauuuuuauuuuuccuuugguauuugcuacagugaaaagaaguuuggaaaguagauacauaa

SEQ ID NO: 93552 - RNA, 64 nt, hsa
auuuaggcauuaccucagggaaaagccuugacagugaaaagaaacuacuuaaucgcuaauagcu

SEQ ID NO: 93553 - RNA, 64 nt, hsa
uucaacuuuuuuucuugcagcaccgaggcacauuugaaaagauggaauugaagucguuuuguuu

SEQ ID NO: 93554 - RNA, 64 nt, hsa
auaaagacuacagaaggaaagagaucuugccuuuugaaaagaugaaggaacaaagguugagaga

SEQ ID NO: 93555 - RNA, 64 nt, hsa
aucccucuaagaaagaaaugaagaaagaaaaugaugaaaagaguaguucaagaaguucuggaga

SEQ ID NO: 93556 - RNA, 64 nt, hsa
uguuuaauuuuugacaacaagcauguauuacuuuugaaaagaugaaaaauaaagauuuauuuaa

SEQ ID NO: 93557 - RNA, 64 nt, hsa
uuuguuuuguaccaacaggaauuagaaaauauaaugaaaagauuucguucccagcagcaucaag

SEQ ID NO: 93558 - RNA, 64 nt, hsa
uauacacacacauacacauauauuaugcauguggugaaaagaauuggcuagauaggggauuuuu

SEQ ID NO: 93559 - RNA, 64 nt, hsa
aucacuuuugggugucuguauccuaagaaguuucugaaaagaucuaaagccuuuuuaucccaua

SEQ ID NO: 93560 - RNA, 64 nt, hsa
ugauuguugaaaauauaauguaugcuauguuaaaugaaaagaucgauugggaauuuaaaaacga

SEQ ID NO: 93561 - RNA, 64 nt, hsa
gggagacugaagugugcagguucuucuauguuuuugaaaagaagguggggucuuggauaucacc

SEQ ID NO: 93562 - RNA, 64 nt, hsa
accuguuagauuaaagcugcacccugugauuauuugaaaagaauuagcuugagaguaaugucac

SEQ ID NO: 93563 - RNA, 64 nt, hsa
uuuauugucccccagaaaagauuaagaugcuacuugaaaagacugugaagauuuuuuacauugc

SEQ ID NO: 93564 - RNA, 64 nt, hsa
augauagauaacauggcuuuuacuccuuacuguuugaaaagauaaguacuuuagcuucuuucug

SEQ ID NO: 93565 - RNA, 64 nt, hsa
uuacacaccugacuuaacaucucuaaacucagauugaaaagagaccgaaugugcagauuccaca

SEQ ID NO: 93566 - RNA, 64 nt, hsa
gaccaacccaguucuguuugacuauguagcaucuugaaaagaaaaauuauaauaaagccccaaa

SEQ ID NO: 93567 - RNA, 64 nt, hsa
uucccaugugucccccaguacuuauaaaagggagugaaaagaccgagcuguaaggcaugugccu

SEQ ID NO: 93568 - RNA, 64 nt, hsa
ugaugcauuguuuuuagcucagguuuugauaaggugaaaagaauagucaccaggguuacucaga

SEQ ID NO: 93569 - RNA, 64 nt, hsa
caucauaacugguggggcacaucuaacucaacugugaaaagacacaucacacaaucaccuugcu

SEQ ID NO: 93570 - RNA, 64 nt, hsa
ccagcacaaggcagagcugggaugaaaacagggcugaaaagacucagggccaauuauuggcuga

SEQ ID NO: 93571 - RNA, 64 nt, hsa
agggaaagaaggugauuuguauuugucuccccgcugaaaagaacaggauucaaguccagaguuu

SEQ ID NO: 93572 - RNA, 64 nt, hsa
auuucuaccauuaaaaucuugaaagcgaaauacuugaaaagaggugaccauaaagaucacacca

SEQ ID NO: 93573 - RNA, 64 nt, hsa
uccauaagcagguuauuuuuauuuuuuuacuguuugaaaagaaauaaguagugucauucauaug

SEQ ID NO: 93574 - RNA, 64 nt, hsa
cuuuuuuucuuccuauucagaaaagagcaaaaugugaaaagacacaagacucucagguauagaa

SEQ ID NO: 93575 - RNA, 64 nt, hsa
uaagcuaagggaagaggaaggaauaacaacucagugaaaagauggucuccaguuucugaaugaa

SEQ ID NO: 93576 - RNA, 64 nt, hsa
uuucuuuuacuauguguaagaaauaccccaaacaugaaaagauuguuuugaucauaugcaugua

SEQ ID NO: 93577 - RNA, 64 nt, hsa
cagcaaugucuaugcuucucgauagcugugaacaugaaaagacaucuauugggaguccgaggca

SEQ ID NO: 93578 - RNA, 64 nt, hsa
uacuggaaauugaaaaacgaaaaucguguguguuugaaaagaagaaugcaacuuguauauuuug

SEQ ID NO: 93579 - RNA, 64 nt, hsa
aaugugggcaaacccuucuacaaaguuuuuguuuugaaaagagcaaaaguaaaaaguguucugu

SEQ ID NO: 93580 - RNA, 64 nt, hsa
aaaaggccuguacauacuucucccaaagcgccacugaaaagauggcauagcuuaaaagaugaaa

SEQ ID NO: 93581 - RNA, 64 nt, hsa
gucacugcaauaaguggguuuuagaaaauaagugugaaaagaaucagguguuaauauaauacua

SEQ ID NO: 93582 - RNA, 64 nt, hsa
aggcacgugacagugacaacacagugacugccucugaaaagagcccugaggcaaacacucucuc

SEQ ID NO: 93583 - RNA, 64 nt, hsa
ucaauugcuaauacccaguuacuuaugauuuaaaaacaaccaacagaaaacaucccacugacug

SEQ ID NO: 93584 - RNA, 64 nt, hsa
aaaaauaaaaugaacaucucuugaaaccuguuaaaacaaccaguuaaagccacagauggcuuuc

SEQ ID NO: 93585 - RNA, 64 nt, hsa
gauucaccaccuccaggaaaagugucuucucagaaacaaccagcugagaagguaauuaaagucu

SEQ ID NO: 93586 - RNA, 64 nt, hsa
gagggaccaauaucugggacagugucuucucagaaacaaccagcugagaagguaauuaaagucu

SEQ ID NO: 93587 - RNA, 64 nt, hsa
gguggugggaaaucuggaacagugucuucucagaaacaaccagccucaaagguaauuaaacucu

SEQ ID NO: 93588 - RNA, 64 nt, hsa
gauggacuacagugugggacagugucuucucagaaacaaccagccuugaagguaauuaaacucu

SEQ ID NO: 93589 - RNA, 64 nt, hsa
gauggagaaaaaucugggacagugucuucucagaaacaaccagccuugaagguaauuaaacucu

SEQ ID NO: 93590 - RNA, 64 nt, hsa
cuccauagccauguggauuuuuauccaaaggcucaacaaccagagggaauggugagaccugaua

SEQ ID NO: 93591 - RNA, 64 nt, hsa
uuggucauauauacauucagaacuuuuauuuuaaaacaaccacaauaacauuaauaauagaaaa

SEQ ID NO: 93592 - RNA, 64 nt, hsa
acuguuucuauaaggaaauaauacuuuuuuaaacaacaaccaaaaaaugccuugcugauucacu

SEQ ID NO: 93593 - RNA, 64 nt, hsa
aacuauaucauguucucgguauuuuaaaaacaacaacaaccauauuugucacagaaauuuaguu

SEQ ID NO: 93594 - RNA, 64 nt, hsa
uuguaguucauauguacaccagcuaguggcugugaacaaccauuuaguugguguaaaaaacuuu

SEQ ID NO: 93595 - RNA, 64 nt, hsa
uguaagagauguggagucuucgguguuuaaagucaacaaccaugccagggauugaggaggacua

SEQ ID NO: 93596 - RNA, 64 nt, hsa
cuaauuauauaguauaccauacauuaucauucaaaacaaccauccugcucauaacaucuuugaa

SEQ ID NO: 93597 - RNA, 64 nt, hsa
uaugauguaccgggagccagcacgaugguccuacacauuccagacauuuuccuuuuugagccgc

SEQ ID NO: 93598 - RNA, 64 nt, hsa
gcuucuuauaggcuccacuuugaggcucugaugaacauuccagugcugguguuggaugucaaug

SEQ ID NO: 93599 - RNA, 64 nt, hsa
aaagacagaggauuguccuuaagucccugcuaaaacauuccauuguuaaaauuugcacuuugaa

SEQ ID NO: 93600 - RNA, 64 nt, hsa
caguuuuguacaaugaaaauuacuaauuuguuugacauuccauguuaaacuacggucauguuca

SEQ ID NO: 93601 - RNA, 64 nt, hsa
uucaaggucaaagugcauggccagcuccauugagacauuccauuucaaagcaccgugcugacag

SEQ ID NO: 93602 - RNA, 64 nt, hsa
ucuuugacugucuuauuuauuauaaccuuucagcacauuccaagguuuuaguuacucaggaagg

SEQ ID NO: 93603 - RNA, 64 nt, hsa
caaagcaccuuuaaaaaaaauacauuuuaaaaaaacauuccaagccaauuggaagacaucauug

SEQ ID NO: 93604 - RNA, 64 nt, hsa
ugcuaccuagaaaucuuuuccauuccucuuucauacauuccaacccacuggaagucuuuagagg

SEQ ID NO: 93605 - RNA, 64 nt, hsa
gaguugccaguggcacauuacaccaguacagagcacauuccaaaggagacauuggaccaguuaa

SEQ ID NO: 93606 - RNA, 64 nt, hsa
uugucauucacaucucacaaaaucuugacaucuuacauuccaauacauuaucaagcaagcacaa

SEQ ID NO: 93607 - RNA, 64 nt, hsa
gccacugaaucaaguguauuucaggcuuauuucaacauuccaaugcccugguuuuccugcuuga

SEQ ID NO: 93608 - RNA, 64 nt, hsa
ggggcccccacuuuuuaccaaacuaguaaaccugacauuccaggcccaugaggggaaagaggau

SEQ ID NO: 93609 - RNA, 64 nt, hsa
uuaaguccagagaguaaacuugaauggaauaacgacauuccagaaguuaaucauuugaauucug

SEQ ID NO: 93610 - RNA, 64 nt, hsa
auuuguaaacuaauaaagguaaucacagccaccaacauuccaagcuacccuggguaccuuugug

SEQ ID NO: 93611 - RNA, 64 nt, hsa
cuugaaccuagccgacgguuauggaaacccauugacauuccaaaacaauauauacacauaacua

SEQ ID NO: 93612 - RNA, 64 nt, hsa
gcaaaagucuagaagauggguaucaaaacagaagacauuccaggagcuagcaauuuuaagaggu

SEQ ID NO: 93613 - RNA, 64 nt, hsa
gauuuaauuugugauaccuuuguauguaugagacacauuccaaagagcucuaacuaugauaggu

SEQ ID NO: 93614 - RNA, 64 nt, hsa
auacccaucuucagugucuuacuuguacuguaucacauuccauacccucauuuaauucuuaaua

SEQ ID NO: 93615 - RNA, 64 nt, hsa
auuccauuucagauuugucaaccagcgauaggccacauuccaguaagaacucaauuugucuccc

SEQ ID NO: 93616 - RNA, 64 nt, hsa
gggagggcggaaagggaggcacugccauuuggagacauuccauuucagauuugucaaccagcga

SEQ ID NO: 93617 - RNA, 64 nt, hsa
aucugaacccgcagcgcccccaucugucuucagcacauuccacggcaucgcauccguccugggc

SEQ ID NO: 93618 - RNA, 64 nt, hsa
ucacauccuccugcccagcuccucacauacccacacauuccagggcuggggugagccugacugc

SEQ ID NO: 93619 - RNA, 64 nt, hsa
ugguaaauuuuuagagacccagaucucggaggcuacauuccauuuuuuggucuuuuugucuuuu

SEQ ID NO: 93620 - RNA, 64 nt, hsa
acauuccacguguguauauauuccacauauguauacauuccauguauguaugcauauauguauu

SEQ ID NO: 93621 - RNA, 64 nt, hsa
acauuccacguguguauauaguccccauauguauacauuccacguguguauauauuccacauau

SEQ ID NO: 93622 - RNA, 64 nt, hsa
auguauuccacauguauauauuccacauauguauacauuccacguguguauauaguccccauau

SEQ ID NO: 93623 - RNA, 64 nt, hsa
caucuguacaggaagcaucccagcgcccacaugggcaugagacagucugcacugcgccugguga

SEQ ID NO: 93624 - RNA, 64 nt, hsa
aacuguaaacaggaacaccuauguguaacugaaggcaugagacaucuguacaggaagcauccca

SEQ ID NO: 93625 - RNA, 64 nt, hsa
uucuuauuccacccuuucuggugucuauaggaaugcaugagagacccuggacguuuuucugcuc

SEQ ID NO: 93626 - RNA, 64 nt, hsa
uggagaaauguaugcgccagggugcuuccguggggcaugagaauuucccgggccauccaagccc

SEQ ID NO: 93627 - RNA, 64 nt, hsa
uucucagauggucccuuccauuccccugaaaccugcaugagagcuccuaacauguuucuccaau

SEQ ID NO: 93628 - RNA, 64 nt, hsa
acuguugcuauguguagagggugcucagagcguggcaugagagcaaggagaccauggcuacucu

SEQ ID NO: 93629 - RNA, 64 nt, hsa
auucaaaaagaauuuuaaauacaccaacaugagacaucaguagucaguugguuuucaguaaagc

SEQ ID NO: 93630 - RNA, 64 nt, hsa
agauuuccccccuuuuguuuuauuccugaaggaacaucaguacccgaucuugaagaaauucaag

SEQ ID NO: 93631 - RNA, 64 nt, hsa
uuccuuuuuaauuuaaugugcucgcacuacaaugcaucaguauuaugauuccucuguacuuucc

SEQ ID NO: 93632 - RNA, 64 nt, hsa
uaauacauuuuaaaaaggugcccgcacuaccauacaucaguauuuuuauuauuauuauuguuau

SEQ ID NO: 93633 - RNA, 64 nt, hsa
uucuaguuugacaauuaguaagcaaugaguauaucaucaguacacuagcuuuuuauuaauccau

SEQ ID NO: 93634 - RNA, 64 nt, hsa
ccuccacagucuuuccaaguuggacucuuccucucaucaguacuaguugucaaauuuaaaaugu

SEQ ID NO: 93635 - RNA, 64 nt, hsa
uuugaagugauuugcaguuacucaucugagacagcaucaguauuugacuaaaucauuguuucac

SEQ ID NO: 93636 - RNA, 64 nt, hsa
caaccugaccauacugcuuucaaaagucuuuucucaucaguagaaucuauuuuggucacuucua

SEQ ID NO: 93637 - RNA, 64 nt, hsa
uggauaagaggaaauaguuuagucacagguuuuuacaguccagcaagggccaaagagguauagu

SEQ ID NO: 93638 - RNA, 64 nt, hsa
uauauaaauaaucuauagggauucaaaaggugucacaguccacuuaauuagucaaauuagcaau

SEQ ID NO: 93639 - RNA, 64 nt, hsa
aggggaagugcccauuguaaaaacacauccacagacaguccaggcacuaaggcugaaugggauc

SEQ ID NO: 93640 - RNA, 64 nt, hsa
aacauaauuugaaauuuguccaugguauguaugaacaguccauuuuaaaauuacugagucauau

SEQ ID NO: 93641 - RNA, 64 nt, hsa
uggaagagcgggaacgagagauucgccagauuguacaguccauuucugaccugaaugaaauauu

SEQ ID NO: 93642 - RNA, 64 nt, hsa
uggggcuguccacauuagggaacuugccucaaaaacaguccacaguggcaauaccggacuucug

SEQ ID NO: 93643 - RNA, 64 nt, hsa
ggacuugagcagagggaacgaccugacuuacuugcacugugaucccccuugcuccgcccacugu

SEQ ID NO: 93644 - RNA, 64 nt, hsa
gacuuacuugcacugugaucccccuugcuccgcccacugugaccuugaaccccaugcacuguga

SEQ ID NO: 93645 - RNA, 64 nt, hsa
ccuugcuccgcccacugugaccuugaaccccaugcacugugaccuccccccuucucccccuucc

SEQ ID NO: 93646 - RNA, 64 nt, hsa
caugcacugugaccuccccccuucucccccuucccacugugauuggcacaucgacaagggcugu

SEQ ID NO: 93647 - RNA, 64 nt, hsa
cuaugugggugacccuguggaagugagaaggagucacugugaugcuuagcuguccuaaaugaug

SEQ ID NO: 93648 - RNA, 64 nt, hsa
cuggagugcugugagcuguccguggugcugaauucacugugacgucacuccugucucucuuugc

SEQ ID NO: 93649 - RNA, 64 nt, hsa
uagguuagccagagacagguuuucauuaucaggucacugugaaaucugguaaggcaguccugag

SEQ ID NO: 93650 - RNA, 64 nt, hsa
gagcucacugcaaacaacuggaauugagguugcacacugugauuuuuacaccgaaaagccaaaa

SEQ ID NO: 93651 - RNA, 64 nt, hsa
uugugccucagaucauccaccugugugaguccaucacugugaaauugacuguguccaugugaug

SEQ ID NO: 93652 - RNA, 64 nt, hsa
cagauuucugagucguacuaugguuuugccuugucacugugaggcccuacuagguguaagcauu

SEQ ID NO: 93653 - RNA, 64 nt, hsa
uuuuugcauguguucugauaaaaaucaauucuagcacugugaagcuucagacaccuugaaaguc

SEQ ID NO: 93654 - RNA, 64 nt, hsa
uaaaucucuccaucugcauuaguauuuuaaggagcacugugagagaaaucacaaaguauuagag

SEQ ID NO: 93655 - RNA, 64 nt, hsa
gggugccccugccuccagcagagcccccaccauucacugugacaucuuuccgugucacccugcc

SEQ ID NO: 93656 - RNA, 64 nt, hsa
agccuggcggccauggggccugccgugccugccccacugugacccacaggccugggugguguac

SEQ ID NO: 93657 - RNA, 64 nt, hsa
caauggaucccuacaggggggcacuggagaggugcacugugagaaggugcaguguccccggcug

SEQ ID NO: 93658 - RNA, 64 nt, hsa
cuguaucaccugcagauguggggcaggggugccucacugugagcgggaugacuguucacugcca

SEQ ID NO: 93659 - RNA, 64 nt, hsa
ucccaggcuggagugcagugacacaaucucagcucacugugaccuccgccuccuggguucaaga

SEQ ID NO: 93660 - RNA, 64 nt, hsa
uucuuguguucuguagacugccaucauugaugaucacugugaaaauugaccaagugauguguuu

SEQ ID NO: 93661 - RNA, 64 nt, hsa
acccuguguacaauuuaaaauauuuguaaaauaucacugugaauuuacagaugucuuuuuguca

SEQ ID NO: 93662 - RNA, 64 nt, hsa
gaccuaaggagcuguccaguucuuggcucuuuuucacugugacugcacagcgguuuccuucuuc

SEQ ID NO: 93663 - RNA, 64 nt, hsa
gaggacaguggguguguacuggccucccgggagccacugugaccaggccuuugagcucuuguca

SEQ ID NO: 93664 - RNA, 64 nt, hsa
cauccuuuucuucagaccacucuccacaguccugcacugugauuccuucucagcaggcacaugu

SEQ ID NO: 93665 - RNA, 64 nt, hsa
gcauugcauuuacaaaacaaggaaaaugcuguaaauauugcauauuuuauguauuuggaccaaa

SEQ ID NO: 93666 - RNA, 64 nt, hsa
uagcacuuaaauauaucugauagcaacacuuaagauauugcauggggauuacuuuccuaucauc

SEQ ID NO: 93667 - RNA, 64 nt, hsa
uuggugccaucagugauuuacaaacaauauuuugauauugcagaugacuugcuuacuguauuug

SEQ ID NO: 93668 - RNA, 64 nt, hsa
gauagguaaauauaguuuuauugucacaugcuaaauauugcaugcauauugacuaauuggaaua

SEQ ID NO: 93669 - RNA, 64 nt, hsa
cagcuuauugaaauaguauugauuuagaaaaaguauauugcauuucuaaaaaacaucuaccaag

SEQ ID NO: 93670 - RNA, 64 nt, hsa
uggcauuaucaaaauauuugaugauguuucagauauauugcaaagucuguauuccagcucuuaa

SEQ ID NO: 93671 - RNA, 64 nt, hsa
auacacagaccagcuauaauuugcuaaacauaaaauauugcaguguauuagccggcuguggcuc

SEQ ID NO: 93672 - RNA, 64 nt, hsa
guucuguguuuccuacggaaauaagaaacgauaaauauugcacugaauguuugugguuuggagu

SEQ ID NO: 93673 - RNA, 64 nt, hsa
auuuuuuuaagauggcaugugcuuugaaaagaagauauugcauuuuuaagaguuuaaaaaucuu

SEQ ID NO: 93674 - RNA, 64 nt, hsa
aaaaaaauagaaauugaaggauuuuuaugaaauuauauugcauuacuauuugcagucaaacuuu

SEQ ID NO: 93675 - RNA, 64 nt, hsa
guaacaucaccucaauuuuuuauuauccuuaaagauauugcauuuucauauucuuuauuuauaa

SEQ ID NO: 93676 - RNA, 64 nt, hsa
gcaggcuccacuccagaucaccacaauaaugugaauauugcaauaaagcaagucauacacauuu

SEQ ID NO: 93677 - RNA, 64 nt, hsa
auaugugaugagcacauacagacacaccucagagauauugcaggcuccacuccagaucaccaca

SEQ ID NO: 93678 - RNA, 64 nt, hsa
uugucuuuuggccauaagugggaaaguuuucuguauauugcauagcauuacacauuuaugccua

SEQ ID NO: 93679 - RNA, 64 nt, hsa
cuucaugcagaauuuugaaauguuuucaguuuguauauugcauauucacaugaucauuguucac

SEQ ID NO: 93680 - RNA, 64 nt, hsa
auuggaaaagccagccauuuacuaauucagaggaacagcauagccaaggcuagcgaggcauacu

SEQ ID NO: 93681 - RNA, 64 nt, hsa
ugggcuugucugggcagagacagaagcugauuuaacagcauagagcacagcgcccuacuucccc

SEQ ID NO: 93682 - RNA, 64 nt, hsa
uaaugccaaaaugcucuggcuuuguauuuucuuuacagcauagauagaaaaaugcacauuuuuc

SEQ ID NO: 93683 - RNA, 64 nt, hsa
ggugugacaggcucuagucuccucccuguuguuuacagcauauuuaagucuugugaaacuguau

SEQ ID NO: 93684 - RNA, 64 nt, hsa
uuuacaauuuaauaaugugauauuuccuaugucuacagcauaccuuauuagguauaaaaccuac

SEQ ID NO: 93685 - RNA, 64 nt, hsa
cucagauguucuaauucucuuuguaugcuuggaaacagcauagauauguugcugugguuuucag

SEQ ID NO: 93686 - RNA, 64 nt, hsa
cgggccugaagcagaucagagggcuuugcaaaagacagcauagagccaucuuccugcaacuuua

SEQ ID NO: 93687 - RNA, 64 nt, hsa
ccucccggguucaagcgauucuucugcugggauuacagcauaugccaccaugcccagauuauuu

SEQ ID NO: 93688 - RNA, 64 nt, hsa
uuuccacgugagguuuuguuuagagggauccacuacucaagaaaaaguuagcaaaccacuccuu

SEQ ID NO: 93689 - RNA, 64 nt, hsa
cugccuuugcaaggacuacugggcuucccaagaaacucaagagccuccguaccuccccugggcg

SEQ ID NO: 93690 - RNA, 64 nt, hsa
ugcugcuuaguuuuuggacugaaaagauauuaaaacucaagaaggaccaagaaguuuucauaug

SEQ ID NO: 93691 - RNA, 64 nt, hsa
aacuaguuaaaagcuucuauuuuccucuuugaacacucaagauugcauggcaaagacccaguca

SEQ ID NO: 93692 - RNA, 64 nt, hsa
ccauuuauggcaugauuagauugcaaagcaaugaacucaagaaggaauugaaauaaggagggac

SEQ ID NO: 93693 - RNA, 64 nt, hsa
uucuuugguacacaguucugguguuccuaccaggacucaagagacaccccuuccugcugacauu

SEQ ID NO: 93694 - RNA, 64 nt, hsa
guccauuuuccuuccuggggccauuggggaugacacucaagauacuugccagucucuccagugu

SEQ ID NO: 93695 - RNA, 64 nt, hsa
ucccacgugggcaauaccagggacccauggggaaacucaagaaugacagcuucuauauuuugua

SEQ ID NO: 93696 - RNA, 64 nt, hsa
gccuuucuacaaagcaaggcccacagacuaccccacucaagaacagcagguaugugggccagag

SEQ ID NO: 93697 - RNA, 64 nt, hsa
gauagcuuccugggugcagagucggccauugaaaacucaagagcuucgagagccaguguuguca

SEQ ID NO: 93698 - RNA, 62 nt, hsa
ucauuuugagagccuccaacugauccaagugucauccggaggaggagguggcccguaugugc

SEQ ID NO: 93699 - RNA, 54 nt, hsa
aagcccuagaaccaagauagaugccauccggaucccugugcucuaucucagugc

SEQ ID NO: 93700 - RNA, 62 nt, hsa
aaugcuuuuagaagcuaagcuguggcucaacucauccggacacacaccuggauucagcaaug

SEQ ID NO: 93701 - RNA, 62 nt, hsa
guccccugcaaggaggcagggcccagcuuccacauccggagcccuggucagcauagccgccc

SEQ ID NO: 93702 - RNA, 62 nt, hsa
cuacuuuuccuucccucaaagcuuccauuccacauccggaggagaagaaggaaaugaauuuc

SEQ ID NO: 93703 - RNA, 51 nt, hsa
gaagauacaaagucuuauagacauccggaaaaaagauuuuuaccugugcug

SEQ ID NO: 93704 - RNA, 62 nt, hsa
ucuucaguuccccagucucgggggccugguaacauccggagccaagacuuguggacagcacu

SEQ ID NO: 93705 - RNA, 62 nt, hsa
cacugcuuuaccugugcugccugcaagacgcccauccggaacagggccuucuacauggagga

SEQ ID NO: 93706 - RNA, 62 nt, hsa
ccaguagggccgugggcucggcccggaccuggcauccggacuuggacucggggccaugggcu

SEQ ID NO: 93707 - RNA, 62 nt, hsa
uaucgagaauaggaaaaccuuuaaaccccggucauccggacaucccaacgcaugcuccugga

SEQ ID NO: 93708 - RNA, 62 nt, hsa
uguagagggcuguaacagugaccucgcacggucauccggaguacuaagccccaguaaggugu

SEQ ID NO: 93709 - RNA, 62 nt, hsa
uacaacucgcagcaccggucagcaaucagcugcauccggacgguguggaggaccgagggguu

SEQ ID NO: 93710 - RNA, 62 nt, hsa
cggcucugugcgggccgcacccuggacggccccauccggacgcugaagcugccguugccgcg

SEQ ID NO: 93711 - RNA, 62 nt, hsa
ccucacccuguucggcccuuugugacucuuggcauccggagacuuuccccucgacccagugg

SEQ ID NO: 93712 - RNA, 62 nt, hsa
gcacucugcccagugagcaccugcccugccugcauccggagaauugccucuaccuggaccuu

SEQ ID NO: 93713 - RNA, 62 nt, hsa
acucgguggcccaggcaggaggugaaagcagccauccggaaggcccuggggacccuugugcc

SEQ ID NO: 93714 - RNA, 62 nt, hsa
uucuaaauugaauauuccacgguuugggacagcauccggaaguuuucccuaugacuuuauau

SEQ ID NO: 93715 - RNA, 62 nt, hsa
uacuacaguggaacuguuucuguuucaucugacauccggauagaugccagccacccccacau

SEQ ID NO: 93716 - RNA, 62 nt, hsa
ccugcugcccucucacaggacugccuucagggcauccggagcuuccugaggacacaccagca

SEQ ID NO: 93717 - RNA, 62 nt, hsa
ugaacucugaaccaccuuugucucugcagaggcauccggaucccagcaagcgagcuuuagca

SEQ ID NO: 93718 - RNA, 62 nt, hsa
uaggcauauugcugucccuuuuguguaucugucauccggaugcuucggaccccacgccucug

SEQ ID NO: 93719 - RNA, 62 nt, hsa
uuuauugagguuuuuuucccccccuuuuagagcauccggaagugauaacacgcaaaaucaca

SEQ ID NO: 93720 - RNA, 62 nt, hsa
aucauuauccuaaagaaguguuucucucccaucauccggauuucugguuguggcccagcaau

SEQ ID NO: 93721 - RNA, 62 nt, hsa
auaguaugguggugaaacuuguacugcaugaacauccggauggcccaguuuucugaaaccca

SEQ ID NO: 93722 - RNA, 62 nt, hsa
uuaguccacgaucauuccaacuggugggaugacauccggacauccucuuccagggacugggg

SEQ ID NO: 93723 - RNA, 62 nt, hsa
gguaucugccccgggcucccucaucccaccuccauccggaguugccuaagaugcauguccag

SEQ ID NO: 93724 - RNA, 62 nt, hsa
ggguguagacgccaagacucacgcaugugugacauccggaguccuggagccgggugucccag

SEQ ID NO: 93725 - RNA, 62 nt, hsa
ccggggcucaacacacaggcuguggcucuggacauccggauauuaaaaggagcguugcugga

SEQ ID NO: 93726 - RNA, 62 nt, hsa
caccuaacagcaacacuggggagagccuggagcauccggacuugcccuaugggagaggggac

SEQ ID NO: 93727 - RNA, 62 nt, hsa
cgucgucggagggauuacuggggagugcgcugcauccggaagucgcugugcccugguugagg

SEQ ID NO: 93728 - RNA, 62 nt, hsa
cuggcggcccucacuuuucuccuguguaaagccauccggaacaccagcaccucacugcaucu

SEQ ID NO: 93729 - RNA, 62 nt, hsa
gaauagugccguggagguguguguguccauggcauccggagcgaggcgacuguccugcgugg

SEQ ID NO: 93730 - RNA, 62 nt, hsa
ugacaugauucuugaagacccaggauaaaggacauccggauagguguguuuaugaaggaugg

SEQ ID NO: 93731 - RNA, 62 nt, hsa
cuacucccuacuuaagggaauaggccaggcuccauccggaggcagggaccaugccaggagga

SEQ ID NO: 93732 - RNA, 62 nt, hsa
caaacuuuccucuaugucuggaaaagcguaggcauccggaggcuuuggaggggagucuggca

SEQ ID NO: 93733 - RNA, 62 nt, hsa
uuguccgccugucugaggggagcccagaggcacauccggacaaguuucagauaacccguggg

SEQ ID NO: 93734 - RNA, 62 nt, hsa
aggaugggauuagcgaagcuguggagacugcacauccggaccugcccaugucucaaaacaaa

SEQ ID NO: 93735 - RNA, 62 nt, hsa
cgccaaggggaaguaaggcagggagaaaggaacauccggaacagccaaagaaacucagaaga

SEQ ID NO: 93736 - RNA, 62 nt, hsa
uucaacaagggugcagccugccacaggcuccucauccggacugaggaagacgaggacaggga

SEQ ID NO: 93737 - RNA, 62 nt, hsa
cccauuguauuuauuugccugcuggaaaaucacauccggaaauaaaauagaaauaugucuuu

SEQ ID NO: 93738 - RNA, 62 nt, hsa
cgagccuucaaugccaccucguuccugcgccacauccggaagcuggggcagaucccagaggg

SEQ ID NO: 93739 - RNA, 64 nt, hsa; identical to SEQ ID NO: 58780

SEQ ID NO: 93740 - RNA, 64 nt, hsa; identical to SEQ ID NO: 58781

SEQ ID NO: 93741 - RNA, 64 nt, hsa; identical to SEQ ID NO: 58782

SEQ ID NO: 93742 - RNA, 54 nt, hsa; identical to SEQ ID NO: 58783

SEQ ID NO: 93743 - RNA, 64 nt, hsa; identical to SEQ ID NO: 58784

SEQ ID NO: 93744 - RNA, 64 nt, hsa; identical to SEQ ID NO: 58785

SEQ ID NO: 93745 - RNA, 64 nt, hsa; identical to SEQ ID NO: 58786

SEQ ID NO: 93746 - RNA, 64 nt, hsa; identical to SEQ ID NO: 58787

SEQ ID NO: 93747 - RNA, 64 nt, hsa; identical to SEQ ID NO: 58788

SEQ ID NO: 93748 - RNA, 64 nt, hsa; identical to SEQ ID NO: 58788

SEQ ID NO: 93749 - RNA, 64 nt, hsa; identical to SEQ ID NO: 58790

SEQ ID NO: 93750 - RNA, 64 nt, hsa; identical to SEQ ID NO: 58791

SEQ ID NO: 93751 - RNA, 64 nt, hsa; identical to SEQ ID NO: 58792

SEQ ID NO: 93752 - RNA, 64 nt, hsa; identical to SEQ ID NO: 58793

SEQ ID NO: 93753 - RNA, 64 nt, hsa; identical to SEQ ID NO: 58794

SEQ ID NO: 93754 - RNA, 64 nt, hsa; identical to SEQ ID NO: 58795

SEQ ID NO: 93755 - RNA, 64 nt, hsa; identical to SEQ ID NO: 58796

SEQ ID NO: 93756 - RNA, 63 nt, hsa
guaugaaguuuuaaaaaaaacuacagcagccaaagaaacuauauauauauauauauauauaua

SEQ ID NO: 93757 - RNA, 63 nt, hsa
gucccauuuucacauuagggcuuuaaaugaauuagaaacuauuugaggcuauaaaaauguccu

SEQ ID NO: 93758 - RNA, 63 nt, hsa
uugagauguucauagcauguuuuauuacauugaagaaacuaaaacauaaaugaaaagaaacac

SEQ ID NO: 93759 - RNA, 63 nt, hsa
ugcuugaaaccacaaaaguuuugcuggcacgaaagaaacuagauggaaauauauguaauucuc

SEQ ID NO: 93760 - RNA, 63 nt, hsa
ugauuuuuuguuuuccucuguugcuagauaaauagaaacuaauaauagcucuauuucucugcc

SEQ ID NO: 93761 - RNA, 63 nt, hsa
gacaaugaaugaacuaugaaagauuuagucaacagaaacuauuuuaggguauguuuaguuggu

SEQ ID NO: 93762 - RNA, 63 nt, hsa
aggggucugcucuagcaucaguaaguauuuagcagaaacuaacuccguaaugaauggaauuca

SEQ ID NO: 93763 - RNA, 63 nt, hsa
ugaaaccuaauccuacccccuuuuuuaacaaaaagaaacuaguacauuugugaaaauuguguu

SEQ ID NO: 93764 - RNA, 63 nt, hsa
aaaauaaagaaaagaugauuuaccuccaaguucagaaacuagacauuccauugaacuaagaag

SEQ ID NO: 93765 - RNA, 63 nt, hsa
cuugguugcuggaggucuggugcuguugcuuccagaaacuaaagggaaagcuuugccugagac

SEQ ID NO: 93766 - RNA, 62 nt, hsa
aagguauggucgauggauaaauaguuauuuuaagaaacuaauuccacugaaccuaaaaucau

SEQ ID NO: 93767 - RNA, 63 nt, hsa
ugaaaauuagagcaaagugcuccuguuuuuuagagaaacuaaaucuugcuguugaacaauuau

SEQ ID NO: 93768 - RNA, 63 nt, hsa
aaaggcaacguuuugcagcuuccaaauuucugaagaaacuaaucucagauuggcaguuaaagu

SEQ ID NO: 93769 - RNA, 63 nt, hsa
ugcuucccaaagcuauagucauagauuucuuccagaaacuauugucauaauugucacuggagu

SEQ ID NO: 93770 - RNA, 63 nt, hsa
aacccaaugaggaacaauuggagauuuuuaugcagaaacuaaauaauccuuaauaaauaaauc

SEQ ID NO: 93771 - RNA, 63 nt, hsa
auuauuuccuucagggacagauuuuccaaccuaagaaacuaccuaccguguguauucucuuga

SEQ ID NO: 93772 - RNA, 63 nt, hsa
guaaggauacauuuggaagaacauacaguauucagaaacuaaccuauauaaaauguaaacaau

SEQ ID NO: 93773 - RNA, 63 nt, hsa
gcauuaccucagggaaaagccuugacagugaaaagaaacuacuuaaucgcuaauagcuagucu

SEQ ID NO: 93774 - RNA, 63 nt, hsa
gagguuuuguuucaccuguuuugcagcaguaagagaaacuagugcugcaagaauguauuuuuu

SEQ ID NO: 93775 - RNA, 63 nt, hsa
ucuuugguuuccuguaucuuuuuaaucaagucuagaaacuauguucaucagucacucauuuuu

SEQ ID NO: 93776 - RNA, 63 nt, hsa
uuaaaaaaguaaaacaagaaaaguacauucuuuagaaacuaacaaagccacauuuacuuuaag

SEQ ID NO: 93777 - RNA, 63 nt, hsa
gagaugggguggccugcagugacacagaaaggaagaaacuagcgguguucuuuuaggcguuuu

SEQ ID NO: 93778 - RNA, 63 nt, hsa
uauuaccucauuuuuaagccuguaugagaauguagaaacuauauauuauauguauauuuauuu

SEQ ID NO: 93779 - RNA, 63 nt, hsa
uacaucaucuacagaaaucuugaucaauaaccuagaaacuagguuaucuagguuauugaucaa

SEQ ID NO: 93780 - RNA, 63 nt, hsa
aguucugguaaacgguccaguuagggagggaguagaaacuauugacucaaaagaguuucuggc

SEQ ID NO: 93781 - RNA, 63 nt, hsa
cgauucguuugaaagagaguaagaugcauuaacagaaacuauccugggauuaggugaaaaaug

SEQ ID NO: 93782 - RNA, 64 nt, hsa
agggccugagcagcuggaucugguacaaagcaaucggacauagaguuggagggggaggccccug

SEQ ID NO: 93783 - RNA, 64 nt, hsa
acacggcucggugucagauggugucaggcugucacggacauagggauaaacuugguuaggacuc

SEQ ID NO: 93784 - RNA, 64 nt, hsa
ggcauguuacugaaaucuuccuuugcgacuuucucggacauaucaacugccuuucucaugaaga

SEQ ID NO: 93785 - RNA, 64 nt, hsa
uaaaagaggaaggguuucuugucccgggaagcaacggacauaaucuguucccagccauggccuu

SEQ ID NO: 93786 - RNA, 64 nt, hsa
aaaauggagccaggcuuccaacuuccgcugccuucggacauagggacccaguucccaggagcgg

SEQ ID NO: 93787 - RNA, 64 nt, hsa
cacugcaguauacauuuaucuacacauuauauaucggacauauaauauguaaauaaaugacuuc

SEQ ID NO: 93788 - RNA, 64 nt, hsa
uguguuuccuuuggcuguucccuaauacaaaacacggacauauuuuuacucguagcacucaauu

SEQ ID NO: 93789 - RNA, 64 nt, hsa
acuuauuugucuaccgaauuauuguuuucuuugucggacauacaccuacacugcauuccucaaa

SEQ ID NO: 93790 - RNA, 64 nt, hsa
uuggagaggaaaugaaccagaagaguggaucccucggacauaccaagauuuagacggucuaccu

SEQ ID NO: 93791 - RNA, 64 nt, hsa
acgaaaauguguagacgcacucucaaaaacugcacggacauacaaaaucaaucuuuuccuuuga

SEQ ID NO: 93792 - RNA, 64 nt, hsa
aauguuugaacaaagacucccauuugagacuuuccggacauacgcagcaccauacaauauuuca

SEQ ID NO: 93793 - RNA, 64 nt, hsa
aacaaaguauauugaauggaaauggcucucauguauuuuggaauuuuccauuaaauaauuugcu

SEQ ID NO: 93794 - RNA, 64 nt, hsa
caccauguugccaagcuagucuacaaagcaucugauuuuggaaguacauggaauuguuguaaca

SEQ ID NO: 93795 - RNA, 64 nt, hsa
acauuuucuuggagcacaaacaacuuuguugaggauuuuggaaggaaagcacaacuggguccuu

SEQ ID NO: 93796 - RNA, 64 nt, hsa
uaaaccuucacaaccuucaugauuucauaggauuauuuuggaaauauagcacuugacuuuauga

SEQ ID NO: 93797 - RNA, 64 nt, hsa
cuagaugaugcuuugugugauacauuaaguucuuauuuuggauuaaaagaaguuuuccauuuga

SEQ ID NO: 93798 - RNA, 64 nt, hsa
uucugacuuugccaaguaauuuguugacacgaaaauuuuggaggaaccaauugaaaacacacuu

SEQ ID NO: 93799 - RNA, 64 nt, hsa
ucgaugcagugcucaaaaucucagauuuuggagcauuuuggauauuggauuuuuggauuuggga

SEQ ID NO: 93800 - RNA, 64 nt, hsa
uucauugaugucgaugcagugcucaaaaucucagauuuuggagcauuuuggauauuggauuuuu

SEQ ID NO: 93801 - RNA, 64 nt, hsa
auuagaaauguuucagauuucaauuuuuuuucagauuuuggaauauuugcauuauauuuagcgg

SEQ ID NO: 93802 - RNA, 64 nt, hsa
uuaguuuuguauaaauuauguuucaaaucuuuacauuuuggaaauaaucauugcuggagauucu

SEQ ID NO: 93803 - RNA, 64 nt, hsa
uuggaaauaaucauugcuggagauucuguuaaauauuuuggaacucuuuuuuuuuuuaaauuau

SEQ ID NO: 93804 - RNA, 64 nt, hsa
gaaaccugccaaucuguguagaucagagcuccaaauuuuggauuaucgggccugugcaagauug

SEQ ID NO: 93805 - RNA, 64 nt, hsa
aaauucuuaagggugaaauaggccuauuuuugcuauuuuggacaaauaaaugauucuauaugug

SEQ ID NO: 93806 - RNA, 64 nt, hsa
uuuaaaaacguucauuuaauuauguauuugaauuauuuuggagaugagguauuuuaugaguauu

SEQ ID NO: 93807 - RNA, 64 nt, hsa
aaaccugaaauccaaaacacuucuggucccuagcauuuuggauaagggauacucagcuuguacc

SEQ ID NO: 93808 - RNA, 64 nt, hsa
uccucaaagaugcuacaaaacuugaauauaacacauuuuggaaggcugacuaaccucgauucug

SEQ ID NO: 93809 - RNA, 64 nt, hsa
agaaaucuuuguacugauguaaaugauuguaguuauuuuggauaguguuuugcuaacaaaagga

SEQ ID NO: 93810 - RNA, 64 nt, hsa
ggacacuuaauuaugacaugagaaugaagaaauuauuuuggaaaaaaaaaaugaccuaauuuac

SEQ ID NO: 93811 - RNA, 64 nt, hsa
uaauuacugaguucagccuuuugugaugacuuauauuuuggacuuacauuuuaacuuuaaagaa

SEQ ID NO: 93812 - RNA, 64 nt, hsa
uggcuuuuucccauugugaagcauugaauaucacauuuuggaacauguuauagggugagucccu

SEQ ID NO: 93813 - RNA, 64 nt, hsa
cucuuacuaacaauuuuuauacagaaaaugagucauuuuggaaaugauucuuauguuuuuuuuu

SEQ ID NO: 93814 - RNA, 64 nt, hsa
cucuucuguguuucgauuuuugaucaauucuuuaauuuuggaagccuauaauacaguuuucuau

SEQ ID NO: 93815 - RNA, 64 nt, hsa
gccccccucucaaacccccaacccaaaaccaagcauuuuggaaugagucuccuuuaguuucaga

SEQ ID NO: 93816 - RNA, 64 nt, hsa
acaaaccaaaacugaauaaagucuuugaggaaacauuuuggaaacuucacaugcauuccgcuug

SEQ ID NO: 93817 - RNA, 64 nt, hsa
agacugaggcuugcagaauuaagguucaggggaaauuuuggaaaguugguuguauuuucauuga

SEQ ID NO: 93818 - RNA, 64 nt, hsa
cauggaggcacaucuucagggcaccaguguuaaaauuuuggagucuuaauuuucauguguacac

SEQ ID NO: 93819 - RNA, 64 nt, hsa
aaaaaagggaguaccaggauuuauuaaguaaagcauuuuggaaauggggaauagcgccauauau

SEQ ID NO: 93820 - RNA, 64 nt, hsa
ucugauucaaugugaauccaucuuuccuugcaauauuuuggauggagaauuugaaguuaaaugc

SEQ ID NO: 93821 - RNA, 64 nt, hsa
uaauauuuccuuugauauuauacaggaaagcaauauuuuggaguauguuaaguugaaguaaaag

SEQ ID NO: 93822 - RNA, 64 nt, hsa
gagcuugcugugcuucaaacuacuacuggaccuuauuuuggaacuaugguagccagaugauaaa

SEQ ID NO: 93823 - RNA, 64 nt, hsa
agaggucagugcuagaauaaaguccuguagguuuauuuuggaagggacuguggccaggguaguu

SEQ ID NO: 93824 - RNA, 64 nt, hsa
ugucauuacagcaagggcaguuuggggguaaagcauuuuggaggaauaaccuuaaaaaguuaaa

SEQ ID NO: 93825 - RNA, 64 nt, hsa
uuauaggacuuugccucguacaauuaauagugauauuuuggacaaggaguucuggugacaagcu

SEQ ID NO: 93826 - RNA, 64 nt, hsa
guugaaacauuuagaaacuggauuugggaacccaauuuuggaaaaccagauucauagucaugaa

SEQ ID NO: 93827 - RNA, 64 nt, hsa
auuuggucccaguuggguacauuuuaaaauccugauuuuggagacuuaaaaccagguuaauggc

SEQ ID NO: 93828 - RNA, 64 nt, hsa
uuaggugguuuauaguucuuuuggcuaacaaaucauuuuggaaauaaagauuuuuuacuacaaa

SEQ ID NO: 93829 - RNA, 64 nt, hsa
ugauuaugcagcauuugaauccaacaaagacuacauuuuggaauccaguggaaucuuuaaucuu

SEQ ID NO: 93830 - RNA, 64 nt, hsa
uagugggacauuuuuagacuuugaugcucuagccauuuuggauuguguaaguugcagauguggc

SEQ ID NO: 93831 - RNA, 64 nt, hsa
auaaauauauauucuauuacauuuucagugaguaauuuuggauuuugcaaggugcauuuuuacu

SEQ ID NO: 93832 - RNA, 64 nt, hsa
cuaccccaauuucggauuuuuuccaaaaucucccauuuuggaauuugccugcugggauuccuua

SEQ ID NO: 93833 - RNA, 64 nt, hsa
aaaaguaaccaaccucauuggaacaaguauuaacauuuuggaauauguuuuauuaguuuuguga

SEQ ID NO: 93834 - RNA, 64 nt, hsa
uaguaaaacaagugucuucccaaccugauaauucauuuuggauaggccuuucucggccccagac

SEQ ID NO: 93835 - RNA, 64 nt, hsa
acaagagauggcuuuuuccuuugcuugaauaaacauuuuggaucaccuccaaagaaugaaaacc

SEQ ID NO: 93836 - RNA, 64 nt, hsa
aaaaugcaugaacaauagaaaaaugcugaacauuauuuuggaugcuagcugcuuggacauuaac

SEQ ID NO: 93837 - RNA, 64 nt, hsa
auaguuuuucaucaagaguuuauuauuguacuuuauuuuggagccaaaaaauugauucuggggg

SEQ ID NO: 93838 - RNA, 64 nt, hsa
uauaauagauggggcauauaauaaagaagcuacuauuuuggaaaaugacauuuuacuauuugcc

SEQ ID NO: 93839 - RNA, 64 nt, hsa
uuguccuauuccucaguucauuuggccauuuuggauuuuggagagccugaaacuuugauaugua

SEQ ID NO: 93840 - RNA, 64 nt, hsa
uugagucuuguccuauuccucaguucauuuggccauuuuggauuuuggagagccugaaacuuug

SEQ ID NO: 93841 - RNA, 64 nt, hsa
cgggucugaccacuaccucccacaauaccuagccauuuuggaaggggaaaacaugcgguggucu

SEQ ID NO: 93842 - RNA, 64 nt, hsa
caaacauucauuguuaagagaagaaugacaguauauuuuggaggaaauaaugaauuuacuaauu

SEQ ID NO: 93843 - RNA, 64 nt, hsa
uacagagugaauuuguauuuaaacaaaaauuuaaauuuuggaauccucuaaacauuuuuguauc

SEQ ID NO: 93844 - RNA, 64 nt, hsa
ugaguagucaguuauaaaagcauaauugcuuuauauuuuggaucauuuuuuacugggggcggac

SEQ ID NO: 93845 - RNA, 64 nt, hsa
ucuuuucuagaaacagaaaaucacuguauuaaauauuuuggaaagauuguucugaaagaagucu

SEQ ID NO: 93846 - RNA, 64 nt, hsa
auaagacuaaguugaguuauacuucuugguucacauuuuggaaaucagagauuacagauuacau

SEQ ID NO: 93847 - RNA, 64 nt, hsa
aaauacuugggacuggaaguguuuucgauuuuggauuuuggaauacuuuuuuuuuuuuuuugga

SEQ ID NO: 93848 - RNA, 64 nt, hsa
uuaucugaaauacuugggacuggaaguguuuucgauuuuggauuuuggaauacuuuuuuuuuuu

SEQ ID NO: 93849 - RNA, 64 nt, hsa
cuaacucuauggcguaaauuacuuugaagaguucauuuuggaaguaagggaaucccgcuucccu

SEQ ID NO: 93850 - RNA, 64 nt, hsa
cuaauguuuuuaucuugagucaauaugauuagguauuuuggauuuacuuuuaaucuuaaaauac

SEQ ID NO: 93851 - RNA, 64 nt, hsa
gagcugguuagaacauuuuaaguggcagcauagaauuuuggaauuuuggggcuuucuuuucaga

SEQ ID NO: 93852 - RNA, 64 nt, hsa
caguuuacaaaaauaagucuuuuugccuuaagucauuuuggaaauaaguaauacugcaucugac

SEQ ID NO: 93853 - RNA, 64 nt, hsa
accagaaguguuucaaauuuuagauuauuuucagauuuuggaauguuugcauauacauaaugag

SEQ ID NO: 93854 - RNA, 64 nt, hsa
auuuuuugucuuguuggugcucaaaaaguuuuggauuuuggagcauuucggauuuuggauuuuu

SEQ ID NO: 93855 - RNA, 64 nt, hsa
ugcucaaaaaguuuuggauuuuggagcauuucggauuuuggauuuuuggauuaggguugcucaa

SEQ ID NO: 93856 - RNA, 64 nt, hsa
guaucccuucuccaaaaugccugggaucagaagcauuuuggauuucagauacuuacagauuuug

SEQ ID NO: 93857 - RNA, 64 nt, hsa
gaucagaagcauuuuggauuucagauacuuacagauuuuggaauauuugcauuauauuuauugg

SEQ ID NO: 93858 - RNA, 64 nt, hsa
cguacuuuguuuugccuguagaguguuguaaaauauuuuggaugugaauguccuugcaggccgg

SEQ ID NO: 93859 - RNA, 64 nt, hsa
uuuuauuccuauuuaauguuauugacuauagcagauuuuggaaaucaguguuuuccaugugacc

SEQ ID NO: 93860 - RNA, 64 nt, hsa
ugaugagaaguuuuuaauuguucuuuuuuauuugauuuuggaauucaggugcacucuauucaag

SEQ ID NO: 93861 - RNA, 64 nt, hsa
ggcccugaguacagggaaguggaacauaggcaggauuuuggauuaauagagaaauuuugauaag

SEQ ID NO: 93862 - RNA, 64 nt, hsa
guucuaaaucuggggguaaagcaagaaccugaacauuuuggagccuuucugcugagcuagacca

SEQ ID NO: 93863 - RNA, 64 nt, hsa
aguuuuaagugcacagcucauaaauucugcugacauuuuggauuaaccuuauguagguugccag

SEQ ID NO: 93864 - RNA, 64 nt, hsa
uaaaaauuguuuugaaagaagaacacaauuuacaauuuuggaaccacugacuccuuucucuugu

SEQ ID NO: 93865 - RNA, 64 nt, hsa
aagugcuucuuaaaagaaccauaguccauuuacaauuuuggaaggcaaaggcugauuuguuugc

SEQ ID NO: 93866 - RNA, 64 nt, hsa
auguuggcauucagaaauuuugaaauuuuggagcauuuuggauuuucagauuagggaugcucaa

SEQ ID NO: 93867 - RNA, 64 nt, hsa
uucuagcgucauguuggcauucagaaauuuugaaauuuuggagcauuuuggauuuucagauuag

SEQ ID NO: 93868 - RNA, 64 nt, hsa
aaaugcuuggggcuagaaguguuuugaauuucagauuuuggaauauuugcauauacaugcgaua

SEQ ID NO: 93869 - RNA, 64 nt, hsa
ucuuggaggaaucaggcaaacaucucaaaaauucucuuuccauccuaccagcagcaguguguaa

SEQ ID NO: 93870 - RNA, 64 nt, hsa
cauaguggcuacauuacuucagauuccccuaaugucuuuccagccagacuuggaaucauggagg

SEQ ID NO: 93871 - RNA, 64 nt, hsa
ccugggguuccaacaaagcucagcucccagauucucuuuccaguuucauccuaaguuccuagca

SEQ ID NO: 93872 - RNA, 64 nt, hsa
acacacuguuaacacuucugccaguuuuuucugaucuuuccagccccacccccuuucucuuucu

SEQ ID NO: 93873 - RNA, 64 nt, hsa
uucuuggaaaggagcucacucuuggaaagacugaucuuuccaaaauauuuucccuggucugaag

SEQ ID NO: 93874 - RNA, 64 nt, hsa
ccauuuuuuuuuaauaaaagauccucagcuacagucuuuccauuuuccuugcuucucuuauugc

SEQ ID NO: 93875 - RNA, 64 nt, hsa
aggccaguaucccaaaccucuuccacgucacuguucuuuccacccauucucccuuugcaucuug

SEQ ID NO: 93876 - RNA, 64 nt, hsa
cuucagccugcaaugagggacugaggcccacgagucuuuccagcucuuccuccauucuggccag

SEQ ID NO: 93877 - RNA, 64 nt, hsa
uaaccaaucuuauuugugaacugauucauaucugucuuuccacucuugguucucuugccguaga

SEQ ID NO: 93878 - RNA, 64 nt, hsa
aggaagaaguccugguguggguuguuugacaccuucuuuccacuuucaccuuuuauuuuuuauu

SEQ ID NO: 93879 - RNA, 64 nt, hsa
guggaaaggcaucagggcuguuugacagugugcgucuuuccaaucccauguuccuccauucgug

SEQ ID NO: 93880 - RNA, 64 nt, hsa
guggggccauggccucgaugauggucuccacaggucuuuccaccucugugaguccaagucaggu

SEQ ID NO: 93881 - RNA, 64 nt, hsa
auuguuccuuaucaggaauaacaaagguacuacaucuuuccagccaucagcacguuguacaacu

SEQ ID NO: 93882 - RNA, 64 nt, hsa
uccuguauccggcacugcuaagcuuuucaagguaucuuuccaauccugcugauguggcagucaa

SEQ ID NO: 93883 - RNA, 64 nt, hsa
acugcuuccuuucuucuuuccagucagcuauuggucuuuccagcuguuauaaucuaaaguauuc

SEQ ID NO: 93884 - RNA, 64 nt, hsa
uuucuacauugaaaauagaaacugcuuccuuucuucuuuccagucagcuauuggucuuuccagc

SEQ ID NO: 93885 - RNA, 64 nt, hsa
uagaaagaaagguaaagagucuagaguuuauuccucuuuccaaaacauucucauuccucuccuc

SEQ ID NO: 93886 - RNA, 64 nt, hsa
aagucuuuauuauuuacuuugcauuuuguuucacucuuuccagauaagcagaguugcucuucac

SEQ ID NO: 93887 - RNA, 64 nt, hsa
uuuacugcuguuuugaauagagccauguucauuuucuuuccaguuagaguaaguacuucugugg

SEQ ID NO: 93888 - RNA, 64 nt, hsa
ccugcucauuaugauuccuccuuuuagucuaauaucuuuccaguucauacuuguuuuuaaucau

SEQ ID NO: 93889 - RNA, 64 nt, hsa
aaaggggccucuccuuuucuccacugucauaaucucuuuccaucuuacuugcccuucuauacuu

SEQ ID NO: 93890 - RNA, 64 nt, hsa
uguuccuguccagcaggggucucccaacaagugcucuuuccaccccaaaggggccucuccuuuu

SEQ ID NO: 93891 - RNA, 64 nt, hsa
uggguccagaagacguggucuagaccagggcugcucuuuccacuugcccuguguucuuucccca

SEQ ID NO: 93892 - RNA, 64 nt, hsa
aaauacccauguuacuucucugaguuuuaguuggucuuuccaucuaucacugcauuaucuugcu

SEQ ID NO: 93893 - RNA, 64 nt, hsa
ggaggccaccuucgcuagcagggagugggaggcuucuuuccagggauuugugucuccguucuga

SEQ ID NO: 93894 - RNA, 64 nt, hsa
aaucucacuaucagagccacaaaucugggaccugucuuuccaacuaaauuggaggcuuuggaag

SEQ ID NO: 93895 - RNA, 64 nt, hsa
agguugcaccucccccaaccuuagauguucuaagucuuuccauuggaucucauuggacccuucc

SEQ ID NO: 93896 - RNA, 64 nt, hsa
cuaaggccauuauuguacuugccuuauuagagugucuuuccacggagccacuccucugacucag

SEQ ID NO: 93897 - RNA, 64 nt, hsa
aaaagugaacagaguuaccuuacagaguuuuggaucuuuccagggauagccaaugauuuuaucc

SEQ ID NO: 93898 - RNA, 64 nt, hsa
uuccuacuguuucacuguacuuccauugaaauacucuuuccauuaaaauauucugaaacaauau

SEQ ID NO: 93899 - RNA, 64 nt, hsa
acccacauacagacacacacacucucucucucuuucuuuccaucccaccccccuuggaauuauu

SEQ ID NO: 93900 - RNA, 64 nt, hsa
ucuagauggaucaugcagcuucucucagcucagcucuuuccaucuaccaaauggguguaauaau

SEQ ID NO: 93901 - RNA, 64 nt, hsa
uuaacuccacauugcuuuauugguuaauuuauauucuuuccauguaauucauguaauuguaugu

SEQ ID NO: 93902 - RNA, 64 nt, hsa
gggccuggcugggggugcagaagggcaggguaguucuuuccauuuccccuugcagcuacacuua

SEQ ID NO: 93903 - RNA, 64 nt, hsa
aauuucuuuaaaaaguuuucuauuuuaucuaaaaucuuuccauuauaucuaaauuagaaugauc

SEQ ID NO: 93904 - RNA, 64 nt, hsa
uucugagguuaacacuugauuuagccccuacauaucuuuccauauauccuauuauuucugaaua

SEQ ID NO: 93905 - RNA, 64 nt, hsa
aagauagucacgaaaauacugaaaguuugauuuuucuuuccauauuugaauuaauuuuuucugu

SEQ ID NO: 93906 - RNA, 64 nt, hsa
guuuuacaagacugaagacccagaguauacuuuuucuuuccagaaauaauuucauaccgccuau

SEQ ID NO: 93907 - RNA, 64 nt, hsa
acugaaucagaggaaucagacagaggaggauagcucuuuccagaauccacacuucugaccucag

SEQ ID NO: 93908 - RNA, 64 nt, hsa
ggugcaaguugaccaaaucguuuuaagugguaacucuuuccaaccguagcaggguuguuuucug

SEQ ID NO: 93909 - RNA, 64 nt, hsa
aaacaagcggaggcgagggccaauucaaccccauucuuuccagcgccccgcaccauagcaccug

SEQ ID NO: 93910 - RNA, 64 nt, hsa
uuuguauauuuggcuugauauggucuuaauauuaucuuuccacgaaauggauauauuucuagaa

SEQ ID NO: 93911 - RNA, 64 nt, hsa
gguuuuugucaugugcaaggaaggacaauaguccucuuuccaaguguguuagcauagacuucuc

SEQ ID NO: 93912 - RNA, 64 nt, hsa
ccugcucuucaagccaauuuacuacacccaguugucuuuccagaaguucaucccagcgguaaua

SEQ ID NO: 93913 - RNA, 64 nt, hsa
ggagggccuagaacauggauagaucucuuaguggucuuuccaaaaguacauguacuugaaauau

SEQ ID NO: 93914 - RNA, 64 nt, hsa
cucauuucaagugaauuauuuuaaucuuuuucucucuuuccaaaaauuuaggaauguuuagugu

SEQ ID NO: 93915 - RNA, 64 nt, hsa
cuaauaauuaaccaucuaccucuguuuuuaauuuucuuuccaaaaggcagcuugaaauguuggu

SEQ ID NO: 93916 - RNA, 64 nt, hsa
ccguggaggacaaagaaaaggguuguuauuuuugucuuuccagccagccugcuggcucccaaga

SEQ ID NO: 93917 - RNA, 64 nt, hsa
agagcgccacacucgcugcuuaagcucccccagcucuuuccagaaaacauuaaacucagaauug

SEQ ID NO: 93918 - RNA, 64 nt, hsa
cugggauuacaggcgcaagccacccagcccagcuucuuuccauuccuugauaggcgaguauucc

SEQ ID NO: 93919 - RNA, 64 nt, hsa
gcacccccuugcagaugaguaucaccccaucuuuucuuuccacuugguuuuuauuuuuauuuuu

SEQ ID NO: 93920 - RNA, 64 nt, hsa
gcugcuugagauugguucugcucuuuucuucauuucuuuccagaacaacucuuucccaccccaa

SEQ ID NO: 93921 - RNA, 64 nt, hsa
auuuuuuaacuaauauuuguacauuuucuuagucucuuuccaagucuuugccucuuuuuuuucu

SEQ ID NO: 93922 - RNA, 64 nt, hsa
ucacacaguuuguaaugaagacagcuccuucucaucuuuccauaagccugagauacaaguucag

SEQ ID NO: 93923 - RNA, 64 nt, hsa
cuaggaggcaaauaucugaagcuugcuaugcuguucuuuccauuccuuuucccucugaaacaca

SEQ ID NO: 93924 - RNA, 64 nt, hsa
uuauuucuucccuuaugaaaaaccucccuuaagaucuuuccaggucaucaauuugaugugcaua

SEQ ID NO: 93925 - RNA, 64 nt, hsa
uaaaggacacccuagguuuuucuuagcuuccagcucuuuccauacagucuucacugaaguguuu

SEQ ID NO: 93926 - RNA, 64 nt, hsa
cccucuagaaacauauuggcugucaucaaaggguucuuuccaggccugaggaccuaggccccag

SEQ ID NO: 93927 - RNA, 64 nt, hsa
uugaagcuggggcgauguuugcagucaagaccauucuuuccaaccucuggguucuugcaaguug

SEQ ID NO: 93928 - RNA, 64 nt, hsa
auugcccauaagacccccaggaagcuaggcacuuucuuuccauggaaacauuuagacacaaacc

SEQ ID NO: 93929 - RNA, 64 nt, hsa
cugaucccagcccuaaaggaaggguagacccgugucuuuccagcccuaaaggaaggguagaccc

SEQ ID NO: 93930 - RNA, 64 nt, hsa
gucuuuccagcccuaaaggaaggguagacccgugucuuuccagcccuaaaggaagggcagaccc

SEQ ID NO: 93931 - RNA, 64 nt, hsa
gucuuuccagcccuaaaggaagggcagacccgugucuuuccaugcccgagggccacgacgucac

SEQ ID NO: 93932 - RNA, 64 nt, hsa
cugggcugugcugaggcagugcugucucgcucagucuuuccagaccagcggggcagcaccuggg

SEQ ID NO: 93933 - RNA, 64 nt, hsa
gagagcuuggaaggagguugagcucuucacugugucuuuccaucugggcucugcagcccagcuc

SEQ ID NO: 93934 - RNA, 64 nt, hsa
ugccaaguucaguuuuguuucuuugcgugcagugucuuuccauggauaaugcauuugauuuauc

SEQ ID NO: 93935 - RNA, 64 nt, hsa
cacacagagucaggccguugcuagucaguucucuucuuuccacccugucccuaucucuaccacu

SEQ ID NO: 93936 - RNA, 64 nt, hsa
guucaacguacaaacacuggaguguguuuuuaucucuuuccaaaaguuugucaaacuaugcaga

SEQ ID NO: 93937 - RNA, 64 nt, hsa
uuagaagugcugcacacuuuacagcagcuuccuuucuuuccauggcacugccuaguuaacagaa

SEQ ID NO: 93938 - RNA, 64 nt, hsa
guggcuaccaacccauucaaagaggacauaugauucuuuccaagaugaacuugaagauuacaua

SEQ ID NO: 93939 - RNA, 64 nt, hsa
aaagcaguuaccucauucaaagaagacauaugacucuuuccaagaugaacuugaagauuacauc

SEQ ID NO: 93940 - RNA, 60 nt, hsa
ugucuacagccaacuauucuauuaguuacaaaacucaaucauuuuauucagcaacuggau

SEQ ID NO: 93941 - RNA, 60 nt, hsa
aaaaaaauaaaguaaaauagaaaacugagaaaacucaauccaugaccagggagaacuuac

SEQ ID NO: 93942 - RNA, 60 nt, hsa
aauggugccaccacucaagcaacaagccucaaacucaaccaugucaucuuuuucuuggau

SEQ ID NO: 93943 - RNA, 60 nt, hsa
aaggacaagaugguuaagucaauucuguuaaaacucaaggcuuauauuaagcaaacacuu

SEQ ID NO: 93944 - RNA, 60 nt, hsa
cugcacaaagaauaaaauuaaggauuuuauaaacucaaauuggcaccuacugaauuaaaa

SEQ ID NO: 93945 - RNA, 60 nt, hsa
cuuugauuaaaggccauuuuuaaaacuuaaaaacucaacaccucacagauuauaauagaa

SEQ ID NO: 93946 - RNA, 60 nt, hsa
ucucuguuugcuugucauagcagcauuuggaaacucaaacaugcuuucauuuacauaaau

SEQ ID NO: 93947 - RNA, 60 nt, hsa
gguauuaauuauugaaagucccuuuccccaaaacucaacuccuauggcaauuaugaacuc

SEQ ID NO: 93948 - RNA, 60 nt, hsa
gucuuuucagccuuuccaucuuuacaaauaaaacucaaaaaagccguccagcuuauccca

SEQ ID NO: 93949 - RNA, 60 nt, hsa
aggauugccugugugcuggaaauauauuugaaacucaaccaguaugcccagccuauugca

SEQ ID NO: 93950 - RNA, 60 nt, hsa
gccagacaaacccaaguuguccaggcaaauaaacucaaaucuuugucacgucugauauua

SEQ ID NO: 93951 - RNA, 60 nt, hsa
uggugcacuuuaauacuaucacaucuuugaaaacucaauuugaguuuuaccaauuaaugu

SEQ ID NO: 93952 - RNA, 60 nt, hsa
aaaaaucuuucccagaaguugguuccuagaaaacucaauaccaucaucucuuaucucuau

SEQ ID NO: 93953 - RNA, 60 nt, hsa
aucuguuacuguucuaaaaauguuuaaaagaaacucaauacagauaaagauaaauaugug

SEQ ID NO: 93954 - RNA, 60 nt, hsa
uuggcaugacuguuugucucgaaaaccaauaaacucaaaguuuagaaaaacucauucaug

SEQ ID NO: 93955 - RNA, 60 nt, hsa
augaccagauggagucuuaacacuuccagcaaacucaaucucagcgugugaccaauggcu

SEQ ID NO: 93956 - RNA, 60 nt, hsa
cuauuucucuaaaacucaaaaaaaaaaaaaaaacucaagauaguaaaagcaccuagugug

SEQ ID NO: 93957 - RNA, 60 nt, hsa
cuaagucauauuaaaaggacuauuucucuaaaacucaaaaaaaaaaaaaaaacucaagau

SEQ ID NO: 93958 - RNA, 60 nt, hsa
gacuagaaccuauaggaaacuacuuggagcaaacucaaaggacagauuagggaucgagau

SEQ ID NO: 93959 - RNA, 60 nt, hsa
aaagcgugauagaggagagaauuuuugacaaaacucaaaaguuguuugcacagcuguucu

SEQ ID NO: 93960 - RNA, 60 nt, hsa
uagauguuuuguguguauuuuuuuaaaugaaaacucaaaauaagacaaguaauuuguuga

SEQ ID NO: 93961 - RNA, 60 nt, hsa
agcaagcuacaaagagggugugucacacugaaacucaauaguugaguuuggcuguuguug

SEQ ID NO: 93962 - RNA, 60 nt, hsa
caguauggcuuuuaguacugaagccaaaugaaacucaaaaccaucucucuuccagcugcu

SEQ ID NO: 93963 - RNA, 60 nt, hsa
gaaucaccaaaggagcuauggagagaauuaaaacucaacauuacuguuaacugugcguua

SEQ ID NO: 93964 - RNA, 60 nt, hsa
aacucaguccaucugaugccaguguugaguaaacucaacuacuaugaaauuucaccuaau

SEQ ID NO: 93965 - RNA, 60 nt, hsa
ccuggagguggccauuaauuggcaccacucaaacucaaacucaguccaucugaugccagu

SEQ ID NO: 93966 - RNA, 60 nt, hsa
uguaaucccaacaucuaauuuuagucuuagaaacucaaacuauuaauaaguggaaaaagu

SEQ ID NO: 93967 - RNA, 60 nt, hsa
cacuuguugcaguacaaucaucggguuaaaaaacucaaugaaaucagcaaacugggaauu

SEQ ID NO: 93968 - RNA, 60 nt, hsa
uucaaugucuuuuuuuuuuuuuucauggaaaaacucaaaccucuguuauuugggagcuca

SEQ ID NO: 93969 - RNA, 60 nt, hsa
uugcuugacaguuucuaaacaaacaaaaauaaacucaaugaaaggaaagauguuucuuuu

SEQ ID NO: 93970 - RNA, 60 nt, hsa
aauaucuuggggccccagaaucacuaaggaaaacucaagcuuagggaaacuucuuagggc

SEQ ID NO: 93971 - RNA, 60 nt, hsa
cugauugccuccuuuggaaaggcuaaucagaaacucaaaagaaugcaacuguuugugucu

SEQ ID NO: 93972 - RNA, 60 nt, hsa
gaucaauuuggaauauauaaaguguacuaaaaacucaacugaagucaggcaugguagcuc

SEQ ID NO: 93973 - RNA, 60 nt, hsa
gccucaucucaaaaaaaaaaaaaggccacaaaacucaacaauaaaaacaaacaguccaau

SEQ ID NO: 93974 - RNA, 60 nt, hsa
uugcuuaagucaacagugcccuaaaacuccaaacucaaaugcagucaauuauucacgcca

SEQ ID NO: 93975 - RNA, 60 nt, hsa
acagacaguauuggauaggguaaagcaagaaaacucaagcugcagcuggacugcaggcuu

SEQ ID NO: 93976 - RNA, 64 nt, hsa
gcugugucagugaagauguacgacuaccuguugggaaggacaaagggaugaggcuccagagaga

SEQ ID NO: 93977 - RNA, 64 nt, hsa
ucugucacgcacauguguccugugguuauagcuagaaggacaggagucuccugcugaugcguga

SEQ ID NO: 93978 - RNA, 64 nt, hsa
ucuggcugccaauggaacucaaaacuuggaaggcgaaggacaauguuaucugggauucaccgug

SEQ ID NO: 93979 - RNA, 64 nt, hsa
uugacuuccagcuuuuacgagugagccaaaaacagaaggacaaguacaacugugcuggccugcu

SEQ ID NO: 93980 - RNA, 64 nt, hsa
caccccacccaccucugcccuguccuuggcagcugaaggacaccuugacuuccagcuuuuacga

SEQ ID NO: 93981 - RNA, 64 nt, hsa
ugccuggccguggcuucucuuuggcucccaaagagaaggacaguguugggaguaucugccgugg

SEQ ID NO: 93982 - RNA, 64 nt, hsa
guaucugccguggcuucucuuuggcucccaaagagaaggacaguguugggaguaucugccggcg

SEQ ID NO: 93983 - RNA, 64 nt, hsa
agcuguugaaauguuuuggccuuuuggagugggggaaggacaaaucugauccuguaaucuuuuu

SEQ ID NO: 93984 - RNA, 64 nt, hsa
caauaaaguaguauaugauccucagauacagggagaaggacaaggcauacagcuuauugauuag

SEQ ID NO: 93985 - RNA, 64 nt, hsa
gggggagcaucccuagugaauacucacaccacaagaaggacaaacuugugcacauguccaagaa

SEQ ID NO: 93986 - RNA, 64 nt, hsa
guagaauguggcaaugccaacuggagaaagggaagaaggacauauuaccuugguuugaaucccu

SEQ ID NO: 93987 - RNA, 64 nt, hsa
uuauauuuucuaucuuugcuagaacuucgucauugaaggacaauuucuucaaagugguuacaau

SEQ ID NO: 93988 - RNA, 64 nt, hsa
aaagaucagagcaggugagcauccacuuugacaugaaggacaagaagacgcauggcucauggcg

SEQ ID NO: 93989 - RNA, 64 nt, hsa
gggaaggaacagaggcccugggcccuuccuaucagaaggacauggugaaggcugggaacgugag

SEQ ID NO: 93990 - RNA, 64 nt, hsa
agauggaccuaguacccacugagauuuccacgccgaaggacagcgaugggaaaaaugcccuuaa

SEQ ID NO: 93991 - RNA, 64 nt, hsa
aacugcuugaaaucuugcuguacuauagagcucagaaggacacagcccguccuccccugccugc

SEQ ID NO: 93992 - RNA, 64 nt, hsa
ugggguuggcgggaccugcuggugacgugcaggugaaggacaggaaggggcaugugagcguaaa

SEQ ID NO: 93993 - RNA, 64 nt, hsa
caccuucugugcucauguuuggaaagcugaaagggaaggacagcugugcccuccugggagcuca

SEQ ID NO: 93994 - RNA, 64 nt, hsa
ggacgcugugcugguucuguuuucuaaaggagcagaaggacaggucucugagacaggaucguug

SEQ ID NO: 93995 - RNA, 64 nt, hsa
accaucaccuuugaaagugcuuguuugggggagggaaggacauacggguaacuagaacuaccca

SEQ ID NO: 93996 - RNA, 64 nt, hsa
cagaugcaggcaguggagguggccugagcaggcagaaggacaccaagcgcccuauguugcuugu

SEQ ID NO: 93997 - RNA, 64 nt, hsa
uugguguguguagacacacauugcagacucuuaacgcaggaaggacuucaaacuucugcugaga

SEQ ID NO: 93998 - RNA, 64 nt, hsa
ucccuucuaaguagacagcaaaaauggcgggggucgcaggaaucugcacucaacugcccaccug

SEQ ID NO: 93999 - RNA, 64 nt, hsa
ucagcgaaugacaaaaucaucuuugugaaggccucgcaggaagacccaacacaugggaccuaua

SEQ ID NO: 94000 - RNA, 64 nt, hsa
acauauuaagaguaugugaaggaagcagggaugucgcaggaauccgcuggcuaacaucugcucu

SEQ ID NO: 94001 - RNA, 64 nt, hsa
ucuucggugguaguuucaaaagacacuacuaauacgcaggaagcguuccagcuauuuaaugcug

SEQ ID NO: 94002 - RNA, 64 nt, hsa
cuuucccuuauguucacugugccauaaugcugcucgcaggaaauggcauuuuacaaaaaaaaaa

SEQ ID NO: 94003 - RNA, 64 nt, hsa
gugcggcuucacccagggcagaacaaggcagaaucgcaggaaacccgcuuccccuuccugacag

SEQ ID NO: 94004 - RNA, 64 nt, hsa
uacagcccauucucaauuauccuucacaauuagacgcaggaaugcuacuaggaauuggaaucaa

SEQ ID NO: 94005 - RNA, 64 nt, hsa
ggagaccaaaauuugggguauuuauaauagucagcgcaggaaugcacauggaauaucuacuugu

SEQ ID NO: 94006 - RNA, 64 nt, hsa
acacauucucuaccugcuccgagccugguccucucgcaggaaugcugcugcugccuccgccgcc

SEQ ID NO: 94007 - RNA, 64 nt, hsa
cccuggaaaggaugcuuuuccucuccuuugccugcgcaggaauucuaacaggagugggugagga

SEQ ID NO: 94008 - RNA, 64 nt, hsa
auuugaacuuuggaacaggguuggcauucaaccacgcaggaagccuacuauuuaaauccuuggc

SEQ ID NO: 94009 - RNA, 64 nt, hsa
ucagccuguuccaugaaggcagagccauggaccacgcaggaagggccuacagcccauuucucca

SEQ ID NO: 94010 - RNA, 64 nt, hsa
uagaagauugucucuaaaauugugguuuaacucacgcaggaaguaaaauuccuauagcaagaca

SEQ ID NO: 94011 - RNA, 64 nt, hsa
ucauugccuugccaaacaggagcuccagcaaaagcgcaggaagagagacuggccuccuuggcug

SEQ ID NO: 94012 - RNA, 64 nt, hsa
cuauuccauuagccuguggucugcaggguaggcccgcaggaaaugaggaauggccgagcuggag

SEQ ID NO: 94013 - RNA, 64 nt, hsa
agugucccuggccccuuccugccaugggcaggcccgcaggaagagccgguagggguggaaaggg

SEQ ID NO: 94014 - RNA, 64 nt, hsa
cuguggggaucauucucucugagggcagaugaggcgcaggaaaauagucuuggaaauguuaaau

SEQ ID NO: 94015 - RNA, 64 nt, hsa
ccauguagaauaaaugaagaaagggaggcccagccgcaggaaggcagaauaaauccuugggagu

SEQ ID NO: 94016 - RNA, 64 nt, hsa
aucaauucuuuucugccugagaaagagaaccagacgcaggaagaugaaaggcugcccuuuguuc

SEQ ID NO: 94017 - RNA, 64 nt, hsa
uucccccagugcggccagcuccgcgccaggauggcgcaggaacucaauaaagugcuuugaaaau

SEQ ID NO: 94018 - RNA, 64 nt, hsa
cccuuaucugcggccggugaagaagcccaagauccgcaggaagaagugaguuggaggcuggggu

SEQ ID NO: 94019 - RNA, 64 nt, hsa
aaaggucugccauacucuucagaggaguucggcucgcaggaaaaugugggcuuccuuuaaaggg

SEQ ID NO: 94020 - RNA, 64 nt, hsa
aaggccuuaugcuccaagcauguaaagaaaagaucgcaggaauguggagagcuuccaaaaagag

SEQ ID NO: 94021 - RNA, 64 nt, hsa
uuccaaggaguuccaugaagaccacauccacacacgcaggaacucccagcaacacaagcuggaa

SEQ ID NO: 94022 - RNA, 64 nt, hsa
gggaugccauguagccccagcuggaagugacuuccgcaggaauugagagggaauagcucacccc

SEQ ID NO: 94023 - RNA, 64 nt, hsa
ccuguccucuccguggaggacccugggcccucaccgcaggaagcaguuuggguuuugaaagguu

SEQ ID NO: 94024 - RNA, 64 nt, hsa
uucaugaaaaacugauagaagcaacagaagaauucgcaggaagaaaaaucauaguguuaaugaa

SEQ ID NO: 94025 - RNA, 64 nt, hsa
uagacacccaaguggaaggugcuacaaccugaagcgcaggaaagaaaggcccauuccccucgca

SEQ ID NO: 94026 - RNA, 64 nt, hsa
auauuucaugauucaaauucuucaaagucuuauacgcaggaauguuuauucugcuguauuucug

SEQ ID NO: 94027 - RNA, 64 nt, hsa
guaugugcugagaugcuuccgaccuuucaggugacgcaggaacacugggggagucugaaugauu

SEQ ID NO: 94028 - RNA, 64 nt, hsa
gugauccauccaucuccagggagcaagacagagacgcaggaauggaaagcggaguuccuaacag

SEQ ID NO: 94029 - RNA, 64 nt, hsa
gcccgaccauuuaagaaaacaaccaucugagacacgcaggaaauugugagcauuucgacccgag

SEQ ID NO: 94030 - RNA, 64 nt, hsa
gaugccguuggggcggaggcugcccuugcagcgccgcaggaacucggccaggugcugaucggug

SEQ ID NO: 94031 - RNA, 64 nt, hsa
cagccucagaccccacccagcaccuucccagacacgcaggaagcccacagaaggcucagcuggu

SEQ ID NO: 94032 - RNA, 64 nt, hsa
ccccaaacuggagggggcauggagaaccguagagcgcaggaacggguggguaauucuagagaca

SEQ ID NO: 94033 - RNA, 64 nt, hsa
acacauacaacacagaucauuucccaguuagauccgcaggaaguagguugguggggguggaugu

SEQ ID NO: 94034 - RNA, 64 nt, hsa
guuccgugcaugcaguggaauaguaccagccuuccgcaggaaggaaauucugacauaugcggug

SEQ ID NO: 94035 - RNA, 64 nt, hsa
aagcacacggucaauccacguggaccgucucccucgcaggaacuccgcauccuugucccucugc

SEQ ID NO: 94036 - RNA, 64 nt, hsa
ugauuucuuccagcuuuuccacacucucuuuaugcgcaggaacaaacagcuguugagugagcug

SEQ ID NO: 94037 - RNA, 64 nt, hsa
agaagaugccuagcccuggggaccuugugaaauacgcaggaaccagggauaccaucugguccag

SEQ ID NO: 94038 - RNA, 64 nt, hsa
cccugcccccgugaggaugucacucagauggaaccgcaggaagcugcuccgugcuuguuugcuc

SEQ ID NO: 94039 - RNA, 64 nt, hsa
ggggugcugugagaaggcugugcccauguggggccgcaggaauccccuguauguucagggcugu

SEQ ID NO: 94040 - RNA, 54 nt, hsa
aauccuacacccugguguagggcccgcaggaagagcagccacgccuggaccgcg

SEQ ID NO: 94041 - RNA, 64 nt, hsa
gccuggcuuccugguaaggaguuucagccgccuccgcaggaacccccaaagugcagauuccgga

SEQ ID NO: 94042 - RNA, 64 nt, hsa
gcccaggccagaagaccucccuucaggugccgggcgcaggaacuguguguguccuacacaaugg

SEQ ID NO: 94043 - RNA, 64 nt, hsa
ugccuuggcagaggggagacuccaaaagagucaucgcaggaagaaguuaagaacacugaacauc

SEQ ID NO: 94044 - RNA, 64 nt, hsa
gcagaugagugggagacugguugcaaggugugaccgcaggaauccuggaggaauagagaguaaa

SEQ ID NO: 94045 - RNA, 64 nt, hsa
gcagaugagugggagacugguugcaaggugugaccgcaggaauccuggaggaacagagaguaaa

SEQ ID NO: 94046 - RNA, 64 nt, hsa
gccggaggacagccagcggcugcuuuguggacaccgcaggaaguuccucgggacacggcugcuu

SEQ ID NO: 94047 - RNA, 64 nt, hsa
augacgaagcugcucagcaacuccaccugcccgccgcaggaaggagcaguccccugcuaucccu

SEQ ID NO: 94048 - RNA, 64 nt, hsa
cuccugccgccucuucccuaccuccuccacuagccgcaggaagggccuccagcacccacaacug

SEQ ID NO: 94049 - RNA, 64 nt, hsa
gcaauggugugguuggagaguugugcugggauagcgcaggaaggugggucccggcaacacgcag

SEQ ID NO: 94050 - RNA, 64 nt, hsa
auugguguccuuauaagaaggggagguuaggacacgcaggaaagaccacaugaaggcccaggag

SEQ ID NO: 94051 - RNA, 64 nt, hsa
gccucccagggaacacaaggccuuugccauuggucgcaggaacccaucucuuagagcuaugggg

SEQ ID NO: 94052 - RNA, 64 nt, hsa
ggggagacuccccucuugcuguguguacuggacacgcaggaagcaugcugucuugcugccucug

SEQ ID NO: 94053 - RNA, 64 nt, hsa
auguucuuaagaauaaaauguugcucucugguuucgcaggaaauagauuguucuaaucuuugaa

SEQ ID NO: 94054 - RNA, 64 nt, hsa
uacugaucuucaauaugaagacaugagcuuuucucgcaggaaauuuucuuuuucacagaacugg

SEQ ID NO: 94055 - RNA, 64 nt, hsa
uccuggucugugaagagccgguggugcccgugcccgcaggaacugggcugggccucgugcgccc

SEQ ID NO: 94056 - RNA, 64 nt, hsa
auuauucaagagaccaccugacaugcaucuccuccgcaggaauacauucguccucucuuagaga

SEQ ID NO: 94057 - RNA, 64 nt, hsa
auggcagaggacugaacaccuccucagaagucagcgcaggaagagccugcuuuggacacgggag

SEQ ID NO: 94058 - RNA, 64 nt, hsa
cauagccacacacccagggccugacugaggcccacgcaggaaccgacacucagacacaaggcaa

SEQ ID NO: 94059 - RNA, 64 nt, hsa
uuaauuuuccuagaaaauccuucagaccugaagacgcaggaaaagaaucuggcucucagggugg

SEQ ID NO: 94060 - RNA, 64 nt, hsa
uggacucgcgagagggugccgcgggcgagaagggcgcaggaaccgaggacuccaggggcugggg

SEQ ID NO: 94061 - RNA, 64 nt, hsa
cugugcaucucggccagcacgggagccagugccgcgcaggaaugugggguccccuguguucccu

SEQ ID NO: 94062 - RNA, 64 nt, hsa
ggcaccuuuccgagugcagcuggagggaucugagcgcaggaagacgcagaacaacagaaauagc

SEQ ID NO: 94063 - RNA, 64 nt, hsa
acucagaggaggcucauuagcuggcuacaugcuucgcaggaagugggaaggacucacaucauaa

SEQ ID NO: 94064 - RNA, 64 nt, hsa
ucagcagcaaauuugacuugaauucacuuaggaucgcaggaaucaggggaaagugauuuuaaag

SEQ ID NO: 94065 - RNA, 64 nt, hsa
ggaaagccugaaaugccuuaauugugaacugauacgcaggaaaaugaaauauguaagcacauug

SEQ ID NO: 94066 - RNA, 64 nt, hsa
gauucgaguucucccugggaggguuuagaagaaacgcaggaacauucuggguggcgucgaagga

SEQ ID NO: 94067 - RNA, 64 nt, hsa
auacuguaacccagguucugccugucguguauaaguuuuagauacuuuuguucuuucuugcucu

SEQ ID NO: 94068 - RNA, 64 nt, hsa
gaccaaaaccacaaucuagacuacaaaguauauuguuuuagaguacucaaauuguauuauuuau

SEQ ID NO: 94069 - RNA, 64 nt, hsa
uugugcccgccugcccccauccccuccaggccacguuuuagauggcccuuguaguugcgggucc

SEQ ID NO: 94070 - RNA, 64 nt, hsa
agucuuuuccuuuuuuucuguuccuagcuaugggguuuuagagaagugggaacaggaaggcauu

SEQ ID NO: 94071 - RNA, 64 nt, hsa
aguuguuaucauaguauuuuaaaaccuguauaguguuuuagacuuguuaaaacauugcugucua

SEQ ID NO: 94072 - RNA, 64 nt, hsa
ccuuuucauugagggaaaauauauuugaauuucuguuuuagauuguaucgggucccaguugauu

SEQ ID NO: 94073 - RNA, 64 nt, hsa
gcagaauuggacaaaauuacuuaugaaagagacaguuuuagacaggcauaugaagaucuucgga

SEQ ID NO: 94074 - RNA, 64 nt, hsa
aagaguuaauuguuccuuucuucagugggccauuguuuuagauauuuaaaaaauccaacaguuu

SEQ ID NO: 94075 - RNA, 64 nt, hsa
gauacuuaaguuuuagaaaugagaaaaauacagaguuuuagaaaugagaucuagagaacacguc

SEQ ID NO: 94076 - RNA, 64 nt, hsa
gauuuuaguaaggucaguuugauuggauacuuaaguuuuagaaaugagaaaaauacagaguuuu

SEQ ID NO: 94077 - RNA, 64 nt, hsa
augcaggcagcacaauauggccuaaacugccauaguuuuagaaugugaaaaaaaugcauguuua

SEQ ID NO: 94078 - RNA, 64 nt, hsa
aaaaucgucuuacauguguacaauaugcaaauuaguuuuagauuagagagugcagccauuuugu

SEQ ID NO: 94079 - RNA, 64 nt, hsa
uagacuaugaugcuuuuguuaagaaagguuucauguuuuagauauuuuccguguccuaaauaau

SEQ ID NO: 94080 - RNA, 64 nt, hsa
uuucgagauucagguucucaauaauaauauucaaguuuuagaguuucacuuuguacuauuuaaa

SEQ ID NO: 94081 - RNA, 64 nt, hsa
uucuauaguuuucuccuuuagagggucgucuucaguuuuagagguuuacuucucccuugccuuu

SEQ ID NO: 94082 - RNA, 64 nt, hsa
gaggauguaacuugaugugagcaguaguaaaccuguuuuagauaucauacuguuaauauuuuau

SEQ ID NO: 94083 - RNA, 64 nt, hsa
caaaauaguucugaaaguggugagauacaaaaagguuuuagaaucacugcccuguugagagaaa

SEQ ID NO: 94084 - RNA, 64 nt, hsa
cccauuuuaagaugggggaaaauuaagguuugagguuuuagaaauuagcaaguagugcauaccc

SEQ ID NO: 94085 - RNA, 64 nt, hsa
ccaucuucugaaauucugagauucuaacauccuuguuuuagaauucuaaguuuccaacauuccu

SEQ ID NO: 94086 - RNA, 64 nt, hsa
acuccugugugacuguggagcacccagggacgugguuuuagagucuaccuaauauguuaaggac

SEQ ID NO: 94087 - RNA, 64 nt, hsa
cgagggguuucuuuccauguguuuuccuccuguuguuuuagaacuuuuuuaaaaaaacagaccu

SEQ ID NO: 94088 - RNA, 64 nt, hsa
guuguuuuagaacuuuuuuaaaaaaacagaccucguuuuagauuuauagcauugacuuuuacac

SEQ ID NO: 94089 - RNA, 64 nt, hsa
auuuuggaggcaauaggauaagcauugucuuaguguuuuagaauuauuuuugaaacagaguuaa

SEQ ID NO: 94090 - RNA, 53 nt, hsa
aauccacuggagcgucuugaaagguuuuagaaaauauuuggcuguagucucaa

SEQ ID NO: 94091 - RNA, 64 nt, hsa
uuaagucuggggggaaauggccacugcagauggaguuuuagaguaguaaugaaauucuaccuag

SEQ ID NO: 94092 - RNA, 64 nt, hsa
uauauauaguaccaauguuaccuuuuuauuuuuuguuuuagauguaagagcaugcucauauguu

SEQ ID NO: 94093 - RNA, 64 nt, hsa
uucugcugguugugagggggaaucugaaaauggaguuuuagaggaaaagucaacaucuaacuag

SEQ ID NO: 94094 - RNA, 64 nt, hsa
acacgaccuaaguugaagaguuuagacuugcugaguuuuagaagugauggaaauuaagagagca

SEQ ID NO: 94095 - RNA, 64 nt, hsa
aauagaaguuucccaguggcauucacuagugagaguuuuagacaaauuauguuacgaguaaagu

SEQ ID NO: 94096 - RNA, 64 nt, hsa
aaaggaagauuuuucuuuuuacaacuagauauuaguuuuagaggaaggaaauagcugaaaaacu

SEQ ID NO: 94097 - RNA, 64 nt, hsa
uguaauuauccccaauucuaaaagaaaaaacuuaguuuuagagaguuaguaaucuuugccuaag

SEQ ID NO: 94098 - RNA, 64 nt, hsa
ccaaguccaagaaccugagauuuuuaaucauuagguuuuagauuuccuuuagcagcagagacug

SEQ ID NO: 94099 - RNA, 64 nt, hsa
uuaccaaaacagcaauuugaaauuagaacuagugguuuuagagaacucagguauucuuuccuga

SEQ ID NO: 94100 - RNA, 64 nt, hsa
auuuucagggcuaccagaaaaauguuuccagaugguuuuagaauguaggacuuaugauccaauu

SEQ ID NO: 94101 - RNA, 64 nt, hsa
aacaaaacaaaacauuaaaauaccuguauguuuuguuuuagacgagaccaaacuaaacaaaaag

SEQ ID NO: 94102 - RNA, 64 nt, hsa
acugacaauuccucgggaaccuggccucuaauuaguuuuagaugacaaggucuuaaggagaaau

SEQ ID NO: 94103 - RNA, 64 nt, hsa
uaagcuguguuacuccaaaggacaugaaaaagcucaagaguaaaauuaaaauucucaaaaaaaa

SEQ ID NO: 94104 - RNA, 64 nt, hsa
guuugaaagaacuuagggaggaccauuggcuugccaagaguacagaaauucauuaugcugcuaa

SEQ ID NO: 94105 - RNA, 64 nt, hsa
uguaguuucuucccuccuguucucugguuauagcuggucccaggucagcgugggaggcaccuuu

SEQ ID NO: 94106 - RNA, 64 nt, hsa
ggaccugcgcuccaggguggucucggucccaggguggucccagcuggugggagccucuggcugc

SEQ ID NO: 94107 - RNA, 64 nt, hsa
gugaaaacucugggggaugcugaucaauagagcuuggucccaagcucuacugggcccuuggagg

SEQ ID NO: 94108 - RNA, 64 nt, hsa
uucucuugauccugggauuaugcuuuauaggauguggucccacaggccugucacagggccaaau

SEQ ID NO: 94109 - RNA, 64 nt, hsa
cucccgccccagccugccguggggcccgucagccuggucccacccccauggagaacccaaaguc

SEQ ID NO: 94110 - RNA, 64 nt, hsa
guagggucuggcugagcuucccacccacuuucccuggucccaauccuuucuuguccuauaccca

SEQ ID NO: 94111 - RNA, 64 nt, hsa
aagugccucugggggaccccccagccucccacccuggucccagguuccacaagugccucuggag

SEQ ID NO: 94112 - RNA, 64 nt, hsa
uggcucacuccgcaagccccccagccucccacccuggucccaguuucccgcaaagugccucugg

SEQ ID NO: 94113 - RNA, 64 nt, hsa
uucuucccagcagcccuucccggccucuaaaguuuggucccagcagcccuucccagccucuaaa

SEQ ID NO: 94114 - RNA, 64 nt, hsa
aacaagcaaggcucuuaggggacacuguugagccuggucccagaaucugugaucuccacagggc

SEQ ID NO: 94115 - RNA, 64 nt, hsa
cagagcgaguagagagcagcccucauucaccaccuggucccagacgugcuucaguccucguccu

SEQ ID NO: 94116 - RNA, 64 nt, hsa
cuuaucuggaagccuuucuggauuaauccagugauggucccaccuuuaguguuugagcuuuguc

SEQ ID NO: 94117 - RNA, 64 nt, hsa
caagcgucuuggcaggggugcugugaauguccaguggucccagcuccccacccuggcccugccc

SEQ ID NO: 94118 - RNA, 64 nt, hsa
uucaugggcauguuccugcuggggcggugcgguuuggucccaacucugcuaaguuuucugagau

SEQ ID NO: 94119 - RNA, 64 nt, hsa
ugcgcaugcuuaaugcuucuggggaggagggggcuggucccagcggagccgcacucuucgcccg

SEQ ID NO: 94120 - RNA, 64 nt, hsa
uaggcccccagcugagggccuggaguggugggauuggucccagugccuggcgcacauuggccug

SEQ ID NO: 94121 - RNA, 64 nt, hsa
ggcuggccagguuuugcagcuggaauucuccucuuggucccagggcggggcagggaauucuaag

SEQ ID NO: 94122 - RNA, 64 nt, hsa
uggauccaggcccaccugugucccugacucaggguggucccaggacuggcaccuacucuuuaga

SEQ ID NO: 94123 - RNA, 64 nt, hsa
aaaggauguggagcucuuuaaaaauaaauugcucuggucccaccucuggaaaucugauucagcc

SEQ ID NO: 94124 - RNA, 64 nt, hsa
agcaugagcucuggggacagacaguuauggguucuggucccacuuuuuaucacuuacuaguugu

SEQ ID NO: 94125 - RNA, 63 nt, hsa
cccuuucugcacagcuggugucggcaucauacuaaaagcaauguuuaaaucaaacuaaagauu

SEQ ID NO: 94126 - RNA, 63 nt, hsa
uguguguuuuuuuuuuuuuuuuuuuuguuguuuaaaagcaaggcaugcuuguggaugacucug

SEQ ID NO: 94127 - RNA, 63 nt, hsa
aaacuuuuuuuagaauugaagucugaaacaaacaaaagcaauucaaugucaauagacauuaag

SEQ ID NO: 94128 - RNA, 63 nt, hsa
uuaaucccauuaucucaggaguguguugguuauaaaagcaaguuuggcucccucuuuuccuca

SEQ ID NO: 94129 - RNA, 63 nt, hsa
auaaguuccaaauauguuaagggcuuuaauacaaaaagcaaaaauugucaguguuuggaugaa

SEQ ID NO: 94130 - RNA, 63 nt, hsa
caauaagaaugaaucucagaaaauauuaaggaaaaaagcaaguuugaagagaccacauggggc

SEQ ID NO: 94131 - RNA, 63 nt, hsa
aaacuaguggucaaggacuaacuccuaaaaaaaaaaagcaacucuuaucaaggauuaauuuaa

SEQ ID NO: 94132 - RNA, 63 nt, hsa
cuaaauaaaacccaucagcaugggguuauguagaaaagcaauuuauuccauuuuaagcacuua

SEQ ID NO: 94133 - RNA, 63 nt, hsa
ggaccuauccuugucuugaaaguuuguugcuuuaaaagcaaguaucucuccauaaauauuaug

SEQ ID NO: 94134 - RNA, 63 nt, hsa
caggaaccagcggaucugcaaagaccuacaaucaaaagcaaauccccauuuuccuuuuauaaa

SEQ ID NO: 94135 - RNA, 63 nt, hsa
gagagcagagcaugcagugauggaagaagcaggaaaagcaagaagaaaagacagcagcaucaa

SEQ ID NO: 94136 - RNA, 63 nt, hsa
aagcacccagaacaugcugagcagaacaucagaaaaagcaagaagaagaaaaggcgacaucaa

SEQ ID NO: 94137 - RNA, 63 nt, hsa
auaagugauaguuuauuguagugauguuuuuauaaaagcaaaaggauauucacuuucagcgcu

SEQ ID NO: 94138 - RNA, 63 nt, hsa
gagcuggagaugcaagcucuaggcugcgcuuccaaaagcaaaugauaauuauguuaaugucau

SEQ ID NO: 94139 - RNA, 63 nt, hsa
uuuuaagacaucuauuuuaugcuuuuguuuaaaaaaagcaaaucuauuuucaaauugugcaau

SEQ ID NO: 94140 - RNA, 63 nt, hsa
accugccccgggagggcagcggggaagacagagaaaagcaaacgcauuccuccucagcuccac

SEQ ID NO: 94141 - RNA, 63 nt, hsa
acacacauuccuuugaaauccacccaguguuuaaaaagcaacuuggaaauuuacacauuagca

SEQ ID NO: 94142 - RNA, 63 nt, hsa
uccuuucuuaguuauuugcuccuugcaaauuaaaaaagcaacuaagagaaagaaaaacauugu

SEQ ID NO: 94143 - RNA, 63 nt, hsa
gugcucugccuggagcuguuuccauaugauauaaaaagcaaguguaguauuccauuacuaugu

SEQ ID NO: 94144 - RNA, 63 nt, hsa
agucccucaggaaaaaaaaaaaauucuguuuuaaaaagcaaucugauucuuagcucuugaaac

SEQ ID NO: 94145 - RNA, 63 nt, hsa
guguauuguaaguagcaguuaaauuauuuuuuuaaaagcaauuucaguuuuaaucacugaaca

SEQ ID NO: 94146 - RNA, 63 nt, hsa
ccucuuauuuuucaguuuccagucaagauuauaaaaagcaaaugauugauauaauuugauauu

SEQ ID NO: 94147 - RNA, 63 nt, hsa
gaaugaagaaggcaaaaaauaucuuuuguacagaaaagcaagaugaaaaggaugugaaauggu

SEQ ID NO: 94148 - RNA, 63 nt, hsa
gucuaugauguguuuacuuuaaaaauugcuguuaaaagcaacacguauuaaauauguaauuau

SEQ ID NO: 94149 - RNA, 63 nt, hsa
aaggggaaggaccauuucguaauggucugacacaaaagcaaguuugauuuuugcagcacuagc

SEQ ID NO: 94150 - RNA, 63 nt, hsa
acuugcaguguuacgaucggaaugcuuuuuauuaaaagcaaguagcaugaaguauugcuuaaa

SEQ ID NO: 94151 - RNA, 63 nt, hsa
ucacaagcaucuuugucuugcaaauccuaagggaaaagcaagucccugcagugagcacuaggg

SEQ ID NO: 94152 - RNA, 63 nt, hsa
cuuccgaauagaauguuuucuuuaagaggcaugaaaagcaacuauuguuguguuacaguguua

SEQ ID NO: 94153 - RNA, 63 nt, hsa
ucaguaagcagcuugccaaucacuccaggucugaaaagcaagucccccagccccaccccaggg

SEQ ID NO: 94154 - RNA, 63 nt, hsa
aaagugauuuaaaaaugaucuuaccuguaccagaaaagcaaaguuaaaggaaacaaaauuugu

SEQ ID NO: 94155 - RNA, 63 nt, hsa
uuugcauuuaugauuucuccagaaauuuaccacaaaagcaaaauuuuuaaaacugcauuuuua

SEQ ID NO: 94156 - RNA, 63 nt, hsa
aggauuuuuuaaaaauuggcauuuuaaguguuuaaaagcaaauacugauuuucaaaaaaaugu

SEQ ID NO: 94157 - RNA, 63 nt, hsa
aagggaguuacagaggcugcuuaaaagauggagaaaagcaaaacccaguauuuaaagucuaua

SEQ ID NO: 94158 - RNA, 63 nt, hsa
aaugccuacuauuuuauaugcauauauuaaaagaaaagcaaagaccugagccgaggagaggau

SEQ ID NO: 94159 - RNA, 63 nt, hsa
caaaagaugucaguguuauaccuaaagcuaaaaaaaagcaaggguuugucauagagggaaccu

SEQ ID NO: 94160 - RNA, 63 nt, hsa
uagaggucaaggaccuuccuguguaguuggugcaaaagcaaucuccacaggacagcacugcuu

SEQ ID NO: 94161 - RNA, 63 nt, hsa
ugaagauuuagaaguuauauaaaaaauuaauuuaaaagcaaaccaaaagagguuuccauuaac

SEQ ID NO: 94162 - RNA, 63 nt, hsa
cugagugauugucaguguaaggccuuuuaaaacaaaagcaaguucuuuguuaggaauugguca

SEQ ID NO: 94163 - RNA, 63 nt, hsa
guguuuugccaauuaauauuauaugcuuguaauaaaagcaaaagaaaagcuuaagugaaagug

SEQ ID NO: 94164 - RNA, 63 nt, hsa
uaucaucauauggacucuauguaacacaaauucaaaagcaaacuaaaagcuauaugcagaguu

SEQ ID NO: 94165 - RNA, 63 nt, hsa
aaaauaaaaaauauuugucuccaccuuuuccccaaaagcaacagcaagacauauuuuguuaga

SEQ ID NO: 94166 - RNA, 63 nt, hsa
ugaugauuuucuuuuaaagaaauuaguuuauuuaaaagcaagauagccuggguugggaguuag

SEQ ID NO: 94167 - RNA, 63 nt, hsa
cugaauagguuuaagucagauaauagauuuuaaaaaagcaaaugaggcaaugugucaaaauuu

SEQ ID NO: 94168 - RNA, 63 nt, hsa
gcauuaaaauuucaaaguuuaauuaauauaauuaaaagcaacagcaagcagcagccugugaag

SEQ ID NO: 94169 - RNA, 63 nt, hsa
acaagaaaguuuguuugaauguguagaagaggaaaaagcaacaacagcaacaacacgaagaug

SEQ ID NO: 94170 - RNA, 63 nt, hsa
ccaagcaaaaaucaggcugagaaaaagcaaaagaaaagcaaaaaaaagaagaagaaacagcag

SEQ ID NO: 94171 - RNA, 63 nt, hsa
agaaaaagaagccaagcaaaaaucaggcugagaaaaagcaaaagaaaagcaaaaaaaagaaga

SEQ ID NO: 94172 - RNA, 63 nt, hsa
augccaagguaauuuuaaauuuacauuuuuaauaaaagcaacauguugaaacaagagagggug

SEQ ID NO: 94173 - RNA, 63 nt, hsa
uauacagcugucacucauuuguaguaaaacuuaaaaagcaaaaacaaaaaacaaaaaagaccu

SEQ ID NO: 94174 - RNA, 63 nt, hsa
cacuaugcacugcuguaacugguaguguucaguaaaagcaaaaugauaguuuucuagaugaca

SEQ ID NO: 94175 - RNA, 63 nt, hsa
ugaauuaaagcaacaaaaagauauugauuggcaaaaagcaagauauaagagauucauuugcuu

SEQ ID NO: 94176 - RNA, 63 nt, hsa
agcaucaggcugagauuugcacacaugggauguaaaagcaagcuguguguugcuuagucacuu

SEQ ID NO: 94177 - RNA, 63 nt, hsa
gccaucugaaguucauuaaucuuuagaugacaaaaaagcaaaaaguucccagaacguuuuugc

SEQ ID NO: 94178 - RNA, 63 nt, hsa
ccuacuuaaauuuuaaguuaugagguuuaugucaaaagcaacauuucacaaauguacuuuuaa

SEQ ID NO: 94179 - RNA, 63 nt, hsa
augcccuuacugugccaaaacaaaaaucuuaagaaaagcaaguagacaccuucauaacuauga

SEQ ID NO: 94180 - RNA, 63 nt, hsa
uagugaaaguauugaaaauacuaaauuauaacuaaaagcaacuuuuuauguuauugaaaauau

SEQ ID NO: 94181 - RNA, 63 nt, hsa
agugucccauugcugccaaaaauacacgucuuuaaaagcaacaaaaauugaaauaagacaucg

SEQ ID NO: 94182 - RNA, 63 nt, hsa
uccauuucuauacuuuaugggacacuagaaacuaaaagcaacaaauaaucugauauaaguccu

SEQ ID NO: 94183 - RNA, 63 nt, hsa
agcagugagaagaaaccucaggaaaggauaugaaaaagcaaguggccagugucugggauacug

SEQ ID NO: 94184 - RNA, 63 nt, hsa
acacaacucugagaauacccacugccagcaucaaaaagcaaagauacuaauuuuuuaagccaa

SEQ ID NO: 94185 - RNA, 63 nt, hsa
guaguaccaaaaagguauuuuccuuucucauuuaaaagcaaaaaccucccuuuuuaauugccu

SEQ ID NO: 94186 - RNA, 63 nt, hsa
gaccauaacuggcaaaauccuuaguguacggacaaaagcaaauuggaaaagccagccauuuac

SEQ ID NO: 94187 - RNA, 63 nt, hsa
gaagaaauauuuuaaggaaaccuauuugaaaaaaaaagcaaagaccauuugauaaaagccuga

SEQ ID NO: 94188 - RNA, 63 nt, hsa
aauaauagaaaaauucuacuuuaauuuccauuaaaaagcaaauagcauugacacauuuaaagc

SEQ ID NO: 94189 - RNA, 63 nt, hsa
agauuuacaaguguaagcuauaugauuucuucaaaaagcaaaagcaauauaccuaauucauuu

SEQ ID NO: 94190 - RNA, 63 nt, hsa
acaaguguaagcuauaugauuucuucaaaaagcaaaagcaauauaccuaauucauuuggauca

SEQ ID NO: 94191 - RNA, 63 nt, hsa
uuuaugcuguacauuucaguucaguguaugaccaaaagcaauauguuuauaagaagauguuug

SEQ ID NO: 94192 - RNA, 63 nt, hsa
ugguguucuaccugcaagaugugcagagggcauaaaagcaaaucaacacuuuauaguuauucu

SEQ ID NO: 94193 - RNA, 63 nt, hsa
uguaccuuucagcauccuaggaauuuuuauacuaaaagcaaaauguuuuuuccaguuagucuu

SEQ ID NO: 94194 - RNA, 63 nt, hsa
gaacauugguuaagaacuguuggaaacaaaacuaaaagcaaacucaacauaugugauguuuau

SEQ ID NO: 94195 - RNA, 63 nt, hsa
guguuauaugacaggacaaagcaaaaacaaacaaaaagcaagccugugaauauaauuuaauuu

SEQ ID NO: 94196 - RNA, 63 nt, hsa
guuguuuucuguggguugcgacccaugcaaucaaaaagcaaaauuuugauugagauuuuuuac

SEQ ID NO: 94197 - RNA, 63 nt, hsa
uggcauuuucauuacaggagaguuuacuaugcuaaaagcaaaaaacaaaaaaaaaaaaaaagg

SEQ ID NO: 94198 - RNA, 63 nt, hsa
guuugcauuuuuuaacauaaucuaagacagaaaaaaagcaauuuuuacuauguaacaauggua

SEQ ID NO: 94199 - RNA, 63 nt, hsa
gaauaagaaaauaauguuuaaagaaaaaaaaaaaaaagcaaaccuccaaaacguggaccuaac

SEQ ID NO: 94200 - RNA, 63 nt, hsa
uaugacuuggauauaugguugaagaaucaaaacaaaagcaaaaaaaaaaagcaaaaaaagaaa

SEQ ID NO: 94201 - RNA, 63 nt, hsa
uaugguugaagaaucaaaacaaaagcaaaaaaaaaaagcaaaaaaagaaaagagaaaaaaaga

SEQ ID NO: 94202 - RNA, 63 nt, hsa
gugaagagaugcaagacuuucaacugacuggcaaaaagcaagcuuuagcuugucuuauaggau

SEQ ID NO: 94203 - RNA, 63 nt, hsa
acucaacuaccucagguauucaguaauacaaugaaaagcaaaauuguuccuuuuuuuugaaaa

SEQ ID NO: 94204 - RNA, 63 nt, hsa
uauccauggcaagcuuuguauauaaaugaacaaaaaagcaagcaaagcaaaacaauaaacuag

SEQ ID NO: 94205 - RNA, 63 nt, hsa
ucauaaaacauguaacacugaucuucagauagaaaaagcaaucuguuuauuuaccuguaaggg

SEQ ID NO: 94206 - RNA, 63 nt, hsa
cagaugaacucugcuguuuagaaguaaccacagaaaagcaaagucaguguacacucugaguga

SEQ ID NO: 94207 - RNA, 63 nt, hsa
uaacucauuuccuugagcuuauacaaaacauagaaaagcaaacuguuaaaguagucaauaauu

SEQ ID NO: 94208 - RNA, 63 nt, hsa
ggaugaccuggcaaauaagaucuugaauaggccaaaagcaaguaucuugcuguguguagucuc

SEQ ID NO: 94209 - RNA, 63 nt, hsa
uuggguauuagaaaucugaaaguacugucaucuaaaagcaauugugauuuuauuguaauuggu

SEQ ID NO: 94210 - RNA, 63 nt, hsa
uugccuagcaagaaucacauucguuucccagugaaaagcaaaccagaacaaaacaaaaagcca

SEQ ID NO: 94211 - RNA, 63 nt, hsa
cugauuauuuguauugaagaaaacaaauuuaccaaaagcaaaagcauaaaccccucccucuuu

SEQ ID NO: 94212 - RNA, 63 nt, hsa
uuccuuuuaccuuucuccaccauccagagccacaaaagcaaaccuucuaccuccuaccuacuu

SEQ ID NO: 94213 - RNA, 63 nt, hsa
cagcauauacauuucagccaaagccauagaagaaaaagcaauaguugcuugaauuaugaucau

SEQ ID NO: 94214 - RNA, 63 nt, hsa
gaaaucagaagaacaaaaaagaagagcaagagaaaaagcaaauuugguaaguugugugugcuc

SEQ ID NO: 94215 - RNA, 63 nt, hsa
cagauuuuuuauaugucugcauguuuaaaaaaaaaaagcaacaaaagaaaaugcacucuaacu

SEQ ID NO: 94216 - RNA, 63 nt, hsa
gcugaauacuuuuuauaaugugaugauuauuaaaaaagcaaaaauuuuggucacuuccaagcu

SEQ ID NO: 94217 - RNA, 63 nt, hsa
auacuucaguaauaauuauguauguuauggcuuaaaagcaaguuucagugaaggucaccuggc

SEQ ID NO: 94218 - RNA, 63 nt, hsa
aauuuagauugguccuuuucaaaauucaaaaaaaaaagcaacaucuucauagaugaaugaaac

SEQ ID NO: 94219 - RNA, 63 nt, hsa
gauaauaucacaacccagaaguaaccaccuuuaaaaagcaacccccauguaugccuauaugug

SEQ ID NO: 94220 - RNA, 63 nt, hsa
cauagaaaacuugaaaaaugcagaaauguauaaaaaagcaaaaaugauuacugauaauaucac

SEQ ID NO: 94221 - RNA, 63 nt, hsa
cgcauaccugcuuccaagaauaaaacaguucugaaaagcaaccgcaaagccgggcgcgguggc

SEQ ID NO: 94222 - RNA, 63 nt, hsa
aaaaaaaagaaagaaagaaagagaaaagaaaagaaaagcaaccacagccagccuuagggaaaa

SEQ ID NO: 94223 - RNA, 63 nt, hsa
gauuacaagcugucucucugacaccagugguaaaaaagcaaguagaauaguuucugagucugu

SEQ ID NO: 94224 - RNA, 63 nt, hsa
aggggccauaucauucauggccaaaaaaaaccaaaaagcaaaaaacaaaaacaagucccaugu

SEQ ID NO: 94225 - RNA, 63 nt, hsa
ugacuuagcuauuaguauauuuaaaaacuguucaaaagcaaaagagaaggaacaggaaugaaa

SEQ ID NO: 94226 - RNA, 63 nt, hsa
aauugucuaauuuacagcaguugugaucccacaaaaagcaaguuuauaccucagauuggggua

SEQ ID NO: 94227 - RNA, 63 nt, hsa
aguaaauccaugucuuuguuuguuuuucuauuaaaaagcaaucaagaaagauaaugugaaaaa

SEQ ID NO: 94228 - RNA, 63 nt, hsa
ggcccagacaggcucacucaagcucuuuaacugaaaagcaacaagccacuccaggacaagguu

SEQ ID NO: 94229 - RNA, 63 nt, hsa
gaguaggagagaggaaacauuugacuuaucuggaaaagcaaaauguacuuaagaauaagaaua

SEQ ID NO: 94230 - RNA, 63 nt, hsa
uuagaaguuaaaccacccgauaggccuucgagcaaaagcaaagauccaccgagagaagaagag

SEQ ID NO: 94231 - RNA, 63 nt, hsa
uucgucauccaaguccaggucuagaucacacucaaaagcaaagcauucucuucccagugccua

SEQ ID NO: 94232 - RNA, 63 nt, hsa
uauucagugaauuacacauccucuuguucuuaaaaaagcaagugucuuugguguuggaggaca

SEQ ID NO: 94233 - RNA, 63 nt, hsa
cauauauauuuuuggaaaauggagcuaugguguaaaagcaacagguggaucaacccaguuguu

SEQ ID NO: 94234 - RNA, 63 nt, hsa
uguucacugaauaaauaaguaaauacauuauugaaaagcaaaucuguauaaaugugaaauuuu

SEQ ID NO: 94235 - RNA, 63 nt, hsa
gauccaacuauuucuuucaucagaaaaaguccgaaaagcaaaccuuaauuugaaauaacagcc

SEQ ID NO: 94236 - RNA, 63 nt, hsa
cugcuccagugaaaugugguacuuuuuucuuuuaaaagcaaccaagagagcugggaauaucug

SEQ ID NO: 94237 - RNA, 63 nt, hsa
ucugcaacagaauaugacaccaucuucccaggcaaaagcaacaucugguugaccaugauuuua

SEQ ID NO: 94238 - RNA, 63 nt, hsa
aacuauuccuguguaaaaacaacaaaaacaaacaaaagcaagaaaaccacaacuaaaacugga

SEQ ID NO: 94239 - RNA, 63 nt, hsa
gagggaaggaauaaucauucaaaugaacuuuaaaaaagcaaauuucaugcacugauuaaaaua

SEQ ID NO: 94240 - RNA, 63 nt, hsa
uaagacaugugaggaggaaaaggaaaaaaagcaaaaagcaagggagaaaagagaaaccgggag

SEQ ID NO: 94241 - RNA, 63 nt, hsa
gcaggccuaagacaugugaggaggaaaaggaaaaaaagcaaaaagcaagggagaaaagagaaa

SEQ ID NO: 94242 - RNA, 63 nt, hsa
auguuguuuuaaaagaaaauagcaaaacaacaaaaaagcaaaccuuaaaaugugaagaaagug

SEQ ID NO: 94243 - RNA, 63 nt, hsa
acaauaaacugguuguauggccauagcuauccgaaaagcaagagacaaagcaagacaaauauu

SEQ ID NO: 94244 - RNA, 63 nt, hsa
aaaagcaaaguaaucuuacaacuaugugcauacaaaagcaauacuauuuugugacuaaauauu

SEQ ID NO: 94245 - RNA, 63 nt, hsa
aguuuuaugaaagaugguauaguuuuuauugacaaaagcaaaguaaucuuacaacuaugugca

SEQ ID NO: 94246 - RNA, 63 nt, hsa
guaaaagggaugcuagaaauucaacugaagaaaaaaagcaagucaaguacguauucagcauua

SEQ ID NO: 94247 - RNA, 63 nt, hsa
aagagcucccaucugaucugcagucauuacagaaaaagcaaauauucccucaacaucagaaca

SEQ ID NO: 94248 - RNA, 63 nt, hsa
caugacuuggaacugaacuaacauuuuucuuuaaaaagcaaaacuuaaaaaaaaaaaaaaaga

SEQ ID NO: 94249 - RNA, 63 nt, hsa
gaggguggacggagcggggcccauucucaggucaaaagcaagauuucuacugucaugugggau

SEQ ID NO: 94250 - RNA, 63 nt, hsa
accggacacaccucugcuccaaaggaaauccaaaaaagcaaacacaagaaaucaaaauccaaa

SEQ ID NO: 94251 - RNA, 63 nt, hsa
ggcuuuaaguaaaaauccaaaaaguuuuuuuaaaaaagcaaaggaagcauacuugugaacuac

SEQ ID NO: 94252 - RNA, 63 nt, hsa
cuuggcauuggaauucuacuggaaaaaaauacaaaaagcaaaacaaaacccucagcacuguua

SEQ ID NO: 94253 - RNA, 63 nt, hsa
auagggucacuuugccauuaugcaaauggagauaaaagcaauucugacuguccaggagcuaau

SEQ ID NO: 94254 - RNA, 63 nt, hsa
uuccuggaaguaauuguaagcauccugaaauaaaaaagcaagaauaugaagaaguaguucaga

SEQ ID NO: 94255 - RNA, 63 nt, hsa
agaaugaauguagaaaaggcugaauucuguaauaaaagcaaacagccuggcuuagcaaggagc

SEQ ID NO: 94256 - RNA, 63 nt, hsa
uuuugucucauuugccaaaaaaaaaaaaaaaaaaaaagcaaacccccuaugguugauauuguu

SEQ ID NO: 94257 - RNA, 63 nt, hsa
ccagaaccuuuuugccuuuuuuuguuccccgugaaaagcaacauggacauuuccuucuagucc

SEQ ID NO: 94258 - RNA, 63 nt, hsa
gaggcucuuucuauaaauacauauuguuuaaaaaaaagcaagaaaaaaaggaaaacaaaggaa

SEQ ID NO: 94259 - RNA, 63 nt, hsa
caacagagcgagacccugucuccaaaaaaaaaaaaaagcaauguuuauauuauaaaagagugu

SEQ ID NO: 94260 - RNA, 63 nt, hsa
uauuuggaaccagaaaagcccaaccuaaauagcaaaagcaauccuaagcaaaaagagcaaugu

SEQ ID NO: 94261 - RNA, 63 nt, hsa
aaucaaaacauagaugcuagugaggcugcagagaaaagcaaauacuuauacacugcugguggg

SEQ ID NO: 94262 - RNA, 63 nt, hsa
aaccaccuuuugaagcagcaacuaucaagucugaaaagcaauugauguuuccauuaaucuuuu

SEQ ID NO: 94263 - RNA, 63 nt, hsa
acuaaaugcugaaauguggaugcauaccgaaauaaaagcaauucauuguguacuaaagguuuu

SEQ ID NO: 94264 - RNA, 63 nt, hsa
cagugaucagaauagauauccuuuuacacgcacaaaagcaauagauucauucaguggacaagu

SEQ ID NO: 94265 - RNA, 63 nt, hsa
uuuacauaguaaguuucacacuaccuuauuaccaaaagcaaacaccucuuacuuuaaacuaca

SEQ ID NO: 94266 - RNA, 63 nt, hsa
gcacuuuuuaaaacaaacaaacaaacaaaacaaaaaagcaaaccacauuuguuaucucaaauu

SEQ ID NO: 94267 - RNA, 63 nt, hsa
cugcugacucacacugcuaacucuguuacugacaaaagcaaaucaauaacucuaaauucuggg

SEQ ID NO: 94268 - RNA, 63 nt, hsa
auaaugggcuuuguuagcacuuucaaaaaaaaaaaaagcaaaccauacuuguccacuguccug

SEQ ID NO: 94269 - RNA, 63 nt, hsa
ccaccagggggaaggcuggcacaaggagaaaaaaaaagcaagcaucagcgaauaguauagugu

SEQ ID NO: 94270 - RNA, 63 nt, hsa
cauguaggguuggugagaaggaaagaugagaacaaaagcaacauuggguuaagggaacucgcu

SEQ ID NO: 94271 - RNA, 63 nt, hsa
uagucuaacuuaaacggaugggauucacuuaacaaaagcaagaagaaaagcacacgaacaggu

SEQ ID NO: 94272 - RNA, 63 nt, hsa
cuuaaagaccaaaucauuuguuugcuuugaagaaaaagcaaaaacaagaacaaaaacaccaaa

SEQ ID NO: 94273 - RNA, 63 nt, hsa
gauuucuauucaccuuuaauauauuuuuacaaaaaaagcaaacaauuuaaaaacaagcccacc

SEQ ID NO: 94274 - RNA, 63 nt, hsa
cccccuguuuguuguuuuguguuguuuccaaugaaaagcaaguuuacccucagaguuaugcuu

SEQ ID NO: 94275 - RNA, 63 nt, hsa
ucuagcauauauguguccauuuccuuaugcuguaaaagcaaguccugcaaccaaacucccauc

SEQ ID NO: 94276 - RNA, 63 nt, hsa
cucuccuagguagcccccucuucccugguaagaaaaagcaaaaggcauuucccacccugaaca

SEQ ID NO: 94277 - RNA, 63 nt, hsa
caauagaaugaugucugcucuagggaaaccuucaaaagcaauaaaaaugcuguguugaaaugc

SEQ ID NO: 94278 - RNA, 63 nt, hsa
aaauguaacugcuaaucaagggugaugcacagcaaaagcaauggaccccaucccucuaaagcc

SEQ ID NO: 94279 - RNA, 64 nt, hsa; identical to SEQ ID NO: 81174

SEQ ID NO: 94280 - RNA, 64 nt, hsa; identical to SEQ ID NO: 81175

SEQ ID NO: 94281 - RNA, 64 nt, hsa; identical to SEQ ID NO: 81176

SEQ ID NO: 94282 - RNA, 64 nt, hsa; identical to SEQ ID NO: 81177

SEQ ID NO: 94283 - RNA, 64 nt, hsa; identical to SEQ ID NO: 81178

SEQ ID NO: 94284 - RNA, 64 nt, hsa; identical to SEQ ID NO: 81179

SEQ ID NO: 94285 - RNA, 64 nt, hsa; identical to SEQ ID NO: 81180

SEQ ID NO: 94286 - RNA, 64 nt, hsa; identical to SEQ ID NO: 81181

SEQ ID NO: 94287 - RNA, 64 nt, hsa; identical to SEQ ID NO: 81182

SEQ ID NO: 94288 - RNA, 64 nt, hsa; identical to SEQ ID NO: 81183

SEQ ID NO: 94289 - RNA, 64 nt, hsa; identical to SEQ ID NO: 81184

SEQ ID NO: 94290 - RNA, 64 nt, hsa; identical to SEQ ID NO: 81185

SEQ ID NO: 94291 - RNA, 64 nt, hsa; identical to SEQ ID NO: 81186

SEQ ID NO: 94292 - RNA, 64 nt, hsa; identical to SEQ ID NO: 81187

SEQ ID NO: 94293 - RNA, 64 nt, hsa; identical to SEQ ID NO: 81188

SEQ ID NO: 94294 - RNA, 64 nt, hsa; identical to SEQ ID NO: 81189

SEQ ID NO: 94295 - RNA, 64 nt, hsa; identical to SEQ ID NO: 81190

SEQ ID NO: 94296 - RNA, 64 nt, hsa; identical to SEQ ID NO: 81191

SEQ ID NO: 94297 - RNA, 64 nt, hsa; identical to SEQ ID NO: 81192

SEQ ID NO: 94298 - RNA, 64 nt, hsa; identical to SEQ ID NO: 81193

SEQ ID NO: 94299 - RNA, 64 nt, hsa; identical to SEQ ID NO: 81194

SEQ ID NO: 94300 - RNA, 64 nt, hsa; identical to SEQ ID NO: 81195

SEQ ID NO: 94301 - RNA, 64 nt, hsa; identical to SEQ ID NO: 81196

SEQ ID NO: 94302 - RNA, 64 nt, hsa; identical to SEQ ID NO: 81197

SEQ ID NO: 94303 - RNA, 64 nt, hsa; identical to SEQ ID NO: 81198

SEQ ID NO: 94304 - RNA, 64 nt, hsa; identical to SEQ ID NO: 81199

SEQ ID NO: 94305 - RNA, 64 nt, hsa; identical to SEQ ID NO: 81200

SEQ ID NO: 94306 - RNA, 64 nt, hsa; identical to SEQ ID NO: 81201

SEQ ID NO: 94307 - RNA, 64 nt, hsa; identical to SEQ ID NO: 81202

SEQ ID NO: 94308 - RNA, 64 nt, hsa; identical to SEQ ID NO: 81203

SEQ ID NO: 94309 - RNA, 64 nt, hsa; identical to SEQ ID NO: 81204

SEQ ID NO: 94310 - RNA, 64 nt, hsa; identical to SEQ ID NO: 81205

SEQ ID NO: 94311 - RNA, 64 nt, hsa; identical to SEQ ID NO: 81206

SEQ ID NO: 94312 - RNA, 64 nt, hsa; identical to SEQ ID NO: 81207

SEQ ID NO: 94313 - RNA, 64 nt, hsa; identical to SEQ ID NO: 81208

SEQ ID NO: 94314 - RNA, 64 nt, hsa; identical to SEQ ID NO: 81209

SEQ ID NO: 94315 - RNA, 64 nt, hsa; identical to SEQ ID NO: 81210

SEQ ID NO: 94316 - RNA, 64 nt, hsa; identical to SEQ ID NO: 81211

SEQ ID NO: 94317 - RNA, 64 nt, hsa; identical to SEQ ID NO: 81212

SEQ ID NO: 94318 - RNA, 64 nt, hsa; identical to SEQ ID NO: 81213

SEQ ID NO: 94319 - RNA, 64 nt, hsa; identical to SEQ ID NO: 81214

SEQ ID NO: 94320 - RNA, 64 nt, hsa; identical to SEQ ID NO: 81215

SEQ ID NO: 94321 - RNA, 64 nt, hsa; identical to SEQ ID NO: 81216

SEQ ID NO: 94322 - RNA, 64 nt, hsa; identical to SEQ ID NO: 81217

SEQ ID NO: 94323 - RNA, 64 nt, hsa; identical to SEQ ID NO: 81218

SEQ ID NO: 94324 - RNA, 64 nt, hsa; identical to SEQ ID NO: 81219

SEQ ID NO: 94325 - RNA, 64 nt, hsa; identical to SEQ ID NO: 81220

SEQ ID NO: 94326 - RNA, 64 nt, hsa; identical to SEQ ID NO: 81221

SEQ ID NO: 94327 - RNA, 64 nt, hsa; identical to SEQ ID NO: 81222

SEQ ID NO: 94328 - RNA, 64 nt, hsa; identical to SEQ ID NO: 81223

SEQ ID NO: 94329 - RNA, 64 nt, hsa; identical to SEQ ID NO: 81224

SEQ ID NO: 94330 - RNA, 64 nt, hsa; identical to SEQ ID NO: 81225

SEQ ID NO: 94331 - RNA, 64 nt, hsa; identical to SEQ ID NO: 81226

SEQ ID NO: 94332 - RNA, 64 nt, hsa; identical to SEQ ID NO: 81227

SEQ ID NO: 94333 - RNA, 64 nt, hsa; identical to SEQ ID NO: 81228

SEQ ID NO: 94334 - RNA, 64 nt, hsa; identical to SEQ ID NO: 81229

SEQ ID NO: 94335 - RNA, 64 nt, hsa; identical to SEQ ID NO: 81230

SEQ ID NO: 94336 - RNA, 64 nt, hsa; identical to SEQ ID NO: 81231

SEQ ID NO: 94337 - RNA, 64 nt, hsa; identical to SEQ ID NO: 81232

SEQ ID NO: 94338 - RNA, 64 nt, hsa; identical to SEQ ID NO: 81233

SEQ ID NO: 94339 - RNA, 64 nt, hsa; identical to SEQ ID NO: 81234

SEQ ID NO: 94340 - RNA, 64 nt, hsa; identical to SEQ ID NO: 81235

SEQ ID NO: 94341 - RNA, 64 nt, hsa; identical to SEQ ID NO: 81236

SEQ ID NO: 94342 - RNA, 64 nt, hsa; identical to SEQ ID NO: 81237

SEQ ID NO: 94343 - RNA, 64 nt, hsa; identical to SEQ ID NO: 81238

SEQ ID NO: 94344 - RNA, 64 nt, hsa; identical to SEQ ID NO: 81239

SEQ ID NO: 94345 - RNA, 64 nt, hsa; identical to SEQ ID NO: 81240

SEQ ID NO: 94346 - RNA, 64 nt, hsa; identical to SEQ ID NO: 81241

SEQ ID NO: 94347 - RNA, 64 nt, hsa; identical to SEQ ID NO: 81242

SEQ ID NO: 94348 - RNA, 64 nt, hsa; identical to SEQ ID NO: 81243

SEQ ID NO: 94349 - RNA, 64 nt, hsa; identical to SEQ ID NO: 81244

SEQ ID NO: 94350 - RNA, 64 nt, hsa; identical to SEQ ID NO: 81245

SEQ ID NO: 94351 - RNA, 64 nt, hsa; identical to SEQ ID NO: 81246

SEQ ID NO: 94352 - RNA, 64 nt, hsa; identical to SEQ ID NO: 81247

SEQ ID NO: 94353 - RNA, 64 nt, hsa; identical to SEQ ID NO: 81248

SEQ ID NO: 94354 - RNA, 64 nt, hsa; identical to SEQ ID NO: 81249

SEQ ID NO: 94355 - RNA, 64 nt, hsa; identical to SEQ ID NO: 81250

SEQ ID NO: 94356 - RNA, 64 nt, hsa; identical to SEQ ID NO: 81251

SEQ ID NO: 94357 - RNA, 64 nt, hsa; identical to SEQ ID NO: 81252

SEQ ID NO: 94358 - RNA, 64 nt, hsa; identical to SEQ ID NO: 81253

SEQ ID NO: 94359 - RNA, 64 nt, hsa; identical to SEQ ID NO: 81254

SEQ ID NO: 94360 - RNA, 64 nt, hsa; identical to SEQ ID NO: 81255

SEQ ID NO: 94361 - RNA, 64 nt, hsa; identical to SEQ ID NO: 81256

SEQ ID NO: 94362 - RNA, 64 nt, hsa; identical to SEQ ID NO: 81257

SEQ ID NO: 94363 - RNA, 64 nt, hsa; identical to SEQ ID NO: 81258

SEQ ID NO: 94364 - RNA, 64 nt, hsa; identical to SEQ ID NO: 81259

SEQ ID NO: 94365 - RNA, 64 nt, hsa; identical to SEQ ID NO: 81260

SEQ ID NO: 94366 - RNA, 64 nt, hsa; identical to SEQ ID NO: 81261

SEQ ID NO: 94367 - RNA, 64 nt, hsa; identical to SEQ ID NO: 81262

SEQ ID NO: 94368 - RNA, 64 nt, hsa; identical to SEQ ID NO: 81263

SEQ ID NO: 94369 - RNA, 64 nt, hsa; identical to SEQ ID NO: 81264

SEQ ID NO: 94370 - RNA, 64 nt, hsa; identical to SEQ ID NO: 81265

SEQ ID NO: 94371 - RNA, 64 nt, hsa; identical to SEQ ID NO: 81266

SEQ ID NO: 94372 - RNA, 64 nt, hsa; identical to SEQ ID NO: 81267

SEQ ID NO: 94373 - RNA, 64 nt, hsa; identical to SEQ ID NO: 81268

SEQ ID NO: 94374 - RNA, 64 nt, hsa; identical to SEQ ID NO: 81269

SEQ ID NO: 94375 - RNA, 64 nt, hsa; identical to SEQ ID NO: 81270

SEQ ID NO: 94376 - RNA, 64 nt, hsa; identical to SEQ ID NO: 81271

SEQ ID NO: 94377 - RNA, 64 nt, hsa; identical to SEQ ID NO: 81272

SEQ ID NO: 94378 - RNA, 64 nt, hsa; identical to SEQ ID NO: 81273

SEQ ID NO: 94379 - RNA, 64 nt, hsa; identical to SEQ ID NO: 81274

SEQ ID NO: 94380 - RNA, 64 nt, hsa; identical to SEQ ID NO: 81275

SEQ ID NO: 94381 - RNA, 64 nt, hsa; identical to SEQ ID NO: 81276

SEQ ID NO: 94382 - RNA, 64 nt, hsa; identical to SEQ ID NO: 81277

SEQ ID NO: 94383 - RNA, 64 nt, hsa; identical to SEQ ID NO: 81278

SEQ ID NO: 94384 - RNA, 64 nt, hsa; identical to SEQ ID NO: 81279

SEQ ID NO: 94385 - RNA, 64 nt, hsa; identical to SEQ ID NO: 81280

SEQ ID NO: 94386 - RNA, 64 nt, hsa; identical to SEQ ID NO: 81281

SEQ ID NO: 94387 - RNA, 51 nt, hsa; identical to SEQ ID NO: 81282

SEQ ID NO: 94388 - RNA, 64 nt, hsa; identical to SEQ ID NO: 81283

SEQ ID NO: 94389 - RNA, 64 nt, hsa; identical to SEQ ID NO: 81284

SEQ ID NO: 94390 - RNA, 64 nt, hsa; identical to SEQ ID NO: 81285

SEQ ID NO: 94391 - RNA, 64 nt, hsa; identical to SEQ ID NO: 81286

SEQ ID NO: 94392 - RNA, 64 nt, hsa; identical to SEQ ID NO: 81287

SEQ ID NO: 94393 - RNA, 64 nt, hsa; identical to SEQ ID NO: 81288

SEQ ID NO: 94394 - RNA, 64 nt, hsa; identical to SEQ ID NO: 81289

SEQ ID NO: 94395 - RNA, 64 nt, hsa; identical to SEQ ID NO: 81290

SEQ ID NO: 94396 - RNA, 64 nt, hsa; identical to SEQ ID NO: 81291

SEQ ID NO: 94397 - RNA, 64 nt, hsa; identical to SEQ ID NO: 81292

SEQ ID NO: 94398 - RNA, 64 nt, hsa; identical to SEQ ID NO: 81293

SEQ ID NO: 94399 - RNA, 64 nt, hsa; identical to SEQ ID NO: 81294

SEQ ID NO: 94400 - RNA, 64 nt, hsa; identical to SEQ ID NO: 81295

SEQ ID NO: 94401 - RNA, 64 nt, hsa; identical to SEQ ID NO: 81296

SEQ ID NO: 94402 - RNA, 64 nt, hsa; identical to SEQ ID NO: 81297

SEQ ID NO: 94403 - RNA, 64 nt, hsa; identical to SEQ ID NO: 81298

SEQ ID NO: 94404 - RNA, 64 nt, hsa; identical to SEQ ID NO: 81299

SEQ ID NO: 94405 - RNA, 64 nt, hsa; identical to SEQ ID NO: 81300

SEQ ID NO: 94406 - RNA, 64 nt, hsa; identical to SEQ ID NO: 81301

SEQ ID NO: 94407 - RNA, 64 nt, hsa; identical to SEQ ID NO: 81302

SEQ ID NO: 94408 - RNA, 64 nt, hsa; identical to SEQ ID NO: 81303

SEQ ID NO: 94409 - RNA, 64 nt, hsa; identical to SEQ ID NO: 81304

SEQ ID NO: 94410 - RNA, 64 nt, hsa; identical to SEQ ID NO: 81305

SEQ ID NO: 94411 - RNA, 64 nt, hsa; identical to SEQ ID NO: 81306

SEQ ID NO: 94412 - RNA, 64 nt, hsa; identical to SEQ ID NO: 81307

SEQ ID NO: 94413 - RNA, 64 nt, hsa; identical to SEQ ID NO: 81308

SEQ ID NO: 94414 - RNA, 64 nt, hsa; identical to SEQ ID NO: 81309

SEQ ID NO: 94415 - RNA, 64 nt, hsa; identical to SEQ ID NO: 81310

SEQ ID NO: 94416 - RNA, 64 nt, hsa; identical to SEQ ID NO: 81311

SEQ ID NO: 94417 - RNA, 64 nt, hsa; identical to SEQ ID NO: 81312

SEQ ID NO: 94418 - RNA, 64 nt, hsa; identical to SEQ ID NO: 81313

SEQ ID NO: 94419 - RNA, 64 nt, hsa; identical to SEQ ID NO: 81314

SEQ ID NO: 94420 - RNA, 64 nt, hsa; identical to SEQ ID NO: 81315

SEQ ID NO: 94421 - RNA, 64 nt, hsa; identical to SEQ ID NO: 81316

SEQ ID NO: 94422 - RNA, 64 nt, hsa; identical to SEQ ID NO: 81317

SEQ ID NO: 94423 - RNA, 64 nt, hsa; identical to SEQ ID NO: 81303

SEQ ID NO: 94424 - RNA, 64 nt, hsa; identical to SEQ ID NO: 81319

SEQ ID NO: 94425 - RNA, 64 nt, hsa; identical to SEQ ID NO: 81320

SEQ ID NO: 94426 - RNA, 64 nt, hsa; identical to SEQ ID NO: 81321

SEQ ID NO: 94427 - RNA, 64 nt, hsa; identical to SEQ ID NO: 81322

SEQ ID NO: 94428 - RNA, 64 nt, hsa; identical to SEQ ID NO: 81323

SEQ ID NO: 94429 - RNA, 64 nt, hsa; identical to SEQ ID NO: 81324

SEQ ID NO: 94430 - RNA, 64 nt, hsa; identical to SEQ ID NO: 81325

SEQ ID NO: 94431 - RNA, 64 nt, hsa; identical to SEQ ID NO: 81326

SEQ ID NO: 94432 - RNA, 64 nt, hsa; identical to SEQ ID NO: 81327

SEQ ID NO: 94433 - RNA, 64 nt, hsa; identical to SEQ ID NO: 81328

SEQ ID NO: 94434 - RNA, 64 nt, hsa; identical to SEQ ID NO: 81329

SEQ ID NO: 94435 - RNA, 64 nt, hsa; identical to SEQ ID NO: 81330

SEQ ID NO: 94436 - RNA, 64 nt, hsa; identical to SEQ ID NO: 81331

SEQ ID NO: 94437 - RNA, 64 nt, hsa; identical to SEQ ID NO: 81332

SEQ ID NO: 94438 - RNA, 64 nt, hsa; identical to SEQ ID NO: 81333

SEQ ID NO: 94439 - RNA, 64 nt, hsa; identical to SEQ ID NO: 81334

SEQ ID NO: 94440 - RNA, 64 nt, hsa; identical to SEQ ID NO: 81335

SEQ ID NO: 94441 - RNA, 64 nt, hsa; identical to SEQ ID NO: 81336

SEQ ID NO: 94442 - RNA, 64 nt, hsa; identical to SEQ ID NO: 81337

SEQ ID NO: 94443 - RNA, 64 nt, hsa; identical to SEQ ID NO: 81338

SEQ ID NO: 94444 - RNA, 64 nt, hsa; identical to SEQ ID NO: 81339

SEQ ID NO: 94445 - RNA, 64 nt, hsa; identical to SEQ ID NO: 81340

SEQ ID NO: 94446 - RNA, 64 nt, hsa; identical to SEQ ID NO: 81341

SEQ ID NO: 94447 - RNA, 64 nt, hsa; identical to SEQ ID NO: 81342

SEQ ID NO: 94448 - RNA, 64 nt, hsa; identical to SEQ ID NO: 81343

SEQ ID NO: 94449 - RNA, 64 nt, hsa; identical to SEQ ID NO: 81344

SEQ ID NO: 94450 - RNA, 64 nt, hsa; identical to SEQ ID NO: 81345

SEQ ID NO: 94451 - RNA, 64 nt, hsa; identical to SEQ ID NO: 81346

SEQ ID NO: 94452 - RNA, 64 nt, hsa; identical to SEQ ID NO: 81347

SEQ ID NO: 94453 - RNA, 64 nt, hsa; identical to SEQ ID NO: 81348

SEQ ID NO: 94454 - RNA, 64 nt, hsa; identical to SEQ ID NO: 81349

SEQ ID NO: 94455 - RNA, 64 nt, hsa; identical to SEQ ID NO: 81350

SEQ ID NO: 94456 - RNA, 64 nt, hsa; identical to SEQ ID NO: 81351

SEQ ID NO: 94457 - RNA, 64 nt, hsa; identical to SEQ ID NO: 81352

SEQ ID NO: 94458 - RNA, 64 nt, hsa; identical to SEQ ID NO: 81353

SEQ ID NO: 94459 - RNA, 64 nt, hsa; identical to SEQ ID NO: 81354

SEQ ID NO: 94460 - RNA, 64 nt, hsa; identical to SEQ ID NO: 81355

SEQ ID NO: 94461 - RNA, 64 nt, hsa; identical to SEQ ID NO: 81356

SEQ ID NO: 94462 - RNA, 64 nt, hsa; identical to SEQ ID NO: 81357

SEQ ID NO: 94463 - RNA, 64 nt, hsa; identical to SEQ ID NO: 81358

SEQ ID NO: 94464 - RNA, 64 nt, hsa; identical to SEQ ID NO: 81359

SEQ ID NO: 94465 - RNA, 64 nt, hsa; identical to SEQ ID NO: 81360

SEQ ID NO: 94466 - RNA, 64 nt, hsa; identical to SEQ ID NO: 81361

SEQ ID NO: 94467 - RNA, 64 nt, hsa; identical to SEQ ID NO: 81362

SEQ ID NO: 94468 - RNA, 64 nt, hsa; identical to SEQ ID NO: 81363

SEQ ID NO: 94469 - RNA, 64 nt, hsa; identical to SEQ ID NO: 81364

SEQ ID NO: 94470 - RNA, 64 nt, hsa; identical to SEQ ID NO: 81365

SEQ ID NO: 94471 - RNA, 64 nt, hsa; identical to SEQ ID NO: 81366

SEQ ID NO: 94472 - RNA, 64 nt, hsa; identical to SEQ ID NO: 81367

SEQ ID NO: 94473 - RNA, 64 nt, hsa; identical to SEQ ID NO: 81368

SEQ ID NO: 94474 - RNA, 64 nt, hsa; identical to SEQ ID NO: 81369

SEQ ID NO: 94475 - RNA, 64 nt, hsa; identical to SEQ ID NO: 81370

SEQ ID NO: 94476 - RNA, 64 nt, hsa; identical to SEQ ID NO: 81371

SEQ ID NO: 94477 - RNA, 64 nt, hsa; identical to SEQ ID NO: 81372

SEQ ID NO: 94478 - RNA, 64 nt, hsa; identical to SEQ ID NO: 81373

SEQ ID NO: 94479 - RNA, 64 nt, hsa; identical to SEQ ID NO: 81374

SEQ ID NO: 94480 - RNA, 64 nt, hsa; identical to SEQ ID NO: 81375

SEQ ID NO: 94481 - RNA, 64 nt, hsa; identical to SEQ ID NO: 81376

SEQ ID NO: 94482 - RNA, 64 nt, hsa; identical to SEQ ID NO: 81377

SEQ ID NO: 94483 - RNA, 64 nt, hsa; identical to SEQ ID NO: 81378

SEQ ID NO: 94484 - RNA, 64 nt, hsa; identical to SEQ ID NO: 81379

SEQ ID NO: 94485 - RNA, 64 nt, hsa; identical to SEQ ID NO: 81380

SEQ ID NO: 94486 - RNA, 64 nt, hsa; identical to SEQ ID NO: 81381

SEQ ID NO: 94487 - RNA, 64 nt, hsa; identical to SEQ ID NO: 81382

SEQ ID NO: 94488 - RNA, 64 nt, hsa; identical to SEQ ID NO: 81383

SEQ ID NO: 94489 - RNA, 64 nt, hsa; identical to SEQ ID NO: 81384

SEQ ID NO: 94490 - RNA, 64 nt, hsa; identical to SEQ ID NO: 81385

SEQ ID NO: 94491 - RNA, 64 nt, hsa; identical to SEQ ID NO: 81386

SEQ ID NO: 94492 - RNA, 64 nt, hsa; identical to SEQ ID NO: 81387

SEQ ID NO: 94493 - RNA, 64 nt, hsa; identical to SEQ ID NO: 81388

SEQ ID NO: 94494 - RNA, 64 nt, hsa; identical to SEQ ID NO: 81389

SEQ ID NO: 94495 - RNA, 64 nt, hsa; identical to SEQ ID NO: 81390

SEQ ID NO: 94496 - RNA, 64 nt, hsa; identical to SEQ ID NO: 81391

SEQ ID NO: 94497 - RNA, 64 nt, hsa; identical to SEQ ID NO: 81392

SEQ ID NO: 94498 - RNA, 64 nt, hsa; identical to SEQ ID NO: 81393

SEQ ID NO: 94499 - RNA, 64 nt, hsa; identical to SEQ ID NO: 81394

SEQ ID NO: 94500 - RNA, 64 nt, hsa; identical to SEQ ID NO: 81395

SEQ ID NO: 94501 - RNA, 64 nt, hsa; identical to SEQ ID NO: 81396

SEQ ID NO: 94502 - RNA, 64 nt, hsa; identical to SEQ ID NO: 81397

SEQ ID NO: 94503 - RNA, 64 nt, hsa; identical to SEQ ID NO: 81398

SEQ ID NO: 94504 - RNA, 64 nt, hsa; identical to SEQ ID NO: 81399

SEQ ID NO: 94505 - RNA, 64 nt, hsa; identical to SEQ ID NO: 81400

SEQ ID NO: 94506 - RNA, 64 nt, hsa; identical to SEQ ID NO: 81401

SEQ ID NO: 94507 - RNA, 64 nt, hsa; identical to SEQ ID NO: 81402

SEQ ID NO: 94508 - RNA, 64 nt, hsa; identical to SEQ ID NO: 81403

SEQ ID NO: 94509 - RNA, 64 nt, hsa; identical to SEQ ID NO: 81404

SEQ ID NO: 94510 - RNA, 64 nt, hsa; identical to SEQ ID NO: 81405

SEQ ID NO: 94511 - RNA, 64 nt, hsa; identical to SEQ ID NO: 81406

SEQ ID NO: 94512 - RNA, 64 nt, hsa; identical to SEQ ID NO: 81407

SEQ ID NO: 94513 - RNA, 64 nt, hsa; identical to SEQ ID NO: 81408

SEQ ID NO: 94514 - RNA, 64 nt, hsa; identical to SEQ ID NO: 81409

SEQ ID NO: 94515 - RNA, 64 nt, hsa; identical to SEQ ID NO: 81410

SEQ ID NO: 94516 - RNA, 64 nt, hsa; identical to SEQ ID NO: 81411

SEQ ID NO: 94517 - RNA, 64 nt, hsa; identical to SEQ ID NO: 81412

SEQ ID NO: 94518 - RNA, 64 nt, hsa; identical to SEQ ID NO: 81413

SEQ ID NO: 94519 - RNA, 64 nt, hsa; identical to SEQ ID NO: 81414

SEQ ID NO: 94520 - RNA, 64 nt, hsa; identical to SEQ ID NO: 81415

SEQ ID NO: 94521 - RNA, 64 nt, hsa; identical to SEQ ID NO: 81416

SEQ ID NO: 94522 - RNA, 64 nt, hsa; identical to SEQ ID NO: 81417

SEQ ID NO: 94523 - RNA, 64 nt, hsa; identical to SEQ ID NO: 81418

SEQ ID NO: 94524 - RNA, 64 nt, hsa; identical to SEQ ID NO: 81419

SEQ ID NO: 94525 - RNA, 64 nt, hsa; identical to SEQ ID NO: 81420

SEQ ID NO: 94526 - RNA, 64 nt, hsa; identical to SEQ ID NO: 81421

SEQ ID NO: 94527 - RNA, 64 nt, hsa; identical to SEQ ID NO: 81422

SEQ ID NO: 94528 - RNA, 64 nt, hsa; identical to SEQ ID NO: 81423

SEQ ID NO: 94529 - RNA, 64 nt, hsa; identical to SEQ ID NO: 81424

SEQ ID NO: 94530 - RNA, 64 nt, hsa; identical to SEQ ID NO: 81425

SEQ ID NO: 94531 - RNA, 64 nt, hsa; identical to SEQ ID NO: 81426

SEQ ID NO: 94532 - RNA, 64 nt, hsa; identical to SEQ ID NO: 81427

SEQ ID NO: 94533 - RNA, 64 nt, hsa; identical to SEQ ID NO: 81428

SEQ ID NO: 94534 - RNA, 64 nt, hsa; identical to SEQ ID NO: 81429

SEQ ID NO: 94535 - RNA, 64 nt, hsa; identical to SEQ ID NO: 81430

SEQ ID NO: 94536 - RNA, 64 nt, hsa; identical to SEQ ID NO: 81431

SEQ ID NO: 94537 - RNA, 64 nt, hsa; identical to SEQ ID NO: 81432

SEQ ID NO: 94538 - RNA, 64 nt, hsa; identical to SEQ ID NO: 81433

SEQ ID NO: 94539 - RNA, 64 nt, hsa; identical to SEQ ID NO: 81434

SEQ ID NO: 94540 - RNA, 64 nt, hsa; identical to SEQ ID NO: 81435

SEQ ID NO: 94541 - RNA, 64 nt, hsa; identical to SEQ ID NO: 81436

SEQ ID NO: 94542 - RNA, 64 nt, hsa; identical to SEQ ID NO: 81437

SEQ ID NO: 94543 - RNA, 64 nt, hsa; identical to SEQ ID NO: 81438

SEQ ID NO: 94544 - RNA, 64 nt, hsa; identical to SEQ ID NO: 81439

SEQ ID NO: 94545 - RNA, 64 nt, hsa; identical to SEQ ID NO: 81440

SEQ ID NO: 94546 - RNA, 64 nt, hsa; identical to SEQ ID NO: 81441

SEQ ID NO: 94547 - RNA, 64 nt, hsa; identical to SEQ ID NO: 81442

SEQ ID NO: 94548 - RNA, 64 nt, hsa; identical to SEQ ID NO: 81443

SEQ ID NO: 94549 - RNA, 64 nt, hsa; identical to SEQ ID NO: 81444

SEQ ID NO: 94550 - RNA, 64 nt, hsa; identical to SEQ ID NO: 81445

SEQ ID NO: 94551 - RNA, 64 nt, hsa; identical to SEQ ID NO: 81446

SEQ ID NO: 94552 - RNA, 64 nt, hsa; identical to SEQ ID NO: 81447

SEQ ID NO: 94553 - RNA, 64 nt, hsa; identical to SEQ ID NO: 81448

SEQ ID NO: 94554 - RNA, 64 nt, hsa; identical to SEQ ID NO: 81449

SEQ ID NO: 94555 - RNA, 64 nt, hsa; identical to SEQ ID NO: 81450

SEQ ID NO: 94556 - RNA, 64 nt, hsa; identical to SEQ ID NO: 81451

SEQ ID NO: 94557 - RNA, 64 nt, hsa; identical to SEQ ID NO: 81452

SEQ ID NO: 94558 - RNA, 64 nt, hsa; identical to SEQ ID NO: 81453

SEQ ID NO: 94559 - RNA, 64 nt, hsa; identical to SEQ ID NO: 81454

SEQ ID NO: 94560 - RNA, 64 nt, hsa; identical to SEQ ID NO: 81455

SEQ ID NO: 94561 - RNA, 64 nt, hsa; identical to SEQ ID NO: 81456

SEQ ID NO: 94562 - RNA, 64 nt, hsa; identical to SEQ ID NO: 81457

SEQ ID NO: 94563 - RNA, 64 nt, hsa; identical to SEQ ID NO: 81458

SEQ ID NO: 94564 - RNA, 64 nt, hsa; identical to SEQ ID NO: 81459

SEQ ID NO: 94565 - RNA, 64 nt, hsa; identical to SEQ ID NO: 81460

SEQ ID NO: 94566 - RNA, 64 nt, hsa; identical to SEQ ID NO: 81461

SEQ ID NO: 94567 - RNA, 64 nt, hsa; identical to SEQ ID NO: 81462

SEQ ID NO: 94568 - RNA, 64 nt, hsa; identical to SEQ ID NO: 81463

SEQ ID NO: 94569 - RNA, 64 nt, hsa; identical to SEQ ID NO: 81464

SEQ ID NO: 94570 - RNA, 64 nt, hsa; identical to SEQ ID NO: 81465

SEQ ID NO: 94571 - RNA, 64 nt, hsa; identical to SEQ ID NO: 81466

SEQ ID NO: 94572 - RNA, 64 nt, hsa; identical to SEQ ID NO: 81467

SEQ ID NO: 94573 - RNA, 64 nt, hsa; identical to SEQ ID NO: 81468

SEQ ID NO: 94574 - RNA, 64 nt, hsa; identical to SEQ ID NO: 81468

SEQ ID NO: 94575 - RNA, 64 nt, hsa; identical to SEQ ID NO: 81470

SEQ ID NO: 94576 - RNA, 64 nt, hsa; identical to SEQ ID NO: 81471

SEQ ID NO: 94577 - RNA, 64 nt, hsa; identical to SEQ ID NO: 81472

SEQ ID NO: 94578 - RNA, 64 nt, hsa; identical to SEQ ID NO: 81473

SEQ ID NO: 94579 - RNA, 64 nt, hsa; identical to SEQ ID NO: 81474

SEQ ID NO: 94580 - RNA, 64 nt, hsa; identical to SEQ ID NO: 81475

SEQ ID NO: 94581 - RNA, 64 nt, hsa; identical to SEQ ID NO: 81476

SEQ ID NO: 94582 - RNA, 64 nt, hsa; identical to SEQ ID NO: 81477

SEQ ID NO: 94583 - RNA, 64 nt, hsa; identical to SEQ ID NO: 81478

SEQ ID NO: 94584 - RNA, 64 nt, hsa; identical to SEQ ID NO: 81479

SEQ ID NO: 94585 - RNA, 64 nt, hsa; identical to SEQ ID NO: 81480

SEQ ID NO: 94586 - RNA, 64 nt, hsa; identical to SEQ ID NO: 81481

SEQ ID NO: 94587 - RNA, 64 nt, hsa; identical to SEQ ID NO: 81482

SEQ ID NO: 94588 - RNA, 64 nt, hsa; identical to SEQ ID NO: 81483

SEQ ID NO: 94589 - RNA, 64 nt, hsa; identical to SEQ ID NO: 81484

SEQ ID NO: 94590 - RNA, 64 nt, hsa; identical to SEQ ID NO: 81485

SEQ ID NO: 94591 - RNA, 64 nt, hsa; identical to SEQ ID NO: 81486

SEQ ID NO: 94592 - RNA, 64 nt, hsa; identical to SEQ ID NO: 81487

SEQ ID NO: 94593 - RNA, 64 nt, hsa; identical to SEQ ID NO: 81488

SEQ ID NO: 94594 - RNA, 64 nt, hsa; identical to SEQ ID NO: 81489

SEQ ID NO: 94595 - RNA, 64 nt, hsa; identical to SEQ ID NO: 81490

SEQ ID NO: 94596 - RNA, 64 nt, hsa; identical to SEQ ID NO: 81491

SEQ ID NO: 94597 - RNA, 64 nt, hsa; identical to SEQ ID NO: 81492

SEQ ID NO: 94598 - RNA, 64 nt, hsa; identical to SEQ ID NO: 81493

SEQ ID NO: 94599 - RNA, 64 nt, hsa; identical to SEQ ID NO: 81494

SEQ ID NO: 94600 - RNA, 64 nt, hsa; identical to SEQ ID NO: 81495

SEQ ID NO: 94601 - RNA, 64 nt, hsa; identical to SEQ ID NO: 81496

SEQ ID NO: 94602 - RNA, 64 nt, hsa; identical to SEQ ID NO: 81497

SEQ ID NO: 94603 - RNA, 64 nt, hsa; identical to SEQ ID NO: 81498

SEQ ID NO: 94604 - RNA, 64 nt, hsa; identical to SEQ ID NO: 81499

SEQ ID NO: 94605 - RNA, 64 nt, hsa; identical to SEQ ID NO: 81500

SEQ ID NO: 94606 - RNA, 64 nt, hsa; identical to SEQ ID NO: 81501

SEQ ID NO: 94607 - RNA, 64 nt, hsa; identical to SEQ ID NO: 81502

SEQ ID NO: 94608 - RNA, 64 nt, hsa; identical to SEQ ID NO: 81503

SEQ ID NO: 94609 - RNA, 64 nt, hsa; identical to SEQ ID NO: 81504

SEQ ID NO: 94610 - RNA, 64 nt, hsa; identical to SEQ ID NO: 81505

SEQ ID NO: 94611 - RNA, 64 nt, hsa; identical to SEQ ID NO: 81506

SEQ ID NO: 94612 - RNA, 64 nt, hsa; identical to SEQ ID NO: 81507

SEQ ID NO: 94613 - RNA, 64 nt, hsa; identical to SEQ ID NO: 81508

SEQ ID NO: 94614 - RNA, 64 nt, hsa; identical to SEQ ID NO: 81509

SEQ ID NO: 94615 - RNA, 64 nt, hsa; identical to SEQ ID NO: 81510

SEQ ID NO: 94616 - RNA, 64 nt, hsa; identical to SEQ ID NO: 81511

SEQ ID NO: 94617 - RNA, 64 nt, hsa; identical to SEQ ID NO: 81512

SEQ ID NO: 94618 - RNA, 64 nt, hsa; identical to SEQ ID NO: 81513

SEQ ID NO: 94619 - RNA, 64 nt, hsa; identical to SEQ ID NO: 81514

SEQ ID NO: 94620 - RNA, 64 nt, hsa; identical to SEQ ID NO: 81515

SEQ ID NO: 94621 - RNA, 64 nt, hsa; identical to SEQ ID NO: 81516

SEQ ID NO: 94622 - RNA, 64 nt, hsa; identical to SEQ ID NO: 81517

SEQ ID NO: 94623 - RNA, 64 nt, hsa; identical to SEQ ID NO: 81518

SEQ ID NO: 94624 - RNA, 64 nt, hsa; identical to SEQ ID NO: 81519

SEQ ID NO: 94625 - RNA, 64 nt, hsa; identical to SEQ ID NO: 81520

SEQ ID NO: 94626 - RNA, 64 nt, hsa; identical to SEQ ID NO: 81521

SEQ ID NO: 94627 - RNA, 64 nt, hsa; identical to SEQ ID NO: 81522

SEQ ID NO: 94628 - RNA, 64 nt, hsa; identical to SEQ ID NO: 81523

SEQ ID NO: 94629 - RNA, 64 nt, hsa; identical to SEQ ID NO: 81524

SEQ ID NO: 94630 - RNA, 64 nt, hsa; identical to SEQ ID NO: 81525

SEQ ID NO: 94631 - RNA, 64 nt, hsa; identical to SEQ ID NO: 81526

SEQ ID NO: 94632 - RNA, 64 nt, hsa; identical to SEQ ID NO: 81527

SEQ ID NO: 94633 - RNA, 64 nt, hsa; identical to SEQ ID NO: 81528

SEQ ID NO: 94634 - RNA, 64 nt, hsa; identical to SEQ ID NO: 81529

SEQ ID NO: 94635 - RNA, 64 nt, hsa; identical to SEQ ID NO: 81530

SEQ ID NO: 94636 - RNA, 64 nt, hsa; identical to SEQ ID NO: 81531

SEQ ID NO: 94637 - RNA, 64 nt, hsa; identical to SEQ ID NO: 81532

SEQ ID NO: 94638 - RNA, 64 nt, hsa; identical to SEQ ID NO: 81533

SEQ ID NO: 94639 - RNA, 64 nt, hsa; identical to SEQ ID NO: 81534

SEQ ID NO: 94640 - RNA, 64 nt, hsa; identical to SEQ ID NO: 81535

SEQ ID NO: 94641 - RNA, 64 nt, hsa; identical to SEQ ID NO: 81536

SEQ ID NO: 94642 - RNA, 64 nt, hsa; identical to SEQ ID NO: 81537

SEQ ID NO: 94643 - RNA, 64 nt, hsa; identical to SEQ ID NO: 81538

SEQ ID NO: 94644 - RNA, 64 nt, hsa; identical to SEQ ID NO: 81539

SEQ ID NO: 94645 - RNA, 64 nt, hsa; identical to SEQ ID NO: 81540

SEQ ID NO: 94646 - RNA, 64 nt, hsa; identical to SEQ ID NO: 81541

SEQ ID NO: 94647 - RNA, 64 nt, hsa; identical to SEQ ID NO: 81542

SEQ ID NO: 94648 - RNA, 64 nt, hsa; identical to SEQ ID NO: 81543

SEQ ID NO: 94649 - RNA, 64 nt, hsa; identical to SEQ ID NO: 81544

SEQ ID NO: 94650 - RNA, 64 nt, hsa; identical to SEQ ID NO: 81545

SEQ ID NO: 94651 - RNA, 64 nt, hsa; identical to SEQ ID NO: 81546

SEQ ID NO: 94652 - RNA, 64 nt, hsa; identical to SEQ ID NO: 81547

SEQ ID NO: 94653 - RNA, 64 nt, hsa; identical to SEQ ID NO: 81548

SEQ ID NO: 94654 - RNA, 64 nt, hsa; identical to SEQ ID NO: 81549

SEQ ID NO: 94655 - RNA, 64 nt, hsa; identical to SEQ ID NO: 81550

SEQ ID NO: 94656 - RNA, 64 nt, hsa; identical to SEQ ID NO: 81551

SEQ ID NO: 94657 - RNA, 64 nt, hsa; identical to SEQ ID NO: 81552

SEQ ID NO: 94658 - RNA, 64 nt, hsa; identical to SEQ ID NO: 81553

SEQ ID NO: 94659 - RNA, 64 nt, hsa; identical to SEQ ID NO: 81554

SEQ ID NO: 94660 - RNA, 64 nt, hsa; identical to SEQ ID NO: 81555

SEQ ID NO: 94661 - RNA, 64 nt, hsa; identical to SEQ ID NO: 81556

SEQ ID NO: 94662 - RNA, 64 nt, hsa; identical to SEQ ID NO: 81557

SEQ ID NO: 94663 - RNA, 60 nt, hsa; identical to SEQ ID NO: 81558

SEQ ID NO: 94664 - RNA, 64 nt, hsa; identical to SEQ ID NO: 81559

SEQ ID NO: 94665 - RNA, 64 nt, hsa; identical to SEQ ID NO: 81560

SEQ ID NO: 94666 - RNA, 64 nt, hsa; identical to SEQ ID NO: 81561

SEQ ID NO: 94667 - RNA, 64 nt, hsa; identical to SEQ ID NO: 81562

SEQ ID NO: 94668 - RNA, 64 nt, hsa; identical to SEQ ID NO: 81563

SEQ ID NO: 94669 - RNA, 64 nt, hsa; identical to SEQ ID NO: 81564

SEQ ID NO: 94670 - RNA, 64 nt, hsa; identical to SEQ ID NO: 81565

SEQ ID NO: 94671 - RNA, 64 nt, hsa; identical to SEQ ID NO: 81566

SEQ ID NO: 94672 - RNA, 64 nt, hsa; identical to SEQ ID NO: 81567

SEQ ID NO: 94673 - RNA, 64 nt, hsa; identical to SEQ ID NO: 81568

SEQ ID NO: 94674 - RNA, 64 nt, hsa; identical to SEQ ID NO: 81569

SEQ ID NO: 94675 - RNA, 64 nt, hsa; identical to SEQ ID NO: 81570

SEQ ID NO: 94676 - RNA, 64 nt, hsa; identical to SEQ ID NO: 81571

SEQ ID NO: 94677 - RNA, 64 nt, hsa; identical to SEQ ID NO: 81572

SEQ ID NO: 94678 - RNA, 64 nt, hsa; identical to SEQ ID NO: 81573

SEQ ID NO: 94679 - RNA, 64 nt, hsa; identical to SEQ ID NO: 81574

SEQ ID NO: 94680 - RNA, 64 nt, hsa; identical to SEQ ID NO: 81575

SEQ ID NO: 94681 - RNA, 64 nt, hsa; identical to SEQ ID NO: 81576

SEQ ID NO: 94682 - RNA, 64 nt, hsa; identical to SEQ ID NO: 81577

SEQ ID NO: 94683 - RNA, 64 nt, hsa; identical to SEQ ID NO: 81578

SEQ ID NO: 94684 - RNA, 64 nt, hsa; identical to SEQ ID NO: 81579

SEQ ID NO: 94685 - RNA, 64 nt, hsa; identical to SEQ ID NO: 81580

SEQ ID NO: 94686 - RNA, 64 nt, hsa; identical to SEQ ID NO: 81581

SEQ ID NO: 94687 - RNA, 64 nt, hsa; identical to SEQ ID NO: 81582

SEQ ID NO: 94688 - RNA, 64 nt, hsa; identical to SEQ ID NO: 81583

SEQ ID NO: 94689 - RNA, 64 nt, hsa; identical to SEQ ID NO: 81584

SEQ ID NO: 94690 - RNA, 64 nt, hsa; identical to SEQ ID NO: 81585

SEQ ID NO: 94691 - RNA, 64 nt, hsa; identical to SEQ ID NO: 81586

SEQ ID NO: 94692 - RNA, 64 nt, hsa; identical to SEQ ID NO: 81587

SEQ ID NO: 94693 - RNA, 64 nt, hsa; identical to SEQ ID NO: 81588

SEQ ID NO: 94694 - RNA, 64 nt, hsa; identical to SEQ ID NO: 81589

SEQ ID NO: 94695 - RNA, 64 nt, hsa; identical to SEQ ID NO: 81590

SEQ ID NO: 94696 - RNA, 64 nt, hsa; identical to SEQ ID NO: 81591

SEQ ID NO: 94697 - RNA, 64 nt, hsa; identical to SEQ ID NO: 81592

SEQ ID NO: 94698 - RNA, 64 nt, hsa; identical to SEQ ID NO: 81593

SEQ ID NO: 94699 - RNA, 64 nt, hsa; identical to SEQ ID NO: 81594

SEQ ID NO: 94700 - RNA, 64 nt, hsa; identical to SEQ ID NO: 81595

SEQ ID NO: 94701 - RNA, 64 nt, hsa; identical to SEQ ID NO: 81596

SEQ ID NO: 94702 - RNA, 64 nt, hsa; identical to SEQ ID NO: 81597

SEQ ID NO: 94703 - RNA, 64 nt, hsa; identical to SEQ ID NO: 81598

SEQ ID NO: 94704 - RNA, 64 nt, hsa; identical to SEQ ID NO: 81599

SEQ ID NO: 94705 - RNA, 64 nt, hsa; identical to SEQ ID NO: 81600

SEQ ID NO: 94706 - RNA, 64 nt, hsa; identical to SEQ ID NO: 81601

SEQ ID NO: 94707 - RNA, 64 nt, hsa; identical to SEQ ID NO: 81602

SEQ ID NO: 94708 - RNA, 64 nt, hsa; identical to SEQ ID NO: 81603

SEQ ID NO: 94709 - RNA, 64 nt, hsa; identical to SEQ ID NO: 81603

SEQ ID NO: 94710 - RNA, 64 nt, hsa; identical to SEQ ID NO: 81605

SEQ ID NO: 94711 - RNA, 64 nt, hsa
accauacuaccaaggaccaguccaccugaaccacacacucuaaagaaauauuuuuuaagauaac

SEQ ID NO: 94712 - RNA, 64 nt, hsa
agacuugcucauuuuucgaguuuuuaacuagacuacacucuauugaguuuaauuuuguccucua

SEQ ID NO: 94713 - RNA, 64 nt, hsa
caaauccuucaagccaaccuauacuaaaaauuaguuccauaaucacaaauggcucuuuugugua

SEQ ID NO: 94714 - RNA, 64 nt, hsa
cuuauucauaguuaauucucauuaacacuuacauuuccauaaagaaaacucaaguauuaauaaa

SEQ ID NO: 94715 - RNA, 64 nt, hsa
agaaacauugacucagaaaaaagguaugaagucuuuccauaaaaucuuuucacaauauuacucc

SEQ ID NO: 94716 - RNA, 64 nt, hsa
guuuguuuuauauuugucauccaguccauugcauuuccauaagaagacauuuugacuggcuggg

SEQ ID NO: 94717 - RNA, 64 nt, hsa
ccuuuguuuguagauuuaauguugaacaguacuuuuccauaaaguucuagucacuucuguuggc

SEQ ID NO: 94718 - RNA, 64 nt, hsa
auaugauaaaaauacauaaauuugacauucccucuuccauaaaccuuuguuuguagauuuaaug

SEQ ID NO: 94719 - RNA, 64 nt, hsa
uuuuagucagaaaaaauaauuuuucauuucaguuuuccauaaacuguuacacaaaauauaaacc

SEQ ID NO: 94720 - RNA, 64 nt, hsa
uucauuagucaaugugauuggccuuuuauuuucuuuccauaacuuaucugcuauuauuaguuuc

SEQ ID NO: 94721 - RNA, 64 nt, hsa
auuauauugaaauaaguucacauuacagaaaagguuccauaauuuggccaaacugcaugcaugu

SEQ ID NO: 94722 - RNA, 64 nt, hsa
gucacaauccuaacacauuaucgggagcagugucuuccauaauguauaaagaacaagguaguuu

SEQ ID NO: 94723 - RNA, 64 nt, hsa
uuuuuaauagaauauaauuaucggaagcagugccuuccauaauuaugacaguuauacugucggu

SEQ ID NO: 94724 - RNA, 64 nt, hsa
guugaaagaccuucuccaaaugagaucuaagccuuuccauaaggaauguagcugguuuccucau

SEQ ID NO: 94725 - RNA, 64 nt, hsa
caagucucaaaccuugaugaaaaacacaaaauuuuuccauaaacuuaucagaagacucacuuuu

SEQ ID NO: 94726 - RNA, 64 nt, hsa
cuaugaauaaggauucagggguuuuuaaucuacuuuccauaaauuaccaauaucacugauucag

SEQ ID NO: 94727 - RNA, 64 nt, hsa
augucuaaauccuauacucuaguugaggaagaucuuccauaauuuuaugguauuacacagggaa

SEQ ID NO: 94728 - RNA, 64 nt, hsa
aauauauaucagugagucuuacagaaagauaugcuuccauaauaugaaauagauuauucaauaa

SEQ ID NO: 94729 - RNA, 64 nt, hsa
uuuucaaaacagggugcuccuccuggcuucuggcuuccauaagaagaaauggagaaaaaaauau

SEQ ID NO: 94730 - RNA, 64 nt, hsa
caauuacugaaaguggcugcaacagagaaaagacuuccauaaaggacgacaaaagaauuggacu

SEQ ID NO: 94731 - RNA, 64 nt, hsa
aaguacacuuccacaccaggaaaacagacccaaauuccauaaacagaacugacguuaaaauaug

SEQ ID NO: 94732 - RNA, 64 nt, hsa
ucagauguuuucucuggaugcagaaagaccaucuuuccauaauuaaagaaccuggugggugugc

SEQ ID NO: 94733 - RNA, 64 nt, hsa
cuuuaggggaaaaaaccccuaaauagcuucauguuuccauaaucaguacuuuauauuuauaaau

SEQ ID NO: 94734 - RNA, 64 nt, hsa
cagaaaacaauuuauuuuuuaaauaauugucuuuuuccauaaaaaagauuacuuuccauuccuu

SEQ ID NO: 94735 - RNA, 64 nt, hsa
aaacuguuuccaaagcaucugcaucguguuuaauuuccauaaguaacguaugagaauucuaggu

SEQ ID NO: 94736 - RNA, 64 nt, hsa
uuaaaaguuuuauaguuucagaguuuacauguaauuccauaaucuccauuuaguuaaauuuugu

SEQ ID NO: 94737 - RNA, 64 nt, hsa
uuucucagauguggccauguuacaguagaggguauuccauaagcacauauuccauaaagugcuc

SEQ ID NO: 94738 - RNA, 64 nt, hsa
cauguuacaguagaggguauuccauaagcacauauuccauaaagugcucagagucacagguuuu

SEQ ID NO: 94739 - RNA, 64 nt, hsa; identical to SEQ ID NO: 84879

SEQ ID NO: 94740 - RNA, 56 nt, hsa; identical to SEQ ID NO: 84880

SEQ ID NO: 94741 - RNA, 64 nt, hsa; identical to SEQ ID NO: 84881

SEQ ID NO: 94742 - RNA, 64 nt, hsa; identical to SEQ ID NO: 84882

SEQ ID NO: 94743 - RNA, 64 nt, hsa; identical to SEQ ID NO: 84883

SEQ ID NO: 94744 - RNA, 64 nt, hsa; identical to SEQ ID NO: 84884

SEQ ID NO: 94745 - RNA, 64 nt, hsa; identical to SEQ ID NO: 84885

SEQ ID NO: 94746 - RNA, 64 nt, hsa; identical to SEQ ID NO: 84886

SEQ ID NO: 94747 - RNA, 64 nt, hsa; identical to SEQ ID NO: 84887

SEQ ID NO: 94748 - RNA, 64 nt, hsa; identical to SEQ ID NO: 84888

SEQ ID NO: 94749 - RNA, 64 nt, hsa; identical to SEQ ID NO: 84889

SEQ ID NO: 94750 - RNA, 64 nt, hsa
aaaaaauauaucugaaguuucuuguguuuuuuuuuuuccccacaaaguguguuuccacuuggag

SEQ ID NO: 94751 - RNA, 64 nt, hsa
cugucacuucauuuccuguauuauaugugauguuuuuccccauuaaaauaccagagauaaugga

SEQ ID NO: 94752 - RNA, 64 nt, hsa
agguguuugacucccauuccuugggcucuggagcuuuccccaagaauuacaucagagaaaagga

SEQ ID NO: 94753 - RNA, 64 nt, hsa
guuuccaagggaggggcccaggcuacauccuugguuuccccacuguggugggggcugggacucu

SEQ ID NO: 94754 - RNA, 64 nt, hsa
cuuccacaaaauuggaagcuuuuuuuaaaaauguuuuccccacaagucaucuugccuuguggca

SEQ ID NO: 94755 - RNA, 64 nt, hsa
uuaauauuuugcccuugaaagucaccugaggaaguuuccccacuuuuauuuuuuaaaauuaagu

SEQ ID NO: 94756 - RNA, 64 nt, hsa
caagggcugucuggcauggcucauuugggugggguuuccccaggcauaccuuaguucccugauc

SEQ ID NO: 94757 - RNA, 64 nt, hsa
gauaccaguucucuagcagauuccccaacaguuuuuuccccaguggggaggguggaagggaggg

SEQ ID NO: 94758 - RNA, 64 nt, hsa
ccaaaaagcuuaaauauugaaaguguuagccuuuuuuccccagacuuguuggcguaggcuacag

SEQ ID NO: 94759 - RNA, 64 nt, hsa
ucacccaacgcuccaaagucauaauugcauugacuuuccccaccagaugcugaaaauguccuug

SEQ ID NO: 94760 - RNA, 64 nt, hsa
ucccccagaucagggccauuggugacaaugcuuguuuccccaggguuccuuccugacaggcauc

SEQ ID NO: 94761 - RNA, 64 nt, hsa
caggcaucugggguugguguagggauggagcugcuuuccccauuucuacagagagccaugcccc

SEQ ID NO: 94762 - RNA, 64 nt, hsa
cccuuagaguauggaggcugagccaggccuuggguuuccccagcacagccuccugucgcugcau

SEQ ID NO: 94763 - RNA, 64 nt, hsa
gugguuguauguuaccuuuuccaccucucauuguuuuccccagaacauuguagauggggguugg

SEQ ID NO: 94764 - RNA, 64 nt, hsa
auaugauggugucugaaauugagaauccaguuucuuuccccagcaguuucuguccuagcaagua

SEQ ID NO: 94765 - RNA, 64 nt, hsa
ugguuuuuuagguggagagacacaccugcuccaauuuccccaccccccucucuuucucuggugg

SEQ ID NO: 94766 - RNA, 64 nt, hsa
uucuaauauggauuaaaaacuccacauaaauauuuuuccccaugcgucuuggguuauaauuuuc

SEQ ID NO: 94767 - RNA, 64 nt, hsa
auacagcucauuacaauaaaauuguuggauuucauuuccccaggucuucaguguugauguaaau

SEQ ID NO: 94768 - RNA, 64 nt, hsa
uaacuuucaguugaagauuaaagcaagaugccauuuuccccaugacuuugguuuuguuuacauu

SEQ ID NO: 94769 - RNA, 64 nt, hsa
aaggacugaacuuuuucucaucaaaacuagcuuuuuuccccacaaauaaauuaucagguuaaac

SEQ ID NO: 94770 - RNA, 64 nt, hsa
accagccaggccagaccaccauggugaaggcuucuuuccccacugcaggacccacuuugagaag

SEQ ID NO: 94771 - RNA, 64 nt, hsa
uucuggccgugcuuggcuugaguaacugucucucuuuccccacccccaucacagggcuuucagu

SEQ ID NO: 94772 - RNA, 64 nt, hsa
uucagcaugcuccuuaaaaccccagaagccccaauuuccccaagccccauuuuuucuugucuuu

SEQ ID NO: 94773 - RNA, 64 nt, hsa
uccaucaaggucucuaguaguucuggcccaccucuuuccccacccuggcuccaugacccacccc

SEQ ID NO: 94774 - RNA, 64 nt, hsa
cccucugccuucaaccuuaagauuuaggaaguucuuuccccaacugucuaacuuggaaagguag

SEQ ID NO: 94775 - RNA, 64 nt, hsa
uuuuuaacguaucacccaaagcauguaugugaucuuuccccauuaguaucuuuuucucaaaugc

SEQ ID NO: 94776 - RNA, 64 nt, hsa
aagauuguuaccaccuugauuuaauaacuucuuguuuccccauacauguguuuuguuuauagau

SEQ ID NO: 94777 - RNA, 64 nt, hsa
uacaaaauggcguagaaugaaaugccucucacccuuuccccacagcgacuacuucccacucaga

SEQ ID NO: 94778 - RNA, 64 nt, hsa
gaggguuagaguccugccaauacagcuguugcauuuuccccaccacuagccccacuuaaacuac

SEQ ID NO: 94779 - RNA, 64 nt, hsa
uccuaaaucauuaagauuuucagguauucaccaauuuccccauguaagguacuguguuguaccu

SEQ ID NO: 94780 - RNA, 64 nt, hsa
acccuugaauucaguguaguaauauuuucagacguuuccccaauaaguguguugaagcauacau

SEQ ID NO: 94781 - RNA, 64 nt, hsa
aaccaacaugucauugacaccucucuucuuuacuuuuccccauaucuaaucauuccucaagucu

SEQ ID NO: 94782 - RNA, 64 nt, hsa
uguauucauuaaacaauaacugucuauucccucuuuuccccagccucuggcaaccaccauucug

SEQ ID NO: 94783 - RNA, 64 nt, hsa
uugacuccaucuauauuucacaaaagagacuuccuuuccccaagaauuaucauggaaugucaga

SEQ ID NO: 94784 - RNA, 64 nt, hsa
gagggcuaaauugggaucucagccugcccuaaucuuuccccaucugaggcagguuucuaggagg

SEQ ID NO: 94785 - RNA, 64 nt, hsa
cuaagaacagguuugcagcuacccucucugaccuuuuccccauaucuugugcuguccagggccu

SEQ ID NO: 94786 - RNA, 64 nt, hsa
guaaagugauauuuccccaugguuuuaaucuguauuuccccaacauguaauaagguugaacacu

SEQ ID NO: 94787 - RNA, 64 nt, hsa
ugauuuucauuauuccuguggauguaaagugauauuuccccaugguuuuaaucuguauuucccc

SEQ ID NO: 94788 - RNA, 64 nt, hsa
agaccccaaauuccugccauuuuccccauuuauguuuccccaugugaaucuucaggaaguaacc

SEQ ID NO: 94789 - RNA, 64 nt, hsa
acuagagguucaagagaccccaaauuccugccauuuuccccauuuauguuuccccaugugaauc

SEQ ID NO: 94790 - RNA, 64 nt, hsa
uuaauuuugaagugaauauuugccaugacuccauuuuccccauaccacuucagacuuuagccug

SEQ ID NO: 94791 - RNA, 64 nt, hsa
gauacagguucauaaacuacaauauuuggauuuuuuuccccaaggcacaaaauguauaauggag

SEQ ID NO: 94792 - RNA, 64 nt, hsa
caugucugcuugagauauuuccucagccugaaaguuuccccaaccaucugccagagaacuccua

SEQ ID NO: 94793 - RNA, 64 nt, hsa
cuguaccccuugguacugccucugaacacucugguuuccccacccaacugcggcuaagucucuu

SEQ ID NO: 94794 - RNA, 64 nt, hsa
uuggccugcuuucccaaaaacagcccacucauccuuuccccagcccucuucagcccuccccagu

SEQ ID NO: 94795 - RNA, 64 nt, hsa
acacugugucuuuccggucauuggauccucucccuuuccccaggcagcucgccuggccacaccg

SEQ ID NO: 94796 - RNA, 64 nt, hsa
ugaguggaaacagguucuugcauguggauguguguuuccccaggcagacggccccucucuuccc

SEQ ID NO: 94797 - RNA, 64 nt, hsa
gaccaaagcccucauugugguccgaggacagccuuuuccccaggccucagagcauugcucaucc

SEQ ID NO: 94798 - RNA, 64 nt, hsa
gagagaauguuuugaaaggccagaggguggccuuuuuccccaaacaguuugguuccuuuuaugu

SEQ ID NO: 94799 - RNA, 64 nt, hsa
aguuugagcucuuaaaaguugaugaacagccucauuuccccagcuucccugauuucuuccagau

SEQ ID NO: 94800 - RNA, 64 nt, hsa
aggaggggaacaaggaguucucuuccgcagccccuuuccccacgcccacccccagucuccaggg

SEQ ID NO: 94801 - RNA, 64 nt, hsa
cgguggaggaaggcucugucacuccaggcauauguuuccccaucucugucuggggcuacagaau

SEQ ID NO: 94802 - RNA, 64 nt, hsa
ccuccacuccggaucgaggccuguauagggcucguuuccccacacaugccuauuucugaagagg

SEQ ID NO: 94803 - RNA, 64 nt, hsa
agaagccuaggggagucccugugguccugaauucuuuccccaaagacgaccagcauuuaaccaa

SEQ ID NO: 94804 - RNA, 64 nt, hsa
ccagaucaccaucuucaaauuggcacaacugaaauuuccccacucuguuggggcuuccccacca

SEQ ID NO: 94805 - RNA, 64 nt, hsa
gggcaacuccuugcccuccugcucagcaccuccauuuccccauccuuggugagauaacaagcua

SEQ ID NO: 94806 - RNA, 64 nt, hsa
ugaaaaugaucaagucuugucaguucgugcccucuuuccccauguucccugggaagacgggugg

SEQ ID NO: 94807 - RNA, 64 nt, hsa
aaaggaaaaguugcugucaucaaaauggcagccuuuuccccagcuacuguuuuuggggccaaga

SEQ ID NO: 94808 - RNA, 64 nt, hsa
cuccugcuuauuuauaaaucauuuccuuucuuuuuuuccccaaagucagaauugcucaaagaaa

SEQ ID NO: 94809 - RNA, 64 nt, hsa
gaaucccagauaugguugcacaaaaccacuuuuuuuuccccaaguauuaaacucuaauguacca

SEQ ID NO: 94810 - RNA, 64 nt, hsa
ccuuuugagaaacugaauuuugcaaagggccaaauuuccccaaacugaacgggcucaggaaaug

SEQ ID NO: 94811 - RNA, 64 nt, hsa
gggauuacaggcgugagccacugcgcccggccuauuuccccaccuuucguguaaggugcuacug

SEQ ID NO: 94812 - RNA, 64 nt, hsa
gggugucugacccaccagcagugcaaugggcagguuuccccacucuauuccugcucuugggaaa

SEQ ID NO: 94813 - RNA, 64 nt, hsa
ggagcucugguuucagagcagugccgggauugccuuuccccaggaucugugucggccauccagg

SEQ ID NO: 94814 - RNA, 64 nt, hsa
ggucuaggccccuuuaggaagccuccgcucucuuuuuccccaacagaccugucuucacccuugg

SEQ ID NO: 94815 - RNA, 64 nt, hsa
cccuccugcccccucucccacuuuucccuuccucuuuccccacagccccccagccccucagccc

SEQ ID NO: 94816 - RNA, 64 nt, hsa
cccuugccuuccccuuucucugucuccaacacucuuuccccaugucuuucuggcugucucuaug

SEQ ID NO: 94817 - RNA, 64 nt, hsa
cccaggccacccuagcccagccccugcauugccguuuccccagagguggccccuccaccucugc

SEQ ID NO: 94818 - RNA, 64 nt, hsa
uccucucccagagggcacugcuuggaaauuguguuuuccccauuuauggugcucuguauucugg

SEQ ID NO: 94819 - RNA, 64 nt, hsa
aguagggagcuaguuuguugauaaauaguucccauuuccccauggagaauuugacauacccugg

SEQ ID NO: 94820 - RNA, 64 nt, hsa
uauaagucauacuguguagaauuucuauuuucuuuuuccccauuaaaagaggaccaaacaauuc

SEQ ID NO: 94821 - RNA, 64 nt, hsa
acaacuuuauuaagcagaauacacuguagaugcuuuuccccaacguaucuggcuggcagucuuu

SEQ ID NO: 94822 - RNA, 64 nt, hsa
ugaagguuccugaggaucuagcuucaugccucaguuuccccauugacuugcacaucucugcagu

SEQ ID NO: 94823 - RNA, 64 nt, hsa
gugucauugcuguaggaaugaccacgggccucaguuuccccauuuguauaaugggaagccugua

SEQ ID NO: 94824 - RNA, 64 nt, hsa
caucauuaggggccagcaucccaggaacuggaccuuuccccagagccuccgccuguggcuguga

SEQ ID NO: 94825 - RNA, 64 nt, hsa
aaggccagggccccuguucuagggguuaggguucuuuccccaaaggaacuuaaaaagacaagcg

SEQ ID NO: 94826 - RNA, 64 nt, hsa
ggaagaucucgcagccucaguguaugggaaacccuuuccccaggcuugucccagcacugccgcu

SEQ ID NO: 94827 - RNA, 64 nt, hsa
gcaggcaguggacagggugcccgccccacagugcuuuccccagcaccccagagccagucgggac

SEQ ID NO: 94828 - RNA, 64 nt, hsa
ccauucuugggaggacacuuuugccaaugaacucuuuccccagcugauuagugucuaaggaaug

SEQ ID NO: 94829 - RNA, 64 nt, hsa
gaugcuuacagugacuguggauacggggguucccuuuccccauucagugacauguccucucugc

SEQ ID NO: 94830 - RNA, 64 nt, hsa
ucaagggagcagggcagcucuaccaggcaagguguuuccccagcauaggcgcagacaguuggga

SEQ ID NO: 94831 - RNA, 64 nt, hsa
cagccagaagugggggcagaggaggguggcucuguuuccccaaggcaaagcuuaugaccaaugg

SEQ ID NO: 94832 - RNA, 64 nt, hsa
auguaaagugcaaucauuucuucagauauaagacuuuccccaacaaugugauuggauuccuuua

SEQ ID NO: 94833 - RNA, 64 nt, hsa
gggcauacuauugggcugggaggauuugacagcauuuccccaguugcccuuuaaguucuucuau

SEQ ID NO: 94834 - RNA, 64 nt, hsa
uuucccucauucugccuaguguguaaguuuucuauuuccccaguacuuuuagccaaccuuacca

SEQ ID NO: 94835 - RNA, 64 nt, hsa
agcuggccaaggcuuauuaaaugugaacccaacuuuuccccagggcuuuccuguaccugcaagc

SEQ ID NO: 94836 - RNA, 64 nt, hsa
uggcaucugcuuuuaauggauguauaauacauccauucuacauccguagcgguuggugacuugu

SEQ ID NO: 94837 - RNA, 64 nt, hsa
gcuguuuuauuacuguuucuaaacuaggauugacauucuacaguugugauaauagcauuuuugu

SEQ ID NO: 94838 - RNA, 64 nt, hsa
ugaagacaucgauauacauuuauuuacacucuugauucuacaauguagaaaaugaggaaaugcc

SEQ ID NO: 94839 - RNA, 64 nt, hsa
accacucuaaucaagaaaagaauuacagacucugauucuacagugaugauugaauucuaaaaau

SEQ ID NO: 94840 - RNA, 64 nt, hsa
auugaaaacuccucaaucaagcuuacuuacacacauucuacagaguuauuuaaggcauacauua

SEQ ID NO: 94841 - RNA, 64 nt, hsa
aaugaauaagucacccuuuaaauauaagacacaaauucuacaguauugaaauaaggauuuaaag

SEQ ID NO: 94842 - RNA, 64 nt, hsa
aaaagccauucacuccagauuuuaccuggggaauauucuacauacugcuuacuuucucuauaaa

SEQ ID NO: 94843 - RNA, 52 nt, hsa
aaacugacucauccaacuagacauucuacagaaagaaaaaugcauuauugac

SEQ ID NO: 94844 - RNA, 64 nt, hsa
uaauaauugaauugguuuuuaaaggcaacauagcauucuacagcaggguuaaucuauuaucaag

SEQ ID NO: 94845 - RNA, 64 nt, hsa
ccuagcuaauuuauuagauuguguugaaggucugauucuacaaaggccaacucuacauauuugg

SEQ ID NO: 94846 - RNA, 64 nt, hsa
ugcuucaaaaauuaaaauccagcaucccaagaucauucuacaaguaauuuugcacagacaucuc

SEQ ID NO: 94847 - RNA, 64 nt, hsa
auuaauuucauugucucuaucugaaccacccuuuauucuacauaugauaggcagcacugaaaua

SEQ ID NO: 94848 - RNA, 64 nt, hsa
gacaguuaaaugcuaauuauauacaucuguaguuauucuacauuuucuugaaauuugggagguu

SEQ ID NO: 94849 - RNA, 64 nt, hsa
acaguuaaaugcuaauuaauauacaucuguaguuauucuacauuuucuugaaauuugggagguu

SEQ ID NO: 94850 - RNA, 64 nt, hsa
agaaacguuaccuuaucaaagacuaaucugugccaccucugauucaguguuuuaugucuuucac

SEQ ID NO: 94851 - RNA, 64 nt, hsa
aaggccccagugaaaaacauacuggggaaauaaaaccucugagaaaagguucaagcaccuuuuc

SEQ ID NO: 94852 - RNA, 64 nt, hsa
acccagccccaggagccagaccacuccugccuccaccucugacucuucagcagcugaagauuaa

SEQ ID NO: 94853 - RNA, 64 nt, hsa
aggagcucacuuggccugcuugcccugcccucucaccucugacacccagccccaggagccagac

SEQ ID NO: 94854 - RNA, 54 nt, hsa
ccauccagccaagcuggugagacaaccucugauccugaggaccggccgcccacc

SEQ ID NO: 94855 - RNA, 64 nt, hsa
gaggaggcuggggacaggcaguuuuuggucuuuuaccucugaucuuguccccaaccuaagccag

SEQ ID NO: 94856 - RNA, 64 nt, hsa
uaaauuuccauccauugugagaauauuuucacugaccucugauggcacuuguugacaaaucauu

SEQ ID NO: 94857 - RNA, 64 nt, hsa
caaaagccuucucuagaaucugaaggccaggcuuaccucugauucugauucauccauacuucau

SEQ ID NO: 94858 - RNA, 64 nt, hsa
cugcccugcccagguggccuccuggcccgcccucaccucugauagacuuugugaaucugaacug

SEQ ID NO: 94859 - RNA, 64 nt, hsa
cagcuuuuucuguggaggacagacggccggccggaccucugagcacauaguguccugcccaccc

SEQ ID NO: 94860 - RNA, 64 nt, hsa
cuuucaccccccaccccccacagcgucagcuccuaccucugaccccagcuucucucugauuccc

SEQ ID NO: 94861 - RNA, 64 nt, hsa
ucaccuuuaaccccccaccugagccccagcuccuaccucugaccccaacuucucuuugaucucu

SEQ ID NO: 94862 - RNA, 64 nt, hsa
acucucgaugguggucuccgcucuugcccgaaggaccucugaaguacgcuggagcuguguugua

SEQ ID NO: 94863 - RNA, 64 nt, hsa
cacgaagcuaacaacacuaauauacguauuuagcaccucugaggcuuugccauggagacccauu

SEQ ID NO: 94864 - RNA, 64 nt, hsa
ucauuuguguauucaggcuuuuuaaauaaaauuagagcuguaaggaaaaugaaaagccacaaau

SEQ ID NO: 94865 - RNA, 64 nt, hsa
uauguguguauuauaacuuauuaaucuugcuguugagcuguauacaugguuuaaaaaauaguac

SEQ ID NO: 94866 - RNA, 64 nt, hsa
uggguaaauugguugaauuauuguauugaagcuugagcuguagcuaaaaguaauuuagguuucc

SEQ ID NO: 94867 - RNA, 64 nt, hsa
uaaguuguauaauaugcuuguaaaggcugagggugagcuguaucuggaugccuuuuuacaauuu

SEQ ID NO: 94868 - RNA, 62 nt, hsa
gcugaagagucuugagaggggcugucaucuguagcugccaucacagugaguuggcagaagug

SEQ ID NO: 94869 - RNA, 62 nt, hsa
ccagccccugugccaggcuaagcugguacaagagcugccaaccucacagaguguuugcuagg

SEQ ID NO: 94870 - RNA, 62 nt, hsa
ucauccuccucagaucuucuguggguuucuaaagcugccagccgagauagccaaggccaaag

SEQ ID NO: 94871 - RNA, 62 nt, hsa
uccccuguccccgcacugggcuuggggaccagagcugccaccugccuguugggccaggagcc

SEQ ID NO: 94872 - RNA, 62 nt, hsa
aguguacacccaccugccucucuggcuccagaagcugccagagugcacuggggggaauguuc

SEQ ID NO: 94873 - RNA, 62 nt, hsa
auacgagcauugcagauugcaguaggggucccagcugccaaguaggacaugacuaggagugu

SEQ ID NO: 94874 - RNA, 62 nt, hsa
acucauugauuaaaauggaauaaagaaagagcagcugccacuuuuaaacaacauaaaggaau

SEQ ID NO: 94875 - RNA, 62 nt, hsa
gauuaaaagauagucaagaaauucugcaauauagcugccaaaauagacagcuacauuuuuau

SEQ ID NO: 94876 - RNA, 62 nt, hsa
uggcaacuggacugaggggagugugcccaggcagcugccaagcacucccucccuggcuucag

SEQ ID NO: 94877 - RNA, 62 nt, hsa
cacuuagaccucaaacuuuagcaucucuguggagcugccauccacuguauaauuucgccugg

SEQ ID NO: 94878 - RNA, 62 nt, hsa
cucccuggaggccagcucugccccaggggcugagcugccaccagagguccugggacccucac

SEQ ID NO: 94879 - RNA, 62 nt, hsa
ucuguggcugucggccagagggaauguucuggagcugccaaggagggaggagacucggguug

SEQ ID NO: 94880 - RNA, 62 nt, hsa
gcugcucucucaggaccauccgaucaagcugcagcugccacccucaccuagaaacaugccuu

SEQ ID NO: 94881 - RNA, 62 nt, hsa
cuuuuggaauguccuggucacagggucaugucagcugccaguucucgucucccguccuggag

SEQ ID NO: 94882 - RNA, 62 nt, hsa
ggaccccacgauuuaggguaacuguuaucaucagcugccauuucugauagggucuaccacau

SEQ ID NO: 94883 - RNA, 62 nt, hsa
aguccugugucaucacugcagcgguccucaggagcugccagggccaauugcuacagaguguc

SEQ ID NO: 94884 - RNA, 62 nt, hsa
ugagggcagacacagcuccagggacccaggccagcugccacacccccgacacuccugcuguc

SEQ ID NO: 94885 - RNA, 62 nt, hsa
cuggauguucugggggaggaggcaaucgcuguagcugccaggccagccccaucuggaaggag

SEQ ID NO: 94886 - RNA, 62 nt, hsa
cauccucucacucacuucuccacccgccaggcagcugccacaggccuaaggcugagugaggu

SEQ ID NO: 94887 - RNA, 62 nt, hsa
cccugcgcuccugcgagaccagauauaaaacuagcugccaacccagccuguggccaggucac

SEQ ID NO: 94888 - RNA, 62 nt, hsa
agacuccuuugugcuggaaccugggcuccuccagcugccaggcaggagucgguaggacugug

SEQ ID NO: 94889 - RNA, 62 nt, hsa
acgaugccagcccgaggcacugcuacgccagcagcugccacaugggaugguggcucaggcgc

SEQ ID NO: 94890 - RNA, 62 nt, hsa
ugcccuuuuccaccucccccuuccaucccaccagcugccaguggcucccagaaagccuuauu

SEQ ID NO: 94891 - RNA, 62 nt, hsa
aagccaagauggcuguaaacacagagcauuugagcugccacucuuggagcacauugauuuuu

SEQ ID NO: 94892 - RNA, 62 nt, hsa
uccagagauggccccuccucaccugggacggaagcugccagcucgcuucccccaagcugccu

SEQ ID NO: 94893 - RNA, 62 nt, hsa
uucucugugucucagauggcgauuuugcugacagcugccaagaaaaugcuucacucaacagu

SEQ ID NO: 94894 - RNA, 62 nt, hsa
ugguuuggugugguguuugccauugcagagcaagcugccacgaagaccccugggcaugauuu

SEQ ID NO: 94895 - RNA, 62 nt, hsa
gcugaagaaggcaugggauggagcccuggcauagcugccaccaugccuaugugcccaagagc

SEQ ID NO: 94896 - RNA, 62 nt, hsa
cucaaacagcaaagucagcauuugcuguauagagcugccacccaacucuaagcaggagaaac

SEQ ID NO: 94897 - RNA, 62 nt, hsa
cagaauuugaccucccagagccaguuuccauuagcugccaugcucugcugccucuaauucac

SEQ ID NO: 94898 - RNA, 62 nt, hsa
ggccuggcccccucagccaucucagggugaggagcugccagucauguccagauggaaugacu

SEQ ID NO: 94899 - RNA, 62 nt, hsa
gaugggaagaugugcauccguggucaaaagucagcugccagcccugcggaaccagagccuca

SEQ ID NO: 94900 - RNA, 62 nt, hsa
cuucaguuaugucccauuuuuaugaugccaaaagcugccacugugugguauucgaggauuau

SEQ ID NO: 94901 - RNA, 62 nt, hsa
aacuccacccgaccccagcaguggugcaggacagcugccagcacccaccuggcccuccuccu

SEQ ID NO: 94902 - RNA, 62 nt, hsa
cucaaggugugugaaagauguuauacaccaggagcugccacugcaugucccaaccagacugu

SEQ ID NO: 94903 - RNA, 62 nt, hsa
guaucuucaguucauuccacuuuaggaaacagagcugccaauugaaacagaagaagaaaaaa

SEQ ID NO: 94904 - RNA, 62 nt, hsa
aaacacccugaaauugugacccccugggggacagcugccagacacagcuggcggcagcacca

SEQ ID NO: 94905 - RNA, 62 nt, hsa
uccagaggucaugaagggaccucuguggcuccagcugccaacccuggagcccagaccgaggu

SEQ ID NO: 94906 - RNA, 62 nt, hsa
aaaaguuuccuuuuuuauucucucaagccaccagcugccagccaccagcagccagcugccag

SEQ ID NO: 94907 - RNA, 62 nt, hsa
cucaagccaccagcugccagccaccagcagccagcugccagccuagcuuuuuuuuuuuuuuu

SEQ ID NO: 94908 - RNA, 64 nt, hsa
cccugaacauuucaugguguucaucaacagugagagacuccauaguuugggcuuguaccacuuu

SEQ ID NO: 94909 - RNA, 64 nt, hsa
cgcgccacugugcuccagccugggcaacagagcaagacuccaucucaaaaaauaaaaauaaaua

SEQ ID NO: 94910 - RNA, 64 nt, hsa
acuuaguauugguggaaaccauuugugaauuuacagacuccaaaaacaaaaagauaauuuagag

SEQ ID NO: 94911 - RNA, 64 nt, hsa
ucaugccacugugcuccagccugguggcacagugagacuccaccucaaaaaaaaaaaaaaaucc

SEQ ID NO: 94912 - RNA, 64 nt, hsa
cgcaccacugcacuccagccugggucacagagugagacuccaucucaaaaaaaaaaaagagaga

SEQ ID NO: 94913 - RNA, 64 nt, hsa
uuucccacugcacuccagccugagugacagagcgagacuccaucucuuuaaaaacaaacaaaaa

SEQ ID NO: 94914 - RNA, 64 nt, hsa
ggcgccacuguacuccaaccugggcgacagagcaagacuccaucucauaaauuaaaaggaaagu

SEQ ID NO: 94915 - RNA, 64 nt, hsa
ccugccacugcacuccagucugggugacagagcaagacuccaucucaaaaaauaaauaaauaga

SEQ ID NO: 94916 - RNA, 64 nt, hsa
cacgccacugcauuccagccugggcgacagagcaagacuccaucucaaaaauaaaauaaaaaaa

SEQ ID NO: 94917 - RNA, 64 nt, hsa
ugugccauugcacuccaaccugggcgacagagugagacuccaucucaaaaaaaaaaaaaaaaaa

SEQ ID NO: 94918 - RNA, 64 nt, hsa
aacuaaacucuuaccauauguuugguaagacuccagacuccagcuaacagucccuauggaaaga

SEQ ID NO: 94919 - RNA, 64 nt, hsa
ggacagaaacuaaacucuuaccauauguuugguaagacuccagacuccagcuaacagucccuau

SEQ ID NO: 94920 - RNA, 64 nt, hsa
ugcaccacuguacuccagccugggcaacagagggagacuccaucuagacuccaucucaaaaaaa

SEQ ID NO: 94921 - RNA, 64 nt, hsa
acuccagccugggcaacagagggagacuccaucuagacuccaucucaaaaaaaaaaaaaaaaaa

SEQ ID NO: 94922 - RNA, 64 nt, hsa
auucaaaaaagugugaugugcugcucagaaggucagacuccaugucugccuugaccucaagguc

SEQ ID NO: 94923 - RNA, 64 nt, hsa
uugccacgugcagcugugcucaccccaggucaucagacuccaccgugugcaugugcaucaaugu

SEQ ID NO: 94924 - RNA, 64 nt, hsa
cagcaggcucuaggggaauccugugguuauguagagacuccauguccuggugugaugagcagga

SEQ ID NO: 94925 - RNA, 64 nt, hsa
uccuacuuucuuucucuggaaaggaaagccuccaagacuccaugugcuugggcagcuugagaag

SEQ ID NO: 94926 - RNA, 64 nt, hsa
ucuuggcugcuuuuguuacuauacauuuucucugagacuccagcagaguuggggcuggaacuug

SEQ ID NO: 94927 - RNA, 64 nt, hsa
ccaggaguuuuagacuagccuggacaacuaagugagacuccaucucuacaaaaaauuaaaaaau

SEQ ID NO: 94928 - RNA, 64 nt, hsa
cgcgccacugcacuccagccugggugacagagccagacuccaucucaaagaaaaaaaaaaaaua

SEQ ID NO: 94929 - RNA, 64 nt, hsa
cgcuccacugcacuccagcccaggugacagugugagacuccaucucaaaaaaaaaaauaagagg

SEQ ID NO: 94930 - RNA, 64 nt, hsa
cgugccacugcacuccagccugggcgacagagugagacuccaucucaaaaaaaaaaaaaaaaac

SEQ ID NO: 94931 - RNA, 64 nt, hsa
ugcgccaccgcacuccagccugggcgacagagcgagacuccaucuuuaaaaaaaaacaagacgg

SEQ ID NO: 94932 - RNA, 64 nt, hsa
cgggccuuugguucccucccccagccccagcuuucuccuacagggcuuuuccugaguccccaga

SEQ ID NO: 94933 - RNA, 64 nt, hsa
gggagccucugccuccucagccacagagaacucccuccuacaaagggggagacugaaacccgag

SEQ ID NO: 94934 - RNA, 64 nt, hsa
caugcaugcacacaaacguguacacaagugugagcuccuacacgcauacacacacacacgugua

SEQ ID NO: 94935 - RNA, 64 nt, hsa
acguguacacauaccacagacacgcgugugcaugcuccuacacaauacauaugcacauaucaug

SEQ ID NO: 94936 - RNA, 64 nt, hsa
cacaugcauguacagguaagcacacauguacaagcuccuacaggcuugcucucacacacgugua

SEQ ID NO: 94937 - RNA, 64 nt, hsa
agaugcacauggacacaccccaaacacgcacaggcuccuacacacaugcacacacguguacacc

SEQ ID NO: 94938 - RNA, 64 nt, hsa
gccuacccaucugggcccaagagcugcacucacacuccuacaacgaaggacaaacuguccaggu

SEQ ID NO: 94939 - RNA, 64 nt, hsa
ugcgcaugcugaaauaacuggaacccagccucuccuccuacaccggccuacccaucugggccca

SEQ ID NO: 94940 - RNA, 64 nt, hsa
agcagccagcccccuccgauacaccucccguccucuccuacagaccugcaccccuccccccuuu

SEQ ID NO: 94941 - RNA, 64 nt, hsa
cccaaguggcauagccccuuuuccgguauggggucuccuacacccacgcgcaccaccucuccgg

SEQ ID NO: 94942 - RNA, 64 nt, hsa
ggaaggccguagaugugugggcccugggcgucaucuccuacauccugugagugaccgcugggaa

SEQ ID NO: 94943 - RNA, 64 nt, hsa
guggcgagcuguuugaccgcaucauggagcgcggcuccuacacagagaaggaugccagccaucu

SEQ ID NO: 94944 - RNA, 64 nt, hsa
cuccuagggcauccccugccugaacgaagacuuccgccgcgaagcccgauagaucgggggaaaa

SEQ ID NO: 94945 - RNA, 64 nt, hsa
guucgcacagaagggcgaccuugcagggacucgccgccgcgaccucaguguggcuuuuacagga

SEQ ID NO: 94946 - RNA, 64 nt, hsa
cggacccgggcagugaaccagagaucacgcgccgcgccgcgaggcuugggggagguguugaaau

SEQ ID NO: 94947 - RNA, 64 nt, hsa
ccacguggccgggagacgcacagggcgccagcgucgccgcgaggccucugggguggguucgcca

SEQ ID NO: 94948 - RNA, 64 nt, hsa
ggagcccccuuccuguguucucccuuuguuccagcgccgcgauggugagaucacuguuccaagc

SEQ ID NO: 94949 - RNA, 64 nt, hsa
ucucacuccugccagggaccagcuuaaugcccugcgccgcgagaagcagaagcucguggagaag

SEQ ID NO: 94950 - RNA, 64 nt, hsa
gaagagccugcgccuccgccuccgccgccugcaccgccgcgaagccgaagccgaagccgaagca

SEQ ID NO: 94951 - RNA, 59 nt, hsa
aagucuaccggggcaacugagccgggccucgccgcgacccuuccggcccaucuaucggg

SEQ ID NO: 94952 - RNA, 64 nt, hsa
aaccaccccaggucagcgcugcgccugcuguggccgccgcgagccacgcccucugggaucucug

SEQ ID NO: 94953 - RNA, 64 nt, hsa
caaggguuccaccccuaccgacgcuagcccgcggcgccgcgacgucugcacggcccagacccag

SEQ ID NO: 94954 - RNA, 62 nt, hsa
cuuacaucacccucaccuaggccggcucggcucgccgcgacucugggguggugcucgccuac

SEQ ID NO: 94955 - RNA, 64 nt, hsa
gcgcgggacaggacuugugcgccggcgccccggacgccgcgauuuugccuuugguuccccgcga

SEQ ID NO: 94956 - RNA, 63 nt, hsa
guaaggauuaagcagauagggagaagggaaaaggggccucacuuuagaaugaaugagucaccu

SEQ ID NO: 94957 - RNA, 63 nt, hsa
gcuccagggccacuuuguuuguaaguaugaucugggccucaaaauaccauaguagcugcuuga

SEQ ID NO: 94958 - RNA, 63 nt, hsa
ggagcugggucuuggggcagcuuuauuccuguugggccucaguuucucuuccccacacaguuu

SEQ ID NO: 94959 - RNA, 63 nt, hsa
cugagccuuucucccaaguuccagagccucuccgggccucagugcugccaucuguacaauggu

SEQ ID NO: 94960 - RNA, 63 nt, hsa
gcccacaggaagccugcaguccuggaagcgcgagggccucaaaggcccgcucuacaucuucug

SEQ ID NO: 94961 - RNA, 63 nt, hsa
ucauuugagaaguaaacagauggcacuuugaaggggccucaccgagugggggcaucaucaaaa

SEQ ID NO: 94962 - RNA, 63 nt, hsa
uguguguagaaagccagcuggauguuugugguggggccucauggugccuaggaggagauaaag

SEQ ID NO: 94963 - RNA, 63 nt, hsa
acgccacaggccucaggauggcuuuuugucugagggccucauuaggcccagacugcugcugcu

SEQ ID NO: 94964 - RNA, 63 nt, hsa
gcacccccgggggccucagaacuaccccuuccagggccucagaacuaccccuacaguuucucc

SEQ ID NO: 94965 - RNA, 63 nt, hsa
cuccucccuggaccugcagcuccgcacccccgggggccucagaacuaccccuuccagggccuc

SEQ ID NO: 94966 - RNA, 63 nt, hsa
ucccgcccagcauccucccugaguccccacacagggccucacucugcaccccaccaggguccc

SEQ ID NO: 94967 - RNA, 63 nt, hsa
ugucccccaaggagucauggaacucaggguacugggccucaacgggaaccugagacagcucca

SEQ ID NO: 94968 - RNA, 63 nt, hsa
guggggaacggaggaggacauggggagguuguggggccucaggcuccgggcaccaggggccaa

SEQ ID NO: 94969 - RNA, 63 nt, hsa
gagggccgguucuaaggcucagacugggcacuggggccucagccugcuuuccugcagcagucg

SEQ ID NO: 94970 - RNA, 63 nt, hsa
acgugccacgcuguagccacagaccccuugcucgggccucacccaaggccaaacuccaaacac

SEQ ID NO: 94971 - RNA, 63 nt, hsa
gggaaccuggaagcugcgcugcucugcgccucugggccucacuguggacagaggagucaggcc

SEQ ID NO: 94972 - RNA, 63 nt, hsa
ggggauucaccuaccuggguccucacuuuccuggggccucaccugcuggagucuucgguggcc

SEQ ID NO: 94973 - RNA, 63 nt, hsa
gaaccucauuuuccuggggccucaccugagugggggccucaucuaccuaaggacucguuugcc

SEQ ID NO: 94974 - RNA, 63 nt, hsa
ggggccugggcugccaggaaccucauuuuccuggggccucaccugagugggggccucaucuac

SEQ ID NO: 94975 - RNA, 63 nt, hsa
ggggccucggcugccuggggucucaccugccuggggccucaccugcuggagucuuugguggcc

SEQ ID NO: 94976 - RNA, 63 nt, hsa
uggggccugggcugccgggaccucacuuucccagggccucaccuaccuagggucucacuaguc

SEQ ID NO: 94977 - RNA, 63 nt, hsa
guucuccuuucccaaguucucccgccugcgucggggccucaaagccgaggcugucaagggucc

SEQ ID NO: 94978 - RNA, 63 nt, hsa
ugaguggcccuggacaaaguuguuucucucccugggccucaguuuccccaucucuagaaugag

SEQ ID NO: 94979 - RNA, 63 nt, hsa
caccccaaaagcagcuccaacagaauggccagagggccucagggagcugcaaaacucauccag

SEQ ID NO: 94980 - RNA, 63 nt, hsa
ccucuggggaaagagcacaggaacugaguugcugggccucaaaacaaaaggcugcaggcacau

SEQ ID NO: 94981 - RNA, 64 nt, hsa; identical to SEQ ID NO: 84377

SEQ ID NO: 94982 - RNA, 64 nt, hsa; identical to SEQ ID NO: 84378

SEQ ID NO: 94983 - RNA, 64 nt, hsa; identical to SEQ ID NO: 84379

SEQ ID NO: 94984 - RNA, 64 nt, hsa; identical to SEQ ID NO: 84380

SEQ ID NO: 94985 - RNA, 64 nt, hsa; identical to SEQ ID NO: 84381

SEQ ID NO: 94986 - RNA, 64 nt, hsa; identical to SEQ ID NO: 84382

SEQ ID NO: 94987 - RNA, 64 nt, hsa; identical to SEQ ID NO: 84383

SEQ ID NO: 94988 - RNA, 64 nt, hsa; identical to SEQ ID NO: 84384

SEQ ID NO: 94989 - RNA, 64 nt, hsa; identical to SEQ ID NO: 84385

SEQ ID NO: 94990 - RNA, 64 nt, hsa; identical to SEQ ID NO: 84386

SEQ ID NO: 94991 - RNA, 64 nt, hsa; identical to SEQ ID NO: 84387

SEQ ID NO: 94992 - RNA, 64 nt, hsa; identical to SEQ ID NO: 84388

SEQ ID NO: 94993 - RNA, 64 nt, hsa; identical to SEQ ID NO: 84389

SEQ ID NO: 94994 - RNA, 64 nt, hsa; identical to SEQ ID NO: 84390

SEQ ID NO: 94995 - RNA, 64 nt, hsa; identical to SEQ ID NO: 84391

SEQ ID NO: 94996 - RNA, 64 nt, hsa; identical to SEQ ID NO: 84392

SEQ ID NO: 94997 - RNA, 64 nt, hsa; identical to SEQ ID NO: 84393

SEQ ID NO: 94998 - RNA, 64 nt, hsa; identical to SEQ ID NO: 84394

SEQ ID NO: 94999 - RNA, 64 nt, hsa; identical to SEQ ID NO: 84395

SEQ ID NO: 95000 - RNA, 64 nt, hsa; identical to SEQ ID NO: 84396

SEQ ID NO: 95001 - RNA, 64 nt, hsa; identical to SEQ ID NO: 84397

SEQ ID NO: 95002 - RNA, 64 nt, hsa; identical to SEQ ID NO: 84398

SEQ ID NO: 95003 - RNA, 64 nt, hsa; identical to SEQ ID NO: 84399

SEQ ID NO: 95004 - RNA, 64 nt, hsa; identical to SEQ ID NO: 84400

SEQ ID NO: 95005 - RNA, 64 nt, hsa; identical to SEQ ID NO: 84401

SEQ ID NO: 95006 - RNA, 64 nt, hsa; identical to SEQ ID NO: 84402

SEQ ID NO: 95007 - RNA, 64 nt, hsa; identical to SEQ ID NO: 84403

SEQ ID NO: 95008 - RNA, 64 nt, hsa; identical to SEQ ID NO: 84404

SEQ ID NO: 95009 - RNA, 64 nt, hsa; identical to SEQ ID NO: 84405

SEQ ID NO: 95010 - RNA, 64 nt, hsa; identical to SEQ ID NO: 84406

SEQ ID NO: 95011 - RNA, 64 nt, hsa; identical to SEQ ID NO: 84407

SEQ ID NO: 95012 - RNA, 64 nt, hsa; identical to SEQ ID NO: 84408

SEQ ID NO: 95013 - RNA, 64 nt, hsa; identical to SEQ ID NO: 84409

SEQ ID NO: 95014 - RNA, 64 nt, hsa; identical to SEQ ID NO: 84410

SEQ ID NO: 95015 - RNA, 64 nt, hsa; identical to SEQ ID NO: 84411

SEQ ID NO: 95016 - RNA, 64 nt, hsa; identical to SEQ ID NO: 84412

SEQ ID NO: 95017 - RNA, 64 nt, hsa; identical to SEQ ID NO: 84413

SEQ ID NO: 95018 - RNA, 64 nt, hsa; identical to SEQ ID NO: 84414

SEQ ID NO: 95019 - RNA, 64 nt, hsa; identical to SEQ ID NO: 84415

SEQ ID NO: 95020 - RNA, 64 nt, hsa; identical to SEQ ID NO: 84416

SEQ ID NO: 95021 - RNA, 64 nt, hsa; identical to SEQ ID NO: 84417

SEQ ID NO: 95022 - RNA, 64 nt, hsa; identical to SEQ ID NO: 84418

SEQ ID NO: 95023 - RNA, 64 nt, hsa; identical to SEQ ID NO: 84419

SEQ ID NO: 95024 - RNA, 64 nt, hsa; identical to SEQ ID NO: 84420

SEQ ID NO: 95025 - RNA, 64 nt, hsa
gcaugguguucaauaggcugggaguuuuauuuaucucuucaaacuuuguacaagagcucauggc

SEQ ID NO: 95026 - RNA, 64 nt, hsa
acuauuuuuaaaaagugcuuacugugcacagauacucuucaagcacuggacguggauucucucu

SEQ ID NO: 95027 - RNA, 64 nt, hsa
uuuuuguuuaggauaaauagguaagcacaaagagcucuucaaaaucagaaaaaacaauaggagu

SEQ ID NO: 95028 - RNA, 64 nt, hsa
uacaguaaauauugaugacaaugacagcuuuuaacucuucaagucaccuaaagcuauuaugcag

SEQ ID NO: 95029 - RNA, 64 nt, hsa
ucccagcaacaucagcucugucagcuccuugcugcucuucaacaccaccgagaaccuguauggc

SEQ ID NO: 95030 - RNA, 64 nt, hsa
agccacgagccaaggugggcacuugaugucggaucucuucaacaagcuggucaugaggcgcaag

SEQ ID NO: 95031 - RNA, 64 nt, hsa
uauccucucucucucuaugacuaucacacacuuucucuucaaugaaaaaaucgaauugguggcu

SEQ ID NO: 95032 - RNA, 64 nt, hsa
cuaaugauuccgcgcggagaccuccugacaacgucucuucaagcauccucagaagccucgacug

SEQ ID NO: 95033 - RNA, 64 nt, hsa
cguuugcaguuucucucuguguugugauucccuucucuucaacguuuucaguacguguuucucu

SEQ ID NO: 95034 - RNA, 64 nt, hsa
auucccuucucuucaacguuuucaguacguguuucucuucaauaaacuucauucaguguuccag

SEQ ID NO: 95035 - RNA, 64 nt, hsa
uucuccuaaggucuggccuugccccuuugcucugccccugaagucuaucugcaggauggucuuc

SEQ ID NO: 95036 - RNA, 64 nt, hsa
cucaugucugcuaaaacagccaucuucaagacagccccugaaaagagaccaguucagguccugc

SEQ ID NO: 95037 - RNA, 64 nt, hsa
aagaauuagagaauaaaccaggccuguuucuuuuccccugaaaucccugccucuggcuuccuaa

SEQ ID NO: 95038 - RNA, 64 nt, hsa
gagugcccagggcugauauauauuggaaauaucaccccugaagccaucgcuggcccccaccucc

SEQ ID NO: 95039 - RNA, 64 nt, hsa
aaaagcaggggccagggagggggcgacuugccugccccugaagcccuuguucccauuggcccca

SEQ ID NO: 95040 - RNA, 64 nt, hsa
ugccuggggggaggggaggagcacccccucagccccccugaaccugaccaaaagccauggcugu

SEQ ID NO: 95041 - RNA, 64 nt, hsa
caggagcgccuccagggccccgcccacucucccaccccugaagcugcacucccacccaccuagc

SEQ ID NO: 95042 - RNA, 64 nt, hsa
gaggcuuccuuggggcggggggagggcaccucagccccugaagacaagcagcacugcaguggca

SEQ ID NO: 95043 - RNA, 64 nt, hsa
aaguuuuaaacucacauccauauuacaccuuuccccccugaaauguauagaauccauuugucau

SEQ ID NO: 95044 - RNA, 64 nt, hsa
guagccgguuccccggccacgacucugggcacuuccccugaagcuccucuccggagcuugacuu

SEQ ID NO: 95045 - RNA, 64 nt, hsa
gaacuaaaaacuccuuaacuuacuguugcuuacaccccugaaagucuguuuuuaagcaaauggg

SEQ ID NO: 95046 - RNA, 64 nt, hsa
uuuuaacccuuuuaaaagagaccuauguugaaaaccccugaaaauucacugaagaaaaaucauu

SEQ ID NO: 95047 - RNA, 64 nt, hsa
ugaaggauuuuagaaaucauauaucucuucuaacccccugaaauccugaguuuaaguggcuuga

SEQ ID NO: 95048 - RNA, 64 nt, hsa
cagcuuccugcucuuucuccuuuuugcuuucuuaccccugaaagagggaaggacaagucaccuc

SEQ ID NO: 95049 - RNA, 64 nt, hsa
uagcuucaucaguccuuccuuccuaaucucuaauccccugaagccuaacacaguuccuaaugug

SEQ ID NO: 95050 - RNA, 64 nt, hsa
uggaggguagggcugugguuuacuccugucuaaaccccugaagccuaacacaguuccuggcaca

SEQ ID NO: 95051 - RNA, 64 nt, hsa
agcugacagaaguuauaccuuacuccuuuccuuuccccugaacaaaccugcuaaucccacuaau

SEQ ID NO: 95052 - RNA, 64 nt, hsa
ggaaggagggaggaaauaugucccuugcacaccaccccugaagcacauggcaguaggaaacagc

SEQ ID NO: 95053 - RNA, 64 nt, hsa
ggaugugcaaaugaaaauugaaggaaagaauaugaacugagaaauguucuuuggcagugauaua

SEQ ID NO: 95054 - RNA, 64 nt, hsa
uucuucagcuaagguuaauuugacgcuaugauaaaacugagagaugucaaaaagccucuuagaa

SEQ ID NO: 95055 - RNA, 64 nt, hsa
ccauccuaugcaguauuugggaaaguucacaagaaacugagaagaaaccuaaaaacuguggaua

SEQ ID NO: 95056 - RNA, 64 nt, hsa
aggcuggaaaacacugauguggacucaguaugauaacugagaugggggacgccagacaugugag

SEQ ID NO: 95057 - RNA, 64 nt, hsa
cucugacccaggccugucacuuugagaggggcaaaacugagaggggcuuuuccuagagaaagag

SEQ ID NO: 95058 - RNA, 64 nt, hsa
cucuuucuuauucuacuacacaagccgccaacucaacugagagcuaaagagacuagaaaagaga

SEQ ID NO: 95059 - RNA, 64 nt, hsa
uaaagagacuagaaaagagauaagcugccaacucaacugagaacaagaaacuagaagagauuua

SEQ ID NO: 95060 - RNA, 64 nt, hsa
ucaggaaauaugcuacugguugccacugacuucaaacugagagcacuugggaaauagcacaugc

SEQ ID NO: 95061 - RNA, 64 nt, hsa
ccauccccaagaaucucaucaaccagggaagaggaacugagaucacagggaaggagauuggagg

SEQ ID NO: 95062 - RNA, 64 nt, hsa
gauaguuaccuaaggcuuuguggcaaugaccuugaacugagagccuguaucuggauuuagcacu

SEQ ID NO: 95063 - RNA, 64 nt, hsa
gauuuugaaaaucagaucugaggccuagaagagaaacugagagcucucucauuccaggaagccu

SEQ ID NO: 95064 - RNA, 64 nt, hsa
aggcaaaaacuagugggaaauguguagaacuguuaacugagauggcuucgagucuuccuucugg

SEQ ID NO: 95065 - RNA, 64 nt, hsa
uaugugaaaacagacaauauuaguuuaggucgggaacugagauauuguaaucaaauaguuaaca

SEQ ID NO: 95066 - RNA, 64 nt, hsa
gagagguuggaaggggugguuggaaggggagagaaacugagauggcccucugugacucgacugc

SEQ ID NO: 95067 - RNA, 64 nt, hsa
aaucgcuugagcccgggaagcagagguugcagugaacugagauagugauagugccacugcaauu

SEQ ID NO: 95068 - RNA, 64 nt, hsa
ugaauuugaaaauuugucuguauuuaauggccugaacugagaguugauauggccaaagggagag

SEQ ID NO: 95069 - RNA, 64 nt, hsa
gaucacuugagccugggagguugaggcugcagugaacugagaucacgacacugcacuccagccu

SEQ ID NO: 95070 - RNA, 64 nt, hsa
gcucuuugaaaauuucuuuuuacacguguaagccaacugagauaccgugaugguguugauuucu

SEQ ID NO: 95071 - RNA, 64 nt, hsa
aggcugacauaaaguuuacgaggacugcuacuauaacugagagugcugaccaagcaaagaaaca

SEQ ID NO: 95072 - RNA, 64 nt, hsa
gaaugaguucauggggagauucuguaaagugaugaacugagaugaaagcagccaacagcccagg

SEQ ID NO: 95073 - RNA, 64 nt, hsa
ugugaagauggagcagagucaaaucugugcuucuaacugagaugagaguguauuaaucacguau

SEQ ID NO: 95074 - RNA, 64 nt, hsa
agaaggaggguugugcccacuucauagaugagaaaacugagaggugaggugacuugccuggggc

SEQ ID NO: 95075 - RNA, 64 nt, hsa
aauugcuugaacccaggagguggagguugcagugaacugagacugcgccacggcacuccagccu

SEQ ID NO: 95076 - RNA, 64 nt, hsa
gccgacaaugguagcuucucaaguuaugaaauaaaacugagagauaauggagaaaauaauuuuu

SEQ ID NO: 95077 - RNA, 64 nt, hsa
ugaugcauggggaaggauguuuuuggacauuaucaacugagauaggugggaaaccuccucucau

SEQ ID NO: 95078 - RNA, 64 nt, hsa
cugccugagaaccuaaauuucagcaacagugaaaaacugagaugaaagauguauaauguagaga

SEQ ID NO: 95079 - RNA, 64 nt, hsa
gaaaacuaauucaauuuuuuuuugaacaaaguauaacugagacuauuuuuggagcuuaagauuu

SEQ ID NO: 95080 - RNA, 64 nt, hsa
acuaccaaggaccaguccaccugaaccacacacucuaaagaaauauuuuuuaagauaacuuuua

SEQ ID NO: 95081 - RNA, 64 nt, hsa
ugaaauagaaguucaggguuccucacucuagucacuaaagaaggauuuuacucucccagcccag

SEQ ID NO: 95082 - RNA, 64 nt, hsa
gcgaaaggguuaugcaaaucucaggguguugccucuaaagaaucuaaagaauagacaugcuuug

SEQ ID NO: 95083 - RNA, 64 nt, hsa
uuaugcaaaucucaggguguugccucuaaagaaucuaaagaauagacaugcuuugggcuuacuc

SEQ ID NO: 95084 - RNA, 64 nt, hsa
uuguagauggcaucuuuuuaaaaaguuauauuuucuaaagaaaaaaauaaaaaaaguuguauuu

SEQ ID NO: 95085 - RNA, 64 nt, hsa
aaaggaugagcaauuauuauuggcaucaugauuucuaaagaagagcuuugaguugguauuuuuc

SEQ ID NO: 95086 - RNA, 64 nt, hsa
agaaaaauaauuaaucucucuggaaaaaggaaagcuaaagaagacuaugauaccauacccaucu

SEQ ID NO: 95087 - RNA, 64 nt, hsa
aaccacagguauucaguuucuuguauuaugauuucuaaagaaaaccuauuaaauauuuggaauu

SEQ ID NO: 95088 - RNA, 64 nt, hsa
cuuauuagaaacgauuccggauggcauuggaaaacuaaagaaacugucaaucuugaagguggau

SEQ ID NO: 95089 - RNA, 64 nt, hsa
auuuuaacagacccugccuaaaagcauuggaaaacuaaagaaguugagcaacuugaaugcagac

SEQ ID NO: 95090 - RNA, 51 nt, hsa
guuugauggccugcauuugagcuaaagaaugaacuucugucugccucgugg

SEQ ID NO: 95091 - RNA, 64 nt, hsa
uaggaagauguugcuauucacguuaguaaacagccuaaagaaacucuuagguuuacugcuacau

SEQ ID NO: 95092 - RNA, 64 nt, hsa
agaauggguauggaaugaaucaaauacuucaucacuaaagaauucuuguuauuuaauaucaaau

SEQ ID NO: 95093 - RNA, 64 nt, hsa
guuuuauuuuggucucuuccauagcuuauuaacacuaaagaaaacaauuacauucuuauacaau

SEQ ID NO: 95094 - RNA, 64 nt, hsa
guugcauaacagcauguaacauaacacuauuugucuaaagaauggggaaagagaagcgguuguc

SEQ ID NO: 95095 - RNA, 64 nt, hsa
guugaugagaaaggggagccaaggcuuuauacgucuaaagaaaauauucaguagcugaauccgc

SEQ ID NO: 95096 - RNA, 64 nt, hsa
aaaugcuacaauaguuuuuuaucuauaaaauuaucuaaagaaucauugucuuucagagacucau

SEQ ID NO: 95097 - RNA, 64 nt, hsa
uuuguauauuaagagaggagcucauuucagauuccuaaagaaauagacauuuuacuguuauuuu

SEQ ID NO: 95098 - RNA, 64 nt, hsa
ccuuuucuaaaaagucaauucaucuaguuaagucgcugaacaauuaccugccaaaugcuauacu

SEQ ID NO: 95099 - RNA, 64 nt, hsa
auuccugcaaaauuaccuaccccaguucaucucugcugaacauuuggaaaccaugcacuagcca

SEQ ID NO: 95100 - RNA, 64 nt, hsa
ggcccugguguugcauuuagcccuggggcauggagcugaacaguacuugugcaggauuguugug

SEQ ID NO: 95101 - RNA, 64 nt, hsa
uguuuaaccaagccauagcccaugccuuuugagggcugaacaaauaagggacuuacugauaauu

SEQ ID NO: 95102 - RNA, 64 nt, hsa
gcccuccgagguggagcagcagcuacaagcagaggcugaacaccugcggaaggagcuggagaau

SEQ ID NO: 95103 - RNA, 64 nt, hsa
gcccuccgagguggaacagcagcuacaagcagaggcugaacaccugcggaaggagcuggagaau

SEQ ID NO: 95104 - RNA, 64 nt, hsa
agcuuccugucaagcaaucaagaaacaaacaaaagcugaacacauuucuuuuuaaaaaaaggag

SEQ ID NO: 95105 - RNA, 64 nt, hsa
ugcuuaccuugguuggaagggaauagaaauguuugcugaacauuggagaaucucaacaugucuc

SEQ ID NO: 95106 - RNA, 64 nt, hsa
gccacggaguuugggggccacagcaccugggcacacacccgagcaccuguccauuggcaugcuu

SEQ ID NO: 95107 - RNA, 64 nt, hsa
gggggauuuuccaggccaggagaaccucguggagacacccgagaugagccacuucuggggcucc

SEQ ID NO: 95108 - RNA, 64 nt, hsa
auaaacacugagcugccaaaacauuuuuuuaaauacacccgaggagcccaagggggaagggcaa

SEQ ID NO: 95109 - RNA, 64 nt, hsa
gauuuauacauaaaccuaaaagcauuugaacaugacacccgaacacauacauauauguucacuu

SEQ ID NO: 95110 - RNA, 64 nt, hsa
cgucccgacgucacgacgccugucccgaugucuuacacccgaguguuagcccuaggcuccugua

SEQ ID NO: 95111 - RNA, 64 nt, hsa
aauucuuaaaaggcccauagcagccaguucaaaaacacccgacgucauguauuugagcauauca

SEQ ID NO: 95112 - RNA, 64 nt, hsa
aagguggcacggugguacugggggugcggcagggacacccgaccacaccagagcgugggagacg

SEQ ID NO: 95113 - RNA, 64 nt, hsa
ggcaugcacgcaaggaauugggguggcacacgggacacccgagagcuccaggagccccgugaac

SEQ ID NO: 95114 - RNA, 64 nt, hsa
uuccaccauuuagguuccagcaccaagcaaacuaacacccgacucaguguaaacagccaaacaa

SEQ ID NO: 95115 - RNA, 64 nt, hsa
aggcacagcacagcagugacucggugaggggaggacacccgacugugcacacuuccaggccucc

SEQ ID NO: 95116 - RNA, 64 nt, hsa
agcguaugaaauucuaagcugggugggguggcucacacccgacguaaucccagcacguugggag

SEQ ID NO: 95117 - RNA, 64 nt, hsa
ccgucugauuuuagguuccaggaacuuccugagaacacccgaucgcagaggguaauuuucugga

SEQ ID NO: 95118 - RNA, 64 nt, hsa
aauuauuagaccccggggcagucaggugcuccggacacccgaaggcaauaaaacaggagccgug

SEQ ID NO: 95119 - RNA, 64 nt, hsa
cuggauucgugacaacaugcgaccgugaccaggaacacccgacuccucaaaagcaaaugagauc

SEQ ID NO: 95120 - RNA, 64 nt, hsa
auguagacagacuuuguauaguucacuuacucuuacacccgacgcuuaccagcggggacaccaa

SEQ ID NO: 95121 - RNA, 64 nt, hsa
uagccugauguggaguggaggguuccugcacccuacacccgagcccauccagccucugggccau

SEQ ID NO: 95122 - RNA, 64 nt, hsa
gagaggugccagcaauugcugaagguggcgaugaacacccgaaggugggagggaggacugguac

SEQ ID NO: 95123 - RNA, 64 nt, hsa
cucgggcaggaggggagguggcuuccuccaaaggacacccgauggcaggugccuagggggugug

SEQ ID NO: 95124 - RNA, 64 nt, hsa
aacacccccgugcucugcaccagccucucccuccacacccgaagcaggcguccaucuguguccu

SEQ ID NO: 95125 - RNA, 64 nt, hsa
gggaggcccagcgcggacauccccugcuggccggacacccgacuccaguccaagucucgcuaca

SEQ ID NO: 95126 - RNA, 64 nt, hsa
uaauggcuuuuuugaaaguuccuuuuucaugaacacacccgagaaaucuuaaauagacacuuug

SEQ ID NO: 95127 - RNA, 64 nt, hsa
gggcaggugaaaccagaauaugugaacugaguggacacccgaggcugccacuggaaugucuucu

SEQ ID NO: 95128 - RNA, 64 nt, hsa
acaagggccgcacggugcugcagaagguggugggacacccgagcugcacguuccuauacggccc

SEQ ID NO: 95129 - RNA, 64 nt, hsa
ggauuguaaauaucuuuuauguccucuagauaaaacacccgauuaacagauguuaaaccuuuua

SEQ ID NO: 95130 - RNA, 64 nt, hsa
uucuagcauuguuugcaagagugaaagaguggaaacacccgaaguguccaucaguaagggacag

SEQ ID NO: 95131 - RNA, 64 nt, hsa
gaauucaccguguguacugagugcaguuuuuuucacacccgaaagucuuuacuggcuuucauag

SEQ ID NO: 95132 - RNA, 60 nt, hsa
ucaugccugcccagaaaugaagcccggcccacacccgacaccagcccugcugcuuccuaa

SEQ ID NO: 95133 - RNA, 64 nt, hsa
gcugugaaccagccccgcucaccugccagccccaacacccgacgggggccgaggccaggcugcc

SEQ ID NO: 95134 - RNA, 64 nt, hsa
ggaccuuauugaugaaagaaaccgucuuugcguuacacccgagucugccucucggagcagggag

SEQ ID NO: 95135 - RNA, 64 nt, hsa
cagugggaagugguaggacucuggaagaggccacacacccgagagcugcgagaucugugcaagu

SEQ ID NO: 95136 - RNA, 64 nt, hsa
ccgaugguugagggauugucacgggaggaacaugacacccgaagggacucuaggugcccucgga

SEQ ID NO: 95137 - RNA, 64 nt, hsa
ucccgcaggccggaggcgcagaccuguggugaggacacccgaggccuccugggagaccugcaga

SEQ ID NO: 95138 - RNA, 64 nt, hsa
auggccaugcccuagacccuccccaaggaugaccacacccgaaguccugucacugagcacaguc

SEQ ID NO: 95139 - RNA, 64 nt, hsa
ccuuucugugccccccagguucuaucuccccgucacacccgaggccuggcuucaggagggagcg

SEQ ID NO: 95140 - RNA, 62 nt, hsa
ccuccauugcucuccaaaagccaauaaagugauuacacccgaugcaccuggcucuguggugg

SEQ ID NO: 95141 - RNA, 64 nt, hsa
uccugcccuguggaaugggcucaagguuccugagacacccgauuccugcccaaacagcuguauu

SEQ ID NO: 95142 - RNA, 53 nt, hsa
gcguggcgaagcugagcugacggacacccgacggccgccugcugcugccgcuc

SEQ ID NO: 95143 - RNA, 52 nt, hsa
cugcaguccgccgggccugagcacacccgaggcucccaccugcggagccgcu

SEQ ID NO: 95144 - RNA, 64 nt, hsa
aaguaccaucaucacugccagagcucaagaucccacacccgacaugacauaaauaaaaaaauaa

SEQ ID NO: 95145 - RNA, 64 nt, hsa
gacaaagagacagaguccccacuagcaucuccugacacccgaggagcccugagucacccugaga

SEQ ID NO: 95146 - RNA, 64 nt, hsa
ugcucugggaccugccccucacguucucuuggggacacccgagccaggacacuacgcaucccug

SEQ ID NO: 95147 - RNA, 50 nt, hsa
gccaggcacaugccccuugaacacccgaugcuacgugucccaaaggaaac

SEQ ID NO: 95148 - RNA, 64 nt, hsa
aaaguucauuuccaaggggaaucaggagcgagccacacccgaaugguagaaagaucucaggguu

SEQ ID NO: 95149 - RNA, 64 nt, hsa
gaagaugaagcacacaggaaccuaaugggccaacugggaugaggugacuauucugagaugacua

SEQ ID NO: 95150 - RNA, 64 nt, hsa
uucaguuuaucuguucauauggauaaauauugguugggaugacuuggugucuaauguguagugc

SEQ ID NO: 95151 - RNA, 64 nt, hsa
uguaaagcagaacuaaugcugacuggauguuuaaugggaugagcauuaaagcugcaaucuacua

SEQ ID NO: 95152 - RNA, 64 nt, hsa
auuuucagucccugaucucuccugucccuuuuccugggaugacagcccuaacaagaacuguuuu

SEQ ID NO: 95153 - RNA, 64 nt, hsa
cugugugaccucccccaagccaaccacuuucaccugggaugacuuucgauuaugcuuuguuuug

SEQ ID NO: 95154 - RNA, 64 nt, hsa
ugcuucugcccccuccugauuucccuaaggagccugggaugauguuggucaaaugaccuagaaa

SEQ ID NO: 95155 - RNA, 64 nt, hsa
ccuucaugauacuagguuuguacuuccuggucucugggaugacuucagauucugcuggccaagg

SEQ ID NO: 95156 - RNA, 64 nt, hsa
uugcuucuagggaguuagcauguagaugggauauugggaugaggaaaggaaaaucagguagaug

SEQ ID NO: 95157 - RNA, 64 nt, hsa
acuuaguauagcuccucagccauaaccugagacuugggaugaaauuuaaaccagauacgauuua

SEQ ID NO: 95158 - RNA, 64 nt, hsa
uaguuacuuaacuaaugaagacauuucagaacucugggaugauuuuaaucuugaaguaguaggu

SEQ ID NO: 95159 - RNA, 64 nt, hsa
ggagaaccucauccagcuccccuucugaaucagcugggaugacuggcuuugagaaggaagggaa

SEQ ID NO: 95160 - RNA, 64 nt, hsa
ugaguccccugugagauuuugcuuuuccacugccugggaugaugcaguuugaagaggcccuugg

SEQ ID NO: 95161 - RNA, 64 nt, hsa
accuacucaagaaaagacagaagagacagugauuugggaugagucuacucuaggauuuucaacu

SEQ ID NO: 95162 - RNA, 64 nt, hsa
aucuguugaagaaaggacagaagaggaaaugcuuugggaugagucuauucuuggauuuugaaug

SEQ ID NO: 95163 - RNA, 64 nt, hsa
uuaauuuugcuucuuuuagguucguucuuauuuaaagcaauaugauugugugacuccuuguagu

SEQ ID NO: 95164 - RNA, 64 nt, hsa
cagccauuuauuaauaugggaauuuaacuuacucaagcaauaguugaagggaaggugcauauua

SEQ ID NO: 95165 - RNA, 64 nt, hsa
gcaauuuucaaucaagccugucccauggagacacaagcaauagugacaugagcacuugacucgc

SEQ ID NO: 95166 - RNA, 64 nt, hsa
cuugaaaaaugaaaguauuuggacauacagacagaagcaauauuauucaggucuuccuuguugc

SEQ ID NO: 95167 - RNA, 64 nt, hsa
accauauuauuugauuacuguguuagaauuucauaagcaauaauuaaaugugucuuuauagaua

SEQ ID NO: 95168 - RNA, 64 nt, hsa
aagaucagacaacacacuaucuuuucaaugaaaaaagcaauaaugauccauacauacuauaagg

SEQ ID NO: 95169 - RNA, 64 nt, hsa
uaguucucaaaugggcuaggccuuuuuuauauugaagcaauaauuccauuuuuacccuuugaaa

SEQ ID NO: 95170 - RNA, 64 nt, hsa
uuccuugauuuccaggauaguuuuucaaauaggaaagcaauaauggcaguaguucucaaauggg

SEQ ID NO: 95171 - RNA, 64 nt, hsa
augaggucuuaaaaugcuggguuuuuuuuuuuucaagcaauauaauaggucuuagaucugaaaa

SEQ ID NO: 95172 - RNA, 64 nt, hsa
gaauuuuuagugauaaaauacauuuguaaguguaaagcaauacagcauaauagaauagaauaua

SEQ ID NO: 95173 - RNA, 64 nt, hsa
uagaggaugccagcuuuaaucuuucugucauuuaaagcaauaugauaaggguauucaauaauug

SEQ ID NO: 95174 - RNA, 64 nt, hsa
uuuuccuuuguuuuaaaacugugguuuuuuaaaaaagcaauaauuaacucagaccucacuaaaa

SEQ ID NO: 95175 - RNA, 64 nt, hsa
aaccuuuuugcaacuaggaacauauacaguaaacaagcaauacaucaccaacgagcauucuuuc

SEQ ID NO: 95176 - RNA, 64 nt, hsa
gcagagauggaaauaaugcgccucuugaggagaaaagcaauaaugaauaaaaggacuuuccuac

SEQ ID NO: 95177 - RNA, 64 nt, hsa
ucuagucuugaagucccucauuuaaacagaggucaagcaauaggcgccuggcagugucaagccu

SEQ ID NO: 95178 - RNA, 64 nt, hsa
gcaauaggcgccuggcagugucaagccugaaaccaagcaauaccgucauguuucagccaagccc

SEQ ID NO: 95179 - RNA, 64 nt, hsa
acauuagagaaaauguuuuuaaagaagccagcucaagcaauauuaaugaaguagguuccaguac

SEQ ID NO: 95180 - RNA, 64 nt, hsa
ucaaaacgaaagcugaaccuauaagcagcaguauaagcaauauggaacucgaauuaaauaucca

SEQ ID NO: 95181 - RNA, 64 nt, hsa
uauagaauuucuauuaaggauuuuuuaaauggacaagcaauaggggguugaaguguuuaucuga

SEQ ID NO: 95182 - RNA, 64 nt, hsa
uuuaagacuuuugaccauaguguuuuccaguuuaaagcaauaacuuucauaguuucuuucaaag

SEQ ID NO: 95183 - RNA, 64 nt, hsa
ugccaucccccucccucccugggcccggcccuggacccgucaggugccuguccccagccccaac

SEQ ID NO: 95184 - RNA, 64 nt, hsa
uauaagccgagggcucagggagccuaacugcgggacccgucagggccccgugacccauccccgu

SEQ ID NO: 95185 - RNA, 64 nt, hsa
uaacugcccagcggacaguggcaggacaggaaaaacccgucaauguacuaggauacugcugcgu

SEQ ID NO: 95186 - RNA, 64 nt, hsa
gugcaaagggcuuagcuaaguuaucgagcuuaaaacccgucaauuaaacaaacauuauuugaac

SEQ ID NO: 95187 - RNA, 64 nt, hsa
uuacaggagugagagucuggugagcccacucuucacccgucaggcccuggccgcaauggacaag

SEQ ID NO: 95188 - RNA, 64 nt, hsa
ccuugucgagggaaagagacccagaaaggacacaacccgucagagaccugggagcaggggcaau

SEQ ID NO: 95189 - RNA, 64 nt, hsa
ugcuccacacccuaaaacaagccucagccaggcaacccgucagucugucuccauccuuucaccc

SEQ ID NO: 95190 - RNA, 64 nt, hsa
ccaugacucuccaguguuuuuucuguuggaccacacccgucacaguucacaguuccaaagagaa

SEQ ID NO: 95191 - RNA, 64 nt, hsa
uaugugaccaauuuuacuggaugcaauugacaggacccgucaucauaauuaaacaacccauauu

SEQ ID NO: 95192 - RNA, 64 nt, hsa
ccuggcagcagggacgacgggacuuacgauuccaacccgucagcauaggugacaccuccuuccc

SEQ ID NO: 95193 - RNA, 64 nt, hsa
ugacgugggccagccuccuugagacacaccuggcacccgucaucggccagcgguggaugcugca

SEQ ID NO: 95194 - RNA, 64 nt, hsa
gcggaccaucggcuggcagagcccagcggccaccacccgucaacccugccaggagcugagggca

SEQ ID NO: 95195 - RNA, 64 nt, hsa
ccauagauucaccauugccucuaauggugucuacacccgucauacuaccagcugagaugguggu

SEQ ID NO: 95196 - RNA, 64 nt, hsa
cucuccuaaagacaaagguuagucugaucuccagacccgucagaauggaauacacagcccacau

SEQ ID NO: 95197 - RNA, 64 nt, hsa
guugccgcacacauuccucucagcuccgccccauacccgucacuacagccucaccucccacccc

SEQ ID NO: 95198 - RNA, 64 nt, hsa
acgggguucaguaugacacagaaucauggacuuaacccgucauguucugguuugagauuuagug

SEQ ID NO: 95199 - RNA, 64 nt, hsa
uggaugcaaugcaggcccuggaggacugugcgucacccgucaaccagagcgugccuccgggcca

SEQ ID NO: 95200 - RNA, 64 nt, hsa
gccgugggguucacuuacgguagcgacuauuacgacccgucagagccgacggaggaggaggagc

SEQ ID NO: 95201 - RNA, 64 nt, hsa
uaauucagcugcuacauccaagcacugaagucuuacccgucaacuuuuuuuuuuuuuuaaauaa

SEQ ID NO: 95202 - RNA, 64 nt, hsa
cgucaaguuucugguuuuucucugcucucauuuaacccgucaaacacaaucuuuguaaagcuag

SEQ ID NO: 95203 - RNA, 64 nt, hsa
aaacggugaaaaguacucccagacggacgcgggcacccgucaugcuuuugcugagaguuggggg

SEQ ID NO: 95204 - RNA, 64 nt, hsa
auggggcccugccaacaccacuuccucagcagaaacccgucaugacgcggcugcuucggaagca

SEQ ID NO: 95205 - RNA, 64 nt, hsa
gaaucuuuguaauuacuuaauauguuaguuaagaacccgucaagcuuauauuugcuagacuuac

SEQ ID NO: 95206 - RNA, 64 nt, hsa
auuugaccaugagcaccacaccaccauuguggccacccgucacuaucgcccgccugaggugauc

SEQ ID NO: 95207 - RNA, 64 nt, hsa
cccgguguguucuuguauagucaguggcaucagcacccgucagccggccuuuuccuucagguuc

SEQ ID NO: 95208 - RNA, 64 nt, hsa
aaccuguggcuaaaaauuuuauuuucuauccuuuacccgucauuaucauuaguugcuaugauuc

SEQ ID NO: 95209 - RNA, 64 nt, hsa
gaagcaagaugcacaggcgggcggcuucccacacacccgucacaagacgcggacaugcaggucu

SEQ ID NO: 95210 - RNA, 64 nt, hsa
aauuauuucccaguuaguauuaucauauguuuguacccgucacaguuuucauagugcuuucaaa

SEQ ID NO: 95211 - RNA, 64 nt, hsa
uuuucuuucgcuggaaagagggacaggggcccccacccgucaccacgccccaacacuccccccg

SEQ ID NO: 95212 - RNA, 64 nt, hsa
gcgcccagccuggaguggccuuuuaugagaggggacccgucaaaucugugccuuauggaggggu

SEQ ID NO: 95213 - RNA, 64 nt, hsa
aggccugccgaggggaggagccuggccucuguccacccgucagcagugugaagucuguuguguu

SEQ ID NO: 95214 - RNA, 64 nt, hsa
auuagcugugagaugccugugagagccuucccgcacccgucagaagcucagagccuucuuggac

SEQ ID NO: 95215 - RNA, 64 nt, hsa
ggguucaaguguguggcugggucagggcguggucacccgucauucugcauaggucggguuggau

SEQ ID NO: 95216 - RNA, 64 nt, hsa
accagagguuggagaacaaacuugggcagccggaacccgucacuauucuagacuucccuggcau

SEQ ID NO: 95217 - RNA, 64 nt, hsa
uuuccccagaaaagcuguguucccuaugcugaacacaccauacacauucucaucuggaaucuaa

SEQ ID NO: 95218 - RNA, 64 nt, hsa
acccaugguugagaugggcaccguuuugcaggaaacaccauauuaauagacauccucaccaucu

SEQ ID NO: 95219 - RNA, 64 nt, hsa
cuccuggugugugugagcaugcccuuugcuugccacaccauauccuuuccccagauccaccugu

SEQ ID NO: 95220 - RNA, 64 nt, hsa
acauccaucccaggacacagcccagccccuccccacaccauacaagguaucagaaaagucuagg

SEQ ID NO: 95221 - RNA, 64 nt, hsa
acuuaguauauuuguaauugguuuuaaaaccaauacaccauacuuucuuucugcaaacagccau

SEQ ID NO: 95222 - RNA, 64 nt, hsa
ggaagccauagaauugcucuggucaaaaccaagcacaccauagccuuaacugaauauuuaggaa

SEQ ID NO: 95223 - RNA, 64 nt, hsa
auaaauauaaaauaugguaauuggaauuaacuccacaccauaguaugcauuguuauacauacug

SEQ ID NO: 95224 - RNA, 64 nt, hsa
uguuuuauaaacgauccuguuaauuaaaccacagacaccauauauccuucugcauccuuuggcc

SEQ ID NO: 95225 - RNA, 64 nt, hsa
gaguacccucucuggucaaguaccuuugguaaauacaccauaccauaauaucugcuuggagaac

SEQ ID NO: 95226 - RNA, 64 nt, hsa
uagagacucugccuaaauugccacaccuauucacacaccauaguaguugggcacacacaucuuc

SEQ ID NO: 95227 - RNA, 64 nt, hsa
acauauaugagagagaaguguuuuucuaucauagacaccauaggggaaaguuuggggaugaagg

SEQ ID NO: 95228 - RNA, 62 nt, hsa
agccuggcaagaacaaguaauuaagaggcuugacaccauacucauucaccccaaaggcucuu

SEQ ID NO: 95229 - RNA, 64 nt, hsa
ccacucucuccuggggccgacacguugggacagcacaccauagcauaaagcuaggggaugcaug

SEQ ID NO: 95230 - RNA, 64 nt, hsa
uucuuucuuaaaaaaauaauacuaugcaggcaagacaccauaaaaguuuaauuccuuacagaag

SEQ ID NO: 95231 - RNA, 64 nt, hsa
aacagggaucacuuuuccuuuagcauucagaaugacaccauauucuuaaauauacuccuucccu

SEQ ID NO: 95232 - RNA, 64 nt, hsa
acaggaucaauuguaaagugagggcuucuccaugacaccauaguucugcccaauacugcauuug

SEQ ID NO: 95233 - RNA, 64 nt, hsa
agaacuggguuuuuguggagguucagagcaggcaacaccauaaguugcucucagauccuuguuc

SEQ ID NO: 95234 - RNA, 64 nt, hsa
cacauuacuggguaauuuuuaagacuauguacccacaccauacauacauacauauauauauaca

SEQ ID NO: 95235 - RNA, 64 nt, hsa
aauuauuaucuacguuucucucuagauauaaaaaacaccauagauccuauacacacaaaaaugg

SEQ ID NO: 95236 - RNA, 64 nt, hsa
ucucauauauauaaaauggacacguggcuauaaaacaccauauaagagaugaguagugcguuuu

SEQ ID NO: 95237 - RNA, 64 nt, hsa
uucaagcuuauuuugaaaucuuaaaaaucagguuacaccauagcuacucaaaaguuuuacacac

SEQ ID NO: 95238 - RNA, 64 nt, hsa
ggcugugguuuccaucugaaaguagagguuguauacaccauauacuguucuucauuuuauuaau

SEQ ID NO: 95239 - RNA, 64 nt, hsa
acaagggaggggaggccgagagucagacugauagacaccauaggagccgacucuuugauaugcc

SEQ ID NO: 95240 - RNA, 64 nt, hsa
ugcuagcuugaaaucugcggcaauuggaguauuuacaccauagaaaugcuauaagugaagaccu

SEQ ID NO: 95241 - RNA, 64 nt, hsa
uuucuauaaggaauacacauacacccacaugcacacaccauaguuuuuauacaaacagcaauaa

SEQ ID NO: 95242 - RNA, 64 nt, hsa
aggaaagccuugauaaaucgggaguccaaaggagacaccauauuuauggagaacauuaggacaa

SEQ ID NO: 95243 - RNA, 64 nt, hsa
ccuggaacuggcggguauucuggucauugaggagacaccauaguggaaacuggggcuuaugcug

SEQ ID NO: 95244 - RNA, 64 nt, hsa
uauaauucaaacagagcaucuuguaacugaagacacaccauaucuaugauaucgcauuagucca

SEQ ID NO: 95245 - RNA, 64 nt, hsa
ucuuuuuuaaaugaauuaaauauugaaacacuguacaccauaguuuacaauauuauguuuccua

SEQ ID NO: 95246 - RNA, 64 nt, hsa
aauccaggauguugaaugggauuauugccaucuuacaccauauuuuuguaaaauguagcuuaau

SEQ ID NO: 95247 - RNA, 64 nt, hsa
augaaagugcucaauagaauuuuuaacguuggcaacaccauaaggauuucuuauguuaaguccc

SEQ ID NO: 95248 - RNA, 64 nt, hsa
augcuguuuuggaaucaucccaaggcaucccaagacaccauaucuucccauuucaagcacugcc

SEQ ID NO: 95249 - RNA, 64 nt, hsa
aaugugaaaaaaaugcauguuuacuuaccuguauacaccauaugcaugcacuagaauuauuaac

SEQ ID NO: 95250 - RNA, 64 nt, hsa
auaaauuguccguguucauacauuugaggggaaaacaccauaagguuucguuucuguauacaac

SEQ ID NO: 95251 - RNA, 64 nt, hsa
agaguaaaagacauguccucuucugaugcauggcacaccauagucaccaagcaaauaacagagc

SEQ ID NO: 95252 - RNA, 64 nt, hsa
uaaguauuuuaaauaauuaaaacauuaaauggcaacaccauagaauauagguguucucuggacc

SEQ ID NO: 95253 - RNA, 64 nt, hsa
uaugaguggugcauuuuuaaguauagugaacaagacaccauauuaaguacagugauaaagcauc

SEQ ID NO: 95254 - RNA, 64 nt, hsa
cacuuuacucacagccuggcuugagucaacaggaacaccauagcacccacaaauacuucuacuu

SEQ ID NO: 95255 - RNA, 64 nt, hsa
gguaauugagaauguacuacgguacuucccucccacaccauacgauaaagcaagacauuuuaua

SEQ ID NO: 95256 - RNA, 64 nt, hsa
guucaagaagagaugucuucuuguugcgcugagaacaccauauguucaugacgagauuccuggc

SEQ ID NO: 95257 - RNA, 64 nt, hsa
auuagagaaaggacaggcuuuuuaugaguaacacacaccauauauaaaacagccuuucuggcug

SEQ ID NO: 95258 - RNA, 64 nt, hsa
uagauaguacccccucccuccuucaaaaaaccaaacaccauaucugaugugugaaaauaaugga

SEQ ID NO: 95259 - RNA, 64 nt, hsa
gagcaauuugucuggacuagaaaaucugaguuuuacaccauacuguuaagaguccuuuugaauu

SEQ ID NO: 95260 - RNA, 64 nt, hsa
aggaaaacaaaguucuagauagguuaaaagaaaaacaccauaaaagugguaguauauuuaagug

SEQ ID NO: 95261 - RNA, 64 nt, hsa
gguugccucucuaugcuauuguguucagauacuuacaccauaauuaaacaguaaguuauagacu

SEQ ID NO: 95262 - RNA, 64 nt, hsa
uuuuuuuuagaauuuucauuaauacuguaguuauacaccauaugccucauuuuaucauagccua

SEQ ID NO: 95263 - RNA, 64 nt, hsa
ugagauggacuguggguacugggagugaucacuaacaccauaguaaugucuaauauucacaggc

SEQ ID NO: 95264 - RNA, 64 nt, hsa
uaggucaccccagauuccuugaccuauuucugggacaccauauuucccuccucagugugcaccc

SEQ ID NO: 95265 - RNA, 64 nt, hsa
acaagucuggguauauucacuauugugagucaauacaccauagcucuguugaaauuccuggagg

SEQ ID NO: 95266 - RNA, 64 nt, hsa
auccagacauacagucaacacugagaaucagcacacaccauauuucaaauauagaagagucaug

SEQ ID NO: 95267 - RNA, 64 nt, hsa
gcuuugauauuucaauguuagccucaauuucugaacaccauagguagaauguaaagcuugucug

SEQ ID NO: 95268 - RNA, 64 nt, hsa
guaugaaaugagaguuagaccauaugggcugacaacaccauaaauaacaagaaaagggagugcu

SEQ ID NO: 95269 - RNA, 64 nt, hsa
ucagacggugaaaaaagcaaauuaacucauuuggacaccauaacucaugcaauaaaacugauug

SEQ ID NO: 95270 - RNA, 64 nt, hsa
aaauguauuuucuuuuauguucagaaauuuacagacaccauauuuguucugcauucccugccac

SEQ ID NO: 95271 - RNA, 64 nt, hsa
uccaguuucggaagauaauaaauguuuguuagauacaccauaauuucagaucaguauauucuga

SEQ ID NO: 95272 - RNA, 64 nt, hsa
uuugcaugguuuaaucagauuuuuuuuuuuuuuuacaccauauuagcuaccuuuucaauggaga

SEQ ID NO: 95273 - RNA, 64 nt, hsa
cuuguauuuaacccuuuuuuauaagcagcugaagacaccauauuuaacacuauaucucagugau

SEQ ID NO: 95274 - RNA, 64 nt, hsa
ccuuguuuaucugcuucuuaaagaaucagccgagacaccauaaaagaaauaggcuuuuugugcc

SEQ ID NO: 95275 - RNA, 64 nt, hsa
aggauaaaaggggaaauaacugccuugggcaaggacaccauagugucacagagagcuuggcaau

SEQ ID NO: 95276 - RNA, 64 nt, hsa
agaccccacagggaccucagucaccuuugagaagacaccauacucagcaaucacaagagcccgc

SEQ ID NO: 95277 - RNA, 64 nt, hsa
gcagcuucgcuuuuuugcaaaugcauucacuuugacaccauauaauggaacagaagcucuggua

SEQ ID NO: 95278 - RNA, 64 nt, hsa
cuucagggaacugcauagauugaucaaaguguaaacaccauagggacccauucuacacagagca

SEQ ID NO: 95279 - RNA, 64 nt, hsa
aaacacacacaugcguauagacauacauacauguacaccauacauagacaagcaucauaaaggc

SEQ ID NO: 95280 - RNA, 64 nt, hsa
uuguggauucuaaaauauauauauauuuauauaaacaccauauaagucaaauauguauuuaaca

SEQ ID NO: 95281 - RNA, 64 nt, hsa
uacuaguguucuguuuguuauuguuuuguuaauuacaccauaaugcuaauuuaaagagacucca

SEQ ID NO: 95282 - RNA, 64 nt, hsa
acuaugggaucacuguccccccaccuguguggccacaccauauguccugucaauccagaacugc

SEQ ID NO: 95283 - RNA, 64 nt, hsa
ggcuguuuuuguuccugccuuuagaguuccaugaacaccauaccuuugcuacuacuaugugcag

SEQ ID NO: 95284 - RNA, 64 nt, hsa
cuuuaagagccaaguauuugccagugcuuaaauuacaccauacaguucuaauuauauauaaucu

SEQ ID NO: 95285 - RNA, 64 nt, hsa
acacgggaaaugcuucucgugaagggcaaauguaacaccauaacaguagggaauaaacuguguc

SEQ ID NO: 95286 - RNA, 64 nt, hsa
auaaaacauuccugcuuuuaguuauuauguauguacaccauauaugaauaaacaguuuccaaaa

SEQ ID NO: 95287 - RNA, 64 nt, hsa
ggccacaaagaacagcucagaugcacaaagauucacaccauacaggccaaauuauagaaucccc

SEQ ID NO: 95288 - RNA, 64 nt, hsa
uaaaauacaacuguucaauggaaauagaaaauaaacaccauaaaagagagaagagagguaauuu

SEQ ID NO: 95289 - RNA, 64 nt, hsa
uagggagcaaaacuauucuucucaagcauccuuuacaccauacuuuacuucugguaugguuuau

SEQ ID NO: 95290 - RNA, 64 nt, hsa
ggaugacaaacacuauccacaucugaaaacuaccacaccauaucagggaucauaaauuaugcau

SEQ ID NO: 95291 - RNA, 64 nt, hsa
cauuccauucaccuaacuuuagacauucguuuagacaccauaacuggagugauugugcuucuag

SEQ ID NO: 95292 - RNA, 64 nt, hsa
ccauugcuagagacccacauccuacaaaauccugacaccauaaccuuaagccaugccuuuccuu

SEQ ID NO: 95293 - RNA, 64 nt, hsa
gucuggaaaacaaacaugaagcaaagaaggcacaacaccauauggaaaagcaagacagaaauau

SEQ ID NO: 95294 - RNA, 64 nt, hsa
cacaugaauaaauuugcaaaaccaagaucacaguacaccauaugcacucugguaccuuaauuuu

SEQ ID NO: 95295 - RNA, 64 nt, hsa
ugguguuuucuuauugcacugaauucaacuccagacaccauacaaagggagaugauggccauuc

SEQ ID NO: 95296 - RNA, 64 nt, hsa
ggaaauuucauuacaaugaagugccaaacucacuacaccauauaauugcagaaaagauuuucag

SEQ ID NO: 95297 - RNA, 64 nt, hsa
ggccagaaagaaagagcaauaauaauuaauucacacaccauauggauucuauuuauaaaucacc

SEQ ID NO: 95298 - RNA, 64 nt, hsa
aaaaaaagaaagccuuuugacagcuacaugacuuacaccauacagaacaguacuggacaaaagg

SEQ ID NO: 95299 - RNA, 64 nt, hsa
ucagaagaaggcuuaaucucaugggaaaguguucacaccauauuauuaaagagaaaaaacagau

SEQ ID NO: 95300 - RNA, 64 nt, hsa
uaaugaggcaucauauauccucucacucucugggacaccauagccacugcccccuccccuggau

SEQ ID NO: 95301 - RNA, 64 nt, hsa
uuuuaauuuucuaaguauuuaucacaggacuuuaacaccauauauuucccucccaguuuuucuc

SEQ ID NO: 95302 - RNA, 64 nt, hsa
auccucccauaggaaauagaauuacagguaagguacaccauacaaaaauugugucauugaggac

SEQ ID NO: 95303 - RNA, 64 nt, hsa
cauguuauguauauugucucguguuuuuauuuuuacaccauauuguauuacacuuuuaguauuc

SEQ ID NO: 95304 - RNA, 64 nt, hsa
ucucauuaucuugaaauuuuuuuaauguuugagaacaccauaagcagaauauucuaacaccuuu

SEQ ID NO: 95305 - RNA, 58 nt, hsa
auaaagacagaucagacugauaaccuuaacaccauaggugcaaaaugaguuguucuga

SEQ ID NO: 95306 - RNA, 64 nt, hsa
aggauccuggucccuguacgaccucauugaagaaacaccauaaguggcguggacuaucuaccuc

SEQ ID NO: 95307 - RNA, 64 nt, hsa
cagccucccaaguagcugggacuacaggcauguaacaccauacuuggcuaaauuaaaaaaaugg

SEQ ID NO: 95308 - RNA, 64 nt, hsa
ccuaguuauucauuguuaauauaacugucuuaguacaccauaaacuggguggauuauaaacaac

SEQ ID NO: 95309 - RNA, 64 nt, hsa
cuggggcuucuaugccuaagaccaacugcguuggacaccauaagccacagccucacaggaagug

SEQ ID NO: 95310 - RNA, 64 nt, hsa
cuguccugccuaaggcugaacuuguuuucugggaacaccauaggucaccuuuauucuggcagag

SEQ ID NO: 95311 - RNA, 64 nt, hsa
cuuccauaccccuaugucagaggaggucuuacggacaccauaggguaggaauagccuuuccuca

SEQ ID NO: 95312 - RNA, 64 nt, hsa
cauaugcagaggauugaaacugaaccacuuccuuacaccauaugcaaaaaucaacucaagaugg

SEQ ID NO: 95313 - RNA, 64 nt, hsa
cccacagccccaucugcgggggcagugcucacccacaccauaagcuacugccauccuggcccag

SEQ ID NO: 95314 - RNA, 64 nt, hsa
accuuugguccuaagucccugcccccuccccuucacaccauaacuagguaacaguuugauaacu

SEQ ID NO: 95315 - RNA, 64 nt, hsa
acagacucuuucagauggaggugccauaucacguacaccauaugcaaguuucccgccaggaggu

SEQ ID NO: 95316 - RNA, 64 nt, hsa
gggcguccgggcagcugcagcugagaggacuuucacaccauaaggagauuucuguuuuucuuuu

SEQ ID NO: 95317 - RNA, 64 nt, hsa
cccacccucccuccuuagcaggugccgugcugggacaccauacggguugguuucaccuccucag

SEQ ID NO: 95318 - RNA, 64 nt, hsa
ucaagugggaagggaaggaguucuacuugucuugacaccauagagguggcuugagaagaugucc

SEQ ID NO: 95319 - RNA, 64 nt, hsa
ugcuauaaagauaaaggugaggggaagacaaagcacaccauauguccacuguucuguucucaua

SEQ ID NO: 95320 - RNA, 64 nt, hsa
uuggcaguuaauuugcagaaguaacugacagcugacaccauaugagaaccuuuguauaaaauau

SEQ ID NO: 95321 - RNA, 64 nt, hsa
gaugugggccacucagagcuaaccaaaauguucaacaccauaacuagagacacucaaauugcca

SEQ ID NO: 95322 - RNA, 64 nt, hsa
ugucugagccacucagaacucaccaaaauguucaacaccauaacaacagcugcucaaacuguaa

SEQ ID NO: 95323 - RNA, 64 nt, hsa
caugugagccacucagaacucaccaaaauguucgacaccauaacaacagcuacucaaacuguaa

SEQ ID NO: 95324 - RNA, 64 nt, hsa
guaacaaggcuuuugggagugauucacaccuggcacaccauacuagaauucacacuggagagaa

SEQ ID NO: 95325 - RNA, 64 nt, hsa
gaauuguuucugcagauuccggauauuauaauucacaccauaaagauugugaagugguuauugg

SEQ ID NO: 95326 - RNA, 64 nt, hsa
cauguggcuuuaugugaggggacugaaugcagacacaccauagcccccuucuacuacuuucccu

SEQ ID NO: 95327 - RNA, 64 nt, hsa
uggugauuccuggaugaucauacacagaggacuuacaccauacaaaaauauugggcaccgcagu

SEQ ID NO: 95328 - RNA, 64 nt, hsa
ccaaaaagugguuaauauuaauaagacuguuuccacaccauaggcaauaauuucuuaauuuaaa

SEQ ID NO: 95329 - RNA, 64 nt, hsa
ggagcuuucuuuuauguaaauuggauaaauacacacaccauacacuauccacagauauagccaa

SEQ ID NO: 95330 - RNA, 64 nt, hsa
aauggguaggagaucuggggaggcccugcccccuacaccauacuuaucaccacccuccucuuuu

SEQ ID NO: 95331 - RNA, 64 nt, hsa
ggauggaaaaggauucuucacagagcacucuggcacaccauaucggagaaaacuugauagauua

SEQ ID NO: 95332 - RNA, 64 nt, hsa
cacugaucacaaaacccauacuacuaccucauugacaccauaccugcuaaccucgaggcuuuag

SEQ ID NO: 95333 - RNA, 64 nt, hsa
uaugaauaccaccuaaaaauacacugaauaaaguacaccauauagcauuauuuuuauaggaaau

SEQ ID NO: 95334 - RNA, 64 nt, hsa
uugugaaaacaaaagauuggaagcuguuuaaaugacaccauaucaggguucugguucccuaaau

SEQ ID NO: 95335 - RNA, 64 nt, hsa
ggcuccuuuuucauguugaucuuuaaauuuucccacaccauaagagaggagcaaaggaaauuac

SEQ ID NO: 95336 - RNA, 64 nt, hsa
uagaagaauaggggcaagacgacaaaaguaccuuugaauaaaacaauuuaagaaauugguuuaa

SEQ ID NO: 95337 - RNA, 64 nt, hsa
uauguauuuuuaguaacagaagcaucugguucugugaauaaaggaauguauagauguuuggaug

SEQ ID NO: 95338 - RNA, 64 nt, hsa
aacugggcaucuaacuguuacaccaaaucuuaagugaauaaaacuuuaccaaggcuucucaguu

SEQ ID NO: 95339 - RNA, 64 nt, hsa
cucuaguuuugccaauagaaaaugcuucuuccauugaauaaaaguuauuucaaauugaauuugu

SEQ ID NO: 95340 - RNA, 64 nt, hsa
agaagggcacaaaaugaaugaauaaauaaauaaaugaauaaagacaaaagccaagguguaugcu

SEQ ID NO: 95341 - RNA, 64 nt, hsa
guccugguucauucccagaagggcacaaaaugaaugaauaaauaaauaaaugaauaaagacaaa

SEQ ID NO: 95342 - RNA, 64 nt, hsa
uuauaccuggaugauucaggagaguguauaugaaugaauaaagcauccaaguauauaugaauga

SEQ ID NO: 95343 - RNA, 64 nt, hsa
auaugaaugaauaaagcauccaaguauauaugaaugaauaaaguauguaaguaucaccagaaaa

SEQ ID NO: 95344 - RNA, 64 nt, hsa
guaauuuugugauuugucuauauuguugcauuuaugaauaaaucauuuaucugcugcugaguag

SEQ ID NO: 95345 - RNA, 64 nt, hsa
uuugaugauggacauuaauaguucuaggcuauuaugaauaaaguuuccaugaacaucuauguac

SEQ ID NO: 95346 - RNA, 64 nt, hsa
gcagguuuuucuaugggcauguuuuuaauucauuugaauaaauaccaagagcuucagugcugga

SEQ ID NO: 95347 - RNA, 64 nt, hsa
agacuucuuggugguuuccaaguuuuggcaauuaugaauaaagcuguuguaaacaucuuugugc

SEQ ID NO: 95348 - RNA, 64 nt, hsa
agaaaagaaaaacacagcaugagaacacaguaaaugaauaaaaccauaaaauauuuagccccuc

SEQ ID NO: 95349 - RNA, 64 nt, hsa
ugugcaaauaaugaaagagcucgguaaagcauucugaauaaauucagccugacugaauuuucag

SEQ ID NO: 95350 - RNA, 64 nt, hsa
uugacuaacugagcuccuucacuuaaaaaucagcugaauaaauuccuuaaguauacuucaagac

SEQ ID NO: 95351 - RNA, 64 nt, hsa
uagugucauuuguaugagagaggaucauggacaaugaauaaaugcacacuucugacuauaauuu

SEQ ID NO: 95352 - RNA, 64 nt, hsa
caauucacuuaacuucuccauggcugcuuccugcugaauaaauagggacaggcauaauggauag

SEQ ID NO: 95353 - RNA, 64 nt, hsa
caugguuuucuuuuucuuaguaugggaguguccaugaauaaauucaugggcauccucauaacuc

SEQ ID NO: 95354 - RNA, 64 nt, hsa
uaaggaugugcuggucccccuacucugugugugcugaauaaauggcuuguaaagaaguuuuucc

SEQ ID NO: 95355 - RNA, 64 nt, hsa
caguggagucuucuuuagugccaguccuugugguugaauaaaaaggaugguccgcuuucuauug

SEQ ID NO: 95356 - RNA, 64 nt, hsa
gucaguguuuccauguuauggaucucucugcguuugaauaaagacuaucucuguugcucacaaa

SEQ ID NO: 95357 - RNA, 64 nt, hsa
cgagggcgcauccaagcgggggccacuugagaagugaauaaauggggcgguuucggaagcguca

SEQ ID NO: 95358 - RNA, 64 nt, hsa
gcaacagauaucauuucaggugacuuaacaugaaugaauaaaagucaaugcuauuggauuguuu

SEQ ID NO: 95359 - RNA, 64 nt, hsa
aaucuaucuuccaauacacuguuuaauauagcacugaauaaaugaugcaaguugucaauggaug

SEQ ID NO: 95360 - RNA, 64 nt, hsa
uuuuaagaguuggggggaguaucuauaguaaacuugaauaaaggggacaaagcuagaacuuauu

SEQ ID NO: 95361 - RNA, 64 nt, hsa
cacaguuuuaagcacauaauguaauucuaaaagaugaauaaacuagagagguucacuuugugcc

SEQ ID NO: 95362 - RNA, 64 nt, hsa
gugauuauagagaaugauuauaugauguuuguaaugaauaaaauaguaguuucauuauuuggca

SEQ ID NO: 95363 - RNA, 64 nt, hsa
uucuuuuucugugauuaugaaaugcaauaaaaucugaauaaagggcaaaguuucuuccugauca

SEQ ID NO: 95364 - RNA, 64 nt, hsa
uaccuuaguagaauacagagcuuugguaauuacaugaauaaaauuaagaaaauagccauauaca

SEQ ID NO: 95365 - RNA, 64 nt, hsa
uucacuuuauaguuugggagacagaaucaggucuugaauaaaauaauuguaaugagugcuaaau

SEQ ID NO: 95366 - RNA, 64 nt, hsa
ugggguuuuguuauugguuuuuuuuuguaaagugugaauaaaagguauguuuacucauuuuucc

SEQ ID NO: 95367 - RNA, 64 nt, hsa
gcccagacagcucuuugaugagggugaugggaacugaauaaaccauacggacuggcaguaacaa

SEQ ID NO: 95368 - RNA, 64 nt, hsa
uugaguaauggauguuuguuuuuuguguaauuugugaauaaauaguuuuuuucugcauuuugaa

SEQ ID NO: 95369 - RNA, 64 nt, hsa
aaauaaaaaaguagggcuguuauuagagugccaaugaauaaauaacuuaagcacaaaauacaua

SEQ ID NO: 95370 - RNA, 64 nt, hsa
auguuuuguuucuuagggaaaacagucugagaaaugaauaaaaagcaugaaguacgugugugug

SEQ ID NO: 95371 - RNA, 64 nt, hsa
gcuggguuucagcauccaccaaugaacugaaaggugaauaaaggacguucaugagaaaucgacu

SEQ ID NO: 95372 - RNA, 64 nt, hsa
accuacuagauugaauuuauuuagugaaugcuccugaauaaaugugcauuccucuuuuagagua

SEQ ID NO: 95373 - RNA, 64 nt, hsa
gcagugcauguuucuaauugacuuacugggaaacugaauaaaauaugccucuuauuaucauauu

SEQ ID NO: 95374 - RNA, 64 nt, hsa
gggcccagauggaccaaguggggccggggagggaugaauaaacacccuaccccgugcccugucu

SEQ ID NO: 95375 - RNA, 64 nt, hsa
ugggcuuggaccgauguccccauauguacagaacugaauaaagugggucucugagaagucugau

SEQ ID NO: 95376 - RNA, 64 nt, hsa
cauagugcuggucucacagcuuaauauuugguaaugaauaaauucugcuagugguauauguuga

SEQ ID NO: 95377 - RNA, 64 nt, hsa
ucaguuuuuaaaagaucgaucuacauacaauagaugaauaaauguuuucagugauaugaaaagg

SEQ ID NO: 95378 - RNA, 64 nt, hsa
cacuagcuuucguuccuuagaaugucuuuucuuuugaauaaacaguauugggugauuuauuaaa

SEQ ID NO: 95379 - RNA, 64 nt, hsa
aucuggccauggcggacacucagcauuuguugauugaauaaauguuagcucuucucauugugaa

SEQ ID NO: 95380 - RNA, 64 nt, hsa
gcauugaaaccauauggugugugauuaaaaaaaaugaauaaauugugaagaacugguuuugguu

SEQ ID NO: 95381 - RNA, 64 nt, hsa
uuaggaaaaguuaacuuguuaaauucuuuugaauugaauaaaaaaaugcauugaaaccauaugg

SEQ ID NO: 95382 - RNA, 64 nt, hsa
uuacuuacacaauucaguuaagaugcuuugacacugaauaaaauauugauuucaugaaaucauu

SEQ ID NO: 95383 - RNA, 64 nt, hsa
uuuguaccuaaguggauauagauaacugcauaaaugaauaaauucagaauuaacuccuucaaua

SEQ ID NO: 95384 - RNA, 64 nt, hsa
aaacuagcaaucuauaaagugcaccaggucaacuugaauaaaaacacuaugacagacagguuug

SEQ ID NO: 95385 - RNA, 64 nt, hsa
guaaaucugauggcucacugauuuuugaaaagccugaauaaaauuggaaagacuggaaaguuag

SEQ ID NO: 95386 - RNA, 64 nt, hsa
accuucuguugauuuuuuaagccacaugcuaugaugaauaaacugauuuauuuucuaccauuac

SEQ ID NO: 95387 - RNA, 64 nt, hsa
gaaaaacuuuuuuaaagauguuagucuuguagcgugaauaaauuugccaucaccuuuugugugg

SEQ ID NO: 95388 - RNA, 64 nt, hsa
uuggugcuguaguauaugaugaaagauguaaagcugaauaaagcauuauuucugcccuagaguu

SEQ ID NO: 95389 - RNA, 64 nt, hsa
cuauauuuucauaauucuauguguauuuuuauuuugaauaaacagaaagaaauuuuggguuuuu

SEQ ID NO: 95390 - RNA, 64 nt, hsa
guauggucuacacauucugauuuuuuuuuuagauugaauaaaauuuguaaaucauuauuuucau

SEQ ID NO: 95391 - RNA, 64 nt, hsa
gggcaacacagcaagacucugucucaaaaauaaaugaauaaaauaaaaaccugccaccaaauua

SEQ ID NO: 95392 - RNA, 64 nt, hsa
uaggaaaaaaaaauaugcauuugcuuaguuuauuugaauaaaagcucuaaaccuagguuauaua

SEQ ID NO: 95393 - RNA, 64 nt, hsa
ucaugugggcugaugcagggaagcucugaagcagugaauaaagguguuucgggcccuguaagug

SEQ ID NO: 95394 - RNA, 64 nt, hsa
ucuaggaaggccccagcccuaguccuaggcgacuugaauaaagugggaggucaaacaugggccu

SEQ ID NO: 95395 - RNA, 64 nt, hsa
agcaagaacgaagcaggauguugucacucccgucugaauaaagcuccaugagcuggguuggaaa

SEQ ID NO: 95396 - RNA, 64 nt, hsa
caguguccagcauaugguagauacuuguaguguuugaauaaaugaaaccagcauuagagcuuua

SEQ ID NO: 95397 - RNA, 64 nt, hsa
uaccuggguguuccacagcugauagugauugccuugaauaaauucaagggcaauuuauucauuu

SEQ ID NO: 95398 - RNA, 64 nt, hsa
uugaaauaucaaggauucuaguaauuguauuuccugaauaaauguauguuuaugaauuuucuaa

SEQ ID NO: 95399 - RNA, 64 nt, hsa
gaugggaauuuuuaucuuagaaauggaugauucgugaauaaaacuagguacauaguaaguguau

SEQ ID NO: 95400 - RNA, 64 nt, hsa
uuuuaggaaaauaagagaaagguaagggcucuuuugaauaaacugcuguuuuauuuguggcaca

SEQ ID NO: 95401 - RNA, 64 nt, hsa
uuuuuguuuauaccagucuuaaagauccagguucugaauaaaaaaauuaauugauacaauugau

SEQ ID NO: 95402 - RNA, 64 nt, hsa
ccaguagauuaauguugugacuauucagaaaaggugaauaaaauugggauauaaaauggacucu

SEQ ID NO: 95403 - RNA, 64 nt, hsa
ccauugguaauaauguuggcaaguaauaguuaucugaauaaaucaaucauauaagaauguauag

SEQ ID NO: 95404 - RNA, 64 nt, hsa
accauuuacacaagagauggcuuuuuccuuugcuugaauaaacauuuuggaucaccuccaaaga

SEQ ID NO: 95405 - RNA, 64 nt, hsa
uuacauggauugccaauuuuuaaaacacuaaaguugaauaaaaugcaugaacaauagaaaaaug

SEQ ID NO: 95406 - RNA, 64 nt, hsa
uaugaauucccuguuaguugauuuaaauccuuucugaauaaagaucagauaaacaguaacugaa

SEQ ID NO: 95407 - RNA, 64 nt, hsa
ugcauauaaaagguagacagcugauauguuuucaugaauaaauauugucagccagaaaagguug

SEQ ID NO: 95408 - RNA, 64 nt, hsa
aaucuuuuuuuuuuuuuuuggucaagcuugaggcugaauaaagccuuugaugcacaaaauggga

SEQ ID NO: 95409 - RNA, 64 nt, hsa
aauuuucagacacauuuuuggauuucugugaaguugaauaaacauaaaagcuaauacaguugua

SEQ ID NO: 95410 - RNA, 64 nt, hsa
uuguauggugagagugaugaauuguuggaucauuugaauaaaaucuuuuacuaaccccaugaua

SEQ ID NO: 95411 - RNA, 64 nt, hsa
guguaugcagaggcagcccucaauaugcagugguugaauaaaugaaugaagaaaccacuaucaa

SEQ ID NO: 95412 - RNA, 64 nt, hsa
ggugcauauuaaaauaagcagagaaaaaaaaaugugaauaaacuacugaaaacacuugguguuu

SEQ ID NO: 95413 - RNA, 64 nt, hsa
cagcacaucacuguagaauuugagugaucuaugcugaauaaacaguggaaugugaccagucaag

SEQ ID NO: 95414 - RNA, 64 nt, hsa
cacaauccagaauguucuaacaauaaguuuucagugaauaaaccacuggcaagacaauuccaug

SEQ ID NO: 95415 - RNA, 64 nt, hsa
guacuugauuuauuauacuuaccaaagcugcaacugaauaaaucuggugaggugaggccuucaa

SEQ ID NO: 95416 - RNA, 64 nt, hsa
gaaauaaugcgccucuugaggagaaaagcaauaaugaauaaaaggacuuuccuacaauaacuuc

SEQ ID NO: 95417 - RNA, 64 nt, hsa
uguauguauugguaaugaugucauuaaaaguauaugaauaaaaauaugaguaacaucauaaaaa

SEQ ID NO: 95418 - RNA, 64 nt, hsa
auuuuguaucauuuguuuuccucaucuaaaaaguugaauaaaaucuguuugauucaguucuccu

SEQ ID NO: 95419 - RNA, 64 nt, hsa
ccgggaacauaguaagggcucaguaaauacuuguugaauaaacucagucuccuacauuagcauu

SEQ ID NO: 95420 - RNA, 64 nt, hsa
ccucagccccauuuugcugaaaauaaugacuuucugaauaaagauggcaacacaauuuuuucuc

SEQ ID NO: 95421 - RNA, 64 nt, hsa
gagaaagugccagcccugaagcuggagccguuugugaauaaacuguucuucaucauugacacug

SEQ ID NO: 95422 - RNA, 64 nt, hsa
ccaggagauggauuuaguuauucaauuuuguggaugaauaaauugaggcacagaaagauuaagu

SEQ ID NO: 95423 - RNA, 64 nt, hsa
uacuugguuucuuuuacuuaccugcuugaauacuugaauaaaccauucaccaauuuuaauccuu

SEQ ID NO: 95424 - RNA, 64 nt, hsa
gagcaagaguguuuggcucccaguuuggacuuggugaauaaauguaccuuagaacuaggauaau

SEQ ID NO: 95425 - RNA, 64 nt, hsa
caaucauuuuuaaaauuccuaauuuucagaaauaugaauaaauaguuuuuguuaaacccuuugu

SEQ ID NO: 95426 - RNA, 64 nt, hsa
cuuccuauggucuugucugaauaaacuacucuccugaauaaaacaacauccaacccaggucauu

SEQ ID NO: 95427 - RNA, 64 nt, hsa
cuuuuuuucuuuucuuucuuccuauggucuugucugaauaaacuacucuccugaauaaaacaac

SEQ ID NO: 95428 - RNA, 64 nt, hsa
uguaugauguuuguaagaccauguuuguaagacaugaauaaauugcugcuuuugcccaacccgu

SEQ ID NO: 95429 - RNA, 64 nt, hsa
cuauguaccuuugugaaauuguugaauuaguuagugaauaaagaaauaaacuucaacuagaaau

SEQ ID NO: 95430 - RNA, 64 nt, hsa
ugaugaacauauuguaaugaugcuucugugaauuugaauaaaaucaacacuaaccagcccuagu

SEQ ID NO: 95431 - RNA, 64 nt, hsa
guugggaaacaaaugcugucucuugugaaauagaugaauaaaaugugauaguaacauaguagag

SEQ ID NO: 95432 - RNA, 64 nt, hsa
gacacuuagaggggagagaugaaagccaaacaaaugaauaaacauaaaugauaccaucagugcu

SEQ ID NO: 95433 - RNA, 64 nt, hsa
aauaaggaaaaggagagaaaaaagaaauugguuaugaauaaaagugacaauaaaacaugagaua

SEQ ID NO: 95434 - RNA, 64 nt, hsa
acuaaaggaaaucuugaggucauauacugaaauaugaauaaauuaaaauaaugaauucagaucu

SEQ ID NO: 95435 - RNA, 64 nt, hsa
acacuuuuucuuaaaagaaaaauauuuugggguuugaauaaaauggaccaccauuucucauugg

SEQ ID NO: 95436 - RNA, 64 nt, hsa
gaaaaccagcaugguuugacaccacaugggaacaugaauaaaucugucucaugauuugaaaagu

SEQ ID NO: 95437 - RNA, 64 nt, hsa
agaucaagugcauugaggggcaguuuuguuugccugaauaaacguaaaggacaaguaaacaauu

SEQ ID NO: 95438 - RNA, 64 nt, hsa
ugauuuguauuuaugucuugagacaguaacuuuuugaauaaaaauaaaccuacaguauguugua

SEQ ID NO: 95439 - RNA, 64 nt, hsa
aaaaaauguauaaaaagaauuaguguaugcuuccugaauaaaaaggagccaaaguugaucagaa

SEQ ID NO: 95440 - RNA, 64 nt, hsa
aagcgggaagggcuuggucuggauguagagagggugaauaaaauugccaagagagauauugaac

SEQ ID NO: 95441 - RNA, 64 nt, hsa
uacaauuccucaggagacuacaguaguauauucuauuccuuaccaguaauaagguucuuccuaa

SEQ ID NO: 95442 - RNA, 64 nt, hsa
uugcuuuuccaucuagaucaguuacagccauuugauuccuuaauuguuuuuucaagucuuccag

SEQ ID NO: 95443 - RNA, 64 nt, hsa
uuauuccuuaaaagauuguuauuguaauuuuguuauuccuuaaaaacauuuaaaagcagauuuu

SEQ ID NO: 95444 - RNA, 64 nt, hsa
aaaaugaaaaugucacucaagcuuaacuuuuguuauuccuuaaaagauuguuauuguaauuuug

SEQ ID NO: 95445 - RNA, 64 nt, hsa
cuuuccauaacuuaucugcuauuauuaguuucuuauuccuuauuauuaaucuguuagcucauua

SEQ ID NO: 95446 - RNA, 64 nt, hsa
gaucaccucuggaaucucugugguugugaaggcaauuccuuaugagacucuugccuccuguggc

SEQ ID NO: 95447 - RNA, 64 nt, hsa
cuucauccuauagagucaaccaccacagauaggaauuccuuauucuuuuuuuaauuuuuuuaag

SEQ ID NO: 95448 - RNA, 64 nt, hsa
agguagauuaguuugaagcauugaccuuuuauuuauuccuuauuucucuuucaucaaaacaaaa

SEQ ID NO: 95449 - RNA, 64 nt, hsa
aggacucucagguaauaguuuaaggaaacccuugauuccuuauauauguuuaagaagguuaguu

SEQ ID NO: 95450 - RNA, 64 nt, hsa
cuaaacaaacuuuuugaaaagcuguuucuaaaagauuccuuaaauucagauaugacagcuaauu

SEQ ID NO: 95451 - RNA, 64 nt, hsa
uaacaucaaaugacucucaucaucaacaaauuguauuccuuauugugaaauuaauacccucagg

SEQ ID NO: 95452 - RNA, 64 nt, hsa
ccccugaccugucaugaguuuucucugcucugacauuccuuauacauccagugaacaaagcugg

SEQ ID NO: 95453 - RNA, 64 nt, hsa
aucaugccuugaguguucuuuucucccaagugcuauuccuuaaacacgagaguuuaccaguugc

SEQ ID NO: 95454 - RNA, 64 nt, hsa
aauacgaccuauuagaguaaucuacaucuggaccauuccuuaaguuuuuccucaccgacaguac

SEQ ID NO: 95455 - RNA, 64 nt, hsa
uaauuuuucaaaccagagcuguucacaugaaaauauuccuuaguagaauguauauuuaagaaau

SEQ ID NO: 95456 - RNA, 64 nt, hsa
gugccaguuuccuugagaagcagcuuucaugcuuauuccuuaaaaacaacagaagaguguuuau

SEQ ID NO: 95457 - RNA, 64 nt, hsa
agcauaugguaaccaagguuagaugccaguuaaaauuccuuagaaauuggaugagccuugagau

SEQ ID NO: 95458 - RNA, 64 nt, hsa
cucuguacuucugccuuuuaauuacugggcccuuauuccuuauuuucugugagaaauaauagau

SEQ ID NO: 95459 - RNA, 64 nt, hsa
guguuugcccaagccuuucucggcaucaucuuguauuccuuaucagauaguaaguaaccuguaa

SEQ ID NO: 95460 - RNA, 64 nt, hsa
gaguauuacuguuuucucagcaugcauuaaaaauauuccuuaacuucaauuguaaauaaacuuu

SEQ ID NO: 95461 - RNA, 64 nt, hsa
augaucuggaccaggggucagcaaagugcagccuacaagcuauugcagucagcugccaguuuuu

SEQ ID NO: 95462 - RNA, 64 nt, hsa
uaaauucuggugguuaaauaacuuaucugugguuacaagcuaguaaguagcagagccaagauuu

SEQ ID NO: 95463 - RNA, 64 nt, hsa
ucccacguacuuauaaagaagguuggugaauuucacaagcuauuuuuggaauauuuuuagaaua

SEQ ID NO: 95464 - RNA, 64 nt, hsa
uuuuggaauauuuuuagaauauuuuaagaauuucacaagcuauucccucaaaucugagggagcu

SEQ ID NO: 95465 - RNA, 64 nt, hsa
guggaaggcugcugucacuagccccuccugagugugucacuaacagcccacugugcuugcaaag

SEQ ID NO: 95466 - RNA, 64 nt, hsa
ucuaggucugugcacucucucuguggaaggcugcugucacuagccccuccugagugugucacua

SEQ ID NO: 95467 - RNA, 64 nt, hsa
ucacuuccagagaacuuguucuucagcaagaaugugucacuaguaaggacaucucuagcauuuc

SEQ ID NO: 95468 - RNA, 64 nt, hsa
cagguauacuugugauauagucauggggcuucagugucacuauuuucuccuuaaagcuccagcc

SEQ ID NO: 95469 - RNA, 64 nt, hsa
uggggagaaacagccugggcuggggcuacaggucugucacuaugcucucuugccuucagacaga

SEQ ID NO: 95470 - RNA, 64 nt, hsa
gccaugugaauguuguauacgauuguaaggcuuaugucacuaaagauuuuuauucugauuuuuu

SEQ ID NO: 95471 - RNA, 64 nt, hsa
uguuucuuaggagaaaaugauucuguaauuccagugucacuaauuuauauuguucuuuccucug

SEQ ID NO: 95472 - RNA, 64 nt, hsa
ccauacccgucacuacagccucaccucccaccccugucacuacggccucaccucccaccccugu

SEQ ID NO: 95473 - RNA, 64 nt, hsa
ccaccccugucacuacggccucaccucccaccccugucacuacagccucaccuccuacagccuu

SEQ ID NO: 95474 - RNA, 64 nt, hsa
cauagcaaauugugcugcacaugaggaaauaggcugucacuaucacauuguccugaaaacagca

SEQ ID NO: 95475 - RNA, 64 nt, hsa
cagcgucuuuuccuagagcuggucaccacuaggcugucacuauaaauuccuugaauauaaguaa

SEQ ID NO: 95476 - RNA, 64 nt, hsa
accuuuacucucaaagccauguguggagggggcuugucacuauuguaggcucacuggauugguc

SEQ ID NO: 95477 - RNA, 64 nt, hsa
uuuaccugugcaccagugugacaggaaagauucaugucacuacuguccguggcuacaauucaaa

SEQ ID NO: 95478 - RNA, 64 nt, hsa
ugcccugaggaugggcuuccuuguccuguggccucugcuccaggggcaguguccuuucccugug

SEQ ID NO: 95479 - RNA, 64 nt, hsa
guguguaagaugggcuauuuguucuuuggaaugacugcuccacuccacacucacaccucuauuc

SEQ ID NO: 95480 - RNA, 64 nt, hsa
guucccuuccaaaaugcacaaaucauacccuugucugcuccaauucagucuccaaaccuggugc

SEQ ID NO: 95481 - RNA, 64 nt, hsa
gcuugccgaaaccagcaugaugcuucaaagagcccugcuccaccccucauggcauggauccuuu

SEQ ID NO: 95482 - RNA, 64 nt, hsa
agaaggaaggauguccccagcccaggaggucuuucugcuccaucguccccaaggaauaaguuug

SEQ ID NO: 95483 - RNA, 64 nt, hsa
aggagcgagcaugugacagucccuggacaaccuccugcuccauccacuacaagaaggaaggaug

SEQ ID NO: 95484 - RNA, 64 nt, hsa
gaacuggggucauucggucugugaucucguugcacugcuccaagucuggcuguguccaggcggu

SEQ ID NO: 95485 - RNA, 64 nt, hsa
ccuguugcccugggaaagggcaaccucccuuucacugcuccaguggcagccauggggaaggcag

SEQ ID NO: 95486 - RNA, 64 nt, hsa
gcuccaguggccuugauuuuaggccaggaaucuucugcuccauguggcuuaagccuuccagcug

SEQ ID NO: 95487 - RNA, 64 nt, hsa
auccugccauuaaggcuaugugcagucugcccuccugcuccaguggccuugauuuuaggccagg

SEQ ID NO: 95488 - RNA, 64 nt, hsa
gcuuggcaguuauaccccaugcagucauaggagacugcuccaucauucucagcacauagggugc

SEQ ID NO: 95489 - RNA, 64 nt, hsa
ccuuuggucaaagagaaagaacucuaauguccagcugcuccaucgauauacucauagaauggaa

SEQ ID NO: 95490 - RNA, 64 nt, hsa
gcucuugucccucacugccccaguaagcuggaggcugcuccagaacucagcaguguuggagggg

SEQ ID NO: 95491 - RNA, 64 nt, hsa
accugucacauaaagcauuuuuuuaaaaagucagcugcuccaaaaucaucaacucagccccugg

SEQ ID NO: 95492 - RNA, 64 nt, hsa
gaucucagcucccguuccccaagcacacuccuagcugcuccagucucagccugggcagcuuccc

SEQ ID NO: 95493 - RNA, 64 nt, hsa
ugcuagucccggcauccugauggcuccgacaggccugcuccagagcacggcugaccauuucugc

SEQ ID NO: 95494 - RNA, 64 nt, hsa
uuuagucuggguccaugucccagaccccucuauucugcuccaggacagcaggacuucaggucuu

SEQ ID NO: 95495 - RNA, 64 nt, hsa
ccagcuggcaggguugcccaccccugcuguccaccugcuccauccucuaggguuccacaggccc

SEQ ID NO: 95496 - RNA, 64 nt, hsa
caggccugaggacaugccucccaccaaauguccccugcuccagucccacuccugucaccccacg

SEQ ID NO: 95497 - RNA, 64 nt, hsa
guucaucccgccccugcuccauguccuuguguggcugcuccagcgagagcugguaacuagguag

SEQ ID NO: 95498 - RNA, 64 nt, hsa
augggagauuaucagucuaguguucaucccgccccugcuccauguccuuguguggcugcuccag

SEQ ID NO: 95499 - RNA, 64 nt, hsa
aaccaaaggaggugaugggaggcuuuucaagacgcugcuccaaacucaucaacuccugugagua

SEQ ID NO: 95500 - RNA, 64 nt, hsa
ucugcccuuccaacgcaucacccgccucaaacugcugcuccagaacauucugaagagaacacag

SEQ ID NO: 95501 - RNA, 64 nt, hsa
guccugggagguggucgcccugcagugcaagcugcugcuccagagcguaccguggcccagacug

SEQ ID NO: 95502 - RNA, 64 nt, hsa
uggcagggaggcagucgcccugcggugcaagcugcugcuccagagcauaccguggcccaggugg

SEQ ID NO: 95503 - RNA, 64 nt, hsa
ggguggaggugguguucuauaccuaaaggaugaccugcuccagaaacagcaccagcacagcaug

SEQ ID NO: 95504 - RNA, 64 nt, hsa
aaaaugggcucccugguaucuccugucuucccuacugcuccaaacccuaaauuuugguuguaca

SEQ ID NO: 95505 - RNA, 64 nt, hsa
ugaagaaagccaucgagagaggcucccucaugggcugcuccauugauguaagucuggggugugg

SEQ ID NO: 95506 - RNA, 64 nt, hsa
gauugcacggaugguaaggaauauggauaacucacugcuccaggacucagaccucgaccccaga

SEQ ID NO: 95507 - RNA, 64 nt, hsa
agcacuagcaccucacuccaucggccccggcacccugcuccaucggcacuggcgcccugcucca

SEQ ID NO: 95508 - RNA, 64 nt, hsa
ggccccggcacccugcuccaucggcacuggcgcccugcuccaucggcacuaaugcuccacucgg

SEQ ID NO: 95509 - RNA, 64 nt, hsa
gacauuggugccccacuccaucagcacuaacgcccugcuccaucggcacuggugucccacucca

SEQ ID NO: 95510 - RNA, 64 nt, hsa
caucacuauguccagcuccgucggcacuaccacccugcuccaucaucacuacguccagcuccaa

SEQ ID NO: 95511 - RNA, 64 nt, hsa
ggcaccaacgcccagcuccaccgguacuggcucccugcuccaucggcacuaacgcccugcuuca

SEQ ID NO: 95512 - RNA, 64 nt, hsa
acagaacagagggccagagcuagggcugcugcuucugcuccagccccuuugccucuguccuccc

SEQ ID NO: 95513 - RNA, 64 nt, hsa
ccccugaucucugaccucugcugagugcugggcacugcuccaagggacaggugggccuggcggc

SEQ ID NO: 95514 - RNA, 64 nt, hsa
gucccauccuggugugagaaucaaccaggcuuuccugcuccaccugagauaaccaacucccucc

SEQ ID NO: 95515 - RNA, 64 nt, hsa
cugccggaggacccccaccugagagauggaugagcugcuccaaaggggaacuguugacacucgg

SEQ ID NO: 95516 - RNA, 64 nt, hsa
gugcccaugaggacaaaguguagcagccuccugccugcuccaagaaaagggcuugcgaaaggaa

SEQ ID NO: 95517 - RNA, 64 nt, hsa
ugcagcaaugaguugggaaaaacugaccgaguaccugcuccaucaugcuugauugagugcuccu

SEQ ID NO: 95518 - RNA, 64 nt, hsa
gaagagauggcaccagggaaaggugugccauaagcugcuccagagcuuuugguaugcugagugu

SEQ ID NO: 95519 - RNA, 64 nt, hsa
gucgccucauuuccugcuacacugaaggggucagcugcuccagugggccaaguugggcaggacc

SEQ ID NO: 95520 - RNA, 64 nt, hsa
cuggccaggagcucuucaggccucccucucucuucugcuccacccuuggccugucucaucccca

SEQ ID NO: 95521 - RNA, 64 nt, hsa
acugaccauccacucuacccucccacccccuucucugcuccaccacauccuccguccagccgcc

SEQ ID NO: 95522 - RNA, 64 nt, hsa
gcccagccuuguaaauaaccacaagguccacucccugcuccacgaagccuuaagccauaggccc

SEQ ID NO: 95523 - RNA, 64 nt, hsa
aagagcagagucugggccucugacucugaguccacugcuccauuuauaaccccagccugaccug

SEQ ID NO: 95524 - RNA, 64 nt, hsa
ugcuguccacaugaccuccauuucccaaaguccucugcuccagcaacugcccuuccaggugggu

SEQ ID NO: 95525 - RNA, 64 nt, hsa
acccugcauuuuccucuuguccuggcccuucagucugcuccaccaaggggcucuugaaccccuu

SEQ ID NO: 95526 - RNA, 64 nt, hsa
gggaguuguauggaaaaauaguagaauuacacagcaugaaaagcagcccaugguuuaaauuauu

SEQ ID NO: 95527 - RNA, 64 nt, hsa
gccuaaugaggugauuaggugaagucucugcccucaugaaaagauuaaucccauuaucucagga

SEQ ID NO: 95528 - RNA, 64 nt, hsa
cuaucuaaaagaagaaaacugauggcuaaguuugcaugaaaacugcacuuuauugcaaguuagu

SEQ ID NO: 95529 - RNA, 64 nt, hsa
aaguagcaaaucugaagauaggcaaugucaaacccaugaaaaugggagauuaaugagcuuuauu

SEQ ID NO: 95530 - RNA, 64 nt, hsa
ggaaaaaaauuccaaagacugauauuuugugucacaugaaaauuauaugaaauucaaauugcag

SEQ ID NO: 95531 - RNA, 64 nt, hsa
ucugggagguuuuuuuuuucuauuuuuauuuuuucaugaaaauuauuggugggccacugaaagu

SEQ ID NO: 95532 - RNA, 64 nt, hsa
augaaagcuaauauaggaacaagacucccaaauccaugaaaacgcuuagugaauauauucuuaa

SEQ ID NO: 95533 - RNA, 64 nt, hsa
aaaauacaagaugcugcuuuauuaugucugucaccaugaaaacuuagcugcaucuuuugaaaua

SEQ ID NO: 95534 - RNA, 64 nt, hsa
uuaccaaaaugcucaagagcucugccgugcuccccaugaaaagucuauuaaguaggcacccugu

SEQ ID NO: 95535 - RNA, 64 nt, hsa
uuggucuguggauuuuuaauauuuuuuaauggaacaugaaaaccuccacagcaacaucgaaacc

SEQ ID NO: 95536 - RNA, 64 nt, hsa
cuuauaagaauuuuaagaacuaaguggcaaauuccaugaaaauauuucucaguucuguaugcac

SEQ ID NO: 95537 - RNA, 64 nt, hsa
uuuagaaaaacauauuacuuugaauucaaauugucaugaaaaccagaacaguguuuguccaugu

SEQ ID NO: 95538 - RNA, 64 nt, hsa
gaugcaagugccuacaguauuaucaggaggagaacaugaaaauauuaagacaaaaauccucagc

SEQ ID NO: 95539 - RNA, 64 nt, hsa
aaagaguuuaacuuucuggaacugaaggagaaaacaugaaaauguuuauauugcuucuuguuaa

SEQ ID NO: 95540 - RNA, 64 nt, hsa
cuuguaaaaaccaugugggguaaacugggaauaacaugaaaagauuucuguggagguggggugg

SEQ ID NO: 95541 - RNA, 64 nt, hsa
uacaaucaaaaucccagaugcuggucucuauucccaugaaaaagugcucaugacauauugagaa

SEQ ID NO: 95542 - RNA, 64 nt, hsa
ccauaucaucaaaacuaauuuguguagauuuuugcaugaaaaaaaucauaaauuucccucaaaa

SEQ ID NO: 95543 - RNA, 64 nt, hsa
caaaaugagaucauaaguguuaauguacacuggacaugaaaacaaagacugguuuagcagcaga

SEQ ID NO: 95544 - RNA, 64 nt, hsa
cuauuuuuauccaaaaguauaaauuuugcuuuggcaugaaaagugguccucuugacugcauuau

SEQ ID NO: 95545 - RNA, 64 nt, hsa
cuaggagcaaucuaagcuguguuacuccaaaggacaugaaaaagcucaagaguaaaauuaaaau

SEQ ID NO: 95546 - RNA, 50 nt, hsa
agccucagcuucugaagugacaugaaaagagccucuggaugcauuuccau

SEQ ID NO: 95547 - RNA, 64 nt, hsa
auagaauuuccuguaauauauuuauauacuuuuucaugaaaauggaguuaucaguuaucuguuu

SEQ ID NO: 95548 - RNA, 64 nt, hsa
uauaauguaaauuaaauccacuaaaauguaauggcaugaaaaucucuguagucugaaucacuaa

SEQ ID NO: 95549 - RNA, 64 nt, hsa
acccaaagaauuauagauauuuuucaugaugacccaugaaaaauaucacucaucuacauaaagg

SEQ ID NO: 95550 - RNA, 64 nt, hsa
uguaccuuugcugucuugcucaagcuugguauggcaugaaaacucgacuuuauuccaaaaguaa

SEQ ID NO: 95551 - RNA, 64 nt, hsa
caaggaacaaaacaaagcuuugaaaaaacuuuaacaugaaaaaacgcacugacauuuuuuuuua

SEQ ID NO: 95552 - RNA, 64 nt, hsa
uauguacaaagguaaccaucacuccuuaaauccacaugaaaacuacuguaacugaucauguauu

SEQ ID NO: 95553 - RNA, 64 nt, hsa
uuuuaaaugcucauaggucuuuccauaucuguaacaugaaaaugauuauucugcauuuuauuca

SEQ ID NO: 95554 - RNA, 64 nt, hsa
ucuaaauacauugcccacuuccaaaaauguucagcaugaaaaaaagggcuucagugucgauuga

SEQ ID NO: 95555 - RNA, 64 nt, hsa
acuuguguuucuacacagcaaaccauuuuucuuucaugaaaauaauauauuauuaacaugaaua

SEQ ID NO: 95556 - RNA, 64 nt, hsa
agcguaucaaauuugcacuucaugaggauuuacacaugaaaauugauauucucaugggcuuugc

SEQ ID NO: 95557 - RNA, 64 nt, hsa
ccacaaugcuuugagcuucuuuuauagaagggaucaugaaaaggucuggucagcuacaguuuaa

SEQ ID NO: 95558 - RNA, 64 nt, hsa
augaugguuagcagaagcuguuguauacaaucuucaugaaaauuucaguguguauuuuucuuuu

SEQ ID NO: 95559 - RNA, 64 nt, hsa
cugccuaacacuuuaguaggugcuauagaggauacaugaaaaguaugagaucugguuccaucca

SEQ ID NO: 95560 - RNA, 64 nt, hsa
ucaugaaaacugcaaugcugggaaaagaaggaaacaugaaaauaaaaauaagacaguuuauuag

SEQ ID NO: 95561 - RNA, 64 nt, hsa
cauugucuaaaaguaacuuuuaaaaagcagaguucaugaaaacugcaaugcugggaaaagaagg

SEQ ID NO: 95562 - RNA, 64 nt, hsa
uuauuuccucugcaggauacaguucaauaugaugcaugaaaaaugcuccacauuuaaaggacau

SEQ ID NO: 95563 - RNA, 64 nt, hsa
auagcacauccuccaacguuaaaagacaguggaucaugaaaagugcuguuuuguccuuugagaa

SEQ ID NO: 95564 - RNA, 64 nt, hsa
acuuccagugcgucucuuuuguuccuggcuuugacaugaaaagauagguuugaguucaaauuuu

SEQ ID NO: 95565 - RNA, 64 nt, hsa
aguauaaauuaauuuuucaaaccagagcuguucacaugaaaauauuccuuaguagaauguauau

SEQ ID NO: 95566 - RNA, 64 nt, hsa
aauuuuaauuccaugaaagucuuaauguuuccaacaugaaaauucucuuacuuaaauacguuug

SEQ ID NO: 95567 - RNA, 64 nt, hsa
aaauauaaguaaggaucaaaacucuaaaauuuugcaugaaaauuacauccaaauugugaaaauc

SEQ ID NO: 95568 - RNA, 64 nt, hsa
aaaucuauaaaaugaugucuuaaaacagccauaucaugaaaaauucuacuuagcuauauuauua

SEQ ID NO: 95569 - RNA, 64 nt, hsa
aaaagcgaauguuugugugugcagacaaucuuagcaugaaaaugguuuaaauaggcugguccua

SEQ ID NO: 95570 - RNA, 64 nt, hsa
uagcugaagucagccacggugggaguguuuauaccaugaaaaucagcaagugcuguaaaucagg

SEQ ID NO: 95571 - RNA, 64 nt, hsa
uucauauauuugugacaauuuuugaguaauauugcaugaaaaugucccuauguuacauccauuc

SEQ ID NO: 95572 - RNA, 64 nt, hsa
uucgcuuucuccuguuuuuuuuuuaaaaaaaaagcaugaaaaaggaagagaaaaaguuugauau

SEQ ID NO: 95573 - RNA, 64 nt, hsa
acaugggccaaaacaugaauugaguauguggucacaugaaaacacggaugaaugaauaaaacac

SEQ ID NO: 95574 - RNA, 64 nt, hsa
agugacugcacaaguaaaaguccaauguugugugcaugaaaaggauuccuugguuaugugcagg

SEQ ID NO: 95575 - RNA, 64 nt, hsa
acauuucacaugcacauuucaaaacaagaugugucaugaaaacagccccuuuaccugccaagac

SEQ ID NO: 95576 - RNA, 64 nt, hsa
ugagcuuauaugacacaauuauuauuugcugauacaugaaaauacugcacuuuaaguuucucaa

SEQ ID NO: 95577 - RNA, 64 nt, hsa
aaagggagaaaugacauguuuucuauuuucuuuucaugaaaacacuguuuuucccccuaauaaa

SEQ ID NO: 95578 - RNA, 64 nt, hsa
guagaaucuacaucaccauccauugcuuuaauuacaugaaaaugcucuaguguugugaugcacu

SEQ ID NO: 95579 - RNA, 64 nt, hsa
gcccauccaggagaaguggguaguaauucuucaucaugaaaaugauauauuacauauuuaguau

SEQ ID NO: 95580 - RNA, 64 nt, hsa
cagaggcccccauauacucugcuacagcuccuaucaugaaaaauaaaauguuugucuuugcaaa

SEQ ID NO: 95581 - RNA, 64 nt, hsa
gauucugaagcaugcacaccucugaagaccccugcaugaaaauaaccuccaaggacccucugac

SEQ ID NO: 95582 - RNA, 64 nt, hsa
gaggggcuuuuauucugccaagucauuucaaauacaugaaaaaucuuacacuggagagaaaccc

SEQ ID NO: 95583 - RNA, 64 nt, hsa
aaaagcauucagcuugccuacuuccuuucauagacaugaaaagacucacacuggaaggaaacac

SEQ ID NO: 95584 - RNA, 64 nt, hsa
gaaaggccuuuauucugccaagucauuucgaagacaugaaaaaacucacacuggagagaaaccc

SEQ ID NO: 95585 - RNA, 64 nt, hsa
gaaaggcuuuuauucucccacgucauuucaaagacaugaaaaaacucacacugcagagaaaccc

SEQ ID NO: 95586 - RNA, 64 nt, hsa
gaaaguguucguauaucacaacucugcucaaagacaugaaaagacucauacuggagagaaaccc

SEQ ID NO: 95587 - RNA, 64 nt, hsa
aaaagcauuccgauaccaccaaucugcucaaaaacaugaaaaggcucauacuggagagaaaccc

SEQ ID NO: 95588 - RNA, 64 nt, hsa
cuuuaagccugcuguaguugaguugcagacagugcaugaaaaaguauuccgcugggaauugagc

SEQ ID NO: 95589 - RNA, 64 nt, hsa
gaguuagacuacauaucuuuuggcacuaacaucucaugaaaaauuaugguuaauaaaauaucac

SEQ ID NO: 95590 - RNA, 64 nt, hsa
auaaacaauacagaaggagagauagaugagagaucaugaaaaccaaauuuuaucuuuuacaugg

SEQ ID NO: 95591 - RNA, 64 nt, hsa
gaccacaugaguucugguugguaaguguccuugucaugaaaacacuugccuuacaaggcucuaa

SEQ ID NO: 95592 - RNA, 64 nt, hsa
aaacguuuccuacauucuuuuccauguguaaaaucaugaaaaagccugucaccggacuugcauu

SEQ ID NO: 95593 - RNA, 64 nt, hsa
aaaaaaacaccucguuuuuaccuugucuucuagacaugaaaaggcaguugcauuccacucugca

SEQ ID NO: 95594 - RNA, 64 nt, hsa
ggaauuugcuuuagccagaauaaagaaaccaaaucaugaaaauuauggaagacuauucugccac

SEQ ID NO: 95595 - RNA, 64 nt, hsa
uuugccccauuuuacagaauaguaaacuaagagccaugaaaaucacuuggccagggucaaggac

SEQ ID NO: 95596 - RNA, 64 nt, hsa
cccucagggaacuuggucuagaaggcacugggaagcucaucagagaaaaugggugcugggccug

SEQ ID NO: 95597 - RNA, 64 nt, hsa
ucgcccucggcgcucugucugccucugccugccagcucaucacgaucugcagggcauugacccu

SEQ ID NO: 95598 - RNA, 64 nt, hsa
uuagggcccugagcccugccuggagagcagcacagcucaucaguccccaaagcccccuggcucu

SEQ ID NO: 95599 - RNA, 64 nt, hsa
acacaggaccugaagcccuaaagaaaggcccucugcucaucaagaaaguggcuaccaaccaggg

SEQ ID NO: 95600 - RNA, 64 nt, hsa
gagccgucacugaguguggcugggcuacaucauagcucaucacggagcuacgacuuuggguacu

SEQ ID NO: 95601 - RNA, 64 nt, hsa
ccugagugaugaugauuaacaccuucuggagccagcucaucagcucagagcccagggucaggag

SEQ ID NO: 95602 - RNA, 64 nt, hsa
cgccggcauagggaccuaaggcccacuggagggcgcucaucaaguagcugcuggauguugacga

SEQ ID NO: 95603 - RNA, 64 nt, hsa
gcccuagauggugcucgccagaccuccucucaaugcucaucacacacagggcuauuccuuuccu

SEQ ID NO: 95604 - RNA, 64 nt, hsa
ucagcgugccugcgauggcguucauguccgucucgcucaucaucaccgacauguccuucuuauc

SEQ ID NO: 95605 - RNA, 64 nt, hsa
aaaagaaaagaaagaagaagccauucccaacguugcucaucaaauuaugaccauaaauuuccag

SEQ ID NO: 95606 - RNA, 64 nt, hsa
guuuuuggaaagauauuuacucaaaauaacuaugcuuuagaacuuuuuuuuuuuuuuuuuuuuu

SEQ ID NO: 95607 - RNA, 64 nt, hsa
uugguuaaacagcagcacuuuuuaguucccuaaacuuuagaagaaaugcuaucagaaauagauu

SEQ ID NO: 95608 - RNA, 64 nt, hsa
gaauuucgguagaacugagugaccuguggaacugcuuuagaaucuaaccugcugucuucgugcu

SEQ ID NO: 95609 - RNA, 64 nt, hsa
auucugguagauuugacuuguuuauaauucugcacuuuagaagaaaaacaguguuaaucuguag

SEQ ID NO: 95610 - RNA, 64 nt, hsa
gauguaucauauuuuuaaauaaaaauaaauauuccuuuagaagaucacucuaucuuuggagguu

SEQ ID NO: 95611 - RNA, 64 nt, hsa
uaagaaaauggaaaaggucaauaaagauauauuucuuuagaaaauggggaucugccauauuugu

SEQ ID NO: 95612 - RNA, 64 nt, hsa
uauuuuauuaacauggaacucuuguuuuuuuaaucuuuagaacuuaaauucuacaagaauuuua

SEQ ID NO: 95613 - RNA, 64 nt, hsa
gaucuuuuuuuugccuuaagaguugaauaugcugcuuuagaacuuuaaaacaagguguaaauga

SEQ ID NO: 95614 - RNA, 64 nt, hsa
gggaaagcaaaaaguagcuguccucccuaaagagcuuuagaagauagcuuaaccuguagguaca

SEQ ID NO: 95615 - RNA, 64 nt, hsa
ugucaggacugucauuuaucuacacauuuguguucuuuagaaaaaggcccacccccugcacaag

SEQ ID NO: 95616 - RNA, 64 nt, hsa
cccagcccucagauggcucuccuacaugauggugcuuuagaaacaaagguaaaauuugccuguu

SEQ ID NO: 95617 - RNA, 64 nt, hsa
gaucccaguguccuuuuccaaaugagugcuguagcuuuagaaguggcccucuauagaaagaagu

SEQ ID NO: 95618 - RNA, 64 nt, hsa
ggguagaauacacucuugacauucuugucuccugcuuuagaaugcuaguguguaucuaucaugu

SEQ ID NO: 95619 - RNA, 64 nt, hsa
guccugucucagggguaaccugcuuacaucuggacuuuagaaucuggcacacaacaaaagugcc

SEQ ID NO: 95620 - RNA, 64 nt, hsa
caguuuucugguaacuuaugauaguagauuguuucuuuagaaacugggcagaagcucugcauuc

SEQ ID NO: 95621 - RNA, 64 nt, hsa
gcauuacauaauaauuuuguggaagcauuuugcccuuuagaauaaauauuagauugauauagcu

SEQ ID NO: 95622 - RNA, 64 nt, hsa
guaucugauggagcuccugaugaccuaauguauccuuuagaaauuuaaaauagcauuagagcaa

SEQ ID NO: 95623 - RNA, 64 nt, hsa
guguauguacacacacacacacaccugccauacacuuuagaagaacgcuucucuucuauuccaa

SEQ ID NO: 95624 - RNA, 64 nt, hsa
gauuuucagcaccugggaaguaaucccaauaauacuuuagaaaaucuaagacaguucuuucugc

SEQ ID NO: 95625 - RNA, 64 nt, hsa
gaaaaaugauuguuucaaggaagugacaguucuacuuuagaaguacuaauuggagaugacuuuu

SEQ ID NO: 95626 - RNA, 64 nt, hsa
agaaucucagcauuguguuaaauaaaaaugaaagcuuuagaaggcaugagauguuccuaucuua

SEQ ID NO: 95627 - RNA, 64 nt, hsa
augcagcuguucugaacuggaauuuuucagcauucuuuagaauuuuaaaugaguagagagcuca

SEQ ID NO: 95628 - RNA, 64 nt, hsa
gaugaauuacuucuucaggguguuaaggcagugacuuuagaaacaaauuuuuuucuuguuuuug

SEQ ID NO: 95629 - RNA, 64 nt, hsa
agaagacacaggggagcaggguuagcucacgugucuuuagaacuccaguacucacccagggacu

SEQ ID NO: 95630 - RNA, 64 nt, hsa
aaaaccaacccaaaccagugaaguuuuuuagaaccuuuagaaggguggucuuuauucagguuuu

SEQ ID NO: 95631 - RNA, 64 nt, hsa
uuauuuuuccuacauuucuuuuuuuuuuuuuuuccuuuagaaugcccuggaaauauauuuaagu

SEQ ID NO: 95632 - RNA, 64 nt, hsa
ccaccacuguauuuugaccaaauaaugacaacuucuuuagaaauuugaauggcuuggugaggaa

SEQ ID NO: 95633 - RNA, 64 nt, hsa
aagugguuucauguuaaaaaacaaacuccuaguccuuuagaaauaacagauucucugcacaaaa

SEQ ID NO: 95634 - RNA, 64 nt, hsa
uagcugauuguauuuuaucucuaaagauuuagaacuuuagaaaaugccgacuucuuccaucuau

SEQ ID NO: 95635 - RNA, 64 nt, hsa
uacuaguccaaaggccaaagcuaauuuauuuccacuuuagaaaaguuagcacaugcuuuugaaa

SEQ ID NO: 95636 - RNA, 64 nt, hsa
uagcccaugggccuuuagaaugcuuuaauccuuucuuuagaaugcuguuuaaacaccauuuacc

SEQ ID NO: 95637 - RNA, 64 nt, hsa
agcucugaaauuugggaaaaaguagcccaugggccuuuagaaugcuuuaauccuuucuuuagaa

SEQ ID NO: 95638 - RNA, 64 nt, hsa
cugucuccaaaaccaugccauaauaauauaagugcuuuagaaauuaaaucauuguguuuuuuau

SEQ ID NO: 95639 - RNA, 64 nt, hsa
caaaauaagggauggucaaauauaugaaacaugucuuuagaaaauuuaggagauaaauuuauuu

SEQ ID NO: 95640 - RNA, 64 nt, hsa
aacucagaacagguuauguaaaaauauagucuggcuuuagaauuuguuaauucaccugcuuugc

SEQ ID NO: 95641 - RNA, 64 nt, hsa
ugaguuuugauuccucuaacuucucagaaugauucuuuagaauucuauaauucauagcaauuuu

SEQ ID NO: 95642 - RNA, 64 nt, hsa
auuucucucugaucuauccuguaauuauucuauacuuuagaagaaaagaucaguucauauuguu

SEQ ID NO: 95643 - RNA, 64 nt, hsa
acuucuuucagagcauuuuaggacauuauggcagcuuuagaaggcugucuuguuucuagccaag

SEQ ID NO: 95644 - RNA, 64 nt, hsa
aguccuaugcauaauguaaagagaauacgauggccuuuagaaaaugcccuuuagcagagaauuu

SEQ ID NO: 95645 - RNA, 64 nt, hsa
cgaaagacuauagcaucacucagucccuguuagacuuuagaagauugauacugaugcacugcau

SEQ ID NO: 95646 - RNA, 64 nt, hsa
cuuugugaaaguaacuuuucaaguaaaugcacaacuuuagaauuucuacaaauaaguucuuuua

SEQ ID NO: 95647 - RNA, 64 nt, hsa
uaaauaaacuuuauuuccucucacuauaguguggcuuuagaauauaucaaguacaaccugaaug

SEQ ID NO: 95648 - RNA, 64 nt, hsa
auuucugucuuuuccaggguaaaagagugcaucgcuuuagaagaaguuuggcaguauuuaaauc

SEQ ID NO: 95649 - RNA, 64 nt, hsa
uuucauucggaauccgaaggauacagucuuuaaacuuuagaauucccaagaaggcuuuauuaca

SEQ ID NO: 95650 - RNA, 64 nt, hsa; identical to SEQ ID NO: 95648

SEQ ID NO: 95651 - RNA, 64 nt, hsa; identical to SEQ ID NO: 95649

SEQ ID NO: 95652 - RNA, 64 nt, hsa
guuaacacauauuucuggcugagauuuuggaacuagcuaguaacuggcuuguguucuuuaagca

SEQ ID NO: 95653 - RNA, 64 nt, hsa
uuagaaaggcuaagugaucuuucucuggcuauccagcuaguaguaaugaagucaggucuugaac

SEQ ID NO: 95654 - RNA, 64 nt, hsa
gggaaauuuugcaauguuuggaggauguugucacagcuaguagcgggugcucugggaucuggug

SEQ ID NO: 95655 - RNA, 64 nt, hsa
acauccaggauuuccgccacccugaauuuaguagagcuaguaggcccuggucgucacucugggc

SEQ ID NO: 95656 - RNA, 64 nt, hsa
ccuauaauuagugcagucuuauguuauaaaagaaagaaguuaacuauauuuggggacaaaaaaa

SEQ ID NO: 95657 - RNA, 64 nt, hsa
gcaaaggcaaaucuaagcaaucauuuuuccccccagaaguuacuuagaaggagaacugggaaca

SEQ ID NO: 95658 - RNA, 64 nt, hsa
ucaaguuaaaauguauuguguuguuuguaaaguaagaaguuacuggccaggagcggcggcucau

SEQ ID NO: 95659 - RNA, 64 nt, hsa
aaaaacaaacaaacaaaacaaaacaaaaaaaaacagaaguuacaaaugaauacucacggauaug

SEQ ID NO: 95660 - RNA, 64 nt, hsa
acauuucccaaguccaugcuuuaaaggguuugcaagaaguuaggguuaaggagaggugaugcca

SEQ ID NO: 95661 - RNA, 64 nt, hsa
ggauguguguaguuucaagauagaaaguuggucaagaaguuauaguggucacaccucaucuauu

SEQ ID NO: 95662 - RNA, 64 nt, hsa
uagcagaggcccugucuucugaagucucaggcuuagaaguuaccaaagugggcucagaaacugu

SEQ ID NO: 95663 - RNA, 64 nt, hsa
uggcaggacuugagguuggcuuccacucugccuuagaaguuaauuuuccaaaguacauuacaaa

SEQ ID NO: 95664 - RNA, 64 nt, hsa
aaauuauuaaguuagcuuuucagaguuuuaauauagaaguuacuagcacugacacacugauuuu

SEQ ID NO: 95665 - RNA, 64 nt, hsa
ucagagugaaacgccuuuacauuugugcggauagagaaguuaacucucccucauaugucacugu

SEQ ID NO: 95666 - RNA, 64 nt, hsa
uaauagaaaaccucagggcccaaguaacagugauagaaguuagaaaaaccuuuacuuagaauug

SEQ ID NO: 95667 - RNA, 64 nt, hsa
gggcccaagccaggagaucgcuugguuuucuuccagaaguuaaauggggggaucugaagauuug

SEQ ID NO: 95668 - RNA, 64 nt, hsa
uuuuuuuuuaaaucaugguaccuguuuuaaaaugagaaguuauuauucauacuguguugcucau

SEQ ID NO: 95669 - RNA, 64 nt, hsa
caagguacauuguucuacuguuuuauacccagguagaaguuacacagcaauuuagcaauguugu

SEQ ID NO: 95670 - RNA, 64 nt, hsa
cagagaguaaacuugaauggaauaacgacauuccagaaguuaaucauuugaauucugaacacug

SEQ ID NO: 95671 - RNA, 64 nt, hsa
ucaugaaugcuccacaauuucaacauaccacaagagaaguuaauuucuuaacauuguguucuau

SEQ ID NO: 95672 - RNA, 64 nt, hsa
ugggaugcaaaguaccuaaagaucucugauccuaagaaguuacuucuggccaggcgcgguggcu

SEQ ID NO: 95673 - RNA, 64 nt, hsa
ugggcaacagagggagacucugucucaaaaaaaaagaaguuacuuccaagacagacuuuuaaga

SEQ ID NO: 95674 - RNA, 64 nt, hsa
ccccuccuagcuugacuuuagugguuuccaauguagaaguuaacaaaguaugccccauuccugu

SEQ ID NO: 95675 - RNA, 64 nt, hsa
aauggccuagccauucucuaagucccauccuggaagaaguuauuucuucaagagcugcaccucu

SEQ ID NO: 95676 - RNA, 64 nt, hsa
guuaaaauacccuuaaggagguucaagcagagugagaaguuaaaauacccuuaaggucuuuaag

SEQ ID NO: 95677 - RNA, 64 nt, hsa
uugcgucccgaaggacggagguucaagcagagugagaaguuaaaauacccuuaaggagguucaa

SEQ ID NO: 95678 - RNA, 64 nt, hsa
uugauuuuuagagguaaugaaaacuuccuuucugagaaguuaguguuaaggucuuggaauguga

SEQ ID NO: 95679 - RNA, 64 nt, hsa
gguaccacagugaggugaauaaaacgggauuuucagaaguuagccugaauuuaacuguauuuuu

SEQ ID NO: 95680 - RNA, 64 nt, hsa
ugaugguuaacauguuuuaaaaaaucuuuaauggagaaguuaaauauuuggugagauuuuaguc

SEQ ID NO: 95681 - RNA, 64 nt, hsa
cacagagauuuauaguauucuuaauaguaugugcagaaguuacaucauuuaaaaaacccuugcu

SEQ ID NO: 95682 - RNA, 64 nt, hsa
uagcacuuuuagagccaaaaaaacucaggcacaaagaaguuaaauaacuugccgggugcggugg

SEQ ID NO: 95683 - RNA, 64 nt, hsa
aaaaacaaaaacaaaacaaaacaacaacaaaaaaagaaguuaaauaacuuguuuaagaucacac

SEQ ID NO: 95684 - RNA, 64 nt, hsa
cuugugaucuucacugaggaauuagaacuaugauagaaguuaggcuguggcaaaugggacauuc

SEQ ID NO: 95685 - RNA, 64 nt, hsa
gauuugccuggacuucccuucccagggagggaacagaaguuaggaggcaacuuugggauggugc

SEQ ID NO: 95686 - RNA, 64 nt, hsa
aauaauuuaaaaauuaauuauuuuacauaauuaaagaaguuaaaaacuauuaacauuaaauaau

SEQ ID NO: 95687 - RNA, 64 nt, hsa
aaaguaggguaagggaaugccagucugaggaguuagaaguuaccguuuuauguaagguaauuau

SEQ ID NO: 95688 - RNA, 64 nt, hsa
cugguggacugaauguagguugagagaggaagcgagaaguuaaggaugccuucaaaauuuuugu

SEQ ID NO: 95689 - RNA, 58 nt, hsa
acugcauagauacggguauuuauuuuacccuaagaagauuuugaaguuuaaaaguacu

SEQ ID NO: 95690 - RNA, 58 nt, hsa
uuguaaaagagaugucuucaugucuuccccuaagaauacgcuuuuccuaacaggcuac

SEQ ID NO: 95691 - RNA, 58 nt, hsa
guggggugugauggaacaggccaguuggccuaagaauuaguacuugcucuaauaaugg

SEQ ID NO: 95692 - RNA, 58 nt, hsa
uuguuacucaaaguaaaguacuaggaguccuaagaaauguucuguucuuguacauuau

SEQ ID NO: 95693 - RNA, 58 nt, hsa
augaaggccagugacaugacaacugugaccuaagaaaugggaagauuaucuuucaaga

SEQ ID NO: 95694 - RNA, 58 nt, hsa
aaaauggacuuuguaauuguacagcauaccuaagaaacucagaaggugcauuuaagag

SEQ ID NO: 95695 - RNA, 58 nt, hsa
augaucaagugaagagccccagauucccccuaagaagcaaaggaucgucuuuuaugcc

SEQ ID NO: 95696 - RNA, 58 nt, hsa
cccucauaguaccaagaauggacugcccccuaagaaaccuguuugagaaucacugaau

SEQ ID NO: 95697 - RNA, 58 nt, hsa
ugcaugaguucucgaaaauggugggaaaccuaagaaaggaggagggcuguauucacug

SEQ ID NO: 95698 - RNA, 58 nt, hsa
caagagguggggaccaaaaccaugcauuccuaagaaguccccaggucaugcugcuguu

SEQ ID NO: 95699 - RNA, 58 nt, hsa
aacugaggaaaaaaaauaauuaaacaggccuaagaagaaaucaaaaaccauaagacac

SEQ ID NO: 95700 - RNA, 58 nt, hsa
uagaacugugccacuaauuaaaggaaauccuaagaaggugcauuucuuuacagagcug

SEQ ID NO: 95701 - RNA, 58 nt, hsa
accauuaaucagaaacaucauggcaaccccuaagaauagacuaaguuuguguuggcug

SEQ ID NO: 95702 - RNA, 58 nt, hsa
agcagagugugguuaucuccuguaccagccuaagaauguuugcugaaacugcuuccua

SEQ ID NO: 95703 - RNA, 58 nt, hsa
ugacaagaaauucuuaugcagccuuuuaccuaagaaauuuucugucagugccuuaucu

SEQ ID NO: 95704 - RNA, 58 nt, hsa
agagaaggguuucaucuucuaagauaucccuaagaaauucuucaaaaguaacggaauc

SEQ ID NO: 95705 - RNA, 58 nt, hsa
ugaagagauucuggaaaugcaucaauaaccuaagaaaaagcgacauaaaaauauacuu

SEQ ID NO: 95706 - RNA, 58 nt, hsa
uuuuccugucuguauauaacuuauuugcccuaagaacuuugagaaucccaauuauuua

SEQ ID NO: 95707 - RNA, 58 nt, hsa
agagccucuguacgcgcagaucaacagaccuaagaaauagcaucgaugcgagcucgug

SEQ ID NO: 95708 - RNA, 58 nt, hsa
aaagaaucucaggaagaacagacuuccuccuaagaaggagaaaaggcauuuuuaaagg

SEQ ID NO: 95709 - RNA, 55 nt, hsa
uuauuacaguuccuaauugaggacaccuaagaaggcaugguacucugacaaaggu

SEQ ID NO: 95710 - RNA, 58 nt, hsa
uuuuuucccccaagugaagaggcagaaaccuaagaaguuaucuuuucuuucuacccaa

SEQ ID NO: 95711 - RNA, 58 nt, hsa
agagaagcaaaugcggagccugcucccuccuaagaagaucccaagaauccaauggcuc

SEQ ID NO: 95712 - RNA, 58 nt, hsa
uaggaaauccgggagguauucuggcuucccuaagaaacaauggaagagaaggagcuug

SEQ ID NO: 95713 - RNA, 58 nt, hsa
uauuuguagcucauuuauuugguuauuuccuaagaauauugaaagugaagcaacuaug

SEQ ID NO: 95714 - RNA, 58 nt, hsa
auuauaacugaaagguuuaaauauacuaccuaagaaaaaaguacuucugugacauaua

SEQ ID NO: 95715 - RNA, 58 nt, hsa
aaagaagcagcaguccugccccaguucuccuaagaaaaauccgcugugggcagagaac

SEQ ID NO: 95716 - RNA, 58 nt, hsa
ugcuuuuucuccauggaugaggcuagacccuaagaaguaauuaagucaauguaaauca

SEQ ID NO: 95717 - RNA, 58 nt, hsa
uaccaugggauaaaaauauguaucccugccuaagaauaacuugugcauuuguuaugga

SEQ ID NO: 95718 - RNA, 54 nt, hsa
cccagacccaagagcugugagcugccuaagaaaucauggcauucacacagccca

SEQ ID NO: 95719 - RNA, 58 nt, hsa
gccgaagaguugaugucaaucuuuuuuuccuaagaaaaaaaguccgcgaguauuaaau

SEQ ID NO: 95720 - RNA, 58 nt, hsa
gguuguaaaagagaacccuuguucccuuccuaagaaacugccuuccacaauuaaagaa

SEQ ID NO: 95721 - RNA, 58 nt, hsa
cuacaaaggguuuuagugccuuagaaguccuaagaagcccaaucuguaucaaagcaga

SEQ ID NO: 95722 - RNA, 58 nt, hsa
agucaagggaaggacaaucccaggaaguccuaagaaguggggcagauggcagggcuga

SEQ ID NO: 95723 - RNA, 58 nt, hsa
uugcuacuaaaaguagggcauaugaccgccuaagaaacagaacuucgagaaguccuaa

SEQ ID NO: 95724 - RNA, 58 nt, hsa
ucaccccaggaauuagucacuaagaauuccuaagaacuuucuaucaaaagcauuggau

SEQ ID NO: 95725 - RNA, 58 nt, hsa
augauaaaaggaaguagaugugaaaaagccuaagaaaaaggaaauuggacaguuuuga

SEQ ID NO: 95726 - RNA, 58 nt, hsa
gugguuaagugaacgagaacucugccuaccuaagaaguucauuguguucuaaguggaa

SEQ ID NO: 95727 - RNA, 58 nt, hsa
auaaaagagcaaagagcuuugggaaauaccuaagaagcaccuuaagauuaggguggca

SEQ ID NO: 95728 - RNA, 58 nt, hsa
accugcccaaggauuuauucauagcuuaccuaagaauuucaaauuucuaccauaacac

SEQ ID NO: 95729 - RNA, 58 nt, hsa
gguagauuaaauauagauuagaaaaauuccuaagaaucagaguagaaauaaaagugaa

SEQ ID NO: 95730 - RNA, 58 nt, hsa
uauguauaaaaauuaaacugggcaauagccuaagaaggggggaauauuguaacacaaa

SEQ ID NO: 95731 - RNA, 58 nt, hsa
aauaggauuuacuuuuuucuaauucugaccuaagaaaaauaaugagaacaagcuguug

SEQ ID NO: 95732 - RNA, 58 nt, hsa
gcaaagccauuuuucagacagagccauuccuaagaacacugaagggcuggaaugcugg

SEQ ID NO: 95733 - RNA, 58 nt, hsa
auaucuaaaauauuauuuuauuauauugccuaagaauaaacauuuguuaaauuggagc

SEQ ID NO: 95734 - RNA, 58 nt, hsa
ccugcacuucuuguuccaugcuugggguccuaagaacaagccaucugaugccucuacu

SEQ ID NO: 95735 - RNA, 58 nt, hsa
uuucuaagauaagccuuaaacagaaaccccuaagaaagguucucugaaaauuauuugg

SEQ ID NO: 95736 - RNA, 58 nt, hsa
cgauugccaaagagcaucuaccuuaccuccuaagaagaaaagccacuuucuuccaauc

SEQ ID NO: 95737 - RNA, 58 nt, hsa
uugcacucuuuguauuuguuguuaaaugccuaagaaguuuucuaaaaauuuuguaaag

SEQ ID NO: 95738 - RNA, 58 nt, hsa
ugauuuuagcguggacuaggacacuuaaccuaagaagaguuucacuuaaucauucaaa

SEQ ID NO: 95739 - RNA, 58 nt, hsa
agucaggaucugaugucuuucuggucucccuaagaaaacuaagcucuugagggacagc

SEQ ID NO: 95740 - RNA, 58 nt, hsa
aaggcagugcagucacuaacucugauuuccuaagaaaggugggcagcauuagcagaug

SEQ ID NO: 95741 - RNA, 58 nt, hsa
uucauuucaaucuuuucauaauuguugaccuaagaauauaauacauuugcuagugaca

SEQ ID NO: 95742 - RNA, 58 nt, hsa
gucaauucuuaaaauuuuuuauuuguucccuaagaaaguaauuacuguuucuguugcc

SEQ ID NO: 95743 - RNA, 58 nt, hsa
ccagguccaccuaacacccccucccuccccuaagaagauggauguccucaaaagagaa

SEQ ID NO: 95744 - RNA, 58 nt, hsa
uuccugcaguagaaugggggcagcaccuccuaagaaggcaccucucuggguugaaggg

SEQ ID NO: 95745 - RNA, 58 nt, hsa
cugaucugagagcugggcggcguccacaccuaagaacagcagcuccaccaaaugaagu

SEQ ID NO: 95746 - RNA, 58 nt, hsa
uugcacuauucugagggaaaaucugacaccuaagaaauuuacugugaaaaagcauuuu

SEQ ID NO: 95747 - RNA, 58 nt, hsa
agacuaccuuagcaugaagaugcucaugccuaagaaugaaaauuguugagguuaucuc

SEQ ID NO: 95748 - RNA, 58 nt, hsa
agccaauguguuaaccugucucugucaaccuaagaauguuggccuuacugacacaccu

SEQ ID NO: 95749 - RNA, 58 nt, hsa
ggugaugugagccuacaucaggguggguccuaagaaacauggcaaaccaggcugucuc

SEQ ID NO: 95750 - RNA, 58 nt, hsa
uguuaccagcauccuccauaucaaagacccuaagaaucagguggggaaggaggugauc

SEQ ID NO: 95751 - RNA, 58 nt, hsa
aauuauacuuuauauaaggcauuccacaccuaagaacuaguuuugggaaauguagccc

SEQ ID NO: 95752 - RNA, 58 nt, hsa
caauguccuucgaaaccucaacacgaggccuaagaauuuccuaagccaugucuuguac

SEQ ID NO: 95753 - RNA, 58 nt, hsa
ccaaggauguuuugcaggaugcccugauccuaagaagggggccugggggugcgugcag

SEQ ID NO: 95754 - RNA, 58 nt, hsa
uucaaggaacagccacaaaauacacaccccuaagaaaaggcaagacuugaacguucug

SEQ ID NO: 95755 - RNA, 58 nt, hsa
uuuucuuaaucauuucaguguucgaccaccuaagaaaaguuggaaaaagaucuucaac

SEQ ID NO: 95756 - RNA, 58 nt, hsa
cagaccucuccacagcucaaagcauugcccuaagaaucagaaguaaagauaauccaag

SEQ ID NO: 95757 - RNA, 58 nt, hsa
cagugugcaggggacucaggggcuuggcccuaagaauguuuugcacugacagugggag

SEQ ID NO: 95758 - RNA, 58 nt, hsa
aaacagccucucucaccaaguucccuugccuaagaaggccacucccucccaccccacu

SEQ ID NO: 95759 - RNA, 58 nt, hsa
uacuggaucaaugaaugaauaaaacucuccuaagaaucuccugagaaaugaacccucc

SEQ ID NO: 95760 - RNA, 58 nt, hsa
uguggcuucucaauaaauauucagauguccuaagaauauacguuugggucugucuucc

SEQ ID NO: 95761 - RNA, 58 nt, hsa
gucugcuucugaaucacugggggugucuccuaagaacugugccucggguuuuucaaua

SEQ ID NO: 95762 - RNA, 58 nt, hsa
gaaacuccagguccauucuguuuaaaucccuaagaaugucagaauuaaaauaacaggg

SEQ ID NO: 95763 - RNA, 58 nt, hsa
guggaaccaaaccaccuuagugaguaacccuaagaauugacacaaaucucauauuuua

SEQ ID NO: 95764 - RNA, 58 nt, hsa
guacagguugaaauaguucuguggcuguccuaagaaauaaugggaaaagaaucucugg

SEQ ID NO: 95765 - RNA, 58 nt, hsa
uuuaauuuaaaaaauuuaauuuguccuuccuaagaaggauaaauauauaaaaaagcca

SEQ ID NO: 95766 - RNA, 58 nt, hsa
uuaaaagugaauuuaaccacaacugagaccuaagaaauugaccuaggggugugugugu

SEQ ID NO: 95767 - RNA, 58 nt, hsa
agaaacucugcagggcacuccccuguuuccuaagaacgaaaaagugcaauaaaggcca

SEQ ID NO: 95768 - RNA, 58 nt, hsa
gaauuacuuuguuguagugaggaaaaaaccuaagaaauuuccccuuuuuuuaaaaaau

SEQ ID NO: 95769 - RNA, 58 nt, hsa
auuuggggaaacacaacguugaaaacuuccuaagaaaaggaaucuugcccuugaaucu

SEQ ID NO: 95770 - RNA, 58 nt, hsa
aauauuuuguuucuuggaacccaaugauccuaagaaaauuauguacuuuuaccugaaa

SEQ ID NO: 95771 - RNA, 58 nt, hsa
ugccaagacggcuauuagcaucagcuguccuaagaagcaguugucacauaaaggaguc

SEQ ID NO: 95772 - RNA, 58 nt, hsa
agucuggguccauuauuuuggcagaacuccuaagaauuuaugggagccuauauaaaca

SEQ ID NO: 95773 - RNA, 58 nt, hsa
uuuuaggcuacaauauuuguuuaaccucccuaagaacuuucaaggcaucuguccugaa

SEQ ID NO: 95774 - RNA, 58 nt, hsa
cugagcugcuuuucaccaucucaagaagccuaagaaguuauauauuuaaucagguaga

SEQ ID NO: 95775 - RNA, 58 nt, hsa
gauuauaaccuuauuaacuaugcauaggccuaagaaagguggcaaugaacugugcaug

SEQ ID NO: 95776 - RNA, 58 nt, hsa
uuguauaaaaugcuguguuuaaaugaagccuaagaaacuaucuguaacauauuuugca

SEQ ID NO: 95777 - RNA, 58 nt, hsa
aagaugaacaaagguuaauuuaaacuuaccuaagaagaugagaaucaaacaaaacaga

SEQ ID NO: 95778 - RNA, 58 nt, hsa
ggugaaagugugcuauggccuuuucaagccuaagaagucucucuuacugaguaaacca

SEQ ID NO: 95779 - RNA, 58 nt, hsa
auauccuuuagcuauagguucuucucucccuaagaacauuagauauuuuaguuuucca

SEQ ID NO: 95780 - RNA, 58 nt, hsa
gauguaaauggaauuauaaauacugugaccuaagaaaagacccacuagaaaguaauug

SEQ ID NO: 95781 - RNA, 58 nt, hsa
ggccugcuucuagugaguuauuaccuuuccuaagaagccagguaucgcacuucagcag

SEQ ID NO: 95782 - RNA, 58 nt, hsa
uggaaguguucccugagaaacccaccagccuaagaagcucuggccccaggcuugucac

SEQ ID NO: 95783 - RNA, 58 nt, hsa
uguacuuucaaugaaauugugaucauuuccuaagaaaagguaaaauucacuaucauau

SEQ ID NO: 95784 - RNA, 58 nt, hsa
agaaccauggggauuuuuuuuuaaugugccuaagaaauuuucucugaggcuuuagcaa

SEQ ID NO: 95785 - RNA, 58 nt, hsa
guccaaaguuuauuuauuuauuuauuacccuaagaaugcuuugccauaaccacauuua

SEQ ID NO: 95786 - RNA, 58 nt, hsa
auagugcaaggagcuccauuuccgagcuccuaagaaauaugcuucaaaggucaaacau

SEQ ID NO: 95787 - RNA, 58 nt, hsa
aacaccagagauccaccuaacugcucauccuaagaagggacuuguuauuggguuuugg

SEQ ID NO: 95788 - RNA, 58 nt, hsa
auacauuuuauaagcuauauuuuaaaggccuaagaacauggcaaguauuuacuuuuau

SEQ ID NO: 95789 - RNA, 58 nt, hsa
aauaucuuccgccuggugcugggcauauccuaagaacuuacaacuuuccuguauuauc

SEQ ID NO: 95790 - RNA, 58 nt, hsa
guugcccuuccccucccucgggaagccaccuaagaauguuuacaugccaaacagaaug

SEQ ID NO: 95791 - RNA, 58 nt, hsa
cuccacuugcagggacuccuuuuauuucccuaagaaagagcugaaaugacugagaacu

SEQ ID NO: 95792 - RNA, 58 nt, hsa
auaagggcuuuuucuccccgcaaacaccccuaagaaugguucuguguaugugaaugag

SEQ ID NO: 95793 - RNA, 58 nt, hsa
ggaagaagauauuuuaagaaccaguuauccuaagaauucugagcacgccucuucugag

SEQ ID NO: 95794 - RNA, 58 nt, hsa
cuaaaacuguaaaaauccuggaauauaaccuaagaaauaccaauguggacauagggcc

SEQ ID NO: 95795 - RNA, 58 nt, hsa
gauugagcauggcucucuauucccucagccuaagaaacacucaugggaaugcauuugg

SEQ ID NO: 95796 - RNA, 58 nt, hsa
uuuggacugaguuuggguucucugcuguccuaagaacuucaguguagagaaaauaaga

SEQ ID NO: 95797 - RNA, 58 nt, hsa
uccuucucuugaccggaaacccugggacccuaagaaccccugaagcuuggggugggug

SEQ ID NO: 95798 - RNA, 58 nt, hsa
uucaaauugcccaaggaaauauugugauccuaagaauauuaagauaauuuuagguuaa

SEQ ID NO: 95799 - RNA, 58 nt, hsa
uaaaauauaaugaagcugaaaccuuuggccuaagaagaaaauggaaguaugugccacu

SEQ ID NO: 95800 - RNA, 58 nt, hsa
ugaauauaaucaacacuauugaacuguaccuaagaauaguuaauaaaaaacugagugu

SEQ ID NO: 95801 - RNA, 58 nt, hsa
ggugcccgcuggccacagccagguuuucccuaagaagauguuauuuuguuggguuuug

SEQ ID NO: 95802 - RNA, 58 nt, hsa
cagcugaaugguuuaaucugacuggcuuccuaagaaauguuuaagacucagcuuuaaa

SEQ ID NO: 95803 - RNA, 58 nt, hsa
auuauuauuauucacaacagacacuuucccuaagaaucucaaacugauuuuuaaaaau

SEQ ID NO: 95804 - RNA, 58 nt, hsa
auguguacuuucuaacaggggauugguaccuaagaaaugugguagcauuauucagaaa

SEQ ID NO: 95805 - RNA, 58 nt, hsa
cuccaacaagacaugcauaccauuggugccuaagaaagauuuuuuuacaguuguguuu

SEQ ID NO: 95806 - RNA, 58 nt, hsa
uuguuuaaauuuaaugaaacaaaaaauuccuaagaaauaccacccuaccacuaacaaa

SEQ ID NO: 95807 - RNA, 58 nt, hsa
cuuacuaaaaauaguugaaaauuauucaccuaagaauagaaucucagcauuguguuaa

SEQ ID NO: 95808 - RNA, 58 nt, hsa
agggaauucagauucugaccagccaggcccuaagaaaaaauuuaaagcuccccagagc

SEQ ID NO: 95809 - RNA, 58 nt, hsa
aggcaggccucucaacuccaggugcuguccuaagaauuuuuacccagggccugucuuc

SEQ ID NO: 95810 - RNA, 58 nt, hsa
uuaugguuuagguaacaguuagauguuuccuaagaaugcaaacugccuuuuccacaca

SEQ ID NO: 95811 - RNA, 58 nt, hsa
aaaucaaaacccagugaaucucauuacuccuaagaaacgaaagauuccuucaaagccu

SEQ ID NO: 95812 - RNA, 58 nt, hsa
uagaacucauccuguuucaagggaaguaccuaagaagauauagaguguuucuagggua

SEQ ID NO: 95813 - RNA, 58 nt, hsa
aguccauugcaauacguguuucuaacuuccuaagaaauugucacacagcccucuguag

SEQ ID NO: 95814 - RNA, 58 nt, hsa
uuuuucuaagggucaguugggacauuaaccuaagaaacauaucuauuaagcacuuguu

SEQ ID NO: 95815 - RNA, 58 nt, hsa
auuuagcaauuugaagacacuaugccuuccuaagaacuaauuuaauucuaaauauuuu

SEQ ID NO: 95816 - RNA, 58 nt, hsa
uuuauuuguauuuaaauguuuuaggcaaccuaagaacaaauguaaaaguaaagaugca

SEQ ID NO: 95817 - RNA, 58 nt, hsa
auuugucaaagaggccuuugaagagaccccuaagaaacacagagaguguuuaguuaag

SEQ ID NO: 95818 - RNA, 58 nt, hsa
aauagacuuaaaucucauugcuuacaagccuaagaaucuuuagagaaguauacauaag

SEQ ID NO: 95819 - RNA, 58 nt, hsa
acugugaagacuaauuuauaaaugugaaccuaagaaaacuccaccucugaaggaaauc

SEQ ID NO: 95820 - RNA, 58 nt, hsa
uuucaaaauaguucguucuuguguuugaccuaagaaugauugucgcaugaaguguuug

SEQ ID NO: 95821 - RNA, 58 nt, hsa
agauggggauaaaaugacuacuuagcauccuaagaaauaugugagauuuuuuauugcu

SEQ ID NO: 95822 - RNA, 58 nt, hsa
acgggagggacccgagccuggcuuuugaccuaagaacccuagcaggagaauacagucu

SEQ ID NO: 95823 - RNA, 54 nt, hsa
ugcaucgggauucagaaugaccaaccuaagaagcacaaauuuaguuuggguguu

SEQ ID NO: 95824 - RNA, 58 nt, hsa
ucugcuuauuuuacaauauacacguuucccuaagaaaucauggcagagaugugagggc

SEQ ID NO: 95825 - RNA, 58 nt, hsa
ggggaggacuggauaauugguuuuccccccuaagaacauuuauuuacgucuuaagagc

SEQ ID NO: 95826 - RNA, 58 nt, hsa
ucuacaggcaggguaggcacaggugcagccuaagaagggaaccugcuuccucucccuu

SEQ ID NO: 95827 - RNA, 58 nt, hsa
caagugcuccugaaagaaacgcuagaagccuaagaacuguggucugguguuccagcug

SEQ ID NO: 95828 - RNA, 58 nt, hsa
agggugguuuauaaagccuguaaacacaccuaagaaaauaaacauuuuacaaaugagc

SEQ ID NO: 95829 - RNA, 58 nt, hsa
uaguaaacuuuaaaaaauagauuuuuucccuaagaaagaauguuuguagaauuuaaag

SEQ ID NO: 95830 - RNA, 58 nt, hsa
ccugaucauaguauucugucagauaaugccuaagaaugaccgcugaagaacguugacc

SEQ ID NO: 95831 - RNA, 58 nt, hsa
acucuaaaagauccuuuuuaaauucaguccuaagaaagaggagugcuuguccccuaag

SEQ ID NO: 95832 - RNA, 58 nt, hsa
uuuuagauauucuuuuagcaguguagagccuaagaaacuugguucuacuaccaugauc

SEQ ID NO: 95833 - RNA, 58 nt, hsa
auguuacaauuguguuucuuaaauugagccuaagaauggaguuaauuggaaauauaca

SEQ ID NO: 95834 - RNA, 58 nt, hsa
agccccucucugugugcagccggaggguccuaagaauggcucccggagcuaacugagg

SEQ ID NO: 95835 - RNA, 58 nt, hsa
uauuucccaguauaaugauacaucguagccuaagaaauauuuucucaauguaauuccc

SEQ ID NO: 95836 - RNA, 58 nt, hsa
ggagaaggguuggucuucugccagggucccuaagaacagguuugcagcuacccucucu

SEQ ID NO: 95837 - RNA, 58 nt, hsa
uaauuacaauguaaauagcuuuuuauuuccuaagaaauaauuuaauguuuaguaaaaa

SEQ ID NO: 95838 - RNA, 58 nt, hsa
ucugcuccaguaugauaauuuuuaauugccuaagaaucauuggaucagaccuaaauga

SEQ ID NO: 95839 - RNA, 58 nt, hsa
acggccugucuccuccugcagggcccacccuaagaauguauuuuuaaacacaugaaau

SEQ ID NO: 95840 - RNA, 58 nt, hsa
uguguuaaagcugcucucaccagugaaaccuaagaaaugagcagguuggcagcuaggg

SEQ ID NO: 95841 - RNA, 58 nt, hsa
cccaccuuccuggaggcaggaccuucggccuaagaaacacaggcccuggugcuaucug

SEQ ID NO: 95842 - RNA, 58 nt, hsa
aguggaugcauuccugagucuuccagagccuaagaaaaucaucuuggccacuuuaaua

SEQ ID NO: 95843 - RNA, 58 nt, hsa
auacaucauuucacuuaaaguugcaguuccuaagaaccuauugaugauguucagugca

SEQ ID NO: 95844 - RNA, 58 nt, hsa
gggagaggccaggcgcagcucacugcggccuaagaaggugaagcaacaugggaacaca

SEQ ID NO: 95845 - RNA, 58 nt, hsa
ucucgagggcagcacugacaaauguguuccuaagaagacauucagacccagguguuau

SEQ ID NO: 95846 - RNA, 58 nt, hsa
ucuugcugaaauuaugauaguuaagauuccuaagaacuugacaaugcuccccuggcuu

SEQ ID NO: 95847 - RNA, 58 nt, hsa
aagaaggagaccacauaccccaaagugaccuaagaacacuuuaaaaagcaacauguaa

SEQ ID NO: 95848 - RNA, 58 nt, hsa
ggaugcaaaguaccuaaagaucucugauccuaagaaguuacuucuggccaggcgcggu

SEQ ID NO: 95849 - RNA, 58 nt, hsa
agaacgaugccauaucuggcugccuuuuccuaagaagaguccacccuaauuaaugucc

SEQ ID NO: 95850 - RNA, 58 nt, hsa
auuauaaccuuaauuuauuauuaacauaccuaagaaguacauuguuaccucuauauac

SEQ ID NO: 95851 - RNA, 58 nt, hsa
agugacuuugacugcuggggaauuuccuccuaagaaccuuauucccaaaauaagccag

SEQ ID NO: 95852 - RNA, 58 nt, hsa
ugagaccaaguuuuuucuaaucucagccccuaagaaaccuaauuugugcuuaggaauc

SEQ ID NO: 95853 - RNA, 58 nt, hsa
gauuuggacuuggcuggcuugcagggguccuaagaaacuccacucuggacagcgccag

SEQ ID NO: 95854 - RNA, 58 nt, hsa
uguauuaugcuuugaaaacuccaucccuccuaagaaucuuaaaaaacuugaaaugcuc

SEQ ID NO: 95855 - RNA, 58 nt, hsa
guagaaagguauaucaucaacuucuauaccuaagaauauaggauugcauuuaauaaua

SEQ ID NO: 95856 - RNA, 58 nt, hsa
gcccuuuucucagagaucacucaauaaaccuaagaacccuccuaccggcuccagccuu

SEQ ID NO: 95857 - RNA, 58 nt, hsa
cuguaugcaugggcauuaccccucagguccuaagaaauaaguccugaaugcaugucgu

SEQ ID NO: 95858 - RNA, 58 nt, hsa
ugggaaugcugcugcuucaaccccagagccuaagaauggcagccguuucuuaacaugu

SEQ ID NO: 95859 - RNA, 52 nt, hsa
auuccaauaaaaguguuugauuccuaagaaagaaaauauuuuuguggacaug

SEQ ID NO: 95860 - RNA, 58 nt, hsa
aauuagguuuggagggaacuuugaucuuccuaagaauuaaaguugccaaauuauucug

SEQ ID NO: 95861 - RNA, 58 nt, hsa
acaggagucaggaaaaugaggcacuaagccuaagaaguucccugguuuuucccagggg

SEQ ID NO: 95862 - RNA, 58 nt, hsa
cagcuaaauuugcaauuccaacuuucauccuaagaauaauaacuguaauggcaaagcg

SEQ ID NO: 95863 - RNA, 58 nt, hsa
gugcuguucuucuggauaacuguucacgccuaagaaauuaaaagacagaacaaaacug

SEQ ID NO: 95864 - RNA, 58 nt, hsa
agaaaccugaaaaccgaauuguaggaguccuaagaauguuaucuaccuugugccugua

SEQ ID NO: 95865 - RNA, 58 nt, hsa
gagguuaaggaacuguguuaccuuuuguccuaagaaaaaggcuugaauuuauguaaau

SEQ ID NO: 95866 - RNA, 58 nt, hsa
accuagauauaccauuaucccuuuuauaccuaagaagggcaugcuaauaauuaccacu

SEQ ID NO: 95867 - RNA, 58 nt, hsa
aaagugaagaccaaguccagaacugaauccuaagaaaugcaggacugcaaagaaauug

SEQ ID NO: 95868 - RNA, 58 nt, hsa
ccccaccucgggccucacgacggugcuaccuaagaaagucuucccucccaccccccgc

SEQ ID NO: 95869 - RNA, 58 nt, hsa
cuucccuuuuaaagguuaaaguuucuaaccuaagaauuaaguacgcguucaggaagcu

SEQ ID NO: 95870 - RNA, 58 nt, hsa
gaaacuuggagcuuugacaaggaacuuuccuaagaaaccgcugauaaccaggacaaaa

SEQ ID NO: 95871 - RNA, 58 nt, hsa
aaguggcuuuuggauauccugauuggggccuaagaagggcauucagacuugaauuuua

SEQ ID NO: 95872 - RNA, 58 nt, hsa
accuacugcaaaaagauuguccaaaaugccuaagaaaauacuccucugaugcauuuag

SEQ ID NO: 95873 - RNA, 58 nt, hsa
caguaauaaauagcucugaaauaacaguccuaagaacuccuaaaguccugagaacuuu

SEQ ID NO: 95874 - RNA, 58 nt, hsa
cacugcccuuacuuuaggcucucaugccccuaagaaaagugaauuuccuuuaacaccg

SEQ ID NO: 95875 - RNA, 58 nt, hsa
agaugucguggcucaggguguaaauauuccuaagaauggcagcaucuauuuccucuuu

SEQ ID NO: 95876 - RNA, 58 nt, hsa
ucacacugggcuccaugauauucuguucccuaagaacugcuucugugugcccuguuuu

SEQ ID NO: 95877 - RNA, 58 nt, hsa
aaaugcuuuguaauuauugacuucagccccuaagaaugcuaugauuucacgugcaggu

SEQ ID NO: 95878 - RNA, 58 nt, hsa
uuauuuccuucagggacagauuuuccaaccuaagaaacuaccuaccguguguauucuc

SEQ ID NO: 95879 - RNA, 58 nt, hsa
gaaaucacaucuugcccacaugcuguaaccuaagaaacugcuaugcaaggcugggugc

SEQ ID NO: 95880 - RNA, 58 nt, hsa
gugaaggucagcaguuuucuaacuugugccuaagaauuauugggaaaugaaaaugcau

SEQ ID NO: 95881 - RNA, 58 nt, hsa
uugucucacccgcagugccaauaacacuccuaagaaauguugauggcuauuuuguggu

SEQ ID NO: 95882 - RNA, 58 nt, hsa
ucuauacacauguguagugugucaagacccuaagaacauguauuugaaggaaggucua

SEQ ID NO: 95883 - RNA, 58 nt, hsa
guuugugugugcauguguguuuauuguuccuaagaauuuggcacaagucagagauaau

SEQ ID NO: 95884 - RNA, 58 nt, hsa
accuagaaauuuuucauucccauaucuaccuaagaaggaagcaguaaauccauaauuu

SEQ ID NO: 95885 - RNA, 58 nt, hsa
cagaagcaggauaguauaaaagcaucagccuaagaauggcacucccacuaacuagcua

SEQ ID NO: 95886 - RNA, 58 nt, hsa
uguaauuaaucgaagucacauuuccugaccuaagaauuuauuuuagguuuccuguaaa

SEQ ID NO: 95887 - RNA, 58 nt, hsa
gcaaccuucacugguuuugaacucagugccuaagaaagucucugaaauguucguuuuu

SEQ ID NO: 95888 - RNA, 58 nt, hsa
cuagaggguugcugccuuucaagcggugccuaagaaguuauuuucuuguuuaacauau

SEQ ID NO: 95889 - RNA, 58 nt, hsa
aagcugauauuuuaggugcucuaaagcaccuaagaaaagaacugcaaagucugagaaa

SEQ ID NO: 95890 - RNA, 58 nt, hsa
ugucuggauuaucuuccuuuucucauggccuaagaaauaaggaucaauaaggaaugau

SEQ ID NO: 95891 - RNA, 58 nt, hsa
ucuucaacuugaggacgagggugauuuuccuaagaaaucagcaaagagggaaggcagg

SEQ ID NO: 95892 - RNA, 58 nt, hsa
cuugccuuugggugucugcuugccacuuccuaagaauucuuguagaaggcaguuuccu

SEQ ID NO: 95893 - RNA, 58 nt, hsa
uauguagauauuuggcuuaaauauaguuccuaagaagcuucuaauaaauuauacaaau

SEQ ID NO: 95894 - RNA, 58 nt, hsa
uuauuaaagggcgacucuguguaaguaaccuaagaaacgaagaaaaauucuuauucaa

SEQ ID NO: 95895 - RNA, 58 nt, hsa
uugauuuguguggcuauuuauuuuuuggccuaagaauuucacugguuguaaaauuuac

SEQ ID NO: 95896 - RNA, 58 nt, hsa
agcuuggggacugacuccagagcccccuccuaagaaccaucaccaccacucagccaau

SEQ ID NO: 95897 - RNA, 58 nt, hsa
agcccagaaacuccuguuguuaccuuugccuaagaaauuuucuuuaauggcgggggcg

SEQ ID NO: 95898 - RNA, 58 nt, hsa
ugaucaguccagaggccuuuggcugccuccuaagaaagucaugugccucuguccuaug

SEQ ID NO: 95899 - RNA, 58 nt, hsa
uagacaauaaaacugccuaccuguaaaaccuaagaaucaacugaagaccuguuaagag

SEQ ID NO: 95900 - RNA, 58 nt, hsa
ggcgacccuggguucuuuuggaaaaugcccuaagaaauguuugaaguaacgcugucac

SEQ ID NO: 95901 - RNA, 58 nt, hsa
ugaccuggaaaugaaugaaacuauuacuccuaagaauuacauuguauagccccacaga

SEQ ID NO: 95902 - RNA, 58 nt, hsa
auggagcuuguggcuggccucagauacaccuaagaagcuuaggggcaagguucauucu

SEQ ID NO: 95903 - RNA, 58 nt, hsa
uguggauccagugcuauucugucaccaaccuaagaaucccaauugcaccuucuguuuc

SEQ ID NO: 95904 - RNA, 58 nt, hsa
uuuuuuuaaggacaaaaguuguugccuuccuaagaaccuucuuuaauaaacucauuuu

SEQ ID NO: 95905 - RNA, 58 nt, hsa
gccacugcaccuggccuaggacugguguccuaagaagaggaagagacacuuaggugga

SEQ ID NO: 95906 - RNA, 58 nt, hsa
uuaacugugcugaaaaacuaauaaagaaccuaagaagaauuccaguguggugaugcca

SEQ ID NO: 95907 - RNA, 58 nt, hsa
uagucuccauuuauuccuaguacucuguccuaagaaucuuuuuaaaacuauaucauga

SEQ ID NO: 95908 - RNA, 58 nt, hsa
ccugcugcacuuccuguucauguacgacccuaagaaaaggugcugaucucugcacggg

SEQ ID NO: 95909 - RNA, 58 nt, hsa
gcaaaauacuggauuuugcacaugcugcccuaagaaucacugcugccauuguaguuug

SEQ ID NO: 95910 - RNA, 58 nt, hsa
acaauaaaugauguuuuuaugugccuccccuaagaauaauuagcaccggggcggaauu

SEQ ID NO: 95911 - RNA, 58 nt, hsa
aaccugggcuggcauuggucacaccaggccuaagaaggcagaaguugaaucaauugaa

SEQ ID NO: 95912 - RNA, 58 nt, hsa
ucugccacuugucaaagaaggugcugauccuaagaauuuuucauucucagaauucggu

SEQ ID NO: 95913 - RNA, 58 nt, hsa
uccccuguaaccucacuucuuauugauuccuaagaagauagaccaacuuuuuaugucg

SEQ ID NO: 95914 - RNA, 58 nt, hsa
uucaguuaucacuuuugggugucuguauccuaagaaguuucugaaaagaucuaaagcc

SEQ ID NO: 95915 - RNA, 58 nt, hsa
aaggcuucugugugacaggaaacccaagccuaagaaacaauuaagugguucucaucuc

SEQ ID NO: 95916 - RNA, 58 nt, hsa
uggggagggggggcaggggaaauguugcccuaagaaugcuucucauuccucuguucuu

SEQ ID NO: 95917 - RNA, 58 nt, hsa
uacuaguggacguaggauauuuucccuaccuaagaauuucacugucuuuuaaaaaaca

SEQ ID NO: 95918 - RNA, 58 nt, hsa
cuuccaaaaugcccaggcaggcuccaacccuaagaaggucgaccucaucaucugggag

SEQ ID NO: 95919 - RNA, 58 nt, hsa
uuagaaguauugaaggaaaaaaugaagaccuaagaaaaaaauauuucaugaucauuuc

SEQ ID NO: 95920 - RNA, 58 nt, hsa
gcgugugacucauucugacauuucagauccuaagaauucuaagaacacuacuagaagc

SEQ ID NO: 95921 - RNA, 58 nt, hsa
ccuacgaauucuaucuuugggaauuuauccuaagaaaauacuuaaggauuuaguuagu

SEQ ID NO: 95922 - RNA, 58 nt, hsa
uugcuacuccuaagggaaguuucuucugccuaagaaguuacaccaugcuuugcuauuu

SEQ ID NO: 95923 - RNA, 58 nt, hsa
ggaggcucugagacuggccccacuugguccuaagaaucccaaggucuuugggagcguc

SEQ ID NO: 95924 - RNA, 58 nt, hsa
aagugacuucauauacguaagacuggugccuaagaaugacuugaauguuaucaguacu

SEQ ID NO: 95925 - RNA, 58 nt, hsa
uccaugggacuuuuuaucaucuaaguaaccuaagaauucaaaagcuggauagaauuuu

SEQ ID NO: 95926 - RNA, 58 nt, hsa
uugauuuagaagauagaaauaguugguuccuaagaaugugaugggccacaaggaaaga

SEQ ID NO: 95927 - RNA, 58 nt, hsa
ccuuucccaccucucuccccaaagugauccuaagaauguacaguugagcucagguuag

SEQ ID NO: 95928 - RNA, 58 nt, hsa
guaugauacuuuguaaaguugauacuuuccuaagaauuuaacaugucauauuuuugaa

SEQ ID NO: 95929 - RNA, 58 nt, hsa
aagccccuucuccaccagauauuugcuuccuaagaauaguucucauuggaggcugagg

SEQ ID NO: 95930 - RNA, 58 nt, hsa
uguggagguucuuuugaccaauuuuauuccuaagaauaaacaaaccccuacaguuaaa

SEQ ID NO: 95931 - RNA, 58 nt, hsa
uucacugcaggcagugcuauuucuugugccuaagaauguuuccaaaagucgcaucgcu

SEQ ID NO: 95932 - RNA, 58 nt, hsa
caauccaguuuuagaauauuuccaugacccuaagaaguuuccucaugucuauuaauau

SEQ ID NO: 95933 - RNA, 58 nt, hsa
uauugacacucucuaccaagagggucuuccuaagaagagugcugucauuauuuccucu

SEQ ID NO: 95934 - RNA, 58 nt, hsa
aucagauuuuuuuugugagucuuacugaccuaagaaacauuguuuaaauuguuuaaau

SEQ ID NO: 95935 - RNA, 58 nt, hsa
aggugagauaagcccugagucucagcuaccuaagaaaaaccuggaugucacuggccac

SEQ ID NO: 95936 - RNA, 58 nt, hsa
acaugaaaguugcacagaggagaggcgcccuaagaauguaagcauugugggaaagcau

SEQ ID NO: 95937 - RNA, 58 nt, hsa
gggaagucauaacccacagauagaucaaccuaagaauccuggcccuucuccacucucc

SEQ ID NO: 95938 - RNA, 58 nt, hsa
ucuuacaaguaugaauaaugugccaaagccuaagaaaacccucaauucuuaauagaua

SEQ ID NO: 95939 - RNA, 58 nt, hsa
uuccccuuuccaauuccaaaauuccaucccuaagaauucccagauagucccagcagcc

SEQ ID NO: 95940 - RNA, 58 nt, hsa
gcugcaugaucgugaccuugaacaaguaccuaagaaauaguggcuucccuggaauugu

SEQ ID NO: 95941 - RNA, 58 nt, hsa
auggcagccuuccuuauuugauuaugcaccuaagaauaaaugguauuugggcauguau

SEQ ID NO: 95942 - RNA, 58 nt, hsa
caguuuccuucauggccuguuuugguccccuaagaaucuccacaucauugucuuucuu

SEQ ID NO: 95943 - RNA, 58 nt, hsa
uacaauagaauacuguuaccaaauucuuccuaagaaagaucguauuaaguuaacgaua

SEQ ID NO: 95944 - RNA, 58 nt, hsa
aauaauuagaaaauguguugauagaaaaccuaagaauaaacacaacaaugaguuaggu

SEQ ID NO: 95945 - RNA, 58 nt, hsa
acccugcuccucucuguccugccucaggccuaagaagcacucucccuuguucccagug

SEQ ID NO: 95946 - RNA, 58 nt, hsa
auaucugacagcaguaacucaagcacacccuaagaaugacccuguggucuaagaagag

SEQ ID NO: 95947 - RNA, 58 nt, hsa
guggacaaaguacuugguuugcuaagaaccuaagaacguguaugcuuugcugaauuag

SEQ ID NO: 95948 - RNA, 58 nt, hsa
uucaacaauaugccccaucuuuauauauccuaagaaacacuaauccuagguuauugcu

SEQ ID NO: 95949 - RNA, 58 nt, hsa
caggccucugacaugucccugaggggccccuaagaaagaaaguggaggggacacucca

SEQ ID NO: 95950 - RNA, 58 nt, hsa
ugcccucuugagaggucauuucucacguccuaagaaccugaucagaaauuuuggaagg

SEQ ID NO: 95951 - RNA, 58 nt, hsa
cucauaccucucuuccugcgaauuuucuccuaagaacuagguuugggguagaaaugaa

SEQ ID NO: 95952 - RNA, 58 nt, hsa
aaaguaugcaugcagucuuguacugugaccuaagaacaaaacuguaacugcauuagaa

SEQ ID NO: 95953 - RNA, 58 nt, hsa
cauccuuaaccuuuauuaaaaccauuguccuaagaacaaugccaacaaagcuuacaac

SEQ ID NO: 95954 - RNA, 58 nt, hsa
gcccauccaguugggaagccaugauuuuccuaagaauccagggccaugggagauacaa

SEQ ID NO: 95955 - RNA, 58 nt, hsa
gcaguccuacuacagucuggagugggguccuaagaagaagggucccaccucaaccccu

SEQ ID NO: 95956 - RNA, 58 nt, hsa
aacgcagccacugaggaagagugguuuuccuaagaagacauugcuggaguugacuuuc

SEQ ID NO: 95957 - RNA, 58 nt, hsa
ucuguuacuuaagauuuauuuagaguuaccuaagaauuauuaaguuugacuuggaagu

SEQ ID NO: 95958 - RNA, 58 nt, hsa
uccgccugggauuuuguuuugucuguucccuaagaaaauauauuuucauuccugcaaa

SEQ ID NO: 95959 - RNA, 58 nt, hsa
ggccgaucagaacccuagcgccuuugguccuaagaaugggaggcugccuuccuuccca

SEQ ID NO: 95960 - RNA, 58 nt, hsa
aucauuucagcuaagauuaaauuuaaagccuaagaauguauagagcuaguuuuaaaau

SEQ ID NO: 95961 - RNA, 58 nt, hsa
gggguggagugggaagggagcauugcagccuaagaagaaggccagagagggaaaaggc

SEQ ID NO: 95962 - RNA, 58 nt, hsa
agcugguuccugcuagaaaugggaaaugccuaagaagaugacuucccaacugcaaguc

SEQ ID NO: 95963 - RNA, 58 nt, hsa
uauaccuaaagaccucuauauccuggugccuaagaaacuucugccucccacagacaac

SEQ ID NO: 95964 - RNA, 58 nt, hsa
uaucgauugucagaauuguuuuugaaagccuaagaacccagcuuuuuagaaaggauuu

SEQ ID NO: 95965 - RNA, 58 nt, hsa
guuucacuggaaagugucaauagaguugccuaagaauaaaaauugaaaugguguuaau

SEQ ID NO: 95966 - RNA, 58 nt, hsa
aagcuuugauccgacaucugagcucuagccuaagaaggagaguugagauuuccuccuc

SEQ ID NO: 95967 - RNA, 58 nt, hsa
agcauuguauaaacagccuuaaguauagccuaagaagagaauuccuuuuucuucuuua

SEQ ID NO: 95968 - RNA, 58 nt, hsa
ggcaaaauaaaauaaagguaauuaaaaaccuaagaaauggcuguaaacugagauuaca

SEQ ID NO: 95969 - RNA, 58 nt, hsa
guuucucauauccaucgugauaggaaggccuaagaauggcaaaucgcuuugagauaua

SEQ ID NO: 95970 - RNA, 64 nt, hsa
aagucacagaugauguggaaggagcucaaacagacgacuucagcagacucaucucuggaggguc

SEQ ID NO: 95971 - RNA, 64 nt, hsa
auguaaccgcaucccucaggcauggccaggaggccgacuucauccuccuucccacuaucaccuc

SEQ ID NO: 95972 - RNA, 64 nt, hsa
cuccaaguggaacccgguccagacagggcugccucgacuucaccuuucccccuaacuuccucca

SEQ ID NO: 95973 - RNA, 64 nt, hsa
ugguugacuucuugcuugugcuucccacucuccccgacuucauucacucaaacuucuuuaaaug

SEQ ID NO: 95974 - RNA, 64 nt, hsa
cuugugauggcuacaauggcuccuagacacucaacgacuucaucuguggcagggagagaggagg

SEQ ID NO: 95975 - RNA, 64 nt, hsa
auauauaaaagguacuguuaacuacuguacaacccgacuucauaauggugcuuucaaacagcga

SEQ ID NO: 95976 - RNA, 64 nt, hsa
agcaagaucaugugcauaucaucccauuguaaagcgacuucaaaaauaugggaacacaguuagu

SEQ ID NO: 95977 - RNA, 64 nt, hsa
uguaugaaaugggcuuucugaaguuuaaauaguccgacuucacccaugguguucugugcuugca

SEQ ID NO: 95978 - RNA, 64 nt, hsa
uuuaguuucaaaccuagcucccuggguggaaugacgacuucacuauacuuagugaauauccuuu

SEQ ID NO: 95979 - RNA, 64 nt, hsa
ugguuuuuuucuaguaaggauuuuaaauaacugccgacuucaaaaguguucuuaaaacgaaaga

SEQ ID NO: 95980 - RNA, 64 nt, hsa
uggaccaguuugguauuagaaguaggaggcuggacgacuucacccccaaaggguccugaagccc

SEQ ID NO: 95981 - RNA, 64 nt, hsa
agccuuuuuuuuaguuaauuuuugucaaaugaaacgacuucaggcaagucucuuuuauaauggu

SEQ ID NO: 95982 - RNA, 64 nt, hsa
cuggcccucggcgcgggcuccuucccgcuucccccgacuucacacggcggcuucggaccaacuc

SEQ ID NO: 95983 - RNA, 64 nt, hsa
cccucuguucucaccugugaguucuugcagguggcgacuucaucugcaaggucacuuacauagc

SEQ ID NO: 95984 - RNA, 64 nt, hsa
gucccucaggggucuggaauaacaauccagaggacgacuucaggaugcccaauggcuccaccau

SEQ ID NO: 95985 - RNA, 64 nt, hsa
cugauuucauauaguagaaaacaaacauuggguccgacuucaaaauguguuguauuguccuaca

SEQ ID NO: 95986 - RNA, 64 nt, hsa
acgguaacauccaaaagcaaccacaaaccuaguacgacuucauuccuuccacuaacucauaguu

SEQ ID NO: 95987 - RNA, 64 nt, hsa
agcuauuaugaacaaaauuuuuccuguuaaauagcgacuucaguauuguguuauguuuuacagc

SEQ ID NO: 95988 - RNA, 64 nt, hsa
uaaaguucugugacugugaugcaugugaguguuccgacuucaucuguuccucuuaacuacggug

SEQ ID NO: 95989 - RNA, 64 nt, hsa
agcucuuuugguacaccagaaggccagaauggaacgacuucaaagagaacuugagauucaaaag

SEQ ID NO: 95990 - RNA, 64 nt, hsa
cugaaaaaauagggaggaaauuccuucaucagaacgacuucaaguggauaacaauauuuauaag

SEQ ID NO: 95991 - RNA, 64 nt, hsa
ccugcaggagccaggugagaauuucaaggauuaucgacuucauauugcacauuaaaguuacaaa

SEQ ID NO: 95992 - RNA, 52 nt, hsa
ucacagaggcuguggggugaaccgacuucaaggaauggguccuucccuucag

SEQ ID NO: 95993 - RNA, 64 nt, hsa
uugaucggucuccuaggcuaaaugagaaugaaagcgacuucaggucagguggcugugggauuuu

SEQ ID NO: 95994 - RNA, 64 nt, hsa
gguguggacgcaaaccugugacagcagagggggacgacuucacacucacugccucauguggccc

SEQ ID NO: 95995 - RNA, 64 nt, hsa
cuuaccacuuaauagaagaaccugucccuagaggcgacuucauugcuauggaucuggagucucu

SEQ ID NO: 95996 - RNA, 64 nt, hsa
uggacaaaugaccacuauguuagacccccaggcucgacuucaggggucaguguuccugucccaa

SEQ ID NO: 95997 - RNA, 64 nt, hsa
cuacauuguaagauccaucuacacagucguuguccgacuucacuugauacuauaugauaugaac

SEQ ID NO: 95998 - RNA, 64 nt, hsa
ccagaucugugucuugaagcagcugcccucauuccgacuucagaaaaucgaagcagcuggcucc

SEQ ID NO: 95999 - RNA, 64 nt, hsa
ucugguuauuaugguguuaguuaucgaauaaaaacgacuucagaaugcagcuucccuacugagc

SEQ ID NO: 96000 - RNA, 64 nt, hsa
auuucuugcgagccucgcagccuccggaagcugucgacuucaugacaagcauuuugugaacuag

SEQ ID NO: 96001 - RNA, 64 nt, hsa
aagaauagcaagaaacuauauagguauacacuuacgacuucacaaaaccuauacuuaauauagu

SEQ ID NO: 96002 - RNA, 64 nt, hsa
uuucaagaaugcaggucucguuugaugaaaaaaccgacuucauaacccaauguuacuaguuagc

SEQ ID NO: 96003 - RNA, 64 nt, hsa
acauaucaccucuacuuaaauccguccuguuuagcgacuucagucaacuacagcugaguccaua

SEQ ID NO: 96004 - RNA, 64 nt, hsa
gcccccuacugagaaacuuccuuugagaauugugcgacuucacaaaaugcaaggugaacaccac

SEQ ID NO: 96005 - RNA, 64 nt, hsa
ucaaauaucccaagacagauuaugcuaaauacaucgacuucaucuucuaacaugauauauucag

SEQ ID NO: 96006 - RNA, 64 nt, hsa
gugggagcagcgguuuggggagcagagacacuaacgacuucagggcagggcucugauauuccau

SEQ ID NO: 96007 - RNA, 64 nt, hsa
acacaucgccucugguuaaaucucuccugcuuggcgacuucaguaagcuacagcuaagcccauc

SEQ ID NO: 96008 - RNA, 64 nt, hsa
ucuggggaccccagaggugucugugcugacaaggcgacuucagauuccauacugagaucguucc

SEQ ID NO: 96009 - RNA, 64 nt, hsa
cucuucuccaaucagagcguggaggcgaguugggcgacuucaagggccuggcauggcagaggcc

SEQ ID NO: 96010 - RNA, 64 nt, hsa
cauuuccucuaaacacaacagggcacagcaaauacgacuucauuuggcuucgaguuccccaggc

SEQ ID NO: 96011 - RNA, 64 nt, hsa
gccugcugccucggaacugugacacccccaucuucgacuucagagucuucuuccaaggucagug

SEQ ID NO: 96012 - RNA, 64 nt, hsa
augagaaagaaagcauguguaugucuguuuauggcgacuucagguggggccugugcgugugccg

SEQ ID NO: 96013 - RNA, 64 nt, hsa
aggaaaaugcaacaucucgcaagcgcugcuguaacgacuucaggagucacugauucagcacuaa

SEQ ID NO: 96014 - RNA, 64 nt, hsa
gagucaucaucuggcucugggauauucuggccuccgacuucacaccggaugagagagcuauguu

SEQ ID NO: 96015 - RNA, 64 nt, hsa
guagagaauucacuuuucucaaauuuuaaaauuucgacuucagccuuugcacucaggagguucu

SEQ ID NO: 96016 - RNA, 64 nt, hsa
aacaaacaggugcuccaggcuuugauuauagauacgacuucaaaaauaugcuaagacgcuugac

SEQ ID NO: 96017 - RNA, 64 nt, hsa
uggauuguguacccuuuaguuaaauuucaccucccgacuucagcauagaucacaggaaaucaca

SEQ ID NO: 96018 - RNA, 64 nt, hsa
aauacuauaugaugauaguuauuauauuauaugacgacuucauucacuucccaaaucacagggu

SEQ ID NO: 96019 - RNA, 64 nt, hsa
uuaugaugcgccuccuucugugcgaccaaugagacgacuucagcaucuuuuuaaaauaaucuaa

SEQ ID NO: 96020 - RNA, 64 nt, hsa
gcaucugggaccuggccacccugcagcagcuauacgacuucacaucaucagaggacgccccgug

SEQ ID NO: 96021 - RNA, 64 nt, hsa
ggcucuccuacuuggcagaaugaucuuggggaaacgacuucaucugaacuucagauauuucaca

SEQ ID NO: 96022 - RNA, 64 nt, hsa
aagcagagguagaagacgaggccagccaggagggcgacuucagucacagcucccaugccucagc

SEQ ID NO: 96023 - RNA, 64 nt, hsa
accacucaagggggagcaaauuuggauggauuuacgacuucacaggcauugugaggaaagagca

SEQ ID NO: 96024 - RNA, 64 nt, hsa
uguugacccuuccugaaaauccucuagcagcccccgacuucagcaguuucuuucuuuguuuuuu

SEQ ID NO: 96025 - RNA, 57 nt, hsa
cgccguguauccagccuuagcucgcaccgacuucaauuucccacccaucuccaguag

SEQ ID NO: 96026 - RNA, 64 nt, hsa
guuauucaaauuucuuguaauuuagugaggugaacgacuucagauuucauuauuggauuuggau

SEQ ID NO: 96027 - RNA, 64 nt, hsa
gacaggcaaacugcaaaccauggugagaaauugacgacuucacacuauggacagcuuuucccaa

SEQ ID NO: 96028 - RNA, 64 nt, hsa
uauuagcccuugcaaguuuucagggcgucuuuuccgacuucaguuuuugugauaaagaauguga

SEQ ID NO: 96029 - RNA, 64 nt, hsa
ggcugggaaucccagcugauucccugacaggagccgacuucacacacaggugacucucaggcau

SEQ ID NO: 96030 - RNA, 64 nt, hsa
gccuucaccuucaccuucauccauguccaacccccgacuucaucccaaaggacagccgccugga

SEQ ID NO: 96031 - RNA, 64 nt, hsa
ggcucaaggggacuggugaugggacaauucuucucgacuucaggagcugacagagccagaggca

SEQ ID NO: 96032 - RNA, 64 nt, hsa
ccuuuguuugccaaaauuauucaacccccucauacgacuucagcuccucacuuggacuccucuu

SEQ ID NO: 96033 - RNA, 64 nt, hsa
uuuaaugaagaaacucauucuuacgaaauuagaacgacuucacguuggagaaagcaugaagagg

SEQ ID NO: 96034 - RNA, 64 nt, hsa
caagcuucaaccucauuggugacagccugucuuucgacuucaaagauacugacaugaagcggcu

SEQ ID NO: 96035 - RNA, 64 nt, hsa
gaacguggccaccugcccagcuucacaccucccccgacuucagcccuuccuaaacccagaccug

SEQ ID NO: 96036 - RNA, 64 nt, hsa
ucaaagaacauggucugaugcaaaggucuucuaccgacuucaugguauuuaggaaaaauuuuua

SEQ ID NO: 96037 - RNA, 64 nt, hsa
accaggcaaaauugagcagcauuuucauagggaccgacuucaguagcacaccugccccugcauu

SEQ ID NO: 96038 - RNA, 64 nt, hsa
cuucuccagaacuugugucuccagaggaguacgccgacuucagcagcuuccugcugcuagucga

SEQ ID NO: 96039 - RNA, 62 nt, hsa
agugcugccaacccugauauaggggaguuguauggaaaaauaguagaauuacacagcaugaa

SEQ ID NO: 96040 - RNA, 62 nt, hsa
ccacauuuccuauauuuugacagagauacugcuggaaaaauuaaaauuaaaaugccauaaua

SEQ ID NO: 96041 - RNA, 62 nt, hsa
ugcaauaacauuuaggauaaucuuugacauuuuggaaaaauaagaauugaggaaaaaaagug

SEQ ID NO: 96042 - RNA, 62 nt, hsa
gccuggaugacauaaugagauucugucucuacuggaaaaaaaaaaaauuagcuggacauggu

SEQ ID NO: 96043 - RNA, 62 nt, hsa
acuugaaagauaacacaauuuuacaaauuuguuggaaaaacaugaauucauaaauucaggaa

SEQ ID NO: 96044 - RNA, 62 nt, hsa
aacgaccccuuguuaccuugauucacuguauguggaaaaauaauguaaccaaaagggaagag

SEQ ID NO: 96045 - RNA, 62 nt, hsa
aaaaguguaaauaaccaauucagaaaacaaaauggaaaaacgaccccuuguuaccuugauuc

SEQ ID NO: 96046 - RNA, 62 nt, hsa
aucggcauuguccaaaauauuuuauucuuuaauggaaaaagccauuaauauucaaaugaagg

SEQ ID NO: 96047 - RNA, 62 nt, hsa
ucaucugaguguagagaaugucccuucacugcuggaaaaauccacuggcucccaagaaaaga

SEQ ID NO: 96048 - RNA, 62 nt, hsa
uuccaggaauuuuuuucaaauggggcuguuucuggaaaaaugaaaaauucuauuggacaaug

SEQ ID NO: 96049 - RNA, 62 nt, hsa
ugcucagaaccauucacauuuaauucaauucuuggaaaaaauuaaagcuuuuugcccacaau

SEQ ID NO: 96050 - RNA, 62 nt, hsa
cucuuacuaaaaugaguuuuagguucuguaaguggaaaaaugugcuuuuauuuuaugggcca

SEQ ID NO: 96051 - RNA, 62 nt, hsa
uguauguugcguaucccaaggcacugaagagguggaaaaauaaucgugucaaucuggaugau

SEQ ID NO: 96052 - RNA, 62 nt, hsa
uguauuuguuucuggucuuuguuaaguucuauuggaaaaaccacugucuguguuuuuuuggc

SEQ ID NO: 96053 - RNA, 62 nt, hsa
cuuaaaagguaucaauguaccuuuuuugguaguggaaaaaaaaaagacaggcugccacagua

SEQ ID NO: 96054 - RNA, 62 nt, hsa
gacagaugacuuuaaagaaauuuuuuucaugauggaaaaaucaccucaauugauuuuuccau

SEQ ID NO: 96055 - RNA, 62 nt, hsa
uauauuuugcaaauuguuguucaaaagauaauuggaaaaaauugaauauauuguaggauuug

SEQ ID NO: 96056 - RNA, 62 nt, hsa
gcaacuuugcuuaaaauuguauaccugguaaguggaaaaagagggauuugaauauaggcaaa

SEQ ID NO: 96057 - RNA, 62 nt, hsa
aauuggauuuaauauuuguauuaaggauuaacuggaaaaaaugugucucagugcuaauucuu

SEQ ID NO: 96058 - RNA, 62 nt, hsa
auccuauugaucuuaagguauuuacauguauguggaaaaacaaaacacuuaacuagaauucu

SEQ ID NO: 96059 - RNA, 62 nt, hsa
auuaacugauuaauuucccuuauguugaggcauggaaaaaaaauuggaaaagaaaaacucag

SEQ ID NO: 96060 - RNA, 62 nt, hsa
uggugaucuaauccuaaauuuaaaagauuuguuggaaaaaauuuuuaggaaacucaccuucc

SEQ ID NO: 96061 - RNA, 62 nt, hsa
acuuuggcaacccuuuugaaaaguagcaauuauggaaaaaaaauauucaauaagagauuagg

SEQ ID NO: 96062 - RNA, 62 nt, hsa
uagagcccuauucucucagacgguggaauauuuggaaaaauuuuaaaacaauuaaaauuuua

SEQ ID NO: 96063 - RNA, 62 nt, hsa
ucguuaaucuugcugcuuaugugccaauuuaguggaaaaaaacaacccuugcugaaaaauuc

SEQ ID NO: 96064 - RNA, 62 nt, hsa
ucugaagauacaugucuuucuccagggacauguggaaaaaaaaaagauguuauacaaccauc

SEQ ID NO: 96065 - RNA, 62 nt, hsa
aaaaggguaucccaaaaauaaaacuauccuuuuggaaaaaaaaagauuuaaaauaauuccug

SEQ ID NO: 96066 - RNA, 62 nt, hsa
agcuugacacccaccaagcaaaaguuucagccuggaaaaaaaaugggggggaaggguggaug

SEQ ID NO: 96067 - RNA, 62 nt, hsa
guggggugccagaaagugucugcugauauuuguggaaaaaaaaucuauuuuguuuaccuacu

SEQ ID NO: 96068 - RNA, 62 nt, hsa
uuuauauuaacgauacuaaaaaaaaauagcuuuggaaaaaaaacuacuguauguaacggaau

SEQ ID NO: 96069 - RNA, 62 nt, hsa
uaucggggcgggccaaccccgagaaugaagauuggaaaaaggaaaaaaaaaaaaacacguca

SEQ ID NO: 96070 - RNA, 62 nt, hsa
auggcugcucauuuaucuuaucuuucaguuaguggaaaaacauuucaaccugacuaaaauuu

SEQ ID NO: 96071 - RNA, 62 nt, hsa
gaaaauucuccuugauaacauaggacaauuaauggaaaaaaaaauucucauuauuugcaaag

SEQ ID NO: 96072 - RNA, 62 nt, hsa
cacugugccuugguuucuccuuuauuucuaaguggaaaaaguauuagccaccaucuuaccuc

SEQ ID NO: 96073 - RNA, 62 nt, hsa
uuauuuaagcaucaaauauuugugcaagaauuuggaaaaauagaagaugaaucauugauuga

SEQ ID NO: 96074 - RNA, 62 nt, hsa
uuuaaaaccuucuuaacaaaacuucuuaaaacuggaaaaaauauauauuauguaucuaugua

SEQ ID NO: 96075 - RNA, 62 nt, hsa
agagucucauuagacaaugauuuuuaaagcauuggaaaaauauuuugccuguaaaaguuagu

SEQ ID NO: 96076 - RNA, 62 nt, hsa
aaaguacauugguaauuugggcacauucagaguggaaaaaauuuguucuauuuuuacaucuu

SEQ ID NO: 96077 - RNA, 62 nt, hsa
agaacuaucauaugauccagcaauaccauuacuggaaaaaggaaaucuguauauuaaagaga

SEQ ID NO: 96078 - RNA, 62 nt, hsa
ccauauagcuuaauauguuuauuaguucucuuuggaaaaaaacuaccacuguggucuuaaaa

SEQ ID NO: 96079 - RNA, 62 nt, hsa
auaauuauaucagaaacucacaaaccuagacauggaaaaacagauuacugucuauugucagc

SEQ ID NO: 96080 - RNA, 58 nt, hsa
auaccaauaagucagccugaugcucuaauggaaaaauggcccucuucaagccugguga

SEQ ID NO: 96081 - RNA, 62 nt, hsa
gaggcuccaccuuguuaaauaaauuggauguauggaaaaauagacugcagaaaaggggaacu

SEQ ID NO: 96082 - RNA, 62 nt, hsa
cugguagagucauggaggaaguaaguuaaauguggaaaaaaugcuuuaaaaguacuuacuau

SEQ ID NO: 96083 - RNA, 62 nt, hsa
aaguacuuacuauaaccacaucauaagaauucuggaaaaauagagaacaaaaggaaaagauu

SEQ ID NO: 96084 - RNA, 62 nt, hsa
gacuggguucgaucagcccuccuaaagcuggcuggaaaaagaagccccagcccagccugccu

SEQ ID NO: 96085 - RNA, 62 nt, hsa
acaccaucugcaaccauaugcuauuaauaaaauggaaaaaaacaaaauggucauuuugcaua

SEQ ID NO: 96086 - RNA, 62 nt, hsa
ucaaaaguaaauguucucuuugccauuuuagauggaaaaauaaaaaaaauuaaaaaguaaau

SEQ ID NO: 96087 - RNA, 62 nt, hsa
gugcuuuucagaauguagagugagaccucugguggaaaaauuauugcccuguggacuccuuu

SEQ ID NO: 96088 - RNA, 62 nt, hsa
cugugagauugaauaaacagucucuauuucuguggaaaaaacaacagaaaagagauauuaaa

SEQ ID NO: 96089 - RNA, 62 nt, hsa
aauugcaucuuuacauaaugaucaagguauaauggaaaaauauaccuauucuugaaguaguu

SEQ ID NO: 96090 - RNA, 62 nt, hsa
gugacaucuauuuuuauaaaguacuguuuaguuggaaaaaguugccuuaauguuugaaaugu

SEQ ID NO: 96091 - RNA, 62 nt, hsa
aauacuacuguaggaguaucugcuuguuaaaauggaaaaaugugucuuuagagcucaguauu

SEQ ID NO: 96092 - RNA, 62 nt, hsa
uacagucugucuguauuuagauauuuuauuucuggaaaaaaugaaauguacauaaaaauaaa

SEQ ID NO: 96093 - RNA, 62 nt, hsa
guuuuuggauuaaauuaguuugugaaggauuauggaaaaauaaaacugucacuguuggacgu

SEQ ID NO: 96094 - RNA, 62 nt, hsa
aaacuuuaaaccuguagaaucaauuuaaguguuggaaaaaauuugucugaaacauuucauaa

SEQ ID NO: 96095 - RNA, 62 nt, hsa
auuggagaaaaacccuaugaguguaaugaauuuggaaaaauauuuuuuucaacaacagcuua

SEQ ID NO: 96096 - RNA, 62 nt, hsa
agguauauuuacauucagaguacacuuuucuuuggaaaaaauuacagguuuuuugaaaagug

SEQ ID NO: 96097 - RNA, 62 nt, hsa
uagauuuuaagugccuuuucacugggagaaucuggaaaaaccuccauaagguauauagcaau

SEQ ID NO: 96098 - RNA, 62 nt, hsa
uuauaauaaauuauauuaguaaaagucuuaacuggaaaaaagaaucuaaaucagaauaguga

SEQ ID NO: 96099 - RNA, 62 nt, hsa
aguugcgcugauuacucuuagagaagaagaaauggaaaaaugaaagaaggcaggaaggaaag

SEQ ID NO: 96100 - RNA, 62 nt, hsa
acuuugcuuuguuuauaaauaaauuaguagauuggaaaaacuaguguuagggaaagaaauca

SEQ ID NO: 96101 - RNA, 62 nt, hsa
guggcuccucucugguugaggagagggaaaauuggaaaaacuggucgaguaauuaucaauaa

SEQ ID NO: 96102 - RNA, 62 nt, hsa
uauauuuuuauauacugaacugccauagaugcuggaaaaaaggaacugauguuuucagcaua

SEQ ID NO: 96103 - RNA, 62 nt, hsa
cuaaaaccuuuuagugacaaaauccuaauauguggaaaaaagcauaugcauaaaggaauaau

SEQ ID NO: 96104 - RNA, 62 nt, hsa
aaguuaaauauaucaagaaagaagagacuguuuggaaaaaugugguucaaguuuuaugcuau

SEQ ID NO: 96105 - RNA, 62 nt, hsa
ugcacuuaaaguugcauugccuacuguuauacuggaaaaaauagaguucaagaauaauauga

SEQ ID NO: 96106 - RNA, 62 nt, hsa
aaagugugauagcgauauuagugccaaucaaauggaaaaaagguaguuuuaauaaacaagac

SEQ ID NO: 96107 - RNA, 62 nt, hsa
uccuuuuucuuucuagcuguuaaccuacuuccuggaaaaaguaguagcucucuguagcauua

SEQ ID NO: 96108 - RNA, 62 nt, hsa
uaauuuuuuggaauuuuuguagacuuuacaccuggaaaaaaagauuuguaaaaucaccggaa

SEQ ID NO: 96109 - RNA, 62 nt, hsa
uaguuucuggggaaagaauaguaaccaugcaauggaaaaaaauggacaaccucuugacuagg

SEQ ID NO: 96110 - RNA, 62 nt, hsa
auaguuugccacuaaaaggaaccaaggcuacuuggaaaaauggaugauuccaaagcaagggc

SEQ ID NO: 96111 - RNA, 62 nt, hsa
guugauguugaugggagucaggauguucacuauggaaaaacaaauauacaaauaugaaauga

SEQ ID NO: 96112 - RNA, 62 nt, hsa
guagcucuaaacuguuaacauagaauguuacuuggaaaaagucuggaauaugugguguacac

SEQ ID NO: 96113 - RNA, 62 nt, hsa
gagggauuaaauuagaccugugagauuauauuuggaaaaauucaugucuguaacuaacccau

SEQ ID NO: 96114 - RNA, 62 nt, hsa
gauaguagguugaaaugggagaauuucucuuuuggaaaaaaagguagauaacuguuuaaaaa

SEQ ID NO: 96115 - RNA, 62 nt, hsa
agguaauuauuaguuguaauagcuuuaaugcauggaaaaacuucaguuacugaccagucaag

SEQ ID NO: 96116 - RNA, 62 nt, hsa
uuggaccauacacuauguuacaaaacuaaaaguggaaaaaacuuauuggugaaugaauauag

SEQ ID NO: 96117 - RNA, 62 nt, hsa
aguugcaggauaucuagcaauuuaagaaaauguggaaaaaauauuuuuauugagaaauagca

SEQ ID NO: 96118 - RNA, 62 nt, hsa
aaucuaauagucaccuaaaauaucuuuuuuguuggaaaaaaguuuauaauaaaaaaguuugu

SEQ ID NO: 96119 - RNA, 62 nt, hsa
aaauguuuauuaaguagcuagaaauaauuauguggaaaaaaaugaauaauggaaaauaguga

SEQ ID NO: 96120 - RNA, 62 nt, hsa
ccauugggaaauugggagaaaugauaaacaaauggaaaaagaagaugucccuaaccuacacc

SEQ ID NO: 96121 - RNA, 62 nt, hsa
ucuuuaagcaagaaguuaaagagugaacaugguggaaaaaauauaauuauuuucaucagacu

SEQ ID NO: 96122 - RNA, 62 nt, hsa
caggggacugccauuuuauaaaugucagcaguuggaaaaaucgucacgaauugacuuagagc

SEQ ID NO: 96123 - RNA, 62 nt, hsa
auuagaguauuucccuuccaaagagggauguuuggaaaaaacucugaaggagaggaggaauu

SEQ ID NO: 96124 - RNA, 62 nt, hsa
uacagccuagggcagacaauaguauagaagucuggaaaaaaacaaaaacagaauuugagaac

SEQ ID NO: 96125 - RNA, 62 nt, hsa
ccaaggagaacaaauauucagaauauucauauuggaaaaaucacaauuuuuaauggcagcag

SEQ ID NO: 96126 - RNA, 62 nt, hsa
uauccauaaaaaaaaauagaugucuuuuauaguggaaaaacacauggggaaaaaaaucaucu

SEQ ID NO: 96127 - RNA, 62 nt, hsa
uugacuuugccacauagcugaacuguguuuacuggaaaaauucagaggccuaaaguuuaaaa

SEQ ID NO: 96128 - RNA, 62 nt, hsa
aaagagggccaaggagguaugagccaucagacuggaaaaaaggaugacuauaugaugaggag

SEQ ID NO: 96129 - RNA, 62 nt, hsa
gcccugagucaaaaggauagccaaggguggaguggaaaaagauauggugaaggcagaacugc

SEQ ID NO: 96130 - RNA, 62 nt, hsa
caauuucuccuuggaacucuaacaggacuaacuggaaaaauacuuugaccauagcucuagua

SEQ ID NO: 96131 - RNA, 62 nt, hsa
agauccccaccugcaucauuccgaauguguccuggaaaaaaacugguacucaaagcugcuua

SEQ ID NO: 96132 - RNA, 62 nt, hsa
augacuccacuuuuaauguggacuuuuacucauggaaaaauugucuccuaauuuggggagau

SEQ ID NO: 96133 - RNA, 62 nt, hsa
auuuuuucaggaccuuaguuccagcagcagaauggaaaaauccuugaagcccaggcugaugc

SEQ ID NO: 96134 - RNA, 62 nt, hsa
cuuguuagagagcuuuucacugugaggaaguguggaaaaauagcucugugugugugugugug

SEQ ID NO: 96135 - RNA, 62 nt, hsa
aaaauaaaaaggauucuaaaaguuugaugcauuggaaaaauuuccuugaggcauuuagcaac

SEQ ID NO: 96136 - RNA, 62 nt, hsa
cauccugaaaccacccuucacccugcagucuguggaaaaauugucuuccacaaaacuggucc

SEQ ID NO: 96137 - RNA, 62 nt, hsa
uuauuugaagaaagaaaaaacagauuuuaggguggaaaaaacagucaacucacacaaagaau

SEQ ID NO: 96138 - RNA, 62 nt, hsa
ggguggaaaaaacagucaacucacacaaagaauggaaaaaaauacugaguuaaauuaagcaa

SEQ ID NO: 96139 - RNA, 62 nt, hsa
uucaccuaucuggaaaaaaaaaaauaugagauuggaaaaaauuagacaagucuaguggaacc

SEQ ID NO: 96140 - RNA, 62 nt, hsa
uggaaggcacacugagcaaguuuucaccuaucuggaaaaaaaaaaauaugagauuggaaaaa

SEQ ID NO: 96141 - RNA, 62 nt, hsa
aggguuaggguuuaaagaaaggagaaagccauuggaaaaaugaugggcuccauuaaggagac

SEQ ID NO: 96142 - RNA, 62 nt, hsa
auaaagcuucaaugucuuuuuuuuuuuuuucauggaaaaacucaaaccucuguuauuuggga

SEQ ID NO: 96143 - RNA, 62 nt, hsa
uuugcauaggaauucaugaaggcgacccaaccuggaaaaagaacuauucacuuuggccaugg

SEQ ID NO: 96144 - RNA, 62 nt, hsa
uuaauaccagaccaaagacauuuucuguuuccuggaaaaaaaaaaugaaucauguuaggcuu

SEQ ID NO: 96145 - RNA, 62 nt, hsa
aaaauuauuuucauugauggaacuggaguuguuggaaaaacauagauuuaaaaugauuuuug

SEQ ID NO: 96146 - RNA, 62 nt, hsa
gccaagugcucuugauaauuucuucagauuuuuggaaaaaaacacuauauaaaugcaaucca

SEQ ID NO: 96147 - RNA, 62 nt, hsa
uagaucacauacguuaucaaaaacuacucccuuggaaaaaauaucuuucgaaaaucaaauuu

SEQ ID NO: 96148 - RNA, 62 nt, hsa
ugggaaagcaaagcagaaaacagugccccaaauggaaaaaagauacucacacagaacaaaac

SEQ ID NO: 96149 - RNA, 62 nt, hsa
cacacaauggguuuggagcugacugggaacaauggaaaaaauuacauuagcugugguuguaa

SEQ ID NO: 96150 - RNA, 62 nt, hsa
auuucauagccuguaucuaucauuuagaugcauggaaaaaaaugggcuuugcacacaauggg

SEQ ID NO: 96151 - RNA, 62 nt, hsa
ucagaguuugaaaugaaauguugucaggguguuggaaaaauuuuggugaguucugcacauuu

SEQ ID NO: 96152 - RNA, 62 nt, hsa
ugacucacugaugaaucagcauuugcauuuuauggaaaaauauaaauccaaagaaauaauuu

SEQ ID NO: 96153 - RNA, 62 nt, hsa
ccuuggcgcugccaccugccccacccaguuucuggaaaaaguugaugcuaaugaggccaacc

SEQ ID NO: 96154 - RNA, 62 nt, hsa
ggugcuggggcuggccugcaggcugcagucccuggaaaaacagucacugacucaagacacug

SEQ ID NO: 96155 - RNA, 62 nt, hsa
acuacuaaguguguguuuuuuuaaaaaaaaaauggaaaaaaaaaagcuuuuaaacuggagag

SEQ ID NO: 96156 - RNA, 62 nt, hsa
gcucagagggaauaucagugauccauacuguuuggaaaaacacugagcucaguuacacuuga

SEQ ID NO: 96157 - RNA, 62 nt, hsa
uuggcauaagcucaaaaaagccaggaucuuuauggaaaaauuuuaauacuuuguuaaaaggu

SEQ ID NO: 96158 - RNA, 62 nt, hsa
gaauaaauggaaagaaauaccauauacauagauggaaaaacccaguauuauaaaaaccucaa

SEQ ID NO: 96159 - RNA, 62 nt, hsa
uucaaccucauucaacaccagaaaguucacaguggaaaaaaucuugaagguaacagauggaa

SEQ ID NO: 96160 - RNA, 62 nt, hsa
gacaguuuacaauguggacaauguagugaauauggaaaaagguuucagccaaaggccuaacc

SEQ ID NO: 96161 - RNA, 62 nt, hsa
gguucaugacagacccuuggacuuuacuguuguggaaaaaucuauauaaaacaguaucagug

SEQ ID NO: 96162 - RNA, 62 nt, hsa
uucgcuaguacaaggggucuucaggaaguucauggaaaaauacauauuaugagaaaauugug

SEQ ID NO: 96163 - RNA, 62 nt, hsa
auuaaggaaugauugaauuuugugggucuugauggaaaaacgcuggucuucuuuuaaugugg

SEQ ID NO: 96164 - RNA, 62 nt, hsa
cuugauggaaaaacgcuggucuucuuuuaauguggaaaaacagcuagugcuucaguccuagg

SEQ ID NO: 96165 - RNA, 62 nt, hsa
uguacuguuauugaaaauauauuuaauaccuuuggaaaaaucuugggcaagaugaccuacua

SEQ ID NO: 96166 - RNA, 62 nt, hsa
cauaauugcaauauuucccccuuacuacuucuuggaaaaaaauuacaaaaugaaguuuuaua

SEQ ID NO: 96167 - RNA, 62 nt, hsa
aauuuauagaaauaguaucggguguucugauguggaaaaaagaaaugcaagguaauuuugua

SEQ ID NO: 96168 - RNA, 62 nt, hsa
agaaacuucuacagauauuacuaauuucaaucuggaaaaagaucgaauuucaaaagaauccg

SEQ ID NO: 96169 - RNA, 62 nt, hsa
caacucauuuucaucuguuuuuugaagaaaaauggaaaaauguaaaaggcagccccucccca

SEQ ID NO: 96170 - RNA, 62 nt, hsa
ucuguugccauuuguguaaauacuagucuuuuuggaaaaaaaauaauguaaagauguuuugu

SEQ ID NO: 96171 - RNA, 64 nt, hsa
gauuuuguaacaagggcuuguuacacagugauaugguaaugauaaaauugcgauuuaucacucc

SEQ ID NO: 96172 - RNA, 64 nt, hsa
guaguccggaaaacaaaaggagggaagacagccugguaaugaauaagauccuuaccacaguuuu

SEQ ID NO: 96173 - RNA, 64 nt, hsa
gccagugcuaugcugagauugagguaaugaagaugguaaugaccuuaacagcuguggagucugg

SEQ ID NO: 96174 - RNA, 64 nt, hsa
auguguuugccggccagugcuaugcugagauugagguaaugaagaugguaaugaccuuaacagc

SEQ ID NO: 96175 - RNA, 60 nt, hsa
agcacaacagaugccacgucuucgugcauucgccaacacgugcccucacagggccagcgu

SEQ ID NO: 96176 - RNA, 60 nt, hsa
gccugugucuucaccuguccuguccaccagcgccaacagccguggggaagccaaggagac

SEQ ID NO: 96177 - RNA, 64 nt, hsa; identical to SEQ ID NO: 45477

SEQ ID NO: 96178 - RNA, 64 nt, hsa; identical to SEQ ID NO: 45478

SEQ ID NO: 96179 - RNA, 64 nt, hsa; identical to SEQ ID NO: 45479

SEQ ID NO: 96180 - RNA, 64 nt, hsa; identical to SEQ ID NO: 45480

SEQ ID NO: 96181 - RNA, 64 nt, hsa; identical to SEQ ID NO: 45481

SEQ ID NO: 96182 - RNA, 64 nt, hsa; identical to SEQ ID NO: 45482

SEQ ID NO: 96183 - RNA, 64 nt, hsa; identical to SEQ ID NO: 45483

SEQ ID NO: 96184 - RNA, 64 nt, hsa; identical to SEQ ID NO: 45484

SEQ ID NO: 96185 - RNA, 64 nt, hsa; identical to SEQ ID NO: 45485

SEQ ID NO: 96186 - RNA, 64 nt, hsa; identical to SEQ ID NO: 45486

SEQ ID NO: 96187 - RNA, 64 nt, hsa; identical to SEQ ID NO: 45487

SEQ ID NO: 96188 - RNA, 56 nt, hsa; identical to SEQ ID NO: 45488

SEQ ID NO: 96189 - RNA, 64 nt, hsa; identical to SEQ ID NO: 45489

SEQ ID NO: 96190 - RNA, 64 nt, hsa; identical to SEQ ID NO: 45490

SEQ ID NO: 96191 - RNA, 64 nt, hsa; identical to SEQ ID NO: 45491

SEQ ID NO: 96192 - RNA, 64 nt, hsa; identical to SEQ ID NO: 45492

SEQ ID NO: 96193 - RNA, 64 nt, hsa; identical to SEQ ID NO: 45493

SEQ ID NO: 96194 - RNA, 64 nt, hsa; identical to SEQ ID NO: 45494

SEQ ID NO: 96195 - RNA, 64 nt, hsa; identical to SEQ ID NO: 45495

SEQ ID NO: 96196 - RNA, 64 nt, hsa; identical to SEQ ID NO: 45496

SEQ ID NO: 96197 - RNA, 64 nt, hsa; identical to SEQ ID NO: 45497

SEQ ID NO: 96198 - RNA, 64 nt, hsa; identical to SEQ ID NO: 45498

SEQ ID NO: 96199 - RNA, 64 nt, hsa; identical to SEQ ID NO: 45499

SEQ ID NO: 96200 - RNA, 64 nt, hsa; identical to SEQ ID NO: 45500

SEQ ID NO: 96201 - RNA, 64 nt, hsa; identical to SEQ ID NO: 45501

SEQ ID NO: 96202 - RNA, 64 nt, hsa; identical to SEQ ID NO: 45502

SEQ ID NO: 96203 - RNA, 64 nt, hsa; identical to SEQ ID NO: 45503

SEQ ID NO: 96204 - RNA, 64 nt, hsa; identical to SEQ ID NO: 45504

SEQ ID NO: 96205 - RNA, 64 nt, hsa; identical to SEQ ID NO: 45505

SEQ ID NO: 96206 - RNA, 64 nt, hsa; identical to SEQ ID NO: 45506

SEQ ID NO: 96207 - RNA, 64 nt, hsa; identical to SEQ ID NO: 45507

SEQ ID NO: 96208 - RNA, 64 nt, hsa; identical to SEQ ID NO: 45508

SEQ ID NO: 96209 - RNA, 64 nt, hsa; identical to SEQ ID NO: 45509

SEQ ID NO: 96210 - RNA, 64 nt, hsa; identical to SEQ ID NO: 45510

SEQ ID NO: 96211 - RNA, 64 nt, hsa; identical to SEQ ID NO: 45511

SEQ ID NO: 96212 - RNA, 64 nt, hsa; identical to SEQ ID NO: 45512

SEQ ID NO: 96213 - RNA, 64 nt, hsa; identical to SEQ ID NO: 45513

SEQ ID NO: 96214 - RNA, 64 nt, hsa; identical to SEQ ID NO: 45514

SEQ ID NO: 96215 - RNA, 64 nt, hsa; identical to SEQ ID NO: 45515

SEQ ID NO: 96216 - RNA, 64 nt, hsa; identical to SEQ ID NO: 45516

SEQ ID NO: 96217 - RNA, 64 nt, hsa; identical to SEQ ID NO: 45517

SEQ ID NO: 96218 - RNA, 64 nt, hsa; identical to SEQ ID NO: 45518

SEQ ID NO: 96219 - RNA, 64 nt, hsa; identical to SEQ ID NO: 45519

SEQ ID NO: 96220 - RNA, 64 nt, hsa; identical to SEQ ID NO: 45520

SEQ ID NO: 96221 - RNA, 64 nt, hsa; identical to SEQ ID NO: 45521

SEQ ID NO: 96222 - RNA, 64 nt, hsa; identical to SEQ ID NO: 45522

SEQ ID NO: 96223 - RNA, 64 nt, hsa; identical to SEQ ID NO: 45523

SEQ ID NO: 96224 - RNA, 64 nt, hsa; identical to SEQ ID NO: 45524

SEQ ID NO: 96225 - RNA, 64 nt, hsa; identical to SEQ ID NO: 45525

SEQ ID NO: 96226 - RNA, 64 nt, hsa; identical to SEQ ID NO: 45526

SEQ ID NO: 96227 - RNA, 64 nt, hsa; identical to SEQ ID NO: 45527

SEQ ID NO: 96228 - RNA, 64 nt, hsa; identical to SEQ ID NO: 45528

SEQ ID NO: 96229 - RNA, 64 nt, hsa; identical to SEQ ID NO: 45529

SEQ ID NO: 96230 - RNA, 64 nt, hsa; identical to SEQ ID NO: 45530

SEQ ID NO: 96231 - RNA, 64 nt, hsa; identical to SEQ ID NO: 45531

SEQ ID NO: 96232 - RNA, 64 nt, hsa; identical to SEQ ID NO: 45532

SEQ ID NO: 96233 - RNA, 64 nt, hsa; identical to SEQ ID NO: 45533

SEQ ID NO: 96234 - RNA, 64 nt, hsa; identical to SEQ ID NO: 45534

SEQ ID NO: 96235 - RNA, 64 nt, hsa; identical to SEQ ID NO: 45535

SEQ ID NO: 96236 - RNA, 64 nt, hsa; identical to SEQ ID NO: 45536

SEQ ID NO: 96237 - RNA, 64 nt, hsa; identical to SEQ ID NO: 45537

SEQ ID NO: 96238 - RNA, 64 nt, hsa; identical to SEQ ID NO: 45538

SEQ ID NO: 96239 - RNA, 64 nt, hsa; identical to SEQ ID NO: 45539

SEQ ID NO: 96240 - RNA, 64 nt, hsa; identical to SEQ ID NO: 45540

SEQ ID NO: 96241 - RNA, 64 nt, hsa; identical to SEQ ID NO: 45541

SEQ ID NO: 96242 - RNA, 64 nt, hsa; identical to SEQ ID NO: 45542

SEQ ID NO: 96243 - RNA, 64 nt, hsa; identical to SEQ ID NO: 45543

SEQ ID NO: 96244 - RNA, 64 nt, hsa; identical to SEQ ID NO: 45544

SEQ ID NO: 96245 - RNA, 64 nt, hsa; identical to SEQ ID NO: 45545

SEQ ID NO: 96246 - RNA, 64 nt, hsa; identical to SEQ ID NO: 45546

SEQ ID NO: 96247 - RNA, 64 nt, hsa; identical to SEQ ID NO: 45547

SEQ ID NO: 96248 - RNA, 64 nt, hsa; identical to SEQ ID NO: 45548

SEQ ID NO: 96249 - RNA, 64 nt, hsa; identical to SEQ ID NO: 45549

SEQ ID NO: 96250 - RNA, 64 nt, hsa; identical to SEQ ID NO: 45550

SEQ ID NO: 96251 - RNA, 64 nt, hsa; identical to SEQ ID NO: 45551

SEQ ID NO: 96252 - RNA, 64 nt, hsa; identical to SEQ ID NO: 45552

SEQ ID NO: 96253 - RNA, 64 nt, hsa; identical to SEQ ID NO: 45553

SEQ ID NO: 96254 - RNA, 64 nt, hsa; identical to SEQ ID NO: 45554

SEQ ID NO: 96255 - RNA, 64 nt, hsa; identical to SEQ ID NO: 45555

SEQ ID NO: 96256 - RNA, 64 nt, hsa; identical to SEQ ID NO: 45556

SEQ ID NO: 96257 - RNA, 64 nt, hsa; identical to SEQ ID NO: 45557

SEQ ID NO: 96258 - RNA, 64 nt, hsa; identical to SEQ ID NO: 45558

SEQ ID NO: 96259 - RNA, 64 nt, hsa; identical to SEQ ID NO: 45559

SEQ ID NO: 96260 - RNA, 64 nt, hsa; identical to SEQ ID NO: 45560

SEQ ID NO: 96261 - RNA, 64 nt, hsa; identical to SEQ ID NO: 45561

SEQ ID NO: 96262 - RNA, 64 nt, hsa; identical to SEQ ID NO: 45562

SEQ ID NO: 96263 - RNA, 64 nt, hsa; identical to SEQ ID NO: 45563

SEQ ID NO: 96264 - RNA, 64 nt, hsa; identical to SEQ ID NO: 45564

SEQ ID NO: 96265 - RNA, 64 nt, hsa; identical to SEQ ID NO: 45565

SEQ ID NO: 96266 - RNA, 64 nt, hsa; identical to SEQ ID NO: 45566

SEQ ID NO: 96267 - RNA, 64 nt, hsa; identical to SEQ ID NO: 45567

SEQ ID NO: 96268 - RNA, 64 nt, hsa; identical to SEQ ID NO: 45568

SEQ ID NO: 96269 - RNA, 64 nt, hsa; identical to SEQ ID NO: 45569

SEQ ID NO: 96270 - RNA, 64 nt, hsa; identical to SEQ ID NO: 45570

SEQ ID NO: 96271 - RNA, 64 nt, hsa; identical to SEQ ID NO: 45571

SEQ ID NO: 96272 - RNA, 64 nt, hsa; identical to SEQ ID NO: 45572

SEQ ID NO: 96273 - RNA, 64 nt, hsa; identical to SEQ ID NO: 45573

SEQ ID NO: 96274 - RNA, 64 nt, hsa; identical to SEQ ID NO: 45574

SEQ ID NO: 96275 - RNA, 64 nt, hsa; identical to SEQ ID NO: 45575

SEQ ID NO: 96276 - RNA, 64 nt, hsa; identical to SEQ ID NO: 45576

SEQ ID NO: 96277 - RNA, 64 nt, hsa; identical to SEQ ID NO: 45577

SEQ ID NO: 96278 - RNA, 64 nt, hsa; identical to SEQ ID NO: 45578

SEQ ID NO: 96279 - RNA, 64 nt, hsa; identical to SEQ ID NO: 45579

SEQ ID NO: 96280 - RNA, 64 nt, hsa; identical to SEQ ID NO: 45580

SEQ ID NO: 96281 - RNA, 64 nt, hsa; identical to SEQ ID NO: 45581

SEQ ID NO: 96282 - RNA, 64 nt, hsa; identical to SEQ ID NO: 45582

SEQ ID NO: 96283 - RNA, 64 nt, hsa; identical to SEQ ID NO: 45583

SEQ ID NO: 96284 - RNA, 64 nt, hsa; identical to SEQ ID NO: 45584

SEQ ID NO: 96285 - RNA, 64 nt, hsa; identical to SEQ ID NO: 45585

SEQ ID NO: 96286 - RNA, 64 nt, hsa; identical to SEQ ID NO: 45586

SEQ ID NO: 96287 - RNA, 64 nt, hsa; identical to SEQ ID NO: 45587

SEQ ID NO: 96288 - RNA, 64 nt, hsa; identical to SEQ ID NO: 45588

SEQ ID NO: 96289 - RNA, 64 nt, hsa; identical to SEQ ID NO: 45589

SEQ ID NO: 96290 - RNA, 64 nt, hsa; identical to SEQ ID NO: 45590

SEQ ID NO: 96291 - RNA, 64 nt, hsa; identical to SEQ ID NO: 45591

SEQ ID NO: 96292 - RNA, 64 nt, hsa; identical to SEQ ID NO: 45592

SEQ ID NO: 96293 - RNA, 64 nt, hsa; identical to SEQ ID NO: 45593

SEQ ID NO: 96294 - RNA, 64 nt, hsa; identical to SEQ ID NO: 45594

SEQ ID NO: 96295 - RNA, 64 nt, hsa; identical to SEQ ID NO: 45595

SEQ ID NO: 96296 - RNA, 64 nt, hsa; identical to SEQ ID NO: 45596

SEQ ID NO: 96297 - RNA, 64 nt, hsa; identical to SEQ ID NO: 45597

SEQ ID NO: 96298 - RNA, 64 nt, hsa; identical to SEQ ID NO: 45598

SEQ ID NO: 96299 - RNA, 64 nt, hsa; identical to SEQ ID NO: 45599

SEQ ID NO: 96300 - RNA, 64 nt, hsa; identical to SEQ ID NO: 45600

SEQ ID NO: 96301 - RNA, 64 nt, hsa; identical to SEQ ID NO: 45601

SEQ ID NO: 96302 - RNA, 64 nt, hsa; identical to SEQ ID NO: 45602

SEQ ID NO: 96303 - RNA, 64 nt, hsa; identical to SEQ ID NO: 45603

SEQ ID NO: 96304 - RNA, 64 nt, hsa; identical to SEQ ID NO: 45604

SEQ ID NO: 96305 - RNA, 64 nt, hsa; identical to SEQ ID NO: 45605

SEQ ID NO: 96306 - RNA, 64 nt, hsa; identical to SEQ ID NO: 45606

SEQ ID NO: 96307 - RNA, 64 nt, hsa; identical to SEQ ID NO: 45607

SEQ ID NO: 96308 - RNA, 64 nt, hsa; identical to SEQ ID NO: 45608

SEQ ID NO: 96309 - RNA, 64 nt, hsa; identical to SEQ ID NO: 45609

SEQ ID NO: 96310 - RNA, 64 nt, hsa; identical to SEQ ID NO: 45610

SEQ ID NO: 96311 - RNA, 64 nt, hsa; identical to SEQ ID NO: 45611

SEQ ID NO: 96312 - RNA, 64 nt, hsa; identical to SEQ ID NO: 45612

SEQ ID NO: 96313 - RNA, 64 nt, hsa; identical to SEQ ID NO: 45613

SEQ ID NO: 96314 - RNA, 64 nt, hsa; identical to SEQ ID NO: 45614

SEQ ID NO: 96315 - RNA, 64 nt, hsa; identical to SEQ ID NO: 45615

SEQ ID NO: 96316 - RNA, 64 nt, hsa; identical to SEQ ID NO: 45616

SEQ ID NO: 96317 - RNA, 64 nt, hsa; identical to SEQ ID NO: 45617

SEQ ID NO: 96318 - RNA, 64 nt, hsa; identical to SEQ ID NO: 45618

SEQ ID NO: 96319 - RNA, 64 nt, hsa; identical to SEQ ID NO: 45619

SEQ ID NO: 96320 - RNA, 64 nt, hsa; identical to SEQ ID NO: 45620

SEQ ID NO: 96321 - RNA, 64 nt, hsa; identical to SEQ ID NO: 45621

SEQ ID NO: 96322 - RNA, 64 nt, hsa; identical to SEQ ID NO: 45622

SEQ ID NO: 96323 - RNA, 64 nt, hsa; identical to SEQ ID NO: 45623

SEQ ID NO: 96324 - RNA, 64 nt, hsa; identical to SEQ ID NO: 45624

SEQ ID NO: 96325 - RNA, 64 nt, hsa; identical to SEQ ID NO: 45625

SEQ ID NO: 96326 - RNA, 64 nt, hsa; identical to SEQ ID NO: 45626

SEQ ID NO: 96327 - RNA, 64 nt, hsa; identical to SEQ ID NO: 45627

SEQ ID NO: 96328 - RNA, 64 nt, hsa; identical to SEQ ID NO: 45628

SEQ ID NO: 96329 - RNA, 64 nt, hsa; identical to SEQ ID NO: 45629

SEQ ID NO: 96330 - RNA, 64 nt, hsa; identical to SEQ ID NO: 45630

SEQ ID NO: 96331 - RNA, 64 nt, hsa; identical to SEQ ID NO: 45631

SEQ ID NO: 96332 - RNA, 64 nt, hsa; identical to SEQ ID NO: 45632

SEQ ID NO: 96333 - RNA, 64 nt, hsa; identical to SEQ ID NO: 45633

SEQ ID NO: 96334 - RNA, 64 nt, hsa; identical to SEQ ID NO: 45634

SEQ ID NO: 96335 - RNA, 64 nt, hsa; identical to SEQ ID NO: 45635

SEQ ID NO: 96336 - RNA, 64 nt, hsa; identical to SEQ ID NO: 45636

SEQ ID NO: 96337 - RNA, 64 nt, hsa; identical to SEQ ID NO: 45637

SEQ ID NO: 96338 - RNA, 64 nt, hsa; identical to SEQ ID NO: 45638

SEQ ID NO: 96339 - RNA, 64 nt, hsa; identical to SEQ ID NO: 45639

SEQ ID NO: 96340 - RNA, 64 nt, hsa; identical to SEQ ID NO: 45640

SEQ ID NO: 96341 - RNA, 64 nt, hsa; identical to SEQ ID NO: 45641

SEQ ID NO: 96342 - RNA, 64 nt, hsa; identical to SEQ ID NO: 45642

SEQ ID NO: 96343 - RNA, 64 nt, hsa; identical to SEQ ID NO: 45643

SEQ ID NO: 96344 - RNA, 64 nt, hsa; identical to SEQ ID NO: 45644

SEQ ID NO: 96345 - RNA, 64 nt, hsa; identical to SEQ ID NO: 45645

SEQ ID NO: 96346 - RNA, 64 nt, hsa; identical to SEQ ID NO: 45646

SEQ ID NO: 96347 - RNA, 64 nt, hsa; identical to SEQ ID NO: 45647

SEQ ID NO: 96348 - RNA, 64 nt, hsa; identical to SEQ ID NO: 45648

SEQ ID NO: 96349 - RNA, 64 nt, hsa; identical to SEQ ID NO: 45649

SEQ ID NO: 96350 - RNA, 64 nt, hsa; identical to SEQ ID NO: 45650

SEQ ID NO: 96351 - RNA, 64 nt, hsa; identical to SEQ ID NO: 45651

SEQ ID NO: 96352 - RNA, 64 nt, hsa; identical to SEQ ID NO: 45652

SEQ ID NO: 96353 - RNA, 64 nt, hsa; identical to SEQ ID NO: 45653

SEQ ID NO: 96354 - RNA, 64 nt, hsa; identical to SEQ ID NO: 45654

SEQ ID NO: 96355 - RNA, 64 nt, hsa; identical to SEQ ID NO: 45655

SEQ ID NO: 96356 - RNA, 64 nt, hsa; identical to SEQ ID NO: 83364

SEQ ID NO: 96357 - RNA, 64 nt, hsa; identical to SEQ ID NO: 83365

SEQ ID NO: 96358 - RNA, 64 nt, hsa
uaaucucugcaguucaucucauuucaaauguuuauggaagaagcacuucauugaaaguagugcu

SEQ ID NO: 96359 - RNA, 64 nt, hsa
acuaauucugugagaguugagcucauuuucuaguuggaagaaugugauauuuguuguguuggua

SEQ ID NO: 96360 - RNA, 64 nt, hsa
aguaaaacuuuaaugggaggggagggcuggcugcuggaagaaggaagaagccagacugguuaga

SEQ ID NO: 96361 - RNA, 64 nt, hsa
uuagagugagagagagaauaaggagccuuucuuauggaagaaaugggagaagagagacaggguu

SEQ ID NO: 96362 - RNA, 64 nt, hsa
uuaaaguaaagaaaugcauaaaagacaagcacuuuggaagaauuauuuuaaugaucaacaauuu

SEQ ID NO: 96363 - RNA, 64 nt, hsa
gugguauucuggugaugggguuuagcaacuuugauggaagaaaauauuaggcuauaaauguccu

SEQ ID NO: 96364 - RNA, 64 nt, hsa
cugccaaagaagggucacaaaguguucuuccucauggaagaagugccucgggguugcagggcug

SEQ ID NO: 96365 - RNA, 64 nt, hsa
augauuggaggccauggccuauguacaaacauacuggaagaaaaccagcuuguuuuuaaaacuu

SEQ ID NO: 96366 - RNA, 64 nt, hsa
caugaacacaccgguaaauaaaacauaguccaaguggaagaauucauuaauaaggaacuuuuaa

SEQ ID NO: 96367 - RNA, 64 nt, hsa
uucuaauguugagacccacugauguuccacaaucuggaagaaaucauguacaggaauaauaugc

SEQ ID NO: 96368 - RNA, 64 nt, hsa
gcaggggaaagaaaggcaacucgcaaagaugagauggaagaaggcacgugagcagaggaggcag

SEQ ID NO: 96369 - RNA, 64 nt, hsa
ugcuugagaaggaaggacaaacacauuauuaucuuggaagaauugcauaaggcuuaugacuuaa

SEQ ID NO: 96370 - RNA, 64 nt, hsa
auggaguuaguguaaaaacauggauuacaccaaguggaagaaacgucuucuugccaagcucauu

SEQ ID NO: 96371 - RNA, 64 nt, hsa
uuccacuuuggcagugaggucguagccuuuuagguggaagaagugagggugcagcgugucagac

SEQ ID NO: 96372 - RNA, 64 nt, hsa
uguggccacugagcggcuccaucugaagguuugauggaagaagggcucuugaaacagaguuaag

SEQ ID NO: 96373 - RNA, 64 nt, hsa
uuugcuuccuaaagauuugaauuuuuuguucccauggaagaaguaaagaagaggucacuagaug

SEQ ID NO: 96374 - RNA, 64 nt, hsa
uuuguucugcauugacucauuuaccagaauucauuggaagaaaucaccaaagauuauuacaaaa

SEQ ID NO: 96375 - RNA, 64 nt, hsa
ucucuauagaucgucagcucauuuuaucuguaauuggaagaacagaaagugcuggcucacuuuc

SEQ ID NO: 96376 - RNA, 64 nt, hsa
uuccuugaagguaaugacuaugggucccucucuguggaagaauacugaauagaagagagaaauc

SEQ ID NO: 96377 - RNA, 64 nt, hsa
ucuugguuucagccgugguccuaguggcuacuuauggaagaauaggaauaguuccacaacaucc

SEQ ID NO: 96378 - RNA, 64 nt, hsa
uagcugcccaagagaaaagaguguauguuuggaguggaagaaaaucgguuuugaaucucaugaa

SEQ ID NO: 96379 - RNA, 64 nt, hsa
aacuacuguuuuucagaaggaagaaagaaucaaauggaagaagaaucaaguccaugcccaagcc

SEQ ID NO: 96380 - RNA, 64 nt, hsa
auuuaauuuuagcuuuaaaauauuggauuggcuuuggaagaauuauauuagguagaauacacau

SEQ ID NO: 96381 - RNA, 64 nt, hsa
cauaagacuaaacaugagaaaaacgcuaacuuauuggaagaaaaucggagaaacguugguguca

SEQ ID NO: 96382 - RNA, 64 nt, hsa
ccugcuaacccacaaaccuguuuggaaauaaacauggaagaauaucuggcaggcuuacuuuuag

SEQ ID NO: 96383 - RNA, 64 nt, hsa
aaaaacaccagaaagcuugcugaaauggaaaacuuggaagaauuguucaucucuuaggcuucca

SEQ ID NO: 96384 - RNA, 64 nt, hsa
aaauuuaaaaauuaacugggcaugguggcugagguggaagaauggaagaaucacuugagcccag

SEQ ID NO: 96385 - RNA, 64 nt, hsa
aaauuaacugggcaugguggcugagguggaagaauggaagaaucacuugagcccaggaguuuga

SEQ ID NO: 96386 - RNA, 64 nt, hsa
aauccagaaagcauuuaagaauugaacuaggggcuggaagaagugaaagggaagcaucuaaaaa

SEQ ID NO: 96387 - RNA, 64 nt, hsa
cuuaggaccauuugagcuugugggucacccacucuggaagaaauagucaugcuucuuuauuauu

SEQ ID NO: 96388 - RNA, 64 nt, hsa
uggcccagcaaggcaaagaacugaaguuccaggauggaagaaccuguguucuccucauaauagu

SEQ ID NO: 96389 - RNA, 64 nt, hsa
gauaggcaagaaggacagcaguaaaugaagaccauggaagaaaagaaggaaugccaaagaucga

SEQ ID NO: 96390 - RNA, 64 nt, hsa
uuccaaagacccagagucucagagccagguuaaguggaagaaacuuugagagguuucuuaauca

SEQ ID NO: 96391 - RNA, 64 nt, hsa
cucaauuuaaaaauccaaaucuuuuuaagcuucuuggaagaauuuccuccugcuuauauuguua

SEQ ID NO: 96392 - RNA, 64 nt, hsa
gcaggaugugucacuaaugcuccaccucacccuuuggaagaaaggaaagcuguuuccuccuggu

SEQ ID NO: 96393 - RNA, 64 nt, hsa
uuugguggcaguuguuuguuuuaaacugaccacuuggaagaaacaccuugguuaucugugguuu

SEQ ID NO: 96394 - RNA, 64 nt, hsa
acgaugaugauauucagacgaagcauugauguuauggaagaaagaaagaaacaaacaaaauaua

SEQ ID NO: 96395 - RNA, 64 nt, hsa
gaagaaguuuuuccuugauugugcuauguuucaguggaagaaauucuuugaaguagaugugagu

SEQ ID NO: 96396 - RNA, 64 nt, hsa
aagacaaaucaacuuugaagacacaaaaguuaauuggaagaaauaaaaacugugaacgaagaau

SEQ ID NO: 96397 - RNA, 64 nt, hsa
ggaucacauacucagucuauggaagcaacgucccuggaagaagaggcugccuauugaaaagguu

SEQ ID NO: 96398 - RNA, 64 nt, hsa
caacauguaugaacuuaaaauauggagaauguuauggaagaaauaguuuauaaguuuguuaagu

SEQ ID NO: 96399 - RNA, 64 nt, hsa
gauucaauauggcagaugggucauauucuuuauuuggaagaaguugugacuucugacaugggug

SEQ ID NO: 96400 - RNA, 64 nt, hsa
cuguaaaaguuuuaauuccuuccagaagaaccaguggaagaauuuaaauuuggcgcuacgauca

SEQ ID NO: 96401 - RNA, 64 nt, hsa
gagacacuuucucauuuuuucaauguuucuguauuggaagaagaacuuaaagcuuccuaaucua

SEQ ID NO: 96402 - RNA, 64 nt, hsa
aauuuuuaaauguucacucuggcuuaccuguuaauggaagaauuugcauaauaucuacuuagaa

SEQ ID NO: 96403 - RNA, 64 nt, hsa
gugcuugggugaucucugcuucauuagucauggguggaagaaaaaccacaccccccgcaccccu

SEQ ID NO: 96404 - RNA, 64 nt, hsa
ccuaggagggagaacaaguuccaaaggugccgacuggaagaaggggguaaaaguuugcuuuggu

SEQ ID NO: 96405 - RNA, 64 nt, hsa
cauuuuuguguagggagaauaaugucuaguaauguggaagaauagcuaucauuccugucucugu

SEQ ID NO: 96406 - RNA, 64 nt, hsa
gauaaacugauacuuuugguucguauguacauacuggaagaaucuucauaauaaaugagacuac

SEQ ID NO: 96407 - RNA, 64 nt, hsa
cagagacuuugguuccccacgcagcccuggggcuuggaagaagcacaugaccguacucugcgug

SEQ ID NO: 96408 - RNA, 64 nt, hsa
ggcaucuuaggacuggaggggcuccuuggaaaacuggaagaagucucaacacuguuucuuuuuc

SEQ ID NO: 96409 - RNA, 64 nt, hsa
uugguuucagaugaugaagaaagaggaacgggcuuggaagaaaauaaucaagaagagcaaagca

SEQ ID NO: 96410 - RNA, 64 nt, hsa
gaaguuaaccacagucgggaaacaagcauagaaauggaagaaagugaacuugaugcucaguauu

SEQ ID NO: 96411 - RNA, 64 nt, hsa
gaaaucaagucaguuuuuuuaaaagaaugaucuauggaagaaaacccaauaguacuuauaauau

SEQ ID NO: 96412 - RNA, 64 nt, hsa
acuaguuuugagcuuuagaccucagccuuuuguguggaagaagucacagcuuucuuaggcuuua

SEQ ID NO: 96413 - RNA, 64 nt, hsa
auugggaaggaaucauuguuccaggcauccaucuuggaagaaaggaccagcuuugagcuccauc

SEQ ID NO: 96414 - RNA, 64 nt, hsa
ucucuuaaauacacguaggugggccagagaacauuggaagaaucaagagagauuagaauaucug

SEQ ID NO: 96415 - RNA, 64 nt, hsa
caaguccugagugacucaagaugcuucacuuacauggaagaaacuucuaaaacucuaccgagug

SEQ ID NO: 96416 - RNA, 64 nt, hsa
agacugugaagaggcugaaagacaccuucccggguggaagaaggaguucacugaaaacuuaucu

SEQ ID NO: 96417 - RNA, 64 nt, hsa
ccugaaacacgucuaccugucugggaucaacuccuggaagaaacgccugauccgcaucaaggug

SEQ ID NO: 96418 - RNA, 64 nt, hsa
ggugagacccucucccaagaggagcagagaaaacuggaagaagauuugcugguagaagucaguc

SEQ ID NO: 96419 - RNA, 64 nt, hsa
acugagcaguuucuguguauauauagaagguagaaaugaaaagugagaaaauauuugaaaggga

SEQ ID NO: 96420 - RNA, 64 nt, hsa
aucagaaaauauaauaaaauugcacaaaaaaaaaaaugaaaaagaugcagacuggucuuuuaga

SEQ ID NO: 96421 - RNA, 64 nt, hsa
agaugacuugugaaccccacaguguggaugugcaaaugaaaauugaaggaaagaauaugaacug

SEQ ID NO: 96422 - RNA, 64 nt, hsa
uuuuaacaaauaaaaggcauuuaaguaaaacuaaaaugaaaaaaguaggccuucugacauugug

SEQ ID NO: 96423 - RNA, 64 nt, hsa
ccaugaaccugggcuaaugggagacuguagagaaaaugaaaaaagauccaccagaggacaucuu

SEQ ID NO: 96424 - RNA, 64 nt, hsa
auguugcuacucccauggcaaagaaaaaaaaaagaaugaaaaaaagaaaaaaauuuggaaaaaa

SEQ ID NO: 96425 - RNA, 64 nt, hsa
aaagaaaaaucaugucaucuucuauuuguacagaaaugaaaauaaaauaugaaaauaaugaaag

SEQ ID NO: 96426 - RNA, 64 nt, hsa
agaaaugaaaauaaaauaugaaaauaaugaaagaaaugaaaagauagcuuuuaauugugguaua

SEQ ID NO: 96427 - RNA, 52 nt, hsa
agauaagcaugaaaacuugaacaaugaaaagcagaaugaaaaugagucauug

SEQ ID NO: 96428 - RNA, 64 nt, hsa
agauaagcaugaaaacuugaacaaugaaaagcagaaugaaaaugagucauugcaacgacuuuca

SEQ ID NO: 96429 - RNA, 64 nt, hsa
auaaaaugauucaguguuucuuuucuauauugucaaugaaaaccuugaguucuaauaauccaug

SEQ ID NO: 96430 - RNA, 64 nt, hsa
uuggaaaauagaguaauuuaaaaaauauauuugaaaugaaaaucuccaacacauuagaagauga

SEQ ID NO: 96431 - RNA, 64 nt, hsa
uuggucaaaacacacauagaaaacaaaaugauccaaugaaaacugguuuaacuagcaaaagccu

SEQ ID NO: 96432 - RNA, 64 nt, hsa
cgugcugaauaggauucuucucaguuugaaagacaaugaaaaaugguuuuguaugacuugaaua

SEQ ID NO: 96433 - RNA, 64 nt, hsa
uaacugugaguggcugcacaggcacugugcaaacaaugaaaagccccuucacuucugccugcac

SEQ ID NO: 96434 - RNA, 53 nt, hsa
cuaaggaugaagaaaguuaagagaaugaaaaguuacgagaacguccuacucau

SEQ ID NO: 96435 - RNA, 64 nt, hsa
uauaauuaucccuuuuuaauauuggggaaagaaaaaugaaaauucauuaguuaauuacugcuuu

SEQ ID NO: 96436 - RNA, 64 nt, hsa
cagaagaaauaacuuuauaacaauuuuuuuuaauaaugaaaaauauuuucgugacaagugagcu

SEQ ID NO: 96437 - RNA, 64 nt, hsa
ggaggaaggaaggacauuaaauucuuucccugguaaugaaaagagcccuuuaucaauacagugc

SEQ ID NO: 96438 - RNA, 64 nt, hsa
auuuugauguuuuuuugccaguuggcuuuucuuaaaugaaaacacuguuccauuuaaaguacau

SEQ ID NO: 96439 - RNA, 64 nt, hsa
auaucugaucaaguuaucaaggagauaauucuagaaugaaaaagaaaauccucuuguuggaaac

SEQ ID NO: 96440 - RNA, 64 nt, hsa
aacaaauucuuuuaauucaacgggugcuuuacauaaugaaaaaaccacuuguggcacacgaugg

SEQ ID NO: 96441 - RNA, 64 nt, hsa
uccugggagccaggaagacuccgcagugggugagaaugaaaacuugagacucccaaguucuggg

SEQ ID NO: 96442 - RNA, 64 nt, hsa
ggagaaaggaccacauugcuuacuugaaacagacaaugaaaacaaccaaagugauauauaaaau

SEQ ID NO: 96443 - RNA, 64 nt, hsa
aaauuguggagcaaaauaguaaauaaaauauaaaaaugaaaaugaagauacgugaaauucaaau

SEQ ID NO: 96444 - RNA, 64 nt, hsa
augagaugagcagaucaaauauuccccgugaguuaaugaaaacugauucaaccaaauggcgaag

SEQ ID NO: 96445 - RNA, 64 nt, hsa
ggcuuaggacucugugccaaaaaucucuauuuuaaaugaaaauauuuauauaaaaauacauuua

SEQ ID NO: 96446 - RNA, 64 nt, hsa
ugguuguaacaaaauuugauuugaacuaccuauaaaugaaaagucgggguuuauuacuuuauau

SEQ ID NO: 96447 - RNA, 64 nt, hsa
uauuuaaaugcugcuggcuauuccuuuguauauaaaugaaaaauaccauucauuaaaauuaagu

SEQ ID NO: 96448 - RNA, 64 nt, hsa
agacucugucucaaaaaaaaaaaaaaaaaagaugaaugaaaauaugaaauauauaaacuaguau

SEQ ID NO: 96449 - RNA, 64 nt, hsa
aaauauuuaauuuguuuuauaaagguagugaaaaaaugaaaauuugcuauuuauuaaaaaacau

SEQ ID NO: 96450 - RNA, 64 nt, hsa
gguucaucacauuauaagauaaauaaauuaaauuaaugaaaaugugacuuagaguagggguagc

SEQ ID NO: 96451 - RNA, 64 nt, hsa
cuucacuucuuuguauauuauguauaaauuagaaaaugaaaaaugugugaauaacauuguauga

SEQ ID NO: 96452 - RNA, 64 nt, hsa
aaaaucauggugacacuuccaauuaagugcacuaaaugaaaaguuaagucacuuauuaacuuuu

SEQ ID NO: 96453 - RNA, 64 nt, hsa
auaaaccuugauguacauguugagauauuuggacaaugaaaaugccuuaaaaggaaugcauaug

SEQ ID NO: 96454 - RNA, 64 nt, hsa
acagccugugcugucuuaaugguuuaugucaggaaaugaaaaagauacuguaccaaaucuggaa

SEQ ID NO: 96455 - RNA, 64 nt, hsa
uuaaaacaaaaauaaguuaaugguacagaaagagaaugaaaaaugaaagccuccuuuuauccua

SEQ ID NO: 96456 - RNA, 64 nt, hsa
uuggcauuugccugaaguuguauugaaacaauuuaaugaaaauauuaaauauuugguuucaaaa

SEQ ID NO: 96457 - RNA, 64 nt, hsa
uuacaaauuggaccuuuauacauuuucugaaaacaaugaaaagaguauauuuaaccuuuucugg

SEQ ID NO: 96458 - RNA, 64 nt, hsa
guuugcgcuuuuaauuguuuuuauuuuguuuuuuaaugaaaacccagaucuuuccuuuuuggca

SEQ ID NO: 96459 - RNA, 64 nt, hsa
guucuuuaaugggugaagaguuucaguuuugcaaaaugaaaaaguucuggagaucaguugugca

SEQ ID NO: 96460 - RNA, 64 nt, hsa
augauagaaaauuuggaaagugcaaauaagcaaaaaugaaaacaauuuuaaaaauguaaaaccu

SEQ ID NO: 96461 - RNA, 64 nt, hsa
accagagaucagaaauucaaaaacucagaauaaaaaugaaaaagcuacaagcauauaugagaag

SEQ ID NO: 96462 - RNA, 64 nt, hsa
aaucuucacagauaugaauacuaaauuauaucuuaaugaaaauagauauggucacaaguacauu

SEQ ID NO: 96463 - RNA, 64 nt, hsa
guuuguucuaagucacucugagaggagugauaccaaugaaaaaaggucaguugauuccagugcu

SEQ ID NO: 96464 - RNA, 64 nt, hsa
uaaaacagaaccuuuaagagcaaccauggcacaaaaugaaaauguaguaguacaaccaguugua

SEQ ID NO: 96465 - RNA, 64 nt, hsa
aaaaucauuguaaaguaucaagacaauacgaguaaaugaaaaggcuguuaaaguagaugacauc

SEQ ID NO: 96466 - RNA, 64 nt, hsa
uagaugaccaagcaaaaagacuuuaaaaaaugguaaugaaaauggaaugcagcuacugcagcua

SEQ ID NO: 96467 - RNA, 64 nt, hsa
gaaauuacugucaccacuaguuuuaauauaguacaaugaaaaaauaauauauauauauauagua

SEQ ID NO: 96468 - RNA, 64 nt, hsa
aaaaaauaaaagaaacauaagauaaguaccucucaaugaaaaauguaaaaguaccuagaaauuc

SEQ ID NO: 96469 - RNA, 64 nt, hsa
caucuuuagagaccauuggcccacugaugaauggaaugaaaaagcgagcagauacuguuggucu

SEQ ID NO: 96470 - RNA, 64 nt, hsa
cacauuaguauguauaacuggcuuuaccaaauugaaugaaaaggagcuugugcaaaaaaauuua

SEQ ID NO: 96471 - RNA, 64 nt, hsa
gcauccuucuguuguuuauuuuaaauauauuuuuaaugaaaagggacuuaaaaaguaaacauga

SEQ ID NO: 96472 - RNA, 64 nt, hsa
cucucuuuccuucaaauaacauaagucugaaagcaaugaaaacgucaaaggaaaauguuuauau

SEQ ID NO: 96473 - RNA, 64 nt, hsa
acugaucaaugccccugcagguugcauuuauuguaaugaaaaagaaagacugggauuaaucucu

SEQ ID NO: 96474 - RNA, 64 nt, hsa
ccuggggaucagaauuccaaaauggaugucccugaaugaaaaucaaggugucagcagagcugug

SEQ ID NO: 96475 - RNA, 64 nt, hsa
aguuuuuauaaaaagaaagcccgggucugcagagaaugaaaacugguuggaaacuaaagguuca

SEQ ID NO: 96476 - RNA, 64 nt, hsa
uagagcguguugcuguuguaacaucccagagaagaaugaaaaggcacaugcuuuuauccgugac

SEQ ID NO: 96477 - RNA, 64 nt, hsa
gauuuuuuuguuuggggagguuggcuugaacauaaaugaaaauauccuguuauuuucuuaggga

SEQ ID NO: 96478 - RNA, 64 nt, hsa
ugcacaucugcucuguuuugguuuuucuacaggaaaugaaaaucaacuuguuuuuuuaauauga

SEQ ID NO: 96479 - RNA, 64 nt, hsa
ucuagauucacaaauuuaaauaaauuacucaaaaaaugaaaauugauuuuguaaacuuuuauuu

SEQ ID NO: 96480 - RNA, 64 nt, hsa
gcugaugauuuugcaaaaugaguugugaugaaucaaugaaaaauguaauuuagaaacugauuuc

SEQ ID NO: 96481 - RNA, 64 nt, hsa
ucagaauuagauggcuuauuuuuuaaaauauuugaaugaaaacauuuuauuuuuaaaauauuac

SEQ ID NO: 96482 - RNA, 64 nt, hsa
ugauuauucucagagggugcugcucuuuaaugaaaaugaaaauuauagcuaauguuuuuuccuc

SEQ ID NO: 96483 - RNA, 64 nt, hsa
ucaguuugauuauucucagagggugcugcucuuuaaugaaaaugaaaauuauagcuaauguuuu

SEQ ID NO: 96484 - RNA, 64 nt, hsa
aguuuguauaaacagguugcuauaagcuuggugaaaugaaaauggaacauuucaaucaaacauu

SEQ ID NO: 96485 - RNA, 64 nt, hsa
caauagguucuaaaaauaaaauugcuaaacaagaaaugaaaacauggagcauuguuaauuuaca

SEQ ID NO: 96486 - RNA, 64 nt, hsa
caggcuuuuuaaauaaaauuagagcuguaaggaaaaugaaaagccacaaaugcaagacuguucu

SEQ ID NO: 96487 - RNA, 64 nt, hsa
uggcuugaagccuaguguuuucauaauguaauucaaugaaaacuguuggagaaauauuuaaaca

SEQ ID NO: 96488 - RNA, 64 nt, hsa
uucucuagcuuaucccugcacaauuauuagagugaaugaaaaaccacuuuccugcuuuccauug

SEQ ID NO: 96489 - RNA, 64 nt, hsa
accuccacagcucauuucuuuguaauauaaucagaaugaaaaauaauuuaagaggacagaagac

SEQ ID NO: 96490 - RNA, 64 nt, hsa
ccuuuuguagcagucuguaacuuaacuauaguauaaugaaaagaaugaccuauaauauaggugu

SEQ ID NO: 96491 - RNA, 64 nt, hsa
uuuggguauccuguaauuuaguuguaacauagaaaaugaaaaaacaguuaaaaaaagugaagua

SEQ ID NO: 96492 - RNA, 64 nt, hsa
aauuuaagaaauagucuauguaaagucacaaauuaaugaaaaaaauucgcaugaaaaugacaga

SEQ ID NO: 96493 - RNA, 64 nt, hsa
cuuguccuacauucauucuccugcuuguaaugaaaaugaaaaaaucauuguaacacuugaugga

SEQ ID NO: 96494 - RNA, 64 nt, hsa
cuaacacuuguccuacauucauucuccugcuuguaaugaaaaugaaaaaaucauuguaacacuu

SEQ ID NO: 96495 - RNA, 64 nt, hsa
ccuggucaucaaaagacucgacagcaagacuuagaaugaaaaaggguacuuguuuauauuaaua

SEQ ID NO: 96496 - RNA, 64 nt, hsa
aauaaaauauuuuugaaaggcauguuccucugucaaugaaaaaaaguacauguauguguuguga

SEQ ID NO: 96497 - RNA, 64 nt, hsa
uuagauuggcccggaaaggccaauaaagaguuagaaugaaaacucauuacuuuuccauucccaa

SEQ ID NO: 96498 - RNA, 64 nt, hsa
uuauaugacaaaugaaaagaauaacaaguugucaaaugaaaagaaugacauugaaacauuugua

SEQ ID NO: 96499 - RNA, 64 nt, hsa
uuuuuaguuaugagaaaucuuugcuuauaugacaaaugaaaagaauaacaaguugucaaaugaa

SEQ ID NO: 96500 - RNA, 64 nt, hsa
agcagacauucucuguagaagguaauggucugagaaugaaaagguguuugauggacauguugug

SEQ ID NO: 96501 - RNA, 64 nt, hsa
uucucaggacccuugcccccacccccauuuuuuuaaugaaaaaaaaaaacaaaaaaaacggauc

SEQ ID NO: 96502 - RNA, 64 nt, hsa
gaaauagaucuggugcacccgaacauuaggagaaaaugaaaaauauacaaccaaccguucguga

SEQ ID NO: 96503 - RNA, 64 nt, hsa
ugcaagggucaaaacuagauuggaucuugguuugaaugaaaaaaagcauaaaauauucuugcaa

SEQ ID NO: 96504 - RNA, 64 nt, hsa
gaaaaauguuugaauaugaucuuuagggacuucuaaugaaaaggguauaugaaaugggaacaau

SEQ ID NO: 96505 - RNA, 64 nt, hsa
auuauccauuuccuaugcguuuuacuccucagagaaugaaaaaaacugcaucccaucacccaaa

SEQ ID NO: 96506 - RNA, 64 nt, hsa
agaaaaugguuaccaguacagucaaaaaagagaaaaugaaaaaaauacaacuaaaaggaagaaa

SEQ ID NO: 96507 - RNA, 64 nt, hsa
aggacaguacaucucuaguagaauaugcccugagaaugaaaagaauguaacaguguuaguauuu

SEQ ID NO: 96508 - RNA, 64 nt, hsa
guguguucaugccuauacgauaaacaugauacauaaugaaaaugcuuaucuuuaggagaaagga

SEQ ID NO: 96509 - RNA, 64 nt, hsa
caaaaccaccacaaaauuagauuuauagacucaaaaugaaaacaucagcuuacugguuuguagu

SEQ ID NO: 96510 - RNA, 64 nt, hsa
ggcauggcccaauugauauaaacauuuagaaggaaaugaaaagcuaaaauaggaaguaauuauu

SEQ ID NO: 96511 - RNA, 64 nt, hsa
aguuaccaggagaaaugugugacaccuauauuauaaugaaaacaaucucauuacuuauaguuua

SEQ ID NO: 96512 - RNA, 64 nt, hsa
ucaucaguagaaucuauuuuggucacuucuagucaaugaaaaauguaaacuuuuaggagagaau

SEQ ID NO: 96513 - RNA, 64 nt, hsa
aauaugggaucccguguguguguguguguguuugaaugaaaaaugcuuauguauugacagaaca

SEQ ID NO: 96514 - RNA, 64 nt, hsa
gugaacauguagauguuuuguguguauuuuuuuaaaugaaaacucaaaauaagacaaguaauuu

SEQ ID NO: 96515 - RNA, 64 nt, hsa
uguuuuauguuaagcaaaacauacuuuagaaacaaaugaaaaaggcaauugaaaaucccagcua

SEQ ID NO: 96516 - RNA, 64 nt, hsa
caguuuguguagacaaucuuacugagcaaaaggcaaugaaaagucuugguucccacacugcgau

SEQ ID NO: 96517 - RNA, 64 nt, hsa
aacuuuggaaugacccccuuauauauuuucugaaaaugaaaacaguuacaugaaaaaaauuucc

SEQ ID NO: 96518 - RNA, 64 nt, hsa
ugggcaacauagcaacaccccccaugucuacaaaaaugaaaaaccaaaaagcaaaccaaaagaa

SEQ ID NO: 96519 - RNA, 64 nt, hsa
agagaugacaaaacuaaguucaggggccauggaaaaugaaaaaguccgcuauauugugauuugg

SEQ ID NO: 96520 - RNA, 64 nt, hsa
uuugugcaccugcuuuuuaaauauuucuacuaaaaaugaaaaaaaaaaacccuuagaccuguag

SEQ ID NO: 96521 - RNA, 64 nt, hsa
aucauuuuucuuuuuucuuuuuuagaaaacucagaaugaaaauucauuccccugaaauauuuag

SEQ ID NO: 96522 - RNA, 64 nt, hsa
agucuaacauuuuuugccaaacagauauauauuuaaugaaaagaagagauacauaaauguguga

SEQ ID NO: 96523 - RNA, 64 nt, hsa
ccaaaacuggaacaccuagcuaacaggagagaggaaugaaaacacacccacgccuuggaaccgu

SEQ ID NO: 96524 - RNA, 64 nt, hsa
gagugauuuuccucuguuuuucacuaaauaagcaaaugaaaacucucuccauuaccuucugcuu

SEQ ID NO: 96525 - RNA, 64 nt, hsa
caguccuuuauccaccuggauuuuuagggaaaaaaaugaaaaagaauaagucacauugguucca

SEQ ID NO: 96526 - RNA, 64 nt, hsa
accacugacuauuuuaucaaauuugccuuaaaauaaugaaaaagaaaaguauaguuaaugguuu

SEQ ID NO: 96527 - RNA, 64 nt, hsa
ucuguuuugccuuuucacgcccuuuauagugugaaaugaaaaauuagucacuuccucacaugga

SEQ ID NO: 96528 - RNA, 64 nt, hsa
uuaugaagcuuuuaugugaaacauguuucuuuguaaugaaaaccacauuggagauguuuaguaa

SEQ ID NO: 96529 - RNA, 64 nt, hsa
gugcauauuuauaaaaauaaaaaacacugggagaaaugaaaaaauauauaucaaauauauucag

SEQ ID NO: 96530 - RNA, 64 nt, hsa
uagauuaaauuggagaaacguguuaauuguguggaaugaaaaaauacauauauuuuuggaaaag

SEQ ID NO: 96531 - RNA, 64 nt, hsa
uuguguugugugacauucaaaugucauuuuuuugaaugaaaaauacuuuccccuuuguguuuug

SEQ ID NO: 96532 - RNA, 64 nt, hsa
gaaaaaaugaaaaaaagaaggaaaaaagaauaagaaugaaaacugcugacguauuacaaaacag

SEQ ID NO: 96533 - RNA, 64 nt, hsa
acauaacucugguguguuaacauugcaaugaaaaaaugaaaaaaagaaggaaaaaagaauaaga

SEQ ID NO: 96534 - RNA, 64 nt, hsa
gaaaaaucacauaacucugguguguuaacauugcaaugaaaaaaugaaaaaaagaaggaaaaaa

SEQ ID NO: 96535 - RNA, 64 nt, hsa
aggaaaaugaaacuagacgggugggggacacuagaaugaaaaccaguguuaggguaaagacaaa

SEQ ID NO: 96536 - RNA, 64 nt, hsa
cuuauuaaggagaaauagaaaagaagaaauuuauaaugaaaagaagaugaauuucauuauguaa

SEQ ID NO: 96537 - RNA, 64 nt, hsa
ugugaaauucacaaaaaguaaaccaaacaaaacgaaugaaaaacuggaaauaauucguuuccau

SEQ ID NO: 96538 - RNA, 64 nt, hsa
acugguagguaagcaugaguuaaggaaagucaaaaaugaaaauauauuuugcuguguauaaauu

SEQ ID NO: 96539 - RNA, 64 nt, hsa
uguaaugugaugaagaaagagaucuuucuuuuuuaaugaaaacauuaauguguuaauacccugu

SEQ ID NO: 96540 - RNA, 64 nt, hsa
uaaagaaagaaaaaaagauuuuuuuauuuguauuaaugaaaagcuuuaguuuaaaauaaggaga

SEQ ID NO: 96541 - RNA, 64 nt, hsa
ggucugcagucuggaagcuugucugcucuauagaaaugaaaaugcagcaugaaguugacauugu

SEQ ID NO: 96542 - RNA, 64 nt, hsa
agaaugagaaacugcaucaacaggacaucaaguuaaugaaaauggagaaacugguauguuuccu

SEQ ID NO: 96543 - RNA, 64 nt, hsa
aaucaaugaucugaagagugaaaaugaugcuuuaaaugaaaaauugaaaucagaagaacaaaaa

SEQ ID NO: 96544 - RNA, 64 nt, hsa
ccuggugggaggagagagggcacaucuccagaaaaaugaaaagcaauacaacuuuaccauaaag

SEQ ID NO: 96545 - RNA, 64 nt, hsa
caaccagacuuugagccugcaucuucuugcaucuaaugaaaaacaaaaagcuaacaucuuuacg

SEQ ID NO: 96546 - RNA, 64 nt, hsa
gauguauuccacuguuauuacuguuaccugcacaaaugaaaaacaauacucaacaguaauucca

SEQ ID NO: 96547 - RNA, 64 nt, hsa
guagauuuguacuuagcaaauacaaacacauccaaaugaaaaauuuuguagauaccauaucccc

SEQ ID NO: 96548 - RNA, 64 nt, hsa
agaguaaacuuuuccuaaaacacuuuauauuauaaaugaaaauaaauugcuaguuuauauuuua

SEQ ID NO: 96549 - RNA, 64 nt, hsa
uucaucuacauguaauguguuauuaauuuuauuaaaugaaaacuaaucaccuucauguggaaau

SEQ ID NO: 96550 - RNA, 64 nt, hsa
gguggugaccuuauagaacauaaauauugugaauaaugaaaauccacugaaucuaauaagggac

SEQ ID NO: 96551 - RNA, 64 nt, hsa
cagcaauucuacucauagguauauacuuaaaagaaaugaaaaauccacacaaaaaccucugcau

SEQ ID NO: 96552 - RNA, 64 nt, hsa
guucuuuuuuccaccuuuuuggucaguaaaacuuaaugaaaaaagcaaagaaaaaaauauucug

SEQ ID NO: 96553 - RNA, 64 nt, hsa
uucugaaaauguauuuaacauagcuguuuuaacaaaugaaaaaaagacguagaaaaauguuuag

SEQ ID NO: 96554 - RNA, 64 nt, hsa
aaaaugaaaaggacccagcaagccucacuuguggaaugaaaauggggcauucaggaaagcaccu

SEQ ID NO: 96555 - RNA, 64 nt, hsa
aggaguuugucgucuuggacucaacaacuaacaaaaugaaaaggacccagcaagccucacuugu

SEQ ID NO: 96556 - RNA, 64 nt, hsa
uguauuauuucuggcuuuuugaauuaaucuagaaaaugaaaagauggaguuguauuuugacaaa

SEQ ID NO: 96557 - RNA, 64 nt, hsa
uacugauacuauucaaugcaaugcaauucaaugcaaugaaaacaaaauuccauuacaggggcag

SEQ ID NO: 96558 - RNA, 64 nt, hsa
gagaaaauguugaccuuuuacuuccuuuuacaaaaaugaaaauaauaaacauguuuucguauaa

SEQ ID NO: 96559 - RNA, 64 nt, hsa
agauguuggaacauuaagaaaaauguauauucccaaugaaaaaauaguuauaucaucuuauagu

SEQ ID NO: 96560 - RNA, 64 nt, hsa
uuuaugguccuaaaagcaaaauaaaaacuauucgaaugaaaagacaagaaaaucagguauuaau

SEQ ID NO: 96561 - RNA, 64 nt, hsa
ucagaacuugcuacguuucaggugcuagggacuuaaugaaaaacaggacaaaacaauuccuuuu

SEQ ID NO: 96562 - RNA, 64 nt, hsa
uacagcauuuucaacauauuggcaacauauuuuaaaugaaaacacuaaaacaauucuuaguaug

SEQ ID NO: 96563 - RNA, 64 nt, hsa
auuaacauaaaauaucaaacacacaaagucauaaaaugaaaauuuacaguuuuaccuguucaua

SEQ ID NO: 96564 - RNA, 64 nt, hsa
ugagaaacaacaauuucuacuuugaagucauaccaaugaaaaaauguauaugcacuuauaauuu

SEQ ID NO: 96565 - RNA, 64 nt, hsa
caaagcuuucauguaaacugugcaccaagcaggaaaugaaaaugucuuguguuaccugaaaaca

SEQ ID NO: 96566 - RNA, 64 nt, hsa
cccaugagcuguaguuauucauccuucuguacaaaaugaaaaguuuggaaauuguuugcccuga

SEQ ID NO: 96567 - RNA, 64 nt, hsa
uuccucugccauccuugcuaaguaguuuugacacaaugaaaauggaagcacuuuagugguagua

SEQ ID NO: 96568 - RNA, 64 nt, hsa
aagaggauggaaaaacugaauacaagauaccaaaaaugaaaaaaagugucccauuuuuaauaac

SEQ ID NO: 96569 - RNA, 64 nt, hsa
augggcucaauuauuauguuugucaggauaaucaaaugaaaauacuaguucagugaucagcauu

SEQ ID NO: 96570 - RNA, 64 nt, hsa
uuuguuaauguugcugccucauugaccugggaaaaaugaaaaaaaaaaauaaagcaaaugguaa

SEQ ID NO: 96571 - RNA, 64 nt, hsa
uagaaugccagaucuuccagauuaggcuaaauguaaugaaaaccucuuaggauuaucuguggag

SEQ ID NO: 96572 - RNA, 64 nt, hsa
gcaagcauaucaaccaggcaagucuugcuguaaaaaugaaaacaaaacaaacccaugagguuac

SEQ ID NO: 96573 - RNA, 64 nt, hsa
gugauguaaugugaucacagcuuuuguuguguugaaugaaaauauguggacugucauuuuguug

SEQ ID NO: 96574 - RNA, 64 nt, hsa
ugaacuucuaaagcaagaggauaaaagaagcaugaaugaaaagaaugacauuucaaaaaaaugg

SEQ ID NO: 96575 - RNA, 64 nt, hsa
gaaugaaaagaaugacauuucaaaaaaaugguucaaugaaaaacuauagcuaaaauauguaaac

SEQ ID NO: 96576 - RNA, 64 nt, hsa
auaaaauagguguugccuauugcugugcuuauaaaaugaaaaaggaaauugaggacacuuuugc

SEQ ID NO: 96577 - RNA, 64 nt, hsa
aacugcucaacaggaaaugaaccuagaaacagaaaaugaaaagguugauugaaauaaaacuuga

SEQ ID NO: 96578 - RNA, 64 nt, hsa
cugcauuugcucuuggaggcuuugggagagcaggaaugaaaacauucagaggaagacaucugua

SEQ ID NO: 96579 - RNA, 64 nt, hsa
aaaauaaagcuaccauuuuacauuucuauuucauaaugaaaaacuaugucaguauuuuaauaug

SEQ ID NO: 96580 - RNA, 64 nt, hsa
uaauggcacugagaaacaugcaagauacaggaaaaaugaaaauguuacaagcuaagaguuuaca

SEQ ID NO: 96581 - RNA, 64 nt, hsa
aaauagaaacugagccauugccaaaugguaaagaaaugaaaaguuuucacagugacuacugaau

SEQ ID NO: 96582 - RNA, 64 nt, hsa
uaacuuguuuaaguguaagaaauaccauuucaggaaugaaaaagaaggaauacuacuuucuaag

SEQ ID NO: 96583 - RNA, 64 nt, hsa
auaaaacacaggaaaggggaauucugugauggcaaaugaaaaaaauguuaacauuugguagaca

SEQ ID NO: 96584 - RNA, 64 nt, hsa
guauuauuuuuuucuuaacagaaauauuuuuaaaaaugaaaaaguacucaaaagugagaagagu

SEQ ID NO: 96585 - RNA, 64 nt, hsa
gauuuccauucaguguagggaagacauuuguaauaaugaaaacugaaaauggaguaauugugag

SEQ ID NO: 96586 - RNA, 64 nt, hsa
auaauauagcaguaguuauacagagaaauacuacaaugaaaacauuuggggcaauuagaccuac

SEQ ID NO: 96587 - RNA, 64 nt, hsa
gcaugucaacccuuccauuucaaucccaguuagaaaugaaaauaauuacuuugaaacuuggcuu

SEQ ID NO: 96588 - RNA, 64 nt, hsa
uuuuacccaaaauaauuuuuagagaaaaugauguaaugaaaaauuguaccaugaauuaggagca

SEQ ID NO: 96589 - RNA, 64 nt, hsa
uacaaagauucaaaugcuuuuaugacuaauguaaaaugaaaagaggcuuacauuuuaaauguua

SEQ ID NO: 96590 - RNA, 64 nt, hsa
aagucaacacauaguguaaaauaauuacaugccuaaugaaaagaagaugucauuuccuaauuuu

SEQ ID NO: 96591 - RNA, 64 nt, hsa
auuauuuuucuuauacuuauuuuuuauuaaacaaaaugaaaaagauccuuuucaaaaaggugau

SEQ ID NO: 96592 - RNA, 64 nt, hsa
gaaaggagggaaaauaauagcccagugagagcugaaugaaaagggacugaauuuaaauauuugu

SEQ ID NO: 96593 - RNA, 64 nt, hsa
auuaaaugaauauuuuauuuuaaaggcuuaaauaaaugaaaaugauuuuuguaauguuuggucu

SEQ ID NO: 96594 - RNA, 64 nt, hsa
uucucagacuaaaccugacauagggaacaccgagaaugaaaacaucuuuaacaccaaaacugaa

SEQ ID NO: 96595 - RNA, 64 nt, hsa
caaauugaaucuuuuacuuaccucuugcaaaaaaaaugaaaaaugaaaaaacaaauucaaaacc

SEQ ID NO: 96596 - RNA, 64 nt, hsa
aaucuuuuacuuaccucuugcaaaaaaaaugaaaaaugaaaaaacaaauucaaaaccuauucaa

SEQ ID NO: 96597 - RNA, 64 nt, hsa
cucaagugacacaaguuacaaguugauaucguugaaugaaaagcaaaacaaaaacaauucagga

SEQ ID NO: 96598 - RNA, 64 nt, hsa
gucucuugagacaaaugcaaaacuuuuuuuuugaaaugaaaagacuuuuuaaaaaaguaaaaca

SEQ ID NO: 96599 - RNA, 64 nt, hsa
ggauaauuuccacuguguggaaugugaauaguuaaaugaaaaguuaugguuauuuaauguaauu

SEQ ID NO: 96600 - RNA, 64 nt, hsa
ucacacauaaaguccuuuuaaggagaaaaucuaaaaugaaaaguggauaaacagaacauuuaua

SEQ ID NO: 96601 - RNA, 64 nt, hsa
ccaaucugguuuucuuuuacccauaaauaacaugaaugaaaaaagauugggacaauagagacug

SEQ ID NO: 96602 - RNA, 64 nt, hsa
aaacaugaaaugguuuuagcuagagucagaccagaaugaaaaugccaggagcugguacacuaca

SEQ ID NO: 96603 - RNA, 64 nt, hsa
gaaauguuagguuacuguaugguuuauggagauuaaugaaaaugaaugcccaaaaauaagucuu

SEQ ID NO: 96604 - RNA, 64 nt, hsa
cuuuuaucaguagaaugauuucauuuagauguauaaugaaaaaggauaaugcaaaaauuaugua

SEQ ID NO: 96605 - RNA, 64 nt, hsa
aauacauauaugcagugcuuguuguccaaauagaaaugaaaauaaguggaagagagaggaagaa

SEQ ID NO: 96606 - RNA, 64 nt, hsa
caaccuuuuuuccuugaauuaacagcaauaaaaaaaugaaaaacagcuuaagaauugugccuca

SEQ ID NO: 96607 - RNA, 64 nt, hsa
augaaauaaaaaggccauauucagaguugaauuuaaugaaaacucagaggaaauaggaaaaucu

SEQ ID NO: 96608 - RNA, 64 nt, hsa
uauguggaguaauagggaaagaagaguuacagaaaaugaaaaagaaaaugaguuacacugagaa

SEQ ID NO: 96609 - RNA, 64 nt, hsa
auacaugaaucuuggccacaaugagaaaaauaaaaaugaaaaaagagcaggcauccauuuccau

SEQ ID NO: 96610 - RNA, 64 nt, hsa
cucaaucaauguaauucaguauuuuaacaaaaggaaugaaaaauuaucaucucaauagacaaag

SEQ ID NO: 96611 - RNA, 64 nt, hsa
gugaucccagauuagauuuuugagauccaaaaaaaaugaaaaccuaggaaaguagcaaauaugu

SEQ ID NO: 96612 - RNA, 64 nt, hsa
aagagaaauaaauguuguuuuagaaagccuacucaaugaaaacacauuuuaagacugaaaguga

SEQ ID NO: 96613 - RNA, 64 nt, hsa
cagccuagauccagaguucagaagaccuugagacaaugaaaauaaacuugguaauaaucuuuuu

SEQ ID NO: 96614 - RNA, 64 nt, hsa
caagacucugccucuauuauaaaaaaacaaaauaaaugaaaaggacuguaggaggcagagacgg

SEQ ID NO: 96615 - RNA, 64 nt, hsa
cguccacaggggaucugucaguuuggguccuccaaaugaaaaaugucaagacagaauuggacau

SEQ ID NO: 96616 - RNA, 64 nt, hsa
guuuuccauauaauauuauuuaaaaugcugagaaaaugaaaaaaucuaaauggugaaauauaua

SEQ ID NO: 96617 - RNA, 64 nt, hsa
ccguguucucagaaagcccaguguuuuugcaaagaaugaaaagggaccccauauguagcaaaaa

SEQ ID NO: 96618 - RNA, 64 nt, hsa
ccgaguuccagguagugguuuugccuuucccaaaaaugaaaauaaacuguuaccgaaggaauua

SEQ ID NO: 96619 - RNA, 64 nt, hsa
guagcccuaccaaaaauagccaguaguaucugaaaaugaaaaauaaaugaaguaucucuaggaa

SEQ ID NO: 96620 - RNA, 64 nt, hsa
uuuaaagcuaaaaacauuacuuuuagaucccuagaaugaaaauuuuuuucucaucuaugcaauu

SEQ ID NO: 96621 - RNA, 64 nt, hsa
aauaacucuuccugcuauucagaauaaguaggagaaugaaaacugcagcauaucagacagcaau

SEQ ID NO: 96622 - RNA, 64 nt, hsa
uguaauaaacuauucuuugaaacuuguuggguagaaugaaaauuaaagccauaaugguagaaga

SEQ ID NO: 96623 - RNA, 64 nt, hsa
auaauaacauauuuauuuuuauacauuuauuucuaaugaaaaaaacuuuuaaauuauaucgcuu

SEQ ID NO: 96624 - RNA, 64 nt, hsa
acuuaucaaauacuuaguaucauggggguugggaaaugaaaaguaggagaaaagugagauuuua

SEQ ID NO: 96625 - RNA, 64 nt, hsa
gcauuugcacuuuuuuuagugacuaaaguugcuuaaugaaaacaugugcugaauguuguggauu

SEQ ID NO: 96626 - RNA, 64 nt, hsa
aaacaaaaaugcgcaucucuuucuuuguuugucaaaugaaaauuuuaacuggaauugucugaua

SEQ ID NO: 96627 - RNA, 64 nt, hsa
aucggagaacaugaaucaaaagugccucaagaggaaugaaaaaagcuuuacuggggcuggggaa

SEQ ID NO: 96628 - RNA, 64 nt, hsa
aagcaagaaucagagaaggaacauaccccuuacaaaugaaaaauuccacucaaaauagggacua

SEQ ID NO: 96629 - RNA, 64 nt, hsa
aacccacuuuaaaauaucuacauuaauauacuugaaugaaaauguccauuuacacguauuugaa

SEQ ID NO: 96630 - RNA, 64 nt, hsa
ugagaaugugccucucaguaucuuaaaauugguuaaugaaaaaucugaauuucuaaaacccuug

SEQ ID NO: 96631 - RNA, 64 nt, hsa
augaagcagaaugagaugauuuaauucuuaccgaaaugaaaauggcugaagaaacacagcaugc

SEQ ID NO: 96632 - RNA, 64 nt, hsa
accuucgcaguguggucucugggggcaaaaaacuaaugaaaacaaucucuguaauggcagauag

SEQ ID NO: 96633 - RNA, 64 nt, hsa
acuugaaauaguaauuuguuaaaagauaugacaaaaugaaaaugcuuaaacuacagaaauuuaa

SEQ ID NO: 96634 - RNA, 64 nt, hsa
uuaugucccuuaguucuuuauuaccuuacauaaaaaugaaaauugcggcaggaugcaugucugu

SEQ ID NO: 96635 - RNA, 64 nt, hsa
uguuaagagcauuguuuccauuaaaaucaauaacaaugaaaaacgguuguuugcuuugugauaa

SEQ ID NO: 96636 - RNA, 64 nt, hsa
cagcaguugugcuccuggacauucauuccagagaaaugaaaaccuauauuguacuuguacucaa

SEQ ID NO: 96637 - RNA, 64 nt, hsa
aacaaaccauccauaacuuggaauacugcucuggaaugaaaaggaacuaacuguugauacaaga

SEQ ID NO: 96638 - RNA, 64 nt, hsa
caccaucugaaaauucacaaaacuucuugcuucaaaugaaaaaaucccaacuauugagcauguu

SEQ ID NO: 96639 - RNA, 64 nt, hsa
gaaauaagcugcuaaucagauuuuaccuuggagaaaugaaaauuauuucuuggggaugccuuuu

SEQ ID NO: 96640 - RNA, 64 nt, hsa
uuccuaagaucauuuuuauccuaggugauuuuuaaaugaaaauguguaaucuaaaauauaccag

SEQ ID NO: 96641 - RNA, 64 nt, hsa
uuauuaaagcaaaaauaaauaaaaguaaaaugcaaaugaaaacaagggagggaaaguuguauua

SEQ ID NO: 96642 - RNA, 64 nt, hsa
cuaaaggcuuuucuacucugagaucucaaugcgaaaugaaaacucaggcaguuuaguccauagu

SEQ ID NO: 96643 - RNA, 64 nt, hsa
cuuuucucacuguagacagauuuuuuccuucuucaaugaaaaggcuuuuaaauuaguacaacug

SEQ ID NO: 96644 - RNA, 64 nt, hsa
aauuauagaucauaauaggaagcaaaaagaaaaaaaugaaaagcaaacauaugcacgcacuuuu

SEQ ID NO: 96645 - RNA, 64 nt, hsa
aaggcaaaugacugaacaguucccucaggacucacguacugaucucccaaaagaagagaggguc

SEQ ID NO: 96646 - RNA, 64 nt, hsa
ugacaacuggauuuaaaaguacaguacagauagucguacugaucaugagagacuggcugauacu

SEQ ID NO: 96647 - RNA, 64 nt, hsa
caucccccauccccugacaaaaagugacggcagccguacugagucuguaaggcccaaagugggu

SEQ ID NO: 96648 - RNA, 64 nt, hsa
agagagccaaacaggcuguuuauggcucuagcugcguacugacuauaaaauagaugcuggacuc

SEQ ID NO: 96649 - RNA, 64 nt, hsa
ucugaucuuuaauaucugauauuuuccugguacucguacugauaagggauuauuggaagucagu

SEQ ID NO: 96650 - RNA, 64 nt, hsa
guuuaccuacuuguucaucaccauuauugaaagccguacugaucaguuaguugacaacgggcau

SEQ ID NO: 96651 - RNA, 64 nt, hsa
ccaguaaauugcagauucucagaauguuuauugacguacugauuauucauucuguuauacucua

SEQ ID NO: 96652 - RNA, 64 nt, hsa
ccaguaaacugcagauucucagaauguuuauugacguacugauuauucauucuguuauacucua

SEQ ID NO: 96653 - RNA, 64 nt, hsa
ugcuguguccacgcgcuaaggcgacccccucccccguacugacuucuccuauaagcgcuucucu

SEQ ID NO: 96654 - RNA, 64 nt, hsa
aaagcaguuaaacagcaggaaagcccauuaacuucguacugaaaaagcaacauacugugaugau

SEQ ID NO: 96655 - RNA, 64 nt, hsa
gaacaccugcaacugcaaauguuuuuugauccgacguacugaaauaggaagucaugcucuuccc

SEQ ID NO: 96656 - RNA, 64 nt, hsa
auaaaugcucuagaguuaacauguaaaauauauacguacugagguuuguaaacuguccuuuuua

SEQ ID NO: 96657 - RNA, 64 nt, hsa
cgcgucuggcggcugcugucguuguguucuaccccguacugacccaacaccacaagggcuuucu

SEQ ID NO: 96658 - RNA, 64 nt, hsa
auaaaacucagccagucucauucuauaucccaaacguacugaaugaaacugauuuugguuccac

SEQ ID NO: 96659 - RNA, 64 nt, hsa
gaaaauggggcuaugccuggcuuaggggcaaccucguacugagaggaggugauaccggguccua

SEQ ID NO: 96660 - RNA, 64 nt, hsa
cuuuuggugcagugggugccuguaacucauuagacguacugaggcagcacuucugcagggugca

SEQ ID NO: 96661 - RNA, 64 nt, hsa
auacaaccagaggucucaucucugaacuuucuugcguacugauuacaugagucuuuggagucgg

SEQ ID NO: 96662 - RNA, 64 nt, hsa
caaccugcauuuguaugugucccgaauccacagucguacugauucuaauggggacacagaucau

SEQ ID NO: 96663 - RNA, 64 nt, hsa
gagaugaagcgcugauccuguagucaccuauuuucguacugaaacaucgucuuuacccacuucu

SEQ ID NO: 96664 - RNA, 64 nt, hsa
acccucugccguugccucucucagaaaaacaagacguacugaaugaaauauuuuacuaagcguu

SEQ ID NO: 96665 - RNA, 64 nt, hsa
augcccauuaguuuuauauaacauuuauuugacacguacugacuucuaucugagaagaacaaac

SEQ ID NO: 96666 - RNA, 64 nt, hsa
gggguauucuggcaggaugaaucgcaggauggcgcguacugaagccacgauguucauccaggcc

SEQ ID NO: 96667 - RNA, 63 nt, hsa
guguaaagccaacucgaggggaaucugaauaagcuuccaaaauuuuuuuuuuuaagaaauaaa

SEQ ID NO: 96668 - RNA, 63 nt, hsa
aggccacuacuuuauacuuucucucuucuguaacuuccaaagcaucccucucaguucucaugc

SEQ ID NO: 96669 - RNA, 63 nt, hsa
uuuuauuugcaacauuuacaguccuucaaaauccuuccaaagaauucuuauacacauuggggc

SEQ ID NO: 96670 - RNA, 63 nt, hsa
auuacuugauuaagauuuuacaaaagaggagcacuuccaaaauucuuauuuuuccuaacaaaa

SEQ ID NO: 96671 - RNA, 63 nt, hsa
cuugagccuuuaauggacuuauuucuucaaauccuuccaaaaauuauuauaagcauugaaauu

SEQ ID NO: 96672 - RNA, 63 nt, hsa
uaugagcuugcuguauuucuugguaucauguugcuuccaaauuuuguuuuuacuguagaagac

SEQ ID NO: 96673 - RNA, 63 nt, hsa
ugaucagguaccugcuuucauuuuagacugcuacuuccaaacuaagcuagauucuugguuuua

SEQ ID NO: 96674 - RNA, 63 nt, hsa
ugacuguuaucccgguuccaagccuagaggauccuuccaaaccagguaagaagucuguggcca

SEQ ID NO: 96675 - RNA, 63 nt, hsa
ugacuauuaucccgguuccaagacgagaggauacuuccaaacaagguaagaagucuguggcca

SEQ ID NO: 96676 - RNA, 63 nt, hsa
gcaagaagaggacaguggaccagcuccugggaccuuccaaaacauuggcuuugacaucugcca

SEQ ID NO: 96677 - RNA, 63 nt, hsa
auacaaguaucuaucuggacuucccugcuagcacuuccaaacaagcucagagauguuccuccc

SEQ ID NO: 96678 - RNA, 63 nt, hsa
caagcagcuggucagucuuugcucaguguccagcuuccaaagccuagacaaccuuucuguagc

SEQ ID NO: 96679 - RNA, 63 nt, hsa
uugcuuagaacguuaaacuauuagaguauuucccuuccaaagagggauguuuggaaaaaacuc

SEQ ID NO: 96680 - RNA, 63 nt, hsa
gagccuuaggauccaaugaguggagaauggggacuuccaaaacccaagguuggcuauaaucuc

SEQ ID NO: 96681 - RNA, 63 nt, hsa
ucaccauuccucaaaccuguaaguuucucacuucuuccaaauuggcuuuggcucuuucugcaa

SEQ ID NO: 96682 - RNA, 63 nt, hsa
aucugccacaggccauauuuguggcccgugcagcuuccaaaucucauacacaacuguucccga

SEQ ID NO: 96683 - RNA, 63 nt, hsa
aguccuucucuuuagggcucuuacaaucuaucacuuccaaaaaguaaauggugacugauaaaa

SEQ ID NO: 96684 - RNA, 63 nt, hsa
ggggcuugggggucaacuccccccaggacuuaccuuccaaaacaaacuuucuucacuuuguau

SEQ ID NO: 96685 - RNA, 63 nt, hsa
uuuccccuaaucguggggguuggaccccagagucuuccaaagaauuuucacugguugccugca

SEQ ID NO: 96686 - RNA, 63 nt, hsa
acgacccgucagagccgacggaggaggaggagccuuccaaacagagaggugaguggggagcug

SEQ ID NO: 96687 - RNA, 63 nt, hsa
aucucauggccaaagucagagcgaugcuugcagcuuccaaaaaccugcaaaccagcgcuuccu

SEQ ID NO: 96688 - RNA, 63 nt, hsa
ugccauuuaaaaaguuguagcagauuguuuccucuuccaaaguaaaauugcugugcuuuaugg

SEQ ID NO: 96689 - RNA, 63 nt, hsa
caugaacacccuuagaaaauguguccuaucuaucuuccaaaugcaauuugauugacugcccau

SEQ ID NO: 96690 - RNA, 63 nt, hsa
uuauuacauugacuucucccaagaugaaucuuccuuccaaauguguuuucuccacacaagccu

SEQ ID NO: 96691 - RNA, 63 nt, hsa
caucugguucugaaaaaguauagcauguagcagcuuccaaacauauucauauugcuuaagagg

SEQ ID NO: 96692 - RNA, 63 nt, hsa
acagcccuggcagcccauggcaacucaaagugccuuccaaaccaaacugccccucaugagguu

SEQ ID NO: 96693 - RNA, 63 nt, hsa
aagacagaaacugauguuccaugcaugucccugcuuccaaagccugaccuuccaaagcuugcu

SEQ ID NO: 96694 - RNA, 63 nt, hsa
guuccaugcaugucccugcuuccaaagccugaccuuccaaagcuugcuuccuuccuccuggcu

SEQ ID NO: 96695 - RNA, 63 nt, hsa
gccgugcccgaugugcaccucccagaagugcagcuuccaaaagucccagagaugaagcucccu

SEQ ID NO: 96696 - RNA, 63 nt, hsa
aaagugccagagaugaaagucccugagaugaagcuuccaaaggugccugagaugaaacuuccu

SEQ ID NO: 96697 - RNA, 63 nt, hsa
gaagugaagcuccccaaggcuccugaggucaagcuuccaaaagugcccgaggcagcccuucca

SEQ ID NO: 96698 - RNA, 63 nt, hsa
gggauuuuuuuuuugguugaccacucccccacacuuccaaaauuaaacaguguuuucuuagca

SEQ ID NO: 96699 - RNA, 63 nt, hsa
ucauuaggucaguuaagggaaauauuuguaccacuuccaaacuuuucagcguuggauaaaaug

SEQ ID NO: 96700 - RNA, 63 nt, hsa
uguguguuuccaacaucaugguagcagcacacacuuccaaagcucagccagggacacuuaaua

SEQ ID NO: 96701 - RNA, 63 nt, hsa
aaagaaaacuguuuuuagaaauacauaaaaucacuuccaaauccuguugcuuauguuggguua

SEQ ID NO: 96702 - RNA, 64 nt, hsa
ugucuccuuuuccaggcucagcagcgugcugauggaaguggaagugccugaagucuuacaggac

SEQ ID NO: 96703 - RNA, 64 nt, hsa
gucugaacuuauugcagaaauugaaaaguaccaagaaguggaagaagaccaagacccaucaugc

SEQ ID NO: 96704 - RNA, 64 nt, hsa
gcauucaauaaaauuggggugccuaaugcuacuggaaguggaacuugagauagggccuaauuug

SEQ ID NO: 96705 - RNA, 64 nt, hsa
uuucaggaaauauaauuugagaauacuuuaaagggaaguggaaguauaagugaaugauauuuuu

SEQ ID NO: 96706 - RNA, 64 nt, hsa
agccuaauguuacuuugaaguggauuugcauauugaaguggagauuccauaauuaugucagugu

SEQ ID NO: 96707 - RNA, 59 nt, hsa
aaccauuauuacaagccuaauguuacuuugaaguggauuugcauauugaaguggagauu

SEQ ID NO: 96708 - RNA, 64 nt, hsa
cagacugaaaccuuuauaggaguuaugcaguucagaaguggacuuuagguaagucauuuauuuu

SEQ ID NO: 96709 - RNA, 64 nt, hsa
gguuuucucaaaggcccaaggauucaagcaaagggaaguggaaucuuguggugaacaguaccuu

SEQ ID NO: 96710 - RNA, 64 nt, hsa
gaacuuucagcccagcguuucugcaaugcagagugaaguggauacugggcaguucgagacaggu

SEQ ID NO: 96711 - RNA, 64 nt, hsa
ccaucaauugauggggaaggcuggcacccaccaagaaguggaaguccucagaaauucucggcac

SEQ ID NO: 96712 - RNA, 64 nt, hsa
gaacuuucuuauuuugcuacugagucacacaagggaaguggaaggaagaacaguuaauuuaaga

SEQ ID NO: 96713 - RNA, 64 nt, hsa
aggcagacagagaugaaaagacagucaaaggacggaaguggaaggacgggagugagcuggggag

SEQ ID NO: 96714 - RNA, 64 nt, hsa
cuuggacaacccagcagggaguuccggggaguccgaaguggagaaaggcuggugggaacaugga

SEQ ID NO: 96715 - RNA, 64 nt, hsa
agaauuguguucgggaggugggggaucugagaccgaaguggacagugguuaagauuguggggcc

SEQ ID NO: 96716 - RNA, 64 nt, hsa
ugauggcagcaguuauacuacguauaugaaagaggaaguggauagguaaguggcuguuugaggu

SEQ ID NO: 96717 - RNA, 64 nt, hsa
uguauccucagacuuugaaauacucgugggauaugaaguggaggugccuagaggguugaagaua

SEQ ID NO: 96718 - RNA, 64 nt, hsa
aguucggggucgacucuaccccuggggcaucguggaaguggaaaacccagggcacugcgacuuu

SEQ ID NO: 96719 - RNA, 64 nt, hsa
uauccuggcuaaggcagacacacugacaccucccgaaguggaccacaagaaacgcaaagugagg

SEQ ID NO: 96720 - RNA, 64 nt, hsa
uaucagauggugagaaaacagaaaaaugagaucagaaguggagauguuggggccaggcacagug

SEQ ID NO: 96721 - RNA, 64 nt, hsa
cuugguucauggagacccuguuuuuuuaaaaaaagaaguggagguguuuacaccagcaaaauac

SEQ ID NO: 96722 - RNA, 64 nt, hsa
auaguaguuuauacuuuugcuuaacucuguuaugucucuuaagcagguuugguuuuuauuaaaa

SEQ ID NO: 96723 - RNA, 64 nt, hsa
acauuaaccuagaaaacuacauagguuauuuugaucucuuaagauuaauguagcagaaauuucu

SEQ ID NO: 96724 - RNA, 64 nt, hsa
guuuugaauugggcuuucugcccuuguugaguuuucucuuaaguaaaguccaaaguccaagggg

SEQ ID NO: 96725 - RNA, 64 nt, hsa
auuagguuuacuucuugucucuccaaguggcuccucucuuaaaagacagaaacuaggguuuagu

SEQ ID NO: 96726 - RNA, 64 nt, hsa
ucuaccuuuacuaucuacuaugccuacuucaccaucucuuaaggacucggcauuuguccacagu

SEQ ID NO: 96727 - RNA, 64 nt, hsa
ugaaaagaucaagaaacgugugaaaacucccuauucucuuaagcgguggcgccccuccaccugg

SEQ ID NO: 96728 - RNA, 64 nt, hsa
cacauacugaaugcugaaguauacauaugcuauuucucuuaaaccucagagcaaccauaugagc

SEQ ID NO: 96729 - RNA, 64 nt, hsa
cgcgcugcgccaccugcacucaccccccucacauucucuuaagcacccgguggcccuccgaggc

SEQ ID NO: 96730 - RNA, 64 nt, hsa
gauuacaggcgugagccaccgcgcccggccugauucucuuaaaauugaagaggugcugccaagg

SEQ ID NO: 96731 - RNA, 64 nt, hsa
aagaguauuuucaguaauaaacgugccaucucuaucucuuaaacauuuauuacaacaauuguuu

SEQ ID NO: 96732 - RNA, 64 nt, hsa
cuguggcggcagugguggguaagcacuccaguguucucuuaaugaggcacuuugccugucacuc

SEQ ID NO: 96733 - RNA, 64 nt, hsa
ccuguuucucuuaaaauaaaauccauuuccuauuucucuuaaaauaaaauccauuauucuuaau

SEQ ID NO: 96734 - RNA, 64 nt, hsa
aaaaugugauuaugcuuaacagcuguuuccuguuucucuuaaaauaaaauccauuuccuauuuc

SEQ ID NO: 96735 - RNA, 64 nt, hsa
cuuuuuguguaccucuacagagaccaaaacucauucucuuaaagagauuuuauggggcuacugc

SEQ ID NO: 96736 - RNA, 64 nt, hsa
auuggauggacuuguuugguacuugggauuuuccucucuuaaccgucaacaucaguguuguaaa

SEQ ID NO: 96737 - RNA, 64 nt, hsa
uuauuguuuucagauuucaacuuguauguguuugucucuuaaagcauuggugaaaucacauauu

SEQ ID NO: 96738 - RNA, 64 nt, hsa
aauggaguguuuguucccugccauuuuucacaccucucuuaauuuuaguucuguuuaguugaga

SEQ ID NO: 96739 - RNA, 64 nt, hsa
acuuuaugaacacaggugucugagcuagaauuauucucuuaaaagacaacauaacuuuuuaugu

SEQ ID NO: 96740 - RNA, 64 nt, hsa
cugucaaaaagaaguaaccucagcacuacuauucucucuuaaaagauaagcuauuuaaccccaa

SEQ ID NO: 96741 - RNA, 64 nt, hsa
uuuuuaagaguaagccaugaaaucuuguaacaugucucuuaacuauuuauaaugaaaaguggca

SEQ ID NO: 96742 - RNA, 64 nt, hsa
aucacagguugucucaagcacaaccaacugaaugucucuuaacuguggggaccaaaagggagag

SEQ ID NO: 96743 - RNA, 64 nt, hsa
cccugcgggccaggcacugcccuuuucaggaagcucucuuaaaauacccauugccccagaccug

SEQ ID NO: 96744 - RNA, 64 nt, hsa
gguggaaggaugggauggguuccagagguauuccucucuuaaaugcaagugccuagauuaggua

SEQ ID NO: 96745 - RNA, 64 nt, hsa
aauacaguauucacucuagaaacaauuaucuuuuucucuuaaugauuuugugugcaucuuuaau

SEQ ID NO: 96746 - RNA, 64 nt, hsa
uuuuagacguuuuuuuccuccaaggugguuuucuucucuuaaauaacucgaucuguacccagcu

SEQ ID NO: 96747 - RNA, 64 nt, hsa
ggugggguucuuguugcuuuuuucucuuuuuuccucucuuaaaaaauguacuugcacaaggaag

SEQ ID NO: 96748 - RNA, 64 nt, hsa
gaaaucuccugcucugauauaguuauguaacugaucucuuaaucuguagcauagaaguauuuug

SEQ ID NO: 96749 - RNA, 64 nt, hsa
aauaacagauaaguccauugguggacagccuucuucucuuaaucacaagauuauuuucagaauu

SEQ ID NO: 96750 - RNA, 64 nt, hsa
augauauaucagcuuuugccuuucaauuuaucaaucucuuaaagagaauccaacuuuauuacga

SEQ ID NO: 96751 - RNA, 64 nt, hsa
acuaaauauuuuaaggcaaguccauaggucugaaucucuuaagaauucucggccucugugggau

SEQ ID NO: 96752 - RNA, 64 nt, hsa
acuuccagcaaaauccaaacugcugucucuuaaaucucuuaaacucucuucuuccauuagaaug

SEQ ID NO: 96753 - RNA, 64 nt, hsa
aaaauccuuacuuccagcaaaauccaaacugcugucucuuaaaucucuuaaacucucuucuucc

SEQ ID NO: 96754 - RNA, 64 nt, hsa
gggguacccccagcagccucucgaaaauugcacuucucuuaaaacuguaacuggccuuucucuu

SEQ ID NO: 96755 - RNA, 64 nt, hsa
aagguauccaguggauuuuucuucucugucuuccucucuuaaauuucaacaucucucuucuugg

SEQ ID NO: 96756 - RNA, 64 nt, hsa
cucgaaggaaacuuuuaaucucugcaguuuauucucucuuaaggaauaaacacucccacuguuu

SEQ ID NO: 96757 - RNA, 64 nt, hsa
uuaaguccaguguuugagccaagguugccaccugucucuuaacaucucacugaacauaaguccu

SEQ ID NO: 96758 - RNA, 64 nt, hsa
aaaacuaggacugugugguguaaauaacuacaauucucuuaacuccguagcaguugccaacuca

SEQ ID NO: 96759 - RNA, 64 nt, hsa
uccaucagaauccacucuucuagggauaugaaaaucucuuaacacccacccuacauacacagac

SEQ ID NO: 96760 - RNA, 64 nt, hsa
cuggccaacuaguuguuaaaagcuaacagcucaaucucuuaaaacacuuuucaaaauauguggg

SEQ ID NO: 96761 - RNA, 64 nt, hsa
ugcuaacauguaguuggggcaccuauaauuggguucucuuaauaaccuuucuuugcaguuaaga

SEQ ID NO: 96762 - RNA, 64 nt, hsa
ggcuucucucuuugauguuaccuguuagugcugaucucuuaaagcagacauuucuuguuuguug

SEQ ID NO: 96763 - RNA, 64 nt, hsa
auuuuuuguguggagucuauguugcccaggcuggucucuuaacuccuaggcucaagugauccuc

SEQ ID NO: 96764 - RNA, 64 nt, hsa
ucaguaaaucccuuuaaauaguguuccuaagauaucucuuaaauccucccauaggaaauagaau

SEQ ID NO: 96765 - RNA, 64 nt, hsa
cuacucacccaguaagucucuuaaaauuuaucauucucuuaaaguaucacucuaaaauuuguca

SEQ ID NO: 96766 - RNA, 64 nt, hsa
uuuaaauauuugauaaaacuacucacccaguaagucucuuaaaauuuaucauucucuuaaagua

SEQ ID NO: 96767 - RNA, 64 nt, hsa
uuuaauagguaaucaaggcaauucaguaucucccucucuuaaagucuguuuuuagacuucaugg

SEQ ID NO: 96768 - RNA, 64 nt, hsa
uuugugucacuuuuuucugccuugcuagccaaaaucucuuaaauacacguaggugggccagaga

SEQ ID NO: 96769 - RNA, 64 nt, hsa
caccccccagccuuagaugccucgcucuuuucaaucucuuaaucuaaaugcuuuuuaaagagau

SEQ ID NO: 96770 - RNA, 64 nt, hsa
ugaauuucucaaauguuugagauguucaagacagucucuuaauccguuaaugcuuuuggaaaca

SEQ ID NO: 96771 - RNA, 64 nt, hsa
caaauacucuaaaaugauaaaauugagguacaacucucuuaaaagaguauggauaacuauauuu

SEQ ID NO: 96772 - RNA, 64 nt, hsa
uuguagagccaugacucugugaagaugaauguugucucuuaacuuggacagggaaauggucuaa

SEQ ID NO: 96773 - RNA, 64 nt, hsa
uucacaauaaauguucauuaaaauaccaaaugauucucuuaagcauuuaccauuauuguaagua

SEQ ID NO: 96774 - RNA, 64 nt, hsa
ugcuucaggugucuagggguauccucugcaacacuugcagaacaaaggucaauaagauccuugc

SEQ ID NO: 96775 - RNA, 64 nt, hsa
auccaguuguacuuaaguguguaacaggaauauuuugcagaauauagguuuaacugaaugaagc

SEQ ID NO: 96776 - RNA, 64 nt, hsa
gcaguucauuccaaauccagcacugcuguuuaccuugcagaaggaggcacugcuacaaccaugg

SEQ ID NO: 96777 - RNA, 64 nt, hsa
aaaucauuucacuucacuccuaacauuucuuacauugcagaacuaaugguaaaguaaauuuuac

SEQ ID NO: 96778 - RNA, 64 nt, hsa
aagaugcagcaaggagaggaugcagaacagcuucuugcagaagcaccugcuccggcauccagcg

SEQ ID NO: 96779 - RNA, 64 nt, hsa
ugcucccagcagaggcugugcgugucaguucuucuugcagaaugugcucugguggaacaaguug

SEQ ID NO: 96780 - RNA, 64 nt, hsa
cuauucuguaauuaaaauauaaccugaauucagcuugcagaauggaagcugaaucuguucauug

SEQ ID NO: 96781 - RNA, 64 nt, hsa
auuguauucuauugauugucaauuuaauuagcuguugcagaauaaguaauauauuuuaaaaacc

SEQ ID NO: 96782 - RNA, 64 nt, hsa
uacguccuugauuaaaucaccccaauaugccccuuugcagaaaguauuggcuuuucccugaauu

SEQ ID NO: 96783 - RNA, 64 nt, hsa
uaugguaaaaaaaaucuugggauugagagucuucuugcagaaacuucucagccaaaguaaaaag

SEQ ID NO: 96784 - RNA, 64 nt, hsa
agcuuuggaaaaaaaacuacuguauguaacggaauugcagaauaugcugcacauguauuuuauu

SEQ ID NO: 96785 - RNA, 64 nt, hsa
uuagauuuuacauaucuuugcagguaucacagccuugcagaagaaccaacugaaaaaaaaauuc

SEQ ID NO: 96786 - RNA, 64 nt, hsa
gcugugaaagucguucucugucuuuaaaaaucaauugcagaaguucauuugucauuuuucuaga

SEQ ID NO: 96787 - RNA, 64 nt, hsa
acuaaagucuuaaacaucuaagacucaguuguaguugcagaaaaaaauuaaagucaccucuacu

SEQ ID NO: 96788 - RNA, 64 nt, hsa
uaagacuggauugauuguggacuuuuauacuauauugcagaaaccaauaucuguuucuuggugg

SEQ ID NO: 96789 - RNA, 64 nt, hsa
uucaauucuaauaaauaaugcugauguucaacaguugcagaaauugugcuauuauguaacugug

SEQ ID NO: 96790 - RNA, 64 nt, hsa
gacugcuguuuggucaaagaauaccuucuuagcauugcagaaagguggucagaugaccagugua

SEQ ID NO: 96791 - RNA, 64 nt, hsa
uuuaccuaauaguuucuuaauauuucagugccccuugcagaaaaaauauuacaugcuaaauaaa

SEQ ID NO: 96792 - RNA, 64 nt, hsa
ugcuguguuuugaaagucuuuaacuaaauuaagauugcagaaugauagugauuauucaauuaga

SEQ ID NO: 96793 - RNA, 64 nt, hsa
gacuuauuguaagauguuggcugaaagcaugaacuugcagaacucccucggagacgcagguugc

SEQ ID NO: 96794 - RNA, 64 nt, hsa
acaauuagaauuauuuuagaaauaguaggaaguauugcagaagucaauacacaaaugugccagg

SEQ ID NO: 96795 - RNA, 64 nt, hsa
cuuagggaaggagagaccuuauuccaaagcacgauugcagaaggggaaagggaauauugcaaaa

SEQ ID NO: 96796 - RNA, 64 nt, hsa
caaggccagcaagccccucaggccagcacuucgcuugcagaagccauccauucacuccuggggu

SEQ ID NO: 96797 - RNA, 64 nt, hsa
augguucauggccucucuucccacugcaggaagauugcagaaggcuguggauuaauuguagcau

SEQ ID NO: 96798 - RNA, 64 nt, hsa
uuuuaguaaaggagcugagaagcuagcauuagguuugcagaaacuauuuaaguuucaacucuga

SEQ ID NO: 96799 - RNA, 64 nt, hsa
gaauacuuuggcugcuaaggaaacuuccucuccauugcagaauagcugagccaagugagugagu

SEQ ID NO: 96800 - RNA, 64 nt, hsa
uccauugcagaauagcugagccaagugagugaguuugcagaaagcagguggugagcuccugccu

SEQ ID NO: 96801 - RNA, 64 nt, hsa
uuuuuuuuuuuugguaugaaauugucuuucuccauugcagaaauaagcuagggaaacacuaacc

SEQ ID NO: 96802 - RNA, 64 nt, hsa
gaaaaauguauucagugggcuuuaaaauuuccauuugcagaauuuggucucucaggcuguuugg

SEQ ID NO: 96803 - RNA, 64 nt, hsa
ggugauagaaaacucgccuacuccacugcagaacuugcagaaugcgugguguuaaucuacagag

SEQ ID NO: 96804 - RNA, 64 nt, hsa
aagaugaagccauguugcauccacauguucccguuugcagaaaccucacaggacaguacgaaua

SEQ ID NO: 96805 - RNA, 64 nt, hsa
cuggagagccacaagcaggaagagcagcgcuguguugcagaauggaguuuccauggauuucuac

SEQ ID NO: 96806 - RNA, 64 nt, hsa
uaauuuaaauuauuacuacacuuuauuacuacacuugcagaaaagaaacauguuaaaaucaugg

SEQ ID NO: 96807 - RNA, 64 nt, hsa
auacacacacacacacacacucugacugucuuuauugcagaagacaguguguugccuuacccag

SEQ ID NO: 96808 - RNA, 64 nt, hsa
acacacacacacacacacacacacacagucuuuauugcagaagacaguguguugccuuaccaga

SEQ ID NO: 96809 - RNA, 64 nt, hsa
acauacacacacauacacacacacagagucuuuauugcagaagacaguguguugccuuauaggc

SEQ ID NO: 96810 - RNA, 64 nt, hsa
uguaaaaccugcccaggaacuuacagaauuuacuuugcagaagcguuaucauacuccauuuaca

SEQ ID NO: 96811 - RNA, 64 nt, hsa
aaauuuaccuagaugucuauuuaugggauuacuuuugcagaaucauaauuuagcaaccauuuau

SEQ ID NO: 96812 - RNA, 64 nt, hsa
ugaaaugaaguacccuuuuguaaauagcauuuuuuugcagaaggugaaaauuccacucucuacc

SEQ ID NO: 96813 - RNA, 64 nt, hsa
ugucugcaagauaaauuagaucgcccugugggguuugcagaauuagugaaggguccaggacgau

SEQ ID NO: 96814 - RNA, 64 nt, hsa
gccccuuucagagauuagaaacuggguuagaggauugcagaagacgaguggggggagggcaggg

SEQ ID NO: 96815 - RNA, 64 nt, hsa
ccucugcauggguuggauuuuccaaaaucauaauuugcagaaggaaggccagcauuuacgaugc

SEQ ID NO: 96816 - RNA, 64 nt, hsa
aaaucuuuuuuuuguuguuuuuaaaaaauucauuuugcagaaagccugaaagaaaaaaaauacc

SEQ ID NO: 96817 - RNA, 64 nt, hsa
uccauugaagacccuauuuugggugaucccuaucuugcagaaugucuguaggaauaagcauaua

SEQ ID NO: 96818 - RNA, 64 nt, hsa
gcaucaaucuguguucagguccaggguuacauaauugcagaagcacaagccauacaucgcaggu

SEQ ID NO: 96819 - RNA, 64 nt, hsa
caguauauuuuguaaauauaaguacuaguccuaauugcagaaagagcgucaguuucaccucccc

SEQ ID NO: 96820 - RNA, 64 nt, hsa
uucgauuuacuuccuaauuauaaaagcugcuuuuuugcagaacauuccuugaaaauauaagguu

SEQ ID NO: 96821 - RNA, 64 nt, hsa
accuccaggaacugucauggauguccaaauggcuuugcagaaaggaaaugagaugacaguauuu

SEQ ID NO: 96822 - RNA, 64 nt, hsa
aguuacauguaugccugcccaguucccuuuuuauuugcagaagcugugaguuuuguucacaauu

SEQ ID NO: 96823 - RNA, 64 nt, hsa
gguuuuuauuugauuuuaguugugugcuuuucauuugcagaaguuaguaacugcagcucaccua

SEQ ID NO: 96824 - RNA, 64 nt, hsa
acagaugcugcuuuggagaacuuuacaaccuggguugcagaacugagccuugguaaaccugucu

SEQ ID NO: 96825 - RNA, 64 nt, hsa
gcugcgggcugcccugugggcuggugcuucaggaggaauccagagaaguguucagaugcccccc

SEQ ID NO: 96826 - RNA, 64 nt, hsa
acauuugcaccuuaggagaggcagauguuaaaauggaauccaaagaccaccuagggcggggcug

SEQ ID NO: 96827 - RNA, 64 nt, hsa
cacccaucccagccccugggcagccgggcagaagggaauccaggcuauggaccucccaaguccc

SEQ ID NO: 96828 - RNA, 64 nt, hsa
ccuccacggaacgucucgccuugcgagcaagcucggaauccaguuccucaggaaccccuccaaa

SEQ ID NO: 96829 - RNA, 64 nt, hsa
ggaauuuccaguggccugacaaugaacuacugcaggaauccagaugccgauacaggcccuuggu

SEQ ID NO: 96830 - RNA, 64 nt, hsa
ggaauuugcaguggccugaccaggaacuacugcaggaauccagauucugggaaacaacccuggu

SEQ ID NO: 96831 - RNA, 64 nt, hsa
ggaauuuccagugacuugaucaugaacuacugcaggaauccagauccuguggaaggcccuuggu

SEQ ID NO: 96832 - RNA, 64 nt, hsa
ucucuuacauauaagagggcucuacuaucuccuuggaauccacauuuggguuaacuccucagau

SEQ ID NO: 96833 - RNA, 64 nt, hsa
aaacuuguagaaagcacauuauagagcuuauguuggaauccaucuuggaggauuuuuguuuuaa

SEQ ID NO: 96834 - RNA, 64 nt, hsa
uugugggucccugggaggccggcagccaggccacggaauccacacguggaccauuguggguccc

SEQ ID NO: 96835 - RNA, 64 nt, hsa
ugugggucccuugggaggccagcagccagacuacggaauccacauguggaccaugggaagucag

SEQ ID NO: 96836 - RNA, 64 nt, hsa
ucuacaccuuugggaugauaggguuguuagugacccacaggacaguauagauguuuguggaugu

SEQ ID NO: 96837 - RNA, 64 nt, hsa
auaggggaagaagccagaaccccaccuggccugcccacaggacaagaaguggguaagggcagga

SEQ ID NO: 96838 - RNA, 64 nt, hsa
ucacuugguaccauauagaucaaaagcuuuguaaccacaggaaaaaauaaacucuuccaucccu

SEQ ID NO: 96839 - RNA, 64 nt, hsa
ccgcuccacaagacaccugugacauccuccagggccacaggagcacgugcugaccaguuuuccc

SEQ ID NO: 96840 - RNA, 64 nt, hsa
guagcugccagcguagaaacccaugaaaaggaggccacaggagauuccugggagcacugggugu

SEQ ID NO: 96841 - RNA, 64 nt, hsa
acucaagggugugcauucauuuuaggugggaucgccacaggauuucauguuauuuuccuuacgg

SEQ ID NO: 96842 - RNA, 64 nt, hsa
gagcguguacuaccccaggaugcaugcagggcccccacaggagcguguacuaccccaggacgca

SEQ ID NO: 96843 - RNA, 64 nt, hsa
gagcguguacuaccccaggacgcaugcagggcccccacaggagcguguacuaccccaggaugca

SEQ ID NO: 96844 - RNA, 64 nt, hsa
uguccuauccccggaccggacgcaugcagggcccccacaggagcguguacuaccccaggacgca

SEQ ID NO: 96845 - RNA, 64 nt, hsa
gagcguguacuaccccaggacgcaugcagggcccccacaggagcguguccuauccccggaccgg

SEQ ID NO: 96846 - RNA, 64 nt, hsa
gagcguguacuaccccagaacgcaugcagggcccccacaggagcguguacuaccccaggacgca

SEQ ID NO: 96847 - RNA, 64 nt, hsa
gagcauguccuaucccuggacgcaugcagggcccccacaggagcguguacuaccccagaacgca

SEQ ID NO: 96848 - RNA, 64 nt, hsa
gagcguguccuauccccggacgcaugcagggcccccacaggagcauguccuaucccuggacgca

SEQ ID NO: 96849 - RNA, 64 nt, hsa
gagcguguccuauccccggacgcaugcagggcccccacaggagcguguccuauccccggacgca

SEQ ID NO: 96850 - RNA, 64 nt, hsa
ccccaccaagugacuuugguugacuugugggcucccacaggagucauggugauggaugauaucc

SEQ ID NO: 96851 - RNA, 64 nt, hsa
aggcaaaucuuacugcuuaauguauaaacucucaccacaggaagcaucgcuguuuccaauaaau

SEQ ID NO: 96852 - RNA, 64 nt, hsa
uacaauauuaggugaauauggaaguaaaggcauuccacaggaucaucauuuaaaaaaaaagaau

SEQ ID NO: 96853 - RNA, 64 nt, hsa
uaugguaucauguaucucucuguggugguucauuccacaggacgaaugcauauucaacacacug

SEQ ID NO: 96854 - RNA, 64 nt, hsa
cuucccuugugucucccuggaccugccugacaggccacaggagcagacagcacacccaagcccg

SEQ ID NO: 96855 - RNA, 64 nt, hsa
gggugcccggcgugagggaucaggcucgccagggccacaggacaggugaugaccuguggccacg

SEQ ID NO: 96856 - RNA, 64 nt, hsa
auuucccaaaaguaugcuccugggaacccuaguuccacaggauaauagguuuuucauaaagaaa

SEQ ID NO: 96857 - RNA, 64 nt, hsa
uucucucagccuuacacucacagaagccaacuuuccacaggacugaagacaaaguguuucauuu

SEQ ID NO: 96858 - RNA, 64 nt, hsa
ucccacagccagcucuuggcuccaagaugagcacccacaggaagccgacccaggccugaggggc

SEQ ID NO: 96859 - RNA, 64 nt, hsa
augagauucuugucugcccucauaucacgcugccccacaggaaugcugcugggaaaagcagggc

SEQ ID NO: 96860 - RNA, 64 nt, hsa
ggccagcagaucacugagagugcaaccccacccuccacaggaaauugccucaugggcagggcca

SEQ ID NO: 96861 - RNA, 64 nt, hsa
caaaaugaccaaagacugucagauuucuuagacuccacaggaccaaaccauagaacaauuucac

SEQ ID NO: 96862 - RNA, 64 nt, hsa
gaaccuggcugcgaacugugcaguuacguugcauccacaggauuccaguugcgugucuguuucc

SEQ ID NO: 96863 - RNA, 64 nt, hsa
uggcugugaaaauuacacccaugcacagaacaagccacaggaauaauaguucaggauuugguuu

SEQ ID NO: 96864 - RNA, 64 nt, hsa
cguggagacauggccuagggggccaggcccggcuccacaggagucuccuucaggacuggugugg

SEQ ID NO: 96865 - RNA, 64 nt, hsa
cauggcaggacagagcgggaggccgggccuugggccacaggagaccagcucagggcggaagguc

SEQ ID NO: 96866 - RNA, 64 nt, hsa
cacacaaaucagugaauggaucccaacaccccaaccacaggagcacggauucccuguaccucaa

SEQ ID NO: 96867 - RNA, 64 nt, hsa
cccacaccucagccacuggagacugaugauccaaccacaggaucccuacucuuuggccacgaga

SEQ ID NO: 96868 - RNA, 64 nt, hsa
gaaaaagaaaagaaagcaagaacagaaaacgaagccacaggaagggaaguagacauuguaugcu

SEQ ID NO: 96869 - RNA, 64 nt, hsa
aacucugagcuugugcccagaaauuaccccaagaccacaggaacccuucaagaagcucccauca

SEQ ID NO: 96870 - RNA, 64 nt, hsa
gagaagcuggccgggaccagccaggagcugggagccacaggaagcaaaagucagccuuuucuuc

SEQ ID NO: 96871 - RNA, 64 nt, hsa
cggguuccuugaaccccacaaaaucccucuccaaccacaggacccuucggcucaccaagaacag

SEQ ID NO: 96872 - RNA, 64 nt, hsa
ccugaacgcucccaaccugccucccgcccggaagccacaggacccacucaugugugugcccaca

SEQ ID NO: 96873 - RNA, 64 nt, hsa
agugagugggcuccccgcugucacugccagucacccacaggaagggacuggugaugggcugucu

SEQ ID NO: 96874 - RNA, 64 nt, hsa
ggcccugcuaggguggcaccagacuucucuggucccacaggacagccaguggccucccaacuug

SEQ ID NO: 96875 - RNA, 64 nt, hsa
cuccuuggucacccucugcuccaggccuucuccaccacaggaccucagcugucccuccuucuac

SEQ ID NO: 96876 - RNA, 64 nt, hsa
cacggacuccugcaucguggcacuccucucgcaugguguggagggcgccaucuaugguguggau

SEQ ID NO: 96877 - RNA, 64 nt, hsa
acuccucucgcaugguguggagggcgccaucuaugguguggaugggaaacugcuccaggugcgg

SEQ ID NO: 96878 - RNA, 64 nt, hsa
ugaaggcuacauuccaguagccgagcucgggccugguguggaauuccagauccgaauccgacug

SEQ ID NO: 96879 - RNA, 64 nt, hsa
ugcccuugcucagguucuuggaccccaggcagcugguguggagccccuuggccagggccauggg

SEQ ID NO: 96880 - RNA, 64 nt, hsa
uugaaacuaauguagagaugccugauuccaaacagguguggagaauauugaauggcucagaagc

SEQ ID NO: 96881 - RNA, 51 nt, hsa
gcuugucaguuggcaaaugaugguguggauaacgucagugugcaugccucu

SEQ ID NO: 96882 - RNA, 64 nt, hsa
acuaagccccgucugaccccagcccagacagcaagguguggaggcuccugugguaguccuccca

SEQ ID NO: 96883 - RNA, 64 nt, hsa
ggaguggggugguuauguuuccaugguuaccauggguguggauggcaguguggggagggcaggu

SEQ ID NO: 96884 - RNA, 64 nt, hsa
cgcugcugcuucugacuuugccucuguccugccugguguggagggcucugucuguugcugagga

SEQ ID NO: 96885 - RNA, 64 nt, hsa
cuugggcagaguaaaaggugccaggaggagcauggguguggaaguccugucagccaagaaauaa

SEQ ID NO: 96886 - RNA, 64 nt, hsa
cuuugaagacggagcugccccagcuguggcuggggguguggaggcagugggaugaacuggggga

SEQ ID NO: 96887 - RNA, 64 nt, hsa
gggccccauggcuuuggcuggccacugaggguaggguguggagguguggaggcccccugaggag

SEQ ID NO: 96888 - RNA, 64 nt, hsa
uggcuuuggcuggccacugaggguaggguguggagguguggaggcccccugaggagcugcggcg

SEQ ID NO: 96889 - RNA, 64 nt, hsa
uacuaagguuuacacaggaauuccaccugaagacuuguguuaaaguucuacagcgcgcacuguu

SEQ ID NO: 96890 - RNA, 64 nt, hsa
acagcaauaaaguacaguaauuuuacuuuuuuucuuguguuacaucuaaauuacaacccuuaau

SEQ ID NO: 96891 - RNA, 64 nt, hsa
ccuacaccguggugagcauacagaguguccugauuuguguuaagugacugagaagauguuaauu

SEQ ID NO: 96892 - RNA, 64 nt, hsa
gcaaaaaagaacaguguugaaauuggaaaggacuuuguguuauuuagguuguuagaaugagccu

SEQ ID NO: 96893 - RNA, 64 nt, hsa
uuguuaguaaaaugugcacaccugacuugcaauguuguguuaaacuagaauuauauucacuugg

SEQ ID NO: 96894 - RNA, 64 nt, hsa
augucaggauuuagagaaggagccuaaacugaauuuguguuauuucaguaaaaguuauggaguu

SEQ ID NO: 96895 - RNA, 64 nt, hsa
aaagguccuaaaaggaauuguuaggcggcaggcuuuguguuacguguuacauggagugagggua

SEQ ID NO: 96896 - RNA, 64 nt, hsa
auuuccuugguuuuuuaaaggugauaauuuugcuuuguguuacuuuuuugcucuugaauguauc

SEQ ID NO: 96897 - RNA, 64 nt, hsa
ggguugaacuuacuugaauggauuaaaaauugcauuguguuacagagcuagaaaauuuuaugua

SEQ ID NO: 96898 - RNA, 64 nt, hsa
uugaagaacagacugaccaaagcucaccuguuuuuuguguuaggugcuuuggcugaacuugauu

SEQ ID NO: 96899 - RNA, 64 nt, hsa
acuucaaacuguguacuguguaguucuauauaguuuguguuaagcaugucauucauauaaacug

SEQ ID NO: 96900 - RNA, 64 nt, hsa
cucugaagauggacucggccccacauacacauuuuuguguuacagucauugauggacucuauuu

SEQ ID NO: 96901 - RNA, 64 nt, hsa
uuaauuacauaaauuaaaccuuaccaugaccaaauuguguuaggacggccugcuaucuacagca

SEQ ID NO: 96902 - RNA, 64 nt, hsa
uuaguauaucuugucgaucuuuaaguuguuacuauuguguuauucaugucuuuaaaucagauac

SEQ ID NO: 96903 - RNA, 64 nt, hsa
cucaccucuacucuguauuuucuacaguugguucuuguguuauaaauguugugagcaacagauu

SEQ ID NO: 96904 - RNA, 64 nt, hsa
caacguuuuaucuuuaugcaguacagugggcuuauuguguuaacacuucagaaagauucaaacu

SEQ ID NO: 96905 - RNA, 64 nt, hsa
gaugcuauguuauguauaacuuuucuaauaaaaguuguguuauaagcuguacuuuuuugaguau

SEQ ID NO: 96906 - RNA, 64 nt, hsa
uguaauuccauaaugagcagagguguacgcgaaauuguguuaugacugauagccuucagcuaca

SEQ ID NO: 96907 - RNA, 64 nt, hsa
aucacuggcuuucucaagaguauggauugacauauuguguuaugaaugcacaucucucagaugu

SEQ ID NO: 96908 - RNA, 64 nt, hsa
auugacucuguuccuaacaaugcaguauucucaauuguguuacugaaaaugcaacauuagcaaa

SEQ ID NO: 96909 - RNA, 64 nt, hsa
aauauuugucuaguacaaugcuugacauacagcauuguguuaugcccauuggggacacagaggu

SEQ ID NO: 96910 - RNA, 64 nt, hsa
uauuucaaauuagaaaaguucaaaugaaguuuaauuguguuauuuuauaaaaccuucuaaaauu

SEQ ID NO: 96911 - RNA, 64 nt, hsa
gucaguuugucuuuuugugccucucaucuuucuuuuguguuauguaagauugauuauucauuuc

SEQ ID NO: 96912 - RNA, 64 nt, hsa
ugguggcuugcugcuguaaucuuuuguuuuguuguuguguuacugaauguggcauuucaggguu

SEQ ID NO: 96913 - RNA, 64 nt, hsa
augcaaauuuuuuaaauaggagaaaauuaagaaauuguguuaaaggccuaaaguucaggagugu

SEQ ID NO: 96914 - RNA, 64 nt, hsa
accaguguguuagguucuaaugucaugacccaauuuguguuauucaucuuuaauccuguuuuca

SEQ ID NO: 96915 - RNA, 64 nt, hsa
aaugaauggaggaacuuuccaaacaccacuuuacuuguguuauauagccaauauaacuaucucu

SEQ ID NO: 96916 - RNA, 64 nt, hsa
uuaugccucagccacuugccugugcuacaauucauuguguuaccuguagauucagguaauacaa

SEQ ID NO: 96917 - RNA, 64 nt, hsa
gcugcugccaugaucccuuugagagguggcucaaaagcuacagggaacuccagguccuuuauua

SEQ ID NO: 96918 - RNA, 64 nt, hsa
caauauauacuguuguggguuggagaaaaguggaaagcuacacugggaagaaacucccuuccuu

SEQ ID NO: 96919 - RNA, 64 nt, hsa
aaauauaagaucugagauugaauauuuucauuaaaagcuacaguuuugugaaucuuugugcuuc

SEQ ID NO: 96920 - RNA, 64 nt, hsa
aaaaaaaaacucauuuauaccuguguauuuuuuaaagcuacaaucuguucaauguuuuuaaaaa

SEQ ID NO: 96921 - RNA, 64 nt, hsa
acuaucugccaggaaacugguacucaagauguugaagcuacaguuauuuuaugauagcacacuu

SEQ ID NO: 96922 - RNA, 64 nt, hsa
cuuguuagcaagcgugugugacagagaguggggaaagcuacaucauugaauauuuugauaaacu

SEQ ID NO: 96923 - RNA, 64 nt, hsa
gauaauaaauaacgggcuuuauuguuuauuuuaaaagcuacaauuuguuuuagcugguuucucu

SEQ ID NO: 96924 - RNA, 64 nt, hsa
acuuaauucucuuuucccuaggugccaucuccucaagcuacaaaauguccacaucuuauauccc

SEQ ID NO: 96925 - RNA, 64 nt, hsa
cagugaaaagauggucuccaguuucugaaugaaaaagcuacagcugagaaauaaaauaaaaugu

SEQ ID NO: 96926 - RNA, 64 nt, hsa
gugugauuuuuauuuucagaagucauauacauguaagcuacaauuuugagugcuuuauaaacac

SEQ ID NO: 96927 - RNA, 64 nt, hsa
accccaccuucuccuuuuuggcaugucuggugaaaagcuacaagguucacagggccaaauauuc

SEQ ID NO: 96928 - RNA, 64 nt, hsa
aggggagaacauuucugaaaaagaacuuauaaugaagcuacaaauccauccuuauuucuuauuc

SEQ ID NO: 96929 - RNA, 64 nt, hsa
acgggcucagcaaaagaugcuucucacugccaugccagcuuaucucaggggugugcggccuuug

SEQ ID NO: 96930 - RNA, 64 nt, hsa
cugguugagguuucaaaccucccuuuccaaaugcccagcuuaaaggggcuagagugaacuuggg

SEQ ID NO: 96931 - RNA, 64 nt, hsa
gccacccuggcaugccccacaaacagaucaccagccagcuuacacaggcauuaacucuccucaa

SEQ ID NO: 96932 - RNA, 64 nt, hsa
augcccaguauucccacucuccaaaaggaacugaccagcuuauauuucucacacuucuggggaa

SEQ ID NO: 96933 - RNA, 64 nt, hsa
uucaaggaaauaagagauuuguaagaaacuaggaccagcuuaacuuauaaugaaugggcauugu

SEQ ID NO: 96934 - RNA, 64 nt, hsa
cugaagaggggcuuuauaagcaggcugggcaggcccagcuuauaaguuaaagggcaucacagug

SEQ ID NO: 96935 - RNA, 64 nt, hsa
agcaauaguggagaaaaauguaaaauuuggucuuccagcuuaaugcagugugaacaauagaugg

SEQ ID NO: 96936 - RNA, 64 nt, hsa
uuuuaauauuauggggaaaccacuaacuauccaaccagcuuauacagcacacuaaggugggcuu

SEQ ID NO: 96937 - RNA, 62 nt, hsa
aguuucaguccucaaugcuguccuuuguuuuacagguacaaguuuucuagcucagacaaacu

SEQ ID NO: 96938 - RNA, 62 nt, hsa
gcaggguaauucuuaaacuuuuuagaggguggcagguacaucaguucuuuuugauaugaaaa

SEQ ID NO: 96939 - RNA, 64 nt, hsa
gaguaccuacuauaauacaguagcuaacauguauugagcacagauuuuuuuugguaaaacugug

SEQ ID NO: 96940 - RNA, 64 nt, hsa
gcugcaagcuuuaccaaguaauuggcaugacaucugagcacagaaauuaaggcaaaaaaccaaa

SEQ ID NO: 96941 - RNA, 64 nt, hsa
agccuccaaucuuuaaaaguaucgguuugccuguugagcacacuccugcaagccaaacacguga

SEQ ID NO: 96942 - RNA, 64 nt, hsa
cuuucccucugugggagacuaugaauauuccugaugagcacaaguaaaacuaaggcuucagcca

SEQ ID NO: 96943 - RNA, 64 nt, hsa
aagcauaguucuuccauaaccaccuuuuguuguuugagcacaagggauucuuuuccuaguucua

SEQ ID NO: 96944 - RNA, 64 nt, hsa
augaaccauuuuccucuucugaaaauucuguaucugagcacaucaagagacucuuguagcagug

SEQ ID NO: 96945 - RNA, 64 nt, hsa
aguccauugccuguuuuuuuaaauaagguuuuacugagcacagccacacucauuuguuuaugca

SEQ ID NO: 96946 - RNA, 64 nt, hsa
uguaauuuaacaagucaaauaaaauaaucauugcugagcacaaucacauguugaaacaagugug

SEQ ID NO: 96947 - RNA, 64 nt, hsa
guggucagaggggagcaaugggcuuugcugcuuaugagcacagaggaauucaguccccaggcag

SEQ ID NO: 96948 - RNA, 64 nt, hsa
ccuuagggccucauuugcucuucauccagggaacugagcacagggggccuccaggagacccuag

SEQ ID NO: 96949 - RNA, 64 nt, hsa
cuugcuuuuuugccccucggaagcauggggcuuuugagcacacuuaaaaaaagaaaaaucugua

SEQ ID NO: 96950 - RNA, 64 nt, hsa
auuuguuaccuuccugaggccucaguauuagucgugagcacaaaguuuugagaccuuuggcguu

SEQ ID NO: 96951 - RNA, 64 nt, hsa
cgaccucauucaucgccugcccccuacccaauucugagcacacgguacuguagcccccaguucc

SEQ ID NO: 96952 - RNA, 64 nt, hsa
gacccacccccaagcagggcuccucuccccagggugagcacaggaccucuguaagcugcuugug

SEQ ID NO: 96953 - RNA, 64 nt, hsa
uucuuccagcaaaaugcuuauuagaguuuuugucugagcacaguagccuggcccugcauaucuu

SEQ ID NO: 96954 - RNA, 64 nt, hsa
acacacacacacacacacacacacacacacacucugagcacauuaucugugauucuuucauccu

SEQ ID NO: 96955 - RNA, 64 nt, hsa
agcuuaauuuggcagagaaaauuuguaacaacucugagcacaugcugggugaagucacagcuca

SEQ ID NO: 96956 - RNA, 64 nt, hsa
ccaacucccaaagccagccugccuccagcuuuacugagcacaggaugcgggggccaagaugaug

SEQ ID NO: 96957 - RNA, 64 nt, hsa
gggugccccaggcuagcucuucuaccucuggggcaccacggacuccccuuggccacucuuggga

SEQ ID NO: 96958 - RNA, 62 nt, hsa
cuaccuggccguccaaauagaucccccaggguaccacggaggcgaaggaguuggagguguuu

SEQ ID NO: 96959 - RNA, 64 nt, hsa
ccaaaccucgcagggcuccagcaggccaaccggcaccacggacuccuggguggcgcccuggcga

SEQ ID NO: 96960 - RNA, 64 nt, hsa
guagaagcugcuggaaggcaggccugagccauucaccacggacaggaagagcagcucuggcuau

SEQ ID NO: 96961 - RNA, 64 nt, hsa
gucaagcuugggcucucaaagcccugcgccuguuaccacggaugcccacagggccugggcaguu

SEQ ID NO: 96962 - RNA, 64 nt, hsa
uguccgugcacaugguuuaaaggccaguccaaacaccacggagcauuuggcaaucaaggcccca

SEQ ID NO: 96963 - RNA, 64 nt, hsa
gcuauugaagugucuuuggauagcugucugagugaccacggacaaagucuuaacaaaacucagg

SEQ ID NO: 96964 - RNA, 64 nt, hsa
ucaacuugaagugcaagauucucuuauuuccgggaccacggagagucugacuuaacuacauaca

SEQ ID NO: 96965 - RNA, 64 nt, hsa
uaaguuguucauguugcagaaaaagguuauacguaccacggauucucuuuaauauuguacaguu

SEQ ID NO: 96966 - RNA, 64 nt, hsa
gcacugguccuaugccagccucacccauguggggaccacggaaggcacacucccuuacccccgg

SEQ ID NO: 96967 - RNA, 64 nt, hsa
gugcggagcuguuagggacgggcccagcuccugcaccacggacacagaaugucuggagagggcc

SEQ ID NO: 96968 - RNA, 64 nt, hsa
aauaaguuuaauuauaaagugaaggaccaguuggaccacggaccccuagaaacucagccaagga

SEQ ID NO: 96969 - RNA, 64 nt, hsa
ggacuggggauucuggccaguguaauuucugucaaccacggacguuugccuucauguguagaau

SEQ ID NO: 96970 - RNA, 64 nt, hsa
ucaccuccugagccacuucagaguucuggaagugaccacggaccaggguggaggaauagacuuc

SEQ ID NO: 96971 - RNA, 64 nt, hsa
ucacagggauagacuacaacaccucuaggccccaaccacggauuuuuuuucucaguggcccaug

SEQ ID NO: 96972 - RNA, 64 nt, hsa
gaugucucuaaguggaccucagugccucugcgugaccacggaaacucacugguacaguggggag

SEQ ID NO: 96973 - RNA, 64 nt, hsa
uucaagcauaaaccuuagcgagugcggcuggaggaccacggacauuggacucacuguggcugga

SEQ ID NO: 96974 - RNA, 64 nt, hsa
gagucaucagaaguguacuucuuggccacacaguaccacggaaggaagggcacugugaagcagu

SEQ ID NO: 96975 - RNA, 64 nt, hsa
gaucgccagcccgaggacuuaccauccacaaugcaccacggaagaggccguucuaugaaaaacu

SEQ ID NO: 96976 - RNA, 64 nt, hsa
gccuccgguugggucugcauuuuggagaguccacaccacggaccagguuuucccccaaggcuug

SEQ ID NO: 96977 - RNA, 64 nt, hsa
aggagacaaagcaagaccagaagggugggaagcuaccacggauugggcugcggggucaggggcu

SEQ ID NO: 96978 - RNA, 64 nt, hsa
uagccacucacccuucacaaacugaaguccauggaccacggaagucgagaauuaauguacaccu

SEQ ID NO: 96979 - RNA, 64 nt, hsa
ugugaugaccaguuguccuccaaaaaccucacucaccacggagucacccugagggccccgggca

SEQ ID NO: 96980 - RNA, 64 nt, hsa
ccaccagaccccaggccucaccggaggcccggugaccacggaacucaccgucugggggaggagg

SEQ ID NO: 96981 - RNA, 64 nt, hsa
gcauggguggcaggguuuggacccgcccagcagcaccacggaccccagccacucucgggggcag

SEQ ID NO: 96982 - RNA, 64 nt, hsa
ugcagggccacaugcugccugcaaacagggcaagaccacggaggcacagggguccugcuccuga

SEQ ID NO: 96983 - RNA, 64 nt, hsa
caauccacgcuucuccggaucgcggugcgccggaaccacggaggaugaugccaguuacuugcuu

SEQ ID NO: 96984 - RNA, 64 nt, hsa
ggagccauuagcucuuaaauuauucacagaagucaccacggaagguuguuuaagaugcagauuc

SEQ ID NO: 96985 - RNA, 64 nt, hsa
ggagaagggauggaggucacacugguagaacguaaccacggaaaagagcgcaucaggccuggca

SEQ ID NO: 96986 - RNA, 64 nt, hsa
gaggcaggcauugucucauuuuucaaugucacaaaccacggagcacucaucuacaaguucucug

SEQ ID NO: 96987 - RNA, 64 nt, hsa
cacguggggagggcugccucagcagguuucucagaccacggagaagugacuuuugggcccgggg

SEQ ID NO: 96988 - RNA, 64 nt, hsa
cagcccggcgccaccauccugcagccuccuccugaccacggacguuuccaucagguuccauccc

SEQ ID NO: 96989 - RNA, 64 nt, hsa
ugacuggacuguggcucugaaccuugagcauaguaccacggacuccgugggcgcucaauaaaca

SEQ ID NO: 96990 - RNA, 64 nt, hsa
ugggaaugcaucuugugggagcagcuucacucccaccacggaccaaugccuuucccccauaggc

SEQ ID NO: 96991 - RNA, 64 nt, hsa
aacugacucuggucuugggaggugaggcuucccaaccacggaagacuacuuuaaaugaaaaaaa

SEQ ID NO: 96992 - RNA, 64 nt, hsa
aaggauugauuugcaaccagaaagggagcugaaaaccacggagcuccauggcucuucauucaaa

SEQ ID NO: 96993 - RNA, 64 nt, hsa
uacacagcugcaucagacaaugccauuucuccccaccacggaaccuuccaucuaagauuucuuc

SEQ ID NO: 96994 - RNA, 64 nt, hsa
uaucugagcagcuucaaagaccccugagcugccaaccacggagaugugccaagcaucucaucuc

SEQ ID NO: 96995 - RNA, 64 nt, hsa
cccugccaccauggggccucccgauacggcaaccaccacggaccuguggggaccaaugaggaaa

SEQ ID NO: 96996 - RNA, 64 nt, hsa
cauccgcugugacugcggagccugcuccacugccaccacggagugugagaccaucugaggccgc

SEQ ID NO: 96997 - RNA, 64 nt, hsa
agagccgggagagagccgcagcuccguccacagcaccacggagaggacagcgccucuugggcug

SEQ ID NO: 96998 - RNA, 64 nt, hsa
uaucugcacucacccaggccuucacccagacuuuaccacggaggcggcugagugcagcuacagc

SEQ ID NO: 96999 - RNA, 64 nt, hsa
ucccucucuggagaaagggcccugggccugccucaccacggaccaaagggagucugccagggcc

SEQ ID NO: 97000 - RNA, 64 nt, hsa
uuuaccuccugccuuuggauugacucugcauuugaccacggacuccagucuguguguagggaga

SEQ ID NO: 97001 - RNA, 64 nt, hsa
ccagccucagaaggccccagagagacccugcaagaccacggagggagcgacacuugaauguaga

SEQ ID NO: 97002 - RNA, 64 nt, hsa
cucugauugucacuugcaucuucacaaaggauaaaccacggagcaacuggaaaaccaucagcca

SEQ ID NO: 97003 - RNA, 64 nt, hsa
gcagugagggguauaucugggcuggccaguuggaaccacggagaucuccuugcccuagaugagc

SEQ ID NO: 97004 - RNA, 64 nt, hsa
uugcuguaagaaguguugccuuugauuguuacuaaccacggauggguaacggucauacauuagg

SEQ ID NO: 97005 - RNA, 64 nt, hsa
ggguggauggagcucagaaggaaaccccagccccaccacggaugacaccaucccucccguccca

SEQ ID NO: 97006 - RNA, 64 nt, hsa
caaagcuccaccaggaggcugguucacguccccuaccacggaagcgaggucccagaaggccagc

SEQ ID NO: 97007 - RNA, 64 nt, hsa
agaggacuacgaugagugugugcugccguucauuaccacggagauccucaagucacugguggcu

SEQ ID NO: 97008 - RNA, 64 nt, hsa
uucgggggccucuggcugcugaaggauucggucuaccacggagggcugugcuguuaggcugcau

SEQ ID NO: 97009 - RNA, 64 nt, hsa
aagaaagccaagcaucacuugcacuuaaaucauuaccacggaagauauauuagcuucaacuuua

SEQ ID NO: 97010 - RNA, 64 nt, hsa
ucagauucuaugagaaacccagggucucugcuuuaccacggagcagggucaccaacccagaucu

SEQ ID NO: 97011 - RNA, 64 nt, hsa
ccacggacggcccagacccgggcuggggcgcggcaccacggacggugccccuugcgcgccaucg

SEQ ID NO: 97012 - RNA, 64 nt, hsa
cagccuuuaaaucacaagcaaaauaggaaaguuaaccacggaggcaccgaguuccagguagugg

SEQ ID NO: 97013 - RNA, 64 nt, hsa
uccggcauccccuccccagacugccugcugucaaaccacggagcagcuggagccugcccugucc

SEQ ID NO: 97014 - RNA, 64 nt, hsa
cuccucucuaggcagcgggugggcacagccccucaccacggacacggacagaggaccaccuccc

SEQ ID NO: 97015 - RNA, 64 nt, hsa
ggagaacugaccagcccucaucauuccccauaaaaccacggacagcgucugugugcgcaucuug

SEQ ID NO: 97016 - RNA, 64 nt, hsa
cucccggcuugucccagccccucuuuugcuucugaccacggaggcuuucucacagcccagccug

SEQ ID NO: 97017 - RNA, 64 nt, hsa
gguccacguggauugucucagggaagccuugaaaaccacggagguggaugccaggaaagggccc

SEQ ID NO: 97018 - RNA, 64 nt, hsa
cauguauggugauagguaucuagagcuuaaugcuacaugugagugacgaugauguacagauucu

SEQ ID NO: 97019 - RNA, 64 nt, hsa
uauaugcuuuauuaauguuuucaaaagguauuauacaugugauacauuuuuuaagcuucaguug

SEQ ID NO: 97020 - RNA, 64 nt, hsa
gugaaaaguaagaccaagaaaaaacaaacuaaagacaugugacuuauucaaugaaagugaaaaa

SEQ ID NO: 97021 - RNA, 64 nt, hsa
uauuuaaaucauguuuuccuaaaauguagcaacuacaugugauaaaagcaaauuagaacauucu

SEQ ID NO: 97022 - RNA, 64 nt, hsa
aucuucaugccauuacagcuuucuagaugcuaauacaugugacuaucguccaauuugcuuucuu

SEQ ID NO: 97023 - RNA, 64 nt, hsa
uagugacauuaaauuuggcuauaaaagauggacuacaugugauacuccuauggacguuaauuga

SEQ ID NO: 97024 - RNA, 64 nt, hsa
caugugacaugugaaagacauacgagacauagcuacaugugaugugcacaugugugaagugcau

SEQ ID NO: 97025 - RNA, 64 nt, hsa
ucacuccccccauacucuuugugauacacaugugacaugugaaagacauacgagacauagcuac

SEQ ID NO: 97026 - RNA, 64 nt, hsa
ggauuauucacuccccccauacucuuugugauacacaugugacaugugaaagacauacgagaca

SEQ ID NO: 97027 - RNA, 64 nt, hsa
aauaggaucccaugagaacauuauacuggaaguuacaugugauacccagcuaaagaauacauau

SEQ ID NO: 97028 - RNA, 64 nt, hsa
gccacaaaacacaagugguaugcuuuagaucugcacaugugaauuuagcauaaucacugggaau

SEQ ID NO: 97029 - RNA, 64 nt, hsa
aggggggcggugguuauuauaaggaauuggcucacgugauuauggaggcgguuaaaucccaaga

SEQ ID NO: 97030 - RNA, 64 nt, hsa
gaggaaggcuguuuucacaaaugacuuguaaugucgugauuaaaaaaauuccuauauucuucug

SEQ ID NO: 97031 - RNA, 64 nt, hsa
uuagcaacugagaucaaagcacucuuccacuuuacgugauuaaaaucaaaccuguaucagcaag

SEQ ID NO: 97032 - RNA, 64 nt, hsa
uuuucaaacacaaggucucuuacagguauaguuccgugauuaugauagcucugugauuauaagc

SEQ ID NO: 97033 - RNA, 64 nt, hsa
agcauuggauccaagccauauauugaaauacaagcgugauuaaucaguaauucacauugccgau

SEQ ID NO: 97034 - RNA, 64 nt, hsa
ugucaaagugcacacuguacuuucuucuuaaaaacgugauuaaagagaucacuuuguccggaug

SEQ ID NO: 97035 - RNA, 64 nt, hsa
cgaguucuucccgcauuacugcuguuuaauagaacgugauuagucaucgccgagaagaaagcau

SEQ ID NO: 97036 - RNA, 64 nt, hsa
cagguucacuaaaugugaacagcuuugcuuuucacgugauuaagacccuacuccaaauuguaga

SEQ ID NO: 97037 - RNA, 64 nt, hsa
ucaaaagagaugaaagguauguagaacagguucacgugauuaccuuuuucuuuuggcuuggauu

SEQ ID NO: 97038 - RNA, 64 nt, hsa
agauaaaaguuguuauugauguauaaacucguugcgugauuagugauguuggaagcauuuuagc

SEQ ID NO: 97039 - RNA, 64 nt, hsa
cuaucacgagaacagcaugggaaagaccugcccccgugauuaaauuauuucccaccaggccccu

SEQ ID NO: 97040 - RNA, 64 nt, hsa
gcuuccaaauuaugcuuuauagcuguauaaacaucgugauuauauucaucuacuuagaaauugu

SEQ ID NO: 97041 - RNA, 64 nt, hsa
ugguguggucuacuaaauaauacuuuaggaaauacgugauuaauaugcaagugaacaaagugag

SEQ ID NO: 97042 - RNA, 64 nt, hsa
ucaauccuguucuuuguuuaagagcaauacuugucgugauuacagggagauccuuuaguaaaau

SEQ ID NO: 97043 - RNA, 64 nt, hsa
acugugcuguuguuaugaugugcuuaacagggaacgugauuagugaaaggaagauaaacgugga

SEQ ID NO: 97044 - RNA, 64 nt, hsa
gguaggagagauggauucuggggucaugaccuuucgugauuauccgcaaaugcaaacaguuuca

SEQ ID NO: 97045 - RNA, 64 nt, hsa
agaggaaaauuauuuuggggaggaacuacacagucgugauuagaauuuaucugaugguuuugua

SEQ ID NO: 97046 - RNA, 64 nt, hsa
ccagcagcuuaauggauuucauggaaugaaauaccgugauuaacucauagcuacauaucauugc

SEQ ID NO: 97047 - RNA, 64 nt, hsa
acugaucaaagggaguccagucaacgugagcaagcgugauuaugaugaggaagcccccucugcu

SEQ ID NO: 97048 - RNA, 64 nt, hsa
guuuggcugguuuucucucacugaaauggccagucgugauuaaagugauaaaaccccauaucug

SEQ ID NO: 97049 - RNA, 64 nt, hsa
ucaacgcagaagaauggacgaaaugaccauccaacgugauuaaggauaggaaucgguaguuugg

SEQ ID NO: 97050 - RNA, 63 nt, hsa
aaaauuuauuguaugaaaauuaagccucaauaaacgugauuauaaaaaacaagucugcaagga

SEQ ID NO: 97051 - RNA, 64 nt, hsa
aacaagaagggaucagaugccacaucguuuuugucgugauuaauuuaacuuaaacuaaaauuuu

SEQ ID NO: 97052 - RNA, 64 nt, hsa
aauguggagacauggaguuuuauugagguagcuacgugauuaaaugguauugcaguguggagac

SEQ ID NO: 97053 - RNA, 64 nt, hsa
gccaguuuccacugugcgggaacucugagucagacgugauuaucugggggucuguccacccugg

SEQ ID NO: 97054 - RNA, 64 nt, hsa
cacagaucagucugucaauaaauggccaauguuccgugauuauuacccugaccuccaucaucau

SEQ ID NO: 97055 - RNA, 64 nt, hsa
ccucuuucugucucugaucagagccgacaccagacgugauuagcaggcgcagcaaauucaauuu

SEQ ID NO: 97056 - RNA, 64 nt, hsa
uguaacaagggugccaugguauuuuuagauaacucgugauuaucuuaagagagguaaauuuagu

SEQ ID NO: 97057 - RNA, 64 nt, hsa
cccccccaccaguccugcccccgcauggagcccccgugauuaguagcccguaugaucacguaga

SEQ ID NO: 97058 - RNA, 64 nt, hsa
cucccaccauccugugaaccccacuccacucgcacgugauuacagucuguaaaggugugacuuu

SEQ ID NO: 97059 - RNA, 64 nt, hsa
cccccccccguccccgcacguagaucgcagcaggcgugauuacacaugcacaccaacaugcaug

SEQ ID NO: 97060 - RNA, 64 nt, hsa
cagauuagaacaugaugauuggagaugcaugaaacgugauuaacgucucugcguaaucaggacu

SEQ ID NO: 97061 - RNA, 64 nt, hsa
gauuacaggcaugagccacugcacucggcuguaccgugauuauuaguucaagguucucuuucac

SEQ ID NO: 97062 - RNA, 64 nt, hsa
caaucagucaguuagccuaaaccuauugauuccucgugauuauuuccaaugugaaaacaguugu

SEQ ID NO: 97063 - RNA, 64 nt, hsa
cagagagcggcuuccccauugccuucuggggagggacacagaggacagcuuccccaucgccuuc

SEQ ID NO: 97064 - RNA, 64 nt, hsa
cagaggauggcuuccccauugccuucuggggagggacacagaggacggcuuccccaucgccuuc

SEQ ID NO: 97065 - RNA, 64 nt, hsa
gacuuucuaauuugaccagauuucuuaaugaauagacacagaauuaacuaaaaacagucucacc

SEQ ID NO: 97066 - RNA, 64 nt, hsa
aacugcuaacuccuaggaaacagccuuuucccuggacacagaugguccauacgcugagccacgu

SEQ ID NO: 97067 - RNA, 64 nt, hsa
cuggcauucaaucguuggcagauuaucuucugaugacacagaaugaaagggcaucucagccucu

SEQ ID NO: 97068 - RNA, 64 nt, hsa
ugguuuagugcucaguuggcucuaguaaccagaggacacagaaaguaucuuuuggaaaguuuag

SEQ ID NO: 97069 - RNA, 64 nt, hsa
ccaaauugggagauaauuaucagucaugaggaaagacacagauuucggucauaaagaauguaag

SEQ ID NO: 97070 - RNA, 64 nt, hsa
cuagccacaguucuaagacccaaagugggggguggacacagaagucccuaggagggaaggagcu

SEQ ID NO: 97071 - RNA, 64 nt, hsa
ccucguucugccagcuggagccaagaagcacagagacacagaggcgccugccccucagcuccgc

SEQ ID NO: 97072 - RNA, 64 nt, hsa
ggucuguacagugacaacccgggccggcagcaaggacacagaugcagccacaguaaggcuccau

SEQ ID NO: 97073 - RNA, 64 nt, hsa
gacccaugccuacuccaugccaggcccagugcuggacacagagacaugaagcucugucuguggg

SEQ ID NO: 97074 - RNA, 64 nt, hsa
acaugaagcucugucugugggagacagggauucugacacagacaccggacaaaccauugucuug

SEQ ID NO: 97075 - RNA, 64 nt, hsa
uggugagagccugaggcugguguucagggcccuggacacagacacagagcagccgcaucucaaa

SEQ ID NO: 97076 - RNA, 64 nt, hsa
gagccugaggcugguguucagggcccuggacacagacacagagcagccgcaucucaaaggcaga

SEQ ID NO: 97077 - RNA, 64 nt, hsa
uuguggacacagaaaugcacaggggacacuuacggacacagaaaugcacaggggaggccgagca

SEQ ID NO: 97078 - RNA, 64 nt, hsa
gugaggugucuacaggguuuauaguagucuuguggacacagaaaugcacaggggacacuuacgg

SEQ ID NO: 97079 - RNA, 64 nt, hsa
cggccuccuugaagauccugauaaaugaagaaaagacacagagaaggaugugacaugccugggc

SEQ ID NO: 97080 - RNA, 64 nt, hsa
cugccgugcaguuggggguggggcgugguguuuagacacagauaggaguccaggguaugacuga

SEQ ID NO: 97081 - RNA, 64 nt, hsa
ucuucccuuugcccuucuccuccaauacauaaaggacacagacaaggaacuugcugaaaggcca

SEQ ID NO: 97082 - RNA, 64 nt, hsa
acccacauggggacauaagcuaauuuuuuuacaggacacagaauucuguucaaugcuguuaaau

SEQ ID NO: 97083 - RNA, 64 nt, hsa
uccaaauuucucauucuucaggccaggaaaccgagacacagagguaaaguaauuuccccaaggu

SEQ ID NO: 97084 - RNA, 64 nt, hsa
cuuuuuaucuauaauccuaauauuucauacugaagacacagaaaucuuucacuugucuuuaaca

SEQ ID NO: 97085 - RNA, 64 nt, hsa
agguguccuuccaagagacagaagaggagacacagacacagagcaggaggacacguggagacag

SEQ ID NO: 97086 - RNA, 64 nt, hsa
caugacagguguccuuccaagagacagaagaggagacacagacacagagcaggaggacacgugg

SEQ ID NO: 97087 - RNA, 64 nt, hsa
ccaauccagugucccuaugagagacggaagaggagacacagacacaaagcaggaggccacauaa

SEQ ID NO: 97088 - RNA, 64 nt, hsa
uauagccaagacugaagaaaccaaauauauguguuuacuguagcaugucuucaaauuaguggaa

SEQ ID NO: 97089 - RNA, 64 nt, hsa
uagagugugaagucaguuacuuguugauguuuucuuacuguaucaaugaaauacauauugucau

SEQ ID NO: 97090 - RNA, 64 nt, hsa
gucauagaauugauuacccgccgaauucauuaauuuacuguaguguuaagagaagcacuaagaa

SEQ ID NO: 97091 - RNA, 52 nt, hsa
uggcauaucuaauaagauagccuuacuguaagugcaauaguugacuuuuaac

SEQ ID NO: 97092 - RNA, 64 nt, hsa
aauauaagaauugguuauuugggggcuuuuuuacuuacuguauuuaaaaauacaaggguauuga

SEQ ID NO: 97093 - RNA, 64 nt, hsa
uucaugucagacuaguuacuuuguugauucucaguuacuguaggcaucaaaaggcaaaaaucaa

SEQ ID NO: 97094 - RNA, 64 nt, hsa
ucacuggauuaucauaaaagggagaaauuaaauauuacuguacucuuaguugcuguguagcuaa

SEQ ID NO: 97095 - RNA, 64 nt, hsa
uauguucucccuuuuccauuuuggauuuaucucuuuacuguaaugacucaaaagguauuuaaga

SEQ ID NO: 97096 - RNA, 64 nt, hsa
gaagauuggaagacuuauauugagaccaguaacuuuacuguaaauuuacuuuguuucauugaaa

SEQ ID NO: 97097 - RNA, 64 nt, hsa
cacuaugagaacuaccguguuagugguuuuucacuuacuguauauuacccuuguaggaauaguu

SEQ ID NO: 97098 - RNA, 64 nt, hsa
cuauuuugggaauuuuuaguuguauucuauucuuuuacuguacauuguuuacaucuggauuuuc

SEQ ID NO: 97099 - RNA, 64 nt, hsa
guuuguuacauagguaaacuugugucauggggguuuacuguacagauuauuucaucacccaggu

SEQ ID NO: 97100 - RNA, 64 nt, hsa
acuauggauaaauuaacuuuuacagaaaucuuguuuacuguaugauauucuaaaacacugucaa

SEQ ID NO: 97101 - RNA, 64 nt, hsa
aaaauguuagcuucaauuaauuagccauugguacuuacuguagcuacacauauuaaaaggcaaa

SEQ ID NO: 97102 - RNA, 64 nt, hsa
uucuuuguuagcucacuuuauaauuuguauuuuuuuacuguauagacuaaauauauucuauuua

SEQ ID NO: 97103 - RNA, 64 nt, hsa
auaggcaauauuauauugacaccuuuuacagaucuuacuguagcuuuuuccauauaaauaaaau

SEQ ID NO: 97104 - RNA, 64 nt, hsa
acuguauuauccucacaugacuuuuuuucuugucuuacuguaccuuaaaaggugauagaguaau

SEQ ID NO: 97105 - RNA, 64 nt, hsa
guugcauucccuauauuuauuuacuuccaauauuuuacuguaaaaguagggagaaauauuaugu

SEQ ID NO: 97106 - RNA, 64 nt, hsa
ugcugaaauauucuaaauaaaaugguuuagaguuuuacuguaacuaugaauaauuaugcuauaa

SEQ ID NO: 97107 - RNA, 64 nt, hsa
auuaaaaaaauccauguguuucaucaaauuuauauuacuguauuuuauaaaauacgaacuauug

SEQ ID NO: 97108 - RNA, 64 nt, hsa
auguccaaaacauuccuuucagccuuuuuauuucuuacuguacugucucuuacuguacugucua

SEQ ID NO: 97109 - RNA, 64 nt, hsa
cuuucagccuuuuuauuucuuacuguacugucucuuacuguacugucuaucugcaguaauugag

SEQ ID NO: 97110 - RNA, 64 nt, hsa
uauuuccuguuugaaggcuuacuguagaaguggcuuacuguagaagcagcuugcugagccccuc

SEQ ID NO: 97111 - RNA, 64 nt, hsa
ccuucauuuuaugcuuuauuuccuguuugaaggcuuacuguagaaguggcuuacuguagaagca

SEQ ID NO: 97112 - RNA, 64 nt, hsa
accuacaaaccuguauggcauauuacuguacugauuacuguaggcgguuguaacacagugcuaa

SEQ ID NO: 97113 - RNA, 64 nt, hsa
cuauugcuccuaaccuacaaaccuguauggcauauuacuguacugauuacuguaggcgguugua

SEQ ID NO: 97114 - RNA, 64 nt, hsa
uggcauccuaucacuaugugauauuuuguacaucuuacuguauuuacaaguuuauuuaucaagg

SEQ ID NO: 97115 - RNA, 64 nt, hsa
caucuuaaugucaagcucauuaaguuaacuguaauuacuguauuuugugggacaaagaaaaaag

SEQ ID NO: 97116 - RNA, 64 nt, hsa
augcuuguuccugcugcuaauaaaguaaggcccauuacuguaucgggaauuucuaguguuuccc

SEQ ID NO: 97117 - RNA, 64 nt, hsa
gaaaaauuaggaugugauuuugguugguuuuaaauuacuguaaguuuuagauucuaagguucaa

SEQ ID NO: 97118 - RNA, 64 nt, hsa
uaaacuagugaaugaacccaggauuugaacucaguuacuguacaacugugagccagaagaagau

SEQ ID NO: 97119 - RNA, 64 nt, hsa
uugggcuuuucaguaucuguauggugggaagcaguuacuguauaugucccaggcaaugugcuaa

SEQ ID NO: 97120 - RNA, 64 nt, hsa
aguuacauuuucauuaugccccaucacaucuucuuuacuguaaaaauauuaaaaagcuguuucc

SEQ ID NO: 97121 - RNA, 64 nt, hsa
gaggcccaccuugcucuuacaauguuugcaauuguuacuguauugaauacaguauaaugacuac

SEQ ID NO: 97122 - RNA, 64 nt, hsa
gaaacaaaaagguauuuugcuguuaccucaauucuuacuguaguagcccaucugaugcuucuau

SEQ ID NO: 97123 - RNA, 64 nt, hsa
augaaauaguucauguucagauggaaauguuagguuacuguaugguuuauggagauuaaugaaa

SEQ ID NO: 97124 - RNA, 64 nt, hsa
uccugaaaauuuuaagacugugauaucugucauuuuacuguauagcugacuguguacucaggua

SEQ ID NO: 97125 - RNA, 64 nt, hsa
agcccuaucucaguuggucaguaaagaccaauccuuacuguaggaaaucauuguuguaucauca

SEQ ID NO: 97126 - RNA, 64 nt, hsa
aagaaaauguauucucugcuuuguauugaauuuauuacuguacauucuguggcuuauaguucug

SEQ ID NO: 97127 - RNA, 64 nt, hsa
uagaauuguaauauguuuacuuguaucacagaucuuacuguacacguuuuguauuagaggaaac

SEQ ID NO: 97128 - RNA, 64 nt, hsa
gauaugauaggcaacagacugaaaaccauaaucuuuacuguauucuaugcauucaaaugugguc

SEQ ID NO: 97129 - RNA, 64 nt, hsa
uuaauacgugucggucauauacaguauugaauuuuuacuguauaguaauucuggaaagagcaaa

SEQ ID NO: 97130 - RNA, 64 nt, hsa
auauuaucuuguuagauuuguuaccaguaaaauauuacuguaauuucauauacacagucuauac

SEQ ID NO: 97131 - RNA, 64 nt, hsa
auauauucuuacaagaguguaagggcucacacauuuacuguacucagaucugaaagacaauguu

SEQ ID NO: 97132 - RNA, 64 nt, hsa
aaauuuaauagauaucuauuucuguuacauuuuauuacuguauggcacaagaaagaagugacau

SEQ ID NO: 97133 - RNA, 64 nt, hsa
acauuggugguauugcaggaauuuuucaaaaacauuacuguaaugaauaacugaguuuccuaua

SEQ ID NO: 97134 - RNA, 64 nt, hsa
auuuugucuuucuuuccuuuuugacuuuaguagcauccuccacacauuugugugccugauuuga

SEQ ID NO: 97135 - RNA, 64 nt, hsa
acgauguuuaacugaagaauuggcuaauguuuugauccuccagugugacuguuguuuuuguuug

SEQ ID NO: 97136 - RNA, 64 nt, hsa
ccccaagcucaacccauaaccucaaccacaucuuauccuccaccccacaucccaccacauccac

SEQ ID NO: 97137 - RNA, 64 nt, hsa
aucaucccccugagcucacccuuaacuccaauuuauccuccaagccuaucucucaccauccagc

SEQ ID NO: 97138 - RNA, 64 nt, hsa
acuggaguccaguggcacaaucucggcucacugcauccuccaccuccuggguucaagugauucu

SEQ ID NO: 97139 - RNA, 64 nt, hsa
gacaggggucucgcugaacuccuggccuccagugauccuccauccucggccucccaaagugcug

SEQ ID NO: 97140 - RNA, 64 nt, hsa
guucacaagaggagacgugacguggugggcugagguuaaucagggaagguuuccugggggaggu

SEQ ID NO: 97141 - RNA, 64 nt, hsa
caaaucuucuaauuccaagauccaauaggaucucguuaaucaucaguuccuuugaucucgcugu

SEQ ID NO: 97142 - RNA, 64 nt, hsa
cuguccaguacauuagacacuaggcacauuggcuguuaaucacuuggaauguguuuagcuugac

SEQ ID NO: 97143 - RNA, 64 nt, hsa
uuauaugcccucaaguaaaagaaaagccgaaaggguuaaucauauuugaaaaccauauuuuauu

SEQ ID NO: 97144 - RNA, 64 nt, hsa
acuugauuaauuaauacuauuugaguuauuaaauguuaaucaaaaugaguauaucauuuccugu

SEQ ID NO: 97145 - RNA, 64 nt, hsa
cuagagaauucugaaacugaggaggggauccucuguuaaucagugagcacuuuuugaugagcug

SEQ ID NO: 97146 - RNA, 64 nt, hsa
gcauaugcaacagugaauaaaagcuucuuuuuuuguuaaucagucaauaaauuuggcuaauuag

SEQ ID NO: 97147 - RNA, 64 nt, hsa
uuuuauuuugauaguagcuuccuccucuggugguguuaaucauuucauuuuuacccuuacuugg

SEQ ID NO: 97148 - RNA, 64 nt, hsa
uuccuuuuuaaaauguauuccuuuguguucaacaguuaaucaaaaccagagagucuagggcagc

SEQ ID NO: 97149 - RNA, 64 nt, hsa
ccuuuugccgaccccaagaguuuugggaguuguaguuaaucaucaagagaauuuggggcuucca

SEQ ID NO: 97150 - RNA, 64 nt, hsa
uuccuuaaagacucuucugaacuaguuggaccugguuaaucauagagaguagccuuuaaucaug

SEQ ID NO: 97151 - RNA, 64 nt, hsa
caguggucuucuguuaauguagugucuuuuacaaguuaaucauuaaauuuguuagaucuuguua

SEQ ID NO: 97152 - RNA, 64 nt, hsa
aacugaauuggcuaggaaaaaagaaaaacugcauguuaaucauuuuccuaagcuguccuuuuga

SEQ ID NO: 97153 - RNA, 64 nt, hsa
aaaucaaaaauuggauaauuuguaauauuuauguguuaaucacacaguaugcucucugaaguuc

SEQ ID NO: 97154 - RNA, 64 nt, hsa
ccaaaguugcuagcaucauuuugcuguugugccaguuaaucauaggaucccauuaaauaagugu

SEQ ID NO: 97155 - RNA, 64 nt, hsa
ccaguauaagacuacugaaucugcuaccaaaacaguuaaucagugagucgauguucuauuuuuu

SEQ ID NO: 97156 - RNA, 64 nt, hsa
agcacuuuaaaacaaacugguguguuguuuuuaaguuaaucauauguuuaauaaaugcgugguu

SEQ ID NO: 97157 - RNA, 64 nt, hsa
auggcuaccuaaaaagaugacccauuauguccuaguuaaucaucauuuuuccuuuaguuuaauu

SEQ ID NO: 97158 - RNA, 64 nt, hsa
caccuuggaucuccugcauguccaaaucucaguaguuaaucaagugucugcugccauuaacaga

SEQ ID NO: 97159 - RNA, 64 nt, hsa
auuuauuuacuucuguuuuguaaauugggauuuuguuaaucaaauuuauuguacuaugacuaaa

SEQ ID NO: 97160 - RNA, 64 nt, hsa
cucaaaggccccaguauucucucuucuuuccucaguuaaucaaauccucugacccagauuuauu

SEQ ID NO: 97161 - RNA, 64 nt, hsa
aagagaauucuguaucaguguaacugccaguucaguuaaucaaaugucauuuguucaauuguua

SEQ ID NO: 97162 - RNA, 64 nt, hsa
aacauacagugcuugaauauacagccuuaacaauguuaaucaucuccuuggaucauuauauuga

SEQ ID NO: 97163 - RNA, 64 nt, hsa
uggaaaauuggaaaugaaauauguugcugggugcguuaaucaccuccgcccaggauuuagucac

SEQ ID NO: 97164 - RNA, 64 nt, hsa
aaagaaugcugcaacuuuuuuaugucucuuagagguuaaucagaguaucugaagggaauuguuu

SEQ ID NO: 97165 - RNA, 64 nt, hsa
uggaguuuuacaaagaaggaaacuguaucuuuagguuaaucaaagcuaugcauuucauauagcu

SEQ ID NO: 97166 - RNA, 64 nt, hsa
uuuuaacuaaauuguuacuugccuuucucacccaguuaaucagucucuguacuuguuucccuuu

SEQ ID NO: 97167 - RNA, 64 nt, hsa
cugugaauuauucagugcauuauaagaaaucuuaguuaaucaugcuuuugggcuucauuaguca

SEQ ID NO: 97168 - RNA, 64 nt, hsa
aauuggugucacauuuguaaaaguaauuuuaauaguuaaucaucucugagaguaaccuguauuu

SEQ ID NO: 97169 - RNA, 64 nt, hsa
cauaaucuccaguuuuuucacagugccucacagaguuaaucaugccuuuuggagcuagaaggac

SEQ ID NO: 97170 - RNA, 64 nt, hsa
uuaaugaauuauauauagauagauagagugauuaguuaaucaaaacuauauauuuguuaaaaau

SEQ ID NO: 97171 - RNA, 64 nt, hsa
gauuaaagaacagauccuagccaucagugacaaaguuaaucaggacccaagucugcuucuguga

SEQ ID NO: 97172 - RNA, 64 nt, hsa
guuacgaagaaaacucaccaaucaucuccuuccuguuaaucacauguuaaugaaaauaagcucu

SEQ ID NO: 97173 - RNA, 64 nt, hsa
aauuuauaauuugauuuuuuauuuuaaaaacuggguuaaucaagucucgguaaguccuuuaaac

SEQ ID NO: 97174 - RNA, 64 nt, hsa
uucuauauuuuccgaggcaguauuuucuuuguauguuaaucauaguuauaguaaagucagacuc

SEQ ID NO: 97175 - RNA, 64 nt, hsa
aucuguuagauauuaaaggugagaauuagggcagguuaaucaaaaauggggaaggggaaauggu

SEQ ID NO: 97176 - RNA, 64 nt, hsa
aauagaguaccaaugucauuaauugauuuuucuuguuaaucagaauuccuauucuguaccuuuc

SEQ ID NO: 97177 - RNA, 64 nt, hsa
ugugaaaaaguggaguaguguuuuuuuaaccauuguuaaucagcuuuuguguaugaaagacaca

SEQ ID NO: 97178 - RNA, 64 nt, hsa
aauuauacugagaaccugaucucguuuacuccauguuaaucacauuccuaccaaccuaaauuuc

SEQ ID NO: 97179 - RNA, 64 nt, hsa
aaaggaaacaaagagugcuuuugggcauccaacaguuaaucacuuauguuuuuagagcaugcaa

SEQ ID NO: 97180 - RNA, 64 nt, hsa
aguccuugucuuguaauuguggauuaaugucaauguuaaucagccccucaaagggagagaaaag

SEQ ID NO: 97181 - RNA, 64 nt, hsa
ccuuaagguguuugcuaguuguguacauagugugguuaaucauuagcuacacugcuucccacuu

SEQ ID NO: 97182 - RNA, 64 nt, hsa
accagggagggagguuauaauaauagagcauccuguuaaucagaaucaugggggagaacauaca

SEQ ID NO: 97183 - RNA, 64 nt, hsa
auuuaagccaacagaguuacccaacccagagacuguuaaucauggauguuagagcucaaacggg

SEQ ID NO: 97184 - RNA, 64 nt, hsa
caacuuauuuuacuacugauauuugaccuggaaaguuaaucauggcaacaaauacauacaggau

SEQ ID NO: 97185 - RNA, 64 nt, hsa
aucauggaucaaccaaguuacacgggguuacacuguuaaucauggguuccucccuucuucugag

SEQ ID NO: 97186 - RNA, 64 nt, hsa
uacuauagauaaaauccuauuuaagacaaauucuguuaaucaacaagggcucuguauuuuuuua

SEQ ID NO: 97187 - RNA, 64 nt, hsa
cugagccaaagcagauagaaguuauuguauaauuguuaaucacuuugcaaauaggggcuaucaa

SEQ ID NO: 97188 - RNA, 64 nt, hsa
cucuggaguuggggcucuuggcuuucagaguuugguuaaucaguguugauucuagaugaucaac

SEQ ID NO: 97189 - RNA, 64 nt, hsa
uaaaucucaaggguuucuuguaaaguccauuuauguuaaucaaaguugaauauaaaaauccacc

SEQ ID NO: 97190 - RNA, 64 nt, hsa
ucaagaauaugaguggauauuauuuuuaccuuauguuaaucagugauaugcuuuagucaauaau

SEQ ID NO: 97191 - RNA, 64 nt, hsa
cuuggauguugguggguuuuugaauuuuugggugguuaaucaguuuuauuuugaaaagacguac

SEQ ID NO: 97192 - RNA, 64 nt, hsa
ugaauguuucuuaggauuguaggaaaauuaucuaguuaaucauaauauuugauggaaagaaaaa

SEQ ID NO: 97193 - RNA, 64 nt, hsa
auauuccuuuucuguuaagauaauacuuaaauuuguuaaucaccaguaagauuugauguuuaaa

SEQ ID NO: 97194 - RNA, 64 nt, hsa
auauucuuauccucuuaaauaaaacugcucaacaguuaaucagcagugaaucaucuugcagcua

SEQ ID NO: 97195 - RNA, 64 nt, hsa
guaccuguugcuucccagaggauggagaaguguaguuaaucacaccucuuaguuuaaucugaaa

SEQ ID NO: 97196 - RNA, 64 nt, hsa
gaagugcuuugaagauguguacccauuuuuguaaguuaaucaugauuauccuggaaaaagaaga

SEQ ID NO: 97197 - RNA, 64 nt, hsa
auauuuuguggacucagucaagcaaccacagucuguuaaucauuucucuaugcucagaugucag

SEQ ID NO: 97198 - RNA, 64 nt, hsa
uuuugggaaagggcaaaaugugucagaugcccuaguuaaucauguaauuuaauucugguauugu

SEQ ID NO: 97199 - RNA, 64 nt, hsa
auuauuuauuuuucauugugagacacuaaaaacuguuaaucagacuacagcuguuaucuuuccu

SEQ ID NO: 97200 - RNA, 64 nt, hsa
uguagcugacccuaaugugacggucauacugucgguuaaucagagaguagcaucccuucaauca

SEQ ID NO: 97201 - RNA, 64 nt, hsa
ucggucagcugacacuaaguuuuuccuguucuggguuaaucauaaggagcccccugccauagca

SEQ ID NO: 97202 - RNA, 64 nt, hsa
ccucugccuaugcaagugucuaacuucugugccuguuaaucaugggagggugagacagaacaau

SEQ ID NO: 97203 - RNA, 64 nt, hsa
cucuagguuuaacauuuuguacaaaauggaaccuguuaaucauauuaaagcacauauguauaua

SEQ ID NO: 97204 - RNA, 64 nt, hsa
gaguaaacuugaauggaauaacgacauuccagaaguuaaucauuugaauucugaacacuggaga

SEQ ID NO: 97205 - RNA, 64 nt, hsa
caucugauuuuuaaacucacgauaccaguuaucuguuaaucaaaauugcauuuuacaauuuaau

SEQ ID NO: 97206 - RNA, 59 nt, hsa
auggcguuggaaagaaaugaaaaacccugguuaaucaaagauguuccagagugccuaga

SEQ ID NO: 97207 - RNA, 64 nt, hsa
cugucuucccucucuaucggggucacuugcaauuguuaaucaaagauugaacacugcguaggag

SEQ ID NO: 97208 - RNA, 64 nt, hsa
guuguaaauuuuuucuucaguaauccauuuuauaguuaaucauaccaaauuuaaguugaugacc

SEQ ID NO: 97209 - RNA, 64 nt, hsa
aauuuucugacuuuacuauuuuaagggccagaggguuaaucacaaagagcaauuauguggucuc

SEQ ID NO: 97210 - RNA, 64 nt, hsa
cuauuauuguucccuggugaaacugaggagaaaaguuaaucaaccagguuacucccacaguuug

SEQ ID NO: 97211 - RNA, 64 nt, hsa
gagcgguaauuccaaauuauuuuucaguaagacaguuaaucagcauuauugugagagggacuga

SEQ ID NO: 97212 - RNA, 64 nt, hsa
cacaaaaccagaaguuucuacauucucuauuuuuguuaaucaucuucucuuuuuccagaauuug

SEQ ID NO: 97213 - RNA, 64 nt, hsa
ugaccaagaccaaggcccaccaaggcagcagacuguuaaucagacaaacagaucucugagaagg

SEQ ID NO: 97214 - RNA, 64 nt, hsa
cuguuggcgaaucagggauuugggagucuaugcgguuaaucaggggugucuuucuugugcaguc

SEQ ID NO: 97215 - RNA, 64 nt, hsa
ucugggguuucugauauggggauuucagccccugguuaaucagucuugucccuacaagucccug

SEQ ID NO: 97216 - RNA, 64 nt, hsa
caugucuuauucuugcccuucccccaaccaguuuguuaaucaaacaauaaaaacauguuuuuuu

SEQ ID NO: 97217 - RNA, 64 nt, hsa
auauagauguggucauguuugacuuguacagaauguuaaucauacagagaauccuugauggaau

SEQ ID NO: 97218 - RNA, 64 nt, hsa
uuaaaagaacucacauuaagcgguuacucagacaguuaaucauagaaaagauuauuugcuucau

SEQ ID NO: 97219 - RNA, 64 nt, hsa
ugcuagaaaaucauguuccuuguccugaguaagaguuaaucagaguaaaugcauuucuggaguu

SEQ ID NO: 97220 - RNA, 64 nt, hsa
uuuagaaagccaacauuuuauguuauaauaugcuguuaaucaggacuuuauuaaauaaaaacau

SEQ ID NO: 97221 - RNA, 64 nt, hsa
cuauaaucaugauacucuucuaauagacuuaaaaguuaaucauugacaacgaaaaauaaaaugu

SEQ ID NO: 97222 - RNA, 64 nt, hsa
aaauucuggaauggaaaucuagccaccaaaacggguuaaucaaaagacguccuuuuccauuuuu

SEQ ID NO: 97223 - RNA, 64 nt, hsa
aauaguuaaaguaaugagcaugaugagaguuucuguuaaucauguauuaaaacugauuuuuagc

SEQ ID NO: 97224 - RNA, 64 nt, hsa
acauguagagugucuccuuccuuuucagagaacaguuaaucaaggcaaaucagcaagcccccaa

SEQ ID NO: 97225 - RNA, 59 nt, hsa
uuuuccccauuuagguguaauuuuugucuguuaaucauucauacguuucuagguaaggu

SEQ ID NO: 97226 - RNA, 64 nt, hsa
aauucaacauuugaagaugugccuuuuggguaauguuaaucacgaauguaguaauauuucauga

SEQ ID NO: 97227 - RNA, 64 nt, hsa
cggugagggugggcgggaggccucagaggauacuguuaaucauaaaaugagcaacgacuucggc

SEQ ID NO: 97228 - RNA, 64 nt, hsa
uuacauaugaccauacaaugcacugaauugacagguuaaucauaagacauggaaagagaagugu

SEQ ID NO: 97229 - RNA, 64 nt, hsa
uuccuucuuuccuuucucuucuuuuaucuccaagguuaaucaggaaaaauagcuuuugacaggg

SEQ ID NO: 97230 - RNA, 64 nt, hsa
uuuauuuuuguaaagguauguaaguuauuaaaugguuaaucauggccuuuuaaaaauaaaauaa

SEQ ID NO: 97231 - RNA, 64 nt, hsa
aaacuugaaauaucgaccauacuggaaaaaauggguuaaucaaauaccaaacaaggugaaauuu

SEQ ID NO: 97232 - RNA, 64 nt, hsa
uuagaaauauuccaguucuccguaacaguguaaaguuaaucagaaagaaaaaauuuuauugaug

SEQ ID NO: 97233 - RNA, 64 nt, hsa
ggacgagcuauagaaaagcuauugagaguaucuaguuaaucagugcaguaguuggaaaccuugc

SEQ ID NO: 97234 - RNA, 64 nt, hsa
auaaaguuguagcaguuaaguccagucacauuugguuaaucaguguuugauauaauugaaagag

SEQ ID NO: 97235 - RNA, 64 nt, hsa
agcaacuugcaaacggacgaagagccugccguguguuaaucauuugccuuacaagauguaccag

SEQ ID NO: 97236 - RNA, 64 nt, hsa
aaaaacucaaaacauaaagaaaaaccauaauacuguuaaucauguuaaaguuaagacuuagacu

SEQ ID NO: 97237 - RNA, 64 nt, hsa
gguagaaaaagagggagucacuugaugcuuucagguuaaucagagcuaugggugcuacaggcuu

SEQ ID NO: 97238 - RNA, 64 nt, hsa
aaauacacucucuuauuuuucuacuuguuuuuuuguuaaucauagcaggauaugacaacucuua

SEQ ID NO: 97239 - RNA, 64 nt, hsa
gccuaugaaauuguuaaaccuggaacaugacauuguuaaucauauaauaaugauucuuaaaugc

SEQ ID NO: 97240 - RNA, 64 nt, hsa
auguaguaucaaauauuagaugugauuuaauaguguuaaucaauuuaaacccauuuuagucacu

SEQ ID NO: 97241 - RNA, 64 nt, hsa
uccucaguuuuuaaugaccuuuucagcaucaauuguuaaucagauuauuuuagguuuucguaaa

SEQ ID NO: 97242 - RNA, 64 nt, hsa
ggacucuaucuguggccuuguucuucauuucaguguuaaucagcuaaacagaaguuguugcuua

SEQ ID NO: 97243 - RNA, 64 nt, hsa
auguugcaaaauuuaguauccauaugcauaagaaguuaaucaccuugccagugggguggucaca

SEQ ID NO: 97244 - RNA, 64 nt, hsa
gggacagugaggaggacacaccagcccauuaguuguuaaucaucaaucacaucugauuguugaa

SEQ ID NO: 97245 - RNA, 64 nt, hsa
cgauuucuguuuagauaauacaccacuacauucuguuaaucauuaggugugacugaauuucuuu

SEQ ID NO: 97246 - RNA, 64 nt, hsa
uccucugaacaaaauguaaagccagccaugcauuguuaaucauccaucacuucccauuuuaugg

SEQ ID NO: 97247 - RNA, 64 nt, hsa
acucauguuuggaaucguaggggaacaucuggcuguuaaucacuugcacaguugagaacauuuc

SEQ ID NO: 97248 - RNA, 64 nt, hsa
caaguguuuuggguuguggacugaagcucagccuguuaaucagaccagcccaugaguguauaac

SEQ ID NO: 97249 - RNA, 64 nt, hsa
gcaaccaccccgaggaccuucaggcugcaaaccgguuaaucaagaauuuggucaaggagguggg

SEQ ID NO: 97250 - RNA, 64 nt, hsa
ggcaauuacauuuuaaaaagaaaaacagaaaaagguuaaucacaaaaccaacccucacuucaca

SEQ ID NO: 97251 - RNA, 64 nt, hsa
cucuuaggucauuuuucaauguguguaaccaaaaguuaaucagaauaaagcggaagcaccauga

SEQ ID NO: 97252 - RNA, 64 nt, hsa
uguucuuuccuuuccauaucccaguauaaucucuguuaaucaacaggacuaccccaagaaccca

SEQ ID NO: 97253 - RNA, 64 nt, hsa
uuuccacuggagucugggauuugcaauucuggagguuaaucaugcuuguacuguaauuuuacua

SEQ ID NO: 97254 - RNA, 64 nt, hsa
ccagucuuauuagauaaauuaguccauaugguugguuaaucaagagccuucuggguuugguuug

SEQ ID NO: 97255 - RNA, 64 nt, hsa
ugcccccagcugcuccucgcaguucgguuaauugguuaaucacuuaaccugcuuuugucacucg

SEQ ID NO: 97256 - RNA, 64 nt, hsa
auaucuuaagacuuccccucaacaugcugccccaguuaaucagcaaccugacucagguaacccu

SEQ ID NO: 97257 - RNA, 64 nt, hsa
auauauuuaauauaggaccuauuuugaauauucaguuaaucauaugguuccuagcuuacaaggg

SEQ ID NO: 97258 - RNA, 64 nt, hsa
gauaaaguuguauacucuacuuucauguuaaaauguuaaucaugauuacuuuaagcccacaucc

SEQ ID NO: 97259 - RNA, 64 nt, hsa
agacuuauaggugaugcaagcaucuaagagagagguuaaucacacuauagaggcauaaguggua

SEQ ID NO: 97260 - RNA, 64 nt, hsa
uccuaaacuauaaaagcagauuuugcuuuuguuuguuaaucauaggcauggccgagcauugugg

SEQ ID NO: 97261 - RNA, 64 nt, hsa
ucuuaaaggacauuaggauuggugcucagaaaugguuaaucaugcugugugcuagccagggcca

SEQ ID NO: 97262 - RNA, 64 nt, hsa
ugaguguacacaaaguuucucauauccuguucaaguuaaucaacaucaagcacauggggaugcu

SEQ ID NO: 97263 - RNA, 64 nt, hsa
augcaaauagaaauuuauaagcauuuuacuacaaguuaaucauauccuucaguagcuuauuucu

SEQ ID NO: 97264 - RNA, 64 nt, hsa
cucggccucccaaagugcugggaucaaauccacuguuaaucauuaggcugaacugucucuuaua

SEQ ID NO: 97265 - RNA, 64 nt, hsa
uggccaagccuuuaguuaucaccaauccccuacuguuaaucagagaugucccacuggauaaaaa

SEQ ID NO: 97266 - RNA, 64 nt, hsa
ucuguuuuuuaagaucuaagaaguugugaauguuguuaaucauuuagccguugcaauaaaugua

SEQ ID NO: 97267 - RNA, 64 nt, hsa
aaaucauucuacuuuugcacuuugaaagaaaggcguuaaucauaaagaagcaagaauggucaaa

SEQ ID NO: 97268 - RNA, 64 nt, hsa
aaauuacucaguuuggauaacauuauuuugugcaguuaaucaaauuugccaaagucuuuaucug

SEQ ID NO: 97269 - RNA, 64 nt, hsa
aggagguaagaccagcugggaugaccuucccuggguuaaucaauuucccucuagacaacacaaa

SEQ ID NO: 97270 - RNA, 64 nt, hsa
cuuagggaccacugaaugccccgaucccaaucagguuaaucagaaucacuuagagaacuuaaaa

SEQ ID NO: 97271 - RNA, 64 nt, hsa
aauuaauuaaaagugaaacguaauuguacaagcaguuaaucacccaccauagggcaugauuaac

SEQ ID NO: 97272 - RNA, 64 nt, hsa
auuucaagaaugaccaaaauggccucuaaaagauguuaaucaucucaaaugaccuuuugucuuu

SEQ ID NO: 97273 - RNA, 64 nt, hsa
aauuugggaaauucuggacuaagacuuaagucucguuaaucaaaucucuuuauaguuaggcuuc

SEQ ID NO: 97274 - RNA, 64 nt, hsa
gacuucugaucaaaaauacugugaaauaaagaauguuaaucaacuuuggaccuggagaugauuu

SEQ ID NO: 97275 - RNA, 64 nt, hsa
uguguuacuagccucaaaauacaucaaaaaauaaguuaaucaggaacuguacggaauauauuuu

SEQ ID NO: 97276 - RNA, 64 nt, hsa
aaagguugguucuugacucugaagggacuuuugaguuaaucagcguaaggggauuucuaaagca

SEQ ID NO: 97277 - RNA, 64 nt, hsa
ccagaaguauuguuuacauuaaacucccuuucauguuaaucaaacaagugaguagcucacgcag

SEQ ID NO: 97278 - RNA, 64 nt, hsa
uaacaggcagaacaugggagaauccuuauuccugguuaaucacuaugcauauuugaaauaaaag

SEQ ID NO: 97279 - RNA, 64 nt, hsa
gcuacauuuucgaagauuuuuuaaaaauaauauuguuaaucaguaaaaaaaaaaaauauuuuug

SEQ ID NO: 97280 - RNA, 64 nt, hsa
ucaggguauaaaaugacaucccauuaauuauauuguuaaucaaucacguguauagaaaaaaaau

SEQ ID NO: 97281 - RNA, 64 nt, hsa
uuaugcucaauggucugauuuuaacucacccgauguuaaucaaugcacauugcuuuagaucaca

SEQ ID NO: 97282 - RNA, 64 nt, hsa
uguugcaggggggcaguaacuccccaacucccucguuaaucacaggaucccacgaauuuaggcu

SEQ ID NO: 97283 - RNA, 64 nt, hsa
uauauaacauuugaacacaauuguguguguuuugguuaaucacaaauuuuguagauaacacuua

SEQ ID NO: 97284 - RNA, 64 nt, hsa
uggauuuuuagcuguagguauucagcaaugauagguuaaucacuggcaaaagcaucagaucuuu

SEQ ID NO: 97285 - RNA, 64 nt, hsa
ggaggaaagagcuagaaaaaaaaaccucaaaaaaguuaaucauugguagaugccccacaauuaa

SEQ ID NO: 97286 - RNA, 64 nt, hsa
ugcauacauacacauauauacacacacaaagagaguuaaucaacugaaaguguuuccuucauuu

SEQ ID NO: 97287 - RNA, 64 nt, hsa
ucaugcuguaugugcccgugccuguagcuucccuguuaaucagcuucuuacacuacuauauuug

SEQ ID NO: 97288 - RNA, 64 nt, hsa
uuguauuaccucuuuuuuucaagugauuuaaauaguuaaucauuuaaccaaagaagauguguag

SEQ ID NO: 97289 - RNA, 64 nt, hsa; identical to SEQ ID NO: 80001

SEQ ID NO: 97290 - RNA, 64 nt, hsa; identical to SEQ ID NO: 80002

SEQ ID NO: 97291 - RNA, 64 nt, hsa; identical to SEQ ID NO: 80003

SEQ ID NO: 97292 - RNA, 64 nt, hsa; identical to SEQ ID NO: 80004

SEQ ID NO: 97293 - RNA, 64 nt, hsa; identical to SEQ ID NO: 80005

SEQ ID NO: 97294 - RNA, 64 nt, hsa; identical to SEQ ID NO: 80006

SEQ ID NO: 97295 - RNA, 64 nt, hsa; identical to SEQ ID NO: 80007

SEQ ID NO: 97296 - RNA, 64 nt, hsa; identical to SEQ ID NO: 80008

SEQ ID NO: 97297 - RNA, 64 nt, hsa; identical to SEQ ID NO: 80009

SEQ ID NO: 97298 - RNA, 64 nt, hsa; identical to SEQ ID NO: 80010

SEQ ID NO: 97299 - RNA, 64 nt, hsa; identical to SEQ ID NO: 80011

SEQ ID NO: 97300 - RNA, 64 nt, hsa; identical to SEQ ID NO: 80012

SEQ ID NO: 97301 - RNA, 64 nt, hsa; identical to SEQ ID NO: 80013

SEQ ID NO: 97302 - RNA, 64 nt, hsa; identical to SEQ ID NO: 80014

SEQ ID NO: 97303 - RNA, 64 nt, hsa; identical to SEQ ID NO: 80015

SEQ ID NO: 97304 - RNA, 64 nt, hsa; identical to SEQ ID NO: 80016

SEQ ID NO: 97305 - RNA, 64 nt, hsa
gcugcagcccucucagaacagagggguagggagggugcaccagugcaccaggaaggcugugugg

SEQ ID NO: 97306 - RNA, 64 nt, hsa
ccucucagaacagagggguagggagggugcaccagugcaccaggaaggcugugugggucuggag

SEQ ID NO: 97307 - RNA, 64 nt, hsa
agcugcccccggcugcagcccaggccauggacaugugcaccaguauguaccugcaggcaugggg

SEQ ID NO: 97308 - RNA, 64 nt, hsa
guggguccaugggcagagcccaagggaauucggugugcaccaggguugaccccagaggauugcu

SEQ ID NO: 97309 - RNA, 64 nt, hsa
aaggacucucaggaccaaagcuuucauguaaacugugcaccaagcaggaaaugaaaaugucuug

SEQ ID NO: 97310 - RNA, 64 nt, hsa
ugccucggccucuccaguagcugggauuacaggugugcaccaccacgccuggcuaaauuuugua

SEQ ID NO: 97311 - RNA, 64 nt, hsa
cugaaauuccugaguucuuccucucaaaauuucugugcaccaguauuauuccucauuuuacaua

SEQ ID NO: 97312 - RNA, 64 nt, hsa
ggucccacgagcugccaggccaaggcugccugccgugcaccaccaccaccaccaccaccaugcu

SEQ ID NO: 97313 - RNA, 64 nt, hsa
caugguggagcugcugcugcugcagaacgcacaggugcaccaguugguccugcagaacuggaug

SEQ ID NO: 97314 - RNA, 64 nt, hsa
uucuuaccauuuuauuccccucaauucucaauauauucaguaaugaagaauggugccaccacuc

SEQ ID NO: 97315 - RNA, 64 nt, hsa
uaauuagauauauauauucauucuacgggauauuauucaguaguggaaaugagugaacuacagc

SEQ ID NO: 97316 - RNA, 64 nt, hsa
ucuuggcuucauuuccaugaagcuguuucaauauauucaguauacuuuguccuuaaugcugcuu

SEQ ID NO: 97317 - RNA, 64 nt, hsa
caaaugcauuacuguuuucaaacugcucacauuuauucaguauuucuccaaguugcuaucuacu

SEQ ID NO: 97318 - RNA, 64 nt, hsa
aaaggauaugaaaucacaggugauagcaguugucauucaguaauuuccuacaagcagcacccca

SEQ ID NO: 97319 - RNA, 64 nt, hsa
agucuagagccuuuaaaaaacccagcagaauguaauucaguauuuguuuauuggcuguuuuuug

SEQ ID NO: 97320 - RNA, 64 nt, hsa
ggcaugaauucauuauggugauacacauaugugaauucaguacauuuugagacaguauucuacc

SEQ ID NO: 97321 - RNA, 64 nt, hsa
gugaauucaguacauuuugagacaguauucuaccauucaguaauuuugguuaaugauuuuaaca

SEQ ID NO: 97322 - RNA, 64 nt, hsa
auuaaaugggaagaaagcaagcagaaauaguaaaauucaguagguuuaaaacaaucuauaaaug

SEQ ID NO: 97323 - RNA, 64 nt, hsa
cuggaagcuuugaaauuuaucagagaaugaagucauucaguacaucugauaaaguuuuguuguu

SEQ ID NO: 97324 - RNA, 64 nt, hsa
uucucacucauuaaacuuugcagaagugauucauauucaguacuguuuuuaaucacuuuuuaaa

SEQ ID NO: 97325 - RNA, 64 nt, hsa
gucugugaauguaaccaguacuucuuuaagcucuauucaguaggguuccagccacugcuuuuuu

SEQ ID NO: 97326 - RNA, 64 nt, hsa
cucauuugccauuugagaaaaugcagucugguguauucaguaauauauaguaaaguaauaauga

SEQ ID NO: 97327 - RNA, 64 nt, hsa
uuuaggacuuuuccauagugccaaagccauacauauucaguagaacaucaauaaauuacaucag

SEQ ID NO: 97328 - RNA, 64 nt, hsa
acugccauauuauauaacaaauuuacauucacaaauucaguauccuguuaagugucauauucuu

SEQ ID NO: 97329 - RNA, 64 nt, hsa
uagcaguauuauuagcauaagcugcauacguaauauucaguaacugccauauuauauaacaaau

SEQ ID NO: 97330 - RNA, 64 nt, hsa
gaaguaaaauaaugaaagauauguuaauuacuuuauucaguaaaguuuuuuaagaauguuuauc

SEQ ID NO: 97331 - RNA, 64 nt, hsa
uaauuccaugauacagaguaucuuggcauuauaaauucaguaucccaggaccuaaaccuuuaug

SEQ ID NO: 97332 - RNA, 64 nt, hsa
agcaaguggagcagggcuuagcaggagcaguuucuggccagaagcaccagccugcugccagcgg

SEQ ID NO: 97333 - RNA, 64 nt, hsa
acacucacucccaccucucaagccuccaaccucuuggccagauugggcucauuaaugucguugc

SEQ ID NO: 97334 - RNA, 64 nt, hsa
ggccugggacccagcuacucuguccaggccacuguggccagagcuggaaggcagggcagaggga

SEQ ID NO: 97335 - RNA, 64 nt, hsa
gccugcuuuuccaggauccugcaggaacgagcacuggccagagagggcccagcuguagccaugg

SEQ ID NO: 97336 - RNA, 64 nt, hsa
ccaagaucucuuacugcugcuucuccuggcuuacuggccagaaacuagcucacucaaggcugcc

SEQ ID NO: 97337 - RNA, 64 nt, hsa
gagccgggcuguggcucagguaauuuuugccauuuggccagagggaaucagagacuacaagcug

SEQ ID NO: 97338 - RNA, 64 nt, hsa
uccaguacccugucuucuagccccaccucccacuuggccagaaccaauguccauugggcauagg

SEQ ID NO: 97339 - RNA, 64 nt, hsa
ugcagaaguagaagcuggugaggggcagggucccuggccagaaggggcauggccaccucccaac

SEQ ID NO: 97340 - RNA, 64 nt, hsa
uuuucuuuagaaucagaauuguagccaguuucuuuggccagaaggaugaauacuuggauauuac

SEQ ID NO: 97341 - RNA, 64 nt, hsa
cagugaagccuccaacccuaagccacugggacgguggccagagaugccagcagccucugucgcc

SEQ ID NO: 97342 - RNA, 64 nt, hsa
cccaccuucggagacggcuucuggaggaacggcuuggccagaagacagggugugagugagacag

SEQ ID NO: 97343 - RNA, 64 nt, hsa
gcagggccuugacaggaauccagggaguagcuccuggccagaaccagccucugcggggcuugug

SEQ ID NO: 97344 - RNA, 64 nt, hsa
uuguauuuuuguuggagacgggguuucaccauauuggccagacuggucucaaacuccugggguc

SEQ ID NO: 97345 - RNA, 64 nt, hsa
acccgugggagagacacacucaggaguggccguuuggccagaaaagaaggucauggccccuggc

SEQ ID NO: 97346 - RNA, 64 nt, hsa
agggcccugggccucugcuuuccauauucacguuuggccagaguuguagucccaaagaagagca

SEQ ID NO: 97347 - RNA, 64 nt, hsa
guuugugguccgagauccuguacuaaggagggucuggccagaggaacagaccagcuuuugcaca

SEQ ID NO: 97348 - RNA, 64 nt, hsa
ggaagccuuccuggauuucacgcaucccauccucuggccagaaauggccuccgaacugugcagc

SEQ ID NO: 97349 - RNA, 64 nt, hsa
uacagagugagcuuggccaagccagcugcaaaccuggccagaggaguucuauugcaucucucac

SEQ ID NO: 97350 - RNA, 64 nt, hsa
cauucagucauguucccaggucugaggggagcaauggccagaccaguuucaguaucucuggcaa

SEQ ID NO: 97351 - RNA, 64 nt, hsa
cucugaaaagguagcucugacucuugucuuuccauggccagagugggucgucaaccucgugugg

SEQ ID NO: 97352 - RNA, 64 nt, hsa
uuguauuuuuaguagaaacagggugucaccauguuggccagacuggucucaaacuccugaccuc

SEQ ID NO: 97353 - RNA, 64 nt, hsa
aagugcugggauuauagucgugagccaccacgccuggccagaguuuuuuauuuuuaucaccacc

SEQ ID NO: 97354 - RNA, 64 nt, hsa
uugcauuuuuaguagagaugggguuucuccauguuggccagaauggucucaauuacuguugucg

SEQ ID NO: 97355 - RNA, 64 nt, hsa
ccauuagacuaugccuuuggaaggggcaauuagauggccagaaagaauucugacucccaugcac

SEQ ID NO: 97356 - RNA, 64 nt, hsa
aagugcugagauuacaguugcgagccacugugcguggccagaacuuuauaauaagagacuugaa

SEQ ID NO: 97357 - RNA, 64 nt, hsa
uuguauuuuuaguagagacggaguuucuccauguuggccagacuggucucgaacuccugaccuc

SEQ ID NO: 97358 - RNA, 64 nt, hsa
cagauaugauggcauuuauaagguggugaaauacuggccagagauuucaucaagccauggauuc

SEQ ID NO: 97359 - RNA, 64 nt, hsa
agguuuucuccugcccugcuugccggcaugaucuuggccagaauuacaucaugauucccaauga

SEQ ID NO: 97360 - RNA, 64 nt, hsa
uuucauuuuucaugagaaaagcuuuccaagugccuggccagaccuugguccuuagugcagagcc

SEQ ID NO: 97361 - RNA, 64 nt, hsa
cagagaagagcagcccugagccccuguauucugcuggccagacacacauggcacagacacagcu

SEQ ID NO: 97362 - RNA, 64 nt, hsa
ugucucccuguuaacugcaggaaugccaagcaccuggccagagcagcccagccccaauaugcuu

SEQ ID NO: 97363 - RNA, 64 nt, hsa
acugguaaggcucagccuacagaaagauuugaaauggccagagccaaucgcuuggugcauucug

SEQ ID NO: 97364 - RNA, 64 nt, hsa
gguuggagaacccagggggcugccuugggcccucuggccagagggaagcgggcagcucuagccc

SEQ ID NO: 97365 - RNA, 64 nt, hsa
gcggugugacuggucauggcacuugcuggccuucuggccagagguccuccuggaagccccuccu

SEQ ID NO: 97366 - RNA, 64 nt, hsa
auuagauucauucaucucauuugccaggacauguuggccagaggucugggcccaucccaggccu

SEQ ID NO: 97367 - RNA, 64 nt, hsa
aucaguaucucacagucccauccuuccaaccuucuggccagagguuuuccugaugggugagucg

SEQ ID NO: 97368 - RNA, 64 nt, hsa
cagagacaggggagaagggcgcccagcugucagguggccagaagcagcggguggccauggcccg

SEQ ID NO: 97369 - RNA, 64 nt, hsa
ccauagaggcucuccaaagagguccagaaugcccuggccagagcgagcaacacggcggaggaga

SEQ ID NO: 97370 - RNA, 64 nt, hsa
acugugggauagugcuccugggagccauauggcuuggccagacugcugggguugcugggugagc

SEQ ID NO: 97371 - RNA, 64 nt, hsa
cuggugcuccaggauguggcuucucaugaagcucuggccagaggaggggaacuuauugggggag

SEQ ID NO: 97372 - RNA, 64 nt, hsa
cuacuagacugccagucucaugcacccagaccuguggccagauuguggccucuggcugccucag

SEQ ID NO: 97373 - RNA, 64 nt, hsa
gccacucuuaggaaagacuauugggaguauuugcuggccagagaaugggacucuaucagcuuua

SEQ ID NO: 97374 - RNA, 64 nt, hsa
cuaguaaaaauguuuuuuucuuuuagcuuugaauuggccagaguuuauccuagauuauuuuauu

SEQ ID NO: 97375 - RNA, 64 nt, hsa
ccgagguugagacugcccuguccugcaaggucguuggccagagguagaggaaacuggucaaagu

SEQ ID NO: 97376 - RNA, 64 nt, hsa
uggcuggcucagcuccacucggguggaguggaaguggccagaccauuuagacggacaggguccu

SEQ ID NO: 97377 - RNA, 64 nt, hsa
cugccugggggaggcagacaugggagugccaagguggccagaugguuccaggacuacaaugucu

SEQ ID NO: 97378 - RNA, 64 nt, hsa
uagggaugcucuaaagcugggcucaagcaagcccuggccagagguccuaaagaugcugacuggg

SEQ ID NO: 97379 - RNA, 64 nt, hsa
gugacagaacaugcagcaaggggacaucuuaggcuggccagacuucagcuguuccuuugaaggu

SEQ ID NO: 97380 - RNA, 64 nt, hsa
ccagaccccagagcccuugugccaucuuucuuccuggccagagugaugggguuccagccauggg

SEQ ID NO: 97381 - RNA, 64 nt, hsa
gugccaacccuguacagaaucgagugcuguagccuggccagaccccagagcccuugugccaucu

SEQ ID NO: 97382 - RNA, 64 nt, hsa
uucucugugcaucuguccauccucccuauggcccuggccagagcucagcaugggcagggguucu

SEQ ID NO: 97383 - RNA, 64 nt, hsa
ccuagagaggguggggguguaguuacuucccaguuggccagaaaacugggccuugcagaccccc

SEQ ID NO: 97384 - RNA, 64 nt, hsa
cucgcagggugagaaccacuggaguggcuggggcuggccagaggucaccguuucuccuuccugu

SEQ ID NO: 97385 - RNA, 64 nt, hsa
guugccaaaccagccagggaaccaaccugggaaguggccagaacugccugggguccaagaacuc

SEQ ID NO: 97386 - RNA, 64 nt, hsa
agcucgggcugauucccccucugucccagaagguuggccagagggugugacccaguuacccuuu

SEQ ID NO: 97387 - RNA, 64 nt, hsa
aauuagcugagccaacagaccauguggacagcuuuggccagagcucccguguggcaucugggag

SEQ ID NO: 97388 - RNA, 64 nt, hsa
aaucaauggaaaggcagggaaugugccucuucuguggccagauucuguuauuugcaauuaaagc

SEQ ID NO: 97389 - RNA, 64 nt, hsa
cucucuuucuuuuuuaaacaaagaacuuugcacuuggccagagaggaggagaaagcccauuuuc

SEQ ID NO: 97390 - RNA, 64 nt, hsa
cuauugcuuaccagucuagcuugaugaagccuuuuggccagaagucaauuuguuuuggaucaga

SEQ ID NO: 97391 - RNA, 64 nt, hsa
gaaucacuuuuaugagggcuaaagauaaagaauuuggccagaaaaugcagccauccuuguguga

SEQ ID NO: 97392 - RNA, 64 nt, hsa
uccagggacccuugggaucuggggcuuccuggccuggccagagcuggagcccccacaggguaag

SEQ ID NO: 97393 - RNA, 64 nt, hsa
uucuugcuguuaggggcuaccaugggaccagcucuggccagagggaacuaagcaaauccaauag

SEQ ID NO: 97394 - RNA, 64 nt, hsa
uuagacagcccaggggaccagguggaccaggugguggccagagaggcuccaggggcuagacucc

SEQ ID NO: 97395 - RNA, 64 nt, hsa
aguccugaguucuggugugugcucccgccuccuggguauacagagagaaggcaggaaucaggag

SEQ ID NO: 97396 - RNA, 64 nt, hsa
gcagaacuguaaaaugcacaacuuuuguaaaugugguauacaggacaaacuagacggccguaga

SEQ ID NO: 97397 - RNA, 64 nt, hsa
gguaacaauaguucauuucucauaacauauaugagguauacaaaauuuucuaacuccagauugu

SEQ ID NO: 97398 - RNA, 64 nt, hsa
auaaaauauaagcacauauuuauuauauaucuaagguauacaaaucugucuacaugaaguuuac

SEQ ID NO: 97399 - RNA, 64 nt, hsa
auuucuauuuuuguagaaguaggaagugaaaauagguauacaguggauuaauuaaaugcagcga

SEQ ID NO: 97400 - RNA, 64 nt, hsa
agaucagccuugcccaugaagguugcauaugugugguauacaguuuuuaccugaaagccugagc

SEQ ID NO: 97401 - RNA, 64 nt, hsa
cagacaaauucaccuucacuuaggccccuguucugguauacauuuacugugagcuuuugccugc

SEQ ID NO: 97402 - RNA, 64 nt, hsa
uuuagaaauauaauagcugccuuagacauuaugagguauacaacuaguauuuaagauaccauuu

SEQ ID NO: 97403 - RNA, 64 nt, hsa
auuuaacaaguaacaaauucuguuguguuucccugguauacaucuuucuaggaaaaaaaaaaaa

SEQ ID NO: 97404 - RNA, 64 nt, hsa
cucugugggaaggguggggacgaggcgucgggaggguauacagggagccccucccgugcauggc

SEQ ID NO: 97405 - RNA, 64 nt, hsa
cauuuuggcagguguagcuuuuucuguuaaaaaugguauacaugaagucacauacuuuuuuaaa

SEQ ID NO: 97406 - RNA, 64 nt, hsa
guucagcugauuuguugguaagccgcacuagaaagguauacauaguaauguauauuuauuuaca

SEQ ID NO: 97407 - RNA, 64 nt, hsa
gaguauuuaaugaaaguauacauaaccaauguuggguauacagaugcuucucaacuuaugaugg

SEQ ID NO: 97408 - RNA, 64 nt, hsa
uuuaacccauuauuccucaccuacccucaaaguagguauacaaaagacuaguuuguuauuaauc

SEQ ID NO: 97409 - RNA, 64 nt, hsa
aauauauucguaaaauaggagcacauuuaguugagguauacaagguaggacucuagacaaaacc

SEQ ID NO: 97410 - RNA, 64 nt, hsa
ccguuuuuuaauugccaugagccaaauacuucuugguauacaauugauccauuuauuuuaaugg

SEQ ID NO: 97411 - RNA, 64 nt, hsa
uucguuuggcuuguauguugaugaaaucaacuuagguauacaauauaaaaaauaaagacccuga

SEQ ID NO: 97412 - RNA, 64 nt, hsa
uuacagcacaucuuuuuuuuggaugugggauggagguauacaauguucuguuguaaagagugga

SEQ ID NO: 97413 - RNA, 64 nt, hsa
ugcuacuugguggguuuuucuccguaugcacauugguauacagucucugagaacuggcuuggug

SEQ ID NO: 97414 - RNA, 64 nt, hsa
uuauagccuuauuaguugugugguugacccuugggguauacaaaugucagucugaguggugucu

SEQ ID NO: 97415 - RNA, 64 nt, hsa
gaaugaggagcagcaagucauaaccacucccuuggguauacaauuugcuguguagugaagugga

SEQ ID NO: 97416 - RNA, 64 nt, hsa
uuugaagaacucgacuuuaugugaucaugguauugguauacaugugggguggagaacuuauuuu

SEQ ID NO: 97417 - RNA, 64 nt, hsa
uuauuaagcaccgauaauagguagccugcugugggguauacagcauugacucagauauagaucc

SEQ ID NO: 97418 - RNA, 64 nt, hsa
aaucagugcaaacacaucuucuguuaaacccauugguauacacagaauauuccugugcccacac

SEQ ID NO: 97419 - RNA, 64 nt, hsa
cuuucuagaaaauuugaagccauuacuuccagcugguauacaggauaaacuacauacacugauc

SEQ ID NO: 97420 - RNA, 64 nt, hsa
aaugcucccuuuaaccauauaauuaaauuacaaagguauacauaauuaaucuaauaaaggauca

SEQ ID NO: 97421 - RNA, 64 nt, hsa
uuaacaccaucuuacuaaccauuauugcuauggugguauacacugccuaugucuuuauuccaau

SEQ ID NO: 97422 - RNA, 64 nt, hsa
aaaacaaagauauucaaacugcuuggguucaaaugguauacaauuugccagcuguuacugaacc

SEQ ID NO: 97423 - RNA, 64 nt, hsa
accuagaucugucagcuaagcuaauuuuauauuugguauacaugcaugucaaauaaaguuaauu

SEQ ID NO: 97424 - RNA, 64 nt, hsa
uaaaaguauugagggggcaaaaauuaccaauuaugguauacaaaaauaagccuauaaauguguu

SEQ ID NO: 97425 - RNA, 64 nt, hsa
gagcccucgcucguccacggucuucugcaucacugguauacacacucguuagcguccauuucuu

SEQ ID NO: 97426 - RNA, 64 nt, hsa
ugccauagguguguauguguauaugugugcgugugguauacaaaugaugaccauuguauuaaaa

SEQ ID NO: 97427 - RNA, 64 nt, hsa
ggugaucacaucaggcccuaucuaagaagcucaugguauacaagggucacccaaauagcugagu

SEQ ID NO: 97428 - RNA, 64 nt, hsa
uuaauccccauauucuucuacugcccuuaacucugguauacaccaaaaagaaaucuuuacuuuc

SEQ ID NO: 97429 - RNA, 64 nt, hsa
uacaugugauguuaguaggugugauaugcaaccugguauacagacauuugugcaauuucauuuc

SEQ ID NO: 97430 - RNA, 64 nt, hsa
gaguucucgaagaaaauaaaugacuuuaggaagagguauacauuuuuuaagucgcucugccucc

SEQ ID NO: 97431 - RNA, 64 nt, hsa
agaguaaaagaaaaacuaagagaucaaacugagagguauacaugaggcuaguguuugcauuccu

SEQ ID NO: 97432 - RNA, 64 nt, hsa
cuugccuccccaggaaagaaggaauugcauccaagguauacauacauauucaucgauguuucgu

SEQ ID NO: 97433 - RNA, 64 nt, hsa
ucucuuuuuucuuccucugacuucgaaaauuguugguauacauuucaaccaaaaugaccucauu

SEQ ID NO: 97434 - RNA, 64 nt, hsa
ugggugcagcuauaugauuaauucugcccaauaggguauacagagacauguccugggugacaug

SEQ ID NO: 97435 - RNA, 64 nt, hsa
cauuugcagaaaccauuaagcaguuacauauuuagguauacacacacacacacacacacauaca

SEQ ID NO: 97436 - RNA, 64 nt, hsa
uccucaaacacacaaacuauuacuuacaaacugcgguauacauuuuacauauggaaauauaggc

SEQ ID NO: 97437 - RNA, 64 nt, hsa
gaaagaucuucaucaacaucuguaucuuuccagagguauacagaauuaaaauuugaucuucaag

SEQ ID NO: 97438 - RNA, 64 nt, hsa
aaugccuguucagggcugguuuucugcaugcacggguauacacauaaugcagugccaugcacau

SEQ ID NO: 97439 - RNA, 64 nt, hsa
gucauacgcuaaaaugauauuggucuuugaauuugguauacauuuauucuguucacuaucacaa

SEQ ID NO: 97440 - RNA, 64 nt, hsa
uuguuugauuuuuuuuuacaagcuaacuguuagagguauacauuuauuuaucuguuguacagau

SEQ ID NO: 97441 - RNA, 64 nt, hsa
uauuuugaagagaaaugguuugugguuguccagugguauacaacugacaggcauuucauuaagc

SEQ ID NO: 97442 - RNA, 64 nt, hsa
caaacacagaauuugauuggauuuguuauucauugguauacaacaauuuuuauucuuaugugug

SEQ ID NO: 97443 - RNA, 64 nt, hsa
ucuacagaccacacucuaguuguuuuccaugaaagguauacaaaugaagaauuuucuagcaaaa

SEQ ID NO: 97444 - RNA, 64 nt, hsa
aaacgauucuuguaccucagccugcugaguagcugguauacaggcacaucgccgccacacccag

SEQ ID NO: 97445 - RNA, 64 nt, hsa
ucaccauguauguggugaauuucguaagguacuugguauacauaucugccuauguuucuuuuca

SEQ ID NO: 97446 - RNA, 64 nt, hsa
caauuucccaaaauaaaauccuuuuuuguaugaugguauacaguuuucaguaaugauguauaca

SEQ ID NO: 97447 - RNA, 64 nt, hsa
auuuaugaaaauaguuucauugucauuuauuggcgguauacaaaguaaaauguuauaaauguga

SEQ ID NO: 97448 - RNA, 64 nt, hsa
gauuuuucucuuugugcaggcuucuuaugccguugguauacagggcaggaaagagaggaauaaa

SEQ ID NO: 97449 - RNA, 64 nt, hsa
gaacuuauguguuuuaauuguauaauuuuugugagguauacauauuguggaauugacucaaaaa

SEQ ID NO: 97450 - RNA, 64 nt, hsa
auuaugaaaaucaagaauagcaagaaacuauauagguauacacuuacgacuucacaaaaccuau

SEQ ID NO: 97451 - RNA, 64 nt, hsa
ugucggugagaugguguggugaugaagccugcuggguauacagcucagggaaagucaucgauga

SEQ ID NO: 97452 - RNA, 64 nt, hsa
uauauaacucuuugagccuuuauugguaaauucugguauacauugaauucauuauaauuugggu

SEQ ID NO: 97453 - RNA, 64 nt, hsa
uaacauaaggcauguagccauauuuucauauagugguauacaacacaguaucauugcaaaugca

SEQ ID NO: 97454 - RNA, 64 nt, hsa
uaauaaguuuggcaagguugcaagauauaaaauugguauacaaauugcaguggcuaggaccucc

SEQ ID NO: 97455 - RNA, 64 nt, hsa
uauaauuaguuuuaauaaaacaugcugcaaccaugguauacaacaaaaauacauuucuuuggug

SEQ ID NO: 97456 - RNA, 64 nt, hsa
gaucaggggguugcaacaauuggguuaaacuuuggguauacauuggaagcaccagggcauguuu

SEQ ID NO: 97457 - RNA, 64 nt, hsa
auuuaugauauagcuuauaugauuuuuuugccuugguauacauuuuaaaauaugaauuuaaaaa

SEQ ID NO: 97458 - RNA, 64 nt, hsa
cuggaauuucccaccuuccgugguguggguaaaugguauacauaaacauuaaaccuuaaccaaa

SEQ ID NO: 97459 - RNA, 64 nt, hsa
auagggauaagauuuuuuguaggcacaagaccaagguauacaucuuccccuaaugccuaucuga

SEQ ID NO: 97460 - RNA, 64 nt, hsa
uugugaaccuuugaacuauauguauguguauaaggguauacacauacauauauggcauauaaca

SEQ ID NO: 97461 - RNA, 64 nt, hsa
cagguuaagacuagaaagucugaguuauguuuuagguauacaugaucgucugaguggucauaac

SEQ ID NO: 97462 - RNA, 64 nt, hsa
gaaagugcaaacaauucuuuggauuauuaaauaagguauacaguaugcaugguuucucaaauuu

SEQ ID NO: 97463 - RNA, 64 nt, hsa
uuguguuugugguuuaggagcugcugacacugcugguauacacagggccaaaacccacuaagau

SEQ ID NO: 97464 - RNA, 64 nt, hsa
uuacucuuuguaccucuauugugccuauauuaaagguauacaaauaaauaaggccaugucugac

SEQ ID NO: 97465 - RNA, 64 nt, hsa
caaagugcguguguguaugugugagugggugcgugguauacauguguacauauauguauaauau

SEQ ID NO: 97466 - RNA, 64 nt, hsa
uugaagagucuacauucagaacauaaaagcacuagguauacaaguuugaaauaugauuuaagca

SEQ ID NO: 97467 - RNA, 64 nt, hsa
aaguagaacaaauguggcaaguaggacuccuaucgguauacaaauuccauuucuuuuuauaaga

SEQ ID NO: 97468 - RNA, 64 nt, hsa
acccuagaguuaaucucuuuugggaacauaaggagguauacagaacugcagaccucuaaacaua

SEQ ID NO: 97469 - RNA, 64 nt, hsa
gacucuacacucaacacacucuaaucuacuuaaagguauacaaaauaugcugaucuuuuuuaaa

SEQ ID NO: 97470 - RNA, 64 nt, hsa
aaagacagcagggacaagauacauaugaggacaagguauacacccaguucugaauaacuugaag

SEQ ID NO: 97471 - RNA, 64 nt, hsa
aauauuguuaauacugaacuugcagguccagguugguauacauuccacccucuagaaguauuuu

SEQ ID NO: 97472 - RNA, 64 nt, hsa
uuacugcacuuauguguaaucagaucuuuauuuagguauacauauccuccuauaccgcacauaa

SEQ ID NO: 97473 - RNA, 64 nt, hsa
aauuuacaugauucauauucauuaugcauuacuugguauacagacuuauuuucauaaugcaaau

SEQ ID NO: 97474 - RNA, 64 nt, hsa
ugcaauuucugauuugcugugaaaucagaaagcagguauacacuuuuggguuuucuguuuguuu

SEQ ID NO: 97475 - RNA, 64 nt, hsa
agcaauagaauaaagaauguguguuuucuuuccugguauacauacaugaucccaugcucccaag

SEQ ID NO: 97476 - RNA, 64 nt, hsa
uaccaagauaauguaauuacauuugguuuuguaagguauacagcaguaaucuccuauuuuggug

SEQ ID NO: 97477 - RNA, 64 nt, hsa
aagugauauaauuuugaccuguguagaacucucugguauacacuggcuauuuaaccaaaugagg

SEQ ID NO: 97478 - RNA, 64 nt, hsa
aaggcuacagcagagugauuucagcuuccaaacugguauacauuccaaacugauaguacauugc

SEQ ID NO: 97479 - RNA, 64 nt, hsa
uuacaagucucgcuuauuaucucacugguauuuagguauacaaaacaguugauuauucaccacg

SEQ ID NO: 97480 - RNA, 64 nt, hsa
auucauugauucucuuuuccuuccacaauaaaaugguauacaagaacaggagugugugugacgu

SEQ ID NO: 97481 - RNA, 64 nt, hsa
gcuauucagucuuaauuucacuaguaguauaauggguauacauuuuuguaaauagcauccccaa

SEQ ID NO: 97482 - RNA, 64 nt, hsa
uguuucucuguaucuguagcauagcauagaacccgguauacagggguuucugcugacacaucaa

SEQ ID NO: 97483 - RNA, 55 nt, hsa
uccuuuucagugguguguagcagcagguauacaggaaaauguugaagagccccag

SEQ ID NO: 97484 - RNA, 64 nt, hsa
ggauggggcaaggugguggggacuaggggagccugguauacaugcggcuucauugccaauaaau

SEQ ID NO: 97485 - RNA, 64 nt, hsa
gagcuucucccccucacccauuccuagugcucuugguauacacuugggaaaauaauguccucca

SEQ ID NO: 97486 - RNA, 64 nt, hsa
gugaagagacugcaugauuaaacuagauagaccugguauacagucacugaacuaguagauguca

SEQ ID NO: 97487 - RNA, 64 nt, hsa
gguuucaggcaagguauuaaugauacaauuccgugguauacagcuccugugacauuugaaguuu

SEQ ID NO: 97488 - RNA, 64 nt, hsa
cagguuugggcaaaauuaauccacaggacugaaagguauacaucugugaguuuuguucucacuu

SEQ ID NO: 97489 - RNA, 64 nt, hsa
gucugauuagccaaucucaccacccaaauggggagguauacauguuugaagaacuguguaacuc

SEQ ID NO: 97490 - RNA, 64 nt, hsa
uuucuguacaucaccaaguaucuuuggcauucuugguauacaaaguauaucacaauuuuaagug

SEQ ID NO: 97491 - RNA, 64 nt, hsa
gucaugaggaugaaagaauggcauuaaagcauuugguauacaguaggugcucaauaaauugcua

SEQ ID NO: 97492 - RNA, 64 nt, hsa
uccuuacauauuuuugcauauuaacccuuuaucagguauacagcuugcaacuauuuucucccau

SEQ ID NO: 97493 - RNA, 64 nt, hsa
uuuguggcagucuguguguguaauagugguguaggguauacagagagguggguaguuguagaua

SEQ ID NO: 97494 - RNA, 64 nt, hsa
cccggccugauguuuuugaaugauuaugaaaauggguauacagcauuaaaaccuuagacugauu

SEQ ID NO: 97495 - RNA, 64 nt, hsa
agagcaggcacagaaggaccagugaggaagucaggguauacaugcaauaaauggagguguugag

SEQ ID NO: 97496 - RNA, 64 nt, hsa
aggcccagacaccccagaagggcaagcucuccuggguauacauuuucucauucaaucuucuccu

SEQ ID NO: 97497 - RNA, 64 nt, hsa
uggugcauauacgcccuugagcuacuucaaaugugguauacaauucuuuuuccuucuacagcau

SEQ ID NO: 97498 - RNA, 64 nt, hsa
ugcagccucuuuuugccugagcaagugggaccuugguauacacaucaccuguucuuucccuuuu

SEQ ID NO: 97499 - RNA, 64 nt, hsa
ucucauaauaaaucaucucaucacaaaucaauacgguauacagaguuaaaguggaaugagguaa

SEQ ID NO: 97500 - RNA, 64 nt, hsa
uuuagcuuaauauggacacugacacauuuugggggguauacauuagacauaucagagcagugua

SEQ ID NO: 97501 - RNA, 64 nt, hsa
uaaaguuugauauguauagaauauaauugaaggagguauacacauauugauguuguuuugauua

SEQ ID NO: 97502 - RNA, 64 nt, hsa
uuucuccaaauacaauagaggagaauauguaaaggguauacauuaauugguacguagcauuuaa

SEQ ID NO: 97503 - RNA, 64 nt, hsa
ugcuuuuuuaaaaaaagcgcugaaguuagaccaagguauacaguuuuguucuaacagacauuua

SEQ ID NO: 97504 - RNA, 64 nt, hsa
aaacacuggcuuuacaggguucucagagaugugggguauacacuguccugcagugagauaguag

SEQ ID NO: 97505 - RNA, 64 nt, hsa
gucaauaaugacccuuuugaggguauggagagaugguauacagcagguaacugugaauugcaga

SEQ ID NO: 97506 - RNA, 64 nt, hsa; identical to SEQ ID NO: 83525

SEQ ID NO: 97507 - RNA, 64 nt, hsa; identical to SEQ ID NO: 83526

SEQ ID NO: 97508 - RNA, 64 nt, hsa; identical to SEQ ID NO: 83527

SEQ ID NO: 97509 - RNA, 64 nt, hsa; identical to SEQ ID NO: 83528

SEQ ID NO: 97510 - RNA, 64 nt, hsa; identical to SEQ ID NO: 83529

SEQ ID NO: 97511 - RNA, 64 nt, hsa; identical to SEQ ID NO: 83530

SEQ ID NO: 97512 - RNA, 64 nt, hsa; identical to SEQ ID NO: 83531

SEQ ID NO: 97513 - RNA, 64 nt, hsa; identical to SEQ ID NO: 83532

SEQ ID NO: 97514 - RNA, 64 nt, hsa; identical to SEQ ID NO: 83533

SEQ ID NO: 97515 - RNA, 64 nt, hsa; identical to SEQ ID NO: 83534

SEQ ID NO: 97516 - RNA, 64 nt, hsa; identical to SEQ ID NO: 83535

SEQ ID NO: 97517 - RNA, 64 nt, hsa; identical to SEQ ID NO: 83536

SEQ ID NO: 97518 - RNA, 64 nt, hsa; identical to SEQ ID NO: 83537

SEQ ID NO: 97519 - RNA, 64 nt, hsa; identical to SEQ ID NO: 83538

SEQ ID NO: 97520 - RNA, 64 nt, hsa; identical to SEQ ID NO: 83539

SEQ ID NO: 97521 - RNA, 64 nt, hsa; identical to SEQ ID NO: 83540

SEQ ID NO: 97522 - RNA, 64 nt, hsa; identical to SEQ ID NO: 83541

SEQ ID NO: 97523 - RNA, 64 nt, hsa; identical to SEQ ID NO: 83542

SEQ ID NO: 97524 - RNA, 64 nt, hsa; identical to SEQ ID NO: 83543

SEQ ID NO: 97525 - RNA, 64 nt, hsa; identical to SEQ ID NO: 83544

SEQ ID NO: 97526 - RNA, 64 nt, hsa; identical to SEQ ID NO: 83545

SEQ ID NO: 97527 - RNA, 64 nt, hsa; identical to SEQ ID NO: 83546

SEQ ID NO: 97528 - RNA, 64 nt, hsa; identical to SEQ ID NO: 83547

SEQ ID NO: 97529 - RNA, 64 nt, hsa; identical to SEQ ID NO: 83548

SEQ ID NO: 97530 - RNA, 64 nt, hsa; identical to SEQ ID NO: 83549

SEQ ID NO: 97531 - RNA, 64 nt, hsa; identical to SEQ ID NO: 83550

SEQ ID NO: 97532 - RNA, 64 nt, hsa; identical to SEQ ID NO: 83551

SEQ ID NO: 97533 - RNA, 64 nt, hsa; identical to SEQ ID NO: 83552

SEQ ID NO: 97534 - RNA, 64 nt, hsa; identical to SEQ ID NO: 83553

SEQ ID NO: 97535 - RNA, 64 nt, hsa; identical to SEQ ID NO: 83554

SEQ ID NO: 97536 - RNA, 64 nt, hsa; identical to SEQ ID NO: 83555

SEQ ID NO: 97537 - RNA, 64 nt, hsa; identical to SEQ ID NO: 83556

SEQ ID NO: 97538 - RNA, 64 nt, hsa; identical to SEQ ID NO: 83557

SEQ ID NO: 97539 - RNA, 64 nt, hsa; identical to SEQ ID NO: 83558

SEQ ID NO: 97540 - RNA, 64 nt, hsa; identical to SEQ ID NO: 83559

SEQ ID NO: 97541 - RNA, 64 nt, hsa; identical to SEQ ID NO: 83560

SEQ ID NO: 97542 - RNA, 64 nt, hsa; identical to SEQ ID NO: 83561

SEQ ID NO: 97543 - RNA, 64 nt, hsa
uagcuggaugcugucagaggcgauggagaaacgcaaaggcuacuagacgcaacaauagaauuac

SEQ ID NO: 97544 - RNA, 64 nt, hsa
uugaaauucuacuaaguuuucccauauucuugauaaaggcuaaauuugaaauaauuuauuuaga

SEQ ID NO: 97545 - RNA, 64 nt, hsa
cauauccuucacauauuucccauaagccccucagaaaggcuaacugugaugaugacacuuuggu

SEQ ID NO: 97546 - RNA, 64 nt, hsa
aauguauuugucauguuaaaaaguguuagccacaaaaggcuacuuacuuucuuuuccuuuuccu

SEQ ID NO: 97547 - RNA, 64 nt, hsa
uaaauauagaaguguugcauguauaggauuucauaaaggcuaauugcauaagaaagaguaaaca

SEQ ID NO: 97548 - RNA, 61 nt, hsa
gggcacaguaugcaauuuaaggaaaacccccaaaggcuacaggcgaccugcugaucaggaa

SEQ ID NO: 97549 - RNA, 64 nt, hsa
uuaccacugugaggcaagcugaggugaacauuuaaaaggcuauuucaagacgaggugcgguggc

SEQ ID NO: 97550 - RNA, 64 nt, hsa
cuacuggcgccucaaccagcagcuucgaguagagaaaggcuaucccagaaauauuucccacaac

SEQ ID NO: 97551 - RNA, 64 nt, hsa
acugguuggguugaccaguaaguagaaaaaggcuaaaggcuaugcgauaugaauuucagaaaug

SEQ ID NO: 97552 - RNA, 64 nt, hsa
caacaguacugguuggguugaccaguaaguagaaaaaggcuaaaggcuaugcgauaugaauuuc

SEQ ID NO: 97553 - RNA, 64 nt, hsa
guccggcuccaucggcacuaccaccccgcuccaucaucacuauguccagcuccgucggcacuac

SEQ ID NO: 97554 - RNA, 64 nt, hsa
guccagcuccgucggcacuaccacccugcuccaucaucacuacguccagcuccaacggcacugg

SEQ ID NO: 97555 - RNA, 64 nt, hsa
guuuccaaauggaugaauuuucauuuggacauuacaucacuaaauucauuagauuuugucugca

SEQ ID NO: 97556 - RNA, 64 nt, hsa
cucaguaaagcaaugaacugcuugcuuagagaagcaucacuauccccauugagaaaaaugugug

SEQ ID NO: 97557 - RNA, 64 nt, hsa
aauuuuacaauugugaaaaccucauggauuugggcaaacugaauguauauaggcuuuugacaaa

SEQ ID NO: 97558 - RNA, 64 nt, hsa
gaaaggcaaacauaggucugggcauuaaauuauacaaacugaaaauguguuacaagaaaaauau

SEQ ID NO: 97559 - RNA, 64 nt, hsa
aggaagggcugcuaucaaaccuaccuuuuuugagcaaacugagacuaaacuucucucuuuucaa

SEQ ID NO: 97560 - RNA, 64 nt, hsa
uuuuucuaaacagaaauuauuuucuauuaauuugcaaacugaugauuucacuuuuuuuuacuuu

SEQ ID NO: 97561 - RNA, 64 nt, hsa
accauuagaagcaaaauuaaaaguacaagcugggcaaacugacagaauacuagauaggagagac

SEQ ID NO: 97562 - RNA, 64 nt, hsa
uuggauugugagaaaguaccaaguaccagccguccaaacugaucacaauuaaaauucugacagu

SEQ ID NO: 97563 - RNA, 64 nt, hsa
acuuucaugcuucugggguuggagcuuaaagauccaaacugagaaagcaggccgggcauggugg

SEQ ID NO: 97564 - RNA, 64 nt, hsa
uagaaagguuugguuugaaaugccccgggggcagcaaacugacaugguugaaugauagcauuuc

SEQ ID NO: 97565 - RNA, 64 nt, hsa
ccuucauucagggcauauuuuuucuucccaggaucaaacugaaaacauguuaaggcuauaguuu

SEQ ID NO: 97566 - RNA, 64 nt, hsa
aaagauuuagaagauauuuuggagauaaacaagacaaacugagucaauuuaacaauccugacau

SEQ ID NO: 97567 - RNA, 62 nt, hsa
acauguguuugguuucugauucaagugacacgcacaaacugaaaaaaaaaaaacaaaaaaag

SEQ ID NO: 97568 - RNA, 64 nt, hsa
ggcuagaaaaaaauaaugguaguaaagaaacugacaaacugaaaauaagaaaacaaaaaucaaa

SEQ ID NO: 97569 - RNA, 64 nt, hsa
aaaaauuaaaagaagaggaagaaagagaaauaaucaaacugaccaugaaguaagcagcacuuaa

SEQ ID NO: 97570 - RNA, 64 nt, hsa
caucagucaugugaaguauuugucuaaaacagagcaaacugaagaccaaauuauucuccuguug

SEQ ID NO: 97571 - RNA, 64 nt, hsa
cuuuuaaguacccccuuuccuccucacccaccuccaaacugacuagcacucagagggacuuaug

SEQ ID NO: 97572 - RNA, 64 nt, hsa
ggggaaguccagaugcggguuaucuugaaagaaacaaacugacauucuaggcagacaguugucu

SEQ ID NO: 97573 - RNA, 64 nt, hsa
ccucccacuuucaccagagcagccucacugugcccugauucacacacuguggcuuuccacguga

SEQ ID NO: 97574 - RNA, 64 nt, hsa
gccacugaacucccccaucccagggcucagccuccugauucauggguccccuaguuaggcccag

SEQ ID NO: 97575 - RNA, 64 nt, hsa
agaaacagcacucugguuauaauugccccagggccugauucaggacugacucuccaccauaaaa

SEQ ID NO: 97576 - RNA, 64 nt, hsa
ggaagugcauccucugggaaaaagauaauggcuucugauucaacauagccauaguccuuugaag

SEQ ID NO: 97577 - RNA, 64 nt, hsa
ucagacgugucauuagaacaugaguccucugcuucugauucaggcauacuuuugggauucuucc

SEQ ID NO: 97578 - RNA, 64 nt, hsa
cauagaaaacuguaaaagauaaaucaggagauggcugauucauaauggguaauaaaauaaauag

SEQ ID NO: 97579 - RNA, 64 nt, hsa
agaacaugaugguuggucucuaauauauuuggaacugauucauaagaaaaguuauuaaaauuau

SEQ ID NO: 97580 - RNA, 64 nt, hsa
aucagucaagagaguaacugaaagaccugcgggacugauucacguggggagaauguucacagca

SEQ ID NO: 97581 - RNA, 64 nt, hsa
acaaaaacaacaguccuacuccgauguuaucuuucugauucaaugugaauccaucuuuccuugc

SEQ ID NO: 97582 - RNA, 64 nt, hsa
uuguguucaguuaaguuuaccuggguauuuuguccugauucacugccaauugucacauuuuaag

SEQ ID NO: 97583 - RNA, 64 nt, hsa
cauaaauuauucagauaauuaacacugcaugaaucugauucagaggcaugcauuuacauauguu

SEQ ID NO: 97584 - RNA, 64 nt, hsa
uucaucuguuugaagccugaaauaauuuaggacucugauucacugaccaaaagucaguguugca

SEQ ID NO: 97585 - RNA, 64 nt, hsa
ggcugauucaaucaagauccgugcucgcagugggcugauucaaucaagauguauguuugcuaug

SEQ ID NO: 97586 - RNA, 64 nt, hsa
aagauguauguagaccuaaaacuacaccaauaggcugauucaaucaagauccgugcucgcagug

SEQ ID NO: 97587 - RNA, 64 nt, hsa
ggcuggggcucuccgugguguucuggacccagccccuggagacaccauucacuuuuacugcuuu

SEQ ID NO: 97588 - RNA, 64 nt, hsa
cuccauggcuggucaugagagcaaaccguaguccccuggagacagcgacuccagagaaccucuu

SEQ ID NO: 97589 - RNA, 64 nt, hsa
ugucaugaagugcacaggagccaaaugaccgagcccuggagagccccaugguggguaggugguu

SEQ ID NO: 97590 - RNA, 64 nt, hsa
ccccucugcugccggcucugggccugaggguccaccuggagaguacauuugcuuuaaugagugc

SEQ ID NO: 97591 - RNA, 64 nt, hsa
cacaggacagacccuuucuccaccacagccaaggccuggagacugggggcccagcagagccugc

SEQ ID NO: 97592 - RNA, 64 nt, hsa
gccaagaggcuggaacauagugucugccucgcuuccuggagauaguaacugagcaggggcuaca

SEQ ID NO: 97593 - RNA, 64 nt, hsa
gccaccacugaguccacucggagugcccuguguuccuggagaaggcauuccaggguugaaucuu

SEQ ID NO: 97594 - RNA, 61 nt, hsa
gcaaggccgccaggcacugagcuggagcccgccuggagagacagacacgugugagugguca

SEQ ID NO: 97595 - RNA, 64 nt, hsa
uaaacaauaaagacuuuaccugucuaauggaaaaccuggagaagucgucaggaaccagacuaca

SEQ ID NO: 97596 - RNA, 64 nt, hsa
uggagaagucgucaggaaccagacuacaguggacccuggagaaccuugaagaacauuuuuccuu

SEQ ID NO: 97597 - RNA, 64 nt, hsa
cagacagagaggacuguagggagggcggcaggggccuggagauccuccugcagaccacgcccgu

SEQ ID NO: 97598 - RNA, 64 nt, hsa
ugcugggagcuccacucugcuucucugacuucugccuggagacuuagggcaccagggguuucuc

SEQ ID NO: 97599 - RNA, 64 nt, hsa
aguuucaagaugaagaacuacaugauacaguggaccuggagaccauccccuuggaaagacaacc

SEQ ID NO: 97600 - RNA, 64 nt, hsa
uuaggacuacccaugaauguuguggaaugcuacaccuggagaguucugguuuuccaccaguuuc

SEQ ID NO: 97601 - RNA, 64 nt, hsa
cuucacacaccacagccaggaggggccuuucccaccuggagagaaacuuccagaccagccccuc

SEQ ID NO: 97602 - RNA, 64 nt, hsa
ccccucauaccacagccaagaggggccuuucucaccuggagagaaauuuccagaccauccccuc

SEQ ID NO: 97603 - RNA, 64 nt, hsa
ccccucacaccacagccaagagaagccuuuccagccuggagagaaacuuccagaccagcccucu

SEQ ID NO: 97604 - RNA, 64 nt, hsa
ccccucucaccacagccaggagaggccuuuaccaccuggagagaagcuuccagaccagccccuc

SEQ ID NO: 97605 - RNA, 64 nt, hsa
ccccucacaccacagccaggagaggccuuucccaccuggagagaaacuuccagaccagccccuc

SEQ ID NO: 97606 - RNA, 64 nt, hsa
ccccucauaccacagccaagaggggccuuucucaccuggagagaaacuuccagaccagccccuc

SEQ ID NO: 97607 - RNA, 64 nt, hsa
ccccucacaccacagccaggagaggccuuucccgccuggagagaagcuucaggccagcuccuca

SEQ ID NO: 97608 - RNA, 64 nt, hsa
cuccucacaccacagccaggagagaccuuuucugccuggagagaaacuuucagaccagccccac

SEQ ID NO: 97609 - RNA, 64 nt, hsa
ccccacacaccacagccaggagaggccguuccugccuggagagaagcuuccagaccagcccuuc

SEQ ID NO: 97610 - RNA, 64 nt, hsa
cccuucacaccacagccaggagaggccuuucccaccuggagagaaacuuccagaccagccccuc

SEQ ID NO: 97611 - RNA, 64 nt, hsa
aucuucuggauuuuugccuggacccuucugcaagccuggagacuggaccugccacauguuccaa

SEQ ID NO: 97612 - RNA, 64 nt, hsa
uagagcaagagcucugggggggccggaaagucucccuggagaaggccguaauaucugggccuug

SEQ ID NO: 97613 - RNA, 64 nt, hsa
cucugugcauuuaagcuacuuguagagacccaggccuggagaguagacauuuugccucugauaa

SEQ ID NO: 97614 - RNA, 64 nt, hsa
gugugcaccaggguucaguagaguccacuucugcccuggagaccacaaaucaacuagcuccauu

SEQ ID NO: 97615 - RNA, 64 nt, hsa
accggugcccaaaucuggcugguggacagaagcaccuggagaguuggagagcuuuuuaaaaaga

SEQ ID NO: 97616 - RNA, 64 nt, hsa
aauuaaugcauuuucauuuccuacugauacaaggccuggagagggcuguugggggcccucaggg

SEQ ID NO: 97617 - RNA, 64 nt, hsa
uuucagggggguugugaggccuggccaggcacccccuggagagaaguuucuggcccuggcugac

SEQ ID NO: 97618 - RNA, 64 nt, hsa
agagaaguuucuggcccuggcugaccccaaagagccuggagaagcugaugcuuugcuucaaauc

SEQ ID NO: 97619 - RNA, 64 nt, hsa
ugugaacccgcgaaggccucaggauuaugguuaaccuggagaggagcaggccauggaggcaggu

SEQ ID NO: 97620 - RNA, 64 nt, hsa
acuguugccacucuccuccccagacuaugaaaucccuggagaauuuuuggugacaugcacugag

SEQ ID NO: 97621 - RNA, 64 nt, hsa
uuuugccaccuuuccuguucaugacagcuacuaaccuggagacaguaacauuucauuaaccaaa

SEQ ID NO: 97622 - RNA, 64 nt, hsa
ggcucuaacauuacugccuucaguaucaaggcugccuggagaaaggauggcagccucagggcuu

SEQ ID NO: 97623 - RNA, 64 nt, hsa
caacaggcuacagugucccugauucuuggaaaagccuggagaagcuggggagaugcgguucaca

SEQ ID NO: 97624 - RNA, 64 nt, hsa
cgcuucccuuucuacuccagcagcaggaagauagccuggagaaggugauuaaagauacggaguc

SEQ ID NO: 97625 - RNA, 64 nt, hsa
cuucauuguaauggaaguuucaguugggcaugagccuggagagaugugacugucuacaguucua

SEQ ID NO: 97626 - RNA, 64 nt, hsa
ugguagucaccuucaugucaucuauaauaguacuccuggagagcccuggcugccuacaccagug

SEQ ID NO: 97627 - RNA, 64 nt, hsa
uuuauugcucagaaaugaggcauauccuaaaaauccuggagagcuguauuuaaugcauuuuugc

SEQ ID NO: 97628 - RNA, 64 nt, hsa
uuggauuacuggauuuuuuuuuuuuuuaaacacaccuggagaggacauuugaaaacacuguucu

SEQ ID NO: 97629 - RNA, 64 nt, hsa
uaaagguuaagcccugaggggucccugauaacaaccuggagaccaggauuuuauggcuccccuc

SEQ ID NO: 97630 - RNA, 64 nt, hsa
aaugaauauuuauuagcugguuggagagcuagaaccuggagagcuagaaccuggagaacuagaa

SEQ ID NO: 97631 - RNA, 64 nt, hsa
gcugguuggagagcuagaaccuggagagcuagaaccuggagaacuagaaccuggagggcuagaa

SEQ ID NO: 97632 - RNA, 64 nt, hsa
agaaucuggagagcuagaaccuggagggcuagaaccuggagagcuagaaccuagaagggcuaga

SEQ ID NO: 97633 - RNA, 64 nt, hsa
gaaccuggcagguuagaaccuagaagggcuagaaccuggagagccagaaccuggagggcuagaa

SEQ ID NO: 97634 - RNA, 64 nt, hsa
agaaccuggagggaaugaaccuggagggcuagaaccuggagaaugagaaaaauuuacauggcaa

SEQ ID NO: 97635 - RNA, 64 nt, hsa
acaaucaucuaaaagccagccacugucagcaaagccuggagaaaugggaccagagagucugccc

SEQ ID NO: 97636 - RNA, 64 nt, hsa
aggagccuugguccaugcugagcauccuggaggaccuggagagcugggagaccaugaugagccu

SEQ ID NO: 97637 - RNA, 64 nt, hsa
ucaagagcuggaaccucccucagcucacuccgagccuggagaacugcaggggccaagguggagg

SEQ ID NO: 97638 - RNA, 64 nt, hsa
uggugcugucugaguauccccagagcaagagagaccuggagacaccagggguggaggguccugg

SEQ ID NO: 97639 - RNA, 64 nt, hsa
cguucaucgggaaccaggacacuuacgagacccaccuggagacuugccgcuucgagggccugaa

SEQ ID NO: 97640 - RNA, 64 nt, hsa
acuccacugggguggaugggcugccugcacagccccuggagagggggccaggcacacccucaga

SEQ ID NO: 97641 - RNA, 64 nt, hsa
cugaaaauucugauuaagccucugggcccuacagccuggagaaccuggagaauccuacacccac

SEQ ID NO: 97642 - RNA, 64 nt, hsa
cugauuaagccucugggcccuacagccuggagaaccuggagaauccuacacccacagaacccgg

SEQ ID NO: 97643 - RNA, 64 nt, hsa
ggcccagggccucuggcuucccugcccaauccucccuggagaagggacaugggaaugaauugaa

SEQ ID NO: 97644 - RNA, 64 nt, hsa
caccacugggaaccaagggcccucacucaggaacccuggagacagaagucaggugucaucauca

SEQ ID NO: 97645 - RNA, 64 nt, hsa
agcagacucuggaggccugugccuugcuagcugaccuggagaugcugccugguggggaucagac

SEQ ID NO: 97646 - RNA, 64 nt, hsa
uccugguuuuagacgaggccacagcugccaucgaccuggagacugacaaccucauccaggcuac

SEQ ID NO: 97647 - RNA, 64 nt, hsa
ucaucgaccugagggggcccaucccugcccaccuccuggagaacacguuggcucaguccugggu

SEQ ID NO: 97648 - RNA, 64 nt, hsa
cagaggaugaggucaauuuccugaugcauauugcccuggagaagaucgccuucauccccuuugg

SEQ ID NO: 97649 - RNA, 64 nt, hsa
gugcaccccuuccuugugaguagcucucaacuguccuggagagcagaggcuauuuggggucgga

SEQ ID NO: 97650 - RNA, 64 nt, hsa
ucugucaggacuaccgugguuuguucugcagccuccuggagacaaggcgucccuucccgggagc

SEQ ID NO: 97651 - RNA, 64 nt, hsa
uugagaggaguugguagacagcaagggaagggucccuggagacccccagccaaacgggucagug

SEQ ID NO: 97652 - RNA, 64 nt, hsa
ggcacugauaagggaacuagcacaggggauugugccuggagacaugcccauggcugcacagaua

SEQ ID NO: 97653 - RNA, 64 nt, hsa
acccagccccgcgcauccagggcuuccugagucgccuggagaacuucacgggacugucgcuggu

SEQ ID NO: 97654 - RNA, 64 nt, hsa
cugguggcacucagcuuggggcugggccugcuggccuggagaccagggugccugcgggccuugg

SEQ ID NO: 97655 - RNA, 64 nt, hsa
cgaggcgcuuauuuucccuuauggugaccugaguccuggagacucccauucucccccucucccu

SEQ ID NO: 97656 - RNA, 64 nt, hsa
gacacugggcgccuccuccucccccuccuccucaccuggagagacuacaggaacuucaggguca

SEQ ID NO: 97657 - RNA, 64 nt, hsa
caagaaugggcaagaaggaucaggucagccacucccuggagacacagccuucuggcugggacug

SEQ ID NO: 97658 - RNA, 64 nt, hsa
aggaagauguauagcuuuagcuuuagccuggcaaccuggagaauccacauaccuuguguauuga

SEQ ID NO: 97659 - RNA, 64 nt, hsa
ucugggcagggcccucgggacaucuccacccgauccuggagagcugugaggauccauucagccu

SEQ ID NO: 97660 - RNA, 58 nt, hsa
uucgagggccacggagaugagccuggacccuggagaaggaggccaggagccagccacu

SEQ ID NO: 97661 - RNA, 64 nt, hsa
cuaggagcaagaaagucucuucggccucgggcuuccuggagaaggggacguccauuccugcugg

SEQ ID NO: 97662 - RNA, 64 nt, hsa
auacuuugauuuaaaauaggccaagagaaucaggccuggagaucuagggucuuguccaaagugu

SEQ ID NO: 97663 - RNA, 64 nt, hsa
aagcugaaauggaauaucugaagauagcucaggaccuggagauguacggugugaacuacuuugc

SEQ ID NO: 97664 - RNA, 64 nt, hsa
cacgcgaggcggagcgaagagccaagcagaagcuccuggagauugccaccaagcccacguaccc

SEQ ID NO: 97665 - RNA, 64 nt, hsa
ggagaggacccucaggccucugagggcaccaggcccuggagaagaggugcaauucagggugugu

SEQ ID NO: 97666 - RNA, 64 nt, hsa
ggagggguugucaagcccacccgggaaacugagcccuggagaggggaagcagccagcccaggau

SEQ ID NO: 97667 - RNA, 64 nt, hsa
gugcaugcaggggugagguauuuucacugcccucccuggagagucccuuguaaguuuggcuccu

SEQ ID NO: 97668 - RNA, 64 nt, hsa
gugccuggcaccccugaaccaugaucugagccucccuggagaagguauuuuauaugucugcugc

SEQ ID NO: 97669 - RNA, 64 nt, hsa
auuuucuuggaaccuuugauuucaacacugagggccuggagaccucggcuccuccugcuccuga

SEQ ID NO: 97670 - RNA, 64 nt, hsa
acgguucuuaauacugaagucaugauguguauuuccuggagaaauuccucuuuaaaugaacaag

SEQ ID NO: 97671 - RNA, 59 nt, hsa
cauaagccuuugccccacaagcuguggagagggccaaaaccaagcugcuugagcccacu

SEQ ID NO: 97672 - RNA, 59 nt, hsa
ccugagagcuggacagagcagagaacuacagggccaaggguccagagaagugauaacuu

SEQ ID NO: 97673 - RNA, 59 nt, hsa
ccucacacgggaccacagccgcgcugccgagggccaagcacaaagguuccagugagcgc

SEQ ID NO: 97674 - RNA, 59 nt, hsa
gugcuggugaugggcccuggcccuacuccagggccaaugcacccccgccucacacacgc

SEQ ID NO: 97675 - RNA, 64 nt, hsa
gagugcaacuguggcuuagcuaauauugcaauguggcuugaauguagguagcauccuuugaugc

SEQ ID NO: 97676 - RNA, 64 nt, hsa
cacaaugaaauuauauuuucuuuguaaagaaaguggcuugaaaucuuuuuuguucaaagauuaa

SEQ ID NO: 97677 - RNA, 64 nt, hsa
cuuuuacuuuucagugucuucugagaaaccaccaggcuugaagugucuucucggaaaaaaccau

SEQ ID NO: 97678 - RNA, 64 nt, hsa
cuuuuacuuuucagugucuucugagaaaccaccaggcuugaaggcuacaagugaugagaaagau

SEQ ID NO: 97679 - RNA, 64 nt, hsa
ccugggugagucugccaacucacaggugcuuuuaggcuugaaaucuccauccuaucauuuccgu

SEQ ID NO: 97680 - RNA, 64 nt, hsa
cugacuauuugacaauagggcugauaauguaaucggcuugaauuuugacuuaguaacuuuuuau

SEQ ID NO: 97681 - RNA, 64 nt, hsa
aucccccugauuuuauaugaagaaauagaagaggggcuugaaguccuccucgcgagugccuucu

SEQ ID NO: 97682 - RNA, 64 nt, hsa
aacuucguaccagcuagaagggagaagagaugggggcuugaacacggggcuuccuuacagcccc

SEQ ID NO: 97683 - RNA, 64 nt, hsa
ccugaaauagggacuuagcucuugggggugggccuggaaggacugaaaggugggauuagaguca

SEQ ID NO: 97684 - RNA, 64 nt, hsa
auuccagaaucuccuacccccagaaaaggggugcuggaaggaggccccaguggacucuuuguac

SEQ ID NO: 97685 - RNA, 64 nt, hsa
uaagccgaccaggaaaccucauuccuaccuacacuggaaggagcgcucucacuguggaagaguu

SEQ ID NO: 97686 - RNA, 64 nt, hsa
gaaugugccccuucuuucaucagaguuaguguucuggaaggaaagcagcagggaagggaauauu

SEQ ID NO: 97687 - RNA, 64 nt, hsa
ucugaaaagugccagcuauuucauuaggcaaugcuggaaggaaaugaaauuauaccuucugauc

SEQ ID NO: 97688 - RNA, 64 nt, hsa
cccagagaagaucuguuucccuguguccugugaauggaaggacccaagccaauauguuccuuug

SEQ ID NO: 97689 - RNA, 64 nt, hsa
ugcuuggauacucacauuaggaggaccaugugguuggaaggauagacugcccccuaccucccac

SEQ ID NO: 97690 - RNA, 64 nt, hsa
gaugacccucugcgguugucaggcgugaauccucuggaaggaacuguuugcaguuguaugcaca

SEQ ID NO: 97691 - RNA, 64 nt, hsa
agagagagagagagagagagagagauccucagaguggaaggagggggaagcagcaggacacauu

SEQ ID NO: 97692 - RNA, 64 nt, hsa
guugagucagauggcaguggcaguccuuugccaguggaaggaguuccugcuaaggggaggugca

SEQ ID NO: 97693 - RNA, 56 nt, hsa
acgacgacgaggaggaauagcugugauggaaggacuagagcgaaagggcccagaga

SEQ ID NO: 97694 - RNA, 64 nt, hsa
gaauugagcuccuggcccuucugaugcuuugaaauggaaggauuguuccuuagagcuucucugc

SEQ ID NO: 97695 - RNA, 64 nt, hsa
ugggccaugaagaaguaggggcugaagaggaagguggaaggagauaaaauauaauauuuagagg

SEQ ID NO: 97696 - RNA, 64 nt, hsa
agucucccuggagaaggccguaauaucugggccuuggaaggaaggacacagggcucuggaagga

SEQ ID NO: 97697 - RNA, 64 nt, hsa
auaucugggccuuggaaggaaggacacagggcucuggaaggaggaggcugcaugccugaaggcu

SEQ ID NO: 97698 - RNA, 64 nt, hsa
aauccaacugaccuagugaagguucagaugcaaauggaaggaaaaaggaaacuggaaggaaaac

SEQ ID NO: 97699 - RNA, 64 nt, hsa
aagguucagaugcaaauggaaggaaaaaggaaacuggaaggaaaaccauugcgguaaguucucc

SEQ ID NO: 97700 - RNA, 64 nt, hsa
uuuuauagcuucaaaguguggcuugacauucaaauggaaggaaccaccugaauuauaucugcaa

SEQ ID NO: 97701 - RNA, 64 nt, hsa
guuugaguggaggaauguuuucuagagcagugacuggaaggacaaacgugguguugcagaacaa

SEQ ID NO: 97702 - RNA, 64 nt, hsa
ggaagagaaaguuaucaagagaaagaggugaggauggaaggauggagaaaaacagacuguggga

SEQ ID NO: 97703 - RNA, 64 nt, hsa
gugcuugggguagaucuucuucacauauucccccuggaaggagcaacuuuucugugcccugcug

SEQ ID NO: 97704 - RNA, 64 nt, hsa
cagaauauugcauggagcacagugcuuccaaaacuggaaggaauuggccuggauuaggagucuu

SEQ ID NO: 97705 - RNA, 64 nt, hsa
cccauuuucacuaaacaauaaaaucuaaauaaauuggaaggaauaacaaccacaaaggaaagaa

SEQ ID NO: 97706 - RNA, 64 nt, hsa
aaggaaguggaaccagaugcagaagaggaaaugauggaaggacuuacgguaucagauaccaaua

SEQ ID NO: 97707 - RNA, 64 nt, hsa
auuauaauuugauaaggugauuauaaaagauacauggaaggaaguggaaccagaugcagaagag

SEQ ID NO: 97708 - RNA, 64 nt, hsa
agagaguaagguguccuuauguuggaaacucaaguggaaggaagauuugguuugguuuuauucu

SEQ ID NO: 97709 - RNA, 64 nt, hsa
uaguucaguaauuuaaaugcuuauuuauuuucaguggaaggauuuuuauuaaaaagaagcuaau

SEQ ID NO: 97710 - RNA, 64 nt, hsa
acccccagaggccuugggcuguggaccuggggguuggaaggaugggggcucauuuaacccucag

SEQ ID NO: 97711 - RNA, 64 nt, hsa
uuucuuauuuugcuacugagucacacaagggaaguggaaggaagaacaguuaauuuaagaauga

SEQ ID NO: 97712 - RNA, 64 nt, hsa
agacagagaugaaaagacagucaaaggacggaaguggaaggacgggagugagcuggggagcugu

SEQ ID NO: 97713 - RNA, 64 nt, hsa
ugaagagaacgucaugaguguaagugcaaaucaguggaaggagcggcaaacugggacaugcaga

SEQ ID NO: 97714 - RNA, 64 nt, hsa
aagggaaggcauguagggacaggaaaggaaacaauggaaggaaagugauucugugaaaaggaca

SEQ ID NO: 97715 - RNA, 64 nt, hsa
acagaacccuuuuccugacucucauggaagaugguggaaggaaaauagacugucucaucaaccc

SEQ ID NO: 97716 - RNA, 64 nt, hsa
cuucauggaaagguguuggcgcugauguagcucauggaaggaucagacugggaaccacagagga

SEQ ID NO: 97717 - RNA, 64 nt, hsa
aacugaaagcuucuguuugaagagacaugaguucuggaaggagcaaggccaccagguccagaga

SEQ ID NO: 97718 - RNA, 64 nt, hsa
ucuaugccaauagcugggccugccuggggaaagguggaaggagaaacagcugcaggagggggga

SEQ ID NO: 97719 - RNA, 64 nt, hsa
gagaaguaugugcccuaucucauggaugugauaguggaaggaauuguggauggaagacaagcag

SEQ ID NO: 97720 - RNA, 64 nt, hsa
uguacugcucucugggagccucccugcuugaggauggaaggaugaaauuugacgaauauaucaa

SEQ ID NO: 97721 - RNA, 64 nt, hsa
gacaccgugagccugccuuuguacuucaaacucauggaaggauaaccaccuucauguuuugaaa

SEQ ID NO: 97722 - RNA, 64 nt, hsa
ccagugugcgcagcucgagccaccagccccagccuggaaggaccagguucuuucacaccugcug

SEQ ID NO: 97723 - RNA, 64 nt, hsa
auguaguucccaccaguugccuuccccucagggauggaaggaagaggguuucuugggcugguug

SEQ ID NO: 97724 - RNA, 64 nt, hsa
cuucuaaaaugagagauagggauuuggugggguauggaaggaacuaaccccuucccucuccacc

SEQ ID NO: 97725 - RNA, 64 nt, hsa
cuacuuccuuucauagacaugaaaagacucacacuggaaggaaacacuaugaaugcaagcaaug

SEQ ID NO: 97726 - RNA, 64 nt, hsa
aagccuucagaucagccucgcaccuucaaaugcauggaaggacucacacuggagaaaaacccua

SEQ ID NO: 97727 - RNA, 64 nt, hsa
augccugugauccuggcuacuucagaggcugagguggaaggaucacuugaggccaggaguuuga

SEQ ID NO: 97728 - RNA, 64 nt, hsa
gagagagaaagaaagaaagaaagaaagggaaagauggaaggaaggaaggaaaaagaaagagaaa

SEQ ID NO: 97729 - RNA, 64 nt, hsa
gggaccgcgguggguggaaucccaaggcuggggguggaaggagcagggcucuggagggauucgc

SEQ ID NO: 97730 - RNA, 64 nt, hsa
ugaagaggagcuugagcuucccucugccugcccguggaaggagcuuugccgcagccuguccgag

SEQ ID NO: 97731 - RNA, 64 nt, hsa
gcuugcaucucugaccaaauuucacauaaaacauuggaaggaggcugggugcgguggcucaugc

SEQ ID NO: 97732 - RNA, 64 nt, hsa
uucaaauagucuugaaggggaaucagcuucaggauggaaggacccaggagaggccccgaggugg

SEQ ID NO: 97733 - RNA, 64 nt, hsa
uauuagccuagauugaauuauagcguuuucuagcuggaaggaaccuuaagaucacaucaucuac

SEQ ID NO: 97734 - RNA, 64 nt, hsa
cuuuucucuggaucucaagaaugguggaggacccuggaaggacagcaaggcagcuccccagccu

SEQ ID NO: 97735 - RNA, 64 nt, hsa
cuuugauaccuggggucgucgagaggcugcgggcuggcggcagucccaggggagagacaccaca

SEQ ID NO: 97736 - RNA, 64 nt, hsa
auggccugggagcuuggaagggaggggugguggguggcggcaucuugacugcccccuguugucc

SEQ ID NO: 97737 - RNA, 64 nt, hsa
agcucuccuaacccaaggcggagaaugaaggugguggcggcagaggaggagggcagcagcugag

SEQ ID NO: 97738 - RNA, 64 nt, hsa
uggcauuaagucuugcuuugguuaaagccuuauuucacauaauugcuaaaaacucauuuuuguu

SEQ ID NO: 97739 - RNA, 64 nt, hsa
aucagauuuacagauuuucuuugacuaauuuuuuucacauaacuuuaggauuuucgaaaguugu

SEQ ID NO: 97740 - RNA, 64 nt, hsa
uaaguauagauuuuaaagauaugggacuuuauuuucacauaagucaauagauguuucucuagaa

SEQ ID NO: 97741 - RNA, 64 nt, hsa
uagcaugccccuguucuuccuaacuuguaaaauuucacauaaauauauuuucaauuguguacaa

SEQ ID NO: 97742 - RNA, 64 nt, hsa
ucauauuuucacaugacguaaaauuuuaugugcuucacauaauuguauuuuagcaggguacaua

SEQ ID NO: 97743 - RNA, 64 nt, hsa
accacccccuucuuuuuuguuguuguggguuuuuucacauaaacacauacauugccaauuuucc

SEQ ID NO: 97744 - RNA, 64 nt, hsa
ugccagcucagcuauggacacaucugagccagccaaggaggaggaugauuacgacgugaugcag

SEQ ID NO: 97745 - RNA, 64 nt, hsa
cucccaggccaccaaggacggcaagaaggacaagaaggaggaagacaagaagugagacuggagg

SEQ ID NO: 97746 - RNA, 64 nt, hsa
acuuuuuggugggaacuguuggaaauuccaggguaaggaggaagaugccuguucucccugucug

SEQ ID NO: 97747 - RNA, 64 nt, hsa
ccuagcccaaccaaugcuagaauuucuugcucugaaggaggagcaggugaaacaggugguaauu

SEQ ID NO: 97748 - RNA, 64 nt, hsa
caccaugaagaggagaagaugggggucuuggaggaaggaggaaaaggcaaggaggcugcaggca

SEQ ID NO: 97749 - RNA, 64 nt, hsa
agaugaaagagaggguacaacuaaagggaaugagaaggaggacgcugcaggaacaagugggcuu

SEQ ID NO: 97750 - RNA, 64 nt, hsa
auaucacuauaacauaacugauaggaaugaaucaaaggaggauuuaccaugcccuuucgguugu

SEQ ID NO: 97751 - RNA, 64 nt, hsa
gaagauacuucagaagggcuguucugaaauuccuaaggaggaauucuuaggaauuccuaaggag

SEQ ID NO: 97752 - RNA, 64 nt, hsa
aguugguuggguggggagucaggggugggaggagaaggaggaagaggaggaaggccagacuggc

SEQ ID NO: 97753 - RNA, 64 nt, hsa
ucagccccugacagaaaaaggaucucugagccuaaaggaggaaaagucccaccaacuaccagac

SEQ ID NO: 97754 - RNA, 64 nt, hsa
acuuugaaaagaccgcuguucauaaggagagagaaaggaggaagagaugagaaaggaagacaga

SEQ ID NO: 97755 - RNA, 64 nt, hsa
caguguauccccagcaccuaauacagaagguaauaaggaggaggcaucugcuaaacgcuuguug

SEQ ID NO: 97756 - RNA, 64 nt, hsa
ucuaagagaagguaagacagauuaggacaucgaaaaggaggauggagccaggugccauggcuug

SEQ ID NO: 97757 - RNA, 64 nt, hsa
gugagacucugucucaauuaauuuuuuuuuuuuaaaggaggaggaucuccauggguaagugguu

SEQ ID NO: 97758 - RNA, 64 nt, hsa
gaacuuuauuccaaugcuaauggcagacaccaggaaggaggagaggaaccauuugugcagauca

SEQ ID NO: 97759 - RNA, 64 nt, hsa
uuuguauguuacuuuaaagaggauguguguucuaaaggaggacaugagcuguguguuuucaaga

SEQ ID NO: 97760 - RNA, 64 nt, hsa
cgggggcaggucuguccggcacagcagcucccucaaggaggagaagagugaggagaaaggaaac

SEQ ID NO: 97761 - RNA, 64 nt, hsa
cguagcgggaugaucucgguuggugagugcagggaaggaggauguaauuccaucauauauacuc

SEQ ID NO: 97762 - RNA, 64 nt, hsa
gccuccuaugaugcagacauggugaauuuaauucaaggaggaggagaauguuuuaggcaggugg

SEQ ID NO: 97763 - RNA, 64 nt, hsa
ggauuguaguagcagcugaccugaguggggaaggaaggaggauuucaguuaggucucccauuug

SEQ ID NO: 97764 - RNA, 64 nt, hsa
cucccucacucuauaguugcccaguugaaaggauaaggaggagggguggcuuuuauggacuucc

SEQ ID NO: 97765 - RNA, 64 nt, hsa
uaggagcacuguugaaguccuggaagggagaucgaaggaggaagauugacuugguucuuucuua

SEQ ID NO: 97766 - RNA, 64 nt, hsa
cauugucauccauuucccaguuagggcaacaaugaaggaggacccagccaagcuagaaggaauu

SEQ ID NO: 97767 - RNA, 64 nt, hsa
gcccugggccacugccauuggguuagucaagaugaaggaggaggacuggcugccuccauuuugc

SEQ ID NO: 97768 - RNA, 64 nt, hsa
ggaaaccgcagcugagcaggugucacaagcuguaaaggaggaagggagucugcaggcccuucac

SEQ ID NO: 97769 - RNA, 64 nt, hsa
ugaaggcuccucuggguuugaggguccaagggacaaggaggagaagccuagcaggauuucagau

SEQ ID NO: 97770 - RNA, 64 nt, hsa
aagcugcuuucacgguaaaauuauguugguuugaaaggaggaaauagcaagguuaagaugugug

SEQ ID NO: 97771 - RNA, 64 nt, hsa
auagaagcgcaaugagagaagcagcaguggguacaaggaggaagaaaaagggcuugcagagagu

SEQ ID NO: 97772 - RNA, 64 nt, hsa
aaggcugaugccaggguuggcacauggaggguacaaggaggacucgccuggaguaucuuaagga

SEQ ID NO: 97773 - RNA, 64 nt, hsa
agugcuaacauucaugauuagggucucagaagguaaggaggaagagaguggaauggaaaaagua

SEQ ID NO: 97774 - RNA, 64 nt, hsa
uggaauugauuuucccugaguggagugcugggggaaggaggagguccaggccgguaguggccau

SEQ ID NO: 97775 - RNA, 64 nt, hsa
caagugccagcagcugcagcaagaauacagccgcaaggaggaggagugccaggcaggggcugcc

SEQ ID NO: 97776 - RNA, 64 nt, hsa
ccgggaccggcggaggcgcucacggagucgcgacaaggaggagcggaggcgcuccagggagcgg

SEQ ID NO: 97777 - RNA, 64 nt, hsa
gagucgggagcgggcccggcgggagcgggagcgcaaggaggagcugcguggcggcgguggcgac

SEQ ID NO: 97778 - RNA, 64 nt, hsa
cagaggggugaagaaggaggaggaagaggcagagaaggaggagaccagggcugggaaagaaacu

SEQ ID NO: 97779 - RNA, 64 nt, hsa
gagugagcgugugauuguagacagaggggugaagaaggaggaggaagaggcagagaaggaggag

SEQ ID NO: 97780 - RNA, 64 nt, hsa
guggguggagaagggaggguggccagcacuaguaaaggaggaauagugcuugcuggccacaagg

SEQ ID NO: 97781 - RNA, 64 nt, hsa
uaaaggaggaauagugcuugcuggccacaaggaaaaggaggaggugucuggggugagggaguua

SEQ ID NO: 97782 - RNA, 64 nt, hsa
ccggacugaggaagacgaggacagggaggaggaaaaggaggaagaggaggacaaaaagggggag

SEQ ID NO: 97783 - RNA, 64 nt, hsa
ggacaaaaagggggaggagaagguucuucguccaaaggaggaaggagaagaaguagaaagugcg

SEQ ID NO: 97784 - RNA, 64 nt, hsa
gagaugugaucaggccccaccccuguaaucaggcaaggaggaggagucagaugaggcccugcac

SEQ ID NO: 97785 - RNA, 64 nt, hsa
ccucaccccuccccugggacuuucccacccaggaaaggaggaccagucaggaugaggccccgcc

SEQ ID NO: 97786 - RNA, 64 nt, hsa
auccuuucuucuguuaauaugucagaauguaagauuuggcaacucgauaaauuuuuuucauuuu

SEQ ID NO: 97787 - RNA, 64 nt, hsa
uuuuaagagacaaauuuuaacuuuuaauuuuuauuuuggcaaaacugucaaaugagaaaaauga

SEQ ID NO: 97788 - RNA, 64 nt, hsa
caccuauugaaagacuucuuggugguuuccaaguuuuggcaauuaugaauaaagcuguuguaaa

SEQ ID NO: 97789 - RNA, 64 nt, hsa
cccauccauguuccugcaaaggacaugaucuuucuuuggcaaccacuuuuuacugucgccauag

SEQ ID NO: 97790 - RNA, 64 nt, hsa
aaaaauuuccuuucgcuuucauuauuuuucuuuuuuuggcaaaggcuugguacccaaggugcgg

SEQ ID NO: 97791 - RNA, 64 nt, hsa
uuaaaaaagauauaaacuauaacuguccguuacuuuuggcaaaagauacaaccacauaauguau

SEQ ID NO: 97792 - RNA, 64 nt, hsa
auucuguauuuggauauuaguguuuaagugguaauuuggcaacaguuuauaaagugauguucug

SEQ ID NO: 97793 - RNA, 64 nt, hsa
auacucuuugaaacugccuuugugagcaaagugcuuuggcaaggcaagggucucccucagcagg

SEQ ID NO: 97794 - RNA, 64 nt, hsa
acaaaguuguuuuuaaaacacacucauaaguaaguuuggcaaguuguuuaaaaaaugucucuuu

SEQ ID NO: 97795 - RNA, 64 nt, hsa
agcaauacuucagugagauuaaguauaaacaguuuuuggcaaaaaacaacacagucuacucuuu

SEQ ID NO: 97796 - RNA, 64 nt, hsa
cucucuuuccccacccccaucacagggcuuucaguuuggcaaaggaaaagcagauaaaaacaga

SEQ ID NO: 97797 - RNA, 64 nt, hsa
uuugccuuuaagccuuuuuuuucuuuuuuuuuuuuuuggcaaaugaauguaccauuucaacuuu

SEQ ID NO: 97798 - RNA, 64 nt, hsa
ugugggccuauuggguuacauaagugacuuuuuguuuggcaaauguuacuccuguauugaguaa

SEQ ID NO: 97799 - RNA, 64 nt, hsa
auacaugcacaaagauguucuaguuaggggcuaauuuggcaagagaaacaguuuauuaauguuu

SEQ ID NO: 97800 - RNA, 64 nt, hsa
gacugcaggcacaagccaccaugccuggcuguuuuuuggcaaaucuugauugugauaagccccc

SEQ ID NO: 97801 - RNA, 64 nt, hsa
ggaauccugugagcacuacucugaagguuuguguuuuggcaaaucuuuuuucuuuuuugagaca

SEQ ID NO: 97802 - RNA, 64 nt, hsa
guuaauuucauaugcuccuggauugauagcaguauuuggcaauaccuaucuguaugagaagaca

SEQ ID NO: 97803 - RNA, 64 nt, hsa
auauccagagaaaauaaacuuaagauuacuggccuuuggcaagaacaguugcuuaaagaguuaa

SEQ ID NO: 97804 - RNA, 64 nt, hsa
gguagcugagguuugugaaacaguaggauucucuuuuggcaauggagaauugcaucugaugguu

SEQ ID NO: 97805 - RNA, 64 nt, hsa
gcauuuuuaaagucucucuucuguaacuggauguuuuggcaacuuuguggggagagacugcugg

SEQ ID NO: 97806 - RNA, 64 nt, hsa
ccuaugcuuaaaauacuguaaauaugcagugagguuuggcaaaaucuauuccaugugugauuug

SEQ ID NO: 97807 - RNA, 64 nt, hsa
uuuaacugcccccccagcccugacauguucuuuuuuuggcaaacauacauaauguuacaucaua

SEQ ID NO: 97808 - RNA, 64 nt, hsa
ugucucguuguucagaacaacccugugaaguaguuuuggcaaugucuguguuacauuucaugua

SEQ ID NO: 97809 - RNA, 64 nt, hsa
agucaagguuggagagucuccuuccagccagugaccuacccaaaccuuuuguucuguaaaacug

SEQ ID NO: 97810 - RNA, 64 nt, hsa
guugaauuuucuuuccagccaguuacccuuucaaccuacccauacuuuguacaacucuuacaca

SEQ ID NO: 97811 - RNA, 64 nt, hsa
ccacgcccuggaugccacccagugcagccuggcaccuacccacccacccuucagcuuaagccac

SEQ ID NO: 97812 - RNA, 64 nt, hsa
aaauaguccuuuuucuuggaagcagugacgucucccuacccaaucuuucccauccuaucaaccc

SEQ ID NO: 97813 - RNA, 64 nt, hsa
ccccucucaggagccaucaucggcuuuccccauuccuacccacuuaggcuuuguagcaagauga

SEQ ID NO: 97814 - RNA, 64 nt, hsa
guggguucccaucauuuccugugucagcgccuggccuacccagauuguaucaugugcuagauug

SEQ ID NO: 97815 - RNA, 64 nt, hsa
auugaauuuaaaaaggcauaauaaucaaauacuuaauagcaaauaaaugauguaucaggguauu

SEQ ID NO: 97816 - RNA, 64 nt, hsa
guccugaggggcagggggaucugugauauaacaaaauagcaaaagcgguaauuuccuuaauguu

SEQ ID NO: 97817 - RNA, 64 nt, hsa
caugcuggccucagagauucaugucacauauugaaauagcaaauagaaaugugcaggagcggag

SEQ ID NO: 97818 - RNA, 64 nt, hsa
gcugcagacagaggaagaaaguuuauggauuuaaaauagcaaagcaacuuguggaucugugugu

SEQ ID NO: 97819 - RNA, 64 nt, hsa
uagcauaacuuuuuacauuuaauuuuucauaugaaauagcaauuaguuacugcuguguuacauu

SEQ ID NO: 97820 - RNA, 64 nt, hsa
guuuuaaaugucuagguucuguauuuuuuucuuaaauagcaagaaaauacagauugcuaguaua

SEQ ID NO: 97821 - RNA, 64 nt, hsa
gaauaaacuuacauauuuauuuuuaggacaugaaaauagcaauauucuuggagauugauaacca

SEQ ID NO: 97822 - RNA, 64 nt, hsa
uugaauggaauuucucaguagcagccuacaacugaauagcaaguggcauaaagcauauccauuc

SEQ ID NO: 97823 - RNA, 64 nt, hsa
acauaaauccuuaguauagaaaaauugcauaaagaauagcaaucuuuaauaaaccuuuuuauua

SEQ ID NO: 97824 - RNA, 64 nt, hsa
caauugaaauuuaaagaaaaguuuuaauuauauaaauagcaaagggcuauugccaauacuaggg

SEQ ID NO: 97825 - RNA, 64 nt, hsa
agccuuucuuugguuucccaagagcuacguauuuaauagcaaagaauugacuggggcaauaacg

SEQ ID NO: 97826 - RNA, 64 nt, hsa
cuuucucacuaaaucuuuuauaggauuuauuuaaaauagcaaaagaagaaguuucaucauuuuu

SEQ ID NO: 97827 - RNA, 64 nt, hsa
uauuauguagaaaucuucaaagguagcauuauuaaauagcaaagaauaauuagaacccacauau

SEQ ID NO: 97828 - RNA, 64 nt, hsa
acuggauguuuguuuguauaauuuugaacacuauaauagcaauucagagacagacauuguuaaa

SEQ ID NO: 97829 - RNA, 64 nt, hsa
ucagagucuccugagucgaggaaucuguauuauuaauagcaaccagggccgggugucguggcuc

SEQ ID NO: 97830 - RNA, 64 nt, hsa
cagagugagacuccuucucaaaaguaaauaaauaaauagcaaccaguacuccaggugauuccag

SEQ ID NO: 97831 - RNA, 64 nt, hsa
cuggauuggucucaaaaacauaaugcucagugaaaauagcaaguuguagaaaguuauauacaaa

SEQ ID NO: 97832 - RNA, 64 nt, hsa
acuuuggcaugaaauguuaagcauccgacaucuaaauagcaauauuuugaauacuggaaacuca

SEQ ID NO: 97833 - RNA, 64 nt, hsa
uaauuucaguaguacaguauggaauaguuaaauaaauagcaaaucacugaauucagaaucucac

SEQ ID NO: 97834 - RNA, 64 nt, hsa
gaauaagaggugauggaccaguuuacugcuuagaaauagcaagaggcacugcaguaaaacuugu

SEQ ID NO: 97835 - RNA, 64 nt, hsa
aaaaguuuuacuuccuugcauucuucuaccuuuaaauagcaaaguaccacuaccaccaccaccu

SEQ ID NO: 97836 - RNA, 64 nt, hsa
uguguuuugccugaaacgauaccagguuccccugaauagcaacuuuacaagguccaugugggag

SEQ ID NO: 97837 - RNA, 64 nt, hsa
uuacaaucauauagaauauauagaguuacauuuuaauagcaacuguguacaugucacgaaacca

SEQ ID NO: 97838 - RNA, 64 nt, hsa
aaaauaauguguuauuuuuauagagaaagaaaaaaauagcaacacaaucuaguuuauuuuaggg

SEQ ID NO: 97839 - RNA, 64 nt, hsa
ugaaauuuauuuggaaccagaaaagcccaaccuaaauagcaaaagcaauccuaagcaaaaagag

SEQ ID NO: 97840 - RNA, 64 nt, hsa
caaacacuuguauguucauugcagcacuauucucaauagcaaagauguggaaucaacguaaaug

SEQ ID NO: 97841 - RNA, 64 nt, hsa
uuuccaucuaccaaauggguguaauaauacuuaccuaccucacaggacuguugugaggcuuggc

SEQ ID NO: 97842 - RNA, 64 nt, hsa
gaggaguagcccccuuuuucagagaguuuggggucuaccucagagcucucccugucaaaaagca

SEQ ID NO: 97843 - RNA, 64 nt, hsa
uauuuaccuuuuacaagguuagaaaagucucauacuaccucaucuuuauuguggcgcuuuugua

SEQ ID NO: 97844 - RNA, 64 nt, hsa
ugcaaccucugccuuccagguuccagcaauucuccuaccucagcucccaaguagcugagaugac

SEQ ID NO: 97845 - RNA, 64 nt, hsa
uguaaaaucuuaagccaauggaacccuugauuuccuaccucaguguacacccaacuauugguug

SEQ ID NO: 97846 - RNA, 64 nt, hsa
uuuaaauagccagcauguaauacaaguaacuacacuaccucauaucuacaugauuuucaaguug

SEQ ID NO: 97847 - RNA, 64 nt, hsa
agccagcauggauaauaacccagauaacuaaccccuaccucacaggauaaaaaggauuacauga

SEQ ID NO: 97848 - RNA, 64 nt, hsa
uuccucaucuguaaaauggggcuaacaauauuaccuaccucauaggauuuaaugaugucaagcu

SEQ ID NO: 97849 - RNA, 64 nt, hsa
ccugcaccuacccacaugcacucgugugagacaaggcccauagguauggccccccccuuccccc

SEQ ID NO: 97850 - RNA, 64 nt, hsa
augcugggaagggagcggcagcccagccaggccuggcccauaaaaggcucccaugcugagcagc

SEQ ID NO: 97851 - RNA, 64 nt, hsa
gagcucucuguguuuggccucucacacacacacaggcccauagacagaugggcagaugcaccca

SEQ ID NO: 97852 - RNA, 64 nt, hsa
agaugggcagccaagggugcacugacuauuagcuggcccauaggauaucuguaaggcugguggg

SEQ ID NO: 97853 - RNA, 64 nt, hsa
gagcuguuauuuuuaggcauaagaugacuuaggaggcccauagaaacauucucguuuaaacaac

SEQ ID NO: 97854 - RNA, 64 nt, hsa
uccuuccuggaccccauucuguccggaggcucauggcccauauuucccacauuucuaauaccac

SEQ ID NO: 97855 - RNA, 64 nt, hsa
uuuaacuuuuuaaggaacagauguggaauacacuggcccauauuucaaccuuaacagcugaagc

SEQ ID NO: 97856 - RNA, 64 nt, hsa
uguaguuggauuguuuguauuaggauucaagcaaggcccauauauugcauuuauuugaaauguc

SEQ ID NO: 97857 - RNA, 64 nt, hsa
ccgggaaugaauggggaggccgcugaacccacccggcccauaucccugguugccucauggccag

SEQ ID NO: 97858 - RNA, 64 nt, hsa
cgccugaggcuugcugucuguucucggcaccccgggcccauacaggaccagggcagcagcauug

SEQ ID NO: 97859 - RNA, 64 nt, hsa
cccauguggcugaagacauuccaacaauggggugggcccauaauaguuagcccucagucaguuc

SEQ ID NO: 97860 - RNA, 64 nt, hsa
uugccuacccucaaugccacacuguuuuugaaguggcccauaacuugaaggaaaaguuuaaaga

SEQ ID NO: 97861 - RNA, 64 nt, hsa
agggccuaacaguguuucuuccccucggccccacggcccauacucaccccuucaccugaggcuu

SEQ ID NO: 97862 - RNA, 64 nt, hsa
ggagcgauccgcagcugcucacuccaccuugcgcggcccauacugggcgugugcaucugaaucc

SEQ ID NO: 97863 - RNA, 64 nt, hsa
acuauaaggaccagcccaaccccaugggcgggggggcccauauggaccaggggaccuugccuug

SEQ ID NO: 97864 - RNA, 64 nt, hsa
cucacagccacccugaagauagacuauaggaacgggcccauaccacacagacugcucuccaauc

SEQ ID NO: 97865 - RNA, 64 nt, hsa
gagaguuuggacccacauagcugcaacccaagcuggcccauaaucagcaguggggcccagcagc

SEQ ID NO: 97866 - RNA, 64 nt, hsa
cagcugcacacaagcaguugagaguugaugaccaggcccauagggcucccacagcugguuccca

SEQ ID NO: 97867 - RNA, 64 nt, hsa
ucccuuuggccuguuuuagauuuuggcaaagccaggcccauagugcuugcugggcucucucuuc

SEQ ID NO: 97868 - RNA, 64 nt, hsa
ggccuuuagccauuugucucuccucacacuccagggcccauauggcccagguucugacaguuug

SEQ ID NO: 97869 - RNA, 64 nt, hsa
augaaugaugaaagccugacgccgugccccuccuggcccauacgccuugccagggcggcaggau

SEQ ID NO: 97870 - RNA, 64 nt, hsa
accagugaucaaggcuaauuggaaaagaguuaucggcccauagcuaauaaguagugacagacaa

SEQ ID NO: 97871 - RNA, 64 nt, hsa
aguuuuugguugggaaugaggaaaauucuuaaaaggcccauagcagccaguucaaaaacacccg

SEQ ID NO: 97872 - RNA, 64 nt, hsa
gggauuugcagggacuuuucugggagaacuuaaaggcccauaguaacugcgaaugaagcaauau

SEQ ID NO: 97873 - RNA, 64 nt, hsa
caggcuggggccacaacccugaauaaacucuguuggcccauaaccuucagcugugagcgggucg

SEQ ID NO: 97874 - RNA, 64 nt, hsa
ggccugcugugccuggugccaacaggggcaucccggcccauaccccuccagacaggaagcaugg

SEQ ID NO: 97875 - RNA, 64 nt, hsa
auagugaauugauaaucuacuuguuaauauauucggcccauauuuuguguguuuggacaaguac

SEQ ID NO: 97876 - RNA, 64 nt, hsa
gucuaaggcccuugccucaucagggauuagaacuggcccauaugccagaaccuguacuaaaugc

SEQ ID NO: 97877 - RNA, 64 nt, hsa
aaugagccagaagccaaggcccugaguuggcaguggcccauaaguguaaaauaaaaguuuacag

SEQ ID NO: 97878 - RNA, 64 nt, hsa
aaagugauggaauuuauuccauuugucuuaggaaggcccauaauacuuguuuuucuuacaugug

SEQ ID NO: 97879 - RNA, 64 nt, hsa
ccuuuccuuccugacguccucuguccuuggggcuggcccauagcagugccugccgugccucugg

SEQ ID NO: 97880 - RNA, 64 nt, hsa
gcauuucuuuuuuauuuuucaaucuauauucacaggcccauacuucagucaguccaaucauagu

SEQ ID NO: 97881 - RNA, 64 nt, hsa
auaucuuuugggggacacaauucuacccacuacaggcccauaucuuaucuaggauguugguggc

SEQ ID NO: 97882 - RNA, 64 nt, hsa
uugccauguccuauugaucagugacacugccagaggcccauaccggcaagaggaagaggacguc

SEQ ID NO: 97883 - RNA, 64 nt, hsa
auuaaggauuuauuugaaaauggugggauucauuggcccauagguacauuggaaaauguauauc

SEQ ID NO: 97884 - RNA, 64 nt, hsa
uguuggugacagggcaaccaugggacuaggagguggcccauacacauggcuggcugguccugag

SEQ ID NO: 97885 - RNA, 64 nt, hsa
gccaggccccucaggcccggcaugggcagugcgaggcccauaguggugggaagccaguuggcca

SEQ ID NO: 97886 - RNA, 64 nt, hsa
uaaauauugggauuggggggaaagagggagcaacggcccauagccuugggguuggacaucucua

SEQ ID NO: 97887 - RNA, 64 nt, hsa
gacuugacaacaucccacaguggcacggagagaaggcccauaccuucugguugcuucagaccug

SEQ ID NO: 97888 - RNA, 64 nt, hsa
agugcugggauuacagacgugagccaccacucccggcccauagaagguuuuuugcuggauaauu

SEQ ID NO: 97889 - RNA, 64 nt, hsa
uauagucucacacccuuccccauaaguauaaaugggcccauauuuaacacauuuugugauuuug

SEQ ID NO: 97890 - RNA, 64 nt, hsa
aaaaaaguggaagaguaaggauaaauuuuuuaaaggcccauaagacaagugauuauuaugauuc

SEQ ID NO: 97891 - RNA, 64 nt, hsa
ucagcuauuuucaacauaacugaaggcauaugcuggcccauaaacacccuguagguucuugaua

SEQ ID NO: 97892 - RNA, 64 nt, hsa
uugugaaaacuaaccuucucugcugagcaauuguggcccauagccauauuuugagaagaaauuc

SEQ ID NO: 97893 - RNA, 64 nt, hsa
aacagucacugauuugccuagauucugagagucuggcccauagccaaccacauuuuccuuuggg

SEQ ID NO: 97894 - RNA, 64 nt, hsa
gaaggagagagaagaagaugaaguuugccaggagggcccauauuuuuucagcugaaggguaaaa

SEQ ID NO: 97895 - RNA, 64 nt, hsa
auuuucuuuaaauaaucccaaauagaccagaauuggcccauaccauagaagaaagaauuggcag

SEQ ID NO: 97896 - RNA, 64 nt, hsa
aauguuacuuuaaaauuaucuuuuuauuuuauaaggcccauaaauacugguuaaacucuguuaa

SEQ ID NO: 97897 - RNA, 64 nt, hsa
ccaaucacugcccaucugagagaugauuuccucuggcccauauuugaauuuauuggaguaacuc

SEQ ID NO: 97898 - RNA, 64 nt, hsa
ggagcgacccgcagcugcucacuccaccuugcgcggcccauacugggcgugugcaucugaaucc

SEQ ID NO: 97899 - RNA, 64 nt, hsa
caaaugaugugugugguguuucuaagagaaacagggcccauaaccagugggcagcuuuaggagg

SEQ ID NO: 97900 - RNA, 64 nt, hsa
gcaaggacagagaagguaccugcaggacccacaaggcccauacuggcccccaucugaacccacc

SEQ ID NO: 97901 - RNA, 64 nt, hsa
aggcaggagaagaacaagaaauggauguaagccuggcccauaaugugaacauaaguaaucacua

SEQ ID NO: 97902 - RNA, 64 nt, hsa
agugcugggauuacaggcgugagccaccaugcccggcccauaaguaccguuuuugagguucagu

SEQ ID NO: 97903 - RNA, 64 nt, hsa
ugcagggugaggucaagagaguucugaccuggauggcccauagaccugacgucccagaauccau

SEQ ID NO: 97904 - RNA, 64 nt, hsa
uucuacaaggcugcagugggcccacccaugggcuggcccauaacuguauguuauguggaagaag

SEQ ID NO: 97905 - RNA, 64 nt, hsa
uuagaaagucugauuguagcuaugauuguccguaggcccauacuagaguucauggauauguuau

SEQ ID NO: 97906 - RNA, 64 nt, hsa
aaaggaggcaugccucugauaugggacugagccuggcccauagaaacaugacacugaccuugga

SEQ ID NO: 97907 - RNA, 64 nt, hsa
gaacuggacccccaugccagugcugcugcaggagggcccauauacuagggucugcugagcuguu

SEQ ID NO: 97908 - RNA, 64 nt, hsa
ggguaggguuacagauccagguuauaacuacucuggcccauaccuuuccugguugugguuuuuc

SEQ ID NO: 97909 - RNA, 64 nt, hsa
agugcuaggauuacaggugugagccaccacaccuggcccauaguuguauuuuuuuuaggucacu

SEQ ID NO: 97910 - RNA, 64 nt, hsa
aggcaggguuggaggccgggggugugagaggagaggcccauagggcugaguggggucgggugag

SEQ ID NO: 97911 - RNA, 64 nt, hsa
aggaauuucgcccuacucuggccccuuuguugugggcccauaaccugcuaacaagccuucagga

SEQ ID NO: 97912 - RNA, 64 nt, hsa
ccagccucuggcuccacugcuuggcugagauccuggcccauaguagaaucuguguagaggaaac

SEQ ID NO: 97913 - RNA, 64 nt, hsa
ggggaaaggaucugguucauggaauucugaucuuggcccauaggugaaccaccaaaauagugcu

SEQ ID NO: 97914 - RNA, 64 nt, hsa
uucuggaaaauguuuauuccaaaacagcuuuaauggcccauauguacacuucguaaucucaagg

SEQ ID NO: 97915 - RNA, 64 nt, hsa
acacaucugcuagcacuuuauguugaaaaauauaggcccauaaaugcaucuuuugaggacuauu

SEQ ID NO: 97916 - RNA, 64 nt, hsa
aauaguggaauuuuauuuuuuaaauuuuuuuauaggcccauaugcucuaucucaagaaacaaga

SEQ ID NO: 97917 - RNA, 64 nt, hsa
cagagccugugcccuucagcccuuucaccuaacaggcccauauucgggccuuugccugaccaaa

SEQ ID NO: 97918 - RNA, 64 nt, hsa
cguuuccacuuagaucuuuuauuuuuaauaagcaggcccauaaaaauuguugacaagaauuaau

SEQ ID NO: 97919 - RNA, 64 nt, hsa
ggucaguuagacauacguugguuuccaggauagaggcccauauauccuggggagcuuuggucua

SEQ ID NO: 97920 - RNA, 64 nt, hsa
acuuucuaagucauuuugcuuagaaauucaguguggcccauacccuuuguccucccagccuggc

SEQ ID NO: 97921 - RNA, 64 nt, hsa
aagugaccagaagaggugugcaguuuccaggccuggcccauacagaccuccaacaggugcuccc

SEQ ID NO: 97922 - RNA, 64 nt, hsa
auugaagacccucaaugccaagaaacgugucccuggcccauauuaaucccucguguguccauaa

SEQ ID NO: 97923 - RNA, 64 nt, hsa
uuacucucuauuuugagaagguagaagguaagagggcccauauucauucuuugccaugaaauga

SEQ ID NO: 97924 - RNA, 64 nt, hsa
gugccacugucacucagaagggcaagcuaggcagggcccauacaacagcaggggucugcagguu

SEQ ID NO: 97925 - RNA, 64 nt, hsa
uguaugaucaacauauaacaagauacaguggaauggcccauacaguauauuacuguugugugau

SEQ ID NO: 97926 - RNA, 64 nt, hsa
cgcagagccggcaaagugagaugcacgccgucccggcccauagacaaguggcgcugggguuucc

SEQ ID NO: 97927 - RNA, 64 nt, hsa
agucauucacgcgucugacagagcuggugcugcaggcccauaggaaggagcuggaaggccuccg

SEQ ID NO: 97928 - RNA, 64 nt, hsa
uugcuuucucugggucuucaauuagaauguggcuggcccauauugguuuguguuuaaaugcugu

SEQ ID NO: 97929 - RNA, 64 nt, hsa
gcagugcuguuucugcauucauaaugcauuuauuggcccauauuuuuauguaaccuguuacaaa

SEQ ID NO: 97930 - RNA, 64 nt, hsa
aucucacagccuucucaugcugccggcucaucugggcccauagagugggcuuugccaguugcug

SEQ ID NO: 97931 - RNA, 64 nt, hsa
gacuggugcccuccucacucccaccugcaucuggggcccauacugguuggcucccgcggugcca

SEQ ID NO: 97932 - RNA, 64 nt, hsa
cuugguuacguccucauaaccuuagaccugaaagggcccauaaauauacuauguucacgaucag

SEQ ID NO: 97933 - RNA, 64 nt, hsa
gaaagcauuuauuaagaauuuacucaggcaugauggcccauacuuguaaucccagcuauuggga

SEQ ID NO: 97934 - RNA, 64 nt, hsa
ugucaggucagccucacuugucccuuucacaguuggcccauaaagucauguuucucucccuuua

SEQ ID NO: 97935 - RNA, 64 nt, hsa
gauaccuuuaccaugaacuuacagaauuaaagauggcccauaaggaauuccagaccaauauuuc

SEQ ID NO: 97936 - RNA, 64 nt, hsa
aggccuagcaggggugggcacacgggucacccgaggcccauaccaagacucuguuccugcccua

SEQ ID NO: 97937 - RNA, 64 nt, hsa
aaucauguguuuauaggauaguacacguuccccaggcccauaacagaggacuaaaaucucugaa

SEQ ID NO: 97938 - RNA, 64 nt, hsa
uucgauuagggaaguggagagcacaucccuguaaggcccauaagagaaagaggaguuuguuaca

SEQ ID NO: 97939 - RNA, 64 nt, hsa
cugucccucacuguugaauuuucucuaacuucaaggcccauaucugugaaaugcuggcauuugc

SEQ ID NO: 97940 - RNA, 64 nt, hsa
caagauuuuaaucaccuggucaccagacccucacggcccauauccaauucgaauuucagaaauu

SEQ ID NO: 97941 - RNA, 64 nt, hsa
augcugucaagcauacuguacugcccagaacaguggcccauagcagggaccugcccuaucaaaa

SEQ ID NO: 97942 - RNA, 64 nt, hsa
cggacccuggggccucccaccccagccucccugaggcccauacuccacggagaggagccccaug

SEQ ID NO: 97943 - RNA, 64 nt, hsa
ggggggccccucuccccaggacgucaggggguggggcccauaaauaaauggaagcugguuuugg

SEQ ID NO: 97944 - RNA, 64 nt, hsa
gcucauggguaggaagaaucaauaucaugaaaauggcccauacugcccaagguaauuuauagau

SEQ ID NO: 97945 - RNA, 64 nt, hsa
ugggcccagcgagcccccaccugcauugaccuuaggcccauagagagggccugucccggugcug

SEQ ID NO: 97946 - RNA, 64 nt, hsa
ucaucaaacucucagcauauggacggccagcuguggcccauaucuuggucacucugaagcacaa

SEQ ID NO: 97947 - RNA, 64 nt, hsa
aguuuugaauucuuuuagcaacuuggauuagaggggcccauaugucagaagcucccagcaccuc

SEQ ID NO: 97948 - RNA, 64 nt, hsa
gggcaaggacagcucagcugcuggcagccugccuggcccauagacaucccccaaguagucucag

SEQ ID NO: 97949 - RNA, 64 nt, hsa
gaguggcuccaaagagcaguggcuuuuugagaauggcccauacuucuggcccggcuggaugaag

SEQ ID NO: 97950 - RNA, 64 nt, hsa
acaucucuggucuuuagagccaccagaucucucuggcccauacagauaucagagcagacggaaa

SEQ ID NO: 97951 - RNA, 64 nt, hsa
uccagggcacaggcugccuuuuggagggagggcuggcccauaggugcugcuggcuccccgccac

SEQ ID NO: 97952 - RNA, 64 nt, hsa
auuuacguaguuuacgcuaccaaucugaauucgaggcccauaugagaggagcuuagaaacgacc

SEQ ID NO: 97953 - RNA, 64 nt, hsa
agacauucauguacagucuggaauguauauauggggcccauaaaaauucccaguaugcauguuu

SEQ ID NO: 97954 - RNA, 64 nt, hsa
accgugauggggccaacagcaagggagggguaggggcccauacaggaguccuccuuucugagcu

SEQ ID NO: 97955 - RNA, 64 nt, hsa
acuuuuaggaauuacuugguuuugcacauuaagaggcccauaaguuuaucagcuauuuacaacc

SEQ ID NO: 97956 - RNA, 64 nt, hsa
gccuaaggagcuguagggucugaggggcaggggaggcccauaucuuguuucagguaaaggaccc

SEQ ID NO: 97957 - RNA, 64 nt, hsa
gaggaagcaucccuugugcaagaucacauagucaggaggugacacagggcuaagacuugaacca

SEQ ID NO: 97958 - RNA, 64 nt, hsa
augugccccaucucauucuauacucacaucccauggaggugaggauuuucacuucuuuucucua

SEQ ID NO: 97959 - RNA, 64 nt, hsa
uccauugggcauaggggaguuggcuuuugccccaggaggugagguuaaggaguugggggccugg

SEQ ID NO: 97960 - RNA, 64 nt, hsa
gugugaauguugacguucguuucauggagaaaggggaggugaaagauugaagagcagguuccug

SEQ ID NO: 97961 - RNA, 64 nt, hsa
uggguggguggugugggcuugcaaauacaagcuuggaggugagacauggccagacaugacuccu

SEQ ID NO: 97962 - RNA, 64 nt, hsa
gagcaggagcaauuggcugccugcaaagccagcuggaggugaagugcaggaaaggaaaggucac

SEQ ID NO: 97963 - RNA, 64 nt, hsa
gagagcagacguggcuuuuuaugugucuuguuggggaggugacuugcaugguggggacaaggcu

SEQ ID NO: 97964 - RNA, 64 nt, hsa
ggggagcaccucugcccggccgcgaccccauuugggaggugaggagcaacucugcccagccgcc

SEQ ID NO: 97965 - RNA, 64 nt, hsa
ggucagucccccguccggccagccgccccguccgggaggugaggggcgccucugcccagcugcc

SEQ ID NO: 97966 - RNA, 64 nt, hsa
acuaaugacaaaccucuuuuuaagaugguagaauggaggugauagucacaaaaguaaauguucc

SEQ ID NO: 97967 - RNA, 64 nt, hsa
agggaucacaauucacugaaauacagcaguguguggaggugauggccaguuaaucugcugaacu

SEQ ID NO: 97968 - RNA, 64 nt, hsa
caguugcuggugaguggagaugauugaagggcuaggaggugagggccuucauuaauugagauca

SEQ ID NO: 97969 - RNA, 64 nt, hsa
auucucacuggggugauuaguggaggaagucuggggaggugagcuacuggaagagacagggcaa

SEQ ID NO: 97970 - RNA, 64 nt, hsa
aagaauauuuguaguuaucuuagaagauagcaugggaggugaggauuccaaaaacauuuuauuu

SEQ ID NO: 97971 - RNA, 64 nt, hsa
auccgcaauguggagcagcagccacugcacaggaggaggugacaaaccauuuccaacagcaaca

SEQ ID NO: 97972 - RNA, 64 nt, hsa
uguucucuccagcccagcauacaggaggaucaaaggaggugacggagcaucguggcacggcagu

SEQ ID NO: 97973 - RNA, 64 nt, hsa
ccaguuugaaugcagucuguccaggcucgucauuggaggugaacaagcaaacccagacggcucc

SEQ ID NO: 97974 - RNA, 64 nt, hsa
aacuaaaaaaauuaagaaauucacuuccccucuaggaggugaugauaggguuucuaaugguuau

SEQ ID NO: 97975 - RNA, 64 nt, hsa
cagaaaacggaggauggggguggggcgccuuccuggaggugacacuugauggggguguguucug

SEQ ID NO: 97976 - RNA, 64 nt, hsa
accaagacuucaucccccccaaaaaaaaaagauuggaggugauuuacagugaaagacacaaaua

SEQ ID NO: 97977 - RNA, 64 nt, hsa
gagaggaccaacucuuuaauuuuuaguaaaaccuggaggugaugggccgggcgcaguggcucac

SEQ ID NO: 97978 - RNA, 64 nt, hsa
ggggaggcugaggcagaagaaucgcuugaacccaggaggugagguugcagugagcugagauugc

SEQ ID NO: 97979 - RNA, 64 nt, hsa
ucucuguuaacucagaaagagaugggagguugggggaggugagcauaaacgcagaguucacugu

SEQ ID NO: 97980 - RNA, 64 nt, hsa
gauggggucuuauccuggccucugaggguucagcggaggugaggaaggcagcagagcuccagca

SEQ ID NO: 97981 - RNA, 64 nt, hsa
gaagccccuccuccuucccccacagauggggacaggaggugauggggugcucagaacccugcag

SEQ ID NO: 97982 - RNA, 64 nt, hsa
uuccaugaucuuggagugacucugaaggacucugggaggugagacguugucccggagaucaaaa

SEQ ID NO: 97983 - RNA, 64 nt, hsa
uuuuuaaguagagguaaaauugagauggggggcgggaggugacaucaugaaguuuuuuggaaau

SEQ ID NO: 97984 - RNA, 64 nt, hsa
cguuucaauuguggaccggcgccgagggggaaagggaggugacuucgcccgguggcaauaguuc

SEQ ID NO: 97985 - RNA, 64 nt, hsa
uugggaaaaaggccucugucccggaagagucaugggaggugaaaggggcacguuugaagaugcg

SEQ ID NO: 97986 - RNA, 64 nt, hsa
augcaauucaucccagaggaaccugaggccugaaggaggugagagaagaccucugugaggaaag

SEQ ID NO: 97987 - RNA, 64 nt, hsa
gggcagcagaggccccugggcagcccagccaggggagccacagccccaaggauggucuugcucu

SEQ ID NO: 97988 - RNA, 64 nt, hsa
uggcgacaguuucccuuaggggucugccuggcaggagccacagcucaggagaguugugagggau

SEQ ID NO: 97989 - RNA, 64 nt, hsa
ccucaccccaguuccaugacauuggcugguauaggagccacagucaggaaagcacuugaggcag

SEQ ID NO: 97990 - RNA, 64 nt, hsa
caaugcaguucugagcaccgugucaagcugcucugagccacagugggaugaaccagccggggcc

SEQ ID NO: 97991 - RNA, 64 nt, hsa
ccugugcagagccccauccacugguucuugcccugagccacauaugucugugccaugggcugag

SEQ ID NO: 97992 - RNA, 64 nt, hsa
uaaaauacuccuuucugcccauuggccaugcugggagccacagcuauccagagccagcaugacc

SEQ ID NO: 97993 - RNA, 64 nt, hsa
uccagggcaucuuaaguucauccagcagcuccaugagccacacagauauccuagaaaauauucc

SEQ ID NO: 97994 - RNA, 64 nt, hsa
uuguuucugaauaucucaggguaggaaccauguggagccacacauucccugaccacagggaagc

SEQ ID NO: 97995 - RNA, 64 nt, hsa
agcuagaggcagggcugucccacagaaauagugugagccacauaugugacuuuaaauuuucuga

SEQ ID NO: 97996 - RNA, 64 nt, hsa
uucagcuccugcuuggccaguguggagaggaaaggagccacaggagcgggugcuacacccggca

SEQ ID NO: 97997 - RNA, 64 nt, hsa
aucgguaguguuguguguaggccauucuucuggagagccacaagcaggaagagcagcgcugugu

SEQ ID NO: 97998 - RNA, 64 nt, hsa
cuuaguguuuucauugcaaauuauaauugcuguagagccacacacaacuuuugaacuuuuaauu

SEQ ID NO: 97999 - RNA, 64 nt, hsa
ucgagcucagguucgccacauagaucccgugcaggagccacauggguccugugcaggaccccua

SEQ ID NO: 98000 - RNA, 64 nt, hsa
ucaaaguggaaugaagcucuggcuuuuggaaggagagccacacuguggcgggucggcggcccuc

SEQ ID NO: 98001 - RNA, 64 nt, hsa
gcuaaggagccucauagccuggcgggggcuggcagagccacaccccaagugccugugcccagag

SEQ ID NO: 98002 - RNA, 64 nt, hsa
aaauguuuucucauucagucuccagucauugguugagccacagccuagggguuggaggaagacu

SEQ ID NO: 98003 - RNA, 64 nt, hsa
aacccuccuguccuggacgugacuucauccugaggagccacagcacaggccgugcuggcacuuu

SEQ ID NO: 98004 - RNA, 64 nt, hsa
caugucuuaggugcagcugugccacgggucagcugagccacagucccagaaccaagcucucggu

SEQ ID NO: 98005 - RNA, 64 nt, hsa
aggguaauaacagaauuggaaccaugccacucuugagccacaauaccugucaccagccuguugu

SEQ ID NO: 98006 - RNA, 64 nt, hsa
guucuguuggagaaacgcuugguuuccggauccagagccacagaaagaaauguaggugugaagu

SEQ ID NO: 98007 - RNA, 64 nt, hsa
agggggagagggaaaaguaaccgggagacaaauugagccacauauuuucagacacuuguuacca

SEQ ID NO: 98008 - RNA, 64 nt, hsa
aguuaugagacugggaaagaacggggcacucaaagagccacacacaucugggccugggcgacgu

SEQ ID NO: 98009 - RNA, 53 nt, hsa
aagagcugacaauuacauaacaggagccacauuccccauugaucaacccccaa

SEQ ID NO: 98010 - RNA, 64 nt, hsa
ugaucaacccccaaagccaugagggauccaaguagagccacagaaaaagaagaauuccaggaga

SEQ ID NO: 98011 - RNA, 64 nt, hsa; identical to SEQ ID NO: 53673

SEQ ID NO: 98012 - RNA, 64 nt, hsa; identical to SEQ ID NO: 53674

SEQ ID NO: 98013 - RNA, 64 nt, hsa; identical to SEQ ID NO: 53675

SEQ ID NO: 98014 - RNA, 64 nt, hsa; identical to SEQ ID NO: 53676

SEQ ID NO: 98015 - RNA, 64 nt, hsa; identical to SEQ ID NO: 53677

SEQ ID NO: 98016 - RNA, 64 nt, hsa; identical to SEQ ID NO: 53678

SEQ ID NO: 98017 - RNA, 64 nt, hsa; identical to SEQ ID NO: 53679

SEQ ID NO: 98018 - RNA, 64 nt, hsa; identical to SEQ ID NO: 53680

SEQ ID NO: 98019 - RNA, 64 nt, hsa; identical to SEQ ID NO: 53681

SEQ ID NO: 98020 - RNA, 64 nt, hsa; identical to SEQ ID NO: 53682

SEQ ID NO: 98021 - RNA, 64 nt, hsa; identical to SEQ ID NO: 53683

SEQ ID NO: 98022 - RNA, 64 nt, hsa; identical to SEQ ID NO: 53684

SEQ ID NO: 98023 - RNA, 64 nt, hsa
cucugaggauaaaguugccaguccuuuuaauggucagccuaaucauucugucagccuaaucggg

SEQ ID NO: 98024 - RNA, 64 nt, hsa
ccaguccuuuuaauggucagccuaaucauucugucagccuaaucggguaauugcuuuuuuuaau

SEQ ID NO: 98025 - RNA, 64 nt, hsa
ccuggaggcggaucaucuaauucucuguggaaugaauacacacauauauauuacaagggauaau

SEQ ID NO: 98026 - RNA, 64 nt, hsa
accucugucuucagcacccucauaagucgucacuaauacacaguuuuguacauguaacauuaaa

SEQ ID NO: 98027 - RNA, 64 nt, hsa
cuguguaugaauaaauauuaccugucuaccucaaaauacacauacugcugaagcauucuguaca

SEQ ID NO: 98028 - RNA, 64 nt, hsa
uugacuuugcaauggugcuaagcugauagauuuaaauacacagacgggcgaguggcgcccgugu

SEQ ID NO: 98029 - RNA, 64 nt, hsa
gagguugguaagagugacuaaccagccuaacuuuaauacacauguauaaagauguucacagaga

SEQ ID NO: 98030 - RNA, 64 nt, hsa
aauauauuuuucuuuuaauuuccagugacuuuagaauacacacaguuuuuccgacuuuucaaaa

SEQ ID NO: 98031 - RNA, 64 nt, hsa
agccauugcuuaaaauauaacauguuuuggauccaauacacacauuguuacaacuaacacaaau

SEQ ID NO: 98032 - RNA, 64 nt, hsa
uucccacagucuuuuauauaauuaaauauaugucaauacacauuagaaucagauuugaaaaagu

SEQ ID NO: 98033 - RNA, 64 nt, hsa
aguacauauuuucaggaucguucaucuagugagcaauacacauauuauaggccaauauuuuuuu

SEQ ID NO: 98034 - RNA, 64 nt, hsa
aauaauguaaaugggggcuucaauauauauauauaauacacacacacacacacaugcacacaua

SEQ ID NO: 98035 - RNA, 64 nt, hsa
uuugauuaaguaaaaaaaaucccuauucuuggaaaauacacaauaaaguauuuugagguaaagg

SEQ ID NO: 98036 - RNA, 64 nt, hsa
cauacacaugccuccaugcauauaugugugugauaauacacaugcauuuaugugcgugugugua

SEQ ID NO: 98037 - RNA, 64 nt, hsa
aaaaaaaauuuauauauacauuguguguguguguaauacacacacacaacccccuauaccugga

SEQ ID NO: 98038 - RNA, 64 nt, hsa
cuagagcgagcaagagagggagagaggaggaaaaaauacacauaauacaaacauacaugcaugc

SEQ ID NO: 98039 - RNA, 64 nt, hsa
cacaugaagauaacuuuuuuuaaaaaaaagcagaaauacacaaugaucucccuuguaagcuccu

SEQ ID NO: 98040 - RNA, 64 nt, hsa
guggagacuuauaagaaggaguacauuugaguugaauacacaaaucuuuacuucucuaccaauu

SEQ ID NO: 98041 - RNA, 64 nt, hsa
accgcaccugccucacauuuucuuucucacuguaaauacacauucuuauucuugaaccuucuga

SEQ ID NO: 98042 - RNA, 64 nt, hsa
acagaaacaagagccccuaagucccagccucugcaauacacaguuaccagaugggaaugcagca

SEQ ID NO: 98043 - RNA, 64 nt, hsa
uguuuuaaggaaauacacagugaaguuuuuaggaaauacacacuaaguauuuagggauaaagua

SEQ ID NO: 98044 - RNA, 64 nt, hsa
cuauguaagagaauaaaugccauuguuuuaaggaaauacacagugaaguuuuuaggaaauacac

SEQ ID NO: 98045 - RNA, 64 nt, hsa
aucccucuaaauuaguucccuagcuuucucaaugaauacacacauauuuuuacauagcuaugau

SEQ ID NO: 98046 - RNA, 64 nt, hsa
auucuuuauugcugguuuuucauuuacacugauaaauacacagaucuuauaaagucuuuaacau

SEQ ID NO: 98047 - RNA, 64 nt, hsa
cauuuugaccaguguuuuacaacauguacauaagaauacacauaauucaacuagagauuugaag

SEQ ID NO: 98048 - RNA, 64 nt, hsa
aagaguauuuggagcaagaagcugcaaugcgccaaauacacaauaggccuuuucuuuaucauuc

SEQ ID NO: 98049 - RNA, 64 nt, hsa
uucuguuuagagagauagaaguuaugacauauguaauacacaucuguguacacagaaaccggca

SEQ ID NO: 98050 - RNA, 64 nt, hsa
gaaaagccaccaauucuagaucuugauuugaauuaauacacacaauaucugagacacuuacacu

SEQ ID NO: 98051 - RNA, 64 nt, hsa
gaugccagauaucccauacagaauuagcagagaaaauacacacaggcuucuauucaaauuuucu

SEQ ID NO: 98052 - RNA, 64 nt, hsa
uaagacuuuaaaauguaagcauuguaauucugaaaauacacauuuuaagaagaaacuauuuugc

SEQ ID NO: 98053 - RNA, 64 nt, hsa
guuuuuuuguuguuguuagugagucucccuucaaaauacacaguagguaguguaaauacugcuu

SEQ ID NO: 98054 - RNA, 64 nt, hsa
uuucaugguauuacugaagguguguauacucccuaauacacauuuaugaaaaucuacuuguuua

SEQ ID NO: 98055 - RNA, 64 nt, hsa
guucauauaaucucgggauacacacacacacacacauauauauacacacacauacguauacaca

SEQ ID NO: 98056 - RNA, 64 nt, hsa
uauauauacacacacauacguauacacacacauacauauauauaaauauaccugaugccagauu

SEQ ID NO: 98057 - RNA, 64 nt, hsa
acacguuagaaagcaacacuguuuuuauguaguucauauauauuaccaugacauuuaacaucaa

SEQ ID NO: 98058 - RNA, 64 nt, hsa
ucguauauguugaaggagguauaauaaacucagucauauauagugaacaguucaaaugggaaag

SEQ ID NO: 98059 - RNA, 64 nt, hsa
gaacuaugaacuucauccauuugcacuguucagacauauauauguauguauguaaaaauuauau

SEQ ID NO: 98060 - RNA, 64 nt, hsa
aauuauauauacacaaauuagcugcacguauauacauauauauauuucuuuuuaaauuucauau

SEQ ID NO: 98061 - RNA, 64 nt, hsa
uguaccuuuauauauauguguguguacauauauacauauauaaacuguauaguguacaugguaa

SEQ ID NO: 98062 - RNA, 64 nt, hsa
aacuaaucuguaccuuuauauauauguguguguacauauauacauauauaaacuguauagugua

SEQ ID NO: 98063 - RNA, 64 nt, hsa
aauauaacauuccagagaauuguggaaaauacugcauauauauguauagacucugacacauauu

SEQ ID NO: 98064 - RNA, 64 nt, hsa
ugcauauauauguauagacucugacacauauuuacauauauaucaagugugcuuagaaaaaugu

SEQ ID NO: 98065 - RNA, 64 nt, hsa
acccaggaaacagaacuuuaagauauauacagcacauauauauauauauacauauauauauaca

SEQ ID NO: 98066 - RNA, 64 nt, hsa
uuuaagauauauacagcacauauauauauauauacauauauauauacacauauauaaaaaacaa

SEQ ID NO: 98067 - RNA, 64 nt, hsa
agcacauauauauauauauacauauauauauacacauauauaaaaaacaaaagcaaaaaauauu

SEQ ID NO: 98068 - RNA, 64 nt, hsa
ucuguguguguguguguauguauacacacauauacauauauauauacacauacauacacauaca

SEQ ID NO: 98069 - RNA, 64 nt, hsa
uauauacacauacauacacauacauacauacauacauauauaucugauaaaauugugauguuuu

SEQ ID NO: 98070 - RNA, 64 nt, hsa
uauguuuuagccagugaugcuaaagguuguauugcauauauacauauauauauauauauauaua

SEQ ID NO: 98071 - RNA, 64 nt, hsa
agccagugaugcuaaagguuguauugcauauauacauauauauauauauauauauauauauaua

SEQ ID NO: 98072 - RNA, 64 nt, hsa
cuccuuuuuccuuuaaucuuauuuuugaugaacacauauauaggagaacaucuauccuaugaau

SEQ ID NO: 98073 - RNA, 64 nt, hsa
cucuuucaaaauuuuacagaauguuaucauacuacauauauacuuuuuauguaagcuuuuucac

SEQ ID NO: 98074 - RNA, 64 nt, hsa
acaucaugaaacaucaucucuacauaaaaaaauacauauauacaaaaauuagcugggcaucaug

SEQ ID NO: 98075 - RNA, 64 nt, hsa
aaagucgagaauuccaagaacuguuacauauaaucauauauaugccuauaucuaaacguuuucc

SEQ ID NO: 98076 - RNA, 64 nt, hsa
aguuugguaacacagcuuuaacuaugucaugcaacauauauauguugguaggauguuauuagag

SEQ ID NO: 98077 - RNA, 64 nt, hsa
auguugguaggauguuauuagagagauaugugugcauauauauuuuuuugcaccugaaucaccc

SEQ ID NO: 98078 - RNA, 64 nt, hsa
acuaaagggaaguucaaguucucauguaaugccacauauauacuugagguguagagauguuauu

SEQ ID NO: 98079 - RNA, 64 nt, hsa
uaguugauugauuaaugauguauugccuuuugcccauauauacccuguguaucuauacuuggaa

SEQ ID NO: 98080 - RNA, 64 nt, hsa
ggaaauauauauguuucugugauauacauauauacauauauauguauauauauacacacacaua

SEQ ID NO: 98081 - RNA, 64 nt, hsa
aaaauuugggaaauauauauguuucugugauauacauauauacauauauauguauauauauaca

SEQ ID NO: 98082 - RNA, 64 nt, hsa
aaauuauauauauauauauauauacacacacacacauauauauauauauauaauucaaagcaca

SEQ ID NO: 98083 - RNA, 64 nt, hsa
aaagucuuuuguacauaacauauauauauauauacauauauauaaauauaaauauaaauauauc

SEQ ID NO: 98084 - RNA, 64 nt, hsa
uggugccugauaucucaaagucuuuuguacauaacauauauauauauauacauauauauaaaua

SEQ ID NO: 98085 - RNA, 64 nt, hsa
uguguacauauacauauauacauaucuacacauacauauauacacauauauguguguauguaga

SEQ ID NO: 98086 - RNA, 64 nt, hsa
uguaugcuuguguguguaaauguguguacauauacauauauacauaucuacacauacauauaua

SEQ ID NO: 98087 - RNA, 64 nt, hsa
ugguuuaaaagaacuauaucuauauguauauuuucauauauaugacagaacaagaauauguauu

SEQ ID NO: 98088 - RNA, 64 nt, hsa
cuuauaauagcagaggucuugguaaaauaacuaccauauauaacguguuauugccaucuagaag

SEQ ID NO: 98089 - RNA, 64 nt, hsa
uguuuauauauauauauauauguauauauauauacauauauauauauauauaaacaugaaauau

SEQ ID NO: 98090 - RNA, 64 nt, hsa
auauuuccucuuuuggauaggucuuuaaccaguucauauauauacuuugucaaauauauggaug

SEQ ID NO: 98091 - RNA, 64 nt, hsa
agauugcuuuaauuugaugggaaaauaguacacacauauauauaacaaauaauauauuaaaaaa

SEQ ID NO: 98092 - RNA, 64 nt, hsa
uauuuccaaguuuguguauauauuauaaaaauuacauauauaaaacuaaggcuuuuauuucugu

SEQ ID NO: 98093 - RNA, 64 nt, hsa
uguguguguguguaugaguuucuaugugagcaugcauauauacuucacaaagagaugaccuaua

SEQ ID NO: 98094 - RNA, 64 nt, hsa
uguguguacguguguauauguguauauauauacacauauauauacacauacacaaauauaugca

SEQ ID NO: 98095 - RNA, 64 nt, hsa
cucccaggucugugucugauagcauacacacacacauauauauacacacacacacacacacaca

SEQ ID NO: 98096 - RNA, 64 nt, hsa
cacacacacacacacacacauacauacacacacacauauauauacacacacacacacacacaca

SEQ ID NO: 98097 - RNA, 64 nt, hsa
uuuuuagauucaucaacagaccaguuuuugugggcauauauauauacacgugcaaauaucagaa

SEQ ID NO: 98098 - RNA, 64 nt, hsa
aacugacuaaaaaucaauauagauauuuuauauacauauauauauauaaaaauacaaaauucag

SEQ ID NO: 98099 - RNA, 64 nt, hsa
uauauauauacauauguauauauauuuaaauacacauauauauuguacagaauaaaaauguuuu

SEQ ID NO: 98100 - RNA, 64 nt, hsa
gacucagggauuuguuggcuaagguuucucugugcauauauauauauauacauauguauauaua

SEQ ID NO: 98101 - RNA, 64 nt, hsa
cacacauacauacauacauauauauauauauauacauauauauacauacacacauacauauaau

SEQ ID NO: 98102 - RNA, 64 nt, hsa
cacacacacacacacacacacacauacauacauacauauauauauauauauacauauauauaca

SEQ ID NO: 98103 - RNA, 64 nt, hsa
aacaugaaaaagcagggaaucucaaacuuuauuccauauauacacacacacacacacacacaca

SEQ ID NO: 98104 - RNA, 64 nt, hsa
uauguauauguguacauauggacauacacauuuacauauauauaaaguauauauauacauauau

SEQ ID NO: 98105 - RNA, 64 nt, hsa
auacacauuuacauauauauaaaguauauauauacauauauauauauauauauguaugaaaccc

SEQ ID NO: 98106 - RNA, 64 nt, hsa
uaugugaaugugugugaguguguauucacauacacauauauacuggaaccuauaguagaaaagg

SEQ ID NO: 98107 - RNA, 64 nt, hsa
ggaauuaaaagcuuaaacccaaaaauuguucauccauauauaagaaauuaucgaauuaaaacuu

SEQ ID NO: 98108 - RNA, 64 nt, hsa
gaaggaacuuuaaaagcaacaagcaauuauguaccauauauacacuguagcaaauauuuuauau

SEQ ID NO: 98109 - RNA, 64 nt, hsa
cuucuaggauccagcugugucaaccuuuauuuagcauauauaacuauaaaucacuuauuacaga

SEQ ID NO: 98110 - RNA, 64 nt, hsa
cuccugcaauguuuuucuugcuuuuugccuuccccauauauauggaacuuggcuaccucugccu

SEQ ID NO: 98111 - RNA, 64 nt, hsa
aaugacauauaagccguauauagaucaauguccacauauauauacacacacacauauauauaua

SEQ ID NO: 98112 - RNA, 64 nt, hsa
uauagaucaauguccacauauauauacacacacacauauauauauauaaaguguaacaaggaac

SEQ ID NO: 98113 - RNA, 64 nt, hsa
uuuagauauacaucacaugugauauaucuagauccauauauagguuugccuuagauaccuaaau

SEQ ID NO: 98114 - RNA, 64 nt, hsa
uaugagccucccuugugcacguauguguauaccacauauauaugcauuuagauauacaucacau

SEQ ID NO: 98115 - RNA, 64 nt, hsa
aaaauaaugggcaaaaauuuuuguugcaacuuuucauauauauuuuccccuuaccaauuguuuu

SEQ ID NO: 98116 - RNA, 64 nt, hsa
aggugcguucuagaugucauccuaaaaaacacuucauauauaauuaaucacuauuuuguauaau

SEQ ID NO: 98117 - RNA, 64 nt, hsa
uuguccaguaguuuaguuuguguacauauauacacauauauauuuugcacuacacaaacgauaa

SEQ ID NO: 98118 - RNA, 64 nt, hsa
uugcuuuuuguuguccaguaguuuaguuuguguacauauauacacauauauauuuugcacuaca

SEQ ID NO: 98119 - RNA, 64 nt, hsa
gauaaagcugucucaugggugcuccauauauauucauauauauuuguugagugaauuaaugaau

SEQ ID NO: 98120 - RNA, 64 nt, hsa
aagugccugggauaaagcugucucaugggugcuccauauauauucauauauauuuguugaguga

SEQ ID NO: 98121 - RNA, 64 nt, hsa
augugcaaagucaacaguauuugccuuaagauuucauauauauauauuuuuuugcauugacugc

SEQ ID NO: 98122 - RNA, 64 nt, hsa
caaagaaagaguagcaggccuuuguauguguguacauauauauauauauaacaaaacaucagcc

SEQ ID NO: 98123 - RNA, 64 nt, hsa
uuuuuuucuggguucauauauauauauauauauacauauauauauauuuuuuuuuggaugaagg

SEQ ID NO: 98124 - RNA, 64 nt, hsa
guauaacuuuguaaauaaguuuuuuuucuggguucauauauauauauauauauacauauauaua

SEQ ID NO: 98125 - RNA, 64 nt, hsa
ccagcuuaagcguucauaugcucugcuuuuaguucauauauacauacauaauguuuuuccuuuc

SEQ ID NO: 98126 - RNA, 64 nt, hsa
uaaauuacuauggcugauuuauuucuacuauauacauauauauuuuuugcuuuuguauauccua

SEQ ID NO: 98127 - RNA, 64 nt, hsa
cgacagagcaagacacugucucucucucucucuccauauauauauguguguguguguauauaua

SEQ ID NO: 98128 - RNA, 64 nt, hsa
uauauauauauauguguguguguguguguguauacauauauacacauauauacacacacacaua

SEQ ID NO: 98129 - RNA, 64 nt, hsa
uauguguguguguguguguguauacauauauacacauauauacacacacacauacauauacaug

SEQ ID NO: 98130 - RNA, 64 nt, hsa
cacauacauauacauguguauauauauaccaucccauauauaugugggauauauauauauauau

SEQ ID NO: 98131 - RNA, 64 nt, hsa
gacuaguaaaucacagugguucaaaauauauauccauauauauauauauccauauauauaucuc

SEQ ID NO: 98132 - RNA, 64 nt, hsa
ugguucaaaauauauauccauauauauauauauccauauauauaucucaugucaucacauuaca

SEQ ID NO: 98133 - RNA, 64 nt, hsa
uauauauguauguauauacacacguacauacauucauauauauacauauauacauaaugugcuu

SEQ ID NO: 98134 - RNA, 64 nt, hsa
uguauauacacacguacauacauucauauauauacauauauacauaaugugcuuaaccacugcc

SEQ ID NO: 98135 - RNA, 64 nt, hsa
gagagaggccuuuuaaaauauauauauauauacacauauauauguauauauacacauauaugua

SEQ ID NO: 98136 - RNA, 64 nt, hsa
cauguauauauauauacauacacauauauguauacauauauacacauauauguauacauauaua

SEQ ID NO: 98137 - RNA, 64 nt, hsa
cauauauguauacauauauacacauauauguauacauauauacacauauguauacauauauaua

SEQ ID NO: 98138 - RNA, 64 nt, hsa
cacauauauguauacauauauacacauauguauacauauauauauauucuacaguaaaacugua

SEQ ID NO: 98139 - RNA, 64 nt, hsa
gaaaacugacagaggagggcgugacucacccaagcauauauaacuagcuagaagugggccagga

SEQ ID NO: 98140 - RNA, 64 nt, hsa
acaucugaaagccacguuccuuacugcagaauagcauauauaucgcuuaaucuuaaauuuauua

SEQ ID NO: 98141 - RNA, 64 nt, hsa
auuucauauauauauacauauauauauacacauacauauauauauauauauauguauguauaaa

SEQ ID NO: 98142 - RNA, 64 nt, hsa
uguuucuaaccacagagaauuucauauauauauacauauauauauacacauacauauauauaua

SEQ ID NO: 98143 - RNA, 64 nt, hsa
cuaguuuaaauauguuucuaaccacagagaauuucauauauauauacauauauauauacacaua

SEQ ID NO: 98144 - RNA, 64 nt, hsa
uugugagucauauauauacauauauauauauacacauauauauaugacuugaaaauuaagauuu

SEQ ID NO: 98145 - RNA, 64 nt, hsa
acuuauuucauugguuuugugagucauauauauacauauauauauauacacauauauauaugac

SEQ ID NO: 98146 - RNA, 64 nt, hsa
caaguaugauacuuauuucauugguuuugugagucauauauauacauauauauauauacacaua

SEQ ID NO: 98147 - RNA, 64 nt, hsa
uauauacacacacacacacacauauguacacauacauauauauacauauauauguauauauaga

SEQ ID NO: 98148 - RNA, 64 nt, hsa
cacacacacacauauguacacauacauauauauacauauauauguauauauagaacacauggca

SEQ ID NO: 98149 - RNA, 64 nt, hsa
aagugaacuaaauauauauguguauauguauacacauauauauacacacacacauauauauauu

SEQ ID NO: 98150 - RNA, 64 nt, hsa
uguguauauguauacacauauauauacacacacacauauauauauuuagaaacgugaguguuaa

SEQ ID NO: 98151 - RNA, 64 nt, hsa
uguuauuauuacaagggaaauagauuuauacauacauauauauauucuucauuacaggaaaugu

SEQ ID NO: 98152 - RNA, 64 nt, hsa
acuuguaaacagaauguuuauuaccucauaagugcauauauagugugaaagagaaggcauuaaa

SEQ ID NO: 98153 - RNA, 64 nt, hsa
cuagacaaaauugucuucucuuucaaaccagagccauauauaugucuguauauaugggaccuac

SEQ ID NO: 98154 - RNA, 64 nt, hsa
auucuuagacucaugugauccaagcuguauauaccauauauaaacauuuuacaugaaucauuua

SEQ ID NO: 98155 - RNA, 64 nt, hsa
aguauuuacagcuaaccuaucuauucauauuuuacauauauauauauauauauacaugcacaca

SEQ ID NO: 98156 - RNA, 64 nt, hsa
uuuugaagaguuuuucuugugcuugcuucggcagcauauauacugaaauuagaaaaagaaaacu

SEQ ID NO: 98157 - RNA, 64 nt, hsa
caagcggugccuaagaaguuauuuucuuguuuaacauauauauuuauuaauuuauuugucgugu

SEQ ID NO: 98158 - RNA, 64 nt, hsa
guggaaaguccugaacuccuggcuuuccaggagacauauauaggggaacaucacccuauauaua

SEQ ID NO: 98159 - RNA, 64 nt, hsa
gcuuuuuacucuaaaauucaauguaauuaaauuucauauauauauaauauauacauauauacau

SEQ ID NO: 98160 - RNA, 64 nt, hsa
aauguaauuaaauuucauauauauauaauauauacauauauacauaguguaaaauaaaauguuu

SEQ ID NO: 98161 - RNA, 64 nt, hsa
caguauauacauauguguguauauacaguauauacauauauauauuuucacuugcuuucaagau

SEQ ID NO: 98162 - RNA, 64 nt, hsa
cugacaaagaugaaauccacuuuuaauauauauacauauauauuuguuaauauauuaaaacagu

SEQ ID NO: 98163 - RNA, 64 nt, hsa
cucaaaaaaaaaaacaaacaaacaaaaaaaaaaccauauauauacauauauauauagcagcuuu

SEQ ID NO: 98164 - RNA, 64 nt, hsa
aaaacaaacaaacaaaaaaaaaaccauauauauacauauauauauagcagcuuuauggagauau

SEQ ID NO: 98165 - RNA, 64 nt, hsa
aaggacaugaguuaaauauauuuauauguacauacauauauauaucccuuuacauauauaugua

SEQ ID NO: 98166 - RNA, 64 nt, hsa
uauuuauauguacauacauauauauaucccuuuacauauauauguaugugggugugagugugua

SEQ ID NO: 98167 - RNA, 64 nt, hsa
aaagauaaccaguuuuugcagagaaacguguacccauauauaauucucccacacuagcuugcag

SEQ ID NO: 98168 - RNA, 64 nt, hsa
uguauguuaauagaaaauauauuugcauaauaugcauauauauguauauuuaccaagauuuugu

SEQ ID NO: 98169 - RNA, 64 nt, hsa
cagugcccauguguauggaagacaaauacacauacauauauacauuuugcagcuauggacaauu

SEQ ID NO: 98170 - RNA, 64 nt, hsa
auacgcaauuguauauauaugugaacuuucucagcauauauauaaaauacacguguauaugagg

SEQ ID NO: 98171 - RNA, 64 nt, hsa
ccuguacacacacagacacacaagcagacacacacauauauacauacgcaauuguauauauaug

SEQ ID NO: 98172 - RNA, 64 nt, hsa
uacaaagagguguacagguaccaucuuguauacacauauauacccacauguacagacauacauu

SEQ ID NO: 98173 - RNA, 64 nt, hsa
gacauacauuuaugcacauucacgcuguuuguuucauauauacaggcauaaaauagaguaaaua

SEQ ID NO: 98174 - RNA, 64 nt, hsa
guaucaggcuaggacgcucugagcugugcauguacauauauacauauauagauacauuuauaau

SEQ ID NO: 98175 - RNA, 64 nt, hsa
cuaggacgcucugagcugugcauguacauauauacauauauagauacauuuauaauauauacac

SEQ ID NO: 98176 - RNA, 64 nt, hsa
uucuauauacgagcuauauauaaauauauauauacauauauauauacacacauacauaucuaga

SEQ ID NO: 98177 - RNA, 64 nt, hsa
acaucaccaucuagaguaucacgcacacaucuaccauauauacagauauauucuauauacgagc

SEQ ID NO: 98178 - RNA, 64 nt, hsa
uacaguuuuauuccucuucagacaugaaagggaacauauauauuccauauauauguucaacucu

SEQ ID NO: 98179 - RNA, 64 nt, hsa
uccucuucagacaugaaagggaacauauauauuccauauauauguucaacucuucauagauugu

SEQ ID NO: 98180 - RNA, 64 nt, hsa
uaugugaauucuaccuaaacaugcuauuacagcucauauauacuuuuuccaucuggauucuuca

SEQ ID NO: 98181 - RNA, 64 nt, hsa
caguuuuauuuuuggugaauuauguuuauacugccauauauaggaacucuuugcuuaacuggag

SEQ ID NO: 98182 - RNA, 64 nt, hsa
cacacacacacacacacacacacacacacacacacauauauauauauauauauuuuuuuuuuuu

SEQ ID NO: 98183 - RNA, 64 nt, hsa
uauauauauacacacacacacacacacacacacacauauauacauauacacacacacacacaca

SEQ ID NO: 98184 - RNA, 64 nt, hsa
auaccauauauguauauauuccacauauguauuccauauauauauuccauauguauaugugugu

SEQ ID NO: 98185 - RNA, 64 nt, hsa
gaauuucuuaacaaaaugauggccaagguaguuccauauauauacauauauuccacaugugugu

SEQ ID NO: 98186 - RNA, 64 nt, hsa
ggcuguagguuuuaaauuuuuauaucuauacauacauauauacauauauauauaauguacaaua

SEQ ID NO: 98187 - RNA, 64 nt, hsa
guuuuaaauuuuuauaucuauacauacauauauacauauauauauaauguacaauauauacaua

SEQ ID NO: 98188 - RNA, 64 nt, hsa
uggcccaugguggcccuuccagugcauauacauacauauauauauauauaugcauauauauaua

SEQ ID NO: 98189 - RNA, 64 nt, hsa
ccagugcauauacauacauauauauauauauaugcauauauauauauauauauauauauaugug

SEQ ID NO: 98190 - RNA, 64 nt, hsa
uauauauauguguauacacacacacauagacagacauauauauauauauuuauuuuuuuuacug

SEQ ID NO: 98191 - RNA, 64 nt, hsa
uguguguguauauguguuuauagagauacacacacauauauauguguguauauauauacacaua

SEQ ID NO: 98192 - RNA, 64 nt, hsa
cacacauauauauguguguauauauauacacauacauauauauacacacacgcauuugcacaga

SEQ ID NO: 98193 - RNA, 64 nt, hsa
cuuccuuuccuaccccuuuucucuuuuauccuuucauauauacacaugcaaaguuuacaaccuu

SEQ ID NO: 98194 - RNA, 64 nt, hsa
auuuuauaaauguguauuucuguguauucacauacauauauauauacacacauauauauguaca

SEQ ID NO: 98195 - RNA, 64 nt, hsa
uuucuguguauucacauacauauauauauacacacauauauauguacauacacauacauacaua

SEQ ID NO: 98196 - RNA, 64 nt, hsa
aaucagauggaaauggaguuuuaaggcaagaggccauauauagggcuacaucuuguuaauugca

SEQ ID NO: 98197 - RNA, 64 nt, hsa
gacugagaagcuggauuuaaucaucccugcccuacauauauaaacauaagguaaccuacugaau

SEQ ID NO: 98198 - RNA, 64 nt, hsa
uacacacacacagacauauauauauauaugcacacauauauaggcaguugcaugcuagcauggg

SEQ ID NO: 98199 - RNA, 64 nt, hsa
auugacauugaauggaucaauacacacacacagacauauauauauauaugcacacauauauagg

SEQ ID NO: 98200 - RNA, 64 nt, hsa
uauacgaacaaaacacacgcgcgcacacacacacauacacgaaagagagagaaacaaacuuuuc

SEQ ID NO: 98201 - RNA, 64 nt, hsa
cuauuuggugucguggaaccucuuacugcuuucaauacacgauuaguaaucaacuguuuuguau

SEQ ID NO: 98202 - RNA, 64 nt, hsa
uauuguauuuuaucuuccgcagauaaauguagaaauacacgauucugucaccucugaucccuuc

SEQ ID NO: 98203 - RNA, 64 nt, hsa
cugaggggucuccaggaggagacuagauuuaugaauacacgagguaugaggucuaggaacauac

SEQ ID NO: 98204 - RNA, 64 nt, hsa
uauuuacuucaggagcaaagauuuucaaacaagcauacacgaugcaaaauaccaaucuggcuuc

SEQ ID NO: 98205 - RNA, 64 nt, hsa
gaaagucuuaaagggagcauuagagauccuuuuaauacacgacugagugccagcuuauuuguga

SEQ ID NO: 98206 - RNA, 64 nt, hsa
cuggaacuucaugaucacuaaauagauguugaaaauacacgaauuuagauacaagcuuuaaaac

SEQ ID NO: 98207 - RNA, 64 nt, hsa
guacacagccccgugaacccugaggaguggagucauacacgaagggcguguggccaucguguca

SEQ ID NO: 98208 - RNA, 64 nt, hsa
uguuuuauuuguaaagcuuucagugaaacacuacauacacgaagaaaaggaacaagguuuaacu

SEQ ID NO: 98209 - RNA, 64 nt, hsa
acagcauauguuugaacaggaaguaggaacaugcauacacgaagaaaugcuaacggaaggauuu

SEQ ID NO: 98210 - RNA, 64 nt, hsa
guauauccugguuaaguuucuauaaaauaagaacauacacgauucauaaaauuauaugauuaau

SEQ ID NO: 98211 - RNA, 61 nt, hsa
ugcagucaaagaaauggugagagccuugaagauacacgaggaugaaguagaggauauggaa

SEQ ID NO: 98212 - RNA, 64 nt, hsa
acuuuuaaaaucauccguaugucaguguaucuggauacacgaggaaaaggaaagagucucagag

SEQ ID NO: 98213 - RNA, 64 nt, hsa
ggcagauaacccugguuggccacagaagcuauuaauacacgacagcauguggggaaggacuuau

SEQ ID NO: 98214 - RNA, 64 nt, hsa
gucucuuccuuguccuucucuggaaaaugccaaaauacacgaugugaauaaaaguacaacggcu

SEQ ID NO: 98215 - RNA, 64 nt, hsa
ccccacuuuaauauauguaagcaacuuccuacuuauacacgacguguuccuaaaacauguuuga

SEQ ID NO: 98216 - RNA, 64 nt, hsa
ugccuuaugggcccuccucauagguugucucugcauacacgaaccuaacccaaauuugcuuugg

SEQ ID NO: 98217 - RNA, 64 nt, hsa
aggcaggccuauuucaucacaagaacacacacauauacacgaauagacaucaaacucaaugcuu

SEQ ID NO: 98218 - RNA, 64 nt, hsa
ucuacaaacugcucucaaguuaccaaggaagaaaauacacgacaaccacuuauggcucuuuuuc

SEQ ID NO: 98219 - RNA, 64 nt, hsa
uaguggcuuuuaaauuguaguuauaucaguguauauacacgaggggaacuguauaaagacauac

SEQ ID NO: 98220 - RNA, 64 nt, hsa
auaaacuguauuaauaaaauccauuuacuguguaauacacgaguuuaaaaauuaagagcgauua

SEQ ID NO: 98221 - RNA, 64 nt, hsa
auggcguacauugguucagucagccuuccacugaauacacgauugagucuggcccagugaaucc

SEQ ID NO: 98222 - RNA, 64 nt, hsa
guguguguguguguguguguguguguguguguguauacacgagcauguauguauuuggagagca

SEQ ID NO: 98223 - RNA, 64 nt, hsa
caaagacgaauugggugcacagcaccccaaccacauacacgaggaagaagaugcggucagcagu

SEQ ID NO: 98224 - RNA, 64 nt, hsa
cuauuuagcuggugaaaucccuagcuuguucuugauacacgaaccuauuuauucucgugguuuu

SEQ ID NO: 98225 - RNA, 64 nt, hsa
aggagaagccaggagucuacaccaacgucugcagauacacgaacuggauccaaaaaaccauuca

SEQ ID NO: 98226 - RNA, 64 nt, hsa
cccuccagggugcgcuucccucucuugccgcagcauacacgagggcaggcaguggccuugucac

SEQ ID NO: 98227 - RNA, 64 nt, hsa
uccccagccaugagucaguuugugcccaugaauaauacacgaccuguuauuuccaugacugcuu

SEQ ID NO: 98228 - RNA, 64 nt, hsa
ugugcccagauuauucuaaaaucuuaaaaaaagaugcauauagugaaauuuuuuaaauggauau

SEQ ID NO: 98229 - RNA, 64 nt, hsa
uauguagguucauuuaaauuuuaagacaguucagugcauauauaguagaagccuuaagaaaaaa

SEQ ID NO: 98230 - RNA, 64 nt, hsa
cucucauuuuaauuucacuggccaccaucaucuuugcauauaaugcacaaucuaucaucugucc

SEQ ID NO: 98231 - RNA, 64 nt, hsa
cgaguguaugucucacaauauauauacacaagugugcauauacaguuaaugaaacuaucuuuaa

SEQ ID NO: 98232 - RNA, 64 nt, hsa
aauugaggcaaauguauuuauuuuggugacauuuugcauauaugaagauuuucugaaauaggac

SEQ ID NO: 98233 - RNA, 64 nt, hsa
auuacacuaucugauuaauaguuucuucauacucugcauauaauuuguggcugcagaauauugu

SEQ ID NO: 98234 - RNA, 64 nt, hsa
auauguugguaggauguuauuagagagauaugugugcauauauauuuuuuugcaccugaaucac

SEQ ID NO: 98235 - RNA, 64 nt, hsa
uaagauuucuuuuuauaaguauucauuuugaaugugcauauaguuauuugaccccuuccaaaua

SEQ ID NO: 98236 - RNA, 64 nt, hsa
aagauaucauugguagcaaacaucucugguaaggugcauauauucauauuaaauucccauucau

SEQ ID NO: 98237 - RNA, 64 nt, hsa
augaaacaaaaauguuucucaaaaucuagaaaagugcauauaaauuuuuguucauuuagaacug

SEQ ID NO: 98238 - RNA, 64 nt, hsa
aaacaagcagcuuuugugacuaagaaggaaaauaugcauauaguggcauauuuuuauaugaauc

SEQ ID NO: 98239 - RNA, 64 nt, hsa
aauugguuuguauauugauauuuccagguucauuugcauauacuuuuuuccaaauaaugcacau

SEQ ID NO: 98240 - RNA, 64 nt, hsa
uauauguauagauacagcuaguuaugcauauauaugcauauauguguuuguuuguguauguaua

SEQ ID NO: 98241 - RNA, 64 nt, hsa
ucuauaccuauauauguauagauacagcuaguuaugcauauauaugcauauauguguuuguuug

SEQ ID NO: 98242 - RNA, 64 nt, hsa
acacaaaauguucuuuuuguuacaagagcugaguugcauauacuguagauaaaucauauuauuu

SEQ ID NO: 98243 - RNA, 64 nt, hsa
uauuuauuguuaaauuacauuuuuaagcuccaugugcauauaaagguuaugaaacauaucaugg

SEQ ID NO: 98244 - RNA, 64 nt, hsa
ucugcuuaaacaaagcaguauauaauaacuuuauugcauauagauuuaguuuuguaacuuagcu

SEQ ID NO: 98245 - RNA, 64 nt, hsa
uacacaugcauuuaugugcguguguguauacacaugcauauauuuacuaauccuaucugccaaa

SEQ ID NO: 98246 - RNA, 64 nt, hsa
uuauauguauuauaauugcauacacaugccuccaugcauauaugugugugauaauacacaugca

SEQ ID NO: 98247 - RNA, 64 nt, hsa
agcgagaugaauguggcaauugcucauuuuauuuugcauauauuaaauugaguagguucagcuc

SEQ ID NO: 98248 - RNA, 64 nt, hsa
aaacguuuuuccagggaguaaauauuuuacgcuuugcauauauaauuuauggagguguugagag

SEQ ID NO: 98249 - RNA, 64 nt, hsa
uguuaaaaaugacuaauacugggggugcucaauaugcauauaguguuuuucauugauaauuuuu

SEQ ID NO: 98250 - RNA, 64 nt, hsa
aucuuauuaaacaaagauccuaaaaguauauuguugcauauaugaauccaaggaauaguucagu

SEQ ID NO: 98251 - RNA, 64 nt, hsa
uaaauauauacagaauaauacacacaguugugugugcauauaaaauacauauuuacgccaggcg

SEQ ID NO: 98252 - RNA, 64 nt, hsa
gauuauaaaaguguugucaaauguuuuauuuaucugcauauagcagugguuggcuuuuuugaau

SEQ ID NO: 98253 - RNA, 64 nt, hsa
uauggcuauaaagaccuauagcuuuugcacuuuaugcauauauaaucaauccuuucuaguucag

SEQ ID NO: 98254 - RNA, 64 nt, hsa
auauaucacagauauaucauuggaagauauaauuugcauauauguucauuaucaguguuccuaa

SEQ ID NO: 98255 - RNA, 64 nt, hsa
guagcuuuacuaagguauaauugauguaauaaacugcauauauuuaaaguguauacuuugacaa

SEQ ID NO: 98256 - RNA, 64 nt, hsa
uccaaagacaagaacucuguguuugaauucauucugcauauaauuauuuauaaguauagauugu

SEQ ID NO: 98257 - RNA, 64 nt, hsa
uuuucaaccuagagaaucuccucuuacagggggaugcauauaacagaucauguauguguaguua

SEQ ID NO: 98258 - RNA, 64 nt, hsa
auucuuuugauguagucaugaguuuuucuuuguuugcauauaauuaaaaugccucuacuuaaug

SEQ ID NO: 98259 - RNA, 64 nt, hsa
uuaaaaaaaaaaacaggaaccaaaugugaccuugugcauauauugguagcugaaaaucuucaag

SEQ ID NO: 98260 - RNA, 64 nt, hsa
acagaaguucauuugguuuuccuuuguuuuauggugcauauagcaauaaagaccccccuccacc

SEQ ID NO: 98261 - RNA, 64 nt, hsa
gccaggccugcguggcccaugguggcccuuccagugcauauacauacauauauauauauauaug

SEQ ID NO: 98262 - RNA, 64 nt, hsa
uuccagugcauauacauacauauauauauauauaugcauauauauauauauauauauauauaug

SEQ ID NO: 98263 - RNA, 64 nt, hsa
uuagguuuacauaacuacucugacauacuggaauugcauauagagauguucaguggucguuuuu

SEQ ID NO: 98264 - RNA, 64 nt, hsa
ucccuuacagagaagaacaaugguaacuaaaagcugcauauaacuagcaauaacuacauugaac

SEQ ID NO: 98265 - RNA, 63 nt, hsa
uuagcuaccaucguccaugaugccaaagguugagagaggaaucaacauggcugcuuugcugcu

SEQ ID NO: 98266 - RNA, 64 nt, hsa
acagcaauacaguccucuugaggcacucaagccugagaggaagcucaggaucugacauguucuu

SEQ ID NO: 98267 - RNA, 64 nt, hsa
ucaugaauaucaaaucuuuugaugcuggacccaagagaggaaaaguuguagcuaaauguugauu

SEQ ID NO: 98268 - RNA, 64 nt, hsa
aguucccaaaucaauuauagguaccuguuuaggagagaggaagauuuuaccucucaaaggguga

SEQ ID NO: 98269 - RNA, 64 nt, hsa
aaggaaaaaaaggaagagagaggaagggagaagggagaggaaugaauugaggaagugaaagaag

SEQ ID NO: 98270 - RNA, 64 nt, hsa
gaaaagggaaaagcagaaaggaaaaaaaggaagagagaggaagggagaagggagaggaaugaau

SEQ ID NO: 98271 - RNA, 64 nt, hsa
uccugcugaagccaggagggucuucccaagauaggagaggaaccgcagguggugagcggcuggg

SEQ ID NO: 98272 - RNA, 64 nt, hsa
auugauucuucaaauuaaaaguucuugagagaaggagaggaagauacagcagacauaggacuga

SEQ ID NO: 98273 - RNA, 64 nt, hsa
ccaccauauguauuuucuaggauuugagaggaaagagaggaaaaugggggaauggguugcaaaa

SEQ ID NO: 98274 - RNA, 64 nt, hsa
uuagcuuccccaccauauguauuuucuaggauuugagaggaaagagaggaaaaugggggaaugg

SEQ ID NO: 98275 - RNA, 64 nt, hsa
guuggaugaacagagaagggaagagaggaagaacgagaggaagagaagggaaggaaguguuugu

SEQ ID NO: 98276 - RNA, 64 nt, hsa
uuuuugaggcaaguuggaugaacagagaagggaagagaggaagaacgagaggaagagaagggaa

SEQ ID NO: 98277 - RNA, 64 nt, hsa
gucuuuauacuaaaaauauaggcucuugggauuggagaggaaaaauuagaggugauuuucagau

SEQ ID NO: 98278 - RNA, 64 nt, hsa
auuaagaaaaagcaagauaauuuugaagaaggacgagaggaagaggcaugaacuuguccuaaca

SEQ ID NO: 98279 - RNA, 64 nt, hsa
ugaguggacugugggggucuguagagacaguguugagaggaaaggggagguccugcugauuccu

SEQ ID NO: 98280 - RNA, 64 nt, hsa
ugaggccuacaggguucaccaggauguaagaggagagaggaauccacaggaccaccagagagga

SEQ ID NO: 98281 - RNA, 64 nt, hsa
cccuaccaucaagccauuguuuugugccauucaggagaggaaaaaaaggaauuuaugcuguaca

SEQ ID NO: 98282 - RNA, 64 nt, hsa
agaacuuuauuuguugggcagaggcuguuccauugagaggaauguuuacagcaguuucaaaaau

SEQ ID NO: 98283 - RNA, 64 nt, hsa
cagugcccccuucccggacggguggcaggcccuggagaggaacugagugucacccugaucucag

SEQ ID NO: 98284 - RNA, 64 nt, hsa
uuguuuguuuguuucaggaaaaaagaaagggagagagaggaaaauagaggguuguccacuccuc

SEQ ID NO: 98285 - RNA, 64 nt, hsa
cucccugguucugcagagggccagaagaaugagagagaggaagacugcuggcagggaaaucgag

SEQ ID NO: 98286 - RNA, 64 nt, hsa
uggagagaacuucuguaugggcaagccugagagggagaggaaacaaaagcuguguccuggcaga

SEQ ID NO: 98287 - RNA, 64 nt, hsa
guugggauacaaaugaaacuuaugcaggaugugugagaggaagcaguuaauuguuucugaauau

SEQ ID NO: 98288 - RNA, 64 nt, hsa
ggaacaggguugaaaacccaggguuuuguacuuggagaggaaagaugccaagcugcuucuuaau

SEQ ID NO: 98289 - RNA, 64 nt, hsa
accccuggccaucacucauguguaguccagguuugagaggaacuggaaggggggugaggguggg

SEQ ID NO: 98290 - RNA, 64 nt, hsa
cugugauucucccagcccuugcaguccgcuaggugagaggaaaagcucuuuacuuccgccccug

SEQ ID NO: 98291 - RNA, 64 nt, hsa
acgggggaggccgaggcaggggcugggcagaggggagaggaagcacaagaagugggagugggag

SEQ ID NO: 98292 - RNA, 64 nt, hsa
cagaggggagaggaagcacaagaagugggagugggagaggaagccacgugcuggagaguagaca

SEQ ID NO: 98293 - RNA, 64 nt, hsa
aaacacauuuugauucugaucauggggugggggagagaggaaaggagggaggggagaagcccag

SEQ ID NO: 98294 - RNA, 64 nt, hsa
gauuccuuccucccccucaucucacaggggaagggagaggaaagaguuguucucccacuggaag

SEQ ID NO: 98295 - RNA, 64 nt, hsa
cagcgucgccaggcaaugaggaaagcagagacaggagaggaaggccucacucacccacugcguc

SEQ ID NO: 98296 - RNA, 64 nt, hsa
guagaaaccuaaggaaaaugcuuuugggcaacaugagaggaaccuuuucauauuaaugacaaaa

SEQ ID NO: 98297 - RNA, 64 nt, hsa
ucacccaaggaacauuugaucuagcagcagggaugagaggaaagcagaaaugaaugaacuguga

SEQ ID NO: 98298 - RNA, 64 nt, hsa
aaacacccugccuacaaggagauguuuugaaauggagaggaaaauuggcaccucaucuuuuaaa

SEQ ID NO: 98299 - RNA, 64 nt, hsa
uucugccccugccccuuagcuacugaggcauagggagaggaaguuaauuucagagccauacaaa

SEQ ID NO: 98300 - RNA, 64 nt, hsa
cgggcaggugggucacguggucugcagaaccaaagagaggaaucgccaaaacaaaucacgagaa

SEQ ID NO: 98301 - RNA, 64 nt, hsa
gccauuuuccugaaucaaauucugcaguggaauggagaggaaaauacuucuaggcaagcagcua

SEQ ID NO: 98302 - RNA, 64 nt, hsa
gugacaacaacuuccaaauuggcucuuuggaggcgagaggaaggggagaacuuggagaauaguu

SEQ ID NO: 98303 - RNA, 64 nt, hsa
uuucugcgaggccucagaacuucccagggccccucccucaaauugucuccaugggaaacuugac

SEQ ID NO: 98304 - RNA, 64 nt, hsa
uucugugcacagccacaccacccucucccgacagcccucaaagacguagcaacucuuucucuca

SEQ ID NO: 98305 - RNA, 64 nt, hsa
gacagagugggggucuccaucuguuuucucuucucccucaaauacaggcuguuuucaucguguc

SEQ ID NO: 98306 - RNA, 64 nt, hsa
cuaauauuauauguuacaauaagccuccauuagucccucaaaacgaugauauaaauaagucugu

SEQ ID NO: 98307 - RNA, 64 nt, hsa
guugaaauuuuuaaagagccugcaucauuugguucccucaaagggaagcccuugccaguggggg

SEQ ID NO: 98308 - RNA, 64 nt, hsa
accccugugccugugucucuacacacuccacacccccucaaacucuguuuaucuguucucugac

SEQ ID NO: 98309 - RNA, 64 nt, hsa
uugcacggcuuuaucacagcauuuuuaaagcuuucccucaaaaauccugaucugcaugaucuca

SEQ ID NO: 98310 - RNA, 64 nt, hsa
guugaauugaagcaaaucagauuuucuguggggacccucaaaugcaacugaagaaauagauugu

SEQ ID NO: 98311 - RNA, 64 nt, hsa
ccucaggugauccgcccaccucagccucccaaagugcugggaugacaggugugagccacugcgc

SEQ ID NO: 98312 - RNA, 64 nt, hsa
ccucaggugaucugcccgccucggucucccaaagugcugggauuacaggcaugagccacugcac

SEQ ID NO: 98313 - RNA, 64 nt, hsa
ccucaggugauccacccgccugagccucccaaagugcugggauuacaggcaugagccaccgcgc

SEQ ID NO: 98314 - RNA, 64 nt, hsa
gcugagguaccagaagugugagaacgagggggcgugcugggaucuuucucucugacuauacuua

SEQ ID NO: 98315 - RNA, 64 nt, hsa
ccucaggugauccccccgucucagccucccaaagugcugggauuacaggcaugagccagcaugc

SEQ ID NO: 98316 - RNA, 64 nt, hsa
uuugucuggagacaccaagagugguuuccaugccugcugggaauaggcugagcaugcaaugaca

SEQ ID NO: 98317 - RNA, 64 nt, hsa
ggaaacugaucugcugggugacuuucauuccaguugcugggacggaaggcugaauguaggguca

SEQ ID NO: 98318 - RNA, 64 nt, hsa
ggauggaagaggcuuaccugacagccagccugccugcugggagccaggagagucagcucauuaa

SEQ ID NO: 98319 - RNA, 64 nt, hsa
cuuaaggaugucuuuacacugacuucaggauagaugcugggaugccugggcauggccacauguu

SEQ ID NO: 98320 - RNA, 64 nt, hsa
cgcuugggucauggucaucuuccagcaccugcugugcugggaaggccgaggaugggggcccagc

SEQ ID NO: 98321 - RNA, 64 nt, hsa
ccucaggugauccgcccgccucggccucccaaagugcugggauuacaggcgugagccaccgcgc

SEQ ID NO: 98322 - RNA, 64 nt, hsa
gggacccccaguuucucuucagacacugaccuucugcugggaaagcagcccugaggaggaagag

SEQ ID NO: 98323 - RNA, 64 nt, hsa
ccucaggugauccacccacuuugaccucccaaagugcugggauuacuagacguaagccaccaca

SEQ ID NO: 98324 - RNA, 64 nt, hsa
ccucaagugauccacccgccucagccucccaaagugcugggauuacaggugugagccacugcac

SEQ ID NO: 98325 - RNA, 64 nt, hsa
ccucagguaaucgaccugccucggccucccaaagugcugggauuacaggugugagccaccacgc

SEQ ID NO: 98326 - RNA, 64 nt, hsa
ccuuaggugauccacucgccuucaucucccaaagugcugggauuacaggcgugagccaccgugc

SEQ ID NO: 98327 - RNA, 64 nt, hsa
aaaaacaaaaaacaaagaugagucgcacaucugcugcugggauuuucuaggguugucuaugaca

SEQ ID NO: 98328 - RNA, 64 nt, hsa
cacuauaggacacacucccaagggaacuggugcuugcugggaaacuuggaaccuucccaggcag

SEQ ID NO: 98329 - RNA, 64 nt, hsa
gaccucgugauccgcccgccucggccucccaaagugcugggauuacaggcgugagccaccgugc

SEQ ID NO: 98330 - RNA, 64 nt, hsa
ccucaggugaucugcccaccucauccuccaaaagugcugggauuacaggcaugagccacugcgc

SEQ ID NO: 98331 - RNA, 64 nt, hsa
ccucaagcaauccucucuccucagccucccaaagugcugggauuacaagugugagccaccacac

SEQ ID NO: 98332 - RNA, 64 nt, hsa
guucaagcaauccucccaccucggccucccaaagugcugggauugcaggcaugagccaccgugc

SEQ ID NO: 98333 - RNA, 64 nt, hsa
gaccucacgauuugcccgccucggcuucccagagugcugggauuacaggcgugagccaccgcgc

SEQ ID NO: 98334 - RNA, 64 nt, hsa
ggucaaaugauccgccugcgucggcuucccagagugcugggauuacaggugucagccacugcgc

SEQ ID NO: 98335 - RNA, 64 nt, hsa
ccugaagugauccacccgccucgaccucccaaagugcugggaugacaggcaugagccaccgcac

SEQ ID NO: 98336 - RNA, 64 nt, hsa
agcagcugugcagacugguggcggugggaggguuugcugggacugauggggacaccggccagcu

SEQ ID NO: 98337 - RNA, 64 nt, hsa
cugccacguuggagaagcccgugugagaagugaaugcugggacucagccuucagacagagagga

SEQ ID NO: 98338 - RNA, 64 nt, hsa
cucuggucgcuccugcccacggagucguggggugugcugggagcuccacucugcuucucugacu

SEQ ID NO: 98339 - RNA, 64 nt, hsa
gaccuugggauccacccgccuuggccucccaaagugcugggauuacaggugugagccaccaugc

SEQ ID NO: 98340 - RNA, 64 nt, hsa
gcucaagcaauuugccugccucagccucccaaagugcugggauuacaggcgugagccacugcac

SEQ ID NO: 98341 - RNA, 64 nt, hsa
gccuaggugauccacccgccucgaccucccaaagugcugggauuacaggcaugagccaccaugc

SEQ ID NO: 98342 - RNA, 64 nt, hsa
gacuuugugauccacccgccucggccucccaaagugcugggauuacaggcaugagccaucacac

SEQ ID NO: 98343 - RNA, 64 nt, hsa
gacgucgugauccacccgccucggccucccaaaaugcugggauuacaggugugagccacugugc

SEQ ID NO: 98344 - RNA, 64 nt, hsa
gcucaagcaauccacccaccucugccucccaaagugcugggauuacaggcgugagccacugugc

SEQ ID NO: 98345 - RNA, 64 nt, hsa
cgcccugagaagccuuccagccugcggugcugucugcugggaggucagcuggucaaggcagagg

SEQ ID NO: 98346 - RNA, 64 nt, hsa
cucacagccugacuucccuuccccaggccaggguugcugggaugccugccccuccugagaggac

SEQ ID NO: 98347 - RNA, 64 nt, hsa
ggcaaacuucgagcccaucagcaggucaacccuaugcugggaaagugaggauuugggauuucug

SEQ ID NO: 98348 - RNA, 64 nt, hsa
gaccuugugaucugcccgccucggccucccgaagugcugggauuacaggugugagccacugggc

SEQ ID NO: 98349 - RNA, 64 nt, hsa
ucagggucagcaugucaacuccauugaaaaacccugcugggauuuuaauagaacuuacagcuca

SEQ ID NO: 98350 - RNA, 64 nt, hsa
ccacaagugaucugcccgccuuggccucccaaagugcugggauuacaggcguaagccacuacac

SEQ ID NO: 98351 - RNA, 64 nt, hsa
ccucaggugaucugcccaccuuggccucccaaagugcugggauuacaggcaugagccacugugc

SEQ ID NO: 98352 - RNA, 64 nt, hsa
accucaacugauccgcccaccuuggccucccaagugcugggauuacaggcgcgagccacggcgc

SEQ ID NO: 98353 - RNA, 64 nt, hsa
acucaaaugauccaccugccucugcuucccaaagugcugggauuacaggcacgagccaccacac

SEQ ID NO: 98354 - RNA, 64 nt, hsa
gcucaagugauccuccugccuuggccucccaaaaugcugggauuacaggcaugagccacugugc

SEQ ID NO: 98355 - RNA, 64 nt, hsa
ccucaggugauccacccgccucagccucccaaagugcugggauuacaggcaaaagccaacacac

SEQ ID NO: 98356 - RNA, 64 nt, hsa
gaccuugugaugcucccaccucggccucccaaagugcugggauuaaagcugugagccacugugc

SEQ ID NO: 98357 - RNA, 64 nt, hsa
gaccucaugauccucccgccucagccucccaaaaugcugggauuacaggcgugagccaccgcgc

SEQ ID NO: 98358 - RNA, 64 nt, hsa
ccucagguuauccacccaccucagccucccaaagugcugggauuacaggugugagccaccgcag

SEQ ID NO: 98359 - RNA, 64 nt, hsa
gaccucgugauccacccgccuuggccucccaaagugcugggauuacaggcgugagccaccgugc

SEQ ID NO: 98360 - RNA, 64 nt, hsa
cucagaugauccuccuguccucagccucccaaaaugcugggagccaccaggcaccaggugugau

SEQ ID NO: 98361 - RNA, 64 nt, hsa
cuggucucaagcuccuggccucggccuccuaaagugcugggauuacaagugugagccacugugc

SEQ ID NO: 98362 - RNA, 64 nt, hsa
uccagaccccucucuaggaccaagucacccgucgugcugggaguguggauucuagcaaaagagc

SEQ ID NO: 98363 - RNA, 64 nt, hsa
ccucaggugauccgccagccucagccucccaaagugcugggauuacaggcgugagccacugcac

SEQ ID NO: 98364 - RNA, 64 nt, hsa
caaaucaccaaacugcuggaacucuccagccaaaugcugggagaaggaccuggagggugagucu

SEQ ID NO: 98365 - RNA, 64 nt, hsa
gaccuugugaucugcccgccucggccucccaaagugcugggauuacaggcgugagccaccgcgc

SEQ ID NO: 98366 - RNA, 64 nt, hsa
ccucaggugaucugcccaccucagccucccaaagugcugggauuacaggcgugagccaccacac

SEQ ID NO: 98367 - RNA, 64 nt, hsa
aguaaugcauguguuuggagauuauuuucuguaaugcugggaacaaaccuguuuuaaaagcaca

SEQ ID NO: 98368 - RNA, 64 nt, hsa
gaccucgugauccgcccaccuuggccucccagagugcugggauuacaggcgugagccaccgcgc

SEQ ID NO: 98369 - RNA, 64 nt, hsa
ccacagguaaucagcccgccucggccucccaaagugcugggauuacaggcgugagccacuuagu

SEQ ID NO: 98370 - RNA, 64 nt, hsa
gaccucaugauccaccugccucagccucccaaaaugcugggauuacaggcuugagccacugcuc

SEQ ID NO: 98371 - RNA, 64 nt, hsa
ccucaggugguccuucugccuuggccucccaaagugcugggauuacaggcgugagccacugcgc

SEQ ID NO: 98372 - RNA, 64 nt, hsa
gaccucgugaucugcccgccucagccucccaaagugcugggauuacaggagugagccaccgcuc

SEQ ID NO: 98373 - RNA, 64 nt, hsa
agaggagguggccugcccgggaagccggccuuggugcugggacugcagggagagggcugugagg

SEQ ID NO: 98374 - RNA, 64 nt, hsa
cgucaggugaucuaccugccucggccucccaaagugcugggauuacaggcgugagccaccacgc

SEQ ID NO: 98375 - RNA, 64 nt, hsa
aagcaauccguccacuugccuuggcuccccaaagugcugggauuacaggcgugagccaccaggc

SEQ ID NO: 98376 - RNA, 64 nt, hsa
accucaggcugucugcccguccagccucccaaagugcugggauugcaggcaugagccacugcuc

SEQ ID NO: 98377 - RNA, 64 nt, hsa
gccucugaacccuuggccauugauagucuaccuuugcugggauccgaaggaacuguacuccccc

SEQ ID NO: 98378 - RNA, 64 nt, hsa
gacaggggagcuccuaguaggggaggggaggggaugcugggaucuaggugacaugccugucccu

SEQ ID NO: 98379 - RNA, 64 nt, hsa
uggccuagagcugggggaggacacuccccacgugugcugggagccgcaggcccagggccgcaug

SEQ ID NO: 98380 - RNA, 64 nt, hsa
ccucaagugauccacucaccucggccucccaaagugcugggauuacaggugugagccaccaugc

SEQ ID NO: 98381 - RNA, 64 nt, hsa
gcucaaaugaugugcccaacucggccucccaaagugcugggauuacaggcaugaaccgccaugc

SEQ ID NO: 98382 - RNA, 64 nt, hsa
gaccucgugaucugcccgccucggccucccaaagugcugggauuacaggcgugagccaccgcgc

SEQ ID NO: 98383 - RNA, 64 nt, hsa
ccucaggugauucgccugccucggccuuucaaagugcugggauuacagacaugagccacugugc

SEQ ID NO: 98384 - RNA, 64 nt, hsa
ggacacgggcagcucaggucagccuguugguagaugcugggacagcauuagaagagggucuuuu

SEQ ID NO: 98385 - RNA, 64 nt, hsa
agcagaaaaggccagacccugcugaguuagaggcugcugggauccacuguuuccacacagcggg

SEQ ID NO: 98386 - RNA, 64 nt, hsa
gcugggauccacuguuuccacacagcgggaaggcugcugggaacagguggcagagaagugccau

SEQ ID NO: 98387 - RNA, 64 nt, hsa
ccucaggugauccaccugccucagccucccaaauugcugggauuacaggcgugagccaccuugc

SEQ ID NO: 98388 - RNA, 64 nt, hsa
ccucaagagauccccccaaccuuggccuccaaagugcugggauuacaggcaugagccaccgcgc

SEQ ID NO: 98389 - RNA, 64 nt, hsa
gaucaagccauccucccgcuuuggccuccuaaagugcugggauuacaugagccaccacaugcag

SEQ ID NO: 98390 - RNA, 64 nt, hsa
gaccucauauuccacccgccucggccucccaaagugcugggauuacaggcguuagccacugcgc

SEQ ID NO: 98391 - RNA, 64 nt, hsa
ccuuaggugaucagcccgccucggccucccagagugcugggauuacaggcgugagccacugugg

SEQ ID NO: 98392 - RNA, 64 nt, hsa
ccucaagugaucugccugccuuggucucccaaagugcugggaauacaggcaugagccaccgcac

SEQ ID NO: 98393 - RNA, 64 nt, hsa
gaccucaugaucuacccgccucggccucccaaagugcugggauuacaggcgugagccaccacgc

SEQ ID NO: 98394 - RNA, 64 nt, hsa
ccucaggugauccaccugccucagccucccaaagugcugggauuacaggcaugagucaccgcac

SEQ ID NO: 98395 - RNA, 64 nt, hsa
ugggcagauuuguaagugacaaaacuccagcugaugcugggaauggggagagggcccuugaggg

SEQ ID NO: 98396 - RNA, 64 nt, hsa
ccucaggugauccauucgucuuggccucucgaagugcugggauuccaggcgugagccacugcgg

SEQ ID NO: 98397 - RNA, 64 nt, hsa
cuuuuuuuaaaagucccccaacaaauaggauucuugcugggaaaggaaguucgguaaggaaaug

SEQ ID NO: 98398 - RNA, 64 nt, hsa
cuccagccuccagagaccgagcagcuguggggccugcugggaaaccaaggucgguuuccgcccu

SEQ ID NO: 98399 - RNA, 64 nt, hsa
ucaggcacagagaaauuucccgagcucugugacaugcugggaacucgcauggaacaggagggca

SEQ ID NO: 98400 - RNA, 64 nt, hsa
gcccuguaguauuucagggaccgugggaccccuuugcugggacaguuauuucaagaguaugacu

SEQ ID NO: 98401 - RNA, 64 nt, hsa
agcaugccuuucugauagccuuuggugaugucacugcugggagguggcuauccuguggaccacc

SEQ ID NO: 98402 - RNA, 64 nt, hsa
gaccucaugaucugcccgccucaaccucccaaagugcugggauuauaggcgugagccaccgccc

SEQ ID NO: 98403 - RNA, 64 nt, hsa
gaccucaugauccacccaccucggccucccaaagugcugggauuccaggcgugagccacugcac

SEQ ID NO: 98404 - RNA, 64 nt, hsa
ggcugguagcaggggccaguccuccccucuugauugcugggaaugagcagcugagcucuuuggu

SEQ ID NO: 98405 - RNA, 64 nt, hsa
ccccaggugaucugcccaccuuggccuuaaaaagugcugggauuaaaggcgugagccaccaugc

SEQ ID NO: 98406 - RNA, 64 nt, hsa
gaccucgugauccacccgccucagccucccaaagugcugggauuacaggcuugagccaccgugc

SEQ ID NO: 98407 - RNA, 64 nt, hsa
gaccucgugauccgcccaucuccaccucccgcagugcugggauuacaggcaugagccaccgcgc

SEQ ID NO: 98408 - RNA, 64 nt, hsa
cauggagucaugagcugucugggaagaauggacgugcugggaccaacucaagaccuuguuuugc

SEQ ID NO: 98409 - RNA, 64 nt, hsa
auuuugugccacacccugcucugggcacugggaaugcugggaaaugagauacauucccgcccuc

SEQ ID NO: 98410 - RNA, 64 nt, hsa
gccugcauguacuguauauuacagauauuugucaugcugggauuuccaacucgaaucuguguga

SEQ ID NO: 98411 - RNA, 64 nt, hsa
auuuuuuccaaaaucucccauuuuggaauuugccugcugggauuccuuagacucuuuuccuucc

SEQ ID NO: 98412 - RNA, 64 nt, hsa
uucuggaaggggaagcaguccuuagguuuugcugugcugggacaguggcaggggacccacaggg

SEQ ID NO: 98413 - RNA, 64 nt, hsa
cuccccgccagccuugcucagcuguggguugcccugcugggaaggagggaaucacguccaccug

SEQ ID NO: 98414 - RNA, 64 nt, hsa
auaaaaaauaaagaaagacagagagaaacaaauuugcugggagagggaaagacauucagaccca

SEQ ID NO: 98415 - RNA, 64 nt, hsa
ggaauuuaugaaguuauggcaaugaacugcagcaugcugggacaauuauuugacuacuuuuuuu

SEQ ID NO: 98416 - RNA, 64 nt, hsa
accucaagugaucugccugccucggccucccaagugcugggauuacaggcgugagccacugcac

SEQ ID NO: 98417 - RNA, 64 nt, hsa
gcuuaagugaucugcccgccuuggccucccaaagugcugggauuacagaugugagccaccacac

SEQ ID NO: 98418 - RNA, 64 nt, hsa
ucacccaccugucucauaguguuuauaaguggccugcugggagugagugcucccucuguucccu

SEQ ID NO: 98419 - RNA, 64 nt, hsa
cuccuuccucucuccuuguaaggugcaccugugcugcugggagccuggaguacuggcuauaccc

SEQ ID NO: 98420 - RNA, 64 nt, hsa
ccucaagugaucuguccaccucggccucccagagugcugggauuacaggcgugagccacuguuc

SEQ ID NO: 98421 - RNA, 64 nt, hsa
gcucaagugauccucacgccuuggccucccaaagugcugggauuauaggcaugagccacugugc

SEQ ID NO: 98422 - RNA, 64 nt, hsa
uaggucuaaauaggauccuggaggcugccugcugugcugggagguauagggguccugggggcag

SEQ ID NO: 98423 - RNA, 64 nt, hsa
ccucaggugauccaccuuucucggccucccaaagugcugggauuacgggugugagccaccgugc

SEQ ID NO: 98424 - RNA, 64 nt, hsa
gaccuugugauccacccaccucggccucccagagugcugggauuacaggcaugagccaccacgc

SEQ ID NO: 98425 - RNA, 64 nt, hsa
uccuuccuguucuccaagccagugaagaguuaucugcugggaaaguguccaagagccuguuuuu

SEQ ID NO: 98426 - RNA, 64 nt, hsa
gaccucaugauccgcccgccuugaccucccaaagugcugggauuacaggcaugagccaccgcac

SEQ ID NO: 98427 - RNA, 64 nt, hsa
ccucaggugaucugcccacuuuggccucccaaagugcugggauuacaggcaugagccaucgccc

SEQ ID NO: 98428 - RNA, 64 nt, hsa
cuggauaugcuccuugagacuucuggcaaacuucugcugggaauuaguuugagggugaggguac

SEQ ID NO: 98429 - RNA, 64 nt, hsa
ccucagaugaucugcccgccucagccucccaaagugcugggauuacaggcaugagccaccacgc

SEQ ID NO: 98430 - RNA, 64 nt, hsa
ccucagguaauccgcccgccucggccucccaaaaugcugggauuagaggugugagccacugugc

SEQ ID NO: 98431 - RNA, 64 nt, hsa
ccucaagcgauccacccaccuaggccucccaaagugcugggauuacaggcaugaaucaccacaa

SEQ ID NO: 98432 - RNA, 64 nt, hsa
ccucaggugauccgcccgccugggccucccaaagugcugggauuacaggcgugagccacugcuc

SEQ ID NO: 98433 - RNA, 64 nt, hsa
gguagaugagagacagggcagggaaucugcguggugcugggauguggggacucuggccucucca

SEQ ID NO: 98434 - RNA, 64 nt, hsa
ggccuggagggcaaggcagaugcauucuccuggcugcugggagagcccaugggaaccuugcuua

SEQ ID NO: 98435 - RNA, 64 nt, hsa
uggcuuuccuccuuugcccugcaguagcaacuggugcugggacaaguugacccaccucucacag

SEQ ID NO: 98436 - RNA, 64 nt, hsa
ugugggguuugucauaucugggagggaagaugggugcugggagaggguugggggcagggggcaa

SEQ ID NO: 98437 - RNA, 64 nt, hsa
agagggaguggagugcaguguggcuugggccuggugcugggaaccugcuagcugagcacuucca

SEQ ID NO: 98438 - RNA, 64 nt, hsa
gaccucgugauccgccugccucagccucccaaagugcugggauuacaggugugagccaccacgc

SEQ ID NO: 98439 - RNA, 64 nt, hsa
ccucaggugauccuccugccucggccucccaaagugcugggauuacaggcaugagccaccgugc

SEQ ID NO: 98440 - RNA, 64 nt, hsa
ccucaggugauccacccaccucagccucccaaagugcugggauuacaagcgugagccacugcac

SEQ ID NO: 98441 - RNA, 64 nt, hsa
ccucaagugauucuccugccucagccucccaaagugcugggauuacaggugugaaccaccacac

SEQ ID NO: 98442 - RNA, 64 nt, hsa
ccucagguaauccgcccaccucagccucccaaagugcugggauuacaggcgugagccacagugc

SEQ ID NO: 98443 - RNA, 64 nt, hsa
gcucaagcgauccuccuggcucagccucccaaagugcugggauuacaggcgugagucacugcgc

SEQ ID NO: 98444 - RNA, 64 nt, hsa
aggggacucgagagaggcgggccccagacccaugugcugggaaaugcagaaaucacguugcugg

SEQ ID NO: 98445 - RNA, 64 nt, hsa
ccucaagcaauccuucugccuuggccccccaaagugcugggauugugggcaugagcugcugugc

SEQ ID NO: 98446 - RNA, 64 nt, hsa
uccaggccagccagaguggggauggucugugaccugcugggaaggcaggcugauggggcacacc

SEQ ID NO: 98447 - RNA, 64 nt, hsa
aaaagagacucauuugcugaugguucaugccuucugcugggacaggccugggcugugcagccac

SEQ ID NO: 98448 - RNA, 64 nt, hsa
gccggugggccuguguugcugggauuuuagucugugcugggaggcagggcuccgcugcgccuca

SEQ ID NO: 98449 - RNA, 64 nt, hsa
gcaaggcaggcuggaggugccggugggccuguguugcugggauuuuagucugugcugggaggca

SEQ ID NO: 98450 - RNA, 64 nt, hsa
ucucaagcaguccucccaccucagccucccaaggugcugggauuacaggugugagccaccacac

SEQ ID NO: 98451 - RNA, 64 nt, hsa
acucugugcacacaucauuguagccacacaucauugcugggagaauuaagcauuauccugaaga

SEQ ID NO: 98452 - RNA, 64 nt, hsa
gaccuugugauccacccaccucagccucccaaagugcugggauuacaggcaugagccaccacac

SEQ ID NO: 98453 - RNA, 64 nt, hsa
ccuaaagugaucugcccgccuuggccucccaaagugcugggauuacagacaugagccaccacgc

SEQ ID NO: 98454 - RNA, 64 nt, hsa
ugugucugucugcccggcaagaguccauucucacugcugggacacucaugaaaaucuccacguc

SEQ ID NO: 98455 - RNA, 64 nt, hsa
aaccuugugauucgcccgccuuggccucccaaagugcugggauuccaggcgugagccacugcgc

SEQ ID NO: 98456 - RNA, 64 nt, hsa
ucucccacccagggccuuccacccucggcuccugugcugggagaaacuuccaggcguggacagc

SEQ ID NO: 98457 - RNA, 64 nt, hsa
cucacagagccccucccaaggaucgggcggaagcugcugggacccuccugggcugccaggauuu

SEQ ID NO: 98458 - RNA, 64 nt, hsa
ccucaggugaucugcccgccuuggccucccaaagugcugggauuacaggugugagccgcugcgc

SEQ ID NO: 98459 - RNA, 64 nt, hsa
ccucaggugauccgcccaccucggccucccaaagugcugggauuacaggugugagccuccacac

SEQ ID NO: 98460 - RNA, 64 nt, hsa
gggcuuucccacccucccuccuuagcaggugccgugcugggacaccauacggguugguuucacc

SEQ ID NO: 98461 - RNA, 64 nt, hsa
gaccuggugaucugcccacccaggccucccaaagugcugggauuaaaggugugagccaccaugc

SEQ ID NO: 98462 - RNA, 64 nt, hsa
aggaaaaugacccaucggugaugcgcucaccuucugcugggaaguuaauccaguacauuguaga

SEQ ID NO: 98463 - RNA, 64 nt, hsa
cggugaaacuugccaaaaugguggguuaugugagugcugggacuguggaauaccuguacagcca

SEQ ID NO: 98464 - RNA, 64 nt, hsa
ucaggcugcagcccccuccccgcucccaccucccugcugggaaaccacagcauuaucacagcau

SEQ ID NO: 98465 - RNA, 64 nt, hsa
uuccuccccuuucuacugcucucccauuuucccuugcugggaguagccacaugcucuugccccc

SEQ ID NO: 98466 - RNA, 64 nt, hsa
uugauggugacucugcaggagacucugaagugacugcugggaaacccuuugggagaccugaccu

SEQ ID NO: 98467 - RNA, 64 nt, hsa
cagagaccuagacgggguggaaggagcaagugacugcugggauuugcaccaggucugccuaacu

SEQ ID NO: 98468 - RNA, 64 nt, hsa
cagcaucuuucaccaagauggguggcaccaaccuugcugggacuuggaucccaggggcuuaucu

SEQ ID NO: 98469 - RNA, 64 nt, hsa
uacccacuggucugcuuaaagcuucccucucagcugcugggacgaucgcccaggcuggagcugg

SEQ ID NO: 98470 - RNA, 64 nt, hsa
ccucaagcaacccuccugccucagucuugcaaagugcugggauuccaggugggagccacugcac

SEQ ID NO: 98471 - RNA, 64 nt, hsa
ccucaagugauccaccuaccuuagucucccaaagugcugggauuacaggugugagccaccacgu

SEQ ID NO: 98472 - RNA, 64 nt, hsa
cuguguuuagagggguggccugaaggaccuuuucugcugggacaagacacuguacugcccucug

SEQ ID NO: 98473 - RNA, 64 nt, hsa
cuuuucugcugggacaagacacuguacugcccucugcugggaagggguuuuaauaaacagaccc

SEQ ID NO: 98474 - RNA, 64 nt, hsa
gaccuugugauccaccagccucagccucccaaagugcugggauuacaggcgugagccacugugc

SEQ ID NO: 98475 - RNA, 64 nt, hsa
cuucaggugauccgccuaccuuggccuccaaaagugcugggauuacaggcaugagcuacugcac

SEQ ID NO: 98476 - RNA, 64 nt, hsa
gaccucgugauucgcccgccgcguccucccaaagugcugggauuacaggccugagccaccgcgc

SEQ ID NO: 98477 - RNA, 64 nt, hsa
cucagaugaucugcccgccucggccucccaaaauugcugggauuacaggugugagccaccgcgc

SEQ ID NO: 98478 - RNA, 64 nt, hsa
accuugugauccacccaccucggucuccccaaagugcugggauuacaggcgugagccacucugc

SEQ ID NO: 98479 - RNA, 64 nt, hsa
gaccucgugauccgcccuccucggccucccaaagugcugggauuauaggcgugagccaccgcgc

SEQ ID NO: 98480 - RNA, 64 nt, hsa
ccucagguaauccaccugccuuggccucccaaagugcugggauuacaggcgugagccaccacac

SEQ ID NO: 98481 - RNA, 64 nt, hsa
ccucaggugaucugccugccucggccucccaaagugcugggauuacaggugugagccacagcac

SEQ ID NO: 98482 - RNA, 64 nt, hsa
gaccuugugaucccccugccucggccucccaaagugcugggauuacaggcaugagccaccacgc

SEQ ID NO: 98483 - RNA, 64 nt, hsa
ccucaggugauccacccgccucagccucccaaagugcugggauuacaggcaugagccaccgcac

SEQ ID NO: 98484 - RNA, 64 nt, hsa
gaccucaugauccacccgccucggccuuccaaagugcugggauuacaggcaugagccaccgugc

SEQ ID NO: 98485 - RNA, 64 nt, hsa
ccucaagugauccacccaccucagccucccaaagugcugggauuacaggccacuacaccuggca

SEQ ID NO: 98486 - RNA, 64 nt, hsa
gaccucgugaucugcccaccucggccucccacagugcugggauuaccggcgugagccaccaugc

SEQ ID NO: 98487 - RNA, 64 nt, hsa
gaccuugucauccaccugucuuggccucccaaagugcugggauuacuggcaugagccacugugc

SEQ ID NO: 98488 - RNA, 64 nt, hsa
ccucaggugauccacccaccugggccucccauagugcugggauucaauuuuuuuuuuuuuuuuu

SEQ ID NO: 98489 - RNA, 64 nt, hsa
caucaggugauccaccugccucggccucccaaagugcugggauuacaggugugagccaccacgc

SEQ ID NO: 98490 - RNA, 64 nt, hsa
gcaaccuccgccucccggguucaagcgauucuucugcugggauuacagcauaugccaccaugcc

SEQ ID NO: 98491 - RNA, 64 nt, hsa
ccucaggugauccacccgccucagccucccacacugcugggauuacaggcaugagccaccgcuc

SEQ ID NO: 98492 - RNA, 64 nt, hsa
gaccuugugauccacccgccucggccucccaaagugcugggauuacaggcgugagccaccuugc

SEQ ID NO: 98493 - RNA, 64 nt, hsa
caccagcagcuugacacccacagugugcucuggcugcugggagcccaucucucggagaaacccu

SEQ ID NO: 98494 - RNA, 64 nt, hsa
ucugagugacugaccuccacuggaggagacccauugcugggaggagcugagggggaacaggagc

SEQ ID NO: 98495 - RNA, 64 nt, hsa
acucaagcaauccgcccaccuugacuucccaaagugcugggauuaugggcgggugugagccauu

SEQ ID NO: 98496 - RNA, 64 nt, hsa
augucacaaaagaacaaaauaacccgaccuuuauugcugggagcuggcuucugucccuuucuuc

SEQ ID NO: 98497 - RNA, 64 nt, hsa
ucucaggugaccugcccaccucggccucccgaagugcugggauuacaagggugagccaccaugc

SEQ ID NO: 98498 - RNA, 64 nt, hsa
gaccucgugaucugcccgccucggccucccaaagugcugggauuacaggccugagccaccgcgu

SEQ ID NO: 98499 - RNA, 64 nt, hsa
cccacgccgcagguagguuucuccagugcgcucuugcugggagguccggaucguuccugcaggg

SEQ ID NO: 98500 - RNA, 64 nt, hsa
gggcuggugcugucccugcuggcugaggagccgcugcugggagacagcgcagccauagaggaag

SEQ ID NO: 98501 - RNA, 64 nt, hsa
ccucaagugauccacucgcuucggccucccaaagugcugggauuauaggcgugagccacugugc

SEQ ID NO: 98502 - RNA, 64 nt, hsa
ccucaaaagauccacccaccucggccucccaaagugcugggauuauaggcaugaaccaccgugu

SEQ ID NO: 98503 - RNA, 64 nt, hsa
cuucaagcaauucuccugccucagccucccaaagugcugggauuacaggugugagccaccgugc

SEQ ID NO: 98504 - RNA, 64 nt, hsa
acuccugaccucgugauccacccaccucaggaagugcugggauuacaggcgugugagccaccac

SEQ ID NO: 98505 - RNA, 61 nt, hsa
cuucacccagcacccaugccccacucugcugaggccagaggaagggaggccugaggggcag

SEQ ID NO: 98506 - RNA, 61 nt, hsa
ucccccggggucuccaccucaggggagacuuaggccagaggugaacauucauguguaggaa

SEQ ID NO: 98507 - RNA, 61 nt, hsa
cagagagagucaugcuggaggagaaggaaguaggccagaaguccagggcugcacuguggug

SEQ ID NO: 98508 - RNA, 61 nt, hsa
uucucccacugggcucccccauccugggccaaggccagaacuuuagugcuaggggaagaug

SEQ ID NO: 98509 - RNA, 61 nt, hsa
cuggaccaguuucccugcugugcuguggcccaggccagagccugugggcaggcaggcaggg

SEQ ID NO: 98510 - RNA, 61 nt, hsa
cucaacaucacauacagcuucagcugccuggaggccagaaggaaagggcagugcaggggag

SEQ ID NO: 98511 - RNA, 61 nt, hsa
gacaucuaaaacuaaauaaauagaaaacaccaggccagaacuauagucauacucacacaaa

SEQ ID NO: 98512 - RNA, 61 nt, hsa
caacucaucagcucuuccucaaggcaaccugaggccagacaccaagaaaccaagcguaucu

SEQ ID NO: 98513 - RNA, 61 nt, hsa
ugcuuagcagggcauuugacuacuuuaucugaggccagaacucucacacacagcuaucaag

SEQ ID NO: 98514 - RNA, 61 nt, hsa
auaaaggaacuuuuauuaaagccugagacucaggccagaauuaggagggagcuuuuugaag

SEQ ID NO: 98515 - RNA, 61 nt, hsa
gguaaacugugguuuccccaagcugcacaggaggccagaaaccacaaguaugaugacuagg

SEQ ID NO: 98516 - RNA, 61 nt, hsa
caguagguuuucuguuguggucccgugggagaggccagacuggauuauuccuccuuugcug

SEQ ID NO: 98517 - RNA, 61 nt, hsa
gguaaauauuuacauucagccagggaagaggaggccagaggucgggccagcugccccauuc

SEQ ID NO: 98518 - RNA, 61 nt, hsa
augauuguaaaauuugcuccucaaaggaaucaggccagacucaauuuuggagggcaagaca

SEQ ID NO: 98519 - RNA, 61 nt, hsa
uuggucaacagaucuggugagggaaguccccaggccagacgcuggacuccugcaaugaggg

SEQ ID NO: 98520 - RNA, 61 nt, hsa
cacauuuccuaucuuccuccagcuuccagcuaggccagaagggcaugcucuggaacccagc

SEQ ID NO: 98521 - RNA, 61 nt, hsa
ugguggccuugccccgcucugcagcacagacaggccagaugcauuuguccuuugccuagcu

SEQ ID NO: 98522 - RNA, 61 nt, hsa
cacaggugacucagcagugacccugugugccaggccagauccaaacugagagggaaggugu

SEQ ID NO: 98523 - RNA, 61 nt, hsa
auggcauagaauugugagagaauguuuugaaaggccagaggguggccuuuuuccccaaaca

SEQ ID NO: 98524 - RNA, 61 nt, hsa
caggguugacaaggggccguccuuuccacacaggccagaagaggucuucaggcgaaccgac

SEQ ID NO: 98525 - RNA, 61 nt, hsa
cgaauugaagggcuaagagucccagauagcuaggccagagcuggaagcagacaguaagggg

SEQ ID NO: 98526 - RNA, 61 nt, hsa
aaugaggaugucugucccugucugccugggcaggccagauuccuccccagcagccgggucu

SEQ ID NO: 98527 - RNA, 61 nt, hsa
uaauugugaaaggagacuuugcagauaaaugaggccagaauggcauguuuuauaauuaacu

SEQ ID NO: 98528 - RNA, 61 nt, hsa
cucuggugcagagcacuucaaauauguccucaggccagauacugauugcuaguagagagac

SEQ ID NO: 98529 - RNA, 61 nt, hsa
cgcccucccacaccugcuugggaggccagagaggccagacaagccgagagccccuucuguu

SEQ ID NO: 98530 - RNA, 61 nt, hsa
cacuugccccgcccucccacaccugcuugggaggccagagaggccagacaagccgagagcc

SEQ ID NO: 98531 - RNA, 61 nt, hsa
gcaaauaccucuucuagcccuuagaagucugaggccagacugacugagggggccugaagcu

SEQ ID NO: 98532 - RNA, 61 nt, hsa
gggaagcaaccccagagcaggcagacaucagaggccagagugccuagcccgacaugaagcu

SEQ ID NO: 98533 - RNA, 61 nt, hsa
uuguugcacuaaaaugaggauccagggcagcaggccagagaaagcaaaggugcacuccaga

SEQ ID NO: 98534 - RNA, 61 nt, hsa
agugggaagggagcauugcagccuaagaagaaggccagagagggaaaaggcaggugcuuuu

SEQ ID NO: 98535 - RNA, 61 nt, hsa
agggaagaccugaaagagaggacugguucugaggccagaaaggugugaggagagaggagga

SEQ ID NO: 98536 - RNA, 61 nt, hsa
gccaagacuacgccacugcacuccagccuggaggccagagugagacuccgucucaaaacaa

SEQ ID NO: 98537 - RNA, 61 nt, hsa
augugccuguaaucccagcuucuggaggcugaggccagagaaucgcuugaaccugggaggu

SEQ ID NO: 98538 - RNA, 64 nt, hsa
ucuuuggccauugugggaagucauuauucuggagacaagaaaaucaucacucuggugccuuggu

SEQ ID NO: 98539 - RNA, 64 nt, hsa
agcugacuuuucuugccagaaaguuuuccuugugacaagaaauuugcaagcuuuucaaucucag

SEQ ID NO: 98540 - RNA, 64 nt, hsa
uacucaaaaacauugacucugcaucaagaaagaaacaagaaagcaauaaaacaagaaauaauuc

SEQ ID NO: 98541 - RNA, 64 nt, hsa
cucugcaucaagaaagaaacaagaaagcaauaaaacaagaaauaauucaugcucacauuuuuau

SEQ ID NO: 98542 - RNA, 64 nt, hsa
uaauacacugauguucuucacuaaauggauggccacaagaaaaauaaaguaaaugucuuaaaua

SEQ ID NO: 98543 - RNA, 64 nt, hsa
ucaaagaguuuuuuaugaaagacuuuccuccuuuacaagaaagaaauggggugcugccuuucug

SEQ ID NO: 98544 - RNA, 64 nt, hsa
uucgaagacaccuuucuuucauuaugcacucgggacaagaaaauuaauagagcguuauuccaca

SEQ ID NO: 98545 - RNA, 64 nt, hsa
aaagaggaacauugaccugcagacuaugguuuguacaagaaaguuuguuugaauguguagaaga

SEQ ID NO: 98546 - RNA, 64 nt, hsa
uggacaaaguucuguauauaguauaaagucauuaacaagaaacaggauaugcuuuaagacagaa

SEQ ID NO: 98547 - RNA, 64 nt, hsa
ggaaccguuuuacacuggauguuucucauguagaacaagaaaucuuucuggaauugauguuuac

SEQ ID NO: 98548 - RNA, 64 nt, hsa
uaauggauggaacuccugcacaaguuuuaacugaacaagaaaucccagcaaaaggcauuuuuuu

SEQ ID NO: 98549 - RNA, 64 nt, hsa
auagauacgauggaaaacuaugcagccaugaaacacaagaaaaucauguccuuuucagcaacau

SEQ ID NO: 98550 - RNA, 64 nt, hsa
gaacaaaaguggggagguaucagggaacaagaaaacaagaaaggguaugaucaaucauuuucuu

SEQ ID NO: 98551 - RNA, 64 nt, hsa
cugcuaaagaacaaaaguggggagguaucagggaacaagaaaacaagaaaggguaugaucaauc

SEQ ID NO: 98552 - RNA, 64 nt, hsa
auuauucacauaaauuuuguuuaauauugguugaacaagaaaucugacuuuaaaagauuauuaa

SEQ ID NO: 98553 - RNA, 64 nt, hsa
caugacauucacaauaccagggaccaugggagacacaagaaaugugugucugcugucauaacuu

SEQ ID NO: 98554 - RNA, 64 nt, hsa
ugcaguccuuuuacuacagcuaugaagaaacgcaacaagaaacucaaugcacaacaaaggauua

SEQ ID NO: 98555 - RNA, 64 nt, hsa
aacuauuaccuggguauuuauccacuaaugagucacaagaaaaggaguggauuugguaagaaua

SEQ ID NO: 98556 - RNA, 64 nt, hsa
ccagaccagcuguaagcugaaaccucaaugaauaacaagaaaagacuccaggccgacucaugau

SEQ ID NO: 98557 - RNA, 64 nt, hsa
uugagcuggcagccuaugagauuguggacauauaacaagaaacagaaaugcccucaugcuuauu

SEQ ID NO: 98558 - RNA, 64 nt, hsa
uguguacuaguacauaucuuuaaauuaccaaaaaacaagaaacaaaacauaaaaaccccaaaac

SEQ ID NO: 98559 - RNA, 64 nt, hsa
agacucauagaguuuuuucugcaaugauugcaguacaagaaaaggauuauugugaggauggucu

SEQ ID NO: 98560 - RNA, 64 nt, hsa
uguaauaaucgagaaugccugggcauuuuacaaaacaagaaaaaaaauacccuuuucuuuuccu

SEQ ID NO: 98561 - RNA, 64 nt, hsa
uuuuugaaaugaaaagacuuuuuaaaaaaguaaaacaagaaaaguacauucuuuagaaacuaac

SEQ ID NO: 98562 - RNA, 64 nt, hsa
gcuuuuguuugcauuuaaauuaaauggcuucuaaacaagaaauugcagcauauucuucucuuug

SEQ ID NO: 98563 - RNA, 64 nt, hsa
uccuuuuuguggguguugcaugcaaaucaaguggacaagaaaaaauaacaaaacaaaaaacaag

SEQ ID NO: 98564 - RNA, 64 nt, hsa
aucaaguggacaagaaaaaauaacaaaacaaaaaacaagaaaaaaaaaacacaaaaccccguaa

SEQ ID NO: 98565 - RNA, 64 nt, hsa
uuacuaccauuuguguugccauuagugaauuuuuacaagaaaacucccugugggugcaaugagu

SEQ ID NO: 98566 - RNA, 64 nt, hsa
guucaucaaaugaugcuguuaagauagggaaaagacaagaaacaggacuggaagaagauguuug

SEQ ID NO: 98567 - RNA, 64 nt, hsa
uuagggaaaauugauaaauaucugucaccaaaccacaagaaauccaaaaucauuuuagguuuac

SEQ ID NO: 98568 - RNA, 64 nt, hsa
ucucuccaugauuuuauuauaauuuugacacuagacaagaaaaaaaaauauuauuugucuuucc

SEQ ID NO: 98569 - RNA, 64 nt, hsa
acuggcaucaccugaugccacuaauuugugaacaacaagaaaucauuuccccauugguuggagu

SEQ ID NO: 98570 - RNA, 64 nt, hsa
ccuggacaggguccaagucugauaguaaccuuuuacaagaaagaacagggaugggaauggaaag

SEQ ID NO: 98571 - RNA, 64 nt, hsa
ccuccucacgcuagaguaaaagucccaguuaagugaagccuaccagaagaacuaguagaagaag

SEQ ID NO: 98572 - RNA, 64 nt, hsa
gucuguggugcagugugugaaaauucaggugcuagaagccuacugguagaaaaacccaaaagga

SEQ ID NO: 98573 - RNA, 64 nt, hsa
ucaucaguccuuccuuccuaaucucuaauccccugaagccuaacacaguuccuaauguguuuug

SEQ ID NO: 98574 - RNA, 64 nt, hsa
gguagggcugugguuuacuccugucuaaaccccugaagccuaacacaguuccuggcacacaaca

SEQ ID NO: 98575 - RNA, 64 nt, hsa
ccaggaucgguccagcucagauauugagggcucugaagccuaguucugucuucucuggagcagc

SEQ ID NO: 98576 - RNA, 64 nt, hsa
uaauuugguugguauuucacuauuuaauuuuuaagaagccuauuuuacuaguguuuuauaugaa

SEQ ID NO: 98577 - RNA, 55 nt, hsa
ucauagugauugaggcauaacuaucaaucacaaaaguauauucaaaaauuauauu

SEQ ID NO: 98578 - RNA, 64 nt, hsa
aacaacucgaaucacucauuuauuuccauauuaaaaucacaaacucauccauuaauguagauaa

SEQ ID NO: 98579 - RNA, 64 nt, hsa
acuaucacaccaacagccacaccucuuccucgacaaucacaaauuacaguaaguaauauauaua

SEQ ID NO: 98580 - RNA, 64 nt, hsa
cuccagaccauguacaaaacacagccacucuugaaaucacaaguccaaccacagagaguccuca

SEQ ID NO: 98581 - RNA, 64 nt, hsa
uuuaugcagcaaaaagaagcucuuuuuuuuuuuuaaucacaaaaaaaaaccccaguucaaaaug

SEQ ID NO: 98582 - RNA, 64 nt, hsa
aaaucuggugacccccuaauguauacagcuaaaaaaucacaauuuuuuuacugcuuuaauucua

SEQ ID NO: 98583 - RNA, 64 nt, hsa
aagggggccacagccuggguggaaggcagaccugaaucacaacgggccagcucuaguaauacga

SEQ ID NO: 98584 - RNA, 64 nt, hsa
acauuugugcuguuuucaauuuugugcuaucgcaaaucacaaaaaaacuguuaucaauucacau

SEQ ID NO: 98585 - RNA, 64 nt, hsa
uucuguauuaaauauuuucaggguuuuaaacacuaaucacaaacugaaugacuugacuucaaaa

SEQ ID NO: 98586 - RNA, 64 nt, hsa
gcuaugugugguacuuugcagcugcuuuugcagaaaucacaauuuuccuguggaauaaagaugg

SEQ ID NO: 98587 - RNA, 64 nt, hsa
cacuccaaccacauuccaagcugagauaaaaucaaaucacaaauguuuaaccacuuugcugcug

SEQ ID NO: 98588 - RNA, 64 nt, hsa
acaaaguaguccauuccugaucucacuuaaaauaaaucacaaguaaauuugaauuuucgguuua

SEQ ID NO: 98589 - RNA, 64 nt, hsa
aauuuuauucugagggugauuugugaucaaguuuaaucacaaaucucuuaauauuuauaaacua

SEQ ID NO: 98590 - RNA, 64 nt, hsa
aucuuaucuucuuuccucacuucugcuuuguuuaaaucacaagagugcuuuaaugaugacauuu

SEQ ID NO: 98591 - RNA, 64 nt, hsa
cauauaaacaauuauuuaucacuuuuaugacccaaaucacaauaaaauugucauuuaggauaaa

SEQ ID NO: 98592 - RNA, 64 nt, hsa
uguagaggcagaggcaaaguuaucaucauacaaaaaucacaaacaaaaaggagaucuguauucg

SEQ ID NO: 98593 - RNA, 64 nt, hsa
gaccccaguuugggaacucaucaaauaaucacaaaaucacaauucucugauuuugagcucaauc

SEQ ID NO: 98594 - RNA, 64 nt, hsa
gaucuaaggaccccaguuugggaacucaucaaauaaucacaaaaucacaauucucugauuuuga

SEQ ID NO: 98595 - RNA, 64 nt, hsa
cggggaggugccugagcuggggccuggagaggggccugggaaaggaaaaccagggauagcuauu

SEQ ID NO: 98596 - RNA, 64 nt, hsa
aaaaaccugguuccuguccucaaaauaaggggcaccugggaaaacagaggaaucuaccuguggu

SEQ ID NO: 98597 - RNA, 64 nt, hsa
guauggacuauggaaaaacaaauuugcacaauggccugggaaguugaggucacuuuuuacaggg

SEQ ID NO: 98598 - RNA, 64 nt, hsa
cuagucucguauauucugaguaaauggaaucaguccugggaauagagaguguccuuugugccag

SEQ ID NO: 98599 - RNA, 64 nt, hsa
gcuggcugaguggaaugcagggaagagggcaguaccugggaaaggacccacccaucuuccugcu

SEQ ID NO: 98600 - RNA, 64 nt, hsa
aucacucccuggauguguggggcaugguuccuucccugggaaggcuaaguucaguucuguuuuu

SEQ ID NO: 98601 - RNA, 64 nt, hsa
cauuccacacugguuagauacuucaguugucaccccugggaagauucucccaccuccucccuuu

SEQ ID NO: 98602 - RNA, 64 nt, hsa
agauaguaacugagcaggggcuacaaagaggucuccugggaacccugucugccccuucccaccu

SEQ ID NO: 98603 - RNA, 64 nt, hsa
guuuaggcuuucgcggaggggaggagacauggagccugggaacuccuuguucuccccucugcug

SEQ ID NO: 98604 - RNA, 64 nt, hsa
gguaggggcuccugggcggccagaugaaugggucccugggaacccagaccucagaugaggacuu

SEQ ID NO: 98605 - RNA, 64 nt, hsa
ugggugcuggcugagcuuugggccgggaaggcagccugggaaucugaggcuggagacagggguu

SEQ ID NO: 98606 - RNA, 64 nt, hsa
auuuauugaguaccuacugugugcuaggcauugaccugggaacuagagauacuucacagaauaa

SEQ ID NO: 98607 - RNA, 64 nt, hsa
cagcguuugggaaacaagacuuuuccugcaauagccugggaaggaauaaaaggauagaguguuu

SEQ ID NO: 98608 - RNA, 64 nt, hsa
augaugccagccuugagcaugaagcugagauggaccugggaacuccaacauaugaugaaaaccc

SEQ ID NO: 98609 - RNA, 64 nt, hsa
gggaggcucagaaacaacagcaacagaugcagaaccugggaaugacaucaccacugcccuauga

SEQ ID NO: 98610 - RNA, 64 nt, hsa
agugcaggcccggggcccacgggcaacauggaacccugggaacugcccucccccuuagcucaca

SEQ ID NO: 98611 - RNA, 64 nt, hsa
uauuaagaacauguugggcauguggacccaagcaccugggaaggagguggcaucugagacagcc

SEQ ID NO: 98612 - RNA, 64 nt, hsa
gucugcauaucugauguucagguagaccugggcgccugggaacgaggccaucagcugccaugca

SEQ ID NO: 98613 - RNA, 64 nt, hsa
guacccaaguggccugaaacaguguagggaaagaccugggaaacacuggaccaaaaaagccuga

SEQ ID NO: 98614 - RNA, 64 nt, hsa
uuugugaugccccuucccagaccagguuaggauuccugggaaggccgcggauuccggcccugga

SEQ ID NO: 98615 - RNA, 64 nt, hsa
aucaccucaccaaggaucggacucugccccuggaccugggaacgacuggacugucacgggguuc

SEQ ID NO: 98616 - RNA, 57 nt, hsa
ucauagccacugagaucugaggggcugccugggaaggcgagucuggggaccuggcac

SEQ ID NO: 98617 - RNA, 64 nt, hsa
uauccuuuauucuccgcacauggaggcugcccuaccugggaaggcaccccagcaccugugaagg

SEQ ID NO: 98618 - RNA, 64 nt, hsa
gcgggcagugcuaaagguggagcugggggauuuuccugggaaugauuugagggcucuugaaagc

SEQ ID NO: 98619 - RNA, 64 nt, hsa
aggaugguggcuggagacaggcaggcuucucugcccugggaagagcccacucagcuuaauugcu

SEQ ID NO: 98620 - RNA, 64 nt, hsa
ggcgguucaagugaaaaccaacacacucagcaucccugggaacugagaggugccagcaauugcu

SEQ ID NO: 98621 - RNA, 64 nt, hsa
cuggggucugaagaucagggucaguguggcugugccugggaauuccagaccugagguugggaaa

SEQ ID NO: 98622 - RNA, 64 nt, hsa
cuuucucaaguauuuauuuauuuauugcaugguuccugggaacauguggcacaaguaaugggau

SEQ ID NO: 98623 - RNA, 64 nt, hsa
cuauaacaagaaaagaaaugaagugcauaagucuccugggaaaagaaccuuaaccccuucucgu

SEQ ID NO: 98624 - RNA, 64 nt, hsa
gccccuccagagacaggaaagaauuugccuucucccugggaacugguucaagagacacugcuug

SEQ ID NO: 98625 - RNA, 64 nt, hsa
gucucacuuuuuguuaauguugcugccucauugaccugggaaaaaugaaaaaaaaaaauaaagc

SEQ ID NO: 98626 - RNA, 64 nt, hsa
aagcugaugggagugagagaacucagcaagccaaccugggaaucagagagagaaggagaaggag

SEQ ID NO: 98627 - RNA, 64 nt, hsa
aggucaccagccugacugcacacagcuaggcaugccugggaauccugcugccagagaaccauuc

SEQ ID NO: 98628 - RNA, 64 nt, hsa
ccauucaucucaugcucucugaacagaagguauaccugggaagauaccagcuuuuucucucagg

SEQ ID NO: 98629 - RNA, 64 nt, hsa
uucaguaguugcuuuugaauaaugguuuugguuaccugggaaggcaggcccagaacccauuucc

SEQ ID NO: 98630 - RNA, 64 nt, hsa
auguaauuggaguaagugacaaaauaagaacuacccugggaaacccugcauucaauguagcugu

SEQ ID NO: 98631 - RNA, 64 nt, hsa
cuuagcuggcaggucugggugccccuuuuccuccccugggaagggcuggaauaggauagaaagc

SEQ ID NO: 98632 - RNA, 64 nt, hsa
guggauuccuucagggcaugguaccuuucuaggaccugggaaugggguggagaggacauccucu

SEQ ID NO: 98633 - RNA, 64 nt, hsa
gacucaguuuggacaagggggaaagggggacuucccugggaagguccagcuaaaaguggcaaca

SEQ ID NO: 98634 - RNA, 64 nt, hsa
uaaaaguggcaacauuugcccccagaauugggggccugggaacacuggaccugcuccuucuccc

SEQ ID NO: 98635 - RNA, 64 nt, hsa
ggagccacgggauggggugggggagccccaugggccugggaaggagggugcuguggagggggcu

SEQ ID NO: 98636 - RNA, 64 nt, hsa
accucauuccccucccacuacagggaucaagugaccugggaagaaccgaguuuaacaccaggau

SEQ ID NO: 98637 - RNA, 64 nt, hsa
uagcaagaaaaugugcagccuuuugggcaaagccccugggaacgaggccuauccacuauggacu

SEQ ID NO: 98638 - RNA, 64 nt, hsa
guuggcaguggggagauuuccacuguggaaaccgccugggaauuccggccagcagcuuccuccu

SEQ ID NO: 98639 - RNA, 64 nt, hsa
gccaggccuuacaucuggcuggaaagcagagccuccugggaacacaucuggcugcacaggcuga

SEQ ID NO: 98640 - RNA, 64 nt, hsa
gcgcagggcuggcacgugacaggcucgucagccaccugggaacacaguucugggcaaagaggau

SEQ ID NO: 98641 - RNA, 64 nt, hsa
ugcuuugcccguggccagaagcucagcagcggcuccugggaaaggccuggaaaggaugagggaa

SEQ ID NO: 98642 - RNA, 64 nt, hsa
uuugucaggcaauaugcccuugagcaggucacccccugggaaugggggguacucacgcaccccg

SEQ ID NO: 98643 - RNA, 64 nt, hsa
cauaaccucaccagccaccucugaggucauggaaccugggaacagaagccucaacccccacaag

SEQ ID NO: 98644 - RNA, 64 nt, hsa
ggggaagagccgggaagggacagucaggcuucucccugggaagguggggccagcaggagaugac

SEQ ID NO: 98645 - RNA, 64 nt, hsa
cuucagcuagagcuucaagucugugccuggagcuccugggaaggcuacucaccuugaacaccac

SEQ ID NO: 98646 - RNA, 64 nt, hsa
gaugcgguggcuaaaggucccaaggcaaggggugccugggaaccuuccugucuucauccuuagc

SEQ ID NO: 98647 - RNA, 64 nt, hsa
ucucucugaguuccucugggcugccgcaggcuccccugggaauagagcaagacgugaguccuaa

SEQ ID NO: 98648 - RNA, 64 nt, hsa
ugagcccagcguccccuccuuggcuuccaggagcccugggaagcauuuuuaacuggguagaauc

SEQ ID NO: 98649 - RNA, 64 nt, hsa
ugccugugagcagcuuagcaaggagcccuugcucccugggaaaggcggugaacuugagucuaaa

SEQ ID NO: 98650 - RNA, 64 nt, hsa
cuccacagccaagcacugccacgguccuccaggaccugggaagcaaaggcacaggcccacggug

SEQ ID NO: 98651 - RNA, 64 nt, hsa
gucuugucaguucgugcccucuuuccccauguucccugggaagacgggugguggcagagugaga

SEQ ID NO: 98652 - RNA, 64 nt, hsa
aggcugcuuugugugagauguaguuuucccaucuccugggaagggaucuuucgagguuccccuc

SEQ ID NO: 98653 - RNA, 64 nt, hsa
cccacccucuggaggccugggaaccuggcugcagccugggaaggcuggagaggcagacgguggg

SEQ ID NO: 98654 - RNA, 64 nt, hsa
uaccugcaccugcuguggucccacccucuggaggccugggaaccuggcugcagccugggaaggc

SEQ ID NO: 98655 - RNA, 64 nt, hsa
uuuccauuuaaaacuaauuuauaaacuauguacuccugggaagauuugaaaucuuuuagaaguu

SEQ ID NO: 98656 - RNA, 64 nt, hsa
aguuagguucccuaacacuaccgcugauagcucaccugggaacugaauccaccuaaccaugaau

SEQ ID NO: 98657 - RNA, 64 nt, hsa
ccucuguggucacagcuggagcacagagagggacccugggaacuuggccugggaagcccagagc

SEQ ID NO: 98658 - RNA, 64 nt, hsa
agcuggagcacagagagggacccugggaacuuggccugggaagcccagagcaggaagccacagc

SEQ ID NO: 98659 - RNA, 64 nt, hsa
cuccgggcaaaagcgggggcgaguguagagcgauccugggaaauccuuugauccgggagcccua

SEQ ID NO: 98660 - RNA, 64 nt, hsa
ggacaggaucccugcugcaccuuccccacccccuccugggaagugcccccucaccucagggcac

SEQ ID NO: 98661 - RNA, 64 nt, hsa
aacgugugguguguccccugggaagucucugggcccugggaagagggaaggugcacguccuggg

SEQ ID NO: 98662 - RNA, 64 nt, hsa
gacucauguccagcaaggaacgugugguguguccccugggaagucucugggcccugggaagagg

SEQ ID NO: 98663 - RNA, 64 nt, hsa
ugauggguugccugugcgccagagugacucacacccugggaaaaguucccgugggugggggcgg

SEQ ID NO: 98664 - RNA, 64 nt, hsa
gcagccaguccagcucuugcuuccucuggcccguccugggaaggggggugucuagagcccagga

SEQ ID NO: 98665 - RNA, 64 nt, hsa
ccucuugcagccccccaaacugggaccgaaugacccugggaaggggaacuuggguagguugggg

SEQ ID NO: 98666 - RNA, 64 nt, hsa
gugggggcugaccccugccuuugauugucauucuccugggaagcccagucucagucccuccccc

SEQ ID NO: 98667 - RNA, 64 nt, hsa
uuauucuccccagccagagcccgagcuccugcucccugggaaaaguggcguauggcccugagcu

SEQ ID NO: 98668 - RNA, 64 nt, hsa
cggggauagaaugguuuccacugaggacauucagccugggaaggaggaagucaccagcucgagg

SEQ ID NO: 98669 - RNA, 64 nt, hsa
guucacagugaccgagagucagguccagcacacaccugggaaagggaugcugccccaaggggga

SEQ ID NO: 98670 - RNA, 64 nt, hsa
ggaacagaagugaggaugagacccagccccuuccccugggaacucuccuggccuucuaggaaug

SEQ ID NO: 98671 - RNA, 64 nt, hsa
acccuguccccuagggacuguccuagccaggucuccugggaaagggagaugucaggauguugcu

SEQ ID NO: 98672 - RNA, 64 nt, hsa
ugacaucuaauuuaccaucaaguuguaaaauuauuuggaaaaauacagaacucguuuuauuugu

SEQ ID NO: 98673 - RNA, 64 nt, hsa
ugggguuuuuuuguuuguuuguuucuuuuguuuuuuggaaaauccgugucuuuaucuuuuuuuc

SEQ ID NO: 98674 - RNA, 64 nt, hsa
agccagugcaaaauaaucugcuuaccuacucacauuggaaaaacccucugagcugaauaauucu

SEQ ID NO: 98675 - RNA, 64 nt, hsa
aggcagaccuagauaagaaaagcagagaacuacuuuggaaaacaguuuaucugcuguaauugaa

SEQ ID NO: 98676 - RNA, 64 nt, hsa
ucccuggagaaaaaaauugcucuguguauaucucuuggaaaauaagacaauaguauuucuccuu

SEQ ID NO: 98677 - RNA, 64 nt, hsa
ucauuauauucuaauuaaaauugugcauaaugcuuuggaaaaaugggucuuuuauaggaaaaaa

SEQ ID NO: 98678 - RNA, 64 nt, hsa
auuuguaauauggaaugggcucaguaagaagagcuuggaaaaugcagaaaguuaugaaaaauaa

SEQ ID NO: 98679 - RNA, 64 nt, hsa
gggaagagugguuaagacuacugaagagaaauauuuggaaaauaagauuucgauaucuucuuuu

SEQ ID NO: 98680 - RNA, 64 nt, hsa
ugcacaaacuuggcuucuuuaaccaagaauauuauuggaaaauucucuaaaaguuaauagggua

SEQ ID NO: 98681 - RNA, 64 nt, hsa
gggccaaagaaacauugccuugaggaagauaugauuggaaaaucaagaguguagaagaauaaau

SEQ ID NO: 98682 - RNA, 64 nt, hsa
acugaugguggggauguaaaaugguacaaccaguuuggaaaacaguuuggcaguuucucaaagg

SEQ ID NO: 98683 - RNA, 64 nt, hsa
aacugccucacuaaauucuuagggauggaaguauuuggaaaaaaaccuaacaguagagucacca

SEQ ID NO: 98684 - RNA, 64 nt, hsa
guuccaugagaaaaggauuguuugcucaaaaagcuuggaaaauacuacacacucccuuucuccu

SEQ ID NO: 98685 - RNA, 64 nt, hsa
aaaugcuuuguuuugcuggugauuuaaccagugcuuggaaaaaucuugcuuggcuauuucugca

SEQ ID NO: 98686 - RNA, 64 nt, hsa
guuuucuaugauccaaaacagcccuauaagaagguuggaaaaggaggaacuauauagcagccuu

SEQ ID NO: 98687 - RNA, 64 nt, hsa
uucucagcacaaaccuuucaaguauguuguuucuuuggaaaauggacauacuguauuguguucu

SEQ ID NO: 98688 - RNA, 64 nt, hsa
uauuugaaaauaaugagacaucuuucauuggauuuuggaaaauuguuccccaugggauucuaac

SEQ ID NO: 98689 - RNA, 64 nt, hsa
gaguugucauuuugcacuuucaaaacuuauuuucuuggaaaacaauauuuauagggcuuaaagc

SEQ ID NO: 98690 - RNA, 64 nt, hsa
uauuauuaauuuuaaguccugucuuuacauccuuuuggaaaacuuguauuaccauggguuugga

SEQ ID NO: 98691 - RNA, 64 nt, hsa
uacauccuuuuggaaaacuuguauuaccauggguuuggaaaaaggacaacgaaaggcuuuucau

SEQ ID NO: 98692 - RNA, 64 nt, hsa
gccccugcacaaaaugaaauaaaggaaguggaaauuggaaaaaacgcaaaccuaacuugcucug

SEQ ID NO: 98693 - RNA, 64 nt, hsa
ggaaaaaacgcaaaccuaacuugcucugcuuguuuuggaaaaggcacucaguucuuggcugccg

SEQ ID NO: 98694 - RNA, 64 nt, hsa
gguuugagaggcuagaaacugagccucucuacuuuuggaaaaaugaacaugugaggucagauuu

SEQ ID NO: 98695 - RNA, 64 nt, hsa
uugggauuccauuguaagcuguguaugugcguguuuggaaaaguguauucauacuuaguuuuuu

SEQ ID NO: 98696 - RNA, 64 nt, hsa
aaauauauuuugcaaauuguuguucaaaagauaauuggaaaaaauugaauauauuguaggauuu

SEQ ID NO: 98697 - RNA, 60 nt, hsa
cacuaauuaaagaagauugaauaaacuuuauuggaaaaugcuaaaauuuuaauauaguua

SEQ ID NO: 98698 - RNA, 64 nt, hsa
caggaaggcugagaggagagagacuccagcuggguuggaaaacaguauuuuccaaacuaccuuc

SEQ ID NO: 98699 - RNA, 64 nt, hsa
augaaauguaaauacuguuuuuaacaacuaugauuuggaaaauaaaucaaugcuauaacuaugu

SEQ ID NO: 98700 - RNA, 64 nt, hsa
ccuuccauucauuuugcugaauuccagaguccuuuuggaaaacugacuuuagucugcugggcug

SEQ ID NO: 98701 - RNA, 64 nt, hsa
aauugaauugggcaaaugaugacugagaacaggcuuggaaaagguuuucuggggaggaggaggc

SEQ ID NO: 98702 - RNA, 64 nt, hsa
ugcuuuauauuaacgauacuaaaaaaaaauagcuuuggaaaaaaaacuacuguauguaacggaa

SEQ ID NO: 98703 - RNA, 64 nt, hsa
gacuaucggggcgggccaaccccgagaaugaagauuggaaaaaggaaaaaaaaaaaaacacguc

SEQ ID NO: 98704 - RNA, 64 nt, hsa
uuuaaaaagaaauuauucucauugcuguauuauauuggaaaaguuuuaaacaaccaagcuaaag

SEQ ID NO: 98705 - RNA, 64 nt, hsa
ugauuugggggauuguuuuguuuuggugguuguuuuggaaaaacaguuuauaaacugauuuuug

SEQ ID NO: 98706 - RNA, 64 nt, hsa
ggaaucaguaaccauucaaucuuuuguccuaggauuggaaaaaaauguuaaagguuuaggacac

SEQ ID NO: 98707 - RNA, 64 nt, hsa
auugaaaauaaauaauuaaaauaucagacauguuuuggaaaagucuuaauuugagaacaccaaa

SEQ ID NO: 98708 - RNA, 64 nt, hsa
cagguaguccuggcuuuuucccugaaacauaagcuuggaaaaucuauuagaaagcagaacaggg

SEQ ID NO: 98709 - RNA, 64 nt, hsa
aacccucaagccaguugauuuuuaauauauuugauuggaaaagaacucucugguauuauuaaga

SEQ ID NO: 98710 - RNA, 64 nt, hsa
uuuuaacuuaacaugaaaaauucacucuuuuauuuuggaaaaaaaguuaacuuuucauacuaac

SEQ ID NO: 98711 - RNA, 64 nt, hsa
uguauaaaaacucaugcugcuccaccagugggccuuggaaaaugcaucaagaaggccaaaccag

SEQ ID NO: 98712 - RNA, 64 nt, hsa
acuuuaccuugaaccacauauaccaauuauaauuuuggaaaaggaauuaagccucacggaacaa

SEQ ID NO: 98713 - RNA, 64 nt, hsa
gaggaguauuauagccaaguuuucuuugaaaguauuggaaaacuaaaauuaaaugacaaggacu

SEQ ID NO: 98714 - RNA, 64 nt, hsa
ucccagaacuuauuagaaacgauuccggauggcauuggaaaacuaaagaaacugucaaucuuga

SEQ ID NO: 98715 - RNA, 64 nt, hsa
aaauuguuauuuuaacagacccugccuaaaagcauuggaaaacuaaagaaguugagcaacuuga

SEQ ID NO: 98716 - RNA, 64 nt, hsa
ucuaaaaaccuucuuuuagaucuuccuugggccuuuggaaaaauaugugacaagugaauguaag

SEQ ID NO: 98717 - RNA, 64 nt, hsa
aaaauaauuuuacuauuucuuuuaaaaguauguuuuggaaaaucaaugauuuuaaugcauagca

SEQ ID NO: 98718 - RNA, 64 nt, hsa
gagauuuauuuuaucucacagguuuguguaauuguuggaaaauuuuuaaacuucuaagugaaag

SEQ ID NO: 98719 - RNA, 64 nt, hsa
guuucucauuguaaagcuucaugucuuuuguuuguuggaaaauuuuuacuuauagaaacuuaau

SEQ ID NO: 98720 - RNA, 64 nt, hsa
uauauuggagaaaaacccuaugaguguaaugaauuuggaaaaauauuuuuuucaacaacagcuu

SEQ ID NO: 98721 - RNA, 64 nt, hsa
cagagguauauuuacauucagaguacacuuuucuuuggaaaaaauuacagguuuuuugaaaagu

SEQ ID NO: 98722 - RNA, 64 nt, hsa
gcaguggcuccucucugguugaggagagggaaaauuggaaaaacuggucgaguaauuaucaaua

SEQ ID NO: 98723 - RNA, 64 nt, hsa
aucacucuggggacuaggugucagcaugugaauuuuggaaaacacaaaaauucagaacauagca

SEQ ID NO: 98724 - RNA, 64 nt, hsa
guauacuuugauuaaguaaaaaaaaucccuauucuuggaaaauacacaauaaaguauuuugagg

SEQ ID NO: 98725 - RNA, 64 nt, hsa
ccaguguuaaaugugaguggaaggaguucuggaauuggaaaaccaucauuuuucaaccaucaca

SEQ ID NO: 98726 - RNA, 64 nt, hsa
aauauaguuugccacuaaaaggaaccaaggcuacuuggaaaaauggaugauuccaaagcaaggg

SEQ ID NO: 98727 - RNA, 64 nt, hsa
guguacaggagaagaaguucauacaggugauucguuggaaaaauucauugucucuagagauugu

SEQ ID NO: 98728 - RNA, 64 nt, hsa
uucucagguugucagguucugccuucaaggguuguuggaaaauaguccccaucuaauauguaua

SEQ ID NO: 98729 - RNA, 64 nt, hsa
uuaguagcucuaaacuguuaacauagaauguuacuuggaaaaagucuggaauaugugguguaca

SEQ ID NO: 98730 - RNA, 64 nt, hsa
gcagagggauuaaauuagaccugugagauuauauuuggaaaaauucaugucuguaacuaaccca

SEQ ID NO: 98731 - RNA, 64 nt, hsa
gaggaauuucaugaugauuuaggaauuuucucucuuggaaaaggcuuccccugugaugaaaaug

SEQ ID NO: 98732 - RNA, 64 nt, hsa
uuuucucagacagacauaguaguaucaacuagcauuggaaaauacauaucacuauucuuggaau

SEQ ID NO: 98733 - RNA, 64 nt, hsa
gcucguaguucaauaacauuccaaagaacguaguuuggaaaacacuggccuaucggcuguaaua

SEQ ID NO: 98734 - RNA, 64 nt, hsa
auugauuuuaugcucccagaauaaaaucauagaguuggaaaauauuuuuuugaaaugcuuccug

SEQ ID NO: 98735 - RNA, 64 nt, hsa
ucaaaaugacacuuauuugucaaguaauaugaucuuggaaaauuuuaaagaaaaauaauccuac

SEQ ID NO: 98736 - RNA, 64 nt, hsa
uaaauaaugccuaucuuuaacuuuuuaagacuauuuggaaaaaugcagugucucagcugucccc

SEQ ID NO: 98737 - RNA, 64 nt, hsa
ucaauuagcagauguauauguaugcauaauuaauuuggaaaauguuauuuuauggaaugucugc

SEQ ID NO: 98738 - RNA, 64 nt, hsa
uugcuugugggaacguaaaaugguucagcugcuguuggaaaacgcuauggagguucgucacaaa

SEQ ID NO: 98739 - RNA, 64 nt, hsa
gcuugucaggauguuaagcaucucaggagaaauauuggaaaauuauauguauaaaaccaaagug

SEQ ID NO: 98740 - RNA, 64 nt, hsa
ccaauuccauacagagaugaucugguaucuucuuuuggaaaaugguauucaaauucuggaaugg

SEQ ID NO: 98741 - RNA, 64 nt, hsa
ggagucucccaaauuuaauguggaagacaaaguguuggaaaaucaaaagaggcucacucaaacc

SEQ ID NO: 98742 - RNA, 64 nt, hsa
uauaugcaaaguaauucaaaccuggccauguacuuuggaaaagaaagcauagagaugaauugug

SEQ ID NO: 98743 - RNA, 64 nt, hsa
agauggcaaaugaugagccaucagaaaacuuaauuuggaaaacauguauguagccaguguggau

SEQ ID NO: 98744 - RNA, 64 nt, hsa
auaagguaucuccccucccuucaggaauaacuuauuggaaaacugaaaagaaucacugaaugga

SEQ ID NO: 98745 - RNA, 64 nt, hsa
uccuuccucuuuauucgagcauacuggcaaugcauuggaaaacagacagcucccacuaagauca

SEQ ID NO: 98746 - RNA, 64 nt, hsa
ucagguuaguggugucugucagcugucuaagagguuggaaaaugaacuacucaagauagucacg

SEQ ID NO: 98747 - RNA, 64 nt, hsa
uagaguauuuucuaagcuggaaacuuagugugccuuggaaaaggccgcaaguugcuuacuccga

SEQ ID NO: 98748 - RNA, 64 nt, hsa
uguugauauaaaguagggaaaaaaauuguacuuuuuggaaaauagcacuuuucacuucugugug

SEQ ID NO: 98749 - RNA, 64 nt, hsa
augauucuuaaccaggcuauauguuaaaaaaaaauuggaaaaugcaauacauuuuuuauuauac

SEQ ID NO: 98750 - RNA, 64 nt, hsa
guugcacagacuguguuuaugacucaaccguugguuggaaaagacuuuguuucauguguauuug

SEQ ID NO: 98751 - RNA, 64 nt, hsa
acaaauguaauuaauaacuuucucugugaaagcuuuggaaaaaucuuuuuuuuuuuuuuugguc

SEQ ID NO: 98752 - RNA, 64 nt, hsa
aauagauggggcauauaauaaagaagcuacuauuuuggaaaaugacauuuuacuauuugccaau

SEQ ID NO: 98753 - RNA, 64 nt, hsa
cacugauggagaggcauaguaaucuguuugugcuuuggaaaaauauauaaaaguuuuuuucccc

SEQ ID NO: 98754 - RNA, 64 nt, hsa
acaaaacagcaucauacauagugaaugauguucauuggaaaauucuaaaauuuguccuugucua

SEQ ID NO: 98755 - RNA, 64 nt, hsa
ugaaaagcgggguucaaugcuacaaaaugugugcuuggaaaauguucugacagcauuucagcug

SEQ ID NO: 98756 - RNA, 64 nt, hsa
guuuucaccuaucuggaaaaaaaaaaauaugagauuggaaaaaauuagacaagucuaguggaac

SEQ ID NO: 98757 - RNA, 64 nt, hsa
uuuaacauauauauuuauuaauuuauuugucguguuggaaaaugugucucugcuuuccuuuucu

SEQ ID NO: 98758 - RNA, 64 nt, hsa
cugucccuuaauaaaaauauauauuacuacuccuuuggaaaauagauuuuuaaugguuaagaac

SEQ ID NO: 98759 - RNA, 64 nt, hsa
uuuaaaauuauuuucauugauggaacuggaguuguuggaaaaacauagauuuaaaaugauuuuu

SEQ ID NO: 98760 - RNA, 64 nt, hsa
ucugccaagugcucuugauaauuucuucagauuuuuggaaaaaaacacuauauaaaugcaaucc

SEQ ID NO: 98761 - RNA, 64 nt, hsa
caacaugauauuuagaccaacaggugaucaauguuuggaaaauacaacaaugacuuauuuaaaa

SEQ ID NO: 98762 - RNA, 64 nt, hsa
cuauagaucacauacguuaucaaaaacuacucccuuggaaaaaauaucuuucgaaaaucaaauu

SEQ ID NO: 98763 - RNA, 64 nt, hsa
ggacauuuguuccacccgaccucugacugaugguuuggaaaauaacuuuaauuaggaucauaug

SEQ ID NO: 98764 - RNA, 64 nt, hsa
aauugacaagcuaggaaagaggaggcagaaagauuuggaaaauucacagaguuucacccuuaag

SEQ ID NO: 98765 - RNA, 64 nt, hsa
ugccuuggcucuauuuggcauggauggagcccaguuggaaaauucccaaauauuacaacaaguc

SEQ ID NO: 98766 - RNA, 64 nt, hsa
gaggaugagauguaguaacuuauagcagugucauuuggaaaaguugaauuugcccuacaaggca

SEQ ID NO: 98767 - RNA, 64 nt, hsa
ugaggggacccccaugaggcugcuuuugugaguguuggaaaaaccaaaaacugcauugaaaugu

SEQ ID NO: 98768 - RNA, 64 nt, hsa
uuuauucgagggaaggaucaaugcuuauuaccauuuggaaaaacgaagaucagaagguaaauga

SEQ ID NO: 98769 - RNA, 64 nt, hsa
ccuucugacacagugugugcacuucaggcaauuuuuggaaaauauaaaaaauuccaaauucugc

SEQ ID NO: 98770 - RNA, 64 nt, hsa
aagacuaacuaguuauaaucauucccuuaaaaaguuggaaaaucauuacagauuaaaauuucuu

SEQ ID NO: 98771 - RNA, 64 nt, hsa
uuauugcuucuuugccucuccaugaauggccaauuuggaaaagcagagaugggcuuucagcaga

SEQ ID NO: 98772 - RNA, 64 nt, hsa
cgauuuuauuaucuugggggaugagaccaugagauuggaaaauguacauuacuucuaguuuuag

SEQ ID NO: 98773 - RNA, 64 nt, hsa
ugggcucagagggaauaucagugauccauacuguuuggaaaaacacugagcucaguuacacuug

SEQ ID NO: 98774 - RNA, 64 nt, hsa
aagauccuuaucuauauucauuccuucauuacuuuuggaaaauucuuacuugugaauguuaaaa

SEQ ID NO: 98775 - RNA, 64 nt, hsa
aaucauuuauuauauuuugccucaacuuuaaacauuggaaaacucauuucuggguuaauccuac

SEQ ID NO: 98776 - RNA, 64 nt, hsa
guauguacuguuauugaaaauauauuuaauaccuuuggaaaaaucuugggcaagaugaccuacu

SEQ ID NO: 98777 - RNA, 64 nt, hsa
uuacauaauugcaauauuucccccuuacuacuucuuggaaaaaaauuacaaaaugaaguuuuau

SEQ ID NO: 98778 - RNA, 64 nt, hsa
uuuauaauuaaaaacccaaagaaccagcucauguuuggaaaaggaaucuuccacugaaacauuu

SEQ ID NO: 98779 - RNA, 64 nt, hsa
gauagaauuuuuauuucauauccuuauguggugcuuggaaaauguuuuuaaccuugaccaugua

SEQ ID NO: 98780 - RNA, 64 nt, hsa
gccggguaggaaccacgguuccuucguccauuaguuggaaaaaguaacagaccuaaaacucuac

SEQ ID NO: 98781 - RNA, 64 nt, hsa
ggcuuuuuuaugaacacucucauuucaguagaauuuggaaaacuaagcgugguuggaauuucuu

SEQ ID NO: 98782 - RNA, 64 nt, hsa
guagcagaaaccaacaagaaccacuccuucauguuuggaaaauaauuucucuuguauuaucucc

SEQ ID NO: 98783 - RNA, 64 nt, hsa
aggggcucuguggcaaaaagagucagacauuucuuuggaaaacagcgaacagccuuagagcucu

SEQ ID NO: 98784 - RNA, 64 nt, hsa
aaaauacuaguaguuuuauauuuggaugacauaauuggaaaagcagauuagcugcuacuacuuu

SEQ ID NO: 98785 - RNA, 64 nt, hsa
uuugcaucccggagguugaaguuggaguuugagguuggaaaauaucuuugaaggcagaaucagu

SEQ ID NO: 98786 - RNA, 64 nt, hsa; identical to SEQ ID NO: 81180

SEQ ID NO: 98787 - RNA, 64 nt, hsa; identical to SEQ ID NO: 81181

SEQ ID NO: 98788 - RNA, 64 nt, hsa; identical to SEQ ID NO: 81204

SEQ ID NO: 98789 - RNA, 64 nt, hsa; identical to SEQ ID NO: 81205

SEQ ID NO: 98790 - RNA, 64 nt, hsa; identical to SEQ ID NO: 81232

SEQ ID NO: 98791 - RNA, 64 nt, hsa; identical to SEQ ID NO: 81233

SEQ ID NO: 98792 - RNA, 64 nt, hsa; identical to SEQ ID NO: 81241

SEQ ID NO: 98793 - RNA, 64 nt, hsa; identical to SEQ ID NO: 81242

SEQ ID NO: 98794 - RNA, 64 nt, hsa; identical to SEQ ID NO: 81294

SEQ ID NO: 98795 - RNA, 64 nt, hsa; identical to SEQ ID NO: 81295

SEQ ID NO: 98796 - RNA, 64 nt, hsa; identical to SEQ ID NO: 81311

SEQ ID NO: 98797 - RNA, 64 nt, hsa; identical to SEQ ID NO: 81312

SEQ ID NO: 98798 - RNA, 64 nt, hsa; identical to SEQ ID NO: 81313

SEQ ID NO: 98799 - RNA, 64 nt, hsa; identical to SEQ ID NO: 81314

SEQ ID NO: 98800 - RNA, 64 nt, hsa; identical to SEQ ID NO: 81315

SEQ ID NO: 98801 - RNA, 64 nt, hsa; identical to SEQ ID NO: 81413

SEQ ID NO: 98802 - RNA, 64 nt, hsa; identical to SEQ ID NO: 81414

SEQ ID NO: 98803 - RNA, 64 nt, hsa; identical to SEQ ID NO: 81424

SEQ ID NO: 98804 - RNA, 64 nt, hsa; identical to SEQ ID NO: 81425

SEQ ID NO: 98805 - RNA, 64 nt, hsa; identical to SEQ ID NO: 81444

SEQ ID NO: 98806 - RNA, 64 nt, hsa; identical to SEQ ID NO: 81445

SEQ ID NO: 98807 - RNA, 64 nt, hsa; identical to SEQ ID NO: 81449

SEQ ID NO: 98808 - RNA, 64 nt, hsa; identical to SEQ ID NO: 81450

SEQ ID NO: 98809 - RNA, 64 nt, hsa; identical to SEQ ID NO: 81554

SEQ ID NO: 98810 - RNA, 64 nt, hsa; identical to SEQ ID NO: 81555

SEQ ID NO: 98811 - RNA, 64 nt, hsa; identical to SEQ ID NO: 81577

SEQ ID NO: 98812 - RNA, 64 nt, hsa; identical to SEQ ID NO: 81578

SEQ ID NO: 98813 - RNA, 64 nt, hsa
gaaaaaaaaaugggaagauuaaaaagcacagggggaagaagaagagauuucggaggccauccug

SEQ ID NO: 98814 - RNA, 64 nt, hsa
aaaaaaaugggaagauuaaaaagcacagggggaagaagaagagauuucggaggccauccugcca

SEQ ID NO: 98815 - RNA, 64 nt, hsa
caaggugucuaguccagcucccauggaggguggggaagaagaagaagaacuucuagguccuaaa

SEQ ID NO: 98816 - RNA, 64 nt, hsa
ggugucuaguccagcucccauggaggguggggaagaagaagaagaacuucuagguccuaaacua

SEQ ID NO: 98817 - RNA, 64 nt, hsa
gucuaguccagcucccauggaggguggggaagaagaagaagaacuucuagguccuaaacuagaa

SEQ ID NO: 98818 - RNA, 64 nt, hsa
agaagaagaacuucuagguccuaaacuagaagaggaagaagaagaggaaguaguugaaaaugau

SEQ ID NO: 98819 - RNA, 64 nt, hsa
agaagaacuucuagguccuaaacuagaagaggaagaagaagaggaaguaguugaaaaugaugag

SEQ ID NO: 98820 - RNA, 64 nt, hsa
uuuaaggaaggggcuucuuaauguagaaagggaagaagaagagagaaaagaaggguaguaaaaa

SEQ ID NO: 98821 - RNA, 64 nt, hsa
ggauuuaaggaaggggcuucuuaauguagaaagggaagaagaagagagaaaagaaggguaguaa

SEQ ID NO: 98822 - RNA, 64 nt, hsa
aaagaagaaaagaagaaggggaagaaaagaaggggaagaagaucaaaacccaccaugccccagg

SEQ ID NO: 98823 - RNA, 64 nt, hsa
auugaaaagaaggggaaggggaagaaaagaaggggaagaagaucaaagaagaaaagaagaaggg

SEQ ID NO: 98824 - RNA, 64 nt, hsa
auguauugcaggaauuaaaaaggaccaagaagaggaagaagaccaaggcccaccgugccccagg

SEQ ID NO: 98825 - RNA, 64 nt, hsa
acuuauugcagaaauugaaaaguaccaagaaguggaagaagaccaagacccaucaugccccagg

SEQ ID NO: 98826 - RNA, 64 nt, hsa
gagucagcacuguccagaaagccaaaaagaaacagaagaagagagacuaaaggucugguaaagg

SEQ ID NO: 98827 - RNA, 64 nt, hsa
cagaacaugcugagcagaacaucagaaaaagcaagaagaagaaaaggcgacaucaagaaggaaa

SEQ ID NO: 98828 - RNA, 64 nt, hsa
uuauuccccaucuuccaaggguugaauucuggaggaagaagacacauuccuaguuccccgugaa

SEQ ID NO: 98829 - RNA, 64 nt, hsa
uuuauggcauuuuuuuaaagaugcccuaaguguugaagaagaguuugcaaaugcaacaaaauau

SEQ ID NO: 98830 - RNA, 64 nt, hsa
aucuagcuuguauccccacaucaugagaaagagggaagaagaagaagggaugaugugugguaga

SEQ ID NO: 98831 - RNA, 64 nt, hsa
uagcuuguauccccacaucaugagaaagagggaagaagaagaagggaugaugugugguagagaa

SEQ ID NO: 98832 - RNA, 64 nt, hsa
gcuccagccccagugggguacuguacaguuaacugaagaagaauuuuaaagacgauuugaacaa

SEQ ID NO: 98833 - RNA, 64 nt, hsa
uagcuguccuuuaacaccgcagaacccccucccagaagaagagcgaucccucggacgguccggg

SEQ ID NO: 98834 - RNA, 64 nt, hsa
aacgauggaggaaggugaaggggaaggggaagaggaagaagagugaaacaaagccagagaaaag

SEQ ID NO: 98835 - RNA, 64 nt, hsa
aaccagcccgcucaaugcagaaaaacuagaaucugaagaagaugugucccaagcuuuccuugag

SEQ ID NO: 98836 - RNA, 64 nt, hsa
guuaagguuccauaauaaacuguuaggugcucuugaagaagaugucauggcauugccucagcac

SEQ ID NO: 98837 - RNA, 64 nt, hsa
gagcucaucucuagcaaggaauuuaucuucaggugaagaagagaggaagcaggaucccacugag

SEQ ID NO: 98838 - RNA, 64 nt, hsa
uucauuuuuagauuuuguugaguccuguaaagaagaagaagaaaaaaguuucaguugugguaga

SEQ ID NO: 98839 - RNA, 64 nt, hsa
uaguucauuuuuagauuuuguugaguccuguaaagaagaagaagaaaaaaguuucaguuguggu

SEQ ID NO: 98840 - RNA, 64 nt, hsa
gccugugaguggacagagcaccccuggcugggaagaagaagaugggguaggaggaggucagguu

SEQ ID NO: 98841 - RNA, 64 nt, hsa
agggccugugaguggacagagcaccccuggcugggaagaagaagaugggguaggaggaggucag

SEQ ID NO: 98842 - RNA, 64 nt, hsa
gcgaugggucuccaggcaaguccccguccaaaaagaagaagaaguuccguaccccguccuuucu

SEQ ID NO: 98843 - RNA, 64 nt, hsa
aaaagaagaagaaguuccguaccccguccuuucugaagaagagcaagaagaagagugacuccug

SEQ ID NO: 98844 - RNA, 64 nt, hsa
aguuccguaccccguccuuucugaagaagagcaagaagaagagugacuccugaaagcccugcgc

SEQ ID NO: 98845 - RNA, 64 nt, hsa
uagaagcuuuugaaaacagacugaagggucgucggaagaagaacaggaaaagagaugaaguggc

SEQ ID NO: 98846 - RNA, 64 nt, hsa
acagauaaaagaagcagaagccaaagcugcucuugaagaagaaaaacgaagacaacagguaacc

SEQ ID NO: 98847 - RNA, 64 nt, hsa
ugcuccaggaucuuugacugaaaaaaaaaaagaagaagaagaaggagagcaagaaggaaagauu

SEQ ID NO: 98848 - RNA, 64 nt, hsa
auaugcuccaggaucuuugacugaaaaaaaaaaagaagaagaagaaggagagcaagaaggaaag

SEQ ID NO: 98849 - RNA, 64 nt, hsa
auacucauccugauaaucucuuaagagcgcccgagaagaagaaugaaacgccuguauauccugg

SEQ ID NO: 98850 - RNA, 64 nt, hsa
gcccucaccuguggaauuuggugucagcuaaaaggaagaagaaauggaaacuuaaauucuagcc

SEQ ID NO: 98851 - RNA, 64 nt, hsa
agaagagagacaaagaucacuacagaccaaaacagaagaagaagaaaaaaaagaaaaagaaauc

SEQ ID NO: 98852 - RNA, 64 nt, hsa
agagagacaaagaucacuacagaccaaaacagaagaagaagaaaaaaaagaaaaagaaaucuaa

SEQ ID NO: 98853 - RNA, 64 nt, hsa
ugggagcucagaugaugaugauguuaguaguuuggaagaagaacaagaauuccacaugagaagu

SEQ ID NO: 98854 - RNA, 64 nt, hsa
uaaacauaaaaggaggagacauacaaugggggaagaagaagaaguccccuguaagaugucacug

SEQ ID NO: 98855 - RNA, 64 nt, hsa
agauaaacauaaaaggaggagacauacaaugggggaagaagaagaaguccccuguaagauguca

SEQ ID NO: 98856 - RNA, 64 nt, hsa
aaaacaaaacaaacaaaugaaaaacguuuaaaaagaagaagaagaaaaaaaacaagaacaagca

SEQ ID NO: 98857 - RNA, 64 nt, hsa
acaaaacaaacaaaugaaaaacguuuaaaaagaagaagaagaaaaaaaacaagaacaagcagca

SEQ ID NO: 98858 - RNA, 64 nt, hsa
uuuacuuuucuuuuuuuuuaacuuuuacucucucgaagaagaggaccuucccacauccacgagg

SEQ ID NO: 98859 - RNA, 64 nt, hsa
uuuuuaguuacagaagcaguuguguuaauauuuagaagaagauguauaucuuccagauuuuguu

SEQ ID NO: 98860 - RNA, 64 nt, hsa
cucaaaaauaaaauaaaaaaagaaagaaagaaaagaagaagaaaagagaagaaggagaaggaga

SEQ ID NO: 98861 - RNA, 64 nt, hsa
agaaggagaugaaggaggaggaggaggagaaggagaagaagaagaagaagaagaccacaaaaga

SEQ ID NO: 98862 - RNA, 64 nt, hsa
aggagaugaaggaggaggaggaggagaaggagaagaagaagaagaagaagaccacaaaagacau

SEQ ID NO: 98863 - RNA, 64 nt, hsa
agaugaaggaggaggaggaggagaaggagaagaagaagaagaagaagaccacaaaagacaugac

SEQ ID NO: 98864 - RNA, 64 nt, hsa
ugaaggaggaggaggaggagaaggagaagaagaagaagaagaagaccacaaaagacaugacuau

SEQ ID NO: 98865 - RNA, 64 nt, hsa
aggaggaggaggaggagaaggagaagaagaagaagaagaagaccacaaaagacaugacuaucca

SEQ ID NO: 98866 - RNA, 64 nt, hsa
uugguagagaaggagcagaaagauguguuuuugggaagaagaagaccucuaggaggagcuagua

SEQ ID NO: 98867 - RNA, 64 nt, hsa
guagagaaggagcagaaagauguguuuuugggaagaagaagaccucuaggaggagcuaguagga

SEQ ID NO: 98868 - RNA, 64 nt, hsa
aagaggauccugaacggaaaaggaagaagaaagagaagaagaaaaagaagguagaguagaggcc

SEQ ID NO: 98869 - RNA, 64 nt, hsa
aaaagaaaaaagaagaggauccugaacggaaaaggaagaagaaagagaagaagaaaaagaaggu

SEQ ID NO: 98870 - RNA, 64 nt, hsa
cuccuacagaaacaccaucugauucagaucacaagaagaagaaaaagaaaaaagaagaggaucc

SEQ ID NO: 98871 - RNA, 64 nt, hsa
uuccguauggagcucuggacuccuaaauuccccugaagaagaaaccaauguacuguggucucuu

SEQ ID NO: 98872 - RNA, 64 nt, hsa
cacacucccagcuggcccaguuugugcaugaggugaagaagagccccuuuggcaaggauguucg

SEQ ID NO: 98873 - RNA, 64 nt, hsa
caacgaccgcuguguggacaugcagagaagcagagaagaagaaaggagcugaggaggagaagcc

SEQ ID NO: 98874 - RNA, 64 nt, hsa
agaaggguggccugcugggccgucuggcugccaggaagaagauauuccaggaaccuaagagcgc

SEQ ID NO: 98875 - RNA, 64 nt, hsa
uugggagggggagaaaaggaaaagaaaaaaaaaagaagaagaagaagaaaagagaagaagaaaa

SEQ ID NO: 98876 - RNA, 64 nt, hsa
ggagggggagaaaaggaaaagaaaaaaaaaagaagaagaagaagaaaagagaagaagaaaaaaa

SEQ ID NO: 98877 - RNA, 64 nt, hsa
gggggagaaaaggaaaagaaaaaaaaaagaagaagaagaagaaaagagaagaagaaaaaaacga

SEQ ID NO: 98878 - RNA, 64 nt, hsa
aaaagaaaaaaaaaagaagaagaagaagaaaagagaagaagaaaaaaacgaaaacagucaacca

SEQ ID NO: 98879 - RNA, 64 nt, hsa
aggagucagcucugacaaugaagaugaugaugaugaagaagaugggaauuaccuucaucccucu

SEQ ID NO: 98880 - RNA, 64 nt, hsa
uaggccuucgagcaaaagcaaagauccaccgagagaagaagagaaagaaaagaaaaagaaaaag

SEQ ID NO: 98881 - RNA, 64 nt, hsa
guaggaagcggacccgcuccagaaguccccacgagaagaagaagaagaggcggucccggucgcg

SEQ ID NO: 98882 - RNA, 64 nt, hsa
agaaacucuugccuuucagaaguccccacgagaagaagaagaagaggcggucccggucgcggac

SEQ ID NO: 98883 - RNA, 64 nt, hsa
aacucuugccuuucagaaguccccacgagaagaagaagaagaggcggucccggucgcggaccaa

SEQ ID NO: 98884 - RNA, 64 nt, hsa
agaaaaaagucaauuguucagguacaccaaagaggaagaagagcuguggaggccacccucuaca

SEQ ID NO: 98885 - RNA, 64 nt, hsa
gugggauucagagugcuuagucugcucacugggagaagaagaguuccugcgcaugcaagcccug

SEQ ID NO: 98886 - RNA, 64 nt, hsa
gaacaucauuacuuaugaugaugaaggggguggggaagaagacacagaagccuuugauauugcc

SEQ ID NO: 98887 - RNA, 64 nt, hsa
aaggcaaaagaaagaaccacucauugucuuugaggaagaagauguccgugagaacaucauuacu

SEQ ID NO: 98888 - RNA, 64 nt, hsa
ugaggcugcuguggaccaguugcugcagucccaugaagaagaucucucaaaugaggaacugaug

SEQ ID NO: 98889 - RNA, 64 nt, hsa
aggagcucaaaccagcacuaaugaacagcauguggaagaagauuuggccugaguguguucaggc

SEQ ID NO: 98890 - RNA, 64 nt, hsa
uuuguccuuucauguaacuuuuuuauuuuaagaggaagaagaagaaaggggcacacacacacaa

SEQ ID NO: 98891 - RNA, 64 nt, hsa
guccuuucauguaacuuuuuuauuuuaagaggaagaagaagaaaggggcacacacacacaauac

SEQ ID NO: 98892 - RNA, 64 nt, hsa
aaaaaaaaaaaaagagagagagagagaagaagaagaagaagagacacaaaucucuaccucccau

SEQ ID NO: 98893 - RNA, 64 nt, hsa
ggaaaaaaaaaaaaaagagagagagagagaagaagaagaagaagagacacaaaucucuaccucc

SEQ ID NO: 98894 - RNA, 64 nt, hsa
auuggaaaaaaaaaaaaaagagagagagagagaagaagaagaagaagagacacaaaucucuacc

SEQ ID NO: 98895 - RNA, 64 nt, hsa
cugauuggaaaaaaaaaaaaaagagagagagagagaagaagaagaagaagagacacaaaucucu

SEQ ID NO: 98896 - RNA, 64 nt, hsa
cacacacucaggaggaaaagaaaaaacaaaggcagaagaagaagaagaagaaauaaaaacccac

SEQ ID NO: 98897 - RNA, 64 nt, hsa
acacucaggaggaaaagaaaaaacaaaggcagaagaagaagaagaagaaauaaaaacccaccca

SEQ ID NO: 98898 - RNA, 64 nt, hsa
cucaggaggaaaagaaaaaacaaaggcagaagaagaagaagaagaaauaaaaacccacccaagc

SEQ ID NO: 98899 - RNA, 64 nt, hsa
aggaggaaaagaaaaaacaaaggcagaagaagaagaagaagaaauaaaaacccacccaagcaag

SEQ ID NO: 98900 - RNA, 64 nt, hsa
cucucaucucauuagacauuggagaguuuacacugaagaagagucuuuucaauaaaguagaaag

SEQ ID NO: 98901 - RNA, 64 nt, hsa
ucauuaugacucugacuauucuugguacuucucagaagaagaaucuuagaguguuuuucauuau

SEQ ID NO: 98902 - RNA, 64 nt, hsa
ucacgcuggcauaucaggaagauguccuuccugggaagaagaagcuccagccaguucugcugca

SEQ ID NO: 98903 - RNA, 64 nt, hsa
cacagugacaccucaggaagauguccuuccuggggaagaagaagcaccagccacaggggcaggu

SEQ ID NO: 98904 - RNA, 64 nt, hsa
cccagaacauccagagucuguccccugugaagaagaagaagauggugccuggggcucugggggu

SEQ ID NO: 98905 - RNA, 64 nt, hsa
cuccccagaacauccagagucuguccccugugaagaagaagaagauggugccuggggcucuggg

SEQ ID NO: 98906 - RNA, 64 nt, hsa
ucucuccccagaacauccagagucuguccccugugaagaagaagaagauggugccuggggcucu

SEQ ID NO: 98907 - RNA, 64 nt, hsa
gaccagaaaauggcaaugauaggagacugacauagaagaagaaugcuucccuaggaaaaagguc

SEQ ID NO: 98908 - RNA, 64 nt, hsa
ccuaggaaaaaggucgcuggcuuuggugcaagaggaagaagaauguuccacuggaagccugagc

SEQ ID NO: 98909 - RNA, 64 nt, hsa
agagugagacccuauuucaaaaaaauaaaaauuggaagaagagcuuaaaaaagauaagauuuua

SEQ ID NO: 98910 - RNA, 64 nt, hsa
aaacugcggaauacaauguccuuccauagcaugggaagaagaaaauaaacaucuccuuuccaac

SEQ ID NO: 98911 - RNA, 64 nt, hsa
uauauuuuucaaauccuugaaucuuuuuuggguugaagaagaagaaagcauagcuuuagaauag

SEQ ID NO: 98912 - RNA, 64 nt, hsa
auuuuucaaauccuugaaucuuuuuuggguugaagaagaagaaagcauagcuuuagaauagaga

SEQ ID NO: 98913 - RNA, 64 nt, hsa; identical to SEQ ID NO: 88200

SEQ ID NO: 98914 - RNA, 64 nt, hsa; identical to SEQ ID NO: 88201

SEQ ID NO: 98915 - RNA, 64 nt, hsa; identical to SEQ ID NO: 88202

SEQ ID NO: 98916 - RNA, 64 nt, hsa; identical to SEQ ID NO: 88203

SEQ ID NO: 98917 - RNA, 64 nt, hsa; identical to SEQ ID NO: 88204

SEQ ID NO: 98918 - RNA, 64 nt, hsa; identical to SEQ ID NO: 88205

SEQ ID NO: 98919 - RNA, 64 nt, hsa; identical to SEQ ID NO: 88206

SEQ ID NO: 98920 - RNA, 64 nt, hsa; identical to SEQ ID NO: 88207

SEQ ID NO: 98921 - RNA, 64 nt, hsa; identical to SEQ ID NO: 88208

SEQ ID NO: 98922 - RNA, 64 nt, hsa; identical to SEQ ID NO: 88209

SEQ ID NO: 98923 - RNA, 64 nt, hsa; identical to SEQ ID NO: 88210

SEQ ID NO: 98924 - RNA, 64 nt, hsa; identical to SEQ ID NO: 88211

SEQ ID NO: 98925 - RNA, 64 nt, hsa; identical to SEQ ID NO: 88212

SEQ ID NO: 98926 - RNA, 64 nt, hsa; identical to SEQ ID NO: 88213

SEQ ID NO: 98927 - RNA, 64 nt, hsa; identical to SEQ ID NO: 88214

SEQ ID NO: 98928 - RNA, 64 nt, hsa; identical to SEQ ID NO: 88215

SEQ ID NO: 98929 - RNA, 64 nt, hsa; identical to SEQ ID NO: 88216

SEQ ID NO: 98930 - RNA, 64 nt, hsa; identical to SEQ ID NO: 88217

SEQ ID NO: 98931 - RNA, 64 nt, hsa; identical to SEQ ID NO: 88218

SEQ ID NO: 98932 - RNA, 64 nt, hsa; identical to SEQ ID NO: 88219

SEQ ID NO: 98933 - RNA, 64 nt, hsa; identical to SEQ ID NO: 88220

SEQ ID NO: 98934 - RNA, 64 nt, hsa; identical to SEQ ID NO: 88221

SEQ ID NO: 98935 - RNA, 64 nt, hsa; identical to SEQ ID NO: 88222

SEQ ID NO: 98936 - RNA, 64 nt, hsa; identical to SEQ ID NO: 88223

SEQ ID NO: 98937 - RNA, 64 nt, hsa; identical to SEQ ID NO: 88224

SEQ ID NO: 98938 - RNA, 64 nt, hsa; identical to SEQ ID NO: 88225

SEQ ID NO: 98939 - RNA, 64 nt, hsa; identical to SEQ ID NO: 88226

SEQ ID NO: 98940 - RNA, 64 nt, hsa; identical to SEQ ID NO: 88227

SEQ ID NO: 98941 - RNA, 64 nt, hsa; identical to SEQ ID NO: 88228

SEQ ID NO: 98942 - RNA, 64 nt, hsa; identical to SEQ ID NO: 88229

SEQ ID NO: 98943 - RNA, 64 nt, hsa; identical to SEQ ID NO: 88230

SEQ ID NO: 98944 - RNA, 64 nt, hsa; identical to SEQ ID NO: 88231

SEQ ID NO: 98945 - RNA, 64 nt, hsa; identical to SEQ ID NO: 88232

SEQ ID NO: 98946 - RNA, 64 nt, hsa; identical to SEQ ID NO: 88233

SEQ ID NO: 98947 - RNA, 64 nt, hsa; identical to SEQ ID NO: 88234

SEQ ID NO: 98948 - RNA, 64 nt, hsa; identical to SEQ ID NO: 88235

SEQ ID NO: 98949 - RNA, 64 nt, hsa; identical to SEQ ID NO: 88236

SEQ ID NO: 98950 - RNA, 64 nt, hsa; identical to SEQ ID NO: 88237

SEQ ID NO: 98951 - RNA, 64 nt, hsa; identical to SEQ ID NO: 88238

SEQ ID NO: 98952 - RNA, 64 nt, hsa; identical to SEQ ID NO: 88239

SEQ ID NO: 98953 - RNA, 64 nt, hsa; identical to SEQ ID NO: 88240

SEQ ID NO: 98954 - RNA, 64 nt, hsa; identical to SEQ ID NO: 88241

SEQ ID NO: 98955 - RNA, 64 nt, hsa; identical to SEQ ID NO: 88242

SEQ ID NO: 98956 - RNA, 64 nt, hsa; identical to SEQ ID NO: 88243

SEQ ID NO: 98957 - RNA, 64 nt, hsa; identical to SEQ ID NO: 88244

SEQ ID NO: 98958 - RNA, 64 nt, hsa; identical to SEQ ID NO: 88245

SEQ ID NO: 98959 - RNA, 64 nt, hsa; identical to SEQ ID NO: 88246

SEQ ID NO: 98960 - RNA, 64 nt, hsa; identical to SEQ ID NO: 88247

SEQ ID NO: 98961 - RNA, 64 nt, hsa; identical to SEQ ID NO: 88248

SEQ ID NO: 98962 - RNA, 61 nt, hsa; identical to SEQ ID NO: 88249

SEQ ID NO: 98963 - RNA, 64 nt, hsa; identical to SEQ ID NO: 88250

SEQ ID NO: 98964 - RNA, 64 nt, hsa; identical to SEQ ID NO: 88251

SEQ ID NO: 98965 - RNA, 64 nt, hsa; identical to SEQ ID NO: 88252

SEQ ID NO: 98966 - RNA, 64 nt, hsa; identical to SEQ ID NO: 88253

SEQ ID NO: 98967 - RNA, 64 nt, hsa; identical to SEQ ID NO: 88254

SEQ ID NO: 98968 - RNA, 64 nt, hsa; identical to SEQ ID NO: 88255

SEQ ID NO: 98969 - RNA, 64 nt, hsa; identical to SEQ ID NO: 88256

SEQ ID NO: 98970 - RNA, 64 nt, hsa; identical to SEQ ID NO: 45833

SEQ ID NO: 98971 - RNA, 64 nt, hsa; identical to SEQ ID NO: 45834

SEQ ID NO: 98972 - RNA, 64 nt, hsa; identical to SEQ ID NO: 45835

SEQ ID NO: 98973 - RNA, 64 nt, hsa; identical to SEQ ID NO: 45836

SEQ ID NO: 98974 - RNA, 64 nt, hsa; identical to SEQ ID NO: 45837

SEQ ID NO: 98975 - RNA, 64 nt, hsa; identical to SEQ ID NO: 45838

SEQ ID NO: 98976 - RNA, 64 nt, hsa; identical to SEQ ID NO: 45839

SEQ ID NO: 98977 - RNA, 64 nt, hsa; identical to SEQ ID NO: 45840

SEQ ID NO: 98978 - RNA, 64 nt, hsa; identical to SEQ ID NO: 38934

SEQ ID NO: 98979 - RNA, 64 nt, hsa; identical to SEQ ID NO: 38935

SEQ ID NO: 98980 - RNA, 64 nt, hsa; identical to SEQ ID NO: 38936

SEQ ID NO: 98981 - RNA, 64 nt, hsa; identical to SEQ ID NO: 38937

SEQ ID NO: 98982 - RNA, 64 nt, hsa; identical to SEQ ID NO: 38938

SEQ ID NO: 98983 - RNA, 64 nt, hsa; identical to SEQ ID NO: 38939

SEQ ID NO: 98984 - RNA, 64 nt, hsa; identical to SEQ ID NO: 38940

SEQ ID NO: 98985 - RNA, 64 nt, hsa; identical to SEQ ID NO: 38941

SEQ ID NO: 98986 - RNA, 64 nt, hsa; identical to SEQ ID NO: 38942

SEQ ID NO: 98987 - RNA, 64 nt, hsa; identical to SEQ ID NO: 38943

SEQ ID NO: 98988 - RNA, 64 nt, hsa; identical to SEQ ID NO: 38944

SEQ ID NO: 98989 - RNA, 64 nt, hsa; identical to SEQ ID NO: 38945

SEQ ID NO: 98990 - RNA, 64 nt, hsa; identical to SEQ ID NO: 38946

SEQ ID NO: 98991 - RNA, 64 nt, hsa; identical to SEQ ID NO: 38947

SEQ ID NO: 98992 - RNA, 64 nt, hsa; identical to SEQ ID NO: 38948

SEQ ID NO: 98993 - RNA, 64 nt, hsa; identical to SEQ ID NO: 38949

SEQ ID NO: 98994 - RNA, 64 nt, hsa; identical to SEQ ID NO: 38950

SEQ ID NO: 98995 - RNA, 64 nt, hsa; identical to SEQ ID NO: 38951

SEQ ID NO: 98996 - RNA, 64 nt, hsa; identical to SEQ ID NO: 38952

SEQ ID NO: 98997 - RNA, 64 nt, hsa; identical to SEQ ID NO: 38953

SEQ ID NO: 98998 - RNA, 64 nt, hsa; identical to SEQ ID NO: 38954

SEQ ID NO: 98999 - RNA, 64 nt, hsa; identical to SEQ ID NO: 38955

SEQ ID NO: 99000 - RNA, 64 nt, hsa; identical to SEQ ID NO: 38956

SEQ ID NO: 99001 - RNA, 64 nt, hsa; identical to SEQ ID NO: 38957

SEQ ID NO: 99002 - RNA, 64 nt, hsa; identical to SEQ ID NO: 38958

SEQ ID NO: 99003 - RNA, 64 nt, hsa; identical to SEQ ID NO: 38959

SEQ ID NO: 99004 - RNA, 64 nt, hsa; identical to SEQ ID NO: 38960

SEQ ID NO: 99005 - RNA, 64 nt, hsa; identical to SEQ ID NO: 38961

SEQ ID NO: 99006 - RNA, 64 nt, hsa; identical to SEQ ID NO: 38962

SEQ ID NO: 99007 - RNA, 64 nt, hsa; identical to SEQ ID NO: 38963

SEQ ID NO: 99008 - RNA, 64 nt, hsa; identical to SEQ ID NO: 38964

SEQ ID NO: 99009 - RNA, 64 nt, hsa; identical to SEQ ID NO: 38965

SEQ ID NO: 99010 - RNA, 64 nt, hsa; identical to SEQ ID NO: 38966

SEQ ID NO: 99011 - RNA, 64 nt, hsa; identical to SEQ ID NO: 38967

SEQ ID NO: 99012 - RNA, 64 nt, hsa; identical to SEQ ID NO: 38968

SEQ ID NO: 99013 - RNA, 64 nt, hsa; identical to SEQ ID NO: 38969

SEQ ID NO: 99014 - RNA, 64 nt, hsa; identical to SEQ ID NO: 38970

SEQ ID NO: 99015 - RNA, 64 nt, hsa; identical to SEQ ID NO: 38971

SEQ ID NO: 99016 - RNA, 64 nt, hsa; identical to SEQ ID NO: 38972

SEQ ID NO: 99017 - RNA, 64 nt, hsa; identical to SEQ ID NO: 38973

SEQ ID NO: 99018 - RNA, 64 nt, hsa
ggggaggcggcucuggugcccauccucccagcaugcucuagagaggcggcucuggugccccucc

SEQ ID NO: 99019 - RNA, 64 nt, hsa
ccuuggagauguacugguguccgucucccagcaugcucuagagaggcggcucuggugcccaucc

SEQ ID NO: 99020 - RNA, 64 nt, hsa
ccacgugucuagcggcuaccguuuggacaguauagcucuagagcauggcuugguaaccuguuug

SEQ ID NO: 99021 - RNA, 64 nt, hsa
uucugaaggcuugccaggacuccugagcagguaggcucuagagucgggcaguccaauaacuuuu

SEQ ID NO: 99022 - RNA, 64 nt, hsa
auuccagagccuccugcagagccagcgaaggaaagcucuagagggagacgacuccaccgccucu

SEQ ID NO: 99023 - RNA, 64 nt, hsa
uuggggcuguugugagucgguggcaggaacgugggcucuagacugugcauucaggcucuccuac

SEQ ID NO: 99024 - RNA, 64 nt, hsa
aaggcucugagagucuagauucucuggcuguaaggcucuagaucauaaggcuucaaaauguuau

SEQ ID NO: 99025 - RNA, 64 nt, hsa
ucuuguauaagauccuagauccuaagggucgaaagcucuagaaucugcaauucaaaaguuccaa

SEQ ID NO: 99026 - RNA, 64 nt, hsa
gcuuugcucuuugguagaaaaggcuagguacacagcucuagacacugccacacagggucugcaa

SEQ ID NO: 99027 - RNA, 64 nt, hsa
uauuuuugacaguguugaaaauguucagaagguugcucuagauugagagaagagacaaacaccu

SEQ ID NO: 99028 - RNA, 64 nt, hsa; identical to SEQ ID NO: 98813

SEQ ID NO: 99029 - RNA, 64 nt, hsa; identical to SEQ ID NO: 98814

SEQ ID NO: 99030 - RNA, 64 nt, hsa; identical to SEQ ID NO: 98815

SEQ ID NO: 99031 - RNA, 64 nt, hsa; identical to SEQ ID NO: 98816

SEQ ID NO: 99032 - RNA, 64 nt, hsa; identical to SEQ ID NO: 98817

SEQ ID NO: 99033 - RNA, 64 nt, hsa; identical to SEQ ID NO: 98818

SEQ ID NO: 99034 - RNA, 64 nt, hsa; identical to SEQ ID NO: 98819

SEQ ID NO: 99035 - RNA, 64 nt, hsa; identical to SEQ ID NO: 98820

SEQ ID NO: 99036 - RNA, 64 nt, hsa; identical to SEQ ID NO: 98821

SEQ ID NO: 99037 - RNA, 64 nt, hsa; identical to SEQ ID NO: 98822

SEQ ID NO: 99038 - RNA, 64 nt, hsa; identical to SEQ ID NO: 98823

SEQ ID NO: 99039 - RNA, 64 nt, hsa; identical to SEQ ID NO: 98824

SEQ ID NO: 99040 - RNA, 64 nt, hsa; identical to SEQ ID NO: 98825

SEQ ID NO: 99041 - RNA, 64 nt, hsa; identical to SEQ ID NO: 98826

SEQ ID NO: 99042 - RNA, 64 nt, hsa; identical to SEQ ID NO: 98827

SEQ ID NO: 99043 - RNA, 64 nt, hsa; identical to SEQ ID NO: 98828

SEQ ID NO: 99044 - RNA, 64 nt, hsa; identical to SEQ ID NO: 98829

SEQ ID NO: 99045 - RNA, 64 nt, hsa; identical to SEQ ID NO: 98830

SEQ ID NO: 99046 - RNA, 64 nt, hsa; identical to SEQ ID NO: 98831

SEQ ID NO: 99047 - RNA, 64 nt, hsa; identical to SEQ ID NO: 98832

SEQ ID NO: 99048 - RNA, 64 nt, hsa; identical to SEQ ID NO: 98833

SEQ ID NO: 99049 - RNA, 64 nt, hsa; identical to SEQ ID NO: 98834

SEQ ID NO: 99050 - RNA, 64 nt, hsa; identical to SEQ ID NO: 98835

SEQ ID NO: 99051 - RNA, 64 nt, hsa; identical to SEQ ID NO: 98836

SEQ ID NO: 99052 - RNA, 64 nt, hsa; identical to SEQ ID NO: 98837

SEQ ID NO: 99053 - RNA, 64 nt, hsa; identical to SEQ ID NO: 98838

SEQ ID NO: 99054 - RNA, 64 nt, hsa; identical to SEQ ID NO: 98839

SEQ ID NO: 99055 - RNA, 64 nt, hsa; identical to SEQ ID NO: 98840

SEQ ID NO: 99056 - RNA, 64 nt, hsa; identical to SEQ ID NO: 98841

SEQ ID NO: 99057 - RNA, 64 nt, hsa; identical to SEQ ID NO: 98842

SEQ ID NO: 99058 - RNA, 64 nt, hsa; identical to SEQ ID NO: 98843

SEQ ID NO: 99059 - RNA, 64 nt, hsa; identical to SEQ ID NO: 98844

SEQ ID NO: 99060 - RNA, 64 nt, hsa; identical to SEQ ID NO: 98845

SEQ ID NO: 99061 - RNA, 64 nt, hsa; identical to SEQ ID NO: 98846

SEQ ID NO: 99062 - RNA, 64 nt, hsa; identical to SEQ ID NO: 98847

SEQ ID NO: 99063 - RNA, 64 nt, hsa; identical to SEQ ID NO: 98848

SEQ ID NO: 99064 - RNA, 64 nt, hsa; identical to SEQ ID NO: 98849

SEQ ID NO: 99065 - RNA, 64 nt, hsa; identical to SEQ ID NO: 98850

SEQ ID NO: 99066 - RNA, 64 nt, hsa; identical to SEQ ID NO: 98851

SEQ ID NO: 99067 - RNA, 64 nt, hsa; identical to SEQ ID NO: 98852

SEQ ID NO: 99068 - RNA, 64 nt, hsa; identical to SEQ ID NO: 98853

SEQ ID NO: 99069 - RNA, 64 nt, hsa; identical to SEQ ID NO: 98854

SEQ ID NO: 99070 - RNA, 64 nt, hsa; identical to SEQ ID NO: 98855

SEQ ID NO: 99071 - RNA, 64 nt, hsa; identical to SEQ ID NO: 98856

SEQ ID NO: 99072 - RNA, 64 nt, hsa; identical to SEQ ID NO: 98857

SEQ ID NO: 99073 - RNA, 64 nt, hsa; identical to SEQ ID NO: 98858

SEQ ID NO: 99074 - RNA, 64 nt, hsa; identical to SEQ ID NO: 98859

SEQ ID NO: 99075 - RNA, 64 nt, hsa; identical to SEQ ID NO: 98860

SEQ ID NO: 99076 - RNA, 64 nt, hsa; identical to SEQ ID NO: 98861

SEQ ID NO: 99077 - RNA, 64 nt, hsa; identical to SEQ ID NO: 98862

SEQ ID NO: 99078 - RNA, 64 nt, hsa; identical to SEQ ID NO: 98863

SEQ ID NO: 99079 - RNA, 64 nt, hsa; identical to SEQ ID NO: 98864

SEQ ID NO: 99080 - RNA, 64 nt, hsa; identical to SEQ ID NO: 98865

SEQ ID NO: 99081 - RNA, 64 nt, hsa; identical to SEQ ID NO: 98866

SEQ ID NO: 99082 - RNA, 64 nt, hsa; identical to SEQ ID NO: 98867

SEQ ID NO: 99083 - RNA, 64 nt, hsa; identical to SEQ ID NO: 98868

SEQ ID NO: 99084 - RNA, 64 nt, hsa; identical to SEQ ID NO: 98869

SEQ ID NO: 99085 - RNA, 64 nt, hsa; identical to SEQ ID NO: 98870

SEQ ID NO: 99086 - RNA, 64 nt, hsa; identical to SEQ ID NO: 98871

SEQ ID NO: 99087 - RNA, 64 nt, hsa; identical to SEQ ID NO: 98872

SEQ ID NO: 99088 - RNA, 64 nt, hsa; identical to SEQ ID NO: 98873

SEQ ID NO: 99089 - RNA, 64 nt, hsa; identical to SEQ ID NO: 98874

SEQ ID NO: 99090 - RNA, 64 nt, hsa; identical to SEQ ID NO: 98875

SEQ ID NO: 99091 - RNA, 64 nt, hsa; identical to SEQ ID NO: 98876

SEQ ID NO: 99092 - RNA, 64 nt, hsa; identical to SEQ ID NO: 98877

SEQ ID NO: 99093 - RNA, 64 nt, hsa; identical to SEQ ID NO: 98878

SEQ ID NO: 99094 - RNA, 64 nt, hsa; identical to SEQ ID NO: 98879

SEQ ID NO: 99095 - RNA, 64 nt, hsa; identical to SEQ ID NO: 98880

SEQ ID NO: 99096 - RNA, 64 nt, hsa; identical to SEQ ID NO: 98881

SEQ ID NO: 99097 - RNA, 64 nt, hsa; identical to SEQ ID NO: 98882

SEQ ID NO: 99098 - RNA, 64 nt, hsa; identical to SEQ ID NO: 98883

SEQ ID NO: 99099 - RNA, 64 nt, hsa; identical to SEQ ID NO: 98884

SEQ ID NO: 99100 - RNA, 64 nt, hsa; identical to SEQ ID NO: 98885

SEQ ID NO: 99101 - RNA, 64 nt, hsa; identical to SEQ ID NO: 98886

SEQ ID NO: 99102 - RNA, 64 nt, hsa; identical to SEQ ID NO: 98887

SEQ ID NO: 99103 - RNA, 64 nt, hsa; identical to SEQ ID NO: 98888

SEQ ID NO: 99104 - RNA, 64 nt, hsa; identical to SEQ ID NO: 98889

SEQ ID NO: 99105 - RNA, 64 nt, hsa; identical to SEQ ID NO: 98890

SEQ ID NO: 99106 - RNA, 64 nt, hsa; identical to SEQ ID NO: 98891

SEQ ID NO: 99107 - RNA, 64 nt, hsa; identical to SEQ ID NO: 98892

SEQ ID NO: 99108 - RNA, 64 nt, hsa; identical to SEQ ID NO: 98893

SEQ ID NO: 99109 - RNA, 64 nt, hsa; identical to SEQ ID NO: 98894

SEQ ID NO: 99110 - RNA, 64 nt, hsa; identical to SEQ ID NO: 98895

SEQ ID NO: 99111 - RNA, 64 nt, hsa; identical to SEQ ID NO: 98896

SEQ ID NO: 99112 - RNA, 64 nt, hsa; identical to SEQ ID NO: 98897

SEQ ID NO: 99113 - RNA, 64 nt, hsa; identical to SEQ ID NO: 98898

SEQ ID NO: 99114 - RNA, 64 nt, hsa; identical to SEQ ID NO: 98899

SEQ ID NO: 99115 - RNA, 64 nt, hsa; identical to SEQ ID NO: 98900

SEQ ID NO: 99116 - RNA, 64 nt, hsa; identical to SEQ ID NO: 98901

SEQ ID NO: 99117 - RNA, 64 nt, hsa; identical to SEQ ID NO: 98902

SEQ ID NO: 99118 - RNA, 64 nt, hsa; identical to SEQ ID NO: 98903

SEQ ID NO: 99119 - RNA, 64 nt, hsa; identical to SEQ ID NO: 98904

SEQ ID NO: 99120 - RNA, 64 nt, hsa; identical to SEQ ID NO: 98905

SEQ ID NO: 99121 - RNA, 64 nt, hsa; identical to SEQ ID NO: 98906

SEQ ID NO: 99122 - RNA, 64 nt, hsa; identical to SEQ ID NO: 98907

SEQ ID NO: 99123 - RNA, 64 nt, hsa; identical to SEQ ID NO: 98908

SEQ ID NO: 99124 - RNA, 64 nt, hsa; identical to SEQ ID NO: 98909

SEQ ID NO: 99125 - RNA, 64 nt, hsa; identical to SEQ ID NO: 98910

SEQ ID NO: 99126 - RNA, 64 nt, hsa; identical to SEQ ID NO: 98911

SEQ ID NO: 99127 - RNA, 64 nt, hsa; identical to SEQ ID NO: 98912

SEQ ID NO: 99128 - RNA, 64 nt, hsa
gacaccucuuuccuuuagccagagaaugguucaaaugucuuacagaacuaagaucuuuuucaga

SEQ ID NO: 99129 - RNA, 64 nt, hsa
accuguucgcauugguaaccugcugcuguauuucaugucuuaacggcuauuuugagguucauua

SEQ ID NO: 99130 - RNA, 64 nt, hsa
uugugcaucugccucuuuugacguuggaagacacaugucuuaccccccaaagggagcccagcac

SEQ ID NO: 99131 - RNA, 64 nt, hsa
aaauauauuuugcauuaaaugcauuucaaguuaaaugucuuaaauguauacauuagaugugugu

SEQ ID NO: 99132 - RNA, 64 nt, hsa
cuuaauguaucaaacuguauaacuuggccgcuguaugucuuaaaaccugcuuuucaauguguug

SEQ ID NO: 99133 - RNA, 64 nt, hsa
auucacuuaacaaacaaauuuuucugcuuuaaaaaugucuuauugucccaaguguacuauagcg

SEQ ID NO: 99134 - RNA, 64 nt, hsa
ggacugaaagguuuaaggaggcgaucaaacuaaaaugucuuaauggcugugugacacacguaag

SEQ ID NO: 99135 - RNA, 64 nt, hsa
gauaaaacuaaaggacuaaauuuguuuuauaaugaugucuuagagggacugaaagguuuaagga

SEQ ID NO: 99136 - RNA, 64 nt, hsa
agacuguacggugguguguuggagcuggcuuguaaugucuuaugagugacaaucguuaguuuga

SEQ ID NO: 99137 - RNA, 64 nt, hsa
gauggcagucaucuagacauguaaaaugccaagaaugucuuagaauugcacaauuuagaauuua

SEQ ID NO: 99138 - RNA, 64 nt, hsa
gauacuuguuucuguucaagucccacuuuaaauuaugucuuaggagacugaaaguggaaucuuc

SEQ ID NO: 99139 - RNA, 64 nt, hsa
cacuaaauggauggccacaagaaaaauaaaguaaaugucuuaaauaauuuaaccauaaauuuuc

SEQ ID NO: 99140 - RNA, 64 nt, hsa
aaaacagauuuuacauaaugccuacuucugguagaugucuuaugagauuguucugcuuuuucua

SEQ ID NO: 99141 - RNA, 64 nt, hsa
gguuugauuuuaaauauuucuggcuuuuauuaauaugucuuaauuuugaguuugaaaauguuaa

SEQ ID NO: 99142 - RNA, 64 nt, hsa
uucaacaguuugcccaggaacugggggaucauauaugucuuaguggacaggggucugaaguaca

SEQ ID NO: 99143 - RNA, 64 nt, hsa
gauggccaaguuuuuucucuggacaggaauguaaaugucuuacuggaaaugacaaguuuuugcu

SEQ ID NO: 99144 - RNA, 64 nt, hsa
auuaaccaauacuggaacugguaucuagcuacugaugucuuacuuugaguuuauuuaugcuuca

SEQ ID NO: 99145 - RNA, 64 nt, hsa
guugaacaaaaauuauggcauuuaagaauuuaacaugucuuagcuguaaaaaugagaaaguguu

SEQ ID NO: 99146 - RNA, 64 nt, hsa
uaaguuuuuuuauauuaguuuuauuuucuagaaaaugucuuaugaauuucuccuauuugcucua

SEQ ID NO: 99147 - RNA, 64 nt, hsa
cgcugacauacagaaugacgaaaaggagagaucaaugucuuauugugaugagucucgacuguca

SEQ ID NO: 99148 - RNA, 64 nt, hsa
guguuagguaaggguuggggguagagguuuugggaugucuuaguuagaaaccagauuaauagaa

SEQ ID NO: 99149 - RNA, 64 nt, hsa
aaauaacuuguuuuguuugucaaauucuaagcauaugucuuaaaaggcauuuuugacuaucacc

SEQ ID NO: 99150 - RNA, 64 nt, hsa
uugggacuaacaacaugaucuucuuugaguuaaaccuaccuaaguagauuuuagguggguuccu

SEQ ID NO: 99151 - RNA, 64 nt, hsa
cuuacuggcuucucaauuuucuuccuucucugccccuaccuaaaacauucuccucggaaauuac

SEQ ID NO: 99152 - RNA, 64 nt, hsa
uaaugagagccuacaaaugggagggaccuaagugccuaccuacucgcuaaucgcaggugcaaac

SEQ ID NO: 99153 - RNA, 64 nt, hsa
cauaguugcugagaaucaaagcacaaaagaaaucccuaccuauguaaauguuugaauggaggac

SEQ ID NO: 99154 - RNA, 64 nt, hsa
uuaguuuuuuuuaaaaaaaaaaacaaagcaacaaauuaacuagauacagaauaauggagaacaa

SEQ ID NO: 99155 - RNA, 64 nt, hsa
uguuuuugcauaacugguuuuguuuuuuugcagaauuaacuauaacaaucacuggcuaccgaag

SEQ ID NO: 99156 - RNA, 64 nt, hsa
aguugcucuuuggcaaugucccuuaaccaugauuauuaacuaaguuuguggcuugaguuuacaa

SEQ ID NO: 99157 - RNA, 64 nt, hsa
uuggggaaucgauuguaaaagucccagguucuaaauuaacuaaauguguacagaaaugaacgug

SEQ ID NO: 99158 - RNA, 64 nt, hsa
guauuuuacaucccaguguacccuuuauuuuauuauuaacuaauuaacuaugagauuuuuaaaa

SEQ ID NO: 99159 - RNA, 64 nt, hsa
caucccaguguacccuuuauuuuauuauuaacuaauuaacuaugagauuuuuaaaaaauggggc

SEQ ID NO: 99160 - RNA, 64 nt, hsa
aagacacuuuuuauuaugaaucagauuccaaaucauuaacuauuuuugcaaaacuggcacaagu

SEQ ID NO: 99161 - RNA, 64 nt, hsa
cacaucacaguaucagcucuuucagugaguuuuuauuaacuagauaacacauguaauacauagu

SEQ ID NO: 99162 - RNA, 64 nt, hsa
cauggucaauaaguauauuuuuaaaaugcucaacauuaacuauucauacagaaaugcaaaucaa

SEQ ID NO: 99163 - RNA, 64 nt, hsa
cacaugguaauaaaaaguauaaauuauaaaugcaauuaacuaagaacagcucugaauguauuug

SEQ ID NO: 99164 - RNA, 64 nt, hsa
uucuuuuagcaauucaguuuaguacaggagugacauuaacuaaugacaauaaauuaaacaaagc

SEQ ID NO: 99165 - RNA, 64 nt, hsa
uaggaauugccucaggcauuuuuuuuuuuuacacauuaacuaaagggcuauucgaaaucuugac

SEQ ID NO: 99166 - RNA, 64 nt, hsa
caaaucuuugaaaagcaaucuuggaaaggaauucauuaacuaaaugggguaaaagguuucuuuu

SEQ ID NO: 99167 - RNA, 64 nt, hsa
gaauuuaauauaccagauuauuaaaauauuguccauuaacuaguucauagauuuuaaaaguaaa

SEQ ID NO: 99168 - RNA, 64 nt, hsa
ucaauaguauuaacuauuaguguuaacuguuaguauuaacuauuaguauuauuaacacuaauaa

SEQ ID NO: 99169 - RNA, 64 nt, hsa
ugucugaaaucagugccuauggguugucaauaguauuaacuauuaguguuaacuguuaguauua

SEQ ID NO: 99170 - RNA, 64 nt, hsa
agggacuaguuaaggauuaacuagcccuuuaaggauuaacuaguuaaggauuaauagcaaaaga

SEQ ID NO: 99171 - RNA, 64 nt, hsa
aagauaaugcacaaaaugaagggacuaguuaaggauuaacuagcccuuuaaggauuaacuaguu

SEQ ID NO: 99172 - RNA, 64 nt, hsa
aucuggauuuuuugugugcauacauauucuacugauuaacuacuuuugcaguuuuaauccugua

SEQ ID NO: 99173 - RNA, 64 nt, hsa
aaaaaugugacugacgggaacaauucuuaaacugauuaacuagcuguaauauaguuuugugaau

SEQ ID NO: 99174 - RNA, 64 nt, hsa
uuuuuaauucaugaacuagcggaaaauuuauuaaauuaacuauuaacuacauucaccuuguaaa

SEQ ID NO: 99175 - RNA, 64 nt, hsa
uucaugaacuagcggaaaauuuauuaaauuaacuauuaacuacauucaccuuguaaauuacugu

SEQ ID NO: 99176 - RNA, 64 nt, hsa
uucaugaacuagcagaaaauuuauuaaauuaacuauuaacuacauucaccuuguaaauuacugu

SEQ ID NO: 99177 - RNA, 64 nt, hsa
uuuuuaauucaugaacuagcagaaaauuuauuaaauuaacuauuaacuacauucaccuuguaaa

SEQ ID NO: 99178 - RNA, 64 nt, hsa
ggaaugacggacacguacuauccaaguguaugggauuaacuaaucauugaaggcauucauccgu

SEQ ID NO: 99179 - RNA, 64 nt, hsa
ccauucuuggaguaguuuuaguguaugucuuuacauuaacuacuaacaguauaaauaacuugac

SEQ ID NO: 99180 - RNA, 64 nt, hsa
gaaaaucauguagaauaaaaauuuuaaaucucacuucacuuagccgacauuccaugcccugacc

SEQ ID NO: 99181 - RNA, 64 nt, hsa
agaugugaucauuccuauauuguuauugauuuuuuucacuuaauaaaaauucaccuuauuccuu

SEQ ID NO: 99182 - RNA, 64 nt, hsa
uaaagauuuuuuaggcaauaacaguaauagggaauucacuuauugagaaugaaagugaagggga

SEQ ID NO: 99183 - RNA, 64 nt, hsa
uaaaauaauguuuccacauuauauuauguuauauuucacuuaaaauacuauucauacuauacau

SEQ ID NO: 99184 - RNA, 64 nt, hsa
cccuccacacaaaccuaaaaauuuugugaccccuuucacuuaccugaaaaguagagaaauggau

SEQ ID NO: 99185 - RNA, 64 nt, hsa
uaaauguagacagauauuucaaacaucagcugaauucacuuaaguuuuuccaaaaccucaguua

SEQ ID NO: 99186 - RNA, 64 nt, hsa
gccauuuuuacaucuaaacuaagaugugcagcauuucacuuauuuagauucacuuaacaaacaa

SEQ ID NO: 99187 - RNA, 64 nt, hsa
uaaacuaagaugugcagcauuucacuuauuuagauucacuuaacaaacaaauuuuucugcuuua

SEQ ID NO: 99188 - RNA, 64 nt, hsa
aaauacacuugugauuauaaaauuaaucacaaauuucacuuauaccugcuaucagcagcuagaa

SEQ ID NO: 99189 - RNA, 64 nt, hsa
uaaacuaauagaaguugaggauuguugaaucuauuucacuuauuuuggcugugguuuccaucug

SEQ ID NO: 99190 - RNA, 64 nt, hsa
acugccaagccauacuuauuaaguucgaacauguuucacuuaaggagagacaccuagcuuaguc

SEQ ID NO: 99191 - RNA, 64 nt, hsa
ucguauauuucucauaaugugaaauaugaugagauucacuuaggggcagcauguuaguuuuggg

SEQ ID NO: 99192 - RNA, 64 nt, hsa
uuauaguccugcgagucugggaacagaucuguuuuucacuuauccugauuuaaugacaguuucc

SEQ ID NO: 99193 - RNA, 64 nt, hsa
cuccaggaucaaaacacaagggacuuuguauuauuucacuuauaauuguuuuguauauuucugg

SEQ ID NO: 99194 - RNA, 64 nt, hsa
gguaauacugucugugaaauaauguaagaagcuuuucacuuaaaaaaaaugcauuacuuucacu

SEQ ID NO: 99195 - RNA, 64 nt, hsa
uaagaagcuuuucacuuaaaaaaaaugcauuacuuucacuuaacacuagacaccaggucgaaaa

SEQ ID NO: 99196 - RNA, 64 nt, hsa
aacuuaacaaaucuuagcaaucucucaaugccuuuucacuuauuuuuuuccaaguuaugauucu

SEQ ID NO: 99197 - RNA, 64 nt, hsa
ggaagugaggaagggucaaggauggaagaguucuuucacuuacccuuuuuauuagucagcuuuu

SEQ ID NO: 99198 - RNA, 64 nt, hsa
gauagagaacccaaaguuuuguaccugguuauuuuucacuuaaguuuguagacgaaaugugcca

SEQ ID NO: 99199 - RNA, 64 nt, hsa
cccuugaagcagcaugucuuugccauagcagcacuucacuuaaaaggaagaaauugccucucug

SEQ ID NO: 99200 - RNA, 64 nt, hsa
agcaggcuuaggaauuuagaugagauguguaagauucacuuacaggcaguagcugcuucuagca

SEQ ID NO: 99201 - RNA, 64 nt, hsa
uuuaauaucuugcucucugacaggaaagaaacaauucacuuaccagccuccucaccccauccuc

SEQ ID NO: 99202 - RNA, 64 nt, hsa
cacaauuauuauucuaacaaugauuauuagcucauucacuuauuuugauaacuaaugaucacag

SEQ ID NO: 99203 - RNA, 64 nt, hsa
uuccuccuaucaaggcagcuauuuuauuaaauuuuucacuuagucugagaaauagcagauaguc

SEQ ID NO: 99204 - RNA, 64 nt, hsa
ucccccaacauccuguugcucuaacuggagcacauucacuuacgaacaccaggaaaccacaggg

SEQ ID NO: 99205 - RNA, 64 nt, hsa
uuucuucugccuuggaguucggcccuccccagacuucacuuaugcuagucuaagacccagauuc

SEQ ID NO: 99206 - RNA, 64 nt, hsa
caauggcacauggcuggaaaaugcagaaagcaaguucacuuacagccugaggcuuauaaagcuu

SEQ ID NO: 99207 - RNA, 64 nt, hsa
ugcgucauaauugcuaaaaacagggugaauuucuuucacuuaaguuggaaaaccagccucuaaa

SEQ ID NO: 99208 - RNA, 64 nt, hsa
gcauacuuuuauuucucuugagaaccuucacccuuucacuuaaaggaggcgcuuuauagcuucu

SEQ ID NO: 99209 - RNA, 64 nt, hsa
aaugaggauuugcuaugcagacagggaagggaauuucacuuaaaaggaaggucauuuggagaug

SEQ ID NO: 99210 - RNA, 64 nt, hsa
acagaauaguuucaccacccucaaaauccugugcuucacuuauuuaucccucccgccgugcccu

SEQ ID NO: 99211 - RNA, 64 nt, hsa
uuaugcaguauguagacuuuuuagacuggcuucuuucacuuagcaauaugcauuuaagguuccu

SEQ ID NO: 99212 - RNA, 64 nt, hsa
uucccuuaaacccuugaggcuucauuaaacucuuuucacuuacuaaacuuuuguaucuucuuug

SEQ ID NO: 99213 - RNA, 64 nt, hsa
gcuuuugagugacauuuauuuagcagcuaguaacuucacuuauuucaggguaaguuuauuuuaa

SEQ ID NO: 99214 - RNA, 64 nt, hsa
aauccauacucagugaaagcagggaaaaaauauuuucacuuauuuuauuugcuucuaaaaugca

SEQ ID NO: 99215 - RNA, 64 nt, hsa
ucuaagagugaguuacagaauucuuuuugguacuuucacuuauucuuucagaauacaucaagga

SEQ ID NO: 99216 - RNA, 64 nt, hsa
aaaacauaugugaugcaauuaacaucugcauaauuucacuuaaaauuauuaugcaaaaaugaau

SEQ ID NO: 99217 - RNA, 64 nt, hsa
guaaaauuuaaauaauuacuuuuuuauaauaugauucacuuaugccacagauucaacauuagaa

SEQ ID NO: 99218 - RNA, 64 nt, hsa
uuuaaugauucccuuguucauuuuugcugugaaaugcacugaaaaaaauccucaaaaugaguua

SEQ ID NO: 99219 - RNA, 64 nt, hsa
cuguuuacccuaaauccucccagaauggagucauugcacugagugaccugcuuccugauugcgc

SEQ ID NO: 99220 - RNA, 64 nt, hsa
cugacuucgccucuuccugcuguaugcucaucccugcacugagcacagauaugacaagcaguag

SEQ ID NO: 99221 - RNA, 64 nt, hsa
acuugauuccaaaugccauguuguuuucacucucugcacugacuuuuuaauuauuuaaaacucu

SEQ ID NO: 99222 - RNA, 64 nt, hsa
accgugggaaugagugcacugauucaaacguugcugcacugaagcucagacacacuugaaacuc

SEQ ID NO: 99223 - RNA, 64 nt, hsa
aaugcugucuccgauaucucaccgugggaaugagugcacugauucaaacguugcugcacugaag

SEQ ID NO: 99224 - RNA, 64 nt, hsa
uauugugauuuucuuuccccugcuaggaaaaaauugcacugaaaugcugacaaaaaauaaugaa

SEQ ID NO: 99225 - RNA, 64 nt, hsa
caaaaaauaaugaaaugaaguggcuuccaaaauaugcacugauguuauccuuuguauuuauagg

SEQ ID NO: 99226 - RNA, 64 nt, hsa
uguguauuacagugggcagguauuugcuuuugcuugcacugaaaauuaaauugcuaucaagaau

SEQ ID NO: 99227 - RNA, 64 nt, hsa
uauggcagugagcagguauguguuugcuuuugcuugcacugaaaauuaaauugcuaucaagagc

SEQ ID NO: 99228 - RNA, 64 nt, hsa
aggggccguggggguugaggcagggcaaaugacaugcacugacccuuccagacauacgaaacac

SEQ ID NO: 99229 - RNA, 64 nt, hsa
gccuaaucucauaccucugaccaacaggcuguucugcacugaaaagguucuucaucccuuucca

SEQ ID NO: 99230 - RNA, 64 nt, hsa
cagcugccacaacaccagccccacuucugggucaugcacugagguccacagaccuacugcacug

SEQ ID NO: 99231 - RNA, 64 nt, hsa
cuucugggucaugcacugagguccacagaccuacugcacugaguuaaaauagcgguacaaguuc

SEQ ID NO: 99232 - RNA, 64 nt, hsa
gagaccucaguuuauagcguaacagacuacacaaugcacugauguuuucauaauguuuaaggga

SEQ ID NO: 99233 - RNA, 64 nt, hsa
ucuguucauguuuuugugaauucuaggcuggugcugcacugaaauagagcaguaagcuugugau

SEQ ID NO: 99234 - RNA, 64 nt, hsa
cucugagcccauacuuuuggcuccucuaguaagaugcacugaaaacuuagccagaguuagguug

SEQ ID NO: 99235 - RNA, 64 nt, hsa
cucagggcacgcaggaccaguuugauugaggagcugcacugaucacccaaugcaucacguaccc

SEQ ID NO: 99236 - RNA, 64 nt, hsa
uccgaugcuuugcacugaaguugcaaaagaucugugcacugaacagugaagguggcuuccggca

SEQ ID NO: 99237 - RNA, 64 nt, hsa
aaagacguuuuggucucgauuagcuccgaugcuuugcacugaaguugcaaaagaucugugcacu

SEQ ID NO: 99238 - RNA, 64 nt, hsa
uuuuuuuucugcaggucaguaaaaggauuuaaguugcacugacaaaaauaccaaaauaaaagug

SEQ ID NO: 99239 - RNA, 64 nt, hsa
cccugacccuggcagugcacugguaagcagacacugcacugaaccaacugcuaugcucagaaug

SEQ ID NO: 99240 - RNA, 64 nt, hsa
auugauuucauucuguuuaaugaauuuggaaauaugcacugaaagaaauguaaaacauuuagaa

SEQ ID NO: 99241 - RNA, 64 nt, hsa
aaacauuuagaauagcucguguuauggaaaaaagugcacugaauuuauuagacaaacuuacgaa

SEQ ID NO: 99242 - RNA, 64 nt, hsa
aucugugcacacuguauguuguucaugauagcuugucuacaacuugacuagguuggaguucugg

SEQ ID NO: 99243 - RNA, 64 nt, hsa
uaaauguuugucagaaaugcagccaguguugugggucuacaacacuaaccagacgacuuuuucc

SEQ ID NO: 99244 - RNA, 64 nt, hsa
ucugucauguguugauauccacacagaauuaggcccuaaugagagccuuagacccucaaccaug

SEQ ID NO: 99245 - RNA, 64 nt, hsa
auuauuaccauguauuaaauugugggcuuugaaaccuaaugaaaccuguuagccacuucucugu

SEQ ID NO: 99246 - RNA, 64 nt, hsa
uuuugaugagaugucucuggggacacgaggaugcccuaaugaugcugacuugucaugguugcag

SEQ ID NO: 99247 - RNA, 64 nt, hsa
ucccugcguguggccacuccucagcauccuccccacccaccaugguucauuccgacuuuuccaa

SEQ ID NO: 99248 - RNA, 64 nt, hsa
uucucacgcguuuccacaacauccccugggucagacccaccagguaccccguaggaauuuccag

SEQ ID NO: 99249 - RNA, 64 nt, hsa
agaggaaguaaaggacaaucagaacaccagucaaacccaccaaauugcuuuauuccccuuugca

SEQ ID NO: 99250 - RNA, 64 nt, hsa
cugagagggcagaacacacauauccaaguaggcuacccaccacuggguagggauuucuguaaag

SEQ ID NO: 99251 - RNA, 64 nt, hsa
ucuccucugcuccucccaccucaucccuaggaggacccaccaguggagcacaugcagccucagu

SEQ ID NO: 99252 - RNA, 64 nt, hsa
ugccagaggaccguggauaccucaguguccacacacccaccaugcccagcccuggagccaucac

SEQ ID NO: 99253 - RNA, 64 nt, hsa
agcccucuccacccagaggucucccuauaccgagacccaccauccuuccauccugaggaccgcc

SEQ ID NO: 99254 - RNA, 64 nt, hsa
ugggggguugccucgaguccccccaccccuccccacccaccaccgcucccgcgggaagccagcc

SEQ ID NO: 99255 - RNA, 64 nt, hsa
gagcacuggcaguugguggcagugagaccagcccacccaccaccacccaccacagaaaagcaca

SEQ ID NO: 99256 - RNA, 64 nt, hsa
aguugguggcagugagaccagcccacccaccaccacccaccacagaaaagcacaaaccucuggg

SEQ ID NO: 99257 - RNA, 64 nt, hsa
aucacaggugauucacacguacacacauaaacacacccaccagugcagccugaaguaacuccca

SEQ ID NO: 99258 - RNA, 64 nt, hsa
uauugaccagaaaacaaugauuuuauaauauuuaacccaccaaaaagucccuccaacagcaaua

SEQ ID NO: 99259 - RNA, 64 nt, hsa
ucacauucugacacaagaugcaagucugugcaaaacccaccaaaaugcuccuauccaacaauua

SEQ ID NO: 99260 - RNA, 64 nt, hsa
aaacaaaaaaaacacaaaaauuucaaaaaacaccacccaccaaauugcacaauagauacaccca

SEQ ID NO: 99261 - RNA, 64 nt, hsa
ccagauagaaaguugcgggcaacacuuuucucagacccaccauguccccaacucagacuuagca

SEQ ID NO: 99262 - RNA, 64 nt, hsa
caugcccaacacauuucugcuaauagggagagggacccaccacacacccacacaugccagaggu

SEQ ID NO: 99263 - RNA, 64 nt, hsa
ugucucagccuccccaguagcugggauuacaggcacccaccaccaugcccagcuaauuguugua

SEQ ID NO: 99264 - RNA, 64 nt, hsa
gcagccugggaaggcuggagaggcagacggugggacccaccagcucucuccccaucccgcuucu

SEQ ID NO: 99265 - RNA, 64 nt, hsa
ugaguccccuccccguaaccucugcaaggccagcacccaccaucacuaccugcaccugcugugg

SEQ ID NO: 99266 - RNA, 64 nt, hsa
acaaaacugcgcccgucuuaggccugggugucugacccaccagcagugcaaugggcagguuucc

SEQ ID NO: 99267 - RNA, 64 nt, hsa
gugaccaccaccacguucagguuucugaaugcagacccaccacgagggauggauuccacccgcc

SEQ ID NO: 99268 - RNA, 64 nt, hsa
uccugguggcagcaccaggggacacaccugccaaacccaccagauggaggggcccucccugguc

SEQ ID NO: 99269 - RNA, 64 nt, hsa
cacgagaugcugucacucagccagaucaguauugacccaccaggggaggugggguuuggugaga

SEQ ID NO: 99270 - RNA, 64 nt, hsa
cgauuuauuuuuguacaaaauaauaaaaaaaaaaacccaccacaaacguagaauccacuucugu

SEQ ID NO: 99271 - RNA, 64 nt, hsa
agaaagagagagacagagagagagaaaaaaaaucacccaccacccccccaaaaacacaaaaaaa

SEQ ID NO: 99272 - RNA, 64 nt, hsa; identical to SEQ ID NO: 81841

SEQ ID NO: 99273 - RNA, 64 nt, hsa; identical to SEQ ID NO: 81842

SEQ ID NO: 99274 - RNA, 64 nt, hsa; identical to SEQ ID NO: 81843

SEQ ID NO: 99275 - RNA, 64 nt, hsa; identical to SEQ ID NO: 81844

SEQ ID NO: 99276 - RNA, 64 nt, hsa; identical to SEQ ID NO: 81845

SEQ ID NO: 99277 - RNA, 64 nt, hsa; identical to SEQ ID NO: 81846

SEQ ID NO: 99278 - RNA, 64 nt, hsa; identical to SEQ ID NO: 81847

SEQ ID NO: 99279 - RNA, 64 nt, hsa; identical to SEQ ID NO: 81848

SEQ ID NO: 99280 - RNA, 64 nt, hsa; identical to SEQ ID NO: 81849

SEQ ID NO: 99281 - RNA, 64 nt, hsa; identical to SEQ ID NO: 81850

SEQ ID NO: 99282 - RNA, 64 nt, hsa; identical to SEQ ID NO: 81851

SEQ ID NO: 99283 - RNA, 61 nt, hsa; identical to SEQ ID NO: 81852

SEQ ID NO: 99284 - RNA, 64 nt, hsa; identical to SEQ ID NO: 81853

SEQ ID NO: 99285 - RNA, 51 nt, hsa; identical to SEQ ID NO: 81854

SEQ ID NO: 99286 - RNA, 64 nt, hsa; identical to SEQ ID NO: 81855

SEQ ID NO: 99287 - RNA, 64 nt, hsa; identical to SEQ ID NO: 81856

SEQ ID NO: 99288 - RNA, 64 nt, hsa; identical to SEQ ID NO: 81857

SEQ ID NO: 99289 - RNA, 64 nt, hsa; identical to SEQ ID NO: 81858

SEQ ID NO: 99290 - RNA, 64 nt, hsa; identical to SEQ ID NO: 81859

SEQ ID NO: 99291 - RNA, 64 nt, hsa; identical to SEQ ID NO: 81860

SEQ ID NO: 99292 - RNA, 64 nt, hsa; identical to SEQ ID NO: 81861

SEQ ID NO: 99293 - RNA, 64 nt, hsa; identical to SEQ ID NO: 81862

SEQ ID NO: 99294 - RNA, 64 nt, hsa; identical to SEQ ID NO: 81863

SEQ ID NO: 99295 - RNA, 64 nt, hsa; identical to SEQ ID NO: 81864

SEQ ID NO: 99296 - RNA, 64 nt, hsa; identical to SEQ ID NO: 81865

SEQ ID NO: 99297 - RNA, 64 nt, hsa; identical to SEQ ID NO: 81866

SEQ ID NO: 99298 - RNA, 64 nt, hsa; identical to SEQ ID NO: 81867

SEQ ID NO: 99299 - RNA, 64 nt, hsa; identical to SEQ ID NO: 81868

SEQ ID NO: 99300 - RNA, 64 nt, hsa; identical to SEQ ID NO: 81869

SEQ ID NO: 99301 - RNA, 64 nt, hsa; identical to SEQ ID NO: 81870

SEQ ID NO: 99302 - RNA, 64 nt, hsa; identical to SEQ ID NO: 81871

SEQ ID NO: 99303 - RNA, 64 nt, hsa; identical to SEQ ID NO: 81872

SEQ ID NO: 99304 - RNA, 64 nt, hsa; identical to SEQ ID NO: 81873

SEQ ID NO: 99305 - RNA, 64 nt, hsa; identical to SEQ ID NO: 81874

SEQ ID NO: 99306 - RNA, 64 nt, hsa; identical to SEQ ID NO: 81875

SEQ ID NO: 99307 - RNA, 64 nt, hsa; identical to SEQ ID NO: 81876

SEQ ID NO: 99308 - RNA, 64 nt, hsa; identical to SEQ ID NO: 81877

SEQ ID NO: 99309 - RNA, 64 nt, hsa; identical to SEQ ID NO: 81878

SEQ ID NO: 99310 - RNA, 64 nt, hsa; identical to SEQ ID NO: 81879

SEQ ID NO: 99311 - RNA, 64 nt, hsa; identical to SEQ ID NO: 81880

SEQ ID NO: 99312 - RNA, 64 nt, hsa; identical to SEQ ID NO: 81881

SEQ ID NO: 99313 - RNA, 64 nt, hsa; identical to SEQ ID NO: 81882

SEQ ID NO: 99314 - RNA, 64 nt, hsa; identical to SEQ ID NO: 81883

SEQ ID NO: 99315 - RNA, 64 nt, hsa; identical to SEQ ID NO: 81884

SEQ ID NO: 99316 - RNA, 64 nt, hsa; identical to SEQ ID NO: 81885

SEQ ID NO: 99317 - RNA, 64 nt, hsa; identical to SEQ ID NO: 81886

SEQ ID NO: 99318 - RNA, 64 nt, hsa; identical to SEQ ID NO: 81887

SEQ ID NO: 99319 - RNA, 64 nt, hsa; identical to SEQ ID NO: 81888

SEQ ID NO: 99320 - RNA, 64 nt, hsa; identical to SEQ ID NO: 81889

SEQ ID NO: 99321 - RNA, 64 nt, hsa; identical to SEQ ID NO: 81890

SEQ ID NO: 99322 - RNA, 64 nt, hsa; identical to SEQ ID NO: 81891

SEQ ID NO: 99323 - RNA, 64 nt, hsa; identical to SEQ ID NO: 81892

SEQ ID NO: 99324 - RNA, 64 nt, hsa; identical to SEQ ID NO: 81893

SEQ ID NO: 99325 - RNA, 64 nt, hsa; identical to SEQ ID NO: 81894

SEQ ID NO: 99326 - RNA, 64 nt, hsa; identical to SEQ ID NO: 81895

SEQ ID NO: 99327 - RNA, 64 nt, hsa; identical to SEQ ID NO: 81896

SEQ ID NO: 99328 - RNA, 64 nt, hsa; identical to SEQ ID NO: 81897

SEQ ID NO: 99329 - RNA, 64 nt, hsa; identical to SEQ ID NO: 81898

SEQ ID NO: 99330 - RNA, 64 nt, hsa; identical to SEQ ID NO: 81899

SEQ ID NO: 99331 - RNA, 64 nt, hsa; identical to SEQ ID NO: 81900

SEQ ID NO: 99332 - RNA, 64 nt, hsa; identical to SEQ ID NO: 81901

SEQ ID NO: 99333 - RNA, 64 nt, hsa; identical to SEQ ID NO: 81902

SEQ ID NO: 99334 - RNA, 64 nt, hsa; identical to SEQ ID NO: 81903

SEQ ID NO: 99335 - RNA, 64 nt, hsa; identical to SEQ ID NO: 81904

SEQ ID NO: 99336 - RNA, 64 nt, hsa; identical to SEQ ID NO: 81905

SEQ ID NO: 99337 - RNA, 64 nt, hsa; identical to SEQ ID NO: 81906

SEQ ID NO: 99338 - RNA, 64 nt, hsa; identical to SEQ ID NO: 81907

SEQ ID NO: 99339 - RNA, 64 nt, hsa; identical to SEQ ID NO: 81908

SEQ ID NO: 99340 - RNA, 64 nt, hsa; identical to SEQ ID NO: 81909

SEQ ID NO: 99341 - RNA, 64 nt, hsa; identical to SEQ ID NO: 81910

SEQ ID NO: 99342 - RNA, 64 nt, hsa; identical to SEQ ID NO: 81911

SEQ ID NO: 99343 - RNA, 64 nt, hsa; identical to SEQ ID NO: 81912

SEQ ID NO: 99344 - RNA, 64 nt, hsa; identical to SEQ ID NO: 81913

SEQ ID NO: 99345 - RNA, 64 nt, hsa; identical to SEQ ID NO: 81914

SEQ ID NO: 99346 - RNA, 64 nt, hsa; identical to SEQ ID NO: 81915

SEQ ID NO: 99347 - RNA, 64 nt, hsa; identical to SEQ ID NO: 81916

SEQ ID NO: 99348 - RNA, 64 nt, hsa; identical to SEQ ID NO: 81917

SEQ ID NO: 99349 - RNA, 64 nt, hsa; identical to SEQ ID NO: 81918

SEQ ID NO: 99350 - RNA, 64 nt, hsa; identical to SEQ ID NO: 81919

SEQ ID NO: 99351 - RNA, 64 nt, hsa; identical to SEQ ID NO: 81920

SEQ ID NO: 99352 - RNA, 64 nt, hsa; identical to SEQ ID NO: 81921

SEQ ID NO: 99353 - RNA, 64 nt, hsa; identical to SEQ ID NO: 81922

SEQ ID NO: 99354 - RNA, 64 nt, hsa; identical to SEQ ID NO: 81923

SEQ ID NO: 99355 - RNA, 64 nt, hsa; identical to SEQ ID NO: 81924

SEQ ID NO: 99356 - RNA, 64 nt, hsa; identical to SEQ ID NO: 81925

SEQ ID NO: 99357 - RNA, 64 nt, hsa; identical to SEQ ID NO: 81926

SEQ ID NO: 99358 - RNA, 64 nt, hsa; identical to SEQ ID NO: 81927

SEQ ID NO: 99359 - RNA, 64 nt, hsa; identical to SEQ ID NO: 81928

SEQ ID NO: 99360 - RNA, 64 nt, hsa; identical to SEQ ID NO: 81929

SEQ ID NO: 99361 - RNA, 64 nt, hsa; identical to SEQ ID NO: 81930

SEQ ID NO: 99362 - RNA, 64 nt, hsa; identical to SEQ ID NO: 81931

SEQ ID NO: 99363 - RNA, 64 nt, hsa; identical to SEQ ID NO: 81932

SEQ ID NO: 99364 - RNA, 64 nt, hsa; identical to SEQ ID NO: 81933

SEQ ID NO: 99365 - RNA, 64 nt, hsa; identical to SEQ ID NO: 81934

SEQ ID NO: 99366 - RNA, 64 nt, hsa; identical to SEQ ID NO: 81935

SEQ ID NO: 99367 - RNA, 64 nt, hsa; identical to SEQ ID NO: 81936

SEQ ID NO: 99368 - RNA, 64 nt, hsa; identical to SEQ ID NO: 81937

SEQ ID NO: 99369 - RNA, 64 nt, hsa; identical to SEQ ID NO: 81938

SEQ ID NO: 99370 - RNA, 64 nt, hsa; identical to SEQ ID NO: 81939

SEQ ID NO: 99371 - RNA, 64 nt, hsa; identical to SEQ ID NO: 81940

SEQ ID NO: 99372 - RNA, 64 nt, hsa; identical to SEQ ID NO: 81941

SEQ ID NO: 99373 - RNA, 64 nt, hsa; identical to SEQ ID NO: 81942

SEQ ID NO: 99374 - RNA, 64 nt, hsa; identical to SEQ ID NO: 81943

SEQ ID NO: 99375 - RNA, 64 nt, hsa; identical to SEQ ID NO: 81944

SEQ ID NO: 99376 - RNA, 64 nt, hsa
cuuugaggagaagugcucuacacugaagucaaaagcccauuaacgagaaagugccugcccacug

SEQ ID NO: 99377 - RNA, 64 nt, hsa
caaaaccaaacuggacucucgugcagaaaauguagcccauuaccacauguagccuuggagaccc

SEQ ID NO: 99378 - RNA, 64 nt, hsa
gacagggugaggguauacccaaagcugaugcagagcccauuagccuaaaagcaacugcaggaca

SEQ ID NO: 99379 - RNA, 64 nt, hsa
cacuuaugugagucaucaugguguuggucuuguagcccauuauuuuuccugugcuuccccagcu

SEQ ID NO: 99380 - RNA, 64 nt, hsa
cuuagugaauauauucuuaaucauuaauaaauuagcccauuauauuuucaucuguauuugccau

SEQ ID NO: 99381 - RNA, 64 nt, hsa
cacgccagagcugaagggggaaacuugguaacuugcccauuauucucugcuuuuagccagaguu

SEQ ID NO: 99382 - RNA, 64 nt, hsa
ggugguuucaaagcucggacaguaacuaucuugagcccauuagagagucuguguccauauuugc

SEQ ID NO: 99383 - RNA, 64 nt, hsa
ccuguaaaccuucaucccuggcccccuaucuugggcccauuaguuuuggggauggggcacaggg

SEQ ID NO: 99384 - RNA, 64 nt, hsa
ugccuccaucagcuucuuauuuaguauuucauaugcccauuagcccuaugcuucagaugacacg

SEQ ID NO: 99385 - RNA, 64 nt, hsa
agguucauggauuuuccaggacuguuucaaacaugcccauuacuaacggcaaaagggggauucc

SEQ ID NO: 99386 - RNA, 64 nt, hsa
acccuuaccuugaggaaugggaaaaugaaccucagcccauuaggcaggaaaaguugauauuuaa

SEQ ID NO: 99387 - RNA, 64 nt, hsa
acuugcuuauacuauucucuccauugaugcacaugcccauuaaccuaggaaaguaauuuucaaa

SEQ ID NO: 99388 - RNA, 64 nt, hsa
cuagaaguggaauaaugugcucagggucaccauagcccauuaguggaaggaccaggacuagacc

SEQ ID NO: 99389 - RNA, 64 nt, hsa
uuccaaguggcagacauuucccuuucaauuuauggcccauuaaaagcucuguuuugguuaugaa

SEQ ID NO: 99390 - RNA, 64 nt, hsa
uaaccaauaccuuuguuuucauguguaagaaaaggcccauuacuuuuaagguaugugcuguccu

SEQ ID NO: 99391 - RNA, 64 nt, hsa
aggggcaaacaucacaaaauguaauuuaaugccugcccauuagagaaguauuuaucaggagaag

SEQ ID NO: 99392 - RNA, 64 nt, hsa
aaggcgcaaaggaagcaagagguuaaagauaauggcccauuagauacaacagcaagcccaagau

SEQ ID NO: 99393 - RNA, 64 nt, hsa
uauucuuggagauugauaaccauagcauuaauacgcccauuauggucauuuaaauugggguuua

SEQ ID NO: 99394 - RNA, 64 nt, hsa
uuuuccucuuuuccccacccaucuccccaauauugcccauuauuaauuaaccucuuucuuuggu

SEQ ID NO: 99395 - RNA, 64 nt, hsa
auacacaauuauuugguuuaggaugguuauuagggcccauuagaaacaggagaaguauuuuacc

SEQ ID NO: 99396 - RNA, 64 nt, hsa
ccgucucuucacacagagcuguaguuucggcucugcccauuagcucauuuuauguaggaguuuu

SEQ ID NO: 99397 - RNA, 64 nt, hsa
cgggaagguggcuccugcaguucagcgucccugggcccauuaaucccacuguggagacuucugg

SEQ ID NO: 99398 - RNA, 64 nt, hsa
gcccuuuaacuuucagaggcaauagguaaauggggcccauuaggucccucacuccacagaguga

SEQ ID NO: 99399 - RNA, 64 nt, hsa
aaauauacauaccuuuguguauagacaagcccaugcccauuaaaauaaaguuauccuguaacau

SEQ ID NO: 99400 - RNA, 64 nt, hsa
ucuggaugcugccauguugggaaguacagucucugcccauuaccugcaugcaggcaccagagca

SEQ ID NO: 99401 - RNA, 64 nt, hsa
uaccuguguagugucgauuauaugucaguuuuuugcccauuacuucaucccuaaaucuucagca

SEQ ID NO: 99402 - RNA, 64 nt, hsa
ccacuccccuggugggacugccaagacccucaaugcccauuaaauacucuugccugccucuuac

SEQ ID NO: 99403 - RNA, 64 nt, hsa
gugaaugcuaauuuguagagcgaacuuccauuuggcccauuauuuguaacuguguaacugcucc

SEQ ID NO: 99404 - RNA, 64 nt, hsa
uugaauuaguuuuuugcuuccuugaauuaauaaagcccauuaaugcaaaucuaagccuucauag

SEQ ID NO: 99405 - RNA, 64 nt, hsa
ccuuguuuuauaagaagaugaucaagguuugugugcccauuaccuuuccucugccugaaagacg

SEQ ID NO: 99406 - RNA, 64 nt, hsa
cuuccucucuugacaucaagggaggaaggggauggcccauuaagaguuacucagaugaccugag

SEQ ID NO: 99407 - RNA, 64 nt, hsa
auggccuugaguauuuuaguugauacauucuucugcccauuauaauucucaccugaaguuaugg

SEQ ID NO: 99408 - RNA, 64 nt, hsa
uguuuuaugcugucaucauugucacgguuugucugcccauuaucuucauucugcaagggaaagg

SEQ ID NO: 99409 - RNA, 64 nt, hsa
cguugaaaucccucauuuauuuucuucucaaaaugcccauuauccaaaugcagaaccucugcau

SEQ ID NO: 99410 - RNA, 64 nt, hsa
uaaauuucugccaagucaguucucuuuggaggaagcccauuacuccguaacugacuggaugguc

SEQ ID NO: 99411 - RNA, 64 nt, hsa
uguuuugacuuggugaaaaugggauugucaaacagcccauuaaguucccugguauuucaccuuc

SEQ ID NO: 99412 - RNA, 64 nt, hsa
uuuuaaaaucucaaagcaguuaaacagcaggaaagcccauuaacuucguacugaaaaagcaaca

SEQ ID NO: 99413 - RNA, 64 nt, hsa
guuaguuacgugaaaucaaaggucaggucaguaagcccauuauccucaaacuugaaguuucguu

SEQ ID NO: 99414 - RNA, 64 nt, hsa
acaaugaugaauccacaguugguuaucugcuacugcccauuagcuaaaaucauuuugcugcuug

SEQ ID NO: 99415 - RNA, 64 nt, hsa
gacaggcauaaacccaaaucaaagauaauuuggugcccauuaugaauuugaaguuaagugauag

SEQ ID NO: 99416 - RNA, 64 nt, hsa
cacuguaggcucuaagaaccacgugcagucuucagcccauuaaauuaucgauuauuuuuuaaug

SEQ ID NO: 99417 - RNA, 64 nt, hsa
aaaccuuacaaagaauguauacucaucuuuuuuggcccauuacaauacugcuuucucagguucu

SEQ ID NO: 99418 - RNA, 64 nt, hsa
agcagcaaccugguucuuaaacacaaaguaaguugcccauuaacaaauggcuuuuaucuuuagc

SEQ ID NO: 99419 - RNA, 64 nt, hsa
ugugugagugguucugagcaaauaacuacagggugcccauuaccacucaagaagacacuucacg

SEQ ID NO: 99420 - RNA, 64 nt, hsa
aggaaaagggauacuuugauaauuaaggccagaggcccauuaguugagaaagucacagauauau

SEQ ID NO: 99421 - RNA, 64 nt, hsa
ugugaugacuaaaaugcuggaaagcgagugaguugcccauuaauuaugauuaaaauucucaccu

SEQ ID NO: 99422 - RNA, 64 nt, hsa
uggguauguguugauguucacagacaguacuugggcccauuagguuuucgcgucuggucuuaga

SEQ ID NO: 99423 - RNA, 64 nt, hsa
uguaggggugcaguuuguccaacucuuuccaacagcccauuagacaccacuagcuggauauuuc

SEQ ID NO: 99424 - RNA, 64 nt, hsa
aagcugaaauauuauuaaaugcuaguauguuucugcccauuaugaaagaugaaauaaaguauuc

SEQ ID NO: 99425 - RNA, 64 nt, hsa
gcucuauuuauguuauuauuccugggagcuuauagcccauuauuuuuacuuuuuuuuuuuaauu

SEQ ID NO: 99426 - RNA, 64 nt, hsa
gcaggacuggguagcagagccgggaagguggguggcccauuacagggggguccccagggugucc

SEQ ID NO: 99427 - RNA, 64 nt, hsa
uuuguuuuauucuucaguguucauauagcaccuggcccauuacauaucuaggcaacuaaaaaca

SEQ ID NO: 99428 - RNA, 64 nt, hsa
augcaacaaaauggaugacuuaguggagauggaagcccauuaauuggguuccccauuaaaucgu

SEQ ID NO: 99429 - RNA, 64 nt, hsa
ggacucugcuacacuuaaaccuaugugacaaaccgcccauuauuuuauuguuuauuuaauuaua

SEQ ID NO: 99430 - RNA, 64 nt, hsa
agucagcgagagcuagcccugguaagcaaacauagcccauuacagguucagaacgugcaccggg

SEQ ID NO: 99431 - RNA, 64 nt, hsa
gcuuuuauccccucucagaaagacaucacuaaaggcccauuaaaaaucuggcccuaaaaguuca

SEQ ID NO: 99432 - RNA, 64 nt, hsa
cucgcugggggggaagggggggacacagcuacacgcccauuaaagcacagcacguccuggggga

SEQ ID NO: 99433 - RNA, 64 nt, hsa
auggguauaauuuccuggcugccucccuuccucagcccauuagguuaaacaccaaagaaagacu

SEQ ID NO: 99434 - RNA, 64 nt, hsa
uuugguucagugauucucaagaaaaagaucucuugcccauuaagaaguguaucaaaaucucaua

SEQ ID NO: 99435 - RNA, 64 nt, hsa
gacaggcagucauccugccucugaugugaaucaggcccauuaaagacgucuggguuugaagccg

SEQ ID NO: 99436 - RNA, 64 nt, hsa
gguuugcacuucuuggaaaaagugccuaaagugugcccauuaauaugaggauagauuuaggcuc

SEQ ID NO: 99437 - RNA, 64 nt, hsa
ugcuguuuuguggagaaacuugcauucaugaagagcccauuaucaacuuuuaaaagugaauuug

SEQ ID NO: 99438 - RNA, 64 nt, hsa
gaacaagcaguaccgucaguacccacuugcuuuagcccauuaugggaaucucugaugccuuugu

SEQ ID NO: 99439 - RNA, 64 nt, hsa
ucuacaggucaagaaauagcgcaguguccuggaugcccauuauauuguuuucuccuuucugggu

SEQ ID NO: 99440 - RNA, 64 nt, hsa
aggacagaugcagcaagauauuaggacagauuucgcccauuauucaggcugcacaacacagaag

SEQ ID NO: 99441 - RNA, 64 nt, hsa
uuggaaaauaaauucagaucaaaaugccuuucaggcccauuaccuagaaaucuaucuuaaaacc

SEQ ID NO: 99442 - RNA, 64 nt, hsa
cuauuaaagaagacuguggaaucuguuuaucggugcccauuauauccuuaaguuuggauauuua

SEQ ID NO: 99443 - RNA, 64 nt, hsa
ugugaggcagaagaguuuucugugaaggaaaaaagcccauuagaguucuucaauucaaugcacg

SEQ ID NO: 99444 - RNA, 64 nt, hsa
gcagaccaggcucugugugggcuagaggaaugucgcccauuacuccucaggccuggcccucggg

SEQ ID NO: 99445 - RNA, 64 nt, hsa
ugcaaaccugagugagcacaggauuugcuucuaggcccauuauuuuuauuaaaacugaaaaaau

SEQ ID NO: 99446 - RNA, 64 nt, hsa
uguauauuucuauauuguuuaacuuuguaagaaugcccauuacuuuuuuaacuaguaaaagcaa

SEQ ID NO: 99447 - RNA, 64 nt, hsa
ccuugaaauauaaaugaaaggaagggaagcauaugcccauuaaugauuuuguuucaggagaggu

SEQ ID NO: 99448 - RNA, 64 nt, hsa
agccaggcuccucaugugaccucgcaguugagaagcccauuaucguggggcauccuuuugccua

SEQ ID NO: 99449 - RNA, 64 nt, hsa
augaggaguccucucuuuaauugcuaaccauccugcccauuauagcuacacucaggaguucuca

SEQ ID NO: 99450 - RNA, 64 nt, hsa
uauuguaccuaaguaaauuuucuuuaagucagaagcccauuaaaauaguuacaagcauugaacu

SEQ ID NO: 99451 - RNA, 64 nt, hsa
agaagcaaauauugucugcccuguuaaacuuggugcccauuaacaguguuuacacuguucaucg

SEQ ID NO: 99452 - RNA, 64 nt, hsa
aguaucuaugcaaaucuugaaagacgaaaucaaagcccauuaaugauucagaaucagugcuuga

SEQ ID NO: 99453 - RNA, 64 nt, hsa
uuauuugugucauagaguaagauauuccuugaaagcccauuaaguggaauagacuuucugaaaa

SEQ ID NO: 99454 - RNA, 64 nt, hsa
gaaaaugcuucauuacuuuaaauagcagcauuaagcccauuauagccucugaauugucccuucc

SEQ ID NO: 99455 - RNA, 64 nt, hsa
uguaaagcaaacuuaauuguaauuaauuuauucagcccauuaagaaaguacuaaaguuuuaucu

SEQ ID NO: 99456 - RNA, 64 nt, hsa
cacuaaaggggugaccuuguuccuugcuuuaugagcccauuagcacuuugguucaaggggccca

SEQ ID NO: 99457 - RNA, 64 nt, hsa
cuacaguuuccaggugaggcccuuucuccaguuugcccauuaacugggagagguacuuucgccu

SEQ ID NO: 99458 - RNA, 64 nt, hsa
gcccugucugcugauucugagaaaucccagaacagcccauuaccaguggggcugcagcccuagg

SEQ ID NO: 99459 - RNA, 64 nt, hsa
ccaucggucagcagggccacugaguagucauuuugcccauuagcccacugccuggaaagcccuu

SEQ ID NO: 99460 - RNA, 64 nt, hsa
ggaauggaugggggacagugaggaggacacaccagcccauuaguuguuaaucaucaaucacauc

SEQ ID NO: 99461 - RNA, 64 nt, hsa; identical to SEQ ID NO: 99459

SEQ ID NO: 99462 - RNA, 64 nt, hsa
cugguaugcuuguuccugcugcuaauaaaguaaggcccauuacuguaucgggaauuucuagugu

SEQ ID NO: 99463 - RNA, 64 nt, hsa
cgucucccugugaugggcccuuaggccuggcugggcccauuacauaucccugugguggcucugg

SEQ ID NO: 99464 - RNA, 64 nt, hsa
gaaaaaccuagaucaguggaucuccucucuggcugcccauuagaauguccuguggagauuaaac

SEQ ID NO: 99465 - RNA, 64 nt, hsa
gaguggucugcucugcucgggcaaaacaagagaugcccauuacugugagggacccuugaagucu

SEQ ID NO: 99466 - RNA, 64 nt, hsa
aaaugccuuaggauggaguuugcaagguuuccuugcccauuaucagaaggaaaaagagcagaau

SEQ ID NO: 99467 - RNA, 64 nt, hsa
ccuccccucagagacaggccucaguucgagggcagcccauuaucugucgcagacaucugccaug

SEQ ID NO: 99468 - RNA, 64 nt, hsa
ucacccuguggcaaaugccaggacagcugcaggugcccauuagcaacgccugccuucugggcaa

SEQ ID NO: 99469 - RNA, 64 nt, hsa
uuguauggauauagcauaguauguuuauccauucgcccauuaaaggaaaucuugauugcuucca

SEQ ID NO: 99470 - RNA, 64 nt, hsa
ugaaggaagagauguucccucuaauuucucucuagcccauuauaaccugcuaucuuggggcaac

SEQ ID NO: 99471 - RNA, 64 nt, hsa
ggggggcaaagccccaacugcaaacaaagugaaugcccauuaauagggaacugguuagauaaau

SEQ ID NO: 99472 - RNA, 64 nt, hsa
gcaaaaguucugagaggagcugagcccuguuguggcccauuaaagaacaggguccucaggcccu

SEQ ID NO: 99473 - RNA, 64 nt, hsa
agacccagccagagaagcagggauuccagaagcugcccauuaagggagaaggagaggauccggu

SEQ ID NO: 99474 - RNA, 64 nt, hsa
agauaaucaacacucaggaccuucagccuugaacgcccauuagugcuauguuauagaaccuaca

SEQ ID NO: 99475 - RNA, 64 nt, hsa
uuggcccccagccccucgucgcggguucagguccgcccauuacuccuugucgugcggucaagga

SEQ ID NO: 99476 - RNA, 64 nt, hsa
agaauuaugcauaaauuuccucuuacaguucgaugcccauuaguuuuauauaacauuuauuuga

SEQ ID NO: 99477 - RNA, 64 nt, hsa
uguucaauuuacuuuuacaaagaucaagaauacugcccauuacugucacaauuuuccagauauu

SEQ ID NO: 99478 - RNA, 64 nt, hsa
agccuccuaugguuugggaaggaauaacacacuggcccauuaguaagggugaaggcuggaggga

SEQ ID NO: 99479 - RNA, 64 nt, hsa
acccagcagccaccuugaaaaaggccauuguggagcccauuauacuuugauuuaaaauaggcca

SEQ ID NO: 99480 - RNA, 64 nt, hsa
gcccuggaggggcucugggacgacuuugucucuagcccauuaauacaauacauccuaugcuuuc

SEQ ID NO: 99481 - RNA, 64 nt, hsa
auuaauguuauuauuugauuguuauaccauaugugcccauuaaaauucuuuuuaauuaaaaaua

SEQ ID NO: 99482 - RNA, 64 nt, hsa
gggucucgauuugaggacauucauuucuucagcagcccauuagcaacugagagcccagggaugu

SEQ ID NO: 99483 - RNA, 64 nt, hsa
cgccugacauucacacagagaggcagagucccgugcccauuaggucuggcaugcccccuccugc

SEQ ID NO: 99484 - RNA, 64 nt, hsa
cuggggaaaccauggcaaaguggauccaguuagagcccauuaaucuugaucauuccgguuuuuu

SEQ ID NO: 99485 - RNA, 64 nt, hsa
agaacguuccuugccaggccaggcaaaagccaaggcccauuagccaguuuagcauuuacuuuaa

SEQ ID NO: 99486 - RNA, 64 nt, hsa
acagccuuguugccgcuggccagaccaccagguggcccauuacucgagaugaucaucacaacca

SEQ ID NO: 99487 - RNA, 64 nt, hsa
uucuuauuucaguuagauggggaacauuuugcuagcccauuagaagcacacagaauuauccuug

SEQ ID NO: 99488 - RNA, 64 nt, hsa
guauuuugucagacuuagagguuucauuucagggcauagucaaaggcaucauccucccaacuac

SEQ ID NO: 99489 - RNA, 64 nt, hsa
acuuccuauguuaauuuccaccaagcuauaaguccauagucaguaaaacauuccccuugggcug

SEQ ID NO: 99490 - RNA, 64 nt, hsa
auguuuauagaugcugcugcucuuuucccugaagcauagucaaguaagaacugcucuacagaag

SEQ ID NO: 99491 - RNA, 64 nt, hsa
uaugagaggcuuauagugcccuccauuguaaauccauagucaucuuuuuaagcuuauuguguuu

SEQ ID NO: 99492 - RNA, 64 nt, hsa
uauagcaaguagucaggaccccagcucacuuuuucauagucauugugguuuagauccaauuccc

SEQ ID NO: 99493 - RNA, 64 nt, hsa
uacaaggguuaaccauuuuuuuuaaguuugacuacauagucaaguccacaagccaucaagcacu

SEQ ID NO: 99494 - RNA, 64 nt, hsa
gagaagaaaaauccucuagacacaugaaggcccacauagucaagucuuccagggcaaagccagc

SEQ ID NO: 99495 - RNA, 64 nt, hsa
cuuuaccuuccaauggauaaaauaguucagaguucauagucauauucauagacacagaaucaag

SEQ ID NO: 99496 - RNA, 64 nt, hsa
uggcaaggucuuuaagaaguccucaacucuuacugcacauaagaucauucauacuggagagaaa

SEQ ID NO: 99497 - RNA, 64 nt, hsa
ugguaaauucuuuaacaagucuucaacccuuucugcacauaauauaauucauacuggagagaaa

SEQ ID NO: 99498 - RNA, 64 nt, hsa
acugaaugcacugaacucagaguugggaagagaugcacauaaucgcucucccggcacaccucau

SEQ ID NO: 99499 - RNA, 64 nt, hsa
cuccuugggagcugggcucuucugcccuggcucugcacauaaguguuagccagcagcuccagaa

SEQ ID NO: 99500 - RNA, 64 nt, hsa
agauauauuuuuauuauacaaaguuuguacaguaccaaaaaagaaaaaaaaaaagguguaaauu

SEQ ID NO: 99501 - RNA, 64 nt, hsa
uugagagaacaggggagcaagccugccccaguacccaaaaaacaauggcuaucauguacugggg

SEQ ID NO: 99502 - RNA, 64 nt, hsa
auggaacugauggauuccucucccacugccucacccaaaaaaaacggucuuggcggccuagggg

SEQ ID NO: 99503 - RNA, 64 nt, hsa
caagccauucaguuucuuguuuguaccuaaaacaccaaaaaagaaacacucaaauccagcugcu

SEQ ID NO: 99504 - RNA, 64 nt, hsa
uuagauucaacauuaaugguagaguggcauuuuaccaaaaaaauggguguauuugauuugggug

SEQ ID NO: 99505 - RNA, 64 nt, hsa
agugaaaacccaucucaaaaaaaaaaaaaaaaaaccaaaaaaacuguccagcuguggacuuuca

SEQ ID NO: 99506 - RNA, 64 nt, hsa
guuaacccauccuuucauuuacucauauaauuagccaaaaaaaaaaggauggcuacauaccaau

SEQ ID NO: 99507 - RNA, 64 nt, hsa
caauuaacuuuugaugcuuucuguuccccuaaaaccaaaaaaugaaccccuugugucguuguua

SEQ ID NO: 99508 - RNA, 64 nt, hsa
aaaccuuugguagaagcuccugucuuaucaggccccaaaaaaccuguucugcagugagagauuu

SEQ ID NO: 99509 - RNA, 64 nt, hsa
agcauucguuggagagccuuacuuggguuugcacccaaaaaaaaaaacccaaucugaggaaaga

SEQ ID NO: 99510 - RNA, 64 nt, hsa
cuugugugaaauucccucuucaccuccccaccccccaaaaaauaaaagggggcauaaacuuuau

SEQ ID NO: 99511 - RNA, 64 nt, hsa
ucugccugccuguuucugucugggugucugaguuccaaaaaauguguguuguuuguuccuccuc

SEQ ID NO: 99512 - RNA, 64 nt, hsa
auacacuuccuguaaacaaauggggacaaugcauccaaaaaaucuuuuuaaacagauuacacaa

SEQ ID NO: 99513 - RNA, 64 nt, hsa
uuuuuucuuuucaccacccuguugagcaauuuucccaaaaaaagggcagcaauuauuaaauuga

SEQ ID NO: 99514 - RNA, 64 nt, hsa
uaaccuuauugggaauggauaauuuagaaacaaaccaaaaaaaaaaaaagauauuugaaguguu

SEQ ID NO: 99515 - RNA, 64 nt, hsa
aauuuccaagaacaacuugauaucauucagcuguccaaaaaauaauaagagcauucauuaaaua

SEQ ID NO: 99516 - RNA, 64 nt, hsa
uucuucaaccaaaaaagaaagaaauugcaaaggaccaaaaaaauguuggggaaucuauacauua

SEQ ID NO: 99517 - RNA, 64 nt, hsa
acaaaaaccugguuuucuuuuuugguuucuucaaccaaaaaagaaagaaauugcaaaggaccaa

SEQ ID NO: 99518 - RNA, 64 nt, hsa
ugaggaauuuuaaacacacauuugauuacagccaccaaaaaaauagacguaaaaauaaaggcau

SEQ ID NO: 99519 - RNA, 64 nt, hsa
acagucaucacaagcauaggaagauacuucaaaaccaaaaaaaccaaggugcaucauuaauauu

SEQ ID NO: 99520 - RNA, 64 nt, hsa; identical to SEQ ID NO: 99508

SEQ ID NO: 99521 - RNA, 64 nt, hsa
agcauucauuggagagccuuacuuggguuugcacccaaaaaaaaaaacccaaucugaggaaaga

SEQ ID NO: 99522 - RNA, 64 nt, hsa
aggacaugagggggaaaguccuuuuugcccuucuccaaaaaauaaccuuccacagagacaaacu

SEQ ID NO: 99523 - RNA, 64 nt, hsa
ugcauuuggauuuuguuguuugauggaauuugagccaaaaaaaaaauacgcaggcuuuccuauu

SEQ ID NO: 99524 - RNA, 64 nt, hsa
ggguaggguggaguggggagggauuaaaacccauccaaaaaauaaauaaaaacuauauaggugc

SEQ ID NO: 99525 - RNA, 64 nt, hsa
ccuauuugaacuagcuucuugucuuaggccugaaccaaaaaacaacaaacaaacaaaaaacaag

SEQ ID NO: 99526 - RNA, 64 nt, hsa
aaggaaaauauuuucacaaaggguuaucugauaaccaaaaaaaaaaaagacauuucaucuaagc

SEQ ID NO: 99527 - RNA, 64 nt, hsa
acuccagccugggcaacagagcaagacuccgucuccaaaaaaaaaaaaaaaaaaaaagaauucc

SEQ ID NO: 99528 - RNA, 64 nt, hsa
cauuguacuggaagugcuaucuaaugcagugauaccaaaaaaaaaggaaauaaaaugcacauaa

SEQ ID NO: 99529 - RNA, 64 nt, hsa
uccaucucaauaaaauuaauaauaauaaaaccuuccaaaaaaagugccgggaccaaauggauuc

SEQ ID NO: 99530 - RNA, 64 nt, hsa
ugggagagggaauuuaaaaggugucaacuuuugaccaaaaaaauugugcccuuguaccgaugca

SEQ ID NO: 99531 - RNA, 64 nt, hsa
uuaacaacuguagcaagaacugcacgguacaaacccaaaaaagaacaagcucaucuauuuggaa

SEQ ID NO: 99532 - RNA, 64 nt, hsa
agcuguauuguucuuuaauggcugucuugcccuuccaaaaaaaauugaaaaaaaaaaaaaaaaa

SEQ ID NO: 99533 - RNA, 64 nt, hsa
gcagggcgcggauuuaaaguccaauuucucaugaccaaaaaaugugugguuuuuucccaugugu

SEQ ID NO: 99534 - RNA, 64 nt, hsa
uauauuaguuuugaauauaaacaucuuuuucagaccaaaaaaaacuuuauuguaugagagcuua

SEQ ID NO: 99535 - RNA, 64 nt, hsa
uuuauucuguguacuaguacauaucuuuaaauuaccaaaaaacaagaaacaaaacauaaaaacc

SEQ ID NO: 99536 - RNA, 64 nt, hsa
caaaguucuuucaaaaaaaaaaacugaaacacaaccaaaaaagcaagagcgagagagaguacgu

SEQ ID NO: 99537 - RNA, 64 nt, hsa
acacguuaucccaugauguuccacugagaaaacaccaaaaaauuuugaaaaagaagauaaaaag

SEQ ID NO: 99538 - RNA, 64 nt, hsa
accaugccacugcacuccagccugggugacacagccaaaaaaaaaaccacuaaguuagaucucu

SEQ ID NO: 99539 - RNA, 64 nt, hsa
auauaauaagggaaaagauaagcagauuucgcaaccaaaaaauaucgaaagucucugugugaug

SEQ ID NO: 99540 - RNA, 64 nt, hsa
cuuagcuuuuauuuuaauaguacauaauuuaauaccaaaaaaggcgccuggauccccaaaaaac

SEQ ID NO: 99541 - RNA, 64 nt, hsa
acauaauuuaauaccaaaaaaggcgccuggauccccaaaaaaccgaggcugggagcuaguggcc

SEQ ID NO: 99542 - RNA, 64 nt, hsa
acaugaccaaaaaccaaaagugcauucaaccuuaccaaaaaaaaaaaaaaaaaaagaauaaaua

SEQ ID NO: 99543 - RNA, 64 nt, hsa
cagacaagcaacccaaacugaacccccucaaaagccaaaaaaugggagacaauuucacauggac

SEQ ID NO: 99544 - RNA, 64 nt, hsa
aucuuccuguuaccaaagcugggcagagacaaaaccaaaaaagagaauuuuagaccaauauccu

SEQ ID NO: 99545 - RNA, 64 nt, hsa
aauugaaaaacacuacuuuaaaguucauauggaaccaaaaaagagcccacauugccaagucaau

SEQ ID NO: 99546 - RNA, 64 nt, hsa
ugucuggccucacgugucucagauuuucuaagaaccaaaaaaaaaaaaggaaaaaaaacacaaa

SEQ ID NO: 99547 - RNA, 64 nt, hsa
aaaaaaaaggaaaaaaaacacaaaacaacaaaaaccaaaaaaaaaaaaaaucacaaaaacaaaa

SEQ ID NO: 99548 - RNA, 64 nt, hsa
ggugaaaaacaaacaaaaaaaaaccaaaaacaaaccaaaaaaaaaaaaaacccacaaaaucaaa

SEQ ID NO: 99549 - RNA, 64 nt, hsa
gugacaagggaggaaagaccaaaaaaacaaccaaccaaaaaaaaaaaaaaaaaggaaagaaacu

SEQ ID NO: 99550 - RNA, 64 nt, hsa
gguccucagagcaggagugacaagggaggaaagaccaaaaaaacaaccaaccaaaaaaaaaaaa

SEQ ID NO: 99551 - RNA, 64 nt, hsa
acuccagccugggcaacauagcgagaccucaucuccaaaaaagaaaacaaaaaacaaaaaaagg

SEQ ID NO: 99552 - RNA, 64 nt, hsa
gaaaagaaaaauuuaugcacugauuuaaaacaaaccaaaaaaaaagaaaaaaacaaaaaaaaaa

SEQ ID NO: 99553 - RNA, 64 nt, hsa
cagacuguggaaggaucugcaguuuuguuuuugaccaaaaaaauaauaauaaguuagcucugaa

SEQ ID NO: 99554 - RNA, 64 nt, hsa
agcacccaagaccacagaaaagagaaaggaaaggccaaaaaaaagaggaaaagaaaaauguaca

SEQ ID NO: 99555 - RNA, 64 nt, hsa
gaacugcugcuaaagugauuuuuuuuuuauuugaccaaaaaaaaaaaggcccaagaagaagaaa

SEQ ID NO: 99556 - RNA, 64 nt, hsa
uuuaaaauaaugcuauuacacaaagcugcauuuaccaaaaaauacaguaaaaucauaauacaga

SEQ ID NO: 99557 - RNA, 64 nt, hsa
cccuccagccugggugacagagugagacccuguuccaaaaaaaaaaaaaaacccaaaaaaccuc

SEQ ID NO: 99558 - RNA, 64 nt, hsa
agagugagacccuguuccaaaaaaaaaaaaaaacccaaaaaaccucaauggcuuuuugcuuuug

SEQ ID NO: 99559 - RNA, 64 nt, hsa; identical to SEQ ID NO: 22114

SEQ ID NO: 99560 - RNA, 64 nt, hsa; identical to SEQ ID NO: 22115

SEQ ID NO: 99561 - RNA, 64 nt, hsa; identical to SEQ ID NO: 22116

SEQ ID NO: 99562 - RNA, 64 nt, hsa; identical to SEQ ID NO: 22117

SEQ ID NO: 99563 - RNA, 64 nt, hsa; identical to SEQ ID NO: 22118

SEQ ID NO: 99564 - RNA, 64 nt, hsa; identical to SEQ ID NO: 22119

SEQ ID NO: 99565 - RNA, 64 nt, hsa; identical to SEQ ID NO: 22120

SEQ ID NO: 99566 - RNA, 64 nt, hsa; identical to SEQ ID NO: 22121

SEQ ID NO: 99567 - RNA, 64 nt, hsa; identical to SEQ ID NO: 22122

SEQ ID NO: 99568 - RNA, 64 nt, hsa; identical to SEQ ID NO: 22123

SEQ ID NO: 99569 - RNA, 64 nt, hsa; identical to SEQ ID NO: 22124

SEQ ID NO: 99570 - RNA, 64 nt, hsa; identical to SEQ ID NO: 22125

SEQ ID NO: 99571 - RNA, 64 nt, hsa; identical to SEQ ID NO: 22126

SEQ ID NO: 99572 - RNA, 64 nt, hsa; identical to SEQ ID NO: 22127

SEQ ID NO: 99573 - RNA, 64 nt, hsa; identical to SEQ ID NO: 22128

SEQ ID NO: 99574 - RNA, 64 nt, hsa; identical to SEQ ID NO: 22129

SEQ ID NO: 99575 - RNA, 64 nt, hsa; identical to SEQ ID NO: 22130

SEQ ID NO: 99576 - RNA, 64 nt, hsa; identical to SEQ ID NO: 22131

SEQ ID NO: 99577 - RNA, 64 nt, hsa; identical to SEQ ID NO: 22132

SEQ ID NO: 99578 - RNA, 64 nt, hsa; identical to SEQ ID NO: 22133

SEQ ID NO: 99579 - RNA, 64 nt, hsa; identical to SEQ ID NO: 22134

SEQ ID NO: 99580 - RNA, 64 nt, hsa; identical to SEQ ID NO: 22135

SEQ ID NO: 99581 - RNA, 64 nt, hsa; identical to SEQ ID NO: 22136

SEQ ID NO: 99582 - RNA, 64 nt, hsa; identical to SEQ ID NO: 22137

SEQ ID NO: 99583 - RNA, 64 nt, hsa; identical to SEQ ID NO: 22138

SEQ ID NO: 99584 - RNA, 64 nt, hsa; identical to SEQ ID NO: 22139

SEQ ID NO: 99585 - RNA, 64 nt, hsa; identical to SEQ ID NO: 22140

SEQ ID NO: 99586 - RNA, 64 nt, hsa; identical to SEQ ID NO: 22141

SEQ ID NO: 99587 - RNA, 64 nt, hsa; identical to SEQ ID NO: 22142

SEQ ID NO: 99588 - RNA, 64 nt, hsa; identical to SEQ ID NO: 22143

SEQ ID NO: 99589 - RNA, 64 nt, hsa; identical to SEQ ID NO: 22144

SEQ ID NO: 99590 - RNA, 64 nt, hsa; identical to SEQ ID NO: 22145

SEQ ID NO: 99591 - RNA, 64 nt, hsa; identical to SEQ ID NO: 22146

SEQ ID NO: 99592 - RNA, 64 nt, hsa; identical to SEQ ID NO: 22147

SEQ ID NO: 99593 - RNA, 64 nt, hsa; identical to SEQ ID NO: 22148

SEQ ID NO: 99594 - RNA, 64 nt, hsa; identical to SEQ ID NO: 22149

SEQ ID NO: 99595 - RNA, 64 nt, hsa; identical to SEQ ID NO: 22150

SEQ ID NO: 99596 - RNA, 64 nt, hsa; identical to SEQ ID NO: 22151

SEQ ID NO: 99597 - RNA, 64 nt, hsa; identical to SEQ ID NO: 22152

SEQ ID NO: 99598 - RNA, 64 nt, hsa; identical to SEQ ID NO: 22153

SEQ ID NO: 99599 - RNA, 64 nt, hsa; identical to SEQ ID NO: 22154

SEQ ID NO: 99600 - RNA, 64 nt, hsa; identical to SEQ ID NO: 22155

SEQ ID NO: 99601 - RNA, 64 nt, hsa; identical to SEQ ID NO: 22156

SEQ ID NO: 99602 - RNA, 64 nt, hsa; identical to SEQ ID NO: 22157

SEQ ID NO: 99603 - RNA, 64 nt, hsa; identical to SEQ ID NO: 22158

SEQ ID NO: 99604 - RNA, 64 nt, hsa; identical to SEQ ID NO: 22159

SEQ ID NO: 99605 - RNA, 64 nt, hsa; identical to SEQ ID NO: 22160

SEQ ID NO: 99606 - RNA, 64 nt, hsa; identical to SEQ ID NO: 22161

SEQ ID NO: 99607 - RNA, 64 nt, hsa; identical to SEQ ID NO: 22162

SEQ ID NO: 99608 - RNA, 64 nt, hsa; identical to SEQ ID NO: 22163

SEQ ID NO: 99609 - RNA, 64 nt, hsa; identical to SEQ ID NO: 22164

SEQ ID NO: 99610 - RNA, 64 nt, hsa; identical to SEQ ID NO: 22165

SEQ ID NO: 99611 - RNA, 64 nt, hsa; identical to SEQ ID NO: 22166

SEQ ID NO: 99612 - RNA, 64 nt, hsa; identical to SEQ ID NO: 22167

SEQ ID NO: 99613 - RNA, 64 nt, hsa; identical to SEQ ID NO: 22168

SEQ ID NO: 99614 - RNA, 64 nt, hsa; identical to SEQ ID NO: 22169

SEQ ID NO: 99615 - RNA, 64 nt, hsa; identical to SEQ ID NO: 22170

SEQ ID NO: 99616 - RNA, 64 nt, hsa; identical to SEQ ID NO: 22171

SEQ ID NO: 99617 - RNA, 64 nt, hsa; identical to SEQ ID NO: 22172

SEQ ID NO: 99618 - RNA, 64 nt, hsa; identical to SEQ ID NO: 22173

SEQ ID NO: 99619 - RNA, 64 nt, hsa; identical to SEQ ID NO: 22174

SEQ ID NO: 99620 - RNA, 64 nt, hsa; identical to SEQ ID NO: 22175

SEQ ID NO: 99621 - RNA, 64 nt, hsa; identical to SEQ ID NO: 22176

SEQ ID NO: 99622 - RNA, 64 nt, hsa; identical to SEQ ID NO: 22177

SEQ ID NO: 99623 - RNA, 64 nt, hsa; identical to SEQ ID NO: 22178

SEQ ID NO: 99624 - RNA, 64 nt, hsa; identical to SEQ ID NO: 22179

SEQ ID NO: 99625 - RNA, 64 nt, hsa; identical to SEQ ID NO: 22180

SEQ ID NO: 99626 - RNA, 64 nt, hsa; identical to SEQ ID NO: 22181

SEQ ID NO: 99627 - RNA, 64 nt, hsa; identical to SEQ ID NO: 22182

SEQ ID NO: 99628 - RNA, 64 nt, hsa; identical to SEQ ID NO: 22183

SEQ ID NO: 99629 - RNA, 64 nt, hsa; identical to SEQ ID NO: 22133

SEQ ID NO: 99630 - RNA, 64 nt, hsa; identical to SEQ ID NO: 22134

SEQ ID NO: 99631 - RNA, 64 nt, hsa; identical to SEQ ID NO: 22134

SEQ ID NO: 99632 - RNA, 64 nt, hsa; identical to SEQ ID NO: 22133

SEQ ID NO: 99633 - RNA, 64 nt, hsa; identical to SEQ ID NO: 22188

SEQ ID NO: 99634 - RNA, 64 nt, hsa; identical to SEQ ID NO: 22189

SEQ ID NO: 99635 - RNA, 64 nt, hsa; identical to SEQ ID NO: 22190

SEQ ID NO: 99636 - RNA, 64 nt, hsa; identical to SEQ ID NO: 22191

SEQ ID NO: 99637 - RNA, 64 nt, hsa; identical to SEQ ID NO: 22192

SEQ ID NO: 99638 - RNA, 64 nt, hsa; identical to SEQ ID NO: 22193

SEQ ID NO: 99639 - RNA, 64 nt, hsa; identical to SEQ ID NO: 22194

SEQ ID NO: 99640 - RNA, 64 nt, hsa; identical to SEQ ID NO: 22195

SEQ ID NO: 99641 - RNA, 64 nt, hsa; identical to SEQ ID NO: 22196

SEQ ID NO: 99642 - RNA, 64 nt, hsa; identical to SEQ ID NO: 22197

SEQ ID NO: 99643 - RNA, 64 nt, hsa; identical to SEQ ID NO: 22198

SEQ ID NO: 99644 - RNA, 64 nt, hsa; identical to SEQ ID NO: 22199

SEQ ID NO: 99645 - RNA, 64 nt, hsa; identical to SEQ ID NO: 22200

SEQ ID NO: 99646 - RNA, 64 nt, hsa; identical to SEQ ID NO: 22201

SEQ ID NO: 99647 - RNA, 64 nt, hsa; identical to SEQ ID NO: 22202

SEQ ID NO: 99648 - RNA, 64 nt, hsa; identical to SEQ ID NO: 22203

SEQ ID NO: 99649 - RNA, 64 nt, hsa; identical to SEQ ID NO: 22204

SEQ ID NO: 99650 - RNA, 64 nt, hsa; identical to SEQ ID NO: 22205

SEQ ID NO: 99651 - RNA, 64 nt, hsa; identical to SEQ ID NO: 22206

SEQ ID NO: 99652 - RNA, 64 nt, hsa; identical to SEQ ID NO: 22207

SEQ ID NO: 99653 - RNA, 64 nt, hsa; identical to SEQ ID NO: 22208

SEQ ID NO: 99654 - RNA, 64 nt, hsa; identical to SEQ ID NO: 22209

SEQ ID NO: 99655 - RNA, 64 nt, hsa; identical to SEQ ID NO: 22210

SEQ ID NO: 99656 - RNA, 64 nt, hsa; identical to SEQ ID NO: 22211

SEQ ID NO: 99657 - RNA, 64 nt, hsa; identical to SEQ ID NO: 22212

SEQ ID NO: 99658 - RNA, 64 nt, hsa; identical to SEQ ID NO: 22213

SEQ ID NO: 99659 - RNA, 64 nt, hsa; identical to SEQ ID NO: 22214

SEQ ID NO: 99660 - RNA, 64 nt, hsa; identical to SEQ ID NO: 22215

SEQ ID NO: 99661 - RNA, 64 nt, hsa; identical to SEQ ID NO: 22216

SEQ ID NO: 99662 - RNA, 64 nt, hsa; identical to SEQ ID NO: 22217

SEQ ID NO: 99663 - RNA, 64 nt, hsa; identical to SEQ ID NO: 22218

SEQ ID NO: 99664 - RNA, 64 nt, hsa; identical to SEQ ID NO: 22219

SEQ ID NO: 99665 - RNA, 64 nt, hsa; identical to SEQ ID NO: 22220

SEQ ID NO: 99666 - RNA, 64 nt, hsa; identical to SEQ ID NO: 22221

SEQ ID NO: 99667 - RNA, 64 nt, hsa; identical to SEQ ID NO: 22222

SEQ ID NO: 99668 - RNA, 64 nt, hsa; identical to SEQ ID NO: 22223

SEQ ID NO: 99669 - RNA, 64 nt, hsa; identical to SEQ ID NO: 22224

SEQ ID NO: 99670 - RNA, 64 nt, hsa; identical to SEQ ID NO: 22225

SEQ ID NO: 99671 - RNA, 64 nt, hsa; identical to SEQ ID NO: 22226

SEQ ID NO: 99672 - RNA, 64 nt, hsa; identical to SEQ ID NO: 22227

SEQ ID NO: 99673 - RNA, 64 nt, hsa; identical to SEQ ID NO: 22228

SEQ ID NO: 99674 - RNA, 64 nt, hsa; identical to SEQ ID NO: 22229

SEQ ID NO: 99675 - RNA, 64 nt, hsa; identical to SEQ ID NO: 22230

SEQ ID NO: 99676 - RNA, 64 nt, hsa; identical to SEQ ID NO: 22231

SEQ ID NO: 99677 - RNA, 64 nt, hsa; identical to SEQ ID NO: 22232

SEQ ID NO: 99678 - RNA, 64 nt, hsa; identical to SEQ ID NO: 22233

SEQ ID NO: 99679 - RNA, 64 nt, hsa; identical to SEQ ID NO: 22234

SEQ ID NO: 99680 - RNA, 64 nt, hsa; identical to SEQ ID NO: 22235

SEQ ID NO: 99681 - RNA, 64 nt, hsa; identical to SEQ ID NO: 22236

SEQ ID NO: 99682 - RNA, 64 nt, hsa; identical to SEQ ID NO: 22237

SEQ ID NO: 99683 - RNA, 64 nt, hsa; identical to SEQ ID NO: 22238

SEQ ID NO: 99684 - RNA, 64 nt, hsa; identical to SEQ ID NO: 22239

SEQ ID NO: 99685 - RNA, 64 nt, hsa; identical to SEQ ID NO: 22240

SEQ ID NO: 99686 - RNA, 64 nt, hsa; identical to SEQ ID NO: 22241

SEQ ID NO: 99687 - RNA, 64 nt, hsa; identical to SEQ ID NO: 22242

SEQ ID NO: 99688 - RNA, 64 nt, hsa; identical to SEQ ID NO: 22243

SEQ ID NO: 99689 - RNA, 64 nt, hsa; identical to SEQ ID NO: 22244

SEQ ID NO: 99690 - RNA, 64 nt, hsa; identical to SEQ ID NO: 22245

SEQ ID NO: 99691 - RNA, 64 nt, hsa; identical to SEQ ID NO: 22246

SEQ ID NO: 99692 - RNA, 64 nt, hsa; identical to SEQ ID NO: 22247

SEQ ID NO: 99693 - RNA, 64 nt, hsa; identical to SEQ ID NO: 22248

SEQ ID NO: 99694 - RNA, 64 nt, hsa; identical to SEQ ID NO: 22249

SEQ ID NO: 99695 - RNA, 64 nt, hsa; identical to SEQ ID NO: 22250

SEQ ID NO: 99696 - RNA, 64 nt, hsa; identical to SEQ ID NO: 22251

SEQ ID NO: 99697 - RNA, 64 nt, hsa; identical to SEQ ID NO: 22252

SEQ ID NO: 99698 - RNA, 64 nt, hsa; identical to SEQ ID NO: 22253

SEQ ID NO: 99699 - RNA, 64 nt, hsa; identical to SEQ ID NO: 22254

SEQ ID NO: 99700 - RNA, 64 nt, hsa; identical to SEQ ID NO: 22255

SEQ ID NO: 99701 - RNA, 64 nt, hsa; identical to SEQ ID NO: 45477

SEQ ID NO: 99702 - RNA, 64 nt, hsa; identical to SEQ ID NO: 45478

SEQ ID NO: 99703 - RNA, 64 nt, hsa; identical to SEQ ID NO: 45479

SEQ ID NO: 99704 - RNA, 64 nt, hsa; identical to SEQ ID NO: 45480

SEQ ID NO: 99705 - RNA, 64 nt, hsa; identical to SEQ ID NO: 45481

SEQ ID NO: 99706 - RNA, 64 nt, hsa; identical to SEQ ID NO: 45482

SEQ ID NO: 99707 - RNA, 64 nt, hsa; identical to SEQ ID NO: 45483

SEQ ID NO: 99708 - RNA, 64 nt, hsa; identical to SEQ ID NO: 45484

SEQ ID NO: 99709 - RNA, 64 nt, hsa; identical to SEQ ID NO: 45485

SEQ ID NO: 99710 - RNA, 64 nt, hsa; identical to SEQ ID NO: 45486

SEQ ID NO: 99711 - RNA, 64 nt, hsa; identical to SEQ ID NO: 45487

SEQ ID NO: 99712 - RNA, 56 nt, hsa; identical to SEQ ID NO: 45488

SEQ ID NO: 99713 - RNA, 64 nt, hsa; identical to SEQ ID NO: 45489

SEQ ID NO: 99714 - RNA, 64 nt, hsa; identical to SEQ ID NO: 45490

SEQ ID NO: 99715 - RNA, 64 nt, hsa; identical to SEQ ID NO: 45491

SEQ ID NO: 99716 - RNA, 64 nt, hsa; identical to SEQ ID NO: 45492

SEQ ID NO: 99717 - RNA, 64 nt, hsa; identical to SEQ ID NO: 45493

SEQ ID NO: 99718 - RNA, 64 nt, hsa; identical to SEQ ID NO: 45494

SEQ ID NO: 99719 - RNA, 64 nt, hsa; identical to SEQ ID NO: 45495

SEQ ID NO: 99720 - RNA, 64 nt, hsa; identical to SEQ ID NO: 45496

SEQ ID NO: 99721 - RNA, 64 nt, hsa; identical to SEQ ID NO: 45497

SEQ ID NO: 99722 - RNA, 64 nt, hsa; identical to SEQ ID NO: 45498

SEQ ID NO: 99723 - RNA, 64 nt, hsa; identical to SEQ ID NO: 45499

SEQ ID NO: 99724 - RNA, 64 nt, hsa; identical to SEQ ID NO: 45500

SEQ ID NO: 99725 - RNA, 64 nt, hsa; identical to SEQ ID NO: 45501

SEQ ID NO: 99726 - RNA, 64 nt, hsa; identical to SEQ ID NO: 45502

SEQ ID NO: 99727 - RNA, 64 nt, hsa; identical to SEQ ID NO: 45503

SEQ ID NO: 99728 - RNA, 64 nt, hsa; identical to SEQ ID NO: 45504

SEQ ID NO: 99729 - RNA, 64 nt, hsa; identical to SEQ ID NO: 45505

SEQ ID NO: 99730 - RNA, 64 nt, hsa; identical to SEQ ID NO: 45506

SEQ ID NO: 99731 - RNA, 64 nt, hsa; identical to SEQ ID NO: 45507

SEQ ID NO: 99732 - RNA, 64 nt, hsa; identical to SEQ ID NO: 45508

SEQ ID NO: 99733 - RNA, 64 nt, hsa; identical to SEQ ID NO: 45509

SEQ ID NO: 99734 - RNA, 64 nt, hsa; identical to SEQ ID NO: 45510

SEQ ID NO: 99735 - RNA, 64 nt, hsa; identical to SEQ ID NO: 45511

SEQ ID NO: 99736 - RNA, 64 nt, hsa; identical to SEQ ID NO: 45512

SEQ ID NO: 99737 - RNA, 64 nt, hsa; identical to SEQ ID NO: 45513

SEQ ID NO: 99738 - RNA, 64 nt, hsa; identical to SEQ ID NO: 45514

SEQ ID NO: 99739 - RNA, 64 nt, hsa; identical to SEQ ID NO: 45515

SEQ ID NO: 99740 - RNA, 64 nt, hsa; identical to SEQ ID NO: 45516

SEQ ID NO: 99741 - RNA, 64 nt, hsa; identical to SEQ ID NO: 45517

SEQ ID NO: 99742 - RNA, 64 nt, hsa; identical to SEQ ID NO: 45518

SEQ ID NO: 99743 - RNA, 64 nt, hsa; identical to SEQ ID NO: 45519

SEQ ID NO: 99744 - RNA, 64 nt, hsa; identical to SEQ ID NO: 45520

SEQ ID NO: 99745 - RNA, 64 nt, hsa; identical to SEQ ID NO: 45521

SEQ ID NO: 99746 - RNA, 64 nt, hsa; identical to SEQ ID NO: 45522

SEQ ID NO: 99747 - RNA, 64 nt, hsa; identical to SEQ ID NO: 45523

SEQ ID NO: 99748 - RNA, 64 nt, hsa; identical to SEQ ID NO: 45524

SEQ ID NO: 99749 - RNA, 64 nt, hsa; identical to SEQ ID NO: 45525

SEQ ID NO: 99750 - RNA, 64 nt, hsa; identical to SEQ ID NO: 45526

SEQ ID NO: 99751 - RNA, 64 nt, hsa; identical to SEQ ID NO: 45527

SEQ ID NO: 99752 - RNA, 64 nt, hsa; identical to SEQ ID NO: 45528

SEQ ID NO: 99753 - RNA, 64 nt, hsa; identical to SEQ ID NO: 45529

SEQ ID NO: 99754 - RNA, 64 nt, hsa; identical to SEQ ID NO: 45530

SEQ ID NO: 99755 - RNA, 64 nt, hsa; identical to SEQ ID NO: 45531

SEQ ID NO: 99756 - RNA, 64 nt, hsa; identical to SEQ ID NO: 45532

SEQ ID NO: 99757 - RNA, 64 nt, hsa; identical to SEQ ID NO: 45533

SEQ ID NO: 99758 - RNA, 64 nt, hsa; identical to SEQ ID NO: 45534

SEQ ID NO: 99759 - RNA, 64 nt, hsa; identical to SEQ ID NO: 45535

SEQ ID NO: 99760 - RNA, 64 nt, hsa; identical to SEQ ID NO: 45536

SEQ ID NO: 99761 - RNA, 64 nt, hsa; identical to SEQ ID NO: 45537

SEQ ID NO: 99762 - RNA, 64 nt, hsa; identical to SEQ ID NO: 45538

SEQ ID NO: 99763 - RNA, 64 nt, hsa; identical to SEQ ID NO: 45539

SEQ ID NO: 99764 - RNA, 64 nt, hsa; identical to SEQ ID NO: 45540

SEQ ID NO: 99765 - RNA, 64 nt, hsa; identical to SEQ ID NO: 45541

SEQ ID NO: 99766 - RNA, 64 nt, hsa; identical to SEQ ID NO: 45542

SEQ ID NO: 99767 - RNA, 64 nt, hsa; identical to SEQ ID NO: 45543

SEQ ID NO: 99768 - RNA, 64 nt, hsa; identical to SEQ ID NO: 45544

SEQ ID NO: 99769 - RNA, 64 nt, hsa; identical to SEQ ID NO: 45545

SEQ ID NO: 99770 - RNA, 64 nt, hsa; identical to SEQ ID NO: 45546

SEQ ID NO: 99771 - RNA, 64 nt, hsa; identical to SEQ ID NO: 45547

SEQ ID NO: 99772 - RNA, 64 nt, hsa; identical to SEQ ID NO: 45548

SEQ ID NO: 99773 - RNA, 64 nt, hsa; identical to SEQ ID NO: 45549

SEQ ID NO: 99774 - RNA, 64 nt, hsa; identical to SEQ ID NO: 45550

SEQ ID NO: 99775 - RNA, 64 nt, hsa; identical to SEQ ID NO: 45551

SEQ ID NO: 99776 - RNA, 64 nt, hsa; identical to SEQ ID NO: 45552

SEQ ID NO: 99777 - RNA, 64 nt, hsa; identical to SEQ ID NO: 45553

SEQ ID NO: 99778 - RNA, 64 nt, hsa; identical to SEQ ID NO: 45554

SEQ ID NO: 99779 - RNA, 64 nt, hsa; identical to SEQ ID NO: 45555

SEQ ID NO: 99780 - RNA, 64 nt, hsa; identical to SEQ ID NO: 45556

SEQ ID NO: 99781 - RNA, 64 nt, hsa; identical to SEQ ID NO: 45557

SEQ ID NO: 99782 - RNA, 64 nt, hsa; identical to SEQ ID NO: 45558

SEQ ID NO: 99783 - RNA, 64 nt, hsa; identical to SEQ ID NO: 45559

SEQ ID NO: 99784 - RNA, 64 nt, hsa; identical to SEQ ID NO: 45560

SEQ ID NO: 99785 - RNA, 64 nt, hsa; identical to SEQ ID NO: 45561

SEQ ID NO: 99786 - RNA, 64 nt, hsa; identical to SEQ ID NO: 45562

SEQ ID NO: 99787 - RNA, 64 nt, hsa; identical to SEQ ID NO: 45563

SEQ ID NO: 99788 - RNA, 64 nt, hsa; identical to SEQ ID NO: 45564

SEQ ID NO: 99789 - RNA, 64 nt, hsa; identical to SEQ ID NO: 45565

SEQ ID NO: 99790 - RNA, 64 nt, hsa; identical to SEQ ID NO: 45566

SEQ ID NO: 99791 - RNA, 64 nt, hsa; identical to SEQ ID NO: 45567

SEQ ID NO: 99792 - RNA, 64 nt, hsa; identical to SEQ ID NO: 45568

SEQ ID NO: 99793 - RNA, 64 nt, hsa; identical to SEQ ID NO: 45569

SEQ ID NO: 99794 - RNA, 64 nt, hsa; identical to SEQ ID NO: 45570

SEQ ID NO: 99795 - RNA, 64 nt, hsa; identical to SEQ ID NO: 45571

SEQ ID NO: 99796 - RNA, 64 nt, hsa; identical to SEQ ID NO: 45572

SEQ ID NO: 99797 - RNA, 64 nt, hsa; identical to SEQ ID NO: 45573

SEQ ID NO: 99798 - RNA, 64 nt, hsa; identical to SEQ ID NO: 45574

SEQ ID NO: 99799 - RNA, 64 nt, hsa; identical to SEQ ID NO: 45575

SEQ ID NO: 99800 - RNA, 64 nt, hsa; identical to SEQ ID NO: 45576

SEQ ID NO: 99801 - RNA, 64 nt, hsa; identical to SEQ ID NO: 45577

SEQ ID NO: 99802 - RNA, 64 nt, hsa; identical to SEQ ID NO: 45578

SEQ ID NO: 99803 - RNA, 64 nt, hsa; identical to SEQ ID NO: 45579

SEQ ID NO: 99804 - RNA, 64 nt, hsa; identical to SEQ ID NO: 45580

SEQ ID NO: 99805 - RNA, 64 nt, hsa; identical to SEQ ID NO: 45581

SEQ ID NO: 99806 - RNA, 64 nt, hsa; identical to SEQ ID NO: 45582

SEQ ID NO: 99807 - RNA, 64 nt, hsa; identical to SEQ ID NO: 45583

SEQ ID NO: 99808 - RNA, 64 nt, hsa; identical to SEQ ID NO: 45584

SEQ ID NO: 99809 - RNA, 64 nt, hsa; identical to SEQ ID NO: 45585

SEQ ID NO: 99810 - RNA, 64 nt, hsa; identical to SEQ ID NO: 45586

SEQ ID NO: 99811 - RNA, 64 nt, hsa; identical to SEQ ID NO: 45587

SEQ ID NO: 99812 - RNA, 64 nt, hsa; identical to SEQ ID NO: 45588

SEQ ID NO: 99813 - RNA, 64 nt, hsa; identical to SEQ ID NO: 45589

SEQ ID NO: 99814 - RNA, 64 nt, hsa; identical to SEQ ID NO: 45590

SEQ ID NO: 99815 - RNA, 64 nt, hsa; identical to SEQ ID NO: 45591

SEQ ID NO: 99816 - RNA, 64 nt, hsa; identical to SEQ ID NO: 45592

SEQ ID NO: 99817 - RNA, 64 nt, hsa; identical to SEQ ID NO: 45593

SEQ ID NO: 99818 - RNA, 64 nt, hsa; identical to SEQ ID NO: 45594

SEQ ID NO: 99819 - RNA, 64 nt, hsa; identical to SEQ ID NO: 45595

SEQ ID NO: 99820 - RNA, 64 nt, hsa; identical to SEQ ID NO: 45596

SEQ ID NO: 99821 - RNA, 64 nt, hsa; identical to SEQ ID NO: 45597

SEQ ID NO: 99822 - RNA, 64 nt, hsa; identical to SEQ ID NO: 45598

SEQ ID NO: 99823 - RNA, 64 nt, hsa; identical to SEQ ID NO: 45599

SEQ ID NO: 99824 - RNA, 64 nt, hsa; identical to SEQ ID NO: 45600

SEQ ID NO: 99825 - RNA, 64 nt, hsa; identical to SEQ ID NO: 45601

SEQ ID NO: 99826 - RNA, 64 nt, hsa; identical to SEQ ID NO: 45602

SEQ ID NO: 99827 - RNA, 64 nt, hsa; identical to SEQ ID NO: 45603

SEQ ID NO: 99828 - RNA, 64 nt, hsa; identical to SEQ ID NO: 45604

SEQ ID NO: 99829 - RNA, 64 nt, hsa; identical to SEQ ID NO: 45605

SEQ ID NO: 99830 - RNA, 64 nt, hsa; identical to SEQ ID NO: 45606

SEQ ID NO: 99831 - RNA, 64 nt, hsa; identical to SEQ ID NO: 45607

SEQ ID NO: 99832 - RNA, 64 nt, hsa; identical to SEQ ID NO: 45608

SEQ ID NO: 99833 - RNA, 64 nt, hsa; identical to SEQ ID NO: 45609

SEQ ID NO: 99834 - RNA, 64 nt, hsa; identical to SEQ ID NO: 45610

SEQ ID NO: 99835 - RNA, 64 nt, hsa; identical to SEQ ID NO: 45611

SEQ ID NO: 99836 - RNA, 64 nt, hsa; identical to SEQ ID NO: 45612

SEQ ID NO: 99837 - RNA, 64 nt, hsa; identical to SEQ ID NO: 45613

SEQ ID NO: 99838 - RNA, 64 nt, hsa; identical to SEQ ID NO: 45614

SEQ ID NO: 99839 - RNA, 64 nt, hsa; identical to SEQ ID NO: 45615

SEQ ID NO: 99840 - RNA, 64 nt, hsa; identical to SEQ ID NO: 45616

SEQ ID NO: 99841 - RNA, 64 nt, hsa; identical to SEQ ID NO: 45617

SEQ ID NO: 99842 - RNA, 64 nt, hsa; identical to SEQ ID NO: 45618

SEQ ID NO: 99843 - RNA, 64 nt, hsa; identical to SEQ ID NO: 45619

SEQ ID NO: 99844 - RNA, 64 nt, hsa; identical to SEQ ID NO: 45620

SEQ ID NO: 99845 - RNA, 64 nt, hsa; identical to SEQ ID NO: 45621

SEQ ID NO: 99846 - RNA, 64 nt, hsa; identical to SEQ ID NO: 45622

SEQ ID NO: 99847 - RNA, 64 nt, hsa; identical to SEQ ID NO: 45623

SEQ ID NO: 99848 - RNA, 64 nt, hsa; identical to SEQ ID NO: 45624

SEQ ID NO: 99849 - RNA, 64 nt, hsa; identical to SEQ ID NO: 45625

SEQ ID NO: 99850 - RNA, 64 nt, hsa; identical to SEQ ID NO: 45626

SEQ ID NO: 99851 - RNA, 64 nt, hsa; identical to SEQ ID NO: 45627

SEQ ID NO: 99852 - RNA, 64 nt, hsa; identical to SEQ ID NO: 45628

SEQ ID NO: 99853 - RNA, 64 nt, hsa; identical to SEQ ID NO: 45629

SEQ ID NO: 99854 - RNA, 64 nt, hsa; identical to SEQ ID NO: 45630

SEQ ID NO: 99855 - RNA, 64 nt, hsa; identical to SEQ ID NO: 45631

SEQ ID NO: 99856 - RNA, 64 nt, hsa; identical to SEQ ID NO: 45632

SEQ ID NO: 99857 - RNA, 64 nt, hsa; identical to SEQ ID NO: 45633

SEQ ID NO: 99858 - RNA, 64 nt, hsa; identical to SEQ ID NO: 45634

SEQ ID NO: 99859 - RNA, 64 nt, hsa; identical to SEQ ID NO: 45635

SEQ ID NO: 99860 - RNA, 64 nt, hsa; identical to SEQ ID NO: 45636

SEQ ID NO: 99861 - RNA, 64 nt, hsa; identical to SEQ ID NO: 45637

SEQ ID NO: 99862 - RNA, 64 nt, hsa; identical to SEQ ID NO: 45638

SEQ ID NO: 99863 - RNA, 64 nt, hsa; identical to SEQ ID NO: 45639

SEQ ID NO: 99864 - RNA, 64 nt, hsa; identical to SEQ ID NO: 45640

SEQ ID NO: 99865 - RNA, 64 nt, hsa; identical to SEQ ID NO: 45641

SEQ ID NO: 99866 - RNA, 64 nt, hsa; identical to SEQ ID NO: 45642

SEQ ID NO: 99867 - RNA, 64 nt, hsa; identical to SEQ ID NO: 45643

SEQ ID NO: 99868 - RNA, 64 nt, hsa; identical to SEQ ID NO: 45644

SEQ ID NO: 99869 - RNA, 64 nt, hsa; identical to SEQ ID NO: 45645

SEQ ID NO: 99870 - RNA, 64 nt, hsa; identical to SEQ ID NO: 45646

SEQ ID NO: 99871 - RNA, 64 nt, hsa; identical to SEQ ID NO: 45647

SEQ ID NO: 99872 - RNA, 64 nt, hsa; identical to SEQ ID NO: 45648

SEQ ID NO: 99873 - RNA, 64 nt, hsa; identical to SEQ ID NO: 45649

SEQ ID NO: 99874 - RNA, 64 nt, hsa; identical to SEQ ID NO: 45650

SEQ ID NO: 99875 - RNA, 64 nt, hsa; identical to SEQ ID NO: 45651

SEQ ID NO: 99876 - RNA, 64 nt, hsa; identical to SEQ ID NO: 45652

SEQ ID NO: 99877 - RNA, 64 nt, hsa; identical to SEQ ID NO: 45653

SEQ ID NO: 99878 - RNA, 64 nt, hsa; identical to SEQ ID NO: 45654

SEQ ID NO: 99879 - RNA, 64 nt, hsa; identical to SEQ ID NO: 45655

SEQ ID NO: 99880 - RNA, 64 nt, hsa
uguccugggugcucucuacgugguggccgguagaauucuccaucuauccaggcuccaggagacc

SEQ ID NO: 99881 - RNA, 64 nt, hsa
gggaugggcaccaagaaucucucccaccaccugaauucuccaaggacucggguuuccuggaaga

SEQ ID NO: 99882 - RNA, 64 nt, hsa
ggugauucucuugaugccaccuucagauccuuuuauucuccagaauaauucuuaacagugguuc

SEQ ID NO: 99883 - RNA, 64 nt, hsa
uuucauaccuugaaguauguguuuaguagccucaauucuccauuaauuaaaagugugggcuggg

SEQ ID NO: 99884 - RNA, 64 nt, hsa
aggaaaaguuauauucaguauaugaauaaguguuauucuccauuauuaauguguucugaaaaua

SEQ ID NO: 99885 - RNA, 64 nt, hsa
caaagaccaaagagauuaggaaaagccuggcaguauucuccaacuccaaacaagcucuagagug

SEQ ID NO: 99886 - RNA, 64 nt, hsa
uuuuuaaauucugcuccugaaaaaugacugucccauucuccacucacugcauuuggggccuuuc

SEQ ID NO: 99887 - RNA, 64 nt, hsa
uucagcccugaaccuuuguccaccauuccuuuaaauucuccaacccaaaguauucuucuuuucu

SEQ ID NO: 99888 - RNA, 64 nt, hsa
acugaaacagaggacuauaaaacauccuucucuuauucuccauacugucuucuacaccuuuaaa

SEQ ID NO: 99889 - RNA, 64 nt, hsa
uggaauacugaccuaauguauaaaacuuaaaacaauucuccaauccccucuccuuugguccagu

SEQ ID NO: 99890 - RNA, 64 nt, hsa
ugccccagugggccaugauuaucuuaaaggcauuauucuccagccuuaaguaagaucuuaggac

SEQ ID NO: 99891 - RNA, 64 nt, hsa
aaaccauagaacaauuucacugcaaacaugcaugauucuccaagacaaaagaagagagauccua

SEQ ID NO: 99892 - RNA, 64 nt, hsa
uguauguaagaugggcauuccucugcucuccucuauucuccaugucgacugagaagaguauaau

SEQ ID NO: 99893 - RNA, 64 nt, hsa
auuacuuucucccuuucucuaccacagcaaacacauucuccaccaugucagucuaaagagucua

SEQ ID NO: 99894 - RNA, 64 nt, hsa
aacauaacuccaucuacaccuuggauuuggacugauucuccauuuuaucaccugaaggcuuggg

SEQ ID NO: 99895 - RNA, 64 nt, hsa
gaccucacauccaucugaggcuucauggacaaagauucuccacuuggccaaacuuuagccaagc

SEQ ID NO: 99896 - RNA, 64 nt, hsa
gagaaaaacaaguuccuuagagguuguauucuuuauucuccaagaaucugucugaaacuuguac

SEQ ID NO: 99897 - RNA, 64 nt, hsa
ggggcauauccuaucccaucccaccagaggauugauucuccauuucacaaggacugaucuggag

SEQ ID NO: 99898 - RNA, 64 nt, hsa
cuaaacgcaaaucuguagauucucuccucucccaucccagaaaacaaaacaaaauaaugcuuuu

SEQ ID NO: 99899 - RNA, 64 nt, hsa
cuucucuucccuaaccaaugaagcuaagugguuaucccagaaacuugucuucuaaaagggagga

SEQ ID NO: 99900 - RNA, 64 nt, hsa
uagaaauaaagagaucucagcagcuuggaagaaaucccagaagcggacuccaucaauccaagaa

SEQ ID NO: 99901 - RNA, 64 nt, hsa
ugucugagaaaaucucccuaauaggggaguggguucccagaagggagaucugggaggggucagg

SEQ ID NO: 99902 - RNA, 64 nt, hsa
aauaggaaaugaguaauuuugaguuugaaaucucucccagaagacaaacuacuucagugaguaa

SEQ ID NO: 99903 - RNA, 64 nt, hsa
uuccucccauaucuccguccuucauccaaaaccuucccagaauccaucagcaagcauguuugag

SEQ ID NO: 99904 - RNA, 64 nt, hsa
uugccaggcuuaaccuuccccuguaucuuacucaucccagaauuauuacuggccauuucuaaau

SEQ ID NO: 99905 - RNA, 64 nt, hsa
gaccugggcacaggcaugggcgauggcucccucuucccagaaucugcggggaacuggggcaagg

SEQ ID NO: 99906 - RNA, 64 nt, hsa
gccagugcccagcccagcggcucugggaagggguucccagaaucccuccugagcugugccauuu

SEQ ID NO: 99907 - RNA, 64 nt, hsa
gugagcuuaaagaacaaccaaacucugccaggggucccagaaagcccaggguccagcagucuca

SEQ ID NO: 99908 - RNA, 64 nt, hsa
ugaucauucccagaaacauuucccagaaaauguuucccagaaaacuagacagaaugaucauuca

SEQ ID NO: 99909 - RNA, 64 nt, hsa
aaaacaaggcagaaugaucauucccagaaacauuucccagaaaauguuucccagaaaacuagac

SEQ ID NO: 99910 - RNA, 64 nt, hsa
ucugaauuuccagaaaacaaggcagaaugaucauucccagaaacauuucccagaaaauguuucc

SEQ ID NO: 99911 - RNA, 64 nt, hsa
ccuucugcugcagcccaagcagggagugucccccucccagaagcauaucccagaugagugguac

SEQ ID NO: 99912 - RNA, 64 nt, hsa
caaugaggacaccugcaggaggggcuagccugacucccagaacuuuaagacuuucuccccacug

SEQ ID NO: 99913 - RNA, 64 nt, hsa
cuuccugcccuuuuggcuugcagacugccuucuaucccagaacagcugagaaaucuaugaagcu

SEQ ID NO: 99914 - RNA, 64 nt, hsa
auggcccugaaacacacacauuucccccuuccuuucccagaagccacuggccccccauagcacc

SEQ ID NO: 99915 - RNA, 64 nt, hsa
cuuuuuuaaauacuacaaauuagugucaggcaguucccagaaagagacaagaaauccuaguggc

SEQ ID NO: 99916 - RNA, 64 nt, hsa
gauuaaaggggcugucucccaaugaaagaggcauucccagaauuugcugcauuuagauuuugau

SEQ ID NO: 99917 - RNA, 64 nt, hsa
ccauuacaguaguguaauauauguuuaacuggagucccagaaggagaggagaaaaugaagaggc

SEQ ID NO: 99918 - RNA, 64 nt, hsa
uuuuuaaaaagcaaacaguguaaaaaaagucaucucccagaagacacuacucguuacauauugg

SEQ ID NO: 99919 - RNA, 64 nt, hsa
ugucaguauguuuauacuaaccuucaugcuuuuuucccagaaucccucaucugccagaaaacuu

SEQ ID NO: 99920 - RNA, 64 nt, hsa
gcauuugauuuaggaccuuggaucaguggucaccucccagaagaggcacggcacaaggaagcau

SEQ ID NO: 99921 - RNA, 64 nt, hsa
cuguagaagguuaaagcugacaacaugugaaacaucccagaauuaugacucuucccaaguuuaa

SEQ ID NO: 99922 - RNA, 64 nt, hsa
ggguuagggacugcauugagcaggcccaccugcuucccagaaccuccucacuagggcugagcac

SEQ ID NO: 99923 - RNA, 64 nt, hsa
auguguccugauaagcugagcuccuuagccuuugucccagaaugccuccugcagggauucuucc

SEQ ID NO: 99924 - RNA, 64 nt, hsa
ggaccuuuccugaggaagagggacuguucuuuugucccagaaaagcaguggcuccauugguguu

SEQ ID NO: 99925 - RNA, 64 nt, hsa
ugagagcugacuggcaagauaaaaacccugaaauucccagaaguuacagaugccuuaaagacuu

SEQ ID NO: 99926 - RNA, 64 nt, hsa
uuccaugacagacacuugcuucccuugggacaagucccagaagaacuaccugaagcaccaaagc

SEQ ID NO: 99927 - RNA, 64 nt, hsa
ccaugccaaggaguuugugccagccuuuucagacucccagaauuggguguuccuggguuauuua

SEQ ID NO: 99928 - RNA, 64 nt, hsa
gugacugaaagcugauuucucugugagacugaaaucccagaacauuguuugccaguaucucaac

SEQ ID NO: 99929 - RNA, 64 nt, hsa
ugguaucccucaucccagaagaggcaucuccauaucccagaaaagaagauccuaucaugaauaa

SEQ ID NO: 99930 - RNA, 64 nt, hsa
cacacauuuggcacuguuaucuugguaucccucaucccagaagaggcaucuccauaucccagaa

SEQ ID NO: 99931 - RNA, 64 nt, hsa
gaauggagugagcucuuccagcacagcugacaagucccagaagcagucccugacccccagcuuu

SEQ ID NO: 99932 - RNA, 64 nt, hsa
gauccuauccaaagcggccuacagucuccugggcucccagaagaguggcaagcugccauccucc

SEQ ID NO: 99933 - RNA, 64 nt, hsa
auccacccucguaacaacagucucccugggugggucccagaagugaucuuugugucgcucgggu

SEQ ID NO: 99934 - RNA, 64 nt, hsa
gcucucacacaugacuggagagaagugagaagacucccagaaucugccuuuuaaguuuccauca

SEQ ID NO: 99935 - RNA, 64 nt, hsa
cgugcucauugcuaaccacugucugucccugaacucccagaaccacuacaucuggcuuugggca

SEQ ID NO: 99936 - RNA, 64 nt, hsa
acuccugggcucaagcaguccucccaccuuggccucccagaaugcuggguuuauagaugugagc

SEQ ID NO: 99937 - RNA, 64 nt, hsa
auuuucuuacagcgaagacuugaguuccuccaagucccagaaccccaagaaugggcaagaagga

SEQ ID NO: 99938 - RNA, 64 nt, hsa
ugcagcugugaagcucgggcugauucccccucugucccagaagguuggccagagggugugaccc

SEQ ID NO: 99939 - RNA, 64 nt, hsa
cagaagguaccccugagguuggcgucuuccuacgucccagaagcagcccccaccccacacauga

SEQ ID NO: 99940 - RNA, 64 nt, hsa
gggaugggcgggcacccaagcccuggcuuguccuucccagaagguaccccugagguuggcgucu

SEQ ID NO: 99941 - RNA, 64 nt, hsa
gaaagagcugggcucucagcuauuucuaguugcuucccagaagccgaggagcagaaggagcugu

SEQ ID NO: 99942 - RNA, 64 nt, hsa
cugcaggaugaggaagacaggccaaucccuucccucccagaagcuggccgcccagcaggaggga

SEQ ID NO: 99943 - RNA, 64 nt, hsa
uaauaaaacuuaucugagucacuugaaacuugguucccagaaaacacauuucugguuuauaauc

SEQ ID NO: 99944 - RNA, 64 nt, hsa
agauuacaggugugagccacugugcccagcaguuucccagaauauauuuaaaugcaaaguuaca

SEQ ID NO: 99945 - RNA, 64 nt, hsa
gggucuguguucuccaggagaaugaggguguuggucccagaauugggaccggggccccgcuggc

SEQ ID NO: 99946 - RNA, 64 nt, hsa
guguugacccagggauggggcuggguaguuggggucccagaaagccggggguaggggccacccu

SEQ ID NO: 99947 - RNA, 64 nt, hsa
gaaggagcccaugugguuggauaaaaucaagaaaaggcugaaugagcacgguuacccccaagug

SEQ ID NO: 99948 - RNA, 64 nt, hsa
uauaaggauuuuggccaaaugggacuuagacuggaggcugaauuugagaaggauuucaaggaag

SEQ ID NO: 99949 - RNA, 64 nt, hsa
augaauuuuggcaugaugacuguacucucaauaaaggcugaaaauguuguauaacugaccugug

SEQ ID NO: 99950 - RNA, 64 nt, hsa
aaugaauaaugaccuuaugaaguaugcuaucuguaggcugaaauuauagguacaucuguuuuca

SEQ ID NO: 99951 - RNA, 64 nt, hsa
cucaaccaauggguggccuugugacuguucuuuaaggcugaagauauccaggaaagggggcuug

SEQ ID NO: 99952 - RNA, 64 nt, hsa
uguaaguagcgcagcagccucugugggggaggauaggcugaaaaaaaaaagugggcucguauuu

SEQ ID NO: 99953 - RNA, 64 nt, hsa
uucacuauucacaggacauuggcauuaucuacuaaggcugaaaaugugcauauuccaugacuca

SEQ ID NO: 99954 - RNA, 64 nt, hsa
gaaauaauaacagacaaggucaaaaaauagaugcaggcugaaaagaaaaggaagugggcuaaga

SEQ ID NO: 99955 - RNA, 64 nt, hsa
uuacgacgcaauaaaauaacaucaauagauuuuuaggcugaauuaauuugaaagcagcaauuug

SEQ ID NO: 99956 - RNA, 64 nt, hsa
acucuaccccacccuacaaaaugcauauggagguaggcugaaaagaauguaauuuuuauuuucu

SEQ ID NO: 99957 - RNA, 64 nt, hsa
aaucaguuaucaguacaagugccgcauagugcauaggcugaaaugucucaagauuccccacacu

SEQ ID NO: 99958 - RNA, 64 nt, hsa
acugaggccaggaaaagaagcacuggaaagcagcaggcugaacaauuccuggaacucaugcagg

SEQ ID NO: 99959 - RNA, 64 nt, hsa
gagauugugaugucauauuucacucucaaaacauaggcugaaagcacgaauuacucaaaaagua

SEQ ID NO: 99960 - RNA, 64 nt, hsa
auuaauauugcacacccaaaccagucuaucagggaggcugaagcaagggcgcagugugauauuu

SEQ ID NO: 99961 - RNA, 64 nt, hsa
gggcccuccgagguggagcagcagcuacaagcagaggcugaacaccugcggaaggagcuggaga

SEQ ID NO: 99962 - RNA, 64 nt, hsa
gggcccuccgagguggaacagcagcuacaagcagaggcugaacaccugcggaaggagcuggaga

SEQ ID NO: 99963 - RNA, 64 nt, hsa
ggcagccucuucaaaaugagcccuguccugccuaaggcugaacuuguuuucugggaacaccaua

SEQ ID NO: 99964 - RNA, 64 nt, hsa
uccuccuggacuccugcacacgcuccuuccucugaggcugaaauucagaauauuagugaccuca

SEQ ID NO: 99965 - RNA, 64 nt, hsa
ugguggcaugagccuguguucccagcugcuuaggaggcugaagcaggaggauugauugagccug

SEQ ID NO: 99966 - RNA, 64 nt, hsa
uggucacaaccugagguacucugcugagugggcaaggcugaagaagaggccuguggaaugcagc

SEQ ID NO: 99967 - RNA, 64 nt, hsa
gaagcaggguggccuccagagccuugccauaaaaaggcugaaggcagccgggcgcaguggcuca

SEQ ID NO: 99968 - RNA, 64 nt, hsa
agacuccgucucaaaaaaaaaaaaaaaacaaaaaaggcugaaggcagcuguagcuccacacaga

SEQ ID NO: 99969 - RNA, 64 nt, hsa
guuaagagguuuguauauaaaucuguuauagaacaggcugaaauuucuuguucauaagauuaug

SEQ ID NO: 99970 - RNA, 64 nt, hsa
acaccuaacauuauacuucauggugauagacugaaggcugaauguuuuccccuuaagauuggga

SEQ ID NO: 99971 - RNA, 64 nt, hsa
agacacagggcccagcacccagguugcugucggcaggcugaagacacuagaauccugaccugua

SEQ ID NO: 99972 - RNA, 64 nt, hsa
ucaggccuggugguggcaguggaggaggcugaggaggcugaagaggcugacaggucggggggcu

SEQ ID NO: 99973 - RNA, 64 nt, hsa
uggauggauagauggauggauggguuggggaguggggguggauggauggauagauggauggaug

SEQ ID NO: 99974 - RNA, 64 nt, hsa
uggauggauggauggauggauggguugggggguggggguggauggauagauggauggauggaug

SEQ ID NO: 99975 - RNA, 64 nt, hsa
caucauguaaucugggaccugccaggcagggguggggguggaggcuuccugcguccuccucacc

SEQ ID NO: 99976 - RNA, 64 nt, hsa
ugcuggcacccaccguggaggaggaaggcaagaggggguggagggguguggcagugguuuuggc

SEQ ID NO: 99977 - RNA, 64 nt, hsa
agugcccuggcuuggucaccacuggggccaaggugggguggagagaggccuaggagccagaaag

SEQ ID NO: 99978 - RNA, 64 nt, hsa
ccccaaacugagacagacugggagcugggagccugggguggacaggaccauacccucuuugagc

SEQ ID NO: 99979 - RNA, 64 nt, hsa
uuggaaggcauugccccaugggcucaggugacucgggguggagugagcacgucugcagggcccu

SEQ ID NO: 99980 - RNA, 64 nt, hsa
aggaaagggcugcgugaaaaacccagcugggccugggguggaggugcacacgggcuggggcuca

SEQ ID NO: 99981 - RNA, 64 nt, hsa
cugugacccgcccucuuuaggcugagcuauaagagggguggacacagggugggcugaggucaga

SEQ ID NO: 99982 - RNA, 64 nt, hsa
agagcaccaggcuccagggcacucggaggcuggugggguggacucagggaggcccagggcuccu

SEQ ID NO: 99983 - RNA, 64 nt, hsa
ugagguucccguucuuucccuucccaagucucuggggguggaaaggaggaagagauacuaguua

SEQ ID NO: 99984 - RNA, 64 nt, hsa
cccuuguccagaccuggugggcccuucagagggagggguggaccuguuucucuuucacuuucau

SEQ ID NO: 99985 - RNA, 64 nt, hsa
gagacggccggcucagccuucccuugcacugguugggguggaaccugcagaggccagcccgggg

SEQ ID NO: 99986 - RNA, 64 nt, hsa
ccccccaauacuagaauggguuugagcuuggggugggguggauggggaagacuuacucugaaug

SEQ ID NO: 99987 - RNA, 64 nt, hsa
uuaaauuuacucccuccccacccagaacccagaugggguggagggggccaccggggcagggagg

SEQ ID NO: 99988 - RNA, 64 nt, hsa
ggcuuaugccccccccucccccaguguguugggugggguggaauugagguuagggugagggguc

SEQ ID NO: 99989 - RNA, 64 nt, hsa
gauccagcggggcuucugggcgccgguuccacgugggguggaauuauuagcaccagcuugcuuc

SEQ ID NO: 99990 - RNA, 64 nt, hsa
cuucucugccgguggggccagcgcugaacagaccgggguggagucagggcugugcuuuccgcgu

SEQ ID NO: 99991 - RNA, 64 nt, hsa
aaaacguauccugaggacuucuuccggagagggugggguggagcagcgggggagccuuggccga

SEQ ID NO: 99992 - RNA, 64 nt, hsa
cuggauguugagucucaucagaauauguggguaggggguggacgugcacgggugcaugauugug

SEQ ID NO: 99993 - RNA, 64 nt, hsa
ugauacauggccuuuuucagggggugcuccucgcgggguggacuugggagugugcagugggaca

SEQ ID NO: 99994 - RNA, 64 nt, hsa
gcccugccugggggaguccguggcgaugggcgcugggguggaggugcaggagccccaggaccug

SEQ ID NO: 99995 - RNA, 64 nt, hsa
ggaacccagagccacccgcuaugagcacaggccggggguggaaggcccaguagagcugcccuuc

SEQ ID NO: 99996 - RNA, 64 nt, hsa
uugggaauucauaugaucugccagagccucuccagggguggaauacauguccuggacuaagcca

SEQ ID NO: 99997 - RNA, 64 nt, hsa
gguggaagucagaaugcuccuggaggcugcagaggggguggaggacucuccccugccucugggg

SEQ ID NO: 99998 - RNA, 64 nt, hsa
agugcaaggcugaaauggacaagggcuccucacggggguggagggagccggagccugccuugug

SEQ ID NO: 99999 - RNA, 64 nt, hsa
uuguuaaccacagcuguggcucguuugagggauugggguggaccugggguuuauuuucaguaac

SEQ ID NO: 100000 - RNA, 64 nt, hsa
acuauuuuuuaagauagaagauaauuugugggcagggguggaggaugcauguaugauacuccau

SEQ ID NO: 100001 - RNA, 64 nt, hsa
gaaagcaugauaagaggaggaagacauaaaguuggggguggagaggcugcugcccagaaacugc

SEQ ID NO: 100002 - RNA, 64 nt, hsa
gguuucuuaauugagggaaggaagcagauucggagggguggagauaaagcuggggauuggagau

SEQ ID NO: 100003 - RNA, 64 nt, hsa
caaugccgaagaccgagggcaggggagggaggcggggguggacagggaggcagcuugugaauuu

SEQ ID NO: 100004 - RNA, 64 nt, hsa
uuuucucaguuggaugcccugugucucugugagugggguggagcaaagggaaccaaugccgaag

SEQ ID NO: 100005 - RNA, 64 nt, hsa
uacugccgcagccccuccugguucuucuggugcugggguggagcaggcucugugcucccaccac

SEQ ID NO: 100006 - RNA, 64 nt, hsa
gguggggguacugacgcccuucccagcucauccagggguggagccuggccugucuuccuccaac

SEQ ID NO: 100007 - RNA, 64 nt, hsa
aaacuaaggcaguggcaaagguagaacucaggcagggguggagaaaaggcguuggucgcaguga

SEQ ID NO: 100008 - RNA, 64 nt, hsa
gggugcggaggaauuuggguaaaggcagagggaagggguggaggagggccagcucaguugccga

SEQ ID NO: 100009 - RNA, 64 nt, hsa
ugcaaaaauacagaugucuauuuuucuaaacugggggguggaggggugccuccugacagcuucc

SEQ ID NO: 100010 - RNA, 64 nt, hsa
ggcugaaugaagccaugacuuggaaagguggugggggguggauggcggcugugacucagggccc

SEQ ID NO: 100011 - RNA, 64 nt, hsa
ugcccaugccaggagccagcugugugaccauccagggguggagggggaaaaccaggcaauuucg

SEQ ID NO: 100012 - RNA, 64 nt, hsa
caccccaaugccaggauagauguauucuagaguagggguggaggcggcccaggaggcugaagac

SEQ ID NO: 100013 - RNA, 64 nt, hsa
gccuuuccuugggaaucugccucccuccauggcagggguggauucgggagcugggaguaaccag

SEQ ID NO: 100014 - RNA, 64 nt, hsa
uguuuguucugugaaaucccgcucaccuccuggagggguggagcagcugggggcuggagcccug

SEQ ID NO: 100015 - RNA, 64 nt, hsa
uccugggaccgcgguggguggaaucccaaggcuggggguggaaggagcagggcucuggagggau

SEQ ID NO: 100016 - RNA, 64 nt, hsa
gcucaugcauaguccuuacagagucccaggaccggggguggagaggagccucaaguacauucca

SEQ ID NO: 100017 - RNA, 64 nt, hsa
gaaggggccccagggccuucgcucccucagcacugggguggaggcggcaggaaggggcggcccu

SEQ ID NO: 100018 - RNA, 64 nt, hsa
ggggcgugucugggggcgggggcaggaggggagcgggguggagggaacacgugcagugccgugg

SEQ ID NO: 100019 - RNA, 64 nt, hsa
ggccagagaaagcaaaggugcacuccagacucuggggguggacaucugaccccaagggggcugc

SEQ ID NO: 100020 - RNA, 64 nt, hsa
ggcugcugcuccucucuuggguaggguaguggcugggguggagugggaagggagcauugcagcc

SEQ ID NO: 100021 - RNA, 63 nt, hsa
uugagacaauucuauuuuucauauacucguugcucauuaaauaguaaaggguugauuugcugc

SEQ ID NO: 100022 - RNA, 63 nt, hsa
gucuuuacuagugcuaaguauuauggugagcuaucauuaaagugugccaucuuggauaaaggc

SEQ ID NO: 100023 - RNA, 63 nt, hsa
auuagguuuuguacaauugaacuuaaauaaaugucauuaaaauaaauaaaugcaauauguauu

SEQ ID NO: 100024 - RNA, 63 nt, hsa
cauaguucccauguuaaaucccauucauaacuuucauuaaagcauuuacuuugaauuucucca

SEQ ID NO: 100025 - RNA, 63 nt, hsa
acagcuagcauguucacagauuugaaagaaguuucauuaaaagcaccauugcuuucuguacug

SEQ ID NO: 100026 - RNA, 63 nt, hsa
acuaggccuuugaugcuuuaauucuucuucaguucauuaaaaguaacuacuaaggaaagguua

SEQ ID NO: 100027 - RNA, 63 nt, hsa
aaugucccuaauuuaacccagcucauuauaaugucauuaaacaugacauuagcauugugguuu

SEQ ID NO: 100028 - RNA, 63 nt, hsa
gggcuagccaauagaguugggacaauugcuuacucauuaaaaauaauagagccccacuugaca

SEQ ID NO: 100029 - RNA, 63 nt, hsa
cuaacuuaguaaaguagaauaauuucaugguauucauuaaaaagcauaaaagucuuccucuug

SEQ ID NO: 100030 - RNA, 63 nt, hsa
uuuagugauacaaaugauugcaauuuuucuaaaucauuaaauuauuugguuugguggagugag

SEQ ID NO: 100031 - RNA, 63 nt, hsa
gacauccccaaagcuugucugccugugggucuuucauuaaaggugacgggcaaggguuuucuc

SEQ ID NO: 100032 - RNA, 63 nt, hsa
guguguacaguguccacaggcaucacaccuucuucauuaaaaacccaguuuccuggucauuuc

SEQ ID NO: 100033 - RNA, 63 nt, hsa
uuuaugcuaauucugcuuauuuuagaguauuuuucauuaaaaggugagcaaagugaaagauac

SEQ ID NO: 100034 - RNA, 63 nt, hsa
ugauguagaguagggcaaaucuguguguguaugucauuaaaaaaauucuaccaucuuucuuua

SEQ ID NO: 100035 - RNA, 63 nt, hsa
gaaggauuauuaagcaaccuuaaagcaauaaguucauuaaacagaagguaauaggaagaacag

SEQ ID NO: 100036 - RNA, 63 nt, hsa
cauuugaugucuagauaacauucaugagauuggucauuaaauacuauuuugcuccuuuucugg

SEQ ID NO: 100037 - RNA, 63 nt, hsa
aauugucucaaagcaucaaauaauacaucuuuaucauuaaacaugaauuuaaugucuaggaua

SEQ ID NO: 100038 - RNA, 63 nt, hsa
uauugauugaaaaaagagaaaggggcaagaaauucauuaaagaaaaaccacagauacugaaac

SEQ ID NO: 100039 - RNA, 63 nt, hsa
uaaacagaauuagguaguauauugaagacagcaucauuaaacaguuauguuguucuccuugca

SEQ ID NO: 100040 - RNA, 63 nt, hsa
aauuuuuuucucacagugucaagguaacugaauucauuaaaaaaucuugaagggaguagggag

SEQ ID NO: 100041 - RNA, 63 nt, hsa
uagguuugcguuuauagucagguuccauuuagcucauuaaaggucacugcugcuucaaaggac

SEQ ID NO: 100042 - RNA, 63 nt, hsa
auggaccuauguauauauaucuaagaccucugaucauuaaaaccuauaaaggguugagcuguc

SEQ ID NO: 100043 - RNA, 63 nt, hsa
cauagcccuucucuauguaagcagccauggcagucauuaaagagaaaggaguagcuuugacau

SEQ ID NO: 100044 - RNA, 63 nt, hsa
agcaucugauaaucuguugguuuauuucacuuuucauuaaaugaacauugaugagagaagaug

SEQ ID NO: 100045 - RNA, 63 nt, hsa
ucagucugaugguucuguucuucauugugauugucauuaaaaagugguaaauugcucaaugua

SEQ ID NO: 100046 - RNA, 63 nt, hsa
cuagaggaugugaucuaauuucuuucuagcucaucauuaaaaaggaaauuguaucaggaccca

SEQ ID NO: 100047 - RNA, 63 nt, hsa
agggggaagaaaggagggcugugaggagauaccucauuaaacuuggcuuagugaagaagagag

SEQ ID NO: 100048 - RNA, 63 nt, hsa
ccacucucagccugggagacuccugccaagcccucauuaaagaugccacccugggcugcccug

SEQ ID NO: 100049 - RNA, 63 nt, hsa
augauaacugguaccuuaucuacuguaaauauuucauuaaaaaugaugcacacauagauauau

SEQ ID NO: 100050 - RNA, 63 nt, hsa
uuuaauguuuuauuggcaacguaugcugcuuuuucauuaaaauaugcuauuaaaauuaaaugg

SEQ ID NO: 100051 - RNA, 63 nt, hsa
gaaacuaaaucuguguucaaagaugaagaccccucauuaaaagccaaggacguucuuaagauu

SEQ ID NO: 100052 - RNA, 63 nt, hsa
gauuggaacugacauaauuagucuugacuuacuucauuaaagcaagauucaauuccuuguuca

SEQ ID NO: 100053 - RNA, 63 nt, hsa
gagaaagucaauuaagugugaguaaaguuaguaucauuaaacaaauugucuauuaaaugcaag

SEQ ID NO: 100054 - RNA, 63 nt, hsa
aucaguuuuuauacagguugcaaaacauaguauucauuaaagacaugaauuuagaauugauuu

SEQ ID NO: 100055 - RNA, 63 nt, hsa
ggaauuucaguauacuguacuauccuuuauaagucauuaaaauaauguuucaucaaaugguua

SEQ ID NO: 100056 - RNA, 63 nt, hsa
uguacagagguuacugcaauaaaggaaguggauucauuaaaccuauuuaauguccauucuuau

SEQ ID NO: 100057 - RNA, 63 nt, hsa
uaacacuugaaaaccaauuuaguuguuagucauucauuaaacauuaacaucacuaucauuuau

SEQ ID NO: 100058 - RNA, 63 nt, hsa
ucuuucaaaacuugaguggucucugagcuccugucauuaaaccuaucuauaucugucuaucag

SEQ ID NO: 100059 - RNA, 63 nt, hsa
cauaauguucuguuauacauaacauuaaaauguucauuaaaaucaauguugaacugcuuuuuc

SEQ ID NO: 100060 - RNA, 63 nt, hsa
cuuuuacuaccacucuugaguccauauaugaaaucauuaaaguuggaugaucaguuuuuuaua

SEQ ID NO: 100061 - RNA, 63 nt, hsa
acauuugcacaaucuaaaauguaagcaaaguagucauuaaaaauacacccucuacuugggcuu

SEQ ID NO: 100062 - RNA, 63 nt, hsa
acuaaaaauacgaggaaaggagagugaggauuuucauuaaaagucucagcaguggguuucuug

SEQ ID NO: 100063 - RNA, 63 nt, hsa
cuaaauaaauggcuuucaaacaaagcaacugggucauuaaaaccagcucaaaggggguuuaaa

SEQ ID NO: 100064 - RNA, 63 nt, hsa
uuugccgucuuguauguagaggcuauuuuuaaaucauuaaauuuuuagaucucuguuuucaua

SEQ ID NO: 100065 - RNA, 63 nt, hsa
cauguuuguuuguagauguuugucugaugcauuucauuaaaaaaaaaaccaugaauuacgaag

SEQ ID NO: 100066 - RNA, 63 nt, hsa
uaugagaacugguucuugccuuccccuugaaccucauuaaauggugauuucuugcuaagcucc

SEQ ID NO: 100067 - RNA, 63 nt, hsa
ucauguaccaagugcuuggcacauagugggccuucauuaaauguuuguugaauaaaagaggga

SEQ ID NO: 100068 - RNA, 63 nt, hsa
gcauagaauaaugaagaucuuuguuuuuuguuuucauuaaagagccauucuggcacuuuaaug

SEQ ID NO: 100069 - RNA, 63 nt, hsa
uuuugagaacauucccuggaauugccacauaauucauuaaaaacauuuuuuuaagcaacacuu

SEQ ID NO: 100070 - RNA, 63 nt, hsa
aagcuacuggaugcacugucagauuaacuuauuucauuaaagaaguugggagaacaaauagga

SEQ ID NO: 100071 - RNA, 63 nt, hsa
acugacaguugguauauguaccagccaaucccuucauuaaauguauacagauuuaguuaagua

SEQ ID NO: 100072 - RNA, 63 nt, hsa
gcuuucugaacucuaaugugccuucauugauuaucauuaaaauuaucauuaaaauugccuuau

SEQ ID NO: 100073 - RNA, 63 nt, hsa
cuaaugugccuucauugauuaucauuaaaauuaucauuaaaauugccuuauuucuauggacuc

SEQ ID NO: 100074 - RNA, 63 nt, hsa
agaggacuugcuauuugccaggugcuuuauguaucauuaaauuuuucucauaguucagaaaaa

SEQ ID NO: 100075 - RNA, 63 nt, hsa
uuuccuuuuaaauuuaguucuaucauuaauuuaucauuaaauuuaguucuaucauuugguacu

SEQ ID NO: 100076 - RNA, 63 nt, hsa
ccuaacauaugucucuaccuagaacggaugguuucauuaaagaauguggauuuauugaugugu

SEQ ID NO: 100077 - RNA, 63 nt, hsa
acagaucagaauguggcaccagaggacugugucucauuaaagugauugcugggagcaaaaacu

SEQ ID NO: 100078 - RNA, 63 nt, hsa
gcacuuuggcauaccgaaaaaacaugaaauuuuucauuaaaaugccaugaaucaagccagggc

SEQ ID NO: 100079 - RNA, 63 nt, hsa
uucauguaauuuacccuuugcaauaaaaaugauucauuaaauauauaacuaaaugugauuugg

SEQ ID NO: 100080 - RNA, 63 nt, hsa
uuucuuuucugguuuuaguuugggaauaaucauucauuaaaaaaaauguauugugguuuaugc

SEQ ID NO: 100081 - RNA, 63 nt, hsa
cauaauacaaggaaccucagagcccccauuuguucauuaaagaggcaacuacagccaaaauca

SEQ ID NO: 100082 - RNA, 63 nt, hsa
aacuaccuuauuuuucacuguacagacacuaauucauuaaauacuaauugauuguuuaaaaga

SEQ ID NO: 100083 - RNA, 63 nt, hsa
acuguauuucauuuucuuuauauuggaccgaagucauuaaaacaaaaugaaacauuugccaaa

SEQ ID NO: 100084 - RNA, 63 nt, hsa
uuuuuugaauauugcaggguucagucuagauugucauuaaauugaagagucuacauucagaac

SEQ ID NO: 100085 - RNA, 61 nt, hsa
auccuaagcacaaaauaaaccuuucuaaccacuucauuaaagcugaagaccaguaugauuu

SEQ ID NO: 100086 - RNA, 63 nt, hsa
gcauuuauuuaagggcuuuuucuuaaauaagaaucauuaaagucauuaaaaaaauuuacugaa

SEQ ID NO: 100087 - RNA, 63 nt, hsa
uaagggcuuuuucuuaaauaagaaucauuaaagucauuaaaaaaauuuacugaaaugcccauc

SEQ ID NO: 100088 - RNA, 63 nt, hsa
cuacauuucugaauuuuugaaaaauguauuuuaucauuaaauggcauuauuuuaaagggugaa

SEQ ID NO: 100089 - RNA, 63 nt, hsa
gaguguguuuaaauuguuacaaacaauaaugcgucauuaaaggccaugcugaucuugcauaac

SEQ ID NO: 100090 - RNA, 63 nt, hsa
uuugcaaaaaauguuuuuggucuuuuauaauucucauuaaaagaauaucuggcaaauuaaaaa

SEQ ID NO: 100091 - RNA, 63 nt, hsa
guguauuugcuaauuuuuauuaauuuuaguuuuucauuaaauaaauuugacuuuucuguaauu

SEQ ID NO: 100092 - RNA, 63 nt, hsa
uaugcuguauuucuuuguagaauaaaugguuucucauuaaacucuaaagauuagggaaaaugg

SEQ ID NO: 100093 - RNA, 63 nt, hsa
uccuucagcugacuccaguauaaucuccucugcucauuaaacugauuccaggagauuggauuu

SEQ ID NO: 100094 - RNA, 63 nt, hsa
guuuucauagugcuuucaaauacaccuuuuugaucauuaaaauaaaaaaauaaaucuugcucu

SEQ ID NO: 100095 - RNA, 63 nt, hsa
auauacccagucauaaaguauaagcaucaguugucauuaaaaguuuucagaaaaucuugaggu

SEQ ID NO: 100096 - RNA, 63 nt, hsa
aaauauuaccuaaauugguuagauacaaagaaaucauuaaaauuauuaauguauauaugaaaa

SEQ ID NO: 100097 - RNA, 63 nt, hsa
ugcuuuaugaagcuuuagaaaugagcucaugacucauuaaaaaauaauaaacgaugcuauuuu

SEQ ID NO: 100098 - RNA, 63 nt, hsa
ggcggggagcugggccuggaggauccuggagucucauuaaaugccugauugugaaccaugucc

SEQ ID NO: 100099 - RNA, 63 nt, hsa
cagccuuguuucucauguaaugcagugacgcugucauuaaacacguggauucauguguggccg

SEQ ID NO: 100100 - RNA, 64 nt, hsa; identical to SEQ ID NO: 87364

SEQ ID NO: 100101 - RNA, 64 nt, hsa; identical to SEQ ID NO: 87365

SEQ ID NO: 100102 - RNA, 64 nt, hsa; identical to SEQ ID NO: 87366

SEQ ID NO: 100103 - RNA, 64 nt, hsa; identical to SEQ ID NO: 87367

SEQ ID NO: 100104 - RNA, 64 nt, hsa; identical to SEQ ID NO: 87368

SEQ ID NO: 100105 - RNA, 64 nt, hsa; identical to SEQ ID NO: 87369

SEQ ID NO: 100106 - RNA, 64 nt, hsa; identical to SEQ ID NO: 87370

SEQ ID NO: 100107 - RNA, 64 nt, hsa; identical to SEQ ID NO: 87371

SEQ ID NO: 100108 - RNA, 64 nt, hsa; identical to SEQ ID NO: 87372

SEQ ID NO: 100109 - RNA, 64 nt, hsa; identical to SEQ ID NO: 87373

SEQ ID NO: 100110 - RNA, 64 nt, hsa; identical to SEQ ID NO: 87374

SEQ ID NO: 100111 - RNA, 64 nt, hsa; identical to SEQ ID NO: 87375

SEQ ID NO: 100112 - RNA, 64 nt, hsa; identical to SEQ ID NO: 87376

SEQ ID NO: 100113 - RNA, 64 nt, hsa; identical to SEQ ID NO: 87377

SEQ ID NO: 100114 - RNA, 64 nt, hsa; identical to SEQ ID NO: 87378

SEQ ID NO: 100115 - RNA, 64 nt, hsa; identical to SEQ ID NO: 87379

SEQ ID NO: 100116 - RNA, 64 nt, hsa; identical to SEQ ID NO: 87380

SEQ ID NO: 100117 - RNA, 64 nt, hsa; identical to SEQ ID NO: 87381

SEQ ID NO: 100118 - RNA, 64 nt, hsa; identical to SEQ ID NO: 87382

SEQ ID NO: 100119 - RNA, 64 nt, hsa; identical to SEQ ID NO: 87383

SEQ ID NO: 100120 - RNA, 64 nt, hsa; identical to SEQ ID NO: 87384

SEQ ID NO: 100121 - RNA, 64 nt, hsa; identical to SEQ ID NO: 87385

SEQ ID NO: 100122 - RNA, 64 nt, hsa; identical to SEQ ID NO: 87386

SEQ ID NO: 100123 - RNA, 64 nt, hsa; identical to SEQ ID NO: 87387

SEQ ID NO: 100124 - RNA, 64 nt, hsa; identical to SEQ ID NO: 87388

SEQ ID NO: 100125 - RNA, 64 nt, hsa; identical to SEQ ID NO: 87389

SEQ ID NO: 100126 - RNA, 64 nt, hsa; identical to SEQ ID NO: 87390

SEQ ID NO: 100127 - RNA, 64 nt, hsa; identical to SEQ ID NO: 87391

SEQ ID NO: 100128 - RNA, 64 nt, hsa; identical to SEQ ID NO: 87392

SEQ ID NO: 100129 - RNA, 64 nt, hsa; identical to SEQ ID NO: 87393

SEQ ID NO: 100130 - RNA, 64 nt, hsa; identical to SEQ ID NO: 87394

SEQ ID NO: 100131 - RNA, 64 nt, hsa; identical to SEQ ID NO: 87395

SEQ ID NO: 100132 - RNA, 64 nt, hsa; identical to SEQ ID NO: 87396

SEQ ID NO: 100133 - RNA, 64 nt, hsa; identical to SEQ ID NO: 87397

SEQ ID NO: 100134 - RNA, 64 nt, hsa; identical to SEQ ID NO: 87398

SEQ ID NO: 100135 - RNA, 64 nt, hsa; identical to SEQ ID NO: 87399

SEQ ID NO: 100136 - RNA, 64 nt, hsa; identical to SEQ ID NO: 87400

SEQ ID NO: 100137 - RNA, 64 nt, hsa; identical to SEQ ID NO: 87401

SEQ ID NO: 100138 - RNA, 64 nt, hsa; identical to SEQ ID NO: 87402

SEQ ID NO: 100139 - RNA, 64 nt, hsa; identical to SEQ ID NO: 87403

SEQ ID NO: 100140 - RNA, 64 nt, hsa; identical to SEQ ID NO: 87404

SEQ ID NO: 100141 - RNA, 64 nt, hsa; identical to SEQ ID NO: 87405

SEQ ID NO: 100142 - RNA, 64 nt, hsa; identical to SEQ ID NO: 87406

SEQ ID NO: 100143 - RNA, 61 nt, hsa
uguagaacacugagcaggacaacugaccugucuccuucacauaguccauaucaccacaaau

SEQ ID NO: 100144 - RNA, 61 nt, hsa
uugcaggacucacuggauagauguuauucgacuccuucagguuaucuugaacugccugacu

SEQ ID NO: 100145 - RNA, 61 nt, hsa
uugcaggacucacuggauagauguuauucaacuccuucaguuuaucuuggacugacugacu

SEQ ID NO: 100146 - RNA, 61 nt, hsa
aagccucucugucaucuccccuucccagccccuccuucauccccugccuccuucaccagcc

SEQ ID NO: 100147 - RNA, 61 nt, hsa
uccccuucccagccccuccuucauccccugccuccuucaccagccuggcuuuugccuggag

SEQ ID NO: 100148 - RNA, 54 nt, hsa
cugggaaugaggagucgugacgugcuccuucagugccccuguacugcccugcca

SEQ ID NO: 100149 - RNA, 61 nt, hsa
agggacuuugugcuaagccugaugaaaugugcuccuucaaucuccaugaaaccaucguaac

SEQ ID NO: 100150 - RNA, 61 nt, hsa
gaaaacacuguucucugcccuccaagaccuucuccuucaccuuuguccccaccgcagacag

SEQ ID NO: 100151 - RNA, 61 nt, hsa
ugggcuggguucuacccaggugcuaggaacacuccuucacagaugggugcuuggaggaagg

SEQ ID NO: 100152 - RNA, 61 nt, hsa
ucuagaauuuauuuuccuagcacuucaccaccuccuucaucuucuccuucaacaauaaacc

SEQ ID NO: 100153 - RNA, 61 nt, hsa
uuuccuagcacuucaccaccuccuucaucuucuccuucaacaauaaacccugagaucuuug

SEQ ID NO: 100154 - RNA, 61 nt, hsa
ucuuuauaaggcaaaaagaucuguauuuacacuccuucaccuagggauguguuuguugccc

SEQ ID NO: 100155 - RNA, 61 nt, hsa
cagcaggacugacucugggcucuacaaccagcuccuucacauaaaggguuuagagacuccc

SEQ ID NO: 100156 - RNA, 64 nt, hsa
aggaguguacaccugcaagggcugaggcccugggcccagucagcccugcugcucagagugcagg

SEQ ID NO: 100157 - RNA, 64 nt, hsa
augggccuacaccugccaaggcugaaucccugggcccagucagcccugcugcacauggcacagg

SEQ ID NO: 100158 - RNA, 64 nt, hsa
uuauuuuggggggacagugccaaguccaucuuugcccagucaauucagugauugauagcaauuu

SEQ ID NO: 100159 - RNA, 64 nt, hsa
aagugagcuuaucuguuugaugcuguggcagggucccagucacugggcauauccuccuucuccu

SEQ ID NO: 100160 - RNA, 64 nt, hsa
cuguuauaauuucugaacuguucugagaccuguucccagucacugauugcaauuucuuuuacac

SEQ ID NO: 100161 - RNA, 64 nt, hsa
augugacaguccccaggcaugcccacaggccaggcccagucacagcugggcuuccacaggucag

SEQ ID NO: 100162 - RNA, 64 nt, hsa
ugugguuccuucucagccgaaacagguccaguaucccagucauuucuucaaaugcugauagggg

SEQ ID NO: 100163 - RNA, 64 nt, hsa
ugccccaggacaagagcaagaaggacaucaguugcccagucaugugauccccugccaucuugcc

SEQ ID NO: 100164 - RNA, 64 nt, hsa
uggcugcccaugaggcucaugaagcagaggguaucccagucauagggagcagaaagagcaagug

SEQ ID NO: 100165 - RNA, 64 nt, hsa
ugugaaccaaagcgucaggggcuuggggcacagccccagucagcucaacccaguccugcuucag

SEQ ID NO: 100166 - RNA, 64 nt, hsa
guuuuucuugaguccuugcacucacuuccccugccccagucacgaugaccccuaaagcuuccuu

SEQ ID NO: 100167 - RNA, 64 nt, hsa
ccaauucuggcagauaucaggcccccaguucagccccagucacccucuuuuacacauguggguc

SEQ ID NO: 100168 - RNA, 64 nt, hsa
uacaaggacaaauuauuagcaagaaauaagaauaguauuagaagaauugauccuauuuugaacc

SEQ ID NO: 100169 - RNA, 64 nt, hsa
aaggcccuaaaacacugaagguucugcaucugaaguauuagauuguuagcagcaaaauaugaaa

SEQ ID NO: 100170 - RNA, 64 nt, hsa
ugcuuagagagaaaugcaucacuuccaaacccauguauuagagaagaagggcgugaaauuuauc

SEQ ID NO: 100171 - RNA, 64 nt, hsa
cugauagugaucaauuuuuuuauuuauaucucuuguauuagaguuuuaguaauaucuuuuaaua

SEQ ID NO: 100172 - RNA, 64 nt, hsa
guguccauuugcucaaccagacaggaguuaacuuguauuagaauuguuuuuucuaaaguuaugu

SEQ ID NO: 100173 - RNA, 64 nt, hsa
uuugaaacagaguuaacaggauaagguuacacuuguauuagaauuguuuuuuucuaaaguuaug

SEQ ID NO: 100174 - RNA, 64 nt, hsa
aggggaaaucaaaucugguugguaggugucuacaguauuagaagaggguauaagggcacuguuu

SEQ ID NO: 100175 - RNA, 64 nt, hsa
uuugauaccauucuugggcacauacuccaagauuguauuagauuuuugugaugaagagcuucca

SEQ ID NO: 100176 - RNA, 64 nt, hsa
aucagaaccauuuuacuuuaaaauuaauaauauuguauuagagaauauauuaaaugguuauauu

SEQ ID NO: 100177 - RNA, 64 nt, hsa
guaacuaaauucuugcugcccucauacuuuuuauguauuagaaucauauucguauugcccuuuu

SEQ ID NO: 100178 - RNA, 64 nt, hsa
aggucuuuugauguucagaguaacugacuaguuaguauuagaagacccucgagguuuuuuucca

SEQ ID NO: 100179 - RNA, 64 nt, hsa
aguuaaggcuugagaagcucugaauaauucaaaaguauuagacccacacagccuuggagagacc

SEQ ID NO: 100180 - RNA, 64 nt, hsa
uguuugugaagaaaaaaacaaguuaaaaacugaauguacugauuuagaaaauauauauaaauau

SEQ ID NO: 100181 - RNA, 64 nt, hsa
gccaaccacuuauaugaauugaauguaucagaaguguacugaagggacuggagaugguuuuccu

SEQ ID NO: 100182 - RNA, 64 nt, hsa
cauauuaagaaugaucugauugaccguguuggucuguacugauucaauuugauguggugaaaag

SEQ ID NO: 100183 - RNA, 64 nt, hsa
aaacagauguccaucagaugacaagaaaggcugcuguacugaaguaaaacaaacaauaccugaa

SEQ ID NO: 100184 - RNA, 64 nt, hsa
ugauuuucaaugacuguaaauugcgauaaggaaauguacugauugccaauacaccccacccuca

SEQ ID NO: 100185 - RNA, 64 nt, hsa
auagugcagagacuuaccagaagacacaaggaauuguacugaagagcuauuacaauccaaauau

SEQ ID NO: 100186 - RNA, 64 nt, hsa
acaaccaaaccucacacuacuguauuucauuaucuguacugaaagcaaaugcuuugugacuauu

SEQ ID NO: 100187 - RNA, 64 nt, hsa
cagaaguugaugugggaagaaguaaacuggauacuguacugauacuauucaaugcaaugcaauu

SEQ ID NO: 100188 - RNA, 64 nt, hsa
cugugggcauuaacuauauugcuacagcaucuaguguacugagccugcggugcauggcucaggc

SEQ ID NO: 100189 - RNA, 64 nt, hsa
agauggugccccccaaauugucuccacaugaagauguacugaugacgccccagaaaugcugcuu

SEQ ID NO: 100190 - RNA, 64 nt, hsa
ugauuuuuuuuuuuuaauaguaaaaauaagaaucuguacugacuuuucacuuggccauucuggu

SEQ ID NO: 100191 - RNA, 64 nt, hsa
gguuuuaaaggacaagcuacaagcucuguguuucuguacugaugugucacuuauuaaauacuuu

SEQ ID NO: 100192 - RNA, 64 nt, hsa; identical to SEQ ID NO: 51765

SEQ ID NO: 100193 - RNA, 64 nt, hsa; identical to SEQ ID NO: 51766

SEQ ID NO: 100194 - RNA, 64 nt, hsa; identical to SEQ ID NO: 51767

SEQ ID NO: 100195 - RNA, 64 nt, hsa; identical to SEQ ID NO: 51768

SEQ ID NO: 100196 - RNA, 64 nt, hsa; identical to SEQ ID NO: 51769

SEQ ID NO: 100197 - RNA, 64 nt, hsa; identical to SEQ ID NO: 51770

SEQ ID NO: 100198 - RNA, 64 nt, hsa; identical to SEQ ID NO: 51771

SEQ ID NO: 100199 - RNA, 64 nt, hsa; identical to SEQ ID NO: 51772

SEQ ID NO: 100200 - RNA, 64 nt, hsa; identical to SEQ ID NO: 51773

SEQ ID NO: 100201 - RNA, 64 nt, hsa; identical to SEQ ID NO: 51774

SEQ ID NO: 100202 - RNA, 64 nt, hsa; identical to SEQ ID NO: 51775

SEQ ID NO: 100203 - RNA, 64 nt, hsa; identical to SEQ ID NO: 51776

SEQ ID NO: 100204 - RNA, 64 nt, hsa; identical to SEQ ID NO: 51777

SEQ ID NO: 100205 - RNA, 64 nt, hsa; identical to SEQ ID NO: 51778

SEQ ID NO: 100206 - RNA, 64 nt, hsa; identical to SEQ ID NO: 51779

SEQ ID NO: 100207 - RNA, 64 nt, hsa; identical to SEQ ID NO: 51780

SEQ ID NO: 100208 - RNA, 64 nt, hsa; identical to SEQ ID NO: 51781

SEQ ID NO: 100209 - RNA, 64 nt, hsa; identical to SEQ ID NO: 51782

SEQ ID NO: 100210 - RNA, 64 nt, hsa; identical to SEQ ID NO: 51783

SEQ ID NO: 100211 - RNA, 64 nt, hsa; identical to SEQ ID NO: 51784

SEQ ID NO: 100212 - RNA, 64 nt, hsa; identical to SEQ ID NO: 51785

SEQ ID NO: 100213 - RNA, 64 nt, hsa; identical to SEQ ID NO: 51786

SEQ ID NO: 100214 - RNA, 64 nt, hsa; identical to SEQ ID NO: 51787

SEQ ID NO: 100215 - RNA, 64 nt, hsa; identical to SEQ ID NO: 51788

SEQ ID NO: 100216 - RNA, 64 nt, hsa; identical to SEQ ID NO: 51789

SEQ ID NO: 100217 - RNA, 64 nt, hsa; identical to SEQ ID NO: 51790

SEQ ID NO: 100218 - RNA, 64 nt, hsa; identical to SEQ ID NO: 51791

SEQ ID NO: 100219 - RNA, 64 nt, hsa; identical to SEQ ID NO: 51792

SEQ ID NO: 100220 - RNA, 64 nt, hsa; identical to SEQ ID NO: 51793

SEQ ID NO: 100221 - RNA, 64 nt, hsa; identical to SEQ ID NO: 51794

SEQ ID NO: 100222 - RNA, 64 nt, hsa; identical to SEQ ID NO: 51795

SEQ ID NO: 100223 - RNA, 64 nt, hsa; identical to SEQ ID NO: 51796

SEQ ID NO: 100224 - RNA, 64 nt, hsa; identical to SEQ ID NO: 51797

SEQ ID NO: 100225 - RNA, 64 nt, hsa; identical to SEQ ID NO: 51798

SEQ ID NO: 100226 - RNA, 64 nt, hsa; identical to SEQ ID NO: 51799

SEQ ID NO: 100227 - RNA, 64 nt, hsa; identical to SEQ ID NO: 51800

SEQ ID NO: 100228 - RNA, 64 nt, hsa; identical to SEQ ID NO: 51801

SEQ ID NO: 100229 - RNA, 64 nt, hsa; identical to SEQ ID NO: 51802

SEQ ID NO: 100230 - RNA, 64 nt, hsa; identical to SEQ ID NO: 51803

SEQ ID NO: 100231 - RNA, 64 nt, hsa; identical to SEQ ID NO: 51804

SEQ ID NO: 100232 - RNA, 64 nt, hsa; identical to SEQ ID NO: 51805

SEQ ID NO: 100233 - RNA, 64 nt, hsa; identical to SEQ ID NO: 51806

SEQ ID NO: 100234 - RNA, 64 nt, hsa; identical to SEQ ID NO: 51807

SEQ ID NO: 100235 - RNA, 64 nt, hsa; identical to SEQ ID NO: 51808

SEQ ID NO: 100236 - RNA, 64 nt, hsa; identical to SEQ ID NO: 51809

SEQ ID NO: 100237 - RNA, 64 nt, hsa; identical to SEQ ID NO: 51810

SEQ ID NO: 100238 - RNA, 64 nt, hsa; identical to SEQ ID NO: 51811

SEQ ID NO: 100239 - RNA, 64 nt, hsa; identical to SEQ ID NO: 51812

SEQ ID NO: 100240 - RNA, 64 nt, hsa; identical to SEQ ID NO: 51813

SEQ ID NO: 100241 - RNA, 64 nt, hsa; identical to SEQ ID NO: 51814

SEQ ID NO: 100242 - RNA, 64 nt, hsa; identical to SEQ ID NO: 51815

SEQ ID NO: 100243 - RNA, 64 nt, hsa; identical to SEQ ID NO: 51816

SEQ ID NO: 100244 - RNA, 64 nt, hsa; identical to SEQ ID NO: 51817

SEQ ID NO: 100245 - RNA, 64 nt, hsa; identical to SEQ ID NO: 51818

SEQ ID NO: 100246 - RNA, 64 nt, hsa; identical to SEQ ID NO: 51819

SEQ ID NO: 100247 - RNA, 64 nt, hsa; identical to SEQ ID NO: 51820

SEQ ID NO: 100248 - RNA, 64 nt, hsa; identical to SEQ ID NO: 51821

SEQ ID NO: 100249 - RNA, 64 nt, hsa; identical to SEQ ID NO: 51822

SEQ ID NO: 100250 - RNA, 64 nt, hsa; identical to SEQ ID NO: 51823

SEQ ID NO: 100251 - RNA, 64 nt, hsa
ugcccuccgccacagacuuugcccggccucaucugccuggcacgcaccaccagucacaaccuau

SEQ ID NO: 100252 - RNA, 64 nt, hsa
cccaggacacccgggccaugccccuggcugggcagccuggcacaagugaagaagaaggcagugg

SEQ ID NO: 100253 - RNA, 64 nt, hsa
uaaucucauucaaauggagacgcccucugcaaaggccuggcagggggaggcacguuucaucugu

SEQ ID NO: 100254 - RNA, 64 nt, hsa
ggaaucggugggacaguuuccuguggccagccgagccuggcagugcuggcaccgcgagcuggcc

SEQ ID NO: 100255 - RNA, 64 nt, hsa
uagacugcccccugccacccuggcacuucccagggccuggcaguauggucugaugggcaguaug

SEQ ID NO: 100256 - RNA, 64 nt, hsa
acuguugucuagagauggagccagcaggcugguagccuggcagccuacaucuccccucagccuc

SEQ ID NO: 100257 - RNA, 64 nt, hsa
uguucacuguuauaucucuagugcuuagcacaaugccuggcauuucaauaaauguuuggacaaa

SEQ ID NO: 100258 - RNA, 64 nt, hsa
ccuaaagacacucaccccugcagugcaugggacagccuggcacaaugaagaauuagcccuccca

SEQ ID NO: 100259 - RNA, 64 nt, hsa
aggggauucagugagugugaaggugaacaggauggccuggcagcagggauguuuccgugagcca

SEQ ID NO: 100260 - RNA, 64 nt, hsa
agccaggacacgccuggaugagaaagccugaggugccuggcaugcccaccggugccacucugca

SEQ ID NO: 100261 - RNA, 64 nt, hsa
uuuaccaaguaccaacaguagaaguaacaggaaagccuggcagaguuaaauaucuuggacauuu

SEQ ID NO: 100262 - RNA, 64 nt, hsa
ugguaacaaagcauagcaguucucuaggggagaggccuggcauugcacaugguguuacauggcu

SEQ ID NO: 100263 - RNA, 64 nt, hsa
agccaaugaagacugugcucgcuggguggugcaggccuggcaccaggaggcuugcacccgccuu

SEQ ID NO: 100264 - RNA, 64 nt, hsa
gugccauucuggaagcuccagcugcugcugggcugccuggcacugcccgcuugccggucagggc

SEQ ID NO: 100265 - RNA, 64 nt, hsa
aagcaaaggagggccuugaggaagcagcccccaggccuggcagccacgcagcggcugagcucau

SEQ ID NO: 100266 - RNA, 64 nt, hsa
gcucaccccugagcccacagccccugcuugggcugccuggcacccucaggguggcccggccucc

SEQ ID NO: 100267 - RNA, 64 nt, hsa
aaugggucagaaacccaggccagcugggcucuaagccuggcauccugucaugcuuaguccuuca

SEQ ID NO: 100268 - RNA, 64 nt, hsa
acugaccugguccacagggcaccugccacccugggccuggcagcucagcuuccccaacacgcag

SEQ ID NO: 100269 - RNA, 64 nt, hsa
aaugaauuaaauuccagagaacaauggaagcauugccuggcagaugucacaacagaauaaccac

SEQ ID NO: 100270 - RNA, 64 nt, hsa
gcagaugucacaacagaauaaccacuuguuuggagccuggcacaguccuccagccugaucaaaa

SEQ ID NO: 100271 - RNA, 64 nt, hsa
ccugugcugacagcgcucccucaggagggccuuggccuggcacggcugugcuccuccccugcuc

SEQ ID NO: 100272 - RNA, 64 nt, hsa
aggagggggccgcuguccaccugcccagugcuuggccuggcaguggcuucagagaggaccuggu

SEQ ID NO: 100273 - RNA, 64 nt, hsa
uuuaggaagggaaauggcuacuuggccagccauugccuggcauuugguaguauaguaugauucu

SEQ ID NO: 100274 - RNA, 64 nt, hsa
cauuucugggccaccucagggaacccaugcaucugccuggcauuuaggcagcagagccccugac

SEQ ID NO: 100275 - RNA, 64 nt, hsa
auacauggcaaaucugaauauuguuuuaugagaggccuggcaauggguaaaacaccaaacuuga

SEQ ID NO: 100276 - RNA, 64 nt, hsa
uuuucauauuuaugucccuaguaucugguauggcgccuggcauauggcauuucagaauauguuc

SEQ ID NO: 100277 - RNA, 64 nt, hsa
aaugauuaagugcauguaaagcauuaagcauagcgccuggcaguaagugcucaauauuaugacu

SEQ ID NO: 100278 - RNA, 64 nt, hsa
uggauuacagguguaagccaccgcaccccgcccagccuggcagauuuuauuuaaucauuuguag

SEQ ID NO: 100279 - RNA, 64 nt, hsa
gcccugauaagcaaaagcaguccccacagccacagccuggcagcucugaucaggaaagugagga

SEQ ID NO: 100280 - RNA, 64 nt, hsa
gcaggaguuccaccaccucuggaacaagauuaaggccuggcagaaaauuuucaaacacuaugac

SEQ ID NO: 100281 - RNA, 64 nt, hsa
ccgggccuggagaacuagagaaggacccggaggggccuggcagccgugccuucagcucuacagc

SEQ ID NO: 100282 - RNA, 64 nt, hsa
gagacugucucaagagggcacugguggcccgacagccuggcacagggcagugggacagggcaug

SEQ ID NO: 100283 - RNA, 64 nt, hsa
ccgugagcucaggcaggccugacccggcggcacagccuggcagggaccucguccccaagccugg

SEQ ID NO: 100284 - RNA, 64 nt, hsa
cggcggcacagccuggcagggaccucguccccaagccuggcagaaugagagggguugagguccc

SEQ ID NO: 100285 - RNA, 64 nt, hsa
gggccagagcaagcgcuguaaacccugacggugggccuggcacacgccuguauucccacaccag

SEQ ID NO: 100286 - RNA, 64 nt, hsa
ccgugcauggguuggcuguggggaccccaggugggccuggcaggacuccagaugaggacaagag

SEQ ID NO: 100287 - RNA, 64 nt, hsa
uggccuggcaucugugcgcguggcguggcccguggccuggcaucugugugcguggcuaucagga

SEQ ID NO: 100288 - RNA, 64 nt, hsa
uggccuggcaucuguguguguggcguggcccguggccuggcaucugugcgcguggcguggcccg

SEQ ID NO: 100289 - RNA, 64 nt, hsa
uggccuggcaucugugugcguggcguggcccguggccuggcaucuguguguguggcguggcccg

SEQ ID NO: 100290 - RNA, 64 nt, hsa
uggcuuggcaucugugugcgugguguggcccguggccuggcaucugugugcguggcguggcccg

SEQ ID NO: 100291 - RNA, 64 nt, hsa
cgaguacaaggacagacagcaggcacggcccgcagccuggcaucugugcguguggcguggcccg

SEQ ID NO: 100292 - RNA, 64 nt, hsa
cauuaugcugcuauugaagaagcauuagggguaugccuggcaggugugagcauccuggcucgcu

SEQ ID NO: 100293 - RNA, 64 nt, hsa
ccuggagccuacaaguggucuggguuagaggcgagccuggcaggcagcacagacugaacucaga

SEQ ID NO: 100294 - RNA, 64 nt, hsa
ugaugucaucauugacagccuuugcuucgugggggccuggcagggccccugccuccccgacccc

SEQ ID NO: 100295 - RNA, 64 nt, hsa
ugguggggaagggacuugagcugggcaaguccuggccuggcacccgcagccgucucccuuccgu

SEQ ID NO: 100296 - RNA, 64 nt, hsa
uggucacuuuugugcuugaggaggcccauuuucugccuggcagggggcaggucugugcccuccc

SEQ ID NO: 100297 - RNA, 64 nt, hsa
ggaggaacccauuugugcucugcuuggacagcaggccuggcacugggaggugggggugagcccc

SEQ ID NO: 100298 - RNA, 64 nt, hsa
caggcagccuucugaucaguacugcucuccuagggccuggcacacugcagcugcccuguaaaug

SEQ ID NO: 100299 - RNA, 64 nt, hsa
guuuucaccagagugagcuccuucuggacauacugccuggcagccugccuuccuagggagcugg

SEQ ID NO: 100300 - RNA, 64 nt, hsa
gauuugacugccuuaaaaacacaaggcccucuaggccuggcagggaugucccugugcccagcac

SEQ ID NO: 100301 - RNA, 64 nt, hsa
ccuggcagggaugucccugugcccagcacagggugccuggcagggggagaccacagguaugcag

SEQ ID NO: 100302 - RNA, 64 nt, hsa
cagauaggagagcacugagcccggauaguucucagccuggcaaguggcucugaagcugccuuca

SEQ ID NO: 100303 - RNA, 64 nt, hsa
uugcagugagccaagaucgcgccacugcacuccagccuggcaauagggcgagacuccgucucaa

SEQ ID NO: 100304 - RNA, 51 nt, hsa
cuaucuacucucuggccuaacggagcccacccaggcacagccaccacuuug

SEQ ID NO: 100305 - RNA, 64 nt, hsa
gccccuuuggggaagaggagggugcauuuuccauggagcccaugucagaguccacuccagcuca

SEQ ID NO: 100306 - RNA, 64 nt, hsa
gccagaguuguucucaggggugcuggggcagaguggagcccagggugcugggauggcuauauua

SEQ ID NO: 100307 - RNA, 64 nt, hsa
cacugcccuccagggccaggauucaggccucugaggagcccacggggcaaagcugcugggccag

SEQ ID NO: 100308 - RNA, 64 nt, hsa
gcaaccggccccagcagcagguccuggugcuggcggagcccaggcgcaagccaucuaccuucug

SEQ ID NO: 100309 - RNA, 64 nt, hsa
ccaggagcagagccagggccuggcgagcuggcguggagcccacaggauucagcagcauggacag

SEQ ID NO: 100310 - RNA, 64 nt, hsa
ggcgggagccucucagcuguccagauucagaacuggagcccacuccuccucccucucguugccu

SEQ ID NO: 100311 - RNA, 64 nt, hsa
cacagaugaacugccucuccuccucccugccuggggagcccaguggccagggaggggaguggug

SEQ ID NO: 100312 - RNA, 64 nt, hsa
gaacuaaagaccuauuggggcuggcccugguggaggagcccagggcaugaagcccaaggcagcu

SEQ ID NO: 100313 - RNA, 64 nt, hsa
uccuuugucuuucucagguauguauuacaggaugggagcccauauaugcgguccaugaaacaga

SEQ ID NO: 100314 - RNA, 64 nt, hsa
gcuggacuuaagguaggagccgaaagugggcaugggagcccauccccgugggugugaggccggg

SEQ ID NO: 100315 - RNA, 64 nt, hsa
cgugcggguccccuccuggccggcagagggcgcaggagcccaggagauggccucagcguggcca

SEQ ID NO: 100316 - RNA, 51 nt, hsa
cagcugggaaggaggcuuaguggagcccacgugggccucuggggugcacau

SEQ ID NO: 100317 - RNA, 64 nt, hsa
aagcagauucgccccagagccuccaggcgugaguggagcccaguccagcgacaccuugguuugg

SEQ ID NO: 100318 - RNA, 64 nt, hsa
ggcccagagcugagaugggagugcgguacaaucuggagcccacagcugucggucagaaccuccu

SEQ ID NO: 100319 - RNA, 64 nt, hsa
ucugcuuuuagaaauguagacauaaacacuccccggagcccacucaccuuuuuucuuuuucuuu

SEQ ID NO: 100320 - RNA, 64 nt, hsa
caggggagacaggagccuagcggagcccagccugggagcccagaggguggcaagaacagugggc

SEQ ID NO: 100321 - RNA, 64 nt, hsa
ccuaacuaacuggcaggggagacaggagccuagcggagcccagccugggagcccagaggguggc

SEQ ID NO: 100322 - RNA, 64 nt, hsa
cagugagcaugccgggccccuccauccacccgggggagcccagugaagccucugagggauugag

SEQ ID NO: 100323 - RNA, 64 nt, hsa
cucaagacaagcccacgcccuugucagcuuagggggagcccaguccugagggcugcaucucugu

SEQ ID NO: 100324 - RNA, 64 nt, hsa
gaaagcuuccugaguggugucgggucccagagagggagcccaccugcugccugggggagagccu

SEQ ID NO: 100325 - RNA, 64 nt, hsa
cccccacucugggcacuaggugggcccuugaaggggagcccaacucgugggccugaugaaagcu

SEQ ID NO: 100326 - RNA, 64 nt, hsa
uuccucuuccugaagcccuacagaguuagggaauggagcccaggcaccaggggucuaaagugug

SEQ ID NO: 100327 - RNA, 64 nt, hsa
uuuuaccgugcacguaaauuggucagcagaaaagggagcccagaaaaggcagcagauggaccau

SEQ ID NO: 100328 - RNA, 64 nt, hsa
agcacagagccgggcagacgcagcaccugcauggggagcccagugcccggcacagcacaggggc

SEQ ID NO: 100329 - RNA, 64 nt, hsa
ugccaaggggaggagcgacaccuccaggcuuccgggagcccagagagcauguggcaggcagugg

SEQ ID NO: 100330 - RNA, 64 nt, hsa
aggaagccccgcccagacgguguucagggaacccggagcccaagcgcuccggcggagcccaaaa

SEQ ID NO: 100331 - RNA, 64 nt, hsa
guguucagggaacccggagcccaagcgcuccggcggagcccaaaagggugggggugggaggggc

SEQ ID NO: 100332 - RNA, 64 nt, hsa
cacaugcccacagcagccucggugacgagagcacggagcccaagagguggggugucguggcucu

SEQ ID NO: 100333 - RNA, 64 nt, hsa
ccgcagguuugggccgacacgcggaaggccggguggagcccauccaugcugugguguugccucg

SEQ ID NO: 100334 - RNA, 64 nt, hsa
cguggcgucagcccagcugcaggagaagcuggcaggagcccagcgccagcuggggcagcuccgg

SEQ ID NO: 100335 - RNA, 64 nt, hsa
aauuaauucccaaucccccauuccaccagggcugggagcccauucccagugcuucccaaggccc

SEQ ID NO: 100336 - RNA, 64 nt, hsa
cccgggugggcugcucagggcagcugccgaagguggagcccagagccugucuggaagggcuguc

SEQ ID NO: 100337 - RNA, 64 nt, hsa
uggucgcugagacagagauggaagccaggacaagggagcccaccgggcccagauagguacagag

SEQ ID NO: 100338 - RNA, 64 nt, hsa
ccuugggcaacuccugccaccacccccuccccagggagcccaaggcaggggaggcucagcaugg

SEQ ID NO: 100339 - RNA, 64 nt, hsa
uguagugauuacacuugaauuguguacuuaguguguaugugauccuccaguguuaucccggaga

SEQ ID NO: 100340 - RNA, 64 nt, hsa
auuuaaaccaaaaugaacugauacuuguuggaauguaugugaacuaauugcaauuauauuagag

SEQ ID NO: 100341 - RNA, 64 nt, hsa
gagguuggcaauauagacaaaguggaaaucauuaguaugugagggccuugauuguuauguaaua

SEQ ID NO: 100342 - RNA, 64 nt, hsa
uuuauucugaagguaauuaaauuuagacuauguaguaugugacagaauuuuuuuaaaauuauaa

SEQ ID NO: 100343 - RNA, 64 nt, hsa
acuuaguacauuaagaaugacuacacuguuccucguaugugaaggaggcagugcugacuccgug

SEQ ID NO: 100344 - RNA, 64 nt, hsa
cuuguucagguuaguacccgcaaaacgggacauaguaugugacaaucugcaucgaucauggacu

SEQ ID NO: 100345 - RNA, 64 nt, hsa
uugauucagacugucagucuauuccugggcaguaguaugugauguccagcacccuaaccccgac

SEQ ID NO: 100346 - RNA, 64 nt, hsa
auaacuguucuugggccacuuuacagagauaaauguaugugaauguuuaugauaaacgcuuaaa

SEQ ID NO: 100347 - RNA, 64 nt, hsa
cauugcaauuugauuuaagccuacuagagccauuguaugugacagcuauauuguauuacaaagu

SEQ ID NO: 100348 - RNA, 64 nt, hsa
uaaaacuagcuuauaguuuaacuuaacuuguuguguaugugaauuuagggauggaaacuuuuuu

SEQ ID NO: 100349 - RNA, 64 nt, hsa
gauaauagguuuuucauaaagaaacguaggguguguaugugaaaguggggugagguucccuggu

SEQ ID NO: 100350 - RNA, 64 nt, hsa
acccccuuucagccacugggucccuuagugcuguguaugugacugcuguagcauuccacugcac

SEQ ID NO: 100351 - RNA, 64 nt, hsa
gaaugagacauauucccaaaaaauucuuaucucuguaugugauuggaaaagaaaagaucacauu

SEQ ID NO: 100352 - RNA, 64 nt, hsa
ccucuccaaaauucauguacuuccuggagccucaguaugugaccuuauuuggaaauacuguggu

SEQ ID NO: 100353 - RNA, 63 nt, hsa
ugaaaagaugcuggauaggcuaccaaaguucccaagugguagauaauucagaagacuuguuug

SEQ ID NO: 100354 - RNA, 63 nt, hsa
aacuacuuuggaagcgucaguggauauauuugaaagugguaauccugaaucucuuuuaaacua

SEQ ID NO: 100355 - RNA, 63 nt, hsa
acagaaugauauuagaaaauguuuuccuuguuuaagugguaguugaacauagaacuuggguau

SEQ ID NO: 100356 - RNA, 63 nt, hsa
gaacuuaagaugaauuauaaaaaugauggauauaagugguagcucuaucuggugaagugucuu

SEQ ID NO: 100357 - RNA, 63 nt, hsa
uugagcagaucugauuauucuuggauaguauucaagugguaucuugacuauuaaacuacguau

SEQ ID NO: 100358 - RNA, 63 nt, hsa
agcagauuuuucuuuagucaugaaaaauaucucaagugguaaguuguuugugcuuuaggcaaa

SEQ ID NO: 100359 - RNA, 63 nt, hsa
uucucauuaaaucuguaaaucaccucuauaaguaagugguaauaauaaagcagauauuuuugu

SEQ ID NO: 100360 - RNA, 63 nt, hsa
cuuaauagggugguacccuggaaaggaucugggaagugguagaauuucuggucuguacuuuua

SEQ ID NO: 100361 - RNA, 63 nt, hsa
agauggagagagcacuuccccguaacgaaagcaaagugguaagcacagggugagacccuuuua

SEQ ID NO: 100362 - RNA, 63 nt, hsa
agaucuucuuuucuaauagccauuugccaccccaagugguaugucggccauuucuccuuaaaa

SEQ ID NO: 100363 - RNA, 63 nt, hsa
ugguauauguaugcugauuuacuacuuaugcguaagugguaugcaugggaugucugaaaucag

SEQ ID NO: 100364 - RNA, 63 nt, hsa
ucauauucugaagucucaccacacauaauaaccaagugguagacucacagccguccaacuuaa

SEQ ID NO: 100365 - RNA, 63 nt, hsa
uaucccugaaguucaaaagacuuauauauguauaagugguaugugauauaaaucguguguuuc

SEQ ID NO: 100366 - RNA, 63 nt, hsa
ggguacauaugugaacauuccagccuucagcauaagugguaguccaaauuuucuuuaagcagc

SEQ ID NO: 100367 - RNA, 64 nt, hsa; identical to SEQ ID NO: 53427

SEQ ID NO: 100368 - RNA, 64 nt, hsa; identical to SEQ ID NO: 53428

SEQ ID NO: 100369 - RNA, 64 nt, hsa; identical to SEQ ID NO: 53429

SEQ ID NO: 100370 - RNA, 64 nt, hsa; identical to SEQ ID NO: 53430

SEQ ID NO: 100371 - RNA, 64 nt, hsa; identical to SEQ ID NO: 53431

SEQ ID NO: 100372 - RNA, 64 nt, hsa; identical to SEQ ID NO: 53432

SEQ ID NO: 100373 - RNA, 64 nt, hsa; identical to SEQ ID NO: 53433

SEQ ID NO: 100374 - RNA, 64 nt, hsa; identical to SEQ ID NO: 53434

SEQ ID NO: 100375 - RNA, 63 nt, hsa
uucauuuuugauguuuugugaagaauuuaaauuuaaacgaauguucuuaaaucaagugugauu

SEQ ID NO: 100376 - RNA, 63 nt, hsa
gaggcgucucacauuuuuacuugguguaauuaauaaacgaagauaaaucauaguguaugugua

SEQ ID NO: 100377 - RNA, 63 nt, hsa
acaagcaauaacucucuacaggaauauauuuuuuaaacgaagagacagaacuguccacaucug

SEQ ID NO: 100378 - RNA, 59 nt, hsa
ggcauugcuguguucaguagaaggaaauguaaacgaaggcugacuugauugugccauuu

SEQ ID NO: 100379 - RNA, 63 nt, hsa
gggcugaaucauaaucacaaggcuuaauuuugauaaacgaauccagugaccuaaggauuuucu

SEQ ID NO: 100380 - RNA, 63 nt, hsa
acuauuaggaauugagaagggggaucaacuaaauaaacgaagagagucuuucuuaugccuucc

SEQ ID NO: 100381 - RNA, 63 nt, hsa
agcauacuauaaagcaaauaucuauuauucuccuaaacgaaugccuagcauagagaaaauacu

SEQ ID NO: 100382 - RNA, 63 nt, hsa
cauaaauggaaagauacaaaugcuuugaaggaauaaacgaaauguuaaaacagggucaaucca

SEQ ID NO: 100383 - RNA, 63 nt, hsa
auuuucaaaaucugcccucagaugaaaauaaaauaaacgaaacauuuagacaauggcuauauu

SEQ ID NO: 100384 - RNA, 63 nt, hsa
agugggaggagucaaugucauucuaccccucgcuaaacgaagauauuaacaucuauugcuuuu

SEQ ID NO: 100385 - RNA, 63 nt, hsa
ccacugaugugucuaaaugagcaugacaggaacuaaacgaaacugauuaaauguaugagaaau

SEQ ID NO: 100386 - RNA, 63 nt, hsa
gguuaccccaucaggaggacauggcacuaucuuuaaacgaaacaaagacaauuuauaauuuga

SEQ ID NO: 100387 - RNA, 63 nt, hsa
aucccguuggagguuuugaaguccaacaaauuuuaaacgaauccaaaguguucucacacguca

SEQ ID NO: 100388 - RNA, 63 nt, hsa
uguguaauaaugcucaaccuucaugucuccguauaaacgaaacuuuccaugagagcucaugac

SEQ ID NO: 100389 - RNA, 63 nt, hsa
ggggcagggagcuggggacauuuuaaucaucaauaaacgaagcacuuuauucuguacagauuu

SEQ ID NO: 100390 - RNA, 63 nt, hsa
gauuuuagucuuucuuacacauaugugugauuuuaaacgaauauucucagaccacaggaaacu

SEQ ID NO: 100391 - RNA, 63 nt, hsa
aagucuuucauggcugcuguugcuuaaaccacuuaaacgaagaguucccuugaaacuuuggga

SEQ ID NO: 100392 - RNA, 63 nt, hsa
uccagcugcguacagucuaguaaccagcaacuguaaacgaaccugugccucuaacaagcgauu

SEQ ID NO: 100393 - RNA, 63 nt, hsa
guuuauauucagguuggauuaugcauguuuagguaaacgaaagcugugucuuacuugauuuau

SEQ ID NO: 100394 - RNA, 63 nt, hsa
acugacaugagaaaagaggagcuguuuugguauuaaacgaauaaaaucuuaagcaaauauagg

SEQ ID NO: 100395 - RNA, 63 nt, hsa
cuuccucuacguuuauccuggcaugugcuaggguaaacgaaggcauaauaagccauggcugac

SEQ ID NO: 100396 - RNA, 63 nt, hsa
gcuuuuuuuguuuguuuccaacgaagcugcuguuaaacgaaacugagaaaaacuuugccccgg

SEQ ID NO: 100397 - RNA, 63 nt, hsa
gucugcgcggauguagcauguucuauguguuuuuaaacgaagauccgagcgacggcuccuccc

SEQ ID NO: 100398 - RNA, 63 nt, hsa
aaacacuguaagcuuuuaagaaaaacaaaguuuuaaacgaaauacugcucuguccagaggcuu

SEQ ID NO: 100399 - RNA, 63 nt, hsa
gguagaggcaggcccuccuccacuucuugguacuaaacgaagaucucgacaccuugcaguuuu

SEQ ID NO: 100400 - RNA, 63 nt, hsa
uucagaauucaacauuaaagauuaauguuuauuuaaacgaacacauuccugcauucaggaugu

SEQ ID NO: 100401 - RNA, 63 nt, hsa
acuuagaagcaaguagaaaauaauugguugauguaaacgaaagugccauuuuaguaaaggcag

SEQ ID NO: 100402 - RNA, 63 nt, hsa
cggguggaagcuuucaucgaguugaacaggacuuaaacgaaucaucagggaccggauauuucu

SEQ ID NO: 100403 - RNA, 63 nt, hsa
aacuaaucggaacauguaaaacaguuacaaaaauaaacgaacucuccucuuguccuacaauga

SEQ ID NO: 100404 - RNA, 63 nt, hsa
gaugcaggagaaguugggcaaaagcccucaggauaaacgaauaagucauucagaguaggugcu

SEQ ID NO: 100405 - RNA, 63 nt, hsa
cucuagggucugaugcuguuuuuguuccaaauauaaacgaaaggcacuagucagccgccugca

SEQ ID NO: 100406 - RNA, 63 nt, hsa
aucgaauaacagcuaaacaaaucgaauaacagcuaaacgaaucgaauaacagcuuuuguacau

SEQ ID NO: 100407 - RNA, 63 nt, hsa
uauuaugcaaaguaccaacugagccaaaaacaauaaacgaaacacagaacucagccuuaagaa

SEQ ID NO: 100408 - RNA, 63 nt, hsa
uucaacaguauugcguugucagacuaggaaagcuaaacgaacaaaaugguuuuaguuuugcug

SEQ ID NO: 100409 - RNA, 63 nt, hsa
auuguuaaaauuagauaacuuacuuacauugaauaaacgaaugcguuuuauugguaacagaua

SEQ ID NO: 100410 - RNA, 63 nt, hsa
aucuuuaaaguuaaugucuagccaagaguuuaguaaacgaagaauuaaacugcacuguugauc

SEQ ID NO: 100411 - RNA, 63 nt, hsa
gauggaaauggaauagauuucuuuuuaaaguuuuaaacgaauauuuugacugaaaaauuuugg

SEQ ID NO: 100412 - RNA, 63 nt, hsa
cagccugggagacugcaucucaaaaaagaaaaauaaacgaaguaaaagauauuuaucagagcu

SEQ ID NO: 100413 - RNA, 63 nt, hsa
accagcugaggguguauuauaugcagaauuacauaaacgaagcucucaaagguaaggagcccu

SEQ ID NO: 100414 - RNA, 63 nt, hsa
cuuggcuagaaauguuuuugugauuuaugcgauuaaacgaaaugauaaagauaaaaccauauu

SEQ ID NO: 100415 - RNA, 63 nt, hsa
uaaaaaugcaaauaaauauuucauuuuuauuuguaaacgaauacaccaaaaggaggcgcucuu

SEQ ID NO: 100416 - RNA, 63 nt, hsa
acccucucucaugaacucuuugaugaggauuuguaaacgaaaacagacucgaacuauugugua

SEQ ID NO: 100417 - RNA, 63 nt, hsa
aaauguugauuuuuuaauauuagauaaaacgaguaaacgaaauuccccagaaauuaguaguaa

SEQ ID NO: 100418 - RNA, 63 nt, hsa
ucaaagaaaaacucuucauuucucccugauucuuaaacgaaggugguuaauagaaacucaggc

SEQ ID NO: 100419 - RNA, 63 nt, hsa
agaagagaaauugcuggguuuagaacaagauuauaaacgaauucggugcucagugaucacuug

SEQ ID NO: 100420 - RNA, 63 nt, hsa
aguucuuccuccaccuccacccagugaucccaauaaacgaauucugucuccccgugccaugug

SEQ ID NO: 100421 - RNA, 63 nt, hsa
ugcggguaacagacaauauaauagccccgaccuuaaacgaagcuuuuguacugcagaauacau

SEQ ID NO: 100422 - RNA, 63 nt, hsa
guguuugauguucaaaacaaaauguuacaacaauaaacgaacauaacauaaacugaaugcauu

SEQ ID NO: 100423 - RNA, 63 nt, hsa
uuguuucugaagaugguuuaaguuauagcuucuuaaacgaaagaauaaaauacugcaaaaugu

SEQ ID NO: 100424 - RNA, 63 nt, hsa
guuuacuagcagccuggaauuugccacuuuuucuaaacgaagauuuauggaacacuuaccaca

SEQ ID NO: 100425 - RNA, 63 nt, hsa
gaaggaacuuaaccgcuagugccgaggacacguuaaacgaacaggaugggccgggcacggugg

SEQ ID NO: 100426 - RNA, 63 nt, hsa
agcagaauuaugucuguagaguuggaagagaauuaaacgaaaaucauuguuaauugcugaggc

SEQ ID NO: 100427 - RNA, 63 nt, hsa
guagagcuuuuuuccuuuccuaagcccuguaaauaaacgaaggcacuucuuuggaagguuaug

SEQ ID NO: 100428 - RNA, 63 nt, hsa
gucacagguuuuauaauaaauuauguuauuauguaaacgaauugcaugcauguugaaauuuuu

SEQ ID NO: 100429 - RNA, 63 nt, hsa
gguuuauggcagguaauuuuuuguaauguguauuaaacgaaguucaaagauuagaaauacauc

SEQ ID NO: 100430 - RNA, 63 nt, hsa
cacacacacacacacgcacguccacacucacauuaaacgaaagcuuuauuugaagcaaagcua

SEQ ID NO: 100431 - RNA, 64 nt, hsa
uaggacugacuggguucuuccucccuccccgaagcccagacaguucaguugggcuggggguugc

SEQ ID NO: 100432 - RNA, 64 nt, hsa
agacauaacugagcugaaguaauuccauaaagggcccagacagccuccuccaccauucccuuca

SEQ ID NO: 100433 - RNA, 64 nt, hsa
gacccagagguaaggcugccuggcugccccaaaccccagacacuccucuccuugccugcaggcu

SEQ ID NO: 100434 - RNA, 64 nt, hsa
ugcucauuauaccccaaagaccuuuuuuccacugcccagacagcuuauaccacccaguguucag

SEQ ID NO: 100435 - RNA, 64 nt, hsa
ccuucccagccacugacucacaguucucuggaugcccagacaccucucuucagggaagaugagu

SEQ ID NO: 100436 - RNA, 64 nt, hsa
acuggaaaucaucacagcagugggauaucagagccccagacagcacugccucuuccuccccacc

SEQ ID NO: 100437 - RNA, 64 nt, hsa
ugcuucuugugaaaccacaggcccuugggguucccccagacagagccgcaaaucaaccccagac

SEQ ID NO: 100438 - RNA, 64 nt, hsa
uuuuaaauggugggaacccuccccaaaaccuuuccccagacacauucuccugugccccucagag

SEQ ID NO: 100439 - RNA, 64 nt, hsa
ucccgaaguuucgauuugauuagucugggguggacccagacauguuaaguauuuuuuaaguucc

SEQ ID NO: 100440 - RNA, 64 nt, hsa
ggucagacagugacuaauccagggccguggcauucccagacagcacaccacugugguccccucc

SEQ ID NO: 100441 - RNA, 64 nt, hsa
ugacuguagccaucaccagaacacuuaguuucuucccagacaugaauuuccugacaggcucuga

SEQ ID NO: 100442 - RNA, 64 nt, hsa
gacgguugaagaaucaagcucauaauaugauacacccagacagacccagaaaucuuuugauuuc

SEQ ID NO: 100443 - RNA, 64 nt, hsa
cauagaucauaguccaauccccuagacccaaaggcccagacacgcaggguucucuauuucucuu

SEQ ID NO: 100444 - RNA, 64 nt, hsa
ucagagaaggagacaccuccuggaggccccaguccccagacaguuucagccagcgcugaggaaa

SEQ ID NO: 100445 - RNA, 64 nt, hsa
aaguaucuucgcagugcucuguucccuccgucuccccagacaucugacacccuaaaagccaucc

SEQ ID NO: 100446 - RNA, 64 nt, hsa
aggaggaagcgaugccgagguaggaaaggccagccccagacauccuaucgccacaaugccaugu

SEQ ID NO: 100447 - RNA, 64 nt, hsa
ccuggcuguguuccugagcccccgucgugccucucccagacagcagcugucuggcccuugcugg

SEQ ID NO: 100448 - RNA, 64 nt, hsa
caaguggucacaaagaggguggcugugaggugaccccagacacugcagaacgaugugcacccuc

SEQ ID NO: 100449 - RNA, 64 nt, hsa
ggcaguccccccacgcccgagaaagccugggggacccagacaccuguccccacagucaaagccu

SEQ ID NO: 100450 - RNA, 64 nt, hsa
ccagacaccuguccccacagucaaagccuggggacccagacauccuguccccacagucagccuc

SEQ ID NO: 100451 - RNA, 64 nt, hsa
cagacccggacagacagacacagccugaaacagacccagacaaacagacagacagacacagccu

SEQ ID NO: 100452 - RNA, 64 nt, hsa
gacaaacagacagacagacacagccugaaacagacccagacagacagacagacagccugaaaca

SEQ ID NO: 100453 - RNA, 64 nt, hsa
gacccagacagacagacagacagccugaaacagacccagacacagccugaaacagauccggaca

SEQ ID NO: 100454 - RNA, 64 nt, hsa
uccggacagacagacagaaacagccugaaacagacccagacagacagacagacacagccugaaa

SEQ ID NO: 100455 - RNA, 64 nt, hsa
cagaccuagacagacagacacagauugaaacagacccagacaaacagacagacacagccugaaa

SEQ ID NO: 100456 - RNA, 64 nt, hsa
cccagacaaacagacagacacagccugaaacagacccagacacagccugaaacagacccggaca

SEQ ID NO: 100457 - RNA, 64 nt, hsa
cccggacagacagacagacacagccugaaacagacccagacagacagacagacacagccugaaa

SEQ ID NO: 100458 - RNA, 64 nt, hsa
cccagacagacagacagacacagccugaaacagacccagacagacagaccgacgcagccugaaa

SEQ ID NO: 100459 - RNA, 64 nt, hsa
cccagacagacagaccgacgcagccugaaagagacccagacagagagacaggcagacacagccu

SEQ ID NO: 100460 - RNA, 64 nt, hsa
acugauggcucugacaccguguugguggcgaugucccagacaaucccaccaggacggcccagac

SEQ ID NO: 100461 - RNA, 64 nt, hsa
gguggcgaugucccagacaaucccaccaggacggcccagacaucccuacuggcuucgcuggugg

SEQ ID NO: 100462 - RNA, 64 nt, hsa
gagcagagguuggccucccuggaggagcagguggcccagacagcccaagcccugcacuggaucg

SEQ ID NO: 100463 - RNA, 64 nt, hsa
gacugucaggauaaacuccguggggguacaggagcccagacaaagcccaggccugucaagagac

SEQ ID NO: 100464 - RNA, 64 nt, hsa
uuucuuggggacccaguauguccucuccucuagacccagacauacaguuauaaccgucuguccu

SEQ ID NO: 100465 - RNA, 64 nt, hsa
caucaaccagggcagauccaccgugcccugguuccccagacauuccagaaugccccacaucauu

SEQ ID NO: 100466 - RNA, 64 nt, hsa
aacacacaggaacagagaaaugguugaugucagacccagacauagaauguuggagcaaaagcuc

SEQ ID NO: 100467 - RNA, 64 nt, hsa
aacccguagauacagagaaguggucgauuccagacccagacauagaauguuugaacaaagacuc

SEQ ID NO: 100468 - RNA, 64 nt, hsa
agugaguguauuuuccuuguguauauauuaaacacacccauacaaacauugguaaaguugauua

SEQ ID NO: 100469 - RNA, 64 nt, hsa
acucucuucugcaauuuugacaccucaauauucacacccauaaacauuacuaagccccaguucu

SEQ ID NO: 100470 - RNA, 64 nt, hsa
agaaaauuuggaaacuauaaauuuagaaacguaucacccauacguccaacaucgaaagaaaacc

SEQ ID NO: 100471 - RNA, 64 nt, hsa
uuacuuuuuauuucuaaaguuguagugaagcucucacccauaauaaagguugugaauguucugu

SEQ ID NO: 100472 - RNA, 64 nt, hsa
ugagguuuuaccuccuccauuccugaccaauaaccacccauaacuacggcauucucugugacuu

SEQ ID NO: 100473 - RNA, 64 nt, hsa
gagagaagggagaaaaaaaaaaaaaaaccacacacacccauacacacauaccagaaaaagaaag

SEQ ID NO: 100474 - RNA, 64 nt, hsa
gcccguaugugcaggaccucagggugccagcccucacccauacaccuccagggcugcaggucau

SEQ ID NO: 100475 - RNA, 64 nt, hsa
uaucuuauuuucucaaucuccucucucuuuccuccacccauaauaagagaauguuccuacucac

SEQ ID NO: 100476 - RNA, 64 nt, hsa
ucugucuaugggaccaguggcuuggauucugccacacccauaaauccuuguguguuaacuucua

SEQ ID NO: 100477 - RNA, 64 nt, hsa
ggcugaggcagaacccaggagcuccaagaaaggccacccauagagcucauccucuguggaauca

SEQ ID NO: 100478 - RNA, 64 nt, hsa
gccuggcagcccccaccucccaccuaucaccccucacccauaacucaggucaacgugaccaacc

SEQ ID NO: 100479 - RNA, 64 nt, hsa
auuggaguuggcccaagaaacauaaacauauaaccacccauaucuauccuggauucugaacucu

SEQ ID NO: 100480 - RNA, 64 nt, hsa
aggcagagaaguggagugacuauuuggagaauagcacccauaucugugugcccuagggcucaga

SEQ ID NO: 100481 - RNA, 64 nt, hsa
cacagucuagauuagaaguguuuuaauuucuacacacccauagugcacacuuguauauugaaaa

SEQ ID NO: 100482 - RNA, 64 nt, hsa
uuauaaauuaaaaaaggcugggugugguggcucacacccauaaucccaacacuuuggcucagca

SEQ ID NO: 100483 - RNA, 64 nt, hsa
uggcagauuccccagauaaccaaggaaaaggggccacccauaccuggaaauaggccauagggcc

SEQ ID NO: 100484 - RNA, 64 nt, hsa
guaugugguuguugaucuuuuuuuuccuuacagacacccauaauaaaauaucauauuaaaauuc

SEQ ID NO: 100485 - RNA, 64 nt, hsa
gggggaccccagagggaggccuaggaggggacugcacccauacugcuucccuaccacaaaucag

SEQ ID NO: 100486 - RNA, 64 nt, hsa
ggaucaggcaggcucucuccccggggacaugaggcacccauaccuaggacccccugcgccuuuu

SEQ ID NO: 100487 - RNA, 64 nt, hsa
uaucuguugaaccuucaugaccuuaucaacuuuacacccauaucccagcaaaugccacucaucc

SEQ ID NO: 100488 - RNA, 64 nt, hsa
uaucuagugcaucuacaucucuauacuguacacucacccauaauucaaacaauuacaccauggu

SEQ ID NO: 100489 - RNA, 64 nt, hsa
uccccaaaugcaaacacaggcacacacaugcacacacccauaaacacacacacagugcuuuaag

SEQ ID NO: 100490 - RNA, 64 nt, hsa
uagucuucugccugcaguuuuauaguuugaggggcacccauauuuguggguuagaguuaguaag

SEQ ID NO: 100491 - RNA, 64 nt, hsa
uccugggacucuggcuauaguacuuugaaauuaucacccauauaaaagagggacauggacuaua

SEQ ID NO: 100492 - RNA, 64 nt, hsa
caccaguucuggggcaaagacacugaugaaacaacacccauaccugaaaagaauaaauguguga

SEQ ID NO: 100493 - RNA, 64 nt, hsa
aggauuaaaucuaaaggaaagaaaaaauuaaaaccacccauaacuuuacucugaagcaguaaca

SEQ ID NO: 100494 - RNA, 64 nt, hsa
acaugucuacuauggcaaaaaacauuaccauccccacccauaccacagcauccccuagagagag

SEQ ID NO: 100495 - RNA, 64 nt, hsa
aacuaggcugcugguuuuaauuacccucagauuucacccauaaaaacgcacaauuguauuauuu

SEQ ID NO: 100496 - RNA, 64 nt, hsa
gacaaguaaaauugcaggugauuugauaauuaagcacccauaccauuuauaacuucugaauuua

SEQ ID NO: 100497 - RNA, 64 nt, hsa
aauaguuaccuugccuuuuaggauguucuuaucccacccauaaugagaguugaaaggggaugga

SEQ ID NO: 100498 - RNA, 64 nt, hsa
uagugugaucaugacuuugucaaaggcaagucuccacccauaaccguucucuuguauuccuguu

SEQ ID NO: 100499 - RNA, 64 nt, hsa
cucugccaucaacuacuauucaaaaccucaaauccacccauauguuaaaauucucauuacucuu

SEQ ID NO: 100500 - RNA, 64 nt, hsa
uucuuagagaaauuucucuguggcucaguuuuaccacccauaaagcggagacaguaauuuacgg

SEQ ID NO: 100501 - RNA, 64 nt, hsa
cauuagaccuuuacagguaauggaacaugagcuucacccauauuaaauauuuuggccccuuuaa

SEQ ID NO: 100502 - RNA, 64 nt, hsa
aauuauuuucuucauauuguagauuuucugcagucacccauacuuaacauuuguaauacauuuu

SEQ ID NO: 100503 - RNA, 64 nt, hsa
cuguguuucgccaaagcucauaagggcugugacccacccauauggccccaguuuuuucugucuc

SEQ ID NO: 100504 - RNA, 64 nt, hsa
aauuuuuuccccuuaauucuuucccucaucuucucacccauaauagaaauuuuauuuccauugu

SEQ ID NO: 100505 - RNA, 64 nt, hsa
aaggccaugaacucacuggauuuccauuuuuaggcacccauagggauguuuuuaggauguaagu

SEQ ID NO: 100506 - RNA, 64 nt, hsa
uacagaaagacuguaugugugugccuugcacacacacccauaccucucagaaaaaguguuuggg

SEQ ID NO: 100507 - RNA, 64 nt, hsa
cagcaucacuccccaaggaagagccaauguuuuccacccauaauccuuucugccgaccccuagu

SEQ ID NO: 100508 - RNA, 64 nt, hsa
gcugagccucaccccggcuuuuuauuuaacagcucacccauaaaaggcccuuuucagggccacc

SEQ ID NO: 100509 - RNA, 64 nt, hsa
gagcuugaguggcucugccccacccugaaucaugcacccauaaaugcaguuauggguggaugug

SEQ ID NO: 100510 - RNA, 64 nt, hsa
cacugcuaucgcuauuuaagaacccuaaaucugucacccauaauaaagcugauuugaaguguua

SEQ ID NO: 100511 - RNA, 64 nt, hsa
aggugagccuuauugcagaucuuuuugauauagucacccauaagcauggugagcuccugcucuc

SEQ ID NO: 100512 - RNA, 64 nt, hsa
uuaauuucugccauuucauguccauaaaagagaccacccauaucaugcacacaauuagauuucu

SEQ ID NO: 100513 - RNA, 64 nt, hsa
agccugggugacagagcaagaccugucacccugccacccauaaaaaaccucuucuguaaugcca

SEQ ID NO: 100514 - RNA, 64 nt, hsa
uaauccauugaugcucuuucaugagaagagauaucacccauauuuccuuauugauauuauuggu

SEQ ID NO: 100515 - RNA, 59 nt, hsa
cucuggaagaaaacuccuaaagagaugcccacccauaaucagaagcaaaauucacagaa

SEQ ID NO: 100516 - RNA, 64 nt, hsa
guuagggaucaagggcaacauaguacuucuccuucacccauaguaauccuccuggggcagaaac

SEQ ID NO: 100517 - RNA, 64 nt, hsa
agaaggucaggagguuuugaguaccuauccuugccacccauacaggaaauccaaaguuuggugu

SEQ ID NO: 100518 - RNA, 64 nt, hsa
aaaucaagccugaggcuggugaacaguagcuacacacccauauuguguguucugugaaugcuag

SEQ ID NO: 100519 - RNA, 64 nt, hsa
uauucaagaaugcuuauucucuuagaugauaccgcacccauaggaauugagaauugggaguggg

SEQ ID NO: 100520 - RNA, 64 nt, hsa
gggagggggaugggggacuuuuguugguggcucccacccauauaucccuccuuuaccauaguac

SEQ ID NO: 100521 - RNA, 64 nt, hsa
ucaaauauuucaaccuuucauauuuuuaagaaaacacccauauauauugaaaugcaaacuuaaa

SEQ ID NO: 100522 - RNA, 64 nt, hsa
ucuguagacauuugcucauguugguaaauacaaucacccauaugaaaaaauuguuuucaccuga

SEQ ID NO: 100523 - RNA, 64 nt, hsa
gaacucuaacugucccaggaaucuugugaauuuucacccauaauggucuuucacuugucauucu

SEQ ID NO: 100524 - RNA, 64 nt, hsa
uguuuaaaauaaaagguguccuugaauuacugaccacccauagaugucuacuguuaccagguuu

SEQ ID NO: 100525 - RNA, 64 nt, hsa
guguggcuggucccuaccugggcagucucauuugcacccauagcccccaucuauggacaggcug

SEQ ID NO: 100526 - RNA, 64 nt, hsa
agcuuucuccugucgguuuggucuguuuugccuucacccauaagccccucgcacucugguggca

SEQ ID NO: 100527 - RNA, 64 nt, hsa
auuaguaaaauuaugucucauuuuauuuuuucagcacccauaccacaauuaauauuaggcugga

SEQ ID NO: 100528 - RNA, 64 nt, hsa
gcccaucuguguuuaguacacaugcaugcauacacacccauacaaacaucugugugagggcagu

SEQ ID NO: 100529 - RNA, 64 nt, hsa
uggauugaugaucacugaggaucuguaugugaggcacccauaacaguaguuuugccugugaguc

SEQ ID NO: 100530 - RNA, 64 nt, hsa
gaauauucuguggugccagugcacacuaccuucccacccauacacauccauguucacuguaaca

SEQ ID NO: 100531 - RNA, 64 nt, hsa
gccuuagagaugaggcucagacaaacgaccuuagcacccauagccuaugccaugagcacuggcu

SEQ ID NO: 100532 - RNA, 64 nt, hsa
uaaacaaauggaaaaagaagaugucccuaaccuacacccauagauuaccaagguuucaguguac

SEQ ID NO: 100533 - RNA, 64 nt, hsa
agguuucauuuugcuguuuucaggaauguaagaacacccauauuggcuacuggaaauucuagaa

SEQ ID NO: 100534 - RNA, 64 nt, hsa
acccagaaagacgauucagcuguguccagccugccacccauacguaggccaaccaagcacuuca

SEQ ID NO: 100535 - RNA, 64 nt, hsa
aaaacuuaaaaaauuagcuggcugugguguugcucacccauaguuccagcuacucgggaagcug

SEQ ID NO: 100536 - RNA, 64 nt, hsa
uuccuggaucucugucuuuauuuccaggcuucuccacccauauuccuccacagaucucucuucc

SEQ ID NO: 100537 - RNA, 64 nt, hsa
gcuucauuuguauauaacacuuucagagccuucccacccauagguaguucuuaaaccaggugaa

SEQ ID NO: 100538 - RNA, 64 nt, hsa
cuccgaccagaacccuucuuccuguggcacuccccacccauagaccuucagaucaucucccaca

SEQ ID NO: 100539 - RNA, 64 nt, hsa
uuaauaguuacaguugggcaugauuuguaccauccacccauacccacacagucacagucacaca

SEQ ID NO: 100540 - RNA, 64 nt, hsa
agugcagugacucacccccugcccccgcaccaaccacccauauucaggagaagaggacagacac

SEQ ID NO: 100541 - RNA, 64 nt, hsa
cuuggcuuuucacaaaggcugaugucuuaacugucacccauauggucccugggccaccgggcag

SEQ ID NO: 100542 - RNA, 64 nt, hsa
uucacaaguagauguaauuuacuaaagaaugauacacccauaugcuauauacagcuuaacucac

SEQ ID NO: 100543 - RNA, 64 nt, hsa
cuuugcgcuugccuucucacaccccccgacuccccacccauauuuugguaccaguuucuccuca

SEQ ID NO: 100544 - RNA, 64 nt, hsa
cucugcugcagggguggaagguggccccucuugucacccauacccauuucuuacaaaauaaguu

SEQ ID NO: 100545 - RNA, 64 nt, hsa
ucauguuucugguuuggugaguccuuugugccaccacccauaaugcuuugcauugcugcauccu

SEQ ID NO: 100546 - RNA, 64 nt, hsa
ugaaagcugggaaguuaugaaugaagauaacauucacccauaaccaagagaacucagguagcug

SEQ ID NO: 100547 - RNA, 64 nt, hsa
auucauauuaacauauucauucucucuucuccaucacccauacccacacauacaucuaguaugu

SEQ ID NO: 100548 - RNA, 64 nt, hsa
uaaagcucucagcucaugcaccccaucuccucuucacccauauuaugccuucuuucucuugucc

SEQ ID NO: 100549 - RNA, 64 nt, hsa
gugggaaaggccacccuagaaagaaguccgcuggcacccauaggaaggggccucaggagcagga

SEQ ID NO: 100550 - RNA, 64 nt, hsa
cugauuucgaucucuuccugauguaaaccaugcucacccauaucccacuauacaaaugcaaaug

SEQ ID NO: 100551 - RNA, 64 nt, hsa
auccaauggauugugcaaauccccuccccaaacccacccauaccagcuagaaucacuugacuuu

SEQ ID NO: 100552 - RNA, 64 nt, hsa
uguacauggcuuagauaaauguaaucaccguaaacacccauaugaucugggauuuuguucauau

SEQ ID NO: 100553 - RNA, 64 nt, hsa
ugguucccagcaccugccugagaccugccccaggcacccauaaccuggaauucccuguuuccuu

SEQ ID NO: 100554 - RNA, 64 nt, hsa
cacccccuuuuuaaagcacuuacuguuuucagagcacccauaucccacccuggugagaaggcca

SEQ ID NO: 100555 - RNA, 64 nt, hsa
ccccagguaaaaaagucucccucucuuccacucacacccauagcgggagagaccucaugcagau

SEQ ID NO: 100556 - RNA, 64 nt, hsa
ucaagguaacaagaguauguggcaaaacauauaccacccauagugcuucacaaaaugcacuucu

SEQ ID NO: 100557 - RNA, 64 nt, hsa
cugcggccagagugaggcuccugcuguacagugccacccauacugugaugucgaugcccaugug

SEQ ID NO: 100558 - RNA, 64 nt, hsa
ugauuaugcuugugugaggcaaucaugguggcaucacccauaaagggaacacauuugacuuuuu

SEQ ID NO: 100559 - RNA, 64 nt, hsa
agguaaaauuacccuugaaaaaaaucccuuggaccacccauaaaugacagugacuuuuucaaua

SEQ ID NO: 100560 - RNA, 64 nt, hsa
accuuugccuugucgcccaggaaguggggcucggcacccauaacuaacaccucccacccuugga

SEQ ID NO: 100561 - RNA, 64 nt, hsa
aacaugcauaugaaaaacaucacuuacguucucccacccauagacauaaaaaagggugaccugu

SEQ ID NO: 100562 - RNA, 64 nt, hsa
uucaacucucucggcgguagggcggugccauccccacccauagggcuggcucacauccagucac

SEQ ID NO: 100563 - RNA, 64 nt, hsa
cucucugagcagagaccccuuuguucuuguuauccacccauauggacuuggaaucaaucuugcc

SEQ ID NO: 100564 - RNA, 64 nt, hsa
cacugaagaaacuacuuuucaggcacuguagggucacccauaugccuccagcucaguugacgcu

SEQ ID NO: 100565 - RNA, 64 nt, hsa
ggcuguaucuccgcgauuacugguacuggugcuccacccauaggggcccuguucucucuggggu

SEQ ID NO: 100566 - RNA, 64 nt, hsa
cuaagccaaggccaguguguucagaggugacugccacccauacuaggacaaacacagcucagau

SEQ ID NO: 100567 - RNA, 64 nt, hsa
auggaggagaaaaagaaaaggaagaaaaaaaugucacccauagucucaccagagacuaucauua

SEQ ID NO: 100568 - RNA, 64 nt, hsa
agaaaggagagcuuagcaggaguccuagcccuuucacccauacacauuuggcucaggguuaccg

SEQ ID NO: 100569 - RNA, 64 nt, hsa
cuuccaccggagagacuacugaccuucucaccuccacccauaccuucuccccacagccucugcu

SEQ ID NO: 100570 - RNA, 64 nt, hsa
ucguuaaaaacacagagagagguguccuccugaccacccauaaccuggcugaggcggaagccuu

SEQ ID NO: 100571 - RNA, 64 nt, hsa
ccgaccuuucuugccucgguucucauuacacuuucacccauagcagaaaacacuuugugcggcu

SEQ ID NO: 100572 - RNA, 64 nt, hsa
aacuuguacuuguuucaucugguuuuauuacucucacccauaaacaguaaugacucucugaccc

SEQ ID NO: 100573 - RNA, 64 nt, hsa
ccaaaagcaaguagccaaagccguugccaaaccccacccauaaaucaaugggcccuuuauuuau

SEQ ID NO: 100574 - RNA, 64 nt, hsa
uagaacccugggguguggcuaacggccccuccagcacccauagccaggucuuccuggcccuuga

SEQ ID NO: 100575 - RNA, 64 nt, hsa
cacuugacucaugcugcuaagaugcacaaccgcacacccauacacaacuacaagggccacaaag

SEQ ID NO: 100576 - RNA, 60 nt, hsa
cagaauccagaaagguuugaucugggggaccacccauacugaggaguugaaagaacaagg

SEQ ID NO: 100577 - RNA, 64 nt, hsa
acaguaagcaggucauuguauagguaaaugccugcacccauaauuuucuaguaauagccacgac

SEQ ID NO: 100578 - RNA, 64 nt, hsa
cagagaugcucaugcaccugugcacacucacauccacccauacacacacacacacacacacaca

SEQ ID NO: 100579 - RNA, 64 nt, hsa
ugacuucacugaggcugucauugcugccuugccccacccauaggcccuguccauacccauguaa

SEQ ID NO: 100580 - RNA, 64 nt, hsa
gauagaaugucuuuaaugguaucauaaucauuuucacccauaauacacaguagcuucuucuuac

SEQ ID NO: 100581 - RNA, 64 nt, hsa
gcuagggaccuggggggaggagacccauggacuucacccauacucagugagggggcuccugccg

SEQ ID NO: 100582 - RNA, 64 nt, hsa
cgacacagcagggaagcuccuccuguggcccggacacccauagacggugcggggggccuggcug

SEQ ID NO: 100583 - RNA, 64 nt, hsa
ggggggugaaguggcccccgaagaauggaacccacacccauagcucuccccacagcugauacgg

SEQ ID NO: 100584 - RNA, 64 nt, hsa
aggaggccaaagggcugcagucaccccuugugcucacccauagugauggccacugguauaguca

SEQ ID NO: 100585 - RNA, 64 nt, hsa
ccugacucuauggguuacugucccaauugcgaaacacccauacuccucuucacccuguagcagg

SEQ ID NO: 100586 - RNA, 64 nt, hsa
gcaggaugcaugucugucuguucuaucuagagaucacccauauaccuauauauguuuguaucua

SEQ ID NO: 100587 - RNA, 64 nt, hsa
auugauagagaaggacaguuauuugcauuuaauucacccauaugcuuucaaaucuaguauaucu

SEQ ID NO: 100588 - RNA, 64 nt, hsa
ucaggucugggaugagaagggcacugcccucccucacccauauugcaugcccccccgccauucc

SEQ ID NO: 100589 - RNA, 64 nt, hsa
uguucaucacacacacccccuuccucccccucaucacccauaaucgugggccccuugggccucu

SEQ ID NO: 100590 - RNA, 64 nt, hsa
auuuuaaacuucaggccagaacccccaaugacuccacccauagucucacuuuaggucucauuua

SEQ ID NO: 100591 - RNA, 64 nt, hsa
uauuggccaggccccuguuacaaacugcgcagaccacccauagcccugcugcugccaccugccc

SEQ ID NO: 100592 - RNA, 64 nt, hsa
acccagcugagucuggguguucccauuggguugggccaggcaaggccucuggugcccgcugccg

SEQ ID NO: 100593 - RNA, 64 nt, hsa
uuauugucaugguuuauaaacaauaaacugugaugccaggcacaucucugccuucccugagcgc

SEQ ID NO: 100594 - RNA, 64 nt, hsa
ccgcugcccccuggcgacagggcagaccaaugaugccaggcagcugucacacgcuaguauuggc

SEQ ID NO: 100595 - RNA, 64 nt, hsa
caguccugcacaccugcuggccuggggagcuccagccaggcagcgaguccugccccgcccgcag

SEQ ID NO: 100596 - RNA, 64 nt, hsa
caaaaccucgucucuacuaaaaauacaaaaauuagccaggcaucguggugggugccuguaaucc

SEQ ID NO: 100597 - RNA, 64 nt, hsa
gaaccuaaaacugccauauaaagauaaagucuaggccaggcaugguggcucaugccuguaaucc

SEQ ID NO: 100598 - RNA, 64 nt, hsa
cacgaagcagaguuggcacauaacauggaaccuggccaggcaugguggcucacaccuauaaccc

SEQ ID NO: 100599 - RNA, 64 nt, hsa
ccuucaugccaggcuccuaugcuccccuugcccugccaggcauuugugugacuguccuguuucc

SEQ ID NO: 100600 - RNA, 64 nt, hsa
cagucacucgccccuuccucaucucuggaauuuggccaggcagucccagaagacucuggaguga

SEQ ID NO: 100601 - RNA, 64 nt, hsa
auuuauugagugccuacuauguguuagguacugugccaggcacugauaagccagugguaaggga

SEQ ID NO: 100602 - RNA, 64 nt, hsa
aaccccaucucuacaaaaaauuuuuaaaaaguuggccaggcaugguaaugcgcgccuguggucc

SEQ ID NO: 100603 - RNA, 64 nt, hsa
ugaaacccugucuuuacuaaaaauacaaaaauuagccaggcaugguggcgugugccaguaaucc

SEQ ID NO: 100604 - RNA, 64 nt, hsa
aagaugugaccccauaaaaauuuuuccugaguuggccaggcaugguggcucacgccuguaaucc

SEQ ID NO: 100605 - RNA, 64 nt, hsa
ccacauaccuggcccaaccagacuucucccgugagccaggcaaaggaaauugucaucugccaac

SEQ ID NO: 100606 - RNA, 64 nt, hsa
ugauaagagauguugacucuaaaguugauuuaaggccaggcauggugguuuacgccuauaaucc

SEQ ID NO: 100607 - RNA, 64 nt, hsa
auaaaaacaaaguugauuaagaaaggaaguauaggccaggcacaguggcucacaccuguaaucc

SEQ ID NO: 100608 - RNA, 64 nt, hsa
uggucccuaugggcuuccgcacaugccgcgggcggccaggcaacgugcgugucucugccaugug

SEQ ID NO: 100609 - RNA, 64 nt, hsa
cugccauguggcagaagugcucuuuguggcaguggccaggcagggagugucugcaguccuggug

SEQ ID NO: 100610 - RNA, 64 nt, hsa
ggcaggggcucugcuuccucagcccuagaggcgagccaggcaagguuggcgacugucauguggc

SEQ ID NO: 100611 - RNA, 64 nt, hsa
gaacaggugcuccccaaacacccugcugcuggcugccaggcaggcccucuggaagggaaggggc

SEQ ID NO: 100612 - RNA, 64 nt, hsa
gggccucugcccucuacucgugccaggcccacuugccaggcaggagcccuccccaagccuucag

SEQ ID NO: 100613 - RNA, 64 nt, hsa
ggcaaaaccaucucuacuaaaaauagaaaaauuagccaggcacguuccaggcaccugugauccc

SEQ ID NO: 100614 - RNA, 64 nt, hsa
agcgagacuucaucucagaaaauaaaaaauaggggccaggcacaguggcucauaccuguaaugc

SEQ ID NO: 100615 - RNA, 64 nt, hsa
ccuagaggugcguauacacacccaaguacacgcagccaggcauucagggguguguuugccacau

SEQ ID NO: 100616 - RNA, 64 nt, hsa
guguuugccacauggagcaucccuuccuggucuugccaggcaccugcacagagcgucuccagcc

SEQ ID NO: 100617 - RNA, 64 nt, hsa
aauuaaguaugucaacaguaaaaaauaaccaguggccaggcaugguggcucaugccuguaaucc

SEQ ID NO: 100618 - RNA, 64 nt, hsa
gaaaccccgucucuacuaaaaauauaaaaaauuagccaggcauaguggcgcaugccuguuguag

SEQ ID NO: 100619 - RNA, 64 nt, hsa
aacagcuggagggaagaugcaggggugggaagcggccaggcagaaagagcuccaggcucuugug

SEQ ID NO: 100620 - RNA, 64 nt, hsa
ccuccaggccacgaaaugggaauuccagcacuaagccaggcaccgggcagaagcugggccuucc

SEQ ID NO: 100621 - RNA, 64 nt, hsa
aaucugucuugaccugcaggaauacacgggcggcgccaggcauuaccucacagcgggacuacac

SEQ ID NO: 100622 - RNA, 64 nt, hsa
uugcuuccuuuucuugcccaugccgcuucuagaagccaggcacagguugccaagaggugacacg

SEQ ID NO: 100623 - RNA, 64 nt, hsa
ugacccugaaagagagaugaaauucaagcugugagccaggcaggagcucaguauggcaaagguu

SEQ ID NO: 100624 - RNA, 64 nt, hsa
ugucacucuccaauaaagguucuggcacuucaaugccaggcaggucuccuaaaugaacagaaug

SEQ ID NO: 100625 - RNA, 64 nt, hsa
uugguuugaacccugugagccugagacagagagggccaggcaccaaccacaaggcgggaaaguc

SEQ ID NO: 100626 - RNA, 64 nt, hsa
agucacuauccuagaggcugcuuggcccagaagagccaggcacagagcugcaguugggcacgcc

SEQ ID NO: 100627 - RNA, 64 nt, hsa
guccagaaaccaccucggggugacugagcggaaggccaggcagggccuuccuccucuuccuccu

SEQ ID NO: 100628 - RNA, 64 nt, hsa
agcucccugcuggagccugggacccauggcacaggccaggcagcccggaggcuggguggggccu

SEQ ID NO: 100629 - RNA, 64 nt, hsa
ugacagagcaagacccuguuuaaaaaagaaaaaggccaggcacgguggcucaugccuguaaucc

SEQ ID NO: 100630 - RNA, 64 nt, hsa
gucucuacuuacaaaaaaaaaaaaaaaaaaaaaagccaggcaugguggugggcuacucuggagg

SEQ ID NO: 100631 - RNA, 64 nt, hsa
gguggggaggagaagguuguaggcauggaagagagccaggcagccccgaaagaagagccugggc

SEQ ID NO: 100632 - RNA, 64 nt, hsa
uguccucucccaguucauuccuggaaccagccaggccaggcaaccaguggcccccaaaggcagg

SEQ ID NO: 100633 - RNA, 64 nt, hsa
ggagagccaggagcauuuaaaaaucagcaucugggccaggcaagauggcucacgccugugaucc

SEQ ID NO: 100634 - RNA, 64 nt, hsa
gaaaccccgucucuacugaaaauacaaaaaauuagccaggcaugguggcaggugccuguagucc

SEQ ID NO: 100635 - RNA, 64 nt, hsa
acugaggauugagcuguguggggucagcugugcugccaggcacauguacguugccucauuucau

SEQ ID NO: 100636 - RNA, 64 nt, hsa
aagguuugcaagcucccugccccagggagcucacgccaggcaggccagugggccuaagccagaa

SEQ ID NO: 100637 - RNA, 64 nt, hsa
agaggggcaauacaacagggucaagggugcagaggccaggcagagugggugcagagugggggau

SEQ ID NO: 100638 - RNA, 64 nt, hsa
aauucagcaaccauuuauugagcaucuauuaugugccaggcacugugccgggcacuggggauau

SEQ ID NO: 100639 - RNA, 64 nt, hsa
acucccuucguggggacaaaagugacaauuguaggccaggcacaguggcucacgccuguaaucc

SEQ ID NO: 100640 - RNA, 64 nt, hsa
gccaaaccacagugggagcuggggcagggggagagccaggcaaucgggggccaaagaugggggu

SEQ ID NO: 100641 - RNA, 64 nt, hsa
ccccucccaggggccuguaacuaagucggguccugccaggcagggggccuguguucugugcccc

SEQ ID NO: 100642 - RNA, 64 nt, hsa
uaaccuugagcuaauguuaaaaaucaagcucuuggccaggcaugguggcucaugccuguaauuc

SEQ ID NO: 100643 - RNA, 64 nt, hsa
acacagccuuccuccccaagcacguggucucugcgccaggcagcccgggcgucagagcucaagc

SEQ ID NO: 100644 - RNA, 64 nt, hsa
auugcaggugcccccuccaggccugacuggcuccgccaggcacuaaccugccauaacccuuugu

SEQ ID NO: 100645 - RNA, 64 nt, hsa
acuaaccugccauaacccuuugugcuggccugcggccaggcagaggaagagaggucgacugugg

SEQ ID NO: 100646 - RNA, 64 nt, hsa
gcacaccacugccaggggucagccucgcacccaggccaggcagaagcugugcucugaagcuagg

SEQ ID NO: 100647 - RNA, 64 nt, hsa
cuaaugaugguggcccagcugugcccagaggacagccaggcaggcccugggagggaguuuagaa

SEQ ID NO: 100648 - RNA, 64 nt, hsa
cacccugcugccacagcuuugcaugcugagcugugccaggcaggauccagccaaggccucuccc

SEQ ID NO: 100649 - RNA, 64 nt, hsa
aggccggagucgaaugaucagccaggaagaguuugccaggcagcuacagcucucugauccucag

SEQ ID NO: 100650 - RNA, 64 nt, hsa
uuuguccuuaacauuuaccucuuguauaguaucugccaggcaguuuuuucuuaaacuacugaga

SEQ ID NO: 100651 - RNA, 64 nt, hsa
ucaugcugucuuuagaguuaggugccugccuaaagccaggcaccaccacaccuggcuuuagagu

SEQ ID NO: 100652 - RNA, 64 nt, hsa
caucucccccaacacaugugcccccaaaaagugagccaggcaccucuguuuccugcuguuuauu

SEQ ID NO: 100653 - RNA, 64 nt, hsa
uggaugggcugccugcacagccccuggagagggggccaggcacacccucagaggagcugcaagc

SEQ ID NO: 100654 - RNA, 64 nt, hsa
gcgaggaagggcugagguggggccggcagggggcgccaggcagccgugaucacaggugacgacc

SEQ ID NO: 100655 - RNA, 64 nt, hsa
gagcgucugcucacuggcucuggggccucgaggugccaggcagcaucaggcccacuggguugcc

SEQ ID NO: 100656 - RNA, 64 nt, hsa
uggccuugggccggugcugggggcacagcugucugccaggcacucucaucaccccagaggccuu

SEQ ID NO: 100657 - RNA, 64 nt, hsa
ucaguauuacuuucugccgcugucaaggccgagggccaggcagaauggcugcacguagguuccc

SEQ ID NO: 100658 - RNA, 64 nt, hsa
ugaaacccugucucugcuaaaaauacaaaaauuagccaggcaugguggcaaacgccuguaaucc

SEQ ID NO: 100659 - RNA, 63 nt, hsa
auucaacaaauguuuauuaaucacucacugugugccaggcaccgugcuggacaucagaaaugc

SEQ ID NO: 100660 - RNA, 64 nt, hsa
ucagcugauaaauauugacugaugccagcucugugccaggcacauuggacaugggggauacacu

SEQ ID NO: 100661 - RNA, 64 nt, hsa
uuaacucugccuguccccagggucugcuccgccugccaggcaagggaacagguccucccaaggg

SEQ ID NO: 100662 - RNA, 64 nt, hsa
agccucuccuucucagugcagggacgucaccccugccaggcaagcccagggcacagaugccagg

SEQ ID NO: 100663 - RNA, 64 nt, hsa
uggcuucucccucucagugcgaggcuucaccccugccaggcaagcccagggcauagaugcugag

SEQ ID NO: 100664 - RNA, 64 nt, hsa
agccucucccucucagugcagggacgucaccccugccaggcaagcccagggcacagaggccggg

SEQ ID NO: 100665 - RNA, 64 nt, hsa
ggccccucccucucagugcgggaacgucaccccugccaggcaagcccagggcacagaugcugcg

SEQ ID NO: 100666 - RNA, 64 nt, hsa
gucucccccaccagaaugggagccaggagucccagccaggcacaggaccgagccuggcucucgg

SEQ ID NO: 100667 - RNA, 64 nt, hsa
agcuccuuggccagaggcuuacaggcaacaagcggccaggcagggucuggccccgggcugcugg

SEQ ID NO: 100668 - RNA, 64 nt, hsa
uuauaaaauuauuauuaggaauuauuuaaguggggccaggcaucuugcaacauuuucugauuuu

SEQ ID NO: 100669 - RNA, 64 nt, hsa
gggagacccugucucuacaagaaauuaaaaauuagccaggcauaguuggcacgugccuguagca

SEQ ID NO: 100670 - RNA, 54 nt, hsa
acgagggcgccgacuccuaaccccgccaggcagccucguucugcacaggcacuu

SEQ ID NO: 100671 - RNA, 64 nt, hsa
ggcagccucguucugcacaggcacuuuagcccgagccaggcacaccugcgagggggcaggugug

SEQ ID NO: 100672 - RNA, 64 nt, hsa
uggugaaaccccaucucuacuaaaacaaaaauuagccaggcaugguggcaccugccuguaaucc

SEQ ID NO: 100673 - RNA, 64 nt, hsa
uuuguuuguaaacguuuaaaaacaaaguuccccggccaggcacaguggcucacaccuguaaucc

SEQ ID NO: 100674 - RNA, 64 nt, hsa
gagaaaccccaucucuauuaaagauacaaaauuagccaggcaugguggugcaugccuguaaucc

SEQ ID NO: 100675 - RNA, 64 nt, hsa
ugaaacccugucuguacuaaaaauacaaaauuuagccaggcaugguggcacacaccuguagucc

SEQ ID NO: 100676 - RNA, 64 nt, hsa
agauucuagaaaaacuggcugcuaacuggccugagccaggcaacacugauuccaaucccuccuc

SEQ ID NO: 100677 - RNA, 64 nt, hsa
ggccccaguuaaacaaacuacccauccaugagcugccaggcagucaaaaacagaagcuuccccg

SEQ ID NO: 100678 - RNA, 64 nt, hsa
gguggugguggugagugucagcaucuacaguacagccaggcaggcaggaccuugaggaaucaga

SEQ ID NO: 100679 - RNA, 57 nt, hsa
ugaaugucuugagaaccugauauauaugccaggcaccuauuuuggcagguggugagu

SEQ ID NO: 100680 - RNA, 64 nt, hsa
cccagagcucgugacgagcaagugcuggguccccgccaggcaccccgaggcggcgcucuggcug

SEQ ID NO: 100681 - RNA, 64 nt, hsa
cgcucaccuaggcugucacaggacccaccuccaugccaggcaacagagggccacagaaccaccc

SEQ ID NO: 100682 - RNA, 64 nt, hsa
ccuaccuacccagcugggccagaggcacgaggcagccaggcagggugggagcaggggcuggcgu

SEQ ID NO: 100683 - RNA, 64 nt, hsa
ccaucuuggggccuuugcccaggcuguuccuucugccaggcaggcccuuccucccuuggcccaa

SEQ ID NO: 100684 - RNA, 64 nt, hsa
uagaagccaugggaccuccucccucauucaucuugcaagcaaaucccauuucuugaaaagccuu

SEQ ID NO: 100685 - RNA, 64 nt, hsa
guccccaccccagugcacucuucuggcccaggcagcaagcaagcugugaacagcuggccugagc

SEQ ID NO: 100686 - RNA, 64 nt, hsa
aguccuuuagcucaauugauagggucagcgucucgcaagcaaaaaaucucaugaccucauauuu

SEQ ID NO: 100687 - RNA, 64 nt, hsa
cuaaagcauuccucagaacugucccauuugaagggcaagcaaaccugggguauuuauccacuga

SEQ ID NO: 100688 - RNA, 64 nt, hsa
uuaaaauuuuaaucaauaaaguaugucuguugaagcaagcaagcaaacaaauccauaacaacca

SEQ ID NO: 100689 - RNA, 64 nt, hsa
aauuuuaaucaauaaaguaugucuguugaagcaagcaagcaaacaaauccauaacaaccacaac

SEQ ID NO: 100690 - RNA, 64 nt, hsa
uuuugaauauuuuagcuauauuuaguggcuuucugcaagcaacuagaacagagaaguaaugggu

SEQ ID NO: 100691 - RNA, 64 nt, hsa
uuugaaugucauaguacauugugugcuaaccauggcaagcaaacauuuacauuuguuuuuuaca

SEQ ID NO: 100692 - RNA, 64 nt, hsa
ugugaucacggauguuggcucccccucgcccuaugcaagcaaacacacucucaccuccucuccc

SEQ ID NO: 100693 - RNA, 64 nt, hsa
gcaucccaagguucaauaaggccuuauuuaacaagcaagcaaaaugcaaaccaaaccauuauuc

SEQ ID NO: 100694 - RNA, 64 nt, hsa
ugagagguagaaguacuucaaauucaacaggccagcaagcaaucggcuuaaaauucccuuucuu

SEQ ID NO: 100695 - RNA, 64 nt, hsa
ccaguacauuuuauaaccauccaggccuugguuugcaagcaacagaccuuaaacauacaggaaa

SEQ ID NO: 100696 - RNA, 64 nt, hsa
gggccuuguaaaaggccaggguaaaaugucucaggcaagcaaaagauuguccccuucugcauau

SEQ ID NO: 100697 - RNA, 64 nt, hsa
aaucaaauaauucuuuucuguaauccaauaugcagcaagcaagggugaccuccaguggcccacu

SEQ ID NO: 100698 - RNA, 64 nt, hsa
guuuucguaaucuucaucaagaaguuuuuaaaaggcaagcaaaaacagaagcaaaucauaucaa

SEQ ID NO: 100699 - RNA, 64 nt, hsa
uaacaacugugggauggcgauggugggaugugucgcaagcaauucacuagacaaucuucacaug

SEQ ID NO: 100700 - RNA, 64 nt, hsa
caggcuccaucccuggcuuccccagccugcggccgcaagcaaaaccaagcgcgagaugcagcua

SEQ ID NO: 100701 - RNA, 64 nt, hsa
acucagauaacaaacuucucuucuaaacugguucugcuucuaagacaagcaucuccugcccucu

SEQ ID NO: 100702 - RNA, 64 nt, hsa
uagagaugcagccaaaauuuuaggccuuuuauccugcuucuagcagaaaaaugcagggagaguc

SEQ ID NO: 100703 - RNA, 64 nt, hsa
cauauuuaaauacugaguauaguacugcugcuacugcuucuacaauguaaaauguaugacuugg

SEQ ID NO: 100704 - RNA, 64 nt, hsa
uaagaaguuagugucagcaaauuaauugaaguuaugcuucuauacugggacauauuuaaauacu

SEQ ID NO: 100705 - RNA, 64 nt, hsa
ccuuuuuuuuucuuuuucuaugagcacacucugcugcuucuaaacuuuacaugccugauggcac

SEQ ID NO: 100706 - RNA, 64 nt, hsa
uucuuccuggggauuacacagcuaugaauguauuugcuucuaaaaccucccaaagugaaucuaa

SEQ ID NO: 100707 - RNA, 52 nt, hsa
aagaagaugaugauaaauaaguugcuucuagugcaguuuuuuucuugucuau

SEQ ID NO: 100708 - RNA, 64 nt, hsa
aaaacaguugcagcuguuuuguugacauucugaaugcuucuaaguaaauacaauuuuuaaaaaa

SEQ ID NO: 100709 - RNA, 64 nt, hsa
uaaucagguuauguacaccaaccucugcaucaguugcuucuauagagcaucagcccucauguuu

SEQ ID NO: 100710 - RNA, 64 nt, hsa
ugagagccauugggccaucaagccuuuauauaucugcuucuaaaauugccccaccugcucuaga

SEQ ID NO: 100711 - RNA, 64 nt, hsa
auaauuugcuucuagaccagccucugucuagacuugcuucuagacagaaucucccagagugugg

SEQ ID NO: 100712 - RNA, 64 nt, hsa
auuuuacuuauacaguggaaacacauaaauaauuugcuucuagaccagccucugucuagacuug

SEQ ID NO: 100713 - RNA, 64 nt, hsa
uaccccugcacaguuuagaacagagggaccaaauugcuucuaggagucaacuggcuggccaguc

SEQ ID NO: 100714 - RNA, 64 nt, hsa
ccccagcccacagagccugaauuuguaagcaacuugcuucuaaaugcccaguucacuucuuugc

SEQ ID NO: 100715 - RNA, 64 nt, hsa
augcaaaacauauaguuacuauuuucaugaguccugcuucuagcuccauuguggaauacagaaa

SEQ ID NO: 100716 - RNA, 64 nt, hsa
uagaaaauuaaacacaaaguguauacauguauuaugcuucuaaaugcucauucuaccagauaca

SEQ ID NO: 100717 - RNA, 64 nt, hsa
cuguguccacaccacagaugaccacaucuaauccugcuucuacucucagcuuuaggacaaaagc

SEQ ID NO: 100718 - RNA, 64 nt, hsa
uacuuagucucugugcuccaagaggucaaauuuuugcuucuagaauuuccuuggggucuuucag

SEQ ID NO: 100719 - RNA, 64 nt, hsa
agucuuuacuggcuuucauagcuuuucuauuuuuugcuucuauuauuucucucucccuuauauu

SEQ ID NO: 100720 - RNA, 64 nt, hsa
ggguccuaggcuggaauguuccuuucgaaagcaaugcuucuaucaaauacuaguauuaauuuau

SEQ ID NO: 100721 - RNA, 64 nt, hsa
uugugggguuuuucuguauuagcuuaugaacuguugcuucuacuuagcccuuuuauagaaacuc

SEQ ID NO: 100722 - RNA, 64 nt, hsa
auuucuugaugcuaguuuagcuauauuaggaaacugcuucuaccuagauugaaagaaauuugac

SEQ ID NO: 100723 - RNA, 64 nt, hsa
ccccaccacuaccuccaugguuguucauuuaggaugcuucuaauucagccacugugaaccauua

SEQ ID NO: 100724 - RNA, 64 nt, hsa
gacugaaacaagcuugugcuaagauggaaagggcugcuucuaacagaugugguuuguugcuuua

SEQ ID NO: 100725 - RNA, 64 nt, hsa
ucuuuagauauuugccugucuguuugcucaaaauugcuucuaaaacaauaaagauucuuuuauu

SEQ ID NO: 100726 - RNA, 64 nt, hsa
cagcuugguaguuaacacaucaaauauuucuugcugcuucuaggagaacuuuuuuggugugugu

SEQ ID NO: 100727 - RNA, 64 nt, hsa
ugcccuuguugaguuuucucuuaaguaaaguccaaaguccaaggggcagauggccagaugcacu

SEQ ID NO: 100728 - RNA, 64 nt, hsa
ggcuuucugcccuuguugaguuuucucuuaaguaaaguccaaaguccaaggggcagauggccag

SEQ ID NO: 100729 - RNA, 64 nt, hsa
aaccauccuccaaaacgccuccauaacaccaguaaaguccaaaaccucuaccgaagaccucaug

SEQ ID NO: 100730 - RNA, 64 nt, hsa
accauguacaaaacacagccacucuugaaaucacaaguccaaccacagagaguccucacucuua

SEQ ID NO: 100731 - RNA, 64 nt, hsa
ugcugagaaugaaaaucuaaaugauugaaguuuuaaguccaaguaggaguugguuuguuuugcc

SEQ ID NO: 100732 - RNA, 64 nt, hsa
aaauggaggcuuuagagaaaagccaaucauuuuuaaguccaauggcaaacauagugggggcugc

SEQ ID NO: 100733 - RNA, 64 nt, hsa
guaaauaaugcaaaauaccugguaguaaaauaaaugcugaaaauuuuccuuuaaaauagaauca

SEQ ID NO: 100734 - RNA, 64 nt, hsa
ugaggucaggaguucgaguccagccuggccaauaugcugaaacccugucucuacuaaaauuaca

SEQ ID NO: 100735 - RNA, 64 nt, hsa
gcggggcgucaacggcacugcuucaggacgcgcuugcugaaacgacuccaacagcuaguucaca

SEQ ID NO: 100736 - RNA, 64 nt, hsa
gaggaggguggggcagggaaagggcuggccccccugcugaaaucuugauucugcauuugaggaa

SEQ ID NO: 100737 - RNA, 64 nt, hsa
ccaaaauacagaauggcuucugugauacuggccuugcugaaacgcaucucacugucauucuauu

SEQ ID NO: 100738 - RNA, 64 nt, hsa
uaaggcaaaaaaccaaagcaaaacaaauacauggugcugaaauuaacuugaugccaagcccaag

SEQ ID NO: 100739 - RNA, 64 nt, hsa
gucucaaaugcgugaucagagaauccuucaccuuugcugaaaagugagcucagauccagcacca

SEQ ID NO: 100740 - RNA, 64 nt, hsa
uucaaaagggcaagaucuuuuuuccuucacuuauugcugaaaccaagagcacaauucccauuga

SEQ ID NO: 100741 - RNA, 64 nt, hsa
guagaccuugaauacaggagcccucuccucauagugcugaaaagauacugaugcauugaccuca

SEQ ID NO: 100742 - RNA, 64 nt, hsa
agagcucccacaaugcugaugaaaacugucaagcugcugaaacuguaauuuucaugauauaaua

SEQ ID NO: 100743 - RNA, 64 nt, hsa
cauuguacauagacacauugucucuuuaaaaugcugcugaaauuguagagaguauagccaaaac

SEQ ID NO: 100744 - RNA, 64 nt, hsa
ccuggauacauucuucagcauuuggcaguuaaucugcugaaaccaaaguaagaacugaaugaca

SEQ ID NO: 100745 - RNA, 64 nt, hsa
caugaacauguacuguucucuucuugaacacucaugcugaaagcccaaguagggggucuaaaau

SEQ ID NO: 100746 - RNA, 64 nt, hsa
uuuuuaaggacuuuccuuccuccaucuccaagaaugcugaaaccaagggggaugacaugugacu

SEQ ID NO: 100747 - RNA, 64 nt, hsa
aagaaaaaaaaaacgcccaacucuugaaguccauugcugaaaacugcagccagggguugaaagg

SEQ ID NO: 100748 - RNA, 64 nt, hsa
acuacugcuuuugugccccuuaaauguagauaugugcugaaagaaaaaaaaaacgcccaacucu

SEQ ID NO: 100749 - RNA, 64 nt, hsa
cacucccaucugauuuacuuaauucagucucagcugcugaaauuuggaaaggaccaaauugcuu

SEQ ID NO: 100750 - RNA, 64 nt, hsa
uauagauuuagcuauuuauuguucgaugccugcaugcugaaacaaugccuacagcugucuucac

SEQ ID NO: 100751 - RNA, 64 nt, hsa
agacauuuuaauaccaugccagagaagaguauucugcugaaaccaacagguuuuacuggucaaa

SEQ ID NO: 100752 - RNA, 64 nt, hsa
gcugaaaccaacagguuuuacuggucaaaaugacugcugaaaauaauuuucaaguugaaagauc

SEQ ID NO: 100753 - RNA, 64 nt, hsa
cgauuucguuuaaugacaaaauaaucucuuaauaugcugaaaucaagcacgugagaguuuuugu

SEQ ID NO: 100754 - RNA, 64 nt, hsa
ugagcaguugaaauucaucacaugaaaaguaaucugcugaaagacuugguugcccacugccuaa

SEQ ID NO: 100755 - RNA, 64 nt, hsa
auuauaugagugcuuagaauggggcuaagggaagugcugaaauagagcaaaggauggaagauaa

SEQ ID NO: 100756 - RNA, 64 nt, hsa
auuuuuuaaauuuacagaauauuauauaacccacugcugaaaaagaaaaaaaugauuguuuuag

SEQ ID NO: 100757 - RNA, 64 nt, hsa
uucuucaacagggaaaacagcuagcuugaaaacuugcugaaaaacacaacuuguguuuauggca

SEQ ID NO: 100758 - RNA, 64 nt, hsa
uuauuuagcuuaucauaaucuacuuuguaaaacaugcugaaaccucacuguggagaaccagaau

SEQ ID NO: 100759 - RNA, 64 nt, hsa
ugguccgaauaucugggccugcccccccaaauuaugcugaaaccuaaucaccagugugauggua

SEQ ID NO: 100760 - RNA, 64 nt, hsa
agguaguuacccugauuugacccugugugggaaaugcugaaagcaccaggaggaagccgguucc

SEQ ID NO: 100761 - RNA, 64 nt, hsa
uauuguauguuuaacccccagugggauuucuggcugcugaaaccacuuugggccaggaagaaca

SEQ ID NO: 100762 - RNA, 64 nt, hsa
uagaugauggugaaauaaaggaagauacuaguuuugcugaaaaugacauuaaggaaaguucugc

SEQ ID NO: 100763 - RNA, 64 nt, hsa
ccucagucucccaaguagcugggacuauuuugcaugcugaaacuucucaaccagaagaaagggc

SEQ ID NO: 100764 - RNA, 64 nt, hsa
cuauugcuguaguguuaggaaaguauuaaguuugugcugaaaauccauugccauuugguacaaa

SEQ ID NO: 100765 - RNA, 64 nt, hsa
gugagucuuuuuccuuguuuaaaggagucccucuugcugaaaguagaugauuacuauugcugua

SEQ ID NO: 100766 - RNA, 64 nt, hsa
uaaaaccucuaaccaucucuuuguucuuugaacaugcugaaaaccaccuggucugcauguaugc

SEQ ID NO: 100767 - RNA, 64 nt, hsa
uuggucugagaauggaauucucuguaagccuaguugcugaaauuuccugcuguauccagaagcc

SEQ ID NO: 100768 - RNA, 64 nt, hsa
uguucccugccacuaaguggcucagucacaccuuugcugaaacacaguagucuuaugaaaagca

SEQ ID NO: 100769 - RNA, 64 nt, hsa
ggacacauacuuugaauaccuuucauauuuuaggugcugaaaauggugagggagugagugcucu

SEQ ID NO: 100770 - RNA, 64 nt, hsa
auuaagaaaacaggcaggcucaccauaguaaaaaugcugaaagccaaagacaaaauugggagaa

SEQ ID NO: 100771 - RNA, 64 nt, hsa
aaaccaggcccaggcaguggggacacauccagagugcugaaagaaccucccccaggucauccua

SEQ ID NO: 100772 - RNA, 64 nt, hsa
ccagucccugugcagacacugucauugcacuuucugcugaaaugguaguuucuugccagcaagg

SEQ ID NO: 100773 - RNA, 64 nt, hsa
ggccuuaugagugcagugaauaugggaaaucguuugcugaaacaucccgucucauuaaacacag

SEQ ID NO: 100774 - RNA, 64 nt, hsa
gcaacuacuuuguuauuucuacaucuuagauaaaugcugaaaaggaaaacgauuucauuguuca

SEQ ID NO: 100775 - RNA, 64 nt, hsa
gucaguagaacucauugagggugcucuugccagcugcugaaaauagaaguuggcuacucucaga

SEQ ID NO: 100776 - RNA, 64 nt, hsa
auaguaauguuucaguccaucauccagcuuuggcugcugaaaucauacagcugugaagacuugc

SEQ ID NO: 100777 - RNA, 64 nt, hsa
aguccuucugccauuuuuuauuuucaguuauaugugcugaaauaauuacugguaaaauuucagg

SEQ ID NO: 100778 - RNA, 64 nt, hsa
acugccuacuuuaccuaguucaccuuaacauguaaauccacaggguagauuucuuucuagaugu

SEQ ID NO: 100779 - RNA, 64 nt, hsa
cugcccacaguuuaaugguguggccuuuccacauaauccacauuaaguucuguguuccuguguu

SEQ ID NO: 100780 - RNA, 64 nt, hsa
ucuuucuaauaauccacacauuucaugcucuaauaauccacacauuucaugcucauuuuuauug

SEQ ID NO: 100781 - RNA, 64 nt, hsa
agauguucauuucacaagugcaugucuuucuaauaauccacacauuucaugcucuaauaaucca

SEQ ID NO: 100782 - RNA, 64 nt, hsa
ucaggcugacacagaccauaagaauuguacagauaauccacagaacugugauaaauaauaaaga

SEQ ID NO: 100783 - RNA, 64 nt, hsa
cuguucaaaaagcaaacauuaagggugggcacauaauccacaagccagaaaguugugcacggcu

SEQ ID NO: 100784 - RNA, 64 nt, hsa
ucuuacauauaagagggcucuacuaucuccuuggaauccacauuuggguuaacuccucagauuu

SEQ ID NO: 100785 - RNA, 64 nt, hsa
uacauuaggaggcagugauauuguggaagauugaaauccacagauaauucaugacccucaucuu

SEQ ID NO: 100786 - RNA, 64 nt, hsa
uugggucccugggaggccggcagccaggccacagaauccacacguggaccauugugggucccug

SEQ ID NO: 100787 - RNA, 64 nt, hsa
gugggucccugggaggccggcagccaggccacggaauccacacguggaccauugugggucccuu

SEQ ID NO: 100788 - RNA, 64 nt, hsa
ugggucccuugggaggccagcagccagacuacggaauccacauguggaccaugggaagucaguc

SEQ ID NO: 100789 - RNA, 64 nt, hsa
gagggcgccuggguccucccagcugacggcaguaaauccacagugaguuggggcgacugugaaa

SEQ ID NO: 100790 - RNA, 64 nt, hsa
aagcgacacaggcugccgcugcucucccaggugaaauccacaccaguccacgccgggucgccug

SEQ ID NO: 100791 - RNA, 62 nt, hsa
aguagguucuguuacaguuuuucuuuugaucgugcacuuauagucuucauuuaauuccucau

SEQ ID NO: 100792 - RNA, 62 nt, hsa
uauuuguggaaauugguauuaucucuguuuuaugcacuuacauuuaucccuuacauuuuguu

SEQ ID NO: 100793 - RNA, 62 nt, hsa
auaugcaaucacucguuuaugcugucuagucaugcacuuaaagcaauuuucaaauguacuca

SEQ ID NO: 100794 - RNA, 62 nt, hsa
gcgugcaguucauuucuaguucuugauagaacugcacuuaauuuucaguaguagucuugacu

SEQ ID NO: 100795 - RNA, 62 nt, hsa
agaucuggggcugcagagaacagaagagcuggugcacuuaauccagcucugcccuugggggg

SEQ ID NO: 100796 - RNA, 62 nt, hsa
gccguggggucucaggggugccuggugaauucugcacuuacacguacucaagggagcgcgcc

SEQ ID NO: 100797 - RNA, 62 nt, hsa
uuuuuuccuauuuuucuucuuuuugcuuuuuuugcacuuaucagaaauauuugaugugugca

SEQ ID NO: 100798 - RNA, 62 nt, hsa
gauuuagaagagacucuuugcugaaauugaauugcacuuauacauguaaauugucaacaugu

SEQ ID NO: 100799 - RNA, 62 nt, hsa
gcaagugacaaucagaggugacuaucuauauuugcacuuaaaaucaaaguaguucaacaugc

SEQ ID NO: 100800 - RNA, 62 nt, hsa
uugacuccccuuauucccucuccaagaguaguugcacuuaacuuuuuuuuuuuuuuuuuagu

SEQ ID NO: 100801 - RNA, 62 nt, hsa
auauaaaugaagauauuuuaccaugaagagauugcacuuauccuugagaacagucuaaauau

SEQ ID NO: 100802 - RNA, 62 nt, hsa
auauaaaugaagauauuuuaccaugaagagauugcacuuauccuugagaacagucuaaugau

SEQ ID NO: 100803 - RNA, 62 nt, hsa
ugagggugaugacaagagacauccggggacugugcacuuacagucgguguggaaugucacuc

SEQ ID NO: 100804 - RNA, 62 nt, hsa
ggagaccagcaguuaacggugagggagguaggugcacuuacccucuccucucuucuccuauc

SEQ ID NO: 100805 - RNA, 63 nt, hsa
cgggacugaggcugccucacguguugcaagaacaguuuugagccauuguuaacaaugccuuuu

SEQ ID NO: 100806 - RNA, 63 nt, hsa
uuuccuaccagcccagagccuuguggcuuguacaguuuugaaacucccguucuauuuuaugau

SEQ ID NO: 100807 - RNA, 63 nt, hsa
aaagugaaaauuuuuuuuuuucuuuugaaaucuaguuuugaauaagucugggugaccgcaccu

SEQ ID NO: 100808 - RNA, 63 nt, hsa
acguuucuacccagauccuuuuucauuuccuuaaguuuugaucuccgucuuccugaugaagca

SEQ ID NO: 100809 - RNA, 63 nt, hsa
caaugggugggggcuauucuuuugcuaucaggaaguuuugaggagcaggcagaguggagaaag

SEQ ID NO: 100810 - RNA, 63 nt, hsa
uggauugauguggagaaaacaccuuucccuucuaguuuugagagacuuccucuuggcucccag

SEQ ID NO: 100811 - RNA, 63 nt, hsa
gcaacuuguacaguggcugagaaaauaggauauaguuuugauuuuuuuaauuguaaaauauuu

SEQ ID NO: 100812 - RNA, 63 nt, hsa
aaaguuaaugagguuuuuaaaauaagguuuucuaguuuugagagugugcacuucacacagggg

SEQ ID NO: 100813 - RNA, 63 nt, hsa
gguucugaaguaaaggcuuguuaaguuucucuuaguuuugauuugaggcaucccguaaaguug

SEQ ID NO: 100814 - RNA, 63 nt, hsa
auauuuauagugagauugugaaagcaaccuuaaaguuuugaagaagacugaugagacuaggug

SEQ ID NO: 100815 - RNA, 63 nt, hsa
aagugguaauaaacaugaaaacugguuuguagcaguuuugaaagaauagaaugcauucaaaug

SEQ ID NO: 100816 - RNA, 63 nt, hsa
gacuuuggacaguggccucuugaguuccucugcaguuuugacauuuaggauuuugugucuuuu

SEQ ID NO: 100817 - RNA, 63 nt, hsa
caaacuacuacuacuacuguucaguuuuuuaaaaguuuugaaaugcugcacuuacauuuaaaa

SEQ ID NO: 100818 - RNA, 63 nt, hsa
uggccauaugcuagggccccugugaaaauaaguaguuuugagaaguuuuucuauauacguaua

SEQ ID NO: 100819 - RNA, 63 nt, hsa
ggucugauaccuaaggagccugguucaguagaaaguuuugaauuuaaaccagaaccuucuaaa

SEQ ID NO: 100820 - RNA, 63 nt, hsa
gaguacagaaugacaacauugagcccacacugcaguuuugaagauaguaacugauggcuggug

SEQ ID NO: 100821 - RNA, 63 nt, hsa
uuucuucuuuggguauaggguugaggggaaauaaguuuugagugagaaauaaacguuuuagcu

SEQ ID NO: 100822 - RNA, 63 nt, hsa
uccauuugucccauuaguugcuguggauuaucaaguuuugaaggaacuguacaucccaacaga

SEQ ID NO: 100823 - RNA, 63 nt, hsa
gcucaugucauuuuucucauggucacauuuaacaguuuugacauguuauacuugcgcauagau

SEQ ID NO: 100824 - RNA, 63 nt, hsa
agucugucuagucauuguaaauauuuaucugucaguuuugacagauuggggccagcuugaugu

SEQ ID NO: 100825 - RNA, 63 nt, hsa
uuuuaaaucuugcaauuguaugugugauuauggaguuuugaaaacguuacauuuuuuaaaucu

SEQ ID NO: 100826 - RNA, 63 nt, hsa
gggucacagaccucccucccaucugggugccugaguuuugacuccaaucagugauaccagacc

SEQ ID NO: 100827 - RNA, 63 nt, hsa
aaccaaugacuacuuaggauggguuguggaauaaguuuugauguggaauugcacaucuaccuu

SEQ ID NO: 100828 - RNA, 63 nt, hsa
gucuaauguaugugcacauauaaguaauacaaaaguuuugagcucuuccaaguauaccauuua

SEQ ID NO: 100829 - RNA, 63 nt, hsa
auuguguacagugguuauuuuccccaguuguauaguuuugagacauucaauuaucacugucuu

SEQ ID NO: 100830 - RNA, 63 nt, hsa
agucuagcauuuacuuuuaaauaauuauaaugaaguuuugaaauacuaaguuaauccagaccu

SEQ ID NO: 100831 - RNA, 63 nt, hsa
caugacaaccagacauuuccaguugguuuuguaaguuuugagaaucuagauacuggguuuuau

SEQ ID NO: 100832 - RNA, 63 nt, hsa
agcugguggacuacgcgcgcagcgugcacgaggaguuuugagcgcccggccgcgccccgcgcc

SEQ ID NO: 100833 - RNA, 63 nt, hsa
gguuuucuaugucuuuuugaacucuuguaaucgaguuuugaucauauuuucuauuaaaguggc

SEQ ID NO: 100834 - RNA, 63 nt, hsa
ccggcuaugugaacugccuauuuccuaugcuggaguuuugauuuuuaacuaaacgcaaaucug

SEQ ID NO: 100835 - RNA, 63 nt, hsa
ugguguggacugaaugggaucaugaaaguagacaguuuugagaacguaaagaacuuuuucuuu

SEQ ID NO: 100836 - RNA, 63 nt, hsa
uuggugccaccaacccauuuugugccacaugcaaguuuugaauaaggaugguauagaaaacaa

SEQ ID NO: 100837 - RNA, 63 nt, hsa
ucccaauauuuuuuuacuuuaauuuuucccacaaguuuugaucagcaaauaaacagcauucuu

SEQ ID NO: 100838 - RNA, 63 nt, hsa
gggcagggacuacagggaaggcuccuucaucccaguuuugagaugaagcuguacuccccauuu

SEQ ID NO: 100839 - RNA, 63 nt, hsa
aaguaggacaugacuaggaguguuaggggcagaaguuuugaaugcacuuaaccggaggagggc

SEQ ID NO: 100840 - RNA, 63 nt, hsa
ccauagguagccuuacuacuugggccucuuucuaguuuugaauuauuucuaagccuuuugggu

SEQ ID NO: 100841 - RNA, 63 nt, hsa
ccagagaagcucauuuaguuagaaaauaaggcaaguuuugaagccugcuaaaugaagagacuu

SEQ ID NO: 100842 - RNA, 63 nt, hsa
uugcagggaagacugagaaaacaguaggaugacaguuuugaguauacucugcacuuuucaauu

SEQ ID NO: 100843 - RNA, 63 nt, hsa
caauugcugcuuguacacucauucauuacuaaaaguuuugagaaauuuuuuuuuccaguaaug

SEQ ID NO: 100844 - RNA, 63 nt, hsa
uuuuuauucuguuuuauaaaccagagagaaaugaguuuugacgucuuuuuacuugaauuucaa

SEQ ID NO: 100845 - RNA, 63 nt, hsa
aauggaaaacauaaguagaauaggugaccucuuaguuuugaacuuauuuaaguguggggauga

SEQ ID NO: 100846 - RNA, 63 nt, hsa
cuugaaccaauguuuuuauuucauauauuuuauaguuuugaaacuaguuucucauaaaauucu

SEQ ID NO: 100847 - RNA, 63 nt, hsa
cacuuccacccuuuuuucuaaguguucgucuuuaguuuugauuuuggaaagauguuaagcauu

SEQ ID NO: 100848 - RNA, 63 nt, hsa
ugacauggcuuauguuaaaaauacccagugcucaguuuugaaagauaggcaaaaaaaaaaaag

SEQ ID NO: 100849 - RNA, 63 nt, hsa
uacuuauauuuucguaugaaaaugaguugugaaaguuuugaguagauauuacuuuaucacuuu

SEQ ID NO: 100850 - RNA, 63 nt, hsa
uuuugugauuuuauuugugcaggucaugcacacaguuuugauaaagggcaguaacaaguauug

SEQ ID NO: 100851 - RNA, 63 nt, hsa
cugaaaccugaauuggauacugccagaauagguaguuuugaaacaaguuaaggacaugguaua

SEQ ID NO: 100852 - RNA, 63 nt, hsa
ugaaguagaaauagcaauuaagaaauuaauucaaguuuugacgguuaacauuuagcagaaaaa

SEQ ID NO: 100853 - RNA, 52 nt, hsa
gugaaggggacaucccauaaguaguuuugagaggguggauggguuacuugcc

SEQ ID NO: 100854 - RNA, 63 nt, hsa
gcuguacaagugaagacaagggcuuuuuaugcaaguuuugaaagauagguauuuauuuuuucu

SEQ ID NO: 100855 - RNA, 63 nt, hsa
agcaggauaugugauacugugugguugguguggaguuuugaagaaggggcuguguuugggcca

SEQ ID NO: 100856 - RNA, 63 nt, hsa
caugaaucaaggugguggcagcaaacuucuaguaguuuugauauguccuugauagaacaaaua

SEQ ID NO: 100857 - RNA, 63 nt, hsa
uucaaugaacaaagggauucuccaggauuccaaaguuuugaagucaucuuagcuuuccacagg

SEQ ID NO: 100858 - RNA, 63 nt, hsa
gcagggaagggaagcagaucuagggaggaaggcaguuuugauuugaggagguuugcacaugua

SEQ ID NO: 100859 - RNA, 63 nt, hsa
uauucuaacauugcacaaguugaugagauaucaaguuuugaauauuauucaggaagcacuuug

SEQ ID NO: 100860 - RNA, 63 nt, hsa
augugaaaaagccuaagaaaaaggaaauuggacaguuuugauacaaacuuuguuugcuaaugc

SEQ ID NO: 100861 - RNA, 63 nt, hsa
uuagucccccuggucugaacuaguugagagaguaguuuugaacagucguaaccguggcuggug

SEQ ID NO: 100862 - RNA, 63 nt, hsa
guauuucaggcuggaaaugaauuauucuuuaccaguuuugaaacacuuugaaauauccuaagg

SEQ ID NO: 100863 - RNA, 63 nt, hsa
ccuuuugaagauacacaaaacacugaggauuuuaguuuugaaaucaaagacuauuaaaggagc

SEQ ID NO: 100864 - RNA, 63 nt, hsa
accaauaucaauagacuucuugaggcuacuauaaguuuugagaaauaagguucaaaaaauaag

SEQ ID NO: 100865 - RNA, 63 nt, hsa
uccagggggaaaugcuggaagucaauaaaacugaguuuugagagcuuggugguguguuguguu

SEQ ID NO: 100866 - RNA, 63 nt, hsa
agaguguuguaguuuuaagguuagcgugacuucaguuuugacuaaggaugacacuaauuguua

SEQ ID NO: 100867 - RNA, 63 nt, hsa
gauuuggggggaccauguaacuuaauuacugcuaguuuugaaaugucuuuguaagaguagggu

SEQ ID NO: 100868 - RNA, 63 nt, hsa
aguucgcauuuauguaaaacauucagaaaaugaaguuuugaauuuguuggaacauucaaagga

SEQ ID NO: 100869 - RNA, 63 nt, hsa
aauugaagauuauucauugcuuuggccucacaaaguuuugauuucaacuaucauaagugaaaa

SEQ ID NO: 100870 - RNA, 63 nt, hsa
uuagcuaaggaacucaugucugaauuuuguuguaguuuugaauguugugcucuuucauacaga

SEQ ID NO: 100871 - RNA, 63 nt, hsa
cuguuaaauugaacguaaauaacuuuggaaaacaguuuugacacuagaacaaggucgcuucuc

SEQ ID NO: 100872 - RNA, 63 nt, hsa
cuugaauaaguaguuuucauguuuucaauaugcaguuuugaaaaugaggauucaccuagacuu

SEQ ID NO: 100873 - RNA, 63 nt, hsa
aaauugccauucacuuuuagaaucuuguauuuaaguuuugauuuucaaauguucugcuucaug

SEQ ID NO: 100874 - RNA, 63 nt, hsa
auaguuugcaagcagauuucuauauuguauuacaguuuugaaaacagauuugguaucauucua

SEQ ID NO: 100875 - RNA, 63 nt, hsa
uucuuuuauuuucucuagugacuucuugcugcuaguuuugaaggacauuguaucgcagaggcc

SEQ ID NO: 100876 - RNA, 63 nt, hsa
gaauuucugaaaguaucagucuucugaauucugaguuuugaaaauauauuuugaggagaaaaa

SEQ ID NO: 100877 - RNA, 63 nt, hsa
cguguuguuugacucagaaggcccuucuacuucaguuuugaauccacaaagaauuaaaaacug

SEQ ID NO: 100878 - RNA, 63 nt, hsa
agcagcugguuggggacuauauucugucacuggaguuuugaaugcagggaccccgcauuccca

SEQ ID NO: 100879 - RNA, 63 nt, hsa
uaaacuuaauugauaaagcucuguuuaauuuagaguuuugaagaaauagucucccuucaauua

SEQ ID NO: 100880 - RNA, 63 nt, hsa
uuaagaaaacauugcuuugugguuaucacuuuaaguuuugacaccuagauuauagucuuagua

SEQ ID NO: 100881 - RNA, 63 nt, hsa
gugcaacagaaccauuaauaaaagaaaggaguuaguuuugagguaacugcauucauuaggggc

SEQ ID NO: 100882 - RNA, 63 nt, hsa
uguaccauuuauuuuaugacauuuuacaauguaaguuuugaaacuaacuguugguaggagaaa

SEQ ID NO: 100883 - RNA, 63 nt, hsa
uuauuaaaauauccuauuuaauuugaauagugaaguuuugaaaauacuuugaaaaagagaagu

SEQ ID NO: 100884 - RNA, 63 nt, hsa
gcuauuuguuguauuuaugcuuaagagcaaaaaaguuuugaugggauuuuaaauucaggcaaa

SEQ ID NO: 100885 - RNA, 63 nt, hsa
cucugguggucuuccuucuaccccaaggccaguaguuuugacacuucccaguggaagauacag

SEQ ID NO: 100886 - RNA, 63 nt, hsa
uuauuuuucuaaacguaagcacuguuuuuccauaguuuugaugacuggcauuuuauagacacc

SEQ ID NO: 100887 - RNA, 63 nt, hsa
acauguaccuauagaaauagaacacugccucugaguuuugaugcuguauuugcugccagacac

SEQ ID NO: 100888 - RNA, 63 nt, hsa
agaguugagugauagagcuaacccuuaucuguaaguuuugaauuuauauuguuucaucccaug

SEQ ID NO: 100889 - RNA, 63 nt, hsa
auugcaguaugaguugccacuggauugacgcaaaguuuugaguuuauuucaguaaccuacaua

SEQ ID NO: 100890 - RNA, 63 nt, hsa
aaacgacuaaaggauuuguuggguuuuugcuuaaguuuugaaccaaauccuagagccagcuga

SEQ ID NO: 100891 - RNA, 63 nt, hsa
gacugucaguaggcuggaagaaguggauauugaaguuuugacaucaaugaugaggcuccaguu

SEQ ID NO: 100892 - RNA, 63 nt, hsa
auagagaggcaaaggacacagaguagcuaaccuaguuuugaagaacaagaugggggguuuuau

SEQ ID NO: 100893 - RNA, 63 nt, hsa
uggagacuaauucuaauguggaccuuagaauacaguuuugaguagaguugaucaaaaucaauu

SEQ ID NO: 100894 - RNA, 63 nt, hsa
acacaccaaguuuggaaauacaauuguacauggaguuuugaucaacggacuuaucucagcucu

SEQ ID NO: 100895 - RNA, 63 nt, hsa
acaauaacccaguuacuuuuuuacacugauaaaaguuuugauauuuauuuuuugccauuuuau

SEQ ID NO: 100896 - RNA, 63 nt, hsa
uuuuuuuuuuuaagaagaaagaaaaugcaagcuaguuuugagaaaggaaggccaaauuggguc

SEQ ID NO: 100897 - RNA, 63 nt, hsa
aaaaccaagaaauguaaagauaacaggaaaauaaguuuugauugcauuguuuuuaaaauaagc

SEQ ID NO: 100898 - RNA, 63 nt, hsa
aaaaaaaaguaguuuuuccuucauaacauacucaguuuugaauuacauguagugucacaugaa

SEQ ID NO: 100899 - RNA, 63 nt, hsa
caaaaaauaaauagccaugcauuugauuuguuuaguuuugauuguuuuaacaguuaguaaugg

SEQ ID NO: 100900 - RNA, 63 nt, hsa
ucuaaaauauuggagaugaggaaaauguacuugaguuuugaaauauuuugguaagccucucuu

SEQ ID NO: 100901 - RNA, 63 nt, hsa
auauauacuugagguguagagauguuauuaagaaguuuugauguuagaauaauugcuuuugga

SEQ ID NO: 100902 - RNA, 63 nt, hsa
ugugucggcugcccccugauccuuccauuaucaaguuuugaaggguguuggggaaauuauggc

SEQ ID NO: 100903 - RNA, 63 nt, hsa
ucacagacuagaccuuucuuauccuccuccuagaguuuugacuugggacucuaguguuaagau

SEQ ID NO: 100904 - RNA, 63 nt, hsa
uuagaggacaaauauuuuuagauccauuuaaggaguuuugaagugccuaagaugaccuauuug

SEQ ID NO: 100905 - RNA, 63 nt, hsa
cuagguagaauuuguacuuguuuucuugguagcaguuuugaaauauucuguacaguacguucc

SEQ ID NO: 100906 - RNA, 63 nt, hsa
agagguucagucugcuucauggucucuuggaccaguuuugacuacaaaaaaaaaaaaaaaaaa

SEQ ID NO: 100907 - RNA, 63 nt, hsa
gagcuguuucaaaggaaguugguuucugguccaaguuuugaccuaaaccauguccaucuucua

SEQ ID NO: 100908 - RNA, 63 nt, hsa
uaguucuuucuuccaguuauacuauguacuaucaguuuugauauaacuauauauauauaaaua

SEQ ID NO: 100909 - RNA, 63 nt, hsa
uaagugguggaaaaaggaaaguauauauguuagaguuuugaaugagggauaaauagaaagcag

SEQ ID NO: 100910 - RNA, 63 nt, hsa
ucaguaaagauuuaauuccaugcuagcucaauuaguuuugaauuauauguauagcuugaaaag

SEQ ID NO: 100911 - RNA, 63 nt, hsa
auuuugcuaaccuaguuuguuacuuuaaaaaucaguuuugaugaaaggagggaaaagcagaug

SEQ ID NO: 100912 - RNA, 63 nt, hsa
agaacuuuagugcuaggggaagaugaaaugugcaguuuugaaauguuggguuuccagagagag

SEQ ID NO: 100913 - RNA, 63 nt, hsa
uucugcuucagaguauaaugaugacccuucuugaguuuugaacaccugaaauuguaaucacug

SEQ ID NO: 100914 - RNA, 63 nt, hsa
ccugugguacgcacugaauuuucuuugucacauaguuuugaauuucacagccuucugcauugc

SEQ ID NO: 100915 - RNA, 63 nt, hsa
gcaagugguuuuuauaaauuggaauaauaccucaguuuugagguuaugcacacuaaauuaaau

SEQ ID NO: 100916 - RNA, 63 nt, hsa
uuuauuuucaguaacuauuuuuuuuauaguuguaguuuugauuuaaagggggggaaacaaguu

SEQ ID NO: 100917 - RNA, 63 nt, hsa
cacauauaucucaaaucuggcuacugcaaaaccaguuuugacaggucagauuuucauauguau

SEQ ID NO: 100918 - RNA, 63 nt, hsa
acuacacuaauuuccaacauaagaggcaggaagaguuuugauucuauccuuuuuuacuaaaca

SEQ ID NO: 100919 - RNA, 63 nt, hsa
ucauuuucuuggcauguuaaaucaagcuuaaaaaguuuugagaaaauuuuacugcgcuguguu

SEQ ID NO: 100920 - RNA, 63 nt, hsa
agaaaaugaauuuuuuccugcagcaggaaacauaguuuugaguaguucuaccucuuauuugua

SEQ ID NO: 100921 - RNA, 63 nt, hsa
aaaagcaaaauuaacaaugaucugugcucugaaaguuuugaaaauauauuugaacaauuugaa

SEQ ID NO: 100922 - RNA, 63 nt, hsa
aggagaagucuucuauuuauuuauuuauucauuaguuuugaagauucuauguuaauauuuuag

SEQ ID NO: 100923 - RNA, 63 nt, hsa
agacacacucacacacaagagccaggaugguggaguuuugauuggguggguuguuugaggggg

SEQ ID NO: 100924 - RNA, 63 nt, hsa
uaaaauccauuuuaggugauaaaauuuuuuaaaaguuuugaaggaaaccucuggauaaaugga

SEQ ID NO: 100925 - RNA, 63 nt, hsa
uguuuaucaaaucguguacuaaaauggaaagcuaguuuugagaaauuauucagaagccuuguu

SEQ ID NO: 100926 - RNA, 63 nt, hsa
auguuuguuuauucuaccucaaacagaggcuuaaguuuugaaguguaaccaguuuauacuuca

SEQ ID NO: 100927 - RNA, 63 nt, hsa
caauuauguucauuuuaagcaaaauuuuaagaaaguuuugaaauucauaaagcauuugguuuu

SEQ ID NO: 100928 - RNA, 63 nt, hsa
acuaauuaauuuuuagauucaauauuuauauggaguuuugaaaaauaauaguggcccugaagg

SEQ ID NO: 100929 - RNA, 63 nt, hsa
aaguuuuucuauuuagcaaaauaauuaguaauaaguuuugacuaggucuaaagaaugaacaca

SEQ ID NO: 100930 - RNA, 63 nt, hsa
uagcagcugacugaaaaucagcacugccugaguaguuuugaucaguuuaacuugaaucacuaa

SEQ ID NO: 100931 - RNA, 63 nt, hsa
ucuuaaccacuuuugucauuuguuuuuuggaguaguuuugaaaaguguuuuauauugagugca

SEQ ID NO: 100932 - RNA, 63 nt, hsa
ucugucuguaaucacuaaagucaacuuuaauagaguuuugaaacaguacugugcaauccgaug

SEQ ID NO: 100933 - RNA, 63 nt, hsa
uuucucuugcucaccaagaaguaacaaaaguauaguuuugacagaguugguguucauaauuuc

SEQ ID NO: 100934 - RNA, 63 nt, hsa
acuauuuuaagagauucagcaugcauggauauuaguuuugauuaauguguacaauaauuuaca

SEQ ID NO: 100935 - RNA, 63 nt, hsa
cacugaucuugacaucaagucuaacaaagaaaaaguuuugaguuuuguauuuucuuuuuucuu

SEQ ID NO: 100936 - RNA, 63 nt, hsa
gagaaaaauacuaugugguuucuguaaguuaccaguuuugaaugaaaaaugguaaauggauuu

SEQ ID NO: 100937 - RNA, 63 nt, hsa
uuaagaaauguuuuuauuuucucuaucaacaguaguuuugaaacuagaagucaaaaaucuuuu

SEQ ID NO: 100938 - RNA, 63 nt, hsa
ccaucaguuucuuuaaaauuggauugucuggugaguuuugauauuaaacauuauguagcuaag

SEQ ID NO: 100939 - RNA, 63 nt, hsa
cauguuugaagcuauagcuuacuaucaugagacaguuuugauuuugggacucuuucaagugua

SEQ ID NO: 100940 - RNA, 63 nt, hsa
aaacaagaacaaauacucuaaacuuaugugaacaguuuugaguuuaugaauucuagaaacuaa

SEQ ID NO: 100941 - RNA, 63 nt, hsa
ccugguacaucacccaugaugucaauuaaaaaaaguuuugaucuuuuaauguaacucagauug

SEQ ID NO: 100942 - RNA, 63 nt, hsa
gaaacuuacgcaguaaucacuaccuggaaggugaguuuugaucucuuuuuaaggagaggcacu

SEQ ID NO: 100943 - RNA, 63 nt, hsa
guaacagcaaccccuguggacuuuguggguaugaguuuugauugaaauauaaagcuuucuuuu

SEQ ID NO: 100944 - RNA, 63 nt, hsa
accaucuugaagucauuguccgguuuccguagcaguuuugaaaccuuaguaccuuuuuaacag

SEQ ID NO: 100945 - RNA, 63 nt, hsa
aggauuugcacugcuuuauuuuagguggcugggaguuuugauugcauauuuuguuauaguuca

SEQ ID NO: 100946 - RNA, 63 nt, hsa
gguacaauguaaaaugccaugcuuauguuuauaaguuuugagauuuuuuuuuuuucugaaaag

SEQ ID NO: 100947 - RNA, 63 nt, hsa
aaguaucugauuuuuaaaguaaauauuuuuuaaaguuuugacauuuaaauuacuugaaucuca

SEQ ID NO: 100948 - RNA, 63 nt, hsa
guacuugaaauucuuaccagaaaauuacuuuggaguuuugaagccuuuauuaauacuacuuuu

SEQ ID NO: 100949 - RNA, 63 nt, hsa
cuagaguucauagauggacuuuugggacccagcaguuuugaaauguguuuauggaguuuaaga

SEQ ID NO: 100950 - RNA, 63 nt, hsa
cuuggugccuaauuuucuagaugauaauaggcuaguuuugauuucuugcucauuuucagaaua

SEQ ID NO: 100951 - RNA, 63 nt, hsa
uaguugaaguuuaugagggaaauaccaguguucaguuuugaacuauaauaguuuguauauuca

SEQ ID NO: 100952 - RNA, 63 nt, hsa
uuaugaaguuuaaaaauagcucacuuuaaagcuaguuuugaauaggugcaacugugacuuggg

SEQ ID NO: 100953 - RNA, 63 nt, hsa
cuugacuaauucauuguuacgucacuuuucuauaguuuugagaguucgauaaaagccauuaaa

SEQ ID NO: 100954 - RNA, 63 nt, hsa
caaaaggugugggcuuuggggucuucuggaaauaguuuugaccagacaucuuugaagugcuuu

SEQ ID NO: 100955 - RNA, 63 nt, hsa
aauugaaauuuaauuguagacuucaauaguccaaguuuugaaggauguuugagcuuuuguaua

SEQ ID NO: 100956 - RNA, 63 nt, hsa
aaaauacauaugcagucuagucagacaaaauaaaguuuugaagugcuacuauaauaaguuuuu

SEQ ID NO: 100957 - RNA, 63 nt, hsa
guuuugaaaagaaaauagcuuuuuauacuuuuuaguuuugauuucgguaacuaguuuaacuac

SEQ ID NO: 100958 - RNA, 63 nt, hsa
ucaagucugugguuuugaugcagagaagaaaauaguuuugauuuuugaguuuuuaacagaagu

SEQ ID NO: 100959 - RNA, 63 nt, hsa
uauuuacacuuuauugucucccgcuucucagauaguuuugauguguuguacaguggaauaucu

SEQ ID NO: 100960 - RNA, 63 nt, hsa
ucaccucugaaggcaaauauaagcugggaaaaaaguuuugaugaaauucuugaaguucauggu

SEQ ID NO: 100961 - RNA, 63 nt, hsa
agacugggaccuuagaaaucauuguagaaacacaguuuugaaagaaaaauaccaugucucuaa

SEQ ID NO: 100962 - RNA, 63 nt, hsa
gaauacauauugaaauagugugcuggcuuuuguaguuuugauaaagaccauugcaggcaaugg

SEQ ID NO: 100963 - RNA, 63 nt, hsa
uagguacauggacuauaucgcacaacaggugcuaguuuugagaaggcccaacaggaguuugca

SEQ ID NO: 100964 - RNA, 63 nt, hsa
ucugucaaauuguauuucaguggcacaaaaaccaguuuugaggucuuagacuuauaauucuuu

SEQ ID NO: 100965 - RNA, 63 nt, hsa
acuccgucgugguuuuauuuuuaauauagagagaguuuugaauucuacacuguugucuuuccu

SEQ ID NO: 100966 - RNA, 63 nt, hsa
cugucuugaugacacuugcagggcaggcugaaaaguuuugagauugagcagcuugggaguuug

SEQ ID NO: 100967 - RNA, 63 nt, hsa
gagggaugcccauuccaugguccuccagagaauaguuuugacuuaacaugucuguuuagccca

SEQ ID NO: 100968 - RNA, 62 nt, hsa
gugggaguaaaauacugaauauaugaguuuuucaguuuugaaaaaaaucucauguuugaauc

SEQ ID NO: 100969 - RNA, 63 nt, hsa
uuauuugaaucugucuuuuugauugccucuugaaguuuugacauagagacauuuacucuggag

SEQ ID NO: 100970 - RNA, 63 nt, hsa
gggggauguucugcacccaguggacuucaaaagaguuuugaagacuuaauuuuuuguaaaaca

SEQ ID NO: 100971 - RNA, 63 nt, hsa
aguuucaguuucucauggaaauugguaaauguuaguuuugacuucaucuauuuuuuauuuguu

SEQ ID NO: 100972 - RNA, 63 nt, hsa
aaauggauuuucacggaagagacagcucugaaaaguuuugaugcuuguggcaagagacuuaac

SEQ ID NO: 100973 - RNA, 63 nt, hsa
uuaaaaagaauucaaaaaaagacugacaaugacaguuuugaguuggauagugaaaaaguggag

SEQ ID NO: 100974 - RNA, 63 nt, hsa
aaaauaauuaccaaggccucccuucuacuugugaguuuugaaauuguucuuuuuauuuucagg

SEQ ID NO: 100975 - RNA, 63 nt, hsa
cacaaucuuuggugacgggucacaggcauugguaguuuugaagcucuccaggugauuccaaug

SEQ ID NO: 100976 - RNA, 63 nt, hsa
guauacauucucuagucugugaugucuggagcuaguuuugagggugaaccacacuuuauccaa

SEQ ID NO: 100977 - RNA, 63 nt, hsa
augaagagcgaaaucaaauucuuauuuuuguacaguuuugaaguuuauacuuagaacugacca

SEQ ID NO: 100978 - RNA, 63 nt, hsa
gugcugagauauaccuguacuauuuaugguuuaaguuuugauucuuagguauuuucuccagcu

SEQ ID NO: 100979 - RNA, 63 nt, hsa
ccaucagcauagacuugacuuccuuaaaccgagaguuuugauguggccuuggcaacccuaaaa

SEQ ID NO: 100980 - RNA, 63 nt, hsa
ucuaagcaauagagagcuucaugacugaguaagaguuuugaagucagcagugaaucaagugcc

SEQ ID NO: 100981 - RNA, 63 nt, hsa
uuguuuucugugaaaacagcagugaacagguucaguuuugaacuggcccugaggaaauggguc

SEQ ID NO: 100982 - RNA, 63 nt, hsa
acugggcuuucuccccacuaagggcaaggccccaguuuugaccaaucgcaugguucuccuggc

SEQ ID NO: 100983 - RNA, 63 nt, hsa
cgugagacaagcaguuaauaguaugaucuuuaaaguuuugacaauauaaaauaaacuugguaa

SEQ ID NO: 100984 - RNA, 63 nt, hsa
auaaaggaaauucagauuguuuaaaugccuaaaaguuuugagauaaguuuuguuucaauuaga

SEQ ID NO: 100985 - RNA, 63 nt, hsa
aaaaugaaagcaacagugauguauugaaaucuuaguuuugauauuuuaaagaaaugacuuucu

SEQ ID NO: 100986 - RNA, 63 nt, hsa
acgaaaguaggcgguacgaacccuaauggaggcaguuuugaggagguccucagcuccacggcc

SEQ ID NO: 100987 - RNA, 63 nt, hsa
agauuucaaaucuuuccaauuuacccuggaaucaguuuugagggagcugauaaagacuuuagc

SEQ ID NO: 100988 - RNA, 63 nt, hsa
uuuuuuuuuaccaaacuucagggacacucugcuaguuuugaauaaguaaccaucaaaguuacu

SEQ ID NO: 100989 - RNA, 63 nt, hsa
caccuggucuucaguucugugcccaacguauauaguuuugacaaugaccagguuggacuguuu

SEQ ID NO: 100990 - RNA, 63 nt, hsa
aaacaaaaauuauuuugccuacagaaagguuguaguuuugagcacauguuaauuuuuuucccu

SEQ ID NO: 100991 - RNA, 63 nt, hsa
aucccggaagaagaggaagaagcagaacagacuaguuuugaguaaacucaguaugcaugugug

SEQ ID NO: 100992 - RNA, 63 nt, hsa
ggaggcuccauauuaaugcauuauuuuuuaaaaaguuuugauaacucuuaaagcaucauuugc

SEQ ID NO: 100993 - RNA, 63 nt, hsa
uagucuguagguggacaagaaugcagaucacacaguuuugaaauuuuaauuugaguagauuua

SEQ ID NO: 100994 - RNA, 63 nt, hsa
aaaaaguuccaacacacagccaugaggagccucaguuuugaaagaggugcauaauaaaacuac

SEQ ID NO: 100995 - RNA, 63 nt, hsa
gcucuuguugcccaggcuggagugcaauggugcaguuuugacucacugcaaccuccgccuccu

SEQ ID NO: 100996 - RNA, 63 nt, hsa
aaaaauauguuugaugcuauuuuguauuuuuacaguuuugauuggguaauguuucuguucuuc

SEQ ID NO: 100997 - RNA, 63 nt, hsa
uaucuugcaagcuccaccuucacuuugcaucuuaguuuugaacaauccuauucaauuuucuca

SEQ ID NO: 100998 - RNA, 63 nt, hsa
uguauaccuauauauucuuuguguuuauuuaaaaguuuugaaaauaugcaguacuguuuauau

SEQ ID NO: 100999 - RNA, 63 nt, hsa
aaaaaguacaagcuauuaaaaaucagauugaaaaguuuugagaaaauguuauuuuuacugaaa

SEQ ID NO: 101000 - RNA, 63 nt, hsa
agagagagagagcgcgagagagaucaagacccaaguuuugaaucucaaccgagguccagggca

SEQ ID NO: 101001 - RNA, 63 nt, hsa
aacaucaguaaacuaccauuaaugucaaugcccaguuuugacuuuuguuagccugacacuccc

SEQ ID NO: 101002 - RNA, 63 nt, hsa
acauuuaccuucagccuccaucagaauggaacgaguuuugaguaaucaggaaguauaucuaua

SEQ ID NO: 101003 - RNA, 63 nt, hsa
uuauuucugucacaguaaaaauaaaauacuuugaguuuugagcuacuggauucuuauuaguuc

SEQ ID NO: 101004 - RNA, 63 nt, hsa
uuaagaaguaccacuugaaacauuuuauguauuaguuuugaaauaauaauggaaaguggcuau

SEQ ID NO: 101005 - RNA, 63 nt, hsa
guauuugaguucacacuauuucuguuuuacagcaguuuugaaaaacacauacuaugccaccaa

SEQ ID NO: 101006 - RNA, 63 nt, hsa
aagagcccucaauugccugccuguauuaauuuuaguuuugagucaggauuuguaauggagugg

SEQ ID NO: 101007 - RNA, 63 nt, hsa
guuagcccugccuuccaggaagguuggggugggaguuuugagugggaaagaggaugacaugug

SEQ ID NO: 101008 - RNA, 63 nt, hsa
gaggccgaggugagcggaucaccugaggucaggaguuuugagaccagccuggccaacauggua

SEQ ID NO: 101009 - RNA, 63 nt, hsa
auacuguucuggacugugccuguuaaguugcucaguuuugagcugucuucagacaagaagauu

SEQ ID NO: 101010 - RNA, 63 nt, hsa
ccuuuguagaaauucuugccugaauucucaccaaguuuugaauuccuaagguagccccgaucu

SEQ ID NO: 101011 - RNA, 63 nt, hsa
gcccgggccugcacauacucacuggacuguuccaguuuugacagcugccagucuuccugcccc

SEQ ID NO: 101012 - RNA, 63 nt, hsa
acuuuuuacuuaggcuugggaugggguccuacaaguuuugaguaugaugaaacuauaucaugu

SEQ ID NO: 101013 - RNA, 63 nt, hsa
uagauuuguuccugcuuuuuucacaaugugaguaguuuugaaaagucagaucuggccauuugu

SEQ ID NO: 101014 - RNA, 63 nt, hsa
gacaugugaaaccuuuuuuaagauuuuucucaaaguuuugaaaagcuauuagccaggaucaug

SEQ ID NO: 101015 - RNA, 63 nt, hsa
aaaguauucuagggagaaacugucuuccauuucaguuuugaaucaguauuguuacacucaaac

SEQ ID NO: 101016 - RNA, 63 nt, hsa
gauguggcguuucaacucauauaauacagaaagaguuuugaaugggcagauuucaaacugaau

SEQ ID NO: 101017 - RNA, 63 nt, hsa
cuuuguuacaggagaggaccuguggauagacuuaguuuugacauaaaacaaugcccauucacc

SEQ ID NO: 101018 - RNA, 63 nt, hsa
uuauuacuuuauguacaacugaaguuuuguuuuaguuuugauaauaaauucuuuggaacuuua

SEQ ID NO: 101019 - RNA, 63 nt, hsa
guaacaaagaacugaagcucuuauuauauuauuaguuuugauuuaauguuuucagcccaucuc

SEQ ID NO: 101020 - RNA, 63 nt, hsa
ucuaccaggucaaaauagugccacuaacgguugaguuuugacugcuuggaacuggaauccuuu

SEQ ID NO: 101021 - RNA, 63 nt, hsa
ucaaauaguggcagacagugucuucugaauguaaguuuugagaaauacgagucugucagagcg

SEQ ID NO: 101022 - RNA, 63 nt, hsa
uuacuuucucagaauuaccuaaauguuuuguagaguuuugacuaguaaucaaucaaaauuaua

SEQ ID NO: 101023 - RNA, 63 nt, hsa
agcuggcuaucuuuaagaaagaugauauauccuaguuuugaaaguaauuuucuuuuuucuuuc

SEQ ID NO: 101024 - RNA, 63 nt, hsa
ucuuucuguuucaggcuugaaaaacccuugcccaguuuugaucccuucaagacuuugucacag

SEQ ID NO: 101025 - RNA, 63 nt, hsa
gcacaauggcuuuuuguuaauaaagaacagauuaguuuugaagaaggcaaaaauuucaguuuu

SEQ ID NO: 101026 - RNA, 63 nt, hsa
uuucuaauauguggccagggcguucagauuuccaguuuugaaaacaauuguauagauuucaca

SEQ ID NO: 101027 - RNA, 63 nt, hsa
ucuuucaacacacuuccacugccugcguaaugaaguuuugauucauuuuuaaccacuggaauu

SEQ ID NO: 101028 - RNA, 63 nt, hsa
acuaagaagcuuaaauguugauaaaauaugacuaguuuugaauuuacaccaagaacuucucaa

SEQ ID NO: 101029 - RNA, 63 nt, hsa
aacacguuacaauuaccacauauccuugcuauaaguuuugaaguuucuuagcaauuaaaguuu

SEQ ID NO: 101030 - RNA, 63 nt, hsa
ucauucuuuuuuucugaaagagguaauaauucuaguuuugauagacucugaggauuaugugaa

SEQ ID NO: 101031 - RNA, 63 nt, hsa
uccagcaaacuaggguaauuggugccuuuuuacaguuuugaauaaaagcauuuacaauuucua

SEQ ID NO: 101032 - RNA, 63 nt, hsa
uuuuaggucucucaaauaauuaagaauagagccaguuuugaauaaagucuagcagaacuaugc

SEQ ID NO: 101033 - RNA, 63 nt, hsa
augagcauauggacuuacgaggguucgacuuagaguuuugagcuuuaagauaggauuauuggg

SEQ ID NO: 101034 - RNA, 63 nt, hsa
aaacuaguaucauuuuagggguguugacacaccaguuuugaguguacugugccugguuugauu

SEQ ID NO: 101035 - RNA, 63 nt, hsa
uggccaccucacgcauuugaucacagacuguagaguuuugaaaagucacuuuuauuuuuaauu

SEQ ID NO: 101036 - RNA, 63 nt, hsa
augcugcagucugcacauuagacgcuuuuuagaaguuuugaaauuaccuugauuuuuuuaauu

SEQ ID NO: 101037 - RNA, 63 nt, hsa
ucuagguuuuuuccuuucauuuuauucucuucuaguuuugacauuuuaugauagauuugcucu

SEQ ID NO: 101038 - RNA, 63 nt, hsa
aaaaacaauuuucaaguuuuuuuuacaauaaacaguuuugauuuaaaaucucguuuguauacu

SEQ ID NO: 101039 - RNA, 63 nt, hsa
uagaacuaguguaauucuugauaauaaaauaagaguuuugauuaagaacagcauagagcuuca

SEQ ID NO: 101040 - RNA, 63 nt, hsa
gagacucagccugcaguuaauuagcauucuggcaguuuugacaucagccagcugcccuaaaua

SEQ ID NO: 101041 - RNA, 63 nt, hsa
auauuuaauuuaaacuaaugaugugaacuauuuaguuuugauguccguuaugugauucugcuu

SEQ ID NO: 101042 - RNA, 63 nt, hsa
aaaacuuugggaaaggggcuagcuagcaaagguaguuuugaaauagauguguauauggacugu

SEQ ID NO: 101043 - RNA, 63 nt, hsa
uucuggaauaauuuuaccaaaacaagcuauuugaguuuugacuugacaaggcaaaacaugaca

SEQ ID NO: 101044 - RNA, 63 nt, hsa
uuuaguugauuuuuuuuaaccuuuuaguuucccaguuuugaauaauuacaugguggauucuga

SEQ ID NO: 101045 - RNA, 63 nt, hsa
uaaagugguuaauucaggaaauugacagaauccaguuuugagaaaagaacacagauauuugcu

SEQ ID NO: 101046 - RNA, 63 nt, hsa
uuuagugucucaccagugguuuuacaucugcagaguuuugagggcugugcugaccuuugagag

SEQ ID NO: 101047 - RNA, 63 nt, hsa
aauuagaguuuaaauaaauaugcuuugaugcauaguuuugaacuaauguaacaugauuuuucu

SEQ ID NO: 101048 - RNA, 63 nt, hsa
ucccuacauguauugcacauuguaaaaaguuuuaguuuugaugaguugugaguuuaccuugua

SEQ ID NO: 101049 - RNA, 63 nt, hsa
auuuuggugucaauuuuguggacauuuggcaggaguuuugacugggguaggagaaacccauga

SEQ ID NO: 101050 - RNA, 63 nt, hsa
gcacggauggcugguccgaagcacgugcauuucaguuuugaggcuccuguccucaggcagugu

SEQ ID NO: 101051 - RNA, 63 nt, hsa
aaggcaauuuuaaauaggcagagagaaguuuauaguuuugaaaacagcugcugaagucaggaa

SEQ ID NO: 101052 - RNA, 63 nt, hsa
aaaccaccaagaacauuuccuggggcauguuccaguuuugaggggugauauaucugccagaua

SEQ ID NO: 101053 - RNA, 63 nt, hsa
aagaucagcuggcuuucuuguuaaaguuauuuaaguuuugaaugcucuacuacuucaagucuu

SEQ ID NO: 101054 - RNA, 63 nt, hsa
cuaggauuaauuaucagaagacagcucaggccaaguuuugaucguuccauacaguaccuuguu

SEQ ID NO: 101055 - RNA, 63 nt, hsa
cuaacaagguauuugcaugagucacaauuacaaaguuuugagcgguuuuguaauuugacauuu

SEQ ID NO: 101056 - RNA, 63 nt, hsa
aaccuuuuaaggaaauacaguccuugggaaaugaguuuugauggugaauugggguguuaagga

SEQ ID NO: 101057 - RNA, 63 nt, hsa
gaaagagaaaggaaauuauaaggucaaguuaacaguuuugagguuuuguguuuuuuucuggaa

SEQ ID NO: 101058 - RNA, 63 nt, hsa
auuauguuauagccaucauaaaaccauuuugguaguuuugacugaacuggguguucacuuuuu

SEQ ID NO: 101059 - RNA, 63 nt, hsa
cuuaaugcuuguaauuuaaacauuuguuccuggaguuuugauuugguggaugugaugguuggu

SEQ ID NO: 101060 - RNA, 63 nt, hsa
guuguggagaggagacgccuccagacucucagaaguuuugaggacugaacugggucacucggg

SEQ ID NO: 101061 - RNA, 63 nt, hsa
uuuguggugaugggaggaugcuguuacuaggagaguuuugagauacugcaguggaugugggau

SEQ ID NO: 101062 - RNA, 63 nt, hsa
uucauaaaccaugcuaacauuuuccuuuuagcuaguuuugaaaguaaggaacaauaccuggga

SEQ ID NO: 101063 - RNA, 63 nt, hsa
acacacacacacacacagugugcaacuagccccaguuuugacagaauaauucuuggucuuccc

SEQ ID NO: 101064 - RNA, 63 nt, hsa
uucacuauuugagguaacuucauuuuucauucuaguuuugauauuuggcuguuuauuuuuguc

SEQ ID NO: 101065 - RNA, 63 nt, hsa
uccauuaaugucauuuuuauggauuguagacccaguuuugaaaccaaaaaagaaaccuagaau

SEQ ID NO: 101066 - RNA, 63 nt, hsa
uuuuuaaaugaaauuaggucauuauuuaugaaaaguuuugagagggcacugucaacuuggguu

SEQ ID NO: 101067 - RNA, 63 nt, hsa
agggacaguuuugaccugaccccuagaggagacaguuuugaccucuucagcaccaggaaggaa

SEQ ID NO: 101068 - RNA, 63 nt, hsa
ccauggaccccuggaggagaccuauggagggacaguuuugaccugaccccuagaggagacagu

SEQ ID NO: 101069 - RNA, 63 nt, hsa
guaucuguacguuaauguuucuugcugaguuacaguuuugauaaagaggcucucauuuccugu

SEQ ID NO: 101070 - RNA, 63 nt, hsa
cuucauaaucuauggaaaccucuaaggugagaaaguuuugaacuuuuaacccuuucuacccag

SEQ ID NO: 101071 - RNA, 63 nt, hsa
guuauauugugauacucaaauucacagcagaguaguuuugaguaacaguaauuaaauccuucu

SEQ ID NO: 101072 - RNA, 63 nt, hsa
uuuagaaacauuagugccugccuggauccccuuaguuuugaaauauuugccauuguuguuuaa

SEQ ID NO: 101073 - RNA, 63 nt, hsa
uacacccauagauuaccaagguuucaguguacuaguuuugaaucuguucugaauggaguuuuu

SEQ ID NO: 101074 - RNA, 63 nt, hsa
augauauuugaaaaugcuaucccugcacucaaaaguuuugaaagaaacuaaucacagcacaga

SEQ ID NO: 101075 - RNA, 63 nt, hsa
guuggguacuuagacccaaaccaauaaauggugaguuuugaacaagaacuaccaucaugcagg

SEQ ID NO: 101076 - RNA, 63 nt, hsa
uggggauaauaauacugaccuaccucaaagggcaguuuugaggcaugacuaaugcuuuuuaga

SEQ ID NO: 101077 - RNA, 63 nt, hsa
cacccacugacaucugaauuuauauaccuguugaguuuugagugcacccaaacacucgauaaa

SEQ ID NO: 101078 - RNA, 63 nt, hsa
guucugcuuuuccuggcacucaaauucaugacuaguuuugaggucaaaccuauguucguaaug

SEQ ID NO: 101079 - RNA, 63 nt, hsa
uguuacugaagcauuugaauauaaagcuauuuuaguuuugauggcuuaacuguucccugagga

SEQ ID NO: 101080 - RNA, 63 nt, hsa
acaccuauaaucccaacacuuugggaggccaggaguuuugagaccagccugggaaacaucugu

SEQ ID NO: 101081 - RNA, 63 nt, hsa
ccucaggaggaagguggacaacagagaaaugagaguuuugauauuuucugaaagaggaacaug

SEQ ID NO: 101082 - RNA, 63 nt, hsa
uugggcaaacaaaauuggagggcaagugacugcaguuuugagaaucaguuuugaccuugauga

SEQ ID NO: 101083 - RNA, 63 nt, hsa
auuggagggcaagugacugcaguuuugagaaucaguuuugaccuugaugauuuuuuguuucca

SEQ ID NO: 101084 - RNA, 63 nt, hsa
gaugcuugagauuuuccugcugcaucgcacucuaguuuugaaggauuuacaucuuaggaaaua

SEQ ID NO: 101085 - RNA, 63 nt, hsa
auaugauauucaaauuucaguguccauaaauaaaguuuugaaaacaugaauacaaacaaaaaa

SEQ ID NO: 101086 - RNA, 63 nt, hsa
uccuuuagguuaaguuuaagcuuuuuaaaaguuaguuuugagaauugagacacaauacuaaua

SEQ ID NO: 101087 - RNA, 63 nt, hsa
ugaaaacagccaugaauaucuuuucuuaaagagaguuuugaaaaugaucacuuaccuaaaacu

SEQ ID NO: 101088 - RNA, 63 nt, hsa
aaaguuuauuuuccucugccauccuugcuaaguaguuuugacacaaugaaaauggaagcacuu

SEQ ID NO: 101089 - RNA, 63 nt, hsa
uuuaucaacguguugugaagauguaccuaaugaaguuuugagaaagcacaggguuauaggugu

SEQ ID NO: 101090 - RNA, 63 nt, hsa
uagcaccucaagguauaauuuaaacagugagguaguuuugaauggcauuucauuaaggcaucu

SEQ ID NO: 101091 - RNA, 63 nt, hsa
augaucagaagaacaugauuuuacaaguauaacaguuuugaguaauucaagccucuaaacaga

SEQ ID NO: 101092 - RNA, 63 nt, hsa
aaugccuuugacaccaaccaugauggcucggucaguuuugaggacuuuguggcugguuugucc

SEQ ID NO: 101093 - RNA, 63 nt, hsa
gggggccuccaguguccugccccugcuuggcccaguuuugauugcuggcaucuugccacccca

SEQ ID NO: 101094 - RNA, 63 nt, hsa
aaaaccaucaucuguaaaaccaucuaugacaugaguuuugagaaacaauaauggggaaaauau

SEQ ID NO: 101095 - RNA, 63 nt, hsa
auuuacaauauaugacuaauuuggggaaaaugaaguuuugauuuauuuguguuuaaaugcugc

SEQ ID NO: 101096 - RNA, 63 nt, hsa
ccucugggguucagcuucugucucugcugucccaguuuugagguuugguuucuuguuucuguc

SEQ ID NO: 101097 - RNA, 63 nt, hsa
aaauucagucuaguucugcugauaaagaucaucaguuuugaaagguuacugauuuuccucuuc

SEQ ID NO: 101098 - RNA, 63 nt, hsa
aggcagagugguccccucuuugccaccuaggccaguuuugacccuggcauuaacuggccuuag

SEQ ID NO: 101099 - RNA, 63 nt, hsa
agagugaaagggguaagggggugggaggguaagaguuuugacaaguuguggcaaaggaaacua

SEQ ID NO: 101100 - RNA, 63 nt, hsa
auaaguaaaaauauuugagaaaaauaaaguacaaguuuugaacaacacaaaaggcaugaauuc

SEQ ID NO: 101101 - RNA, 63 nt, hsa
aacacuacuaaauuuugguuccuccauagaauuaguuuugaaacacuugauguagugagaaau

SEQ ID NO: 101102 - RNA, 63 nt, hsa
ccaugugggaaucagcauucuuaauuucguuaaaguuuugacuuguaaugaaauguucaagua

SEQ ID NO: 101103 - RNA, 63 nt, hsa
gcuggggugccaaacaccagaaggggagauaauaguuuugacucugaacuuggccacaacccc

SEQ ID NO: 101104 - RNA, 63 nt, hsa
uaguagaacgcuaucugggaagcuauuuuuuucaguuuugauauuucuagcuuaucuacuucc

SEQ ID NO: 101105 - RNA, 63 nt, hsa
aaagaaacaugguuuacuugcacaaaacugaucaguuuugagagaucguuaaugcccuugaag

SEQ ID NO: 101106 - RNA, 63 nt, hsa
ggaagaagcuggacauucagccuguggagucugaguuuugaaggauguagggagccuuaguug

SEQ ID NO: 101107 - RNA, 63 nt, hsa
gacuaaacuaccuccaaagcaagcagucuuuucaguuuugacugagugaugugagaaacuucu

SEQ ID NO: 101108 - RNA, 63 nt, hsa
agcacuugggugaaucugggcaccugauuucugaguuuugaguucuggagcuaguguuuugac

SEQ ID NO: 101109 - RNA, 63 nt, hsa
aacaccaaaauauuuuagaauaaauucuuagaaaguuuugagaggaauuuuuagagaggacau

SEQ ID NO: 101110 - RNA, 63 nt, hsa
ugagccuauuguguuacuugaccuuauuuuggaaguuuugaauuggccuaggaggaaacccag

SEQ ID NO: 101111 - RNA, 63 nt, hsa
cugaaaaucugagaacuauuuaccuaucacucuaguuuugaagcaaagauggacuucaguggg

SEQ ID NO: 101112 - RNA, 63 nt, hsa
ugcaguuaggaaagggaugggcagggaaaaacuaguuuugagugucuuuagauagaaacauga

SEQ ID NO: 101113 - RNA, 63 nt, hsa
aacacuuucuugggaagcagaucagccuagaaaaguuuugauuagcacugugguuuuccuuuu

SEQ ID NO: 101114 - RNA, 63 nt, hsa
gguaguuuggggcaaaaauccgaggugcuugggaguuuugaauguuaagaauugaccaucugc

SEQ ID NO: 101115 - RNA, 63 nt, hsa
gggguuuggaaauguaaauguguaccuugcuuuaguuuugaggcuggggaauaugugugggug

SEQ ID NO: 101116 - RNA, 63 nt, hsa
gacacuuguaacauauucaacguccuguacuccaguuuugacuacgagaucagauuuuggagg

SEQ ID NO: 101117 - RNA, 63 nt, hsa
ugaaauuagugugcagagucauucuaccgauaaaguuuugaaauaaugugaaaacuggagcau

SEQ ID NO: 101118 - RNA, 63 nt, hsa
guuuuacccuuucuaaacacuguccuuuuugaaaguuuugaauauauccacauucuauugaaa

SEQ ID NO: 101119 - RNA, 63 nt, hsa
acuuugguacugcugucuuccaagguagcucuaaguuuugaugugugggcuucugaguuuaua

SEQ ID NO: 101120 - RNA, 63 nt, hsa
augguaguucaguugggguacuuguuuuauggaaguuuugauugauuuacuugcccucccacc

SEQ ID NO: 101121 - RNA, 63 nt, hsa
uaaguccucacccuuuacauuaucuaauucuucaguuuugaugcugauaccugcccccggccc

SEQ ID NO: 101122 - RNA, 63 nt, hsa
uguucuucacuaugauuuacugugugccaaaggaguuuugacaggguacagaguauuuuacua

SEQ ID NO: 101123 - RNA, 63 nt, hsa
uguaaaaauugguuaacuuuacaaaugucagcuaguuuugacuacuaauugggggaaauuuua

SEQ ID NO: 101124 - RNA, 63 nt, hsa
cuuuccuucccuauuguuuuuguuuuuuuaaugaguuuugacgcauguuguuuugauugcuau

SEQ ID NO: 101125 - RNA, 63 nt, hsa
auauagagccacuuccugaaaccaagaaucuguaguuuugauccaaaaucuaaaacuuaaagu

SEQ ID NO: 101126 - RNA, 63 nt, hsa
uaucucagcugucuuuucuaacuguguagguugaguuuugaacacgugcuuguggacaucagg

SEQ ID NO: 101127 - RNA, 63 nt, hsa
gaccucagaacugaaauugauaaugaaguugcaaguuuugauagcccgugaagugcauaagua

SEQ ID NO: 101128 - RNA, 63 nt, hsa
caguaauaugucuccuugcuucuuugaugugauaguuuugagaugggugagaaucuaauagau

SEQ ID NO: 101129 - RNA, 63 nt, hsa
ugugcaaaagcuccccguccagcuuugacagucaguuuugaugucagcuccucggcaggguag

SEQ ID NO: 101130 - RNA, 63 nt, hsa
ugggguuucaauugacuucuguuccuugcuuuuaguuuugauagaagggaagaccugcagugc

SEQ ID NO: 101131 - RNA, 63 nt, hsa
caggucuggccagggacgugcugcaauuggugcaguuuugaaugcaacauuguccccuacugg

SEQ ID NO: 101132 - RNA, 63 nt, hsa
acagcaagauaaccccaagacagucuuuuaucaaguuuugacgguuuaugcugggcacugcca

SEQ ID NO: 101133 - RNA, 63 nt, hsa
aauucaaaagugaacgaaagcauuuaacuggccaguuuugauugcaaaugcuguaaagauaua

SEQ ID NO: 101134 - RNA, 63 nt, hsa
ccugcuauucugccaaaagacaauuucuagaguaguuuugaauggguugauuucccccacucc

SEQ ID NO: 101135 - RNA, 63 nt, hsa
gauaaggcauacauuugcgcagaugagcuaggaaguuuugagaaguaccuuuuauguucagaa

SEQ ID NO: 101136 - RNA, 63 nt, hsa
gcccugcuucuaaucugguucuuuccacagccuaguuuugauugacuucauauucuagaauac

SEQ ID NO: 101137 - RNA, 63 nt, hsa
aauuuaaguccuccaauuccagcauauccagugaguuuugacaguguguuuauguggaauguu

SEQ ID NO: 101138 - RNA, 63 nt, hsa
gaucuguugaacugucuuccaaccugccauggcaguuuugacacuacuccuguuugcccuccu

SEQ ID NO: 101139 - RNA, 63 nt, hsa
acugaauaguaacuucuuucuugaacuaagaucaguuuugaaguuucuaaaggagauagaaug

SEQ ID NO: 101140 - RNA, 63 nt, hsa
gccacacccuagauccagccucaggaacuaacaaguuuugagaaaagcagguaguagagcagc

SEQ ID NO: 101141 - RNA, 63 nt, hsa
auaugugauaugguaauuuucauaacagaugucaguuuugaaccaagaauuggugauuuguuu

SEQ ID NO: 101142 - RNA, 63 nt, hsa
acugagaugaucaguuacauucaucaguuggugaguuuugaagaauaacuacauuuuauuuca

SEQ ID NO: 101143 - RNA, 63 nt, hsa
aaugacaaauugauauucugauauaaaacucaaaguuuugaagucagugggaaaaaaggaggu

SEQ ID NO: 101144 - RNA, 63 nt, hsa
cuggcagcucucucuacccaacuuugcacuuguaguuuugagucuuugucucucuggaauaug

SEQ ID NO: 101145 - RNA, 63 nt, hsa
gauucugcucuaaaacauugcucuggguuauacaguuuugaucccaaaagcuuuuuuguuaca

SEQ ID NO: 101146 - RNA, 63 nt, hsa
ccuggcgggugggaaggaauggcuggggcggccaguuuugacacgccccagugcccuggagaa

SEQ ID NO: 101147 - RNA, 63 nt, hsa
gcaaguaagucagguuucacaagaaaauuuucaaguuuugaagggaauuugagguugaucugg

SEQ ID NO: 101148 - RNA, 63 nt, hsa
caguaauuaaauugcaucccaggagauuuauaaaguuuugauauuuuucccuacucuggaauu

SEQ ID NO: 101149 - RNA, 63 nt, hsa
uuuguguagaaaaauaggugcaauaaugaucaaaguuuugaugucuugagucuccaucuuagg

SEQ ID NO: 101150 - RNA, 63 nt, hsa
ccuuacgaaauacgucuuuuucagaacuguuaaaguuuugauguacaucgagcugaauucugu

SEQ ID NO: 101151 - RNA, 63 nt, hsa
uuccaucccugucaugucuucaguuaucucucgaguuuugaagcugaacaguagcaaaucaga

SEQ ID NO: 101152 - RNA, 63 nt, hsa
ugaaguacaggcaaacuugauguuugaaagauaaguuuugagaaaugucauuguauuuuggag

SEQ ID NO: 101153 - RNA, 63 nt, hsa
uggaaauaaaaauauuuguuagugaauugguugaguuuugauuccucuaacuucucagaauga

SEQ ID NO: 101154 - RNA, 63 nt, hsa
cugggacauuuucauugauauucuauacaccaaaguuuugacgguuuaccaucauuccauuuu

SEQ ID NO: 101155 - RNA, 63 nt, hsa
auuuuggccacuuuacauuuagauucuggugagaguuuugacugaauguuccaaucucugaug

SEQ ID NO: 101156 - RNA, 63 nt, hsa
aagcaaguaaugucaacuuugagcacuuuguugaguuuugaaaaaucuuauuuguugcugcac

SEQ ID NO: 101157 - RNA, 63 nt, hsa
uguuaauaagcuucucccuuucgucaccccaaaaguuuugaaucaaugaaagagacauugaaa

SEQ ID NO: 101158 - RNA, 63 nt, hsa
ucaugcuacuuucuguuacaccucuauuauauuaguuuugaauauaaacaucuuuuucagacc

SEQ ID NO: 101159 - RNA, 63 nt, hsa
aagccagcugaucuaguaguaaccaaaaauuccaguuuugagaauaggaaagauuccgccugc

SEQ ID NO: 101160 - RNA, 63 nt, hsa
cauuguaucaaauuauuuuuaaguuuuauccguaguuuugauaaaagauuuuccuauuccuug

SEQ ID NO: 101161 - RNA, 63 nt, hsa
augcauuuccuugauucaauuugugaccuuaccaguuuugaauuggaauugcaccauuucgua

SEQ ID NO: 101162 - RNA, 63 nt, hsa
aguggcuaguaccaucugcaauaggauuuaggaaguuuugaucucacaaauuuacuguaaggc

SEQ ID NO: 101163 - RNA, 63 nt, hsa
uaagcuuuaauaaucuuccccuuuuaugugaaaaguuuugagaacugugaaauguuuaggaac

SEQ ID NO: 101164 - RNA, 63 nt, hsa
cccauggaggcaguucaguaacuaaacuaauaaaguuuugaaaaguuacacguaaaguagaag

SEQ ID NO: 101165 - RNA, 63 nt, hsa
cuuuauaccaaaauucagugaaggcauucuacaaguuuugaguuagcauuacauuuuaauauu

SEQ ID NO: 101166 - RNA, 63 nt, hsa
auauuuguuuaauaauaaccuauuucaagucugaguuuugaaaauuuacauuucccaaguauu

SEQ ID NO: 101167 - RNA, 63 nt, hsa
gccaacuguggucaaagaauggcuuucaguuaaaguuuugacuucuuauuauaaauaauauaa

SEQ ID NO: 101168 - RNA, 63 nt, hsa
gucaccuucccuugcagcuuaaggagcccaguaaguuuugaaaauguuugcgaaucaaacuaa

SEQ ID NO: 101169 - RNA, 63 nt, hsa
cucaagagucagcuggcagguuuguugaaauacaguuuugaguuauuuugauguggcuuuuua

SEQ ID NO: 101170 - RNA, 63 nt, hsa
augauauuuugaguaauuuuaugcaugaaacaaaguuuugacaggcuuuugaccgugauucau

SEQ ID NO: 101171 - RNA, 63 nt, hsa
uacacccucccccuccagggaaugcugaguuccaguuuugagcagaggugaggcagaauccac

SEQ ID NO: 101172 - RNA, 63 nt, hsa
gacuauuuaucgucgauacucuguagcuguguaaguuuugacaaauaguguaucucguggaau

SEQ ID NO: 101173 - RNA, 63 nt, hsa
aagacacaaaugcaugaacaaguuuuaauguauaguuuugaauccuuugccugccuggugugc

SEQ ID NO: 101174 - RNA, 63 nt, hsa
agucuuccgagaaacuuuucugaucaguuugcgaguuuugaugaguuuuguaagguuuuuguu

SEQ ID NO: 101175 - RNA, 63 nt, hsa
gcuugcagcaaguaaucuucaaauauuccaguaaguuuugaaauaaugaaugcauugaaaaua

SEQ ID NO: 101176 - RNA, 63 nt, hsa
uuuggaaagaauuuuuguauuuauuccuguuacaguuuugacuuucaacuucucuccccgugc

SEQ ID NO: 101177 - RNA, 63 nt, hsa
gacauaugaaaauucaagaaccuaaaaaauaccaguuuugaaugaguuuuugugguuuugguu

SEQ ID NO: 101178 - RNA, 63 nt, hsa
ucagguuacuaugcugaaauuccaaaaugucugaguuuugaauagugaucacuuuguucuggu

SEQ ID NO: 101179 - RNA, 63 nt, hsa
ggauccuccuucguggucuucuaagucaguguuaguuuugaaauuuuuggcccugcauaaguu

SEQ ID NO: 101180 - RNA, 63 nt, hsa
aagggcuucauuccuuuuaugucauuucuagacaguuuugaaucuagguuaauaacacuuuau

SEQ ID NO: 101181 - RNA, 63 nt, hsa
uggauugauacggggaaaacaucuuucccuucuaguuuugagagacuuccucuuggcucccag

SEQ ID NO: 101182 - RNA, 63 nt, hsa
uucuauuuaggucauuuguucuuuuuacuauugaguuuugagagguuuuuuauauauccuaga

SEQ ID NO: 101183 - RNA, 63 nt, hsa
aaaauguuccuacuuuaaauauacaauucagugaguuuugauaaauugauauacccauguaac

SEQ ID NO: 101184 - RNA, 63 nt, hsa
guccuuuuuuauaaaggacacuuuucuccuaguaguuuugaauucaggaacagauccaaaguu

SEQ ID NO: 101185 - RNA, 63 nt, hsa
uugcuuucuaggagguuuguuguuuugccuguuaguuuugaggagcaggaagcucaugggggc

SEQ ID NO: 101186 - RNA, 63 nt, hsa
ggacccaacaacuaaccacguuuacacgacuugaguuuugaaccccgauuaaugucuguacgu

SEQ ID NO: 101187 - RNA, 63 nt, hsa
ugugccuaaggcugcuugaucuauuucuauaacaguuuugaucuuaaaagcuuugugauugca

SEQ ID NO: 101188 - RNA, 63 nt, hsa
gacaaggcacaaauacuuucagaauuguauuucaguuuugaagauuuaaaaaaaaugugaaaa

SEQ ID NO: 101189 - RNA, 63 nt, hsa
acugugugggauacuuagugguaugucucuuuaaguuuugauuaauguuucuuaaauggaauu

SEQ ID NO: 101190 - RNA, 63 nt, hsa
uuccugaggccucaguauuagucgugagcacaaaguuuugagaccuuuggcguuguuucuuga

SEQ ID NO: 101191 - RNA, 63 nt, hsa
uuccaaaccaguuuauucugugguucuauaauaaguuuugauauaaucuuggcuucuuaaaaa

SEQ ID NO: 101192 - RNA, 63 nt, hsa
ccacauuauucucuguggggacaagagcugggcaguuuugaaugggucuugagguggguaccc

SEQ ID NO: 101193 - RNA, 63 nt, hsa
guaauuggauuucgcuaucaguucccauccuuaaguuuugauauucaauaucugauagauaca

SEQ ID NO: 101194 - RNA, 63 nt, hsa
uuuauguccaauagcuacuacauuugauagaacaguuuugaggaacauuucauucuugaacgc

SEQ ID NO: 101195 - RNA, 63 nt, hsa
gugguccaggauucuguaaugcuuuacacaggcaguuuugaaaugaaaaucaauuuaccuuuc

SEQ ID NO: 101196 - RNA, 63 nt, hsa
uaaucuccuauuuuggugucaguuuuucaauaaaguuuugauuaugggcaaauccccucuuuu

SEQ ID NO: 101197 - RNA, 63 nt, hsa
gguauauugaagacgaaauuaaaauuguccuucaguuuugaggccauguguaaaguuuaacca

SEQ ID NO: 101198 - RNA, 63 nt, hsa
gcuuaagacugcugcugauaauuuuguaauauaaguuuugaaaucuaaaugucaauuuucuac

SEQ ID NO: 101199 - RNA, 63 nt, hsa
uuuuaaagauaugucuguauugaagagaaagccaguuuugaguuuuuuacacuugcacaucau

SEQ ID NO: 101200 - RNA, 63 nt, hsa
auuaaacuuuuuuuuuucaguuuauggaccaagaguuuugauuuauuuaggguggaguucagg

SEQ ID NO: 101201 - RNA, 63 nt, hsa
agagagagugugugauuagaagcuaaauaggaaaguuuugagcuucaagucagugaggaguaa

SEQ ID NO: 101202 - RNA, 63 nt, hsa
ucgaauauaguucuguguagagaaugucacuguaguuuugaguguauacaugugugggugcug

SEQ ID NO: 101203 - RNA, 63 nt, hsa
agaacugcuccuugguggccauuagaucgagucaguuuugaucugcaucacuuaguuauuggg

SEQ ID NO: 101204 - RNA, 63 nt, hsa
uuguguccuuuuaauauuguuuucaacaaugguaguuuugagguuuuggccauuuucucuuua

SEQ ID NO: 101205 - RNA, 63 nt, hsa
uuuagauuccugagagaugucucuggaagggaaaguuuugagaacuaauggcuauuuuugagg

SEQ ID NO: 101206 - RNA, 63 nt, hsa
aaaucacagaaaauugucagauuucuucgggaaaguuuugauccgagugcuuuuuugguacca

SEQ ID NO: 101207 - RNA, 63 nt, hsa
cuguaugcaucuaauuucauuugcguaauacauaguuuugagccauaagcagguucuuuaugu

SEQ ID NO: 101208 - RNA, 63 nt, hsa
aucuauauguauauguauauuuaaucaaccagcaguuuugaaacuagucauccugguacaaaa

SEQ ID NO: 101209 - RNA, 63 nt, hsa
aaagccuucuuggaaaaugggacauuagcauugaguuuugaaagaugaguaggaguuugcuaa

SEQ ID NO: 101210 - RNA, 63 nt, hsa
uauuuuuauaacgugguucuuauuuaacugucuaguuuugauagaauuuaccaggucuggcug

SEQ ID NO: 101211 - RNA, 63 nt, hsa
gcuaaauuuguauucucugugaauuucacuggcaguuuugaacuucccuuccuuaaaguacuc

SEQ ID NO: 101212 - RNA, 63 nt, hsa
gugcccaagucauuucagaaagaaagacccuucaguuuugaugcauuuugcugaacacuuggg

SEQ ID NO: 101213 - RNA, 63 nt, hsa
cuaacucaaucccugguacauuccuaauaaagcaguuuugaggaaaaucaacagacucuuuuu

SEQ ID NO: 101214 - RNA, 63 nt, hsa
gcaacuauggguuugcaguuuucugaguaggugaguuuugaauauggguaaaucagaauaaug

SEQ ID NO: 101215 - RNA, 63 nt, hsa
gccauuugaauguuaggaagcuucggggagacaaguuuugagagaagccccagagggagcuau

SEQ ID NO: 101216 - RNA, 63 nt, hsa
gagcaucucuguuugguaaggaggacaauugucaguuuugagggggacauguguuaaaucaca

SEQ ID NO: 101217 - RNA, 63 nt, hsa
gaaggagagaugaccccuacccccucaucccccaguuuugaaaaggucuaagcaagugagucu

SEQ ID NO: 101218 - RNA, 63 nt, hsa
uaucauucgccucuauaacaauuuaauguauucaguuuugacugugcuucauaucauguaccu

SEQ ID NO: 101219 - RNA, 63 nt, hsa
guaacuacuuuggcucuaccccuagaaauguccaguuuugagugacuguaguauggauggguu

SEQ ID NO: 101220 - RNA, 63 nt, hsa
ggcagugccguuccggaggccugguccaucuggaguuuugaggggugaggggaccagagcagu

SEQ ID NO: 101221 - RNA, 63 nt, hsa
uuuguuuugcuucauuuuaugcuuuuuuauuuuaguuuugauguucugagguuugcuuugguu

SEQ ID NO: 101222 - RNA, 63 nt, hsa
acaacaugccaucuauaguugccagcccuggucaguuuugauucuuaaccccauggacuccuu

SEQ ID NO: 101223 - RNA, 63 nt, hsa
uuugcaauguauugaaggaauugcugccgugugaguuuugaaugauuuugcaguaaagaccug

SEQ ID NO: 101224 - RNA, 63 nt, hsa
uuuugcuuucaggauuuggcguaaauacuugguaguuuugacaucucugcuuaacacucaaga

SEQ ID NO: 101225 - RNA, 63 nt, hsa
uguuuucagucagauuucugaaaagugagagguaguuuugauaguaaaaauuuuugguugugc

SEQ ID NO: 101226 - RNA, 63 nt, hsa
accuuguuugaagcuguuauuugcaguccuauuaguuuugagccauugcauuuaaguucccua

SEQ ID NO: 101227 - RNA, 63 nt, hsa
caggugugagccacagugccuggcccauucuugaguuuugauaaaguaauucauacaaaguac

SEQ ID NO: 101228 - RNA, 63 nt, hsa
agguagaaaaugugaaauaaaucucauauauauaguuuugaaauacguuuucuauuucaugug

SEQ ID NO: 101229 - RNA, 63 nt, hsa
ucagcauguuagacaacuacacaguauguuguuaguuuugaaagacauucacucaaggaaaac

SEQ ID NO: 101230 - RNA, 63 nt, hsa
auuguuaagcugcaguugaguuguucaagugagaguuuugauaagccacuuaugggccgcguu

SEQ ID NO: 101231 - RNA, 63 nt, hsa
ggaaaccuauuguugauauuacaguauauauggaguuuugaacuuccugaaauuaaaaaaguu

SEQ ID NO: 101232 - RNA, 63 nt, hsa
uauauuugaugggaacccagugagccaggggccaguuuugacaggucagugucccagacauuu

SEQ ID NO: 101233 - RNA, 63 nt, hsa
uuuaugauucauaauuucaguuuacuagacugaaguuuugaaguaaacacuuuucaguuucuu

SEQ ID NO: 101234 - RNA, 63 nt, hsa
uuaucuauuagauaaucaagggcacugugauacaguuuugaguaaaaagacauuuuuuaaaag

SEQ ID NO: 101235 - RNA, 63 nt, hsa
cuagggccauuguaagucacuugaauaaaaaauaguuuugaagcaugagagucauacagagcg

SEQ ID NO: 101236 - RNA, 63 nt, hsa
caggagugagauauaaacauuuugcuuuuuuucaguuuugaaauauaguuugucauccuguga

SEQ ID NO: 101237 - RNA, 63 nt, hsa
ugacagccaacuaauacaguaaacuguuauacuaguuuugagcuuuagaccucagccuuuugu

SEQ ID NO: 101238 - RNA, 63 nt, hsa
uuuuucugaugcuuugaauauaguuuugaaaggaguuuugacuuuuuuccccucauucaucuc

SEQ ID NO: 101239 - RNA, 63 nt, hsa
agaaaaaaaaauuuuuucugaugcuuugaauauaguuuugaaaggaguuuugacuuuuuuccc

SEQ ID NO: 101240 - RNA, 63 nt, hsa
uuccugucuugcuucacacaguuccuuaaaaucaguuuugaacuuuggucauagagucuucau

SEQ ID NO: 101241 - RNA, 63 nt, hsa
cucucacuucucagggaugaaauucuuuuucaaaguuuugaaguuccuugcaacuuagccaug

SEQ ID NO: 101242 - RNA, 63 nt, hsa
auacacuuccagugcugccuucuuuacacugccaguuuugacaaaacagguuuguuuuuuauu

SEQ ID NO: 101243 - RNA, 63 nt, hsa
aguaugucuucagcuugaucagauuuuaaaaucaguuuugaaagugguucccgacuucuuugc

SEQ ID NO: 101244 - RNA, 63 nt, hsa
uuccuucugggugcagacugcaccuccggaugcaguuuugauguccaucuuccaggagagacg

SEQ ID NO: 101245 - RNA, 63 nt, hsa
ggaccaggaugacaccuccauuucucuccaggaaguuuugaguuucucuccaccgugacacaa

SEQ ID NO: 101246 - RNA, 63 nt, hsa
uuuaaguucuuuugucaccaaauauuaauaaacaguuuugacuucacaccaagguuggauaaa

SEQ ID NO: 101247 - RNA, 63 nt, hsa
gaacugggcagacaccccuggagcucagccgacaguuuugaugagcagggaagucugaggccc

SEQ ID NO: 101248 - RNA, 63 nt, hsa
cuggggguagaugagacccuacuacugaacuccaguuuugaucucgugacuuuuagaaaaaca

SEQ ID NO: 101249 - RNA, 63 nt, hsa
uagauuugaugggugugaagauuaugagaguaaaguuuugaagacucagggauagcuguaaug

SEQ ID NO: 101250 - RNA, 63 nt, hsa
ccgugugugcauauuuguugguucucugauuaaaguuuugagucuaaaagcauugguuccuuc

SEQ ID NO: 101251 - RNA, 63 nt, hsa
uccgugggggaaugucauggucuugcuuuacuaaguuuugagacuggcagguagugaaacuca

SEQ ID NO: 101252 - RNA, 63 nt, hsa
gcucuguugauuguguccuuugaugaaauuuuaaguuuugauguacuguugacucuuucuguc

SEQ ID NO: 101253 - RNA, 63 nt, hsa
agcccuguauucuuggcuguacccgucgaauggaguuuugaucucgcugaguuuggaguuggg

SEQ ID NO: 101254 - RNA, 63 nt, hsa
gacaguggguugagggagaacaguucuuaguccaguuuugauguuaacuuccauagcugacaa

SEQ ID NO: 101255 - RNA, 63 nt, hsa
gacagcugggaggguuucucggucuggaggcguaguuuugaaacucacaucacccacugugca

SEQ ID NO: 101256 - RNA, 63 nt, hsa
accccaccccucguccucucggccuucuguaauaguuuugagaugucugucccuccucccugg

SEQ ID NO: 101257 - RNA, 63 nt, hsa
uuccugucugccugcaaacacaugcagacauuuaguuuugauuuacauauaguuaaauauaug

SEQ ID NO: 101258 - RNA, 63 nt, hsa
accuugugagcagaaggcaagagcggcaagaugaguuuugagcguuguauuccaaaggccuca

SEQ ID NO: 101259 - RNA, 63 nt, hsa
aacuuguuuagcacccguuuuuaagucaguagaaguuuugaacuuacaguaaaaguugugaac

SEQ ID NO: 101260 - RNA, 63 nt, hsa
gcuggagugcaguguugcaguccggcucacugcaguuuugaccucccaggcucaagcgauccu

SEQ ID NO: 101261 - RNA, 63 nt, hsa
cuaaccuguucagagccaggaaggagacugcacaguuuugaaagcacagcccgucagguccgg

SEQ ID NO: 101262 - RNA, 63 nt, hsa
aagcaacuuaucagcuacuuaagagaaauggcaaguuuugauaugaguauacaauauauaaaa

SEQ ID NO: 101263 - RNA, 63 nt, hsa
cuuuguucuugaacacuuuugcccugcagccucaguuuugaauucuuuuagcaacuuggauua

SEQ ID NO: 101264 - RNA, 63 nt, hsa
aaugacugcuauggugggaacacaauaaacaccaguuuugacuuuuagugcauaguuguccuu

SEQ ID NO: 101265 - RNA, 63 nt, hsa
cagauuggucacauaaaugccacggcauuccgaaguuuugauuuugauuaacauugacaggau

SEQ ID NO: 101266 - RNA, 63 nt, hsa
uccucuugggguuuuguaccaucugaugcuggaaguuuugauuagugauauuuucuacuacua

SEQ ID NO: 101267 - RNA, 63 nt, hsa
uuugcuuucuuauuucucuuucucugcguuguuaguuuugaagaguggaggagcuaggggcuc

SEQ ID NO: 101268 - RNA, 63 nt, hsa
gcagauuuucucacugguaucacauggucuugcaguuuugaacucuucgaccgauuuguggga

SEQ ID NO: 101269 - RNA, 63 nt, hsa
uuuugcaacgaauuuguaauuuuucuguacgauaguuuugauaauuuauaguacuuugauguc

SEQ ID NO: 101270 - RNA, 63 nt, hsa
ccguugcugacuuagaaucccuguguuaauuuaaguuuugacaagcuggcuuacacuggcaau

SEQ ID NO: 101271 - RNA, 63 nt, hsa
agggccacaaggugcaggguuaauacucuugccaguuuugaaauauagaugcuaugguucaga

SEQ ID NO: 101272 - RNA, 63 nt, hsa
ucacguguauauauagaccaaggauaugugcugaguuuugaugucaaauauauuucucuuuca

SEQ ID NO: 101273 - RNA, 63 nt, hsa
uacugaaaagaaaugaaguugauguaugucccaaguuuugaugaaacuguauuuguaaaaaaa

SEQ ID NO: 101274 - RNA, 63 nt, hsa
uuuuuauaacuuccaaaacaaaaaccugagcacaguuuugaaguucuagccacucgagcucau

SEQ ID NO: 101275 - RNA, 63 nt, hsa
guagucggauuccggggaaaagaacaaguaucuaguuuugaugacaauguuuucuuguaagaa

SEQ ID NO: 101276 - RNA, 63 nt, hsa
acuagguuuacagucccuuauuuuuaaugccuaaguuuugacagcaggaagaaaacaauuuuu

SEQ ID NO: 101277 - RNA, 63 nt, hsa
guuuaauguccuguucuuaagcucguuagagccaguuuugaaacguuuggucuuaccgugaac

SEQ ID NO: 101278 - RNA, 63 nt, hsa
gguuccguuuuacggagauuuuuccucauauuuaguuuugaaugaggaaaaugugcucaauua

SEQ ID NO: 101279 - RNA, 63 nt, hsa
caaaaaacaaaguaaccuuuuuucauaccugccaguuuugaauuuauauauguuauugaacaa

SEQ ID NO: 101280 - RNA, 63 nt, hsa
ugcuucuuggggaaaaauaguauaggaugugaaaguuuugaauuacgguuauuuaaaaacuaa

SEQ ID NO: 101281 - RNA, 63 nt, hsa
guuuuaugguacuuguuggaauugggacuuaggaguuuugauuuugauaagaaacugggauaa

SEQ ID NO: 101282 - RNA, 63 nt, hsa
uuaccaaagagcugccaagguuacagugaacagaguuuugaaaggcauugcuuuaaaggaaaa

SEQ ID NO: 101283 - RNA, 63 nt, hsa
aaauaaggaaaaacccuucucauuguuaacuggaguuuugauguauuucucuuuggaugaaua

SEQ ID NO: 101284 - RNA, 63 nt, hsa
agggcuucaucuucacuugauggcuuuaaggacaguuuugaucuacagggccagucuacauua

SEQ ID NO: 101285 - RNA, 63 nt, hsa
augguggugguuuggcuucuguucuuauucuugaguuuugauaccacgcagaccuuggguggg

SEQ ID NO: 101286 - RNA, 63 nt, hsa
acugggaugaaacuaaagcaauagaaacaacacaguuuugaccuaacauaccguuuauaaugc

SEQ ID NO: 101287 - RNA, 63 nt, hsa
aucuccuuguuccagcugaaaaccugcugugagaguuuugacagagcacuuuauuuucgucaa

SEQ ID NO: 101288 - RNA, 63 nt, hsa
cacaaaccuucuuuucaaugcaaugcaucugaaaguuuugauacuuguaacuuuuuuuuuuuu

SEQ ID NO: 101289 - RNA, 63 nt, hsa
aaguugaaauggguauguaaguugaaaaccagaaguuuugagaaacauccuuuguuaacuuuc

SEQ ID NO: 101290 - RNA, 63 nt, hsa
accuuccaaaacaaaaauaaagaccuguccaaaaguuuugacaaaaauacugauugcucccaa

SEQ ID NO: 101291 - RNA, 59 nt, hsa
cgagccgagaacggucgugaguacuguggaguuuugagggauggcaccguccaggccgc

SEQ ID NO: 101292 - RNA, 63 nt, hsa
gcugaucagaagcucagcauggccauuaugccuaguuuugaugaauaaacaugggaaagccau

SEQ ID NO: 101293 - RNA, 63 nt, hsa
uagaaugaaaugacuuugauuccugcgccuuuuaguuuugaacucuggaauuccucugccccc

SEQ ID NO: 101294 - RNA, 63 nt, hsa
cagagauuggguccuugggccuggcuucuuaagaguuuugaugaugcugggaaaagugacugc

SEQ ID NO: 101295 - RNA, 63 nt, hsa
ucaucuuaaauuucaaaccauuuaccaucugaaaguuuugauuugaauguaaaacaggaaauu

SEQ ID NO: 101296 - RNA, 63 nt, hsa
uuaccuguggaguugcauauccaaaccuuagugaguuuugaagcuuuaagcaaauucuuuuaa

SEQ ID NO: 101297 - RNA, 63 nt, hsa
acauuuauuggugcugccagcuuuaagcauaugaguuuugauauucuauauuuuucaaauccu

SEQ ID NO: 101298 - RNA, 63 nt, hsa
cugcucuuuaccuugcauuuuagcuaauuuaggaguuuugagaauguauuggauacgcuccag

SEQ ID NO: 101299 - RNA, 63 nt, hsa
uguuaaagggcaagaaaaaagggaggggguuggaguuuugaacguaguaagccuuaccuuaau

SEQ ID NO: 101300 - RNA, 63 nt, hsa
uuggcagaaagacauuuuucuccucaguagcauaguuuugauguuagugaggaacauuguuga

SEQ ID NO: 101301 - RNA, 63 nt, hsa
gaccacuugcugucucuguuguauuuugguaugaguuuugauagcucuauaaaauguuuugga

SEQ ID NO: 101302 - RNA, 63 nt, hsa
uguuuauaugguaaaggaauccuuucagcugccaguuuugaauaaugaauaucauauuguauc

SEQ ID NO: 101303 - RNA, 63 nt, hsa
caagguaacagaauugcugacaucugucuaaaaaguuuugacuauccaauuuagauguguaau

SEQ ID NO: 101304 - RNA, 63 nt, hsa
caaaauguugauaucauaggugauguacaauuuaguuuugaaugaguuauuauguuaucacug

SEQ ID NO: 101305 - RNA, 63 nt, hsa
cuacagccaguaagugauaaaucuagaaaauugaguuuugaguaccucuuuucccauauacaa

SEQ ID NO: 101306 - RNA, 63 nt, hsa
gucuuuaaaacauagugauuacaauauuuagaaaguuuugagcacuugcuauaaguuuuuuaa

SEQ ID NO: 101307 - RNA, 63 nt, hsa
uguugauaauuuuuagaagcaaauuuuccugaaaguuuugaguagaggugagacccccucccc

SEQ ID NO: 101308 - RNA, 63 nt, hsa
uguauuucaguaguuguagaauuauugauauuuaguuuugauagcuaauguuuaauuguuugg

SEQ ID NO: 101309 - RNA, 63 nt, hsa
cauuuuuucauuucucuucucauuuuucaggaaaguuuugaguguuauaagguggaaggaaac

SEQ ID NO: 101310 - RNA, 63 nt, hsa
auaaacaccgaggcuuacuguaguagaaacuuuaguuuugaugaugcacaaaauaaacagcag

SEQ ID NO: 101311 - RNA, 63 nt, hsa
aauauguuuuauucagcuucuauaagugugaccaguuuugauauuuauuuaugcuaauauuuu

SEQ ID NO: 101312 - RNA, 63 nt, hsa
uaaaauaaauacaaauguuuauuucagaagggcaguuuugauuauaugugaauacacaaauuu

SEQ ID NO: 101313 - RNA, 63 nt, hsa
auuuugguuacauugaauacagauuugcugaacaguuuugauguuauuuuuuuaauaaaauuu

SEQ ID NO: 101314 - RNA, 63 nt, hsa
gguucuuaaauccucauaucuggaaacuugugaaguuuugacaccuuuccuauagauauagga

SEQ ID NO: 101315 - RNA, 63 nt, hsa
aaaauguccaacauacaguuuuuaaaguguggcaguuuugaguaguaacuuagaauguauaag

SEQ ID NO: 101316 - RNA, 63 nt, hsa
uccaggguuugggcuugauuccuguugaauaauaguuuugagcauucuuugugguuaaauaaa

SEQ ID NO: 101317 - RNA, 63 nt, hsa
ucuuugugguuaaauaaauucuuaaaucugccuaguuuugaugaauucuuuugugaaacuuga

SEQ ID NO: 101318 - RNA, 64 nt, hsa
gcgggacugaggcugccucacguguugcaagaacaguuuugagccauuguuaacaaugccuuuu

SEQ ID NO: 101319 - RNA, 64 nt, hsa
cuuuccuaccagcccagagccuuguggcuuguacaguuuugaaacucccguucuauuuuaugau

SEQ ID NO: 101320 - RNA, 64 nt, hsa
caaagugaaaauuuuuuuuuuucuuuugaaaucuaguuuugaauaagucugggugaccgcaccu

SEQ ID NO: 101321 - RNA, 64 nt, hsa
cacguuucuacccagauccuuuuucauuuccuuaaguuuugaucuccgucuuccugaugaagca

SEQ ID NO: 101322 - RNA, 64 nt, hsa
acaaugggugggggcuauucuuuugcuaucaggaaguuuugaggagcaggcagaguggagaaag

SEQ ID NO: 101323 - RNA, 64 nt, hsa
cuggauugauguggagaaaacaccuuucccuucuaguuuugagagacuuccucuuggcucccag

SEQ ID NO: 101324 - RNA, 64 nt, hsa
agcaacuuguacaguggcugagaaaauaggauauaguuuugauuuuuuuaauuguaaaauauuu

SEQ ID NO: 101325 - RNA, 64 nt, hsa
gaaaguuaaugagguuuuuaaaauaagguuuucuaguuuugagagugugcacuucacacagggg

SEQ ID NO: 101326 - RNA, 64 nt, hsa
agguucugaaguaaaggcuuguuaaguuucucuuaguuuugauuugaggcaucccguaaaguug

SEQ ID NO: 101327 - RNA, 64 nt, hsa
aauauuuauagugagauugugaaagcaaccuuaaaguuuugaagaagacugaugagacuaggug

SEQ ID NO: 101328 - RNA, 64 nt, hsa
caagugguaauaaacaugaaaacugguuuguagcaguuuugaaagaauagaaugcauucaaaug

SEQ ID NO: 101329 - RNA, 64 nt, hsa
agacuuuggacaguggccucuugaguuccucugcaguuuugacauuuaggauuuugugucuuuu

SEQ ID NO: 101330 - RNA, 64 nt, hsa
gcaaacuacuacuacuacuguucaguuuuuuaaaaguuuugaaaugcugcacuuacauuuaaaa

SEQ ID NO: 101331 - RNA, 64 nt, hsa
uuggccauaugcuagggccccugugaaaauaaguaguuuugagaaguuuuucuauauacguaua

SEQ ID NO: 101332 - RNA, 64 nt, hsa
uggucugauaccuaaggagccugguucaguagaaaguuuugaauuuaaaccagaaccuucuaaa

SEQ ID NO: 101333 - RNA, 64 nt, hsa
agaguacagaaugacaacauugagcccacacugcaguuuugaagauaguaacugauggcuggug

SEQ ID NO: 101334 - RNA, 64 nt, hsa
auuucuucuuuggguauaggguugaggggaaauaaguuuugagugagaaauaaacguuuuagcu

SEQ ID NO: 101335 - RNA, 64 nt, hsa
auccauuugucccauuaguugcuguggauuaucaaguuuugaaggaacuguacaucccaacaga

SEQ ID NO: 101336 - RNA, 64 nt, hsa
ugcucaugucauuuuucucauggucacauuuaacaguuuugacauguuauacuugcgcauagau

SEQ ID NO: 101337 - RNA, 64 nt, hsa
aagucugucuagucauuguaaauauuuaucugucaguuuugacagauuggggccagcuugaugu

SEQ ID NO: 101338 - RNA, 64 nt, hsa
uuuuuaaaucuugcaauuguaugugugauuauggaguuuugaaaacguuacauuuuuuaaaucu

SEQ ID NO: 101339 - RNA, 64 nt, hsa
agggucacagaccucccucccaucugggugccugaguuuugacuccaaucagugauaccagacc

SEQ ID NO: 101340 - RNA, 64 nt, hsa
gaaccaaugacuacuuaggauggguuguggaauaaguuuugauguggaauugcacaucuaccuu

SEQ ID NO: 101341 - RNA, 64 nt, hsa
ugucuaauguaugugcacauauaaguaauacaaaaguuuugagcucuuccaaguauaccauuua

SEQ ID NO: 101342 - RNA, 64 nt, hsa
aauuguguacagugguuauuuuccccaguuguauaguuuugagacauucaauuaucacugucuu

SEQ ID NO: 101343 - RNA, 64 nt, hsa
aagucuagcauuuacuuuuaaauaauuauaaugaaguuuugaaauacuaaguuaauccagaccu

SEQ ID NO: 101344 - RNA, 64 nt, hsa
gcaugacaaccagacauuuccaguugguuuuguaaguuuugagaaucuagauacuggguuuuau

SEQ ID NO: 101345 - RNA, 64 nt, hsa
aagcugguggacuacgcgcgcagcgugcacgaggaguuuugagcgcccggccgcgccccgcgcc

SEQ ID NO: 101346 - RNA, 64 nt, hsa
ugguuuucuaugucuuuuugaacucuuguaaucgaguuuugaucauauuuucuauuaaaguggc

SEQ ID NO: 101347 - RNA, 64 nt, hsa
accggcuaugugaacugccuauuuccuaugcuggaguuuugauuuuuaacuaaacgcaaaucug

SEQ ID NO: 101348 - RNA, 64 nt, hsa
augguguggacugaaugggaucaugaaaguagacaguuuugagaacguaaagaacuuuuucuuu

SEQ ID NO: 101349 - RNA, 64 nt, hsa
cuuggugccaccaacccauuuugugccacaugcaaguuuugaauaaggaugguauagaaaacaa

SEQ ID NO: 101350 - RNA, 64 nt, hsa
cucccaauauuuuuuuacuuuaauuuuucccacaaguuuugaucagcaaauaaacagcauucuu

SEQ ID NO: 101351 - RNA, 64 nt, hsa
ugggcagggacuacagggaaggcuccuucaucccaguuuugagaugaagcuguacuccccauuu

SEQ ID NO: 101352 - RNA, 64 nt, hsa
caaguaggacaugacuaggaguguuaggggcagaaguuuugaaugcacuuaaccggaggagggc

SEQ ID NO: 101353 - RNA, 64 nt, hsa
gccauagguagccuuacuacuugggccucuuucuaguuuugaauuauuucuaagccuuuugggu

SEQ ID NO: 101354 - RNA, 64 nt, hsa
cccagagaagcucauuuaguuagaaaauaaggcaaguuuugaagccugcuaaaugaagagacuu

SEQ ID NO: 101355 - RNA, 64 nt, hsa
auugcagggaagacugagaaaacaguaggaugacaguuuugaguauacucugcacuuuucaauu

SEQ ID NO: 101356 - RNA, 64 nt, hsa
ccaauugcugcuuguacacucauucauuacuaaaaguuuugagaaauuuuuuuuuccaguaaug

SEQ ID NO: 101357 - RNA, 64 nt, hsa
guuuuuauucuguuuuauaaaccagagagaaaugaguuuugacgucuuuuuacuugaauuucaa

SEQ ID NO: 101358 - RNA, 64 nt, hsa
uaauggaaaacauaaguagaauaggugaccucuuaguuuugaacuuauuuaaguguggggauga

SEQ ID NO: 101359 - RNA, 64 nt, hsa
acuugaaccaauguuuuuauuucauauauuuuauaguuuugaaacuaguuucucauaaaauucu

SEQ ID NO: 101360 - RNA, 64 nt, hsa
acacuuccacccuuuuuucuaaguguucgucuuuaguuuugauuuuggaaagauguuaagcauu

SEQ ID NO: 101361 - RNA, 64 nt, hsa
augacauggcuuauguuaaaaauacccagugcucaguuuugaaagauaggcaaaaaaaaaaaag

SEQ ID NO: 101362 - RNA, 64 nt, hsa
auacuuauauuuucguaugaaaaugaguugugaaaguuuugaguagauauuacuuuaucacuuu

SEQ ID NO: 101363 - RNA, 64 nt, hsa
guuuugugauuuuauuugugcaggucaugcacacaguuuugauaaagggcaguaacaaguauug

SEQ ID NO: 101364 - RNA, 64 nt, hsa
acugaaaccugaauuggauacugccagaauagguaguuuugaaacaaguuaaggacaugguaua

SEQ ID NO: 101365 - RNA, 64 nt, hsa
cugaaguagaaauagcaauuaagaaauuaauucaaguuuugacgguuaacauuuagcagaaaaa

SEQ ID NO: 101366 - RNA, 52 nt, hsa; identical to SEQ ID NO: 100853

SEQ ID NO: 101367 - RNA, 64 nt, hsa
ggcuguacaagugaagacaagggcuuuuuaugcaaguuuugaaagauagguauuuauuuuuucu

SEQ ID NO: 101368 - RNA, 64 nt, hsa
gagcaggauaugugauacugugugguugguguggaguuuugaagaaggggcuguguuugggcca

SEQ ID NO: 101369 - RNA, 64 nt, hsa
gcaugaaucaaggugguggcagcaaacuucuaguaguuuugauauguccuugauagaacaaaua

SEQ ID NO: 101370 - RNA, 64 nt, hsa
cuucaaugaacaaagggauucuccaggauuccaaaguuuugaagucaucuuagcuuuccacagg

SEQ ID NO: 101371 - RNA, 64 nt, hsa
agcagggaagggaagcagaucuagggaggaaggcaguuuugauuugaggagguuugcacaugua

SEQ ID NO: 101372 - RNA, 64 nt, hsa
auauucuaacauugcacaaguugaugagauaucaaguuuugaauauuauucaggaagcacuuug

SEQ ID NO: 101373 - RNA, 64 nt, hsa
gaugugaaaaagccuaagaaaaaggaaauuggacaguuuugauacaaacuuuguuugcuaaugc

SEQ ID NO: 101374 - RNA, 64 nt, hsa
cuuagucccccuggucugaacuaguugagagaguaguuuugaacagucguaaccguggcuggug

SEQ ID NO: 101375 - RNA, 64 nt, hsa
uguauuucaggcuggaaaugaauuauucuuuaccaguuuugaaacacuuugaaauauccuaagg

SEQ ID NO: 101376 - RNA, 64 nt, hsa
gccuuuugaagauacacaaaacacugaggauuuuaguuuugaaaucaaagacuauuaaaggagc

SEQ ID NO: 101377 - RNA, 64 nt, hsa
gaccaauaucaauagacuucuugaggcuacuauaaguuuugagaaauaagguucaaaaaauaag

SEQ ID NO: 101378 - RNA, 64 nt, hsa
auccagggggaaaugcuggaagucaauaaaacugaguuuugagagcuuggugguguguuguguu

SEQ ID NO: 101379 - RNA, 64 nt, hsa
cagaguguuguaguuuuaagguuagcgugacuucaguuuugacuaaggaugacacuaauuguua

SEQ ID NO: 101380 - RNA, 64 nt, hsa
ggauuuggggggaccauguaacuuaauuacugcuaguuuugaaaugucuuuguaagaguagggu

SEQ ID NO: 101381 - RNA, 64 nt, hsa
uaguucgcauuuauguaaaacauucagaaaaugaaguuuugaauuuguuggaacauucaaagga

SEQ ID NO: 101382 - RNA, 64 nt, hsa
gaauugaagauuauucauugcuuuggccucacaaaguuuugauuucaacuaucauaagugaaaa

SEQ ID NO: 101383 - RNA, 64 nt, hsa
auuagcuaaggaacucaugucugaauuuuguuguaguuuugaauguugugcucuuucauacaga

SEQ ID NO: 101384 - RNA, 64 nt, hsa
acuguuaaauugaacguaaauaacuuuggaaaacaguuuugacacuagaacaaggucgcuucuc

SEQ ID NO: 101385 - RNA, 64 nt, hsa
acuugaauaaguaguuuucauguuuucaauaugcaguuuugaaaaugaggauucaccuagacuu

SEQ ID NO: 101386 - RNA, 64 nt, hsa
uaaauugccauucacuuuuagaaucuuguauuuaaguuuugauuuucaaauguucugcuucaug

SEQ ID NO: 101387 - RNA, 64 nt, hsa
aauaguuugcaagcagauuucuauauuguauuacaguuuugaaaacagauuugguaucauucua

SEQ ID NO: 101388 - RNA, 64 nt, hsa
uuucuuuuauuuucucuagugacuucuugcugcuaguuuugaaggacauuguaucgcagaggcc

SEQ ID NO: 101389 - RNA, 64 nt, hsa
ggaauuucugaaaguaucagucuucugaauucugaguuuugaaaauauauuuugaggagaaaaa

SEQ ID NO: 101390 - RNA, 64 nt, hsa
ccguguuguuugacucagaaggcccuucuacuucaguuuugaauccacaaagaauuaaaaacug

SEQ ID NO: 101391 - RNA, 64 nt, hsa
uagcagcugguuggggacuauauucugucacuggaguuuugaaugcagggaccccgcauuccca

SEQ ID NO: 101392 - RNA, 64 nt, hsa
guaaacuuaauugauaaagcucuguuuaauuuagaguuuugaagaaauagucucccuucaauua

SEQ ID NO: 101393 - RNA, 64 nt, hsa
auuaagaaaacauugcuuugugguuaucacuuuaaguuuugacaccuagauuauagucuuagua

SEQ ID NO: 101394 - RNA, 64 nt, hsa
ugugcaacagaaccauuaauaaaagaaaggaguuaguuuugagguaacugcauucauuaggggc

SEQ ID NO: 101395 - RNA, 64 nt, hsa
uuguaccauuuauuuuaugacauuuuacaauguaaguuuugaaacuaacuguugguaggagaaa

SEQ ID NO: 101396 - RNA, 64 nt, hsa
auuauuaaaauauccuauuuaauuugaauagugaaguuuugaaaauacuuugaaaaagagaagu

SEQ ID NO: 101397 - RNA, 64 nt, hsa
ugcuauuuguuguauuuaugcuuaagagcaaaaaaguuuugaugggauuuuaaauucaggcaaa

SEQ ID NO: 101398 - RNA, 64 nt, hsa
ucucugguggucuuccuucuaccccaaggccaguaguuuugacacuucccaguggaagauacag

SEQ ID NO: 101399 - RNA, 64 nt, hsa
cuuauuuuucuaaacguaagcacuguuuuuccauaguuuugaugacuggcauuuuauagacacc

SEQ ID NO: 101400 - RNA, 64 nt, hsa
uacauguaccuauagaaauagaacacugccucugaguuuugaugcuguauuugcugccagacac

SEQ ID NO: 101401 - RNA, 64 nt, hsa
aagaguugagugauagagcuaacccuuaucuguaaguuuugaauuuauauuguuucaucccaug

SEQ ID NO: 101402 - RNA, 64 nt, hsa
cauugcaguaugaguugccacuggauugacgcaaaguuuugaguuuauuucaguaaccuacaua

SEQ ID NO: 101403 - RNA, 64 nt, hsa
uaaacgacuaaaggauuuguuggguuuuugcuuaaguuuugaaccaaauccuagagccagcuga

SEQ ID NO: 101404 - RNA, 64 nt, hsa
agacugucaguaggcuggaagaaguggauauugaaguuuugacaucaaugaugaggcuccaguu

SEQ ID NO: 101405 - RNA, 64 nt, hsa
uauagagaggcaaaggacacagaguagcuaaccuaguuuugaagaacaagaugggggguuuuau

SEQ ID NO: 101406 - RNA, 64 nt, hsa
uuggagacuaauucuaauguggaccuuagaauacaguuuugaguagaguugaucaaaaucaauu

SEQ ID NO: 101407 - RNA, 64 nt, hsa
aacacaccaaguuuggaaauacaauuguacauggaguuuugaucaacggacuuaucucagcucu

SEQ ID NO: 101408 - RNA, 64 nt, hsa
uacaauaacccaguuacuuuuuuacacugauaaaaguuuugauauuuauuuuuugccauuuuau

SEQ ID NO: 101409 - RNA, 64 nt, hsa
auuuuuuuuuuuaagaagaaagaaaaugcaagcuaguuuugagaaaggaaggccaaauuggguc

SEQ ID NO: 101410 - RNA, 64 nt, hsa
gaaaaccaagaaauguaaagauaacaggaaaauaaguuuugauugcauuguuuuuaaaauaagc

SEQ ID NO: 101411 - RNA, 64 nt, hsa
caaaaaaaaguaguuuuuccuucauaacauacucaguuuugaauuacauguagugucacaugaa

SEQ ID NO: 101412 - RNA, 64 nt, hsa
acaaaaaauaaauagccaugcauuugauuuguuuaguuuugauuguuuuaacaguuaguaaugg

SEQ ID NO: 101413 - RNA, 64 nt, hsa
uucuaaaauauuggagaugaggaaaauguacuugaguuuugaaauauuuugguaagccucucuu

SEQ ID NO: 101414 - RNA, 64 nt, hsa
cauauauacuugagguguagagauguuauuaagaaguuuugauguuagaauaauugcuuuugga

SEQ ID NO: 101415 - RNA, 64 nt, hsa
cugugucggcugcccccugauccuuccauuaucaaguuuugaaggguguuggggaaauuauggc

SEQ ID NO: 101416 - RNA, 64 nt, hsa
uucacagacuagaccuuucuuauccuccuccuagaguuuugacuugggacucuaguguuaagau

SEQ ID NO: 101417 - RNA, 64 nt, hsa
auuagaggacaaauauuuuuagauccauuuaaggaguuuugaagugccuaagaugaccuauuug

SEQ ID NO: 101418 - RNA, 64 nt, hsa
gcuagguagaauuuguacuuguuuucuugguagcaguuuugaaauauucuguacaguacguucc

SEQ ID NO: 101419 - RNA, 64 nt, hsa
cagagguucagucugcuucauggucucuuggaccaguuuugacuacaaaaaaaaaaaaaaaaaa

SEQ ID NO: 101420 - RNA, 64 nt, hsa
agagcuguuucaaaggaaguugguuucugguccaaguuuugaccuaaaccauguccaucuucua

SEQ ID NO: 101421 - RNA, 64 nt, hsa
uuaguucuuucuuccaguuauacuauguacuaucaguuuugauauaacuauauauauauaaaua

SEQ ID NO: 101422 - RNA, 64 nt, hsa
uuaagugguggaaaaaggaaaguauauauguuagaguuuugaaugagggauaaauagaaagcag

SEQ ID NO: 101423 - RNA, 64 nt, hsa
cucaguaaagauuuaauuccaugcuagcucaauuaguuuugaauuauauguauagcuugaaaag

SEQ ID NO: 101424 - RNA, 64 nt, hsa
cauuuugcuaaccuaguuuguuacuuuaaaaaucaguuuugaugaaaggagggaaaagcagaug

SEQ ID NO: 101425 - RNA, 64 nt, hsa
cagaacuuuagugcuaggggaagaugaaaugugcaguuuugaaauguuggguuuccagagagag

SEQ ID NO: 101426 - RNA, 64 nt, hsa
auucugcuucagaguauaaugaugacccuucuugaguuuugaacaccugaaauuguaaucacug

SEQ ID NO: 101427 - RNA, 64 nt, hsa
gccugugguacgcacugaauuuucuuugucacauaguuuugaauuucacagccuucugcauugc

SEQ ID NO: 101428 - RNA, 64 nt, hsa
ugcaagugguuuuuauaaauuggaauaauaccucaguuuugagguuaugcacacuaaauuaaau

SEQ ID NO: 101429 - RNA, 64 nt, hsa
uuuuauuuucaguaacuauuuuuuuuauaguuguaguuuugauuuaaagggggggaaacaaguu

SEQ ID NO: 101430 - RNA, 64 nt, hsa
ccacauauaucucaaaucuggcuacugcaaaaccaguuuugacaggucagauuuucauauguau

SEQ ID NO: 101431 - RNA, 64 nt, hsa
uacuacacuaauuuccaacauaagaggcaggaagaguuuugauucuauccuuuuuuacuaaaca

SEQ ID NO: 101432 - RNA, 64 nt, hsa
aucauuuucuuggcauguuaaaucaagcuuaaaaaguuuugagaaaauuuuacugcgcuguguu

SEQ ID NO: 101433 - RNA, 64 nt, hsa
aagaaaaugaauuuuuuccugcagcaggaaacauaguuuugaguaguucuaccucuuauuugua

SEQ ID NO: 101434 - RNA, 64 nt, hsa
uaaaagcaaaauuaacaaugaucugugcucugaaaguuuugaaaauauauuugaacaauuugaa

SEQ ID NO: 101435 - RNA, 64 nt, hsa
uaggagaagucuucuauuuauuuauuuauucauuaguuuugaagauucuauguuaauauuuuag

SEQ ID NO: 101436 - RNA, 64 nt, hsa
cagacacacucacacacaagagccaggaugguggaguuuugauuggguggguuguuugaggggg

SEQ ID NO: 101437 - RNA, 64 nt, hsa
uuaaaauccauuuuaggugauaaaauuuuuuaaaaguuuugaaggaaaccucuggauaaaugga

SEQ ID NO: 101438 - RNA, 64 nt, hsa
auguuuaucaaaucguguacuaaaauggaaagcuaguuuugagaaauuauucagaagccuuguu

SEQ ID NO: 101439 - RNA, 64 nt, hsa
gauguuuguuuauucuaccucaaacagaggcuuaaguuuugaaguguaaccaguuuauacuuca

SEQ ID NO: 101440 - RNA, 64 nt, hsa
acaauuauguucauuuuaagcaaaauuuuaagaaaguuuugaaauucauaaagcauuugguuuu

SEQ ID NO: 101441 - RNA, 64 nt, hsa
uacuaauuaauuuuuagauucaauauuuauauggaguuuugaaaaauaauaguggcccugaagg

SEQ ID NO: 101442 - RNA, 64 nt, hsa
gaaguuuuucuauuuagcaaaauaauuaguaauaaguuuugacuaggucuaaagaaugaacaca

SEQ ID NO: 101443 - RNA, 64 nt, hsa
auagcagcugacugaaaaucagcacugccugaguaguuuugaucaguuuaacuugaaucacuaa

SEQ ID NO: 101444 - RNA, 64 nt, hsa
uucuuaaccacuuuugucauuuguuuuuuggaguaguuuugaaaaguguuuuauauugagugca

SEQ ID NO: 101445 - RNA, 64 nt, hsa
uucugucuguaaucacuaaagucaacuuuaauagaguuuugaaacaguacugugcaauccgaug

SEQ ID NO: 101446 - RNA, 64 nt, hsa
auuucucuugcucaccaagaaguaacaaaaguauaguuuugacagaguugguguucauaauuuc

SEQ ID NO: 101447 - RNA, 64 nt, hsa
gacuauuuuaagagauucagcaugcauggauauuaguuuugauuaauguguacaauaauuuaca

SEQ ID NO: 101448 - RNA, 64 nt, hsa
ccacugaucuugacaucaagucuaacaaagaaaaaguuuugaguuuuguauuuucuuuuuucuu

SEQ ID NO: 101449 - RNA, 64 nt, hsa
agagaaaaauacuaugugguuucuguaaguuaccaguuuugaaugaaaaaugguaaauggauuu

SEQ ID NO: 101450 - RNA, 64 nt, hsa
auuaagaaauguuuuuauuuucucuaucaacaguaguuuugaaacuagaagucaaaaaucuuuu

SEQ ID NO: 101451 - RNA, 64 nt, hsa
uccaucaguuucuuuaaaauuggauugucuggugaguuuugauauuaaacauuauguagcuaag

SEQ ID NO: 101452 - RNA, 64 nt, hsa
ucauguuugaagcuauagcuuacuaucaugagacaguuuugauuuugggacucuuucaagugua

SEQ ID NO: 101453 - RNA, 64 nt, hsa
uaaacaagaacaaauacucuaaacuuaugugaacaguuuugaguuuaugaauucuagaaacuaa

SEQ ID NO: 101454 - RNA, 64 nt, hsa
gccugguacaucacccaugaugucaauuaaaaaaaguuuugaucuuuuaauguaacucagauug

SEQ ID NO: 101455 - RNA, 64 nt, hsa
ugaaacuuacgcaguaaucacuaccuggaaggugaguuuugaucucuuuuuaaggagaggcacu

SEQ ID NO: 101456 - RNA, 64 nt, hsa
uguaacagcaaccccuguggacuuuguggguaugaguuuugauugaaauauaaagcuuucuuuu

SEQ ID NO: 101457 - RNA, 64 nt, hsa
caccaucuugaagucauuguccgguuuccguagcaguuuugaaaccuuaguaccuuuuuaacag

SEQ ID NO: 101458 - RNA, 64 nt, hsa
uaggauuugcacugcuuuauuuuagguggcugggaguuuugauugcauauuuuguuauaguuca

SEQ ID NO: 101459 - RNA, 64 nt, hsa
ugguacaauguaaaaugccaugcuuauguuuauaaguuuugagauuuuuuuuuuuucugaaaag

SEQ ID NO: 101460 - RNA, 64 nt, hsa
aaaguaucugauuuuuaaaguaaauauuuuuuaaaguuuugacauuuaaauuacuugaaucuca

SEQ ID NO: 101461 - RNA, 64 nt, hsa
aguacuugaaauucuuaccagaaaauuacuuuggaguuuugaagccuuuauuaauacuacuuuu

SEQ ID NO: 101462 - RNA, 64 nt, hsa
ccuagaguucauagauggacuuuugggacccagcaguuuugaaauguguuuauggaguuuaaga

SEQ ID NO: 101463 - RNA, 64 nt, hsa
ucuuggugccuaauuuucuagaugauaauaggcuaguuuugauuucuugcucauuuucagaaua

SEQ ID NO: 101464 - RNA, 64 nt, hsa
uuaguugaaguuuaugagggaaauaccaguguucaguuuugaacuauaauaguuuguauauuca

SEQ ID NO: 101465 - RNA, 64 nt, hsa
uuuaugaaguuuaaaaauagcucacuuuaaagcuaguuuugaauaggugcaacugugacuuggg

SEQ ID NO: 101466 - RNA, 64 nt, hsa
ucuugacuaauucauuguuacgucacuuuucuauaguuuugagaguucgauaaaagccauuaaa

SEQ ID NO: 101467 - RNA, 64 nt, hsa
acaaaaggugugggcuuuggggucuucuggaaauaguuuugaccagacaucuuugaagugcuuu

SEQ ID NO: 101468 - RNA, 64 nt, hsa
aaauugaaauuuaauuguagacuucaauaguccaaguuuugaaggauguuugagcuuuuguaua

SEQ ID NO: 101469 - RNA, 64 nt, hsa
gaaaauacauaugcagucuagucagacaaaauaaaguuuugaagugcuacuauaauaaguuuuu

SEQ ID NO: 101470 - RNA, 64 nt, hsa
uguuuugaaaagaaaauagcuuuuuauacuuuuuaguuuugauuucgguaacuaguuuaacuac

SEQ ID NO: 101471 - RNA, 64 nt, hsa
uucaagucugugguuuugaugcagagaagaaaauaguuuugauuuuugaguuuuuaacagaagu

SEQ ID NO: 101472 - RNA, 64 nt, hsa
uuauuuacacuuuauugucucccgcuucucagauaguuuugauguguuguacaguggaauaucu

SEQ ID NO: 101473 - RNA, 64 nt, hsa
cucaccucugaaggcaaauauaagcugggaaaaaaguuuugaugaaauucuugaaguucauggu

SEQ ID NO: 101474 - RNA, 64 nt, hsa
aagacugggaccuuagaaaucauuguagaaacacaguuuugaaagaaaaauaccaugucucuaa

SEQ ID NO: 101475 - RNA, 64 nt, hsa
ugaauacauauugaaauagugugcuggcuuuuguaguuuugauaaagaccauugcaggcaaugg

SEQ ID NO: 101476 - RNA, 64 nt, hsa
guagguacauggacuauaucgcacaacaggugcuaguuuugagaaggcccaacaggaguuugca

SEQ ID NO: 101477 - RNA, 64 nt, hsa
gucugucaaauuguauuucaguggcacaaaaaccaguuuugaggucuuagacuuauaauucuuu

SEQ ID NO: 101478 - RNA, 64 nt, hsa
cacuccgucgugguuuuauuuuuaauauagagagaguuuugaauucuacacuguugucuuuccu

SEQ ID NO: 101479 - RNA, 64 nt, hsa
ccugucuugaugacacuugcagggcaggcugaaaaguuuugagauugagcagcuugggaguuug

SEQ ID NO: 101480 - RNA, 64 nt, hsa
agagggaugcccauuccaugguccuccagagaauaguuuugacuuaacaugucuguuuagccca

SEQ ID NO: 101481 - RNA, 63 nt, hsa
ugugggaguaaaauacugaauauaugaguuuuucaguuuugaaaaaaaucucauguuugaauc

SEQ ID NO: 101482 - RNA, 64 nt, hsa
auuauuugaaucugucuuuuugauugccucuugaaguuuugacauagagacauuuacucuggag

SEQ ID NO: 101483 - RNA, 64 nt, hsa
ugggggauguucugcacccaguggacuucaaaagaguuuugaagacuuaauuuuuuguaaaaca

SEQ ID NO: 101484 - RNA, 64 nt, hsa
uaguuucaguuucucauggaaauugguaaauguuaguuuugacuucaucuauuuuuuauuuguu

SEQ ID NO: 101485 - RNA, 64 nt, hsa
gaaauggauuuucacggaagagacagcucugaaaaguuuugaugcuuguggcaagagacuuaac

SEQ ID NO: 101486 - RNA, 64 nt, hsa
uuuaaaaagaauucaaaaaaagacugacaaugacaguuuugaguuggauagugaaaaaguggag

SEQ ID NO: 101487 - RNA, 64 nt, hsa
aaaaauaauuaccaaggccucccuucuacuugugaguuuugaaauuguucuuuuuauuuucagg

SEQ ID NO: 101488 - RNA, 64 nt, hsa
ucacaaucuuuggugacgggucacaggcauugguaguuuugaagcucuccaggugauuccaaug

SEQ ID NO: 101489 - RNA, 64 nt, hsa
aguauacauucucuagucugugaugucuggagcuaguuuugagggugaaccacacuuuauccaa

SEQ ID NO: 101490 - RNA, 64 nt, hsa
uaugaagagcgaaaucaaauucuuauuuuuguacaguuuugaaguuuauacuuagaacugacca

SEQ ID NO: 101491 - RNA, 64 nt, hsa
ugugcugagauauaccuguacuauuuaugguuuaaguuuugauucuuagguauuuucuccagcu

SEQ ID NO: 101492 - RNA, 64 nt, hsa
gccaucagcauagacuugacuuccuuaaaccgagaguuuugauguggccuuggcaacccuaaaa

SEQ ID NO: 101493 - RNA, 64 nt, hsa
cucuaagcaauagagagcuucaugacugaguaagaguuuugaagucagcagugaaucaagugcc

SEQ ID NO: 101494 - RNA, 64 nt, hsa
guuguuuucugugaaaacagcagugaacagguucaguuuugaacuggcccugaggaaauggguc

SEQ ID NO: 101495 - RNA, 64 nt, hsa
gacugggcuuucuccccacuaagggcaaggccccaguuuugaccaaucgcaugguucuccuggc

SEQ ID NO: 101496 - RNA, 64 nt, hsa
acgugagacaagcaguuaauaguaugaucuuuaaaguuuugacaauauaaaauaaacuugguaa

SEQ ID NO: 101497 - RNA, 64 nt, hsa
aauaaaggaaauucagauuguuuaaaugccuaaaaguuuugagauaaguuuuguuucaauuaga

SEQ ID NO: 101498 - RNA, 64 nt, hsa
caaaaugaaagcaacagugauguauugaaaucuuaguuuugauauuuuaaagaaaugacuuucu

SEQ ID NO: 101499 - RNA, 64 nt, hsa
gacgaaaguaggcgguacgaacccuaauggaggcaguuuugaggagguccucagcuccacggcc

SEQ ID NO: 101500 - RNA, 64 nt, hsa
cagauuucaaaucuuuccaauuuacccuggaaucaguuuugagggagcugauaaagacuuuagc

SEQ ID NO: 101501 - RNA, 64 nt, hsa
uuuuuuuuuuaccaaacuucagggacacucugcuaguuuugaauaaguaaccaucaaaguuacu

SEQ ID NO: 101502 - RNA, 64 nt, hsa
acaccuggucuucaguucugugcccaacguauauaguuuugacaaugaccagguuggacuguuu

SEQ ID NO: 101503 - RNA, 64 nt, hsa
uaaacaaaaauuauuuugccuacagaaagguuguaguuuugagcacauguuaauuuuuuucccu

SEQ ID NO: 101504 - RNA, 64 nt, hsa
caucccggaagaagaggaagaagcagaacagacuaguuuugaguaaacucaguaugcaugugug

SEQ ID NO: 101505 - RNA, 64 nt, hsa
uggaggcuccauauuaaugcauuauuuuuuaaaaaguuuugauaacucuuaaagcaucauuugc

SEQ ID NO: 101506 - RNA, 64 nt, hsa
auagucuguagguggacaagaaugcagaucacacaguuuugaaauuuuaauuugaguagauuua

SEQ ID NO: 101507 - RNA, 64 nt, hsa
aaaaaaguuccaacacacagccaugaggagccucaguuuugaaagaggugcauaauaaaacuac

SEQ ID NO: 101508 - RNA, 64 nt, hsa
ugcucuuguugcccaggcuggagugcaauggugcaguuuugacucacugcaaccuccgccuccu

SEQ ID NO: 101509 - RNA, 64 nt, hsa
aaaaaauauguuugaugcuauuuuguauuuuuacaguuuugauuggguaauguuucuguucuuc

SEQ ID NO: 101510 - RNA, 64 nt, hsa
auaucuugcaagcuccaccuucacuuugcaucuuaguuuugaacaauccuauucaauuuucuca

SEQ ID NO: 101511 - RNA, 64 nt, hsa
auguauaccuauauauucuuuguguuuauuuaaaaguuuugaaaauaugcaguacuguuuauau

SEQ ID NO: 101512 - RNA, 64 nt, hsa
uaaaaaguacaagcuauuaaaaaucagauugaaaaguuuugagaaaauguuauuuuuacugaaa

SEQ ID NO: 101513 - RNA, 64 nt, hsa
aagagagagagagcgcgagagagaucaagacccaaguuuugaaucucaaccgagguccagggca

SEQ ID NO: 101514 - RNA, 64 nt, hsa
aaacaucaguaaacuaccauuaaugucaaugcccaguuuugacuuuuguuagccugacacuccc

SEQ ID NO: 101515 - RNA, 64 nt, hsa
aacauuuaccuucagccuccaucagaauggaacgaguuuugaguaaucaggaaguauaucuaua

SEQ ID NO: 101516 - RNA, 64 nt, hsa
auuauuucugucacaguaaaaauaaaauacuuugaguuuugagcuacuggauucuuauuaguuc

SEQ ID NO: 101517 - RNA, 64 nt, hsa
uuuaagaaguaccacuugaaacauuuuauguauuaguuuugaaauaauaauggaaaguggcuau

SEQ ID NO: 101518 - RNA, 64 nt, hsa
uguauuugaguucacacuauuucuguuuuacagcaguuuugaaaaacacauacuaugccaccaa

SEQ ID NO: 101519 - RNA, 64 nt, hsa
uaagagcccucaauugccugccuguauuaauuuuaguuuugagucaggauuuguaauggagugg

SEQ ID NO: 101520 - RNA, 64 nt, hsa
uguuagcccugccuuccaggaagguuggggugggaguuuugagugggaaagaggaugacaugug

SEQ ID NO: 101521 - RNA, 64 nt, hsa
ggaggccgaggugagcggaucaccugaggucaggaguuuugagaccagccuggccaacauggua

SEQ ID NO: 101522 - RNA, 64 nt, hsa
gauacuguucuggacugugccuguuaaguugcucaguuuugagcugucuucagacaagaagauu

SEQ ID NO: 101523 - RNA, 64 nt, hsa
cccuuuguagaaauucuugccugaauucucaccaaguuuugaauuccuaagguagccccgaucu

SEQ ID NO: 101524 - RNA, 64 nt, hsa
agcccgggccugcacauacucacuggacuguuccaguuuugacagcugccagucuuccugcccc

SEQ ID NO: 101525 - RNA, 64 nt, hsa
uacuuuuuacuuaggcuugggaugggguccuacaaguuuugaguaugaugaaacuauaucaugu

SEQ ID NO: 101526 - RNA, 64 nt, hsa
cuagauuuguuccugcuuuuuucacaaugugaguaguuuugaaaagucagaucuggccauuugu

SEQ ID NO: 101527 - RNA, 64 nt, hsa
ugacaugugaaaccuuuuuuaagauuuuucucaaaguuuugaaaagcuauuagccaggaucaug

SEQ ID NO: 101528 - RNA, 64 nt, hsa
uaaaguauucuagggagaaacugucuuccauuucaguuuugaaucaguauuguuacacucaaac

SEQ ID NO: 101529 - RNA, 64 nt, hsa
ggauguggcguuucaacucauauaauacagaaagaguuuugaaugggcagauuucaaacugaau

SEQ ID NO: 101530 - RNA, 64 nt, hsa
ucuuuguuacaggagaggaccuguggauagacuuaguuuugacauaaaacaaugcccauucacc

SEQ ID NO: 101531 - RNA, 64 nt, hsa
uuuauuacuuuauguacaacugaaguuuuguuuuaguuuugauaauaaauucuuuggaacuuua

SEQ ID NO: 101532 - RNA, 64 nt, hsa
uguaacaaagaacugaagcucuuauuauauuauuaguuuugauuuaauguuuucagcccaucuc

SEQ ID NO: 101533 - RNA, 64 nt, hsa
aucuaccaggucaaaauagugccacuaacgguugaguuuugacugcuuggaacuggaauccuuu

SEQ ID NO: 101534 - RNA, 64 nt, hsa
uucaaauaguggcagacagugucuucugaauguaaguuuugagaaauacgagucugucagagcg

SEQ ID NO: 101535 - RNA, 64 nt, hsa
uuuacuuucucagaauuaccuaaauguuuuguagaguuuugacuaguaaucaaucaaaauuaua

SEQ ID NO: 101536 - RNA, 64 nt, hsa
uagcuggcuaucuuuaagaaagaugauauauccuaguuuugaaaguaauuuucuuuuuucuuuc

SEQ ID NO: 101537 - RNA, 64 nt, hsa
uucuuucuguuucaggcuugaaaaacccuugcccaguuuugaucccuucaagacuuugucacag

SEQ ID NO: 101538 - RNA, 64 nt, hsa
ugcacaauggcuuuuuguuaauaaagaacagauuaguuuugaagaaggcaaaaauuucaguuuu

SEQ ID NO: 101539 - RNA, 64 nt, hsa
guuucuaauauguggccagggcguucagauuuccaguuuugaaaacaauuguauagauuucaca

SEQ ID NO: 101540 - RNA, 64 nt, hsa
aucuuucaacacacuuccacugccugcguaaugaaguuuugauucauuuuuaaccacuggaauu

SEQ ID NO: 101541 - RNA, 64 nt, hsa
gacuaagaagcuuaaauguugauaaaauaugacuaguuuugaauuuacaccaagaacuucucaa

SEQ ID NO: 101542 - RNA, 64 nt, hsa
aaacacguuacaauuaccacauauccuugcuauaaguuuugaaguuucuuagcaauuaaaguuu

SEQ ID NO: 101543 - RNA, 64 nt, hsa
gucauucuuuuuuucugaaagagguaauaauucuaguuuugauagacucugaggauuaugugaa

SEQ ID NO: 101544 - RNA, 64 nt, hsa
uuccagcaaacuaggguaauuggugccuuuuuacaguuuugaauaaaagcauuuacaauuucua

SEQ ID NO: 101545 - RNA, 64 nt, hsa
auuuuaggucucucaaauaauuaagaauagagccaguuuugaauaaagucuagcagaacuaugc

SEQ ID NO: 101546 - RNA, 64 nt, hsa
caugagcauauggacuuacgaggguucgacuuagaguuuugagcuuuaagauaggauuauuggg

SEQ ID NO: 101547 - RNA, 64 nt, hsa
caaacuaguaucauuuuagggguguugacacaccaguuuugaguguacugugccugguuugauu

SEQ ID NO: 101548 - RNA, 64 nt, hsa
cuggccaccucacgcauuugaucacagacuguagaguuuugaaaagucacuuuuauuuuuaauu

SEQ ID NO: 101549 - RNA, 64 nt, hsa
aaugcugcagucugcacauuagacgcuuuuuagaaguuuugaaauuaccuugauuuuuuuaauu

SEQ ID NO: 101550 - RNA, 64 nt, hsa
uucuagguuuuuuccuuucauuuuauucucuucuaguuuugacauuuuaugauagauuugcucu

SEQ ID NO: 101551 - RNA, 64 nt, hsa
aaaaaacaauuuucaaguuuuuuuuacaauaaacaguuuugauuuaaaaucucguuuguauacu

SEQ ID NO: 101552 - RNA, 64 nt, hsa
uuagaacuaguguaauucuugauaauaaaauaagaguuuugauuaagaacagcauagagcuuca

SEQ ID NO: 101553 - RNA, 64 nt, hsa
agagacucagccugcaguuaauuagcauucuggcaguuuugacaucagccagcugcccuaaaua

SEQ ID NO: 101554 - RNA, 64 nt, hsa
cauauuuaauuuaaacuaaugaugugaacuauuuaguuuugauguccguuaugugauucugcuu

SEQ ID NO: 101555 - RNA, 64 nt, hsa
uaaaacuuugggaaaggggcuagcuagcaaagguaguuuugaaauagauguguauauggacugu

SEQ ID NO: 101556 - RNA, 64 nt, hsa
uuucuggaauaauuuuaccaaaacaagcuauuugaguuuugacuugacaaggcaaaacaugaca

SEQ ID NO: 101557 - RNA, 64 nt, hsa
uuuuaguugauuuuuuuuaaccuuuuaguuucccaguuuugaauaauuacaugguggauucuga

SEQ ID NO: 101558 - RNA, 64 nt, hsa
guaaagugguuaauucaggaaauugacagaauccaguuuugagaaaagaacacagauauuugcu

SEQ ID NO: 101559 - RNA, 64 nt, hsa
uuuuagugucucaccagugguuuuacaucugcagaguuuugagggcugugcugaccuuugagag

SEQ ID NO: 101560 - RNA, 64 nt, hsa
aaauuagaguuuaaauaaauaugcuuugaugcauaguuuugaacuaauguaacaugauuuuucu

SEQ ID NO: 101561 - RNA, 64 nt, hsa
aucccuacauguauugcacauuguaaaaaguuuuaguuuugaugaguugugaguuuaccuugua

SEQ ID NO: 101562 - RNA, 64 nt, hsa
gauuuuggugucaauuuuguggacauuuggcaggaguuuugacugggguaggagaaacccauga

SEQ ID NO: 101563 - RNA, 64 nt, hsa
ggcacggauggcugguccgaagcacgugcauuucaguuuugaggcuccuguccucaggcagugu

SEQ ID NO: 101564 - RNA, 64 nt, hsa
caaggcaauuuuaaauaggcagagagaaguuuauaguuuugaaaacagcugcugaagucaggaa

SEQ ID NO: 101565 - RNA, 64 nt, hsa
aaaaccaccaagaacauuuccuggggcauguuccaguuuugaggggugauauaucugccagaua

SEQ ID NO: 101566 - RNA, 64 nt, hsa
uaagaucagcuggcuuucuuguuaaaguuauuuaaguuuugaaugcucuacuacuucaagucuu

SEQ ID NO: 101567 - RNA, 64 nt, hsa
acuaggauuaauuaucagaagacagcucaggccaaguuuugaucguuccauacaguaccuuguu

SEQ ID NO: 101568 - RNA, 64 nt, hsa
ccuaacaagguauuugcaugagucacaauuacaaaguuuugagcgguuuuguaauuugacauuu

SEQ ID NO: 101569 - RNA, 64 nt, hsa
caaccuuuuaaggaaauacaguccuugggaaaugaguuuugauggugaauugggguguuaagga

SEQ ID NO: 101570 - RNA, 64 nt, hsa
agaaagagaaaggaaauuauaaggucaaguuaacaguuuugagguuuuguguuuuuuucuggaa

SEQ ID NO: 101571 - RNA, 64 nt, hsa
uauuauguuauagccaucauaaaaccauuuugguaguuuugacugaacuggguguucacuuuuu

SEQ ID NO: 101572 - RNA, 64 nt, hsa
ucuuaaugcuuguaauuuaaacauuuguuccuggaguuuugauuugguggaugugaugguuggu

SEQ ID NO: 101573 - RNA, 64 nt, hsa
aguuguggagaggagacgccuccagacucucagaaguuuugaggacugaacugggucacucggg

SEQ ID NO: 101574 - RNA, 64 nt, hsa
auuuguggugaugggaggaugcuguuacuaggagaguuuugagauacugcaguggaugugggau

SEQ ID NO: 101575 - RNA, 64 nt, hsa
guucauaaaccaugcuaacauuuuccuuuuagcuaguuuugaaaguaaggaacaauaccuggga

SEQ ID NO: 101576 - RNA, 64 nt, hsa
cacacacacacacacacagugugcaacuagccccaguuuugacagaauaauucuuggucuuccc

SEQ ID NO: 101577 - RNA, 64 nt, hsa
cuucacuauuugagguaacuucauuuuucauucuaguuuugauauuuggcuguuuauuuuuguc

SEQ ID NO: 101578 - RNA, 64 nt, hsa
cuccauuaaugucauuuuuauggauuguagacccaguuuugaaaccaaaaaagaaaccuagaau

SEQ ID NO: 101579 - RNA, 64 nt, hsa
uuuuuuaaaugaaauuaggucauuauuuaugaaaaguuuugagagggcacugucaacuuggguu

SEQ ID NO: 101580 - RNA, 64 nt, hsa
gagggacaguuuugaccugaccccuagaggagacaguuuugaccucuucagcaccaggaaggaa

SEQ ID NO: 101581 - RNA, 64 nt, hsa
gccauggaccccuggaggagaccuauggagggacaguuuugaccugaccccuagaggagacagu

SEQ ID NO: 101582 - RNA, 64 nt, hsa
gguaucuguacguuaauguuucuugcugaguuacaguuuugauaaagaggcucucauuuccugu

SEQ ID NO: 101583 - RNA, 64 nt, hsa
ucuucauaaucuauggaaaccucuaaggugagaaaguuuugaacuuuuaacccuuucuacccag

SEQ ID NO: 101584 - RNA, 64 nt, hsa
aguuauauugugauacucaaauucacagcagaguaguuuugaguaacaguaauuaaauccuucu

SEQ ID NO: 101585 - RNA, 64 nt, hsa
cuuuagaaacauuagugccugccuggauccccuuaguuuugaaauauuugccauuguuguuuaa

SEQ ID NO: 101586 - RNA, 64 nt, hsa
cuacacccauagauuaccaagguuucaguguacuaguuuugaaucuguucugaauggaguuuuu

SEQ ID NO: 101587 - RNA, 64 nt, hsa
uaugauauuugaaaaugcuaucccugcacucaaaaguuuugaaagaaacuaaucacagcacaga

SEQ ID NO: 101588 - RNA, 64 nt, hsa
uguuggguacuuagacccaaaccaauaaauggugaguuuugaacaagaacuaccaucaugcagg

SEQ ID NO: 101589 - RNA, 64 nt, hsa
auggggauaauaauacugaccuaccucaaagggcaguuuugaggcaugacuaaugcuuuuuaga

SEQ ID NO: 101590 - RNA, 64 nt, hsa
ccacccacugacaucugaauuuauauaccuguugaguuuugagugcacccaaacacucgauaaa

SEQ ID NO: 101591 - RNA, 64 nt, hsa
uguucugcuuuuccuggcacucaaauucaugacuaguuuugaggucaaaccuauguucguaaug

SEQ ID NO: 101592 - RNA, 64 nt, hsa
auguuacugaagcauuugaauauaaagcuauuuuaguuuugauggcuuaacuguucccugagga

SEQ ID NO: 101593 - RNA, 64 nt, hsa
cacaccuauaaucccaacacuuugggaggccaggaguuuugagaccagccugggaaacaucugu

SEQ ID NO: 101594 - RNA, 64 nt, hsa
cccucaggaggaagguggacaacagagaaaugagaguuuugauauuuucugaaagaggaacaug

SEQ ID NO: 101595 - RNA, 64 nt, hsa
uuugggcaaacaaaauuggagggcaagugacugcaguuuugagaaucaguuuugaccuugauga

SEQ ID NO: 101596 - RNA, 64 nt, hsa
aauuggagggcaagugacugcaguuuugagaaucaguuuugaccuugaugauuuuuuguuucca

SEQ ID NO: 101597 - RNA, 64 nt, hsa
agaugcuugagauuuuccugcugcaucgcacucuaguuuugaaggauuuacaucuuaggaaaua

SEQ ID NO: 101598 - RNA, 64 nt, hsa
uauaugauauucaaauuucaguguccauaaauaaaguuuugaaaacaugaauacaaacaaaaaa

SEQ ID NO: 101599 - RNA, 64 nt, hsa
auccuuuagguuaaguuuaagcuuuuuaaaaguuaguuuugagaauugagacacaauacuaaua

SEQ ID NO: 101600 - RNA, 64 nt, hsa
augaaaacagccaugaauaucuuuucuuaaagagaguuuugaaaaugaucacuuaccuaaaacu

SEQ ID NO: 101601 - RNA, 64 nt, hsa
uaaaguuuauuuuccucugccauccuugcuaaguaguuuugacacaaugaaaauggaagcacuu

SEQ ID NO: 101602 - RNA, 64 nt, hsa
auuuaucaacguguugugaagauguaccuaaugaaguuuugagaaagcacaggguuauaggugu

SEQ ID NO: 101603 - RNA, 64 nt, hsa
uuagcaccucaagguauaauuuaaacagugagguaguuuugaauggcauuucauuaaggcaucu

SEQ ID NO: 101604 - RNA, 64 nt, hsa
uaugaucagaagaacaugauuuuacaaguauaacaguuuugaguaauucaagccucuaaacaga

SEQ ID NO: 101605 - RNA, 64 nt, hsa
caaugccuuugacaccaaccaugauggcucggucaguuuugaggacuuuguggcugguuugucc

SEQ ID NO: 101606 - RNA, 64 nt, hsa
ugggggccuccaguguccugccccugcuuggcccaguuuugauugcuggcaucuugccacccca

SEQ ID NO: 101607 - RNA, 64 nt, hsa
uaaaaccaucaucuguaaaaccaucuaugacaugaguuuugagaaacaauaauggggaaaauau

SEQ ID NO: 101608 - RNA, 64 nt, hsa
uauuuacaauauaugacuaauuuggggaaaaugaaguuuugauuuauuuguguuuaaaugcugc

SEQ ID NO: 101609 - RNA, 64 nt, hsa
accucugggguucagcuucugucucugcugucccaguuuugagguuugguuucuuguuucuguc

SEQ ID NO: 101610 - RNA, 64 nt, hsa
gaaauucagucuaguucugcugauaaagaucaucaguuuugaaagguuacugauuuuccucuuc

SEQ ID NO: 101611 - RNA, 64 nt, hsa
gaggcagagugguccccucuuugccaccuaggccaguuuugacccuggcauuaacuggccuuag

SEQ ID NO: 101612 - RNA, 64 nt, hsa
uagagugaaagggguaagggggugggaggguaagaguuuugacaaguuguggcaaaggaaacua

SEQ ID NO: 101613 - RNA, 64 nt, hsa
cauaaguaaaaauauuugagaaaaauaaaguacaaguuuugaacaacacaaaaggcaugaauuc

SEQ ID NO: 101614 - RNA, 64 nt, hsa
uaacacuacuaaauuuugguuccuccauagaauuaguuuugaaacacuugauguagugagaaau

SEQ ID NO: 101615 - RNA, 64 nt, hsa
accaugugggaaucagcauucuuaauuucguuaaaguuuugacuuguaaugaaauguucaagua

SEQ ID NO: 101616 - RNA, 64 nt, hsa
ggcuggggugccaaacaccagaaggggagauaauaguuuugacucugaacuuggccacaacccc

SEQ ID NO: 101617 - RNA, 64 nt, hsa
auaguagaacgcuaucugggaagcuauuuuuuucaguuuugauauuucuagcuuaucuacuucc

SEQ ID NO: 101618 - RNA, 64 nt, hsa
aaaagaaacaugguuuacuugcacaaaacugaucaguuuugagagaucguuaaugcccuugaag

SEQ ID NO: 101619 - RNA, 64 nt, hsa
aggaagaagcuggacauucagccuguggagucugaguuuugaaggauguagggagccuuaguug

SEQ ID NO: 101620 - RNA, 64 nt, hsa
ggacuaaacuaccuccaaagcaagcagucuuuucaguuuugacugagugaugugagaaacuucu

SEQ ID NO: 101621 - RNA, 64 nt, hsa
gagcacuugggugaaucugggcaccugauuucugaguuuugaguucuggagcuaguguuuugac

SEQ ID NO: 101622 - RNA, 64 nt, hsa
aaacaccaaaauauuuuagaauaaauucuuagaaaguuuugagaggaauuuuuagagaggacau

SEQ ID NO: 101623 - RNA, 64 nt, hsa
gugagccuauuguguuacuugaccuuauuuuggaaguuuugaauuggccuaggaggaaacccag

SEQ ID NO: 101624 - RNA, 64 nt, hsa
acugaaaaucugagaacuauuuaccuaucacucuaguuuugaagcaaagauggacuucaguggg

SEQ ID NO: 101625 - RNA, 64 nt, hsa
uugcaguuaggaaagggaugggcagggaaaaacuaguuuugagugucuuuagauagaaacauga

SEQ ID NO: 101626 - RNA, 64 nt, hsa
aaacacuuucuugggaagcagaucagccuagaaaaguuuugauuagcacugugguuuuccuuuu

SEQ ID NO: 101627 - RNA, 64 nt, hsa
agguaguuuggggcaaaaauccgaggugcuugggaguuuugaauguuaagaauugaccaucugc

SEQ ID NO: 101628 - RNA, 64 nt, hsa
ugggguuuggaaauguaaauguguaccuugcuuuaguuuugaggcuggggaauaugugugggug

SEQ ID NO: 101629 - RNA, 64 nt, hsa
agacacuuguaacauauucaacguccuguacuccaguuuugacuacgagaucagauuuuggagg

SEQ ID NO: 101630 - RNA, 64 nt, hsa
gugaaauuagugugcagagucauucuaccgauaaaguuuugaaauaaugugaaaacuggagcau

SEQ ID NO: 101631 - RNA, 64 nt, hsa
aguuuuacccuuucuaaacacuguccuuuuugaaaguuuugaauauauccacauucuauugaaa

SEQ ID NO: 101632 - RNA, 64 nt, hsa
gacuuugguacugcugucuuccaagguagcucuaaguuuugaugugugggcuucugaguuuaua

SEQ ID NO: 101633 - RNA, 64 nt, hsa
gaugguaguucaguugggguacuuguuuuauggaaguuuugauugauuuacuugcccucccacc

SEQ ID NO: 101634 - RNA, 64 nt, hsa
uuaaguccucacccuuuacauuaucuaauucuucaguuuugaugcugauaccugcccccggccc

SEQ ID NO: 101635 - RNA, 64 nt, hsa
uuguucuucacuaugauuuacugugugccaaaggaguuuugacaggguacagaguauuuuacua

SEQ ID NO: 101636 - RNA, 64 nt, hsa
auguaaaaauugguuaacuuuacaaaugucagcuaguuuugacuacuaauugggggaaauuuua

SEQ ID NO: 101637 - RNA, 64 nt, hsa
gcuuuccuucccuauuguuuuuguuuuuuuaaugaguuuugacgcauguuguuuugauugcuau

SEQ ID NO: 101638 - RNA, 64 nt, hsa
aauauagagccacuuccugaaaccaagaaucuguaguuuugauccaaaaucuaaaacuuaaagu

SEQ ID NO: 101639 - RNA, 64 nt, hsa
cuaucucagcugucuuuucuaacuguguagguugaguuuugaacacgugcuuguggacaucagg

SEQ ID NO: 101640 - RNA, 64 nt, hsa
ugaccucagaacugaaauugauaaugaaguugcaaguuuugauagcccgugaagugcauaagua

SEQ ID NO: 101641 - RNA, 64 nt, hsa
ccaguaauaugucuccuugcuucuuugaugugauaguuuugagaugggugagaaucuaauagau

SEQ ID NO: 101642 - RNA, 64 nt, hsa
augugcaaaagcuccccguccagcuuugacagucaguuuugaugucagcuccucggcaggguag

SEQ ID NO: 101643 - RNA, 64 nt, hsa
cugggguuucaauugacuucuguuccuugcuuuuaguuuugauagaagggaagaccugcagugc

SEQ ID NO: 101644 - RNA, 64 nt, hsa
acaggucuggccagggacgugcugcaauuggugcaguuuugaaugcaacauuguccccuacugg

SEQ ID NO: 101645 - RNA, 64 nt, hsa
gacagcaagauaaccccaagacagucuuuuaucaaguuuugacgguuuaugcugggcacugcca

SEQ ID NO: 101646 - RNA, 64 nt, hsa
aaauucaaaagugaacgaaagcauuuaacuggccaguuuugauugcaaaugcuguaaagauaua

SEQ ID NO: 101647 - RNA, 64 nt, hsa
accugcuauucugccaaaagacaauuucuagaguaguuuugaauggguugauuucccccacucc

SEQ ID NO: 101648 - RNA, 64 nt, hsa
ugauaaggcauacauuugcgcagaugagcuaggaaguuuugagaaguaccuuuuauguucagaa

SEQ ID NO: 101649 - RNA, 64 nt, hsa
ugcccugcuucuaaucugguucuuuccacagccuaguuuugauugacuucauauucuagaauac

SEQ ID NO: 101650 - RNA, 64 nt, hsa
aaauuuaaguccuccaauuccagcauauccagugaguuuugacaguguguuuauguggaauguu

SEQ ID NO: 101651 - RNA, 64 nt, hsa
ugaucuguugaacugucuuccaaccugccauggcaguuuugacacuacuccuguuugcccuccu

SEQ ID NO: 101652 - RNA, 64 nt, hsa
cacugaauaguaacuucuuucuugaacuaagaucaguuuugaaguuucuaaaggagauagaaug

SEQ ID NO: 101653 - RNA, 64 nt, hsa
ugccacacccuagauccagccucaggaacuaacaaguuuugagaaaagcagguaguagagcagc

SEQ ID NO: 101654 - RNA, 64 nt, hsa
aauaugugauaugguaauuuucauaacagaugucaguuuugaaccaagaauuggugauuuguuu

SEQ ID NO: 101655 - RNA, 64 nt, hsa
aacugagaugaucaguuacauucaucaguuggugaguuuugaagaauaacuacauuuuauuuca

SEQ ID NO: 101656 - RNA, 64 nt, hsa
aaaugacaaauugauauucugauauaaaacucaaaguuuugaagucagugggaaaaaaggaggu

SEQ ID NO: 101657 - RNA, 64 nt, hsa
ucuggcagcucucucuacccaacuuugcacuuguaguuuugagucuuugucucucuggaauaug

SEQ ID NO: 101658 - RNA, 64 nt, hsa
ugauucugcucuaaaacauugcucuggguuauacaguuuugaucccaaaagcuuuuuuguuaca

SEQ ID NO: 101659 - RNA, 64 nt, hsa
uccuggcgggugggaaggaauggcuggggcggccaguuuugacacgccccagugcccuggagaa

SEQ ID NO: 101660 - RNA, 64 nt, hsa
ugcaaguaagucagguuucacaagaaaauuuucaaguuuugaagggaauuugagguugaucugg

SEQ ID NO: 101661 - RNA, 64 nt, hsa
gcaguaauuaaauugcaucccaggagauuuauaaaguuuugauauuuuucccuacucuggaauu

SEQ ID NO: 101662 - RNA, 64 nt, hsa
uuuuguguagaaaaauaggugcaauaaugaucaaaguuuugaugucuugagucuccaucuuagg

SEQ ID NO: 101663 - RNA, 64 nt, hsa
cccuuacgaaauacgucuuuuucagaacuguuaaaguuuugauguacaucgagcugaauucugu

SEQ ID NO: 101664 - RNA, 64 nt, hsa
cuuccaucccugucaugucuucaguuaucucucgaguuuugaagcugaacaguagcaaaucaga

SEQ ID NO: 101665 - RNA, 64 nt, hsa
cugaaguacaggcaaacuugauguuugaaagauaaguuuugagaaaugucauuguauuuuggag

SEQ ID NO: 101666 - RNA, 64 nt, hsa
auggaaauaaaaauauuuguuagugaauugguugaguuuugauuccucuaacuucucagaauga

SEQ ID NO: 101667 - RNA, 64 nt, hsa
acugggacauuuucauugauauucuauacaccaaaguuuugacgguuuaccaucauuccauuuu

SEQ ID NO: 101668 - RNA, 64 nt, hsa
aauuuuggccacuuuacauuuagauucuggugagaguuuugacugaauguuccaaucucugaug

SEQ ID NO: 101669 - RNA, 64 nt, hsa
gaagcaaguaaugucaacuuugagcacuuuguugaguuuugaaaaaucuuauuuguugcugcac

SEQ ID NO: 101670 - RNA, 64 nt, hsa
auguuaauaagcuucucccuuucgucaccccaaaaguuuugaaucaaugaaagagacauugaaa

SEQ ID NO: 101671 - RNA, 64 nt, hsa
cucaugcuacuuucuguuacaccucuauuauauuaguuuugaauauaaacaucuuuuucagacc

SEQ ID NO: 101672 - RNA, 64 nt, hsa
uaagccagcugaucuaguaguaaccaaaaauuccaguuuugagaauaggaaagauuccgccugc

SEQ ID NO: 101673 - RNA, 64 nt, hsa
ucauuguaucaaauuauuuuuaaguuuuauccguaguuuugauaaaagauuuuccuauuccuug

SEQ ID NO: 101674 - RNA, 64 nt, hsa
uaugcauuuccuugauucaauuugugaccuuaccaguuuugaauuggaauugcaccauuucgua

SEQ ID NO: 101675 - RNA, 64 nt, hsa
caguggcuaguaccaucugcaauaggauuuaggaaguuuugaucucacaaauuuacuguaaggc

SEQ ID NO: 101676 - RNA, 64 nt, hsa
auaagcuuuaauaaucuuccccuuuuaugugaaaaguuuugagaacugugaaauguuuaggaac

SEQ ID NO: 101677 - RNA, 64 nt, hsa
ccccauggaggcaguucaguaacuaaacuaauaaaguuuugaaaaguuacacguaaaguagaag

SEQ ID NO: 101678 - RNA, 64 nt, hsa
ucuuuauaccaaaauucagugaaggcauucuacaaguuuugaguuagcauuacauuuuaauauu

SEQ ID NO: 101679 - RNA, 64 nt, hsa
uauauuuguuuaauaauaaccuauuucaagucugaguuuugaaaauuuacauuucccaaguauu

SEQ ID NO: 101680 - RNA, 64 nt, hsa
ggccaacuguggucaaagaauggcuuucaguuaaaguuuugacuucuuauuauaaauaauauaa

SEQ ID NO: 101681 - RNA, 64 nt, hsa
ugucaccuucccuugcagcuuaaggagcccaguaaguuuugaaaauguuugcgaaucaaacuaa

SEQ ID NO: 101682 - RNA, 64 nt, hsa
ccucaagagucagcuggcagguuuguugaaauacaguuuugaguuauuuugauguggcuuuuua

SEQ ID NO: 101683 - RNA, 64 nt, hsa
uaugauauuuugaguaauuuuaugcaugaaacaaaguuuugacaggcuuuugaccgugauucau

SEQ ID NO: 101684 - RNA, 64 nt, hsa
cuacacccucccccuccagggaaugcugaguuccaguuuugagcagaggugaggcagaauccac

SEQ ID NO: 101685 - RNA, 64 nt, hsa
ugacuauuuaucgucgauacucuguagcuguguaaguuuugacaaauaguguaucucguggaau

SEQ ID NO: 101686 - RNA, 64 nt, hsa
uaagacacaaaugcaugaacaaguuuuaauguauaguuuugaauccuuugccugccuggugugc

SEQ ID NO: 101687 - RNA, 64 nt, hsa
uagucuuccgagaaacuuuucugaucaguuugcgaguuuugaugaguuuuguaagguuuuuguu

SEQ ID NO: 101688 - RNA, 64 nt, hsa
agcuugcagcaaguaaucuucaaauauuccaguaaguuuugaaauaaugaaugcauugaaaaua

SEQ ID NO: 101689 - RNA, 64 nt, hsa
guuuggaaagaauuuuuguauuuauuccuguuacaguuuugacuuucaacuucucuccccgugc

SEQ ID NO: 101690 - RNA, 64 nt, hsa
ggacauaugaaaauucaagaaccuaaaaaauaccaguuuugaaugaguuuuugugguuuugguu

SEQ ID NO: 101691 - RNA, 64 nt, hsa
cucagguuacuaugcugaaauuccaaaaugucugaguuuugaauagugaucacuuuguucuggu

SEQ ID NO: 101692 - RNA, 64 nt, hsa
gggauccuccuucguggucuucuaagucaguguuaguuuugaaauuuuuggcccugcauaaguu

SEQ ID NO: 101693 - RNA, 64 nt, hsa
caagggcuucauuccuuuuaugucauuucuagacaguuuugaaucuagguuaauaacacuuuau

SEQ ID NO: 101694 - RNA, 64 nt, hsa
cuggauugauacggggaaaacaucuuucccuucuaguuuugagagacuuccucuuggcucccag

SEQ ID NO: 101695 - RNA, 64 nt, hsa
uuucuauuuaggucauuuguucuuuuuacuauugaguuuugagagguuuuuuauauauccuaga

SEQ ID NO: 101696 - RNA, 64 nt, hsa
uaaaauguuccuacuuuaaauauacaauucagugaguuuugauaaauugauauacccauguaac

SEQ ID NO: 101697 - RNA, 64 nt, hsa
gguccuuuuuuauaaaggacacuuuucuccuaguaguuuugaauucaggaacagauccaaaguu

SEQ ID NO: 101698 - RNA, 64 nt, hsa
uuugcuuucuaggagguuuguuguuuugccuguuaguuuugaggagcaggaagcucaugggggc

SEQ ID NO: 101699 - RNA, 64 nt, hsa
aggacccaacaacuaaccacguuuacacgacuugaguuuugaaccccgauuaaugucuguacgu

SEQ ID NO: 101700 - RNA, 64 nt, hsa
cugugccuaaggcugcuugaucuauuucuauaacaguuuugaucuuaaaagcuuugugauugca

SEQ ID NO: 101701 - RNA, 64 nt, hsa
ugacaaggcacaaauacuuucagaauuguauuucaguuuugaagauuuaaaaaaaaugugaaaa

SEQ ID NO: 101702 - RNA, 64 nt, hsa
uacugugugggauacuuagugguaugucucuuuaaguuuugauuaauguuucuuaaauggaauu

SEQ ID NO: 101703 - RNA, 64 nt, hsa
cuuccugaggccucaguauuagucgugagcacaaaguuuugagaccuuuggcguuguuucuuga

SEQ ID NO: 101704 - RNA, 64 nt, hsa
guuccaaaccaguuuauucugugguucuauaauaaguuuugauauaaucuuggcuucuuaaaaa

SEQ ID NO: 101705 - RNA, 64 nt, hsa
uccacauuauucucuguggggacaagagcugggcaguuuugaaugggucuugagguggguaccc

SEQ ID NO: 101706 - RNA, 64 nt, hsa
uguaauuggauuucgcuaucaguucccauccuuaaguuuugauauucaauaucugauagauaca

SEQ ID NO: 101707 - RNA, 64 nt, hsa
uuuuauguccaauagcuacuacauuugauagaacaguuuugaggaacauuucauucuugaacgc

SEQ ID NO: 101708 - RNA, 64 nt, hsa
agugguccaggauucuguaaugcuuuacacaggcaguuuugaaaugaaaaucaauuuaccuuuc

SEQ ID NO: 101709 - RNA, 64 nt, hsa
guaaucuccuauuuuggugucaguuuuucaauaaaguuuugauuaugggcaaauccccucuuuu

SEQ ID NO: 101710 - RNA, 64 nt, hsa
ugguauauugaagacgaaauuaaaauuguccuucaguuuugaggccauguguaaaguuuaacca

SEQ ID NO: 101711 - RNA, 64 nt, hsa
ugcuuaagacugcugcugauaauuuuguaauauaaguuuugaaaucuaaaugucaauuuucuac

SEQ ID NO: 101712 - RNA, 64 nt, hsa
uuuuuaaagauaugucuguauugaagagaaagccaguuuugaguuuuuuacacuugcacaucau

SEQ ID NO: 101713 - RNA, 64 nt, hsa
gauuaaacuuuuuuuuuucaguuuauggaccaagaguuuugauuuauuuaggguggaguucagg

SEQ ID NO: 101714 - RNA, 64 nt, hsa
aagagagagugugugauuagaagcuaaauaggaaaguuuugagcuucaagucagugaggaguaa

SEQ ID NO: 101715 - RNA, 64 nt, hsa
aucgaauauaguucuguguagagaaugucacuguaguuuugaguguauacaugugugggugcug

SEQ ID NO: 101716 - RNA, 64 nt, hsa
uagaacugcuccuugguggccauuagaucgagucaguuuugaucugcaucacuuaguuauuggg

SEQ ID NO: 101717 - RNA, 64 nt, hsa
auuguguccuuuuaauauuguuuucaacaaugguaguuuugagguuuuggccauuuucucuuua

SEQ ID NO: 101718 - RNA, 64 nt, hsa
uuuuagauuccugagagaugucucuggaagggaaaguuuugagaacuaauggcuauuuuugagg

SEQ ID NO: 101719 - RNA, 64 nt, hsa
aaaaucacagaaaauugucagauuucuucgggaaaguuuugauccgagugcuuuuuugguacca

SEQ ID NO: 101720 - RNA, 64 nt, hsa
ucuguaugcaucuaauuucauuugcguaauacauaguuuugagccauaagcagguucuuuaugu

SEQ ID NO: 101721 - RNA, 64 nt, hsa
uaucuauauguauauguauauuuaaucaaccagcaguuuugaaacuagucauccugguacaaaa

SEQ ID NO: 101722 - RNA, 64 nt, hsa
aaaagccuucuuggaaaaugggacauuagcauugaguuuugaaagaugaguaggaguuugcuaa

SEQ ID NO: 101723 - RNA, 64 nt, hsa
auauuuuuauaacgugguucuuauuuaacugucuaguuuugauagaauuuaccaggucuggcug

SEQ ID NO: 101724 - RNA, 64 nt, hsa
ugcuaaauuuguauucucugugaauuucacuggcaguuuugaacuucccuuccuuaaaguacuc

SEQ ID NO: 101725 - RNA, 64 nt, hsa
ugugcccaagucauuucagaaagaaagacccuucaguuuugaugcauuuugcugaacacuuggg

SEQ ID NO: 101726 - RNA, 64 nt, hsa
ccuaacucaaucccugguacauuccuaauaaagcaguuuugaggaaaaucaacagacucuuuuu

SEQ ID NO: 101727 - RNA, 64 nt, hsa
agcaacuauggguuugcaguuuucugaguaggugaguuuugaauauggguaaaucagaauaaug

SEQ ID NO: 101728 - RNA, 64 nt, hsa
agccauuugaauguuaggaagcuucggggagacaaguuuugagagaagccccagagggagcuau

SEQ ID NO: 101729 - RNA, 64 nt, hsa
ugagcaucucuguuugguaaggaggacaauugucaguuuugagggggacauguguuaaaucaca

SEQ ID NO: 101730 - RNA, 64 nt, hsa
ggaaggagagaugaccccuacccccucaucccccaguuuugaaaaggucuaagcaagugagucu

SEQ ID NO: 101731 - RNA, 64 nt, hsa
auaucauucgccucuauaacaauuuaauguauucaguuuugacugugcuucauaucauguaccu

SEQ ID NO: 101732 - RNA, 64 nt, hsa
aguaacuacuuuggcucuaccccuagaaauguccaguuuugagugacuguaguauggauggguu

SEQ ID NO: 101733 - RNA, 64 nt, hsa
cggcagugccguuccggaggccugguccaucuggaguuuugaggggugaggggaccagagcagu

SEQ ID NO: 101734 - RNA, 64 nt, hsa
uuuuguuuugcuucauuuuaugcuuuuuuauuuuaguuuugauguucugagguuugcuuugguu

SEQ ID NO: 101735 - RNA, 64 nt, hsa
uacaacaugccaucuauaguugccagcccuggucaguuuugauucuuaaccccauggacuccuu

SEQ ID NO: 101736 - RNA, 64 nt, hsa
cuuugcaauguauugaaggaauugcugccgugugaguuuugaaugauuuugcaguaaagaccug

SEQ ID NO: 101737 - RNA, 64 nt, hsa
guuuugcuuucaggauuuggcguaaauacuugguaguuuugacaucucugcuuaacacucaaga

SEQ ID NO: 101738 - RNA, 64 nt, hsa
uuguuuucagucagauuucugaaaagugagagguaguuuugauaguaaaaauuuuugguugugc

SEQ ID NO: 101739 - RNA, 64 nt, hsa
aaccuuguuugaagcuguuauuugcaguccuauuaguuuugagccauugcauuuaaguucccua

SEQ ID NO: 101740 - RNA, 64 nt, hsa
acaggugugagccacagugccuggcccauucuugaguuuugauaaaguaauucauacaaaguac

SEQ ID NO: 101741 - RNA, 64 nt, hsa
uagguagaaaaugugaaauaaaucucauauauauaguuuugaaauacguuuucuauuucaugug

SEQ ID NO: 101742 - RNA, 64 nt, hsa
aucagcauguuagacaacuacacaguauguuguuaguuuugaaagacauucacucaaggaaaac

SEQ ID NO: 101743 - RNA, 64 nt, hsa
aauuguuaagcugcaguugaguuguucaagugagaguuuugauaagccacuuaugggccgcguu

SEQ ID NO: 101744 - RNA, 64 nt, hsa
uggaaaccuauuguugauauuacaguauauauggaguuuugaacuuccugaaauuaaaaaaguu

SEQ ID NO: 101745 - RNA, 64 nt, hsa
cuauauuugaugggaacccagugagccaggggccaguuuugacaggucagugucccagacauuu

SEQ ID NO: 101746 - RNA, 64 nt, hsa
uuuuaugauucauaauuucaguuuacuagacugaaguuuugaaguaaacacuuuucaguuucuu

SEQ ID NO: 101747 - RNA, 64 nt, hsa
uuuaucuauuagauaaucaagggcacugugauacaguuuugaguaaaaagacauuuuuuaaaag

SEQ ID NO: 101748 - RNA, 64 nt, hsa
ccuagggccauuguaagucacuugaauaaaaaauaguuuugaagcaugagagucauacagagcg

SEQ ID NO: 101749 - RNA, 64 nt, hsa
ucaggagugagauauaaacauuuugcuuuuuuucaguuuugaaauauaguuugucauccuguga

SEQ ID NO: 101750 - RNA, 64 nt, hsa
uugacagccaacuaauacaguaaacuguuauacuaguuuugagcuuuagaccucagccuuuugu

SEQ ID NO: 101751 - RNA, 64 nt, hsa
uuuuuucugaugcuuugaauauaguuuugaaaggaguuuugacuuuuuuccccucauucaucuc

SEQ ID NO: 101752 - RNA, 64 nt, hsa
aagaaaaaaaaauuuuuucugaugcuuugaauauaguuuugaaaggaguuuugacuuuuuuccc

SEQ ID NO: 101753 - RNA, 64 nt, hsa
uuuccugucuugcuucacacaguuccuuaaaaucaguuuugaacuuuggucauagagucuucau

SEQ ID NO: 101754 - RNA, 64 nt, hsa
ucucucacuucucagggaugaaauucuuuuucaaaguuuugaaguuccuugcaacuuagccaug

SEQ ID NO: 101755 - RNA, 64 nt, hsa
cauacacuuccagugcugccuucuuuacacugccaguuuugacaaaacagguuuguuuuuuauu

SEQ ID NO: 101756 - RNA, 64 nt, hsa
caguaugucuucagcuugaucagauuuuaaaaucaguuuugaaagugguucccgacuucuuugc

SEQ ID NO: 101757 - RNA, 64 nt, hsa
cuuccuucugggugcagacugcaccuccggaugcaguuuugauguccaucuuccaggagagacg

SEQ ID NO: 101758 - RNA, 64 nt, hsa
gggaccaggaugacaccuccauuucucuccaggaaguuuugaguuucucuccaccgugacacaa

SEQ ID NO: 101759 - RNA, 64 nt, hsa
auuuaaguucuuuugucaccaaauauuaauaaacaguuuugacuucacaccaagguuggauaaa

SEQ ID NO: 101760 - RNA, 64 nt, hsa
agaacugggcagacaccccuggagcucagccgacaguuuugaugagcagggaagucugaggccc

SEQ ID NO: 101761 - RNA, 64 nt, hsa
gcuggggguagaugagacccuacuacugaacuccaguuuugaucucgugacuuuuagaaaaaca

SEQ ID NO: 101762 - RNA, 64 nt, hsa
cuagauuugaugggugugaagauuaugagaguaaaguuuugaagacucagggauagcuguaaug

SEQ ID NO: 101763 - RNA, 64 nt, hsa
uccgugugugcauauuuguugguucucugauuaaaguuuugagucuaaaagcauugguuccuuc

SEQ ID NO: 101764 - RNA, 64 nt, hsa
uuccgugggggaaugucauggucuugcuuuacuaaguuuugagacuggcagguagugaaacuca

SEQ ID NO: 101765 - RNA, 64 nt, hsa
cgcucuguugauuguguccuuugaugaaauuuuaaguuuugauguacuguugacucuuucuguc

SEQ ID NO: 101766 - RNA, 64 nt, hsa
gagcccuguauucuuggcuguacccgucgaauggaguuuugaucucgcugaguuuggaguuggg

SEQ ID NO: 101767 - RNA, 64 nt, hsa
ggacaguggguugagggagaacaguucuuaguccaguuuugauguuaacuuccauagcugacaa

SEQ ID NO: 101768 - RNA, 64 nt, hsa
ugacagcugggaggguuucucggucuggaggcguaguuuugaaacucacaucacccacugugca

SEQ ID NO: 101769 - RNA, 64 nt, hsa
aaccccaccccucguccucucggccuucuguaauaguuuugagaugucugucccuccucccugg

SEQ ID NO: 101770 - RNA, 64 nt, hsa
uuuccugucugccugcaaacacaugcagacauuuaguuuugauuuacauauaguuaaauauaug

SEQ ID NO: 101771 - RNA, 64 nt, hsa
aaccuugugagcagaaggcaagagcggcaagaugaguuuugagcguuguauuccaaaggccuca

SEQ ID NO: 101772 - RNA, 64 nt, hsa
aaacuuguuuagcacccguuuuuaagucaguagaaguuuugaacuuacaguaaaaguugugaac

SEQ ID NO: 101773 - RNA, 64 nt, hsa
ggcuggagugcaguguugcaguccggcucacugcaguuuugaccucccaggcucaagcgauccu

SEQ ID NO: 101774 - RNA, 64 nt, hsa
gcuaaccuguucagagccaggaaggagacugcacaguuuugaaagcacagcccgucagguccgg

SEQ ID NO: 101775 - RNA, 64 nt, hsa
aaagcaacuuaucagcuacuuaagagaaauggcaaguuuugauaugaguauacaauauauaaaa

SEQ ID NO: 101776 - RNA, 64 nt, hsa
ccuuuguucuugaacacuuuugcccugcagccucaguuuugaauucuuuuagcaacuuggauua

SEQ ID NO: 101777 - RNA, 64 nt, hsa
aaaugacugcuauggugggaacacaauaaacaccaguuuugacuuuuagugcauaguuguccuu

SEQ ID NO: 101778 - RNA, 64 nt, hsa
ucagauuggucacauaaaugccacggcauuccgaaguuuugauuuugauuaacauugacaggau

SEQ ID NO: 101779 - RNA, 64 nt, hsa
guccucuugggguuuuguaccaucugaugcuggaaguuuugauuagugauauuuucuacuacua

SEQ ID NO: 101780 - RNA, 64 nt, hsa
cuuugcuuucuuauuucucuuucucugcguuguuaguuuugaagaguggaggagcuaggggcuc

SEQ ID NO: 101781 - RNA, 64 nt, hsa
agcagauuuucucacugguaucacauggucuugcaguuuugaacucuucgaccgauuuguggga

SEQ ID NO: 101782 - RNA, 64 nt, hsa
auuuugcaacgaauuuguaauuuuucuguacgauaguuuugauaauuuauaguacuuugauguc

SEQ ID NO: 101783 - RNA, 64 nt, hsa
gccguugcugacuuagaaucccuguguuaauuuaaguuuugacaagcuggcuuacacuggcaau

SEQ ID NO: 101784 - RNA, 64 nt, hsa
aagggccacaaggugcaggguuaauacucuugccaguuuugaaauauagaugcuaugguucaga

SEQ ID NO: 101785 - RNA, 64 nt, hsa
uucacguguauauauagaccaaggauaugugcugaguuuugaugucaaauauauuucucuuuca

SEQ ID NO: 101786 - RNA, 64 nt, hsa
guacugaaaagaaaugaaguugauguaugucccaaguuuugaugaaacuguauuuguaaaaaaa

SEQ ID NO: 101787 - RNA, 64 nt, hsa
uuuuuuauaacuuccaaaacaaaaaccugagcacaguuuugaaguucuagccacucgagcucau

SEQ ID NO: 101788 - RNA, 64 nt, hsa
aguagucggauuccggggaaaagaacaaguaucuaguuuugaugacaauguuuucuuguaagaa

SEQ ID NO: 101789 - RNA, 64 nt, hsa
aacuagguuuacagucccuuauuuuuaaugccuaaguuuugacagcaggaagaaaacaauuuuu

SEQ ID NO: 101790 - RNA, 64 nt, hsa
uguuuaauguccuguucuuaagcucguuagagccaguuuugaaacguuuggucuuaccgugaac

SEQ ID NO: 101791 - RNA, 64 nt, hsa
ugguuccguuuuacggagauuuuuccucauauuuaguuuugaaugaggaaaaugugcucaauua

SEQ ID NO: 101792 - RNA, 64 nt, hsa
gcaaaaaacaaaguaaccuuuuuucauaccugccaguuuugaauuuauauauguuauugaacaa

SEQ ID NO: 101793 - RNA, 64 nt, hsa
augcuucuuggggaaaaauaguauaggaugugaaaguuuugaauuacgguuauuuaaaaacuaa

SEQ ID NO: 101794 - RNA, 64 nt, hsa
cguuuuaugguacuuguuggaauugggacuuaggaguuuugauuuugauaagaaacugggauaa

SEQ ID NO: 101795 - RNA, 64 nt, hsa
uuuaccaaagagcugccaagguuacagugaacagaguuuugaaaggcauugcuuuaaaggaaaa

SEQ ID NO: 101796 - RNA, 64 nt, hsa
gaaauaaggaaaaacccuucucauuguuaacuggaguuuugauguauuucucuuuggaugaaua

SEQ ID NO: 101797 - RNA, 64 nt, hsa
cagggcuucaucuucacuugauggcuuuaaggacaguuuugaucuacagggccagucuacauua

SEQ ID NO: 101798 - RNA, 64 nt, hsa
caugguggugguuuggcuucuguucuuauucuugaguuuugauaccacgcagaccuuggguggg

SEQ ID NO: 101799 - RNA, 64 nt, hsa
aacugggaugaaacuaaagcaauagaaacaacacaguuuugaccuaacauaccguuuauaaugc

SEQ ID NO: 101800 - RNA, 64 nt, hsa
caucuccuuguuccagcugaaaaccugcugugagaguuuugacagagcacuuuauuuucgucaa

SEQ ID NO: 101801 - RNA, 64 nt, hsa
gcacaaaccuucuuuucaaugcaaugcaucugaaaguuuugauacuuguaacuuuuuuuuuuuu

SEQ ID NO: 101802 - RNA, 64 nt, hsa
aaaguugaaauggguauguaaguugaaaaccagaaguuuugagaaacauccuuuguuaacuuuc

SEQ ID NO: 101803 - RNA, 64 nt, hsa
aaccuuccaaaacaaaaauaaagaccuguccaaaaguuuugacaaaaauacugauugcucccaa

SEQ ID NO: 101804 - RNA, 59 nt, hsa; identical to SEQ ID NO: 101291

SEQ ID NO: 101805 - RNA, 64 nt, hsa
agcugaucagaagcucagcauggccauuaugccuaguuuugaugaauaaacaugggaaagccau

SEQ ID NO: 101806 - RNA, 64 nt, hsa
auagaaugaaaugacuuugauuccugcgccuuuuaguuuugaacucuggaauuccucugccccc

SEQ ID NO: 101807 - RNA, 64 nt, hsa
ccagagauuggguccuugggccuggcuucuuaagaguuuugaugaugcugggaaaagugacugc

SEQ ID NO: 101808 - RNA, 64 nt, hsa
gucaucuuaaauuucaaaccauuuaccaucugaaaguuuugauuugaauguaaaacaggaaauu

SEQ ID NO: 101809 - RNA, 64 nt, hsa
auuaccuguggaguugcauauccaaaccuuagugaguuuugaagcuuuaagcaaauucuuuuaa

SEQ ID NO: 101810 - RNA, 64 nt, hsa
cacauuuauuggugcugccagcuuuaagcauaugaguuuugauauucuauauuuuucaaauccu

SEQ ID NO: 101811 - RNA, 64 nt, hsa
acugcucuuuaccuugcauuuuagcuaauuuaggaguuuugagaauguauuggauacgcuccag

SEQ ID NO: 101812 - RNA, 64 nt, hsa
uuguuaaagggcaagaaaaaagggaggggguuggaguuuugaacguaguaagccuuaccuuaau

SEQ ID NO: 101813 - RNA, 64 nt, hsa
cuuggcagaaagacauuuuucuccucaguagcauaguuuugauguuagugaggaacauuguuga

SEQ ID NO: 101814 - RNA, 64 nt, hsa
ugaccacuugcugucucuguuguauuuugguaugaguuuugauagcucuauaaaauguuuugga

SEQ ID NO: 101815 - RNA, 64 nt, hsa
uuguuuauaugguaaaggaauccuuucagcugccaguuuugaauaaugaauaucauauuguauc

SEQ ID NO: 101816 - RNA, 64 nt, hsa
ccaagguaacagaauugcugacaucugucuaaaaaguuuugacuauccaauuuagauguguaau

SEQ ID NO: 101817 - RNA, 64 nt, hsa
acaaaauguugauaucauaggugauguacaauuuaguuuugaaugaguuauuauguuaucacug

SEQ ID NO: 101818 - RNA, 64 nt, hsa
ccuacagccaguaagugauaaaucuagaaaauugaguuuugaguaccucuuuucccauauacaa

SEQ ID NO: 101819 - RNA, 64 nt, hsa
ugucuuuaaaacauagugauuacaauauuuagaaaguuuugagcacuugcuauaaguuuuuuaa

SEQ ID NO: 101820 - RNA, 64 nt, hsa
uuguugauaauuuuuagaagcaaauuuuccugaaaguuuugaguagaggugagacccccucccc

SEQ ID NO: 101821 - RNA, 64 nt, hsa
cuguauuucaguaguuguagaauuauugauauuuaguuuugauagcuaauguuuaauuguuugg

SEQ ID NO: 101822 - RNA, 64 nt, hsa
ucauuuuuucauuucucuucucauuuuucaggaaaguuuugaguguuauaagguggaaggaaac

SEQ ID NO: 101823 - RNA, 64 nt, hsa
aauaaacaccgaggcuuacuguaguagaaacuuuaguuuugaugaugcacaaaauaaacagcag

SEQ ID NO: 101824 - RNA, 64 nt, hsa
uaauauguuuuauucagcuucuauaagugugaccaguuuugauauuuauuuaugcuaauauuuu

SEQ ID NO: 101825 - RNA, 64 nt, hsa
uuaaaauaaauacaaauguuuauuucagaagggcaguuuugauuauaugugaauacacaaauuu

SEQ ID NO: 101826 - RNA, 64 nt, hsa
uauuuugguuacauugaauacagauuugcugaacaguuuugauguuauuuuuuuaauaaaauuu

SEQ ID NO: 101827 - RNA, 64 nt, hsa
agguucuuaaauccucauaucuggaaacuugugaaguuuugacaccuuuccuauagauauagga

SEQ ID NO: 101828 - RNA, 64 nt, hsa
aaaaauguccaacauacaguuuuuaaaguguggcaguuuugaguaguaacuuagaauguauaag

SEQ ID NO: 101829 - RNA, 64 nt, hsa
cuccaggguuugggcuugauuccuguugaauaauaguuuugagcauucuuugugguuaaauaaa

SEQ ID NO: 101830 - RNA, 64 nt, hsa
uucuuugugguuaaauaaauucuuaaaucugccuaguuuugaugaauucuuuugugaaacuuga

SEQ ID NO: 101831 - RNA, 64 nt, hsa
ucaggaaaugaaagcuaaaacaacccauuugcuacccauccaaagcacuuacaguuuagcaaau

SEQ ID NO: 101832 - RNA, 64 nt, hsa
gaacgagaugucacuaaaaacaguaaaaaugacucccauccauccucugacaaggaagaaggug

SEQ ID NO: 101833 - RNA, 64 nt, hsa
gguugaauaugcaaaagcaguuccgcugggaacccccauccaaucaacugcuguacccaugggg

SEQ ID NO: 101834 - RNA, 64 nt, hsa
cagcugaacuccuccaucuuccaaaucaaucaggcccauccaucccaugccucccuccucccca

SEQ ID NO: 101835 - RNA, 61 nt, hsa
ucaauggaccuccucugugagacugugccuucccauccaggcuggaaggagcucucuguga

SEQ ID NO: 101836 - RNA, 64 nt, hsa
cucuucuaacacccucagucagugacacacccaucccauccaccacuucccccguguggggucc

SEQ ID NO: 101837 - RNA, 64 nt, hsa
ccagugcuaugccuggaggcucaacacaaaacuucccauccaaacauucagaugaacugagcgu

SEQ ID NO: 101838 - RNA, 64 nt, hsa
aaucaagcuucucgcccacuccacggcucugagccccauccaagggcaagacuuggugcccagc

SEQ ID NO: 101839 - RNA, 64 nt, hsa
guggaaugggagguuggauuagcugcgcugaggucccauccacagcuggugcucagcugcuuga

SEQ ID NO: 101840 - RNA, 64 nt, hsa
ucccaucuccccucuccccucucccguucuuccucccauccaccuccucucuacucugccaguc

SEQ ID NO: 101841 - RNA, 64 nt, hsa
cgcucaggcaugcaaccaugggcaccaggcaauacccauccaucacccaucucacucuccccag

SEQ ID NO: 101842 - RNA, 64 nt, hsa
gcacuaagucucuagccucuuucucccuucugcucccauccaagaaagacaguguauaaggaac

SEQ ID NO: 101843 - RNA, 64 nt, hsa
cugaggagagcauuggcugaagcccaguuccuuucccauccauccccaacuccaauaauccccc

SEQ ID NO: 101844 - RNA, 64 nt, hsa
cugagaucagagccagaucagccuuaagucaccucccauccaagaacuuggccuaaaaauacuc

SEQ ID NO: 101845 - RNA, 64 nt, hsa
augggaccagguuggaccacguggcaucagaggucccauccagauccaacuauagguccaagag

SEQ ID NO: 101846 - RNA, 64 nt, hsa
uugauccucccacccagucugccccuggucucugcccauccaaucagagcccacccuccuggaa

SEQ ID NO: 101847 - RNA, 64 nt, hsa
uccucccucaucuccucugccugugucugcgacccccauccaugugccaaagugucccuugggu

SEQ ID NO: 101848 - RNA, 64 nt, hsa
ggccaccuucccugcaaugggugcacacgcggcucccauccagcccucucagcguggggcugug

SEQ ID NO: 101849 - RNA, 64 nt, hsa
gauugccagcacagugaguuucccagccugcucccccauccacacuuggaaauugagggagcau

SEQ ID NO: 101850 - RNA, 64 nt, hsa
uaccuccacgggugucagcccagaugacuccucacccauccaccaccugcagcuugagauguua

SEQ ID NO: 101851 - RNA, 64 nt, hsa
augcugauacacacuguuguuaggccugcaccugcccauccagaaagcagcagcugccuuguua

SEQ ID NO: 101852 - RNA, 64 nt, hsa
uccuuccccuugaaguagggggacccugaauuugcccauccaccugggucacuuugagaguugu

SEQ ID NO: 101853 - RNA, 64 nt, hsa
ucacccuucuugaagucuccgaucugucccugaucccauccaugcucaggccuuaggucuggcc

SEQ ID NO: 101854 - RNA, 64 nt, hsa
cuauacccuugacgcccauaccugccucaguuuccccauccacaccuggacgcaggcccugccg

SEQ ID NO: 101855 - RNA, 63 nt, hsa
ccucagagaguugaggaccgcagcauccccuccacuccagaguugggugguauggauuuucaa

SEQ ID NO: 101856 - RNA, 63 nt, hsa
cagcacacaauuucaagccauuuucagaucagaacuccagaaguguugacaagaugccuauuc

SEQ ID NO: 101857 - RNA, 63 nt, hsa
caguugcaguauuucaaagucccuauccaggucacuccagaaaaggguauugaaacguugaaa

SEQ ID NO: 101858 - RNA, 63 nt, hsa
ucauaacauauaugagguauacaaaauuuucuaacuccagauuguagucauuuugagagguac

SEQ ID NO: 101859 - RNA, 63 nt, hsa
ccuguaacuuaucuagaaagaaaagacccugagacuccagaaucugcuguugccauagcccca

SEQ ID NO: 101860 - RNA, 63 nt, hsa
uugucugaggccucaucccucggaagccgucugacuccagagucugagcccccggcuaguacc

SEQ ID NO: 101861 - RNA, 63 nt, hsa
agagcacagaccccagagucuugugguucucuaacuccagaaaggacaauguccccuauucag

SEQ ID NO: 101862 - RNA, 63 nt, hsa
cacacaccugggcagccacuucauauaaagguuacuccagaccauguacaaaacacagccacu

SEQ ID NO: 101863 - RNA, 63 nt, hsa
augcuaccuuuugggaaacaaacugccccguuaacuccagaucauugcacuggaauguaauca

SEQ ID NO: 101864 - RNA, 63 nt, hsa
aauuuacugugacuagauuugaagcaaauaaauacuccagauccaugcagcuagaacacacuu

SEQ ID NO: 101865 - RNA, 63 nt, hsa
cugaccucaucaugguucuaguucucauacagaacuccagaauuuuuaaagaacucuauaauu

SEQ ID NO: 101866 - RNA, 63 nt, hsa
cauguggcccaccagcagccuuuccaaaggggaacuccagagacauuucauaaugcaaacagc

SEQ ID NO: 101867 - RNA, 63 nt, hsa
ucccuuccugcccaucccuucccuacaaugcccacuccagacgcaaagauacacuuuuuuccu

SEQ ID NO: 101868 - RNA, 63 nt, hsa
uaaaaugcagcuguuguuagacaacuguugaaaacuccagaaauacaucacccaagguggcag

SEQ ID NO: 101869 - RNA, 63 nt, hsa
agccuccgcaggaugccggacaauggugaagaaacuccagauaucaaggaauugggaaauccu

SEQ ID NO: 101870 - RNA, 63 nt, hsa
cagcaaaucucaugauaaaggacaaggucaagaacuccagagcacugagcagagaggcuggug

SEQ ID NO: 101871 - RNA, 63 nt, hsa
uuacuggguaaaagcagggcagcagggaacaaaacuccagacucuugggccguccccauuugc

SEQ ID NO: 101872 - RNA, 63 nt, hsa
aaccuaaaaauguaggcuuucauguugcaaagaacuccagagucaguaguuagguuugguuug

SEQ ID NO: 101873 - RNA, 63 nt, hsa
aguuuacugaacuccagaccaugcauguaguccacuccagaaaucaugcucgcuucccuuggc

SEQ ID NO: 101874 - RNA, 63 nt, hsa
aagacuugggggugaaacuuuccaguuuacugaacuccagaccaugcauguaguccacuccag

SEQ ID NO: 101875 - RNA, 63 nt, hsa
cuccucuacccaaagcucugucccccugcucccacuccagaagaacugcggcacgcgcuucgg

SEQ ID NO: 101876 - RNA, 63 nt, hsa
ucacugcccucucccugccugggggcuaugugcacuccagaccccugcccaggcucaggccca

SEQ ID NO: 101877 - RNA, 63 nt, hsa
uucuggauacagccuuuuggguaaacacugggaacuccagaaguuguggggagaguggggaau

SEQ ID NO: 101878 - RNA, 63 nt, hsa
gaaagacugcaauagaaaacucccaaacccagcacuccagacucgagggaagccagcuuccaa

SEQ ID NO: 101879 - RNA, 63 nt, hsa
gaaacucacccaaagccuguagccuccccaacuacuccagacuguccugcucacccuuuccuu

SEQ ID NO: 101880 - RNA, 63 nt, hsa
gaaugccagaggagcaaggaugcagggcccaggacuccagagcugugaccuggcucugguuca

SEQ ID NO: 101881 - RNA, 63 nt, hsa
aagguaacugagagcagaugguccuccauuucaacuccagaaguggggcucugggagggaugu

SEQ ID NO: 101882 - RNA, 63 nt, hsa
cacccccuccagcuccaguuuccaaguuccugcacuccagaauccacaaagccgugccuuucu

SEQ ID NO: 101883 - RNA, 63 nt, hsa
uucguccaaggcaccggugugugugugucuugcacuccagagcugaccuccaccgcccagccu

SEQ ID NO: 101884 - RNA, 63 nt, hsa
ugccacccagccacuuagggucuacagggugggacuccagaccuagagcguaaguauggaugu

SEQ ID NO: 101885 - RNA, 64 nt, hsa; identical to SEQ ID NO: 24344

SEQ ID NO: 101886 - RNA, 64 nt, hsa; identical to SEQ ID NO: 24345

SEQ ID NO: 101887 - RNA, 64 nt, hsa; identical to SEQ ID NO: 24346

SEQ ID NO: 101888 - RNA, 64 nt, hsa; identical to SEQ ID NO: 24347

SEQ ID NO: 101889 - RNA, 64 nt, hsa; identical to SEQ ID NO: 24348

SEQ ID NO: 101890 - RNA, 64 nt, hsa; identical to SEQ ID NO: 24349

SEQ ID NO: 101891 - RNA, 64 nt, hsa; identical to SEQ ID NO: 24350

SEQ ID NO: 101892 - RNA, 64 nt, hsa; identical to SEQ ID NO: 24351

SEQ ID NO: 101893 - RNA, 64 nt, hsa; identical to SEQ ID NO: 24352

SEQ ID NO: 101894 - RNA, 64 nt, hsa; identical to SEQ ID NO: 24353

SEQ ID NO: 101895 - RNA, 64 nt, hsa; identical to SEQ ID NO: 24354

SEQ ID NO: 101896 - RNA, 64 nt, hsa; identical to SEQ ID NO: 24355

SEQ ID NO: 101897 - RNA, 64 nt, hsa
ugaaaacaacauuggccuuuuguaucucacaauucuggucuagauucaguuaugaauguaggca

SEQ ID NO: 101898 - RNA, 64 nt, hsa
ggaauaugguuguggauuucugagcaugugcagacuggucuagcuaguucaggaacuggugcau

SEQ ID NO: 101899 - RNA, 64 nt, hsa
uaggauauugagccaauuuaaauaaagcaauauacuggucuagcugaguucuagaacuucucuc

SEQ ID NO: 101900 - RNA, 64 nt, hsa
cugaugcaguccaggcuccaugcuuugaaaaccacuggucuagcuuuagauaggauauugagcc

SEQ ID NO: 101901 - RNA, 64 nt, hsa
ggguaagagggaggccacugaggucucuguugaacuggucuaaugaguucaagggccugaggca

SEQ ID NO: 101902 - RNA, 64 nt, hsa
uuuucccuuccuuuuugcaggcccauggucagcucuggucuagauguaucuaggcuuagggagc

SEQ ID NO: 101903 - RNA, 64 nt, hsa
uaugaaagaaaaacuugaaaugcuacuuaacuuacuauuucaaagggaaguauauuucuuuuua

SEQ ID NO: 101904 - RNA, 64 nt, hsa
augcacacaaaaaauaacuuauaguuagacuuuucuauuucaaguaaagcuuugaguuacuugu

SEQ ID NO: 101905 - RNA, 64 nt, hsa
uguucucuaaucaauagugguuuagcuuucuuuucuauuucacucguuucuaggguuuuuuauu

SEQ ID NO: 101906 - RNA, 64 nt, hsa
auuacuugcucugggcaaguggauauuuauuaggcuauuucaaagccacagcauaagaauguca

SEQ ID NO: 101907 - RNA, 64 nt, hsa
uucuaaauaccauuaaggcuugacugguuaauuccuauuucaaggauuuggauuuauucaggua

SEQ ID NO: 101908 - RNA, 64 nt, hsa
uuugugagcaaaguaaccccauaaguuuauuucccuauuucaugguauuguuuaaacuuuaaaa

SEQ ID NO: 101909 - RNA, 64 nt, hsa
gggaccauugcauugugcccaaguaauaauaaaacuauuucagauguauuauaugauugagcaa

SEQ ID NO: 101910 - RNA, 64 nt, hsa
gcagcuguaguuuguuucuuuuuauuaccaaguacuauuucauuguaugaauauaucacaguuu

SEQ ID NO: 101911 - RNA, 64 nt, hsa
uguggaacaacccaguaauaucagacucgaauuacuauuucauucuauuucaaaugcuuauaaa

SEQ ID NO: 101912 - RNA, 64 nt, hsa
cccaguaauaucagacucgaauuacuauuucauucuauuucaaaugcuuauaaagcuacuauug

SEQ ID NO: 101913 - RNA, 64 nt, hsa
uuccccaguccaaaacacagucauuucaccuggacuauuucaaucauuacacagguguccaacc

SEQ ID NO: 101914 - RNA, 64 nt, hsa
uuaacugaagaaagagaaauugaauaauauaguucuauuucaacauguggguucacagauuuau

SEQ ID NO: 101915 - RNA, 64 nt, hsa
uuggauguacaguaguuuuauuuccacagccacauuaccauagcaauaagaaaggaggcauagu

SEQ ID NO: 101916 - RNA, 64 nt, hsa
uauaucaggugaccugguagagauguaaagcaauuuaccauaguuugggcuuuaguauuguaaa

SEQ ID NO: 101917 - RNA, 64 nt, hsa
cauuccugacauccuccccagcucaagucuauucuuaccauagaacccagggcagggagagaag

SEQ ID NO: 101918 - RNA, 64 nt, hsa
uaagagagguuugguuuguggugguuugcuuucuuuaccauaagcaaucccuugccuuaacuca

SEQ ID NO: 101919 - RNA, 64 nt, hsa
gugaaaaggucaagauuaagacuaaaacuuauuguuaccauauguauucaucuguuggaucuug

SEQ ID NO: 101920 - RNA, 64 nt, hsa
cuguagugaauuaucugagcuagaguuaccuagcuuaccauacuauaucuuuggaaucaugaaa

SEQ ID NO: 101921 - RNA, 64 nt, hsa
uuaaaaaacucacauagaggagacaaucagaaauuuaccauagucccaagaauucagcuacaug

SEQ ID NO: 101922 - RNA, 64 nt, hsa
cagcacuugcuuucuucuucuuaaagagagcugcuuaccauacauagcacccacagugucuccc

SEQ ID NO: 101923 - RNA, 64 nt, hsa
auaaaacuuguaauagagcaauaauuguaaaugguuaccauacuguaagauauuuugauaaaaa

SEQ ID NO: 101924 - RNA, 64 nt, hsa
ugcaaaguguaucauguggaauauccucauauuuuuaccauauuuuaagaacuuuaagacgauu

SEQ ID NO: 101925 - RNA, 51 nt, hsa
auuggaacauguuagaauaguuuaccauaauuaccaaggaaaagaaaagua

SEQ ID NO: 101926 - RNA, 64 nt, hsa
guaaaauuaccuuagaagaaaacaacggguucaguuaccauaaugcagacauuuucuacuucag

SEQ ID NO: 101927 - RNA, 64 nt, hsa
uaguaaaaaggaagagcguuuccuaaucccuccuuuaccauauccuacacagaaaaauacuuuu

SEQ ID NO: 101928 - RNA, 64 nt, hsa
aaaauacuuuuagacuuauauugccaagccaaaguuaccauauuuugguguuuuuguguuuucu

SEQ ID NO: 101929 - RNA, 64 nt, hsa
aagugcacaccucaccauccuucagucuaaggaagaagggcaagcccugggaccaagagcucuc

SEQ ID NO: 101930 - RNA, 64 nt, hsa
caugcuguguguccugguauugggagguuucugggaagggcagaggauaaauguggcccugccu

SEQ ID NO: 101931 - RNA, 64 nt, hsa
ggcccuucacagggggcagcgggacaggcaucuugaagggcauauguccucggaagcuccgagc

SEQ ID NO: 101932 - RNA, 64 nt, hsa
uagcuccauuucuuauuuuccaccaaauuuaauugaagggcauuaauuagaugucuucacccug

SEQ ID NO: 101933 - RNA, 64 nt, hsa
aaaagucauauuuuaagugggauuuguuuuuccugaagggcauuugaaggaacaauaucuggga

SEQ ID NO: 101934 - RNA, 64 nt, hsa
aagaccagcccaagugccgucuuagccauucagugaagggcaaacagcccauggguaguauggc

SEQ ID NO: 101935 - RNA, 64 nt, hsa
gaugaguuccagaugucccuucuuugauaugguagaagggcauuuauuuauaugagagcaaaug

SEQ ID NO: 101936 - RNA, 64 nt, hsa
uggggagagggagugugccccucggggcaggagggaagggcaucuggggaagggcaggagggaa

SEQ ID NO: 101937 - RNA, 64 nt, hsa
gugccccucggggcaggagggaagggcaucuggggaagggcaggagggaagagcuguccaugca

SEQ ID NO: 101938 - RNA, 64 nt, hsa
guaucagcaggaagccauugccauucugagccuugaagggcaaggagggaaacaguguuaccag

SEQ ID NO: 101939 - RNA, 64 nt, hsa
uguaacaugguauuggcuuaucguuuuuaucucugaagggcaguagccugaagauaacagugca

SEQ ID NO: 101940 - RNA, 64 nt, hsa
gggccacugccagaaagagagucaagcaaaccuggaagggcaaaucugagagugggaaggccaa

SEQ ID NO: 101941 - RNA, 64 nt, hsa
uggagucaggcagugcacuccuggagccaagagggaagggcaggguagagaggguauguccagu

SEQ ID NO: 101942 - RNA, 64 nt, hsa
gacugcaggcugcuaauugcaggaaaugacuuuggaagggcaggcucuuguccaguuucagggc

SEQ ID NO: 101943 - RNA, 64 nt, hsa
ugccagcaguguccuugggaaaggcaauauuuaugaagggcagaagaggcagccccaagaaccu

SEQ ID NO: 101944 - RNA, 64 nt, hsa
uucaaaaauggaagcccacuucucagauuuuucugaagggcauacaaugaaaagugaaggggaa

SEQ ID NO: 101945 - RNA, 64 nt, hsa
gaacaaaccccgaaacaguaagaaauuggagugagaagggcaugguauugggacuaggaucggc

SEQ ID NO: 101946 - RNA, 64 nt, hsa
gacagguuuuggggggggcucaggucugggaugagaagggcacugcccucccucacccauauug

SEQ ID NO: 101947 - RNA, 64 nt, hsa
cugugugagcucucugugagcucuggcuggcggagaagggcagguguccggagcugucggggug

SEQ ID NO: 101948 - RNA, 64 nt, hsa
uguccccuggcugcacccaggacuucgggcuccugugucucaccauucccaagccccuggccac

SEQ ID NO: 101949 - RNA, 64 nt, hsa
cacgcagccagaauccuuaagucuguguguuucugugucucaagacugggcucacauucuggcu

SEQ ID NO: 101950 - RNA, 64 nt, hsa
acacauguggcagcugaacgaggugcuguugugggugucucagcucugagggucuuugugagcu

SEQ ID NO: 101951 - RNA, 64 nt, hsa
cucugagggucuuugugagcucccacuguugugggugucucagcucugagggucuuugugagcu

SEQ ID NO: 101952 - RNA, 64 nt, hsa
cucugagggucuuugugagcucccacuguugugggugucucagcucugagggucuuugugaguu

SEQ ID NO: 101953 - RNA, 64 nt, hsa
aaagacaguuucuugcaagcuccaguagcuccgcgugucucauuugccaggaagauggguuccc

SEQ ID NO: 101954 - RNA, 64 nt, hsa
augauaagguuuagaaugacaggaacccaucacugugucucauggucccacuuccccaucugug

SEQ ID NO: 101955 - RNA, 64 nt, hsa
uuuucuuuuuucuuuauuuuuuuuuuuugaaaccgugucucacucugucgcccaggcuggagga

SEQ ID NO: 101956 - RNA, 64 nt, hsa
ugugugcccauuaccuuuccucugccugaaagacgugucucaagaaaaauaaauucuauuuuag

SEQ ID NO: 101957 - RNA, 64 nt, hsa
uagugaauuaucugugccuagacccaaacugaaagugucucaggcaggaaguuccaagggaugu

SEQ ID NO: 101958 - RNA, 64 nt, hsa
cuacccugcuccagcuucagcccagguaguuggugugucucaauaugaauagggggugaguagc

SEQ ID NO: 101959 - RNA, 64 nt, hsa
cccaggaccacauuuuaacaaucaauguuuucaggugucucaugaggaacacuacuuaaugcag

SEQ ID NO: 101960 - RNA, 64 nt, hsa
auuaauuuuuuuuuuuuuuuuuuuuguagagacagugucucacuauguugcccaagcuggucuu

SEQ ID NO: 101961 - RNA, 64 nt, hsa
ugccuacuuuuaugaguaccaucagcuggacacagugucucauaccuguauuugcagcacuuug

SEQ ID NO: 101962 - RNA, 64 nt, hsa
gaaucaggaucugggacuggcaggguccccuccugugucucaucucuugcagcagcagcugcug

SEQ ID NO: 101963 - RNA, 64 nt, hsa
guggguuuggccccaugucacuggccggaaggaugugucucagcccugcccuguggggugcccc

SEQ ID NO: 101964 - RNA, 64 nt, hsa
uguagcugcccccuugcccugugugggauucgcagugucucauuuggugacgucuuacugguga

SEQ ID NO: 101965 - RNA, 64 nt, hsa
gggagcggugucuggugcgucagccugcugcuucgugucucacucgagaguugcuucugguuuc

SEQ ID NO: 101966 - RNA, 64 nt, hsa
aacauuuauauugagauucuuuguggcuauuggugugucucacaggcaaaauuugauuuggcua

SEQ ID NO: 101967 - RNA, 64 nt, hsa
auuccuuuaaaaacuacaucuuuccuaugcaagagugucucacaugugcuuaaccgaggugcuu

SEQ ID NO: 101968 - RNA, 64 nt, hsa
ccuaggcagaugggggcuguggaaagauuguucugugucucauucccucuuaagccacuccccc

SEQ ID NO: 101969 - RNA, 64 nt, hsa
uuuucagcauaguaaagcuggaaggccaggugcagugucucaccccugucaucccagcacuuug

SEQ ID NO: 101970 - RNA, 64 nt, hsa
aggaggacuaugagcaguggcuggagaucaaagugugucucaccaagacagugagaccgacucc

SEQ ID NO: 101971 - RNA, 64 nt, hsa
caccuggcuaauuuuaaaauuuuuuguaaggacagugucucaccauguugccuaggcgggucuc

SEQ ID NO: 101972 - RNA, 64 nt, hsa
uaaacaugaugaaaccgcaugcuauggcuuucuagugucucauauucuguuggcaagaagcuca

SEQ ID NO: 101973 - RNA, 64 nt, hsa
acagccaaagacaucaacccaagugcugggucaagugucucaucauacuggcacuguugcuggg

SEQ ID NO: 101974 - RNA, 64 nt, hsa
aucaacccagccuggcacccuugccugucugagagugucucaaagggcugauggcuuccugguc

SEQ ID NO: 101975 - RNA, 64 nt, hsa
aggaggagcaaggacaagaugcgcacagggugguuuuccucauggauuuugucaaauagaugau

SEQ ID NO: 101976 - RNA, 64 nt, hsa
cuccuccccacaaaggcuuugaaaucauaaggauuuuccucaucucuuuauagcuuucccaaaa

SEQ ID NO: 101977 - RNA, 64 nt, hsa
cuugggcaagucacuuaaccucucuuugccucaauuuccucaucuugaaaugaggauaauaaua

SEQ ID NO: 101978 - RNA, 64 nt, hsa
cuaaaagaaugacagaacaaucaucuuagcacccuuuccucacaauaauauaaaaauauuaaaa

SEQ ID NO: 101979 - RNA, 64 nt, hsa
ucucugguuaccccucuucccuuguuaucuaagcuuuccucaguugucaucucuucccagcucu

SEQ ID NO: 101980 - RNA, 64 nt, hsa
ugcggugauuuugauccagggacugcaucuccucuuuccucaucacagccagugcugagaggcu

SEQ ID NO: 101981 - RNA, 64 nt, hsa
guaauuguauauaauuuuuguguuucuugcuccauuuccucaugcugucauccuuaaaguccau

SEQ ID NO: 101982 - RNA, 64 nt, hsa
cuugauuaagucauuuagccucucuggauuucuauuuccucaucuguaaaauagaguuaaaugu

SEQ ID NO: 101983 - RNA, 64 nt, hsa
caucuguggcaaaauuucagacuauuuuugcgucuuuccucaucacuuuuugugaugcaacucc

SEQ ID NO: 101984 - RNA, 64 nt, hsa
cgugccagucuccugacuagagcacuuuacucuguuuccucagcccugcagccccugggagcac

SEQ ID NO: 101985 - RNA, 64 nt, hsa
acuggaccuaacuuuaucauuaauuagguaauauuuuccucauuucuuuacugcugccauuuuc

SEQ ID NO: 101986 - RNA, 64 nt, hsa
gguaauauuuuccucauuucuuuacugcugccauuuuccucaccaguauuccagagauggucau

SEQ ID NO: 101987 - RNA, 64 nt, hsa
acauccuucuguuucuccuucagcucuauccugcuuuccucaucccuucugacaccacguccuc

SEQ ID NO: 101988 - RNA, 64 nt, hsa
ggccuucacccacgggaugccggguucuccuuucuuuccucaccccaaccuuuacuccaccaga

SEQ ID NO: 101989 - RNA, 64 nt, hsa
uuagaagccuugaagauuacaacugugauuuccuuuuccucagcaagcuccuauguguauauuu

SEQ ID NO: 101990 - RNA, 64 nt, hsa
uagggugaugacccucuuuguccuagguguacccuuuccucaucucuauuaaauuguaaacagg

SEQ ID NO: 101991 - RNA, 64 nt, hsa
agaacagcugaagucucaaaucauugucuggaauuuuccucaccuuggcuagcuccaccugcuc

SEQ ID NO: 101992 - RNA, 64 nt, hsa
uaacauuucucaugaacccacugccccucugcauuuuccucacugguuagagauuaaguaaaua

SEQ ID NO: 101993 - RNA, 64 nt, hsa
guuauuuccucuaacuugauauuaauuugcuuucuuuccucaaaaauguaaguaggcauguugc

SEQ ID NO: 101994 - RNA, 64 nt, hsa
ugaccuuugaaauaaugucaacagucacaacagguuuccucaagccccauuugucaacuaaaag

SEQ ID NO: 101995 - RNA, 64 nt, hsa
gacuauuaaagaauguuuuggaauaaacugucuuuuuccucaaugaaugggaugucuaauguau

SEQ ID NO: 101996 - RNA, 64 nt, hsa
acuaaaguagaauuaucucucauuuguuguuguuuuuccucaaaauuaccaaacaaagcaaaaa

SEQ ID NO: 101997 - RNA, 64 nt, hsa
ucaaaguauuuauaaaaacacugcccucuaaaaauuuccucagaucugaaguauggucuugguc

SEQ ID NO: 101998 - RNA, 64 nt, hsa
uagaguaaucuacaucuggaccauuccuuaaguuuuuccucaccgacaguaccaucaugccuug

SEQ ID NO: 101999 - RNA, 64 nt, hsa
aaaauaaaaauaagacaguuuauuagaaauagcauuuccucauaagcauaaaaagaaaaucuuu

SEQ ID NO: 102000 - RNA, 64 nt, hsa
ugcauacuuuuucauucaaaauggguauucuugauuuccucagaacugauaaaaaauaaugcaa

SEQ ID NO: 102001 - RNA, 64 nt, hsa
cuguucuauuuuuguguuauaauuuaaacuucgauuuccucauaguccuuuaaguugacauuuc

SEQ ID NO: 102002 - RNA, 64 nt, hsa
cuaauaaucggggcauggguaaaacuuaugaaaauuuccucaugcugaauuguaauuuucucuu

SEQ ID NO: 102003 - RNA, 64 nt, hsa
gggcaggaggugggguggaaauagggugggcuccuuuccucagguagaguggggggccaaaacc

SEQ ID NO: 102004 - RNA, 64 nt, hsa
caagaauguaauuuauuggggcccccccagcugcuuuccucaccugccccugcccuaccuuaca

SEQ ID NO: 102005 - RNA, 64 nt, hsa
uguuugcuucaguuuuuuaucauggggagaucuuuuuccucagaauuguuuucuuuucacugua

SEQ ID NO: 102006 - RNA, 64 nt, hsa
ucacuacaauaugauacauagaugguaccuuacuuuuccucauucuuaauaggugucuaagaau

SEQ ID NO: 102007 - RNA, 64 nt, hsa
caaucauucacuccuuaugcaaagccaauauaauuuuccucauaccuuaugcuugaggauauug

SEQ ID NO: 102008 - RNA, 64 nt, hsa
uuaucucaggcaggaggcguuuacauaacagauguuuccucagcugggugugagguauacucua

SEQ ID NO: 102009 - RNA, 64 nt, hsa
gaaugcuggcugggagagccaugacuaccagacuuuuccucaggcuccuuggcauguuagucug

SEQ ID NO: 102010 - RNA, 64 nt, hsa
ucuggucucacugccuuaucucacaccaacucuguuuccucauugcccccugagauggccuguc

SEQ ID NO: 102011 - RNA, 64 nt, hsa
uagaauauugggggaaggagggcagacuccaucguuuccucagggagacugggcggaggugggg

SEQ ID NO: 102012 - RNA, 64 nt, hsa
aguggccuuuccuccuucugggugcccagcccccuuuccucaccugauacccaagcccaccacu

SEQ ID NO: 102013 - RNA, 64 nt, hsa
uguaggaucuuuggaaucucuugguuccuaagaguuuccucagagaucauaccuccccagaggg

SEQ ID NO: 102014 - RNA, 64 nt, hsa
uuuaacucaacaauaccugcuucccaauuacucauuuccucagauaagaagaaaucaucucuac

SEQ ID NO: 102015 - RNA, 64 nt, hsa
uuauuuuuauacccuuaaccaguuuaauuuuuuuuuuccucauuguuggggaugaugagaagaa

SEQ ID NO: 102016 - RNA, 64 nt, hsa
auaagccauuuuccuucauuagguccugguuuaauuuccucaucuuuaaaaugagaagguuaaa

SEQ ID NO: 102017 - RNA, 64 nt, hsa
ugucuauuugggcuaaccauagaauuucauuuauuuuccucacaauauuuuccuagaccaacuc

SEQ ID NO: 102018 - RNA, 64 nt, hsa
acuuucucuaguuagaugucaguccuaaauagguuuuccucacuucaggccucaccccucaccu

SEQ ID NO: 102019 - RNA, 64 nt, hsa
cagaugcuucccuccauacuuuuuauuugcucuguuuccucagauuuauuuugucuugccccau

SEQ ID NO: 102020 - RNA, 64 nt, hsa
agcaaaguugaacugggcuaccucucuacagcuguuuccucagagggaaaaaucuugagaccag

SEQ ID NO: 102021 - RNA, 64 nt, hsa
gcuagguggugcuuacuaauuaccuucucaggauuuuccucagauugaaaagcuuaugaggauu

SEQ ID NO: 102022 - RNA, 64 nt, hsa
caguaucuaacauuaccauucacguuaaaugaaguuuccucauaacauuuaucuuuaguuuuau

SEQ ID NO: 102023 - RNA, 64 nt, hsa
caaauacaauuugcauuaaaaagauuggcauuauuuuccucaucagcagaauuuauaacagugu

SEQ ID NO: 102024 - RNA, 64 nt, hsa
uaccucccugucugcuuacucacccacucuguccuuuccucaccaacuaacaugugccagccag

SEQ ID NO: 102025 - RNA, 64 nt, hsa
ucuuccucugggcaaagaagggcuuccaguggccuuuccucacucuguaguguuuguggggaua

SEQ ID NO: 102026 - RNA, 64 nt, hsa
cccucaccugggcaaacaugaagcucuggccuccuuuccucagccccuuguucuucccuguccu

SEQ ID NO: 102027 - RNA, 64 nt, hsa
ugcuagaguaucuggcuggcugcugugugccugguuuccucacauccugccucagcuucaccac

SEQ ID NO: 102028 - RNA, 64 nt, hsa
aagaagcaccucacagcuccuuucuagguccuucuuuccucauuggaagcaaagaccuagccaa

SEQ ID NO: 102029 - RNA, 64 nt, hsa
uguauuuuggaagacagguuuuuuaaagaaacauuuuccucagauuaaaagaugaugcuauuac

SEQ ID NO: 102030 - RNA, 64 nt, hsa
accaucagcucugccuugcacuguggucgucaacuuuccucaaaucaaaaacaggcagguacag

SEQ ID NO: 102031 - RNA, 64 nt, hsa
gaagagccuuuauacaauuggacgcauuuugguuuuuccucauugagaauucaaauccucuuuu

SEQ ID NO: 102032 - RNA, 64 nt, hsa
ugucccccacccucauggcccaccuccaacccacuuuccucaguaucuggagagggaagggaag

SEQ ID NO: 102033 - RNA, 64 nt, hsa
ucgaugcuuugguuuugaccccaccugauccuccuuuccucaugcagcacaagugcucaccggg

SEQ ID NO: 102034 - RNA, 64 nt, hsa
cagguguucuucauuaccucagugagaagccagcuuuccucaucaggccauugucccugaagag

SEQ ID NO: 102035 - RNA, 64 nt, hsa
uaugagcuggggaugucucucaugaccaaaugcuuuuccucaaagggagagagugcuauuguag

SEQ ID NO: 102036 - RNA, 64 nt, hsa
aaauagucuuccuuuauggauuuucauuggacucuuuccucagcgauuguccuggcuguuuauu

SEQ ID NO: 102037 - RNA, 64 nt, hsa
auuaacucauggccucagucaguucauucuuuaauuuccucaccaaauuauugacuuagagcau

SEQ ID NO: 102038 - RNA, 64 nt, hsa
ucccauccagcacucucuauggaaauaguugucauuuccucagugauggugugucuuauaguga

SEQ ID NO: 102039 - RNA, 64 nt, hsa
caccagcuccugccaaauuaugcauuaguaacuuuuuccucagagacaccccuaaaggcuccca

SEQ ID NO: 102040 - RNA, 64 nt, hsa
uccaguuuuagaauauuuccaugacccuaagaaguuuccucaugucuauuaauauucccaaucc

SEQ ID NO: 102041 - RNA, 63 nt, hsa
guccuuaauuuaucaaauauaugauacguggacauuuccucauagucugugguuucuuuuaau

SEQ ID NO: 102042 - RNA, 64 nt, hsa
aaaaaaauuuuuuuagagauggggucucacuauguuuccucaucuggucuuaaacuucuaggcu

SEQ ID NO: 102043 - RNA, 64 nt, hsa
auggaaauauaaacaaaauuuaccaacuacaguuuuuccucauuugaaucuaacccauuucuga

SEQ ID NO: 102044 - RNA, 64 nt, hsa
uccauggguaacgucauucauccacauuaacuaauuuccucacuccaagcucuuuucuggagau

SEQ ID NO: 102045 - RNA, 64 nt, hsa
auuaccuuacuauuucuuuuguuccaaguuuguauuuccucagaguucucacauauggaaagga

SEQ ID NO: 102046 - RNA, 64 nt, hsa
uuccuaauaugaucuaaaacccuaaaugguuauuuuuccucagaaugauuuguaaauagcuacu

SEQ ID NO: 102047 - RNA, 64 nt, hsa
guguuucuuguguuugagaaccaugacuuaugacuuuccucagaacaugagacuguaaaacaaa

SEQ ID NO: 102048 - RNA, 64 nt, hsa
acuuuuuagcgaacuuaacagguuucacugacguuuuccucaauuuuugaauuuaggugggauu

SEQ ID NO: 102049 - RNA, 64 nt, hsa
acacuugaucccaaaaccccuuuaagaccuuagguuuccucagcggaaaacuguacuuuaaucc

SEQ ID NO: 102050 - RNA, 64 nt, hsa
augcggggaagacuaaugcauggugacaccuaguuuuccucaacaggacacuugaucccaaaac

SEQ ID NO: 102051 - RNA, 64 nt, hsa
uauugauugauguugcaucaauuuagcaaauucauuuccucauucuugauggccugaauauaug

SEQ ID NO: 102052 - RNA, 64 nt, hsa
aauucuuuuugugaccucagaaugucucuggaucuuuccucauugacugacucugugccacguc

SEQ ID NO: 102053 - RNA, 64 nt, hsa
caguugccacagauuauacaaccauuacccaaaccacucugacagucuccuccaguuccagcaa

SEQ ID NO: 102054 - RNA, 64 nt, hsa
guucacccugagggcugucuugaagcccgcuacccacucugaggcuccuaggagguaccaugcu

SEQ ID NO: 102055 - RNA, 64 nt, hsa
ucccccucucccucccaucccuuuucuucccuuucacucugaagcaguuuuagcuuauuaacag

SEQ ID NO: 102056 - RNA, 64 nt, hsa
ucuuuaggcauuuccucuuuuccccgccugcacccacucugaacaugacaaaaguugccagagu

SEQ ID NO: 102057 - RNA, 64 nt, hsa
aagaggggguuuuacacucugauuccaggacaagcacucugaggcgggugggggagagaaaccc

SEQ ID NO: 102058 - RNA, 64 nt, hsa
ucaguuuuggugucugcuucaagaggggguuuuacacucugauuccaggacaagcacucugagg

SEQ ID NO: 102059 - RNA, 64 nt, hsa
gcucagcccuuucugugagagucccucugcugcucacucugauccagaggcacccugaguuggu

SEQ ID NO: 102060 - RNA, 64 nt, hsa
ggccuuaccucuuccucuacuggcauccuaauggcacucugacagcauccagggugacuacagg

SEQ ID NO: 102061 - RNA, 64 nt, hsa
ugcccuguuuggccacccucuggccagccaaaagcacucugaaaccaagaccuucccauuuccu

SEQ ID NO: 102062 - RNA, 64 nt, hsa
ccacaggagggggauaaucagagcuugaggcuggcacucugacugcuggcuuuucccagacagc

SEQ ID NO: 102063 - RNA, 64 nt, hsa
ccuucggccccuccucccucuuuuccucuggaugcacucugaugauaccaugguuaccccauug

SEQ ID NO: 102064 - RNA, 64 nt, hsa
uuguacuguccauccuucaggcaucccuaaagcucacucugaagauguuagagacaaacacaaa

SEQ ID NO: 102065 - RNA, 52 nt, hsa
cacuuccacugggaucaugagucacucugaagccacucugaaaucacucuga

SEQ ID NO: 102066 - RNA, 63 nt, hsa
cacuuccacugggaucaugagucacucugaagccacucugaaaucacucugaagccaaagcug

SEQ ID NO: 102067 - RNA, 64 nt, hsa
gggaucaugagucacucugaagccacucugaaaucacucugaagccaaagcugggcucaguggg

SEQ ID NO: 102068 - RNA, 64 nt, hsa
ggguggagccccugagcugaguucugcagagacccacucugaccccacuaaaaugaccccugau

SEQ ID NO: 102069 - RNA, 64 nt, hsa
uuauggacuggacguuaacucucuugcucaaggucacucugaguggaagaguggggauaaaucu

SEQ ID NO: 102070 - RNA, 64 nt, hsa
auugaucaauuuuaacuacauaaaaauguuuauaggacaagaaaaaccccaccauaacccaagg

SEQ ID NO: 102071 - RNA, 64 nt, hsa
gaugccuguaacuccagcuacucgggagacugaaggacaagaaucacuugaaccugggaagccg

SEQ ID NO: 102072 - RNA, 64 nt, hsa
cuuccugucucuguuuccauuaucacccagagagggacaagauaggacauggccuggaccaggg

SEQ ID NO: 102073 - RNA, 64 nt, hsa
agcugccucugcaguuggacaagacuuggcccccggacaagacucgcccagcacuugcggcugg

SEQ ID NO: 102074 - RNA, 64 nt, hsa
ccaaacucaaccacaaccagcugccucugcaguuggacaagacuuggcccccggacaagacucg

SEQ ID NO: 102075 - RNA, 64 nt, hsa
aggaggagacagaguucccucuguauagccucugggacaagaaaaagaaaacacaagaauguau

SEQ ID NO: 102076 - RNA, 64 nt, hsa
acacgugaccuuuuggugcacacuggagcuacuuggacaagaccagcaugccuugcugcacgug

SEQ ID NO: 102077 - RNA, 64 nt, hsa
gaucagagcaggugagcauccacuuugacaugaaggacaagaagacgcauggcucauggcgggc

SEQ ID NO: 102078 - RNA, 64 nt, hsa
gccagcgugcaacugcccaagcuccaggucuccaggacaagagcaguugucugccaugagcacc

SEQ ID NO: 102079 - RNA, 64 nt, hsa
uucuccagugacaguguccugugacugcaaaaggggacaagaaaaucccucuuccuccauggga

SEQ ID NO: 102080 - RNA, 64 nt, hsa
ccauauaggcccguccacacaggcuugacuggguggacaagaaugaacccaugacagcaccugc

SEQ ID NO: 102081 - RNA, 64 nt, hsa
cucaugccaacagucuuuaugaugggauuaagguggacaagaucuccuaagaucugugaauggg

SEQ ID NO: 102082 - RNA, 64 nt, hsa
aagaucuccuaagaucugugaaugggauuaagguggacaagaucuccuaagaucugaaaagaaa

SEQ ID NO: 102083 - RNA, 64 nt, hsa
gagucggggcuccggccuccugccaaggcucuuguccccauacaccaucccacaagggcgcugg

SEQ ID NO: 102084 - RNA, 64 nt, hsa
aguggcgagcccagcugcccagcccugcccccccuccccauagccagcacagcuaucccgcggg

SEQ ID NO: 102085 - RNA, 64 nt, hsa
gaugaauuguuaauauggcaguaauuaauuaguaucuacuuaaauuuaguggucagaaauguau

SEQ ID NO: 102086 - RNA, 64 nt, hsa
agcuaaaaaaucacaauuuuuuuacugcuuuaauucuacuuaauuuugguagauauugaauggc

SEQ ID NO: 102087 - RNA, 64 nt, hsa
agagaggagucagauuaucuacuuagauuuggcaucuacuuagauuuaacauauacuagcugag

SEQ ID NO: 102088 - RNA, 64 nt, hsa
accgaguagggcuauguagagaggagucagauuaucuacuuagauuuggcaucuacuuagauuu

SEQ ID NO: 102089 - RNA, 64 nt, hsa
ggaauuaaagcagagagaagccauucgugaugcuuagaaccaaggauggucauguacacaaaga

SEQ ID NO: 102090 - RNA, 64 nt, hsa
ugcagacauguuuacuaaugaucauagccaggauuagaaccacuuucaaacauuggggccuucu

SEQ ID NO: 102091 - RNA, 64 nt, hsa
aguggcuacuguauugacauucugggucuaggacuagaaccaguggucuguaacaaaaguacuu

SEQ ID NO: 102092 - RNA, 64 nt, hsa
auauuuaaauacuggggaaauugcuucacugucuuagaaccaagcaagauucaccuguguuuug

SEQ ID NO: 102093 - RNA, 64 nt, hsa
cuugaauuuccaaaauagucaguaaaggaucuaauagaaccagaauuauuugggugaauucugc

SEQ ID NO: 102094 - RNA, 64 nt, hsa
ugguauuuugguguucacuuacgaagcauacaacuagaaccauauccaagcagacucuggguug

SEQ ID NO: 102095 - RNA, 64 nt, hsa
acaccuguccuuuccauagcccuuuuuggaccuuuagaaccacagaugauaggaccagcccaau

SEQ ID NO: 102096 - RNA, 64 nt, hsa
gcuuuucaguuacagaguccaguggaccauuuuguagaaccaugcagcucccugcggaaggugg

SEQ ID NO: 102097 - RNA, 64 nt, hsa
gagagcuagcagcagggagggcuucugccauuucugagaucaaaacgguuuuacugcagcuuug

SEQ ID NO: 102098 - RNA, 64 nt, hsa
gucgaggcaggaggaucacuugaguccagaaguuugagaucagccugggcaaugugauaaaacc

SEQ ID NO: 102099 - RNA, 64 nt, hsa
cgcuugaaccugggaguuagagguugcagugagcugagaucacaccauugcgcuucagccuggg

SEQ ID NO: 102100 - RNA, 64 nt, hsa
ucauugauaucaugacuuccaauugagaggaaaaugagaucaaaugucauuucccaaauuucuu

SEQ ID NO: 102101 - RNA, 64 nt, hsa
gccaagguggguggaccacaugaggucaggaguuugagaucagccuggccaacauggugaaacc

SEQ ID NO: 102102 - RNA, 64 nt, hsa
uucuugaacccaggagacggaaguugcagugagcugagaucacaccacugcacuccagccuggu

SEQ ID NO: 102103 - RNA, 64 nt, hsa
caccugaaccccagaggcagagguugcagugagcugagaucacgccauuguacuccagccuggg

SEQ ID NO: 102104 - RNA, 64 nt, hsa
ucaaaaacuugaucacaugcuugaauggagcuggugagaucaacaacacuacuucccugccgga

SEQ ID NO: 102105 - RNA, 64 nt, hsa
cacuugaacccaggaggcggaaguugcagugagcugagaucaugccacugcacuccagccuggg

SEQ ID NO: 102106 - RNA, 64 nt, hsa
cagcacuuugggaggccaaggcaggcagaucauuugagaucaggaguuugaaaccagccuggcc

SEQ ID NO: 102107 - RNA, 64 nt, hsa
ccauccaacccuuagacucacgaacaaauccaccugagaucagcagagccacccuagaucagcu

SEQ ID NO: 102108 - RNA, 64 nt, hsa
aagggugccuuaaaaauguuguggccaagccacaugagaucaaagacacacuuuucaugaccuc

SEQ ID NO: 102109 - RNA, 64 nt, hsa
guacuauuaacaacccauaggcacuugggaugucugagaucagugccuauggguuguuaauacu

SEQ ID NO: 102110 - RNA, 64 nt, hsa
gaaucauuugcauuaucagccuguuugggaugucugagaucagugccucuggguuguuaauacu

SEQ ID NO: 102111 - RNA, 64 nt, hsa
auucaugguuguuuagcacacaguucaggaccuuugagaucauguuuguauaagcacuccuuga

SEQ ID NO: 102112 - RNA, 64 nt, hsa
uauucaugucugugaagcuuuuaaacauuacacuugagaucagucaugacuugauauucaggua

SEQ ID NO: 102113 - RNA, 64 nt, hsa
cacuugggcccaggaggucaagccugcagcgagcugagaucacaccacugcacuccagccuggg

SEQ ID NO: 102114 - RNA, 64 nt, hsa
cgcuugaaccggggagguggagguugcagugagcugagaucacgccauuguacuccagccuggg

SEQ ID NO: 102115 - RNA, 64 nt, hsa
uugucauugauaacaucuuaucaggagacgguuuugagaucaacuggucugacuaaaauuuauu

SEQ ID NO: 102116 - RNA, 64 nt, hsa
auuuauauucucacauaucuggaggcuggaagucugagaucagagugccagcauggucaaccuc

SEQ ID NO: 102117 - RNA, 64 nt, hsa
aaggaucccugagagucucuguuucaucaggacauucugaaauuuacccacagugaggcugugg

SEQ ID NO: 102118 - RNA, 64 nt, hsa
augcuaucaguaauagucccaguuccauccaacuuucugaaauuucauuuuuuuuuuugagaug

SEQ ID NO: 102119 - RNA, 64 nt, hsa
gauuacaggugugagccaccgcacccggccaacuuucugaaauuucaaaacugaauugauccuu

SEQ ID NO: 102120 - RNA, 64 nt, hsa
uauuaaaauuguucaagaaaauuucuuugaacacuucugaaaguuuuuggaaacuuagaaaaga

SEQ ID NO: 102121 - RNA, 64 nt, hsa
auaauaugcccugcugaauacaugccauuucacauucugaaacuggguagagugguuggguguu

SEQ ID NO: 102122 - RNA, 64 nt, hsa
aagaaauagggugauuuuuaaaggauuaauaaaauucugaaauguuaaguagaagauuacauug

SEQ ID NO: 102123 - RNA, 64 nt, hsa
uccuguucaccagcaaaaaaugucucucccauuuuucugaaaguggcugauguaagaacaggca

SEQ ID NO: 102124 - RNA, 64 nt, hsa
gcagcaaccuuugaucaggagugagauuuucggguucugaaaccugggacacgagucugugaau

SEQ ID NO: 102125 - RNA, 64 nt, hsa
auaaauauaugaugcugagucuguggaaugauacuucugaaaucaaaauuccucauaaggcaug

SEQ ID NO: 102126 - RNA, 64 nt, hsa
cuagcuauccuuuuaaauuaugcuaauucucuucuucugaaauuauggucacacuauauacuau

SEQ ID NO: 102127 - RNA, 64 nt, hsa
accuuucagccauaguuggacauucauugcugaauucugaaaugauagaauugucuuuauuuuu

SEQ ID NO: 102128 - RNA, 64 nt, hsa
uuauuuuucucugugaggucaauuaaaugccuuguucugaaauuuauuuuuuacaagagagagu

SEQ ID NO: 102129 - RNA, 64 nt, hsa
auaaauucagaaaugcucuaagcuaccaaaguuauucugaaaguaugggaacugcuacaacuaa

SEQ ID NO: 102130 - RNA, 64 nt, hsa
gugaaucuaaucuuaaaacuacaaguuguaaguauucugaaauugggaaacauuuauuuuaaau

SEQ ID NO: 102131 - RNA, 64 nt, hsa
ucuguaauaauuuaauguuacuuauuaucagaauuucugaaaccuuuacaaaaauucugauuua

SEQ ID NO: 102132 - RNA, 64 nt, hsa
guaacuuuguggcaaaaauuuucaauauaauacauucugaaacaauaguugcugccuugcaaag

SEQ ID NO: 102133 - RNA, 64 nt, hsa
gacuguuucccuuuccuucaaggccuagaguauauucugaaaauuuaggaaugaggaagaaauc

SEQ ID NO: 102134 - RNA, 64 nt, hsa
acacauuuauuuuucuccuugaucaaguauaaaauucugaaacagaggcuuuaaaauuuaaaac

SEQ ID NO: 102135 - RNA, 64 nt, hsa
acacaaaccaucaucacagaagaugcaacaucuuuucugaaagauugccuuaagagagcuccag

SEQ ID NO: 102136 - RNA, 64 nt, hsa
cuucauguguacuuuccuaccccaagaggaaguuuucugaaauaagauuuaaaaacaaaacaaa

SEQ ID NO: 102137 - RNA, 64 nt, hsa
uuaaguauuugguagcugaauaaggggucagaacuucugaaaccagagaucuguaaucaucucu

SEQ ID NO: 102138 - RNA, 64 nt, hsa
aagccucucucucuuucucuccuccccaacuuuuuucugaaagccuugauuucuguagacagaa

SEQ ID NO: 102139 - RNA, 64 nt, hsa
aguggauguuucuauuuggcaaggaagguaggauuucugaaacucaggccuuaaccaauagguu

SEQ ID NO: 102140 - RNA, 64 nt, hsa
auucauagguaggagggcuuagauuuuaaggcacuucugaaagucaaucccuggacaaggcagu

SEQ ID NO: 102141 - RNA, 64 nt, hsa
ucuccauuuucccuaacuaaaugaaaaggacacauucugaaaucccuuuuguuggagaauaagu

SEQ ID NO: 102142 - RNA, 64 nt, hsa
agggaggauagagaaacagagcacccccugugcuuucugaaaauagacuugcucuugucuugag

SEQ ID NO: 102143 - RNA, 64 nt, hsa
gggagagcagcccaaccaauccccaauccuuuucuucugaaacugagcaggaaggguaaggaag

SEQ ID NO: 102144 - RNA, 64 nt, hsa
ucaucguugggcagaaguuuagcauuaauaguuguucugaaacguguuuuaucagguuuagagc

SEQ ID NO: 102145 - RNA, 64 nt, hsa
uguaacugugagagcaaaugaauaauuccugcuauucugaaauugccuacauguuucaauacca

SEQ ID NO: 102146 - RNA, 64 nt, hsa
cuauagaugucuauacugugaaaaguguuuucaauucugaaaaaaagcauacaucaugauuaug

SEQ ID NO: 102147 - RNA, 64 nt, hsa
aggggagacacaaaauagggauuuuuacuucauuuucugaaagucuagagaauuacaacuuugg

SEQ ID NO: 102148 - RNA, 64 nt, hsa
uugccuuuauaauuuuaacaucuuauauugaagauucugaaaaccuaucuuuauuagaggaaaa

SEQ ID NO: 102149 - RNA, 64 nt, hsa
gaaauaucuaagcuguacaugguacacuagaauuuucugaaagcagaaaacguucagauuuugu

SEQ ID NO: 102150 - RNA, 64 nt, hsa
auuuuacaaaauggcaaguauggaaaaccauggauucugaaaguuaaaaauuuaguuguucucc

SEQ ID NO: 102151 - RNA, 64 nt, hsa
ugacagcuagugcuugggaucguacauguuaauuuucugaaagauaauucuaagugaaauuuaa

SEQ ID NO: 102152 - RNA, 64 nt, hsa
ccacagagccucgggacaucaaaaacagcagaacuucugaaaccucugggucaucucucacaca

SEQ ID NO: 102153 - RNA, 64 nt, hsa
ccugcggcaucagaugaauuguuaauuaucuaauuucugaaaugugcagcucccauuuggccuu

SEQ ID NO: 102154 - RNA, 64 nt, hsa
uguugaaguaccaaguaaccuacaagccuccuaguucugaaaaguuggaagggcaucaugaccu

SEQ ID NO: 102155 - RNA, 64 nt, hsa
uuuuuucuucgacaaaaaaauaauaaaacguuucuucugaaaagcugaacguuucuguauaagc

SEQ ID NO: 102156 - RNA, 64 nt, hsa
ggguuuuuuuucaacguuaaauauucuagaaacuuucugaaauaauuucuguuuaaaaauauug

SEQ ID NO: 102157 - RNA, 64 nt, hsa
cucugccaucucgcuaaaucaucagucucggcucuucugaaauagaaggugccugaucuuccua

SEQ ID NO: 102158 - RNA, 64 nt, hsa
uuuucauuuacuaauuacaaauguugaggccuaauucugaaaguccucauauuuaaaggcuaga

SEQ ID NO: 102159 - RNA, 64 nt, hsa
cuuuccauuuagugaucaagauauggaagcugauuucugaaaaugcucaguguguacucuaauu

SEQ ID NO: 102160 - RNA, 64 nt, hsa
ccugccuaaagauagaauggcuucucuguuuuucuucugaaauacaaccagaaacaaugugucu

SEQ ID NO: 102161 - RNA, 64 nt, hsa
ucuucugaaauacaaccagaaacaaugugucuauuucugaaagaauaggauuaaugaucauaca

SEQ ID NO: 102162 - RNA, 64 nt, hsa
cauuaauagugaaaauauuguguauuagcuaagguucugaaauauucuauguauauaucauuua

SEQ ID NO: 102163 - RNA, 64 nt, hsa
cacacacacacaccaggcguguuugaguccacaguucugaaacauguggcuaccuugucuuuca

SEQ ID NO: 102164 - RNA, 64 nt, hsa
cuugauuuauguauuuuauguccagauucgccauuucugaaauccagauccaacacaagcaguc

SEQ ID NO: 102165 - RNA, 64 nt, hsa
uggcaaaguauccaucuugucuaucucccggcacuucugaaauauauugcuaccauuguauaac

SEQ ID NO: 102166 - RNA, 64 nt, hsa
uguuggauuagcuuaaucaccaaguccugucaacuucugaaaugaaucucaaauuucuucccuu

SEQ ID NO: 102167 - RNA, 64 nt, hsa
ugguucagucuuuauacugccucuugaguaaucuuucugaaauuuaaacuugauauuuuucgcc

SEQ ID NO: 102168 - RNA, 64 nt, hsa
ccucagauagaaggaccuuuaugaucuggccauauucugaaauagcuucaauccucuccucauc

SEQ ID NO: 102169 - RNA, 64 nt, hsa
ugacauguagcuucuucugaaagaauuauuugccuucugaaaugugacccccaaguccuauccu

SEQ ID NO: 102170 - RNA, 64 nt, hsa
aauacuacccauagaaaacuugacauguagcuucuucugaaagaauuauuugccuucugaaaug

SEQ ID NO: 102171 - RNA, 64 nt, hsa
agaacuuuagaaaaugccgacuucuuccaucuauuucugaaagguucuuuguggauuuauauag

SEQ ID NO: 102172 - RNA, 64 nt, hsa
agcacaaggaacaguuugauacacuuuuaaaagguucugaaaacaaagcuguauagggauccuc

SEQ ID NO: 102173 - RNA, 64 nt, hsa
auucaggugguuuauuaauuacauuuaaaaaguuuucugaaaaaacuuuugcaauaaaaaaaaa

SEQ ID NO: 102174 - RNA, 64 nt, hsa
auagugaaugguaagacuagugcaaaacaguuauuucugaaaauuaaagaccauuauugcuacc

SEQ ID NO: 102175 - RNA, 64 nt, hsa
aacauuauuugccuaaaauuagcauugugaugcuuucugaaagaaauauuuuauaaauccuguu

SEQ ID NO: 102176 - RNA, 64 nt, hsa
uagugugguuguugauaccuugcaauaguauugcuucugaaaguaauaaaaaauuuuaggagaa

SEQ ID NO: 102177 - RNA, 64 nt, hsa
uuuuuucccaaaaagaggaguaacaaaaugucauuucugaaagaggcuuacuuuauaccaacua

SEQ ID NO: 102178 - RNA, 64 nt, hsa
cugcauauuuccaucuugaauuggugguucuaaauucugaaacuguaguugagauacagcuauu

SEQ ID NO: 102179 - RNA, 64 nt, hsa
ugaguuuaauucagauuaccuaauuuuaaaauguuucugaaaagugaacagaguuaccuuacag

SEQ ID NO: 102180 - RNA, 64 nt, hsa
guacuuccauugaaauacucuuuccauuaaaauauucugaaacaauauaguaauaauggaauug

SEQ ID NO: 102181 - RNA, 64 nt, hsa
cuuuuaaguguuagcaauaguucaaaaaauuaaguucugaaaauugaaaaaauuaaaauguaaa

SEQ ID NO: 102182 - RNA, 64 nt, hsa
aagcagaaucaugagucuucuauuuuugucccauuucugaaaauuaucaagauaacuaguaaaa

SEQ ID NO: 102183 - RNA, 64 nt, hsa
gucccuauuacaggauauguugcaguccccaucuuucugaaaauaacccuuaacguauccaaca

SEQ ID NO: 102184 - RNA, 64 nt, hsa
aaacaaguguuuuaaaagaugaguuuuuccuacauucugaaaagcaaacaugaaaaacugaaca

SEQ ID NO: 102185 - RNA, 64 nt, hsa
ucuaaguuuugaugugugggcuucugaguuuauauucugaaaggaaauacacuucuuuugaaca

SEQ ID NO: 102186 - RNA, 64 nt, hsa
uaacagaaauuaauuuaacugacaugcauauugauucugaaauuuuuuuccuaaguuuuuuuca

SEQ ID NO: 102187 - RNA, 64 nt, hsa
cucccaagagcucaaaagcagaaauggccaggccuucugaaaacuuaaguccagaauugucaca

SEQ ID NO: 102188 - RNA, 64 nt, hsa
aguuguggccuccuuggauucuucugacuuuggcuucugaaaggaaggccuagauccagcccug

SEQ ID NO: 102189 - RNA, 64 nt, hsa
aacuaaaaggcgcuucauguccaguguguggcccuucugaaacuuauggucaucucucccacug

SEQ ID NO: 102190 - RNA, 64 nt, hsa
agcugaauaaaugugucuaaaacagacucuuguauucugaaaguacagucuacaacugauaaaa

SEQ ID NO: 102191 - RNA, 64 nt, hsa
cucuaauggcauuugaacauguaaucaccagagauucugaaaugacugguuuauguuaagcuau

SEQ ID NO: 102192 - RNA, 64 nt, hsa
aggcugcaugagacaucuuucugaaaaugguaacuucugaaacagcaaagcuuccuguguuuca

SEQ ID NO: 102193 - RNA, 64 nt, hsa
gauuugugacaagccaaggcugcaugagacaucuuucugaaaaugguaacuucugaaacagcaa

SEQ ID NO: 102194 - RNA, 64 nt, hsa
agugaucucccugaacauuuuuaagguuuuacuuuucugaaauuauacaucacagcagugcaua

SEQ ID NO: 102195 - RNA, 64 nt, hsa
cggacaagacuacccuuguuuuauguuuucaguauucugaaaauaccaguguguggcaguucuc

SEQ ID NO: 102196 - RNA, 64 nt, hsa
aaucuagaaacaugaaauuaguauuccaaagagauucugaaauuucuuuucuuggggaaaugac

SEQ ID NO: 102197 - RNA, 64 nt, hsa
uuuuuaguaaaagaaagugaggaaaaggaagugcuucugaaaacaaaccuuucuggacggcaga

SEQ ID NO: 102198 - RNA, 64 nt, hsa
ucauuuggggaaaaguggugguuauuagggcuuuuucugaaauguguaucuauguaacaucacu

SEQ ID NO: 102199 - RNA, 64 nt, hsa
augcuuuagaacaaacccuuuuugaucuuaaugcuucugaaaacuaggucugacucuggggauu

SEQ ID NO: 102200 - RNA, 64 nt, hsa
cuggaagaugagauuguaggugauauuuauuuucuucugaaacuuuuguauaguuugcaaauuu

SEQ ID NO: 102201 - RNA, 64 nt, hsa
aagggcuauucuuucuuucacgugcaaaacauuuuucugaaauagcaaacaaccuacauguuug

SEQ ID NO: 102202 - RNA, 64 nt, hsa
caggcagggagaucuuaauaccuaauuucaucauuucugaaaauguacuguuuuagaauguauu

SEQ ID NO: 102203 - RNA, 64 nt, hsa
gacuugugucuuguaucauuuuccagugccaggguucugaaauucauucagaaccuguuagauu

SEQ ID NO: 102204 - RNA, 64 nt, hsa
aauaauuaaaagagggauuaucacuaucugauacuucugaaagaaacacuuacaaaauuucuua

SEQ ID NO: 102205 - RNA, 64 nt, hsa
uuuauuuuuaugucaucaccucccuugccuuuguuucugaaaauuuugucugcuaaaaaguuuc

SEQ ID NO: 102206 - RNA, 64 nt, hsa
cuguaaucuuuuuugacucuuaaaagaaauucauuucugaaaugcuugguuggaagacugugac

SEQ ID NO: 102207 - RNA, 64 nt, hsa
gaguuggaggaggcuguucucagcccuuucccuuuucugaaagcuguuccuggccgggcauccc

SEQ ID NO: 102208 - RNA, 64 nt, hsa
cgguuugcagagaauguuagccaugacuugggcuuucugaaaguuggcuauaauuucucuaucc

SEQ ID NO: 102209 - RNA, 64 nt, hsa
cucaaagucuaacauauucaaugcaaguaagacuuucugaaaacacuugaugauguggaaaugc

SEQ ID NO: 102210 - RNA, 64 nt, hsa
ugcacuugcagaagaaagaaaaaaauucaaaccacauguuuauuuuuuuuuugccuaccucauu

SEQ ID NO: 102211 - RNA, 64 nt, hsa
aguuagaauuaaauuccugcuuguaauuuauauccauguuuaggcuuuucauaagaugaaacau

SEQ ID NO: 102212 - RNA, 64 nt, hsa
uugugauguuuuguucaaaguuguaguucuugugcauguuuacuuuauuagaguaggaaggcua

SEQ ID NO: 102213 - RNA, 64 nt, hsa
ugcuaucuauggcccugcaaaaauauaaccauuacauguuuaaauuguaaauuuuagagcauac

SEQ ID NO: 102214 - RNA, 64 nt, hsa
uuauaguagccucaagaagucuauugauauuggucauguuuauuucuugccauauuuauaacac

SEQ ID NO: 102215 - RNA, 64 nt, hsa
cagaaguuuuuuguuguuguuguuguuguuuuaacauguuuaaccaacagaaguuauuuacaga

SEQ ID NO: 102216 - RNA, 64 nt, hsa
uuuuaggucuugcauaucaguuuuauuacugcaccauguuuacuucaaaaagacaaaacaaaaa

SEQ ID NO: 102217 - RNA, 64 nt, hsa
agguuaucagcucuuuaagagcucuauuaauugccauguuuacaaacaaacacaaagagagaag

SEQ ID NO: 102218 - RNA, 64 nt, hsa
uuugcuuuauucgaaaagaggcuuuuaaaaugugcauguuuagaaacaaaauuucuucauggaa

SEQ ID NO: 102219 - RNA, 64 nt, hsa
gcacuagucuuaaauuguauaaaauauccccuaacauguuuaaauguccauuuuuauucauuau

SEQ ID NO: 102220 - RNA, 64 nt, hsa
aucuucuacauccuaggcauuguccuaggcauugcauguuuauauccccaauucucaccacaac

SEQ ID NO: 102221 - RNA, 64 nt, hsa
aaaauaauuaugagaagcaaauaaaaucaaaagucauguuuaaagacguguuuuuaaaauucca

SEQ ID NO: 102222 - RNA, 64 nt, hsa
aaacacucauuaaaagaaccccagaggucaccaacauguuuauaucuugacuugacuuuuuuau

SEQ ID NO: 102223 - RNA, 64 nt, hsa
acgcaggaacucccagcaacacaagcuggaagcacauguuuauuuauucugcauuuuauucugg

SEQ ID NO: 102224 - RNA, 64 nt, hsa
ggggcccacagggaacccugcuugcacuuuguaacauguuuacuuuucagggcaucuuagcuuc

SEQ ID NO: 102225 - RNA, 64 nt, hsa
cugguuccuguuggugucuccacaaguagguaaacauguuuaaaggaacccggguucuuagauu

SEQ ID NO: 102226 - RNA, 64 nt, hsa
aaauccagaauuucagauaaucuaucuacuuaaacauguuuaaaguauguuuuguuuugcagac

SEQ ID NO: 102227 - RNA, 64 nt, hsa
uugauguuuugcauuacuucauuuauguuuacaucauguuuagaaauguuuucauuuacugugg

SEQ ID NO: 102228 - RNA, 64 nt, hsa
uuauaaaacuaguuacauuauaaacgguuucaaacauguuuaauuuacauuagguuuuuaugua

SEQ ID NO: 102229 - RNA, 64 nt, hsa
uuuuaugauuguuauguguauuauguaauacguacauguuuauggcaauuuaacauguguauuc

SEQ ID NO: 102230 - RNA, 64 nt, hsa
aaaauaaaauaauuauaaauaucauuguacauagcauguuuauaucugcaaaaaaccuaauagc

SEQ ID NO: 102231 - RNA, 64 nt, hsa
aaaauccuuaacaccucaugguguuauucuucaccauguuuauauauauauauauauauuuuuu

SEQ ID NO: 102232 - RNA, 64 nt, hsa
ugauggggcaugcugagaaauagagaaaagagaccauguuuauuuggguaggaggaagccuugc

SEQ ID NO: 102233 - RNA, 64 nt, hsa
uaaguuaguguugcuuguuuuuguuuuguucucccauguuuaguugcaauuacuggcucucaag

SEQ ID NO: 102234 - RNA, 64 nt, hsa
gaaagcuucgguggaaggucacuauuucugacugcauguuuacuuaaucagguugcugcaugca

SEQ ID NO: 102235 - RNA, 64 nt, hsa
acccuagugacgucacagaccugagaugaagauucauguuuagccaguguuuuccagccuugua

SEQ ID NO: 102236 - RNA, 64 nt, hsa
aagguuucgaaauguaaauauuccuuauuuaagacauguuuaaauucaccuacuagcacgacuu

SEQ ID NO: 102237 - RNA, 64 nt, hsa
ucuuugaaaaccagugugugacucacuguagagccauguuuacuguuugacuguguggcacagg

SEQ ID NO: 102238 - RNA, 64 nt, hsa
ccagccagaagucccuuccaaauauaagaguacucauguuuauuuauuuccaacugagcagcaa

SEQ ID NO: 102239 - RNA, 64 nt, hsa
ugaaucagcuacaaagguaauauuguauuaaaaucauguuuaagauagcugcuuuuauguguau

SEQ ID NO: 102240 - RNA, 64 nt, hsa
augaauuugguugguuuugguguuguacagcucacauguuuacacacucagugcccuaauuucc

SEQ ID NO: 102241 - RNA, 64 nt, hsa
cacaaggacccuucagguguuacuagaaggcguccauguuuauuguuuuuuaaagaauguuugg

SEQ ID NO: 102242 - RNA, 64 nt, hsa
uauuuuugauguauauaucuauuauucaaaaaaucauguuuauuuugaguccuaggacuuaaaa

SEQ ID NO: 102243 - RNA, 64 nt, hsa
aauuccaggguaaggaggaagaugccuguucucccugucugaagagggagaugagacagcucuc

SEQ ID NO: 102244 - RNA, 64 nt, hsa
ugacuuuagaggcaugggcuccaaccccuuagcucugucugagaauuaugguuuuacugcuacg

SEQ ID NO: 102245 - RNA, 64 nt, hsa
gguuggaaaguaggggaaauugaaguuguagucacugucugagaauggcuaugaagcgucauuu

SEQ ID NO: 102246 - RNA, 64 nt, hsa
agucuggauucggauguauaaggugugccuuguacugucugauuuacuacacagagaaacuuuu

SEQ ID NO: 102247 - RNA, 64 nt, hsa
ucacucucaauucacuggcaaaugccugaauggucugucugaaggaagcaacagagaagugggg

SEQ ID NO: 102248 - RNA, 64 nt, hsa
auacacuugugacugaaccaugcccaguuuaugccugucugacugucacucuggcacuaggagg

SEQ ID NO: 102249 - RNA, 64 nt, hsa
ugaaauuuucaccucuugggguauuuuaauuguacugucugaacccagggaucacaaauucugu

SEQ ID NO: 102250 - RNA, 64 nt, hsa
aaacaauuuagucugaaacacaauugugcugaaucugucugacuauaacucugaccacacagaa

SEQ ID NO: 102251 - RNA, 64 nt, hsa
uguauagaucccagauccaucccaugauuuguuccugucugaggcauagaggcaggcaagccgu

SEQ ID NO: 102252 - RNA, 64 nt, hsa
gaaacugagcugagcccaguauccaaggauuccucugucugauccuuuggucuuugcuaccagg

SEQ ID NO: 102253 - RNA, 64 nt, hsa
auaacaaaugacaaauuauauaucaugaauccuucugucugacuaacucaauaacuuucuauaa

SEQ ID NO: 102254 - RNA, 64 nt, hsa
cuaaacuuuaggcuaauaaucuuuacuauugaaucugucugauauagaucuuaggguugaagaa

SEQ ID NO: 102255 - RNA, 64 nt, hsa
aggucugggacgugugugugacucuuaacaauugcugucugaaaaugagagagaagacuucgga

SEQ ID NO: 102256 - RNA, 64 nt, hsa
cccauuuggaauauagaauuaggaugggaaaacacugucugauucugcacacaaaaguggguuu

SEQ ID NO: 102257 - RNA, 64 nt, hsa
gaugcucacaguuuuauuuuacuuuaaaauaaaccugucugacuguagcuuugugaaauaucuu

SEQ ID NO: 102258 - RNA, 64 nt, hsa
ucgaaugcugcauuuuuauaaacaaaauuacagacugucugaaauugaagaagaaugaacuaau

SEQ ID NO: 102259 - RNA, 64 nt, hsa
uuucagugguaguggggaaaccugaauuugucagcaugauuauuuguaacucagauuguucaaa

SEQ ID NO: 102260 - RNA, 64 nt, hsa
aaccaugauaaauuuaaaaacaacagaaauguggcaugauuacuuauuuauuuguuccagguga

SEQ ID NO: 102261 - RNA, 64 nt, hsa
gcauuugcguuuauugagagagaggaugugccaucaugauuaaugaaaacuaucuuuugaguuu

SEQ ID NO: 102262 - RNA, 64 nt, hsa
gauuuuggucaccaaugaguacccgacccguugccaugauuaagagagaaugcuuucuauugga

SEQ ID NO: 102263 - RNA, 64 nt, hsa
guaugagguaaggaucuaauucuguuuccucucacaugauuacuugauagcuaagcaucugauu

SEQ ID NO: 102264 - RNA, 64 nt, hsa
ggacucauaaucugaagacucacagaauggaaaccaugauuauaacaagaccacaugguauaac

SEQ ID NO: 102265 - RNA, 64 nt, hsa
gugauccuuacuggguuuccaagcagaggagucacaugauuacaauugccaguagaguuguugu

SEQ ID NO: 102266 - RNA, 64 nt, hsa
uuuuucucugagggcuggggguugggggagucagcaugauuauauuuuaauguagaaaauguga

SEQ ID NO: 102267 - RNA, 64 nt, hsa
agaauuuucucuagacuauuaggcuagacagucucaugauuauacuaaccaaaccuggaguaaa

SEQ ID NO: 102268 - RNA, 64 nt, hsa
aagucaguauguccacuuaaagcacauaaaagggcaugauuaugaauguuagaaucaauuugcu

SEQ ID NO: 102269 - RNA, 64 nt, hsa; identical to SEQ ID NO: 93680

SEQ ID NO: 102270 - RNA, 64 nt, hsa; identical to SEQ ID NO: 93681

SEQ ID NO: 102271 - RNA, 64 nt, hsa; identical to SEQ ID NO: 93682

SEQ ID NO: 102272 - RNA, 64 nt, hsa; identical to SEQ ID NO: 93683

SEQ ID NO: 102273 - RNA, 64 nt, hsa; identical to SEQ ID NO: 93684

SEQ ID NO: 102274 - RNA, 64 nt, hsa; identical to SEQ ID NO: 93685

SEQ ID NO: 102275 - RNA, 64 nt, hsa; identical to SEQ ID NO: 93686

SEQ ID NO: 102276 - RNA, 64 nt, hsa; identical to SEQ ID NO: 93687

SEQ ID NO: 102277 - RNA, 64 nt, hsa
ggaaggugagucuacuuucccugaggcuuuggggucagaguauauguuguuuggagaaagaggg

SEQ ID NO: 102278 - RNA, 64 nt, hsa
ggcucuuccuacaaccuugagaaguagauaggcaucagaguaugguacuauaggaaucagaaaa

SEQ ID NO: 102279 - RNA, 64 nt, hsa
cuuuucugaaacuccuugcuguaaggcagcuuucucagaguacuauauauuuucaacaguaaag

SEQ ID NO: 102280 - RNA, 64 nt, hsa
cuggauaaagcaauuccccuuaggaaacauagccucagaguauuucauauaaauuuucucuauc

SEQ ID NO: 102281 - RNA, 56 nt, hsa
cauuuuuuuccuccugguaguaaaugucagaguaagagaaacaaacuguuuagaau

SEQ ID NO: 102282 - RNA, 64 nt, hsa
ucuuacaugggaucaaauacuugagauuaguacuucagaguacuggccuuguucaauuuaguac

SEQ ID NO: 102283 - RNA, 64 nt, hsa
aguacaguugagauaguuaagauauaaccacaagucagaguacauugguuguauuuuguaaacu

SEQ ID NO: 102284 - RNA, 64 nt, hsa
uagaauaaugcuaaaaaauaaugccuauaaaucuucagaguauaaagacauccauucagaaaca

SEQ ID NO: 102285 - RNA, 64 nt, hsa
acacauuacccuaaccagccagcaguaacagauuucagaguaagauaaagcagauucugucuuc

SEQ ID NO: 102286 - RNA, 64 nt, hsa
gauagauaaaagugugauuaaucaaaugauaugaucagaguaaagaauuuugccauuuugaucc

SEQ ID NO: 102287 - RNA, 64 nt, hsa
cagugggauucuggugcugaugaauagguugccuucagaguauuauugacagacagcuugugga

SEQ ID NO: 102288 - RNA, 64 nt, hsa
agugaacaaguuuuuggcagagguauauuuacauucagaguacacuuuucuuuggaaaaaauua

SEQ ID NO: 102289 - RNA, 64 nt, hsa
acugauaauauugagugaugcaugagguagguguucagaguaauauucugcauuauagugaaaa

SEQ ID NO: 102290 - RNA, 64 nt, hsa
guuagaaaaugugaucuggcaguuuaugcauucuucagaguaauguaauaauaccuaugugaug

SEQ ID NO: 102291 - RNA, 64 nt, hsa
caauuugcucuuauaaagagacauuuucauagguucagaguaacucaccuccaugggcugacca

SEQ ID NO: 102292 - RNA, 64 nt, hsa
auaguacacacuucagaguaagacaaaugcaaagcaucuuaaggagugaaaauagaguguaaau

SEQ ID NO: 102293 - RNA, 64 nt, hsa
uccucugcuuuaugaaguuugaguuguauuugugcaucuuaaaguagguugaggcuugaggcug

SEQ ID NO: 102294 - RNA, 64 nt, hsa
aacuguuaaauauaaaaaaauucaaaguauuugacaucuuaagcaaauauccagaauauuuuua

SEQ ID NO: 102295 - RNA, 64 nt, hsa
aagcaaauauccagaauauuuuuaaguaaaaaaccaucuuaaguauucaaaauuuccuugguuu

SEQ ID NO: 102296 - RNA, 64 nt, hsa
aauagcugagugcaguccuugcucauauuuccuucaucuuaaccccgcaaacaagaauuaagau

SEQ ID NO: 102297 - RNA, 64 nt, hsa
uugcuuuuuaaaaugucagcaagaaggccugccucaucuuaacaaagcaaaaaaaaaugcuuua

SEQ ID NO: 102298 - RNA, 64 nt, hsa
agcauauaaaaagccuguauauuuuuuaaaaacacaucuuaacuccacgcuuuacgauauuaua

SEQ ID NO: 102299 - RNA, 64 nt, hsa
uaaacuuuugaagaucuuaaguguauugcucuuucaucuuaaacacuuucgaggauuugcagug

SEQ ID NO: 102300 - RNA, 64 nt, hsa
cagauccaagguaacuggguaggaaaucuuuugacaucuuaacucauguugaguuugugcugug

SEQ ID NO: 102301 - RNA, 64 nt, hsa
aucagguaaacugucacuuaaauggagguguccacaucuuaauuguuucuccuugacacauuuc

SEQ ID NO: 102302 - RNA, 64 nt, hsa
gagaacuaauggcuauuuuugaggacaaaaauuacaucuuaagcuaauuccuuaaauacauaca

SEQ ID NO: 102303 - RNA, 64 nt, hsa
cuauuuugagaaauauaaauacauagaaauggugcaucuuaacauuuguuuguacauguauaaa

SEQ ID NO: 102304 - RNA, 64 nt, hsa
ugcacauuuggggguauaucuauuucugaagagguaagcugaucaaaauaaauagaguguaaau

SEQ ID NO: 102305 - RNA, 64 nt, hsa
uuuugaauacacccacauuuuguacguuuccauguaagcugacauaguguucugccauguaaug

SEQ ID NO: 102306 - RNA, 64 nt, hsa
uuccugcagaggaguagugucagccaccuuguacuaagcugaaacaugucccucuggagcuucc

SEQ ID NO: 102307 - RNA, 64 nt, hsa
aaaacaaaucuaagggaaaggaauauuaugggauuaagcugagcaagcaauucugguggaaagu

SEQ ID NO: 102308 - RNA, 64 nt, hsa; identical to SEQ ID NO: 45025

SEQ ID NO: 102309 - RNA, 64 nt, hsa; identical to SEQ ID NO: 45026

SEQ ID NO: 102310 - RNA, 64 nt, hsa; identical to SEQ ID NO: 45027

SEQ ID NO: 102311 - RNA, 64 nt, hsa; identical to SEQ ID NO: 45028

SEQ ID NO: 102312 - RNA, 64 nt, hsa; identical to SEQ ID NO: 45029

SEQ ID NO: 102313 - RNA, 64 nt, hsa; identical to SEQ ID NO: 45030

SEQ ID NO: 102314 - RNA, 64 nt, hsa; identical to SEQ ID NO: 45031

SEQ ID NO: 102315 - RNA, 64 nt, hsa; identical to SEQ ID NO: 45032

SEQ ID NO: 102316 - RNA, 64 nt, hsa; identical to SEQ ID NO: 45033

SEQ ID NO: 102317 - RNA, 64 nt, hsa; identical to SEQ ID NO: 45034

SEQ ID NO: 102318 - RNA, 64 nt, hsa; identical to SEQ ID NO: 45035

SEQ ID NO: 102319 - RNA, 64 nt, hsa; identical to SEQ ID NO: 45036

SEQ ID NO: 102320 - RNA, 64 nt, hsa; identical to SEQ ID NO: 45037

SEQ ID NO: 102321 - RNA, 64 nt, hsa; identical to SEQ ID NO: 45038

SEQ ID NO: 102322 - RNA, 64 nt, hsa; identical to SEQ ID NO: 45039

SEQ ID NO: 102323 - RNA, 64 nt, hsa; identical to SEQ ID NO: 45040

SEQ ID NO: 102324 - RNA, 64 nt, hsa; identical to SEQ ID NO: 45041

SEQ ID NO: 102325 - RNA, 64 nt, hsa; identical to SEQ ID NO: 45042

SEQ ID NO: 102326 - RNA, 64 nt, hsa; identical to SEQ ID NO: 45043

SEQ ID NO: 102327 - RNA, 64 nt, hsa; identical to SEQ ID NO: 45044

SEQ ID NO: 102328 - RNA, 64 nt, hsa; identical to SEQ ID NO: 45045

SEQ ID NO: 102329 - RNA, 64 nt, hsa; identical to SEQ ID NO: 45046

SEQ ID NO: 102330 - RNA, 64 nt, hsa; identical to SEQ ID NO: 45047

SEQ ID NO: 102331 - RNA, 64 nt, hsa; identical to SEQ ID NO: 45048

SEQ ID NO: 102332 - RNA, 64 nt, hsa; identical to SEQ ID NO: 45049

SEQ ID NO: 102333 - RNA, 64 nt, hsa; identical to SEQ ID NO: 45050

SEQ ID NO: 102334 - RNA, 64 nt, hsa; identical to SEQ ID NO: 45051

SEQ ID NO: 102335 - RNA, 64 nt, hsa; identical to SEQ ID NO: 45052

SEQ ID NO: 102336 - RNA, 64 nt, hsa; identical to SEQ ID NO: 45053

SEQ ID NO: 102337 - RNA, 64 nt, hsa; identical to SEQ ID NO: 45054

SEQ ID NO: 102338 - RNA, 64 nt, hsa; identical to SEQ ID NO: 45055

SEQ ID NO: 102339 - RNA, 64 nt, hsa; identical to SEQ ID NO: 45056

SEQ ID NO: 102340 - RNA, 64 nt, hsa; identical to SEQ ID NO: 45057

SEQ ID NO: 102341 - RNA, 64 nt, hsa; identical to SEQ ID NO: 45058

SEQ ID NO: 102342 - RNA, 64 nt, hsa; identical to SEQ ID NO: 45059

SEQ ID NO: 102343 - RNA, 64 nt, hsa; identical to SEQ ID NO: 45060

SEQ ID NO: 102344 - RNA, 64 nt, hsa; identical to SEQ ID NO: 45061

SEQ ID NO: 102345 - RNA, 64 nt, hsa; identical to SEQ ID NO: 45062

SEQ ID NO: 102346 - RNA, 64 nt, hsa; identical to SEQ ID NO: 45063

SEQ ID NO: 102347 - RNA, 64 nt, hsa; identical to SEQ ID NO: 45064

SEQ ID NO: 102348 - RNA, 64 nt, hsa; identical to SEQ ID NO: 45065

SEQ ID NO: 102349 - RNA, 64 nt, hsa; identical to SEQ ID NO: 45066

SEQ ID NO: 102350 - RNA, 64 nt, hsa
auuccugugauaacuuaaaaggcucuuuuauguuaaaagagaggugaaucuucuuugacagacu

SEQ ID NO: 102351 - RNA, 64 nt, hsa
cacuguggaagcuaaaacacuucuacuagggccaaaaagagaaaagaaaagaaaauuucuacua

SEQ ID NO: 102352 - RNA, 64 nt, hsa
agaauauaugcuaacuguugaagauauuuuggguaaaagagauaauguugacaugauacucuau

SEQ ID NO: 102353 - RNA, 64 nt, hsa
caaggaaauuucaguggcucucugguuucuuaacaaaagagaaagcacagcacuuucugaucca

SEQ ID NO: 102354 - RNA, 64 nt, hsa
aaaagccaaauuuaaauuauaagaaagaagggaaaaaagagaaaaacucaagucuauuacuugu

SEQ ID NO: 102355 - RNA, 64 nt, hsa
acuccacacagguguuucaguagaguggggcaggaaaagagaucucuucgauuucuuucaggcc

SEQ ID NO: 102356 - RNA, 64 nt, hsa
aguguaugaauuugucacauguaucacccccaaaaaaagagaaaaagaaaaauagaagacauau

SEQ ID NO: 102357 - RNA, 64 nt, hsa
augucauuagugacaaagauuugcaacauuagagaaaagagacacaaauauaaaauuaaaaacu

SEQ ID NO: 102358 - RNA, 64 nt, hsa
aaaaucuucacugaauaucauauguaucuaaaugaaaagagaauuacuuauauucaucuauuuu

SEQ ID NO: 102359 - RNA, 64 nt, hsa
uaugggaguccacgauucucagguauugauugaaaaaagagaaaggggcaagaaauucauuaaa

SEQ ID NO: 102360 - RNA, 64 nt, hsa
acuggaauuguugaaucacacugcauagcugcccaaaagagaguguuuggucuugaacuuucua

SEQ ID NO: 102361 - RNA, 64 nt, hsa
aaccugcauugcacuaggaauucuguguuaguuuaaaagagaucucuaaaacuuccccaucccu

SEQ ID NO: 102362 - RNA, 64 nt, hsa
uagugcaaauuauuuguaugcuucaaaaaaaaaaaaaagagagaaacaaaaaagugugacauua

SEQ ID NO: 102363 - RNA, 64 nt, hsa
aacauguugcuguuuccaguuccguucugagagaaaaagagagagagagagaaaaagaccaugc

SEQ ID NO: 102364 - RNA, 64 nt, hsa
acccccucccuccccuaagaagauggauguccucaaaagagaaggaacaaaccuccuugggaau

SEQ ID NO: 102365 - RNA, 64 nt, hsa
ggggagagggaagugaauugcagaggggagggggaaaagagagagagagagagagagagagaga

SEQ ID NO: 102366 - RNA, 64 nt, hsa
uauuaaagagacugguagcucaucauccuaccauaaaagagaaaaaaauucggaaagugaucag

SEQ ID NO: 102367 - RNA, 64 nt, hsa
agucaaguguucaggccacacagucagcccaggaaaaagagaagcagggccaaauggaaagaac

SEQ ID NO: 102368 - RNA, 64 nt, hsa
acaaaagcacaaacaugggucaaaggaaaaucuuaaaagagaacacaccaaaaaagugaaagag

SEQ ID NO: 102369 - RNA, 64 nt, hsa
aggagauugaugacaagcaaguuacucaggaaucaaaagagaaaaaaguuucugaaaacaauga

SEQ ID NO: 102370 - RNA, 64 nt, hsa
uagugagauggccuggggaagcugugaaagaaccaaaagagaucacaauacucaaaagagagag

SEQ ID NO: 102371 - RNA, 64 nt, hsa
agcugugaaagaaccaaaagagaucacaauacucaaaagagagagagagagaaaaaagagagau

SEQ ID NO: 102372 - RNA, 64 nt, hsa
gagaucacaauacucaaaagagagagagagagaaaaaagagagaucuugauccacagaaauaca

SEQ ID NO: 102373 - RNA, 64 nt, hsa
agaagguugacuuuuugcacuucuguauauagucaaaagagagaaaccuguauaauaguaagau

SEQ ID NO: 102374 - RNA, 64 nt, hsa
uucaaaacuacugcauguuuaaaacuucaacaaaaaaagagagaaagaacuauacuaagaacau

SEQ ID NO: 102375 - RNA, 64 nt, hsa
uaauugaacuagauuacauaauaguauuucuagaaaaagagauauuuuuagauuguaugccacu

SEQ ID NO: 102376 - RNA, 64 nt, hsa
guccugccagaaagagaaugaaugacagaaaaaaaaaagagagacaaacucuaggaacaaugcc

SEQ ID NO: 102377 - RNA, 64 nt, hsa
aaagcaguuuacucaucaauugaaaaguccuccaaaaagagaacuauugggaaaccauggugug

SEQ ID NO: 102378 - RNA, 64 nt, hsa
aaaugaacuuucuugcacuugcuugucgccaaauaaaagagaggcccauugauuccucccccac

SEQ ID NO: 102379 - RNA, 64 nt, hsa
gauaucaaaacaucucuaagauacaguauuuaguaaaagagaaaguuucaggaaauaaaacuac

SEQ ID NO: 102380 - RNA, 64 nt, hsa
aggauuuuuuuuuuuuaaguaagaagggaacuguaaaagagaaaaaaagaaauucaugcauagc

SEQ ID NO: 102381 - RNA, 64 nt, hsa
uaaucauuggucuuuucaaaacuagguguuuaaaaaaagagacauauaugauauugcuguuaua

SEQ ID NO: 102382 - RNA, 64 nt, hsa
cagucaauauuugacaauguggaauuaccaaauuaaaagagaauacuaugaauguauucauauu

SEQ ID NO: 102383 - RNA, 64 nt, hsa
aacucauaaaacaaaagccuuguaagcauuuauuaaaagagauuauuaaaagagauugaaagac

SEQ ID NO: 102384 - RNA, 64 nt, hsa
aaagccuuguaagcauuuauuaaaagagauuauuaaaagagauugaaagacaugcauucaauaa

SEQ ID NO: 102385 - RNA, 64 nt, hsa
aaaacuucucgaaccgcugugucuccuacguaaaaaaagagauguacaaaucaauaauaauuac

SEQ ID NO: 102386 - RNA, 64 nt, hsa
cagccuaggcaacagagugagacuuugucucaaaaaaagagaaauuuuccuuaauaagaaaagu

SEQ ID NO: 102387 - RNA, 64 nt, hsa
auucuauagguuaauuuucaaagcagaguauuacaaaagagaaguuagaauuacagcuacugac

SEQ ID NO: 102388 - RNA, 64 nt, hsa
uuuguuuguuuuagaaaaguuacaguaaaaauuaaaaagagauaccaaugguuuacacuuuaac

SEQ ID NO: 102389 - RNA, 64 nt, hsa
aauguccauucugcagcguuucucuuucccuuggaaaagagaauuuaucauuacuguuacauuu

SEQ ID NO: 102390 - RNA, 64 nt, hsa
ggguggucccugcccuuaccagagcugaaaaugaaaaagagaacagcagcuuucuagggacagc

SEQ ID NO: 102391 - RNA, 64 nt, hsa
uucaaauagaaaaacaacaaaacccaugaaauggaaaagagaguuccaaaaaagaagaccuguu

SEQ ID NO: 102392 - RNA, 64 nt, hsa
gagaggaguaaaguguuuagauucugaaccugagaaaagagaacuuucucuuaagaaguuggaa

SEQ ID NO: 102393 - RNA, 64 nt, hsa
uuucgcuguuuguuguuucauagauuuauuuaaaaaaagagaaagucuauagcuauaaaucuuu

SEQ ID NO: 102394 - RNA, 64 nt, hsa
agaaauaugaauacaauuccccuaaacucuccucaaaagagaauucagucuacagccauuuaaa

SEQ ID NO: 102395 - RNA, 64 nt, hsa
uaaucuacuuuugcuaagaugcauuuaauaaaaaaaaagagagagagagagaggugugagggac

SEQ ID NO: 102396 - RNA, 64 nt, hsa
agugccuucauacacuguaccccagcucucuucuaaaagagaagugggugggcacacugaacug

SEQ ID NO: 102397 - RNA, 64 nt, hsa
ugaaugcagacagaaauaaauuaguguccuuaccaaaagagaucggcgggugcugcagccucac

SEQ ID NO: 102398 - RNA, 64 nt, hsa
ccauuuguaaaauaaaauagagcagaaaaacacaaaaagagaacacugguucagacauucagug

SEQ ID NO: 102399 - RNA, 64 nt, hsa
uguuucuguugauuucuuuuuuguaugcugugauaaaagagaaaugaaaagugccagucacugu

SEQ ID NO: 102400 - RNA, 64 nt, hsa
cagaguugauuaagaaaaaugaagaaaaaacgcaaaaagagaacacauguagaaggugguggau

SEQ ID NO: 102401 - RNA, 64 nt, hsa
aaaacugcacaaauuuuuaugggacaaagccuagaaaagagaaauguaguuugaaucauaaucu

SEQ ID NO: 102402 - RNA, 64 nt, hsa
agggagggaaacagggagaaagggaaaaagaagaaaaagagaaagaugaaaauaggaacaaaua

SEQ ID NO: 102403 - RNA, 64 nt, hsa
acgugaccucccggggacaguggcugugcuuuuaaaaagagaugcuugcaaagcaauggggaac

SEQ ID NO: 102404 - RNA, 64 nt, hsa
cagcuauauacucugcuuggugcauaagaaagagaaaagagaugccuuuuguguuuugaguaag

SEQ ID NO: 102405 - RNA, 64 nt, hsa
ugaucuagaacugguccagccgacgaagaguaggaaaagagaagggcugcucagggaaacauug

SEQ ID NO: 102406 - RNA, 64 nt, hsa
uuucagccugagcgacagagugaaacugucucaaaaaagagagacuuccgggacagucauuauc

SEQ ID NO: 102407 - RNA, 64 nt, hsa
uauuggacuaaagucuguugguuagugcuguuguaaaagagaccucuggggccgaguguggugg

SEQ ID NO: 102408 - RNA, 64 nt, hsa
gcagcagagcgagacuccgucucaaacagaaaaaaaaagagaauuuugaaucuccuuucccaaa

SEQ ID NO: 102409 - RNA, 64 nt, hsa
aaaauugaaauaaagcuacugggccuccucucauaaaagagacaguuguuggcaagguagcaau

SEQ ID NO: 102410 - RNA, 64 nt, hsa
gguuaauuucauguaaaacagaaaaaaagagugaaaaagagaauauacaugaagaauagaaaca

SEQ ID NO: 102411 - RNA, 64 nt, hsa
agccagacuugagaggugacaauuaaagaucuaaaaaagagaggagauucccccaaacaacaau

SEQ ID NO: 102412 - RNA, 64 nt, hsa
uuugcauuuuuuuguuugcauauuaaaaaaagagaaaagagaaagcaagagacagaaaucagga

SEQ ID NO: 102413 - RNA, 64 nt, hsa
uuucauuuuugcauuuuuuuguuugcauauuaaaaaaagagaaaagagaaagcaagagacagaa

SEQ ID NO: 102414 - RNA, 64 nt, hsa
guaccaucucccccgccaauaaaaaagagaagaaaaaagagaaacccguggcacuauguaaaua

SEQ ID NO: 102415 - RNA, 64 nt, hsa
uaacaaguuauaguaccaucucccccgccaauaaaaaagagaagaaaaaagagaaacccguggc

SEQ ID NO: 102416 - RNA, 64 nt, hsa
caagagggaaggugauugguagugaguuaaaagaaaaagagaggaaaagagaguaguuuugucu

SEQ ID NO: 102417 - RNA, 64 nt, hsa
ggugauugguagugaguuaaaagaaaaagagaggaaaagagaguaguuuugucuucaaguaaaa

SEQ ID NO: 102418 - RNA, 64 nt, hsa
cucuccccugcgagcccuuuuuauuugagaaggaaaaagagaaaagagaaucguuuaagggaac

SEQ ID NO: 102419 - RNA, 64 nt, hsa
cugcgagcccuuuuuauuugagaaggaaaaagagaaaagagaaucguuuaagggaacccggcgc

SEQ ID NO: 102420 - RNA, 64 nt, hsa
aauaaaugugcccccaaguuguuaauguuauauuaaaagagaggguccuucaaaaaaauuauuu

SEQ ID NO: 102421 - RNA, 64 nt, hsa
cagccacaaguacuggaguagauaacaaggagggaaaagagagggcacugccucagggcuuaca

SEQ ID NO: 102422 - RNA, 64 nt, hsa
uagcuauuaguauauuuaaaaacuguucaaaagcaaaagagaaggaacaggaaugaaaggaaac

SEQ ID NO: 102423 - RNA, 64 nt, hsa
agaauuugcaaacuaccgucgcucagcaacaccaaaaagagaaagucugguuaaaacaccauga

SEQ ID NO: 102424 - RNA, 64 nt, hsa
uacuucucgggaaaggaucaucgccguugaaaugaaaagagagacagagagaaaaaaaaaaaga

SEQ ID NO: 102425 - RNA, 64 nt, hsa
cguugaaaugaaaagagagacagagagaaaaaaaaaaagagaacccacaugaagcucugaaacc

SEQ ID NO: 102426 - RNA, 64 nt, hsa
aaaguuaacucuuaguuuuuacuuguuuaauucuaaaagagaagggagcugaggccauucccug

SEQ ID NO: 102427 - RNA, 64 nt, hsa
gguggguuccagggacuguaccuguaggaaacagaaaagagaagaaagaagcacucugcuggcg

SEQ ID NO: 102428 - RNA, 64 nt, hsa
ggggaagccugagguagucaacccaggagccaagaaaagagaacuacgaggaacaggugcccgg

SEQ ID NO: 102429 - RNA, 64 nt, hsa
uaaaagggcaaaaaacaaucucaaaaagauuagaaaaagagaaggggggaagggaagagaaaau

SEQ ID NO: 102430 - RNA, 64 nt, hsa
caacauagcgugacccugucucuacaaaaaauuaaaaagagaacauacaaaguugacauaugag

SEQ ID NO: 102431 - RNA, 64 nt, hsa
accuaaagggaaccugcaauaaucuugaaaaagaaaaagagaaaaauuuuaaaauccugcuaua

SEQ ID NO: 102432 - RNA, 64 nt, hsa
agagaaaaauuuuaaaauccugcuauaggagaaaaaaagagaaaaaaauaaaaaucaaaaaaaa

SEQ ID NO: 102433 - RNA, 64 nt, hsa
uuucuucuucuucuuuuuuuuuuuuuauaaaagcaaaagagaaauacauaaaaaaguguuuacc

SEQ ID NO: 102434 - RNA, 64 nt, hsa
gugcaauacauuuuuuucucuuuccuugaaaauaaaaagagaaacaaguauuuugcuauauaua

SEQ ID NO: 102435 - RNA, 64 nt, hsa
uuuuggguuuuuuuuuuuuuuaauguuuccuaauaaaagagaagcugcauuuuauugguuuuua

SEQ ID NO: 102436 - RNA, 64 nt, hsa
ggcagccccucaccccagaccccccuucuaaggaaaaagagagguucagagcguuggaccuuca

SEQ ID NO: 102437 - RNA, 64 nt, hsa
guaacuccauuugcuacaggacaggcccuugccuaaaagagaagguaucuagaaaugccuuuaa

SEQ ID NO: 102438 - RNA, 64 nt, hsa
auuuuucaucuuuuugcugucaauuuguuuccagaaaagagacuuuucccucucuugauaggau

SEQ ID NO: 102439 - RNA, 64 nt, hsa
acacagugagaccccuucucaaaaaaaaaaaaaaaaaagagagagugugugauuagaagcuaaa

SEQ ID NO: 102440 - RNA, 64 nt, hsa
aauauaagggaaaaauaugagaaaaauaaaaauaaaaagagaauaauaggccaggcacuguggc

SEQ ID NO: 102441 - RNA, 64 nt, hsa
cucugauaaaacagaauuuaaaccaacaaagaucaaaagagacaaggccauuauauaaugguaa

SEQ ID NO: 102442 - RNA, 64 nt, hsa
caaaauugauagaccgcuagcaagacuaaugaagaaaagagagaagaaucaaauagaugcaaua

SEQ ID NO: 102443 - RNA, 64 nt, hsa
uccuguuaccaaagcugggcagagacaaaaccaaaaaagagaauuuuagaccaauauccuugau

SEQ ID NO: 102444 - RNA, 64 nt, hsa
cuuuccuaaagcuccucugcacauagaggggagaaaaagagaauuuaggcaacuccacuccccc

SEQ ID NO: 102445 - RNA, 64 nt, hsa
cccuucacccccaacccuguauucuacucucccgaaaagagaagagaaucgcaugaguagcaag

SEQ ID NO: 102446 - RNA, 64 nt, hsa
cuccuaucccucugccccuacugcucagcaauguaaaagagacaaauaaggagaaagaaaaucu

SEQ ID NO: 102447 - RNA, 64 nt, hsa
gcugugagcucaaacaaaaacugcagacaaacaaaaaagagaaaagcuuuuauuuguguuuuca

SEQ ID NO: 102448 - RNA, 64 nt, hsa
aaaaauacaaaaauuagccggguguggugguggguaccgcuacuugggaggcugaggcaggaga

SEQ ID NO: 102449 - RNA, 64 nt, hsa
aguauucuguguuaaaaauguucuauuuuaauuauaccgcuaucauuccaaaggaggauggcau

SEQ ID NO: 102450 - RNA, 64 nt, hsa
agacacuuuuuaaaguuuuuguuuuuguuucaauuaccgcuagauuuuuuuuucucuuuuuuua

SEQ ID NO: 102451 - RNA, 64 nt, hsa
uucuggggcugggccugagccuaacucccuccacuaccgcuauuucuccuuggauggcaccauc

SEQ ID NO: 102452 - RNA, 64 nt, hsa
cccaccuuccucugugcccccauagcacuguguauaccgcuacuaccacugcaauucacauuau

SEQ ID NO: 102453 - RNA, 64 nt, hsa
cucaagggaaaauggaggcuccagcagcauauuguaccgcuaccccuuugaaaggcugaagaug

SEQ ID NO: 102454 - RNA, 64 nt, hsa
cugacuagguggacagagcucaaagaggcccucuuaccgcuagcgaggugauaggacaucuggc

SEQ ID NO: 102455 - RNA, 64 nt, hsa
ggaggaguuaacuuugcgccggccgucagggcauuaccgcuaacgucugcaggagcuuuauucc

SEQ ID NO: 102456 - RNA, 64 nt, hsa
cugucuccagaagcuucuagcucuggggucuggcuaccgcuaggaggcugagcaagccaggaag

SEQ ID NO: 102457 - RNA, 64 nt, hsa
acaagugauugaucuaaaguuccuuuuaaguuuauaccgcuaaacaaacugaguugauuucuau

SEQ ID NO: 102458 - RNA, 64 nt, hsa
uuuuguuuucagauuuauuccccauguuuacagauaccgcuaauaaauugcaguaguccuuccc

SEQ ID NO: 102459 - RNA, 64 nt, hsa
uuccagguuauuaaaugggucaaccagagcaaaagguuauuaagaauacuuagugcagaaggug

SEQ ID NO: 102460 - RNA, 64 nt, hsa
agaccagacauggagcaacacuuuuuuucuuccagguuauuaaaugggucaaccagagcaaaag

SEQ ID NO: 102461 - RNA, 64 nt, hsa
auacucaacucaacuaggcucauacucaauugaugguuauuagacaauuccauuucuuucuggu

SEQ ID NO: 102462 - RNA, 64 nt, hsa
aauugaugguuauuagacaauuccauuucuuucugguuauuauaaacagaaaaucuuuccucuu

SEQ ID NO: 102463 - RNA, 64 nt, hsa
uuugaaaugaaaugaaaccuuguuuaaacauuaaaauuacuaaaauaggcugggcgcgguggcu

SEQ ID NO: 102464 - RNA, 64 nt, hsa
ugggaagaccacaucuuguuccacaucaggcaauaauuacuaaagagaaucccugucaauguca

SEQ ID NO: 102465 - RNA, 64 nt, hsa
uaaaacagaaagcacuaggauacaaaugaagcuuaauuacuaaaauguaauucuugacacucuu

SEQ ID NO: 102466 - RNA, 64 nt, hsa
agaaauaugaagaaaaaauacaccaagauggucaaauuacuacacaaaucagcaccagcacagu

SEQ ID NO: 102467 - RNA, 64 nt, hsa
uuauucucaauggaagaauggcaucugaucucauaauuacuaguuuauauuaauauaguuuuuu

SEQ ID NO: 102468 - RNA, 64 nt, hsa
uuuaacuuccuucuguuuuaagauuguaauuaaaaauuacuauuuuguuauauggaaugguuaa

SEQ ID NO: 102469 - RNA, 64 nt, hsa
cuauuauaaggccauuuccuuuucacauuagauaaauuacuauaaagacuccuaauagcuuuuc

SEQ ID NO: 102470 - RNA, 64 nt, hsa
uauucuguguuuuaucuagucacauaaauggauuaauuacuaauuucaguugagaccuucuaau

SEQ ID NO: 102471 - RNA, 64 nt, hsa
uagucacugcaaauuugacugugacuuuaaucuaaauuacuauguaaacaaaaaguagauaguu

SEQ ID NO: 102472 - RNA, 64 nt, hsa
aaaucugcauuuuaauucauguuggucaaagucgaauuacuaucuauuuaucuuauaucguaga

SEQ ID NO: 102473 - RNA, 64 nt, hsa
uuauucugaauggcugaaguuagucuuaaacucaaauuacuauaugaugauuuaaaacaaaaua

SEQ ID NO: 102474 - RNA, 64 nt, hsa
ccagcuucuggaauugcugcuuucuuuuuacagaaauuacuacccaacagauuucaggaaguac

SEQ ID NO: 102475 - RNA, 64 nt, hsa
aaaauagcuuuauuuaugcugaauugugauuuuuuuaugccaaauuuuuuuuaguucuaaucau

SEQ ID NO: 102476 - RNA, 64 nt, hsa
uucuaaucauugaugauagcuuggaaauaaauaauuaugccauggcauuugacaguucauuauu

SEQ ID NO: 102477 - RNA, 64 nt, hsa
aacaggcuauaucauaggcaguuuccaaacuuaauuaugccauuuaguuugucuagauuucuuu

SEQ ID NO: 102478 - RNA, 64 nt, hsa
ugucauaccacacaguagcugcacaguuuuaagauuaugccaucaccuaggguaauguuuugua

SEQ ID NO: 102479 - RNA, 64 nt, hsa
cccacucagaauccacggugaccucuccgcuugccaaaauaaccgaaggaaagaccguucacca

SEQ ID NO: 102480 - RNA, 64 nt, hsa
accgcaaauaucugugggguccuguugaaaagaacaaaauaaaggagcccaaggggucauucug

SEQ ID NO: 102481 - RNA, 64 nt, hsa
auuuuuuuguagaguuuuuggaaagauauuuacucaaaauaacuaugcuuuagaacuuuuuuuu

SEQ ID NO: 102482 - RNA, 64 nt, hsa
gcccauagaaacauucucguuuaaacaacaacaacaaaauaaauuuaucagcacuagauauuag

SEQ ID NO: 102483 - RNA, 64 nt, hsa
uauucuaggugccaguguuaggaugucaguuuuacaaaauaaugaagcaauuagcuaugugauu

SEQ ID NO: 102484 - RNA, 64 nt, hsa
uugauugaagugcagagaaaaaucccuuagauugcaaaauaaaauaguugaacucucugucuuc

SEQ ID NO: 102485 - RNA, 64 nt, hsa
uuaagaugaaauuuauaugaaagcauuuuuaucacaaaauaaaaaagguuugccaagcucagug

SEQ ID NO: 102486 - RNA, 64 nt, hsa
cuuccguccagugcugugaugcccaugacaccugcaaaauaaguucugccugggcauuuuguag

SEQ ID NO: 102487 - RNA, 64 nt, hsa
uuagaaggauuuuauucucaacagaugcaaaaugcaaaauaaaauauuggcaaacaauacagca

SEQ ID NO: 102488 - RNA, 64 nt, hsa
uuagaaaugaagaaaaugaauauauuucuuaauacaaaauaagugggaaaugagaaguuauacc

SEQ ID NO: 102489 - RNA, 64 nt, hsa
cuauggggaaucaugguucuuuuaaagcaauuuucaaaauaaguaccaauuaaagcuuuagguu

SEQ ID NO: 102490 - RNA, 64 nt, hsa
auauugcuagagcuauuuuccugaaauacauuugcaaaauaaggcugcuuuguaaucaaggaau

SEQ ID NO: 102491 - RNA, 64 nt, hsa
caggugaauuggcucucauggaaauuuggaauuacaaaauaaacguccuggggguuacccagaa

SEQ ID NO: 102492 - RNA, 64 nt, hsa
cccagaauacagauuuaaaaguuugccuguagagcaaaauaaaacagucaguuguagucauuaa

SEQ ID NO: 102493 - RNA, 64 nt, hsa
uaguacuugauguugauguuuuuauuuugcugagcaaaauaaagccaaugggagaaagacuauu

SEQ ID NO: 102494 - RNA, 64 nt, hsa
uuaccguaauauuauaucuugcccuacuuauuuacaaaauaauauguuucuguuaugguccuua

SEQ ID NO: 102495 - RNA, 64 nt, hsa
aaccaguguugauauguuugauuaagacuuuucacaaaauaaucauauaaaacacuagucucuu

SEQ ID NO: 102496 - RNA, 64 nt, hsa
uuuauguauguuccuaaugcuuauggaacuccuccaaaauaaaguuacucaaagagagcaaaua

SEQ ID NO: 102497 - RNA, 64 nt, hsa
uuaaagacggcuguuccaaaugggagaaauuggccaaaauaaagggguuacagggcccaugcaa

SEQ ID NO: 102498 - RNA, 64 nt, hsa
acccgugauaaugugauugaacacuuuaguaaugcaaaauaacucauuuccaacuacugcugca

SEQ ID NO: 102499 - RNA, 64 nt, hsa
agaguguuauuaaugauuaugaacuuuugcuuaacaaaauaacauacgacgagagcuugaguug

SEQ ID NO: 102500 - RNA, 64 nt, hsa
ggguuccccucucucaugcaugaacaggggcauccaaaauaagaagcucuccauucuguggugg

SEQ ID NO: 102501 - RNA, 64 nt, hsa
auuaaaucacaaaguauguuaaaggucacaaaagcaaaauaacugucugaggcuaaggcccacg

SEQ ID NO: 102502 - RNA, 64 nt, hsa
uuuuuuucaauugccagcuacugcuuuuauucaucaaaauaaaauaacuuguucugaaguuguc

SEQ ID NO: 102503 - RNA, 64 nt, hsa
uaauuauuguuuauauuuucaauucaaaaauguacaaaauaaaguuacauugcuggucuuguaa

SEQ ID NO: 102504 - RNA, 64 nt, hsa
ccuguugaaaagccauguuuaagauuuaauuugccaaaauaaugucuuguuaauauucuuucaa

SEQ ID NO: 102505 - RNA, 64 nt, hsa
uuauaauuguuggaccuccuugagauaguaacaacaaaauaaagcaagcuaucugcaccucaaa

SEQ ID NO: 102506 - RNA, 64 nt, hsa
gcaaugagccacagcaaaaaguaaagaacaacaacaaaauaaagcuguuguuaaauuuuaaaca

SEQ ID NO: 102507 - RNA, 64 nt, hsa
uaauaaaauuuaguuucucauuauagucuaaaagcaaaauaaauucugaaguaguccaauaaca

SEQ ID NO: 102508 - RNA, 64 nt, hsa
auuagccaccacaccuuaagaugcauuucacagccaaaauaagucucauuucuuuucaugacac

SEQ ID NO: 102509 - RNA, 64 nt, hsa
auuuuaauacuugcaaaaacauuacuaaguauaccaaaauaauugacucuauuaucugaaauga

SEQ ID NO: 102510 - RNA, 64 nt, hsa
ggcagucaaaugguguuuguuuuuaucaaaaugucaaaauaacauacuuggagaaguauguaau

SEQ ID NO: 102511 - RNA, 64 nt, hsa
uuggaggcuaaaauguaauguuuuuucauucauacaaaauaauggacacucccuaauuccauua

SEQ ID NO: 102512 - RNA, 64 nt, hsa
agaguuugcgauauuuagauacugaaauuuaugucaaaauaacggcuaggaauaauucugucaa

SEQ ID NO: 102513 - RNA, 64 nt, hsa
ucugaaacagaggcuuuaaaauuuaaaaccucagcaaaauaauccaugaauuuacugauucuuc

SEQ ID NO: 102514 - RNA, 64 nt, hsa
auaaagaauucuuuugaggauggaauucuguccacaaaauaauuuugugagcccagauaucauu

SEQ ID NO: 102515 - RNA, 64 nt, hsa
caaacucauccauagauaauucaagauuuguauucaaaauaaacauaguuuucacaguuacaaa

SEQ ID NO: 102516 - RNA, 64 nt, hsa
uuuguauucaaaauaaacauaguuuucacaguuacaaaauaaaucaccuauuuuaucuuuuccu

SEQ ID NO: 102517 - RNA, 64 nt, hsa
guggugucuacugcuagggagauuauaugaaggccaaaauaaugacuucagcaagagugacuga

SEQ ID NO: 102518 - RNA, 64 nt, hsa
auauuuguauuacuugaauuuugcucuuguauggcaaaauaauuagugaguuuaaaaaaaaucu

SEQ ID NO: 102519 - RNA, 64 nt, hsa
ugcaaaauaauuaaaccuguacauauuccauuuacaaaauaaauucagcccugcacuuucuuua

SEQ ID NO: 102520 - RNA, 64 nt, hsa
uaguaguugcuauguacugauuuaccucaaggugcaaaauaauuaaaccuguacauauuccauu

SEQ ID NO: 102521 - RNA, 64 nt, hsa
aaaccagaucugaacauguauuuguugaguuuugcaaaauaaaauuaauuuuguaaguaaauau

SEQ ID NO: 102522 - RNA, 64 nt, hsa
guugauuuuagauaaccaaguaaguauuauaauacaaaauaauuuuaaguguaagaaacuaaag

SEQ ID NO: 102523 - RNA, 64 nt, hsa
uuuguugcauuucaguaaaagcagaauaaccuuucaaaauaauaacaggcugggugcaauggcu

SEQ ID NO: 102524 - RNA, 64 nt, hsa
agccuggccugggcaacagagcaagacccugucucaaaauaauaauaauauauaauuuuacacc

SEQ ID NO: 102525 - RNA, 64 nt, hsa
cugaauucaccacagcuggaauagcuguggaaaacaaaauaaaacaacaaaauuaauaaugaaa

SEQ ID NO: 102526 - RNA, 64 nt, hsa
uaguaaugcaaacaaauuauuuuuuacaaaaaaacaaaauaaauaaaauuagacuuccuucccu

SEQ ID NO: 102527 - RNA, 64 nt, hsa
agaguaaccuguauuuuaauuguugaaacuuaaccaaaauaagauacugucucagcuagggcuu

SEQ ID NO: 102528 - RNA, 64 nt, hsa
ugggaauauuuguuguuaaaaacuucuuuuugcccaaaauaacucauuuuguauuaucugaaaa

SEQ ID NO: 102529 - RNA, 64 nt, hsa
ucuauauauuuaugauaaaucuuuuccauuuguacaaaauaaaauuccauuucauugugaccua

SEQ ID NO: 102530 - RNA, 64 nt, hsa
accuauauuuauguaacuguauacugaauucugacaaaauaaaaaaagauaccuuauugacgaa

SEQ ID NO: 102531 - RNA, 64 nt, hsa
uuuucacuguaggaaucacaaaauaaguuuuugucaaaauaacuguuguugaacguuauacugg

SEQ ID NO: 102532 - RNA, 64 nt, hsa
gauaucaccaaaaauguuuucacuguaggaaucacaaaauaaguuuuugucaaaauaacuguug

SEQ ID NO: 102533 - RNA, 64 nt, hsa
cauguuaaauuucccuuuuauuuuggucaugcaucaaaauaaauuuacuaaguacuaaagagcc

SEQ ID NO: 102534 - RNA, 64 nt, hsa
ugauuguuucuuuaacuuaggauccaaacauguccaaaauaaugcagaguacauaugcaaucac

SEQ ID NO: 102535 - RNA, 64 nt, hsa
gaacuuacaacucagaaaagauugcuagacucaccaaaauaauaaauguucuuuauuuuacagg

SEQ ID NO: 102536 - RNA, 64 nt, hsa
aaaagauuuugguugagacuaaauuacucaucgucaaaauaaugucaaaauaguuuuggggauc

SEQ ID NO: 102537 - RNA, 64 nt, hsa
gucaucguuauccucucuuaugaacaacuguagucaaaauaagguggcacaauuuaauuguuuu

SEQ ID NO: 102538 - RNA, 64 nt, hsa
cucuaagaguuuuuuuccuucugagcuuccuuuucaaaauaaaagugacaauuguagcauugac

SEQ ID NO: 102539 - RNA, 64 nt, hsa
uaugagcccauaaggguucugugcuuagcauuaacaaaauaagguuuauagguaaagccaaugu

SEQ ID NO: 102540 - RNA, 64 nt, hsa
uuugagugguauuucucuugauugagcagcuagacaaaauaaucugcaaauuuaaauguggcgc

SEQ ID NO: 102541 - RNA, 64 nt, hsa
gaauuuucuaaaaguuaaccuugugggcuguugccaaaauaagaguauuuagaggacacugauu

SEQ ID NO: 102542 - RNA, 64 nt, hsa
gugauagaagauuauucagaacaaaauaaguagacaaaauaacaaaagacaggaaaauaagucu

SEQ ID NO: 102543 - RNA, 64 nt, hsa
uagaaggggaaaugugauagaagauuauucagaacaaaauaaguagacaaaauaacaaaagaca

SEQ ID NO: 102544 - RNA, 64 nt, hsa
uaaauuaguuuuaguuuguguucuuaaggguuugcaaaauaauuuggcucccaaacucuuguug

SEQ ID NO: 102545 - RNA, 64 nt, hsa
uauuuuuauaacuucuugugagucuuaaguauuucaaaauaaaagugguuuuaaaguaaauuca

SEQ ID NO: 102546 - RNA, 64 nt, hsa
caaaugaaacuuuaaaauuuauuuugguuuaucccaaaauaauggaaaauguccaguuguguuu

SEQ ID NO: 102547 - RNA, 64 nt, hsa
aauuuuaguacaaaauuucauaaaccguguuuuucaaaauaaguuuaugucaaauccagcuucc

SEQ ID NO: 102548 - RNA, 64 nt, hsa
ucagacauucagugggcaaguaaauuauggacugcaaaauaaugauuuuuauucaagaaagcuu

SEQ ID NO: 102549 - RNA, 64 nt, hsa
aaguuuuauauccagauauacaaccacaauaaagcaaaauaaccuacuaucaaaauagaaaugu

SEQ ID NO: 102550 - RNA, 64 nt, hsa
cuuguaagcuuuaacuauaucucucuuuaaaaugcaaaauaaugucuuaagauucaaagucugu

SEQ ID NO: 102551 - RNA, 64 nt, hsa
aagucuguauuuuuaaagcauggcuuuggcuuugcaaaauaaaaaauguguuuuguacaugaag

SEQ ID NO: 102552 - RNA, 64 nt, hsa
aaauugggucuuagauuuugauuuacuagugugacaaaauaacuacauccuaaugaaaaucaag

SEQ ID NO: 102553 - RNA, 64 nt, hsa
uaaacccauguuucugagaugccauuauuccaagcaaaauaagagauaaucccuucaaguuaaa

SEQ ID NO: 102554 - RNA, 64 nt, hsa
guuuucaacacaucaacucacauauguucaaaaccaaaauaauaccuucauuaucaaacugguu

SEQ ID NO: 102555 - RNA, 64 nt, hsa
aagcucuagguucuucagcacauuucccccaaaacaaaauaaaauugagggcauguugcauauu

SEQ ID NO: 102556 - RNA, 64 nt, hsa
agaaguuauuauucauacuguguugcucauuugacaaaauaagguaaggauuucauaaucaggu

SEQ ID NO: 102557 - RNA, 64 nt, hsa
guuuacagaacccaaaugaugucuuccucucucucaaaauaaacuaaccuauucauauugcugu

SEQ ID NO: 102558 - RNA, 64 nt, hsa
uuugugagcaguuugccauucagaaaccauugagcaaaauaagucuauagaugggacugaaacu

SEQ ID NO: 102559 - RNA, 64 nt, hsa
aaguuuuguuuuucacaaagcucuuauuaugaagcaaaauaaaaauucuaguuucuuguaugau

SEQ ID NO: 102560 - RNA, 64 nt, hsa
uuagugucucuauuuaugagaucacugaacuuuucaaaauaaagcuuuugcauagaauaaugaa

SEQ ID NO: 102561 - RNA, 64 nt, hsa
ucacugcuguaaagcaaaauauuugugaaagugccaaaauaaagucugucaugccaaaaguaaa

SEQ ID NO: 102562 - RNA, 64 nt, hsa
guauuauuugauacuaaauuuucaauuauuacuucaaaauaagagucugaggauuucuucuuac

SEQ ID NO: 102563 - RNA, 64 nt, hsa
ugaaaacuaaucaaauauagugccuauuuagucucaaaauaagguaacuauuaacuugauuaua

SEQ ID NO: 102564 - RNA, 64 nt, hsa
aacugcuuuguuugcaagauuaaauuaguguuggcaaaauaaaguucuaaagauaauacuaaac

SEQ ID NO: 102565 - RNA, 64 nt, hsa
acaucugcaucauuucauaggauuagaacuuacucaaaauaauguaaaucuuuaaaaauauaaa

SEQ ID NO: 102566 - RNA, 64 nt, hsa
guuuuuuuucuccuacaaggagauauggcuggaccaaaauaaaaugacaugaaacugcaaaaau

SEQ ID NO: 102567 - RNA, 64 nt, hsa
aaacaaugacuguaacguguuauagauguaaagacaaaauaaagguuaaagagggcauaaagga

SEQ ID NO: 102568 - RNA, 64 nt, hsa
ugcaugauuuauccaaaguuuccauaguuuuauucaaaauaauaaauguuaauaaggugauaag

SEQ ID NO: 102569 - RNA, 64 nt, hsa
caugaaauuggagcucuguauaaacugaaaaagacaaaauaaguaaagcacuuguugcuuugcu

SEQ ID NO: 102570 - RNA, 64 nt, hsa
ugucucauuguagucugucuucaacuauuuuauccaaaauaaaccuccagaagaaaguaguuuu

SEQ ID NO: 102571 - RNA, 64 nt, hsa
cucagccuaauugagcccuauuauuuuaacuuaacaaaauaaauacagaaguaccuauuucuaa

SEQ ID NO: 102572 - RNA, 64 nt, hsa
cuccauauauugucauucaaaauauauuuuaacccaaaauaaguuaaauaauuugugcauguuu

SEQ ID NO: 102573 - RNA, 64 nt, hsa
aaauggacgaaaaauucucucgccaucuuaauaacaaaauaaacuacaaauuccugacccaagg

SEQ ID NO: 102574 - RNA, 64 nt, hsa
ccuggagauucugaagugccuuugcugugguuuucaaaauaauaaagauuuguauucaacucaa

SEQ ID NO: 102575 - RNA, 64 nt, hsa
uggaacauuaucuacaauuuuacucucaaauagucaaaauaaaaacaucucaauuucuaauacc

SEQ ID NO: 102576 - RNA, 64 nt, hsa
uguauucauucacuuucaagauuuguuuuggugucaaaauaacaugaaaagguagauggaguug

SEQ ID NO: 102577 - RNA, 64 nt, hsa
gcauacuuuucauguuuuaauuuuuuucuuccagcaaaauaaacacugaggcccuaaaaauaga

SEQ ID NO: 102578 - RNA, 64 nt, hsa
gggcauguuauuugaagugcucagcaguugaaagcaaaauaauaacugcuauuuauaaaaaugc

SEQ ID NO: 102579 - RNA, 64 nt, hsa
uagaguaaacuuauugcauauuuucauaaucagucaaaauaauaaaacuaaaaacaaaaaguaa

SEQ ID NO: 102580 - RNA, 64 nt, hsa
uaauagagcagaugguugccuuugggucuugaaccaaaauaagacuuacuaaaggaagagugag

SEQ ID NO: 102581 - RNA, 64 nt, hsa
uuuuuuuuuuaaacucauauauugggauuuucaccaaaauaaugcuuuugaaaaaaagaaaaaa

SEQ ID NO: 102582 - RNA, 64 nt, hsa
uauauugagaaucaaaguagaaguuuuaggaaugcaaaauaagucaucuugcauacagggagug

SEQ ID NO: 102583 - RNA, 64 nt, hsa
auuuuuuuuucuuuuuaauauuuucuucuggucacaaaauaaagaaauuugggaugcaaaguac

SEQ ID NO: 102584 - RNA, 62 nt, hsa
auuucucauuguuggaaucugaauaaaccaauuacaaaauaacauaugugcacauuguaagu

SEQ ID NO: 102585 - RNA, 64 nt, hsa
ucucagaugauuauuccaguuuucaaugauuuuucaaaauaaaagucaaucagcauuguuauuu

SEQ ID NO: 102586 - RNA, 64 nt, hsa
augugaaguauucaugagaaucuguagauuccaucaaaauaaguaggaacucauacuaaaauug

SEQ ID NO: 102587 - RNA, 64 nt, hsa
gcauaacgaccuugaauguaauuggaguaagugacaaaauaagaacuacccugggaaacccugc

SEQ ID NO: 102588 - RNA, 64 nt, hsa
cuuaccacuucgaugguugugauuaauuuaaaaucaaaauaaaggaauuacugaguuuauuugc

SEQ ID NO: 102589 - RNA, 64 nt, hsa
ucgagagcaaaucaaaaccucuauccagacaagacaaaauaaaacucaccaucuccugaagacc

SEQ ID NO: 102590 - RNA, 64 nt, hsa
acuauaggccauaaagaaugggacugcauuggaccaaaauaaaugggaaaaucgugguuugaaa

SEQ ID NO: 102591 - RNA, 64 nt, hsa
uacauggauauacuuccuuuuaaauucucagcugcaaaauaauuguagacaaaauaauggcauu

SEQ ID NO: 102592 - RNA, 64 nt, hsa
ccuuuuaaauucucagcugcaaaauaauuguagacaaaauaauggcauuuaacuaaagauggag

SEQ ID NO: 102593 - RNA, 64 nt, hsa
gaucacugaaauauuuaugacagugcauaauuugcaaaauaaaaaauguacacuagcauaauau

SEQ ID NO: 102594 - RNA, 64 nt, hsa
aauaauuguuaauauggaauaagcucaaauaugucaaaauaaauguaaaaaaugaguguugccc

SEQ ID NO: 102595 - RNA, 64 nt, hsa
ccuaagccauaaaauaaauuuuauuccaaaauaacaaaauaaauaaucuacuguacacaaucug

SEQ ID NO: 102596 - RNA, 64 nt, hsa
ucauagauccuaagccauaaaauaaauuuuauuccaaaauaacaaaauaaauaaucuacuguac

SEQ ID NO: 102597 - RNA, 64 nt, hsa
gcuaauaauucuguaaggacacaucaaagcuggccaaaauaaugaauuuuuuuuaaaaagcaau

SEQ ID NO: 102598 - RNA, 64 nt, hsa
gucacaaucaucuuacuagcucucucucucucagcaaaauaaaacugugaugugucuucuuugu

SEQ ID NO: 102599 - RNA, 64 nt, hsa
guuuaugcuuuuuagauuuugguugcuuucuugccaaaauaaguguuaacuguguuucaaacuu

SEQ ID NO: 102600 - RNA, 64 nt, hsa
cauagguacuguuguaccaaggucacuuaucuaacaaaauaacccuucauguauuuuaaauuua

SEQ ID NO: 102601 - RNA, 64 nt, hsa
ugugaacagccugauguuugggaccuuuuuuccucaaaauaaacaaguccuuauuaaaccagga

SEQ ID NO: 102602 - RNA, 64 nt, hsa
auaaaaaggauguaugguuuuuaucaacugucuccaaaauaaucucuuguuaugcagggaguac

SEQ ID NO: 102603 - RNA, 64 nt, hsa
gaaguagaucaaaauagaacacaauagagaacuucaaaauaaaacaggugugagaauugugugu

SEQ ID NO: 102604 - RNA, 64 nt, hsa
aagauugacuauaccaaacauuauauuaaaaacacaaaauaaaaacuauaaaaauguacuuuag

SEQ ID NO: 102605 - RNA, 64 nt, hsa
gcaaauaauuuugccuucuaggcuguugcucuaacaaaauaaaccuuagacauaucacaccuaa

SEQ ID NO: 102606 - RNA, 64 nt, hsa
aagagugcuuuaaugaugacauuuagcaagugcucaaaauaauugacagguuuuguuuuuuuuu

SEQ ID NO: 102607 - RNA, 64 nt, hsa
auacaguguuuuacauucucuccuuuauagguaacaaaauaauguuuagcucaguaaguacuga

SEQ ID NO: 102608 - RNA, 64 nt, hsa
caugcuuaaugauggaaaugaaauguuaaaucaacaaaauaagauccaguguuucauaacauuu

SEQ ID NO: 102609 - RNA, 64 nt, hsa
caguuuuuacccuaaagugcaaaagugaaacauacaaaauaagacuaauuuuuaagaguaacuc

SEQ ID NO: 102610 - RNA, 64 nt, hsa
cuaauuuuucuuacacacuaaauggguauuuguucaaaauaaugaaguuauggcuucacauuca

SEQ ID NO: 102611 - RNA, 64 nt, hsa
aaaccuguaugccgauuuuccucaagccaucucacaaaauaagaauuucaaauguaaauauugu

SEQ ID NO: 102612 - RNA, 64 nt, hsa
uaaggcuuuuaauacauuuugaauggcaccaaaacaaaauaagucaaaauggacagucauuuua

SEQ ID NO: 102613 - RNA, 64 nt, hsa
ucgagacuaggaagaaacugcaugaacuaacgagcaaaauaaccagcuaacaucauaaugacag

SEQ ID NO: 102614 - RNA, 64 nt, hsa
aaacccaucucacgugcagagacacacauaggcucaaaauaaaaggauggaggaagaucuacga

SEQ ID NO: 102615 - RNA, 64 nt, hsa
acaggcaaaauccuugcuuaugacaucacuuguacaaaauaaacaaauaacaaugugcucucgg

SEQ ID NO: 102616 - RNA, 64 nt, hsa
aauugacugucacuguuccuugucacugguagaccaaaauaaaaccagcucuacuggucuugug

SEQ ID NO: 102617 - RNA, 64 nt, hsa
ugcuaauuuauccugaaauuucagauucccagagcaaaauaauuuuaaacaaagguugagaugu

SEQ ID NO: 102618 - RNA, 64 nt, hsa
uuacaguauuuuuauucauauuuaaacauuuuuacaaaauaaauaaaguguuuuacauaguaag

SEQ ID NO: 102619 - RNA, 64 nt, hsa
acuuuaaaccaaugccuauaaaaagcaagucuaccaaaauaaacuaagacuuucuaugugguuu

SEQ ID NO: 102620 - RNA, 64 nt, hsa
aacccauuuucgcuauaaauaaaagguaacuguacaaaauaaguacaaugcaacaaaauagugu

SEQ ID NO: 102621 - RNA, 64 nt, hsa
accauuuggucaggauuccuguugccuuuauauccaaaauaaacuccccuuucuugagguuguc

SEQ ID NO: 102622 - RNA, 64 nt, hsa
ucaccuugauuuugagcuggaauguuucaaugagcaaaauaaauuagacaaaaguuuacuuucu

SEQ ID NO: 102623 - RNA, 64 nt, hsa
aauuuuuaaaaagacuguuuuuaaaaaggugcuacaaaauaaagugcuaucuuuuucuguuucu

SEQ ID NO: 102624 - RNA, 64 nt, hsa
uuagaauuacacagcuaaaaaggaaaaaaaacaccaaaauaagauaaaauaaaacaaauuuaaa

SEQ ID NO: 102625 - RNA, 64 nt, hsa
ccaaaauaagauaaaauaaaacaaauuuaaacaccaaaauaagauauaauaaaacauuuguuuu

SEQ ID NO: 102626 - RNA, 64 nt, hsa
accaaaauaagauauaauaaaacauuuguuuuugcaaaauaaggcccaauguuauggccuaaug

SEQ ID NO: 102627 - RNA, 64 nt, hsa
uucuaauacauauuaaaagacauaacuaucaaaacaaaauaaauuugucuguuuucaaccaaag

SEQ ID NO: 102628 - RNA, 64 nt, hsa
uauguauccgcaugugugcaugugaguauguuugcaaaauaauaaaggauauuggagaccuguu

SEQ ID NO: 102629 - RNA, 64 nt, hsa; identical to SEQ ID NO: 100468

SEQ ID NO: 102630 - RNA, 64 nt, hsa; identical to SEQ ID NO: 100469

SEQ ID NO: 102631 - RNA, 64 nt, hsa; identical to SEQ ID NO: 100470

SEQ ID NO: 102632 - RNA, 64 nt, hsa; identical to SEQ ID NO: 100471

SEQ ID NO: 102633 - RNA, 64 nt, hsa; identical to SEQ ID NO: 100472

SEQ ID NO: 102634 - RNA, 64 nt, hsa; identical to SEQ ID NO: 100473

SEQ ID NO: 102635 - RNA, 64 nt, hsa; identical to SEQ ID NO: 100474

SEQ ID NO: 102636 - RNA, 64 nt, hsa; identical to SEQ ID NO: 100475

SEQ ID NO: 102637 - RNA, 64 nt, hsa; identical to SEQ ID NO: 100476

SEQ ID NO: 102638 - RNA, 64 nt, hsa; identical to SEQ ID NO: 100477

SEQ ID NO: 102639 - RNA, 64 nt, hsa; identical to SEQ ID NO: 100478

SEQ ID NO: 102640 - RNA, 64 nt, hsa; identical to SEQ ID NO: 100479

SEQ ID NO: 102641 - RNA, 64 nt, hsa; identical to SEQ ID NO: 100480

SEQ ID NO: 102642 - RNA, 64 nt, hsa; identical to SEQ ID NO: 100481

SEQ ID NO: 102643 - RNA, 64 nt, hsa; identical to SEQ ID NO: 100482

SEQ ID NO: 102644 - RNA, 64 nt, hsa; identical to SEQ ID NO: 100483

SEQ ID NO: 102645 - RNA, 64 nt, hsa; identical to SEQ ID NO: 100484

SEQ ID NO: 102646 - RNA, 64 nt, hsa; identical to SEQ ID NO: 100485

SEQ ID NO: 102647 - RNA, 64 nt, hsa; identical to SEQ ID NO: 100486

SEQ ID NO: 102648 - RNA, 64 nt, hsa; identical to SEQ ID NO: 100487

SEQ ID NO: 102649 - RNA, 64 nt, hsa; identical to SEQ ID NO: 100488

SEQ ID NO: 102650 - RNA, 64 nt, hsa; identical to SEQ ID NO: 100489

SEQ ID NO: 102651 - RNA, 64 nt, hsa; identical to SEQ ID NO: 100490

SEQ ID NO: 102652 - RNA, 64 nt, hsa; identical to SEQ ID NO: 100491

SEQ ID NO: 102653 - RNA, 64 nt, hsa; identical to SEQ ID NO: 100492

SEQ ID NO: 102654 - RNA, 64 nt, hsa; identical to SEQ ID NO: 100493

SEQ ID NO: 102655 - RNA, 64 nt, hsa; identical to SEQ ID NO: 100494

SEQ ID NO: 102656 - RNA, 64 nt, hsa; identical to SEQ ID NO: 100495

SEQ ID NO: 102657 - RNA, 64 nt, hsa; identical to SEQ ID NO: 100496

SEQ ID NO: 102658 - RNA, 64 nt, hsa; identical to SEQ ID NO: 100497

SEQ ID NO: 102659 - RNA, 64 nt, hsa; identical to SEQ ID NO: 100498

SEQ ID NO: 102660 - RNA, 64 nt, hsa; identical to SEQ ID NO: 100499

SEQ ID NO: 102661 - RNA, 64 nt, hsa; identical to SEQ ID NO: 100500

SEQ ID NO: 102662 - RNA, 64 nt, hsa; identical to SEQ ID NO: 100501

SEQ ID NO: 102663 - RNA, 64 nt, hsa; identical to SEQ ID NO: 100502

SEQ ID NO: 102664 - RNA, 64 nt, hsa; identical to SEQ ID NO: 100503

SEQ ID NO: 102665 - RNA, 64 nt, hsa; identical to SEQ ID NO: 100504

SEQ ID NO: 102666 - RNA, 64 nt, hsa; identical to SEQ ID NO: 100505

SEQ ID NO: 102667 - RNA, 64 nt, hsa; identical to SEQ ID NO: 100506

SEQ ID NO: 102668 - RNA, 64 nt, hsa; identical to SEQ ID NO: 100507

SEQ ID NO: 102669 - RNA, 64 nt, hsa; identical to SEQ ID NO: 100508

SEQ ID NO: 102670 - RNA, 64 nt, hsa; identical to SEQ ID NO: 100509

SEQ ID NO: 102671 - RNA, 64 nt, hsa; identical to SEQ ID NO: 100510

SEQ ID NO: 102672 - RNA, 64 nt, hsa; identical to SEQ ID NO: 100511

SEQ ID NO: 102673 - RNA, 64 nt, hsa; identical to SEQ ID NO: 100512

SEQ ID NO: 102674 - RNA, 64 nt, hsa; identical to SEQ ID NO: 100513

SEQ ID NO: 102675 - RNA, 64 nt, hsa; identical to SEQ ID NO: 100514

SEQ ID NO: 102676 - RNA, 59 nt, hsa; identical to SEQ ID NO: 100515

SEQ ID NO: 102677 - RNA, 64 nt, hsa; identical to SEQ ID NO: 100516

SEQ ID NO: 102678 - RNA, 64 nt, hsa; identical to SEQ ID NO: 100517

SEQ ID NO: 102679 - RNA, 64 nt, hsa; identical to SEQ ID NO: 100518

SEQ ID NO: 102680 - RNA, 64 nt, hsa; identical to SEQ ID NO: 100519

SEQ ID NO: 102681 - RNA, 64 nt, hsa; identical to SEQ ID NO: 100520

SEQ ID NO: 102682 - RNA, 64 nt, hsa; identical to SEQ ID NO: 100521

SEQ ID NO: 102683 - RNA, 64 nt, hsa; identical to SEQ ID NO: 100522

SEQ ID NO: 102684 - RNA, 64 nt, hsa; identical to SEQ ID NO: 100523

SEQ ID NO: 102685 - RNA, 64 nt, hsa; identical to SEQ ID NO: 100524

SEQ ID NO: 102686 - RNA, 64 nt, hsa; identical to SEQ ID NO: 100525

SEQ ID NO: 102687 - RNA, 64 nt, hsa; identical to SEQ ID NO: 100526

SEQ ID NO: 102688 - RNA, 64 nt, hsa; identical to SEQ ID NO: 100527

SEQ ID NO: 102689 - RNA, 64 nt, hsa; identical to SEQ ID NO: 100528

SEQ ID NO: 102690 - RNA, 64 nt, hsa; identical to SEQ ID NO: 100529

SEQ ID NO: 102691 - RNA, 64 nt, hsa; identical to SEQ ID NO: 100530

SEQ ID NO: 102692 - RNA, 64 nt, hsa; identical to SEQ ID NO: 100531

SEQ ID NO: 102693 - RNA, 64 nt, hsa; identical to SEQ ID NO: 100532

SEQ ID NO: 102694 - RNA, 64 nt, hsa; identical to SEQ ID NO: 100533

SEQ ID NO: 102695 - RNA, 64 nt, hsa; identical to SEQ ID NO: 100534

SEQ ID NO: 102696 - RNA, 64 nt, hsa; identical to SEQ ID NO: 100535

SEQ ID NO: 102697 - RNA, 64 nt, hsa; identical to SEQ ID NO: 100536

SEQ ID NO: 102698 - RNA, 64 nt, hsa; identical to SEQ ID NO: 100537

SEQ ID NO: 102699 - RNA, 64 nt, hsa; identical to SEQ ID NO: 100538

SEQ ID NO: 102700 - RNA, 64 nt, hsa; identical to SEQ ID NO: 100539

SEQ ID NO: 102701 - RNA, 64 nt, hsa; identical to SEQ ID NO: 100540

SEQ ID NO: 102702 - RNA, 64 nt, hsa; identical to SEQ ID NO: 100541

SEQ ID NO: 102703 - RNA, 64 nt, hsa; identical to SEQ ID NO: 100542

SEQ ID NO: 102704 - RNA, 64 nt, hsa; identical to SEQ ID NO: 100543

SEQ ID NO: 102705 - RNA, 64 nt, hsa; identical to SEQ ID NO: 100544

SEQ ID NO: 102706 - RNA, 64 nt, hsa; identical to SEQ ID NO: 100545

SEQ ID NO: 102707 - RNA, 64 nt, hsa; identical to SEQ ID NO: 100546

SEQ ID NO: 102708 - RNA, 64 nt, hsa; identical to SEQ ID NO: 100547

SEQ ID NO: 102709 - RNA, 64 nt, hsa; identical to SEQ ID NO: 100548

SEQ ID NO: 102710 - RNA, 64 nt, hsa; identical to SEQ ID NO: 100549

SEQ ID NO: 102711 - RNA, 64 nt, hsa; identical to SEQ ID NO: 100550

SEQ ID NO: 102712 - RNA, 64 nt, hsa; identical to SEQ ID NO: 100551

SEQ ID NO: 102713 - RNA, 64 nt, hsa; identical to SEQ ID NO: 100552

SEQ ID NO: 102714 - RNA, 64 nt, hsa; identical to SEQ ID NO: 100553

SEQ ID NO: 102715 - RNA, 64 nt, hsa; identical to SEQ ID NO: 100554

SEQ ID NO: 102716 - RNA, 64 nt, hsa; identical to SEQ ID NO: 100555

SEQ ID NO: 102717 - RNA, 64 nt, hsa; identical to SEQ ID NO: 100556

SEQ ID NO: 102718 - RNA, 64 nt, hsa; identical to SEQ ID NO: 100557

SEQ ID NO: 102719 - RNA, 64 nt, hsa; identical to SEQ ID NO: 100558

SEQ ID NO: 102720 - RNA, 64 nt, hsa; identical to SEQ ID NO: 100559

SEQ ID NO: 102721 - RNA, 64 nt, hsa; identical to SEQ ID NO: 100560

SEQ ID NO: 102722 - RNA, 64 nt, hsa; identical to SEQ ID NO: 100561

SEQ ID NO: 102723 - RNA, 64 nt, hsa; identical to SEQ ID NO: 100562

SEQ ID NO: 102724 - RNA, 64 nt, hsa; identical to SEQ ID NO: 100563

SEQ ID NO: 102725 - RNA, 64 nt, hsa; identical to SEQ ID NO: 100564

SEQ ID NO: 102726 - RNA, 64 nt, hsa; identical to SEQ ID NO: 100565

SEQ ID NO: 102727 - RNA, 64 nt, hsa; identical to SEQ ID NO: 100566

SEQ ID NO: 102728 - RNA, 64 nt, hsa; identical to SEQ ID NO: 100567

SEQ ID NO: 102729 - RNA, 64 nt, hsa; identical to SEQ ID NO: 100568

SEQ ID NO: 102730 - RNA, 64 nt, hsa; identical to SEQ ID NO: 100569

SEQ ID NO: 102731 - RNA, 64 nt, hsa; identical to SEQ ID NO: 100570

SEQ ID NO: 102732 - RNA, 64 nt, hsa; identical to SEQ ID NO: 100571

SEQ ID NO: 102733 - RNA, 64 nt, hsa; identical to SEQ ID NO: 100572

SEQ ID NO: 102734 - RNA, 64 nt, hsa; identical to SEQ ID NO: 100573

SEQ ID NO: 102735 - RNA, 64 nt, hsa; identical to SEQ ID NO: 100574

SEQ ID NO: 102736 - RNA, 64 nt, hsa; identical to SEQ ID NO: 100575

SEQ ID NO: 102737 - RNA, 60 nt, hsa; identical to SEQ ID NO: 100576

SEQ ID NO: 102738 - RNA, 64 nt, hsa; identical to SEQ ID NO: 100577

SEQ ID NO: 102739 - RNA, 64 nt, hsa; identical to SEQ ID NO: 100578

SEQ ID NO: 102740 - RNA, 64 nt, hsa; identical to SEQ ID NO: 100579

SEQ ID NO: 102741 - RNA, 64 nt, hsa; identical to SEQ ID NO: 100580

SEQ ID NO: 102742 - RNA, 64 nt, hsa; identical to SEQ ID NO: 100581

SEQ ID NO: 102743 - RNA, 64 nt, hsa; identical to SEQ ID NO: 100582

SEQ ID NO: 102744 - RNA, 64 nt, hsa; identical to SEQ ID NO: 100583

SEQ ID NO: 102745 - RNA, 64 nt, hsa; identical to SEQ ID NO: 100584

SEQ ID NO: 102746 - RNA, 64 nt, hsa; identical to SEQ ID NO: 100585

SEQ ID NO: 102747 - RNA, 64 nt, hsa; identical to SEQ ID NO: 100586

SEQ ID NO: 102748 - RNA, 64 nt, hsa; identical to SEQ ID NO: 100587

SEQ ID NO: 102749 - RNA, 64 nt, hsa; identical to SEQ ID NO: 100588

SEQ ID NO: 102750 - RNA, 64 nt, hsa; identical to SEQ ID NO: 100589

SEQ ID NO: 102751 - RNA, 64 nt, hsa; identical to SEQ ID NO: 100590

SEQ ID NO: 102752 - RNA, 64 nt, hsa; identical to SEQ ID NO: 100591

SEQ ID NO: 102753 - RNA, 64 nt, hsa
ggccauuuaaagugagaggggcaccaacagacaauucggggaccuuaggccccuuccugaggca

SEQ ID NO: 102754 - RNA, 64 nt, hsa
accagcacugagcccccucucccuccugcaauaauucggggagucucagccccauccaggugcc

SEQ ID NO: 102755 - RNA, 64 nt, hsa
cuacuggaaaaacacuuaaggagcuaaacuuaccuucggggauuauuagcugauaagguucaca

SEQ ID NO: 102756 - RNA, 64 nt, hsa
cuguugcauuggcaguuaaguuuccacguaaacuuucggggacacauucaaaccacaggagaaa

SEQ ID NO: 102757 - RNA, 64 nt, hsa
uccuuuuccugguguggacucugaagggucagucuucggggaagagaggugggguggggcuacu

SEQ ID NO: 102758 - RNA, 64 nt, hsa
ugaaggagagcccuucauuuggagauuauguucuuucggggagaggcugaggacuuaaaauauu

SEQ ID NO: 102759 - RNA, 64 nt, hsa
aaaaaccauugcaacucacaguaagagacuggguuucggggaaggaggggcuagggacauuuug

SEQ ID NO: 102760 - RNA, 64 nt, hsa
cucugggaggcauuauaauggagggucuucagaguucggggaccaagucuagcagauucucagc

SEQ ID NO: 102761 - RNA, 64 nt, hsa
ggcugugauuaaggcccaacacccagacuacucuuucggggagcucagccgccugguggggaca

SEQ ID NO: 102762 - RNA, 64 nt, hsa
gggccugcagguaucagcuugcucucuuugcacuuucggggaaggaggacucacagugaggaag

SEQ ID NO: 102763 - RNA, 64 nt, hsa
ugcuacauacaggcccccacagcccgccuggauguucggggacccccacaucaccaccuuggau

SEQ ID NO: 102764 - RNA, 64 nt, hsa
agcuaugguuacuaauauguuuguuauauuuauuuucggggagaggaucuuguuauuguuuccu

SEQ ID NO: 102765 - RNA, 64 nt, hsa
caaccucagauuaauccuauuuauuaucuaccuuuucggggaugcugaguucuuugugaugggu

SEQ ID NO: 102766 - RNA, 64 nt, hsa
uacugaagauuucuuagucaguuuuuaggggauuuucggggaggggaaauagguaauguaugga

SEQ ID NO: 102767 - RNA, 64 nt, hsa
cuagggcaacagccaaccuaggagccagcgggcuuucggggaaaaaaaagaaaaagacaucuaa

SEQ ID NO: 102768 - RNA, 64 nt, hsa
gcugguuaccaucuuugcacuggcccuucggagauucggggacucaguucugguggggucaccc

SEQ ID NO: 102769 - RNA, 64 nt, hsa
uuaaaugucugauauaaaacaugccacaggagaauucggggauuugaguuucucugaauagcau

SEQ ID NO: 102770 - RNA, 64 nt, hsa
gggcaacaugauauuuggguagcugaugucauaauucggggacaauuaucucaaucaucaagaa

SEQ ID NO: 102771 - RNA, 64 nt, hsa
uuugagauucuagaacacaugggagcuuuuuauuuucggggaaaaaccguauuuuuuucuuguc

SEQ ID NO: 102772 - RNA, 64 nt, hsa
ccauugaaagacuugaagaauacauauacuuauauucggggauaugaaggauucaaugaaugau

SEQ ID NO: 102773 - RNA, 64 nt, hsa
uggggccacugcagugcaguucaagaggcucugguucggggaagagcuggauggaguaugaauc

SEQ ID NO: 102774 - RNA, 64 nt, hsa
cagcuggaagcuugaguggcaccagggcccgggguucggggauagaagccccgccgagacccca

SEQ ID NO: 102775 - RNA, 64 nt, hsa
gggaucucagcaguggggcaggagggugccugauuucggggaguccugacccgagccuguuguc

SEQ ID NO: 102776 - RNA, 64 nt, hsa
aaacccacugggaaggacaaagaguuugccgccuuucggggauccgagggacuguggcgaccgu

SEQ ID NO: 102777 - RNA, 64 nt, hsa
ggcgcaccugcuguccuggagcuuccgaucucuguucggggacccugugagccuucuggccggc

SEQ ID NO: 102778 - RNA, 64 nt, hsa
ucccaggacuuuguggcugguuuguccgugauucuucggggaacuguagaugacaggcuuaauu

SEQ ID NO: 102779 - RNA, 64 nt, hsa
gaagggcaggcaccaacaacucagaaugggggcuuucggggagggcgccuaguccccccagcuc

SEQ ID NO: 102780 - RNA, 64 nt, hsa
ugaccuguuggacaguacuuuucuuucuuuuuuuuucggggagggguuaaagacaggaucucac

SEQ ID NO: 102781 - RNA, 64 nt, hsa
cuccagcugcucucaauggcuuccagguguguuguucggggacagccaccgccuugagucuggc

SEQ ID NO: 102782 - RNA, 64 nt, hsa
guagcccauguuaagcuucuauuuuuuacuuguuuucggggagaaauaagaauuagacaucuuc

SEQ ID NO: 102783 - RNA, 64 nt, hsa
ggguucgggccuuccggaugcggcuugggcgcucuucggggaccuccguggcgcggaagacccg

SEQ ID NO: 102784 - RNA, 64 nt, hsa
guguugccagugcuaagcugcccugaggguuuccuucggggaccagcccacagcacaccaaggu

SEQ ID NO: 102785 - RNA, 64 nt, hsa
uuauaaaaaaucuauuuguaucuauccuaaccaguucggggauauauuaagauauuuuuguaca

SEQ ID NO: 102786 - RNA, 64 nt, hsa
uggugugugugcauucuuuaaagagccaaguugcuucggggaaacagccaggaaaauggucaag

SEQ ID NO: 102787 - RNA, 64 nt, hsa
gugaaguuuacaagaaggcugcuuaaaugccugcuucggggaaaucucugccucucucucucuc

SEQ ID NO: 102788 - RNA, 64 nt, hsa
guacuaucuuacugagccacagugaugcaugcuuuucggggaaaacuucauucacaaguauucc

SEQ ID NO: 102789 - RNA, 64 nt, hsa
ccaccuucccagcucucccucuggcccugccuucuucggggaacuccuggaaauaucaguuacu

SEQ ID NO: 102790 - RNA, 64 nt, hsa
agagcaccuucccuggcuuccuacucugcccccuuucggggagugcacaacacaauaguugcag

SEQ ID NO: 102791 - RNA, 64 nt, hsa
guuccuggaagcaggugcuacaacaugugaggcauucggggaagcugcacaugugccacacagu

SEQ ID NO: 102792 - RNA, 64 nt, hsa
ggggaugagaaccuuccugcugugaugugacaccuucggggacauugaccacucaaaacucaga

SEQ ID NO: 102793 - RNA, 64 nt, hsa
gauuacccugcccagcaggaacuggaauacaguguucggggagaaggccaaaugauauccuuga

SEQ ID NO: 102794 - RNA, 64 nt, hsa
acgguuuuguuuuuuacugguuuguguuuauauuuucggggauacuuaauaaaucuauugcugu

SEQ ID NO: 102795 - RNA, 64 nt, hsa
uguguguguguguguguguguguguguguguguguucggggagagggugguagcacagggcuug

SEQ ID NO: 102796 - RNA, 64 nt, hsa
guuuugccugacagccauuugaauguuaggaagcuucggggagacaaguuuugagagaagcccc

SEQ ID NO: 102797 - RNA, 64 nt, hsa
aacagcagcugggcuggguucccagucggagccuuucggggaucugggggaugagggcggaagg

SEQ ID NO: 102798 - RNA, 64 nt, hsa
gggaaugcgcucuggaaacacccuuccggaacccuucggggaaaaggagaccauccuuggagug

SEQ ID NO: 102799 - RNA, 64 nt, hsa
uuguugucuuuuacuuuuguuuuuaaccuggggguucggggagaggcccugcuugggaacaucu

SEQ ID NO: 102800 - RNA, 64 nt, hsa
auuguuuucaaagugauggucagacccuccaggcuucggggaaauguggguuugcuggucucuc

SEQ ID NO: 102801 - RNA, 64 nt, hsa
uuugguagcaaggguccagagaugagguguuuuuuucggggagcuaauaacaaaaacauuuuaa

SEQ ID NO: 102802 - RNA, 64 nt, hsa
uuguagucuaccugcaugugaucuauguugacauuucggggauauuguguucaagaaugauucc

SEQ ID NO: 102803 - RNA, 64 nt, hsa
auauccauuuuuuucuuaaguucgggaaacaaaguucggggaaaauaccuggcaugaaacugua

SEQ ID NO: 102804 - RNA, 64 nt, hsa
gggcugucggccuuggcccccugcuggucgcuguuucggggacucggggcggccaguaccaccg

SEQ ID NO: 102805 - RNA, 64 nt, hsa
cagcucucuacggcagguccgggagggcuggggcuucggggagcccuacccgccaaaccugcug

SEQ ID NO: 102806 - RNA, 64 nt, hsa
uacucgggaaauuugcuuuugccaaacccgcuuuuucggggaucccgcgccccccuccucacuu

SEQ ID NO: 102807 - RNA, 64 nt, hsa
agcgcccccacucccggccgcgagcaggcagggcuucggggacgcggggcgcuucucgggcggg

SEQ ID NO: 102808 - RNA, 64 nt, hsa
gcuuuaaacaucucugguuccuaguuucugauuauucggggaugggggggaugggaggggacag

SEQ ID NO: 102809 - RNA, 64 nt, hsa
ggguguggugguacgugccuguagucccagcuacuucggggacugaggugggaggaucacuuga

SEQ ID NO: 102810 - RNA, 64 nt, hsa
aagcaguauagacuccaccuuccaggauguccauuucggggagaggagcaggugggacccucaa

SEQ ID NO: 102811 - RNA, 64 nt, hsa
gaaagaaagggcgguggcucgggagguuccggccuucggggaccagacuugcugccaagggcuu

SEQ ID NO: 102812 - RNA, 64 nt, hsa
uaggauuuacuagcaagcuaauggaaacaugauuuucggggaagaaaaacuacagaaaauguag

SEQ ID NO: 102813 - RNA, 64 nt, hsa
aagauauacaccaaacuguuaaaugugguuucucuucggggagggggggauugggggaggggcc

SEQ ID NO: 102814 - RNA, 64 nt, hsa
ggucagaacugugugguugguuugagggagcgaauucggggaaggcacuuggugauauaacuuu

SEQ ID NO: 102815 - RNA, 64 nt, hsa
ucuucauuuuacagugaugaguacauaugcauguuucggggacuuggcccuucugaugaggggc

SEQ ID NO: 102816 - RNA, 64 nt, hsa
gaaacuauucccccuaagacuguucaacuuguagauacaucaacuuugaaauuauuccauuuua

SEQ ID NO: 102817 - RNA, 64 nt, hsa
uaccuugugccuuuggcacaaaugugcagaauagauacaucaguuggugcauaaucgaaaaaaa

SEQ ID NO: 102818 - RNA, 64 nt, hsa
ucgacauagaaccucagcuguuaaccaaggggaaauacaucagaucugcaacacagaaaugcuc

SEQ ID NO: 102819 - RNA, 64 nt, hsa
ggcuugggcuauggucuccaaagauccuucaaaaauacaucaagccagcuucauucacucacuu

SEQ ID NO: 102820 - RNA, 64 nt, hsa
uaaaugauagguaugaaauagaauaagaaguaaaauacaucagcagauuuucauacuaguaugu

SEQ ID NO: 102821 - RNA, 64 nt, hsa
ucagugaaauuauggaaaauuacuuaaaacgugaauacaucaucacaguagaauuuauuaugag

SEQ ID NO: 102822 - RNA, 64 nt, hsa
uccauacuguuuaauauuuauagaguucauagaaauacaucaauaagcuccuaaauuauagagc

SEQ ID NO: 102823 - RNA, 64 nt, hsa
auaugacuuugaauaaaauaaagcuaccauguuaauacaucauuuuuuguuucuuccuaauuaa

SEQ ID NO: 102824 - RNA, 59 nt, hsa
ugccaagugccagcuguuacacauggagaggaaaugauuccuuauauuaaaccugacca

SEQ ID NO: 102825 - RNA, 59 nt, hsa
gaaaaaaugaaaaagcagggacaacaggaggaaaugaaggcagagaaauauaguuuccu

SEQ ID NO: 102826 - RNA, 59 nt, hsa
guuauccuaguuugaacaggauauguucaggaaaugaaaggugaauuaugccccuuauu

SEQ ID NO: 102827 - RNA, 59 nt, hsa
auuugacauuucguagguguaagagaaauggaaaugaaugguuucaacaaagaucauuu

SEQ ID NO: 102828 - RNA, 59 nt, hsa
auauuuccguaccccugaggaaacaaaaaggaaaugaggagagaaaguuacuguuaagg

SEQ ID NO: 102829 - RNA, 59 nt, hsa
auucauucuacgggauauuauucaguaguggaaaugagugaacuacagcuauaccucac

SEQ ID NO: 102830 - RNA, 59 nt, hsa
acaauaaagaccuccaaggguacuucuuuggaaaugaaauguagcacaaucuuagccua

SEQ ID NO: 102831 - RNA, 59 nt, hsa
acaggacaagaaguggguaagggcaggaaggaaaugaacggaguuagcucccaggcucc

SEQ ID NO: 102832 - RNA, 59 nt, hsa
gauuccaggaaauaccgauaugagaauggggaaaugaaaccaggaagggaagagagcua

SEQ ID NO: 102833 - RNA, 59 nt, hsa
gcacaugcugcccagcacauguccaccugggaaaugagaugccaucgucacauucauuu

SEQ ID NO: 102834 - RNA, 59 nt, hsa
aucuuacgugaccaagaaaccacguuaggggaaaugaaaaaagcaagccacaauaccau

SEQ ID NO: 102835 - RNA, 59 nt, hsa
gauuccuuccauuuucaacaguagaugaaggaaaugauacugaaugagucacaguguuc

SEQ ID NO: 102836 - RNA, 59 nt, hsa
ugauccucauuguguucaggcaaaaaauaggaaaugaguaauuuugaguuugaaaucuc

SEQ ID NO: 102837 - RNA, 59 nt, hsa
uugcugucuuuuuacacuguaugcgguuuggaaaugaauguagaaacuuacugugggca

SEQ ID NO: 102838 - RNA, 59 nt, hsa
aaauuacauuaaguauuaaugaggggaaaggaaaugagcucuacgaggauuucacccug

SEQ ID NO: 102839 - RNA, 59 nt, hsa
agugugcaugguucaaucccucacauccaggaaaugaauuuugcaauugggccagaugc

SEQ ID NO: 102840 - RNA, 59 nt, hsa
ugccacuagaguugaaagauaagggaacaggaaaugaaugcauugugguaauuuagaau

SEQ ID NO: 102841 - RNA, 59 nt, hsa
cuucucuggagauccagcauuccuuauuuggaaaugacuuuguuuaugugucuaucccu

SEQ ID NO: 102842 - RNA, 59 nt, hsa
aaaaauggcuuaucugaaaucaguacuguggaaaugaacuauauuagcuauuaugaaua

SEQ ID NO: 102843 - RNA, 59 nt, hsa
gaaaaucugcuggccagcuauguccucuaggaaaugacagacccaaccaccagcaauaa

SEQ ID NO: 102844 - RNA, 59 nt, hsa
auuuaugaaauuuuguacuaaaaucauuuggaaaugauuguauuguaaacugaggcuaa

SEQ ID NO: 102845 - RNA, 59 nt, hsa
caauuuuuauacagaaaaugagucauuuuggaaaugauucuuauguuuuuuuuuuuucu

SEQ ID NO: 102846 - RNA, 59 nt, hsa
uucaugucuguacagauuauuuaaaucauggaaaugaaaaaaauguucucugcuugcua

SEQ ID NO: 102847 - RNA, 59 nt, hsa
cucugcuugcuaccaaaggacaaacucuuggaaaugaacacuuucugcuuuccuuccuc

SEQ ID NO: 102848 - RNA, 59 nt, hsa
aggacuugauauucauaauucagugcuguggaaaugaaaaaaaugauugaagaggugga

SEQ ID NO: 102849 - RNA, 59 nt, hsa
aaugaaaaaaaugauugaagagguggaacggaaaugaccuuagggggaaaaaaaaggac

SEQ ID NO: 102850 - RNA, 59 nt, hsa
auggacuuuucugggaaaugacuuuucugggaaaugacaguuucuuugacauauuuucu

SEQ ID NO: 102851 - RNA, 59 nt, hsa
aauccauguagaagucauggacuuuucugggaaaugacuuuucugggaaaugacaguuu

SEQ ID NO: 102852 - RNA, 59 nt, hsa
uugaguuuaaaggaauugaaauuacuucaggaaaugaauauaaaauagguucacaguua

SEQ ID NO: 102853 - RNA, 59 nt, hsa
uuuguuuuucuuuuguaccuagucucauuggaaaugacuaguauucugccucauuuuca

SEQ ID NO: 102854 - RNA, 59 nt, hsa
ccaacuagaugcuuguuggccacgggaagggaaaugacuuguucuaauucuagguucac

SEQ ID NO: 102855 - RNA, 59 nt, hsa
uggcagcuguuuuauugccauucaacuagggaaaugaagaaaucacgcagccuuuuggu

SEQ ID NO: 102856 - RNA, 59 nt, hsa
uugaaggaucuguacgagaaaaacaaaaaggaaaugaauauucaacagcucaccaacua

SEQ ID NO: 102857 - RNA, 59 nt, hsa
acagccugcacacaccugccugcagagcaggaaaugagagauagaggaugggcagcugg

SEQ ID NO: 102858 - RNA, 59 nt, hsa
ugcacauugucauguuauaccaccauucuggaaaugauuucuguggauuugaaauugca

SEQ ID NO: 102859 - RNA, 59 nt, hsa
gauaagugugaauguuuuauacagaaaauggaaaugauacauuucucuuguuagguguu

SEQ ID NO: 102860 - RNA, 59 nt, hsa
gaauugauuuuuaaacacauauaacaguaggaaaugaauaaaugggcuucugcauuugg

SEQ ID NO: 102861 - RNA, 59 nt, hsa
auuuuauuaugucugucuuaucaugcaauggaaaugaugcuuuuuguaaguaugcaucu

SEQ ID NO: 102862 - RNA, 59 nt, hsa
uccuggccuuuccugguuuucaucaggaaggaaaugacaccaaauauguccgcagaaug

SEQ ID NO: 102863 - RNA, 59 nt, hsa
aggguaacugugcugaaugcuuuagaugaggaaaugauccccaaguggugaaugacacg

SEQ ID NO: 102864 - RNA, 59 nt, hsa
acagaagaagucguugaugugauuuuugaggaaaugacagaugugacuuuggaaccaaa

SEQ ID NO: 102865 - RNA, 59 nt, hsa
uaaccacagguuguguucauucuuuuccuggaaaugaugacuuuauugcuuagaaaguu

SEQ ID NO: 102866 - RNA, 59 nt, hsa
agcuaaaauggguuauuuauaggacugauggaaaugauuucaucucugccaucucuaaa

SEQ ID NO: 102867 - RNA, 59 nt, hsa
uaggggaaggaaauuuacaagauuuaauaggaaaugaaacagcuugaauuucaaacuaa

SEQ ID NO: 102868 - RNA, 59 nt, hsa
uauacuugguacuugcucuagaacauuugggaaaugacaaacucaggcuggcucuccuc

SEQ ID NO: 102869 - RNA, 59 nt, hsa
uuuuuuaaguucacuuuuuuuguucuaggggaaaugaaugugcaaaaaaagaaaaagaa

SEQ ID NO: 102870 - RNA, 59 nt, hsa
cagauaaacagaaaugcucugauuagaaaggaaaugaaugguuccacucaaauguccug

SEQ ID NO: 102871 - RNA, 59 nt, hsa
acauuaaaagaacuuaaaaaguaauuuuuggaaaugaggcuucaauuagaauuauuuuu

SEQ ID NO: 102872 - RNA, 59 nt, hsa
uaugaaaaaauacccaauauauauuuuuuggaaaugaaacauuaaaagaacuuaaaaag

SEQ ID NO: 102873 - RNA, 59 nt, hsa
acguuuauugucaaggggaguuuuuacauggaaaugacaaugggaaaauucagauauuu

SEQ ID NO: 102874 - RNA, 59 nt, hsa
cggaagggggaggagugcucaacggggagggaaaugaucuaugacuccaaccguaugau

SEQ ID NO: 102875 - RNA, 59 nt, hsa
cuuccaguugccuuagggacagagacaaaggaaaugaagagaccucagacaucuuuucc

SEQ ID NO: 102876 - RNA, 64 nt, hsa
acacgccuguaguccaggccacucgagcacacaccuguaguaccagcuacucuggaggcugagg

SEQ ID NO: 102877 - RNA, 64 nt, hsa
ggcaggaggaucacuugagcccaggagauuaagacuguaguauacuaugaucgugccuguggcu

SEQ ID NO: 102878 - RNA, 64 nt, hsa
augcaaaacaaucuaucccagguucuguucugguuggcuacauuguucagcaacucacaaaacg

SEQ ID NO: 102879 - RNA, 64 nt, hsa
cuguugaguaacuccuccuuuacuuuuuuccugcuggcuacagcauggggugcccuauaggcac

SEQ ID NO: 102880 - RNA, 64 nt, hsa
agaaggaaggcuccaaacggaaaaucaacaugaguggcuacauccuguucagcagugagaugag

SEQ ID NO: 102881 - RNA, 64 nt, hsa
uguugguuuuaccgaccaaaugaaacauuccaccuggcuacacgaaaauuucuagaaaaagaag

SEQ ID NO: 102882 - RNA, 64 nt, hsa
uguuuccagugcaagagaagggaaauacuaggaacuaagacauuucuaauuuauugcuuauuac

SEQ ID NO: 102883 - RNA, 64 nt, hsa
aucuuuccagauaucuuaaggguaaaagcuuauucuaagacagucuguccauugagaauauuag

SEQ ID NO: 102884 - RNA, 64 nt, hsa
cuuacaguugaaaacagauucucauaucaaguagcuaagacaaaaguuuuuuucaagaauugaa

SEQ ID NO: 102885 - RNA, 64 nt, hsa
uggggaauuugcccuuuuaauaauuuccaguccccuaagacaaaguaacccucaacguuuuauc

SEQ ID NO: 102886 - RNA, 64 nt, hsa
aaauaaugcaacgcaggaggagaaaagaaaugcacuaagacaagaacauucucucauagaacau

SEQ ID NO: 102887 - RNA, 64 nt, hsa
uguacauaauugcaugaaaauagcuauuuuuuuccuaagacauuuuucauucaugaauauuuuc

SEQ ID NO: 102888 - RNA, 64 nt, hsa
ggaagcucaugccuguaauuauaaccuucagcuacuaagacaggugugguggcucacgccugug

SEQ ID NO: 102889 - RNA, 64 nt, hsa
gguggcucacgccugugauuauaaucuucaguuacuaagacagaguccaugagaguguuaaugg

SEQ ID NO: 102890 - RNA, 64 nt, hsa
guguucuaaagccuucccugauuacaguucuugucuaagacaugaaaaaacucacacuggagag

SEQ ID NO: 102891 - RNA, 64 nt, hsa
guguucuaaagccuuucauuuuuacaguucuuaucuaagacaugaaagaacacguacuggggag

SEQ ID NO: 102892 - RNA, 64 nt, hsa; identical to SEQ ID NO: 50174

SEQ ID NO: 102893 - RNA, 64 nt, hsa; identical to SEQ ID NO: 50175

SEQ ID NO: 102894 - RNA, 64 nt, hsa; identical to SEQ ID NO: 50176

SEQ ID NO: 102895 - RNA, 64 nt, hsa; identical to SEQ ID NO: 50177

SEQ ID NO: 102896 - RNA, 64 nt, hsa; identical to SEQ ID NO: 50178

SEQ ID NO: 102897 - RNA, 64 nt, hsa; identical to SEQ ID NO: 50179

SEQ ID NO: 102898 - RNA, 64 nt, hsa; identical to SEQ ID NO: 50180

SEQ ID NO: 102899 - RNA, 64 nt, hsa; identical to SEQ ID NO: 50181

SEQ ID NO: 102900 - RNA, 64 nt, hsa; identical to SEQ ID NO: 50182

SEQ ID NO: 102901 - RNA, 64 nt, hsa; identical to SEQ ID NO: 50183

SEQ ID NO: 102902 - RNA, 64 nt, hsa; identical to SEQ ID NO: 50184

SEQ ID NO: 102903 - RNA, 64 nt, hsa; identical to SEQ ID NO: 50185

SEQ ID NO: 102904 - RNA, 64 nt, hsa; identical to SEQ ID NO: 50186

SEQ ID NO: 102905 - RNA, 64 nt, hsa; identical to SEQ ID NO: 50187

SEQ ID NO: 102906 - RNA, 64 nt, hsa; identical to SEQ ID NO: 50188

SEQ ID NO: 102907 - RNA, 64 nt, hsa; identical to SEQ ID NO: 50189

SEQ ID NO: 102908 - RNA, 64 nt, hsa; identical to SEQ ID NO: 50190

SEQ ID NO: 102909 - RNA, 64 nt, hsa; identical to SEQ ID NO: 50191

SEQ ID NO: 102910 - RNA, 64 nt, hsa; identical to SEQ ID NO: 50192

SEQ ID NO: 102911 - RNA, 64 nt, hsa; identical to SEQ ID NO: 50193

SEQ ID NO: 102912 - RNA, 64 nt, hsa; identical to SEQ ID NO: 50194

SEQ ID NO: 102913 - RNA, 64 nt, hsa; identical to SEQ ID NO: 50195

SEQ ID NO: 102914 - RNA, 64 nt, hsa; identical to SEQ ID NO: 50196

SEQ ID NO: 102915 - RNA, 64 nt, hsa; identical to SEQ ID NO: 50197

SEQ ID NO: 102916 - RNA, 64 nt, hsa; identical to SEQ ID NO: 50198

SEQ ID NO: 102917 - RNA, 64 nt, hsa; identical to SEQ ID NO: 50199

SEQ ID NO: 102918 - RNA, 64 nt, hsa; identical to SEQ ID NO: 50200

SEQ ID NO: 102919 - RNA, 64 nt, hsa; identical to SEQ ID NO: 50201

SEQ ID NO: 102920 - RNA, 64 nt, hsa; identical to SEQ ID NO: 50202

SEQ ID NO: 102921 - RNA, 64 nt, hsa; identical to SEQ ID NO: 50203

SEQ ID NO: 102922 - RNA, 64 nt, hsa; identical to SEQ ID NO: 50204

SEQ ID NO: 102923 - RNA, 64 nt, hsa; identical to SEQ ID NO: 50205

SEQ ID NO: 102924 - RNA, 64 nt, hsa; identical to SEQ ID NO: 50206

SEQ ID NO: 102925 - RNA, 64 nt, hsa; identical to SEQ ID NO: 50207

SEQ ID NO: 102926 - RNA, 64 nt, hsa; identical to SEQ ID NO: 50208

SEQ ID NO: 102927 - RNA, 64 nt, hsa; identical to SEQ ID NO: 50209

SEQ ID NO: 102928 - RNA, 64 nt, hsa; identical to SEQ ID NO: 50210

SEQ ID NO: 102929 - RNA, 64 nt, hsa; identical to SEQ ID NO: 50211

SEQ ID NO: 102930 - RNA, 64 nt, hsa; identical to SEQ ID NO: 50212

SEQ ID NO: 102931 - RNA, 64 nt, hsa; identical to SEQ ID NO: 50213

SEQ ID NO: 102932 - RNA, 64 nt, hsa; identical to SEQ ID NO: 50214

SEQ ID NO: 102933 - RNA, 64 nt, hsa; identical to SEQ ID NO: 50215

SEQ ID NO: 102934 - RNA, 64 nt, hsa; identical to SEQ ID NO: 50216

SEQ ID NO: 102935 - RNA, 64 nt, hsa; identical to SEQ ID NO: 50217

SEQ ID NO: 102936 - RNA, 64 nt, hsa; identical to SEQ ID NO: 50218

SEQ ID NO: 102937 - RNA, 64 nt, hsa; identical to SEQ ID NO: 50219

SEQ ID NO: 102938 - RNA, 64 nt, hsa; identical to SEQ ID NO: 50220

SEQ ID NO: 102939 - RNA, 64 nt, hsa; identical to SEQ ID NO: 50221

SEQ ID NO: 102940 - RNA, 64 nt, hsa; identical to SEQ ID NO: 50222

SEQ ID NO: 102941 - RNA, 64 nt, hsa; identical to SEQ ID NO: 50223

SEQ ID NO: 102942 - RNA, 64 nt, hsa; identical to SEQ ID NO: 50224

SEQ ID NO: 102943 - RNA, 64 nt, hsa; identical to SEQ ID NO: 50225

SEQ ID NO: 102944 - RNA, 64 nt, hsa; identical to SEQ ID NO: 50226

SEQ ID NO: 102945 - RNA, 64 nt, hsa; identical to SEQ ID NO: 50227

SEQ ID NO: 102946 - RNA, 64 nt, hsa; identical to SEQ ID NO: 50228

SEQ ID NO: 102947 - RNA, 64 nt, hsa; identical to SEQ ID NO: 50229

SEQ ID NO: 102948 - RNA, 64 nt, hsa; identical to SEQ ID NO: 50230

SEQ ID NO: 102949 - RNA, 64 nt, hsa; identical to SEQ ID NO: 50231

SEQ ID NO: 102950 - RNA, 64 nt, hsa; identical to SEQ ID NO: 50232

SEQ ID NO: 102951 - RNA, 64 nt, hsa; identical to SEQ ID NO: 50233

SEQ ID NO: 102952 - RNA, 64 nt, hsa; identical to SEQ ID NO: 50234

SEQ ID NO: 102953 - RNA, 64 nt, hsa; identical to SEQ ID NO: 50235

SEQ ID NO: 102954 - RNA, 64 nt, hsa; identical to SEQ ID NO: 50236

SEQ ID NO: 102955 - RNA, 64 nt, hsa; identical to SEQ ID NO: 50237

SEQ ID NO: 102956 - RNA, 64 nt, hsa; identical to SEQ ID NO: 50238

SEQ ID NO: 102957 - RNA, 64 nt, hsa; identical to SEQ ID NO: 50239

SEQ ID NO: 102958 - RNA, 64 nt, hsa; identical to SEQ ID NO: 50240

SEQ ID NO: 102959 - RNA, 64 nt, hsa; identical to SEQ ID NO: 50241

SEQ ID NO: 102960 - RNA, 64 nt, hsa; identical to SEQ ID NO: 50242

SEQ ID NO: 102961 - RNA, 64 nt, hsa; identical to SEQ ID NO: 50243

SEQ ID NO: 102962 - RNA, 64 nt, hsa
aagugucauuaggauuguugcugccagaacugauaugcaugaauggcacuuaaaauaaauauau

SEQ ID NO: 102963 - RNA, 64 nt, hsa
ggccugcuguuucuguugucuuguaugucuguguaugcaugacauuuggucccuuucuuugaaa

SEQ ID NO: 102964 - RNA, 64 nt, hsa
uugcucuuguuaaagauuuguuugaauauagaagaugcaugauuucuggguuuuuuuuuuuuuu

SEQ ID NO: 102965 - RNA, 64 nt, hsa
auuacaggcauaagccacugcgcccagccagaagaugcaugauuucuuaggaucauaugcuguu

SEQ ID NO: 102966 - RNA, 54 nt, hsa
agaaggacuauagaucauaaggcaaugcaugaaccacagaagcugcaugguuaa

SEQ ID NO: 102967 - RNA, 64 nt, hsa
ugguucuauaaucauauuauaugcacuaaacuauaugcaugaaaguucuuugcauggauuaaug

SEQ ID NO: 102968 - RNA, 64 nt, hsa
aucaguuuuccuccugcucccagaauguccugugaugcaugauucuaagaacuggaagaaccug

SEQ ID NO: 102969 - RNA, 64 nt, hsa
uuuccagaugucagaaaagaaagcauacaugcuuaugcaugaaacaauucugcaaaaaaaggau

SEQ ID NO: 102970 - RNA, 64 nt, hsa
uuucuguggaagaguaagaacauuaaaaugaaagaugcaugaugaaaaucuaaguagagaggcu

SEQ ID NO: 102971 - RNA, 64 nt, hsa
agaggcucuugugguuaacugauaauauugagugaugcaugagguagguguucagaguaauauu

SEQ ID NO: 102972 - RNA, 64 nt, hsa
uguucuuaaacaguauaaauaguuguaaguuugcaugcaugauggaaaaauaaaaaccuguauc

SEQ ID NO: 102973 - RNA, 64 nt, hsa
ugauguucugcagaauggcacuugacugcugggcaugcaugaaguuaagggcaagaaacaguau

SEQ ID NO: 102974 - RNA, 64 nt, hsa
agcauaacuaugugggcaaaauagauagaauuaaaugcaugaauuuuccucagacuuauuuuau

SEQ ID NO: 102975 - RNA, 64 nt, hsa
gcuaauacucugacagaaaaaaaucuuggauaauaugcaugagaaaaauccuucaauaaacaca

SEQ ID NO: 102976 - RNA, 64 nt, hsa
ugaaucuucuuuuauuucuaggcuguacagucugaugcaugauuuuuuuauaaauauuucauac

SEQ ID NO: 102977 - RNA, 64 nt, hsa
aucagaugcuuuuuuuuucuucuuaccaucauuuaugcaugacauagguaaugugacuaauuuc

SEQ ID NO: 102978 - RNA, 64 nt, hsa
gaaguagaaggaauuuccagauauuggaaacaguaugcaugaagacaugaaggcaagaaacagc

SEQ ID NO: 102979 - RNA, 64 nt, hsa
uuuuaaaaguuaaguccauucuaauuacccaaauaugcaugaauucauucuccuuuugagaagu

SEQ ID NO: 102980 - RNA, 63 nt, hsa
agaccguacucaguaacaggccggaaaauugugcucuagaagaauaaaacugaaaaacucuag

SEQ ID NO: 102981 - RNA, 63 nt, hsa
cauaagguaaacauucuauauauucuaugccugcucuagaauugaaagacuucagcaguauua

SEQ ID NO: 102982 - RNA, 63 nt, hsa
cuccacaucugccuuaaaaccaaagagggcuuccucuagaagccaagggaaaggggugcuuuu

SEQ ID NO: 102983 - RNA, 63 nt, hsa
aggaacauuauggagagaaaggguacugaggcacucuagaaucugccacauucauuuucaaau

SEQ ID NO: 102984 - RNA, 63 nt, hsa
aggcagcuggaauuggaacucagauuuguugaacucuagaacuaaagaucauaauguugucuu

SEQ ID NO: 102985 - RNA, 63 nt, hsa
uucagaguucaaggaagaagcaaaauaucacaucucuagaaguguugggaaaaauauaauuuc

SEQ ID NO: 102986 - RNA, 63 nt, hsa
acuccuaaguuauuucucauagaacccagccuacucuagaauuucagcagugacauuggagaa

SEQ ID NO: 102987 - RNA, 63 nt, hsa
aaauacaccagcucauuuggcugcucagucuaacucuagaauggaugcuuuugaauucauuuc

SEQ ID NO: 102988 - RNA, 63 nt, hsa
uagagaggaauuaacuuccuggucugugcccuucucuagaagaauauaagaugcuccuccucc

SEQ ID NO: 102989 - RNA, 63 nt, hsa
gcugggaggaaagugcugggcaucuuacaguaacucuagaaguuccuuugacuaggcugcaau

SEQ ID NO: 102990 - RNA, 63 nt, hsa
cugaagccauuggagagcugucuuccuguguaccucuagaaucccagcagcagagaaccauca

SEQ ID NO: 102991 - RNA, 58 nt, hsa
gcccuuccuucgcccgcuaacaccacuccucuagaacucggugguaaugacugggagg

SEQ ID NO: 102992 - RNA, 63 nt, hsa
agaaguauguggacaucucuucuuuuccugucccucuagaagaacauucucccuugcuugaug

SEQ ID NO: 102993 - RNA, 63 nt, hsa
uuaagauccucacagcacgggagcagggagaggcucuagaacaagguuucacaaccgagaugc

SEQ ID NO: 102994 - RNA, 63 nt, hsa
cucauuacccuuuucuggguuugaagcugcugucucuagaagugccaucucaauugugcuuug

SEQ ID NO: 102995 - RNA, 63 nt, hsa
uguccagaccauugucuuccaaccccagcuggccucuagaacacccacuggccaguccuagag

SEQ ID NO: 102996 - RNA, 63 nt, hsa
uguuaucaaggaauuguacugugcuacaauuaucucuagaaucuccagaaagguggagggcug

SEQ ID NO: 102997 - RNA, 63 nt, hsa
aguccugauccuaacccugggcucccuggaggacucuagaagcucagguucccugccacacua

SEQ ID NO: 102998 - RNA, 63 nt, hsa
ucuguuuugcccaggggcucccgcuuuuucuugcucuagaagagcaguauucaaccuuuuagc

SEQ ID NO: 102999 - RNA, 63 nt, hsa
cagacuauggauguguucucuaggccuucaggacucuagaauguccauauuuauuuuuauguu

SEQ ID NO: 103000 - RNA, 63 nt, hsa
caguaacaaacuccagucuguugcaguaacaaacucuagaauauugacauucucuguggggga

SEQ ID NO: 103001 - RNA, 63 nt, hsa
ucccucuuagcuguagucuauauuagggcaguucucuagaacgcccacauuuccaccaacuca

SEQ ID NO: 103002 - RNA, 63 nt, hsa
cuaguagguucugcuguuaugcagagccauuuccucuagaauuuggauaauaaagaugcuuau

SEQ ID NO: 103003 - RNA, 63 nt, hsa
augacaauguagcuugaaagcgaugaagaaugucucuagaagagaaugaaggauugaagaauu

SEQ ID NO: 103004 - RNA, 63 nt, hsa
ugaauauauugguugcucauuuuugaagagagucucuagaauauagauuuucacuucuuuuga

SEQ ID NO: 103005 - RNA, 63 nt, hsa
augauaugauaauccuaccaauuuucaagaagucucuagaaagagauaacacauggaaagacg

SEQ ID NO: 103006 - RNA, 63 nt, hsa
gccagccauauuacucuagucccuaccaaacugcucuagaaggucauuuccauuuuguuugug

SEQ ID NO: 103007 - RNA, 63 nt, hsa
auugaaaguaagaaaacggauuuaggaugaaaacucuagaacuacccuaugcuguuuauacug

SEQ ID NO: 103008 - RNA, 63 nt, hsa
cuacagucagauuuauagccagccaucuaucaccucuagaagguuccagagacagugaaacug

SEQ ID NO: 103009 - RNA, 63 nt, hsa
uccucuuuaaaaaaaaaaaaguuuuuguuauaucucuagaacauuucaagucuuuuccuuuuu

SEQ ID NO: 103010 - RNA, 63 nt, hsa
cacagaacguauagaguuaaccaaagugcucuucucuagaaucuuuacaccuccugugugguu

SEQ ID NO: 103011 - RNA, 63 nt, hsa
aguccccuaaauuucuguucuaguuuuaaauuucucuagaacuugcaauaguuggggguuuua

SEQ ID NO: 103012 - RNA, 63 nt, hsa
gucucggccuccacauuaaccauaggauguugacucuagaaccuggacccacccagcgcgucc

SEQ ID NO: 103013 - RNA, 63 nt, hsa
uuuaauuuucuugugagauaauauucuaagaggcucuagaaacaugaaauacucaguagugau

SEQ ID NO: 103014 - RNA, 53 nt, hsa
ucauaagcuccccuuccuaaucacucuagaagcugauuccccaaagguaagac

SEQ ID NO: 103015 - RNA, 63 nt, hsa
aggacaccauguacuauaaccaguuaaauggaacucuagaauaucaagggagcaagaggaagc

SEQ ID NO: 103016 - RNA, 63 nt, hsa
aaucaaaaacaaagaagcccuauaagaccauuucucuagaacagauguucuuaauauuuuucu

SEQ ID NO: 103017 - RNA, 63 nt, hsa
uggagcauguggucuuuuuaaaaaauuguaacccucuagaaaauaucaaagaaaugaaccaga

SEQ ID NO: 103018 - RNA, 63 nt, hsa
aguuacugagaauuguugugcuuugacaguuaacucuagaaagaaagaacacuaccacugcaa

SEQ ID NO: 103019 - RNA, 63 nt, hsa
agaaaaaaguacugugaccugagagacacccuccucuagaauuuaguggcgggucugggcugg

SEQ ID NO: 103020 - RNA, 63 nt, hsa
cugaaacacauguguaacaaucaaaauggugggcucuagaaugguuuuggagcucgagaucuu

SEQ ID NO: 103021 - RNA, 63 nt, hsa
ggucuccauucaggcaaguguguuucagcaaaucucuagaaauuuacauugauuaaaauguua

SEQ ID NO: 103022 - RNA, 63 nt, hsa
uuugauaauuguuauuuuuuuggcagauaauuccucuagaauguguaucuuuuuaugauuuag

SEQ ID NO: 103023 - RNA, 63 nt, hsa
ugacccaacauuucuuagcaugagcuaccucaucucuagaagcugggauggacuuacuauucu

SEQ ID NO: 103024 - RNA, 63 nt, hsa
gaaacaccuuaaguguauacuguuguguaaugucucuagaaaggaauccugucuuaaaacugg

SEQ ID NO: 103025 - RNA, 63 nt, hsa
cugcuaccuaaaggauauaaagaaauacuauugcucuagaauguauuacuuuguucucccaug

SEQ ID NO: 103026 - RNA, 63 nt, hsa
ggccuagaaccaguuuuaagauuaugccuacaucucuagaagacuaguacacuggcaucaucu

SEQ ID NO: 103027 - RNA, 63 nt, hsa
gccugggcccaaggggugaugaggcauccuuuccucuagaagaccugagucuuccugaccgac

SEQ ID NO: 103028 - RNA, 63 nt, hsa
cuagacaaaaaccauuguugaugaggcagaugccucuagaagagacguuuaaaagccaucaaa

SEQ ID NO: 103029 - RNA, 63 nt, hsa
aaguuccacaucaucuuaucgaucaagaagcuacucuagaagucggagcagaggaugguacag

SEQ ID NO: 103030 - RNA, 63 nt, hsa
uguccuguugccaaacaaaagccagucauguaacucuagaagcagugacugguggggcuuucu

SEQ ID NO: 103031 - RNA, 63 nt, hsa
gugaugcuucuggggcacguugaccauaugcaccucuagaaccuaaccagggcuuccuucuac

SEQ ID NO: 103032 - RNA, 63 nt, hsa
gagagcguuccuugaguccguacaccguccucccucuagaagcuggcaucacacucaugcugg

SEQ ID NO: 103033 - RNA, 63 nt, hsa
uaugaaguuccccaaggaaacgaacaaaaugaacucuagaauaucuagcaaauaguuaaagaa

SEQ ID NO: 103034 - RNA, 63 nt, hsa
ugcauggaagagaacaccucuuuauggcuuacccucuagaauuucuaauuuauguguucuguu

SEQ ID NO: 103035 - RNA, 63 nt, hsa
agcaccugggucccagcaucuagagcauggagccucuagaagccaugcucacccgcccacauu

SEQ ID NO: 103036 - RNA, 63 nt, hsa
caucaggaaagagagcaccacgugauggaguuucucuagaagcuccagugauaagagauguug

SEQ ID NO: 103037 - RNA, 63 nt, hsa
aagugugacucaaucuugccugccuucugggagcucuagaauuguucccaacccaguccaugg

SEQ ID NO: 103038 - RNA, 63 nt, hsa
ucccuuccccagagaccuucagugccauccugacucuagaaggccccccacagcagggcguag

SEQ ID NO: 103039 - RNA, 63 nt, hsa
ccuugaaagaaccgaagucuuucccauucacuucucuagaaagcugccaagacagaggcagaa

SEQ ID NO: 103040 - RNA, 63 nt, hsa
ggcaggcuccaggcaggguccucugggaaguuacucuagaaaacgaagggaggaggagcacaa

SEQ ID NO: 103041 - RNA, 63 nt, hsa
aaaacauaaccauauguguuuugcguuuacuuccucuagaaaagaauuugcaggcaaccaugu

SEQ ID NO: 103042 - RNA, 63 nt, hsa
ggaagaaacaacuucuuuaaagagcuucuuuggcucuagaaaaauuucaaacaauuaaaauaa

SEQ ID NO: 103043 - RNA, 63 nt, hsa
gaaauaauuuuuuucaaauaagaaaauuguguacucuagaaauggagaccgauuuacaauuua

SEQ ID NO: 103044 - RNA, 63 nt, hsa
uacuccuccuccagauaccaacugcugauguugcucuagaaaaaccaccaaacaugacuguuc

SEQ ID NO: 103045 - RNA, 63 nt, hsa
gauuaggauuugauuucuugaaacccucuaggucucuagaacacugaggacaguuucuuuuga

SEQ ID NO: 103046 - RNA, 63 nt, hsa
ggacuuuauuuucacauaagucaauagauguuucucuagaacaaaauauuuaguaaagcuuua

SEQ ID NO: 103047 - RNA, 63 nt, hsa
uuaaaaaauguccaugauggaauauuccccuaucucuagaauuuuaagugcuuuguaauggga

SEQ ID NO: 103048 - RNA, 63 nt, hsa
guaauuuuacacaugcuggaaugacuguaauuacucuagaauuccaaguagaauacaauaacu

SEQ ID NO: 103049 - RNA, 63 nt, hsa
gauaacucuuaaaaaaccgucgagauuacaaugcucuagaaucagcauauaagaaaauaaaug

SEQ ID NO: 103050 - RNA, 63 nt, hsa
acaauauuacauuacagccuguauucauuuguucucuagaaguuuugucagaauuuugacuug

SEQ ID NO: 103051 - RNA, 63 nt, hsa
auuguaacuacacugggcaucagaauaaaaggccucuagaaauugcugaacaaugguuaauua

SEQ ID NO: 103052 - RNA, 63 nt, hsa
ucucuccuucauuaauuuaaauauuuuuaucggcucuagaaaaugcauaagguuaguacaaga

SEQ ID NO: 103053 - RNA, 63 nt, hsa
cacucucugcacugacuuuuuaauuauuuaaaacucuagaaagaugaacaaagguuaauuuaa

SEQ ID NO: 103054 - RNA, 63 nt, hsa
acuauucuguugugacuaugagaacauuucugucucuagaagucaucugucuguauugaucuu

SEQ ID NO: 103055 - RNA, 63 nt, hsa
auucuccuauuuaccaguccuguccuauauacccucuagaaacagaaagcaauuuuuaggcag

SEQ ID NO: 103056 - RNA, 63 nt, hsa
agugucacauuucucuaagaugaaagauuuuuacucuagaaacugugcgagcacaacacacac

SEQ ID NO: 103057 - RNA, 63 nt, hsa
cagcuuugggaaagcugccucguuucccuuuuccucuagaagcagaaccagcucuacgagagu

SEQ ID NO: 103058 - RNA, 63 nt, hsa
aaugcccugacucuaccagcgcccauaaaugaucucuagaaggacuguuaguaccaaucuguu

SEQ ID NO: 103059 - RNA, 63 nt, hsa
aaaauauaccauaggcuaaaacuaaggcuuucacucuagaaugcaaagcuguuuugcagcugu

SEQ ID NO: 103060 - RNA, 63 nt, hsa
uucccaucugcugcucuuuguagaaaagguuuccucuagaacugaauuccucuggaauugagu

SEQ ID NO: 103061 - RNA, 63 nt, hsa
uguaaacauugagcucaccuuuuauauauuaaccucuagaauuaaugggccuaugugguuuuu

SEQ ID NO: 103062 - RNA, 63 nt, hsa
uaaaauauuuagcccuuccuugguagguagcuucucuagaauuuaauugugcuuuuuuuuuuu

SEQ ID NO: 103063 - RNA, 63 nt, hsa
uacuuugccaaagcugucaucuuguaauauaugcucuagaaaugacauaaagguuuaugggga

SEQ ID NO: 103064 - RNA, 63 nt, hsa
gaaccugaaauauuguuuucuuccuugaauuuucucuagaaaugcagaaauuaggaaggugau

SEQ ID NO: 103065 - RNA, 63 nt, hsa
gugaaucuuguuuuuuuuaucuuuaaaauauaucucuagaacuuaaagcugaaaucugcaaau

SEQ ID NO: 103066 - RNA, 63 nt, hsa
aaccucaagggauuuagugcccugucucccugucucuagaagccuuagccugggcaccuggcu

SEQ ID NO: 103067 - RNA, 63 nt, hsa
ugaaaugggaaucaguggucuuacuauauacuucucuagaagagauuacuuaagacuguguca

SEQ ID NO: 103068 - RNA, 63 nt, hsa
cauggugggaaacagccaccgagaagguucuagcucuagaaagggacuaaacuuauucucuca

SEQ ID NO: 103069 - RNA, 63 nt, hsa
guucuuacccaguuaacaugaagaaaccacugucucuagaagaaagcuuguuuugcaguauua

SEQ ID NO: 103070 - RNA, 63 nt, hsa
gaccaguugcacauguuuuccccuaaaagcuuacucuagaaaggauauuuuuuggagagggag

SEQ ID NO: 103071 - RNA, 63 nt, hsa
ccuuaucucccucagacgcagaguuuuuaguuucucuagaaauuuuguuucauauuaggaaua

SEQ ID NO: 103072 - RNA, 63 nt, hsa
gaucauuaagaugaagagaguaauucacauuuacucuagaaccuuuaacaagcacugaaagga

SEQ ID NO: 103073 - RNA, 63 nt, hsa
ugucacaggauuaauuaauugccgguuuucauacucuagaaggcugaaacugauguuuaucuu

SEQ ID NO: 103074 - RNA, 63 nt, hsa
uaauauauuucacaucuuuauuauugcaguuuucucuagaaagcucugagaagcuuucucugc

SEQ ID NO: 103075 - RNA, 63 nt, hsa
cauugaggaacuguugauuggcaggcacugauucucuagaacacugggcaugaggauguugca

SEQ ID NO: 103076 - RNA, 63 nt, hsa
uacuuuucagguaauuauggaaaauauuuuaaacucuagaagcuucaauaaugaugugugauu

SEQ ID NO: 103077 - RNA, 63 nt, hsa
ucucugugugcuuugugguugcugucauauuugcucuagaagaaaaaaaaaaaaggaggggaa

SEQ ID NO: 103078 - RNA, 63 nt, hsa
cacauuuuauacuuuucauaaaccacaaagucucucuagaauuuuuucugccuucacuaaaau

SEQ ID NO: 103079 - RNA, 63 nt, hsa
gcuccugggcucaagugauccucuagacucagccucuagaauagcugggacuacaggcacaug

SEQ ID NO: 103080 - RNA, 63 nt, hsa
cagccuuuugggaauaauagcacaugauuugggcucuagaauuccaguccccuuucucggggu

SEQ ID NO: 103081 - RNA, 63 nt, hsa
uuguucuucaguauuuuguuuuucucaaaaaugcucuagaacuuuccuuggcacauauaaaag

SEQ ID NO: 103082 - RNA, 63 nt, hsa
uuccaauaauguuagaguucauguaaucacauucucuagaaccauuuaguuuguguuaacuau

SEQ ID NO: 103083 - RNA, 63 nt, hsa
aagaggucuugcagucuucagaugaaacuaaaucucuagaagaggcacaagaauggcuaaagc

SEQ ID NO: 103084 - RNA, 63 nt, hsa
aaaggauccacuacuucuuguucuuaugaaugacucuagaaaaaucagaaucaaguugugggu

SEQ ID NO: 103085 - RNA, 63 nt, hsa
cuucacuaaugaucacauucuuuccaaaaggaacucuagaagaccaaaugccccgaguuaaga

SEQ ID NO: 103086 - RNA, 63 nt, hsa
acgugaaauauuuaaguauauaguauauuuauacucuagaacaugcacauuuauauauauaug

SEQ ID NO: 103087 - RNA, 63 nt, hsa
aaaaccuaaacucuucaggcuaccuuugugugucucuagaagagaaaagcaucuaucuggaga

SEQ ID NO: 103088 - RNA, 63 nt, hsa
ugaauaaacaucagaguauuuuaaaaaacaguucucuagaaagaacuguuauaauuaaaauga

SEQ ID NO: 103089 - RNA, 63 nt, hsa
aaacuccugugcuuuugagcaaggacuuuugcccucuagaaagcaacugaggccaggugcggu

SEQ ID NO: 103090 - RNA, 63 nt, hsa
acugugucaaaaugauaauuuuguuauguuagccucuagaaaauuuaaguucagaaaaaugca

SEQ ID NO: 103091 - RNA, 63 nt, hsa
ugcuuauagaggcaaaccacaguaucauuuuaacucuagaauugggcuuguacagaaggauaa

SEQ ID NO: 103092 - RNA, 63 nt, hsa
auuuugagucauaggucuguaauuuauagagaucucuagaauucuuauuguaauuuuccuacu

SEQ ID NO: 103093 - RNA, 63 nt, hsa
cuuucaacucuguugacccucugucuggucuuccucuagaagguaccgcagaaauugaugugu

SEQ ID NO: 103094 - RNA, 63 nt, hsa
cacucagggcuucuccucugcuaggcuacccuccucuagaaggcugaguaccaugggcuacag

SEQ ID NO: 103095 - RNA, 63 nt, hsa
gaagaccaaaccccacauccuccuuuccccucucucuagaaucaucucgcaccaccaguuaca

SEQ ID NO: 103096 - RNA, 63 nt, hsa
auugcauugcauucagaguaaccugugugcauacucuagaagaguagggaaaauaaugcuugu

SEQ ID NO: 103097 - RNA, 63 nt, hsa
gggauuaaaaauaaggauaaacacuaauaagagcucuagaaaaaagggaacagaaagucugcc

SEQ ID NO: 103098 - RNA, 60 nt, hsa
gggcacccaggagugucugagcugcauuaccucuagaaaccucaaacaaguagaaacuug

SEQ ID NO: 103099 - RNA, 63 nt, hsa
augagccaccgcaccuggccuucccugcuuccucucuagaauccaauuagggauguuuguuac

SEQ ID NO: 103100 - RNA, 63 nt, hsa
cguuuucauugucaagaauguuacuguaguauucucuagaacuucaaugucuuuguggacauu

SEQ ID NO: 103101 - RNA, 63 nt, hsa
uuaauuuuuaagcucuuugccaauauuccauuucucuagaauguuuauccuaagcacuuguuu

SEQ ID NO: 103102 - RNA, 63 nt, hsa
ccagcuugcuaaauuaggcuauaccuagguaaucucuagaagacaacucugacagacucuuua

SEQ ID NO: 103103 - RNA, 63 nt, hsa
uuuuucaucaugcacgaauuaauaaucaucauacucuagaaucuugucugucacucacuacau

SEQ ID NO: 103104 - RNA, 63 nt, hsa
uuucuagguuuguaagugcagcaguuuuauuuccucuagaacucauccuguuucaagggaagu

SEQ ID NO: 103105 - RNA, 63 nt, hsa
cuaagaauuuuccacuucuucaaaaugaacuuacucuagaaagcuuacccuuggauaaccagu

SEQ ID NO: 103106 - RNA, 63 nt, hsa
ugcuggugaguauuaccuuucaucugugccaugcucuagaaccuugaccuugauaguucacca

SEQ ID NO: 103107 - RNA, 63 nt, hsa
gcuuaaugaucaaguguuacuuaucuaauaauccucuagaaagaacccuguuagaucuugguu

SEQ ID NO: 103108 - RNA, 63 nt, hsa
aggggaaacucuggugccggggagggcacgaggcucuagaaaugcccuucacuuucuccuggu

SEQ ID NO: 103109 - RNA, 63 nt, hsa
ucuccaccugcccaccgggacacucccccugcucucuagaaaggaacucucuuucuucucuug

SEQ ID NO: 103110 - RNA, 63 nt, hsa
cuucuaguuuugacauuuuaugauagauuugcucucuagaaggaaacgucuuuauuuaggagg

SEQ ID NO: 103111 - RNA, 63 nt, hsa
augcagacucaaaccuucccaacaucuuuaugacucuagaauaaucauauugaugaaaucgua

SEQ ID NO: 103112 - RNA, 63 nt, hsa
uuuguuuuuugguuuuuuuuuuuacccagacaacucuagaaaugcggaccaaacuacuucauu

SEQ ID NO: 103113 - RNA, 63 nt, hsa
agugcgugaagaccaacaaagucacagucguaucucuagaaagcucuaaagaccauguuggaa

SEQ ID NO: 103114 - RNA, 63 nt, hsa
aauuccugcuuguuaauuacauaauaugugaugcucuagaaaauagucacaaguauuaauaau

SEQ ID NO: 103115 - RNA, 63 nt, hsa
uaagaccaaaaacuguaauauccuuuagaaaugcucuagaagaucuguauuguguagaaugau

SEQ ID NO: 103116 - RNA, 63 nt, hsa
caugauagccaauggugagggaaaaggagguuucucuagaagagucugaugaaaggccgggaa

SEQ ID NO: 103117 - RNA, 63 nt, hsa
aagcuuugucagguuaauguagcauguuaaggacucuagaaaaaaauaaacuaaggagacgag

SEQ ID NO: 103118 - RNA, 63 nt, hsa
auauucggggauaugaaggauucaaugaaugaucucuagaaagauuuaaagaagaauauucag

SEQ ID NO: 103119 - RNA, 63 nt, hsa
gguuccacccuaacuuggggaaacaaaagccuucucuagaaucugaaggccaggcuuaccucu

SEQ ID NO: 103120 - RNA, 63 nt, hsa
uaggaaucaauaguuaguagugacauuggugcucucuagaaaucucagcaugagcugcuauag

SEQ ID NO: 103121 - RNA, 63 nt, hsa
acaggccugcuagcucagccgacgcucuggacacucuagaaaucacuccucagugugaccucc

SEQ ID NO: 103122 - RNA, 63 nt, hsa
cuaguccugaguauaaauccugugcauagauuccucuagaaaggcaucaaaaggcucaacaga

SEQ ID NO: 103123 - RNA, 63 nt, hsa
aaauggguucagggucuuguccuuagcuacuagcucuagaaaagucccaaaagcagcagaagg

SEQ ID NO: 103124 - RNA, 63 nt, hsa
acuggacuguuccugggaaaagggugaagccaccucuagaagggacuuuggccuccccccaag

SEQ ID NO: 103125 - RNA, 63 nt, hsa
uuguguguaugguacuagcacaccacugcaugucucuagaaugcuguugccacuuacgggggc

SEQ ID NO: 103126 - RNA, 63 nt, hsa
gugucuucuaagagcuguucaauacaguauucacucuagaaacaauuaucuuuuucucuuaau

SEQ ID NO: 103127 - RNA, 63 nt, hsa
uaauaguaaagguaaaaucucucaguuuccuaccucuagaaagaggccaucucacuagaauag

SEQ ID NO: 103128 - RNA, 63 nt, hsa
ccccaaacuuucaccaaaagcaauaaagaggaacucuagaacuggagccaggacuaagugaga

SEQ ID NO: 103129 - RNA, 63 nt, hsa
aauucaggagcuuugaaggaaguccaaggaaagcucuagaaaacaguauaaacuuucagaggc

SEQ ID NO: 103130 - RNA, 63 nt, hsa
aaucuucuagaagaaaaaucuccgaagagcucucucuagaaguccaaaauggcuagccauuau

SEQ ID NO: 103131 - RNA, 63 nt, hsa
uagcugaugucagcuucauguggauuuuaagcacucuagaaacaaugaagcuucuuggcauau

SEQ ID NO: 103132 - RNA, 63 nt, hsa
uccugccacuagguuucaccucccaaacccagccucuagaacagccagacccugcagaucccc

SEQ ID NO: 103133 - RNA, 63 nt, hsa
gacagugucuaaauauaagacaauauugaucagcucuagaauaacuuuaaagaaagacguguu

SEQ ID NO: 103134 - RNA, 63 nt, hsa
uucuuugcauuuggcucuacuuacuaacaaccccucuagaauacauuggugauuucauuuaaa

SEQ ID NO: 103135 - RNA, 63 nt, hsa
uuguaguacauguuuuuacuaauaauucuuguucucuagaaagcuuucuauuucuaaccuaug

SEQ ID NO: 103136 - RNA, 63 nt, hsa
ugaaugguaguugaggucuucauacaguucagccucuagaaugguaacaaaucagccaauugg

SEQ ID NO: 103137 - RNA, 63 nt, hsa
aggaauugagcgguuccccaccuccuaccccuacucuagaaacacacuagacagaugucuccu

SEQ ID NO: 103138 - RNA, 63 nt, hsa
gcaggguucaguuucauguaucuuugucuuuuccucuagaaccugccuuuuucaaauaucccu

SEQ ID NO: 103139 - RNA, 63 nt, hsa
cugccacugucccaacucuuucccucuacgucucucuagaaugacaucuuuaaaccccuuaca

SEQ ID NO: 103140 - RNA, 63 nt, hsa
ggagauuuaguuuuacugcuuugacuggugggucucuagaagcaaaacugagugauaacucau

SEQ ID NO: 103141 - RNA, 63 nt, hsa
ccauaguuuuguuuugguuuauuuuuaacaacgcucuagaaacaaagucaaauuaaucacaaa

SEQ ID NO: 103142 - RNA, 63 nt, hsa
ucucuuuagaacuugauggcugggcacugccaucucuagaauugccacgagucucucucuucc

SEQ ID NO: 103143 - RNA, 63 nt, hsa
ggguguacuaguuacacaucuucaacagacccccucuagaaauuuuucagaugcuucugggag

SEQ ID NO: 103144 - RNA, 63 nt, hsa
agcagcuguggucauuaaaccauuaguuuaccccucuagaacuggggucugcaaacucccacc

SEQ ID NO: 103145 - RNA, 63 nt, hsa
cuacagcacuaagagaagccccugagaaaaacccucuagaaaaacagcuguuccucugugugg

SEQ ID NO: 103146 - RNA, 63 nt, hsa
uucccucuguggccuccuggcuugcacugcucccucuagaaagauuccuucaggucuggaggc

SEQ ID NO: 103147 - RNA, 63 nt, hsa
ucaguggacaguaugcacucagcugaccacucucucuagaaauagucaagauaugaacuaaga

SEQ ID NO: 103148 - RNA, 63 nt, hsa
gccuuguuaugcacaagagauucuauuaaaagccucuagaaguaacuccccuuaaaaugucua

SEQ ID NO: 103149 - RNA, 63 nt, hsa
gccuugugcuagugcccucgagaagaguuauugcucuagaaaguugaguucucauuuuuuuaa

SEQ ID NO: 103150 - RNA, 63 nt, hsa
aucccggcggcaaggagaacagaacacugaagacucuagaaaagcaaagccggauuucuggaa

SEQ ID NO: 103151 - RNA, 63 nt, hsa
cauacucugcuucucucugucagcguccugcugcucuagaagacuguccguggaugaguuuag

SEQ ID NO: 103152 - RNA, 63 nt, hsa
aagcugaagguguacuucaccagcaagagucaacucuagaauucaggauguuccuucuauugu

SEQ ID NO: 103153 - RNA, 63 nt, hsa
uuuuccuuuuuuucuugauuaggucuggaacagcucuagaaugaacacauaaaauuuagcaau

SEQ ID NO: 103154 - RNA, 63 nt, hsa
agugauuuugauguauucuaauuuugagaccaucucuagaaaagaauugcuaccucuuguaug

SEQ ID NO: 103155 - RNA, 63 nt, hsa
uucacuucaagacuuuccuucuuuucacuaaaacucuagaagguguuacaagggggagggaag

SEQ ID NO: 103156 - RNA, 63 nt, hsa
uccuaggcccuagggauccaacuggcugucugccucuagaacucuccacccucaucucucugc

SEQ ID NO: 103157 - RNA, 63 nt, hsa
gcugguaaaggggugcuggaggccauggaggagcucuagaaacauuagcaugggcugaucuga

SEQ ID NO: 103158 - RNA, 63 nt, hsa
uuauggcauaugucuccgauuuagaugguuauucucuagaaaauaguauuuaaagacauuuua

SEQ ID NO: 103159 - RNA, 63 nt, hsa
cucauccccaccccaccucaccccaacaaacuccucuagaagaagccaagaauuucucucuau

SEQ ID NO: 103160 - RNA, 63 nt, hsa
cugaugcuuggaccccuuuuauugaucagagugcucuagaauaauggauggucuuggaugaug

SEQ ID NO: 103161 - RNA, 63 nt, hsa
ucauuauuuuaaugaaugugagcucuugacuuacucuagaauucuaauacagauacuuucugc

SEQ ID NO: 103162 - RNA, 63 nt, hsa
cuauuguuugaucuaguuauuuuaauaaaggaacucuagaaguuucaaguggccagugaagug

SEQ ID NO: 103163 - RNA, 63 nt, hsa
aaauaaguaggacugaguauuuaugugaaaacucucuagaagguaaaaauaaagauaauucuu

SEQ ID NO: 103164 - RNA, 63 nt, hsa
guuuucuguguaauuccagaugagucacuguaacucuagaagauuaaccuuccagccaaccua

SEQ ID NO: 103165 - RNA, 63 nt, hsa
uccucgcccuuucuuaaagugcaguucuuagcccucuagaaacgaguuggugucuuucgucuc

SEQ ID NO: 103166 - RNA, 63 nt, hsa
gccccaaagcauauaaucucuacuccuuacagucucuagaauuaaauguacucauuuagacaa

SEQ ID NO: 103167 - RNA, 63 nt, hsa
acuaccuuacgugauagcauacaaagaagaaagcucuagaaagagaaauuauggagaaugauu

SEQ ID NO: 103168 - RNA, 63 nt, hsa
acuuaccccacagcugguuacugacaacacaagcucuagaauucauguuuguuuguuuguuuu

SEQ ID NO: 103169 - RNA, 63 nt, hsa
agaaaaauguggauaaacagucaaaccuuuauccucuagaauuuuggcaauguugacuaagaa

SEQ ID NO: 103170 - RNA, 63 nt, hsa
cauccugaagaaaugguaaggguggagccaaaucucuagaaauaaguagugaggccguuaauu

SEQ ID NO: 103171 - RNA, 63 nt, hsa
aacccugacugugggcuugagaacaaagaugaacucuagaacucuagcagccuaacugcugcu

SEQ ID NO: 103172 - RNA, 63 nt, hsa
uaccauuugaauauuuucauuugguguuuuccccucuagaaaacagaguugcuguuguuuuuu

SEQ ID NO: 103173 - RNA, 63 nt, hsa
ccccagaucucuucccccauuccuucuuuugggcucuagaaagucuugccucauugaguguuu

SEQ ID NO: 103174 - RNA, 63 nt, hsa
uuuuaucaagaugaagacauuuuacccuaccuacucuagaaauauacaacaauguuauauuuu

SEQ ID NO: 103175 - RNA, 63 nt, hsa
gggcuaaugcugcauuuuucuacaacaucaugccucuagaagguuuaagcuagguaggcuuuc

SEQ ID NO: 103176 - RNA, 63 nt, hsa
aucuauuaucaacugcugcuucaccagacuuuucucuagaagcugucugcguuuacucuuguu

SEQ ID NO: 103177 - RNA, 63 nt, hsa
aggaacacugaacuaguuggaaauuacugcuuucucuagaaauauaaagcaaagcacuauucc

SEQ ID NO: 103178 - RNA, 63 nt, hsa
uuuuucagccacuaagaaccccucugcuuuuaacucuagaauuugggcuuggaccagaucuaa

SEQ ID NO: 103179 - RNA, 63 nt, hsa
uggguuuucccuugccuuaugggcugaaguguucucuagaauccagcaggucacacugggggc

SEQ ID NO: 103180 - RNA, 63 nt, hsa
agucugaggauguuaacuuuggaacucgcaguccucuagaacagcuucagauuauggcuuuuu

SEQ ID NO: 103181 - RNA, 63 nt, hsa
gcugcucuccaaugcuaacuuucugacacagugcucuagaacccugccugugguccugagcac

SEQ ID NO: 103182 - RNA, 63 nt, hsa
aguugaggaaaugguugggaaucgcuguuagaacucuagaaauucuaaucugacuuugccacu

SEQ ID NO: 103183 - RNA, 63 nt, hsa
gccuggacagccaggggcuccucgggcccugugcucuagaaggcccauucuaugucugcuucg

SEQ ID NO: 103184 - RNA, 63 nt, hsa
gaaaagaaucugaacauuuaagugcgaaguuuucucuagaaauauauucaagauauguuuauu

SEQ ID NO: 103185 - RNA, 63 nt, hsa
uuuauuuugcucgugcuuagcuaaauaugucaucucuagaaaagaugugguuuguuuuggcac

SEQ ID NO: 103186 - RNA, 63 nt, hsa
ccguucaaaugagcguagcccccugagucaucacucuagaagaaucuguacaucaucaggacu

SEQ ID NO: 103187 - RNA, 63 nt, hsa
augguguucacucuacauaucagguuauggugucucuagaaucuguuguuuguuuccuauaag

SEQ ID NO: 103188 - RNA, 63 nt, hsa
aaugaagaccuacuuucaacuccuuuuuccccccucuagaagaaucaaauugaaucuuuuacu

SEQ ID NO: 103189 - RNA, 63 nt, hsa
aaggugauugguuuucuuuacagacuccuuguucucuagaagggcuuuuuacuugaauaaaac

SEQ ID NO: 103190 - RNA, 63 nt, hsa
uuugugaaugagaguuggcaugucaaaugcauccucuagaaaaauaauuaguguuauagucuu

SEQ ID NO: 103191 - RNA, 63 nt, hsa
cacauagagccucucucuuuuccuguuucuuggcucuagaagaucagcacugcacuguuagcu

SEQ ID NO: 103192 - RNA, 63 nt, hsa
uggagaauuaucacaaccuaaugacauuaauaccucuagaaagggcugcugucauagugaaca

SEQ ID NO: 103193 - RNA, 63 nt, hsa
aacuugcagguccagguugguauacauuccacccucuagaaguauuuucuuacaguagauaag

SEQ ID NO: 103194 - RNA, 63 nt, hsa
aauuggugauacuucuaaacuauaacuauaaaucucuagaauucugugaauuucaacauuauu

SEQ ID NO: 103195 - RNA, 63 nt, hsa
acaaagucaauggaaauugaacucuagaauugucucuagaaaacauagcuucuuacugaacuu

SEQ ID NO: 103196 - RNA, 51 nt, hsa
acaaagucaauggaaauugaacucuagaauugucucuagaaaacauagcuu

SEQ ID NO: 103197 - RNA, 63 nt, hsa
gauuuccuguagaaguagcuuuaaugguuuuugcucuagaauaccguaggucuauccuuagag

SEQ ID NO: 103198 - RNA, 63 nt, hsa
ccugccuccugggguccagugacugggacccuacucuagaacuguguaccauccaauucgcca

SEQ ID NO: 103199 - RNA, 63 nt, hsa
ucccuguaguugacaauucugcauguacuaguccucuagaaauagguuaaacugaagcaacuu

SEQ ID NO: 103200 - RNA, 63 nt, hsa
cacgcacaugcgaccccgaggaaacgaaacccacucuagaaaacgcgaccuuggccgcaccua

SEQ ID NO: 103201 - RNA, 63 nt, hsa
ugucugcucccacagcaccaucuaagaccccuccucuagaaguggggaaggccagauguguag

SEQ ID NO: 103202 - RNA, 63 nt, hsa
acuauguauauuuaaauuuaguaauuuucuaaucucuagaaaucucugcuguucaaaaggugg

SEQ ID NO: 103203 - RNA, 63 nt, hsa
auuucuaaaucccaucuugauauacuaugaauacucuagaaugauguaaagcagauaggaaug

SEQ ID NO: 103204 - RNA, 63 nt, hsa
caaucauguacuuuaguuuaauguauaaagauccucuagaaaaugauaauauuguguauuaag

SEQ ID NO: 103205 - RNA, 63 nt, hsa
cucugguggucucaagacaagaacaagagcugacucuagaaucuucugccuggcugaccucug

SEQ ID NO: 103206 - RNA, 63 nt, hsa
ggucagugauggcaacaggauggccaaggauggcucuagaacacucuguccaugcgucacucc

SEQ ID NO: 103207 - RNA, 63 nt, hsa
cuguccuguccaaugcgggggcacugcagaacucucuagaaaugucaugauugagcuucagag

SEQ ID NO: 103208 - RNA, 63 nt, hsa
aacugaauaaucuuugccuggagugacacuacacucuagaauuuccacuuuggagaauacuca

SEQ ID NO: 103209 - RNA, 63 nt, hsa
uuuuauuuuguuuucaaccaucaauaaaguuuucucuagaauauuguuuugaacauccuugua

SEQ ID NO: 103210 - RNA, 63 nt, hsa
guauggaaaugcacccucccuccugccgcuccucucuagaaccuucuagaaccugggcugugc

SEQ ID NO: 103211 - RNA, 63 nt, hsa
ucuaagggugccaagagacugguuagucaaagccucuagaaggggauccucguugaaaggagc

SEQ ID NO: 103212 - RNA, 63 nt, hsa
cauaucuauaaaacaaacauaguaucugucaaucucuagaaaccacaagaugauggagagguc

SEQ ID NO: 103213 - RNA, 63 nt, hsa
guguagggacccugccaaguggcaccugauuuacucuagaaaauaaaaguagaaaauacugag

SEQ ID NO: 103214 - RNA, 63 nt, hsa
gucccugaaguauuuaauaagaagcauuuugcacucuagaaaguauguuuguguugguuuuuu

SEQ ID NO: 103215 - RNA, 63 nt, hsa
gguagauuacuuaucagaaaacauauaugucaucucuagaacgaagaaaaagcauaguaguuc

SEQ ID NO: 103216 - RNA, 63 nt, hsa
gguaggguauaguaucacuccugaguuccacugcucuagaaucuaaccagaaauagaaaccua

SEQ ID NO: 103217 - RNA, 63 nt, hsa
cccugcucaccauuggagaaucagcucacugcucucuagaaacguggcguuggugaacggacc

SEQ ID NO: 103218 - RNA, 63 nt, hsa
ucaggacgugaugagguacucgugguucuggagcucuagaaacacuucugaugcaugaaaaau

SEQ ID NO: 103219 - RNA, 63 nt, hsa
aauguucagucggucguguuuuuaacacagagucucuagaagaggugcagacaucccgucuga

SEQ ID NO: 103220 - RNA, 63 nt, hsa
uggcaaguguccagaugccagaaccuucuuuuccucuagaagggauggugcuugguaaccuua

SEQ ID NO: 103221 - RNA, 63 nt, hsa
auguaugucgauugauaucgcugcuacaucagacucuagaaaaaagggcugagaggaagcaag

SEQ ID NO: 103222 - RNA, 63 nt, hsa
gauaauuccucaagcaugagaccuugcuaagcacucuagaauaaguuuuauguucugcucaca

SEQ ID NO: 103223 - RNA, 63 nt, hsa
uacaaaagugcaaauuucucauuuccugugggucucuagaaacucucucaauauuuaaagcca

SEQ ID NO: 103224 - RNA, 63 nt, hsa
ugggcuugguaagugaauuuaugagauuuacugcucuagaaaguauagauggccaaaggaccg

SEQ ID NO: 103225 - RNA, 63 nt, hsa
ccaucugagaugggguccuguuguuuauuaucacucuagaaguuauacauugauauuuauucu

SEQ ID NO: 103226 - RNA, 63 nt, hsa
auuuuuguaacuuuacgcaggacacuuagagcucucuagaaucccacugacuuuagugggucu

SEQ ID NO: 103227 - RNA, 63 nt, hsa
uaugcccauuugauccuaaccuuuuagccugcucucuagaacccuacuuacaguugaccaagc

SEQ ID NO: 103228 - RNA, 63 nt, hsa
aguacggcccccucuuugcaggcuuuuccuccucucuagaaccuccuucuguuggaggcccuc

SEQ ID NO: 103229 - RNA, 63 nt, hsa
cucaggcccccagcccuguggcuuccaccucagcucuagaagccugcucccucugcagggggu

SEQ ID NO: 103230 - RNA, 63 nt, hsa
gaaaaaaagaaaaagaacaaaaaauauauaucacucuagaaaauaaaucucuccugugucuua

SEQ ID NO: 103231 - RNA, 63 nt, hsa
caaacacuaacugggggauuuuauuuauaagggcucuagaaaaaacgaguuauucacaccagc

SEQ ID NO: 103232 - RNA, 63 nt, hsa
aaaaaaaaaguuuguuaaaaggcuacacgagcucucuagaaacugcugcuacuagaaaugucu

SEQ ID NO: 103233 - RNA, 63 nt, hsa
uggggccauuagaaugaggcagacaccaggccacucuagaagccgagccgucacaccucaggc

SEQ ID NO: 103234 - RNA, 63 nt, hsa
uuccccuggcaugaaacuuucagauuccccugccucuagaaauuguccugcccuccucaccac

SEQ ID NO: 103235 - RNA, 63 nt, hsa
aacccaugguucucagcuggggugacacugcuccucuagaagcagguuugaaauuauggguau

SEQ ID NO: 103236 - RNA, 63 nt, hsa
ccuggcuuuuuguugauuauuaagcuguguucacucuagaagguguaaaggcccugucccaau

SEQ ID NO: 103237 - RNA, 63 nt, hsa
uacauucuccuugucugguauaacuuccauguucucuagaaaucaagguuuuguuuguuaauu

SEQ ID NO: 103238 - RNA, 63 nt, hsa
guuucuggugugugaacuuuaugguaacuucuacucuagaauacguacguaugcacccacaga

SEQ ID NO: 103239 - RNA, 63 nt, hsa
cagaacccagcccagaucggaggacaaguuccucucuagaacccaauccaauuuggagcccca

SEQ ID NO: 103240 - RNA, 63 nt, hsa
ggagccccagcccaacuccagaacccaacccuucucuagaauccagcccagaucugaggccaa

SEQ ID NO: 103241 - RNA, 63 nt, hsa
ugugguccaaaugcggaucacuggucagauggacucuagaagcacugagcucccugucucugg

SEQ ID NO: 103242 - RNA, 63 nt, hsa
ucaaaaagccucaugcauagcgggucauguagucucuagaaaauacauaaccugauggaaaug

SEQ ID NO: 103243 - RNA, 63 nt, hsa
guuauuuauauccuauuuuuucucaccccaucucucuagaaacaccuauaaaggcuauuauug

SEQ ID NO: 103244 - RNA, 63 nt, hsa
uuguauaagauccuagauccuaagggucgaaagcucuagaaucugcaauucaaaaguuccaag

SEQ ID NO: 103245 - RNA, 63 nt, hsa
gcugccgugauggauucuguuugacguauuguucucuagaaggccuggcucugauccagugac

SEQ ID NO: 103246 - RNA, 63 nt, hsa
guccccacccucugccccccagcccucuggcgucucuagaaacugcugcugauggagaccagg

SEQ ID NO: 103247 - RNA, 63 nt, hsa
cugacggaggaauuaacacaaaagcagacaacacucuagaacuggagagagguccagauugcg

SEQ ID NO: 103248 - RNA, 63 nt, hsa
ccagccccuccccuacuuuuuggucagcuacgucucuagaauaagaugguaucugaaguccuu

SEQ ID NO: 103249 - RNA, 63 nt, hsa
guuguuucucucccugggccucaguuuccccaucucuagaaugaggauguuggggaaaauccc

SEQ ID NO: 103250 - RNA, 63 nt, hsa
ugaaauucaguaauauuugacauuuuuauuuaucucuagaaguuucucuaaaauuguacucag

SEQ ID NO: 103251 - RNA, 63 nt, hsa
aaguacagugaugagcaugccuaaauccauguucucuagaauguaagcuuggugaaagaaggg

SEQ ID NO: 103252 - RNA, 63 nt, hsa
uagacuguucugggguagcagagucacagaucacucuagaaucuaauacuugguaauuauacu

SEQ ID NO: 103253 - RNA, 63 nt, hsa
cccccaggaauggggaacucucccucuggucuacucuagaagagggguuacuucuccccuggg

SEQ ID NO: 103254 - RNA, 63 nt, hsa
ucccaucuccuuucagaaaaauucaagguccuccucuagaaguuucaaaucucucccaacucu

SEQ ID NO: 103255 - RNA, 63 nt, hsa
aaggcccuggguucaagagaguuggagaaaccccucuagaaacauauuggcugucaucaaagg

SEQ ID NO: 103256 - RNA, 63 nt, hsa
gaaauuccuuaacugagcuauacuugguacuugcucuagaacauuugggaaaugacaaacuca

SEQ ID NO: 103257 - RNA, 63 nt, hsa
aucucuuccagcaccaucaggguuuuaauggcccucuagaauuaccacugagauacacuauuu

SEQ ID NO: 103258 - RNA, 63 nt, hsa
ugaagaaucugggccaaccagggguccuugggccucuagaaggccacaguaggccucucuuug

SEQ ID NO: 103259 - RNA, 63 nt, hsa
aucugcuggugccuugaucuuggacuucccagccucuagaacuguaagaaauaaauauuugcu

SEQ ID NO: 103260 - RNA, 63 nt, hsa
caagggcccaaggacagugccuuaguuuggauccucuagaaacuaacccugggaaaagggcau

SEQ ID NO: 103261 - RNA, 63 nt, hsa
uguauaacuuauuuucuuauuaucuucuucucccucuagaauauaaauuuaugaaaauacaaa

SEQ ID NO: 103262 - RNA, 63 nt, hsa
ugcguggaaggagcaaugcagacacagugaaaucucuagaaucugcuuuguuuuguaagaacu

SEQ ID NO: 103263 - RNA, 63 nt, hsa
aguuaaaccaaacuacagucucagccugucauucucuagaacacauccaggugucggagcuaa

SEQ ID NO: 103264 - RNA, 63 nt, hsa
agucagggacccccauaaaggacacccccuucucucuagaaagagcugggcucucagcuauuu

SEQ ID NO: 103265 - RNA, 63 nt, hsa
aagacgggggcugcuucuccucuucaguauggacucuagaaagucuggcuacaugaauagauu

SEQ ID NO: 103266 - RNA, 63 nt, hsa
agugcuaacuugggccagcgggguuugggguaucucuagaaaacagcaacugaacagagcucc

SEQ ID NO: 103267 - RNA, 63 nt, hsa
ggcgugacccaggccccuguagcccucagccuccucuagaagcuucuguacuccuuguaggau

SEQ ID NO: 103268 - RNA, 63 nt, hsa
ugccguggccacccccgcugcccagugucugcccucuagaaguaggcuguguuuccagguguu

SEQ ID NO: 103269 - RNA, 63 nt, hsa
uaaacaggaaagucgcauuauuuucccauucuacucuagaaagcauggaaauuaaguguuucg

SEQ ID NO: 103270 - RNA, 63 nt, hsa
ucaacuauuuuguaaaugcaaguuuuuuaguagcucuagaaacauuuuuaagaaggagggaau

SEQ ID NO: 103271 - RNA, 63 nt, hsa
ugaccagcucagaggauggggcuguccccugggcucuagaaagaacauucugugucaccagca

SEQ ID NO: 103272 - RNA, 63 nt, hsa
gaagaggcugggggacuagaaagaggcccugcccucuagaaagcucagaucuuggcuucuguu

SEQ ID NO: 103273 - RNA, 63 nt, hsa
ucuuccaagaaugccucuguggugcuguuuggucucuagaaacagggucacuuuuuuaaugua

SEQ ID NO: 103274 - RNA, 63 nt, hsa
cgacugcugcuguuaaaaaacaugcauuagaaucucuagaacacgaggaaaaacagggucuug

SEQ ID NO: 103275 - RNA, 63 nt, hsa
uugugcaaugauuguuaaauuauacugaaguagcucuagaaagacacauguauacaaggcacu

SEQ ID NO: 103276 - RNA, 63 nt, hsa
gccguaguagauguucuacuuuguucugcuguucucuagaaagaauauuugguuuuccuguau

SEQ ID NO: 103277 - RNA, 63 nt, hsa
uacacaucagcauaugagaaucucugagagguccucuagaaaggagagaaaaagcaccucuuu

SEQ ID NO: 103278 - RNA, 63 nt, hsa
ggauucauauauuacaucaacuucccuuuuuaacucuagaaauucucaguaugggguuucccu

SEQ ID NO: 103279 - RNA, 63 nt, hsa
uggguuccuauggccuuguuggagggggccaggcucuagaacgucuaacacaguggagaaccg

SEQ ID NO: 103280 - RNA, 63 nt, hsa
uugaucacgaucauauuguagucucucaaagugcucuagaaauugucagugguuuacaugaag

SEQ ID NO: 103281 - RNA, 63 nt, hsa
aacuauagugauauaucaguguuugagagugaccucuagaaaaaagaaaaguguuuuuagaaa

SEQ ID NO: 103282 - RNA, 63 nt, hsa
gccacccaguagcccagagugagcuuuagcucucucuagaaugagcaagacugggccccacau

SEQ ID NO: 103283 - RNA, 63 nt, hsa
aguugugcaggagguagccuggugguuuucaaccucuagaauuuuaagccuuuguugaacugu

SEQ ID NO: 103284 - RNA, 63 nt, hsa
aguuuggaguaagggacuucauauaccugauuccucuagaaggcugucuaacauaccacauga

SEQ ID NO: 103285 - RNA, 63 nt, hsa
ugauauauuacuacuuauaauacuguggcuagucucuagaauggauguugaaaucuuugccuc

SEQ ID NO: 103286 - RNA, 63 nt, hsa
agugaacugaggaaggugcuuagauggugagggcucuagaaaccaagccccaugagcagcagu

SEQ ID NO: 103287 - RNA, 63 nt, hsa
aacuauagugauauaucaguguuugggagugaccucuagaaaaaagaaaacuguuuuuagaaa

SEQ ID NO: 103288 - RNA, 63 nt, hsa
agccgcauccugccuguagauggccggggaaggcucuagaaaaggggcgcauugcgauccaac

SEQ ID NO: 103289 - RNA, 62 nt, hsa
guucuggcagcuccccgaggcagccgggguacccucuagauucagggaugcuugcucuccac

SEQ ID NO: 103290 - RNA, 62 nt, hsa
acuuuguuucucccaaguaggccaccaggcagccucuagaguugcuuuacccaaauccuucu

SEQ ID NO: 103291 - RNA, 62 nt, hsa
cuguaagugcuuuuuuuuucuucaccugggacccucuagagguuggaaagagaagagaggcu

SEQ ID NO: 103292 - RNA, 62 nt, hsa
ucccaaaaaguguuaucuuuuccuuaaauaucccucuagagguauuuuuccuaagugguauu

SEQ ID NO: 103293 - RNA, 62 nt, hsa
augcagccucaaaauguuucaaaugccuaccgccucuagaucgagccacguugacuucaggu

SEQ ID NO: 103294 - RNA, 62 nt, hsa
gcagugguaauucaaaaugagaggguccccugccucuagagucaucaucuaauuggggacag

SEQ ID NO: 103295 - RNA, 62 nt, hsa
cuccacaucugccuuaaaaccaaagagggcuuccucuagaagccaagggaaaggggugcuuu

SEQ ID NO: 103296 - RNA, 62 nt, hsa
acacuauaguauucccuuauuguagccaugguccucuagaugcaguuaaccaaauaggguca

SEQ ID NO: 103297 - RNA, 62 nt, hsa
gcuuuucuuaccugucacaucuuggccauccuccucuagacaaaaccagccuuuaaaauauc

SEQ ID NO: 103298 - RNA, 62 nt, hsa
cugaagccauuggagagcugucuuccuguguaccucuagaaucccagcagcagagaaccauc

SEQ ID NO: 103299 - RNA, 62 nt, hsa
aaacgcuuaacaucuuccaccgcaacagcuugccucuagagggggaauuguucauccauuug

SEQ ID NO: 103300 - RNA, 57 nt, hsa
gcccuuccuucgcccgcuaacaccacuccucuagaacucggugguaaugacugggag

SEQ ID NO: 103301 - RNA, 62 nt, hsa
gugaguaugguguucaggaugcaccaccaccaccucuagauaccuucaggcaacacagccca

SEQ ID NO: 103302 - RNA, 62 nt, hsa
agaaguauguggacaucucuucuuuuccugucccucuagaagaacauucucccuugcuugau

SEQ ID NO: 103303 - RNA, 62 nt, hsa
ccuccuacuuuccucccuagguggacagugcuccucuagagagcugcgacuuuaauuaaaaa

SEQ ID NO: 103304 - RNA, 62 nt, hsa
gguauuuuaaucuccuguuuaugauauauucaccucuagagcagucacugucaggguguugc

SEQ ID NO: 103305 - RNA, 62 nt, hsa
gaaaagaaaagaaaauuucuacuaauuucagaccucuagagcaauucaguccuguuggaaau

SEQ ID NO: 103306 - RNA, 62 nt, hsa
aaaacucuuagaaaaaaaaaauucuguaauguccucuagauuuagauuaugagcccugagga

SEQ ID NO: 103307 - RNA, 62 nt, hsa
ugaaaugaaguuaaguuuggaaagaagugauaccucuagacuggguuuauauuaaucuggga

SEQ ID NO: 103308 - RNA, 62 nt, hsa
ccugcugucuauucuaagcccccagacucaagccucuagacucuuggaugaaacagugagaa

SEQ ID NO: 103309 - RNA, 62 nt, hsa
uguccagaccauugucuuccaaccccagcuggccucuagaacacccacuggccaguccuaga

SEQ ID NO: 103310 - RNA, 62 nt, hsa
uaccucagucacacacccccaaccccaggcagccucuagagccuucuugcuuucauuuuccu

SEQ ID NO: 103311 - RNA, 62 nt, hsa
auguuccguggcaaugcuuuugugcauuacauccucuagagggaacauaaaaagauaccaau

SEQ ID NO: 103312 - RNA, 62 nt, hsa
cuaguagguucugcuguuaugcagagccauuuccucuagaauuuggauaauaaagaugcuua

SEQ ID NO: 103313 - RNA, 62 nt, hsa
caagccucuauuauacaaaccaugcagacucgccucuagagauucugauucgguugaucugg

SEQ ID NO: 103314 - RNA, 62 nt, hsa
cuacagucagauuuauagccagccaucuaucaccucuagaagguuccagagacagugaaacu

SEQ ID NO: 103315 - RNA, 62 nt, hsa
uguuacaggggccucagagcaccuucguuucuccucuagaccagggacagguguagagauaa

SEQ ID NO: 103316 - RNA, 62 nt, hsa
uagaagguggaaaagccaagggaacggauucuccucuagagucuccggaaggaacacagcuc

SEQ ID NO: 103317 - RNA, 62 nt, hsa
guggcccuuggccgagcgccgaacucgcucgcccucuagauguccaagugccacgugaacua

SEQ ID NO: 103318 - RNA, 62 nt, hsa
uggagcauguggucuuuuuaaaaaauuguaacccucuagaaaauaucaaagaaaugaaccag

SEQ ID NO: 103319 - RNA, 62 nt, hsa
gucuggcagaagccacgcuuguuccccauguaccucuagagaagcagaaaccaaaguccccc

SEQ ID NO: 103320 - RNA, 62 nt, hsa
uuucugaaccccacaucugccaucauuucucuccucuagagucccuggcuucuggccacugc

SEQ ID NO: 103321 - RNA, 62 nt, hsa
uucaggguagucaaaauaaacauaaauuaucuccucuagaugaguggcgauguuggcugauu

SEQ ID NO: 103322 - RNA, 62 nt, hsa
agaaaaaaguacugugaccugagagacacccuccucuagaauuuaguggcgggucugggcug

SEQ ID NO: 103323 - RNA, 62 nt, hsa
uuugauaauuguuauuuuuuuggcagauaauuccucuagaauguguaucuuuuuaugauuua

SEQ ID NO: 103324 - RNA, 62 nt, hsa
ucagaugccuccugaagaauuacagacuucuuccucuagacuuggaggugagggacccucuc

SEQ ID NO: 103325 - RNA, 62 nt, hsa
gccugggcccaaggggugaugaggcauccuuuccucuagaagaccugagucuuccugaccga

SEQ ID NO: 103326 - RNA, 62 nt, hsa
cuagacaaaaaccauuguugaugaggcagaugccucuagaagagacguuuaaaagccaucaa

SEQ ID NO: 103327 - RNA, 62 nt, hsa
gugaugcuucuggggcacguugaccauaugcaccucuagaaccuaaccagggcuuccuucua

SEQ ID NO: 103328 - RNA, 62 nt, hsa
ucauaccuagagauuuguggggggauacugaaccucuagacugaaguacuuaccggggagca

SEQ ID NO: 103329 - RNA, 62 nt, hsa
gagagcguuccuugaguccguacaccguccucccucuagaagcuggcaucacacucaugcug

SEQ ID NO: 103330 - RNA, 62 nt, hsa
ugcauggaagagaacaccucuuuauggcuuacccucuagaauuucuaauuuauguguucugu

SEQ ID NO: 103331 - RNA, 62 nt, hsa
ucaucggcaggcgcaugaguaucugugggaguccucuagagagaugagaagccaggaggccu

SEQ ID NO: 103332 - RNA, 62 nt, hsa
caagcccauugcucucccacugcagaacauggccucuagauuaaugccaccgauucaggaac

SEQ ID NO: 103333 - RNA, 62 nt, hsa
agcaccugggucccagcaucuagagcauggagccucuagaagccaugcucacccgcccacau

SEQ ID NO: 103334 - RNA, 62 nt, hsa
uggacaugaguccugugaggacuggugucucuccucuagagcuuucaucuuugggaugccug

SEQ ID NO: 103335 - RNA, 62 nt, hsa
ugccacuucaucuaggaaaccuucauugaugcccucuagauuaggugcccuuacuauccauu

SEQ ID NO: 103336 - RNA, 62 nt, hsa
aaaacauaaccauauguguuuugcguuuacuuccucuagaaaagaauuugcaggcaaccaug

SEQ ID NO: 103337 - RNA, 62 nt, hsa
agcauccacgcaucucuuggucccaauaacugccucuagauacauagccauacugcuaguua

SEQ ID NO: 103338 - RNA, 62 nt, hsa
gagugccgccuguacucacaaaggcugccuuuccucuagagucacuaauuuuaccugaugcu

SEQ ID NO: 103339 - RNA, 62 nt, hsa
auuguaacuacacugggcaucagaauaaaaggccucuagaaauugcugaacaaugguuaauu

SEQ ID NO: 103340 - RNA, 62 nt, hsa
gcugaaucuaaguaugguuuuuugucauauugccucuagauuuucuucugugcuucucucua

SEQ ID NO: 103341 - RNA, 62 nt, hsa
cgaggaacagagauggcccagcagacauuuggccucuagauccuuugaauggagcguaagua

SEQ ID NO: 103342 - RNA, 62 nt, hsa
uuauguaacugugggccuugccccugucuggcccucuagaugauuuguagcaguguuauucu

SEQ ID NO: 103343 - RNA, 62 nt, hsa
auucuccuauuuaccaguccuguccuauauacccucuagaaacagaaagcaauuuuuaggca

SEQ ID NO: 103344 - RNA, 62 nt, hsa
cagcuuugggaaagcugccucguuucccuuuuccucuagaagcagaaccagcucuacgagag

SEQ ID NO: 103345 - RNA, 62 nt, hsa
ggcuaccaggucucuaggggccugagagaggcccucuagagaauccagggaaacugugagcc

SEQ ID NO: 103346 - RNA, 62 nt, hsa
uucccaucugcugcucuuuguagaaaagguuuccucuagaacugaauuccucuggaauugag

SEQ ID NO: 103347 - RNA, 62 nt, hsa
uguaaacauugagcucaccuuuuauauauuaaccucuagaauuaaugggccuaugugguuuu

SEQ ID NO: 103348 - RNA, 62 nt, hsa
uuaaguacaggaagagacauauuuugaauuacccucuagacaucuaguaugcugaaaacugu

SEQ ID NO: 103349 - RNA, 62 nt, hsa
aucaccugcucuuuggcuaagguggcaguguaccucuagaucaaccugggaacagucacaag

SEQ ID NO: 103350 - RNA, 62 nt, hsa
uuccgacuugggguucaggcaggcuguuuucaccucuagacaccccucuccaccccuccugc

SEQ ID NO: 103351 - RNA, 62 nt, hsa
gauggggaccagcagccccacaccagggccagccucuagagcagacuacagcuggggugcag

SEQ ID NO: 103352 - RNA, 62 nt, hsa
acccucaggacacccucucugcacccugugguccucuagaguagcuagcucugaggccccaa

SEQ ID NO: 103353 - RNA, 62 nt, hsa
acuuguacaguuguagcugcgaguccagaaguccucuagagcauguguacuggcacugaguu

SEQ ID NO: 103354 - RNA, 62 nt, hsa
caucgugaugcuucucugaaguucugcuacaaccucuagaucugcagcuugccacaucagcu

SEQ ID NO: 103355 - RNA, 62 nt, hsa
acuguaaucuccagcuccugggcucaagugauccucuagacucagccucuagaauagcuggg

SEQ ID NO: 103356 - RNA, 62 nt, hsa
gcuccugggcucaagugauccucuagacucagccucuagaauagcugggacuacaggcacau

SEQ ID NO: 103357 - RNA, 62 nt, hsa
ggcugcaguccuauagaaugcauaccuuccucccucuagacaucccuccaccagaagagaca

SEQ ID NO: 103358 - RNA, 62 nt, hsa
agcugauuggagucagcuggaacauaccacugccucuagacuaaggucagcagauuuagcaa

SEQ ID NO: 103359 - RNA, 62 nt, hsa
auguuuuuagaagcaagagcaaaauuaugaaaccucuagagauuugggucauguuacuccau

SEQ ID NO: 103360 - RNA, 62 nt, hsa
aaacuccugugcuuuugagcaaggacuuuugcccucuagaaagcaacugaggccaggugcgg

SEQ ID NO: 103361 - RNA, 62 nt, hsa
guuuguuugguuuuuuuaauucuuaaaaacauccucuagaggaauagaaacaaauuuuuaug

SEQ ID NO: 103362 - RNA, 62 nt, hsa
acugugucaaaaugauaauuuuguuauguuagccucuagaaaauuuaaguucagaaaaaugc

SEQ ID NO: 103363 - RNA, 62 nt, hsa
gaaaugguucaugugauaaugugggcugguauccucuagaguaccuggguacauaaacagaa

SEQ ID NO: 103364 - RNA, 62 nt, hsa
ucuuccucacacccauuuagugggggauggguccucuagacuugaggggcuacccugggaag

SEQ ID NO: 103365 - RNA, 62 nt, hsa
aguucuguaauucuaaguguuguucuagauuuccucuagagaagguuauuagaaucuccauu

SEQ ID NO: 103366 - RNA, 62 nt, hsa
cuuucaacucuguugacccucugucuggucuuccucuagaagguaccgcagaaauugaugug

SEQ ID NO: 103367 - RNA, 62 nt, hsa
guugaaacaaacuuguauguaucuguaugugaccucuagauggaaauaaaaguuugauguuu

SEQ ID NO: 103368 - RNA, 62 nt, hsa
cacucagggcuucuccucugcuaggcuacccuccucuagaaggcugaguaccaugggcuaca

SEQ ID NO: 103369 - RNA, 62 nt, hsa
cuguuccacaaacagcaggcugaauggccucgccucuagauugacgugggccagccuccuug

SEQ ID NO: 103370 - RNA, 62 nt, hsa
uucccuggcuucuccuucagcccauccacucuccucuagagcaguuggguuggaggcucauu

SEQ ID NO: 103371 - RNA, 62 nt, hsa
guuacuuaaguuuguaagacagugcccugagaccucuagagaaaagauguuuguuuacauaa

SEQ ID NO: 103372 - RNA, 59 nt, hsa
gggcacccaggagugucugagcugcauuaccucuagaaaccucaaacaaguagaaacuu

SEQ ID NO: 103373 - RNA, 62 nt, hsa
gagaaaccauuccaguaugcauauuuuuuucuccucuagauucauacauuuauauagcauug

SEQ ID NO: 103374 - RNA, 62 nt, hsa
cagcuggcuccgagggcaacacaggggccuggccucuagagggcuggugauugaggggcccg

SEQ ID NO: 103375 - RNA, 62 nt, hsa
ugaaaaagaccuaaaaacagaaccaaagacagccucuagauuucuuacccucaagucuccug

SEQ ID NO: 103376 - RNA, 62 nt, hsa
uaagauuuguaaaucaugggcuugaccuuugaccucuagacacuaauuuuauccuuugaggc

SEQ ID NO: 103377 - RNA, 62 nt, hsa
uuucuagguuuguaagugcagcaguuuuauuuccucuagaacucauccuguuucaagggaag

SEQ ID NO: 103378 - RNA, 62 nt, hsa
gcuuaaugaucaaguguuacuuaucuaauaauccucuagaaagaacccuguuagaucuuggu

SEQ ID NO: 103379 - RNA, 62 nt, hsa
aagugggugcccuugguagcagccuggggugaccucuagagcuggaggcugugggacuccag

SEQ ID NO: 103380 - RNA, 62 nt, hsa
gauggaauuuuuccagccucauccuggccugcccucuagacuccaguccccaagcccucagc

SEQ ID NO: 103381 - RNA, 62 nt, hsa
agcuuccuauuccauguugagguuugugggccccucuagaggagggcuaguucuauacuuaa

SEQ ID NO: 103382 - RNA, 62 nt, hsa
uuuuccaaagaauauucuaagagcuauuagcuccucuagauauuuuuuugggggaaaaaggg

SEQ ID NO: 103383 - RNA, 62 nt, hsa
ggauuguguuagaggaaucggcucuguauuugccucuagagaaacacaguguucucuuugua

SEQ ID NO: 103384 - RNA, 62 nt, hsa
caaaaugccaagaucugggagccucuuucacuccucuagacacacugccugagauagaaguu

SEQ ID NO: 103385 - RNA, 62 nt, hsa
cuaguccugaguauaaauccugugcauagauuccucuagaaaggcaucaaaaggcucaacag

SEQ ID NO: 103386 - RNA, 62 nt, hsa
agcaagcuguagacggacagcaggacauuggaccucuagagcaagaugucaguaggaugacc

SEQ ID NO: 103387 - RNA, 62 nt, hsa
acuggacuguuccugggaaaagggugaagccaccucuagaagggacuuuggccuccccccaa

SEQ ID NO: 103388 - RNA, 62 nt, hsa
uaauaguaaagguaaaaucucucaguuuccuaccucuagaaagaggccaucucacuagaaua

SEQ ID NO: 103389 - RNA, 62 nt, hsa
uuucauuauaaaaugguuagaggacccuacccccucuagauucccugauuuccccaggccug

SEQ ID NO: 103390 - RNA, 62 nt, hsa
gacuuccucugagugaugccugagggucagcuccucuagacauugacugcaagagaaucucu

SEQ ID NO: 103391 - RNA, 62 nt, hsa
uccugccacuagguuucaccucccaaacccagccucuagaacagccagacccugcagauccc

SEQ ID NO: 103392 - RNA, 62 nt, hsa
uucuuugcauuuggcucuacuuacuaacaaccccucuagaauacauuggugauuucauuuaa

SEQ ID NO: 103393 - RNA, 60 nt, hsa
aagccacuuuccucuucagauccuggucugcaccucuagaggcagguccuaagaaggaga

SEQ ID NO: 103394 - RNA, 62 nt, hsa
gccucucuuuugggggaaucaagcauuugcuuccucuagacuacagcagggaaagggaggag

SEQ ID NO: 103395 - RNA, 62 nt, hsa
agacguuuucuaacuuuuucucuuuaagugcuccucuagacuagacugauugaaguagacag

SEQ ID NO: 103396 - RNA, 62 nt, hsa
caugaaaauucagaauuuuauacuuucccuacccucuagagaaauaagaucuuuuuugucag

SEQ ID NO: 103397 - RNA, 62 nt, hsa
ugaaugguaguugaggucuucauacaguucagccucuagaaugguaacaaaucagccaauug

SEQ ID NO: 103398 - RNA, 62 nt, hsa
gcaggguucaguuucauguaucuuugucuuuuccucuagaaccugccuuuuucaaauauccc

SEQ ID NO: 103399 - RNA, 62 nt, hsa
gcugugugaccacuuucccccacccuucccacccucuagacaacucucucccuuaccuguuu

SEQ ID NO: 103400 - RNA, 62 nt, hsa
ggguguacuaguuacacaucuucaacagacccccucuagaaauuuuucagaugcuucuggga

SEQ ID NO: 103401 - RNA, 62 nt, hsa
agcagcuguggucauuaaaccauuaguuuaccccucuagaacuggggucugcaaacucccac

SEQ ID NO: 103402 - RNA, 62 nt, hsa
ugccuccccucuggucuccagaguuuuccuguccucuagaggcaagccaggccagggagcug

SEQ ID NO: 103403 - RNA, 62 nt, hsa
cuacagcacuaagagaagccccugagaaaaacccucuagaaaaacagcuguuccucugugug

SEQ ID NO: 103404 - RNA, 62 nt, hsa
aggcaggaaggacugucccagacgaggggcuuccucuagagucucacugcuggggaggagag

SEQ ID NO: 103405 - RNA, 62 nt, hsa
cagggccccagccugauggggcugcccucaguccucuagaucaagaugcugacuauuagggg

SEQ ID NO: 103406 - RNA, 62 nt, hsa
gacuggaaaccuacccauuuuccccugagcauccucuagaugcugccccaaggaguugcugc

SEQ ID NO: 103407 - RNA, 62 nt, hsa
uucccucuguggccuccuggcuugcacugcucccucuagaaagauuccuucaggucuggagg

SEQ ID NO: 103408 - RNA, 62 nt, hsa
gcuucccugccaaacucacaaggagacaucaaccucuagacagggaacagcuucaggauacu

SEQ ID NO: 103409 - RNA, 62 nt, hsa
gccuuguuaugcacaagagauucuauuaaaagccucuagaaguaacuccccuuaaaaugucu

SEQ ID NO: 103410 - RNA, 62 nt, hsa
gaagaacugucuauuuucucagucauuuuuaaccucuagagucacugauacacagaauauaa

SEQ ID NO: 103411 - RNA, 62 nt, hsa
auaaaagauuuguacuguuuagaugggagaaaccucuagagagaguaaaaaugaauuacacu

SEQ ID NO: 103412 - RNA, 62 nt, hsa
uccuaggcccuagggauccaacuggcugucugccucuagaacucuccacccucaucucucug

SEQ ID NO: 103413 - RNA, 62 nt, hsa
cggagcccccucucagccuuaccugggccccuccucuagagaagagcucaacucucucccaa

SEQ ID NO: 103414 - RNA, 62 nt, hsa
guaagcuagaggauuguaaauaucuuuuauguccucuagauaaaacacccgauuaacagaug

SEQ ID NO: 103415 - RNA, 62 nt, hsa
agcggcugucacacucauugaaaugaaauggaccucuagaccaccuugugucuguuuccucu

SEQ ID NO: 103416 - RNA, 62 nt, hsa
cucauccccaccccaccucaccccaacaaacuccucuagaagaagccaagaauuucucucua

SEQ ID NO: 103417 - RNA, 62 nt, hsa
ugugccuguacccuccccuggucuacauaggaccucuagauaguguuagagagagaacaugu

SEQ ID NO: 103418 - RNA, 62 nt, hsa
caaaagagaugucauucaguuaaaaagacaaaccucuagauguguaauuacauggaaaauac

SEQ ID NO: 103419 - RNA, 62 nt, hsa
uuagcuguggcacaacacauacagcauugguuccucuagaucugguuaaaugcagaaugcag

SEQ ID NO: 103420 - RNA, 62 nt, hsa
uccucgcccuuucuuaaagugcaguucuuagcccucuagaaacgaguuggugucuuucgucu

SEQ ID NO: 103421 - RNA, 62 nt, hsa
caaacaaccgugcucagccuguuucucucugcccucuagagcaaggcccaccagguccaucc

SEQ ID NO: 103422 - RNA, 62 nt, hsa
ccucuccugcucugagccaggguggggcauucccucuagauucagguuugggcagggguccu

SEQ ID NO: 103423 - RNA, 62 nt, hsa
caaguuuccuaccagcaaauagcccuaacuugccucuagaguaggccaaaugccaacucugu

SEQ ID NO: 103424 - RNA, 62 nt, hsa
aagccucuagcuucacuggugcagaaaauuuuccucuagaucagaaucuucaagaaucaguu

SEQ ID NO: 103425 - RNA, 62 nt, hsa
agaaaaauguggauaaacagucaaaccuuuauccucuagaauuuuggcaauguugacuaaga

SEQ ID NO: 103426 - RNA, 62 nt, hsa
gccucuguccucauuuuguuuccuaugaucauccucuagauaccagauagaggcccauuccu

SEQ ID NO: 103427 - RNA, 62 nt, hsa
ggauugccauuuucauuauauaauacuuuguaccucuagagcacucucccuuucuguuuuuu

SEQ ID NO: 103428 - RNA, 62 nt, hsa
uaccauuugaauauuuucauuugguguuuuccccucuagaaaacagaguugcuguuguuuuu

SEQ ID NO: 103429 - RNA, 62 nt, hsa
gggcuaaugcugcauuuuucuacaacaucaugccucuagaagguuuaagcuagguaggcuuu

SEQ ID NO: 103430 - RNA, 62 nt, hsa
uuggaccagaucuaacaucuugaauacucugcccucuagagccuucagccuuaauggaaggu

SEQ ID NO: 103431 - RNA, 62 nt, hsa
agucugaggauguuaacuuuggaacucgcaguccucuagaacagcuucagauuauggcuuuu

SEQ ID NO: 103432 - RNA, 62 nt, hsa
ucugauugagugcagaggagacuagacagucuccucuagacagguuguagacacacccuccc

SEQ ID NO: 103433 - RNA, 62 nt, hsa
gccagucagcuccuacagugaucaguuggccaccucuagaucuguguuugccggucuagacg

SEQ ID NO: 103434 - RNA, 62 nt, hsa
agagccugguagagacuagggaagggaggucuccucuagacugacucacauugccuugagcu

SEQ ID NO: 103435 - RNA, 62 nt, hsa
aaugaagaccuacuuucaacuccuuuuuccccccucuagaagaaucaaauugaaucuuuuac

SEQ ID NO: 103436 - RNA, 62 nt, hsa
acgaggagaucuaagcagcguucccacagcccccucuagauucuuggaguuccgcagagcuu

SEQ ID NO: 103437 - RNA, 62 nt, hsa
uuugugaaugagaguuggcaugucaaaugcauccucuagaaaaauaauuaguguuauagucu

SEQ ID NO: 103438 - RNA, 62 nt, hsa
uggagaauuaucacaaccuaaugacauuaauaccucuagaaagggcugcugucauagugaac

SEQ ID NO: 103439 - RNA, 62 nt, hsa
aacuugcagguccagguugguauacauuccacccucuagaaguauuuucuuacaguagauaa

SEQ ID NO: 103440 - RNA, 62 nt, hsa
ucccuguaguugacaauucugcauguacuaguccucuagaaauagguuaaacugaagcaacu

SEQ ID NO: 103441 - RNA, 62 nt, hsa
ugucugcucccacagcaccaucuaagaccccuccucuagaaguggggaaggccagaugugua

SEQ ID NO: 103442 - RNA, 62 nt, hsa
caaucauguacuuuaguuuaauguauaaagauccucuagaaaaugauaauauuguguauuaa

SEQ ID NO: 103443 - RNA, 62 nt, hsa
cacacuucaaccccagcuugcuggucggcuuuccucuagagagagccgguuuuggggccauu

SEQ ID NO: 103444 - RNA, 62 nt, hsa
ucuaagggugccaagagacugguuagucaaagccucuagaaggggauccucguugaaaggag

SEQ ID NO: 103445 - RNA, 62 nt, hsa
guguagggucacugggagagcagaggucacagccucuagagaagggagaggggcgugugcau

SEQ ID NO: 103446 - RNA, 62 nt, hsa
gggcugacccucucugcaaaacucuccccuguccucuagaccccacccuggguguaugugag

SEQ ID NO: 103447 - RNA, 62 nt, hsa
cugggccuggugagcuacugcccccaaccuacccucuagaggggcugggaagggccguucug

SEQ ID NO: 103448 - RNA, 62 nt, hsa
gagguguccgcugacggguggccucucaccccccucuagagaaaccugacauuuacaaugga

SEQ ID NO: 103449 - RNA, 62 nt, hsa
cagcaccuuagggccaggggcuuaccuuucaaccucuagagagaccagcugccuuugagacc

SEQ ID NO: 103450 - RNA, 62 nt, hsa
uaaaccuaggccugugauacuugggcugugauccucuagagccagcuuggacucacaucauu

SEQ ID NO: 103451 - RNA, 62 nt, hsa
uggcaaguguccagaugccagaaccuucuuuuccucuagaagggauggugcuugguaaccuu

SEQ ID NO: 103452 - RNA, 62 nt, hsa
cucagccgcucuuugcuccagaccugccccucccucuagaggcugccugggccuguucacgu

SEQ ID NO: 103453 - RNA, 62 nt, hsa
ucaugauuccuguagguaaaaguacaagacgaccucuagaugucuuuucuuucuaugaaagg

SEQ ID NO: 103454 - RNA, 62 nt, hsa
ggggcccagucguucuugggcccaggauggggccucuagacuugcaagggagaggaacaggg

SEQ ID NO: 103455 - RNA, 62 nt, hsa
acccagcggcgacauuguacagacuccucucaccucuagauagcaaauagcucucagauggu

SEQ ID NO: 103456 - RNA, 62 nt, hsa
agggcucugugaccaggaaggaagucagcaugccucuagaggcaaggaggggaggaacacug

SEQ ID NO: 103457 - RNA, 62 nt, hsa
gugugagaggucuccuggguuggggcccagccccucuagaguagcugguggccagggaugaa

SEQ ID NO: 103458 - RNA, 62 nt, hsa
uugaaauauaaaaaccuagauuuauggaguuuccucuagaucauguuauauucuauaucaga

SEQ ID NO: 103459 - RNA, 62 nt, hsa
ucucugcucccaaaccaugucaggaccaccuuccucuagagcucgggagcccggagggucuu

SEQ ID NO: 103460 - RNA, 62 nt, hsa
uuccccuggcaugaaacuuucagauuccccugccucuagaaauuguccugcccuccucacca

SEQ ID NO: 103461 - RNA, 62 nt, hsa
cacccuugacugguugggauuugcucguccagccucuagacacuucccaaagcaagacugga

SEQ ID NO: 103462 - RNA, 62 nt, hsa
aacccaugguucucagcuggggugacacugcuccucuagaagcagguuugaaauuaugggua

SEQ ID NO: 103463 - RNA, 62 nt, hsa
agaauacuucuccucuuccucaccuucgggugccucuagacacuugacuuacgaucguuauu

SEQ ID NO: 103464 - RNA, 62 nt, hsa
ugccacaggguccuccgaugcuggccuuugcgccucuagaggcagccacucauggauucaag

SEQ ID NO: 103465 - RNA, 62 nt, hsa
uggccaucccaccuaucccuuacccuucccugccucuagagccacuguucucacuacuucua

SEQ ID NO: 103466 - RNA, 62 nt, hsa
gaggggacugcuguacaaagaauauaggaaggccucuagacuacauccauuccuuccucaac

SEQ ID NO: 103467 - RNA, 62 nt, hsa
gugcugagcaaacguggagacaccauuucccuccucuagaccucaucuuggagagagagaug

SEQ ID NO: 103468 - RNA, 62 nt, hsa
cuucacccugugggaaguggccccagccaucuccucuagaccaaggcaggcagccccgacau

SEQ ID NO: 103469 - RNA, 62 nt, hsa
uuugaccucugccccccaugaaucccauuuuaccucuagaccuauaaguucugguuuauguu

SEQ ID NO: 103470 - RNA, 62 nt, hsa
guucucuaauauuuuaccucauuuguguuccaccucuagauuacuucagguuuuuuuccuuu

SEQ ID NO: 103471 - RNA, 62 nt, hsa
aaaaaauaaaagugggaaaaucuuccaacuguccucuagagugugaauauaugaaaggaguc

SEQ ID NO: 103472 - RNA, 62 nt, hsa
uuaugaaauccuauugguggauaucguagucuccucuagauauuuugccauaauacaugcca

SEQ ID NO: 103473 - RNA, 62 nt, hsa
ggcucaaaacagaauuuaucuuguuaauaauuccucuagauagaauaauguagaaacauuuu

SEQ ID NO: 103474 - RNA, 62 nt, hsa
ucaaaugcacgguggucccuguuagaguuagaccucuagacucaccuguucucacgcccugu

SEQ ID NO: 103475 - RNA, 62 nt, hsa
ucccaucuccuuucagaaaaauucaagguccuccucuagaaguuucaaaucucucccaacuc

SEQ ID NO: 103476 - RNA, 62 nt, hsa
aaggcccuggguucaagagaguuggagaaaccccucuagaaacauauuggcugucaucaaag

SEQ ID NO: 103477 - RNA, 62 nt, hsa
aggaguggaagugugggugaugcaaguagaacccucuagauguacccuguguggucugcagg

SEQ ID NO: 103478 - RNA, 62 nt, hsa
cugggaugaccuucccuggguuaaucaauuucccucuagacaacacaaacugcaggcaugug

SEQ ID NO: 103479 - RNA, 62 nt, hsa
cucuaggcuuuuaucuugcggggucagagcgcccucuagagggaaaagcuagaggcacaggg

SEQ ID NO: 103480 - RNA, 62 nt, hsa
aucucuuccagcaccaucaggguuuuaauggcccucuagaauuaccacugagauacacuauu

SEQ ID NO: 103481 - RNA, 62 nt, hsa
aguaacgucuugucugugaucuuuguucuugaccucuagaccccaagaugugaacagugcac

SEQ ID NO: 103482 - RNA, 62 nt, hsa
cuuggagacacagaggguuucaccuuggaugaccucuagagaaauugcccaagaagcccacc

SEQ ID NO: 103483 - RNA, 62 nt, hsa
cucaagguaguuauaugcuggagaagaaaaauccucuagacacaugaaggcccacauaguca

SEQ ID NO: 103484 - RNA, 62 nt, hsa
ugaagaaucugggccaaccagggguccuugggccucuagaaggccacaguaggccucucuuu

SEQ ID NO: 103485 - RNA, 62 nt, hsa
aucugcuggugccuugaucuuggacuucccagccucuagaacuguaagaaauaaauauuugc

SEQ ID NO: 103486 - RNA, 62 nt, hsa
caagggcccaaggacagugccuuaguuuggauccucuagaaacuaacccugggaaaagggca

SEQ ID NO: 103487 - RNA, 62 nt, hsa
uguauaacuuauuuucuuauuaucuucuucucccucuagaauauaaauuuaugaaaauacaa

SEQ ID NO: 103488 - RNA, 62 nt, hsa
cucucggcuucucugcugagggugcacccuuuccucuagaugguaguugucacguuaucuuu

SEQ ID NO: 103489 - RNA, 62 nt, hsa
ggcgugacccaggccccuguagcccucagccuccucuagaagcuucuguacuccuuguagga

SEQ ID NO: 103490 - RNA, 62 nt, hsa
ugccguggccacccccgcugcccagugucugcccucuagaaguaggcuguguuuccaggugu

SEQ ID NO: 103491 - RNA, 62 nt, hsa
cgcagggucccaggcccagaagaggccccacgccucuagagcugggcuccguccucggcguu

SEQ ID NO: 103492 - RNA, 62 nt, hsa
aaaaaaauacagagucauccccuacccccaccccucuagagacccuccagcuaaaaacagag

SEQ ID NO: 103493 - RNA, 62 nt, hsa
gaagaggcugggggacuagaaagaggcccugcccucuagaaagcucagaucuuggcuucugu

SEQ ID NO: 103494 - RNA, 62 nt, hsa
aguuggcugccaaucucccugcucuugguucuccucuagauugaaguuuguuuucugaugcu

SEQ ID NO: 103495 - RNA, 62 nt, hsa
uuuguaguuaaaggguccaguucugacuggagccucuagagagcugggcuuguauguucuuu

SEQ ID NO: 103496 - RNA, 62 nt, hsa
ccccucuuucuuggggacccaguauguccucuccucuagacccagacauacaguuauaaccg

SEQ ID NO: 103497 - RNA, 62 nt, hsa
ugcaguuagcaaacuuuugcuuaagccuuuuuccucuagauacuccccauguuucgguaauc

SEQ ID NO: 103498 - RNA, 62 nt, hsa
uggauugugagugaaugggcccuuugagcugcccucuagagagcaaauccaguuuccuggag

SEQ ID NO: 103499 - RNA, 62 nt, hsa
acuccuaggcucaagcaguccuccugccuuagccucuagaguagcuggggcuacaggugcug

SEQ ID NO: 103500 - RNA, 62 nt, hsa
uacacaucagcauaugagaaucucugagagguccucuagaaaggagagaaaaagcaccucuu

SEQ ID NO: 103501 - RNA, 62 nt, hsa
augagacauguggauggcagugagagaucgugccucuagaucuugauggaggcuuggugaga

SEQ ID NO: 103502 - RNA, 62 nt, hsa
cacuucaucgugaggagcuguugggugucuugccucuagaggcuuugagaagcucagcugcc

SEQ ID NO: 103503 - RNA, 62 nt, hsa
aacuauagugauauaucaguguuugagagugaccucuagaaaaaagaaaaguguuuuuagaa

SEQ ID NO: 103504 - RNA, 62 nt, hsa
gcauugcagcaugaggcagggcaaacacuuucccucuagaucccuggggccucacccuguau

SEQ ID NO: 103505 - RNA, 62 nt, hsa
aguugugcaggagguagccuggugguuuucaaccucuagaauuuuaagccuuuguugaacug

SEQ ID NO: 103506 - RNA, 62 nt, hsa
aguuuggaguaagggacuucauauaccugauuccucuagaaggcugucuaacauaccacaug

SEQ ID NO: 103507 - RNA, 62 nt, hsa
aacuauagugauauaucaguguuugggagugaccucuagaaaaaagaaaacuguuuuuagaa

SEQ ID NO: 103508 - RNA, 63 nt, hsa
aguucuggcagcuccccgaggcagccgggguacccucuagauucagggaugcuugcucuccac

SEQ ID NO: 103509 - RNA, 63 nt, hsa
cacuuuguuucucccaaguaggccaccaggcagccucuagaguugcuuuacccaaauccuucu

SEQ ID NO: 103510 - RNA, 63 nt, hsa
ucuguaagugcuuuuuuuuucuucaccugggacccucuagagguuggaaagagaagagaggcu

SEQ ID NO: 103511 - RNA, 63 nt, hsa
uucccaaaaaguguuaucuuuuccuuaaauaucccucuagagguauuuuuccuaagugguauu

SEQ ID NO: 103512 - RNA, 63 nt, hsa
caugcagccucaaaauguuucaaaugccuaccgccucuagaucgagccacguugacuucaggu

SEQ ID NO: 103513 - RNA, 63 nt, hsa
agcagugguaauucaaaaugagaggguccccugccucuagagucaucaucuaauuggggacag

SEQ ID NO: 103514 - RNA, 63 nt, hsa
acuccacaucugccuuaaaaccaaagagggcuuccucuagaagccaagggaaaggggugcuuu

SEQ ID NO: 103515 - RNA, 63 nt, hsa
cacacuauaguauucccuuauuguagccaugguccucuagaugcaguuaaccaaauaggguca

SEQ ID NO: 103516 - RNA, 63 nt, hsa
ugcuuuucuuaccugucacaucuuggccauccuccucuagacaaaaccagccuuuaaaauauc

SEQ ID NO: 103517 - RNA, 63 nt, hsa
ccugaagccauuggagagcugucuuccuguguaccucuagaaucccagcagcagagaaccauc

SEQ ID NO: 103518 - RNA, 63 nt, hsa
uaaacgcuuaacaucuuccaccgcaacagcuugccucuagagggggaauuguucauccauuug

SEQ ID NO: 103519 - RNA, 57 nt, hsa; identical to SEQ ID NO: 103300

SEQ ID NO: 103520 - RNA, 63 nt, hsa
ggugaguaugguguucaggaugcaccaccaccaccucuagauaccuucaggcaacacagccca

SEQ ID NO: 103521 - RNA, 63 nt, hsa
gagaaguauguggacaucucuucuuuuccugucccucuagaagaacauucucccuugcuugau

SEQ ID NO: 103522 - RNA, 63 nt, hsa
gccuccuacuuuccucccuagguggacagugcuccucuagagagcugcgacuuuaauuaaaaa

SEQ ID NO: 103523 - RNA, 63 nt, hsa
ggguauuuuaaucuccuguuuaugauauauucaccucuagagcagucacugucaggguguugc

SEQ ID NO: 103524 - RNA, 63 nt, hsa
agaaaagaaaagaaaauuucuacuaauuucagaccucuagagcaauucaguccuguuggaaau

SEQ ID NO: 103525 - RNA, 63 nt, hsa
gaaaacucuuagaaaaaaaaaauucuguaauguccucuagauuuagauuaugagcccugagga

SEQ ID NO: 103526 - RNA, 63 nt, hsa
cugaaaugaaguuaaguuuggaaagaagugauaccucuagacuggguuuauauuaaucuggga

SEQ ID NO: 103527 - RNA, 63 nt, hsa
cccugcugucuauucuaagcccccagacucaagccucuagacucuuggaugaaacagugagaa

SEQ ID NO: 103528 - RNA, 63 nt, hsa
guguccagaccauugucuuccaaccccagcuggccucuagaacacccacuggccaguccuaga

SEQ ID NO: 103529 - RNA, 63 nt, hsa
guaccucagucacacacccccaaccccaggcagccucuagagccuucuugcuuucauuuuccu

SEQ ID NO: 103530 - RNA, 63 nt, hsa
uauguuccguggcaaugcuuuugugcauuacauccucuagagggaacauaaaaagauaccaau

SEQ ID NO: 103531 - RNA, 63 nt, hsa
gcuaguagguucugcuguuaugcagagccauuuccucuagaauuuggauaauaaagaugcuua

SEQ ID NO: 103532 - RNA, 63 nt, hsa
ccaagccucuauuauacaaaccaugcagacucgccucuagagauucugauucgguugaucugg

SEQ ID NO: 103533 - RNA, 63 nt, hsa
acuacagucagauuuauagccagccaucuaucaccucuagaagguuccagagacagugaaacu

SEQ ID NO: 103534 - RNA, 63 nt, hsa
cuguuacaggggccucagagcaccuucguuucuccucuagaccagggacagguguagagauaa

SEQ ID NO: 103535 - RNA, 63 nt, hsa
uuagaagguggaaaagccaagggaacggauucuccucuagagucuccggaaggaacacagcuc

SEQ ID NO: 103536 - RNA, 63 nt, hsa
aguggcccuuggccgagcgccgaacucgcucgcccucuagauguccaagugccacgugaacua

SEQ ID NO: 103537 - RNA, 63 nt, hsa
uuggagcauguggucuuuuuaaaaaauuguaacccucuagaaaauaucaaagaaaugaaccag

SEQ ID NO: 103538 - RNA, 63 nt, hsa
agucuggcagaagccacgcuuguuccccauguaccucuagagaagcagaaaccaaaguccccc

SEQ ID NO: 103539 - RNA, 63 nt, hsa
uuuucugaaccccacaucugccaucauuucucuccucuagagucccuggcuucuggccacugc

SEQ ID NO: 103540 - RNA, 63 nt, hsa
uuucaggguagucaaaauaaacauaaauuaucuccucuagaugaguggcgauguuggcugauu

SEQ ID NO: 103541 - RNA, 63 nt, hsa
aagaaaaaaguacugugaccugagagacacccuccucuagaauuuaguggcgggucugggcug

SEQ ID NO: 103542 - RNA, 63 nt, hsa
cuuugauaauuguuauuuuuuuggcagauaauuccucuagaauguguaucuuuuuaugauuua

SEQ ID NO: 103543 - RNA, 63 nt, hsa
aucagaugccuccugaagaauuacagacuucuuccucuagacuuggaggugagggacccucuc

SEQ ID NO: 103544 - RNA, 63 nt, hsa
ugccugggcccaaggggugaugaggcauccuuuccucuagaagaccugagucuuccugaccga

SEQ ID NO: 103545 - RNA, 63 nt, hsa
ucuagacaaaaaccauuguugaugaggcagaugccucuagaagagacguuuaaaagccaucaa

SEQ ID NO: 103546 - RNA, 63 nt, hsa
ugugaugcuucuggggcacguugaccauaugcaccucuagaaccuaaccagggcuuccuucua

SEQ ID NO: 103547 - RNA, 63 nt, hsa
gucauaccuagagauuuguggggggauacugaaccucuagacugaaguacuuaccggggagca

SEQ ID NO: 103548 - RNA, 63 nt, hsa
ugagagcguuccuugaguccguacaccguccucccucuagaagcuggcaucacacucaugcug

SEQ ID NO: 103549 - RNA, 63 nt, hsa
uugcauggaagagaacaccucuuuauggcuuacccucuagaauuucuaauuuauguguucugu

SEQ ID NO: 103550 - RNA, 63 nt, hsa
cucaucggcaggcgcaugaguaucugugggaguccucuagagagaugagaagccaggaggccu

SEQ ID NO: 103551 - RNA, 63 nt, hsa
ucaagcccauugcucucccacugcagaacauggccucuagauuaaugccaccgauucaggaac

SEQ ID NO: 103552 - RNA, 63 nt, hsa
uagcaccugggucccagcaucuagagcauggagccucuagaagccaugcucacccgcccacau

SEQ ID NO: 103553 - RNA, 63 nt, hsa
auggacaugaguccugugaggacuggugucucuccucuagagcuuucaucuuugggaugccug

SEQ ID NO: 103554 - RNA, 63 nt, hsa
augccacuucaucuaggaaaccuucauugaugcccucuagauuaggugcccuuacuauccauu

SEQ ID NO: 103555 - RNA, 63 nt, hsa
caaaacauaaccauauguguuuugcguuuacuuccucuagaaaagaauuugcaggcaaccaug

SEQ ID NO: 103556 - RNA, 63 nt, hsa
cagcauccacgcaucucuuggucccaauaacugccucuagauacauagccauacugcuaguua

SEQ ID NO: 103557 - RNA, 63 nt, hsa
cgagugccgccuguacucacaaaggcugccuuuccucuagagucacuaauuuuaccugaugcu

SEQ ID NO: 103558 - RNA, 63 nt, hsa
uauuguaacuacacugggcaucagaauaaaaggccucuagaaauugcugaacaaugguuaauu

SEQ ID NO: 103559 - RNA, 63 nt, hsa
agcugaaucuaaguaugguuuuuugucauauugccucuagauuuucuucugugcuucucucua

SEQ ID NO: 103560 - RNA, 63 nt, hsa
acgaggaacagagauggcccagcagacauuuggccucuagauccuuugaauggagcguaagua

SEQ ID NO: 103561 - RNA, 63 nt, hsa
auuauguaacugugggccuugccccugucuggcccucuagaugauuuguagcaguguuauucu

SEQ ID NO: 103562 - RNA, 63 nt, hsa
cauucuccuauuuaccaguccuguccuauauacccucuagaaacagaaagcaauuuuuaggca

SEQ ID NO: 103563 - RNA, 63 nt, hsa
gcagcuuugggaaagcugccucguuucccuuuuccucuagaagcagaaccagcucuacgagag

SEQ ID NO: 103564 - RNA, 63 nt, hsa
aggcuaccaggucucuaggggccugagagaggcccucuagagaauccagggaaacugugagcc

SEQ ID NO: 103565 - RNA, 63 nt, hsa
auucccaucugcugcucuuuguagaaaagguuuccucuagaacugaauuccucuggaauugag

SEQ ID NO: 103566 - RNA, 63 nt, hsa
guguaaacauugagcucaccuuuuauauauuaaccucuagaauuaaugggccuaugugguuuu

SEQ ID NO: 103567 - RNA, 63 nt, hsa
auuaaguacaggaagagacauauuuugaauuacccucuagacaucuaguaugcugaaaacugu

SEQ ID NO: 103568 - RNA, 63 nt, hsa
caucaccugcucuuuggcuaagguggcaguguaccucuagaucaaccugggaacagucacaag

SEQ ID NO: 103569 - RNA, 63 nt, hsa
uuuccgacuugggguucaggcaggcuguuuucaccucuagacaccccucuccaccccuccugc

SEQ ID NO: 103570 - RNA, 63 nt, hsa
agauggggaccagcagccccacaccagggccagccucuagagcagacuacagcuggggugcag

SEQ ID NO: 103571 - RNA, 63 nt, hsa
gacccucaggacacccucucugcacccugugguccucuagaguagcuagcucugaggccccaa

SEQ ID NO: 103572 - RNA, 63 nt, hsa
cacuuguacaguuguagcugcgaguccagaaguccucuagagcauguguacuggcacugaguu

SEQ ID NO: 103573 - RNA, 63 nt, hsa
ucaucgugaugcuucucugaaguucugcuacaaccucuagaucugcagcuugccacaucagcu

SEQ ID NO: 103574 - RNA, 63 nt, hsa
cacuguaaucuccagcuccugggcucaagugauccucuagacucagccucuagaauagcuggg

SEQ ID NO: 103575 - RNA, 63 nt, hsa
agcuccugggcucaagugauccucuagacucagccucuagaauagcugggacuacaggcacau

SEQ ID NO: 103576 - RNA, 63 nt, hsa
aggcugcaguccuauagaaugcauaccuuccucccucuagacaucccuccaccagaagagaca

SEQ ID NO: 103577 - RNA, 63 nt, hsa
gagcugauuggagucagcuggaacauaccacugccucuagacuaaggucagcagauuuagcaa

SEQ ID NO: 103578 - RNA, 63 nt, hsa
uauguuuuuagaagcaagagcaaaauuaugaaaccucuagagauuugggucauguuacuccau

SEQ ID NO: 103579 - RNA, 63 nt, hsa
aaaacuccugugcuuuugagcaaggacuuuugcccucuagaaagcaacugaggccaggugcgg

SEQ ID NO: 103580 - RNA, 63 nt, hsa
gguuuguuugguuuuuuuaauucuuaaaaacauccucuagaggaauagaaacaaauuuuuaug

SEQ ID NO: 103581 - RNA, 63 nt, hsa
uacugugucaaaaugauaauuuuguuauguuagccucuagaaaauuuaaguucagaaaaaugc

SEQ ID NO: 103582 - RNA, 63 nt, hsa
ggaaaugguucaugugauaaugugggcugguauccucuagaguaccuggguacauaaacagaa

SEQ ID NO: 103583 - RNA, 63 nt, hsa
cucuuccucacacccauuuagugggggauggguccucuagacuugaggggcuacccugggaag

SEQ ID NO: 103584 - RNA, 63 nt, hsa
aaguucuguaauucuaaguguuguucuagauuuccucuagagaagguuauuagaaucuccauu

SEQ ID NO: 103585 - RNA, 63 nt, hsa
ccuuucaacucuguugacccucugucuggucuuccucuagaagguaccgcagaaauugaugug

SEQ ID NO: 103586 - RNA, 63 nt, hsa
aguugaaacaaacuuguauguaucuguaugugaccucuagauggaaauaaaaguuugauguuu

SEQ ID NO: 103587 - RNA, 63 nt, hsa
ccacucagggcuucuccucugcuaggcuacccuccucuagaaggcugaguaccaugggcuaca

SEQ ID NO: 103588 - RNA, 63 nt, hsa
acuguuccacaaacagcaggcugaauggccucgccucuagauugacgugggccagccuccuug

SEQ ID NO: 103589 - RNA, 63 nt, hsa
cuucccuggcuucuccuucagcccauccacucuccucuagagcaguuggguuggaggcucauu

SEQ ID NO: 103590 - RNA, 63 nt, hsa
uguuacuuaaguuuguaagacagugcccugagaccucuagagaaaagauguuuguuuacauaa

SEQ ID NO: 103591 - RNA, 59 nt, hsa; identical to SEQ ID NO: 103372

SEQ ID NO: 103592 - RNA, 63 nt, hsa
ggagaaaccauuccaguaugcauauuuuuuucuccucuagauucauacauuuauauagcauug

SEQ ID NO: 103593 - RNA, 63 nt, hsa
ccagcuggcuccgagggcaacacaggggccuggccucuagagggcuggugauugaggggcccg

SEQ ID NO: 103594 - RNA, 63 nt, hsa
augaaaaagaccuaaaaacagaaccaaagacagccucuagauuucuuacccucaagucuccug

SEQ ID NO: 103595 - RNA, 63 nt, hsa
auaagauuuguaaaucaugggcuugaccuuugaccucuagacacuaauuuuauccuuugaggc

SEQ ID NO: 103596 - RNA, 63 nt, hsa
auuucuagguuuguaagugcagcaguuuuauuuccucuagaacucauccuguuucaagggaag

SEQ ID NO: 103597 - RNA, 63 nt, hsa
ugcuuaaugaucaaguguuacuuaucuaauaauccucuagaaagaacccuguuagaucuuggu

SEQ ID NO: 103598 - RNA, 63 nt, hsa
gaagugggugcccuugguagcagccuggggugaccucuagagcuggaggcugugggacuccag

SEQ ID NO: 103599 - RNA, 63 nt, hsa
agauggaauuuuuccagccucauccuggccugcccucuagacuccaguccccaagcccucagc

SEQ ID NO: 103600 - RNA, 63 nt, hsa
gagcuuccuauuccauguugagguuugugggccccucuagaggagggcuaguucuauacuuaa

SEQ ID NO: 103601 - RNA, 63 nt, hsa
auuuuccaaagaauauucuaagagcuauuagcuccucuagauauuuuuuugggggaaaaaggg

SEQ ID NO: 103602 - RNA, 63 nt, hsa
uggauuguguuagaggaaucggcucuguauuugccucuagagaaacacaguguucucuuugua

SEQ ID NO: 103603 - RNA, 63 nt, hsa
ucaaaaugccaagaucugggagccucuuucacuccucuagacacacugccugagauagaaguu

SEQ ID NO: 103604 - RNA, 63 nt, hsa
ccuaguccugaguauaaauccugugcauagauuccucuagaaaggcaucaaaaggcucaacag

SEQ ID NO: 103605 - RNA, 63 nt, hsa
gagcaagcuguagacggacagcaggacauuggaccucuagagcaagaugucaguaggaugacc

SEQ ID NO: 103606 - RNA, 63 nt, hsa
aacuggacuguuccugggaaaagggugaagccaccucuagaagggacuuuggccuccccccaa

SEQ ID NO: 103607 - RNA, 63 nt, hsa
uuaauaguaaagguaaaaucucucaguuuccuaccucuagaaagaggccaucucacuagaaua

SEQ ID NO: 103608 - RNA, 63 nt, hsa
uuuucauuauaaaaugguuagaggacccuacccccucuagauucccugauuuccccaggccug

SEQ ID NO: 103609 - RNA, 63 nt, hsa
ggacuuccucugagugaugccugagggucagcuccucuagacauugacugcaagagaaucucu

SEQ ID NO: 103610 - RNA, 63 nt, hsa
cuccugccacuagguuucaccucccaaacccagccucuagaacagccagacccugcagauccc

SEQ ID NO: 103611 - RNA, 63 nt, hsa
guucuuugcauuuggcucuacuuacuaacaaccccucuagaauacauuggugauuucauuuaa

SEQ ID NO: 103612 - RNA, 61 nt, hsa
aaagccacuuuccucuucagauccuggucugcaccucuagaggcagguccuaagaaggaga

SEQ ID NO: 103613 - RNA, 63 nt, hsa
agccucucuuuugggggaaucaagcauuugcuuccucuagacuacagcagggaaagggaggag

SEQ ID NO: 103614 - RNA, 63 nt, hsa
aagacguuuucuaacuuuuucucuuuaagugcuccucuagacuagacugauugaaguagacag

SEQ ID NO: 103615 - RNA, 63 nt, hsa
acaugaaaauucagaauuuuauacuuucccuacccucuagagaaauaagaucuuuuuugucag

SEQ ID NO: 103616 - RNA, 63 nt, hsa
gugaaugguaguugaggucuucauacaguucagccucuagaaugguaacaaaucagccaauug

SEQ ID NO: 103617 - RNA, 63 nt, hsa
agcaggguucaguuucauguaucuuugucuuuuccucuagaaccugccuuuuucaaauauccc

SEQ ID NO: 103618 - RNA, 63 nt, hsa
ggcugugugaccacuuucccccacccuucccacccucuagacaacucucucccuuaccuguuu

SEQ ID NO: 103619 - RNA, 63 nt, hsa
gggguguacuaguuacacaucuucaacagacccccucuagaaauuuuucagaugcuucuggga

SEQ ID NO: 103620 - RNA, 63 nt, hsa
cagcagcuguggucauuaaaccauuaguuuaccccucuagaacuggggucugcaaacucccac

SEQ ID NO: 103621 - RNA, 63 nt, hsa
cugccuccccucuggucuccagaguuuuccuguccucuagaggcaagccaggccagggagcug

SEQ ID NO: 103622 - RNA, 63 nt, hsa
gcuacagcacuaagagaagccccugagaaaaacccucuagaaaaacagcuguuccucugugug

SEQ ID NO: 103623 - RNA, 63 nt, hsa
uaggcaggaaggacugucccagacgaggggcuuccucuagagucucacugcuggggaggagag

SEQ ID NO: 103624 - RNA, 63 nt, hsa
ccagggccccagccugauggggcugcccucaguccucuagaucaagaugcugacuauuagggg

SEQ ID NO: 103625 - RNA, 63 nt, hsa
agacuggaaaccuacccauuuuccccugagcauccucuagaugcugccccaaggaguugcugc

SEQ ID NO: 103626 - RNA, 63 nt, hsa
uuucccucuguggccuccuggcuugcacugcucccucuagaaagauuccuucaggucuggagg

SEQ ID NO: 103627 - RNA, 63 nt, hsa
agcuucccugccaaacucacaaggagacaucaaccucuagacagggaacagcuucaggauacu

SEQ ID NO: 103628 - RNA, 63 nt, hsa
cgccuuguuaugcacaagagauucuauuaaaagccucuagaaguaacuccccuuaaaaugucu

SEQ ID NO: 103629 - RNA, 63 nt, hsa
ugaagaacugucuauuuucucagucauuuuuaaccucuagagucacugauacacagaauauaa

SEQ ID NO: 103630 - RNA, 63 nt, hsa
cauaaaagauuuguacuguuuagaugggagaaaccucuagagagaguaaaaaugaauuacacu

SEQ ID NO: 103631 - RNA, 63 nt, hsa
guccuaggcccuagggauccaacuggcugucugccucuagaacucuccacccucaucucucug

SEQ ID NO: 103632 - RNA, 63 nt, hsa
ucggagcccccucucagccuuaccugggccccuccucuagagaagagcucaacucucucccaa

SEQ ID NO: 103633 - RNA, 63 nt, hsa
gguaagcuagaggauuguaaauaucuuuuauguccucuagauaaaacacccgauuaacagaug

SEQ ID NO: 103634 - RNA, 63 nt, hsa
gagcggcugucacacucauugaaaugaaauggaccucuagaccaccuugugucuguuuccucu

SEQ ID NO: 103635 - RNA, 63 nt, hsa
ccucauccccaccccaccucaccccaacaaacuccucuagaagaagccaagaauuucucucua

SEQ ID NO: 103636 - RNA, 63 nt, hsa
augugccuguacccuccccuggucuacauaggaccucuagauaguguuagagagagaacaugu

SEQ ID NO: 103637 - RNA, 63 nt, hsa
gcaaaagagaugucauucaguuaaaaagacaaaccucuagauguguaauuacauggaaaauac

SEQ ID NO: 103638 - RNA, 63 nt, hsa
auuagcuguggcacaacacauacagcauugguuccucuagaucugguuaaaugcagaaugcag

SEQ ID NO: 103639 - RNA, 63 nt, hsa
cuccucgcccuuucuuaaagugcaguucuuagcccucuagaaacgaguuggugucuuucgucu

SEQ ID NO: 103640 - RNA, 63 nt, hsa
ccaaacaaccgugcucagccuguuucucucugcccucuagagcaaggcccaccagguccaucc

SEQ ID NO: 103641 - RNA, 63 nt, hsa
uccucuccugcucugagccaggguggggcauucccucuagauucagguuugggcagggguccu

SEQ ID NO: 103642 - RNA, 63 nt, hsa
ucaaguuuccuaccagcaaauagcccuaacuugccucuagaguaggccaaaugccaacucugu

SEQ ID NO: 103643 - RNA, 63 nt, hsa
aaagccucuagcuucacuggugcagaaaauuuuccucuagaucagaaucuucaagaaucaguu

SEQ ID NO: 103644 - RNA, 63 nt, hsa
uagaaaaauguggauaaacagucaaaccuuuauccucuagaauuuuggcaauguugacuaaga

SEQ ID NO: 103645 - RNA, 63 nt, hsa
ugccucuguccucauuuuguuuccuaugaucauccucuagauaccagauagaggcccauuccu

SEQ ID NO: 103646 - RNA, 63 nt, hsa
uggauugccauuuucauuauauaauacuuuguaccucuagagcacucucccuuucuguuuuuu

SEQ ID NO: 103647 - RNA, 63 nt, hsa
cuaccauuugaauauuuucauuugguguuuuccccucuagaaaacagaguugcuguuguuuuu

SEQ ID NO: 103648 - RNA, 63 nt, hsa
agggcuaaugcugcauuuuucuacaacaucaugccucuagaagguuuaagcuagguaggcuuu

SEQ ID NO: 103649 - RNA, 63 nt, hsa
cuuggaccagaucuaacaucuugaauacucugcccucuagagccuucagccuuaauggaaggu

SEQ ID NO: 103650 - RNA, 63 nt, hsa
gagucugaggauguuaacuuuggaacucgcaguccucuagaacagcuucagauuauggcuuuu

SEQ ID NO: 103651 - RNA, 63 nt, hsa
uucugauugagugcagaggagacuagacagucuccucuagacagguuguagacacacccuccc

SEQ ID NO: 103652 - RNA, 63 nt, hsa
ugccagucagcuccuacagugaucaguuggccaccucuagaucuguguuugccggucuagacg

SEQ ID NO: 103653 - RNA, 63 nt, hsa
cagagccugguagagacuagggaagggaggucuccucuagacugacucacauugccuugagcu

SEQ ID NO: 103654 - RNA, 63 nt, hsa
aaaugaagaccuacuuucaacuccuuuuuccccccucuagaagaaucaaauugaaucuuuuac

SEQ ID NO: 103655 - RNA, 63 nt, hsa
gacgaggagaucuaagcagcguucccacagcccccucuagauucuuggaguuccgcagagcuu

SEQ ID NO: 103656 - RNA, 63 nt, hsa
uuuugugaaugagaguuggcaugucaaaugcauccucuagaaaaauaauuaguguuauagucu

SEQ ID NO: 103657 - RNA, 63 nt, hsa
cuggagaauuaucacaaccuaaugacauuaauaccucuagaaagggcugcugucauagugaac

SEQ ID NO: 103658 - RNA, 63 nt, hsa
gaacuugcagguccagguugguauacauuccacccucuagaaguauuuucuuacaguagauaa

SEQ ID NO: 103659 - RNA, 63 nt, hsa
uucccuguaguugacaauucugcauguacuaguccucuagaaauagguuaaacugaagcaacu

SEQ ID NO: 103660 - RNA, 63 nt, hsa
uugucugcucccacagcaccaucuaagaccccuccucuagaaguggggaaggccagaugugua

SEQ ID NO: 103661 - RNA, 63 nt, hsa
ucaaucauguacuuuaguuuaauguauaaagauccucuagaaaaugauaauauuguguauuaa

SEQ ID NO: 103662 - RNA, 63 nt, hsa
gcacacuucaaccccagcuugcuggucggcuuuccucuagagagagccgguuuuggggccauu

SEQ ID NO: 103663 - RNA, 63 nt, hsa
uucuaagggugccaagagacugguuagucaaagccucuagaaggggauccucguugaaaggag

SEQ ID NO: 103664 - RNA, 63 nt, hsa
aguguagggucacugggagagcagaggucacagccucuagagaagggagaggggcgugugcau

SEQ ID NO: 103665 - RNA, 63 nt, hsa
agggcugacccucucugcaaaacucuccccuguccucuagaccccacccuggguguaugugag

SEQ ID NO: 103666 - RNA, 63 nt, hsa
ccugggccuggugagcuacugcccccaaccuacccucuagaggggcugggaagggccguucug

SEQ ID NO: 103667 - RNA, 63 nt, hsa
ugagguguccgcugacggguggccucucaccccccucuagagaaaccugacauuuacaaugga

SEQ ID NO: 103668 - RNA, 63 nt, hsa
ccagcaccuuagggccaggggcuuaccuuucaaccucuagagagaccagcugccuuugagacc

SEQ ID NO: 103669 - RNA, 63 nt, hsa
uuaaaccuaggccugugauacuugggcugugauccucuagagccagcuuggacucacaucauu

SEQ ID NO: 103670 - RNA, 63 nt, hsa
cuggcaaguguccagaugccagaaccuucuuuuccucuagaagggauggugcuugguaaccuu

SEQ ID NO: 103671 - RNA, 63 nt, hsa
ccucagccgcucuuugcuccagaccugccccucccucuagaggcugccugggccuguucacgu

SEQ ID NO: 103672 - RNA, 63 nt, hsa
aucaugauuccuguagguaaaaguacaagacgaccucuagaugucuuuucuuucuaugaaagg

SEQ ID NO: 103673 - RNA, 63 nt, hsa
aggggcccagucguucuugggcccaggauggggccucuagacuugcaagggagaggaacaggg

SEQ ID NO: 103674 - RNA, 63 nt, hsa
cacccagcggcgacauuguacagacuccucucaccucuagauagcaaauagcucucagauggu

SEQ ID NO: 103675 - RNA, 63 nt, hsa
cagggcucugugaccaggaaggaagucagcaugccucuagaggcaaggaggggaggaacacug

SEQ ID NO: 103676 - RNA, 63 nt, hsa
ugugugagaggucuccuggguuggggcccagccccucuagaguagcugguggccagggaugaa

SEQ ID NO: 103677 - RNA, 63 nt, hsa
auugaaauauaaaaaccuagauuuauggaguuuccucuagaucauguuauauucuauaucaga

SEQ ID NO: 103678 - RNA, 63 nt, hsa
uucucugcucccaaaccaugucaggaccaccuuccucuagagcucgggagcccggagggucuu

SEQ ID NO: 103679 - RNA, 63 nt, hsa
auuccccuggcaugaaacuuucagauuccccugccucuagaaauuguccugcccuccucacca

SEQ ID NO: 103680 - RNA, 63 nt, hsa
ccacccuugacugguugggauuugcucguccagccucuagacacuucccaaagcaagacugga

SEQ ID NO: 103681 - RNA, 63 nt, hsa
uaacccaugguucucagcuggggugacacugcuccucuagaagcagguuugaaauuaugggua

SEQ ID NO: 103682 - RNA, 63 nt, hsa
cagaauacuucuccucuuccucaccuucgggugccucuagacacuugacuuacgaucguuauu

SEQ ID NO: 103683 - RNA, 63 nt, hsa
cugccacaggguccuccgaugcuggccuuugcgccucuagaggcagccacucauggauucaag

SEQ ID NO: 103684 - RNA, 63 nt, hsa
uuggccaucccaccuaucccuuacccuucccugccucuagagccacuguucucacuacuucua

SEQ ID NO: 103685 - RNA, 63 nt, hsa
agaggggacugcuguacaaagaauauaggaaggccucuagacuacauccauuccuuccucaac

SEQ ID NO: 103686 - RNA, 63 nt, hsa
ugugcugagcaaacguggagacaccauuucccuccucuagaccucaucuuggagagagagaug

SEQ ID NO: 103687 - RNA, 63 nt, hsa
acuucacccugugggaaguggccccagccaucuccucuagaccaaggcaggcagccccgacau

SEQ ID NO: 103688 - RNA, 63 nt, hsa
cuuugaccucugccccccaugaaucccauuuuaccucuagaccuauaaguucugguuuauguu

SEQ ID NO: 103689 - RNA, 63 nt, hsa
aguucucuaauauuuuaccucauuuguguuccaccucuagauuacuucagguuuuuuuccuuu

SEQ ID NO: 103690 - RNA, 63 nt, hsa
gaaaaaauaaaagugggaaaaucuuccaacuguccucuagagugugaauauaugaaaggaguc

SEQ ID NO: 103691 - RNA, 63 nt, hsa
cuuaugaaauccuauugguggauaucguagucuccucuagauauuuugccauaauacaugcca

SEQ ID NO: 103692 - RNA, 63 nt, hsa
uggcucaaaacagaauuuaucuuguuaauaauuccucuagauagaauaauguagaaacauuuu

SEQ ID NO: 103693 - RNA, 63 nt, hsa
uucaaaugcacgguggucccuguuagaguuagaccucuagacucaccuguucucacgcccugu

SEQ ID NO: 103694 - RNA, 63 nt, hsa
cucccaucuccuuucagaaaaauucaagguccuccucuagaaguuucaaaucucucccaacuc

SEQ ID NO: 103695 - RNA, 63 nt, hsa
uaaggcccuggguucaagagaguuggagaaaccccucuagaaacauauuggcugucaucaaag

SEQ ID NO: 103696 - RNA, 63 nt, hsa
caggaguggaagugugggugaugcaaguagaacccucuagauguacccuguguggucugcagg

SEQ ID NO: 103697 - RNA, 63 nt, hsa
gcugggaugaccuucccuggguuaaucaauuucccucuagacaacacaaacugcaggcaugug

SEQ ID NO: 103698 - RNA, 63 nt, hsa
acucuaggcuuuuaucuugcggggucagagcgcccucuagagggaaaagcuagaggcacaggg

SEQ ID NO: 103699 - RNA, 63 nt, hsa
caucucuuccagcaccaucaggguuuuaauggcccucuagaauuaccacugagauacacuauu

SEQ ID NO: 103700 - RNA, 63 nt, hsa
uaguaacgucuugucugugaucuuuguucuugaccucuagaccccaagaugugaacagugcac

SEQ ID NO: 103701 - RNA, 63 nt, hsa
ucuuggagacacagaggguuucaccuuggaugaccucuagagaaauugcccaagaagcccacc

SEQ ID NO: 103702 - RNA, 63 nt, hsa
ucucaagguaguuauaugcuggagaagaaaaauccucuagacacaugaaggcccacauaguca

SEQ ID NO: 103703 - RNA, 63 nt, hsa
gugaagaaucugggccaaccagggguccuugggccucuagaaggccacaguaggccucucuuu

SEQ ID NO: 103704 - RNA, 63 nt, hsa
aaucugcuggugccuugaucuuggacuucccagccucuagaacuguaagaaauaaauauuugc

SEQ ID NO: 103705 - RNA, 63 nt, hsa
gcaagggcccaaggacagugccuuaguuuggauccucuagaaacuaacccugggaaaagggca

SEQ ID NO: 103706 - RNA, 63 nt, hsa
cuguauaacuuauuuucuuauuaucuucuucucccucuagaauauaaauuuaugaaaauacaa

SEQ ID NO: 103707 - RNA, 63 nt, hsa
gcucucggcuucucugcugagggugcacccuuuccucuagaugguaguugucacguuaucuuu

SEQ ID NO: 103708 - RNA, 63 nt, hsa
aggcgugacccaggccccuguagcccucagccuccucuagaagcuucuguacuccuuguagga

SEQ ID NO: 103709 - RNA, 63 nt, hsa
cugccguggccacccccgcugcccagugucugcccucuagaaguaggcuguguuuccaggugu

SEQ ID NO: 103710 - RNA, 63 nt, hsa
ucgcagggucccaggcccagaagaggccccacgccucuagagcugggcuccguccucggcguu

SEQ ID NO: 103711 - RNA, 63 nt, hsa
caaaaaaauacagagucauccccuacccccaccccucuagagacccuccagcuaaaaacagag

SEQ ID NO: 103712 - RNA, 63 nt, hsa
ggaagaggcugggggacuagaaagaggcccugcccucuagaaagcucagaucuuggcuucugu

SEQ ID NO: 103713 - RNA, 63 nt, hsa
uaguuggcugccaaucucccugcucuugguucuccucuagauugaaguuuguuuucugaugcu

SEQ ID NO: 103714 - RNA, 63 nt, hsa
cuuuguaguuaaaggguccaguucugacuggagccucuagagagcugggcuuguauguucuuu

SEQ ID NO: 103715 - RNA, 63 nt, hsa
gccccucuuucuuggggacccaguauguccucuccucuagacccagacauacaguuauaaccg

SEQ ID NO: 103716 - RNA, 63 nt, hsa
cugcaguuagcaaacuuuugcuuaagccuuuuuccucuagauacuccccauguuucgguaauc

SEQ ID NO: 103717 - RNA, 63 nt, hsa
guggauugugagugaaugggcccuuugagcugcccucuagagagcaaauccaguuuccuggag

SEQ ID NO: 103718 - RNA, 63 nt, hsa
aacuccuaggcucaagcaguccuccugccuuagccucuagaguagcuggggcuacaggugcug

SEQ ID NO: 103719 - RNA, 63 nt, hsa
guacacaucagcauaugagaaucucugagagguccucuagaaaggagagaaaaagcaccucuu

SEQ ID NO: 103720 - RNA, 63 nt, hsa
uaugagacauguggauggcagugagagaucgugccucuagaucuugauggaggcuuggugaga

SEQ ID NO: 103721 - RNA, 63 nt, hsa
acacuucaucgugaggagcuguugggugucuugccucuagaggcuuugagaagcucagcugcc

SEQ ID NO: 103722 - RNA, 63 nt, hsa
aaacuauagugauauaucaguguuugagagugaccucuagaaaaaagaaaaguguuuuuagaa

SEQ ID NO: 103723 - RNA, 63 nt, hsa
ugcauugcagcaugaggcagggcaaacacuuucccucuagaucccuggggccucacccuguau

SEQ ID NO: 103724 - RNA, 63 nt, hsa
caguugugcaggagguagccuggugguuuucaaccucuagaauuuuaagccuuuguugaacug

SEQ ID NO: 103725 - RNA, 63 nt, hsa
uaguuuggaguaagggacuucauauaccugauuccucuagaaggcugucuaacauaccacaug

SEQ ID NO: 103726 - RNA, 63 nt, hsa
aaacuauagugauauaucaguguuugggagugaccucuagaaaaaagaaaacuguuuuuagaa

SEQ ID NO: 103727 - RNA, 64 nt, hsa
ccuuccauuuuuuaaaauaagaaauuagcagcccucugcauaauguagcugccuauaugcaguu

SEQ ID NO: 103728 - RNA, 64 nt, hsa
gaucucagcauaauaaugcucacuaauaaugaagucugcauagugacacucaucaagacugaag

SEQ ID NO: 103729 - RNA, 64 nt, hsa
aaggaaaagcacaagaaacuuuggaagcacuuuuucugcauacuuagaugaucuucaugggccc

SEQ ID NO: 103730 - RNA, 64 nt, hsa
gaugacuuaaggugaagugaggacaaaaucacauucugcauacuaaccuauuuuuuucucccuu

SEQ ID NO: 103731 - RNA, 64 nt, hsa
agggcacaccuagacaaacaagggagaagagugucagaaucagaaucauggagaaaaugggcgg

SEQ ID NO: 103732 - RNA, 64 nt, hsa
caccuagacaaacaagggagaagagugucagaaucagaaucauggagaaaaugggcgggggugg

SEQ ID NO: 103733 - RNA, 64 nt, hsa
auuugauuaaauaaugauucacagaauuuaguaacagaaucaaacuaagccauguaugagggua

SEQ ID NO: 103734 - RNA, 64 nt, hsa
auuaagauaucuucagcuuguagucagacacaaucagaaucacagaaaaauccugccuaaggca

SEQ ID NO: 103735 - RNA, 64 nt, hsa
aaaugagaugcagaaucagaaggaucuauuucuacagaaucauuucaccaguuaagcacaugag

SEQ ID NO: 103736 - RNA, 64 nt, hsa
ccuccuguuguaguugccauaaggaaaugagaugcagaaucagaaggaucuauuucuacagaau

SEQ ID NO: 103737 - RNA, 64 nt, hsa
uuggacuuaaaguuccacauggcuggggaggccucagaaucauggugggaggcaaaagacacuu

SEQ ID NO: 103738 - RNA, 64 nt, hsa
uuggacuuacaguuccacauggcuggggaggccucagaaucauggcgggaggugaaaggcacuu

SEQ ID NO: 103739 - RNA, 64 nt, hsa
aucagagucacagaguagaauuugaucagaaucacagaaucaucagacauaggaacugagcaca

SEQ ID NO: 103740 - RNA, 64 nt, hsa
caaauuugaucagagucacagaguagaauuugaucagaaucacagaaucaucagacauaggaac

SEQ ID NO: 103741 - RNA, 64 nt, hsa
gagggagguuauaauaauagagcauccuguuaaucagaaucaugggggagaacauacagcccag

SEQ ID NO: 103742 - RNA, 64 nt, hsa
guguaucucaggggcuuccaaauuuagcuuacaucagaaucacuuggaaggcuuguuaaaaccc

SEQ ID NO: 103743 - RNA, 64 nt, hsa
aucaagaaacaaauuuuaauuaaacaaucuguaacagaaucaagaaacaaauacauuuuaauua

SEQ ID NO: 103744 - RNA, 64 nt, hsa
caucccuuuucacaugguuucuccauguauauaacagaaucaagaaacaaauuuuaauuaaaca

SEQ ID NO: 103745 - RNA, 64 nt, hsa
uuacaguguuuucuuaucaauuugcuauauugcacagaaucagugugugucuuuucauaagguu

SEQ ID NO: 103746 - RNA, 64 nt, hsa
aguauugccaaugcuguuuucauucucuaguggccagaaucauuauccuugaaauuucugguag

SEQ ID NO: 103747 - RNA, 64 nt, hsa
aacaaacaaaaaaacaaaaacaaaaaaacaaaaccagaaucagguaaaacagcuaugugauuaa

SEQ ID NO: 103748 - RNA, 64 nt, hsa
agugguaucaagagaacuuugguggugguuucuucagaaucaugaaguucuuuugccagauaaa

SEQ ID NO: 103749 - RNA, 64 nt, hsa
uuggacuuacaguuccacaugacuggggaggccucagaaucauggugggaggcaaaaagcacuu

SEQ ID NO: 103750 - RNA, 64 nt, hsa
uuggacuuacaguuccacauggccggggaggccucagaaucauggcgggaggugaaaagcacuu

SEQ ID NO: 103751 - RNA, 64 nt, hsa
gcaaaagugauguuauaguuuuuuuuacuuuugucagaaucaaggcuucggccaccugugcaau

SEQ ID NO: 103752 - RNA, 64 nt, hsa
uuuugcuauagacucauucauguuuuuuaggaaucagaaucauuucaggagaaaaccaacuaag

SEQ ID NO: 103753 - RNA, 64 nt, hsa
ucuuggagagucuuggggauuguuggcaccuaaacagaaucagugacccgggugcuuuguggcc

SEQ ID NO: 103754 - RNA, 64 nt, hsa
aaucagugacccgggugcuuuguggccagcagcacagaaucaaacccgcaucccagcauugggc

SEQ ID NO: 103755 - RNA, 64 nt, hsa
acuguagccaccuaaguaggacauuauaugauuucagaaucaauauguggaacuucuuuaagca

SEQ ID NO: 103756 - RNA, 64 nt, hsa
acucugccuggccuaccacuaacuugaauacauucagaaucaccuccucuccccaaaauuugua

SEQ ID NO: 103757 - RNA, 64 nt, hsa
ucuugaaagacgaaaucaaagcccauuaaugauucagaaucagugcuugaccuccuguauucug

SEQ ID NO: 103758 - RNA, 64 nt, hsa
aguucauugggggaaaaaaaauaagaagauucaacagaaucagcauuugaaguguaccauuggu

SEQ ID NO: 103759 - RNA, 64 nt, hsa
ggcaugugugccuggcccagguuucuuaauaaaacagaaucaugaucuuccagguuccccccag

SEQ ID NO: 103760 - RNA, 64 nt, hsa
uaaaacacuuuccaaauaucugcacuucugaugucagaaucaaaccagauaauucucuaauucu

SEQ ID NO: 103761 - RNA, 64 nt, hsa
auugauauaaaaauaaaagaacuggaaccagauucagaaucaugaaaacaacauuuuuacaaca

SEQ ID NO: 103762 - RNA, 64 nt, hsa
caguuuuauuuuucucugauuuuuuuuaauaccacagaaucaccugagugucaauugaaaguug

SEQ ID NO: 103763 - RNA, 64 nt, hsa
auggaacccuuucccguauuaaacaaaccagagacagaaucagugcugacucaggaucuccugg

SEQ ID NO: 103764 - RNA, 64 nt, hsa
gauacagcucaugccaacccauccuaagugaguucagaaucaggguaucuugcccuauaagaua

SEQ ID NO: 103765 - RNA, 64 nt, hsa
gcaagacagaccaccagccagaaaucucugauaucaaccucaugucccccaccccucaccccau

SEQ ID NO: 103766 - RNA, 64 nt, hsa
gacuuccucauucauugagcuuuuuaaaagaucacaaccucaagaugguuaaaauccauugaca

SEQ ID NO: 103767 - RNA, 53 nt, hsa
cuccugugacgcccuccuagagccaaccucaguugaugccuucccagagucaa

SEQ ID NO: 103768 - RNA, 64 nt, hsa
ccagagccaaccucgggugacacccucccagagucaaccucaugugacaccuuaccggaguaaa

SEQ ID NO: 103769 - RNA, 64 nt, hsa
uuuuuaaccacuccgcacaucagugcugugaaggcaaccucaccauguauuuucuucauaaucu

SEQ ID NO: 103770 - RNA, 64 nt, hsa
uuacugaagccgacuccccuccccaucucccucucaaccucaacccaccugcaugcaucucccc

SEQ ID NO: 103771 - RNA, 53 nt, hsa
aacugagauugaaucgguaaaaacaaccucagggguccauaaacaauaucugc

SEQ ID NO: 103772 - RNA, 64 nt, hsa
uaacuauuucaaaaauuacugccuuuaaaaaaaacaaccucaagcuauauuuguauucauaauu

SEQ ID NO: 103773 - RNA, 64 nt, hsa
ucgaccucccgaagcucagaugguccuccaaccucaaccucaguuuuuuuuuucuuucuuucuu

SEQ ID NO: 103774 - RNA, 64 nt, hsa
gcaaccucgaccucccgaagcucagaugguccuccaaccucaaccucaguuuuuuuuuucuuuc

SEQ ID NO: 103775 - RNA, 64 nt, hsa
acgaggccacagcugccaucgaccuggagacugacaaccucauccaggcuaccauccgcaccca

SEQ ID NO: 103776 - RNA, 64 nt, hsa
acaaaggaguaguagcugaauuugauucuccagccaaccucauugcagcuagaggcaucuucua

SEQ ID NO: 103777 - RNA, 59 nt, hsa
cuugcuucccccagggcagcacaggcuaagucaggaacaucggaugccagggagggagg

SEQ ID NO: 103778 - RNA, 59 nt, hsa
cacacaguaggugcugagaguuaggacaggucaggaagucccccaggguccacaaaggu

SEQ ID NO: 103779 - RNA, 59 nt, hsa
cuagaaaaacggguaguaaacuguggauagucaggaaaacacccagcaagggacacagc

SEQ ID NO: 103780 - RNA, 59 nt, hsa
caggaaaacacccagcaagggacacagcugucaggaaaugaaucuuccccccaaccccc

SEQ ID NO: 103781 - RNA, 59 nt, hsa
uugucaguauccguccugaacggggccuagucaggaagcggucuagaaguguacgguca

SEQ ID NO: 103782 - RNA, 59 nt, hsa
uauucagaagaucuuuugcauuuucuucugucaggaauggggaaggggagugggggcac

SEQ ID NO: 103783 - RNA, 59 nt, hsa
uggcaagggacggagaggucccaacaggagucaggaagagguuugauuauaaccaagaa

SEQ ID NO: 103784 - RNA, 59 nt, hsa
cuguuuucauggguccuguagauguuugagucaggaagguaaggcggggagugacugaa

SEQ ID NO: 103785 - RNA, 59 nt, hsa
agcacauugauuuuucaaaagccagcucugucaggaaaggaggugcuguuaugagcagc

SEQ ID NO: 103786 - RNA, 59 nt, hsa
uuuuuaaauuuuuuauggguagaauuguagucaggaaaacagaaagggcuugaaauuua

SEQ ID NO: 103787 - RNA, 59 nt, hsa
gcuguaggaggaggcagggauuccagggugucaggaaggcaggggugccaggucccacc

SEQ ID NO: 103788 - RNA, 59 nt, hsa
gcucuaggaggaggcagggacuccagggugucaggaaggcaggggugccgggucccacc

SEQ ID NO: 103789 - RNA, 59 nt, hsa
cugaggugggucugaaauucauacaugaagucaggaaaagaaaagaaacuuaguucuac

SEQ ID NO: 103790 - RNA, 59 nt, hsa
auucugacuugcagaaaugcagacauacagucaggaaagaacaaacuucaauuaaaugu

SEQ ID NO: 103791 - RNA, 59 nt, hsa
aauucacacuggugagaaacccuuugaaugucaggaauguaggaaggccuuuaggcaga

SEQ ID NO: 103792 - RNA, 59 nt, hsa
gaacucauacuaaugagaaaccuaugaaugucaggaaugcagcaaggccuuuaagcaga

SEQ ID NO: 103793 - RNA, 59 nt, hsa
ccccuccguucugucucccucgacuccaagucaggaauaccgugggcuuccugcccuca

SEQ ID NO: 103794 - RNA, 59 nt, hsa
gcugaggcuucauucaguccugccccuuagucaggaaugcaguuuauucuacuccaaga

SEQ ID NO: 103795 - RNA, 64 nt, hsa
guuuugcuaucauugcuaagagauucccgcugauugggcucagugccagcuguuauucugcuuc

SEQ ID NO: 103796 - RNA, 64 nt, hsa
ugagugcccucuuaguuggugugugaggucuuggugggcucaggccagcuguuugcgagugugg

SEQ ID NO: 103797 - RNA, 64 nt, hsa
cugggcucagaccuagcagcguggggugagucccugggcucaguccuagcugcauggggugcag

SEQ ID NO: 103798 - RNA, 64 nt, hsa
gugaaugggucuacaccugcaugggcugagucccugggcucagaccuagcagcguggggugagu

SEQ ID NO: 103799 - RNA, 64 nt, hsa
gguacagucacggcucacaaaagccuugaccuccugggcucaggugauccucccaccucagccu

SEQ ID NO: 103800 - RNA, 64 nt, hsa
ggcaccaucuuggcucacugcagccucugccuccugggcucaaacaguccucccaccucagccu

SEQ ID NO: 103801 - RNA, 64 nt, hsa
ggcgcgaucuccgcucacugcaagcucugccuccugggcucacaccauucuccugccucagccu

SEQ ID NO: 103802 - RNA, 64 nt, hsa
uuuucccauguugcucaugcuggucucaaacuccugggcucaagcaauccacccaccucugccu

SEQ ID NO: 103803 - RNA, 64 nt, hsa
uggucucagcggcagguggaggagagcaggaugcugggcucaagcgcuuggcguguggaucucu

SEQ ID NO: 103804 - RNA, 64 nt, hsa
gguuucccaguuguugacugugacaggcucagcaugggcucagcagaugcugucuuaauuugug

SEQ ID NO: 103805 - RNA, 64 nt, hsa
uuucaccauguugcccaggcuggucucaaccuccugggcucaagcaauccuccugccucggccu

SEQ ID NO: 103806 - RNA, 64 nt, hsa
ggcgcaaucucggcucacugcaaccucugccuccugggcucaagcaauucucccaccucagccu

SEQ ID NO: 103807 - RNA, 64 nt, hsa
agcgacccagcuucccuccacuuccagguggugcugggcucaccgagggagcacuggugggugc

SEQ ID NO: 103808 - RNA, 64 nt, hsa
agcaggaacccuuuccaaaagcccagagaugcccugggcucagaucuguaauucucccaggagc

SEQ ID NO: 103809 - RNA, 64 nt, hsa
uguagaaacaaaguccaggcuggucuugaacuccugggcucaagcauuucuccuaccucggccu

SEQ ID NO: 103810 - RNA, 64 nt, hsa
uccuggcaagaucucugauuucauaauacuuuuuugggcucauguaguggaauuaaauauaccu

SEQ ID NO: 103811 - RNA, 64 nt, hsa
ggguugaucauggcucacugcauccuugacuuccugggcucaagugauccaccucagccugccu

SEQ ID NO: 103812 - RNA, 64 nt, hsa
uucacuauguugaccaagcuggucuuggaacuccugggcucaagugauccuccugccuuggccu

SEQ ID NO: 103813 - RNA, 64 nt, hsa
uugucuauuuuccuuucaaaauugguauuuuuguugggcucaauuuucauuauaauacuuuucu

SEQ ID NO: 103814 - RNA, 64 nt, hsa
ggcacaaucuuggcucacugcaaccucugccuccugggcucaacggauccuuccaccucagccu

SEQ ID NO: 103815 - RNA, 64 nt, hsa
uuuugccaaguugcccaggcugaucuugaacuccugggcucaagccauccucccuccucagccu

SEQ ID NO: 103816 - RNA, 64 nt, hsa
guccugggugugaguguuccuguguaacaagaacugggcucaacgguccagcuguuucuaugga

SEQ ID NO: 103817 - RNA, 64 nt, hsa
ggcaugaucaugguucacuucaaccccuaccuccugggcucaaguguuccucucaccuuauccu

SEQ ID NO: 103818 - RNA, 64 nt, hsa
uuucucuguguugcccagucuugucucaaacuccugggcucaagcgauccacccaccuugggcu

SEQ ID NO: 103819 - RNA, 64 nt, hsa
ucuaaggaugggaggggaacuugguuuaucugggugggcucagugaccccuuggaauggcugag

SEQ ID NO: 103820 - RNA, 64 nt, hsa
gaggaagccgucgcggggaccaugcugccuucucugggcucacgacuguucuggaaaggacccc

SEQ ID NO: 103821 - RNA, 64 nt, hsa
acugcuccccccauuugcugacguagugcucucaugggcucaccugggcccaaggcacagccag

SEQ ID NO: 103822 - RNA, 64 nt, hsa
cuccuaccacugagcgccuuugccagguccagccugggcucagguuccaagacucagcugccua

SEQ ID NO: 103823 - RNA, 64 nt, hsa
cucuuucucccaggcagggcucugcagguccauaugggcucaaugucaccacccucugcauggc

SEQ ID NO: 103824 - RNA, 64 nt, hsa
uggguggaacaggcaugugacagaguggggagccugggcucagcuccucccccugccguugguu

SEQ ID NO: 103825 - RNA, 64 nt, hsa
ucuugcuauguugcccaagcuaguuucaaacuccugggcucaagcgaugcuccugcuucagccu

SEQ ID NO: 103826 - RNA, 64 nt, hsa
ggcacaaucauggcucacugcagccccgaacuacugggcucaagccuuccucccgccucagccu

SEQ ID NO: 103827 - RNA, 64 nt, hsa
gaugacaggacagacugguggugaggagucuaagugggcucaguuugaugucagugucugggcu

SEQ ID NO: 103828 - RNA, 64 nt, hsa
ggagucuaagugggcucaguuugaugucagugucugggcucaugacuuguaaauggaagcugau

SEQ ID NO: 103829 - RNA, 64 nt, hsa
aggggugccuuuccuaauuugcaaaggugccauaugggcucacagcacccuggaggagaagggc

SEQ ID NO: 103830 - RNA, 64 nt, hsa
cuggguucuuacuucucagccaguaccugccccaugggcucaaggauuccuggccagcuccugc

SEQ ID NO: 103831 - RNA, 64 nt, hsa
uggugcaaucuggcucacugcauccucaacuuccugggcucaagugauccuuccacuucagccu

SEQ ID NO: 103832 - RNA, 64 nt, hsa
cuccagggccugcgggcauaaccugaucuguagcugggcucagccacaggccuuccugguugga

SEQ ID NO: 103833 - RNA, 64 nt, hsa
uuaaagaugguguauguuuguaaaaauauucuucugggcucaaaagcuagcuugagggggcaga

SEQ ID NO: 103834 - RNA, 64 nt, hsa
aaagcucaagaaccugcacgagggccuaaaacagugggcucagcuuuggcugugcauuggaauc

SEQ ID NO: 103835 - RNA, 64 nt, hsa
ucucacuauguugcccaggcuggucuugaacuucugggcucaagugauccucccuccuuggccu

SEQ ID NO: 103836 - RNA, 64 nt, hsa
gguacaagcacaguucacuguacccuguuccuccugggcucaagugauucuuccaccuaaauuu

SEQ ID NO: 103837 - RNA, 64 nt, hsa
aggagcaaaugcuggaugagcaacuccuguucuuugggcucaaggggacuggugaugggacaau

SEQ ID NO: 103838 - RNA, 64 nt, hsa
gcuucucuugaaaacuugguauaucuggccacacugggcucacauucccaaggguaacucuugg

SEQ ID NO: 103839 - RNA, 64 nt, hsa
gacacaaucauagcucacugcagccuuuaacuacugggcucaagacauccuccugcuucagccu

SEQ ID NO: 103840 - RNA, 64 nt, hsa
ucuugcuauguugcccaggcuggucuugaacuccugggcucaugcaauccuccugccuuggccu

SEQ ID NO: 103841 - RNA, 64 nt, hsa
acugcguguccucugaagcagugaagucugugccuaugccgagcgcgcuaagaagucucccuuc

SEQ ID NO: 103842 - RNA, 64 nt, hsa
gaggacccaaggccccacuggagcagucuguccuuaugccgaaucaaggcggaacaugggugaa

SEQ ID NO: 103843 - RNA, 64 nt, hsa
auaggauugacuaguuuacugguuuuuauucccauaugccgauucugggacaauaaaguuguuu

SEQ ID NO: 103844 - RNA, 64 nt, hsa
aaauaacuccauugaacagcaucuauucagaaacuaugccgaauaaaaagauugguggaagggc

SEQ ID NO: 103845 - RNA, 64 nt, hsa
ccuugugucaggaaaaaaugugggguaugccaaguaugccgauagaauaagugcuaaugaugcc

SEQ ID NO: 103846 - RNA, 64 nt, hsa
aggaugauucuauauauucuuuaaugauauuaaauaugccgaagccaagcacacagucuuucua

SEQ ID NO: 103847 - RNA, 64 nt, hsa
guuacuuauaacacacacacacacaucugaaauauaugccgaaaauugacgucuuugaccucag

SEQ ID NO: 103848 - RNA, 64 nt, hsa
guccauaaaugcucagugcucaggaucucauuaauaugccgaaccuaacuacagaugacuuuuu

SEQ ID NO: 103849 - RNA, 64 nt, hsa
uaaaguccaauuaaaauauggaaauguaaaaguguaugccgaauaccuuaaaguaacuaauuau

SEQ ID NO: 103850 - RNA, 64 nt, hsa
gcuccucuucugccuguguauggagagcaaauccuaugccgaaaggcuacgagcaauacuauag

SEQ ID NO: 103851 - RNA, 64 nt, hsa
gauggguuauuucaaccuguuuuggucacaucacuaugccgagcaagaaaaguggaucucaggg

SEQ ID NO: 103852 - RNA, 64 nt, hsa
cugaggcugucgcucacucagauuguccguuugcuaugccgaaugcagccaaaauuccuuuuua

SEQ ID NO: 103853 - RNA, 64 nt, hsa
aaucugcugagugugcagccugcaucaccugcuguaugccgaucaucucagaaagggcugugua

SEQ ID NO: 103854 - RNA, 64 nt, hsa
cuugcguaugucuguuaccaugucacugugguccuaugccgaaugcccucaggggacuugaauc

SEQ ID NO: 103855 - RNA, 64 nt, hsa
aaaugaagacaggagaacugcugccgucaugagcuaugccgacagucagcagcugauccccgac

SEQ ID NO: 103856 - RNA, 64 nt, hsa
uaugugcuggccgcaccugaacauagcuggugcuuaugccgaguuauuugcgaugaguaaauau

SEQ ID NO: 103857 - RNA, 63 nt, hsa
ugaaggagauaacuuauuaaucugucgaaggcuuaugccgagccagaagccgaagccacuugc

SEQ ID NO: 103858 - RNA, 64 nt, hsa
ucaugagaaaugucuaaucccaugggaaaaccuguaugccgauuuuccucaagccaucucacaa

SEQ ID NO: 103859 - RNA, 64 nt, hsa
uuaauuuuucuuuagcccuuauuuugaugaguauuaugccgaauacaggcagcccucacuuuuc

SEQ ID NO: 103860 - RNA, 64 nt, hsa; identical to SEQ ID NO: 103795

SEQ ID NO: 103861 - RNA, 64 nt, hsa; identical to SEQ ID NO: 103796

SEQ ID NO: 103862 - RNA, 64 nt, hsa; identical to SEQ ID NO: 103797

SEQ ID NO: 103863 - RNA, 64 nt, hsa; identical to SEQ ID NO: 103798

SEQ ID NO: 103864 - RNA, 64 nt, hsa; identical to SEQ ID NO: 103799

SEQ ID NO: 103865 - RNA, 64 nt, hsa; identical to SEQ ID NO: 103800

SEQ ID NO: 103866 - RNA, 64 nt, hsa; identical to SEQ ID NO: 103801

SEQ ID NO: 103867 - RNA, 64 nt, hsa; identical to SEQ ID NO: 103802

SEQ ID NO: 103868 - RNA, 64 nt, hsa; identical to SEQ ID NO: 103803

SEQ ID NO: 103869 - RNA, 64 nt, hsa; identical to SEQ ID NO: 103804

SEQ ID NO: 103870 - RNA, 64 nt, hsa; identical to SEQ ID NO: 103805

SEQ ID NO: 103871 - RNA, 64 nt, hsa; identical to SEQ ID NO: 103806

SEQ ID NO: 103872 - RNA, 64 nt, hsa; identical to SEQ ID NO: 103807

SEQ ID NO: 103873 - RNA, 64 nt, hsa; identical to SEQ ID NO: 103808

SEQ ID NO: 103874 - RNA, 64 nt, hsa; identical to SEQ ID NO: 103809

SEQ ID NO: 103875 - RNA, 64 nt, hsa; identical to SEQ ID NO: 103810

SEQ ID NO: 103876 - RNA, 64 nt, hsa; identical to SEQ ID NO: 103811

SEQ ID NO: 103877 - RNA, 64 nt, hsa; identical to SEQ ID NO: 103812

SEQ ID NO: 103878 - RNA, 64 nt, hsa; identical to SEQ ID NO: 103813

SEQ ID NO: 103879 - RNA, 64 nt, hsa; identical to SEQ ID NO: 103814

SEQ ID NO: 103880 - RNA, 64 nt, hsa; identical to SEQ ID NO: 103815

SEQ ID NO: 103881 - RNA, 64 nt, hsa; identical to SEQ ID NO: 103816

SEQ ID NO: 103882 - RNA, 64 nt, hsa; identical to SEQ ID NO: 103817

SEQ ID NO: 103883 - RNA, 64 nt, hsa; identical to SEQ ID NO: 103818

SEQ ID NO: 103884 - RNA, 64 nt, hsa; identical to SEQ ID NO: 103819

SEQ ID NO: 103885 - RNA, 64 nt, hsa; identical to SEQ ID NO: 103820

SEQ ID NO: 103886 - RNA, 64 nt, hsa; identical to SEQ ID NO: 103821

SEQ ID NO: 103887 - RNA, 64 nt, hsa; identical to SEQ ID NO: 103822

SEQ ID NO: 103888 - RNA, 64 nt, hsa; identical to SEQ ID NO: 103823

SEQ ID NO: 103889 - RNA, 64 nt, hsa; identical to SEQ ID NO: 103824

SEQ ID NO: 103890 - RNA, 64 nt, hsa; identical to SEQ ID NO: 103825

SEQ ID NO: 103891 - RNA, 64 nt, hsa; identical to SEQ ID NO: 103826

SEQ ID NO: 103892 - RNA, 64 nt, hsa; identical to SEQ ID NO: 103827

SEQ ID NO: 103893 - RNA, 64 nt, hsa; identical to SEQ ID NO: 103828

SEQ ID NO: 103894 - RNA, 64 nt, hsa; identical to SEQ ID NO: 103829

SEQ ID NO: 103895 - RNA, 64 nt, hsa; identical to SEQ ID NO: 103830

SEQ ID NO: 103896 - RNA, 64 nt, hsa; identical to SEQ ID NO: 103831

SEQ ID NO: 103897 - RNA, 64 nt, hsa; identical to SEQ ID NO: 103832

SEQ ID NO: 103898 - RNA, 64 nt, hsa; identical to SEQ ID NO: 103833

SEQ ID NO: 103899 - RNA, 64 nt, hsa; identical to SEQ ID NO: 103834

SEQ ID NO: 103900 - RNA, 64 nt, hsa; identical to SEQ ID NO: 103835

SEQ ID NO: 103901 - RNA, 64 nt, hsa; identical to SEQ ID NO: 103836

SEQ ID NO: 103902 - RNA, 64 nt, hsa; identical to SEQ ID NO: 103837

SEQ ID NO: 103903 - RNA, 64 nt, hsa; identical to SEQ ID NO: 103838

SEQ ID NO: 103904 - RNA, 64 nt, hsa; identical to SEQ ID NO: 103839

SEQ ID NO: 103905 - RNA, 64 nt, hsa; identical to SEQ ID NO: 103840

SEQ ID NO: 103906 - RNA, 64 nt, hsa; identical to SEQ ID NO: 103841

SEQ ID NO: 103907 - RNA, 64 nt, hsa; identical to SEQ ID NO: 103842

SEQ ID NO: 103908 - RNA, 64 nt, hsa; identical to SEQ ID NO: 103843

SEQ ID NO: 103909 - RNA, 64 nt, hsa; identical to SEQ ID NO: 103844

SEQ ID NO: 103910 - RNA, 64 nt, hsa; identical to SEQ ID NO: 103845

SEQ ID NO: 103911 - RNA, 64 nt, hsa; identical to SEQ ID NO: 103846

SEQ ID NO: 103912 - RNA, 64 nt, hsa; identical to SEQ ID NO: 103847

SEQ ID NO: 103913 - RNA, 64 nt, hsa; identical to SEQ ID NO: 103848

SEQ ID NO: 103914 - RNA, 64 nt, hsa; identical to SEQ ID NO: 103849

SEQ ID NO: 103915 - RNA, 64 nt, hsa; identical to SEQ ID NO: 103850

SEQ ID NO: 103916 - RNA, 64 nt, hsa; identical to SEQ ID NO: 103851

SEQ ID NO: 103917 - RNA, 64 nt, hsa; identical to SEQ ID NO: 103852

SEQ ID NO: 103918 - RNA, 64 nt, hsa; identical to SEQ ID NO: 103853

SEQ ID NO: 103919 - RNA, 64 nt, hsa; identical to SEQ ID NO: 103854

SEQ ID NO: 103920 - RNA, 64 nt, hsa; identical to SEQ ID NO: 103855

SEQ ID NO: 103921 - RNA, 64 nt, hsa; identical to SEQ ID NO: 103856

SEQ ID NO: 103922 - RNA, 63 nt, hsa; identical to SEQ ID NO: 103857

SEQ ID NO: 103923 - RNA, 64 nt, hsa; identical to SEQ ID NO: 103858

SEQ ID NO: 103924 - RNA, 64 nt, hsa; identical to SEQ ID NO: 103859

SEQ ID NO: 103925 - RNA, 64 nt, hsa
auucguagauuuaauaacuuaccugaagggguuuucuugauaauuuuccuuuaauaugaaauuu

SEQ ID NO: 103926 - RNA, 64 nt, hsa
guugaugucaauaacaguauaaaacagcccuauuucuugauaaaaaaugacaaaugacugucuc

SEQ ID NO: 103927 - RNA, 64 nt, hsa
gauauuaauguauccaaugaaauaaucgacuuguucuugauagccucauuaaagcauuugguuu

SEQ ID NO: 103928 - RNA, 64 nt, hsa
uuaagugacacuacgcgugcaguucauuucuaguucuugauagaacugcacuuaauuuucagua

SEQ ID NO: 103929 - RNA, 64 nt, hsa
aaaucauauuacaaguacguaaggauucagggucucuugauagacuuaucauagcucuauauug

SEQ ID NO: 103930 - RNA, 64 nt, hsa
auuagcuguuaaugcucugugaguuuagaaaaagucuugauaguaaaucuaguuuuugacacag

SEQ ID NO: 103931 - RNA, 64 nt, hsa
gaaaaagcuuuguaaucauaacacaaugaguaauucuugauaaaaguucagauacaaaaggagc

SEQ ID NO: 103932 - RNA, 64 nt, hsa
uugccucucaugaggcaacugaaaaaauccugugucuugauagcaugggugcugugugugugca

SEQ ID NO: 103933 - RNA, 64 nt, hsa
aacauuuccugauaaaugccuuuuagagauagguucuugauauucagacaucugcagaaauguu

SEQ ID NO: 103934 - RNA, 64 nt, hsa
acuauaaacuugaaacaaagaguuagcugucagcucuugauaauauaauuggggaaacagaaua

SEQ ID NO: 103935 - RNA, 64 nt, hsa
cuuucacauuccuuguuuguccuuuuaauuuguuucuugauauaugaagacuauaaacuugaaa

SEQ ID NO: 103936 - RNA, 64 nt, hsa
uuuccaaauacuuagaguuaugaauagcauaauuucuugauaccauaacuuugccuguguuguu

SEQ ID NO: 103937 - RNA, 64 nt, hsa
cuugauuaacccaagacuuuccugauauugacucucuugauacauacccaagcugaacaaucuu

SEQ ID NO: 103938 - RNA, 64 nt, hsa
uuuuaacauuccacuuaugccuugaaacaucauuucuugauaacuuuuugauacuucuuucuug

SEQ ID NO: 103939 - RNA, 64 nt, hsa
aacaucauuucuugauaacuuuuugauacuucuuucuugauaaggcacuuuuaccaggugugug

SEQ ID NO: 103940 - RNA, 64 nt, hsa
aacggccuggaaucgcaaagagacaccacucugggcagagcagagcaggguaugggguggggag

SEQ ID NO: 103941 - RNA, 64 nt, hsa
ccuggaaucgcaaagagacaccacucugggcagagcagagcaggguaugggguggggagagagg

SEQ ID NO: 103942 - RNA, 64 nt, hsa
gaugagaaggauggcggggcuagggaagcagagagcagagcacacacuggcucaagcagcagag

SEQ ID NO: 103943 - RNA, 64 nt, hsa
aaacuuuuaggugguggaaccagggaagcagagagcagagcaugcagugauggaagaagcagga

SEQ ID NO: 103944 - RNA, 64 nt, hsa
aguguugaaccagcaucaagucuccagaaacauggcagagcagacaggccguuaaguuucacag

SEQ ID NO: 103945 - RNA, 64 nt, hsa
gccgagauugcaccacugcacuccagccuggagagcagagcaagacucugucucaaaaaaaaga

SEQ ID NO: 103946 - RNA, 64 nt, hsa
caauugagugcgauuauuggcuucugagcgcugagcagagcagguggaagaggaacuuugagca

SEQ ID NO: 103947 - RNA, 64 nt, hsa
aacagaccaucacagauuggaaacuugguagauagcagagcaugguauuagugaaaaagguuca

SEQ ID NO: 103948 - RNA, 64 nt, hsa
cugcguugugccaguugcuggagagguagugugagcagagcagcugaaaucuugccaucaagca

SEQ ID NO: 103949 - RNA, 64 nt, hsa
ggggggacacgucuucccacugcuuagagcgagagcagagcaaacugcgcagcaggcaccucca

SEQ ID NO: 103950 - RNA, 64 nt, hsa
gccacgguggcuccagccaggaccagccagaccagcagagcagggagccacuugccagggugga

SEQ ID NO: 103951 - RNA, 64 nt, hsa
caggguuacagcaagagccacugagguguggcuggcagagcaacugaggagcucugcgagagug

SEQ ID NO: 103952 - RNA, 64 nt, hsa
acuacaguuuuagcggggagggggauaggaagacgcagagcaaaugagcuccggagucccugca

SEQ ID NO: 103953 - RNA, 64 nt, hsa
agcugaugucaucacacucuccauguuaguaauggcagagcagucuaaacagaguccgggagaa

SEQ ID NO: 103954 - RNA, 64 nt, hsa
gccagcagggacgcgccccaggugggcagcuguggcagagcagcgacccgcggcggggcggcau

SEQ ID NO: 103955 - RNA, 64 nt, hsa
gccagcagggacgcgccccaggugggcagcuguggcagagcagucccgacaccuaaauaaaagu

SEQ ID NO: 103956 - RNA, 64 nt, hsa
uauugcgaagcacaugccccaucgagccuacugggcagagcagcagagcaggguuggaggggcu

SEQ ID NO: 103957 - RNA, 64 nt, hsa
agcacaugccccaucgagccuacugggcagagcagcagagcaggguuggaggggcuggggagac

SEQ ID NO: 103958 - RNA, 64 nt, hsa
ucauuguuuuuguuuuuguuuuuguuuugacacugcagagcacaaggcuaaagguuacagcuga

SEQ ID NO: 103959 - RNA, 64 nt, hsa
cuaaagguuacagcugagaucuuuggaaccaaaggcagagcaagcagagcccguugucugggcc

SEQ ID NO: 103960 - RNA, 64 nt, hsa
guggugggaggcacaguguuuacaggcucugguggcagagcaguuggcacaccugugggugaau

SEQ ID NO: 103961 - RNA, 64 nt, hsa
cagaccuacaggcgaggccgcagcagaggguggggcagagcagccucggggucugggggcugca

SEQ ID NO: 103962 - RNA, 64 nt, hsa
ccagccccuggaugcagccucacaguccuuaccagcagagcaccuuagacagucccugccaaug

SEQ ID NO: 103963 - RNA, 64 nt, hsa
agacccugcccugugggcccccaaauggaaaugggcagagcagagaccaucccugaaggccccg

SEQ ID NO: 103964 - RNA, 64 nt, hsa
caggaugccggagagacagccccuugugcugugagcagagcaggcaguggcucuggaggcugcc

SEQ ID NO: 103965 - RNA, 64 nt, hsa
ccaccaagguuuccucucuucccccaggaccugggcagagcaggcaugagcugggcuguggugc

SEQ ID NO: 103966 - RNA, 64 nt, hsa
accugggcagagcaggcaugagcugggcuguggugcagagcaagcagacccagccacacugcuc

SEQ ID NO: 103967 - RNA, 64 nt, hsa
acucaguauugauaaaaccuuuuuaauaagugaugcagagcagccaaggauauguugacccaga

SEQ ID NO: 103968 - RNA, 64 nt, hsa
ucaaccaggcuauuuuuauacuuaaaacaugucagcagagcauaggcagaauaaaaugguuuaa

SEQ ID NO: 103969 - RNA, 62 nt, hsa
aggagcaagaagaguauuaacagccuggaccagcagagcaacaucggaauucuucacuccaa

SEQ ID NO: 103970 - RNA, 64 nt, hsa
ccaauaaguuugaguuaggagcuuuuaccuuguagcagagcaguauuaacaccuaguugguuca

SEQ ID NO: 103971 - RNA, 64 nt, hsa
uccacccaguguccacuggccuguccuucagggagcagagcagagcaggugguggacgggccca

SEQ ID NO: 103972 - RNA, 64 nt, hsa
ccaguguccacuggccuguccuucagggagcagagcagagcaggugguggacgggcccagugcu

SEQ ID NO: 103973 - RNA, 64 nt, hsa; identical to SEQ ID NO: 95478

SEQ ID NO: 103974 - RNA, 64 nt, hsa; identical to SEQ ID NO: 95479

SEQ ID NO: 103975 - RNA, 64 nt, hsa; identical to SEQ ID NO: 95480

SEQ ID NO: 103976 - RNA, 64 nt, hsa; identical to SEQ ID NO: 95481

SEQ ID NO: 103977 - RNA, 64 nt, hsa; identical to SEQ ID NO: 95482

SEQ ID NO: 103978 - RNA, 64 nt, hsa; identical to SEQ ID NO: 95483

SEQ ID NO: 103979 - RNA, 64 nt, hsa; identical to SEQ ID NO: 95484

SEQ ID NO: 103980 - RNA, 64 nt, hsa; identical to SEQ ID NO: 95485

SEQ ID NO: 103981 - RNA, 64 nt, hsa; identical to SEQ ID NO: 95486

SEQ ID NO: 103982 - RNA, 64 nt, hsa; identical to SEQ ID NO: 95487

SEQ ID NO: 103983 - RNA, 64 nt, hsa; identical to SEQ ID NO: 95488

SEQ ID NO: 103984 - RNA, 64 nt, hsa; identical to SEQ ID NO: 95489

SEQ ID NO: 103985 - RNA, 64 nt, hsa; identical to SEQ ID NO: 95490

SEQ ID NO: 103986 - RNA, 64 nt, hsa; identical to SEQ ID NO: 95491

SEQ ID NO: 103987 - RNA, 64 nt, hsa; identical to SEQ ID NO: 95492

SEQ ID NO: 103988 - RNA, 64 nt, hsa; identical to SEQ ID NO: 95493

SEQ ID NO: 103989 - RNA, 64 nt, hsa; identical to SEQ ID NO: 95494

SEQ ID NO: 103990 - RNA, 64 nt, hsa; identical to SEQ ID NO: 95495

SEQ ID NO: 103991 - RNA, 64 nt, hsa; identical to SEQ ID NO: 95496

SEQ ID NO: 103992 - RNA, 64 nt, hsa; identical to SEQ ID NO: 95497

SEQ ID NO: 103993 - RNA, 64 nt, hsa; identical to SEQ ID NO: 95498

SEQ ID NO: 103994 - RNA, 64 nt, hsa; identical to SEQ ID NO: 95499

SEQ ID NO: 103995 - RNA, 64 nt, hsa; identical to SEQ ID NO: 95500

SEQ ID NO: 103996 - RNA, 64 nt, hsa; identical to SEQ ID NO: 95501

SEQ ID NO: 103997 - RNA, 64 nt, hsa; identical to SEQ ID NO: 95502

SEQ ID NO: 103998 - RNA, 64 nt, hsa; identical to SEQ ID NO: 95503

SEQ ID NO: 103999 - RNA, 64 nt, hsa; identical to SEQ ID NO: 95504

SEQ ID NO: 104000 - RNA, 64 nt, hsa; identical to SEQ ID NO: 95505

SEQ ID NO: 104001 - RNA, 64 nt, hsa; identical to SEQ ID NO: 95506

SEQ ID NO: 104002 - RNA, 64 nt, hsa; identical to SEQ ID NO: 95507

SEQ ID NO: 104003 - RNA, 64 nt, hsa; identical to SEQ ID NO: 95508

SEQ ID NO: 104004 - RNA, 64 nt, hsa; identical to SEQ ID NO: 95509

SEQ ID NO: 104005 - RNA, 64 nt, hsa; identical to SEQ ID NO: 95510

SEQ ID NO: 104006 - RNA, 64 nt, hsa; identical to SEQ ID NO: 95511

SEQ ID NO: 104007 - RNA, 64 nt, hsa; identical to SEQ ID NO: 95512

SEQ ID NO: 104008 - RNA, 64 nt, hsa; identical to SEQ ID NO: 95513

SEQ ID NO: 104009 - RNA, 64 nt, hsa; identical to SEQ ID NO: 95514

SEQ ID NO: 104010 - RNA, 64 nt, hsa; identical to SEQ ID NO: 95515

SEQ ID NO: 104011 - RNA, 64 nt, hsa; identical to SEQ ID NO: 95516

SEQ ID NO: 104012 - RNA, 64 nt, hsa; identical to SEQ ID NO: 95517

SEQ ID NO: 104013 - RNA, 64 nt, hsa; identical to SEQ ID NO: 95518

SEQ ID NO: 104014 - RNA, 64 nt, hsa; identical to SEQ ID NO: 95519

SEQ ID NO: 104015 - RNA, 64 nt, hsa; identical to SEQ ID NO: 95520

SEQ ID NO: 104016 - RNA, 64 nt, hsa; identical to SEQ ID NO: 95521

SEQ ID NO: 104017 - RNA, 64 nt, hsa; identical to SEQ ID NO: 95522

SEQ ID NO: 104018 - RNA, 64 nt, hsa; identical to SEQ ID NO: 95523

SEQ ID NO: 104019 - RNA, 64 nt, hsa; identical to SEQ ID NO: 95524

SEQ ID NO: 104020 - RNA, 64 nt, hsa; identical to SEQ ID NO: 95525

SEQ ID NO: 104021 - RNA, 62 nt, hsa
cagcagcccaggaagcagcacacgcggccguggggaggcaggcaccgggcaugucggcgccu

SEQ ID NO: 104022 - RNA, 62 nt, hsa
uacgugugucaagccuagccaccucagcugcagggaggcagaaggcaaggcaggccccacgg

SEQ ID NO: 104023 - RNA, 62 nt, hsa
gggaggcugaggcaggagaaucgcuugaacccgggaggcacagguuccagugagccaagguu

SEQ ID NO: 104024 - RNA, 62 nt, hsa
gggaggcugaggcaggagaaucgcuugaaccugggaggcagagguugcaguaagccaagauc

SEQ ID NO: 104025 - RNA, 62 nt, hsa
gggaggcugaggcaggagaauugcuugaaccggggaggcagaaguugcagugagccgagauu

SEQ ID NO: 104026 - RNA, 62 nt, hsa
gggaggcugaggcaggagaauggcaugaaccugggaggcagagcuugcagugagcugagauu

SEQ ID NO: 104027 - RNA, 62 nt, hsa
gacggcaccucuucccccauggcagggugugagggaggcagguuuggaauggugcgaguaug

SEQ ID NO: 104028 - RNA, 62 nt, hsa
uggcugagcccaggguggggagauccugggaagggaggcacuggaggaagacggcaccucuu

SEQ ID NO: 104029 - RNA, 62 nt, hsa
gggaggcugaggcaggagaaucgcuugaaccugggaggcagaaguugcagugagcugagauu

SEQ ID NO: 104030 - RNA, 62 nt, hsa
acaguggcucaugccuauaauuccagcacuuugggaggcagaggugggcggaucacaagguc

SEQ ID NO: 104031 - RNA, 62 nt, hsa
gcgggcgcgacgugaucguggaccugugggaggggaggcacguggcgcgcgugggcccgcug

SEQ ID NO: 104032 - RNA, 62 nt, hsa
caguccaggcuggagagguuggggccgggguagggaggcaggagccaugucaguucugaagg

SEQ ID NO: 104033 - RNA, 62 nt, hsa
gaugauuuguguaaccugaggccaggauuaaggggaggcaaucaaugcaccuagggaaaaaa

SEQ ID NO: 104034 - RNA, 62 nt, hsa
aggaggcugaggcaggagaagggugggaacccgggaggcagagcuugcagugagccgagauu

SEQ ID NO: 104035 - RNA, 62 nt, hsa
ugaagggauguaucaagugggguggugggagggggaggcaagguuauaugcacuuucucaug

SEQ ID NO: 104036 - RNA, 62 nt, hsa
cugguauguucaguaggaacuguacauguguugggaggcauaaagacuaauuagcaaccaua

SEQ ID NO: 104037 - RNA, 62 nt, hsa
gcaauggcucacaccuguaauuccaacacuuugggaggcagaggcgggaggauugcuugagg

SEQ ID NO: 104038 - RNA, 62 nt, hsa
aagaggcugaggcaggagaaucgcuugaaccugggaggcagagguugcagugagccaagauu

SEQ ID NO: 104039 - RNA, 62 nt, hsa
uggugcccuauuuccagccaccccagcagcuagggaggcaaagcaggcugcagucagucccu

SEQ ID NO: 104040 - RNA, 62 nt, hsa
ugugagugugcgucuguacgggaagaggcagagggaggcagccagcggggcgugaugcagug

SEQ ID NO: 104041 - RNA, 62 nt, hsa
uuuuuggcacauaacaacuuuuuuuuuaauuugggaggcaagcacaaacuaggaagacuagc

SEQ ID NO: 104042 - RNA, 62 nt, hsa
auuuauauuuuacaaaugcuagauauuggucugggaggcaacauuaaugguaccagccuguc

SEQ ID NO: 104043 - RNA, 62 nt, hsa
caggaaaggacggcugagcauguggagcgagagggaggcagguggacgcugcagaccccagg

SEQ ID NO: 104044 - RNA, 62 nt, hsa
ggcgcgaugucaaaggucgggacagcugugccgggaggcagccacagggaagcucacacauc

SEQ ID NO: 104045 - RNA, 62 nt, hsa
cccucccccagcagaauggaggcaggggacaagggaggcaguggcuaguggggugaacagcu

SEQ ID NO: 104046 - RNA, 62 nt, hsa
ucuuugcccccgacggcugugacgcagccggagggaggcacuagucaccgacagcggccuug

SEQ ID NO: 104047 - RNA, 62 nt, hsa
ccuggggcggggggcgugccugucacugccuggggaggcauuugccucuguaccaucgccuu

SEQ ID NO: 104048 - RNA, 62 nt, hsa
cccccgcucaggugagcccgaaggcaggagccgggaggcacuccucccaaacacuccacuca

SEQ ID NO: 104049 - RNA, 62 nt, hsa
ugugccgguagaauaaggaaggaagggaggcagggaggcaaagcaugucagaaacggaccuu

SEQ ID NO: 104050 - RNA, 62 nt, hsa
gaucccuuugugccgguagaauaaggaaggaagggaggcagggaggcaaagcaugucagaaa

SEQ ID NO: 104051 - RNA, 62 nt, hsa
ugcuggggaggcagcaagcaugcuggugggaagggaggcagggacuggcagcugccaccccc

SEQ ID NO: 104052 - RNA, 62 nt, hsa
cucaugaccuaaacucugggcuuuucuugcuggggaggcagcaagcaugcuggugggaaggg

SEQ ID NO: 104053 - RNA, 62 nt, hsa
cuuucuuuuaaggcuguuccugggccuggcgggggaggcaggggugagaggauggaauugug

SEQ ID NO: 104054 - RNA, 62 nt, hsa
cggccccgcaccugccauuugcacgcccggccgggaggcagagacggggggaggggaagccu

SEQ ID NO: 104055 - RNA, 62 nt, hsa
gggaggcugaggcacaagaaucacuugaacccgggaggcagagguuguagugagcccagauu

SEQ ID NO: 104056 - RNA, 62 nt, hsa
ugagcccagauugugccacugcucuccagccugggaggcacagcaaacugucccccaaaaaa

SEQ ID NO: 104057 - RNA, 62 nt, hsa
aguccucuucuggaagcugcagaugggggcccgggaggcacacacgagucugggacucauuc

SEQ ID NO: 104058 - RNA, 62 nt, hsa
acucugagguuucuaucuuccagacaagagcugggaggcaagauuucugguuucugguuccu

SEQ ID NO: 104059 - RNA, 62 nt, hsa
gggagccaauccacccagacccgcguccaccugggaggcauuugggguugcaggaccgagac

SEQ ID NO: 104060 - RNA, 62 nt, hsa
ucugcugaagagggggaugaagugggucuccagggaggcagugggggccuuguuggcagcug

SEQ ID NO: 104061 - RNA, 62 nt, hsa
gcagcagccccgagggacgcccccagaggaccgggaggcaccccacccuccccaccagugca

SEQ ID NO: 104062 - RNA, 62 nt, hsa
agcagaaaacccaagggcagguggagaguccagggaggcaggauggaucaccagacaccuaa

SEQ ID NO: 104063 - RNA, 62 nt, hsa
gcuuagcaucuacucuguauaacgcaugagaggggaggcaaagaagaaaaagacacacagaa

SEQ ID NO: 104064 - RNA, 62 nt, hsa
uucuucagcccgacuggaggaacagcagcucugggaggcacagagugcaggucucaggggca

SEQ ID NO: 104065 - RNA, 62 nt, hsa
gauucauggaugaaugaaagcuagaccugauggggaggcauuaugacuaaauaggcccagcc

SEQ ID NO: 104066 - RNA, 62 nt, hsa
ucucuggauggaacgggcaugggccucucugggggaggcagggcuggaaugggagaccuguu

SEQ ID NO: 104067 - RNA, 62 nt, hsa
gaauaucuuauauugggcgauuugggggcucggggaggcagagaaucucuugggagucuugg

SEQ ID NO: 104068 - RNA, 62 nt, hsa
agcaucuuuagaccuagaucugucuaacucuggggaggcacauugacauuuccauuacacac

SEQ ID NO: 104069 - RNA, 62 nt, hsa
gggagcagcugagccauuuguucuugaacucugggaggcagaaguccccgcacccaucaugc

SEQ ID NO: 104070 - RNA, 62 nt, hsa
uagggcucauggcaugggcccccacugggggagggaggcaucuuguuucuugugguucccug

SEQ ID NO: 104071 - RNA, 62 nt, hsa
gggaguggaaauggggaagggggccuggagaggggaggcaggggccccugugcucucugaac

SEQ ID NO: 104072 - RNA, 62 nt, hsa
cuucagcccuggagugggcagagaguauuguggggaggcauggccagugggacuaguguucc

SEQ ID NO: 104073 - RNA, 62 nt, hsa
ggcauggggcuacauuccagugccugacuauagggaggcacuccugauuccauggagcagcc

SEQ ID NO: 104074 - RNA, 62 nt, hsa
agcagcagcaggauggugaaguaguaaacugggggaggcagggcacagggagaugcucaggg

SEQ ID NO: 104075 - RNA, 62 nt, hsa
cuuucccucccaggaguccccuagguggcugggggaggcaggcucacuggccauuuucccua

SEQ ID NO: 104076 - RNA, 62 nt, hsa
cgccagagcuuuuccacugauuguacucagcggggaggcaggggaggcagaggggcagccuc

SEQ ID NO: 104077 - RNA, 62 nt, hsa
uuuuccacugauuguacucagcggggaggcaggggaggcagaggggcagccucucuaaugcu

SEQ ID NO: 104078 - RNA, 62 nt, hsa
gguaggcugaggcaggagaauggcgggaacccgggaggcagagguugcagugagcugagauc

SEQ ID NO: 104079 - RNA, 62 nt, hsa
gcccaaggagguugucagggacacacagcagggggaggcagcccagaucccugcucaugcgu

SEQ ID NO: 104080 - RNA, 62 nt, hsa
cucccugccacagguggagcugaccggcuuuggggaggcagguaccccagggcagcaggcuc

SEQ ID NO: 104081 - RNA, 62 nt, hsa
ggugggggcugaggcugaggccaaaggggcuggggaggcaggccugcugccugcccucgauc

SEQ ID NO: 104082 - RNA, 62 nt, hsa
gagaaguucuugauucagccaaaugcagggaggggaggcagauggagcccauaggccaccuc

SEQ ID NO: 104083 - RNA, 62 nt, hsa
gucugcuaggcgcuggggagacugauaacuuggggaggcaagagacugggagccacuucucc

SEQ ID NO: 104084 - RNA, 62 nt, hsa
cuuuauagaagcacauuucugccaccuccccugggaggcacccagaagccugccacucuuua

SEQ ID NO: 104085 - RNA, 62 nt, hsa
ucuacccacccugccuccaggccagggggcuggggaggcaaauagagccccccuauuuuagu

SEQ ID NO: 104086 - RNA, 62 nt, hsa
cuguaagcugggugagcuacugaagccaaggugggaggcagcugacaacaccacccacggcc

SEQ ID NO: 104087 - RNA, 62 nt, hsa
gcugggagaccagguccucugugcaugggcccgggaggcagaccugccccaagggugaugca

SEQ ID NO: 104088 - RNA, 62 nt, hsa
caagauuguuugaaaaaaaaaaaaggggagcagggaggcagaaaguccuggaaaaguaaauu

SEQ ID NO: 104089 - RNA, 62 nt, hsa
ggccaaauaggagggagacugugguaggggcagggaggcaacacugcuguccacaugaccuc

SEQ ID NO: 104090 - RNA, 62 nt, hsa
gccugaucccugaaccccuggccagcucugaggggaggcaccuccaggcaggccaggcugcc

SEQ ID NO: 104091 - RNA, 64 nt, hsa; identical to SEQ ID NO: 79249

SEQ ID NO: 104092 - RNA, 64 nt, hsa; identical to SEQ ID NO: 79250

SEQ ID NO: 104093 - RNA, 64 nt, hsa; identical to SEQ ID NO: 79251

SEQ ID NO: 104094 - RNA, 64 nt, hsa; identical to SEQ ID NO: 79252

SEQ ID NO: 104095 - RNA, 64 nt, hsa; identical to SEQ ID NO: 79253

SEQ ID NO: 104096 - RNA, 64 nt, hsa; identical to SEQ ID NO: 79254

SEQ ID NO: 104097 - RNA, 64 nt, hsa; identical to SEQ ID NO: 79255

SEQ ID NO: 104098 - RNA, 64 nt, hsa; identical to SEQ ID NO: 79256

SEQ ID NO: 104099 - RNA, 64 nt, hsa; identical to SEQ ID NO: 79257

SEQ ID NO: 104100 - RNA, 64 nt, hsa; identical to SEQ ID NO: 79258

SEQ ID NO: 104101 - RNA, 64 nt, hsa; identical to SEQ ID NO: 79259

SEQ ID NO: 104102 - RNA, 64 nt, hsa; identical to SEQ ID NO: 79260

SEQ ID NO: 104103 - RNA, 64 nt, hsa; identical to SEQ ID NO: 79261

SEQ ID NO: 104104 - RNA, 64 nt, hsa; identical to SEQ ID NO: 79262

SEQ ID NO: 104105 - RNA, 64 nt, hsa; identical to SEQ ID NO: 79263

SEQ ID NO: 104106 - RNA, 64 nt, hsa; identical to SEQ ID NO: 79264

SEQ ID NO: 104107 - RNA, 64 nt, hsa; identical to SEQ ID NO: 79265

SEQ ID NO: 104108 - RNA, 64 nt, hsa; identical to SEQ ID NO: 79266

SEQ ID NO: 104109 - RNA, 64 nt, hsa; identical to SEQ ID NO: 79267

SEQ ID NO: 104110 - RNA, 64 nt, hsa; identical to SEQ ID NO: 79268

SEQ ID NO: 104111 - RNA, 64 nt, hsa; identical to SEQ ID NO: 79269

SEQ ID NO: 104112 - RNA, 64 nt, hsa; identical to SEQ ID NO: 79270

SEQ ID NO: 104113 - RNA, 64 nt, hsa; identical to SEQ ID NO: 79271

SEQ ID NO: 104114 - RNA, 64 nt, hsa; identical to SEQ ID NO: 79272

SEQ ID NO: 104115 - RNA, 64 nt, hsa; identical to SEQ ID NO: 79273

SEQ ID NO: 104116 - RNA, 64 nt, hsa; identical to SEQ ID NO: 79274

SEQ ID NO: 104117 - RNA, 64 nt, hsa; identical to SEQ ID NO: 79275

SEQ ID NO: 104118 - RNA, 64 nt, hsa; identical to SEQ ID NO: 79276

SEQ ID NO: 104119 - RNA, 64 nt, hsa; identical to SEQ ID NO: 79277

SEQ ID NO: 104120 - RNA, 64 nt, hsa; identical to SEQ ID NO: 79278

SEQ ID NO: 104121 - RNA, 64 nt, hsa; identical to SEQ ID NO: 79279

SEQ ID NO: 104122 - RNA, 64 nt, hsa; identical to SEQ ID NO: 79280

SEQ ID NO: 104123 - RNA, 64 nt, hsa; identical to SEQ ID NO: 79281

SEQ ID NO: 104124 - RNA, 64 nt, hsa; identical to SEQ ID NO: 79282

SEQ ID NO: 104125 - RNA, 64 nt, hsa; identical to SEQ ID NO: 79283

SEQ ID NO: 104126 - RNA, 64 nt, hsa; identical to SEQ ID NO: 79284

SEQ ID NO: 104127 - RNA, 64 nt, hsa; identical to SEQ ID NO: 79285

SEQ ID NO: 104128 - RNA, 64 nt, hsa; identical to SEQ ID NO: 79286

SEQ ID NO: 104129 - RNA, 64 nt, hsa; identical to SEQ ID NO: 79287

SEQ ID NO: 104130 - RNA, 64 nt, hsa; identical to SEQ ID NO: 79288

SEQ ID NO: 104131 - RNA, 64 nt, hsa; identical to SEQ ID NO: 79289

SEQ ID NO: 104132 - RNA, 64 nt, hsa; identical to SEQ ID NO: 79290

SEQ ID NO: 104133 - RNA, 64 nt, hsa; identical to SEQ ID NO: 94908

SEQ ID NO: 104134 - RNA, 64 nt, hsa; identical to SEQ ID NO: 94909

SEQ ID NO: 104135 - RNA, 64 nt, hsa; identical to SEQ ID NO: 94910

SEQ ID NO: 104136 - RNA, 64 nt, hsa; identical to SEQ ID NO: 94911

SEQ ID NO: 104137 - RNA, 64 nt, hsa; identical to SEQ ID NO: 94912

SEQ ID NO: 104138 - RNA, 64 nt, hsa; identical to SEQ ID NO: 94913

SEQ ID NO: 104139 - RNA, 64 nt, hsa; identical to SEQ ID NO: 94914

SEQ ID NO: 104140 - RNA, 64 nt, hsa; identical to SEQ ID NO: 94915

SEQ ID NO: 104141 - RNA, 64 nt, hsa; identical to SEQ ID NO: 94916

SEQ ID NO: 104142 - RNA, 64 nt, hsa; identical to SEQ ID NO: 94917

SEQ ID NO: 104143 - RNA, 64 nt, hsa; identical to SEQ ID NO: 94918

SEQ ID NO: 104144 - RNA, 64 nt, hsa; identical to SEQ ID NO: 94919

SEQ ID NO: 104145 - RNA, 64 nt, hsa; identical to SEQ ID NO: 94920

SEQ ID NO: 104146 - RNA, 64 nt, hsa; identical to SEQ ID NO: 94921

SEQ ID NO: 104147 - RNA, 64 nt, hsa; identical to SEQ ID NO: 94922

SEQ ID NO: 104148 - RNA, 64 nt, hsa; identical to SEQ ID NO: 94923

SEQ ID NO: 104149 - RNA, 64 nt, hsa; identical to SEQ ID NO: 94924

SEQ ID NO: 104150 - RNA, 64 nt, hsa; identical to SEQ ID NO: 94925

SEQ ID NO: 104151 - RNA, 64 nt, hsa; identical to SEQ ID NO: 94926

SEQ ID NO: 104152 - RNA, 64 nt, hsa; identical to SEQ ID NO: 94927

SEQ ID NO: 104153 - RNA, 64 nt, hsa; identical to SEQ ID NO: 94928

SEQ ID NO: 104154 - RNA, 64 nt, hsa; identical to SEQ ID NO: 94929

SEQ ID NO: 104155 - RNA, 64 nt, hsa; identical to SEQ ID NO: 94930

SEQ ID NO: 104156 - RNA, 64 nt, hsa; identical to SEQ ID NO: 94931

SEQ ID NO: 104157 - RNA, 64 nt, hsa
guccauuuccuauauaaauaccagcaagaucacucugagauacauaaacucgcauuuccuucug

SEQ ID NO: 104158 - RNA, 64 nt, hsa
auagauguccacguagcagagacugacuuaggaucugagauaaagcaucggauugcaggaauaa

SEQ ID NO: 104159 - RNA, 64 nt, hsa
uucacugcuuggcaguauugacauugaauauucucugagauacuuuuuuucuuuuggcuuuuca

SEQ ID NO: 104160 - RNA, 64 nt, hsa
acuucauuauuaaaaauugauagaauuuuagcuccugagauauuuacaacugggagaaaugucu

SEQ ID NO: 104161 - RNA, 64 nt, hsa
guguaaaaagcugaccauucccauucguucuauucugagauaggagaaaaccgcccuguggcug

SEQ ID NO: 104162 - RNA, 64 nt, hsa
guauuguccaagguuucccccccacugagacagccugagauauggccucaugggaagggaaaga

SEQ ID NO: 104163 - RNA, 64 nt, hsa
gcccagcaaccuucuaggccugcuuuccagacuucugagauagccugggaugagcaauccuguu

SEQ ID NO: 104164 - RNA, 64 nt, hsa
gaccccucucuaccugugagcguucagggggucccugagauaguuuagaugcccccccaucuua

SEQ ID NO: 104165 - RNA, 64 nt, hsa
guccguuuucaaauucaucaacagccuagagugccugagauauaagaugaaacacaaauccaca

SEQ ID NO: 104166 - RNA, 64 nt, hsa
uggcauugacgaaaaucauuugaaucucuucuggcugagauaauuugccaaugcaaaauacagu

SEQ ID NO: 104167 - RNA, 62 nt, hsa
caaaaguaacuuguuuaucucagucuguacaaaaacaguaaggaggcagaaagccaagcacu

SEQ ID NO: 104168 - RNA, 62 nt, hsa
cuuaaccuggucugaggugagacuaaacacaaaaacaguagauaaaucucucccuaaaagau

SEQ ID NO: 104169 - RNA, 62 nt, hsa
uuuaccagaccuugguaaaagaacuauuuuggaaacaguauuuguaaauggaacuaaugcua

SEQ ID NO: 104170 - RNA, 62 nt, hsa
uagacuaaaaauauccuugaaagaauaguagcaaacaguaugcaguacuccuguguucuaag

SEQ ID NO: 104171 - RNA, 62 nt, hsa
agggucaguuaaugcuacaguuacuguauagcaaacaguauccuuuuuucuccuuccccuag

SEQ ID NO: 104172 - RNA, 62 nt, hsa
aaauaaugucccaagccuuuccuuuuagugauaaacaguagcagccugcguuaauugagcac

SEQ ID NO: 104173 - RNA, 62 nt, hsa
uuuuuauaaggaauacuguuauaucuaaauuuaaacaguauuuauuuuuucaaaaacagcua

SEQ ID NO: 104174 - RNA, 62 nt, hsa
gagugaguuugucaaaaguaucucauacuuauaaacaguaugagauaggaggauuaaaauau

SEQ ID NO: 104175 - RNA, 62 nt, hsa
aaaucuagauacucauuaaguagccuuaugacaaacaguaugagauacuuaugacaaacucg

SEQ ID NO: 104176 - RNA, 62 nt, hsa
cucauacaucugugaaaaagauaaugugaaauaaacaguaaaaaaaaaaaguauguugaugg

SEQ ID NO: 104177 - RNA, 62 nt, hsa
aacuugaauuaugcauuuauuggcauuaauguaaacaguaaguccuaagcuuugauggaagg

SEQ ID NO: 104178 - RNA, 62 nt, hsa
ugcuauuguguucagauacuuacaccauaauuaaacaguaaguuauagacuugcugaguuug

SEQ ID NO: 104179 - RNA, 62 nt, hsa
auuuuuucauaaaggcauuuguaguacacagaaaacaguaguuucaguaguguaaaagaguu

SEQ ID NO: 104180 - RNA, 62 nt, hsa
cccauguuugccuggauaaaguuccucauuucaaacaguauacauacuucuuugcaguucau

SEQ ID NO: 104181 - RNA, 62 nt, hsa
uuugcaguucauuauaguaaggcuuaaccuguaaacaguaucugauggcccaccuauaaaua

SEQ ID NO: 104182 - RNA, 62 nt, hsa
guuuucuuauaugugcaaugaaguggaaugauaaacaguaugccuuuaauuuauauguguuc

SEQ ID NO: 104183 - RNA, 62 nt, hsa
uguucacaguauaugaaaauauggaguaauuuaaacaguaaauaaacauucuguggaugcuu

SEQ ID NO: 104184 - RNA, 62 nt, hsa
ccuguuaauaacgcaauuauuucuguguucuuaaacaguauaaauaguuguaaguuugcaug

SEQ ID NO: 104185 - RNA, 62 nt, hsa
gacugcugggcaugcaugaaguuaagggcaagaaacaguaugccauguguucuguaccauca

SEQ ID NO: 104186 - RNA, 62 nt, hsa
acuguuuaccuguuggucuaacagcaaaucauaaacaguaguuuucaacauacuucuaaggc

SEQ ID NO: 104187 - RNA, 62 nt, hsa
agauauaauaaaagguguuuaucauaaaaaagaaacaguauuagauuuuggucuccauaauc

SEQ ID NO: 104188 - RNA, 62 nt, hsa
ugauuuaaauccuuucugaauaaagaucagauaaacaguaacugaaggagcauguauagcuc

SEQ ID NO: 104189 - RNA, 62 nt, hsa
cugccaaauacauaggaauuuucuuucuuaaaaaacaguaaugaagacuauaucuccuuucc

SEQ ID NO: 104190 - RNA, 62 nt, hsa
cauuaguuuaacucuuaaaacauaguguuguuaaacaguauuuuuugggggcggguggauag

SEQ ID NO: 104191 - RNA, 62 nt, hsa
gguggauagcuuuuuguucuaucuuguacagaaaacaguaauggaaucacucauguucagaa

SEQ ID NO: 104192 - RNA, 62 nt, hsa
uauaauaaaaaguuacaggucacuuuaaaagcaaacaguaccacuugaugauuuugcauaaa

SEQ ID NO: 104193 - RNA, 62 nt, hsa
uccuacugaucagacucuuccaccuaaaaugaaaacaguaaccuucuauauacuguaaauaa

SEQ ID NO: 104194 - RNA, 62 nt, hsa
gaagggcuguuuuuuaagaaaaaauuuuugguaaacaguauuguguaaaauugcuuuuugua

SEQ ID NO: 104195 - RNA, 62 nt, hsa
acuccuguugauguuaaauuacuauauaauauaaacaguauguguuuuuauauaucauugug

SEQ ID NO: 104196 - RNA, 62 nt, hsa
uucauaaagcaagacaacauuaugacacuuuaaaacaguagcaaagaagucuauuuauuaac

SEQ ID NO: 104197 - RNA, 62 nt, hsa
uuuucuaaauuuuaguaagagagaagcuuuuaaaacaguacauuccugaauaaaacaacaau

SEQ ID NO: 104198 - RNA, 62 nt, hsa
aguccacuuaauuagucaaauuagcaauggcuaaacaguaucaaguacugcagaauuuauca

SEQ ID NO: 104199 - RNA, 62 nt, hsa
auagaccaaagaugguguacucuaauuuuuuaaaacaguaauggaacacaauuuuuuucauu

SEQ ID NO: 104200 - RNA, 62 nt, hsa
agaccugaggaacuuuacacugaccagcuuuaaaacaguacuuuaaaaggaaaagccuguua

SEQ ID NO: 104201 - RNA, 62 nt, hsa
gcaguauggcagucauaaaaauuuuggaaccaaaacaguaucuuuuuuuaagcuaaaaaaaa

SEQ ID NO: 104202 - RNA, 62 nt, hsa
uggcugcaauuacaggcaaccagccugacuuaaaacaguaucuuaagguagauggugauuag

SEQ ID NO: 104203 - RNA, 62 nt, hsa
auaugaaauaaaauauauucuucuaagcaaagaaacaguacuauucauagaaaacauuaguu

SEQ ID NO: 104204 - RNA, 62 nt, hsa
uuuuuaaaagcaguucaaguugacaacagcagaaacaguaacaaaaaaaucugcucagaaaa

SEQ ID NO: 104205 - RNA, 62 nt, hsa
ugucaguagaagugagauaagauccucagaggaaacaguaagaagggauaaucauuaagaua

SEQ ID NO: 104206 - RNA, 62 nt, hsa
cuaacugcccucucccaagauucauuuaguucaaacaguauccguaaacuaggaauaaugcc

SEQ ID NO: 104207 - RNA, 62 nt, hsa; identical to SEQ ID NO: 104203

SEQ ID NO: 104208 - RNA, 62 nt, hsa; identical to SEQ ID NO: 104204

SEQ ID NO: 104209 - RNA, 64 nt, hsa
ugugguccugagcugugugcccuucucagucugaggggccuaaccuagagcagguuuccauagu

SEQ ID NO: 104210 - RNA, 64 nt, hsa
gaaaaggugucucugagccgagggcaugugagcuggggccuaaacaacuagaaggagagagcca

SEQ ID NO: 104211 - RNA, 64 nt, hsa
uggggcagggggcuacccaggggcuuccuauccuggggccuaccccgggcaggcacccccaggg

SEQ ID NO: 104212 - RNA, 64 nt, hsa
accuggagucuacccagggccacccagcggcccuggggccuacccaucuucuggacagccaagu

SEQ ID NO: 104213 - RNA, 64 nt, hsa
uuuaugucauacuuauuuuuuuaguacccuuuaaaggagcuacagucauuuuauuauuucagga

SEQ ID NO: 104214 - RNA, 64 nt, hsa
aagcagaaggugcuggaaggcugguuagucugggaggagcuauuucaucuuccagcucagcucc

SEQ ID NO: 104215 - RNA, 64 nt, hsa
uaacaggguuuuaagcccagcucaggaacaguucaggagcuaaauuuccgcagcaauaagaaug

SEQ ID NO: 104216 - RNA, 64 nt, hsa
aaugauuuuucaaaacguaucuuaaauguuccccaggagcuauaugaaaaagguuaugugaaag

SEQ ID NO: 104217 - RNA, 64 nt, hsa
uuccaacagucagcuauuuuauggcacacuuuuuuugacugaugacaucuccuuugcuauaccu

SEQ ID NO: 104218 - RNA, 64 nt, hsa
uauauuaaguaauuuuuaaauauuuguaauauuguugacugacuaauaaacuauuaaguuauug

SEQ ID NO: 104219 - RNA, 64 nt, hsa
uggauaacaguaaugaucccauuaccagauaagauugacugacggggaaaaaaaaaaaaaaaga

SEQ ID NO: 104220 - RNA, 64 nt, hsa
uucaccauuaaaauuccaaacccaaagccuuuguuugacugaaggagaagagagggaaguaagc

SEQ ID NO: 104221 - RNA, 64 nt, hsa
uuuucccuuuccgcaugauaaauuuauguaauauuugacugacuugaccguaaguauguuacuu

SEQ ID NO: 104222 - RNA, 64 nt, hsa
uaaacuaccuccaaagcaagcagucuuuucaguuuugacugagugaugugagaaacuucuuuuc

SEQ ID NO: 104223 - RNA, 64 nt, hsa
auugcgggguauauggagagucaggaaacuuccuuugacugauguucaguguccaucacuuugu

SEQ ID NO: 104224 - RNA, 64 nt, hsa
uaaggaguugguaaaaagcaguucaacucuuagcuugacugagcuaaaauucacaggacuacgu

SEQ ID NO: 104225 - RNA, 64 nt, hsa
cuucaaagaaagacccaccgaaugcaguuucugcuugacugacugggccugcagcucccuucuc

SEQ ID NO: 104226 - RNA, 64 nt, hsa
uucaaaugagccaucuuuuuccuuugcguuuuucuugacugaaggugagauguuauuuguggca

SEQ ID NO: 104227 - RNA, 64 nt, hsa
auuuaauuuuuuaauuugagaauuuuuauuucuuuugacugaaaacacauuagaaccuaugagu

SEQ ID NO: 104228 - RNA, 64 nt, hsa
ucaggcauuuucaucugcuguccacguauuucacuugacugaaagcucauaugaguuaaaaugu

SEQ ID NO: 104229 - RNA, 64 nt, hsa
ggcagaauuuuucuuaucccuugugaggcaguuguugacugaguuuuucauccuuacaauccug

SEQ ID NO: 104230 - RNA, 64 nt, hsa
caacaguuauaguuugaaaguccaacuguauuaauugacugauaauaugauaauauagagauua

SEQ ID NO: 104231 - RNA, 64 nt, hsa
aucagacguacucgucauaagugagaggcguguguugacugauugacccagcgcuuuggaaaua

SEQ ID NO: 104232 - RNA, 64 nt, hsa
agguuaggacuuggugaacauguuugugggccuuuugacugaguggcagaaggaaacugcucag

SEQ ID NO: 104233 - RNA, 64 nt, hsa
aagccccagcagcccucaacaggcccagggagggaagugugagcgccuugguaugacuuaaaau

SEQ ID NO: 104234 - RNA, 64 nt, hsa
gagaagcuggacuucugugggccccucaacagccaagugugaccccacugccaaguggggaugg

SEQ ID NO: 104235 - RNA, 64 nt, hsa
uguuuuuuggaggugcaguuaaacuuuuaagcuuaagugugacaggacugauaaauagaagauc

SEQ ID NO: 104236 - RNA, 64 nt, hsa
cauuucauaccauguauauauagagauguucuauaagugugagaaaguauaugcuuuaauagau

SEQ ID NO: 104237 - RNA, 64 nt, hsa
cucaucccgaucucuuccugucagaggaccggagaagugugagaaggugccccuucaggcaccu

SEQ ID NO: 104238 - RNA, 64 nt, hsa
gaacuaguuguuacacagcucccagccaagaagaaagugugagaaguugaugggcagcaaaccu

SEQ ID NO: 104239 - RNA, 64 nt, hsa
uauuuagaaguaaagugugaugacgauaacacuuaagugugaauuuuuaaauauaguugaguag

SEQ ID NO: 104240 - RNA, 64 nt, hsa
uaaugauaacguauuuggaguuuauuuagaaguaaagugugaugacgauaacacuuaaguguga

SEQ ID NO: 104241 - RNA, 64 nt, hsa
uauacaucaauuauuacaaaaagcagugaauuguaagugugagguguguuuacuuagaugugaa

SEQ ID NO: 104242 - RNA, 64 nt, hsa
aggcuuguuuuauuggaaggaccagaaaacugguaagugugacccagaucaagugugaggagau

SEQ ID NO: 104243 - RNA, 64 nt, hsa
aaggaccagaaaacugguaagugugacccagaucaagugugaggagaugaggcuggggauaguc

SEQ ID NO: 104244 - RNA, 64 nt, hsa; identical to SEQ ID NO: 60581

SEQ ID NO: 104245 - RNA, 64 nt, hsa; identical to SEQ ID NO: 60582

SEQ ID NO: 104246 - RNA, 64 nt, hsa
ggggaaggaagaaaaaacggcuuucauuaccaaauaauguaaaaccucaaaagcaagggcuuca

SEQ ID NO: 104247 - RNA, 64 nt, hsa
auuuaaagaaauauguuguuucuugucuguaauguaauguaaaggguggaaaggccucaagcuc

SEQ ID NO: 104248 - RNA, 64 nt, hsa
auuuaauuuaaagaaauauguuguuucuugucuguaauguaauguaaaggguggaaaggccuca

SEQ ID NO: 104249 - RNA, 64 nt, hsa
gggccaacuccaauauaggguggguaaggccuuauaauguaaagagcauauaauguaaagggcu

SEQ ID NO: 104250 - RNA, 64 nt, hsa
aggguggguaaggccuuauaauguaaagagcauauaauguaaagggcuuuagagugagacagac

SEQ ID NO: 104251 - RNA, 64 nt, hsa
ccugcaauaaguguacuaaacucuacgcucugguuaauguaauguacucuccuggacugaaugc

SEQ ID NO: 104252 - RNA, 64 nt, hsa
ugguuaaaauaaauacgccauuggcaauacuucauaauguaauggaauuguuuggggaacacuu

SEQ ID NO: 104253 - RNA, 64 nt, hsa
gguguuuuaaauucauuauaaacuauuuauuaacuaauguaauguccuccucuaagaccauauu

SEQ ID NO: 104254 - RNA, 64 nt, hsa
aacauuuggaaaaguaacaaauagaguaaauuguuaauguaaauaguuggugcuuacuuucauu

SEQ ID NO: 104255 - RNA, 64 nt, hsa
gcuaucuguuuauguagaaugauuuuguuaagaguaauguaaacuauuauugaguagaggccua

SEQ ID NO: 104256 - RNA, 64 nt, hsa
aguguccaucauucuguguagaagcuuaaauauguaauguaaccaaacuccaguauuaaaaauc

SEQ ID NO: 104257 - RNA, 64 nt, hsa
ccaguucuucaaacacucuuaaauuuuucuuaaguaauguaaaaauggaacugccaauuuuauu

SEQ ID NO: 104258 - RNA, 64 nt, hsa
guuugaaaauuauuaguuuugcaagaucacacacuaauguaaccauuuuaugaagguugaagug

SEQ ID NO: 104259 - RNA, 64 nt, hsa
uuuuccuauuaaaaauucaguuuccccugagacuuaauguaaccacuuaauguaaucacuaucu

SEQ ID NO: 104260 - RNA, 64 nt, hsa
aauucaguuuccccugagacuuaauguaaccacuuaauguaaucacuaucucauuguuucaucu

SEQ ID NO: 104261 - RNA, 64 nt, hsa
agaauuuuguaucuccuuugauaaaaaguguguauaauguaaaguaguuuugcauauucuugug

SEQ ID NO: 104262 - RNA, 64 nt, hsa
uuugguuuuauaauguuugucaccagauuuuuauuaauguaaaaaaaaucaauuuuuaaaaaau

SEQ ID NO: 104263 - RNA, 64 nt, hsa
aguuuucaaauacuauugaccacauugcucuaguuaauguaaggucagcucugacuuuuugugu

SEQ ID NO: 104264 - RNA, 64 nt, hsa
auauuuuguuuaaauauaaucuauaauuguuuuguaauguaagacuaauuacuaauauuuaugu

SEQ ID NO: 104265 - RNA, 64 nt, hsa
cuaaugguaggaauguuaauguaaauaguggugguaauguaaaaucauuucauuuaucauucau

SEQ ID NO: 104266 - RNA, 64 nt, hsa
uuuuuauuuuggagacggcuaaugguaggaauguuaauguaaauaguggugguaauguaaaauc

SEQ ID NO: 104267 - RNA, 64 nt, hsa
agagauaauguaaacugaaaaaaaaucugcaagauaauguaacugaauguuuuaaaaacagaac

SEQ ID NO: 104268 - RNA, 64 nt, hsa
auaugaccaucuuuccaucaaaucaauguagagauaauguaaacugaaaaaaaaucugcaagau

SEQ ID NO: 104269 - RNA, 64 nt, hsa
uuauuaguaccuggcuugaagccuaguguuuucauaauguaauucaaugaaaacuguuggagaa

SEQ ID NO: 104270 - RNA, 64 nt, hsa
cuugggacagguguguaauguuagugugcaugacuaauguaagaaauuguuauucuacuaauau

SEQ ID NO: 104271 - RNA, 64 nt, hsa
ucuaaagaaaagaaucagaaaucaaucuuucuacuaauguaaauuugagauuauuuuuaaaaau

SEQ ID NO: 104272 - RNA, 64 nt, hsa
gcuagauuguuguguguuuuguugaauuuuuucauaauguaaugccguauuuauuguuuuuaaa

SEQ ID NO: 104273 - RNA, 64 nt, hsa
uuguaugcuaguuuaaaaaagaaaauauguaauauaauguaaaaaaaaacaaaaaaaagcuuuu

SEQ ID NO: 104274 - RNA, 64 nt, hsa
agagaaucgagaaauuugauagagguaacuuguuuaauguaaaucuaauaguacuuguaauuuc

SEQ ID NO: 104275 - RNA, 64 nt, hsa
acagaucuuauuuuuuuauuuugagugccacuauuaauguaaaaaggggggggcucuacagcag

SEQ ID NO: 104276 - RNA, 64 nt, hsa
ggauuuugggguuuuuuuuuaguauuuauagaaauaauguaaaaauaaaaaguaaagagaauga

SEQ ID NO: 104277 - RNA, 64 nt, hsa
auauuuuaaaaguuauaaacuaaccucagaccucuaauguaaguugguuucaagauuggggauu

SEQ ID NO: 104278 - RNA, 64 nt, hsa
ugaguuuaaaaaaauaacaucugaaaagaaaugcuaauguaaucauuuaucuuaucuagcaaga

SEQ ID NO: 104279 - RNA, 64 nt, hsa
uaacaacucuauuuuuuacuacauaauuaaauuuuaauguaaaauucauagcauccugauuauu

SEQ ID NO: 104280 - RNA, 64 nt, hsa
aaacacacauuugauauucucuuauauguuauaguaauguaacguauaaacucaagccuuuuua

SEQ ID NO: 104281 - RNA, 64 nt, hsa
gcuugcugucucucagaauuguuuucuuaccuuuuaauguaaugacgagugugcuucaguuugu

SEQ ID NO: 104282 - RNA, 64 nt, hsa
cugaggacaauauuuaaaugacaggaagguauauuaauguaacaagcauucauuuaaggaauag

SEQ ID NO: 104283 - RNA, 64 nt, hsa
ugcaucauuucauaggauuagaacuuacucaaaauaauguaaaucuuuaaaaauauaaauuaga

SEQ ID NO: 104284 - RNA, 64 nt, hsa
aaaugcagucauuuuauucucaagugcuuaaaauuaauguaauuaaaagcuuagcugacuacag

SEQ ID NO: 104285 - RNA, 64 nt, hsa
aaaauugguuaaaaaauuuuguuuuuuaauuacguaauguaaaagcccaacaaacacuuuaugc

SEQ ID NO: 104286 - RNA, 64 nt, hsa
guaguuaauaauaauuccaacaaggaauucagaguaauguaaaagacuaaauaucauuccuucu

SEQ ID NO: 104287 - RNA, 64 nt, hsa
guucuaaggaauagcugcauaagacauuuugaaauaauguaaugugaaguguuucuuaaagcuc

SEQ ID NO: 104288 - RNA, 64 nt, hsa
ccauuuucuuaguguuuuuaaccuguacauuguguaauguaauguuuguauauaaugaaauuuu

SEQ ID NO: 104289 - RNA, 64 nt, hsa
gguacuguuugguauuugcaaacaaaaauguaguuaauguaauuuuuaugaaaugugugcagua

SEQ ID NO: 104290 - RNA, 64 nt, hsa
ugcauauuuuuuaacaaugcccaaucuguaugaauaauguaaacuucgauuuuuuuuuaaaaaa

SEQ ID NO: 104291 - RNA, 64 nt, hsa
uuaaaaaaauuagauuuuagcuggagcuuuugacuaauguaaaguaaaugccaaacuaccgacu

SEQ ID NO: 104292 - RNA, 64 nt, hsa
auuauacaugguugguugucucuucuugaaacuguaauguaaaucuaggguccagucauauccu

SEQ ID NO: 104293 - RNA, 64 nt, hsa
accacauagcuuuugcacugcaguuacuauuuacuaauguaaacguaggguuuguaaaagucac

SEQ ID NO: 104294 - RNA, 64 nt, hsa
uaaaaacacaaucaguguucaggcuucaguuauauaauguaagcacaacuaaaaugaaacuugu

SEQ ID NO: 104295 - RNA, 64 nt, hsa
uguuucuauacaaaguaaauggauuguuugugcuuaauguaaagccgcuuuauaaaacuguaaa

SEQ ID NO: 104296 - RNA, 64 nt, hsa
aaaaggacuauuaauagaaccuuuugagaugaauuaauguaagaauauuuuuuaaauaggcuua

SEQ ID NO: 104297 - RNA, 64 nt, hsa
gaucaaaugcucuuaaauguuccuguuaccauccuaauguaaauacuggauuuuucugucauuu

SEQ ID NO: 104298 - RNA, 64 nt, hsa
augagauaaaacaacacaaugcauguugccuuuuuaauguaaauacccguagguaucauuaaua

SEQ ID NO: 104299 - RNA, 64 nt, hsa
cuuguuuuuaaauguuagauggcacuauguauauuaauguaaaacaauguuaauuuacucaagu

SEQ ID NO: 104300 - RNA, 64 nt, hsa
cuaauuuuuguauuuuaguagagacaggguuucauaauguaagucaagcuggucucgaacuccu

SEQ ID NO: 104301 - RNA, 64 nt, hsa
uuugaaaaaauuagauuuuuugaaaagugaguaauaauguaauucaacucuuaaauuauuuccu

SEQ ID NO: 104302 - RNA, 64 nt, hsa
aauggaguagcaacuaguuuuguagcacuacauuuaauguaaugagauaccuuuguucauuuuu

SEQ ID NO: 104303 - RNA, 64 nt, hsa
aguaucacaucuagcucccuuacuuguccacagauaauguaaacaaaggagggaaaaacuuauu

SEQ ID NO: 104304 - RNA, 64 nt, hsa
aagucgugugaaauccuguacacuguguauagaauaauguaauuuuauguuaauuguuauuacu

SEQ ID NO: 104305 - RNA, 64 nt, hsa
guaccucauguugaauguuauuguacuguauuuuuaauguaacagugcagaucuuguuagacac

SEQ ID NO: 104306 - RNA, 64 nt, hsa
gucacaauuuuccagauauuauauaaugaacucguaauguaacauuuccuucuagcuuccuacu

SEQ ID NO: 104307 - RNA, 64 nt, hsa
ggaugucagagaaacuuuaugcauauuaaaaauguaauguaauuauaagcgauuccccucaaca

SEQ ID NO: 104308 - RNA, 64 nt, hsa
aaagcuuugaaaauaaaggacuucacaaaaacgguaauguaaaugugcuuccaaguugggggga

SEQ ID NO: 104309 - RNA, 64 nt, hsa
uacccccugcuuaaaaauggacaaaaagaaacuauaauguaaugguuuucccuuaaaggaaugu

SEQ ID NO: 104310 - RNA, 64 nt, hsa
ucuuucuacagaagaauauuggauugauuggaguuaauguaauacucaucauuuaccacugugc

SEQ ID NO: 104311 - RNA, 64 nt, hsa
ugggaauugucucuuuguuccuauaaguagaucuuaauguaaaauaguaaauguccauugaaaa

SEQ ID NO: 104312 - RNA, 64 nt, hsa
ugagccaccgugcccggcccagauagguugaucuuaauguaacaacccaaaaauaaaugucaua

SEQ ID NO: 104313 - RNA, 64 nt, hsa
ugccaucccaaaaccagcugcuacccuguccuuuuaauguaagucacuccccuucacuguggcc

SEQ ID NO: 104314 - RNA, 64 nt, hsa
ccaaacguuuucugggcauuuuuuggccaguuuuuaauguaacaccauuagacacucaccagau

SEQ ID NO: 104315 - RNA, 64 nt, hsa
cucuuugugacuuguaauuuaacuuaaucucaucuaauguaaauauuagauuaugauguucagu

SEQ ID NO: 104316 - RNA, 64 nt, hsa
ucuuaagugagauguuaagcccacuuuguucuuuuaauguaauggagcuuauggguagaagacc

SEQ ID NO: 104317 - RNA, 64 nt, hsa; identical to SEQ ID NO: 60066

SEQ ID NO: 104318 - RNA, 64 nt, hsa; identical to SEQ ID NO: 60067

SEQ ID NO: 104319 - RNA, 64 nt, hsa; identical to SEQ ID NO: 60068

SEQ ID NO: 104320 - RNA, 64 nt, hsa; identical to SEQ ID NO: 60069

SEQ ID NO: 104321 - RNA, 64 nt, hsa; identical to SEQ ID NO: 60070

SEQ ID NO: 104322 - RNA, 64 nt, hsa; identical to SEQ ID NO: 60071

SEQ ID NO: 104323 - RNA, 64 nt, hsa; identical to SEQ ID NO: 60072

SEQ ID NO: 104324 - RNA, 64 nt, hsa; identical to SEQ ID NO: 60073

SEQ ID NO: 104325 - RNA, 64 nt, hsa; identical to SEQ ID NO: 60074

SEQ ID NO: 104326 - RNA, 64 nt, hsa; identical to SEQ ID NO: 60075

SEQ ID NO: 104327 - RNA, 64 nt, hsa; identical to SEQ ID NO: 60076

SEQ ID NO: 104328 - RNA, 63 nt, hsa
aauucccaugccagagugaaaugauuaaguauaagaccagauucauggagccaagccacuaca

SEQ ID NO: 104329 - RNA, 63 nt, hsa
uucuuuuguauuccccuuccccuauuaccuauuagaccagaucuucuguccuaaaaacuuguc

SEQ ID NO: 104330 - RNA, 63 nt, hsa
gagagugggcucauuggccuaaauaaaaagagaagaccagaagucuuugaggucucugucucu

SEQ ID NO: 104331 - RNA, 63 nt, hsa
uuuauuucucaugaauucccauuuuguggcuaaagaccagaccuuugcacuauuucaucaaga

SEQ ID NO: 104332 - RNA, 63 nt, hsa
ggauguggaggagugaccagaccagaccagaccagaccagagggaucggaggcucaggccccc

SEQ ID NO: 104333 - RNA, 63 nt, hsa
gaaguggauguggaggagugaccagaccagaccagaccagaccagagggaucggaggcucagg

SEQ ID NO: 104334 - RNA, 63 nt, hsa
ggguggaaguggauguggaggagugaccagaccagaccagaccagaccagagggaucggaggc

SEQ ID NO: 104335 - RNA, 63 nt, hsa
ugaagggguggaaguggauguggaggagugaccagaccagaccagaccagaccagagggaucg

SEQ ID NO: 104336 - RNA, 63 nt, hsa
cauauaaaucugcuucaaccuuaggauguuuucagaccagaggcaacuuauucaugaauuuuu

SEQ ID NO: 104337 - RNA, 63 nt, hsa
uacaaaaaguuuagggcauguuuucuguuuuaaagaccagaaguuugaaggcacccaaauccu

SEQ ID NO: 104338 - RNA, 63 nt, hsa
uuacauuuugaugaccuccauuuugauacuuguagaccagaucuaauccgaagauuaaucuuu

SEQ ID NO: 104339 - RNA, 63 nt, hsa
gagaagucuuaagagaugacugcucagauggagagaccagagaagagaacaagcuguugauuc

SEQ ID NO: 104340 - RNA, 63 nt, hsa
aaaauacugaaagcacaggggcagggacagaccagaccagacccaggagucuccaaagcacag

SEQ ID NO: 104341 - RNA, 63 nt, hsa
aagagaaaauacugaaagcacaggggcagggacagaccagaccagacccaggagucuccaaag

SEQ ID NO: 104342 - RNA, 63 nt, hsa
ccuagguucccucaucuguaaaacaaagguuucagaccagaugguguuuaagguuucucccca

SEQ ID NO: 104343 - RNA, 63 nt, hsa
auuuggggguuauucagccaaaauuaccguuuuagaccagaaugaauagacuacacugauaaa

SEQ ID NO: 104344 - RNA, 63 nt, hsa
ggagccagcaagagagcuuggagucgccucucuagaccagaucuagccccacccucacuccag

SEQ ID NO: 104345 - RNA, 63 nt, hsa
ccagcaccccucuccuuuggccuccggcagugcagaccagaggggaccuuuuaaggaaagaag

SEQ ID NO: 104346 - RNA, 64 nt, hsa
cuggggcuagaucgaugauaugaccagaaaucaaaaagggaaugcauuauuuauugcuguguaa

SEQ ID NO: 104347 - RNA, 64 nt, hsa
uguccagcugaguuucucuuggguauaaaggcuaaaagggaaaaaggauauguggagaaucauc

SEQ ID NO: 104348 - RNA, 64 nt, hsa
uuuuaagaacucuugaauugugugguaucuaauaaaagggaagguaagauggauaaucacuuuc

SEQ ID NO: 104349 - RNA, 64 nt, hsa
ggacuacuuuaauuuggauccuuuggguuuggagaaagggaaugugaaagcugucauuacagac

SEQ ID NO: 104350 - RNA, 64 nt, hsa
gaauagcagagagcaaaccaaucagucccucaggaaagggaagaaaaagaagagguggcaccau

SEQ ID NO: 104351 - RNA, 64 nt, hsa
aggaaaggucucagaugaaagagaggguacaacuaaagggaaugagaaggaggacgcugcagga

SEQ ID NO: 104352 - RNA, 64 nt, hsa
ccucacaguggguaaauauaucauacaucucuugaaagggaaaauauccaugucaguuucuuuc

SEQ ID NO: 104353 - RNA, 64 nt, hsa
cuuccauugugggguagguggucggggaugggagaaagggaaaagucagggaaggggagaagaa

SEQ ID NO: 104354 - RNA, 64 nt, hsa
gaaaaacuugaaaugcuacuuaacuuacuauuucaaagggaaguauauuucuuuuuaaagaauc

SEQ ID NO: 104355 - RNA, 64 nt, hsa
uuuuucaauagauuauucugccauuuuuuaaaggaaagggaaaaugaaaacagcaugucuuuuu

SEQ ID NO: 104356 - RNA, 64 nt, hsa
uagcuugaaagaugcucuacauuaugaccaauaaaaagggaauguauguuuuguuugaaaaauu

SEQ ID NO: 104357 - RNA, 64 nt, hsa
acauuaauuugucuagcauuaucaucuuaaugacaaagggaauaaugaacuagaaaccagcaag

SEQ ID NO: 104358 - RNA, 64 nt, hsa
uccugccagcucaaccugucauuuacagacuaagaaagggaaguacacaccuggcuuguggcca

SEQ ID NO: 104359 - RNA, 64 nt, hsa
gcaacauggcgagacccuguuucuacaaaaagaaaaagggaaaaaaaaagcagggacugucauu

SEQ ID NO: 104360 - RNA, 64 nt, hsa
accaaugaaaaaaggucaguugauuccagugcuaaaagggaaaaaccugugguccgcccagaag

SEQ ID NO: 104361 - RNA, 64 nt, hsa
acgcagaaaagaaaaaaagguuaagcauaaaaagaaagggaaaaagcagaaacacugcagaaga

SEQ ID NO: 104362 - RNA, 64 nt, hsa
aagagaacacaccaaaaaagugaaagagaaauugaaagggaaaaaagacaaaaagcauaaggcu

SEQ ID NO: 104363 - RNA, 64 nt, hsa
agaaaagguuuauauuauuagugaaaacaaaacuaaagggaaguucaaguucucauguaaugcc

SEQ ID NO: 104364 - RNA, 64 nt, hsa
ccaguguagggcuaucuuuuuaaaaaaugucaacaaagggaaaauaaacuaucagcuuggaugg

SEQ ID NO: 104365 - RNA, 64 nt, hsa
uaaguccuuuucucccugugccguuuucuugcucaaagggaacagugaauuagccagcuagaau

SEQ ID NO: 104366 - RNA, 64 nt, hsa
uuuagcagucagauuagguaggugguuuuauuucaaagggaaacuuuaauccaaagaaagauua

SEQ ID NO: 104367 - RNA, 64 nt, hsa
gcccacuucauaucacacaaaaugaauuuucuauaaagggaaaaaaguuugcuccuccauagau

SEQ ID NO: 104368 - RNA, 64 nt, hsa
guuuacugcugcuuggggccagggcaguccuuugaaagggaagcaaguuccggaauuuguucgc

SEQ ID NO: 104369 - RNA, 64 nt, hsa
uauuuauauguguuauaaugaaugcuucuauuuaaaagggaaauauuucuacaugugcauauag

SEQ ID NO: 104370 - RNA, 64 nt, hsa
uucauugagggccuaaaguaaucgcgcuaagaauaaagggaaaacggcgucgcccucauuucaa

SEQ ID NO: 104371 - RNA, 64 nt, hsa
cuccaaggaguuagaauuucccaguuuaaaacaaaaagggaaauguccuagguuuucuuugugc

SEQ ID NO: 104372 - RNA, 64 nt, hsa
aaagaauagaagugaaauuugcauaaugaauguaaaagggaaauaaaagucuuuugaagguagc

SEQ ID NO: 104373 - RNA, 64 nt, hsa
uucucuuuggaaaaaaacuaccacuguggucuuaaaagggaacaaaauauaccauaggcuaaaa

SEQ ID NO: 104374 - RNA, 64 nt, hsa
cuuucucucugaaagcagaaaaaggcacugauauaaagggaagagaaggaggcucaccggaggg

SEQ ID NO: 104375 - RNA, 64 nt, hsa
uuaaaagcacaucuauguucacugccacucugaaaaagggaauuauuucucagucuuucaaggc

SEQ ID NO: 104376 - RNA, 64 nt, hsa
ccaagguuggagggugggaugaguacccucugaaaaagggaauuugcuggugaaaagaggcugg

SEQ ID NO: 104377 - RNA, 64 nt, hsa
uacuguaggcagcugaagaaccgccguucccuugaaagggaacaccuggcauucugugguguuu

SEQ ID NO: 104378 - RNA, 64 nt, hsa
aauauauggagaaaugaacaaacuauguaaacaaaaagggaaacucacuuguuuuucuuuagau

SEQ ID NO: 104379 - RNA, 64 nt, hsa
auuuacugacaaaaagggaaaauacgaaacacagaaagggaaaauaaacugacuuuuauaauga

SEQ ID NO: 104380 - RNA, 64 nt, hsa
auuuccaaucaguguauugcucauuuacugacaaaaagggaaaauacgaaacacagaaagggaa

SEQ ID NO: 104381 - RNA, 64 nt, hsa
uggaguuaccucagcagaagacuagaauuagagaaaagggaaagaccuuuucuucuaguaagug

SEQ ID NO: 104382 - RNA, 64 nt, hsa
aacuaauacuacuguaccuguuauggaggacugcaaagggaagagaaaagcagaacacuguauu

SEQ ID NO: 104383 - RNA, 64 nt, hsa
uauauuugcaguuggggacagguugaguagaggaaaagggaaagaagggaaagcagaaaacaaa

SEQ ID NO: 104384 - RNA, 64 nt, hsa
uugagaagcaggcggguugggugggaggaggaagaaagggaagaauuagguuugaauugcuuuu

SEQ ID NO: 104385 - RNA, 64 nt, hsa
cugagaagcaggcggguugggugggaggaggaagaaagggaagaauuagguuugaauugcuuuu

SEQ ID NO: 104386 - RNA, 64 nt, hsa
aaaaaugaaaggugaguaaccagauagcaaaagaaaagggaaagccauccaaauuugaaagcug

SEQ ID NO: 104387 - RNA, 64 nt, hsa
cauuuaagaauugaacuaggggcuggaagaagugaaagggaagcaucuaaaaaugaaaggugag

SEQ ID NO: 104388 - RNA, 64 nt, hsa
aaaaacauuuuagaaacggacagcuuauaaaaauaaagggaagaaaggaggcagcauggagaga

SEQ ID NO: 104389 - RNA, 64 nt, hsa
ccguuuuagaaaaggaaaacgugaacaaacuuagaaagggaaggaaaucccaucagugaauccu

SEQ ID NO: 104390 - RNA, 64 nt, hsa
ggaggaaguggacucgaauccuggaggaggaaauaaagggaaagggaagucguggagaggcagg

SEQ ID NO: 104391 - RNA, 64 nt, hsa
aguggacucgaauccuggaggaggaaauaaagggaaagggaagucguggagaggcagggaaaau

SEQ ID NO: 104392 - RNA, 64 nt, hsa
gcaugugguuuugaccuuuuuuucaaucuucuagaaagggaacggaagcagaagugggacaucg

SEQ ID NO: 104393 - RNA, 64 nt, hsa
aaaauugguacuccugugccacagggguuccagaaaagggaagucacuuuaccuugcgguggug

SEQ ID NO: 104394 - RNA, 64 nt, hsa
auuccaccuccuuccugaacucuaauagagguuaaaagggaaaaaaaaaauucuguagauagca

SEQ ID NO: 104395 - RNA, 64 nt, hsa
agugcugugauugacuaguaauggcuaccacgggaaagggaaggggaagcaguagcacuaaugc

SEQ ID NO: 104396 - RNA, 64 nt, hsa
gcacugggaauggaaacuuaaucucugugacuacaaagggaaguuuuugugccuugguguucca

SEQ ID NO: 104397 - RNA, 64 nt, hsa
uuucaguuuacucaaaaacuuuuggguaaauaaaaaagggaaguacagauaguuuagguugugc

SEQ ID NO: 104398 - RNA, 64 nt, hsa
gccuacaggccauaguuaaccugcaauagagaagaaagggaaguagggcagugcaugacuggcc

SEQ ID NO: 104399 - RNA, 64 nt, hsa
uauauacacgaggggaacuguauaaagacauacuaaagggaacagauuaaaauaaguauuauua

SEQ ID NO: 104400 - RNA, 64 nt, hsa
auuauaaggcauucauauuuuuaggacugaauucaaagggaaaugcuucuuugacuuuuuuuca

SEQ ID NO: 104401 - RNA, 64 nt, hsa
auacaauagcuuaccuggcuaaaacuuugcguauaaagggaaaacuugcuuuaaucugugggau

SEQ ID NO: 104402 - RNA, 64 nt, hsa
ugggcuaaagagaagacgacgagaguaaggaaauaaagggaauugccucuggcuagagaguagu

SEQ ID NO: 104403 - RNA, 64 nt, hsa
ugcuaaggcagaauuuugagggugggagagaagaaaagggaaagaagcugaaaauguaaaacca

SEQ ID NO: 104404 - RNA, 64 nt, hsa
cucuccugaaacuuaaaaacagugggaauauaggaaagggaaccaaaucucauuaauuaauugu

SEQ ID NO: 104405 - RNA, 64 nt, hsa
ucagccgccugagaugggggucagcucuuuauauaaagggaaaccagaccaggccuaaagccca

SEQ ID NO: 104406 - RNA, 64 nt, hsa
uauugguaauguuuuugaucagaauaaagaggguaaagggaaaaaguuacuacacaugcuaggc

SEQ ID NO: 104407 - RNA, 64 nt, hsa
acucagugaacauucuuaccuaagcaaggcuauaaaagggaauacuacaguuuuguccacacuu

SEQ ID NO: 104408 - RNA, 64 nt, hsa
ccucugaacauaaauuuggucaaauaauuggaacaaagggaaacagauacuugauaugaaagcc

SEQ ID NO: 104409 - RNA, 64 nt, hsa
cauaaggucauuuucucccucuacucacaauacuaaagggaaaaaauggauucaaagcuaggau

SEQ ID NO: 104410 - RNA, 64 nt, hsa
aagggcagccagagagaaaggucggguuacccacaaagggaagcccaucagacucacagcugac

SEQ ID NO: 104411 - RNA, 64 nt, hsa
agagaagaaucaaauagaugcaauaaaaaaugauaaagggaauaucaucacugaucccacagaa

SEQ ID NO: 104412 - RNA, 64 nt, hsa
uuucuuucuauauauggauuaaaacaaaaauccuaaagggaaauacgccaaaauguugacaaug

SEQ ID NO: 104413 - RNA, 64 nt, hsa
aauuacuuuucauguugggguggggacggaggggaaagggaagccuggguuuuuguacaaaaau

SEQ ID NO: 104414 - RNA, 64 nt, hsa
uaguuuuguaaucaagauuuuauguaacauuuguaaagggaaaauuagcacuuuugugguucuu

SEQ ID NO: 104415 - RNA, 64 nt, hsa
ugaaguugucaauuccucuuauucuuaaauaucuaaagggaaaggaaaccaacuuuaauuucag

SEQ ID NO: 104416 - RNA, 64 nt, hsa
augagggcaccgcgcagcucaguuagagacggagaaagggaagaggcugggauggucucugcug

SEQ ID NO: 104417 - RNA, 64 nt, hsa
ucccaaaggccaaggaagggaugguguagguucaaaagggaaaccccccagggccugcuguggc

SEQ ID NO: 104418 - RNA, 64 nt, hsa
cuccugccacgccacugugucaugaaggaaagugaaagggaacgaggaaguaggaaugcccacg

SEQ ID NO: 104419 - RNA, 64 nt, hsa
ccaccaggguucuuuugaaauaguaccacauguaaaagggaauuuggcuuucacuucaucuaau

SEQ ID NO: 104420 - RNA, 64 nt, hsa
cccauagaccccaguugaagauggaauuuucaggaaagggaaaauacuagauaauucuagaauu

SEQ ID NO: 104421 - RNA, 64 nt, hsa
ggugaaauucacauaacauaaaguuaaccauuuuaaagggaacaauucaguggcauuugguacu

SEQ ID NO: 104422 - RNA, 64 nt, hsa
agugcagcauuucagcauauguaaaaaaaaaaaaaaagggaauugacaugucacauaucaaaug

SEQ ID NO: 104423 - RNA, 64 nt, hsa
gccgcuucauucaugccuacacaauuuuuuuuuaaaagggaacuuuaguuaauuaagugauaag

SEQ ID NO: 104424 - RNA, 64 nt, hsa
acaggugauuaacuuggaugaguuuugggaaguuaaagggaagaaaacacuguuaucauuuuuu

SEQ ID NO: 104425 - RNA, 64 nt, hsa
uauacaacaccaaaaaauaucuaguaauauauuuaaagggaaauugagcugcuuuuuuugaaac

SEQ ID NO: 104426 - RNA, 63 nt, hsa
ccaccugagaccugcuccacgacccuuccaggcagagccgagaguucgccccaacccuucccc

SEQ ID NO: 104427 - RNA, 63 nt, hsa
acccggacagcucaguccugccagcagccgcaaagagccgaggcugccaggcccauuuauguc

SEQ ID NO: 104428 - RNA, 64 nt, hsa
cucgaagcuuggcggacccccagggccacacuguacccuccagcgagucccaggagagugacuc

SEQ ID NO: 104429 - RNA, 64 nt, hsa
ucucagcuucugcgaucagauuaucaucaccaccacccuccagagaauuuuuacgcaagaagag

SEQ ID NO: 104430 - RNA, 64 nt, hsa
guggccccagggcuucuaaaaccccaccuagaccacccuccaugucagguacugagcaaggccc

SEQ ID NO: 104431 - RNA, 64 nt, hsa
cccccccauggaugcccuucagauagcagaggacacccuccaaacacugguuccccacugcccu

SEQ ID NO: 104432 - RNA, 64 nt, hsa
uuuccauuguggaucacagcacacacauacauacacccuccaccuccccauccccuguucuccc

SEQ ID NO: 104433 - RNA, 64 nt, hsa
cuucuuugaucccagcaucucagucccccucccaacccuccauauggcucucaauggugcucac

SEQ ID NO: 104434 - RNA, 64 nt, hsa
ccagaccagaguuuccugaggggcccugacccuaacccuccagcucagcccuguacaccugacc

SEQ ID NO: 104435 - RNA, 64 nt, hsa
caugcucaccauagcccccuuccuugugaccuggacccuccauuguaccuggcugagacuguca

SEQ ID NO: 104436 - RNA, 64 nt, hsa
ccgagguccccagacccccugagcccucccagggacccuccacgaccagcucugggggaggcac

SEQ ID NO: 104437 - RNA, 64 nt, hsa
ugaggaccgcgacaaggacgacauucuguucuacacccuccaggaaaugacagcagucagugcc

SEQ ID NO: 104438 - RNA, 64 nt, hsa
cuguucaucccauguuagcuccaaagcauuucccacccuccaucuaccccuuccagaagcaaaa

SEQ ID NO: 104439 - RNA, 64 nt, hsa
ucuuuuuccaucccuagccauucuggaucuugugacccuccaugccaaccagcuucccuacucc

SEQ ID NO: 104440 - RNA, 64 nt, hsa
ccuacccucucacuuaacuggagcuuugggacgcacccuccacagugggaggugguggugggug

SEQ ID NO: 104441 - RNA, 64 nt, hsa
uguucaaaagcugugauuuuugucuccccuucccacccuccagccaaggagcagcccugcccag

SEQ ID NO: 104442 - RNA, 64 nt, hsa
uacaugguacuguauguaugggagagcagacugcacccuccagcaacaacagaugaaagccagu

SEQ ID NO: 104443 - RNA, 64 nt, hsa
gggccacucccucccuagccuucaucagcagagcacccuccaucccccugcauugcucuucugu

SEQ ID NO: 104444 - RNA, 64 nt, hsa
acccuccacucagcuguccugcagcaaacacuccacccuccaccuuccauuuucccccacuacu

SEQ ID NO: 104445 - RNA, 64 nt, hsa
gcucucuaggccucuccaguuugcaccuguccccacccuccacucagcuguccugcagcaaaca

SEQ ID NO: 104446 - RNA, 64 nt, hsa
cucugggugccagguacgacgcuugccccggcccacccuccauccccacccuccauccccaccc

SEQ ID NO: 104447 - RNA, 64 nt, hsa
guacgacgcuugccccggcccacccuccauccccacccuccauccccacccuagauggagcgag

SEQ ID NO: 104448 - RNA, 64 nt, hsa
ccccuccuccacuggguucagaggguaagaaagcacccuccaauaaacccaggcuccaggccgu

SEQ ID NO: 104449 - RNA, 64 nt, hsa
gagagguuuccugcguuuuauuucuauuugguauacccuccacuguuguccacugcccugugug

SEQ ID NO: 104450 - RNA, 64 nt, hsa
uagcagcugcuucggaacaccgucccuccuaugcacccuccaagacgugcagcagaugcaaagg

SEQ ID NO: 104451 - RNA, 64 nt, hsa
ggaugcugagagaggaggcccgagaggacaccccacccuccagcguggccuuugauccagacuu

SEQ ID NO: 104452 - RNA, 64 nt, hsa
cacagacagcugcgaccaggacgucagccagcacugcacagacagcugcgaccagagacuggag

SEQ ID NO: 104453 - RNA, 64 nt, hsa
ugaggccgugguuagcguggacaucagccagcacugcacagacagcugcgaccaggacgucagc

SEQ ID NO: 104454 - RNA, 64 nt, hsa
ugacauccaaguuuaccaguagaaagacacaggaugcacagaaugggcaugaccuucagcucac

SEQ ID NO: 104455 - RNA, 64 nt, hsa
uaaugaaagggaggaacggaaggacaauuuccagugcacagaaucacuuggaugaaauaagacc

SEQ ID NO: 104456 - RNA, 64 nt, hsa
gcucccugaaggcacacguacgcacacacgcacaugcacagauaugccgccugggcacacagau

SEQ ID NO: 104457 - RNA, 64 nt, hsa
acacacgugcagauaugguauccggacacacacgugcacagauaugcugccuggacacacagau

SEQ ID NO: 104458 - RNA, 64 nt, hsa
acggauauugccuggacacacacacacacacgugugcacagauaugcugucuggacacgcacac

SEQ ID NO: 104459 - RNA, 64 nt, hsa
acacgcagacaugcuguccggacacacacacgcaugcacagauaugcuguccggacacacacac

SEQ ID NO: 104460 - RNA, 64 nt, hsa
acacacgugcagauauugccuggacacacacaugugcacagauaugcugucuggacaugcacac

SEQ ID NO: 104461 - RNA, 64 nt, hsa
ccgguggccuuuccagagcugaacagaggacagaugcacagacgggggggcucugguggucaag

SEQ ID NO: 104462 - RNA, 64 nt, hsa
agugaacaugugugcgugugcacacacgcaaguaugcacagacauacacuaaacacgaacauac

SEQ ID NO: 104463 - RNA, 64 nt, hsa
ugcucuuaacaaacacugcugcagucagcauccuugcacagauuucuuuguauacuuguauuag

SEQ ID NO: 104464 - RNA, 64 nt, hsa
uagggauguuggggugagucagugugaccccacgugcacagaaagugcugcgaguggugcaugg

SEQ ID NO: 104465 - RNA, 64 nt, hsa
aggaaagcaaauguagguaaggggagagcaaggaugcacagaaaacacacugacugugggacug

SEQ ID NO: 104466 - RNA, 64 nt, hsa
uuuaaggaaccugcuaucaggaaaucuacaugugugcacagagagagaaaaguagaacaguucu

SEQ ID NO: 104467 - RNA, 64 nt, hsa
uucuaaauuugauuauauucucugaugaucccuuugcacagaacuaugcuuaucucauguuugu

SEQ ID NO: 104468 - RNA, 64 nt, hsa
ucuguacauauuuuuguaccuuuuauguaaauuuugcacagaaauuuuuggcauaaguuuauuu

SEQ ID NO: 104469 - RNA, 64 nt, hsa
agugggcaaaugcggacccucccugccugcagccugcacagauucugguuugagguuugacucu

SEQ ID NO: 104470 - RNA, 64 nt, hsa
ucgccugccagcccagagcccuggaggagccggcugcacagagaggcuuuucuucccagcuggg

SEQ ID NO: 104471 - RNA, 64 nt, hsa
ucgugucacauacugcaggugcaucaguuacuuuugcacagauucuagggggacauuuuucuga

SEQ ID NO: 104472 - RNA, 64 nt, hsa
cucugacugccuuggaguagguggcauaaccuugugcacagagaacuagaaaaggggcagaacc

SEQ ID NO: 104473 - RNA, 64 nt, hsa
caugccaaugcacgcacacaucagugcacacggaugcacagagauaugcacacaccgaugugcg

SEQ ID NO: 104474 - RNA, 64 nt, hsa
ccaaauguauuucucccuucgcugggugccgggcugcacagacuauuccccaccugcuucccag

SEQ ID NO: 104475 - RNA, 64 nt, hsa
gagaguuccagauucccagcuuccagaugauccuugcacagacaaccuaccuucuuuccagagg

SEQ ID NO: 104476 - RNA, 64 nt, hsa
uaaauaaauguuaauauuauuuauguuuauuauuugcacagaagaguucuagggagauguauuu

SEQ ID NO: 104477 - RNA, 64 nt, hsa
cacacaggugcacagaccacacagcacacacaagugcacagagcacacugcacacaugcacaca

SEQ ID NO: 104478 - RNA, 64 nt, hsa
aaagugcauaggccacacagcacaugcacacaggugcacagaccacacagcacacacaagugca

SEQ ID NO: 104479 - RNA, 64 nt, hsa
cguguagcucacacacaguauacacauacacaagugcacagaccacacacagcacuaacacaug

SEQ ID NO: 104480 - RNA, 64 nt, hsa
uacaggcauacacaugcacgcuuacauguacacgugcacagaucacacacaugcacacacgugu

SEQ ID NO: 104481 - RNA, 64 nt, hsa
cuuuggcuauccugggcucugaucaugauauguuugagcauaguagcucccuaaacucuuggag

SEQ ID NO: 104482 - RNA, 64 nt, hsa
gggaugacuccuggacagugaagaguugaaugacugagcauauucagcagcucacugaagcgcc

SEQ ID NO: 104483 - RNA, 64 nt, hsa
ucagugauagggaaauagcugcauugaucuuacaugagcauaaucauccuuauacuucaugagg

SEQ ID NO: 104484 - RNA, 64 nt, hsa
uuaaaucacaacuuaaaaguuuuuaaaagugcuuugagcauauguauauguuuagugacaaauc

SEQ ID NO: 104485 - RNA, 64 nt, hsa
agcagcacauucuuacagaggagauggagcguuaugagcauaguauguggauagguaucuucac

SEQ ID NO: 104486 - RNA, 64 nt, hsa
cuaucagggucuucccauggugguucagaauagaugagcauagcaugguuuuguuuguuuuugc

SEQ ID NO: 104487 - RNA, 64 nt, hsa
gacuuucuuaaaaauauuuuuucuguaccuaacuugagcauaaggguuauuugagcaaguaaca

SEQ ID NO: 104488 - RNA, 64 nt, hsa
gaguuuacaguuuaagauuuuaaguauuguuuccugagcauaacuccauaaguaagaaauuucu

SEQ ID NO: 104489 - RNA, 64 nt, hsa
ucuuuccgucccucucuuucugauccaggccccucaguccaagcuuuggaaaaccuucaccuca

SEQ ID NO: 104490 - RNA, 64 nt, hsa
gcggccaccaacugaccuggggcgcugcuccccacaguccaaauaagcugaaagugcagcucgc

SEQ ID NO: 104491 - RNA, 64 nt, hsa
uaacuuuuuugcaauaauggaaacguucuaugugcaguccaauaggguagcaacuggccaaaug

SEQ ID NO: 104492 - RNA, 64 nt, hsa
caggacuccugagcagguaggcucuagagucgggcaguccaauaacuuuuuugcaauaauggaa

SEQ ID NO: 104493 - RNA, 64 nt, hsa
gaacagccaccacucuaucauccucauuuuggggcaguccaagacauagcugguuuuagaaacc

SEQ ID NO: 104494 - RNA, 64 nt, hsa
cuucagauugucugacagcaggaacugagagaagcaguccaaagaugucuuucaccaacucccu

SEQ ID NO: 104495 - RNA, 64 nt, hsa
agaaauauuaguguuacggaagugccuaauaucccaguccaaauuuuuuuuuuuuuuuuuuuuu

SEQ ID NO: 104496 - RNA, 64 nt, hsa
ugggauuacaggugugagccaccacgccuggccccaguccaaaauauuuaaagauuguuuccuu

SEQ ID NO: 104497 - RNA, 64 nt, hsa
gcugcuguucuuuaaucuuccucuagcaggcaugcaguccaaggaauaucaaaauucugguugu

SEQ ID NO: 104498 - RNA, 64 nt, hsa
gcugcugcucuuuaauuuuccucuagcaggcaugcaguccaaggaauaucaaaauucugauugu

SEQ ID NO: 104499 - RNA, 64 nt, hsa
cuucacagaaaauaaaagguguuaauuugcuuuuuaaaacaaauuuaauuaucacauuuuaaau

SEQ ID NO: 104500 - RNA, 64 nt, hsa
uugaaaucuaugauuuacugcaguaguaugugcuuaaaacaacuguugaggucuuuuaagcagg

SEQ ID NO: 104501 - RNA, 64 nt, hsa
uuugcuuccagcaaguauguuagacuagauauuauaaaacaacuagauccugaauaaaaucugc

SEQ ID NO: 104502 - RNA, 64 nt, hsa
gauaaacauaaguaaauuuaaacuguuguuuguauaaaacaauuauaaugaaguguuuauaaga

SEQ ID NO: 104503 - RNA, 64 nt, hsa
ucuaaucugagugaguuacugagcuuugguccacuaaaacaagcugagcuuugguccacuaaaa

SEQ ID NO: 104504 - RNA, 64 nt, hsa
uugguccacuaaaacaagcugagcuuugguccacuaaaacaagaugaaaaauacaagagugacu

SEQ ID NO: 104505 - RNA, 64 nt, hsa
aaaagcaacucuuaucaaggauuaauuuaauuuuuaaaacaaauacaaguuauugauucacucu

SEQ ID NO: 104506 - RNA, 64 nt, hsa
uuaaaauugugucaagguauuucucacuauacucuaaaacaacuagacuugaaaagaaaccauu

SEQ ID NO: 104507 - RNA, 64 nt, hsa
gacaagaugguacaaccuuuauucuuuuccaaaauaaaacaaagggcacagcaucuguagucag

SEQ ID NO: 104508 - RNA, 64 nt, hsa
auagcaucuguacaaaggggaaagaacauaaagguaaaacaaaacaaaacaacauuuugagaac

SEQ ID NO: 104509 - RNA, 64 nt, hsa
aaccugaagaugaguaaaacuggugggucuuuaauaaaacaacaacaaaaacagcaguuuguga

SEQ ID NO: 104510 - RNA, 64 nt, hsa
caauaacuucuauguugguuucaguggcuggaauuaaaacaaaacaaaacaaacuuccaaacag

SEQ ID NO: 104511 - RNA, 64 nt, hsa
cacuaaucacacaacaauuuugagaaguaggcuauaaaacaaaaaaagguugcuguuuucuauu

SEQ ID NO: 104512 - RNA, 64 nt, hsa
uuugacauuggcacuaaaugcauuuggggaugguuaaaacaaauuacuauagaacauuuaaaug

SEQ ID NO: 104513 - RNA, 64 nt, hsa
aacaugaauauaaugcuuacuucaaauuguuuaguaaaacaaaauaacuaaagaaaugugagcu

SEQ ID NO: 104514 - RNA, 64 nt, hsa
aaauguuagguuuccuaaaggguacagugccguauaaaacaaccugccucauauauuucuccuc

SEQ ID NO: 104515 - RNA, 64 nt, hsa
ugugggggcaaaauuuaauuuggauuugauuuuuuaaaacaauguuuacugcgauuucuauauu

SEQ ID NO: 104516 - RNA, 64 nt, hsa
agcuaugaugaccuucauauaaucagcauaaacauaaaacaaauuuuuuacuuaacaugagugc

SEQ ID NO: 104517 - RNA, 64 nt, hsa
cuuuagcacacuaggugguaugccuuuauuagcauaaaacaaaaaaaacuuuaacaggagcuuu

SEQ ID NO: 104518 - RNA, 64 nt, hsa
aaauuauucuuuuauauaacugaccagugcuuaauaaaacaagcagguacuuacaaauaauuac

SEQ ID NO: 104519 - RNA, 64 nt, hsa
ggaguagaaaacaacaaagaauggaauggacucuuaaaacaaugaaagagcauuuaucguuugu

SEQ ID NO: 104520 - RNA, 64 nt, hsa
ggacugguacgguagucuguggaaaccaggaagauaaaacaacagccacaaaagagaaaaucaa

SEQ ID NO: 104521 - RNA, 64 nt, hsa
acuuaugagaauuucacauuggaauucauaaugguaaaacaacauacaucugccaauauacguu

SEQ ID NO: 104522 - RNA, 64 nt, hsa
gcccuuugcuucuuucauuacuuauaaucuccucuaaaacaaccucugcauguuuuuuuuaaau

SEQ ID NO: 104523 - RNA, 64 nt, hsa
aacugaauaguuuacuauuucauucaagcauguuuaaaacaaauaauuuccuuucaccaguuuu

SEQ ID NO: 104524 - RNA, 64 nt, hsa
cccgcuaaccuuuuuucacccaugauuugagcccuaaaacaacagccuuuauguuuucagugca

SEQ ID NO: 104525 - RNA, 64 nt, hsa
cucaucaacuuaugauaaauuggacuauuaggaauaaaacaaucucagagcagcuccuaaacaa

SEQ ID NO: 104526 - RNA, 64 nt, hsa
auucucucagacgguggaauauuuggaaaaauuuuaaaacaauuaaaauuuuaaagcaaucuug

SEQ ID NO: 104527 - RNA, 64 nt, hsa
aaacaauuaaaauuuuaaagcaaucuuggcagacuaaaacaaguacaucuguacaugacuguau

SEQ ID NO: 104528 - RNA, 64 nt, hsa
uuaaacugugaagaacuuuaucauacaggaaacuuaaaacaagaggugucaaaagacccaaauu

SEQ ID NO: 104529 - RNA, 64 nt, hsa
ccuuuugcauaagccucuuuauaacauguaucuuuaaaacaauuaagucuuuaggaauguguaa

SEQ ID NO: 104530 - RNA, 64 nt, hsa
ccagaaaugcccucccuagguccaggaccaaagauaaaacaaacacgaggaacauguagcgucu

SEQ ID NO: 104531 - RNA, 64 nt, hsa
aauuaacuaauucuacuugaaaucaggaguuuuauaaaacaacauuuuuagacguggucaucuu

SEQ ID NO: 104532 - RNA, 64 nt, hsa
uuauguauaauauauuuaaauggggaauuucaucuaaaacaaugauguaguauuuuuaauauuc

SEQ ID NO: 104533 - RNA, 64 nt, hsa
gaacugaucaaaguagcuuacuauaucuaaacuguaaaacaauauaguuucuccugaacaccug

SEQ ID NO: 104534 - RNA, 64 nt, hsa
uauuuguuucccuguuuuuuugguaggucuuauauaaaacaaacauuccuuuguucuaguguug

SEQ ID NO: 104535 - RNA, 64 nt, hsa
uucauuacuaggaaguucuuuuuaaaaugacacuuaaaacaaucacugaaaacuugauccacau

SEQ ID NO: 104536 - RNA, 64 nt, hsa
auuccaucugagugauugucaguguaaggccuuuuaaaacaaaagcaaguucuuuguuaggaau

SEQ ID NO: 104537 - RNA, 64 nt, hsa
acugugaagaaguuuucacaacuauuuaugcugguaaaacaaaugcuguuaaaucaccuuaugc

SEQ ID NO: 104538 - RNA, 64 nt, hsa
uaacagucucaauuuuaacuaaaacuugaagaacuaaaacaacaaugcaaaccuuucagcauug

SEQ ID NO: 104539 - RNA, 64 nt, hsa
uugcauuugcaagaucugagcaaauaagauuaaguaaaacaaaucaauuguauauauaauugac

SEQ ID NO: 104540 - RNA, 64 nt, hsa
uaguagaugauaagccuaaaaaaagcacaauuauuaaaacaaacagauccauguuaggacauuu

SEQ ID NO: 104541 - RNA, 64 nt, hsa
ucaguccuucucccaacccccugcaaauugucuuuaaaacaacaacacauaaggaaucugaagc

SEQ ID NO: 104542 - RNA, 64 nt, hsa
cuuugugucuaguuugaagcuucuuguauuugucuaaaacaacaagccagaauuuuguaucucc

SEQ ID NO: 104543 - RNA, 64 nt, hsa
cuucgucuugauaggcuguaguguacaugggauguaaaacaaacaaguguaucaaagguggaug

SEQ ID NO: 104544 - RNA, 64 nt, hsa
ggguugaagcuuuucugauaauuauuacacaauuuaaaacaacauauauauuuaaaauaaauau

SEQ ID NO: 104545 - RNA, 64 nt, hsa
uugucuuccuccaaggaguuagaauuucccaguuuaaaacaaaaagggaaauguccuagguuuu

SEQ ID NO: 104546 - RNA, 64 nt, hsa
aaacaacugcuacauacauaugcagaauguguaauaaaacaaaaagcaauugcuauaugaaaau

SEQ ID NO: 104547 - RNA, 64 nt, hsa
ccccuccaaaucuucccucaaagaucuuaaugaguaaaacaacugcuacauacauaugcagaau

SEQ ID NO: 104548 - RNA, 64 nt, hsa
uauuuuuauauggaauugcauaaugugugccuuuuaaaacaauaacaaaaaccagagaugugcc

SEQ ID NO: 104549 - RNA, 64 nt, hsa
cuugacauuaaccucaucaaaagugugugaauuuuaaaacaaauucuaaaaaaacuauagugcu

SEQ ID NO: 104550 - RNA, 64 nt, hsa
gacuucaaaagaguuuugaagacuuaauuuuuuguaaaacaaguacuugagauuuugguuuauc

SEQ ID NO: 104551 - RNA, 64 nt, hsa
acaggcaugagucaccaugccuggccucauuuuuuaaaacaaaugaauaaauggacaaaugagu

SEQ ID NO: 104552 - RNA, 64 nt, hsa
uccuuacucgauguuuucuuucaacugagaagccuaaaacaaacaaaaaccuuguguguuaucc

SEQ ID NO: 104553 - RNA, 64 nt, hsa
agcgacuucaguauuguguuauguuuuacagcguuaaaacaacuaugaagaucugcagcuauuc

SEQ ID NO: 104554 - RNA, 64 nt, hsa
ucagcauuguuuuucucagcuucuuggcaaaaauuaaaacaacaacaacaacaacaacaacaac

SEQ ID NO: 104555 - RNA, 64 nt, hsa
aaccggaugcuaacgguguuuuaaaaaauaauaauaaaacaacuuguuuccuuuuggccacccc

SEQ ID NO: 104556 - RNA, 64 nt, hsa
agaauauuuuuuuuuugagcauggcuaguggauuuaaaacaacacauaccugucacugcuggag

SEQ ID NO: 104557 - RNA, 64 nt, hsa
cuggaauaguuuaacccagcaacuuuccuuuuuauaaaacaacaaaugguucaacucugucugc

SEQ ID NO: 104558 - RNA, 64 nt, hsa
uuuuucugcacuauaugcaaacaggguaacuaacuaaaacaaagccacuuucaaucuucaaucc

SEQ ID NO: 104559 - RNA, 64 nt, hsa
ccaucagaugacaagaaaggcugcuguacugaaguaaaacaaacaauaccugaaugcucuguag

SEQ ID NO: 104560 - RNA, 64 nt, hsa
acacaacacaguguuugucuuccacagggaagcuuaaaacaaaagauauuuuuaacccacugac

SEQ ID NO: 104561 - RNA, 64 nt, hsa
aauccugacuuggugacaguaucauguguauuuauaaaacaaggcuagccauauuuaggacaac

SEQ ID NO: 104562 - RNA, 64 nt, hsa
agaguguuuuugcacauuugggcgcuaaagggauuaaaacaacugaugccacaaugacuauuga

SEQ ID NO: 104563 - RNA, 64 nt, hsa
auuuuuagagguacauguuuuaaguaaauguauuuaaaacaaauuuucauggucugaauuguau

SEQ ID NO: 104564 - RNA, 64 nt, hsa
aaauguguugaaauuauuuuguaaauccaugacuuaaaacaagauacauacauaguauaacaca

SEQ ID NO: 104565 - RNA, 64 nt, hsa
ugagacacccuaccuucaauuguucaucaguggguaaaacaaauucugauguacauucaggaca

SEQ ID NO: 104566 - RNA, 64 nt, hsa
caauaaaaaaugcuuugagauagcuaacugcccauaaaacaaacucaaauugcuuauaaaguuu

SEQ ID NO: 104567 - RNA, 64 nt, hsa
cugcauucucauuggaaaugucuguuuagcuuuauaaaacaaacacuuugcugaaauaggaaaa

SEQ ID NO: 104568 - RNA, 57 nt, hsa
uuauuauuuuuuuuaauuagauacuccuaaaacaaaguuuaaaggauuacuaucugu

SEQ ID NO: 104569 - RNA, 64 nt, hsa
aauuuugaaaagaaauagaaauuaagcuacuauauaaaacaauuguuuacguguacuuuuaacu

SEQ ID NO: 104570 - RNA, 64 nt, hsa
cuuaaaugauggaaguauaggacguugcuuauuuuaaaacaagggaaggacacaaaauggaaug

SEQ ID NO: 104571 - RNA, 64 nt, hsa
uggaaugacugcuuaguccuuucucagauacucuuaaaacaauuuuuuauuguuaaauuugugg

SEQ ID NO: 104572 - RNA, 64 nt, hsa
ucaacaaaagaaaaaaaauaaaacaguaacacuuuaaaacaagaaucagacauuuuccuaugca

SEQ ID NO: 104573 - RNA, 64 nt, hsa
uuuccuuuauauacuuguuuaucuggacugccaguaaaacaaauguguauucaacaaaagaaaa

SEQ ID NO: 104574 - RNA, 64 nt, hsa
gaaaauagugagucucaaauuguucucuuuuaacuaaaacaaaucugcaaugaaucuagaugca

SEQ ID NO: 104575 - RNA, 64 nt, hsa
aaacuuggcuacguauuggaaucaccuaaaaaguuaaaacaaaacauggaugucugggucccgc

SEQ ID NO: 104576 - RNA, 64 nt, hsa
auagucuauaaaaacaguuuuacuugcaauccauuaaaacaacaaacgaaaccuagugaagcau

SEQ ID NO: 104577 - RNA, 64 nt, hsa
uacaugcauuuaugcaauauuaauguaagggcucuaaaacaauggaguagagccagagguauaa

SEQ ID NO: 104578 - RNA, 64 nt, hsa
uccagccuaggcaacagagcaagacccugucucuuaaaacaaaaaaccucacacauaccuaaaa

SEQ ID NO: 104579 - RNA, 64 nt, hsa
caguaauacgcuauuucuccaacaucaagacaacuaaaacaaaugauaaaaauguuuauuuuua

SEQ ID NO: 104580 - RNA, 64 nt, hsa
caugauacucagauuccucacccuugcuuaggaguaaaacaauauacuuuacagggugauaaua

SEQ ID NO: 104581 - RNA, 64 nt, hsa
gaaaaguuuuuuuucaaucauuguaccuugauauuaaaacaaauauccuuuaaguauuucuaau

SEQ ID NO: 104582 - RNA, 64 nt, hsa
uguucucucuaugguaaagauauuauucaccauguaaaacaaaaaacaauauuuauuguauuuu

SEQ ID NO: 104583 - RNA, 64 nt, hsa
caacuuuaugcagcuuccuuuugagggacaaauuuaaaacaaacaaccccccaucacaaacuua

SEQ ID NO: 104584 - RNA, 64 nt, hsa
uuuuacugcuuuuaacuucugauagcguuggaauuaaaacaaugucaaggugcuguugucauug

SEQ ID NO: 104585 - RNA, 64 nt, hsa
auuacucagauuuggggaaaugacauuuuuauacuaaaacaaacaccaaaauauuuuagaauaa

SEQ ID NO: 104586 - RNA, 64 nt, hsa
ugcccuaucaauuaauuuugguuuauuaauaguuuaaaacaauauucucuuuuugaaaauagua

SEQ ID NO: 104587 - RNA, 64 nt, hsa
ugguggaaguauaaauaagccuaugaacuuauaauaaaacaaacuguagguagaaaaaaugaga

SEQ ID NO: 104588 - RNA, 64 nt, hsa
aaaaaauacuuguucagguaauucuaauucuuaauaaaacaaaugaguaucauacagguagagg

SEQ ID NO: 104589 - RNA, 64 nt, hsa
cuuaaauuacucaauuuaaaauuuuaaaauccuuuaaaacaacuuuucaauuaauauuaucaca

SEQ ID NO: 104590 - RNA, 64 nt, hsa
guauuucauuuucuuuauauuggaccgaagucauuaaaacaaaaugaaacauuugccaaaacaa

SEQ ID NO: 104591 - RNA, 64 nt, hsa
acuccuuguucucuagaagggcuuuuuacuugaauaaaacaaugcaacuuagcaaaccaauuua

SEQ ID NO: 104592 - RNA, 64 nt, hsa
caaaguuuacagacuuuugauauggaaaaccagauaaaacaauguuacaaaaggcaaauauaaa

SEQ ID NO: 104593 - RNA, 64 nt, hsa
aucgcauucauaaaacaauuggaagugaaacuauuaaaacaauagggcuuuuuaaaauuaaaaa

SEQ ID NO: 104594 - RNA, 64 nt, hsa
uuaguuugaaagauaucuggagaaaucgcauucauaaaacaauuggaagugaaacuauuaaaac

SEQ ID NO: 104595 - RNA, 64 nt, hsa
aagagagaagcuuuuaaaacaguacauuccugaauaaaacaacaauauuguaucuuaaucaagg

SEQ ID NO: 104596 - RNA, 64 nt, hsa
aguagcugaguguuccugaguugccuaguagcaauaaaacaagugaauaggaaaauaauuaaua

SEQ ID NO: 104597 - RNA, 64 nt, hsa
cuaaaucuucagcauagaaggaaguguguuugccuaaaacaaucuaaaacaauucccuucuuuu

SEQ ID NO: 104598 - RNA, 64 nt, hsa
agcauagaaggaaguguguuugccuaaaacaaucuaaaacaauucccuucuuuuucaucccaga

SEQ ID NO: 104599 - RNA, 64 nt, hsa
uguauuccuaacagucuuuuguugucguuguuuuuaaaacaaagguacggaccaugugcuauau

SEQ ID NO: 104600 - RNA, 64 nt, hsa
augcacauuuaaagagaagcaucuaccacggcuuuaaaacaaaacaacucugagaugaacaaua

SEQ ID NO: 104601 - RNA, 64 nt, hsa
ugguauuuugacauguuauaauacgcaaguaaaauaaaacaauaguuuacucagcucauguuac

SEQ ID NO: 104602 - RNA, 64 nt, hsa
aaacauaaauuaaaacucaaaugccaggacaaaauaaaacaauauaccagauggagaggaugcc

SEQ ID NO: 104603 - RNA, 64 nt, hsa
uuugaacaaagugugugcauaaccagucaugagauaaaacaacacaaugcauguugccuuuuua

SEQ ID NO: 104604 - RNA, 64 nt, hsa
uuuuaaauguuagauggcacuauguauauuaauguaaaacaauguuaauuuacucaaguuuuca

SEQ ID NO: 104605 - RNA, 64 nt, hsa
uucaaaacagaagggcaaauggaaaaggggaauauaaaacaaaccaauaaaaauaccaucugag

SEQ ID NO: 104606 - RNA, 64 nt, hsa
gaauacauucauaaguacauacauucuuuugguauaaaacaauauuuugacaguuuaggcuuca

SEQ ID NO: 104607 - RNA, 64 nt, hsa
gguuuuaauagcuaaaaaacuacaaauuaagcucuaaaacaaacaaacuacagaaauguaaacc

SEQ ID NO: 104608 - RNA, 64 nt, hsa
cagccuggcaauagggcgagacuccgucucaauuuaaaacaagagagaaccagacugagucucu

SEQ ID NO: 104609 - RNA, 64 nt, hsa
cauuucccaagauugguuucccuugaguuuuugcuaaaacaaaucuuaguaguuuugcccguuu

SEQ ID NO: 104610 - RNA, 64 nt, hsa
uuugcuaaaacaaaucuuaguaguuuugcccguuuaaaacaacucacaaucguaaaugcuacua

SEQ ID NO: 104611 - RNA, 64 nt, hsa
uucccuuuauagauugauuccagcaaaggcggaauaaaacaaauuuccuaugaagagaauccug

SEQ ID NO: 104612 - RNA, 64 nt, hsa
guuuacauuuuaaauaguccauauugaauuuaauuaaaacaagggaugcaugcagucaaauuga

SEQ ID NO: 104613 - RNA, 64 nt, hsa; identical to SEQ ID NO: 38255

SEQ ID NO: 104614 - RNA, 64 nt, hsa; identical to SEQ ID NO: 38256

SEQ ID NO: 104615 - RNA, 64 nt, hsa; identical to SEQ ID NO: 38257

SEQ ID NO: 104616 - RNA, 64 nt, hsa; identical to SEQ ID NO: 38258

SEQ ID NO: 104617 - RNA, 64 nt, hsa; identical to SEQ ID NO: 38259

SEQ ID NO: 104618 - RNA, 64 nt, hsa; identical to SEQ ID NO: 38260

SEQ ID NO: 104619 - RNA, 64 nt, hsa; identical to SEQ ID NO: 38261

SEQ ID NO: 104620 - RNA, 64 nt, hsa; identical to SEQ ID NO: 38262

SEQ ID NO: 104621 - RNA, 64 nt, hsa; identical to SEQ ID NO: 38263

SEQ ID NO: 104622 - RNA, 64 nt, hsa; identical to SEQ ID NO: 38264

SEQ ID NO: 104623 - RNA, 64 nt, hsa; identical to SEQ ID NO: 38265

SEQ ID NO: 104624 - RNA, 64 nt, hsa; identical to SEQ ID NO: 38266

SEQ ID NO: 104625 - RNA, 64 nt, hsa; identical to SEQ ID NO: 38267

SEQ ID NO: 104626 - RNA, 64 nt, hsa; identical to SEQ ID NO: 38268

SEQ ID NO: 104627 - RNA, 64 nt, hsa; identical to SEQ ID NO: 38269

SEQ ID NO: 104628 - RNA, 64 nt, hsa; identical to SEQ ID NO: 38270

SEQ ID NO: 104629 - RNA, 64 nt, hsa; identical to SEQ ID NO: 38271

SEQ ID NO: 104630 - RNA, 64 nt, hsa; identical to SEQ ID NO: 38272

SEQ ID NO: 104631 - RNA, 64 nt, hsa; identical to SEQ ID NO: 38273

SEQ ID NO: 104632 - RNA, 64 nt, hsa; identical to SEQ ID NO: 38274

SEQ ID NO: 104633 - RNA, 64 nt, hsa; identical to SEQ ID NO: 38275

SEQ ID NO: 104634 - RNA, 64 nt, hsa; identical to SEQ ID NO: 38276

SEQ ID NO: 104635 - RNA, 64 nt, hsa; identical to SEQ ID NO: 38277

SEQ ID NO: 104636 - RNA, 64 nt, hsa; identical to SEQ ID NO: 38278

SEQ ID NO: 104637 - RNA, 64 nt, hsa; identical to SEQ ID NO: 38279

SEQ ID NO: 104638 - RNA, 64 nt, hsa; identical to SEQ ID NO: 38280

SEQ ID NO: 104639 - RNA, 64 nt, hsa; identical to SEQ ID NO: 38281

SEQ ID NO: 104640 - RNA, 64 nt, hsa; identical to SEQ ID NO: 38282

SEQ ID NO: 104641 - RNA, 64 nt, hsa; identical to SEQ ID NO: 38283

SEQ ID NO: 104642 - RNA, 64 nt, hsa; identical to SEQ ID NO: 38284

SEQ ID NO: 104643 - RNA, 62 nt, hsa; identical to SEQ ID NO: 38285

SEQ ID NO: 104644 - RNA, 64 nt, hsa; identical to SEQ ID NO: 38286

SEQ ID NO: 104645 - RNA, 64 nt, hsa; identical to SEQ ID NO: 38287

SEQ ID NO: 104646 - RNA, 64 nt, hsa; identical to SEQ ID NO: 38288

SEQ ID NO: 104647 - RNA, 64 nt, hsa; identical to SEQ ID NO: 38289

SEQ ID NO: 104648 - RNA, 64 nt, hsa; identical to SEQ ID NO: 38290

SEQ ID NO: 104649 - RNA, 64 nt, hsa; identical to SEQ ID NO: 38291

SEQ ID NO: 104650 - RNA, 64 nt, hsa; identical to SEQ ID NO: 38292

SEQ ID NO: 104651 - RNA, 64 nt, hsa; identical to SEQ ID NO: 38293

SEQ ID NO: 104652 - RNA, 64 nt, hsa; identical to SEQ ID NO: 38294

SEQ ID NO: 104653 - RNA, 64 nt, hsa; identical to SEQ ID NO: 38295

SEQ ID NO: 104654 - RNA, 64 nt, hsa; identical to SEQ ID NO: 38296

SEQ ID NO: 104655 - RNA, 64 nt, hsa; identical to SEQ ID NO: 38297

SEQ ID NO: 104656 - RNA, 64 nt, hsa; identical to SEQ ID NO: 38298

SEQ ID NO: 104657 - RNA, 64 nt, hsa; identical to SEQ ID NO: 38299

SEQ ID NO: 104658 - RNA, 64 nt, hsa; identical to SEQ ID NO: 38300

SEQ ID NO: 104659 - RNA, 64 nt, hsa; identical to SEQ ID NO: 38301

SEQ ID NO: 104660 - RNA, 64 nt, hsa; identical to SEQ ID NO: 38302

SEQ ID NO: 104661 - RNA, 64 nt, hsa; identical to SEQ ID NO: 38303

SEQ ID NO: 104662 - RNA, 64 nt, hsa; identical to SEQ ID NO: 38304

SEQ ID NO: 104663 - RNA, 64 nt, hsa; identical to SEQ ID NO: 38305

SEQ ID NO: 104664 - RNA, 64 nt, hsa; identical to SEQ ID NO: 38306

SEQ ID NO: 104665 - RNA, 64 nt, hsa; identical to SEQ ID NO: 38307

SEQ ID NO: 104666 - RNA, 64 nt, hsa; identical to SEQ ID NO: 38308

SEQ ID NO: 104667 - RNA, 64 nt, hsa; identical to SEQ ID NO: 38309

SEQ ID NO: 104668 - RNA, 64 nt, hsa; identical to SEQ ID NO: 38310

SEQ ID NO: 104669 - RNA, 64 nt, hsa; identical to SEQ ID NO: 38311

SEQ ID NO: 104670 - RNA, 64 nt, hsa; identical to SEQ ID NO: 38312

SEQ ID NO: 104671 - RNA, 64 nt, hsa; identical to SEQ ID NO: 38313

SEQ ID NO: 104672 - RNA, 64 nt, hsa; identical to SEQ ID NO: 38314

SEQ ID NO: 104673 - RNA, 64 nt, hsa; identical to SEQ ID NO: 38315

SEQ ID NO: 104674 - RNA, 64 nt, hsa; identical to SEQ ID NO: 38316

SEQ ID NO: 104675 - RNA, 64 nt, hsa; identical to SEQ ID NO: 38317

SEQ ID NO: 104676 - RNA, 64 nt, hsa; identical to SEQ ID NO: 38318

SEQ ID NO: 104677 - RNA, 64 nt, hsa
aaaugcagacucaaaccuucccaacaucuuuaugacucuagaauaaucauauugaugaaaucgu

SEQ ID NO: 104678 - RNA, 64 nt, hsa
uuuuuguuuuuugguuuuuuuuuuuacccagacaacucuagaaaugcggaccaaacuacuucau

SEQ ID NO: 104679 - RNA, 64 nt, hsa
uuucaguuuuuccaucaugagaugaaugagcauuacucuagauaaauuucaagacaggauacua

SEQ ID NO: 104680 - RNA, 64 nt, hsa
cgggauccuagcucuuguaggcagacaccagugcacucuagauaccuccugagaccuccguccu

SEQ ID NO: 104681 - RNA, 64 nt, hsa
uaucugaagcccucccagguguuaacauuccaagacucuagaguccaagguuuaaagagucuag

SEQ ID NO: 104682 - RNA, 64 nt, hsa
aauaagauucuaacggucuguucuguuucaaggcacucuagauuccauugguccaagauuccgg

SEQ ID NO: 104683 - RNA, 64 nt, hsa; identical to SEQ ID NO: 98813

SEQ ID NO: 104684 - RNA, 64 nt, hsa; identical to SEQ ID NO: 98814

SEQ ID NO: 104685 - RNA, 64 nt, hsa; identical to SEQ ID NO: 98815

SEQ ID NO: 104686 - RNA, 64 nt, hsa; identical to SEQ ID NO: 98816

SEQ ID NO: 104687 - RNA, 64 nt, hsa; identical to SEQ ID NO: 98817

SEQ ID NO: 104688 - RNA, 64 nt, hsa; identical to SEQ ID NO: 98818

SEQ ID NO: 104689 - RNA, 64 nt, hsa; identical to SEQ ID NO: 98819

SEQ ID NO: 104690 - RNA, 64 nt, hsa; identical to SEQ ID NO: 98820

SEQ ID NO: 104691 - RNA, 64 nt, hsa; identical to SEQ ID NO: 98821

SEQ ID NO: 104692 - RNA, 64 nt, hsa; identical to SEQ ID NO: 98822

SEQ ID NO: 104693 - RNA, 64 nt, hsa; identical to SEQ ID NO: 98823

SEQ ID NO: 104694 - RNA, 64 nt, hsa; identical to SEQ ID NO: 98824

SEQ ID NO: 104695 - RNA, 64 nt, hsa; identical to SEQ ID NO: 98825

SEQ ID NO: 104696 - RNA, 64 nt, hsa; identical to SEQ ID NO: 98826

SEQ ID NO: 104697 - RNA, 64 nt, hsa; identical to SEQ ID NO: 98827

SEQ ID NO: 104698 - RNA, 64 nt, hsa; identical to SEQ ID NO: 98828

SEQ ID NO: 104699 - RNA, 64 nt, hsa; identical to SEQ ID NO: 98829

SEQ ID NO: 104700 - RNA, 64 nt, hsa; identical to SEQ ID NO: 98830

SEQ ID NO: 104701 - RNA, 64 nt, hsa; identical to SEQ ID NO: 98831

SEQ ID NO: 104702 - RNA, 64 nt, hsa; identical to SEQ ID NO: 98832

SEQ ID NO: 104703 - RNA, 64 nt, hsa; identical to SEQ ID NO: 98833

SEQ ID NO: 104704 - RNA, 64 nt, hsa; identical to SEQ ID NO: 98834

SEQ ID NO: 104705 - RNA, 64 nt, hsa; identical to SEQ ID NO: 98835

SEQ ID NO: 104706 - RNA, 64 nt, hsa; identical to SEQ ID NO: 98836

SEQ ID NO: 104707 - RNA, 64 nt, hsa; identical to SEQ ID NO: 98837

SEQ ID NO: 104708 - RNA, 64 nt, hsa; identical to SEQ ID NO: 98838

SEQ ID NO: 104709 - RNA, 64 nt, hsa; identical to SEQ ID NO: 98839

SEQ ID NO: 104710 - RNA, 64 nt, hsa; identical to SEQ ID NO: 98840

SEQ ID NO: 104711 - RNA, 64 nt, hsa; identical to SEQ ID NO: 98841

SEQ ID NO: 104712 - RNA, 64 nt, hsa; identical to SEQ ID NO: 98842

SEQ ID NO: 104713 - RNA, 64 nt, hsa; identical to SEQ ID NO: 98843

SEQ ID NO: 104714 - RNA, 64 nt, hsa; identical to SEQ ID NO: 98844

SEQ ID NO: 104715 - RNA, 64 nt, hsa; identical to SEQ ID NO: 98845

SEQ ID NO: 104716 - RNA, 64 nt, hsa; identical to SEQ ID NO: 98846

SEQ ID NO: 104717 - RNA, 64 nt, hsa; identical to SEQ ID NO: 98847

SEQ ID NO: 104718 - RNA, 64 nt, hsa; identical to SEQ ID NO: 98848

SEQ ID NO: 104719 - RNA, 64 nt, hsa; identical to SEQ ID NO: 98849

SEQ ID NO: 104720 - RNA, 64 nt, hsa; identical to SEQ ID NO: 98850

SEQ ID NO: 104721 - RNA, 64 nt, hsa; identical to SEQ ID NO: 98851

SEQ ID NO: 104722 - RNA, 64 nt, hsa; identical to SEQ ID NO: 98852

SEQ ID NO: 104723 - RNA, 64 nt, hsa; identical to SEQ ID NO: 98853

SEQ ID NO: 104724 - RNA, 64 nt, hsa; identical to SEQ ID NO: 98854

SEQ ID NO: 104725 - RNA, 64 nt, hsa; identical to SEQ ID NO: 98855

SEQ ID NO: 104726 - RNA, 64 nt, hsa; identical to SEQ ID NO: 98856

SEQ ID NO: 104727 - RNA, 64 nt, hsa; identical to SEQ ID NO: 98857

SEQ ID NO: 104728 - RNA, 64 nt, hsa; identical to SEQ ID NO: 98858

SEQ ID NO: 104729 - RNA, 64 nt, hsa; identical to SEQ ID NO: 98859

SEQ ID NO: 104730 - RNA, 64 nt, hsa; identical to SEQ ID NO: 98860

SEQ ID NO: 104731 - RNA, 64 nt, hsa; identical to SEQ ID NO: 98861

SEQ ID NO: 104732 - RNA, 64 nt, hsa; identical to SEQ ID NO: 98862

SEQ ID NO: 104733 - RNA, 64 nt, hsa; identical to SEQ ID NO: 98863

SEQ ID NO: 104734 - RNA, 64 nt, hsa; identical to SEQ ID NO: 98864

SEQ ID NO: 104735 - RNA, 64 nt, hsa; identical to SEQ ID NO: 98865

SEQ ID NO: 104736 - RNA, 64 nt, hsa; identical to SEQ ID NO: 98866

SEQ ID NO: 104737 - RNA, 64 nt, hsa; identical to SEQ ID NO: 98867

SEQ ID NO: 104738 - RNA, 64 nt, hsa; identical to SEQ ID NO: 98868

SEQ ID NO: 104739 - RNA, 64 nt, hsa; identical to SEQ ID NO: 98869

SEQ ID NO: 104740 - RNA, 64 nt, hsa; identical to SEQ ID NO: 98870

SEQ ID NO: 104741 - RNA, 64 nt, hsa; identical to SEQ ID NO: 98871

SEQ ID NO: 104742 - RNA, 64 nt, hsa; identical to SEQ ID NO: 98872

SEQ ID NO: 104743 - RNA, 64 nt, hsa; identical to SEQ ID NO: 98873

SEQ ID NO: 104744 - RNA, 64 nt, hsa; identical to SEQ ID NO: 98874

SEQ ID NO: 104745 - RNA, 64 nt, hsa; identical to SEQ ID NO: 98875

SEQ ID NO: 104746 - RNA, 64 nt, hsa; identical to SEQ ID NO: 98876

SEQ ID NO: 104747 - RNA, 64 nt, hsa; identical to SEQ ID NO: 98877

SEQ ID NO: 104748 - RNA, 64 nt, hsa; identical to SEQ ID NO: 98878

SEQ ID NO: 104749 - RNA, 64 nt, hsa; identical to SEQ ID NO: 98879

SEQ ID NO: 104750 - RNA, 64 nt, hsa; identical to SEQ ID NO: 98880

SEQ ID NO: 104751 - RNA, 64 nt, hsa; identical to SEQ ID NO: 98881

SEQ ID NO: 104752 - RNA, 64 nt, hsa; identical to SEQ ID NO: 98882

SEQ ID NO: 104753 - RNA, 64 nt, hsa; identical to SEQ ID NO: 98883

SEQ ID NO: 104754 - RNA, 64 nt, hsa; identical to SEQ ID NO: 98884

SEQ ID NO: 104755 - RNA, 64 nt, hsa; identical to SEQ ID NO: 98885

SEQ ID NO: 104756 - RNA, 64 nt, hsa; identical to SEQ ID NO: 98886

SEQ ID NO: 104757 - RNA, 64 nt, hsa; identical to SEQ ID NO: 98887

SEQ ID NO: 104758 - RNA, 64 nt, hsa; identical to SEQ ID NO: 98888

SEQ ID NO: 104759 - RNA, 64 nt, hsa; identical to SEQ ID NO: 98889

SEQ ID NO: 104760 - RNA, 64 nt, hsa; identical to SEQ ID NO: 98890

SEQ ID NO: 104761 - RNA, 64 nt, hsa; identical to SEQ ID NO: 98891

SEQ ID NO: 104762 - RNA, 64 nt, hsa; identical to SEQ ID NO: 98892

SEQ ID NO: 104763 - RNA, 64 nt, hsa; identical to SEQ ID NO: 98893

SEQ ID NO: 104764 - RNA, 64 nt, hsa; identical to SEQ ID NO: 98894

SEQ ID NO: 104765 - RNA, 64 nt, hsa; identical to SEQ ID NO: 98895

SEQ ID NO: 104766 - RNA, 64 nt, hsa; identical to SEQ ID NO: 98896

SEQ ID NO: 104767 - RNA, 64 nt, hsa; identical to SEQ ID NO: 98897

SEQ ID NO: 104768 - RNA, 64 nt, hsa; identical to SEQ ID NO: 98898

SEQ ID NO: 104769 - RNA, 64 nt, hsa; identical to SEQ ID NO: 98899

SEQ ID NO: 104770 - RNA, 64 nt, hsa; identical to SEQ ID NO: 98900

SEQ ID NO: 104771 - RNA, 64 nt, hsa; identical to SEQ ID NO: 98901

SEQ ID NO: 104772 - RNA, 64 nt, hsa; identical to SEQ ID NO: 98902

SEQ ID NO: 104773 - RNA, 64 nt, hsa; identical to SEQ ID NO: 98903

SEQ ID NO: 104774 - RNA, 64 nt, hsa; identical to SEQ ID NO: 98904

SEQ ID NO: 104775 - RNA, 64 nt, hsa; identical to SEQ ID NO: 98905

SEQ ID NO: 104776 - RNA, 64 nt, hsa; identical to SEQ ID NO: 98906

SEQ ID NO: 104777 - RNA, 64 nt, hsa; identical to SEQ ID NO: 98907

SEQ ID NO: 104778 - RNA, 64 nt, hsa; identical to SEQ ID NO: 98908

SEQ ID NO: 104779 - RNA, 64 nt, hsa; identical to SEQ ID NO: 98909

SEQ ID NO: 104780 - RNA, 64 nt, hsa; identical to SEQ ID NO: 98910

SEQ ID NO: 104781 - RNA, 64 nt, hsa; identical to SEQ ID NO: 98911

SEQ ID NO: 104782 - RNA, 64 nt, hsa; identical to SEQ ID NO: 98912

SEQ ID NO: 104783 - RNA, 64 nt, hsa
cuacaugguuggaguguuuuuagaucagauaaauauagaaaaguaaaauggaaaaugauacuca

SEQ ID NO: 104784 - RNA, 64 nt, hsa
auuaaaacauuucuaaagugagacugaaaauaauauagaaaaucucauugcuacuugugauuau

SEQ ID NO: 104785 - RNA, 64 nt, hsa
uuuuaauuugcaguuucuguaaacaacuuguauaauagaaaagcagagaaauaaauuucccucc

SEQ ID NO: 104786 - RNA, 64 nt, hsa
cgggagcacuaaaaccaaaauacauguauuauuuauagaaaauauuuucuguuuuaaucuuuuc

SEQ ID NO: 104787 - RNA, 64 nt, hsa
gugauucuuguuuucagaagggagagugguauagauagaaaaugacaaagauggcaauauacac

SEQ ID NO: 104788 - RNA, 64 nt, hsa
uaaaacuuaaaaacucaacaccucacagauuauaauagaaaaagaaauggccucaguuugaucu

SEQ ID NO: 104789 - RNA, 64 nt, hsa
cuaucauuaaugagacaugaguaacuaaaaagugauagaaaacuauuaacagugcggcuacaug

SEQ ID NO: 104790 - RNA, 64 nt, hsa
agacaauuguaacacaauauuuguguaucuaaauauagaaaagguacaguaaaaauauggucua

SEQ ID NO: 104791 - RNA, 64 nt, hsa
ucucuuaaacauuuauuacaacaauuguuuuaaaauagaaaaaauaaaaugcuucuauuuuacc

SEQ ID NO: 104792 - RNA, 64 nt, hsa
uuauucuguuuauuaacagugucccaucuacugaauagaaaacuuugagaauaauauauauaua

SEQ ID NO: 104793 - RNA, 64 nt, hsa
ucuguggagaaaacuucaaaacuuaaaaaaggacauagaaaauguuuugaauaggccaggcgca

SEQ ID NO: 104794 - RNA, 64 nt, hsa
ggaaagccuagaacagaaauaaaugaaauagagaauagaaaagcaauacagaaaaaaaauuaug

SEQ ID NO: 104795 - RNA, 64 nt, hsa
acuaauaaucucuauuuauaacuaaaucauugagauagaaaaagauucccauugacuguagacu

SEQ ID NO: 104796 - RNA, 64 nt, hsa
gauggauuaugauaaagaagaugcuaccaaugaaauagaaaaccaacgagaugagaagacugug

SEQ ID NO: 104797 - RNA, 64 nt, hsa
uugcucuuacgaacuuuaauaaaauaguuagcuaauagaaaaacagguaagaauaaagcaaugu

SEQ ID NO: 104798 - RNA, 64 nt, hsa
aauggaaauauucaauugagacuugaggggaauaauagaaaauuaagguagauccccaauauuu

SEQ ID NO: 104799 - RNA, 64 nt, hsa
aggcuuagaugacuucugcaggauuuauauucagauagaaaacaucaaauauuuucaggggaga

SEQ ID NO: 104800 - RNA, 64 nt, hsa
uauacaaaaaaaaaagaacauuuccaaaacuaaaauagaaaaugcuuguggcauuuauuuucuc

SEQ ID NO: 104801 - RNA, 64 nt, hsa
uguauacuuaugcaugcauacauaaauccuuaguauagaaaaauugcauaaagaauagcaaucu

SEQ ID NO: 104802 - RNA, 64 nt, hsa
agauauuugaucugaguuucuaucacuaauuuggauagaaaauuucuaagggacaugguaaucc

SEQ ID NO: 104803 - RNA, 64 nt, hsa
uagaaauguaaaauacucuccagaucuaccauuaauagaaaauaaacuaaaccuuauauuuuau

SEQ ID NO: 104804 - RNA, 64 nt, hsa
cuguuuugugcuguaccuuuucugauucagaauuauagaaaacuugauaaauacuugauuuuaa

SEQ ID NO: 104805 - RNA, 64 nt, hsa
agugguauccuuacuagauucauaaugcaauuagauagaaaagguccaaaacuguacccuaugu

SEQ ID NO: 104806 - RNA, 64 nt, hsa
uagcuaguauaacuuuacagauaaccuaaaaagaauagaaaagaagagagaguggcuuugucag

SEQ ID NO: 104807 - RNA, 64 nt, hsa
guuccguaggcagagugcucacuuugaauugcuaauagaaaauaaugcacaguguccucaggau

SEQ ID NO: 104808 - RNA, 64 nt, hsa
acuagaaaaccaaugaaaagugaggccaucagaaauagaaaaugccuggcacgaacagucuauc

SEQ ID NO: 104809 - RNA, 64 nt, hsa
uccacaguugggcaaucauagcuaauuuuuggucauagaaaaucugcaucaaaucaguuuccau

SEQ ID NO: 104810 - RNA, 64 nt, hsa
agaauuugauacgcuuuuuagaaauaugcccagaauagaaaagcuauguuggggcacauguccu

SEQ ID NO: 104811 - RNA, 64 nt, hsa
uuuacugaaagagagagcagcuguuaugcaacauauagaaaaauguauagaugcuuggacagac

SEQ ID NO: 104812 - RNA, 64 nt, hsa
ugugauaaauaugagcaaaugaaguguaauaucuauagaaaaguagagugagggugaauuuaua

SEQ ID NO: 104813 - RNA, 64 nt, hsa
uuuaaaguuuuugcuuguguccuccucagucagaauagaaaaguaacugaaauacuuuuaccuu

SEQ ID NO: 104814 - RNA, 64 nt, hsa
aagaacagguucacagaaggagauaccaaaggggauagaaaaaugggaaaaaugguaagugaaa

SEQ ID NO: 104815 - RNA, 64 nt, hsa
uccagaaaauagguacgguuuuaaaauauuuuauauagaaaagcuacaaaguaaauugagcaau

SEQ ID NO: 104816 - RNA, 64 nt, hsa
cccacagguuaaaaaacuuuaguaacuuguuuguauagaaaauaguaacaaggacuauuuucua

SEQ ID NO: 104817 - RNA, 64 nt, hsa
aacauucuuuuaacaacauuuuucugaauccucaauagaaaaucacauuaaucuuauuuuaaaa

SEQ ID NO: 104818 - RNA, 64 nt, hsa
uauuauccucauuuuacacaugagggaccgaaggauagaaaaguuauuuuucaaaggucuugca

SEQ ID NO: 104819 - RNA, 64 nt, hsa
uccccccaccccaauuugcuauuuccuuauuaaaauagaaaauuauaggcaagauacaauuaua

SEQ ID NO: 104820 - RNA, 64 nt, hsa
cacauucuuuucaguuggagagaauugggcuaagauagaaaauaacaugauuuguuccuuauua

SEQ ID NO: 104821 - RNA, 64 nt, hsa
cuauucauauugcugugaaugcuuuaucuuggagauagaaaauauaaugauaaauucaucaugu

SEQ ID NO: 104822 - RNA, 64 nt, hsa
cggccuuaacuccaccugauggcaggugacccggauagaaaauggcccugcguuuagccaggau

SEQ ID NO: 104823 - RNA, 64 nt, hsa
acaucuucaguggcagcucaaucuccuuacacacauagaaaaugugcagaacgaaguuaccagc

SEQ ID NO: 104824 - RNA, 64 nt, hsa
ugugcagaacgaaguuaccagcaggauggaccuaauagaaaaagaagucgaugguaauuuaaga

SEQ ID NO: 104825 - RNA, 64 nt, hsa
uccuuuguagcuacuuuugcaggauaauaauuuuauagaaaaggaacaguugcauuuagcuucu

SEQ ID NO: 104826 - RNA, 64 nt, hsa
cauaagcuaaaucauauuaguauuaauacuacccauagaaaacuugacauguagcuucuucuga

SEQ ID NO: 104827 - RNA, 64 nt, hsa
auuugaaauagaauagguaacaccucagcguacuauagaaaaugcacucagcucaacugcugug

SEQ ID NO: 104828 - RNA, 64 nt, hsa
uuuugcauuacaggcugcauucuugccuuacuguauagaaaaagaaaaaaggcuggguuuacua

SEQ ID NO: 104829 - RNA, 64 nt, hsa
cugagaccacagaggcucagacucacuguuaagaauagaaaacuggguaugcguuucauguagc

SEQ ID NO: 104830 - RNA, 64 nt, hsa
uuauuaugggauuggaagaaacacguggucaugaauagaaaaaaaacaaacccaaagguaggaa

SEQ ID NO: 104831 - RNA, 64 nt, hsa
aacucacauuaagcgguuacucagacaguuaaucauagaaaagauuauuugcuucaucaguuca

SEQ ID NO: 104832 - RNA, 64 nt, hsa
uaaucauagaaaagauuauuugcuucaucaguucauagaaaagauuauuugcuucaucaguuaa

SEQ ID NO: 104833 - RNA, 64 nt, hsa
agcucuuacagaguugacagucuaguuucagcacauagaaaaccagcagugaauaaaccaaggu

SEQ ID NO: 104834 - RNA, 64 nt, hsa
auauugaggucauuguuuuuggcuuaaguuuauuauagaaaaucaacacuaauguuuuuagauu

SEQ ID NO: 104835 - RNA, 64 nt, hsa
gaaaaagaauugcaauuuuaauuuaaaaacauuuauagaaaauucauuuaauuuuagugacuau

SEQ ID NO: 104836 - RNA, 64 nt, hsa
gggagugcaauuguucuuaaagagccucuucugcauagaaaaagaauugcaauuuuaauuuaaa

SEQ ID NO: 104837 - RNA, 64 nt, hsa
ugaucugguucuuucuucagagauuucuacggggauagaaaaucgggagucugcccucauuaau

SEQ ID NO: 104838 - RNA, 64 nt, hsa
accuguggucauuauuuuuucuuucuguacagaaauagaaaagcauuagaaauaacuucuaacc

SEQ ID NO: 104839 - RNA, 64 nt, hsa
cuuuuugaauacuuguuucuuuagcacuuugaagauagaaaaaccacuuuuuaaguacuaaguc

SEQ ID NO: 104840 - RNA, 64 nt, hsa
cuugcugugcauuuuaaccaauaaucugaugaauauagaaaaaaaugauccaaaauauggauau

SEQ ID NO: 104841 - RNA, 64 nt, hsa
ucauauuuucuguccagucaauguugguuacuaaauagaaaaccuaauuaaggaaguaacuuuu

SEQ ID NO: 104842 - RNA, 64 nt, hsa
uuggcccucuuuccucuguggcaaagcgugucccauagaaaauuggguguguauacuuguauaa

SEQ ID NO: 104843 - RNA, 64 nt, hsa
guguggaauaguucugaauuaugcuguucuacagauagaaaaaaaguccaaaugccuuuaaaaa

SEQ ID NO: 104844 - RNA, 64 nt, hsa
uaacauuguauucguguuugcauuauuaauuugaauagaaaauaaucacauuuucaacccauuu

SEQ ID NO: 104845 - RNA, 64 nt, hsa
gguuucuuggcuuuccgaaggccaugaucuagagauagaaaaaucccuacuaagucccaacagg

SEQ ID NO: 104846 - RNA, 64 nt, hsa
aggguggccauuuagucugaccugggcuauggggauagaaaagaaaucuuuggggcacugcauc

SEQ ID NO: 104847 - RNA, 64 nt, hsa
ucuguauuauauacaaguguaauacaugcauauaauagaaaaaaaacauggaauuucaaauaua

SEQ ID NO: 104848 - RNA, 64 nt, hsa
uguuugaaugcuuauauauuuguucaaucuguugauagaaaaaauuguucauuuuccucagucu

SEQ ID NO: 104849 - RNA, 64 nt, hsa
acaauuauaauuucuuuacauacucaaaaccaagauagaaaaaggugcuaucguucaacuucaa

SEQ ID NO: 104850 - RNA, 64 nt, hsa
uuacuaauuuuuguauuauuuuuguaaauagccaauagaaaaguuugcuugacauggugcuuuu

SEQ ID NO: 104851 - RNA, 64 nt, hsa
guccauccuaauucacagaauuaaaugagcuuaaauagaaaauucaguauuuuaugauaaucac

SEQ ID NO: 104852 - RNA, 64 nt, hsa
uuuguaagcuacuuaucuccaaaaaacuucagaaauagaaaacuacauuuuggcaggaauaauu

SEQ ID NO: 104853 - RNA, 64 nt, hsa
augggggcuauaauuaugguauauaauguaucugauagaaaauuugauaagaaaauguaaugaa

SEQ ID NO: 104854 - RNA, 64 nt, hsa
aacaucuaucaagcaacacagccccuuaucccagauagaaaagugucucaaaugcauucuacug

SEQ ID NO: 104855 - RNA, 64 nt, hsa
uuauauuguuucauccuuauauuggaaugauuauauagaaaaugcucuuaaaaagauuaaaccu

SEQ ID NO: 104856 - RNA, 64 nt, hsa
agccacucccgccacacgcucacuccagguucguauagaaaaagcacagcucucacuggccagu

SEQ ID NO: 104857 - RNA, 64 nt, hsa
aaagaacacccaucguauaaggaaauccagccccauagaaaacaaucugcccaccgacccccuu

SEQ ID NO: 104858 - RNA, 64 nt, hsa
acugacaauguauuuuggaagacauauauuauauauagaaaagaggagaggaaaacuauuccau

SEQ ID NO: 104859 - RNA, 64 nt, hsa
guagaauuguuagauggcaauagucauuaaaaacauagaaaaaugaugucuuuaaguggagaau

SEQ ID NO: 104860 - RNA, 64 nt, hsa
caucugaacuggaccaguguugaucuguaauguaauagaaaaucugauagaccagcacuucuga

SEQ ID NO: 104861 - RNA, 64 nt, hsa
aagaaauuuuaugcggaaaaucuuuauaugcaguauagaaaaguuaacacaaguacuaauaaaa

SEQ ID NO: 104862 - RNA, 64 nt, hsa
uuuugcaaguuuaauuugauuuauuucagagaaaauagaaaaaacaauguuagaagguuauuua

SEQ ID NO: 104863 - RNA, 64 nt, hsa
aaucucauuguaaagcuaucagucauuuaguagaauagaaaagcaacauagagcauacaagaac

SEQ ID NO: 104864 - RNA, 64 nt, hsa
uuauuuuggaucuuagauccaaacacaguuucuaauagaaaacuauuauuuauauugggaaagg

SEQ ID NO: 104865 - RNA, 64 nt, hsa
aucauaaaaaaccagauaauugaacuuugaaguuauagaaaaucagagagggguaaguuuauag

SEQ ID NO: 104866 - RNA, 64 nt, hsa
uuugggagauuauaaucaguuuguuuucaagauaauagaaaauaagguccaugagaauagaagu

SEQ ID NO: 104867 - RNA, 64 nt, hsa
agguuuguccuauucuucauuuauucauacuaggauagaaaauuuuggaaucagaaaauagauc

SEQ ID NO: 104868 - RNA, 64 nt, hsa
aaaacuuagcagucagugacauggggaaauaguuauagaaaaugucacugaauuuuuucauauu

SEQ ID NO: 104869 - RNA, 64 nt, hsa
aauuggucagucagguagaagauacaugugugauauagaaaaauaaugccucuccugcugccau

SEQ ID NO: 104870 - RNA, 64 nt, hsa
ggcagggagaagagaaggcauuaguaagaaaaaaauagaaaaaaauaugaacagacucagcuuu

SEQ ID NO: 104871 - RNA, 64 nt, hsa
cagucucuuccccaaagucucaccuuuucuuccaauagaaaauuccgcuugaccuuuggugcac

SEQ ID NO: 104872 - RNA, 64 nt, hsa
ucaacugaauucacacacacacaaauauaguaccauagaaaaaguuuguuuucucgaaauaauu

SEQ ID NO: 104873 - RNA, 64 nt, hsa
ugaucgcauauucauugaugaggguuugcuugagauagaaaaugguggcuccuuucugucuuau

SEQ ID NO: 104874 - RNA, 64 nt, hsa
acuuuuguguauagaaaauauguauaguagguagauagaaaaguauaaaauguuuguugaagua

SEQ ID NO: 104875 - RNA, 64 nt, hsa
uuaaaacacaaauuucaaucaaauacuuuuguguauagaaaauauguauaguagguagauagaa

SEQ ID NO: 104876 - RNA, 64 nt, hsa
ccagugucagcuuccaaucccuaguacauauauaauagaaaagggccaagaaaaauaugcaucu

SEQ ID NO: 104877 - RNA, 64 nt, hsa
uuauacuucuuuaaaaagcucugaagcugcuacaauagaaaaaucaaaaaggguaacaguaucu

SEQ ID NO: 104878 - RNA, 61 nt, hsa
uucgagaaauuaaaucuuaaaaucuguguaaauagaaaacuugaaccauuaguaauaacag

SEQ ID NO: 104879 - RNA, 64 nt, hsa
uucuugaaaugucuauuuaagcugcuuuaaguuaauagaaaagauuaaagcaaaauauucauuu

SEQ ID NO: 104880 - RNA, 64 nt, hsa
agucccccuccuaacgucuuccuuucccugcacuaacgccaaccugacugcuuuuccugucagu

SEQ ID NO: 104881 - RNA, 64 nt, hsa
gggccuggacacagaugaccucuacgggagucugaacgccaagauuuagucucaggauuaaccu

SEQ ID NO: 104882 - RNA, 64 nt, hsa
gcguuucugauggaaacaguuuggauuguauaauaacgccaagcccaguuguagucguuugagu

SEQ ID NO: 104883 - RNA, 64 nt, hsa
uguucuuuccgagucuuaaucuucagaaacagugaacgccaaaaagaacucaagauauucuggg

SEQ ID NO: 104884 - RNA, 64 nt, hsa
uguguguuuuuuaauagguuauuucugacagacaaacgccaaaaaaagaugaaagucuuguauc

SEQ ID NO: 104885 - RNA, 64 nt, hsa
aaggaucccccgugacggcucugccccacuugugaacgccaacccucagugcuuagccugcuuu

SEQ ID NO: 104886 - RNA, 64 nt, hsa
aagcauauaauauucucacguacuucuuucagcaaacgccaaacaguaguaauucuuguaacua

SEQ ID NO: 104887 - RNA, 64 nt, hsa
ccuaugagaagcuggcucuucugaguccagggccaacgccaacuggcaaccucuuuacucuuag

SEQ ID NO: 104888 - RNA, 64 nt, hsa
cccggguucuagcugcccuucucuccuguaggagaacgccaagaacgaagagauucugaauucc

SEQ ID NO: 104889 - RNA, 64 nt, hsa
uugaagccugucagggaugcuuuguaucuaacacaacgccaacagaagcacauuugucuuccag

SEQ ID NO: 104890 - RNA, 64 nt, hsa
ucuguagguuaaaugcagguauuuuaacugugugaacgccaaacuaaaguuuacagucuuucuu

SEQ ID NO: 104891 - RNA, 64 nt, hsa
aacagcucugcuggacacccaagaaagccaugggaacgccaacuggaaagguccccuuccccag

SEQ ID NO: 104892 - RNA, 64 nt, hsa
cugaucugcgugacagaaacaccagcauauuugcaacgccaaggauauuggucuuaagugcaag

SEQ ID NO: 104893 - RNA, 64 nt, hsa
uuaaaguguggaaagcaaaauaacaaaaaagagaaacgccaacaaaaaucagcagauguugaag

SEQ ID NO: 104894 - RNA, 64 nt, hsa
cuggcagcuccaagagguuuuucagcucuuugacaacgccaacugcccaagccuacagaacaaa

SEQ ID NO: 104895 - RNA, 64 nt, hsa
cugcuggccuuagcagggagacaggggagcaaagaacgccaagccggaggcccgaggccagccg

SEQ ID NO: 104896 - RNA, 64 nt, hsa
uccauguagcaaccaggacgaaguugagaaggaaaacgccaaaugcuuugguuauuagaguuua

SEQ ID NO: 104897 - RNA, 64 nt, hsa
ucccaggccccaggggagaaagaggaguagcaugaacgccaaggaauguacguugagaaucacu

SEQ ID NO: 104898 - RNA, 64 nt, hsa
agacuauuuaaaaacugguacaacaggucucuacaacgccaagaucuaacuaagcuuuaaaagg

SEQ ID NO: 104899 - RNA, 64 nt, hsa
cuuggggccccagcggugggagugcaaaagacccaacgccaacaccuggugccuucugcagcca

SEQ ID NO: 104900 - RNA, 64 nt, hsa
cuggcucagaggggcccaccuugcguggaaugaaaacgccaaaggcucaugagcaacauuaggc

SEQ ID NO: 104901 - RNA, 64 nt, hsa
caaguugggacucauccaauggagccgucuacucaacgccaaaggcuuccuucucuggcauauu

SEQ ID NO: 104902 - RNA, 64 nt, hsa
caugcucuagagaaaauaauuuuauuuuuaaauaaacgccaaaaaaugucaaaaucucaagauu

SEQ ID NO: 104903 - RNA, 64 nt, hsa
aaauguuuaauaaauaucugagcauguaucuaucaacgccaagaauuucaaagucuccuucaac

SEQ ID NO: 104904 - RNA, 64 nt, hsa
cuuaaaaaagaagacuuguguaagucucugcaucaacgccaauaaacauguugcuuaauaauaa

SEQ ID NO: 104905 - RNA, 64 nt, hsa
uguagauagccauuucauuucuuuaaacuguuucaacgccaauauguauucuacaaaagagaau

SEQ ID NO: 104906 - RNA, 64 nt, hsa
cacugccuccagagucuuuaaauucucaguuaucaacgccaagguuuaaggucuagauaggguu

SEQ ID NO: 104907 - RNA, 64 nt, hsa
caacuaccccuccucagacaacagccucuacaccaacgccaagggcagcaccaucucugccuuc

SEQ ID NO: 104908 - RNA, 64 nt, hsa
uuuuguuuugguuucuguauuauguauuuuugucaacgccaauaaauuucuuugauuuguauuu

SEQ ID NO: 104909 - RNA, 64 nt, hsa
ccaugucccccagccauggcauggcugcacuguaaacgccaaucggggggucaccaggaucaac

SEQ ID NO: 104910 - RNA, 64 nt, hsa
gaccagagcuguguuuguggaguccacugucuacaacgccaacgucaaccuguucugcauuguc

SEQ ID NO: 104911 - RNA, 64 nt, hsa
auaugaaaacucucaugaauaaacaucuccgugaaacgccaaggcccucgucaaacccugaguc

SEQ ID NO: 104912 - RNA, 64 nt, hsa
ucuaaaacuaauuugacaaaucaugacacuagaaaacgccaauguuuuaugucuuugcccaucu

SEQ ID NO: 104913 - RNA, 64 nt, hsa
gugagaucacaguucauugcagccuugacuucucaacgccaagucauccucccaccucagccuc

SEQ ID NO: 104914 - RNA, 64 nt, hsa
uuuuguacaccuucuguuucuuugcuuauuuuuuaacgccaaagaaagacucucagagaauaga

SEQ ID NO: 104915 - RNA, 64 nt, hsa
ugcucacuaaaacaacuuuuuccauuuuuaauaaaacgccaaaaauaucacaacccaccaaaaa

SEQ ID NO: 104916 - RNA, 64 nt, hsa
gucagcucuagccaacagugagguuucuuuucuucugcccuaacuauuguguagccucuuaugc

SEQ ID NO: 104917 - RNA, 64 nt, hsa
gccgaaggguccaagggccagacugccucacccucugcccuaaucagcagggugggccugccuu

SEQ ID NO: 104918 - RNA, 64 nt, hsa
ugugggucguggauaaggagcuuauucagguuuccugcccuagcuauuagcuccacuucacaug

SEQ ID NO: 104919 - RNA, 64 nt, hsa
cuagucagcuaaagucauuuguaguuugccccaccugcccuaaauaagaaaccccaaauguagu

SEQ ID NO: 104920 - RNA, 64 nt, hsa
cagcacuuuugaccaaguccugcuacugcggccccugcccuagggcuuagagcauggaccuccu

SEQ ID NO: 104921 - RNA, 64 nt, hsa
ccacaucugaaaccuguagguccccccagcucaccugcccuacuggggcccaacacuguaccca

SEQ ID NO: 104922 - RNA, 64 nt, hsa
acagcuuccucacaccccugucccacccacacagcugcccuagcugaccccgagaagugcucuu

SEQ ID NO: 104923 - RNA, 64 nt, hsa
gggucugauuuucucacugaacuccaccgaccaacugcccuaagcccccagggccuccagggcc

SEQ ID NO: 104924 - RNA, 64 nt, hsa
uuccuaccacagaaguaauuuucaaaguaagucucugcccuaggcacaucagaucaccugggga

SEQ ID NO: 104925 - RNA, 64 nt, hsa
uuucuauucuauuccauguuggaccaauaccacacugcccuagucacuguugcauuauaguaua

SEQ ID NO: 104926 - RNA, 64 nt, hsa
aggcccccuggccugggcacccagcugcaggccccugcccuacgugcacuacaggaagggguga

SEQ ID NO: 104927 - RNA, 64 nt, hsa
acggacaggaccccgggacagaaccccgggagcacugcccuaggagcccggaccccacgagcuc

SEQ ID NO: 104928 - RNA, 64 nt, hsa
agcaccaggccccagcucccuccgggggcccuccaggaaccaccaagcucucucacgaccuucc

SEQ ID NO: 104929 - RNA, 64 nt, hsa
ccccaaucugaaagccaugcgugucgguguauauaggaaccauguacagagcccagagaagccc

SEQ ID NO: 104930 - RNA, 64 nt, hsa
cccaucaucucagaggccccuggauguccuucgaaggaaccaggacccucagagcccagcaucc

SEQ ID NO: 104931 - RNA, 64 nt, hsa
gcaaagccuccugcuccuacccaugcuacaggccaggaaccagagcccaucaucucagaggccc

SEQ ID NO: 104932 - RNA, 64 nt, hsa
gggcagaggccaaguuccaggugucuguguucccaggaaccaaauggggagucuggggcccguu

SEQ ID NO: 104933 - RNA, 64 nt, hsa
cccacccacccccauccaggaaccgugacguccaaggaaccaaacccagacgcagaacaauaaa

SEQ ID NO: 104934 - RNA, 64 nt, hsa
auacagggaugguguucaaaaaacuuguaaauaaaggaaccauaaucaauuuucuuuucuuucu

SEQ ID NO: 104935 - RNA, 64 nt, hsa
aaauauuauauuauauauauauauauuucccugaaggaaccaaagcgaauuuuaaaagaugcaa

SEQ ID NO: 104936 - RNA, 64 nt, hsa
ggcacaugugaauuuccacaccaaacagagcaugaggaaccaguugacaugcuggguugugacu

SEQ ID NO: 104937 - RNA, 64 nt, hsa
caaaaguuuaaaacacauaugaaguucaaauuucaggaaccaaggacugccagaaaauauuagc

SEQ ID NO: 104938 - RNA, 64 nt, hsa
gggucugaucgcaaauacacuaaauguggaguguaggaaccaaaaugaaaccugcuguauggaa

SEQ ID NO: 104939 - RNA, 64 nt, hsa
uguuuuacuacuauggcacuuugauaaaauggucaggaaccaacuuuacuggcaaaagggucca

SEQ ID NO: 104940 - RNA, 64 nt, hsa
aguaacugugcacccuccaacaucccaaccccagaggaaccagugggauugaaaaccagcagaa

SEQ ID NO: 104941 - RNA, 64 nt, hsa
ugaggccuucccauggcuacagugugacccuuggaggaaccaaaggcugugcauuguuagaauu

SEQ ID NO: 104942 - RNA, 64 nt, hsa
acuuauagacccaaucagaauacggugguugagaaggaaccaguguuuacaaguaauaucagaa

SEQ ID NO: 104943 - RNA, 64 nt, hsa
gaaccaguguuuacaaguaauaucagaaaguugaaggaaccaguguuuacaaguaauaccagaa

SEQ ID NO: 104944 - RNA, 64 nt, hsa
uuuauauacuaguaucuggcuauuaguauuuuacaggaaccauaguucuuggugacuacauaua

SEQ ID NO: 104945 - RNA, 64 nt, hsa
uucucuguaccuuuauaguaccacuccaaaggcaaggaaccaugauugacaacagucaagcugu

SEQ ID NO: 104946 - RNA, 64 nt, hsa
guagccuggcgccuaggaaccagaccugaaaccaaggaaccagacccgaaaccaggccugggcc

SEQ ID NO: 104947 - RNA, 64 nt, hsa
agaagcaaaacuaaaggcagguagccuggcgccuaggaaccagaccugaaaccaaggaaccaga

SEQ ID NO: 104948 - RNA, 64 nt, hsa
cacucccuccuggagcucugugggucucuggaagaggaaccaggagaagggcuggggccggggc

SEQ ID NO: 104949 - RNA, 64 nt, hsa
gggcuuggaacccggugcucccucugucauccucaggaaccaacaauucgucggaggcaucaug

SEQ ID NO: 104950 - RNA, 64 nt, hsa
gaugagggugcccgggcuggacggcuaagggcacgaagacgauaucugguagagagggccagag

SEQ ID NO: 104951 - RNA, 64 nt, hsa
cugggucagacgccagugacagaagcugugaguggaagacgagggauugccaucgccuaugagg

SEQ ID NO: 104952 - RNA, 63 nt, hsa
aggacugacuggguucuuccucccuccccgaagcccagacaguucaguugggcuggggguugc

SEQ ID NO: 104953 - RNA, 63 nt, hsa
gacauaacugagcugaaguaauuccauaaagggcccagacagccuccuccaccauucccuuca

SEQ ID NO: 104954 - RNA, 63 nt, hsa
acccagagguaaggcugccuggcugccccaaaccccagacacuccucuccuugccugcaggcu

SEQ ID NO: 104955 - RNA, 63 nt, hsa
gcucauuauaccccaaagaccuuuuuuccacugcccagacagcuuauaccacccaguguucag

SEQ ID NO: 104956 - RNA, 63 nt, hsa
cuucccagccacugacucacaguucucuggaugcccagacaccucucuucagggaagaugagu

SEQ ID NO: 104957 - RNA, 63 nt, hsa
cuggaaaucaucacagcagugggauaucagagccccagacagcacugccucuuccuccccacc

SEQ ID NO: 104958 - RNA, 63 nt, hsa
gcuucuugugaaaccacaggcccuugggguucccccagacagagccgcaaaucaaccccagac

SEQ ID NO: 104959 - RNA, 63 nt, hsa
uuuaaauggugggaacccuccccaaaaccuuuccccagacacauucuccugugccccucagag

SEQ ID NO: 104960 - RNA, 63 nt, hsa
cccgaaguuucgauuugauuagucugggguggacccagacauguuaaguauuuuuuaaguucc

SEQ ID NO: 104961 - RNA, 63 nt, hsa
gucagacagugacuaauccagggccguggcauucccagacagcacaccacugugguccccucc

SEQ ID NO: 104962 - RNA, 63 nt, hsa
gacuguagccaucaccagaacacuuaguuucuucccagacaugaauuuccugacaggcucuga

SEQ ID NO: 104963 - RNA, 63 nt, hsa
acgguugaagaaucaagcucauaauaugauacacccagacagacccagaaaucuuuugauuuc

SEQ ID NO: 104964 - RNA, 63 nt, hsa
auagaucauaguccaauccccuagacccaaaggcccagacacgcaggguucucuauuucucuu

SEQ ID NO: 104965 - RNA, 63 nt, hsa
cagagaaggagacaccuccuggaggccccaguccccagacaguuucagccagcgcugaggaaa

SEQ ID NO: 104966 - RNA, 63 nt, hsa
aguaucuucgcagugcucuguucccuccgucuccccagacaucugacacccuaaaagccaucc

SEQ ID NO: 104967 - RNA, 63 nt, hsa
ggaggaagcgaugccgagguaggaaaggccagccccagacauccuaucgccacaaugccaugu

SEQ ID NO: 104968 - RNA, 63 nt, hsa
cuggcuguguuccugagcccccgucgugccucucccagacagcagcugucuggcccuugcugg

SEQ ID NO: 104969 - RNA, 63 nt, hsa
aaguggucacaaagaggguggcugugaggugaccccagacacugcagaacgaugugcacccuc

SEQ ID NO: 104970 - RNA, 63 nt, hsa
gcaguccccccacgcccgagaaagccugggggacccagacaccuguccccacagucaaagccu

SEQ ID NO: 104971 - RNA, 63 nt, hsa
cagacaccuguccccacagucaaagccuggggacccagacauccuguccccacagucagccuc

SEQ ID NO: 104972 - RNA, 63 nt, hsa
agacccggacagacagacacagccugaaacagacccagacaaacagacagacagacacagccu

SEQ ID NO: 104973 - RNA, 63 nt, hsa
acaaacagacagacagacacagccugaaacagacccagacagacagacagacagccugaaaca

SEQ ID NO: 104974 - RNA, 63 nt, hsa
acccagacagacagacagacagccugaaacagacccagacacagccugaaacagauccggaca

SEQ ID NO: 104975 - RNA, 63 nt, hsa
ccggacagacagacagaaacagccugaaacagacccagacagacagacagacacagccugaaa

SEQ ID NO: 104976 - RNA, 63 nt, hsa
agaccuagacagacagacacagauugaaacagacccagacaaacagacagacacagccugaaa

SEQ ID NO: 104977 - RNA, 63 nt, hsa
ccagacaaacagacagacacagccugaaacagacccagacacagccugaaacagacccggaca

SEQ ID NO: 104978 - RNA, 63 nt, hsa
ccggacagacagacagacacagccugaaacagacccagacagacagacagacacagccugaaa

SEQ ID NO: 104979 - RNA, 63 nt, hsa
ccagacagacagacagacacagccugaaacagacccagacagacagaccgacgcagccugaaa

SEQ ID NO: 104980 - RNA, 63 nt, hsa
ccagacagacagaccgacgcagccugaaagagacccagacagagagacaggcagacacagccu

SEQ ID NO: 104981 - RNA, 63 nt, hsa
cugauggcucugacaccguguugguggcgaugucccagacaaucccaccaggacggcccagac

SEQ ID NO: 104982 - RNA, 63 nt, hsa
guggcgaugucccagacaaucccaccaggacggcccagacaucccuacuggcuucgcuggugg

SEQ ID NO: 104983 - RNA, 63 nt, hsa
agcagagguuggccucccuggaggagcagguggcccagacagcccaagcccugcacuggaucg

SEQ ID NO: 104984 - RNA, 63 nt, hsa
acugucaggauaaacuccguggggguacaggagcccagacaaagcccaggccugucaagagac

SEQ ID NO: 104985 - RNA, 63 nt, hsa
uucuuggggacccaguauguccucuccucuagacccagacauacaguuauaaccgucuguccu

SEQ ID NO: 104986 - RNA, 63 nt, hsa
aucaaccagggcagauccaccgugcccugguuccccagacauuccagaaugccccacaucauu

SEQ ID NO: 104987 - RNA, 63 nt, hsa
acacacaggaacagagaaaugguugaugucagacccagacauagaauguuggagcaaaagcuc

SEQ ID NO: 104988 - RNA, 63 nt, hsa
acccguagauacagagaaguggucgauuccagacccagacauagaauguuugaacaaagacuc

SEQ ID NO: 104989 - RNA, 64 nt, hsa; identical to SEQ ID NO: 79907

SEQ ID NO: 104990 - RNA, 64 nt, hsa; identical to SEQ ID NO: 79908

SEQ ID NO: 104991 - RNA, 64 nt, hsa
uugguguugcagaagguuuacucuguggccaaaggagggucaggaaggaugagcauuuagggca

SEQ ID NO: 104992 - RNA, 64 nt, hsa
gucagcagaacugggguggauuuggguuggaagugagggucagagaggagucagagagaauccc

SEQ ID NO: 104993 - RNA, 64 nt, hsa
gaugacuucacugggagccuucuggaauccugcagagggucaaggagcagggauguuggaugcc

SEQ ID NO: 104994 - RNA, 64 nt, hsa
uucuuccucaaauauuuggggcuaacacuucacagagggucacaguccaugaucugaccaacua

SEQ ID NO: 104995 - RNA, 64 nt, hsa
gagugcuggaauggggaccugggguggggaggcagagggucacuuuacauaggauuaaguucga

SEQ ID NO: 104996 - RNA, 64 nt, hsa
cagaggugggaggccccugguggcauggaagagggagggucagugccaagucucaggaggaggg

SEQ ID NO: 104997 - RNA, 64 nt, hsa
ggcucauauuuauaaaucccacccccagaguggggagggucaggugccagaccuggacuaaacu

SEQ ID NO: 104998 - RNA, 64 nt, hsa
aagacucacaggugaccugcuaucgagauagccagagggucaggagagaaugggggaggaggcg

SEQ ID NO: 104999 - RNA, 64 nt, hsa
agugacaagaaucacauccgguuguguccugugggagggucagaggcagaaucuacuuacagug

SEQ ID NO: 105000 - RNA, 64 nt, hsa
auggcuggaauguggagcccaggugccucugguggagggucaucugcuuuuccagacugugguu

SEQ ID NO: 105001 - RNA, 64 nt, hsa
cuuuuacacaugugggucaaccacugugugcucagagggucagucccuuccucugcuguguuuu

SEQ ID NO: 105002 - RNA, 64 nt, hsa
gggcagggccuggcacagcugcagagugcacagggagggucagaagugccaagucacuggccgu

SEQ ID NO: 105003 - RNA, 64 nt, hsa
gaauguagaacacugagcaggacaacugaccugucuccuucacauaguccauaucaccacaaau

SEQ ID NO: 105004 - RNA, 64 nt, hsa
gucuugcaggacucacuggauagauguuauucgacuccuucagguuaucuugaacugccugacu

SEQ ID NO: 105005 - RNA, 64 nt, hsa
gucuugcaggacucacuggauagauguuauucaacuccuucaguuuaucuuggacugacugacu

SEQ ID NO: 105006 - RNA, 64 nt, hsa
gugaagccucucugucaucuccccuucccagccccuccuucauccccugccuccuucaccagcc

SEQ ID NO: 105007 - RNA, 64 nt, hsa
aucuccccuucccagccccuccuucauccccugccuccuucaccagccuggcuuuugccuggag

SEQ ID NO: 105008 - RNA, 54 nt, hsa; identical to SEQ ID NO: 100148

SEQ ID NO: 105009 - RNA, 64 nt, hsa
aucagggacuuugugcuaagccugaugaaaugugcuccuucaaucuccaugaaaccaucguaac

SEQ ID NO: 105010 - RNA, 64 nt, hsa
cuugaaaacacuguucucugcccuccaagaccuucuccuucaccuuuguccccaccgcagacag

SEQ ID NO: 105011 - RNA, 64 nt, hsa
uuaugggcuggguucuacccaggugcuaggaacacuccuucacagaugggugcuuggaggaagg

SEQ ID NO: 105012 - RNA, 64 nt, hsa
ucaucuagaauuuauuuuccuagcacuucaccaccuccuucaucuucuccuucaacaauaaacc

SEQ ID NO: 105013 - RNA, 64 nt, hsa
uauuuuccuagcacuucaccaccuccuucaucuucuccuucaacaauaaacccugagaucuuug

SEQ ID NO: 105014 - RNA, 64 nt, hsa
uucucuuuauaaggcaaaaagaucuguauuuacacuccuucaccuagggauguguuuguugccc

SEQ ID NO: 105015 - RNA, 64 nt, hsa
ccucagcaggacugacucugggcucuacaaccagcuccuucacauaaaggguuuagagacuccc

SEQ ID NO: 105016 - RNA, 64 nt, hsa
ucucucaaaagacuuuguuguugugugguuuuuuguuugugauuuuuuuccuuaugcaaaucau

SEQ ID NO: 105017 - RNA, 64 nt, hsa
uuacgcuaucuuguuugggaaugauguuucauagguuugugaugaucuuuacguucaggacuca

SEQ ID NO: 105018 - RNA, 64 nt, hsa
ucacauuugaggacuuuucucggguaucuugaggguuugugauccugaacccuuaaacagugcu

SEQ ID NO: 105019 - RNA, 64 nt, hsa
gcuguaaaucuggaaauuugauagacuugacuguguuugugaaaacugagcauuaaagguuuug

SEQ ID NO: 105020 - RNA, 64 nt, hsa
aaccauuucuccauggugucuuuauacuuuacugguuugugaauuuuauacaauugaaagucuu

SEQ ID NO: 105021 - RNA, 64 nt, hsa
caauauuuaauauaaauauaccauauaauauauuguuugugaauuauugagaaauguaacauuc

SEQ ID NO: 105022 - RNA, 64 nt, hsa
cagcaugaccugguguagacuuaaaaaacuacauguuugugaauauuuuauaauguggaaugau

SEQ ID NO: 105023 - RNA, 64 nt, hsa
caggaagaauagaauuguaugcuuuuuucugcauguuugugaucacugugagucucagaugauu

SEQ ID NO: 105024 - RNA, 64 nt, hsa
cuccucugacaugcggucagauaagucccgucuuguuugugaguaccacagaaacgccugagag

SEQ ID NO: 105025 - RNA, 64 nt, hsa
cugacaugaggaaugcagguucacacuguaaagaguuugugaaagguuucagucuaacuggggu

SEQ ID NO: 105026 - RNA, 64 nt, hsa
gaggaauuuguaacgaucggugugaccugaaaggguuugugauacagcggucacuauuuucucu

SEQ ID NO: 105027 - RNA, 64 nt, hsa
aaaaaaagcccacaucuuauacuccaaugaguguguuugugaguuuuuauccuguuugaauuuu

SEQ ID NO: 105028 - RNA, 64 nt, hsa
aaucgcugucucucugucucuuugcuuuguaucuguuugugaguugauccuggcuucucucucu

SEQ ID NO: 105029 - RNA, 64 nt, hsa
gcucaguuuuuacagacuguaaaggagauguguuguuugugaagauggagcagagucaaaucug

SEQ ID NO: 105030 - RNA, 64 nt, hsa
aauucacacuggagaaaagccauagaaauguaagguuugugacaaggcuuucgggaaugauuca

SEQ ID NO: 105031 - RNA, 64 nt, hsa
aauucacauugaagagaaaccauacagagguaagguuugugacaagguuuuugcauauaaugca

SEQ ID NO: 105032 - RNA, 64 nt, hsa
acuccucacccccuugcuccccuggucuucuggaguuugugacauugauuugaaauggauggug

SEQ ID NO: 105033 - RNA, 64 nt, hsa
aguuuucuaacauagcuauaagguccuuguugcuguuugugauaacugauagauaacucauugg

SEQ ID NO: 105034 - RNA, 64 nt, hsa
cugggugggcaggggccucaugacaagcgacaaguguacccagaguagaaggccuuccccacuc

SEQ ID NO: 105035 - RNA, 64 nt, hsa
agaaaauaccuuauuaucugcagggacucaaagcuguacccaaaucaagaaagacaaaauaaca

SEQ ID NO: 105036 - RNA, 64 nt, hsa
uguuuucauaaauaacguuuuauuggagcauagcuguacccauuuguuuacauauuggcuaugg

SEQ ID NO: 105037 - RNA, 64 nt, hsa
aucucauguaucccauaaauauauacaccuaccauguacccauaaaaauuuaaaaagaaaugga

SEQ ID NO: 105038 - RNA, 64 nt, hsa
gcgcaugcuugcccuauuaaaggcagcugacagcuguacccacuagcuaacgugucucuggugg

SEQ ID NO: 105039 - RNA, 64 nt, hsa
guacauguauuaguuccuuuacugcugaccacauuguacccauuucacagagaaggagcagaga

SEQ ID NO: 105040 - RNA, 64 nt, hsa
uaugggaauuauuccucagaagagaauuuaaagguguacccauauauaucucuuucuggaguau

SEQ ID NO: 105041 - RNA, 64 nt, hsa
uuggucuucuuucaaauuguuuguaugaagaugcuguacccacuugaacaguccucagguguuu

SEQ ID NO: 105042 - RNA, 64 nt, hsa
agaacaaaguuaaaauuaaaaagucuuuauccaagucaccaaugaaacaggauucugauucauu

SEQ ID NO: 105043 - RNA, 64 nt, hsa
caagugguuuuuccuaauuccagaggaacuggacgucaccaaacaagguugcauuuuacuuuug

SEQ ID NO: 105044 - RNA, 64 nt, hsa
uccaugguccccagucuccccuccacuugguggggucaccaacuacucaccagaagggggcuua

SEQ ID NO: 105045 - RNA, 64 nt, hsa
gagaggguuuugccauguuugcuuguaugaccaagucaccaaggaaauaaacaggaaggaaauc

SEQ ID NO: 105046 - RNA, 64 nt, hsa
ccaauuuucaucuaaaagguuauauucuaguugugucaccaaaucaucaaaaaaccuuaaaaaa

SEQ ID NO: 105047 - RNA, 64 nt, hsa
uuuaauuuuggaauuuagaauguguauuugcaaagucaccaauuuucaucuaaaagguuauauu

SEQ ID NO: 105048 - RNA, 64 nt, hsa
cuaguuaugcagagcaguugccuugggucccacugucaccaaggcaaccaguccugcugcuacc

SEQ ID NO: 105049 - RNA, 64 nt, hsa
acccacccuguccucugacgucccuuucccaacugucaccaaacagaccaucuucccaggccug

SEQ ID NO: 105050 - RNA, 64 nt, hsa
uuaauuugauguuuaccuaagccuuuaaggcugugucaccaagguauggccacaaggaagaaua

SEQ ID NO: 105051 - RNA, 64 nt, hsa
aauuccaauaauuagggaaaauugauaaauaucugucaccaaaccacaagaaauccaaaaucau

SEQ ID NO: 105052 - RNA, 64 nt, hsa
caucuaaguaacauuugcacaugauacagcaaaaggaguucauugcaauacugucuuuggauau

SEQ ID NO: 105053 - RNA, 64 nt, hsa
uggacguaagacaaacacgugcucguccuuuaauggaguucaccagcacacuuguuaaccaguc

SEQ ID NO: 105054 - RNA, 64 nt, hsa
ugggaggccaaggcaggcagaucaccugaagucaggaguucaagaccauccuggccaacacagu

SEQ ID NO: 105055 - RNA, 64 nt, hsa
ccaccuccccaugggcccaaggaugcgccucucuggaguucacgugcugcacccccagggaggg

SEQ ID NO: 105056 - RNA, 64 nt, hsa
uaggaggccgaggcaggcggauugccugagcucaggaguucaagaucagucugggcaacacgau

SEQ ID NO: 105057 - RNA, 64 nt, hsa
uugggaggccaaggcaggcggaucccugaguucgggaguucaagaccagccugaccaacacgga

SEQ ID NO: 105058 - RNA, 64 nt, hsa
ugggaggcugaggcgggcagaucgcuugaggucaggaguucaagaccagcccgggcaacguggu

SEQ ID NO: 105059 - RNA, 64 nt, hsa
ugggaggccgagucagguggaucaccugaggucaggaguucaagaccagccuggccaacauggc

SEQ ID NO: 105060 - RNA, 64 nt, hsa
ugggaggccaaagcaggaggaucgcuugagcccaggaguucaagaccaaccuggugaaaccccg

SEQ ID NO: 105061 - RNA, 64 nt, hsa
auucuucauuuaccuaguauuaugaaagaaugaaggaguucaaacaaauguguuucccaguuaa

SEQ ID NO: 105062 - RNA, 64 nt, hsa
ugggaggcugaggcaggaggaucacuugaggucaggaguucaauguggacaacacaguaagacc

SEQ ID NO: 105063 - RNA, 64 nt, hsa
ugggagguugagguaggaggaucgcuugaacccaggaguucaagucugcagugagcuaugauug

SEQ ID NO: 105064 - RNA, 64 nt, hsa
gcuggcuggugaaaaguggggagcugacagccuuggaguucagugcuuccccagggcuacgaag

SEQ ID NO: 105065 - RNA, 64 nt, hsa
acggggagcgaggcugguuuccugugcagcagguggaguucauuuccaacccagagguccgugc

SEQ ID NO: 105066 - RNA, 64 nt, hsa
ugggaggcaggggcggguggaucaccugaggucaggaguucaagacuagccuggccaacauggu

SEQ ID NO: 105067 - RNA, 64 nt, hsa
ugagaggcugaggugguaggaucaccugaggucaggaguucaagaccagccuguccaacauggu

SEQ ID NO: 105068 - RNA, 64 nt, hsa
uaccuuuuaagaaugagaaacugcugggcuuaagggaguucaguaugaaucaagauugaaccau

SEQ ID NO: 105069 - RNA, 64 nt, hsa
gaaacacugcagcgaucuuaauuuuguuagauuuggaguucaauaaauggaguauccugaguug

SEQ ID NO: 105070 - RNA, 64 nt, hsa
ccucugacaugagaaugaaaccaggaauggacuuggaguucaacaggcugagaggaugccucca

SEQ ID NO: 105071 - RNA, 64 nt, hsa
uucuugaccguucuugggcacuggaggcuggcuaggaguucaguaauaaacguggccuucgugc

SEQ ID NO: 105072 - RNA, 64 nt, hsa
uaggaguccaaggcgggcggaucacuugaggucaggaguucaagaccagcuuggccaaggugau

SEQ ID NO: 105073 - RNA, 64 nt, hsa
ugggaggcugaggcgggcagaucacuugaggccaggaguucaagaccagcccaaccaacauggu

SEQ ID NO: 105074 - RNA, 64 nt, hsa
ugggaggcugaggugggaagauucuuugagcccaggaguucaaggcugcagugaauucugaucg

SEQ ID NO: 105075 - RNA, 64 nt, hsa
aauuauaucaccuguguucugaacuaaaaugaugggaguucauuuuguauuuacuuugcaguaa

SEQ ID NO: 105076 - RNA, 64 nt, hsa
ugggaggcuaaggcagcuggaucacuugaggccaggaguucaagaccagccuggcaaacauggu

SEQ ID NO: 105077 - RNA, 64 nt, hsa
cgggaggccaaggugagaggauaacuugaaacuaggaguucaagaccagccaaggcaacauagu

SEQ ID NO: 105078 - RNA, 64 nt, hsa
ugagacgcugaggugggaggaucacuugagcccaggaguucaaaaccagccugggcaauauagu

SEQ ID NO: 105079 - RNA, 64 nt, hsa
ugggaggcuaaggugggcggaucaccugaugucaggaguucaagaccagccuggccaacauggu

SEQ ID NO: 105080 - RNA, 64 nt, hsa
aucccagcacugagaggccgaucacuugaggucaggaguucaagaccagccuggccaacauggu

SEQ ID NO: 105081 - RNA, 64 nt, hsa
ugggaggccaagguggguggaucacuugaggccaggaguucaagaccagccuggccaacaugau

SEQ ID NO: 105082 - RNA, 64 nt, hsa
uaagaggccaaggcggauggaucacuugagcccaggaguucaacaccagccugagcaacauggu

SEQ ID NO: 105083 - RNA, 64 nt, hsa
uggaaggccgaggugggcagaucaucugaggccaggaguucaagaccagccuggcuaacauggu

SEQ ID NO: 105084 - RNA, 64 nt, hsa
ggggaggccaaggcaggaggcuugcuugaggcaaggaguucaaggcuacagugagcuaugauug

SEQ ID NO: 105085 - RNA, 64 nt, hsa
uggcaggcugaggcgggcagaucaccugagaucaggaguucaagaucagccugaccaacaugga

SEQ ID NO: 105086 - RNA, 64 nt, hsa
uuugugcuggguaaaagaggagagcugugcuuucuaccccaaaguuguugguaauggagccggu

SEQ ID NO: 105087 - RNA, 64 nt, hsa
gaaaacauguuuaagauaaaauacaaacuuuaccuaccccaaauucauaaaguacauuuagugc

SEQ ID NO: 105088 - RNA, 64 nt, hsa
caggagguguaaaaauaaacaguguucucuucucuaccccaaagccacuacugaccaaggucuc

SEQ ID NO: 105089 - RNA, 64 nt, hsa
ucugagaauggcuaugaagcgucauuucacauuuuaccccaacugaccugcaugcccaggacac

SEQ ID NO: 105090 - RNA, 64 nt, hsa; identical to SEQ ID NO: 75208

SEQ ID NO: 105091 - RNA, 64 nt, hsa; identical to SEQ ID NO: 75209

SEQ ID NO: 105092 - RNA, 64 nt, hsa; identical to SEQ ID NO: 75210

SEQ ID NO: 105093 - RNA, 64 nt, hsa; identical to SEQ ID NO: 75211

SEQ ID NO: 105094 - RNA, 64 nt, hsa; identical to SEQ ID NO: 75212

SEQ ID NO: 105095 - RNA, 64 nt, hsa; identical to SEQ ID NO: 75213

SEQ ID NO: 105096 - RNA, 64 nt, hsa; identical to SEQ ID NO: 75214

SEQ ID NO: 105097 - RNA, 64 nt, hsa; identical to SEQ ID NO: 75215

SEQ ID NO: 105098 - RNA, 64 nt, hsa; identical to SEQ ID NO: 75216

SEQ ID NO: 105099 - RNA, 64 nt, hsa; identical to SEQ ID NO: 75217

SEQ ID NO: 105100 - RNA, 64 nt, hsa; identical to SEQ ID NO: 75218

SEQ ID NO: 105101 - RNA, 64 nt, hsa; identical to SEQ ID NO: 75219

SEQ ID NO: 105102 - RNA, 64 nt, hsa; identical to SEQ ID NO: 75220

SEQ ID NO: 105103 - RNA, 64 nt, hsa; identical to SEQ ID NO: 75221

SEQ ID NO: 105104 - RNA, 64 nt, hsa; identical to SEQ ID NO: 75222

SEQ ID NO: 105105 - RNA, 60 nt, hsa; identical to SEQ ID NO: 75223

SEQ ID NO: 105106 - RNA, 64 nt, hsa; identical to SEQ ID NO: 75224

SEQ ID NO: 105107 - RNA, 64 nt, hsa; identical to SEQ ID NO: 75225

SEQ ID NO: 105108 - RNA, 64 nt, hsa; identical to SEQ ID NO: 75226

SEQ ID NO: 105109 - RNA, 64 nt, hsa; identical to SEQ ID NO: 75227

SEQ ID NO: 105110 - RNA, 64 nt, hsa; identical to SEQ ID NO: 75228

SEQ ID NO: 105111 - RNA, 64 nt, hsa; identical to SEQ ID NO: 75229

SEQ ID NO: 105112 - RNA, 64 nt, hsa; identical to SEQ ID NO: 75230

SEQ ID NO: 105113 - RNA, 64 nt, hsa; identical to SEQ ID NO: 75231

SEQ ID NO: 105114 - RNA, 64 nt, hsa; identical to SEQ ID NO: 75232

SEQ ID NO: 105115 - RNA, 64 nt, hsa; identical to SEQ ID NO: 75233

SEQ ID NO: 105116 - RNA, 64 nt, hsa; identical to SEQ ID NO: 75234

SEQ ID NO: 105117 - RNA, 64 nt, hsa; identical to SEQ ID NO: 75235

SEQ ID NO: 105118 - RNA, 64 nt, hsa; identical to SEQ ID NO: 75236

SEQ ID NO: 105119 - RNA, 64 nt, hsa; identical to SEQ ID NO: 75237

SEQ ID NO: 105120 - RNA, 64 nt, hsa; identical to SEQ ID NO: 75238

SEQ ID NO: 105121 - RNA, 64 nt, hsa; identical to SEQ ID NO: 75239

SEQ ID NO: 105122 - RNA, 64 nt, hsa; identical to SEQ ID NO: 75240

SEQ ID NO: 105123 - RNA, 64 nt, hsa; identical to SEQ ID NO: 75241

SEQ ID NO: 105124 - RNA, 64 nt, hsa; identical to SEQ ID NO: 75242

SEQ ID NO: 105125 - RNA, 64 nt, hsa; identical to SEQ ID NO: 75243

SEQ ID NO: 105126 - RNA, 64 nt, hsa; identical to SEQ ID NO: 75244

SEQ ID NO: 105127 - RNA, 64 nt, hsa; identical to SEQ ID NO: 75245

SEQ ID NO: 105128 - RNA, 64 nt, hsa; identical to SEQ ID NO: 75246

SEQ ID NO: 105129 - RNA, 51 nt, hsa; identical to SEQ ID NO: 45449

SEQ ID NO: 105130 - RNA, 64 nt, hsa; identical to SEQ ID NO: 45450

SEQ ID NO: 105131 - RNA, 64 nt, hsa; identical to SEQ ID NO: 45451

SEQ ID NO: 105132 - RNA, 64 nt, hsa; identical to SEQ ID NO: 45452

SEQ ID NO: 105133 - RNA, 64 nt, hsa; identical to SEQ ID NO: 45453

SEQ ID NO: 105134 - RNA, 64 nt, hsa; identical to SEQ ID NO: 45454

SEQ ID NO: 105135 - RNA, 64 nt, hsa; identical to SEQ ID NO: 45455

SEQ ID NO: 105136 - RNA, 64 nt, hsa; identical to SEQ ID NO: 45456

SEQ ID NO: 105137 - RNA, 64 nt, hsa; identical to SEQ ID NO: 45457

SEQ ID NO: 105138 - RNA, 64 nt, hsa; identical to SEQ ID NO: 45458

SEQ ID NO: 105139 - RNA, 64 nt, hsa; identical to SEQ ID NO: 45459

SEQ ID NO: 105140 - RNA, 64 nt, hsa; identical to SEQ ID NO: 45460

SEQ ID NO: 105141 - RNA, 56 nt, hsa
ccucccuguccaagaagugacuguugagaggcgaggagguagugggugaggcuacc

SEQ ID NO: 105142 - RNA, 64 nt, hsa
guguguguguggauguguguuuugggguacggggagaggcgaugcuauuggccaucacuaccaa

SEQ ID NO: 105143 - RNA, 64 nt, hsa
acauacaccccagccgcacagaugcgugugacccagaggcgagacgcagcuuuguccugggaga

SEQ ID NO: 105144 - RNA, 64 nt, hsa
cuuucccggaacccuccucucgccuggacccaagagaggcgacagcuguggcuggggcucuugg

SEQ ID NO: 105145 - RNA, 64 nt, hsa
auguucagaguguugaugagaagacccuauacucagaggcgacaaguaagaagcuggucuuauc

SEQ ID NO: 105146 - RNA, 64 nt, hsa
cuccaauuccacagucucugggagacuuucccuaagaggcgacuuccucuccagccuucucucu

SEQ ID NO: 105147 - RNA, 64 nt, hsa
ccagugaggucccaaaugacccagggcuuaagggagaggcgagagaaugaucuggccucagggg

SEQ ID NO: 105148 - RNA, 64 nt, hsa
ggcccaucucugcugaccuggguguggcggagggagaggcgaugcugcaaaguguuuucugugu

SEQ ID NO: 105149 - RNA, 64 nt, hsa
ccacugucugcuuagcccagcucagggguggggaagaggcgaaagcgugggggaggugagcgca

SEQ ID NO: 105150 - RNA, 64 nt, hsa
cauaagaggaggccaaaaguuaaacguucuaaaaagaggcgaaaggaagcaagcaguucagaag

SEQ ID NO: 105151 - RNA, 64 nt, hsa
uuacagcagcagggaggcccagcagcccacuggcagaggcgagagcucugggauggcaaggcgg

SEQ ID NO: 105152 - RNA, 64 nt, hsa
aggggagucugggugcaucagauuggggggcgccagaggcgaggcugccuggcucccuuucuca

SEQ ID NO: 105153 - RNA, 64 nt, hsa
acgggggaccucggagcugcucuaaggcgccugcagaggcgagcagagcccgcagcccacgccu

SEQ ID NO: 105154 - RNA, 64 nt, hsa
ugagacgaggcaggggcucugcuuccucagcccuagaggcgagccaggcaagguuggcgacugu

SEQ ID NO: 105155 - RNA, 64 nt, hsa
uccuuaacccuacacccuuuagcuggaugcugucagaggcgauggagaaacgcaaaggugcguu

SEQ ID NO: 105156 - RNA, 64 nt, hsa
gacaccuuauagugacuuagagaagaagaugcaaagaggcgaacgcucgcccagagcaagaaau

SEQ ID NO: 105157 - RNA, 64 nt, hsa
auaugauaguauaaaaaaugguuaaugacaauucagaggcgaggagauucuguaaacuuaaaau

SEQ ID NO: 105158 - RNA, 64 nt, hsa
aggaccccuagacugcucgcuaguggaacacgacagaggcgaaauccugccccgucucccgugg

SEQ ID NO: 105159 - RNA, 64 nt, hsa
aaauaugguguagaaauucuugugaaauauugcaagaggcgaguuuaaaauucugcagauggcc

SEQ ID NO: 105160 - RNA, 64 nt, hsa
acccuaauucaauaugacugaugaucauaaaagaagaggcgaguagggcacaacaggcacaaag

SEQ ID NO: 105161 - RNA, 64 nt, hsa
acaccacggucgacgacggcuggagggacguuucagaggcgaguccuggguggcuccucgccuu

SEQ ID NO: 105162 - RNA, 64 nt, hsa
uuuuucuuaccacuuaauagaagaaccugucccuagaggcgacuucauugcuauggaucuggag

SEQ ID NO: 105163 - RNA, 64 nt, hsa
ccuugcuagcucagcgggcggcuugucccuaggaagaggcgauucaacacaccauuggaauuuu

SEQ ID NO: 105164 - RNA, 64 nt, hsa
cgugaggaggucgaggcgcacagggcaagcaggaagaggcgagggcacuugggggucauuauuu

SEQ ID NO: 105165 - RNA, 64 nt, hsa
gccuccccucugcccagccccuguggccucuuggagaggcgagccagggggcuccccggaccgc

SEQ ID NO: 105166 - RNA, 64 nt, hsa
ccggcugagacgcucgccccgacgcauggacccgagaggcgacgacacgagugaauaaagugca

SEQ ID NO: 105167 - RNA, 64 nt, hsa
uggcugaggcuuggagcaucuccucagacagagcagaggcgacaccucuucaggggugugugga

SEQ ID NO: 105168 - RNA, 64 nt, hsa
cgcccugucccucucuggucaaacaacauacuaaagaggcgaggcaaugacuguuggccaguuc

SEQ ID NO: 105169 - RNA, 64 nt, hsa
gcugcggaaucuucuuacuaagcuugaagaguggagaggcgagaggugagcuacuuugugagcc

SEQ ID NO: 105170 - RNA, 64 nt, hsa
cgggaaagccagggccccugccugcagguuagaaagaggcgagcguggauugucacagcugcgg

SEQ ID NO: 105171 - RNA, 64 nt, hsa
acguccuaagcagaguuaauccuggcugcucaggagaggcgacacauuucaaaucuccacgaga

SEQ ID NO: 105172 - RNA, 64 nt, hsa
ugccaccagccugcagcacaccccacagccaaguagaggcgaaagcaguggcucauccuaccug

SEQ ID NO: 105173 - RNA, 64 nt, hsa
aacuaccuuuuacaaauguuacaaaauguauuuuagaggcgacaucucucaagaugaccugagu

SEQ ID NO: 105174 - RNA, 64 nt, hsa
gcaagauagcacacagaaguuggcugcgucaaguagaggcgacauuuauuaagugaaaaucaug

SEQ ID NO: 105175 - RNA, 64 nt, hsa
cucaccucacaggagggccaggcauguauuccucagaggcgaaacugccaaacucuuucuccug

SEQ ID NO: 105176 - RNA, 64 nt, hsa
caguuagaugauucacuuuuugccccuagggaugagaggcgaaagccacuucucauacaagccc

SEQ ID NO: 105177 - RNA, 64 nt, hsa
gacugcaugcugaugagcaaggcaggcaggucugagaggcgaaacgaaucucccggcagugcuu

SEQ ID NO: 105178 - RNA, 64 nt, hsa
gcaguucccuccgcagaacaccccaugcgugcugagaggcgagcuccuugaagaaggggcuguu

SEQ ID NO: 105179 - RNA, 64 nt, hsa
ccacuguggcaucuccguccugcccaccuucuuaagaggcgagauggagcaggcccaucugccu

SEQ ID NO: 105180 - RNA, 64 nt, hsa
uacuucaugaucaugaauuccaguuaauuuauaaagaggcgauuuuugugugccauucacacug

SEQ ID NO: 105181 - RNA, 64 nt, hsa
aauccuuacagguaaguauugcuuccgccacugcagaggcgaaagccagugcuuugguaaaggu

SEQ ID NO: 105182 - RNA, 64 nt, hsa
ucugggguguccccccacacccugcuuuggccccagaggcgagggaccaguggaggugccaggg

SEQ ID NO: 105183 - RNA, 64 nt, hsa
uugcucgaggggacaaaaaagucaaaacgaggcgagaggcgaagcccacuuuuguauaccggcc

SEQ ID NO: 105184 - RNA, 64 nt, hsa
uauaagcagcagauuuugugggaggaaacacuugagaggcgauauugucaacaguauuugaagg

SEQ ID NO: 105185 - RNA, 64 nt, hsa
uggacucuaguccuuggcuggacuguagaaggugagaggcgagucacccuccucacagaccucu

SEQ ID NO: 105186 - RNA, 64 nt, hsa
ugggcaccaugggccaaaauuuuguguccagggaagaggcgagaagugcaaccugcauuucacu

SEQ ID NO: 105187 - RNA, 64 nt, hsa
aggcccugaggaccgcgcugaagcaccggacucuagaggcgaggccuccaagggcacagaccug

SEQ ID NO: 105188 - RNA, 64 nt, hsa
aauguuccaggaccaaagacuugauggaggggcuagaggcgacccuuguuguaaaaggcgauca

SEQ ID NO: 105189 - RNA, 64 nt, hsa
gcaccaccacagcuggcuaauucuauuuuuuuauagaggcgaagucucacuaugucgccaggcu

SEQ ID NO: 105190 - RNA, 64 nt, hsa
gcuggggagucgugaacgggacucaggugugggaagaggcgagagggcuguggaggagcucgca

SEQ ID NO: 105191 - RNA, 64 nt, hsa
cugucccugcugcagcgccaggacccccggagguagaggcgagaguggaggcucuucuucugcc

SEQ ID NO: 105192 - RNA, 64 nt, hsa
aaaaaaaaaaauuuaaaguuaaaugauaagucuuagaggcgagugaggaauaaaauggauguaa

SEQ ID NO: 105193 - RNA, 64 nt, hsa
ccaggcaacaguggccucugggagggggucaggaagaggcgaacagcucaggcagcgcaggugu

SEQ ID NO: 105194 - RNA, 64 nt, hsa
ugagucagguggcacugaaagccauggguucugaagaggcgaauuuguugaaaagucccaaggg

SEQ ID NO: 105195 - RNA, 64 nt, hsa
uuucugucccucgugaagucacgucacacaggggagaggcgaggucgauggaacuggccacgca

SEQ ID NO: 105196 - RNA, 64 nt, hsa
ccuuuggcacagaggcugaguggacagucaggagagaggcgagaggcaaggcgaagccuguguc

SEQ ID NO: 105197 - RNA, 64 nt, hsa
ggcaccuggguccaucagagaaggugcaggugacagaggcgaaggcagauggggcacugaccca

SEQ ID NO: 105198 - RNA, 64 nt, hsa
cagguggacguagaguuggccuuuuuacaggcaaagaggcgaauuguagaauuguuagauggca

SEQ ID NO: 105199 - RNA, 64 nt, hsa
agguagucugccacggauccagagcacggcacucagaggcgagaaacuccaucgaguguuccau

SEQ ID NO: 105200 - RNA, 64 nt, hsa
guguggucccuggagccuacaaguggucuggguuagaggcgagccuggcaggcagcacagacug

SEQ ID NO: 105201 - RNA, 64 nt, hsa
cuugcacuuuugcauuugccuaacagacuuuugcagaggcgauggcagagagcagcugcaggca

SEQ ID NO: 105202 - RNA, 64 nt, hsa
uggauucuguauccaugggauuggguguucauccagaggcgacuggguaaauuaggaagaggug

SEQ ID NO: 105203 - RNA, 64 nt, hsa
agucacuuugaggugucucaaucugaucugagugagaggcgacaggaguauuuuuuuuuuuuua

SEQ ID NO: 105204 - RNA, 64 nt, hsa
caaccaaagugcaggacaucaaaaacaaccugaaagaggcgauugaaguacgugcuggcuccuu

SEQ ID NO: 105205 - RNA, 64 nt, hsa
ggaaaggagagggacucuggcgucccggcaggcgagaggcgaggcugagcgaaagaaggaagga

SEQ ID NO: 105206 - RNA, 64 nt, hsa
aaagccuugucacuuuggacguuugcgucuuugaagaggcgaugggagcauaucaugacugccu

SEQ ID NO: 105207 - RNA, 64 nt, hsa
gaaugauucaggguaaaucacauacuuuguuuagagaggcgagggguuuaaccgagucacccag

SEQ ID NO: 105208 - RNA, 64 nt, hsa
agggagagggagucuggccccagcuuuuccuaucagaggcgauuuuccuucaccaggggauggg

SEQ ID NO: 105209 - RNA, 64 nt, hsa
uugggccgccucuccuccaucuucuggcaaggacagaggcgaggggacagcccagcgccauccu

SEQ ID NO: 105210 - RNA, 64 nt, hsa
cgguggccagagccagccagcauggccacccucaagaggcgagaugagcccacagaggcauauc

SEQ ID NO: 105211 - RNA, 64 nt, hsa
gcucagggcgggcagccuauggugaagaggagacagaggcgaugggcgugcuucguccuccgua

SEQ ID NO: 105212 - RNA, 64 nt, hsa
cgccaccacaccagcuaauuuuuguauuuuuaguagaggcgaaguuuccccauguuggccaggc

SEQ ID NO: 105213 - RNA, 64 nt, hsa
uuagauuuggaggggcuggggugggcagagagcaagaggcgaguaaagagaauggugguuucag

SEQ ID NO: 105214 - RNA, 64 nt, hsa
auugcuaugcaaucuugaauauuuucucuuuugccucguaaaaugaaaaugcauucacaguuuc

SEQ ID NO: 105215 - RNA, 64 nt, hsa
uucacuuuggccuagauuuaugaaaaaugcaugccucguaaagaguccacuguauucacgagua

SEQ ID NO: 105216 - RNA, 64 nt, hsa
auuuuaauaugaaagauccucaugaauuaaauaguugaugcaauuuuuaacguuaauugauaua

SEQ ID NO: 105217 - RNA, 64 nt, hsa
uggugguggggagggaaggccuccugaauugaguuugaugcagagcuuuuuagccaugaagaau

SEQ ID NO: 105218 - RNA, 64 nt, hsa
agcuagcucuugagcauuagucacuaccuucagcuugaugcauggucacuucuuuacuauuuaa

SEQ ID NO: 105219 - RNA, 64 nt, hsa
uagugguauucuguuuacagauguauuaggaccauugaugcauuacauuuaagaauucucuuua

SEQ ID NO: 105220 - RNA, 64 nt, hsa
ggcaugccagucuuauaauuaacauaauuuaaauuugaugcaauuuaaauauaacaggagacuu

SEQ ID NO: 105221 - RNA, 64 nt, hsa
acagagaaucuuaagagcuguuagaaaguagcacuugaugcaagggauguuuugaaaagaaaaa

SEQ ID NO: 105222 - RNA, 64 nt, hsa
cauuuggguugggguucacucuuaccaagaaucuuugaugcagcuuuaagaugguggggaggau

SEQ ID NO: 105223 - RNA, 64 nt, hsa
uauaagaaguagaaagucauugaacugacaguguuugaugcaacuaaaagaggauuguaagaca

SEQ ID NO: 105224 - RNA, 64 nt, hsa
ggcgcuuucaguauuuugccauuaagcauaguauuugaugcagguuuuuuuugauugaugcagg

SEQ ID NO: 105225 - RNA, 64 nt, hsa
auuaagcauaguauuugaugcagguuuuuuuugauugaugcaggggaucaaauuuaggaaguuc

SEQ ID NO: 105226 - RNA, 64 nt, hsa
ggcaugaaaaucugacuuugcccagcucuuuuccuugaugcaguuucccgguguggaaggaacc

SEQ ID NO: 105227 - RNA, 64 nt, hsa
ucaucagauucaucuccacugauaaccgguuuccuugaugcagacauaguuuagcuuucuuuga

SEQ ID NO: 105228 - RNA, 64 nt, hsa
uuuuuuuggucaagcuugaggcugaauaaagccuuugaugcacaaaaugggacugcugaagagu

SEQ ID NO: 105229 - RNA, 64 nt, hsa
acaguguaaaguuaaucagaaagaaaaaauuuuauugaugcagugugucuuuauaaagcuguuc

SEQ ID NO: 105230 - RNA, 64 nt, hsa
gagagaaaaugagugaauauucuucucacuuuuauugaugcauucagagaauaagcaaugaaau

SEQ ID NO: 105231 - RNA, 64 nt, hsa
uuuuuaauauuucuauugcaaaagucuauccgauuugaugcacuuugaauauugagauauuuug

SEQ ID NO: 105232 - RNA, 64 nt, hsa
cuuuccuuuuguaauaagaaagaagagagagaacuugaugcaaaguccacgaaaaaacaauuuu

SEQ ID NO: 105233 - RNA, 64 nt, hsa
uugccagagauaccuguuuugaugaguaccuauuuugaugcaaaggaacggcccugggaccuca

SEQ ID NO: 105234 - RNA, 64 nt, hsa
cccacgaccggagugcuggcucucacagugaauuuugaugcauuuaaaauaagauucugaugcc

SEQ ID NO: 105235 - RNA, 64 nt, hsa
caggcgcugguucugaagcaccgauggaaacagauugaugcagauggaaggaggaagggagacu

SEQ ID NO: 105236 - RNA, 64 nt, hsa
uccucugggaagcagauaagcauagaacugauacuugaugcacacucguagugguaacucaucc

SEQ ID NO: 105237 - RNA, 64 nt, hsa
acuuccaccauaaugcaguuaccuguaggcauaauugaugcacaugauguucacacagugagag

SEQ ID NO: 105238 - RNA, 64 nt, hsa
ucucuuuuugccauggcuaaucccugcauuuccauucagggaaaaggugguagugagcauagaa

SEQ ID NO: 105239 - RNA, 64 nt, hsa
agagauggcugccuggacuggaaucaaaucuaauuucagggaaaugaagauggaauuugaaggu

SEQ ID NO: 105240 - RNA, 64 nt, hsa
uggccuugucuuucuggggaggagggaauguacauucagggaguagccuuuugcggaaaaauuc

SEQ ID NO: 105241 - RNA, 64 nt, hsa
cauucuggcuuuguccauaacaaugcucugggauuucagggaguucccucauuuguaaaaugag

SEQ ID NO: 105242 - RNA, 64 nt, hsa
ucuagaaaccaguauggaagggagggguccugauuucagggaaauggaggguggggccggguga

SEQ ID NO: 105243 - RNA, 64 nt, hsa
gcucagcaaggugugaaugaccuuaguccgcaaguucagggaagcaggcagagcggggaggugc

SEQ ID NO: 105244 - RNA, 64 nt, hsa
accuagucauuaaugaguaagauacuccuguuaguucagggaccaaguuuuaugacccagaggc

SEQ ID NO: 105245 - RNA, 64 nt, hsa
aacaguuugugacagaaaaugcaguguuucauuuuucagggauaaaugcuaagauaaaauugcu

SEQ ID NO: 105246 - RNA, 64 nt, hsa
gaaucuugaagaaaaaucuuuugguggaggugccuucagggaaaguuuucuucacccucacucu

SEQ ID NO: 105247 - RNA, 64 nt, hsa
uagcagagccccucuuaucuugagaacuccauucuucagggaaaggaucucccuagcucagaga

SEQ ID NO: 105248 - RNA, 64 nt, hsa
uuggaagaaguaaacauggcuagaaagaaccacguucagggaaugacguugugcccagccuuuu

SEQ ID NO: 105249 - RNA, 64 nt, hsa
aaccaguucuacuaaugcuucacuccuggcucuguucagggaggcugcccaggaggaagacugg

SEQ ID NO: 105250 - RNA, 64 nt, hsa
caacaugaauucgcaccuuacaugacagaagugauucagggauuccuaugaauagaaaugcuga

SEQ ID NO: 105251 - RNA, 64 nt, hsa
gggccuccaacaggcaaauucagggaggauagguuucagggaauauaaauuuauuuaauauuag

SEQ ID NO: 105252 - RNA, 64 nt, hsa
ucagugggaaaacuaagggccuccaacaggcaaauucagggaggauagguuucagggaauauaa

SEQ ID NO: 105253 - RNA, 64 nt, hsa
ggagggggacauuuuuuggggggcagggacuguguucagggaaaguaccugaccaacagaacuu

SEQ ID NO: 105254 - RNA, 64 nt, hsa
gcucuccaggagauuucaauccaggcuaucuguguucagggaaugauuugcaagaaguugguuu

SEQ ID NO: 105255 - RNA, 64 nt, hsa
ccaugaguggggcuggcaucuugccagccugggcuucagggauguuuggggggggugguuagag

SEQ ID NO: 105256 - RNA, 64 nt, hsa
ucaagggcuucagccccaugcuggucccuugguguucagggagggucacuuggaccgcuguuca

SEQ ID NO: 105257 - RNA, 64 nt, hsa
ccacguguuuuuccauccaaucacacugcugugauucagggaucuuucuucuaagacggacaca

SEQ ID NO: 105258 - RNA, 64 nt, hsa
aacaacaacgacaaaaaauagacuguuuuaaaguuucagggaaaguugguggcugauuuaaagu

SEQ ID NO: 105259 - RNA, 64 nt, hsa
aaaaugcuuuguuugcccuuugcuucugcuuuuuuucagggaagcugccaaagaaugucgacgu

SEQ ID NO: 105260 - RNA, 64 nt, hsa
aucuauguuucaucuuguuuuuauaauaaaaagcuucagggaacaagcccaaagcccucaccac

SEQ ID NO: 105261 - RNA, 64 nt, hsa
cuaccugccagguucaguucuuuuaaggugccucuucagggacacagugugucucucugauugg

SEQ ID NO: 105262 - RNA, 64 nt, hsa
agcuaagcucgggaucauuuccauaagucugcuuuucagggauucucugcuggugcuggugcaa

SEQ ID NO: 105263 - RNA, 64 nt, hsa
uauagagagaaagauaacuuauuguguguuugauuucagggagagagauuuucuuuggucaucc

SEQ ID NO: 105264 - RNA, 64 nt, hsa
uggccauuccguucaaauccuagaucguuacagcuucagggaauucauauuuuguuauguguag

SEQ ID NO: 105265 - RNA, 64 nt, hsa
auuuucuugugcuucagcuacuagaaagguuuaauucagggauaagucccaauugaguaguuca

SEQ ID NO: 105266 - RNA, 64 nt, hsa
auccaucacuuaaauacagugacaggacagcaacuucagggaucuguaaagaucauuuaaaugg

SEQ ID NO: 105267 - RNA, 64 nt, hsa
auuugaggagaguuuaugaauccaucccccuguuuucagggaccucugccuucucccacacccc

SEQ ID NO: 105268 - RNA, 64 nt, hsa
cgucacuccccccaguuuuauuuuuagcuuuggcuucagggagugacagccaucacaaauagcc

SEQ ID NO: 105269 - RNA, 64 nt, hsa
ugccuucccaggucugacuuugucacccugccguuucagggagcagaaguccuucuggacagug

SEQ ID NO: 105270 - RNA, 64 nt, hsa
gcuugagaggguuucuuuuacuucaaaaucuuucuucagggagcaagacaugaacugacuaauu

SEQ ID NO: 105271 - RNA, 64 nt, hsa
acuuucuccccauggcacuggggaaccauggaaguucagggaacuucagggaagaggcuugguc

SEQ ID NO: 105272 - RNA, 64 nt, hsa
cauggcacuggggaaccauggaaguucagggaacuucagggaagaggcuuggucaauuccugag

SEQ ID NO: 105273 - RNA, 64 nt, hsa
cuuuuuggcuagggaaggugcagguggcccagcauucagggaggagucguaagaucuuaagaaa

SEQ ID NO: 105274 - RNA, 64 nt, hsa
aagcccaggcaccaaugggaauggaccaaagaguuucagggaaacuccaguauauuccagaguc

SEQ ID NO: 105275 - RNA, 64 nt, hsa
ccuagcaugcugaaugcacgugacaccgacugacuucagggaucugggccaggaguguggugga

SEQ ID NO: 105276 - RNA, 64 nt, hsa
ggacaugaauucaggccucuguacuaaaaucuauuucagggaauguucugucuagugauuugcu

SEQ ID NO: 105277 - RNA, 64 nt, hsa
ucuagagacccuccagcuaaaaacagagccugaguucagggacccaaguggugagcggcgucuu

SEQ ID NO: 105278 - RNA, 64 nt, hsa
ugacucgugaaaguaggugauuccuuugcagaacuucagggacugggagcagaggccccucacu

SEQ ID NO: 105279 - RNA, 64 nt, hsa
cccuuggugaagccgugccagggggcucagcugcuucagggaaugugucccucccaccaugggc

SEQ ID NO: 105280 - RNA, 64 nt, hsa
cagcugcaucuugcuugugagaaauggggaagaguucagggaggacacgugaccugcacaggau

SEQ ID NO: 105281 - RNA, 64 nt, hsa
gcccaaugaaagaagaguuccauggucaacuaaguucagggaacccuguuacacuauuaaaggc

SEQ ID NO: 105282 - RNA, 64 nt, hsa
aauaugggaaacacucuaaaggagaugcaggauguucagggagccuugcaguguuauacgcgug

SEQ ID NO: 105283 - RNA, 64 nt, hsa
augcacauagcaaucuggcuuccauucauaaggauucagggaauauuccagaagccauagcuuc

SEQ ID NO: 105284 - RNA, 64 nt, hsa
cuuuucaucaauucuuaaauuucuuaaccuaggcuucagggagcauaugaaaccaaaauuauau

SEQ ID NO: 105285 - RNA, 64 nt, hsa
aaggugugcaauuuucuauaggugacuuuugcaauucagggaagauuugggcauauuaaaugaa

SEQ ID NO: 105286 - RNA, 64 nt, hsa
uaucuaugucuauaucaucuaucaauuuauuaagcaggucuaucuuuaauuuguuaucucaaac

SEQ ID NO: 105287 - RNA, 64 nt, hsa
aucucuaaaauugcuauccugauaauuuuguugacaggucuaaauuacaaugaaguuaagguua

SEQ ID NO: 105288 - RNA, 64 nt, hsa
gguguaaauuaauauggauaauuuuauuuaccuccaggucuaaaagguagugugacccaaauuu

SEQ ID NO: 105289 - RNA, 64 nt, hsa
uuuucaugugaaaggacugggguuuuagcaaacacaggucuaaucucuuuuguguuuuugugca

SEQ ID NO: 105290 - RNA, 64 nt, hsa
aaauuuuuuguuuguuuguuuuuaagaaacaagaaaacagaacugccuuugcacuaaauuagug

SEQ ID NO: 105291 - RNA, 64 nt, hsa
auucaccgggauguacaguuuacaguugaagagcaaacagaaagguuuucucuuggugggauau

SEQ ID NO: 105292 - RNA, 64 nt, hsa
auauuucauaauuucuaaccucuguucucucaguaaacagaaugucugaucgaucaugcagaua

SEQ ID NO: 105293 - RNA, 64 nt, hsa
auaaaucaguauuuaaccuaaaauuacauauuugaaacagaagauauuauguuaugcucaguaa

SEQ ID NO: 105294 - RNA, 64 nt, hsa
cuggugccuaccauacacggaaagcaaaacagaaaaacagaagacaaaaaauagagaucagcaa

SEQ ID NO: 105295 - RNA, 64 nt, hsa
ugccuguacuggugccuaccauacacggaaagcaaaacagaaaaacagaagacaaaaaauagag

SEQ ID NO: 105296 - RNA, 64 nt, hsa
ugucauuauuagagauuucaguaauuaaaaugggaaacagaagccuaaguuauuuaccuuauca

SEQ ID NO: 105297 - RNA, 64 nt, hsa
cuacauuuaugagcuguaagaagaaaauggagacaaacagaaggagggaaaaaccaaccuacuc

SEQ ID NO: 105298 - RNA, 64 nt, hsa
auaaggaaacagaaacaacuuuuuguguugcaucaaacagaagauuuugacugcugugacuuug

SEQ ID NO: 105299 - RNA, 64 nt, hsa
gaaaaauagacaaccaguucgcauuuuaauaaggaaacagaaacaacuuuuuguguugcaucaa

SEQ ID NO: 105300 - RNA, 64 nt, hsa
uuaauggaucagacuuugccagauuugguuagggaaacagaaauuuagaauggugcauuauuuu

SEQ ID NO: 105301 - RNA, 64 nt, hsa
gagaguaaauagcccuucagcaugcucauucaugaaacagaagaggcuguacaagugaagacaa

SEQ ID NO: 105302 - RNA, 64 nt, hsa
cagugaccccaucuaaauaaaauacugcuuuugcaaacagaacacuguaauaggguaguucugg

SEQ ID NO: 105303 - RNA, 64 nt, hsa
gauuauuaagcaaccuuaaagcaauaaguucauuaaacagaagguaauaggaagaacaguacau

SEQ ID NO: 105304 - RNA, 64 nt, hsa
auaaucaguuuggaccaguuucuuaaggucauuaaaacagaagcaaauuaagacagguuugacu

SEQ ID NO: 105305 - RNA, 64 nt, hsa
aaagcacuuucugucaaauaauggacuuuuuucuaaacagaaauuauuuucuauuaauuugcaa

SEQ ID NO: 105306 - RNA, 64 nt, hsa
ccauaaaaaacaauuaccuggugagaaguugcauaaacagaauuagguaguauauugaagacag

SEQ ID NO: 105307 - RNA, 64 nt, hsa
gaaaacuugccucuauuuauaaugaagauaacuuaaacagaaauauccauuuuguaguuauagc

SEQ ID NO: 105308 - RNA, 64 nt, hsa
uacuuggacgcaacauugcaagcgcugugaauggaaacagaauacacuuaacauagaaaugaau

SEQ ID NO: 105309 - RNA, 64 nt, hsa
agaaaaaaggccuugaauugacaaauuaacagaaaaacagaacaaguuuauucuaucauuuggu

SEQ ID NO: 105310 - RNA, 64 nt, hsa
ucuagucccaugugauuuaaacaaacaaacaaacaaacagaaguaacgaagcuaagaauaugag

SEQ ID NO: 105311 - RNA, 64 nt, hsa
agggcggaguuuguuguaaggcaaucaccugucaaaacagaaauugggugggaaaggagucuuu

SEQ ID NO: 105312 - RNA, 64 nt, hsa
gucauauucuaguauuucucacaggggguaugagaaacagaaagcuauauguagcagcuggucu

SEQ ID NO: 105313 - RNA, 64 nt, hsa
guuucaaaaaaucugaccaaaacaaacaaacagaaaacagaaaacaaaaaaaccucuaugcaau

SEQ ID NO: 105314 - RNA, 64 nt, hsa
ugaagauguuucaaaaaaucugaccaaaacaaacaaacagaaaacagaaaacaaaaaaaccucu

SEQ ID NO: 105315 - RNA, 64 nt, hsa
uauuuuggaaaaaaaguuaacuuuucauacuaacaaacagaacaagauuuaagguaaauuucuu

SEQ ID NO: 105316 - RNA, 64 nt, hsa
cacuuuuuuauagaaucaaugaugggucagaggaaaacagaaaaaucacaaauaggcuaagaag

SEQ ID NO: 105317 - RNA, 64 nt, hsa
gacuuuuuaguuuggguccuacuguuguuauuaaaaacagaacaaaaacaaaacacacacacac

SEQ ID NO: 105318 - RNA, 64 nt, hsa
aaacagaacaaaaacaaaacacacacacacacaaaaacagaaacaaaaaaaaccagcauuaaaa

SEQ ID NO: 105319 - RNA, 64 nt, hsa
cuucuuacugucccacagcuugguuucauguuacaaacagaaaagcucgaggcucccaccccgc

SEQ ID NO: 105320 - RNA, 64 nt, hsa
uuaaaacaacaacaacaacaacaacaacaacaacaaacagaaggauaaacuggcuugccugugg

SEQ ID NO: 105321 - RNA, 64 nt, hsa
uucugugguccccucacucagucucucauuugguaaacagaaagcuguuuucccuacaaggugc

SEQ ID NO: 105322 - RNA, 64 nt, hsa
caauucauauuuauggccuuuggaauccaaagaaaaacagaagaauaauucauggauuuguuca

SEQ ID NO: 105323 - RNA, 64 nt, hsa
cauugcuuuaaccuuugguuacuuuuauucuguuaaacagaauugaagaaagaguauuauacca

SEQ ID NO: 105324 - RNA, 64 nt, hsa
uagaaaccccauuucuacugaacauccuaguuuuaaacagaagaaaaacuguaauccugggguu

SEQ ID NO: 105325 - RNA, 64 nt, hsa
ucuuucuucagaauuaaaacuaaaaucuuaaauaaaacagaaaacuugauggugacacuugggu

SEQ ID NO: 105326 - RNA, 64 nt, hsa
cguuugugcaguauugaaaagacaggagaaaagaaaacagaaaccugguuauaaccugacgcua

SEQ ID NO: 105327 - RNA, 64 nt, hsa
uuucuggagcagauuguacagcugugacuuuggaaaacagaaaguaagacccucagaaaaccaa

SEQ ID NO: 105328 - RNA, 64 nt, hsa
uauucauucuacaggaacagcaauaaguacuauuaaacagaagauggcuacacuaaguuccaau

SEQ ID NO: 105329 - RNA, 64 nt, hsa
ucccuuuggagcugcucagacuuacuuuaagcucaaacagaagggaaugcuauuacugguggug

SEQ ID NO: 105330 - RNA, 64 nt, hsa
acuagccaguuuagguaugacuuuggaagugcagaaacagaaggauacuguuagaaaauccuaa

SEQ ID NO: 105331 - RNA, 64 nt, hsa
aguuuuaauuuggguauagguuaaauggaagaagaaacagaacuucauggccaaaguagaccua

SEQ ID NO: 105332 - RNA, 64 nt, hsa
uaugccacacuuugcaccuuaaugaaauacuuugaaacagaaguuauucacuguguuuuugaug

SEQ ID NO: 105333 - RNA, 64 nt, hsa
cucuuuuucucccaacucauauuuuugauaggaaaaacagaaaacccauccaguucuucagaaa

SEQ ID NO: 105334 - RNA, 64 nt, hsa
cuacugugaaaaggggaggggaugugguaagcggaaacagaagacaggcagcagaggcauuaaa

SEQ ID NO: 105335 - RNA, 64 nt, hsa
agcagggucuaacugugcuuacuuagcccaguucaaacagaacaaaggaaaaauauagaaagca

SEQ ID NO: 105336 - RNA, 64 nt, hsa
ugacaaucugggcaaggcuuguggggcgcuugacaaacagaaucugcccugugccgccugguuc

SEQ ID NO: 105337 - RNA, 64 nt, hsa
ugagcuuugaaguagguggcuugagcuagagauaaaacagaaucuucuggguaguccccuguug

SEQ ID NO: 105338 - RNA, 64 nt, hsa
gcagacaauaguauagaagucuggaaaaaaacaaaaacagaauuugagaaccuuggaccacucc

SEQ ID NO: 105339 - RNA, 64 nt, hsa
accaaaaaaugguagacaugaaaggcaggugaggaaacagaaaaggucucuuugcagauauaua

SEQ ID NO: 105340 - RNA, 64 nt, hsa
cguaguguugaauauguugcauguccauguuagaaaacagaauccagucaucagcuaauacaaa

SEQ ID NO: 105341 - RNA, 64 nt, hsa
uggagaugaaauaaacaaggcaaaauagagguggaaacagaaggaagucauuugcugagucugc

SEQ ID NO: 105342 - RNA, 64 nt, hsa
ggucagagaaaugcaugggaauauuuuuuccuuaaaacagaaaaaaauuaaaguauuauuaaua

SEQ ID NO: 105343 - RNA, 64 nt, hsa
gcucugauuaacuaguauucaaucaccaacuugcaaacagaauucauaacacuuggcacuuguu

SEQ ID NO: 105344 - RNA, 64 nt, hsa
aauggacaaggaaggaauaaagggagaagagggaaaacagaaaaccugaugcuggggacacagc

SEQ ID NO: 105345 - RNA, 64 nt, hsa
uucauggauauguuauacugaaccaggccagagcaaacagaaaaagaagguugagggcaaugga

SEQ ID NO: 105346 - RNA, 64 nt, hsa
agaauacacuaagaaguuucuaguuugugugccaaaacagaagcuucuccaagcaugauggcca

SEQ ID NO: 105347 - RNA, 64 nt, hsa
aaagucagcaaaagaaagaaugcauuucgaaagcaaacagaagaaaaaaguauauucucacagu

SEQ ID NO: 105348 - RNA, 64 nt, hsa
gcuuaagacccaagaaaugcuguuugcucaugguaaacagaaacagcaucuucgcuacaaccac

SEQ ID NO: 105349 - RNA, 64 nt, hsa
gaugccugaugcccauggucaacccacgcagaagaaacagaagaacucaugcugccagauagau

SEQ ID NO: 105350 - RNA, 64 nt, hsa
gcucacgccaggcaggccagugggccuaagccagaaacagaaagacagcaguggccagguggag

SEQ ID NO: 105351 - RNA, 64 nt, hsa
cuagcaagaucccugagacgggguaaguuauaauaaacagaaauguauuggcucagagcucugg

SEQ ID NO: 105352 - RNA, 64 nt, hsa
uuguuauucucggacugugaauuuuggugauguaaaacagaauauucuguaaaccuaaugucug

SEQ ID NO: 105353 - RNA, 64 nt, hsa
uggcaagguggguuccagggacuguaccuguaggaaacagaaaagagaagaaagaagcacucug

SEQ ID NO: 105354 - RNA, 64 nt, hsa
gcgcauggcuguucugcugcaacugugcuccacgaaacagaagaaaagguaagguguuguguca

SEQ ID NO: 105355 - RNA, 64 nt, hsa
uuaauuuucaagcacuugauuaacacaacacugcaaacagaagggagaaagugucagugacaca

SEQ ID NO: 105356 - RNA, 64 nt, hsa
acuuccacaccaggaaaacagacccaaauuccauaaacagaacugacguuaaaauaugcgaaag

SEQ ID NO: 105357 - RNA, 64 nt, hsa
cuuauccagggccauagaaguaugaaucuaauuaaaacagaaaugggaauuauugcacagaaau

SEQ ID NO: 105358 - RNA, 64 nt, hsa
ccacacucagaaacgaggaccuagaagaucccuaaaacagaauaagaacaaaugugauuguauu

SEQ ID NO: 105359 - RNA, 64 nt, hsa
agauauggaccaccggagucagcgagagugacugaaacagaagcgauaccucucgcucccaugc

SEQ ID NO: 105360 - RNA, 64 nt, hsa
uguuaccauccuuuaaucauaacuaaaacauugaaaacagaacaaaugagaaaagaaaaaaaac

SEQ ID NO: 105361 - RNA, 64 nt, hsa
ccauuuguuucaaagaggucugcauguugggcgaaaacagaacaacuguguuuccuuuuacuug

SEQ ID NO: 105362 - RNA, 64 nt, hsa
ccaaaaacuagacaaauaaagacaaacuaaaacaaaacagaacaaaagcaaaggaaaaugcuuu

SEQ ID NO: 105363 - RNA, 64 nt, hsa
caguauacugcuaucgagacauguuuguucggaaaaacagaaagauccauaaagaugcagaguc

SEQ ID NO: 105364 - RNA, 64 nt, hsa
auucaccuuaccaauauuaaucccagcguguguaaaacagaacaguaacucuaugugaccccag

SEQ ID NO: 105365 - RNA, 64 nt, hsa
ucuuucugaaaucuaagcuuuguauuuaauuaaaaaacagaauucaacaucuauugauaaaaca

SEQ ID NO: 105366 - RNA, 64 nt, hsa
agguuuacgagauuuggcugccuuaagaauacaaaaacagaaaugcagaauuucuggggcugcu

SEQ ID NO: 105367 - RNA, 64 nt, hsa
aacgaaagcaaaaauugacaaaugggacaugauuaaacagaauuaccauuugacucagcaaucc

SEQ ID NO: 105368 - RNA, 64 nt, hsa
gcuggaagccauuauccuaaaugaacucacucagaaacagaaaaccaaauaccacauguucuca

SEQ ID NO: 105369 - RNA, 64 nt, hsa
augagaugggaugaaauccuaugacaguaagcaaaaacagaaccaugaaaaaugauuggacaua

SEQ ID NO: 105370 - RNA, 64 nt, hsa
auccuuguucuuugacaauuugugaugucugaaaaaacagaacccgaaaagcuauggugauaug

SEQ ID NO: 105371 - RNA, 64 nt, hsa
augcaagguccucagaguagccggguucuaccacaaacagaaacagaaugaaaguagcugucag

SEQ ID NO: 105372 - RNA, 64 nt, hsa
gguccucagaguagccggguucuaccacaaacagaaacagaaugaaaguagcugucaguccuug

SEQ ID NO: 105373 - RNA, 64 nt, hsa
gagcuagcccaaaaucccaaacucaaaccaaaccaaacagaaagcaguggagguggggguugcu

SEQ ID NO: 105374 - RNA, 64 nt, hsa
ggcucugagcguacauagggaagggaggaagggaaaacagaaagcagacaaagaaaaaagagcu

SEQ ID NO: 105375 - RNA, 64 nt, hsa
guguaguuuuuaauuguuaaaaaaaaaaaguuuuaaacagaagcacaugacauaugaaagccug

SEQ ID NO: 105376 - RNA, 64 nt, hsa
ugaugcucucuucugacagccaaagaugaaaaacaaacagaaaaaaaaaaguaaagagucuauu

SEQ ID NO: 105377 - RNA, 64 nt, hsa
ccagaagaacccauagaugaagaugaagauauucaaacagaaagaauaagaacagccacugcuc

SEQ ID NO: 105378 - RNA, 64 nt, hsa
aucaaaauauacuuuuggaaguagaugacuuugaaaacagaaaugguacugauggccucucaua

SEQ ID NO: 105379 - RNA, 64 nt, hsa
uucauuacucaucacauccccgaugcuaaauuaaaaacagaaaacaaagaaaagcuuguauaua

SEQ ID NO: 105380 - RNA, 56 nt, hsa
gcaaggagcagaagacauagacguugaaacagaaacagaaggaugaaggacaguuu

SEQ ID NO: 105381 - RNA, 62 nt, hsa
gcaaggagcagaagacauagacguugaaacagaaacagaaggaugaaggacaguuuuuuccu

SEQ ID NO: 105382 - RNA, 64 nt, hsa
augcaugugauggugccugagaccccugccuuagaaacagaauuccuaaggggauugacucucc

SEQ ID NO: 105383 - RNA, 64 nt, hsa
aaaguagugccacugcagugucuuuuuaaacuggaaacagaauuggaaaacugccugacuuauc

SEQ ID NO: 105384 - RNA, 64 nt, hsa
cgaacuagaagcuaugcguuaccucugauucuggaaacagaauagcagccacucauucugcauu

SEQ ID NO: 105385 - RNA, 50 nt, hsa
cugucaacaguaagcuguaaaaacagaacaaugacauaaaucaagggaga

SEQ ID NO: 105386 - RNA, 64 nt, hsa
aaagaggcagggguugcaauccuagucucugauaaaacagaauuuaaaccaacaaagaucaaaa

SEQ ID NO: 105387 - RNA, 64 nt, hsa
acauacgcaaaucaauaaauguaauccagcauauaaacagaaccaaagacagaaaccacaugau

SEQ ID NO: 105388 - RNA, 64 nt, hsa
cacaccaucuuuccaucccaggcuuuugaaaaacaaacagaaacccguguaucugggauauuuc

SEQ ID NO: 105389 - RNA, 64 nt, hsa
uauguaacuggaaucucaaaaguucuuugggacaaaacagaaguccauggaguuaucuaagcuc

SEQ ID NO: 105390 - RNA, 64 nt, hsa
ccucucaauucacaaugaguuaacugauaaaacaaaacagaagucagacaauguuuuaaauuga

SEQ ID NO: 105391 - RNA, 64 nt, hsa
auguguccuaugcccagcugcacagcuuacccucaaacagaaaauaaugaagccuucuuccucc

SEQ ID NO: 105392 - RNA, 64 nt, hsa
ugaaauguguagggaggcuuuuaauuauggcucaaaacagaauuuaucuuguuaauaauuccuc

SEQ ID NO: 105393 - RNA, 52 nt, hsa
aucaaaauuuguacuggugaugaaacagaauauaugaaauguguagggaggc

SEQ ID NO: 105394 - RNA, 64 nt, hsa
uccccccuccuucugcuguguaucaugguguucaaaacagaaauguuuuuuggcauuccaccuc

SEQ ID NO: 105395 - RNA, 64 nt, hsa
guucuuugauccagaggugggugcagcugaaaguaaacagaauggauugccaguuacauguaug

SEQ ID NO: 105396 - RNA, 64 nt, hsa
uauauuaauuuuauuaagcaaggguucgccagagaaacagaaccaauaggauauauaagcccaa

SEQ ID NO: 105397 - RNA, 64 nt, hsa
cugguagaugguaaaacauuauuuaaauguuauuaaacagaaauaauguuuuaccaucucuuca

SEQ ID NO: 105398 - RNA, 64 nt, hsa
augaaugaauuucuaaauacaguaugugcuggguaaacagaaagugguuuagacauucuugauu

SEQ ID NO: 105399 - RNA, 64 nt, hsa
uuuggcuaaguagaggacauggacuaguuguagcaaacagaacaugcuguuugcucuugccaaa

SEQ ID NO: 105400 - RNA, 64 nt, hsa
uggauuccugcgaguugcuuucagucauucagggaaacagaaagacguuuuccaacauguagaa

SEQ ID NO: 105401 - RNA, 64 nt, hsa
augaguacaaaaaugcagacacuuaacaaaaagcaaacagaaaaaaaaguguggaauguguugu

SEQ ID NO: 105402 - RNA, 64 nt, hsa
uguacuguauguggcagugacuucugccauacuucauaccuacuugaacaucagaggguccauc

SEQ ID NO: 105403 - RNA, 64 nt, hsa
uuccuaguuuuaaguguuucaccagcaaguauuccauaccuacuugauguugcuggucuggugu

SEQ ID NO: 105404 - RNA, 64 nt, hsa
cauuuuucaacucaaggcaauggcuuucuacaccaacucuaauccauaaacgggucuuaugaca

SEQ ID NO: 105405 - RNA, 64 nt, hsa
auaagggugguggacuaucuugaagaacccuuucaacucuaaaaauugacccuaucaacuggag

SEQ ID NO: 105406 - RNA, 64 nt, hsa
caucaucaggacugcauugcucaggcauuuucuaaacucuaaauuuacgagcuguacaaaaaaa

SEQ ID NO: 105407 - RNA, 64 nt, hsa
uuuccuguauaauauaugaauguuucugagaagaaacucuaaauaguugaaaggcuaaccugcu

SEQ ID NO: 105408 - RNA, 64 nt, hsa
uaggggugucccaugacacuauuucauauucuacagaaguaaaucagguuucaccaacugaaau

SEQ ID NO: 105409 - RNA, 64 nt, hsa
aagaaggaauuaccuuugacaauauuuuucgguaagaaguaaaaccucuggagaccuaucuuua

SEQ ID NO: 105410 - RNA, 64 nt, hsa
aaguugauauacauagucauuuuuccucuaugguagaaguaaaaaaaaaaaaaaaggacauagc

SEQ ID NO: 105411 - RNA, 64 nt, hsa
agagacuucugcuuuucaacccccacccuccucaagaaguaauaauuuguuuacuuguaaauug

SEQ ID NO: 105412 - RNA, 64 nt, hsa
ucuguauguguucaacauuuuugaauacauuaaaagaaguaaccaacugaacgacaaagcaugg

SEQ ID NO: 105413 - RNA, 64 nt, hsa
ccugcaaacauagcuaugcuucaugaggcuuacaagaaguaacuuuagguaggagcuguuuuug

SEQ ID NO: 105414 - RNA, 64 nt, hsa
cuugaaaauaacgaccuugucuuguaucaguggaagaaguaaguugcuuagaaagggaaaaguc

SEQ ID NO: 105415 - RNA, 64 nt, hsa
aguacaucauauguauacaaucagauaaaagcauagaaguaaaucauucggaugugauuuuuau

SEQ ID NO: 105416 - RNA, 64 nt, hsa
gcuguauuuguaaacaaagacaaauguugcuuuaagaaguaauuauaauuaggaauaggcuaug

SEQ ID NO: 105417 - RNA, 64 nt, hsa
uuuuaaagcaagaauggaagacccuugaaaauaaagaaguaauuauugacacauuucuuuuuua

SEQ ID NO: 105418 - RNA, 64 nt, hsa
uugauguuuuugaaacuuaguagaacaaauauucagaaguaacuugauaagauaugaauguuuc

SEQ ID NO: 105419 - RNA, 64 nt, hsa
augcuccacgugguaagauccuccaagcugcuuuagaaguaacaaugaagaacguggacguuuu

SEQ ID NO: 105420 - RNA, 64 nt, hsa
cauuaaaaaaaaaaucaaugguggggaacuauaaagaaguaacaaaagaagugacaucuucagc

SEQ ID NO: 105421 - RNA, 64 nt, hsa
guuucaggugggucacauucugaugaauguuucccuuguacagaucccagcuuauggccuugac

SEQ ID NO: 105422 - RNA, 64 nt, hsa
cacccuucuuuccuaccagcccagagccuuguggcuuguacaguuuugaaacucccguucuauu

SEQ ID NO: 105423 - RNA, 64 nt, hsa
guuugcuugguguuuguuuuuaacgcacaacuugcuuguacaguaaacugucuucuguacuauu

SEQ ID NO: 105424 - RNA, 64 nt, hsa
ugggagccucuggcugcaucugugcagccacauccuuguacagaggcauagguuaccaccccca

SEQ ID NO: 105425 - RNA, 64 nt, hsa
auuucuaagcuaauuauuuuaccguuuuguugaccuuguacacaagaaugagauuaaucuguau

SEQ ID NO: 105426 - RNA, 64 nt, hsa
aaaaugacaaacuuggaccacaggcuuucuugaccuuguacaguauaguaaaaauacccuuuac

SEQ ID NO: 105427 - RNA, 64 nt, hsa
aaagugaagaccuuguacagaauguguuaaauuucuuguacaaaauuguuuauuugccuuuucu

SEQ ID NO: 105428 - RNA, 54 nt, hsa
aaaugaugacagcaaagugaagaccuuguacagaauguguuaaauuucuuguac

SEQ ID NO: 105429 - RNA, 64 nt, hsa
uucauggauaauuuuuaacuucauuauuucuguacuuguacaaacucaacacuaacuuuuuuuu

SEQ ID NO: 105430 - RNA, 64 nt, hsa
uucaacuuuugaaauacaaaaccaguguuuuuuacuuguacacuguuuuaaagucuauuaaaau

SEQ ID NO: 105431 - RNA, 64 nt, hsa
cuacaguagguaacuuuaaggauuucuuccuauccuuguacaaugacaugaaugucuuucuuug

SEQ ID NO: 105432 - RNA, 64 nt, hsa
uaacaguguacuaugguuuuauaucuugacuugccuuguacaucuuucaauucuggaauaucug

SEQ ID NO: 105433 - RNA, 64 nt, hsa
aaguucuggcucugcagagaccaaaccuuacugacuuguacagacuuguacaaguaaagacuua

SEQ ID NO: 105434 - RNA, 64 nt, hsa
ucugcagagaccaaaccuuacugacuuguacagacuuguacaaguaaagacuuauacagauaga

SEQ ID NO: 105435 - RNA, 64 nt, hsa
uuggagugagaaauguucugaaacugaauuacuucuuguacagcugagauagcuucuucugaac

SEQ ID NO: 105436 - RNA, 64 nt, hsa
cucucucacucuuucuuacucucuucucaggucacuuguacacuugguuuccuaguagaagcuc

SEQ ID NO: 105437 - RNA, 64 nt, hsa
guuuguuguugccauucuagcaaugagcuuaguccuuguacaucugcauuaaggugccgaugca

SEQ ID NO: 105438 - RNA, 64 nt, hsa
uauuucucuuuacaaaugauggaauuuuuuugcacuuguacauuuauuuucucuguauugauuu

SEQ ID NO: 105439 - RNA, 64 nt, hsa
gugcccaugucguucuucucucccugugacacagcuuguacagucugauucuuuuuaucugggg

SEQ ID NO: 105440 - RNA, 64 nt, hsa
cucagacuucuuguggcgccaccuccacgucugucuuguacaugacacuccuccacgcgguuuc

SEQ ID NO: 105441 - RNA, 64 nt, hsa
uauggugcuauuucaauuagucuagguuuaggcccuuguacauuuugcccauaacuuuuuacaa

SEQ ID NO: 105442 - RNA, 64 nt, hsa
gugguuaucuuuguuguauuggcauaaucagugacuuguacauucagcaauagcauuugagcaa

SEQ ID NO: 105443 - RNA, 64 nt, hsa
uaggccuucacaccuucacaggugcgaaaggaaaggccuucacacccucacagaggcaucaugc

SEQ ID NO: 105444 - RNA, 64 nt, hsa
uugaaaaauauagaaucauuaauggcccaagauaggccuucacaccuucacaggugcgaaagga

SEQ ID NO: 105445 - RNA, 64 nt, hsa
agggccccucucuucccaucucccuuguccugguggccuucagugucucuuccaguuccaggag

SEQ ID NO: 105446 - RNA, 64 nt, hsa
ugucucuuccaguuccaggagcugcugggaagcuggccuucauuguuggugacagggcaaccau

SEQ ID NO: 105447 - RNA, 64 nt, hsa
accaaauauagcucuguguauaacaucguacugcggccuucaaaacuacguuauguuggagcau

SEQ ID NO: 105448 - RNA, 64 nt, hsa
aaaguuuccccucuauuguaauacauuauuaaguggccuucagaacugaguuaauaagugaaaa

SEQ ID NO: 105449 - RNA, 64 nt, hsa
cuucccucucucacuccccacaucccaucgucucggccuucacaaucugucaguucuaaccucc

SEQ ID NO: 105450 - RNA, 64 nt, hsa
cacaaucugucaguucuaaccuccuaagcaacuaggccuucaguaaaugugauucaccucuucu

SEQ ID NO: 105451 - RNA, 64 nt, hsa
cuggaaaaugacguuuguggcucuuucccaaguuggccuucaaagagccugccugcuguugagc

SEQ ID NO: 105452 - RNA, 64 nt, hsa
cgugucagccugcaucgcaagcacacacccugcgggccuucaagucucacuguuccguaugagg

SEQ ID NO: 105453 - RNA, 64 nt, hsa
uuuuuaaaaaauaugucguagaauuccuucgaaaggccuucagacacaugcuauguucugucuu

SEQ ID NO: 105454 - RNA, 64 nt, hsa
cuccccugauagaagauuguuggugaauuuucaaggccuucaguuuauuuccacuauuuucaaa

SEQ ID NO: 105455 - RNA, 64 nt, hsa
uaggggagcaccacgcgcugcaguucaccgaccuggccuucaagcaggcccgggacggcugccc

SEQ ID NO: 105456 - RNA, 64 nt, hsa
gggccccacgcaccaccuaccuggcuuccugcaaggccuucacgccugccagggucagcugcag

SEQ ID NO: 105457 - RNA, 64 nt, hsa
gcugcucugguggaguugggaagggauaggaccuggccuucacugucucccuugcccuuugacu

SEQ ID NO: 105458 - RNA, 64 nt, hsa
guuuggagaugugggccuuugauagacccacuugggccuucaugccauggccuguggauggaga

SEQ ID NO: 105459 - RNA, 64 nt, hsa
agagaucaggcucugggaccccugccugggggguggccuucaugcacuagccacuuccgcaggu

SEQ ID NO: 105460 - RNA, 64 nt, hsa
ccaugcccagagccccgccugccucagcgggucaggccuucagaacacugccacccacccaguu

SEQ ID NO: 105461 - RNA, 64 nt, hsa
aaauaaauuaaagcguaaaaggagaccuacaucaggccuucauccugaggauuuuaucaagaaa

SEQ ID NO: 105462 - RNA, 64 nt, hsa
uuuugcaugcugaaacuucucaaccagaagaaagggccuucacaguguccuuuauguaagaaug

SEQ ID NO: 105463 - RNA, 64 nt, hsa
caaagcagggagaacagaaagguagaguuacuaaggccuucagugaacagaaaggagcagagag

SEQ ID NO: 105464 - RNA, 64 nt, hsa
uucucuggguccagggugacucuccaaagaaauuggccuucagcuggagaaaacauugggugga

SEQ ID NO: 105465 - RNA, 64 nt, hsa
ugauucugcuuucuguuagcuuaggcagacauugggccuucaccuacaaguuuuuccuuacccc

SEQ ID NO: 105466 - RNA, 64 nt, hsa
cuggaaaggccacuuggcccugugcugagugagcggccuucauuagagcgaggcagcccuuggc

SEQ ID NO: 105467 - RNA, 64 nt, hsa; identical to SEQ ID NO: 72506

SEQ ID NO: 105468 - RNA, 64 nt, hsa; identical to SEQ ID NO: 72507

SEQ ID NO: 105469 - RNA, 64 nt, hsa; identical to SEQ ID NO: 72508

SEQ ID NO: 105470 - RNA, 64 nt, hsa; identical to SEQ ID NO: 72509

SEQ ID NO: 105471 - RNA, 64 nt, hsa; identical to SEQ ID NO: 72510

SEQ ID NO: 105472 - RNA, 64 nt, hsa; identical to SEQ ID NO: 72511

SEQ ID NO: 105473 - RNA, 64 nt, hsa; identical to SEQ ID NO: 72512

SEQ ID NO: 105474 - RNA, 64 nt, hsa; identical to SEQ ID NO: 72513

SEQ ID NO: 105475 - RNA, 64 nt, hsa; identical to SEQ ID NO: 72514

SEQ ID NO: 105476 - RNA, 64 nt, hsa; identical to SEQ ID NO: 72515

SEQ ID NO: 105477 - RNA, 64 nt, hsa; identical to SEQ ID NO: 72516

SEQ ID NO: 105478 - RNA, 64 nt, hsa; identical to SEQ ID NO: 72517

SEQ ID NO: 105479 - RNA, 64 nt, hsa; identical to SEQ ID NO: 72518

SEQ ID NO: 105480 - RNA, 64 nt, hsa; identical to SEQ ID NO: 72519

SEQ ID NO: 105481 - RNA, 64 nt, hsa; identical to SEQ ID NO: 72520

SEQ ID NO: 105482 - RNA, 64 nt, hsa; identical to SEQ ID NO: 72521

SEQ ID NO: 105483 - RNA, 64 nt, hsa; identical to SEQ ID NO: 72522

SEQ ID NO: 105484 - RNA, 64 nt, hsa; identical to SEQ ID NO: 72523

SEQ ID NO: 105485 - RNA, 64 nt, hsa; identical to SEQ ID NO: 72524

SEQ ID NO: 105486 - RNA, 64 nt, hsa; identical to SEQ ID NO: 72525

SEQ ID NO: 105487 - RNA, 64 nt, hsa; identical to SEQ ID NO: 72526

SEQ ID NO: 105488 - RNA, 64 nt, hsa; identical to SEQ ID NO: 72527

SEQ ID NO: 105489 - RNA, 64 nt, hsa; identical to SEQ ID NO: 72528

SEQ ID NO: 105490 - RNA, 64 nt, hsa; identical to SEQ ID NO: 72529

SEQ ID NO: 105491 - RNA, 64 nt, hsa; identical to SEQ ID NO: 72530

SEQ ID NO: 105492 - RNA, 64 nt, hsa; identical to SEQ ID NO: 72531

SEQ ID NO: 105493 - RNA, 64 nt, hsa; identical to SEQ ID NO: 72532

SEQ ID NO: 105494 - RNA, 64 nt, hsa; identical to SEQ ID NO: 72533

SEQ ID NO: 105495 - RNA, 64 nt, hsa; identical to SEQ ID NO: 72534

SEQ ID NO: 105496 - RNA, 64 nt, hsa; identical to SEQ ID NO: 72535

SEQ ID NO: 105497 - RNA, 64 nt, hsa; identical to SEQ ID NO: 72536

SEQ ID NO: 105498 - RNA, 64 nt, hsa; identical to SEQ ID NO: 72537

SEQ ID NO: 105499 - RNA, 64 nt, hsa; identical to SEQ ID NO: 72538

SEQ ID NO: 105500 - RNA, 64 nt, hsa; identical to SEQ ID NO: 72539

SEQ ID NO: 105501 - RNA, 64 nt, hsa; identical to SEQ ID NO: 72540

SEQ ID NO: 105502 - RNA, 64 nt, hsa; identical to SEQ ID NO: 72541

SEQ ID NO: 105503 - RNA, 64 nt, hsa; identical to SEQ ID NO: 72542

SEQ ID NO: 105504 - RNA, 64 nt, hsa; identical to SEQ ID NO: 72543

SEQ ID NO: 105505 - RNA, 64 nt, hsa; identical to SEQ ID NO: 72544

SEQ ID NO: 105506 - RNA, 64 nt, hsa; identical to SEQ ID NO: 72545

SEQ ID NO: 105507 - RNA, 64 nt, hsa; identical to SEQ ID NO: 72546

SEQ ID NO: 105508 - RNA, 64 nt, hsa; identical to SEQ ID NO: 72547

SEQ ID NO: 105509 - RNA, 64 nt, hsa; identical to SEQ ID NO: 72548

SEQ ID NO: 105510 - RNA, 64 nt, hsa; identical to SEQ ID NO: 72549

SEQ ID NO: 105511 - RNA, 64 nt, hsa; identical to SEQ ID NO: 72550

SEQ ID NO: 105512 - RNA, 64 nt, hsa; identical to SEQ ID NO: 72551

SEQ ID NO: 105513 - RNA, 64 nt, hsa; identical to SEQ ID NO: 72552

SEQ ID NO: 105514 - RNA, 64 nt, hsa; identical to SEQ ID NO: 72553

SEQ ID NO: 105515 - RNA, 64 nt, hsa; identical to SEQ ID NO: 72554

SEQ ID NO: 105516 - RNA, 64 nt, hsa; identical to SEQ ID NO: 72555

SEQ ID NO: 105517 - RNA, 64 nt, hsa; identical to SEQ ID NO: 72556

SEQ ID NO: 105518 - RNA, 64 nt, hsa; identical to SEQ ID NO: 72557

SEQ ID NO: 105519 - RNA, 64 nt, hsa; identical to SEQ ID NO: 72558

SEQ ID NO: 105520 - RNA, 64 nt, hsa; identical to SEQ ID NO: 72559

SEQ ID NO: 105521 - RNA, 64 nt, hsa; identical to SEQ ID NO: 72560

SEQ ID NO: 105522 - RNA, 64 nt, hsa; identical to SEQ ID NO: 72561

SEQ ID NO: 105523 - RNA, 64 nt, hsa; identical to SEQ ID NO: 72562

SEQ ID NO: 105524 - RNA, 64 nt, hsa; identical to SEQ ID NO: 72563

SEQ ID NO: 105525 - RNA, 64 nt, hsa; identical to SEQ ID NO: 72564

SEQ ID NO: 105526 - RNA, 64 nt, hsa; identical to SEQ ID NO: 72565

SEQ ID NO: 105527 - RNA, 64 nt, hsa; identical to SEQ ID NO: 72566

SEQ ID NO: 105528 - RNA, 64 nt, hsa; identical to SEQ ID NO: 72567

SEQ ID NO: 105529 - RNA, 64 nt, hsa; identical to SEQ ID NO: 72568

SEQ ID NO: 105530 - RNA, 64 nt, hsa; identical to SEQ ID NO: 72569

SEQ ID NO: 105531 - RNA, 64 nt, hsa; identical to SEQ ID NO: 72570

SEQ ID NO: 105532 - RNA, 64 nt, hsa; identical to SEQ ID NO: 72571

SEQ ID NO: 105533 - RNA, 64 nt, hsa; identical to SEQ ID NO: 72572

SEQ ID NO: 105534 - RNA, 64 nt, hsa; identical to SEQ ID NO: 72573

SEQ ID NO: 105535 - RNA, 64 nt, hsa; identical to SEQ ID NO: 72574

SEQ ID NO: 105536 - RNA, 64 nt, hsa; identical to SEQ ID NO: 72575

SEQ ID NO: 105537 - RNA, 64 nt, hsa; identical to SEQ ID NO: 72576

SEQ ID NO: 105538 - RNA, 64 nt, hsa; identical to SEQ ID NO: 72577

SEQ ID NO: 105539 - RNA, 64 nt, hsa; identical to SEQ ID NO: 72578

SEQ ID NO: 105540 - RNA, 64 nt, hsa; identical to SEQ ID NO: 72579

SEQ ID NO: 105541 - RNA, 64 nt, hsa; identical to SEQ ID NO: 72580

SEQ ID NO: 105542 - RNA, 64 nt, hsa; identical to SEQ ID NO: 72581

SEQ ID NO: 105543 - RNA, 64 nt, hsa; identical to SEQ ID NO: 72582

SEQ ID NO: 105544 - RNA, 64 nt, hsa; identical to SEQ ID NO: 72583

SEQ ID NO: 105545 - RNA, 64 nt, hsa; identical to SEQ ID NO: 72584

SEQ ID NO: 105546 - RNA, 64 nt, hsa; identical to SEQ ID NO: 72585

SEQ ID NO: 105547 - RNA, 64 nt, hsa; identical to SEQ ID NO: 72586

SEQ ID NO: 105548 - RNA, 64 nt, hsa; identical to SEQ ID NO: 72587

SEQ ID NO: 105549 - RNA, 64 nt, hsa; identical to SEQ ID NO: 72588

SEQ ID NO: 105550 - RNA, 64 nt, hsa; identical to SEQ ID NO: 72589

SEQ ID NO: 105551 - RNA, 64 nt, hsa; identical to SEQ ID NO: 72590

SEQ ID NO: 105552 - RNA, 64 nt, hsa; identical to SEQ ID NO: 72591

SEQ ID NO: 105553 - RNA, 64 nt, hsa; identical to SEQ ID NO: 72592

SEQ ID NO: 105554 - RNA, 64 nt, hsa; identical to SEQ ID NO: 72593

SEQ ID NO: 105555 - RNA, 64 nt, hsa; identical to SEQ ID NO: 72594

SEQ ID NO: 105556 - RNA, 64 nt, hsa; identical to SEQ ID NO: 72595

SEQ ID NO: 105557 - RNA, 64 nt, hsa; identical to SEQ ID NO: 72596

SEQ ID NO: 105558 - RNA, 64 nt, hsa; identical to SEQ ID NO: 72597

SEQ ID NO: 105559 - RNA, 64 nt, hsa; identical to SEQ ID NO: 72598

SEQ ID NO: 105560 - RNA, 64 nt, hsa; identical to SEQ ID NO: 72599

SEQ ID NO: 105561 - RNA, 64 nt, hsa; identical to SEQ ID NO: 72600

SEQ ID NO: 105562 - RNA, 64 nt, hsa; identical to SEQ ID NO: 72601

SEQ ID NO: 105563 - RNA, 64 nt, hsa; identical to SEQ ID NO: 59936

SEQ ID NO: 105564 - RNA, 64 nt, hsa; identical to SEQ ID NO: 59937

SEQ ID NO: 105565 - RNA, 64 nt, hsa; identical to SEQ ID NO: 59938

SEQ ID NO: 105566 - RNA, 64 nt, hsa; identical to SEQ ID NO: 59939

SEQ ID NO: 105567 - RNA, 64 nt, hsa; identical to SEQ ID NO: 59940

SEQ ID NO: 105568 - RNA, 64 nt, hsa; identical to SEQ ID NO: 59941

SEQ ID NO: 105569 - RNA, 64 nt, hsa; identical to SEQ ID NO: 59942

SEQ ID NO: 105570 - RNA, 64 nt, hsa; identical to SEQ ID NO: 59943

SEQ ID NO: 105571 - RNA, 64 nt, hsa; identical to SEQ ID NO: 59944

SEQ ID NO: 105572 - RNA, 64 nt, hsa; identical to SEQ ID NO: 59945

SEQ ID NO: 105573 - RNA, 64 nt, hsa; identical to SEQ ID NO: 59946

SEQ ID NO: 105574 - RNA, 64 nt, hsa; identical to SEQ ID NO: 59947

SEQ ID NO: 105575 - RNA, 64 nt, hsa; identical to SEQ ID NO: 59948

SEQ ID NO: 105576 - RNA, 64 nt, hsa; identical to SEQ ID NO: 59949

SEQ ID NO: 105577 - RNA, 64 nt, hsa; identical to SEQ ID NO: 59950

SEQ ID NO: 105578 - RNA, 64 nt, hsa; identical to SEQ ID NO: 59951

SEQ ID NO: 105579 - RNA, 64 nt, hsa; identical to SEQ ID NO: 59952

SEQ ID NO: 105580 - RNA, 64 nt, hsa; identical to SEQ ID NO: 59953

SEQ ID NO: 105581 - RNA, 64 nt, hsa; identical to SEQ ID NO: 59954

SEQ ID NO: 105582 - RNA, 64 nt, hsa; identical to SEQ ID NO: 59955

SEQ ID NO: 105583 - RNA, 64 nt, hsa
cccauauagucaacucuugauuauccacguguggauuauccaccaugccaggaagacccauaac

SEQ ID NO: 105584 - RNA, 64 nt, hsa
gaggggagggaggaacccauauagucaacucuugauuauccacguguggauuauccaccaugcc

SEQ ID NO: 105585 - RNA, 64 nt, hsa
gaauuguuacccccuuuacucagagauaacauagauuauccaggcugagauggaaaacaagccc

SEQ ID NO: 105586 - RNA, 64 nt, hsa
ccucacacugaaacaaaggaagugaugucccauuauuauccacccugagccaccauaauaugcu

SEQ ID NO: 105587 - RNA, 64 nt, hsa
aauucucaagacuaaagacuugagauuauauaaaauuauccagaaucauucagcuaauacuauu

SEQ ID NO: 105588 - RNA, 64 nt, hsa
aaaauagaaagauuggaaaucaccauuguuuccuauuauccacaguguggauggauacuuauuu

SEQ ID NO: 105589 - RNA, 64 nt, hsa
gggauugcaggcaugagccacugcucccggcccuauuauccauaguucuaauccacagggauua

SEQ ID NO: 105590 - RNA, 64 nt, hsa
aaaucauuuggcaucuugaggucugucaugcuuuauuauccauaguuuuugggggguuuuuugu

SEQ ID NO: 105591 - RNA, 64 nt, hsa
aaauuaauaacuggagccucuaaauuuauuauccauuauccagugauggaaaguuguauuucuc

SEQ ID NO: 105592 - RNA, 64 nt, hsa
aaaaacuaaauuaauaacuggagccucuaaauuuauuauccauuauccagugauggaaaguugu

SEQ ID NO: 105593 - RNA, 64 nt, hsa
uucuguguuucuacuugaauuguggaaaagcucuauuauccaauuaacuucuccauaauuauug

SEQ ID NO: 105594 - RNA, 64 nt, hsa
uugcaccagcaugucuugaguuagaggacuuaaaauuauccaguuucuucuguguuucuacuug

SEQ ID NO: 105595 - RNA, 64 nt, hsa
uguuggcucucaaacuuagcaaaauuagcaauauauuauccaaucuucugaacuugaucaagag

SEQ ID NO: 105596 - RNA, 64 nt, hsa
ucugcagaucaagauuuucucauuagaacaaugaauuauccagcauucagaucuuucuagucac

SEQ ID NO: 105597 - RNA, 64 nt, hsa
ugccugccgccgugacugcguuuuaguucucuaaauuauccaagccgauguugcucuguccuuc

SEQ ID NO: 105598 - RNA, 64 nt, hsa
aaaaauaaucacucccuaugaucuaguuaauguaauuauccagucacuguaacuaaucucuuga

SEQ ID NO: 105599 - RNA, 64 nt, hsa
caauaaaaaaaaaccuagugcugauucacagcuuauuauccaauucaaaaauaaauuagaaaaa

SEQ ID NO: 105600 - RNA, 64 nt, hsa
aagucuaaacuguuaaacaacucuuuaaaggauaauuauccaauaaaaaaaaaccuagugcuga

SEQ ID NO: 105601 - RNA, 64 nt, hsa
guccucauucccaagauugaggaggcaguaguuaaucugggaaggcaguagaauggccagcauu

SEQ ID NO: 105602 - RNA, 64 nt, hsa
cuacuugggaggcugaguugggaggauugcugcaaucugggagguggaaguugcagugagccga

SEQ ID NO: 105603 - RNA, 64 nt, hsa
caaauauagccacagaaauaaaggagggaccaauaucugggacagguaauuuugcaaaacacau

SEQ ID NO: 105604 - RNA, 64 nt, hsa
caaauauagccacagaaauaaagaagggacaacaaucugggacagguaauuuugcaaaacacau

SEQ ID NO: 105605 - RNA, 64 nt, hsa
cgaauauagccacagaaauaaaggauggagaaaaaucugggacagguaauuuugcaaaacacau

SEQ ID NO: 105606 - RNA, 64 nt, hsa
cgaacauagccacagaaauaaaggauggagaaaaaucugggacagguaauuuugcaaaagacau

SEQ ID NO: 105607 - RNA, 64 nt, hsa
accaugcccaggucuccugccucacaucacaauaaucugggacccaggcuugugcccuuucagu

SEQ ID NO: 105608 - RNA, 64 nt, hsa
gucuagugaaucagaaaggcuuagccaaggccacaucugggaagaguggagaaauuugccacuu

SEQ ID NO: 105609 - RNA, 64 nt, hsa
gaagugaggagccccuccgcccggcagccaccccaucugggaagugaggagcgucuacgcccgg

SEQ ID NO: 105610 - RNA, 64 nt, hsa
gaagugaggagccccucugccuggccaccaccccaucugggaggugugcccagcagcucauuga

SEQ ID NO: 105611 - RNA, 64 nt, hsa
ggcaggcuccaacccuaagaaggucgaccucaucaucugggagaucgaggugccaaagguaggg

SEQ ID NO: 105612 - RNA, 64 nt, hsa
acacuggacaggugacuguaugguagagacugugaucugggaacuuuuugcuguacaaaucugu

SEQ ID NO: 105613 - RNA, 64 nt, hsa
ccaaauugggaaaugucccagucagaagaagauuaucugggacacugauacugacagggagaug

SEQ ID NO: 105614 - RNA, 64 nt, hsa
uucauacuggagaaaggccuuaugagugcugucaaucugggaaacaucagaaugucugcucucc

SEQ ID NO: 105615 - RNA, 64 nt, hsa
ugaugaucugaaucucugacuuauugauuauggaaccugucaaguaguuuucaacucucccagu

SEQ ID NO: 105616 - RNA, 64 nt, hsa
gggccaggccagaagcugguguccaacagacaccaccugucaaagcugccuuucacaggguucc

SEQ ID NO: 105617 - RNA, 64 nt, hsa
ggggccugcuugcucacuagagagauggauucucaccugucaccugacucgagcccccugcuuc

SEQ ID NO: 105618 - RNA, 64 nt, hsa
aaggcugucuguccauccguccgucuguccaccuaccugucaguccacauaggcuccuggcgug

SEQ ID NO: 105619 - RNA, 64 nt, hsa
cuggaaagucucuuccaguucaucaggguaguagaccugucagauuggaggucaaagucaaaag

SEQ ID NO: 105620 - RNA, 64 nt, hsa
guuuuguggcacauugucugauauauauuguguaaccugucaggugaguugauuuagacaacau

SEQ ID NO: 105621 - RNA, 64 nt, hsa
ccacgcuauaccaucuaccugggcuucgggcaggaccugucagcugggaggcccaaggagaaga

SEQ ID NO: 105622 - RNA, 64 nt, hsa
gcggccccagaguccccgcaccaggcagagccguaccugucacccuccccaagcgccugcaccg

SEQ ID NO: 105623 - RNA, 64 nt, hsa
cagucugugucguguucagugucacaaagcuaccaccugucaccagagccuacugcugcucucc

SEQ ID NO: 105624 - RNA, 64 nt, hsa
cauccucccuugcucacaaaguuacaggguaggcaccugucaggacagaacagcagcagcgcua

SEQ ID NO: 105625 - RNA, 64 nt, hsa
caguagugucaguuuuccuaaucucaguccagguaggaauuaagaaauaucucaaguguugaug

SEQ ID NO: 105626 - RNA, 64 nt, hsa
cuaugguaaugaagaacucuuuggcuuagucagaaggaauuaacgaaccucgguaggaauguau

SEQ ID NO: 105627 - RNA, 64 nt, hsa
auuuauaaggcuuuuucauaaauguauagcaaauaggaauuauuaacuugagcauaagauauga

SEQ ID NO: 105628 - RNA, 64 nt, hsa
aaaauaacuacucacaacauucacuauguuugcaaggaauuaacacaaauaaaagaugccuuuu

SEQ ID NO: 105629 - RNA, 64 nt, hsa
ggcuauuguaauuuacccacauuaucacauuuucaggaauuauaagaauguguuuuauuguacu

SEQ ID NO: 105630 - RNA, 64 nt, hsa
uccuuggagcugaaugcaaggaaugugaauucugaggaauuaagguagaauauauuugacuuuc

SEQ ID NO: 105631 - RNA, 64 nt, hsa
uuuguccucauugaguugacauccaaaauuugucaggaauuaaagaaugacuuuugaguggcaa

SEQ ID NO: 105632 - RNA, 56 nt, hsa
cauccaagacuggacucugaaaaaaaaggaauuauacaaaggaacauaaagaccac

SEQ ID NO: 105633 - RNA, 64 nt, hsa
ugacuguguacccuuuaaaauaucuuuuaauuugaggaauuacauucuaucuaaauuguguguc

SEQ ID NO: 105634 - RNA, 64 nt, hsa
cuaagagaagauauuuuuuaaaugccuuauggauaggaauuaguacuaagcaaugugucuugca

SEQ ID NO: 105635 - RNA, 64 nt, hsa
aucaucauaauuuuugugguucuauuucagguauaggaauuauaaaauaauugguucuuucuaa

SEQ ID NO: 105636 - RNA, 64 nt, hsa
acuuuuuuuuuuuuucagauuccagugugacaugaggaauuagauuuugaagaugagcauauau

SEQ ID NO: 105637 - RNA, 64 nt, hsa
aaagcaaaauguuuuuuccaguuagucuucuucaaggaauuacuauuguuccuuuugucacagg

SEQ ID NO: 105638 - RNA, 64 nt, hsa
uaagcuaguuuaacacuugagcaaaugcuuaagaaggaauuaaaaaaaaaaagcuuugccaaua

SEQ ID NO: 105639 - RNA, 64 nt, hsa
uugaaaugugucauacuguuuuaggaucaagacuaggaauuaggagccagguugacaaggacuu

SEQ ID NO: 105640 - RNA, 64 nt, hsa
guagcauucaugguaaacuuuuaagugcuaagcaaggaauuauuuacugauugguuuuaaagag

SEQ ID NO: 105641 - RNA, 64 nt, hsa
gaauuuuuuaaaaauacauuuuaugguucucuuaaggaauuaauauucacuucugaaggacuua

SEQ ID NO: 105642 - RNA, 64 nt, hsa
uauaaagaaaugaccggugacauuuauucaccaaaggaauuaauauacugagucaaagauuaac

SEQ ID NO: 105643 - RNA, 64 nt, hsa
gaauuuccuuuucccccuuuuuuguguugucuauaggaauuaacuugggauuguuuuguggguu

SEQ ID NO: 105644 - RNA, 64 nt, hsa
auagaguaaguauaagagauaauucauuaguaauaggaauuaacugaccccuuuuggauggggg

SEQ ID NO: 105645 - RNA, 64 nt, hsa
acaaugaguuaaauauaauaacaaugacuuuaugaggaauuaaagguuaagcuuuguguuuacc

SEQ ID NO: 105646 - RNA, 64 nt, hsa
gaaccauuuuacagauuuaaaauaaacagguuugaggaauuaguuuaacuuauccaaaguuucg

SEQ ID NO: 105647 - RNA, 64 nt, hsa
gguaaugaaaagggaggaaaaaaaaagaaggaaaaggaauuauagacccccagggucagccagu

SEQ ID NO: 105648 - RNA, 64 nt, hsa
ugcucaggagcauuggaauccucuucuuccagggaggaauuagccugcaagguuaggacuugaa

SEQ ID NO: 105649 - RNA, 64 nt, hsa
aacuugccauguugagugccauuguauugaacuuauucuaaaggcuuaugcuaacccauuuaua

SEQ ID NO: 105650 - RNA, 64 nt, hsa
aaauuuccuauuuguuccaauacaaacucacuuuauucuaaaguauauuaaugaaaccaguucc

SEQ ID NO: 105651 - RNA, 64 nt, hsa
gaaaaugcacacuuuguuuuuacuuuuccguuucauucuaaagguaguuaagaugaaauuuaua

SEQ ID NO: 105652 - RNA, 64 nt, hsa
gucagccucuuucauagugugcaaacauuuuaucauucuaaauggugacucucugcccuuggac

SEQ ID NO: 105653 - RNA, 64 nt, hsa
gaccuucugcuaccucucauagaauugcucuguaauucuaaauuuaaaauuagaaguagagaga

SEQ ID NO: 105654 - RNA, 64 nt, hsa
uugaugacauaucuuuaaacuuucuugcaucaguauucuaaauugagcaaacugaaagauuuuc

SEQ ID NO: 105655 - RNA, 64 nt, hsa
gcguguugauagcaauaauuuguuucuuuuaaagauucuaaaaggucugagaccuguagcauua

SEQ ID NO: 105656 - RNA, 64 nt, hsa
gcaacuguaaacgaaccugugccucuaacaagcgauucuaaaccaccuaugaguauuucuuuua

SEQ ID NO: 105657 - RNA, 64 nt, hsa
gauaaaguccugaaccuuucaaaauggaaaauuaauucuaaacuuagaaauaugcuucugccua

SEQ ID NO: 105658 - RNA, 64 nt, hsa
auuaaaucuccagcuuacuauaaaugauaucuauauucuaaagagcuacuucuaauuauuccaa

SEQ ID NO: 105659 - RNA, 64 nt, hsa
guaucagauuuuguuagaugcuagaaauggauuuauucuaaaauuuggaacugucguacacauu

SEQ ID NO: 105660 - RNA, 64 nt, hsa
guaguacaagauugaaaaacucaacaagaauuuaauucuaaaagcaaaaauugguuugaguuuu

SEQ ID NO: 105661 - RNA, 64 nt, hsa
auuuuauucucaacagguguaaaacaggcagagcauucuaaaaccacaugguagugcuuuggug

SEQ ID NO: 105662 - RNA, 64 nt, hsa
ugcuccaaaccguuccaagguggggccaguugcgauucuaaaggaagaagcacuaaauggcagg

SEQ ID NO: 105663 - RNA, 64 nt, hsa
caggcauucucuauucuuuucccccuguagacccauucuaaaugugggccugaggucaauggga

SEQ ID NO: 105664 - RNA, 64 nt, hsa
guuuuauuauccuuacuuuuuuuuuaacauuauuauucuaaaggucaaaacugagaagagauua

SEQ ID NO: 105665 - RNA, 64 nt, hsa
auauuucaucuaacugcuuagaacuauaaauagcauucuaaauuugaguaaauacaauuuuuua

SEQ ID NO: 105666 - RNA, 64 nt, hsa
aucacauuuguuguggugcugccaguuuugcuuuauucuaaauuuuguaccaaagcaacuuuag

SEQ ID NO: 105667 - RNA, 64 nt, hsa
cccuugaccagaaauuuuucuucuaaagaauuuaauucuaaaaguuauagacauucccaaagau

SEQ ID NO: 105668 - RNA, 64 nt, hsa
ugucuucauguaccuguauguaaaucccacuuuuauucuaaaauucuuugaauauuuuguuucu

SEQ ID NO: 105669 - RNA, 64 nt, hsa
uuguuaaaauaaauaacauuuaauuugacggaaaauucuaaaaaucaacauuugguaacuuaaa

SEQ ID NO: 105670 - RNA, 64 nt, hsa
uuuuguugaaugcuauggaauauuaauauaauuaauucuaaaauaucaccuaaaauaugucaac

SEQ ID NO: 105671 - RNA, 64 nt, hsa
uuccccuguaaaauuggaauaguaugauuggauuauucuaaaaaggucuuauacucaagagugg

SEQ ID NO: 105672 - RNA, 64 nt, hsa
uuuaaucuugucuuggaaagauaaaaugaccugcauucuaaauuagaauugggguucuguuuaa

SEQ ID NO: 105673 - RNA, 64 nt, hsa
accuuuuuugggggagugacaggaugggguauggauucuaaaaugccuuuucccaaaauguuga

SEQ ID NO: 105674 - RNA, 64 nt, hsa
aagcccuuuuauaccuccccagacuccuucaacaauucuaaaaugauuguaguaaucugcauua

SEQ ID NO: 105675 - RNA, 64 nt, hsa
auagaauuuuuuuuugauaaaggaucacaaaacaauucuaaaaccuaacuguuuuuaccauuga

SEQ ID NO: 105676 - RNA, 64 nt, hsa
uguaugucuuuuguuaacauauuuguuaugccuuauucuaaaauugagucucaaacuggaaugc

SEQ ID NO: 105677 - RNA, 64 nt, hsa
uuaaaaauuuauagaaccauaucaacacugacagauucuaaaauuaaguaguaaauuuaacucc

SEQ ID NO: 105678 - RNA, 64 nt, hsa
uuuagguaguuauuuauacaagagucuuuaagucauucuaaauauuuuuucuugaaaguuuuaa

SEQ ID NO: 105679 - RNA, 64 nt, hsa
cuuucccaugagauaccauguucuaugccuucccauucuaaaaguguggacaacgcuugauuug

SEQ ID NO: 105680 - RNA, 64 nt, hsa
ugagggaagugugauauauuaacaaauauaaccaauucuaaauuuguuuuagcucuaaccucau

SEQ ID NO: 105681 - RNA, 64 nt, hsa
agucuugucuaucagauucccacaaccacuccugauucuaaauuuagugauaugguaaugaaau

SEQ ID NO: 105682 - RNA, 64 nt, hsa
cagauuaaaauguuuacaacaaaauguuaauuauauucuaaauacaggguauguucuaaucuau

SEQ ID NO: 105683 - RNA, 64 nt, hsa
ggcagcagaggaacccaaaggcaguaaaucaaauauucuaaaacccaaaguucauuauuuucau

SEQ ID NO: 105684 - RNA, 64 nt, hsa
uaauauucaucucuugcugucagacccauucuauauucuaaaagcuucugcuccuuccuuccca

SEQ ID NO: 105685 - RNA, 64 nt, hsa
gaggagacaauaguucagaaccuuuuuaagagccauucuaaaagugaccagcaggagggaucua

SEQ ID NO: 105686 - RNA, 64 nt, hsa
gugauuucugugggagggaaucauugcaauguauauucuaaauaaagucaucuaacuauuaaaa

SEQ ID NO: 105687 - RNA, 64 nt, hsa
acaauuguugaggggggaucuagguaauuggcagauucuaaauaauauaauuuccagauaguaa

SEQ ID NO: 105688 - RNA, 64 nt, hsa
aacucuuguaguuuacuguuuuuuuaaguguguaauucuaaaagccaguuuaugauuuaggauu

SEQ ID NO: 105689 - RNA, 64 nt, hsa
aaacuacaguuuuuccaaacuaauaaacugaugaauucuaaauaaguucagagauauagucaua

SEQ ID NO: 105690 - RNA, 64 nt, hsa
agaugccucuuaaaaaugaagauuucagagacccauucuaaacaagggcauucacucucuggaa

SEQ ID NO: 105691 - RNA, 64 nt, hsa
uccuucauuuuacuacuucuuaaaacaagguuggauucuaaagauaaagauuuuggagacucug

SEQ ID NO: 105692 - RNA, 64 nt, hsa
gcaugacugaaaucuaaucacuggaaaccaugugauucuaaauauauuauguaaauguuaaugu

SEQ ID NO: 105693 - RNA, 64 nt, hsa
uaccagcaaagaauauuuuuaauguggauaucuaauucuaaagucuguuccauuagaagcaauu

SEQ ID NO: 105694 - RNA, 64 nt, hsa
uauuguauuuuaaaaaugcauauugaucacuauaauucuaaaacaauuuuuuaaauaaaccagc

SEQ ID NO: 105695 - RNA, 64 nt, hsa
cgugacuucucauuuuaaauaaaauauuuuaggaauucuaaacaucuaaauuuccuaacaaggc

SEQ ID NO: 105696 - RNA, 64 nt, hsa
agguacaauucaguuguuggcuuguuuugacuuaauucuaaaauaggucucaagccuguauuuu

SEQ ID NO: 105697 - RNA, 64 nt, hsa
agcaucauacauagugaaugauguucauuggaaaauucuaaaauuuguccuugucuagguugag

SEQ ID NO: 105698 - RNA, 64 nt, hsa
guuugauuuuaguauuugagauaaauacuuuuacauucuaaacaaguccacucucuguggcuaa

SEQ ID NO: 105699 - RNA, 64 nt, hsa
gugaguggagagaugcagugaggcaguugucauuauucuaaaaauuguacuacuuucacuuuuc

SEQ ID NO: 105700 - RNA, 64 nt, hsa
gucuucggcuugggugaaaugacaguuccucuucauucuaaagguuuacuccauugaauuuaag

SEQ ID NO: 105701 - RNA, 64 nt, hsa
uuucugagaguugaugagguuuaagaacaugaagauucuaaaaggucaguuuuuagagauagau

SEQ ID NO: 105702 - RNA, 64 nt, hsa
acuauuguguuuguuucauaugaauauuuuuguaauucuaaaagagaucuuauuuaaauuuccu

SEQ ID NO: 105703 - RNA, 64 nt, hsa
uaaaugacaauuaucaagguuuuaacaauuuauaauucuaaaccagaggauuauaaagaagugc

SEQ ID NO: 105704 - RNA, 64 nt, hsa
aauagugauuuauuugucaucaaauguacaacuuauucuaaauauuuucauuuucuguguucua

SEQ ID NO: 105705 - RNA, 64 nt, hsa
uagaguucagaguccuuaaaauguaagauuauagauucuaaagauucuauaguucuagacaugg

SEQ ID NO: 105706 - RNA, 64 nt, hsa
uauaguucuagacauggagguucuaaggccuaggauucuaaaaugugauguucuaaggcucuga

SEQ ID NO: 105707 - RNA, 64 nt, hsa
uaguucuaagacucaaauguucuaaguuucuaagauucuaaagguccacaggucuagacuauua

SEQ ID NO: 105708 - RNA, 64 nt, hsa
ccugaagaaaguguaggauagaauuguuuuuagcauucuaaauuuaaaugcuuaaaacgucaau

SEQ ID NO: 105709 - RNA, 64 nt, hsa
uaaaagaagcuuauuguaguauguuugcagaaaaauucuaaacaaaaauuauacagcuuauuag

SEQ ID NO: 105710 - RNA, 64 nt, hsa
auuaaaucuccagauuucuguaaaugauaccuacauucuaaagaguuaauucuaauuauuccga

SEQ ID NO: 105711 - RNA, 64 nt, hsa
gaagauauuaagucccuuucaaaauggaaaauuaauucuaaacugagaaaaauguuccuacuac

SEQ ID NO: 105712 - RNA, 64 nt, hsa; identical to SEQ ID NO: 105710

SEQ ID NO: 105713 - RNA, 64 nt, hsa; identical to SEQ ID NO: 105711

SEQ ID NO: 105714 - RNA, 64 nt, hsa
ugggccacgauuuaaaccaucagagaugacaagccauuugaaauucugacccucagcuuuggga

SEQ ID NO: 105715 - RNA, 64 nt, hsa
acuaagcuguaauuaugauggcugagaaaugauucauuugaagauacaauuuuauuugauauca

SEQ ID NO: 105716 - RNA, 64 nt, hsa
uuucauaugacaauguuaggcaaaggccucccugcauuugaagagcagguuuucauuuauaugu

SEQ ID NO: 105717 - RNA, 64 nt, hsa
agucuuuccucuguugcugaccagauuguguuaccauuugaauacacugacuaauguuuguuaa

SEQ ID NO: 105718 - RNA, 64 nt, hsa
auucuugaaagaaucaacuacagugaauccuuugcauuugaagccuuaacaugcauugcuuuaa

SEQ ID NO: 105719 - RNA, 64 nt, hsa
caauuuugaucuguuaaauuggauuuuacauguacauuugaaugccagaauuucuaaauaaauc

SEQ ID NO: 105720 - RNA, 64 nt, hsa
agguugcugcuguuuccagugaaucacauuucgucauuugaagcccaugaggaccauugugugg

SEQ ID NO: 105721 - RNA, 64 nt, hsa
gcaacaaugcuuguuuuuugguguuuucuuuugacauuugaaaauuuaguacauuguuaaaaug

SEQ ID NO: 105722 - RNA, 64 nt, hsa
ucuuauguauggguuuuuuuuaaugugaucccuucauuugaauauuaauggcuuuuuccauuaa

SEQ ID NO: 105723 - RNA, 64 nt, hsa
uggccuuuuaaccaagaaguaguacuugauuggucauuugaaaacacugcaacagugaacuuuu

SEQ ID NO: 105724 - RNA, 64 nt, hsa
auuguaaaauagcaaacuaaaugcaaagaguuugcauuugaaaauaauaaaguaguugccguau

SEQ ID NO: 105725 - RNA, 64 nt, hsa
ugaaacuguggggcuuacagaaaugacugccggucauuugaaugagaccuggaacaaaucguuu

SEQ ID NO: 105726 - RNA, 64 nt, hsa
gagcuggggucucagggcucagaugagucuguugcauuugaauggggucauagcagguucuggu

SEQ ID NO: 105727 - RNA, 64 nt, hsa
ccccacccagccccuauuuggaccuaaacugugccauuugaacagucacuuccaagcucagucu

SEQ ID NO: 105728 - RNA, 64 nt, hsa
aaaacauugaagguugauauuuuauguggaagaacauuugaauugaauucagaauuuuucugaa

SEQ ID NO: 105729 - RNA, 64 nt, hsa
aaaacuguacaguuuaaaugaaaauguuuuucuucauuugaagaaaauuuguugauaaaccaug

SEQ ID NO: 105730 - RNA, 64 nt, hsa
aauugaaaaugagaaauuaaaccugcaagugaaacauuugaaacgauuauacuuucuacauaag

SEQ ID NO: 105731 - RNA, 64 nt, hsa
uuuauaguccaaacagauuauaaaaaauguuuuccauuugaacuuuacaguuugcaaaagugcu

SEQ ID NO: 105732 - RNA, 64 nt, hsa
augcccuaaugaugcugacuugucaugguugcagcauuugaacuuuugguguuaaaaaaaaaaa

SEQ ID NO: 105733 - RNA, 64 nt, hsa
gcuggugucuggguagucauggauuucugcuggacauuugaaugugauaaacaauccagcauua

SEQ ID NO: 105734 - RNA, 64 nt, hsa
ucuugaaaggcuuuuggugaaaaugaagggauuucauuugaaauuacagcaugaugaauuuugc

SEQ ID NO: 105735 - RNA, 64 nt, hsa
cucaaaauaauggugauacauucuagccuuaagacauuugaauugccgguuguugaggugaauu

SEQ ID NO: 105736 - RNA, 64 nt, hsa
ccguagacuacgaaugucucccuauggcugguagcauuugaagacuaaagacuugucaaauaua

SEQ ID NO: 105737 - RNA, 64 nt, hsa
guuaaaauguaugugccaaguucuacuagaauuccauuugaaauagcaccuuccuuagguuuca

SEQ ID NO: 105738 - RNA, 64 nt, hsa
agauaacccuguggcagugacacgggcaaauuggcauuugaauaaagcccugggaccaccucaa

SEQ ID NO: 105739 - RNA, 64 nt, hsa
cccugauacuauaagcucagcaaguaaccugguacauuugaaauaaaaaccaaauuuuuagauu

SEQ ID NO: 105740 - RNA, 64 nt, hsa
caaagagauuguucugaagaccgugcucuaagggcauuugaaagacugccagguagugcgagcc

SEQ ID NO: 105741 - RNA, 64 nt, hsa
ucaggggugggagaaacuccuuuccuucagcuggcauuugaauguuuccaaaucuauuuuaucu

SEQ ID NO: 105742 - RNA, 64 nt, hsa
cuuggcccuugguaaaauuuugacaaucauaagucauuugaaaagaacagacuuacuaaaauca

SEQ ID NO: 105743 - RNA, 64 nt, hsa
ucccacaacaaauaccaagcaucaaaagcacuuucauuugaaaauuauuauguuguaauuuuuc

SEQ ID NO: 105744 - RNA, 64 nt, hsa
uguggggaaacaauuuuuugugaugaaaaggcagcauuugaauacuccuguuaguagcagaaau

SEQ ID NO: 105745 - RNA, 64 nt, hsa
caaagcugaaaauguguauacacuuaaacuugcacauuugaauucauuugcugaccggaauggu

SEQ ID NO: 105746 - RNA, 64 nt, hsa
ugauggacuuugguuugaacacaauucguuuuuucauuugaauuggcauuucccaauauuugcu

SEQ ID NO: 105747 - RNA, 64 nt, hsa
auuuuuaauugcuuauaacaagcauauuuuguggcauuugaacuauauuuacugcuccaauauc

SEQ ID NO: 105748 - RNA, 64 nt, hsa
ucauuugaccuugccagcugaccuucaaacccugcauuugaaccgaccaacauuaaguccagag

SEQ ID NO: 105749 - RNA, 64 nt, hsa
acuugaauggaauaacgacauuccagaaguuaaucauuugaauucugaacacuggagaaaaacc

SEQ ID NO: 105750 - RNA, 64 nt, hsa
ggaggaguauacaugauucuuguguucauguugucauuugaaacucuucacauaaaauuuucua

SEQ ID NO: 105751 - RNA, 64 nt, hsa
uuaacuugauuauacuauauaauauucucaauuacauuugaauuuaaaaauauugagcucuuga

SEQ ID NO: 105752 - RNA, 64 nt, hsa
gauguuaccuuuggguuuuuaaaagacaagucaucauuugaaaauauauuaggguguguugauu

SEQ ID NO: 105753 - RNA, 64 nt, hsa
uauagggcaguuuggugcaauuuauguuaaaugccauuugaauguaaucaccuguguuaccacg

SEQ ID NO: 105754 - RNA, 64 nt, hsa
ugggcauuuuuaguaggauagacccuuuguucugcauuugaauguuucguauauuuuuguuuca

SEQ ID NO: 105755 - RNA, 64 nt, hsa
cccuuggaaucugaacaaaggaauauaaaauugccauuugaaaacugaccagcuaaucuggacc

SEQ ID NO: 105756 - RNA, 64 nt, hsa
gaaaucucaucguaaggcagcuaguucuaauuugcauuugaauguauaacaaauugcaucacuu

SEQ ID NO: 105757 - RNA, 64 nt, hsa
uuugauucugccuuaagaggguauaaaacuaaaccauuugaaggcacagcccauaagacuauac

SEQ ID NO: 105758 - RNA, 64 nt, hsa
cuaguauguuuuauuauuuuaugggucuugagugcauuugaagguguccuucaguucccacgua

SEQ ID NO: 105759 - RNA, 64 nt, hsa
ccagugaauuaauuucagcuuauaugggugucuucauuugaacaugaggaauauuagguuauau

SEQ ID NO: 105760 - RNA, 64 nt, hsa
uucaaggauccaggaugccaaaaauaugugugaacauuugaaacauuuuuauuugcugcuuuuu

SEQ ID NO: 105761 - RNA, 64 nt, hsa
aaauuuugucugcacuugaguucacuugaguuuacauuugaaaugugcauguuuauuuauauag

SEQ ID NO: 105762 - RNA, 64 nt, hsa
auuaaauaggugaguuguugagcgagaaccccuucauuugaaaagaaaugaguaugcuacuaua

SEQ ID NO: 105763 - RNA, 64 nt, hsa
uucucuggauguuaggaccuaggggaacauugggcauuugaacauaucagggaggguccccauu

SEQ ID NO: 105764 - RNA, 64 nt, hsa
aauuuuucacuuaaagaaaaaaaaugccaugaaacauuugaacugaugagccacagaacuucag

SEQ ID NO: 105765 - RNA, 64 nt, hsa
uaacauaggccaaauucuagagauguuuauagagcauuugaagugcugauaauuuauguuuuuu

SEQ ID NO: 105766 - RNA, 64 nt, hsa
aauguggcagguuagaaagagagagaaugucuuucauuugaagaguguuggacuugugugaaag

SEQ ID NO: 105767 - RNA, 64 nt, hsa
auggagacauuaacaagcuaaugguaauuagaaucauuugaauuuauuuuuuucuaauauguga

SEQ ID NO: 105768 - RNA, 64 nt, hsa
uuuuuagugaagugggcaccuuucuaguccacggcauuugaagagagcgaggagaaccauucug

SEQ ID NO: 105769 - RNA, 64 nt, hsa
aucaacuccaguuuaaaaaguguuauuuuuaaaacauuugaaaccaaguacuguuuaauuucaa

SEQ ID NO: 105770 - RNA, 64 nt, hsa
auccuuuuuccuuaauuuauacaugauccaggcacauuugaaauuugguaggcauugcaaacac

SEQ ID NO: 105771 - RNA, 64 nt, hsa
aggcacauuugaaauuugguaggcauugcaaacacauuugaauauuguguauuucauacuauuc

SEQ ID NO: 105772 - RNA, 64 nt, hsa
gucauguuuauuaccuauaugguuguuuuaauuacauuugaauaauuauauuuuuccaaccacu

SEQ ID NO: 105773 - RNA, 64 nt, hsa
ugcuucguggaaugcugcauuuauauguaagugacauuugaauacuguccuuccugcuuuaucu

SEQ ID NO: 105774 - RNA, 64 nt, hsa
ugggcaaugccuuguuuucuccucugaauauuugcauuugaaaggauugcuuccuguucugcuc

SEQ ID NO: 105775 - RNA, 64 nt, hsa
aguauuuauuuuaaaaaauuauguuuucaucauucauuugaaaaugaaaaagccccaaagugag

SEQ ID NO: 105776 - RNA, 64 nt, hsa
cagaacuauaauauacauugccuuuucucagcagcauuugaauucaacuuauuuauuuccucua

SEQ ID NO: 105777 - RNA, 64 nt, hsa
gaauacuugaagucuuacagucaccuguaccaaacauuugaaaucaacuacaaguacaugggac

SEQ ID NO: 105778 - RNA, 64 nt, hsa
aacaaaugacuuacagccucauccucccuaacuccauuugaacucaacuuagcucacacucagu

SEQ ID NO: 105779 - RNA, 64 nt, hsa
uuuuaugguaaauaguaauacaacuaggucauuucauuugaaaucuaggagucaaauggaaaga

SEQ ID NO: 105780 - RNA, 64 nt, hsa
uaaugauacauuuagacaaaaccccaaacuaagccauuugaaacaagauucucuccauugcagu

SEQ ID NO: 105781 - RNA, 64 nt, hsa
cagggauuguucuugacauaccugacuuuucucacauuugaacuuccacuaucauuguauccau

SEQ ID NO: 105782 - RNA, 64 nt, hsa
uacucuugcugcacuuauguaaacaaucagaccacauuugaagaaacuccaccuauuuugcaaa

SEQ ID NO: 105783 - RNA, 64 nt, hsa
uacaguaacaaucugcuuucuuuguaacaugacacauuugaaaucauugguuauauuaccaaug

SEQ ID NO: 105784 - RNA, 64 nt, hsa
uuuagcuaaauauauacucuucucuaguuuaaaacauuugaacuugccuaguuagugugguugg

SEQ ID NO: 105785 - RNA, 64 nt, hsa
uagaaaaaguccugcuuuaaguaauauguagccacauuugaauccucuaccacaagucuuuuuu

SEQ ID NO: 105786 - RNA, 64 nt, hsa
guaaacugacaggggcuccuguccuguaaaauggcauuugaaucucguucuuuguguccuuacu

SEQ ID NO: 105787 - RNA, 64 nt, hsa
uucaaauaacuaacacgaacuuccagaaaauuaacauuugaacuuagcuguaauucuaaacuga

SEQ ID NO: 105788 - RNA, 64 nt, hsa
agaaaaagcaaaaacaagaacaaaaacaccaaaucauuugaaaucacuguccauuaaaaaaaau

SEQ ID NO: 105789 - RNA, 64 nt, hsa
ugaaacccacuuuggaccaucacacacauuucagcauuugaagugacacaagcuaccugguaac

SEQ ID NO: 105790 - RNA, 64 nt, hsa
uuugcuuaacauuucuacauaauauuuauggucuggucaguauuggucuggucaguauugccug

SEQ ID NO: 105791 - RNA, 64 nt, hsa
uacauaauauuuauggucuggucaguauuggucuggucaguauugccuggcugacgugaaaugu

SEQ ID NO: 105792 - RNA, 64 nt, hsa
agugaccgcucuugcucuugguaaaauauagaguggucaguagccuuaugcaccuaauucaaaa

SEQ ID NO: 105793 - RNA, 64 nt, hsa
uuuuucuacuuugcuuuucucuccauacuuaaauggucaguagcuacugaguggugcuuuaucu

SEQ ID NO: 105794 - RNA, 64 nt, hsa
uacagagaagagaaaagcugcuuugggaccacauggucaguaggcacacugcccccugccaccc

SEQ ID NO: 105795 - RNA, 64 nt, hsa
augcccaggaaugugucagagucaccuccauaauggucaguacagagaagagaaaagcugcuuu

SEQ ID NO: 105796 - RNA, 64 nt, hsa
gacagaagcugugaguggaagacgagggauugccaucgccuaugaggaugagggaagcggcuga

SEQ ID NO: 105797 - RNA, 64 nt, hsa
augccuacuucuuuuccaaauaagcaucagauuuaucgccuauuaugcaguaacagucaauaaa

SEQ ID NO: 105798 - RNA, 64 nt, hsa
cugaaaucucagcagaugcccaccauuucucuagaucgccuagucucaacccauaaaaaggaag

SEQ ID NO: 105799 - RNA, 64 nt, hsa
agcagagcuccugggccugcugccugcacaccacaucgccuaccuacaaugccaaagccucacu

SEQ ID NO: 105800 - RNA, 64 nt, hsa
gcugugggauaaaugugugugggaauauugaaacaucgccuaggaauugugguuuguauauaac

SEQ ID NO: 105801 - RNA, 64 nt, hsa
cuaggaaccucucugccaccaagggcugccauccaucgccuaguaaccacggcaacccaaccua

SEQ ID NO: 105802 - RNA, 64 nt, hsa
gggaaucuccccaagcucacacucucucccgcuuaucgccuauucucacaccucuucucggucc

SEQ ID NO: 105803 - RNA, 64 nt, hsa
gggguuggugggcugucacggagcgacugucgagaucgccuaguauguucugugaacacaaaua

SEQ ID NO: 105804 - RNA, 64 nt, hsa
gaguuagacuccagguacuuuguggucaaaggaaaucgccuagcuccaggcuguguuaggacag

SEQ ID NO: 105805 - RNA, 64 nt, hsa
cauuucaaaauaauuuaugacucauggaauguugaucgccuaaaaaugaacaucgcauuuucuu

SEQ ID NO: 105806 - RNA, 64 nt, hsa
ggauuuccugagaagauaacagugaaacagcguuaucgccuacuuggaaauagucucaacgugc

SEQ ID NO: 105807 - RNA, 64 nt, hsa
acacguccacgugauuggggaggacgcagcgugcaucgccuacauccgccucacccaguacauc

SEQ ID NO: 105808 - RNA, 64 nt, hsa
gaaguucucuaauagauguuacuuuugacaaaagaucgccuaugaguuacaagcaccaggggau

SEQ ID NO: 105809 - RNA, 64 nt, hsa
cucugcugcuucuaccuuuauugcaguuccccaaaucgccuaauaaacuuuccucuugcaaagc

SEQ ID NO: 105810 - RNA, 64 nt, hsa
ccugccaucucugcaguggccgucgccuugauguaucgccuauacauggcagaggacugaacac

SEQ ID NO: 105811 - RNA, 64 nt, hsa
cucacccuccccuccaucugcguugaugcucagaaucgccuaccugugccugcguguaaaccac

SEQ ID NO: 105812 - RNA, 64 nt, hsa
cacacauuuacucugcauuguccccgucuuucccaucgccuagcguuuggggaggaacagggag

SEQ ID NO: 105813 - RNA, 64 nt, hsa
gcaggggaggagggaggggcgccagcaccugaugaucgccuacugucugcggguucuuuuaccu

SEQ ID NO: 105814 - RNA, 64 nt, hsa
caagccccuguaaaucagggaaaaugcgcaacugaucgccuaggagagggccucguaguggcac

SEQ ID NO: 105815 - RNA, 64 nt, hsa
ccugaacguccucaaaugugacauuaacauucccaucgccuaccauuuucugcgcagauaugcu

SEQ ID NO: 105816 - RNA, 64 nt, hsa
aagagaggugagaagugcucccaagcagacacaacagcagcacagaggucuggaggccacacaa

SEQ ID NO: 105817 - RNA, 64 nt, hsa
ccgcccagauuccugcaguggagaggaggucuuccagcagcagcaggucuggagggcugagaau

SEQ ID NO: 105818 - RNA, 64 nt, hsa
cccagauuccugcaguggagaggaggucuuccagcagcagcaggucuggagggcugagaaugaa

SEQ ID NO: 105819 - RNA, 64 nt, hsa
ccccaaguccugguccucucagcccugggcccuucagcagcagcauggaggagggugcugaacc

SEQ ID NO: 105820 - RNA, 64 nt, hsa
caaguccugguccucucagcccugggcccuucagcagcagcauggaggagggugcugaaccucg

SEQ ID NO: 105821 - RNA, 64 nt, hsa
aaggaguaaaacauaguugcuccuaacuuuuuuccagcagcagcaagugguaauaaacaugaaa

SEQ ID NO: 105822 - RNA, 64 nt, hsa
gaguaaaacauaguugcuccuaacuuuuuuccagcagcagcaagugguaauaaacaugaaaacu

SEQ ID NO: 105823 - RNA, 64 nt, hsa
gccucagccagcaccacugccaccagggcaacugcagcagcaucucaugcauaacccuguggcu

SEQ ID NO: 105824 - RNA, 64 nt, hsa
agccgaagcgaaaggggucagggugcugaggcaacagcagcaagggcuggucuggacaagaaaa

SEQ ID NO: 105825 - RNA, 64 nt, hsa
cacgucgagcccccagacucugugcacuucagaccagcagcagcaggagggcucccgagggccu

SEQ ID NO: 105826 - RNA, 64 nt, hsa
gucgagcccccagacucugugcacuucagaccagcagcagcaggagggcucccgagggccuuau

SEQ ID NO: 105827 - RNA, 64 nt, hsa
ugggaccaagagcucucccgccuucucccucgagcagcagcaaggacccugacgcuguccccga

SEQ ID NO: 105828 - RNA, 64 nt, hsa
aggccaaagcaagagcagauucccuaggcaagagcagcagcacaacuaggaaaccccaaagccc

SEQ ID NO: 105829 - RNA, 64 nt, hsa
cuggccugguaaacccagcugggagguuucuaggcagcagcaaaacucugugacaggguguccu

SEQ ID NO: 105830 - RNA, 64 nt, hsa
gggggcccagcagagccugcucccacccuccucccagcagcagacacccacccucucacugacu

SEQ ID NO: 105831 - RNA, 64 nt, hsa
auccgcccagaccccucuccugcccucugcacaccagcagcaggcaugaaccuugggucuggga

SEQ ID NO: 105832 - RNA, 64 nt, hsa
gugguagcagcaacagcagcagcagcagcagcagcagcagcagagaccucuccacuuucccuua

SEQ ID NO: 105833 - RNA, 64 nt, hsa
gcagugguagcagcaacagcagcagcagcagcagcagcagcagcagagaccucuccacuuuccc

SEQ ID NO: 105834 - RNA, 64 nt, hsa
guggcagugguagcagcaacagcagcagcagcagcagcagcagcagcagagaccucuccacuuu

SEQ ID NO: 105835 - RNA, 64 nt, hsa
uugguggcagugguagcagcaacagcagcagcagcagcagcagcagcagcagagaccucuccac

SEQ ID NO: 105836 - RNA, 64 nt, hsa
cucuugguggcagugguagcagcaacagcagcagcagcagcagcagcagcagcagagaccucuc

SEQ ID NO: 105837 - RNA, 64 nt, hsa
cugcucuugguggcagugguagcagcaacagcagcagcagcagcagcagcagcagcagagaccu

SEQ ID NO: 105838 - RNA, 64 nt, hsa
ucccugcucuugguggcagugguagcagcaacagcagcagcagcagcagcagcagcagcagaga

SEQ ID NO: 105839 - RNA, 64 nt, hsa
gucucccugcucuugguggcagugguagcagcaacagcagcagcagcagcagcagcagcagcag

SEQ ID NO: 105840 - RNA, 64 nt, hsa
cacuggcucaagcagcagagguaagaggaagaggcagcagcaucccaagaaggaaagagcugga

SEQ ID NO: 105841 - RNA, 64 nt, hsa
ugauggaagaagcaggaaaagcaagaagaaaagacagcagcaucaagaggaggaggacaucuug

SEQ ID NO: 105842 - RNA, 64 nt, hsa
cacacacauauagcaguagcagcagcagcagcagcagcagcaaccuuugaucaggagugagauu

SEQ ID NO: 105843 - RNA, 64 nt, hsa
acacacacacauauagcaguagcagcagcagcagcagcagcagcaaccuuugaucaggagugag

SEQ ID NO: 105844 - RNA, 64 nt, hsa
cauacacacacacauauagcaguagcagcagcagcagcagcagcagcaaccuuugaucaggagu

SEQ ID NO: 105845 - RNA, 64 nt, hsa
gcacauacacacacacauauagcaguagcagcagcagcagcagcagcagcaaccuuugaucagg

SEQ ID NO: 105846 - RNA, 64 nt, hsa
cacgcacauacacacacacauauagcaguagcagcagcagcagcagcagcagcaaccuuugauc

SEQ ID NO: 105847 - RNA, 64 nt, hsa
gcgcacgcacauacacacacacauauagcaguagcagcagcagcagcagcagcagcaaccuuug

SEQ ID NO: 105848 - RNA, 64 nt, hsa
accagagcuuuaacauuugaagccacuucagcagcagcagcaaaaggcgaacucaucucuaccc

SEQ ID NO: 105849 - RNA, 64 nt, hsa
ggcaccagagcuuuaacauuugaagccacuucagcagcagcagcaaaaggcgaacucaucucua

SEQ ID NO: 105850 - RNA, 64 nt, hsa
cugggcaccagagcuuuaacauuugaagccacuucagcagcagcagcaaaaggcgaacucaucu

SEQ ID NO: 105851 - RNA, 64 nt, hsa
ugagcagcggcuggucucuucccuccaccuggggcagcagcaggaggccuggggaggaggaaaa

SEQ ID NO: 105852 - RNA, 64 nt, hsa
cacugcugucuucccuaccucaccaggcuacuggcagcagcaucccgagagcacaucaucucca

SEQ ID NO: 105853 - RNA, 64 nt, hsa
aaauacugucccacucagcucugcuggcgcaguacagcagcagcagccccagcacagcuguguu

SEQ ID NO: 105854 - RNA, 64 nt, hsa
uacugucccacucagcucugcuggcgcaguacagcagcagcagccccagcacagcuguguuccu

SEQ ID NO: 105855 - RNA, 64 nt, hsa
ccagaagcacccagcccugcccagcaaccggccccagcagcagguccuggugcuggcggagccc

SEQ ID NO: 105856 - RNA, 64 nt, hsa
gggccuggcgagcuggcguggagcccacaggauucagcagcauggacagucacucuugcacuau

SEQ ID NO: 105857 - RNA, 64 nt, hsa
uguuucaaccccacauguauuccaugcucagcagcagcagcagaaauaguaggauauagaucac

SEQ ID NO: 105858 - RNA, 64 nt, hsa
cccuguuucaaccccacauguauuccaugcucagcagcagcagcagaaauaguaggauauagau

SEQ ID NO: 105859 - RNA, 64 nt, hsa
cuccccuguuucaaccccacauguauuccaugcucagcagcagcagcagaaauaguaggauaua

SEQ ID NO: 105860 - RNA, 64 nt, hsa
uaagccuugcaaacaaaaaacaacaaaaaagaagcagcagcagcagccugcuguguggcaucug

SEQ ID NO: 105861 - RNA, 64 nt, hsa
gccuugcaaacaaaaaacaacaaaaaagaagcagcagcagcagccugcuguguggcaucugaac

SEQ ID NO: 105862 - RNA, 64 nt, hsa
cuuuagggaguccccucuuaggacaggcacugcccagcagcaagggcagcagaguugggugcua

SEQ ID NO: 105863 - RNA, 64 nt, hsa
caagaagggacuugccuaaagccacccagcaacucagcagcagaaccaagaugggccccaggcu

SEQ ID NO: 105864 - RNA, 64 nt, hsa
gaagggagaacauaucuauccucucagacccucgcagcagcagcaacucauacuuggcuaauga

SEQ ID NO: 105865 - RNA, 64 nt, hsa
gggagaacauaucuauccucucagacccucgcagcagcagcaacucauacuuggcuaaugauau

SEQ ID NO: 105866 - RNA, 64 nt, hsa
uagaaaaauauuccagcacuugaguuguguguggcagcagcauuugaguccaugaaugcuaugg

SEQ ID NO: 105867 - RNA, 64 nt, hsa
uggacagcccagacccugaaaggacguguggagacagcagcaguccuguggugcaguuacugcc

SEQ ID NO: 105868 - RNA, 64 nt, hsa
uucuuauucugugagauguuuuguauuauuucaccagcagcauagaacaggaccucugcuuuug

SEQ ID NO: 105869 - RNA, 64 nt, hsa
cugaggccacccacugacccaacugauccugcuccagcagcacaccucagccccacugacaccc

SEQ ID NO: 105870 - RNA, 64 nt, hsa
cuccccacaucugaaacugccuccccccaaccaccagcagcagcagggcccuccucccccacca

SEQ ID NO: 105871 - RNA, 64 nt, hsa
cccacaucugaaacugccuccccccaaccaccagcagcagcagggcccuccucccccaccagcu

SEQ ID NO: 105872 - RNA, 64 nt, hsa
gaaagaucgcucugcucggggagccugggcagagcagcagcaacgugagggucgcugugguggu

SEQ ID NO: 105873 - RNA, 64 nt, hsa
gauagaggcgcuguaggagccuggucaucucuaccagcagcagcagcagcgagguucuagccca

SEQ ID NO: 105874 - RNA, 64 nt, hsa
agaggcgcuguaggagccuggucaucucuaccagcagcagcagcagcgagguucuagcccagga

SEQ ID NO: 105875 - RNA, 64 nt, hsa
ggcgcuguaggagccuggucaucucuaccagcagcagcagcagcgagguucuagcccaggaggg

SEQ ID NO: 105876 - RNA, 64 nt, hsa
ggcugugcaccacugggacccagcagcagcucagcagcagcagugagagggccuugggaaagac

SEQ ID NO: 105877 - RNA, 64 nt, hsa
gaaggcugugcaccacugggacccagcagcagcucagcagcagcagugagagggccuugggaaa

SEQ ID NO: 105878 - RNA, 64 nt, hsa
aucacaacaaggaaggcugugcaccacugggacccagcagcagcucagcagcagcagugagagg

SEQ ID NO: 105879 - RNA, 64 nt, hsa
ugggugcucacugccucugcaggugcagaggggucagcagcaggagaagcguguugaacacgug

SEQ ID NO: 105880 - RNA, 64 nt, hsa
aacccguuacauuucaggacgauccuuuuuccuucagcagcauuucuuacuggcuguggcugga

SEQ ID NO: 105881 - RNA, 64 nt, hsa
gcguccuaccaagaccccagcccaacucaagcuacagcagcagcacuucccaagccugcugacc

SEQ ID NO: 105882 - RNA, 64 nt, hsa
uccuaccaagaccccagcccaacucaagcuacagcagcagcacuucccaagccugcugaccaca

SEQ ID NO: 105883 - RNA, 64 nt, hsa
ugcuggccuuguuagacagcacuugggccuuugccagcagcaagaggugaagcgaagccacucu

SEQ ID NO: 105884 - RNA, 64 nt, hsa
gccccucccagcgcugagagccuccccuggcugucagcagcacuguguccaggcucuugucuga

SEQ ID NO: 105885 - RNA, 64 nt, hsa
ucuccacugacagccgccucuggguugaauuccgcagcagcagcaauuggguuggaaagggcuu

SEQ ID NO: 105886 - RNA, 64 nt, hsa
ccacugacagccgccucuggguugaauuccgcagcagcagcaauuggguuggaaagggcuucuu

SEQ ID NO: 105887 - RNA, 64 nt, hsa
ccaagagcaauugcagcagacccagcagcagcagcagcagcacaaacauugcugccuuuguccc

SEQ ID NO: 105888 - RNA, 64 nt, hsa
ggaccaagagcaauugcagcagacccagcagcagcagcagcagcacaaacauugcugccuuugu

SEQ ID NO: 105889 - RNA, 64 nt, hsa
caaggaccaagagcaauugcagcagacccagcagcagcagcagcagcacaaacauugcugccuu

SEQ ID NO: 105890 - RNA, 64 nt, hsa
gcucaaggaccaagagcaauugcagcagacccagcagcagcagcagcagcacaaacauugcugc

SEQ ID NO: 105891 - RNA, 64 nt, hsa
gcugcucaaggaccaagagcaauugcagcagacccagcagcagcagcagcagcacaaacauugc

SEQ ID NO: 105892 - RNA, 64 nt, hsa
uugucucaaaccagucagggccgucaugacuacgcagcagcagcaguuuccaagacgggccaga

SEQ ID NO: 105893 - RNA, 64 nt, hsa
ucucaaaccagucagggccgucaugacuacgcagcagcagcaguuuccaagacgggccagaaac

SEQ ID NO: 105894 - RNA, 64 nt, hsa
gcucagccagucacagcuccaccuccaacuucuacagcagcaauuuuuagugggaaagaacagc

SEQ ID NO: 105895 - RNA, 64 nt, hsa
cugaugcuaaagaagacagacuuucccuuccucccagcagcagcagugcagagcccaccuggag

SEQ ID NO: 105896 - RNA, 64 nt, hsa
augcuaaagaagacagacuuucccuuccucccagcagcagcagugcagagcccaccuggaggga

SEQ ID NO: 105897 - RNA, 64 nt, hsa
gccacgcuagguuaugacgaccugacccaggggacagcagcaggagacuacuccaaagguggcu

SEQ ID NO: 105898 - RNA, 64 nt, hsa
gccucugucugggugggacccccgcgagugcauccagcagcaguagcagggccgcgcccuuggu

SEQ ID NO: 105899 - RNA, 64 nt, hsa
uguuucuccugucccuccuaugcagggcuugcagcagcagcaguguggccaucuccauccccca

SEQ ID NO: 105900 - RNA, 64 nt, hsa
ugcuguuucuccugucccuccuaugcagggcuugcagcagcagcaguguggccaucuccauccc

SEQ ID NO: 105901 - RNA, 64 nt, hsa
uaccuggccaaaacacuggccaggaugcagcaagcagcagcaggggcugacagcaggcuuacug

SEQ ID NO: 105902 - RNA, 64 nt, hsa
uaaaggucaagucugcucucccucgccuaaagugcagcagcagcuccucucaagcucacucucu

SEQ ID NO: 105903 - RNA, 64 nt, hsa
gcaucgggagcacccagagcacccccugcuccaccagcagcauggcauagccccggccccccgc

SEQ ID NO: 105904 - RNA, 64 nt, hsa
ugguggcgguggcugccccggccuccucggagagcagcagcaccaaccacagcaucgggagcac

SEQ ID NO: 105905 - RNA, 64 nt, hsa
caugcugcagccucagaaaccaggccucucacuccagcagcaggcagaaccgugucuguggucg

SEQ ID NO: 105906 - RNA, 64 nt, hsa
ggcgccaucagggccucccuugcccgccugagagcagcagcagucucugucaucccgucgcccc

SEQ ID NO: 105907 - RNA, 64 nt, hsa
aagggcuagugagaccacacagggguagccccagcagcagcacccugcaagccagccuggccag

SEQ ID NO: 105908 - RNA, 64 nt, hsa
gggaagggcuagugagaccacacagggguagccccagcagcagcacccugcaagccagccuggc

SEQ ID NO: 105909 - RNA, 64 nt, hsa
accugccccacuuguccuuagccuggaccucugacagcagcaucucuaccuucuccccagcucc

SEQ ID NO: 105910 - RNA, 64 nt, hsa
ggucuuggaacuugccugccuuuccauccauggccagcagcaccugcccuaccugccccacuug

SEQ ID NO: 105911 - RNA, 64 nt, hsa
accugcuuacucagauacuuacacacaacaacagcagcagcagcugcuacugcaacaaccgcua

SEQ ID NO: 105912 - RNA, 64 nt, hsa
gguaccugcuuacucagauacuuacacacaacaacagcagcagcagcugcuacugcaacaaccg

SEQ ID NO: 105913 - RNA, 64 nt, hsa
gguucuuugucucacugaauucuuaucauggaaacagcagcagcagccgcuaggaaaucuucaa

SEQ ID NO: 105914 - RNA, 64 nt, hsa
ucuuugucucacugaauucuuaucauggaaacagcagcagcagccgcuaggaaaucuucaagug

SEQ ID NO: 105915 - RNA, 64 nt, hsa
ccaagaagcccugcccuccagccacagcaguccacagcagcaggguuaagacucagcacagggc

SEQ ID NO: 105916 - RNA, 64 nt, hsa
uccacagcagcaggguuaagacucagcacagggccagcagcagcacaaccuugaccagagcuug

SEQ ID NO: 105917 - RNA, 64 nt, hsa
acagcagcaggguuaagacucagcacagggccagcagcagcacaaccuugaccagagcuugggu

SEQ ID NO: 105918 - RNA, 64 nt, hsa
accacccagguaugggcagcucccaggccagcagcagcagcagccuacgcuaauaggaccacug

SEQ ID NO: 105919 - RNA, 64 nt, hsa
cagaccacccagguaugggcagcucccaggccagcagcagcagcagccuacgcuaauaggacca

SEQ ID NO: 105920 - RNA, 64 nt, hsa
guccagaccacccagguaugggcagcucccaggccagcagcagcagcagccuacgcuaauagga

SEQ ID NO: 105921 - RNA, 64 nt, hsa
accuagaacacuaacucaccagccccacugccagcagcagcaggugauuggaccaggccauucu

SEQ ID NO: 105922 - RNA, 64 nt, hsa
cccaccuagaacacuaacucaccagccccacugccagcagcagcaggugauuggaccaggccau

SEQ ID NO: 105923 - RNA, 64 nt, hsa
aaguucuaccagagcagacagucacccuacuuuucagcagcaaaacugcccugaugacgcagca

SEQ ID NO: 105924 - RNA, 64 nt, hsa
agugcgcuguucacacccgcuccggagagcaccccagcagcauccagaagcagcugcaguguug

SEQ ID NO: 105925 - RNA, 64 nt, hsa
cuaaacagaaucagugacccgggugcuuuguggccagcagcacagaaucaaacccgcaucccag

SEQ ID NO: 105926 - RNA, 64 nt, hsa
aacucacagcuccuccgggauacauaugugcccucagcagcagcucccaggugaaguuaccaga

SEQ ID NO: 105927 - RNA, 64 nt, hsa
uacaggaguuuaaaacguauagccuacaaaguaccagcagcaaauuagcaaagaagcagugaaa

SEQ ID NO: 105928 - RNA, 64 nt, hsa
aacuuuuaguuacuaaauuauagcuaaguuuugucagcagcauacuccggaaagucucauacuu

SEQ ID NO: 105929 - RNA, 64 nt, hsa
acgacaccauccugacaugagaggccugggccagcagcagcauugccgcuccacaucuuugcuc

SEQ ID NO: 105930 - RNA, 61 nt, hsa
acgacaccauccugacaugagaggccugggccagcagcagcauugccgcuccacaucuuug

SEQ ID NO: 105931 - RNA, 64 nt, hsa
gcagauugaagaccagcaggggcuuccuaaaaagcagcagcagcuggaauuccaaggccaaguc

SEQ ID NO: 105932 - RNA, 64 nt, hsa
ccuuccagguuccuggcagugagaggcagcuucucagcagcaggugcuccuuagccaaauaugg

SEQ ID NO: 105933 - RNA, 64 nt, hsa
aaaaaaaaaaaagucuaccaaaggaauuugcauccagcagcagcacuuagaccugccagccacu

SEQ ID NO: 105934 - RNA, 64 nt, hsa
aaaaaaaaagucuaccaaaggaauuugcauccagcagcagcacuuagaccugccagccacuguc

SEQ ID NO: 105935 - RNA, 64 nt, hsa
gggaaaggggcuugccugaggucacguagauaaucagcagcacauugaacgcugcacuccuggg

SEQ ID NO: 105936 - RNA, 64 nt, hsa
acugccauucaugcauugucagauauuuauuaaacagcagcaaagugccagccaauuuguccug

SEQ ID NO: 105937 - RNA, 64 nt, hsa
ccaguguucgcugugggaucaccuucuggcccuccagcagcaugauggcacgcugucgcccaaa

SEQ ID NO: 105938 - RNA, 64 nt, hsa
agccgauggggccccccaggcccaggcgaaagggcagcagcauguggcccauggcaccaccccc

SEQ ID NO: 105939 - RNA, 64 nt, hsa
uugcagauugucugcagaaacucagacagcucaucagcagcagcagcuguauuguauuuuaccu

SEQ ID NO: 105940 - RNA, 64 nt, hsa
cagauugucugcagaaacucagacagcucaucagcagcagcagcuguauuguauuuuaccucau

SEQ ID NO: 105941 - RNA, 64 nt, hsa
ggaaaccagcacacgcaaaagaugacgcccagcacagcagcaggacacaccaugugccaggaaa

SEQ ID NO: 105942 - RNA, 64 nt, hsa
aaaaccuauacaacaauaagaggagugcgcccuucagcagcauguauacaaaaauugcaacgau

SEQ ID NO: 105943 - RNA, 64 nt, hsa
ggauguucacuguaugccucugagcagagagcagcagcagcagguaccagcacggcccugacug

SEQ ID NO: 105944 - RNA, 64 nt, hsa
aagggauguucacuguaugccucugagcagagagcagcagcagcagguaccagcacggcccuga

SEQ ID NO: 105945 - RNA, 64 nt, hsa
ggugacucgugagugguaccaacaaacucaugagcagcagcaacaacugaauguccugguccug

SEQ ID NO: 105946 - RNA, 64 nt, hsa
agcagcaacaacugaauguccugguccuggcuagcagcagcaccguggugaugcaggaugaguc

SEQ ID NO: 105947 - RNA, 64 nt, hsa
gacaaauaagggaauaaaaucuggccaccccagccagcagcagcaaccuguucaggucgccugc

SEQ ID NO: 105948 - RNA, 64 nt, hsa
aaauaagggaauaaaaucuggccaccccagccagcagcagcaaccuguucaggucgccugccgc

SEQ ID NO: 105949 - RNA, 64 nt, hsa
uauagcaguuguauuguguaacaaguacugcucccagcagcaauuagggagaaaacuagucuaa

SEQ ID NO: 105950 - RNA, 64 nt, hsa
ggcugcuuguaggacuguucaccaagggggauaccagcagcaagagagugcacccguuuagccc

SEQ ID NO: 105951 - RNA, 64 nt, hsa
gcgguagccuccgcagaggcugggggccuccacccagcagcagaccaaccaggaagcagcuuga

SEQ ID NO: 105952 - RNA, 64 nt, hsa
guucugcaccccaagcccuugccccagcccaguccagcagcagauguuacaaucugagugagga

SEQ ID NO: 105953 - RNA, 64 nt, hsa
cggccccuguaggccaaggcgccaggcaggacgacagcagcagcagcgcgucuccuucaggugg

SEQ ID NO: 105954 - RNA, 64 nt, hsa
ccccuguaggccaaggcgccaggcaggacgacagcagcagcagcgcgucuccuucaggugggag

SEQ ID NO: 105955 - RNA, 61 nt, hsa
ccaacucggagcccgccugagcuccagugcccagcagcagcaugucagcugagccuccugc

SEQ ID NO: 105956 - RNA, 64 nt, hsa
ccaacucggagcccgccugagcuccagugcccagcagcagcaugucagcugagccuccugcccu

SEQ ID NO: 105957 - RNA, 64 nt, hsa
uuuuggucccacagaggcaucagcuucagugagacagcagcagccgaugccgcccuuggcuaca

SEQ ID NO: 105958 - RNA, 64 nt, hsa
cagaccccuaugccuuguuccgagcacgaagaaacagcagcagggaugucuaccagccaccucu

SEQ ID NO: 105959 - RNA, 64 nt, hsa
augaaaggugugucuaaaaaacaauucagaauaccagcagcauuguacagcaagggguaaauaa

SEQ ID NO: 105960 - RNA, 64 nt, hsa
gacgucggccauuuaguaauuuaaagcgaauuuccagcagcaagcaugcuuugauaucugguuc

SEQ ID NO: 105961 - RNA, 64 nt, hsa
gaauguuaaggacagcagguagaggaaucaaagccagcagcauccuagaaaggagauggggcuu

SEQ ID NO: 105962 - RNA, 64 nt, hsa
aauggugucuguguuucagacagaagagcugaaucagcagcaacuguccagcgcggagcagcug

SEQ ID NO: 105963 - RNA, 64 nt, hsa
ccugcaccagggaggaguggaggacgagguaacucagcagcaaugucaccuuguagccuaugcg

SEQ ID NO: 105964 - RNA, 64 nt, hsa
gcagcacagucucuauggugcugaggaagagcagcagcagcaggauggugaaguaguaaacugg

SEQ ID NO: 105965 - RNA, 64 nt, hsa
ccagcagcacagucucuauggugcugaggaagagcagcagcagcaggauggugaaguaguaaac

SEQ ID NO: 105966 - RNA, 64 nt, hsa
uggccccaagguugccccgggccagcagcccagccagcagcacagucucuauggugcugaggaa

SEQ ID NO: 105967 - RNA, 64 nt, hsa
agccuugagcuaaguucaggcagcagcauguggccagcagcagugugcugggagcagagguugg

SEQ ID NO: 105968 - RNA, 64 nt, hsa
aggaagugauggagagccuugagcuaaguucaggcagcagcauguggccagcagcagugugcug

SEQ ID NO: 105969 - RNA, 64 nt, hsa
ccuccagcccggucucacccaugguccagucucccagcagcagcaacauccccacgcagccccc

SEQ ID NO: 105970 - RNA, 64 nt, hsa
ccagcccggucucacccaugguccagucucccagcagcagcaacauccccacgcagccccccag

SEQ ID NO: 105971 - RNA, 64 nt, hsa
aggcagacgggagcagguucuuggccagcguagacagcagcaaacagcagcagggaagccauuc

SEQ ID NO: 105972 - RNA, 64 nt, hsa
gagcagguucuuggccagcguagacagcagcaaacagcagcagggaagccauucucacugcauc

SEQ ID NO: 105973 - RNA, 59 nt, hsa
uuaucaucguccaaguuuagcaaucccaucagcagcaguaagaggaaugucucccuccu

SEQ ID NO: 105974 - RNA, 64 nt, hsa
ggccugauuuuaagccuuuugccgcuccggggaccagcagcaauccugggcagccaguggcucu

SEQ ID NO: 105975 - RNA, 64 nt, hsa
ggggcccccgcagcagcagcagcagcagcagcagcagcagcaggcgguggccaggccgggccgg

SEQ ID NO: 105976 - RNA, 64 nt, hsa
cucggggcccccgcagcagcagcagcagcagcagcagcagcagcagcagcaggcgguggccagg

SEQ ID NO: 105977 - RNA, 64 nt, hsa
cggcucggggcccccgcagcagcagcagcagcagcagcagcagcagcagcagcaggcgguggcc

SEQ ID NO: 105978 - RNA, 64 nt, hsa
cggcggcucggggcccccgcagcagcagcagcagcagcagcagcagcagcagcagcaggcggug

SEQ ID NO: 105979 - RNA, 64 nt, hsa
ggccggcggcucggggcccccgcagcagcagcagcagcagcagcagcagcagcagcagcaggcg

SEQ ID NO: 105980 - RNA, 64 nt, hsa
uaaggccggcggcucggggcccccgcagcagcagcagcagcagcagcagcagcagcagcagcag

SEQ ID NO: 105981 - RNA, 64 nt, hsa
ccguaaggccggcggcucggggcccccgcagcagcagcagcagcagcagcagcagcagcagcag

SEQ ID NO: 105982 - RNA, 64 nt, hsa
gauccguaaggccggcggcucggggcccccgcagcagcagcagcagcagcagcagcagcagcag

SEQ ID NO: 105983 - RNA, 64 nt, hsa
ugugauccguaaggccggcggcucggggcccccgcagcagcagcagcagcagcagcagcagcag

SEQ ID NO: 105984 - RNA, 64 nt, hsa
guuaagaugugacugccaucaucuucgugguggccagcagcagcuacaacauggucauccggga

SEQ ID NO: 105985 - RNA, 64 nt, hsa
aguucccucucacuuucaguaaaaauaaauaaaacagcagcagcaaacaaauaaaaugaaauaa

SEQ ID NO: 105986 - RNA, 64 nt, hsa
ucccucucacuuucaguaaaaauaaauaaaacagcagcagcaaacaaauaaaaugaaauaaaag

SEQ ID NO: 105987 - RNA, 64 nt, hsa
acucuaaaacuaucagcagcggcagcagcagcagcagcagcaguuugugaucuguccuuccaac

SEQ ID NO: 105988 - RNA, 64 nt, hsa
uagacucuaaaacuaucagcagcggcagcagcagcagcagcagcaguuugugaucuguccuucc

SEQ ID NO: 105989 - RNA, 64 nt, hsa
accuagacucuaaaacuaucagcagcggcagcagcagcagcagcagcaguuugugaucuguccu

SEQ ID NO: 105990 - RNA, 64 nt, hsa
gacaccuagacucuaaaacuaucagcagcggcagcagcagcagcagcagcaguuugugaucugu

SEQ ID NO: 105991 - RNA, 64 nt, hsa
ucagacaccuagacucuaaaacuaucagcagcggcagcagcagcagcagcagcaguuugugauc

SEQ ID NO: 105992 - RNA, 64 nt, hsa
gaauuuuaaaacauuuugcuuugggaaaguaggucagcagcaccuaagaucaaggaugcguucc

SEQ ID NO: 105993 - RNA, 64 nt, hsa
agcuugaauuauaaaugugguguuuggccugccucagcagcaccaguugacugcucgugugcca

SEQ ID NO: 105994 - RNA, 64 nt, hsa
uggcugugcugcaagcugacuccagccuugggcucagcagcacccggugaacagcagcaggagg

SEQ ID NO: 105995 - RNA, 64 nt, hsa
cucuaccucgcagggcucagcagcacccggugaacagcagcaggaggagccgcuagagcagcug

SEQ ID NO: 105996 - RNA, 64 nt, hsa
ugcaagcuugcuuuagggcugagcccuggacucccagcagcagcacaguucagcauuguguggc

SEQ ID NO: 105997 - RNA, 64 nt, hsa
aagcuugcuuuagggcugagcccuggacucccagcagcagcacaguucagcauuguguggcugg

SEQ ID NO: 105998 - RNA, 64 nt, hsa
uguucagagcuggcaauggcagcgacagcagcaacagcagcagauccaagaagcgggucccuga

SEQ ID NO: 105999 - RNA, 64 nt, hsa
cccaggggcuguucagagcuggcaauggcagcgacagcagcaacagcagcagauccaagaagcg

SEQ ID NO: 106000 - RNA, 64 nt, hsa
ugaggaccucaaggaccccaucaaguguacacagcagcagcaaaaucaagggaugacccuccuc

SEQ ID NO: 106001 - RNA, 64 nt, hsa
uggugaggaccucaaggaccccaucaaguguacacagcagcagcaaaaucaagggaugacccuc

SEQ ID NO: 106002 - RNA, 64 nt, hsa
gcagggggaggggugacagggcgagcccccaccccagcagcagcaauacccccacccuccugcc

SEQ ID NO: 106003 - RNA, 64 nt, hsa
gggggaggggugacagggcgagcccccaccccagcagcagcaauacccccacccuccugcccug

SEQ ID NO: 106004 - RNA, 64 nt, hsa
ugaccccacccauuccaaggcggggucacgguaccagcagcacuuggggugaggccuccaaagc

SEQ ID NO: 106005 - RNA, 64 nt, hsa
gccccuugccaagggaguugggggaaagcagcagcagcagcaggagcgacuagaguuuuuccug

SEQ ID NO: 106006 - RNA, 64 nt, hsa
caagccccuugccaagggaguugggggaaagcagcagcagcagcaggagcgacuagaguuuuuc

SEQ ID NO: 106007 - RNA, 64 nt, hsa
guccaagccccuugccaagggaguugggggaaagcagcagcagcagcaggagcgacuagaguuu

SEQ ID NO: 106008 - RNA, 64 nt, hsa
ggccggcucccccagacucagagggcagcaggagcagcagcagcagcagcagcagcaacaacaa

SEQ ID NO: 106009 - RNA, 64 nt, hsa
cggcucccccagacucagagggcagcaggagcagcagcagcagcagcagcagcaacaacaacaa

SEQ ID NO: 106010 - RNA, 64 nt, hsa
cucccccagacucagagggcagcaggagcagcagcagcagcagcagcagcaacaacaacaacua

SEQ ID NO: 106011 - RNA, 64 nt, hsa
ccccagacucagagggcagcaggagcagcagcagcagcagcagcagcaacaacaacaacuacug

SEQ ID NO: 106012 - RNA, 64 nt, hsa
cagacucagagggcagcaggagcagcagcagcagcagcagcagcaacaacaacaacuacugugc

SEQ ID NO: 106013 - RNA, 64 nt, hsa
acucagagggcagcaggagcagcagcagcagcagcagcagcaacaacaacaacuacugugccuu

SEQ ID NO: 106014 - RNA, 64 nt, hsa
uugcuuccuacaccacguccuugaguggaguucccugcugaagccccuagcacacacugcaugc

SEQ ID NO: 106015 - RNA, 64 nt, hsa
gagcauuuacucugucucccuguggaugaaacugcugcugaaaugguuccaauuuuuaggaauc

SEQ ID NO: 106016 - RNA, 64 nt, hsa
cuaggacgaggagcuggggagcuuccucacaucucugcugaagaagggccucccccaggccccc

SEQ ID NO: 106017 - RNA, 64 nt, hsa
aagccccagcauccccguaggcaucucgcuggggcugcugaagcgggagauggcgcaggguaug

SEQ ID NO: 106018 - RNA, 64 nt, hsa
ucauuguacauagacacauugucucuuuaaaaugcugcugaaauuguagagaguauagccaaaa

SEQ ID NO: 106019 - RNA, 64 nt, hsa
gccuggauacauucuucagcauuuggcaguuaaucugcugaaaccaaaguaagaacugaaugac

SEQ ID NO: 106020 - RNA, 64 nt, hsa
uuugauuuuuugaaugagauauauaaucaaaguacugcugaacugugagugcaguauucuaaac

SEQ ID NO: 106021 - RNA, 64 nt, hsa
agcagcagugcuauaggugggaaauacaguuuagcugcugaauuucuauaccucucugauuuac

SEQ ID NO: 106022 - RNA, 64 nt, hsa
agaguaagagguucuuacuuguacauaggcuuuccugcugaaaacaggccccugcuguacagau

SEQ ID NO: 106023 - RNA, 64 nt, hsa
cauuaaaaaguccagacacacuguauugugaaaacugcugaacauguggcagcaauuuuguguu

SEQ ID NO: 106024 - RNA, 64 nt, hsa
cagacauuuuaauaccaugccagagaagaguauucugcugaaaccaacagguuuuacuggucaa

SEQ ID NO: 106025 - RNA, 64 nt, hsa
ugcugaaaccaacagguuuuacuggucaaaaugacugcugaaaauaauuuucaaguugaaagau

SEQ ID NO: 106026 - RNA, 64 nt, hsa
uauuuuuuaaauuuacagaauauuauauaacccacugcugaaaaagaaaaaaaugauuguuuua

SEQ ID NO: 106027 - RNA, 64 nt, hsa
aaagaaucaacagccaaacugcuggggcugcaagcugcugaagccagggcaugggauuaaagag

SEQ ID NO: 106028 - RNA, 64 nt, hsa
aaagaaaaaggggcugcuuuccaaaggcaagaaacugcugaaaaagcugggugcagugaaauga

SEQ ID NO: 106029 - RNA, 64 nt, hsa
gcaagcuugaagccccuuggcuuacagcauuugccugcugaauacuaaacacucacauggcaag

SEQ ID NO: 106030 - RNA, 64 nt, hsa
cacacaugaaaagccaaauuauggcuuggauguucugcugaaacuggucuaugucauacugucu

SEQ ID NO: 106031 - RNA, 64 nt, hsa
ccucgggauugguaucaaaggcuuccacugccuucugcugaaggcaugauguaugcggcuccac

SEQ ID NO: 106032 - RNA, 64 nt, hsa
uccccccagguacgauagggacugaauauggacccugcugaaagcaguguauugacgcauauuu

SEQ ID NO: 106033 - RNA, 64 nt, hsa
aguguguggcaguucucgcagauguuaccuaaaacugcugaacuugaccggcagaauguucugc

SEQ ID NO: 106034 - RNA, 64 nt, hsa
cuuauugucacaagaguacaguuaaugcugcgugcugcugaacucuguugggugaacugguauu

SEQ ID NO: 106035 - RNA, 64 nt, hsa
ugguugucuucagcugacaguaugaaaaaugaaacugcugaaaaagcugagcaccuggucaccc

SEQ ID NO: 106036 - RNA, 64 nt, hsa
augagcuaaguuguuauuucuuucauucauaucccugcugaaauauugguacuagcaacuuaaa

SEQ ID NO: 106037 - RNA, 64 nt, hsa
uggggagcaaagagggcagccugacuagaugccccugcugaaucugguacuuucugcacagccu

SEQ ID NO: 106038 - RNA, 64 nt, hsa
uguuuuuucucucacccuggcuuugucaagucuacugcugaacccauugaaggcauucuucaac

SEQ ID NO: 106039 - RNA, 64 nt, hsa
auauuuccauuugauucuuacaauuuucauauaucugcugaaauuccccaucuuuucaugcaug

SEQ ID NO: 106040 - RNA, 64 nt, hsa
uggugcuuuggauuugaaaagggucugauggggagaaggagaacguaucauccuagcuuccucu

SEQ ID NO: 106041 - RNA, 64 nt, hsa
cugcuguucccuuugcucuugauuaggagagauggaaggagaugagcucccauaacugaauugg

SEQ ID NO: 106042 - RNA, 64 nt, hsa
ccucacuccuuuuacucacugggcucaugacagugaaggagaugcuccaucugcuucucccccu

SEQ ID NO: 106043 - RNA, 64 nt, hsa
cuaagcaaucauuuuuccccccagaaguuacuuagaaggagaacugggaacacuuggggucucu

SEQ ID NO: 106044 - RNA, 64 nt, hsa
cuguagcuccagcuugucucccuggcuucucuuugaaggagaaaaauguaaaauaugcacugag

SEQ ID NO: 106045 - RNA, 64 nt, hsa
cuuugcagaggggcggggggugaggcuuagcccagaaggagaacugagcaggaaaccaaggcuc

SEQ ID NO: 106046 - RNA, 64 nt, hsa
gcccuuucugccguuaauaagaaggagaauagcugaaggagagagauauuuuauuaauuuccug

SEQ ID NO: 106047 - RNA, 64 nt, hsa
gcagcaaucaacaagcccuuucugccguuaauaagaaggagaauagcugaaggagagagauauu

SEQ ID NO: 106048 - RNA, 64 nt, hsa
cuggcccugccagcugguaguccaucagcacaaugaaggagacuuggagaagaggaagaauaac

SEQ ID NO: 106049 - RNA, 64 nt, hsa
ggaaggcggggcaggcagccuguugcaggcaggggaaggagaagagacugaggggcugugaccu

SEQ ID NO: 106050 - RNA, 64 nt, hsa
aacuggaaagguccccuuccccaggggagccugcgaaggagagguucuguagaauccaagccca

SEQ ID NO: 106051 - RNA, 64 nt, hsa
ugaggugucaaauacaaauaaaucugggcuuagggaaggagagaccuuauuccaaagcacgauu

SEQ ID NO: 106052 - RNA, 64 nt, hsa
cagguuuucuguugcacaaggacgggucaggaaggaaggagaggcuuuuccagaaacaaaaaau

SEQ ID NO: 106053 - RNA, 64 nt, hsa
uggguaagauuggccagagguaggaauguggggagaaggagaggcugaaaagaaagcagaggag

SEQ ID NO: 106054 - RNA, 64 nt, hsa
cucugucucgaaagaaagaaagaaaaaaaggaaggaaggagaaggaaggaaggagaagaaaagg

SEQ ID NO: 106055 - RNA, 64 nt, hsa
aaagaaagaaaaaaaggaaggaaggagaaggaaggaaggagaagaaaagguaccuguucuacgu

SEQ ID NO: 106056 - RNA, 64 nt, hsa
aaaaagaaagaaagaaaagaagaagaaaagagaagaaggagaaggagaugaaggaggaggagga

SEQ ID NO: 106057 - RNA, 64 nt, hsa
aaagaaagaaaagaagaagaaaagagaagaaggagaaggagaugaaggaggaggaggaggagaa

SEQ ID NO: 106058 - RNA, 64 nt, hsa
agaaggagaaggagaugaaggaggaggaggaggagaaggagaagaagaagaagaagaagaccac

SEQ ID NO: 106059 - RNA, 64 nt, hsa
auuacguccaccaaagacccguguuggggguacugaaggagaggcccugggggacccucugaag

SEQ ID NO: 106060 - RNA, 64 nt, hsa
uuaugucaucugcuucuccccuguuggggcuaaggaaggagauagguggcuccuaaaagaggag

SEQ ID NO: 106061 - RNA, 64 nt, hsa
uuuucugaaaaauacauuuagauuaguuuaguuugaaggagaggugggcugauggcugaguugu

SEQ ID NO: 106062 - RNA, 64 nt, hsa
auauucccucaaaucccuccucuuacuccaugcugaaggagaaguacucucagaugcauuaugu

SEQ ID NO: 106063 - RNA, 64 nt, hsa
ucucaaccaucccacuaaguuauagccaagaagggaaggagacacggggauuugggguucucug

SEQ ID NO: 106064 - RNA, 64 nt, hsa
augcuuugggcuuucuccuucuguggccccggaggaaggagagacugaggcaaggcaaagugau

SEQ ID NO: 106065 - RNA, 64 nt, hsa
aacccaguuagccaagauguuggaugcguugcuagaaggagaaauagaagaccuugaccugcug

SEQ ID NO: 106066 - RNA, 64 nt, hsa
cauauuguuuggagacuuccagauggcucugcacgaaggagaaccacgcauuuaugaagacauc

SEQ ID NO: 106067 - RNA, 64 nt, hsa
aaauguaaaacuuuuaagguauaucauuauaacugaaggagaaggugccccaaaaugcaagauu

SEQ ID NO: 106068 - RNA, 64 nt, hsa
gcuuguaacuccaccaacccaucagaaggagaaggaaggagacucaccucugccucaaugugaa

SEQ ID NO: 106069 - RNA, 64 nt, hsa
uccuucccuggcuuguaacuccaccaacccaucagaaggagaaggaaggagacucaccucugcc

SEQ ID NO: 106070 - RNA, 64 nt, hsa
agccagaggggcagccaccuugcaugagggugaggaaggagaagcccagccagccucuacccau

SEQ ID NO: 106071 - RNA, 64 nt, hsa
ucugggccacuugcuuaauugcauuucuggcagggaaggagaggagggauggagaagcucugcu

SEQ ID NO: 106072 - RNA, 64 nt, hsa
uugagcuccugggcaagaacaccuuugaguuccugaaggagaauaacuuccagccuuacccccu

SEQ ID NO: 106073 - RNA, 64 nt, hsa
uuugggaugagaacagcucugacggccgguaugugaaggagaacugcaaaccucugaaggucag

SEQ ID NO: 106074 - RNA, 64 nt, hsa
aaacccaggagguagcuggcagaguagcugucaggaaggagaaagguucuuucuggcugguugu

SEQ ID NO: 106075 - RNA, 64 nt, hsa
ccaguucugaggagaggaggucuucaguacuauugaaggagacauugaucuucuggauguacag

SEQ ID NO: 106076 - RNA, 64 nt, hsa
ugaccuggaaugggggccuuugucaaacacuguugaaggagaggcugaugugucugugauggug

SEQ ID NO: 106077 - RNA, 64 nt, hsa
gcccugccugacgauguaucgaaaagaugagagugaaggagacuuugugcagcaggaaacgggu

SEQ ID NO: 106078 - RNA, 64 nt, hsa
caggccacucucuucccuuucuuggugaaguaaggaaggagaaagugguuacuagccaggcaua

SEQ ID NO: 106079 - RNA, 64 nt, hsa
gccagacugugaccaggaaacagcucaucccagagaaggagaugcuuaacaaaaaaaaauugaa

SEQ ID NO: 106080 - RNA, 64 nt, hsa
cauaaaaccuagugagcuaaaggcuuugucugcagaaggagaucaagaggcuggggguaaggcc

SEQ ID NO: 106081 - RNA, 64 nt, hsa
ugacccccaggggcugacauucuagggggagauagaaggagacaaacguagaagguagaauaag

SEQ ID NO: 106082 - RNA, 64 nt, hsa
agggagugcugagugccacaggaagucagacaaggaaggagaguguggggcaggugccguuuaa

SEQ ID NO: 106083 - RNA, 64 nt, hsa
aacuugcucugaacugcacccaggaggugacugggaaggagaaaaccagcaaaggaagcucugc

SEQ ID NO: 106084 - RNA, 64 nt, hsa
ccacauccccugacgaagcuuguccagauggcaggaaggagaacggaugcuugucuggccauga

SEQ ID NO: 106085 - RNA, 64 nt, hsa
uugaaagcugugcucagaggaggugagaggagaggaaggagaaaacugcaucauaacuuuacag

SEQ ID NO: 106086 - RNA, 64 nt, hsa
auauuuuuuccuuucaaaucagacgaugagacuagaaggagaaauacuuucugucuuauuaaaa

SEQ ID NO: 106087 - RNA, 64 nt, hsa
ugccccugugggacucauccuugcccaggugagggaaggagacaggaugaggucucgacccugu

SEQ ID NO: 106088 - RNA, 64 nt, hsa
uuccccaaaggaaccgcccagugcagguauuucagaaggagaaggcuggagaaggacaugagau

SEQ ID NO: 106089 - RNA, 64 nt, hsa; identical to SEQ ID NO: 82429

SEQ ID NO: 106090 - RNA, 64 nt, hsa; identical to SEQ ID NO: 82430

SEQ ID NO: 106091 - RNA, 64 nt, hsa; identical to SEQ ID NO: 82431

SEQ ID NO: 106092 - RNA, 64 nt, hsa; identical to SEQ ID NO: 82432

SEQ ID NO: 106093 - RNA, 64 nt, hsa; identical to SEQ ID NO: 82433

SEQ ID NO: 106094 - RNA, 64 nt, hsa; identical to SEQ ID NO: 82434

SEQ ID NO: 106095 - RNA, 64 nt, hsa; identical to SEQ ID NO: 82435

SEQ ID NO: 106096 - RNA, 64 nt, hsa; identical to SEQ ID NO: 82436

SEQ ID NO: 106097 - RNA, 64 nt, hsa; identical to SEQ ID NO: 82437

SEQ ID NO: 106098 - RNA, 64 nt, hsa; identical to SEQ ID NO: 82438

SEQ ID NO: 106099 - RNA, 64 nt, hsa; identical to SEQ ID NO: 82439

SEQ ID NO: 106100 - RNA, 64 nt, hsa; identical to SEQ ID NO: 82440

SEQ ID NO: 106101 - RNA, 64 nt, hsa; identical to SEQ ID NO: 82441

SEQ ID NO: 106102 - RNA, 64 nt, hsa; identical to SEQ ID NO: 82442

SEQ ID NO: 106103 - RNA, 64 nt, hsa; identical to SEQ ID NO: 82443

SEQ ID NO: 106104 - RNA, 64 nt, hsa; identical to SEQ ID NO: 82444

SEQ ID NO: 106105 - RNA, 64 nt, hsa; identical to SEQ ID NO: 82445

SEQ ID NO: 106106 - RNA, 64 nt, hsa; identical to SEQ ID NO: 82446

SEQ ID NO: 106107 - RNA, 64 nt, hsa; identical to SEQ ID NO: 82447

SEQ ID NO: 106108 - RNA, 64 nt, hsa; identical to SEQ ID NO: 82448

SEQ ID NO: 106109 - RNA, 64 nt, hsa; identical to SEQ ID NO: 82449

SEQ ID NO: 106110 - RNA, 64 nt, hsa; identical to SEQ ID NO: 82450

SEQ ID NO: 106111 - RNA, 64 nt, hsa; identical to SEQ ID NO: 82451

SEQ ID NO: 106112 - RNA, 64 nt, hsa; identical to SEQ ID NO: 82452

SEQ ID NO: 106113 - RNA, 64 nt, hsa; identical to SEQ ID NO: 82453

SEQ ID NO: 106114 - RNA, 64 nt, hsa; identical to SEQ ID NO: 82454

SEQ ID NO: 106115 - RNA, 64 nt, hsa; identical to SEQ ID NO: 82455

SEQ ID NO: 106116 - RNA, 64 nt, hsa; identical to SEQ ID NO: 82456

SEQ ID NO: 106117 - RNA, 64 nt, hsa; identical to SEQ ID NO: 82457

SEQ ID NO: 106118 - RNA, 64 nt, hsa; identical to SEQ ID NO: 82458

SEQ ID NO: 106119 - RNA, 64 nt, hsa; identical to SEQ ID NO: 82459

SEQ ID NO: 106120 - RNA, 64 nt, hsa; identical to SEQ ID NO: 82460

SEQ ID NO: 106121 - RNA, 64 nt, hsa; identical to SEQ ID NO: 82461

SEQ ID NO: 106122 - RNA, 64 nt, hsa; identical to SEQ ID NO: 82462

SEQ ID NO: 106123 - RNA, 64 nt, hsa; identical to SEQ ID NO: 82463

SEQ ID NO: 106124 - RNA, 64 nt, hsa; identical to SEQ ID NO: 82464

SEQ ID NO: 106125 - RNA, 64 nt, hsa
cagagaggaccccacuggacuggguuuugucucugcaucucauuguagagcuugguggcugagc

SEQ ID NO: 106126 - RNA, 64 nt, hsa
ggaguugacgcauccugcaguugggccagcugucgcaucucagcggggcgcacauguuauccac

SEQ ID NO: 106127 - RNA, 64 nt, hsa
ggcggggggcgucucagcacccuccccagggggugcaucucagcccccucuuuccguccuuccc

SEQ ID NO: 106128 - RNA, 64 nt, hsa
ccccccugcugccagccucccccguccccaacaugcaucucacucugggugucuuggucuuuua

SEQ ID NO: 106129 - RNA, 64 nt, hsa
aaaugacugcaguaaccagguaauauuggcaaaggcaucucaggaacaucaccuuagugaggaa

SEQ ID NO: 106130 - RNA, 64 nt, hsa
agauaacuuagaacagccuaugggaaguagucaugcaucucagguuuguucugagacaccugau

SEQ ID NO: 106131 - RNA, 64 nt, hsa
uaggagaacagagacccgagggcugcuuugggggaggggggaacucgagaauguauggauuuac

SEQ ID NO: 106132 - RNA, 64 nt, hsa
aaaaaaggaacuaaguucagcgagggguggggggaggggggagauuuuucuuuugaaaaauaau

SEQ ID NO: 106133 - RNA, 64 nt, hsa
gggaaagugaaaagcuccuuagcccuggggcuugaggggggaaagggguaggguggguaagagu

SEQ ID NO: 106134 - RNA, 64 nt, hsa
cucuccaugacucuugacauccuagcuucuucuaaggggggagggaaaggggggagauuuuuau

SEQ ID NO: 106135 - RNA, 64 nt, hsa
uugacauccuagcuucuucuaaggggggagggaaaggggggagauuuuuauauauauauacaua

SEQ ID NO: 106136 - RNA, 64 nt, hsa
uggagggggccaccggggcagggagggggcggcaaggggggaaugggaguugucuccccuucuc

SEQ ID NO: 106137 - RNA, 64 nt, hsa
uccuucucucuucuuggucucuacucccagggggaggggggaacuuacucuaggaaaagccaug

SEQ ID NO: 106138 - RNA, 64 nt, hsa
ggagguugcuguacaggaaaaaccgagauaggggaggggggagggggaagcaaaggggggaggu

SEQ ID NO: 106139 - RNA, 64 nt, hsa
aaaccgagauaggggaggggggagggggaagcaaaggggggaggucaaaucccaaaccauuacu

SEQ ID NO: 106140 - RNA, 64 nt, hsa
aggauauccaaggccacuacauugaggaggggggaggggggagggaggagaaggguuacuugcu

SEQ ID NO: 106141 - RNA, 64 nt, hsa
aacaaacaggauauccaaggccacuacauugaggaggggggaggggggagggaggagaaggguu

SEQ ID NO: 106142 - RNA, 64 nt, hsa
caaaauaaaaacaauaauucaaguaacaaugcccggaauauacguccuaacuacaccccuuccu

SEQ ID NO: 106143 - RNA, 64 nt, hsa
aaacaguggcagcagauuuuaaguuaaagaauauggaauauaguaaaauaaguaaauuucuuuu

SEQ ID NO: 106144 - RNA, 55 nt, hsa
ggcuucaugcuggagaguaaaauuuggaauauaaugaguaugggaagauuuguau

SEQ ID NO: 106145 - RNA, 64 nt, hsa
gauuaggagaaggcauaugacaguagagaggacuggaauauagaggagaauauaagcauguaga

SEQ ID NO: 106146 - RNA, 64 nt, hsa
guuuguaaaaauauacugauuuugaaaaguaucaggaauauaaauauuugguaauucuguguaa

SEQ ID NO: 106147 - RNA, 64 nt, hsa
ggcuuuuuccauggggcuauaguagagaguuaguggaauauagacaggacucugaaaacacaac

SEQ ID NO: 106148 - RNA, 64 nt, hsa
uaaaguuuucauuugugccacaaaaaucugucguggaauauauuuuauuuucauuaauucagug

SEQ ID NO: 106149 - RNA, 64 nt, hsa
aauaggacauugaguuuccaaguauugagauaagggaauauaaauaguauuauauguaucagga

SEQ ID NO: 106150 - RNA, 64 nt, hsa
uggaauauauauauuauauauauaaaauacauauggaauauauauauuuuauauauauauauau

SEQ ID NO: 106151 - RNA, 64 nt, hsa
auauuauauauauuuuuauauauauaauauauauggaauauauauauuauauauauaaaauaca

SEQ ID NO: 106152 - RNA, 64 nt, hsa
cagaucacucaagaggcagcauagcaauguaaaaggaauauaaguagguguuggaugccuuuuu

SEQ ID NO: 106153 - RNA, 64 nt, hsa
gguguuggaugccuuuuuccuagaccaggaauggggaauauauaacaccugugccaccgcucuu

SEQ ID NO: 106154 - RNA, 64 nt, hsa
uauauuuucuuaaaaaauaccagcaguuacucauggaauauauucugcguuuauaaaacuaguu

SEQ ID NO: 106155 - RNA, 64 nt, hsa
ucaauaauugaguaauuuuagaagcauuauuuuaggaauauauaguugucacaguaaauaucuu

SEQ ID NO: 106156 - RNA, 64 nt, hsa
gccuauaauuauauauacauuccauagucaucaaggaauauauugugcagagagaguauccuug

SEQ ID NO: 106157 - RNA, 64 nt, hsa
ugccuuuguuagguggagaagaaaugucucuagaggaauauaaauaccugauuucuugucaucg

SEQ ID NO: 106158 - RNA, 64 nt, hsa
ccgaggggccucacuguuagaaggaaaacuaacaggaauauaaucaacaucaacaaaggacauc

SEQ ID NO: 106159 - RNA, 64 nt, hsa
gauaaaacgaacaaaagaauuagaauuccugcggggaauauauacaagacuuuauuuagucaag

SEQ ID NO: 106160 - RNA, 64 nt, hsa
ggaauauauacauauauuccacauguguguauguggaauauauuccacauguguauauauucca

SEQ ID NO: 106161 - RNA, 64 nt, hsa
cauauauauacauauauuccacauguguguauguggaauauauuccacauguguguauguggaa

SEQ ID NO: 106162 - RNA, 64 nt, hsa
aagcacuucaaaacagaagggcaaauggaaaaggggaauauaaaacaaaccaauaaaaauacca

SEQ ID NO: 106163 - RNA, 64 nt, hsa
gcuguuaaaauuauuuuuuugucuuacaauucagggaauauauuuauauuuuucuaugaaaagu

SEQ ID NO: 106164 - RNA, 64 nt, hsa
acuugaagcuaacguuagaauagugguuaacagagcuaagaaauaaggcuaaccaucgaaaaga

SEQ ID NO: 106165 - RNA, 64 nt, hsa
aaaauaaauuacaauugaucugucauccauauuugcuaagaaugucuauuuccaagaaccuaua

SEQ ID NO: 106166 - RNA, 64 nt, hsa
gugcuucucagugggaagguguaaggaggggcuugcuaagaauuugagcacauguagcuaauuu

SEQ ID NO: 106167 - RNA, 64 nt, hsa
cuaagcuuuuuuuuuuuuuuuuuuuccaguuaaugcuaagaaaagauuuggggaagguuauaau

SEQ ID NO: 106168 - RNA, 64 nt, hsa
ccugacauugccauugagggcuuuguuaccacaagcuaagaaacugaguuuaacagcccaguua

SEQ ID NO: 106169 - RNA, 64 nt, hsa
gacucugugacgacaaaaguacaaacagucugaggcuaagaaagguucaucucacaacaggaaa

SEQ ID NO: 106170 - RNA, 64 nt, hsa
gcuaaaggagcauguucuaacccaaugcaaggaagcuaagaaccuugaaaaaagguuagaggaa

SEQ ID NO: 106171 - RNA, 64 nt, hsa
cauacaauacacuaacauuaacaauagcugaugagcuaagaaaaaaaaaaagucugugcauagu

SEQ ID NO: 106172 - RNA, 64 nt, hsa
aaaggcacuaaauccuuuccugacaauggcagagucucuagagguagaaauuugccuugcugca

SEQ ID NO: 106173 - RNA, 64 nt, hsa
cacaucccauggaggugaggauuuucacuucuuuucucuagacuuggaagcugagauucagaga

SEQ ID NO: 106174 - RNA, 64 nt, hsa
augguuccuggaccccccaguucuguguggcucuucucuagaggagcauugaccccccugaauc

SEQ ID NO: 106175 - RNA, 64 nt, hsa
uuccuagaauaagaggugagaaucucaugauuugucucuagaugugggaggauuguguguaacc

SEQ ID NO: 106176 - RNA, 64 nt, hsa
uccguuuucauugucaagaauguuacuguaguauucucuagaacuucaaugucuuuguggacau

SEQ ID NO: 106177 - RNA, 64 nt, hsa
guuuaauuuuuaagcucuuugccaauauuccauuucucuagaauguuuauccuaagcacuuguu

SEQ ID NO: 106178 - RNA, 64 nt, hsa
uuggauucaaugagugggaaauacauugugccuuucucuagaugugauacguuauaccaaaauc

SEQ ID NO: 106179 - RNA, 64 nt, hsa
aauaggaaucaauaguuaguagugacauuggugcucucuagaaaucucagcaugagcugcuaua

SEQ ID NO: 106180 - RNA, 64 nt, hsa
ggccaugcaaccaggugauuuuuaggaauagaugucucuagacucugucuccuuuccuacaagg

SEQ ID NO: 106181 - RNA, 64 nt, hsa
ugguuaggaaaacaaaacugcuuagaagccccuuucucuagagcaguuuuaugucauuuguaaa

SEQ ID NO: 106182 - RNA, 64 nt, hsa
caagugauuuugauguauucuaauuuugagaccaucucuagaaaagaauugcuaccucuuguau

SEQ ID NO: 106183 - RNA, 64 nt, hsa
ugcugugggugcuaacaccucagagcuguccucuucucuagaguggagguuuucaaagugcauc

SEQ ID NO: 106184 - RNA, 64 nt, hsa
guuggguuuucccuugccuuaugggcugaaguguucucuagaauccagcaggucacacuggggg

SEQ ID NO: 106185 - RNA, 64 nt, hsa
acacggaccucgggcuaguuaaggugugcaaagaucucuagaguuuaguccuuacugucucacu

SEQ ID NO: 106186 - RNA, 64 nt, hsa
cccuggguucuguucugugugggccuguggggagucucuagacaagaucuuuuccaggcccuga

SEQ ID NO: 106187 - RNA, 64 nt, hsa
ugggagaggaaucuaagaaccagauggcuucagcucucuagaggagcugagccuauucacagug

SEQ ID NO: 106188 - RNA, 64 nt, hsa
uccagaacccagcccagaucggaggacaaguuccucucuagaacccaauccaauuuggagcccc

SEQ ID NO: 106189 - RNA, 64 nt, hsa
uuggagccccagcccaacuccagaacccaacccuucucuagaauccagcccagaucugaggcca

SEQ ID NO: 106190 - RNA, 64 nt, hsa
cccccagaucugucuggucugaauggacgcccagcucaucuaggguggacccagcugcugggga

SEQ ID NO: 106191 - RNA, 64 nt, hsa
ccacuuuggcgagcguccugcuuccgcccucgcccucaucuacgcugcuccgcuuuccucagac

SEQ ID NO: 106192 - RNA, 64 nt, hsa
cauucuggaauucucaucuaaugguucacuggcucucaucuauuguuuaacucacuaguuuaua

SEQ ID NO: 106193 - RNA, 64 nt, hsa
ccacccaagaaaauuuucuuagcauucuggaauucucaucuaaugguucacuggcucucaucua

SEQ ID NO: 106194 - RNA, 64 nt, hsa
agaacugcacgguacaaacccaaaaaagaacaagcucaucuauuuggaacccaagccucauauu

SEQ ID NO: 106195 - RNA, 64 nt, hsa
gaaaucugggauguacuguuugcugccacacugucucaucuaguaccuuuggaguagguuuacc

SEQ ID NO: 106196 - RNA, 64 nt, hsa
gauugcuugagcccaggaguucgaggcugcagucagucaugauggcaccacugcacuccagccu

SEQ ID NO: 106197 - RNA, 64 nt, hsa
auuucuugguaagaagccgggaacagacaacagaagucaugaagcccaagugaaaucaaaggug

SEQ ID NO: 106198 - RNA, 64 nt, hsa
uacucagcuauccauuauaguuuugcccuuaagaagucaugauuaacuuaugaaaaaauuauuu

SEQ ID NO: 106199 - RNA, 64 nt, hsa
aaucaucugugaguuccuucagguucucacucauagucaugauccuucagagggaauaugcacu

SEQ ID NO: 106200 - RNA, 64 nt, hsa
ugggggauugauacgaccggggaaaauguuccuaaaccaggaagcugcguuagccgaucaggcu

SEQ ID NO: 106201 - RNA, 64 nt, hsa
cacugcccccgaggccagaguguaaguaaaggauaaccaggacucgcugggagagauggacucu

SEQ ID NO: 106202 - RNA, 64 nt, hsa
auuuugagauacccugcuaucgauggucgcuacaaaccaggaaauacucaaguuauuaugugua

SEQ ID NO: 106203 - RNA, 64 nt, hsa
uuucuguuguuuuaauuaguauuuguguaguucaaaccaggaaggauuugacuaucauuagauu

SEQ ID NO: 106204 - RNA, 64 nt, hsa
gcagaggcugggggccuccacccagcagcagaccaaccaggaagcagcuugaacuggauggaga

SEQ ID NO: 106205 - RNA, 64 nt, hsa
agguggggucacagugaauuucacauccccucucaaccaggaguggagggcuaggucccuuccc

SEQ ID NO: 106206 - RNA, 64 nt, hsa
ggcaacaucuugcaaaacuacaauguagucucauaaccaggauauugacauugauacagugaag

SEQ ID NO: 106207 - RNA, 64 nt, hsa
cccccacaccccagccgugucccuaaccccuggcaaccaggaauccacucuccauuucuauaau

SEQ ID NO: 106208 - RNA, 64 nt, hsa
acucuacauuuucucugcacuuucaaugcccuguucuuccaaaccccuaucccaaguuuuauga

SEQ ID NO: 106209 - RNA, 64 nt, hsa
ccauucucauuugauguucccuagaaccucccugucuuccaacugcaggauguguuuacuucuc

SEQ ID NO: 106210 - RNA, 64 nt, hsa
uaggcuuccugcuaaaaagcuucugagauuguggucuuccaaaaaaaauaggagcuugguugaa

SEQ ID NO: 106211 - RNA, 64 nt, hsa
accccaaaucuuagaucugccagguaguucaacaucuuccaagugugcugguucugcuuuccaa

SEQ ID NO: 106212 - RNA, 64 nt, hsa
acugcauuucuagacucucgccggcccaggcccaucuuccaaagcaagaggaaggaaugauaau

SEQ ID NO: 106213 - RNA, 64 nt, hsa
acaaccaugauaagagcaaggcuguuaaauaauaucuuccaauuuacagaucagacaugaaugg

SEQ ID NO: 106214 - RNA, 64 nt, hsa
ucuguccauaccuacuucuaggauugcaaaggagucuuccaacuagagaaaaauuguccacuga

SEQ ID NO: 106215 - RNA, 64 nt, hsa
aauuuaagagggaaauauaaccuauaaauuuguuucuuccaagcuuagcucuuaaauuuggaga

SEQ ID NO: 106216 - RNA, 64 nt, hsa
gacagacuggacauuucccuguuucgagccaggcucuuccaaggggccagcuggguccccggag

SEQ ID NO: 106217 - RNA, 64 nt, hsa
ccgaggcucccgguuccaagucccaucgugcuccucuuccaaugccacacugccucugagccca

SEQ ID NO: 106218 - RNA, 64 nt, hsa
ucauguuucucacuguuccaggaaauugaucaacucuuccaaugggacauugaugaucacauuc

SEQ ID NO: 106219 - RNA, 64 nt, hsa
ugugauacggaaacaauaaauuccugagauacauucuuccaaucugugguaauaauaagaauuc

SEQ ID NO: 106220 - RNA, 64 nt, hsa
caacuacuaaaacuucccgccacccugcuauuucucuuccaauuacuguucaaacauuuuuggu

SEQ ID NO: 106221 - RNA, 64 nt, hsa
auguauaaaauaagcuucugccuauuugcauuuaucuuccaaacccaaucuaguaggauguucu

SEQ ID NO: 106222 - RNA, 64 nt, hsa
ccugccauuuaaaaaguuguagcagauuguuuccucuuccaaaguaaaauugcugugcuuuaug

SEQ ID NO: 106223 - RNA, 64 nt, hsa
aacaugaacacccuuagaaaauguguccuaucuaucuuccaaaugcaauuugauugacugccca

SEQ ID NO: 106224 - RNA, 64 nt, hsa
cugaauccugaggccacugugaauuugcugauguucuuccaacucaguugagugauuuuaaggu

SEQ ID NO: 106225 - RNA, 64 nt, hsa
uguagcuauuuauuaaaugcccuggguucuuuagucuuccaagggagggccucgcgcccauucg

SEQ ID NO: 106226 - RNA, 64 nt, hsa
ccaauuucagccugccacgauucuuggaaauaugucuuccaagugccauccaucaucaguagga

SEQ ID NO: 106227 - RNA, 64 nt, hsa
ucugugaguauaggaaugguauccuuccuaauuaucuuccaaaggaauuauuuugugugugugc

SEQ ID NO: 106228 - RNA, 64 nt, hsa
cccuuuggcaaagcccccauccacaccuggcacuccccucuaccaaucccuggcacaggguucc

SEQ ID NO: 106229 - RNA, 64 nt, hsa
agccugacucccucggcccuuacccaccugucacccccucuacgcucuccuuccucgccagcac

SEQ ID NO: 106230 - RNA, 64 nt, hsa
uugucugauguuagugaugcacauguguaacagcccccucuaaaagcgcaagccagucauaccc

SEQ ID NO: 106231 - RNA, 64 nt, hsa
uccacaggggcuugggaugguuguggggggcuggccccucuagccuuuccgguccuuccugggc

SEQ ID NO: 106232 - RNA, 64 nt, hsa
uauucuugcccucucuuuugaggcucucucauaaccccucuauuucuagagacaacaaaaaugc

SEQ ID NO: 106233 - RNA, 64 nt, hsa
agaaguggggccugcaccauacaucuguguccgcccccucuaccccuuccccccacguagggca

SEQ ID NO: 106234 - RNA, 64 nt, hsa
ggcuggcuguaagggagacucagucccagccucuccccucuacaacuccugccacuguuggcca

SEQ ID NO: 106235 - RNA, 64 nt, hsa
cacacuugcccuuucucccucucuccagcacacuccccucuaagaaaguaaaagcaaagcuuuc

SEQ ID NO: 106236 - RNA, 64 nt, hsa
aaggccaagaggagacagccgugacgguaaacuuccccucuaccagccuccaagccccacgcca

SEQ ID NO: 106237 - RNA, 64 nt, hsa
cuugugccccgugugcucagcagcugccucugucccccucuacugucccuuucacaccuugccu

SEQ ID NO: 106238 - RNA, 64 nt, hsa
ccaccugacccuaaauagguuccccagaguccugccccucuaaugaaugagaacugcaggaguu

SEQ ID NO: 106239 - RNA, 64 nt, hsa
uuucaggauugggugagacagagacaaaugaaccccccucuaaagucauuuaacuaauagccag

SEQ ID NO: 106240 - RNA, 64 nt, hsa
agcgcccggcugggacggucucuccauaccccagccccucuaacuagaguggggagcaugccag

SEQ ID NO: 106241 - RNA, 64 nt, hsa
cccagccuuaaaacucacugccucccccaagggcccccucuaaggagggugugggggagcccug

SEQ ID NO: 106242 - RNA, 64 nt, hsa
ucaccccacccugcuuuuaaaaauucuaaucuauccccucuaaccauagccccaucuauaauac

SEQ ID NO: 106243 - RNA, 64 nt, hsa
agggacugauaauuucauuuguggauuacgcagaccccucuacuuccccucuuucccuucugag

SEQ ID NO: 106244 - RNA, 64 nt, hsa
aagcccaggggcaaugguuugggugacucacuuuccccucuagguggugccaggggcuggaggc

SEQ ID NO: 106245 - RNA, 64 nt, hsa
ucucacuuguuuuaguucugauccagggagaucaccccucuaauuauuucugaacuugguuaau

SEQ ID NO: 106246 - RNA, 64 nt, hsa
auuauuuagagccauuagagcacagcuucuucugccccucuacuguugcacagccagaaggggc

SEQ ID NO: 106247 - RNA, 64 nt, hsa
cucuuggcccagccugguuccccccacuuccacuccccucuacucucucuaggacugggcugau

SEQ ID NO: 106248 - RNA, 64 nt, hsa
ccuuguucucuaaguuccacugagcuccaugugcccccucuaccauuugcagaguccugcacag

SEQ ID NO: 106249 - RNA, 64 nt, hsa
uuuccuuuccagaaggcuugauuucauuaggagaccccucuauugaguucuaaauaguuuaucu

SEQ ID NO: 106250 - RNA, 64 nt, hsa
cuccgguggccuucaagguccuuuaugaguguuaccccucuacacguccacaccacucaccaca

SEQ ID NO: 106251 - RNA, 64 nt, hsa
ucuucucugcucccaacccccaucucacagcaucccccucuauuuccaaugcuccucuccaacc

SEQ ID NO: 106252 - RNA, 64 nt, hsa
cugcugggugggggccuguuucuguaacuuucucccccucuacugagaagugaccuggaaguga

SEQ ID NO: 106253 - RNA, 64 nt, hsa
uguuaauaaucucacauauacaaguagcuucccuccccucuaguuuuuucuuccuuuucacugc

SEQ ID NO: 106254 - RNA, 64 nt, hsa
uuccuuaacuggcaguugagcacauaguacauuuccccucuaccaaacggaacacuuggauucc

SEQ ID NO: 106255 - RNA, 64 nt, hsa
aauuaaucuuuaagcuucaagaaacuugcucugaccccucuaagcaaacuacuaagcauuuaaa

SEQ ID NO: 106256 - RNA, 64 nt, hsa
gguggguggcacagcagugccccccugcagccuuccccucuacacaggacaugcacacacaagu

SEQ ID NO: 106257 - RNA, 64 nt, hsa
guuauugcuuuuucgguggcacuuacuuuuuuugccccucuaaggguaugcuuguguaucauuu

SEQ ID NO: 106258 - RNA, 64 nt, hsa
gauaggaguuccccagcaaaaguagaggagacuuccccucuaggaaaugcacggcuugauaccc

SEQ ID NO: 106259 - RNA, 64 nt, hsa
auugauucauugguacugccuuaaagauacaguaccccucuagcuuuguuuagucuuuauacug

SEQ ID NO: 106260 - RNA, 64 nt, hsa
auacacagauuaggagaugaccuuacuggguacaccccucuaaccagugcuuacagguuaaugc

SEQ ID NO: 106261 - RNA, 64 nt, hsa
uccgaagacggagaggagggaaauggggcccuuuccccucuauugcaucccccugcccgacucc

SEQ ID NO: 106262 - RNA, 64 nt, hsa
cuguucuggggcagggggaauaugcaagcuaaagccccucuauacccugguaggcuuccucuuc

SEQ ID NO: 106263 - RNA, 64 nt, hsa
uguggcagcugccucugggcugagcacagcuugaccccucuagccccuguaaauacuggaucaa

SEQ ID NO: 106264 - RNA, 64 nt, hsa
uucuuaagaaaguuaagcacccucucuuaacuuuccccucuauuugcucuccuuuuucuuucuu

SEQ ID NO: 106265 - RNA, 64 nt, hsa
gaguacuuuacugugaggaauugcagaaccuuuuccccucuacucuugucuaaaaguucugugu

SEQ ID NO: 106266 - RNA, 64 nt, hsa
gaugcuuauccuuucaucugugugauuguuuuuuccccucuacuaacaagauccucccagcuuu

SEQ ID NO: 106267 - RNA, 64 nt, hsa
aucuggcaaacagccccugggcugugccuggaucccccucuagcuccugcucacccacgcccac

SEQ ID NO: 106268 - RNA, 64 nt, hsa
uuuuucucgucacacagguaaccuuaaagacagaccccucuaaagaacgcuuuguaaauacaug

SEQ ID NO: 106269 - RNA, 64 nt, hsa
augaaaaucacauaguaugauaaacagguguauuccccucuacuugcccaugugcucauuuuuc

SEQ ID NO: 106270 - RNA, 64 nt, hsa
aaauauguacuuaugcuuuaguaguuuguuugguccccucuaguaugugucacugagaaauuuu

SEQ ID NO: 106271 - RNA, 64 nt, hsa
uuacacuacacacuguguacugcaguugguaugaccccucuaaggaguguagcaacuacagucu

SEQ ID NO: 106272 - RNA, 64 nt, hsa
cuagaggucuaagucccccaccccuuuccccacuccccucuaguggugaacuuuagaggaaaag

SEQ ID NO: 106273 - RNA, 64 nt, hsa
ggauggcugguuuagucuggguccaugucccagaccccucuauucugcuccaggacagcaggac

SEQ ID NO: 106274 - RNA, 64 nt, hsa
cccaccaaacagaaaaagugaaggcuggguuuuuccccucuaaucuggagacaagcugcugcuc

SEQ ID NO: 106275 - RNA, 64 nt, hsa
ugugggguucuugcuuugugugguauuuuguuuuccccucuaaugagagggcauggccugaguc

SEQ ID NO: 106276 - RNA, 64 nt, hsa
uucucaccucccuuccccaaaagcucucuuaagaccccucuaagucaguaccuggaaaauuucc

SEQ ID NO: 106277 - RNA, 64 nt, hsa
acuuccugagagaccgaacccccucaccugaaucccccucuaucaaacaaacaaaaaagcagca

SEQ ID NO: 106278 - RNA, 64 nt, hsa
ggccaccaucccagcuuccggcucccucuucuccccccucuacccgccaccccaccccacccca

SEQ ID NO: 106279 - RNA, 64 nt, hsa
ucauuaucaucauuauuauugcucuccacuguauccccucuaccuggcaugugcuugucaaguu

SEQ ID NO: 106280 - RNA, 64 nt, hsa
ucauuaucaucacuauuauugcucaccacuguauccccucuacuuggcaagugguugucaaguu

SEQ ID NO: 106281 - RNA, 64 nt, hsa
cugcugacccuuccguacuccuggacccccuugaccccucuauuucuguuggcuaaggccagcc

SEQ ID NO: 106282 - RNA, 64 nt, hsa
gcugugacacuucuucaucucacccccccccgccccccucuaggagagcuggcucugcaguggg

SEQ ID NO: 106283 - RNA, 64 nt, hsa
ucuacgcacaugggucauaacucgcaugucgagcccccucuagugaaggguaggagagcucagc

SEQ ID NO: 106284 - RNA, 64 nt, hsa
guagguuuuaaauuaaaaguguuaucaaaaguuuccccucuauuguaauacauuauuaaguggc

SEQ ID NO: 106285 - RNA, 64 nt, hsa
guuuaagaaugaaucucuuacaccucuacuuuugccccucuacuguauauuaagcccauaggcu

SEQ ID NO: 106286 - RNA, 64 nt, hsa
guaccggagugaccccggcagccacugcccaccuccccucuacccaggggccugaaaagagggg

SEQ ID NO: 106287 - RNA, 64 nt, hsa
agccuucagcacuaaccuaugagggugagcugguccccucuauauauacaucauacuuaacuuu

SEQ ID NO: 106288 - RNA, 64 nt, hsa
accuccacccucaaguaggauucaguguguuguuccccucuauguauccauauguuuucauaau

SEQ ID NO: 106289 - RNA, 64 nt, hsa
cccaguggagucucuuccuauguggucuucucuaccccucuaccccacauuggccaguggacuc

SEQ ID NO: 106290 - RNA, 64 nt, hsa
acagaaaagggagcuaaauugaauacacaaauuuccccucuaauuauaugggaaccagaauaga

SEQ ID NO: 106291 - RNA, 64 nt, hsa
uccuccuugaagcucccaguauucuuuuucuuuuccccucuaaaccuguuucugagaguggauc

SEQ ID NO: 106292 - RNA, 64 nt, hsa
ugcgcguugugccuggcugugcucucuuuuaugcccccucuauucuccucucucccccagggga

SEQ ID NO: 106293 - RNA, 64 nt, hsa
gauucccauaucccuccucuucuuugcauauuucccccucuaauuagcauguugcauuagcaug

SEQ ID NO: 106294 - RNA, 64 nt, hsa
cauauguguuguacacuguggugcccuguccaguccccucuaccaagcugagacccccaucccc

SEQ ID NO: 106295 - RNA, 64 nt, hsa
uuguugucugauauuugccacugagcuggugaagccccucuaaagagaucucgacccuggggag

SEQ ID NO: 106296 - RNA, 64 nt, hsa
uucacaggccagaaaacauaugcauuaugaaguuccccucuacuccaugcacauaguaagucug

SEQ ID NO: 106297 - RNA, 64 nt, hsa
cugucauggccccaugugaucucucccuccccuaccccucuaucauuuaguuucuucugcgcaa

SEQ ID NO: 106298 - RNA, 64 nt, hsa
guuugcccccugcccucccacuccuuccccuucuccccucuaaaccuucucccaucucuuucaa

SEQ ID NO: 106299 - RNA, 64 nt, hsa
ucggagcuuccuauuccauguugagguuugugggccccucuagaggagggcuaguucuauacuu

SEQ ID NO: 106300 - RNA, 64 nt, hsa
uucacuuaaauaucauuucucaagugagugaguuccccucuacuuuuagccuuccacccaaacu

SEQ ID NO: 106301 - RNA, 64 nt, hsa
ccuuaccccaggacuuggucuucaaccaccauuaccccucuaacuuugcacaaauaaaccugug

SEQ ID NO: 106302 - RNA, 64 nt, hsa
cuuggauaucacguccucugggaagucuucuuuuccccucuaaccuaggacccucauuaccggc

SEQ ID NO: 106303 - RNA, 64 nt, hsa
caucugauauaauuaguguucccugugaauucccccccucuaugggaaggaugccuuuacucuu

SEQ ID NO: 106304 - RNA, 64 nt, hsa
uuuuuuucauuauaaaaugguuagaggacccuacccccucuagauucccugauuuccccaggcc

SEQ ID NO: 106305 - RNA, 64 nt, hsa
acaagggggucucuggagaugucacccagggagcccccucuaugucugagaggcugccacugcu

SEQ ID NO: 106306 - RNA, 64 nt, hsa
ggggucuaguauguagcuuccagaacccacccugccccucuaccugggaggccaaaugggugag

SEQ ID NO: 106307 - RNA, 64 nt, hsa
ugucuccccuagucccccaggagcucuuuccuuuccccucuaguuuugggugugcauguuugga

SEQ ID NO: 106308 - RNA, 64 nt, hsa
acaguucuuugcauuuggcucuacuuacuaacaaccccucuagaauacauuggugauuucauuu

SEQ ID NO: 106309 - RNA, 64 nt, hsa
uuuuuauccuuaauguuaaucuacuuaaccuggcccccucuaacaugagucgauaaauguuguc

SEQ ID NO: 106310 - RNA, 64 nt, hsa
gcccacaagggggauuagaguggccuggccccucccccucuaccucaguagcccccaggccuga

SEQ ID NO: 106311 - RNA, 64 nt, hsa
acucuugcaacuaaaaaaauuaagaaauucacuuccccucuaggaggugaugauaggguuucua

SEQ ID NO: 106312 - RNA, 64 nt, hsa
caggucaccuugucaggaucugggcagcggcuucccccucuagccccuccccugccuagagcuc

SEQ ID NO: 106313 - RNA, 64 nt, hsa
guugggguguacuaguuacacaucuucaacagacccccucuagaaauuuuucagaugcuucugg

SEQ ID NO: 106314 - RNA, 64 nt, hsa
gagcagcagcuguggucauuaaaccauuaguuuaccccucuagaacuggggucugcaaacuccc

SEQ ID NO: 106315 - RNA, 64 nt, hsa
gcaaaucuugcuacuggcucuagaucugcgguuuccccucuacccugccucccgucuccccaga

SEQ ID NO: 106316 - RNA, 64 nt, hsa
ugacugguucauagggcuuuaauuauacaauuuaccccucuaauuaguacuauauguaugugac

SEQ ID NO: 106317 - RNA, 55 nt, hsa
agggggaagagacuaaauaacagagccccucuaggagaagccacgggaucccggc

SEQ ID NO: 106318 - RNA, 64 nt, hsa
guugagagcguggagcccuccaggccuuugcucuccccucuaggcacacgcgcacuuccaucuc

SEQ ID NO: 106319 - RNA, 64 nt, hsa
gagaagccaagaacuugugugucccccacccuauccccucuaacaccauuccuccaccugauga

SEQ ID NO: 106320 - RNA, 64 nt, hsa
accuccuaagcaguccuggcuuuuccucaucacuccccucuacagugccugguagacaagugcu

SEQ ID NO: 106321 - RNA, 64 nt, hsa
gccgccacacggucaccugcaaggacgucacgggccccucuaaaggauucguggugcucauccc

SEQ ID NO: 106322 - RNA, 64 nt, hsa
cauguaccaagcuaaauagcaauucauuucuccuccccucuacccuuaccaaaacucccacuuu

SEQ ID NO: 106323 - RNA, 64 nt, hsa
cagcaugucugccagcggaaacuucucgagcuccccccucuaccccgccccaccuugcagcuaa

SEQ ID NO: 106324 - RNA, 64 nt, hsa
uuauccccgcccuucuuucucacuuccacaucucccccucuauauccucacagagcccuaacau

SEQ ID NO: 106325 - RNA, 64 nt, hsa
caggggaugggaggggucccugagcccuucccuuccccucuaaggaggcagcaacggagagugg

SEQ ID NO: 106326 - RNA, 64 nt, hsa
ucagggugcuguccccuccccucuguuuacaucuccccucuaccccgcuguaucgcauauugcu

SEQ ID NO: 106327 - RNA, 64 nt, hsa
uuacuaccauuugaauauuuucauuugguguuuuccccucuagaaaacagaguugcuguuguuu

SEQ ID NO: 106328 - RNA, 64 nt, hsa
aguagagaagagaauggaaagcagcacacuccguccccucuagucuggagcuguuaacagaauc

SEQ ID NO: 106329 - RNA, 64 nt, hsa
caguaaaucuacuucuuuuuccagggacgacuguccccucuaaaguuaaagucaauacaagaaa

SEQ ID NO: 106330 - RNA, 64 nt, hsa
uagaacacagaaaauaaaaccaagacuggaagguccccucuaccccucccaggcccagagcuag

SEQ ID NO: 106331 - RNA, 64 nt, hsa
agaacauuuacacauucucacaauuguaaaguuuccccucuauuuuggugaccaauacuacugu

SEQ ID NO: 106332 - RNA, 64 nt, hsa
cucccagucuuuaucugaaggcccagccaaagcaccccucuaaaccggucaccuaggggaaaug

SEQ ID NO: 106333 - RNA, 64 nt, hsa
aucuaguguugcugcgagugaccucacuucagagccccucuagcagaguggggcggaaguccug

SEQ ID NO: 106334 - RNA, 64 nt, hsa
gcaaaaugaagaccuacuuucaacuccuuuuuccccccucuagaagaaucaaauugaaucuuuu

SEQ ID NO: 106335 - RNA, 64 nt, hsa
cuuuagccuuuaguaggagcucaaauuguuggggccccucuaccucucucagggcuagaacugc

SEQ ID NO: 106336 - RNA, 64 nt, hsa
ggcgacgaggagaucuaagcagcguucccacagcccccucuagauucuuggaguuccgcagagc

SEQ ID NO: 106337 - RNA, 64 nt, hsa
aaagugucuuaauccuuuguucccagacacacaaccccucuagcucucggaggggcgaucauga

SEQ ID NO: 106338 - RNA, 64 nt, hsa
aacccuucuaaacggugaccuuuagugccaacuuccccucuaacuggacagccucuucuguccc

SEQ ID NO: 106339 - RNA, 64 nt, hsa
acccccacccggaaccuccccuugccuaacauuuccccucuaugguaacaucucugacuucucu

SEQ ID NO: 106340 - RNA, 64 nt, hsa
ucucccuggaacgggagggacagggaauuuuuucccccucuauguacaaaaaaaaacaaagcuc

SEQ ID NO: 106341 - RNA, 64 nt, hsa
ccucuuucccccuucugcgccuagcguuccucuuccccucuaguuuccuggagccccaacacau

SEQ ID NO: 106342 - RNA, 64 nt, hsa
caccuccgugcugucacugccaucuccccccugaccccucuaacccauccucugccucccuccc

SEQ ID NO: 106343 - RNA, 64 nt, hsa
aauaugggguuggguaguguggguggcaggccauccccucuaaucuuggaaccucugaauaugg

SEQ ID NO: 106344 - RNA, 64 nt, hsa
augucucaucaauaaccuuaccauaugcuuagguccccucuaugcugucaucagaccuuuggca

SEQ ID NO: 106345 - RNA, 64 nt, hsa
gccugagguguccgcugacggguggccucucaccccccucuagagaaaccugacauuuacaaug

SEQ ID NO: 106346 - RNA, 64 nt, hsa
ggaaauccuuagcccucccuagaggauuggcuguccccucuauccucacugcuugaauuuggug

SEQ ID NO: 106347 - RNA, 64 nt, hsa
auuguccuuuucccuccugccccuaacaguccuaccccucuagccuacauuagcauauuucuca

SEQ ID NO: 106348 - RNA, 64 nt, hsa
uucuccugggacuuagagguggccagauuuaaggccccucuacucauccaacucccucuucacu

SEQ ID NO: 106349 - RNA, 64 nt, hsa
uuuccagccgaaggaaaaucacuuccguuaugucccccucuaauuuagccgcucgacauuuuac

SEQ ID NO: 106350 - RNA, 64 nt, hsa
gacagcgcuagauuucguguacaaaaccuguguaccccucuauauauauguuacauagaaugua

SEQ ID NO: 106351 - RNA, 64 nt, hsa
uagaaaaaggaugucuuuuuuuuuuuuuuuacucccccucuaaacacugcugcugccuuaauuu

SEQ ID NO: 106352 - RNA, 64 nt, hsa
aaauaacugacccucccuuccuguccgcccucuuccccucuaaugcucacgcucccaacacaag

SEQ ID NO: 106353 - RNA, 64 nt, hsa
caccucccuucuccuccuguguuuaaguggauggccccucuauccauccaggucccaugccaag

SEQ ID NO: 106354 - RNA, 64 nt, hsa
ccaacucuuccaggccccaccucccugcaccccuccccucuauagagcaggggagugaaggggu

SEQ ID NO: 106355 - RNA, 64 nt, hsa
uucuguuuugccugaaguuggagugaguguggcuccccucuauuuagcaugacaagccccaggc

SEQ ID NO: 106356 - RNA, 64 nt, hsa
ccuaagauagcuggaugaaucaggaaaaccauguccccucuagguauuauuaauauaagcagga

SEQ ID NO: 106357 - RNA, 64 nt, hsa
gagauucagaaggcaccucuucggucaaacauggccccucuauaaccccacuauucuucuccua

SEQ ID NO: 106358 - RNA, 64 nt, hsa
aaaucuuaguuccauggaauuuuaagcauuguucccccucuaaccugugucuaaagaauuaaaa

SEQ ID NO: 106359 - RNA, 64 nt, hsa
ugcgcccugggggccugggcucugcugcccuggaccccucuauuuauuucccuuccacagugug

SEQ ID NO: 106360 - RNA, 64 nt, hsa
ggcugcucugguccccagcauugccuccuccuagccccucuaguccaguuugccucccuuaccc

SEQ ID NO: 106361 - RNA, 64 nt, hsa
ugccccaggaagcccacagccucaccugcugcugccccucuaggucugggcagccaugaccugc

SEQ ID NO: 106362 - RNA, 64 nt, hsa
ggccucccagcaucugggacucgagagugggcagccccucuaccuccuggagcugaacuggggu

SEQ ID NO: 106363 - RNA, 64 nt, hsa
cacacacacacacacacacacacacacacacacgccccucuacugcuauguggcuucaaccagc

SEQ ID NO: 106364 - RNA, 64 nt, hsa
uccugugcuguagcaccuucacuggcccaucccuccccucuagugcuguccugguacccguccc

SEQ ID NO: 106365 - RNA, 64 nt, hsa
cugugugugagaggucuccuggguuggggcccagccccucuagaguagcugguggccagggaug

SEQ ID NO: 106366 - RNA, 64 nt, hsa
gggacugggagggcccacuucaggguucuccucuccccucuaaggccgaagaaggguccuuccc

SEQ ID NO: 106367 - RNA, 64 nt, hsa
gucuugcccacccccgauccccgugcgcuccucaccccucuacagacaggggcgcugcugcaga

SEQ ID NO: 106368 - RNA, 64 nt, hsa
aauacacagugcugaccagacagccucccccuguccccucuaugaccucgcccuccacaaaugg

SEQ ID NO: 106369 - RNA, 64 nt, hsa
gcccaacggggacacaaggaggcagaggagcuaaccccucuacuccacuuucaaaacuacauuu

SEQ ID NO: 106370 - RNA, 64 nt, hsa
uaagaucgccucccccuacgccgucuuggcuuuuccccucuacuuccaguccuuagguuagaug

SEQ ID NO: 106371 - RNA, 64 nt, hsa
ggaaaaacagaaacaacccucccccccauuuuuuccccucuauucaucaaaccuuuauguaucu

SEQ ID NO: 106372 - RNA, 64 nt, hsa
uauagucacacuuuaaauuaagccuuauauuaggccccucuauuuucaggauauaauucuuaac

SEQ ID NO: 106373 - RNA, 64 nt, hsa
aggcaccaaucaggagaaggguucugccucccauccccucuaccugcagacagggucggaggug

SEQ ID NO: 106374 - RNA, 64 nt, hsa
ggacaagcugcucuggcaggacucacguuacagaccccucuaccccuucagccugcccuacagc

SEQ ID NO: 106375 - RNA, 64 nt, hsa
agcuccagccccccucugguuugcugccuccucuccccucuaaaaaagucuuccgcuugauuuu

SEQ ID NO: 106376 - RNA, 61 nt, hsa
acgaaccugugggacccuagccaggcgccccccccucuaaggguccucuggccccacggac

SEQ ID NO: 106377 - RNA, 64 nt, hsa
uuccagucuacuugaguuagcauaauacagaaguccccucuacuuuaacuuuuacaaaaaagua

SEQ ID NO: 106378 - RNA, 64 nt, hsa
cuuuguaaugugcugguucucuuuuuuuuucuuuccccucuauggcccuuaagacuuucauuuu

SEQ ID NO: 106379 - RNA, 64 nt, hsa
gaugguguccugaggccuccaaggacgguccccaccccucuacguuuccccaauaaagccuuuu

SEQ ID NO: 106380 - RNA, 64 nt, hsa
cucccagcccgcaguauuucagggacaggcucuuccccucuaucccucacccugagagcacccc

SEQ ID NO: 106381 - RNA, 64 nt, hsa
gguaccuccccuacagcagcccuugggucauuggccccucuaggagugacccuagugacuuccc

SEQ ID NO: 106382 - RNA, 64 nt, hsa
uuucgggcgcagccaucuugccggcaccgccccgccccucuaguuguauccuuuauaauaaacu

SEQ ID NO: 106383 - RNA, 64 nt, hsa
ugcagcguuggaacgugagccucggauuuccuggccccucuacuguaaaugugccuuagccuaa

SEQ ID NO: 106384 - RNA, 64 nt, hsa
agaguccccugcaguuucuggguaacagggcacaccccucuaguuucaugggcgagcaccccca

SEQ ID NO: 106385 - RNA, 64 nt, hsa
cucuuuucugugucaguuucucucccucuccucaccccucuauccauuccucccgccccagcca

SEQ ID NO: 106386 - RNA, 64 nt, hsa
acugcccaccccaaguccccaggggauggcccucccccucuaccaagccacuccaagagccagc

SEQ ID NO: 106387 - RNA, 64 nt, hsa
accuaaggcccuggguucaagagaguuggagaaaccccucuagaaacauauuggcugucaucaa

SEQ ID NO: 106388 - RNA, 64 nt, hsa
gagaauagucaggccuaucagucucacagaaucaccccucuaccuuugauauuccacuuagcug

SEQ ID NO: 106389 - RNA, 64 nt, hsa
aggccuuuugacucuuuuaucugaguuuuauugaccccucuaauucucuuacccagaauauuua

SEQ ID NO: 106390 - RNA, 64 nt, hsa
gccccucuuuucccacauucauagccuguagugcccccucuaacccccagugccacagagaaga

SEQ ID NO: 106391 - RNA, 64 nt, hsa
cacuuucaucauuauuuauacaucgucaccacacccccucuauucaugagaaguaaagcugaga

SEQ ID NO: 106392 - RNA, 64 nt, hsa
cuuggacaguggagagaaucuguaaaagugugacccccucuaagauuucguuuuaaaugaucag

SEQ ID NO: 106393 - RNA, 64 nt, hsa
ucgcggccucuucucucagaccgucuuccuccaaccccucuauguagugccgcucuuggggaca

SEQ ID NO: 106394 - RNA, 64 nt, hsa
cccccagcaggccugguuccacccugggcagcacccccucuaguucuaauaaagccgccucugu

SEQ ID NO: 106395 - RNA, 64 nt, hsa
gaccaaaaaaauacagagucauccccuacccccaccccucuagagacccuccagcuaaaaacag

SEQ ID NO: 106396 - RNA, 64 nt, hsa
cccuuucccagagccccuggugguccugaaccggccccucuaucccuccgcaggccucuugccu

SEQ ID NO: 106397 - RNA, 64 nt, hsa
gcaaaggaagcucugccuuuuauaauugaaaaggccccucuauuuuauuuuucuugaaaacauu

SEQ ID NO: 106398 - RNA, 64 nt, hsa
agaagugcacuuuaagaggugggagcugggcagaccccucuaccuccuccaggcugggagacag

SEQ ID NO: 106399 - RNA, 64 nt, hsa
cuuacuaguguuuggcucaccuuugggcaaaggcccccucuaggccuugccccaccuccaucaa

SEQ ID NO: 106400 - RNA, 64 nt, hsa
ugugaagaacagacccugggucccacacugaaauccccucuagucacccauucccaccccccag

SEQ ID NO: 106401 - RNA, 64 nt, hsa
gagccuaugggagucccgggacagagugcccacuccccucuacuugcugcucugggccucccca

SEQ ID NO: 106402 - RNA, 64 nt, hsa
uuuccuguucagcauguacuccccucauccgauuccccucuaucagucacugacaguuaauaaa

SEQ ID NO: 106403 - RNA, 64 nt, hsa
uuuccuguucagcauguacuccccucauccgauuccccucuaucagucacugacaguuaacaaa

SEQ ID NO: 106404 - RNA, 64 nt, hsa
gcuaacuguauuuauugugaugccuuggucagggccccucuacccacuucucccagucaguugu

SEQ ID NO: 106405 - RNA, 64 nt, hsa
ggcuauccgaauucucugaaaaaauaauaaaaguccccucuauuauaugagccuguacagaaau

SEQ ID NO: 106406 - RNA, 64 nt, hsa
uuuuuuccucuacugacuucucuccauacucuuuccccucuauuucuuuguaugacugucauag

SEQ ID NO: 106407 - RNA, 64 nt, hsa
uucucaccuauccacacaacauauccguauauauccccucuacucuuacuucccccaaauuuaa

SEQ ID NO: 106408 - RNA, 64 nt, hsa
uuuccuguucagcauguacuccccucauccgauuccccucuaucagucacugccaguuaauaaa

SEQ ID NO: 106409 - RNA, 64 nt, hsa
gucauauguacuuugaauuugagaagugggugauccccucuaggcuuccuggaggucacauuua

SEQ ID NO: 106410 - RNA, 64 nt, hsa
uccagguuaggaaaggauucagcacuacagcauaccccucuacaacauacagcccugucacauu

SEQ ID NO: 106411 - RNA, 64 nt, hsa
aaaacuaccuucugacuuggguugaggcuggguuccccucuauuguuccccuaucauaagagcu

SEQ ID NO: 106412 - RNA, 64 nt, hsa
aaauugaucagucaguaguguaagaauaacugugccccucuaagagugcacacacacgcacaca

SEQ ID NO: 106413 - RNA, 64 nt, hsa
uucugguccaacuuguacauccagaacaaaagggccccucuaguagcugugugcuggauuauuc

SEQ ID NO: 106414 - RNA, 64 nt, hsa
cuccccuucgcguauuucaggauucuccuuuuuaccccucuaccaagcugugacccucaauuca

SEQ ID NO: 106415 - RNA, 64 nt, hsa
cuaacagaggaaacaaaugguccagcagucguucccagcagaacagcggagccuggacugacac

SEQ ID NO: 106416 - RNA, 64 nt, hsa
ucuccaccacagccaaggccuggagacugggggcccagcagagccugcucccacccuccuccca

SEQ ID NO: 106417 - RNA, 64 nt, hsa
accuggacucgccucuacccagcagacccugacuccagcagauucuggcccagggacaggagga

SEQ ID NO: 106418 - RNA, 64 nt, hsa
aaccacuacagucaguaccuggacucgccucuacccagcagacccugacuccagcagauucugg

SEQ ID NO: 106419 - RNA, 64 nt, hsa
uguaagauugauucugauucugaagucuuaacugccagcagaaaaacuccauacuguucauugu

SEQ ID NO: 106420 - RNA, 64 nt, hsa
agucaagauaucuggguucucacucuacucagucccagcagagcuguuguauaaccuugauuaa

SEQ ID NO: 106421 - RNA, 64 nt, hsa
cuugguuuuaagcugucuaccuaauugcugucucccagcagacugguggcaugcccaguggcuu

SEQ ID NO: 106422 - RNA, 64 nt, hsa
cuuccaugaacagaucgucauugcaguuaaagcuccagcagaaaccagauuggauguuccagcu

SEQ ID NO: 106423 - RNA, 64 nt, hsa
accgcugggucugcggccuaagggaccucccucgccagcagagguccauuccguucccagcugc

SEQ ID NO: 106424 - RNA, 64 nt, hsa
ugcuucugggcccagcuaaggaagccaucuguucccagcagaggagagcugcugcgcugaccug

SEQ ID NO: 106425 - RNA, 64 nt, hsa
gagaugggcaggagagucaaagggcuugcuugccccagcagaguucccagcagacagccauggc

SEQ ID NO: 106426 - RNA, 64 nt, hsa
agagucaaagggcuugcuugccccagcagaguucccagcagacagccauggcucuucccagcag

SEQ ID NO: 106427 - RNA, 64 nt, hsa; identical to SEQ ID NO: 106426

SEQ ID NO: 106428 - RNA, 64 nt, hsa; identical to SEQ ID NO: 106425

SEQ ID NO: 106429 - RNA, 64 nt, hsa
ccggaagggaagggacaccaaggaucuccggccaccagcagaagccagcagagaggcaugggac

SEQ ID NO: 106430 - RNA, 64 nt, hsa
agggacaccaaggaucuccggccaccagcagaagccagcagagaggcaugggacagguucccca

SEQ ID NO: 106431 - RNA, 64 nt, hsa
uaagaauagaaaacuggguaugcguuucauguagccagcagaacugaagugugcugugacaagc

SEQ ID NO: 106432 - RNA, 64 nt, hsa
cuagacaguuagagacucugucacccuagcuauaccagcagaaaaccuguucaggcaggcuuuc

SEQ ID NO: 106433 - RNA, 64 nt, hsa
acugagggaggaaaugagcgaguucccucugacaccagcagauccccaggggcugcugggcagu

SEQ ID NO: 106434 - RNA, 64 nt, hsa
guccuggggggcugggacgcccaagaucaagaggccagcagauucggacuccgcugagggcugu

SEQ ID NO: 106435 - RNA, 64 nt, hsa
ggcacucucuggcuaaaaacaaacucugaggccaccagcagaucaucuuuaagcuaaguuacua

SEQ ID NO: 106436 - RNA, 64 nt, hsa
cggcaguucucaaacuuuagcaugugaagagucaccagcagauuccugggcucgccuggagaca

SEQ ID NO: 106437 - RNA, 64 nt, hsa
guggcggucaccaccaccaccucucccgcccuuaccagcagaaagcaaugcaaacugagcugcu

SEQ ID NO: 106438 - RNA, 64 nt, hsa
aaauggcccgacagcauucugagguugugcaugaccagcagauacuauccuguuggugugcccu

SEQ ID NO: 106439 - RNA, 64 nt, hsa
aagucuggucgcaguggcaaagccagcaccauggccagcagagcggugagcagcacucccacca

SEQ ID NO: 106440 - RNA, 64 nt, hsa
ggccccuguggucugcuuguccuucagcccaugcccagcagauaccucucugacuggagacggg

SEQ ID NO: 106441 - RNA, 64 nt, hsa
gcaacaucacaucaguccucugucaguuucccagccagcagauugcaaacauccuagauagcca

SEQ ID NO: 106442 - RNA, 64 nt, hsa
aauagauucucaacgagauuucacuguggcuucuccagcagaauuuguuacucgcuuuggggga

SEQ ID NO: 106443 - RNA, 64 nt, hsa
gguucacaaggcuuggaccugccauggagggugcccagcagacguggugugagagggacagcuc

SEQ ID NO: 106444 - RNA, 64 nt, hsa
ggcucaugaggcuuggaccugccguggagggugcccagcagacgugguaugagagggauggcuc

SEQ ID NO: 106445 - RNA, 64 nt, hsa
acggcucacgagacuuggaccugguggagggugcccagcagacguggugugagagggacggcuc

SEQ ID NO: 106446 - RNA, 64 nt, hsa
ggcucacgaggcuuggaccugcuguggagggugcccagcagacguggugugagaggaacggcuc

SEQ ID NO: 106447 - RNA, 64 nt, hsa
ucaccuguguaggccccuguagugacccacgcguccagcagacgcccacccaccgcuagccguu

SEQ ID NO: 106448 - RNA, 64 nt, hsa
cuguccugugcgggccauagggcagggcccugucccagcagaugggcuugggagggggcucccu

SEQ ID NO: 106449 - RNA, 64 nt, hsa; identical to SEQ ID NO: 81180

SEQ ID NO: 106450 - RNA, 64 nt, hsa; identical to SEQ ID NO: 81181

SEQ ID NO: 106451 - RNA, 64 nt, hsa; identical to SEQ ID NO: 81204

SEQ ID NO: 106452 - RNA, 64 nt, hsa; identical to SEQ ID NO: 81205

SEQ ID NO: 106453 - RNA, 64 nt, hsa; identical to SEQ ID NO: 81232

SEQ ID NO: 106454 - RNA, 64 nt, hsa; identical to SEQ ID NO: 81233

SEQ ID NO: 106455 - RNA, 64 nt, hsa; identical to SEQ ID NO: 81241

SEQ ID NO: 106456 - RNA, 64 nt, hsa; identical to SEQ ID NO: 81242

SEQ ID NO: 106457 - RNA, 64 nt, hsa; identical to SEQ ID NO: 81294

SEQ ID NO: 106458 - RNA, 64 nt, hsa; identical to SEQ ID NO: 81295

SEQ ID NO: 106459 - RNA, 64 nt, hsa; identical to SEQ ID NO: 81311

SEQ ID NO: 106460 - RNA, 64 nt, hsa; identical to SEQ ID NO: 81312

SEQ ID NO: 106461 - RNA, 64 nt, hsa; identical to SEQ ID NO: 81313

SEQ ID NO: 106462 - RNA, 64 nt, hsa; identical to SEQ ID NO: 81314

SEQ ID NO: 106463 - RNA, 64 nt, hsa; identical to SEQ ID NO: 81315

SEQ ID NO: 106464 - RNA, 64 nt, hsa; identical to SEQ ID NO: 81413

SEQ ID NO: 106465 - RNA, 64 nt, hsa; identical to SEQ ID NO: 81414

SEQ ID NO: 106466 - RNA, 64 nt, hsa; identical to SEQ ID NO: 81424

SEQ ID NO: 106467 - RNA, 64 nt, hsa; identical to SEQ ID NO: 81425

SEQ ID NO: 106468 - RNA, 64 nt, hsa; identical to SEQ ID NO: 81444

SEQ ID NO: 106469 - RNA, 64 nt, hsa; identical to SEQ ID NO: 81445

SEQ ID NO: 106470 - RNA, 64 nt, hsa; identical to SEQ ID NO: 81449

SEQ ID NO: 106471 - RNA, 64 nt, hsa; identical to SEQ ID NO: 81450

SEQ ID NO: 106472 - RNA, 64 nt, hsa; identical to SEQ ID NO: 81554

SEQ ID NO: 106473 - RNA, 64 nt, hsa; identical to SEQ ID NO: 81555

SEQ ID NO: 106474 - RNA, 64 nt, hsa; identical to SEQ ID NO: 81577

SEQ ID NO: 106475 - RNA, 64 nt, hsa; identical to SEQ ID NO: 81578

SEQ ID NO: 106476 - RNA, 64 nt, hsa
acagcggcgucuucuccuuccugcugcagcugaagcucaugaugugggcgcucaaggacgucug

SEQ ID NO: 106477 - RNA, 64 nt, hsa
cugugcagcugagcgaguugcugacgcugcccgugcucaugaagcgcuccaucacggcaccgcu

SEQ ID NO: 106478 - RNA, 64 nt, hsa
aacugaggcacagagagguuagggacuuuucaugaucacacagcuaauaagugguggucccagg

SEQ ID NO: 106479 - RNA, 64 nt, hsa
agagaggcagaugugugcaaaaagcacaaccccaaucacacacagaaacccguaggcacggaca

SEQ ID NO: 106480 - RNA, 64 nt, hsa
gugccagcagcagcugcccgccacagggguacccaucacacaccagcguuuugaccagaugcga

SEQ ID NO: 106481 - RNA, 64 nt, hsa
caacucucugcuccccgagaccgagaaccggcguaucacacacaucuccgcggagcagaagcgg

SEQ ID NO: 106482 - RNA, 64 nt, hsa
gguuugggugggacaaaguuagaauugccugaagaucacacauucagacuguugugucugugga

SEQ ID NO: 106483 - RNA, 64 nt, hsa
uauggacaggcugggacagaggcagauggguuagaucacacauaacaauagggucuaugucaua

SEQ ID NO: 106484 - RNA, 64 nt, hsa
uacacagacacacacagaaagacacagacacaaaaucacacacacacccuccccgccacagaga

SEQ ID NO: 106485 - RNA, 64 nt, hsa
cagacacacacagaaagacacacacagacacaaaaucacacacacacccuccccgccacagaga

SEQ ID NO: 106486 - RNA, 64 nt, hsa
aguaacugaagccuaggccccguccccaccucaaaucacacacacccccuccccaccacagaga

SEQ ID NO: 106487 - RNA, 64 nt, hsa
ccaggccuaccugggagagggugagguucagcacaucacacaccauccccacugucauucaggg

SEQ ID NO: 106488 - RNA, 64 nt, hsa
cuccaucucacuggcucugagggcaggacaggguaucacacauuucucaccaggccuccuuucc

SEQ ID NO: 106489 - RNA, 64 nt, hsa
caaacaaauauugccaacucuucuauuuauggauaucacacauaucagcaggaguaauaaauuu

SEQ ID NO: 106490 - RNA, 64 nt, hsa
uucuuaaggauaauuuuccucaaucacacuacacaucacacaagauuugacuguaauauuuaaa

SEQ ID NO: 106491 - RNA, 64 nt, hsa
gaacucagaacccaagucugaucaggagaaaaacaucacacaaauuccaauugagaagcauucu

SEQ ID NO: 106492 - RNA, 64 nt, hsa
acaacaaaaaaagaaguuaaauaacuuguuuaagaucacacagcuagugcaguuacccccucuc

SEQ ID NO: 106493 - RNA, 64 nt, hsa
ggacugaugauauuugaauguuuauuaaauuauuaucacacaaauguguugauauuguggcuau

SEQ ID NO: 106494 - RNA, 64 nt, hsa
uacaaagagccucugccuucccaaacuaauauuuaucacacauggucauuaaaugggaaaaaaa

SEQ ID NO: 106495 - RNA, 64 nt, hsa
uauagucugaaucuuaggaagaagguaaaagaaaggaggcaagagaauaguuaugaugaauaug

SEQ ID NO: 106496 - RNA, 64 nt, hsa
uuaugaugaauauguguuaagugccugcucugaaggaggcaauguucuucucauuugaauccuu

SEQ ID NO: 106497 - RNA, 64 nt, hsa
auuuuuggcacauaacaacuuuuuuuuuaauuugggaggcaagcacaaacuaggaagacuagcu

SEQ ID NO: 106498 - RNA, 64 nt, hsa
cauuuauauuuuacaaaugcuagauauuggucugggaggcaacauuaaugguaccagccuguca

SEQ ID NO: 106499 - RNA, 64 nt, hsa
uguucagcuauuuuccagauaucuccccacaaaaggaggcaaaggguaccagcuuuucaaugag

SEQ ID NO: 106500 - RNA, 64 nt, hsa
ugcuugccucaaauccaagcagucuugaacacuuggaggcaauuaaugaguauaucuuagucaa

SEQ ID NO: 106501 - RNA, 64 nt, hsa
cacucugagguuucuaucuuccagacaagagcugggaggcaagauuucugguuucugguuccua

SEQ ID NO: 106502 - RNA, 64 nt, hsa
gugauugggcccuccggcuggauguucugggggaggaggcaaucgcuguagcugccaggccagc

SEQ ID NO: 106503 - RNA, 64 nt, hsa
ggugauguaguauggccugacagcucuguuuagaggaggcaacacugaucccccagaugcaggg

SEQ ID NO: 106504 - RNA, 64 nt, hsa
gggcggagccccggcucuuauagaagcuucagcaggaggcaagcguguucucagcacauauggg

SEQ ID NO: 106505 - RNA, 64 nt, hsa
cccgucagccugugcuaggcauggugucuucacaggaggcaaauccagagccuggcugugggga

SEQ ID NO: 106506 - RNA, 64 nt, hsa
cgagaauugugcuacuuauacugguucauaaucuggaggcaagguucgacugcagccgccccgu

SEQ ID NO: 106507 - RNA, 64 nt, hsa
uccagaauaaaaagaagagacugaucucuucaauuauugucaucuguagccaccagcacaucac

SEQ ID NO: 106508 - RNA, 64 nt, hsa
guguuuaauagugaucuguauacagcugugcacauauugucaucacuuauucuagcaucacugu

SEQ ID NO: 106509 - RNA, 64 nt, hsa
uagaaauaaguuaauacuaucauaguaauauuauuauugucaucccaagaaaaaauauauuaaa

SEQ ID NO: 106510 - RNA, 64 nt, hsa
auaagaaaaauuaauacuaucauguuaauacuauuauugucaucccaagaaaaaagauauuuua

SEQ ID NO: 106511 - RNA, 64 nt, hsa
augggcuacacagcagcuguucaacaagaguaaauauugucacaacacugaaccucuggcuaga

SEQ ID NO: 106512 - RNA, 64 nt, hsa
uaauuaaaguaaaauuauucccugaauuguuugauauugucaccuagcagauauguauuacuuu

SEQ ID NO: 106513 - RNA, 64 nt, hsa
acaauguaaagcaauaugauuuguuacuauaauuaaccuguauaaaagauacauuuuauggugg

SEQ ID NO: 106514 - RNA, 64 nt, hsa
ucaucugagacaaggcaagucccuuccacuuaugaaccuguaaaaucaaaaguaaacuaguuac

SEQ ID NO: 106515 - RNA, 64 nt, hsa
ugaauguaaauagcacuaaacguuuucuuucugcaaccuguacuuacagauucuuccuguaaac

SEQ ID NO: 106516 - RNA, 64 nt, hsa
ugcacagcacuaaagcaugagcuacuuucaucuaaaccuguaaaaauaugaaagauuuuuauau

SEQ ID NO: 106517 - RNA, 64 nt, hsa
ccagccuugaaguucuuugaccuccucaauucacaaccuguagcugacuuuagccacccacaag

SEQ ID NO: 106518 - RNA, 64 nt, hsa
uucuacaguuuucuuaaucaaaaguggucuagguaaccuguaaagaaaggauuaaaaauuuaag

SEQ ID NO: 106519 - RNA, 64 nt, hsa
auccaggccuagucaguagcaguaggguaacgggauugaaaaagauuugauggagaggaaagua

SEQ ID NO: 106520 - RNA, 64 nt, hsa
gcaacaccaacacaggaagaaauagaagucaccuauugaaaacuggaauggcccauucagaaag

SEQ ID NO: 106521 - RNA, 64 nt, hsa
uucuuucuucuucacaggccuucuuucaaggcaaauugaaaaucacuggcaacaugggucucgc

SEQ ID NO: 106522 - RNA, 64 nt, hsa
uuaaaauaaaaauauuuuuaacauggguuuccuuauugaaaaaucaguguauuagucauaaaac

SEQ ID NO: 106523 - RNA, 64 nt, hsa
uguguaaugcauuguucucaguuucccugccaacauugaaaaauaaaaacagcagcuuuucucc

SEQ ID NO: 106524 - RNA, 64 nt, hsa
gauuaauccuaaaauacagguguguuccaucugaauugaaaaugauauauuugagauauaauuu

SEQ ID NO: 106525 - RNA, 64 nt, hsa
cuaugguuguuaucuuacuucuacaguggaagagauugaaaagcauuugucagguuaaugcuaa

SEQ ID NO: 106526 - RNA, 64 nt, hsa
auaaaauuugaaacaauaauuucaaauaauaaagauugaaaaugcuuaacccagaaagaaucca

SEQ ID NO: 106527 - RNA, 64 nt, hsa
aaaacauguuggcuuuucucuugacgugggagaaauugaaaagaaggggaaggggaagaaaaga

SEQ ID NO: 106528 - RNA, 64 nt, hsa
acagcguauuggcuuggcuguugacauggaugaaauugaaaaguaccaagaaguggaagaagac

SEQ ID NO: 106529 - RNA, 64 nt, hsa
ggcuuuuuauuuaaaggauucugucacaagucuuauugaaaaguagauuuuuuaaaaaaaaaaa

SEQ ID NO: 106530 - RNA, 64 nt, hsa
cacuuauuggucuaguuuguccguuuuauaugacauugaaaacuugugugugcaacuuuugggg

SEQ ID NO: 106531 - RNA, 64 nt, hsa
uauaauucuggugaaguaauaguuucaguggaugauugaaaacaacaacaacaaaaacaaaaug

SEQ ID NO: 106532 - RNA, 64 nt, hsa
uugguggcagaaaaagaagauacugcauuuucacauugaaaagaauacuuugauuuuugaaggu

SEQ ID NO: 106533 - RNA, 64 nt, hsa
uucgccauacuagcggagguaaaacaaaagaaauauugaaaacugaggcaguuaaccaaaguag

SEQ ID NO: 106534 - RNA, 64 nt, hsa
ugaagccagccacaagauacuaacaaauguauaaauugaaaaguaccaauacuuuuugcacaua

SEQ ID NO: 106535 - RNA, 64 nt, hsa
acugaucgcaggauuuucugauccauagcuauuaauugaaaacuucugauagugcuguaggcuc

SEQ ID NO: 106536 - RNA, 64 nt, hsa
gguugaauaauauaugccuuguauaauauugaaaauugaaaaguacaacuaacgcaaccaagug

SEQ ID NO: 106537 - RNA, 64 nt, hsa
aggaaaagguugaauaauauaugccuuguauaauauugaaaauugaaaaguacaacuaacgcaa

SEQ ID NO: 106538 - RNA, 64 nt, hsa
uugguuaaucuacaccuuaacucuggcugcugcaauugaaaacuuucuuucuaauaaaauaaua

SEQ ID NO: 106539 - RNA, 64 nt, hsa
aaacgugcauacaguagcaaauauuuauugacaaauugaaaagcaggaaggaagaggguugugc

SEQ ID NO: 106540 - RNA, 64 nt, hsa
aaaaaggaauaugaaagucuuauuaaaacacuucauugaaaauauacagucuaaauuuauuauu

SEQ ID NO: 106541 - RNA, 64 nt, hsa
uacuguuuagugagcaguaugauuuguacaugccauugaaaauuauuaaucagaagaaaauuaa

SEQ ID NO: 106542 - RNA, 64 nt, hsa
gcccaugguucauuugguaucccuauuuaauugcauugaaaaugucauccuuucuguuguuaga

SEQ ID NO: 106543 - RNA, 64 nt, hsa
uauauauauauauuuuaaauguuuucacugacucauugaaaauguuaauuacacacacaugcau

SEQ ID NO: 106544 - RNA, 64 nt, hsa
uuuuacguuggaauccuccuucuagcugaaggugauugaaaaggaaaagagugagugaacagaa

SEQ ID NO: 106545 - RNA, 64 nt, hsa
cuugcacaaauuguaaugugauacugugaaacaaauugaaaacauugccucuuugcaucacaua

SEQ ID NO: 106546 - RNA, 64 nt, hsa
auguauguagcacuuuccuauauauuugucacacauugaaaacuggacuggguauaacuauguu

SEQ ID NO: 106547 - RNA, 64 nt, hsa
aaagacuuuuguguuuuggcuuugucacagauuuauugaaaaacuuuuuugcuucugcuuccau

SEQ ID NO: 106548 - RNA, 64 nt, hsa
uugggauuggauuuuaccauaugaaauguuucauauugaaaacacaagaugaccuuucuaauga

SEQ ID NO: 106549 - RNA, 64 nt, hsa
uguccauuggguaacuuuuauccacauauuacuaauugaaaaaugaagacaaguucuuuguaac

SEQ ID NO: 106550 - RNA, 64 nt, hsa
aaugaaucuaauccauaaggcuuuguaguacaagauugaaaaacucaacaagaauuuaauucua

SEQ ID NO: 106551 - RNA, 64 nt, hsa
aaguucugaaauaucuaaagcaguuuacucaucaauugaaaaguccuccaaaaagagaacuauu

SEQ ID NO: 106552 - RNA, 64 nt, hsa
aaucaguccuaugaauguaucccuaaaugugguuauugaaaaccuaauagcugccucaugacaa

SEQ ID NO: 106553 - RNA, 64 nt, hsa
aagagcuugcuuacuacaagaaaaauauugaaauauugaaaauauugaaaauauuauuauugaa

SEQ ID NO: 106554 - RNA, 64 nt, hsa
cuuacuacaagaaaaauauugaaauauugaaaauauugaaaauauuauuauugaaaauaaaauc

SEQ ID NO: 106555 - RNA, 64 nt, hsa
auauugaaauauugaaaauauugaaaauauuauuauugaaaauaaaaucuugaucucaacuauc

SEQ ID NO: 106556 - RNA, 64 nt, hsa
cacucaucuaccagauucugccuauguaaaaugaauugaaaaacaauuuucuguaaucuuuuau

SEQ ID NO: 106557 - RNA, 64 nt, hsa
agauauuauuaauuuuuauuuauuuuucuugggaauugaaaaaaauugaaauaaauaaaaaugc

SEQ ID NO: 106558 - RNA, 64 nt, hsa
gugacaacacaggaaaaguugguuuucaggugagauugaaaaugaagcaaagauaggaugaauc

SEQ ID NO: 106559 - RNA, 64 nt, hsa
guuaucccuccucaguaugaaaaauaaauuagauauugaaaaaugucuaaacuucagugaugga

SEQ ID NO: 106560 - RNA, 64 nt, hsa
aaaucuguagaauuuauuuuaacuaugaccuuuaauugaaaauaaauaauuaaaauaucagaca

SEQ ID NO: 106561 - RNA, 64 nt, hsa
agugaugugccauuuguuaauauacaagagaaauauugaaaauauauugaaaagagcaauuuua

SEQ ID NO: 106562 - RNA, 64 nt, hsa
auuuguuaauauacaagagaaauauugaaaauauauugaaaagagcaauuuuaaauuauuuuug

SEQ ID NO: 106563 - RNA, 64 nt, hsa
auaaauguauguguggggcugagguucuaaaggaauugaaaagagacgauaaacauugaaugag

SEQ ID NO: 106564 - RNA, 64 nt, hsa
caauacauaaccuauggcaguugguugaauaauuauugaaaaaaagaacacgacugaaaaaguu

SEQ ID NO: 106565 - RNA, 64 nt, hsa
uacuaaauuauaacuaaaagcaacuuuuuauguuauugaaaauauugaaagaacugauauuaau

SEQ ID NO: 106566 - RNA, 64 nt, hsa
aucuugaacauuuaugaugucaauuagugaaaguauugaaaauacuaaauuauaacuaaaagca

SEQ ID NO: 106567 - RNA, 64 nt, hsa
uagguuauucauaauguauaccuagaaaagugaaauugaaaauaccaaaagauguaucauuuuu

SEQ ID NO: 106568 - RNA, 64 nt, hsa
aguugguagaccaaaaggugaccucgcuuaguauauugaaaacacacaccacacaucacacaca

SEQ ID NO: 106569 - RNA, 64 nt, hsa
uguucauaauguuucugcauucaucuguucuuaaauugaaaaacauauaauuuacuucuuauaa

SEQ ID NO: 106570 - RNA, 64 nt, hsa
uuaauuuauaauuuauucauguguuauuacuguaauugaaaauguuauagacacuuuuaaauuc

SEQ ID NO: 106571 - RNA, 64 nt, hsa
cagcucauagguagagcaaagaaaggguggauggauugaaaagauuagccucugucucgguggc

SEQ ID NO: 106572 - RNA, 64 nt, hsa
gcaaaacauacuuuagaaacaaaugaaaaaggcaauugaaaaucccagcuauuucaccuagaug

SEQ ID NO: 106573 - RNA, 64 nt, hsa
aaccauuauuuuucauuuuguuuguucuaagaggauugaaaaucaguuuaguuuaaaugucuuu

SEQ ID NO: 106574 - RNA, 64 nt, hsa
augaccaugucucgguuuauuuuuuuuuucuuggauugaaaaguacugaaauucaaugugacau

SEQ ID NO: 106575 - RNA, 64 nt, hsa
uguuguagccauauucccugcugcugcacgccgaauugaaaauccaucucuuaccucuucucua

SEQ ID NO: 106576 - RNA, 64 nt, hsa
gcaaauuuaagcauuauauauuaggagacuaaacauugaaaacuuucacugauuuuuaaauugg

SEQ ID NO: 106577 - RNA, 64 nt, hsa
caaauccucuaauugcauacuacucucaagucccauugaaaaugaaugcuugacuucaacuuuu

SEQ ID NO: 106578 - RNA, 64 nt, hsa
cacagcugaacuauuucagugucaacuauucagaauugaaaauguaaauuaaaauuuccacaag

SEQ ID NO: 106579 - RNA, 64 nt, hsa
aaauauuaagcucuugguuaaauguuuuucagccauugaaaauguuaugaaaaagccuugaaua

SEQ ID NO: 106580 - RNA, 64 nt, hsa
ugauuuacugugaauuugcccaaucuuugaugacauugaaaacguuuuggggcauacacacuca

SEQ ID NO: 106581 - RNA, 64 nt, hsa
ucaagauggugggggcauuuuuagagcggcaauaauugaaaaaaaaggcgaacucugccuugga

SEQ ID NO: 106582 - RNA, 64 nt, hsa
ucccaacuaaagaauggauuuaauuaaacuauguauugaaaaaaaaguagccuaaguguuagag

SEQ ID NO: 106583 - RNA, 64 nt, hsa
acaggaagacggugauucuugcccuuaauucauaauugaaaauaugcaguaacaagcauaaaac

SEQ ID NO: 106584 - RNA, 64 nt, hsa
augauaaauuuuacauuauguauauuuuacugcaauugaaaaaaucauacucuauuaccaauuu

SEQ ID NO: 106585 - RNA, 64 nt, hsa
uuauuguauuuuaguauauuuauauaauuauguuauugaaaaaaauuggcauuaaaacuuaacc

SEQ ID NO: 106586 - RNA, 64 nt, hsa
gcagcaggccuguugcuuuuuuauggcgauucccauugaaaauguaaguaaaugucuguggccu

SEQ ID NO: 106587 - RNA, 64 nt, hsa
uacaguucuccaacuucauugugccagugaaucuauugaaaagcuguuaauauuuccguguccu

SEQ ID NO: 106588 - RNA, 64 nt, hsa
uagaaauugaugacuuuauaaugcaaccaggaguauugaaaaaaaaguaagcaaugagcucaaa

SEQ ID NO: 106589 - RNA, 64 nt, hsa
uugaaucaugugauucuagauuaacauuaaauagauugaaaaagaaacuuugcacgguaugagc

SEQ ID NO: 106590 - RNA, 64 nt, hsa
uucuguuuuuuucuuuguuaauucauuuaaacucauugaaaacauaguauacauuacuaaaagg

SEQ ID NO: 106591 - RNA, 64 nt, hsa
uauucccuucuguuuuaaaggagguauuuuggaaauugaaaaacuuaauuuacaagugcuggua

SEQ ID NO: 106592 - RNA, 64 nt, hsa
caaauauuccaguaaguuuugaaauaaugaaugcauugaaaauagcauuguuggaauuuauucc

SEQ ID NO: 106593 - RNA, 64 nt, hsa
agcaccaagaacaguuuuuauauuuuauuuucacauugaaaaucagucagauuugcuucagccu

SEQ ID NO: 106594 - RNA, 64 nt, hsa
cuuagagucagcaucaugggaaagaguaacagcaauugaaaaaagagauucaagagccaaguac

SEQ ID NO: 106595 - RNA, 64 nt, hsa
uucaugauuuccuaccauauucaggccuaaagacauugaaaaagcaucuuuucuugagaucaug

SEQ ID NO: 106596 - RNA, 64 nt, hsa
cuuggaauuuucauuuugaugcagaaauuuugaaauugaaaaugugcauguuuuggugcacaaa

SEQ ID NO: 106597 - RNA, 64 nt, hsa
cagucgaccugauaaaaagcaacguaugguaaauauugaaaacuccaggcaucgaaaacaagag

SEQ ID NO: 106598 - RNA, 64 nt, hsa
auuauuucauuacauuacucagaacaggcauauaauugaaaacuuaugaauuauuuuuuuuuaa

SEQ ID NO: 106599 - RNA, 64 nt, hsa
cacaguucaccaagugccuucuguagucacaugaauugaaaaggagacgcugcucccacggagg

SEQ ID NO: 106600 - RNA, 64 nt, hsa
cguuccuucuagaaggucuggaggacguagaguuauugaaaaugcagaugguucugaggaggaa

SEQ ID NO: 106601 - RNA, 64 nt, hsa
ggaaauuaucgcccacauuuguaauauagucgccauugaaaaguuaauuauccuuuuuuuaggg

SEQ ID NO: 106602 - RNA, 64 nt, hsa
cugacuuucuguuacaaaguugauugucucugucauugaaaaguuuuaguauuaaucuuuuucu

SEQ ID NO: 106603 - RNA, 64 nt, hsa
cagacuagugcuuaaaaaaaaaaaagaaggaaaaauugaaaaaaauaaaaaaaaaaguuacaga

SEQ ID NO: 106604 - RNA, 64 nt, hsa
uauaagguugaaaauucugaauaacccuuuuagcauugaaaaaaaaaacaaaaacaaaaaaugg

SEQ ID NO: 106605 - RNA, 64 nt, hsa
uuaaaaaaaaagaaauauauagacauauaucugcauugaaaacaaccuaaauauucaucagugg

SEQ ID NO: 106606 - RNA, 64 nt, hsa
augaaaucauuuauaaagaacaacuguuucuauuauugaaaauuguauguaaaacuauuuaaaa

SEQ ID NO: 106607 - RNA, 64 nt, hsa
aaacuuagcuguuuuaaaaacuuuguauuugaacauugaaaaguuacaguagucagcucugaua

SEQ ID NO: 106608 - RNA, 64 nt, hsa
uaucaauagaggugaaaggaaauuauuaaacuauauugaaaaauaaagaugucaauaaaaggag

SEQ ID NO: 106609 - RNA, 64 nt, hsa
aauuaggaagcuugauuugcuuugugauugaaaaauugaaaaccucuuuccaaaggcuguuuua

SEQ ID NO: 106610 - RNA, 64 nt, hsa
uuguagcuaauuaggaagcuugauuugcuuugugauugaaaaauugaaaaccucuuuccaaagg

SEQ ID NO: 106611 - RNA, 64 nt, hsa
uacauuacuuaaauguugcuuuuagcuuugauaaauugaaaauauuuuaauguguuguauuuuu

SEQ ID NO: 106612 - RNA, 64 nt, hsa
aauugaaaauauuuuaauguguuguauuuuugaaauugaaaacacuguaaaauagauugaugug

SEQ ID NO: 106613 - RNA, 51 nt, hsa
agauaagcaugaaaacuugaacaaugaaaagcagaaugaaaaugagucauu

SEQ ID NO: 106614 - RNA, 64 nt, hsa
cuucagucccuccaguguguauauuaccauucuccaaugaaauaauagggcauuuaacaaagau

SEQ ID NO: 106615 - RNA, 64 nt, hsa
uuuggucaaaacacacauagaaaacaaaaugauccaaugaaaacugguuuaacuagcaaaagcc

SEQ ID NO: 106616 - RNA, 64 nt, hsa
gcgugcugaauaggauucuucucaguuugaaagacaaugaaaaaugguuuuguaugacuugaau

SEQ ID NO: 106617 - RNA, 64 nt, hsa
gagcagcucaaaguaaacguguauuuuuuaguaacaaugaaauugucaaauuucaagauuuuaa

SEQ ID NO: 106618 - RNA, 64 nt, hsa
cauuuuccacuucuacaugaugcaauuaagaugccaaugaaaaguauugugaacauuauucuca

SEQ ID NO: 106619 - RNA, 64 nt, hsa
gguuuguucuaagucacucugagaggagugauaccaaugaaaaaaggucaguugauuccagugc

SEQ ID NO: 106620 - RNA, 64 nt, hsa
cucaggaaucaaaagagaaaaaaguuucugaaaacaaugaaaccauaaaagauaauauucuaaa

SEQ ID NO: 106621 - RNA, 64 nt, hsa
ggaaauuacugucaccacuaguuuuaauauaguacaaugaaaaaauaauauauauauauauagu

SEQ ID NO: 106622 - RNA, 64 nt, hsa
uaaaaaauaaaagaaacauaagauaaguaccucucaaugaaaaauguaaaaguaccuagaaauu

SEQ ID NO: 106623 - RNA, 64 nt, hsa
uuaagugauguaaaauaaaugcuuuuuggauuaucaaugaaagcaauuuuaugugugccugaag

SEQ ID NO: 106624 - RNA, 64 nt, hsa
guauuagugugugaagagauaagggcauuuguuucaaugaaaaaguuaguguuaaaggaaguga

SEQ ID NO: 106625 - RNA, 64 nt, hsa
guuguuuaagugacugaacgauccuucaaagucucaaugaaauaggagggaaaccuuuggcuac

SEQ ID NO: 106626 - RNA, 64 nt, hsa
cuccuugguuauauuuuuuuaacuuuaccaugcucaaugaaaaggugauugucaccaugaucac

SEQ ID NO: 106627 - RNA, 64 nt, hsa
gccgggaaguaaagcuuuggaggaaaaucaauaucaaugaaagugcuaagaucauugaucuuua

SEQ ID NO: 106628 - RNA, 64 nt, hsa
auaaggaaaagauggaauuacuggaccaguuugacaaugaaagaaaggaaugggaaagucaaug

SEQ ID NO: 106629 - RNA, 64 nt, hsa
auauugaagugguuguaacaauuuguuaaaacaacaaugaaauuuaccacauuaacugacgcuu

SEQ ID NO: 106630 - RNA, 64 nt, hsa
acagccuagauccagaguucagaagaccuugagacaaugaaaauaaacuugguaauaaucuuuu

SEQ ID NO: 106631 - RNA, 64 nt, hsa
uucucaacuugguuaaggaggaagaaaacccagucaaugaaauucaaugaaauucuuggaaacu

SEQ ID NO: 106632 - RNA, 64 nt, hsa
gguuaaggaggaagaaaacccagucaaugaaauucaaugaaauucuuggaaacuuccauuaagu

SEQ ID NO: 106633 - RNA, 64 nt, hsa
uuugaaagccuuuguaaauaucaauauaauguaccaaugaaauaacaucuggggcaaugaaacc

SEQ ID NO: 106634 - RNA, 64 nt, hsa
ucaauauaauguaccaaugaaauaacaucuggggcaaugaaacccugaucauguuguugauggu

SEQ ID NO: 106635 - RNA, 64 nt, hsa
ugaugcuacaggauuugaaauuguauuacaaauccaaugaaaugaguuuuucuuuucauuuacc

SEQ ID NO: 106636 - RNA, 64 nt, hsa
aagaaaauaacaauaaaagacaaggaaaaaauaacaaugaaaguugauaaguacaugauaagcg

SEQ ID NO: 106637 - RNA, 64 nt, hsa
cagcugcugacgggcuuugucuguggaaggagacagaaggaaauugacccacucuccuaucucc

SEQ ID NO: 106638 - RNA, 64 nt, hsa
gauagaagcacauggagugcaauaggacauugugagaaggaauuuuucagggauucaucuacua

SEQ ID NO: 106639 - RNA, 64 nt, hsa
uuuuaccuuuuggacaguaauuucuaucacaguuagaaggaaaugauagucaaauacacguuua

SEQ ID NO: 106640 - RNA, 64 nt, hsa
uugcucucaguauaagauuuuacuuuauuaaugcagaaggaauauggauauauuucuuuaaguc

SEQ ID NO: 106641 - RNA, 64 nt, hsa
ugacccaggcugaguccauacugccccugaucccagaaggaaugcugaccccucgucguaugaa

SEQ ID NO: 106642 - RNA, 64 nt, hsa
accucccucuauggggauggcuauuuuauuuuugagaaggaaaaaaaaagucauguauauauac

SEQ ID NO: 106643 - RNA, 64 nt, hsa
agcagagguaagaggaagaggcagcagcaucccaagaaggaaagagcuggagucagcacugucc

SEQ ID NO: 106644 - RNA, 64 nt, hsa
ucagaaaaagcaagaagaagaaaaggcgacaucaagaaggaaaggucucagaugaaagagaggg

SEQ ID NO: 106645 - RNA, 64 nt, hsa
cauuuuucugaaaguggcugauguaagaacaggcagaaggaaaacccuuuuugucaauaacucu

SEQ ID NO: 106646 - RNA, 64 nt, hsa
cucuggucaagccccauuuggucuacagcccaugagaaggaaugaggcugguucugcacucuca

SEQ ID NO: 106647 - RNA, 64 nt, hsa
ugagacuuggguggugggaagaaggaaggugggaagaaggaauuagacacucugccugccacuc

SEQ ID NO: 106648 - RNA, 64 nt, hsa
uuuuaauaaguaaagugagacuuggguggugggaagaaggaaggugggaagaaggaauuagaca

SEQ ID NO: 106649 - RNA, 64 nt, hsa
uccaucccguccggaaaagaaggacccagagggaagaaggaacaguggaggcgggacgcccucc

SEQ ID NO: 106650 - RNA, 64 nt, hsa
auuucgggaggaacucuguugcuucgccuggacaagaaggaaaaugcugauuuccuccuugggu

SEQ ID NO: 106651 - RNA, 61 nt, hsa
augcuguggaugaacgaugaaugucaaugucagaaggaaaagagaauuuuggccaucaaaa

SEQ ID NO: 106652 - RNA, 64 nt, hsa
aauguuguguucauuuguugagccauaucucagaagaaggaaagggagcuacagaaaggagguu

SEQ ID NO: 106653 - RNA, 64 nt, hsa
ugccauauugugaaaaacuuuaguggacaagggcagaaggaagagggaagaccuguuaggaagc

SEQ ID NO: 106654 - RNA, 64 nt, hsa
aggauuugcugagaguuugaauguggaguguaagagaaggaagaguuaaugaugacauuaaggu

SEQ ID NO: 106655 - RNA, 64 nt, hsa
ugaaugcacuugguuuauuguugggggugcucucagaaggaaccugugaaagccuuuaucaguc

SEQ ID NO: 106656 - RNA, 64 nt, hsa
aaccaaaacaugggaugaagcuaaaucaaugcuuagaaggaaauuuauagcuucaaauacuuau

SEQ ID NO: 106657 - RNA, 64 nt, hsa
aauaauugauaauaacaguccaaagaaagcagaaagaaggaaagccuagaacagaaauaaauga

SEQ ID NO: 106658 - RNA, 64 nt, hsa
ucaaggaaauaugaaggcacuuccuuuuuuucuaagaaggaaguugcuagaugauuccuucauc

SEQ ID NO: 106659 - RNA, 64 nt, hsa
aucuguaaauaaaaggguuccaaccuuuuaaaaaagaaggaaaaaacuuuuuggugcuccagug

SEQ ID NO: 106660 - RNA, 64 nt, hsa
gaauggaggaguuguuuggggagggaaaggagagagaaggaaaggagugagguauuucccgucu

SEQ ID NO: 106661 - RNA, 64 nt, hsa
aauuaaauaaaaugcugcugcuuugacaguaaagagaaggaaguauucugauuagcuguaucug

SEQ ID NO: 106662 - RNA, 64 nt, hsa
aagagaucaggaagagaaggagcagagcugauggagaaggaaggcuccaucuccagugggaacu

SEQ ID NO: 106663 - RNA, 64 nt, hsa
caccccagugagauguccccugacccuccaccgcagaaggaaggcagggaggaggcagagaaga

SEQ ID NO: 106664 - RNA, 64 nt, hsa
ugccaaccucugagaggugaaaagcuauguaaauagaaggaauggccaguucaaaagaauagua

SEQ ID NO: 106665 - RNA, 64 nt, hsa
gcuauuacuaaaaauauauauagacaaaauuaaaagaaggaaugauaagaauaaauuuaauuua

SEQ ID NO: 106666 - RNA, 64 nt, hsa
agucuggagaagguauuagcaaagcaaaaggcugagaaggaacagggaacauuggagcugacug

SEQ ID NO: 106667 - RNA, 64 nt, hsa
cugaaaaaaaaaaagaagaagaagaaggagagcaagaaggaaagauuugugaacuggaagaaag

SEQ ID NO: 106668 - RNA, 64 nt, hsa
gaagcuaaaaagcuaaaguaccagucaucuagagagaaggaaauuaauguuucuuaauaauccu

SEQ ID NO: 106669 - RNA, 64 nt, hsa
agugauucagggauuccuaugaauagaaaugcugagaaggaacgcauuuuauugcagaagcuaa

SEQ ID NO: 106670 - RNA, 64 nt, hsa
aauaugucugccaaguuguuagaaucuuugaaucagaaggaaaaaaagcagcgcugguugacaa

SEQ ID NO: 106671 - RNA, 64 nt, hsa
cccaaccugagauuuguaguccaggauuacaaccagaaggaaaguaugacagauuucuacuuaa

SEQ ID NO: 106672 - RNA, 64 nt, hsa
uauugcagcacuuucugaggcuuucacuguagggagaaggaaaccccaaggguagaauagccau

SEQ ID NO: 106673 - RNA, 64 nt, hsa
ugggauccaggaaccagugggauuggaugggagaagaaggaaggggguggcccgucacccccgc

SEQ ID NO: 106674 - RNA, 64 nt, hsa
ggggagaagccuggggaggagggggaggaagacaagaaggaagaggaggaggagaaggaagacg

SEQ ID NO: 106675 - RNA, 64 nt, hsa
gagggggaggaagacaagaaggaagaggaggaggagaaggaagacgaggagcuggacugggccu

SEQ ID NO: 106676 - RNA, 64 nt, hsa
gaguuguucccccagggggcucugccccaccuggagaaggaagcugccugguguggagugacuc

SEQ ID NO: 106677 - RNA, 64 nt, hsa
gaauuucuaccaaauaguagagcauaccacuugaagaaggaaagaaccgaagagcaaacaaaag

SEQ ID NO: 106678 - RNA, 64 nt, hsa
auuaguauauuuaaaaacuguucaaaagcaaaagagaaggaacaggaaugaaaggaaaccuucc

SEQ ID NO: 106679 - RNA, 64 nt, hsa
guauaaauauauuuauuaaguagcgcugcggcuaagaaggaagagugaggggucuguccauggg

SEQ ID NO: 106680 - RNA, 64 nt, hsa
uuuuuucauaaaaauuaaaugcuuuaagaaauggagaaggaaaaauagcuuuuaucaauuuuuu

SEQ ID NO: 106681 - RNA, 64 nt, hsa
uuguauugauaauuggacaaagagagagaaagaaagaaggaaggaaggaaaaacuuguuacuga

SEQ ID NO: 106682 - RNA, 64 nt, hsa
ucauccuuuucuauuucccuagaaccuuaaugguagaaggaauugcaaagaaucaaguccaccc

SEQ ID NO: 106683 - RNA, 64 nt, hsa
uucucaugugacagauggggaaacugaggccuugagaaggaaaaaggcuaaucuaaguuccugc

SEQ ID NO: 106684 - RNA, 64 nt, hsa
cacugaacaaggucucagggguauugcuaagccaagaaggaacuuucccacacuacugaaugga

SEQ ID NO: 106685 - RNA, 64 nt, hsa
uuguaaaagcccagaucacugugggcuggagaggagaaggaaagggucugcgccagcccugucc

SEQ ID NO: 106686 - RNA, 64 nt, hsa
accuugcuucaagaauaaaccacaccagugaacaagaaggaaaggccuuuuggagugugucuuu

SEQ ID NO: 106687 - RNA, 64 nt, hsa
augcuuauuaaaacaaaugauguauggggagaggagaaggaagggcaaggaaggaauugacaga

SEQ ID NO: 106688 - RNA, 64 nt, hsa
caucugugaggugauaggcaaggaugaaagacaaagaaggaaaagaguaucaaaggcagaaagg

SEQ ID NO: 106689 - RNA, 64 nt, hsa
ccuccccacccaccaaaugccucugccuugauggagaaggaaaaggcuggcaagguggguucca

SEQ ID NO: 106690 - RNA, 64 nt, hsa
uauggcaugauuagauugcaaagcaaugaacucaagaaggaauugaaauaaggagggacaugau

SEQ ID NO: 106691 - RNA, 64 nt, hsa
guuaggcuuuucugccugcuccugcuuaaacacaagaaggaauccuggauuuugcccucuccuu

SEQ ID NO: 106692 - RNA, 64 nt, hsa
uuagggcaacaaugaaggaggacccagccaagcuagaaggaauuuuguggaugggagacagcag

SEQ ID NO: 106693 - RNA, 64 nt, hsa
accucaacacaucccuucagugacucagagucucagaaggaaacccugacuccuggggccauuu

SEQ ID NO: 106694 - RNA, 64 nt, hsa
accuggcaccaguauaacuauaaagcacuagcugagaaggaacugauacuuacauuucauggac

SEQ ID NO: 106695 - RNA, 64 nt, hsa
guccugagaacagcuuuagucauggaauacugggagaaggaauaacuuucacaaaauaaacuua

SEQ ID NO: 106696 - RNA, 64 nt, hsa
agagcaagaccuuguuucucaaaaauaaauaaauagaaggaaauaaauguaaaaaugcugcaaa

SEQ ID NO: 106697 - RNA, 64 nt, hsa
cuucgagucgaguguaagggcccuucacaaaagcagaaggaacacuggcccaaacccccagcac

SEQ ID NO: 106698 - RNA, 64 nt, hsa
uuaugggagaagggcaaagacuucaugggaagagagaaggaaggcccuggguagaaacgcuugg

SEQ ID NO: 106699 - RNA, 64 nt, hsa
uuuggggaacugagcucagaggcaggugcuucagagaaggaaacaaaaugagggguggcaggga

SEQ ID NO: 106700 - RNA, 64 nt, hsa
ccucuuucuccccauggccccacugcagaauuaaagaaggaagaagggaaggcggaggagucua

SEQ ID NO: 106701 - RNA, 64 nt, hsa
aaagaaggaagaagggaaggcggaggagucuauaagaaggaaucaugauuucuauuuagcagau

SEQ ID NO: 106702 - RNA, 64 nt, hsa
ggccgcauuccccccaauguggagaagucuaucaagaaggaaauggcucaguaugcuagcaaca

SEQ ID NO: 106703 - RNA, 64 nt, hsa
cgcaucacaauuggcaauaaaaccuguguguuugagaaggaaaaugacccaucggugaugcgcu

SEQ ID NO: 106704 - RNA, 64 nt, hsa
gccagaauggcauguuuuauaauuaacugaauaaagaaggaagcauuauuauauauuauugugg

SEQ ID NO: 106705 - RNA, 64 nt, hsa
cauaacaugaauugauggucaauuucccuucagcagaaggaaaaggugauuuagaucaguagcu

SEQ ID NO: 106706 - RNA, 64 nt, hsa
aacauuaauaugugcaaagauuggcucuccaacaagaaggaaagcagggaggaagggagaccac

SEQ ID NO: 106707 - RNA, 64 nt, hsa
aacagaacgucgcugauggagaaagggcucccgcagaaggaacggccuguaccgugcgcuccgg

SEQ ID NO: 106708 - RNA, 64 nt, hsa
acucauggaagagaugaacgccaugcuggcccggagaaggaaagccacgcaaguuggggagaaa

SEQ ID NO: 106709 - RNA, 64 nt, hsa
ccccauuaauuuuaggagcuucuggaagaggugaagaaggaauugcagaaagugaaagaggaaa

SEQ ID NO: 106710 - RNA, 64 nt, hsa
gaguaagaggcgcugggcucggagccuguuuccaagaaggaauugguugucaucuggcaguguu

SEQ ID NO: 106711 - RNA, 64 nt, hsa
gaggaaaggcaguccuggacagaagacugucagcagaaggaaaguacuggacuacccgugggua

SEQ ID NO: 106712 - RNA, 64 nt, hsa
ccacugugcacagguuugagaggacaaguucaucagaaggaaggcaguccuuagaagucacaua

SEQ ID NO: 106713 - RNA, 64 nt, hsa
gugaacauguuugugggccuuuugacugaguggcagaaggaaacugcucaggaagagaaacagg

SEQ ID NO: 106714 - RNA, 64 nt, hsa
cugacuucuuccuccuccuccuucccugacucacagaaggaaugcaaucacccagcaaguccua

SEQ ID NO: 106715 - RNA, 64 nt, hsa
ggcucuugagccucugggaaugggaggggccaagagaaggaaaacccugucuuuagcacccuuu

SEQ ID NO: 106716 - RNA, 64 nt, hsa
agguuuuuuaaaggauauuuaacuuuuauggacuagaaggaaucacgagggcuacugcacaaua

SEQ ID NO: 106717 - RNA, 64 nt, hsa
uaccccagaagcagguggucugccccaggcauaaagaaggaaaauuggccaucuuucccaccuc

SEQ ID NO: 106718 - RNA, 64 nt, hsa
aggcaagcagcuagacuggugaauugggggaaauagaaggaacuaguaacugagacuccuccag

SEQ ID NO: 106719 - RNA, 64 nt, hsa
gagagaaaccaacaagagaucucgaacccugucuagaaggaauguauuuguugcuaaauuucgu

SEQ ID NO: 106720 - RNA, 64 nt, hsa
gaaacaaaguggaaggaaagaugcucagguacagagaaggaaugucuuugguccucuugccauc

SEQ ID NO: 106721 - RNA, 64 nt, hsa
augacaacccugugguuuccaaggagcugagaauagaaggaaacuagcuuacaugagaacagac

SEQ ID NO: 106722 - RNA, 64 nt, hsa
gauuuugcccagcacauggagcuguaauccagagagaaggaaacguagaaauuuauuauuaaaa

SEQ ID NO: 106723 - RNA, 64 nt, hsa
cccgcucagcaacauagaagagggaaggaaagagagaaggaaagagagagagaaagaaagucuc

SEQ ID NO: 106724 - RNA, 64 nt, hsa
gaaggaaggagggaagaaaagaaagcaaaggaacagaaggaaggaaagaaagaugggaggaagu

SEQ ID NO: 106725 - RNA, 64 nt, hsa
gaggcggagaggggagaagaaggaagggaagggcagaaggaaggagggaagaaaagaaagcaaa

SEQ ID NO: 106726 - RNA, 64 nt, hsa
gggcuuuuccuuugggggaggcggagaggggagaagaaggaagggaagggcagaaggaaggagg

SEQ ID NO: 106727 - RNA, 64 nt, hsa
gcuuuuacacagcacaugaagcaguaauccagaaagaaggaaaugcagaauuuuauuaucaaag

SEQ ID NO: 106728 - RNA, 64 nt, hsa
cucauuuucaggaaaguuuguaguauuacaaggcagaaggaaacacaguagcaaugguugcucu

SEQ ID NO: 106729 - RNA, 64 nt, hsa; identical to SEQ ID NO: 85991

SEQ ID NO: 106730 - RNA, 64 nt, hsa; identical to SEQ ID NO: 85992

SEQ ID NO: 106731 - RNA, 64 nt, hsa; identical to SEQ ID NO: 85993

SEQ ID NO: 106732 - RNA, 64 nt, hsa; identical to SEQ ID NO: 85994

SEQ ID NO: 106733 - RNA, 64 nt, hsa; identical to SEQ ID NO: 85995

SEQ ID NO: 106734 - RNA, 64 nt, hsa; identical to SEQ ID NO: 85996

SEQ ID NO: 106735 - RNA, 64 nt, hsa; identical to SEQ ID NO: 85997

SEQ ID NO: 106736 - RNA, 64 nt, hsa; identical to SEQ ID NO: 85998

SEQ ID NO: 106737 - RNA, 64 nt, hsa; identical to SEQ ID NO: 85999

SEQ ID NO: 106738 - RNA, 64 nt, hsa; identical to SEQ ID NO: 86000

SEQ ID NO: 106739 - RNA, 64 nt, hsa; identical to SEQ ID NO: 86001

SEQ ID NO: 106740 - RNA, 64 nt, hsa; identical to SEQ ID NO: 86002

SEQ ID NO: 106741 - RNA, 64 nt, hsa; identical to SEQ ID NO: 86003

SEQ ID NO: 106742 - RNA, 64 nt, hsa; identical to SEQ ID NO: 86004

SEQ ID NO: 106743 - RNA, 64 nt, hsa; identical to SEQ ID NO: 86005

SEQ ID NO: 106744 - RNA, 64 nt, hsa; identical to SEQ ID NO: 86006

SEQ ID NO: 106745 - RNA, 64 nt, hsa; identical to SEQ ID NO: 86007

SEQ ID NO: 106746 - RNA, 64 nt, hsa; identical to SEQ ID NO: 86008

SEQ ID NO: 106747 - RNA, 64 nt, hsa; identical to SEQ ID NO: 86009

SEQ ID NO: 106748 - RNA, 64 nt, hsa; identical to SEQ ID NO: 86010

SEQ ID NO: 106749 - RNA, 64 nt, hsa; identical to SEQ ID NO: 86011

SEQ ID NO: 106750 - RNA, 64 nt, hsa; identical to SEQ ID NO: 86012

SEQ ID NO: 106751 - RNA, 64 nt, hsa; identical to SEQ ID NO: 86013

SEQ ID NO: 106752 - RNA, 64 nt, hsa; identical to SEQ ID NO: 86014

SEQ ID NO: 106753 - RNA, 64 nt, hsa; identical to SEQ ID NO: 86015

SEQ ID NO: 106754 - RNA, 64 nt, hsa; identical to SEQ ID NO: 86016

SEQ ID NO: 106755 - RNA, 64 nt, hsa; identical to SEQ ID NO: 86017

SEQ ID NO: 106756 - RNA, 64 nt, hsa; identical to SEQ ID NO: 86018

SEQ ID NO: 106757 - RNA, 64 nt, hsa; identical to SEQ ID NO: 86019

SEQ ID NO: 106758 - RNA, 64 nt, hsa; identical to SEQ ID NO: 86020

SEQ ID NO: 106759 - RNA, 64 nt, hsa; identical to SEQ ID NO: 86021

SEQ ID NO: 106760 - RNA, 64 nt, hsa; identical to SEQ ID NO: 86022

SEQ ID NO: 106761 - RNA, 64 nt, hsa; identical to SEQ ID NO: 86023

SEQ ID NO: 106762 - RNA, 64 nt, hsa; identical to SEQ ID NO: 86024

SEQ ID NO: 106763 - RNA, 64 nt, hsa; identical to SEQ ID NO: 86025

SEQ ID NO: 106764 - RNA, 64 nt, hsa; identical to SEQ ID NO: 86026

SEQ ID NO: 106765 - RNA, 64 nt, hsa; identical to SEQ ID NO: 86027

SEQ ID NO: 106766 - RNA, 64 nt, hsa; identical to SEQ ID NO: 86028

SEQ ID NO: 106767 - RNA, 64 nt, hsa; identical to SEQ ID NO: 86029

SEQ ID NO: 106768 - RNA, 64 nt, hsa; identical to SEQ ID NO: 86030

SEQ ID NO: 106769 - RNA, 64 nt, hsa; identical to SEQ ID NO: 86031

SEQ ID NO: 106770 - RNA, 64 nt, hsa
guguaaugcauuguucucaguuucccugccaacauugaaaaauaaaaacagcagcuuuucuccu

SEQ ID NO: 106771 - RNA, 64 nt, hsa
acauaguugacauuccuaguaaaauauuugcuuguugaaaaaaacauguuaacagauguguuua

SEQ ID NO: 106772 - RNA, 64 nt, hsa
cuaaacuuuauauaaugugugguuucaauucagcuugaaaaauaaucucacuacauguagcagu

SEQ ID NO: 106773 - RNA, 64 nt, hsa
gaugacuugaaaugaggccuacucuaaagaauucuugaaaaacuuacaagucaagccuagccug

SEQ ID NO: 106774 - RNA, 64 nt, hsa
agucaagccuagccugauaauccuauuacauaguuugaaaaauaguauuuuauuucucagaaca

SEQ ID NO: 106775 - RNA, 64 nt, hsa
augaagccauauuaauaacugcauuuuccuaacuuugaaaaauuuugcaaaugucuuaggugau

SEQ ID NO: 106776 - RNA, 64 nt, hsa
uagaacuuaaaacuccaaacuagaguacguaacauugaaaaaugaggcauaaaaaugcaauaaa

SEQ ID NO: 106777 - RNA, 64 nt, hsa
auuuuugcauuuaaguuguuugaaggcauguauuuugaaaaauaucuguuacaaauuuauaauu

SEQ ID NO: 106778 - RNA, 64 nt, hsa
gacuaugaaauacauaaaccauauaucaaguuauuugaaaaauaccuauuuuuuuccaaagugu

SEQ ID NO: 106779 - RNA, 64 nt, hsa
auugguccuguguuaccaaguuuauaugugacaguugaaaaagaaauucccuugaaaugaucau

SEQ ID NO: 106780 - RNA, 64 nt, hsa
auguuacaguacaagaaugacuuucucuugauuguugaaaaaucauuaccuguggaauggcuag

SEQ ID NO: 106781 - RNA, 64 nt, hsa
cucuugucaguuuccuguuccugguuccaucuuuuugaaaaaggcccuccuuugagcuacaaac

SEQ ID NO: 106782 - RNA, 64 nt, hsa
gccgccuacugguuuguaguuaaccuagagaagguugaaaaauuaauccuaccuuuaaagggau

SEQ ID NO: 106783 - RNA, 64 nt, hsa
cagugauauuauuuccauaacuuaaaaagugaguuugaaaaagaaaaucuccagcaagcaucuc

SEQ ID NO: 106784 - RNA, 64 nt, hsa
uuuaaaaacaucgaguaccucaagucaguuugccuugaaaaauaucaaauauaacucuuagaga

SEQ ID NO: 106785 - RNA, 64 nt, hsa
gucucuuggaaauguuaagaaagaagacccuuuguugaaaaauguugcucugggagacuuacug

SEQ ID NO: 106786 - RNA, 64 nt, hsa
uaagagaaaccuugcaaacucuauaaagaaacuuuugaaaaaguguacaugaagaauguagccc

SEQ ID NO: 106787 - RNA, 64 nt, hsa
uccugacacuauacauuucaaaauuuuuuauaacuugaaaaacacuucugugcuaccacucagu

SEQ ID NO: 106788 - RNA, 64 nt, hsa
aucaaagaauugaaugaauacaacagaauugagguugaaaaauauuugauugccacauuccuuu

SEQ ID NO: 106789 - RNA, 64 nt, hsa
uuguguuaagugacugagaagauguuaauuacuuuugaaaaaggaucaugguuuuugcucuacu

SEQ ID NO: 106790 - RNA, 64 nt, hsa
augauaaguuccaaaaauaccauuuaucuacuauuugaaaaaagaagaggauaucccuuccuac

SEQ ID NO: 106791 - RNA, 64 nt, hsa
acucaaauaugaguacaaaugccuuaaaauggaauugaaaaacucuuuauuuuccccuaucauu

SEQ ID NO: 106792 - RNA, 64 nt, hsa
cuuaaguauaucauguaaagaaaugucuuaauuuuugaaaaaaguacauauuuauuuucuuuug

SEQ ID NO: 106793 - RNA, 64 nt, hsa
ccaguaaggaagcaacuaaauuuuguuuuguucuuugaaaaaggcuaaccugagcuagguaaag

SEQ ID NO: 106794 - RNA, 64 nt, hsa
guaaaauuuuauuuuaauuaaaaucaauucauguuugaaaaaggauuuaaaguagcuucuaaua

SEQ ID NO: 106795 - RNA, 64 nt, hsa
uaugugaauauacauaucaagaacuuuggggguuuugaaaaaaaugaauuguauauauacaaau

SEQ ID NO: 106796 - RNA, 64 nt, hsa
aauguuuguauauguaaucagauguacauuuauauugaaaaacaaaugagauggacuuaaagag

SEQ ID NO: 106797 - RNA, 64 nt, hsa
cucaucucagguaauuuaugaaaucuauguaaacuugaaaaauauuucuuaauuuuuguuuuug

SEQ ID NO: 106798 - RNA, 64 nt, hsa
auuucccucuauaaguguuauugauuauuuuaaauugaaaaaaguuucacuuggaugaaaaaag

SEQ ID NO: 106799 - RNA, 64 nt, hsa
aauuguuggugggaauguaaauggugcaccugcuuugaaaaacaguuuggcaguaccucaaaaa

SEQ ID NO: 106800 - RNA, 64 nt, hsa
gaaaugcaagggacccagaauauccaaauaagccuugaaaaagaacaaaguugguggauucaca

SEQ ID NO: 106801 - RNA, 64 nt, hsa
guccauuggguaacuuuuauccacauauuacuaauugaaaaaugaagacaaguucuuuguaacu

SEQ ID NO: 106802 - RNA, 64 nt, hsa
augaaucuaauccauaaggcuuuguaguacaagauugaaaaacucaacaagaauuuaauucuaa

SEQ ID NO: 106803 - RNA, 64 nt, hsa
guucaccaaaaccaaacuuguucauuuagauaauuugaaaaaguuccauagaaaaggcgugcag

SEQ ID NO: 106804 - RNA, 64 nt, hsa
uaaaccauuguaacuauuaaccuuuuuugucuuauugaaaaaaaaaauguugagaagcguuuuu

SEQ ID NO: 106805 - RNA, 64 nt, hsa
cauugaagaccagcuuucucauaaauuucucuuuuugaaaaaaagaaagcauuuguacuaagcu

SEQ ID NO: 106806 - RNA, 64 nt, hsa
caguuuugaugaaaggagggaaaagcagauggacuugaaaaagauccaagcuccuauuagaaaa

SEQ ID NO: 106807 - RNA, 64 nt, hsa
cagaaaacugagcauacuagcaagacagcucuucuugaaaaaaaaaauauguauacacaaauau

SEQ ID NO: 106808 - RNA, 64 nt, hsa
gaagaaaaucuguucuuaauauauuucauuaugauugaaaaacauaaaaacuaacauaggaaag

SEQ ID NO: 106809 - RNA, 64 nt, hsa
ugccaaauguuguuuucauaaccaugauauuguuuugaaaaaauuuuaucuuaaaauacugaau

SEQ ID NO: 106810 - RNA, 64 nt, hsa
aguguuaggucaauaacacuguauuuuaauguacuugaaaaauguuuuuauuuuuguuuuauuu

SEQ ID NO: 106811 - RNA, 64 nt, hsa
acucaucuaccagauucugccuauguaaaaugaauugaaaaacaauuuucuguaaucuuuuauu

SEQ ID NO: 106812 - RNA, 64 nt, hsa
guaauuuuugcuccaauauccauucuguagacuuuugaaaaaaaaguuuuuaauuugaugccca

SEQ ID NO: 106813 - RNA, 64 nt, hsa
gauauuauuaauuuuuauuuauuuuucuugggaauugaaaaaaauugaaauaaauaaaaaugca

SEQ ID NO: 106814 - RNA, 64 nt, hsa
aggauguagagauuuggggugguugauuagacuuuugaaaaacucaucaccacaugccuucacu

SEQ ID NO: 106815 - RNA, 64 nt, hsa
ucucugaacuugauauaaagauuuuauuugucccuugaaaaaguaacaaaugugcauagaucaa

SEQ ID NO: 106816 - RNA, 64 nt, hsa
acauaagguaccaaauaugaugcaauaaauuguuuugaaaaacaguugugugaauauuucaacu

SEQ ID NO: 106817 - RNA, 64 nt, hsa
uuucuuuauauucagcuacucuugucauuucucguugaaaaacuaaaaucugacuagguuaguu

SEQ ID NO: 106818 - RNA, 64 nt, hsa
cugaaaggcaguuugauuuuuauuuuuaacacacuugaaaaaagguuggaguagccagacuuuc

SEQ ID NO: 106819 - RNA, 64 nt, hsa
cugccauuugcuauaaaguugaacuuuguauggcuugaaaaagaaaugacaauauggaacaucc

SEQ ID NO: 106820 - RNA, 64 nt, hsa
aaaugccugaaaaaaauaagcauuuacuaauaccuugaaaaaucaaagaacauuauguuccucc

SEQ ID NO: 106821 - RNA, 64 nt, hsa
aagggacuuuuauuuguaaaguaauggaucuggcuugaaaaauacgguagagauacuuagcucu

SEQ ID NO: 106822 - RNA, 64 nt, hsa
ggagccaguuaaaaaaccagagcauuccuuuuuauugaaaaauaaaauuaauuuguuaucaggu

SEQ ID NO: 106823 - RNA, 64 nt, hsa
aaugccuuugaaauuuuguaaucaaaaaaaagcuuugaaaaaaucuaaaggggagaguauucuu

SEQ ID NO: 106824 - RNA, 64 nt, hsa
acucuuuggugacuccaacuauggauagcuuauuuugaaaaaggagaauugcaaauuuuaccaa

SEQ ID NO: 106825 - RNA, 64 nt, hsa
cagcagcaaguuuagcaucuucaaauuucuuuuauugaaaaaaauuuuauuaguaacauguugu

SEQ ID NO: 106826 - RNA, 64 nt, hsa
gaaaaauuaauggcauuuuaaagguuaaaacauuuugaaaaauuauuagcauguaacaaagaau

SEQ ID NO: 106827 - RNA, 64 nt, hsa
ccagcucaggaugaaaggauagacacaaaauuguuugaaaaacauuuuccaggccuggcuccaa

SEQ ID NO: 106828 - RNA, 64 nt, hsa
agcauagccaaggcuagcgaggcauacuuuccaguugaaaaaaaucaaaauuuuuugccuucca

SEQ ID NO: 106829 - RNA, 64 nt, hsa
acacagaacuuuuccauaaacauuguuccacauauugaaaaaacuguaaaauuauagcacuaac

SEQ ID NO: 106830 - RNA, 64 nt, hsa
acccuaaaguguguaaguuuuucauuuugucauauugaaaaaugauuugcauaguacugaaugu

SEQ ID NO: 106831 - RNA, 64 nt, hsa
aacauuuaaaaauuaaucaguuacaguaaagacuuugaaaaagaaauguacuuguuaggaagua

SEQ ID NO: 106832 - RNA, 64 nt, hsa
uuuuuacacagguuuucuugucuugacaagaugcuugaaaaaccaagaggauaugaaaaucugu

SEQ ID NO: 106833 - RNA, 64 nt, hsa
guucauaauguuucugcauucaucuguucuuaaauugaaaaacauauaauuuacuucuuauaaa

SEQ ID NO: 106834 - RNA, 64 nt, hsa
accaacaacauuaugguauuugugugacuuuuauuugaaaaaaugugagcaguaauuuggguua

SEQ ID NO: 106835 - RNA, 64 nt, hsa
gggugucuccccaggugaguccauccacacacguuugaaaaacacuauuagucuuucuaacaca

SEQ ID NO: 106836 - RNA, 64 nt, hsa
aaugaacucaaucuaaauuaaaaaagaaagaaauuugaaaaaacuuucucuuugccauuucuuc

SEQ ID NO: 106837 - RNA, 64 nt, hsa
aaugucaaccuuuguaagaaaaccaaaauaaaaauugaaaaauaaaaaccauaaacauuugcac

SEQ ID NO: 106838 - RNA, 64 nt, hsa
uguaauauguaaauuaaaauauuucuacauuuuauugaaaaaaaaaccuuuuuuuuugccuaaa

SEQ ID NO: 106839 - RNA, 64 nt, hsa
aacacauuaauguugaauuuuacagacaguauauuugaaaaaaauugauuccauguagucuuca

SEQ ID NO: 106840 - RNA, 64 nt, hsa
cuggacacauggcugcuaauucaucagcuuaucauugaaaaaguccauagccaaaaccugacug

SEQ ID NO: 106841 - RNA, 64 nt, hsa
uauauuuaaagguaaugagauaaugaugaguguuuugaaaaauguuuaguguucaaauagaaac

SEQ ID NO: 106842 - RNA, 64 nt, hsa
aacaucuucuguguaugaagcaaaugucgauguuuugaaaaaagcuaggagaugacuuugaaug

SEQ ID NO: 106843 - RNA, 64 nt, hsa
auucccuagagcucaagaaagcugguccaggagguugaaaaagcuauuuuguuguuaaauuauu

SEQ ID NO: 106844 - RNA, 64 nt, hsa
auuacaggaauuguauguucacuucgaaucauguuugaaaaaacguuguauccuuauuuuguaa

SEQ ID NO: 106845 - RNA, 64 nt, hsa
uacuaaaagauauguuucugauacaauagcaaacuugaaaaaaaaaaaagaaauagaagauucc

SEQ ID NO: 106846 - RNA, 64 nt, hsa
auguacugauuacugccuauuuuaauaaacacucuugaaaaaugcauguugcccuguugcugcc

SEQ ID NO: 106847 - RNA, 64 nt, hsa
cugagauguagccccucuccuggaagugcuaauuuugaaaaacugcucauaugauguacaugua

SEQ ID NO: 106848 - RNA, 64 nt, hsa
aaugaauaugcuuucauuaaauagggagguagauuugaaaaaaccguuauaaagaaaugugccu

SEQ ID NO: 106849 - RNA, 64 nt, hsa
uuugaaggguuuaugugcaaagugaaaacaaauuuugaaaaauaagacaaauccauucucuucu

SEQ ID NO: 106850 - RNA, 64 nt, hsa
gauuauuuuaucugguauggugcuaauauuuuauuugaaaaaaguuacugcaacuuaacuuaaa

SEQ ID NO: 106851 - RNA, 64 nt, hsa
uguagaacugauuuuacaaauuaauauuugugcuuugaaaaaaaguuucuauuuaguuauuuaa

SEQ ID NO: 106852 - RNA, 64 nt, hsa
acauauuugcauguaaacaaugauuucaaaauacuugaaaaauaaaauuuuaacccaaaugaau

SEQ ID NO: 106853 - RNA, 64 nt, hsa
aauuauaagguaaaauuuuccuguuuuucccccuuugaaaaacucaggaaaaaaggaagauuga

SEQ ID NO: 106854 - RNA, 64 nt, hsa
gcacagcagcgaugcagaaggcaagaacggcagcuugaaaaauuaaaggagguuguucacuucc

SEQ ID NO: 106855 - RNA, 64 nt, hsa
cagcggaaaaggauucaucagcuagaacagcaaguugaaaaacucagaaagaagcucaagaccg

SEQ ID NO: 106856 - RNA, 64 nt, hsa
gcaugauuauuagaaacuauuuaagcuuuuuucuuugaaaaacaagcuccuuuuacagaauaua

SEQ ID NO: 106857 - RNA, 64 nt, hsa
cagcaggcugggugcguuaaaaagcccaaguauuuugaaaaaacucgaacagauuugacaaggg

SEQ ID NO: 106858 - RNA, 64 nt, hsa
uugauguccaguuacaccauccauucuguuaauuuugaaaaaauauacccucccuuuaguuugu

SEQ ID NO: 106859 - RNA, 64 nt, hsa
cuuacagcuccaacuuuuuugaaugaccaucugguugaaaaaucuuucucauauaaguuuaacc

SEQ ID NO: 106860 - RNA, 64 nt, hsa
aaaaccuagaaguuggauauuggcauauugguuguugaaaaauaaauuucauccucacuuauga

SEQ ID NO: 106861 - RNA, 64 nt, hsa
guaaucuuuauucugagggucucgggauugcagguugaaaaacacaaccuuaaucagcaguaaa

SEQ ID NO: 106862 - RNA, 64 nt, hsa
uaggaaucaaaguuuauuaaaguuacauagaggauugaaaaauguauaucacucaauuuuuauc

SEQ ID NO: 106863 - RNA, 64 nt, hsa
uuucauaacauauggaaugcuuuaagcaauuguuuugaaaaaaaucugcguaucuuugacuuaa

SEQ ID NO: 106864 - RNA, 64 nt, hsa
caagauggugggggcauuuuuagagcggcaauaauugaaaaaaaaggcgaacucugccuuggag

SEQ ID NO: 106865 - RNA, 64 nt, hsa
cccaacuaaagaauggauuuaauuaaacuauguauugaaaaaaaaguagccuaaguguuagaga

SEQ ID NO: 106866 - RNA, 64 nt, hsa
uuauguacucacagucuuucccuugaagagaagauugaaaaagucuacuguucauaaaccaugc

SEQ ID NO: 106867 - RNA, 64 nt, hsa
uagaacauuuguaugaaaagacauuuaguaugcuuugaaaaaaacucagcuuuuaguuuuuuuc

SEQ ID NO: 106868 - RNA, 64 nt, hsa
caacuggaauaauauaguaauccuguaacuggguuugaaaaaauaaucaacaaaagauacaauu

SEQ ID NO: 106869 - RNA, 54 nt, hsa
gggaucgagaugagcuuuaaaaacuugaaaaacaguuuguaagccuuucaacag

SEQ ID NO: 106870 - RNA, 64 nt, hsa
ugagcucucuuguuuuuuuguuacuauuauuccuuugaaaaaaagacaaaauaucuaaaaaaug

SEQ ID NO: 106871 - RNA, 64 nt, hsa
ucugauuccacuuucaaagucuuggauauauucuuugaaaaaugaguaguauggaauauuaaga

SEQ ID NO: 106872 - RNA, 64 nt, hsa
augucaacucauuacuuuuuuccugugaacaguauugaaaaaccccaacggcugauaauuaagu

SEQ ID NO: 106873 - RNA, 64 nt, hsa
gaauuucuaaaauggaauuuaaugccaucacaauuugaaaaacuuuuuuuuuuuuuuuacuaua

SEQ ID NO: 106874 - RNA, 60 nt, hsa
uuucaagccaaaaaauauaauuccauugcuuugaaaaaguuaaugcuuaagagggaauga

SEQ ID NO: 106875 - RNA, 64 nt, hsa
uuauccuagcacaugcuucaauaguucaaggaacuugaaaaauacuuuuccuuaccuuuacccc

SEQ ID NO: 106876 - RNA, 64 nt, hsa
uugggugugacaucagaguauuugaccugcaguauugaaaaaggagaauucagaaugauacagu

SEQ ID NO: 106877 - RNA, 64 nt, hsa
gugcucacucaauguguuuaggcagauuccacuuuugaaaaaaaauaugaaaugugugcucaac

SEQ ID NO: 106878 - RNA, 64 nt, hsa
ggugauaauaaucuccauaguuauuugaaguggcuugaaaaaggcaagauugacuuuuaugaca

SEQ ID NO: 106879 - RNA, 64 nt, hsa
ccaagaugcaaaauuaggcuuugauuggcacuuuuugaaaaauaugcaacaaauaugggaugua

SEQ ID NO: 106880 - RNA, 64 nt, hsa
ggcccuuugacuaaguugauauggaaauauuuuguugaaaaacuguacagagcagcuuuacaag

SEQ ID NO: 106881 - RNA, 64 nt, hsa
uuucauuacagaauuguuuauaaaaguucauuuguugaaaaauaaggauccuuuuuaauaccac

SEQ ID NO: 106882 - RNA, 64 nt, hsa
agaaauugaugacuuuauaaugcaaccaggaguauugaaaaaaaaguaagcaaugagcucaaau

SEQ ID NO: 106883 - RNA, 64 nt, hsa
aaaaugcugaaaagaagagaaauaccccaaguucuugaaaaaaaauuuuuugauaugacuacuc

SEQ ID NO: 106884 - RNA, 64 nt, hsa
auauugcaaguggaugaguuggaaauuaugcacuuugaaaaacauucacuuuguuuaagcuuau

SEQ ID NO: 106885 - RNA, 64 nt, hsa
aaauuuuuauaaaauacucuugcaaaaaguuuauuugaaaaauuucuagauggucucaugaguu

SEQ ID NO: 106886 - RNA, 64 nt, hsa
cuuugauagaaaggaauuuuaaauaguuugacacuugaaaaaagauacuauuuauaaguugaag

SEQ ID NO: 106887 - RNA, 64 nt, hsa
cauuucagaguguuggagaagaaucuguagcuuguugaaaaagcugggggugaaagggaacaag

SEQ ID NO: 106888 - RNA, 64 nt, hsa
aaauaaauauucuuccugauuaaaaaaauuuuuuuugaaaaaaacaaggccagccccaaccuuc

SEQ ID NO: 106889 - RNA, 64 nt, hsa
cguggccuauagcuucccuuccggaaagcuugcuuugaaaaacuuaaaaagcccccguuuacau

SEQ ID NO: 106890 - RNA, 64 nt, hsa
cacaaugugucuuucuuuuuggacauuuaccuuuuugaaaaagaaaacacuuaaaaugaucauu

SEQ ID NO: 106891 - RNA, 64 nt, hsa
agauuuuuugguuaagcuuugacacuggaaugaguugaaaaaaugugccauuuugcauuuucau

SEQ ID NO: 106892 - RNA, 64 nt, hsa
uuagagaagcccaguaguuuuuauuguuggauuuuugaaaaaaccucuaccaagaauguggugu

SEQ ID NO: 106893 - RNA, 64 nt, hsa
ucauggugaauauaugugauaacaucuuuauacuuugaaaaauguuccacuuacccuucagaua

SEQ ID NO: 106894 - RNA, 64 nt, hsa
aaacacaguaauguguauauagugguauaagaucuugaaaaaaaucucuauaauugugcucuuu

SEQ ID NO: 106895 - RNA, 64 nt, hsa
augggaaaagccauuuuuaguaggugacuaccauuugaaaaacucaauuggauguauaucugaa

SEQ ID NO: 106896 - RNA, 64 nt, hsa
uauuccuauuagaagaaauaauuuuuuuuaauaauugaaaaaauuuaccacagccuugucugau

SEQ ID NO: 106897 - RNA, 64 nt, hsa
gguagauauuuaggggaauagucaaaauuuacuguugaaaaagcaguugcuaugugcuuucuua

SEQ ID NO: 106898 - RNA, 64 nt, hsa
uaccuuuacagaaccacagaucacuuauuauacuuugaaaaauugcuuugaaaaaugcuuuucc

SEQ ID NO: 106899 - RNA, 64 nt, hsa
ccacagaucacuuauuauacuuugaaaaauugcuuugaaaaaugcuuuuccaguucuuagaaaa

SEQ ID NO: 106900 - RNA, 64 nt, hsa
gguuuggccuugcugcuguuuugauuuauggaauuugaaaaagauaauuauaaugccugcaaug

SEQ ID NO: 106901 - RNA, 64 nt, hsa
ugagcacguguguaaaggacuggggaggcgugucuugaaaaagcaacugcagaaauuccuuaug

SEQ ID NO: 106902 - RNA, 64 nt, hsa
gugaaucccucagugcugacuuauaucuuguucuuugaaaaaaugcauugacucuuuaagacau

SEQ ID NO: 106903 - RNA, 64 nt, hsa
acuccugauaaagaauauaaagugagccugauucuugaaaaaaucagaaccagagccuguuuug

SEQ ID NO: 106904 - RNA, 64 nt, hsa
auagacuuauauuuuauaaucagaauauguugcuuugaaaaagccucuaauggacugaccuuaa

SEQ ID NO: 106905 - RNA, 64 nt, hsa
gcaggauucuaaaaguagacaaucacagggaggauugaaaaaaagggcacucugauagggcaaa

SEQ ID NO: 106906 - RNA, 64 nt, hsa
ucaugauuuccuaccauauucaggccuaaagacauugaaaaagcaucuuuucuugagaucaugg

SEQ ID NO: 106907 - RNA, 64 nt, hsa
uugcuugguuauuccccucuugcucuucuuuaguuugaaaaaacaaaaacguggccuuggaauu

SEQ ID NO: 106908 - RNA, 64 nt, hsa
guaaaaucaaauuuuauauuucauuuuuugacucuugaaaaaugucuuugcuccuuggcagcua

SEQ ID NO: 106909 - RNA, 64 nt, hsa
ccuuaaaugaacaaugaagcagguaaaauuacccuugaaaaaaaucccuuggaccacccauaaa

SEQ ID NO: 106910 - RNA, 64 nt, hsa
agacuagugcuuaaaaaaaaaaaagaaggaaaaauugaaaaaaauaaaaaaaaaaguuacagaa

SEQ ID NO: 106911 - RNA, 64 nt, hsa
auaagguugaaaauucugaauaacccuuuuagcauugaaaaaaaaaacaaaaacaaaaaaugga

SEQ ID NO: 106912 - RNA, 64 nt, hsa
gcuaacuuucccccaccccugaugcaguaaaacauugaaaaaaaaaaaaaaggagagguagaag

SEQ ID NO: 106913 - RNA, 64 nt, hsa
ccaggacuuugcacaacuuugguuuuaaaagcuguugaaaaauaggaaaacaaagggcauuguu

SEQ ID NO: 106914 - RNA, 64 nt, hsa
uuuucugacugagccaauagugguuggggaacucuugaaaaaggggagagaauggcugggugcu

SEQ ID NO: 106915 - RNA, 64 nt, hsa
accuggcgugaguuucauguaugaaaacauaaaauugaaaaaaaaaaaaaaaccuacacgagca

SEQ ID NO: 106916 - RNA, 64 nt, hsa
ugaucaaacuuuguucaacaucagggaauuuauauugaaaaauugugcaaauauaauaaauuug

SEQ ID NO: 106917 - RNA, 64 nt, hsa
gaguuauaauuacauucaaaguauacuuuauuucuugaaaaauauuacagauuuuuugaaaauu

SEQ ID NO: 106918 - RNA, 64 nt, hsa
aguaugaaucuacccaugaaggaugagagauguuuugaaaaacuagccaggacacacccacagg

SEQ ID NO: 106919 - RNA, 64 nt, hsa
auuuauaccaguuauaugaauugacuuaaguaucuugaaaaagaaacuuuagagaaagcaucag

SEQ ID NO: 106920 - RNA, 64 nt, hsa
cucucuagauuccuccucucugggcagcgcaucuuugaaaaaagugcagauaaaacccucaucu

SEQ ID NO: 106921 - RNA, 64 nt, hsa
cauguucuaacccaaugcaaggaagcuaagaaccuugaaaaaagguuagaggaauugcuaacua

SEQ ID NO: 106922 - RNA, 64 nt, hsa
uccaugaucuagaauuuaaaaaaauuuuaaaggguugaaaaaagugaaaagaauauuuucaaca

SEQ ID NO: 106923 - RNA, 64 nt, hsa
aucaauagaggugaaaggaaauuauuaaacuauauugaaaaauaaagaugucaauaaaaggaga

SEQ ID NO: 106924 - RNA, 64 nt, hsa
uggugcaauuccauucauuuguacagaaacauuuuugaaaaauucuuuucaauaagaugcaaaa

SEQ ID NO: 106925 - RNA, 64 nt, hsa
aaagccgaagcccagugccaugacugcccgcggauugaaaaacagaaacacaaaacuuugacuu

SEQ ID NO: 106926 - RNA, 64 nt, hsa
uugcaguuauugcauucaaaguaugcuuaacuuuuugaaaaaauuagauuuuuugaaaagugag

SEQ ID NO: 106927 - RNA, 64 nt, hsa
ugcucaaacuuuguucaauaucagggaauuuauauugaaaaaaacugugcgaauguaauaaagu

SEQ ID NO: 106928 - RNA, 64 nt, hsa
ggcaacagacucaugacaaaggauucaagauuguuugaaaaaaaaaaaaggggagcagggaggc

SEQ ID NO: 106929 - RNA, 64 nt, hsa
uuuuuuguuguuguucuggagagcuucuaggaacuugaaaaauacauaugccacacucuuaaga

SEQ ID NO: 106930 - RNA, 64 nt, hsa
ugauugacuggcuaguggccuggccauugguauuuugaaaaaucccuccaagugauucuuuuac

SEQ ID NO: 106931 - RNA, 64 nt, hsa
cuaauucacaaguuuuuuuuugaagugaauucuuuugaaaaaaaaaugcaaaacuagaaaacuu

SEQ ID NO: 106932 - RNA, 64 nt, hsa
gucaauauaaaaggcaguacuccacagaaugauguugaaaaacuucuucgaagaacaccuucua

SEQ ID NO: 106933 - RNA, 64 nt, hsa
agaaauaaacccauauaaauaugcucagcugauuuugaaaaagugaaaaagcaauucaauggag

SEQ ID NO: 106934 - RNA, 64 nt, hsa
cggacuuaaaugugauacauaaaacuagauaacuuugaaaaaagccacaggagaaaaaucuuca

SEQ ID NO: 106935 - RNA, 64 nt, hsa
gguggaaggaaacauaguagcaauggauacuuuuuugaaaaauuauugcauuaccaagaaacag

SEQ ID NO: 106936 - RNA, 64 nt, hsa
gugcaugcaagagcauucuuaggagaccacuguuuugaaaaacuuuugacuuguacguguuagc

SEQ ID NO: 106937 - RNA, 64 nt, hsa
uuuaccacugagguguuaauauaacauaguauuuuugaaaaaguuucuucaucuuauauugugu

SEQ ID NO: 106938 - RNA, 64 nt, hsa
guaaauaaaacaguguauuuugaaguuugacugcuugaaaaagauuagcauacaucuaauguga

SEQ ID NO: 106939 - RNA, 64 nt, hsa
acugucagaauuguuaacugaaacaaauauuugcuugaaaaaaaaaguucaugaaguaccaaug

SEQ ID NO: 106940 - RNA, 64 nt, hsa
aaaaucucaagaagugaagcagauucauacagccuugaaaaaaguaaaacccugaccuguaacc

SEQ ID NO: 106941 - RNA, 63 nt, hsa
auacauugguguaugucaaagaauaaauuaguaaaauuaguaaaugaaaaagacucuuccgua

SEQ ID NO: 106942 - RNA, 64 nt, hsa
uucaauaucauacauugguguaugucaaagaauaaauuaguaaaauuaguaaaugaaaaagacu

SEQ ID NO: 106943 - RNA, 64 nt, hsa
aaacaauuuagaaaauaguuauccauugacuagaaauuaguacaugcccacagcuggcucccac

SEQ ID NO: 106944 - RNA, 64 nt, hsa
auuauuuuuauaaauuuuauuguuggaaaucaaaaauuaguagauuuuuuaccauguuaaauua

SEQ ID NO: 106945 - RNA, 64 nt, hsa
caaauuucagcuacauaaaacauuucaggauuuaaauuaguaccauaucaauuuucugugauga

SEQ ID NO: 106946 - RNA, 64 nt, hsa
ugguucaaucuuaguaaauuaacauucuggauuuaauuaguaguucuaaguuacaccuggccug

SEQ ID NO: 106947 - RNA, 64 nt, hsa
gcagagugagacucgucucaaaaaaaagaaagaaaauuaguaauuguaaguaccccugauaagc

SEQ ID NO: 106948 - RNA, 64 nt, hsa
gaaaauuaguaauuguaaguaccccugauaagcaaauuaguaauugucaauaccccuguuaagc

SEQ ID NO: 106949 - RNA, 64 nt, hsa
uuaacagcuuauaaaaaauuugucuaaauuuaauaauuaguauaaggauaugaccuaauaaaug

SEQ ID NO: 106950 - RNA, 64 nt, hsa
aguauuuguagaagauuauguguuguauauaacaaauuaguauuuauagaauaugaccuauuua

SEQ ID NO: 106951 - RNA, 64 nt, hsa
ugauuauugugagucaaaacucuaagugguuaaaaauuaguaugaauuuuuuagcuucuuaaug

SEQ ID NO: 106952 - RNA, 64 nt, hsa
acccacuuuauagauaauuacagggauggugaaaaauuaguaaauagcuucacaaaagaggcag

SEQ ID NO: 106953 - RNA, 64 nt, hsa
ccaucuuaauaauuaguaauaauuaauuaguaauaauuaguaagcauuuucucaaugcucugau

SEQ ID NO: 106954 - RNA, 64 nt, hsa
ggggaugaagccaucuuaauaauuaguaauaauuaauuaguaauaauuaguaagcauuuucuca

SEQ ID NO: 106955 - RNA, 64 nt, hsa
cucuuagaccauuuggggaugaagccaucuuaauaauuaguaauaauuaauuaguaauaauuag

SEQ ID NO: 106956 - RNA, 64 nt, hsa
agauuuuagaguuagguaguacagguaagggggaaauuguaaagaauuagcagaauuaggcaua

SEQ ID NO: 106957 - RNA, 64 nt, hsa
uucauugcucccauaagcaaauuuguuuuaaaauaauuguaaaugagguauauacuuaguucuu

SEQ ID NO: 106958 - RNA, 64 nt, hsa
uucacuuaauaauguguacauuagucauucaauaaauuguaauuguaaagaaaacauacaacac

SEQ ID NO: 106959 - RNA, 64 nt, hsa
uaauaauguguacauuagucauucaauaaauuguaauuguaaagaaaacauacaacacuugccu

SEQ ID NO: 106960 - RNA, 64 nt, hsa
gcugcuguaagaaugugaauuugaauguauuuugaauuguaagagcaaaagaacguuuuuguac

SEQ ID NO: 106961 - RNA, 64 nt, hsa
auuggaaugaucuucagguuucuacaaauaggguaauuguaaauuuaaagcauuagcauuuauu

SEQ ID NO: 106962 - RNA, 64 nt, hsa
uaacauacugucaauuuuccuuguuugaauauagaauuguaacacuacacgguguacauuucca

SEQ ID NO: 106963 - RNA, 64 nt, hsa
uuuauggucguagcauauaguguuguauauuguaaauuguaauuucaaccagaaguaaauuuuu

SEQ ID NO: 106964 - RNA, 64 nt, hsa
cacuuuagguaucucuuaggcaaauagagauauaaauuguaauaggaaacagucucuaaaugug

SEQ ID NO: 106965 - RNA, 64 nt, hsa
acuuuaaaugucucugcucugacugaauugaaggaauuguaaguuucaguugcugaauauauca

SEQ ID NO: 106966 - RNA, 64 nt, hsa
gaaggcauguggauuauaagauuugucuaguaaaaauuguaauugaauauguuuaaauauuuaa

SEQ ID NO: 106967 - RNA, 64 nt, hsa
auaugcauuuuuacuaaguaguaauuuuacacugaauuguaaauguuuuuacagugaguuuuau

SEQ ID NO: 106968 - RNA, 64 nt, hsa
gauaagacaugaaaauuauauuauuaaaauguucaauuguaaugguaaucaugaguauacuuaa

SEQ ID NO: 106969 - RNA, 64 nt, hsa
augauugguuacaagagaauaauguuacauguuuaauuguaauauuugucuccuaucauuuucu

SEQ ID NO: 106970 - RNA, 64 nt, hsa
ugaaaaauaugcuucggaaacugugcauaguucuaauuguaagucagauuguauauucaaauug

SEQ ID NO: 106971 - RNA, 64 nt, hsa
cauaguucuaauuguaagucagauuguauauucaaauuguaauuaagagauuuaaauauuagaa

SEQ ID NO: 106972 - RNA, 64 nt, hsa
auuaauauagcuauugacaguuucaaagcagguaaauuguaaauguuucuuuaagaaaaagcau

SEQ ID NO: 106973 - RNA, 64 nt, hsa
gaguuguuccuuuacuggcugaaagauauauucgaauuguaaagaugcuuuuucucaugcauug

SEQ ID NO: 106974 - RNA, 64 nt, hsa
acccccacuccuuuauuucagcaaaagcuaauuaaauuguaauguuucuaugucaacuacuggg

SEQ ID NO: 106975 - RNA, 64 nt, hsa
auuuaguaaaguguaucaaaguaggacuuuuuugaauuguaaauaggugguuuuauuaaauaaa

SEQ ID NO: 106976 - RNA, 64 nt, hsa
ugauaauguguacagauuuucuguucaaauauucaauuguaaacuucuuguuaagacuguuacg

SEQ ID NO: 106977 - RNA, 64 nt, hsa
uuuuauguauagugaguauauuuugcauguuuuaaauuguaaauggagcuaaguccaagaaagu

SEQ ID NO: 106978 - RNA, 64 nt, hsa
auuuccacacugugaaggcaguauuagaagacuuaauuguaaaagcucucuugucacuguguua

SEQ ID NO: 106979 - RNA, 64 nt, hsa
cuaauguuacaucugaggaaguauguaauuugagaauuguaacuucuaagggauucacugcauc

SEQ ID NO: 106980 - RNA, 64 nt, hsa
uuuuacggugacuuuuggaggaggggaguuuggaaauuguaaaauguuauagauuguugccuau

SEQ ID NO: 106981 - RNA, 64 nt, hsa
ugauaaaaaccaagaugccuccacauuuugucauaauuguaaccaauuucaccucugucuccag

SEQ ID NO: 106982 - RNA, 64 nt, hsa
gguaccacucuuccacaguuuggaauaauuuuauaauuguaaagauagaaauuauauugauaag

SEQ ID NO: 106983 - RNA, 64 nt, hsa
aagauagaaauuauauugauaaguaaauauguaaaauuguaaauauguaaaaaaaagaauggug

SEQ ID NO: 106984 - RNA, 64 nt, hsa
ugcucuuugaugauaaaacuuguaauagagcaauaauuguaaaugguuaccauacuguaagaua

SEQ ID NO: 106985 - RNA, 64 nt, hsa
auuuuuaccauauuuuaagaacuuuaagacgauuaauuguaaauaauuuauuugauuggugcag

SEQ ID NO: 106986 - RNA, 64 nt, hsa
uuuaagaauaccaugaauguaagaaauugaaagaaauuguaaaauaucacauaauauagaaaug

SEQ ID NO: 106987 - RNA, 64 nt, hsa
cucaaugcgauucugagauauuugaauuucauaaaauuguaacugaaauuuaaaauuuuuaguu

SEQ ID NO: 106988 - RNA, 64 nt, hsa
auuuuaaggagcucccaaaauguguuaccuauuaaauuguaacucagcaaguagaagaccauuu

SEQ ID NO: 106989 - RNA, 64 nt, hsa
gcguuagcagcacccuacagaggguaaguuucagaauuguaauuugagaacuccuucaauuaua

SEQ ID NO: 106990 - RNA, 64 nt, hsa
ggacugcuugaauuacauuggcuuuuagaaccgaaauuguaacuauguauuguauuucauggga

SEQ ID NO: 106991 - RNA, 64 nt, hsa
agaccaaaguaguauagaaguauggacuuaauuuaauuguaaaauuauuagagguauuuguugu

SEQ ID NO: 106992 - RNA, 64 nt, hsa
aaaugugcuuguuauugauaggaucauguuguuaaauuguaaauuuucaaaauuaauugauguu

SEQ ID NO: 106993 - RNA, 64 nt, hsa
aacgaaggagaaaaagguaguuugaaccuugguaaauuguaaacagcuaauaaugaaguuauuc

SEQ ID NO: 106994 - RNA, 64 nt, hsa
gagacucgucucaaaaaaaagaaagaaaauuaguaauuguaaguaccccugauaagcaaauuag

SEQ ID NO: 106995 - RNA, 64 nt, hsa
auaaaauugaaguacuuaauugaagcuuuuuaaaaauuguaaaguaaaugaaagcuauugagau

SEQ ID NO: 106996 - RNA, 64 nt, hsa
acccuuuuuuccgucaaaauuggauuuguaauuaaauuguaagccucguaggauguauguugga

SEQ ID NO: 106997 - RNA, 64 nt, hsa
auuguuucuuguuuuguacugcaauagggguuauaauuguaagauaaaaauguguguguguuua

SEQ ID NO: 106998 - RNA, 64 nt, hsa
gaaaauccucuauugagaauguggauaaaugaacaauuguaaguuuugcaucauaaacugagaa

SEQ ID NO: 106999 - RNA, 64 nt, hsa
uaagaaucagaguaggguaacaauguaccaggcaaauuguaaguugaaauucuagauaagcaug

SEQ ID NO: 107000 - RNA, 64 nt, hsa
aacuaaacagagguuuccaaacugaaggcaaccuaauuguaaaugccuguguuaaagaggcagc

SEQ ID NO: 107001 - RNA, 64 nt, hsa
uguaaauauuuaauauuccgcuaauuugauuuugaauuguaaaugucaaguauucuguuuuugg

SEQ ID NO: 107002 - RNA, 64 nt, hsa
cagcuauuuaggggaauguuacguugaucucuuaaauuguaaacacuacaaaaugucaaaauaa

SEQ ID NO: 107003 - RNA, 64 nt, hsa
uacaguuuuuuuuguuugguuugugggcuguuggaauuguaauuuuuaauugccuucuaaaaaa

SEQ ID NO: 107004 - RNA, 64 nt, hsa
ucauugucaaaugcauauuuagauuagauuauugaauuguaauguuuaucugcugcuuuuuuua

SEQ ID NO: 107005 - RNA, 64 nt, hsa
acucuuaauacauuucuuuaagacuuguaaguauaauuguaaagcuuguuaacuguuuauauac

SEQ ID NO: 107006 - RNA, 64 nt, hsa
ugggagaauuauuucuauauauuagugaaauuugaauuguaaacuugucagugaauuuaucacu

SEQ ID NO: 107007 - RNA, 64 nt, hsa
guaaccugaaaugccacuauuguggaaauaggauaauuguaauugugaaaaaauaauuuuaagg

SEQ ID NO: 107008 - RNA, 64 nt, hsa
acauuuaauuuaguacaauuaaguauauuauaaaaauuguaaaacuacuacuuuguuuuaguua

SEQ ID NO: 107009 - RNA, 64 nt, hsa
cauauguaguagaaucagccauugcucugcuccuggcauagagucaccuguuuguuauguggau

SEQ ID NO: 107010 - RNA, 64 nt, hsa
agaacacuuggaaugaacgaaugaacuuguagggggcauagaggauucuugaaaaaaaaaaaug

SEQ ID NO: 107011 - RNA, 64 nt, hsa
aucuacagucgcugaauaaccaauaaacaguaaccuccaucaaaugcuauaccaauggaccagu

SEQ ID NO: 107012 - RNA, 64 nt, hsa
cuccauagguuccugaugaguuucuuucuacuuucuccaucaucuucuuuccucuuucuuccca

SEQ ID NO: 107013 - RNA, 64 nt, hsa
ugaggauggcagagggacacagugccugucucgccuccaucagggagagcagccaugccaggga

SEQ ID NO: 107014 - RNA, 64 nt, hsa
uguccccuucuccccagcuaagaauguguggcaccuccaucaguuauacuuagaaggagcagaa

SEQ ID NO: 107015 - RNA, 64 nt, hsa
acaagagaagcccccaaccugauucucaugacagcuccaucaagaaugugggaugugccgacca

SEQ ID NO: 107016 - RNA, 64 nt, hsa
cuggucuuguguuacacauccauggaccgguucacuccaucauauacagcucucugcuccgugu

SEQ ID NO: 107017 - RNA, 64 nt, hsa
uuuucaagguccuucuauuguuuugucugauuuucuccaucauccugauuagcauguuuauucc

SEQ ID NO: 107018 - RNA, 64 nt, hsa
augagccuuuguuugagauuugaaaacaacauggcuccaucacauauucccuuuuuucuuuuga

SEQ ID NO: 107019 - RNA, 64 nt, hsa
aaccagaaugacuggacaaucuuuuucauagcuucuccaucacauucaagcugguuuaugucac

SEQ ID NO: 107020 - RNA, 64 nt, hsa
auugugcucagugaacauccagugcugggugcagcuccaucacccucuuguguguuuacauguc

SEQ ID NO: 107021 - RNA, 64 nt, hsa
cagagguggggcugcaccagacucagcacuagcacuccaucagcacuagcaccucacuccauca

SEQ ID NO: 107022 - RNA, 64 nt, hsa
ucagcacuagcacuccaucagcacuagcaccucacuccaucagcacuagcaccucacuccaucg

SEQ ID NO: 107023 - RNA, 64 nt, hsa
cuccaucggcacuaaugccccacucggcgccccacuccaucagcacuaaugcuccacuccauug

SEQ ID NO: 107024 - RNA, 64 nt, hsa
acuaaugacccgcuccuuugacauuggugccccacuccaucagcacuaacgcccugcuccaucg

SEQ ID NO: 107025 - RNA, 64 nt, hsa
acuaacguccggcuccaucggcacuaccaccccgcuccaucaucacuauguccagcuccgucgg

SEQ ID NO: 107026 - RNA, 64 nt, hsa
cacuauguccagcuccgucggcacuaccacccugcuccaucaucacuacguccagcuccaacgg

SEQ ID NO: 107027 - RNA, 64 nt, hsa
uccccguugucauagcuauuucauugccaaccaacuccaucacaugguuguugauaucgucaua

SEQ ID NO: 107028 - RNA, 64 nt, hsa
uucuuucuuguuccacaaugaauugcacauccaucuccaucagagcugauagccuguuaauaag

SEQ ID NO: 107029 - RNA, 64 nt, hsa
cacacgcugcguucacugccaaugcuguacucaccuccaucacccuccaacuuuggggcccaug

SEQ ID NO: 107030 - RNA, 64 nt, hsa
cgagauugaacuguagcccgagccgccccacccacuccaucaucuccaggugccccacgccugg

SEQ ID NO: 107031 - RNA, 64 nt, hsa
ggccagccugccuccaccucccacccccuuccaccuccaucagucaugugugcagagucagugc

SEQ ID NO: 107032 - RNA, 64 nt, hsa
ggcccagggcuacuaaagacuucaggauagaauucuccaucaaauauacagcauaaguaaaacu

SEQ ID NO: 107033 - RNA, 64 nt, hsa
cuaggcuacauuucaaaauucagggcuguuuaagauuuaaaaucacaaacauuaacggcaguag

SEQ ID NO: 107034 - RNA, 64 nt, hsa
uuucagucauaguacuaauaauuaaauuuucaguauuuaaaaagacaaaguauuuuguccauuu

SEQ ID NO: 107035 - RNA, 64 nt, hsa
ugaauacuuuuuucauaguuauuuguuuaaaaagauuuaaaaaucauugcacuuuggucagaaa

SEQ ID NO: 107036 - RNA, 64 nt, hsa
aaugcuaagugguauccgagguucuuaauaugagauuuaaaaucuuaaaauguuucuuauuuuc

SEQ ID NO: 107037 - RNA, 64 nt, hsa
augcagccacuauaacuugauaagucauugcacuauuuaaaaaguuuuaguaauaucaugaauu

SEQ ID NO: 107038 - RNA, 64 nt, hsa
uuuaaaauguauuugaaguaauauuuaaauaggcauuuaaaauuucaaauuagauguuaaauuu

SEQ ID NO: 107039 - RNA, 64 nt, hsa
cauucacucuguuucucuucugcuggauuauauaauuuaaaaauaauguguucccguauuuugu

SEQ ID NO: 107040 - RNA, 64 nt, hsa
uaaaugcugauauugauuucacugguccaucuauauuuaaaacgugcaagaaaaaaauaaaaua

SEQ ID NO: 107041 - RNA, 64 nt, hsa
uuuguguaacaaaggcauaucgucauguuaauaaauuuaaaacaucauucguauaaaauauuuu

SEQ ID NO: 107042 - RNA, 64 nt, hsa
caaauucaauguuauacauacuugguaaacauuuauuuaaaauuuaauuuacuauacuuauugu

SEQ ID NO: 107043 - RNA, 64 nt, hsa
auuugguguacuaacaucaaaauguauccaagccauuuaaaaaauauuuauauauacauaguag

SEQ ID NO: 107044 - RNA, 64 nt, hsa
gccaggaaaggcuagguucaguagaugagacauuauuuaaaagauaaauuuaaaaagaugguaa

SEQ ID NO: 107045 - RNA, 64 nt, hsa
agguucaguagaugagacauuauuuaaaagauaaauuuaaaaagaugguaaaugaacacuuguu

SEQ ID NO: 107046 - RNA, 64 nt, hsa
uuguguguaauugccauuaaauuuucaaaauguaauuuaaaaggauuaaauacucauuuaauaa

SEQ ID NO: 107047 - RNA, 64 nt, hsa
auguaauuuaaaaggauuaaauacucauuuaauaauuuaaaauaauuauuguauaauaucuaca

SEQ ID NO: 107048 - RNA, 64 nt, hsa
acuaaaacaaagaaaugguaaaugaauuguuugcauuuaaaaaaaaaaacucuuaagaaaacug

SEQ ID NO: 107049 - RNA, 64 nt, hsa
cucuaaaguguauauuuuuguguccaguuauauuauuuaaaaaaguguuacuuuguaaaaauug

SEQ ID NO: 107050 - RNA, 64 nt, hsa
aagacaaaguuuuucagaaaagaggaaaaaaagaauuuaaaaaaggaucuccacucuucaugac

SEQ ID NO: 107051 - RNA, 64 nt, hsa
aaaaauuuaacugguuuuuacuacugaugacuugauuuaaaaaaaauacaaagaugcuggaugc

SEQ ID NO: 107052 - RNA, 64 nt, hsa
cucuagguauauuuccaacuuuauauaucacaguauuuaaaaagacauguuugcauugagaaau

SEQ ID NO: 107053 - RNA, 64 nt, hsa
uauauauucaauuuuuuaccauuuuauggaaaauauuuaaaaucuguuuuuacaggguuuuuuu

SEQ ID NO: 107054 - RNA, 64 nt, hsa
uuaugaauaauaaagauguuaacaauccaucuguauuuaaaacacuagcagccagaucugcugc

SEQ ID NO: 107055 - RNA, 64 nt, hsa
aaaaugagacauugucucuaaaauacauaaguaaauuuaaaaaaaaaagaauaauaauuugaac

SEQ ID NO: 107056 - RNA, 64 nt, hsa
aacgcuaauuaaaaacuugcuuuaaagauauugaauuuaaaaaggcauaauaaucaaauacuua

SEQ ID NO: 107057 - RNA, 64 nt, hsa
caucagucuuuuucaucauccaaguuuguaguucauuuaaaaauacaacauuaaacacauuuug

SEQ ID NO: 107058 - RNA, 64 nt, hsa
guuucacucaugucugucauuuuauaagcauaucauuuaaaaagcuucuaaaaagcuauuucgc

SEQ ID NO: 107059 - RNA, 64 nt, hsa
augaaaauauauuucccuguaagcugaauuacucauuuaaaaauuuuaacuucuauaugggacc

SEQ ID NO: 107060 - RNA, 64 nt, hsa
gcaacuuuaaggcuuguaaauacauagaacaaauauuuaaaaaaacaaaaagaaauugacucag

SEQ ID NO: 107061 - RNA, 64 nt, hsa
aucuuucugccugccucucagcuugcuucagaaaauuuaaaaaaucacaauaguaaucaaaaca

SEQ ID NO: 107062 - RNA, 64 nt, hsa
uuuguuuaaccuugaugaauuguauaaagagagaauuuaaaaaauuacauucuuuauuuucuau

SEQ ID NO: 107063 - RNA, 64 nt, hsa
acauuuaauggaaagcaaaacaaaucagguccugauuuaaaauuuuaacacguuuagauagcuu

SEQ ID NO: 107064 - RNA, 64 nt, hsa
uaacauaaaagcaaguacauauaguagugacuauauuuaaaaaaacagcauaaaaugcuuaaaa

SEQ ID NO: 107065 - RNA, 64 nt, hsa
uuagguaccuaucugcuccaauuauauuuuuaacauuuaaaaaccaaaguccucuacacuugau

SEQ ID NO: 107066 - RNA, 64 nt, hsa
acagaaagcacugaguugagcaagcaauuccuuuauuuaaaaaaaaaaguacguauuuagauaa

SEQ ID NO: 107067 - RNA, 64 nt, hsa
cauguuaccauugguuuauucuugugcuuucuguauuuaaaacuuuggcuguacuaagcaaaug

SEQ ID NO: 107068 - RNA, 64 nt, hsa
guucugucauucauuauuuacaaccauuugcuucauuuaaaaccauuucagcuauaacaaagua

SEQ ID NO: 107069 - RNA, 64 nt, hsa
uaccuucagcuugaugcauggucacuucuuuacuauuuaaaauacuacacauuguacaaaauau

SEQ ID NO: 107070 - RNA, 64 nt, hsa
auagauacacaugauuauguuaagaggcuuuaagauuuaaaaguuucacacaaccauaaguaua

SEQ ID NO: 107071 - RNA, 64 nt, hsa
cugucuucccccaaagaguugaaaucuuaaaucuauuuaaaaggauauaaaagcuuuggauaug

SEQ ID NO: 107072 - RNA, 64 nt, hsa
cuuuuuuuagccaaaauguaaaaauggcuguaauauuuaaaacuuauaacaucuuauuguuggu

SEQ ID NO: 107073 - RNA, 64 nt, hsa
aauuuuugaguuuuacauucuuacagaaaaguccauuuaaaagugaucauuuguaagaccaaaa

SEQ ID NO: 107074 - RNA, 62 nt, hsa
aacugugcuauuauuucaauaaagaccucuugacauuuaaaacuguuucuguuccucagucu

SEQ ID NO: 107075 - RNA, 64 nt, hsa
auagcauggcuugaaaugcuaugucugcaugauaauuuaaaauggaagauuuaaacuuugcacu

SEQ ID NO: 107076 - RNA, 64 nt, hsa
ucuuucuccaagaacuuucaagccaacaaaugaaauuuaaaagcaaauguaaaaguguucugua

SEQ ID NO: 107077 - RNA, 64 nt, hsa
acuuacguuaaacuucauuucuaguacacgcccuauuuaaaaaagagcaguacauccugggagg

SEQ ID NO: 107078 - RNA, 64 nt, hsa
aagauacagacauucaaugaauuauauucaaugcauuuaaaauaccacuguaauugacagagua

SEQ ID NO: 107079 - RNA, 64 nt, hsa
aaauaacaacuaacuuguuugaggcaaaucuaaaauuuaaaauuaaucuugcuucauuguuaca

SEQ ID NO: 107080 - RNA, 64 nt, hsa
uaauaguuaaaaguggaagaauagaaauaaauaaauuuaaaaugaaauuaauuaaaguagaaga

SEQ ID NO: 107081 - RNA, 64 nt, hsa
aaaauccaauuugaauaagucaugcuuuccuagaauuuaaaaauaaaaaagucuuccucuggaa

SEQ ID NO: 107082 - RNA, 64 nt, hsa
cuaucuaucuauaucuacaucuauauaaucuuacauuuaaaauuguauuccuacacauauuaga

SEQ ID NO: 107083 - RNA, 64 nt, hsa
uaaacgcuaaaacauuugaagaaacaauuuaauuauuuaaaauucaaguauuuuauucacauua

SEQ ID NO: 107084 - RNA, 64 nt, hsa
gcagccacuguaugauauuuuaagcaaauauguuauuuaaaauauugauccuucccuuggacca

SEQ ID NO: 107085 - RNA, 64 nt, hsa
cacgucagcaagagccucuuugucucacuccaucauuuaaaaccaguauauucaguaguugaag

SEQ ID NO: 107086 - RNA, 64 nt, hsa
gacacuguggucagucauuugaaaauugacuuuaauuuaaaacaaaggccugugccucccaccc

SEQ ID NO: 107087 - RNA, 64 nt, hsa
uugcauuuaaaugauaacauaaaagauauaaaaaauuuaaaacugcuauuuuucuuauagaaga

SEQ ID NO: 107088 - RNA, 64 nt, hsa
uaucucacaaauaggaaauaaaacuaaaacguggauuuaaaaagaacugcacgggcuuuagggu

SEQ ID NO: 107089 - RNA, 64 nt, hsa
uuucuaaaucugggauuuaaaaucuuuagacaauauuuaaaaucuugauuuuuuuuaaauguca

SEQ ID NO: 107090 - RNA, 64 nt, hsa
caacaguccuaaacugucauuuucuaaaucugggauuuaaaaucuuuagacaauauuuaaaauc

SEQ ID NO: 107091 - RNA, 64 nt, hsa
ucucauuucuacaucuuagcagugacaaacugcaauuuaaaaaguguguuugguuauuaauaua

SEQ ID NO: 107092 - RNA, 64 nt, hsa
aagugggaaaugagaaguuauaccaauaaaaagcauuuaaaaauuuaggggauauuguaaccca

SEQ ID NO: 107093 - RNA, 64 nt, hsa
ggucugcauuugggggcuaaaguguauauauuccauuuaaaauggaauuuguuuguauuugggg

SEQ ID NO: 107094 - RNA, 64 nt, hsa
agcccaugggcauuaaggcaaaguaguuccagugauuuaaaauacgguuccaaauacgcuaaaa

SEQ ID NO: 107095 - RNA, 64 nt, hsa
uagacucccuacaguccuucaauggaaaaguaacauuuaaaaauccuuuggguaauucgaauua

SEQ ID NO: 107096 - RNA, 64 nt, hsa
cauuuaaaaauccuuuggguaauucgaauuacagauuuaaaagagcuuaagaucugguguuuug

SEQ ID NO: 107097 - RNA, 64 nt, hsa
aaacuauugcuacuuaaauuuccaauaauuaaaaauuuaaaauuuuuaaauuagaauugccaau

SEQ ID NO: 107098 - RNA, 64 nt, hsa
ugucucuauuaagaaaaaaaauguuaacauuaugauuuaaaagugcauuaaccuuaaucuagau

SEQ ID NO: 107099 - RNA, 64 nt, hsa
ggcaaccuccagaacugugaaaaauaaauuuguuauuuaaaaagaaaaaaaaaaaaacaaaaac

SEQ ID NO: 107100 - RNA, 64 nt, hsa
ugccggauggaaagaggcugccccauuugaggucauuuaaaaucugugaagcaaauccagacuc

SEQ ID NO: 107101 - RNA, 64 nt, hsa
cauucauauuugcacaggaaaaauaaagaccuggauuuaaaaauaggaaugacucuugcuucag

SEQ ID NO: 107102 - RNA, 64 nt, hsa
aaaauaaacguccuggggguuacccagaauacagauuuaaaaguuugccuguagagcaaaauaa

SEQ ID NO: 107103 - RNA, 64 nt, hsa
gaaaugacugcugaaauaaggcgauuguaugaauauuuaaaaugccuggaacacuaaaguaaag

SEQ ID NO: 107104 - RNA, 64 nt, hsa
uuggaaucgugucuuccaugcuccacuggguucaauuuaaaauaggagaggcuuucucuucuga

SEQ ID NO: 107105 - RNA, 64 nt, hsa
aggugugguuuuauugaaugucuauuugaguaucauuuaaaaaguauuugccuuuuacugucau

SEQ ID NO: 107106 - RNA, 64 nt, hsa
gucauggaauaguuuuuauauuuacagcuuuuauauuuaaaacuuguaagaguuuuuuuaauga

SEQ ID NO: 107107 - RNA, 64 nt, hsa
aaaaaaaaaaaaacuucaguuuucuaaaaauuauauuuaaaauuguaaucaaaauguaccuagu

SEQ ID NO: 107108 - RNA, 64 nt, hsa
aaacugcuuuuuccaacucagaaauucaauuuggauuuaaaagccugcucaaucccugaggacu

SEQ ID NO: 107109 - RNA, 64 nt, hsa
uacguagccuaaggcuccuguuuugcacagccaaauuuaaaacuguuggaauggauuuuucuuu

SEQ ID NO: 107110 - RNA, 64 nt, hsa
uaaucauugcuuucuguagaagaaaaagguuuaaauuuaaaauguguauuuagagcauggagag

SEQ ID NO: 107111 - RNA, 64 nt, hsa
ugagucaauaccuuuauaagcaaaaccaugauaaauuuaaaaacaacagaaauguggcaugauu

SEQ ID NO: 107112 - RNA, 64 nt, hsa
gggcaugugcuauuaccagaaacaacaaacuuauauuuaaaauacccuucauuugacacaguuu

SEQ ID NO: 107113 - RNA, 64 nt, hsa
ucaguauuguguaucuuuggacaauuagauggacauuuaaaauggaacuucuuuuaucugacag

SEQ ID NO: 107114 - RNA, 64 nt, hsa
aucacugucucaaagagauauuaaaauuuuauacauuuaaaaucauuguuaaauugauugagga

SEQ ID NO: 107115 - RNA, 64 nt, hsa
aaaaucauuguuaaauugauugaggaaaacaaccauuuaaaaaaaaucuauguugaauccuuuu

SEQ ID NO: 107116 - RNA, 64 nt, hsa
gaauugguuauuugggggcuuuuuuacuuacuguauuuaaaaauacaaggguauugauaugaaa

SEQ ID NO: 107117 - RNA, 64 nt, hsa
gcguguauggaugugugugagucagugguagcuuauuuaaaaagcaccuuauccuuucucccau

SEQ ID NO: 107118 - RNA, 64 nt, hsa
aucuccugauuuuucaauguuauucuucaguccuauuuaaaaacaaaaccaagcucccuucccu

SEQ ID NO: 107119 - RNA, 64 nt, hsa
gagagaaguaucagcacccagaagagaaaaaggaauuuaaaacaaaaaccacagaggcggaaau

SEQ ID NO: 107120 - RNA, 64 nt, hsa
uggaaacaguauuuguaaauggaacuaaugcuauauuuaaaaacacugauuuuuuuuuaaccug

SEQ ID NO: 107121 - RNA, 64 nt, hsa
acuucuuuuuacauuucagcuccagcagccagcuauuuaaaaaauauuuuuaaauaucuucccc

SEQ ID NO: 107122 - RNA, 64 nt, hsa
cauugucuuggugguguuacaagacuuguuauccauuuaaaaaugguaguggaaauucuaugcc

SEQ ID NO: 107123 - RNA, 64 nt, hsa
uaugauuuauuagcacaacgugguacuauuugccauuuaaaacuagaacagguauauaagcuaa

SEQ ID NO: 107124 - RNA, 64 nt, hsa
gcaacacaagacaccuuuuguauuuaaaaccuugauuuaaaauaucaccccuugaagccuuuuu

SEQ ID NO: 107125 - RNA, 64 nt, hsa
acuguaugauuaagcaacacaagacaccuuuuguauuuaaaaccuugauuuaaaauaucacccc

SEQ ID NO: 107126 - RNA, 64 nt, hsa
guagugugcaguucuaguuugcauuccugauaugauuuaaaacauguaauauaaagauguuaaa

SEQ ID NO: 107127 - RNA, 64 nt, hsa
aucagucagugcaaaugucagauacaauguauuuauuuaaaagauucauuuuuaaucaugaaau

SEQ ID NO: 107128 - RNA, 64 nt, hsa
uuuccaauggcucaggagacaaugaaaagcccccauuuaaaaaaauaacaaacauuuuuuaaaa

SEQ ID NO: 107129 - RNA, 64 nt, hsa
aagugcaccuagcuuauuacaucgugaaagguacauuuaaaauauguuaaauuggcuugaaauu

SEQ ID NO: 107130 - RNA, 64 nt, hsa
aagaauaaauuuggacccgguuucugauuauuuaauuuaaaagaucacuuacaggaucauguua

SEQ ID NO: 107131 - RNA, 64 nt, hsa
cuguuguaauggaguaaagaagagggccagcuuaauuuaaaaauaaagugaguuuaccaaaauu

SEQ ID NO: 107132 - RNA, 64 nt, hsa
guuauuccaguaaaaggaaauaguuuucucaaccauuuaaaaauauucuucugaacucaucaaa

SEQ ID NO: 107133 - RNA, 64 nt, hsa
acuugcucugaccccucuaagcaaacuacuaagcauuuaaaagagaaucuaauuuuuaaaggug

SEQ ID NO: 107134 - RNA, 64 nt, hsa
ugaaaugaaaucuucccaguauuauaaauuguguauuuaaaaaaaagaaacuuuucugaaugcc

SEQ ID NO: 107135 - RNA, 64 nt, hsa
uacuuugaagugcagcucauguuuuuaacuuuuaauuuaaaaacacaaaaaaaauuuuagcucu

SEQ ID NO: 107136 - RNA, 64 nt, hsa
uuuuuuguaccuacguaagaguacuugaaguuuuauuuaaaauaaaauguuguggaaaagguag

SEQ ID NO: 107137 - RNA, 64 nt, hsa
cauuucccucccauuugccuugccucagaaauaaauuuaaaagacguuuguaaccacuguguuu

SEQ ID NO: 107138 - RNA, 64 nt, hsa
aucaaguauaaaauucugaaacagaggcuuuaaaauuuaaaaccucagcaaaauaauccaugaa

SEQ ID NO: 107139 - RNA, 64 nt, hsa
acaaaaccacaucagguuuucagaaggaaaaaacauuuaaaaacccaccaucacaugagagaau

SEQ ID NO: 107140 - RNA, 64 nt, hsa
uggacagaggcauuuucaccuuaauggugaaguaauuuaaaauauaaauccauucaggugacaa

SEQ ID NO: 107141 - RNA, 64 nt, hsa
ugacacagggggccuggaaagaaagggaaaguggauuuaaaauauauauauacguaacccaagc

SEQ ID NO: 107142 - RNA, 64 nt, hsa
cacuacagguuaaaagaccauaagcaaacugguuauuuaaaauguaaaaaggaauaugaaaguc

SEQ ID NO: 107143 - RNA, 64 nt, hsa
aauacauuguacauauuauguuaauauuuacacaauuuaaaauauagauguguuuuauuuugaa

SEQ ID NO: 107144 - RNA, 64 nt, hsa
cauccagaauguauagacaggaaaagcaugucuuauuuaaaacuguaauuuaugggcucaggau

SEQ ID NO: 107145 - RNA, 64 nt, hsa
caaauugcccacucgugauaagucaacagccaauauuuaaaacuuuguucguuacuggcuuuac

SEQ ID NO: 107146 - RNA, 64 nt, hsa
caauaaugagaaauguuggugugcuuuucuaagcauuuaaaacauaauugccaauugaaacccu

SEQ ID NO: 107147 - RNA, 64 nt, hsa
uuauuaucuuuaacuguaucuauuuugaauguaaauuuaaaaaaaguaauucucugucaaugga

SEQ ID NO: 107148 - RNA, 64 nt, hsa
uaguuugauaugguuacuucuauguugaaauaaaauuuaaaaucacaugcaaaaaaaaaaucag

SEQ ID NO: 107149 - RNA, 64 nt, hsa
aaagcaccugauuugcacuugaaccagauuauagauuuaaaaguauaugacauguauuuuguau

SEQ ID NO: 107150 - RNA, 64 nt, hsa
uuauagauuuaaaaguauaugacauguauuuuguauuuaaaacuagaauagccaguauuuaugu

SEQ ID NO: 107151 - RNA, 64 nt, hsa
uaaauguguuuuuaaccucccgcauucugugcuuauuuaaaacaaggaaacuucuaaccauuuc

SEQ ID NO: 107152 - RNA, 64 nt, hsa
ucuuuuguguauucauguuuaaagaaaaaaagugauuuaaaaaugaucuuaccuguaccagaaa

SEQ ID NO: 107153 - RNA, 64 nt, hsa
guuguucuuuaaguguacaucguaauuugaccuaauuuaaaaauaauauauuuucgaaguagua

SEQ ID NO: 107154 - RNA, 64 nt, hsa
uuuuauaaauaaauaauuccaaaauaauuucuuaauuuaaaaugauagcacuucucuugcacuu

SEQ ID NO: 107155 - RNA, 64 nt, hsa
ugcaaauauauuuugaaguuacuuuuaaauauuuauuuaaaaccucuguuucuguaacuguaug

SEQ ID NO: 107156 - RNA, 64 nt, hsa
aaugagaauagacuggaacaugugagggaaaaauauuuaaaaaaagauggcagucaucuagaca

SEQ ID NO: 107157 - RNA, 64 nt, hsa
aucaggauugcaugaaagaagaaaauccuucaauauuuaaaauguuucuuacaauacccacgga

SEQ ID NO: 107158 - RNA, 64 nt, hsa
auggcaccuugaaagugaacuucuagaaaucuacauuuaaaaggcaaagcuuuaaaagcagagc

SEQ ID NO: 107159 - RNA, 64 nt, hsa
agaaaggagauuuauuuuccuuaaacauccaauaauuuaaaaugauuuucaauaauaauaauca

SEQ ID NO: 107160 - RNA, 64 nt, hsa
aggaagugggcuaagaugggaaaaauauaaaaagauuuaaaauccagcaacaaaauuuacacau

SEQ ID NO: 107161 - RNA, 64 nt, hsa
aacagaguaaauagcauucucuaucaauauauaaauuuaaaaaacuaucuuuuugcuuacaguu

SEQ ID NO: 107162 - RNA, 64 nt, hsa
caucauguuacuuuaaauauaucuauauuauuguauuuaaaauguguuucuuacagacugcaug

SEQ ID NO: 107163 - RNA, 64 nt, hsa
uggaaccagcaguucagagaucugccuuauaaacauuuaaaaccgguuugugguacacaaagag

SEQ ID NO: 107164 - RNA, 64 nt, hsa
cagucuauucuaggaaugaaccagcaaguuguucauuuaaaacugaccaaagacaauuaauucc

SEQ ID NO: 107165 - RNA, 64 nt, hsa
agggaauaaauuuuugucuuuguuggagugaagcauuuaaaagaguaaggguaaaaaagauaaa

SEQ ID NO: 107166 - RNA, 64 nt, hsa
caccucagaaauugaaagcacuaugaauuuguccauuuaaaaaugaucuguaguuuuuuuggug

SEQ ID NO: 107167 - RNA, 64 nt, hsa
gacucaagcaauguggcugacuguaacuuuauuaauuuaaaagguaggaaguaagcuacuuagu

SEQ ID NO: 107168 - RNA, 64 nt, hsa
cuuuaagugucugugaacauggaguaauauuacuauuuaaaauaggccauuuguaucuaccuuu

SEQ ID NO: 107169 - RNA, 64 nt, hsa
auguacaaaaaaauggcaaauucaauaaacucaaauuuaaaauaauuuuuaaauuaacaguuau

SEQ ID NO: 107170 - RNA, 64 nt, hsa
guuaaugggaauuuaacauauuuaagaaaccaauauuuaaaauguuggucuagguuuuuuuccu

SEQ ID NO: 107171 - RNA, 64 nt, hsa
auuuauauucauagauccucucaaguauuauacaauuuaaaaacucuuguuccaaaguccuguc

SEQ ID NO: 107172 - RNA, 64 nt, hsa
cauucuauauguaagauagcacacaaguagaaauauuuaaaagcagucuuauucacagauugca

SEQ ID NO: 107173 - RNA, 64 nt, hsa
gugauccgaugugcagccaaaucugagaggccccauuuaaaaaagaaagaacaugggugguaca

SEQ ID NO: 107174 - RNA, 64 nt, hsa
cccaccuugcagcgcauuccaaccaccugggagcauuuaaaacuccagaugcccacaccacacc

SEQ ID NO: 107175 - RNA, 64 nt, hsa
acacaaaucaaaugugaaggauuugauuuucuacauuuaaaaugaagaaccaaaacucucuucu

SEQ ID NO: 107176 - RNA, 64 nt, hsa
auuuuacuacauaguauacaaguuuuuaaugagcauuuaaaaaaauaaguaaaucuaggcuauu

SEQ ID NO: 107177 - RNA, 64 nt, hsa
uaaaguguauauuaggauuuaaauuuaugccacaauuuaaaaauaaaaccagagguuauauaca

SEQ ID NO: 107178 - RNA, 64 nt, hsa
uauuuuacuuguuuuuaauuauucauucauggcaauuuaaaaagucauauuuuaagugggauuu

SEQ ID NO: 107179 - RNA, 64 nt, hsa
uugcauuuugacauuacuuuauuauacauuuugcauuuaaaaggcugcaccaguuggcuuuucu

SEQ ID NO: 107180 - RNA, 64 nt, hsa
uuuaugaauuaauguuuauaaaugacuguacugaauuuaaaaccguacaguuucauuugcauuu

SEQ ID NO: 107181 - RNA, 64 nt, hsa
guugcuucccgcucauaaauacauaauauauugaauuuaaaauguguuuauuaaccgauucucc

SEQ ID NO: 107182 - RNA, 64 nt, hsa
cuguugcuuugugaguggagauagagacucuuacauuuaaaaauggaaaaacauuucacaaauu

SEQ ID NO: 107183 - RNA, 64 nt, hsa
agaguuuaaaaguuuagcuuauugaguaguugucauuuaaaauauaauugcgaauaucagaaaa

SEQ ID NO: 107184 - RNA, 64 nt, hsa
cacauccucauacaauuuaauugcucaaccaugcauuuaaaacuccucaagaaaggauugguac

SEQ ID NO: 107185 - RNA, 64 nt, hsa
uucaaacaauuuugugguuaaaacuggauuuuaaauuuaaaaaucaauaaaaauuucaaauguu

SEQ ID NO: 107186 - RNA, 64 nt, hsa
guucuguuagauguuguuauauuuuaaaaguuuaauuuaaaaaauuuaauuuguccuuccuaag

SEQ ID NO: 107187 - RNA, 64 nt, hsa
auuugcugcagaauuuggguugacuccugagcauauuuaaaacaaagaagcuagaaauuuagca

SEQ ID NO: 107188 - RNA, 64 nt, hsa
ugggauacagucuaacucaucugauuuaauaugcauuuaaaaaaaugccauaacuauuaaacac

SEQ ID NO: 107189 - RNA, 64 nt, hsa
cuucuauuguuugggccuuguggauaauguacagauuuaaaaacaaaucuuguugcugauuugu

SEQ ID NO: 107190 - RNA, 64 nt, hsa
cuaagaaggcaaagcagaaagaagagguauacuuauuuaaaaaacuaagaugaaaaaagugcgc

SEQ ID NO: 107191 - RNA, 64 nt, hsa
caaaaacaaauuuuaaaauuaaaguauuuuauacauuuaaaaauauggaaaaacaacccagacg

SEQ ID NO: 107192 - RNA, 64 nt, hsa
acuucuucacugaaguuauacugaacaaaauauuauuuaaaauuacuucaacuuuguguuuuua

SEQ ID NO: 107193 - RNA, 64 nt, hsa
ugaagguuuuguguauaucuuauguggauuaccaauuuaaaaauauauguaguucugugucaaa

SEQ ID NO: 107194 - RNA, 64 nt, hsa
aaagcauuacucuuuuucaauaaauuguuuuuuaauuuaaaaaaaggauuauuggcuuguuuuc

SEQ ID NO: 107195 - RNA, 64 nt, hsa
agugagauagaauacauguaagugugguuuuguaauuuaaaaagugcuauacuaagggaaagaa

SEQ ID NO: 107196 - RNA, 64 nt, hsa
augccuuaaauuuuaucaauaacagaauuauuguauuuaaaaaaaaacuaauacuuaucuuuaa

SEQ ID NO: 107197 - RNA, 64 nt, hsa
ugaucuuuuuguuucguuuuguuucuucuucugcauuuaaaaauuaaaagauugguuugaggau

SEQ ID NO: 107198 - RNA, 64 nt, hsa
uuacguguuacauggagugaggguagaugugaagauuuaaaacgauugauggauuuaaggaagu

SEQ ID NO: 107199 - RNA, 64 nt, hsa
accaaugcauguguuugaaauauccauuaagaugauuuaaaauuugucuuguauuuugaguuuc

SEQ ID NO: 107200 - RNA, 64 nt, hsa
uuuagggagaucauguuuucuuaaucaugcuggaauuuaaaaauuguuuuacuuguaucgaaau

SEQ ID NO: 107201 - RNA, 64 nt, hsa
aacuaauuacuaauuuuuaaagaacaaaucacacauuuaaaaaaucuguagaauuuauuuuaac

SEQ ID NO: 107202 - RNA, 64 nt, hsa
uucauccaaaugacauuaucugcacguuuuuaaaauuuaaaaacaaaggacuauuuaaaaauac

SEQ ID NO: 107203 - RNA, 64 nt, hsa
ucugcacguuuuuaaaauuuaaaaacaaaggacuauuuaaaaauacaguuuauuaacaaacgug

SEQ ID NO: 107204 - RNA, 64 nt, hsa
acacaguauacucuagucaauuuauguuaacuuuauuuaaaacacaauuuauuuggccgggcac

SEQ ID NO: 107205 - RNA, 64 nt, hsa
uacuuguggcuuuuauuaucuuuaaacuuguugcauuuaaaauauuuuuaaaaccuucuuaaca

SEQ ID NO: 107206 - RNA, 64 nt, hsa
ccuucugguuauauugugcaguuucaaaagaacuauuuaaaacucuugaaaacucauguaaaua

SEQ ID NO: 107207 - RNA, 64 nt, hsa
gggugaaaauuguauuuguuaaaauaccuuaauaauuuaaaaugaccugauuuccuggaaaauu

SEQ ID NO: 107208 - RNA, 64 nt, hsa
ugaucaucaaguuaauugguaaauuuuuauugaaauuuaaaacuugcauuuuuauauaugugua

SEQ ID NO: 107209 - RNA, 64 nt, hsa
uugcccuuaccacucccagaaacauaagugaccaauuuaaaaugcuagggaacaggcuuacaac

SEQ ID NO: 107210 - RNA, 64 nt, hsa
ucuggcauuuuuaaacauuuaaaaauuauuaaacauuuaaaaauuaguuuauuaucagauauca

SEQ ID NO: 107211 - RNA, 64 nt, hsa
uguuagaaauuaguuuuaucuggcauuuuuaaacauuuaaaaauuauuaaacauuuaaaaauua

SEQ ID NO: 107212 - RNA, 64 nt, hsa
uguuguuuucacucucugcacugacuuuuuaauuauuuaaaacucuagaaagaugaacaaaggu

SEQ ID NO: 107213 - RNA, 64 nt, hsa
ugguaacucuaauggggauagacccacuuaagauauuuaaaaagguauggcaucagcguuucau

SEQ ID NO: 107214 - RNA, 64 nt, hsa
ugauacuaauuaagauuacuuuuguauuaucacuauuuaaaagauccuaguaauuuauucuuuc

SEQ ID NO: 107215 - RNA, 64 nt, hsa
auuuguauaccccacugaauucaagcugauuuaaauuuaaaauuugguauaugcugaagucugc

SEQ ID NO: 107216 - RNA, 64 nt, hsa
accuauauaaaucaaaguacacauuauuuaaaauauuuaaaaaaauuuucaguuucuucauuuu

SEQ ID NO: 107217 - RNA, 64 nt, hsa
aaagagaugaccuauauaaaucaaaguacacauuauuuaaaauauuuaaaaaaauuuucaguuu

SEQ ID NO: 107218 - RNA, 64 nt, hsa
uucaauucuuaugucgcucaaaaaauaaaauuuaauuuaaaaaguaucugauuuuuaaaguaaa

SEQ ID NO: 107219 - RNA, 64 nt, hsa
uuuuuauuuuaguccuauuuguauuauuuuaugcauuuaaaaacacaguccugagagggaugga

SEQ ID NO: 107220 - RNA, 64 nt, hsa
uacuuauuccuaaacugauaauucuuacuucuggauuuaaaaucaaaaauaacacacuuguaca

SEQ ID NO: 107221 - RNA, 64 nt, hsa
uuuuuauuucagcccuauuuguauuauuuugugcauuuaaaaaacacaaucuuaaggggauaga

SEQ ID NO: 107222 - RNA, 64 nt, hsa
uuaucacuuucucuuugcauaauaauguacuaauauuuaaaauaccuucagccuaaggcacaag

SEQ ID NO: 107223 - RNA, 64 nt, hsa
uauuuuuauucagcaguguucuuuaaacgguuucauuuaaaaaguaacuuuuuuuuuuugccug

SEQ ID NO: 107224 - RNA, 64 nt, hsa
aauuaaaauuuuuguuuaaacuguccaggaucugauuuaaaaauauggucuuuguuuuauauga

SEQ ID NO: 107225 - RNA, 64 nt, hsa
uacuaccucuuuugauauaacuaguuucugagguauuuaaaaauuugguuuuaaaaauauuaag

SEQ ID NO: 107226 - RNA, 64 nt, hsa
uucuuuugucuucuuuuuaauauauaaaaguuauauuuaaaaaguauauaacauacuauauaug

SEQ ID NO: 107227 - RNA, 64 nt, hsa
uugcuauugaaagaucaauuuugucuuuaccugcauuuaaaauggaacagcucuuagcagcugu

SEQ ID NO: 107228 - RNA, 64 nt, hsa
ugauaauuauuacacaauuuaaaacaacauauauauuuaaaauaaauauauacaguaaauauau

SEQ ID NO: 107229 - RNA, 64 nt, hsa
gauggguugaagcuuuucugauaauuauuacacaauuuaaaacaacauauauauuuaaaauaaa

SEQ ID NO: 107230 - RNA, 64 nt, hsa
uucuguuuuggucucuggugauauuuuaaacaauauuuaaaagucaguauagaaguguuuuagu

SEQ ID NO: 107231 - RNA, 64 nt, hsa
acauacauauauauauaucauauagcuuaagcugauuuaaaacaaaggccuuagacuaauuuuc

SEQ ID NO: 107232 - RNA, 64 nt, hsa
ucugcuacuauaacagaauacgacagacuggguaauuuaaaaagaaaagaaauuuauuuucuuc

SEQ ID NO: 107233 - RNA, 64 nt, hsa
uuaauaugaaauauuacauauauauaagugccauauuuaaaauaauuugucuaacaguagaacu

SEQ ID NO: 107234 - RNA, 64 nt, hsa
cauguuaauuuucugaaagauaauucuaagugaaauuuaaaauaaauaaauuuuuaaugaccug

SEQ ID NO: 107235 - RNA, 64 nt, hsa
ucuacauuucuaauauuuacaaaaaugauagccuauuuaaaauuaucuucuuccccaauaacaa

SEQ ID NO: 107236 - RNA, 64 nt, hsa
ugaacuauuaauauuuaaaaacgagaaauacaacauuuaaaaaauuaagaguauuuugcauuag

SEQ ID NO: 107237 - RNA, 64 nt, hsa
auucaugaaaaacuuagaauagugaacuauuaauauuuaaaaacgagaaauacaacauuuaaaa

SEQ ID NO: 107238 - RNA, 64 nt, hsa
caugagauacaauucacauaccauauaaucacacauuuaaaauacacaauucagugguuuuaac

SEQ ID NO: 107239 - RNA, 64 nt, hsa
aauuguuuagaauauuaaguuuuccucugugcaaauuuaaaacaaauaacaagagaucguguua

SEQ ID NO: 107240 - RNA, 64 nt, hsa
aagcaaauuuugcacaguaaaccaauaguuugagauuuaaaacuauuuucuuauaguauaguua

SEQ ID NO: 107241 - RNA, 64 nt, hsa
ugcauuuuggcagaaagaaaaaaaaucaguugugauuuaaaacguuuguugagauuuucaaaca

SEQ ID NO: 107242 - RNA, 64 nt, hsa
gaaauaaagcuccuaguaaaguuauucauauuauauuuaaaaaggucuauguucuucaacuaau

SEQ ID NO: 107243 - RNA, 64 nt, hsa
uaugcuuauaugucuucuauaaauccaaugcagaauuuaaaauuucaguuuacucuaguuacca

SEQ ID NO: 107244 - RNA, 64 nt, hsa
aaauuuaaauuuucagucauuuaaaauuuuaaaaauuuaaaauuucacaaaacuaaggguaaaa

SEQ ID NO: 107245 - RNA, 64 nt, hsa
uuguuucagucauuuaaaauuuaaauuuucagucauuuaaaauuuuaaaaauuuaaaauuucac

SEQ ID NO: 107246 - RNA, 64 nt, hsa
uuuugaauaauaauguuuaaauuuuguuucagucauuuaaaauuuaaauuuucagucauuuaaa

SEQ ID NO: 107247 - RNA, 64 nt, hsa
uuaguuuaguaaguucagaaguagaaacaaacuuauuuaaaaccaucauuugaaaguuuaauuc

SEQ ID NO: 107248 - RNA, 64 nt, hsa
ugaguagcucauucuugugacuuacagugccaacauuuaaaaaaguaugaaaaugauuuauuuu

SEQ ID NO: 107249 - RNA, 64 nt, hsa
uaauauauauuguauuuuuauuugauagcuugggauuuaaaacaucucuguugaaggcuuuuga

SEQ ID NO: 107250 - RNA, 64 nt, hsa
acccagacugaacuuaccgugagcgacaaagaugauuuaaaagggaagucuagaguuccuaguc

SEQ ID NO: 107251 - RNA, 64 nt, hsa
gucacaagguuuaaggugacccaaugauucagcuauuuaaaaaaaaaagaggaaagaaugaaag

SEQ ID NO: 107252 - RNA, 64 nt, hsa
guguuuaauuauuuugccauguauuacuaauuguauuuaaaauuucuacuucccuuaggcauuu

SEQ ID NO: 107253 - RNA, 64 nt, hsa
uaaaauuucuacuucccuuaggcauuuuauaaaaauuuaaaaauuauuuuucuauuuuguuuaa

SEQ ID NO: 107254 - RNA, 64 nt, hsa
auuuuuuguuguuucuuaaauaagaaacuuuuuuauuuaaaaaacuaaaaacuagaggugagaa

SEQ ID NO: 107255 - RNA, 64 nt, hsa
aacuuucuuucucacuaaaucuuuuauaggauuuauuuaaaauagcaaaagaagaaguuucauc

SEQ ID NO: 107256 - RNA, 64 nt, hsa
ccaaucuaggcaauguagugagacccugucucuaauuuaaaaaagaaaaagaaaaaaacauucc

SEQ ID NO: 107257 - RNA, 64 nt, hsa
aagacugucuuaccuuauguuaaggaagucagguauuuaaaauguuacauaugccggcgcagug

SEQ ID NO: 107258 - RNA, 64 nt, hsa
cacaaaaauaacuaugaaaaugccaguaacguuuauuuaaaacaaaauauuuuaauuuuuaaau

SEQ ID NO: 107259 - RNA, 64 nt, hsa
cccuauuugauacuugacagugcaaguuucuguaauuuaaaaagaugugguggccugacaccug

SEQ ID NO: 107260 - RNA, 64 nt, hsa
ccucaccuuucgcuguuuguuguuucauagauuuauuuaaaaaaagagaaagucuauagcuaua

SEQ ID NO: 107261 - RNA, 64 nt, hsa
uuaggcauuaauauaaaagagguaggagucuguuauuuaaaaaaagcauuaaauuuaaaaaaaa

SEQ ID NO: 107262 - RNA, 64 nt, hsa
gagguaggagucuguuauuuaaaaaaagcauuaaauuuaaaaaaaaacugucuugucuacuuuu

SEQ ID NO: 107263 - RNA, 64 nt, hsa
gcguuauguguugaacaguaugcuucagggguaaauuuaaaauagucucuugaagcccuaguca

SEQ ID NO: 107264 - RNA, 64 nt, hsa
uguuuugaagaguugaaucuucuguuaaaaggugauuuaaaacuugaaugugaugaauuguggc

SEQ ID NO: 107265 - RNA, 64 nt, hsa
uuugcaguguaauucuuuguuuuuaauugcagacauuuaaaaaugucauuuucuacuguuaaga

SEQ ID NO: 107266 - RNA, 64 nt, hsa
gcaaacuuucuauugccugucccaugugcaucuuauuuaaaauuucccccauggaaaucacucu

SEQ ID NO: 107267 - RNA, 64 nt, hsa
uggauauugaagcuauccaagcuuuugaaauaaaauuuaaaaacccccaagccugggugagugu

SEQ ID NO: 107268 - RNA, 64 nt, hsa
uggguuucaaauguuaagaacacuaaauagcaugauuuaaaaaaugaaaaaugcuaacacccaa

SEQ ID NO: 107269 - RNA, 64 nt, hsa
aaaccuaaggaagaauaauaauauaagaaaggaaauuuaaaaacauuccacaagaagaaaaauu

SEQ ID NO: 107270 - RNA, 64 nt, hsa
ucaagaaaacuauaaaauacuuaaagauauauaaauuuaaaaaaacauagcugcaggucuuugg

SEQ ID NO: 107271 - RNA, 64 nt, hsa
cuuacuuuuauuauuaaauguauugagguauuauauuuaaaaaaaacuauguucagaacuucau

SEQ ID NO: 107272 - RNA, 64 nt, hsa
uaaauugugauugaaguggagagguacucuaggaauuuaaaaagacacaaaauuauuuuuuucc

SEQ ID NO: 107273 - RNA, 64 nt, hsa
aacuccuuuucccuaggaagucaaaaaugcugugauuuaaaauaucuaauuauauuuuuuucuu

SEQ ID NO: 107274 - RNA, 64 nt, hsa
gauuaaauguaucauuaucuauauauaaaccaugauuuaaaacuuuaauuuucuaaacauagua

SEQ ID NO: 107275 - RNA, 64 nt, hsa
uauauuacaaguauauuacauguaaaacaggacaauuuaaaaauuuuaaauuuuaaagaauuaa

SEQ ID NO: 107276 - RNA, 64 nt, hsa
augauuuccgggaauuauuauugaaagccuaugaauuuaaaaccagguuuaccauguaauuugu

SEQ ID NO: 107277 - RNA, 64 nt, hsa
acaagaaaaaaggcccacaauuagaaaaauuuacauuuaaaaaaaauguuguuucuauccccau

SEQ ID NO: 107278 - RNA, 64 nt, hsa
uguacaaugaauugauguuuaguuugcuuuagucauuuaaaaagauauuguaccaggaugugcu

SEQ ID NO: 107279 - RNA, 64 nt, hsa
gccacacagagcugaaugggcaguguaaucaauaauuuaaaaaacaugaaugucauuagauccu

SEQ ID NO: 107280 - RNA, 64 nt, hsa
uaaauuuaaaaagcuuucucuuuaaguugcuacaauuuaaaaaucaaguaagcuacucuaaauc

SEQ ID NO: 107281 - RNA, 64 nt, hsa
augaagaugaaauauuauuuauccuauuuauuaaauuuaaaaagcuuucucuuuaaguugcuac

SEQ ID NO: 107282 - RNA, 64 nt, hsa
ugacaguaguaccaaaaagguauuuuccuuucucauuuaaaagcaaaaaccucccuuuuuaauu

SEQ ID NO: 107283 - RNA, 64 nt, hsa
gagucaauuuaacaauccugacaugcucccuccaauuuaaaagcgcacacacacacacacacac

SEQ ID NO: 107284 - RNA, 64 nt, hsa
ugaaauuuacugugagacuguauguuuuaauugcauuuaaaaauauauagcuugaaagcaguua

SEQ ID NO: 107285 - RNA, 64 nt, hsa
agggacaaagaaauccccccuucagaacagaggcauuuaaaauggaaaagagagauuggauuuu

SEQ ID NO: 107286 - RNA, 64 nt, hsa
uuuuuuaaaaaauaaggucuuaauguuucauuuaauuuaaaauauacugucauguuguguuuug

SEQ ID NO: 107287 - RNA, 64 nt, hsa
cauuguacuuaauuucuaaauauauaaaauccacauuuaaaaauuauaaaagcaaggacuuggg

SEQ ID NO: 107288 - RNA, 64 nt, hsa
cccauuuuugaagagggugaaguuuggagaacaaauuuaaaaaccaucagucaugugagcagau

SEQ ID NO: 107289 - RNA, 64 nt, hsa
cuuuaucaaaaaacccuucaauagcauccuuaagauuuaaaaaaaaaaaaaaaaaaaaggaaaa

SEQ ID NO: 107290 - RNA, 64 nt, hsa
uacauugagaaaccaagucaaucaagcaggaaucauuuaaaaaccagauaaagccauguuuuuc

SEQ ID NO: 107291 - RNA, 64 nt, hsa
gaauaauuuaaccaagccccucuccacuucuuuuauuuaaaagcacugauucaauugcuaggaa

SEQ ID NO: 107292 - RNA, 64 nt, hsa
uuaaagagacuucaaaauauugaguauuuuaaaaauuuaaaaguaggucaguuuauaacgagua

SEQ ID NO: 107293 - RNA, 64 nt, hsa
uguuaguaugucauaaaauauaacauuacagcuuauuuaaaaccaaauauaguugaacauauuu

SEQ ID NO: 107294 - RNA, 64 nt, hsa
uacagcuuauuuaaaaccaaauauaguugaacauauuuaaaauacauuuucacagaauggauga

SEQ ID NO: 107295 - RNA, 64 nt, hsa
uucaacauuuuucaaaaucaggagauuuucguccauuuaaaaaauguauaggugcagauauuga

SEQ ID NO: 107296 - RNA, 64 nt, hsa
acugcuuuaagaaauaacaauuacaauguguauuauuuaaaaaugggagaaauaguuuguucua

SEQ ID NO: 107297 - RNA, 64 nt, hsa
aaaacugucaaaaucaguauauacuauuaguuauauuuaaaaauauuuuuuuaaauucuuuaca

SEQ ID NO: 107298 - RNA, 64 nt, hsa
uauguuauugaaaagcauuauuaauguuuaauuuauuuaaaauuuuggaauuugccauuucuca

SEQ ID NO: 107299 - RNA, 64 nt, hsa
uuugaaaacacuauauugauccauuugauccaucauuuaaaaaauaaauacaauuccuaaggca

SEQ ID NO: 107300 - RNA, 64 nt, hsa
ggagaaagacacugaaauuuagaaaauuuugucgauuuaaaauauuucuccuaucuaccaagua

SEQ ID NO: 107301 - RNA, 64 nt, hsa
uagugcugcauuuuuuuaaaguuggauugcugcuauuuaaaaaaaaaaaaaggacacagaucaa

SEQ ID NO: 107302 - RNA, 64 nt, hsa
uauuuuaaagaaccacuugaaaucggaucauuuuauuuaaaaauaaaaaauguuaaugccaguu

SEQ ID NO: 107303 - RNA, 64 nt, hsa
ucuggcugauguugguauuggguguaggaacaugauuuaaaaaaaaacucuugccucugcuuuc

SEQ ID NO: 107304 - RNA, 64 nt, hsa
ccaauugaauuaaaguguggccucguuuuuagucauuuaaaauuguuuucuaaguaauugcugc

SEQ ID NO: 107305 - RNA, 64 nt, hsa
cuuugacaugucuuggggaaaagcuuacauuuuaauuuaaaagaaagaucaauuauauccaugc

SEQ ID NO: 107306 - RNA, 64 nt, hsa
uuaucaaaaacagcacaacccccucaaucugcccauuuaaaaauugguggagugaacaaagagc

SEQ ID NO: 107307 - RNA, 64 nt, hsa
uuuugaagaugagcauauauuacuaucuuuaagcauuuaaaaauacuguucacacuuuauuacc

SEQ ID NO: 107308 - RNA, 64 nt, hsa
agacgcgucagauggcagauuuggaaaguuaaccauuuaaaagaacauuuuucucuccaacaua

SEQ ID NO: 107309 - RNA, 64 nt, hsa
agaaauauuguuuuuuauauuauuguuguaugacauuuaaaaauuucuuucuauguguauuuau

SEQ ID NO: 107310 - RNA, 64 nt, hsa
cuuugauuaguucuuuauuaaauaugucauaaauauuuaaaaauaauacagcaauaccaaaaua

SEQ ID NO: 107311 - RNA, 64 nt, hsa
gcuacauagagagaccccaucucuacaaagaaagauuuaaaaauuaaccaggcaugguggcucg

SEQ ID NO: 107312 - RNA, 64 nt, hsa
cuagaagauuuuggucuacuuuucugugaacagaauuuaaaacauacaaagagauaaaucacca

SEQ ID NO: 107313 - RNA, 64 nt, hsa
uggaagagaagagaaaggacauggcguauuuuguauuuaaaaguaauuguauuaauuauuuaaa

SEQ ID NO: 107314 - RNA, 64 nt, hsa
ggagccuguuacccguuagagagcugagacccuuauuuaaaacucaccucccaaucaccccaaa

SEQ ID NO: 107315 - RNA, 64 nt, hsa
uguuguuaugguagagaaacacacaugccuuaaaauuuaaaaagcagggcccaaagcuuauuag

SEQ ID NO: 107316 - RNA, 64 nt, hsa
uuauaacaugauaggugcugaauugugauucacaauuuaaaaacacuguaauccaaacuuuuuu

SEQ ID NO: 107317 - RNA, 64 nt, hsa
uaaaaauguauuaauaacuuaugguuguuaaauaauuuaaaaguuaacaaacuaaacuguuaca

SEQ ID NO: 107318 - RNA, 64 nt, hsa
auuucuucuucaagagaugccuaaaauguuuucuauuuaaaaauuacaaaaaugaacccaaguc

SEQ ID NO: 107319 - RNA, 64 nt, hsa
caaaaaauacuauuaaccuauauaaccauuuaaaauuuaaaaaauuauguuccaaguaccucua

SEQ ID NO: 107320 - RNA, 64 nt, hsa
ugaaaagcaaaaaauacuauuaaccuauauaaccauuuaaaauuuaaaaaauuauguuccaagu

SEQ ID NO: 107321 - RNA, 64 nt, hsa
uuuacaucuuauuuuugccuuuauuucauaaguaauuuaaaaaucacuggauugcuuuauuaua

SEQ ID NO: 107322 - RNA, 64 nt, hsa
aauaucucaaguagaaaaguuuuugaaaacuaacauuuaaaaauuaaucaguuacaguaaagac

SEQ ID NO: 107323 - RNA, 64 nt, hsa
uuucaaguuggccaauaauagcauucucucugacauuuaaaaauaauuucuauucaaaauacau

SEQ ID NO: 107324 - RNA, 64 nt, hsa
uagguacuuauauaaaaucuaguccaguucucucauuuaaaaaaaugaagacacugaaauacag

SEQ ID NO: 107325 - RNA, 64 nt, hsa
uaaagggacuuguaagcauuucuggaaauauuugauuuaaaaacauauauuaauagauguuuuc

SEQ ID NO: 107326 - RNA, 64 nt, hsa
uuauaacauguauaccuauauauucuuuguguuuauuuaaaaguuuugaaaauaugcaguacug

SEQ ID NO: 107327 - RNA, 64 nt, hsa
augauuuuguggugauucgugccauugcuuuuuuauuuaaaagaaaauuuuguaauuaaaugcc

SEQ ID NO: 107328 - RNA, 64 nt, hsa
uggcaggacucauauuauucaguuguacccaaguauuuaaaaaugacucucuuaagccuuaaaa

SEQ ID NO: 107329 - RNA, 64 nt, hsa
uaaacuuaauaaauuaucuguuaauguagauuuuauuuaaaaaacuauauuugaacauuggucu

SEQ ID NO: 107330 - RNA, 64 nt, hsa
gaauauugacuuuuucucuuuuuuauuugggauaauuuaaaaaaugauggaugagaaaagaaag

SEQ ID NO: 107331 - RNA, 64 nt, hsa
cuuguuuuuuucugucuugugaaugcacuugauaauuuaaaaauaaaaauaucuguuucucugc

SEQ ID NO: 107332 - RNA, 64 nt, hsa
agaauaugaaguaucuguuuuugaaauucacuuuauuuaaaagauaagcagcugacugggcacg

SEQ ID NO: 107333 - RNA, 64 nt, hsa
caacaaggaagucugcucuguacaauugucccucauuuaaaagauauauuaagcuuuucuuuuc

SEQ ID NO: 107334 - RNA, 64 nt, hsa
uuauugagccaauuaaauugacauugcuuugacaauuuaaaacuucuauaaaggugaauauuuu

SEQ ID NO: 107335 - RNA, 64 nt, hsa
cugagaacaggaugacucguguuugaaggaucuuauuuaaaauuguuuuuguauuuucuuaaag

SEQ ID NO: 107336 - RNA, 64 nt, hsa
ucaaaaucacccaaaacuuuuggcaaauaaaagcauuuaaaaagaccuuucuguacaggauuuu

SEQ ID NO: 107337 - RNA, 64 nt, hsa
aaucuaggaaauuaguuguauuuugugcaagcuaauuuaaaaacaugaugggcuguuuuaagac

SEQ ID NO: 107338 - RNA, 64 nt, hsa
uacauguuuuaaaaaaccgaguugguuuuauugaauuuaaaaagauagguaacuaaguagcauu

SEQ ID NO: 107339 - RNA, 64 nt, hsa
uuauugaauuuaaaaagauagguaacuaaguagcauuuaaaaucaagauagagcauuccuucuu

SEQ ID NO: 107340 - RNA, 64 nt, hsa
uaaacauuuuguauucagacgccaaaguuaacugauuuaaaaguugauuuacuuuuuauuaagu

SEQ ID NO: 107341 - RNA, 64 nt, hsa
guuaaucagcagugaaucaucuugcagcuaugcaauuuaaaaaaaauacagauuaccaauuuca

SEQ ID NO: 107342 - RNA, 64 nt, hsa
acaaauuaaaaagacaaauuaaaccugaaauuauauuuaaaauauauuugagacaugaaauaca

SEQ ID NO: 107343 - RNA, 64 nt, hsa
uguaaauauuucuuaugucuccucuauuaagaguauuuaaaaucauauuuaaauaugaaucuau

SEQ ID NO: 107344 - RNA, 64 nt, hsa
ucuacauauaagguuuuuauuugaauuguaaaauauuuaaaaguaugaauaaaauauauuuaua

SEQ ID NO: 107345 - RNA, 64 nt, hsa
caguuauuuaacaaauaaauaccucauugauuauauuuaaaaguaauacacuuccuguaaacaa

SEQ ID NO: 107346 - RNA, 64 nt, hsa
uuuaaaagguuuuaaucauucuucuauaaaauacauuuaaaauggaaaaauacuuaauaucacu

SEQ ID NO: 107347 - RNA, 64 nt, hsa
uuuguuguuaaauuauuuucuggcccuucuuaauauuuaaaaauguauuuccccuuguggcuuu

SEQ ID NO: 107348 - RNA, 64 nt, hsa
ggccaggucucaguccgcgcuaaacaaugcaauaauuuaaaaucauaaagggccaguguauaaa

SEQ ID NO: 107349 - RNA, 64 nt, hsa
uuuuaaaaaggaaaguauaaaaacaaaaguuguaauuuaaaagucugaauaaccaucugcugcu

SEQ ID NO: 107350 - RNA, 64 nt, hsa
auauuguauuaacuuaauaggaacccuguguacaauuuaaaauauuuguaaaauaucacuguga

SEQ ID NO: 107351 - RNA, 64 nt, hsa
uauuaacuaaaguuguuuauguuuguguucuuaaauuuaaaacacgaagaaaaagaaaugucuu

SEQ ID NO: 107352 - RNA, 64 nt, hsa
auauuugaaguccuagucugaguucugguggggaauuuaaaaaugcauccuggaaauccuuuaa

SEQ ID NO: 107353 - RNA, 64 nt, hsa
ccuuaacuaugccaaucuaauuauaauucccuguauuuaaaaugguuucuuuuacuuauugaaa

SEQ ID NO: 107354 - RNA, 64 nt, hsa
aaugacugacagaauauuuuguugggcaguccugauuuaaaacuaagacuggcuugugguuaaa

SEQ ID NO: 107355 - RNA, 64 nt, hsa
gcgagcucaaagcaauuaagugggaacauuuuuaauuuaaaaaaaauuuccaaauauuuguggg

SEQ ID NO: 107356 - RNA, 64 nt, hsa
aauuuuaauaaaagugaaccagaacaaaucacucauuuaaaaaguaauucagaagaacagugug

SEQ ID NO: 107357 - RNA, 64 nt, hsa
agucucuauuucuuccuuuuauaagaguaauuauauuuaaaaaaucuaccuacccuucuggaau

SEQ ID NO: 107358 - RNA, 64 nt, hsa
gccacauugcaaaagaauuuugcagaagugauuaauuuaaaauguuauuaagggccuugagaug

SEQ ID NO: 107359 - RNA, 64 nt, hsa
aauccaauauguuuccaucacuuugccaaaaccuauuuaaaacagugaauuaaauuuucacuag

SEQ ID NO: 107360 - RNA, 64 nt, hsa
caaagauccagugcaguuuuucucuugaaggaucauuuaaaaagggacgcgaauaaguuugcuc

SEQ ID NO: 107361 - RNA, 64 nt, hsa
uaugcuaaaucacauucagcauguguauuuugacauuuaaaauacuucccucaauucuguaaau

SEQ ID NO: 107362 - RNA, 64 nt, hsa
uacaaaaguucuuauuacugggcggacugauaacauuuaaaaaauaauuguguuugaccccaaa

SEQ ID NO: 107363 - RNA, 64 nt, hsa
acugcugacguauuacaaaacagaaaaauaaaugauuuaaaaucaaaucaaaaagaaaaaacua

SEQ ID NO: 107364 - RNA, 64 nt, hsa
aaaaguuuaaucuaaaugauaugugcauuuccucauuuaaaaaauccaauuggauuauucuuaa

SEQ ID NO: 107365 - RNA, 64 nt, hsa
auuaaaauauauaagcuuaaauuuuauaucuuacauuuaaaauauuaagauuccuuugacuugc

SEQ ID NO: 107366 - RNA, 64 nt, hsa
aacacuuucaaacuccugcugguaguaaaaggggauuuaaaaauagaaucauagccauaagccu

SEQ ID NO: 107367 - RNA, 64 nt, hsa
caagaggaacauaugccugagaaccuuugcaugaauuuaaaauuucaauuauccauucuuauaa

SEQ ID NO: 107368 - RNA, 64 nt, hsa
auuugagguuuucuacaauuugguauaacuaagaauuuaaaaauguuuuaucauauauauuugu

SEQ ID NO: 107369 - RNA, 64 nt, hsa
auauaaaaaaacugacuguggcugaaagaauugcauuuaaaaauauuuaugugcaccuuguuac

SEQ ID NO: 107370 - RNA, 64 nt, hsa
gugaaauccuuuguuauuuuucuaaaaaaauaaaauuuaaaaagaaagaaaacuaaggaagaac

SEQ ID NO: 107371 - RNA, 64 nt, hsa
uuauauucuuguuuaauaagcuuauuuuuaaacaauuuaaaagcuauuauucuuagcauuaacc

SEQ ID NO: 107372 - RNA, 64 nt, hsa
auuaaagugcaauauuguauauuuuuaagaacaaauuuaaaauagaauuuugauguuucucaga

SEQ ID NO: 107373 - RNA, 64 nt, hsa
acaauaaguuuauaguuaacgaagauuuuuuucuauuuaaaaccccauuuuccuaaagaacaaa

SEQ ID NO: 107374 - RNA, 64 nt, hsa
uuuccuaaagaacaaaguaguaaaauaaaaaaaaauuuaaaaaauuaaaaaauaaaaaaaagag

SEQ ID NO: 107375 - RNA, 64 nt, hsa
uauauaaauauguaaauacaugcuuuaauuugcaauuuaaaaugaagggguuaaauaaguuaga

SEQ ID NO: 107376 - RNA, 64 nt, hsa
gcaauuuaaaaugaagggguuaaauaaguuagacauuuaaaagaaaugauuguuaccauaaauu

SEQ ID NO: 107377 - RNA, 64 nt, hsa
cauuuuuauuauccacgugauggcuaaguggauaauuuaaaagcuuaguaaugucuggucauuc

SEQ ID NO: 107378 - RNA, 64 nt, hsa
aaaaaugaagaacaacuuuaucaaggaagcuaguauuuaaaaacaaauucaugagcaagcugca

SEQ ID NO: 107379 - RNA, 64 nt, hsa
aacaguuguggaauucuuacuucauuaugaauguauuuaaaaaacaaacaccaaauaauuggaa

SEQ ID NO: 107380 - RNA, 64 nt, hsa
uauuuaaaaauauagaauauauuagagaacugugauuuaaaaguacuguuaauguaaaaaauaa

SEQ ID NO: 107381 - RNA, 64 nt, hsa
uauauaaaugaaaacauuuaauuguguucaucauauuuaaaaauauagaauauauuagagaacu

SEQ ID NO: 107382 - RNA, 64 nt, hsa
uuucucugagaucuauagucuguuucuccucauuauuuaaaaaugcuaaaccuuguaucucacu

SEQ ID NO: 107383 - RNA, 64 nt, hsa
acacauuuguccuugugucacguuccauuauuuuauuuaaaaaccucaguaaucguuuuagcuu

SEQ ID NO: 107384 - RNA, 64 nt, hsa
accagccucaucaacacagugaaacuccaucucaauuuaaaaagaaaaaaagugguuuuaggau

SEQ ID NO: 107385 - RNA, 64 nt, hsa
aauauuuuaacaaguuuguuauauauuuuauuuaauuuaaaagaaaucucuuaccaaccuacau

SEQ ID NO: 107386 - RNA, 64 nt, hsa
augaacugucuguucuuagguagaaacgguguuuauuuaaaaaucaguuuuaaaaaaugagcua

SEQ ID NO: 107387 - RNA, 64 nt, hsa
gauguuaauaaugaagccauauguuuaugucuggauuuaaaaauuuuaaacaaucauuuacuau

SEQ ID NO: 107388 - RNA, 64 nt, hsa
uguaauuugacauucugggucacagauauaagguauuuaaaaucuauuuaugcuuuauagagaa

SEQ ID NO: 107389 - RNA, 64 nt, hsa
agacauuggccuuaguaggcuguauucacugcuaauuuaaaaaagggaguaccaggauuuauua

SEQ ID NO: 107390 - RNA, 64 nt, hsa
aaaaaugagugcagauuacugaauauaauacauuauuuaaaauauuugggaguaguauaauuug

SEQ ID NO: 107391 - RNA, 64 nt, hsa
uuuuuaaaagccuauuguuuuucagaauugagauauuuaaaacuuguuauaacuucuuccuaaa

SEQ ID NO: 107392 - RNA, 64 nt, hsa
aagaugaaauauccuaaaauauaggagcacagacauuuaaaauucauaaucaggcuaacaacac

SEQ ID NO: 107393 - RNA, 64 nt, hsa
gaauugauuauugagaaaauguagcaguuugcauauuuaaaaauuaaucauuuugcauuuuaca

SEQ ID NO: 107394 - RNA, 64 nt, hsa
aagauauuuauauauugccauacaaaaacuuaacauuuaaaacugauaauaucuguaaugacau

SEQ ID NO: 107395 - RNA, 64 nt, hsa
cuuuugaaacucagacuucaguguauacccaauaauuuaaaauuaugugaaauguuuuaaauuu

SEQ ID NO: 107396 - RNA, 64 nt, hsa
ggaaaaccugucugagaaaaugccugacaguuuaauuuaaaacuaugguguaagucuuugacaa

SEQ ID NO: 107397 - RNA, 64 nt, hsa
aguacuguauguguuaauuucuacuuuuuuuaauauuuaaaauugcuuuuaaauaaacauauuc

SEQ ID NO: 107398 - RNA, 64 nt, hsa
caaauuuaaacuuuuaaaagauuauucaagaugaauuuaaaagucaacccuucacacaguuucc

SEQ ID NO: 107399 - RNA, 64 nt, hsa
gauuguguuugaaaauuauauacugagcauacuaauuuaaaaagagaacuuguugaaauuuaaa

SEQ ID NO: 107400 - RNA, 64 nt, hsa
ugagcauacuaauuuaaaaagagaacuuguugaaauuuaaaacguguuucuagguugaccuugu

SEQ ID NO: 107401 - RNA, 64 nt, hsa
uuuucuuuagucacagaaguugaaucugguuauuauuuaaaaacuagaagcccccaaaccagca

SEQ ID NO: 107402 - RNA, 64 nt, hsa
uuucaauggccuugcugugugguguuucaagugcauuuaaaaugugugacacagaaacggcaca

SEQ ID NO: 107403 - RNA, 64 nt, hsa
cucuuucuggggaauccaauuauaguugcuuuguauuuaaaaacaagaacagccaaggguuguu

SEQ ID NO: 107404 - RNA, 64 nt, hsa
uuaaaaaauaguaugaaugugaauacuagaaaagauuuaaaaaauaguaugagugugaguacua

SEQ ID NO: 107405 - RNA, 64 nt, hsa
gaaacuuuacauuuguugacuuuuuuucauucucauuuaaaauauauugugcuaugauaaccaa

SEQ ID NO: 107406 - RNA, 64 nt, hsa
gauuauacuauauaauauucucaauuacauuugaauuuaaaaauauugagcucuugauuacaau

SEQ ID NO: 107407 - RNA, 64 nt, hsa
cuaauguaauuuaacaaauugcugcauguauuccauuuaaaaauauguuuaaauuguccuaaaa

SEQ ID NO: 107408 - RNA, 64 nt, hsa
aguaagacccuaucucuaccccccuaauaaauuaauuuaaaaagccccccaaucugugguauuu

SEQ ID NO: 107409 - RNA, 64 nt, hsa
uggggggaaaauuuuauuucccuuuucuucugauauuuaaaaaauucaucgaucuuucaagaug

SEQ ID NO: 107410 - RNA, 64 nt, hsa
gagaaagaacucuauuggugucgucugagcagccauuuaaaaauuggaaucuaaaggaugguug

SEQ ID NO: 107411 - RNA, 64 nt, hsa
uuauaguauagguaaauuuucuuuuucaaauccaauuuaaaauaaccuuuccuuuuaaaugugc

SEQ ID NO: 107412 - RNA, 64 nt, hsa
acagauucuaauuuaugguaaauuucagauguuuauuuaaaauuuucacuuuuaaacaguaacc

SEQ ID NO: 107413 - RNA, 64 nt, hsa
cugaacuagaugacuguuguacuguagcucagucauuuaaaaaauauauaaauacuaccuugua

SEQ ID NO: 107414 - RNA, 64 nt, hsa
acauuguaguuacacaaacacaaauaaauauuuuauuuaaaauucuggaaguaauauaaaaggg

SEQ ID NO: 107415 - RNA, 64 nt, hsa
uuuguaauugauauuaaaaguggcacauuuaaaaauuuaaaaauugaagugcaaaaaaaauuuu

SEQ ID NO: 107416 - RNA, 64 nt, hsa
gaaaguaguuuguaauugauauuaaaaguggcacauuuaaaaauuuaaaaauugaagugcaaaa

SEQ ID NO: 107417 - RNA, 64 nt, hsa
cuguguuugucuaaaaauguggcauauggauggcauuuaaaacuuugaaugaauuauaccuaaa

SEQ ID NO: 107418 - RNA, 64 nt, hsa
auaguagccucuuaaaaaaaaaaaaccugcuaggauuuaaaaauaaaaaucagaggccuaucuc

SEQ ID NO: 107419 - RNA, 64 nt, hsa
cuuccagguggaggagaaaggggaaucucccaaaauuuaaaaacaaauuggaagaauaaccagg

SEQ ID NO: 107420 - RNA, 64 nt, hsa
guaagagcagagcaccucccacugggggugggguauuuaaaaauuaacucauuaguaucauaaa

SEQ ID NO: 107421 - RNA, 64 nt, hsa
ggcccaucccagauguuugugauguccugaaacaauuuaaaaggagacccacagagcuaauguu

SEQ ID NO: 107422 - RNA, 64 nt, hsa
uuuaaaaggagacccacagagcuaauguuuauccauuuaaaagguauaaaucaaaauaacaaau

SEQ ID NO: 107423 - RNA, 64 nt, hsa
gcucuguuuuugguuuacaguguaauaauaccucauuuaaaaaauaaaaaccacuacuguuaca

SEQ ID NO: 107424 - RNA, 64 nt, hsa
aaaaaauaaaaaccacuacuguuacauuuuauuaauuuaaaaagcuagaaaauucauguaguua

SEQ ID NO: 107425 - RNA, 64 nt, hsa
uuauuacagacauugguguacuugaagguuuuauauuuaaaaguauuuuugaaaugcaaugugu

SEQ ID NO: 107426 - RNA, 64 nt, hsa
gcaugagaugagaaagaaggacaaacucuuaagaauuuaaaaaguguuuugagaaugauuucua

SEQ ID NO: 107427 - RNA, 64 nt, hsa
ccugcauuuccagcuaaucucuucugcucuaaauauuuaaaaacaguucuucucaaacauuuuc

SEQ ID NO: 107428 - RNA, 64 nt, hsa
gguguuuuccugcuuuguagucucuaacucugaaauuuaaaauauguaaacuaaagugguuuua

SEQ ID NO: 107429 - RNA, 64 nt, hsa
gugcuuuguuucauuaaauaauagggaaauauccauuuaaaacagguauaucaguggaaacaca

SEQ ID NO: 107430 - RNA, 64 nt, hsa
gguaagaaaacuauuuugaauaaauaaacuauuuauuuaaaaugucuuuguauuuuuccaauuu

SEQ ID NO: 107431 - RNA, 64 nt, hsa
guugagcuauauaaacauuaacuuuagauuugggauuuaaaaugccuauuguaagauagaauaa

SEQ ID NO: 107432 - RNA, 64 nt, hsa
uguauaaaaccaaagugcuauuuuuaaaagcaucauuuaaaaaaaaaugacaugccugaacaac

SEQ ID NO: 107433 - RNA, 64 nt, hsa
cuagaaugacagauucaggugguuuauuaauuacauuuaaaaaguuuucugaaaaaacuuuugc

SEQ ID NO: 107434 - RNA, 64 nt, hsa
ggugcuggucagacuuuuuuuguuagauucucucauuuaaaaaaaauacuguuuguuuaaagca

SEQ ID NO: 107435 - RNA, 64 nt, hsa
uaauucauuuuaaucguaauguauuuuagugugaauuuaaaaauuucauacaucaaaucuauga

SEQ ID NO: 107436 - RNA, 64 nt, hsa
uuucucauguuuguucauucuaguuuauauuuucauuuaaaauccuuuagguuaaguuuaagcu

SEQ ID NO: 107437 - RNA, 64 nt, hsa
auuguauggucaguaggcaaucuuaaauguuuuuauuuaaaauaaaguauuccuugaaaauaua

SEQ ID NO: 107438 - RNA, 64 nt, hsa
agauuuuuaacaugucagagagaagagaguuaaaauuuaaaaaugcaucuugggagagaaauuu

SEQ ID NO: 107439 - RNA, 64 nt, hsa
ugaaacaggacugaagcccuuuuuaccuagaaccauuuaaaagccugagcaaggaccaccaccc

SEQ ID NO: 107440 - RNA, 64 nt, hsa
agcugaucaacaccuuaaaauucauuuaauacuuauuuaaaaagaagaugagagauucaaaaau

SEQ ID NO: 107441 - RNA, 64 nt, hsa
auuaaaauuucuuuuggggagagacugucuaguaauuuaaaauguguuaaauaugaaccauauu

SEQ ID NO: 107442 - RNA, 64 nt, hsa
cuguacaauuaaacauuuucaaaagguguaauuuauuuaaaauugucucauuuugguaaaauuu

SEQ ID NO: 107443 - RNA, 64 nt, hsa
auuauaguguauaugauguuugugaaaaugccagauuuaaaaugauguauuuauuuuugguaaa

SEQ ID NO: 107444 - RNA, 64 nt, hsa
agaaaaaaaguaauuuaugacuauuuaaaauaaaauuuaaaaguagagugacugucagguaaag

SEQ ID NO: 107445 - RNA, 64 nt, hsa
auauuuauuaagagaaaaaaaguaauuuaugacuauuuaaaauaaaauuuaaaaguagagugac

SEQ ID NO: 107446 - RNA, 64 nt, hsa
uuguaauuuuccagcugugaaaauguugccuuguauuuaaaaggguuucaugaauggaaaccua

SEQ ID NO: 107447 - RNA, 64 nt, hsa
aaauuuuuaucuuuaaaucugagacaaguauuauauuuaaaacuagaucuauuaauacauucau

SEQ ID NO: 107448 - RNA, 64 nt, hsa
uguauuggggauauguuuuacauaaauagaacucauuuaaaaguaugguucaaguacugcucuu

SEQ ID NO: 107449 - RNA, 64 nt, hsa
cuauaaaacacugagaguaucuaugucuuucugaauuuaaaaugaaaauucauguccauaugga

SEQ ID NO: 107450 - RNA, 64 nt, hsa
aaaauggauucuugucuccucuucagaauuagccauuuaaaauauuuucugugacuucaaauug

SEQ ID NO: 107451 - RNA, 64 nt, hsa
acaguuaagacuugaaauugaaaauucuuuuaauauuuaaaauaacuuguuuauucaaugucua

SEQ ID NO: 107452 - RNA, 64 nt, hsa
cccaggggaaaaugaagguuaggauuuaacagucauuuaaaaaaaaaauuuguuuugacggaug

SEQ ID NO: 107453 - RNA, 64 nt, hsa
aaaaaauuuguuuugacggaugauuggauuauucauuuaaaaugauuagaaggcaaguuucuag

SEQ ID NO: 107454 - RNA, 64 nt, hsa
gaagacuuggggcaugggacagcucagacuuuguauuuaaaaguuaaaaaggacaaaaaaaaaa

SEQ ID NO: 107455 - RNA, 64 nt, hsa
aaaaguuaaaaaggacaaaaaaaaaaucuaaagcauuuaaaaucuagugaaauaacugaagggc

SEQ ID NO: 107456 - RNA, 64 nt, hsa
guacucaagaaaauugaacaaauguaauggaucaauuuaaaauauuuuauuucuuaaaagccuu

SEQ ID NO: 107457 - RNA, 64 nt, hsa
aguaacccauucuucacccuccauuuguauggcaauuuaaaagucuuuggcuuugcucugaauu

SEQ ID NO: 107458 - RNA, 64 nt, hsa
auacuacuguuaguauuauuuaacuauuuuguagauuuaaaagauuucugguuaagggaggugg

SEQ ID NO: 107459 - RNA, 64 nt, hsa
cuauuacauuuuacugauuaacaaauaaauuggaauuuaaaaauaucgauaucaccaugauuua

SEQ ID NO: 107460 - RNA, 64 nt, hsa
ugggauuauguagcuaaacauugugaugauuauuauuuaaaaccauuauuuaauaagaguaaaa

SEQ ID NO: 107461 - RNA, 64 nt, hsa
uuuaauaagaguaaaaauaugugaaucuggauauauuuaaaaaaagaaauuugaugcccagaua

SEQ ID NO: 107462 - RNA, 64 nt, hsa
cuugugcugucguuuuguuuguuuuucuaugauaauuuaaaauacauagguagggcuacugagg

SEQ ID NO: 107463 - RNA, 64 nt, hsa
cauuauacuuacuuccugcauuuagagggaguuuauuuaaaagaaauaaaugacaaucaaacca

SEQ ID NO: 107464 - RNA, 64 nt, hsa
gaauucacauuaaguuccccuugcacacuuaccuauuuaaaaaacuaaacuugcacugcaacug

SEQ ID NO: 107465 - RNA, 64 nt, hsa
cuuuaaccaaagaauuauuuuaaaguaaccuuauauuuaaaagaugauuuugcaaaaaauaaaa

SEQ ID NO: 107466 - RNA, 64 nt, hsa
ucuccuuucuggguaacaagcccuaacuucuguaauuuaaaagcuccuacuuuugccacaaggu

SEQ ID NO: 107467 - RNA, 64 nt, hsa
agaaguaccuaauaguuugaacagauauguuuuuauuuaaaagaguagaauaaccuuucagaau

SEQ ID NO: 107468 - RNA, 64 nt, hsa
cuugagauauggaaggaugccuuuuuuucucugcauuuaaaaaaaucccccagcacuucccaca

SEQ ID NO: 107469 - RNA, 64 nt, hsa
caaaugggacacauggucugucaaugagagcauaauuuaaaaauauauuuauaaggaaauuuua

SEQ ID NO: 107470 - RNA, 64 nt, hsa
aguaacuuuuuuccagggaggggugggagagggaauuuaaaaggugucaacuuuugaccaaaaa

SEQ ID NO: 107471 - RNA, 64 nt, hsa
gcaacugcaguucauccgcacuguaaauacauguauuuaaaaaaacaaucccaaguaaaaauuu

SEQ ID NO: 107472 - RNA, 64 nt, hsa
uguaaguggaaaaugcaaugucuuaaauaaaacuauuuaaaauuggcaccauacaauugcuuug

SEQ ID NO: 107473 - RNA, 64 nt, hsa
gccaaccaaguguagauguagcauuguuccacacauuuaaaacauuugaaggaccuaaauucgu

SEQ ID NO: 107474 - RNA, 64 nt, hsa
acacuugggagaacagaaauaagaauuaaugaaaauuuaaaagauuaaaugaaugagaagaaau

SEQ ID NO: 107475 - RNA, 64 nt, hsa
cuaacaguaauaacuauaaaucucacuuuaaauaauuuaaaacaaauuaaagugauauaugagu

SEQ ID NO: 107476 - RNA, 64 nt, hsa
uauaugaagacaauuucuguaaugguuuuaagagauuuaaaaagaaauucacugguucuuuaca

SEQ ID NO: 107477 - RNA, 64 nt, hsa
uuaaacaccugcauauuuuuauguaaaucucuaaauuuaaaauauuuuaaguacauuuauuuuu

SEQ ID NO: 107478 - RNA, 64 nt, hsa
uguaguuuauuuauuugguucuuuagauggaggaauuuaaaaaaucaaauuuuucucuucaccu

SEQ ID NO: 107479 - RNA, 64 nt, hsa
ucugaguaauuuuaauuuugccaaauacacugacauuuaaaauagugauccaucuaaauuuuuu

SEQ ID NO: 107480 - RNA, 64 nt, hsa
gaacaaaaagaauguugcuggaacguaaaauaguauuuaaaaguuaaugaacacuucucuaguu

SEQ ID NO: 107481 - RNA, 64 nt, hsa
gguuuggguagacuuuuuuuuuauaucaaguauaauuuaaaacaucagauuaaauaauuacacu

SEQ ID NO: 107482 - RNA, 64 nt, hsa
uuaacauuaauuuuauuuuuucagacauacuguaauuuaaaaauuaaugugagcguuuguuuua

SEQ ID NO: 107483 - RNA, 64 nt, hsa
aaguuuuuugugugugugaaacacuucaaaacugauuuaaaagauguaaauuuaaaauugguug

SEQ ID NO: 107484 - RNA, 64 nt, hsa
gugaaacacuucaaaacugauuuaaaagauguaaauuuaaaauugguuguaucuaauaugcccc

SEQ ID NO: 107485 - RNA, 64 nt, hsa
aaaugguauuagauacuuauuuccuuuaaacuuuauuuaaaacaaacaacagaguuaaucuguc

SEQ ID NO: 107486 - RNA, 64 nt, hsa
uggguaaucaaaacauucacauuuauucugcuggauuuaaaaauauguacuuuuuuuuuuuuuu

SEQ ID NO: 107487 - RNA, 64 nt, hsa
agagcuaauuuaaaaaagcaaaguaagacuaauuauuuaaaauaaaaaugccacaaauuucauu

SEQ ID NO: 107488 - RNA, 64 nt, hsa
gaacugaauucuacaugugcugcaugaagagcuaauuuaaaaaagcaaaguaagacuaauuauu

SEQ ID NO: 107489 - RNA, 64 nt, hsa
uaaaaugauaguggauaauagacaaagugaaaacauuuaaaaaggaagagaaacuucagccuuu

SEQ ID NO: 107490 - RNA, 64 nt, hsa
aaaaauuugaauauacauauauauauauauguauauuuaaaaagugaauauaauuugaggcaca

SEQ ID NO: 107491 - RNA, 64 nt, hsa
ucaaauguuuuauacauuuuuggagauaguaaaaauuuaaaaauguaauagggaaaauauuuaa

SEQ ID NO: 107492 - RNA, 64 nt, hsa
uuucaugaaaucuugguacaaauucagaucucuuauuuaaaauuuaaauaaggaauacauuuuc

SEQ ID NO: 107493 - RNA, 64 nt, hsa
uuaucaauaaauuccauaaaauaaugucauugguauuuaaaaaugaauauuaauauaaugaaau

SEQ ID NO: 107494 - RNA, 64 nt, hsa
gugguugugggggggguguuggagguucuauuucauuuaaaaauguauucauuucccuggcccc

SEQ ID NO: 107495 - RNA, 64 nt, hsa
gcuguccugaugaugagucauuccaauuuacuggauuuaaaacaaaaaguuguuacgguuucau

SEQ ID NO: 107496 - RNA, 64 nt, hsa
uaauuucaguuuggagcuuuuaggcauuauguauauuuaaaaaauauauucuucaaaaaugcau

SEQ ID NO: 107497 - RNA, 64 nt, hsa
gaaagcuuuauguaguuaugcaugucaguuugcuauuuaaaaugugugacaguguuugucauau

SEQ ID NO: 107498 - RNA, 64 nt, hsa
uuugcaucaucaucuuccuauuuaaugaauugugauuuaaaacaaaaugaaaauaagccaggua

SEQ ID NO: 107499 - RNA, 64 nt, hsa
guaugcuaaaaagucagagugauacaaaagugauauuuaaaaauauacacacauguauguacac

SEQ ID NO: 107500 - RNA, 64 nt, hsa
uuuauuuugcacaaacuauuugcagucucuguguauuuaaaaaguaaagaaaguugcauccaga

SEQ ID NO: 107501 - RNA, 64 nt, hsa
uuguacuguauauuugaguaacugucaggcuuuuauuuaaaauuguuuaacauguaccauguac

SEQ ID NO: 107502 - RNA, 64 nt, hsa
uccgaaguuaggaccuaguuacuuugcucucaacauuuaaaauaaugcaguugcucuagugaau

SEQ ID NO: 107503 - RNA, 64 nt, hsa
uuccuccauuuuaaaugacuacuuuuauuuuuuaauuuaaaaaaucuacuucaguaucaugagu

SEQ ID NO: 107504 - RNA, 64 nt, hsa
guuacaguagccaauugaaaauguauaucccaaaauuuaaaaaaaaaaguaccagcagcaauaa

SEQ ID NO: 107505 - RNA, 64 nt, hsa
gcacuaguuuuaucugguacauacaaaaacagccauuuaaaaucugaugauucuguggaauugg

SEQ ID NO: 107506 - RNA, 64 nt, hsa
agcaaauauaaugcuaguccuagauuacuuauugauuuaaaaacaaaaaaaagauuacuuaauu

SEQ ID NO: 107507 - RNA, 64 nt, hsa
gauuuaaaaacaaaaaaaagauuacuuaauuuugauuuaaaaacaaaaaaucguaaaauacaaa

SEQ ID NO: 107508 - RNA, 64 nt, hsa
acacguuugauacuuuguacaucagaugcaucuuauuuaaaagggauacuuuuguaaaaguaaa

SEQ ID NO: 107509 - RNA, 64 nt, hsa
uuuucucagaauuuacacucacucgcagucauuuauuuaaaaagauaaaacaagauaauggguu

SEQ ID NO: 107510 - RNA, 64 nt, hsa
uucagugaacugguacaauguggucccucucaauauuuaaaaauauaauuuguaacagugcuua

SEQ ID NO: 107511 - RNA, 64 nt, hsa
ccaaaaacacaacagucauuaucugugaaccauaauuuaaaaaucuuucuagaauaacaacagc

SEQ ID NO: 107512 - RNA, 64 nt, hsa
uuuacuguuuucuuuuuagaaacccacuguuaaaauuuaaaaaggugcuuuaaaauaaaacgcc

SEQ ID NO: 107513 - RNA, 64 nt, hsa
cauccauacucaggguguagggagaauacuuugcauuuaaaaacccuguccaccugucaccagc

SEQ ID NO: 107514 - RNA, 64 nt, hsa
uauacaagauugaaaaucuuguguaaauccugccauuuaaaaaguuguagcagauuguuuccuc

SEQ ID NO: 107515 - RNA, 64 nt, hsa
cuuuauugcuuuuuuguauugguuaaaacuguacauuuaaaauugcuauguuacuauuuucuac

SEQ ID NO: 107516 - RNA, 64 nt, hsa
gagcacacuauucucauugccaacguuaaaccuuauuuaaaagccaaacgugcccugagcccuc

SEQ ID NO: 107517 - RNA, 64 nt, hsa
aaaaggcauuggcauuuucuugucucuucuguugauuuaaaaaugaucccuccuggugauaacc

SEQ ID NO: 107518 - RNA, 64 nt, hsa
guguuuauugguacauugcaguuuuuuuuuugaaauuuaaaaauuucuguaaaacuuugucuuc

SEQ ID NO: 107519 - RNA, 64 nt, hsa
ugucuucaaguaaucugacagcauuaaauauugcauuuaaaaauuauacuguagcaaauacauu

SEQ ID NO: 107520 - RNA, 64 nt, hsa
auauugcauuuaaaaauuauacuguagcaaauacauuuaaaaauuaaucacaacguuaagauga

SEQ ID NO: 107521 - RNA, 64 nt, hsa
cagaaaaaagcaaauauaaauuuuuaaugacuccauuuaaaaauaucacagggugggggcaagg

SEQ ID NO: 107522 - RNA, 64 nt, hsa
cauaaauauauacaccuaccauguacccauaaaaauuuaaaaagaaauggaauggcaaauaaug

SEQ ID NO: 107523 - RNA, 64 nt, hsa
aacagggugacuacagucaacaauaacuuuauacauuuaaaaauaaaagaguguaauugggacg

SEQ ID NO: 107524 - RNA, 64 nt, hsa
uaccuguuuguuaggaaauggaauggucucuuugauuuaaaauaaauaaaaauagauuauuacg

SEQ ID NO: 107525 - RNA, 64 nt, hsa
aauuaacuuucauaaauuuuauggcaugucuucuauuuaaaaggaaaagaauaaguauucuugc

SEQ ID NO: 107526 - RNA, 64 nt, hsa
uaccacauuuauuucuauauucauuuuguaaaaaauuuaaaagugcuauuuuguuuguauuuga

SEQ ID NO: 107527 - RNA, 64 nt, hsa
ggugcauuucuccucuguuuucuuuuuaauauacauuuaaaauacaguauuaucacuuuauaaa

SEQ ID NO: 107528 - RNA, 64 nt, hsa
uuuaaaaguaaaaaaaacaaaaaaaaaacaaaaaauuuaaaaaaaagguuugcuaaucugauag

SEQ ID NO: 107529 - RNA, 64 nt, hsa
guggaaguuaucuuaaugccacgguucaccaucaauuuaaaaguaaaaaaaacaaaaaaaaaac

SEQ ID NO: 107530 - RNA, 64 nt, hsa
ggaauuguuuuccuguuuuuccuuacuauaaaucauuuaaaaacugaauucauuuucuuagaug

SEQ ID NO: 107531 - RNA, 64 nt, hsa
auaugcuguagaaaauauuccuugaagaugugagauuuaaaaauuuuucccuuucaauguuguu

SEQ ID NO: 107532 - RNA, 64 nt, hsa
uggaaguuuguaccaucuguuugaguauaugcacauuuaaaaaauaucauauaguaaaugcaaa

SEQ ID NO: 107533 - RNA, 64 nt, hsa
cagcauguaacagacuggcacaugugccagcugaauuuaaaauauaauacuuuuaaaaagaaaa

SEQ ID NO: 107534 - RNA, 64 nt, hsa
aaacagaacuuuuaaaugaagcuuaaauuacucaauuuaaaauuuuaaaauccuuuaaaacaac

SEQ ID NO: 107535 - RNA, 64 nt, hsa
acauaguaaucuuuuccaguuaugucugauuaagauuuaaaacugaagguuucauuuugggagu

SEQ ID NO: 107536 - RNA, 64 nt, hsa
acuuucaaaaccuauuuuaaguacagcaaaauuuauuuaaaacugucauagcaguaaaaaguau

SEQ ID NO: 107537 - RNA, 64 nt, hsa
cuuauuaggaagggauugcuucacugguuuaauaauuuaaaaguuauguuuguuaaacacccug

SEQ ID NO: 107538 - RNA, 64 nt, hsa
cugagagauccaucaaauugaacaaucuguuguaauuuaaaauuuuggccacuuuuuucagauu

SEQ ID NO: 107539 - RNA, 64 nt, hsa
uauacaaguuuucuuuaaagcccucuccuuuagaauuuaaaauauuguaccauugaagaguuug

SEQ ID NO: 107540 - RNA, 64 nt, hsa
cauugauggaacuggaguuguuggaaaaacauagauuuaaaaugauuuuugauagcugacauug

SEQ ID NO: 107541 - RNA, 64 nt, hsa
ugaauuauguagaaugucaaucaaguuuuuguauauuuaaaaguuggacaucaauuuuuucccc

SEQ ID NO: 107542 - RNA, 64 nt, hsa
aaaaauuaauaacuuuuaguaauuacuuuuauuaauuuaaaauagaacgcuugagaggcacuuu

SEQ ID NO: 107543 - RNA, 64 nt, hsa
gguuuuuuaaaauuaauauuaauaacuuuuauuaauuuaaaauagaaugcuuaaaauaaaauag

SEQ ID NO: 107544 - RNA, 64 nt, hsa
acucuguaauuuauacgguguacuauauaaugggauuuaaaaaaagugcuaucuuuucuauuuc

SEQ ID NO: 107545 - RNA, 64 nt, hsa
ggugaucaauguuuggaaaauacaacaaugacuuauuuaaaaauuacccuuccugcuauuuaga

SEQ ID NO: 107546 - RNA, 64 nt, hsa
gaaaccagccauuuaauuguucuagaguuuuagcauuuaaaaaucguaugaaagucuacaucag

SEQ ID NO: 107547 - RNA, 64 nt, hsa
uacuuuguuuacauuuuagauuguacuugucuuuauuuaaaaugaugaaucuagucugaaucag

SEQ ID NO: 107548 - RNA, 64 nt, hsa
aaagcaauauaguugcauaaaagcacuguaaaauauuuaaaagguuaaaacuguggaaaauuau

SEQ ID NO: 107549 - RNA, 64 nt, hsa
aaguaggaaacaauauuuugaaaauaaguuuuaaauuuaaaaugaucaaaaagcaauauaguug

SEQ ID NO: 107550 - RNA, 64 nt, hsa
uucauuuguacaucccuuugaaaaaauauaacagauuuaaaauguuuugaauuuaacuuguuua

SEQ ID NO: 107551 - RNA, 64 nt, hsa
uagggcaacauauauuugaauuuaaaagcacuuuauuuaaaaaaaaaagaaguuuucaguucug

SEQ ID NO: 107552 - RNA, 64 nt, hsa
uauuucaguuuucuuuagggcaacauauauuugaauuuaaaagcacuuuauuuaaaaaaaaaag

SEQ ID NO: 107553 - RNA, 64 nt, hsa
ucacuuuggucauguuuauuaaaccaccagugacauuuaaaaauauauuuuuagcagucguaau

SEQ ID NO: 107554 - RNA, 64 nt, hsa
acagaugugaacuuuauuccuugucacuaauuauauuuaaaauuauuucuaggaagucaaauaa

SEQ ID NO: 107555 - RNA, 64 nt, hsa
acugaauaauucuacaugaaguuaaaaguuagcaauuuaaaaaauuuugcugcauaauaaagau

SEQ ID NO: 107556 - RNA, 64 nt, hsa
agccauccauccugaauuuuauaaaugauuuuuuauuuaaaaauuugagauuuuuaaaauuuuu

SEQ ID NO: 107557 - RNA, 64 nt, hsa
uaggacagugacaaaauucguaagugaauacuuaauuuaaaaguguuaacauuaaugcucaaua

SEQ ID NO: 107558 - RNA, 64 nt, hsa
gucgcuuucuauuucucuuucuuugugugaauuuauuuaaaagaaaaaaaaacuuuuuguaacg

SEQ ID NO: 107559 - RNA, 64 nt, hsa
uuugguuauuuuauuuuaaaaaaaugaaaaauuaauuuaaaaaaaugcaaaaaacuguuggauu

SEQ ID NO: 107560 - RNA, 64 nt, hsa
aagaagcucuccacccacuugguauuucaagaaaauuuaaaacgaucccaaggaaagaugauuu

SEQ ID NO: 107561 - RNA, 64 nt, hsa
gccacacuuccuuuagaaggaacuguuauaauuuauuuaaaaguugaaaaaccacccaagauga

SEQ ID NO: 107562 - RNA, 64 nt, hsa
ugacgguacauuaaaucaaaauugaggauggaugauuuaaaaacauuugacuuuugaauaauaa

SEQ ID NO: 107563 - RNA, 64 nt, hsa
caacugucuugagaauucagggaaauagaauggaauuuaaaacuucaacaguuuuguuaaaucu

SEQ ID NO: 107564 - RNA, 64 nt, hsa
uaguaugaauuuuuuagcuucuuaaugaauauggauuuaaaacucuccaguucuuauuuuauga

SEQ ID NO: 107565 - RNA, 64 nt, hsa
caaauacuuucagaauuguauuucaguuuugaagauuuaaaaaaaaugugaaaauaaauauaua

SEQ ID NO: 107566 - RNA, 64 nt, hsa
auuaacucuuauuguuguguuucugaaaagugaaauuuaaaaagcagccugaaaaauaaaaauu

SEQ ID NO: 107567 - RNA, 64 nt, hsa
uggagauuagggaaggaaaacuacucuagaggccauuuaaaaguauguauuuauuagaacaugc

SEQ ID NO: 107568 - RNA, 64 nt, hsa
aaaaugucauguuauuaacaguuauuagguugucauuuaaaaauaaaguuccuuuauauuucug

SEQ ID NO: 107569 - RNA, 64 nt, hsa
uugauucaguauucuuuuaucauaaauuuuuagcauuuaaaaauucacugauguacauuaagcc

SEQ ID NO: 107570 - RNA, 64 nt, hsa
auaugaagauugggcuugaaguauauauuuuugcauuuaaaaguaucaccuaucauauuuucca

SEQ ID NO: 107571 - RNA, 64 nt, hsa
gagccugcauuucuaguuaagauggaucuuguaaauuuaaaauuggauuaacauuggagugcug

SEQ ID NO: 107572 - RNA, 64 nt, hsa
uguuuauuacugcuugagguugagccuuuugaguauuuaaaaaauauauaccaacagaacuacu

SEQ ID NO: 107573 - RNA, 64 nt, hsa
aaaacaaaaaaaaggaaggaaaaaaaaagaaaaaauuuaaaaaauuuuaaaaauauaacgaggg

SEQ ID NO: 107574 - RNA, 64 nt, hsa
uuuucucccagcuagugcuaucuuucucaaaauaauuuaaaaguaggcgagaggcuaggaugua

SEQ ID NO: 107575 - RNA, 64 nt, hsa
ggucucuggugaucuuauuuuuaaagccuguauuauuuaaaaugcauuuuuauugaaaggccug

SEQ ID NO: 107576 - RNA, 64 nt, hsa
aaaauauacaugaugggauuccuauugugaagucauuuaaaauaaugacuugaauuucucagaa

SEQ ID NO: 107577 - RNA, 64 nt, hsa
gaaguuagucuuaaacucaaauuacuauaugaugauuuaaaacaaaauaaaagagcgaggaugg

SEQ ID NO: 107578 - RNA, 64 nt, hsa
gucuuaaaggaagcaucaagaauucaauauuugcauuuaaaaauacuuuuuaaggccauuuuau

SEQ ID NO: 107579 - RNA, 64 nt, hsa
augaaucauuugaaguauuuuuauauguauaucuauuuaaaacuaauauauuauuaaagcuuaa

SEQ ID NO: 107580 - RNA, 64 nt, hsa
uuuucaugaacucuuuuuacugaaaaugcccugcauuuaaaaauguuuauuuuagacccuucua

SEQ ID NO: 107581 - RNA, 64 nt, hsa
cagauagaaaaaugcuuauuuaaaucuuugcaugauuuaaaaacagauuuuccauuuucuuaca

SEQ ID NO: 107582 - RNA, 64 nt, hsa
auggccacaaaaaaguaguuugaguguuaugaauauuuaaaauuguaagauaagaaacaguuuc

SEQ ID NO: 107583 - RNA, 64 nt, hsa
uugaaguucuguauucauuauagauguagcccuuauuuaaaaaagugaauuccauacuaaaacu

SEQ ID NO: 107584 - RNA, 64 nt, hsa
ugacuuuuucaguuucuugaacgguuaaggguggauuuaaaaacuagacaguuuaguuuugggg

SEQ ID NO: 107585 - RNA, 64 nt, hsa
uuuuuugagaaaaaaaaauguuuacucuuccaucauuuaaaaaaaauguaaaagacaaaaaaaa

SEQ ID NO: 107586 - RNA, 64 nt, hsa
aaaaauguaaaagacaaaaaaaaaauggaggaugauuuaaaagaugcuuucuaucucugggaaa

SEQ ID NO: 107587 - RNA, 64 nt, hsa
cuaucaacuguaaagcuccuuuucuuccacuuuaauuuaaaaguucaugucauuuaaaaacaag

SEQ ID NO: 107588 - RNA, 64 nt, hsa
ccuuuucuuccacuuuaauuuaaaaguucaugucauuuaaaaacaagucaagaaauuaaaauug

SEQ ID NO: 107589 - RNA, 64 nt, hsa
agaaaauggacugaagucugaauaaggucauugcauuuaaaaagcauauaacuguacuugacug

SEQ ID NO: 107590 - RNA, 64 nt, hsa
ucucuucaucuacaggaugcaauaggcugauuguauuuaaaaaucaaaguacccaaaacugagu

SEQ ID NO: 107591 - RNA, 64 nt, hsa
uauuucacuaccgcucccuguuuuagauauucagauuuaaaagguuuucaaagaauuacuuucu

SEQ ID NO: 107592 - RNA, 64 nt, hsa
ccaaugaguuucaggaaugaaguagaagguaguuauuuaaaaauaaaaaacacaguccgucccu

SEQ ID NO: 107593 - RNA, 64 nt, hsa
agacuugaaacuuccagugugaguugaccccaucauuuaaaaauaaaguccccggguuccuuaa

SEQ ID NO: 107594 - RNA, 64 nt, hsa
gauccuucagacacaucuaugagaagauuuguucauuuaaaagucugcccacugaggauaggga

SEQ ID NO: 107595 - RNA, 64 nt, hsa
agaaguauuuugcagagcuaucaauguccaaauaauuuaaaaaaaaaaauaaagguauuuaagc

SEQ ID NO: 107596 - RNA, 64 nt, hsa
ucagauuccagagauaucuuacgucuuugauucaauuuaaaauuuguacuuauuuucuuuuaga

SEQ ID NO: 107597 - RNA, 64 nt, hsa
ugucauccaagacguagagcuugaaugugacguuauuuaaaaacaacaacaaagaaggcagagc

SEQ ID NO: 107598 - RNA, 64 nt, hsa
uuuauacuaagggacaauuauuuuaagaccauggauuuaaaaaaaaaaaaaaaaacucuguuuc

SEQ ID NO: 107599 - RNA, 64 nt, hsa
guauuuuuguaaaacuuuugauauuucuguauacauuuaaaaaaucaauugccacuacaguagu

SEQ ID NO: 107600 - RNA, 64 nt, hsa
uugcuaaucauuuccuggguuccacuuacucuugauuuaaaaaaaaaaaaacaacaaaagaguu

SEQ ID NO: 107601 - RNA, 64 nt, hsa
ucuuaauuuuugaauuuuaaaacuaaucuauuuuauuuaaaaaaaaucaaguacuuuggaagug

SEQ ID NO: 107602 - RNA, 64 nt, hsa
uacaaaaagaaaaaaaaaauccuguuguauuaacauuuaaaaacagaauuguguuaugugauca

SEQ ID NO: 107603 - RNA, 64 nt, hsa
ugcuuuuuaaaaaagacagcaaacuuuuuuuuuuauuuaaaaaaagauauauuaacaguuuuag

SEQ ID NO: 107604 - RNA, 64 nt, hsa
cagagcgagacucagucucaaaaaaaauuuaaaaauuuaaaaaaauaaaaagaauccaaccccg

SEQ ID NO: 107605 - RNA, 64 nt, hsa
cuggacgacagagcgagacucagucucaaaaaaaauuuaaaaauuuaaaaaaauaaaaagaauc

SEQ ID NO: 107606 - RNA, 64 nt, hsa
agaaagcauuaugcaaaaagucacuuuuaagggcauuuaaaaauuuuuaaguaaagccauucuu

SEQ ID NO: 107607 - RNA, 64 nt, hsa
uugaucuggauggcaagaccguuuaucauuuuuuauuuaaaaaaaucaaaccucaaaaaaguca

SEQ ID NO: 107608 - RNA, 64 nt, hsa
gcugcguaucuugucucaauaaguuuuaaguaacauuuaaaaauauuaaagcauguuauuugac

SEQ ID NO: 107609 - RNA, 64 nt, hsa
ucacuuuacugcauaggaaacaaucuaccucaucauuuaaaaugacaugggugucgguuuugua

SEQ ID NO: 107610 - RNA, 64 nt, hsa
guaauaauuaauaguauguuuaauuuuaaagaucauuuaaaauuaacaucagguauauuuugua

SEQ ID NO: 107611 - RNA, 64 nt, hsa
ccaugguauugguuccuucauauaccuugcuuggauuuaaaacuuuuuuggaagugguaagaaa

SEQ ID NO: 107612 - RNA, 64 nt, hsa
uguaugcuauguuaaaugaaaagaucgauugggaauuuaaaaacgaauuguauuuucucucucc

SEQ ID NO: 107613 - RNA, 64 nt, hsa
ugaagccuugcugaacuaaguuuuguguguauauauuuaaaaaaaaaaucaguguuuaaauaaa

SEQ ID NO: 107614 - RNA, 64 nt, hsa
gguuggaacuuuagggggugggagggggcguuggauuuaaaaaugccaaaacuuaccuauaaau

SEQ ID NO: 107615 - RNA, 64 nt, hsa
gauauucaguacaacucugucauuucuuuguaauauuuaaaaaauauuaguaaaggagugaauu

SEQ ID NO: 107616 - RNA, 64 nt, hsa
ucggccucuuaaucccuuaccugagaaugaagggauuuaaaacacugauuuaacauugaaaggc

SEQ ID NO: 107617 - RNA, 64 nt, hsa
uuguuaacauucagauuuaauuacuguaaguaaaauuuaaaauguaaauacaucaguucauguu

SEQ ID NO: 107618 - RNA, 64 nt, hsa
aaauuucagagaacuaauuuuuaaaaucuuuagcauuuaaaacuuuuuuuguuuuguuuucuga

SEQ ID NO: 107619 - RNA, 64 nt, hsa
gaaaaguaugcuuuguguuuuaacuguuaaaauaauuuaaaaauuaauuauuuuacauaauuaa

SEQ ID NO: 107620 - RNA, 64 nt, hsa
cuugaacuaaugauagauaguauuuuuuuccucuauuuaaaauuuuugucuugauuaggagauu

SEQ ID NO: 107621 - RNA, 64 nt, hsa
acaaucagaucuaugcuguggcauauuuugcuuuauuuaaaaauuuuuuuuuagagaugaguuc

SEQ ID NO: 107622 - RNA, 64 nt, hsa
ucagguccuuauuggcaccuaguagggcaugugcauuuaaaaacuuguccuuaaaaauagaaga

SEQ ID NO: 107623 - RNA, 64 nt, hsa
auuuuagucugaugcuguuguauuuuuucauuuuauuuaaaacacuacuuacuucuuauucucu

SEQ ID NO: 107624 - RNA, 64 nt, hsa
uuuccacggcgacacacagccucaguggugcaagauuuaaaauuaccuuccuuuuuggcuggaa

SEQ ID NO: 107625 - RNA, 64 nt, hsa
cuuugaagugaacccuugcuauaauuuuuuagagauuuaaaauuuaugguagacauuuaggaca

SEQ ID NO: 107626 - RNA, 64 nt, hsa
aagucauagggauuauaaauucaauuugaguaaaauuuaaaaccauauauuuuaugauaaaggg

SEQ ID NO: 107627 - RNA, 64 nt, hsa
uuucaaaacuauuuccaaucacaaggaaagauuuauuuaaaauauacucguacauuucaccugu

SEQ ID NO: 107628 - RNA, 64 nt, hsa
gauuuuucaaauugguggggagugaauaaauacaauuuaaaagucagaaaucaguuuggcaaag

SEQ ID NO: 107629 - RNA, 64 nt, hsa
gugcuugguauuucugucuuauacauaggaaaacauuuaaaauaaauaguuuuuaauuguaggc

SEQ ID NO: 107630 - RNA, 64 nt, hsa
auuuccaaaaaucccuuaggggaugaggggugaaauuuaaaagcuccugaaaaugaguacugcu

SEQ ID NO: 107631 - RNA, 64 nt, hsa
auugaaacauuuuaauuucaaauucaaauagaacauuuaaaaugauuucauuauuauuacccau

SEQ ID NO: 107632 - RNA, 64 nt, hsa
gauuguuacuuaaauuuuccaccuggaaucauggauuuaaaauuuccccaccucauggggaaaa

SEQ ID NO: 107633 - RNA, 64 nt, hsa
aaacacccucacuguaugauauaaaguuauagucauuuaaaaaugugugauauuaguacauuag

SEQ ID NO: 107634 - RNA, 64 nt, hsa
acuguuucuauuauugaaaauuguauguaaaacuauuuaaaauagaauagaaggauacacaccc

SEQ ID NO: 107635 - RNA, 64 nt, hsa
gaccaugaaugaauaggccagcugggacaaaugaauuuaaaaaaucagaaaaaugcaagauuua

SEQ ID NO: 107636 - RNA, 64 nt, hsa
ucacugacuguuuuuguaugguccaugaucuagaauuuaaaaaaauuuuaaaggguugaaaaaa

SEQ ID NO: 107637 - RNA, 64 nt, hsa
cagccaugagccaccaugaccaacguguuucuuaauuuaaaaaaaaaaaaauagaccaggugcu

SEQ ID NO: 107638 - RNA, 64 nt, hsa
ggcuugguucaguaauaaauaugugagacuuuucauuuaaaaaaagucaaaugacuuaauucug

SEQ ID NO: 107639 - RNA, 64 nt, hsa
agagaauguuguaauaaguaaaugccuuaagaguauuuaaaauaugcuuccacauuucaaaaua

SEQ ID NO: 107640 - RNA, 64 nt, hsa
cccucauaggccuaggcuuuggucuaaaaggaacauuuaaaaaguugcccuguaaaguuauuug

SEQ ID NO: 107641 - RNA, 64 nt, hsa
aaaauacaguaccgugucugaauuaauuauuaauauuuaaaauacuucauuccuuaacucuccc

SEQ ID NO: 107642 - RNA, 64 nt, hsa
gggagagcugagccaguuguccuauggacaacuuauuuaaaaauauuucagauaucaaaauucu

SEQ ID NO: 107643 - RNA, 64 nt, hsa
uccuaaacucccuucccucucucccauuucaggaauuuaaaauuaaguagaacaaaaaacccag

SEQ ID NO: 107644 - RNA, 64 nt, hsa
uuaucaugaauucccuuuuaaucaacuguagguuauuuaaaauaaauuccuacaacuuaaugga

SEQ ID NO: 107645 - RNA, 64 nt, hsa
ucccaggagccaaccucccccuuugcagggcugcauuuaaaaauuagguuugggacaguucuug

SEQ ID NO: 107646 - RNA, 64 nt, hsa
auuuagcaccugccagaugccagaaauuuauaccauuuaaaacucaguaagucuuuuaaauauc

SEQ ID NO: 107647 - RNA, 64 nt, hsa
uuuucacaugcuaaugugcagcugagugcacuuuauuuaaaaagaauggauaaaugcaauauuc

SEQ ID NO: 107648 - RNA, 64 nt, hsa
gauauggggaaauaaacuuaaaaaaaaaucaggaauuuaaaaaaacgagcaauuugaagagaau

SEQ ID NO: 107649 - RNA, 64 nt, hsa
uaugugauaauagagggcuggaauuuaaaccuguauuuaaaaaaaagaaucaccaaaucuauuu

SEQ ID NO: 107650 - RNA, 64 nt, hsa
ucacuuggagcaguuucugcuauugugcucuuucauuuaaaauguauguuuuuuuuuuuuuaaa

SEQ ID NO: 107651 - RNA, 64 nt, hsa
cuggguuguccccccaaacauauuuuaauauguuauuuaaaaugauuuuacccaagccuaagua

SEQ ID NO: 107652 - RNA, 64 nt, hsa
ucccgugccuuuuaaaaaauaccaacauuaugaaauuuaaaagcuuaaauauauuugccuaguu

SEQ ID NO: 107653 - RNA, 64 nt, hsa
aauuauaaaaugaucucuguuuuuccugucagagauuuaaaaaacugaaaagguauaccucaac

SEQ ID NO: 107654 - RNA, 64 nt, hsa
auaucaucaagagcuuaagaaucuuggcuuucauauuuaaaaugcuuuuggggagacauauauu

SEQ ID NO: 107655 - RNA, 64 nt, hsa
agacuguuuccacaccauaggcaauaauuucuuaauuuaaaaaaucuaaguauauuccuauugu

SEQ ID NO: 107656 - RNA, 64 nt, hsa
caagagucuaaaaacuaguuuccuuguguuggaaauuuaaaaggaaaaaaaucguauuucacug

SEQ ID NO: 107657 - RNA, 64 nt, hsa
auuuuaaaauugcaugagauuagcaaaauuauuaauuuaaaaccccaaaguaaauugcaaauuu

SEQ ID NO: 107658 - RNA, 64 nt, hsa
uacugaaacuuaaagaucaguggaaaaaaaaaacauuuaaaaauguuguaggagacuuucaauu

SEQ ID NO: 107659 - RNA, 64 nt, hsa
aaauauuucuauuaaugguuuaauuucuuuguauauuuaaaaauaaauaugaaaaaccccuaaa

SEQ ID NO: 107660 - RNA, 64 nt, hsa
uuagaaagaauuagccaaccaggcuacaguugauauuuaaaagauccauuuaaaacaagcugau

SEQ ID NO: 107661 - RNA, 64 nt, hsa
gccaaccaggcuacaguugauauuuaaaagauccauuuaaaacaagcugauaguguuucguuaa

SEQ ID NO: 107662 - RNA, 64 nt, hsa
cuaaacaauaucaucuaggacuucuauuuaaguuauuuaaaauaaaucuuccuugagagccuug

SEQ ID NO: 107663 - RNA, 64 nt, hsa
cuccagccuggcaauagggcgagacuccgucucaauuuaaaacaagagagaaccagacugaguc

SEQ ID NO: 107664 - RNA, 64 nt, hsa
aggcaaaaaaauuauuaaaaauacauuaaagaugauuuaaaaaaaagaaaauuccugggcauuu

SEQ ID NO: 107665 - RNA, 64 nt, hsa
gauagggauggguugggggcgggguaauuauuuuauuuaaaaaaauaccgagcagcaaaagggg

SEQ ID NO: 107666 - RNA, 64 nt, hsa
gugugacccugucucuaaagaaaaacuauagaaaauuuaaaaaauuaaaaaacggguaacaugg

SEQ ID NO: 107667 - RNA, 64 nt, hsa
ugggcaguauagugagaucuuuucucuacaaaaaauuuaaaaauuagccaagugugguggugug

SEQ ID NO: 107668 - RNA, 64 nt, hsa
agccagcuaaggcuuauuauuucaaaagaagauuauuuaaaacaugagugacagguagucagaa

SEQ ID NO: 107669 - RNA, 64 nt, hsa
uaaaucccucuccaaaggguacuugcgaugccggauuuaaaacuugcucagagccacuuagcca

SEQ ID NO: 107670 - RNA, 64 nt, hsa
cuauagcagaguuucucuauuuuauauuucauagauuuaaaaaacccaaauaaagauggauuua

SEQ ID NO: 107671 - RNA, 64 nt, hsa
auuucauagauuuaaaaaacccaaauaaagauggauuuaaaauucacuguggaaaagaguauug

SEQ ID NO: 107672 - RNA, 64 nt, hsa
gugguggcacguagagaacuagaugguaauaaagauuuaaaacuaugaagaagguuacagugua

SEQ ID NO: 107673 - RNA, 64 nt, hsa
auaacacggcaugggaguaagguuauccuuagaaauuuaaaauaacuccacaguaaaauaggua

SEQ ID NO: 107674 - RNA, 64 nt, hsa
ugucuuacucaguucagucuuuuuuugcucauaaauuuaaaaguuacauaccugguuugcuuag

SEQ ID NO: 107675 - RNA, 64 nt, hsa
uuggagagugagaauuuuugcauuauguaaaacaauuuaaaaaucuuuuaagucuuuuucugug

SEQ ID NO: 107676 - RNA, 64 nt, hsa
gaauuucauccaaauguuacccuguaauacuggcauuuaaaauucuuauuuaaccuuccucccu

SEQ ID NO: 107677 - RNA, 64 nt, hsa
acaccagguuggguuaauuaaagcuuuugguauaauuuaaaauuaaauuuauaaaugcaguugu

SEQ ID NO: 107678 - RNA, 64 nt, hsa
auauguaaaggguauacauuaauugguacguagcauuuaaaaucaggucuuauaauuaaugcuu

SEQ ID NO: 107679 - RNA, 64 nt, hsa
aaucacccugguauccaauaucugagcauggcaaauuuaaaaaauaacacaauuucuugccugu

SEQ ID NO: 107680 - RNA, 64 nt, hsa
augccuuaucagaaucuaaaugaaaauagcgaacauuuaaaagcuaucaccauuguaguagaau

SEQ ID NO: 107681 - RNA, 64 nt, hsa
auaacuauacuugucaaauagcaccuaucuaugcauuuaaaaaugcauuaauaucuaacauaaa

SEQ ID NO: 107682 - RNA, 64 nt, hsa
ccaaguaucuguuuauauaguuaguuuucagcucauuuaaaagaggcaaaaauuaaaagcuugg

SEQ ID NO: 107683 - RNA, 64 nt, hsa
gauaugacaaaaugaaaaugcuuaaacuacagaaauuuaaaaaugccauaacaaucuugcgaga

SEQ ID NO: 107684 - RNA, 64 nt, hsa
auccacagaccaaccuggaguugaaaaucuuauaauuuaaaauaugcucuaaacauguuuaucg

SEQ ID NO: 107685 - RNA, 64 nt, hsa
uugagguaaaagcaucacaugaacuuguaaaggaauuuaaaaauccuacuuucauaauaaguug

SEQ ID NO: 107686 - RNA, 64 nt, hsa
aaaauaaaugucauagucaagauuugguagauaaauuuaaaauuaaaauauucugcaguuggga

SEQ ID NO: 107687 - RNA, 64 nt, hsa
ucagcuuaucuaaaccuaaugaaauuccuuuuauauuuaaaaauaguacauucugucucauguc

SEQ ID NO: 107688 - RNA, 64 nt, hsa
accuuuucuuuacccaaggauuuuuaaaacucagauuuaaaacaagggguuacuuuacauccua

SEQ ID NO: 107689 - RNA, 64 nt, hsa
augugggaugaguuuuuaaaugccacaagacauaauuuaaaauaaauaaacuuugggaaaaggu

SEQ ID NO: 107690 - RNA, 64 nt, hsa
ugccugcuucauuuugcaauaacaaugcaguagaauuuaaaacuuggaugcuuaagaggccugc

SEQ ID NO: 107691 - RNA, 64 nt, hsa
gaauguuuucaagaaauguacacugugguaaaugauuuaaaacacuaguauaguguuguguagc

SEQ ID NO: 107692 - RNA, 64 nt, hsa
ccaacauaguauuuuugcagccuaagaguucauuauuuaaaaauaaacuaaagaaauaugucac

SEQ ID NO: 107693 - RNA, 64 nt, hsa
auaauauaaauuaccauuguuuguggaggauuacauuuaaaaaagcaaaaagugaaaaaaaaaa

SEQ ID NO: 107694 - RNA, 64 nt, hsa
ggucacagaucuaucauaauugcuuuucugaugcauuuaaaaauaaauggaacacuuaaaugua

SEQ ID NO: 107695 - RNA, 64 nt, hsa
cuugauuauuuuucagaaagcagacugauacuaaauuuaaaauguaguuucaauuuaauaauca

SEQ ID NO: 107696 - RNA, 64 nt, hsa
gacugugagacugagagggcucacgccucuguguucaggauacuuaguucauggcuuuucucuu

SEQ ID NO: 107697 - RNA, 64 nt, hsa
uuuaccuuccugauuuucugguuacuaauuagcuucaggauacgcugcucucauacuugggcug

SEQ ID NO: 107698 - RNA, 64 nt, hsa
uucagacacauggugagguccauggcucuugucaucaggauaagccugcacaccuagagugucg

SEQ ID NO: 107699 - RNA, 64 nt, hsa
acacaguugggguugggucaauaguuucccaauuucaggauauuucgaugucagaaauaacgca

SEQ ID NO: 107700 - RNA, 64 nt, hsa
aaauuauucuguuauuggaucugugccuguaauaucaggauacuaccauccaaaucuaucuaga

SEQ ID NO: 107701 - RNA, 64 nt, hsa
uccuaaaaccaaaaacaacagugacaauagagucucaggauagcagagucugaaaauaccuugg

SEQ ID NO: 107702 - RNA, 64 nt, hsa
cuacaaaaauggcaccucuuagcagugaugaggcucaggauaucggauaucauaacaccaaugu

SEQ ID NO: 107703 - RNA, 64 nt, hsa
gaggcucaggauaucggauaucauaacaccaaugucaggauaaauaucucuucuaaagacgaua

SEQ ID NO: 107704 - RNA, 64 nt, hsa
uuaucuaaccaaucagaaauacuaguuuaaaaugaauuucuauaugaauauggaucugccauaa

SEQ ID NO: 107705 - RNA, 64 nt, hsa
acuucaaaagguuuguaagauuuggaucucaacuaauuucuacauugccagaauauacuauaaa

SEQ ID NO: 107706 - RNA, 64 nt, hsa
auguaaacuuuaaacauaaugccacaaggucacuaauuucuagcagguaaaauuauaaggauau

SEQ ID NO: 107707 - RNA, 64 nt, hsa
auuuguacucaguaaaacaaaaauuuauggucaaaauuucuaacuugguucaucacauuauaag

SEQ ID NO: 107708 - RNA, 64 nt, hsa
ggaaugcgaguaaggauuggcuugaauuccauggaauuucuaguaugagacuauuuauaugaag

SEQ ID NO: 107709 - RNA, 64 nt, hsa
auuccuuuauauuugcuccccuauuuuuggcuuuaauuucuaauugcaaagauguuuacaucaa

SEQ ID NO: 107710 - RNA, 64 nt, hsa
uccuaaauaagauccacccacaccuaagucacagaauuucuaaguuccccaacuacucucacac

SEQ ID NO: 107711 - RNA, 64 nt, hsa
uaucauuguauuuuuuauuaaaaguuuuguaauaaauuucuaaauuaucuucuggugugggacu

SEQ ID NO: 107712 - RNA, 64 nt, hsa
aagucaaucauuucucacuguguacauaaugcuuaauuucuaaagauaauauuacuguuuauuu

SEQ ID NO: 107713 - RNA, 64 nt, hsa
uucuuauuuuuccuaacaaaagaugaaagcagggaauuucuaucuaaaugaugaguauuaguuc

SEQ ID NO: 107714 - RNA, 64 nt, hsa
cucuuugaaacccaaaaugucuucuaaagaaucaaauuucuauuucugccucugacaaaaagaa

SEQ ID NO: 107715 - RNA, 64 nt, hsa
uauuaucaguuugguaguucauuauuuuagaacaaauuucuaaauuaauuuauucccauaaccu

SEQ ID NO: 107716 - RNA, 64 nt, hsa
uuuaaaugacaaaccuagguaauuaaugguugugaauuucuauuuuugcuuuguuuuuaaugaa

SEQ ID NO: 107717 - RNA, 64 nt, hsa
accuuaucuauguagaauauauuuccuuauucagaauuucuaaaaguuuaaguucuaugagggc

SEQ ID NO: 107718 - RNA, 64 nt, hsa
aguauuucaguuccgugucuuaacaguuugugauaauuucuaaaacugucuuuucaacuuaugu

SEQ ID NO: 107719 - RNA, 64 nt, hsa
ggcccugguucauguuuucaucaaucuaaggugcaauuucuaaauuuguaagaguagguuuaaa

SEQ ID NO: 107720 - RNA, 64 nt, hsa
auauauuaguaaaccuaugaagggaugauucuuuaauuucuaaaguguuguucaaacucaccuu

SEQ ID NO: 107721 - RNA, 64 nt, hsa
aauuauuuugccauguauuacuaauuguauuuaaaauuucuacuucccuuaggcauuuuauaaa

SEQ ID NO: 107722 - RNA, 64 nt, hsa
ggaaaaauuaccaauuuguacauuuuaauuauucaauuucuacuuuguaaaaauagggaaauua

SEQ ID NO: 107723 - RNA, 64 nt, hsa
augcuaaucuuuacuaaauagugagcuaaauuagaauuucuaacucuuauauugugcucuuuua

SEQ ID NO: 107724 - RNA, 64 nt, hsa
cauuccugaguuuuguaauuccuaauccuucuauaauuucuauuaccuucaccauagucauucu

SEQ ID NO: 107725 - RNA, 64 nt, hsa
cucagaaauaguuauucauuaguuuuuaauuuuuaauuucuaagguacagagaucuauaaaacc

SEQ ID NO: 107726 - RNA, 64 nt, hsa
ugaagcauuugaaaaagccaaaguguacgguagaaauuucuacaaaaugaauauuaucaagagu

SEQ ID NO: 107727 - RNA, 64 nt, hsa
uuucuuuuaaaaaaauuaaaauaaaacaaaaaaaaauuucuaggacuagacgauguaauaccag

SEQ ID NO: 107728 - RNA, 64 nt, hsa
uucaauuuugcacugucuuuugagauucaagaaaaauuucuauucuuuuuuuugcauccaauug

SEQ ID NO: 107729 - RNA, 64 nt, hsa
uguuuguuuaauccuuugaaauauuugaaacaucaauuucuauuuucugaccucuaagccuaaa

SEQ ID NO: 107730 - RNA, 64 nt, hsa
aaguguuuaggaaggauaaaguuacauuugucuuaauuucuaacauuaucuuugcuuuuauguu

SEQ ID NO: 107731 - RNA, 64 nt, hsa
uugacuguaguggucacuaaacccuuuuugagagaauuucuauuaaagaugaggcagacucgcu

SEQ ID NO: 107732 - RNA, 64 nt, hsa
ccaguuaucacugcagauugcaauguuuaccaagaauuucuaaaaaugagugcagauuacugaa

SEQ ID NO: 107733 - RNA, 64 nt, hsa
uauaucaacuuauuuuucaccagguuaaaauuuuaauuucuacaaaauaacauucugaaucaag

SEQ ID NO: 107734 - RNA, 64 nt, hsa
guccaagcacaucuugucaacaugcauugccaugaauuucuaccagaugugcuuuuauuuagcu

SEQ ID NO: 107735 - RNA, 64 nt, hsa
acaacgcacacauuuucaacaaccaaaaaaugacaauuucuaguuuaguuaauuucuacaaauc

SEQ ID NO: 107736 - RNA, 64 nt, hsa
caacaaccaaaaaaugacaauuucuaguuuaguuaauuucuacaaaucaucuuauguuauuagc

SEQ ID NO: 107737 - RNA, 64 nt, hsa
ugaaaaacaaugauuguauggguacucaaaguauaauuucuacugaaugcauaucacuugugca

SEQ ID NO: 107738 - RNA, 64 nt, hsa
uaacuuagcuuuauguagaauuucuacuguauuuaauuucuauugaagcccuucuguauuuuaa

SEQ ID NO: 107739 - RNA, 64 nt, hsa
cuaguccuccucuaguuaacuuagcuuuauguagaauuucuacuguauuuaauuucuauugaag

SEQ ID NO: 107740 - RNA, 60 nt, hsa
cuaucacuauguuguuguaacuaacucaagaauuucuaaacucucccaggucacacugau

SEQ ID NO: 107741 - RNA, 64 nt, hsa
uuggagugcuuaaaaaugccaaaaacaaaaugguaauuucuacuuugauaaaguaaaaaaguua

SEQ ID NO: 107742 - RNA, 64 nt, hsa
aauaggugcucaauaaaaauguguucaauggaugaauuucuaaaauauccuccaaugugugcau

SEQ ID NO: 107743 - RNA, 64 nt, hsa
ggagggaaaaggccuuuacuagauucuugucacaaauuucuagucaauguguucuuaacugggu

SEQ ID NO: 107744 - RNA, 64 nt, hsa
uggaaaagaaacaauaugcuuuacacucauuuucaauuucuaaauuugcaggggauacugaaaa

SEQ ID NO: 107745 - RNA, 64 nt, hsa
uaccaugaagugaaaaugccacauuuugcuuuauaauuucuacccauguugggaaaaacuggcu

SEQ ID NO: 107746 - RNA, 64 nt, hsa
ucuauucuaucaucuaaaacaaaucauuaaaacuaauuucuagcuaauuguuaauuauaauuau

SEQ ID NO: 107747 - RNA, 64 nt, hsa
guggaauaauuccacugauugugauaaugguuucaauuucuacacaauauaaauauccaguaua

SEQ ID NO: 107748 - RNA, 64 nt, hsa
uauagugcauauuaauuugauuaaauucucauuuaauuucuaguaguauuuaaaugaguaaaug

SEQ ID NO: 107749 - RNA, 64 nt, hsa
uaaaugaguaaaugugaguuuuuuucugccuuguaauuucuaaauaauuaauauguuuuaagga

SEQ ID NO: 107750 - RNA, 64 nt, hsa
agcuuucuguugcaaauaccuuggaggagaaaguaauuucuaaauauacagagagguaacuuga

SEQ ID NO: 107751 - RNA, 64 nt, hsa
uuuaacuuggauaccugcuauucugccaaaagacaauuucuagaguaguuuugaauggguugau

SEQ ID NO: 107752 - RNA, 64 nt, hsa
aaaaaaaaaaaaauccacauugugacuuuuauuuaauuucuauuuuuuuugguaauaaaaaguu

SEQ ID NO: 107753 - RNA, 64 nt, hsa
aacaaaacaaaacaaaacaaaaaacuagauauguaauuucuaaacacccagaucacaaugacaa

SEQ ID NO: 107754 - RNA, 64 nt, hsa
aucacuaauauuuucacaguuuauuaauauauuuaauuucuauuuaaauuuuagauuauuuuua

SEQ ID NO: 107755 - RNA, 64 nt, hsa
cacaacacuuaggcuuaaaaaugagcucacucagaauuucuauucuuucuaaaaagagauuuau

SEQ ID NO: 107756 - RNA, 64 nt, hsa
ugcaauauaaagucacaauagauaauauauaucaaauuucuaaaagguaaagaauguugugggu

SEQ ID NO: 107757 - RNA, 64 nt, hsa
gauguagugaaagaacaaauccuagagucuuugaaauuucuaagggcauucuagaccucuguug

SEQ ID NO: 107758 - RNA, 64 nt, hsa
cugguggugcuggucuuuuccuccccauuccuacaauuucuauguggcccaagucauuccuaau

SEQ ID NO: 107759 - RNA, 64 nt, hsa
agagguuagaaugaucaucuguaaucugaggguuaauuucuaggcagguggagagagugguaaa

SEQ ID NO: 107760 - RNA, 64 nt, hsa
uuuuuuaagugcuguaaagaguaguuguaauuggaauuucuacuguauaaauguuuuacauuaa

SEQ ID NO: 107761 - RNA, 64 nt, hsa
accuaauacuuuuuuuagaugcaacaaacccuugaauuucuauuuguauucgaagacaagucau

SEQ ID NO: 107762 - RNA, 64 nt, hsa
cuguuugcuuauuuguauaagucauacuguguagaauuucuauuuucuuuuuccccauuaaaag

SEQ ID NO: 107763 - RNA, 64 nt, hsa
gcauaucuuaaaauaguauuuaaguaaauggucuaauuucuacauaauuauugcacugaacuuu

SEQ ID NO: 107764 - RNA, 64 nt, hsa
acuagaaaacuuuauucauuuuagaauagaacauaauuucuaacuguaaaauugucauuuugua

SEQ ID NO: 107765 - RNA, 64 nt, hsa
uuguucaauauugccguuacauuuauuagccuguaauuucuaaauuggagauucucuacauuuc

SEQ ID NO: 107766 - RNA, 64 nt, hsa
uuuaauaaaauuuguauuguuaaagugccuuggaaauuucuaauaaauaacuucauauaaaagc

SEQ ID NO: 107767 - RNA, 64 nt, hsa
aaccaagguuacuuucuuguuuuuggaaaaacaaaauuucuacaauuacaguucccaaagucag

SEQ ID NO: 107768 - RNA, 64 nt, hsa
aaccaagguuacuuucuuguucuuggauaaagaaaauuucuacaauuacaguucccaaagacac

SEQ ID NO: 107769 - RNA, 64 nt, hsa
guggcaaccugugcucagucugaagacaauggacccacguuaggugugacacguucacauaacu

SEQ ID NO: 107770 - RNA, 64 nt, hsa
cuuuaccccucugcuuuauuuauuguaagcauucccacguuaaauaaacuuuggcuguugucua

SEQ ID NO: 107771 - RNA, 64 nt, hsa
aaccaguauaauaagcaaauacacuauaauagauccacguuacuggaaucuguaaaccuugagg

SEQ ID NO: 107772 - RNA, 64 nt, hsa
uggaaauugugcacuuuccuguuuauacccuuccccacguuauuguaaaagaguuuaacagcag

SEQ ID NO: 107773 - RNA, 64 nt, hsa
guugauuacaaccuccaugcuucauaagcggacgccacguuaggguuggacgugggcaccacga

SEQ ID NO: 107774 - RNA, 64 nt, hsa
ugaaaaguucgcucugccagaaaccaccuagggaccacguuagcugccuuccuugagcucccca

SEQ ID NO: 107775 - RNA, 64 nt, hsa
auacccugauuuuucaucuuacgugaccaagaaaccacguuaggggaaaugaaaaaagcaagcc

SEQ ID NO: 107776 - RNA, 64 nt, hsa
aaguacaguuggcaagaucuccaagcugaaacuuccacguuaaaacuuuugccuguaagaauuu

SEQ ID NO: 107777 - RNA, 64 nt, hsa
ugaugucuuucugaagauuuucugcugugcgcuuccacguuacuuuggccuguauuaaagcagu

SEQ ID NO: 107778 - RNA, 64 nt, hsa
aguucuugauagcccagggcaucugcugggcugaccacguuacucauccccguuaacauucucu

SEQ ID NO: 107779 - RNA, 64 nt, hsa
gccucccaaauaugcuauggagcuauuuuuguuaccacguuauaacgugaauauuuauacagua

SEQ ID NO: 107780 - RNA, 64 nt, hsa
aaagcaguugaauuauguuaaauguugcccuuugccacguuaaauugaacacuguuuuggaugc

SEQ ID NO: 107781 - RNA, 64 nt, hsa
ucgguugggagaaacuagcucugauccuaacaggccacguuaaacugcccaucuggagaaucgc

SEQ ID NO: 107782 - RNA, 64 nt, hsa
ccaguucuuacccaucaugcacccuguacaguugccacguuacugccuuuuuuaaaaauauauu

SEQ ID NO: 107783 - RNA, 64 nt, hsa
cucugggaggucuuggccgacucagggaccuaagccacguuaaguccaaggagaagaagaggcc

SEQ ID NO: 107784 - RNA, 64 nt, hsa
acucugagcuggaaauugaauuugaguuuaaacuccacguuaagcugucagcauacacaaacac

SEQ ID NO: 107785 - RNA, 64 nt, hsa
cauccuugcucuaccucaacguggggcccugacaccacguuaucaaacaugcagcccccacacc

SEQ ID NO: 107786 - RNA, 64 nt, hsa
ugaccuugcaagagaguuucugcccauuuuagagccacguuaccaaaucgauguaggccuaauc

SEQ ID NO: 107787 - RNA, 64 nt, hsa
aagaaaauaaaauaauuuaauuuuacauuagauuccacguuagauuugguuugaaaaacuaaaa

SEQ ID NO: 107788 - RNA, 64 nt, hsa
aaaauacauuguggcuuagcaaauaagcaaguucccacguuacuuuuguuuugcuucaaguaau

SEQ ID NO: 107789 - RNA, 64 nt, hsa
ucuauaauuuauuugcacaccuguauguguggugccacguuagccacuaaaucugaacuuuuac

SEQ ID NO: 107790 - RNA, 64 nt, hsa
auucucuccccacuccacgcuccccacuccucugccacguuauguuacggcacaaaauuaauuu

SEQ ID NO: 107791 - RNA, 64 nt, hsa
gcuuugaggauagaagcagauguucuguuuggcaccacguuauaaucugcuuauuuuacaauau

SEQ ID NO: 107792 - RNA, 64 nt, hsa
auuuuaauagaaagacaugauguauguauuuaagccacguuaaaagaaaaaauauaacuaugga

SEQ ID NO: 107793 - RNA, 64 nt, hsa
cacgggacagaagacgguggccucugcugccgggccacguuaguccgcagcucacccgaacaga

SEQ ID NO: 107794 - RNA, 64 nt, hsa
gcaauuuuugacauuaauuaugaaacauuuuagcccacguuaguucuacauuauucuucacuua

SEQ ID NO: 107795 - RNA, 64 nt, hsa
aagauugaagaaagagaaacuugucaacucauauccacguuaucuagcaaaguacauaagaauc

SEQ ID NO: 107796 - RNA, 64 nt, hsa
ucaacagcuagcagcuuaugugauucaccccaugccacguuagugucacaaauuuuaugguuua

SEQ ID NO: 107797 - RNA, 64 nt, hsa
uacuuuuuguauuuuuaguagagacaggguuucaccacguuagccaugauggucucaaacuucu

SEQ ID NO: 107798 - RNA, 64 nt, hsa
caaaguacagugcuggcacuggggcacagagugcccacguuagccccgggcucugauagagagg

SEQ ID NO: 107799 - RNA, 64 nt, hsa
gccugaaaaugggucccagcggacaggggcugacccacguuacuccccaugcgguuuuuccucu

SEQ ID NO: 107800 - RNA, 64 nt, hsa
ucagccacuucuuuaaggagcuccagggcugcagccacguuagagggccccuuggggggcaggg

SEQ ID NO: 107801 - RNA, 64 nt, hsa
aggggccucugagugccaagcgacguggcgggcuccacguuagcccaggcucugagagccagcc

SEQ ID NO: 107802 - RNA, 64 nt, hsa
auucgagacauacuuaauuuugaauuucuccuugccacguuaauaaagccaaaagcagcgggug

SEQ ID NO: 107803 - RNA, 64 nt, hsa
ucuguagcagacacggaagaguccaagggagcagccacguuaggaagagagacuugggaacagc

SEQ ID NO: 107804 - RNA, 64 nt, hsa
uuuaggaucaggcugaauaugaggacaaagugggccacguuagcaucugcagagaucaaucugg

SEQ ID NO: 107805 - RNA, 64 nt, hsa
gguguccuccugggguucuuuuugccaacuuuccccacguuaaaggugaacauugguucuuuca

SEQ ID NO: 107806 - RNA, 64 nt, hsa
uuuggguccugccguauaaucuguucuucuauucccacguuagccaguuguucuugaugaaucu

SEQ ID NO: 107807 - RNA, 64 nt, hsa
gagaggagaagugcgccaauguugucuuuucuuuccacguuauacuguguaaggugauguuccc

SEQ ID NO: 107808 - RNA, 64 nt, hsa
ucuccagcacagagcagagcuacacagaggugacccacguuaguccacugagaguucugagucc

SEQ ID NO: 107809 - RNA, 64 nt, hsa
caaguuggcaaaacagacaucaugcuggugagugccacguuacuccccuggcuggaaaugcuuu

SEQ ID NO: 107810 - RNA, 64 nt, hsa
cacauagcucugggccuuuuuuguauucugauugccacguuaaucuguaaucguuaaguaccca

SEQ ID NO: 107811 - RNA, 64 nt, hsa
gugugcuugcuaaaugguguacauuucuuguuaaccacguuauuaaaacuugaucagcacauaa

SEQ ID NO: 107812 - RNA, 64 nt, hsa
cugaagaggcuugcagauuugcuuucguugauguccacguuacugaggauugacugaguauaga

SEQ ID NO: 107813 - RNA, 64 nt, hsa
ugucacugacucccggcuauacauggccugucgaccacguuauagcccucaggccuguugaacu

SEQ ID NO: 107814 - RNA, 64 nt, hsa
guagauggggagaaaacacaguugguuuuuuuuuccacguuaucaaccgugacugcaagagcgu

SEQ ID NO: 107815 - RNA, 64 nt, hsa
uugacccaucaagaugcuuggcucaauaagaaaaccacguuaggagcaaccuuuguauauugga

SEQ ID NO: 107816 - RNA, 64 nt, hsa
auggaaagggcacccagagcagcaggaccuauagccacguuaugucagcaaugaagacuuugaa

SEQ ID NO: 107817 - RNA, 64 nt, hsa
uuuuguauuuuuuuuuaguagagaugggguuucaccacguuagccaggauggucucgaucuccu

SEQ ID NO: 107818 - RNA, 64 nt, hsa
uucgcucuuccuccagccucuggcaaccacuaauccacguuauaugucuagauuugccucuucu

SEQ ID NO: 107819 - RNA, 64 nt, hsa
aaguugcaacugaccuugaacugaaucacucuccccacguuauuuuuuaauuacuauuuuuuuu

SEQ ID NO: 107820 - RNA, 64 nt, hsa
guucuagguccuggcuucuagaucuggaaccuuaccacguuacugcauacugaucccuuuccca

SEQ ID NO: 107821 - RNA, 64 nt, hsa
agcuccgcagaggcgugggcucgauuccucagggccacguuaccacagaccuguuuguuucuua

SEQ ID NO: 107822 - RNA, 64 nt, hsa
agaguggaugcuucugccuagugacagguuaucaccacguuauauauucccuaccgaaggagac

SEQ ID NO: 107823 - RNA, 64 nt, hsa
ugaugggauuuucaauuauacugaagcuaguucaccacguuaacugcauuuuacacauugacaa

SEQ ID NO: 107824 - RNA, 64 nt, hsa
agugccucacaaagaaauuaagaaguuguccgucccacguuacaucaaauucaguuuuauauag

SEQ ID NO: 107825 - RNA, 64 nt, hsa
cuucuuucacuuagcauaguguuuuaaaguucauccacguuauaacauguguaucacuauguca

SEQ ID NO: 107826 - RNA, 64 nt, hsa
uuuuguuccagaauaaaaggaaauauuuuaaaagccacguuauaggaccuaaaaaucugauuuc

SEQ ID NO: 107827 - RNA, 64 nt, hsa
uaaaacugauaaccaaugaaagccuuuucucuuauuccucuaccgucauuuacaugauaaucug

SEQ ID NO: 107828 - RNA, 64 nt, hsa
uaucuuugauaauuguuauuuuuuuggcagauaauuccucuagaauguguaucuuuuuaugauu

SEQ ID NO: 107829 - RNA, 64 nt, hsa
ccccaagucccccacccccauccugcuccagcguuuccucuaacagggaccagcucuccgcuuu

SEQ ID NO: 107830 - RNA, 64 nt, hsa
acagggaccagcucuccgcuuugcccccacgggguuccucuaaccagaaccagcuuccuagccu

SEQ ID NO: 107831 - RNA, 64 nt, hsa
ugggaaggaaagaguugaguugguuucuuucugauuccucuacucauguagaaaacacuuguac

SEQ ID NO: 107832 - RNA, 64 nt, hsa
aauauuucuagguuuguaagugcagcaguuuuauuuccucuagaacucauccuguuucaaggga

SEQ ID NO: 107833 - RNA, 64 nt, hsa
agaggcuguucauugauccacuauucccucuauuuuccucuaagguaaauauuuagagguauuu

SEQ ID NO: 107834 - RNA, 64 nt, hsa
cuauguggcaaaaggucagccuugggguuggccguuccucuaaucuggacuugcuugcaaaggu

SEQ ID NO: 107835 - RNA, 64 nt, hsa
gaaaagcaucagaaaagcuuuuguacuuugugguuuccucuauuuugaauuuuuugaucaaaaa

SEQ ID NO: 107836 - RNA, 64 nt, hsa
cacucccuuuuuugucaaccccaucuguagccucuuccucuacucaggcagucgacccgccacg

SEQ ID NO: 107837 - RNA, 64 nt, hsa
gugacauucuaagaaaaacuguaccuuagagauuuuccucuagugcucaaacaaauacaaaaua

SEQ ID NO: 107838 - RNA, 64 nt, hsa
ucuucguaucauuagaagaaccccagagauagcauuccucuauuuuauuuuacuuucuuuugga

SEQ ID NO: 107839 - RNA, 64 nt, hsa
gacguuuagccauuuuggcugcuguucuuuaaucuuccucuagcaggcaugcaguccaaggaau

SEQ ID NO: 107840 - RNA, 64 nt, hsa
gacguuuaaccauuuuggcugcugcucuuuaauuuuccucuagcaggcaugcaguccaaggaau

SEQ ID NO: 107841 - RNA, 64 nt, hsa
ucccucacuuuuacuuucccuucccccauaaguuggaggauaaaauggguaucaaugcuaauau

SEQ ID NO: 107842 - RNA, 64 nt, hsa
caguggguggugagagggggccaugggccuugugggaggauaucuuuuggccguguacccucag

SEQ ID NO: 107843 - RNA, 64 nt, hsa
uguaaucccaacacuuuguugggaggccaaagcaggaggauagcuugaggccaggaguuccaga

SEQ ID NO: 107844 - RNA, 64 nt, hsa
gccuguguucccagcuacucaggaggcugaagcaggaggauagcuugagcccaggaguuugagg

SEQ ID NO: 107845 - RNA, 64 nt, hsa
uaaggaagggaggauaacuuugggaagguuuuguggaggauauguguuuagagaugcgagcugg

SEQ ID NO: 107846 - RNA, 64 nt, hsa
aagaugagaggauuaguuauacaauuuaaggaagggaggauaacuuugggaagguuuuguggag

SEQ ID NO: 107847 - RNA, 64 nt, hsa
aguuaucccacuggcuugguguguauacauuaggggaggauaaucugaugcuaacuuuuuuuuu

SEQ ID NO: 107848 - RNA, 64 nt, hsa
guaagcaauaucuugaguuuguagcuuagaauugggaggauacuuaacaucuggaagacaaguu

SEQ ID NO: 107849 - RNA, 64 nt, hsa
gaaccccaugcacugugaccuccccccuucucccccuucccacugugauuggcacaucgacaag

SEQ ID NO: 107850 - RNA, 64 nt, hsa
uauuuugggagauagggaaagugaaccgacuuccccuucccauaccccucagggugguucccua

SEQ ID NO: 107851 - RNA, 64 nt, hsa
ccugcuaagggcccuucucugcccuuucugcccuccuucccaucccacaugcugagccgccaca

SEQ ID NO: 107852 - RNA, 64 nt, hsa
aucccagcaacacagguggcagcuucucccccuuccuucccaccccagucccucuucccacccc

SEQ ID NO: 107853 - RNA, 64 nt, hsa
ccuuuuuuuccccugaauacugcccaaagcauccccuucccaucugccucucaggaguugggga

SEQ ID NO: 107854 - RNA, 64 nt, hsa
guucuagcccugagugacagucuuaaggcuagauccuucccauaguaucaucuguccucuggaa

SEQ ID NO: 107855 - RNA, 64 nt, hsa
cgcccuuucacuuaguucagugccaguccuuuugccuucccaacccugcuguuaggccugcugu

SEQ ID NO: 107856 - RNA, 64 nt, hsa
ccuaugauugaaguccuccugcuuuugggggcugccuucccagagucccccgggugcuccccug

SEQ ID NO: 107857 - RNA, 64 nt, hsa
gaccuggaaggcguuucugagucuuguacugggaccuucccagggaaggugccuuggggugcag

SEQ ID NO: 107858 - RNA, 64 nt, hsa
gcuacaaagaggucuccugggaacccugucugccccuucccaccuguccuugggccacaccauc

SEQ ID NO: 107859 - RNA, 64 nt, hsa
accccagucaggagcaaugacugacuggcugcagccuucccacgccaagaggcuggaacauagu

SEQ ID NO: 107860 - RNA, 64 nt, hsa
cugggcuucgaaggcgacccgcccaccauccugcccuucccagaaccugagaccgucugggggg

SEQ ID NO: 107861 - RNA, 64 nt, hsa
auuuuguuccccucccgcuggcccgggggccccaccuucccacggguucccacgcugcugugac

SEQ ID NO: 107862 - RNA, 64 nt, hsa
aagcgcccucaccccagccccacucacccacccuccuucccaccagccugcucuccgcaggccc

SEQ ID NO: 107863 - RNA, 64 nt, hsa
uaaugacgucucuucucuguggaacuucacgauuccuucccacggucaacucgggaccucccag

SEQ ID NO: 107864 - RNA, 63 nt, hsa
uaauaggguuacuuggaugagccaacuccgcuuccuucccauggauaggaagggacucugugu

SEQ ID NO: 107865 - RNA, 64 nt, hsa
cugucaaaagaugagugaucuugugugggaaaagccuucccaggcgucuguaccgaaaggagca

SEQ ID NO: 107866 - RNA, 64 nt, hsa
uccuggccuggagaacauucaguuuccuuccaacccuucccaccuuucccccacucccuuggag

SEQ ID NO: 107867 - RNA, 64 nt, hsa
ugacuuuaaaagcagcagcaucaagaacuccuagccuucccaaaugcccccuggggaguucugg

SEQ ID NO: 107868 - RNA, 64 nt, hsa
gcagguugcugagccaguggcugccccgugcccuccuucccagcacuaucaugugucacguuuc

SEQ ID NO: 107869 - RNA, 64 nt, hsa
gcuucugaacaggaucccaugccaguguggaacaccuucccaaucuuaguucagaaguggcuug

SEQ ID NO: 107870 - RNA, 64 nt, hsa
caaagugugccuugugucuugugucaggccuugcccuucccaccagcaugucccucguggcuca

SEQ ID NO: 107871 - RNA, 64 nt, hsa
gggugagcaccuggggcaggugggugguuaagguccuucccacuucgcaggugucagaaccuag

SEQ ID NO: 107872 - RNA, 64 nt, hsa
aggucacacagcuaucugcaugucccacaacuccccuucccagccccagccaaacugagccacu

SEQ ID NO: 107873 - RNA, 64 nt, hsa
gcaguguuccccuuuagagagggugugugcugucccuucccacagucccuggcaggcggcugga

SEQ ID NO: 107874 - RNA, 64 nt, hsa
agaaaacagccagcaggaggagcuucaucuguucccuucccaccuccaaccuagcccuacugcc

SEQ ID NO: 107875 - RNA, 64 nt, hsa
aaaauugcccuggggggugcugggugugcugucuccuucccacauccucagccccacaccagcu

SEQ ID NO: 107876 - RNA, 64 nt, hsa
caccucacacccuucacucuccuuuuucugggucccuucccacuuccuuccaggaccuccauug

SEQ ID NO: 107877 - RNA, 64 nt, hsa
auuaaacacuguuccgaguggucuccucauccauccuucccaccucacacccuucacucuccuu

SEQ ID NO: 107878 - RNA, 64 nt, hsa
uuccuugggugaaugcaggagcagcaguggcugcccuucccaccuggacagugguguguguaga

SEQ ID NO: 107879 - RNA, 64 nt, hsa
cuuggcaaguuaaaugucccaagcaccuugucucccuucccaagaacaaaccauuucugugcac

SEQ ID NO: 107880 - RNA, 64 nt, hsa
uccugacuuccucuucugcccaacacugggugccccuucccaguuucccagcaggggcuucaug

SEQ ID NO: 107881 - RNA, 64 nt, hsa
uguuguacagcccggucucccugcgcgcucugcuccuucccaugugcagacagaucagggagga

SEQ ID NO: 107882 - RNA, 64 nt, hsa
cauuuccuccaguccugggccccauccuugagggccuucccagccagccagcaggagaggcaag

SEQ ID NO: 107883 - RNA, 64 nt, hsa
uggauucaccuuacgccccuacagcaggcucagcccuucccacccugccccaugcccagcagca

SEQ ID NO: 107884 - RNA, 64 nt, hsa
ucucagaugaagcugaggagccgugccuaggaucccuucccagcucugaggacgggcugcagag

SEQ ID NO: 107885 - RNA, 64 nt, hsa
gagaggaaacaucuguuuuauagauuuagcauggccuucccaucaaaaauacacucguaccaug

SEQ ID NO: 107886 - RNA, 64 nt, hsa
cccuucccggccucuaaaguuuggucccagcagcccuucccagccucuaaaguuuggucuggua

SEQ ID NO: 107887 - RNA, 64 nt, hsa
uccguauuaaacgcauuugcauuuugagaaguguccuucccacuucagcccuccggagagacua

SEQ ID NO: 107888 - RNA, 64 nt, hsa
cugcucuaggaaacaguuuaagaaaucauuggccccuucccagcacauugaauggguaagcaga

SEQ ID NO: 107889 - RNA, 64 nt, hsa
gccccuccauccaaaacugccaagugacucauugccuucccaacccuuccagaggcuuucugug

SEQ ID NO: 107890 - RNA, 64 nt, hsa
gugaggguagggagaggacaaggggucaccgagcccuucccagagagcagggagcuuauaaaug

SEQ ID NO: 107891 - RNA, 64 nt, hsa
caucugaccauuucuucucccugucuccuguuccccuucccaguuaaacagguuagauugaagg

SEQ ID NO: 107892 - RNA, 64 nt, hsa
uuuucugugacccuuucgcuuuugcauucacccuccuucccaccuaccuguccuggggcuguug

SEQ ID NO: 107893 - RNA, 64 nt, hsa
auggcgagcagccuauggcccagggccuguaaucccuucccaagacuagcugcucaggguggug

SEQ ID NO: 107894 - RNA, 64 nt, hsa
gcuucuuuuaaaucucugucuucucuaaccucccccuucccauuucaaugcucccuuccuaauu

SEQ ID NO: 107895 - RNA, 64 nt, hsa
acccugcaacauccugagaccaaagaccuugugcccuucccaggagccgcggaggaggacagug

SEQ ID NO: 107896 - RNA, 64 nt, hsa
caguaaacacgugauguggagugcaagcuccuccccuucccacuagaacauacuuuaacagaaa

SEQ ID NO: 107897 - RNA, 64 nt, hsa
ucauaucugcuuggggaagccaauggggcacaauccuucccaauuucaugaucuggggcaucau

SEQ ID NO: 107898 - RNA, 64 nt, hsa
acccuuuuacaugcuugggugcagguagaugaggccuucccauggcuacagugugacccuugga

SEQ ID NO: 107899 - RNA, 64 nt, hsa
aaacccuaaaucugagucaguaauucucuuacauccuucccaaaaaucagugucuagggacuag

SEQ ID NO: 107900 - RNA, 64 nt, hsa
agcccuaaaucugagucaguaauucucuaaaaauccuucccaaaaaucagugucuagggacugg

SEQ ID NO: 107901 - RNA, 64 nt, hsa
ucgugcauuaaaauuucuuauuuacccuuuucccccuucccauuucuucccacuuucaucuacc

SEQ ID NO: 107902 - RNA, 64 nt, hsa
cuaaacauucaauuccagagaaccaaaaaucccaccuucccaccgaacacuacuaaggggcuug

SEQ ID NO: 107903 - RNA, 64 nt, hsa
agccccuuuggagcuuuucucuuguccucucacuccuucccagaaguuuuugcacagaacuuca

SEQ ID NO: 107904 - RNA, 64 nt, hsa
cauucuccauaccucccccaagcucuccuccagcccuucccagggcucagcccugcuguccuga

SEQ ID NO: 107905 - RNA, 64 nt, hsa
uuaacaacauccccauuccccaccugguccucccccuucccaugcugccaacuucuaaccgcaa

SEQ ID NO: 107906 - RNA, 64 nt, hsa
uuuuccuucucccuccaucccuugacgguucuggccuucccaaacugcuuuugaucuuuugauu

SEQ ID NO: 107907 - RNA, 64 nt, hsa
gccuggagaggacugagccuacggaaaggggauaccuucccacucagcacugcuucacacaggc

SEQ ID NO: 107908 - RNA, 64 nt, hsa
gcagagcccaggaggcagcaucuccagagcuggcccuucccaucuccccucuccccucucccgu

SEQ ID NO: 107909 - RNA, 64 nt, hsa
uucuucuuuccuccgcuccccuccccuucccuccccuucccauccuucuuucucuuuuuuuuac

SEQ ID NO: 107910 - RNA, 64 nt, hsa
gaacaaggggugccaggagacugcuacucccaguccuucccagaaacugccuagggcuuugagu

SEQ ID NO: 107911 - RNA, 64 nt, hsa
uaaaccguucuggguuuugaaagccucaggccaaccuucccaacugcugcgugagcagacaccu

SEQ ID NO: 107912 - RNA, 64 nt, hsa
uuuagaggcaguugccccacacauagccccuugaccuucccaucaccuccucaucagggccugc

SEQ ID NO: 107913 - RNA, 64 nt, hsa
ccaguuggagacugucuggccccccugguccccuccuucccaagugagucucucugggccuuag

SEQ ID NO: 107914 - RNA, 64 nt, hsa
gccguggcccuugaguccccauugaggcuugguuccuucccaauccaguggacuucgcagucca

SEQ ID NO: 107915 - RNA, 64 nt, hsa
ucagcccugaggacagaugccuccuuccucuuuuccuucccaaagcaagcaagaggccguggcu

SEQ ID NO: 107916 - RNA, 64 nt, hsa
cccugugaugugucucgacaccaauacacaacccccuucccaccauccuucaugucacuagaua

SEQ ID NO: 107917 - RNA, 64 nt, hsa
cccaccauccuucaugucacuagauacacaacccccuucccaccaucccuucagucacuagugg

SEQ ID NO: 107918 - RNA, 64 nt, hsa
gcuucuucccguccugccacagacacuucuccugccuucccacccugacccggcagaacccacc

SEQ ID NO: 107919 - RNA, 64 nt, hsa
gagcggaacagcccauccagcagagugaguccauccuucccagguucuccccugggagacuccc

SEQ ID NO: 107920 - RNA, 64 nt, hsa
gggcccagcuuccaccggcagggaguugugagcgccuucccaacaaugugccccucaccccuug

SEQ ID NO: 107921 - RNA, 64 nt, hsa
ugcugccuggccaagccccacacccgcagacccuccuucccauccucugaaaugggacccugug

SEQ ID NO: 107922 - RNA, 64 nt, hsa
ugaugugccuguaaucuuuuucuccacccaaaccccuucccacgacaaaaacaagacugccucc

SEQ ID NO: 107923 - RNA, 64 nt, hsa
cagcacugggaagcuggagugcugcuugugccucccuucccagugggcuguguugacugcugcu

SEQ ID NO: 107924 - RNA, 64 nt, hsa
gaggaccccagcuccucagcuugcauggacucugccuucccagcgcuugucccccgaggaaggc

SEQ ID NO: 107925 - RNA, 64 nt, hsa
ggucggggacccucagcagcaggggcucugucucccuucccaaagggcgagaaccacauuggac

SEQ ID NO: 107926 - RNA, 64 nt, hsa
gagcugagcacugcccccucacccccccaccaccccuucccauuucaucgguggggacguggag

SEQ ID NO: 107927 - RNA, 64 nt, hsa
gcccuguuucuuugugucaucgugagcaugugccccuucccaggggcugugaccauugggugug

SEQ ID NO: 107928 - RNA, 64 nt, hsa
gggagauuccuuuuccagcaggccuggguagcugccuucccagcccagcccucccuggggccug

SEQ ID NO: 107929 - RNA, 64 nt, hsa
aggaaagauugagguggcagagcagaccacucucccuucccaaacuguccaacuucucccccuu

SEQ ID NO: 107930 - RNA, 64 nt, hsa
gcuuucccaagaaggccuggauucaggggagaggccuucccagggccacuccccuuacacccuc

SEQ ID NO: 107931 - RNA, 64 nt, hsa
ccucgcccucaagaacaagggccuugugcgugggccuucccauugcugcuuucccaagaaggcc

SEQ ID NO: 107932 - RNA, 64 nt, hsa
cagcugcugacagcccuggaugugauccggagucccuucccaccaggggcugaccucccagcug

SEQ ID NO: 107933 - RNA, 64 nt, hsa
cucuuugucuuggggaccaggaugcucccccaguccuucccagaugauggcugccugugggacc

SEQ ID NO: 107934 - RNA, 64 nt, hsa
aguacacuaaaccuaggucuggucaccaauaggguuuggagagcaaagggccacaacucaucag

SEQ ID NO: 107935 - RNA, 64 nt, hsa
aaaguccauuuuccuucuucuuuuuuuuuuuuuuuuuggagacagcaucucacccuguccuggc

SEQ ID NO: 107936 - RNA, 64 nt, hsa
cuucacuuugggcuuucugauguuuauucacaccuuuggagaguugcaacuugccacauacgaa

SEQ ID NO: 107937 - RNA, 64 nt, hsa
uagacuuaguaccagaaccaaaaauaccuagauuuuuggagaacuuauuacauacauagaaaca

SEQ ID NO: 107938 - RNA, 64 nt, hsa
gacugagccuugcuucucacuggcaguguugagcuuuggagaugggaugguugcuaugccaagc

SEQ ID NO: 107939 - RNA, 64 nt, hsa
ucaaaaacauaauacuuuuaugcugaugaugguauuuggagaugugaaagccaaaagccccugg

SEQ ID NO: 107940 - RNA, 64 nt, hsa
uuuucuuggacuacuuuaauuuggauccuuuggguuuggagaaagggaaugugaaagcugucau

SEQ ID NO: 107941 - RNA, 64 nt, hsa
auacaagccuuggguccauguuuacucucuucuauuuggagaauaagauggaugcuuauugaag

SEQ ID NO: 107942 - RNA, 64 nt, hsa
aguaaugcaccuucucuugcugauuauuuauuuguuuggagagacagaaauguaaaaguguauc

SEQ ID NO: 107943 - RNA, 64 nt, hsa
uuauuauuauauuuuuuuuaauuuggauucucgcuuuggagagggggaugcucucauccccucu

SEQ ID NO: 107944 - RNA, 64 nt, hsa
guaucugaaucacuggggauuaugauucacccucuuuggagaacaugcucucuuuucacccccc

SEQ ID NO: 107945 - RNA, 64 nt, hsa
ugcuuauauuuaucgcuuggcucaaguucugcccuuuggagaaauacugagcaagucuuucauu

SEQ ID NO: 107946 - RNA, 64 nt, hsa
acaaguuggaugacacuacucccaacuuuuuaaauuuggagaaaaccaucaaggucgaggaagc

SEQ ID NO: 107947 - RNA, 64 nt, hsa
cugcauuauaaguauaaagggaaccgagauuuaauuuggagaucaucacuguuaaaacgauacc

SEQ ID NO: 107948 - RNA, 64 nt, hsa
agucuuauauuguuuuuuaaacucugccaugaaauuuggagacaugacugugaaauuccuaacu

SEQ ID NO: 107949 - RNA, 64 nt, hsa
agaugaaauaaacuuauuacuuuaaaggaaaggauuuggagaauugaacucacaaacugauguu

SEQ ID NO: 107950 - RNA, 64 nt, hsa
gggcccuaaccuaaaaucggagaguaauuuaugcuuuggagaauuugacucaaauauauacuug

SEQ ID NO: 107951 - RNA, 64 nt, hsa
auguuuacagcaguuucaaaaaugacaaagucaguuuggagacagaaaaagacaaaagguccag

SEQ ID NO: 107952 - RNA, 64 nt, hsa
aacauccuucccugaguagaaaguaaugcauguguuuggagauuauuuucuguaaugcugggaa

SEQ ID NO: 107953 - RNA, 64 nt, hsa
gcagucucuucagguagcuaaauuaggagcuuguuuuggagaaaugaagcaaaggugaaugaca

SEQ ID NO: 107954 - RNA, 64 nt, hsa
cuuuucaucaacauguagagcugcuauuuuacuauuuggagaauaugaugugaaaauuggaccu

SEQ ID NO: 107955 - RNA, 64 nt, hsa
gucaagaaggaaacauguauauuagugaaguguuuuuggagacuguuugaaugugaccaaaugu

SEQ ID NO: 107956 - RNA, 64 nt, hsa
uguucucucuggacucuugccuagcucacaaggcuuuggagaauugucuuccuaaaucggggca

SEQ ID NO: 107957 - RNA, 64 nt, hsa
aauuuaaaauacauagguagggcuacugaggaaauuuggagagccacauucugugguuucucau

SEQ ID NO: 107958 - RNA, 64 nt, hsa
caggaaacagacuaaaaagaauuccaccaggcuguuuggagauccucaucuuggagcuuuuuca

SEQ ID NO: 107959 - RNA, 64 nt, hsa
uucuggugggacaauggguggugaauucugaaguuuuggagagggaaguggagcagccagcaag

SEQ ID NO: 107960 - RNA, 64 nt, hsa
uaaagcgcaucuucuccacaugggcuucacgugguuuggagaugggugggggaaaacaaucagg

SEQ ID NO: 107961 - RNA, 64 nt, hsa
uuggacaggacccagcccugcaccguucacuguauuuggagaaaaugguaagaguuccauaccg

SEQ ID NO: 107962 - RNA, 64 nt, hsa
ccuuuuagauaggaucuaggagugauuuuauuguuuuggagaauggaagggcccccauggcccu

SEQ ID NO: 107963 - RNA, 64 nt, hsa
caaggcagaggcucugaagcacuuuccuuguacauuuggagaguggcauugccuuuuagauagg

SEQ ID NO: 107964 - RNA, 64 nt, hsa
ugaccauaagaacuguggccaaaaagaacaguuuuuuggagaggcagaugacauuauaccugau

SEQ ID NO: 107965 - RNA, 64 nt, hsa
aaaaugaauugaaccauuucaacuauuuucuauauuuggagaaaguuugugcccuguguuuuau

SEQ ID NO: 107966 - RNA, 64 nt, hsa
aggccauuccugggugagcccuugggcaggcauguuuggagaugagagaggcuucgagagggug

SEQ ID NO: 107967 - RNA, 64 nt, hsa
caguguggugaugccaugcccaucaugggaggcuuuuggagaaacagaauguuugggcaggggc

SEQ ID NO: 107968 - RNA, 64 nt, hsa
uacuuugauagaguguggggugggggggaccugcuuuggagaucagccucaccuucucccaucc

SEQ ID NO: 107969 - RNA, 64 nt, hsa
ggcggccuggccuagaccaggggugcagccagcuuuuggagaaccuggauggccuuaggguucc

SEQ ID NO: 107970 - RNA, 64 nt, hsa
caagacuguggaauggggaauaaggaaggaggaguuuggagaaugacuccaaagguuugagcuu

SEQ ID NO: 107971 - RNA, 64 nt, hsa
uugaucaagacugggaauauaagagagaagcagguuuggagagaucaauuuugaacauuuuaga

SEQ ID NO: 107972 - RNA, 64 nt, hsa
uuggagagugggcugacaucaaguguaauuagcuuuuggagaguggguuuuguccauuauuaau

SEQ ID NO: 107973 - RNA, 64 nt, hsa
aaucuguuaccucugacaucaaguguaauuagcuuuuggagagugggcugacaucaaguguaau

SEQ ID NO: 107974 - RNA, 64 nt, hsa; identical to SEQ ID NO: 53771

SEQ ID NO: 107975 - RNA, 64 nt, hsa; identical to SEQ ID NO: 53772

SEQ ID NO: 107976 - RNA, 64 nt, hsa; identical to SEQ ID NO: 53773

SEQ ID NO: 107977 - RNA, 64 nt, hsa; identical to SEQ ID NO: 53774

SEQ ID NO: 107978 - RNA, 64 nt, hsa; identical to SEQ ID NO: 53775

SEQ ID NO: 107979 - RNA, 64 nt, hsa; identical to SEQ ID NO: 53776

SEQ ID NO: 107980 - RNA, 64 nt, hsa; identical to SEQ ID NO: 53777

SEQ ID NO: 107981 - RNA, 64 nt, hsa; identical to SEQ ID NO: 53778

SEQ ID NO: 107982 - RNA, 64 nt, hsa; identical to SEQ ID NO: 53779

SEQ ID NO: 107983 - RNA, 64 nt, hsa; identical to SEQ ID NO: 53780

SEQ ID NO: 107984 - RNA, 64 nt, hsa; identical to SEQ ID NO: 53781

SEQ ID NO: 107985 - RNA, 64 nt, hsa; identical to SEQ ID NO: 53782

SEQ ID NO: 107986 - RNA, 64 nt, hsa; identical to SEQ ID NO: 53783

SEQ ID NO: 107987 - RNA, 64 nt, hsa; identical to SEQ ID NO: 53784

SEQ ID NO: 107988 - RNA, 64 nt, hsa; identical to SEQ ID NO: 53785

SEQ ID NO: 107989 - RNA, 64 nt, hsa; identical to SEQ ID NO: 53786

SEQ ID NO: 107990 - RNA, 64 nt, hsa; identical to SEQ ID NO: 53787

SEQ ID NO: 107991 - RNA, 64 nt, hsa; identical to SEQ ID NO: 53788

SEQ ID NO: 107992 - RNA, 64 nt, hsa; identical to SEQ ID NO: 53789

SEQ ID NO: 107993 - RNA, 64 nt, hsa; identical to SEQ ID NO: 53790

SEQ ID NO: 107994 - RNA, 64 nt, hsa; identical to SEQ ID NO: 53791

SEQ ID NO: 107995 - RNA, 64 nt, hsa; identical to SEQ ID NO: 53792

SEQ ID NO: 107996 - RNA, 64 nt, hsa; identical to SEQ ID NO: 53793

SEQ ID NO: 107997 - RNA, 64 nt, hsa; identical to SEQ ID NO: 53794

SEQ ID NO: 107998 - RNA, 64 nt, hsa; identical to SEQ ID NO: 53795

SEQ ID NO: 107999 - RNA, 64 nt, hsa; identical to SEQ ID NO: 53796

SEQ ID NO: 108000 - RNA, 64 nt, hsa; identical to SEQ ID NO: 53797

SEQ ID NO: 108001 - RNA, 64 nt, hsa; identical to SEQ ID NO: 53798

SEQ ID NO: 108002 - RNA, 64 nt, hsa; identical to SEQ ID NO: 53799

SEQ ID NO: 108003 - RNA, 64 nt, hsa; identical to SEQ ID NO: 53800

SEQ ID NO: 108004 - RNA, 64 nt, hsa; identical to SEQ ID NO: 53801

SEQ ID NO: 108005 - RNA, 64 nt, hsa; identical to SEQ ID NO: 53802

SEQ ID NO: 108006 - RNA, 64 nt, hsa; identical to SEQ ID NO: 53803

SEQ ID NO: 108007 - RNA, 64 nt, hsa; identical to SEQ ID NO: 53804

SEQ ID NO: 108008 - RNA, 64 nt, hsa; identical to SEQ ID NO: 53805

SEQ ID NO: 108009 - RNA, 64 nt, hsa; identical to SEQ ID NO: 53806

SEQ ID NO: 108010 - RNA, 64 nt, hsa; identical to SEQ ID NO: 53807

SEQ ID NO: 108011 - RNA, 64 nt, hsa; identical to SEQ ID NO: 53808

SEQ ID NO: 108012 - RNA, 64 nt, hsa; identical to SEQ ID NO: 53809

SEQ ID NO: 108013 - RNA, 64 nt, hsa; identical to SEQ ID NO: 53810

SEQ ID NO: 108014 - RNA, 64 nt, hsa; identical to SEQ ID NO: 53811

SEQ ID NO: 108015 - RNA, 64 nt, hsa; identical to SEQ ID NO: 53812

SEQ ID NO: 108016 - RNA, 64 nt, hsa; identical to SEQ ID NO: 53813

SEQ ID NO: 108017 - RNA, 64 nt, hsa; identical to SEQ ID NO: 53814

SEQ ID NO: 108018 - RNA, 64 nt, hsa; identical to SEQ ID NO: 53815

SEQ ID NO: 108019 - RNA, 64 nt, hsa
gauccugaauggaggaaggauauguccucauuccauagagcauuagaagcugccaccagcccag

SEQ ID NO: 108020 - RNA, 64 nt, hsa
ugcugucagccacagcuuccugccguagagaaugauagagcagcugcucacacaggaggccgga

SEQ ID NO: 108021 - RNA, 58 nt, hsa
aauaccuuuccaauuaacacugagaaauuaagguuaagauucuccuuuuguacuggga

SEQ ID NO: 108022 - RNA, 58 nt, hsa
aauauuuuuaucggcucuagaaaaugcauaagguuaguacaagaucaguagagagaaa

SEQ ID NO: 108023 - RNA, 58 nt, hsa
auagaaaacuaauauacucccuuuaauauaagguuaucuacuauugauucuuucuagg

SEQ ID NO: 108024 - RNA, 58 nt, hsa
ccuuugagaugaagucguguucucaaaauaagguuauauuauuuucuuuuucugcuug

SEQ ID NO: 108025 - RNA, 58 nt, hsa
caacuccuugauuguaaaacugaaaaacuaagguuauuugaauguucuguuuucucuu

SEQ ID NO: 108026 - RNA, 58 nt, hsa
uauauucuuuguugcaaguggcagaaaguaagguuaugugcauggccauguguuugua

SEQ ID NO: 108027 - RNA, 58 nt, hsa
acuauagacuuuuaccaauggguagcuauaagguuacagcuuauuuuguaacuauuuu

SEQ ID NO: 108028 - RNA, 58 nt, hsa
uuagaaaaaaguaaacuugccauuugguuaagguuaccugcuuuuuauuuuauuccag

SEQ ID NO: 108029 - RNA, 64 nt, hsa; identical to SEQ ID NO: 21372

SEQ ID NO: 108030 - RNA, 64 nt, hsa; identical to SEQ ID NO: 21373

SEQ ID NO: 108031 - RNA, 64 nt, hsa; identical to SEQ ID NO: 21374

SEQ ID NO: 108032 - RNA, 64 nt, hsa; identical to SEQ ID NO: 21375

SEQ ID NO: 108033 - RNA, 64 nt, hsa; identical to SEQ ID NO: 21376

SEQ ID NO: 108034 - RNA, 64 nt, hsa; identical to SEQ ID NO: 21377

SEQ ID NO: 108035 - RNA, 64 nt, hsa; identical to SEQ ID NO: 21378

SEQ ID NO: 108036 - RNA, 64 nt, hsa; identical to SEQ ID NO: 21379

SEQ ID NO: 108037 - RNA, 64 nt, hsa; identical to SEQ ID NO: 21380

SEQ ID NO: 108038 - RNA, 64 nt, hsa; identical to SEQ ID NO: 21381

SEQ ID NO: 108039 - RNA, 64 nt, hsa; identical to SEQ ID NO: 21382

SEQ ID NO: 108040 - RNA, 64 nt, hsa; identical to SEQ ID NO: 21383

SEQ ID NO: 108041 - RNA, 64 nt, hsa; identical to SEQ ID NO: 21384

SEQ ID NO: 108042 - RNA, 64 nt, hsa; identical to SEQ ID NO: 21385

SEQ ID NO: 108043 - RNA, 64 nt, hsa; identical to SEQ ID NO: 21386

SEQ ID NO: 108044 - RNA, 64 nt, hsa; identical to SEQ ID NO: 21387

SEQ ID NO: 108045 - RNA, 64 nt, hsa; identical to SEQ ID NO: 21388

SEQ ID NO: 108046 - RNA, 64 nt, hsa; identical to SEQ ID NO: 21389

SEQ ID NO: 108047 - RNA, 64 nt, hsa; identical to SEQ ID NO: 21390

SEQ ID NO: 108048 - RNA, 64 nt, hsa; identical to SEQ ID NO: 21391

SEQ ID NO: 108049 - RNA, 64 nt, hsa; identical to SEQ ID NO: 21392

SEQ ID NO: 108050 - RNA, 64 nt, hsa; identical to SEQ ID NO: 21393

SEQ ID NO: 108051 - RNA, 51 nt, hsa; identical to SEQ ID NO: 21394

SEQ ID NO: 108052 - RNA, 64 nt, hsa; identical to SEQ ID NO: 21395

SEQ ID NO: 108053 - RNA, 64 nt, hsa; identical to SEQ ID NO: 21396

SEQ ID NO: 108054 - RNA, 64 nt, hsa; identical to SEQ ID NO: 21397

SEQ ID NO: 108055 - RNA, 56 nt, hsa; identical to SEQ ID NO: 21398

SEQ ID NO: 108056 - RNA, 64 nt, hsa; identical to SEQ ID NO: 21399

SEQ ID NO: 108057 - RNA, 64 nt, hsa; identical to SEQ ID NO: 21400

SEQ ID NO: 108058 - RNA, 64 nt, hsa; identical to SEQ ID NO: 21401

SEQ ID NO: 108059 - RNA, 64 nt, hsa; identical to SEQ ID NO: 21402

SEQ ID NO: 108060 - RNA, 64 nt, hsa; identical to SEQ ID NO: 21403

SEQ ID NO: 108061 - RNA, 64 nt, hsa; identical to SEQ ID NO: 21404

SEQ ID NO: 108062 - RNA, 64 nt, hsa; identical to SEQ ID NO: 21405

SEQ ID NO: 108063 - RNA, 64 nt, hsa; identical to SEQ ID NO: 21406

SEQ ID NO: 108064 - RNA, 64 nt, hsa; identical to SEQ ID NO: 21407

SEQ ID NO: 108065 - RNA, 64 nt, hsa; identical to SEQ ID NO: 21408

SEQ ID NO: 108066 - RNA, 64 nt, hsa; identical to SEQ ID NO: 21409

SEQ ID NO: 108067 - RNA, 64 nt, hsa; identical to SEQ ID NO: 21410

SEQ ID NO: 108068 - RNA, 64 nt, hsa; identical to SEQ ID NO: 21411

SEQ ID NO: 108069 - RNA, 64 nt, hsa; identical to SEQ ID NO: 21412

SEQ ID NO: 108070 - RNA, 64 nt, hsa; identical to SEQ ID NO: 21413

SEQ ID NO: 108071 - RNA, 64 nt, hsa; identical to SEQ ID NO: 21414

SEQ ID NO: 108072 - RNA, 64 nt, hsa; identical to SEQ ID NO: 21415

SEQ ID NO: 108073 - RNA, 64 nt, hsa; identical to SEQ ID NO: 21416

SEQ ID NO: 108074 - RNA, 64 nt, hsa; identical to SEQ ID NO: 21417

SEQ ID NO: 108075 - RNA, 64 nt, hsa; identical to SEQ ID NO: 21418

SEQ ID NO: 108076 - RNA, 64 nt, hsa; identical to SEQ ID NO: 21419

SEQ ID NO: 108077 - RNA, 64 nt, hsa; identical to SEQ ID NO: 21420

SEQ ID NO: 108078 - RNA, 64 nt, hsa; identical to SEQ ID NO: 21421

SEQ ID NO: 108079 - RNA, 64 nt, hsa; identical to SEQ ID NO: 21422

SEQ ID NO: 108080 - RNA, 64 nt, hsa; identical to SEQ ID NO: 21423

SEQ ID NO: 108081 - RNA, 64 nt, hsa; identical to SEQ ID NO: 21424

SEQ ID NO: 108082 - RNA, 64 nt, hsa; identical to SEQ ID NO: 21425

SEQ ID NO: 108083 - RNA, 64 nt, hsa; identical to SEQ ID NO: 21426

SEQ ID NO: 108084 - RNA, 64 nt, hsa; identical to SEQ ID NO: 21427

SEQ ID NO: 108085 - RNA, 64 nt, hsa; identical to SEQ ID NO: 21428

SEQ ID NO: 108086 - RNA, 64 nt, hsa; identical to SEQ ID NO: 21429

SEQ ID NO: 108087 - RNA, 64 nt, hsa; identical to SEQ ID NO: 21430

SEQ ID NO: 108088 - RNA, 64 nt, hsa; identical to SEQ ID NO: 21431

SEQ ID NO: 108089 - RNA, 64 nt, hsa; identical to SEQ ID NO: 21432

SEQ ID NO: 108090 - RNA, 64 nt, hsa; identical to SEQ ID NO: 21433

SEQ ID NO: 108091 - RNA, 64 nt, hsa; identical to SEQ ID NO: 21434

SEQ ID NO: 108092 - RNA, 64 nt, hsa; identical to SEQ ID NO: 21435

SEQ ID NO: 108093 - RNA, 64 nt, hsa; identical to SEQ ID NO: 21436

SEQ ID NO: 108094 - RNA, 64 nt, hsa; identical to SEQ ID NO: 21437

SEQ ID NO: 108095 - RNA, 64 nt, hsa; identical to SEQ ID NO: 21438

SEQ ID NO: 108096 - RNA, 64 nt, hsa; identical to SEQ ID NO: 21439

SEQ ID NO: 108097 - RNA, 64 nt, hsa; identical to SEQ ID NO: 21440

SEQ ID NO: 108098 - RNA, 64 nt, hsa; identical to SEQ ID NO: 21441

SEQ ID NO: 108099 - RNA, 64 nt, hsa; identical to SEQ ID NO: 21442

SEQ ID NO: 108100 - RNA, 64 nt, hsa; identical to SEQ ID NO: 21443

SEQ ID NO: 108101 - RNA, 64 nt, hsa; identical to SEQ ID NO: 21444

SEQ ID NO: 108102 - RNA, 64 nt, hsa; identical to SEQ ID NO: 21445

SEQ ID NO: 108103 - RNA, 64 nt, hsa; identical to SEQ ID NO: 21446

SEQ ID NO: 108104 - RNA, 64 nt, hsa; identical to SEQ ID NO: 21447

SEQ ID NO: 108105 - RNA, 64 nt, hsa; identical to SEQ ID NO: 21448

SEQ ID NO: 108106 - RNA, 64 nt, hsa; identical to SEQ ID NO: 21449

SEQ ID NO: 108107 - RNA, 64 nt, hsa; identical to SEQ ID NO: 21450

SEQ ID NO: 108108 - RNA, 64 nt, hsa; identical to SEQ ID NO: 21451

SEQ ID NO: 108109 - RNA, 64 nt, hsa; identical to SEQ ID NO: 21452

SEQ ID NO: 108110 - RNA, 64 nt, hsa; identical to SEQ ID NO: 21453

SEQ ID NO: 108111 - RNA, 64 nt, hsa; identical to SEQ ID NO: 21454

SEQ ID NO: 108112 - RNA, 64 nt, hsa; identical to SEQ ID NO: 21455

SEQ ID NO: 108113 - RNA, 64 nt, hsa; identical to SEQ ID NO: 21456

SEQ ID NO: 108114 - RNA, 64 nt, hsa; identical to SEQ ID NO: 21457

SEQ ID NO: 108115 - RNA, 64 nt, hsa; identical to SEQ ID NO: 21458

SEQ ID NO: 108116 - RNA, 64 nt, hsa; identical to SEQ ID NO: 21459

SEQ ID NO: 108117 - RNA, 64 nt, hsa; identical to SEQ ID NO: 21460

SEQ ID NO: 108118 - RNA, 64 nt, hsa; identical to SEQ ID NO: 21461

SEQ ID NO: 108119 - RNA, 64 nt, hsa; identical to SEQ ID NO: 21462

SEQ ID NO: 108120 - RNA, 64 nt, hsa; identical to SEQ ID NO: 21463

SEQ ID NO: 108121 - RNA, 64 nt, hsa; identical to SEQ ID NO: 21464

SEQ ID NO: 108122 - RNA, 64 nt, hsa; identical to SEQ ID NO: 21465

SEQ ID NO: 108123 - RNA, 64 nt, hsa; identical to SEQ ID NO: 21466

SEQ ID NO: 108124 - RNA, 64 nt, hsa; identical to SEQ ID NO: 21467

SEQ ID NO: 108125 - RNA, 64 nt, hsa; identical to SEQ ID NO: 21468

SEQ ID NO: 108126 - RNA, 64 nt, hsa; identical to SEQ ID NO: 21469

SEQ ID NO: 108127 - RNA, 64 nt, hsa; identical to SEQ ID NO: 21470

SEQ ID NO: 108128 - RNA, 64 nt, hsa; identical to SEQ ID NO: 21471

SEQ ID NO: 108129 - RNA, 64 nt, hsa; identical to SEQ ID NO: 21472

SEQ ID NO: 108130 - RNA, 64 nt, hsa; identical to SEQ ID NO: 21473

SEQ ID NO: 108131 - RNA, 64 nt, hsa; identical to SEQ ID NO: 21474

SEQ ID NO: 108132 - RNA, 64 nt, hsa; identical to SEQ ID NO: 21475

SEQ ID NO: 108133 - RNA, 64 nt, hsa; identical to SEQ ID NO: 21476

SEQ ID NO: 108134 - RNA, 64 nt, hsa; identical to SEQ ID NO: 21477

SEQ ID NO: 108135 - RNA, 64 nt, hsa; identical to SEQ ID NO: 21478

SEQ ID NO: 108136 - RNA, 64 nt, hsa; identical to SEQ ID NO: 21479

SEQ ID NO: 108137 - RNA, 64 nt, hsa; identical to SEQ ID NO: 21480

SEQ ID NO: 108138 - RNA, 64 nt, hsa; identical to SEQ ID NO: 21481

SEQ ID NO: 108139 - RNA, 64 nt, hsa; identical to SEQ ID NO: 21482

SEQ ID NO: 108140 - RNA, 64 nt, hsa; identical to SEQ ID NO: 21483

SEQ ID NO: 108141 - RNA, 64 nt, hsa; identical to SEQ ID NO: 21484

SEQ ID NO: 108142 - RNA, 64 nt, hsa; identical to SEQ ID NO: 21485

SEQ ID NO: 108143 - RNA, 64 nt, hsa; identical to SEQ ID NO: 21486

SEQ ID NO: 108144 - RNA, 64 nt, hsa; identical to SEQ ID NO: 21487

SEQ ID NO: 108145 - RNA, 64 nt, hsa; identical to SEQ ID NO: 21488

SEQ ID NO: 108146 - RNA, 64 nt, hsa; identical to SEQ ID NO: 21489

SEQ ID NO: 108147 - RNA, 64 nt, hsa; identical to SEQ ID NO: 21490

SEQ ID NO: 108148 - RNA, 64 nt, hsa; identical to SEQ ID NO: 21491

SEQ ID NO: 108149 - RNA, 64 nt, hsa; identical to SEQ ID NO: 21492

SEQ ID NO: 108150 - RNA, 64 nt, hsa; identical to SEQ ID NO: 21493

SEQ ID NO: 108151 - RNA, 64 nt, hsa; identical to SEQ ID NO: 21494

SEQ ID NO: 108152 - RNA, 64 nt, hsa; identical to SEQ ID NO: 21495

SEQ ID NO: 108153 - RNA, 64 nt, hsa; identical to SEQ ID NO: 21496

SEQ ID NO: 108154 - RNA, 64 nt, hsa; identical to SEQ ID NO: 21497

SEQ ID NO: 108155 - RNA, 64 nt, hsa; identical to SEQ ID NO: 21498

SEQ ID NO: 108156 - RNA, 64 nt, hsa; identical to SEQ ID NO: 21499

SEQ ID NO: 108157 - RNA, 64 nt, hsa; identical to SEQ ID NO: 21500

SEQ ID NO: 108158 - RNA, 64 nt, hsa; identical to SEQ ID NO: 21501

SEQ ID NO: 108159 - RNA, 64 nt, hsa; identical to SEQ ID NO: 21502

SEQ ID NO: 108160 - RNA, 64 nt, hsa; identical to SEQ ID NO: 21503

SEQ ID NO: 108161 - RNA, 64 nt, hsa; identical to SEQ ID NO: 21504

SEQ ID NO: 108162 - RNA, 64 nt, hsa; identical to SEQ ID NO: 21505

SEQ ID NO: 108163 - RNA, 64 nt, hsa; identical to SEQ ID NO: 21506

SEQ ID NO: 108164 - RNA, 64 nt, hsa; identical to SEQ ID NO: 21507

SEQ ID NO: 108165 - RNA, 64 nt, hsa; identical to SEQ ID NO: 21508

SEQ ID NO: 108166 - RNA, 64 nt, hsa; identical to SEQ ID NO: 21509

SEQ ID NO: 108167 - RNA, 64 nt, hsa; identical to SEQ ID NO: 21510

SEQ ID NO: 108168 - RNA, 64 nt, hsa; identical to SEQ ID NO: 21511

SEQ ID NO: 108169 - RNA, 64 nt, hsa; identical to SEQ ID NO: 21512

SEQ ID NO: 108170 - RNA, 64 nt, hsa; identical to SEQ ID NO: 21513

SEQ ID NO: 108171 - RNA, 64 nt, hsa; identical to SEQ ID NO: 21514

SEQ ID NO: 108172 - RNA, 64 nt, hsa; identical to SEQ ID NO: 21515

SEQ ID NO: 108173 - RNA, 64 nt, hsa; identical to SEQ ID NO: 21516

SEQ ID NO: 108174 - RNA, 64 nt, hsa; identical to SEQ ID NO: 21517

SEQ ID NO: 108175 - RNA, 64 nt, hsa; identical to SEQ ID NO: 21518

SEQ ID NO: 108176 - RNA, 64 nt, hsa; identical to SEQ ID NO: 21519

SEQ ID NO: 108177 - RNA, 64 nt, hsa; identical to SEQ ID NO: 21520

SEQ ID NO: 108178 - RNA, 64 nt, hsa; identical to SEQ ID NO: 21521

SEQ ID NO: 108179 - RNA, 64 nt, hsa; identical to SEQ ID NO: 21522

SEQ ID NO: 108180 - RNA, 64 nt, hsa; identical to SEQ ID NO: 21523

SEQ ID NO: 108181 - RNA, 64 nt, hsa; identical to SEQ ID NO: 21524

SEQ ID NO: 108182 - RNA, 64 nt, hsa; identical to SEQ ID NO: 21525

SEQ ID NO: 108183 - RNA, 64 nt, hsa; identical to SEQ ID NO: 21526

SEQ ID NO: 108184 - RNA, 64 nt, hsa; identical to SEQ ID NO: 21527

SEQ ID NO: 108185 - RNA, 64 nt, hsa; identical to SEQ ID NO: 21528

SEQ ID NO: 108186 - RNA, 64 nt, hsa; identical to SEQ ID NO: 21529

SEQ ID NO: 108187 - RNA, 64 nt, hsa; identical to SEQ ID NO: 21530

SEQ ID NO: 108188 - RNA, 64 nt, hsa; identical to SEQ ID NO: 21531

SEQ ID NO: 108189 - RNA, 64 nt, hsa; identical to SEQ ID NO: 21532

SEQ ID NO: 108190 - RNA, 64 nt, hsa; identical to SEQ ID NO: 21533

SEQ ID NO: 108191 - RNA, 64 nt, hsa; identical to SEQ ID NO: 21534

SEQ ID NO: 108192 - RNA, 64 nt, hsa; identical to SEQ ID NO: 21535

SEQ ID NO: 108193 - RNA, 64 nt, hsa; identical to SEQ ID NO: 21536

SEQ ID NO: 108194 - RNA, 64 nt, hsa; identical to SEQ ID NO: 21537

SEQ ID NO: 108195 - RNA, 64 nt, hsa; identical to SEQ ID NO: 21538

SEQ ID NO: 108196 - RNA, 64 nt, hsa; identical to SEQ ID NO: 21539

SEQ ID NO: 108197 - RNA, 64 nt, hsa; identical to SEQ ID NO: 21540

SEQ ID NO: 108198 - RNA, 64 nt, hsa; identical to SEQ ID NO: 21541

SEQ ID NO: 108199 - RNA, 64 nt, hsa; identical to SEQ ID NO: 21542

SEQ ID NO: 108200 - RNA, 64 nt, hsa; identical to SEQ ID NO: 21543

SEQ ID NO: 108201 - RNA, 64 nt, hsa
uuuuuuuugguuaggacuuuuuuugaaguuccuuuuuacuuaggugugaaagaugguucuuugu

SEQ ID NO: 108202 - RNA, 64 nt, hsa
auuaaacaaaacugauaucaauaguaaaagucauuuuacuuaucaauuuucuguuuuuuuuuuu

SEQ ID NO: 108203 - RNA, 64 nt, hsa
gcuacauuuuaauuuuaaaauagcuucacauuauuuuacuuauauuggguuuuucuucauuuua

SEQ ID NO: 108204 - RNA, 64 nt, hsa
guuuagagaaagaacuaaugucucauaugauguauuuacuuauuuuaaaaaaaagaauaggaau

SEQ ID NO: 108205 - RNA, 64 nt, hsa
cagaugaaagcaaucaaguuucuucuuuuccacuuuuacuuaugagcaggauauugauuacaaa

SEQ ID NO: 108206 - RNA, 64 nt, hsa
uguuguucauacuuuuuccuuccugacauuuguuuuuacuuacagguguucugcuggugacggu

SEQ ID NO: 108207 - RNA, 64 nt, hsa
uugagcugaguuuucauuuugauuuuguuagcuuuuuacuuagcuguaagguaccaaacuauuu

SEQ ID NO: 108208 - RNA, 64 nt, hsa
gaaguaaaguguucuauccaggauuaaagucaaguuuacuuaggcaacacaagaauauuucacu

SEQ ID NO: 108209 - RNA, 64 nt, hsa
uaauguauguucaucuccucuguuccugcuuauuuuuacuuauauauuucagcagaagguccgu

SEQ ID NO: 108210 - RNA, 64 nt, hsa
aauacucacauauuuuuacuuaaauuuucuuuaauuuacuuauauguuauuauaauuuugaauu

SEQ ID NO: 108211 - RNA, 64 nt, hsa
ugcaaaauccaguagguuaaaauacucacauauuuuuacuuaaauuuucuuuaauuuacuuaua

SEQ ID NO: 108212 - RNA, 64 nt, hsa
aauuggauauauguguuaaaauuuaacauuuagauuuacuuaauuguagaaaauacaaauguaa

SEQ ID NO: 108213 - RNA, 64 nt, hsa
aucaacaaacauaacuucuaccaugguuaagaauuuuacuuaggaaaaguauugaaguucaaau

SEQ ID NO: 108214 - RNA, 64 nt, hsa
acaaaauugauguuuuuauaaucaaauguauuuuuuuacuuauguaguuuuuguuuuaugcaag

SEQ ID NO: 108215 - RNA, 64 nt, hsa
augagcaggaagagggaaggcuguuugagaaccauuuacuuagcagaaccacauauuuuagaca

SEQ ID NO: 108216 - RNA, 64 nt, hsa
gcccagccaaguaacugaaccauuccaacuucaauuuacuuaugaaaagaauuugaugauguag

SEQ ID NO: 108217 - RNA, 64 nt, hsa
uuucuucagagcaagaagguuauauuuuuuaaaauuuacuuaguaaugcacauucaaaacacac

SEQ ID NO: 108218 - RNA, 64 nt, hsa
uaauggauuauguggaauuguagugccaucgguuuuuacuuagagcccuugacgugcuuggacc

SEQ ID NO: 108219 - RNA, 64 nt, hsa
gauaauaaaguagguuuuauauauucuuuaaauuuuuacuuauauaauacuuucuaguuuuucc

SEQ ID NO: 108220 - RNA, 64 nt, hsa
uuauuccugacuaguuuugcacacuugaaaauuguuuacuuauuuuacaacuguuuuacugaug

SEQ ID NO: 108221 - RNA, 64 nt, hsa
aaauaacacauugucaaccuggauccuuugacaauuuacuuaacucuggcauguucacaaaaag

SEQ ID NO: 108222 - RNA, 64 nt, hsa
aaguucaucacuuuugcauucagauacuuggucauuuacuuaccaaauuacaaacgcaauacua

SEQ ID NO: 108223 - RNA, 64 nt, hsa
uacugagaccaucucuuccuuucuuuccccuucuuuuacuuagaaugucuuuguauucauuugc

SEQ ID NO: 108224 - RNA, 64 nt, hsa
ucuuuucacuuacaagcucuaugaucuuaaauaauuuacuuaauguauuuugguguauuuuccu

SEQ ID NO: 108225 - RNA, 64 nt, hsa
gacucaaaauaacuuguuuguaaaagaaaauuuguuuacuuacccauuaguaaguuccugcaua

SEQ ID NO: 108226 - RNA, 64 nt, hsa
gcccaggcugcuuuuuaaaaauauuuuuuuauuuuuuacuuauuuuuaaauuuucucuuuuuau

SEQ ID NO: 108227 - RNA, 64 nt, hsa
cauuuuuuaauaaccaaaggcaggggaaaaucauuuuacuuauuaauaaauauuuuaugaugug

SEQ ID NO: 108228 - RNA, 64 nt, hsa
auuaucaaauucaagugaauuuauuuguguguucuuuacuuauauaaaaaaagauaacuuuaag

SEQ ID NO: 108229 - RNA, 64 nt, hsa
gauacaacuaagauccuaaauguuuuaauuaguguuuacuuaagccuuuuucaggugaggaggu

SEQ ID NO: 108230 - RNA, 64 nt, hsa
uucuauauuauguuuucgcuuuuguauuuuaagcuuuacuuagauauucaaaaccugguauauc

SEQ ID NO: 108231 - RNA, 64 nt, hsa
agcugcaauucugccugggugccuugggguguauuuuacuuauaaccuguguguuuuccacagu

SEQ ID NO: 108232 - RNA, 64 nt, hsa
aacaaguuaacaugauaauaggaagaaacaaaaauuuacuuaacuucuuucuuuugauuuuuuu

SEQ ID NO: 108233 - RNA, 64 nt, hsa
aaacacuccuguacauaaucgguuaauuuaaaauuuuacuuaauaagugaacaaguaaugaaga

SEQ ID NO: 108234 - RNA, 64 nt, hsa
uuaauaagugaacaaguaaugaagauuucaccuguuuacuuaggguaucuacccagacccaucg

SEQ ID NO: 108235 - RNA, 64 nt, hsa
aacugaacauauggaaauagauuuauuguaaguauuuacuuagagcuuuuucuuaaaucugaac

SEQ ID NO: 108236 - RNA, 64 nt, hsa
augaacuauuucagucaagcccacucuaccacuuuuuacuuaucugguuaauaauccgaaaugu

SEQ ID NO: 108237 - RNA, 64 nt, hsa
gugguguuuggaauuggguuuuucaaugaguggcuuuacuuaucaaucacaacagguaauagca

SEQ ID NO: 108238 - RNA, 64 nt, hsa
uguacuuucuuuaaucuuaaaaaguacacggcuuuuuacuuauuuaccuuuuaaauaugccccu

SEQ ID NO: 108239 - RNA, 64 nt, hsa
uuaaguuuccuagugauucucaaucucuuugaauuuuacuuacauuuacacacacacgcacaca

SEQ ID NO: 108240 - RNA, 64 nt, hsa
auaaguuucccagugauucucaaccucuuugaauuuuacuuauaauuacauacacacacacacu

SEQ ID NO: 108241 - RNA, 64 nt, hsa
gcgugugagccaccacgcccggccaugaaauauuuuuacuuaaaaauugggaauaagcuuuuug

SEQ ID NO: 108242 - RNA, 64 nt, hsa
aggcgugagccaccgugcccaaccaugaaauauuuuuacuuaaaaauugggaauaagcucgcuu

SEQ ID NO: 108243 - RNA, 64 nt, hsa
aaucuguccacuguauuuuacaggucuucauacuuuuacuuaauuuucuuuaucuguauggcaa

SEQ ID NO: 108244 - RNA, 64 nt, hsa
cuuacaggagaaaaggcuauauuugugaucagauuuuacuuauugacauauuagaaagguuuuu

SEQ ID NO: 108245 - RNA, 64 nt, hsa
gcguuaaaguuguacuaggcaaacacacugauguaggaagcacgaggaaaggaagacguuuuga

SEQ ID NO: 108246 - RNA, 64 nt, hsa
ucccugcacccaaggggccucuccaugccuucuuaggaagcagcuaugaauccauuguccuugu

SEQ ID NO: 108247 - RNA, 64 nt, hsa
auuaaaaauguauaugaaugcuccuaauauggucaggaagcaaggaagcgaaggauauauuaug

SEQ ID NO: 108248 - RNA, 64 nt, hsa
uauacuaagaguaaagcaacucaaguuauaggaaaggaagcagauaccuugcaaagcaacuagu

SEQ ID NO: 108249 - RNA, 64 nt, hsa
ccagcuuugggggaccuggaagaaaugucuccaaaggaagcaaggcauguuuuaguugagugcu

SEQ ID NO: 108250 - RNA, 64 nt, hsa
ucucagcucacuguuuuuccuugaguucuccuacaggaagcagaugagaacugcccagucuuca

SEQ ID NO: 108251 - RNA, 64 nt, hsa
ccagaauuagaguuauuagagcaagagagagcuuaggaagcaugagggcaacuauagugaggcc

SEQ ID NO: 108252 - RNA, 64 nt, hsa
auuauuagugguguggcacugggagcugcuccuaaggaagcagggagcaaaucccaccuuuacc

SEQ ID NO: 108253 - RNA, 64 nt, hsa
ucaagcauuuauccaaauucugcucacagacaugaggaagcaggcuguagauuuaagggcacuc

SEQ ID NO: 108254 - RNA, 64 nt, hsa
uuuuauauaagacguauacggcaccuucuugaaaaggaagcauuugaacuuguuccucccuaua

SEQ ID NO: 108255 - RNA, 64 nt, hsa
acaguugugauucagcaccugcugucugagcgggaggaagcacugaaacaacacaaaacccuau

SEQ ID NO: 108256 - RNA, 64 nt, hsa
aagcaucuuugaaaaguccugcgcugcggaggacaggaagcacccccucaauagccagcaccca

SEQ ID NO: 108257 - RNA, 64 nt, hsa
ucagcugggaaggccgcaagaggcauagagggagaggaagcacacugcagggcugcuguggccc

SEQ ID NO: 108258 - RNA, 64 nt, hsa
ugaaugugccuuaaaaaucaagacacuaguucagaggaagcacauaauguccagaucuauggcg

SEQ ID NO: 108259 - RNA, 64 nt, hsa
caugaucugagcagcagcauccaggcugaccucaaggaagcauagccacaaaacagaauagcac

SEQ ID NO: 108260 - RNA, 64 nt, hsa
caaagcuaaaauaauggcuucacucuuauauuugaggaagcaacugaacaggagucaaugauuu

SEQ ID NO: 108261 - RNA, 64 nt, hsa
ugaauaagguguugaaagagugcaggggguugggaggaagcauguaagagagggaacauuuccu

SEQ ID NO: 108262 - RNA, 64 nt, hsa
ggaggugguauugaccggcacucaguggguggagaggaagcauauguggaaggagcauuuccuu

SEQ ID NO: 108263 - RNA, 64 nt, hsa
ugcacacacaaaaugcccaaggcacucacuggggaggaagcaaggaagcaaacagucugagaaa

SEQ ID NO: 108264 - RNA, 64 nt, hsa
caaaaugcccaaggcacucacuggggaggaagcaaggaagcaaacagucugagaaaaugaugca

SEQ ID NO: 108265 - RNA, 64 nt, hsa
gugacaggcagacacaugcuguuggccucaagcaaggaagcagagcacuguguaaccagcaguc

SEQ ID NO: 108266 - RNA, 64 nt, hsa
ucauugacuucaagaugccucuucuaccucuuccaggaagcacaggccaggggaucugggugug

SEQ ID NO: 108267 - RNA, 64 nt, hsa
aggcugggggccuccacccagcagcagaccaaccaggaagcagcuugaacuggauggagacuuu

SEQ ID NO: 108268 - RNA, 64 nt, hsa
uucagaagaggaacacaaaggaagccacccaggaaggaagcacagagcugggggcucuggaaac

SEQ ID NO: 108269 - RNA, 64 nt, hsa
agcaccaaagcuccccaccccagccugguggcagaggaagcagguggcaccaacucaccaaagg

SEQ ID NO: 108270 - RNA, 64 nt, hsa
aguuuccauuuucuauuaccuggaaagggccauaaggaagcaggcagggcuuagguagcuuggu

SEQ ID NO: 108271 - RNA, 64 nt, hsa
cuggcaagggacaggaagcugauagaaagugaacaggaagcaaacaggaagugagcaaggggcc

SEQ ID NO: 108272 - RNA, 64 nt, hsa
gggaauacaaagguauccauggagguagcaccacaggaagcaggcaucacacuugaggcuuggg

SEQ ID NO: 108273 - RNA, 64 nt, hsa
uguggaagccaaggcugggucugacaucccugccaggaagcagguuggacagaaaccacuugcu

SEQ ID NO: 108274 - RNA, 64 nt, hsa
cucugagaaaaggcaugguuucuuaauugagggaaggaagcagauucggagggguggagauaaa

SEQ ID NO: 108275 - RNA, 64 nt, hsa
uaaagaggugccuucagcuggugggccgagaggcaggaagcagccuuccuuggagcaguucuuc

SEQ ID NO: 108276 - RNA, 64 nt, hsa
aacggugucauauuuagucagaggccccacccccaggaagcauggauggggaugaaggcacagg

SEQ ID NO: 108277 - RNA, 64 nt, hsa
uucuuguuucucaugaaaaguuugauuaaaauucaggaagcagcaaaaccuucaaaacaagaca

SEQ ID NO: 108278 - RNA, 64 nt, hsa
aaggaugccacuugggaaugaauuguccuuuucuaggaagcacgggggagugagacaggcuggg

SEQ ID NO: 108279 - RNA, 64 nt, hsa
agaauggcauguuuuauaauuaacugaauaaagaaggaagcauuauuauauauuauugugggga

SEQ ID NO: 108280 - RNA, 64 nt, hsa
uauuucaucuucauaagaaugagaaaggcucaaaaggaagcacuuuuagaaaucuucucugacc

SEQ ID NO: 108281 - RNA, 64 nt, hsa
aaaaaaaaguuuaaaaagcaaaauggggagggggaggaagcagugacuuuuuuuugguaauuau

SEQ ID NO: 108282 - RNA, 64 nt, hsa
cuuugaauaaaugacauggcaccuccuagcaggaaggaagcaggguugaaacccugaaguguua

SEQ ID NO: 108283 - RNA, 64 nt, hsa
aucuucaguauuuucuccacuucauuuuuaagaaaggaagcaacagauagauguugcucuuuca

SEQ ID NO: 108284 - RNA, 64 nt, hsa
ugggcaccuaacggccugcccuguuagcuuuccaaggaagcagaagacgggaggggaggcauug

SEQ ID NO: 108285 - RNA, 62 nt, hsa
uaaauuagcgaaaucaacccuuccuaaguuuaagggaaaaguuauuuuuaaaaacaacuuaa

SEQ ID NO: 108286 - RNA, 62 nt, hsa
auacagggacagggugucuccugaagauacuuagggaaaacaggagccuaccacaaggcucc

SEQ ID NO: 108287 - RNA, 62 nt, hsa
accucuugagauauauuauugaugacauuuaaagggaaaaguccuaaauuuaccuuaaauaa

SEQ ID NO: 108288 - RNA, 62 nt, hsa
aaaacuuuuaaauucaacaccugaaaaucaugagggaaaaugauuaccucuugagauauauu

SEQ ID NO: 108289 - RNA, 62 nt, hsa
cuugccaauuuuguuguuuaaaaaaaaaauucagggaaaauuaaaaaccuggaacuccauaa

SEQ ID NO: 108290 - RNA, 62 nt, hsa
guugggguggccauaaugguuuguugggggugagggaaaaaacccacagggaccagaauguu

SEQ ID NO: 108291 - RNA, 62 nt, hsa
acaguggguaaauauaucauacaucucuugaaagggaaaauauccaugucaguuucuuucac

SEQ ID NO: 108292 - RNA, 62 nt, hsa
cauugugggguagguggucggggaugggagaaagggaaaagucagggaaggggagaagaaag

SEQ ID NO: 108293 - RNA, 62 nt, hsa
aauauguaguggccuuuucaaggccuagucccagggaaaacauuuuguagaguauaggggag

SEQ ID NO: 108294 - RNA, 62 nt, hsa
gcuguaagaagaaaauggagacaaacagaaggagggaaaaaccaaccuacucugaaagccuu

SEQ ID NO: 108295 - RNA, 62 nt, hsa
aaugugugauuaaaugcuuuuuuaaauugcuaagggaaaauaacaaaguguuaguaaucauu

SEQ ID NO: 108296 - RNA, 62 nt, hsa
ucaauagauuauucugccauuuuuuaaaggaaagggaaaaugaaaacagcaugucuuuuuaa

SEQ ID NO: 108297 - RNA, 62 nt, hsa
guggaaugaagucuuugauggguaggagagagagggaaaaccucaaacuacaucauagaagu

SEQ ID NO: 108298 - RNA, 62 nt, hsa
cauggcgagacccuguuucuacaaaaagaaaaagggaaaaaaaaagcagggacugucauucu

SEQ ID NO: 108299 - RNA, 62 nt, hsa
augaaaaaaggucaguugauuccagugcuaaaagggaaaaaccugugguccgcccagaagag

SEQ ID NO: 108300 - RNA, 62 nt, hsa
agaaaagaaaaaaagguuaagcauaaaaagaaagggaaaaagcagaaacacugcagaagaca

SEQ ID NO: 108301 - RNA, 62 nt, hsa
gaacacaccaaaaaagugaaagagaaauugaaagggaaaaaagacaaaaagcauaaggcucc

SEQ ID NO: 108302 - RNA, 62 nt, hsa
aagucuguaauuucaguuuuugugucggggagagggaaaaacuauuugucuguaguugcuuu

SEQ ID NO: 108303 - RNA, 62 nt, hsa
ucuucuguaaugagaauagacuggaacaugugagggaaaaauauuuaaaaaaagauggcagu

SEQ ID NO: 108304 - RNA, 62 nt, hsa
gcuugaaaccuucccacacucccugcuccaggagggaaaaacagauguuguugacagauaga

SEQ ID NO: 108305 - RNA, 62 nt, hsa
gccaggauuaaggggaggcaaucaaugcaccuagggaaaaaauuuaaggagguauucacacu

SEQ ID NO: 108306 - RNA, 62 nt, hsa
cucuaaggccuuugacugcagaggcaccuguuagggaaaaucagaugucucauauaauaagg

SEQ ID NO: 108307 - RNA, 62 nt, hsa
uguagggcuaucuuuuuaaaaaaugucaacaaagggaaaauaaacuaucagcuuggaugguc

SEQ ID NO: 108308 - RNA, 62 nt, hsa
gaauacuugaaguaggaaguaggaaauccaguagggaaaauaggguccuugaaacagaaaaa

SEQ ID NO: 108309 - RNA, 62 nt, hsa
uguggauacagucauuauuuaaagcacaugccagggaaaaagaccaaauuuugaggucuuuu

SEQ ID NO: 108310 - RNA, 62 nt, hsa
guagaaguuaaaggagaaucugaaggcaggucagggaaaagaagaacuggaaaugaaacaga

SEQ ID NO: 108311 - RNA, 62 nt, hsa
agcgcuuuuggggguggcuuaugggggagaaaagggaaaaugcugucaguagauggaggcaa

SEQ ID NO: 108312 - RNA, 62 nt, hsa
gaaaaggguucuggaguguucauucagagugaagggaaaacuuuauccuucuauuucuuaua

SEQ ID NO: 108313 - RNA, 62 nt, hsa
gaaugagaacuuugcaguuggaugaauagagaagggaaaaguugcuggagcacggagugaag

SEQ ID NO: 108314 - RNA, 62 nt, hsa
uuugaauuuaaaggguguacaggucuuucuguagggaaaauuauuccauguaaacauuucaa

SEQ ID NO: 108315 - RNA, 62 nt, hsa
accacugagcuuuaaauaagaauggaaauacaagggaaaaccugcguuguaaacaugaggau

SEQ ID NO: 108316 - RNA, 62 nt, hsa
ugccacuugcacugugcuugcuccuaagcaaaagggaaaaggagcgcgcgugauagaagaaa

SEQ ID NO: 108317 - RNA, 62 nt, hsa
uuuuaauuugggcaucucuagagaacgcuuucagggaaaaauacuuuaauaguaaaaagauu

SEQ ID NO: 108318 - RNA, 62 nt, hsa
uuucuagauuauaaacugacuaaacuuacaucagggaaaaauugguauuuaugcaaaaaaaa

SEQ ID NO: 108319 - RNA, 62 nt, hsa
agugauaagauucauacacucuguauuuggggagggaaaaccuuuuuaagcaugguggggca

SEQ ID NO: 108320 - RNA, 62 nt, hsa
cuguuuauaaaauuuccuuagagacuuuuugaagggaaaauagagcaacagggaaaaaugaa

SEQ ID NO: 108321 - RNA, 62 nt, hsa
uuagagacuuuuugaagggaaaauagagcaacagggaaaaaugaaagaaaugucuugguuac

SEQ ID NO: 108322 - RNA, 62 nt, hsa
auacacagcuacagacacacauucuguugacaagggaaaaccuucaaagcauguuucuuucc

SEQ ID NO: 108323 - RNA, 62 nt, hsa
ggucuacgaagaauagggugaaaaaccucagaagggaaaacuccaaaccaguugggagacuu

SEQ ID NO: 108324 - RNA, 62 nt, hsa
cccugcagggcugagauguggcaggagcucccagggaaaaacgaagugcauuugauuggugu

SEQ ID NO: 108325 - RNA, 62 nt, hsa
acaucauauguccaugaaacuucagauaaacuagggaaaacugggugcugaggugaaagcau

SEQ ID NO: 108326 - RNA, 62 nt, hsa
cucagacaaggaacucucuccucucuuuuuggagggaaaaaaaaaauaucacuacacaaacc

SEQ ID NO: 108327 - RNA, 62 nt, hsa
auggaacuggucagugauucucuaccccaaguagggaaaaccuccaucuuuucccugucuuc

SEQ ID NO: 108328 - RNA, 62 nt, hsa
caucaggacugcuucaucgucuuggcugagaaagggaaaagacacacaagucgcguggguug

SEQ ID NO: 108329 - RNA, 62 nt, hsa
cgaggcccucugcaagaagcucaaggaagcucagggaaaauggacguauucagagaguguuu

SEQ ID NO: 108330 - RNA, 62 nt, hsa
uuccaaaaucaaagauuugaccuuaagagggaagggaaaaaagugugaaaggaugaugaaga

SEQ ID NO: 108331 - RNA, 62 nt, hsa
uuuugccuuuaagacgauucauucuugucuagagggaaaaucuggcugauuugggaauaaaa

SEQ ID NO: 108332 - RNA, 62 nt, hsa
acugacaaaaagggaaaauacgaaacacagaaagggaaaauaaacugacuuuuauaaugaau

SEQ ID NO: 108333 - RNA, 62 nt, hsa
ccaaucaguguauugcucauuuacugacaaaaagggaaaauacgaaacacagaaagggaaaa

SEQ ID NO: 108334 - RNA, 62 nt, hsa
aaaaguuguuugcuuaaaaaaaauuucaugugagggaaaaaaaaaaaaccuauuccagaaua

SEQ ID NO: 108335 - RNA, 62 nt, hsa
aaacagaaaacaauuccacgaggccaaucuaaagggaaaaaauccuacacuacuuuuacuac

SEQ ID NO: 108336 - RNA, 62 nt, hsa
uucaguuuuaacgaguaauuggauaaacccugagggaaaacggagguagauucagcaccuaa

SEQ ID NO: 108337 - RNA, 62 nt, hsa
agacugaacugugugcaacaggaaaagucaaaagggaaaagguagcugaugagguuacaugg

SEQ ID NO: 108338 - RNA, 62 nt, hsa
agguguuucauuuucguuuuuaugggaaaccaagggaaaagcacauugcgauccauucagug

SEQ ID NO: 108339 - RNA, 62 nt, hsa
aauaugcauuuaaauacagucuuccauuugcaagggaaaagucucuuguaauccgaaucucu

SEQ ID NO: 108340 - RNA, 62 nt, hsa
caugggagaaaauagauaagaguagaaacugcagggaaaauuauuugcauaacaauuccucu

SEQ ID NO: 108341 - RNA, 62 nt, hsa
acuuuguaagacccauauuuuuaacucuucccagggaaaauucauguugcugcagaaguagg

SEQ ID NO: 108342 - RNA, 62 nt, hsa
agauucuucacugacuugaauugagaugggcaagggaaaaggucccuggacucccuccugcc

SEQ ID NO: 108343 - RNA, 62 nt, hsa
acauaaagugcuugagucuauuuuuaauaaaaagggaaaaagcaacuugaggcaaccugucc

SEQ ID NO: 108344 - RNA, 62 nt, hsa
accccuauuuguagggaaaaggacuugagugcagggaaaacucaaaucccaggcccugggaa

SEQ ID NO: 108345 - RNA, 62 nt, hsa
cucugaggaugaaguuuccuaccccuauuuguagggaaaaggacuugagugcagggaaaacu

SEQ ID NO: 108346 - RNA, 62 nt, hsa
uccuauuuuuuuuuuuaacuaccuuaaacuuaagggaaaaguucuccuaucuugauuucacu

SEQ ID NO: 108347 - RNA, 61 nt, hsa
caguucuugcauuggcauaaugaggagcaggagggaaaaggccuuuacuagauucuuguca

SEQ ID NO: 108348 - RNA, 62 nt, hsa
aagggccaaacauucuuuaucccucccaccccagggaaaacauuuggaaaauaguccuuuuu

SEQ ID NO: 108349 - RNA, 62 nt, hsa
ccaaagacagagggagcuucacugagacucagagggaaaaggaaaagagccucaaacauuuu

SEQ ID NO: 108350 - RNA, 62 nt, hsa
uuuuggagauaguaaaaauuuaaaaauguaauagggaaaauauuuaauuuuuaagucaaaaa

SEQ ID NO: 108351 - RNA, 62 nt, hsa
cugaacagaagggcaagagagguggaucugugagggaaaagacccaauaggauaacucaagu

SEQ ID NO: 108352 - RNA, 62 nt, hsa
ucuggcuauuuaagguucaaaaucaagugccuagggaaaauuccaauggaugauuuucuggg

SEQ ID NO: 108353 - RNA, 62 nt, hsa
auuacuuguuuacauccaacaaaugguuagcuagggaaaacagugcaaacugaguguuagua

SEQ ID NO: 108354 - RNA, 62 nt, hsa
ugacuguccuuucaaggaaaaacuugcaauagagggaaaagccauuaaagcagcucccugcu

SEQ ID NO: 108355 - RNA, 62 nt, hsa
caccuccuuccugaacucuaauagagguuaaaagggaaaaaaaaaauucuguagauagcaaa

SEQ ID NO: 108356 - RNA, 62 nt, hsa
gacaagcagguuuauguguuuaaacagaaagaagggaaaagguacuaugugauaugguacug

SEQ ID NO: 108357 - RNA, 62 nt, hsa
uucaugaauuuugugaacuugccaaaaggggaagggaaaaaucuuuguguuacuucacucaa

SEQ ID NO: 108358 - RNA, 62 nt, hsa
gauacauaaagacuugagaagggaauuguuuaagggaaaagaaaagaguaauaauuuuuuuu

SEQ ID NO: 108359 - RNA, 62 nt, hsa
aauauuaaaauuaggaauuuaggcauuaccucagggaaaagccuugacagugaaaagaaacu

SEQ ID NO: 108360 - RNA, 62 nt, hsa
gccccugcaaagaagggagagaagguacccaaagggaaaaagagaaaagcugaugcuggcaa

SEQ ID NO: 108361 - RNA, 62 nt, hsa
uauuggauaaauaugaauaaauauuuucucucagggaaaauaauuuuugaaaguagggugau

SEQ ID NO: 108362 - RNA, 62 nt, hsa
uauuguuaugaaacuguaaggucuacauauaaagggaaaaaguuaauguggaaagcugaucu

SEQ ID NO: 108363 - RNA, 62 nt, hsa
ucccggcauaccuauuagugucuuaaaaaggaagggaaaagucuuuuguugcccucuccuau

SEQ ID NO: 108364 - RNA, 62 nt, hsa
aaaaaaaagaaaggacauugaguuuuaacagaagggaaaaggaaagaagaaaagauuuuugc

SEQ ID NO: 108365 - RNA, 62 nt, hsa
acagcacuaaauaacuugggggaaacggggggagggaaaaugaaaugaaaacccuguugcug

SEQ ID NO: 108366 - RNA, 62 nt, hsa
ucucaccaauuguagauuggugugaauugcuaagggaaaaaccuuaugcagagaaaaguuuu

SEQ ID NO: 108367 - RNA, 62 nt, hsa
aucuuagaagaaaccccaugaaggaaaagaauagggaaaagcuuucagcaguuauuuagccc

SEQ ID NO: 108368 - RNA, 62 nt, hsa
ugcgacguacugucacugaugagagacugggaagggaaaagcauauauauauagauauauag

SEQ ID NO: 108369 - RNA, 62 nt, hsa
acuucucugagcucagaaagugccccuugaugagggaaaaugucccacugcacugcgaauuu

SEQ ID NO: 108370 - RNA, 62 nt, hsa
cuuuuaucuugcggggucagagcgcccucuagagggaaaagcuagaggcacaggguuucugc

SEQ ID NO: 108371 - RNA, 62 nt, hsa
acaaccaccccguggcuuguguggggucucgcagggaaaagggcuggcuucuagguccccga

SEQ ID NO: 108372 - RNA, 62 nt, hsa
uuuguaaucaagauuuuauguaacauuuguaaagggaaaauuagcacuuuugugguucuuaa

SEQ ID NO: 108373 - RNA, 62 nt, hsa
uaaagggaaaauuagcacuuuugugguucuuaagggaaaagaaacagaccuuguggagauua

SEQ ID NO: 108374 - RNA, 62 nt, hsa
ucucagauccauaauccauacucagugaaagcagggaaaaaauauuuucacuuauuuuauuu

SEQ ID NO: 108375 - RNA, 62 nt, hsa
cuguguaaguauugugaaaacccuuuucuuccagggaaaaauuauuggaaauuccuuaacug

SEQ ID NO: 108376 - RNA, 62 nt, hsa
uagaacacgguuacagcugguucuguagaaagagggaaaagaugauugugacaauucagagc

SEQ ID NO: 108377 - RNA, 62 nt, hsa
auucucuggcucagccccagccuuucugaagaagggaaaacuagggacccagaugguuuaag

SEQ ID NO: 108378 - RNA, 62 nt, hsa
aacuuccuauucuuucuuaaauuugauggagaagggaaaauaaauugcaguuauugauucuu

SEQ ID NO: 108379 - RNA, 62 nt, hsa
aguaggauauccaaaguucaauguguuucaaaagggaaaacuuuuacuugugggggugggag

SEQ ID NO: 108380 - RNA, 62 nt, hsa
cccauccucuucuuuuagcaguaaaauagcugagggaaaagggagggaaaaggaaguuaugg

SEQ ID NO: 108381 - RNA, 62 nt, hsa
cuuuuagcaguaaaauagcugagggaaaagggagggaaaaggaaguuaugggaauaccugug

SEQ ID NO: 108382 - RNA, 64 nt, hsa
aauucuuugggauguucagacagacucaaauccuaaucaggaaaaagacucaucuaguaaugag

SEQ ID NO: 108383 - RNA, 64 nt, hsa
caucagauccugcuuugaaaauugauacaaacagaaucaggacagaaaaugguuccauuuugcc

SEQ ID NO: 108384 - RNA, 64 nt, hsa
acgaguauuuucucuuccugccaagaacuaggugaaucaggaauugauugcauaugcaagcccu

SEQ ID NO: 108385 - RNA, 64 nt, hsa
aaugcugacgaaaagcaauauccaaagucuugucaaucaggaugcaguuucuccaucgguaugg

SEQ ID NO: 108386 - RNA, 64 nt, hsa
acacuucuuuaagcuuuuuuuuuuuaaugucaugaaucaggaaggauacauagugauucguaua

SEQ ID NO: 108387 - RNA, 64 nt, hsa
uuuuacuaagguuuagcaccuuugaucuuuucuaaaucaggaaaaaaaucuaugcauauugagg

SEQ ID NO: 108388 - RNA, 64 nt, hsa
cugcaauaauuuguuguacaacuguuguaucaggaaucaggauuuuuuuguuguuguacuuucc

SEQ ID NO: 108389 - RNA, 64 nt, hsa
uccuguguauugcaagguacaauuuucuccaauaaaucaggagaacaggaguuugaugaugcaa

SEQ ID NO: 108390 - RNA, 64 nt, hsa
gaacacagaugcagaaauccuuaaaauguuagcaaaucaggaaugcaagccuuguucaacauuu

SEQ ID NO: 108391 - RNA, 64 nt, hsa
gucugagaucuguacuguuucaggauuacaaaggaaucaggauuuagccucaaguaguucccuu

SEQ ID NO: 108392 - RNA, 64 nt, hsa
cugggcccaguccugcuaguggcaaguuucuuugaaucaggaaggcaggugagguaagggccaa

SEQ ID NO: 108393 - RNA, 64 nt, hsa
uuacaauaauuuuuuucagcuauagcugcaguuuaaucaggauggguagagagcuguccucaua

SEQ ID NO: 108394 - RNA, 64 nt, hsa
uagcagaugcucguucuugccuccuucaggcaccaaucaggagaaggguucugccucccauccc

SEQ ID NO: 108395 - RNA, 64 nt, hsa
ucuccuuagagagagaacugugcuuccaaacagaaaucaggagugaccacaaagccugaaaaca

SEQ ID NO: 108396 - RNA, 62 nt, hsa
gguucuagcuaguaauaacaauauaauucuuuggcagauauucagaauaacauuuuaaacua

SEQ ID NO: 108397 - RNA, 62 nt, hsa
auuuaaauaucuuugauaauuguuauuuuuuuggcagauaauuccucuagaauguguaucuu

SEQ ID NO: 108398 - RNA, 62 nt, hsa
auuugcauccaccuucccuucugacucagguuggcagauaaacuguccccagacccugccac

SEQ ID NO: 108399 - RNA, 62 nt, hsa
gguuccuaugccuagccugugugccauuucauggcagauauguaagaaaggaaauggcccua

SEQ ID NO: 108400 - RNA, 62 nt, hsa
cuugcacuggcucuucuaaaggacuuuuggagggcagauaauuucaucuguuaaauccaaca

SEQ ID NO: 108401 - RNA, 62 nt, hsa
cacucuccuuagaauuggaacuaugcaguuaaggcagauaaaauguacagauguuucauaua

SEQ ID NO: 108402 - RNA, 64 nt, hsa
gggccgugcgcacuguguuccgugcccuggggacccccggaaaagcagcccagucagauguggg

SEQ ID NO: 108403 - RNA, 64 nt, hsa
gcuggagugccagucccugagcucagacccccguccccggaacugggccacaccacgugcccuc

SEQ ID NO: 108404 - RNA, 58 nt, hsa
cccgcgagacgcuguacuaggcugugcgccccggaacguguccaggaggagccuggcc

SEQ ID NO: 108405 - RNA, 64 nt, hsa
cucucagcuggaugagacuguccuggaggauccaccccggaacagacagaauggugucucucag

SEQ ID NO: 108406 - RNA, 64 nt, hsa
cguaucacuagcuugcggccaggucaugauguggccccggaagcuggcccugcgugccaugagu

SEQ ID NO: 108407 - RNA, 58 nt, hsa
gcucagaggugguuguuggcggagaacgccgccgcaguguuugaccucuagcggugaa

SEQ ID NO: 108408 - RNA, 58 nt, hsa
gggcugccccggaaucagcuccccggggccgccgcaacgaagguggauccgcaucuug

SEQ ID NO: 108409 - RNA, 64 nt, hsa
uacucuggucagucuccagcuaaccucucaaucaggcaaacauucuucuuggaggaaucaggca

SEQ ID NO: 108410 - RNA, 64 nt, hsa
cucaaucaggcaaacauucuucuuggaggaaucaggcaaacaucucaaaaauucucuuuccauc

SEQ ID NO: 108411 - RNA, 64 nt, hsa
acaaucagacggaucaccuuaucucuacacagcuggcaaacaccaggcugcggcuuggauuaac

SEQ ID NO: 108412 - RNA, 64 nt, hsa
cuuuagagaaaagccaaucauuuuuaaguccaauggcaaacauagugggggcugcaguagcacc

SEQ ID NO: 108413 - RNA, 64 nt, hsa
aaauauuaauuauucuuguuuuucucacacaggcauacuccaaaugcuucuuccaguucauuuu

SEQ ID NO: 108414 - RNA, 64 nt, hsa
uggacuuuuuuguacauaaauaagaaaaaccaaaauacuccaaagaugacuuccccugccuccu

SEQ ID NO: 108415 - RNA, 64 nt, hsa
caaagguaauggcccaucgaugagcauuuuuaacauacuccauagucuuuuccugugguguuag

SEQ ID NO: 108416 - RNA, 64 nt, hsa
agugauuuucuuuauaagaaaauuugggcucugaauacuccauucugccucacuuccuugaccu

SEQ ID NO: 108417 - RNA, 64 nt, hsa
gggagccugagccccuucagcuuugaggggggugauacuccaggcuguuuggggugggagccaa

SEQ ID NO: 108418 - RNA, 64 nt, hsa
uucugacuuccauccccaaaacacauuuaccagcauacuccaaacuguuucugauguguuccau

SEQ ID NO: 108419 - RNA, 64 nt, hsa
aagcucuuuucuccugcagaaagggccacccaugauacuccacucccagcagcucaaccuaccc

SEQ ID NO: 108420 - RNA, 64 nt, hsa
acaaagguccccuggcccuucaucugggaaucauauacuccacucuagcucccagaaucuacag

SEQ ID NO: 108421 - RNA, 52 nt, hsa
gacuguucaaaaaaucuugagcauacuccagcaagauauguuuuugguagca

SEQ ID NO: 108422 - RNA, 64 nt, hsa
gcaaauaacugagccaaccagaauaaaauaaccaauacuccacugcucauauuuuuaucuaauu

SEQ ID NO: 108423 - RNA, 64 nt, hsa
ggaccugcguugccgucuaugcaaaugcaugcaaauacuccaggcccugggaugugggcuugug

SEQ ID NO: 108424 - RNA, 64 nt, hsa
gaaaacggugacaagguuaacauaaggacaacaaauacuccacccugucaugguaugugaggug

SEQ ID NO: 108425 - RNA, 64 nt, hsa
auccuauaacucacucagagacacaugguaacacauacuccagauugaccuuauaaauaaaaga

SEQ ID NO: 108426 - RNA, 64 nt, hsa
auguuuacucaguuuagugucuuguauuucuauaauacuccaacaggaaugguagucacacugu

SEQ ID NO: 108427 - RNA, 64 nt, hsa
ccagggaggcgucccucccuaggagccacacauuauacuccaagucccugccgggcuccgccuu

SEQ ID NO: 108428 - RNA, 64 nt, hsa
gagacugcaggugccgcacauugucaaguuagaaauacuccagguggguguuagcacuguggug

SEQ ID NO: 108429 - RNA, 64 nt, hsa
cuuccuguaccuugacaugcaaaaggcucuccuaauacuccacauucaaacugaagaggaaaau

SEQ ID NO: 108430 - RNA, 64 nt, hsa
ccguucucuggaaauggcaucagauuuaaggauaauacuccaucauagaaauaagccuuaauaa

SEQ ID NO: 108431 - RNA, 64 nt, hsa
uaauggcaaugguagucuuugguuagcugcaaaaauacuccauuucaaguuaaaaaugcaucuu

SEQ ID NO: 108432 - RNA, 64 nt, hsa
acaguuggaaaauauaauugcucuuugauagcauauacuccaauuuuuccauaguccuaacuac

SEQ ID NO: 108433 - RNA, 64 nt, hsa
ggcuuaauagugcauuuauuuuuagcacugaauaauacuccauugucuagaugaauaguuuauc

SEQ ID NO: 108434 - RNA, 64 nt, hsa
uuuucgaaccuauuugguuuacccugcaagcuaaauacuccacggcagagcuuaauuauccuuu

SEQ ID NO: 108435 - RNA, 64 nt, hsa
augcaaacauaacaaaaucacuuccauagugacgauacuccaaccauauggauauuagucauag

SEQ ID NO: 108436 - RNA, 64 nt, hsa
gcagcccuuuggguacuacugcugcaaagugcaaauacuccaagcuucaagugauauauguauu

SEQ ID NO: 108437 - RNA, 64 nt, hsa
uuguaaaaagaaauugugaaaaaugagcuuguaaauacuccauuauuuuauuuuauagucucaa

SEQ ID NO: 108438 - RNA, 64 nt, hsa
gaaaugaauuagaaagaaaccauaagccuuaacaauacuccaaucacaguuaaauuaauuuaga

SEQ ID NO: 108439 - RNA, 64 nt, hsa
ccuguaaauuauuauagacaauagauugcaugucauacuccauuugguucaacacaacaaccua

SEQ ID NO: 108440 - RNA, 64 nt, hsa
uugugaacagaccggagaggacaguggauuguuuauacuccaguguacauaguguaauguagcg

SEQ ID NO: 108441 - RNA, 64 nt, hsa
ccuugagaugaggucugugccugauguacaacggauacuccauaaauguuugacaaaccaacga

SEQ ID NO: 108442 - RNA, 64 nt, hsa
ugcaauguuuguuuuuauuuuuggcuuuaugucuauacuccacagagagcuuuuuaaguaauga

SEQ ID NO: 108443 - RNA, 64 nt, hsa
gugguugggaaaaauaaaaauacagugguguggaauacuccaaaaccuagaaaugcuguaggaa

SEQ ID NO: 108444 - RNA, 64 nt, hsa
uagaaccaaacccaauaugcauaaaagaaauacaauacuccaggcuuuagcugaaggaagcaac

SEQ ID NO: 108445 - RNA, 64 nt, hsa
cacgucacuguacuccagccugggugacagagugauacuccaucucaaaaaaaaaaaaaaaaaa

SEQ ID NO: 108446 - RNA, 64 nt, hsa
auaauuuauauccaaaauuuguguuuuaaauuucauacuccagaacuuucauguuuaugaguau

SEQ ID NO: 108447 - RNA, 64 nt, hsa
agaaauguaaaagaugugacaaaaccuuuaagccauacuccaggcuucuuaaacauaaugagaa

SEQ ID NO: 108448 - RNA, 64 nt, hsa
ucaauuaguauuaaacuucacuaaaaaguaaaccauacuccaaauuguauauuggauugcauuu

SEQ ID NO: 108449 - RNA, 64 nt, hsa
aggaaucugaugcuccuuugcugcccccaagaguauacuccaccgagaaccaccagccacacca

SEQ ID NO: 108450 - RNA, 64 nt, hsa
uuuaauuuacugugacuagauuugaagcaaauaaauacuccagauccaugcagcuagaacacac

SEQ ID NO: 108451 - RNA, 64 nt, hsa
guacuuguaaauagcacuaguuagacucuuuagaauacuccaagaguuagggcagcagagugga

SEQ ID NO: 108452 - RNA, 64 nt, hsa
auaaauaagacuuaguuaaggauaguuaacuauuauacuccaacaauucaugagcaacaguaua

SEQ ID NO: 108453 - RNA, 64 nt, hsa
acugccacaaaaaaagaugaaauguaauuucuaaauacuccaggugugugguauuauggaaagc

SEQ ID NO: 108454 - RNA, 64 nt, hsa
caaauuuucuauagaaucaagauagaaccuuuagauacuccaacucaccaaaauguaaaaaaac

SEQ ID NO: 108455 - RNA, 64 nt, hsa
cuccucuuuccgcucccccaucucggcccugcccauacuccaagggucagcucccaucucuccu

SEQ ID NO: 108456 - RNA, 64 nt, hsa
uaaugauauuuaaagcaauaauuuuuuguaugucauacuccacaauuuacauguauauuacagc

SEQ ID NO: 108457 - RNA, 64 nt, hsa
gccagucugugaagacaacugccagauacuggcaauacuccagccuggugacagagugagacuc

SEQ ID NO: 108458 - RNA, 64 nt, hsa
uagacucaaggaagaauaauuuuaacagacauguauacuccauagaaacuaaacuaaaauaguu

SEQ ID NO: 108459 - RNA, 64 nt, hsa
ccaugugcccuuuuuagggaagcuguuggagaaaauacuccagcaaaaugaaggaguacacaaa

SEQ ID NO: 108460 - RNA, 64 nt, hsa
ggaaagggcucagccugugauaggcauucaauaaauacuccaaugcugucauuccuuugucuac

SEQ ID NO: 108461 - RNA, 64 nt, hsa
agcugggucugaccguuguaugguuugaccugauauacuccauucuccccugcgccuccuccuc

SEQ ID NO: 108462 - RNA, 64 nt, hsa
aaauguaaaggacucaaaguuuaaguaaaaagugauacuccaccuuguguuucaaagaauuuag

SEQ ID NO: 108463 - RNA, 64 nt, hsa
aaggcccauaagacaagugauuauuaugauucccauacuccagauacaaaccauaucccagcca

SEQ ID NO: 108464 - RNA, 52 nt, hsa
gcuguggcaaggacagcuaguuauacuccauucuuuggucgucguccucggu

SEQ ID NO: 108465 - RNA, 64 nt, hsa
auguuuuuacaagaugaaauaauagauaaaagcuauacuccaucuaaaauaagacaugccugaa

SEQ ID NO: 108466 - RNA, 64 nt, hsa
gccguguggguuagucgggugccaggacaaugaaauacuccagcaccuguggcugacgaauuug

SEQ ID NO: 108467 - RNA, 64 nt, hsa
auguauauguauauauauauaguaacuacuuuuuauacuccauacauaacuugauauagaaagc

SEQ ID NO: 108468 - RNA, 64 nt, hsa
ucuugcuugauugaaaacgacaucaucccuugguauacuccagggauugguuucaggaccccug

SEQ ID NO: 108469 - RNA, 64 nt, hsa
gacuuauuucuuuaguucugcacuuuuccacauuauacuccauaugaguauuaauccuauggau

SEQ ID NO: 108470 - RNA, 64 nt, hsa
ucacagccagugaacaaucaccaugcucauucacauacuccaguggaaaguaaguuugguguag

SEQ ID NO: 108471 - RNA, 64 nt, hsa
uguuacacccuccacugaacccucaaccuucgaaauacuccaguuuuguggguuuggucauuuu

SEQ ID NO: 108472 - RNA, 64 nt, hsa
gaacuggaaauuauacaaaaguaaauugggaaggauacuccagcaucugacacuggcaaaaugg

SEQ ID NO: 108473 - RNA, 64 nt, hsa
uguacacaauuacuguaaggcuaauucacgugccauacuccaccugaaagccugaguuaucuug

SEQ ID NO: 108474 - RNA, 64 nt, hsa
gacuacagcuguuaucuuuccucuccuacaaagaauacuccacacauaaaaacuuagguaaaug

SEQ ID NO: 108475 - RNA, 64 nt, hsa
ggcagagauugcacugagccgagaucgcgccacuauacuccagccugggcaacagacauccugu

SEQ ID NO: 108476 - RNA, 64 nt, hsa
ugugcuaacccauucauaguuggcaguuaaacacauacuccaaaagacugcuacuaucuacuau

SEQ ID NO: 108477 - RNA, 52 nt, hsa
aaucucugugcucaugcugaagauacuccagcgccuuccuggagauagcugg

SEQ ID NO: 108478 - RNA, 64 nt, hsa
gcuuugggugaucuugaaaaucaaauacuauccuauacuccagcugcuuaacuucauuuuauuc

SEQ ID NO: 108479 - RNA, 64 nt, hsa
aaacauuccuguugaugggaaaagcccccaguuaauacuccagagacagggaaaggucagcccg

SEQ ID NO: 108480 - RNA, 64 nt, hsa
uauaucagcucuaaagcagagauguauuauggugauacuccaagguggcauagccauucauuua

SEQ ID NO: 108481 - RNA, 64 nt, hsa
uuuauuccugaagcuuaccagauaugaauggcuaauacuccauuguucugcuuguuguaauggu

SEQ ID NO: 108482 - RNA, 64 nt, hsa
gaacuccuuggaugaaaguccacuggggccagcaauacuccagagcccaguuucugcuggaucc

SEQ ID NO: 108483 - RNA, 64 nt, hsa
ucuuguggaugagcucuaaguacaugcccaguggauacuccaugugacaugguuucucccuaug

SEQ ID NO: 108484 - RNA, 64 nt, hsa
agcucagugguguggggaaacguuccccuggaucauacuccagaauucugcucucagcaauugc

SEQ ID NO: 108485 - RNA, 64 nt, hsa
ugauugcugagggugcaucaauuacaagcauugaauacuccauccccuucccucccagugaaug

SEQ ID NO: 108486 - RNA, 64 nt, hsa
ugacagcuuuguauuuggugaaaugguuuuaauuauacuccauguguauuuugcccacuuuuuu

SEQ ID NO: 108487 - RNA, 64 nt, hsa
ggaaagagcacgaggauguucucagcucuggccaauacuccauuucauaaaccauguuacauuu

SEQ ID NO: 108488 - RNA, 64 nt, hsa
uucugucagucuguaagcuuugauaaccugcuuaauacuccaaagugugaguuccucugaucuc

SEQ ID NO: 108489 - RNA, 64 nt, hsa
gugaaauuuucagaauguuguuuuuuucauguagauacuccaggaagaguuaagcacugcuuuc

SEQ ID NO: 108490 - RNA, 64 nt, hsa
uguuaccaaauaauggcuaauguuacaaaaaguuauacuccagagacccaaagcuugacauuua

SEQ ID NO: 108491 - RNA, 64 nt, hsa
uccucuauuauuuucacuauucauuuagguuuuuauacuccaccuccuuucaaaaaagauuuaa

SEQ ID NO: 108492 - RNA, 64 nt, hsa
uauuuuuagcaaugccuauugcaagugcaauuauauacuccagggaaauucaccacacugaauc

SEQ ID NO: 108493 - RNA, 64 nt, hsa
cacucacagaggcaaguguuguagacuaacaaagauacuccaaaauacaauggcuuaaagaaug

SEQ ID NO: 108494 - RNA, 64 nt, hsa
uuccuaccucuuauuucucauugagccucaggcuauacuccagcuggccaaggcuggaaaccug

SEQ ID NO: 108495 - RNA, 64 nt, hsa
ugggguugggggggaggugagguaccagccuuggauacuccaugggguggggguggaaaaacag

SEQ ID NO: 108496 - RNA, 64 nt, hsa
aagauuugucaaaacucaguguuuucuccaucagauacuccaugaaaggucacaauuucucuug

SEQ ID NO: 108497 - RNA, 64 nt, hsa
uggugagggccagauguuauucccuuucuuaaagauacuccaagccacaugccacuaaccacaa

SEQ ID NO: 108498 - RNA, 64 nt, hsa
aaauaagagaccucuaagagauccccauggcugaauacuccaaauaauccuaugucacaauaua

SEQ ID NO: 108499 - RNA, 64 nt, hsa
uugauccccagaagaaccauuuuaacuccaucugauacuccauugccuaugaaauguaaaaugu

SEQ ID NO: 108500 - RNA, 64 nt, hsa
ugcuuuaaacuguaguaguuggucuagaaacaaaauacuccaagaaaaagaaaauuuucaaaua

SEQ ID NO: 108501 - RNA, 64 nt, hsa
uaugauuugaagacagacuauaugucauuuuauuauacuccaucaaucuauaauauauuagacu

SEQ ID NO: 108502 - RNA, 64 nt, hsa
gaagaaaaagcgccagugaagaaaucuauacgagauacuccagccaaaaaugcacaaaagucaa

SEQ ID NO: 108503 - RNA, 64 nt, hsa
aacacauagugguaauuggagguuacuguuaugaauacuccaucugacuacgacuaagagagug

SEQ ID NO: 108504 - RNA, 64 nt, hsa
uuuacugccacuguggaaacagguucuagauuucauacuccaucuaaagucauuuuucaguuac

SEQ ID NO: 108505 - RNA, 64 nt, hsa
uacuuucuuuuucuauuggaaaugguuacaaguuauacuccaaaagauauuugaauuaucuuga

SEQ ID NO: 108506 - RNA, 64 nt, hsa
aucagucuguauguacuaucuggaaagauaacacauacuccagccaccucaccugauuggcuau

SEQ ID NO: 108507 - RNA, 64 nt, hsa
guauuugugguaucaguuuggaaaaaaaaaucugauacuccauuugauuauuguaaauauuuga

SEQ ID NO: 108508 - RNA, 64 nt, hsa
acaaauguacauacacucaggaagguaguacaagauacuccauacaacacaaccaugugcuauu

SEQ ID NO: 108509 - RNA, 64 nt, hsa
acaaaucugauguuaauguuugcucuuagaagucauacuccauggucuucaaagaccaaaaaau

SEQ ID NO: 108510 - RNA, 64 nt, hsa
caguauuuugcuuuuaugcugcuuuuucuuuuugauacuccagguuuauaaacuaucuuuuaaa

SEQ ID NO: 108511 - RNA, 64 nt, hsa
ccucccggggacuguucugggauugaaauugugcauacuccaaacuuucgcagccaucuucccg

SEQ ID NO: 108512 - RNA, 64 nt, hsa
agaagcagccagaaggagacuuaaacauggaaagauacuccacugaugaguuuagaagugauua

SEQ ID NO: 108513 - RNA, 64 nt, hsa
gaaugccauacacuacugucucuucagaucugaaauacuccaguuuagagccaggaaauuucac

SEQ ID NO: 108514 - RNA, 64 nt, hsa
ucuaacaguguauuuguguaaaguuugucauuucauacuccauacacuacaguugcugucacug

SEQ ID NO: 108515 - RNA, 64 nt, hsa
acagaaacugaucucaaaugacaggaaaaugaauauacuccauugaaaggaaaaauaaggaaau

SEQ ID NO: 108516 - RNA, 64 nt, hsa
gaacuuacagaauuuacuuugcagaagcguuaucauacuccauuuacaucuguguuacacguga

SEQ ID NO: 108517 - RNA, 64 nt, hsa
aggggauggggacaugaugcccagagccaccccuauacuccagucucccuggcaucagcuacug

SEQ ID NO: 108518 - RNA, 64 nt, hsa
uuucuuucauuagcuaggaucuacuagaugcauuauacuccauaccugcuuuucccauggccgc

SEQ ID NO: 108519 - RNA, 64 nt, hsa
cucacaaugcaggauccucuuugcugacucaggaauacuccauauuuuagacuacugccucuac

SEQ ID NO: 108520 - RNA, 64 nt, hsa
auauugugccauaugacaacaaagucuuuccuaaauacuccaucuguuuaguacuguauugugg

SEQ ID NO: 108521 - RNA, 64 nt, hsa
uuugccuuggaaguugcauggcaucaccuccaccauacuccaucaguuagagcugacacaaacc

SEQ ID NO: 108522 - RNA, 64 nt, hsa
ccuuaaaccagaaugggaguuugaaagagagaucauacuccagcugaaguuuguugacccuuuu

SEQ ID NO: 108523 - RNA, 64 nt, hsa
auuuaggggcaaguaauaauggaaugcuacuaagauacuccauauucuuccccgaaucacacag

SEQ ID NO: 108524 - RNA, 64 nt, hsa
aauguauccauugccuuugaugauguucccagccauacuccagucaacggggacuacuaguccc

SEQ ID NO: 108525 - RNA, 64 nt, hsa
cuaagaaaagugguccauccugaauaaacauguaauacuccagcagggauaugaagccucugaa

SEQ ID NO: 108526 - RNA, 64 nt, hsa
cauuacuccuggucuugggaguugccuucugaggauacuccacuggggguaccugagccuggau

SEQ ID NO: 108527 - RNA, 64 nt, hsa
cagagcgagacuuaucucauaaauaaauagauagauacuccagccugggugacagagcgagacu

SEQ ID NO: 108528 - RNA, 64 nt, hsa
ccucucucgggagcccuagcccugcuccaacuccauacuccacuccaagugccccaccacuccc

SEQ ID NO: 108529 - RNA, 64 nt, hsa
auuaauguuuauuuagcucugaagcaagagugauauacuccaggacuuagaauagugccuaaag

SEQ ID NO: 108530 - RNA, 64 nt, hsa
caggggucuaauccaaaagaaaugucauuaaccaauacuccaaguccuugaguuuuguuauauc

SEQ ID NO: 108531 - RNA, 64 nt, hsa
auuggacccuugcuuugauaccauucuugggcacauacuccaagauuguauuagauuuuuguga

SEQ ID NO: 108532 - RNA, 64 nt, hsa
uuuuuuuaaaaaaaaaaaaaaaagcccacaucuuauacuccaaugaguguguuugugaguuuuu

SEQ ID NO: 108533 - RNA, 64 nt, hsa
uaauuugugggcagggguggaggaugcauguaugauacuccauaaauucaacauucuuuacuau

SEQ ID NO: 108534 - RNA, 64 nt, hsa
gacucacugcacagccgcuuccuagcagggagcuauacuccaacuccuacuugaguuccugcgg

SEQ ID NO: 108535 - RNA, 64 nt, hsa
gggccggccacaagacccaugucuccaucuggucauacuccauagcuaccaaguuaaccugcuc

SEQ ID NO: 108536 - RNA, 64 nt, hsa
gagcaggaccguggaucaccugcaacaagcucugauacuccaggggauacuuaagcccucauca

SEQ ID NO: 108537 - RNA, 64 nt, hsa
agcugagucagaauuaaaggagggaauuguauugauacuccaauaccuaaauuucacaauacca

SEQ ID NO: 108538 - RNA, 64 nt, hsa
uuuauaaaacuuccuaagagacuaucugaacucuauacuccagacaguuaggugggaguauaaa

SEQ ID NO: 108539 - RNA, 64 nt, hsa
gcacccccauuauauuaauuuucagggauaguaaauacuccaaaaugaaauugguauuguuuuc

SEQ ID NO: 108540 - RNA, 64 nt, hsa
uguauaauucaacaauuuuagauuaugguguaagauacuccaguaacuuaucuuucuguccuuu

SEQ ID NO: 108541 - RNA, 64 nt, hsa
uagucuauggaguuuucugauuucccuggaguaaauacuccaugguuauuuuaagcuaccuaca

SEQ ID NO: 108542 - RNA, 64 nt, hsa
auccccuucuuucccaugagagagagaacuggugauacuccaacaccguccaguuguggcagcu

SEQ ID NO: 108543 - RNA, 64 nt, hsa
uuuauauuguccuuuuuuacuggaagacguacgcauacuccaucgauguuguauuugcaguggc

SEQ ID NO: 108544 - RNA, 64 nt, hsa
ccuggggccucccaccccagccucccugaggcccauacuccacggagaggagccccaugcccag

SEQ ID NO: 108545 - RNA, 64 nt, hsa
gugagcgcauugagccaguggugcuaaaugcuacauacuccaacugaaauguuaaggaagaaga

SEQ ID NO: 108546 - RNA, 64 nt, hsa
gcccccuagccagccccgcacacacucaacucugauacuccagcccuguggcaccccagacccu

SEQ ID NO: 108547 - RNA, 64 nt, hsa
gugggagaauuagagaauuuauuugugucagaaaauacuccagaacaaccaccccauauuauga

SEQ ID NO: 108548 - RNA, 64 nt, hsa
uucugccaacauaguuuuauccugucucaguaggauacuccauaacacaauagcaguacaccac

SEQ ID NO: 108549 - RNA, 64 nt, hsa
cuagagggaaaguuaggaauaggccucccagaggauacuccagacaguugacaagcaucgcagc

SEQ ID NO: 108550 - RNA, 64 nt, hsa
uauuuucgggcaauuauguuuagcuuucaucauuauacuccaacagacccgucugaagggguau

SEQ ID NO: 108551 - RNA, 64 nt, hsa
gugcccccagaugccucuugauaggagaggcaacauacuccaaauaguuggguucuucagggaa

SEQ ID NO: 108552 - RNA, 64 nt, hsa
agagagcuacauuuuaaaggcugucuuggcaaaaauacuccauuugggaacucacugccuuaua

SEQ ID NO: 108553 - RNA, 64 nt, hsa
guagccagugacccguuaggagcucucaccguacauacuccagucuaauuuaaaucugaccaca

SEQ ID NO: 108554 - RNA, 64 nt, hsa
ugccggugucccuucuccccagaucccucauuugauacuccaaaaccaucaccauguaccaugu

SEQ ID NO: 108555 - RNA, 64 nt, hsa
guccgaauugcuuuuauuuucuuauacuuucaguauacuccauagaccaaagagcaaaaucuau

SEQ ID NO: 108556 - RNA, 64 nt, hsa
caacacuuauuagugacaguauugacaucugagcauacuccaguuuacuaauacagcaggguaa

SEQ ID NO: 108557 - RNA, 64 nt, hsa
uguguguuaaaaugauaacuaacaugugaauaaaauacuccauuugaaacucuucgguuauuug

SEQ ID NO: 108558 - RNA, 64 nt, hsa
ucaaaaugagauaugcaauaaauauuauuugaugauacuccaccagugaaaauugaugcuaagu

SEQ ID NO: 108559 - RNA, 64 nt, hsa
gcuauucguccuguaaucuguuucuaggugaagcauacuccaguguuuuagggguuuugaaaau

SEQ ID NO: 108560 - RNA, 64 nt, hsa
uggaagccgugguaugugaggaaccccaagugaaauacuccacguugcacacgcagucugcaga

SEQ ID NO: 108561 - RNA, 64 nt, hsa
aaauaagcuuucuuguaagcucucuuccuaacagggcacauauucuuccauaauauaaacacuu

SEQ ID NO: 108562 - RNA, 64 nt, hsa
aacccacuguuaccaguguaggaaguuacaagaaggcacauacugaaugcugaaguauacauau

SEQ ID NO: 108563 - RNA, 64 nt, hsa
aaacacugcauuaaaaaaguaucuguugcauuaaggcacauagugggauuacaucauaaaccuc

SEQ ID NO: 108564 - RNA, 64 nt, hsa
ucuacuaaaaauacaaaaauuagcugggcaugguggcacauaccuguaaucccagcuacucggg

SEQ ID NO: 108565 - RNA, 64 nt, hsa
uuucauucuuaaaaauaaaugaauuuucacuguuggcacauaugaggcuuaaauauaaggaaca

SEQ ID NO: 108566 - RNA, 64 nt, hsa
guccgucuaacugguacauugauaauuuaguuugggcacauaaaaggaauauuuauauggcuuc

SEQ ID NO: 108567 - RNA, 64 nt, hsa
gcagugcuaccacgguaauggacagaguuaucgaggcacauacuucaccacugucacaggaaga

SEQ ID NO: 108568 - RNA, 64 nt, hsa
ggagugcuaccauggaaauggacagaguuaucgaggcacauacuucaccaccgucacaggaagc

SEQ ID NO: 108569 - RNA, 64 nt, hsa
auuaaauguauguaagacacuuggcacaaaaccuggcacauaguaaaggcucaauaaaaacaag

SEQ ID NO: 108570 - RNA, 64 nt, hsa
auuagggagacucguaaggccaggcccugugcugggcacauagcugugaucacagcagacaggg

SEQ ID NO: 108571 - RNA, 59 nt, hsa
aaaaugaauaagcuaucaauauauaauuuaaguacaaguuuaggcugggcgugguggcu

SEQ ID NO: 108572 - RNA, 59 nt, hsa
aucucaaaaaaagaaagaaagaaaaaagaaaguacaaguuuauaaaguauuauagugaa

SEQ ID NO: 108573 - RNA, 59 nt, hsa
uucuuccucuuuaccucuuaaaacagcagaaguacaagaauacagcuguagggucauug

SEQ ID NO: 108574 - RNA, 59 nt, hsa
uuguuuuaaaucuauuuuguaaagauauaaaguacaauagaauuucuggaguacagauu

SEQ ID NO: 108575 - RNA, 59 nt, hsa
aacauucauuauuuuauuaauauugcccuaaguacaacuaggcaagugauugccaccua

SEQ ID NO: 108576 - RNA, 59 nt, hsa
ggaaaccagcagauaguaaaccugguucaaaguacaauucaagaaacugaguauuuaug

SEQ ID NO: 108577 - RNA, 59 nt, hsa
ccaacauggugaaacccugucucuacuaaaaguacaaaaauuagccaggcgugguggcg

SEQ ID NO: 108578 - RNA, 59 nt, hsa
gcuggaucugaaccaguguucuuuuguguaaguacaaccauauuucagucaguccagag

SEQ ID NO: 108579 - RNA, 59 nt, hsa
auuuaaauguuaacuguuguauugugacuaaguacaacuuuuggaaugauaccugaaga

SEQ ID NO: 108580 - RNA, 59 nt, hsa
cccaucauuuggaaaaauaaaggcaucugaaguacaauauuacuuauagaaauaguuua

SEQ ID NO: 108581 - RNA, 59 nt, hsa
cuucuucccauagaauuagaaacaugugaaaguacaauaaacuucuuguucaaauuacc

SEQ ID NO: 108582 - RNA, 59 nt, hsa
auugaaaauuuaaauaacaugguggcaugaaguacaauucgaguauuaggcaauuugca

SEQ ID NO: 108583 - RNA, 59 nt, hsa
aauucagccaaacauaaauaaccuuccuuaaguacaauuuaacuucaagaaaacaaaau

SEQ ID NO: 108584 - RNA, 59 nt, hsa
agaugaguauuuccaggacaacguucuaaaaguacaauuauuucuuauuggggagauua

SEQ ID NO: 108585 - RNA, 59 nt, hsa
gagauuacagguaguuuggcaaagcauugaaguacaaagguacauuuucaauuaaaaag

SEQ ID NO: 108586 - RNA, 64 nt, hsa
gugcggcucacaucacuguccaccaccaccuggagcggcucaucagaacugaaggggaguuuuc

SEQ ID NO: 108587 - RNA, 64 nt, hsa
gcucugcagcaauauucugauaauguauugcagugcggcucacaucacuguccaccaccaccug

SEQ ID NO: 108588 - RNA, 64 nt, hsa
cuggcccccuuguucagccccugccggcacacgggcggcucacccuggacacugugaugcgcau

SEQ ID NO: 108589 - RNA, 64 nt, hsa
caucaucccgcuggcccugugcccuggagggugggcggcucauggugccacagccccuggcagg

SEQ ID NO: 108590 - RNA, 57 nt, hsa
ugcagacagacaauaauucuggagauacugguggaaguuccaaguccaauaagacac

SEQ ID NO: 108591 - RNA, 57 nt, hsa
uugcucauuaauuuugaaaagauguaccugguggauaucuagcuaguaauauauucu

SEQ ID NO: 108592 - RNA, 57 nt, hsa
ugccaugaguaggagccccuaguggggcugguggacagcuuuggaagagguguccug

SEQ ID NO: 108593 - RNA, 57 nt, hsa
ugcgccugcugcccuuuccuggcagggcugguggagucuucccucaaagcaugccuu

SEQ ID NO: 108594 - RNA, 57 nt, hsa
augaccuaggacugaugcuguggggugcugguggagcagcugaugucguguuuacag

SEQ ID NO: 108595 - RNA, 57 nt, hsa
caugggggcuugcucauaccgccccuccugguggauguguguguuuauuauguggag

SEQ ID NO: 108596 - RNA, 57 nt, hsa
auguuaguuuugguaauuuuuuuucugcugguggauuuacauauuaaauuuuuucug

SEQ ID NO: 108597 - RNA, 57 nt, hsa
guggauuuacauauuaaauuuuuucugcugguggauaaacauuaaaauuaaucaugu

SEQ ID NO: 108598 - RNA, 57 nt, hsa
uggugcuccaagggucgcugccgcucccugguggagcugacccccauagcagcagug

SEQ ID NO: 108599 - RNA, 57 nt, hsa
ugucagagcccagcucaugcacaucagcugguggagcaggccuggccuuggagaacg

SEQ ID NO: 108600 - RNA, 57 nt, hsa
agcgaguaaugucaacuucgggagggucugguggacuuucuccccacuccccaaguc

SEQ ID NO: 108601 - RNA, 57 nt, hsa
ugacuuuucuucuuacaugcugaaucacugguggaaacguuaggauaagcaagaauu

SEQ ID NO: 108602 - RNA, 57 nt, hsa
aaaauuccaguuauuaacacacucaaacugguggagcuuguucacccuaggaagggg

SEQ ID NO: 108603 - RNA, 57 nt, hsa
gguggccaccugggucccagcacuuggcugguggagagauuuuuuucauuauggagc

SEQ ID NO: 108604 - RNA, 57 nt, hsa
ucagcaaaaauaaguagcuaccuacuacugguggauucuuuuccuuauagugaauuu

SEQ ID NO: 108605 - RNA, 57 nt, hsa
agggacaggaggaaaaugaaaccuguucugguggaaaugaaaaccaagagcuacaag

SEQ ID NO: 108606 - RNA, 57 nt, hsa
ugauaccccucuuggugggcagcugcucugguggaguugggaagggauaggaccugg

SEQ ID NO: 108607 - RNA, 57 nt, hsa
cagggagccuuccuggucccaggaccucugguggagggccauggcguggaccuucac

SEQ ID NO: 108608 - RNA, 57 nt, hsa
uaacaggcuccugcccccaagacugcucugguggaaaauccagccugggagccccug

SEQ ID NO: 108609 - RNA, 57 nt, hsa
ugguugacgucugcuguggguuuccuccugguggagugccugucugugucacacacu

SEQ ID NO: 108610 - RNA, 57 nt, hsa
gagagggauggcucacgaggcuuggaccugguggagggugcccggcagacgugugag

SEQ ID NO: 108611 - RNA, 57 nt, hsa
gagaggaacggcucacgagacuuggaccugguggagggugcccagcagacguggugu

SEQ ID NO: 108612 - RNA, 57 nt, hsa
uaaccccugcucggggccccacggaugcugguggacugugugccccugguggaggug

SEQ ID NO: 108613 - RNA, 57 nt, hsa
ugcaggaugcugguggacugugugccccugguggagguggacgacaugaugaucaug

SEQ ID NO: 108614 - RNA, 57 nt, hsa
ggcuuccagcuaccccugacuuagagccugguggaggugugguucuucagaagucag

SEQ ID NO: 108615 - RNA, 57 nt, hsa
uaaucccagcacuuugggaggccgaggcugguggaucacgaggucaagaguucaaga

SEQ ID NO: 108616 - RNA, 64 nt, hsa
caacgucuagcggccccgcgggacuggggacugagcccaggagguuugcacaagccgggcgauu

SEQ ID NO: 108617 - RNA, 64 nt, hsa
guuggggaacagauggcugaggcugcagacucaggcccaggacacucaaccccaggaggggagc

SEQ ID NO: 108618 - RNA, 64 nt, hsa
gaggggagccgcucggcgaaugagcugggugggugcccaggagccggcccgcagcaccugcaca

SEQ ID NO: 108619 - RNA, 64 nt, hsa
cugcuugggaggcugagguugcaggaucacuugagcccaggaggucaaggcugcagugagccaa

SEQ ID NO: 108620 - RNA, 64 nt, hsa
cacuuuggaaggcugaggcagaaggaucacuugagcccaggaauuugagguuguaguaagcuac

SEQ ID NO: 108621 - RNA, 64 nt, hsa
cuaugcagaugucuaagacaggaggaucacaagagcccaggagguugagaaugcagugagcuug

SEQ ID NO: 108622 - RNA, 64 nt, hsa
acuuugggaggcugaaguaggaggaucgucuugagcccaggaguucaagaccagccuggacaac

SEQ ID NO: 108623 - RNA, 64 nt, hsa
cuuuccacaggccauccucuuauuccguucuggggcccaggaaguggggaagaguagguucucg

SEQ ID NO: 108624 - RNA, 61 nt, hsa
ucaccaacggcaucaugugacacgcuccucagcccaggaguggugggggguccagggcacc

SEQ ID NO: 108625 - RNA, 64 nt, hsa
ggggaagugaacuacccagggcagccccuuuguggcccaggauaaucaacacuguucucucugu

SEQ ID NO: 108626 - RNA, 64 nt, hsa
agacgugagaugaacacuggagugggcagagguggcccaggaccauggcacccuuagagugcag

SEQ ID NO: 108627 - RNA, 64 nt, hsa
cucucugaguucugugcugucucuuggaggcagggcccaggagaacaaaguguggaggccucgg

SEQ ID NO: 108628 - RNA, 64 nt, hsa
uccccuacuccaccuccuuccaaguccagcucaggcccaggaggugggagaaggucacagagcc

SEQ ID NO: 108629 - RNA, 64 nt, hsa
gagggggugcuggccaagagccaacacauucuuggcccaggagcauugcuuuucugugaauuca

SEQ ID NO: 108630 - RNA, 64 nt, hsa
ccuuucugccuuggccucggcgggcuuuucuggggcccaggaagcccacacuaugcacagagcc

SEQ ID NO: 108631 - RNA, 64 nt, hsa
ucccaagucagacagaugucagcuucccagccaugcccaggacguccuaucucccccaacccac

SEQ ID NO: 108632 - RNA, 64 nt, hsa
cccagcacuuagggugccaauguggauuaccugagcccaggaguuugagaccagccuggguaac

SEQ ID NO: 108633 - RNA, 64 nt, hsa
acaaaaucuaggcagugaacaagucuucauccuggcccaggaaauagccuauuaaaaaaugcug

SEQ ID NO: 108634 - RNA, 64 nt, hsa
agggggaggaugacaagccgcugcccaccuccaagcccaggaaacaguacaagauggcuaagga

SEQ ID NO: 108635 - RNA, 64 nt, hsa
ggaaaacuggguuuaucucaaggcagcagccugagcccaggagcagaggacccaguuguuauaa

SEQ ID NO: 108636 - RNA, 64 nt, hsa
acagggaagcaugugacacccacaaucccaccuagcccaggagagagcuacggcagggugugug

SEQ ID NO: 108637 - RNA, 64 nt, hsa
aggagaauuacuugaacgcaggagaaucacugcagcccaggaggcagagguugcagugagccga

SEQ ID NO: 108638 - RNA, 64 nt, hsa
uuaauaugaaauuuuuuuucaugcuuuaucaauagcccaggauauauuuuauuuuuagaauuuu

SEQ ID NO: 108639 - RNA, 64 nt, hsa
uaagagacaauuucugcagguggcaggugagcaagcccaggagaaugcugcaaucuugggggug

SEQ ID NO: 108640 - RNA, 64 nt, hsa
uuacucaggaggcugaggcaggaggaucacuugagcccaggagguugaggcuggagugagccau

SEQ ID NO: 108641 - RNA, 64 nt, hsa
gcacuuugggaggcugaugugggcggauaguugagcccaggaguucgagaccagccugggcaac

SEQ ID NO: 108642 - RNA, 64 nt, hsa
cuacucaggaggcugaggugggaaaaucacuugagcccaggaggucgaggcugcagugugcugu

SEQ ID NO: 108643 - RNA, 64 nt, hsa
cacuaugggaggcugaggcaagcagguuguuugagcccaggaauuugagaacaggauuuugaga

SEQ ID NO: 108644 - RNA, 64 nt, hsa
ggccgccacugcaguucugcuaggucugcuuccugcccaggaaggugccugcacaugagaggag

SEQ ID NO: 108645 - RNA, 64 nt, hsa
aggcauccuggugccugcauaccucuggcagcuggcccaggaagagccagcaagagcaaggcau

SEQ ID NO: 108646 - RNA, 64 nt, hsa
cguucuuauaccacguuccacggaggagugaggagcccaggaacgacguggucuuccagcccau

SEQ ID NO: 108647 - RNA, 64 nt, hsa
gaagugccaagauuggcuuggcaucugcacuccagcccaggacuguggucugccauugcaaugc

SEQ ID NO: 108648 - RNA, 64 nt, hsa
ugaaggcuggcacgugcagcguccuuggcaguuggcccaggaacuggagccacagagcuggugc

SEQ ID NO: 108649 - RNA, 64 nt, hsa
uauuuugggaggccgaggagagaggaucacuuaagcccaggagucugagaccagccugggcaac

SEQ ID NO: 108650 - RNA, 64 nt, hsa
cuacaugggaggcugaggugggaggaucacuugagcccaggaaguccagaacguagugagccuu

SEQ ID NO: 108651 - RNA, 64 nt, hsa
cuggaagggcccucgaaugccauucacaggaacagcccaggaacccagggacuucagaagggcu

SEQ ID NO: 108652 - RNA, 64 nt, hsa
uaaucccagcucuggaagcugaaggauagcuugagcccaggaguucgaggcugcagugagcuau

SEQ ID NO: 108653 - RNA, 64 nt, hsa
cuacugaggaggcugaggugggaggauugcuugagcccaggaggcagagguugcagugagccaa

SEQ ID NO: 108654 - RNA, 64 nt, hsa
cacuuugggaggcugagguggguagauuacuugagcccaggaauucaagaccagccugggcaac

SEQ ID NO: 108655 - RNA, 64 nt, hsa
cuucucaggaggcuggggugggaagaucacuugagcccaggaggucgaggcugcagugagccau

SEQ ID NO: 108656 - RNA, 64 nt, hsa
cacuuugggaggcugagucgggaggauagcgugagcccaggaguuugagaccagcuaaggcaau

SEQ ID NO: 108657 - RNA, 64 nt, hsa
uuggguucguaccagcaaguagacuaggaacugagcccaggaaagggggauguuuuccuggugu

SEQ ID NO: 108658 - RNA, 64 nt, hsa
cucacugcccaagucauggcaacaggcuggagcagcccaggagaugggccuaaaauguucugga

SEQ ID NO: 108659 - RNA, 64 nt, hsa
ccccucccucgucccacccccacccaggcaggaagcccaggaggagugcgggcagggccugacc

SEQ ID NO: 108660 - RNA, 64 nt, hsa
cugaaggggucccccauuguuuugcuuccccagcgcccaggaugagcgguuuaccaucgagcuu

SEQ ID NO: 108661 - RNA, 64 nt, hsa
caagagaagggcccaggaaggaugcucucauaaggcccaggaaggaugcucucauaagcaccuu

SEQ ID NO: 108662 - RNA, 64 nt, hsa
ucugccauccacggccuuuucuggcaagagaagggcccaggaaggaugcucucauaaggcccag

SEQ ID NO: 108663 - RNA, 64 nt, hsa
acacaaaacaaacagugauuguacagcaggcugggcccaggaggucagguucauuuuguuacau

SEQ ID NO: 108664 - RNA, 64 nt, hsa
aaaggagaaggaauuggagcagcuuuuccuggaggcccaggauauuucuuuucuggguaucuug

SEQ ID NO: 108665 - RNA, 64 nt, hsa
ucccagcugcucugauaagaggaggcucacuugagcccaggagguugaggcugcagugagcaga

SEQ ID NO: 108666 - RNA, 64 nt, hsa
cugcucagguggcuaggguggauggaucgcuugagcccaggagguggagguugcagugagcuga

SEQ ID NO: 108667 - RNA, 64 nt, hsa
gaucuugggaggucgaggcaagcugaucgcuugagcccaggaguuuaagaccggccugaguagc

SEQ ID NO: 108668 - RNA, 64 nt, hsa
cuacugggggugcugaggugggaggaucgcuugagcccaggagagugaggcugcagugagcuga

SEQ ID NO: 108669 - RNA, 64 nt, hsa
caauagcuaggaaucauguucaauauugaauucugcccaggagcaugaacugauccaugaaugc

SEQ ID NO: 108670 - RNA, 64 nt, hsa
guggcugagguggaagaauggaagaaucacuugagcccaggaguuugaggcugcagugagcuau

SEQ ID NO: 108671 - RNA, 64 nt, hsa
cagcuccccaccugcccugcacucugcccucuuugcccaggauacugaggagggcuggagcucg

SEQ ID NO: 108672 - RNA, 64 nt, hsa
agcuugggccacugccugggacccagcagacacugcccaggacucuuuagugcacucacucuug

SEQ ID NO: 108673 - RNA, 64 nt, hsa
uccagauaaauaaccauacacugaccucauacuugcccaggacccauuaaaguugcgguauuua

SEQ ID NO: 108674 - RNA, 64 nt, hsa
agacuccuguugggacacaguuggucugcagucggcccaggacggucuacucagcacaacugac

SEQ ID NO: 108675 - RNA, 64 nt, hsa
ccacucaggaggcugaggcaggaggauugcuugagcccaggaguucgaggcugcagucagucau

SEQ ID NO: 108676 - RNA, 64 nt, hsa
gaagcccaagugaaaucaaaggugcuaaauggucgcccaggagacauccguugugcuugccugc

SEQ ID NO: 108677 - RNA, 64 nt, hsa
ugggcuacucuggaggcccuugaggaucacuugagcccaggagauugaggcugcagugagccau

SEQ ID NO: 108678 - RNA, 64 nt, hsa
uaaucccagcacuuugaggugggcaauggcuugagcccaggaguucgacaccagccuggccaac

SEQ ID NO: 108679 - RNA, 64 nt, hsa
ggucacuguccuguaaugucucccggucagggcagcccaggacugcccagccuggugggcuggg

SEQ ID NO: 108680 - RNA, 64 nt, hsa
caaauccauagaaagacaaacggccaccuugggugcccaggauacuggugccuggccccacgua

SEQ ID NO: 108681 - RNA, 64 nt, hsa
cacuuuaggaggcugaggcaggaggacuguuugagcccaggaguuugagaccaaccugaguaag

SEQ ID NO: 108682 - RNA, 64 nt, hsa
cuacuuggggugcugaggcgggaggauuacuugagcccaggaggauuacuucaaccugggaggu

SEQ ID NO: 108683 - RNA, 64 nt, hsa
gcacuuuggaggccaaggcaggaggacugcuugagcccaggaguuugagaccagccugggcaau

SEQ ID NO: 108684 - RNA, 64 nt, hsa
cacuuugggaggccgaggcaggaagacugcuugagcccaggaguucaagaccagccugggcaac

SEQ ID NO: 108685 - RNA, 64 nt, hsa
cuacucaggagguugaggugggaagauugcuugagcccaggaguuugagguugcagugagcuga

SEQ ID NO: 108686 - RNA, 64 nt, hsa
ugcuuugggaggccauagcaggaggauugcuugagcccaggaguucgagaccagccagagcaac

SEQ ID NO: 108687 - RNA, 64 nt, hsa
cuacuugggagguugaggugggaggauugcuugagcccaggauuucaaggcugcagugagccau

SEQ ID NO: 108688 - RNA, 64 nt, hsa
cugcagcugcuagcucagacaccaaagggguaaggcccaggacauucauaucuuuaaaagcugc

SEQ ID NO: 108689 - RNA, 64 nt, hsa
gaccugaaccagagcuggagugaggaucaaacaggcccaggagccugaggaaauacccagucag

SEQ ID NO: 108690 - RNA, 64 nt, hsa
cugccccggcugugccagggugagggagggccaagcccaggaggauuugucugagacauuucca

SEQ ID NO: 108691 - RNA, 64 nt, hsa
uccgggaucccagaacucuggucuccaaauuacagcccaggacaccuuucucugccgccugcug

SEQ ID NO: 108692 - RNA, 64 nt, hsa
ggagucuuuuuuuccucugcccugaucaacuggggcccaggaaaagcaaugucucuucacgggc

SEQ ID NO: 108693 - RNA, 64 nt, hsa
ccagggcugcaggcaaagcuggacaugugcccuggcccaggaggccauguugggcccucguuuc

SEQ ID NO: 108694 - RNA, 64 nt, hsa
gcaaguacagccacuguaaauaacccucgucccugcccaggaacccagacuggacuucagucuc

SEQ ID NO: 108695 - RNA, 64 nt, hsa
ccaagaaggucauuuccaaacccauccuggaagggcccaggauccaaaggucaucaguccugcu

SEQ ID NO: 108696 - RNA, 64 nt, hsa
cacgaugggaggccaagacaggcagaucacuugagcccaggaguuugaggccagccugggcaac

SEQ ID NO: 108697 - RNA, 64 nt, hsa
cuacucaggaggcaaagaugggaggauuacuugagcccaggaggucaaggcuacagugagccau

SEQ ID NO: 108698 - RNA, 64 nt, hsa
augcccagagugaccaagcagcaccagcaggccugcccaggaugcugaaagcagauuucuucuu

SEQ ID NO: 108699 - RNA, 64 nt, hsa
ucaauaagaaaauaggggugauggagggggagaagcccaggacugggagaaucgcacaugcccc

SEQ ID NO: 108700 - RNA, 64 nt, hsa
ccagcaggaggaagcccaggagcuggguccugccgcccaggagcugggcccugccacccaggcc

SEQ ID NO: 108701 - RNA, 64 nt, hsa
cacacuuccccaagggcggacccagcaggaggaagcccaggagcuggguccugccgcccaggag

SEQ ID NO: 108702 - RNA, 64 nt, hsa
cccugcugaugagcccacucuaggagccccaguagcccaggagcuugggugugcugacgagcag

SEQ ID NO: 108703 - RNA, 64 nt, hsa
cccaggacugagguccugagaaggggauagcacugcccaggacgugugucccuagccuggaaug

SEQ ID NO: 108704 - RNA, 64 nt, hsa
guccagcugcccucuacgaucaggugcaggggcugcccaggacaaagcgggggcaggggaaaga

SEQ ID NO: 108705 - RNA, 64 nt, hsa
cacuuugggaggcccaggcagaaggaucgcugcagcccaggaguucgagacuagccugggcaac

SEQ ID NO: 108706 - RNA, 64 nt, hsa
guacucaggaggccaaggcaggaggauugcuugagcccaggaguuugagaccagccugggcaac

SEQ ID NO: 108707 - RNA, 64 nt, hsa
augaaucaacugcuauccuuccccucaccccucagcccaggagggaaagggcauuuucuuuuuc

SEQ ID NO: 108708 - RNA, 64 nt, hsa
ucucagugcugacucacgggcaugcuucauugaggcccaggaagaggcccugguuuggggcugu

SEQ ID NO: 108709 - RNA, 64 nt, hsa
gcuacucaggaggcugaggcuagaggauccuugagcccaggagguugaggcugcagugaggugu

SEQ ID NO: 108710 - RNA, 64 nt, hsa
cacuuugggaggcugaggcaggaggaucacuugagcccaggaguucaagacuagccuaggcaac

SEQ ID NO: 108711 - RNA, 64 nt, hsa
gugccugagcuuagguuguggaguggcugagagggcccaggagggcucgggacagcugugugcu

SEQ ID NO: 108712 - RNA, 64 nt, hsa
ccccauuccucucuugcuacaaauaaggaaacaggcccaggagauuaagugacuuggcuaaagu

SEQ ID NO: 108713 - RNA, 64 nt, hsa
ggcagggacaccccugcagggucucgggcucugagcccaggacauucccugccccuuacucacc

SEQ ID NO: 108714 - RNA, 64 nt, hsa
caagggggccacuggcuaccccuacugcgcggcggcccaggagcucggacugcugguccuggag

SEQ ID NO: 108715 - RNA, 64 nt, hsa
aagaccacucccaccucaggaagcuaguauucaugcccaggaucggugaguucaggggauccau

SEQ ID NO: 108716 - RNA, 64 nt, hsa
aaccacucacaccccagggggaugagcucuccaagcccaggauucuggcaagagaggugaagaa

SEQ ID NO: 108717 - RNA, 64 nt, hsa
ccaagcaggugucggacugcucagaguccgcauggcccaggagcagguggucggaggccccugg

SEQ ID NO: 108718 - RNA, 64 nt, hsa
ggccagguggcgaaaggggcccagucguucuugggcccaggauggggccucuagacuugcaagg

SEQ ID NO: 108719 - RNA, 64 nt, hsa
guuggcccaggccccuggcagugcucccggaggggcccaggaaggccugggcagagacccugua

SEQ ID NO: 108720 - RNA, 64 nt, hsa
ggggcugggggcuggcaccgagaguucaaggagagcccaggagccagucucuggcuguggcucc

SEQ ID NO: 108721 - RNA, 64 nt, hsa
uuacaguuaugugauaaaggaaaaauucuuuccugcccaggaccugcgccauccuuuaggccga

SEQ ID NO: 108722 - RNA, 64 nt, hsa
acugaccgaccauugccauuucuggccucgcuaggcccaggagaggagggaggcaagccagucg

SEQ ID NO: 108723 - RNA, 64 nt, hsa
cagauguggccagagcaccggccucccagagaaagcccaggaaguccccgugguguccccuggc

SEQ ID NO: 108724 - RNA, 64 nt, hsa
uguggcucagccaucccggcuggguuugccaucagcccaggauacucaccgugucacagcugug

SEQ ID NO: 108725 - RNA, 64 nt, hsa
caucagauucaagcccaggaggcugaaaacgagggcccaggaccagaaucgcugccuccucucc

SEQ ID NO: 108726 - RNA, 64 nt, hsa
cauggccaccagccccagcugccaucagauucaagcccaggaggcugaaaacgagggcccagga

SEQ ID NO: 108727 - RNA, 64 nt, hsa
cacuuuaagaggccaaggcggauggaucacuugagcccaggaguucaacaccagccugagcaac

SEQ ID NO: 108728 - RNA, 64 nt, hsa
uaagcugccuggcauguggcacuuugucagggcagcccaggaaucugaaacaggaucaaacucu

SEQ ID NO: 108729 - RNA, 64 nt, hsa
ggcugcauucccuggagacucacugcaaguuccugcccaggaggcugagggcaccccauccuca

SEQ ID NO: 108730 - RNA, 64 nt, hsa
agggcucaagacaccacccccuccagcuucuggggcccaggagccucucccugcuacagggggu

SEQ ID NO: 108731 - RNA, 64 nt, hsa
cuaacugggaggcugaggcaggaggaucacuugagcccaggagauugaggcugcagugagcaug

SEQ ID NO: 108732 - RNA, 64 nt, hsa
cuccagcugcccacucaugggcccuucaccaccugcccaggaucucacccaguacugacagcuc

SEQ ID NO: 108733 - RNA, 64 nt, hsa
gagaugagggggucgacagguugaacgucuucaggcccaggaccccaagcuccucagccuggcc

SEQ ID NO: 108734 - RNA, 64 nt, hsa
gacacacacuccacgagagcagccccuccacucugcccaggagaggggccgacccuccucggga

SEQ ID NO: 108735 - RNA, 64 nt, hsa
ugauggcugugggaaucccccacuuccaagaugugcccaggaugugaggagcuggaguggaagc

SEQ ID NO: 108736 - RNA, 64 nt, hsa
uacgacacgcguccucgggcgccaccgggcgcucgcccaggacuccccgggccucgggcccggc

SEQ ID NO: 108737 - RNA, 64 nt, hsa
ggccgcccacggggggccacagcagcggccgcucgcccaggauggagaggcgggucccaggccc

SEQ ID NO: 108738 - RNA, 64 nt, hsa
gcgcggcccccggggauuccccccccccgagggugcccaggacucgacaagcuggacccccugc

SEQ ID NO: 108739 - RNA, 64 nt, hsa
ggugcggcccuggggacccccccuccccgagugugcccaggaacucagagagggcgcggccccc

SEQ ID NO: 108740 - RNA, 64 nt, hsa
ugagaagccaccgggaaagcagccagcacaaagggcccaggaagccagcccccgagagcugagc

SEQ ID NO: 108741 - RNA, 64 nt, hsa
uugacuuggcagcauggagccaaggucuguccccgcccaggagggugccuuccucggggguagg

SEQ ID NO: 108742 - RNA, 64 nt, hsa
cccccacuccauggggacagaagcuccagcauuugcccaggacccguccagaccucacccugug

SEQ ID NO: 108743 - RNA, 64 nt, hsa
cagccaugccuauccaaugacgucuccauaaaaggcccaggaacacgggagcuucugaagagcu

SEQ ID NO: 108744 - RNA, 64 nt, hsa
gcuuacugaggccaugagaaccugaggggcaucugcccaggacaggagccauggcauaugacaa

SEQ ID NO: 108745 - RNA, 64 nt, hsa
cucccugcugcagagagcacagcccuugccuggagcccaggaaccccauccuugcuucaucuca

SEQ ID NO: 108746 - RNA, 64 nt, hsa
ucuguuuggggaagaugcaaggaaguaaugagaagcccaggaaauuucuccaccuguguuuaug

SEQ ID NO: 108747 - RNA, 64 nt, hsa
auguggcaaggcuuggaugagauggggcaccagugcccaggaauuugaacauuuuccuuuaccc

SEQ ID NO: 108748 - RNA, 64 nt, hsa
cugaucagcuggauccccacgugagcaacagcuggcccaggaaaggcugccugcagaggacagg

SEQ ID NO: 108749 - RNA, 64 nt, hsa
cagaaacgacgguacccaggagaagggauuuugggcccaggagaaacacuuacauucuggugcc

SEQ ID NO: 108750 - RNA, 64 nt, hsa
ggaaaucgauuucacaauccaaaaauggcccacagcccaggaagcuacccugaacaugccaguu

SEQ ID NO: 108751 - RNA, 64 nt, hsa
gauuccacugcaaaaguggcugcuuuggaugccagcccaggaugaguaguuccuguucucaggg

SEQ ID NO: 108752 - RNA, 64 nt, hsa
caauuugggaggcagaggugagagaaucgcuugagcccaggaauucgagaccagccugggccac

SEQ ID NO: 108753 - RNA, 64 nt, hsa
uugggucauucauguccuacgcagcuaaaacagagcccaggagccagggaggaaaagcagucag

SEQ ID NO: 108754 - RNA, 64 nt, hsa
ucuuccccaucaggcugggcucuggcagggaccugcccaggauggagaugagagagggugagag

SEQ ID NO: 108755 - RNA, 64 nt, hsa
guggcucccuccuccccaucaagcacaagagagggcccaggaaaaaagguuucacauaagugua

SEQ ID NO: 108756 - RNA, 64 nt, hsa
ccauucacucccaggcaggggugaggguggccuggcccaggaggccaggaaggagggcccuguc

SEQ ID NO: 108757 - RNA, 64 nt, hsa
gacucagucugugaguaaaacugggggcucaaaugcccaggaugaggggaucagugacugucua

SEQ ID NO: 108758 - RNA, 64 nt, hsa
cacuuugggaggccgaggugggaggaucacuugagcccaggaguucgagaccagccuaggcaac

SEQ ID NO: 108759 - RNA, 64 nt, hsa
uggggcagaaacccagaacucagcauucaaggaugcccaggagagcugucccuguuuuaaagag

SEQ ID NO: 108760 - RNA, 64 nt, hsa
acuggucucaucuccauugccuuaaugccagguggcccaggaguacccaugcacagcagcugug

SEQ ID NO: 108761 - RNA, 64 nt, hsa
gucuugucuaucuugauggagaagagggguuccugcccaggaucuuacaacacagcaaguagca

SEQ ID NO: 108762 - RNA, 64 nt, hsa
aggaagcacagaucucuagagcuguccugucgcugcccaggauugaccuguguguaagucccaa

SEQ ID NO: 108763 - RNA, 64 nt, hsa
uuuuuuuuuuuuugagauggagucucgcucuaucgcccaggauggagugcaguggcucaaucuc

SEQ ID NO: 108764 - RNA, 64 nt, hsa
cucuuccacugguagaaggccuuuaaugaucugggcccaggaugauuuccugcccuuuuaucau

SEQ ID NO: 108765 - RNA, 64 nt, hsa
uggccucaucuuccuuccugcuguaccacagauggcccaggagaggcacuugucuuuuauuaua

SEQ ID NO: 108766 - RNA, 64 nt, hsa
auguuaggcucuccagggcuucuuuccaaacccccagcuccacaccccccagacccagcugguu

SEQ ID NO: 108767 - RNA, 64 nt, hsa
gcccggccaggcagcugggaccagaaugcaaccccagcuccacuccagccuggcguccagggcc

SEQ ID NO: 108768 - RNA, 64 nt, hsa
guuccuguguuaguuugcuuaugauaauggcuuccagcuccauccauauugcuacagaggacau

SEQ ID NO: 108769 - RNA, 64 nt, hsa
uaugacuagcucuugccgauuaaugagaagagagcagcuccacaauuuuuaauuuuuuuaacuu

SEQ ID NO: 108770 - RNA, 64 nt, hsa
gggucgugguggagaaucugagggcacucucugccagcuccacagggugggaugagccucuccu

SEQ ID NO: 108771 - RNA, 64 nt, hsa
cauucccacauaauacauuccaucacagccagcccagcuccacucagggcuggcccggggaguc

SEQ ID NO: 108772 - RNA, 64 nt, hsa
ugagcaucauacuggaaagcaaacaccuuuccuccagcuccagaauuccuugucucugaaugac

SEQ ID NO: 108773 - RNA, 64 nt, hsa
gagcucacaccgaguugugcuuggcuugcuugugcagcuccaggcacccggugggcacucuggu

SEQ ID NO: 108774 - RNA, 64 nt, hsa
ggacuuggccuaggguugucugagccggagccggcagcuccacuggagagcagugcaggcagag

SEQ ID NO: 108775 - RNA, 64 nt, hsa
gggcgugugugugguggggcuuggcaugugauggcagcuccaggcaugccgcugcuuguauggc

SEQ ID NO: 108776 - RNA, 64 nt, hsa
cuugucccuuuugaucauuauuaacucaggguuucagcuccaaccucgcugaguuggugcagcu

SEQ ID NO: 108777 - RNA, 64 nt, hsa
ucaggguuucagcuccaaccucgcugaguuggugcagcuccaggucauuccuggggugggaauc

SEQ ID NO: 108778 - RNA, 64 nt, hsa
aacagcagcuccaccaaaugaagucccucucacgcagcuccacagcgcugucucgugaauggac

SEQ ID NO: 108779 - RNA, 64 nt, hsa
cugagagcugggcggcguccacaccuaagaacagcagcuccaccaaaugaagucccucucacgc

SEQ ID NO: 108780 - RNA, 64 nt, hsa
aggccugggcccucaggauguuucaaaggcuccacagcuccaccgcuccaccuggcuucacucc

SEQ ID NO: 108781 - RNA, 64 nt, hsa
gagccaugagacccacagacuuggugccugagcgcagcuccagggaagccccagccccuuccag

SEQ ID NO: 108782 - RNA, 64 nt, hsa
uguuauauacagauggcagcuuggaucucagguacagcuccaggggcaggcagugcccagcugg

SEQ ID NO: 108783 - RNA, 64 nt, hsa
cucccgccagccuuguuuucagguggucuggaggcagcuccacguccacacaguggccggcccu

SEQ ID NO: 108784 - RNA, 64 nt, hsa
ggcuuuuccaccuccagcaaguguucccagcaaccagcuccauccuggcugcuugccuuccauu

SEQ ID NO: 108785 - RNA, 64 nt, hsa
guggcugagcucugugaucgcugugauguggacccagcuccagggagcagagugucgaggaugg

SEQ ID NO: 108786 - RNA, 64 nt, hsa
cagccaccuuugcgugucaccuucacgggacuuccagcuccagcuaccuuugugugucaccuca

SEQ ID NO: 108787 - RNA, 64 nt, hsa
cccaaggugccugugcucccagcagguccaagugcagcuccagccaccuuugcgugucaccuuc

SEQ ID NO: 108788 - RNA, 64 nt, hsa
uuuuuguauaaauaaaagaaaaugggacgugucccagcuccaggggugaugggggugauggacu

SEQ ID NO: 108789 - RNA, 64 nt, hsa
uucccgcagaccaaagagagugugacucccuugccagcuccagagugggggggcugucccaggg

SEQ ID NO: 108790 - RNA, 64 nt, hsa
caaagaacuuuccaggucagccggacagcuccagcagcuccacguuccaggcagccucgcccgc

SEQ ID NO: 108791 - RNA, 64 nt, hsa
ccuagaggccaaagaacuuuccaggucagccggacagcuccagcagcuccacguuccaggcagc

SEQ ID NO: 108792 - RNA, 64 nt, hsa
aucccauaccaaagcccugugaguucaucagagucagcuccaggaaccaucaugguaaguggua

SEQ ID NO: 108793 - RNA, 64 nt, hsa
uuugggucagaaccuucucucucugaauuuggaucagcuccaagcagugaaaauaguaaucaga

SEQ ID NO: 108794 - RNA, 64 nt, hsa
cgcaacacaacaaucagauggcaccagggacuggcagcuccacugccgucaacuccuguucucc

SEQ ID NO: 108795 - RNA, 64 nt, hsa
caaaggcccugcuuccuggaaaggacacucagagcagcuccaagacagaggcucuguggcgggg

SEQ ID NO: 108796 - RNA, 64 nt, hsa
ccccuuggccagggccaugggagucccgcgcagucagcuccacauuggccucugcagcugggug

SEQ ID NO: 108797 - RNA, 64 nt, hsa
cuuauugugcucagugaacauccagugcugggugcagcuccaucacccucuuguguguuuacau

SEQ ID NO: 108798 - RNA, 64 nt, hsa
caagugauagucuauaggaguguuuaauuucuugcagcuccaucugguugcugcauuugaagca

SEQ ID NO: 108799 - RNA, 64 nt, hsa
cacaaggauagaugcuggcccagggcccagagcccagcuccaaggggaaucagaacucaaaugg

SEQ ID NO: 108800 - RNA, 64 nt, hsa
cuuugggccagacaugccacaaggacuuccuguccagcuccaaccugcaaagaucuguccucag

SEQ ID NO: 108801 - RNA, 64 nt, hsa
accauggcuguguccccaggcaauaggaauuuuucagcuccauuguaaucuuacgggaucauca

SEQ ID NO: 108802 - RNA, 64 nt, hsa
uugccagguaauaagugugaucauuguugaacuucagcuccagugucucuccagaauaagacau

SEQ ID NO: 108803 - RNA, 64 nt, hsa
ugugucuuugucauugucugguucuuaagagucccagcuccagguggcguccucccugccucuc

SEQ ID NO: 108804 - RNA, 64 nt, hsa
ugucaaauggccugcccaugaagcccuggaauuccagcuccaccuccacuaccacuccaagccu

SEQ ID NO: 108805 - RNA, 64 nt, hsa
cggcacuaccacccugcuccaucaucacuacguccagcuccaacggcacuggugccccauucca

SEQ ID NO: 108806 - RNA, 64 nt, hsa
ggcaccagugccucgcuccauuggcaccaacgcccagcuccaccgguacuggcucccugcucca

SEQ ID NO: 108807 - RNA, 64 nt, hsa
ugacuagcacucagagggacuuaugauaaagguucagcuccagggguaguaccugagugugugc

SEQ ID NO: 108808 - RNA, 64 nt, hsa
guuuugcaagacaguggucaacaggaagacccagcagcuccacccucccaagugacaggccauu

SEQ ID NO: 108809 - RNA, 64 nt, hsa
ucugauggaaugugccaccuguccggcccagugccagcuccagugccgcuccugcuuccccucc

SEQ ID NO: 108810 - RNA, 64 nt, hsa
gggagggggaccugucccccacucucucacccaccagcuccacacauuccagccaggcccaggc

SEQ ID NO: 108811 - RNA, 64 nt, hsa
agcacuccgucugaugggaggagucgugggagcccagcuccaggcccugguaccccucuucaug

SEQ ID NO: 108812 - RNA, 64 nt, hsa
uaggcaggcucucagauguagguggcaaguggcacagcuccauguccggaggcccagcacuccg

SEQ ID NO: 108813 - RNA, 64 nt, hsa
ugacccccggccugcagaacaucuguccccaagccagcuccacugcccaggcccccaagagggc

SEQ ID NO: 108814 - RNA, 64 nt, hsa
caagccagcuccacugcccaggcccccaagagggcagcuccagaagcugcccagggcuccggga

SEQ ID NO: 108815 - RNA, 64 nt, hsa
caaacgccaccuuacacucugcaggcugcagcggcagcuccagauggccuccugagcuggacga

SEQ ID NO: 108816 - RNA, 64 nt, hsa
ccuagggcuccagaggggugaaugggccuuugcucagcuccaggcccagcgggaagggaggcug

SEQ ID NO: 108817 - RNA, 64 nt, hsa
aguccauggggaucucaucacccacucccagccccagcuccagcugcccucaccucucuagcag

SEQ ID NO: 108818 - RNA, 64 nt, hsa
ggccccaccuuuguccccuagcaaauucaggguacagcuccaccuagaaccaggcugcccucua

SEQ ID NO: 108819 - RNA, 64 nt, hsa
ccuuggccccugccugcgucugugcucaaagcagcagcuccaacccugccucuguccccuuccc

SEQ ID NO: 108820 - RNA, 64 nt, hsa
cagugccuccccgccccgccgcuggcgucaaguucagcuccacgugugccaucaguggauccga

SEQ ID NO: 108821 - RNA, 64 nt, hsa
gucuuccuauuuugaguuugguucagaucuuaagcagcuccaugcaacuguauuuauuuuugau

SEQ ID NO: 108822 - RNA, 64 nt, hsa
aaaauugauuacaaguucucugcugugguugcugcagcuccaggaaguccccgcaaugucucac

SEQ ID NO: 108823 - RNA, 64 nt, hsa
acugucagggugcuggccccucugcagauggaaucagcuccaggcugacaccagcagaguccug

SEQ ID NO: 108824 - RNA, 64 nt, hsa
agggagggaggacagaccuccaccacacugacaucagcuccagcucccccagguugggggggag

SEQ ID NO: 108825 - RNA, 64 nt, hsa
acacaucccccccaaccuacccccaccccaaaagcagcuccaacagaauggccagagggccuca

SEQ ID NO: 108826 - RNA, 64 nt, hsa
acgagcaguggagagggaaagcaacuucuugcuggaagaauaucucugccuucuuaccuuaaau

SEQ ID NO: 108827 - RNA, 64 nt, hsa
uuccaaaagauauuuugcucuauuuuaaaguguagaagaauacacugcuaauaaauaauaaaag

SEQ ID NO: 108828 - RNA, 64 nt, hsa
gacaauggcaauaucaacaaugaggaaaauuacugaagaauaaguuuccauaagucuccuacau

SEQ ID NO: 108829 - RNA, 64 nt, hsa
uguucagguuuagaucauaugacacucgagcacagaagaauaauuucaaggaggucaucuugua

SEQ ID NO: 108830 - RNA, 64 nt, hsa
cuaauuaaaaugggguuugcaggcuuuuuauggugaagaauaauauaucucugucuauagcuuu

SEQ ID NO: 108831 - RNA, 64 nt, hsa
caggccauuucauugagggaaaacauaauaucuugaagaauauuguuaaaaccuuacuuaaagc

SEQ ID NO: 108832 - RNA, 64 nt, hsa
gggaaauucacacugugcguuuuagaguaugcaagaagaauauaaauaaauaaaaauauucucc

SEQ ID NO: 108833 - RNA, 64 nt, hsa
gguuuccgcaggucugcuccccaccccugccucggaagaauaaagagaauguaguucccuacuc

SEQ ID NO: 108834 - RNA, 64 nt, hsa
ugagaaaaaaugaauguauuccuguuuuugaagagaagaauaauuuuuuuuuucucuagggaga

SEQ ID NO: 108835 - RNA, 64 nt, hsa
gcauugcuguauacaccucaugcuuaugcaaugggaagaauaugggggccagggggugugguac

SEQ ID NO: 108836 - RNA, 64 nt, hsa
aaaaagcaguaucuucacucaaaagucuugcuuggaagaauaagcagaaauaauuuuauauauu

SEQ ID NO: 108837 - RNA, 64 nt, hsa
ccuugaagguaaugacuaugggucccucucuguggaagaauacugaauagaagagagaaaucac

SEQ ID NO: 108838 - RNA, 64 nt, hsa
uugguuucagccgugguccuaguggcuacuuauggaagaauaggaauaguuccacaacauccug

SEQ ID NO: 108839 - RNA, 64 nt, hsa
cauuaaggucauuacucucaaccaccuaggcaaugaagaauauaccauuucaaauauuuacagu

SEQ ID NO: 108840 - RNA, 64 nt, hsa
gaagcccuccaagaaaaaaaauagaaaagcacuugaagaauauucccaauauucccggucagca

SEQ ID NO: 108841 - RNA, 64 nt, hsa
uagggacugucauaccagugaagaauaaaagggugaagaauaaaagggauaugaugacaagguu

SEQ ID NO: 108842 - RNA, 64 nt, hsa
guggcuaagaugguauagggacugucauaccagugaagaauaaaagggugaagaauaaaaggga

SEQ ID NO: 108843 - RNA, 64 nt, hsa
aagaaaaauuaaggggggauccauugaaagacuugaagaauacauauacuuauauucggggaua

SEQ ID NO: 108844 - RNA, 64 nt, hsa
aggauucaaugaaugaucucuagaaagauuuaaagaagaauauucagauaaggauguugaagau

SEQ ID NO: 108845 - RNA, 64 nt, hsa
auuacuugguauuuagaacuccuagcaccacggggaagaauagagguaucaucaaacguggcaa

SEQ ID NO: 108846 - RNA, 64 nt, hsa
aaguauauacauuucccuauuacucucaucagcugaagaauauguacuauuguguuacucaaau

SEQ ID NO: 108847 - RNA, 64 nt, hsa
uaugaacacugaucaaguaguuguggagagaugagaagaauauaugcagcaaaggugcugugag

SEQ ID NO: 108848 - RNA, 64 nt, hsa
gaugaugcuuuuucuugaugcuaagaucacugcagaagaauaaccugaccuuuucuuugcauuu

SEQ ID NO: 108849 - RNA, 64 nt, hsa
gcuggugcuucuuacauuuaauauggaaaggugggaagaauauuacugcauuagauguaauucu

SEQ ID NO: 108850 - RNA, 64 nt, hsa
uuuucgcuuaaaggaaaaaaaaaucuaaaacugcgaagaauacuaaauguaguugagaaauaau

SEQ ID NO: 108851 - RNA, 64 nt, hsa
uaaccaggaagugcuuauucucucaucacagugggaagaauagccuauugucuuucauuuugcc

SEQ ID NO: 108852 - RNA, 64 nt, hsa
ccuugauuuccucccaaaguaggugagcuauagugaagaauaggugcaaacaaacaagcuuacu

SEQ ID NO: 108853 - RNA, 63 nt, hsa
guuaugcugugaaguaggcaauacaguuguuaaagaagaauaauguuggacucugaauguuau

SEQ ID NO: 108854 - RNA, 64 nt, hsa
gaaguucaaucugucucugggaaagacuagauuggaagaauaaaauucaagaaugugauguuuu

SEQ ID NO: 108855 - RNA, 64 nt, hsa
ccucuuuuucuugcaaguuuuaaauuuccaaccuuaagugaauuuguggaccaaauuucaaagg

SEQ ID NO: 108856 - RNA, 64 nt, hsa
aaagacuaagguuucgagagcauuccuacucacauaagugaagaaaucugucagauaggaaucu

SEQ ID NO: 108857 - RNA, 64 nt, hsa
uuaugaaaaaauauguauaucuguaaucaguuguuaagugaauggcacuaaaaguaucgagaac

SEQ ID NO: 108858 - RNA, 64 nt, hsa
gcuuuucccuguccugacccgauggagcagccgguaagugaagagcacagcuggaagcagagac

SEQ ID NO: 108859 - RNA, 64 nt, hsa
caucaaaacuucaauaaucaagauaccuaauauuuaagugaauauuuuuaaaacucaaaauuaa

SEQ ID NO: 108860 - RNA, 64 nt, hsa
caaaauagaugagaauaugguacagauuguucuauaagugaaaagcauuauguacuugaaagua

SEQ ID NO: 108861 - RNA, 64 nt, hsa
uccugagacuaacuuuguauguuaagguuugaacuaagugaauguaucugcagaggaaguauua

SEQ ID NO: 108862 - RNA, 64 nt, hsa
ucccccuugugugauaccacauguguauaguauuuaagugaaacucaagcccucaaggcccaac

SEQ ID NO: 108863 - RNA, 64 nt, hsa
gaguuugaugaugcaaaguugaucucuguacauuuaagugaaaagucuuuauaacuuuucaccc

SEQ ID NO: 108864 - RNA, 64 nt, hsa
acuauugaugacuguguuaagugcaucuguauuguaagugaaauguaauuauuucuguguacca

SEQ ID NO: 108865 - RNA, 64 nt, hsa
cuacacuuucucugaaucauuuagguuuaagauguaagugaacaauucuuucuuucugccaaga

SEQ ID NO: 108866 - RNA, 64 nt, hsa
uacagugaccauguuaaccuacccugcacugcuuuaagugaacauacuuugaaaaagcauuaug

SEQ ID NO: 108867 - RNA, 64 nt, hsa
aauauggccuugauccauggauuaaaucaguaucuaagugaauguguugauguuuuauugauca

SEQ ID NO: 108868 - RNA, 64 nt, hsa
acaucccagugccuuuaaccuggauuucuaaucuuaagugaaaugggugcagcauuccuuugga

SEQ ID NO: 108869 - RNA, 64 nt, hsa
caugauuuaaagguugaguaugugaagauauaaguaagugaacuaccaugcuuuguuuacgugu

SEQ ID NO: 108870 - RNA, 64 nt, hsa
aaacaaucuuccaaagaacuguauaagguggucauaagugaauauuuuaauuaaaauugguaaa

SEQ ID NO: 108871 - RNA, 64 nt, hsa
gugaaaucauacacucucguguauauacuucauauaagugaauauauacucucgugagaacuua

SEQ ID NO: 108872 - RNA, 64 nt, hsa
gccuugccucuucuagagcuucuagaacuucauauaagugaaaucauacacucucguguauaua

SEQ ID NO: 108873 - RNA, 64 nt, hsa
aguauuguauuauucucuguaguaagauuaguaauaagugaaaauaaaugauuuaaauucauuu

SEQ ID NO: 108874 - RNA, 64 nt, hsa
auucuaaauguuguauuuuaucaguaacauuuucuaagugaagauuaauuuacugaggaugaua

SEQ ID NO: 108875 - RNA, 64 nt, hsa
guuauauccacuagguggcagucauugaucauaauaagugaaaugagcccuuguucuaguacau

SEQ ID NO: 108876 - RNA, 64 nt, hsa
uuuugcuuuucuuuaaauaaaacguauguauaauuaagugaagcugcauguuuguauugaagua

SEQ ID NO: 108877 - RNA, 64 nt, hsa
aaacauuacuuccauauaaagacagaucucuuaauaagugaaucuaguggaagaacauagguau

SEQ ID NO: 108878 - RNA, 64 nt, hsa
gucuguugggaaaacaaaauguguaggugguuuguaagugaauaauuuuuauuucuucuuguau

SEQ ID NO: 108879 - RNA, 64 nt, hsa
aaguauaaaauaccuaggaauacagccaaccagguaagugaaagauuucuacaaugagaauuac

SEQ ID NO: 108880 - RNA, 64 nt, hsa
uacagcaacauagauggagcugaggcucuuauccuaagugaauuaaugcaggaacagaaaauga

SEQ ID NO: 108881 - RNA, 64 nt, hsa
aaaauguagaaauuaaauuuuuaagaguuaaugguaagugaacaauuuuaaauuuauuuuuuau

SEQ ID NO: 108882 - RNA, 64 nt, hsa
aagacauuaaaauaugagauguaugaugaaaaucuaagugaagagacuuuuaugguuaacuuau

SEQ ID NO: 108883 - RNA, 64 nt, hsa
uauugucuucuagccuugagccucugagggucaguaagugaaguacagauagcaaaauuuuacu

SEQ ID NO: 108884 - RNA, 64 nt, hsa
uagguaaaauucaguauaauaggcugaaguggaguaagugaaaaccugccuuuugccacucuua

SEQ ID NO: 108885 - RNA, 64 nt, hsa
gugacauuugaauaaggaaaaacagaguuccuguuaagugaauaacuuuagcuuuuacagggga

SEQ ID NO: 108886 - RNA, 64 nt, hsa
uuucuuucugugccacacaauggauggcucuccuuaagugaagaaagagucaaugagauuuugc

SEQ ID NO: 108887 - RNA, 64 nt, hsa
uguuucccuaaugaugggcaguuggccagggcacugaccagagcugggaaauuuguaucuccaa

SEQ ID NO: 108888 - RNA, 64 nt, hsa
ccauuuuaaggaaacucuuggugcuacaaaacccugaccagacacuuggcaaauuuaccucuuu

SEQ ID NO: 108889 - RNA, 64 nt, hsa
ugguuauaugaaguucaucucaaaauggagaccaugaccagaguuuccagaugauacacguucu

SEQ ID NO: 108890 - RNA, 64 nt, hsa
gaagccagaucagcaaauggaggaaccucggaggugaccagaaagaucuccaucgguugcccaa

SEQ ID NO: 108891 - RNA, 64 nt, hsa
cccccauccuagggaucuugucaggguuccuuacugaccagaggagcccgcagcaaucuccaca

SEQ ID NO: 108892 - RNA, 64 nt, hsa
cccaacugcccugcucuccucauacucaccgguuugaccagaaauucuccaaauccagccauag

SEQ ID NO: 108893 - RNA, 62 nt, hsa
ggaagcagagaaguugcuguuauguuuuugcauccguuuacccuaugcaaaguugcuguaug

SEQ ID NO: 108894 - RNA, 62 nt, hsa
ucaccuugauuuuggcccgguucuuucaguguuccguuuacccuuuuuacugaaaguaagug

SEQ ID NO: 108895 - RNA, 62 nt, hsa
gcauugauagccaguguguuuucuuauuuaacuccguuuacuacauucuacaugguguuuac

SEQ ID NO: 108896 - RNA, 62 nt, hsa
ugcguggccuuaaacauugagaagugcugcucuccguuuauuugggauuugauucucauuuu

SEQ ID NO: 108897 - RNA, 62 nt, hsa
aaacugcacacacagcuccucuuaccguagccuccguuuaugggccuugcuuugggcuuugc

SEQ ID NO: 108898 - RNA, 62 nt, hsa
caaagauuaugaaucuuaugaauguuaaccuuuccguuuauuacaagcaaguacuauuauuu

SEQ ID NO: 108899 - RNA, 62 nt, hsa
auuaccaacacaaggcaauuuauuugaaagauuccguuuauccugccauugcuuugaaaagc

SEQ ID NO: 108900 - RNA, 62 nt, hsa
ggaaaggaggaaagguaucagggauuuuuaaguccguuuagagagcaaaccauauugugccu

SEQ ID NO: 108901 - RNA, 62 nt, hsa
gcguuuuguuugguaguuuugccaaggucacuuccguuuaccuucauggugcuguugccccc

SEQ ID NO: 108902 - RNA, 62 nt, hsa
cucaaaucuguuaucccaaucauuguugccucuccguuuauuauaaacuguaugcucacaac

SEQ ID NO: 108903 - RNA, 62 nt, hsa
auuuugucuggccaauggguucuauagaaaaguccguuuaguguagagaaauugaaaacaga

SEQ ID NO: 108904 - RNA, 62 nt, hsa
ccuuauacauuucaaucccuuuuaugcuggauuccguuuaaagaagacauuauuagagcagg

SEQ ID NO: 108905 - RNA, 62 nt, hsa
aaacucauuuuaggcaaauaugaguuuuauuguccguuuacuuguuucagaguuuguauugu

SEQ ID NO: 108906 - RNA, 62 nt, hsa
cugucccagcuuggaaggcauugaaaacagucuccguuuacacaucucuucauaccacgugu

SEQ ID NO: 108907 - RNA, 62 nt, hsa
ugauauugcacugggauuugaauguguguguuuccguuuaacuuguggugaaggaagugugu

SEQ ID NO: 108908 - RNA, 62 nt, hsa
uaaacaguaggguuuuuccucuccugaccuuauccguuuacaguucaaugaaauaaguguau

SEQ ID NO: 108909 - RNA, 62 nt, hsa
cagaagcaugagaggaaggagauauugugggguccguuuaacucgauagaaagcgcaggggg

SEQ ID NO: 108910 - RNA, 62 nt, hsa
uucaugugcuacuuuaacaugaauggagaaaauccguuuauggaaguacagugacaauugac

SEQ ID NO: 108911 - RNA, 62 nt, hsa
aacaguaucaauguugaaucugugaaugguuuuccguuuacugugaugugcuacuguaaaua

SEQ ID NO: 108912 - RNA, 62 nt, hsa
acauugggcugcugaacccacaaaaaucuaaauccguuuagaaucaucuauuuaacuccuca

SEQ ID NO: 108913 - RNA, 62 nt, hsa
caaaccggggagacaagaugauuggcagguauuccguuuaucacaguccacuuaaaaaauga

SEQ ID NO: 108914 - RNA, 62 nt, hsa
uucuuagaacuuguuuuaauuuuugugguccuuccguuuauuauaauaggcguccaccaaug

SEQ ID NO: 108915 - RNA, 62 nt, hsa
ccucagguggccucuggcuggcugugggggacuccguuuacuaccacagggagacagaggga

SEQ ID NO: 108916 - RNA, 62 nt, hsa
acauucagacccagguguuaugcaggauuacauccguuuauuaucaagggcaaccuugguga

SEQ ID NO: 108917 - RNA, 62 nt, hsa
uagacaugcugcaaggaaagaagauucuaaaguccguuuauggaggcaauuccauauccuuu

SEQ ID NO: 108918 - RNA, 62 nt, hsa
cacacacacaacaaaaauuugaaccaaaacauuccguuuacauuuuagacaguaaguaucuu

SEQ ID NO: 108919 - RNA, 62 nt, hsa
gccagcccagcccagcuggugggaagcgucuguccguuuacuccaagguggggucuuuguga

SEQ ID NO: 108920 - RNA, 62 nt, hsa
gagagaaaaccacuuagacugcacuuuucuguuccguuuacucuguuuacacauuuugcacu

SEQ ID NO: 108921 - RNA, 62 nt, hsa
aaugucuuaaaaaguagaauuuucuucuuuaauccguuuaguaguuaccucccuuuuacuuu

SEQ ID NO: 108922 - RNA, 62 nt, hsa
gguauacacagggccaaaacccacuaagauuguccguuuauguuuauuuaaaugguuuccua

SEQ ID NO: 108923 - RNA, 62 nt, hsa
uucccugcccaagacuuuauuuaacccuggacuccguuuacacagacaaagugacaucagaa

SEQ ID NO: 108924 - RNA, 62 nt, hsa
uucccuaauaaucaaaacaccgcguaggcuccuccguuuaucaguauuaaugguguaacuuu

SEQ ID NO: 108925 - RNA, 62 nt, hsa
aggaacagcucagcuaaagcccucggguuccauccguuuaaaucuguggcauuuucagagcc

SEQ ID NO: 108926 - RNA, 62 nt, hsa
aagcaauccuaagauccugcuuguuguaagacuccguuuaauuuccagaagcagcagccacu

SEQ ID NO: 108927 - RNA, 62 nt, hsa
cccaggugcugccccuucucuccuguuccucguccguuuacugccgcagccccuccugguuc

SEQ ID NO: 108928 - RNA, 62 nt, hsa
caggcuugaggagcuggcgcuuguaauguuuauccguuuaaacauuucguccuccugguaca

SEQ ID NO: 108929 - RNA, 62 nt, hsa
uuaaaaugcagcagagguacucuucugucccuuccguuuauaguucucugagagaguucuau

SEQ ID NO: 108930 - RNA, 62 nt, hsa
acaggcaugacccaccgcucccggccuuguuuuccguuuaaagucgucuucuuuuaauguaa

SEQ ID NO: 108931 - RNA, 62 nt, hsa
ucuauaauuuaauucaagagaaugcuuuuauuuccguuuaaacauauuuuguauauauguga

SEQ ID NO: 108932 - RNA, 62 nt, hsa
agaugcuaaugcuaucgguaaucucuggggaguccguuuaaggcuuuccuugguauuuggca

SEQ ID NO: 108933 - RNA, 62 nt, hsa
gggucccagaccuugcguuccuuuuguuccuguccguuuaucaggacacgggccccaccugu

SEQ ID NO: 108934 - RNA, 62 nt, hsa
gcccagggcccauucuugcuucucaggcaccuuccguuuauuaauugccauugcuccugaca

SEQ ID NO: 108935 - RNA, 62 nt, hsa
cagagcuugcccauugccugucucucgccaauuccguuuauccaaaaagguacauguuuuug

SEQ ID NO: 108936 - RNA, 62 nt, hsa
augauucugcaauucgggaccuacugcagggguccguuuaguaacgucuugucugugaucuu

SEQ ID NO: 108937 - RNA, 62 nt, hsa
ugauccuagguucugaugagugauagguggucuccguuuauacccuuucuucuuuuggcacc

SEQ ID NO: 108938 - RNA, 62 nt, hsa
aaaaagaaacacagacgcccaggugucagcucuccguuuaaagaaugaaaaauguaacucau

SEQ ID NO: 108939 - RNA, 62 nt, hsa
gaccaacccaaaagacugcauacuuuuggcaauccguuuaaacaagauaagaagguaggaua

SEQ ID NO: 108940 - RNA, 62 nt, hsa
gacaguuuauguuaagcacuuagcuuaaacaauccguuuauauuagcacuguaucccuugug

SEQ ID NO: 108941 - RNA, 62 nt, hsa
uucccuucuuaguggcuguuguuuguuguacuuccguuuagacuuuguuuuaaugcuuguac

SEQ ID NO: 108942 - RNA, 64 nt, hsa
cauuuagcauuuaaguugggguauuuagagccuguaaucuaaaugcuggcucaaauuuauuccc

SEQ ID NO: 108943 - RNA, 64 nt, hsa
ugcauaaucauaagcaccucaacacuugaauacauaaucuaaaaauuauauaguaaagcuggua

SEQ ID NO: 108944 - RNA, 64 nt, hsa
uguguuuagcucauuuaaaucaaaauguguacuuuaaucuaaaauguuuuaauaaucuguauuu

SEQ ID NO: 108945 - RNA, 64 nt, hsa
aacuuguuuguuugucuuuguauauaacuacuucuaaucuaaucacuagaguuauuauauucug

SEQ ID NO: 108946 - RNA, 64 nt, hsa
gauauaugcaugugugugaugguauguauggauuuaaucuaaucuaauaauugugccccgcagu

SEQ ID NO: 108947 - RNA, 64 nt, hsa
augcaugugugugaugguauguauggauuuaaucuaaucuaauaauugugccccgcaguugugc

SEQ ID NO: 108948 - RNA, 64 nt, hsa
uuguacacuauauuacaugaucagaucauacaaauaaucuaagauuauacagucuagugauccu

SEQ ID NO: 108949 - RNA, 64 nt, hsa
gauuauacagucuagugauccuagauuacacaaguaaucuaagcuuccacuuuaggaaacuaga

SEQ ID NO: 108950 - RNA, 64 nt, hsa
gauuuuacagucuggugacccuagauuacacaaguaaucuaagcuuccacuuuggaaaacuaga

SEQ ID NO: 108951 - RNA, 64 nt, hsa
uuguacacuacauuacaugaucagaucauacaaauaaucuaagauuuuacagucuggugacccu

SEQ ID NO: 108952 - RNA, 64 nt, hsa
cuaauccuuuuccuuauuugccuucuacuccccuuaaucuaaucuaaaagcucuguuccaugca

SEQ ID NO: 108953 - RNA, 64 nt, hsa
ccuuuuccuuauuugccuucuacuccccuuaaucuaaucuaaaagcucuguuccaugcaacugg

SEQ ID NO: 108954 - RNA, 64 nt, hsa
gcuugacaagauugagaggcccaugccaacagucuaaucuaagagauuagucuuucaaacucac

SEQ ID NO: 108955 - RNA, 64 nt, hsa
uugaguuuagucacugcaaauuugacugugacuuuaaucuaaauuacuauguaaacaaaaagua

SEQ ID NO: 108956 - RNA, 64 nt, hsa
auaccaaaauuauuucagaaauguacaacuuuuuaccuaguacaaggcaacauauagguuguaa

SEQ ID NO: 108957 - RNA, 64 nt, hsa
cagcucacacaugagaucuaggugaggauugauuaccuaguagucauuucauggguuguuggga

SEQ ID NO: 108958 - RNA, 64 nt, hsa
uuucuuuucuuuuuuuuuaguuuuuauuuacuuuaccuaguaugccuuuuuuuaguugcuucuc

SEQ ID NO: 108959 - RNA, 64 nt, hsa
caugcaagcuugauucaccuucagggggcugauaaccuaguaaaucaucaaaaugagaucauaa

SEQ ID NO: 108960 - RNA, 64 nt, hsa
auguguaggaaggagaaaacagaauuugguggauaccuaguagucucugccauacccuugacca

SEQ ID NO: 108961 - RNA, 64 nt, hsa
cuuuuccugggguuuugcauucacugguuguguuaccuaguauugccuaugauaaucguuaguc

SEQ ID NO: 108962 - RNA, 64 nt, hsa
acaugccuguauuacugaaagcuaaauccucaaaaccuaguaaggggacuaaugauucauuaaa

SEQ ID NO: 108963 - RNA, 64 nt, hsa
uggauaaauaacauaucccgggcagaugagcucaaccuaguagguaagaguuugguuuggucac

SEQ ID NO: 108964 - RNA, 64 nt, hsa
ucagagaaucuggaguugaaugauuauuccagauacuguauaaccugcauaacuuuuugucuuu

SEQ ID NO: 108965 - RNA, 64 nt, hsa
cagggccagugcagggucaguuaaugcuacaguuacuguauagcaaacaguauccuuuuuucuc

SEQ ID NO: 108966 - RNA, 64 nt, hsa
uuaaaaaaugcccuauuguaaguuguugguuuauacuguauaaguaacacuaguagcuguuuug

SEQ ID NO: 108967 - RNA, 64 nt, hsa
accaauaauaagagcccugagcccagaaaaaaggacuguauaguuuaaagggaggauugaaagg

SEQ ID NO: 108968 - RNA, 64 nt, hsa
gggaaaauuaguucccauucuuucaacccccuuaacuguauagcucuuuuccuagaauagugac

SEQ ID NO: 108969 - RNA, 64 nt, hsa
uggaugcagcaauaauuucuguaugguccauagcacuguauauuauggaucgauauuaauguau

SEQ ID NO: 108970 - RNA, 64 nt, hsa
gcuuaaaaauacuucuaugacucucugcuaucccacuguauagauccacagggagcaaacacuu

SEQ ID NO: 108971 - RNA, 64 nt, hsa
cuaguuuauucuaaucuauuguuaaguauugugcacuguauaccaaguucuuagggcacaugaa

SEQ ID NO: 108972 - RNA, 64 nt, hsa
guagauauauauuuccaaauauucuaaaaaagauacuguauaugucaaaaauauuuuuauguga

SEQ ID NO: 108973 - RNA, 64 nt, hsa
aaaaugggaagcauuaguuggagcuagaaaaugaacuguauauuauugcuauauuugcuaauac

SEQ ID NO: 108974 - RNA, 64 nt, hsa
cccaucgucagacaacuuuggaguauuagaaaccacuguauauauguggaaagccaggucagcc

SEQ ID NO: 108975 - RNA, 64 nt, hsa
cccuguuguuuacagcauauuuaagucuugugaaacuguauaggaaaaaaguaucuacguuuuu

SEQ ID NO: 108976 - RNA, 64 nt, hsa
acuuugcaccaggugguuuggccacugaauuaauacuguauagcaagagaaacaaucuuauuuu

SEQ ID NO: 108977 - RNA, 64 nt, hsa
aacguuuuugcauuacaggcugcauucuugccuuacuguauagaaaaagaaaaaaggcuggguu

SEQ ID NO: 108978 - RNA, 64 nt, hsa
uccaugaacauuucaagcuuaugggggagaagacacuguauacauuuucaucugcauuccuuag

SEQ ID NO: 108979 - RNA, 64 nt, hsa
auucccagugagaaauauuuucaguauucguaacacuguauaugaugaaaggcuucuauuugga

SEQ ID NO: 108980 - RNA, 64 nt, hsa
gauuguuuuaucuguacauuuuuucagauauuuaacuguauaaaaauguucauuuuacacaaua

SEQ ID NO: 108981 - RNA, 64 nt, hsa
ugugaucugcaacauuuuuucaacuuuugcuagcacuguauacuauugcauucuuaggcuacug

SEQ ID NO: 108982 - RNA, 64 nt, hsa
uauuucagugauaauguucauuuugaaaauauguacuguauaacauuaagaaaauauuuaacuc

SEQ ID NO: 108983 - RNA, 64 nt, hsa
ugcagugcaacaggaggcuuuuucagugaucuucacuguauauguaaauuacaaauguggcugu

SEQ ID NO: 108984 - RNA, 64 nt, hsa
gcuugauugcuuaaacuauugacuugguaagucuacuguauauaacaucuaauauauauauauu

SEQ ID NO: 108985 - RNA, 64 nt, hsa
gcuugauugcuuaaacuauugacuugguaagucuacuguauauaacaucuaauauauauauuac

SEQ ID NO: 108986 - RNA, 64 nt, hsa
auuaucauacuauucuuugaaaaaaaagaugcuuacuguauacuuguuuucaagcauccucuaa

SEQ ID NO: 108987 - RNA, 64 nt, hsa
ugucuuugacagaaacaugguuacgugguucaugacuguauauucacuggaagauagucaagac

SEQ ID NO: 108988 - RNA, 64 nt, hsa
guaaauaaaauaguguugauguacugaaauaugaacuguauaaaaaguauuaguaauuguauau

SEQ ID NO: 108989 - RNA, 64 nt, hsa
aaauuaacuauuaaccacauucaccuuguaaaugacuguauaaaacuuguugacaaugcacuga

SEQ ID NO: 108990 - RNA, 64 nt, hsa
gacauuuucaauguuuccuuaagguuuuugaaugacuguauauuuggcaguuaagcagugccac

SEQ ID NO: 108991 - RNA, 64 nt, hsa
aauuguuuuucuuuauuuucuucagcauuuaaucacuguauacuauguaauuccugaaggggaa

SEQ ID NO: 108992 - RNA, 64 nt, hsa
agacugaguggggucucucugcccaagaucccugacauagcaguagcuugucuuuuccacauga

SEQ ID NO: 108993 - RNA, 64 nt, hsa
gucuaaaauacaccuggaucugucuagucaaucaacauagcagagacagucuuaaaccuaccau

SEQ ID NO: 108994 - RNA, 64 nt, hsa
ucucccaccugucugcauagaaaggcagaauuagacauagcaugcuuuggaaaagcaaauagga

SEQ ID NO: 108995 - RNA, 64 nt, hsa
uagauuagagcaaggauguaagggagaggaagggacauagcaguauuucaggugagagucaagg

SEQ ID NO: 108996 - RNA, 64 nt, hsa
uuuggcauugguuccagaugagcuuuuaaagcaaacauagcaguuguuugccauuucuugcacu

SEQ ID NO: 108997 - RNA, 64 nt, hsa
ucuuuacagagccauccaaaaauuuuuugucccuacauagcaauuuucuguggcacugagaaac

SEQ ID NO: 108998 - RNA, 64 nt, hsa
uccucuaugguagaaguaaaaaaaaaaaaaaaggacauagcaacauuaaaguaguggauuuuuc

SEQ ID NO: 108999 - RNA, 64 nt, hsa
ccacuuccuuuuucucuuacuuccagcacacuagacauagcaaaaguguuugccuacucaaaaa

SEQ ID NO: 109000 - RNA, 64 nt, hsa
gaugcgcagggcgcccccuucuguuccagggugaacauagcacacgcccuccuggcugggccuc

SEQ ID NO: 109001 - RNA, 64 nt, hsa
guucacuuggaccuagugcugccuccuguuuauuacauagcauggcccuuaugucuugaguuga

SEQ ID NO: 109002 - RNA, 64 nt, hsa
auuaauauuaauauuaacaauauugauguuaauuacauagcauacuauuucaauaaauuauaug

SEQ ID NO: 109003 - RNA, 64 nt, hsa
aggagagcaaacaaacagucauggucuaaaacccacauagcacuuugcucuuaguuacauguaa

SEQ ID NO: 109004 - RNA, 64 nt, hsa
ccugcagaauccuaagcgagccagacaggaucccacauagcagcagcgggaagugugccaagga

SEQ ID NO: 109005 - RNA, 64 nt, hsa
ucuauugcauugauuuauaaauaguugucaguucacauagcaauuuaaucaaguaaucauuaau

SEQ ID NO: 109006 - RNA, 64 nt, hsa
acuuuaaugagacaguguuagcaaauggccuagcacauagcaaguacuuaaaaaauggaauccu

SEQ ID NO: 109007 - RNA, 64 nt, hsa
gcuugagcccaggaguucagaaucagccugggcaacauagcaauacuccgucucauaaaaauua

SEQ ID NO: 109008 - RNA, 64 nt, hsa
agaaagaugaggagacagagguccaggguggguuacauagcacauccagggcuaagcaagaaau

SEQ ID NO: 109009 - RNA, 64 nt, hsa
uucucagugucauccauugcugucgugagagacaacauagcaauaucugguauguugcaagcuu

SEQ ID NO: 109010 - RNA, 64 nt, hsa
uggaagagaacaucauuuacuaguccucuucaacacauagcaaugguaucauuguuaauuaugu

SEQ ID NO: 109011 - RNA, 64 nt, hsa
aauauaauuuaagcaaugggcuaagguccaagaaacauagcaauuauaucuacaaauaaucuau

SEQ ID NO: 109012 - RNA, 64 nt, hsa
ccgcgucucccccaugcacaggggaaggauguugacauagcacugggcuguuugaaugccuuuu

SEQ ID NO: 109013 - RNA, 64 nt, hsa
acuugagcccaggaguucuagacaagccugggaaacauagcaagaucucauccuuacaaaaaau

SEQ ID NO: 109014 - RNA, 64 nt, hsa
cuuuacuauuuauuucagaaauguugacaauacaacauagcauaugucuucaucucacuaagaa

SEQ ID NO: 109015 - RNA, 64 nt, hsa
uaucauuguucuugggagcaguguauguuacuuuacauagcagcgguuccugucauguguucau

SEQ ID NO: 109016 - RNA, 64 nt, hsa
augauuccuggacaucaccaguccuagcucuuacacauagcaggggcaccuuccgacaucccag

SEQ ID NO: 109017 - RNA, 64 nt, hsa
uuuuuaaucucugaauguaauuucgauacuguguacauagcagggagugaucggggugaaauaa

SEQ ID NO: 109018 - RNA, 64 nt, hsa
auacaguaaaauauuucgugggaaccuaacacucacauagcauaugguuuauuaauaaugcaua

SEQ ID NO: 109019 - RNA, 64 nt, hsa
ccagggaauggcuccuuauaccaaagaugcuggcacauagcagaacccagugcacguccucccc

SEQ ID NO: 109020 - RNA, 64 nt, hsa
gcauagcacuugcagaccugccugaacgcacaugacauagcacuugccgaucugcgugugucca

SEQ ID NO: 109021 - RNA, 64 nt, hsa
guguugcugaauuaaaauucugcuggacuuuuuaacauagcaaauccgauguuuauaaacuggu

SEQ ID NO: 109022 - RNA, 64 nt, hsa
aaauuacugaagaauaaguuuccauaagucuccuacauagcaguguuauuuauguacagauaag

SEQ ID NO: 109023 - RNA, 64 nt, hsa
augacaagaaaacaagggaaagaguuaaccugucacauagcagguuaacuuuuucaggguuugc

SEQ ID NO: 109024 - RNA, 64 nt, hsa
acuugaggccaggagauugagaccaguguggccaacauagcaaaaacccgucucgacgaaaaau

SEQ ID NO: 109025 - RNA, 64 nt, hsa
gaugggugaugucuuuccuuauguugcuuuuucaacauagcagaauuaauguagggagcuaaau

SEQ ID NO: 109026 - RNA, 64 nt, hsa
ucuucauuuauucuucuuuuccaauugaacuuucacauagcacagaaaaaauucaaacugccua

SEQ ID NO: 109027 - RNA, 64 nt, hsa
cuuugcugcuucuacuguaaaggcagccuuuaaaacauagcaauaugcaccuuucaacuuuaca

SEQ ID NO: 109028 - RNA, 64 nt, hsa
uauaauuuugaaaauaacaacuaaaagauguauaacauagcaaaacugcuuaaacaucccauuu

SEQ ID NO: 109029 - RNA, 64 nt, hsa
uuaaaucucaaauaggcuauuaaaaaagucuacaacauagcagaucuguuuugugguuuggaau

SEQ ID NO: 109030 - RNA, 64 nt, hsa
ucuugagaauaggaguucaagaccagccugggcaacauagcaagauccugucucuccaaaaaaa

SEQ ID NO: 109031 - RNA, 64 nt, hsa
accuuguaagcaauaguuauauuuaggugguagaacauagcaaaaauauaaccgaaaguuggcc

SEQ ID NO: 109032 - RNA, 64 nt, hsa
gugcuaggauaaaccaaucaucuuaacuuggcuaacauagcacaguauuuacugugcuaauggg

SEQ ID NO: 109033 - RNA, 64 nt, hsa
uuuaagacugauaauuuuacaauuuauaugcuucacauagcaugucaacuuuugacuaagaauu

SEQ ID NO: 109034 - RNA, 64 nt, hsa
auuugagcucaggaguuccagaccagccugggcaacauagcaaaaucucaucucuacaaaaagu

SEQ ID NO: 109035 - RNA, 64 nt, hsa
aaaaagguaggaaaucccuaaaacuuccagccucacauagcacgguucucaccugucacuguuu

SEQ ID NO: 109036 - RNA, 64 nt, hsa
ugagauuggcuucagaauccauuacaguuaccuuacauagcacuugauacguguuaaaugaaca

SEQ ID NO: 109037 - RNA, 64 nt, hsa
caggccuuaccuaguguuucccaucccucugaucacauagcacuuguaugugauuuaaaaugga

SEQ ID NO: 109038 - RNA, 64 nt, hsa
guccaguugcagccuaauggugaacgggauuacaacauagcaaauacuguuugacuuucagaag

SEQ ID NO: 109039 - RNA, 64 nt, hsa
acuugaggucgggaguucgagaccagccuggccaacauagcaaaacccugucucuacuaaaaau

SEQ ID NO: 109040 - RNA, 64 nt, hsa
uuaaaugugcuuuugaaccaauuugcagaagcucacauagcaaguucauaaguuuccaaaaagg

SEQ ID NO: 109041 - RNA, 64 nt, hsa
auggacuccggaaagcuuucuguuuuuacuggaaacauagcaaaccuugauuuagcuccaagaa

SEQ ID NO: 109042 - RNA, 64 nt, hsa
guuugaggccagaaauuugagaccagccugggcaacauagcaaaacccugucucuacaaaaaau

SEQ ID NO: 109043 - RNA, 64 nt, hsa
uguaugcagauuuauggauauuaucaaugagaagacauagcauguaacuucuccuauaucucua

SEQ ID NO: 109044 - RNA, 64 nt, hsa
gcuugaggccaggaguuugagacuagacugggcaacauagcaagaccccgucucuacaaagcac

SEQ ID NO: 109045 - RNA, 64 nt, hsa
aucaaauaccgaaauugaacuuucuaaaaccuacacauagcaugcguuuaaauucuauuauaua

SEQ ID NO: 109046 - RNA, 64 nt, hsa
cagcucccgcauaccaggauaacccccgcaaaccacauagcagacccccgccauccucgcagag

SEQ ID NO: 109047 - RNA, 64 nt, hsa
uggggaagguaccacaaacauuaucuaccagggaacauagcauaaauuagucugaaauuuccug

SEQ ID NO: 109048 - RNA, 64 nt, hsa
ggcaucagucaacaguguaugucaugcaguacagacauagcaagccuuguccugacuauguuuc

SEQ ID NO: 109049 - RNA, 64 nt, hsa
aucacacauaguguaucguggcaugaagcccggcacauagcaggcccugcauauugauggacaa

SEQ ID NO: 109050 - RNA, 64 nt, hsa
uuuuucuuacuagaccuguaacuuuuguaaauacacauagcauguaaugguaucuuaaagugug

SEQ ID NO: 109051 - RNA, 64 nt, hsa
acuuaagcccaggagucugagaccagccugggcaacauagcaagacccccaucucugcaaaaaa

SEQ ID NO: 109052 - RNA, 64 nt, hsa
cuggggauugaaaucuuuaguccuuggagcugucacauagcaggggcaaccucacacugaaaca

SEQ ID NO: 109053 - RNA, 64 nt, hsa
gcuugaguucaggaguucaagaccagccugggcaacauagcaaaaccuuaucucuacaaaaaaa

SEQ ID NO: 109054 - RNA, 64 nt, hsa
aauucauaccauauaaaacuuguuagguuuuuaaacauagcaaucaaggcuacaaaaacaaacc

SEQ ID NO: 109055 - RNA, 64 nt, hsa
gagcuuacucaggacuuuucaaacaucaggacacacauagcaauuuggauguuguaaaacuacg

SEQ ID NO: 109056 - RNA, 64 nt, hsa
uuuauaguaaaauucuagcaccacuagaauaaucacauagcauguacaauauauuuaugcuggc

SEQ ID NO: 109057 - RNA, 64 nt, hsa
caucuguuguucuguggucacagugaccuuagcuacauagcagacuuucccaaauguauugauu

SEQ ID NO: 109058 - RNA, 64 nt, hsa
uuaacacguagaucuuuguacaguugacuuuuugacauagcaaggccaaaaauaacuuucugaa

SEQ ID NO: 109059 - RNA, 64 nt, hsa
uguagugacauuaggcagaaauggccagucaaacacauagcaguguuccauagacuuggguaug

SEQ ID NO: 109060 - RNA, 64 nt, hsa
uaauggacgaagcaacaaauaugucaagaacaggacauagcacgaaucuguuaccaguaggagg

SEQ ID NO: 109061 - RNA, 64 nt, hsa
ccucuuuggugcucuuaaaagccagcagcugagaacauagcacaggcccacguggugagggcac

SEQ ID NO: 109062 - RNA, 64 nt, hsa
ucugugggcaggccucgaaaaccaucacaugaccacauagcaugaggccacugcugcuucucca

SEQ ID NO: 109063 - RNA, 64 nt, hsa
gcuugaggucaggaguuuuagaccagccuggacaacauagcaagaccucaucucuucuaaaaau

SEQ ID NO: 109064 - RNA, 64 nt, hsa
augacuuuuauaucccauuuugguaauuauucauacauagcacauaugaccaugauguucaggg

SEQ ID NO: 109065 - RNA, 64 nt, hsa
ucaauuccugugcauuagugugaugauuucugucacauagcagcauuccgauucuauguaacug

SEQ ID NO: 109066 - RNA, 64 nt, hsa
agaccuuaauuuuuauauuuuuuuaaaguagcuaacauagcaguaggcacuuaagcauuuaguc

SEQ ID NO: 109067 - RNA, 64 nt, hsa
uacagaucauggcggugcgucagccucacaggagacauagcaggucucagaaaccuucuaugac

SEQ ID NO: 109068 - RNA, 64 nt, hsa
ucaguaaagcagaggcuagaauuacaguauuuauacauagcaacuuuucauaaaguagaaaaau

SEQ ID NO: 109069 - RNA, 64 nt, hsa
ugcuuucuucuucuuaaagagagcugcuuaccauacauagcacccacagugucucccuucucuu

SEQ ID NO: 109070 - RNA, 64 nt, hsa
cuaacaaaauggaauguuaacugaauggaauuaaacauagcaauugucaagccaucaaaauuau

SEQ ID NO: 109071 - RNA, 64 nt, hsa
gccuucccuuuacagcucuccuccagcccugggcacauagcauaggcuggggacacaggauccu

SEQ ID NO: 109072 - RNA, 64 nt, hsa
gguagacugaauaucugacgggauuucuauauggacauagcacagaugaaccaaaaauguauuu

SEQ ID NO: 109073 - RNA, 64 nt, hsa
agaucuagauaacucaugacauuuuauuugaccaacauagcacaugaugagauaucaagguaau

SEQ ID NO: 109074 - RNA, 64 nt, hsa
guauuugauacguguuccuauaaaaucaaagaaaacauagcacuagcauucaggguuauacaca

SEQ ID NO: 109075 - RNA, 64 nt, hsa
gaaggauucaaguacaaguaauauuuuguauaaaacauagcaguuuagguccccauaauccuca

SEQ ID NO: 109076 - RNA, 64 nt, hsa
cuguucaacaaacuuguuuaauuuguuuaaaucaacauagcaugaaacaccaaauaaaauguuu

SEQ ID NO: 109077 - RNA, 64 nt, hsa
uuguacaauuauuuucuggguacuucccauaugcacauagcacuguaaaaaauauuucccaaag

SEQ ID NO: 109078 - RNA, 64 nt, hsa
uugcagcacuacuuuaaauauuagauuaugucucacauagcacugcucauuuuacuuuuauuuu

SEQ ID NO: 109079 - RNA, 64 nt, hsa
accugagggcaggagucugagaccagccuggccaacauagcaaaaccccaucucuauuaaaaau

SEQ ID NO: 109080 - RNA, 64 nt, hsa
uaggauauuggacucugcuuagcauuuucaagccacauagcaugacuguuuuuugaauagguug

SEQ ID NO: 109081 - RNA, 64 nt, hsa
ucucucugcugcuguugagguuauauuaaguuccacauagcaauuacaguaugccaguuccacu

SEQ ID NO: 109082 - RNA, 64 nt, hsa
gcuugaagucaggaguucaagaccaaccugggcaacauagcaacaccccccaugucuacaaaaa

SEQ ID NO: 109083 - RNA, 64 nt, hsa
uuuugguauugggacaguggauaagcagguuaucacauagcauagaauucuuaaaagauacaug

SEQ ID NO: 109084 - RNA, 64 nt, hsa
aaaagcugcagccggugcuugcacaccgccuugcacauagcagaggcuccgggcucacuccuuc

SEQ ID NO: 109085 - RNA, 64 nt, hsa
aagagccgcagccggugcuugcacaccgccuugcacauagcagaggcuccgggcugacuccuuc

SEQ ID NO: 109086 - RNA, 64 nt, hsa
uugauauaccauguauucacacuuuaaaaaauacacauagcagaguaucggaaaguauguacca

SEQ ID NO: 109087 - RNA, 64 nt, hsa
ucagugauaauuugcugaagaagcaaauagauuaacauagcaacuaaguagaugauuaguugca

SEQ ID NO: 109088 - RNA, 64 nt, hsa
ccuugaggccaggaguuuaaggccagccugggcaacauagcaaaaccuagucccuaaaauuaaa

SEQ ID NO: 109089 - RNA, 64 nt, hsa
aaugaugaaauucaguccaacaugcuuauuauaaacauagcaauucuugcucuaucaaauuagc

SEQ ID NO: 109090 - RNA, 64 nt, hsa
uuguggauaauaauugaauugguuuuuaaaggcaacauagcauucuacagcaggguuaaucuau

SEQ ID NO: 109091 - RNA, 64 nt, hsa
gggugcauuaacuuaaaagauucacuaaagcagcacauagcacugggaacucuggcuccgaaaa

SEQ ID NO: 109092 - RNA, 64 nt, hsa
aacucauuuauaaagcuaaaauaaccggauauauacauagcaugacauuucuuugugcuuuggc

SEQ ID NO: 109093 - RNA, 64 nt, hsa
guuucauuucuuuggauggacucuuaucuagaauacauagcagcucugcaaaggaacaguuuuu

SEQ ID NO: 109094 - RNA, 64 nt, hsa
agcaugugaauuuuggaaaacacaaaaauucagaacauagcaaauaccuuugaaguauaaaaga

SEQ ID NO: 109095 - RNA, 64 nt, hsa
agaggugaauauuugggucauuuacauguacacuacauagcaaguugauacucauguugcaugu

SEQ ID NO: 109096 - RNA, 64 nt, hsa
accagccacuccagcuuugugucuucucucaauuacauagcaauuucuccuucccaccaucaug

SEQ ID NO: 109097 - RNA, 64 nt, hsa
aaacuagcaacucuuauuucuuuccuuuaaaaauacauagcauuaaaucccaaauccuauuuaa

SEQ ID NO: 109098 - RNA, 64 nt, hsa
cuauaaaaaauaaaauaauuauaaauaucauuguacauagcauguuuauaucugcaaaaaaccu

SEQ ID NO: 109099 - RNA, 64 nt, hsa
ugaagauauguagagauuccuuauccaugccuguacauagcauguccuccuccccucagcuuug

SEQ ID NO: 109100 - RNA, 64 nt, hsa
uauucauucaagaaaccuugggccaccgcuuuguacauagcaccgugcuaggcucugggauccc

SEQ ID NO: 109101 - RNA, 64 nt, hsa
cucaccauuaugacauccaucccccuagcucaccacauagcacauagaaugauauuuuugauuu

SEQ ID NO: 109102 - RNA, 64 nt, hsa
acccccaccuaauuauccagcauauauguaagaaacauagcagcgaugguauucgaucugugcc

SEQ ID NO: 109103 - RNA, 64 nt, hsa
gcuccuugcaacgucuuaagcaagcgaccccccgacauagcaaaagguggcaacccauggaggc

SEQ ID NO: 109104 - RNA, 64 nt, hsa
gcaugugaauagccacugcacuccagccugggcaacauagcaagacuccaucucuaaguaaaaa

SEQ ID NO: 109105 - RNA, 64 nt, hsa
uuuugaaacaaauauuugaaaaccagguauccacacauagcacuuuuauuccugacuaguuuug

SEQ ID NO: 109106 - RNA, 64 nt, hsa
auuucucagauauuauuucucugggaaacauucuacauagcacaggagcuuaagaguggcauua

SEQ ID NO: 109107 - RNA, 64 nt, hsa
ucccauguaaaaccugcuacaaauggcagcuuauacauagcaaugguaaaaucaucaucuggau

SEQ ID NO: 109108 - RNA, 64 nt, hsa
cuccugauggaaugguaaagcaaucuuucuuggaacauagcaaguaguaaccgaucaaauugcu

SEQ ID NO: 109109 - RNA, 64 nt, hsa
agcugccuaccuaaugaggacuucaagccccaccacauagcaugcuuccuuucucuccuggcuc

SEQ ID NO: 109110 - RNA, 64 nt, hsa
ucucuugccgcauaggcuuuuuaaaggugcuuucacauagcacaggcauuacccguagucgugu

SEQ ID NO: 109111 - RNA, 64 nt, hsa
auacaaaugagcaagguauuuguugcaacuuacuacauagcauauacccaaaaucacugaagaa

SEQ ID NO: 109112 - RNA, 64 nt, hsa
uauaauuacguaaacacauauucaauucuugcuaacauagcaguacuuugcugugagcagguca

SEQ ID NO: 109113 - RNA, 64 nt, hsa
ucuugagcccaggauuuugaauccaucguggacaacauagcaagauuccaucucuaaaaaaaau

SEQ ID NO: 109114 - RNA, 64 nt, hsa
acucagagaacagaagugcaaugugaugggaggaacauagcaauaucugcuccuuuucgaguug

SEQ ID NO: 109115 - RNA, 64 nt, hsa
gaaccauggauuuuuuuugaccaucuucuaauaaacauagcaaguauuaugaauacauuaaagu

SEQ ID NO: 109116 - RNA, 64 nt, hsa
acuugagcccaggaguuuaagaccagccugggcaacauagcaagacccugucucuaaagaaaaa

SEQ ID NO: 109117 - RNA, 64 nt, hsa
cucaauguuucauaugaagcccuuggugaugaggacauagcaucugcccuggaaaucguuauuc

SEQ ID NO: 109118 - RNA, 64 nt, hsa
agagugucugggacgcugcuguauucugaaagucacauagcacacaguaauguuaucuggaagc

SEQ ID NO: 109119 - RNA, 64 nt, hsa
uuuguuguuccuucauuuuuuucuuuuuaauaagacauagcagaauuccuuagguaugggauuu

SEQ ID NO: 109120 - RNA, 64 nt, hsa
uucuaccuagaaugcaaaauuggguauaugaauuacauagcauguuguugggauuuuuuuuaau

SEQ ID NO: 109121 - RNA, 64 nt, hsa
uuaguuuuuaaaaauugcgcuacuugccugggaaacauagcagaccucguuucuacuaaaaauu

SEQ ID NO: 109122 - RNA, 64 nt, hsa
aguagauugucauuugucaggcuccuguacauuuacauagcauguuauauuaauaauaaaugua

SEQ ID NO: 109123 - RNA, 64 nt, hsa
cuuaggggaugguagaccuuuauuggguaucaagacauagcauccaaguggcauaauucagggg

SEQ ID NO: 109124 - RNA, 64 nt, hsa
aauucaaaagcugguauuuuucuuccuaaaugucacauagcaaaggcugcccaaauccccaaac

SEQ ID NO: 109125 - RNA, 64 nt, hsa
gcacucuggaauuguuucaguuaagucauuuuagacauagcauuuauuaucacuguggaucucu

SEQ ID NO: 109126 - RNA, 64 nt, hsa
aaugcgauucaguucaccgcuaaggaaagugaugacauagcaguuacagagggugauaaaucuc

SEQ ID NO: 109127 - RNA, 64 nt, hsa
uucuccaccuuucaguuucucaguuguuucagaaacauagcaaugacauaaaaacugcuaugga

SEQ ID NO: 109128 - RNA, 64 nt, hsa
cacccacaccccaaagcuggaaggaucugguucaacauagcacaaacccuuaggaaaaaugaaa

SEQ ID NO: 109129 - RNA, 64 nt, hsa
gucuaggacagauugcuuccacuagaaccuggagacauagcaucuuugauagcauaagccagau

SEQ ID NO: 109130 - RNA, 64 nt, hsa
uuucauccagaggaacaaaaaaauuaaaaauagaacauagcaaagcaaagacagaaugcccccc

SEQ ID NO: 109131 - RNA, 64 nt, hsa
acuugagcccagaauuagagauaagccuauggaaacauagcaagacacugucucuacaggggaa

SEQ ID NO: 109132 - RNA, 64 nt, hsa
gguauguaaacuuguaaaaauagagauuugacagacauagcaaucuagucaauguguaaggggu

SEQ ID NO: 109133 - RNA, 64 nt, hsa
uggcauuuaacuaaagauggagcaugaucuaaguacauagcacaugugaauaaaagaaaagcug

SEQ ID NO: 109134 - RNA, 64 nt, hsa
guaaucucugaaauuuccuuaaauuauauacuuaacauagcagagaaacuggauuguuuuugua

SEQ ID NO: 109135 - RNA, 64 nt, hsa
ccuugagcccuggaguuugaguccagccugggugacauagcaagacccugucuuaaaagaaaaa

SEQ ID NO: 109136 - RNA, 64 nt, hsa
guuuucuguauguuguugggggaucaacuuucacacauagcaagcacauggccucccugauguc

SEQ ID NO: 109137 - RNA, 64 nt, hsa
aagaugcaccuugaucucacccucacuccaaggcacauagcaggaucacucccuagcuucucug

SEQ ID NO: 109138 - RNA, 64 nt, hsa
acuuggcacuccugugcccucugccuggacaagcacauagcaagcugaacuguccuaaggcagg

SEQ ID NO: 109139 - RNA, 64 nt, hsa
uaaaccagaaaacaauuguggggaucaaggacagacauagcacuuagacaggacuuucaugacc

SEQ ID NO: 109140 - RNA, 64 nt, hsa
aaugguuucguaaauaauuugccuauuuugguuaacauagcacauggagauaaucaucugaaag

SEQ ID NO: 109141 - RNA, 64 nt, hsa
cagaacuugaaugugucaggugacccugaugaaaacauagcaucucaggagauuucaugccugg

SEQ ID NO: 109142 - RNA, 64 nt, hsa
cauguuauguuuaauaagcuacuagcaaaauaaaacauagcaaauggcaucacuguguuugacu

SEQ ID NO: 109143 - RNA, 64 nt, hsa
ucuuacugguggaaagucuuuguaaggaaaaaacacauagcaaggagcaaauuuccacaaagug

SEQ ID NO: 109144 - RNA, 64 nt, hsa
aggauguuuacagugaauaauuuuaaaaccacaaacauagcagaaauguacuuuauuauuaaau

SEQ ID NO: 109145 - RNA, 64 nt, hsa
aaaaugaucauuaggacauaacagacuaggccagacauagcaucuuguggcuuugcaaccauuu

SEQ ID NO: 109146 - RNA, 64 nt, hsa
cuguuauauacccaaugccuagaagaggaccugcacauagcaggugcucaguaaauguuuguug

SEQ ID NO: 109147 - RNA, 64 nt, hsa
caguauuuacuguguaauacuuaagugccacuaaacauagcaaauugugcugcacaugaggaaa

SEQ ID NO: 109148 - RNA, 64 nt, hsa
aaaguaauccacuuucuuguuuaauauaccagauacauagcaaaagcagcuuggaauaauuaua

SEQ ID NO: 109149 - RNA, 64 nt, hsa
ggcuaggaguuccaguucgaaaccagcuucguaaacauagcaagacccagucucuaccaaaaaa

SEQ ID NO: 109150 - RNA, 64 nt, hsa
cuucccugaauugcagugauuucuguuauaaggcacauagcaagccuguaccacucuacaguaa

SEQ ID NO: 109151 - RNA, 64 nt, hsa
gcuucagcccaggaguuugagaccagccugggcaacauagcaaaaccccaucucuacaaaaaua

SEQ ID NO: 109152 - RNA, 64 nt, hsa
ugaaucagcugggguguuuucacugauaaacaacacauagcaggugugcauucauuacaaauau

SEQ ID NO: 109153 - RNA, 64 nt, hsa
aaaaugugaccugaggcccuagucuagcaagaggacauagcacccucaucugggaauagggaag

SEQ ID NO: 109154 - RNA, 64 nt, hsa
uguuguuuguuuccuauaagaugcuuugcugaacacauagcaaaauucaugugacggaugauaa

SEQ ID NO: 109155 - RNA, 64 nt, hsa
aaacuaugaaucagcaaauuuuuaagauuguaccacauagcaaacauacagcuguugaaaaaua

SEQ ID NO: 109156 - RNA, 64 nt, hsa
gagauugcuugaguccaggagaccagccugggcaacauagcaaaaccucaucucuauuuaaaaa

SEQ ID NO: 109157 - RNA, 64 nt, hsa
caugugccuuaaacagacuuuuuaguccaaaauuacauagcauugaagaauauauuucacugug

SEQ ID NO: 109158 - RNA, 64 nt, hsa
uagaugcacuaagaauucacugcagcagcagguuacauagcaaaaaugcaaaggugaacaggaa

SEQ ID NO: 109159 - RNA, 64 nt, hsa
aaagcuacuguaguaccuaaaaagucaguguuguacauagcauaaaaacucugcagagaaguau

SEQ ID NO: 109160 - RNA, 64 nt, hsa
cucuuugucuauggaguuauacuuccaucaaauuacauagcaaugcugaauuaggcaaaaccaa

SEQ ID NO: 109161 - RNA, 64 nt, hsa
guacauuuccacaaaucuaagaauugcccuauaaacauagcaggauuuugagagcuugaaaauu

SEQ ID NO: 109162 - RNA, 64 nt, hsa
cuaugaccccaaaucauagucaauggugccucaaacauagcaccuuaaguuaaaggcugccuag

SEQ ID NO: 109163 - RNA, 64 nt, hsa
ugggguugcuucauugagauaaagcacacuuaucacauagcacaaaggacgugccauggugcuu

SEQ ID NO: 109164 - RNA, 64 nt, hsa
uucauuguguucaguagugaauuucuacaguuuaacauagcacagggccuucugaaaaucgcac

SEQ ID NO: 109165 - RNA, 64 nt, hsa
caucgccaggauuucuaaugcacucaguuucccuacauagcagggauucuuagcuagguguccc

SEQ ID NO: 109166 - RNA, 64 nt, hsa
uuaacuauggcaauacauuugugcuuuaacuguuacauagcaguaucaccacuuaccaggaucc

SEQ ID NO: 109167 - RNA, 64 nt, hsa
aaacgaaaacagacucgaacuauuguguaccaccacauagcacaugcacgucugucccagacuu

SEQ ID NO: 109168 - RNA, 64 nt, hsa
cucccacaccaagugcaugucaguuguggagaaaacauagcaaaaagagccguacgcucuuuac

SEQ ID NO: 109169 - RNA, 64 nt, hsa
gcauugaccagaaaaauugaaaguguucugaggcacauagcagaggagcugcagauuuccugcu

SEQ ID NO: 109170 - RNA, 64 nt, hsa
caauuugaacuuccagggauuuuauugugaacuuacauagcaacauuaaaaugaaguugaauug

SEQ ID NO: 109171 - RNA, 64 nt, hsa
cccaggagggacccuugauacauguacaaagcauacauagcaccccuugcccugugucugugga

SEQ ID NO: 109172 - RNA, 64 nt, hsa
aaaccuugccuacgacauguuuaauacuucaucuacauagcagcccuucagauaaucacaacca

SEQ ID NO: 109173 - RNA, 63 nt, hsa
ggacauucuuacugugcuaaaaagccacugcaaacauagcaauaaaaaccugucauuuuccaa

SEQ ID NO: 109174 - RNA, 64 nt, hsa
agaucgucacgaguuaaagcagcucgggcuggagacauagcauucauuccuguucagaaugcga

SEQ ID NO: 109175 - RNA, 64 nt, hsa
caggcccaggagauuaagugacuuggcuaaagucacauagcaaauuaguagcagagccgggacu

SEQ ID NO: 109176 - RNA, 64 nt, hsa
gcuugagcccaagaguucauaucuagccuggucaacauagcaagaccccugucucuauuuuuuu

SEQ ID NO: 109177 - RNA, 64 nt, hsa
auccuuuccucucuccccguucaugcccugcacuacauagcacagccgggaugcuuggaacaga

SEQ ID NO: 109178 - RNA, 64 nt, hsa
guuuuaaccuucaggaagaauuguaaagaccuguacauagcacaacaugauccggauaauauau

SEQ ID NO: 109179 - RNA, 64 nt, hsa
gcaaggacuguuuguucuuuugccccauuucucaacauagcacacuugugcacugagaggaggg

SEQ ID NO: 109180 - RNA, 64 nt, hsa
gagcuagugagucgagacuuagaagaauggggccacauagcagcagaggacugguguaagggag

SEQ ID NO: 109181 - RNA, 64 nt, hsa
auuuagcuaauagcuacaggcugagagaauuguaacauagcaugacaaauuuuguguugacuug

SEQ ID NO: 109182 - RNA, 64 nt, hsa
caugcucgcaucuuuguuuuuaaucuggcuucgaacauagcacaaguaacuugaauagcacauc

SEQ ID NO: 109183 - RNA, 64 nt, hsa
acuugaggucaggaguuugagaccagugugcaaaacauagcaagaccucaucucagaaaaaaaa

SEQ ID NO: 109184 - RNA, 64 nt, hsa
acuugaggucaggaguucaagaccagccugggaaacauagcaagaccccaucucuuaaaaaaaa

SEQ ID NO: 109185 - RNA, 64 nt, hsa
gcuugagcccaggaauucaagaccaguccgagcaacauagcaaaagcccuuaucugcaaaaaau

SEQ ID NO: 109186 - RNA, 64 nt, hsa
acccugggguuaugaagaugguugaacaccccacacauagcaccggagauaugagaucaacagu

SEQ ID NO: 109187 - RNA, 64 nt, hsa
aagcacugcagcgauuucucaaagacauaaaagaacauagcauucaacccagcaucccauuacu

SEQ ID NO: 109188 - RNA, 64 nt, hsa
gucauuagggaaauacaaaucaaacucaagacauacauagcaucucauuaggauuaguaguauc

SEQ ID NO: 109189 - RNA, 64 nt, hsa
gucacagugaacuaugauuacgccaaccugggucacauagcaagacucuguuucaaaaaaaaag

SEQ ID NO: 109190 - RNA, 64 nt, hsa
gcuuaagcccaggaguucaagaccaaccuggacaacauagcaagaccccaucucuuaaaaaaaa

SEQ ID NO: 109191 - RNA, 64 nt, hsa
gcuuaagcucaggaguuugagaccagccugggcaacauagcaagacccccaccaucucugaaaa

SEQ ID NO: 109192 - RNA, 64 nt, hsa
acuguugacacaguacaaguuacauagcuaaaauacauagcauugaagacuaauuuuaaggauu

SEQ ID NO: 109193 - RNA, 64 nt, hsa
ccuugaggccaggguucgagaccaaccuugggcaacauagcaagaccccauuucuuaaaaaaaa

SEQ ID NO: 109194 - RNA, 64 nt, hsa
acugacaugucuauuuccuugggagcaugugagaacauagcaguagggaccaaaagucucagca

SEQ ID NO: 109195 - RNA, 64 nt, hsa
ggaggaucccaggaguucaaauccugccugggcaacauagcaagacccugucucuuaaaaaaac

SEQ ID NO: 109196 - RNA, 64 nt, hsa
uucuaccagguccccauccugcugccagcucucaacauagcaggccauaggacccagagaagaa

SEQ ID NO: 109197 - RNA, 64 nt, hsa
gauguuuaugaggaugauugcugguuucccuuacacauagcagagcucacucaguucucacagu

SEQ ID NO: 109198 - RNA, 64 nt, hsa
cuccacgaggugaaaaauauucaguaacuuguuuacauagcauuuguguaaagacuaugaucuc

SEQ ID NO: 109199 - RNA, 64 nt, hsa
uacaugugguauaagcacauguacagaggaguacacauagcauauaaacaugucuguagcacau

SEQ ID NO: 109200 - RNA, 64 nt, hsa
ucaggguuuaccaggagcuuaauaauuaauggcuacauagcaaggcaucgucuuggaaccggag

SEQ ID NO: 109201 - RNA, 64 nt, hsa
cuggagggugagagaauuguggagaccaacuaccacauagcaagagcccagcucuugggagcau

SEQ ID NO: 109202 - RNA, 64 nt, hsa
ugcuguaacuccaguuccuagaacaauuuccagcacauagcaaguguucaguaaauauuugcug

SEQ ID NO: 109203 - RNA, 64 nt, hsa
uacacaugcacgcuugcacacaugcacacagaccacauagcacacaugugcacugaccacaccu

SEQ ID NO: 109204 - RNA, 64 nt, hsa
ugaacagaccuucuuuuaacuucuaaucucaagcacauagcagcuguuguuuucauauuaaaga

SEQ ID NO: 109205 - RNA, 64 nt, hsa
cuuuauauucucaauuucccgcacagugccuagcacauagcaaggacucaacaaauuucauuga

SEQ ID NO: 109206 - RNA, 64 nt, hsa
cacaacacacaccacaccugggacuguuuuuaauacauagcaacagacuggguuauuuauuuaa

SEQ ID NO: 109207 - RNA, 64 nt, hsa
gacugcauuauuuuacuacuguaauuucuccacgacauagcauuauguacauagaugaguguaa

SEQ ID NO: 109208 - RNA, 64 nt, hsa
cugaauuaauaugcuuccuugcaaaugggaaaucacauagcaguuaccccauggcauugugacu

SEQ ID NO: 109209 - RNA, 64 nt, hsa
ccaggggaaggaguggcucugggcagagagggacacauagcacugggguggcagguccuuuuga

SEQ ID NO: 109210 - RNA, 64 nt, hsa
acuugagcucaggaauucgagaccagccugggucacauagcaagaccccgucucuacaaaaaau

SEQ ID NO: 109211 - RNA, 64 nt, hsa
gguauauacgugugguucauccaucaucugcugcacauagcagacuagaauucugggaacccug

SEQ ID NO: 109212 - RNA, 64 nt, hsa
gcugagaucgcaccacugcacuccagccugggcaacauagcaaaauccugucucaaaaaaaaag

SEQ ID NO: 109213 - RNA, 64 nt, hsa
accugaggucaggaguucaagaccagucuggccaacauagcaaaacccugucucuacuaaaaau

SEQ ID NO: 109214 - RNA, 64 nt, hsa
acuugagcccaggaguucgagaccagccuaggcaacauagcaagacccugucuguacacaaaau

SEQ ID NO: 109215 - RNA, 64 nt, hsa
aagucuuagugaccaaacgugaccuugaaagcagacauagcaugacagaccuuccuagaguguu

SEQ ID NO: 109216 - RNA, 64 nt, hsa
gccucaggacaccucccagccagaaggcucugagacauagcagcaguauccucuccggaucugu

SEQ ID NO: 109217 - RNA, 64 nt, hsa
uuaugucauagaaacuguaugaacaaccagauuuacauagcagagaaaucauacauugaaugcu

SEQ ID NO: 109218 - RNA, 64 nt, hsa
ccuaauaaucuggaauauucuacauggcuugauuacauagcaaacaagaccaagauuuagggcu

SEQ ID NO: 109219 - RNA, 64 nt, hsa
gugccauccaaauuaauccugcauuugcagaugcacauagcaaucuggcuuccauucauaaggu

SEQ ID NO: 109220 - RNA, 64 nt, hsa
caaaugcacacacaugcacacacacauuuaagggacauagcaguaacacuguuuuuuaacaaca

SEQ ID NO: 109221 - RNA, 64 nt, hsa
cuaaggcuaguccuuuuauaaacaacuuuuucugacauagcauuuauguauaauaaaccagaca

SEQ ID NO: 109222 - RNA, 64 nt, hsa
cuuuuagcucaaaauguugagucauuuacauaugacauagcaugaaucacucuuuacagaaaau

SEQ ID NO: 109223 - RNA, 64 nt, hsa
ugcaaugucugucccuaaacauagugguauuuuaacauagcagcugguuaaccgggacuacaga

SEQ ID NO: 109224 - RNA, 64 nt, hsa
aaaucccuguuauuuugugaauugggacaagauaacauagcagaggaauuaauaauuuuuuuga

SEQ ID NO: 109225 - RNA, 64 nt, hsa
cagaggauuaagguuuuuuuagaaaugugaaacaacauagcaguaaaauacaugagauaaagac

SEQ ID NO: 109226 - RNA, 64 nt, hsa
uuagcuucagguugucuuguuucuguauauagugacauagcauucugcugccaucuuagcugug

SEQ ID NO: 109227 - RNA, 64 nt, hsa
uggaaaagcagcuaacauuucuugaggcucuaccacauagcaggcacugucacagaguaauggc

SEQ ID NO: 109228 - RNA, 64 nt, hsa
ggggacauucuacugugcuaaaaagccacugcagacauagcaauaaaaacaugucauuuuccaa

SEQ ID NO: 109229 - RNA, 64 nt, hsa
auaauuauugcaccacugaacuccagccugggccacauagcaagacccugucuccaaaaaaaaa

SEQ ID NO: 109230 - RNA, 64 nt, hsa
uaauuaaggaaguaguccuugcacuucuaaucuuacauagcauccauacuuagaauuuggcaua

SEQ ID NO: 109231 - RNA, 64 nt, hsa
cuugagguuaggaguuugagaacuggccuggccaacauagcaaaaccucaucucuacuaaaaua

SEQ ID NO: 109232 - RNA, 64 nt, hsa
uuugcuuccucgguuuuuucaaaaauauauauacacauagcaauguccuccuccccauguccuc

SEQ ID NO: 109233 - RNA, 64 nt, hsa
accuccugaguaauaagcauggugucaguuuuguacauagcaaauaaaauaaaugaaaucugaa

SEQ ID NO: 109234 - RNA, 64 nt, hsa
ucauaauuguuaaaaaucuguguuccaaaaguggacauagcauguacaggcaguuuucuguccu

SEQ ID NO: 109235 - RNA, 64 nt, hsa
auccaccuucuuccuuagguccccuccuccaucagcaaaggagcacuucucuaaucaugcccuc

SEQ ID NO: 109236 - RNA, 64 nt, hsa
gaguaaaaaacaugaccugguagaaggaagagaggcaaaggaaacuggguggggaggaucaauu

SEQ ID NO: 109237 - RNA, 64 nt, hsa
aauugaaaguuuaaagagggggaagaguugguuugcaaaggaaaaguuuaaauagcuuaauauc

SEQ ID NO: 109238 - RNA, 64 nt, hsa
cugaggaugagaaguaagcaaacuguggaaacaugcaaaggaaaaagugauagaauaauauuca

SEQ ID NO: 109239 - RNA, 64 nt, hsa
cacucugugaagccagcaucuaggggcuaaagaugcaaaggaaagcagcaugcauugucuguac

SEQ ID NO: 109240 - RNA, 64 nt, hsa
cuuagaauggggcuaagggaagugcugaaauagagcaaaggauggaagauaauauagacuacca

SEQ ID NO: 109241 - RNA, 64 nt, hsa
ggaccaggucuucuugcugaccucgucuacaaaggcaaaggaaggcaaaggaagcugucucggg

SEQ ID NO: 109242 - RNA, 64 nt, hsa
uucuugcugaccucgucuacaaaggcaaaggaaggcaaaggaagcugucucggguguuucugaa

SEQ ID NO: 109243 - RNA, 64 nt, hsa
ugaaggcagaaagcaaaauuauguuugccacuuugcaaaggagcucacuguggugucuguguuc

SEQ ID NO: 109244 - RNA, 64 nt, hsa
uaggcgaaucauuuguucaaagcuguuggccucugcaaaggaaauaccaguucugggcaaucag

SEQ ID NO: 109245 - RNA, 64 nt, hsa
accuguaaauugauucaagugagccaggaaagcagcaaaggaaagagaaaccugagugacgacg

SEQ ID NO: 109246 - RNA, 64 nt, hsa
caagucauaccuacauucaaggagaggggaccaugcaaaggauaaacugcaggugaagaacuug

SEQ ID NO: 109247 - RNA, 64 nt, hsa
cuuuuagugcuggcccucucuguggguguggccugcaaaggaaccaacagacccuaugcugggg

SEQ ID NO: 109248 - RNA, 64 nt, hsa
agguucaaaaggaagugccucaaagcaaaggcaagcaaaggaaccccacgaugaacuugcucuu

SEQ ID NO: 109249 - RNA, 64 nt, hsa
auaauauuuaaugugugaacagcuacugugacaugcaaaggaaaggacagugcagaauuaaacc

SEQ ID NO: 109250 - RNA, 64 nt, hsa
ugaucuuuaaauuuucccacaccauaagagaggagcaaaggaaauuaccaguuuagacuaaguu

SEQ ID NO: 109251 - RNA, 64 nt, hsa
augcuggaucucauagaaaauucacagccagacaaucuucuaaucuggagucuuugagaucuuc

SEQ ID NO: 109252 - RNA, 64 nt, hsa
cagccagacaaucuucuaaucuggagucuuugagaucuucuaccccaacucaucauuuuccuau

SEQ ID NO: 109253 - RNA, 64 nt, hsa
uucccaccauucacugacucauuaggagauaggcaucuucuaaagauuuuuuuuauauugugua

SEQ ID NO: 109254 - RNA, 64 nt, hsa
uuuucauagcuguaguccauucuaauaauuucugaucuucuaguggcuacuuaauuagacauua

SEQ ID NO: 109255 - RNA, 64 nt, hsa
aguuuauaaaguggaaguauuaggagauucauaaaucuucuauauugagaauuggcuauguuaa

SEQ ID NO: 109256 - RNA, 64 nt, hsa
uaaaaauauagaaauaaugucagaucagagucugaucuucuauguuuguauuuaaauggauuaa

SEQ ID NO: 109257 - RNA, 64 nt, hsa
cuugggacucucgucugcacugcguguccucugaagcagugaagucugugccuaugccgagcgc

SEQ ID NO: 109258 - RNA, 64 nt, hsa
guaacuggcaaguuaccaagguuguuccugaaacagcagugaucaugacuucuccuuuccagag

SEQ ID NO: 109259 - RNA, 64 nt, hsa
gaacuguacagaucagcagagcaggacaguuggcagcagugaccucaguagggaacauguccgu

SEQ ID NO: 109260 - RNA, 64 nt, hsa
ugugccuggggcauggacuuuguuaagcagagucagcagugagguccucauucuccagccagcc

SEQ ID NO: 109261 - RNA, 64 nt, hsa
gugugggaauauccuaagugguagccuuccaaguagcagugaguugacauucagcugcuuuuaa

SEQ ID NO: 109262 - RNA, 64 nt, hsa
aggucuaaaaaugagggcaaaacacuaaggcucuagcagugacuuguucacuaaaaagagagag

SEQ ID NO: 109263 - RNA, 64 nt, hsa
gacgacacggccucgcagcaaagugugucagacgagcagugacgggcgugcggccgggcgggga

SEQ ID NO: 109264 - RNA, 64 nt, hsa
cuuggucgcccuuucuuaccaucugagccgucagagcagugacccaucuguacucaugugagug

SEQ ID NO: 109265 - RNA, 64 nt, hsa
agcuuccuggcucugggggacccaggugggacuuagcagugaguauuggaagacuuggguugau

SEQ ID NO: 109266 - RNA, 64 nt, hsa
cguuugaaagauaauuaagaucccccguggagaaagcagugacacauucacacagcuguucccu

SEQ ID NO: 109267 - RNA, 64 nt, hsa
aucaagauccuguucugagucagaugaugaugacagcagugaaacuccuccucacuggaaagag

SEQ ID NO: 109268 - RNA, 64 nt, hsa
acaguguaguagaucaucuucauauacuucuauuagcagugaugauggaaggcgagcuaagagg

SEQ ID NO: 109269 - RNA, 64 nt, hsa
ggauuccaucauugaaaauuuugacccaaggcacagcagugaaauuuauaguucucaauuuagu

SEQ ID NO: 109270 - RNA, 64 nt, hsa
auucacugugguacauuuuaaaauaaaauauuuuagcagugaauauggauuaagguguuuuggg

SEQ ID NO: 109271 - RNA, 64 nt, hsa
acauguuagguaccgugcucugcuguggagacagagcagugaccccaaggagcucacggucccu

SEQ ID NO: 109272 - RNA, 64 nt, hsa
agaaaacuguucagucacagauauauucuugccuagcagugaagugccuuuauuuucagcauag

SEQ ID NO: 109273 - RNA, 64 nt, hsa
ccucucagcaugagguggagcagugaccagguggagcagugaccaggacgccucuggcccagug

SEQ ID NO: 109274 - RNA, 64 nt, hsa
guuugacacacaggcuccucucagcaugagguggagcagugaccagguggagcagugaccagga

SEQ ID NO: 109275 - RNA, 64 nt, hsa
acaaugcgcuuuagacauauuucuuuaaaaugcaagcagugagaaauaagaccucucugaauua

SEQ ID NO: 109276 - RNA, 64 nt, hsa
accacucuggccucuguuucccccaccaacggggagcagugacauuuaccucccucacagaguc

SEQ ID NO: 109277 - RNA, 64 nt, hsa
uaugugccaguuccuguaacagguguggggacacagcagugaguaaucaauacagacaagguuc

SEQ ID NO: 109278 - RNA, 64 nt, hsa
uccccuauugcgcucucaagaccagagacccaacagcagugaucucagggcagacagcccucca

SEQ ID NO: 109279 - RNA, 64 nt, hsa
cucuuaugacauuauaucuugugccuuucuccucagcagugagcagugagcuacuccuggccca

SEQ ID NO: 109280 - RNA, 64 nt, hsa
gacauuauaucuugugccuuucuccucagcagugagcagugagcuacuccuggcccaggcccua

SEQ ID NO: 109281 - RNA, 64 nt, hsa
ccccaugaacauuuguccuaacucagauuuugugagcagugaaguuuaacagagcagugacauu

SEQ ID NO: 109282 - RNA, 64 nt, hsa
uaacucagauuuugugagcagugaaguuuaacagagcagugacauuuaacaaagcagugaaguu

SEQ ID NO: 109283 - RNA, 64 nt, hsa
cagugaaguuuaacagagcagugacauuuaacaaagcagugaaguuuaacagaguucugagaau

SEQ ID NO: 109284 - RNA, 64 nt, hsa
gguaguggcgugcaucugaucugagaggcaguaaagcagugaugaagacagugcagcagaacau

SEQ ID NO: 109285 - RNA, 64 nt, hsa
agacagugcagcagaacauugaaguccugauugcagcagugacucugcaaccuuggauaaauua

SEQ ID NO: 109286 - RNA, 64 nt, hsa
gagcucccugcggccacuccugaacaaggacaugagcagugaggagcagucccucuacuacagg

SEQ ID NO: 109287 - RNA, 64 nt, hsa
ugaugaggaggagaucaacaccgaucacaaugaaagcagugaagugagccagucagagggagag

SEQ ID NO: 109288 - RNA, 64 nt, hsa
aaaguuguuuguuggacuccauaagugaauuucaagcagugaggauuuuguggugccugagaug

SEQ ID NO: 109289 - RNA, 64 nt, hsa
ucccugcaguagccacggccaggcccuuaggaggagcagugaccggggguguccagaaauaucc

SEQ ID NO: 109290 - RNA, 64 nt, hsa
uauucaagugcauuaaagucuacaauggaaaaaaagcagugaagcauuagaugcugguaaaagc

SEQ ID NO: 109291 - RNA, 64 nt, hsa
ugauaggauaguuagugaggauuauuaaccucugagcagugauauagcauaauaaagccccggg

SEQ ID NO: 109292 - RNA, 64 nt, hsa
aaauugagugagaaggaaacacuuguuuuauucacagagguaaagugucuuuucaauauaacca

SEQ ID NO: 109293 - RNA, 64 nt, hsa
aguuuugaaaucaaagacuauuaaaggagcuguacagagguaaaaaaauaaauguggaacauua

SEQ ID NO: 109294 - RNA, 64 nt, hsa
ccugcuucauuguccauccccugggggagugggucagagguacuggagggugcugagccgaagg

SEQ ID NO: 109295 - RNA, 64 nt, hsa
ggaaaaccggaggagcaauuggggauccaggugucagagguaggggaaccaggggcaagcuggg

SEQ ID NO: 109296 - RNA, 64 nt, hsa
gugccagagauggcugugccggaggugcggcuuccagagguacagcugccgaaagugucagaga

SEQ ID NO: 109297 - RNA, 64 nt, hsa
gugccagagauggcugugccggaggugcggcuuccagagguacagcugcugaaagugucggaga

SEQ ID NO: 109298 - RNA, 64 nt, hsa
gugccagagauggcugugccggaggugcggcuuccagagguagagcugcccaaagugucagaga

SEQ ID NO: 109299 - RNA, 64 nt, hsa
gauggcaggaugggcacugccgagaacagcauuggucccagagcccugggcaucagaccuuaac

SEQ ID NO: 109300 - RNA, 64 nt, hsa
uccccaccaauccccgccacagcaggcgccucgggucccagaugucugcagcccucagcagcug

SEQ ID NO: 109301 - RNA, 64 nt, hsa
agcagcuuucugguucuugugauuguauccugaggucccagaacccuauucucccacgaggauc

SEQ ID NO: 109302 - RNA, 64 nt, hsa
cugagcugccggucuuggcuuccuggucgccucugucccagagauggucccagggagccauccu

SEQ ID NO: 109303 - RNA, 64 nt, hsa
cauuuuaggauaccuuuacuuuaaggaccacacagucccagaggacacaucccucgggaacucu

SEQ ID NO: 109304 - RNA, 64 nt, hsa
cugaugggagcugcuucucccccaugccucacuggucccagaucagggcuccagggacagauga

SEQ ID NO: 109305 - RNA, 64 nt, hsa
cagucacaacugccauuuccagucucugcugagugucccagacccucgaggcugccacuccguc

SEQ ID NO: 109306 - RNA, 64 nt, hsa
ggugagcuuaaagaacaaccaaacucugccaggggucccagaaagcccaggguccagcagucuc

SEQ ID NO: 109307 - RNA, 64 nt, hsa
uuugggcgucauucacccacuaccccuagugcuagucccagaggaugcugcggagggggcagcc

SEQ ID NO: 109308 - RNA, 64 nt, hsa
gcuggcugggcuuccuguuuccagaugcauuccugucccagagucaccacagagacuguuugga

SEQ ID NO: 109309 - RNA, 64 nt, hsa
ggcugacacaugggguaugccgggcacugggcaggucccagagccggggaaccagcucaccucu

SEQ ID NO: 109310 - RNA, 64 nt, hsa
gugggccugaugaaagcuuccugaguggugucgggucccagagagggagcccaccugcugccug

SEQ ID NO: 109311 - RNA, 64 nt, hsa
gagucuacuuggcccuagaagagaaaguugaagagucccagaccuacuagcauuuugcaacuau

SEQ ID NO: 109312 - RNA, 64 nt, hsa
aguuccguggguuuccccuuugauucuguaaauagucccagagagaauucgugggcugagggca

SEQ ID NO: 109313 - RNA, 64 nt, hsa
gaggaaagccgucucccugcuugacucgacugcugucccagaggagaguccugugcgaccugag

SEQ ID NO: 109314 - RNA, 64 nt, hsa
uuuacucgcaacaacuuaauuucuaaggguccaagucccagagaauccauagucgucaaagcuu

SEQ ID NO: 109315 - RNA, 64 nt, hsa
gauguguccugauaagcugagcuccuuagccuuugucccagaaugccuccugcagggauucuuc

SEQ ID NO: 109316 - RNA, 64 nt, hsa
uggaccuuuccugaggaagagggacuguucuuuugucccagaaaagcaguggcuccauuggugu

SEQ ID NO: 109317 - RNA, 64 nt, hsa
gggcagcccauuucucaaaguccagaaaauuagggucccagaagggggcagcagcaggcuggga

SEQ ID NO: 109318 - RNA, 64 nt, hsa
gcuggggguccagcacaggcuguaucugcagagggucccagaggaacgcuggagccaagagaag

SEQ ID NO: 109319 - RNA, 64 nt, hsa
gcgggcagggggugaccccuggagcuaguugcgugucccagaauggaggguguucugacacccc

SEQ ID NO: 109320 - RNA, 64 nt, hsa
cccccgugcuggcggagcggacgccgcgcucugggucccagaggggccggguggcucagacgac

SEQ ID NO: 109321 - RNA, 64 nt, hsa
cugcacugcuacccucuauuucccacucagggcugucccagagagaaggcagccgaacugagga

SEQ ID NO: 109322 - RNA, 64 nt, hsa
gagacagagacuuuguggaaguaucucugagggagucccagacacaggcagagagggccacaua

SEQ ID NO: 109323 - RNA, 64 nt, hsa
cgaugugcaccucccggaagugcagcucccgaaagucccagagaugaaacucccuaaaaugccu

SEQ ID NO: 109324 - RNA, 64 nt, hsa
cgaugugcaccucccagaagugcagcuuccaaaagucccagagaugaagcucccugagaugaaa

SEQ ID NO: 109325 - RNA, 64 nt, hsa
guagccaaggucagcccugaggccagggugaaaggucccagacuucgaaugcccaccuuugggc

SEQ ID NO: 109326 - RNA, 64 nt, hsa
aauccgggcaggacccucgaagaggagaccgagggucccagaggaccaaugcuacaagccagca

SEQ ID NO: 109327 - RNA, 64 nt, hsa
uuccccuagugaccccccccccacuucaccccaugucccagagccucagaacccacccucccug

SEQ ID NO: 109328 - RNA, 64 nt, hsa
gauuuucuuacagcgaagacuugaguuccuccaagucccagaaccccaagaaugggcaagaagg

SEQ ID NO: 109329 - RNA, 64 nt, hsa
gugcagcugugaagcucgggcugauucccccucugucccagaagguuggccagagggugugacc

SEQ ID NO: 109330 - RNA, 64 nt, hsa
agggucuguguucuccaggagaaugaggguguuggucccagaauugggaccggggccccgcugg

SEQ ID NO: 109331 - RNA, 64 nt, hsa
gguguugacccagggauggggcuggguaguuggggucccagaaagccggggguaggggccaccc

SEQ ID NO: 109332 - RNA, 64 nt, hsa
accagguaccccguaggaauuuccaguuucccuugaucuagaugggauucuuauaaaaauucaa

SEQ ID NO: 109333 - RNA, 64 nt, hsa
gaagggccacaggcccgcuaagccccaaaggcaggaucuagaugaugaugaacaugauuaugaa

SEQ ID NO: 109334 - RNA, 64 nt, hsa
cccuuuaaaaacuaacccacugaauauuccgugugaucuagaacaguguggcagcuuucacagc

SEQ ID NO: 109335 - RNA, 64 nt, hsa
ggcugaguguacuaguaguuaagagaauaaacuagaucuagaaucagagcuggauucaauuccu

SEQ ID NO: 109336 - RNA, 64 nt, hsa
guggguuuuggcauauuagauagagaaaaugacagaucuagaugaagggagcuuuuggaugugu

SEQ ID NO: 109337 - RNA, 64 nt, hsa
ugccuucuuucacccuguccugauagacuucccugaucuagauauccuucgucaugacacuucu

SEQ ID NO: 109338 - RNA, 64 nt, hsa
gagagagguucuggggaggaagggccaggagagagaucuagaaaguggguucacuagagcuggg

SEQ ID NO: 109339 - RNA, 64 nt, hsa
ugaggagaaaauauauagcuuuggacacgaggaagaucuagaaaauuaucauugaacauauuaa

SEQ ID NO: 109340 - RNA, 64 nt, hsa
uuuuuuucauaauauucucauagaguuucugcuagaucuagagcucugcucagugccucuuaua

SEQ ID NO: 109341 - RNA, 64 nt, hsa
uuuuguccucuuugcuuccccaaggcuaaagucagaucuagaguucugccacaggucuaacaau

SEQ ID NO: 109342 - RNA, 64 nt, hsa
ugaacugaccucuaaagcagcgugagaugggaaugaucuagaaaacuuuggauuuuugaaguaa

SEQ ID NO: 109343 - RNA, 64 nt, hsa
ccgcagagggagcaggaagagaugcugauaguuugaucuagaaaccagcagcuacuggcucaaa

SEQ ID NO: 109344 - RNA, 64 nt, hsa
ucuucuuccuucuuggccuaacucuuccaguuaggaucuagaacuuugccuuuuuuuuuuuuuu

SEQ ID NO: 109345 - RNA, 64 nt, hsa
auuuuugcagauucuuggcuggguuuaguguacugaucuagaaaagcuguuuuucugcuccuuu

SEQ ID NO: 109346 - RNA, 64 nt, hsa
cuuuuugaaagucuaccuucuaaauugccccgacgaucuagauucuacauguuaccauugguuu

SEQ ID NO: 109347 - RNA, 64 nt, hsa
ggaucucaagcuaaagcaaaccaucuuauacagagaucuagaaucuuauauuuuccauaggaag

SEQ ID NO: 109348 - RNA, 64 nt, hsa
ugauuucaagcuaaagcaaaccaccuuauacagagaucuagaaucucuuuauguucuccagagg

SEQ ID NO: 109349 - RNA, 64 nt, hsa
agauugcaucuguguagaaguaaugcagguacaagaucuagaguuuuuccuuagacucuuuagu

SEQ ID NO: 109350 - RNA, 64 nt, hsa
ggacuuagcuuccugauacuagguagugaugguggaucuagagacauucacuugaagagcaagg

SEQ ID NO: 109351 - RNA, 64 nt, hsa
uuuuguaugaagcaugccucaguuuccucauuuugaucuagauauaaaauuaaaauuguccauu

SEQ ID NO: 109352 - RNA, 64 nt, hsa
caaaaugucacugccagaaagagcuguuccagcugaucuagagcauacugcccuagaguguccc

SEQ ID NO: 109353 - RNA, 64 nt, hsa
aagauuauuugaucagaauauuuuguaaugaaaggaucuagaaagcaacuuggaaguguaaaga

SEQ ID NO: 109354 - RNA, 64 nt, hsa
aucucaucauccugaagccuauaaugaagaaaaagaucuagaaacugaguuguggagcugacuc

SEQ ID NO: 109355 - RNA, 64 nt, hsa
ugggugugugucugcacccacauccucacacauugaucuagaucugccuuuauccacucgaauu

SEQ ID NO: 109356 - RNA, 64 nt, hsa
uacgucauugucucaaguguggcuguaaaaaucagaucuagaguuuagagacauacuuguuaac

SEQ ID NO: 109357 - RNA, 64 nt, hsa
uucaucucagcuuuugaugguacugaugagucuugaucuagauacaggacugguuccuuccuua

SEQ ID NO: 109358 - RNA, 64 nt, hsa
gccugauaacccaugccaggucuuauagauuccugaucuagaaccuuuccaggcaaucucagac

SEQ ID NO: 109359 - RNA, 64 nt, hsa
ggcagauuugcauauuucauacccagguaucugggaucuagacaucugaauuugaucucaaugg

SEQ ID NO: 109360 - RNA, 64 nt, hsa
gauuuauuuuguuuguaauuaguuauuauaagaagaucuagauccuagauauuagaauaaaauu

SEQ ID NO: 109361 - RNA, 64 nt, hsa
uagaaaugagaaaaauacagaguuuuagaaaugagaucuagagaacacgucuucuaaaaggggc

SEQ ID NO: 109362 - RNA, 64 nt, hsa
agccucaagugagggucaaauucaacauuauccugaucuagacagcccccauucucaauccacc

SEQ ID NO: 109363 - RNA, 64 nt, hsa
uuuauauagaccuauccucuaaauaugugacaaggaucuagaaauucugagaggggaaaaugug

SEQ ID NO: 109364 - RNA, 64 nt, hsa
agcacaggcuuuuucaggugcuuuccccaagauagaucuagauauuagcuagugaaaugcuaaa

SEQ ID NO: 109365 - RNA, 64 nt, hsa
cguuguuuucugccauuuaucccaaacuuuuucagaucuagaauucgagagugucauggacaaa

SEQ ID NO: 109366 - RNA, 64 nt, hsa
ggguguguuacuauauuaaaauacacacacaacugaucuagacaucaagaggaagaaaaaugau

SEQ ID NO: 109367 - RNA, 64 nt, hsa
uugcucuccauuuugacguuaaaaaacaacaacagaucuagagauaccucaaggauaucauuuu

SEQ ID NO: 109368 - RNA, 64 nt, hsa
uccacugugagaucuacagggaagccaaaagaaugaucuagaguauguugaagaagauggacau

SEQ ID NO: 109369 - RNA, 64 nt, hsa
auucacauacacauauguauauacaggcugacuugaucuagaacauuaaauccgcccugcaagu

SEQ ID NO: 109370 - RNA, 64 nt, hsa
aucuggucauguuggucaaaagcuggauuauuuagaucuagaaacagaucuugaaaucugaaug

SEQ ID NO: 109371 - RNA, 64 nt, hsa
cuugucuccuuaaagaaaaaguuugccagcuccugaucuagaccaagagggagauauugaccuu

SEQ ID NO: 109372 - RNA, 64 nt, hsa
augggcacccaugugcuggcacagaacaguuccagaucuagacuggagagguccacagccuugu

SEQ ID NO: 109373 - RNA, 64 nt, hsa
aaaggcuguaaucagcagacuggaagcugaggaagaucuagaaguaaaagaaaaaauuagaugc

SEQ ID NO: 109374 - RNA, 64 nt, hsa
gggaggccaaggcgagcggaucaugaggucagaagaucuagaacagccuggucaacauggugaa

SEQ ID NO: 109375 - RNA, 64 nt, hsa
uucucuguucauacagcaaguauggaaaaaagaugaucuagaagucaacuaucucaaccuccau

SEQ ID NO: 109376 - RNA, 64 nt, hsa
cauccuucaaaggacaguguuguuuugaccgggagaucuagagagugcucagaauuagggccug

SEQ ID NO: 109377 - RNA, 64 nt, hsa
uuucuacuuugucuuugaacugaaaauaaacauggaucuagaaaaccaaccagcaaguuuucag

SEQ ID NO: 109378 - RNA, 64 nt, hsa
ccauaauucucuuuggugcaggucuugggagcgugaucuagauuacacugcaccauucccaagu

SEQ ID NO: 109379 - RNA, 64 nt, hsa
aacguccauuaagcugagagugcuaugaagacaggaucuagaauaaucuugcucacagcugugc

SEQ ID NO: 109380 - RNA, 64 nt, hsa
guccuggguuaggcaccugagauugacaugaugggaucuagaucuuuccuccuugacaucaccu

SEQ ID NO: 109381 - RNA, 64 nt, hsa
caaguaaaggcugaggacuccucuuuaauccucagaucuagauaacucaugacauuuuauuuga

SEQ ID NO: 109382 - RNA, 64 nt, hsa
gucaggccuuugcaguaggcuugagugaacuucugaucuagauuugaaaguaaauuuuaugaag

SEQ ID NO: 109383 - RNA, 64 nt, hsa
acaccguugacaagaaggcugaguuuacauaaaugaucuagauugaaacucagcuaccuuucuu

SEQ ID NO: 109384 - RNA, 64 nt, hsa
uuguagguagcccuuacuacacucaacugauugggaucuagaauguaacuaaauugcuuauaaa

SEQ ID NO: 109385 - RNA, 64 nt, hsa
cagggguggggaauguuugggcagaagggagaaggaucuagaauguguuuucugaauaacauuu

SEQ ID NO: 109386 - RNA, 64 nt, hsa
accuugucuuucaaaagaacucagaauccuccaggaucuagaagaaggaagaaaguguguaaau

SEQ ID NO: 109387 - RNA, 64 nt, hsa
uggaaaguuaccauaugauaauuuuuaauugugugaucuagacaugccuuagguaacugcagaa

SEQ ID NO: 109388 - RNA, 64 nt, hsa
gauacauacuaaaguauuuguaaauaaaugacaugaucuagaaucaguaauuuuguguuugggg

SEQ ID NO: 109389 - RNA, 64 nt, hsa
ccccaaggagccuggcacugauuggcaucacauugaucuagaacugguccagccgacgaagagu

SEQ ID NO: 109390 - RNA, 64 nt, hsa
aguccaaaauguuggaaauaaaauauaagacauugaucuagauaugagguuuuucuccuucauu

SEQ ID NO: 109391 - RNA, 64 nt, hsa
gcccucagagagguuccagucuagaugaggagcugaucuagacagguaaaaggcuaacuaaccc

SEQ ID NO: 109392 - RNA, 64 nt, hsa
uggacugcacacuuccaccauagcuugcuggguugaucuagaugucuguuuguuguauggaaau

SEQ ID NO: 109393 - RNA, 64 nt, hsa
ucaucaauguucaguucaaaagccugaaaguuuagaucuagaagcugguaaaaaugacaauauc

SEQ ID NO: 109394 - RNA, 64 nt, hsa
auuuccuuaaaauaauugugauucuagguccuaggaucuagaauuagaucuuuguauuuuuaau

SEQ ID NO: 109395 - RNA, 64 nt, hsa
ugagaaacuuuauacuucaguuuucagauauauggaucuagaucccaaauaaaugauuaaucuu

SEQ ID NO: 109396 - RNA, 64 nt, hsa
aaaaugucuuacacggcuguaauugagaaauacugaucuagagucauuuccugcuucuuaaauu

SEQ ID NO: 109397 - RNA, 64 nt, hsa
ccauuccccagcaugaaugugccuuuuaauuagugaucuagaaagaaguucagccgaacccaca

SEQ ID NO: 109398 - RNA, 64 nt, hsa
cugguuucagcccaggacccaccacugaggagaggaucuagacaggugggccuaauuccaaggg

SEQ ID NO: 109399 - RNA, 64 nt, hsa
uuaucuaggguuguagcuuuugauacaacuccccgaucuagauuuauuccuacauucugaaugg

SEQ ID NO: 109400 - RNA, 64 nt, hsa
ggaauguauguaacuagguaggguuccuuucuuagaucuagaggaaguacagccacccacugac

SEQ ID NO: 109401 - RNA, 64 nt, hsa
ucugguuaaaauuauauugacugguggccuuagggaucuagaaacuucuacuaaacagagaaau

SEQ ID NO: 109402 - RNA, 64 nt, hsa
auccuucccaaaaaucagugucuagggacugguugaucuagaugaguuauaaaugguauuugac

SEQ ID NO: 109403 - RNA, 64 nt, hsa
cuggauucacagcucugucacuuaauugcuacaugaucuagagccaguuacuuuguguuucagc

SEQ ID NO: 109404 - RNA, 64 nt, hsa
auggaugaauugggguaaauaagguuuuaauucagaucuagaagaaaguauuguacguuugaau

SEQ ID NO: 109405 - RNA, 64 nt, hsa
ugguuuguguuuugagguacaaaaaaaugcugcagaucuagaaaugcauauauuuagcggguau

SEQ ID NO: 109406 - RNA, 64 nt, hsa
acagucuccucaugagacauagccuaaucaauuagaucuagaauuggaaaaauugucccgucug

SEQ ID NO: 109407 - RNA, 64 nt, hsa
gguauguuuuucuuuuuuaaaaaagcugcuguuggaucuagaaggugaagaauuuuuuuaugua

SEQ ID NO: 109408 - RNA, 64 nt, hsa
acugaggugcaaagcaguuaagcaacugguccaagaucuagaccagguacucaaccaccccacu

SEQ ID NO: 109409 - RNA, 64 nt, hsa
aauccuguuauccuguguauuuacuaguccucaugaucuagacuuaaccccuuuucuguguuac

SEQ ID NO: 109410 - RNA, 64 nt, hsa
uuuuauuaaaaaauauauauauguauaaauaaaugaucuagauauuuuccucuuuuucugaagc

SEQ ID NO: 109411 - RNA, 64 nt, hsa
ccuugggccuggccagucuuccucuuagccucuggaucuagaagggaccauaagaggaguaggc

SEQ ID NO: 109412 - RNA, 64 nt, hsa
gacugcaugcuacugucuagagcuugucucaauggaucuagaacuucaucgcccucugaucgcc

SEQ ID NO: 109413 - RNA, 64 nt, hsa
uagaauucuuuauugguggcccuacuauggugaugaucuagaacugacuuacuucaggacagaa

SEQ ID NO: 109414 - RNA, 64 nt, hsa
cuuccauucauaaggagacucaaugauuuuaauugaucuagacagaauuauuuaaguuuuauca

SEQ ID NO: 109415 - RNA, 64 nt, hsa
uucuuuuuugguuucuuggcuuuccgaaggccaugaucuagagauagaaaaaucccuacuaagu

SEQ ID NO: 109416 - RNA, 64 nt, hsa
ccuugguuauuacuuucaauugaaaguucuaugggaucuagaaaugagacauacuggcauggag

SEQ ID NO: 109417 - RNA, 64 nt, hsa
uguaaacuauagacucuacuguaguacauuucaggaucuagaaguuuuacuuuuauaaagaugg

SEQ ID NO: 109418 - RNA, 64 nt, hsa
guucuuguuugaaaauacuguaguucaggcucuugaucuagauggcagauaggaacuuucuugu

SEQ ID NO: 109419 - RNA, 64 nt, hsa
uaauuuuccuuuugagguugugggcauaagugcugaucuagaauacagucugggucccacacug

SEQ ID NO: 109420 - RNA, 64 nt, hsa
uuauauuuauguuuuauuucuauuuggacucagagaucuagacccaauaauuaguaggcuccug

SEQ ID NO: 109421 - RNA, 64 nt, hsa
cuguccuuuuccacugaagaaggaaagacguuuugaucuagaaauagcguugugauuuccuugc

SEQ ID NO: 109422 - RNA, 64 nt, hsa
gaauuccugucuucuuuaggaguaaugauucauagaucuagauagguggaaauaucauucaaaa

SEQ ID NO: 109423 - RNA, 64 nt, hsa
ucgaaaauugacauaguagcauugaggauacucugaucuagaaagccaaguauuugagcaacau

SEQ ID NO: 109424 - RNA, 64 nt, hsa
gauagaacagacuuuacuuuucuagcccagcauugaucuagaagcagaggaaucccagcgccuu

SEQ ID NO: 109425 - RNA, 64 nt, hsa
aacagcuuuuucuaaggggagagcaagggggagagaucuagauugggugagggggacggggaug

SEQ ID NO: 109426 - RNA, 64 nt, hsa
aguuugguugcuggcuguaggaguuuuugugguugaucuagacagaugcuagauaaugaauaaa

SEQ ID NO: 109427 - RNA, 64 nt, hsa
uuguuaacuugcagauaaccagaugcaacgugaagaucuagacuggacccugguuugaugaacc

SEQ ID NO: 109428 - RNA, 64 nt, hsa
ggauuugaccccuuggcucucaaguguccccuuagaucuagaacugcuccuugguggccauuag

SEQ ID NO: 109429 - RNA, 64 nt, hsa
ggaagacacaauguuguuauuuauuacuccuugagaucuagauacacauaugguauaauucauc

SEQ ID NO: 109430 - RNA, 64 nt, hsa
uaaacucaacaaaugucaucaaauauguugaauugaucuagaaauuauuucauauauaaaucag

SEQ ID NO: 109431 - RNA, 64 nt, hsa
ccagcauccuuugcauuacuuuuuccuucaggaugaucuagagcagcauggagcuguugguaga

SEQ ID NO: 109432 - RNA, 64 nt, hsa
acauguuuuaguuugcuucaccuaaaauaaugcugaucuagagauagagaaauaggggugguua

SEQ ID NO: 109433 - RNA, 64 nt, hsa
gcaaauaccaaaggaauguaaaaaaaacucaggugaucuagaaguguuuauuuucuucccuucc

SEQ ID NO: 109434 - RNA, 64 nt, hsa
ccacagucucacugacuguuuuuguaugguccaugaucuagaauuuaaaaaaauuuuaaagggu

SEQ ID NO: 109435 - RNA, 64 nt, hsa
ucuacuaccugaucuccuccuaccacgacuuugggaucuagaggagcuuuggcuccggcuguga

SEQ ID NO: 109436 - RNA, 64 nt, hsa
uagaaugaggauguuggggaaaaucccggaucaggaucuagaagucuuggguccccgucccuac

SEQ ID NO: 109437 - RNA, 64 nt, hsa
gucugaggaggcugugacgcccuaugaccgcagagaucuagacagucguaacaguccccaggcu

SEQ ID NO: 109438 - RNA, 64 nt, hsa
ugaggaccagaaaaguugugucucccuuagaugagaucuagacgcccccaaauccuugagaugu

SEQ ID NO: 109439 - RNA, 64 nt, hsa
gagagaaagaaaaucugaagggccccuggccugagaucuagacaaccuagcugcgccaagaccu

SEQ ID NO: 109440 - RNA, 64 nt, hsa
ggaagagggaugaugggauggaaugggagggugggaucuagaugaccucuugaaauugucccag

SEQ ID NO: 109441 - RNA, 64 nt, hsa
cccugcucuaugcugacccuugucacugaacccugaucuagacuuauaugaauaaaugaaauua

SEQ ID NO: 109442 - RNA, 64 nt, hsa
gagggcuugcucuaaaucguuuagaggauaacaggaucuagagaugcucucugcuugacaacaa

SEQ ID NO: 109443 - RNA, 64 nt, hsa
ugcauuuucauuauuuggguaggugaccugcuuggaucuagacagcaucuguucaaaguuguag

SEQ ID NO: 109444 - RNA, 64 nt, hsa
aaacaauuuaaaaaucuuuuaagucuuuuucugugaucuagaacaagauaauauggcauuggaa

SEQ ID NO: 109445 - RNA, 64 nt, hsa
caugaccgcugacaccacucagagcuggaaccaagaucuagauaguccguagauagcacuuagg

SEQ ID NO: 109446 - RNA, 64 nt, hsa
acauuuucaauaaagaauauguauaaacuguacagaucuagaucuacaaccuauuucucuacuc

SEQ ID NO: 109447 - RNA, 64 nt, hsa
auuuucaaaauucaugacuugaagugcaaggacagaucuagauguuuguuuaccaagcuaugug

SEQ ID NO: 109448 - RNA, 64 nt, hsa; identical to SEQ ID NO: 109446

SEQ ID NO: 109449 - RNA, 64 nt, hsa
caacccacaaguagcuacgacugcaagcaccugccaccauaaagggcugcauuuugccaccaua

SEQ ID NO: 109450 - RNA, 64 nt, hsa
caagcaccugccaccauaaagggcugcauuuugccaccauaaagggcugcauuuuuuuaaaaag

SEQ ID NO: 109451 - RNA, 64 nt, hsa
cugaaaggcaggaguguuagcaucucgcuuuauccaccauaacguaaagaacugcggugugaua

SEQ ID NO: 109452 - RNA, 64 nt, hsa
uuagcaccuaaagaucugcaccccaaaccaaugucaccauaaagagggcacgaagaagaguggg

SEQ ID NO: 109453 - RNA, 63 nt, hsa
gggugacacgaggacacagggacagguucuaucaugggugacaccaggagagagggacagguu

SEQ ID NO: 109454 - RNA, 63 nt, hsa
gggugacaccaggacacagggacagguucugucaugggugacacgaggacacagggacagguu

SEQ ID NO: 109455 - RNA, 63 nt, hsa
aaaacaaguccaaaaagcacccacagagaggcaaugggugagacaggaauccccucacagugg

SEQ ID NO: 109456 - RNA, 63 nt, hsa
ccacacuccucauggaugucauguccuacuucaaugggugaggauacaacuagaagccagcag

SEQ ID NO: 109457 - RNA, 63 nt, hsa
auguugagaaguggaaaaaaacccagguucuagaugggugaaucaguuggguuuuguaaauac

SEQ ID NO: 109458 - RNA, 63 nt, hsa
ucucaagggccuagcuaucaugauacgaggcgaaugggugacggccgggcaggagcaggcaug

SEQ ID NO: 109459 - RNA, 63 nt, hsa
gguccccaggcuggaaagauggacagaggcccaaugggugaaggcuuugaagagcacacagaa

SEQ ID NO: 109460 - RNA, 63 nt, hsa
ucugcuugucucguccaggaagcguuagggcugaugggugacucagcaaggcagugucagagc

SEQ ID NO: 109461 - RNA, 64 nt, hsa
guauauacauaucaacauaacuauguugaugauucauaucaaauucucaaugcaggucauuacu

SEQ ID NO: 109462 - RNA, 64 nt, hsa
augaguuugacaugaaucaucaacauaguauauacauaucaacauaacuauguugaugauucau

SEQ ID NO: 109463 - RNA, 64 nt, hsa
acaauccaaaagggugcugcuggucauaagaacacauaucaacacauuuauuuauacuaaauaa

SEQ ID NO: 109464 - RNA, 64 nt, hsa
acuaaucccccauucucuaaucaccauuauuaaucauaucaagucaauuaguuugguuucacac

SEQ ID NO: 109465 - RNA, 64 nt, hsa
auauucaugcugucugaagauucagucacguuaccauaucaagcugaaaaugucaccacuaucu

SEQ ID NO: 109466 - RNA, 64 nt, hsa
aaccauuuugcaucccagaaauaaguggcacuugcauaucaacaauccuuuuuauaaccucuug

SEQ ID NO: 109467 - RNA, 64 nt, hsa
aaaagaauacacacuagagaaaaaccuuacaaaugugaagcaucugauaaauccugugaagcgu

SEQ ID NO: 109468 - RNA, 64 nt, hsa
uugauguugcuggucuggugucuuauuuccuaaagugaagcaucuuuuuuuaaaaaagaauuug

SEQ ID NO: 109469 - RNA, 64 nt, hsa
cgguugacccuacuguggauugguggguuucggggugaagcaaguucacuacagcaucaauaga

SEQ ID NO: 109470 - RNA, 64 nt, hsa
acucuuuggcuuuguuuguuuguuuucuucuucagugaagcagccuuacuauucauagaagggc

SEQ ID NO: 109471 - RNA, 64 nt, hsa
gaagugugggcaaccaaauguagguaaggaugaagaagaacaggaacucucacugguggcugau

SEQ ID NO: 109472 - RNA, 64 nt, hsa
uaugacauucuggaaaaggcaaaacuauagggaugaagaacagaucaguuguugucagguuuga

SEQ ID NO: 109473 - RNA, 64 nt, hsa
gcuacugcuacugauuuuggaggaaauuuuucuagaagaacaaaggucauauuugaggcaagcu

SEQ ID NO: 109474 - RNA, 64 nt, hsa
uguuugcugggaauuccugauucuuguuauauaagaagaacaaccuauuucgcucccagaaaaa

SEQ ID NO: 109475 - RNA, 64 nt, hsa
agaaucguacucauaaucagcucugcauacaucugaagaacaaaaacaucaacgucuuuugucc

SEQ ID NO: 109476 - RNA, 64 nt, hsa
acgggcgcuuuaaccaucagcugccucucgaauggaagaacagugguaauggauuaacauccua

SEQ ID NO: 109477 - RNA, 64 nt, hsa
accagaacaaaucacucauuuaaaaaguaauucagaagaacaguguggcaugaucagacuucua

SEQ ID NO: 109478 - RNA, 64 nt, hsa
uggcuuuggggaaaacucauauccccaugaaaaggaagaacaaucacaaauaaagugagaguaa

SEQ ID NO: 109479 - RNA, 64 nt, hsa
gagcucagaugaugaugauguuaguaguuuggaagaagaacaagaauuccacaugagaaguaaa

SEQ ID NO: 109480 - RNA, 64 nt, hsa
gaugucaauaggauggcaccuuggaaagaaaaaugaagaacaacuuuaucaaggaagcuaguau

SEQ ID NO: 109481 - RNA, 64 nt, hsa
aauggauaaaguaguguaauggauugacaaucaggaagaacagaauaacucaguuuuuuuucuc

SEQ ID NO: 109482 - RNA, 64 nt, hsa
ucucagcugggaagagaggaugcaagaccagacugaagaacacgguugaguccccagaaccaaa

SEQ ID NO: 109483 - RNA, 64 nt, hsa
ggucaggggaaggcaugggggggaccagaaaccagaagaacaaucaagacugcaaugaaaaaaa

SEQ ID NO: 109484 - RNA, 64 nt, hsa
auacaucuauggugaccacuuuugacaaaggaaugaagaacauacacuggggaaaagauaaugu

SEQ ID NO: 109485 - RNA, 64 nt, hsa
gagacccccgcccccgcaccuuccagacuuagcagaagaacaaacugaagaacagacccagcca

SEQ ID NO: 109486 - RNA, 64 nt, hsa
cccgcaccuuccagacuuagcagaagaacaaacugaagaacagacccagccagagaagcaggga

SEQ ID NO: 109487 - RNA, 64 nt, hsa
aauauuuaaguaaaaacaaaaugaugcauuuugagaagaacaaagugugcacucagcggcugga

SEQ ID NO: 109488 - RNA, 64 nt, hsa
uacucauucaaagcacauuguagauauucagagagaagaacaaauggcuggcuuggcaaauccc

SEQ ID NO: 109489 - RNA, 62 nt, hsa
gccuucuagcacacuuuuuuaaaugaauaaugguagccuaaacuuaauauuuuuauaaagua

SEQ ID NO: 109490 - RNA, 55 nt, hsa
agccaggagaaaauuuauaauucaaguagccuauuuuauaugcacaaaucugcca

SEQ ID NO: 109491 - RNA, 64 nt, hsa
gauagaucgggggaaaauggggccuucgaccccagcgggcuaccugaaccaaggcgucucuuua

SEQ ID NO: 109492 - RNA, 64 nt, hsa
gucaagagccugugguccagcaugccuggccugggcgggcuaccucugagaacggcugaaaugg

SEQ ID NO: 109493 - RNA, 64 nt, hsa
uggcuguccccguuccagaacuugcauacacugagcgggcuacagagcuagaaggcccugcagc

SEQ ID NO: 109494 - RNA, 64 nt, hsa
ucuaagaacucaccuccguuagcgcacugugucagcgggcuauggacaaggaagaauaguggca

SEQ ID NO: 109495 - RNA, 64 nt, hsa
ccccgggaccgcgcuagggcuccgaggagcuggggcgggcuaggaggaggggguaggugauggg

SEQ ID NO: 109496 - RNA, 64 nt, hsa
aagugucgggaguccuuacgcaaccuugacaugugcgggcuacugggguccaucggcagcggga

SEQ ID NO: 109497 - RNA, 64 nt, hsa
acuuuucucaucuguaaaaccaggcugaugccgugcgggcuaaugagccaauaaagcucacacu

SEQ ID NO: 109498 - RNA, 64 nt, hsa
aaaccaccaggcauccggcccuuaccggcaagcagcgggcuaacgggaggcugggcacagaggu

SEQ ID NO: 109499 - RNA, 64 nt, hsa
ccaggccaucugccugcucaugggguccuaaagcgcgggcuaagccugcaggaaagccggggcg

SEQ ID NO: 109500 - RNA, 64 nt, hsa
cauaagaaagcaucuaaacugaacugagagcacagcgggcuacccuggacaaaguaaaggugga

SEQ ID NO: 109501 - RNA, 55 nt, hsa
cacagcggaccauccaguagccaacgcgggcuaaaaccgaccggacaucuagcgg

SEQ ID NO: 109502 - RNA, 64 nt, hsa
caggagcugaggggugagggcuggggaccaugccgcgggcuaggucgggcccgugcaggccggc

SEQ ID NO: 109503 - RNA, 64 nt, hsa
uacuaucuugggagggagaagggauggagcaggagcgggcuaagagggcugcgggggccuugua

SEQ ID NO: 109504 - RNA, 64 nt, hsa
uggaaguccaguuuauuucugaaucaaaaaaugagcgggcuauugugcugccuuuaauaaaauu

SEQ ID NO: 109505 - RNA, 64 nt, hsa
caggcugccccucccugugggcucagggucuccugcgggcuaggcagccaggagcucuguccgc

SEQ ID NO: 109506 - RNA, 64 nt, hsa
cucccccggggacccccaggcugaggguucugccgcgggcuaccggccucugagugccuccagc

SEQ ID NO: 109507 - RNA, 64 nt, hsa
cgccccccgggaccuccgcgggugccgcccucgcgcgggcuagggggagguucucccagccuga

SEQ ID NO: 109508 - RNA, 64 nt, hsa
gacgaggagaacugagggcacguggggugcggcagcgggcuagggcccagggcagcuugcccgu

SEQ ID NO: 109509 - RNA, 64 nt, hsa
gacuaggcgggggagaaaggaagccuuucugagagcgggcuaggccggcacuggagaggccgga

SEQ ID NO: 109510 - RNA, 64 nt, hsa
ucccucacaccugugggcagggcagaacagccuggcgggcuacaguuuagcauggccuucuuga

SEQ ID NO: 109511 - RNA, 64 nt, hsa
augggaaugaggggcucugcaacugagcgaagcugcgggcuaggaggcuggaaagccauuuauc

SEQ ID NO: 109512 - RNA, 64 nt, hsa
auuauucugagcuuuuuggccuggagaagggagggcgggcuagaaggccaaaagaaggaugagg

SEQ ID NO: 109513 - RNA, 64 nt, hsa
cacuggagcacugauucggacacaccagggaccagcgggcuagucccagggcauggcccagcgg

SEQ ID NO: 109514 - RNA, 64 nt, hsa
cccccugaacccaccccccacggaaaccagcccugcgggcuaagcaggugcgaccccagcaaga

SEQ ID NO: 109515 - RNA, 64 nt, hsa
ccagaaccucucccuucuggagccacucugcacugcgggcuaaacauguuuccagugugauucc

SEQ ID NO: 109516 - RNA, 61 nt, hsa
ugaggacauaauguguaagagaggugagaagugcucccaagcagacacaacagcagcacag

SEQ ID NO: 109517 - RNA, 61 nt, hsa
caaauccuacucccucagccucaggcaguggugcucccaucuuccuccccacaacugugcu

SEQ ID NO: 109518 - RNA, 61 nt, hsa
gugcucaggcuggugccagccuuucagacccugcucccagggacuuggguggaugcgcuga

SEQ ID NO: 109519 - RNA, 61 nt, hsa
acugugguagaaggaagacagaacucacacaugcucccaggauuggggacagggacagagg

SEQ ID NO: 109520 - RNA, 61 nt, hsa
aaggccuggagacugggggcccagcagagccugcucccacccuccucccagcagcagacac

SEQ ID NO: 109521 - RNA, 61 nt, hsa
uaugauauccaucacaucuuaucuugaucuuugcucccaguggauuguacagugaugacuu

SEQ ID NO: 109522 - RNA, 61 nt, hsa
gacuggcagguuuuuuaauccaguggcaaggugcucccacuccagggcccagcacaucucc

SEQ ID NO: 109523 - RNA, 61 nt, hsa
ccugcagguccuggugggucagcccagcaccugcucccagugggagcuucccgggauaaac

SEQ ID NO: 109524 - RNA, 61 nt, hsa
cagucccacaccgcuggucccugcccuccccugcucccagguugaggugcgcucaccucag

SEQ ID NO: 109525 - RNA, 61 nt, hsa
acggcccuccuucuuuuccuaacaugcaccuugcucccaauggugcuuggagggggaagag

SEQ ID NO: 109526 - RNA, 61 nt, hsa
agggggcaagcuuugcuccuucaguucugcuugcucccaagccccugacccgcucggacuu

SEQ ID NO: 109527 - RNA, 61 nt, hsa
gcccccuuuauugcugcaccaggguuggcauugcucccacugagcccuacuccacccuguc

SEQ ID NO: 109528 - RNA, 61 nt, hsa
ucuccuuccaggucagcucauucacaagaguugcucccaagccuggaugaguugcaccuug

SEQ ID NO: 109529 - RNA, 61 nt, hsa
ugcuccaacucgggccuggggcacugcucgcugcucccaggaaggggguggcgugacaggc

SEQ ID NO: 109530 - RNA, 61 nt, hsa
gugaggacacacacuaggcccaaggugccugugcucccagcagguccaagugcagcuccag

SEQ ID NO: 109531 - RNA, 61 nt, hsa
uccguccugggaaagagcauccucuggcaggugcucccaccaggucagacccaguccugga

SEQ ID NO: 109532 - RNA, 61 nt, hsa
ccugcacccacuggcugggaagaucucuuccugcucccacgccccugucuggauccccucc

SEQ ID NO: 109533 - RNA, 61 nt, hsa
aggagagaaguggaagccccauggaagacagugcucccagcugagguaggaggcggaggug

SEQ ID NO: 109534 - RNA, 61 nt, hsa
ugguucaguauuuaaugccauuuuauucacaugcucccauguucucccucccucccauugu

SEQ ID NO: 109535 - RNA, 61 nt, hsa
gcaggagaggggagaaccccauccucagagcugcucccagccagcgagucaggagcggggg

SEQ ID NO: 109536 - RNA, 61 nt, hsa
gagacagggcuccagggaugaggccgcauucugcucccacagcgccuuuuccagaaaguuc

SEQ ID NO: 109537 - RNA, 61 nt, hsa
uucucucccuuccucucuccuuauagacacuugcucccaacccauucacuacaggugaagg

SEQ ID NO: 109538 - RNA, 61 nt, hsa
ggggggccaagguccugcucaacucuaccccugcucccauuccucccuccggccauacugc

SEQ ID NO: 109539 - RNA, 61 nt, hsa
ucauuagugaauuacacucaaggaaaagaugugcucccaccaggcagcuccagcuguuacc

SEQ ID NO: 109540 - RNA, 61 nt, hsa
caaaguuuucuuuccaaaaucaggcuuugucugcucccaauucaccucguuacucucaccu

SEQ ID NO: 109541 - RNA, 61 nt, hsa
cacggccuccacccgggacgccuuccuccucugcucccaaacaggguuuccguggccuguu

SEQ ID NO: 109542 - RNA, 61 nt, hsa
gggugggcaggccaggacugcuuuuuuuuaaugcucccauuucacagaggauaccaccgag

SEQ ID NO: 109543 - RNA, 61 nt, hsa
cccucccacaguauuuugugcaaugaagcccugcucccagccuuucagagacagggacaca

SEQ ID NO: 109544 - RNA, 61 nt, hsa
ccuucucagggucuccccagcccaguccccuugcucccaucccacucggugcuguugggua

SEQ ID NO: 109545 - RNA, 64 nt, hsa
cauucugccaauuccaccacccauucaguuugcuuaucccuacagaacagugacugagguucuu

SEQ ID NO: 109546 - RNA, 64 nt, hsa
auccucauccugcuguugccuccgcccuuaacucuaucccuauuaggaaccuuguuucccaccg

SEQ ID NO: 109547 - RNA, 64 nt, hsa
uuuuggguggugacuguuuuuuucugacuuugcauaucccuagacacuagaacuaaaggauugg

SEQ ID NO: 109548 - RNA, 64 nt, hsa
ucuuaaggaauuuuuagacuuaaguucacugugauaucccuaguaccuagaagaguaccuagca

SEQ ID NO: 109549 - RNA, 64 nt, hsa
ccaugugaauguuguauacgauuguaaggcuuaugucacuaaagauuuuuauucugauuuuuuc

SEQ ID NO: 109550 - RNA, 64 nt, hsa
guuucuuaggagaaaaugauucuguaauuccagugucacuaauuuauauuguucuuuccucuga

SEQ ID NO: 109551 - RNA, 64 nt, hsa
agcacuuguccacgucuuuucucauaucaugguagucacuaacauauauaagguaugugcuauu

SEQ ID NO: 109552 - RNA, 64 nt, hsa
uacuucagugcaccuacugcuuacuguugcuuuagucacuaauugcuuucugguuugaaagaug

SEQ ID NO: 109553 - RNA, 64 nt, hsa; identical to SEQ ID NO: 74593

SEQ ID NO: 109554 - RNA, 64 nt, hsa; identical to SEQ ID NO: 74594

SEQ ID NO: 109555 - RNA, 64 nt, hsa; identical to SEQ ID NO: 74595

SEQ ID NO: 109556 - RNA, 64 nt, hsa; identical to SEQ ID NO: 74596

SEQ ID NO: 109557 - RNA, 64 nt, hsa; identical to SEQ ID NO: 74597

SEQ ID NO: 109558 - RNA, 64 nt, hsa; identical to SEQ ID NO: 74598

SEQ ID NO: 109559 - RNA, 64 nt, hsa; identical to SEQ ID NO: 74599

SEQ ID NO: 109560 - RNA, 64 nt, hsa; identical to SEQ ID NO: 74600

SEQ ID NO: 109561 - RNA, 64 nt, hsa; identical to SEQ ID NO: 74601

SEQ ID NO: 109562 - RNA, 64 nt, hsa; identical to SEQ ID NO: 74602

SEQ ID NO: 109563 - RNA, 64 nt, hsa; identical to SEQ ID NO: 74603

SEQ ID NO: 109564 - RNA, 64 nt, hsa; identical to SEQ ID NO: 74604

SEQ ID NO: 109565 - RNA, 64 nt, hsa; identical to SEQ ID NO: 74605

SEQ ID NO: 109566 - RNA, 64 nt, hsa; identical to SEQ ID NO: 74606

SEQ ID NO: 109567 - RNA, 61 nt, hsa
ucacgggcuaugcccggggagcugucgggaguggcgggaaucggggccaugcccggggagc

SEQ ID NO: 109568 - RNA, 61 nt, hsa
aucggggccaugcccggggagcugucgggaguggcgggaaucggggccaugcccggggagc

SEQ ID NO: 109569 - RNA, 61 nt, hsa
aucggggccaugcccggggagcugucgggaguggcgggaaauggggggcaucaccaugccu

SEQ ID NO: 109570 - RNA, 61 nt, hsa
gauggcagcagguauuggguccucagccuucuggcgggagcccugaggcugcggacaaagc

SEQ ID NO: 109571 - RNA, 61 nt, hsa
agguggaguucuuccaugcaggagcacggcauggcgggagcggggcugcagaguauccgag

SEQ ID NO: 109572 - RNA, 64 nt, hsa
auuccagcacuacagaaguguguuuuacucauuugaggaacagcacaucagcuuugcccuugac

SEQ ID NO: 109573 - RNA, 64 nt, hsa
aggccagcccuacagaagugcuguuuacucauuggaggaacaguaccuuggcuuggcucuugac

SEQ ID NO: 109574 - RNA, 64 nt, hsa
ucucacuauccaccucaacacacauccaucucaagaggaacauuuauaccaggcagucagagcu

SEQ ID NO: 109575 - RNA, 64 nt, hsa
uucagguccugcccugcuguucuuugcuggagaugaggaacaggugcuggggcuaaaguuuggg

SEQ ID NO: 109576 - RNA, 64 nt, hsa
gaguugauguguguuuuaaaagaaaaaacccaaugaggaacaauuggagauuuuuaugcagaaa

SEQ ID NO: 109577 - RNA, 64 nt, hsa
uccuaggguuuuuugguuuuguuuuguugccaacgaggaacacagcucugggggaaugguguca

SEQ ID NO: 109578 - RNA, 64 nt, hsa
gggcuccccacucccugcccaccaauacccaggugaggaacagacccucuggccucucacccca

SEQ ID NO: 109579 - RNA, 64 nt, hsa
gacuuacgccuuuggaauugcucuucauucagaagaggaacacaaaggaagccacccaggaagg

SEQ ID NO: 109580 - RNA, 64 nt, hsa
gaaacaccuaaccuugcaaguuuuaccgccuuuugaggaacacaaaucggagaacaaacccagg

SEQ ID NO: 109581 - RNA, 64 nt, hsa
uuguccccgucuuucccaucgccuagcguuuggggaggaacagggagagagcuucggggcgucu

SEQ ID NO: 109582 - RNA, 64 nt, hsa
gaaauguccccgcaguggaugcagcucacaugcugaggaacacccagcucuggacagaguucuu

SEQ ID NO: 109583 - RNA, 64 nt, hsa
ccaagcucaucuucauugaaugucucauuuggccgaggaacaacugaacuuugugguuugcugu

SEQ ID NO: 109584 - RNA, 64 nt, hsa
gcaacucaugguuaaagaccuuugaucaggacuggaggaacaaagguuuguguauuaguccauu

SEQ ID NO: 109585 - RNA, 64 nt, hsa
aaaaauggaggaggauagguucuuuggguaaauugaggaacauggaaaauggagggccaccacu

SEQ ID NO: 109586 - RNA, 64 nt, hsa
cuaggcagaccccagccagacccccgccagacagacucccaaccagacugaccccuuacuauuc

SEQ ID NO: 109587 - RNA, 64 nt, hsa
ugaguuuuugccauguugcccagacuggucuugaacucccaaccucaagcaauccuccugccuc

SEQ ID NO: 109588 - RNA, 64 nt, hsa
gagcccccacaccuggccgagccagcgcuucucaacucccaagguuugcaagcucccugcccca

SEQ ID NO: 109589 - RNA, 64 nt, hsa
cagagugacaggagugaggggagagagcgaacccacucccaagauaacggccugaguccacgca

SEQ ID NO: 109590 - RNA, 64 nt, hsa
agaacuuuuuaccagauuuucaaagacaucugugacucccaaaaguuaacaaucacugaugugg

SEQ ID NO: 109591 - RNA, 64 nt, hsa
guuauagcugcuuucagauuguuccauuaucuguacucccaacaacccugccggauauauuugu

SEQ ID NO: 109592 - RNA, 64 nt, hsa
agaauucagcugcccccgcucaugggccccucugacucccaaagagcugccuaagaggcaauga

SEQ ID NO: 109593 - RNA, 64 nt, hsa
agaggcaaugaguguguuggcuugugaucugggaacucccaagaacagcaggcccaccuaccuu

SEQ ID NO: 109594 - RNA, 64 nt, hsa
cagagguacagcugcugaaagugucggagaugaaacucccaaaggugccagagauggcugugcc

SEQ ID NO: 109595 - RNA, 64 nt, hsa
cagagguagagcugcccaaagugucagagaugaaacucccaaaggugccagagauggcugugcc

SEQ ID NO: 109596 - RNA, 64 nt, hsa
cagagguggagcuccccaaggugucagagaugaaacucccaaaggugccagagauggcugugcc

SEQ ID NO: 109597 - RNA, 64 nt, hsa
uagugcagcagggcaguagcgguaccaaugcagaacucccaagacccgagcugggaccaguacc

SEQ ID NO: 109598 - RNA, 64 nt, hsa
gucuacagcucccccagcuccccccaccucccccacucccaaccacguugggacagggaggugu

SEQ ID NO: 109599 - RNA, 59 nt, hsa
ggcuggagccaggggccacuucugaacugcaccagcaccaggcccacccucgucucugc

SEQ ID NO: 109600 - RNA, 59 nt, hsa
ccauagccagcacagcuaucccgcggggacaccagcacugagcccccucucccuccugc

SEQ ID NO: 109601 - RNA, 59 nt, hsa
ucagccccucuuucccaggcccuggaucucaccagcagccaagguugagccagaaccag

SEQ ID NO: 109602 - RNA, 59 nt, hsa
gcauggguugcccuacaggcccacagggccaccagcacacccccgcacgcugggcacca

SEQ ID NO: 109603 - RNA, 59 nt, hsa
gaaucaggaccagcaugugcagagcuggccaccagcacaggcuuagggcaguucagaac

SEQ ID NO: 109604 - RNA, 59 nt, hsa
ugaguacucauaauuggccagcaucucaccaccagcaaguaguagggccaggucaaucc

SEQ ID NO: 109605 - RNA, 59 nt, hsa
caugcggccucacugggggccaucagccucaccagcaaagcagagaugagagcguggga

SEQ ID NO: 109606 - RNA, 59 nt, hsa
gaggggccuaugccuuuacuccuuuuaaacaccagcacccgucuuuuccccaaccuaaa

SEQ ID NO: 109607 - RNA, 59 nt, hsa
acccgucuuuuccccaaccuaaaaccaaccaccagcauuucacuacaggaccaaaugga

SEQ ID NO: 109608 - RNA, 59 nt, hsa
acucucuggcuaaaaacaaacucugaggccaccagcagaucaucuuuaagcuaaguuac

SEQ ID NO: 109609 - RNA, 59 nt, hsa
gcuggguucugauugcuagaugucacacccaccagcaucaccaaagugacucugagaua

SEQ ID NO: 109610 - RNA, 59 nt, hsa
caguucucaaacuuuagcaugugaagagucaccagcagauuccugggcucgccuggaga

SEQ ID NO: 109611 - RNA, 59 nt, hsa
auggccagcagagcggugagcagcacucccaccagcagcccggucagacugaaguguuc

SEQ ID NO: 109612 - RNA, 59 nt, hsa
uucagccaaugcccagagugaccaagcagcaccagcaggccugcccaggaugcugaaag

SEQ ID NO: 109613 - RNA, 59 nt, hsa
gaaaaccugccauuguggcccuggagagucaccagcagcucuugggaaggacuugcugg

SEQ ID NO: 109614 - RNA, 59 nt, hsa
cuguuugucuccucgacagggagccuguccaccagcaggcugcggucccagcgggugcg

SEQ ID NO: 109615 - RNA, 59 nt, hsa
ccccucugcccagcucaccacaucuucaucaccagcaaacgccaggacuuggcuccccc

SEQ ID NO: 109616 - RNA, 59 nt, hsa
cccgagcugcccccacccccggccucagccaccagcacccccauagggcccccagacac

SEQ ID NO: 109617 - RNA, 59 nt, hsa
cccuuggaaggggucucgguggagcugugcaccagcagccaagcagaaagaaacacgcg

SEQ ID NO: 109618 - RNA, 59 nt, hsa
uucuuugagccagacgccaacuugacccucaccagcauuaucaggagcgcgcucagcaa

SEQ ID NO: 109619 - RNA, 59 nt, hsa
ccucccgggagauccgugcgcccgaccagcaccagcaucgcggaccgcaaaggccgccc

SEQ ID NO: 109620 - RNA, 59 nt, hsa
agacaacuaacccuuuccccaacagagcccaccagcagugguggagaugucgguccaug

SEQ ID NO: 109621 - RNA, 59 nt, hsa
uuuuuuaaaaaaagaaguggagguguuuacaccagcaaaauacucauuuuuuaagugua

SEQ ID NO: 109622 - RNA, 59 nt, hsa
ccccccaaaacuugggcuggcccagggcccaccagcagcugauguugccuccucuccug

SEQ ID NO: 109623 - RNA, 59 nt, hsa
cccguggggggacagccgaugggagccagcaccagcaggauccgagggcgccccggaca

SEQ ID NO: 109624 - RNA, 64 nt, hsa
auauuuaaucaguaaguuaauuaguggcauaaaaaaguagcaucagggucuuuucccaagccag

SEQ ID NO: 109625 - RNA, 64 nt, hsa
aucagugaauaauaaacauaaaugcaauuuacucaaguagcaauuuaagaaauaggaaagucau

SEQ ID NO: 109626 - RNA, 64 nt, hsa
aaagccagcauucacaaaaugaggaagauaaggaaaguagcauaaauauuuucuauuaacaugg

SEQ ID NO: 109627 - RNA, 64 nt, hsa
acuagacagauuuaaguaauugacaacuuacuuaaaguagcaaagucauggauuguauugacuu

SEQ ID NO: 109628 - RNA, 64 nt, hsa
aaugggaaucuucuugguauuuuauguguauuguaaguagcaguuaaauuauuuuuuuaaaagc

SEQ ID NO: 109629 - RNA, 64 nt, hsa
uagcauuccuuuucaugaugugcuuuugugcaguaaguagcauuuucggcuacuuaacuuuaca

SEQ ID NO: 109630 - RNA, 64 nt, hsa
aauuacaagauauauuuaaaaaguaaccagauaaaaguagcacaugugcuuuuguuaaaaauaa

SEQ ID NO: 109631 - RNA, 64 nt, hsa
uaaauaggaaaccaugaaugggaaggauggcaauaaguagcaacuauacuuuccaaugacuaaa

SEQ ID NO: 109632 - RNA, 64 nt, hsa
uaauugacuuggaaaaaaaaaacagcaaaagcaaaaguagcaacauaugucaacauaugucacu

SEQ ID NO: 109633 - RNA, 64 nt, hsa
aguuccacaaaauuugauccuuauugcuuccagcaaguagcaugaacuucuguguucaccugua

SEQ ID NO: 109634 - RNA, 64 nt, hsa
cauaucaaauauuuuggguacuaggcaguuuccaaaguagcaugguaguauuacuuguuaaaag

SEQ ID NO: 109635 - RNA, 64 nt, hsa
acuucugcuauucauauggucugauuagugacauaaguagcagccguuuuucaacuucaguuuc

SEQ ID NO: 109636 - RNA, 64 nt, hsa
agaggugaccaggcccggacagaaauggccugggaaguagcagaagcagugcagcaggaacugg

SEQ ID NO: 109637 - RNA, 64 nt, hsa
agcaggaacuggaagugccuucauccaggacaggaaguagcacuucugaaacaggaaguggucu

SEQ ID NO: 109638 - RNA, 63 nt, hsa
acacuguccauccccaagugacauguggcuucagaaguagagucugaaagagcagugggaugg

SEQ ID NO: 109639 - RNA, 63 nt, hsa
aaaacaaauguguggcuaaggaguuaccugggggaaguagaaugagaggucuguugggaauaa

SEQ ID NO: 109640 - RNA, 63 nt, hsa
cuguucgugucuuucugcaguuuucggcaauaagaaguagaagauuugcuguccugcugucca

SEQ ID NO: 109641 - RNA, 63 nt, hsa
acugucuuuggcagugaguaaauagcauauuuugaaguagaguuguauacuuuuucauaagau

SEQ ID NO: 109642 - RNA, 63 nt, hsa
accaaauuggucuuaaaaaugauguuaacccaagaaguagacaucaaaaauuaaaaaaaaaaa

SEQ ID NO: 109643 - RNA, 63 nt, hsa
gagccaaauuaggaaacagacaguaacgucaaggaaguagauacuggcuggcauugucagugu

SEQ ID NO: 109644 - RNA, 63 nt, hsa
uguuuuucuuuagggcucuuccuacaaccuugagaaguagauaggcaucagaguaugguacua

SEQ ID NO: 109645 - RNA, 63 nt, hsa
gcauucucuuugaauucucacagaauucagcaagaaguagaaaccuguuauuuacuacauugu

SEQ ID NO: 109646 - RNA, 63 nt, hsa
gguaguuaagaaagguguagauauaaugagguagaaguagaaaggaagaaaaacucaaagaau

SEQ ID NO: 109647 - RNA, 63 nt, hsa
uugcuaugccaagccuuguuucucugcucagaagaaguagagaagcuauuaucaauuaaaagc

SEQ ID NO: 109648 - RNA, 63 nt, hsa
uaaaugagaugcguaguuuguuuucuuucaugggaaguagagauaaaaauauauacauuucuc

SEQ ID NO: 109649 - RNA, 63 nt, hsa
uggggcuuauaugagacaugaagcauuggcucagaaguagagggagaagaggaacccaguucc

SEQ ID NO: 109650 - RNA, 63 nt, hsa
uuuuuuuaccaccaucuuuuucuacucuguauggaaguagaucuuuauggggaaaagagaauu

SEQ ID NO: 109651 - RNA, 63 nt, hsa
aagaagggauccucuuucaaaggcuaccuuuaugaaguagacacuauugcccucagaaugaga

SEQ ID NO: 109652 - RNA, 63 nt, hsa
uugagcaaagcauuuuugcucauguuucuuaaggaaguagaguaguccuugugucagaacaca

SEQ ID NO: 109653 - RNA, 63 nt, hsa
uaccuuucaguccugucuggguuuuaaauaagugaaguagaagaaauugaguauuuucugaca

SEQ ID NO: 109654 - RNA, 63 nt, hsa
uaaaaccugggaaggauuuucugaccuuccccugaaguagaucauaagacugucauguaagag

SEQ ID NO: 109655 - RNA, 63 nt, hsa
ugagaugaauuaagacaaagaacaggugccauagaaguagauuucuaggaaugaaguggggca

SEQ ID NO: 109656 - RNA, 63 nt, hsa
cagagacccuguauuuaaucuacuuugaucagagaaguagaauuuauaacagguuagcuaaaa

SEQ ID NO: 109657 - RNA, 63 nt, hsa
gguccauuagauuccgaaaaacagguagacgaggaaguagacaguggaagugaguagucuccc

SEQ ID NO: 109658 - RNA, 63 nt, hsa
ugacguuuccaugcuguggucucuugauauacggaaguagacguaacuuauuuuccagcgaaa

SEQ ID NO: 109659 - RNA, 63 nt, hsa
auuuaauauuuggguacugauuauauccacauggaaguagaagguaaggaguuuaggaaaaua

SEQ ID NO: 109660 - RNA, 63 nt, hsa
ugacuggguuaagccaucuuucuuaagauuccugaaguagaaauagcaauuaagaaauuaauu

SEQ ID NO: 109661 - RNA, 63 nt, hsa
uguucuucuguguucucucauuauggacuuugugaaguagaaacauaauuuuuuuuccuccaa

SEQ ID NO: 109662 - RNA, 63 nt, hsa
auuuuuacuauuaaaauauucaguuuuuuaaaugaaguagaacuugaguucauguuuuauaug

SEQ ID NO: 109663 - RNA, 63 nt, hsa
gaugagguaaagacucagcuaaggguuuuacaggaaguagauuaauugauccugucaccaacc

SEQ ID NO: 109664 - RNA, 63 nt, hsa
caaauagaguuuuuauauuuguuaugauaaaaggaaguagaugugaaaaagccuaagaaaaag

SEQ ID NO: 109665 - RNA, 63 nt, hsa
ugugccuuugucuccuugugucuccuuucccccgaaguagaugaaacagucucacauacccaa

SEQ ID NO: 109666 - RNA, 63 nt, hsa
uagaauugcucuguaauucuaaauuuaaaauuagaaguagagagagauaagccaucgccccuu

SEQ ID NO: 109667 - RNA, 63 nt, hsa
cuugaaacuaggagguaacaagaaagcuucuaggaaguagauguuccauaucuucaaaaugcc

SEQ ID NO: 109668 - RNA, 63 nt, hsa
uuuugugguugcuggcuggguacuguauuuaaugaaguagagaauagcacuugcaaaaauaca

SEQ ID NO: 109669 - RNA, 63 nt, hsa
agaaaucggaugguugccgugucuguguagaaagaaguagacaugggagacuuuucauuuugu

SEQ ID NO: 109670 - RNA, 63 nt, hsa
ucuugcacugugauguuuuuacgugaauauguugaaguagaagucuaccauauuauuuuauaa

SEQ ID NO: 109671 - RNA, 63 nt, hsa
guuuuaacccugcuuaauaauguugguguuuuagaaguagauacaggcacugcucugaaaacc

SEQ ID NO: 109672 - RNA, 63 nt, hsa
ucagugucaaugcagcccccauuguggucacaggaaguagaggaggccacguucuuacuaguu

SEQ ID NO: 109673 - RNA, 63 nt, hsa
uuuuuuuaaaaaaaauugucuuugaauguauuggaaguagacaugcauuaacugugacauuau

SEQ ID NO: 109674 - RNA, 63 nt, hsa
uaauuuauuacugcccagcauuccuuccaacgggaaguagaugggcgacugcuuuguucacac

SEQ ID NO: 109675 - RNA, 63 nt, hsa
uauuuuuaacaugugcuuuuccaaauuaaaaaugaaguagaguauaccaaaugcauaaacuuu

SEQ ID NO: 109676 - RNA, 63 nt, hsa
cucugaaauugagucucggucaugacuuaucccgaaguagagcaauguguuuccucucauugu

SEQ ID NO: 109677 - RNA, 63 nt, hsa
gaagcugaaaaauuguagagugcccaugggguagaaguagaauccuuuuauacuuugguuccu

SEQ ID NO: 109678 - RNA, 63 nt, hsa
cacauacuaaagugacacaaagagaaugaagcagaaguagagaagaaagacuguaugugacaa

SEQ ID NO: 109679 - RNA, 63 nt, hsa
auucagcaguugacacaggcuaagaaauggaaagaaguagaucuguuuuuucucaauguugcu

SEQ ID NO: 109680 - RNA, 63 nt, hsa
uccauggaauuucuaguaugagacuauuuauaugaaguagaagguaacucuuugcacauaaau

SEQ ID NO: 109681 - RNA, 63 nt, hsa
aagcuccuugagaaaccuagcaguggccauagagaaguagacuggguauggggaaccuaaguc

SEQ ID NO: 109682 - RNA, 63 nt, hsa
aucuugugccuaaaaguuuuuuugcuuaauuaugaaguagacaugcauguuuacauuuaugua

SEQ ID NO: 109683 - RNA, 63 nt, hsa
aauauuuucuuauagauauugugcaauaaagcugaaguagaaugugugguuuuugcaaaugcu

SEQ ID NO: 109684 - RNA, 63 nt, hsa
gauauggacaucuugggauaucucuuuaccacugaaguagaauugauuguucagcuggagccc

SEQ ID NO: 109685 - RNA, 63 nt, hsa
caaggacugcgucaaaguccucaucacauucucgaaguagaucaaaguccagaucuaguucca

SEQ ID NO: 109686 - RNA, 63 nt, hsa
ccuacgauagcuacuauagcaggagucggagucgaaguagaagccagagaagugacaguuacc

SEQ ID NO: 109687 - RNA, 63 nt, hsa
aagaaucauacucuacuucuaagaaaauaauuagaaguagacaaagauuaaugaaagggaugu

SEQ ID NO: 109688 - RNA, 63 nt, hsa
uguuuugccugccaauugaaugauuucguagcugaaguagaaacauuuagguuucuguagcau

SEQ ID NO: 109689 - RNA, 63 nt, hsa
ccaaaccuguaccauuuccguauuucugcuguagaaguagaaauaaauuuucuuaaauaauga

SEQ ID NO: 109690 - RNA, 63 nt, hsa
uaguuguggguggaguguguucucagaagguaugaaguagauguuuuccuagguguuggaaaa

SEQ ID NO: 109691 - RNA, 63 nt, hsa
agaaaacucaugcucuguuucucugaaucaaaugaaguagaaguuuacaaagcuaacuuucuu

SEQ ID NO: 109692 - RNA, 63 nt, hsa
aaaccaagaaaauagugaguuaaaaaaauaauagaaguagaaaugcccacauccacacuuagc

SEQ ID NO: 109693 - RNA, 63 nt, hsa
aaacagaaagcuauauguagcagcuggucuugagaaguagaagcaucuuaacugucauaagag

SEQ ID NO: 109694 - RNA, 63 nt, hsa
ugggagcccagugucaagucugcuggaaugcaggaaguagaacagaaucgccacaggacuguu

SEQ ID NO: 109695 - RNA, 63 nt, hsa
guggcagaaggaaccugagcaggacccccaccugaaguagaacuuaagagaggggccaagugu

SEQ ID NO: 109696 - RNA, 63 nt, hsa
gccccuccacgcccacucuucccuuguuccccagaaguagagggcucugggugcccauuucuu

SEQ ID NO: 109697 - RNA, 63 nt, hsa
aucagauuuuauucaagcuuucuaaauaucugugaaguagacccuagaaaauugucucguuua

SEQ ID NO: 109698 - RNA, 63 nt, hsa
uagaauuuuucacauggccacuggaccauuguggaaguagacugguugaaauauucuuaguau

SEQ ID NO: 109699 - RNA, 63 nt, hsa
ugguuauuuugauauaugauaauaauuaucuuugaaguagaacaauucuguuaacuggaaaau

SEQ ID NO: 109700 - RNA, 63 nt, hsa
auauacauauauaugucaggcaaagugcugcuggaaguagaauuuguccaauaacaggucaac

SEQ ID NO: 109701 - RNA, 63 nt, hsa
ucuauagcaucaaaaacuucugggggcgugggggaaguagaauaccaaguauaauaguuacau

SEQ ID NO: 109702 - RNA, 63 nt, hsa
ugggaaaagucacauucuaggcuggauucuacugaaguagaggccuggugguuuaacagccga

SEQ ID NO: 109703 - RNA, 63 nt, hsa
uacaccuggcccucuucaucgaauuuuauuugagaaguagagcucuugccauuuuuucccuug

SEQ ID NO: 109704 - RNA, 63 nt, hsa
caugguuuuggccuuuuguguauauuaguaccagaaguagauacuauaaaucuuguuauuuuu

SEQ ID NO: 109705 - RNA, 63 nt, hsa
uauacaacccuggcauuauguccacuguguauagaaguagauuaagagccauauaaguuugaa

SEQ ID NO: 109706 - RNA, 63 nt, hsa
uuuuuaaaagccaauucuuuuuuaucccuuuuagaaguagaauuugcacacuuacuacaauug

SEQ ID NO: 109707 - RNA, 63 nt, hsa
cuuuaaauaucauucuuuguaucuuaaaucugugaaguagaacaauuuggucuuagcuuuaca

SEQ ID NO: 109708 - RNA, 63 nt, hsa
ggcuaagugcuggugucagggaaauuccauaaugaaguagaaugcugcuccugcauuaagauu

SEQ ID NO: 109709 - RNA, 63 nt, hsa
cagaauggugaaagaguccaacaauggcugagggaaguagagguuaagauauagcucaacagu

SEQ ID NO: 109710 - RNA, 63 nt, hsa
acauaaaagucaauucuaauagggcagucgccagaaguagaccugucuaggcacuaagggagu

SEQ ID NO: 109711 - RNA, 63 nt, hsa
uuuauuacugcauuuuuauuuggugcuuuuuaggaaguagaucuuugguaccacuucacuacg

SEQ ID NO: 109712 - RNA, 63 nt, hsa
gguggugauuuuucaauuucuuuuauauuuacggaaguagaaaaaauguucugucuuuuugaa

SEQ ID NO: 109713 - RNA, 63 nt, hsa
ccaauccaagugugugccccuacccccagcucagaaguagaaaggguuuaaguuugcuuguau

SEQ ID NO: 109714 - RNA, 63 nt, hsa
ucaauuucaggagguuucacaaaauggacuccugaaguagacagaguagugagguuucauugc

SEQ ID NO: 109715 - RNA, 63 nt, hsa
gugccccuaaagacacauuuacucaauauuggagaaguagauaaugaauuaagcaacuggucu

SEQ ID NO: 109716 - RNA, 63 nt, hsa
guuuuguuuuaagaggaaaugagaaggccagcagaaguagauuaaaacuagagagcugguuua

SEQ ID NO: 109717 - RNA, 63 nt, hsa
aauacuuaguuuagcuuuaguuuaguaaguucagaaguagaaacaaacuuauuuaaaaccauc

SEQ ID NO: 109718 - RNA, 63 nt, hsa
uuucuuuuuauaacucauggcaggcaucuguaagaaguagagaacccagaugaucucuuagga

SEQ ID NO: 109719 - RNA, 63 nt, hsa
uugguugaugccaaaaaaaaauacaugcuaagagaaguagaaaucauagcugguucacacuga

SEQ ID NO: 109720 - RNA, 63 nt, hsa
cacugaugccuuaaaaauuaacaaggucauucagaaguagauuacauugccuaaaguagaaug

SEQ ID NO: 109721 - RNA, 63 nt, hsa
ggggcgguggucaggcuaaggccaaguguuuaagaaguagaguguagcugccagcguagaaac

SEQ ID NO: 109722 - RNA, 63 nt, hsa
aguauaguaaccacaagugauuggcuuauaaaugaaguagaaaugcuuuuuaauauuccaaaa

SEQ ID NO: 109723 - RNA, 63 nt, hsa
aagcaagcuguguguugcuuagucacuuacuuagaaguagauggugggggacagcggcguggg

SEQ ID NO: 109724 - RNA, 63 nt, hsa
auucuaaugccagguugcuguaggguaacuuuugaaguagauauauuaccugguucugcuauc

SEQ ID NO: 109725 - RNA, 63 nt, hsa
ccagggaguuucagaugccuuugagaaaugaaugaaguagagagaaaauaaaagaaaaaccag

SEQ ID NO: 109726 - RNA, 63 nt, hsa
uacuaaagauuguaaugaguuaccuuauccuuagaaguagaauguuugcuuucuucuucuugg

SEQ ID NO: 109727 - RNA, 63 nt, hsa
uuuacucaaaucuucaauuucuugccagggugggaaguagaauuucauguaugcugaagacug

SEQ ID NO: 109728 - RNA, 63 nt, hsa
ggcccccagccugagacugugcaacuccagguggaaguagagcuggucccucagcuggggggc

SEQ ID NO: 109729 - RNA, 63 nt, hsa
ugacucaagccaguggaagaccacacaccuugagaaguagaagagucauaggauuugaaagcu

SEQ ID NO: 109730 - RNA, 63 nt, hsa
acucaaagaucccaacaaugaauaggaggcauggaaguagaugugccaauggggagggaugag

SEQ ID NO: 109731 - RNA, 63 nt, hsa
gcaugauuagugguuacccuauugaauaggucagaaguagaaucuuuucaucaucacagaaag

SEQ ID NO: 109732 - RNA, 63 nt, hsa
cagcuuugaggaacaugcauaagaaauguagcugaaguagaggggacgugagagaagggccag

SEQ ID NO: 109733 - RNA, 63 nt, hsa
cccucaggggauauuucacugaagaaccaguuagaaguagaaacagcuguggggcuugggccc

SEQ ID NO: 109734 - RNA, 63 nt, hsa
ggaguaccaggagggagccagcauuucagaucugaaguagacgauaggaauguggaagaacac

SEQ ID NO: 109735 - RNA, 63 nt, hsa
ugaaauuuugucauguuucaaauaaagagaacugaaguagaaaauagaaaugccaguaaacaa

SEQ ID NO: 109736 - RNA, 63 nt, hsa
uucagugggaagaaaugcauaaaaugccuauaagaaguagaaagucauugaacugacaguguu

SEQ ID NO: 109737 - RNA, 63 nt, hsa
caacauccuuauucucaucuuuaagguaaggaggaaguagagauagaaggaaauacgugauuu

SEQ ID NO: 109738 - RNA, 63 nt, hsa
cucacacuuauauuguggcauauagucaacauggaaguagaccagcucugcugauuugaaauu

SEQ ID NO: 109739 - RNA, 63 nt, hsa
gggguacugcuggccagggguaggauaguauaggaaguagaaggggaaggaggguuagauaga

SEQ ID NO: 109740 - RNA, 63 nt, hsa
cugauacuaugaggcugaaacaauccuugugaugaaguagaucaugcagugacauacaaagac

SEQ ID NO: 109741 - RNA, 63 nt, hsa
uuuguuauuuucuuaccaagugcauugauaugugaaguagaaugaauugcagaggaaaguuuu

SEQ ID NO: 109742 - RNA, 63 nt, hsa
gggguggcaccacccggcuaguugaaauaaucggaaguagacaagcucucaaaguguugagug

SEQ ID NO: 109743 - RNA, 63 nt, hsa
aagagaugagccucuguacuguaaauaagaaaugaaguagagaaauguuaaauauuuuaugag

SEQ ID NO: 109744 - RNA, 63 nt, hsa
cuacaagaauuguaaacugcauacaguuuguuugaaguagacagugaggauaauaacaaaguu

SEQ ID NO: 109745 - RNA, 63 nt, hsa
aaagggcugagaucaauaaauuuaacacuagacgaaguagacuuccugucuuuuugagaagag

SEQ ID NO: 109746 - RNA, 63 nt, hsa
ugguagguaaauaauguguauauaacuuuaaaagaaguagaauuuuuuuguagauguauaauu

SEQ ID NO: 109747 - RNA, 63 nt, hsa
uguuagguaaguuauuuauauauaacuuuaaaagaaguagaagauuuuuuggagauuuauaau

SEQ ID NO: 109748 - RNA, 63 nt, hsa
ccacugaucuuccuggacaggaggggugaccaugaaguagagcagugggcuuugccuucugac

SEQ ID NO: 109749 - RNA, 63 nt, hsa
auuuuguguuugggguguggggguggugaaagggaaguagaaccgaaacaagauuaguccuga

SEQ ID NO: 109750 - RNA, 63 nt, hsa
uaauauagaggagaugaccaaaucagugcuggggaaguagauuuggcuucucugcuucucaua

SEQ ID NO: 109751 - RNA, 63 nt, hsa
auuuugagaauggaagcaggucugaggucagaagaaguagagaaugaaggaaaaggugaaugc

SEQ ID NO: 109752 - RNA, 63 nt, hsa
ggcaucacugauagaauuucugaaagagaaagagaaguagauggucaaccagucacuaguugg

SEQ ID NO: 109753 - RNA, 63 nt, hsa
caaaugagaauguguuauaugccaaggaacaaugaaguagaauauaauguauacuaagggauu

SEQ ID NO: 109754 - RNA, 63 nt, hsa
uuguuugccuacugaagagaugaaaccauggcagaaguagaauccuuauagaaacaggaccag

SEQ ID NO: 109755 - RNA, 63 nt, hsa
aagggaaugauuguggcuuggaccugacuaugagaaguagaaauaaucagaaaaaucagaaau

SEQ ID NO: 109756 - RNA, 63 nt, hsa
gguaugacauuggauagaacaugggauacuuuagaaguagaauugacagggcauauuaguuga

SEQ ID NO: 109757 - RNA, 63 nt, hsa
cguaagagcuacaaaggagggaaaaggaaccaagaaguagaaggagucccaucaggagggaag

SEQ ID NO: 109758 - RNA, 63 nt, hsa
ugaaauacugauaggcuuuuaagcuucuuuuaagaaguagauagaaauacgaagauuaugaua

SEQ ID NO: 109759 - RNA, 63 nt, hsa
ccaugagccccagagcaguagcaggagacuugagaaguagagugacaaaaacaagcacuuaau

SEQ ID NO: 109760 - RNA, 63 nt, hsa
uccuuucauucccccuaaaaacagagugaccuggaaguagauguucuuugcuccuugucagag

SEQ ID NO: 109761 - RNA, 63 nt, hsa
ccccucccucccuauaaggcuguggaaccugaggaaguagauacuugaagagauucuguuuag

SEQ ID NO: 109762 - RNA, 63 nt, hsa
uuuaaaugagggccaguauuaucucugcuuucagaaguagacauaauaggaugaaucauauaa

SEQ ID NO: 109763 - RNA, 63 nt, hsa
cuuuuaauuuagcaaaauauuugucgguggagggaaguagauaagaauguauuaguguauuuu

SEQ ID NO: 109764 - RNA, 63 nt, hsa
uccuauuuugaucuuuuucaagucuucugaaaggaaguagacaguauuacacccugaauaaau

SEQ ID NO: 109765 - RNA, 63 nt, hsa
aacaaaaaacaagaaugaaaaacagaaauaaaagaaguagaaaagacaaagaaagaaagccca

SEQ ID NO: 109766 - RNA, 63 nt, hsa
uaaaccucaaauaguuguguaucuguccuguuagaaguagaugacuucaauuaaacaaauuua

SEQ ID NO: 109767 - RNA, 63 nt, hsa
auaauaaaucagaugcccugaggcucuguugaggaaguagaaucccaaugggacuccagacag

SEQ ID NO: 109768 - RNA, 63 nt, hsa
ugaguugaucuagcuauuauuuaaguauuuauugaaguagaggggccuucaaacuacuuuaua

SEQ ID NO: 109769 - RNA, 63 nt, hsa
cucuagcagagggaggggacccaccccagugaggaaguagauugcugccucuagccagagacc

SEQ ID NO: 109770 - RNA, 63 nt, hsa
caguccccuguguuugccagagauacugugcucgaaguagagguuuuacucuacucaucacug

SEQ ID NO: 109771 - RNA, 63 nt, hsa
agaaggggugugcaugcgccuacucgcuugcuagaaguagauucuggacagucagcucuucau

SEQ ID NO: 109772 - RNA, 63 nt, hsa
gauugugcuauguuucaguggaagaaauucuuugaaguagaugugagugaaaaacugcaugcc

SEQ ID NO: 109773 - RNA, 63 nt, hsa
uccugaaguuuaugcuuuuccuuucugguaccggaaguagaaaacagcacauguugauuacga

SEQ ID NO: 109774 - RNA, 63 nt, hsa
ugcacuauacugauuaauuuuuuuuuuucuuuugaaguagauucuuauuacucagucauacug

SEQ ID NO: 109775 - RNA, 63 nt, hsa
ucucuuuaagugcuccucuagacuagacugauugaaguagacagugugguggaaucaguuuaa

SEQ ID NO: 109776 - RNA, 63 nt, hsa
gaaauggugagagccuugaagauacacgaggaugaaguagaggauauggaagaaaauuaagug

SEQ ID NO: 109777 - RNA, 63 nt, hsa
guuuuugcuuuagugcauugugugugcaagcaugaaguagaaacacuuuuuuuuucuggguac

SEQ ID NO: 109778 - RNA, 63 nt, hsa
gaugcuggcuaaaccgcuuuaaaguuuuauuuggaaguagaacuagcuuuaaaacgggguuca

SEQ ID NO: 109779 - RNA, 63 nt, hsa
gcagccaaauccgaggaagagaaacugaagggagaaguagauggcaaugguuaugauaaaaag

SEQ ID NO: 109780 - RNA, 63 nt, hsa
uauagcauacuaauauccaccugauuuauugacgaaguagacauuaggcaaagccaaacaaua

SEQ ID NO: 109781 - RNA, 63 nt, hsa
uauuuguguaggcccauggaaaucacuacuugugaaguagagaugccuuuuugucuaaugguu

SEQ ID NO: 109782 - RNA, 63 nt, hsa
uaauaaaagaaagcaugguauuaaacuaucauagaaguagacagaaaaagaaaaaaggacuca

SEQ ID NO: 109783 - RNA, 63 nt, hsa
aaaggcaaugucugacauuuuuggucucuguuagaaguagacucuguugaaaagaaagaagcu

SEQ ID NO: 109784 - RNA, 63 nt, hsa
ggcugucuggaaagggagggacaaaaggacccagaaguagaagaauggggauggaguggugag

SEQ ID NO: 109785 - RNA, 63 nt, hsa
guccggugucacaguucagucagugaggaugaugaaguagauacagucuucaggacaccauua

SEQ ID NO: 109786 - RNA, 63 nt, hsa
aucuuccuucaguguauuuuuguuuuucaagaggaaguagauuuuaacuggacaacuuugagu

SEQ ID NO: 109787 - RNA, 63 nt, hsa
gccauuguaccuuuugauguuuagaaguucguggaaguagacgcugaggugugcagaggagcu

SEQ ID NO: 109788 - RNA, 63 nt, hsa
aaaaugaguccuaaagaacauacugaguacuuagaaguagaagaacauaagauguauuucuga

SEQ ID NO: 109789 - RNA, 63 nt, hsa
acuguuguuuacuuguugcugauucaagaaacagaaguagaagaggaggagggauucuggucu

SEQ ID NO: 109790 - RNA, 63 nt, hsa
auauauuauuuuacugcuuaaauuccaaguccugaaguagaugguugagauaugaguucuucg

SEQ ID NO: 109791 - RNA, 63 nt, hsa
cucuaggaaaaaauacuugggauaucacaugaagaaguagacugaaauaucagauuugucauc

SEQ ID NO: 109792 - RNA, 63 nt, hsa
aauauuuaugcuuaguguaaacauucugugaaugaaguagacucuucgguggaauauauuaau

SEQ ID NO: 109793 - RNA, 63 nt, hsa
ugaaccucuuucugguucucagcagaaguaacugaaguagaucaggaaggggcugccucagga

SEQ ID NO: 109794 - RNA, 63 nt, hsa
uuuuguugguugcacuaacugcaagguugcugggaaguagaguccauuugguugaugagcuuu

SEQ ID NO: 109795 - RNA, 63 nt, hsa
aauguggaggcuuucuauagcauucuaagcugagaaguagauuguuacccaguaaugaaauaa

SEQ ID NO: 109796 - RNA, 63 nt, hsa
guuuauuuuuacuuuuagaauugguccuaugaagaaguagaaagugagucaugcacuagacag

SEQ ID NO: 109797 - RNA, 63 nt, hsa
cacaagcccagcucagauucaagaaaagggugugaaguagaggugcaguuaaguggggggcca

SEQ ID NO: 109798 - RNA, 63 nt, hsa
cuuccuuacacuugguggaauaagaaacuuuuugaaguagaggaaauacauugagguaacauc

SEQ ID NO: 109799 - RNA, 63 nt, hsa
cugucucugcaggaaggcuccggcuuaaucuaggaaguagauuccagcugcacgaugaggaac

SEQ ID NO: 109800 - RNA, 63 nt, hsa
gugaaacucuacccugaagaaagggauggauaggaaguagaccucuuuuucuuaccagucucc

SEQ ID NO: 109801 - RNA, 63 nt, hsa
agauaaugucuuaauuuuguaccaauucagguagaaguagaggccuaccuugaauuaaggguu

SEQ ID NO: 109802 - RNA, 63 nt, hsa
uuaugguuuugauucaagaaucgucuuauucuggaaguagaucugaauaggcuaccggagccu

SEQ ID NO: 109803 - RNA, 63 nt, hsa
accugugauccguguaucuucuccccagugacagaaguagagaagagaauggaaagcagcaca

SEQ ID NO: 109804 - RNA, 63 nt, hsa
uacccccacauauucaagaagcucaaaugaccugaaguagaauaaacauaauuuacaucacag

SEQ ID NO: 109805 - RNA, 63 nt, hsa
gcaugcauauuuuaauaucuguuuggauagucagaaguagaaucauaaagguaaaauaugagu

SEQ ID NO: 109806 - RNA, 63 nt, hsa
uuuuuguucuaaggugcaucuagugcagauagugaaguagauuagcaucuacugcccuaagug

SEQ ID NO: 109807 - RNA, 63 nt, hsa
uuuguauuauuguucucacuuauuauuaauaaugaaguagaaguuacuuaauugccagcaaau

SEQ ID NO: 109808 - RNA, 63 nt, hsa
uuguauaaucuuuuaccuauaaaauauuuauuugaaguagaggguaaaucagcgguaagaaca

SEQ ID NO: 109809 - RNA, 63 nt, hsa
ccaacauucuccuaagccaguuaccuuugcacugaaguagaauucaaaaggagauagagguuc

SEQ ID NO: 109810 - RNA, 63 nt, hsa
ccaccucaccucuuuguucuuccugucuccuuugaaguagacucauucuucacacgauugacc

SEQ ID NO: 109811 - RNA, 63 nt, hsa
agucauaaugacccaggaauagcuaaugacacagaaguagaucaaaauagaacacaauagaga

SEQ ID NO: 109812 - RNA, 63 nt, hsa
agcuuagauuugugaagggagaguagaaggggagaaguagaaccacaguguuuuauuuauuuu

SEQ ID NO: 109813 - RNA, 63 nt, hsa
cccaauacaggcaaacaaccuggucaaccuuuugaaguagaagaaaugaaaauuacuugacaa

SEQ ID NO: 109814 - RNA, 63 nt, hsa
uuuucauaagaguuuaaaugcugauauuugguggaaguagagaguaacucauauucuaucaau

SEQ ID NO: 109815 - RNA, 63 nt, hsa
guggagggucagaggucgggucuucggcccugagaaguagaaaugcaggggccgugcuguccc

SEQ ID NO: 109816 - RNA, 63 nt, hsa
acauauuaaacuuuucuuccccuuccuaguucugaaguagauauauauauauauauaucuacu

SEQ ID NO: 109817 - RNA, 63 nt, hsa
cccccuuuuccugcaccuaguggccuuucuugggaaguagagauguggcggcuuucccacccu

SEQ ID NO: 109818 - RNA, 63 nt, hsa
cugaagcagacagggaaugggagaggaggaugggaaguagacaguggcugguauggcucugag

SEQ ID NO: 109819 - RNA, 63 nt, hsa
uugaaagaugggguuggguaaaguagauuaggugaaguagaacauaaaauugaauaguaccca

SEQ ID NO: 109820 - RNA, 63 nt, hsa
cauuggaggugguuucuggccgugauuggaugugaaguagaagagguccucgaucaugguguu

SEQ ID NO: 109821 - RNA, 63 nt, hsa
uuccuaggcccuuucugccugugucagggccaggaaguagaggcugggaacucuucugguccc

SEQ ID NO: 109822 - RNA, 63 nt, hsa
gaaaauaguaacauugauauuucuugugaaggagaaguagaaaguaacagugacuucuagauu

SEQ ID NO: 109823 - RNA, 63 nt, hsa
uuagaggucccucuuuaccccagaccugggagggaaguagauguuuugccaaaauacuucuuc

SEQ ID NO: 109824 - RNA, 63 nt, hsa
aacucauagaagaugaacccuucaagaaaacgugaaguagaacgggugggccagaaaugaaaa

SEQ ID NO: 109825 - RNA, 63 nt, hsa
ugaugcuguguccaaaauuaugcacuguuuguugaaguagaaccagaaauccugaccuccugu

SEQ ID NO: 109826 - RNA, 63 nt, hsa
acaggccccgacaucaccccaaggacaacggcagaaguagagagaaacuaccuaccucacuuc

SEQ ID NO: 109827 - RNA, 63 nt, hsa
uuugcacuugugcuuucaguuagccuucuguaggaaguagaagucauauguugucuuuguugu

SEQ ID NO: 109828 - RNA, 63 nt, hsa
ccuuuugagcaagcgccaaugaguuucaggaaugaaguagaagguaguuauuuaaaaauaaaa

SEQ ID NO: 109829 - RNA, 63 nt, hsa
gugccagcugacuuaagggagugaacuaccugugaaguagaaaaucagagggaaguuuucauu

SEQ ID NO: 109830 - RNA, 63 nt, hsa
uguuaucaaacuuugaaauugaguugcuggaaugaaguagaggugacucucucugugguacac

SEQ ID NO: 109831 - RNA, 63 nt, hsa
aacauugugagcuuccuaccugacauguuggcagaaguagaauauuaggauccucaagcaucu

SEQ ID NO: 109832 - RNA, 63 nt, hsa
cugaaugagcaaaagcuggagcauuacucuugagaaguagaacaaggcacuucaguccuauuc

SEQ ID NO: 109833 - RNA, 63 nt, hsa
agaaauuggaugguugccgugucuguguagaaagaaguagacaugggagacuuuucauuuugu

SEQ ID NO: 109834 - RNA, 63 nt, hsa
accuugcacugauuuugucugagugcccugggagaaguagaaaaugauugaaagugacuuccg

SEQ ID NO: 109835 - RNA, 63 nt, hsa
caaugucacaagcacugugcuaaacacuguggugaaguagaacaauugcuaaucauuuccugg

SEQ ID NO: 109836 - RNA, 63 nt, hsa
ccuuaagcuuuuuugguuaagucuuccuuuucagaaguagaugucauuauaugccaaaagucu

SEQ ID NO: 109837 - RNA, 63 nt, hsa
aaaccacucaguaaaagcaaaagcuuguccugagaaguagagugaguucuuuuucacucugug

SEQ ID NO: 109838 - RNA, 63 nt, hsa
auauugauuaccuugaggggagugagaaaaggagaaguagagauaagggaaggggagacugua

SEQ ID NO: 109839 - RNA, 63 nt, hsa
cacugagccccagcugcugagaaggccuugagggaaguagaggcugggagcaaaugccccaug

SEQ ID NO: 109840 - RNA, 63 nt, hsa
uccuauguggugaucaugaauggcucauguguagaaguagauguacaucggcugagugacggu

SEQ ID NO: 109841 - RNA, 63 nt, hsa
aucucacacuuuuacccacugcuccaaaaaacagaaguagaaugccauuggaugucaaaugga

SEQ ID NO: 109842 - RNA, 63 nt, hsa
gcagcucuuucuccaggugggauguagcaccccgaaguagagcuuucugcucugcuccuggaa

SEQ ID NO: 109843 - RNA, 63 nt, hsa
uuuuuuaaugugccuuuuggguugguagaaacggaaguagaaguaggcuggaggaugaguugg

SEQ ID NO: 109844 - RNA, 63 nt, hsa
auaaaaucacugaagcaucaaaauauacuuuuggaaguagaugacuuugaaaacagaaauggu

SEQ ID NO: 109845 - RNA, 63 nt, hsa
uauaauucuuuaacagcuauagguuaucuggcugaaguagaccuaauuuuaugugacuugugg

SEQ ID NO: 109846 - RNA, 63 nt, hsa
gauuuuucucuuuccuaucuuugauggaaggaggaaguagaaagugguaaagaauugaggcuu

SEQ ID NO: 109847 - RNA, 63 nt, hsa
cagcccuucaaguucuuuuauuucuggguaacagaaguagacagacagguuacuugguguauc

SEQ ID NO: 109848 - RNA, 63 nt, hsa
cuccacagacacugacuguuuuuguccuauuaagaaguagaccacugagaagggagaagguga

SEQ ID NO: 109849 - RNA, 63 nt, hsa
uucugggaaguaauaaugaccauugacaacuaagaaguagacaccaugcuaaagacuuacaua

SEQ ID NO: 109850 - RNA, 63 nt, hsa
aauauuuugagugagggggagugggucaaagaggaaguagagguguaauccuguauuaacccu

SEQ ID NO: 109851 - RNA, 63 nt, hsa
ccucugagggaaagcccagaaaaggacagaaacgaaguagaaaggggcccaguccuggccugg

SEQ ID NO: 109852 - RNA, 63 nt, hsa
aaaauacuucugugcccccugauuugaggguaagaaguagauaaugaggccacuguggguguu

SEQ ID NO: 109853 - RNA, 63 nt, hsa
cagcaguaccugcuguuuagcaaagacugaugagaaguagacuuuuuuuuuuuuggagauaga

SEQ ID NO: 109854 - RNA, 63 nt, hsa
ucgauucuuauucuuuuauaauuaugcguggaagaaguagacacauuaaacgauuccaguugg

SEQ ID NO: 109855 - RNA, 63 nt, hsa
ggagggggaagcuuaucuugaaaaagcaucacagaaguagaaaaaaaugucgaaagcauuaua

SEQ ID NO: 109856 - RNA, 63 nt, hsa
ggggaugggguacugccggucuguguugucuuagaaguagaugugugauggccagaauaaaag

SEQ ID NO: 109857 - RNA, 63 nt, hsa
gaguaguugucagagugaagaguuuaaucaacagaaguagaguaacauauucuuuaguagaac

SEQ ID NO: 109858 - RNA, 63 nt, hsa
aagaaauaauugauggagccauugaugcaaaccgaaguagauuuagaacuuauaugaauuuga

SEQ ID NO: 109859 - RNA, 63 nt, hsa
uuagggaagaagaaaacauuuuaaagaauaccagaaguagaaucacauguaacagucucugca

SEQ ID NO: 109860 - RNA, 63 nt, hsa
aaagcaagaacagaaaacgaagccacaggaagggaaguagacauuguaugcuuaugguuucuc

SEQ ID NO: 109861 - RNA, 63 nt, hsa
aauaccgucagugugaaaacauuccguaguuuagaaguagacguugccaaugcugugacucaa

SEQ ID NO: 109862 - RNA, 63 nt, hsa
gacagauuguauuaauuuaaccaggacuauguagaaguagaaagaaaagaaaaagaaaaucuu

SEQ ID NO: 109863 - RNA, 63 nt, hsa
ugugggugaccgcccgaaggccuucacaggauggaaguagaaugauuucaguagauacucauu

SEQ ID NO: 109864 - RNA, 63 nt, hsa
gguguuugaagaggcucugggauagaugguuaagaaguagaaaauuuaguuuagggaaagccc

SEQ ID NO: 109865 - RNA, 63 nt, hsa
ggcacuuaacucuucauguuccaguucaucccagaaguagacaucccaggacccauucugugu

SEQ ID NO: 109866 - RNA, 63 nt, hsa
acuuaaaaauuaaauuggaaagcagguuucaaggaaguagaaacaaaauacaauuuuuuuggu

SEQ ID NO: 109867 - RNA, 63 nt, hsa
cuuauuauguaagggucauuagacaaaugucuugaaguagacauggaauuuaugaaugguucu

SEQ ID NO: 109868 - RNA, 63 nt, hsa
auccuacagauccucccauuucuagggaggucugaaguagaauuuucacuuuauguuagaaga

SEQ ID NO: 109869 - RNA, 63 nt, hsa
gaaauuaccuugcaauaaaguuggugggaccaggaaguagagaaaaaaaaaguaaaauguggu

SEQ ID NO: 109870 - RNA, 63 nt, hsa
cuuuugaauucacaccuuauugaaaucaguguagaaguagaguuaccuaaaccuuuaucgcca

SEQ ID NO: 109871 - RNA, 63 nt, hsa
gagaagguucuucguccaaaggaggaaggagaagaaguagaaagugcgaagagcugaguuccc

SEQ ID NO: 109872 - RNA, 63 nt, hsa
ucuugagggacggguaggaauuagccaguugaggaaguagaaggaauuuccagauauuggaaa

SEQ ID NO: 109873 - RNA, 63 nt, hsa
gaaaugagaaugacagccuuuuuuccugggccagaaguagaggggugggugcguaaggaugug

SEQ ID NO: 109874 - RNA, 63 nt, hsa
gucccaucugauaguggcuuugggaaccucugugaaguagagagcccucccuugucaggguua

SEQ ID NO: 109875 - RNA, 63 nt, hsa
uuuuuuguuauccuguauaccuccuccagccaugaaguagaggacuaaccauguguuauguuu

SEQ ID NO: 109876 - RNA, 63 nt, hsa
gaacuuugugaauggauuuaaauacaauaguaugaaguagaaguuaugcaaugagaaugaaua

SEQ ID NO: 109877 - RNA, 63 nt, hsa
gucucuuggagauuguugaaugcagccagugaagaaguagauuccuaaauuuuauuggggacc

SEQ ID NO: 109878 - RNA, 64 nt, hsa; identical to SEQ ID NO: 47001

SEQ ID NO: 109879 - RNA, 64 nt, hsa; identical to SEQ ID NO: 47002

SEQ ID NO: 109880 - RNA, 64 nt, hsa; identical to SEQ ID NO: 47003

SEQ ID NO: 109881 - RNA, 64 nt, hsa; identical to SEQ ID NO: 47004

SEQ ID NO: 109882 - RNA, 64 nt, hsa; identical to SEQ ID NO: 47005

SEQ ID NO: 109883 - RNA, 64 nt, hsa; identical to SEQ ID NO: 47006

SEQ ID NO: 109884 - RNA, 58 nt, hsa; identical to SEQ ID NO: 47007

SEQ ID NO: 109885 - RNA, 64 nt, hsa; identical to SEQ ID NO: 47008

SEQ ID NO: 109886 - RNA, 64 nt, hsa; identical to SEQ ID NO: 47009

SEQ ID NO: 109887 - RNA, 64 nt, hsa; identical to SEQ ID NO: 47010

SEQ ID NO: 109888 - RNA, 64 nt, hsa; identical to SEQ ID NO: 47011

SEQ ID NO: 109889 - RNA, 64 nt, hsa; identical to SEQ ID NO: 47012

SEQ ID NO: 109890 - RNA, 64 nt, hsa; identical to SEQ ID NO: 47013

SEQ ID NO: 109891 - RNA, 64 nt, hsa; identical to SEQ ID NO: 47014

SEQ ID NO: 109892 - RNA, 64 nt, hsa; identical to SEQ ID NO: 47015

SEQ ID NO: 109893 - RNA, 64 nt, hsa
ggcgcggggccacacccgugaaccaugcagacggccgaagaagucuuaggcagggcgcccuggg

SEQ ID NO: 109894 - RNA, 64 nt, hsa
cuacuguugcugggaacuuaggcuuaacauaaagccgaagaagguaccuagaaauuugaaacuu

SEQ ID NO: 109895 - RNA, 64 nt, hsa
agaacuggaccaaucaaaccucaggcgaucaaaaccgaagaaacaaaaucuuaaaggcuauggu

SEQ ID NO: 109896 - RNA, 64 nt, hsa
caccagggaaaguuuagagauuugcggcaauggaccgaagaacgggccaggaaguccuccaauu

SEQ ID NO: 109897 - RNA, 64 nt, hsa
agguagagagcagggcauaugcugacccaugcagccgaagaaagaagaggcagcaacaggagga

SEQ ID NO: 109898 - RNA, 64 nt, hsa
acguccugucacuccaccucgaacagcuaauccgccgaagaaaaggugaagaaaggaauucugu

SEQ ID NO: 109899 - RNA, 64 nt, hsa
acuccauuugaccagauuguuuggcuaacacaucccgaagaaugauuuugucaggaauuauugu

SEQ ID NO: 109900 - RNA, 64 nt, hsa
ggagaacaggggggaugauggggccaccgagaggccgaagaaggccaaggaggagcggcgcaug

SEQ ID NO: 109901 - RNA, 64 nt, hsa
cgacagauucaugccacggauaaaugaggcaaauccgaagaaaaggaaaaucgaauaaaaaaua

SEQ ID NO: 109902 - RNA, 64 nt, hsa
ccaggcguggacucugcccucagcuucacagucaccgaagaaaugaaguuacaggaggggcaca

SEQ ID NO: 109903 - RNA, 64 nt, hsa
uguaggagauagguacuguuguuuuuuauuaccgccgaagaaacaggccagauaagugaaguaa

SEQ ID NO: 109904 - RNA, 64 nt, hsa
uccuucaaugacaugaaaacugugcaagcaaaaaccgaagaaaaacacuuaaguacaacuguag

SEQ ID NO: 109905 - RNA, 64 nt, hsa
aaacccugccccaaugcaccugcaggcaagguacccgaagaagcagaggcugagggcaggcaaa

SEQ ID NO: 109906 - RNA, 64 nt, hsa
auggcccauuagauacaacagcaagcccaagauuccgaagaagacagacaacucccccuaguac

SEQ ID NO: 109907 - RNA, 64 nt, hsa
uuaucuaguuuaaaaacacuuuuuuucaaggaaaccgaagaaaccaucauccacuuuucucucu

SEQ ID NO: 109908 - RNA, 64 nt, hsa
gaaaugcuuuaaacucugaagacaggauaccucaccgaagaagccacacugauccaagauggga

SEQ ID NO: 109909 - RNA, 64 nt, hsa
gcuuaacucgccuaguagauuugcaccaauggaaccgaagaacuucauagacacucacaagguu

SEQ ID NO: 109910 - RNA, 52 nt, hsa
gugaauuccucaggaaguaaaaccgaagaagauggcccagcuccccaagaaa

SEQ ID NO: 109911 - RNA, 64 nt, hsa
auggggguacucaauggaguaugucugauggaucccgaagaauggagaggaacacaggcgcuga

SEQ ID NO: 109912 - RNA, 64 nt, hsa
ccccaaccauuugcacuacaagggcggaggcaccccgaagaaugaaaaguacacacccauggaa

SEQ ID NO: 109913 - RNA, 64 nt, hsa
aucagucugauggaaccuguugggaguuucuucaccgaagaauaucuuucuagcccucagccac

SEQ ID NO: 109914 - RNA, 64 nt, hsa
aauuucccauaggaagacuucaccuccuacaacuccgaagaaaacccuuacuguccaagaccgu

SEQ ID NO: 109915 - RNA, 64 nt, hsa
cuuauacacaauucauucuuugcagcuaauuaagccgaagaagccugggaaucaaguuugaaac

SEQ ID NO: 109916 - RNA, 64 nt, hsa
ugcuaggcccagcacaaugaacagauuuaccaucccgaagaaccaacuccuacaaaugagaauu

SEQ ID NO: 109917 - RNA, 64 nt, hsa
ccuugcuucagaggccugauggcgucggacuauuccgaagaaguggccaccuccgaaaaauucc

SEQ ID NO: 109918 - RNA, 64 nt, hsa
uucagucagccuguggcacuguucaucugcugucccgaagaaaccgagaacacauuuggugcac

SEQ ID NO: 109919 - RNA, 56 nt, hsa
cuagcuacagccaaucuuaaaacauuccgaagaauuccauaguggaccacuuggaa

SEQ ID NO: 109920 - RNA, 64 nt, hsa
gucauuuuaauccaaauuuucacagagaagaaucccgaagaauguaacaagaagcaaagccuuc

SEQ ID NO: 109921 - RNA, 64 nt, hsa
ugccaagaaauauauauuugucacuagggcauaaccgaagaaucaagugauuucuugccauccu

SEQ ID NO: 109922 - RNA, 64 nt, hsa
acaaaacuggagaugcaucgggaaagaagaaacuccgaagaaaagaauuuuaguguuaaugacu

SEQ ID NO: 109923 - RNA, 51 nt, hsa
gcaugagcaguggaagauaaaccgaagaauuaaagguaaauaugaaaugau

SEQ ID NO: 109924 - RNA, 64 nt, hsa
uggaauugugcuccaaaugucuacugaagcuuaaccgaagaacuaauaaauggacuacaguagc

SEQ ID NO: 109925 - RNA, 59 nt, hsa
auuuuucaggaagcuacuaaagugcuguuccgaagaauaggcugaaacaaaaauauaag

SEQ ID NO: 109926 - RNA, 64 nt, hsa
agaccagccuggacagcuuagugagaucccgucuccgaagaaaagauauguauucuaauuggca

SEQ ID NO: 109927 - RNA, 64 nt, hsa
ugaucagggaccaugaaaagaaacuugugcuucaccgaagaaaaauaucuaaacaucgaaaaac

SEQ ID NO: 109928 - RNA, 64 nt, hsa
uagucuuucaguacgagacaaaguuucuuaaaucccgaagaaaaauauaaguguuccacaaguu

SEQ ID NO: 109929 - RNA, 64 nt, hsa
cccgaugaccccagaaaaccgugugagauucguaccgaagaaccuuguggaaucccuuugcuua

SEQ ID NO: 109930 - RNA, 64 nt, hsa
ccagcaccucagccugcacagugucccccagguuccgaagaagaugcuccagcaacacagccug

SEQ ID NO: 109931 - RNA, 64 nt, hsa
guugauuuuguuuuuagcuuacugcugccuuuguccgaagaaacuguuccuccauuauuugaau

SEQ ID NO: 109932 - RNA, 64 nt, hsa
agaccuaugucuuucgauaugcagccaaguuuuaccgaagaaaaggcucuguggauaaagcucu

SEQ ID NO: 109933 - RNA, 64 nt, hsa
cugccaaaggauuuuggaaaguagcauuccuucgccgaagaaauggugauuucugccaggggcu

SEQ ID NO: 109934 - RNA, 64 nt, hsa
ggcugugcuuaagaauuuaagcucuguuuuaaagccgaagaagaaaacauuugaauuuaccuuc

SEQ ID NO: 109935 - RNA, 64 nt, hsa
aggauucuuuacugugccagcacggggauuggauccgaagaaacuggcuacugggguuuggccc

SEQ ID NO: 109936 - RNA, 64 nt, hsa
ccuccugcaguuggacugaauucuucccuuucauccgaagaaacccacuugcuguuuccagccg

SEQ ID NO: 109937 - RNA, 64 nt, hsa
gaggacaggcuguaugucagauuuaccuuuuauuccgaagaacucggagcauuuauuuuguuaa

SEQ ID NO: 109938 - RNA, 64 nt, hsa
ccacacgagagcuccaggcucugggcuggucacuccgaagaagaggauuugugacgucacuuag

SEQ ID NO: 109939 - RNA, 64 nt, hsa
uacguaauggagggaagaauuucccagccaucuuccgaagaauacaagaucccguccuccaggc

SEQ ID NO: 109940 - RNA, 64 nt, hsa
gaugucuuugugaugugaugcuuagcaguuuggcccgaagaaggaaaauauccaguaccaugcu

SEQ ID NO: 109941 - RNA, 64 nt, hsa
ugaucagagaccacgaaaagaaauuugugcuucaccgaagaaaaauaucuaaacaucgagaaac

SEQ ID NO: 109942 - RNA, 64 nt, hsa
uggauuaaacuuacaaaaaguaucuauaacuggaccgaagaauauggaagguaugaacagcagu

SEQ ID NO: 109943 - RNA, 64 nt, hsa
gcuuuacacagucaccuugcccuuccuuccaccaccgaagaaaaaagauggucauacuaacagg

SEQ ID NO: 109944 - RNA, 64 nt, hsa
uuccauggaaauaaaaaguauguuguacauacugccgaagaauugucuugcaaguuaaggcuuc

SEQ ID NO: 109945 - RNA, 64 nt, hsa
gaccauccggccaugaggaagcugccuaaggagcccgaagaauucugcugcucaccaggaccca

SEQ ID NO: 109946 - RNA, 64 nt, hsa
ccuucuuccacugucucauccacauaagcacuccccgaagaauuaaggggguucuguuuucaag

SEQ ID NO: 109947 - RNA, 64 nt, hsa
cacucccuuccccauagauaggccccuggggcucccgaagaaugaacccaagagcaagggcuug

SEQ ID NO: 109948 - RNA, 64 nt, hsa
ugucauaggcauagagaguugcacauaaaaaauaccgaagaaaacccaaaauucaaucaacaau

SEQ ID NO: 109949 - RNA, 64 nt, hsa
auauacaaaggggaccagugccacagaaggguacccgaagaaaugagaagucaaggacucucuu

SEQ ID NO: 109950 - RNA, 64 nt, hsa
caggugugacugucaguuugcuggucuuccaauaccgaagaaagggugguugugacaauaccuc

SEQ ID NO: 109951 - RNA, 64 nt, hsa
acagggcugcaagugcccugccaggcucuaaggcccgaagaacaggugauaucgggggcgcugc

SEQ ID NO: 109952 - RNA, 64 nt, hsa
agggcgaagauggccgagaugauccuaaaaauaaccgaagaaagagaggaccaaccagaauucc

SEQ ID NO: 109953 - RNA, 64 nt, hsa
gcucauguucuucaucuucucaaaucaucagaggccgaagaaaaacacuuuggcugugucuaua

SEQ ID NO: 109954 - RNA, 64 nt, hsa
ggcccacuucaggguucuccucuccccucuaaggccgaagaaggguccuucccucuccccaaga

SEQ ID NO: 109955 - RNA, 64 nt, hsa
uggacgugcugcgcauguucgggagcgaacucccccgaagaaggaccagugaagacgucagggg

SEQ ID NO: 109956 - RNA, 64 nt, hsa
agugaguuuguguguaugaauuuguaccuguuuuccgaagaaaaaagcaauacugaacaaaaca

SEQ ID NO: 109957 - RNA, 64 nt, hsa
cuucacuaaagugucauccaccaguguguugaauccgaagaaugacaauuuucuaccacuggug

SEQ ID NO: 109958 - RNA, 64 nt, hsa
aauaggcauggagccgccacacccagccaaugugccgaagaaagaaagaaaaacaugcucaucc

SEQ ID NO: 109959 - RNA, 64 nt, hsa
uccacuacagacccagccccagguucaauguccuccgaagaaugaagucuuucccuggugaugg

SEQ ID NO: 109960 - RNA, 64 nt, hsa
cuuccugcagaacacacagugccuuaugccacagccgaagaauccguggggccggcaagcaggc

SEQ ID NO: 109961 - RNA, 64 nt, hsa
ggagugugggggcauuuggggggugaaguggcccccgaagaauggaacccacacccauagcucu

SEQ ID NO: 109962 - RNA, 64 nt, hsa
agagagcuuugugugauucauguuuuaaaaagaaccgaagaagccacaggcagggccugaggga

SEQ ID NO: 109963 - RNA, 64 nt, hsa
cccucugaaucaugcagggaagggucugccccugcccuggcacacacaggcacccauucccucc

SEQ ID NO: 109964 - RNA, 64 nt, hsa
gcagucacucugcuaagagucccucccugccacgcccuggcaggacacaggcacuuuuccaaug

SEQ ID NO: 109965 - RNA, 64 nt, hsa
gggggguacagagggagaaggcucugcaagagcucccuggcaauacccccuuguguaauugcuu

SEQ ID NO: 109966 - RNA, 64 nt, hsa
ggccccuguggccugggugggcccucccgccccucccuggcaggacaaucugcuugugucuccc

SEQ ID NO: 109967 - RNA, 64 nt, hsa
aaucccaguuuugcagucaacuauuaaccuggggcccuggcagauugggguauccacccaguca

SEQ ID NO: 109968 - RNA, 64 nt, hsa
gaggcaggaaaaacgcgagugucugaagaccucacccuggcagggugggcuucuauccacccau

SEQ ID NO: 109969 - RNA, 64 nt, hsa
gagcuuuggcuauacucucuccucccgacccccacccuggcauacuacacagaucacucugggc

SEQ ID NO: 109970 - RNA, 64 nt, hsa
uggcugaucaccccuugcuucuuggauggcacuucccuggcaccucuguggcuaguuguccuac

SEQ ID NO: 109971 - RNA, 64 nt, hsa
cuuucucuggggaccccauuccugucaguagcaacccuggcaguguccggagcggcucuagaca

SEQ ID NO: 109972 - RNA, 64 nt, hsa
guuccucccucucuggccugugccgccucagcagcccuggcagaacugaagagcggcaccgggc

SEQ ID NO: 109973 - RNA, 64 nt, hsa
uuggaaauugcauuuguaaccaaggggugcgaaacccuggcagucccaggcagcaccaggccag

SEQ ID NO: 109974 - RNA, 64 nt, hsa
acccagcuccagcucccguuagccaggacuuguccccuggcagcugggcugagucugcccugag

SEQ ID NO: 109975 - RNA, 64 nt, hsa
gcuuaguagccuugaagcagcacaucuccacugucccuggcaggauugugggaggcuucacaac

SEQ ID NO: 109976 - RNA, 64 nt, hsa
gauugacuggcugcucacucaggcagguggccugcccuggcauccuguagauucugagcagguu

SEQ ID NO: 109977 - RNA, 64 nt, hsa
ggugagcuggaguugggggugucucgggcccaggcccuggcagagaaacagggaggccugggga

SEQ ID NO: 109978 - RNA, 64 nt, hsa
caggcccagggccgcaugugugcacucuacgccucccuggcacugcuaucaggacugagccagg

SEQ ID NO: 109979 - RNA, 64 nt, hsa
ggggcccucuggaguugauacaagccugccugagcccuggcacacccguuugggguugguccuu

SEQ ID NO: 109980 - RNA, 64 nt, hsa
gcgcagcugcaagguugccaggacccacccucaucccuggcaccgucaugggaguuugcucuug

SEQ ID NO: 109981 - RNA, 64 nt, hsa
gcuaaagcaucucacucccagggcagccccagcacccuggcauugcgggaggugcucugcugca

SEQ ID NO: 109982 - RNA, 64 nt, hsa
agucaaacuuuuuuguagaaccuucuuucccuuacccuggcaaauugcuucuuuacuugcuggu

SEQ ID NO: 109983 - RNA, 64 nt, hsa
caaggauagcuacugacagccuccugcugcccuacccuggcaggcacaggcgcagcuggcuggg

SEQ ID NO: 109984 - RNA, 64 nt, hsa
cucccauuccagguacuagcuguguguucugcaccccuggcaccuuccucuccucccacacagg

SEQ ID NO: 109985 - RNA, 64 nt, hsa
agaacacagagagggacaaacacagccaugaacccccuggcacuaguaccagcaccuaguuggc

SEQ ID NO: 109986 - RNA, 64 nt, hsa
cagaggggcaguugaagucucguccuggucucugcccuggcauggacuggcacagagguguucu

SEQ ID NO: 109987 - RNA, 64 nt, hsa
aagguacauaccaccccuucugccgcgccuccaccccuggcaccaaggucuucugcugcuuaug

SEQ ID NO: 109988 - RNA, 64 nt, hsa
gcccuucccgcaccgccgccagcgcccgcagacacccuggcaucucaagagggagugaggagag

SEQ ID NO: 109989 - RNA, 64 nt, hsa
auugaaaaaagagauucaagagccaaguacucagcccuggcaggggauggggacaugaugccca

SEQ ID NO: 109990 - RNA, 64 nt, hsa
caugaugcccagagccaccccuauacuccagucucccuggcaucagcuacugcaguacuggggu

SEQ ID NO: 109991 - RNA, 64 nt, hsa
ccuggcccccaggagcuggaggcaccgcccacuccccuggcauuccagcuuugcaggugacccu

SEQ ID NO: 109992 - RNA, 52 nt, hsa
acgucagcagucggcacugagucccuggcaccaggcucuggcgcucugcugg

SEQ ID NO: 109993 - RNA, 64 nt, hsa
gcguuccugccgcagcucugaccuggugcugucgcccuggcaucuuaauaaaaccugcuuauac

SEQ ID NO: 109994 - RNA, 64 nt, hsa
cgcccuggcaucuuaauaaaaccugcuuauacuucccuggcaggggagauaccaugaucgcgga

SEQ ID NO: 109995 - RNA, 64 nt, hsa
cuuugagccuuuggccacauccaccucgaggggacccuggcaccccgggcacacaaaccucugu

SEQ ID NO: 109996 - RNA, 64 nt, hsa
ggugccaggccuuagagcagacaagggcucucagcccuggcaugcccccuaaagggaccaaggu

SEQ ID NO: 109997 - RNA, 64 nt, hsa
gugggucccuggcaagugucuugugauaggcagucccuggcagggccuucgggugguuggcaag

SEQ ID NO: 109998 - RNA, 64 nt, hsa
ggugugccuuggcucccaagguggcacugugggucccuggcaagugucuugugauaggcagucc

SEQ ID NO: 109999 - RNA, 64 nt, hsa
uuugugguggggggugcggaggagguacccccaccccuggcacagccgccuggaaugcaggacu

SEQ ID NO: 110000 - RNA, 64 nt, hsa
ugcugugugaugggcaggcuuugccccagcccaccccuggcaaggugcacuuguuuucugguuu

SEQ ID NO: 110001 - RNA, 64 nt, hsa
ucuguggcucaccuuuauucuugaaacugagguuuaccuggaucuggcuacugaggcuagagcc

SEQ ID NO: 110002 - RNA, 64 nt, hsa
augggggcuguguuugcacaaguuauuuucauguuaccuggagaguguccagaggcugcucuga

SEQ ID NO: 110003 - RNA, 64 nt, hsa
aucuuguggaagacugucuuggauggggaaguacuaccuggagauuucaaauucacuuggccug

SEQ ID NO: 110004 - RNA, 64 nt, hsa
auguuugaaguuguaaucugucccaucauaaacuuaccuggagcucauguggaggaacagaagg

SEQ ID NO: 110005 - RNA, 64 nt, hsa
aacuuaccuuuccagguuuguuuuaguauguauguaccuggaaauuuuuauuacuuuuuauacc

SEQ ID NO: 110006 - RNA, 64 nt, hsa
auuggccucuuuguacuggaaaaguauucagugguaccuggaggucuggacaguuauacuguaa

SEQ ID NO: 110007 - RNA, 64 nt, hsa
ccgugucagcguguggugucgccugcaugggucguaccuggaugguguguccaccaucgacacg

SEQ ID NO: 110008 - RNA, 64 nt, hsa
guacauuucuuaugagcuuuguuuauauacccauuaccuggauguuuuuguccacugggagagg

SEQ ID NO: 110009 - RNA, 64 nt, hsa
cccuggugcugccaccugccccuacucaagugucuaccuggagccccuggggcggugcuggcca

SEQ ID NO: 110010 - RNA, 64 nt, hsa
cugagauuccagaaaucugcugcauuucacaugguaccuggaacccaacaguucauggauaucc

SEQ ID NO: 110011 - RNA, 64 nt, hsa
ucauaagaauacaaaguauacauacaguauugcuuaccuggaggauucagaucauuuaggaauu

SEQ ID NO: 110012 - RNA, 64 nt, hsa
uuacaggcaucagaaaauaaguaaucaaauuagguaccuggaaacauagcuauuaccaucucau

SEQ ID NO: 110013 - RNA, 64 nt, hsa
aaugcgcucauuaugcaagucgccuacucucugcuaccuggacguucauucuuauguauuagga

SEQ ID NO: 110014 - RNA, 64 nt, hsa
ggaaaucaugccaaaaaaauccaaaacaaagaaguaccuggaguggagagaguauuccugcuga

SEQ ID NO: 110015 - RNA, 64 nt, hsa
ucuacucgguaaaauuuuuuuuaaaaaaugugcauaccuggauuuccuuggcuucuuugagaau

SEQ ID NO: 110016 - RNA, 64 nt, hsa
gaagcugcucacccaagauuuggugcaggaaaacuaccuggaguaccggcaggugcccagcagu

SEQ ID NO: 110017 - RNA, 64 nt, hsa
aguggaaugcagggaagagggcaguaccugggaaaggacccacccaucuuccugcugcuguaac

SEQ ID NO: 110018 - RNA, 64 nt, hsa
acucagagcagagcaaaugagggagggggcgcucaggacccaggcccuccaugggcuaguguga

SEQ ID NO: 110019 - RNA, 64 nt, hsa
uuccgggccugcucuagugaggagugccuaagccaggacccagaaacucagaguugauggugag

SEQ ID NO: 110020 - RNA, 64 nt, hsa
guccucucagccaggugccguguuggccuuggcuaggacccagagccacacugcagccuccgcc

SEQ ID NO: 110021 - RNA, 64 nt, hsa
cuacuucccugacuggagcuaaaucccaccagccaggacccaaacucuccuuaccgagaaggac

SEQ ID NO: 110022 - RNA, 64 nt, hsa
agugaaagguagggaaagugggagagggacuuggaggacccaccugugaggacccugaccuggc

SEQ ID NO: 110023 - RNA, 64 nt, hsa
gggauuucugugcuauaaaccugauucuaaauguaggacccaaguuucuggacuacuucagaau

SEQ ID NO: 110024 - RNA, 64 nt, hsa
gaggggaggcgaggaagaguaauauuuagcauucaggacccacccacccuaugccggcuucugu

SEQ ID NO: 110025 - RNA, 64 nt, hsa
ugcuugccuagggccucugugauggacaucucguaggacccagccagucucauccagcagguug

SEQ ID NO: 110026 - RNA, 64 nt, hsa
ugacuuccccagggugcacagcgaguaacagaucaggacccaaacuugggcagucugggcuggg

SEQ ID NO: 110027 - RNA, 64 nt, hsa
gccgacucugcucccaucucagccaugaggccucaggacccacucugcucacagguggcuuccu

SEQ ID NO: 110028 - RNA, 64 nt, hsa
gcucccaagccggaguucacagucaucacugugcaggacccagguuccucccagaccugaaccc

SEQ ID NO: 110029 - RNA, 64 nt, hsa
ccaggagccccggcggcgcagcugcaagguugccaggacccacccucaucccuggcaccgucau

SEQ ID NO: 110030 - RNA, 64 nt, hsa
gagcucaagaagcugcugcacgggcugggccuucaggacccagagggcuuccuauucaaggaga

SEQ ID NO: 110031 - RNA, 64 nt, hsa
auccuuucggcuucccaguugagcucccaagaccaggacccacuggggcauauaaaaaagucaa

SEQ ID NO: 110032 - RNA, 64 nt, hsa
guccuuucggcuucccaguugagcucccaagaccaggacccacuggggcauauaaaaucucugc

SEQ ID NO: 110033 - RNA, 64 nt, hsa
gucauccauuucccaguuagggcaacaaugaaggaggacccagccaagcuagaaggaauuuugu

SEQ ID NO: 110034 - RNA, 64 nt, hsa
cagcagguucucugcccucccuagggguuggggaaggacccaccccggucagcacagugccuuu

SEQ ID NO: 110035 - RNA, 64 nt, hsa
gccccuccccacaccaguugaacugcaggaagagaggacccauccugccacaggacccagaaaa

SEQ ID NO: 110036 - RNA, 64 nt, hsa
uugaacugcaggaagagaggacccauccugccacaggacccagaaaaaaagcccaacacacacu

SEQ ID NO: 110037 - RNA, 64 nt, hsa
acaagucccaagaugccagaaaggcagucucccaaggacccaccaugcagaagugucaauaaac

SEQ ID NO: 110038 - RNA, 64 nt, hsa
ucccauccuuguccuucucucccucagaagccucaggacccaacagguggcaggcaguggacag

SEQ ID NO: 110039 - RNA, 61 nt, hsa
uaccagagauguggugagcucuguucuucuaccaacccagucucaacacacaaagugccac

SEQ ID NO: 110040 - RNA, 61 nt, hsa
cugagcuacuugaagggggccaucuagguccccaacccauggacuuugccuccauuuucag

SEQ ID NO: 110041 - RNA, 61 nt, hsa
cacggccuagcccaacccagcccaacccggcccaacccagcccagcccagcucagcucagc

SEQ ID NO: 110042 - RNA, 51 nt, hsa
ccagcagcagcacggccuagcccaacccagcccaacccggcccaacccagc

SEQ ID NO: 110043 - RNA, 61 nt, hsa
uaauagugaaccacaccaggagaacaaauacccaacccaguggcaucagcagucacagagc

SEQ ID NO: 110044 - RNA, 61 nt, hsa
cuagacaucaaagcagcguuccaaccugaggccaacccaucucaccugacacugaauacug

SEQ ID NO: 110045 - RNA, 61 nt, hsa
gccaggcgcagccaucgggaaggucauucagccaacccagaggauguagacccuguccuca

SEQ ID NO: 110046 - RNA, 61 nt, hsa
cuccucacagggccuggccauauagccagcuccaacccaaagcccugcacagugccucacc

SEQ ID NO: 110047 - RNA, 61 nt, hsa
ugcaccuuccucucccaggucgcugcugcagccaacccaguagcccccuuagcgcccccgc

SEQ ID NO: 110048 - RNA, 61 nt, hsa
cuuaagccauguccucaucugcccacccuccccaacccacauaccuccauuccacuuguga

SEQ ID NO: 110049 - RNA, 61 nt, hsa
ugggucccagccugguuugcaaagaccaccuccaacccaacccaaucccucuccacucuuc

SEQ ID NO: 110050 - RNA, 61 nt, hsa
cccagccugguuugcaaagaccaccuccaacccaacccaaucccucuccacucuucucucc

SEQ ID NO: 110051 - RNA, 61 nt, hsa
gaggcucugcucagaguucggcggacccaccccaacccaacucccagccgccagccaaagc

SEQ ID NO: 110052 - RNA, 61 nt, hsa
gaguccugggucccaguccagcugcugccucccaacccaugcccgcuagaaaccugcugcg

SEQ ID NO: 110053 - RNA, 61 nt, hsa
accccacaucccaccacauccaccuccauccccaacccauccucauccccaacuacagccc

SEQ ID NO: 110054 - RNA, 61 nt, hsa
cucauccucauccccaacugcagccccaaacccaacccagggccauccccaaacccauccc

SEQ ID NO: 110055 - RNA, 61 nt, hsa
uugagacagcagccuaucuggggccacacagccaacccagcccuggucccugaggucugcc

SEQ ID NO: 110056 - RNA, 61 nt, hsa
uugggccccuuccucugacccucguuggaccccaacccagacccccuuuucuccauguacc

SEQ ID NO: 110057 - RNA, 61 nt, hsa
gagaaauccugcacccaucagccaacacuccccaacccaucggccaccccaagcccucugc

SEQ ID NO: 110058 - RNA, 61 nt, hsa
uugaugcuuugggggcucaauuauuuuauauccaacccagcaucuuucuagucccuaugcu

SEQ ID NO: 110059 - RNA, 64 nt, hsa
augaauuuucuacuucuacacccauuugagagacaccaauaaaagaaagucauauguaggaaac

SEQ ID NO: 110060 - RNA, 64 nt, hsa
acacaacguaaguuauuuagaaucacuuuaaucaaccaauaauccuuagccaauuuauaaggga

SEQ ID NO: 110061 - RNA, 64 nt, hsa
aaacugcccaugucauuuguuuccagaaacgaggaccaauaauucucucacacuggcauuugug

SEQ ID NO: 110062 - RNA, 64 nt, hsa
ccugcaaauugcuguaauuuuauaccauguucuaaccaauaaacagaacuauuucuuacacucu

SEQ ID NO: 110063 - RNA, 64 nt, hsa
aauaauugccugcuucagaggcuaauauaacaaaaccaauaaaaccgagugaugguguuuguau

SEQ ID NO: 110064 - RNA, 64 nt, hsa
ccauaauaugaugcuuuuuaagauguauguucacaccaauaauugccugcuucagaggcuaaua

SEQ ID NO: 110065 - RNA, 64 nt, hsa
acagugggccuggguaaagagucacauugguaggaccaauaaagaauaauaaaaagacaaagca

SEQ ID NO: 110066 - RNA, 64 nt, hsa
agcaugacugauuaacagaauuuuauacaacuguaccaauaaaauuccaaauuggaauuguuuu

SEQ ID NO: 110067 - RNA, 64 nt, hsa
caaagccccagggcuggcccguuugggacagcugaccaauaaacacugaugguguguuugucuc

SEQ ID NO: 110068 - RNA, 64 nt, hsa
cuauagcaggcaccaaagcaagugcccgguaaauaccaauaagaaauuaaggaaagaaacaaac

SEQ ID NO: 110069 - RNA, 64 nt, hsa
aaugacaugguuaaucuggaacuuacguucuuauaccaauaaaagguaccucaauacauguucu

SEQ ID NO: 110070 - RNA, 64 nt, hsa
gagcuggcacugaagaucuccagggacuucagagaccaauaaaagcccauagggaagagagaga

SEQ ID NO: 110071 - RNA, 64 nt, hsa
gaguauuauuugcaauuuuauuaguuacagugcuauuaaagaauaugugcuccuuuuuauuaua

SEQ ID NO: 110072 - RNA, 64 nt, hsa
uuaggugugauauaguguuagauuuuuuugauguauuaaagaaugcaucuccaauccuuaggcc

SEQ ID NO: 110073 - RNA, 64 nt, hsa
uuuacugaacuuuuuauguaaaaaaauaaaaucaauuaaagaacuuggcauguguguucccuaa

SEQ ID NO: 110074 - RNA, 64 nt, hsa
auaugauacaccaacuucuaaaaagaaaguacgaauuaaagaccgcaauaaacuuucuacagag

SEQ ID NO: 110075 - RNA, 64 nt, hsa
acagaaaaguugaaaccacaacaaaaugaauucuauuaaagaauagccccagauauaaauucuc

SEQ ID NO: 110076 - RNA, 64 nt, hsa
cucuugaaagcaauguucauaaauauuuaagcaaauuaaagacaauguuaacaaauuuucuauu

SEQ ID NO: 110077 - RNA, 64 nt, hsa
aaucucgcauugcucccuaagcacccugggccuuauuaaagagcaacuucuauuuccagucggg

SEQ ID NO: 110078 - RNA, 64 nt, hsa
uauaaacugcucuugcaguccaaagggauaccugauuaaagaaguuucuuauuuaaacaucuca

SEQ ID NO: 110079 - RNA, 64 nt, hsa
guacuaccuuauacccuuccccaaaaacaaagggauuaaagaccuaaauaugaagacaaaacuu

SEQ ID NO: 110080 - RNA, 64 nt, hsa
cauggaacugucaaaggauucguaucuggaauacauuaaagaagcaaaagaaccucauacaaaa

SEQ ID NO: 110081 - RNA, 64 nt, hsa
uaagaucauaacaaugucucaugauguaaaaaauauuaaagauaucaauacuaagugacaguau

SEQ ID NO: 110082 - RNA, 64 nt, hsa
uuuaauaauguugccuuggaaacauuuuugagauauuaaagauuggaauguguuguaaguuucu

SEQ ID NO: 110083 - RNA, 64 nt, hsa
uguaacgacacaaucagcacaacuggagagaggcauuaaagaaccagggaagguaguuugauuu

SEQ ID NO: 110084 - RNA, 64 nt, hsa
cucaaaaaaagagacuuguuacaugaaaguuuucauuaaagagcugaaaacaagaauuuagaga

SEQ ID NO: 110085 - RNA, 64 nt, hsa
ucucaaaauguauagccagacuugagaggugacaauuaaagaucuaaaaaagagaggagauucc

SEQ ID NO: 110086 - RNA, 64 nt, hsa
agcuacuggaugcacugucagauuaacuuauuucauuaaagaaguugggagaacaaauaggaaa

SEQ ID NO: 110087 - RNA, 64 nt, hsa
guguguguggugugucuuucaugacacugacauuauuaaagaguucaggcaaguuuguggaaug

SEQ ID NO: 110088 - RNA, 64 nt, hsa
uaagaauguauuaguguauuuuaaaguaauaaugauuaaagaauaacuaaaugacucugauuuu

SEQ ID NO: 110089 - RNA, 64 nt, hsa
gcguugggcaugauuacugcaguguuuguucuuuauuaaagacagggagucguggcugucucua

SEQ ID NO: 110090 - RNA, 64 nt, hsa
cacaugucaugcuagccaagaggacauuauugucauuaaagagaggcauuauuuauacacccug

SEQ ID NO: 110091 - RNA, 64 nt, hsa
uaauuuacuuagccucucugugucuuuccaccuaauuaaagaggauccaccccaggguuauuuu

SEQ ID NO: 110092 - RNA, 64 nt, hsa
augcuuuuuacuacaaacaaaauuacucaccuggauuaaagauuaaggccuuaaucuguuuaga

SEQ ID NO: 110093 - RNA, 64 nt, hsa
ugaaauugccccaguucagaguugaauguuuauuauuaaagaaaaaaguaauguacauauggcu

SEQ ID NO: 110094 - RNA, 64 nt, hsa
ccuaaaugguuauauuugauagaauucauaacacauuaaagagaaaauuucacauuaaaggaag

SEQ ID NO: 110095 - RNA, 64 nt, hsa
uauuuguauggaauucuuauucaaauacaguucuauuaaagaguauacuccuauuggaugaaaa

SEQ ID NO: 110096 - RNA, 64 nt, hsa
uugaguaugcuagcuaaaaaauaucaagugccugauuaaagaauugcuaaaugguugucaauac

SEQ ID NO: 110097 - RNA, 64 nt, hsa
auuacagaaaguuaaguguauacuacaaacucuaauuaaagauaaaaaucuuuucuacuuuucu

SEQ ID NO: 110098 - RNA, 64 nt, hsa
ggaaggcauauuuuguauguauaaauucaccacaauuaaagauuauucuugucaguccuugcua

SEQ ID NO: 110099 - RNA, 64 nt, hsa
guaaguuuggcuuugugggaauagguguggagaaauuaaagagugaaggccauauuucauuuuu

SEQ ID NO: 110100 - RNA, 64 nt, hsa
guuugauuugaaauaaaaggaaauuuuagcaaggauuaaagaaaaaagcuaucagcuguauguu

SEQ ID NO: 110101 - RNA, 64 nt, hsa
auguuuucauuccaaacugguagugguauguagaauuaaagauaauaauguugcuucuuauuca

SEQ ID NO: 110102 - RNA, 64 nt, hsa
gaaaaccuuccuuuucagauucccugucugcucaauuaaagauguuugaauccaaaggaaguca

SEQ ID NO: 110103 - RNA, 64 nt, hsa
gcaaaagucaggaaagagguugugagcugauuggauuaaagaccuggcacuucaguaacucagc

SEQ ID NO: 110104 - RNA, 64 nt, hsa
cucauggcaaguugaauggugagcuagcuuauaaauuaaagagcucugaacuguauucagaccg

SEQ ID NO: 110105 - RNA, 64 nt, hsa
cucuaaggaaaggaugcaugagcuaacaccugacauuaaagaagcaagccaagugaggagccag

SEQ ID NO: 110106 - RNA, 64 nt, hsa
agaugggaaaauuagugucuagaaauacucucccauuaaagaggaagagaagauuuuaaagacu

SEQ ID NO: 110107 - RNA, 64 nt, hsa
ucauguauuauaugugcuguaacaucauguacguuaccuccaucuauuuuaggauauuuuccuc

SEQ ID NO: 110108 - RNA, 64 nt, hsa
uggggaaaaaagaugaaaaacuugaacuacaaauuaccuccauguauauuauuggccauaguua

SEQ ID NO: 110109 - RNA, 64 nt, hsa
gauauucuagacuuguuuuaguaauggaaacucuuaccuccacauauuauccuacagauguuuc

SEQ ID NO: 110110 - RNA, 64 nt, hsa
cuagauuuguuucuguuuuauagauuuaauucaauaccuccacauagauguuuuuauauuacau

SEQ ID NO: 110111 - RNA, 63 nt, hsa
gcacucagaaaaaauaggcagucccugaugcucagaucuuagccuugauauuaauaguugaga

SEQ ID NO: 110112 - RNA, 63 nt, hsa
acccugcccaugauuaaacaucauguauguagaagaucuuaaguccauacgcauuucaugaag

SEQ ID NO: 110113 - RNA, 63 nt, hsa
aguaugugaagaaaaucuacuuguaaaaggcucagaucuuaauuaaaagguaauuguagcaca

SEQ ID NO: 110114 - RNA, 63 nt, hsa
agcaaugaauugugccuaguggagaaccucuauagaucuuaaaaaaugaauuauucuuuagca

SEQ ID NO: 110115 - RNA, 63 nt, hsa
agugguuugaauaaaguagaucaaaacuuccagagaucuuaauggcuauauaggaagaaauau

SEQ ID NO: 110116 - RNA, 63 nt, hsa
cuuaauguagguaggcccagagucuuacauuuaagaucuuacaugcaguuauaaaaccgccac

SEQ ID NO: 110117 - RNA, 64 nt, hsa; identical to SEQ ID NO: 102277

SEQ ID NO: 110118 - RNA, 64 nt, hsa; identical to SEQ ID NO: 102278

SEQ ID NO: 110119 - RNA, 64 nt, hsa; identical to SEQ ID NO: 102279

SEQ ID NO: 110120 - RNA, 64 nt, hsa; identical to SEQ ID NO: 102280

SEQ ID NO: 110121 - RNA, 56 nt, hsa; identical to SEQ ID NO: 102281

SEQ ID NO: 110122 - RNA, 64 nt, hsa; identical to SEQ ID NO: 102282

SEQ ID NO: 110123 - RNA, 64 nt, hsa; identical to SEQ ID NO: 102283

SEQ ID NO: 110124 - RNA, 64 nt, hsa; identical to SEQ ID NO: 102284

SEQ ID NO: 110125 - RNA, 64 nt, hsa; identical to SEQ ID NO: 102285

SEQ ID NO: 110126 - RNA, 64 nt, hsa; identical to SEQ ID NO: 102286

SEQ ID NO: 110127 - RNA, 64 nt, hsa; identical to SEQ ID NO: 102287

SEQ ID NO: 110128 - RNA, 64 nt, hsa; identical to SEQ ID NO: 102288

SEQ ID NO: 110129 - RNA, 64 nt, hsa; identical to SEQ ID NO: 102289

SEQ ID NO: 110130 - RNA, 64 nt, hsa; identical to SEQ ID NO: 102290

SEQ ID NO: 110131 - RNA, 64 nt, hsa; identical to SEQ ID NO: 102291

SEQ ID NO: 110132 - RNA, 64 nt, hsa
acguuugaggaacaggagugggcacugauagaaaggacuucaacgccagugacuguguaccucc

SEQ ID NO: 110133 - RNA, 64 nt, hsa
gcucacuucuagagagaagaaaaaggcuggguuuggacuucaugccuccucacuggugaaaccc

SEQ ID NO: 110134 - RNA, 64 nt, hsa
acccugcugguacccagacccccaccuucggaggggacuucauguuccguguacguuugcaucu

SEQ ID NO: 110135 - RNA, 64 nt, hsa
uaacuggccuccagccacauucucauagcagguaggacuucagccuuccagacacugcccuuag

SEQ ID NO: 110136 - RNA, 64 nt, hsa
cccaggucagccaagaaagauacauaaucucaugggacuucagugggaguuacacaggaauguu

SEQ ID NO: 110137 - RNA, 64 nt, hsa
acuugggguccaucaccccaggggguccauaguuggacuucagagggucuaugaaaccccuaaa

SEQ ID NO: 110138 - RNA, 64 nt, hsa
guaccugucugaagagugacauuaaacuuugaaaggacuucacugcuccuuuacgauauuccaa

SEQ ID NO: 110139 - RNA, 64 nt, hsa
agguuuauaaacuaucuuuuaaaauuuuaagccaggacuucaaaaauuguagaguacuuguuug

SEQ ID NO: 110140 - RNA, 64 nt, hsa
ugaaugccggggacagagaggggcagguugaccgggacuucaaagccgugaucgugaauaucga

SEQ ID NO: 110141 - RNA, 64 nt, hsa
aauaaauaaauccuccagucuggaucguuugacgggacuucagguucuuucugaaaucgccgug

SEQ ID NO: 110142 - RNA, 64 nt, hsa
uccuugcaggagauggcgucuaccagaaggggauggacuucauuuuggagaagcucaaccaugg

SEQ ID NO: 110143 - RNA, 64 nt, hsa
cuuucccucagguggagaugcggaaagcccugacggacuucauucaagaggaauuccagcaucu

SEQ ID NO: 110144 - RNA, 64 nt, hsa
acuaagcuuccauagaaauacacuuuguaucuggaccucaaaauuaugggaacauuuacuuaaa

SEQ ID NO: 110145 - RNA, 64 nt, hsa
caauuaugauaaaggacaaaauaagcuguuugccaccucaaaacuuuaugaacuucaccaccac

SEQ ID NO: 110146 - RNA, 64 nt, hsa
auggugcaccugcuuugaaaaacaguuuggcaguaccucaaaaaguuaaacguagagugaccau

SEQ ID NO: 110147 - RNA, 64 nt, hsa
cucagaugggaaggguggugcuaagauccuccugaccucaaaguguauuugccuuuaagcgaac

SEQ ID NO: 110148 - RNA, 64 nt, hsa
ccuucuuagauggccuaaaucugucucuucauuuaccucaaacucaaauuaguaugccauuuuc

SEQ ID NO: 110149 - RNA, 64 nt, hsa
cuugcuuuucagcaguagucuggcccaauucucuaccucaaaggaaaguuucaaggauuaaagg

SEQ ID NO: 110150 - RNA, 64 nt, hsa
ucguauuguuugccacugaggguucagaugauagaccucaaaaaaucgaaaauacugguugaaa

SEQ ID NO: 110151 - RNA, 64 nt, hsa
uaccuuuuuagucacauugaccugcuggcugaauaccucaaauaguccaguagagggcagucca

SEQ ID NO: 110152 - RNA, 64 nt, hsa
cucauaaaaauugucagcucucucugacacuuagaccucaaacuuuagcaucucuguggagcug

SEQ ID NO: 110153 - RNA, 64 nt, hsa
cugccucuauuaauguauuuuuauuuaucauguaaccucaaagugccuucuguauuguguaagc

SEQ ID NO: 110154 - RNA, 64 nt, hsa
aaugguaguuagcaacuagggcuagucuucccuuaccucaaaggcucucacuaccguggaccac

SEQ ID NO: 110155 - RNA, 64 nt, hsa
cggcacuccagccuggcgacaagagugagacuccaccucaaaaaaaaaaaaaagaauccaauac

SEQ ID NO: 110156 - RNA, 64 nt, hsa
ugugaggcauaaaugcuuccuucuacguaggccaaccucaaaacuuucaguaggaauguugcua

SEQ ID NO: 110157 - RNA, 64 nt, hsa
ggaaucucagggucccaggcugugggccaucacgaccucaaacuggcuccuaaucuccagcuuu

SEQ ID NO: 110158 - RNA, 64 nt, hsa
cucugcuguccaguaggcugcuucucugagggucaccucaaagguaugcuaugccguguggcuc

SEQ ID NO: 110159 - RNA, 64 nt, hsa
cacagagggcaccacugagaacugcgugcauaggaccucaaaauacaaaauuagcagggccuca

SEQ ID NO: 110160 - RNA, 64 nt, hsa
auauaggaagaacgcgguguguaacacuguguacaccucaaauaccaccccaacccacucccug

SEQ ID NO: 110161 - RNA, 64 nt, hsa
guaucaguuuccaugaaagaccugaauaccacuuaccucaaauuaagcauauguguuacuucaa

SEQ ID NO: 110162 - RNA, 64 nt, hsa
acuguaauauuuaaauauuacccuccaagucuguaccucaaaugaauucuuuaaggagauggac

SEQ ID NO: 110163 - RNA, 64 nt, hsa
ucaccauguuggccagacuggucucgaacuccugaccucaaaugauccgcugucuuguccuccc

SEQ ID NO: 110164 - RNA, 64 nt, hsa
uacuauuuaaaauacccaacauguauuaugaaauaccucaaaaguaauuuaguuacauucuuaa

SEQ ID NO: 110165 - RNA, 64 nt, hsa
guuuuuuuaacgucagccagauauuuagaaaauaaccucaaaaguguuuauauggucagugagc

SEQ ID NO: 110166 - RNA, 64 nt, hsa
ucccacuggaaaguaaacaaaaccaucccucccaaccucaaagcuaggccacacucuauuucaa

SEQ ID NO: 110167 - RNA, 64 nt, hsa
cccagccuggguagagccaccagguacgacgaccagguaccagaaaccaccaggcacacggggc

SEQ ID NO: 110168 - RNA, 64 nt, hsa
cagaucagaagaggugcaggcuggcaccugcggcagguaccagccugggcacugguggccgccu

SEQ ID NO: 110169 - RNA, 64 nt, hsa
uauagacuuaaucugcuuuuugucccauuugacaagguaccaggaggaaauuuuuuaagggauc

SEQ ID NO: 110170 - RNA, 64 nt, hsa
acagacuuuugaguuuauaugcaaugccuucauuagguaccaccggcacuuacaaaaugugcgg

SEQ ID NO: 110171 - RNA, 64 nt, hsa
uacagauguaauuuccuuuuuguugucaaacauaagguaccaaauaugaugcaauaaauuguuu

SEQ ID NO: 110172 - RNA, 64 nt, hsa
guccuaccucugccacuaaugagguguuuggaggagguaccagccauauaauaggggguguaug

SEQ ID NO: 110173 - RNA, 64 nt, hsa
acccuaaaaccagaccacuccacgcaggacaggcaggagagauucuuccuaaagccucccccau

SEQ ID NO: 110174 - RNA, 64 nt, hsa
uugcuucauuggcccugggacuucucucugcaggaggagagaacgcugccucuccucuggauug

SEQ ID NO: 110175 - RNA, 64 nt, hsa
ucccuuuucuccaugcuuaauggugugaggcgucaggagagaggccaaguacauaaaaaaaaaa

SEQ ID NO: 110176 - RNA, 64 nt, hsa
ccggccugaaagcccucccugcaagaaggugugcaggagagaagaggccccggcauggggaucu

SEQ ID NO: 110177 - RNA, 64 nt, hsa
aggagaggagagcaucugcucugagacggauggaaggagagagguugaggaugcacuggccugu

SEQ ID NO: 110178 - RNA, 64 nt, hsa
ggagagagguugaggaugcacuggccuguucuguaggagagacuggccagaggcagcuaagggg

SEQ ID NO: 110179 - RNA, 64 nt, hsa
augguuuuuuuucuuguguucuaguuuccauaauaggagagaaaauauagaaauauaugcaaaa

SEQ ID NO: 110180 - RNA, 64 nt, hsa
gcuguuaggccugcuguucccuuugcucuugauuaggagagauggaaggagaugagcucccaua

SEQ ID NO: 110181 - RNA, 64 nt, hsa
ccuggaaccaacaggggcugaggagagagggcacaggagagagggcagagaagaggaggggugu

SEQ ID NO: 110182 - RNA, 64 nt, hsa
gggacgcaucucagccuggaaccaacaggggcugaggagagagggcacaggagagagggcagag

SEQ ID NO: 110183 - RNA, 64 nt, hsa
gaggcuguugugugcgcggaugaggggagguggcaggagagaauucuacauuuaggggguuagg

SEQ ID NO: 110184 - RNA, 64 nt, hsa
accucuagcggugaagggggaaggggaagaggaaaggagagaaguggucggugucuguuuccuu

SEQ ID NO: 110185 - RNA, 64 nt, hsa
acugagccccgcagaccuccccagccccuagcccaggagagagaaagccaggcagguagccagg

SEQ ID NO: 110186 - RNA, 64 nt, hsa
cgaaggugcuggaggugggagcaggagauugagaaggagagaaagugggugagaugcuggagaa

SEQ ID NO: 110187 - RNA, 64 nt, hsa
gagaaagugggugagaugcuggagaagagaggagaggagagaggcagagagcggucucaggcug

SEQ ID NO: 110188 - RNA, 64 nt, hsa
agcgauugaguugggcuuuaggaggacacaucauaggagagaauccagggucuguaagcugguu

SEQ ID NO: 110189 - RNA, 64 nt, hsa
agguccugaugucaucacugcacgcaggugugagaggagagaccucuucugcaccgccuggcua

SEQ ID NO: 110190 - RNA, 64 nt, hsa
aaguguugaagcugugcuccccuuaaaucguggcaggagagauuaagguaauuacaacacucag

SEQ ID NO: 110191 - RNA, 64 nt, hsa
aaggugucuugguuugaugucauagaaugauccaaggagagaaaaaagguaguuacuguuuuca

SEQ ID NO: 110192 - RNA, 64 nt, hsa
ccuuccaaauccugguucagauggaagaaauagcaggagagaggacccauuagcuggcagaccc

SEQ ID NO: 110193 - RNA, 64 nt, hsa
gggccuuauguggagcagagguugucucugaaccaggagagaagguacuauaccuuucaaaucc

SEQ ID NO: 110194 - RNA, 64 nt, hsa
aaacuccuuccgccccagguuucuucuucucuuaaggagagauuauucucaccaacccgcugcc

SEQ ID NO: 110195 - RNA, 64 nt, hsa
uuuguagcuuuucacccucugucccagggaaucuaggagagaugaggcccgucagagucaagag

SEQ ID NO: 110196 - RNA, 59 nt, hsa
ccgagcccacgggcgacugacagcucugcaggagagauugcaacaccaucccacacugu

SEQ ID NO: 110197 - RNA, 64 nt, hsa
caggccuuaacugagagggacagaagacgcuggaaggagagaaggaagcgggaagugugcuucu

SEQ ID NO: 110198 - RNA, 64 nt, hsa
aguugcggggggcaucucuuaauccugggguaaaaggagagauugccauacuuagacucacugu

SEQ ID NO: 110199 - RNA, 64 nt, hsa
gaagugagagaguaugguggcaauaucacaagggaggagagaggaaaacaauuaucuucucuac

SEQ ID NO: 110200 - RNA, 64 nt, hsa
uaauuuagcauucugagaugagugucagguuuucaggagagaaugaguuggggugagcccagag

SEQ ID NO: 110201 - RNA, 62 nt, hsa
cuucaauaauguucaacugaaucucacagaugaggagagagaagaaacggaagaggaaguuu

SEQ ID NO: 110202 - RNA, 64 nt, hsa
gcugguggaauggaggaguuguuuggggagggaaaggagagagaaggaaaggagugagguauuu

SEQ ID NO: 110203 - RNA, 64 nt, hsa
ggagagagggacagguucugucaggggugacaccaggagagagggacagguucuguugggggug

SEQ ID NO: 110204 - RNA, 64 nt, hsa
ggagacagggacagguucugucgggggugacaccaggagagagggacagguucugucaggggug

SEQ ID NO: 110205 - RNA, 64 nt, hsa
ggacacagggacagguucuaucaugggugacaccaggagagagggacagguucuguugggggug

SEQ ID NO: 110206 - RNA, 64 nt, hsa
auuugugaauaacaaacugcacaaccugcaaaccaggagagagggacagguucugucaggggug

SEQ ID NO: 110207 - RNA, 64 nt, hsa
uuauuauggugauuauacaggcaagaagacaaaaaggagagaaaauguaccucuucuacuggaa

SEQ ID NO: 110208 - RNA, 64 nt, hsa
ugggguugggggcuaaauuaauuggaguggggcgaggagagagccagaaaacauagauccgagg

SEQ ID NO: 110209 - RNA, 64 nt, hsa
cuaccuggacauugagccuccaggcaccauguugaggagagaugaaaaccagggcgguagaacu

SEQ ID NO: 110210 - RNA, 64 nt, hsa
uuccggggaacaaugacggggugggagaggggagaggagagaguuugggaaagggagauggaga

SEQ ID NO: 110211 - RNA, 64 nt, hsa
augcauaagugccauccuuuaaucauagacuuugaggagagaaagcauaaaaauauagcauaua

SEQ ID NO: 110212 - RNA, 64 nt, hsa
cuuacuuguaacagcguaauuaaacacaucauggaggagagaaacuuaaaauuaaaauaguauu

SEQ ID NO: 110213 - RNA, 64 nt, hsa
ucucuauggcuucccugagaaaggugaggcccaaaggagagaggccuucaaacugucccagguc

SEQ ID NO: 110214 - RNA, 64 nt, hsa
agcucugugaucagaaggaaauuggguccaguguaggagagagcugguccugggccuggcaggc

SEQ ID NO: 110215 - RNA, 64 nt, hsa
ccaguugcucaacuacugcaggaucucaggacuaaggagagagaaggcuaaauagagaggaguu

SEQ ID NO: 110216 - RNA, 64 nt, hsa
cggggagugguggugcuggccaagagcuucucucaggagagaaucaaagagaacuuccagguaa

SEQ ID NO: 110217 - RNA, 64 nt, hsa
ucugaggucauuuuuguguagaacuccuuuccccaggagagagccuuaucucugcccuccuuua

SEQ ID NO: 110218 - RNA, 64 nt, hsa
aagcagcaaccucugcagggcugacaggauuuaaaggagagaauguucuuauuuggaagcagcu

SEQ ID NO: 110219 - RNA, 64 nt, hsa
gcuuagacagaguugaucuguagaauaucuuuaaaggagagaugucaacuuucugcacuauucc

SEQ ID NO: 110220 - RNA, 64 nt, hsa
caacauucauucaauacuguuauaucagaggaguaggagagaggaaacauuugacuuaucugga

SEQ ID NO: 110221 - RNA, 64 nt, hsa
aaaaccuguuugaaucuugguucugauauggacuaggagagagacugggucaaguaagcuuauc

SEQ ID NO: 110222 - RNA, 62 nt, hsa
agacucuacucaaccccugacccuuuccuaucaggagagauggcuuguccccugcccugaag

SEQ ID NO: 110223 - RNA, 64 nt, hsa
uccuccugcaucuccccuucuuuccuucccccucaggagagagaaaacuuagugcuuccagccc

SEQ ID NO: 110224 - RNA, 64 nt, hsa
gcccagcaccaugaguugggugcagacaccuagaaggagagacuucuuggaacgcucauccccc

SEQ ID NO: 110225 - RNA, 64 nt, hsa
gucaaaacuggaauuuucuaaagcuuuggagaaaaggagagaauuaguagggcaagaucaaagc

SEQ ID NO: 110226 - RNA, 64 nt, hsa
aacaggauaaauucagugauagcccaagcuggucaggagagacagaagugcuggcuaggagguc

SEQ ID NO: 110227 - RNA, 64 nt, hsa
gccgugccagcugugcccuagugauaaggguaagaggagagaugucaggcucacugcccuuauu

SEQ ID NO: 110228 - RNA, 64 nt, hsa
auagaucucucccacuagagcccagagggaugagaggagagagcaacuguucuuucuuuuuuuu

SEQ ID NO: 110229 - RNA, 64 nt, hsa
aggagaccagucaguacuucuuggagggggcaggaggagagaggaaaagggagggcgagaauga

SEQ ID NO: 110230 - RNA, 64 nt, hsa
gcacaaccucgaguucuuggggcgcagagaacuuaggagagaagcacggaggagcccccggcag

SEQ ID NO: 110231 - RNA, 64 nt, hsa
agccuggaaggaggcaauaagugggaaagguaggaggagagaaggcuggggagggcugggcagc

SEQ ID NO: 110232 - RNA, 64 nt, hsa
ucugaaaucacauggugagaaggaggaugaagggaggagagagcuuuugcucugggucuccagu

SEQ ID NO: 110233 - RNA, 64 nt, hsa
ugagauauuuuaaaauauugccuccguuuuaucgaggagagaaauaauaacuaaaaaauauacc

SEQ ID NO: 110234 - RNA, 64 nt, hsa
gguuguggacucagcuccugugaggggucugguuaggagagagccauuuuuaaggacagggagu

SEQ ID NO: 110235 - RNA, 64 nt, hsa
ugaugcgcugggaucugauugaggauaaaaaggaaggagagaugaccccuacccccucaucccc

SEQ ID NO: 110236 - RNA, 64 nt, hsa
uccccucagagcccaugguaacgaaccccuagaaaggagagaacgggcgucaggggugcacagu

SEQ ID NO: 110237 - RNA, 64 nt, hsa
gaaagaggcagagaaggaaagagacaggcagagaaggagagaggcagagagggagagaggcaga

SEQ ID NO: 110238 - RNA, 64 nt, hsa
agaaagagagguggggagaggggagagagauaugaggagagagagacagaggaggcagagaggg

SEQ ID NO: 110239 - RNA, 64 nt, hsa
cacccagaggaggagagagccggcaguucccugcaggagagaggaggggcugcuggacccaagg

SEQ ID NO: 110240 - RNA, 64 nt, hsa
ggcguccccucccucugucuucagcacccagaggaggagagagccggcaguucccugcaggaga

SEQ ID NO: 110241 - RNA, 64 nt, hsa
aggaagugacucauccucuugaagaugcugaaacaggagagaaaggggauguauccaugggggc

SEQ ID NO: 110242 - RNA, 64 nt, hsa
gcauggccagcagcuugcguuagaaugaggaggaaggagagaaggggaggagggcggggggcac

SEQ ID NO: 110243 - RNA, 64 nt, hsa
gccaaaauguugacaaugacugucuccaggucaaaggagagaggugggauugugggugacuuuu

SEQ ID NO: 110244 - RNA, 64 nt, hsa
cgcccggagcagggacugucauucagggaggcuaaggagagaggcuugcuugggauauagaaag

SEQ ID NO: 110245 - RNA, 64 nt, hsa
agaaagauuguuaauccuaugaacucccuuuuguaggagagaaagggccaaucuguagggguag

SEQ ID NO: 110246 - RNA, 64 nt, hsa
gcaaauuggucaacaaaauuugcaaagugauuucaggagagagcagcuuugaggaauguggaaa

SEQ ID NO: 110247 - RNA, 64 nt, hsa
ccauaggacauuucacacaguccuuagaacccccaggagagagcuacugacuuguuaucaucuc

SEQ ID NO: 110248 - RNA, 64 nt, hsa
aagcucccacccugggacagcaugccacugagcaaggagagaugggugagccugaagauggucc

SEQ ID NO: 110249 - RNA, 64 nt, hsa
caccuaagcccagagcaaggaacagguauaauaaguggaaaaucuuggaauaaguauaauuauc

SEQ ID NO: 110250 - RNA, 64 nt, hsa
cauacaggagaaaggcccuauccaugucaagcuuguggaaaaagauuuagcaggcuagaccauc

SEQ ID NO: 110251 - RNA, 64 nt, hsa
aauuuuuuuuuccaguaaugagcuuaagaaauuuguggaaaauaacucaccuggcaucuuacau

SEQ ID NO: 110252 - RNA, 64 nt, hsa
cuccaaaugcuacaguacaaagcccuaagcaugaguggaaaaucguugcuucagaaaagacuuc

SEQ ID NO: 110253 - RNA, 64 nt, hsa
ggguguucaaggucaggagugauuuuugcauuugguggaaaaccucaagucagacucaguggca

SEQ ID NO: 110254 - RNA, 64 nt, hsa
ugcacuguaaauccggcauugauguuuccaccauguggaaaagcaaggauuucccuggccccgc

SEQ ID NO: 110255 - RNA, 64 nt, hsa
gaacucuuacuaaaaugaguuuuagguucuguaaguggaaaaaugugcuuuuauuuuaugggcc

SEQ ID NO: 110256 - RNA, 64 nt, hsa
gaauguauguugcguaucccaaggcacugaagagguggaaaaauaaucgugucaaucuggauga

SEQ ID NO: 110257 - RNA, 64 nt, hsa
uugguacuauguggaaaauauuagaaacuucuauguggaaaauauuagaaacuacagaguuugc

SEQ ID NO: 110258 - RNA, 64 nt, hsa
uuucauaucuuggauuugcagcuguugguacuauguggaaaauauuagaaacuucuauguggaa

SEQ ID NO: 110259 - RNA, 64 nt, hsa
aguguggggugccagaaagugucugcugauauuuguggaaaaaaaaucuauuuuguuuaccuac

SEQ ID NO: 110260 - RNA, 64 nt, hsa
aagaaauguauauacugacagaagauauuugaaaguggaaaauuggaaaugaaauauguugcug

SEQ ID NO: 110261 - RNA, 64 nt, hsa
agaguugaacuauuuuugauaacaagaguaaaugguggaaaaugcuucuuaguugucuugucuu

SEQ ID NO: 110262 - RNA, 64 nt, hsa
cuagucaguccauaaagauugugcuaauuuuuuuguggaaaaguagccauuaguucaggaaacu

SEQ ID NO: 110263 - RNA, 64 nt, hsa
augcaacuugucuauguaaauaauguacacauuuguggaaaaugcuauuauuaagagaacaagc

SEQ ID NO: 110264 - RNA, 64 nt, hsa
cugugaaguuguguauuuaaugcauuauagcaugguggaaaauaagguucagaugcagaagaau

SEQ ID NO: 110265 - RNA, 64 nt, hsa
gguugaaauaucuugguauccaggauaaggguauguggaaaaacaggcuuuaggcaaguggaaa

SEQ ID NO: 110266 - RNA, 64 nt, hsa
gauaaggguauguggaaaaacaggcuuuaggcaaguggaaaauucaaaaugugcugugaaagga

SEQ ID NO: 110267 - RNA, 64 nt, hsa
gaggagacuggccccacuucuaugggucugagcuguggaaaagggagagcagagaggaacugag

SEQ ID NO: 110268 - RNA, 64 nt, hsa
uugcuggcugugcugccagggacccgcagcccugguggaaaagccaguagcacauacgcagggc

SEQ ID NO: 110269 - RNA, 64 nt, hsa
aaaaucauuuucuuuuuuuuuuuuuuuuucuguuguggaaaagcgugaauuuguuauuaagcau

SEQ ID NO: 110270 - RNA, 64 nt, hsa
cauuuucagacauuuuuggaaauuuccauuaaagguggaaaaucuauuuuuuuccuccuuugca

SEQ ID NO: 110271 - RNA, 64 nt, hsa
guguguugcugucagaauauucuuuuuauauucuguggaaaaauaaaggaaauucagauuguuu

SEQ ID NO: 110272 - RNA, 64 nt, hsa
cagcaaugacucaggcaucagagaugaugcugcaguggaaaaccugacucugugugucugcaac

SEQ ID NO: 110273 - RNA, 64 nt, hsa
gacaguucugugcuucaccaugagguuugccuuuguggaaaacuggugacagugagaauauaaa

SEQ ID NO: 110274 - RNA, 64 nt, hsa
cauuucagagaaaagcccuauacguguagugaauguggaaaagacuucagauugaauucacauc

SEQ ID NO: 110275 - RNA, 64 nt, hsa
cacacaggagagaaagcacaugaauguaaugaauguggaaaagcuuucagucaaaccucaugcc

SEQ ID NO: 110276 - RNA, 64 nt, hsa
aacauacuacaggaauauuaugucuguaaucaguguggaaaagccuuuauuuauauuuaccacu

SEQ ID NO: 110277 - RNA, 64 nt, hsa
auuuuuccagugagaaaacuaucuugacaggauaguggaaaaaccuucaggcagcuuuuauguc

SEQ ID NO: 110278 - RNA, 64 nt, hsa
uuuauuuuuuaucacaagcaccuuugaaauguacguggaaaacgucggcugcucgugagaauca

SEQ ID NO: 110279 - RNA, 64 nt, hsa
ccucagugcagagccugaaguuggggguuuagggguggaaaaggcuucgugaaauguuaaugau

SEQ ID NO: 110280 - RNA, 64 nt, hsa
agcaauuuugugugggucauuguucugucaauuuguggaaaaaauuacuucagucucauauaaa

SEQ ID NO: 110281 - RNA, 64 nt, hsa
aaaaguucuaaugguuuuuaaaaaccaguguugaguggaaaaguguuucuuuaguuuggaaaga

SEQ ID NO: 110282 - RNA, 64 nt, hsa
aauuuggaccauacacuauguuacaaaacuaaaaguggaaaaaacuuauuggugaaugaauaua

SEQ ID NO: 110283 - RNA, 64 nt, hsa
cauauaagacagaaacccuauggguguaaugaauguggaaaaucauucugugugaagucaagag

SEQ ID NO: 110284 - RNA, 64 nt, hsa
uugaguugcaggauaucuagcaauuuaagaaaauguggaaaaaauauuuuuauugagaaauagc

SEQ ID NO: 110285 - RNA, 64 nt, hsa
cccaaauguuuauuaaguagcuagaaauaauuauguggaaaaaaaugaauaauggaaaauagug

SEQ ID NO: 110286 - RNA, 64 nt, hsa
accgacuacacaauuauguaccaucacaguauuaguggaaaaguaccaugugauuuaauucucc

SEQ ID NO: 110287 - RNA, 64 nt, hsa
augcaguuaauuuuaacaugugugaugugccaugguggaaaaguacuaucggaauaacucugca

SEQ ID NO: 110288 - RNA, 64 nt, hsa
caagucagaggagugggaggucugaucauuguugguggaaaaacguaagguuauuuuguguuuu

SEQ ID NO: 110289 - RNA, 64 nt, hsa
uuugcaaggugcauuuuuacuauuguuacauuauguggaaaacuuaugcugauuuauuuaaggg

SEQ ID NO: 110290 - RNA, 64 nt, hsa
ugucgcucucaguucucgauaggucagagcagagguggaaaaacagcauguacggauuuucagu

SEQ ID NO: 110291 - RNA, 64 nt, hsa
cuggaagugugacggagcaggcgggcugaggagaguggaaaaggaagcgacccagaaauggcag

SEQ ID NO: 110292 - RNA, 64 nt, hsa
gcuugggauuagcuugggagcgcagcgcugcaaaguggaaaauaugaaaagaccacacaggccc

SEQ ID NO: 110293 - RNA, 64 nt, hsa
aauccaaaccuuccugaacgcuaugacaccaugaguggaaaauuccacaccuaacaaacacauu

SEQ ID NO: 110294 - RNA, 64 nt, hsa
ugugucuuugacagcuagugucuaguguaugaaaguggaaaaggacauuucuguaguagcuguu

SEQ ID NO: 110295 - RNA, 64 nt, hsa
gcaguaaaguguauauauuaugcaguuucucuaaguggaaaaacuugacaugacuuuaauagug

SEQ ID NO: 110296 - RNA, 64 nt, hsa
uucccagcucagcaugacagagacuccauuccagguggaaaaagcacauggcucuuucuucucc

SEQ ID NO: 110297 - RNA, 64 nt, hsa
uuuguaacaacaaucagccauaacaaguuuacuuguggaaaagaaaagguguagcacuuucaga

SEQ ID NO: 110298 - RNA, 64 nt, hsa
uuccuguguguguggccuuugcaucauuuaucuuguggaaaagaagauucaggcccugagaggu

SEQ ID NO: 110299 - RNA, 64 nt, hsa
ccacaggaaacaaacuuuauguguguguguauguguggaaaaugguguucauuuuuuuuggggg

SEQ ID NO: 110300 - RNA, 64 nt, hsa
cauacagcugagaaacccuaugaauguaaggaauguggaaaagccuucagcaggaaagaaaauc

SEQ ID NO: 110301 - RNA, 64 nt, hsa
cauacgggugagaaacccuaugcauguacaguauguggaaaagccuuuagucagaaaucaaacc

SEQ ID NO: 110302 - RNA, 64 nt, hsa
cacacaggagaaaggccuuaugaaugcguugaguguggaaaaucauuucgccgaagcucuucac

SEQ ID NO: 110303 - RNA, 64 nt, hsa
cacacuggagaaaggccauaugaaugcauugauuguggaaaaucauuucgccacaguucuucgu

SEQ ID NO: 110304 - RNA, 64 nt, hsa
cauacuggagagaaacccuaugaauguaaagaauguggaaaacccuucaguuuccuuacaggcu

SEQ ID NO: 110305 - RNA, 64 nt, hsa
cacacuggagauaaacccuuugaguguaaaaaauguggaaaagcauuuagauacuacuacucag

SEQ ID NO: 110306 - RNA, 64 nt, hsa
cacacuguacagaaacgcuaugaauguaaacaauguggaaaaaccuacauaucuucuguagguu

SEQ ID NO: 110307 - RNA, 64 nt, hsa
cacacuggagauaaacccuuuaaguguaaagaauguggaaaagcauuccgauaccaccaaucug

SEQ ID NO: 110308 - RNA, 64 nt, hsa
ccuucuggaggaaagcuuugggaaagcaguguauguggaaaagucuugagccaucauucauccc

SEQ ID NO: 110309 - RNA, 64 nt, hsa
acuuuccauacaccagguucuuucuacaauccugguggaaaagccacagaaccuucuuccugcc

SEQ ID NO: 110310 - RNA, 64 nt, hsa
ugccaccucuccacccaggaggccauguagcauaguggaaaaagucccugagggcgguuaggag

SEQ ID NO: 110311 - RNA, 64 nt, hsa
uacaauuuauagaaauaguaucggguguucugauguggaaaaaagaaaugcaagguaauuuugu

SEQ ID NO: 110312 - RNA, 64 nt, hsa
agaugauguagauguugcccuacuaccuaccauuguggaaaaggugauucuuccuaaacuaaca

SEQ ID NO: 110313 - RNA, 64 nt, hsa
uugcaguguauuuuugcauuuucuaguucugaaaguggaaaaugaaacagucuauaauaaacuu

SEQ ID NO: 110314 - RNA, 64 nt, hsa
gaccuauucaggaccauauaguauuucacaaguaguggaaaaccaguuaccucauugcuuacca

SEQ ID NO: 110315 - RNA, 64 nt, hsa
auguuauccuuacguccugagccgguuuaagucuguggaaaaggaagcacgggagaaauccacg

SEQ ID NO: 110316 - RNA, 64 nt, hsa
ucagagaccauccacugucuuugacaccuagaagguggaaaaaggaaagagauuugagaaguga

SEQ ID NO: 110317 - RNA, 64 nt, hsa
gaacccggcuguugccuuaaaugugugagagggacuuggccaaggcaaaagcuggggagaugcc

SEQ ID NO: 110318 - RNA, 64 nt, hsa
agcacagcucucaggcccagcccugggcgaccuccuuggccaagucugccuuucacccuggggu

SEQ ID NO: 110319 - RNA, 64 nt, hsa
uugaugugcaguauugcaccacagcucugcggaccuuggccauugccgcagucgcagcuuccuu

SEQ ID NO: 110320 - RNA, 64 nt, hsa
ccucuuccucccacugcagcugaucuagggguuucuuggccacauuucccuugagagagagugg

SEQ ID NO: 110321 - RNA, 64 nt, hsa
uuccuguuuggggaaguuggcuuuuaugucagcucuuggccaguggucacuuccaagccuggug

SEQ ID NO: 110322 - RNA, 64 nt, hsa
cccacaugggagucucccagcaccucugacucagcuuggccaaugcagaacuuggcaucugaac

SEQ ID NO: 110323 - RNA, 51 nt, hsa
gccugcauccuacagagugagcuuggccaagccagcugcaaaccuggccag

SEQ ID NO: 110324 - RNA, 64 nt, hsa
cccaguagccaggauaccugauggccacgugugccuuggccacgggaggcugcugagauuggcc

SEQ ID NO: 110325 - RNA, 64 nt, hsa
gcccagcguuuaccacugcugucaagccacagcccuuggccaccauacgggccauccucaguga

SEQ ID NO: 110326 - RNA, 64 nt, hsa
aaaugaccaaauccauggauaauugcuucacagccuuggccauccuggcucagcucucaauuua

SEQ ID NO: 110327 - RNA, 64 nt, hsa
auccgugacagcacuuuccuguugcacugaaacucuuggccauguagaggaaaagauauggagu

SEQ ID NO: 110328 - RNA, 64 nt, hsa
gggggccugcgucccugcacacugcgaggacugccuuggccacaggcccacucccuacgacacg

SEQ ID NO: 110329 - RNA, 64 nt, hsa
cuucuguuuacucugcaaauguaagaaagaaccacuuggccagaagugucccccagaugcuuuu

SEQ ID NO: 110330 - RNA, 64 nt, hsa
caagacacagcagaggucaaaggcaguggagagccuuggccaguucagugacagcuucuggcug

SEQ ID NO: 110331 - RNA, 64 nt, hsa
gcuauuuacuugggaaaguauuuuucuuacaguucuuggccacaguuuuuuugcugaggguuuc

SEQ ID NO: 110332 - RNA, 64 nt, hsa
aaacucccagcagccccuacagagguggcacaugcuuggccacacaucuacucccugcccacac

SEQ ID NO: 110333 - RNA, 64 nt, hsa
uuuagggcuuugguuuucauuccuuuuuguuuggcuuggccaaaccagaauucagcuuaucuga

SEQ ID NO: 110334 - RNA, 64 nt, hsa
acucuuggcugugcuggccaggugacuccuaguucuuggccacaucaucagaaagucaaagguc

SEQ ID NO: 110335 - RNA, 64 nt, hsa
ccuuccuuccacuccccucccugccagagucugucuuggccagugccagccucgaugcuuuggu

SEQ ID NO: 110336 - RNA, 64 nt, hsa
cuuuuuucuuuuuuuccccuccaaacuccuuuuccuuggccaagccuucaugcuucccccuuuc

SEQ ID NO: 110337 - RNA, 64 nt, hsa
cuccaccacggcuucccucuuggcucauuccaagcuuggccaaauuggggaagugggauggagg

SEQ ID NO: 110338 - RNA, 64 nt, hsa
ccugggguuuucagaugcacauucaguguugcuucuuggccauguucgacagaugcugagacca

SEQ ID NO: 110339 - RNA, 64 nt, hsa
uccaugcucccagggacuugcagacgaugcauuucuuggccaaaguggcuuccucaagaaagca

SEQ ID NO: 110340 - RNA, 64 nt, hsa
gcagauaagacagcauaggugauggcugcuuggucuuggccacagugcucucagccagcacuaa

SEQ ID NO: 110341 - RNA, 64 nt, hsa
accuggccaggacccccuucggcacccaguugcccuuggccaccaccuguggcaggacucaagc

SEQ ID NO: 110342 - RNA, 64 nt, hsa
aacccagccugccugggcucugaccacuaacacucuuggccauggacagccugcacaggaccgc

SEQ ID NO: 110343 - RNA, 64 nt, hsa
ccauggacagccugcacaggaccgccucccugcucuuggccacugugcucccauuucuguccuu

SEQ ID NO: 110344 - RNA, 64 nt, hsa
gcuuuuaaacaucugguuugggagagaccaucgacuuggccagugagacugagaauggauuccg

SEQ ID NO: 110345 - RNA, 64 nt, hsa
aaguaugcaggcaggucugguccgagggggcuggcuuggccaugccuuucugugccuuuaauga

SEQ ID NO: 110346 - RNA, 64 nt, hsa
ucgucucccuugucugcccugugugacccucagucuuggccagccaugcaugcgcccgaagcuc

SEQ ID NO: 110347 - RNA, 64 nt, hsa
cucuccucccugccaccaugcucaucacucuggccuuggccaugcucccuggucaccccacuuc

SEQ ID NO: 110348 - RNA, 64 nt, hsa
acaggcuacucagagcugaggggccccugggacccuuggccaucaggcgaggggcugggccugu

SEQ ID NO: 110349 - RNA, 64 nt, hsa
aucaggcgaggggcugggccugugcagcugggcccuuggccagaguccacucccuuccuggcug

SEQ ID NO: 110350 - RNA, 64 nt, hsa
cuagccuucuuuuguacuuuucauucuggaugggcuuggccaaaacaggcucaggccaaagacc

SEQ ID NO: 110351 - RNA, 64 nt, hsa
guuuguauuuuuaguagagacggggcuucaccaucuuggccaggcuggucuugaacuccugacc

SEQ ID NO: 110352 - RNA, 64 nt, hsa
auguuucaaaggaagaaccagucaccuuucacuucuuggccaaauuuuauccugagaaugcuga

SEQ ID NO: 110353 - RNA, 64 nt, hsa
caaguagcugggacuacaggcaugcaccaccacacuuggccaauguucuguauuuuuaauaggg

SEQ ID NO: 110354 - RNA, 64 nt, hsa
caccauccagugagcgagggaugcuggggcggggcuuggccagugccuucagggagguggcccc

SEQ ID NO: 110355 - RNA, 64 nt, hsa
aaucauuguacuguaaaagccuagugacucccuccuuggccaggcccucacccaguucagaucc

SEQ ID NO: 110356 - RNA, 64 nt, hsa
ucaguuacacaaaggaccucagcugcuucucccacuuggccaagcagggaggaagaagcuuagg

SEQ ID NO: 110357 - RNA, 64 nt, hsa
ggccucaggugggccgcaggcgggaaaagcagcccuuggccagaagucaagcccagccacgugg

SEQ ID NO: 110358 - RNA, 64 nt, hsa
ugggauagggauaaaauacccaccccaaaaugaccuuggccaccugucugccauauacguacac

SEQ ID NO: 110359 - RNA, 64 nt, hsa
uuacagaauaguaaacuaagagccaugaaaaucacuuggccagggucaaggacucgugacuccu

SEQ ID NO: 110360 - RNA, 64 nt, hsa
gucaggaaaugacauguuaaugcuuugcucccugaagggggaaaaaaucuguccuuuaacaagc

SEQ ID NO: 110361 - RNA, 64 nt, hsa
aaacguccagaugcauuacugcuaucuuaguuuaaagggggaaagaaaagggaagaagaaagga

SEQ ID NO: 110362 - RNA, 64 nt, hsa
ggcugaucuguagagguaugaaaauacagccccaaagggggaauuugucauggggaagggccag

SEQ ID NO: 110363 - RNA, 64 nt, hsa
ggcaucagucuaacaagucauuaggucacucgggaagggggaaaaaguuuaaaaugggggaaaa

SEQ ID NO: 110364 - RNA, 64 nt, hsa
cacgccagccucucugagccaaagcugcuugcagaagggggagaucccaguucgaagacucccg

SEQ ID NO: 110365 - RNA, 64 nt, hsa
cgccucucugugccagggaggcugggagagcagcaagggggaccaggugcgccaucaggaggag

SEQ ID NO: 110366 - RNA, 64 nt, hsa
accaguggugugagcaguuggacucaguuuggacaagggggaaagggggacuucccugggaagg

SEQ ID NO: 110367 - RNA, 64 nt, hsa
ugugagcaguuggacucaguuuggacaagggggaaagggggacuucccugggaagguccagcua

SEQ ID NO: 110368 - RNA, 64 nt, hsa
cagcaucaagucccaaguaaggacagugagagaaaagggggagaaggauuggagcaaaagagaa

SEQ ID NO: 110369 - RNA, 64 nt, hsa
gcccuaggaaaugaaagaauuguguauagaauggaagggggaucaucaaggacauguaucucaa

SEQ ID NO: 110370 - RNA, 64 nt, hsa
ucgagcagggugcugugggugauauggacagcagaagggggagaccaagguuccagcucaacca

SEQ ID NO: 110371 - RNA, 64 nt, hsa
ugcugagaccccccaccaccagccgguaccugggaagggggagagugcaggccugcucagggac

SEQ ID NO: 110372 - RNA, 64 nt, hsa
agugaucuauggaagucgugucuuacuccaggugaagggggaaaaaaaaagccuauacuuuggc

SEQ ID NO: 110373 - RNA, 64 nt, hsa
aagaaucugcaggcugcuuguaggacuguucaccaagggggauaccagcagcaagagagugcac

SEQ ID NO: 110374 - RNA, 64 nt, hsa
ggugccugagagcccagggcccuuccuccguuuuaagggggaagcaacauuuggaggggaugga

SEQ ID NO: 110375 - RNA, 64 nt, hsa
aauguggcaggcggaccuggaauguguuggagggaagggggaguaccaccugagucuccagcuu

SEQ ID NO: 110376 - RNA, 64 nt, hsa
aaaaaagcaaaaugcugugauaaaccaaacagggaagggggaaaaacccuccuccuugggauuu

SEQ ID NO: 110377 - RNA, 64 nt, hsa
cauaacccgacacggacuuauuuuugucauuagcaagggggaaaaggccaaaggacaagggccu

SEQ ID NO: 110378 - RNA, 64 nt, hsa
guccagcacacaccugggaaagggaugcugccccaagggggaccaaaagggccggacguuacag

SEQ ID NO: 110379 - RNA, 64 nt, hsa
uccuuccagccagaaagaaagaaagacaaggaguaagggggauuuagaguuaugucucagcuac

SEQ ID NO: 110380 - RNA, 64 nt, hsa
ugcagugcuuuuucuuaaacuuggccaauuuggaaagggggaaggagccaccccaaaacggugg

SEQ ID NO: 110381 - RNA, 64 nt, hsa
cacagcccugagugucccaagccgggagccaacgaagccggacacggcuucacugaccagcggc

SEQ ID NO: 110382 - RNA, 64 nt, hsa
cuuggaaccucauugcuaccacagacuugcacugaagccggacagcugcccagacacaugggcu

SEQ ID NO: 110383 - RNA, 64 nt, hsa
uuccaaaaucccacagcuaguuaaugacagaucuccccacuacauuaaucccgugcuccuccuc

SEQ ID NO: 110384 - RNA, 64 nt, hsa
ccuuacguaugaagcauggagaagcagccauuguccccacuaugggcagaggggggacccggcu

SEQ ID NO: 110385 - RNA, 64 nt, hsa
aggcccgugguaauucuccccaccuccccggaugccccacuaguccaacuucauggcugcacgu

SEQ ID NO: 110386 - RNA, 64 nt, hsa
uggucuccagccccacuucccaaauaugccucagccccacuagcuggcaccaacuuaauuccac

SEQ ID NO: 110387 - RNA, 64 nt, hsa
ccccugagcugaguucugcagagacccacucugaccccacuaaaaugaccccugauucaucaaa

SEQ ID NO: 110388 - RNA, 64 nt, hsa
auuacacagccauaaaaaggaaugaagcagugauccccacuacacuguggaugaaccuugaaug

SEQ ID NO: 110389 - RNA, 64 nt, hsa
gggauguaggcgcuggagcuccaguucccaggagcaggggcagguguuccuagauguuaguguu

SEQ ID NO: 110390 - RNA, 64 nt, hsa
agcugucgccuuucugaccagcaggccuggagggcaggggcacagagcagagaggagggcacug

SEQ ID NO: 110391 - RNA, 64 nt, hsa
cagaucugugccugggaucgugcauuugaggggccaggggcaggcagggcugcagagggagacg

SEQ ID NO: 110392 - RNA, 64 nt, hsa
gagguggcaggaauacuucaccuuuccucucccucaggggcaggugguggaggggcgcccaggg

SEQ ID NO: 110393 - RNA, 64 nt, hsa
gagccugcggagcugcaggggcaggcgaggccuccaggggcaggguccugaggcaggaacucga

SEQ ID NO: 110394 - RNA, 63 nt, hsa
agcuggagaccaaugucugagccugcggagcugcaggggcaggcgaggccuccaggggcaggg

SEQ ID NO: 110395 - RNA, 60 nt, hsa
aggagugcggcugcgccugacagugcaaggcaggggcacggugguggggcacggagggca

SEQ ID NO: 110396 - RNA, 64 nt, hsa
ccagaaaggacacaacccgucagagaccugggagcaggggcaaugaccguuugacuguuugugg

SEQ ID NO: 110397 - RNA, 64 nt, hsa
cuggggugggacagggagggccggcggcucugagcaggggcaggcgcagaggucccagccccag

SEQ ID NO: 110398 - RNA, 64 nt, hsa
cagugugcccaaaagccauguauuucagggaccucaggggcaccuccggcugccuagcccuccc

SEQ ID NO: 110399 - RNA, 64 nt, hsa
aagagcagcaugacauuggcaucagcugaauaaccaggggcacaugggggaacguggaugggaa

SEQ ID NO: 110400 - RNA, 64 nt, hsa
ugacaucguucccuggggacauugggaaggugggcaggggcaagugaacucagcacucugcagu

SEQ ID NO: 110401 - RNA, 64 nt, hsa
cucacugcgucucaugaggccgcugccgcugcugcaggggcacccagaccuccagagcauccag

SEQ ID NO: 110402 - RNA, 58 nt, hsa
gcgacaaggccggccugugacguggugccaggggcagccccaacccacccgggccagg

SEQ ID NO: 110403 - RNA, 64 nt, hsa
ggccucuaacccucagugggcccccaggucagggcaggggcacugaguggccuggcucugagga

SEQ ID NO: 110404 - RNA, 64 nt, hsa
ucuucuucuuccaucuccuuggugacacccagcccaggggcacccccuuccccagcccccaccu

SEQ ID NO: 110405 - RNA, 64 nt, hsa
acguagugcacagaauacgugagaguugcucuggcaggggcagaauccucacaggaucgccugg

SEQ ID NO: 110406 - RNA, 64 nt, hsa
ggcuucccaguaaggcccagugaucccauuaucccaggggcaaaaccaccuguccccuuuugag

SEQ ID NO: 110407 - RNA, 64 nt, hsa
cucuguccuuggcagagaccuugcugcccaggcccaggggcaggcucuuggccugccccaggcc

SEQ ID NO: 110408 - RNA, 64 nt, hsa
cuccuggcccuucagucuuggugccaccugggcacaggggcaagcuuggugguugugaguccau

SEQ ID NO: 110409 - RNA, 64 nt, hsa
cucugucccaauccgagaaguuccgaggcuuucccaggggcagucugugucacgcuggccauuu

SEQ ID NO: 110410 - RNA, 64 nt, hsa
aagcacugucuaguugaaaguucccuucuccacccaggggcagugaaggaggaggggcuuauag

SEQ ID NO: 110411 - RNA, 64 nt, hsa
guaccaaagacugacccccgccagcuggggugcccaggggcagggccggcccgccagggagggg

SEQ ID NO: 110412 - RNA, 64 nt, hsa
ucugcaggccgcuugcccuccuguccccuccccgcaggggcacaguggagacgcaggggcucug

SEQ ID NO: 110413 - RNA, 64 nt, hsa
cccagcccucgaggcucgaugccugugccaaggccaggggcagccagagggcagcuggauggcc

SEQ ID NO: 110414 - RNA, 64 nt, hsa
agaaggggucuggcccgggcauccacguagggggcaggggcaggggcgggcggagggaggggag

SEQ ID NO: 110415 - RNA, 64 nt, hsa
ggcugcucuuuccacuugcccuguguucuuuccccaggggcaugacugucgccacacgccucug

SEQ ID NO: 110416 - RNA, 64 nt, hsa
cagccaaggcaccccugcccugggacuggcagggcaggggcaggggcagggacaguggccaggc

SEQ ID NO: 110417 - RNA, 64 nt, hsa
aggcaccccugcccugggacuggcagggcaggggcaggggcagggacaguggccaggcggcccg

SEQ ID NO: 110418 - RNA, 64 nt, hsa
ccuuuaaaugcaguaaacuccaccuaaccagauucaggggcacuaugcccacugccuccucuuc

SEQ ID NO: 110419 - RNA, 64 nt, hsa
uucuauccucccagucaccuuugcagacaaagaccaggggcagcucccgagggcacugugaagg

SEQ ID NO: 110420 - RNA, 64 nt, hsa
ugcccccugccgggcagcuuuaaggacagacccccaggggcaguuuagccucaggcacaggcau

SEQ ID NO: 110421 - RNA, 64 nt, hsa
ggcuggggcaggcuugggcucaauccugggcacccaggggcagcccaccccuaaccuggcuccu

SEQ ID NO: 110422 - RNA, 64 nt, hsa
ggccaaccggacccaggccuuccaggagcaggagcaggggcaggggcaggggcagggagagccc

SEQ ID NO: 110423 - RNA, 64 nt, hsa
ccggacccaggccuuccaggagcaggagcaggggcaggggcaggggcagggagagcccugcauu

SEQ ID NO: 110424 - RNA, 64 nt, hsa
ccaggccuuccaggagcaggagcaggggcaggggcaggggcagggagagcccugcauuuccucu

SEQ ID NO: 110425 - RNA, 64 nt, hsa
cuggcuauccucacaggcaccguagagguggggacaggggcaggggcaggggcggagccccuga

SEQ ID NO: 110426 - RNA, 64 nt, hsa
auccucacaggcaccguagagguggggacaggggcaggggcaggggcggagccccugaagaagg

SEQ ID NO: 110427 - RNA, 64 nt, hsa
auguauuugaaggaaggucuaaccaggggguuuucaggggcauugucugaccacauucuuuuug

SEQ ID NO: 110428 - RNA, 64 nt, hsa
aauaguggaacuucacacuuacaucaauucagugcaggggcauagaauaaaauauuaaauauug

SEQ ID NO: 110429 - RNA, 64 nt, hsa
ccucgcaucuuuuuuuuuuuaagcuuuaacuuagcaggggcauggacuuuauagcacuuuuuca

SEQ ID NO: 110430 - RNA, 64 nt, hsa
cguagagugaugugcacuccuggugggugaggggcaggggcaguggcagugugcaaagaauuga

SEQ ID NO: 110431 - RNA, 64 nt, hsa
cagguugucagagcuauguggagucuguggguggcaggggcagccgcuccagccuuugaagacu

SEQ ID NO: 110432 - RNA, 64 nt, hsa
aggcuuggacuuccugggagcuccuccaaguacccaggggcaucagagcugccuggguguuaca

SEQ ID NO: 110433 - RNA, 64 nt, hsa
cuggaacugaauggcgcuucgggauucugaguagcaggggcagcaugcccagugggccuggggu

SEQ ID NO: 110434 - RNA, 64 nt, hsa
uccggaauugaggggcacgcaggauucugagcaccaggggcagaggcggccagacaaccucagg

SEQ ID NO: 110435 - RNA, 64 nt, hsa
caagagggcaccugaggagacuuuggggacagggcaggggcagggagggaaacugaggaaaucu

SEQ ID NO: 110436 - RNA, 64 nt, hsa
cauuccucccaacagcucaaaauuaggccuugggcaggggcagggagagcugcugagccuaaag

SEQ ID NO: 110437 - RNA, 64 nt, hsa
aaagguauuuguugguuuauguuacuuaauaguccaggggcaccuggcuucagguagguuugau

SEQ ID NO: 110438 - RNA, 64 nt, hsa
aaggggugucugggaccuggauggccagcagggacaggggcauugucaucucaaaggcccaacc

SEQ ID NO: 110439 - RNA, 64 nt, hsa
ccgaaggacacccagcaggcaccccccggggaggcaggggcagaggucagaaggggugucuggg

SEQ ID NO: 110440 - RNA, 64 nt, hsa
gaccguucgcauggcagccaucaaagaguccuggacgcacaauauccagcgagagaaagaguuu

SEQ ID NO: 110441 - RNA, 64 nt, hsa
cuuugcacuaucguuugcuugguguuuguuuuuaacgcacaacuugcuuguacaguaaacuguc

SEQ ID NO: 110442 - RNA, 64 nt, hsa
cagauggggccuuuggggcugguagaaauacccaacgcacaaaugaccgcacguucucugcccc

SEQ ID NO: 110443 - RNA, 64 nt, hsa
uguauuuuuccaagcacaguauaaaauuuuaacaacgcacaaaaaaauacagaacugcagggga

SEQ ID NO: 110444 - RNA, 64 nt, hsa
gucugccugaaucaccuuucuuugugugccuccuacgcacaaagccagcucugcaguggaaucu

SEQ ID NO: 110445 - RNA, 64 nt, hsa
gcucuggauucuggaucucuccugcuguaaccccacgcacaagccugcaacccccagagcucuu

SEQ ID NO: 110446 - RNA, 64 nt, hsa
cucgaccacagaauaaugccagucaccacccugaacgcacaaucuccagugcaggaucuaauga

SEQ ID NO: 110447 - RNA, 64 nt, hsa
caguaaugauuuccuuagcagaagccguauuuguacgcacaacauuaaaucaagggcuacaauu

SEQ ID NO: 110448 - RNA, 64 nt, hsa
uuguagagaaaaaaaaauauguguacacauaugaacgcacaacaugcacauucauccucacaug

SEQ ID NO: 110449 - RNA, 64 nt, hsa
ccaagcucagucuaaaugaaaccgaaacgugaccacgcacaaaggcagucacugccucgagggg

SEQ ID NO: 110450 - RNA, 64 nt, hsa
aaaccauuuugaucucccugugguuaucaauauaacgcacaaucacaaguguaugaggacuuag

SEQ ID NO: 110451 - RNA, 64 nt, hsa
ugguuuuaauuacccucagauuucacccauaaaaacgcacaauuguauuauuuuacagagaugu

SEQ ID NO: 110452 - RNA, 64 nt, hsa
ccaaggaugcugucaagcaccugcaugugcugucacgcacaagggcacgugaagucauugaggc

SEQ ID NO: 110453 - RNA, 64 nt, hsa
acuggacucacauucgacauaccccacugggcacacgcacaaacacacacacuauggggugggg

SEQ ID NO: 110454 - RNA, 64 nt, hsa
gguaaaauugggguaaaaugugguaaaaugugauacgcacaaacccuuugaaaauagcaaaaca

SEQ ID NO: 110455 - RNA, 64 nt, hsa
uucauaauaaucuucaaguucaggagccgcagagacgcacaacuuuacacuuaucauuucuaac

SEQ ID NO: 110456 - RNA, 64 nt, hsa
cuaaugagaguuuuuacagcucaucauucaaauaacgcacaaaaaacaaaagccgcuaugaccg

SEQ ID NO: 110457 - RNA, 64 nt, hsa
cuugauuucucaggagcgucugggggggcucagcacgcacaaacuccuucuccuucuaccacuc

SEQ ID NO: 110458 - RNA, 64 nt, hsa
agaagaauggcccaaguuucauucgcccucagccacgcacaagggaaagggaacuuuggguuau

SEQ ID NO: 110459 - RNA, 64 nt, hsa
aucccaggaaggcagagguggcagugagcugagaacgcacaacugcacuccagccugggugacg

SEQ ID NO: 110460 - RNA, 64 nt, hsa
guagcaaaugacacaugcacgcacacacacauacacgcacaagcgccagugcgcacguguacac

SEQ ID NO: 110461 - RNA, 64 nt, hsa
uuuuuacauguguuugguuucugauucaagugacacgcacaaacugaaaaaaaaaaaacaaaaa

SEQ ID NO: 110462 - RNA, 64 nt, hsa
gguagaagacuucucauuggggagcaacuuuuugacgcacaacuuuuggugcguuuuucuaguu

SEQ ID NO: 110463 - RNA, 64 nt, hsa
aagccgcuuccucuccacugaagagcuaugagauacgcacaauacuugcuguucacguuaugac

SEQ ID NO: 110464 - RNA, 64 nt, hsa
gaucuugggaccuccaaacuuauagcgcugaccaacgcacaacagguagcagagagguguuuag

SEQ ID NO: 110465 - RNA, 64 nt, hsa
ucaaacacagcauuucauguaaucagaauucuaaacgcacaacucgggagcugugcacggcuuc

SEQ ID NO: 110466 - RNA, 64 nt, hsa
ucuuacguuuucugggaauuuuguaacaaguuacacgcacaaguguuagaaacuuuggcauaac

SEQ ID NO: 110467 - RNA, 64 nt, hsa
aaucuuuguugagacguucgacuuguucuuguguacgcacaauggcacgugugcgcuuauuguc

SEQ ID NO: 110468 - RNA, 64 nt, hsa
uauuccuucuuuuuuccuccuuucauuucccacuacgcacaaagaguuuauaaacacuguucuc

SEQ ID NO: 110469 - RNA, 64 nt, hsa
ugaaaacagacuuccaccucaguggccugugggcacgcacaagugaggucuguuuuucuagaca

SEQ ID NO: 110470 - RNA, 64 nt, hsa
acacuguugcucuugaaaaucugggucugaaaaaacgcacaagagccccugcccugcccuagcu

SEQ ID NO: 110471 - RNA, 64 nt, hsa
cgcucaguuuggaccauuggaggaacuuagugucacgcacaaauggggcuauuccuacgcuuag

SEQ ID NO: 110472 - RNA, 64 nt, hsa
uacauucuuuucuaugagcagcaggggauagacuacgcacaauuucugccaaagauugauggca

SEQ ID NO: 110473 - RNA, 64 nt, hsa
gagcugugaaucuagaggcucugagccacuguuaacgcacaauguucacagacaucuguugcug

SEQ ID NO: 110474 - RNA, 64 nt, hsa
aaauaccaaccugaagacaccguucauucaggcaacgcacaaaacagaaaaugaagguggaaca

SEQ ID NO: 110475 - RNA, 64 nt, hsa
ucccaccacuaaaaaaccaacaaugugauuuauaacgcacaacuucgugcucaggucaucuagg

SEQ ID NO: 110476 - RNA, 64 nt, hsa
aaugacaaaccacacaauuguuguugaguaaaccacgcacaauggcaugucuuucuuuuucugc

SEQ ID NO: 110477 - RNA, 64 nt, hsa
gcccacaggaggcaugcacaaucugguaggagaaacgcacaaguacagauagcuugcucucuga

SEQ ID NO: 110478 - RNA, 64 nt, hsa
ugcacaguguggcugcuuuuccauaauuuuugggacgcacaaaugucugcaugauuuugagaaa

SEQ ID NO: 110479 - RNA, 64 nt, hsa
aggacauucuccccucuccuaggagacggaugucacgcacaaauggggagagaaguguuuauuu

SEQ ID NO: 110480 - RNA, 64 nt, hsa
gaucacagaguucagggggaaaaugugacagcacacgcacaaacgccuucacuggaucagccgc

SEQ ID NO: 110481 - RNA, 64 nt, hsa
agaaaacaauuuuuuaaaaauucucauuacauagacgcacaagaauaugucacauaaagaaaau

SEQ ID NO: 110482 - RNA, 64 nt, hsa
gguggcagcgcccagccuggccccaagcauggaaacgcacaaccccuaaucgcccugagcuacu

SEQ ID NO: 110483 - RNA, 64 nt, hsa
cacauuucagugaucagaauagauauccuuuuacacgcacaaaagcaauagauucauucagugg

SEQ ID NO: 110484 - RNA, 64 nt, hsa
ccagcugaccagaaugagauccaaucugcugaaaacgcacaaguuuauuguuggacaagaugaa

SEQ ID NO: 110485 - RNA, 64 nt, hsa
cugugaauuaaaauaugcucaugugugggcacacacgcacaaacacacacacgcacgcacacag

SEQ ID NO: 110486 - RNA, 64 nt, hsa
aaugcuuuuuaaagcacaugucucauuuuaaaugacgcacaaacugaagauguuaauaaaauuu

SEQ ID NO: 110487 - RNA, 64 nt, hsa
uggaggggaaaaagaugacagagaaguggacuccaaaccucauuuuaguuguagaagaaaauuu

SEQ ID NO: 110488 - RNA, 64 nt, hsa
ccccaccucugcagaagaaaauuuugcucuuauaaaaccucauguuuucaucauucccaucuuu

SEQ ID NO: 110489 - RNA, 64 nt, hsa
auuuccaaaaauguaagaaauuuuacaauugugaaaaccucauggauuugggcaaacugaaugu

SEQ ID NO: 110490 - RNA, 64 nt, hsa
gaggacuuggugaaaggaaauagcaguuacagcaaaaccucagugauuacaauugaggaaaaag

SEQ ID NO: 110491 - RNA, 64 nt, hsa
ugcuucaacacuuaaguagcauacacugcccuacaaaccucagagagcacuuuuccccaaguuc

SEQ ID NO: 110492 - RNA, 64 nt, hsa
uuuugucuuguacuacuuugacccaccccugaauaaaccucaauugcuggagugggguguaguu

SEQ ID NO: 110493 - RNA, 64 nt, hsa
ggccauaucuucaccaggccagagauucaguuuuaaaccucagcagccaucaguuuggccaagu

SEQ ID NO: 110494 - RNA, 64 nt, hsa
gaaugaagucuuugauggguaggagagagagggaaaaccucaaacuacaucauagaaguauguu

SEQ ID NO: 110495 - RNA, 64 nt, hsa
auacagccccaccaucauccccuucucauuuuauaaaccucaaaguggauucacuuucugauag

SEQ ID NO: 110496 - RNA, 64 nt, hsa
caggaggcaguggcgggcuccccgaugggacauaaaaccucaccgaagauggaugcuuaccccu

SEQ ID NO: 110497 - RNA, 64 nt, hsa
uuuuuuuuaagggccuuggagccaucucuaaaacaaaccucaagggauuuagugcccugucucc

SEQ ID NO: 110498 - RNA, 64 nt, hsa
ucccauccugccaugagcaauuguuugcucuugaaaaccucacugcaaggcugaggcugagcuu

SEQ ID NO: 110499 - RNA, 64 nt, hsa
cacuuuucuguaaauauacauaaacuuaaaaagaaaaccucauggagucaucuugcacacacuu

SEQ ID NO: 110500 - RNA, 64 nt, hsa
uaugucuuguucuugagauuuuguauauuuaggaaaaccucaagcaguaauuaauaucuccugg

SEQ ID NO: 110501 - RNA, 64 nt, hsa
acccauuuuuauagaucagaaucagaaaacagguaaaccucacucacacauuuggacucauuug

SEQ ID NO: 110502 - RNA, 64 nt, hsa
aauauugaaauauuucauguccuauuuuaauagaaaaccucagggcccaaguaacagugauaga

SEQ ID NO: 110503 - RNA, 56 nt, hsa
uuaguuccuucuucugcuaauccccaaaaccucagaaaccucauaauucuuaacac

SEQ ID NO: 110504 - RNA, 64 nt, hsa
uaguuccuucuucugcuaauccccaaaaccucagaaaccucauaauucuuaacaccuggcauuu

SEQ ID NO: 110505 - RNA, 64 nt, hsa
aaauacucauauguuuaugaccaaaauaaauaugaaaccucauauuaaaaaggugugguguucg

SEQ ID NO: 110506 - RNA, 64 nt, hsa
uuguccuugugucacguuccauuauuuuauuuaaaaaccucaguaaucguuuuagcuucuuucc

SEQ ID NO: 110507 - RNA, 64 nt, hsa
caaaguucuauacagcauuuccuuuauagcauucaaaccucacauccucccuucaguuuaaugc

SEQ ID NO: 110508 - RNA, 64 nt, hsa
auuaaacuuucuguauauagucaauaagcaauaaaaaccucauuuuucagaguucacaguuuaa

SEQ ID NO: 110509 - RNA, 64 nt, hsa
aguguucuggacaaggccaagcuuuucuuuauuaaaaccucagcaugucucccugaucugaacu

SEQ ID NO: 110510 - RNA, 64 nt, hsa
ucaucggcuuucauuauugugcagaaauauuagaaaaccucauugaucaauuuuauguauuuga

SEQ ID NO: 110511 - RNA, 64 nt, hsa
aaaauuauuacauccuuuacauucaguuaagaucaaaccucacaaagagaaauagaauguuuga

SEQ ID NO: 110512 - RNA, 64 nt, hsa
uuuuugaaaaucauuacacuuucacuagaagcccaaaccucagcauucugcaauauguaaccaa

SEQ ID NO: 110513 - RNA, 64 nt, hsa
gacacaccaugugccaggaaaugaccucagcaagaaaccucaggccgugugaagagcagcaaag

SEQ ID NO: 110514 - RNA, 64 nt, hsa
agaaggaaauaaauguaaaaaugcugcaaauuaaaaaccucaaagaagggaaauaauugcaaca

SEQ ID NO: 110515 - RNA, 64 nt, hsa
gcagugaaugugggaaagcuuuuauucagaugucaaaccucauucgacaccagagaauucauac

SEQ ID NO: 110516 - RNA, 64 nt, hsa
guacaguauguggaaaagccuuuagucagaaaucaaaccucacugaacaugagaaaauucauac

SEQ ID NO: 110517 - RNA, 64 nt, hsa
ccauauacauagauggaaaaacccaguauuauaaaaaccucaauucugaaaaucuauagacuga

SEQ ID NO: 110518 - RNA, 64 nt, hsa
guccccaaucccucugcccagucccucaauguugaaaccucaucucuugaaggcagauccugau

SEQ ID NO: 110519 - RNA, 64 nt, hsa
cuccaagcucagcugcuggauucuggaugucaacaaaccucaccacuggauccugacaaccaca

SEQ ID NO: 110520 - RNA, 64 nt, hsa
ucauuuugaucaauguuuauagauuucaagguacaaaccucacuuuuuauguuuauuccuaaau

SEQ ID NO: 110521 - RNA, 64 nt, hsa
cuaugcaaaacauaggaggauucauacaggagagaaaccucacaagugugaugauuguggcaaa

SEQ ID NO: 110522 - RNA, 64 nt, hsa
uuaaugaaaugaagauauuucaaacagaucuuugaaaccucagauucuguggugcaauuuuaau

SEQ ID NO: 110523 - RNA, 64 nt, hsa
gucaggacuuccugucacuguuuuccaaagcuguaaaccucacuggugaacguucaccuuaaug

SEQ ID NO: 110524 - RNA, 64 nt, hsa
cuauuaugcguaaugcucagcuuuuuguaaagaaauauuuaauuguauuuuguguuuauacagg

SEQ ID NO: 110525 - RNA, 64 nt, hsa
caaguuuguugagcuuuaaaauguauuugaaguaauauuuaaauaggcauuuaaaauuucaaau

SEQ ID NO: 110526 - RNA, 64 nt, hsa
uggcuugauuuuuggaaacaauauagagguauucauauuuaaaugaggguuuacauuuguuuug

SEQ ID NO: 110527 - RNA, 64 nt, hsa
uguaaaugcugauauugauuucacugguccaucuauauuuaaaacgugcaagaaaaaaauaaaa

SEQ ID NO: 110528 - RNA, 64 nt, hsa
guauucuuaauacagugcucacugcauuuaauaaauauuuaauaaaugaugaaugauagaaguu

SEQ ID NO: 110529 - RNA, 64 nt, hsa
uucagggagguaggaaagguaacagaaaaccagcauauuuaaucaaagcaagaaguaaucgcug

SEQ ID NO: 110530 - RNA, 64 nt, hsa
ggucucauuuaauggcccuguuuuuuucauuauuauauuuaaugauagggcaggauuucguaug

SEQ ID NO: 110531 - RNA, 64 nt, hsa
ccacuuuuccuucuuguagacucagcucaccuguauauuuaaacuguucuuggcaucuugaaac

SEQ ID NO: 110532 - RNA, 64 nt, hsa
gugcuuucucagguuacuguauaacuguuauaauauauuuaauauauaaaauuaagacuuuugc

SEQ ID NO: 110533 - RNA, 64 nt, hsa
cauaaauucaggaagcacaauauauaccaaacauauauuuaaauaaaauccaggccuagacuca

SEQ ID NO: 110534 - RNA, 64 nt, hsa
uuguagaaggguuauauuuuacuacuguggaaaaauauuuaagauaguuuugccagaacaguuu

SEQ ID NO: 110535 - RNA, 64 nt, hsa
uuucaauuuugcaugcucgauuauucccuguacaauauuuaaaauuuauugcuugauacuuuug

SEQ ID NO: 110536 - RNA, 64 nt, hsa
ucuuuuucaauauacaaauuuuaaaaauacuacaauauuuaacuaaggcccaaccgauuuccau

SEQ ID NO: 110537 - RNA, 64 nt, hsa
gacaauuauuuuuauagacaaaguaaaaagacagauauuuaagaggcauaaccaaaaaagcaaa

SEQ ID NO: 110538 - RNA, 64 nt, hsa
aguaguauguauuacucuuauacauuagauaccuauauuuaaaugaaaggcccaauuuguaaac

SEQ ID NO: 110539 - RNA, 64 nt, hsa
auuucgggugguuuacguuuaugccaguuccuuuauauuuaaauuucuuguuuuauauauuuug

SEQ ID NO: 110540 - RNA, 64 nt, hsa
ucuauauuuaagguuucugggaguaguuuugucuauauuuaauccauagaugugcuccuaguca

SEQ ID NO: 110541 - RNA, 64 nt, hsa
uuuggcuuccuacauaaauuaauaaagucugucuauauuuaagguuucugggaguaguuuuguc

SEQ ID NO: 110542 - RNA, 64 nt, hsa
uauccgaaaaaguaaacguuuaugacuauagguaauauuuaagaaaaugcaugguucauuuuua

SEQ ID NO: 110543 - RNA, 64 nt, hsa
cagauccuggcccucccgcccccaccccucagggauauuuaaaacuuauuuuauauaccaguua

SEQ ID NO: 110544 - RNA, 64 nt, hsa
aauaaauuuuuagaaaucugauuggcauauugagauauuuaagguugaauguuuguccuuagga

SEQ ID NO: 110545 - RNA, 64 nt, hsa
aaacaaaaacagguaucagugcauuauuaaaugaauauuuaaauuagacauuaccaguaauuuc

SEQ ID NO: 110546 - RNA, 64 nt, hsa
aguaauguaaaauuuaaauggggaaagauauuuaauauuuaauacuaagcuuuaaaaagaaacc

SEQ ID NO: 110547 - RNA, 64 nt, hsa
uuggcagaguaauguaaaauuuaaauggggaaagauauuuaauauuuaauacuaagcuuuaaaa

SEQ ID NO: 110548 - RNA, 64 nt, hsa
uaagaacauguuuuaaaaagauacacucuaucacauauuuaagcaaacaucacauuuggagaag

SEQ ID NO: 110549 - RNA, 64 nt, hsa
aagugugcauuauuuuacaugugcaaaucagaauauauuuaaaaaaaagcaaaagaaauucaau

SEQ ID NO: 110550 - RNA, 64 nt, hsa
acaagugcgauuucaaaaagaucuugaaaguaauauauuuaaucaauuaaaauguuuaucugua

SEQ ID NO: 110551 - RNA, 64 nt, hsa
aguggaugcugaaguuacaugagcuacauguuaaauauuuaaagucuccaaaauaaaacacccc

SEQ ID NO: 110552 - RNA, 64 nt, hsa
augaaguuguaaaaacuugaauguguauaguuagauauuuaaaugguugcuucuucauagaauu

SEQ ID NO: 110553 - RNA, 64 nt, hsa
cagaucaaccccuuuauuuucucuuuagcugugcauauuuaaaauauuggaaaguaucagauuu

SEQ ID NO: 110554 - RNA, 64 nt, hsa
auuuucuaaaucugggauuuaaaaucuuuagacaauauuuaaaaucuugauuuuuuuuaaaugu

SEQ ID NO: 110555 - RNA, 64 nt, hsa
ugucaguuacuuuuagaaagaaaacacugcagaaauauuuaacagauuacuucuugauaaaauu

SEQ ID NO: 110556 - RNA, 64 nt, hsa
uuugguuugcugagucuuguuuuaaguggccuugauauuuaaaacuauuccugccaccauuucu

SEQ ID NO: 110557 - RNA, 64 nt, hsa
uuauuugcuucucccuccccaaccaccucaugguauauuuaagagugaaagggacaaacuagua

SEQ ID NO: 110558 - RNA, 64 nt, hsa
auuuaaauuauuuuuuuccagauuggcacaugaaauauuuaaacuuuuuugugugccuuucugu

SEQ ID NO: 110559 - RNA, 64 nt, hsa
uaauuuuuuaaauauggauuaugcuugaauuacuauauuuaaaaugaaaauguauagauuacac

SEQ ID NO: 110560 - RNA, 64 nt, hsa
aagucauggaauaguuuuuauauuuacagcuuuuauauuuaaaacuuguaagaguuuuuuuaau

SEQ ID NO: 110561 - RNA, 64 nt, hsa
auaaaaaaaaaaaaacuucaguuuucuaaaaauuauauuuaaaauuguaaucaaaauguaccua

SEQ ID NO: 110562 - RNA, 64 nt, hsa
uuuuugaucuaccuagguggaguugguggugcugauauuuaaauucaggcuacugcuucaaucu

SEQ ID NO: 110563 - RNA, 64 nt, hsa
uuaauuuaauauuuacucuauaaccaaaugaaauauauuuaaaauauauugaauauuuuauauu

SEQ ID NO: 110564 - RNA, 64 nt, hsa
ucucucuuuauauaaauacacagaguuugguaugauauuuaaauacaucaucuggccaggcaug

SEQ ID NO: 110565 - RNA, 64 nt, hsa
aagaaaacuaagacagacuguagaugcauuuuaaauauuuaaauaugauccucagacaugcagc

SEQ ID NO: 110566 - RNA, 64 nt, hsa
uuccagguagauccuaaguugcuggaucuaguugauauuuaaacaauaucuaguugauauuucu

SEQ ID NO: 110567 - RNA, 64 nt, hsa
aauuguaauaaugaaaugagcuuucucuauagccauauuuaauuaaauaagugucgaaugucuu

SEQ ID NO: 110568 - RNA, 64 nt, hsa
caagugcaaauuuuauucuaaguuucagagcucuauauuuaauuuaggucaaaugcuuuccaaa

SEQ ID NO: 110569 - RNA, 64 nt, hsa
ucugaacaguuaugugccuguaaagucuccucuaauauuuaaaggauuauuuuuaugcaaagua

SEQ ID NO: 110570 - RNA, 64 nt, hsa
aauuuuuuuauugcuuucauuucccaguuaaaugauauuuaacaccugggaaaacaggacagcu

SEQ ID NO: 110571 - RNA, 64 nt, hsa
caaguaugucagagcacaaaguuggcagcugguuauauuuaauucagccccucugaaaagcaca

SEQ ID NO: 110572 - RNA, 64 nt, hsa
uauuuguugagcuccuauuugcccagagauggucauauuuaaacagaaguauacguuuuucagu

SEQ ID NO: 110573 - RNA, 64 nt, hsa
ugcaaauugcccacucgugauaagucaacagccaauauuuaaaacuuuguucguuacuggcuuu

SEQ ID NO: 110574 - RNA, 64 nt, hsa
uuguuggaggaaacugguugcuagucaauguucuauauuuaaugaaugugugauaaaucauccu

SEQ ID NO: 110575 - RNA, 64 nt, hsa
aaguauuuuuuguuuauucucuuaaaagaucacuauauuuaaauaaaagugaaggucagcaaca

SEQ ID NO: 110576 - RNA, 64 nt, hsa
uauuccaaaugauuuacugcuuuuggaaucacaaauauuuaauucauuucucuaauuugauucu

SEQ ID NO: 110577 - RNA, 64 nt, hsa
cauauaauaaauccaauuaaacauuauuugauacauauuuaacuuuuuuggcuguauguaauuc

SEQ ID NO: 110578 - RNA, 64 nt, hsa
ggaucaggauugcaugaaagaagaaaauccuucaauauuuaaaauguuucuuacaauacccacg

SEQ ID NO: 110579 - RNA, 64 nt, hsa
gaaacccaggaauauuuaccugguguuacauuuaauauuuaauguaacuggucuagcaacauua

SEQ ID NO: 110580 - RNA, 64 nt, hsa
uuucaauuuauugcucaguguaccuguuaacauuauauuuaacaauugcuuaaauuuuuguuuu

SEQ ID NO: 110581 - RNA, 64 nt, hsa
guugacgcucaucucuuuugucuuacgcuuagccauauuuaaaucuugaauuuaauagagucua

SEQ ID NO: 110582 - RNA, 64 nt, hsa
cuguuaaugggaauuuaacauauuuaagaaaccaauauuuaaaauguuggucuagguuuuuuuc

SEQ ID NO: 110583 - RNA, 64 nt, hsa
ugcuuagauuauguucuguuaaugggaauuuaacauauuuaagaaaccaauauuuaaaauguug

SEQ ID NO: 110584 - RNA, 64 nt, hsa
uugaaucagauuuaagggcucuguccuguuauacauauuuaaggcagaaaaaaaguuacauguc

SEQ ID NO: 110585 - RNA, 64 nt, hsa
cacauucuauauguaagauagcacacaaguagaaauauuuaaaagcagucuuauucacagauug

SEQ ID NO: 110586 - RNA, 64 nt, hsa
cauauguuugaaaaauccgugaguauuccaaaauauauuuaauaauggaauaucugcauuaaua

SEQ ID NO: 110587 - RNA, 64 nt, hsa
gaaaaacagaccauuuaaaaacucagacaagauuauauuuaauauauuaauuacuaaaaaggca

SEQ ID NO: 110588 - RNA, 64 nt, hsa
aauuuucacauuuauauuuaaacuucaauuuuuuauauuuaaacuucaauuuuuuagcaacagc

SEQ ID NO: 110589 - RNA, 64 nt, hsa
uaucuggggaaaaaagguccgaauuuucacauuuauauuuaaacuucaauuuuuuauauuuaaa

SEQ ID NO: 110590 - RNA, 64 nt, hsa
uaggggcagaucuugaauucuggccaagaaacugauauuuaacccauaaagagauagucacuau

SEQ ID NO: 110591 - RNA, 64 nt, hsa
caaguaguagagccaaguuggccaaaaaacuuggauauuuaaaaagacgguuucuuuuaauuuu

SEQ ID NO: 110592 - RNA, 64 nt, hsa
cucccccugacacagagaaggggccuugguauuuauauuuaagaaaugaagauaauauuaauaa

SEQ ID NO: 110593 - RNA, 64 nt, hsa
guaauuuuauguagaguuugagcugaagccccguauauuuaauuuauuuuguuaaacaugaaag

SEQ ID NO: 110594 - RNA, 64 nt, hsa
accagucaccaaauguaagacccauaagaaacccauauuuaaaaaucugaauuuuuuagaagaa

SEQ ID NO: 110595 - RNA, 64 nt, hsa
agaaaucaguaguuuugcaauguuaauuauuuagauauuuaauuucgcagauuuuuaaacuuua

SEQ ID NO: 110596 - RNA, 64 nt, hsa
cuguacuaaaugccuaauuuguauggaagagugcauauuuaaucucuuuucuauacugcuccuu

SEQ ID NO: 110597 - RNA, 64 nt, hsa
uuugaguagccuuuguuuaaaaaaaagacuaaauauauuuaaaaggccacauuuauauuuuuuu

SEQ ID NO: 110598 - RNA, 64 nt, hsa
aaauggaguuuauauuuguuauuucuauuuuguuauauuuaauaauagaauuagauugaaauaa

SEQ ID NO: 110599 - RNA, 64 nt, hsa
aggauugcauucuauuuucuauaugacccucuugauauuuaaaaaacacuauggauaacaauuc

SEQ ID NO: 110600 - RNA, 64 nt, hsa
uacaaguucuauauauguagaaaugaauaaauauauauuuaaguacaguuuucaugaggaaguu

SEQ ID NO: 110601 - RNA, 64 nt, hsa
auuucagaaaauucuucauagugguauuggccuuauauuuaacuuuuuuuuuauuuuuuuuuug

SEQ ID NO: 110602 - RNA, 64 nt, hsa
ggggacaucaaaacuucaauaaucaagauaccuaauauuuaagugaauauuuuuaaaacucaaa

SEQ ID NO: 110603 - RNA, 64 nt, hsa
aaaauuagguccaguaacaccuguauauauguauauauuuaauaaagaguacuuguacaaaaaa

SEQ ID NO: 110604 - RNA, 64 nt, hsa
uuauugauguuuucacaaagaacaggaaaauaaaauauuuaaaaauauaaaauguuuguuuuau

SEQ ID NO: 110605 - RNA, 64 nt, hsa
uuaggucaaacccaaguuaguucaauccugauucauauuuaauuugaagauagaagguuugcag

SEQ ID NO: 110606 - RNA, 64 nt, hsa
uauuucuugccauaaugguaaaggacugauugauauauuuaagaguuaauaaauuugugauuuc

SEQ ID NO: 110607 - RNA, 64 nt, hsa
ucugauaauuauuacacaauuuaaaacaacauauauauuuaaaauaaauauauacaguaaauau

SEQ ID NO: 110608 - RNA, 64 nt, hsa
uuauucaugaaaaacuuagaauagugaacuauuaauauuuaaaaacgagaaauacaacauuuaa

SEQ ID NO: 110609 - RNA, 64 nt, hsa
acacauuuaaaauacacaauucagugguuuuaacauauuuaaauacaugugcaaucaucccccc

SEQ ID NO: 110610 - RNA, 64 nt, hsa
auuuuuuauuuaauuuccuauuuucacauaaguuauauuuaagggaggagggaauuuuuuuuaa

SEQ ID NO: 110611 - RNA, 64 nt, hsa
gucugcaguucucgaugaccgaaaguuaucaaaaauauuuaaaauauuuaaauugugaaccuau

SEQ ID NO: 110612 - RNA, 64 nt, hsa
ucucgaugaccgaaaguuaucaaaaauauuuaaaauauuuaaauugugaaccuauugauaaaga

SEQ ID NO: 110613 - RNA, 64 nt, hsa
acaaauauguuuauguauuaaaucaccauccaaaauauuuaaggaauauauaaaaagauuuuua

SEQ ID NO: 110614 - RNA, 64 nt, hsa
caagaagucacugcuuuuuagguguguugcaucaauauuuaaauaaaaucccagaaauguauuu

SEQ ID NO: 110615 - RNA, 64 nt, hsa
uaggcaggaaugaucuuuucaaaucauuagcacaauauuuaaauaucuaaaaauuuaagagauc

SEQ ID NO: 110616 - RNA, 64 nt, hsa
aauaauugcgggugcuucaggacuuuuugcuucuauauuuaaguauauuguuuuuauagcaaga

SEQ ID NO: 110617 - RNA, 64 nt, hsa
cuaaauaaaauuuuaacaaauuaaacuaaacaauauauuuaaagaugauauauaacuacucagu

SEQ ID NO: 110618 - RNA, 64 nt, hsa
gugugguuugucccacaaaugcagaguugguuuaauauuuaaauaucaaccaguguaauucagc

SEQ ID NO: 110619 - RNA, 64 nt, hsa
cugcccucagguugccuauguauuuuaccuuuucauauuuaaggcaaaaguacuugaaaauuuu

SEQ ID NO: 110620 - RNA, 64 nt, hsa
augcuugcuuccauuauuucaguugguugcccuaauauuuaaaauuuacacuucuaagacuaga

SEQ ID NO: 110621 - RNA, 64 nt, hsa
aauauuugugguucauguauauuuugaccagaguauauuuaaguauauaauuucagcuuccuug

SEQ ID NO: 110622 - RNA, 64 nt, hsa
ugauucauuuuaguuacuguguuuuauuuugaaaauauuuaaauauugcacuucuauaaauagu

SEQ ID NO: 110623 - RNA, 64 nt, hsa
aaguaauaauuccccaauaucaucuaaucaagccauauuuaaauuucugaaguuaacuccaaau

SEQ ID NO: 110624 - RNA, 64 nt, hsa
cauuaguagauauaaacauaauucaaauauuuaaauauuuaagaggagaaaaguaacuagaaaa

SEQ ID NO: 110625 - RNA, 64 nt, hsa
aucuccuacauuaguagauauaaacauaauucaaauauuuaaauauuuaagaggagaaaaguaa

SEQ ID NO: 110626 - RNA, 64 nt, hsa
acugcaagcuuuccugccaauuugggauuuucaaauauuuaauucuaaauuccagauuuuaagg

SEQ ID NO: 110627 - RNA, 64 nt, hsa
cauccuggugccaggaauauaaaaaagaguggauauauuuaaccauaacauacugugauucauc

SEQ ID NO: 110628 - RNA, 64 nt, hsa
gauaugcaaagaagcuauuaccuacauaagagguauauuuaaagauuuuuuuuuucauccuggu

SEQ ID NO: 110629 - RNA, 64 nt, hsa
gcgaccaccuugccgcuuuucaucacaagcuugaauauuuaaauucuguacuuauaucuguaaa

SEQ ID NO: 110630 - RNA, 64 nt, hsa
ggucuauuaucccaacagaagagaaaauauuuuuauauuuaaggauuaugcugcacuguacuac

SEQ ID NO: 110631 - RNA, 64 nt, hsa
guaucaacaaguguaguuauacauuuuguuuuggauauuuaauccuuacuugggaaaaaaucag

SEQ ID NO: 110632 - RNA, 64 nt, hsa
ggucggauauuaaauaagucccaggcagauuuacauauuuaauuuaaaacauuggcuuuauuuc

SEQ ID NO: 110633 - RNA, 64 nt, hsa
uaacauuuucuuauuucuuauaauaugaaugcugauauuuaaagguagaucuaugugguauucu

SEQ ID NO: 110634 - RNA, 64 nt, hsa
ucuaaauuucaugugcaaauaauuauauauaaauauauuuaaaaaugcuauauauaguauaugc

SEQ ID NO: 110635 - RNA, 64 nt, hsa
ugaaguugucuugcggcuuugcaagugucccuuuauauuuaaauuugaaaguuguaagcacuga

SEQ ID NO: 110636 - RNA, 64 nt, hsa
cugauagaauacaagaugauucaaaauuauauagauauuuaaagcuuuucugcuguuuuuuuuu

SEQ ID NO: 110637 - RNA, 64 nt, hsa
aguuuacugaaggaauauauuuaauuauauucauauauuuaacaaauaaaaauauguugaauuu

SEQ ID NO: 110638 - RNA, 64 nt, hsa
ucuaguuuuguccaguucaguuuacugaaggaauauauuuaauuauauucauauauuuaacaaa

SEQ ID NO: 110639 - RNA, 64 nt, hsa
cacuguuucuggcacgccucgugggcauuuugaaauauuuaacguuuccucaugauuugccuuu

SEQ ID NO: 110640 - RNA, 64 nt, hsa
acauagugcugaaaaaucugcaacuucuuggaucauauuuaaugaauuauaguauaaugcuugc

SEQ ID NO: 110641 - RNA, 64 nt, hsa
auuacagcuuauuuaaaaccaaauauaguugaacauauuuaaaauacauuuucacagaauggau

SEQ ID NO: 110642 - RNA, 64 nt, hsa
uaauuucuauuacuaaaguucauaucacaaaaugauauuuaauaauaaccuugggguaaaucau

SEQ ID NO: 110643 - RNA, 64 nt, hsa
cacugaauugucaguuuccuucauuugguauuacauauuuaauucuuaaauauugaggccccau

SEQ ID NO: 110644 - RNA, 64 nt, hsa
uaaaaacauuucuauaaauauaaagcuuuucuuuauauuuaagacaaaauauaaaggcuagaau

SEQ ID NO: 110645 - RNA, 64 nt, hsa
uagcugggaucauuuuugauccauugucauauuuauauuuaauuauuaaauguaucugaugaua

SEQ ID NO: 110646 - RNA, 64 nt, hsa
acuuaauuccugaucaguauagacaggacuauauauauuuaaucagagaauuacauuauaucug

SEQ ID NO: 110647 - RNA, 64 nt, hsa
cuuucucaagugugugauaaggucugcugauaaaauauuuaaccccaagaaagugaaaacuaau

SEQ ID NO: 110648 - RNA, 64 nt, hsa
ucccaaugucuuuacuuuuuaaaaaaggcuuuucauauuuaagcacauaccuauuuuguagacu

SEQ ID NO: 110649 - RNA, 64 nt, hsa
ggacacuaauuuauauaggagugaaguuuuauaaauauuuaauauuuauuuuggauucaaauug

SEQ ID NO: 110650 - RNA, 64 nt, hsa
auguauuaagacaggacauauuguuggugagauaauauuuaauagguauaaaaugguaaaauac

SEQ ID NO: 110651 - RNA, 64 nt, hsa
acacaaauuaaaaagacaaauuaaaccugaaauuauauuuaaaauauauuugagacaugaaaua

SEQ ID NO: 110652 - RNA, 64 nt, hsa
ucuuaugucuccucuauuaagaguauuuaaaaucauauuuaaauaugaaucuauucaugcuaac

SEQ ID NO: 110653 - RNA, 64 nt, hsa
ugucuacauauaagguuuuuauuugaauuguaaaauauuuaaaaguaugaauaaaauauauuua

SEQ ID NO: 110654 - RNA, 64 nt, hsa
caguuuccccccaaaaaagagauuuauuuaugaaauauuuaaaguuucuaaugugguauuuuaa

SEQ ID NO: 110655 - RNA, 64 nt, hsa
cccaguuauuuaacaaauaaauaccucauugauuauauuuaaaaguaauacacuuccuguaaac

SEQ ID NO: 110656 - RNA, 64 nt, hsa
auuuuguuguuaaauuauuuucuggcccuucuuaauauuuaaaaauguauuuccccuuguggcu

SEQ ID NO: 110657 - RNA, 64 nt, hsa
cuauuauccuaccacuuugcgggacacacuauuaauauuuaagcauagauucuuccagauguuu

SEQ ID NO: 110658 - RNA, 64 nt, hsa
uuaagaauguugguuauuuucacgggagcgugugauauuuaacauuaauauuuuauuugacacu

SEQ ID NO: 110659 - RNA, 64 nt, hsa
uauugaacaccuucaugcuuacuauuuuaugucuauauuuaaaucauuuuaacuucuauagguu

SEQ ID NO: 110660 - RNA, 64 nt, hsa
uuauuaccuuguuccuguaaaauccauuuaaucaauauuuaagagauuaagaauauugcccaaa

SEQ ID NO: 110661 - RNA, 64 nt, hsa
uaaucuauuuucauaaucaauaugugccuaaauuauauuuaaaucauuucacucuguacuauau

SEQ ID NO: 110662 - RNA, 64 nt, hsa
aauuauauuuauugaauuccuagaugcaguauggauauuuaaauuguuaaaacuuuaugaaaac

SEQ ID NO: 110663 - RNA, 64 nt, hsa
ugauaauucuuugagaugcuaaguguuucaguucauauuuaaugauacuuaaaucgugggaauu

SEQ ID NO: 110664 - RNA, 64 nt, hsa
gcuguucacaugaaaauauuccuuaguagaauguauauuuaagaaauaaaacaacaaaggggaa

SEQ ID NO: 110665 - RNA, 64 nt, hsa
auuuaacccuuuuuuauaagcagcugaagacaccauauuuaacacuauaucucagugauaggga

SEQ ID NO: 110666 - RNA, 64 nt, hsa
uaccccucugaucauuuccuguguuugaguuggaauauuuaaaauugcaguaugaccuggcucu

SEQ ID NO: 110667 - RNA, 64 nt, hsa
aguggcuacauuugacacuuuagaaaaaauaaacauauuuaauaauuuuuguuucuccuuagga

SEQ ID NO: 110668 - RNA, 64 nt, hsa
ugaauuucuuguuggaaauguaaaucuaguguccauauuuaauacucucacagcuuuguguuua

SEQ ID NO: 110669 - RNA, 64 nt, hsa
cuuuuauaugugugggauaucaauguguauauuuauauuuaaaguguauuuauuguuacaaguc

SEQ ID NO: 110670 - RNA, 64 nt, hsa
ucuguaagcuaguauauuuguuucacuguuuguaauauuuaagaaaugcucauucuuuguagaa

SEQ ID NO: 110671 - RNA, 64 nt, hsa
gcauagcaguuuuugacccaggcagaauaaguuaauauuuaauuaaauauugcuuugaagaugg

SEQ ID NO: 110672 - RNA, 64 nt, hsa
caaaauaauaaauguuaauaaggugauaagggguauauuuaauguauuguaucaaauugugaau

SEQ ID NO: 110673 - RNA, 64 nt, hsa
aauucuuuuaaaauaaaauuaauauuuauaauggauauuuaaugauuguuauuuuuaaaaacca

SEQ ID NO: 110674 - RNA, 64 nt, hsa
uaguuguauaaaucaaaaacacagaauaaggaacauauuuaacuuuuuuucauuauaaaauggu

SEQ ID NO: 110675 - RNA, 64 nt, hsa
ggacccauugaggauaacuauaaaauuacagaaaauauuuaaaugcaacuuauugcuauagaag

SEQ ID NO: 110676 - RNA, 64 nt, hsa
cuaggaacagauggcuucacugaaguuauuccaaauauuuaagaaauaauaccaggcuuuuaua

SEQ ID NO: 110677 - RNA, 64 nt, hsa
ugaauuuaaucgggcccuugguggaaacauuuauauauuuaaugcagaugcauaguguuuuuca

SEQ ID NO: 110678 - RNA, 64 nt, hsa
uauaauaucaacuauucuaaauacagguaaugguauauuuaaggcuaccauaacauccuauuua

SEQ ID NO: 110679 - RNA, 64 nt, hsa
caguauagaaaccuccauuuuugccuucgaaugcauauuuaagaguuaacagaaugaaaaaaaa

SEQ ID NO: 110680 - RNA, 64 nt, hsa
acacuccuaaaaauaaggaaccaugacauuguagauauuuaauauuguacaguauagaaaccuc

SEQ ID NO: 110681 - RNA, 64 nt, hsa
aggauauuuaaucaugacaugcacggacacguacauauuuaacugaaacaaguuuuaccaaaca

SEQ ID NO: 110682 - RNA, 64 nt, hsa
gcuuugguucuuuagggugacugugguaagaaggauauuuaaucaugacaugcacggacacgua

SEQ ID NO: 110683 - RNA, 64 nt, hsa
agcuaauuaaucugcauaugaagcauuuucugauauauuuaauaagagguauagaagcucuuca

SEQ ID NO: 110684 - RNA, 64 nt, hsa
caaaauuuuuaucuuuaaaucugagacaaguauuauauuuaaaacuagaucuauuaauacauuc

SEQ ID NO: 110685 - RNA, 64 nt, hsa
auauuuaacuguauaaaaauguucauuuuacacaauauuuaauuaaaguauuucuugucuguga

SEQ ID NO: 110686 - RNA, 64 nt, hsa
acaauaagauuguuuuaucuguacauuuuuucagauauuuaacuguauaaaaauguucauuuua

SEQ ID NO: 110687 - RNA, 64 nt, hsa
cugauaguccaaggaaccaccuuucucccuugauauauuuaacuccgucuuuggccugacaaca

SEQ ID NO: 110688 - RNA, 64 nt, hsa
gcugcuauacaacugcuuugcaacaguugcugguauauuuaaaucauuaaauuucagcauuuac

SEQ ID NO: 110689 - RNA, 64 nt, hsa
ggauaacauuuuaauuugaagguuuggaauauauauauuuaagcuuuauuuccagaacagugag

SEQ ID NO: 110690 - RNA, 64 nt, hsa
uuuacuaccuuugcaaaaacaaaauaccccaaagauauuuaaacaagguuauaauuuagcaucu

SEQ ID NO: 110691 - RNA, 64 nt, hsa
gacuaagcaauaaucuuaacaaccucuuuccugaauauuuaaauguguuuguaugguguuauga

SEQ ID NO: 110692 - RNA, 64 nt, hsa
uuuucauggauuuguguucuuacaguacuugaaaauauuuaaggaagagaugaagcucugcagu

SEQ ID NO: 110693 - RNA, 64 nt, hsa
uggucaguugaaccuuacaguaaaguauagaaauauauuuaauguggaaugucaaugccaggau

SEQ ID NO: 110694 - RNA, 51 nt, hsa
uaagaagaaauagaagauaauauauuuaauggcacugagaaacaugcaaga

SEQ ID NO: 110695 - RNA, 64 nt, hsa
uuuaucauuauauucuaaucuugaauauucuaccauauuuaaaaauaucucaagguuucuguuc

SEQ ID NO: 110696 - RNA, 64 nt, hsa
auuaaauaguuuaagcucaauuuaauuuugcuagauauuuaacaaaacauacggcucaaccuca

SEQ ID NO: 110697 - RNA, 64 nt, hsa
auacuacaguucggagaacugcuuauuuccaaguauauuuaacuuauaaaguuaauaaauaguu

SEQ ID NO: 110698 - RNA, 64 nt, hsa
uagacuucauuuauauuuuccuuacuaauaucuaauauuuaaugaauaaugaucaauuuuuuau

SEQ ID NO: 110699 - RNA, 64 nt, hsa
uuagcucuauccccacuaucuacuagaauuucucauauuuaaaccaagaugggagacuagguca

SEQ ID NO: 110700 - RNA, 64 nt, hsa
accaauuuaaauuguauguuuucaggcuguuuguauauuuaauuaagggaugggagggguuauu

SEQ ID NO: 110701 - RNA, 64 nt, hsa
gaaaaaauuugaauauacauauauauauauauguauauuuaaaaagugaauauaauuugaggca

SEQ ID NO: 110702 - RNA, 64 nt, hsa
gagauaguaaaaauuuaaaaauguaauagggaaaauauuuaauuuuuaagucaaaaacuaugcu

SEQ ID NO: 110703 - RNA, 64 nt, hsa
auggugaaccauguauuucagugaaauauuuaauauauuuaaauaucaauaaaaucaaacucuu

SEQ ID NO: 110704 - RNA, 64 nt, hsa
ugggggaggauggugaaccauguauuucagugaaauauuuaauauauuuaaauaucaauaaaau

SEQ ID NO: 110705 - RNA, 64 nt, hsa
uuucauuuuauucuaccuguugugugaguuuaguauauuuaauuuacuuuuuguuacucuuuac

SEQ ID NO: 110706 - RNA, 64 nt, hsa
ucuguguguuacuuucuuuuuauauagcuauaguauauuuaaacaauaauacuaucuuuuauag

SEQ ID NO: 110707 - RNA, 64 nt, hsa
cauuuuuugaugugccacaguuucgaguuuuucgauauuuaaauuuuuuggcuuuucaucuaag

SEQ ID NO: 110708 - RNA, 64 nt, hsa
auaaggaaaguguucaaggccagauaugccucagauauuuaaccaguaagccuuaguuguacau

SEQ ID NO: 110709 - RNA, 64 nt, hsa
cucauucucaucagacucuccuuguuuuguuugcauauuuaauuuuaaauuaaaccaaagaaua

SEQ ID NO: 110710 - RNA, 64 nt, hsa
aguucagugaacugguacaauguggucccucucaauauuuaaaaauauaauuuguaacagugcu

SEQ ID NO: 110711 - RNA, 64 nt, hsa
uaaauuauauuugugcuauaguauuugauucaaaauauuuaaaaaugucuugcuguugacauau

SEQ ID NO: 110712 - RNA, 64 nt, hsa
gauucaaaauauuuaaaaaugucuugcuguugacauauuuaauguuuuaaauguacagacauau

SEQ ID NO: 110713 - RNA, 64 nt, hsa
cuguugacauauuuaauguuuuaaauguacagacauauuuaacuggugcacuuuguaaauuccc

SEQ ID NO: 110714 - RNA, 64 nt, hsa
aaaauauaguaugugauuaaccaauccugcuuccauauuuaagcacugggaauggaaacuuaau

SEQ ID NO: 110715 - RNA, 64 nt, hsa
aacuaugaauauuuacauauuuugccuuuuagugauauuuaauguuaaagugccaugaaaaaua

SEQ ID NO: 110716 - RNA, 64 nt, hsa
uguuguuuuggggaguauucccaauguaucuuugauauuuaaccugguuaauuuguggacaguc

SEQ ID NO: 110717 - RNA, 64 nt, hsa
ucuuccuggaugaaauuacaaauauguguagaauauauuuaauaaaagacuuauaaaauaccua

SEQ ID NO: 110718 - RNA, 64 nt, hsa
aauauggacccugcugaaagcaguguauugacgcauauuuaacucgcccucuauccguagagua

SEQ ID NO: 110719 - RNA, 64 nt, hsa
agaggaagaccaaaaaauucaaugucuuaaaaauauauuuaauggcaaugcaaaagucuuccug

SEQ ID NO: 110720 - RNA, 64 nt, hsa
uuuugaauccuuugccugccuggugugccucaguauauuuaaacucaagacaaugcaccuagcu

SEQ ID NO: 110721 - RNA, 64 nt, hsa
aacacgaaacuuguuauugugaaugauucauguuauauuuaaugcauuaaaccugucuccacug

SEQ ID NO: 110722 - RNA, 64 nt, hsa
guauucauuuugaguagguugaagaagaaaaaaaauauuuaaaugaauugaauuccugauggga

SEQ ID NO: 110723 - RNA, 64 nt, hsa
auauuggccauucuguauguuuuuguaaaacagaauauuuaauccuuauuuauuaaucucuugc

SEQ ID NO: 110724 - RNA, 64 nt, hsa
caucaggugccuauggauuaaaucacauacuggcauauuuaagcugaaugucaaucuggaaaau

SEQ ID NO: 110725 - RNA, 64 nt, hsa
cagaaauaccacucuuuguguagauauuugucauauauuuaagaaaaagcuaaaaagaauggaa

SEQ ID NO: 110726 - RNA, 64 nt, hsa
ugaaagcaguuuuauguauaaauaacaaauguuuauauuuaacuaaauguaagguacgaauuau

SEQ ID NO: 110727 - RNA, 64 nt, hsa
auauauaucuacugucacauuccauauauuuugaauauuuaacucaucuaguuaauaauguuuu

SEQ ID NO: 110728 - RNA, 64 nt, hsa
uaucaaaucagaauguaaacaugaacucuugcauauauuuaaaauuguguuggaacauuugaac

SEQ ID NO: 110729 - RNA, 64 nt, hsa
gagggacgguauuuaugaaucaggguuaggcuccauauuuaaagauagagccaguuuuuuuuuu

SEQ ID NO: 110730 - RNA, 64 nt, hsa
uucauaugaaucacagcuguugacaaugucccauauauuuaagaaauuauaucauacugauacu

SEQ ID NO: 110731 - RNA, 64 nt, hsa
auauuaaaauugugaagcaaaggucaauaggcuuauauuuaauuaaagccuuacugaagaauaa

SEQ ID NO: 110732 - RNA, 64 nt, hsa
aaaguaggacauuauugccauauuguaugucuuaauauuuaacuuauucggaaauauauuccac

SEQ ID NO: 110733 - RNA, 64 nt, hsa
auggucuucaauuuaauuuaaaaauauuuugacaauauuuaauuugugcuuaugugguguuugg

SEQ ID NO: 110734 - RNA, 64 nt, hsa
auauagaauuauuacaauuuccugggagagauggauauuuaaaccucuauuauuuuagacaaga

SEQ ID NO: 110735 - RNA, 64 nt, hsa
gucaucauauguauaugucauaugacuuuauaaaauauuuaaugugacaaaaaguggaaagaau

SEQ ID NO: 110736 - RNA, 64 nt, hsa
uaauuuuaugaaaauuaugcucaauaagaguuguauauuuaauauauuugcagugaacacagaa

SEQ ID NO: 110737 - RNA, 64 nt, hsa
cugacaagguagagguccagguucaccuuuauauauauuuaaaacaauuaguacugaauuggac

SEQ ID NO: 110738 - RNA, 64 nt, hsa
auuaaaaaaggauuuguauuaaaucuuauucuguauauuuaauguagcauuuuuguauuuaaau

SEQ ID NO: 110739 - RNA, 64 nt, hsa
gaaagaaacugcaggcgccuuuguaaaaugcaaaauauuuaauuaaaagagauuuuaacauaau

SEQ ID NO: 110740 - RNA, 64 nt, hsa
uaaauaaaauugguaggaauguuuucuugccauuauauuuaacuuuucuucuuuuuccuugaca

SEQ ID NO: 110741 - RNA, 64 nt, hsa
augucugcagaaucacuguauguaacaaacagccauauuuaagacaugccuggauaaauaaaau

SEQ ID NO: 110742 - RNA, 64 nt, hsa
uaaauaaaauugguaggaauguuuucuugccauuauauuuaacguuucuucuuuuuccuugaca

SEQ ID NO: 110743 - RNA, 64 nt, hsa; identical to SEQ ID NO: 110741

SEQ ID NO: 110744 - RNA, 64 nt, hsa
cauuccuuccgaaaccccugauauuuaauauuuaauauuuaaaaacccaaauuaucaaaccauu

SEQ ID NO: 110745 - RNA, 64 nt, hsa
aauucaucauuccuuccgaaaccccugauauuuaauauuuaauauuuaaaaacccaaauuauca

SEQ ID NO: 110746 - RNA, 64 nt, hsa
gagacggaauucaucauuccuuccgaaaccccugauauuuaauauuuaauauuuaaaaacccaa

SEQ ID NO: 110747 - RNA, 64 nt, hsa
aucucuauuuaauauuuaugucuauuuaagccucauauuuaaagacagggaagagcagaacgga

SEQ ID NO: 110748 - RNA, 64 nt, hsa
gucucccacgugggagacaagaaaucccuguuuaauauuuaaacagcaguguuccccaucuggg

SEQ ID NO: 110749 - RNA, 64 nt, hsa
augauauucaguacaacucugucauuucuuuguaauauuuaaaaaauauuaguaaaggagugaa

SEQ ID NO: 110750 - RNA, 64 nt, hsa
cuguaaaguucugaccuugauaacaaagcuauaaauauuuaaguuugcuaauaugcguaaguau

SEQ ID NO: 110751 - RNA, 64 nt, hsa
uuaaaacaguauuugaguuuaaaagaguuuguauauauuuaaaugaauaacuuuuuauacucuu

SEQ ID NO: 110752 - RNA, 64 nt, hsa
gccacccggguuuaguucagccauuucaagaaguauauuuaacgucgguaguucugcuuuauua

SEQ ID NO: 110753 - RNA, 64 nt, hsa
auaaauaauuuucuuuuaaucuuuauuuugcucaauauuuaauaggaaguaugauuucaaggac

SEQ ID NO: 110754 - RNA, 64 nt, hsa
aaacuggggauuuuguuuguaacuuugguuaucuauauuuaaacauuagcugagacauauuuuu

SEQ ID NO: 110755 - RNA, 64 nt, hsa
gauccuugcuuuugcagaauuuggugcucagacaauauuuaaggacauuucagcgagacaaagu

SEQ ID NO: 110756 - RNA, 64 nt, hsa
auucugugacaaaaaguuaagauucuugggcagaauauuuaaauuggucagucagguagaagau

SEQ ID NO: 110757 - RNA, 64 nt, hsa
aauaaaaggaauuccaaauggacaagcaguaaugauauuuaaauauuuugagugagggggagug

SEQ ID NO: 110758 - RNA, 64 nt, hsa
uuuuuuuuucuuucuuucuaaucucauuuuggugauauuuaaacaaacauaaaugauuguaacu

SEQ ID NO: 110759 - RNA, 64 nt, hsa
acagcaaggugcucuaaguaauauucgauaaaauauauuuaauagaaauuugcguuugauauuc

SEQ ID NO: 110760 - RNA, 64 nt, hsa
uuuacuucucccccaauuuuaaagaaguauguguauauuuaauaggggaagguaguuuauggaa

SEQ ID NO: 110761 - RNA, 64 nt, hsa
guuuugugguccugaugggcccacaaguuuuucuauauuuaacuggaaauaugcuuugauuuug

SEQ ID NO: 110762 - RNA, 64 nt, hsa
caacaacucauuuuuacagaguuugugaagcuaaauauuuaacauuguugauuucaguaagcug

SEQ ID NO: 110763 - RNA, 64 nt, hsa
uauauggaguuucgaagaauaaaauaugagagcaauauuuaaauucucaggaauugacuuauac

SEQ ID NO: 110764 - RNA, 64 nt, hsa
uguauauauuuuauuuaaauauauguuacauauuauauuuaaacauacauauuuaacauuuuuu

SEQ ID NO: 110765 - RNA, 64 nt, hsa
uuaaauauauguuacauauuauauuuaaacauacauauuuaacauuuuuuacauaucuaucaau

SEQ ID NO: 110766 - RNA, 64 nt, hsa
ccuuguuuagcugauggucauuucugggauuggaauauuuaauaagcccaauucuaaguugaua

SEQ ID NO: 110767 - RNA, 64 nt, hsa
auuuccuaauuuauacaugauuuuugguguuaauauauuuaaugauuaauaacagaauguuuau

SEQ ID NO: 110768 - RNA, 64 nt, hsa
uuuaaaggaagaaaccauuuuuaaugagaugaaaauauuuaacgaauuuaaaaagcuaaugaca

SEQ ID NO: 110769 - RNA, 64 nt, hsa
gugugagccacugugcccagcaguuucccagaauauauuuaaaugcaaaguuacaugaggggaa

SEQ ID NO: 110770 - RNA, 64 nt, hsa
ugauguauauuuaauguuaauauugugcaaacuuauauuuaaaacuugccugguuucuaaaccc

SEQ ID NO: 110771 - RNA, 64 nt, hsa
ucaguuuuauauuuauaagccuuauuuaugauguauauuuaauguuaauauugugcaaacuuau

SEQ ID NO: 110772 - RNA, 64 nt, hsa
cugcuaucaucauuaacagcguaauuauacaagcauauuuaaugcugaguuuaauuuaauaugu

SEQ ID NO: 110773 - RNA, 64 nt, hsa
auuacaaacuuuaaacacuuuuuaaaucuucaaaauauuuaaaacaaauuuaaagggccuguua

SEQ ID NO: 110774 - RNA, 64 nt, hsa
aaauaccuuccaaugaaaccaagaauuucucaaaauauuuaaugucacauauuauaagaaguua

SEQ ID NO: 110775 - RNA, 64 nt, hsa
gaagauuuauaaauguuugaaauuguacacauugauauuuaaugacaaauuuacuuaaaauaaa

SEQ ID NO: 110776 - RNA, 64 nt, hsa
cacuaauaagcaucaguuuguuguuuuuaaaaggauauuuaagugagcauuuucuaguucauau

SEQ ID NO: 110777 - RNA, 64 nt, hsa
gcauacuccaguguuuuagggguuuugaaaauaaauauuuaaauuucacaguccucaauguuug

SEQ ID NO: 110778 - RNA, 64 nt, hsa
acaacauauacaacaccaaaaaauaucuaguaauauauuuaaagggaaauugagcugcuuuuuu

SEQ ID NO: 110779 - RNA, 64 nt, hsa
uuagccuaagauauacuuguuuuuguaaagaaaaauauuuaauguugaacaaaauaaauuggag

SEQ ID NO: 110780 - RNA, 64 nt, hsa
uauuuauuauauauaucaacaguaguucaaggugccaucuuaaauuaauugcaucuucauuagg

SEQ ID NO: 110781 - RNA, 64 nt, hsa
cgugcuucaagugaagagugcagaaauagugaugccaucuuagauuuuccuacacuaguaucuu

SEQ ID NO: 110782 - RNA, 64 nt, hsa
uucuucuuuuggcaccuguaaguuccgguaguggccaucuuacauucucauguccugcuggaag

SEQ ID NO: 110783 - RNA, 64 nt, hsa
acagcgccuaccaugugcagcugccuguccgaccccaucuuacagacgagaaaaccagcacaca

SEQ ID NO: 110784 - RNA, 64 nt, hsa
caaaauuuuccuucuguuaaaggaaaauauugugaauaaccacugguguguucuuagaucagca

SEQ ID NO: 110785 - RNA, 64 nt, hsa
caugcuaaauauugcaugcauauugacuaauuggaauaaccauuuacucaauuauggacagcuu

SEQ ID NO: 110786 - RNA, 64 nt, hsa
ucaucagugaagaauuguauuucaagauucaaacaauaaccagcaauuaaacuuuuuucuacaa

SEQ ID NO: 110787 - RNA, 64 nt, hsa
uguuaaauuaguuuugguugugcuagcaugaauuaauaaccaccauuuuauaccaguaucauca

SEQ ID NO: 110788 - RNA, 64 nt, hsa
aguuuuaaauauuguguuuauaaaauaaccaacuaauaaccauuugucuuucccauuuugugca

SEQ ID NO: 110789 - RNA, 64 nt, hsa
guacuaauuuaaguuuuaaauauuguguuuauaaaauaaccaacuaauaaccauuugucuuucc

SEQ ID NO: 110790 - RNA, 64 nt, hsa
gggaaucucccaaaauuuaaaaacaaauuggaagaauaaccaggacagccaagugaagcagcca

SEQ ID NO: 110791 - RNA, 64 nt, hsa
uagucaggaguaagcucugugcgagagaucugugaauaaccagauaaccccagcugccguuaac

SEQ ID NO: 110792 - RNA, 64 nt, hsa
aaaaaaugaaguguauuaaguaaauaaauaaguaaauaaccaaccaacccugaggaacaucuug

SEQ ID NO: 110793 - RNA, 64 nt, hsa
aggauuuagccucaaguaguucccuuguuguauuaauaaccacacccuuucugcaucccugucc

SEQ ID NO: 110794 - RNA, 64 nt, hsa
uacuuugcaugauaugccuuaauaugccuucauaaauaaccauuuuaagucauaauuuguccuu

SEQ ID NO: 110795 - RNA, 64 nt, hsa
uuucaacaggccacucacucuuaagggugagaagaauaaccacaauuguaugugccuguuuuuu

SEQ ID NO: 110796 - RNA, 64 nt, hsa
ugaguugacagaagcaacuauuguacaaauuaaaaauaaccauaagggagaaaccagaagaauu

SEQ ID NO: 110797 - RNA, 64 nt, hsa
uagcagagcuuuauugcaggcauuuuaaaaauugaauaaccaugugaaauaauuugggcuuaaa

SEQ ID NO: 110798 - RNA, 64 nt, hsa
aacaugagaaagcucaugggcaagaaacucuaugaauaaccaagauggagccgggugcaguugc

SEQ ID NO: 110799 - RNA, 64 nt, hsa
ugccuugugagagauugagacacucuaaauaaauaauaaccaagaugggaaauuucccugccag

SEQ ID NO: 110800 - RNA, 64 nt, hsa
aguuagcauguuggggccaggaagggacaaguuagauaaggacugagugcuuccguugcaggca

SEQ ID NO: 110801 - RNA, 64 nt, hsa
cuccaauugggacuccccagcaggaauacuuagggauaaggaagaaugcuagcaucucugucuc

SEQ ID NO: 110802 - RNA, 64 nt, hsa
uacauuucuacagaaccugugauuauucucgcaugauaaggaugguacuugcauauggugaauu

SEQ ID NO: 110803 - RNA, 64 nt, hsa
uugcuuuguuuuuuaagagauuaaaauguuucuggauaaggauuagcuucucgaaguguccauc

SEQ ID NO: 110804 - RNA, 64 nt, hsa
ugaguuugguaccaucuuauuuuccccuuauacagauaaggaaacuggggugcagaaaagugaa

SEQ ID NO: 110805 - RNA, 64 nt, hsa
uagcccugagguucuuuucccaggauggcuccaggauaaggaucacuguaggugguuguggagu

SEQ ID NO: 110806 - RNA, 64 nt, hsa
ucacuuuuaucuuuuagguaagagaaaagaaaaagauaaggaaagaagagagaagagagacaaa

SEQ ID NO: 110807 - RNA, 64 nt, hsa
ugcaggucagagguggagugcaaaauaucguuaugauaaggagugguugaauaaugggagaaug

SEQ ID NO: 110808 - RNA, 64 nt, hsa
uucacauucuuauuguaaccuuccucauuucacagauaaggaaucuuuggggauuaaccaaccu

SEQ ID NO: 110809 - RNA, 64 nt, hsa
auuaaaaccaacaaggaguuucaugugcaaaggagauaaggaaugaauauaaagauugcuauuu

SEQ ID NO: 110810 - RNA, 64 nt, hsa
ugagcaguaaaucaauggaacaucccaagaagaggauaaggaugcuuaaaauggaaaucauucu

SEQ ID NO: 110811 - RNA, 64 nt, hsa
uuugcccaaugugugcagguuaugugcugcuguagauaaggacugugccauuggaaauuucauu

SEQ ID NO: 110812 - RNA, 64 nt, hsa
guguguguguccugaacuccucaagcagcgauuggagcccaagcaccccuggagaggaagggag

SEQ ID NO: 110813 - RNA, 64 nt, hsa
ugcugguagaaucaggguccucgggcaugaacgcgagcccaaagugccagucugcgauuggaaa

SEQ ID NO: 110814 - RNA, 64 nt, hsa
ggaagccccgcccagacgguguucagggaacccggagcccaagcgcuccggcggagcccaaaag

SEQ ID NO: 110815 - RNA, 64 nt, hsa
uguucagggaacccggagcccaagcgcuccggcggagcccaaaagggugggggugggaggggca

SEQ ID NO: 110816 - RNA, 64 nt, hsa
ugcauuuuacuuugcugacuuuguuguaauagaucccauucauuguccccuuugggguauuucc

SEQ ID NO: 110817 - RNA, 64 nt, hsa
gcgcuggccuggccuugaaagaaccgaagucuuucccauucacuucucuagaaagcugccaaga

SEQ ID NO: 110818 - RNA, 64 nt, hsa
acccaucucccccaucccccacugccacacccuccccauucagacacuucauggaccaagaaug

SEQ ID NO: 110819 - RNA, 64 nt, hsa
agaagucauggcccaaauccagugugcaccccuccccauucacagagccuuuuucacaauucca

SEQ ID NO: 110820 - RNA, 64 nt, hsa
cccacucacaacaucuuguaagacugugcccggccccauucacuccauccugugagaccacgcc

SEQ ID NO: 110821 - RNA, 64 nt, hsa
cccacucacuccaucuuguaagacuaugcccagccccauucacuccauccugugagucccacuc

SEQ ID NO: 110822 - RNA, 64 nt, hsa
ggaguagaaguccauccuccccccaaccuccugacccauucauaaaugcugagaaugucucuca

SEQ ID NO: 110823 - RNA, 64 nt, hsa
gcaagacucugaugauaauucuguuucucaucugcccauucaguauuuuguuuuccuuccguca

SEQ ID NO: 110824 - RNA, 64 nt, hsa
uggggaggcagucauaccuguucagagaaccaggaagacucaauaucuaucucagaggaaauau

SEQ ID NO: 110825 - RNA, 64 nt, hsa
guuacccaggaaagaaauggucugcuagagugauaagacucagaacaggaagccugcaugugac

SEQ ID NO: 110826 - RNA, 64 nt, hsa
cccuccagccacagcaguccacagcagcaggguuaagacucagcacagggccagcagcagcaca

SEQ ID NO: 110827 - RNA, 64 nt, hsa
caggaaaagggaugagagaaaggaggugguauggaagacucagcaggaacaagguaggcuucaa

SEQ ID NO: 110828 - RNA, 64 nt, hsa
agagaaggagccaucuccaucuugaaggaacucaaagacucaagugggaacgacugggcacugc

SEQ ID NO: 110829 - RNA, 64 nt, hsa
guagaugcccugauaaagaacaucuguccugugaaagacucaaugagcuguuauguuguaaaca

SEQ ID NO: 110830 - RNA, 64 nt, hsa
cucacccacuggccccgagggggguguagacgccaagacucacgcaugugugacauccggaguc

SEQ ID NO: 110831 - RNA, 64 nt, hsa
ccccacccuggggcccugccucaccaaggaaauaaagacucaagccauuuugggguguccaggc

SEQ ID NO: 110832 - RNA, 64 nt, hsa
gggccaugucuuacucucaguaucuacaacacacaagacucaguaggcccugacugaugucucu

SEQ ID NO: 110833 - RNA, 64 nt, hsa
agagacugaugagaaacguucauaacaugaagguaagacucagggagacagagacuuuguggaa

SEQ ID NO: 110834 - RNA, 64 nt, hsa
cgcgagacgcuguacuaggcugugcgccccggaacguguccaggaggagccuggccaugggucc

SEQ ID NO: 110835 - RNA, 64 nt, hsa
gcuccuaucugugcacuuaccguagguagggacacguguccacgcaccacagacacacccacga

SEQ ID NO: 110836 - RNA, 64 nt, hsa
ucagacaaagguaaaucagccagccaggcacccacagccucagcuccugugcaguuccugggca

SEQ ID NO: 110837 - RNA, 64 nt, hsa
cagaggguccccucugggagaaacagcuucaccccagccucagggcccugggccaucacugcag

SEQ ID NO: 110838 - RNA, 64 nt, hsa
cccucgaggcagggaaaagccaucuauucuucugcagccucaggagcgagacuucaaggacuca

SEQ ID NO: 110839 - RNA, 64 nt, hsa
auaagagccccuucugcaucuuauucacagcuugcagccucagccccuuugaugaggcccucag

SEQ ID NO: 110840 - RNA, 64 nt, hsa
acucagccucaggauggggaauagccaagaauggcagccucagcgcagaggcaaggucagaaag

SEQ ID NO: 110841 - RNA, 64 nt, hsa
aacagccacuuagugcuuuguccuggacuccacucagccucaggauggggaauagccaagaaug

SEQ ID NO: 110842 - RNA, 64 nt, hsa
ugguuguuuaugcaacucuaucuuaagaacugcccagccucagcugaaaacccgaaucugagaa

SEQ ID NO: 110843 - RNA, 64 nt, hsa
ccuggagaaggcauuccaggguugaaucuugucccagccucagccugggacaccuagguggaga

SEQ ID NO: 110844 - RNA, 64 nt, hsa
ggccucagucuucagauagacaguaagaagaaagcagccucauugauccgcagauguaggggcc

SEQ ID NO: 110845 - RNA, 64 nt, hsa
gcuguguaguccauagcccagccagaugagcuugcagccucauaggaggucagcaccuugcaaa

SEQ ID NO: 110846 - RNA, 64 nt, hsa
uguugcaacucuguguaccaagaaccccuagcaucagccucauuccuaagccaauaacgccugu

SEQ ID NO: 110847 - RNA, 64 nt, hsa
uucaucuucuggugcccacggccauuggcauugccagccucauuccaugccacuaugagucaac

SEQ ID NO: 110848 - RNA, 64 nt, hsa
ccucaucugaaaggcccaaaccagggggaagcaccagccucagugcagcccccuccugacccca

SEQ ID NO: 110849 - RNA, 64 nt, hsa
uggggccauacccaugugucgccucucacucuggcagccucagaggccccuugcugcuggcucc

SEQ ID NO: 110850 - RNA, 64 nt, hsa
ggaaagaugguggaagacauaggcuaaauuucuccagccucacaauggucuucacuuggucuga

SEQ ID NO: 110851 - RNA, 64 nt, hsa
ccuagaagauuccuggauggagaccccauugguucagccucaagucuggcccgucuucgaaaaa

SEQ ID NO: 110852 - RNA, 64 nt, hsa
agcagcgcuuucagcuggaccacucaggccuggacagccucaucuccaugaggcuggugcuucg

SEQ ID NO: 110853 - RNA, 64 nt, hsa
ccuuggccucuucuugcuuugaccuggcagauaucagccucaacauugaguaugcaccucucug

SEQ ID NO: 110854 - RNA, 64 nt, hsa
agagccgugagccaaguaaaccucuuuaauuacccagccucaggugcuccgggaacgccuuccg

SEQ ID NO: 110855 - RNA, 64 nt, hsa
ccucgaagauguuguacuccaccgccugcaccaacagccucaguguuacuucccaggauuugcu

SEQ ID NO: 110856 - RNA, 64 nt, hsa
gcuguaauuaccgagcaaggucugagcucuucuucagccucaguucccucauugguuaaaaggg

SEQ ID NO: 110857 - RNA, 64 nt, hsa
ggcauggguguccacagcacuggcccccucuccccagccucagcugcuguccgccugaucuguc

SEQ ID NO: 110858 - RNA, 50 nt, hsa
agcucguggggauggagugacagccucagucccccucagcacagacaaaa

SEQ ID NO: 110859 - RNA, 64 nt, hsa
gguuucaggccaaaaccagggaagauucuagcuucagccucauguccauuuccagucugucagc

SEQ ID NO: 110860 - RNA, 64 nt, hsa
guuuaugccuucaucagcgugaccccugugccugcagccucauagguguuaaucuguaauuuua

SEQ ID NO: 110861 - RNA, 64 nt, hsa
gcuggagugcaguggugcagucuguagcucacugcagccucaaacuccuaggcucaggcgaucc

SEQ ID NO: 110862 - RNA, 64 nt, hsa
guccucucauccucccgccgcccgucaggccggccagccucacaucagucucuccgccccgggg

SEQ ID NO: 110863 - RNA, 64 nt, hsa
uuccagccaaaguccccccaccccuucagagaagcagccucaaauuccagaaguggaggcucca

SEQ ID NO: 110864 - RNA, 64 nt, hsa
cuugccaccaaccgaaccgugaauguagggcccccagccucaccucugccccaggaccaacaac

SEQ ID NO: 110865 - RNA, 64 nt, hsa
gucauaucacuuugcucuuaccauuccuuuugaucagccucaauucagccucauuguguaguau

SEQ ID NO: 110866 - RNA, 64 nt, hsa
uugcucuuaccauuccuuuugaucagccucaauucagccucauuguguaguauguuuuuucuuu

SEQ ID NO: 110867 - RNA, 64 nt, hsa
cuccugaaccuccuccuccagccucaccuuccuccagccucaccacuccucccuggaccugcag

SEQ ID NO: 110868 - RNA, 61 nt, hsa
uuuaccucagagccuccugaaccuccuccuccagccucaccuuccuccagccucaccacuc

SEQ ID NO: 110869 - RNA, 64 nt, hsa
ggcuggagugcaguggcaugaucauggcucacugcagccucaaccuccagggcuuaagcaaucc

SEQ ID NO: 110870 - RNA, 64 nt, hsa
agcuuuuaaaaaggaaggguagacucacuuagcucagccucacccaugcuaagggcacaugcac

SEQ ID NO: 110871 - RNA, 64 nt, hsa
caagagggccaucagaaggaagccaaagaguucacagccucagcaccaacaacucaacaugguc

SEQ ID NO: 110872 - RNA, 64 nt, hsa
uuuuuauguuuccuaaaggaaauuguuuauucuacagccucaguagguagacacaaacauaaag

SEQ ID NO: 110873 - RNA, 64 nt, hsa
uagggccucucugggcccuacagccucacuuccccagccucaccuugcuguccucugacacugc

SEQ ID NO: 110874 - RNA, 64 nt, hsa
acuguuggaggcacuagggccucucugggcccuacagccucacuuccccagccucaccuugcug

SEQ ID NO: 110875 - RNA, 64 nt, hsa
cauuccucucagcuccgccccauacccgucacuacagccucaccucccaccccugucacuacgg

SEQ ID NO: 110876 - RNA, 64 nt, hsa
gucacuacggccucaccucccaccccugucacuacagccucaccuccuacagccuuaaguccca

SEQ ID NO: 110877 - RNA, 64 nt, hsa
gcugaucuugaacuccugggcucaagcaaucugccagccucagccucucaaagugcugggauua

SEQ ID NO: 110878 - RNA, 64 nt, hsa
ggcuagagugcaguggugcaaucucagcucacugcagccucaacugccccagguuuaagcaauc

SEQ ID NO: 110879 - RNA, 64 nt, hsa
cucucucucuuugcucucuuucucccuccccuaccagccucauucuuccuccgguagccucucc

SEQ ID NO: 110880 - RNA, 64 nt, hsa
ccgguagccucucccaccuaaccucugcaucccccagccucauguccugccccaucccuauccu

SEQ ID NO: 110881 - RNA, 64 nt, hsa
ucccagcaaagcugagacaaaauuggagaagcugcagccucacgcaccaucccccucuuuccac

SEQ ID NO: 110882 - RNA, 55 nt, hsa
agccuauagcccugcuuugagcugucagccucaccugcccuggaaccccggcacc

SEQ ID NO: 110883 - RNA, 64 nt, hsa
uuauuuggagccgggucuagagggaacccucuaucagccucaggaaaacaagaccucugugcac

SEQ ID NO: 110884 - RNA, 64 nt, hsa
ucaccuguuugcauggagaaaugggcuggccccacagccucacaggagcaguuugugggcuggu

SEQ ID NO: 110885 - RNA, 64 nt, hsa
gcccuuuccugcuucucugaaagcacaggucacccagccucagaaucacaccucccggcugcug

SEQ ID NO: 110886 - RNA, 64 nt, hsa
uuagaccucucaacacaguaugccaaguggauuccagccucauggccuagcaaaagaacagacu

SEQ ID NO: 110887 - RNA, 64 nt, hsa
ccucccugcccccaggccccggcauugccaucagcagccucagcgucuccccggccaugugugc

SEQ ID NO: 110888 - RNA, 64 nt, hsa
ccuggggcggcugaugccagggcggcccgcggggcagccucacggaagggcccggugggacgug

SEQ ID NO: 110889 - RNA, 64 nt, hsa
caaggccaggagcgcuggguucugcagcagggcucagccucaggggcguuaagacccuggauga

SEQ ID NO: 110890 - RNA, 64 nt, hsa
gggguggaggugcuccccacaguccgggccaggacagccucaggggagagugaaggccugcagg

SEQ ID NO: 110891 - RNA, 61 nt, hsa
gugacuuacaugggaagugaugccaccagggcagccucaccuccuccccaucaucuugucc

SEQ ID NO: 110892 - RNA, 64 nt, hsa
uccccuucucccagugcguuugacuuugucaggucagccucacuugucccuuucacaguuggcc

SEQ ID NO: 110893 - RNA, 64 nt, hsa
ccaaggugaaacuuagauaucauggacuguuguccagccucaaugcuucauuuuccccuugcau

SEQ ID NO: 110894 - RNA, 64 nt, hsa
acaggagcacuggaggaggagugggcucucugugcagccucacagggcuuugccacggagccac

SEQ ID NO: 110895 - RNA, 64 nt, hsa
gcauccaugucccggagaggggucccucaacagucagccucaccugucagaccgggguucuccc

SEQ ID NO: 110896 - RNA, 64 nt, hsa
aucccuacccccuccaaggggcagguuuccaguccagccucagagaucaggcucugggaccccu

SEQ ID NO: 110897 - RNA, 64 nt, hsa
gugccgaguccuugucccuaccuccagcuuccuccagccucaaaccgccucuggaucuagcugu

SEQ ID NO: 110898 - RNA, 64 nt, hsa
ugagucacggcccagacugggcaccuucgcgucucagccucagggagccccacagccccaagcu

SEQ ID NO: 110899 - RNA, 64 nt, hsa
ugugccaccuuguacaaagccggcugcccagccccagccucaccaccgcaucccaccuccugcc

SEQ ID NO: 110900 - RNA, 64 nt, hsa
agagagcgaugauggacuugagcgccguguucuucagccucagcuggaaggggaaaagucaggg

SEQ ID NO: 110901 - RNA, 64 nt, hsa
cuacagccuuccucaggccccugucucuggcccccagccucagugccucuuggcccagggccag

SEQ ID NO: 110902 - RNA, 64 nt, hsa
uaauuuuaugagggccacgggucuguguucgacucagccucagggacgacucugaccucuuggc

SEQ ID NO: 110903 - RNA, 64 nt, hsa
gacucacuugcccacaccgagggcgaccccgucacagccucaagucacucccaagcccccuccu

SEQ ID NO: 110904 - RNA, 64 nt, hsa
ggcugaagugcgguggugcaaucauggcucacugcagccucaaauuccugggcucaagcgaucc

SEQ ID NO: 110905 - RNA, 64 nt, hsa
cccuggcuaccaggaaacucggagacaaucuuuucagccucagcauuucuggcuggauuuccac

SEQ ID NO: 110906 - RNA, 64 nt, hsa
cccggccacacacagcaagaaagauacaucugaccagccucaacgucaacguauuuccccucuc

SEQ ID NO: 110907 - RNA, 64 nt, hsa
ugccaggacaccacaugggagggggcucaggccucagccucaagaucuucagcuguggccucuc

SEQ ID NO: 110908 - RNA, 64 nt, hsa
cugaacgaggaccuggacucagagccagacagggcagccucagacccuucucuggggcuccugg

SEQ ID NO: 110909 - RNA, 64 nt, hsa
agagacucuugacaccggucucugcugaggcucccagccucaguuucccccacagcagcacggg

SEQ ID NO: 110910 - RNA, 64 nt, hsa
aaggccuugagaggacccugcaggcagucagcaccagccucagcaacugugcagagaccuacag

SEQ ID NO: 110911 - RNA, 64 nt, hsa
ggagggcagucccucagaaucccagaggcagucccagccucagaacccaggauaggaaaugggu

SEQ ID NO: 110912 - RNA, 64 nt, hsa
auacccuagccugaggcuccacuggaagaucucgcagccucaguguaugggaaacccuuucccc

SEQ ID NO: 110913 - RNA, 64 nt, hsa
ugcugugcccccggccaggcccugaggaaaugcucagccucaguggagauggggagguuagaga

SEQ ID NO: 110914 - RNA, 64 nt, hsa
cuucuguugggcccaguggccccugcuauccccacagccucauuccugcagaagguuugugacg

SEQ ID NO: 110915 - RNA, 64 nt, hsa
aggaauccuacuccuaugaccccgaagaugaggccagccucagccucuauggcaaggcccugcu

SEQ ID NO: 110916 - RNA, 64 nt, hsa
acaucuugcugcucucagagccagaaaaugcugacagccucaugcugguggacuucgaguacag

SEQ ID NO: 110917 - RNA, 64 nt, hsa
ccuggcuuggucuggaugggacacugucagaguuuggccacagccuguccuuuacuucauccac

SEQ ID NO: 110918 - RNA, 64 nt, hsa
gggagaggggaagucuuggcagggaaaucccuuuuggccacacaguuuacaaacccaguaucau

SEQ ID NO: 110919 - RNA, 64 nt, hsa
agguguaggguugugagcaaagcuccccuguuuguggccacaccuucccuuuccaaaaaggcua

SEQ ID NO: 110920 - RNA, 64 nt, hsa
cccccaggaaggaguuugagguucauugucauuauggccacaguuuggugcuugugcacgggac

SEQ ID NO: 110921 - RNA, 64 nt, hsa
cucugcagcaagcagggcuucaggaggugcccgcuggccacagccagguuuucccuaagaagau

SEQ ID NO: 110922 - RNA, 64 nt, hsa
agcgcacugggcugccgucuguccccagcucccguggccacacagcuaucuggaggcuuugcag

SEQ ID NO: 110923 - RNA, 64 nt, hsa
ggggugggucauuugagaggaguuccagcuguucuggccacacugggcugguggggaaggagcg

SEQ ID NO: 110924 - RNA, 64 nt, hsa
ggcccauugacagaugagaggucugaagccuuccuggccacaggcaucacuuucuccuccuccu

SEQ ID NO: 110925 - RNA, 64 nt, hsa
augacacaaugccucacucaggccccgggcucccuggccacaagcuuuuucuauccuguuuuca

SEQ ID NO: 110926 - RNA, 64 nt, hsa
gagauggcucuuguucagucaagaccccagacucuggccacaaaaaugccauaaugccuguugg

SEQ ID NO: 110927 - RNA, 64 nt, hsa
gugagccaaugcucaccagccccagagucagagcuggccacaggcuggcagccuccaggggcuu

SEQ ID NO: 110928 - RNA, 64 nt, hsa
gcuaagccauguggcagggaccgucuugcccugcuggccacacucuggagaagcacuucucagc

SEQ ID NO: 110929 - RNA, 61 nt, hsa
uucuugugccuggcagcuaacacgcccgggguggccacagcgccagccucagacuggaggg

SEQ ID NO: 110930 - RNA, 64 nt, hsa
cagccucucagugcccuccagccccgcgaccauguggccacaauccacgcuucuccggaucgcg

SEQ ID NO: 110931 - RNA, 64 nt, hsa
gcaguggccacaaggcugcuuucugcacucucuguggccacaggaacaaagaugcgaguugaag

SEQ ID NO: 110932 - RNA, 64 nt, hsa
cuaaguuagcuuugguagcucuguuggucagcaguggccacaaggcugcuuucugcacucucug

SEQ ID NO: 110933 - RNA, 64 nt, hsa
uaccagcaacuugaacuucaccugcaaagcucuguggccacauuuucagccaaagggaaauaug

SEQ ID NO: 110934 - RNA, 64 nt, hsa
uucauccuggcuggagaauguggagaacuaaagguggccacaaauucuuugacacucaaguccc

SEQ ID NO: 110935 - RNA, 64 nt, hsa
caggaaggucaauauaugccuaacauuucuaaacuggccacauaaccuuagauuuuuaaaggaa

SEQ ID NO: 110936 - RNA, 64 nt, hsa
ucuuccuacaugaucuuuaccuguuguuagacuguggccacagccaguaaaucaggccagagug

SEQ ID NO: 110937 - RNA, 64 nt, hsa
cacacuggaaggaagagccaucguggucuuugucuggccacaggccaggcugcugggcauccuc

SEQ ID NO: 110938 - RNA, 64 nt, hsa
guccaucaccccucccaggccagccucuguaaguuggccacacuuggggagugaguguggguau

SEQ ID NO: 110939 - RNA, 64 nt, hsa
ucccucucuuuggaaaguuuagccuggaagcaguuggccacacuguguggagggcaccucucug

SEQ ID NO: 110940 - RNA, 64 nt, hsa
gggccugcgucccugcacacugcgaggacugccuuggccacaggcccacucccuacgacacgug

SEQ ID NO: 110941 - RNA, 64 nt, hsa
caucaggcacccagguuccuacugucuugccauguggccacaguuagcaacaaaggaggcugua

SEQ ID NO: 110942 - RNA, 64 nt, hsa
uccucuuggaucagucacuguggccaugcauguuuggccacaugauuaauccagucugggucau

SEQ ID NO: 110943 - RNA, 64 nt, hsa
ccacagaugugcuguugguccaggugucccagucuggccacagcccugccuccgcccucaccua

SEQ ID NO: 110944 - RNA, 64 nt, hsa
guagggggugggagcagagccucggugagggucuuggccacagggcagugccuuccugaacgug

SEQ ID NO: 110945 - RNA, 64 nt, hsa
ucuugaaggcuggaggagucagagugagagcuaguggccacagcugcagagcacugcagcuccc

SEQ ID NO: 110946 - RNA, 64 nt, hsa
ccaccccuccccagucaccaguucuccucuggacuggccacacccaccccauuccuggacuccu

SEQ ID NO: 110947 - RNA, 64 nt, hsa
gguggcauuacagggaugagggagucacuguggguggccacagggcuauggccaagcguucccu

SEQ ID NO: 110948 - RNA, 64 nt, hsa
cagugagggucccaguguucccuccacucccgaguggccacaggcucgcgggcugggaaggauu

SEQ ID NO: 110949 - RNA, 64 nt, hsa
aaauguccagcuucucuugaaaacuugguauaucuggccacacugggcucacauucccaagggu

SEQ ID NO: 110950 - RNA, 64 nt, hsa
cauggcccgggccuuauccagucaaagcggaugcuggccacagaaaggccacucaggauguccu

SEQ ID NO: 110951 - RNA, 64 nt, hsa
ugcagcucaccuguggguuuucccuuugagccuuuggccacauccaccucgaggggacccuggc

SEQ ID NO: 110952 - RNA, 64 nt, hsa
accagcuagccuacgcggggauggccgucaguucuggccacaggacccgagucugggcuugggu

SEQ ID NO: 110953 - RNA, 64 nt, hsa
cuuggagaagggcugcuacuuaacaaggaaguccuggccacaggaguccccuacuggcugcaga

SEQ ID NO: 110954 - RNA, 64 nt, hsa
uagaggcagggaaugaagaagguacugugggccauggccacaccugaugcguuuuuggugggcu

SEQ ID NO: 110955 - RNA, 64 nt, hsa
gaccccccagccaaguggcagacgcugguuuugguggccacaggggguggcccgugcgacagag

SEQ ID NO: 110956 - RNA, 64 nt, hsa
ggagguaguaccuuugaagaugcuguugaccaccuggccacagccagucaggggccugguggug

SEQ ID NO: 110957 - RNA, 64 nt, hsa
gggauaauguuggaaagaaagguucugaauccuuuggccacauuuugcccugcuucucucaggg

SEQ ID NO: 110958 - RNA, 64 nt, hsa
auuuggacugcacagagcagcugccgugagcgucuggccacauggagcugcuuucuggggaaca

SEQ ID NO: 110959 - RNA, 64 nt, hsa
gaaacuggagaugucuuguuagcauaagugucuucauucccaccuggaggguuugggagaggag

SEQ ID NO: 110960 - RNA, 64 nt, hsa
accgcugcuccgucccuuuccccagccagacacucauucccauugaccaucuggucccaggagc

SEQ ID NO: 110961 - RNA, 64 nt, hsa
uucuucuaaagaauuuaauucuaaaaguuauagacauucccaaagauauaccugcaagcaucac

SEQ ID NO: 110962 - RNA, 64 nt, hsa
auuggcacaugauucugugccuguuucugggggucauucccaugagaagagcagguagaacuua

SEQ ID NO: 110963 - RNA, 64 nt, hsa
uuuucucuuugcuagaaaaucagcccauagagugcauucccaaauucuaaauagcugacccuaa

SEQ ID NO: 110964 - RNA, 64 nt, hsa
aauauucccucaaaaccuagucaagaaagugccacauucccaccuucuaacagguaauuauuag

SEQ ID NO: 110965 - RNA, 64 nt, hsa
gaaaugcugcuucuucccuacccacuguaacuggcauucccauaguacugagguacuagagacc

SEQ ID NO: 110966 - RNA, 64 nt, hsa
guugccuuucuuucacagagccuucagagggaaacauucccauccauuguuccuggaaagguga

SEQ ID NO: 110967 - RNA, 64 nt, hsa
accugagaguucgaagagggcacauucccaaagacauucccagucaugaaauguagaagacugg

SEQ ID NO: 110968 - RNA, 64 nt, hsa
uuuacauguaagaccugagaguucgaagagggcacauucccaaagacauucccagucaugaaau

SEQ ID NO: 110969 - RNA, 64 nt, hsa
cugugacaauuuaccgaaaugaugaaguaaccaccauucccaccuuucacugccuaggcuccaa

SEQ ID NO: 110970 - RNA, 64 nt, hsa
cucaggauccagccugggcucacccuguguggcucauucccacccaggaaacugaagauaaaag

SEQ ID NO: 110971 - RNA, 64 nt, hsa
cucugacgcuugugacagugccucuuccagugaacauucccagcccagccccgccccgccccgc

SEQ ID NO: 110972 - RNA, 64 nt, hsa
auuugaucauaccuaagagguuaggaaauggugccauucccaccuuagagugcuacauaggugc

SEQ ID NO: 110973 - RNA, 64 nt, hsa
cgaagguuauggucaaucccaaaagucaccacuccauucccaacuagacauuaccaaagugacc

SEQ ID NO: 110974 - RNA, 64 nt, hsa
agauugcuucucauccccagucccaaugcacauccauucccaagaaaugcuuugucuucagccu

SEQ ID NO: 110975 - RNA, 64 nt, hsa
uuggcauuacacucacuccuguucccuuauucuucauucccaguaauucccuaccaaauggugg

SEQ ID NO: 110976 - RNA, 64 nt, hsa
cucacagccaagcugaagcuuggagaaaacucugcauucccaugagggcaaaggcagcugcccu

SEQ ID NO: 110977 - RNA, 64 nt, hsa
caggcagagggaccuugcugcugugugauuggaacauucccaaauaucuugugaauuuguaauc

SEQ ID NO: 110978 - RNA, 64 nt, hsa
ugggcaucccgggugaccuuggcccaucugccugcauucccacccccuugggccuggcuggauc

SEQ ID NO: 110979 - RNA, 64 nt, hsa
gcaggaaaacagagaugguuuaguaaugaauuaucauucccaaacccguguccaccuggaacau

SEQ ID NO: 110980 - RNA, 64 nt, hsa
uucuggauauccuccgugggcgaacugcgagccccauucccagcucuucucccugcugacaucg

SEQ ID NO: 110981 - RNA, 64 nt, hsa; identical to SEQ ID NO: 110917

SEQ ID NO: 110982 - RNA, 64 nt, hsa; identical to SEQ ID NO: 110918

SEQ ID NO: 110983 - RNA, 64 nt, hsa; identical to SEQ ID NO: 110919

SEQ ID NO: 110984 - RNA, 64 nt, hsa; identical to SEQ ID NO: 110920

SEQ ID NO: 110985 - RNA, 64 nt, hsa; identical to SEQ ID NO: 110921

SEQ ID NO: 110986 - RNA, 64 nt, hsa; identical to SEQ ID NO: 110922

SEQ ID NO: 110987 - RNA, 64 nt, hsa; identical to SEQ ID NO: 110923

SEQ ID NO: 110988 - RNA, 64 nt, hsa; identical to SEQ ID NO: 110924

SEQ ID NO: 110989 - RNA, 64 nt, hsa; identical to SEQ ID NO: 110925

SEQ ID NO: 110990 - RNA, 64 nt, hsa; identical to SEQ ID NO: 110926

SEQ ID NO: 110991 - RNA, 64 nt, hsa; identical to SEQ ID NO: 110927

SEQ ID NO: 110992 - RNA, 64 nt, hsa; identical to SEQ ID NO: 110928

SEQ ID NO: 110993 - RNA, 61 nt, hsa; identical to SEQ ID NO: 110929

SEQ ID NO: 110994 - RNA, 64 nt, hsa; identical to SEQ ID NO: 110930

SEQ ID NO: 110995 - RNA, 64 nt, hsa; identical to SEQ ID NO: 110931

SEQ ID NO: 110996 - RNA, 64 nt, hsa; identical to SEQ ID NO: 110932

SEQ ID NO: 110997 - RNA, 64 nt, hsa; identical to SEQ ID NO: 110933

SEQ ID NO: 110998 - RNA, 64 nt, hsa; identical to SEQ ID NO: 110934

SEQ ID NO: 110999 - RNA, 64 nt, hsa; identical to SEQ ID NO: 110935

SEQ ID NO: 111000 - RNA, 64 nt, hsa; identical to SEQ ID NO: 110936

SEQ ID NO: 111001 - RNA, 64 nt, hsa; identical to SEQ ID NO: 110937

SEQ ID NO: 111002 - RNA, 64 nt, hsa; identical to SEQ ID NO: 110938

SEQ ID NO: 111003 - RNA, 64 nt, hsa; identical to SEQ ID NO: 110939

SEQ ID NO: 111004 - RNA, 64 nt, hsa; identical to SEQ ID NO: 110940

SEQ ID NO: 111005 - RNA, 64 nt, hsa; identical to SEQ ID NO: 110941

SEQ ID NO: 111006 - RNA, 64 nt, hsa; identical to SEQ ID NO: 110942

SEQ ID NO: 111007 - RNA, 64 nt, hsa; identical to SEQ ID NO: 110943

SEQ ID NO: 111008 - RNA, 64 nt, hsa; identical to SEQ ID NO: 110944

SEQ ID NO: 111009 - RNA, 64 nt, hsa; identical to SEQ ID NO: 110945

SEQ ID NO: 111010 - RNA, 64 nt, hsa; identical to SEQ ID NO: 110946

SEQ ID NO: 111011 - RNA, 64 nt, hsa; identical to SEQ ID NO: 110947

SEQ ID NO: 111012 - RNA, 64 nt, hsa; identical to SEQ ID NO: 110948

SEQ ID NO: 111013 - RNA, 64 nt, hsa; identical to SEQ ID NO: 110949

SEQ ID NO: 111014 - RNA, 64 nt, hsa; identical to SEQ ID NO: 110950

SEQ ID NO: 111015 - RNA, 64 nt, hsa; identical to SEQ ID NO: 110951

SEQ ID NO: 111016 - RNA, 64 nt, hsa; identical to SEQ ID NO: 110952

SEQ ID NO: 111017 - RNA, 64 nt, hsa; identical to SEQ ID NO: 110953

SEQ ID NO: 111018 - RNA, 64 nt, hsa; identical to SEQ ID NO: 110954

SEQ ID NO: 111019 - RNA, 64 nt, hsa; identical to SEQ ID NO: 110955

SEQ ID NO: 111020 - RNA, 64 nt, hsa; identical to SEQ ID NO: 110956

SEQ ID NO: 111021 - RNA, 64 nt, hsa; identical to SEQ ID NO: 110957

SEQ ID NO: 111022 - RNA, 64 nt, hsa; identical to SEQ ID NO: 110958

SEQ ID NO: 111023 - RNA, 64 nt, hsa; identical to SEQ ID NO: 110959

SEQ ID NO: 111024 - RNA, 64 nt, hsa; identical to SEQ ID NO: 110960

SEQ ID NO: 111025 - RNA, 64 nt, hsa; identical to SEQ ID NO: 110961

SEQ ID NO: 111026 - RNA, 64 nt, hsa; identical to SEQ ID NO: 110962

SEQ ID NO: 111027 - RNA, 64 nt, hsa; identical to SEQ ID NO: 110963

SEQ ID NO: 111028 - RNA, 64 nt, hsa; identical to SEQ ID NO: 110964

SEQ ID NO: 111029 - RNA, 64 nt, hsa; identical to SEQ ID NO: 110965

SEQ ID NO: 111030 - RNA, 64 nt, hsa; identical to SEQ ID NO: 110966

SEQ ID NO: 111031 - RNA, 64 nt, hsa; identical to SEQ ID NO: 110967

SEQ ID NO: 111032 - RNA, 64 nt, hsa; identical to SEQ ID NO: 110968

SEQ ID NO: 111033 - RNA, 64 nt, hsa; identical to SEQ ID NO: 110969

SEQ ID NO: 111034 - RNA, 64 nt, hsa; identical to SEQ ID NO: 110970

SEQ ID NO: 111035 - RNA, 64 nt, hsa; identical to SEQ ID NO: 110971

SEQ ID NO: 111036 - RNA, 64 nt, hsa; identical to SEQ ID NO: 110972

SEQ ID NO: 111037 - RNA, 64 nt, hsa; identical to SEQ ID NO: 110973

SEQ ID NO: 111038 - RNA, 64 nt, hsa; identical to SEQ ID NO: 110974

SEQ ID NO: 111039 - RNA, 64 nt, hsa; identical to SEQ ID NO: 110975

SEQ ID NO: 111040 - RNA, 64 nt, hsa; identical to SEQ ID NO: 110976

SEQ ID NO: 111041 - RNA, 64 nt, hsa; identical to SEQ ID NO: 110977

SEQ ID NO: 111042 - RNA, 64 nt, hsa; identical to SEQ ID NO: 110978

SEQ ID NO: 111043 - RNA, 64 nt, hsa; identical to SEQ ID NO: 110979

SEQ ID NO: 111044 - RNA, 64 nt, hsa; identical to SEQ ID NO: 110980

SEQ ID NO: 111045 - RNA, 64 nt, hsa
ucuucuggagccucugggcagaacccuccaucagaguggaaaucagacgggacccccugcagcu

SEQ ID NO: 111046 - RNA, 64 nt, hsa
cacccucaccucucucccugccuguuuuccccaaaguggaaaggaaggccuuucaaaccagagu

SEQ ID NO: 111047 - RNA, 64 nt, hsa
ccuuggagcaguagaguaccugguagaccauaauaguggaaaagggucuaguuuuccccuuguu

SEQ ID NO: 111048 - RNA, 64 nt, hsa
ugagggucagcuuuuggcuccuucuuccugagacaguggaaacaaugccagcucuguggcuucu

SEQ ID NO: 111049 - RNA, 64 nt, hsa
caugaacaaacucccaugggagccaugccaguguaguggaaaaguaguacauggggagaugggg

SEQ ID NO: 111050 - RNA, 64 nt, hsa
auuauuccuacugggaaaacauaaacauuucucaaguggaaaguaaacaguguuggcacuauuu

SEQ ID NO: 111051 - RNA, 64 nt, hsa
uucucuuaaaagguaucaauguaccuuuuuugguaguggaaaaaaaaaagacaggcugccacag

SEQ ID NO: 111052 - RNA, 64 nt, hsa
guguuacaagacuuguuauccauuuaaaaaugguaguggaaauucuaugccuuggauacacacc

SEQ ID NO: 111053 - RNA, 64 nt, hsa
ugauggguuuaaguaccuugguagggcuggcaccaguggaaacacauacugaagcugccaccac

SEQ ID NO: 111054 - RNA, 64 nt, hsa
aagucccugugcuaaugggauuacaaauacaaaaaguggaaaaaaauuuucguaaacuuuguuu

SEQ ID NO: 111055 - RNA, 64 nt, hsa
gacaucacaaucccauuauucagagcgcguauggaguggaaacgcuuguaggguuucaccaggu

SEQ ID NO: 111056 - RNA, 64 nt, hsa; identical to SEQ ID NO: 111055

SEQ ID NO: 111057 - RNA, 64 nt, hsa
uuguguugacuuuauaaauuucgcuucuuagaacaguggaaacuauguguuuuucucauauuug

SEQ ID NO: 111058 - RNA, 64 nt, hsa
uacucucuuccacauguuacuggauaaauuguuuaguggaaaauaggcuuuuuaaucaugaaua

SEQ ID NO: 111059 - RNA, 64 nt, hsa
cuccuguguugaugccacuucccaggguggagacaguggaaaagaaccgaggacaggaaaggau

SEQ ID NO: 111060 - RNA, 64 nt, hsa
guggcccuucugagucacaucaccgacacugagcaguggaaaggggcuauauguguaugaauag

SEQ ID NO: 111061 - RNA, 64 nt, hsa
aaaucuaaaaauucugguuuuaaauaugagaaucaguggaaaauaaggguauaauuuuguaggu

SEQ ID NO: 111062 - RNA, 64 nt, hsa
uggcggcagcaagagaaaaugagaaagaagcaaaaguggaaaccccuaauaaaccuaucagauc

SEQ ID NO: 111063 - RNA, 64 nt, hsa
uggugguggcaagagaaaaugaagaagaagcaaaaguggaaaccccugauaaacccaucagauc

SEQ ID NO: 111064 - RNA, 64 nt, hsa
uucugaguucuggugagacggagaccccgguggcaguggaaaaaucagaagcacaaaggaaaac

SEQ ID NO: 111065 - RNA, 64 nt, hsa
uuacgacagguuugguuuuuaaauuuuccaaccaaguggaaaggcaaguuggucuuauagaaag

SEQ ID NO: 111066 - RNA, 64 nt, hsa
ugcucucccacaaguccagcugcaacccagagauaguggaaacugaaauuaggaaggaaaucau

SEQ ID NO: 111067 - RNA, 64 nt, hsa
uggugcaaaauuuaaaaagcgcaaauagguaucuaguggaaaaccuaagccucccucucuccuc

SEQ ID NO: 111068 - RNA, 64 nt, hsa
gcuggaagugugacggagcaggcgggcugaggagaguggaaaaggaagcgacccagaaauggca

SEQ ID NO: 111069 - RNA, 64 nt, hsa
agcuugggauuagcuugggagcgcagcgcugcaaaguggaaaauaugaaaagaccacacaggcc

SEQ ID NO: 111070 - RNA, 64 nt, hsa
aaauccaaaccuuccugaacgcuaugacaccaugaguggaaaauuccacaccuaacaaacacau

SEQ ID NO: 111071 - RNA, 64 nt, hsa
uaguuuauguucucagcagccagaguggaaacagaguggaaacacauggagcaucagguagaau

SEQ ID NO: 111072 - RNA, 64 nt, hsa
agggcugggaauaguuuauguucucagcagccagaguggaaacagaguggaaacacauggagca

SEQ ID NO: 111073 - RNA, 64 nt, hsa
uuggggaagggaacauuuucccucauccucugaaaguggaaaccagacugagaugguaaguuaa

SEQ ID NO: 111074 - RNA, 64 nt, hsa
cgguuaaugggucaguucuccuuggaacugaaucaguggaaagagaaugcuucccauagaaagc

SEQ ID NO: 111075 - RNA, 64 nt, hsa
augugucuuugacagcuagugucuaguguaugaaaguggaaaaggacauuucuguaguagcugu

SEQ ID NO: 111076 - RNA, 64 nt, hsa
ugcaguaaaguguauauauuaugcaguuucucuaaguggaaaaacuugacaugacuuuaauagu

SEQ ID NO: 111077 - RNA, 64 nt, hsa
uuagugaugaaacagccaccaccauauugccauuaguggaaaaaaagaggacagugaaccugcc

SEQ ID NO: 111078 - RNA, 64 nt, hsa
auucagagagaacauggguccagaggacauucucaguggaaagaguuugaucugcagcacccag

SEQ ID NO: 111079 - RNA, 64 nt, hsa
uuguggugggugcugugaagaguaaacauuacucaguggaaagcuaaguucagaagguacuuug

SEQ ID NO: 111080 - RNA, 64 nt, hsa
ucacuuuugauugaggcaaagggguccuacuguaaguggaaaagacucacuccccuaacauaag

SEQ ID NO: 111081 - RNA, 64 nt, hsa
auuuuuacagucugaucuuuugacuucuacauauaguggaaaucugccaauacuaauuggugga

SEQ ID NO: 111082 - RNA, 64 nt, hsa
cauguagcaaguguacuuuguggaguguugaguaaguggaaaauggaaagccaguugcauuuag

SEQ ID NO: 111083 - RNA, 64 nt, hsa
uuugcaguguauuuuugcauuuucuaguucugaaaguggaaaaugaaacagucuauaauaaacu

SEQ ID NO: 111084 - RNA, 64 nt, hsa
agaccuauucaggaccauauaguauuucacaaguaguggaaaaccaguuaccucauugcuuacc

SEQ ID NO: 111085 - RNA, 64 nt, hsa
cccagaccuaccaacgaccauaccauauuucaccaguggaaagccaguuaccucaguggcuacc

SEQ ID NO: 111086 - RNA, 62 nt, hsa
ggcuguuucuuuggaucccucugucccagagccacccagaacccugacucuugagaaucaag

SEQ ID NO: 111087 - RNA, 62 nt, hsa
cccagaacccugacucuugagaaucaagaaaacacccagaaaggccuuaaugaccucauagg

SEQ ID NO: 111088 - RNA, 62 nt, hsa
cucucgcuuaacuuccuaggggcugcugagcccacccagagguuguuggaguucagcggggc

SEQ ID NO: 111089 - RNA, 62 nt, hsa
aaacaccucagagggcugcccuccagaggcugcacccagaacagugggacaugagcaggggu

SEQ ID NO: 111090 - RNA, 62 nt, hsa
ccaccgucccucugcagauacacugcucuccccacccagaccugccugucucccacccuuuc

SEQ ID NO: 111091 - RNA, 62 nt, hsa
ggcugaagugcaugggucagggugugaggccacacccagaguagccaugaggaggcagagag

SEQ ID NO: 111092 - RNA, 62 nt, hsa
gcagugagaugagggcugugauuaaggcccaacacccagacuacucuuucggggagcucagc

SEQ ID NO: 111093 - RNA, 62 nt, hsa
gagcugcauauuuuuauggccccaucuucauucacccagaagaaacagagcaugagcccaca

SEQ ID NO: 111094 - RNA, 62 nt, hsa
aggggaaaaugugaagcugaacccccuccagacacccagaauguagcaucugagaaggcccu

SEQ ID NO: 111095 - RNA, 62 nt, hsa
agcagggcugugaugggcgagucccggagccccacccagaccugaaugcuucugagagcaaa

SEQ ID NO: 111096 - RNA, 62 nt, hsa
cgccuuugcugaagucuccccgcagcccucuccacccagaggucucccuauaccgagaccca

SEQ ID NO: 111097 - RNA, 62 nt, hsa
gacagccuccuaggcucccugagguaccuuuccacccagacccuccuuccccaccccauaag

SEQ ID NO: 111098 - RNA, 62 nt, hsa
gaguccccagacagcagaguaugaacugcugacacccagauuccauuaaaaauucugcuaau

SEQ ID NO: 111099 - RNA, 62 nt, hsa
ucagggcagaacuccuguaucagccucauggacacccagaauugguaucucauggcuggaga

SEQ ID NO: 111100 - RNA, 62 nt, hsa
cagagucugggucucacuggccccaagucucccacccagaacucuggccaaaaauggcucuc

SEQ ID NO: 111101 - RNA, 62 nt, hsa
ugacugcuacuuccugucucuguuuccauuaucacccagagagggacaagauaggacauggc

SEQ ID NO: 111102 - RNA, 62 nt, hsa
aggccagaauacuggagaccagcgugaacccucacccagagucaggggaagauuuagaaaca

SEQ ID NO: 111103 - RNA, 62 nt, hsa
gagagcuuucuuguuuguuuucccuccuuuaccacccagaaauccauuugagucugcuccuu

SEQ ID NO: 111104 - RNA, 62 nt, hsa
gagcugggccagggaggacacgcuccacugaccacccagagcugggccagggacucaacaau

SEQ ID NO: 111105 - RNA, 51 nt, hsa
acacggacacgcucugcugaccacccagagcugggccagggaggacacgcu

SEQ ID NO: 111106 - RNA, 62 nt, hsa
gucccuacguuuuacauugauuaaugaauuaucacccagacaugugcagaugaaaugucaau

SEQ ID NO: 111107 - RNA, 62 nt, hsa
ucaugggugugugugcacauguugguuucacucacccagaguaauuuugugagcaugcaugu

SEQ ID NO: 111108 - RNA, 62 nt, hsa
ugagaugacuaggacagucuguacccagaggccacccagaagcccucagauguacauacaca

SEQ ID NO: 111109 - RNA, 62 nt, hsa
gaucccacuguuccucuuugccacagagaaagcacccagacgccacaggcucugucgcauuu

SEQ ID NO: 111110 - RNA, 62 nt, hsa
ccagccacucccgggaccacggcaaaaggaaccacccagacccaccacccguacacccucag

SEQ ID NO: 111111 - RNA, 62 nt, hsa
uuguaaugauguuucuuuggauacugucuagucacccagaaaaauguauggaugaauuuuuu

SEQ ID NO: 111112 - RNA, 62 nt, hsa
cagggguuuggucacaaaggauggacucuucccacccagaggaugcagggaaagcacacugu

SEQ ID NO: 111113 - RNA, 62 nt, hsa
ccucacugcccucaaggacaacagcagggugucacccagagcccgaugaggggugccagcag

SEQ ID NO: 111114 - RNA, 62 nt, hsa
cccugcccugggcuguugagaagagaucaguccacccagaguuagacauuguuuuuguagaa

SEQ ID NO: 111115 - RNA, 62 nt, hsa
gucccaggaaccacaggaagugagcuaaggcucacccagagcagcugggucuccaggcugcc

SEQ ID NO: 111116 - RNA, 62 nt, hsa
cccccaccauaaaucacaucauuagcaugaaccacccagaguggcccaagacucccagauca

SEQ ID NO: 111117 - RNA, 62 nt, hsa
ugguggcacguaagcuccuugucugucuccagcacccagaaucucauuaaagcuuauuuauu

SEQ ID NO: 111118 - RNA, 62 nt, hsa
gguucuccaacagcccagagcucacucuuuuacacccagagguggagcagguggcuuagggg

SEQ ID NO: 111119 - RNA, 62 nt, hsa
agaagcacauuucugccaccuccccugggaggcacccagaagccugccacucuuuaccuagu

SEQ ID NO: 111120 - RNA, 62 nt, hsa
gcagcuuuccucugaaaagcaaccucuccugccacccagaucccaucucaagagcucgccca

SEQ ID NO: 111121 - RNA, 62 nt, hsa
aagccaaggaucauccccuggaacccaguaugcacccagaggggacucagcuucaaagcugc

SEQ ID NO: 111122 - RNA, 64 nt, hsa
aaaucgucugggcacaguggcucacgccuguagucccagcuacuugggaggcugaggcaggaga

SEQ ID NO: 111123 - RNA, 64 nt, hsa
aaauuagccaggcauggugccgcauaacuauaaucccagcuacuugggaggcugaggcaggaga

SEQ ID NO: 111124 - RNA, 64 nt, hsa
aaauuagcugagcaugguggugggcuccuguagucccagcuacuugggaggcugaggcaggaga

SEQ ID NO: 111125 - RNA, 64 nt, hsa
uugugaacccccagcauguguuucugacuuuucucccagcuaccuucucaggugccagcugcug

SEQ ID NO: 111126 - RNA, 64 nt, hsa
aaauuagcugggcgugguggcauaugccuguggucccagcuacucagaaggcaaguggugaugg

SEQ ID NO: 111127 - RNA, 64 nt, hsa
acuuugccauggaggacugagcguugccuuuucucccagcuaccucccaaagcagccugaccug

SEQ ID NO: 111128 - RNA, 64 nt, hsa
uuauuuaaacucacuuaauuaaggaaaauauuuucccagcuagaaaaguauacucauucucauu

SEQ ID NO: 111129 - RNA, 64 nt, hsa
aaauuagccaggcauaguggcgcgcgccuauaaucccagcuacugggaggcugaggcgggagaa

SEQ ID NO: 111130 - RNA, 64 nt, hsa
aaauuggcugggugcggugguacaugccuguagucccagcuacuugggaggcugaggcaggaga

SEQ ID NO: 111131 - RNA, 64 nt, hsa
ggauguucaguggauaucggucacaugccagguccccagcuacgcauucaaggauggauaauau

SEQ ID NO: 111132 - RNA, 64 nt, hsa
aaacuagcugggcgugguggcaggagccuguagucccagcuacucgggaggcugaggcaggaga

SEQ ID NO: 111133 - RNA, 64 nt, hsa
aaauuagccagccaugguggcgggcgccuguaaucccagcuacuugggaggcugaggcaggaga

SEQ ID NO: 111134 - RNA, 64 nt, hsa
aaauuagccaggcguggucgugggcaccuguagucccagcuacucagggggcugaggcaggaga

SEQ ID NO: 111135 - RNA, 64 nt, hsa
aaaaaaaaaaaggcaugguggcacgcacuguagucccagcuacucaggagacugaggcuagaag

SEQ ID NO: 111136 - RNA, 64 nt, hsa
guuggagcugggugcaguggcuugugccuguagucccagcuacuugggaggcugaggcaggagg

SEQ ID NO: 111137 - RNA, 64 nt, hsa
caauuagcugggcaugguggccggcgccuguaaucccagcuacuagggaggcugagacacacga

SEQ ID NO: 111138 - RNA, 64 nt, hsa
ugaguagcugggauuacaggcacccaccacuaugcccagcuaauuuuuuuauuuuuaguagaga

SEQ ID NO: 111139 - RNA, 64 nt, hsa
caaaaagccaagugugguggugugcaccuauagucccagcuacucaggaagcugagacaagagg

SEQ ID NO: 111140 - RNA, 64 nt, hsa
aaauuaccugggccugguggcacacgccuguagucccagcuacuugggaggcugaggcaggaga

SEQ ID NO: 111141 - RNA, 64 nt, hsa
uuuaauuagcugugcgcaauugcucaugcauagucccagcuacccaggaggcugaggugggagg

SEQ ID NO: 111142 - RNA, 64 nt, hsa
aaauuagcugggcaugguggcaugugccuauagucccagcuacucaggaggcugaggcaggaga

SEQ ID NO: 111143 - RNA, 64 nt, hsa
cgaguagcuggaauuauaggcgugcaccaccacgcccagcuaauuuuuguauuuuuaguaaaga

SEQ ID NO: 111144 - RNA, 64 nt, hsa
aaauuagccgagcacgguggugcaugccuguaaucccagcuacuugggaggcugaggcacgaga

SEQ ID NO: 111145 - RNA, 64 nt, hsa
aaauuauccaggcaugguggcguacgccuguagucccagcuacucaggaggcugaggcaggaga

SEQ ID NO: 111146 - RNA, 64 nt, hsa
gaauuagucaggcgugguggugggcgccuguaaucccagcuacucaggaggcugaggcaggaga

SEQ ID NO: 111147 - RNA, 64 nt, hsa
aaauuagcugggcgugguggcgggcaccuguaaucccagcuacuugggagacugaggcaggaga

SEQ ID NO: 111148 - RNA, 64 nt, hsa
aaauuagccaggcgugauggcacgugucuguaaucccagcuacucuggagacugaggugggaga

SEQ ID NO: 111149 - RNA, 64 nt, hsa
caaguagcugggauuacaggcaugcaccaccaugcccagcuaauuuuuguauuuuuaguagaga

SEQ ID NO: 111150 - RNA, 64 nt, hsa
cgaguagcugggauuacaggcaugcgucaccacucccagcuaauuuuguauuuucaguagagac

SEQ ID NO: 111151 - RNA, 64 nt, hsa
aaauuggcuggacaugguggcgcaugucuguaaucccagcuacuguaaucucagcuacuuggga

SEQ ID NO: 111152 - RNA, 64 nt, hsa
aaauuagccaggcaugguggcgugugccaguaaucccagcuacuugggaggcugaggcgcgaga

SEQ ID NO: 111153 - RNA, 64 nt, hsa
aauaaaaagccagacuggugguauguaucugugucccagcuaauugggagggugaguugggagg

SEQ ID NO: 111154 - RNA, 64 nt, hsa
uaauuaguugggcguaguggugcaugccuguaaucccagcuacucuggagacagguggagggga

SEQ ID NO: 111155 - RNA, 64 nt, hsa
ugggauuacaggcgugagccaccgcgccuggccacccagcuaaguuuguauuuuuguuggagac

SEQ ID NO: 111156 - RNA, 64 nt, hsa
cgagcagcugggauuauaggcguccaccaccacgcccagcuaauuuuuguauuuuuaguagaaa

SEQ ID NO: 111157 - RNA, 64 nt, hsa
agaauacccaggugugguagugcaugccuguagucccagcuacuuuggagacugaggugggagu

SEQ ID NO: 111158 - RNA, 64 nt, hsa
aaauuaguugggugugguggcgggugccuguaaucccagcuacucaggaggcugaggcaggaga

SEQ ID NO: 111159 - RNA, 64 nt, hsa
aaauuagccagguguggagguacaugccuguaaucccagcuacucaggaggcugaggcagaaga

SEQ ID NO: 111160 - RNA, 64 nt, hsa
aaauuagccaggcgugguggcacgugccuguagucccagcuacuccggaggcugaggcaggaga

SEQ ID NO: 111161 - RNA, 64 nt, hsa
aaauuagccgggcaugguggcaggugccuguaaucccagcuacucagggggcugaggcagggga

SEQ ID NO: 111162 - RNA, 64 nt, hsa
aaauuagccgggagugguggugcgugccuguagucccagcuacuugggaggcugaggcaggaga

SEQ ID NO: 111163 - RNA, 64 nt, hsa
cgaauagcugggauuacaggcacgccucaccacgcccagcuaauuucuguauuuuuagaagaga

SEQ ID NO: 111164 - RNA, 64 nt, hsa
ugccucagccuccugaguagugugugccaccacgcccagcuaauuuuuuaauuuuuaguagaga

SEQ ID NO: 111165 - RNA, 64 nt, hsa
aaauuagccggguguggugucgggcaccuguagucccagcuacucaggaggcugaggcaggaga

SEQ ID NO: 111166 - RNA, 64 nt, hsa
ucuuuugaccaagaccucaagagagccagaacuacccagcuaagccuuuuacuaaauuucugaa

SEQ ID NO: 111167 - RNA, 64 nt, hsa
aaaaaagccaggcaugguggcacacaccuguaaucccagcuacucgggaggcugaggaaggaga

SEQ ID NO: 111168 - RNA, 64 nt, hsa
aaauuagcugggcaugguggcacacaccuguagucccagcuacuugggaggcugaggcaggaga

SEQ ID NO: 111169 - RNA, 64 nt, hsa
aaauuagcugggcaugacggccagagcccauggucccagcuacucgagaggcugagguaagagc

SEQ ID NO: 111170 - RNA, 64 nt, hsa
caaguagcugggacuacagguguacgccaccacacccagcuaauuuuuguauuuuuaguaggga

SEQ ID NO: 111171 - RNA, 64 nt, hsa
aaaaaauuagccgggcguggugggcacccguaaucccagcuacucaggaggcugaggcaggaga

SEQ ID NO: 111172 - RNA, 64 nt, hsa
aaauuagccaggugugguggcaugugccuguggucccagcuacucaggaggcugaggugggaaa

SEQ ID NO: 111173 - RNA, 64 nt, hsa
agucuuuguaagggcucucugugguuugacuuaccccagcuaccguuaaaugaggacaaaucac

SEQ ID NO: 111174 - RNA, 64 nt, hsa
cucacuauccuguaagguuauccaaguagcuuagcccagcuaaguucuaucagagacccaaauu

SEQ ID NO: 111175 - RNA, 64 nt, hsa
uuaacucccucagcuaaaacuggcauuacugacucccagcuauauuucuccagacuugcauuuu

SEQ ID NO: 111176 - RNA, 64 nt, hsa
aaaguagccagccgugaugacaggcaccuguaaucccagcuacucgggaggcugaggcaugaga

SEQ ID NO: 111177 - RNA, 64 nt, hsa
caaguagcugggacuacaggcaugagccaucacacccagcuaguuuuuuguauuuuuaguaaag

SEQ ID NO: 111178 - RNA, 64 nt, hsa
aaauuagccgggugugguggcgggcgccuguagucccagcuacucuggaggcugaggcaggaga

SEQ ID NO: 111179 - RNA, 64 nt, hsa
caauuuacugggauuacaggcaccugccaccacgcccagcuaauuuuuguauuuuuaguagaga

SEQ ID NO: 111180 - RNA, 64 nt, hsa
caaguagcugggauuacaggcaugugccaccaugcccagcuaauuuuguuuuuuuuuuagucga

SEQ ID NO: 111181 - RNA, 64 nt, hsa
aaaauuagccaggcacguuccaggcaccugugaucccagcuacuuagaggcugaggcagaagaa

SEQ ID NO: 111182 - RNA, 64 nt, hsa
aaauuauccaggcgugguggugcacgccuguaaucccagcuacucaggaggcuaaggcaggaga

SEQ ID NO: 111183 - RNA, 64 nt, hsa
ugaguaguugggauuacaggcgcccaccaccaugcccagcuaauuuuuguguuuuuauuggagg

SEQ ID NO: 111184 - RNA, 64 nt, hsa
ugaguagcugggacuacaggugugcaccaacaugcccagcuaauuuuuuauauuuuuaguagag

SEQ ID NO: 111185 - RNA, 64 nt, hsa
aaauuagccaggcgugguggcacgugccuguaaucccagcuacuugggaggcugaggcaggaga

SEQ ID NO: 111186 - RNA, 64 nt, hsa
ugaguagcugggauuacaggugugcgccaccacgcccagcuaauuuuuuguauuuuuaguagag

SEQ ID NO: 111187 - RNA, 64 nt, hsa
aaauuagcuggguguggugguacauaccuguagucccagcuacucagaaggcugaggugggagg

SEQ ID NO: 111188 - RNA, 64 nt, hsa
cgaguagcugggacuacaggcaccugccaccgcgcccagcuaauuuuuuuguauuuuuaguaga

SEQ ID NO: 111189 - RNA, 64 nt, hsa
aaauuagcugggcguggugguguaccccuguaaucccagcuacucgggaggcugagacaggaga

SEQ ID NO: 111190 - RNA, 64 nt, hsa
cuaguagcugggacuacagggauguaccaccacacccagcuaaucuucaucuaaucuuaaaacu

SEQ ID NO: 111191 - RNA, 64 nt, hsa
aaauuaaccgggcgugguggcaggcaucuauaaucccagcuacuugggaggcugaggcaggaga

SEQ ID NO: 111192 - RNA, 64 nt, hsa
cgaguagcugggauuacaggugcucaccaccacacccagcuaauuuuuguauuuuuaguagaga

SEQ ID NO: 111193 - RNA, 64 nt, hsa
ugaguagcuggaacuacaggugugcgccaccacgcccagcuaauuuuuguaauuuuaguagaga

SEQ ID NO: 111194 - RNA, 64 nt, hsa
aacuuagcuggcauugguggcgcaugccuauagucccagcuacuugggagguugagguaggagg

SEQ ID NO: 111195 - RNA, 64 nt, hsa
aaauuagcugggugugguugcacacgccuguaaucccagcuacucaggaggcugagggaggaga

SEQ ID NO: 111196 - RNA, 64 nt, hsa
caauuagcagggcaugguggugcacgucuguagucccagcuacucaggaggcugaggcagaaga

SEQ ID NO: 111197 - RNA, 64 nt, hsa
uuccaggccuggugugguggcucacgccuguagccccagcuauugcaccacugcucuccaagcu

SEQ ID NO: 111198 - RNA, 64 nt, hsa
aaauuaguuggguguuauggugcaugccuguaaucccagcuacucgggaggcugaggcaggaga

SEQ ID NO: 111199 - RNA, 64 nt, hsa
aaauuagccaggcgugguggugcacaccuguagucccagcuacucgggaggcugagacaggaga

SEQ ID NO: 111200 - RNA, 64 nt, hsa
aaaguagccgggcguggugaugcgugccuguaaucccagcuacccaggaaggcugaggcggcag

SEQ ID NO: 111201 - RNA, 64 nt, hsa
aaccacugucuagagcaacuuuucuuggaacugucccagcuaccaagucagacaccaagguuua

SEQ ID NO: 111202 - RNA, 64 nt, hsa
aaauuagccgggcaugguggcaggcgccuauaaucccagcuacuggggaggcugaggcaggaga

SEQ ID NO: 111203 - RNA, 64 nt, hsa
aaauuagccgagcguagugacgggugcccguaaucccagcuacucaggaggcugagacaggaga

SEQ ID NO: 111204 - RNA, 64 nt, hsa
aaauuagcugggcaugguggggcaugccuguagucccagcuacucagaagggugaggcagaauu

SEQ ID NO: 111205 - RNA, 64 nt, hsa
aaaucagcuggguguggugccgcgugccuguaaucccagcuacuugggaggcugaggcauaaga

SEQ ID NO: 111206 - RNA, 64 nt, hsa
cacuuggcugggcacaguggcacaugccuguaaucccagcuacuuggcaggcugaggugggaga

SEQ ID NO: 111207 - RNA, 64 nt, hsa
cuugaagcugggugugacggugcacaccucuagucccagcuacucgggaggccaagacagaagg

SEQ ID NO: 111208 - RNA, 64 nt, hsa
cgaguagcugggacuaaaggcgugugccaccaugcccagcuaauucuuguauuuuuaguagaga

SEQ ID NO: 111209 - RNA, 64 nt, hsa
aaauuagccgggugucguggcacacaccuguaaucccagcuauuugggaggccaaggcaggaga

SEQ ID NO: 111210 - RNA, 64 nt, hsa
aaacuagcugggggugguggugcaugccuguggucccagcuacuugggaggcuaagguagaaga

SEQ ID NO: 111211 - RNA, 64 nt, hsa
aaauuggcagggugugguggcacaugccuauaaucccagcuacuugggaggcuaaggcaggaga

SEQ ID NO: 111212 - RNA, 64 nt, hsa
aaauuagccagacaugguggcacaugccuuuagucccagcuacucuggaggcugaaguuggagg

SEQ ID NO: 111213 - RNA, 64 nt, hsa
aaauuagcugggcgugguggugggcaccuguagucccagcuacucaggaggcugaggcaggaga

SEQ ID NO: 111214 - RNA, 64 nt, hsa
ccuucugccacgauuguaaguuuccugaggccuucccagcuauguggaacugugaguuaauuaa

SEQ ID NO: 111215 - RNA, 64 nt, hsa
aaauuagcugggcaugguggugcaugccuguaaucccagcuacucgggaggcugaggcaggaga

SEQ ID NO: 111216 - RNA, 64 nt, hsa
aaauuaguugcgugugguggcacaucccuauagucccagcuacuugggaggcugagguggaagg

SEQ ID NO: 111217 - RNA, 64 nt, hsa
aaauuagccgggcaugguggugggcgccuguaaucccagcuacucagaaggcugaggcaggaga

SEQ ID NO: 111218 - RNA, 64 nt, hsa
aaauuagcugggcgugguggugcaugccuguaaucccagcuacucgggaggcugaggcaggaga

SEQ ID NO: 111219 - RNA, 64 nt, hsa
ccuaguagcugggacuacagcacccaccaccacacccagcuaauuuuuguauuuuuaguagaga

SEQ ID NO: 111220 - RNA, 64 nt, hsa
ugaaaagcugggauuacagggcccugccaccaagcccagcuaauuguauuuuuaguagagacag

SEQ ID NO: 111221 - RNA, 64 nt, hsa
caaguagcugggauuacaggcacccgccaccacacccagcuaauuuuuuguauauuuaguagag

SEQ ID NO: 111222 - RNA, 64 nt, hsa
aaauuagcucagugugguggcacacacuuguaaucccagcuacucaggaggcugaggcaugaga

SEQ ID NO: 111223 - RNA, 64 nt, hsa
aaauuagccaggcgugguggcgggcgccuguaaucccagcuacucaggaggcugaggcagcaga

SEQ ID NO: 111224 - RNA, 64 nt, hsa
ucacagaugauaccaacagugaagcuguggaaugcccagcuaguuaaagaaugcaaaggaaaau

SEQ ID NO: 111225 - RNA, 64 nt, hsa
aaauuagccaggcaugguggugggcgccuguagucccagcuacucaggaggcugaggcaggaga

SEQ ID NO: 111226 - RNA, 64 nt, hsa
aaaaauagccagguguggggugcaugccuggaaucccagcuacuugagaggcugaggcacgaga

SEQ ID NO: 111227 - RNA, 64 nt, hsa
aaauuaccugggcaugguggcaggugcuuauaaucccagcuacucugggggccaaggcaggaga

SEQ ID NO: 111228 - RNA, 64 nt, hsa
ggaguagcugggacuacaggugcccaccaccacacccagcuaauuuuuuuguauuuuuaguaga

SEQ ID NO: 111229 - RNA, 64 nt, hsa
aguagccggggagcuacaagcaugcaccaccacacccagcuaauuuuuuuuuuuuuuuugagag

SEQ ID NO: 111230 - RNA, 64 nt, hsa
aaauuaaccaggcaugguggcaugcaccuguagucccagcuacuuggggugcugaggcgggagg

SEQ ID NO: 111231 - RNA, 64 nt, hsa
aaaauagcugggcaugguggcacgcaccucuacucccagcuacuaggaggcugaggcaggagaa

SEQ ID NO: 111232 - RNA, 64 nt, hsa
aaaacagccaagcuuggugguaugugccuguggucccagcuacuggggaggcugaggugggagg

SEQ ID NO: 111233 - RNA, 64 nt, hsa
aaauuagccaggcgugguggugggcaccuguagucccagcuacucaggaggcugaggcaggaga

SEQ ID NO: 111234 - RNA, 64 nt, hsa
gaacuagcugggcaugguggcgcaugcauguagucccagcuacuccugaggcucagucaggaga

SEQ ID NO: 111235 - RNA, 64 nt, hsa
aaauuagccaggcgugguggcgcaugccuguaaucccagcuacucgggaggcugaggcaggaga

SEQ ID NO: 111236 - RNA, 64 nt, hsa
ugguuagccuggugugguggugcacaccuguaaucccagcuacuugggagacugagacaugaga

SEQ ID NO: 111237 - RNA, 64 nt, hsa
caaguaggugggauuacaggcgcccgccaccacgcccagcuaauuuuuguauuuuuaguagaga

SEQ ID NO: 111238 - RNA, 64 nt, hsa
aaauuagccaggcaugguggcgugcgccugcagucccagcuacuugggaggcugaguugggagg

SEQ ID NO: 111239 - RNA, 64 nt, hsa
aaauuagccgggcgugguggcaggcaccuguaaucccagcuacuugggaggcugaggcaggaga

SEQ ID NO: 111240 - RNA, 64 nt, hsa
aaauuagucgggcgugguggugcaugccuguaaucccagcuacuggggaggcugaggcaggaga

SEQ ID NO: 111241 - RNA, 64 nt, hsa
gaucucaggucuaaggcuuccuuucccucccucucccagcuaguuugugcuaauuaagagaccu

SEQ ID NO: 111242 - RNA, 64 nt, hsa
cgaguagcugggauuacaggcaugggccaccacacccagcuaauuuuuuguguuuucuuuuuag

SEQ ID NO: 111243 - RNA, 64 nt, hsa
aaauuagcuggguauguuggugcaggcuugcaaucccagcuacuugggacgcugaggugggagg

SEQ ID NO: 111244 - RNA, 64 nt, hsa
auuuuggcagggugcuguggugcuugcauguagucccagcuauucaggaauauugcuugagucc

SEQ ID NO: 111245 - RNA, 64 nt, hsa
aaaauuagccgggugcaguggugaggccuguaaucccagcuacucaggaggcugaggcaggaga

SEQ ID NO: 111246 - RNA, 64 nt, hsa
aaauuggccgggcaugguggcaugugccuguagucccagcuacuugggaggcugaggcaggaga

SEQ ID NO: 111247 - RNA, 64 nt, hsa
acaaaaauuaggcauaguggugcacgccugcagucccagcuacucaggagguugaggcagaaga

SEQ ID NO: 111248 - RNA, 64 nt, hsa
cauguggcugggacuauaggugcaugccaccacacccagcuaauuaaaaaaauuuuuugugugg

SEQ ID NO: 111249 - RNA, 64 nt, hsa
aaauuagccagacgugguggcaugcgccuguaaucccagcuacucaggaagcugaggcgagaga

SEQ ID NO: 111250 - RNA, 64 nt, hsa
aaauuagcugagcaugguggugugugccuguagucccagcuacuauggagguugaggugggagg

SEQ ID NO: 111251 - RNA, 64 nt, hsa
aaauuagccaggcaugguggcaagcgccuguagucccagcuacucuggaggcugaggcaggaga

SEQ ID NO: 111252 - RNA, 64 nt, hsa
aaauuagcugggcaugguggcgcacaccuguagucccagcuacucuggaggcugaggcagggga

SEQ ID NO: 111253 - RNA, 64 nt, hsa
aaauuagcugggugcaguggcgcaugcuuguaaucccagcuacucaggaggcagaggcaggaga

SEQ ID NO: 111254 - RNA, 64 nt, hsa
aauuuacucaggcaugauggcccauacuuguaaucccagcuauugggaaggaugagaugggagg

SEQ ID NO: 111255 - RNA, 64 nt, hsa
ucagacgggcacagugguggugcccaccugugaucccagcuacucaggaggcugaggcaggaga

SEQ ID NO: 111256 - RNA, 64 nt, hsa
aaauuagcugggcgugguggcgugcaccuguagucccagcuacucaggauccugaggcaugaga

SEQ ID NO: 111257 - RNA, 64 nt, hsa
uuacaaaaauacaaaaauuagcuggacguguagucccagcuacuuaggaggcugaggggcaagg

SEQ ID NO: 111258 - RNA, 64 nt, hsa
ugaauaccugggacuucaggcacgcgccacuacacccagcuaauuuuuaaacuauaauuuuuuu

SEQ ID NO: 111259 - RNA, 64 nt, hsa
aaauuagucggacaugguggcaggcaccuguagucccagcuacucgggaggcugaggcaggaga

SEQ ID NO: 111260 - RNA, 64 nt, hsa
aaauuagcuaggcgggguagugcaugccuguaaucccagcuacucaggaggcugaggccggaga

SEQ ID NO: 111261 - RNA, 64 nt, hsa
acaugccguuucaugucaccugcuacagcucucccccagcuaguaugaugauccuguuuuacaa

SEQ ID NO: 111262 - RNA, 64 nt, hsa
gcauuagccgagccugguggugcgugccuguaaucccagcuacucaggaggcugaggcaggaga

SEQ ID NO: 111263 - RNA, 64 nt, hsa
aaauuagccgggcgugguggcccacgccuguaaucccagcuacucgggaggcuaaggcaggaaa

SEQ ID NO: 111264 - RNA, 64 nt, hsa
aaauuagccgggcgugguagcgggcgccuguagucccagcuacucgggaggcugaggcaggaga

SEQ ID NO: 111265 - RNA, 64 nt, hsa
aaaaaugccaggugugguggggugcaccuguagucccagcuacuagggaggcugagccaggagg

SEQ ID NO: 111266 - RNA, 64 nt, hsa
aaaauuagcuggguguggugacgcuugccuguaucccagcuacucaggaagcugagacacgaga

SEQ ID NO: 111267 - RNA, 64 nt, hsa
aucagggcucagggccuucacuucaagggcccuccccagcuacucgggaggcugaggcaggaga

SEQ ID NO: 111268 - RNA, 64 nt, hsa
aaauuagcugggcaugguugcaggcgccuguagucccagcuacuugggaggcugaggcaggaga

SEQ ID NO: 111269 - RNA, 64 nt, hsa
ggggcuccccaggcccagggcucaacuucauggccccagcuauauccccccaguuccacacuaa

SEQ ID NO: 111270 - RNA, 64 nt, hsa
aacacaucuucaaggcggcagagcugugcgcccacccagcuauugaaaaggacuuucugugggc

SEQ ID NO: 111271 - RNA, 64 nt, hsa
aaauuagccaggcgugguggcaggugccuguaaucccagcuacuugggaggcugaggcaugaga

SEQ ID NO: 111272 - RNA, 64 nt, hsa
aaauuagccgggcaugguggugcaugccuguaaucccagcuacucgggaggcugaggcaggaga

SEQ ID NO: 111273 - RNA, 64 nt, hsa
aaauuagccgggcgugguggcgggcaccuguagucccagcuacucgggaggcugaggcaggaga

SEQ ID NO: 111274 - RNA, 64 nt, hsa
aaaucagcuggguacgguggcacgugccugugaucccagcuacuugggaggcugaggcaggagg

SEQ ID NO: 111275 - RNA, 64 nt, hsa
aaauuagcugggcuugguggcuggcgccuguaaucccagcuacucaggagacugaggcagaagg

SEQ ID NO: 111276 - RNA, 64 nt, hsa
gugguggugggcaccuguacuggggaggugcccacccagcuacuggggaggcugagucaggaga

SEQ ID NO: 111277 - RNA, 64 nt, hsa
acccuccuggggacuacaggugcgugcuaccauacccagcuaauuuaaacaaauuuuuuuuuug

SEQ ID NO: 111278 - RNA, 64 nt, hsa
caaagcgcuaggauuccaggugugagcuacugugcccagcuaaaauagggauuuuuauauuaaa

SEQ ID NO: 111279 - RNA, 64 nt, hsa
agcucugaaaugcgaugugaucuguaccaggucacccagcuaugcugcaaaguggguuggccaa

SEQ ID NO: 111280 - RNA, 64 nt, hsa
ugauuggccgagcaugguggugcacaccaguauucccagcuacucuggaggcugaggcggaggc

SEQ ID NO: 111281 - RNA, 64 nt, hsa
aaauuagccaggcgugguggugcacaccuguaaucccagcuacucgggaggcugaggcaagaga

SEQ ID NO: 111282 - RNA, 64 nt, hsa
cgaguagcuaggauuacaggugcgugccaccacgcccagcuaauuuuuauauguuuaguggaaa

SEQ ID NO: 111283 - RNA, 64 nt, hsa
caccagugugcauacagucauggaguuggguauucccagcuaccagggaggcugaggugggagg

SEQ ID NO: 111284 - RNA, 64 nt, hsa
caaagugcuaggauuccaggcgugagccaucgugcccagcuagacgucuuccuuuuuuuuuuuu

SEQ ID NO: 111285 - RNA, 64 nt, hsa
aaaguagcugggauuacaggcaugcgccaccacacccagcuaauuuuuuguauuugguagagau

SEQ ID NO: 111286 - RNA, 64 nt, hsa
aaauuacccggaugugauggcacaugccuguaaucccagcuacucaggaggcugaggcaggaua

SEQ ID NO: 111287 - RNA, 64 nt, hsa
aaaaguagcagguguggugguaugccccuguagucccagcuacuugggaggcugaggugggaag

SEQ ID NO: 111288 - RNA, 64 nt, hsa
aaauuggcugggcaugguggcgggugccuguaaucccagcuacuggggaggcugaggcaggaga

SEQ ID NO: 111289 - RNA, 64 nt, hsa
aauuagccaggcaugguggugugcaccugagaaucccagcuacucagaagguugagacaaaggg

SEQ ID NO: 111290 - RNA, 64 nt, hsa
aucuucagauuucucuguauuuauuauguguauccccagcuauguaugcagcacagcccaucuc

SEQ ID NO: 111291 - RNA, 64 nt, hsa
uaaguagcugggauuacaggcacccaccaccaugcccagcuaauuuuuguauuuuaguagagac

SEQ ID NO: 111292 - RNA, 64 nt, hsa
aaauuagccgggugcgguggcgggcaccuguagucccagcuacucgggaggcugaggcaggaga

SEQ ID NO: 111293 - RNA, 64 nt, hsa
aaauuagcugagugugguggcacaugccugugaucccagcuacucaggaagcugaggcagaaag

SEQ ID NO: 111294 - RNA, 64 nt, hsa
aaauuagccuggugugguggcgagugccuguaaucccagcuauucaggagggugaggcagaaga

SEQ ID NO: 111295 - RNA, 64 nt, hsa
aaauuagccaggcgugguugugggcgccuguagucccagcuacucaggaggcugaggcaggaga

SEQ ID NO: 111296 - RNA, 64 nt, hsa
agacccagcuaaagucaccugccuguucuaaaggcccagcuacagccaaucagccgauuuccug

SEQ ID NO: 111297 - RNA, 64 nt, hsa
gacccagcuuuauucaccugacuguuuccagagacccagcuaaagucaccugccuguucuaaag

SEQ ID NO: 111298 - RNA, 64 nt, hsa
cuuggacagacuguuucucaguuauuuccagagacccagcuacaguucccuggcuguuucuaga

SEQ ID NO: 111299 - RNA, 64 nt, hsa
uguauccugagguuccuagaucucacugaacuggcccagcuaaggagaccuggacucugggugu

SEQ ID NO: 111300 - RNA, 64 nt, hsa
aagaugguggcuuuaaccugacugucuaaaaauucccagcuaagccuuuuccucuacucucuuc

SEQ ID NO: 111301 - RNA, 64 nt, hsa
aaauuaguuggacaugauggugugcaccuauagucccagcuacucgggaggcugaagcagaagg

SEQ ID NO: 111302 - RNA, 64 nt, hsa
aaauuagccaggcaggguggcaugugccuuuaaucccagcuacagggaggcugaggcaggagaa

SEQ ID NO: 111303 - RNA, 64 nt, hsa
aaauuagccgggugugguggcacaugccuguaaucccagcuacucgggaagcugaggcaggaga

SEQ ID NO: 111304 - RNA, 64 nt, hsa
aaauuaguucaucgggguggcacacaucaguagucccagcuacucugcaggcugaggugggagg

SEQ ID NO: 111305 - RNA, 64 nt, hsa
cgggacuccucccuggggguggggcuccuaccugggggcagaacuccuaccugaaggcagggcu

SEQ ID NO: 111306 - RNA, 64 nt, hsa
gggguuuuaugguggaugaggcuucuuccuggauggggcagagcuucuccugaccagggcaagg

SEQ ID NO: 111307 - RNA, 64 nt, hsa
uauagcuugggucccuuuuccugcaaggccccauggggcagaauauaauaaauauucugaguga

SEQ ID NO: 111308 - RNA, 64 nt, hsa
uugucucuacucccucucuuggaucuggggaggaggggcagagaccugggacucuguauuucua

SEQ ID NO: 111309 - RNA, 64 nt, hsa
agggcugcuggggcuaaagugccuugcugaaggaggggcagaguuaaacauuagccacaauggc

SEQ ID NO: 111310 - RNA, 64 nt, hsa
cacucaacacaccuaagccaguggcccucuaggaggggcagaagagccaaccagaggguuccug

SEQ ID NO: 111311 - RNA, 64 nt, hsa
uggggaagggggacaagggucagucugucgggugggggcagaaaucaaaucagcccaaggauau

SEQ ID NO: 111312 - RNA, 64 nt, hsa
uuccuguauucaggcagcucagagcagaaaguaaggggcagagucauacguguggccaggaagu

SEQ ID NO: 111313 - RNA, 64 nt, hsa
gaaauaaacacauuucuaacaauacaagggaguaggggcagaccuguguugaguauuugugugg

SEQ ID NO: 111314 - RNA, 64 nt, hsa
ugaguacauacugaucuuucauaauccauucagaggggcagauugagaauguuuuacacaugcu

SEQ ID NO: 111315 - RNA, 64 nt, hsa
aggucauacugccaaucuuuagacaaauggccauggggcagaggacaggggagcugagguuggu

SEQ ID NO: 111316 - RNA, 64 nt, hsa
uacuuuugcacuucuccaagugcaggucacaccaggggcagacccugucgcugcguuucugaac

SEQ ID NO: 111317 - RNA, 64 nt, hsa
uuuuuagguguaaaagauggagucccacggaggaggggcagagccaggaggcaguggggcugug

SEQ ID NO: 111318 - RNA, 64 nt, hsa
accuggguacccugguggggaugcagggaaggccggggcagagaaagugaaggucgacccaggg

SEQ ID NO: 111319 - RNA, 64 nt, hsa
ugcuucucaguuuugcuaacagugggagcucaacggggcagagggaggaagguccaugaugcuc
